United States Patent 8,461,315 (MICRORNAS AND USES THEREOF) - sequence listing, part 25

SEQ ID NO: 727301 - RNA, 65 nt, Homo Sapiens; identical to SEQ ID NO: 278026

SEQ ID NO: 727302 - RNA, 65 nt, Homo Sapiens; identical to SEQ ID NO: 278027

SEQ ID NO: 727303 - RNA, 65 nt, Homo Sapiens; identical to SEQ ID NO: 278028

SEQ ID NO: 727304 - RNA, 65 nt, Homo Sapiens; identical to SEQ ID NO: 278029

SEQ ID NO: 727305 - RNA, 65 nt, Homo Sapiens; identical to SEQ ID NO: 278030

SEQ ID NO: 727306 - RNA, 65 nt, Homo Sapiens; identical to SEQ ID NO: 278031

SEQ ID NO: 727307 - RNA, 65 nt, Homo Sapiens; identical to SEQ ID NO: 278032

SEQ ID NO: 727308 - RNA, 65 nt, Homo Sapiens; identical to SEQ ID NO: 278033

SEQ ID NO: 727309 - RNA, 65 nt, Homo Sapiens; identical to SEQ ID NO: 278034

SEQ ID NO: 727310 - RNA, 65 nt, Homo Sapiens; identical to SEQ ID NO: 278035

SEQ ID NO: 727311 - RNA, 65 nt, Homo Sapiens; identical to SEQ ID NO: 278036

SEQ ID NO: 727312 - RNA, 65 nt, Homo Sapiens; identical to SEQ ID NO: 278037

SEQ ID NO: 727313 - RNA, 65 nt, Homo Sapiens; identical to SEQ ID NO: 278038

SEQ ID NO: 727314 - RNA, 65 nt, Homo Sapiens; identical to SEQ ID NO: 278039

SEQ ID NO: 727315 - RNA, 65 nt, Homo Sapiens; identical to SEQ ID NO: 278040

SEQ ID NO: 727316 - RNA, 65 nt, Homo Sapiens; identical to SEQ ID NO: 278041

SEQ ID NO: 727317 - RNA, 65 nt, Homo Sapiens; identical to SEQ ID NO: 278042

SEQ ID NO: 727318 - RNA, 65 nt, Homo Sapiens; identical to SEQ ID NO: 278043

SEQ ID NO: 727319 - RNA, 65 nt, Homo Sapiens; identical to SEQ ID NO: 278044

SEQ ID NO: 727320 - RNA, 65 nt, Homo Sapiens; identical to SEQ ID NO: 278045

SEQ ID NO: 727321 - RNA, 65 nt, Homo Sapiens; identical to SEQ ID NO: 278046

SEQ ID NO: 727322 - RNA, 65 nt, Homo Sapiens; identical to SEQ ID NO: 278047

SEQ ID NO: 727323 - RNA, 65 nt, Homo Sapiens; identical to SEQ ID NO: 278048

SEQ ID NO: 727324 - RNA, 65 nt, Homo Sapiens; identical to SEQ ID NO: 278049

SEQ ID NO: 727325 - RNA, 65 nt, Homo Sapiens; identical to SEQ ID NO: 278050

SEQ ID NO: 727326 - RNA, 65 nt, Homo Sapiens; identical to SEQ ID NO: 278051

SEQ ID NO: 727327 - RNA, 65 nt, Homo Sapiens; identical to SEQ ID NO: 278052

SEQ ID NO: 727328 - RNA, 65 nt, Homo Sapiens; identical to SEQ ID NO: 278053

SEQ ID NO: 727329 - RNA, 65 nt, Homo Sapiens; identical to SEQ ID NO: 278054

SEQ ID NO: 727330 - RNA, 65 nt, Homo Sapiens; identical to SEQ ID NO: 278055

SEQ ID NO: 727331 - RNA, 65 nt, Homo Sapiens; identical to SEQ ID NO: 278056

SEQ ID NO: 727332 - RNA, 65 nt, Homo Sapiens; identical to SEQ ID NO: 278057

SEQ ID NO: 727333 - RNA, 65 nt, Homo Sapiens; identical to SEQ ID NO: 278058

SEQ ID NO: 727334 - RNA, 65 nt, Homo Sapiens; identical to SEQ ID NO: 278059

SEQ ID NO: 727335 - RNA, 65 nt, Homo Sapiens; identical to SEQ ID NO: 278060

SEQ ID NO: 727336 - RNA, 65 nt, Homo Sapiens; identical to SEQ ID NO: 278061

SEQ ID NO: 727337 - RNA, 65 nt, Homo Sapiens; identical to SEQ ID NO: 278062

SEQ ID NO: 727338 - RNA, 65 nt, Homo Sapiens; identical to SEQ ID NO: 278063

SEQ ID NO: 727339 - RNA, 65 nt, Homo Sapiens; identical to SEQ ID NO: 278064

SEQ ID NO: 727340 - RNA, 65 nt, Homo Sapiens; identical to SEQ ID NO: 278065

SEQ ID NO: 727341 - RNA, 65 nt, Homo Sapiens; identical to SEQ ID NO: 278066

SEQ ID NO: 727342 - RNA, 65 nt, Homo Sapiens; identical to SEQ ID NO: 278067

SEQ ID NO: 727343 - RNA, 65 nt, Homo Sapiens; identical to SEQ ID NO: 278068

SEQ ID NO: 727344 - RNA, 65 nt, Homo Sapiens; identical to SEQ ID NO: 278069

SEQ ID NO: 727345 - RNA, 65 nt, Homo Sapiens; identical to SEQ ID NO: 278070

SEQ ID NO: 727346 - RNA, 65 nt, Homo Sapiens; identical to SEQ ID NO: 278071

SEQ ID NO: 727347 - RNA, 65 nt, Homo Sapiens; identical to SEQ ID NO: 278072

SEQ ID NO: 727348 - RNA, 65 nt, Homo Sapiens; identical to SEQ ID NO: 278073

SEQ ID NO: 727349 - RNA, 65 nt, Homo Sapiens; identical to SEQ ID NO: 278074

SEQ ID NO: 727350 - RNA, 65 nt, Homo Sapiens; identical to SEQ ID NO: 278075

SEQ ID NO: 727351 - RNA, 65 nt, Homo Sapiens; identical to SEQ ID NO: 278076

SEQ ID NO: 727352 - RNA, 65 nt, Homo Sapiens; identical to SEQ ID NO: 278077

SEQ ID NO: 727353 - RNA, 65 nt, Homo Sapiens; identical to SEQ ID NO: 278078

SEQ ID NO: 727354 - RNA, 65 nt, Homo Sapiens; identical to SEQ ID NO: 278079

SEQ ID NO: 727355 - RNA, 65 nt, Homo Sapiens; identical to SEQ ID NO: 278080

SEQ ID NO: 727356 - RNA, 65 nt, Homo Sapiens; identical to SEQ ID NO: 278081

SEQ ID NO: 727357 - RNA, 65 nt, Homo Sapiens; identical to SEQ ID NO: 278082

SEQ ID NO: 727358 - RNA, 65 nt, Homo Sapiens; identical to SEQ ID NO: 278083

SEQ ID NO: 727359 - RNA, 65 nt, Homo Sapiens; identical to SEQ ID NO: 278084

SEQ ID NO: 727360 - RNA, 65 nt, Homo Sapiens; identical to SEQ ID NO: 278085

SEQ ID NO: 727361 - RNA, 65 nt, Homo Sapiens; identical to SEQ ID NO: 278086

SEQ ID NO: 727362 - RNA, 65 nt, Homo Sapiens; identical to SEQ ID NO: 278087

SEQ ID NO: 727363 - RNA, 65 nt, Homo Sapiens; identical to SEQ ID NO: 278088

SEQ ID NO: 727364 - RNA, 65 nt, Homo Sapiens; identical to SEQ ID NO: 278089

SEQ ID NO: 727365 - RNA, 65 nt, Homo Sapiens; identical to SEQ ID NO: 278090

SEQ ID NO: 727366 - RNA, 65 nt, Homo Sapiens; identical to SEQ ID NO: 278091

SEQ ID NO: 727367 - RNA, 65 nt, Homo Sapiens; identical to SEQ ID NO: 278092

SEQ ID NO: 727368 - RNA, 65 nt, Homo Sapiens; identical to SEQ ID NO: 278093

SEQ ID NO: 727369 - RNA, 65 nt, Homo Sapiens; identical to SEQ ID NO: 278094

SEQ ID NO: 727370 - RNA, 65 nt, Homo Sapiens; identical to SEQ ID NO: 278095

SEQ ID NO: 727371 - RNA, 65 nt, Homo Sapiens; identical to SEQ ID NO: 278096

SEQ ID NO: 727372 - RNA, 65 nt, Homo Sapiens; identical to SEQ ID NO: 278097

SEQ ID NO: 727373 - RNA, 65 nt, Homo Sapiens; identical to SEQ ID NO: 278098

SEQ ID NO: 727374 - RNA, 65 nt, Homo Sapiens; identical to SEQ ID NO: 278099

SEQ ID NO: 727375 - RNA, 65 nt, Homo Sapiens; identical to SEQ ID NO: 278100

SEQ ID NO: 727376 - RNA, 65 nt, Homo Sapiens; identical to SEQ ID NO: 278101

SEQ ID NO: 727377 - RNA, 65 nt, Homo Sapiens; identical to SEQ ID NO: 278102

SEQ ID NO: 727378 - RNA, 65 nt, Homo Sapiens; identical to SEQ ID NO: 278103

SEQ ID NO: 727379 - RNA, 65 nt, Homo Sapiens; identical to SEQ ID NO: 278104

SEQ ID NO: 727380 - RNA, 65 nt, Homo Sapiens; identical to SEQ ID NO: 278105

SEQ ID NO: 727381 - RNA, 65 nt, Homo Sapiens; identical to SEQ ID NO: 278106

SEQ ID NO: 727382 - RNA, 65 nt, Homo Sapiens; identical to SEQ ID NO: 278107

SEQ ID NO: 727383 - RNA, 65 nt, Homo Sapiens; identical to SEQ ID NO: 278108

SEQ ID NO: 727384 - RNA, 52 nt, Homo Sapiens; identical to SEQ ID NO: 277781

SEQ ID NO: 727385 - RNA, 65 nt, Homo Sapiens; identical to SEQ ID NO: 278110

SEQ ID NO: 727386 - RNA, 65 nt, Homo Sapiens; identical to SEQ ID NO: 278111

SEQ ID NO: 727387 - RNA, 65 nt, Homo Sapiens; identical to SEQ ID NO: 278112

SEQ ID NO: 727388 - RNA, 65 nt, Homo Sapiens; identical to SEQ ID NO: 278113

SEQ ID NO: 727389 - RNA, 65 nt, Homo Sapiens; identical to SEQ ID NO: 278114

SEQ ID NO: 727390 - RNA, 65 nt, Homo Sapiens; identical to SEQ ID NO: 278115

SEQ ID NO: 727391 - RNA, 65 nt, Homo Sapiens; identical to SEQ ID NO: 278116

SEQ ID NO: 727392 - RNA, 65 nt, Homo Sapiens; identical to SEQ ID NO: 278117

SEQ ID NO: 727393 - RNA, 65 nt, Homo Sapiens; identical to SEQ ID NO: 278118

SEQ ID NO: 727394 - RNA, 65 nt, Homo Sapiens; identical to SEQ ID NO: 278119

SEQ ID NO: 727395 - RNA, 65 nt, Homo Sapiens; identical to SEQ ID NO: 278120

SEQ ID NO: 727396 - RNA, 65 nt, Homo Sapiens; identical to SEQ ID NO: 278121

SEQ ID NO: 727397 - RNA, 65 nt, Homo Sapiens; identical to SEQ ID NO: 278122

SEQ ID NO: 727398 - RNA, 65 nt, Homo Sapiens; identical to SEQ ID NO: 278123

SEQ ID NO: 727399 - RNA, 65 nt, Homo Sapiens; identical to SEQ ID NO: 278124

SEQ ID NO: 727400 - RNA, 65 nt, Homo Sapiens; identical to SEQ ID NO: 278125

SEQ ID NO: 727401 - RNA, 65 nt, Homo Sapiens; identical to SEQ ID NO: 278126

SEQ ID NO: 727402 - RNA, 65 nt, Homo Sapiens; identical to SEQ ID NO: 278127

SEQ ID NO: 727403 - RNA, 65 nt, Homo Sapiens; identical to SEQ ID NO: 278128

SEQ ID NO: 727404 - RNA, 65 nt, Homo Sapiens; identical to SEQ ID NO: 278129

SEQ ID NO: 727405 - RNA, 65 nt, Homo Sapiens; identical to SEQ ID NO: 278130

SEQ ID NO: 727406 - RNA, 65 nt, Homo Sapiens; identical to SEQ ID NO: 278131

SEQ ID NO: 727407 - RNA, 65 nt, Homo Sapiens; identical to SEQ ID NO: 278132

SEQ ID NO: 727408 - RNA, 65 nt, Homo Sapiens; identical to SEQ ID NO: 278133

SEQ ID NO: 727409 - RNA, 65 nt, Homo Sapiens; identical to SEQ ID NO: 278134

SEQ ID NO: 727410 - RNA, 65 nt, Homo Sapiens; identical to SEQ ID NO: 278135

SEQ ID NO: 727411 - RNA, 65 nt, Homo Sapiens; identical to SEQ ID NO: 278136

SEQ ID NO: 727412 - RNA, 65 nt, Homo Sapiens; identical to SEQ ID NO: 278137

SEQ ID NO: 727413 - RNA, 65 nt, Homo Sapiens; identical to SEQ ID NO: 278138

SEQ ID NO: 727414 - RNA, 65 nt, Homo Sapiens; identical to SEQ ID NO: 278139

SEQ ID NO: 727415 - RNA, 65 nt, Homo Sapiens; identical to SEQ ID NO: 278140

SEQ ID NO: 727416 - RNA, 65 nt, Homo Sapiens; identical to SEQ ID NO: 278141

SEQ ID NO: 727417 - RNA, 65 nt, Homo Sapiens; identical to SEQ ID NO: 278142

SEQ ID NO: 727418 - RNA, 65 nt, Homo Sapiens; identical to SEQ ID NO: 278143

SEQ ID NO: 727419 - RNA, 65 nt, Homo Sapiens; identical to SEQ ID NO: 278144

SEQ ID NO: 727420 - RNA, 65 nt, Homo Sapiens; identical to SEQ ID NO: 278145

SEQ ID NO: 727421 - RNA, 65 nt, Homo Sapiens; identical to SEQ ID NO: 278146

SEQ ID NO: 727422 - RNA, 65 nt, Homo Sapiens; identical to SEQ ID NO: 278147

SEQ ID NO: 727423 - RNA, 65 nt, Homo Sapiens; identical to SEQ ID NO: 278148

SEQ ID NO: 727424 - RNA, 65 nt, Homo Sapiens; identical to SEQ ID NO: 278149

SEQ ID NO: 727425 - RNA, 65 nt, Homo Sapiens; identical to SEQ ID NO: 278150

SEQ ID NO: 727426 - RNA, 65 nt, Homo Sapiens; identical to SEQ ID NO: 278151

SEQ ID NO: 727427 - RNA, 65 nt, Homo Sapiens; identical to SEQ ID NO: 278152

SEQ ID NO: 727428 - RNA, 65 nt, Homo Sapiens; identical to SEQ ID NO: 278153

SEQ ID NO: 727429 - RNA, 65 nt, Homo Sapiens; identical to SEQ ID NO: 278154

SEQ ID NO: 727430 - RNA, 65 nt, Homo Sapiens; identical to SEQ ID NO: 278155

SEQ ID NO: 727431 - RNA, 65 nt, Homo Sapiens; identical to SEQ ID NO: 278156

SEQ ID NO: 727432 - RNA, 65 nt, Homo Sapiens; identical to SEQ ID NO: 278157

SEQ ID NO: 727433 - RNA, 65 nt, Homo Sapiens; identical to SEQ ID NO: 278158

SEQ ID NO: 727434 - RNA, 65 nt, Homo Sapiens; identical to SEQ ID NO: 278159

SEQ ID NO: 727435 - RNA, 65 nt, Homo Sapiens; identical to SEQ ID NO: 278160

SEQ ID NO: 727436 - RNA, 65 nt, Homo Sapiens; identical to SEQ ID NO: 278161

SEQ ID NO: 727437 - RNA, 65 nt, Homo Sapiens; identical to SEQ ID NO: 278162

SEQ ID NO: 727438 - RNA, 65 nt, Homo Sapiens; identical to SEQ ID NO: 278163

SEQ ID NO: 727439 - RNA, 65 nt, Homo Sapiens; identical to SEQ ID NO: 278164

SEQ ID NO: 727440 - RNA, 65 nt, Homo Sapiens; identical to SEQ ID NO: 278165

SEQ ID NO: 727441 - RNA, 65 nt, Homo Sapiens; identical to SEQ ID NO: 278166

SEQ ID NO: 727442 - RNA, 65 nt, Homo Sapiens; identical to SEQ ID NO: 278167

SEQ ID NO: 727443 - RNA, 65 nt, Homo Sapiens; identical to SEQ ID NO: 278168

SEQ ID NO: 727444 - RNA, 65 nt, Homo Sapiens; identical to SEQ ID NO: 278169

SEQ ID NO: 727445 - RNA, 65 nt, Homo Sapiens; identical to SEQ ID NO: 278170

SEQ ID NO: 727446 - RNA, 65 nt, Homo Sapiens; identical to SEQ ID NO: 278171

SEQ ID NO: 727447 - RNA, 65 nt, Homo Sapiens; identical to SEQ ID NO: 278172

SEQ ID NO: 727448 - RNA, 65 nt, Homo Sapiens; identical to SEQ ID NO: 278173

SEQ ID NO: 727449 - RNA, 65 nt, Homo Sapiens; identical to SEQ ID NO: 278174

SEQ ID NO: 727450 - RNA, 65 nt, Homo Sapiens; identical to SEQ ID NO: 278175

SEQ ID NO: 727451 - RNA, 65 nt, Homo Sapiens; identical to SEQ ID NO: 278176

SEQ ID NO: 727452 - RNA, 65 nt, Homo Sapiens; identical to SEQ ID NO: 278177

SEQ ID NO: 727453 - RNA, 65 nt, Homo Sapiens; identical to SEQ ID NO: 278178

SEQ ID NO: 727454 - RNA, 65 nt, Homo Sapiens; identical to SEQ ID NO: 278179

SEQ ID NO: 727455 - RNA, 65 nt, Homo Sapiens; identical to SEQ ID NO: 278180

SEQ ID NO: 727456 - RNA, 65 nt, Homo Sapiens; identical to SEQ ID NO: 278181

SEQ ID NO: 727457 - RNA, 65 nt, Homo Sapiens; identical to SEQ ID NO: 278182

SEQ ID NO: 727458 - RNA, 65 nt, Homo Sapiens; identical to SEQ ID NO: 278183

SEQ ID NO: 727459 - RNA, 65 nt, Homo Sapiens; identical to SEQ ID NO: 278184

SEQ ID NO: 727460 - RNA, 65 nt, Homo Sapiens; identical to SEQ ID NO: 278185

SEQ ID NO: 727461 - RNA, 65 nt, Homo Sapiens; identical to SEQ ID NO: 278186

SEQ ID NO: 727462 - RNA, 65 nt, Homo Sapiens; identical to SEQ ID NO: 278187

SEQ ID NO: 727463 - RNA, 65 nt, Homo Sapiens; identical to SEQ ID NO: 278188

SEQ ID NO: 727464 - RNA, 65 nt, Homo Sapiens; identical to SEQ ID NO: 278189

SEQ ID NO: 727465 - RNA, 65 nt, Homo Sapiens; identical to SEQ ID NO: 278190

SEQ ID NO: 727466 - RNA, 65 nt, Homo Sapiens; identical to SEQ ID NO: 278191

SEQ ID NO: 727467 - RNA, 65 nt, Homo Sapiens; identical to SEQ ID NO: 278192

SEQ ID NO: 727468 - RNA, 65 nt, Homo Sapiens; identical to SEQ ID NO: 278193

SEQ ID NO: 727469 - RNA, 65 nt, Homo Sapiens; identical to SEQ ID NO: 278194

SEQ ID NO: 727470 - RNA, 65 nt, Homo Sapiens; identical to SEQ ID NO: 278195

SEQ ID NO: 727471 - RNA, 65 nt, Homo Sapiens; identical to SEQ ID NO: 278196

SEQ ID NO: 727472 - RNA, 65 nt, Homo Sapiens; identical to SEQ ID NO: 278197

SEQ ID NO: 727473 - RNA, 63 nt, Homo Sapiens
ccuagaugacugccugugcagagacacaguuugcaccauuagccuuaccugcccugcccugau

SEQ ID NO: 727474 - RNA, 63 nt, Homo Sapiens
ggauguuuccaccuccuucuccaaccucuaccccaccauuaguguauuuuacuauaaaaacag

SEQ ID NO: 727475 - RNA, 63 nt, Homo Sapiens
ccgggaggcggagguugcagugagcugagaucgcaccauuacacuccagccugggcaacagag

SEQ ID NO: 727476 - RNA, 63 nt, Homo Sapiens
ccuucaaguccuuuccaccucucacccauugcccaccauuaauaagcuuagcuucucuugcca

SEQ ID NO: 727477 - RNA, 63 nt, Homo Sapiens
ugucacuccucugcucagaaaccuucaaugguucaccauuaccaguggaaugaagucaauucu

SEQ ID NO: 727478 - RNA, 63 nt, Homo Sapiens
aacuuccucccucuaugcccaccccugacacuucaccauuaaucuuaacacagaacaugaggu

SEQ ID NO: 727479 - RNA, 63 nt, Homo Sapiens
uauggcuguauuugcuguugauucagacuuucacaccauuaauggggaaaagcguggccacaa

SEQ ID NO: 727480 - RNA, 63 nt, Homo Sapiens
gaaugccacuuuggcugaacuacaaguguaggccaccauuauaauuuauaaauacagcauacu

SEQ ID NO: 727481 - RNA, 63 nt, Homo Sapiens
uucuauuguuuauauuguuaaaaugagcuugugcaccauuagguccugcuggguguucucagu

SEQ ID NO: 727482 - RNA, 63 nt, Homo Sapiens
uguuugcaucugcagucuauuaaacauuuuguucaccauuaaaaugucaaagaaaaauugaga

SEQ ID NO: 727483 - RNA, 63 nt, Homo Sapiens
agaaaugcuuccagucacaaauagugcuuaauucaccauuauggggauugacuuuauuuuuuu

SEQ ID NO: 727484 - RNA, 63 nt, Homo Sapiens
ccacuaugaucaaguuggggcauccacaaagcacaccauuaaucuggugucauugacuaacca

SEQ ID NO: 727485 - RNA, 63 nt, Homo Sapiens
auaucaggacugguuacuugcuaguuuguccaacaccauuaugcaucugcgggcagagaaggu

SEQ ID NO: 727486 - RNA, 63 nt, Homo Sapiens
cacggggugggggugagggcggcugggcuuggccaccauuaaauuagucugcccaccuuucua

SEQ ID NO: 727487 - RNA, 63 nt, Homo Sapiens
cugcccaccuuucuaggcugcucaggcuauucccaccauuaguugaaugaauggccuucccuu

SEQ ID NO: 727488 - RNA, 63 nt, Homo Sapiens
uucuaguuggcauaaaaacacuacaguaaaccccaccauuaccaaagacccuucgguguccau

SEQ ID NO: 727489 - RNA, 63 nt, Homo Sapiens
ggacauuuagcgugaugaaaggauugaagaauucaccauuagaugucucuagaagagaaugaa

SEQ ID NO: 727490 - RNA, 63 nt, Homo Sapiens
caucauauagaccucugcccuucagaguagccucaccauuaguggcagcaucauguaacugag

SEQ ID NO: 727491 - RNA, 63 nt, Homo Sapiens
ugggcuugcuauucugucccuagguguuuuguucaccauuauaaugaauuuagugagcauagg

SEQ ID NO: 727492 - RNA, 63 nt, Homo Sapiens
gcugcuaauaugcuacuuaaccaucuauuaaugcaccauuaaaggcuuagcauuuaaguagca

SEQ ID NO: 727493 - RNA, 63 nt, Homo Sapiens
uuagaaaccagaaugcuuuguuuuuaccagauucaccauuagagguugauggggcaacugcag

SEQ ID NO: 727494 - RNA, 63 nt, Homo Sapiens
gcaaaauuacacaagaaaacaguauugcaaugacaccauuacauaaggaacauugaacuguua

SEQ ID NO: 727495 - RNA, 63 nt, Homo Sapiens
aauuaauugcuggagacuacaauuccuggcaaacaccauuauuccagaugcaccaugcuaccc

SEQ ID NO: 727496 - RNA, 63 nt, Homo Sapiens
uagguauuaauagauauguaaagaaagaaaucacaccauuaauaaugguaagauugguuuaug

SEQ ID NO: 727497 - RNA, 63 nt, Homo Sapiens
ccuuucaaacauccccaaagucauggccauacucaccauuagccaguuucuaacaucuguuuc

SEQ ID NO: 727498 - RNA, 63 nt, Homo Sapiens
aaaauaauaaaaaucacuuuacuuauacugggacaccauuaccaaaaaaaauuguaucucauu

SEQ ID NO: 727499 - RNA, 63 nt, Homo Sapiens
aauugccacaauuacuuuuaucuuuuuuuuugccaccauuauaaauuauuucaguuggguuuu

SEQ ID NO: 727500 - RNA, 63 nt, Homo Sapiens
aucaccaguauuguggcugggauaacugacuagcaccauuauggguaaacacucgauaaucug

SEQ ID NO: 727501 - RNA, 63 nt, Homo Sapiens
ucacugaacaaugagacaaucagcccaccagcccaccauuaacuaucuacucacucauacagc

SEQ ID NO: 727502 - RNA, 63 nt, Homo Sapiens
accagaccagcuuuguuuugcuguuuuggaaaacaccauuagaauaguagcgaggaggauuuu

SEQ ID NO: 727503 - RNA, 63 nt, Homo Sapiens
ccagacaccgcuguggagauccacggugggggacaccauuagugucuuuagcucacauacauu

SEQ ID NO: 727504 - RNA, 63 nt, Homo Sapiens
gaagggauauuuaaacuugcuacuguuguucaacaccauuaauggucagugugaaccauuaca

SEQ ID NO: 727505 - RNA, 63 nt, Homo Sapiens
acaaaacacuccaaguuucagcaguuuuagcgccaccauuaacccacuuugcuugucucauga

SEQ ID NO: 727506 - RNA, 63 nt, Homo Sapiens
gaauagaaggugaguucuggaagugcaaagaagcaccauuaagugcaucuucuagaaguugua

SEQ ID NO: 727507 - RNA, 63 nt, Homo Sapiens
aacacuauuagauaauaagugcuuauuguuuaacaccauuaauuuugaguauaauuuguuaca

SEQ ID NO: 727508 - RNA, 63 nt, Homo Sapiens
uuucucucuauaaguuucugucauugaacagaucaccauuaaaaagaauauuagaauccagca

SEQ ID NO: 727509 - RNA, 63 nt, Homo Sapiens
ggcacaaccaugaauaaaaauacaauucucuugcaccauuaaauaguguguuaagugcuacgg

SEQ ID NO: 727510 - RNA, 63 nt, Homo Sapiens
aguaaaacaaagaaguuuaaagacuggcagguacaccauuaucacauaagugcugucaguaua

SEQ ID NO: 727511 - RNA, 63 nt, Homo Sapiens
uaagucaaaaaauuaauacaccaaggauaucggcaccauuacacaaaaugccauuaagugaag

SEQ ID NO: 727512 - RNA, 63 nt, Homo Sapiens
gaaagccguacugaucaguuccuacuuguucaucaccauuauuacaaggggaagugguguuua

SEQ ID NO: 727513 - RNA, 63 nt, Homo Sapiens
aguuuggcgauuugaugguaugccuuguuuguucaccauuauuauacaaagagcggagaauuc

SEQ ID NO: 727514 - RNA, 63 nt, Homo Sapiens
guuuuauuuuuaaauuuucagaauagauuuauacaccauuauuuagucaggaaaaacauucag

SEQ ID NO: 727515 - RNA, 63 nt, Homo Sapiens
aagccacuuugcuuacaccuuaggaggcacaagcaccauuauucacauuacaauaauauacca

SEQ ID NO: 727516 - RNA, 63 nt, Homo Sapiens
aucuauaucuacuuuguguuauaccagauuagccaccauuagcaacaguuugcuauaagaaac

SEQ ID NO: 727517 - RNA, 63 nt, Homo Sapiens
uucuguuugcaggauuuuuuucuggaauugacacaccauuacauuuuguauuuuauuugggca

SEQ ID NO: 727518 - RNA, 63 nt, Homo Sapiens
caggucugacugaccaccagguggcagaauuggcaccauuaccgucacuugauuugcuagcug

SEQ ID NO: 727519 - RNA, 63 nt, Homo Sapiens
auuuuaacaguaggaauuuaauguuaauuuuugcaccauuaauuuagcaaaggccaucuacaa

SEQ ID NO: 727520 - RNA, 63 nt, Homo Sapiens
auaauggcucguguuuauguugaagauaaauagcaccauuauugggggaaguuauucaaaagc

SEQ ID NO: 727521 - RNA, 63 nt, Homo Sapiens
ccaagaguauacuccaccgagaaccaccagccacaccauuauaccagaaggcggaucccccaa

SEQ ID NO: 727522 - RNA, 63 nt, Homo Sapiens
uuccacgcugcaguuuuuauuaaaugcguaauacaccauuaauguuccugccuaucuggaguu

SEQ ID NO: 727523 - RNA, 63 nt, Homo Sapiens
uuaaaauuucacucuggcauaugauuuaucuaucaccauuacuuuuuuuuaagucacaauuuc

SEQ ID NO: 727524 - RNA, 63 nt, Homo Sapiens
uuaaccacaaaauacagcaagugcaccuauauucaccauuaacuuauaucccaaguccauuuu

SEQ ID NO: 727525 - RNA, 63 nt, Homo Sapiens
ugaauaaaauaauuguaaugagugcuaaaugggcaccauuauucgaaucagauaccuuuuaua

SEQ ID NO: 727526 - RNA, 63 nt, Homo Sapiens
auaacuuuaccaacauuggaaaacagccaacuacaccauuaguaauauauuugauuacauuuu

SEQ ID NO: 727527 - RNA, 63 nt, Homo Sapiens
cagaauagaaccacugguuaaacauauuuuauucaccauuaagugaucuuuaucaauauucug

SEQ ID NO: 727528 - RNA, 63 nt, Homo Sapiens
agaucuggaauggucgccaugauugaaaccacgcaccauuacaucaucauuacauuaauuaca

SEQ ID NO: 727529 - RNA, 63 nt, Homo Sapiens
aaaagguaaauuggauauaaguaaauuugauuucaccauuaagucuuacucauuugcuagguu

SEQ ID NO: 727530 - RNA, 63 nt, Homo Sapiens
cacccccguuccccugagguaucgcaguguggacaccauuaccuuggcagacugguguuguuc

SEQ ID NO: 727531 - RNA, 63 nt, Homo Sapiens
agcaccagacugagcagcuauuuugaucacuaccaccauuaucaaugaccugugguuuaaccc

SEQ ID NO: 727532 - RNA, 63 nt, Homo Sapiens
uuagaucgggucucggaagggaaguagccaucacaccauuaaaaagccuguggaccuuuuucu

SEQ ID NO: 727533 - RNA, 63 nt, Homo Sapiens
cacugagucugcccugggcucugauaaaaccuucaccauuaacuugcugugugaccuugggca

SEQ ID NO: 727534 - RNA, 63 nt, Homo Sapiens
aagcaaagaccauuugauaaaagccugaguugucaccauuaugucuuaagcuguuagucuuaa

SEQ ID NO: 727535 - RNA, 63 nt, Homo Sapiens
cgaagggaaggugcuguacaguucauuccuuugcaccauuagccaaucugucuuuuauggauu

SEQ ID NO: 727536 - RNA, 63 nt, Homo Sapiens
ccucaaagacuugaucggagaauacucuuguuucaccauuauguugguacaguauaguaccau

SEQ ID NO: 727537 - RNA, 63 nt, Homo Sapiens
ccaucaccuuaaccaagugacaaaguccuagcacaccauuaaugguaggauaacugacauuaa

SEQ ID NO: 727538 - RNA, 63 nt, Homo Sapiens
ugcgcugauaagcguucaugaccucuuugucuacaccauuaugggugaauggcuuuguauaga

SEQ ID NO: 727539 - RNA, 63 nt, Homo Sapiens
agaauugcagcuuugugcccacguuacugucaucaccauuaaaacugcuuguguaucagacuu

SEQ ID NO: 727540 - RNA, 63 nt, Homo Sapiens
ucucuacucccucuugucaguguagacacaggucaccauuaugcugguguauguuuaucaaag

SEQ ID NO: 727541 - RNA, 63 nt, Homo Sapiens
uaauaauaauaaaaugaaagaaacaaucaccaccaccauuauuaaacuguaacuugucuagua

SEQ ID NO: 727542 - RNA, 63 nt, Homo Sapiens
uuccccuacccccaaggaugccaggaagacguccaccauuagccauguggcaaccuuuacuuc

SEQ ID NO: 727543 - RNA, 63 nt, Homo Sapiens
uucugauaucuaguacacaggagacuuuucuuucaccauuacuucauguccuuuuaugcugua

SEQ ID NO: 727544 - RNA, 63 nt, Homo Sapiens
uuuacuaaucacauguucugggcugauguccugcaccauuaugaccugggaauaacauuagca

SEQ ID NO: 727545 - RNA, 63 nt, Homo Sapiens
cucucacaaugauuuuaugucaagaauguuuuucaccauuauuagaagauggagacucuuagg

SEQ ID NO: 727546 - RNA, 63 nt, Homo Sapiens
uccuccugagcucugauaaccacccccaguuagcaccauuaacucucauaggacuaucuccac

SEQ ID NO: 727547 - RNA, 63 nt, Homo Sapiens
uccuccugagcucugauaagcacccccaguuagcaccauuaacucucacgggacuauuuccac

SEQ ID NO: 727548 - RNA, 63 nt, Homo Sapiens
uuggcuguuucaucucuaaguuugggcugaaaccaccauuacuccagccuggcagcccagcgu

SEQ ID NO: 727549 - RNA, 63 nt, Homo Sapiens
auacaacauucuagaagucuauugauucagguacaccauuaaguuuugcauucuauugcuagu

SEQ ID NO: 727550 - RNA, 63 nt, Homo Sapiens
aaaacacuuauaguaaaugguuuauuuaggaaacaccauuauauuaguguacauuuauguucc

SEQ ID NO: 727551 - RNA, 63 nt, Homo Sapiens
aggaugagagaagcaagagccauacccuaacaucaccauuaaaagcaggaaagaucaaaaacg

SEQ ID NO: 727552 - RNA, 63 nt, Homo Sapiens
cccagcaccuuaccccaggacuuggucuucaaccaccauuaccccucuaacuuugcacaaaua

SEQ ID NO: 727553 - RNA, 63 nt, Homo Sapiens
acaagagaacugucucauagucauggaaugcaucaccauuaagacaaaagcaauguguucaug

SEQ ID NO: 727554 - RNA, 63 nt, Homo Sapiens
gugcgacagaaugcaguuagaaucaguucauaucaccauuaaaaucauccauucagaaaccaa

SEQ ID NO: 727555 - RNA, 63 nt, Homo Sapiens
gcugaagaaauccaaggauacagucucagaggacaccauuaggcuaauagagaaacagguacu

SEQ ID NO: 727556 - RNA, 63 nt, Homo Sapiens
cuaccuucccuccuggaaccacacuacuugaaucaccauuacuuugccucgcuggcagaguug

SEQ ID NO: 727557 - RNA, 63 nt, Homo Sapiens
agcuauaagguucagaaucauucuaauaguuggcaccauuauaacugaauuagauuuucccau

SEQ ID NO: 727558 - RNA, 63 nt, Homo Sapiens
acauccaucccccuagcucaguauuugugaucucaccauuaugucaggaaagcuuucacacug

SEQ ID NO: 727559 - RNA, 63 nt, Homo Sapiens
aaucaacgcuuucucugauuagguaguuuaaaucaccauuaaagcacacacacagaaaccacg

SEQ ID NO: 727560 - RNA, 63 nt, Homo Sapiens
uacacagacacacacagaaacgccacagagacacaccauuacaaaucacacgcagccccuccc

SEQ ID NO: 727561 - RNA, 63 nt, Homo Sapiens
cacacauacacagaaagacaggccacagaaacacaccauuacaaaucgcagauacgcccuucc

SEQ ID NO: 727562 - RNA, 63 nt, Homo Sapiens
uacacagacacgcaaucgcacgccacagagacacaccauuacaaaucacacacacacccuccc

SEQ ID NO: 727563 - RNA, 63 nt, Homo Sapiens
uacacagacacacacagaaacccgccacagagacaccauuacaaaaaucacacacacacccuc

SEQ ID NO: 727564 - RNA, 63 nt, Homo Sapiens
uacacagacacacacagaaacccaccacagagacaccauuacacaaaucacacacacccccuc

SEQ ID NO: 727565 - RNA, 63 nt, Homo Sapiens
gugaaaaucagaucuauuuuguuugccauuagucaccauuaguuauauaaauuuuauuguuuu

SEQ ID NO: 727566 - RNA, 63 nt, Homo Sapiens
cccuagcagacuuuuacuucucuuacacugcuacaccauuacuuucuugagacauuuguaagu

SEQ ID NO: 727567 - RNA, 59 nt, Homo Sapiens
accugaacccuauauuuuaacauagaggucaccauuauccauuuaauggucuuauaacu

SEQ ID NO: 727568 - RNA, 63 nt, Homo Sapiens
gcuuuuugaggcucgccaggucccuuuuguuuucaccauuaaaauuccaaacccaaagccuuu

SEQ ID NO: 727569 - RNA, 63 nt, Homo Sapiens
uacaguagccaaaagguagaccagcguuuauaacaccauuauucuugaacagauauuuguaca

SEQ ID NO: 727570 - RNA, 63 nt, Homo Sapiens
caagauugggacucgcuuccgauuacucaagcucaccauuauuccuuuaaauuguaaauuaag

SEQ ID NO: 727571 - RNA, 63 nt, Homo Sapiens
uacuucaauuuguuaccacaacuugcugaaauacaccauuauuauuuguuguaugcaauacug

SEQ ID NO: 727572 - RNA, 63 nt, Homo Sapiens
uaugauuguuauuauuuguccaaucaagcaaagcaccauuauuucuaacauauaaaagaccag

SEQ ID NO: 727573 - RNA, 63 nt, Homo Sapiens
aauguggacaugaagauugggguguaacaccuacaccauuaucuuggaaagaaacaaccguug

SEQ ID NO: 727574 - RNA, 63 nt, Homo Sapiens
gcccagcuacuccuuuaccugugagaagaucuucaccauuaggaagaucucuagacccccaga

SEQ ID NO: 727575 - RNA, 63 nt, Homo Sapiens
ggccgugauacauuuuuuaauucauuuguuuuccaccauuauauuuuuauacuuuucaguuag

SEQ ID NO: 727576 - RNA, 63 nt, Homo Sapiens
ucuuuuccugaaacuuuuuaugaauggcuauggcaccauuaaugcugcugaauaucuuuaaac

SEQ ID NO: 727577 - RNA, 63 nt, Homo Sapiens
ugucuucucuacauggcauaaagcggcaaagcccaccauuaggugaggcggucccgaguugag

SEQ ID NO: 727578 - RNA, 63 nt, Homo Sapiens
ugggcuuucccaauaggccaacagucuucaggacaccauuagagugaggaugaugaaguagau

SEQ ID NO: 727579 - RNA, 63 nt, Homo Sapiens
uuagaauaaauuuccagaacuuguacagaaaggcaccauuauguuaugauaugguacaguucu

SEQ ID NO: 727580 - RNA, 63 nt, Homo Sapiens
gcccugccucauaacuaaauaacuaaaagauuucaccauuacaauauuuguggaaucagauaa

SEQ ID NO: 727581 - RNA, 63 nt, Homo Sapiens
cucagacagaaugcuucagggucuggcuagagccaccauuagaagccagccacauuucccugu

SEQ ID NO: 727582 - RNA, 63 nt, Homo Sapiens
uuuucuuaccuaauauacugcucugcaguuagacaccauuauuauccaaaucaacacaaugca

SEQ ID NO: 727583 - RNA, 63 nt, Homo Sapiens
aggcugguugggaccucuacagcuucauucuuucaccauuaaauaguggccuuuuucaguauu

SEQ ID NO: 727584 - RNA, 63 nt, Homo Sapiens
uucuacucaaacacuaaucccccauucucuaaucaccauuauuaaucauaucaagucaauuag

SEQ ID NO: 727585 - RNA, 63 nt, Homo Sapiens
uugaacugauaguuacuguugugaccugaaguucaccauuaaaagggauuacccaagcaaaau

SEQ ID NO: 727586 - RNA, 63 nt, Homo Sapiens
gucuugcauggacauuugugauucucauuuucucaccauuaaauuaccuuggaggguagggcu

SEQ ID NO: 727587 - RNA, 63 nt, Homo Sapiens
auugccuggcauuugguaguauaguaugauucucaccauuauuugucauggaggcagacauac

SEQ ID NO: 727588 - RNA, 63 nt, Homo Sapiens
aggggaagaaaaagcuauuguuuacaauuauaucaccauuaaggcaacugcuacacccugcuu

SEQ ID NO: 727589 - RNA, 63 nt, Homo Sapiens
uuugugaacgcuucugccacaacccugcucagacaccauuacuaacuccuaugcaucccuuag

SEQ ID NO: 727590 - RNA, 63 nt, Homo Sapiens
ucauucauguaguuuauucaauacgaugcagcccaccauuaacagucagaaaacacaccugga

SEQ ID NO: 727591 - RNA, 63 nt, Homo Sapiens
uaaaagaugauugauuauuguccauuuaaacgucaccauuacugaauuaggagcauaguuuuu

SEQ ID NO: 727592 - RNA, 63 nt, Homo Sapiens
uguuuaaaggauccauuuaguuuauaguauaaucaccauuaucgaaucaggaaacuuuaguua

SEQ ID NO: 727593 - RNA, 63 nt, Homo Sapiens
ucacauugaauaguggaacauuuucauaugauacaccauuauguuuaagauauauuuccaaga

SEQ ID NO: 727594 - RNA, 63 nt, Homo Sapiens
auuuucugccacagguaacaugauuguuugacacaccauuauauuuaauucuaguuucucuca

SEQ ID NO: 727595 - RNA, 63 nt, Homo Sapiens
uuuucuauauggauugaccacagucuuaucuuccaccauuaagcuguauaacaauaaaauguu

SEQ ID NO: 727596 - RNA, 63 nt, Homo Sapiens
uagcaggggauguucucugauuuauuccacuggcaccauuagugaauauuuaguuguuuucau

SEQ ID NO: 727597 - RNA, 63 nt, Homo Sapiens
gaccuuuucuuugcauuuguuuugaaugucuaacaccauuagcuuuugugaucugguuaagaa

SEQ ID NO: 727598 - RNA, 63 nt, Homo Sapiens
ugggucuuucaggguggccaguguccuuuccagcaccauuauucuaccugacaguauuugaca

SEQ ID NO: 727599 - RNA, 63 nt, Homo Sapiens
agagggugggaaaaggcacacuccaccuuccagcaccauuaucccugcagggaguggccaacu

SEQ ID NO: 727600 - RNA, 63 nt, Homo Sapiens
uaacuucaugaaccagaaugucaaaaccauaaacaccauuaucgaagaaguuucagugaacuu

SEQ ID NO: 727601 - RNA, 63 nt, Homo Sapiens
accaccuccccaacccuacagaaaaaagagcaccaccauuauuucauuuucccccauagaaga

SEQ ID NO: 727602 - RNA, 63 nt, Homo Sapiens
gcuuuaagaacauguggaauuugccuuuuuuuccaccauuaagauccaccaugcuaaugacac

SEQ ID NO: 727603 - RNA, 63 nt, Homo Sapiens
ucucaacgacugcucuauuuagauaagacaugucaccauuaauucugguuuuggaaaauuucc

SEQ ID NO: 727604 - RNA, 63 nt, Homo Sapiens
aaucaauauauuaugucauacaguuaauagauccaccauuagguuuugacuagauuagacaaa

SEQ ID NO: 727605 - RNA, 63 nt, Homo Sapiens
agguguggcguuuuugcuuucagaucgccugaacaccauuaagauauguauccauuagucuga

SEQ ID NO: 727606 - RNA, 63 nt, Homo Sapiens
gccuucccugaaucaaaauaaucuuucauucgucaccauuauacuaaugaacaauagauuuca

SEQ ID NO: 727607 - RNA, 63 nt, Homo Sapiens
guuuuggccauggauaaagugaagaggccuacucaccauuaucccugcagcgugacaccuuuu

SEQ ID NO: 727608 - RNA, 63 nt, Homo Sapiens
ugauccugccagauucccagaggauucucacgccaccauuaccucacucagugugaccuggag

SEQ ID NO: 727609 - RNA, 63 nt, Homo Sapiens
ucacuuaagaaguaagcaaccgagcacugaagucaccauuaggaauagccuaggaagugcccu

SEQ ID NO: 727610 - RNA, 63 nt, Homo Sapiens
ucaucagggcugugcugaauagauguuuauguccaccauuauccuguuugauauucuuacaaa

SEQ ID NO: 727611 - RNA, 63 nt, Homo Sapiens
aaaacagaagguauuaaaaaaacaagagauucccaccauuauuuagguucaccugcaaaacaa

SEQ ID NO: 727612 - RNA, 63 nt, Homo Sapiens
auguggugacugaagccagaggugauguacuuucaccauuagcuuaauuuuaacuuaaaauua

SEQ ID NO: 727613 - RNA, 63 nt, Homo Sapiens
ugagagguuuugcuagggccuauuauuuuuaaccaccauuaauuaguugggguggaguuuacu

SEQ ID NO: 727614 - RNA, 63 nt, Homo Sapiens
gcucaaagguacugacacaguugauuuuauucacaccauuagggguaugcaagaugucccugu

SEQ ID NO: 727615 - RNA, 63 nt, Homo Sapiens
augacuuuuaagcacaguaauagucuauuggaacaccauuagcgacuaggagacuauaaacag

SEQ ID NO: 727616 - RNA, 63 nt, Homo Sapiens
aagcugucugauagagaacuuucaggcagaucccaccauuagccuguaaacaaaagguguggc

SEQ ID NO: 727617 - RNA, 63 nt, Homo Sapiens
gaaguuuccagaaagaagagaggacacaucucccaccauuaccagagggucaaaggagaacaa

SEQ ID NO: 727618 - RNA, 61 nt, Homo Sapiens
ugaaaagggcaaggcccugauguauagguugcaccauuacucagacuucuaaagagacuau

SEQ ID NO: 727619 - RNA, 63 nt, Homo Sapiens
guccaacggacaagaaaaaagcaaagucaacgacaccauuaucuugucaagaucagaugguuu

SEQ ID NO: 727620 - RNA, 63 nt, Homo Sapiens
aaauggaaauuacauuugaagauguggcaagaucaccauuagcacugugucgucuccgugcca

SEQ ID NO: 727621 - RNA, 63 nt, Homo Sapiens
cuguaaacaaaaaguuuggcuucaggcagaucccaccauuagcaaguugucugauagagaacu

SEQ ID NO: 727622 - RNA, 63 nt, Homo Sapiens
aguccaugaauguuaaaauguuagccaaagcaucaccauuacaaaaauacaucuacuaggcug

SEQ ID NO: 727623 - RNA, 63 nt, Homo Sapiens
cuguaaacaaaagguuuggcuucaggcagaucccaccauuagcaagcucuccgauagagaacu

SEQ ID NO: 727624 - RNA, 63 nt, Homo Sapiens
acauuugacuuaaauuguuucuuauuuuaauugcaccauuaaaauugaaaacauguuugaacc

SEQ ID NO: 727625 - RNA, 63 nt, Homo Sapiens
augacaaauuuuguguugacuugaaaggaaucacaccauuauuccuuagaaguaauuacaugu

SEQ ID NO: 727626 - RNA, 63 nt, Homo Sapiens
uaucugcggguccuguccuuuucucaagaccuucaccauuacuggcauuuuccugucuucucu

SEQ ID NO: 727627 - RNA, 63 nt, Homo Sapiens
uaaugacaaaccuuguuaaauauagauuuuaaucaccauuacaucacaaaaaugcccuagaaa

SEQ ID NO: 727628 - RNA, 63 nt, Homo Sapiens
auauuuaucuugaaagaaauaaaaaucuucacucaccauuauggaaaauccacugggaaaugu

SEQ ID NO: 727629 - RNA, 63 nt, Homo Sapiens
aacucuuuaucuuguaaaaugaaacucuauaaccaccauuaaaaaaacaacucauucccacau

SEQ ID NO: 727630 - RNA, 63 nt, Homo Sapiens
ugacucuucauauaacccuuguugacaaugaagcaccauuaugacucugugcccuguuugguu

SEQ ID NO: 727631 - RNA, 63 nt, Homo Sapiens
caggguguuugacugaagaaugcagaacuuagucaccauuagguagaaaggcuuuuuaacuuc

SEQ ID NO: 727632 - RNA, 63 nt, Homo Sapiens
cugaggagagaacaaguguucaaucucacuaaccaccauuaaaggaauggggaggggguuugg

SEQ ID NO: 727633 - RNA, 63 nt, Homo Sapiens
acugaaucguuucauguaagaauccaaaguggacaccauuaacaggucuuugaaauaugcaug

SEQ ID NO: 727634 - RNA, 63 nt, Homo Sapiens
uaaacguugcugucaaaagauuuaccaggucuacaccauuaugcuuauuauuuuuuuaauuau

SEQ ID NO: 727635 - RNA, 63 nt, Homo Sapiens
cucugcacugcagcacagugaaugauaugcacucaccauuagcuucgacacagggacugaggg

SEQ ID NO: 727636 - RNA, 63 nt, Homo Sapiens
caggccccacccacaagguacauucuacauccccaccauuaacaugcccugccuguugagccc

SEQ ID NO: 727637 - RNA, 63 nt, Homo Sapiens
ugauuuggucauaaguaaggacuauauuuaugucaccauuauuagauauauguacuuuuguaa

SEQ ID NO: 727638 - RNA, 63 nt, Homo Sapiens
gauugacccauuugaagaucggcaaaagagaaucaccauuaaaaaacaaauggaaucucugau

SEQ ID NO: 727639 - RNA, 63 nt, Homo Sapiens
ccauuucccccaaauuaaacaauuucugaaaagcaccauuagcgucagcaaauguaaaaauuu

SEQ ID NO: 727640 - RNA, 63 nt, Homo Sapiens
ugcacaauggucuuccuccaccccucugggaaucaccauuaggcaggccucaguagggcaaaa

SEQ ID NO: 727641 - RNA, 63 nt, Homo Sapiens
ggaaagaggaggaaguccuaagcagagaaguagcaccauuauccccauuuaacagaagggaaa

SEQ ID NO: 727642 - RNA, 63 nt, Homo Sapiens
auucuccucuagugacgcagcugcccgggacaccaccauuauccaggauggggacaggaucac

SEQ ID NO: 727643 - RNA, 63 nt, Homo Sapiens
ccaaaaugaaucugaaaaaaaaaauggggaaggcaccauuaagaugaguaaaagaccgcuuuu

SEQ ID NO: 727644 - RNA, 63 nt, Homo Sapiens
ccauaaaaauucccaguaugcauguuuuaugcucaccauuaugaauuggggucuucaaagaga

SEQ ID NO: 727645 - RNA, 63 nt, Homo Sapiens
guagguggggguggggaggcccaaaugauggaucaccauuauauuuugaaagaagccaucaag

SEQ ID NO: 727646 - RNA, 63 nt, Homo Sapiens
auaagguuuacgagcuaugagaauuggugcuaucaccauuagcuauuugcuguaaugucaaga

SEQ ID NO: 727647 - RNA, 63 nt, Homo Sapiens
gcuaccgcgccuggccaugaugauauuauuaaacaccauuauucacauuucaaauaauaacaa

SEQ ID NO: 727648 - RNA, 63 nt, Homo Sapiens
ucuaaauauugauuucugccuuccuugcuaaugcaccauuagaagauauuagucuuggggcag

SEQ ID NO: 727649 - RNA, 63 nt, Homo Sapiens
aguaauaaugugauucucuauggcuucuagcuucaccauuaagcugcaguuaagggucuguca

SEQ ID NO: 727650 - RNA, 63 nt, Homo Sapiens
cacucaccagauguuuacaaguuuuuaauguaacaccauuagauucugggcauuuuuuggcca

SEQ ID NO: 727651 - RNA, 63 nt, Homo Sapiens
caagccauauaauuuuauguuaaagaaaauaaacaccauuauuguuucauauuuaaguguauu

SEQ ID NO: 727652 - RNA, 63 nt, Homo Sapiens
aauucuuaguucagggcuggaccauccagacgucaccauuauacaaaaaaaaauaauauuuuc

SEQ ID NO: 727653 - RNA, 63 nt, Homo Sapiens
aacaguugaggcacuacacucauuauacuaagacaccauuaagauuauauucuaauaauuaug

SEQ ID NO: 727654 - RNA, 64 nt, Homo Sapiens
gcucuguuuccuaauucaggaccccacucaucuagcccuccaagagccuccgccaaauuguagc

SEQ ID NO: 727655 - RNA, 64 nt, Homo Sapiens
gagucaacaguccccugauccccuaccucugccugcccuccagccccaucaccagcuucuugcu

SEQ ID NO: 727656 - RNA, 64 nt, Homo Sapiens
ggcacaucaguuaaugccagugaggucagcuucugcccuccagcaauacaugugcagggguugc

SEQ ID NO: 727657 - RNA, 64 nt, Homo Sapiens
guacugaggguacuggccuaagggaauucccacagcccuccaguuuccccaucaugggcaagga

SEQ ID NO: 727658 - RNA, 64 nt, Homo Sapiens
aaacagaggugacaaaugugcuccaggacucacugcccuccagacaguauuaccaccagacuga

SEQ ID NO: 727659 - RNA, 55 nt, Homo Sapiens; identical to SEQ ID NO: 540628

SEQ ID NO: 727660 - RNA, 64 nt, Homo Sapiens
caagggugaauccuucccacacuccuccaugguugcccuccagggucuagcccagccuauuugu

SEQ ID NO: 727661 - RNA, 64 nt, Homo Sapiens
aucuucacauuccaagacugccagccagcagcuggcccuccaccuacccuggcgggccacccug

SEQ ID NO: 727662 - RNA, 64 nt, Homo Sapiens
gccagcccuccuggguaccggccugccaagcccagcccuccagaccaccuccuugcucucccca

SEQ ID NO: 727663 - RNA, 64 nt, Homo Sapiens
ggaucagaagcuccaaguucgcuccaagauauaagcccuccaaggagacuuuaugcccuccaga

SEQ ID NO: 727664 - RNA, 64 nt, Homo Sapiens
gcuccaagauauaagcccucucuagagacuuuaugcccuccagaccauccucucucaggaagcu

SEQ ID NO: 727665 - RNA, 64 nt, Homo Sapiens
ccugacuggggaugggcggcgggcugcgaggccugcccuccaaaguccacugcguuccugggaa

SEQ ID NO: 727666 - RNA, 64 nt, Homo Sapiens
aaugguggucgugugauugacucaaucaguacccgcccuccaucacgagcaggcgaacgccacc

SEQ ID NO: 727667 - RNA, 64 nt, Homo Sapiens
accagacacagcuguuguucggggcuguggaacugcccuccaagcugcuggucuacuugucggu

SEQ ID NO: 727668 - RNA, 64 nt, Homo Sapiens
aagcagguccagaacuaagugggaguggaggcaggcccuccacagaagcucugcagcaggggcu

SEQ ID NO: 727669 - RNA, 64 nt, Homo Sapiens
uccccguuacucaaauccuuggcacuacuacaaugcccuccauucuucagggcugagaauugac

SEQ ID NO: 727670 - RNA, 64 nt, Homo Sapiens
guguuucaggagaggacugugcuggaucaugcuugcccuccacagggaauacagcauccuuaca

SEQ ID NO: 727671 - RNA, 64 nt, Homo Sapiens
ugucuguggccuucuggggcaccgauucuaccaggcccuccagcugcguggucuccgcagacca

SEQ ID NO: 727672 - RNA, 64 nt, Homo Sapiens
uuuccagcccuccggagagugggcuuggcccuaggcccuccagcucagccagaaaaagcccaga

SEQ ID NO: 727673 - RNA, 64 nt, Homo Sapiens
ggcugcuugaggaaacgcagauaagcacuuugcugcccuccagugggcggggugggauuuuugc

SEQ ID NO: 727674 - RNA, 64 nt, Homo Sapiens
ccccagaggggcgccuguggcagggugugcgucagcccuccaaccaggcggcugggaucucagg

SEQ ID NO: 727675 - RNA, 64 nt, Homo Sapiens
gcuuccgccugccucccagcgaguacgucaucgugcccuccaccuacgagccccaccaggaggg

SEQ ID NO: 727676 - RNA, 64 nt, Homo Sapiens
cugccgguggcacucagcaccuccuugugcuagagcccuccaucaccuucacgcugucccacca

SEQ ID NO: 727677 - RNA, 64 nt, Homo Sapiens
uaucgacaaucugucagccgacgcagggcuggaggcccuccauuucccuccccuuuuaauuuau

SEQ ID NO: 727678 - RNA, 64 nt, Homo Sapiens
aagcugcagcucugcucaacugcgucuucucucagcccuccacacacacucacccccacuccca

SEQ ID NO: 727679 - RNA, 64 nt, Homo Sapiens
gcucuggggccagaauggcuguccuugucguagagcccuccacauuuucuuuuucuuuuuugag

SEQ ID NO: 727680 - RNA, 64 nt, Homo Sapiens
gaacuacaagugugagccaccgcgccuggcccaagcccuccacauuuucaauccaggagccuug

SEQ ID NO: 727681 - RNA, 64 nt, Homo Sapiens
aguaucugagaagcugcuacggucaggcugaugugcccuccagcggcagauaaaccccaugagg

SEQ ID NO: 727682 - RNA, 64 nt, Homo Sapiens
ggcaacuggugcagggacuggcuggagcugcccugcccuccauaggcccuccacuggccccagg

SEQ ID NO: 727683 - RNA, 64 nt, Homo Sapiens
ggccccagggcuggagcugcgcuggcucuggcuggcccuccacuugcacuagcugacugugcug

SEQ ID NO: 727684 - RNA, 64 nt, Homo Sapiens
caagccguaccuggugaacugcguccgcaucccugcccuccagucccuccugcuuuuuagccgg

SEQ ID NO: 727685 - RNA, 64 nt, Homo Sapiens
ccaggagcccugcccaccuccgugcagcugaccugcccuccagcccaggacuaggggcaggacu

SEQ ID NO: 727686 - RNA, 64 nt, Homo Sapiens
uccaaauccagacgcaggcccgcgugaggccccggcccuccaaaaccaggggaccucgggacug

SEQ ID NO: 727687 - RNA, 64 nt, Homo Sapiens
cagccuccuggacucggccugcugcgugcgcccugcccuccaccgggcauggacugacugccag

SEQ ID NO: 727688 - RNA, 64 nt, Homo Sapiens
cugguccccaucccugucucucccuuucacccuugcccuccaguccucuaccucuggccugccc

SEQ ID NO: 727689 - RNA, 64 nt, Homo Sapiens
agguagagccugugcagccugggcugcugucauugcccuccaguaagggcucaggguuuugcuu

SEQ ID NO: 727690 - RNA, 64 nt, Homo Sapiens
aggcaucuccacagccccggguccucugucuaacgcccuccauuucacgcccuccaucucacag

SEQ ID NO: 727691 - RNA, 64 nt, Homo Sapiens
ccccggguccucugucuaacgcccuccauuucacgcccuccaucucacagucaagauaaaggcc

SEQ ID NO: 727692 - RNA, 63 nt, Homo Sapiens
caaaggagaagaaauuacucuguucuugauaagggaagugagaggcaaagacuuacugguugg

SEQ ID NO: 727693 - RNA, 63 nt, Homo Sapiens
aaaggaaaauuuuaagccagauacucauagaauggaagugagcuguccagcugcuccaucgau

SEQ ID NO: 727694 - RNA, 63 nt, Homo Sapiens
gaauauuucaguuuccugaacauuuuuuuccauggaagugaggaaaugcuuaaauauauaaua

SEQ ID NO: 727695 - RNA, 63 nt, Homo Sapiens
gccucaguagaagagacgcaucuagacacauacggaagugauggagcacaauggugggcccuc

SEQ ID NO: 727696 - RNA, 63 nt, Homo Sapiens
agugcagccucugcccggccgccaccccgucugggaagugaggagcgucucugccuggcugcc

SEQ ID NO: 727697 - RNA, 63 nt, Homo Sapiens
aggagcgucucugcccggccgccaucccaucuaggaagugaggagcgccucuucccacccgcc

SEQ ID NO: 727698 - RNA, 63 nt, Homo Sapiens
aggagcgccucuucccacccgccaucccaucuaggaagugaggagcuucucugccuggccgcc

SEQ ID NO: 727699 - RNA, 63 nt, Homo Sapiens
aggagccccucugcccagcagccacccugucugggaagugaggagcgucuccgcccggcagcc

SEQ ID NO: 727700 - RNA, 63 nt, Homo Sapiens
gugaggggcgccucugcccagcugccccuacugggaagugaggagccccucugccccgccagc

SEQ ID NO: 727701 - RNA, 63 nt, Homo Sapiens
gcgaggggcgccucugcccggcugccccuacugggaagugaggagccccucugcccggccagc

SEQ ID NO: 727702 - RNA, 63 nt, Homo Sapiens
guuaggggcgccucugcccggccgccccuacugggaagugaggagccccucugcccggccacc

SEQ ID NO: 727703 - RNA, 63 nt, Homo Sapiens
ccagagcauggcacaugagcgccagagccaacaggaagugagcgaggacaugcaccaaggcuu

SEQ ID NO: 727704 - RNA, 63 nt, Homo Sapiens
ucgcucagagaugagauccuuucuucacuuaggggaagugaaaguaucuguuuuuaauuuuca

SEQ ID NO: 727705 - RNA, 63 nt, Homo Sapiens
cuauuaaaacuacuguucauuuugggggcugggggaagugagccuguuuggaugauggaugcc

SEQ ID NO: 727706 - RNA, 63 nt, Homo Sapiens
aauguagugccuuuaaaggaaaaaugaacacagggaagugacuuugcuacaaauaauguugcu

SEQ ID NO: 727707 - RNA, 63 nt, Homo Sapiens
ugcagaaguuggguagagagguuaagaagaggaggaagugagacggggaagggaggagcaccu

SEQ ID NO: 727708 - RNA, 63 nt, Homo Sapiens
cuucccagagcaagcaggcugcauuuuagcuauggaagugaccugcugugacacugugcucuc

SEQ ID NO: 727709 - RNA, 63 nt, Homo Sapiens
ugccaccaaggcucgguccagcccaguaccgcuggaagugaauaaacuccggagggucggacg

SEQ ID NO: 727710 - RNA, 63 nt, Homo Sapiens
ccacauagggagggcuuagagcucacagccuugggaagugagacuagaagaggggagcagaaa

SEQ ID NO: 727711 - RNA, 63 nt, Homo Sapiens
aggagcgccucugcccggccgccaucccaucuaggaagugaggagcgccucuucccagccgcc

SEQ ID NO: 727712 - RNA, 63 nt, Homo Sapiens
aggagcgccucuucccagccgccaucccaucuaggaagugaggagcgucucugcccggccgcc

SEQ ID NO: 727713 - RNA, 63 nt, Homo Sapiens
aggagccccuccgcccggcagccaccccaucugggaagugaggagcgucuacgcccgggcagc

SEQ ID NO: 727714 - RNA, 63 nt, Homo Sapiens
ugcccggccgccccugcccggccgccccuacugggaagugaggagccccucugccuggccacc

SEQ ID NO: 727715 - RNA, 63 nt, Homo Sapiens
gaacaggaacucagggugcccuucuacugccugggaagugauggggagcuguuccuggacagc

SEQ ID NO: 727716 - RNA, 63 nt, Homo Sapiens
ggucccaggcacacacccugagaagacaagcagggaagugaaaugccucucagaaacgcggcc

SEQ ID NO: 727717 - RNA, 63 nt, Homo Sapiens
auaaaucgagaggaguuauagugggaaaaauuaggaagugauuaaagauguagcucuggccca

SEQ ID NO: 727718 - RNA, 63 nt, Homo Sapiens
auuucggugacuuccgcauccucuggaacuugaggaagugaacucugaguaagaaacagaauc

SEQ ID NO: 727719 - RNA, 64 nt, Homo Sapiens; identical to SEQ ID NO: 727654

SEQ ID NO: 727720 - RNA, 64 nt, Homo Sapiens; identical to SEQ ID NO: 727655

SEQ ID NO: 727721 - RNA, 64 nt, Homo Sapiens; identical to SEQ ID NO: 727656

SEQ ID NO: 727722 - RNA, 64 nt, Homo Sapiens; identical to SEQ ID NO: 727657

SEQ ID NO: 727723 - RNA, 64 nt, Homo Sapiens; identical to SEQ ID NO: 727658

SEQ ID NO: 727724 - RNA, 55 nt, Homo Sapiens; identical to SEQ ID NO: 540628

SEQ ID NO: 727725 - RNA, 64 nt, Homo Sapiens; identical to SEQ ID NO: 727660

SEQ ID NO: 727726 - RNA, 64 nt, Homo Sapiens; identical to SEQ ID NO: 727661

SEQ ID NO: 727727 - RNA, 64 nt, Homo Sapiens; identical to SEQ ID NO: 727662

SEQ ID NO: 727728 - RNA, 64 nt, Homo Sapiens; identical to SEQ ID NO: 727663

SEQ ID NO: 727729 - RNA, 64 nt, Homo Sapiens; identical to SEQ ID NO: 727664

SEQ ID NO: 727730 - RNA, 64 nt, Homo Sapiens; identical to SEQ ID NO: 727665

SEQ ID NO: 727731 - RNA, 64 nt, Homo Sapiens; identical to SEQ ID NO: 727666

SEQ ID NO: 727732 - RNA, 64 nt, Homo Sapiens; identical to SEQ ID NO: 727667

SEQ ID NO: 727733 - RNA, 64 nt, Homo Sapiens; identical to SEQ ID NO: 727668

SEQ ID NO: 727734 - RNA, 64 nt, Homo Sapiens; identical to SEQ ID NO: 727669

SEQ ID NO: 727735 - RNA, 64 nt, Homo Sapiens; identical to SEQ ID NO: 727670

SEQ ID NO: 727736 - RNA, 64 nt, Homo Sapiens; identical to SEQ ID NO: 727671

SEQ ID NO: 727737 - RNA, 64 nt, Homo Sapiens; identical to SEQ ID NO: 727672

SEQ ID NO: 727738 - RNA, 64 nt, Homo Sapiens; identical to SEQ ID NO: 727673

SEQ ID NO: 727739 - RNA, 64 nt, Homo Sapiens; identical to SEQ ID NO: 727674

SEQ ID NO: 727740 - RNA, 64 nt, Homo Sapiens; identical to SEQ ID NO: 727675

SEQ ID NO: 727741 - RNA, 64 nt, Homo Sapiens; identical to SEQ ID NO: 727676

SEQ ID NO: 727742 - RNA, 64 nt, Homo Sapiens; identical to SEQ ID NO: 727677

SEQ ID NO: 727743 - RNA, 64 nt, Homo Sapiens; identical to SEQ ID NO: 727678

SEQ ID NO: 727744 - RNA, 64 nt, Homo Sapiens; identical to SEQ ID NO: 727679

SEQ ID NO: 727745 - RNA, 64 nt, Homo Sapiens; identical to SEQ ID NO: 727680

SEQ ID NO: 727746 - RNA, 64 nt, Homo Sapiens; identical to SEQ ID NO: 727681

SEQ ID NO: 727747 - RNA, 64 nt, Homo Sapiens; identical to SEQ ID NO: 727682

SEQ ID NO: 727748 - RNA, 64 nt, Homo Sapiens; identical to SEQ ID NO: 727683

SEQ ID NO: 727749 - RNA, 64 nt, Homo Sapiens; identical to SEQ ID NO: 727684

SEQ ID NO: 727750 - RNA, 64 nt, Homo Sapiens; identical to SEQ ID NO: 727685

SEQ ID NO: 727751 - RNA, 64 nt, Homo Sapiens; identical to SEQ ID NO: 727686

SEQ ID NO: 727752 - RNA, 64 nt, Homo Sapiens; identical to SEQ ID NO: 727687

SEQ ID NO: 727753 - RNA, 64 nt, Homo Sapiens; identical to SEQ ID NO: 727688

SEQ ID NO: 727754 - RNA, 64 nt, Homo Sapiens; identical to SEQ ID NO: 727689

SEQ ID NO: 727755 - RNA, 64 nt, Homo Sapiens; identical to SEQ ID NO: 727690

SEQ ID NO: 727756 - RNA, 64 nt, Homo Sapiens; identical to SEQ ID NO: 727691

SEQ ID NO: 727757 - RNA, 63 nt, Homo Sapiens; identical to SEQ ID NO: 727692

SEQ ID NO: 727758 - RNA, 63 nt, Homo Sapiens; identical to SEQ ID NO: 727693

SEQ ID NO: 727759 - RNA, 63 nt, Homo Sapiens; identical to SEQ ID NO: 727694

SEQ ID NO: 727760 - RNA, 63 nt, Homo Sapiens; identical to SEQ ID NO: 727695

SEQ ID NO: 727761 - RNA, 63 nt, Homo Sapiens; identical to SEQ ID NO: 727696

SEQ ID NO: 727762 - RNA, 63 nt, Homo Sapiens; identical to SEQ ID NO: 727697

SEQ ID NO: 727763 - RNA, 63 nt, Homo Sapiens; identical to SEQ ID NO: 727698

SEQ ID NO: 727764 - RNA, 63 nt, Homo Sapiens; identical to SEQ ID NO: 727699

SEQ ID NO: 727765 - RNA, 63 nt, Homo Sapiens; identical to SEQ ID NO: 727700

SEQ ID NO: 727766 - RNA, 63 nt, Homo Sapiens; identical to SEQ ID NO: 727701

SEQ ID NO: 727767 - RNA, 63 nt, Homo Sapiens; identical to SEQ ID NO: 727702

SEQ ID NO: 727768 - RNA, 63 nt, Homo Sapiens; identical to SEQ ID NO: 727703

SEQ ID NO: 727769 - RNA, 63 nt, Homo Sapiens; identical to SEQ ID NO: 727704

SEQ ID NO: 727770 - RNA, 63 nt, Homo Sapiens; identical to SEQ ID NO: 727705

SEQ ID NO: 727771 - RNA, 63 nt, Homo Sapiens; identical to SEQ ID NO: 727706

SEQ ID NO: 727772 - RNA, 63 nt, Homo Sapiens; identical to SEQ ID NO: 727707

SEQ ID NO: 727773 - RNA, 63 nt, Homo Sapiens; identical to SEQ ID NO: 727708

SEQ ID NO: 727774 - RNA, 63 nt, Homo Sapiens; identical to SEQ ID NO: 727709

SEQ ID NO: 727775 - RNA, 63 nt, Homo Sapiens; identical to SEQ ID NO: 727710

SEQ ID NO: 727776 - RNA, 63 nt, Homo Sapiens; identical to SEQ ID NO: 727711

SEQ ID NO: 727777 - RNA, 63 nt, Homo Sapiens; identical to SEQ ID NO: 727712

SEQ ID NO: 727778 - RNA, 63 nt, Homo Sapiens; identical to SEQ ID NO: 727713

SEQ ID NO: 727779 - RNA, 63 nt, Homo Sapiens; identical to SEQ ID NO: 727714

SEQ ID NO: 727780 - RNA, 63 nt, Homo Sapiens; identical to SEQ ID NO: 727715

SEQ ID NO: 727781 - RNA, 63 nt, Homo Sapiens; identical to SEQ ID NO: 727716

SEQ ID NO: 727782 - RNA, 63 nt, Homo Sapiens; identical to SEQ ID NO: 727717

SEQ ID NO: 727783 - RNA, 63 nt, Homo Sapiens; identical to SEQ ID NO: 727718

SEQ ID NO: 727784 - RNA, 61 nt, Homo Sapiens; identical to SEQ ID NO: 470455

SEQ ID NO: 727785 - RNA, 61 nt, Homo Sapiens; identical to SEQ ID NO: 470456

SEQ ID NO: 727786 - RNA, 61 nt, Homo Sapiens; identical to SEQ ID NO: 470457

SEQ ID NO: 727787 - RNA, 61 nt, Homo Sapiens; identical to SEQ ID NO: 470458

SEQ ID NO: 727788 - RNA, 61 nt, Homo Sapiens; identical to SEQ ID NO: 470459

SEQ ID NO: 727789 - RNA, 61 nt, Homo Sapiens; identical to SEQ ID NO: 470460

SEQ ID NO: 727790 - RNA, 61 nt, Homo Sapiens; identical to SEQ ID NO: 470461

SEQ ID NO: 727791 - RNA, 61 nt, Homo Sapiens; identical to SEQ ID NO: 470462

SEQ ID NO: 727792 - RNA, 61 nt, Homo Sapiens; identical to SEQ ID NO: 470463

SEQ ID NO: 727793 - RNA, 61 nt, Homo Sapiens; identical to SEQ ID NO: 470464

SEQ ID NO: 727794 - RNA, 61 nt, Homo Sapiens; identical to SEQ ID NO: 470465

SEQ ID NO: 727795 - RNA, 61 nt, Homo Sapiens; identical to SEQ ID NO: 470466

SEQ ID NO: 727796 - RNA, 61 nt, Homo Sapiens; identical to SEQ ID NO: 470467

SEQ ID NO: 727797 - RNA, 61 nt, Homo Sapiens; identical to SEQ ID NO: 470468

SEQ ID NO: 727798 - RNA, 61 nt, Homo Sapiens; identical to SEQ ID NO: 470469

SEQ ID NO: 727799 - RNA, 61 nt, Homo Sapiens; identical to SEQ ID NO: 470470

SEQ ID NO: 727800 - RNA, 61 nt, Homo Sapiens; identical to SEQ ID NO: 470471

SEQ ID NO: 727801 - RNA, 61 nt, Homo Sapiens; identical to SEQ ID NO: 470472

SEQ ID NO: 727802 - RNA, 61 nt, Homo Sapiens; identical to SEQ ID NO: 470473

SEQ ID NO: 727803 - RNA, 61 nt, Homo Sapiens; identical to SEQ ID NO: 470474

SEQ ID NO: 727804 - RNA, 61 nt, Homo Sapiens; identical to SEQ ID NO: 470475

SEQ ID NO: 727805 - RNA, 61 nt, Homo Sapiens; identical to SEQ ID NO: 470476

SEQ ID NO: 727806 - RNA, 61 nt, Homo Sapiens; identical to SEQ ID NO: 470477

SEQ ID NO: 727807 - RNA, 61 nt, Homo Sapiens; identical to SEQ ID NO: 470478

SEQ ID NO: 727808 - RNA, 61 nt, Homo Sapiens; identical to SEQ ID NO: 470479

SEQ ID NO: 727809 - RNA, 61 nt, Homo Sapiens; identical to SEQ ID NO: 470480

SEQ ID NO: 727810 - RNA, 61 nt, Homo Sapiens; identical to SEQ ID NO: 470481

SEQ ID NO: 727811 - RNA, 61 nt, Homo Sapiens; identical to SEQ ID NO: 470482

SEQ ID NO: 727812 - RNA, 61 nt, Homo Sapiens; identical to SEQ ID NO: 470483

SEQ ID NO: 727813 - RNA, 61 nt, Homo Sapiens; identical to SEQ ID NO: 470484

SEQ ID NO: 727814 - RNA, 62 nt, Homo Sapiens
aauccugcuuucucaaguacuauucuaacauugcgcuuuauaagggaugauauuucuaccac

SEQ ID NO: 727815 - RNA, 62 nt, Homo Sapiens
uaaagcccaggaacuucuagaauaacccagaugcgcuuuaauuuuuuuuaauauguuuugau

SEQ ID NO: 727816 - RNA, 62 nt, Homo Sapiens
ccuuaauauaucuauggcagacauuuaagaaugcgcuuuaucuagcucaugguaacuuugca

SEQ ID NO: 727817 - RNA, 62 nt, Homo Sapiens
acgguaguuaggaugcucaguugcuaaacacugcgcuuuauuuucuuaaccaguuguggugu

SEQ ID NO: 727818 - RNA, 62 nt, Homo Sapiens
caugggauaaaaauaaucgauguauguuacgggcgcuuuaaccaucagcugccucucgaaug

SEQ ID NO: 727819 - RNA, 62 nt, Homo Sapiens
ucggagcgcaaugccaucuagccgccggcgcugcgcuuuauugguucaccuggguggcugga

SEQ ID NO: 727820 - RNA, 62 nt, Homo Sapiens
uuaauuaccaaaacucuccugucucuguaccagcgcuuuauguguuucccuuaaugauacaa

SEQ ID NO: 727821 - RNA, 62 nt, Homo Sapiens
agaaguggcagaacacuggauuuguguguguggcgcuuuagggugcuggacuguauggcuga

SEQ ID NO: 727822 - RNA, 62 nt, Homo Sapiens
agauuagccugagaaauaauaaaacacuuugagcgcuuuaagucccuccccuugcacuugug

SEQ ID NO: 727823 - RNA, 62 nt, Homo Sapiens
aagugacuguuuggcuuauaaacacauugaaugcgcuuuauugcccaugggauauguggugu

SEQ ID NO: 727824 - RNA, 62 nt, Homo Sapiens
gaauaacaaguugucccuagcaaaaccgcugagcgcuuuauaauuuugugguguauuuuugu

SEQ ID NO: 727825 - RNA, 62 nt, Homo Sapiens
gaaaaugguuagacugaaaacuuuuuaaauaagcgcuuuaaucucaguuuuauaaggugaua

SEQ ID NO: 727826 - RNA, 62 nt, Homo Sapiens
cagacaucaguuccauggugucacauggggaagcgcuuuauauacauugucaugugacugga

SEQ ID NO: 727827 - RNA, 62 nt, Homo Sapiens
aagcauuguuuuaguccaggaggcugcagaaugcgcuuuagaucucaccucacaggcacauc

SEQ ID NO: 727828 - RNA, 62 nt, Homo Sapiens
auuaguuaaucuuuugcaggccacagacuugagcgcuuuauucauugcaugagucaagucgg

SEQ ID NO: 727829 - RNA, 62 nt, Homo Sapiens
aauuuuuaaacuucuaagugaaaguagucugagcgcuuuauaaaauucauauuauugugugu

SEQ ID NO: 727830 - RNA, 62 nt, Homo Sapiens
ugugggagaagagaggagagugccacuguucugcgcuuuaauaccccagcacacacacuccc

SEQ ID NO: 727831 - RNA, 62 nt, Homo Sapiens
ucaugaugacaacacugccucgcguuucaauagcgcuuuauacuuuuuuaaguguuuucuau

SEQ ID NO: 727832 - RNA, 62 nt, Homo Sapiens
cauauuucuuuaaaaugcaagugguuuacaaugcgcuuuagauuuugcuauuguaaauauua

SEQ ID NO: 727833 - RNA, 62 nt, Homo Sapiens
auuugagugauucaauaguuccaauugugagggcgcuuuagcuguagcuaucuucaccugcg

SEQ ID NO: 727834 - RNA, 62 nt, Homo Sapiens
uugagcgcauggcaagucacaaguccccggcggcgcuuuagugggccgaggugggcuucagu

SEQ ID NO: 727835 - RNA, 62 nt, Homo Sapiens
aaagauugaacuuaaaugccccccucccaacagcgcuuuaaaagcgaccucucuugagguag

SEQ ID NO: 727836 - RNA, 62 nt, Homo Sapiens
uuuuuaauagacaaaucacaucuuuuucacaagcgcuuuauuuugccgccaucucuuaguuu

SEQ ID NO: 727837 - RNA, 62 nt, Homo Sapiens
auauuauucacagaugcauucuucaacacuaugcgcuuuaucccuuggauuuaauuuaaagu

SEQ ID NO: 727838 - RNA, 62 nt, Homo Sapiens
uccgugugcuuucaguuuuuuugaauauuaaggcgcuuuacuccaauccaacuugaagucaa

SEQ ID NO: 727839 - RNA, 62 nt, Homo Sapiens
ucugccucagaaagcucugcgcuuuccagaaagcgcuuuacccugcaggguuuugcuaaccu

SEQ ID NO: 727840 - RNA, 62 nt, Homo Sapiens
gcuucucuuuggcauauccacacuuaaaggaggcgcuuuauacuugagaaccuucacccuuu

SEQ ID NO: 727841 - RNA, 62 nt, Homo Sapiens
uucauucucccccucucucccuccugugucuugcgcuuuauguuuucuuccguuugauaauu

SEQ ID NO: 727842 - RNA, 62 nt, Homo Sapiens
uccuagagaagccaugugauucccagagccaggcgcuuuacaccuaaaguaguuugacuuuc

SEQ ID NO: 727843 - RNA, 62 nt, Homo Sapiens
gcuuguguguguagcuucuuguagcuuagaaagcgcuuuaugcccaugaugucauuucaggc

SEQ ID NO: 727844 - RNA, 63 nt, Homo Sapiens; identical to SEQ ID NO: 58102

SEQ ID NO: 727845 - RNA, 63 nt, Homo Sapiens; identical to SEQ ID NO: 58103

SEQ ID NO: 727846 - RNA, 63 nt, Homo Sapiens; identical to SEQ ID NO: 58104

SEQ ID NO: 727847 - RNA, 63 nt, Homo Sapiens; identical to SEQ ID NO: 58105

SEQ ID NO: 727848 - RNA, 63 nt, Homo Sapiens; identical to SEQ ID NO: 58106

SEQ ID NO: 727849 - RNA, 63 nt, Homo Sapiens; identical to SEQ ID NO: 58107

SEQ ID NO: 727850 - RNA, 63 nt, Homo Sapiens; identical to SEQ ID NO: 58108

SEQ ID NO: 727851 - RNA, 63 nt, Homo Sapiens; identical to SEQ ID NO: 58109

SEQ ID NO: 727852 - RNA, 63 nt, Homo Sapiens; identical to SEQ ID NO: 58110

SEQ ID NO: 727853 - RNA, 63 nt, Homo Sapiens; identical to SEQ ID NO: 58111

SEQ ID NO: 727854 - RNA, 63 nt, Homo Sapiens; identical to SEQ ID NO: 58112

SEQ ID NO: 727855 - RNA, 63 nt, Homo Sapiens; identical to SEQ ID NO: 58113

SEQ ID NO: 727856 - RNA, 63 nt, Homo Sapiens; identical to SEQ ID NO: 58114

SEQ ID NO: 727857 - RNA, 63 nt, Homo Sapiens; identical to SEQ ID NO: 58115

SEQ ID NO: 727858 - RNA, 63 nt, Homo Sapiens; identical to SEQ ID NO: 58116

SEQ ID NO: 727859 - RNA, 63 nt, Homo Sapiens; identical to SEQ ID NO: 58117

SEQ ID NO: 727860 - RNA, 63 nt, Homo Sapiens; identical to SEQ ID NO: 58118

SEQ ID NO: 727861 - RNA, 63 nt, Homo Sapiens; identical to SEQ ID NO: 58119

SEQ ID NO: 727862 - RNA, 63 nt, Homo Sapiens; identical to SEQ ID NO: 58120

SEQ ID NO: 727863 - RNA, 63 nt, Homo Sapiens; identical to SEQ ID NO: 58121

SEQ ID NO: 727864 - RNA, 63 nt, Homo Sapiens; identical to SEQ ID NO: 58122

SEQ ID NO: 727865 - RNA, 63 nt, Homo Sapiens; identical to SEQ ID NO: 58123

SEQ ID NO: 727866 - RNA, 63 nt, Homo Sapiens; identical to SEQ ID NO: 58124

SEQ ID NO: 727867 - RNA, 63 nt, Homo Sapiens; identical to SEQ ID NO: 58125

SEQ ID NO: 727868 - RNA, 63 nt, Homo Sapiens; identical to SEQ ID NO: 58126

SEQ ID NO: 727869 - RNA, 63 nt, Homo Sapiens; identical to SEQ ID NO: 58127

SEQ ID NO: 727870 - RNA, 63 nt, Homo Sapiens; identical to SEQ ID NO: 58128

SEQ ID NO: 727871 - RNA, 63 nt, Homo Sapiens; identical to SEQ ID NO: 58129

SEQ ID NO: 727872 - RNA, 63 nt, Homo Sapiens; identical to SEQ ID NO: 58130

SEQ ID NO: 727873 - RNA, 63 nt, Homo Sapiens; identical to SEQ ID NO: 58131

SEQ ID NO: 727874 - RNA, 64 nt, Homo Sapiens; identical to SEQ ID NO: 657704

SEQ ID NO: 727875 - RNA, 64 nt, Homo Sapiens; identical to SEQ ID NO: 657705

SEQ ID NO: 727876 - RNA, 64 nt, Homo Sapiens; identical to SEQ ID NO: 657706

SEQ ID NO: 727877 - RNA, 64 nt, Homo Sapiens; identical to SEQ ID NO: 657707

SEQ ID NO: 727878 - RNA, 64 nt, Homo Sapiens; identical to SEQ ID NO: 657708

SEQ ID NO: 727879 - RNA, 64 nt, Homo Sapiens; identical to SEQ ID NO: 657709

SEQ ID NO: 727880 - RNA, 64 nt, Homo Sapiens; identical to SEQ ID NO: 657710

SEQ ID NO: 727881 - RNA, 64 nt, Homo Sapiens; identical to SEQ ID NO: 657711

SEQ ID NO: 727882 - RNA, 64 nt, Homo Sapiens; identical to SEQ ID NO: 657712

SEQ ID NO: 727883 - RNA, 64 nt, Homo Sapiens; identical to SEQ ID NO: 657713

SEQ ID NO: 727884 - RNA, 64 nt, Homo Sapiens; identical to SEQ ID NO: 657714

SEQ ID NO: 727885 - RNA, 64 nt, Homo Sapiens; identical to SEQ ID NO: 657715

SEQ ID NO: 727886 - RNA, 64 nt, Homo Sapiens; identical to SEQ ID NO: 657716

SEQ ID NO: 727887 - RNA, 64 nt, Homo Sapiens; identical to SEQ ID NO: 657717

SEQ ID NO: 727888 - RNA, 64 nt, Homo Sapiens; identical to SEQ ID NO: 657718

SEQ ID NO: 727889 - RNA, 64 nt, Homo Sapiens; identical to SEQ ID NO: 657719

SEQ ID NO: 727890 - RNA, 64 nt, Homo Sapiens; identical to SEQ ID NO: 657720

SEQ ID NO: 727891 - RNA, 64 nt, Homo Sapiens; identical to SEQ ID NO: 657721

SEQ ID NO: 727892 - RNA, 64 nt, Homo Sapiens; identical to SEQ ID NO: 657722

SEQ ID NO: 727893 - RNA, 64 nt, Homo Sapiens; identical to SEQ ID NO: 657723

SEQ ID NO: 727894 - RNA, 64 nt, Homo Sapiens; identical to SEQ ID NO: 657724

SEQ ID NO: 727895 - RNA, 64 nt, Homo Sapiens; identical to SEQ ID NO: 657725

SEQ ID NO: 727896 - RNA, 64 nt, Homo Sapiens; identical to SEQ ID NO: 657726

SEQ ID NO: 727897 - RNA, 64 nt, Homo Sapiens; identical to SEQ ID NO: 657727

SEQ ID NO: 727898 - RNA, 64 nt, Homo Sapiens; identical to SEQ ID NO: 657728

SEQ ID NO: 727899 - RNA, 64 nt, Homo Sapiens; identical to SEQ ID NO: 657729

SEQ ID NO: 727900 - RNA, 64 nt, Homo Sapiens; identical to SEQ ID NO: 657730

SEQ ID NO: 727901 - RNA, 64 nt, Homo Sapiens; identical to SEQ ID NO: 657731

SEQ ID NO: 727902 - RNA, 64 nt, Homo Sapiens; identical to SEQ ID NO: 657732

SEQ ID NO: 727903 - RNA, 64 nt, Homo Sapiens; identical to SEQ ID NO: 657733

SEQ ID NO: 727904 - RNA, 63 nt, Homo Sapiens
ucggccccgccaccugcccagcgugcccuggcucuccagaaccuucuaucccacagucaggcc

SEQ ID NO: 727905 - RNA, 63 nt, Homo Sapiens
agaaagucuuaagcaaaauacucccaggucucacuccagaacauaaaaauggugugugaucaa

SEQ ID NO: 727906 - RNA, 63 nt, Homo Sapiens
aaacccaguguccaucuuuccacccucccugaucuccagaaccuucgacugacccccuugucu

SEQ ID NO: 727907 - RNA, 63 nt, Homo Sapiens
gaccugcacgggacuuguggaugggccuggacucuccagaaacuacuugggcagagcaaagga

SEQ ID NO: 727908 - RNA, 63 nt, Homo Sapiens
caacagaccaggaggggcccccaccugauggaccuccagaaaaacggaucacagccacuaugg

SEQ ID NO: 727909 - RNA, 63 nt, Homo Sapiens
uggggagggagugggccuggaucugggaccucccuccagaauuuccuccagaugggggcagug

SEQ ID NO: 727910 - RNA, 63 nt, Homo Sapiens
cuuccuggugcccaccaggcacuacggcuuccucuccagaauguggcuuugccugagcacaga

SEQ ID NO: 727911 - RNA, 63 nt, Homo Sapiens
auugaauaacuagaacacaagccacuguuucagcuccagaaaaaagaaagggcuuuaacguuu

SEQ ID NO: 727912 - RNA, 63 nt, Homo Sapiens
acagggauuccuccuuucccccccaaauauuaacuccagaaacuaggccugacuggggacacc

SEQ ID NO: 727913 - RNA, 63 nt, Homo Sapiens
agcacacaauuucaagccauuuucagaucagaacuccagaaguguugacaagaugccuauucg

SEQ ID NO: 727914 - RNA, 63 nt, Homo Sapiens
gaggauccuucaguucuggccauuccagggacccuccagaaacacaguguuucaagagacccu

SEQ ID NO: 727915 - RNA, 63 nt, Homo Sapiens
ggguccccaucaucccagcugcucccaaauaaacuccagaagaggaaucugugggccugugag

SEQ ID NO: 727916 - RNA, 63 nt, Homo Sapiens
aaaucaccuauucacugcuuaugcagucggaagcuccagaagaacaaagagcccaauuaccag

SEQ ID NO: 727917 - RNA, 63 nt, Homo Sapiens
acucugucguugccuugaucuugaacuuccagccuccagaacuaugagaaauaaaauucuguu

SEQ ID NO: 727918 - RNA, 63 nt, Homo Sapiens
aguugcaguauuucaaagucccuauccaggucacuccagaaaaggguauugaaacguugaaau

SEQ ID NO: 727919 - RNA, 63 nt, Homo Sapiens
ugcugcauuuaggccaggucuccaauugcuuuccuccagaaaguguguucccgucuagugagg

SEQ ID NO: 727920 - RNA, 63 nt, Homo Sapiens
cccaaacuccuggccuucugugguuucccuuugcuccagaaacacagaugugucuaaagacuu

SEQ ID NO: 727921 - RNA, 63 nt, Homo Sapiens
gaaacguacacuaucauugcuaaacuaacaguccuccagaaauuuaauaagauguuuuugauu

SEQ ID NO: 727922 - RNA, 63 nt, Homo Sapiens
uuaagugaccuccuucaucacauccugcaguaucuccagaagcagcacuaggguuugaguuuc

SEQ ID NO: 727923 - RNA, 63 nt, Homo Sapiens
ccacguguauuguccgggcucagaaugggaggacuccagaagaugagagaaaccucuuuaucc

SEQ ID NO: 727924 - RNA, 63 nt, Homo Sapiens
uuagccuuaccaccuuuuaaaaaauuuguuauucuccagaaacaguaaauaggugaguagggg

SEQ ID NO: 727925 - RNA, 63 nt, Homo Sapiens
cucagucagugauuuuuugaugcuucucuuauccuccagaauagagaccuaaggacacgugga

SEQ ID NO: 727926 - RNA, 63 nt, Homo Sapiens
cccuguccccagucagagauaacauccaacuaacuccagaagcggaagaggauauauuuaaca

SEQ ID NO: 727927 - RNA, 63 nt, Homo Sapiens
cucuggccuugguggccccauucuacaccaucucuccagaacuggauggagcgggucuccuga

SEQ ID NO: 727928 - RNA, 63 nt, Homo Sapiens
gccaugccagcugggcucgucuggccccucgcacuccagaaaacuccccccggggagaggaca

SEQ ID NO: 727929 - RNA, 63 nt, Homo Sapiens
ugcuguugccauagccccauaaagacccugagacuccagaauccuguaacuuaucuagaaaga

SEQ ID NO: 727930 - RNA, 63 nt, Homo Sapiens
uacucccucaguaaagcauucccucacagguuucuccagaaagccuauccaguuuuccugguu

SEQ ID NO: 727931 - RNA, 63 nt, Homo Sapiens
caggugcuggcgcccguucucguguccugacaccuccagaacggcuuuugccacugacucggc

SEQ ID NO: 727932 - RNA, 63 nt, Homo Sapiens
gugcaggaugugcauuagcaguuuauuauaauucuccagaaauccugcuucacuugcagauaa

SEQ ID NO: 727933 - RNA, 63 nt, Homo Sapiens
auauggcugggccaacucugggggauucagagucuccagaaagguugcccugagaguguccca

SEQ ID NO: 727934 - RNA, 63 nt, Homo Sapiens
acccuuccucaucugugccucucccuccucacacuccagaauugaacagugcucugccucuaa

SEQ ID NO: 727935 - RNA, 63 nt, Homo Sapiens
ugcugccuuuuuaaguuuugggacuggccguggcuccagaaugaggggaagcugcuaggggaa

SEQ ID NO: 727936 - RNA, 63 nt, Homo Sapiens
accucaacaaugucaguggcuauuaacucccaucuccagaagccgcacuuuccugaagccucu

SEQ ID NO: 727937 - RNA, 63 nt, Homo Sapiens
cagugacucuugaacauggaugcucccucugcccuccagaacuuuggaaucagcaggccucug

SEQ ID NO: 727938 - RNA, 63 nt, Homo Sapiens
cacccucuccccugcagucuccccacaccuggacuccagaauucuccaugagucaagcccccu

SEQ ID NO: 727939 - RNA, 63 nt, Homo Sapiens
cucccacccuggggccaacuaggaacaugaucccuccagaaguggacgggggguggggaagga

SEQ ID NO: 727940 - RNA, 63 nt, Homo Sapiens
acugggaucacaggugucagcuccugccuuugccuccagaagcaguccuggcuucaggcaauu

SEQ ID NO: 727941 - RNA, 63 nt, Homo Sapiens
agcacagcucauggagggugccuggacugcucucuccagaaacgcauuuuccuacaccccuuu

SEQ ID NO: 727942 - RNA, 63 nt, Homo Sapiens
cccacccugacagcccaacacaaagagaaaccccuccagaacucuuuccuagauccacacuuu

SEQ ID NO: 727943 - RNA, 63 nt, Homo Sapiens
auccccaaucacccuaaucuuugaacauuccaacuccagaaugaccuaacaacaucacuuuug

SEQ ID NO: 727944 - RNA, 63 nt, Homo Sapiens
cagacaugauuucaacauggacacuuuaacuuucuccagaacugucagucuuuguaauuauuu

SEQ ID NO: 727945 - RNA, 63 nt, Homo Sapiens
ccaucacuguucuuuaaagcagaaaggaaagaacuccagaaucguaucuuuggagaaggagaa

SEQ ID NO: 727946 - RNA, 63 nt, Homo Sapiens
cucuacaauagaaaaaaaagugaauuuuaucuacuccagaaguuauuuuuuuaagcaacauca

SEQ ID NO: 727947 - RNA, 63 nt, Homo Sapiens
gugcaugcagaucagcuguucugaaucacuggacuccagaaauaauggagagaagaccucuuc

SEQ ID NO: 727948 - RNA, 63 nt, Homo Sapiens
cagaggugacaaaugugaggaggacucacugcccuccagaaaaauuaccaccagacugacucc

SEQ ID NO: 727949 - RNA, 63 nt, Homo Sapiens
agcaguugucccccaaauaccucauucucgccccuccagaagagagcugcuggugaacuccau

SEQ ID NO: 727950 - RNA, 63 nt, Homo Sapiens
cauaacccuucucuccacacuuucuccccacuccuccagaaggcuuuucccuaaucauucccu

SEQ ID NO: 727951 - RNA, 63 nt, Homo Sapiens
ugccagagugcacuggggggccugccucucuggcuccagaagccuucucauaguguacaccca

SEQ ID NO: 727952 - RNA, 63 nt, Homo Sapiens; identical to SEQ ID NO: 240602

SEQ ID NO: 727953 - RNA, 63 nt, Homo Sapiens
aacuugggagaugauggugcaagcagagucauucuccagaaggaaaauagaagaccuugcaag

SEQ ID NO: 727954 - RNA, 63 nt, Homo Sapiens
guggagggcuguucgcccuuuuaucucuagaaucuccagaaagggaauuguacugugcuacaa

SEQ ID NO: 727955 - RNA, 55 nt, Homo Sapiens; identical to SEQ ID NO: 240605

SEQ ID NO: 727956 - RNA, 63 nt, Homo Sapiens
gcauuuuauguaguucuaaaugaacaccaaaaucuccagaaauguuaucuucauaugauaugc

SEQ ID NO: 727957 - RNA, 63 nt, Homo Sapiens
acccucccaggcaucccauauguaaauuuuugucuccagaaaaauguucucaugcccucaauc

SEQ ID NO: 727958 - RNA, 63 nt, Homo Sapiens
uaaucaaagaauuuucuguauuggcaggauguacuccagaauacagggaggacugggcacuau

SEQ ID NO: 727959 - RNA, 63 nt, Homo Sapiens
gccucuggacucaccuugagguacccaggcccacuccagaaugaaaggaguacccagggccug

SEQ ID NO: 727960 - RNA, 63 nt, Homo Sapiens
guaaccaagugggaaaauaacagaggguacaagcuccagaacacccaaccccaucucagagcu

SEQ ID NO: 727961 - RNA, 63 nt, Homo Sapiens
cuaaaauuuaauuucuuuuugagaggggcugcucuccagaaagagaaguguuugauggugcca

SEQ ID NO: 727962 - RNA, 63 nt, Homo Sapiens
ggccauucagcaagacaacaccggccaggccaccuccagaaacaggggcucaggaaaacggga

SEQ ID NO: 727963 - RNA, 63 nt, Homo Sapiens
cacaaagagaagagggcuuggaucaugaauagacuccagaauccaagucuauaauauaauuau

SEQ ID NO: 727964 - RNA, 63 nt, Homo Sapiens
gccuucccuacccugacgccucccagucaucaucuccagaacucccagcggggcucccugagc

SEQ ID NO: 727965 - RNA, 63 nt, Homo Sapiens
auauuagauuucugacuugcaaauauguuuguacuccagaagaauuagaggaaaagcagauac

SEQ ID NO: 727966 - RNA, 63 nt, Homo Sapiens
gcugggauuacaagugugagccaccacaccuggcuccagaaauuuuauuuuauuuuuuugagg

SEQ ID NO: 727967 - RNA, 63 nt, Homo Sapiens
acuauguguguuguuuccauagcucuucacuuccuccagaagccuccuuacauuaaaaagccu

SEQ ID NO: 727968 - RNA, 63 nt, Homo Sapiens
uguaguaauuucuauuugcacugugccuuucaacuccagaaacauucugaagauguacuugga

SEQ ID NO: 727969 - RNA, 63 nt, Homo Sapiens
uuaaucuagauaauaaaagcuuuuuggggcaaccuccagaacugugaaaaauaaauuuguuau

SEQ ID NO: 727970 - RNA, 63 nt, Homo Sapiens
cgcuaaccgcccuucugcguuccauaaagguggcuccagaaagggcauccucuaccccaagcc

SEQ ID NO: 727971 - RNA, 63 nt, Homo Sapiens
caucauacuggaaagcaaacaccuuuccuccagcuccagaauuccuugucucugaaugacucu

SEQ ID NO: 727972 - RNA, 63 nt, Homo Sapiens
gccuccucuucaacugaccagccuccaugcugccuccagaauggucuuucuaaugugugaauc

SEQ ID NO: 727973 - RNA, 63 nt, Homo Sapiens
aaaccugacaaagagacuguaauauuguaguugcuccagaaugucaagggcagcuuacggaga

SEQ ID NO: 727974 - RNA, 63 nt, Homo Sapiens
aguguggucagucugccugcugcugugcgguagcuccagaaccaccucguuccugguuuuguu

SEQ ID NO: 727975 - RNA, 63 nt, Homo Sapiens
uuuguaagaacaaucauaaaaggacuuguuagucuccagaacaucugcuaaaaugcaaguaua

SEQ ID NO: 727976 - RNA, 63 nt, Homo Sapiens
augaguuuaugggaaugccuuuucccucuggcacuccagaacaaaccucuauauguugcugaa

SEQ ID NO: 727977 - RNA, 63 nt, Homo Sapiens
aaauaccauauaugauccucgaaaugauaauaucuccagaauauuguuuucacccaaauuuga

SEQ ID NO: 727978 - RNA, 63 nt, Homo Sapiens
accuauuuuugaggaccuugaaaaucuuaaucucuccagaagggauacugcauugguucuucu

SEQ ID NO: 727979 - RNA, 63 nt, Homo Sapiens
uuugccuauauucucccuacaagaauauuuuugcuccagaaagacauguucuuuucucaaauu

SEQ ID NO: 727980 - RNA, 63 nt, Homo Sapiens
cauuugguuacccucgggauggccauccacugucuccagaaagagaccacuuagagggucucu

SEQ ID NO: 727981 - RNA, 63 nt, Homo Sapiens
uuaaaccuucaggaacaccaguuaggaaaauagcuccagaaaauauagauauauuuuauuuuu

SEQ ID NO: 727982 - RNA, 63 nt, Homo Sapiens
gauauaaaggaagaauauuuccuuuauguguuucuccagaauggugccuguuucucucugugu

SEQ ID NO: 727983 - RNA, 63 nt, Homo Sapiens
agaagccacaccauuugcaccauccacgccuugcuccagaaggccuggccgccuucucccugg

SEQ ID NO: 727984 - RNA, 63 nt, Homo Sapiens
gaagguagccagugccugagcccugucagcugccuccagaagggucagaucucaggcuugucc

SEQ ID NO: 727985 - RNA, 63 nt, Homo Sapiens
ugugccagacuuacagaaaaugccagagauuggcuccagaauuccucgccuagcacucugccu

SEQ ID NO: 727986 - RNA, 63 nt, Homo Sapiens
cuagcccagcagguuaaucucuaacaccuggaucuccagaaacuaauugugaaggagucaggg

SEQ ID NO: 727987 - RNA, 63 nt, Homo Sapiens
cuggugguggacacagcuuuaauaaacagggaucuccagaacaagcuccacucucugguuucu

SEQ ID NO: 727988 - RNA, 63 nt, Homo Sapiens
cuaauauccuaaaauacagauacagcuugaccucuccagaacaccaaugagggcgaaugacau

SEQ ID NO: 727989 - RNA, 57 nt, Homo Sapiens; identical to SEQ ID NO: 240639

SEQ ID NO: 727990 - RNA, 63 nt, Homo Sapiens
gaaagcuuggaaacuuacccgcaauaaguuguucuccagaaaauucacuuucaauuauaucca

SEQ ID NO: 727991 - RNA, 63 nt, Homo Sapiens
aucauuugaaacaucuuuuguaccauggaagugcuccagaagauugcuuucaaaaggacugcu

SEQ ID NO: 727992 - RNA, 63 nt, Homo Sapiens
gcaaccacauugaauucuugaaaugguaacugucuccagaacaguuuuaguauauauagccca

SEQ ID NO: 727993 - RNA, 63 nt, Homo Sapiens
cuacuacaauggccaaguaccugcccacaggcucuccagaaaaauagccaucuacaauaguaa

SEQ ID NO: 727994 - RNA, 63 nt, Homo Sapiens
uuguucgguuauguucauguuccauugcuacaucuccagaauacagagagugaacagcaccuc

SEQ ID NO: 727995 - RNA, 63 nt, Homo Sapiens
agagcauguucugcauguaugaucccccauccccuccagaauaggaaauaaagcccuguucug

SEQ ID NO: 727996 - RNA, 63 nt, Homo Sapiens
caaauguuagacuacacauuaucaguuaauuaacuccagaaagauaugcagugguucuuacag

SEQ ID NO: 727997 - RNA, 63 nt, Homo Sapiens
uucugaugggggagggcggucuucccacuuccucuccagaacuccagaaagagcagugugcuu

SEQ ID NO: 727998 - RNA, 63 nt, Homo Sapiens
ggggagggcggucuucccacuuccucuccagaacuccagaaagagcagugugcuuaugcuuca

SEQ ID NO: 727999 - RNA, 63 nt, Homo Sapiens
aaaacuucucuucugagccucuuuaacagcuuucuccagaaccagugucugaaccacccugga

SEQ ID NO: 728000 - RNA, 63 nt, Homo Sapiens
uaguaauaaggagaggguugggggugggcagggcuccagaaagucagcagugugccugggcac

SEQ ID NO: 728001 - RNA, 63 nt, Homo Sapiens
aaauguguauauuuaauguuuuauuguuagcuucuccagaaaauugaugcaaauucugguaau

SEQ ID NO: 728002 - RNA, 63 nt, Homo Sapiens
gcugcucucaggcacccccuucuucauugcucucuccagaaaggguugcuagccuuaacuuca

SEQ ID NO: 728003 - RNA, 63 nt, Homo Sapiens
uuauguuucugccuucggcgagagaacagcaagcuccagaaaguggcugcgccuucagccccg

SEQ ID NO: 728004 - RNA, 63 nt, Homo Sapiens
agcacaguagugcgggccugggcccugcuccaccuccagaaguggcuggauguacccugccug

SEQ ID NO: 728005 - RNA, 63 nt, Homo Sapiens
ccugcgacccucacuggccuggccuugugggggcuccagaaaagaggcuaggagaggccagag

SEQ ID NO: 728006 - RNA, 63 nt, Homo Sapiens
caaggcacagcccuuguugggagggagaacccucuccagaaacccugccaccauggugucuug

SEQ ID NO: 728007 - RNA, 63 nt, Homo Sapiens
cugagcugccccuggcuuccuuuaaggaggcugcuccagaaggaaccuggguggggagggcga

SEQ ID NO: 728008 - RNA, 63 nt, Homo Sapiens
ucuguaccccaaagagaguucucaugaaauauucuccagaauguauucauuaucaagaaaaug

SEQ ID NO: 728009 - RNA, 63 nt, Homo Sapiens
auucucuugaugccaccuucagauccuuuuauucuccagaauaauucuuaacagugguucaaa

SEQ ID NO: 728010 - RNA, 63 nt, Homo Sapiens
ugagcccgucucccggacagguugaggaagcugcuccagaagcgccucggaaggggagcucuc

SEQ ID NO: 728011 - RNA, 63 nt, Homo Sapiens
gaaaauucuggaacuugaaaaaguaguaagggccuccagaauugacuuagcccuaguaauaaa

SEQ ID NO: 728012 - RNA, 63 nt, Homo Sapiens
uuaaauuuuuuaauuaccuguuguaggguguuccuccagaagcaaagagcaaaauuuuacugu

SEQ ID NO: 728013 - RNA, 63 nt, Homo Sapiens
aaacuucagucuggacuucuuuuugccagagaacuccagaaaccagucaggcucucagucagc

SEQ ID NO: 728014 - RNA, 63 nt, Homo Sapiens
uuuaguguagaugaaaaugucuucacccacucccuccagaacaauagcuucccuucccucccc

SEQ ID NO: 728015 - RNA, 63 nt, Homo Sapiens
cguggccuuccagaacagucagacucccacugucuccagaaguagaaaaacacaaacaaaaac

SEQ ID NO: 728016 - RNA, 63 nt, Homo Sapiens
ucagcagaucugagccaccguguuccugugccacuccagaaccccagugucauuugcuccucc

SEQ ID NO: 728017 - RNA, 63 nt, Homo Sapiens
auguguguggcuucccuaccuaacugugcucugcuccagaaacaucugaauguuccagcagcc

SEQ ID NO: 728018 - RNA, 63 nt, Homo Sapiens
cagcagagccuucuagggucuggagguuucagccuccagaagaucacuuuaguuaugcuaaag

SEQ ID NO: 728019 - RNA, 63 nt, Homo Sapiens
uuaccacaaaagcaaaauuugcauuuaugauuucuccagaaauuauuuacaguauugagcuuu

SEQ ID NO: 728020 - RNA, 63 nt, Homo Sapiens
accuggccgccagccccuucaucacugugaggucuccagaaggagcguuggucucuguuugga

SEQ ID NO: 728021 - RNA, 63 nt, Homo Sapiens
cagcaguguuggaggggccuaagcuggaggcugcuccagaacuuugucccucacugccccagu

SEQ ID NO: 728022 - RNA, 63 nt, Homo Sapiens
accccagugccuuuugacaaccaaugcauuuggcuccagaaagauuccuacuggagcuuaguu

SEQ ID NO: 728023 - RNA, 63 nt, Homo Sapiens
acggguaucuccgcguggugcaguaaagcuggccuccagaaacgggacccucuuccucuagca

SEQ ID NO: 728024 - RNA, 63 nt, Homo Sapiens
cuuguaaauaaaauaaauccagccgccauccuucuccagaauuuauuucaccaagccaauacc

SEQ ID NO: 728025 - RNA, 56 nt, Homo Sapiens; identical to SEQ ID NO: 240675

SEQ ID NO: 728026 - RNA, 63 nt, Homo Sapiens
ccaaguauucguguaaauuaguaacuaaaguagcuccagaaugagggcuuugaucauucaaaa

SEQ ID NO: 728027 - RNA, 63 nt, Homo Sapiens
uagagcccaucaauauuuuucuacugcccgugucuccagaaugucaagcugaaaauaauaguu

SEQ ID NO: 728028 - RNA, 63 nt, Homo Sapiens
ggggagcagaguccgagcuuugccucuccccaucuccagaagauaugacaacacauacacacu

SEQ ID NO: 728029 - RNA, 63 nt, Homo Sapiens
gacaauguccccuauucaggugugguucucuaacuccagaaaggagcacagaccccagagucu

SEQ ID NO: 728030 - RNA, 63 nt, Homo Sapiens
uucauguuuaugaguauuaguuuaaauuucauacuccagaacuuuuauauccaaaauuugugu

SEQ ID NO: 728031 - RNA, 63 nt, Homo Sapiens
aaggcauuaaagaaaauagcgauuuuagccuuucuccagaacuuguuaaugucaauaugauga

SEQ ID NO: 728032 - RNA, 63 nt, Homo Sapiens
cugcuugcccccagagagccguucagguggggucuccagaagguguggucaccugaggaugug

SEQ ID NO: 728033 - RNA, 63 nt, Homo Sapiens
auacuggaagccaccucuggcuuggaagacccccuccagaagcgacccuuaagugccacccuu

SEQ ID NO: 728034 - RNA, 63 nt, Homo Sapiens
auggcagagcagacaggccgaccagcaucaagucuccagaaacacaguaagagauaguguuga

SEQ ID NO: 728035 - RNA, 63 nt, Homo Sapiens
caccaaggaaaaagcagagaucaaccugcuguccuccagaaagaacugacccuuccuucaucc

SEQ ID NO: 728036 - RNA, 63 nt, Homo Sapiens
gcuagacuaagaauuagguguugaugacuccugcuccagaaucaucagcuuauauuuuuuauc

SEQ ID NO: 728037 - RNA, 63 nt, Homo Sapiens
gacuguccuauaaguuguacacccuccacaguacuccagaaaguacacuggaagcuuugauuc

SEQ ID NO: 728038 - RNA, 63 nt, Homo Sapiens
ccagauuuguuuccuuuuggccuccugcaaagucuccagaagaaaauuugccaaucuuuccua

SEQ ID NO: 728039 - RNA, 63 nt, Homo Sapiens
agauguuuacuacaaaagcaugccaaaccuaggcuccagaaaccacguccaucagcugcauac

SEQ ID NO: 728040 - RNA, 63 nt, Homo Sapiens
acuagcauugcacauauagucugcuuucuguuccuccagaauuugaguccuguuaauguagua

SEQ ID NO: 728041 - RNA, 63 nt, Homo Sapiens
cauucuucaacagugccuugcauguaacaagcacuccagaaauguuuguugaaugaaugaaug

SEQ ID NO: 728042 - RNA, 63 nt, Homo Sapiens
auggcuggagagcugaucagccaggcacagaaucuccagaacaaccuagagagugaaugcuaa

SEQ ID NO: 728043 - RNA, 63 nt, Homo Sapiens
aucuccuggcaccuugaucuuggauuuuacagccuccagaacugugagaaaauaaauuucugu

SEQ ID NO: 728044 - RNA, 63 nt, Homo Sapiens
uaaugguacuuaguauuuugaucaaacuuuagucuccagaacuaaacaagucccuaaguuucc

SEQ ID NO: 728045 - RNA, 63 nt, Homo Sapiens
caggaaguacuggagaaaauggacguguuaugacuccagaauuucccaaagcagugcaugcug

SEQ ID NO: 728046 - RNA, 63 nt, Homo Sapiens
aauguuaccuuuuggcuugagaaugucuuucagcuccagaauuauuguuacucauauuuuaau

SEQ ID NO: 728047 - RNA, 52 nt, Homo Sapiens; identical to SEQ ID NO: 240697

SEQ ID NO: 728048 - RNA, 63 nt, Homo Sapiens
uugugaccacuauuguggguugggugcugguagcuccagaauuuauaguaauuuuguuguugu

SEQ ID NO: 728049 - RNA, 63 nt, Homo Sapiens
uaggguuaugugugucauucagcuucacagcuacuccagaaaaccaaccucacagccucguag

SEQ ID NO: 728050 - RNA, 63 nt, Homo Sapiens
uguaacuguguuguuauguguccaugugcuagucuccagaacucauccaaagauguccagaug

SEQ ID NO: 728051 - RNA, 63 nt, Homo Sapiens
uuuuucugucagugaaaauaucuugauuguacucuccagaaaauuauuucuaauaauacacua

SEQ ID NO: 728052 - RNA, 63 nt, Homo Sapiens
uugggauuaucgucuucuaacaucucauucaaucuccagaagaucaaaagcuucagugaguua

SEQ ID NO: 728053 - RNA, 63 nt, Homo Sapiens
gacguaacuuagcauggaucaucuuauacugagcuccagaaagccagcucauggaauuuuuuc

SEQ ID NO: 728054 - RNA, 63 nt, Homo Sapiens
uuuauuuuccugucuucuuucuccugugguuugcuccagaauuaagguuuguuuuccauccau

SEQ ID NO: 728055 - RNA, 63 nt, Homo Sapiens
cucccuuuugacacaguuguuucagaaagagcucuccagaagccaauauugagauguaauuca

SEQ ID NO: 728056 - RNA, 63 nt, Homo Sapiens
agaagaaaaaaaaucuuucagauaagagguguucuccagaauggaggaacuacuuggcaugua

SEQ ID NO: 728057 - RNA, 63 nt, Homo Sapiens
acuuaacuguaugugcaacagcaaugaaauuaacuccagaagccuuccaccugcgucacccag

SEQ ID NO: 728058 - RNA, 63 nt, Homo Sapiens
ucaagcugcucaucuguuaguaagugauguucacuccagaacacauucaugaugagaacuuuc

SEQ ID NO: 728059 - RNA, 63 nt, Homo Sapiens
agaagaaaaaaaaucuuucagauaagagguguucuccagaauggaagaacgacuuggcaugua

SEQ ID NO: 728060 - RNA, 63 nt, Homo Sapiens
ucacacugcugugcagccaucaccaccauucaucuccagaauuuguucucagucccaaacuga

SEQ ID NO: 728061 - RNA, 63 nt, Homo Sapiens
ucuauucauaaauguucuauacaguggacagcccuccagaaugguacuucagugccuagugua

SEQ ID NO: 728062 - RNA, 63 nt, Homo Sapiens
aaauaaggaagagggcugagcugagcuucgguucuccagaauguaagaaaacaaaaucuaaaa

SEQ ID NO: 728063 - RNA, 63 nt, Homo Sapiens
cgaccaccagcaccauccucuccucccagcagccuccagaaccaugcccaggucuccugccuc

SEQ ID NO: 728064 - RNA, 63 nt, Homo Sapiens
ugaccucaucaugguucuaguucucauacagaacuccagaauuuuuaaagaacucuauaauug

SEQ ID NO: 728065 - RNA, 63 nt, Homo Sapiens
uuacugaaucugucuacccuucauucaugagaacuccagaaugaguguugaccacugaagcau

SEQ ID NO: 728066 - RNA, 63 nt, Homo Sapiens
ccacacuaagguaaguucagacuagauugaacacuccagaauuuuuuacuacagacuguuuuu

SEQ ID NO: 728067 - RNA, 63 nt, Homo Sapiens
auccccauggagagacagcauugcuccccagcccuccagaaaccuugagcagauccagggauc

SEQ ID NO: 728068 - RNA, 63 nt, Homo Sapiens
cauugccgggguaggguggugucuucaccacagcuccagaaggcacuggugggauguggaguc

SEQ ID NO: 728069 - RNA, 63 nt, Homo Sapiens
gaaagaaucaaauuucuugcccggucacuggcacuccagaagacagcgugccggaaccggcag

SEQ ID NO: 728070 - RNA, 63 nt, Homo Sapiens
acuuucauagucccaaagauaggcagagaacaucuccagaaaugugugugugugugugugugu

SEQ ID NO: 728071 - RNA, 63 nt, Homo Sapiens
ccccauuccccucugagcaucucauggcguucccuccagaacugaagagccacagucuccaga

SEQ ID NO: 728072 - RNA, 63 nt, Homo Sapiens
gugcuuguggagggccugacuagucagacgaaacuccagaacagaaaagccagaggguucacc

SEQ ID NO: 728073 - RNA, 63 nt, Homo Sapiens
ucugaaacacauucuugaagaauaaacagaaaucuccagaaccauaauuuucuucaaugaguu

SEQ ID NO: 728074 - RNA, 63 nt, Homo Sapiens
uagacuucagacccuuaaugauaccugguaauucuccagaagacuauauuacagaaugaugua

SEQ ID NO: 728075 - RNA, 63 nt, Homo Sapiens
aauaaucaucuguguggcauaucaguugacucucuccagaauauuaauuguaaagccaagcuu

SEQ ID NO: 728076 - RNA, 63 nt, Homo Sapiens
caguguggugcuguggaaggcuggcuggaaagacuccagaauccuguugcagcuuccucugcc

SEQ ID NO: 728077 - RNA, 63 nt, Homo Sapiens
gaagagaaugauggauauucaguguggguuugucuccagaacacucugugaggagcuguggga

SEQ ID NO: 728078 - RNA, 63 nt, Homo Sapiens
agcacuagggucccaggagagcugaggauagagcuccagaaacgucccugaggguggagggaa

SEQ ID NO: 728079 - RNA, 63 nt, Homo Sapiens
aggggggaaagagaccagccuuggucccuaagccuccagaaacgucuucuuaauccccaccuu

SEQ ID NO: 728080 - RNA, 63 nt, Homo Sapiens
gcauauuucugugcuguggaugacauggccuuacuccagaaucccaggcccuccacugugacu

SEQ ID NO: 728081 - RNA, 63 nt, Homo Sapiens
gugcuggcaaccacuaagaauucaaacuggggccuccagaacucacuggggccuacagcuuug

SEQ ID NO: 728082 - RNA, 63 nt, Homo Sapiens
ucagccuuaaauacaaaaauaaaacugaaacugcuccagaaagcagcuuucuccaaaaauguc

SEQ ID NO: 728083 - RNA, 63 nt, Homo Sapiens
gaagcccaaaagcucuuaaggagaauuguauuucuccagaagcugcagcaagagguacagcuc

SEQ ID NO: 728084 - RNA, 63 nt, Homo Sapiens
auuauucaauuucaugaauaacucuuguuugcacuccagaaaacaacauacauguuuaaauac

SEQ ID NO: 728085 - RNA, 63 nt, Homo Sapiens
aucuuuuagaauuuuuuuggagguguuuguuuucuccagaauaaagguauuacuuuagaauag

SEQ ID NO: 728086 - RNA, 63 nt, Homo Sapiens
guggcuguguagcauccucagugcaaaacccagcuccagaauuuucaccugguaacgaauuuc

SEQ ID NO: 728087 - RNA, 63 nt, Homo Sapiens
aaaaugcagcuguuguuagacaacuguugaaaacuccagaaauacaucacccaagguggcagu

SEQ ID NO: 728088 - RNA, 63 nt, Homo Sapiens
acccaggccuugacauuguuauucaaauggccccuccagaaaguuuaaugauuuccauuugua

SEQ ID NO: 728089 - RNA, 63 nt, Homo Sapiens
gugaaaccuuggcacaggacugaggauccucuccuccagaaaagcccccucgaggaaauaaau

SEQ ID NO: 728090 - RNA, 63 nt, Homo Sapiens
aggugucuacugaaaagggaaccugcuucuuuacuccagaacgcuguucuuuaaagaccaaga

SEQ ID NO: 728091 - RNA, 55 nt, Homo Sapiens; identical to SEQ ID NO: 240741

SEQ ID NO: 728092 - RNA, 63 nt, Homo Sapiens
gcucagggccuuccccacaguugccacuccuagcuccagaaggcaaauacuugacucccacuc

SEQ ID NO: 728093 - RNA, 63 nt, Homo Sapiens
uaagacaggccacaggagggaggcccaguccuccuccagaaaauuaagaugcuaggaugaggc

SEQ ID NO: 728094 - RNA, 63 nt, Homo Sapiens
uucugggauaacauuuggagcccuucucccugccuccagaaugagacucugauuagcugccuc

SEQ ID NO: 728095 - RNA, 63 nt, Homo Sapiens
auuaaccaccccucucuaguauuccacagcugccuccagaaacagagggggagcaaacaggaa

SEQ ID NO: 728096 - RNA, 63 nt, Homo Sapiens
accccgacggggggccuuauccugggaggcaggcuccagaagcgccagcuccucagccugcuc

SEQ ID NO: 728097 - RNA, 63 nt, Homo Sapiens
cucugaccccauuuguuuuucccugccacaugacuccagaagugugcuacaggaguacaucug

SEQ ID NO: 728098 - RNA, 63 nt, Homo Sapiens
ccuuuggaaauggugaaggaguuccugcaaggucuccagaaccuuggcuaaggugcuguuccu

SEQ ID NO: 728099 - RNA, 63 nt, Homo Sapiens
uucuauuaccuuuaaaaaagagaggauagcaagcuccagaagggucucaaauaauuauuucac

SEQ ID NO: 728100 - RNA, 63 nt, Homo Sapiens
guaaugguggcagaacccacgcgcagcaggcaccuccagaaaggagcgagagcagagcaaacu

SEQ ID NO: 728101 - RNA, 63 nt, Homo Sapiens
ggaguuuucugugagaauaauauugaggggcaacuccagaaguuuuuacuuccgguuucuuca

SEQ ID NO: 728102 - RNA, 63 nt, Homo Sapiens
auuaauaaaacaaaacaaaaguagggacugggacuccagaacccuaaagcaaaauuuccaggg

SEQ ID NO: 728103 - RNA, 63 nt, Homo Sapiens
aacuugauucaucgcugcaaauuccccaauggacuccagaagacuucuagcugaaaaacgagu

SEQ ID NO: 728104 - RNA, 63 nt, Homo Sapiens
ccuagaaacaucucaucauuaagagcauaucuucuccagaaguccagggcaaggacagacuaa

SEQ ID NO: 728105 - RNA, 63 nt, Homo Sapiens
agaaacuguuucuccaggcgcugcugagauggacuccagaagaaaugugggagaaaaucgcug

SEQ ID NO: 728106 - RNA, 63 nt, Homo Sapiens
uaguacgcuuuauuuuuagauauuugaaaaacacuccagaaucaaguggcaaauauuuuaaaa

SEQ ID NO: 728107 - RNA, 63 nt, Homo Sapiens
auagaagcucagccuggccugcacggcucauuccuccagaauuccccguguggcccaccccag

SEQ ID NO: 728108 - RNA, 63 nt, Homo Sapiens
gagccaccauuuuuuauaauuucuaauaaccaacuccagaacuaggagcugaucaacucuuug

SEQ ID NO: 728109 - RNA, 63 nt, Homo Sapiens
gauguuggcaccuuugaauucuacauccuguuucuccagaaugagaauuuguguacaaagaua

SEQ ID NO: 728110 - RNA, 63 nt, Homo Sapiens
auaccuuauaacacugagccacuucuccccacccuccagaagggguccacguugaauucugaa

SEQ ID NO: 728111 - RNA, 63 nt, Homo Sapiens
cauugcauugugggaaucacaaagcaaauaguacuccagaaagacaaauaucagaagcuuccu

SEQ ID NO: 728112 - RNA, 63 nt, Homo Sapiens
uuuagacuguuagacaaaagugcucacgugcagcuccagaauauggaaacagagcaaaagaac

SEQ ID NO: 728113 - RNA, 63 nt, Homo Sapiens
ccgccuuccccaaagcagaggggcugucugugucuccagaaaggggacaucgggggggagggg

SEQ ID NO: 728114 - RNA, 63 nt, Homo Sapiens
gaguuugggcugcaagugcucacagcucuuguucuccagaaacuggagaauugcccucaggag

SEQ ID NO: 728115 - RNA, 63 nt, Homo Sapiens
uuucuacccaugcaacggaagaaaaacccauuacuccagaagaguauaucuaaguaacuaaaa

SEQ ID NO: 728116 - RNA, 63 nt, Homo Sapiens
ccuugaugaagaaguugauaugccuuuucccaacuccagaaagugacaagcucacagaccuuu

SEQ ID NO: 728117 - RNA, 63 nt, Homo Sapiens
uugugucgguuaaaaauucgaaggcuuaugggucuccagaaacucugccagccagccucagug

SEQ ID NO: 728118 - RNA, 63 nt, Homo Sapiens
ucccaaauaacuauuuucuuaucugcaguauuccuccagaagagcuaaccagggcagggcugg

SEQ ID NO: 728119 - RNA, 63 nt, Homo Sapiens
cccuuccaacgcaucacccgccucaaacugcugcuccagaacauucugaagagaacacagccu

SEQ ID NO: 728120 - RNA, 63 nt, Homo Sapiens
ggcuaagguauaaaucaacacacugcuuccuuccuccagaaggucuuacugugaaggaaaaaa

SEQ ID NO: 728121 - RNA, 63 nt, Homo Sapiens
uuaggcuuuuguauuuuuuauagucaguuuugucuccagaaccacuuggcuacacauagacuc

SEQ ID NO: 728122 - RNA, 63 nt, Homo Sapiens
gcagaucccucagcaggaacgcaguauuuguaccuccagaaugccugcggugauauucuaucu

SEQ ID NO: 728123 - RNA, 63 nt, Homo Sapiens
cacuuugagauacuuaaagaaguaaaaagauuucuccagaaaaaauaucaaguauaaugaugu

SEQ ID NO: 728124 - RNA, 63 nt, Homo Sapiens
cuucuggcugauuguuccgagugcuuccucuuucuccagaagcuaguucuguucuguggguuu

SEQ ID NO: 728125 - RNA, 63 nt, Homo Sapiens
augaacugcaguggagaugacuuuuggacagcucuccagaagcucaaaccagcccaacccgag

SEQ ID NO: 728126 - RNA, 63 nt, Homo Sapiens
ucuggacggagcugcuggcagcagcagucucugcuccagaaucgauucaucugugaccuccag

SEQ ID NO: 728127 - RNA, 63 nt, Homo Sapiens
uacuauccaucuugaugagaguauaguuugacucuccagaauguuucuuuucuauagagaaau

SEQ ID NO: 728128 - RNA, 63 nt, Homo Sapiens
gugagaaauacauaccugcucuuggacuucagccuccagaacugcccucaccagaacccaacc

SEQ ID NO: 728129 - RNA, 63 nt, Homo Sapiens
ccuucagcucuugccuugcccuggacccuccuucuccagaagggaucaggguggggacaagga

SEQ ID NO: 728130 - RNA, 63 nt, Homo Sapiens
augcuugugagaaucauuaauaguguucuuuuucuccagaaaaaauauaaauucuacagaaaa

SEQ ID NO: 728131 - RNA, 63 nt, Homo Sapiens
cucuccaaccaccacacuccccgccguacaguucuccagaaucccaggcgaugacaagucuga

SEQ ID NO: 728132 - RNA, 63 nt, Homo Sapiens
ucccaggggccggccuccucugccugguaaugacuccagaacaacaacugggaagaaacuuga

SEQ ID NO: 728133 - RNA, 63 nt, Homo Sapiens
aaggaagcauggcccugacuucagaauuccagacuccagaacuggaagaauaaaugucuguug

SEQ ID NO: 728134 - RNA, 63 nt, Homo Sapiens
ugcauugaauugaauaugaauuucucuaacucucuccagaaaauggauggagauaacuugucu

SEQ ID NO: 728135 - RNA, 63 nt, Homo Sapiens
ugagauucuuuagccacuuuggggagccugucucuccagaagccuuucuuaguggugcccaca

SEQ ID NO: 728136 - RNA, 63 nt, Homo Sapiens
uaaaaugcacggcuaaacuauucagaguuaacacuccagaauuguuaaauuacaaguacuaug

SEQ ID NO: 728137 - RNA, 63 nt, Homo Sapiens
ugagcgccugcagaucccgcaggcuucguuugccuccagaaccuucccgucugauuguuccuc

SEQ ID NO: 728138 - RNA, 63 nt, Homo Sapiens
accuuucuaaaaguuuucaucgccuugguaaagcuccagaaauggacaaugcuagugacugca

SEQ ID NO: 728139 - RNA, 63 nt, Homo Sapiens
cauauugcccggugaugaaaccucacuucaugccuccagaaagaucggcuucucagauggcuu

SEQ ID NO: 728140 - RNA, 63 nt, Homo Sapiens
gaugcagagagcuguggggcguagcuuggcugccuccagaagacucugggccaaagcccaugg

SEQ ID NO: 728141 - RNA, 63 nt, Homo Sapiens
augaaaagcaauacaacuuuagagagggcacaucuccagaaaaauagggauccuggugggagg

SEQ ID NO: 728142 - RNA, 63 nt, Homo Sapiens
gaaggggguggggauuuucuuuagauacgaaaucuccagaaugucauccucgccucucaggcu

SEQ ID NO: 728143 - RNA, 63 nt, Homo Sapiens
ugacgacugggccaugugacgugacacucuacccuccagaaccucccaugggauuccccggcu

SEQ ID NO: 728144 - RNA, 63 nt, Homo Sapiens
ugcucuccacuugcuuuaggcaaaugucaccuucuccagaagcuuuuucuugaagaggcagcu

SEQ ID NO: 728145 - RNA, 63 nt, Homo Sapiens
uagcaauuuccgccuggugacaucagcgccggccuccagaacuuccagcaggccccagucucg

SEQ ID NO: 728146 - RNA, 63 nt, Homo Sapiens
uuuuaaggcuacauuuuggauuuaucugagucucuccagaaguaggagaggagggggagguca

SEQ ID NO: 728147 - RNA, 63 nt, Homo Sapiens
aagcacuuagcgugcuguucugucacaaaauaacuccagaaaggcuuuucuuuggcgauucag

SEQ ID NO: 728148 - RNA, 63 nt, Homo Sapiens
acuuuaaacuuuuauuaccacaguugcugccuccuccagaauuuuugaauuuuaauaaaaggc

SEQ ID NO: 728149 - RNA, 63 nt, Homo Sapiens
cauugcgagaguagcuauuuugaaagaauaauucuccagaaguuaacaucuaauaucuaguau

SEQ ID NO: 728150 - RNA, 63 nt, Homo Sapiens
aaaucaccagcaccuugaucuuugacuucuaaucuccagaauagugagaaauaaauuucuguu

SEQ ID NO: 728151 - RNA, 63 nt, Homo Sapiens
uucuuugccaccagccugucacuccaguggcagcuccagaaacggaggcuguugcuuuuaucc

SEQ ID NO: 728152 - RNA, 63 nt, Homo Sapiens
uacugcuucugucccugcuggcagccucugucccuccagaacggcuaaccagagcacacuguc

SEQ ID NO: 728153 - RNA, 57 nt, Homo Sapiens; identical to SEQ ID NO: 240803

SEQ ID NO: 728154 - RNA, 63 nt, Homo Sapiens
uaauccuugcuuugguuuggaacugccuucgggcuccagaacuuaaauugcuugguccguggc

SEQ ID NO: 728155 - RNA, 63 nt, Homo Sapiens
gugggcugggccgcuggagccuccgccugcuuccuccagaagacacgaaucaugacucacgau

SEQ ID NO: 728156 - RNA, 63 nt, Homo Sapiens
aaucaguguuaguccucugucuucuccauguuucuccagaauucugcuaagcaguuuauaguu

SEQ ID NO: 728157 - RNA, 63 nt, Homo Sapiens
cugcucucagcaauugcaguccccuggaucauacuccagaauucagugguguggggaaacguu

SEQ ID NO: 728158 - RNA, 63 nt, Homo Sapiens; identical to SEQ ID NO: 240808

SEQ ID NO: 728159 - RNA, 63 nt, Homo Sapiens
ucccaacucgucugccguccccccaauuccaagcuccagaaacuucuuggaccuccucccccg

SEQ ID NO: 728160 - RNA, 63 nt, Homo Sapiens
ugcaagagcuucuuagcaguacaucacagcucccuccagaagcccaccgauuucagcgugucc

SEQ ID NO: 728161 - RNA, 63 nt, Homo Sapiens
cccacccaagaaaauaauagucagcuccccaugcuccagaauagcaguuuccuugcaacacuu

SEQ ID NO: 728162 - RNA, 63 nt, Homo Sapiens
auucuauagugugccagagcuuuggauuuguaacuccagaaacugcucuaauuggcugguugg

SEQ ID NO: 728163 - RNA, 53 nt, Homo Sapiens; identical to SEQ ID NO: 240813

SEQ ID NO: 728164 - RNA, 63 nt, Homo Sapiens
accccggcccccugcccguuaaguucuuggucccuccagaaccuaguuguucguugguuauac

SEQ ID NO: 728165 - RNA, 63 nt, Homo Sapiens
agucugucuucaacuauuuuauccaaaauaaaccuccagaagaaaguaguuuucauuuacuua

SEQ ID NO: 728166 - RNA, 63 nt, Homo Sapiens
gagaccuaucgucuuggaacuugccauucuuuccuccagaacaaaauguuaacuuucuaacac

SEQ ID NO: 728167 - RNA, 63 nt, Homo Sapiens
acagacagguuuucacauaaaugcagcccauuucuccagaacccauuugaggggugggggggu

SEQ ID NO: 728168 - RNA, 63 nt, Homo Sapiens; identical to SEQ ID NO: 240818

SEQ ID NO: 728169 - RNA, 63 nt, Homo Sapiens
aggcugcuugguacugaguauacuuaaauauaacuccagaauccagggacuugguguuaaaac

SEQ ID NO: 728170 - RNA, 63 nt, Homo Sapiens
acgccucaacauauacuugugcucuuccuuugccuccagaagaaguuuuuccuugauugugcu

SEQ ID NO: 728171 - RNA, 63 nt, Homo Sapiens
cugccuccaccacaggcauccugcaaaugcagacuccagaauccccagcaucagcgggaacca

SEQ ID NO: 728172 - RNA, 63 nt, Homo Sapiens
gugagaaauaaauguguuuuuggaccucccagccuccagaacugucugcuggcaccuugaucu

SEQ ID NO: 728173 - RNA, 63 nt, Homo Sapiens
auuuuguuugcuuugacccuggcuacacugaaccuccagaaucauacaacauacuuaaugcag

SEQ ID NO: 728174 - RNA, 63 nt, Homo Sapiens
gccguagcaguuugacgauaaauauaaauuucgcuccagaaagucuuucacauggcuacuggg

SEQ ID NO: 728175 - RNA, 63 nt, Homo Sapiens
gcacaggaacgaaauaccuccaaaagaugaaaacuccagaaaccucuuaugagucauuuuuuu

SEQ ID NO: 728176 - RNA, 63 nt, Homo Sapiens
aguccguuauuugggaaaguaauauuagguuuccuccagaaauuauugguaaucuuuucugug

SEQ ID NO: 728177 - RNA, 63 nt, Homo Sapiens
aagaagcccuuuacauuuccguccacaaggcaacuccagaagaccuggguugucucaaauccu

SEQ ID NO: 728178 - RNA, 63 nt, Homo Sapiens
guaucuggucagguugacccuaagaaugcauuccuccagaagaaaguugcaggcacaacaguu

SEQ ID NO: 728179 - RNA, 52 nt, Homo Sapiens; identical to SEQ ID NO: 240829

SEQ ID NO: 728180 - RNA, 63 nt, Homo Sapiens
gccauucucccaaacuaaugucccaguuuagggcuccagaaaauaugaggcucugauuuccua

SEQ ID NO: 728181 - RNA, 63 nt, Homo Sapiens
ccccacccaggccaggcaugccugagccagggucuccagaaagcuuucacaggcagccagugc

SEQ ID NO: 728182 - RNA, 63 nt, Homo Sapiens
ucagguaugccucaccaauucgcauuuguauaucuccagaaauugcauaugaugccagccuca

SEQ ID NO: 728183 - RNA, 63 nt, Homo Sapiens
aaauuccuaaagcuuuuaggccuuagagcaagacuccagaauguucugugguuucuuagguga

SEQ ID NO: 728184 - RNA, 63 nt, Homo Sapiens
caauaaaguguaauauuucugguagauuagcugcuccagaauugucauuggucaauaggggag

SEQ ID NO: 728185 - RNA, 63 nt, Homo Sapiens
ccagccggcuucccccaagguucagaggggacccuccagaagcuguuuuucaauuguugacau

SEQ ID NO: 728186 - RNA, 63 nt, Homo Sapiens
ggaggugguguucuauaccuaaaggaugaccugcuccagaaacagcaccagcacagcauguau

SEQ ID NO: 728187 - RNA, 63 nt, Homo Sapiens
uucacacaugacuaccuuugagcuaaugacugucuccagaaaauaacugugccccaagaagug

SEQ ID NO: 728188 - RNA, 63 nt, Homo Sapiens
auaugccagguagacaccagcccaaguacccuccuccagaagucugugacuaccuugucacua

SEQ ID NO: 728189 - RNA, 63 nt, Homo Sapiens
cugaaaauguuuuguuagcuuuuccuucuuucucuccagaagaaacauggauagaugauagcu

SEQ ID NO: 728190 - RNA, 63 nt, Homo Sapiens
cugcucuaauuucuuuugcccauauaugaguaucuccagaaugucuacaaauaguuuuuguag

SEQ ID NO: 728191 - RNA, 63 nt, Homo Sapiens
guuugaggccaccaaaagaucaacagacaaaugcuccagaaaucuaugcugacugugacacaa

SEQ ID NO: 728192 - RNA, 63 nt, Homo Sapiens
ccaucucgggcacaggcccaccccgccccaccccuccagaacacggcucacgcuuaccucaac

SEQ ID NO: 728193 - RNA, 63 nt, Homo Sapiens
cuauaaaguuaaacauacacuuuuacuuuaggacuccagaauuccacuucuaguuauuuauuc

SEQ ID NO: 728194 - RNA, 63 nt, Homo Sapiens
accagaauucuucuguaauucugcccaugacuccuccagaauuuuaguagauacagggugggu

SEQ ID NO: 728195 - RNA, 63 nt, Homo Sapiens
guuuuauccaugaggaagauuuuuaacaaaagccuccagaagauuuccccucaguuuccauug

SEQ ID NO: 728196 - RNA, 63 nt, Homo Sapiens
aagauauggugaaggcagaacugcucacaccagcuccagaagcacguccucugacuucacugc

SEQ ID NO: 728197 - RNA, 63 nt, Homo Sapiens
cuggagcagcccaccuagagagucuaaugagaacuccagaaaggagcagcccgccuagaaccc

SEQ ID NO: 728198 - RNA, 63 nt, Homo Sapiens
guguguuucccugaugcggguucagccuccucacuccagaaacgcucuccucugggcccugcc

SEQ ID NO: 728199 - RNA, 63 nt, Homo Sapiens
ggacagccacggccaagugggcagccacagcuccuccagaaagcuaagucacagggaucugcu

SEQ ID NO: 728200 - RNA, 63 nt, Homo Sapiens
ucaccagagagcuuucagcuuaggcauggggagcuccagaaggaaaggcagaugacggggagu

SEQ ID NO: 728201 - RNA, 63 nt, Homo Sapiens
ccaggagucgacaguuuugggaauucagccacacuccagaaaguuugggggcggggggguggg

SEQ ID NO: 728202 - RNA, 63 nt, Homo Sapiens
agugcaauucagaaggcagcgaauuaacuucuccuccagaacagacucccugacaaaagugaa

SEQ ID NO: 728203 - RNA, 63 nt, Homo Sapiens
aagaaucucaaccuggagggacccccuuccuaccuccagaauacuucccaccugagcaugcug

SEQ ID NO: 728204 - RNA, 63 nt, Homo Sapiens
ccgccuguccuuccagcaugcagacaaaaggaucuccagaaagagccagcagcugugguacuc

SEQ ID NO: 728205 - RNA, 63 nt, Homo Sapiens
uggaaauccuaguuuccucuaacuucaguccugcuccagaauuccaagcucccugccccaaau

SEQ ID NO: 728206 - RNA, 63 nt, Homo Sapiens
ucugcccaggaggcaggggaacacacuagugcucuccagaauccagaguuccuucucacccag

SEQ ID NO: 728207 - RNA, 63 nt, Homo Sapiens
ugcuccuuuacccucuuggucucugccuggggccuccagaagcagucacugcugcaagguggc

SEQ ID NO: 728208 - RNA, 63 nt, Homo Sapiens
gcagaaagcgggugcuguaguccucccaacaaacuccagaacagccggaagggagcccccugc

SEQ ID NO: 728209 - RNA, 63 nt, Homo Sapiens
cugcuguggacugcaucagguugcgucuggggccuccagaacuaagaccaagacaccugggga

SEQ ID NO: 728210 - RNA, 63 nt, Homo Sapiens
ccagccagaagccugauugggugcuuaaugaaucuccagaauguggccuggaguauuuauaug

SEQ ID NO: 728211 - RNA, 63 nt, Homo Sapiens
gaaagaccuuacuucauuucguagaauuuauuacuccagaacauucagaauaauuauugcaua

SEQ ID NO: 728212 - RNA, 63 nt, Homo Sapiens
uccucuucaucucagcauucuccaucacuuccccuccagaaaaacggauggaaggaagcccuc

SEQ ID NO: 728213 - RNA, 63 nt, Homo Sapiens
ccaaggagcuucagggcaguccuucuggcacugcuccagaauuccuccuucuuggugugucug

SEQ ID NO: 728214 - RNA, 63 nt, Homo Sapiens
cuagauacuguguuaugugcaacuguagaaacccuccagaaauuuccacugcuguucuucacu

SEQ ID NO: 728215 - RNA, 50 nt, Homo Sapiens; identical to SEQ ID NO: 240865

SEQ ID NO: 728216 - RNA, 63 nt, Homo Sapiens
accacacagacucugggccuccccgcaaaauggcuccagaauuagaguaauuaugagauggug

SEQ ID NO: 728217 - RNA, 63 nt, Homo Sapiens
aaauggcaacauggaauauuguccuccaugccccuccagaaggaccuaggagaguaggugagc

SEQ ID NO: 728218 - RNA, 63 nt, Homo Sapiens
aaggcgucgaggaauuggaaagauuugcacacccuccagaaaggagagacgcaaucuccccuc

SEQ ID NO: 728219 - RNA, 63 nt, Homo Sapiens
aaugcuuauuaugaguuuaagaagcaguucuuccuccagaaagaagggggcgauagcaugcag

SEQ ID NO: 728220 - RNA, 63 nt, Homo Sapiens
ccgcagcccuggggccaguaggaagcggacccgcuccagaaguccccacgagaagaagaagaa

SEQ ID NO: 728221 - RNA, 63 nt, Homo Sapiens
gacuguguugacugacgagccgagggguggccgcuccagaagggugcccagucaggccgcacc

SEQ ID NO: 728222 - RNA, 63 nt, Homo Sapiens
uagaccuuugcuuaugcaaaucugaaggguuggcuccagaacucaucauucauucucaagacc

SEQ ID NO: 728223 - RNA, 63 nt, Homo Sapiens
ccucgucugggaauucgagagagguucucugcccuccagaagcagcagauacaugucagugca

SEQ ID NO: 728224 - RNA, 63 nt, Homo Sapiens
uguucaauaaaaugcuuuuaugguucuaacuaccuccagaaugcccaaucccaaauuuuguuu

SEQ ID NO: 728225 - RNA, 63 nt, Homo Sapiens
uagaagccugucucuguaccccagacucucccacuccagaaugccaccaccgacucucccaac

SEQ ID NO: 728226 - RNA, 63 nt, Homo Sapiens
auuggggucacauaugucccccaggagugucaucuccagaauuauggacagagaagaaaauga

SEQ ID NO: 728227 - RNA, 63 nt, Homo Sapiens
cuuuuuuccuuuuuacaaacauugcuuuccauucuccagaacuucuucccaacuucuuacacc

SEQ ID NO: 728228 - RNA, 63 nt, Homo Sapiens
gacuggucaugaagcucauggaacuccugcacucuccagaaguaaaaggggcugggacacucu

SEQ ID NO: 728229 - RNA, 63 nt, Homo Sapiens
cuauccacuguauuuccacaaagguggcuucugcuccagaacuacucucuauuauugggcaua

SEQ ID NO: 728230 - RNA, 63 nt, Homo Sapiens
gucuaaaugcugaaaaaacaaccauuugcauggcuccagaaauacgugucucagacugcaugu

SEQ ID NO: 728231 - RNA, 63 nt, Homo Sapiens
cauccugucaaucacucuguuuucugccauguacuccagaacucugggagacuucucuguaca

SEQ ID NO: 728232 - RNA, 63 nt, Homo Sapiens
gccucggccucagcuccguuaugugcuggugcccuccagaaaaagugccuucugugaguuuaa

SEQ ID NO: 728233 - RNA, 63 nt, Homo Sapiens
gggauguaucagggaugaucagcugaugagaggcuccagaaggauuucuagaucgcuucaagc

SEQ ID NO: 728234 - RNA, 63 nt, Homo Sapiens
uuuaagcuagcuuuaccuaagccacuucucagccuccagaauacucucucugggguugugagu

SEQ ID NO: 728235 - RNA, 63 nt, Homo Sapiens
aguguaaacugcaguuuuccgguuaaaaaugaucuccagaauauacaggggcacauuuucugu

SEQ ID NO: 728236 - RNA, 63 nt, Homo Sapiens
caauaccaaccugaaaguucagacuucugucuucuccagaaggaauguagcugcgucauaagg

SEQ ID NO: 728237 - RNA, 63 nt, Homo Sapiens
uuggaacaccuggcaugugauugguaaaauccucuccagaaucaagcugauagcuccuccaug

SEQ ID NO: 728238 - RNA, 63 nt, Homo Sapiens
cagcaagaacacuuggaaugacagaauuauguccuccagaaacagcagugguuacccagacuu

SEQ ID NO: 728239 - RNA, 63 nt, Homo Sapiens
agacauuggcauucaaauguagcuccagugucucuccagaauaugugaucauuguugaacuuc

SEQ ID NO: 728240 - RNA, 63 nt, Homo Sapiens
ucaaagaagggaagaaacucccagcugcagguccuccagaaaauggagccugucucaggaagg

SEQ ID NO: 728241 - RNA, 63 nt, Homo Sapiens
auaguuauccccaggccuggcacgucaaagaggcuccagaaauguuugcugagugagugauga

SEQ ID NO: 728242 - RNA, 63 nt, Homo Sapiens
ugccgguacugaagaugcuccuuccucccccugcuccagaagguagcaaacuguacauuccuu

SEQ ID NO: 728243 - RNA, 63 nt, Homo Sapiens
uccugcagacauccuacucgaguuacuugcuaacuccagaaauauacucucuuugccagauga

SEQ ID NO: 728244 - RNA, 63 nt, Homo Sapiens
aucccgauucccgggaucuguguuagccagcagcuccagaaaagcccuggcucugcacauaag

SEQ ID NO: 728245 - RNA, 63 nt, Homo Sapiens
acucuuuuugcauaaauaccaguguguucuuaacuccagaaccgagaaauagagaaauauaaa

SEQ ID NO: 728246 - RNA, 63 nt, Homo Sapiens
caugcucgcuucccuuggcaugcauguaguccacuccagaaauguuuacugaacuccagacca

SEQ ID NO: 728247 - RNA, 61 nt, Homo Sapiens
cccaguaaaagauaugauauuuuccauagauaccuccagaauuuuuuucagcaaauggaau

SEQ ID NO: 728248 - RNA, 63 nt, Homo Sapiens
aggaacgguguuauggacugaauguucauguuccuccagaauucauaugcugaagccucuguc

SEQ ID NO: 728249 - RNA, 63 nt, Homo Sapiens
gucugcuggcaccuugaucuugaacuucccagccuccagaacugugagaaagaaaucucuaug

SEQ ID NO: 728250 - RNA, 63 nt, Homo Sapiens
gugggaccuuguaaaaugcucccugucagagcucuccagaauaugcuuguuggagauccuuca

SEQ ID NO: 728251 - RNA, 63 nt, Homo Sapiens
acggugagggcugacucugaacugucucucagucuccagaaaguguucaagccuguuguguuc

SEQ ID NO: 728252 - RNA, 63 nt, Homo Sapiens
aaaggaauuagagggucagaaacacccagguuccuccagaaagcuccuuggagcccaacaacu

SEQ ID NO: 728253 - RNA, 63 nt, Homo Sapiens
auacguauguuuaaaaacccacucaagauuccccuccagaaaaagaaagaugugagauaacuu

SEQ ID NO: 728254 - RNA, 63 nt, Homo Sapiens
ccuaaaauacaauuuugagggauucuccauggacuccagaaacguuuuaugauauggguuagg

SEQ ID NO: 728255 - RNA, 63 nt, Homo Sapiens
aaaccaaaauaccaugggauaaacagcuuuaaucuccagaagaugcugcauuuaucccaagaa

SEQ ID NO: 728256 - RNA, 63 nt, Homo Sapiens
gaaaacaaaucaaauaaauaauuuacaauaucacuccagaaaagagugacaaaucuuuaaagu

SEQ ID NO: 728257 - RNA, 63 nt, Homo Sapiens
aaugagccuccaccaccaagaaaauuucagugacuccagaagaaagcuucgaaagauauccca

SEQ ID NO: 728258 - RNA, 63 nt, Homo Sapiens
ugagaugagccagccgagccugaaaaccuagcucuccagaacagaccuaaucagcuuacaguu

SEQ ID NO: 728259 - RNA, 63 nt, Homo Sapiens
acugcggcacgcgcuucgggcccccugcucccacuccagaagauccucuacccaaagcucugu

SEQ ID NO: 728260 - RNA, 63 nt, Homo Sapiens
gaacucaagcugguuuuaaguggcgccugcucccuccagaaugugaccucaucucccgagcaa

SEQ ID NO: 728261 - RNA, 63 nt, Homo Sapiens
augggaacaucugggugugcuacaucuaaggaccuccagaagcgcccucuuucucccagugau

SEQ ID NO: 728262 - RNA, 63 nt, Homo Sapiens
gcuccccacccccccaaagacaguccuuuccuacuccagaaauccgcaccccgccccaugccc

SEQ ID NO: 728263 - RNA, 63 nt, Homo Sapiens
accuuccaaggugucugguugcccugccucuggcuccagaacagaaagggagccucacgcugg

SEQ ID NO: 728264 - RNA, 63 nt, Homo Sapiens
caccaacuccuauuucccuaccaaccaaggagccuccagaaggaaaggaggaagaaauguuuu

SEQ ID NO: 728265 - RNA, 63 nt, Homo Sapiens
ccucaaccccagggauucccaggaagcagaacucuccagaagaaggguuuugaucauuccagc

SEQ ID NO: 728266 - RNA, 63 nt, Homo Sapiens
gcccugccucaacaggguccauugccuccucgccuccagaacuuggagcagggaagugggcac

SEQ ID NO: 728267 - RNA, 63 nt, Homo Sapiens
ggaaagauauagcauagugguucucagcacagucuccagaacagaagcaucuguaguaccugg

SEQ ID NO: 728268 - RNA, 63 nt, Homo Sapiens
agacauugaccccucccuccaugugguaaaccacuccagaauggccaccaggcuucccagagu

SEQ ID NO: 728269 - RNA, 63 nt, Homo Sapiens
uuguguuacaucuauaaagagcaaaauaacacacuccagaacuuggcaguuguagcauuaguu

SEQ ID NO: 728270 - RNA, 63 nt, Homo Sapiens
agcucauguuugugauccucuaucuggacagcucuccagaauccuguguugccccuguucugc

SEQ ID NO: 728271 - RNA, 63 nt, Homo Sapiens
gaaugugccaugcaugaagcaaaggauuccaggcuccagaaaaaaugaaugaacucaccuuga

SEQ ID NO: 728272 - RNA, 63 nt, Homo Sapiens
agcugggcaggacaaguaggacaucccuggagccuccagaagggacuggccucugcccacacc

SEQ ID NO: 728273 - RNA, 63 nt, Homo Sapiens
aaguaugauuuguguucaauccugaccaagaggcuccagaauagagggagugugcgaaucaag

SEQ ID NO: 728274 - RNA, 63 nt, Homo Sapiens
cugaugguaucaauggauuuugauauugccacccuccagaaucgaagaagacacagaagccuu

SEQ ID NO: 728275 - RNA, 63 nt, Homo Sapiens
cggugcgugagguucccggccggcguccccugccuccagaacggcccagcguggggcccuagc

SEQ ID NO: 728276 - RNA, 63 nt, Homo Sapiens
acagcccuucuccccaaggggucccuccccugccuccagaaucaccuggcagcuuuucuugcc

SEQ ID NO: 728277 - RNA, 63 nt, Homo Sapiens
uggguucguccccagugagagucaggggagaggcuccagaaccgugccggugacaagcugucu

SEQ ID NO: 728278 - RNA, 63 nt, Homo Sapiens
caaggcuccaggcccgugugugccggccacugucuccagaacgacacggcgucaaaaccaagc

SEQ ID NO: 728279 - RNA, 63 nt, Homo Sapiens
ucugcugagacugagcaccuuacagauauuuuucuccagaagauggugcuggguaauaaaauc

SEQ ID NO: 728280 - RNA, 63 nt, Homo Sapiens
auccccuuuccuccccaccuuccccagacucagcuccagaauaccuucuucgcugcuagagaa

SEQ ID NO: 728281 - RNA, 63 nt, Homo Sapiens
auuauucgcuccaagaaagaugcuaagucugagcuccagaagagacugugcuggguguggcuu

SEQ ID NO: 728282 - RNA, 63 nt, Homo Sapiens
aggugccgccuuggccgggcccccacgugucuucuccagaaugugucugucuuugccuggugu

SEQ ID NO: 728283 - RNA, 63 nt, Homo Sapiens
gcgacacacacacacuuauggcaccagccuggacuccagaaaaaggguguccagguauugugu

SEQ ID NO: 728284 - RNA, 63 nt, Homo Sapiens
agcuggagcucgaucaugccugcgugacaaagccuccagaaaaauccuugaaagacaggacau

SEQ ID NO: 728285 - RNA, 63 nt, Homo Sapiens
ugcggccacagcacuagagucacccccccaggccuccagaaccuuacuggcacuguggcacug

SEQ ID NO: 728286 - RNA, 63 nt, Homo Sapiens
ugaucuguacuaucuagugucuaaaacacuauucuccagaaaaaucaaucauuuucuagcccu

SEQ ID NO: 728287 - RNA, 63 nt, Homo Sapiens
acaaugaauguaguuaacugguuccugcucacacuccagaauuaaauucuauugaaaaaggaa

SEQ ID NO: 728288 - RNA, 63 nt, Homo Sapiens
ugcagaucacagugcuggaagcaggaacccaggcuccagaagguguugccaggggcccagaug

SEQ ID NO: 728289 - RNA, 63 nt, Homo Sapiens
aaagaugaacaucggaauaacaaacauuguccucuccagaaaguccuuucuuucuccauacug

SEQ ID NO: 728290 - RNA, 63 nt, Homo Sapiens
cucaggauuuagaaagucuguaagccauccaugcuccagaaagcaccgaucuguuguaguugc

SEQ ID NO: 728291 - RNA, 63 nt, Homo Sapiens
cguggaggcgugugcaggcuuggaagaagaacucuccagaacauggaacuuaacccucuuuug

SEQ ID NO: 728292 - RNA, 63 nt, Homo Sapiens
cugaggccagagggaggagagaauugcucauggcuccagaacugguggcaaguuucucuggac

SEQ ID NO: 728293 - RNA, 63 nt, Homo Sapiens
uguggggagaguggggaaucuaaacacugggaacuccagaaguucuggauacagccuuuuggg

SEQ ID NO: 728294 - RNA, 63 nt, Homo Sapiens
gccccucacccuucuuccccccgccuacccucccuccagaauacccccuucaccccuccuugc

SEQ ID NO: 728295 - RNA, 63 nt, Homo Sapiens
agcugcuucuccccccauccugaccccuucucucuccagaaacggguaacuggggggccacca

SEQ ID NO: 728296 - RNA, 63 nt, Homo Sapiens
ucagcucaauugcugugcaggaucaaucacagucuccagaagaccuucuucauccuuccuuac

SEQ ID NO: 728297 - RNA, 63 nt, Homo Sapiens
ugacaaggcaccagcaggacgcagcucacaccacuccagaaccgcaagggggaccgaugcugu

SEQ ID NO: 728298 - RNA, 63 nt, Homo Sapiens
cccgcgccccacauaccugccuuuugguccuggcuccagaaaacuccuggucgugccccgucu

SEQ ID NO: 728299 - RNA, 63 nt, Homo Sapiens
acuuuaugaaaugguacacuuggcagauuuuaacuccagaagcuguggacacuuuugacagcu

SEQ ID NO: 728300 - RNA, 63 nt, Homo Sapiens
gaugccaucuuccugaauguagguuuauggagccuccagaacauuguuccaaguuugucaaug

SEQ ID NO: 728301 - RNA, 63 nt, Homo Sapiens
uuuccaucccaaaggcagucagaauggagggagcuccagaaacuguuccugccccacaggaau

SEQ ID NO: 728302 - RNA, 63 nt, Homo Sapiens
agccccucggaggcagaggaacacaacagugcccuccagaagcgcaaaccucacagggucccc

SEQ ID NO: 728303 - RNA, 63 nt, Homo Sapiens
uuauccacuguggaugaugaaccaucaucgaaacuccagaaauacucaugguuuuaaauauag

SEQ ID NO: 728304 - RNA, 63 nt, Homo Sapiens
uggaaccauuucucccgcagacccccacccagccuccagaagccccacacccacccccacccc

SEQ ID NO: 728305 - RNA, 63 nt, Homo Sapiens
uagcuucaccccaaucccaggugcaagccccugcuccagaagaaaagcagcucuccccucaga

SEQ ID NO: 728306 - RNA, 63 nt, Homo Sapiens
ugccagcuucucucuccaggagugagucaccugcuccagaagagagauggggaggagauaugg

SEQ ID NO: 728307 - RNA, 63 nt, Homo Sapiens
gccaagagaacccaaaccaaugccucagccccacuccagaauaucugcccuucacuuagcacc

SEQ ID NO: 728308 - RNA, 63 nt, Homo Sapiens
gcaggagaauaaauuuguguuugagcuccuggccuccagaauuugagcccauugaaacugauc

SEQ ID NO: 728309 - RNA, 63 nt, Homo Sapiens
cuguucuuuaaagaccaagaaccugcuucuuuacuccagaacuaggugucuacugaaaaggga

SEQ ID NO: 728310 - RNA, 63 nt, Homo Sapiens
agguacucagcuuucugggaaguauuuccccuucuccagaagcgaaggaaaaugaagagagcc

SEQ ID NO: 728311 - RNA, 63 nt, Homo Sapiens
aaucccccgcugcagggacacccacgcccuucucuccagaagccgggcaggcagaauccggcc

SEQ ID NO: 728312 - RNA, 63 nt, Homo Sapiens
gagggagaggaggggguuggggaggacccaccucuccagaauggcgacuguccccauccgccu

SEQ ID NO: 728313 - RNA, 63 nt, Homo Sapiens
caucuaaguuagagcuggcaccagaacugagaccuccagaaaucuauuccaguauuuuuucca

SEQ ID NO: 728314 - RNA, 63 nt, Homo Sapiens
cccaguuucugucaucuuaaucacuagaauguucuccagaaaccuguccugcuuugccuuuug

SEQ ID NO: 728315 - RNA, 63 nt, Homo Sapiens
uggcuuagaggagcuccaaauaucuuagaguaucuccagaaacauucucagaaaauccaacca

SEQ ID NO: 728316 - RNA, 57 nt, Homo Sapiens; identical to SEQ ID NO: 240966

SEQ ID NO: 728317 - RNA, 63 nt, Homo Sapiens
aauagcagcugacaacuuucaguuguggcagcucuccagaagugugauacuccaacaccgucc

SEQ ID NO: 728318 - RNA, 63 nt, Homo Sapiens
gcaagggcucagcugggaucugcgcccggccugcuccagaacgcagcccacucgccaccggug

SEQ ID NO: 728319 - RNA, 63 nt, Homo Sapiens
ggguuugcuggggaacuggcgccaucgccgggacuccagaaccgcagaagccuccccagcuca

SEQ ID NO: 728320 - RNA, 63 nt, Homo Sapiens
cccugcccucuccucacaggucuguugcagggacuccagaaaccauucugggagccguggaug

SEQ ID NO: 728321 - RNA, 63 nt, Homo Sapiens
gguucaugaugcauaaagcgcuaggcccuagaacuccagaaacagcacagcuggggcggggac

SEQ ID NO: 728322 - RNA, 63 nt, Homo Sapiens
ccacagccacaccucaccgcccaguccagcugucuccagaaggggacaggcaguccgcggucu

SEQ ID NO: 728323 - RNA, 63 nt, Homo Sapiens
uuggccaccaguucuucggccagcaccucugcccuccagaaccugcagccuggaggggugagg

SEQ ID NO: 728324 - RNA, 63 nt, Homo Sapiens
cagcccggagcccagcccccugccccggcccugcuccagaacccagcccagaucggaggacaa

SEQ ID NO: 728325 - RNA, 63 nt, Homo Sapiens
uagaacccaauccaauuuggagccccagcccaacuccagaacccaacccuucucuagaaucca

SEQ ID NO: 728326 - RNA, 63 nt, Homo Sapiens
cggcugggucugcguccuuuccugugccuuucccuccagaaugcggccucagaccuagaagcu

SEQ ID NO: 728327 - RNA, 63 nt, Homo Sapiens
ugucccagcuagcaccugagagcugggccuccucuccagaaucauguggaggggccagaggcc

SEQ ID NO: 728328 - RNA, 63 nt, Homo Sapiens
auuuucucggaggugauaggcuuccacacaggucuccagaagcccugcauugaauauccaucc

SEQ ID NO: 728329 - RNA, 63 nt, Homo Sapiens
uguuccagcaucuucccuggauggcuggaggaacuccagaaaauauccaucuucuuuuugugg

SEQ ID NO: 728330 - RNA, 63 nt, Homo Sapiens
ccagcuccacugcccaggcccccaagagggcagcuccagaagcugcccagggcuccgggaccc

SEQ ID NO: 728331 - RNA, 63 nt, Homo Sapiens
cccuuaggggcugaggaagcugcccucgaaacccuccagaagacaucuguccugcagaggccc

SEQ ID NO: 728332 - RNA, 63 nt, Homo Sapiens
uccuuauccaaaucaauaaagagagaauccucccuccagaaggguuucuaaaaacagcccuca

SEQ ID NO: 728333 - RNA, 63 nt, Homo Sapiens
ucuaggacagauuuuacguggagaguugaacuacuccagaaacuaaagaguaauguuucuaga

SEQ ID NO: 728334 - RNA, 63 nt, Homo Sapiens
gugagaccuccuggaacacuggcaucucugagccuccagaagggguucugggccuaguugucc

SEQ ID NO: 728335 - RNA, 63 nt, Homo Sapiens
ccccgccuggcacucagccuugccagagauuggcuccagaauuuuugccaggcuuacagaaca

SEQ ID NO: 728336 - RNA, 63 nt, Homo Sapiens
gagagggucucucuccuagcugcuacccaggaccuccagaaggagcccuuggaccucugggag

SEQ ID NO: 728337 - RNA, 63 nt, Homo Sapiens
uacuaagugcuuaguaaauguuagauaaguauucuccagaauugauguaaauuauuuuuaaac

SEQ ID NO: 728338 - RNA, 63 nt, Homo Sapiens
guuauauaaauuccacauuuuuaugcaacuaaucuccagaacauuuuuccucuuaccaagaag

SEQ ID NO: 728339 - RNA, 63 nt, Homo Sapiens
uugcaagucuaggagaguguggcguccuuucagcuccagaaugggaguggcacaggugaccca

SEQ ID NO: 728340 - RNA, 63 nt, Homo Sapiens
cuugccugcuagggaccucgaggagccucuccccuccagaagacgcugggcuucacggcugcc

SEQ ID NO: 728341 - RNA, 63 nt, Homo Sapiens
ucaggcucucagugacccuuacauggcucugcccuccagaacuagagugaggcucuguccaau

SEQ ID NO: 728342 - RNA, 63 nt, Homo Sapiens
gugaggcaauaaauuucucuuugcacuuccaggcuccagaacuacccugucuccaccuugaua

SEQ ID NO: 728343 - RNA, 63 nt, Homo Sapiens
ucucuccucaaaggaaagaauuccuccccgggacuccagaauuauggucacagggccguccug

SEQ ID NO: 728344 - RNA, 63 nt, Homo Sapiens
ugcaggcgccucugguucucgcaggcgagaccccuccagaaucucucgggcugccagcgaugg

SEQ ID NO: 728345 - RNA, 63 nt, Homo Sapiens
accgugagaaccaggcauucggaaaccauugcccuccagaacagcggacgggggucccgaggu

SEQ ID NO: 728346 - RNA, 63 nt, Homo Sapiens
gcugggauuacaaaugugaguaccugccucagccuccagaaguaacuucuaggcucaagcauc

SEQ ID NO: 728347 - RNA, 63 nt, Homo Sapiens
gagccagucaugcuaaaugcgacagccuggugacuccagaaugagucaaacucucauuuaggu

SEQ ID NO: 728348 - RNA, 63 nt, Homo Sapiens
ugccagguucuccccuugagaguuuuuccaagacuccagaagggccgggugucuuuagggauc

SEQ ID NO: 728349 - RNA, 63 nt, Homo Sapiens
ggggcucugggagggauguuuccuccauuucaacuccagaaguagguaacugagagcagaugg

SEQ ID NO: 728350 - RNA, 63 nt, Homo Sapiens
ugcauaaucagcgcccuggaugccuuucucuggcuccagaauacuccagaauccacaaagccg

SEQ ID NO: 728351 - RNA, 63 nt, Homo Sapiens
cacaaagccgugccuuucucccaaguuccugcacuccagaaucacccccuccagcuccaguuu

SEQ ID NO: 728352 - RNA, 63 nt, Homo Sapiens
agaagccagcuccuggaguuggcacagggugcucuccagaacgacaggaaaccaggcagagga

SEQ ID NO: 728353 - RNA, 63 nt, Homo Sapiens
accaccccauauuaugauuagugucagaaaauacuccagaacagagaauuagagaauuuauuu

SEQ ID NO: 728354 - RNA, 63 nt, Homo Sapiens
cacaggagcugcccccagugggagacucagagacuccagaaggagaucucauacucaacagaa

SEQ ID NO: 728355 - RNA, 63 nt, Homo Sapiens
ccucaacacuugagggcccagaaagucugaucucuccagaaugaucagcccagaggaaugcug

SEQ ID NO: 728356 - RNA, 62 nt, Homo Sapiens
guaaauuaggaggcucaacaauaaaacauuaugcuccagaaauuaugugagaugugcuauau

SEQ ID NO: 728357 - RNA, 63 nt, Homo Sapiens
aucuguaagcaccuugaucuuggacuucucagccuccagaauugugagaaauaaauuucuguu

SEQ ID NO: 728358 - RNA, 63 nt, Homo Sapiens
gagacaagcauggugcugcugcuucugcugcuucuccagaaaaucccugggacaccuuuguuc

SEQ ID NO: 728359 - RNA, 63 nt, Homo Sapiens
cuuugcaggcguccaauccuagaaaccaauggucuccagaacucucacacaaguguuuuucug

SEQ ID NO: 728360 - RNA, 63 nt, Homo Sapiens
ugacuggcauccugcuuuccagugccugccagccuccagaagagccaggugccugacuaguac

SEQ ID NO: 728361 - RNA, 63 nt, Homo Sapiens
guuguuaguuuugaagaguggaggagcuaggggcuccagaaagaaucuuacacauguguugaa

SEQ ID NO: 728362 - RNA, 63 nt, Homo Sapiens
uccuuucaugugaaguuuuuuauuguggaaucacuccagaagacuuaucccuugaauuuucaa

SEQ ID NO: 728363 - RNA, 63 nt, Homo Sapiens
agcagcuagaaagagaaaaaauuggguaagggacuccagaagcgcccaacauacgcacugggc

SEQ ID NO: 728364 - RNA, 63 nt, Homo Sapiens
ucauuccagauccagagaucucaacggggacaacuccagaagguucuggccccaacccuugac

SEQ ID NO: 728365 - RNA, 63 nt, Homo Sapiens
uugucuuacccuccggugugugggucugugccucuccagaaucccugugugccccuggcuuuc

SEQ ID NO: 728366 - RNA, 63 nt, Homo Sapiens
agguccagccuaggcccccuauucugggaagggcuccagaagagguggggggaccccaaagcc

SEQ ID NO: 728367 - RNA, 63 nt, Homo Sapiens
gccagaagugcaauuaaccuuacuguugacauccuccagaaugacaagucuugcuaaauguga

SEQ ID NO: 728368 - RNA, 63 nt, Homo Sapiens
cugggaaaauaaaguccucuugaacuucccagccuccagaacuaccuacugauguuuugaugu

SEQ ID NO: 728369 - RNA, 63 nt, Homo Sapiens
cucuggcuagaggccagccccaguccaaauguccuccagaagccuggcuagaguccucacucc

SEQ ID NO: 728370 - RNA, 63 nt, Homo Sapiens
uucuagcucuggggucuggccccucuccucugucuccagaagcuggaaacauuuaauuuauac

SEQ ID NO: 728371 - RNA, 63 nt, Homo Sapiens
gcugggauuacaggcguacacuccugccucagccuccagaauaucuccuggauucaaacaauu

SEQ ID NO: 728372 - RNA, 63 nt, Homo Sapiens
cccuugaagggccuuugggacuccacucuccuucuccagaaccauaccaugggaaggagccau

SEQ ID NO: 728373 - RNA, 63 nt, Homo Sapiens
aacaagaaagccaucucuuccugcuugaaucugcuccagaauuaaguguucaguaaauauuug

SEQ ID NO: 728374 - RNA, 63 nt, Homo Sapiens
caugaugaacugugaucugcucuuagccgcagucuccagaaccaucuccuaccccacauccug

SEQ ID NO: 728375 - RNA, 63 nt, Homo Sapiens; identical to SEQ ID NO: 241025

SEQ ID NO: 728376 - RNA, 63 nt, Homo Sapiens
ucuauaacagaagugacauguguacugauuuuucuccagaaauauggaugcuguuguauucag

SEQ ID NO: 728377 - RNA, 63 nt, Homo Sapiens
ccuaggccuuuucaugcuucauuucuuccacuucuccagaaaauggaagcuaugaagcaacau

SEQ ID NO: 728378 - RNA, 63 nt, Homo Sapiens
uuccuccacacaggucgccgugagucaagcugccuccagaaccucagagcuucccuggugggc

SEQ ID NO: 728379 - RNA, 63 nt, Homo Sapiens
ugaccgggcuguucuguagacucaggaccguggcuccagaacuccugugccaggcgggaggga

SEQ ID NO: 728380 - RNA, 63 nt, Homo Sapiens
uccggccggagaggccucccgcggacgccgucucuccagaacuccgcuuccaagagggagccu

SEQ ID NO: 728381 - RNA, 63 nt, Homo Sapiens
cuauccugggagaucuaccugaaggagaacuaccuccagaaccgacaguuccagcaaaagcag

SEQ ID NO: 728382 - RNA, 63 nt, Homo Sapiens
cgcaucccacucuaugcgaaccacaagacccuccuccagaaggcagccgcugaguucggggcu

SEQ ID NO: 728383 - RNA, 63 nt, Homo Sapiens
gggugcagggggcugugggcauccagcgucauccuccagaaccucacaucugaacugggggca

SEQ ID NO: 728384 - RNA, 63 nt, Homo Sapiens
gauaacaaaaucaaauaguaugguagagacacgcuccagaaggagauugcuuugugaagcucu

SEQ ID NO: 728385 - RNA, 63 nt, Homo Sapiens
gugagucaguaccuguuguuucaaacuuuuggccuccagaacuaagcacagcccugcuugaau

SEQ ID NO: 728386 - RNA, 63 nt, Homo Sapiens
cugacuuaagagaguaagauuugggacagccaucuccagaaacagacaggcuggauuccagug

SEQ ID NO: 728387 - RNA, 63 nt, Homo Sapiens
gcuggaaaggaugcugccagagcugcugacugucuccagaagggcugguucccggaaugaauc

SEQ ID NO: 728388 - RNA, 63 nt, Homo Sapiens
guggaaacaaagcaggaccagcaggcacagcaccuccagaacagugccccggaugaccagagg

SEQ ID NO: 728389 - RNA, 63 nt, Homo Sapiens
cugccuucuggcugacaauccuggaaaucuguucuccagaauccaggccaaaaaguucacagu

SEQ ID NO: 728390 - RNA, 63 nt, Homo Sapiens
ccauagggagcuggcuggggguuuccgugggagcuccagaacuuuccccagcugagugaagag

SEQ ID NO: 728391 - RNA, 63 nt, Homo Sapiens
auaggacaauuugcugaggucugagaggacucccuccagaaaaucccugaucucuuaaaauuu

SEQ ID NO: 728392 - RNA, 63 nt, Homo Sapiens
gcugcagccuacugaggaggcagaggccaccuccuccagaaagcccucggccugggccgccgc

SEQ ID NO: 728393 - RNA, 63 nt, Homo Sapiens
acugccuuucuuccccucaagucaacuuuugugcuccagaaaauuuucuauucuguaagucug

SEQ ID NO: 728394 - RNA, 63 nt, Homo Sapiens
aagauccugcggcuggggccgucugccuacacgcuccagaagggccagcgcagagcugggaug

SEQ ID NO: 728395 - RNA, 63 nt, Homo Sapiens
ccgugacugcugccucaucgauaccccauuuagcuccagaaagcaaagaaaacucgaguaaca

SEQ ID NO: 728396 - RNA, 63 nt, Homo Sapiens
caggggcuauagcgauggggugaacucccuacucuccagaauccaccgaggcucccgugacuu

SEQ ID NO: 728397 - RNA, 63 nt, Homo Sapiens
gcagcuccacagggcagggccuggcacacuggccuccagaaggucuccucugcagcucaggga

SEQ ID NO: 728398 - RNA, 63 nt, Homo Sapiens
cccugcccugcgagugugucccuguacccacaccuccagaauggugccucccauuuccccuca

SEQ ID NO: 728399 - RNA, 63 nt, Homo Sapiens
uaaacuggcuuacuauagacuucguaaaaauggcuccagaagaguaacaaacugaaaucuuug

SEQ ID NO: 728400 - RNA, 63 nt, Homo Sapiens
ucugucuggggacgaaggguuggacgggaugaccuccagaagucccuucaauuucuaguaccu

SEQ ID NO: 728401 - RNA, 63 nt, Homo Sapiens
uuagccuccagguccagacuacuacucuauguucuccagaagggugcuaagucaccuacugaa

SEQ ID NO: 728402 - RNA, 63 nt, Homo Sapiens
gccuaugaggcaucuggccccugguagccagcucuccagaauuacuuguagguaauuccucuc

SEQ ID NO: 728403 - RNA, 60 nt, Homo Sapiens; identical to SEQ ID NO: 241053

SEQ ID NO: 728404 - RNA, 63 nt, Homo Sapiens
caaggccagagacuucaagucuaucugaaaagucuccagaagucuaaccccagauaaauagcc

SEQ ID NO: 728405 - RNA, 63 nt, Homo Sapiens
cauccauaacauaguaaagagggacauugccagcuccagaaaacuauuuuccaacugaaguca

SEQ ID NO: 728406 - RNA, 63 nt, Homo Sapiens
auaguauuauagagucuuuuaugaguggaaauucuccagaaagauaaagaaucauuagaaauu

SEQ ID NO: 728407 - RNA, 63 nt, Homo Sapiens
auuuuaagaaaauaacaaaguugcaucagcugccuccagaacaguuuuuuuaaaaaagaggac

SEQ ID NO: 728408 - RNA, 63 nt, Homo Sapiens
uaagucccagugucugcuguccacaauaaaauucuccagaaaacugcucuccuguauuauccu

SEQ ID NO: 728409 - RNA, 63 nt, Homo Sapiens
uuuaaggggucuguuucucaugacaccaguuugcuccagaaaggagaaggguaguuugaggug

SEQ ID NO: 728410 - RNA, 63 nt, Homo Sapiens
ucgagcagcacccaccuccagaauucugagauccuccagaaagucaguccuagcaagaagcga

SEQ ID NO: 728411 - RNA, 63 nt, Homo Sapiens
cuuccuccaaggacagaagggagagggugaguccuccagaacugaagggaaggggggucagaa

SEQ ID NO: 728412 - RNA, 63 nt, Homo Sapiens
aaaaggucaagauuucuaucacuuccccgucuucuccagaacuugugucuccagaggaguacg

SEQ ID NO: 728413 - RNA, 65 nt, Homo Sapiens
ccaggaagcacacugggugcagauaaucaggacauuccagagauccccaauuuaagagggucauu

SEQ ID NO: 728414 - RNA, 65 nt, Homo Sapiens
ucuugcgcucagcacacucuagggaauaauuccacuccagagauggggcugcuucaaggucuuuu

SEQ ID NO: 728415 - RNA, 65 nt, Homo Sapiens
augagagcaaaccguaguccccuggagacagcgacuccagagaaccucuugggagacagaagagg

SEQ ID NO: 728416 - RNA, 65 nt, Homo Sapiens
agguggguggacccaagcuugucugcugccugaguuccagagagggaggacccugggguggaggg

SEQ ID NO: 728417 - RNA, 65 nt, Homo Sapiens
gcgggcugcccugugggcuggugcuucaggaggaauccagagaaguguucagaugccccccuugg

SEQ ID NO: 728418 - RNA, 65 nt, Homo Sapiens
cagcuucugcgaucagauuaucaucaccaccacccuccagagaauuuuuacgcaagaagagccaa

SEQ ID NO: 728419 - RNA, 65 nt, Homo Sapiens
gauguugugaggcgugagugagaugauuaaagcguuccagagagugcgcucuuggaugauagccg

SEQ ID NO: 728420 - RNA, 65 nt, Homo Sapiens
acgacuaccuguugggaaggacaaagggaugaggcuccagagagaguuggcugccacagccucug

SEQ ID NO: 728421 - RNA, 65 nt, Homo Sapiens
gaagacaagguguuucugccaaacggggaccuccauccagagaaaaggaagaaggugcagggugg

SEQ ID NO: 728422 - RNA, 65 nt, Homo Sapiens
gugggauuagagucaggccagaaagagaacauucauccagagaucccagaguuggggaucuggcu

SEQ ID NO: 728423 - RNA, 65 nt, Homo Sapiens
aaguucuccguuaguuccuguauuagucaagguuuuccagagaaacagaaucaauauauauuggg

SEQ ID NO: 728424 - RNA, 65 nt, Homo Sapiens
uuaaauauuguacacuuugccuuuuugaguaacauuccagagauagguauuuuuuguaggcuguu

SEQ ID NO: 728425 - RNA, 65 nt, Homo Sapiens
acucaaggacaaggggggacaguuuugccuacagcuccagagacacagagaacaaaggggugacc

SEQ ID NO: 728426 - RNA, 65 nt, Homo Sapiens
ugccagcuggcaaaugagggcuggacucucuucccuccagagaccaccccgcuccuugcugcagc

SEQ ID NO: 728427 - RNA, 65 nt, Homo Sapiens
caagguaucccagccuggacaggcauggaccugucuccagagagaggagccugaaguucgugggg

SEQ ID NO: 728428 - RNA, 65 nt, Homo Sapiens
gagaagcggcgauaccauagaguccagaucuugccuccagagauuugcuuuaccuuccugauuuu

SEQ ID NO: 728429 - RNA, 65 nt, Homo Sapiens
gggggaagccagugauccagccccaccaaggggccuccagagaccccaggaacaauaagugucuc

SEQ ID NO: 728430 - RNA, 65 nt, Homo Sapiens
ccagcucagucccacagccccuugcuucuaagggauccagagaccugcuccagauccucuuuccc

SEQ ID NO: 728431 - RNA, 65 nt, Homo Sapiens
guuguggucuauuuagggacaaagaagguauaaaguccagagaugagaaaacugggucagcccuc

SEQ ID NO: 728432 - RNA, 65 nt, Homo Sapiens
gugauuagggugaggcacaaagaguuucuugaucauccagagaacauugacagacaauuaugaau

SEQ ID NO: 728433 - RNA, 65 nt, Homo Sapiens
guguguuuuguucugaucaagggguagggaaccuuuccagagaagucccauuaguaagaaaugac

SEQ ID NO: 728434 - RNA, 65 nt, Homo Sapiens
cauuagauaugauuuaaccauaagcagcagcacgauccagagauccauugccaucagugaucuca

SEQ ID NO: 728435 - RNA, 65 nt, Homo Sapiens
caguaauuucagccuuauaauuagcaaaaacaucuuccagagaauaaagucuucuguggcuuuag

SEQ ID NO: 728436 - RNA, 65 nt, Homo Sapiens
ugcaauuaauuuuauuaacugauuucuggucuaucuccagagauaaaauaccauuccuucacaac

SEQ ID NO: 728437 - RNA, 65 nt, Homo Sapiens
ccgagccacaccuuuggaaguaaugauuuggccauuccagagauucuggggcuaaaguuuguuuu

SEQ ID NO: 728438 - RNA, 65 nt, Homo Sapiens
agccccucacuuuacagaugaggaaauggaggugguccagagagggucugggauucccaagguca

SEQ ID NO: 728439 - RNA, 65 nt, Homo Sapiens
gugacuggaggggcaggagaugguccaaguguccauccagagaugagacucuuagaaucaaagug

SEQ ID NO: 728440 - RNA, 65 nt, Homo Sapiens
gcuggggcauucuuuacaccuacaaaaaguuauuuuccagagaauguagcuguuuccaggguugc

SEQ ID NO: 728441 - RNA, 65 nt, Homo Sapiens
uaaggagcaccaaagcugaggcuggcucagagaucuccagagaagcugcagccugcccuggcccu

SEQ ID NO: 728442 - RNA, 65 nt, Homo Sapiens
aaggugucuucuuugacuuaaugucuuuaaaaguauccagagauacuacaauauuaacauaagaa

SEQ ID NO: 728443 - RNA, 65 nt, Homo Sapiens
aaaaccagaaauggaaauaaggaauucaggggaguuccagagacuuacaaaaugaacucauuuua

SEQ ID NO: 728444 - RNA, 65 nt, Homo Sapiens
cacuuaaccuaauuuaugcuuucgacuguucuguuuccagagaggaaagccuuuacaaauuacuc

SEQ ID NO: 728445 - RNA, 65 nt, Homo Sapiens
cuauuccaggucucaacauaugccuuagagcaccuuccagagaagcuauguacuacucuaccccc

SEQ ID NO: 728446 - RNA, 65 nt, Homo Sapiens
acaggagccaaagcgagccuuucaugccugcauccuccagagacccaguacaagucaggucaggc

SEQ ID NO: 728447 - RNA, 65 nt, Homo Sapiens
ggcagcauuggcccacaggaagaggccaucucucuuccagagagaggacccaugucuccugggac

SEQ ID NO: 728448 - RNA, 65 nt, Homo Sapiens
auuuuauuugugguuuauuaaggagcaauguaucuuccagagaaguuuucccugccaucucaaag

SEQ ID NO: 728449 - RNA, 65 nt, Homo Sapiens
ggugggacugcaaggagaggaguguugaagccuguuccagagagagggguuuugaugcccucacu

SEQ ID NO: 728450 - RNA, 65 nt, Homo Sapiens
uccuaagggaagggacaguuccccuguuacugugcuccagagaccccccaagguaguaaacccug

SEQ ID NO: 728451 - RNA, 65 nt, Homo Sapiens
aggccugccagccccucuccuuuugcuacauucuauccagagagcuaucaguuugaccacgggcc

SEQ ID NO: 728452 - RNA, 65 nt, Homo Sapiens
guuuaaaaauaaauauugacuuaaauuucuuuucuuccagagauuacauuuuaagccuuuuguuu

SEQ ID NO: 728453 - RNA, 56 nt, Homo Sapiens
cuuuagaauaucuuuucaaguaacucuccagagaacuaaagcaggcagagcuuuga

SEQ ID NO: 728454 - RNA, 65 nt, Homo Sapiens
cuuuuguccccaccucucuguuguugcuguacagauccagagagcaccuguugaagugauauuca

SEQ ID NO: 728455 - RNA, 65 nt, Homo Sapiens
ugcaggugagcccuuuugucauugcuuauacuaaguccagagacaauuuuauuuuugaaggaaaa

SEQ ID NO: 728456 - RNA, 65 nt, Homo Sapiens
uugguuucuacagcaacccuuucuuuccuucccucuccagagaugacucucucuuccuucuccuu

SEQ ID NO: 728457 - RNA, 65 nt, Homo Sapiens
caugaaccugacacaaucuccagcaaucaugcaguuccagagacaugaaacacauacagacucaa

SEQ ID NO: 728458 - RNA, 65 nt, Homo Sapiens
ccaggaacaauaaaaugucuccccaccaaugggccuccagagaccgggggcagccagugacccag

SEQ ID NO: 728459 - RNA, 65 nt, Homo Sapiens
augucuguguggcuuucccuaagggucccaagcaguccagagaagagaguuugcuccaaguggga

SEQ ID NO: 728460 - RNA, 65 nt, Homo Sapiens
cauacuucugagggaagacugcucagggguggguauccagagagcucuuuccaggggaaggaggu

SEQ ID NO: 728461 - RNA, 65 nt, Homo Sapiens
uuguucuucagcaagaauguuauuugaguuucacuuccagagaaccuguaucucuuguucucucc

SEQ ID NO: 728462 - RNA, 65 nt, Homo Sapiens
acaugugagcuucuuuuaggcacagcuucagcauuuccagagaccugaaaauaaugucuacaguc

SEQ ID NO: 728463 - RNA, 65 nt, Homo Sapiens
ccucuggauggcaccagaggcucugcucugaggcuuccagagaguguugaugaggccucuuggac

SEQ ID NO: 728464 - RNA, 65 nt, Homo Sapiens
cccaagacccccgcuuccauggccuacagucaaacuccagagaugcugaggggccagguccacca

SEQ ID NO: 728465 - RNA, 65 nt, Homo Sapiens
gaaacaaacccaggugucucuuaccugugcuggcuuccagagaugcaucaauaguuuauauugcu

SEQ ID NO: 728466 - RNA, 65 nt, Homo Sapiens
auauuuucucucccuccauuaaccugcccuagaccuccagagaccacacugcaccuuaucccagg

SEQ ID NO: 728467 - RNA, 65 nt, Homo Sapiens
gccucucagcagcagggggguucccuccccgcaucuccagagagacccccucucuccucccuucc

SEQ ID NO: 728468 - RNA, 65 nt, Homo Sapiens
agaguauuggguagauauuuuuggaaauagaaauuuccagagaaggauccugguuucaaugacgg

SEQ ID NO: 728469 - RNA, 65 nt, Homo Sapiens
aauagugauaauaacaucagauuuuaauauaacauuccagagaauuguggaaaauacugcauaua

SEQ ID NO: 728470 - RNA, 65 nt, Homo Sapiens
cacaccuagaauguaaguuaaacaaaauaccggcuuccagagaccccuuuucuccagccauauua

SEQ ID NO: 728471 - RNA, 65 nt, Homo Sapiens
gauuuauagccagccaucuaucaccucuagaagguuccagagacagugaaacugcaagaugcucu

SEQ ID NO: 728472 - RNA, 65 nt, Homo Sapiens
uuuaaaucacuugagguaugaaguuuauccuguuuuccagagauaaacauaaguugaucuuccca

SEQ ID NO: 728473 - RNA, 65 nt, Homo Sapiens
gugcaccugccucccacugacccagacccacuuccuccagagaggccucucuccgccugagcuau

SEQ ID NO: 728474 - RNA, 65 nt, Homo Sapiens
gggagagucuaguucacugcccucccucagcugacuccagagauggagguagaaggaauugccuu

SEQ ID NO: 728475 - RNA, 65 nt, Homo Sapiens
cugauggcauucacuucacacagucgucuauguuauccagagauuuuuauuucauuuuacauuuu

SEQ ID NO: 728476 - RNA, 65 nt, Homo Sapiens
gauuguuuaacaguauguguggugaugucauuaucuccagagaggcuucaagaaauccuuuggaa

SEQ ID NO: 728477 - RNA, 65 nt, Homo Sapiens
ugaaauuucccaaaauaauuauggcuucugucaucuccagagauaaucuggcuugguuuacccca

SEQ ID NO: 728478 - RNA, 65 nt, Homo Sapiens
cauuucuuuacugcugccauuuuccucaccaguauuccagagauggucauagcucauuacucuac

SEQ ID NO: 728479 - RNA, 65 nt, Homo Sapiens
aaauuuguaacaugagucagugggacuggugugcuuccagagagugucuucgaggguaucaucau

SEQ ID NO: 728480 - RNA, 65 nt, Homo Sapiens
gagauaaaccaaguuuuuggaaaugguccuguuacuccagagaaaauugagcagcucagguaaga

SEQ ID NO: 728481 - RNA, 65 nt, Homo Sapiens
gcagguucaucggguacugggacccagcagugugauccagagagcagugggagacgcuggcagca

SEQ ID NO: 728482 - RNA, 65 nt, Homo Sapiens
gagcccaccagccagcccuggcccaccccccagccuccagagaagccccgcacgggcugucuggg

SEQ ID NO: 728483 - RNA, 65 nt, Homo Sapiens
agguccugcagacgguauuaguugaugccagccccuccagagaaaagaauccuggcugccaugug

SEQ ID NO: 728484 - RNA, 65 nt, Homo Sapiens
agacauuuauauuaugaaauaauguaggaaugggcuccagagagaguacaauauguguccaugag

SEQ ID NO: 728485 - RNA, 65 nt, Homo Sapiens
cucuucuuucacuggaauuagcaauuuuuauuacuuccagagaucaagaagaaugaauuaaggga

SEQ ID NO: 728486 - RNA, 65 nt, Homo Sapiens
caguggcucuccauugccacucccagccuccuguauccagagauguugccuucuugcauucuggg

SEQ ID NO: 728487 - RNA, 65 nt, Homo Sapiens
gcucugcuucacccuggaaggaccacucuccugccuccagagaaaugccuguauuggucccuucu

SEQ ID NO: 728488 - RNA, 65 nt, Homo Sapiens
aacacaucacuagauugacgacccagucccccaauuccagagagacccacaaaaugcagcccacc

SEQ ID NO: 728489 - RNA, 65 nt, Homo Sapiens
cgacauuagcauaaacacauccacagucgccguauuccagagaugaaucaugauggcaggaaggc

SEQ ID NO: 728490 - RNA, 65 nt, Homo Sapiens
gcaaggagagggagggcccacaggucagaaaaagcuccagagaccucacagcauuguagggcggg

SEQ ID NO: 728491 - RNA, 65 nt, Homo Sapiens
augacccuccccuagucacucauccauccccuggcuccagagauggucacaugacccaggccugg

SEQ ID NO: 728492 - RNA, 65 nt, Homo Sapiens
uccacccagcccacuaacugaggagcuaguguuaauccagagaaccccccgcaaugugcuuccga

SEQ ID NO: 728493 - RNA, 65 nt, Homo Sapiens
accaaauaaaccuucggagaacgucacuaagcuuuuccagagagaagacccuagaugaaguugga

SEQ ID NO: 728494 - RNA, 65 nt, Homo Sapiens
cuguuaacugaagccugcuccuucuuguucugcccuccagagauuugcucaaaugaucaauaagc

SEQ ID NO: 728495 - RNA, 65 nt, Homo Sapiens
gucggaccacuggccaggggaccuuugauugucuuuccagagaugcugcucucugcagggcacca

SEQ ID NO: 728496 - RNA, 65 nt, Homo Sapiens
agcaguuaggcaccuuaacuggagaccagaaaccuuccagagaacacagggcugcaucccgagca

SEQ ID NO: 728497 - RNA, 65 nt, Homo Sapiens
auuaaaggcagaaaaacuggaaaaccuacugcagguccagagacuucuguuuuacaacugggaaa

SEQ ID NO: 728498 - RNA, 65 nt, Homo Sapiens
uagcugcuugcugaggucuuuuaguugguaauaacuccagagaagcagccuguguauauuccuaa

SEQ ID NO: 728499 - RNA, 65 nt, Homo Sapiens
aaaacugaagccuaagagagaaacuguccuaguuguccagagauaaaaaucauauagaccaauug

SEQ ID NO: 728500 - RNA, 65 nt, Homo Sapiens
cucaugaaaauccugaguuaauuuggaaugauaauuccagagauaaaguguccacaacaguuagg

SEQ ID NO: 728501 - RNA, 65 nt, Homo Sapiens
guuugacacccuccuuagagggcugcucuuuuuuuuccagagauaauccuagccauccucuccac

SEQ ID NO: 728502 - RNA, 65 nt, Homo Sapiens
aggugcaagauggaaaggauuguaggugcaagcuguccagagaaaagaguccuuguuccagcccu

SEQ ID NO: 728503 - RNA, 65 nt, Homo Sapiens
ccaacuucacccaugcaugagagacucuccuccuuuccagagagaaucggaucgcaccacgugug

SEQ ID NO: 728504 - RNA, 65 nt, Homo Sapiens
aggugguacaggggauuggaaacaugcuccgcgccuccagagaaaaguugcucccgagguccaug

SEQ ID NO: 728505 - RNA, 65 nt, Homo Sapiens
ggcgggaggaucgcuugaaccugggaggcggagguuccagagagccaagaucgcaccacugcacu

SEQ ID NO: 728506 - RNA, 65 nt, Homo Sapiens
agcuguuucuggauaauggcccucuucugaucacuuccagagaugccuucgauuccauuuuaccu

SEQ ID NO: 728507 - RNA, 65 nt, Homo Sapiens
gcaaauacagcaaucuagagagcacuuuguuaaucuccagagagaaccagcaaaucugcaaacca

SEQ ID NO: 728508 - RNA, 65 nt, Homo Sapiens
caugcccauggccauccaugcuacccucagggagauccagagacuugcuccaggccgaggcuggg

SEQ ID NO: 728509 - RNA, 65 nt, Homo Sapiens
gggacuaaguguaccagagaagcaaaaccaaauauuccagagacuugguagaaagaagaugaaug

SEQ ID NO: 728510 - RNA, 65 nt, Homo Sapiens
ggcuggaagagacuccaggcuggggacuaagggcuuccagagagugacaccggucugcagggagu

SEQ ID NO: 728511 - RNA, 65 nt, Homo Sapiens
uggcagauacuggugggaagugcucccugcuucgguccagagaaccacccucuugcugcucgccc

SEQ ID NO: 728512 - RNA, 65 nt, Homo Sapiens
cugagccagucuuugaacuggucauagacaauuccuccagagacaauaugcaucuacuuggcaag

SEQ ID NO: 728513 - RNA, 65 nt, Homo Sapiens
ccaacucugcccuggcuucuccugagcccugguaguccagagaccagccaaccccaccucuaugc

SEQ ID NO: 728514 - RNA, 65 nt, Homo Sapiens
ugggaccugaaauagucccucuuaccccuggcaccuccagagaacgccuuggguuuuaucuuucc

SEQ ID NO: 728515 - RNA, 65 nt, Homo Sapiens
cagcccacagccaaugcuuacuucccucuucuuuguccagagagccuucaaugucaucuuugcca

SEQ ID NO: 728516 - RNA, 65 nt, Homo Sapiens
ucauguaaaaaaguuagugucuuccauuaacugcuuccagagauguucaaaggcaaaguucauuu

SEQ ID NO: 728517 - RNA, 65 nt, Homo Sapiens
auaauauugucaaauagauaccuuauauaucuuucuccagagaacacugaagucucugcuguaau

SEQ ID NO: 728518 - RNA, 65 nt, Homo Sapiens
aacucuaugagauaugugggcauugaagaauuccuuccagagauaugcagcucauccucacuugg

SEQ ID NO: 728519 - RNA, 65 nt, Homo Sapiens
auuauaaagugcuuuagguaaaugauuuuagauuuuccagagaauuaaaaauguuaggauaacag

SEQ ID NO: 728520 - RNA, 65 nt, Homo Sapiens
acgcuuaacuuucuaugcauuuuagaaauaaggaguccagagacuuuaaauguauuuuuuguaua

SEQ ID NO: 728521 - RNA, 65 nt, Homo Sapiens
gucaugcuggaggagaaggauugaaauguuggguuuccagagagaggaagaugaaaugugcaguu

SEQ ID NO: 728522 - RNA, 65 nt, Homo Sapiens
gggcagaccuggcagagcgcacuggaaaugacuguuccagagagccgagaggcuccccaugcaac

SEQ ID NO: 728523 - RNA, 65 nt, Homo Sapiens
ugggugccuggguugagagaccucuucucacugccuccagagagguaccauucccauuuucucag

SEQ ID NO: 728524 - RNA, 65 nt, Homo Sapiens
ggaccuugacucuuccacacgggccacugcccugcuccagagagugccucaucugaccccacccu

SEQ ID NO: 728525 - RNA, 65 nt, Homo Sapiens
aacaugauagcuuuuaauucgcucauggccugcauuccagagaccucucccccuuacaaggcgug

SEQ ID NO: 728526 - RNA, 65 nt, Homo Sapiens
gagcuuugcuggcaaaagcacuguagcccuuugauuccagagagguguuccaauuuuaacuuuua

SEQ ID NO: 728527 - RNA, 65 nt, Homo Sapiens
aaauccaaugacaaugguacuugcagggaggaacuuccagagaggcagucuuacuccaaagacua

SEQ ID NO: 728528 - RNA, 65 nt, Homo Sapiens
uugcacaaaguucccucuguggaaggagcucugguuccagagaauugagaucagauguggccaag

SEQ ID NO: 728529 - RNA, 65 nt, Homo Sapiens
uaaaguuaguuucuauuuuaucaguaccugcuucuuccagagaaacgaaguugcugcuccggcau

SEQ ID NO: 728530 - RNA, 65 nt, Homo Sapiens
ccagcccucccuggcugugagcagccuccacuguguccagagacaugggccucccacuccuguuc

SEQ ID NO: 728531 - RNA, 65 nt, Homo Sapiens
uauuuucuucuguggcaacuaaguggauaauuacauccagagaaaaaguuucuaaaguuacuacu

SEQ ID NO: 728532 - RNA, 65 nt, Homo Sapiens
ugaucaaagugauacaaucaauuucaaaacaaucuuccagagaccacuugaagguucauaguuuu

SEQ ID NO: 728533 - RNA, 65 nt, Homo Sapiens
aaugcuaaauguguaauaauguaacaugauuucccuccagagaaagcacaauuuaaaacaauccu

SEQ ID NO: 728534 - RNA, 55 nt, Homo Sapiens
aacccaccuugaagguauaacuggauccagagagggaaggacugacaagaaggaa

SEQ ID NO: 728535 - RNA, 65 nt, Homo Sapiens
acagggcucuuugaauguaugucaaacucaguuacuccagagaaaaaacugccuuucccuucaaa

SEQ ID NO: 728536 - RNA, 65 nt, Homo Sapiens
agaaaauauauauauucaagaugcugaaaauccuuuccagagaaaauuuguuucuuuuuaaaauu

SEQ ID NO: 728537 - RNA, 65 nt, Homo Sapiens
aauauuccgccggcauuuagaagacucuuggccucuccagagacgccccuuuccucguccgcucu

SEQ ID NO: 728538 - RNA, 65 nt, Homo Sapiens
aggcaccuugugccacagggggccggcgacugccauccagagaaaggaugggcagccugcagugu

SEQ ID NO: 728539 - RNA, 65 nt, Homo Sapiens
guuuauugcccaacacguuaaaacuguaucagucauccagagaccacgugagcgccagcgaaaag

SEQ ID NO: 728540 - RNA, 65 nt, Homo Sapiens
uauaugaauguugcauaguaagguuuucuauuuucuccagagaacuaaccuuucuuuauuauuaa

SEQ ID NO: 728541 - RNA, 65 nt, Homo Sapiens
aucugaggcacaugucagcaccacguacugcagccuccagagaguggaagagcagcccuaggcuu

SEQ ID NO: 728542 - RNA, 65 nt, Homo Sapiens
aaauguccagacucacaauguauucucuuaacaguuccagagacuggcuuuaaacaacagaaauu

SEQ ID NO: 728543 - RNA, 65 nt, Homo Sapiens
ucugccaccuggccgccacauucaugcugugccacuccagagacugccuaagcgucaggcuuguu

SEQ ID NO: 728544 - RNA, 65 nt, Homo Sapiens
auugccauucugauuuugauuuccauaacucauaauccagagauacacaaauguaaaauaaguau

SEQ ID NO: 728545 - RNA, 65 nt, Homo Sapiens
ccuggaugugaaugcuaaacacaagucaacugagauccagagaaugccauauuuugauguauagg

SEQ ID NO: 728546 - RNA, 65 nt, Homo Sapiens
gagcugguuuaauacucugagaaugagcagggagauccagagaaugaaucccugaccgcaucacc

SEQ ID NO: 728547 - RNA, 65 nt, Homo Sapiens
aguagacacuuggucucaugaagccacugcugggcuccagagagaagggaaaacuaagagguuuu

SEQ ID NO: 728548 - RNA, 59 nt, Homo Sapiens
agaggggagggaagcauuaaagagcuaacuccagagaucuauaaagcauauccuuuacc

SEQ ID NO: 728549 - RNA, 65 nt, Homo Sapiens
caccaaagaagauggaaccagacuggaauucugucuccagagagaaacccagcuguuugggucaa

SEQ ID NO: 728550 - RNA, 65 nt, Homo Sapiens
auggggauagaaaaguagguaagacucagccuuuguccagagaagcucaggguauagcugaauag

SEQ ID NO: 728551 - RNA, 65 nt, Homo Sapiens
ugcaccuccagcuucuuucugaagcaugacccaucuccagagaugggauuugagaaaucagugag

SEQ ID NO: 728552 - RNA, 65 nt, Homo Sapiens
ugcagaaacuuggaugucacugccugacauucacuuccagagaggaccuaucccaaauguggaau

SEQ ID NO: 728553 - RNA, 65 nt, Homo Sapiens
gagcaucagugaggcuucagccuccucgucuccacuccagagaggagguggcuaugucuucuuaa

SEQ ID NO: 728554 - RNA, 65 nt, Homo Sapiens
uuuugaggucauuagcaaacaugaacucacagggauccagagaugguaaaauucaaaacagccug

SEQ ID NO: 728555 - RNA, 65 nt, Homo Sapiens
cauguggcccaccagcagccuuuccaaaggggaacuccagagacauuucauaaugcaaacagcac

SEQ ID NO: 728556 - RNA, 65 nt, Homo Sapiens
ucccauagucuagagggaugcccauuccaugguccuccagagaauaguuuugacuuaacaugucu

SEQ ID NO: 728557 - RNA, 65 nt, Homo Sapiens
guauuuauagcacguuacaguuguugcagauaauuuccagagacuguuuauaugcaccacuguuu

SEQ ID NO: 728558 - RNA, 65 nt, Homo Sapiens
uguggagugauccugccgcccccucccugggcucguccagagaucucaaacuccgaugccccugg

SEQ ID NO: 728559 - RNA, 65 nt, Homo Sapiens
ucuguagcacugcuuuuuugaggccaguagcaacauccagagaucauucuuccauacuuuacucc

SEQ ID NO: 728560 - RNA, 65 nt, Homo Sapiens
agcuuuuccuacgaucugcauuauguaaucacagguccagagagcuuuauggaagcgggagagga

SEQ ID NO: 728561 - RNA, 65 nt, Homo Sapiens
auugcuucuuuaaggagccaucugugggggaugcauccagagaaaaaggcaguugcccaaaccau

SEQ ID NO: 728562 - RNA, 65 nt, Homo Sapiens
gccugcagcucuccacaggaucagaaccacugguauccagagaaaaagggugaauuugaagaauu

SEQ ID NO: 728563 - RNA, 65 nt, Homo Sapiens
gcuauugaugauacaagaggcucaacccugagccuuccagagagaucucucucaacaccacaguu

SEQ ID NO: 728564 - RNA, 61 nt, Homo Sapiens
gcaaauaagugugcuuagcaugcugaagguuuccagagaaaggaaauaccaacacauuuag

SEQ ID NO: 728565 - RNA, 65 nt, Homo Sapiens
aaaaagcuaauuuuccuaaguuuucucagcuuaguuccagagagacucuaaguuucuugcagucu

SEQ ID NO: 728566 - RNA, 65 nt, Homo Sapiens
uuagaaauuugaguaaagaacaacugaacugucacuccagagauuaauccuaggguaagguggau

SEQ ID NO: 728567 - RNA, 65 nt, Homo Sapiens
gucaaacccagagaaaugugacaguccauauuagcuccagagaguuaaugucuuacuaaugugga

SEQ ID NO: 728568 - RNA, 65 nt, Homo Sapiens
gcccuaggggaucuuuagauguggaccccccaaaguccagagauuauuacacaguuccagaguau

SEQ ID NO: 728569 - RNA, 65 nt, Homo Sapiens
uuucgagggguccucaccugcuggguguugaccacuccagagaagucugauuaaagagaucuguu

SEQ ID NO: 728570 - RNA, 65 nt, Homo Sapiens
aaggaaggggcaggggugggccugauuguuccagcuccagagacucaccagccgccauggccaag

SEQ ID NO: 728571 - RNA, 65 nt, Homo Sapiens
cuaugugcaaauauagaagcacggguccacagaguuccagagaaugaaugcugacgacuaagcac

SEQ ID NO: 728572 - RNA, 65 nt, Homo Sapiens
cugaccugugcucccuccccaaucaucuuuccuguuccagagagguggggcugaggugucuccau

SEQ ID NO: 728573 - RNA, 65 nt, Homo Sapiens
agaggcaacaaguauuacaguugcuuguauauucuuccagagaucucugucuauacaagcaaaaa

SEQ ID NO: 728574 - RNA, 65 nt, Homo Sapiens
cauuauauauucuaguuagaucagcucugguagguuccagagaacagucaauguuggaaggauga

SEQ ID NO: 728575 - RNA, 65 nt, Homo Sapiens
aaaagacagacuagcuacaucaaacagaaucuauuuccagagagucuugcugcugauauuuuuuc

SEQ ID NO: 728576 - RNA, 65 nt, Homo Sapiens
aguacaguuugagacccacuggcuagaacauauccuccagagacuuggcuuaauuggucugggua

SEQ ID NO: 728577 - RNA, 65 nt, Homo Sapiens
ucuaaauuuguccagagcuuucuuuuuccuagaaauccagagagcaaagucagagccuggcaccu

SEQ ID NO: 728578 - RNA, 65 nt, Homo Sapiens
agugguucuucagaaucaccuagaugccuccacccuccagagauccugaguccaggagucugaag

SEQ ID NO: 728579 - RNA, 65 nt, Homo Sapiens
uagaaaagcaagacaagccagagaucucccacaccuccagagaugugcaaacagcugggaggaaa

SEQ ID NO: 728580 - RNA, 65 nt, Homo Sapiens
cuugggauuuucuguuaguuugucuuguuuugcuuuccagagaucuugcucauacaaugaaucac

SEQ ID NO: 728581 - RNA, 65 nt, Homo Sapiens
uuugauuuuacuuuuauguaaccaacacaauucucuccagagacuggacaacuaacccgagcugg

SEQ ID NO: 728582 - RNA, 65 nt, Homo Sapiens
cugaaugaauuggucuggggauacuugggacccacuccagagauuggagccuuuauaagacacug

SEQ ID NO: 728583 - RNA, 65 nt, Homo Sapiens
uggggcuggaugucuccaucgaucaucuuuccuguuccagagaggcugaccuguguucccucccc

SEQ ID NO: 728584 - RNA, 65 nt, Homo Sapiens
uggggcuggaugucuccaucagucaucuuucuuguuccagagaggcugaccuguguuuccucccc

SEQ ID NO: 728585 - RNA, 65 nt, Homo Sapiens
uagacuggauacgaacuagcaaaaggggucaauuguccagagacccuggcaaauccuccuaccca

SEQ ID NO: 728586 - RNA, 65 nt, Homo Sapiens
gugguuuucauuuauuuuuccuugucuuauuucuuuccagagaacgaaugcaacugugggcauuu

SEQ ID NO: 728587 - RNA, 65 nt, Homo Sapiens
guuucaugcuguugcgugugguaaugacuuggcacuccagagaaaccuguccccaguguuuccag

SEQ ID NO: 728588 - RNA, 65 nt, Homo Sapiens
aagaucagauucguccacaauuucagguuaaugacuccagagagugaauuuacuacagcauguga

SEQ ID NO: 728589 - RNA, 65 nt, Homo Sapiens
gugauagaaucuuccccaaaccaugagaagaccauuccagagaaagcuaagaucauugaucuuua

SEQ ID NO: 728590 - RNA, 65 nt, Homo Sapiens
gcaugugcaaaguaaaaugcgucuccucguguaucuccagagacuuauuuguaguccuaugaaca

SEQ ID NO: 728591 - RNA, 65 nt, Homo Sapiens
gcuauggacaagaaucaaauuucuguucauugcucuccagagaauggggaugugagaaaugucuc

SEQ ID NO: 728592 - RNA, 65 nt, Homo Sapiens
caugguguuggccccugaggucuggcugucaaguguccagagagccucagggagccaguucaagg

SEQ ID NO: 728593 - RNA, 65 nt, Homo Sapiens
ggcacccugaggucaggggauccuaaggguguccuuccagagacgguguuuccagggggaggacc

SEQ ID NO: 728594 - RNA, 65 nt, Homo Sapiens
ucaguggcgcgaguccaggaaggucauggggcaacuccagagagaagcauccccuggcccggugg

SEQ ID NO: 728595 - RNA, 65 nt, Homo Sapiens
accuuaguggccagagacugacuucaagguuuuauuccagagacuccagagacuuaagcuaagua

SEQ ID NO: 728596 - RNA, 65 nt, Homo Sapiens
gccagagacugacuucaagguuuuauuccagagacuccagagacuuaagcuaaguauuuuuucau

SEQ ID NO: 728597 - RNA, 65 nt, Homo Sapiens
cuauauguguaucuuccuaggcaaaagcuguaauuuccagagagaccauuaggaacagguaguau

SEQ ID NO: 728598 - RNA, 65 nt, Homo Sapiens
acgcgggaaaggcaaggccuggcuuacuuagagcuuccagagagcauagcugcuuccaucucuua

SEQ ID NO: 728599 - RNA, 65 nt, Homo Sapiens
ugccagcaaugacaucucaggggccagaggaacuguccagagagcaacucugagaucuaaggaug

SEQ ID NO: 728600 - RNA, 65 nt, Homo Sapiens
ugaaagaaugucucggucacaucaggcccgcuagguccagagagcgagcccccaaugcccggcca

SEQ ID NO: 728601 - RNA, 65 nt, Homo Sapiens
uuccucaccgagcaugcuucccuaggaucccgucuuccagagaaccugugggcugacugcccucc

SEQ ID NO: 728602 - RNA, 65 nt, Homo Sapiens
auuacaguuuccaaaugcauucugggauugccuauuccagagaggguacagaaaaagcacacaga

SEQ ID NO: 728603 - RNA, 65 nt, Homo Sapiens
uuacgagagcuauucauucaucccaucuccaaaaauccagagacagcuguuacuuggccauuucu

SEQ ID NO: 728604 - RNA, 65 nt, Homo Sapiens
gaggccaggaggcagugaggccaaagauacuuuuuuccagagacaauuguuagucccaacucugg

SEQ ID NO: 728605 - RNA, 65 nt, Homo Sapiens
aaaccucagacuuugugcacgugcaaaaugcccaguccagagacauggagggcaucuguacuccu

SEQ ID NO: 728606 - RNA, 65 nt, Homo Sapiens
gagaaaauggacagucuagacuagaugucauuguuuccagagaagcccucagcagggccggagac

SEQ ID NO: 728607 - RNA, 65 nt, Homo Sapiens
ggcucaaaaaagaaagaagcguuaaauuggccugcuccagagacugaaucgugguaauauuggcu

SEQ ID NO: 728608 - RNA, 65 nt, Homo Sapiens
acaguggcaaaaugaagaaaagggagcaagaguuguccagagaagguugcccagcccagggggaa

SEQ ID NO: 728609 - RNA, 65 nt, Homo Sapiens
gugcggggccagcugcuauggcaucuccagacuguuccagagaagaggccuuccacccugaccuu

SEQ ID NO: 728610 - RNA, 65 nt, Homo Sapiens
gagaccauccuggccaacauaggcggaucacaagguccagagaucgcacuuugggaggccgaggc

SEQ ID NO: 728611 - RNA, 65 nt, Homo Sapiens
uugcugagaaaucaaagccauuucugcauuguuguuccagagaauuucgguacuuggauaaauca

SEQ ID NO: 728612 - RNA, 65 nt, Homo Sapiens
gaacauuuuuuuuccuagugaccaucaacguuaauuccagagaugacuuucagaaugagcaaaac

SEQ ID NO: 728613 - RNA, 65 nt, Homo Sapiens
agacuuagauguuucguucagagggcugugaaggauccagagacaagaguaggugguggugacgu

SEQ ID NO: 728614 - RNA, 65 nt, Homo Sapiens
uucuuuuaaugcuucuuucaauucuuuuccuucccuccagagaacugauccaaauucugaccuau

SEQ ID NO: 728615 - RNA, 65 nt, Homo Sapiens
ccucaauccccaaagguccgagcaaagcagcaguguccagagaccgacagaggggcuguuaggac

SEQ ID NO: 728616 - RNA, 65 nt, Homo Sapiens
gggagcauuauagauuaaugcagaagauuuagguuuccagagaagcauacauaaccuagcuucuu

SEQ ID NO: 728617 - RNA, 65 nt, Homo Sapiens
caggcagcaacgcaagucaggcugaacauucagucuccagagacagcuguguggagcaaaucaga

SEQ ID NO: 728618 - RNA, 65 nt, Homo Sapiens
cuucaaacccugcauuugaaccgaccaacauuaaguccagagaguaaacuugaauggaauaacga

SEQ ID NO: 728619 - RNA, 65 nt, Homo Sapiens
ucaaagauugaacacugcguaggagagggagaugauccagagacauguggcagcaggcauggcuu

SEQ ID NO: 728620 - RNA, 65 nt, Homo Sapiens
aggcagccuauugguguuauguuuauguaacauaguccagagaacugacaugcaggucaaaaguc

SEQ ID NO: 728621 - RNA, 65 nt, Homo Sapiens
aaauccaaggaaacaugcagcucuucaacaugacauccagagaugacuauuacuuuucuguuuag

SEQ ID NO: 728622 - RNA, 65 nt, Homo Sapiens
uuggugucuuaauggcaugucagauaauuuguuuuuccagagaagagagcucaaagaggaauugg

SEQ ID NO: 728623 - RNA, 65 nt, Homo Sapiens
uagaggacaaaaucaugaaaacagagucccugucuuccagagaucauccggggcuuuaauauuaa

SEQ ID NO: 728624 - RNA, 65 nt, Homo Sapiens
uuuuguaggugggaauccagccucuguuagauauguccagagauggaaacucacuccccuacaaa

SEQ ID NO: 728625 - RNA, 65 nt, Homo Sapiens
cauuccuguugaugggaaaagcccccaguuaauacuccagagacagggaaaggucagcccguuuc

SEQ ID NO: 728626 - RNA, 65 nt, Homo Sapiens
uggaggacaggagucgacgugaguuccugggagucuccagagauggggccuggaggccuggagga

SEQ ID NO: 728627 - RNA, 65 nt, Homo Sapiens
uugguauuuggccaaggccugcaucgggaauaaaguccagagaauuucuuucugcaggaugccgc

SEQ ID NO: 728628 - RNA, 65 nt, Homo Sapiens
gcucuguucauuaauagauuuucuuugaaacugacuccagagaugguuuuaguccaaugguucag

SEQ ID NO: 728629 - RNA, 65 nt, Homo Sapiens
agcucccuuucucaggagcuucccagacuaaaggauccagagagccaccucaagacccccauuug

SEQ ID NO: 728630 - RNA, 65 nt, Homo Sapiens
ggccuuagaaauguguuuuaguuaacuaaugaaguuccagagauggucugcuuuuugcuuuuaau

SEQ ID NO: 728631 - RNA, 65 nt, Homo Sapiens
uaaauaguaauaguuucauaaauacacuuaaguuuuccagagaacgauuugauguucuaaucauu

SEQ ID NO: 728632 - RNA, 65 nt, Homo Sapiens
cuggcccucgcccagucuaucugaugggcagucaguccagagaugggcugaggccuaagcccucc

SEQ ID NO: 728633 - RNA, 65 nt, Homo Sapiens
guaaagaagcagaaagagaacaaacaccaccacuguccagagagaaucacccaggagaaauaaua

SEQ ID NO: 728634 - RNA, 65 nt, Homo Sapiens
uuggcagacaagugccauuuuacagcauuuccagguccagagagggaaggugggccccguguguu

SEQ ID NO: 728635 - RNA, 65 nt, Homo Sapiens
aggccuagucuccaauaaauggacacgguuguggauccagagaagggggguccugauucugggcu

SEQ ID NO: 728636 - RNA, 65 nt, Homo Sapiens
aucuuauuauauuuacucauggcucaaugggggccuccagagacccucucaggcugcugagcuag

SEQ ID NO: 728637 - RNA, 65 nt, Homo Sapiens
cugcccguugacuaacuaugcucugugguuuuguuuccagagaacucagauugcacagagcuaga

SEQ ID NO: 728638 - RNA, 65 nt, Homo Sapiens
ucuuauguauuuuaacaguuggguucuguggaguguccagagaccuuggguuagguauauccauc

SEQ ID NO: 728639 - RNA, 65 nt, Homo Sapiens
gacaacuuguugguaguuaggcacccaugaaugucuccagagacauccugagaggcaagauuccu

SEQ ID NO: 728640 - RNA, 65 nt, Homo Sapiens
uggaacaguguuaaauuucuaugauguuggagccauccagagacuacuggaauugucgagacuuu

SEQ ID NO: 728641 - RNA, 65 nt, Homo Sapiens
agaaggggggccuugggccgcugcagucacaucuguccagagaaauuccuuuugggacuggaggc

SEQ ID NO: 728642 - RNA, 65 nt, Homo Sapiens
augauaaauaugccugacuaaagccacuacagaaauccagagauuggcuguuaaaauuuguuuug

SEQ ID NO: 728643 - RNA, 65 nt, Homo Sapiens
gucccuccauggcacucuggguccucuccucacucuccagagacccucacauguccuuuugaaca

SEQ ID NO: 728644 - RNA, 65 nt, Homo Sapiens
ccccuggagcucauuucugaaucgcacucuccauuuccagagacuaaaggauguccuuugaaaug

SEQ ID NO: 728645 - RNA, 65 nt, Homo Sapiens
cauucacaaguauuuacagaucuagaauacuaauuuccagagagaaauguuucccaaauuguuuu

SEQ ID NO: 728646 - RNA, 65 nt, Homo Sapiens
agaaacaagagccccuaaguugaccaucacagagauccagagaaccuuuuggccaaaagaauauc

SEQ ID NO: 728647 - RNA, 65 nt, Homo Sapiens
ccgaggagggagagucucccccacagcaggccagguccagagagaacccugcauggcugagcugc

SEQ ID NO: 728648 - RNA, 65 nt, Homo Sapiens
ccugagggagggauuccaugcccccaccaacaccguccagagaggacgacuuuuggggagacuca

SEQ ID NO: 728649 - RNA, 65 nt, Homo Sapiens
ggagggacucagauuuauauguauuaugggaaaccuccagagaggggccauuggcacccacccaa

SEQ ID NO: 728650 - RNA, 65 nt, Homo Sapiens
aggggaagacugggccagacauuuucaaacugugguccagagaauucuagguugaccugucugug

SEQ ID NO: 728651 - RNA, 65 nt, Homo Sapiens
augggguuggggguggagguuugccaagacccuucuccagagauuagaacucaucagagugcgga

SEQ ID NO: 728652 - RNA, 65 nt, Homo Sapiens
uuagaaacugacucacuugaugauguuuugcugcuuccagagauagggagggggaagaggacccc

SEQ ID NO: 728653 - RNA, 65 nt, Homo Sapiens
cuuuuuuuuuuuuuuucugacauaugugccuuaccuccagagagucacaaccagcuucuccaggu

SEQ ID NO: 728654 - RNA, 65 nt, Homo Sapiens
cgcuguugcccgcccuccacgagccccagccccaauccagagaagggugcugggucauuacuucu

SEQ ID NO: 728655 - RNA, 65 nt, Homo Sapiens
cugcccccuucccuccagcgugcagcucugguucuuccagagagaaucacuccaguggugaaggg

SEQ ID NO: 728656 - RNA, 65 nt, Homo Sapiens
ggggccuugguccugagaauccucagggcugggucuccagagagucccgugcuccuccuccuccu

SEQ ID NO: 728657 - RNA, 65 nt, Homo Sapiens
gagcuuaagaguggcauuaucuucucgccuuaauuuccagagauuauuucuguacugagaauccu

SEQ ID NO: 728658 - RNA, 65 nt, Homo Sapiens
gccagugggggacuuucucacagcuuacauagccauccagagauccacagcuacgucacugaauu

SEQ ID NO: 728659 - RNA, 65 nt, Homo Sapiens
uauuuuuguuacugacaguuaacaguggugugacauccagagagcagcugggcugcucccgcccc

SEQ ID NO: 728660 - RNA, 65 nt, Homo Sapiens
gcugcaauuguccaggcgaugacaauggugauggcuccagagaacacaccagcuauuuaugagcc

SEQ ID NO: 728661 - RNA, 65 nt, Homo Sapiens
ggggcugagagguuucuacacucgaggagcagggguccagagaggcaggcuggggaggcaaggga

SEQ ID NO: 728662 - RNA, 65 nt, Homo Sapiens
guagaagaaauaaucagguaaguuaaaaguucauuuccagagaagguaaaccccacuuaccaucu

SEQ ID NO: 728663 - RNA, 65 nt, Homo Sapiens
cuuccuccccagcccccgggcucgggaguuaugcauccagagaccugcccuucuaccuuccucgc

SEQ ID NO: 728664 - RNA, 65 nt, Homo Sapiens
uaccaaauaauggcuaauguuacaaaaaguuauacuccagagacccaaagcuugacauuuaccua

SEQ ID NO: 728665 - RNA, 60 nt, Homo Sapiens
ggaaagaauuugccuucuccaucuugccccuccagagacauggagcggcugauauccuga

SEQ ID NO: 728666 - RNA, 65 nt, Homo Sapiens
uagaggaaguaggggguggucuguuuuaccagggauccagagacagaaacagaaaaggcugccag

SEQ ID NO: 728667 - RNA, 65 nt, Homo Sapiens
auacugguaucuuacagcuuuuguaaaguuauuauuccagagaguauuuuguuuguuuuaaaucu

SEQ ID NO: 728668 - RNA, 65 nt, Homo Sapiens
guauagcuuauaccaauuaucuaaagaaaugccuuuccagagacugaucauaaauaauauguuuc

SEQ ID NO: 728669 - RNA, 65 nt, Homo Sapiens
ccugaggccccagagcuugaaucuuuguuugcaucuccagagacaccagaccccaccugaucugc

SEQ ID NO: 728670 - RNA, 65 nt, Homo Sapiens
gagcagcuguggggccugcugccugaccuccagccuccagagaccggcaaagacuccugucccca

SEQ ID NO: 728671 - RNA, 65 nt, Homo Sapiens
aucuagaaguggcuggaaaccaacgcaguuauguuuccagagaacuuuauacuucaguaugguuu

SEQ ID NO: 728672 - RNA, 65 nt, Homo Sapiens
cuggcaugcaauggacauggagcaaggccaccagguccagagaacgagacaugaguucuggaagg

SEQ ID NO: 728673 - RNA, 65 nt, Homo Sapiens
agcucuucugcucccccaucaggacuggugcugcuuccagagacuuccuugggguugcaaccugg

SEQ ID NO: 728674 - RNA, 65 nt, Homo Sapiens
cagcaccaguggaaacacaugaacuucgaugcagguccagagaccauggacacucccacgaggcu

SEQ ID NO: 728675 - RNA, 65 nt, Homo Sapiens
agugccguuguuaugugaaacucuuccauucagauuccagagagguucucaugcuccccccccuc

SEQ ID NO: 728676 - RNA, 65 nt, Homo Sapiens
uccucgccuggacucagggcaggugccguggguucuccagagaccccagcaacuggcccaggaug

SEQ ID NO: 728677 - RNA, 65 nt, Homo Sapiens
cugggacacuuuuauguuaaugcucuggacuugccuccagagacugcuccagaguuggugacaca

SEQ ID NO: 728678 - RNA, 65 nt, Homo Sapiens
ucucuuuuguuuauaaaaaacacuaaacauucaauuccagagaaccaaaaaucccaccuucccac

SEQ ID NO: 728679 - RNA, 65 nt, Homo Sapiens
aggcuaccuuccaucacuguuguacagaaaagaaauccagagaaucaaauggacuggccuugggg

SEQ ID NO: 728680 - RNA, 65 nt, Homo Sapiens
cccaucuuucccuucuuccuccucuccuucacaaauccagagaaccuuggggugguugugccagc

SEQ ID NO: 728681 - RNA, 65 nt, Homo Sapiens
agggccaggcgcaccaggagaggcguuucuggggcuccagagaagugccacgggaggcagaaguc

SEQ ID NO: 728682 - RNA, 65 nt, Homo Sapiens
cugcggcugugagagcagcaggacccugggccaguuccagagaccugggggugugucugggggug

SEQ ID NO: 728683 - RNA, 65 nt, Homo Sapiens
gucagaccauggcgugguauuuauugugcagcagauccagagacagaggcagccugucuuuucag

SEQ ID NO: 728684 - RNA, 65 nt, Homo Sapiens
aucauuuggauggaguaauuuaaaaugaauuaaauuccagagaacaauggaagcauugccuggca

SEQ ID NO: 728685 - RNA, 65 nt, Homo Sapiens
ccucacuuugcugccccaccaucuugcugacaacuuccagagaagccaugguuuuuuguauuggu

SEQ ID NO: 728686 - RNA, 65 nt, Homo Sapiens
uggcagauuguauuggccagcaggaaagcaagcucuccagagaaugcccccaguuaaauaccucc

SEQ ID NO: 728687 - RNA, 65 nt, Homo Sapiens
aggagggcaggggcauugggaaugggugggugcccuccagagaggggcugcuaccucccagcagg

SEQ ID NO: 728688 - RNA, 65 nt, Homo Sapiens
caagugaauugucuaaguucucuuucauuuaaagguccagagaggauuauccauuacaguuuaac

SEQ ID NO: 728689 - RNA, 65 nt, Homo Sapiens
cugagauauggcauauaauauuagugaggucuauguccagagaagcucggggcagggauacaaag

SEQ ID NO: 728690 - RNA, 65 nt, Homo Sapiens
cauacacuuuuuucugacaaaacaucauuuaugguuccagagaugauuuuauaaaugccuauuuu

SEQ ID NO: 728691 - RNA, 65 nt, Homo Sapiens
agacuucgggaaggugucugccauaggaaaucuuguccagagacaggccgaaugaucaaggggac

SEQ ID NO: 728692 - RNA, 65 nt, Homo Sapiens
ucaaacugccaaauaaaaaugugaauuuuaaauuauccagagauguccacuaaaacuccaucuua

SEQ ID NO: 728693 - RNA, 65 nt, Homo Sapiens
gagaagaugcuugugccagguuuugguucuuugguuccagagagauucuggaaagugcagaauuc

SEQ ID NO: 728694 - RNA, 65 nt, Homo Sapiens
gaacagucuuccagaucuggccuggacagagagccuccagagaguaugggcucaggggacucagc

SEQ ID NO: 728695 - RNA, 65 nt, Homo Sapiens
aaacauaggaauaugacucaaguuuagcccaucucuccagagagccugguuuuuaaaagauaaac

SEQ ID NO: 728696 - RNA, 65 nt, Homo Sapiens
gauccuagccaggcaccuuaccccuuucccugcccuccagagacuccagcugaggacaacggaac

SEQ ID NO: 728697 - RNA, 65 nt, Homo Sapiens
cgauccucuuaaggcauuaugccauucagggcuguuccagagauuaggccagcagccucaucccu

SEQ ID NO: 728698 - RNA, 65 nt, Homo Sapiens
uggggaccagaggugacaguggugagaccaaaggauccagagacugaaagauacgguugucuaga

SEQ ID NO: 728699 - RNA, 65 nt, Homo Sapiens
ccaggagccaaaagcuggggggaguccuguggcuuuccagagaagguuggcagagagaagcuggu

SEQ ID NO: 728700 - RNA, 65 nt, Homo Sapiens
aaacauggugcaauggcaccagaaaucccuuggccuccagagauugguaugauuguagcuuccuc

SEQ ID NO: 728701 - RNA, 65 nt, Homo Sapiens
aggccaauaccuaagcauuuaggaaaaauaugguuuccagagaaaucuuaguugauuauuaaaaa

SEQ ID NO: 728702 - RNA, 65 nt, Homo Sapiens
ucucccuccacgauugugaaccaccuucccaagccuccagagaguuguuucucugcagcuggggu

SEQ ID NO: 728703 - RNA, 65 nt, Homo Sapiens
ugguggggggaggaggaggcgaauaaguccuaaucuccagagaaaugagcuuccuccagcuguga

SEQ ID NO: 728704 - RNA, 65 nt, Homo Sapiens
cauaaugagaaagucagacuauuuagaagugucuuuccagagaaggaguaaauuuaaucuccagg

SEQ ID NO: 728705 - RNA, 65 nt, Homo Sapiens
uaacauucagaauauagcaugugggugggacucaguccagagaccacccacuccugagugggugg

SEQ ID NO: 728706 - RNA, 65 nt, Homo Sapiens
aaaaaugaacaaacuacaaaacaucagugaagagcuccagagaaauauuucucuacaacugauga

SEQ ID NO: 728707 - RNA, 65 nt, Homo Sapiens
cagaugcugcugugcugcagacagauacaugcuaguccagagagccgccccugagauggcuguga

SEQ ID NO: 728708 - RNA, 65 nt, Homo Sapiens
uaguuggcuaguacuuugaugcucccuugaugggguccagagagccucccugcagccaccagacu

SEQ ID NO: 728709 - RNA, 65 nt, Homo Sapiens
agccccagcuucuuacccacccaggaaacccuugguccagagaggacaggcuuucuggaggaauc

SEQ ID NO: 728710 - RNA, 65 nt, Homo Sapiens
guugacacaaccccuucccccaauuuuuguggaucuccagagaggcccuucuuuggauucaccaa

SEQ ID NO: 728711 - RNA, 65 nt, Homo Sapiens
acauuucaguacccgcuggcagcuccucccacucauccagagacggccggugggcaggcggggag

SEQ ID NO: 728712 - RNA, 52 nt, Homo Sapiens
aggcagcagaaacugaauagguuccagagacuuuuggcccaggaggaauauu

SEQ ID NO: 728713 - RNA, 65 nt, Homo Sapiens
ccaucuuguuuguuuuccuaccuuaugcugaguaguccagagaguuaaaaaaauucucugcaugu

SEQ ID NO: 728714 - RNA, 65 nt, Homo Sapiens
ucuaguagccaauuaacuacucugggguggcagguuccagagaaugcaguagaccuuuugccacu

SEQ ID NO: 728715 - RNA, 65 nt, Homo Sapiens
ugugaacuugugaauguaauugaucuuuccuuccuuccagagaaagauuuaagggacacuguuaa

SEQ ID NO: 728716 - RNA, 57 nt, Homo Sapiens
aagaggaagaggaggaguaauggugucuccagagacuuuacaucgguuccugucuuc

SEQ ID NO: 728717 - RNA, 65 nt, Homo Sapiens
ggaccaguuccuucauuuucaggugggacucuugauccagagaggacaaagcuccucagugagcu

SEQ ID NO: 728718 - RNA, 65 nt, Homo Sapiens
uaccuaccacaugggaaccguuuguccacacucauuccagagaaaaccgaguccucucaguugca

SEQ ID NO: 728719 - RNA, 65 nt, Homo Sapiens
gccagaagguggguaggauguuccuuagaucauuauccagagacuaauuauaaauguaagcuuau

SEQ ID NO: 728720 - RNA, 65 nt, Homo Sapiens
gcaaaauugaaaaaaagauuggaacauuagggaaauccagagaagauaaaaaggauuaugggagg

SEQ ID NO: 728721 - RNA, 65 nt, Homo Sapiens
aguguggaaaaaaaaaaacauucacuagguucgaauccagagagcgaggaggacugagcccagaa

SEQ ID NO: 728722 - RNA, 65 nt, Homo Sapiens
uucucuggcaaguguucucaccacaucuauucccauccagagacaguccaguggccuagcuggua

SEQ ID NO: 728723 - RNA, 65 nt, Homo Sapiens
acacuuuuucaaaaugcucagccaaaauuauuguguccagagaguugggcauuugauggcaauag

SEQ ID NO: 728724 - RNA, 65 nt, Homo Sapiens
ggacaaacucuuaacuuuuaacaauuuuauuccauuccagagaaugucucggguuaagggaagug

SEQ ID NO: 728725 - RNA, 65 nt, Homo Sapiens
gcgcucugcucauguccguaccaucgcagugauccuccagagacagugugcuggucuaaauuaau

SEQ ID NO: 728726 - RNA, 65 nt, Homo Sapiens
gcgccccuccugguucccugccugccccaccguccuccagagaauaccgagaaugaggagcccuc

SEQ ID NO: 728727 - RNA, 65 nt, Homo Sapiens
cugggcuucaagguacagccccugcaguacagcuauccagagagagagaagggccucagaggaca

SEQ ID NO: 728728 - RNA, 65 nt, Homo Sapiens
caguauuaaaaaaaaaaaaaugaccuuaccauuauuccagagauuacucucaauacaauauauuu

SEQ ID NO: 728729 - RNA, 65 nt, Homo Sapiens
auaacuucuuugcaagaaaaaugauggcaugacaauccagagauccagaggggaguugugugcca

SEQ ID NO: 728730 - RNA, 65 nt, Homo Sapiens
cucaaaaacucuuguacucaaaccaacuguggucauccagagaagauaucauuugguagaaagaa

SEQ ID NO: 728731 - RNA, 65 nt, Homo Sapiens
aaacuguggaauggaaaaagaauuggacuggcgaguccagagaggcacaaaaguccacugaugca

SEQ ID NO: 728732 - RNA, 65 nt, Homo Sapiens
agcuagaagucccccuugaacucuggacaaaggguuccagagagaaccuuggaaaccuggcuuug

SEQ ID NO: 728733 - RNA, 65 nt, Homo Sapiens
ccacgcaaauggccugcccaaauaaauggaacuuauccagagaaagauuuuuuuguacaaugauu

SEQ ID NO: 728734 - RNA, 65 nt, Homo Sapiens
gggcuucccugucccggaggucuccccuuuaccccuccagagaagggauguccagagacuaggcc

SEQ ID NO: 728735 - RNA, 65 nt, Homo Sapiens
aggccucuccccuuuaccccguagccugggggauguccagagacugagugaauggcccuuccuua

SEQ ID NO: 728736 - RNA, 65 nt, Homo Sapiens
cauaaaaguauucacuuuccuuuacauuaaaaauuuccagagaaggguucuucaaauauuucaug

SEQ ID NO: 728737 - RNA, 65 nt, Homo Sapiens
uuaggucuucucuugaggcucuuagaaaagcguuuuccagagagauuucuauuuuugaacaaugg

SEQ ID NO: 728738 - RNA, 65 nt, Homo Sapiens
aacaguagagagggaacauccuaagacagaggaacuccagagaugagugucuggagcgcuucagu

SEQ ID NO: 728739 - RNA, 65 nt, Homo Sapiens
ugcagaccucacugucagggaccucacugggccuuuccagagaacaguuucaucaggaccaaaaa

SEQ ID NO: 728740 - RNA, 65 nt, Homo Sapiens
ucuccauugugcaaauuuuugaauugauuacacucuccagagaucccaugcaauuuuguuuacua

SEQ ID NO: 728741 - RNA, 65 nt, Homo Sapiens
aaaacucuucaagaacaagggcaagaaugagaacuuccagagauggguuauuuuuauauugaaug

SEQ ID NO: 728742 - RNA, 65 nt, Homo Sapiens
augugcuauauuuuuguauauuuuccauuguuuucuccagagagauguaaauuagcagaugacuu

SEQ ID NO: 728743 - RNA, 65 nt, Homo Sapiens
cgcccacaucugaaggaccuugucagugugcgaacuccagagaaggugguuuggagcaacggugu

SEQ ID NO: 728744 - RNA, 65 nt, Homo Sapiens
cuuuguucaaguaucagaagaaauaaacccacagcuccagagaaggugaccauucucagaacucc

SEQ ID NO: 728745 - RNA, 65 nt, Homo Sapiens
gccagauuuuaccuaccaagaaaaaaagauauuuuuccagagaguuagguauaucauaauuuucc

SEQ ID NO: 728746 - RNA, 65 nt, Homo Sapiens
uuacuagacucaugacuuggaggccaaaccuuaaauccagagauagcagccucgauagggaccuu

SEQ ID NO: 728747 - RNA, 65 nt, Homo Sapiens
ccgucacuauucaucaaugaagauuaacacugagauccagagaggcuggaugacuugcucaaguu

SEQ ID NO: 728748 - RNA, 65 nt, Homo Sapiens
auagagccugcccaggccuugcaggcugcagccaguccagagagauacugggccucuccuagacu

SEQ ID NO: 728749 - RNA, 65 nt, Homo Sapiens
uuggaaaauauuuuuucaccgagaucauucauguguccagagaucagagguuuuuguacauuuuu

SEQ ID NO: 728750 - RNA, 65 nt, Homo Sapiens
caagcaagaccuggaugugaucugacaaaaccuucuccagagaauugcaucauuuuaauuaugag

SEQ ID NO: 728751 - RNA, 65 nt, Homo Sapiens
agagaaaacucacccaggaauucuuuauuccaauuuccagagagaugguucuuggagggaaaaga

SEQ ID NO: 728752 - RNA, 65 nt, Homo Sapiens
auaaacuuaagauuacuggccagcagcugaauauauccagagaaagaauuaauuauguuuggaug

SEQ ID NO: 728753 - RNA, 65 nt, Homo Sapiens
uugugucuaugguuguggguugcuccacccucaucuccagagauuagaaaugcuugcuuuauagc

SEQ ID NO: 728754 - RNA, 65 nt, Homo Sapiens
cuucagggggcuccuuccggggcuccggccuguuuuccagagagaguggcaguagccccaugggg

SEQ ID NO: 728755 - RNA, 65 nt, Homo Sapiens
ccccucuaacuggacagccucuucugucccaagucuccagagagaaaucaggccugaugaggggg

SEQ ID NO: 728756 - RNA, 65 nt, Homo Sapiens
acguucaugucauuuuagaggauuauaugguugucuccagagaaauuaacuuacauuaucaaaaa

SEQ ID NO: 728757 - RNA, 65 nt, Homo Sapiens
cccuugggggaucccgggugaggaguguugccccauccagagaaugaaugaguuccuuuaagugc

SEQ ID NO: 728758 - RNA, 65 nt, Homo Sapiens
cagccugcgccacuguguucuucucuuaagaggcuuccagagaaaacggcacaccaaucaauaaa

SEQ ID NO: 728759 - RNA, 65 nt, Homo Sapiens
ucaguaccugcuuggucagguauguugugggcaauuccagagaauuuaguuauaccuuauaccau

SEQ ID NO: 728760 - RNA, 65 nt, Homo Sapiens
ccaaacuguucuguggguuuuuuccuauaaggauauccagagaaguuucccaccucucaccccua

SEQ ID NO: 728761 - RNA, 65 nt, Homo Sapiens
ccaguccuggaguagaagagauuauggcagaaaaguccagagauggagaguuggccugauuuggg

SEQ ID NO: 728762 - RNA, 65 nt, Homo Sapiens
auuuuauguuuuaugauaugguucaacaacauuaauccagagagaauucccaccuuucacauaua

SEQ ID NO: 728763 - RNA, 57 nt, Homo Sapiens
aaauaauuaaaagaaaaacauucaccauccagagaccuccagguuuugcuucauuaa

SEQ ID NO: 728764 - RNA, 65 nt, Homo Sapiens
uuaauggcuauauaggaagaaaguagaucaaaacuuccagagaucuuauuaaagugguuugaaua

SEQ ID NO: 728765 - RNA, 65 nt, Homo Sapiens
cccagggaggaagacuguaauaaucauccccauccuccagagaaaacuaaggugcuaggaauucg

SEQ ID NO: 728766 - RNA, 65 nt, Homo Sapiens
caacaggaugaauaccauccccaaggaugagcugguccagagauaaggacagcacaggaugcccu

SEQ ID NO: 728767 - RNA, 65 nt, Homo Sapiens
acagguaaaacagggccacaugccucugcacacccuccagagacagccugccccuacccuggacu

SEQ ID NO: 728768 - RNA, 65 nt, Homo Sapiens
ugcagcaagagagccauuuccgaccucggccccuauccagagaggggcaggaucuaaaacagcag

SEQ ID NO: 728769 - RNA, 65 nt, Homo Sapiens
aacaguccuugcccuggggccgguucuuacccagguccagagaaaccaacgcgggaugucagacu

SEQ ID NO: 728770 - RNA, 65 nt, Homo Sapiens
ggcauucuuuucugguacauggugagaguucaggcuccagagacucaaaacggaaugguuuuccu

SEQ ID NO: 728771 - RNA, 65 nt, Homo Sapiens
ccucuuccaggagagcacccuuacuuggcccggcuuccagagacccucgaaaucuccgagaagau

SEQ ID NO: 728772 - RNA, 65 nt, Homo Sapiens
aucagcauucucacuccuaccugguaauuuaagauuccagagaguggcuccucccggugcccaag

SEQ ID NO: 728773 - RNA, 65 nt, Homo Sapiens
uccugggccuuucaaccuugcgggcugugcugaguuccagagagcugccggaauuccagguuuga

SEQ ID NO: 728774 - RNA, 65 nt, Homo Sapiens
cuccugcccuuggggcugucuuccuucuccugaaauccagagacuuucuugcucaucccuucucc

SEQ ID NO: 728775 - RNA, 65 nt, Homo Sapiens
aagguuucccuccggggaaugccucccuggaauguuccagagacggaacauucucuagagacaac

SEQ ID NO: 728776 - RNA, 65 nt, Homo Sapiens
aguccugggagagcgggcgguccagagagcgggcauccagagagggguucccauuucccagguuc

SEQ ID NO: 728777 - RNA, 65 nt, Homo Sapiens
gggcauccagagaggaguccccauuucccagguucuccagagagccuccacugagccucugguuc

SEQ ID NO: 728778 - RNA, 65 nt, Homo Sapiens
cagagagugagagagagaaaagagaguaaccaguuuccagagagcacacucccuaucugguugga

SEQ ID NO: 728779 - RNA, 62 nt, Homo Sapiens
cagaauuucucuuaccgauuaagacuuuaaguuccagagaaucaggaagacaccuuugguga

SEQ ID NO: 728780 - RNA, 61 nt, Homo Sapiens
gaggugguucuuccucuuacaauauucuucauccagagauaagccgacccagguaauuuaa

SEQ ID NO: 728781 - RNA, 65 nt, Homo Sapiens
gaggugguucuuccucuuacuuaaaauauucuucauccagagauacaucagcugacccagguaau

SEQ ID NO: 728782 - RNA, 65 nt, Homo Sapiens
ugauaacuuggcccagggcccuacagggccaaggguccagagaaggagcuggacagagcagagaa

SEQ ID NO: 728783 - RNA, 65 nt, Homo Sapiens
ucaguguugcaguaaacugcuggaaacugagagguuccagagaaaguaacagcccuaaugaugac

SEQ ID NO: 728784 - RNA, 65 nt, Homo Sapiens
ugauuaaccugacuuuauagggacugaaguccaccuccagagacaaguccaaguucuugauccac

SEQ ID NO: 728785 - RNA, 65 nt, Homo Sapiens
agaugaagcacguucugccggggaggcccucaccuuccagagaggacagacacagauuuccugcu

SEQ ID NO: 728786 - RNA, 65 nt, Homo Sapiens
ucuccaucuaucggaccccaguuuccaucacuaucuccagagauguagcuauuaugcgcccgucu

SEQ ID NO: 728787 - RNA, 65 nt, Homo Sapiens
aaacgugcacacgcgucucauuugaccccuuugcuuccagagaugaauguggcacucccuccuuc

SEQ ID NO: 728788 - RNA, 65 nt, Homo Sapiens
ugcuaagaauagauggaagacagcaggauaaacauuccagagaaaaucauguuuauucccugcug

SEQ ID NO: 728789 - RNA, 65 nt, Homo Sapiens
ugguacuucccagggcuaccggcaguccucuguaguccagagaggugagauuagaucuucuuggu

SEQ ID NO: 728790 - RNA, 65 nt, Homo Sapiens
guuucucugugcuauuuuuuggaauucuuucagauuccagagauaucuuacgucuuugauucaau

SEQ ID NO: 728791 - RNA, 65 nt, Homo Sapiens
cgauuccccaaccacagcaaaggcaacacucuuccuccagagaucaccaagccccucuuaccucc

SEQ ID NO: 728792 - RNA, 65 nt, Homo Sapiens
auaccucacccugccacuccaccauguaugaucauuccagagaucuuugugacuagaguuagugu

SEQ ID NO: 728793 - RNA, 65 nt, Homo Sapiens
gaagccacauauaaaaaggcauugagggcucacuguccagagaauugcuuuuguaaaugcuccac

SEQ ID NO: 728794 - RNA, 65 nt, Homo Sapiens
cuguucauuccaaaucuguuaagcauuuccaaacauccagagaaugguuucacuguugagggugc

SEQ ID NO: 728795 - RNA, 65 nt, Homo Sapiens
aacuauagaagaguugccuccugucucucgaaucuuccagagauaucacuuaauuguuaacagcu

SEQ ID NO: 728796 - RNA, 65 nt, Homo Sapiens
ccguguggccccuucacuucugaccacacuuccuguccagagagagaagugccccugcugccucc

SEQ ID NO: 728797 - RNA, 65 nt, Homo Sapiens
gaguguggugacuuccuggaaggaggaugcagacuuccagagagcccccccaacggacgugcuga

SEQ ID NO: 728798 - RNA, 65 nt, Homo Sapiens
ucuuccccaggaagcggggucuuggccuggaaccuuccagagaggaggcgggagcaauuuuagcc

SEQ ID NO: 728799 - RNA, 65 nt, Homo Sapiens
agccguggggucccucaggccugggcggugcagcuuccagagagcgagcgcccuuuagcggccug

SEQ ID NO: 728800 - RNA, 65 nt, Homo Sapiens
cugaugaaacgccacugggagugaggaagccagacuccagagacacggagaagaucaaacuggag

SEQ ID NO: 728801 - RNA, 65 nt, Homo Sapiens
uccucuuagcucagcugagcauggagacagcaguuuccagagaguggagagagcagggcuaaaua

SEQ ID NO: 728802 - RNA, 65 nt, Homo Sapiens
cauuguccauuagugaaugaauuccugugacauccuccagagauggccccuccucaccugggacg

SEQ ID NO: 728803 - RNA, 65 nt, Homo Sapiens
ugcccagcuggccgcacacggacauuccaaagaccuccagagaccaccccacccccacauuccuu

SEQ ID NO: 728804 - RNA, 65 nt, Homo Sapiens
ggaaccugggaugagaaacgacagguggaagguuguccagagacaccuacagcguggaugcuguu

SEQ ID NO: 728805 - RNA, 65 nt, Homo Sapiens
caccguuccacuuacaguaugcaagccugcuuaccuccagagacaaauuauaaaacaagaaauca

SEQ ID NO: 728806 - RNA, 65 nt, Homo Sapiens
cugugggaaucuucagaaccaaguggggcaacaacuccagagagguuacucggacaaagacccca

SEQ ID NO: 728807 - RNA, 65 nt, Homo Sapiens
gugccaugaucagggauaugagaacaggaggguccuccagagaauuggggcacggccccuacccg

SEQ ID NO: 728808 - RNA, 65 nt, Homo Sapiens
acauggacacccccagcucuuuacaggaacugagguccagagagggaucuggccaacgggccuuu

SEQ ID NO: 728809 - RNA, 65 nt, Homo Sapiens
accuucccagcucuugccagaagugaagaugcucuuccagagaccuccaaaguaacgaccuuugu

SEQ ID NO: 728810 - RNA, 65 nt, Homo Sapiens
uacuucuuauagaaaaacaauuucugugguuugaauccagagagaggaaauaacauucauugaca

SEQ ID NO: 728811 - RNA, 65 nt, Homo Sapiens
aggagcagcuacuccuuuuagcuguugggcugugcuccagagaaaaauuuagggauacagcaggg

SEQ ID NO: 728812 - RNA, 65 nt, Homo Sapiens
uuguuaauaaagacaaugaaucuguucuuccagaguccagagacaauugcuuuaugaauuaacag

SEQ ID NO: 728813 - RNA, 65 nt, Homo Sapiens
ggcauuucugucuuuuuaagccucucccucauaauuccagagaagccugccucccuucccucaga

SEQ ID NO: 728814 - RNA, 65 nt, Homo Sapiens
gucagugugcaaugugucuggcggccuuccacacuuccagagaauuucacuucuauacuuuguau

SEQ ID NO: 728815 - RNA, 65 nt, Homo Sapiens
ccagggccagcaaagccggcuccugaguuuauuuuuccagagauuaaccaagucaacuuuucacc

SEQ ID NO: 728816 - RNA, 65 nt, Homo Sapiens
ggcugcugcagcccugggaauaaauccaagagcuuuccagagacuauuuuucacuacuuaaggaa

SEQ ID NO: 728817 - RNA, 65 nt, Homo Sapiens
ucacagucacgaagcucauggugaauaaauugagguccagagaggugauugcuucagacuuagag

SEQ ID NO: 728818 - RNA, 65 nt, Homo Sapiens
guccccagguacaacaaauguuccccaggucucuauccagagagacaccuccgcuuccccccugc

SEQ ID NO: 728819 - RNA, 65 nt, Homo Sapiens
ucacguguggagccaggccuccccuccagggguacuccagagaccgccaggugagcugguucaga

SEQ ID NO: 728820 - RNA, 65 nt, Homo Sapiens
aucgggaaaauuacauaaucccucugauuccacuauccagagauagccauuauuauuaauauuug

SEQ ID NO: 728821 - RNA, 65 nt, Homo Sapiens
cauccuaucccuugacauacuuaaucauauaucucuccagagaacucaccugacaaaugucucug

SEQ ID NO: 728822 - RNA, 65 nt, Homo Sapiens
cuuuucuguggaugccgauuucuguaaacucugcauccagagauucauuuucuagauacaauaaa

SEQ ID NO: 728823 - RNA, 65 nt, Homo Sapiens
cccccacaucccuagacagggauggaauguaaauauccagagaauuugggucuaguauaguacau

SEQ ID NO: 728824 - RNA, 65 nt, Homo Sapiens
uuaaauugucauuauuuugguuggucuguguucaauccagagagcuuucuuccuuguuguuugcu

SEQ ID NO: 728825 - RNA, 65 nt, Homo Sapiens
uuuuaaaauaauagaagaaaaaucaguuugcuuucuccagagaaauucagcgugaauuaauuuuu

SEQ ID NO: 728826 - RNA, 65 nt, Homo Sapiens
agguguuuuuuucggggagcuuuugguagcaaggguccagagaugugcagcugggguucccugcu

SEQ ID NO: 728827 - RNA, 65 nt, Homo Sapiens
guguugaauccuucaacaaaaauauauuuuaaccauccagagaugaggaguaaauaaaagccuaa

SEQ ID NO: 728828 - RNA, 65 nt, Homo Sapiens
cuugauaaaacucuguaaugcaaaauuaucuauuuuccagagauuuucugacaguauacaaacaa

SEQ ID NO: 728829 - RNA, 65 nt, Homo Sapiens
caaauuuugcacgauuggacucaagaagugcuuuauccagagaagauggggacauugggaaccug

SEQ ID NO: 728830 - RNA, 65 nt, Homo Sapiens
ccacggccgggcccccuggcgacaacuuccaucauuccagagaaaagccacuuuaaaaacagcug

SEQ ID NO: 728831 - RNA, 65 nt, Homo Sapiens
auuccuuguaauuaagucacaggcaggacccaguuuccagagagcaggcggggccgcccaguggg

SEQ ID NO: 728832 - RNA, 65 nt, Homo Sapiens
ucuucucccgucugcccugcggguugcccgccuccuccagagacuugcccaagggcccaucacca

SEQ ID NO: 728833 - RNA, 65 nt, Homo Sapiens
accagggaauuaauucccccagucaaccaauggcauccagagagggcauggaggcuccauacaac

SEQ ID NO: 728834 - RNA, 65 nt, Homo Sapiens
acaccacaccuggcaaauuugauuuuuuuuuuuuuuccagagacggggucucgcaacauugccca

SEQ ID NO: 728835 - RNA, 65 nt, Homo Sapiens
agagacgccagccucagacuuuuucccacugaggguccagagagcggggccacgugucacccacg

SEQ ID NO: 728836 - RNA, 65 nt, Homo Sapiens
cuugcuagggcuucccccuucuccccaucccggucuccagagacccagcuucugagagacagggu

SEQ ID NO: 728837 - RNA, 65 nt, Homo Sapiens
ggaaaaauagaccaugaacuauacacaaaagugaauccagagauuaaaaacagaaauauggaaaa

SEQ ID NO: 728838 - RNA, 65 nt, Homo Sapiens
ugcucccauucacgucaauaccaagaaccauguucuccagagaauaaauuuaauuuaugacagcu

SEQ ID NO: 728839 - RNA, 65 nt, Homo Sapiens
cugcauggggagcccggggagcugaguaguggggauccagagaggacccccgcccccagagacuu

SEQ ID NO: 728840 - RNA, 65 nt, Homo Sapiens
gugggagguaggcuguggggugggcuggaguccucuccagagaggcucaacaaggaaaaaugcca

SEQ ID NO: 728841 - RNA, 65 nt, Homo Sapiens
cugaccuuagcguucuggacucugccccaaucggguccagagaccacaccacuaaccauccccaa

SEQ ID NO: 728842 - RNA, 65 nt, Homo Sapiens
guccuuccugagaagacagcccucugccuuggagcuccagagagagggagcccuguauucuuggc

SEQ ID NO: 728843 - RNA, 65 nt, Homo Sapiens
ucugacuuuagaguauacaccugacccaguugugguccagagaaucugaguugugcugucagcuu

SEQ ID NO: 728844 - RNA, 65 nt, Homo Sapiens
ccaugagggugggagccggccugggcagcuccaacuccagagaaggguacagcugaccccggcug

SEQ ID NO: 728845 - RNA, 65 nt, Homo Sapiens
gaggagggggccugagacugacaccccugccccccuccagagagugccgugggcaaacccugaag

SEQ ID NO: 728846 - RNA, 65 nt, Homo Sapiens
cugggaggaccccaggcagggggacaaaagccuguuccagagacccauagcaggaauggcaggaa

SEQ ID NO: 728847 - RNA, 65 nt, Homo Sapiens
gacacaaacguguuucguaaaugcugggcgggcccuccagagaagggccgggggccacgggcugc

SEQ ID NO: 728848 - RNA, 65 nt, Homo Sapiens
ggggauucuggaacugggaaagugggccccagcuguccagagaagcuuuaguugggaggagccuc

SEQ ID NO: 728849 - RNA, 65 nt, Homo Sapiens
gggcaccuccccacacacccuggggggggccaggcuccagagagggcuggguuugucccccaccc

SEQ ID NO: 728850 - RNA, 65 nt, Homo Sapiens
caccccucuccagguuauccccuccucccuggagcuccagagaccauaguuuugagaugucuguc

SEQ ID NO: 728851 - RNA, 65 nt, Homo Sapiens
gaaaacaaaaucuagaugcaagcagcuuuuuacaauccagagacacggggcgggcgggccgccag

SEQ ID NO: 728852 - RNA, 65 nt, Homo Sapiens
ggaugcagaggggugcugcuguccugccucucugcuccagagagaccccaccacacuccccgccu

SEQ ID NO: 728853 - RNA, 65 nt, Homo Sapiens
ccaggaagccggucaucaccguggcaaagguuuauuccagagaagaagcugaaaugcaggaagug

SEQ ID NO: 728854 - RNA, 65 nt, Homo Sapiens
auuaaauguuaugaugaaugaagucuuuauauuuuuccagagaaaaauagaauuuauauuacaua

SEQ ID NO: 728855 - RNA, 65 nt, Homo Sapiens
acugcacuuccccaaaacgguccagcuucuggguauccagagagccaagagucacuggccccugc

SEQ ID NO: 728856 - RNA, 65 nt, Homo Sapiens
cagcuaaagucaccugccugauucaccugacuguuuccagagaccguuucuagagacccagcuuu

SEQ ID NO: 728857 - RNA, 65 nt, Homo Sapiens
cagcuacaguucccuggcuguguuucucaguuauuuccagagaccgagcagcuccuuggacagac

SEQ ID NO: 728858 - RNA, 65 nt, Homo Sapiens
acuuaggaugagggcagaaaugcucauuggggaacuccagagacacugagccacacuguuaaguc

SEQ ID NO: 728859 - RNA, 65 nt, Homo Sapiens
ugaugauuauugcagaacauuguaucacauuuuaguccagagauagaauaaaguugaauaaccuu

SEQ ID NO: 728860 - RNA, 65 nt, Homo Sapiens
uucuuuugggggccuuccccuuuuacuccuuuucuuccagagaucaagagcuucucuugcaucuu

SEQ ID NO: 728861 - RNA, 65 nt, Homo Sapiens
augguuugccuguccagacuugcucucaagccucauccagagaaggagcugcagaugagggagcc

SEQ ID NO: 728862 - RNA, 65 nt, Homo Sapiens
ggagaaaagugagccaucugcuggucaggaaguccuccagagaggcagcuuuucccacaauggug

SEQ ID NO: 728863 - RNA, 59 nt, Homo Sapiens
gugcuggugagcaggcauagcagaggcccuccagagagacugcccugcacgccaugccu

SEQ ID NO: 728864 - RNA, 65 nt, Homo Sapiens
cuucuguuauugcuugagcauuuggaacucgagcuuccagagaaauuugagguccucgcuuguuc

SEQ ID NO: 728865 - RNA, 65 nt, Homo Sapiens
uaaaguaacaauaaaagcaguuuuuagaguugaguuccagagagggcagggcaauggcagugaca

SEQ ID NO: 728866 - RNA, 65 nt, Homo Sapiens
uauguguuguccaguuuuccagaccaggacugaaauccagagagggucaggaauuuggccccaug

SEQ ID NO: 728867 - RNA, 65 nt, Homo Sapiens
gacccccucgccuuccccaccuccccaccgagaacuccagagacccagauguuggacaccaggaa

SEQ ID NO: 728868 - RNA, 65 nt, Homo Sapiens
gacuuuaaaguuguuuacagaaauuuaaacucaauuccagagauugaaguuguccaaacagcuca

SEQ ID NO: 728869 - RNA, 65 nt, Homo Sapiens
aggcaguuuucuuuguucucagacuaauggaugguuccagagaaggaaaugaaaggugcugggug

SEQ ID NO: 728870 - RNA, 65 nt, Homo Sapiens
gugcugccccauacccggaaucauaagacccucauuccagagagggacuuuaaucugacuguagc

SEQ ID NO: 728871 - RNA, 65 nt, Homo Sapiens
acaaaaauguagcuucucaguaucucgugcucuucuccagagauucccacacuuuaggggguugg

SEQ ID NO: 728872 - RNA, 65 nt, Homo Sapiens
cccaucgaacugaaggaucagaaggucauuccagauccagagaucacucaacggggacaacucca

SEQ ID NO: 728873 - RNA, 65 nt, Homo Sapiens
cacuccgcucuggaacucaccuggcagagaugcauuccagagauguugagagaacaguguugcug

SEQ ID NO: 728874 - RNA, 65 nt, Homo Sapiens
ugucagcccuuaucaggcaugauugugagugaaguuccagagauggaguagacccuguguacaca

SEQ ID NO: 728875 - RNA, 65 nt, Homo Sapiens
guaguucuuuaaauaagagagauuccccucaacaauccagagaaaaauguaauguaauuauaagc

SEQ ID NO: 728876 - RNA, 65 nt, Homo Sapiens
cucaccuugucucugcagccggagggaccaggguuuccagagaugcuggauuucugacagggcuu

SEQ ID NO: 728877 - RNA, 65 nt, Homo Sapiens
ggaaagauugagguggcagauggauguggcugcaguccagagaaauuggccgguucuugaccugg

SEQ ID NO: 728878 - RNA, 65 nt, Homo Sapiens
gcucccuaagaccuugagagagagagaagagagacuccagagaagaaaggcccuguaaagcccuc

SEQ ID NO: 728879 - RNA, 65 nt, Homo Sapiens
uuagauaugaguuaagagcuagagcaagacaguuguccagagaaucgccccuggccccaaaacag

SEQ ID NO: 728880 - RNA, 65 nt, Homo Sapiens
aagccaucggagcugcuagaguucugucuggacuuuccagagaccaguauucccuuuugcugccu

SEQ ID NO: 728881 - RNA, 65 nt, Homo Sapiens
cuuaucucagaaacagguuuuaaaaugaagugcuuuccagagaaccaucauauaaauaaagauua

SEQ ID NO: 728882 - RNA, 65 nt, Homo Sapiens
uaaggucugugcugggccaagagcagcuuugaagcuccagagaaccaccccgucagguuccuugu

SEQ ID NO: 728883 - RNA, 65 nt, Homo Sapiens
acccuugugccaccugggccagcaaagaggagggguccagagaacagcugaaauacugucacuag

SEQ ID NO: 728884 - RNA, 65 nt, Homo Sapiens
uuuucucuucucugcagccugaguucuuugcuuccuccagagacuagcagagagcccacgugcag

SEQ ID NO: 728885 - RNA, 65 nt, Homo Sapiens
uucuccauuaaaaaauaauuagccagccuccugucuccagagaagccugccucagcucccugccc

SEQ ID NO: 728886 - RNA, 65 nt, Homo Sapiens
aucccguacaccagugggaagagggugagggcugauccagagacccugagccuacagcaaggcug

SEQ ID NO: 728887 - RNA, 65 nt, Homo Sapiens
aucugugccuucucuauggccuugcuaccugggauuccagagaguugauggggugcagauagggg

SEQ ID NO: 728888 - RNA, 65 nt, Homo Sapiens
uugugaacucaaccacaaucuccucgagacauucauccagagaccauguggcacuugauugaaac

SEQ ID NO: 728889 - RNA, 65 nt, Homo Sapiens
aaagaggaauguuaccauccccagcugcccuuauuuccagagaaccagacguuuguuucccaguu

SEQ ID NO: 728890 - RNA, 65 nt, Homo Sapiens
auugaaagaccugcuggagcucacaaggcgggaguuccagagagaggacauagcucugaauuacc

SEQ ID NO: 728891 - RNA, 65 nt, Homo Sapiens
agaccugccgaggccacacuccuggaguaucugcauccagagaucugcacguuuguaaagcuaag

SEQ ID NO: 728892 - RNA, 65 nt, Homo Sapiens
uggggauggcucgguccaagcccaacacugcccgcuccagagagccucagcccugccucccuuuc

SEQ ID NO: 728893 - RNA, 65 nt, Homo Sapiens
auuuucuucaacaaccauaucgcuaaacuaauauauccagagauuuugcacaauucguguugaac

SEQ ID NO: 728894 - RNA, 65 nt, Homo Sapiens
gugucccacauguuggauuccguccccaccacacuuccagagaccggagaacugugcagggccua

SEQ ID NO: 728895 - RNA, 65 nt, Homo Sapiens
ccugcugacccagucugggauggugcagugugcuguccagagagagcguuuuuggugggcuuacu

SEQ ID NO: 728896 - RNA, 65 nt, Homo Sapiens
uccuccuggcagcccuguguaaagaauuucuucaguccagagaauguuguggcuuuuaugcuuuc

SEQ ID NO: 728897 - RNA, 65 nt, Homo Sapiens
ucucuuggcagagugagggcgaacuggcugcuucuuccagagagagagggauccagggcaucugu

SEQ ID NO: 728898 - RNA, 65 nt, Homo Sapiens
agaacugacaggguuuggcuccacagacugauuuuuccagagaggauguucuacucucaauacua

SEQ ID NO: 728899 - RNA, 65 nt, Homo Sapiens
agauuccagcuucggaagccuugggcagccuugccuccagagagcccacucuguacagaggcugu

SEQ ID NO: 728900 - RNA, 65 nt, Homo Sapiens
auagaaauguguuuuccugaccaguuacagguguuuccagagaccggugagugaccaccugggug

SEQ ID NO: 728901 - RNA, 65 nt, Homo Sapiens
gggauggguugggggcgggggcuuggggugggacuuccagagauacuuaaacuguuuucuuuugg

SEQ ID NO: 728902 - RNA, 65 nt, Homo Sapiens
ccaggggggcguguaugcucccauccuucuuccucuccagagaugggcagccccuucugcccacc

SEQ ID NO: 728903 - RNA, 65 nt, Homo Sapiens
ccucccucagggguaaggagggcuggucaguugcauccagagaugcaacguggacaucuccuugg

SEQ ID NO: 728904 - RNA, 65 nt, Homo Sapiens
acugcccuccucaaagccauuuccacucagcucuuuccagagaauucucaguuuuaugagacggg

SEQ ID NO: 728905 - RNA, 65 nt, Homo Sapiens
aacagagcuacgccagcaggcgccaagcacccaacuccagagauggaagccugguggccuuccuu

SEQ ID NO: 728906 - RNA, 65 nt, Homo Sapiens
ucucaauaaauguuaagagcguaaguguaaggggguccagagaccaaaaguuuuagagcuacagg

SEQ ID NO: 728907 - RNA, 65 nt, Homo Sapiens
aaaaucccaguggaggguggaaggaaccguuugccuccagagauggccccagggagaacacaggg

SEQ ID NO: 728908 - RNA, 65 nt, Homo Sapiens
augaaggagaaccugguggcauugccccagagcucuccagagaugagccuccccuauccccaccc

SEQ ID NO: 728909 - RNA, 65 nt, Homo Sapiens
ugcuuauguauaaguaaaggggcaggugcuugggcuccagagagacccuagguacugccuucuaa

SEQ ID NO: 728910 - RNA, 65 nt, Homo Sapiens
aacuacugggcucaagacauccuccugcuucagccuccagagaguugggaccauaggugcacacc

SEQ ID NO: 728911 - RNA, 65 nt, Homo Sapiens
auauaucugaagcagcaaccccacugaugcagacauccagagaguccuaugaaaagacaaggcca

SEQ ID NO: 728912 - RNA, 65 nt, Homo Sapiens
gaagugugacaagugugggcuccugaaaggaauguuccagagaaaccagcuaaaucaugacaccu

SEQ ID NO: 728913 - RNA, 65 nt, Homo Sapiens
gaaauuuagggguagaaaauguuuuccccuaauuuuccagagaagccuauuuuuauauuuuuaaa

SEQ ID NO: 728914 - RNA, 65 nt, Homo Sapiens
ugaagcacucuuggaguuguggguccugcccagaguccagagagcagccucagcugagcacaggu

SEQ ID NO: 728915 - RNA, 65 nt, Homo Sapiens
caggccacagccccuggcacugcagguggccucccuccagagacucgaguccccaugauucccuc

SEQ ID NO: 728916 - RNA, 65 nt, Homo Sapiens
cauaagacccagcaguugugcuccuggacauucauuccagagaaaugaaaaccuauauuguacuu

SEQ ID NO: 728917 - RNA, 65 nt, Homo Sapiens
aggaaacguagaaauuuauucacauggagcuguaauccagagagagucaaugagauuuugcccag

SEQ ID NO: 728918 - RNA, 65 nt, Homo Sapiens
guuucuacucugcucccuaguuagcccugggacccuccagagaggaagggagggcuggcucccag

SEQ ID NO: 728919 - RNA, 65 nt, Homo Sapiens
agcaccccaccacacacaccgggugaggcgugggauccagagagagucgagugauauggcuugua

SEQ ID NO: 728920 - RNA, 65 nt, Homo Sapiens
aggccaguguauaugcaaaccugggccaucaccauuccagagacagggcagggggguggcugggg

SEQ ID NO: 728921 - RNA, 65 nt, Homo Sapiens
cucguacucuuucucccgucgaguggugagggccuuccagagauccagggugcuccagcgcuggg

SEQ ID NO: 728922 - RNA, 65 nt, Homo Sapiens
uuuuaucacccaaauaagaauguccacuguuuaauuccagagaauucaguauauucacaauguug

SEQ ID NO: 728923 - RNA, 65 nt, Homo Sapiens
gagcuguguaccuugucuaaagaacccuguuccuuuccagagacagaaaaccaaagacgcuuggc

SEQ ID NO: 728924 - RNA, 65 nt, Homo Sapiens
ccagcuaaaucauggcaccuuccugaaaggaauguuccagagaaagaagugugacaagugugggc

SEQ ID NO: 728925 - RNA, 65 nt, Homo Sapiens
ucucuggagauuacuacccagauagaugcugugccuccagagaguuuguucagggaaaucagcau

SEQ ID NO: 728926 - RNA, 65 nt, Homo Sapiens
guuucugguugggaagcguaaaagccagggagagauccagagaguuuucaaguuuuugcagaugu

SEQ ID NO: 728927 - RNA, 65 nt, Homo Sapiens
aaacuuaugaugaaaauuuacaauaaccugaaagauccagagauguaugagagcauuuuguaacu

SEQ ID NO: 728928 - RNA, 64 nt, Homo Sapiens
acgccgccaguccauucuuaaggaacugccgacuaggacugaugaugcauuuuagcuuugagcu

SEQ ID NO: 728929 - RNA, 64 nt, Homo Sapiens
ucagcuuauggcuucugucuaagcaccugaacagaggacugaaaccuccacugcaggcugguuu

SEQ ID NO: 728930 - RNA, 64 nt, Homo Sapiens
acagaggcucucggugccgaagauugccugccagaggacugaccacagccuggcuggcagcugc

SEQ ID NO: 728931 - RNA, 64 nt, Homo Sapiens
agccuggcuggcagcugcucuguggaggaccuccaggacugagacugggcucuguuuuccaagg

SEQ ID NO: 728932 - RNA, 64 nt, Homo Sapiens
ggcuggaauaaggcagcaucacggaaauucuguaaggacugacacagagagcucaugcugacug

SEQ ID NO: 728933 - RNA, 64 nt, Homo Sapiens
cuuccugaacauauucugcaccucgucagccuucaggacugaucugccauuuucaccucuaaau

SEQ ID NO: 728934 - RNA, 64 nt, Homo Sapiens
aguuacggcugccagaugccguagacucuucccuaggacugacgauggugcuugaugagggaag

SEQ ID NO: 728935 - RNA, 64 nt, Homo Sapiens
caagcugugucuuucagaccagaugacaagcacaaggacugacuaaaaugcacaaagcccuggg

SEQ ID NO: 728936 - RNA, 64 nt, Homo Sapiens
uguagagaggcguuagugggcagguggccacagcaggacugaggacaggcccccauuauccuag

SEQ ID NO: 728937 - RNA, 64 nt, Homo Sapiens
cacccagaccugaaugcuucugagagcaaagggaaggacugacgagagauguauauuuaauuuu

SEQ ID NO: 728938 - RNA, 64 nt, Homo Sapiens
cuccagggugagaaggcucaucgggcccuuaugaaggacugagggccccaccccgccacuuccc

SEQ ID NO: 728939 - RNA, 64 nt, Homo Sapiens
cccuggguggugcagcgccuggcugggggaugcuaggacugagaagguucugggugcccgcagg

SEQ ID NO: 728940 - RNA, 64 nt, Homo Sapiens
augguagguuugggcagaagccuguuuaguuuuaaggacugaaacauaccacuucagacuuuag

SEQ ID NO: 728941 - RNA, 64 nt, Homo Sapiens
aaaguaauuacauguaucaguuuguauauggaucaggacugagcuucacugucuacagugugcu

SEQ ID NO: 728942 - RNA, 64 nt, Homo Sapiens
ugcuuugaggugccuuggaaaagcacaauuauucaggacugaacggauuuagcuuauaagaaca

SEQ ID NO: 728943 - RNA, 64 nt, Homo Sapiens
aggaguggagggaagcagggcagccccucuggccaggacugaggccugcccccucccaggagcc

SEQ ID NO: 728944 - RNA, 64 nt, Homo Sapiens
gccaaagagcaugggggacuggagaugacauuugaggacugaugagaccucagccaggucuucu

SEQ ID NO: 728945 - RNA, 64 nt, Homo Sapiens
ccccuacccaacuacccccaaggaaaaaugacuaaggacugagccagagugagauucugcaugg

SEQ ID NO: 728946 - RNA, 64 nt, Homo Sapiens
gagauacaaguucagggacucagcaaugcacuuuaggacugagcuaggaggcaaauaucugaag

SEQ ID NO: 728947 - RNA, 64 nt, Homo Sapiens
uuuuccaaagcagguuugggcaaaauuaauccacaggacugaaagguauacaucugugaguuuu

SEQ ID NO: 728948 - RNA, 64 nt, Homo Sapiens
caauuauugucugaagcuaaaauggguuauuuauaggacugauggaaaugauuucaucucugcc

SEQ ID NO: 728949 - RNA, 64 nt, Homo Sapiens
ucuuacgauacagggccauuuuuuuaaaacucucaggacugaacagaagagaaaaauuauuaau

SEQ ID NO: 728950 - RNA, 64 nt, Homo Sapiens
accagcuguaucugaaagagaaaagacaugaaauauaaaccaaccuccucauuucuguugagua

SEQ ID NO: 728951 - RNA, 64 nt, Homo Sapiens
uacaauagaaacgcuuuuaauaaagucuuucagaauaaaccaaguuuuuguaaauuuucaauuc

SEQ ID NO: 728952 - RNA, 64 nt, Homo Sapiens
cauccacuaccccguuuucucuucuugcugcaaaauaaaccacucuguccauuuuuaacucuaa

SEQ ID NO: 728953 - RNA, 64 nt, Homo Sapiens
guggaagcaugugcaggagacauaucauccaaacauaaaccauuaaaauguuugugguuugcuu

SEQ ID NO: 728954 - RNA, 64 nt, Homo Sapiens
cucugaagaaguucaaaaaaaauuauaugaagagauaaaccaaguuuuuggaaaugguccuguu

SEQ ID NO: 728955 - RNA, 64 nt, Homo Sapiens
aaccauuuaaaaaaaaucuauguugaauccuuuuauaaaccaguaucacuuuguaauauaaaca

SEQ ID NO: 728956 - RNA, 64 nt, Homo Sapiens
uccuguuggaauuugggugaguuggaaccaauuuauaaaccaauauuccaaaugaccaguucca

SEQ ID NO: 728957 - RNA, 64 nt, Homo Sapiens
caucuuaacuuggcuaacauauagcagugcuaggauaaaccaauucaucuguugacaauuugcc

SEQ ID NO: 728958 - RNA, 64 nt, Homo Sapiens
uugaucccuggcucagaggauagcgguuuccaucauaaaccaagaugaugaguucagccuuuau

SEQ ID NO: 728959 - RNA, 64 nt, Homo Sapiens
cuguucccugggucagaggauagcgguuuccaucauaaaccaagaugaugaguucagccuuuau

SEQ ID NO: 728960 - RNA, 60 nt, Homo Sapiens
auaacauccauaguguuuagagagaaaaaaauaaaccaauaaccuaccuacugacaagua

SEQ ID NO: 728961 - RNA, 64 nt, Homo Sapiens
aucucuagggauguuuaacauuuauaauugcaaaauaaaccaacuauaaaaaaagaaacuaaga

SEQ ID NO: 728962 - RNA, 64 nt, Homo Sapiens
ucucaauacuguaugaauaaugaaacuuacuaucauaaaccauguuucauguggccuguuaggg

SEQ ID NO: 728963 - RNA, 64 nt, Homo Sapiens
accauagaaauguuuuucaaaauggcaacaauggauaaaccaaggauuuuguguuuaacaaucc

SEQ ID NO: 728964 - RNA, 64 nt, Homo Sapiens
cgcgcgcacacacacaugcuuuacaaguuuuauuauaaaccaagaauuuuggacuugcaaagag

SEQ ID NO: 728965 - RNA, 64 nt, Homo Sapiens
uuccuuuguccaaaaugauucuaaauagaaucuaauaaaccaauguagcauuauuuuuuucuaa

SEQ ID NO: 728966 - RNA, 64 nt, Homo Sapiens; identical to SEQ ID NO: 69124

SEQ ID NO: 728967 - RNA, 64 nt, Homo Sapiens; identical to SEQ ID NO: 69125

SEQ ID NO: 728968 - RNA, 64 nt, Homo Sapiens; identical to SEQ ID NO: 69126

SEQ ID NO: 728969 - RNA, 64 nt, Homo Sapiens; identical to SEQ ID NO: 69127

SEQ ID NO: 728970 - RNA, 64 nt, Homo Sapiens; identical to SEQ ID NO: 69128

SEQ ID NO: 728971 - RNA, 64 nt, Homo Sapiens; identical to SEQ ID NO: 69129

SEQ ID NO: 728972 - RNA, 64 nt, Homo Sapiens
aaauguacagcaagccuauguaguucaauuaauauauaaggaaaaggaaggucuuucuucauga

SEQ ID NO: 728973 - RNA, 64 nt, Homo Sapiens
ugaauuucuucauuugcucuugcaucuacauugcuauaaggauauaaaaugugguuucuauauu

SEQ ID NO: 728974 - RNA, 64 nt, Homo Sapiens
aacaaagucaaguccauaaaaggcagugauauacuauaaggauaaucauauccacaguuaugua

SEQ ID NO: 728975 - RNA, 64 nt, Homo Sapiens
auuuacagcagugaacaugagccuuuuuaccaauuauaaggaaaugugaauucuauuaugggua

SEQ ID NO: 728976 - RNA, 64 nt, Homo Sapiens
gcugggauaugauggguuagaagcaaggagaaaauauaaggacuuuuugauggaauuaaaugug

SEQ ID NO: 728977 - RNA, 64 nt, Homo Sapiens
aagguaaccaauccagugaauagaugugcccuuuuauaaggaaacuucugauguuuauuaaaaa

SEQ ID NO: 728978 - RNA, 64 nt, Homo Sapiens
aauguuuuauaacugaguaauaaguugaagggcuuauaaggaaaaaggauguauuauugagaag

SEQ ID NO: 728979 - RNA, 64 nt, Homo Sapiens
uauuauugagaaguaaguugaacauuuucauaaauauaaggaugaauaaaguauucaaaauauu

SEQ ID NO: 728980 - RNA, 64 nt, Homo Sapiens
uaugaaggaggcuuuucuucucagcuaacaggcauauaaggaaaaccaucuagagaguuuucuu

SEQ ID NO: 728981 - RNA, 64 nt, Homo Sapiens
aauacaaaggaucaccacaauccucuauugaacauauaaggauccucagauuuaaauaaguacu

SEQ ID NO: 728982 - RNA, 64 nt, Homo Sapiens; identical to SEQ ID NO: 494653

SEQ ID NO: 728983 - RNA, 64 nt, Homo Sapiens; identical to SEQ ID NO: 494654

SEQ ID NO: 728984 - RNA, 64 nt, Homo Sapiens; identical to SEQ ID NO: 494655

SEQ ID NO: 728985 - RNA, 64 nt, Homo Sapiens; identical to SEQ ID NO: 494656

SEQ ID NO: 728986 - RNA, 64 nt, Homo Sapiens; identical to SEQ ID NO: 494657

SEQ ID NO: 728987 - RNA, 64 nt, Homo Sapiens; identical to SEQ ID NO: 494658

SEQ ID NO: 728988 - RNA, 64 nt, Homo Sapiens; identical to SEQ ID NO: 494659

SEQ ID NO: 728989 - RNA, 64 nt, Homo Sapiens; identical to SEQ ID NO: 494660

SEQ ID NO: 728990 - RNA, 64 nt, Homo Sapiens; identical to SEQ ID NO: 494661

SEQ ID NO: 728991 - RNA, 64 nt, Homo Sapiens; identical to SEQ ID NO: 494662

SEQ ID NO: 728992 - RNA, 64 nt, Homo Sapiens; identical to SEQ ID NO: 494663

SEQ ID NO: 728993 - RNA, 64 nt, Homo Sapiens; identical to SEQ ID NO: 494664

SEQ ID NO: 728994 - RNA, 64 nt, Homo Sapiens; identical to SEQ ID NO: 494665

SEQ ID NO: 728995 - RNA, 64 nt, Homo Sapiens; identical to SEQ ID NO: 494666

SEQ ID NO: 728996 - RNA, 64 nt, Homo Sapiens; identical to SEQ ID NO: 494667

SEQ ID NO: 728997 - RNA, 64 nt, Homo Sapiens; identical to SEQ ID NO: 494668

SEQ ID NO: 728998 - RNA, 64 nt, Homo Sapiens; identical to SEQ ID NO: 494669

SEQ ID NO: 728999 - RNA, 64 nt, Homo Sapiens; identical to SEQ ID NO: 494670

SEQ ID NO: 729000 - RNA, 64 nt, Homo Sapiens; identical to SEQ ID NO: 494671

SEQ ID NO: 729001 - RNA, 64 nt, Homo Sapiens; identical to SEQ ID NO: 494672

SEQ ID NO: 729002 - RNA, 64 nt, Homo Sapiens; identical to SEQ ID NO: 494673

SEQ ID NO: 729003 - RNA, 64 nt, Homo Sapiens; identical to SEQ ID NO: 494674

SEQ ID NO: 729004 - RNA, 64 nt, Homo Sapiens; identical to SEQ ID NO: 494675

SEQ ID NO: 729005 - RNA, 64 nt, Homo Sapiens; identical to SEQ ID NO: 494676

SEQ ID NO: 729006 - RNA, 64 nt, Homo Sapiens; identical to SEQ ID NO: 494677

SEQ ID NO: 729007 - RNA, 64 nt, Homo Sapiens; identical to SEQ ID NO: 494678

SEQ ID NO: 729008 - RNA, 64 nt, Homo Sapiens; identical to SEQ ID NO: 494679

SEQ ID NO: 729009 - RNA, 64 nt, Homo Sapiens; identical to SEQ ID NO: 494680

SEQ ID NO: 729010 - RNA, 64 nt, Homo Sapiens; identical to SEQ ID NO: 494681

SEQ ID NO: 729011 - RNA, 64 nt, Homo Sapiens; identical to SEQ ID NO: 494682

SEQ ID NO: 729012 - RNA, 64 nt, Homo Sapiens; identical to SEQ ID NO: 494683

SEQ ID NO: 729013 - RNA, 64 nt, Homo Sapiens; identical to SEQ ID NO: 494684

SEQ ID NO: 729014 - RNA, 64 nt, Homo Sapiens; identical to SEQ ID NO: 494685

SEQ ID NO: 729015 - RNA, 64 nt, Homo Sapiens; identical to SEQ ID NO: 494686

SEQ ID NO: 729016 - RNA, 64 nt, Homo Sapiens; identical to SEQ ID NO: 494687

SEQ ID NO: 729017 - RNA, 64 nt, Homo Sapiens; identical to SEQ ID NO: 494688

SEQ ID NO: 729018 - RNA, 64 nt, Homo Sapiens; identical to SEQ ID NO: 494689

SEQ ID NO: 729019 - RNA, 64 nt, Homo Sapiens; identical to SEQ ID NO: 494690

SEQ ID NO: 729020 - RNA, 64 nt, Homo Sapiens; identical to SEQ ID NO: 494691

SEQ ID NO: 729021 - RNA, 64 nt, Homo Sapiens; identical to SEQ ID NO: 494692

SEQ ID NO: 729022 - RNA, 64 nt, Homo Sapiens; identical to SEQ ID NO: 494693

SEQ ID NO: 729023 - RNA, 64 nt, Homo Sapiens; identical to SEQ ID NO: 494694

SEQ ID NO: 729024 - RNA, 64 nt, Homo Sapiens; identical to SEQ ID NO: 494695

SEQ ID NO: 729025 - RNA, 64 nt, Homo Sapiens
ggacuucacuccagaguuacuucuuuuuuugaagucauuacacaagaguuaauuguuuucuuug

SEQ ID NO: 729026 - RNA, 64 nt, Homo Sapiens
aaggagcugccccugucaggaguagucuguugaaucauuacaucccccuaggaccugugcagac

SEQ ID NO: 729027 - RNA, 64 nt, Homo Sapiens
ggacccucugggugcauugacaaaugugacugagucauuacagucaaaugugacuaagucauua

SEQ ID NO: 729028 - RNA, 64 nt, Homo Sapiens
ugugacugagucauuacagucaaaugugacuaagucauuacaaaugguuaugacaaagucauua

SEQ ID NO: 729029 - RNA, 64 nt, Homo Sapiens
ugugacuaagucauuacaaaugguuaugacaaagucauuacaaagaauaguggaaaagguaucu

SEQ ID NO: 729030 - RNA, 64 nt, Homo Sapiens
uaggcaaaauacuuuucaggccuuuuuaaaaaauucauuacagcaaacagcuggggaaggacau

SEQ ID NO: 729031 - RNA, 64 nt, Homo Sapiens
ccaccaaccagacccuuggaaaggaauacuaaaaucauuacaagguauggauuuuaaauggaug

SEQ ID NO: 729032 - RNA, 64 nt, Homo Sapiens
ugaauaaaugugucuaaaacugggugauuaaaguucauuacagcuaggagaauucagaaaagaa

SEQ ID NO: 729033 - RNA, 64 nt, Homo Sapiens
cuaacucuccuuccuuggcucaaugaucuauugaucauuacaccucaauuugaguugguucucu

SEQ ID NO: 729034 - RNA, 64 nt, Homo Sapiens
uuuauguauuucacugucauaguuaagccuuuucucauuacauaaaugacuuuguuuuauccac

SEQ ID NO: 729035 - RNA, 64 nt, Homo Sapiens
uggauuagaccaacuggagaacauugugacauggucauuacauauuggauccuagcaugacuau

SEQ ID NO: 729036 - RNA, 64 nt, Homo Sapiens
ucuauuucuugguggagcaguaccuuucaaaaaaucauuacauuacuguuuauugugaagcauu

SEQ ID NO: 729037 - RNA, 64 nt, Homo Sapiens
agaucagaucaugaaaggcauugcacuuguaguuucauuacaaaaucuguuuuuuuuuuuaaug

SEQ ID NO: 729038 - RNA, 64 nt, Homo Sapiens
gugcacuuacaguucagaccguucuccuguaaguucauuacaaacacgggcggaaggcacucag

SEQ ID NO: 729039 - RNA, 64 nt, Homo Sapiens
ugacagcaggaagaaaacaauuuuuuaaaaauucucauuacauagacgcacaagaauaugucac

SEQ ID NO: 729040 - RNA, 64 nt, Homo Sapiens; identical to SEQ ID NO: 468216

SEQ ID NO: 729041 - RNA, 64 nt, Homo Sapiens; identical to SEQ ID NO: 468217

SEQ ID NO: 729042 - RNA, 64 nt, Homo Sapiens; identical to SEQ ID NO: 468218

SEQ ID NO: 729043 - RNA, 64 nt, Homo Sapiens; identical to SEQ ID NO: 468219

SEQ ID NO: 729044 - RNA, 64 nt, Homo Sapiens; identical to SEQ ID NO: 468220

SEQ ID NO: 729045 - RNA, 64 nt, Homo Sapiens; identical to SEQ ID NO: 468221

SEQ ID NO: 729046 - RNA, 64 nt, Homo Sapiens; identical to SEQ ID NO: 468222

SEQ ID NO: 729047 - RNA, 64 nt, Homo Sapiens; identical to SEQ ID NO: 468223

SEQ ID NO: 729048 - RNA, 64 nt, Homo Sapiens; identical to SEQ ID NO: 468224

SEQ ID NO: 729049 - RNA, 64 nt, Homo Sapiens; identical to SEQ ID NO: 468225

SEQ ID NO: 729050 - RNA, 64 nt, Homo Sapiens; identical to SEQ ID NO: 468226

SEQ ID NO: 729051 - RNA, 64 nt, Homo Sapiens; identical to SEQ ID NO: 468227

SEQ ID NO: 729052 - RNA, 64 nt, Homo Sapiens; identical to SEQ ID NO: 468228

SEQ ID NO: 729053 - RNA, 64 nt, Homo Sapiens; identical to SEQ ID NO: 468229

SEQ ID NO: 729054 - RNA, 64 nt, Homo Sapiens; identical to SEQ ID NO: 468230

SEQ ID NO: 729055 - RNA, 64 nt, Homo Sapiens; identical to SEQ ID NO: 468231

SEQ ID NO: 729056 - RNA, 64 nt, Homo Sapiens; identical to SEQ ID NO: 468232

SEQ ID NO: 729057 - RNA, 64 nt, Homo Sapiens; identical to SEQ ID NO: 468233

SEQ ID NO: 729058 - RNA, 64 nt, Homo Sapiens; identical to SEQ ID NO: 468234

SEQ ID NO: 729059 - RNA, 64 nt, Homo Sapiens; identical to SEQ ID NO: 468235

SEQ ID NO: 729060 - RNA, 64 nt, Homo Sapiens; identical to SEQ ID NO: 468236

SEQ ID NO: 729061 - RNA, 64 nt, Homo Sapiens; identical to SEQ ID NO: 468237

SEQ ID NO: 729062 - RNA, 64 nt, Homo Sapiens; identical to SEQ ID NO: 468238

SEQ ID NO: 729063 - RNA, 64 nt, Homo Sapiens; identical to SEQ ID NO: 468239

SEQ ID NO: 729064 - RNA, 64 nt, Homo Sapiens; identical to SEQ ID NO: 468240

SEQ ID NO: 729065 - RNA, 64 nt, Homo Sapiens; identical to SEQ ID NO: 468241

SEQ ID NO: 729066 - RNA, 64 nt, Homo Sapiens; identical to SEQ ID NO: 468242

SEQ ID NO: 729067 - RNA, 64 nt, Homo Sapiens; identical to SEQ ID NO: 468243

SEQ ID NO: 729068 - RNA, 64 nt, Homo Sapiens; identical to SEQ ID NO: 468244

SEQ ID NO: 729069 - RNA, 64 nt, Homo Sapiens; identical to SEQ ID NO: 468245

SEQ ID NO: 729070 - RNA, 64 nt, Homo Sapiens; identical to SEQ ID NO: 468246

SEQ ID NO: 729071 - RNA, 64 nt, Homo Sapiens; identical to SEQ ID NO: 468247

SEQ ID NO: 729072 - RNA, 64 nt, Homo Sapiens; identical to SEQ ID NO: 468248

SEQ ID NO: 729073 - RNA, 64 nt, Homo Sapiens; identical to SEQ ID NO: 468249

SEQ ID NO: 729074 - RNA, 64 nt, Homo Sapiens; identical to SEQ ID NO: 468250

SEQ ID NO: 729075 - RNA, 64 nt, Homo Sapiens; identical to SEQ ID NO: 468251

SEQ ID NO: 729076 - RNA, 64 nt, Homo Sapiens; identical to SEQ ID NO: 468252

SEQ ID NO: 729077 - RNA, 64 nt, Homo Sapiens; identical to SEQ ID NO: 468253

SEQ ID NO: 729078 - RNA, 64 nt, Homo Sapiens; identical to SEQ ID NO: 468254

SEQ ID NO: 729079 - RNA, 64 nt, Homo Sapiens; identical to SEQ ID NO: 468255

SEQ ID NO: 729080 - RNA, 64 nt, Homo Sapiens; identical to SEQ ID NO: 468256

SEQ ID NO: 729081 - RNA, 64 nt, Homo Sapiens; identical to SEQ ID NO: 468257

SEQ ID NO: 729082 - RNA, 64 nt, Homo Sapiens; identical to SEQ ID NO: 468258

SEQ ID NO: 729083 - RNA, 64 nt, Homo Sapiens; identical to SEQ ID NO: 468259

SEQ ID NO: 729084 - RNA, 64 nt, Homo Sapiens; identical to SEQ ID NO: 468260

SEQ ID NO: 729085 - RNA, 64 nt, Homo Sapiens; identical to SEQ ID NO: 468261

SEQ ID NO: 729086 - RNA, 64 nt, Homo Sapiens; identical to SEQ ID NO: 468262

SEQ ID NO: 729087 - RNA, 64 nt, Homo Sapiens; identical to SEQ ID NO: 468263

SEQ ID NO: 729088 - RNA, 64 nt, Homo Sapiens; identical to SEQ ID NO: 468264

SEQ ID NO: 729089 - RNA, 64 nt, Homo Sapiens; identical to SEQ ID NO: 468265

SEQ ID NO: 729090 - RNA, 64 nt, Homo Sapiens; identical to SEQ ID NO: 468266

SEQ ID NO: 729091 - RNA, 64 nt, Homo Sapiens; identical to SEQ ID NO: 468267

SEQ ID NO: 729092 - RNA, 64 nt, Homo Sapiens; identical to SEQ ID NO: 468268

SEQ ID NO: 729093 - RNA, 64 nt, Homo Sapiens; identical to SEQ ID NO: 468269

SEQ ID NO: 729094 - RNA, 64 nt, Homo Sapiens; identical to SEQ ID NO: 468270

SEQ ID NO: 729095 - RNA, 64 nt, Homo Sapiens; identical to SEQ ID NO: 468271

SEQ ID NO: 729096 - RNA, 64 nt, Homo Sapiens; identical to SEQ ID NO: 468272

SEQ ID NO: 729097 - RNA, 64 nt, Homo Sapiens; identical to SEQ ID NO: 468273

SEQ ID NO: 729098 - RNA, 64 nt, Homo Sapiens; identical to SEQ ID NO: 468274

SEQ ID NO: 729099 - RNA, 64 nt, Homo Sapiens; identical to SEQ ID NO: 468275

SEQ ID NO: 729100 - RNA, 64 nt, Homo Sapiens; identical to SEQ ID NO: 468276

SEQ ID NO: 729101 - RNA, 64 nt, Homo Sapiens; identical to SEQ ID NO: 468277

SEQ ID NO: 729102 - RNA, 64 nt, Homo Sapiens; identical to SEQ ID NO: 468278

SEQ ID NO: 729103 - RNA, 64 nt, Homo Sapiens; identical to SEQ ID NO: 468279

SEQ ID NO: 729104 - RNA, 64 nt, Homo Sapiens; identical to SEQ ID NO: 468280

SEQ ID NO: 729105 - RNA, 64 nt, Homo Sapiens; identical to SEQ ID NO: 468281

SEQ ID NO: 729106 - RNA, 64 nt, Homo Sapiens; identical to SEQ ID NO: 468282

SEQ ID NO: 729107 - RNA, 64 nt, Homo Sapiens; identical to SEQ ID NO: 468283

SEQ ID NO: 729108 - RNA, 64 nt, Homo Sapiens; identical to SEQ ID NO: 468284

SEQ ID NO: 729109 - RNA, 64 nt, Homo Sapiens; identical to SEQ ID NO: 468285

SEQ ID NO: 729110 - RNA, 64 nt, Homo Sapiens; identical to SEQ ID NO: 468286

SEQ ID NO: 729111 - RNA, 64 nt, Homo Sapiens; identical to SEQ ID NO: 468287

SEQ ID NO: 729112 - RNA, 64 nt, Homo Sapiens; identical to SEQ ID NO: 468288

SEQ ID NO: 729113 - RNA, 64 nt, Homo Sapiens; identical to SEQ ID NO: 468289

SEQ ID NO: 729114 - RNA, 64 nt, Homo Sapiens; identical to SEQ ID NO: 468290

SEQ ID NO: 729115 - RNA, 64 nt, Homo Sapiens; identical to SEQ ID NO: 468291

SEQ ID NO: 729116 - RNA, 64 nt, Homo Sapiens; identical to SEQ ID NO: 468292

SEQ ID NO: 729117 - RNA, 64 nt, Homo Sapiens; identical to SEQ ID NO: 468293

SEQ ID NO: 729118 - RNA, 64 nt, Homo Sapiens; identical to SEQ ID NO: 468294

SEQ ID NO: 729119 - RNA, 64 nt, Homo Sapiens; identical to SEQ ID NO: 468293

SEQ ID NO: 729120 - RNA, 64 nt, Homo Sapiens; identical to SEQ ID NO: 468294

SEQ ID NO: 729121 - RNA, 64 nt, Homo Sapiens
cucggccucccaaagugcugggauuacaggccucagcuaccacgccuggccaauccaggucuua

SEQ ID NO: 729122 - RNA, 64 nt, Homo Sapiens
cucuucuggaaaagagaggcuuuucuucaucgagagcuaccagaggagauauuaucuguccucu

SEQ ID NO: 729123 - RNA, 64 nt, Homo Sapiens
ggaggcagugucuggaugaucaugauguaauggaagcuaccaggcagggaagagcagugcuguc

SEQ ID NO: 729124 - RNA, 64 nt, Homo Sapiens
uuacauuucuauuucauaauaaagauuaaaauaaagcuaccauuuuucaauaucacucuugagu

SEQ ID NO: 729125 - RNA, 64 nt, Homo Sapiens
gucugauuacgaaaaguacucuauguuacaguaaagcuaccacucuggcugcuagacagcuugg

SEQ ID NO: 729126 - RNA, 64 nt, Homo Sapiens
gacccaguagaaagaaaaacauccugggaaauccagcuaccagggcccucccaguggaggcauc

SEQ ID NO: 729127 - RNA, 64 nt, Homo Sapiens
gcccucccaguggaggcaucauccugggaaauccagcuaccauggacccaguagaaagaaaaac

SEQ ID NO: 729128 - RNA, 50 nt, Homo Sapiens
cuggcugcuagauagcuuggagcuaccacuaguacuguguguuacaguaa

SEQ ID NO: 729129 - RNA, 64 nt, Homo Sapiens
gcccucccaguggaggcaucauccugggaaauccagcuaccaugacccaguagaaagaaacagc

SEQ ID NO: 729130 - RNA, 50 nt, Homo Sapiens
cuggcugcuagacagcuuggagcuaccacuaguacuguguguuacaguaa

SEQ ID NO: 729131 - RNA, 64 nt, Homo Sapiens
aaagugcuguugcagcuaugugaacuguagacucagaucccaaucacggcuucaccucccuaug

SEQ ID NO: 729132 - RNA, 64 nt, Homo Sapiens
guuaucuaacuccuggagggccuggcccagcccaagaucccagccccacagggaauggccuugg

SEQ ID NO: 729133 - RNA, 64 nt, Homo Sapiens
agcacuugaaacuacagcuuaccacaggaaaguuagaucccauuaaugcuagucaguaugcacc

SEQ ID NO: 729134 - RNA, 64 nt, Homo Sapiens
ggacaguaucaccguaaaccuuccacuggagggcagaucccaaacccacuucuuccuuaaaagg

SEQ ID NO: 729135 - RNA, 64 nt, Homo Sapiens
cucaccuccguguucuuggggagugcguggugucagaucccauccugcuccucuccagaguuuc

SEQ ID NO: 729136 - RNA, 64 nt, Homo Sapiens
cucaccuccguguucucggggagugcguggugucagaucccauccugcucaucuccagcauuuc

SEQ ID NO: 729137 - RNA, 64 nt, Homo Sapiens
cucaccucuguguucucggggagugcguggugucagaucccauccugcuccucuccagcauuuc

SEQ ID NO: 729138 - RNA, 64 nt, Homo Sapiens
cucaccuccguguucucggggagugcguggugucagaucccauccugcuccucuccagaguuuc

SEQ ID NO: 729139 - RNA, 64 nt, Homo Sapiens
aggauuuugguggaaaacuaggcuccucagugaaagaucccaaaccugcauaauagcuauugga

SEQ ID NO: 729140 - RNA, 64 nt, Homo Sapiens
agcuucuccacugcccuauggaagaggaaaucggagaucccagacaagacuuugaagguguagg

SEQ ID NO: 729141 - RNA, 64 nt, Homo Sapiens
ucccccuguaaccauaacugacccuucagccacuagaucccagacacugggucaugcgaucccc

SEQ ID NO: 729142 - RNA, 64 nt, Homo Sapiens
acccagauccuggauccuagacucuuuggccacgagaucccagugauccaaccacaggaucccu

SEQ ID NO: 729143 - RNA, 63 nt, Homo Sapiens
cgugccuaggaaaaggggacagagggcaaggagagaagugagagcuacaauuccagcauugga

SEQ ID NO: 729144 - RNA, 63 nt, Homo Sapiens
gcccagauagacuaacaacccuuuagugcuccaagaagugagaauuuccgaaaaagaucugcc

SEQ ID NO: 729145 - RNA, 63 nt, Homo Sapiens
uaccaaaacuuccacagaugggccaaucuuaucagaagugagcgugagccaccgcacccggcu

SEQ ID NO: 729146 - RNA, 63 nt, Homo Sapiens
caaauacauucagcuuacuguuuaaaaaagguuagaagugaagaagcauuccucaagaucacu

SEQ ID NO: 729147 - RNA, 63 nt, Homo Sapiens
gugaggagcaacucugcccagccgccccgucugagaagugaggagacccuccgccuggcaacc

SEQ ID NO: 729148 - RNA, 63 nt, Homo Sapiens
aggagccccucugcccagcagccgccccgucugagaagugaggagccccucugcccagcagcc

SEQ ID NO: 729149 - RNA, 63 nt, Homo Sapiens
ggccuguuucuguaacuuucucccccucuacugagaagugaccuggaagugagaaguucuuug

SEQ ID NO: 729150 - RNA, 63 nt, Homo Sapiens
gacggguguuuuauuuggucuaauacccugaaaagaagugaugacuuguugcuuuucaaaaca

SEQ ID NO: 729151 - RNA, 63 nt, Homo Sapiens
uaauaauaaaaauauaaaaaggugauguucaacagaagugaagacaaaacaauaugcaucagg

SEQ ID NO: 729152 - RNA, 63 nt, Homo Sapiens
auguucuuucacaucacuggaaucugcaauucaagaagugacaagggagaauucuugcuuuac

SEQ ID NO: 729153 - RNA, 63 nt, Homo Sapiens
acagagacgggagcucugaguguccacgggugaagaagugaguguccacgggugaagaaguga

SEQ ID NO: 729154 - RNA, 63 nt, Homo Sapiens
uccacgggugaagaagugaguguccacgggugaagaagugaguauguuucaccuggacauuaa

SEQ ID NO: 729155 - RNA, 63 nt, Homo Sapiens
cauauaaggaaaaccaucuagagaguuuucuuuagaagugacucccauuagccugguguggug

SEQ ID NO: 729156 - RNA, 63 nt, Homo Sapiens
agcgagacccugugucuaaguaaagaaaaagccagaagugacucccacugcuucuguugaucg

SEQ ID NO: 729157 - RNA, 63 nt, Homo Sapiens
gggcuggucuuggaagguuuuuugcauccaaaaagaagugauuaaccuccaucggccuuaguu

SEQ ID NO: 729158 - RNA, 63 nt, Homo Sapiens
acccccaggaacuccaauuggcagcgcgagaguagaagugaauggacagccuggacauuuuga

SEQ ID NO: 729159 - RNA, 63 nt, Homo Sapiens
uaccuacuauuggcccuaaauagcagaaagaagagaagugaccgagagaaccucagauucuuc

SEQ ID NO: 729160 - RNA, 63 nt, Homo Sapiens
uauucugaugaaucucaaaguaaggcugguaagagaagugaguggugugacucuuacuccuua

SEQ ID NO: 729161 - RNA, 63 nt, Homo Sapiens
cugcuaucauaaggggucagggacauuccggggagaagugaccacuaaggugaggauuagaga

SEQ ID NO: 729162 - RNA, 63 nt, Homo Sapiens
agugaccacuaaggugaggauuagagagugaguagaagugagccagacaaaaaaagcagaaaa

SEQ ID NO: 729163 - RNA, 63 nt, Homo Sapiens
ccacugaguggccacuguccuuccuaaaugucaagaagugaaguaugucacccuuucagggaa

SEQ ID NO: 729164 - RNA, 63 nt, Homo Sapiens
acaugcugacagaaaacucccauggcucuaggaagaagugacacuaagccaacaccuuucuuu

SEQ ID NO: 729165 - RNA, 63 nt, Homo Sapiens; identical to SEQ ID NO: 421856

SEQ ID NO: 729166 - RNA, 63 nt, Homo Sapiens
uagauacaaagucugugucuaaauauuauuuaaagaagugauuuuucauucucuuggauucuu

SEQ ID NO: 729167 - RNA, 63 nt, Homo Sapiens
gugaggagcgucucugucuggccaccccgucugagaagugaggagaccuccgcccggcagccg

SEQ ID NO: 729168 - RNA, 63 nt, Homo Sapiens
gaggagaccuccgcccggcagccgcccugucugagaagugaggagccccuccgcccggcagcc

SEQ ID NO: 729169 - RNA, 63 nt, Homo Sapiens
gcauuuuuagugaagcaagaaaggaguuugccaagaagugaucuguuuuaaaggucauauuug

SEQ ID NO: 729170 - RNA, 63 nt, Homo Sapiens
cacgguuuaacacagcagaguacagaagggugaagaagugagcagaggcuuaugaagauauuc

SEQ ID NO: 729171 - RNA, 63 nt, Homo Sapiens
aauuucuuguucauaagauuaugaaaccacaugagaagugauaaaauguuuguuaaagcuaga

SEQ ID NO: 729172 - RNA, 63 nt, Homo Sapiens
uaauucauccuagcaaauucuaccuuauuuuacagaagugaaagugagguaucagaaguguua

SEQ ID NO: 729173 - RNA, 63 nt, Homo Sapiens
aagcuaauaaagaaaagagguuuauacugcaaaagaagugaaacuauauguauucacaguuga

SEQ ID NO: 729174 - RNA, 63 nt, Homo Sapiens
uuugugucgcucgggucggacugggugggucccagaagugauccccucguaacaacagucucc

SEQ ID NO: 729175 - RNA, 63 nt, Homo Sapiens
agacucccagaaucugccuucacaugacuggagagaagugagagugccugcccucagcucuca

SEQ ID NO: 729176 - RNA, 63 nt, Homo Sapiens
uccauaagccugaugaguugaaauugcaguuugagaagugaauuaaccuuacaucccuuuguu

SEQ ID NO: 729177 - RNA, 63 nt, Homo Sapiens
uguuguuauaguucauuguuuugccuacucagcagaagugaugacucuuaaaaauuggcuuug

SEQ ID NO: 729178 - RNA, 63 nt, Homo Sapiens
guggcuagauggaguauuaagguggagcagaaaagaagugagaacaucuugauuccccuuucu

SEQ ID NO: 729179 - RNA, 63 nt, Homo Sapiens
ggccagggauugccuucuaaauuaugauaaaacagaagugaagaguuucagagcaucagauug

SEQ ID NO: 729180 - RNA, 63 nt, Homo Sapiens
guuucuguuuuucccaguaugcauguuuaaaauagaagugacaagaaucacauccgguugugu

SEQ ID NO: 729181 - RNA, 63 nt, Homo Sapiens
gguuucgauuauagacaucacugacccaugagaagaagugauuuucaggagaccauaggaccc

SEQ ID NO: 729182 - RNA, 63 nt, Homo Sapiens
cucccuugacucuggcuccucuccugagugaagagaagugauuaugcucaagagggagguuuc

SEQ ID NO: 729183 - RNA, 64 nt, Homo Sapiens
auuuuugucuccacuaagcacuauuccuuccucuuuaucucacagauggguaaauguguacauc

SEQ ID NO: 729184 - RNA, 64 nt, Homo Sapiens
uuggcacuucuaaguuuuacauauuguacuugaauuaucucauguaaauauauauuuuuaacau

SEQ ID NO: 729185 - RNA, 64 nt, Homo Sapiens
uaauacucccagcugucauggcuaggcugcaacuuuaucucauuauaugguacccagacacugg

SEQ ID NO: 729186 - RNA, 64 nt, Homo Sapiens
uccuugaauauaguuguguauuucaagcagugcuuuaucucaugaacuguucagucauucuggu

SEQ ID NO: 729187 - RNA, 64 nt, Homo Sapiens
uaugagccaggcaucauacuaaacuucaccuacauuaucucacuuaguccuuuaucauccuuaa

SEQ ID NO: 729188 - RNA, 64 nt, Homo Sapiens
uuaucauccuuaaaacaauucugugacauacauauuaucucauuuuacacaaagggaagucggg

SEQ ID NO: 729189 - RNA, 64 nt, Homo Sapiens
uauauauaaauauauacagauacauaucuguguauuaucucaaggaauguacaaacuuuaguuu

SEQ ID NO: 729190 - RNA, 64 nt, Homo Sapiens
aaguguauuuguguauauguguguauacauauguuuaucucacacacauuaugagcuugaauuc

SEQ ID NO: 729191 - RNA, 64 nt, Homo Sapiens
aaauuuuacuuuucaugcuucuguacuuacauuuuuaucucaaccuuaauuuuucuuucuuuuu

SEQ ID NO: 729192 - RNA, 64 nt, Homo Sapiens
acccuaauuuuucauucagucauaauaccaauaguuaucucaugcaccucugagugccuucuuc

SEQ ID NO: 729193 - RNA, 64 nt, Homo Sapiens; identical to SEQ ID NO: 79919

SEQ ID NO: 729194 - RNA, 64 nt, Homo Sapiens; identical to SEQ ID NO: 79920

SEQ ID NO: 729195 - RNA, 64 nt, Homo Sapiens; identical to SEQ ID NO: 79921

SEQ ID NO: 729196 - RNA, 64 nt, Homo Sapiens; identical to SEQ ID NO: 79922

SEQ ID NO: 729197 - RNA, 64 nt, Homo Sapiens; identical to SEQ ID NO: 79923

SEQ ID NO: 729198 - RNA, 64 nt, Homo Sapiens; identical to SEQ ID NO: 79924

SEQ ID NO: 729199 - RNA, 64 nt, Homo Sapiens; identical to SEQ ID NO: 79925

SEQ ID NO: 729200 - RNA, 64 nt, Homo Sapiens; identical to SEQ ID NO: 79926

SEQ ID NO: 729201 - RNA, 64 nt, Homo Sapiens; identical to SEQ ID NO: 79927

SEQ ID NO: 729202 - RNA, 64 nt, Homo Sapiens; identical to SEQ ID NO: 79928

SEQ ID NO: 729203 - RNA, 64 nt, Homo Sapiens; identical to SEQ ID NO: 79929

SEQ ID NO: 729204 - RNA, 64 nt, Homo Sapiens; identical to SEQ ID NO: 79930

SEQ ID NO: 729205 - RNA, 64 nt, Homo Sapiens; identical to SEQ ID NO: 79931

SEQ ID NO: 729206 - RNA, 64 nt, Homo Sapiens; identical to SEQ ID NO: 79932

SEQ ID NO: 729207 - RNA, 64 nt, Homo Sapiens; identical to SEQ ID NO: 79933

SEQ ID NO: 729208 - RNA, 64 nt, Homo Sapiens; identical to SEQ ID NO: 79934

SEQ ID NO: 729209 - RNA, 64 nt, Homo Sapiens; identical to SEQ ID NO: 79935

SEQ ID NO: 729210 - RNA, 64 nt, Homo Sapiens; identical to SEQ ID NO: 79936

SEQ ID NO: 729211 - RNA, 64 nt, Homo Sapiens; identical to SEQ ID NO: 79937

SEQ ID NO: 729212 - RNA, 64 nt, Homo Sapiens; identical to SEQ ID NO: 79938

SEQ ID NO: 729213 - RNA, 64 nt, Homo Sapiens; identical to SEQ ID NO: 79939

SEQ ID NO: 729214 - RNA, 64 nt, Homo Sapiens; identical to SEQ ID NO: 334387

SEQ ID NO: 729215 - RNA, 64 nt, Homo Sapiens; identical to SEQ ID NO: 334388

SEQ ID NO: 729216 - RNA, 64 nt, Homo Sapiens; identical to SEQ ID NO: 334389

SEQ ID NO: 729217 - RNA, 64 nt, Homo Sapiens; identical to SEQ ID NO: 334390

SEQ ID NO: 729218 - RNA, 64 nt, Homo Sapiens; identical to SEQ ID NO: 334391

SEQ ID NO: 729219 - RNA, 64 nt, Homo Sapiens; identical to SEQ ID NO: 334392

SEQ ID NO: 729220 - RNA, 64 nt, Homo Sapiens; identical to SEQ ID NO: 334393

SEQ ID NO: 729221 - RNA, 64 nt, Homo Sapiens; identical to SEQ ID NO: 334394

SEQ ID NO: 729222 - RNA, 64 nt, Homo Sapiens; identical to SEQ ID NO: 334395

SEQ ID NO: 729223 - RNA, 64 nt, Homo Sapiens; identical to SEQ ID NO: 334396

SEQ ID NO: 729224 - RNA, 64 nt, Homo Sapiens; identical to SEQ ID NO: 334397

SEQ ID NO: 729225 - RNA, 64 nt, Homo Sapiens; identical to SEQ ID NO: 334398

SEQ ID NO: 729226 - RNA, 64 nt, Homo Sapiens; identical to SEQ ID NO: 356005

SEQ ID NO: 729227 - RNA, 64 nt, Homo Sapiens; identical to SEQ ID NO: 356006

SEQ ID NO: 729228 - RNA, 64 nt, Homo Sapiens; identical to SEQ ID NO: 356007

SEQ ID NO: 729229 - RNA, 64 nt, Homo Sapiens; identical to SEQ ID NO: 356008

SEQ ID NO: 729230 - RNA, 64 nt, Homo Sapiens; identical to SEQ ID NO: 356009

SEQ ID NO: 729231 - RNA, 64 nt, Homo Sapiens; identical to SEQ ID NO: 356010

SEQ ID NO: 729232 - RNA, 64 nt, Homo Sapiens; identical to SEQ ID NO: 356011

SEQ ID NO: 729233 - RNA, 64 nt, Homo Sapiens; identical to SEQ ID NO: 356012

SEQ ID NO: 729234 - RNA, 64 nt, Homo Sapiens; identical to SEQ ID NO: 356013

SEQ ID NO: 729235 - RNA, 64 nt, Homo Sapiens; identical to SEQ ID NO: 356014

SEQ ID NO: 729236 - RNA, 52 nt, Homo Sapiens; identical to SEQ ID NO: 356015

SEQ ID NO: 729237 - RNA, 64 nt, Homo Sapiens; identical to SEQ ID NO: 356016

SEQ ID NO: 729238 - RNA, 64 nt, Homo Sapiens; identical to SEQ ID NO: 356017

SEQ ID NO: 729239 - RNA, 64 nt, Homo Sapiens; identical to SEQ ID NO: 356018

SEQ ID NO: 729240 - RNA, 64 nt, Homo Sapiens; identical to SEQ ID NO: 356019

SEQ ID NO: 729241 - RNA, 64 nt, Homo Sapiens; identical to SEQ ID NO: 356020

SEQ ID NO: 729242 - RNA, 64 nt, Homo Sapiens; identical to SEQ ID NO: 356021

SEQ ID NO: 729243 - RNA, 64 nt, Homo Sapiens; identical to SEQ ID NO: 356022

SEQ ID NO: 729244 - RNA, 64 nt, Homo Sapiens; identical to SEQ ID NO: 356023

SEQ ID NO: 729245 - RNA, 64 nt, Homo Sapiens; identical to SEQ ID NO: 356024

SEQ ID NO: 729246 - RNA, 64 nt, Homo Sapiens; identical to SEQ ID NO: 356025

SEQ ID NO: 729247 - RNA, 64 nt, Homo Sapiens; identical to SEQ ID NO: 356026

SEQ ID NO: 729248 - RNA, 64 nt, Homo Sapiens; identical to SEQ ID NO: 356027

SEQ ID NO: 729249 - RNA, 64 nt, Homo Sapiens; identical to SEQ ID NO: 356028

SEQ ID NO: 729250 - RNA, 64 nt, Homo Sapiens; identical to SEQ ID NO: 356029

SEQ ID NO: 729251 - RNA, 64 nt, Homo Sapiens; identical to SEQ ID NO: 356030

SEQ ID NO: 729252 - RNA, 64 nt, Homo Sapiens; identical to SEQ ID NO: 356031

SEQ ID NO: 729253 - RNA, 64 nt, Homo Sapiens; identical to SEQ ID NO: 356032

SEQ ID NO: 729254 - RNA, 64 nt, Homo Sapiens; identical to SEQ ID NO: 356033

SEQ ID NO: 729255 - RNA, 64 nt, Homo Sapiens; identical to SEQ ID NO: 356034

SEQ ID NO: 729256 - RNA, 64 nt, Homo Sapiens; identical to SEQ ID NO: 356035

SEQ ID NO: 729257 - RNA, 64 nt, Homo Sapiens; identical to SEQ ID NO: 356036

SEQ ID NO: 729258 - RNA, 64 nt, Homo Sapiens; identical to SEQ ID NO: 356037

SEQ ID NO: 729259 - RNA, 64 nt, Homo Sapiens; identical to SEQ ID NO: 356038

SEQ ID NO: 729260 - RNA, 64 nt, Homo Sapiens; identical to SEQ ID NO: 356039

SEQ ID NO: 729261 - RNA, 64 nt, Homo Sapiens; identical to SEQ ID NO: 356040

SEQ ID NO: 729262 - RNA, 64 nt, Homo Sapiens; identical to SEQ ID NO: 356041

SEQ ID NO: 729263 - RNA, 64 nt, Homo Sapiens; identical to SEQ ID NO: 356042

SEQ ID NO: 729264 - RNA, 64 nt, Homo Sapiens; identical to SEQ ID NO: 356043

SEQ ID NO: 729265 - RNA, 64 nt, Homo Sapiens; identical to SEQ ID NO: 356044

SEQ ID NO: 729266 - RNA, 64 nt, Homo Sapiens; identical to SEQ ID NO: 356045

SEQ ID NO: 729267 - RNA, 64 nt, Homo Sapiens; identical to SEQ ID NO: 356046

SEQ ID NO: 729268 - RNA, 64 nt, Homo Sapiens; identical to SEQ ID NO: 356047

SEQ ID NO: 729269 - RNA, 64 nt, Homo Sapiens; identical to SEQ ID NO: 356048

SEQ ID NO: 729270 - RNA, 64 nt, Homo Sapiens; identical to SEQ ID NO: 356049

SEQ ID NO: 729271 - RNA, 64 nt, Homo Sapiens; identical to SEQ ID NO: 356050

SEQ ID NO: 729272 - RNA, 64 nt, Homo Sapiens; identical to SEQ ID NO: 356051

SEQ ID NO: 729273 - RNA, 64 nt, Homo Sapiens; identical to SEQ ID NO: 356052

SEQ ID NO: 729274 - RNA, 64 nt, Homo Sapiens; identical to SEQ ID NO: 356053

SEQ ID NO: 729275 - RNA, 64 nt, Homo Sapiens; identical to SEQ ID NO: 356054

SEQ ID NO: 729276 - RNA, 64 nt, Homo Sapiens; identical to SEQ ID NO: 356055

SEQ ID NO: 729277 - RNA, 64 nt, Homo Sapiens; identical to SEQ ID NO: 356056

SEQ ID NO: 729278 - RNA, 64 nt, Homo Sapiens; identical to SEQ ID NO: 356057

SEQ ID NO: 729279 - RNA, 64 nt, Homo Sapiens; identical to SEQ ID NO: 356058

SEQ ID NO: 729280 - RNA, 64 nt, Homo Sapiens; identical to SEQ ID NO: 356059

SEQ ID NO: 729281 - RNA, 64 nt, Homo Sapiens; identical to SEQ ID NO: 356060

SEQ ID NO: 729282 - RNA, 64 nt, Homo Sapiens; identical to SEQ ID NO: 356061

SEQ ID NO: 729283 - RNA, 64 nt, Homo Sapiens; identical to SEQ ID NO: 356062

SEQ ID NO: 729284 - RNA, 64 nt, Homo Sapiens; identical to SEQ ID NO: 356063

SEQ ID NO: 729285 - RNA, 62 nt, Homo Sapiens
aucuagaugggauucuuauaaaaauucaaccucagacauaaacaccccauuucuguaaaccc

SEQ ID NO: 729286 - RNA, 62 nt, Homo Sapiens
uuuuucauuacguggguuuugaaaucuagccccagacauacuguguugagagauacuuagag

SEQ ID NO: 729287 - RNA, 62 nt, Homo Sapiens
uugaacuuuguguguguguguuuagaauauaacagacauaagaaaaaauuaccuaaaugaag

SEQ ID NO: 729288 - RNA, 62 nt, Homo Sapiens
ucucuugucuaguacgcacauaugcacacaggcagacauaccucccaucaugacaugguccc

SEQ ID NO: 729289 - RNA, 62 nt, Homo Sapiens
uggaacuaugaacuucauccauuugcacuguucagacauauauauguauguauguaaaaauu

SEQ ID NO: 729290 - RNA, 62 nt, Homo Sapiens
cuugugauauuuucuggccuggcuuucccucucagacauagcucuuuggagaacuagguguu

SEQ ID NO: 729291 - RNA, 62 nt, Homo Sapiens
agcccuucauccuuccucccucagcagccaggcagacauaacaacaaaacuacuaaaaggag

SEQ ID NO: 729292 - RNA, 62 nt, Homo Sapiens
agccaaagucuuucugaagaaucugugcuggacagacauaauucccuuucucauugucucca

SEQ ID NO: 729293 - RNA, 62 nt, Homo Sapiens
auucccugaacugauguaaaucuucauagugucagacauacugaccaaaaccacaaucuaga

SEQ ID NO: 729294 - RNA, 62 nt, Homo Sapiens
auuuaaauagguccugagacuguugauagccccagacauacccacagcauuauauguaacau

SEQ ID NO: 729295 - RNA, 62 nt, Homo Sapiens
ggauauucccaagccgaccuacagccuucggacagacauaugccuggagcaggagccccgcc

SEQ ID NO: 729296 - RNA, 62 nt, Homo Sapiens
uccaaugugagaaauguccugugacagaaguacagacauaacucuugggugaugugagucau

SEQ ID NO: 729297 - RNA, 62 nt, Homo Sapiens
gggugguaacugaguuugugcagugccuaucccagacauacgagggacgaugugcuguauuu

SEQ ID NO: 729298 - RNA, 62 nt, Homo Sapiens
uuauggacgaaaugccuaaauguuuaggcacccagacauaaugaaaaggcucaccuggccac

SEQ ID NO: 729299 - RNA, 62 nt, Homo Sapiens
guuuuguuuguacauauuuaguagguuaacuacagacauacuauguguugguuacuagagua

SEQ ID NO: 729300 - RNA, 62 nt, Homo Sapiens
augggucagugggcauggcucauuuggaagcccagacauagguuugaaugaaacuauaguuc

SEQ ID NO: 729301 - RNA, 62 nt, Homo Sapiens
aacauaaggcacauugugucuaguuuaagcuccagacauacacccacaaccagaggaaucua

SEQ ID NO: 729302 - RNA, 62 nt, Homo Sapiens
guuaaaacucaaaccucuuaccaagagcaucucagacauagaggacuaggguacaaugaagg

SEQ ID NO: 729303 - RNA, 62 nt, Homo Sapiens
ggaaaagacacauuuuuuagauauauaucacccagacauaaacucaaggccagcuuauaguc

SEQ ID NO: 729304 - RNA, 62 nt, Homo Sapiens
ccaggagcaauuucaaaaccauccccgccucccagacauauacaccagaggucacucuccac

SEQ ID NO: 729305 - RNA, 62 nt, Homo Sapiens
uuuguagaaguggaccaacucacucccaaacacagacauacuagggacagaagaauaaguaa

SEQ ID NO: 729306 - RNA, 62 nt, Homo Sapiens
uaaacugggauuaaaaccucuucagcagguuacagacauacuaauugaaauuauuagaagaa

SEQ ID NO: 729307 - RNA, 62 nt, Homo Sapiens
cuuuaauguuaaaggugcucagaacaaauaaucagacauauaaguauuguaaaauaaacaug

SEQ ID NO: 729308 - RNA, 62 nt, Homo Sapiens
cucccccaacccaacgcuuuuuuggaucagcucagacauauuucaguauaaaacaguuggaa

SEQ ID NO: 729309 - RNA, 62 nt, Homo Sapiens
uucaauggagagacuuaagacacauuugaaaacagacauaucaaguucuaugugaugauuuu

SEQ ID NO: 729310 - RNA, 62 nt, Homo Sapiens
guacaaauacaugaacacagccugucugugcucagacauagagaaguacuaccugacuugag

SEQ ID NO: 729311 - RNA, 62 nt, Homo Sapiens
auauuugucaaccuucuccuuauaaauaaguucagacauacauuuaauaacauagggugacu

SEQ ID NO: 729312 - RNA, 62 nt, Homo Sapiens
caguguuagaugugcacaaggaaaguuauuuucagacauauuugaaugacugcuguacugca

SEQ ID NO: 729313 - RNA, 62 nt, Homo Sapiens
agaagacaguauggcagcuuuccucaaaacuucagacauagaauuaacacaugauccugcaa

SEQ ID NO: 729314 - RNA, 62 nt, Homo Sapiens
aaaguucuugagagaaggagaggaagauacagcagacauaggacugagccaaggaagagucu

SEQ ID NO: 729315 - RNA, 62 nt, Homo Sapiens
cagcucacaaggcccucuuuguuuccugcucccagacauaagcccaaggggccccugcaccc

SEQ ID NO: 729316 - RNA, 62 nt, Homo Sapiens
guuuuuuuuuuuuuuacaaauuuuguuuggcucagacauauaacgucugggcagaaaaccug

SEQ ID NO: 729317 - RNA, 62 nt, Homo Sapiens
aaaggucucuuuguaguucgugucuuugguaucagacauacggaaaaaugacuuuucaguua

SEQ ID NO: 729318 - RNA, 62 nt, Homo Sapiens
gaaagcucugugugaucaauaauacuuucuggcagacauacagacauaauuauuuaacccag

SEQ ID NO: 729319 - RNA, 62 nt, Homo Sapiens
acagggaaauagcuuguaggccuaacagugaucagacauauuaaaauucuguauaaccaggu

SEQ ID NO: 729320 - RNA, 62 nt, Homo Sapiens
aauaaaaauauuaaauagaagguaaaacaaaucagacauacacacauuagauagauaaauuu

SEQ ID NO: 729321 - RNA, 62 nt, Homo Sapiens
aggaugggaugugguggggcagggaucugguacagacauaggcgcuuccuuccaggaacagu

SEQ ID NO: 729322 - RNA, 62 nt, Homo Sapiens
uuaacaacauguauuugguuucccucaacuuacagacauacagcuauuuaaaacuauggcaa

SEQ ID NO: 729323 - RNA, 62 nt, Homo Sapiens
aaaauaauauauauauauauaguacaaugguccagacauaauaagagguguaaaaacuauca

SEQ ID NO: 729324 - RNA, 62 nt, Homo Sapiens
uaaaacacuaagcugaauuagucauguccauucagacauaaccugaacuacugaaaagauca

SEQ ID NO: 729325 - RNA, 62 nt, Homo Sapiens
cuuggcacacuuuauuguuaccuguucuuucccagacauacaacuauccauucccuauacac

SEQ ID NO: 729326 - RNA, 62 nt, Homo Sapiens
cuuagcaucuuaauggaagauuucuucaugaucagacauaaaaggggaacgauguucuuuuc

SEQ ID NO: 729327 - RNA, 62 nt, Homo Sapiens
gccauguuuccucuuuaugcaaaacuucuugucagacauaaaccauaugccuuggggaggac

SEQ ID NO: 729328 - RNA, 62 nt, Homo Sapiens
uucauuaagaguuuuuggaauuguuuauugggcagacauaucaugauaguucugcugauguu

SEQ ID NO: 729329 - RNA, 62 nt, Homo Sapiens
cugaugguuaauaaaugugccacguggggccgcagacauagcaccgugcauggggcagcaaa

SEQ ID NO: 729330 - RNA, 62 nt, Homo Sapiens
gauuuaauuuggaauaugaaugguuacuuuuccagacauacaauauuuuaaugaacuuugau

SEQ ID NO: 729331 - RNA, 62 nt, Homo Sapiens
acaaacuacuuucacauugaacagcugugagacagacauauugagaugccugcccuuguuag

SEQ ID NO: 729332 - RNA, 62 nt, Homo Sapiens
aucuuagaaagaaauuguagaaaaaacccaugcagacauaacauuuauaccaaugaggcaaa

SEQ ID NO: 729333 - RNA, 62 nt, Homo Sapiens
gacuccuaauuuucauugauuaaaacuccuuucagacauauaaguuuaauaaauaacuuuuu

SEQ ID NO: 729334 - RNA, 62 nt, Homo Sapiens
ucuuuaugucacuaguuauaguuaaguucauucagacauaauuauauaaaaacuacguggau

SEQ ID NO: 729335 - RNA, 62 nt, Homo Sapiens
uaaaucauauucaacuaguuuucaucuaaaugcagacauauuguuccuuuuacccuguucug

SEQ ID NO: 729336 - RNA, 62 nt, Homo Sapiens
uucagagcgcuagcuguguguuggguuucccccagacauacuggaaaacacugacugacucc

SEQ ID NO: 729337 - RNA, 62 nt, Homo Sapiens
aacugagcacaggcuuuuucucacagaaucaucagacauaggagaguagaauuugaucagaa

SEQ ID NO: 729338 - RNA, 62 nt, Homo Sapiens
ugaucuggagcuuuuggacaaugguggggugucagacauaacugagaaaguucuaauucuuc

SEQ ID NO: 729339 - RNA, 62 nt, Homo Sapiens
aagccuuguccugacuauguugucaugcaguacagacauagcuggcaucagucaacagugua

SEQ ID NO: 729340 - RNA, 62 nt, Homo Sapiens
auuuucaguucugcugucacuuggcauuugugcagacauaccccugugucacucacuuagcc

SEQ ID NO: 729341 - RNA, 62 nt, Homo Sapiens
agauaguuucucuaaugcugggggagcuuauucagacauaguuaguugaugcuuguaaggua

SEQ ID NO: 729342 - RNA, 62 nt, Homo Sapiens
aauagcugugagguuuugcucucauaacaacacagacauaaauuuuuguacccaugcugaaa

SEQ ID NO: 729343 - RNA, 62 nt, Homo Sapiens
uccugucuccaagaauguuuugcuagagcuaacagacauagacugcaaaagaauaauuugga

SEQ ID NO: 729344 - RNA, 62 nt, Homo Sapiens
ccaauuuauaaauaaucugucugcugguacgacagacauaaaucucuacucugagaguuuuu

SEQ ID NO: 729345 - RNA, 62 nt, Homo Sapiens
uauuucagaaagacuuuacccaauucaguugucagacauaaugauuuauuugaaggcuuguu

SEQ ID NO: 729346 - RNA, 62 nt, Homo Sapiens
ucagcuuccuuggagaagccaccccagguuuccagacauagauguugaauuguuuguggggg

SEQ ID NO: 729347 - RNA, 62 nt, Homo Sapiens
cuuuuuuuagucuuaaaauaaugacuccuauucagacauaucauuuuucuuuuuuguaaauc

SEQ ID NO: 729348 - RNA, 62 nt, Homo Sapiens
ggaauucaaaauggcuggccuaccuuggcuaccagacauauugggguuuuuguaguugaaug

SEQ ID NO: 729349 - RNA, 62 nt, Homo Sapiens
aucaaccauauaaaucaaguaccuauugggaacagacauaacauucaauuuuucauuuaugc

SEQ ID NO: 729350 - RNA, 62 nt, Homo Sapiens
gccccacggugguccaugacugcggaacugcccagacauaagcaggagccuccgaggaaucc

SEQ ID NO: 729351 - RNA, 62 nt, Homo Sapiens
uaucaccgugaaaauacuucauuuggauguuacagacauacuugcuuuuuucccccugaacc

SEQ ID NO: 729352 - RNA, 62 nt, Homo Sapiens
cacauacauacauugacccaguguauguuauacagacauauaaaagagaauguacuguauau

SEQ ID NO: 729353 - RNA, 62 nt, Homo Sapiens
aaguaacauugagaaugacauagaacuuaaugcagacauauauucuuggguuuaaaauacau

SEQ ID NO: 729354 - RNA, 62 nt, Homo Sapiens
ccagguagccuguuucuaacuccaacauaacucagacauagcgucaaacuuuacaucaggga

SEQ ID NO: 729355 - RNA, 62 nt, Homo Sapiens
ugcuaaguaacauuuuuuucuacauaccuauccagacauaaauguguauguaaauuagaaaa

SEQ ID NO: 729356 - RNA, 62 nt, Homo Sapiens
uucaggauggugcgucaggaagugguauguaucagacauauucauacuuuguuauauauguu

SEQ ID NO: 729357 - RNA, 62 nt, Homo Sapiens
ggucaacaggguuagcuaucauuuaaggcacccagacauaaggucaguuugaggcaucacaa

SEQ ID NO: 729358 - RNA, 62 nt, Homo Sapiens
cuaaacacgaacauacagugcgcaaguaugcacagacauacacaugugugcgugugcacaca

SEQ ID NO: 729359 - RNA, 62 nt, Homo Sapiens
augaaaaauccgcugaggagcauaccccaaaccagacauaugcuuaggauucaugcugagau

SEQ ID NO: 729360 - RNA, 62 nt, Homo Sapiens
acucucgucuccuuccccucgccauagaguuccagacauauuuuccgaucaagcuuuuauuu

SEQ ID NO: 729361 - RNA, 62 nt, Homo Sapiens
uuuacauauuguaauucauuuuuaagagaguacagacauacacuuuuugaguaggcaauaug

SEQ ID NO: 729362 - RNA, 62 nt, Homo Sapiens
ggaccauuagcccacagaugcauguauucucucagacauaccgguguagaugcuauauuucu

SEQ ID NO: 729363 - RNA, 62 nt, Homo Sapiens
ugacauuuuuaauuuacaaccuuucuggggcucagacauaaaguuaccuauccaagguugca

SEQ ID NO: 729364 - RNA, 62 nt, Homo Sapiens
ucauuugguguacaucauagaguguacuuacacagacauagaugauaucguuuacuacacac

SEQ ID NO: 729365 - RNA, 62 nt, Homo Sapiens
cggcuuugggguacaagcuguagggaaggauccagacauacaccuggagcuaucuguggucu

SEQ ID NO: 729366 - RNA, 62 nt, Homo Sapiens
gucaacacugagaaucagcagucaucaaaauccagacauacaggagacaggcauauucaugg

SEQ ID NO: 729367 - RNA, 62 nt, Homo Sapiens
uagacauuucaaaauuaauagggaccuacagacagacauacaauguuuggaaagguucuaag

SEQ ID NO: 729368 - RNA, 62 nt, Homo Sapiens
cagcauguuacugaauacuggcuccuaggcuacagacauauauguguaugguauagacuguu

SEQ ID NO: 729369 - RNA, 62 nt, Homo Sapiens
gcacccccgcuagagcugugaaaaauucucuccagacauagucagaugucuccuggggccau

SEQ ID NO: 729370 - RNA, 62 nt, Homo Sapiens
aaauaaaagggccauaaugguuuguucucuuucagacauaauuuaguaggggacaagaaguc

SEQ ID NO: 729371 - RNA, 62 nt, Homo Sapiens
gcuggucucacagcuuaauauuuauuuaguaccagacauaguugucagcauuuuuguugcca

SEQ ID NO: 729372 - RNA, 62 nt, Homo Sapiens
caugcugguggccuucugaaacuuccgagauucagacauagcuuguuagcuggaaccuauuc

SEQ ID NO: 729373 - RNA, 62 nt, Homo Sapiens
gaacagcgcauucuucuguagcagauuccuuacagacauauaccuguaguuuccaguuaagu

SEQ ID NO: 729374 - RNA, 62 nt, Homo Sapiens
cauacauaauugaauauauucuaagguauaagcagacauaagcauugcugucauucauuuug

SEQ ID NO: 729375 - RNA, 62 nt, Homo Sapiens
gaaguuacacagcaauuuagcaauguuguuaacagacauacagaauugugugugugugugug

SEQ ID NO: 729376 - RNA, 62 nt, Homo Sapiens
uuguuuuuaaacauucaaaagcaauuaaugaucagacauaggagaaacccugaauagaaaca

SEQ ID NO: 729377 - RNA, 62 nt, Homo Sapiens
ucagucaggaugacaucacucccaauguuaugcagacauacagacgguuggcauacguuaua

SEQ ID NO: 729378 - RNA, 62 nt, Homo Sapiens
uggaauggguccuguuauuuaugcuugcugcacagacauauuagaagaaaaaaaaaagcuuu

SEQ ID NO: 729379 - RNA, 62 nt, Homo Sapiens
auggcuauacuuggaaguucuccuuguuggcacagacauagaaaugcuuuaaccccaaaccu

SEQ ID NO: 729380 - RNA, 62 nt, Homo Sapiens
aauagcaaucauuuuaaauuuaguuuuugaugcagacauaaaagucaaauuauuuuuuguau

SEQ ID NO: 729381 - RNA, 62 nt, Homo Sapiens
caaagagagauaagauuucaguugcucugccacagacauagacuuuauguaacuuuuagcca

SEQ ID NO: 729382 - RNA, 62 nt, Homo Sapiens
aguaucaacuagcauuggaauuuuuucucagacagacauaguuuauuuucauucaauuuuuu

SEQ ID NO: 729383 - RNA, 62 nt, Homo Sapiens
ucuuacacgaggaagugaaguaaauuuuaguucagacauaaaauuucacuuauuaggaauau

SEQ ID NO: 729384 - RNA, 62 nt, Homo Sapiens
ggugcccugcaagguaagccaccggaucaucucagacauaucuggacacuuguugagagagc

SEQ ID NO: 729385 - RNA, 62 nt, Homo Sapiens
accuggucagaacuaugccuucaaaagcccugcagacauaguccuggacuguuucuuuaauu

SEQ ID NO: 729386 - RNA, 62 nt, Homo Sapiens
augugaaugccuacaaagccauuuucaggacacagacauaugggaaggagaaauuaauugag

SEQ ID NO: 729387 - RNA, 62 nt, Homo Sapiens
cugaagcagcucaagaccaacaguaaaaccuucagacauagacuaaaacuggaccauaauuu

SEQ ID NO: 729388 - RNA, 62 nt, Homo Sapiens
uauaacccauaaucaagaacaugagcgaaaagcagacauaaaucgauauggaugguuugugg

SEQ ID NO: 729389 - RNA, 62 nt, Homo Sapiens
aagaaaaauucaugauuucuuccugaagccuacagacauaaaauaacagugugaagaauuac

SEQ ID NO: 729390 - RNA, 62 nt, Homo Sapiens
ccuguaaaugaucaggaaaggccuuguggcaccagacauaagacccccugaaaguaucaucc

SEQ ID NO: 729391 - RNA, 62 nt, Homo Sapiens
guaaacuuccagaucuuuuuucuaugcguaaucagacauacauauauacugcaguguaucuc

SEQ ID NO: 729392 - RNA, 62 nt, Homo Sapiens
uggucauggccuccacagcaggucccuguggacagacauaucugcauauuuaucaauaaagc

SEQ ID NO: 729393 - RNA, 62 nt, Homo Sapiens
gaagcgaagcaagaggaaccucucgccaugaucagacauacagcugccuaccuaaugaggac

SEQ ID NO: 729394 - RNA, 62 nt, Homo Sapiens
gagucauuuggagaaagccucuaaccaaaccccagacauaggguuuaugugggcauaaaauu

SEQ ID NO: 729395 - RNA, 62 nt, Homo Sapiens
cagggcaaaaagcauacgcaggcuguucucuacagacauaguggggaggagguuguuguuug

SEQ ID NO: 729396 - RNA, 62 nt, Homo Sapiens
guauuucaaaauaaaucucauguaggagaugacagacauaagaaaauauaauguaccuagau

SEQ ID NO: 729397 - RNA, 62 nt, Homo Sapiens
ugcuucagugccccuuuucuccuagccccuggcagacauagcuugcugucugcaagggagcc

SEQ ID NO: 729398 - RNA, 62 nt, Homo Sapiens
uuuuucuguucauuuauuuugcauguccuaugcagacauagaauuuaaauuacacacugaga

SEQ ID NO: 729399 - RNA, 62 nt, Homo Sapiens
gaggcagggcaaaugacaugcacugacccuuccagacauacgaaacacaaaccacaacugac

SEQ ID NO: 729400 - RNA, 62 nt, Homo Sapiens
ugaccuguaaaaaguacucaagggcuuuauuacagacauacccucccuuugaaaagggacau

SEQ ID NO: 729401 - RNA, 62 nt, Homo Sapiens
aagcaaguuuuaccucucuguacauguuuuugcagacauacuugaaaagcucacuuaaaucu

SEQ ID NO: 729402 - RNA, 62 nt, Homo Sapiens
ucggaucuacuguagagcaccccugcuugguacagacauacucaggggcuaccgugucuuca

SEQ ID NO: 729403 - RNA, 62 nt, Homo Sapiens
cuuugcacugucccuagaggccugaggggacccagacauaucggaagaaaggccaaccugau

SEQ ID NO: 729404 - RNA, 62 nt, Homo Sapiens
auagcauugauucaccuuguauuucuaguucacagacauacacauaacuccauaaguaagaa

SEQ ID NO: 729405 - RNA, 62 nt, Homo Sapiens
guacuugcccuaguuuguggaauguguacacacagacauaaaugugugugugcgugugugua

SEQ ID NO: 729406 - RNA, 62 nt, Homo Sapiens
ucugcuucuguguuuuugugacuucuucacaacagacauauuacucacugggagugaaaaug

SEQ ID NO: 729407 - RNA, 62 nt, Homo Sapiens
ucuguggcucuccucugguucugcccccaaaucagacauaccgccccugcucuucccgagag

SEQ ID NO: 729408 - RNA, 62 nt, Homo Sapiens
aaaauuaauaaugauugugagaauuauaaauacagacauaaaaagaggaguacaacauacug

SEQ ID NO: 729409 - RNA, 62 nt, Homo Sapiens
uucaucuccacugauaaccgguuuccuugaugcagacauaguuuagcuuucuuugacugcag

SEQ ID NO: 729410 - RNA, 62 nt, Homo Sapiens
gcugucuuagugcaaaaaacauacuuacauuucagacauauccaaagggaauacucacauuu

SEQ ID NO: 729411 - RNA, 62 nt, Homo Sapiens
aucucucaagccaaaggagaagacaguaagaacagacauaagggacauuuuaguuugggcua

SEQ ID NO: 729412 - RNA, 62 nt, Homo Sapiens
gucaugugcaagacaaugcuaagaacagaauacagacauaaauaagucacggcccaugaccu

SEQ ID NO: 729413 - RNA, 62 nt, Homo Sapiens
cuugagcucucccaauuauuguaauauaaggacagacauaauaguauucuguacccauagua

SEQ ID NO: 729414 - RNA, 62 nt, Homo Sapiens
ugguauguaaacuuguaaaaauagagauuugacagacauagcaaucuagucaauguguaagg

SEQ ID NO: 729415 - RNA, 62 nt, Homo Sapiens
aguaugauucucaccauuauuugucauggaggcagacauacaccagaaaugggggagaaaca

SEQ ID NO: 729416 - RNA, 62 nt, Homo Sapiens
ucuugauaacauuaacauuaauuuuauuuuuucagacauacuguaauuuaaaaauuaaugug

SEQ ID NO: 729417 - RNA, 62 nt, Homo Sapiens
ccauucacuuagccuaucagaaaagucauuggcagacauauauguccuugaaccuuuuuuau

SEQ ID NO: 729418 - RNA, 62 nt, Homo Sapiens
acuuagacaggacuuucaugggggaucaaggacagacauagcguaaaccagaaaacaauugu

SEQ ID NO: 729419 - RNA, 62 nt, Homo Sapiens
uaugauagcuugugcugauuuauacugcagggcagacauacaaaccaggauuaaaauucaua

SEQ ID NO: 729420 - RNA, 62 nt, Homo Sapiens
cuguggcuaugguggccuguaaguggaguuugcagacauaggagaaaagagagcucaggccc

SEQ ID NO: 729421 - RNA, 62 nt, Homo Sapiens
cauauuuaaaugaaauggggcuuuuuaacaugcagacauaccuugagugugaguuuggaggc

SEQ ID NO: 729422 - RNA, 62 nt, Homo Sapiens
uaaauuuuuacaucaauccuuucaguuucucccagacauaccgagggaaguccuaggguggu

SEQ ID NO: 729423 - RNA, 62 nt, Homo Sapiens
gguucuguggaauaagauaccugccuguuuuccagacauacacuauacaucauuuuugcccu

SEQ ID NO: 729424 - RNA, 62 nt, Homo Sapiens
aucuuguggcuuugcaaccaaacagacuaggccagacauagcuaaaaugaucauuaggacau

SEQ ID NO: 729425 - RNA, 62 nt, Homo Sapiens
ucuuauuguaauagaugagcauauuuuuuuaccagacauaaaugggguaauaaucuaugccu

SEQ ID NO: 729426 - RNA, 62 nt, Homo Sapiens
uugcuguugacauauuuaauguuuuaaauguacagacauauuuaacuggugcacuuuguaaa

SEQ ID NO: 729427 - RNA, 62 nt, Homo Sapiens
uuuguguguuuauaugcucaaaucuucaacuucagacauauacaacucugguuuauuaucuu

SEQ ID NO: 729428 - RNA, 62 nt, Homo Sapiens
cauccccacacacgccuaugcacaagcacauacagacauaugucacggcacucccaaaagca

SEQ ID NO: 729429 - RNA, 62 nt, Homo Sapiens
cauuuaugauuugaaaguugggaagggagaagcagacauaguaggaaaggguaggaagggug

SEQ ID NO: 729430 - RNA, 62 nt, Homo Sapiens
auuacaagcuauuggaacuccagcaaaguauucagacauaguagaaugggaugcauguauau

SEQ ID NO: 729431 - RNA, 62 nt, Homo Sapiens
aaguaguuuuuuuuucaauuacauguugcuuccagacauacuucucugcaacuuguugagca

SEQ ID NO: 729432 - RNA, 62 nt, Homo Sapiens
agguuccugaauaauuccugcagggcuggugacagacauaacagcucugguuuuauaauauc

SEQ ID NO: 729433 - RNA, 62 nt, Homo Sapiens
uacuuauuuaugccuaaaaaccauacuggaaucagacauaaaguauuuauguauuaaccuga

SEQ ID NO: 729434 - RNA, 62 nt, Homo Sapiens
augucaucacgaaacugccccacacaaauaaacagacauaagcuuuaaaacacgcacacaaa

SEQ ID NO: 729435 - RNA, 62 nt, Homo Sapiens
uuuccuaaaguugaagcauucgaucacagacacagacauacugaacucugguugggguacua

SEQ ID NO: 729436 - RNA, 62 nt, Homo Sapiens
aaccagcagaaaugccuuacaccauauuaccacagacauacucucuucagaucucuaacuuc

SEQ ID NO: 729437 - RNA, 62 nt, Homo Sapiens
agugaaauaaauaaaguccugaccccagugcacagacauagaggcacagauugcagucagac

SEQ ID NO: 729438 - RNA, 62 nt, Homo Sapiens
ugcugugccugauguugggagagcccugcucccagacauaaauagagcaaccaguacuaacc

SEQ ID NO: 729439 - RNA, 62 nt, Homo Sapiens
gcggugcacuuucgcucuugggggcugcaccccagacauagcuggcaccagagcagggugcu

SEQ ID NO: 729440 - RNA, 62 nt, Homo Sapiens
uacuaaugauacuuacaaguuucuagcucucacagacauauagaauaaggguuuuugcauaa

SEQ ID NO: 729441 - RNA, 62 nt, Homo Sapiens
ccaucuuguauacacauauauacccacauguacagacauacauuuaugcacauucacgcugu

SEQ ID NO: 729442 - RNA, 62 nt, Homo Sapiens
cacaaggucguaaaugcauguaacacccaguacagacauaucaaauacaaggagggggcuau

SEQ ID NO: 729443 - RNA, 62 nt, Homo Sapiens
guuacaggaagugaaaugcagcauuuccucuacagacauagucucuccgaauccuccugaag

SEQ ID NO: 729444 - RNA, 62 nt, Homo Sapiens
aguuacugaaagcaaaucagcucccugcauuucagacauaccugcugacagcauggucuucc

SEQ ID NO: 729445 - RNA, 62 nt, Homo Sapiens
cucucacagcgcuaaggaagcucucugcccgucagacauaagaacagggacugcauuugcuc

SEQ ID NO: 729446 - RNA, 62 nt, Homo Sapiens
uuugagauguaaaaaaaaaacucuaauuauugcagacauauuaagugggacagcuaaugaag

SEQ ID NO: 729447 - RNA, 62 nt, Homo Sapiens
ccaaggaggcaccacaggucccaccauguggacagacauagcaccucagcgggcaggagguc

SEQ ID NO: 729448 - RNA, 62 nt, Homo Sapiens
gacaucuggcuugccacaaaggucuguucgaccagacauauccuagcuaagggauguccaaa

SEQ ID NO: 729449 - RNA, 62 nt, Homo Sapiens
ggcuccucucaagggcauucugggcuuguaaacagacauaggaagccucuguuuacccugaa

SEQ ID NO: 729450 - RNA, 62 nt, Homo Sapiens
agaaaccauaaaauuguuuuuauuuuucaggccagacauagcuuccuaaugaaagaaaaugg

SEQ ID NO: 729451 - RNA, 62 nt, Homo Sapiens
gugauccaggaggcucaaaguggccagagugacagacauacguguuugugaagaggcaggac

SEQ ID NO: 729452 - RNA, 62 nt, Homo Sapiens
uuuccuucuuuaagguaaucgacacacacacacagacauauauaugucuauauauauauaua

SEQ ID NO: 729453 - RNA, 62 nt, Homo Sapiens
cacguuaccagacgcuggagcggcgaggccgccagacauacaccuccuuugggcccagcggc

SEQ ID NO: 729454 - RNA, 62 nt, Homo Sapiens
ucaucauuccccagaaaccuuuaaacugaugacagacauaacuaguuauugaugugcaucug

SEQ ID NO: 729455 - RNA, 62 nt, Homo Sapiens
gauauauaggccaacuauuaaggaaaaauaugcagacauacaauuucuaaaaucccaagugu

SEQ ID NO: 729456 - RNA, 62 nt, Homo Sapiens
auuucacuuuuggaggggacaaguuuaguuuucagacauagaaguagauaaaaacaaauuuu

SEQ ID NO: 729457 - RNA, 62 nt, Homo Sapiens
gucaggaaagaacaaacuuccuugcagaaaugcagacauacagugaauagaacaaauucuga

SEQ ID NO: 729458 - RNA, 62 nt, Homo Sapiens
ccuaggagccuucagucugggagaaacagagccagacauagacaguuccagcaucacagaac

SEQ ID NO: 729459 - RNA, 62 nt, Homo Sapiens
ggcaaagccuucaacaaguccucaauucuuaccagacauaagauaauucuggcugggugcgg

SEQ ID NO: 729460 - RNA, 62 nt, Homo Sapiens
ggcaaagccuuuaagaagcccucaauucuuaacagacauaagauaauuuauacuggagagaa

SEQ ID NO: 729461 - RNA, 62 nt, Homo Sapiens
agcaaaguguucacuaagaguguuuaucuugccagacauaagaagaugaaugguagagcaac

SEQ ID NO: 729462 - RNA, 62 nt, Homo Sapiens
gacucuuccucagcagccuggcaggcaggaaacagacauaggaccccagcccagaucugaau

SEQ ID NO: 729463 - RNA, 62 nt, Homo Sapiens
aauagauuaccagaaaaaugaaaagaaaaaaacagacauacaaaauaaaagccccaguuuuu

SEQ ID NO: 729464 - RNA, 62 nt, Homo Sapiens
ggccacaaagcaacugcuggguuagcuuuccacagacauaaauauaguccaucugcaaucac

SEQ ID NO: 729465 - RNA, 62 nt, Homo Sapiens
ucuguaucuauguauguauauauaugcauaugcagacauauguauauggucuggucagcaua

SEQ ID NO: 729466 - RNA, 62 nt, Homo Sapiens
cccauagcaucccacaggcccccaggaacacgcagacauaugacggagaaacacaaacacca

SEQ ID NO: 729467 - RNA, 62 nt, Homo Sapiens
caagcaagcuggaagcuuccaaaaucgagcugcagacauagaucuaacaaagaacagccugu

SEQ ID NO: 729468 - RNA, 62 nt, Homo Sapiens
auaauucauacuagagagaacucaauuccuaacagacauaagggcaaagccuuuaauaaauu

SEQ ID NO: 729469 - RNA, 62 nt, Homo Sapiens
uaaauaaauacguauuuucacugcaaaauucacagacauaaauuacggacugagaagugucc

SEQ ID NO: 729470 - RNA, 62 nt, Homo Sapiens
caccucuaccucgaccacauugcuugaggcuccagacauacuucccagcagguaugggcagu

SEQ ID NO: 729471 - RNA, 62 nt, Homo Sapiens
ugccgcgcacucacggagcugcguagucuccucagacauagucaaagcuuugccgagaaaag

SEQ ID NO: 729472 - RNA, 62 nt, Homo Sapiens
cuaaacucagaggcagugacagcagucagggacagacauacauuucucauaccuuccccaca

SEQ ID NO: 729473 - RNA, 62 nt, Homo Sapiens
agagguuauauaaaaauacugcaaauagaccgcagacauaaauaucuaccaaaugcuaucuu

SEQ ID NO: 729474 - RNA, 62 nt, Homo Sapiens
gagcgagccccucggcucuggaggcaaucaagcagacauagaagagccaagaguccaggagg

SEQ ID NO: 729475 - RNA, 62 nt, Homo Sapiens
cugcaugaaucaguuuugggccugcuugcuuccagacauaacuuccuuagcgucuuguuuga

SEQ ID NO: 729476 - RNA, 62 nt, Homo Sapiens
cguuuugggaaaccaaggucaggaggccguugcagacauaaaucucggcgacucggccccgu

SEQ ID NO: 729477 - RNA, 62 nt, Homo Sapiens
caaggcagaugugucuuccuuuucauuaucagcagacauaagaucugagacagagucaucau

SEQ ID NO: 729478 - RNA, 62 nt, Homo Sapiens
uucuaucaagcuguauccuuaaauuaaaaagccagacauacuagagaugggugugcaagaua

SEQ ID NO: 729479 - RNA, 62 nt, Homo Sapiens
gcaggguugggcugaaucaaaugggagcccuccagacauaaggaggccagaggcugcaagga

SEQ ID NO: 729480 - RNA, 62 nt, Homo Sapiens
ggguucaggccuggcguagcacccacaaguggcagacauaucacaagaguccccagacucug

SEQ ID NO: 729481 - RNA, 62 nt, Homo Sapiens
uauauauauauguguauacacacacacauagacagacauauauauauauauuuauuuuuuuu

SEQ ID NO: 729482 - RNA, 62 nt, Homo Sapiens
uuggggacccaguauguccucuccucuagacccagacauacaguuauaaccgucuguccuag

SEQ ID NO: 729483 - RNA, 62 nt, Homo Sapiens
aggggcagaaggcuugaccacacccuuguagacagacauaagugggggcuuggagcagaaga

SEQ ID NO: 729484 - RNA, 62 nt, Homo Sapiens
gaagggauuaguacaauuucuauauguacauacagacauacucagauacacacacuugugua

SEQ ID NO: 729485 - RNA, 62 nt, Homo Sapiens
cgggugcagaagcggggagcugcugccagcagcagacauagaccucaccuucccugccuugg

SEQ ID NO: 729486 - RNA, 62 nt, Homo Sapiens
acaccuguacuuuagaguuuuuucagaugcggcagacauacacucugauuuccggggcagcc

SEQ ID NO: 729487 - RNA, 62 nt, Homo Sapiens
uuaaaacaauuuuaaaaucuuaaaauggccaucagacauagagagcuuugugugauucaugu

SEQ ID NO: 729488 - RNA, 62 nt, Homo Sapiens
uaagucuuagugaccaaacgugaccuugaaagcagacauagcaugacagaccuuccuagagu

SEQ ID NO: 729489 - RNA, 62 nt, Homo Sapiens
aucuugaagucauuaugcuaagugaaauaaaccagacauaaaaggacaaauacuaugauucc

SEQ ID NO: 729490 - RNA, 62 nt, Homo Sapiens
auuuguuucauuucaaauaggauuugaaaccucagacauacagaaaugcuuaugauauuccc

SEQ ID NO: 729491 - RNA, 62 nt, Homo Sapiens
uaucauuguaacuaaaaaagcugacauugacccagacauauuguacucuuucuaaaaauaau

SEQ ID NO: 729492 - RNA, 62 nt, Homo Sapiens
cggggacauucuacugugcuaaaaagccacugcagacauagcaauaaaaacaugucauuuuc

SEQ ID NO: 729493 - RNA, 62 nt, Homo Sapiens
auguuggagcaaaagcucccugaugucagacccagacauagacacaggaacagagaaauggu

SEQ ID NO: 729494 - RNA, 62 nt, Homo Sapiens
auguuugaacaaagacuccccgauuccagacccagacauagacguagauacagagaaguggu

SEQ ID NO: 729495 - RNA, 62 nt, Homo Sapiens
acagccaguuuggggccccuagagaauucauccagacauauuccauacacaccuaaaagaug

SEQ ID NO: 729496 - RNA, 62 nt, Homo Sapiens
uauauauaugcacacauauaaauacacacacacagacauauaauauugacauugaauggauc

SEQ ID NO: 729497 - RNA, 62 nt, Homo Sapiens
auagucaaggcucuuagucuucaagugcucaacagacauaugucaucuaaauuuuucaggua

SEQ ID NO: 729498 - RNA, 62 nt, Homo Sapiens
uucauaucauaaauuuuucuggaaagcuauuucagacauagauuucauaguauuuuucugag

SEQ ID NO: 729499 - RNA, 65 nt, Homo Sapiens
cugccucagccucuggaguagcugagacuacaggcgcccaccaccaugcccggcuaauuuuguuu

SEQ ID NO: 729500 - RNA, 65 nt, Homo Sapiens
ucuugcccugugguuugacucuccuuagaaccaccgcccaccagaaacauaaaggauuaaaauca

SEQ ID NO: 729501 - RNA, 65 nt, Homo Sapiens
gccccuccccucucacacugaccuccccccuuacggcccaccaggguauguaaauaucucuuuuc

SEQ ID NO: 729502 - RNA, 65 nt, Homo Sapiens
gacagagcugcugccuucccggccucacgcacccugcccaccagccccucggaagcaugugacaa

SEQ ID NO: 729503 - RNA, 65 nt, Homo Sapiens
gcaaguuguucuugaacaccugaggccuuccuggugcccaccaggcacuacggcuuccucuccag

SEQ ID NO: 729504 - RNA, 65 nt, Homo Sapiens
ccugaccccacuggaccaaaaggggcagcacuggugcccaccauacacacaggugucucauguga

SEQ ID NO: 729505 - RNA, 65 nt, Homo Sapiens
accggcugccucugagauagcccuggguacccugagcccaccagggacaccucgcccuucagccc

SEQ ID NO: 729506 - RNA, 65 nt, Homo Sapiens
guacccugagcccaccagggacaccucgcccuucagcccaccacccuggcaggcuuccauccccg

SEQ ID NO: 729507 - RNA, 65 nt, Homo Sapiens
cuccccgugggaagccuccgcccugagguccgcuggcccaccaccccugggugcucaguuucuac

SEQ ID NO: 729508 - RNA, 65 nt, Homo Sapiens
uccuugaugagcaugccagcuaugugguagggccagcccaccaugggggccaagaccugcacagg

SEQ ID NO: 729509 - RNA, 65 nt, Homo Sapiens
gaauuauggcuguaaauaacacuauaguuuaauaagcccaccauucugaguuuauuaaacauuuu

SEQ ID NO: 729510 - RNA, 65 nt, Homo Sapiens
uguauauuacccuggggcagugaagcccuaggugugcccaccaguaugaguugccauuaagaccu

SEQ ID NO: 729511 - RNA, 65 nt, Homo Sapiens
gagcccagggccucaaugagccugguccaugaagugcccaccacaucgcagcacuuuuaccacgu

SEQ ID NO: 729512 - RNA, 65 nt, Homo Sapiens
cccacccccacuggcuuuggugcuguccacacagugcccaccagaaggcagagggaacuccaggg

SEQ ID NO: 729513 - RNA, 65 nt, Homo Sapiens
acucuggaguuucuuaugugcccugguggacacuugcccaccauccugugaguaaaagugaaaua

SEQ ID NO: 729514 - RNA, 65 nt, Homo Sapiens
agaggccuucaaguccuuuccaccucucacccauugcccaccauuaauaagcuuagcuucucuug

SEQ ID NO: 729515 - RNA, 65 nt, Homo Sapiens
caagaccuggcacuccuccaagcuuggcacagugagcccaccagcucagaugguugaucuuacca

SEQ ID NO: 729516 - RNA, 65 nt, Homo Sapiens
uuagcaaagagaccagcugacugucucucggcccagcccaccacgccgaguagcuuguguggaug

SEQ ID NO: 729517 - RNA, 65 nt, Homo Sapiens
gaagccuuguugaagcugugagcaggagaagcggugcccaccagcuuccaggucucccugaccug

SEQ ID NO: 729518 - RNA, 65 nt, Homo Sapiens
ucugcaggaaucccggcuccagagcaggaaauucagcccaccagccaccucauccccaacccccu

SEQ ID NO: 729519 - RNA, 55 nt, Homo Sapiens
guggacgcugggccccgccaccugggcccaccaagccacccuggccaagaucuga

SEQ ID NO: 729520 - RNA, 65 nt, Homo Sapiens
gagcugcugccccuggguccugccucaucugccacgcccaccagugagaccucucucagcaccac

SEQ ID NO: 729521 - RNA, 65 nt, Homo Sapiens
caaguguuacaagccccagacuccugcuggcucucgcccaccaacccuccagccccgggccggac

SEQ ID NO: 729522 - RNA, 65 nt, Homo Sapiens
guuggucuuugccucaaagcagagcccacacccaugcccaccaguuccgucugcucaccugccac

SEQ ID NO: 729523 - RNA, 65 nt, Homo Sapiens
caugaggccaagggcuccacagcugggcccgcuuagcccaccaggccuccccuaccucaaacccc

SEQ ID NO: 729524 - RNA, 65 nt, Homo Sapiens
cccucucugcugccggugaucccuguccccuuucagcccaccagugggaagccccuccugccagu

SEQ ID NO: 729525 - RNA, 65 nt, Homo Sapiens
gguuagcacacucagcgcuguaguaccccaauuaagcccaccauuuggcagcuauuuccugagcc

SEQ ID NO: 729526 - RNA, 65 nt, Homo Sapiens
cagacucuguguguguauguuuuuuggcauguuuggcccaccacauagagaagugagaguauuua

SEQ ID NO: 729527 - RNA, 65 nt, Homo Sapiens
cuuccccaccccguaucaguggcugauggcugagagcccaccaacuucacguguaagaugagaau

SEQ ID NO: 729528 - RNA, 65 nt, Homo Sapiens
auuuccugugagggcccaggaaauccuugcugcgugcccaccagggguuacugccuucucccuug

SEQ ID NO: 729529 - RNA, 65 nt, Homo Sapiens
cccacaggugcugugcuuugagcacggucuccugugcccaccagccaggcagucuggccugugcc

SEQ ID NO: 729530 - RNA, 65 nt, Homo Sapiens
ggccaugcucaccgcccugcagaaccgcggccgaagcccaccacugagagugaguggccacaggu

SEQ ID NO: 729531 - RNA, 65 nt, Homo Sapiens
accagaggucacucuccacaaacugaagauguucugcccaccagcucagacucuccugguugugu

SEQ ID NO: 729532 - RNA, 65 nt, Homo Sapiens
ggguguaggugaaaggcaucugacaaugcugccaugcccaccaucugccccaacugcaggaaugc

SEQ ID NO: 729533 - RNA, 65 nt, Homo Sapiens
guucauuugugcaccaauuacuuuggaagucaugagcccaccauuuuaagaaguaauuuuccaac

SEQ ID NO: 729534 - RNA, 65 nt, Homo Sapiens
uugaaauccuagaaauacaguauaaauaaaagaaugcccaccagacacauacuccagauugaccu

SEQ ID NO: 729535 - RNA, 65 nt, Homo Sapiens
cugccucagccucccgaguagcugggacuacaggcgcccaccaccacgcccggcuaauuuuuugu

SEQ ID NO: 729536 - RNA, 65 nt, Homo Sapiens
cagccucagccucccgaguagcugggauuaugggcgcccaccaccaugcccagcuaauuuuugua

SEQ ID NO: 729537 - RNA, 65 nt, Homo Sapiens
gccaguggggggcaggggugcgccuccucugcccugcccaccagccugugauuugauggggucuu

SEQ ID NO: 729538 - RNA, 65 nt, Homo Sapiens
gcccaaccccgcagccugggcuucgaaggcgacccgcccaccauccugcccuucccagaaccuga

SEQ ID NO: 729539 - RNA, 65 nt, Homo Sapiens
ccauaaguaguuuugagaggguggauggguuacuugcccaccagaaacagcccuagucccaacuc

SEQ ID NO: 729540 - RNA, 65 nt, Homo Sapiens
aaaaucaaaacuucuuuaagcugguaaagugaggggcccaccagcagugaucuccugaugccuua

SEQ ID NO: 729541 - RNA, 65 nt, Homo Sapiens
cauggcuucauuuagagaccacaguaacaacagcagcccaccaaucagagaagcugguuguuauu

SEQ ID NO: 729542 - RNA, 65 nt, Homo Sapiens
accuccccagcaagcaaccugaaaucucagcagaugcccaccauuucucuagaucgccuagucuc

SEQ ID NO: 729543 - RNA, 65 nt, Homo Sapiens
ccggcugcuagcccacggugaagcccggcgggguugcccaccaguugcgaaagcccccuuuccuc

SEQ ID NO: 729544 - RNA, 65 nt, Homo Sapiens
uuucuugagcaccuucugugcccagcauaugcuaggcccaccagcuaaguguguguggggggucu

SEQ ID NO: 729545 - RNA, 65 nt, Homo Sapiens
uugggggagggcccgaaauaucuauguuuuaccaagcccaccacaugauucugauguacucuaaa

SEQ ID NO: 729546 - RNA, 65 nt, Homo Sapiens
cugggggugucccagggacucugucagugccuucagcccaccagcaggagcuuggaguuugggga

SEQ ID NO: 729547 - RNA, 65 nt, Homo Sapiens
agccucggccaggccugcucugcucagcgcccaccgcccaccaccccuccugcuuccccgagccu

SEQ ID NO: 729548 - RNA, 65 nt, Homo Sapiens
ccuccccgccuccucccacugggacucccagcagagcccaccagccagcccuggcccacccccca

SEQ ID NO: 729549 - RNA, 65 nt, Homo Sapiens
gggaaagugggagguggugcuggugcucucuccaggcccaccaugcugggagaggcggccagagc

SEQ ID NO: 729550 - RNA, 65 nt, Homo Sapiens
acagagauuuuacauggaaagauggugccaccuaugcccaccacaaacaagaccucuuuucuuua

SEQ ID NO: 729551 - RNA, 65 nt, Homo Sapiens
uccaaucucucaaaacgguccuguuuucucuuucugcccaccacaacaggaaacuuauucuauuc

SEQ ID NO: 729552 - RNA, 65 nt, Homo Sapiens
uggcucugcagcacauugcccugccagccgcuggugcccaccagcugggcauggccguugccucu

SEQ ID NO: 729553 - RNA, 65 nt, Homo Sapiens
ccacaaagagcagcaccugagcagaacagaccagagcccaccacagcucccaggcccagcaccga

SEQ ID NO: 729554 - RNA, 65 nt, Homo Sapiens
aacucacugaacaaugagacacagccagcccaccagcccaccauuguaaauaucuacucacucau

SEQ ID NO: 729555 - RNA, 65 nt, Homo Sapiens
ccaccauuaacucacugaacucacucauacagccagcccaccagccaggcagaguaaauaucuac

SEQ ID NO: 729556 - RNA, 65 nt, Homo Sapiens
cucccacuuccccuccccuugggucaagccacccugcccaccaccaguucccugggaggcugaca

SEQ ID NO: 729557 - RNA, 65 nt, Homo Sapiens
gugcccggcuaauuuaguuggccgggacuacaggcgcccaccacccugccucagccucccgagua

SEQ ID NO: 729558 - RNA, 65 nt, Homo Sapiens
ugaguugaggugauuucaugacuaugaguaggugggcccaccacuagcuggcuaguguaacacug

SEQ ID NO: 729559 - RNA, 65 nt, Homo Sapiens
uacugaagggacccaaggcacuuccugcagcucacgcccaccagccuccugccaagccaaaugug

SEQ ID NO: 729560 - RNA, 65 nt, Homo Sapiens
gccacggccuuugaccaucuaaggccgagugcaccgcccaccacuuauuauuacaguuccacauc

SEQ ID NO: 729561 - RNA, 65 nt, Homo Sapiens
cagucccccaauuccagagacacccacaaaaugcagcccaccaccguguugcaguaccccccauu

SEQ ID NO: 729562 - RNA, 65 nt, Homo Sapiens
gugucaugagagaauggguuacagugagcugaugugcccaccaccccuuaaggacuuagcuggcc

SEQ ID NO: 729563 - RNA, 65 nt, Homo Sapiens
cucacuggaaaacagugguccuuuguuuuggaauggcccaccauuggauguuuggaacccuuuag

SEQ ID NO: 729564 - RNA, 65 nt, Homo Sapiens
ccccuccccaccucacuuggggcccccagcagguugcccaccaagcugaaaggcagugauuuaga

SEQ ID NO: 729565 - RNA, 65 nt, Homo Sapiens
caggcagucagagcuggaaguguauggagagcccagcccaccagguccugccuuuugcggugaua

SEQ ID NO: 729566 - RNA, 65 nt, Homo Sapiens
cugccucagccucccgaguagcugggaccacaggggcccaccaccgcgcccggcuaauuuuuugu

SEQ ID NO: 729567 - RNA, 65 nt, Homo Sapiens
cuagccaggcauuccaaacaauuucuuauacugcugcccaccaaagcagcuugccaacagucaaa

SEQ ID NO: 729568 - RNA, 65 nt, Homo Sapiens
cuaccucagccucccgaguagcugggacuacaggcgcccaccaccaugcccggcuaauuuuuguu

SEQ ID NO: 729569 - RNA, 65 nt, Homo Sapiens
ggcucacgacgauggcaccugcugugucccaccuggcccaccagaauccccucccccuggggugu

SEQ ID NO: 729570 - RNA, 61 nt, Homo Sapiens
caagccugggccuucuggucuggaguuaugggcccaccaggcagggacagaaaggggauag

SEQ ID NO: 729571 - RNA, 65 nt, Homo Sapiens
gaguuuuccacccgucucuccaacuaagagccaaggcccaccaagaggauggagcaccucuggga

SEQ ID NO: 729572 - RNA, 65 nt, Homo Sapiens
aagauccaggauaaucucucucuuugacuuacaaagcccaccaggcacuggcccucccacuuccc

SEQ ID NO: 729573 - RNA, 65 nt, Homo Sapiens
augagcuggaguggggaugagcagggaaccuccacgcccaccaccugcuccuuagccuggaagau

SEQ ID NO: 729574 - RNA, 65 nt, Homo Sapiens
guccuuuugacacugcucuauguccaacccgucuggcccaccaggccaacuaugauuauuaacga

SEQ ID NO: 729575 - RNA, 65 nt, Homo Sapiens
ugucaggauagucacagugacagccacauccccaagcccaccagguccugccccuuucaggccua

SEQ ID NO: 729576 - RNA, 61 nt, Homo Sapiens
cccaggaauauugaaauagcacaggcuaauugcccaccacuaaacagauccuaagccauag

SEQ ID NO: 729577 - RNA, 65 nt, Homo Sapiens
gaauacauucucuauuaguuaugccuuccagugaugcccaccagaaggggaggaccugcccaggu

SEQ ID NO: 729578 - RNA, 65 nt, Homo Sapiens
ucccccugcugggucaggagagggcugguacauccgcccaccaugggacugucauguuauccaga

SEQ ID NO: 729579 - RNA, 65 nt, Homo Sapiens
gaccauggagcaguggcacccccagugcucuuccugcccaccaggggccuuuccuaugggcaagg

SEQ ID NO: 729580 - RNA, 65 nt, Homo Sapiens
acccacugcccaccucuaagauacuuaccaguacugcccaccacccaagucccagccacccaagc

SEQ ID NO: 729581 - RNA, 65 nt, Homo Sapiens
aacauaauuuuaaagccuuuguaaguuaccagaaagcccaccagcauauaaaaaauaauuuccau

SEQ ID NO: 729582 - RNA, 65 nt, Homo Sapiens
gugccucagccuccugaguagcugggacuacaggcgcccaccaccacacauggcuaauuuuugua

SEQ ID NO: 729583 - RNA, 65 nt, Homo Sapiens
ugccuguggagcagugcccaucccagcccguuucugcccaccaguuguucucaggaaccuuaccc

SEQ ID NO: 729584 - RNA, 65 nt, Homo Sapiens
uauacaaagccuuggucccgugaaaacacucgugugcccaccagcggccuugaagaggcaggucu

SEQ ID NO: 729585 - RNA, 65 nt, Homo Sapiens
gagcaucacaggauguuccagugucccuggucucugcccaccagaugccagcacucccaccauuc

SEQ ID NO: 729586 - RNA, 65 nt, Homo Sapiens
guccccuugcugauggcauggugcuccuggugucugcccaccacuugguccucuaggcaggcagg

SEQ ID NO: 729587 - RNA, 65 nt, Homo Sapiens
agggccaggggcauacgcaggggcucgccuugcacgcccaccagguguggcuggccaugggcacu

SEQ ID NO: 729588 - RNA, 65 nt, Homo Sapiens
acacaucacaggcugauuucgucuucuaggugcuggcccaccaccuaugugcacaaccaccaugu

SEQ ID NO: 729589 - RNA, 65 nt, Homo Sapiens
auaaucuuuauguuaccaaggugaaaucagccccugcccaccaaaggagcauuuguaagcacaug

SEQ ID NO: 729590 - RNA, 65 nt, Homo Sapiens
uugccucagccucaugaauagcugggauuacaggugcccaccaccaugccuggcuaguuuuugua

SEQ ID NO: 729591 - RNA, 65 nt, Homo Sapiens
gcuaauugucaacuuuauuaaggauuacuuugucugcccaccaccuaguguaaaauaaaaucaag

SEQ ID NO: 729592 - RNA, 65 nt, Homo Sapiens
cugccucagccucaugaauagcugggauuacaggugcccaccaccaugccuggcugguuuuugua

SEQ ID NO: 729593 - RNA, 65 nt, Homo Sapiens
uucuggcuaucgucccccuucucacugaccugaccgcccaccaccuccuucccccucaucacaug

SEQ ID NO: 729594 - RNA, 65 nt, Homo Sapiens
uuaauauauucuuguuggcuaacuaaauuguguaugcccaccacaaagaagguacuauuuuuugu

SEQ ID NO: 729595 - RNA, 65 nt, Homo Sapiens
cugcaucagccucccgaguagcuggcauuacaggcgcccaccaccacgcucggcuaaauuuuuuu

SEQ ID NO: 729596 - RNA, 65 nt, Homo Sapiens
ggugcuaggcugggagcugcccugagagcugggaugcccaccaaggcccacagaacugucuccag

SEQ ID NO: 729597 - RNA, 65 nt, Homo Sapiens
aguagggugugacuugaaaguaucgugaccauguggcccaccagcagccuuuccaaaggggaacu

SEQ ID NO: 729598 - RNA, 50 nt, Homo Sapiens
cugucaccucccuggugugagcccaccagcgcgcaccgucgccacggauc

SEQ ID NO: 729599 - RNA, 65 nt, Homo Sapiens
aaauggaaugaugacuuugaaaaccacuggcuuacgcccaccauuuccgagguccuguccacggc

SEQ ID NO: 729600 - RNA, 65 nt, Homo Sapiens
acgcccagcuaauuuuuuuugcugggauuacgggcgcccaccaccgagccuuaagcucccaagua

SEQ ID NO: 729601 - RNA, 65 nt, Homo Sapiens
acacucggcuaauuuugugugcugggguuacaggcgcccaccaccgugccucagccucccaagua

SEQ ID NO: 729602 - RNA, 65 nt, Homo Sapiens
cccucaagccccagcagcccagugccuugcucggcgcccaccaccgccuuugcauuuauuuauac

SEQ ID NO: 729603 - RNA, 65 nt, Homo Sapiens
ucuccauagguucuagucuggagcccaggccuguugcccaccaaggagguugggcuggcuggacu

SEQ ID NO: 729604 - RNA, 65 nt, Homo Sapiens
ggcaggggccugcucccagcgcuauugcuuuaggggcccaccacggagggcagggggccuacggu

SEQ ID NO: 729605 - RNA, 65 nt, Homo Sapiens
ccagcaccugugccgaggucagaucaccuccugcagcccaccacuagggacaaagagggcaaaug

SEQ ID NO: 729606 - RNA, 65 nt, Homo Sapiens
gugcgaauccugacccaagguucuccuggguuugugcccaccaugaacacguuuacaggaaagug

SEQ ID NO: 729607 - RNA, 65 nt, Homo Sapiens
ggcuggggagaaggagggguaaugcccgggcuggugcccaccaggugucuugggcuguaggcuag

SEQ ID NO: 729608 - RNA, 64 nt, Homo Sapiens
acgccugaagucacagcuccggugcagggccugggcccaccacgucucuuuccucgccacauag

SEQ ID NO: 729609 - RNA, 65 nt, Homo Sapiens
cuaugacgugcgcuaugcacagggcgccaucuucugcccaccaugggguggcuucuuugaggaga

SEQ ID NO: 729610 - RNA, 65 nt, Homo Sapiens
aggggucagcaaacuacugccugugggccaaauuugcccaccaccuguaucuguaaauaagguuu

SEQ ID NO: 729611 - RNA, 65 nt, Homo Sapiens
gacuccucuuugugcagagaccagcccaccccugugcccaccaugacccucuuccucaugcugaa

SEQ ID NO: 729612 - RNA, 65 nt, Homo Sapiens
uugcuccgcucccaccgcccccaccccuuccccaggcccaccaucaccaccgccucuggccgcca

SEQ ID NO: 729613 - RNA, 65 nt, Homo Sapiens
ccagccacaggcuucuuguccaccucuucuccccugcccaccagcugcucagcgcauaagaccuu

SEQ ID NO: 729614 - RNA, 65 nt, Homo Sapiens
uaccaaaacacagacaaaccaaagguaaccagcuagcccaccacugaaaggaaagaucugagaca

SEQ ID NO: 729615 - RNA, 65 nt, Homo Sapiens
cgaggacuccacuucuggggacgccugguucguucgcccaccaggccuaggcuacgcuccaugcu

SEQ ID NO: 729616 - RNA, 65 nt, Homo Sapiens
cugccucagccugcugaguaguugggauuacaggcgcccaccaccaugcccagcuaauuuuugug

SEQ ID NO: 729617 - RNA, 65 nt, Homo Sapiens
ucuucaugucaagagagggaagcaggaggccacaagcccaccagggaagacagggaaaggaaggc

SEQ ID NO: 729618 - RNA, 65 nt, Homo Sapiens
uuuccucucuuguccccuagacccccagcccuacugcccaccaggcacacuuacugcuacucugu

SEQ ID NO: 729619 - RNA, 65 nt, Homo Sapiens
gcagacaucuuccacguggacuaaaaugaauguaugcccaccagauugugaguuuaguuucucuc

SEQ ID NO: 729620 - RNA, 65 nt, Homo Sapiens
uauuuccuuuauagcuaaaacacgcucucugccaagcccaccaagcaguuccuguaauuuuguga

SEQ ID NO: 729621 - RNA, 65 nt, Homo Sapiens
cuucccagaacccucggacggcuguuccuggcugugcccaccacccgccuaagaggaacacagca

SEQ ID NO: 729622 - RNA, 65 nt, Homo Sapiens
ccacauuuucuccaggaaauuaccaacuuuucaaagcccaccaauuucuuaaaacacaaaguuuu

SEQ ID NO: 729623 - RNA, 65 nt, Homo Sapiens
ucaaggccaguucugcagugacaggcccaggggcugcccaccaggugugcugggcagacuucagc

SEQ ID NO: 729624 - RNA, 65 nt, Homo Sapiens
uaaaugugaauguaugagcugggggagucaacccagcccaccaugccuuggcugaugauaccaga

SEQ ID NO: 729625 - RNA, 65 nt, Homo Sapiens
gccucuccuggggccacuguugggggugggagugagcccaccacagaggccacaggcaggccccc

SEQ ID NO: 729626 - RNA, 65 nt, Homo Sapiens
ggcggagggcaggggaacgggauccuucucccgcugcccaccaacaccaacacacacacaccucu

SEQ ID NO: 729627 - RNA, 65 nt, Homo Sapiens
gcugugggaacuuccaggcccagcccccaggagccgcccaccacgcuggcucccgagcucagaca

SEQ ID NO: 729628 - RNA, 64 nt, Homo Sapiens
gaggcagaugccaaaccaaaaggcucaggaaacagcccaccacacucagucaagacggaaguaa

SEQ ID NO: 729629 - RNA, 65 nt, Homo Sapiens
ccaagggcagugccccaaggacugcccaaaaacuugcccaccagaaggaaagccagcagccccag

SEQ ID NO: 729630 - RNA, 65 nt, Homo Sapiens
gcacugcugaugcaugccaugaaaaccaaguuuaagcccaccaauaucuguauauacacauaacu

SEQ ID NO: 729631 - RNA, 65 nt, Homo Sapiens
aucucccuccugagaugccguggccauggcucugugcccaccagcgcuccgcguguugguggcug

SEQ ID NO: 729632 - RNA, 65 nt, Homo Sapiens
cccugcccccagcccaagagcccucccauagggcugcccaccaaguguggucccccaccagcucc

SEQ ID NO: 729633 - RNA, 65 nt, Homo Sapiens
gcggcccucacuuguggucaccugugccccuugaagcccaccaaaagcccuggccaccacaccgg

SEQ ID NO: 729634 - RNA, 65 nt, Homo Sapiens
cacagcucccuucucaucucguuuucucccucucagcccaccaccugcaggauuugucccacucu

SEQ ID NO: 729635 - RNA, 65 nt, Homo Sapiens
gcuggugagacaaccucugauccugaggaccggccgcccaccaaggguugggcccccggggccag

SEQ ID NO: 729636 - RNA, 65 nt, Homo Sapiens
ugcagggguguccuuguccacucgcaccccucgccgcccaccagggccaugcucugugacuuggg

SEQ ID NO: 729637 - RNA, 65 nt, Homo Sapiens
auggccuggcagcucuccagcagggcagaguguuugcccaccagcugcuagcccuaggaaggcca

SEQ ID NO: 729638 - RNA, 65 nt, Homo Sapiens
cgucaggcccugacuccucucucaccagcccugcagcccaccagacccucucugaugucccagug

SEQ ID NO: 729639 - RNA, 65 nt, Homo Sapiens
gacgauguggguauggaaccgcauguggccacacugcccaccaccuagccggcuuugccauccgg

SEQ ID NO: 729640 - RNA, 65 nt, Homo Sapiens
ggucaaugucaagagaggaacuuaugagcgucacugcccaccaaaguccuugaacccaacagucc

SEQ ID NO: 729641 - RNA, 65 nt, Homo Sapiens
gauguggucauaagaucugauuguaaauauuuuaugcccaccagaccacugugccuuuaacaagg

SEQ ID NO: 729642 - RNA, 65 nt, Homo Sapiens
uguccgucccuguccccuuucacagccccugcugggcccaccacccgucagcuguaacccucacc

SEQ ID NO: 729643 - RNA, 65 nt, Homo Sapiens
uuucggaaugccugcuuaccaaggccagccccccggcccaccagccuuccauggcuucugaguac

SEQ ID NO: 729644 - RNA, 65 nt, Homo Sapiens
acauauagaauugggaacugcaauuuuuguucaaugcccaccaagggaaacaaaggcuuagcaaa

SEQ ID NO: 729645 - RNA, 57 nt, Homo Sapiens
cgaauuguagagcugcuugugcccugcgcccaccaaugcagugccggccaguucuga

SEQ ID NO: 729646 - RNA, 65 nt, Homo Sapiens
cuugaugacuaaaaguagcuagugccugugguuuagcccaccaauuacagaauauaaacaacagu

SEQ ID NO: 729647 - RNA, 65 nt, Homo Sapiens
acuuuugagcuggggcugacccagccuguggcuuugcccaccaggccccagccugcccacuacau

SEQ ID NO: 729648 - RNA, 65 nt, Homo Sapiens
ccgcugaccucuggccacaggaagccagguccaccgcccaccacccuuucaggccauguuucuac

SEQ ID NO: 729649 - RNA, 61 nt, Homo Sapiens
ccaucgaugaccgaaagugaccaagaccaaggcccaccaaggcagcagacuguuaaucaga

SEQ ID NO: 729650 - RNA, 65 nt, Homo Sapiens
cagagcaauaggaggaaaaggaaagcguuuuuguagcccaccaucuacagcuuuacuguaaaacc

SEQ ID NO: 729651 - RNA, 65 nt, Homo Sapiens
uggggcaguggucagaccccacacgcccucucugggcccaccaccugcaucugcgacuagagagc

SEQ ID NO: 729652 - RNA, 65 nt, Homo Sapiens
ucaucucacuccuuugccugcacugccaggguggggcccaccaagauuccugaucaugacgggaa

SEQ ID NO: 729653 - RNA, 65 nt, Homo Sapiens
cccagaggguuuccaugggguaggaggaugggcucgcccaccagugacuuuuucuaagagcuccc

SEQ ID NO: 729654 - RNA, 65 nt, Homo Sapiens
caauaccuuaacaaaugcacucugagcuggagggagcccaccauuugcacccaccuacccacccu

SEQ ID NO: 729655 - RNA, 65 nt, Homo Sapiens
ugcuuccugcuccuuggagcuggcucccggaccuugcccaccauccaugcaguggcucccagggc

SEQ ID NO: 729656 - RNA, 65 nt, Homo Sapiens
agccccacucacagcugcugcuacacaucuugccagcccaccagcgcuaugcacccccaccauuc

SEQ ID NO: 729657 - RNA, 65 nt, Homo Sapiens
cacucuggcacuggcuucaugagagcccccaucaugcccaccacccaggcugggagcagccuagg

SEQ ID NO: 729658 - RNA, 65 nt, Homo Sapiens
ggggcuccuuguuacacauggagcccacuggaaacgcccaccacgcuggcugccaggcucgccag

SEQ ID NO: 729659 - RNA, 65 nt, Homo Sapiens
aggucgguucccgaggccugcccguccgccauccugcccaccacccacccaccuccgcauccacc

SEQ ID NO: 729660 - RNA, 65 nt, Homo Sapiens
gcccaggcaccacugugaaugcugggacccuccuggcccaccaagccauugccccucccauccau

SEQ ID NO: 729661 - RNA, 65 nt, Homo Sapiens
augccuggcugauuuuuguagcuggcauuauaggugcccaccacccugccucagccuccugagua

SEQ ID NO: 729662 - RNA, 57 nt, Homo Sapiens
gugugcugguguccaagugaggccggcgcccaccaugcuccugggcgcccacgcggc

SEQ ID NO: 729663 - RNA, 65 nt, Homo Sapiens
gucucgacacguaccacguacguggaaacacaagagcccaccacuugaauuucuaagaccauuuc

SEQ ID NO: 729664 - RNA, 65 nt, Homo Sapiens
gagaaagaccaucaaucaggggccauaguacaggagcccaccagcaggauuuuugaauaauccua

SEQ ID NO: 729665 - RNA, 65 nt, Homo Sapiens
gggaagagggcucacaagacacauuugucccccgggcccaccacaucauccucacguguucggua

SEQ ID NO: 729666 - RNA, 65 nt, Homo Sapiens
auggucuuugcaaaaaggaacaaaacaacacaaaagcccaccaggcugcugcuuuguggaaagac

SEQ ID NO: 729667 - RNA, 65 nt, Homo Sapiens
ccaagucagccucccugcgacugcccaggcacacugcccaccaccccacccccgaaacaaugcca

SEQ ID NO: 729668 - RNA, 65 nt, Homo Sapiens
acugaagaggaggggcugccgggcaaaguugcucugcccaccagacaguaaggagaaacagagag

SEQ ID NO: 729669 - RNA, 65 nt, Homo Sapiens
acacccagcuaauuuuuuuggcugggacuacaggugcccaccacccccgaguagucccaggagua

SEQ ID NO: 729670 - RNA, 65 nt, Homo Sapiens
aacucagaggugauuggggaaaugacccauucccugcccaccagacugagugagacaaauacaga

SEQ ID NO: 729671 - RNA, 65 nt, Homo Sapiens
guucaggaccccugcuuuugacuccaauccccugagcccaccacuagaaaaacauaaaggaaaaa

SEQ ID NO: 729672 - RNA, 65 nt, Homo Sapiens
ccaucccagaucuuccuuuacggcaagcuggaauggcccaccagcgcuucagauggcuuugauuu

SEQ ID NO: 729673 - RNA, 65 nt, Homo Sapiens
gccagaaagugcaagcacccucaggccaaggucucgcccaccaaacuuccugugaaccaaaguuc

SEQ ID NO: 729674 - RNA, 65 nt, Homo Sapiens
cagcagucaggggagaaaaugccugccuguccugugcccaccacgacccagccuccucagacccc

SEQ ID NO: 729675 - RNA, 65 nt, Homo Sapiens
cuccccuuucugccuggucagccccguggccucuggcccaccaagcucccugucacccagccaug

SEQ ID NO: 729676 - RNA, 63 nt, Homo Sapiens
aguaccguaacguggagugaggggcugcccugggcccaccacugcccaagaguucuugcuguu

SEQ ID NO: 729677 - RNA, 65 nt, Homo Sapiens
cagccucagccucccgaauagcugggauuacacgugcccaccaccaugcccagcuaauuuuugua

SEQ ID NO: 729678 - RNA, 65 nt, Homo Sapiens
cuccagccucugccgcugccaugcuuugaguccacgcccaccagccuugcucucuucaauaaacc

SEQ ID NO: 729679 - RNA, 65 nt, Homo Sapiens
cugccucagccucuugaguagcugggauuacaggcgcccaccaccacagccugcuaauuuuugua

SEQ ID NO: 729680 - RNA, 65 nt, Homo Sapiens
agcacaucuggcucacuccccacuccgucucuggagcccaccagggaaggcccucauccccugcc

SEQ ID NO: 729681 - RNA, 65 nt, Homo Sapiens
gccaccacucaggggcucuggaggggucagcuggagcccaccaagcugucacugcugcacucacu

SEQ ID NO: 729682 - RNA, 65 nt, Homo Sapiens
aucccucucuaccucccaaggugauaugggcagcugcccaccacuccagagguagcagcauccuu

SEQ ID NO: 729683 - RNA, 65 nt, Homo Sapiens
caucugccucauaggccacucuuuccuuucccucugcccaccaaguccucauaucugcagagaac

SEQ ID NO: 729684 - RNA, 65 nt, Homo Sapiens
cccagugucuucucuacauggcauaaagcggcaaagcccaccauuaggugaggcggucccgaguu

SEQ ID NO: 729685 - RNA, 65 nt, Homo Sapiens
ccugccucagccucucaaguagcgggauuacaggcgcccaccaccaaaaauuagcccagcuaauu

SEQ ID NO: 729686 - RNA, 65 nt, Homo Sapiens
cccugccaugcucucacccucgaggcaacccuggggcccaccagcucucccuggacgaccggccu

SEQ ID NO: 729687 - RNA, 65 nt, Homo Sapiens
acgccuggcucauuuuuuuggcugggacuacaggcgcccaccacgcugccucagcuucccgagua

SEQ ID NO: 729688 - RNA, 65 nt, Homo Sapiens
accccuggcuaaauuuguaugcugggauuacaggugcccaccacccugccucagccucccaagua

SEQ ID NO: 729689 - RNA, 65 nt, Homo Sapiens
caugauuaggccucagacccgagaggggguacugugcccaccacagccuguccccagaggcugag

SEQ ID NO: 729690 - RNA, 65 nt, Homo Sapiens
ccaccucuggauaauuuugccucaagccgacuuaugcccaccaucuucucgacuggaggaccaca

SEQ ID NO: 729691 - RNA, 65 nt, Homo Sapiens
ucgggguaugguuguaggccuguggaggugccagggcccaccaugaggcugccgaggccagggcc

SEQ ID NO: 729692 - RNA, 65 nt, Homo Sapiens
cugugcuguacaccccguuaagcuucucccugagggcccaccagcgugcugcauacccaccgccc

SEQ ID NO: 729693 - RNA, 65 nt, Homo Sapiens
cugugcugcauacccaccgcagcuucucccugagggcccaccagcgugcugcauacccaccgccc

SEQ ID NO: 729694 - RNA, 65 nt, Homo Sapiens
cugugcugcauacccaccgcgcccugccucugagggcccaccagccuuggggccgaacagccccu

SEQ ID NO: 729695 - RNA, 65 nt, Homo Sapiens
augccuggcuaauuuuuguagcugggauuacaggugcccaccaaccucucucagccuccugggua

SEQ ID NO: 729696 - RNA, 65 nt, Homo Sapiens
augcccggcuaauuuuugugguugggauuacaggcgcccaccacccugccucagcauccuaauua

SEQ ID NO: 729697 - RNA, 65 nt, Homo Sapiens
cccgccuaauuuuuuguauuaguggcgcgaucuuggcccaccacgugucccccaggcuggagugc

SEQ ID NO: 729698 - RNA, 65 nt, Homo Sapiens
cccaccuuccagaaacuugguaaggagcugagggugcccaccaagaggggccagcugggaaaugc

SEQ ID NO: 729699 - RNA, 65 nt, Homo Sapiens
auguuccuugaagcccaucgaggaccacagccucugcccaccagcgaggcagcauaaaggacuca

SEQ ID NO: 729700 - RNA, 65 nt, Homo Sapiens
ccucugcccaccucacaugcugcuuccaucucccagcccaccagccuugcugucccggugucacc

SEQ ID NO: 729701 - RNA, 65 nt, Homo Sapiens
cuucaggaguaggggaagccacuggagcaggcauggcccaccaggaucccuccaggccagaacug

SEQ ID NO: 729702 - RNA, 65 nt, Homo Sapiens
uggaaucacuagcuuggguugucugagccugcugggcccaccacaacccccuggcccacccuggg

SEQ ID NO: 729703 - RNA, 65 nt, Homo Sapiens
ggccagguccagcgcuuccuggugcuguccucucggcccaccauccgccccacuucucccagccu

SEQ ID NO: 729704 - RNA, 65 nt, Homo Sapiens
ucuccgaagaggaaagccacacagugaagaagggagcccaccaccuggccagaggagggaggggc

SEQ ID NO: 729705 - RNA, 65 nt, Homo Sapiens
cccuucacaccccccuucaccccucauaugcacaagcccaccaacauaaugaaaucguucacauu

SEQ ID NO: 729706 - RNA, 65 nt, Homo Sapiens
uccaccucagcgggccagcagcccagggaaccccugcccaccaggauugcuggaagugugacgga

SEQ ID NO: 729707 - RNA, 65 nt, Homo Sapiens
gggugcccagcccccuuuccucaccugauacccaagcccaccacuuuuauuuucuggugaggugg

SEQ ID NO: 729708 - RNA, 65 nt, Homo Sapiens
cugccucagccucccgaguagcugggacuauaggcgcccaccacgacgcccggcuaauuuuuugu

SEQ ID NO: 729709 - RNA, 65 nt, Homo Sapiens
cugucucagccuccuagauaacugggauuacaggugcccaccaccaugcccggcuaauuuuugua

SEQ ID NO: 729710 - RNA, 65 nt, Homo Sapiens
gcaguguggggcaggcaccccacuggcugcagcuagcccaccauaggcacagcacaucccaccac

SEQ ID NO: 729711 - RNA, 65 nt, Homo Sapiens
ugcucagccuguuucucucugcccucuagagcaaggcccaccagguccauccaggaggcucuccu

SEQ ID NO: 729712 - RNA, 65 nt, Homo Sapiens
uguaaccugaacuucugugugguggcaguacuguggcccaccaguguaaucucccuggauuaagg

SEQ ID NO: 729713 - RNA, 65 nt, Homo Sapiens
cccuccuuggggcguuuaggacugggcgucuccaagcccaccauggcccagauggacgugcaaag

SEQ ID NO: 729714 - RNA, 63 nt, Homo Sapiens
gggacggagacacugacugaggcgaugggagcugcccaccagagugccucugagcagcucaca

SEQ ID NO: 729715 - RNA, 65 nt, Homo Sapiens
gcuauucagauuggacugugucacuucuagaaauagcccaccaagaacagcacacagggucaggg

SEQ ID NO: 729716 - RNA, 65 nt, Homo Sapiens
uaagaaauaucacagagccaagccagcccagccuugcccaccauuuguuaaugaguuacauuauc

SEQ ID NO: 729717 - RNA, 65 nt, Homo Sapiens
aacucauucauguaguuuaucuggaauacgaugcagcccaccauugugacagucagaaaacacac

SEQ ID NO: 729718 - RNA, 65 nt, Homo Sapiens
cccuugggaccugguucucuuggaaccaucugcccgcccaccaugccuaugaaucucuaaggcuc

SEQ ID NO: 729719 - RNA, 65 nt, Homo Sapiens
aucccauugcccugguuauacccacccccuucagugcccaccaacaaucggcccacagcucccac

SEQ ID NO: 729720 - RNA, 65 nt, Homo Sapiens
cagaugugacccucaggccaagcuguacaaaaacugcccaccagcaaaaaccauguuuagcuugc

SEQ ID NO: 729721 - RNA, 65 nt, Homo Sapiens
cggggagguguucaaagacacuggucugggucucugcccaccaggcagagcaacuuccagcaagg

SEQ ID NO: 729722 - RNA, 65 nt, Homo Sapiens
ggacucggcccccaaggcuccuccccuugggucccgcccaccagccccaacuucccuacuggcug

SEQ ID NO: 729723 - RNA, 65 nt, Homo Sapiens
acacaguccgugcugugcuguccagcaggggcccugcccaccagaauggacucuccucggguggg

SEQ ID NO: 729724 - RNA, 65 nt, Homo Sapiens
cuuguuuguugaauuugugaacaguauagaucucagcccaccaaugccaagacaaaauuauuuuu

SEQ ID NO: 729725 - RNA, 65 nt, Homo Sapiens
ugggucaggaaauuacugcccacuugucaaguucagcccaccaucuguuugaagauuauaugaag

SEQ ID NO: 729726 - RNA, 65 nt, Homo Sapiens
augccuggcuuaauuuuuuggcugggauuacaggugcccaccacccugccucagccucccaagua

SEQ ID NO: 729727 - RNA, 65 nt, Homo Sapiens
cuucgccagcacccuuuccccaucauggggcagaugcccaccagcccucacuaucuacugcuuga

SEQ ID NO: 729728 - RNA, 65 nt, Homo Sapiens
cauggcccugccacaucccguguaacauaaguggugcccaccauguuugcacuuuuaauaacucu

SEQ ID NO: 729729 - RNA, 65 nt, Homo Sapiens
acacgugccaauggccccaucucggggaauuccaggcccaccaggcauuuguguggaccaaucua

SEQ ID NO: 729730 - RNA, 65 nt, Homo Sapiens
ggcaaauccaaaguucuuucccagggacaggcacugcccaccaacgccacgugaggguccagccu

SEQ ID NO: 729731 - RNA, 65 nt, Homo Sapiens
cauacccucuucuuuuuuucgccuugcccaggaaugcccaccacaacccccucccucaaggaaug

SEQ ID NO: 729732 - RNA, 65 nt, Homo Sapiens
ucacuugguucccacucccacaaaggaccuagacagcccaccaaguguccaacaauucuaaccaa

SEQ ID NO: 729733 - RNA, 65 nt, Homo Sapiens
ucuuggacgggaaggcgcuaacuuugguucaaggggcccaccaagugcuuuaugagcccauuagc

SEQ ID NO: 729734 - RNA, 65 nt, Homo Sapiens
ugcuucugagugucgcacuaccucggcccccucaagcccaccauccgaagcaucugccucccacc

SEQ ID NO: 729735 - RNA, 65 nt, Homo Sapiens
aggcccugcgggaggagagcgcugccgccgccgccgcccaccagcugaaggagaaagaggccgcu

SEQ ID NO: 729736 - RNA, 65 nt, Homo Sapiens
caccccugauguucgccgucuauugccugggcagugcccaccaugagcccugcugcuuccuaacu

SEQ ID NO: 729737 - RNA, 65 nt, Homo Sapiens
cacagugcccauguccccucguuccugugcacugagcccaccagcguccuggggccagcaaugug

SEQ ID NO: 729738 - RNA, 65 nt, Homo Sapiens
uauggcuccuccaccugguaugagaccacccaugggcccaccaauugggcuucccccugcucgag

SEQ ID NO: 729739 - RNA, 65 nt, Homo Sapiens
aaggugggugccccagaguagauuccaccccugcugcccaccaauggagaaucccaauguugaau

SEQ ID NO: 729740 - RNA, 65 nt, Homo Sapiens
cacauggcccuuugcuugagggcuccccacucccugcccaccaauacccaggugaggaacagacc

SEQ ID NO: 729741 - RNA, 65 nt, Homo Sapiens
ccugugucucuggcuacagcaagaccagcccaggagcccaccagcaccugccucucagcuacuug

SEQ ID NO: 729742 - RNA, 65 nt, Homo Sapiens
uggcucaucccucaggcccaccuggugugucaccugcccaccaccgggcagaggccaggagggga

SEQ ID NO: 729743 - RNA, 65 nt, Homo Sapiens
ggcuguggcggagcucccgcccgacagaccucagugcccaccacgcgccaggaugcacagaccga

SEQ ID NO: 729744 - RNA, 65 nt, Homo Sapiens
cugggggccucgggaggcuaggccccuccucaaaggcccaccagcccggcgcucaugcugagccc

SEQ ID NO: 729745 - RNA, 65 nt, Homo Sapiens
ggcugcacaggccagggcucgggcaugugguggccgcccaccaggggccuucacgucugcccuuu

SEQ ID NO: 729746 - RNA, 65 nt, Homo Sapiens
agcauguggacgcccuccguccugcagucuugccagcccaccacagccacuguagaccacaggca

SEQ ID NO: 729747 - RNA, 61 nt, Homo Sapiens
ucauccucuccacaaaguagacccucuccgagcccaccagccacagaauauuauguaaaga

SEQ ID NO: 729748 - RNA, 65 nt, Homo Sapiens
cuacuugcccuagcaugaggcucugagagccaccugcccaccaaucuggugaggauaaugguggc

SEQ ID NO: 729749 - RNA, 65 nt, Homo Sapiens
gacugucccuguuguaacugcccaaggcauguuuugcccaccagaucauggcccacguggaggcc

SEQ ID NO: 729750 - RNA, 65 nt, Homo Sapiens
guaccucugagucccagggaccugggcaggcccaagcccaccacgagcaucauccaguccucagc

SEQ ID NO: 729751 - RNA, 65 nt, Homo Sapiens
ucacaaucauguagcagaauggcacccagaccacugcccaccagugacggacaugcacguggcag

SEQ ID NO: 729752 - RNA, 65 nt, Homo Sapiens
acgggacugacagccucccagaggcccguggaggagcccaccagccccuucuucuugugaaggaa

SEQ ID NO: 729753 - RNA, 65 nt, Homo Sapiens
ggacagacgugggcuucagaagcucgcuggccugggcccaccagcauuuucuuuuaugaacauga

SEQ ID NO: 729754 - RNA, 65 nt, Homo Sapiens
aagucaccaggacaguccaccucuugguuggccaggcccaccagggccuggugaggccacuuggc

SEQ ID NO: 729755 - RNA, 65 nt, Homo Sapiens
ugccccugccacccacggggaggggaauaggagaagcccaccagcgccagugcaauucugaggcu

SEQ ID NO: 729756 - RNA, 65 nt, Homo Sapiens
uaauuuucucaucagaaaugauuccauuaaggucagcccaccauguaugauuuccuauauuccaa

SEQ ID NO: 729757 - RNA, 65 nt, Homo Sapiens
ugaaagcggacugagagcaggcaaauguggcuuucgcccaccaagcacucuccacuucccaguuu

SEQ ID NO: 729758 - RNA, 65 nt, Homo Sapiens
guauaucaaaccucacuuccaccaagcgaagggcagcccaccaccguuuggcgagcacgaacuag

SEQ ID NO: 729759 - RNA, 65 nt, Homo Sapiens
ccucugacccaggcugcucuagucccacugggcuggcccaccaggccacccagagcuuccugccu

SEQ ID NO: 729760 - RNA, 65 nt, Homo Sapiens
ccgcucagucucucucucucuuccuuccuuucucugcccaccacccccccucucccuuuccuucc

SEQ ID NO: 729761 - RNA, 65 nt, Homo Sapiens
gagaaaagaagccaugagaggcuacuagcccaccagcccaccaggggagaggaccgccggccuca

SEQ ID NO: 729762 - RNA, 65 nt, Homo Sapiens
ccaccagggagaaaagaagccggccucagcuacuagcccaccagcuccccgggggagaggaccgc

SEQ ID NO: 729763 - RNA, 65 nt, Homo Sapiens
ccagcccuacccagaguauuucugagccaugaggggcccaccagauugguucugaauuggauuca

SEQ ID NO: 729764 - RNA, 65 nt, Homo Sapiens
ugaccucaagaccagccacaccaagucugugcacugcccaccacccccuucaaccccuccuacac

SEQ ID NO: 729765 - RNA, 65 nt, Homo Sapiens
ggagcucagaugugggcaggaauucccaaaccugagcccaccaaggacucacaagugguccagaa

SEQ ID NO: 729766 - RNA, 65 nt, Homo Sapiens
caagugaugcuuuugagcuuacacacaauucacaggcccaccagugacaauuuacugugaguuaa

SEQ ID NO: 729767 - RNA, 65 nt, Homo Sapiens
ccuugugggaagaaguuugcaccucggcccuggcugcccaccaucagugccccgcagucagcagc

SEQ ID NO: 729768 - RNA, 65 nt, Homo Sapiens
aaauuccuccuuccccccaucucugaguggaggaagcccaccaaucugcccuuugcagugugcag

SEQ ID NO: 729769 - RNA, 65 nt, Homo Sapiens
uugccucagccucccgaguagcugggauuacaggugcccaccaccgcgcccagcuaauuuuuuaa

SEQ ID NO: 729770 - RNA, 65 nt, Homo Sapiens
ucagaacagaagccauguaucucccccacaccagggcccaccauggagcuuguguucucagaauc

SEQ ID NO: 729771 - RNA, 65 nt, Homo Sapiens
uccaggucccaugccaagaaccagugauucuaguggcccaccaccucccucuccugccacccuua

SEQ ID NO: 729772 - RNA, 65 nt, Homo Sapiens
ggagaaagugagccuggggaagaaggggguuugaagcccaccaagaccgaaacuggagaagggcu

SEQ ID NO: 729773 - RNA, 65 nt, Homo Sapiens
gaggaggagcgcuacccaccuccagggagcacccugcccaccaagaagcacugggugaccagcug

SEQ ID NO: 729774 - RNA, 65 nt, Homo Sapiens
ccccuggagugugucagagcccaggggagaaugcagcccaccaggagcaccuggacccccugccc

SEQ ID NO: 729775 - RNA, 63 nt, Homo Sapiens
uggagaagcgugucagauagcggcgugacccgggcccaccaggccacggccgccugcuguaca

SEQ ID NO: 729776 - RNA, 65 nt, Homo Sapiens
ggccaagagcgagcgagaggcgcugccccagccaggcccaccaccucucacagucagugcacgca

SEQ ID NO: 729777 - RNA, 65 nt, Homo Sapiens
gaggggcggcugcugccuggugacggcacccggaggcccaccaggacgcgccaccggugaaugug

SEQ ID NO: 729778 - RNA, 65 nt, Homo Sapiens
ccgcccaccuugacugccccaggcccguccgccuggcccaccaacccuggagcugaugacggggg

SEQ ID NO: 729779 - RNA, 65 nt, Homo Sapiens
gagucccggcuucgaguaguagccagacuagccccgcccaccaacucccuccacgcagcggccgg

SEQ ID NO: 729780 - RNA, 65 nt, Homo Sapiens
ggcucuuaauggggccggguccacucucccgggccgcccaccacaccuuugggcugcccuggccc

SEQ ID NO: 729781 - RNA, 65 nt, Homo Sapiens
agcuauugaucauuaaaauuacuguaccauccagagcccaccagagucuuuaagucuauuguuua

SEQ ID NO: 729782 - RNA, 65 nt, Homo Sapiens
gccuauuuucuuggugucauuuccccgccugcgaugcccaccauggcccucaagaaguugugccc

SEQ ID NO: 729783 - RNA, 65 nt, Homo Sapiens
cugguucccgcggcccauuuggcaggccccuccaggcccaccagcgacccucugcaagggggaca

SEQ ID NO: 729784 - RNA, 65 nt, Homo Sapiens
gcgauccacggagcugaagcaguaccagugugcuugcccaccacagcacauggcuggcacugagc

SEQ ID NO: 729785 - RNA, 65 nt, Homo Sapiens
uggccucaccuccugaaggccuaccacagccuccugcccaccagccuccuagaacugagcugccu

SEQ ID NO: 729786 - RNA, 65 nt, Homo Sapiens
cacggacacauuucugccuagagacaccgccuucugcccaccacucagaccagcacaucccuuuu

SEQ ID NO: 729787 - RNA, 65 nt, Homo Sapiens
cuuguccuaauaaaauuaagaggugcuacuccagugcccaccagcgugccucuccuggucgugga

SEQ ID NO: 729788 - RNA, 65 nt, Homo Sapiens
cuuguccuaauaaaauuaagaggugccacuccagugcccaccagcagugccucuccuggcccuga

SEQ ID NO: 729789 - RNA, 65 nt, Homo Sapiens
cuugucuuaauaaaauuaagaggugccacuccagugcccaccagcagugccucuccuggcccuga

SEQ ID NO: 729790 - RNA, 65 nt, Homo Sapiens
cuuguccuaauaaaauuaagaguugccacuccagugcccaccagcgugccucuccuggcccugga

SEQ ID NO: 729791 - RNA, 65 nt, Homo Sapiens
gcugccauuugucuccagccuggccucugaagcuggcccaccagaccuuuccuggaccccccagc

SEQ ID NO: 729792 - RNA, 65 nt, Homo Sapiens
gugcccucuccccggggacccuuccuucaggcucugcccaccaagccacacggccuuggcuauug

SEQ ID NO: 729793 - RNA, 65 nt, Homo Sapiens
gcucuucucccuguucucugccaccgccaucuggagcccaccacaacugagggcuuggcugccug

SEQ ID NO: 729794 - RNA, 65 nt, Homo Sapiens
ccccuuccucuuucuccucccccccagggcugggugcccaccaugcguggcugugcccucaguug

SEQ ID NO: 729795 - RNA, 65 nt, Homo Sapiens
agcucccagcaccugacuccucccaucgccccggugcccaccaugucccugccccuggcaagugc

SEQ ID NO: 729796 - RNA, 65 nt, Homo Sapiens
ucccucuaggaugcccccucuaccagucaccaggagcccaccaccggucucccccuacauauuaa

SEQ ID NO: 729797 - RNA, 65 nt, Homo Sapiens
gccuggccagccugcccccuugcugcugcuccccagcccaccagucagggacacguggggugugc

SEQ ID NO: 729798 - RNA, 65 nt, Homo Sapiens
agcuccugguccguaggagggcucaaggaaucugugcccaccaccguggcgccugcugcgucaga

SEQ ID NO: 729799 - RNA, 65 nt, Homo Sapiens
uucaggagccagcccucuuccauccgcccggcucugcccaccaccacugccaggcugaacagggg

SEQ ID NO: 729800 - RNA, 65 nt, Homo Sapiens
acgccuggcuaguuuuuugugcugggacuacaggugcccaccacccugccucagccucccgagua

SEQ ID NO: 729801 - RNA, 65 nt, Homo Sapiens
acgcccggcuaauuuuuugugcugggacuacaggcgcccaccacccugccucagccuccugagua

SEQ ID NO: 729802 - RNA, 65 nt, Homo Sapiens
ccaaaacaaaauacugauuuagcuauuuagcuaaagcccaccaaaauuaccacugaaacacuucg

SEQ ID NO: 729803 - RNA, 65 nt, Homo Sapiens
uuauuuuucaaagucuuaggcugauugaaggugaagcccaccagaugaaaccccaugggcccguu

SEQ ID NO: 729804 - RNA, 65 nt, Homo Sapiens
ccaccgguggggagggucguccgguaucccccagugcccaccaccaccaaccagaaucacuucuc

SEQ ID NO: 729805 - RNA, 65 nt, Homo Sapiens
caguggccuuagagggagccugcccugcccccaccgcccaccaccuccuccccuucauuccugcu

SEQ ID NO: 729806 - RNA, 65 nt, Homo Sapiens
ccgggugggcaggggccugaggguggcucgggccagcccaccagccaauggaccccuccucaggc

SEQ ID NO: 729807 - RNA, 65 nt, Homo Sapiens
accuaaccccuagccgucaucuccacacucaccaggcccaccaggggagggggcuggccuggggg

SEQ ID NO: 729808 - RNA, 65 nt, Homo Sapiens
ccuucagaggaccuaagacccaccuaugacucagggcccaccacaccccacccccccccaacugg

SEQ ID NO: 729809 - RNA, 65 nt, Homo Sapiens
cccaccaggcccagagccugguuggccauucucaugcccaccagcuucuggcuuugggaugucuc

SEQ ID NO: 729810 - RNA, 65 nt, Homo Sapiens
uagucguacacggagacuggcagcgccgacguccugcccaccacgcacucccggagagcacggaa

SEQ ID NO: 729811 - RNA, 65 nt, Homo Sapiens
cugccucagccucccaaguagcugggauaacaggcgcccaccaccgcacccugcuaauuuuuugu

SEQ ID NO: 729812 - RNA, 65 nt, Homo Sapiens
ccaacaacaaaaguguuuuccccccacccccacucgcccaccagggugaugccacuuuugccucc

SEQ ID NO: 729813 - RNA, 65 nt, Homo Sapiens
gaccugagcuauucucacucggaccuggggaaacggcccaccaaggacagcuacacgcugacgga

SEQ ID NO: 729814 - RNA, 60 nt, Homo Sapiens
gccgucgguuccuuaacugaggccguggcugcccaccacgaccccucacaccuccugcug

SEQ ID NO: 729815 - RNA, 65 nt, Homo Sapiens
uacaacugaagacaacuaacccuuuccccaacagagcccaccagcagugguggagaugucggucc

SEQ ID NO: 729816 - RNA, 55 nt, Homo Sapiens
gggcccacggcucccacuaaggccugcccaccaccgcccgccugggcagccauga

SEQ ID NO: 729817 - RNA, 65 nt, Homo Sapiens
caacccugccuggaucucccugcuucaccccuguggcccaccaggugggccaugaaaggagagga

SEQ ID NO: 729818 - RNA, 65 nt, Homo Sapiens
cugccucagccucccgaguagcugggccuaaaggugcccaccacuauacccggcuaauuuuugua

SEQ ID NO: 729819 - RNA, 65 nt, Homo Sapiens
gacgcacccuccaggaugcucgcugggauucccacgcccaccacugucccccaccccauggcugg

SEQ ID NO: 729820 - RNA, 65 nt, Homo Sapiens
agcugauguugccuccucucuugggcuggcccagggcccaccagcgagcuggguccccccaaaac

SEQ ID NO: 729821 - RNA, 65 nt, Homo Sapiens
aggaccugucgaccugagguauaaacucugggcccgcccaccagcgaaaccagcacuccaugaag

SEQ ID NO: 729822 - RNA, 65 nt, Homo Sapiens
uccaccaucugguaauaaacgcuuccaaacuugaggcccaccaucuccagcccuuaaauccccca

SEQ ID NO: 729823 - RNA, 65 nt, Homo Sapiens
augcccagcuaauuuuuauagcugggauuacaagugcccaccacccugccucagccuuccaagua

SEQ ID NO: 729824 - RNA, 65 nt, Homo Sapiens
ccuguucugaccucaugaguaccccccccccccccgcccaccagauggguauucaccacccuggg

SEQ ID NO: 729825 - RNA, 65 nt, Homo Sapiens
ucgcuacugcuggaaccgcgucggccuccgccccggcccaccaccccucaacccgcccugcagcc

SEQ ID NO: 729826 - RNA, 65 nt, Homo Sapiens
aagaugcccucccuuggcaugagcaagcugaagcugcccaccaucgcugcuccugaaguuguaga

SEQ ID NO: 729827 - RNA, 65 nt, Homo Sapiens
acacagaaggaaaaaaacauuaccuuugugaaguugcccaccaaaugaacuugcaaacaggcuga

SEQ ID NO: 729828 - RNA, 65 nt, Homo Sapiens
guccugcucccucacuccuccagugggagggccuggcccaccagaaccgacugcuggaacccagc

SEQ ID NO: 729829 - RNA, 65 nt, Homo Sapiens
aucucaggaaaggcuguuguccgcccgccucugccgcccaccaccccgaggggguggggacugag

SEQ ID NO: 729830 - RNA, 65 nt, Homo Sapiens
auaaagcaaauauugcuauaguggauuggguugcagcccaccacaagccauaccucaaagauauu

SEQ ID NO: 729831 - RNA, 65 nt, Homo Sapiens
augcccggcuaguuuuuuuggcugggauuacaggcgcccaccacccugccucagccucccgagua

SEQ ID NO: 729832 - RNA, 65 nt, Homo Sapiens
cccuugccugguuccauauggcuccuuccagcccugcccaccaagugcagcucccacuuuccauc

SEQ ID NO: 729833 - RNA, 65 nt, Homo Sapiens
ggcuccagccauugcggugguuucuagauagccaggcccaccaagagauauugccccuugaugag

SEQ ID NO: 729834 - RNA, 65 nt, Homo Sapiens
augccucauccucccaaguaggugggauuacaggugcccaccaccaagcccugcaaauuuuuuug

SEQ ID NO: 729835 - RNA, 65 nt, Homo Sapiens
cugcggggaggcucuuuuucucccuggccuccagugcccaccaggaggaucugcgcacggugcac

SEQ ID NO: 729836 - RNA, 65 nt, Homo Sapiens
cagugcccaccaggaggaucugcgcacggugcacagcccaccagagcacuacagccuuuuauuga

SEQ ID NO: 729837 - RNA, 65 nt, Homo Sapiens
gaagccagcacaggguuaaaguaacuccuggcauugcccaccagggggcuggugcaccugcugac

SEQ ID NO: 729838 - RNA, 65 nt, Homo Sapiens
caggucuaggccgugugguacccagaagugucccagcccaccacaccguuuaccucccucgcccu

SEQ ID NO: 729839 - RNA, 65 nt, Homo Sapiens
gcccuagacucaucuuggcccucccccgggaaugcgcccaccaaggguuucccuuacagggcccc

SEQ ID NO: 729840 - RNA, 65 nt, Homo Sapiens
ucuccucaccugggccuucuuuccgaugagacucagcccaccauugagucccaggaaacagugcu

SEQ ID NO: 729841 - RNA, 65 nt, Homo Sapiens
aagcaagcagcaagcaagaucgcuacccucggccugcccaccaccgcagacagcccagagccugc

SEQ ID NO: 729842 - RNA, 65 nt, Homo Sapiens
augcccagcuaauuuuuugugcugggauuacaggugcccaccauccugccucagccucccaagua

SEQ ID NO: 729843 - RNA, 65 nt, Homo Sapiens
gcccucccccuugccaguguccuggccuccacugugcccaccacuggguccacgccugugccugu

SEQ ID NO: 729844 - RNA, 53 nt, Homo Sapiens
gccucccucagccacgccucguggcccaccagauggagcacugcuggaaguga

SEQ ID NO: 729845 - RNA, 65 nt, Homo Sapiens
cuaaaaggaccccaaaugguaccucggccagggcagcccaccaugaaacaggugccaucuuggcc

SEQ ID NO: 729846 - RNA, 65 nt, Homo Sapiens
cauuauuuuuaggauguguauuucauuuauuuauggcccaccagucucccccaaauuaguacaga

SEQ ID NO: 729847 - RNA, 65 nt, Homo Sapiens
cugccgcagccuccagaguagcugggauaacaggugcccaccaccacaccccacuaauuuuugua

SEQ ID NO: 729848 - RNA, 65 nt, Homo Sapiens
ccuguaugugccacauggaaaaacaggacaccagagcccaccagacagugccggccagcagagaa

SEQ ID NO: 729849 - RNA, 65 nt, Homo Sapiens
agcaggccucgaggagucaauauagcaauuuaagggcccaccagaaugaauuuagggguuacgau

SEQ ID NO: 729850 - RNA, 65 nt, Homo Sapiens
gguccccuguugauuauaugugcggccuuccagcugcccaccaucacagcuacagcucgcucccc

SEQ ID NO: 729851 - RNA, 65 nt, Homo Sapiens
gucugaagggggcguggccacaccuccuagaccacgcccaccacuuagaccacgcccaccuccug

SEQ ID NO: 729852 - RNA, 65 nt, Homo Sapiens
agggcaggaguguuuauggcagagugaaguucugugcccaccacaagaggcugugagauguucug

SEQ ID NO: 729853 - RNA, 65 nt, Homo Sapiens
ucucccagucucccugccccccaugccccagaccggcccaccagggacuagccgcugucgcacag

SEQ ID NO: 729854 - RNA, 65 nt, Homo Sapiens
aggcagccucugggggguggccaggccgggaaaaagcccaccauuuggcaucccugggccuuggg

SEQ ID NO: 729855 - RNA, 65 nt, Homo Sapiens
agccgggaugccugcaucccacccccggccccagggcccaccacauaaaaucugggagcccagag

SEQ ID NO: 729856 - RNA, 57 nt, Homo Sapiens
gacggcggcugccagagugagugcccggcccaccagggacugcagcugcaccagcag

SEQ ID NO: 729857 - RNA, 65 nt, Homo Sapiens
caguuuaucucuuaucuaccuaugaccugcgagcugcccaccacccccaguuguugcgccuuucc

SEQ ID NO: 729858 - RNA, 65 nt, Homo Sapiens
gccuuccgggcugcucucuuccaugaugugcuugggcccaccaggcugcccccacuccagggcag

SEQ ID NO: 729859 - RNA, 65 nt, Homo Sapiens
ggccucugcuaccugccaguccuugggcaaguccugcccaccauaucauccuggccccaccaggg

SEQ ID NO: 729860 - RNA, 59 nt, Homo Sapiens
agggggagacaugcuguaggcaccaagaagcccaccacucagccgagaacaacagcuag

SEQ ID NO: 729861 - RNA, 65 nt, Homo Sapiens
augauccagucuggaauaacugccagguuucuucugcccaccaaagcagauuaguuagaauucac

SEQ ID NO: 729862 - RNA, 65 nt, Homo Sapiens
uugccccgcuccuccaccauggcaaggccaggagugcccaccagcugucucgagcuggacaguga

SEQ ID NO: 729863 - RNA, 65 nt, Homo Sapiens
uguggcuucauccagcccucucuggccuauccugugcccaccaccgucccccaaagucccuucug

SEQ ID NO: 729864 - RNA, 65 nt, Homo Sapiens
cccggccguggaccauagucccagcagccccgucugcccaccauucacuauaaggcugagggcug

SEQ ID NO: 729865 - RNA, 65 nt, Homo Sapiens
ggagccaaucucagcccuccacgccaaggagccuugcccaccagccaaucaauguucgucucugc

SEQ ID NO: 729866 - RNA, 65 nt, Homo Sapiens
aggauguggcuaugucuuuuaggaagccacucuuagcccaccagagucugcccuuuggcccaaaa

SEQ ID NO: 729867 - RNA, 65 nt, Homo Sapiens
gcaggugagcaaccaguuggcuaggggagcagggggcccaccagagcuguggagaggggacccua

SEQ ID NO: 729868 - RNA, 65 nt, Homo Sapiens
uuggauucagauugcgacauucaacuuuuccccaagcccaccaacgcagcacacauauuuucuug

SEQ ID NO: 729869 - RNA, 65 nt, Homo Sapiens
uagagcacaacuucccauugagagaugaccucaaggcccaccaaaaggcugaugcugauuuggcc

SEQ ID NO: 729870 - RNA, 65 nt, Homo Sapiens
ccccccugucacccaugacauaagaggagugcguggcccaccaggugggcgucaucugguccugg

SEQ ID NO: 729871 - RNA, 64 nt, Homo Sapiens; identical to SEQ ID NO: 729131

SEQ ID NO: 729872 - RNA, 64 nt, Homo Sapiens; identical to SEQ ID NO: 729132

SEQ ID NO: 729873 - RNA, 64 nt, Homo Sapiens; identical to SEQ ID NO: 729133

SEQ ID NO: 729874 - RNA, 64 nt, Homo Sapiens; identical to SEQ ID NO: 729134

SEQ ID NO: 729875 - RNA, 64 nt, Homo Sapiens; identical to SEQ ID NO: 729135

SEQ ID NO: 729876 - RNA, 64 nt, Homo Sapiens; identical to SEQ ID NO: 729136

SEQ ID NO: 729877 - RNA, 64 nt, Homo Sapiens; identical to SEQ ID NO: 729137

SEQ ID NO: 729878 - RNA, 64 nt, Homo Sapiens; identical to SEQ ID NO: 729138

SEQ ID NO: 729879 - RNA, 64 nt, Homo Sapiens; identical to SEQ ID NO: 729139

SEQ ID NO: 729880 - RNA, 64 nt, Homo Sapiens; identical to SEQ ID NO: 729140

SEQ ID NO: 729881 - RNA, 64 nt, Homo Sapiens; identical to SEQ ID NO: 729141

SEQ ID NO: 729882 - RNA, 64 nt, Homo Sapiens; identical to SEQ ID NO: 729142

SEQ ID NO: 729883 - RNA, 62 nt, Homo Sapiens
uggucccugggggacccccaaccuuaccaccggagccgaaucccuccugggccaccuggggc

SEQ ID NO: 729884 - RNA, 62 nt, Homo Sapiens
uauagaacuuuguuagacuaucuuagaucuaagagccgaagcuuguaccuaacauuuuaucc

SEQ ID NO: 729885 - RNA, 62 nt, Homo Sapiens
cuguguggaaaggaggcccacgggcacuaggggagccgaauucuacaaucccgcuggggcgg

SEQ ID NO: 729886 - RNA, 62 nt, Homo Sapiens
aacuuuuguacuucucugguauggagaguuuggagccgaaugauuugcauuuuuuacauguc

SEQ ID NO: 729887 - RNA, 62 nt, Homo Sapiens
cccugggcccaucucucccugcgcaccaggcugagccgaagcugcgggggcaggccgggccu

SEQ ID NO: 729888 - RNA, 62 nt, Homo Sapiens
ggaaccagugggucacuguggcagcuucaucugagccgaagguguggguccucuguggcugu

SEQ ID NO: 729889 - RNA, 62 nt, Homo Sapiens
auaagaauaauauauuugugccacugagagcugagccgaaauguccgagguagcugcucucc

SEQ ID NO: 729890 - RNA, 62 nt, Homo Sapiens
uggauacaagaaauccaggaaaauaagaaguggagccgaagggcaaauagcaauugacuuga

SEQ ID NO: 729891 - RNA, 62 nt, Homo Sapiens
ucaauucgacagacagaugggggaaaagaggugagccgaagaggaaaagggagaaaggcagu

SEQ ID NO: 729892 - RNA, 62 nt, Homo Sapiens
auagucugaagucauucagaagcagcauucaggagccgaaagcaauaguaacaguaugcaaa

SEQ ID NO: 729893 - RNA, 62 nt, Homo Sapiens
ggcauggcugcgcuggauccgcuuuuuuuggugagccgaaugcuuugcagcagugcuuccaa

SEQ ID NO: 729894 - RNA, 62 nt, Homo Sapiens
uaaaauaaaaguaaacaagaguuacccucuuugagccgaaccugaaaaagugaagccucaga

SEQ ID NO: 729895 - RNA, 62 nt, Homo Sapiens
gcuuaaauaguuuaaguagggggggguucagggagccgaaaggcuaagccugcaguuuacuc

SEQ ID NO: 729896 - RNA, 62 nt, Homo Sapiens
guguucauagaaacauggaauucucugauuuugagccgaacaugaguuuuuagacuguaucu

SEQ ID NO: 729897 - RNA, 62 nt, Homo Sapiens
aaaauguccugccaguuuaaggguacauuguagagccgaacuuugaguuacugugcaagauu

SEQ ID NO: 729898 - RNA, 62 nt, Homo Sapiens
ugggcaugggagcccaucccgacuuaagguaggagccgaaagguaggggaagaggguggcug

SEQ ID NO: 729899 - RNA, 62 nt, Homo Sapiens
ggacugaagcuacaguuuuuggguuuccccgagagccgaagucauccaguccacugacaaga

SEQ ID NO: 729900 - RNA, 62 nt, Homo Sapiens
cuccggcgggccgcaagagggccgggagggucgagccgaagucgugggcucccgggucgcaa

SEQ ID NO: 729901 - RNA, 62 nt, Homo Sapiens
cgccgguaaguugccaaagccaugaaacacaagagccgaaaagaggacgacguuucuuuucu

SEQ ID NO: 729902 - RNA, 62 nt, Homo Sapiens
auugcuugaaccuggaaggcagagguugcagugagccgaaauggcgccacuguacuccaacc

SEQ ID NO: 729903 - RNA, 62 nt, Homo Sapiens
caaaaacagccuccaauaccacaaccugaaaagagccgaaaugguuauuuuacagcauacaa

SEQ ID NO: 729904 - RNA, 62 nt, Homo Sapiens
ugcgccacugcacuccagccagagcuugcagugagccgaauaaugcugugaacccuggaggc

SEQ ID NO: 729905 - RNA, 62 nt, Homo Sapiens
cgguccugaaaaacacuaaucaggagcugcgggagccgaauuaaucuagacgaauggagaug

SEQ ID NO: 729906 - RNA, 62 nt, Homo Sapiens
uaaccaagacauggaaauaaaugugaaagcuggagccgaagagucaaagagcuaaaaaauua

SEQ ID NO: 729907 - RNA, 62 nt, Homo Sapiens
ucucccugccccgcccuggcgaucccugcugugagccgaagccauccccccugccaccgggc

SEQ ID NO: 729908 - RNA, 62 nt, Homo Sapiens
uagaaguucccuuaaaaagauguuaaaagcaagagccgaauuauucaggggcauuuuggugc

SEQ ID NO: 729909 - RNA, 62 nt, Homo Sapiens
cacgccacuacacuccagccugagauugcagugagccgaaauauugcuugaaccuaggaggc

SEQ ID NO: 729910 - RNA, 62 nt, Homo Sapiens
cacuucaggagcccuacugaagggaacagccugagccgaacauguuauuuaaccugaguaua

SEQ ID NO: 729911 - RNA, 62 nt, Homo Sapiens
aggugggggaggggcgacaguagugagcgccugagccgaacaauccucgaacuaaaagccuu

SEQ ID NO: 729912 - RNA, 62 nt, Homo Sapiens
uauuacccuucucaaaguccugauuuaaucaagagccgaaauuuuggaaaaacuuuagagga

SEQ ID NO: 729913 - RNA, 62 nt, Homo Sapiens
ccuggaacgcucuccguccgggagcagggccggagccgaacguuggagcgcgcucugcgauu

SEQ ID NO: 729914 - RNA, 62 nt, Homo Sapiens
uuacuucaguacaaugccaccaguaguacgaugagccgaagcuuuacauugugagaguagca

SEQ ID NO: 729915 - RNA, 62 nt, Homo Sapiens
gccagucagcauguugcugcucagccacggaugagccgaauaggccugggaccagcugggug

SEQ ID NO: 729916 - RNA, 62 nt, Homo Sapiens
gggggagugggucagagguacuggagggugcugagccgaagggacggugggagggggguuau

SEQ ID NO: 729917 - RNA, 62 nt, Homo Sapiens
aaccucuacuguaaacuuucugguccgagaacgagccgaacacagcgcgacgcagggacuag

SEQ ID NO: 729918 - RNA, 62 nt, Homo Sapiens
ccgcgugcuuccugucacauacacgauccggagagccgaaggggcucccccugcacauuugc

SEQ ID NO: 729919 - RNA, 62 nt, Homo Sapiens
gagacagcugagcugaggccccccaccaagcugagccgaaugagucuacuaugggcagggcc

SEQ ID NO: 729920 - RNA, 62 nt, Homo Sapiens
ccaggggccggccaguggccaugccuccucaggagccgaagcgccgggcaggguguggggcc

SEQ ID NO: 729921 - RNA, 62 nt, Homo Sapiens
ucucccucuuuccacggucucccucugaugccgagccgaagcuggacuguacugcugccauc

SEQ ID NO: 729922 - RNA, 62 nt, Homo Sapiens
ugccccauugucagugggucauuuaaggcuaggagccgaaugguaauacaguuucuacgucu

SEQ ID NO: 729923 - RNA, 62 nt, Homo Sapiens
gaugucacuaaggauggcugcacgacacccaugagccgaaagcucacuccuugcccccuccc

SEQ ID NO: 729924 - RNA, 62 nt, Homo Sapiens
aguguuugugaagaggcaggggaagccuaggagagccgaaucccccagacugggacacaggc

SEQ ID NO: 729925 - RNA, 62 nt, Homo Sapiens
gcaccacucccuguaggugguguuggcagcuggagccgaagaaguaggucuacagucccaua

SEQ ID NO: 729926 - RNA, 62 nt, Homo Sapiens
ggcguugggauccaggggaaggggccgcggaggagccgaaagggcgccggcgcugccuggcg

SEQ ID NO: 729927 - RNA, 62 nt, Homo Sapiens
ugauaauaaaagcuauuauucucccugccucugagccgaacaccucccaugccguuccacuc

SEQ ID NO: 729928 - RNA, 62 nt, Homo Sapiens
agagaacccuugugcuacgccaggcaguuaccgagccgaagggagaugaugggccuucgccc

SEQ ID NO: 729929 - RNA, 62 nt, Homo Sapiens
ugcaccauugcacuccacccggagguugcagugagccgaaguaccgcuuguacccaggaggu

SEQ ID NO: 729930 - RNA, 64 nt, Homo Sapiens; identical to SEQ ID NO: 687063

SEQ ID NO: 729931 - RNA, 64 nt, Homo Sapiens; identical to SEQ ID NO: 687064

SEQ ID NO: 729932 - RNA, 64 nt, Homo Sapiens; identical to SEQ ID NO: 687065

SEQ ID NO: 729933 - RNA, 64 nt, Homo Sapiens; identical to SEQ ID NO: 687066

SEQ ID NO: 729934 - RNA, 64 nt, Homo Sapiens; identical to SEQ ID NO: 687067

SEQ ID NO: 729935 - RNA, 64 nt, Homo Sapiens; identical to SEQ ID NO: 687068

SEQ ID NO: 729936 - RNA, 64 nt, Homo Sapiens; identical to SEQ ID NO: 687069

SEQ ID NO: 729937 - RNA, 64 nt, Homo Sapiens; identical to SEQ ID NO: 687070

SEQ ID NO: 729938 - RNA, 64 nt, Homo Sapiens; identical to SEQ ID NO: 687071

SEQ ID NO: 729939 - RNA, 64 nt, Homo Sapiens; identical to SEQ ID NO: 687072

SEQ ID NO: 729940 - RNA, 64 nt, Homo Sapiens; identical to SEQ ID NO: 687073

SEQ ID NO: 729941 - RNA, 64 nt, Homo Sapiens; identical to SEQ ID NO: 687074

SEQ ID NO: 729942 - RNA, 64 nt, Homo Sapiens; identical to SEQ ID NO: 687075

SEQ ID NO: 729943 - RNA, 64 nt, Homo Sapiens; identical to SEQ ID NO: 687076

SEQ ID NO: 729944 - RNA, 64 nt, Homo Sapiens; identical to SEQ ID NO: 687077

SEQ ID NO: 729945 - RNA, 64 nt, Homo Sapiens; identical to SEQ ID NO: 687078

SEQ ID NO: 729946 - RNA, 64 nt, Homo Sapiens; identical to SEQ ID NO: 687079

SEQ ID NO: 729947 - RNA, 64 nt, Homo Sapiens; identical to SEQ ID NO: 687080

SEQ ID NO: 729948 - RNA, 64 nt, Homo Sapiens; identical to SEQ ID NO: 687081

SEQ ID NO: 729949 - RNA, 64 nt, Homo Sapiens; identical to SEQ ID NO: 687082

SEQ ID NO: 729950 - RNA, 64 nt, Homo Sapiens; identical to SEQ ID NO: 687083

SEQ ID NO: 729951 - RNA, 64 nt, Homo Sapiens; identical to SEQ ID NO: 574358

SEQ ID NO: 729952 - RNA, 64 nt, Homo Sapiens; identical to SEQ ID NO: 574359

SEQ ID NO: 729953 - RNA, 64 nt, Homo Sapiens; identical to SEQ ID NO: 574360

SEQ ID NO: 729954 - RNA, 64 nt, Homo Sapiens; identical to SEQ ID NO: 574361

SEQ ID NO: 729955 - RNA, 64 nt, Homo Sapiens; identical to SEQ ID NO: 334399

SEQ ID NO: 729956 - RNA, 57 nt, Homo Sapiens; identical to SEQ ID NO: 334400

SEQ ID NO: 729957 - RNA, 64 nt, Homo Sapiens; identical to SEQ ID NO: 334401

SEQ ID NO: 729958 - RNA, 64 nt, Homo Sapiens; identical to SEQ ID NO: 334402

SEQ ID NO: 729959 - RNA, 64 nt, Homo Sapiens; identical to SEQ ID NO: 334403

SEQ ID NO: 729960 - RNA, 64 nt, Homo Sapiens; identical to SEQ ID NO: 334404

SEQ ID NO: 729961 - RNA, 64 nt, Homo Sapiens; identical to SEQ ID NO: 334405

SEQ ID NO: 729962 - RNA, 64 nt, Homo Sapiens; identical to SEQ ID NO: 334406

SEQ ID NO: 729963 - RNA, 64 nt, Homo Sapiens; identical to SEQ ID NO: 334407

SEQ ID NO: 729964 - RNA, 64 nt, Homo Sapiens; identical to SEQ ID NO: 334408

SEQ ID NO: 729965 - RNA, 64 nt, Homo Sapiens; identical to SEQ ID NO: 334409

SEQ ID NO: 729966 - RNA, 64 nt, Homo Sapiens; identical to SEQ ID NO: 334410

SEQ ID NO: 729967 - RNA, 64 nt, Homo Sapiens; identical to SEQ ID NO: 334411

SEQ ID NO: 729968 - RNA, 64 nt, Homo Sapiens; identical to SEQ ID NO: 334412

SEQ ID NO: 729969 - RNA, 64 nt, Homo Sapiens; identical to SEQ ID NO: 334413

SEQ ID NO: 729970 - RNA, 64 nt, Homo Sapiens; identical to SEQ ID NO: 334414

SEQ ID NO: 729971 - RNA, 64 nt, Homo Sapiens; identical to SEQ ID NO: 334415

SEQ ID NO: 729972 - RNA, 64 nt, Homo Sapiens; identical to SEQ ID NO: 334416

SEQ ID NO: 729973 - RNA, 64 nt, Homo Sapiens; identical to SEQ ID NO: 334417

SEQ ID NO: 729974 - RNA, 64 nt, Homo Sapiens; identical to SEQ ID NO: 334418

SEQ ID NO: 729975 - RNA, 64 nt, Homo Sapiens; identical to SEQ ID NO: 334419

SEQ ID NO: 729976 - RNA, 64 nt, Homo Sapiens; identical to SEQ ID NO: 334420

SEQ ID NO: 729977 - RNA, 64 nt, Homo Sapiens; identical to SEQ ID NO: 334421

SEQ ID NO: 729978 - RNA, 64 nt, Homo Sapiens; identical to SEQ ID NO: 334422

SEQ ID NO: 729979 - RNA, 64 nt, Homo Sapiens; identical to SEQ ID NO: 334423

SEQ ID NO: 729980 - RNA, 64 nt, Homo Sapiens; identical to SEQ ID NO: 334424

SEQ ID NO: 729981 - RNA, 64 nt, Homo Sapiens; identical to SEQ ID NO: 334425

SEQ ID NO: 729982 - RNA, 64 nt, Homo Sapiens
auaguuuccacuuuaaagggaagaagggacuuuaacauccuaugaauuugaaacauccuaugaa

SEQ ID NO: 729983 - RNA, 64 nt, Homo Sapiens
ggaagaagggacuuuaacauccuaugaauuugaaacauccuaugaauuugaaaguuuccuaagu

SEQ ID NO: 729984 - RNA, 64 nt, Homo Sapiens
aagaaguuuaaguaaguaagcaagggguuacuuuacauccuacuuuuaaaacucagauuuaaaa

SEQ ID NO: 729985 - RNA, 64 nt, Homo Sapiens
agaaagaaauuacuucuaguuaaauguucaugucacauccuaaugacugacuuuuuccauuuuu

SEQ ID NO: 729986 - RNA, 64 nt, Homo Sapiens
aauauaaaagggccuguaccuaugagucauuguagacaucuauagccuuuauugauuuuacuuu

SEQ ID NO: 729987 - RNA, 64 nt, Homo Sapiens
gucauuccauugcuauuuuuucagagaaauaucugacaucuauuauugagaaacuauauacuuc

SEQ ID NO: 729988 - RNA, 64 nt, Homo Sapiens
uguauguuugcauauuauagcucucuuuaagacagacaucuaaaaagauuuugguuauucuggg

SEQ ID NO: 729989 - RNA, 64 nt, Homo Sapiens
uggucuuagaauccaugucagauuggugcuuccagacaucuauucccaguccaucagagugaaa

SEQ ID NO: 729990 - RNA, 64 nt, Homo Sapiens
uacugaauuaaaggauuaaauuaggugacauggugacaucuaucccuuuauuuugacacuaaaa

SEQ ID NO: 729991 - RNA, 64 nt, Homo Sapiens
uagguaguaauuuguucaaaagcgguuuuagccagacaucuaguugcaguguucaagaggauua

SEQ ID NO: 729992 - RNA, 64 nt, Homo Sapiens
ucgcuggaaggucuuugacggcaccaucuggaaggacaucuacaaucaggagugguggaaccuc

SEQ ID NO: 729993 - RNA, 64 nt, Homo Sapiens
agccucgggccacauggguccacugcaccagugugacaucuacaacuccaagauugccgggaag

SEQ ID NO: 729994 - RNA, 64 nt, Homo Sapiens
guacuuccauuuguaagucccaugauagaugaugguucuagagugugcuaaucucacauuuagc

SEQ ID NO: 729995 - RNA, 64 nt, Homo Sapiens
gcagcaucuguuuuuuguuguucaugacaauggaguucuagaaauauuuuagcaaauauuauau

SEQ ID NO: 729996 - RNA, 64 nt, Homo Sapiens
ucguauguaugaggaguuagggauggggagucaaguucuagaaaguuuugucugaaaaccuuug

SEQ ID NO: 729997 - RNA, 64 nt, Homo Sapiens
agcuauacugcaaaaguauaauguuuuuggaacuguucuagagcauaccaugaaaagcaguuug

SEQ ID NO: 729998 - RNA, 64 nt, Homo Sapiens
aauugauagacccaaaaaauauaauuuaaucaaaguucuagaguuuuuguuuguuuguuugaga

SEQ ID NO: 729999 - RNA, 64 nt, Homo Sapiens
cauuacaggcaugagccaccaugccuggcccaaaguucuagaauuuuuuaaagguauucauggu

SEQ ID NO: 730000 - RNA, 64 nt, Homo Sapiens
cccguuccccaguggcuguaugcuuccugaggguguucuagaagcugugucucauucaccauga

SEQ ID NO: 730001 - RNA, 64 nt, Homo Sapiens
agaagggcugccaaaugaggucugggcugcugagguucuagaauucuuuuugucacuguuaauu

SEQ ID NO: 730002 - RNA, 64 nt, Homo Sapiens
uggggcagucugcagauguuugaaguaguuuaguguucuagaaagagcuauuacuguggauagu

SEQ ID NO: 730003 - RNA, 64 nt, Homo Sapiens
cuugucuuacaccgugcugccauuaaaggcagcuguucuagaguuucagucaccuaaguacacc

SEQ ID NO: 730004 - RNA, 64 nt, Homo Sapiens
aauuuauaccuuccguaugagaaggcuuuaauguguucuagaucauuuuuuuaaagggggaggg

SEQ ID NO: 730005 - RNA, 64 nt, Homo Sapiens
acaauaucuuagcuuuuagcuuuccaaaguuuaaguucuagaucccauagaaagaugggguugu

SEQ ID NO: 730006 - RNA, 64 nt, Homo Sapiens
uucuguaaaggcacuuugugguuuuuccaaagauguucuagaucuauuugguugcucuauaguc

SEQ ID NO: 730007 - RNA, 64 nt, Homo Sapiens
ucuguguacauuccuuucauaggguagaguucuaguucuagaaguucuuauuuuguuuuuguug

SEQ ID NO: 730008 - RNA, 64 nt, Homo Sapiens
ucugggaaccagugccugagcggugcuggccuggguucuagaucagucacagcugucuaggccu

SEQ ID NO: 730009 - RNA, 64 nt, Homo Sapiens
ucugggaaccagcaccugagagugacuggccuggguucuagacccauuccauaaaucaguggug

SEQ ID NO: 730010 - RNA, 64 nt, Homo Sapiens
gaauucuggaucacccaagaggaaaagacuggcaguucuagauuccucuauauggggagaccug

SEQ ID NO: 730011 - RNA, 64 nt, Homo Sapiens
uucucaacucagccaacugaguagcaaaucauuuguucuagaccaccuaaggagggaagguuau

SEQ ID NO: 730012 - RNA, 64 nt, Homo Sapiens
ccugcaccccagcauuccagcucugcccccgcggguucuagacgccccucccaagcguuccugg

SEQ ID NO: 730013 - RNA, 64 nt, Homo Sapiens
cccucggccuccgaggcuccccgccuccacucuaguucuagaugagugggaggcgugccccccu

SEQ ID NO: 730014 - RNA, 64 nt, Homo Sapiens
ggauucuuuccccagaggcucccaaucagcuuuuguucuagacuuccccaucccgaagccauca

SEQ ID NO: 730015 - RNA, 64 nt, Homo Sapiens
ggaccagguuugaugccugucuagagggagacuuguucuagagaucuguguuucuggagugauu

SEQ ID NO: 730016 - RNA, 64 nt, Homo Sapiens
ccacagugcccaccugcucuauggcuggcaggcaguucuagaaguagcaaaacaucuuuuccug

SEQ ID NO: 730017 - RNA, 64 nt, Homo Sapiens
agccuggccaacauggugaaaccugaggucaggaguucuagaucgaggccaagauggguggauc

SEQ ID NO: 730018 - RNA, 64 nt, Homo Sapiens
aagaauuaaccaacugaugauucuaacuucucaaguucuagagagaaaauuuucaaugagcuuu

SEQ ID NO: 730019 - RNA, 64 nt, Homo Sapiens
uccaagcagacaggauuccgucaguugugauagaguucuagauuggcaaugcaguuacauuguu

SEQ ID NO: 730020 - RNA, 64 nt, Homo Sapiens
aaugcaguuacauuguuucuucuuugaaaauaaaguucuagacauauaaaacaggauaccacua

SEQ ID NO: 730021 - RNA, 61 nt, Homo Sapiens
gguggcagcguggagggcucggcguggauggcagccucaggacacacaccccugccucaag

SEQ ID NO: 730022 - RNA, 61 nt, Homo Sapiens
aggaagccucggccucccugagcucugaccccagccucacccgaaaggccagccuggggcu

SEQ ID NO: 730023 - RNA, 61 nt, Homo Sapiens
ugaggucccgggcuuagugugagcaucuugccagccucaggcuugagggagggcugggcua

SEQ ID NO: 730024 - RNA, 61 nt, Homo Sapiens
gacaaagguaaaucagccagccaggcacccacagccucagcuccugugcaguuccugggca

SEQ ID NO: 730025 - RNA, 61 nt, Homo Sapiens
aggguccccucugggagaaacagcuucaccccagccucagggcccugggccaucacugcag

SEQ ID NO: 730026 - RNA, 61 nt, Homo Sapiens
cacuacggccauucuccucuugggcgcuccucagccucacugugaccuuucugccagagcu

SEQ ID NO: 730027 - RNA, 61 nt, Homo Sapiens
uuuggaccuaacaucucgcacgugacucccucagccucagagccuugggaugcagagcagc

SEQ ID NO: 730028 - RNA, 52 nt, Homo Sapiens
gcaaccgcgacuucagcugaggcagccucacagccugccaucuggugccucc

SEQ ID NO: 730029 - RNA, 61 nt, Homo Sapiens
ggaagcccucuuuccccaaauccuacucccucagccucaggcaguggugcucccaucuucc

SEQ ID NO: 730030 - RNA, 61 nt, Homo Sapiens
aaaaagaacucaaccaauuuggcaccccaugcagccucaaaauguuucaaaugccuaccgc

SEQ ID NO: 730031 - RNA, 61 nt, Homo Sapiens
ccaagcuucaaggaagugcuugggggacccccagccucauccucuuaguugggucucuugu

SEQ ID NO: 730032 - RNA, 61 nt, Homo Sapiens
ucuugacccugcauauccaggaaggaacugccagccucagaggaggcagcaccgagggugc

SEQ ID NO: 730033 - RNA, 61 nt, Homo Sapiens
ugcucagcagccagucucagagaccagcacucagccucauucagcauggguccuugaugcc

SEQ ID NO: 730034 - RNA, 61 nt, Homo Sapiens
ccccagcuggagcuggcugagagcaguccugcagccucauuccuuaguucccggagcuggc

SEQ ID NO: 730035 - RNA, 61 nt, Homo Sapiens
ucucuguuccccagcccaccuggcucacacacagccucauggguagggucagcaaaccaga

SEQ ID NO: 730036 - RNA, 61 nt, Homo Sapiens
gaggcugcccccucacccagaagucugagcccagccucaggaggggccaagaaccaggggg

SEQ ID NO: 730037 - RNA, 61 nt, Homo Sapiens
auuucaggcuggaaaacuaucaguaugaucucagccucaguucucuugucuguaaaaugga

SEQ ID NO: 730038 - RNA, 61 nt, Homo Sapiens
gacuacuuaccacaucaaaucugggcccaaacagccucaguuaacugcauaauucaggaac

SEQ ID NO: 730039 - RNA, 61 nt, Homo Sapiens
gaugucucuacuugcucuaugagccuuuugccagccucagaauaggcgagguaaccuugaa

SEQ ID NO: 730040 - RNA, 61 nt, Homo Sapiens
ggaucucuguggggcucuucaccaauuuuuccagccucauuuauaguaaacaaauuguucu

SEQ ID NO: 730041 - RNA, 61 nt, Homo Sapiens
gagauggaaucuuagaucgucccccaugugccagccucauucgaauucuacucuuugguua

SEQ ID NO: 730042 - RNA, 52 nt, Homo Sapiens
uuagcauggaagaggagugaggcagccucacugugugcccucagggauacga

SEQ ID NO: 730043 - RNA, 59 nt, Homo Sapiens
caagacagcuggugccuuaagaauuggcccagccucagauccugucuuuagcaaccagc

SEQ ID NO: 730044 - RNA, 61 nt, Homo Sapiens
ucuguauuucugugugguuguagcaaggacucagccucauguagcacgaauaggggugugg

SEQ ID NO: 730045 - RNA, 61 nt, Homo Sapiens
ccgccucccgguucaagccauucuucugccucagccucagcgaguagcugagacuaccggc

SEQ ID NO: 730046 - RNA, 61 nt, Homo Sapiens
cugugccagaagcaacagaggugccaggccucagccucacccacagcagccccaucgccaa

SEQ ID NO: 730047 - RNA, 61 nt, Homo Sapiens
accaaagaaaugaagcuggcaagcuacuuuucagccucaagcuuuacacagcuguccuuac

SEQ ID NO: 730048 - RNA, 61 nt, Homo Sapiens
acucccaccacaggcauaagcuaucaccuagcagccucaaaacgggucaguauuaagguuu

SEQ ID NO: 730049 - RNA, 61 nt, Homo Sapiens
uguagcuccuccugacaaacgucugggaaaacagccucaccccacucuccucucucuuccc

SEQ ID NO: 730050 - RNA, 61 nt, Homo Sapiens
uaaaccagaaggaagcccucucagaucaccccagccucacuccauuucccacuuccacccc

SEQ ID NO: 730051 - RNA, 61 nt, Homo Sapiens
gacuuugucccuucuaauuauuaucucuuuccagccucauucagcuauucuuacugacaua

SEQ ID NO: 730052 - RNA, 61 nt, Homo Sapiens
uuucuaaauauaauaaaaacuuaccuggcaucagccucauaccuaaaacuccugacucuua

SEQ ID NO: 730053 - RNA, 61 nt, Homo Sapiens
cacacacuggcacagggaggcuacaacuaagcagccucagaucuguaaaguugauuggugc

SEQ ID NO: 730054 - RNA, 61 nt, Homo Sapiens
cuggcgaugagccauuuauugugucucacaccagccucauuuccaacuccgacuuccuacu

SEQ ID NO: 730055 - RNA, 61 nt, Homo Sapiens
acuuuauccugcuauaacuuuauccucuucccagccucaucccuguuuuucuguuagggca

SEQ ID NO: 730056 - RNA, 61 nt, Homo Sapiens
gucugcaaacaggucccugccuuuuuagaagcagccucauggucucaugcuuaaucuuguc

SEQ ID NO: 730057 - RNA, 61 nt, Homo Sapiens
ucgaggcagggaaaagccaucuauucuucugcagccucaggagcgagacuucaaggacuca

SEQ ID NO: 730058 - RNA, 61 nt, Homo Sapiens
agagccccuucugcaucuuauucacagcuugcagccucagccccuuugaugaggcccucag

SEQ ID NO: 730059 - RNA, 61 nt, Homo Sapiens
ccuuguugcucuaacaguccagauguacacccagccucagggggaaggcagcucucuccag

SEQ ID NO: 730060 - RNA, 61 nt, Homo Sapiens
cucccuugugauuucugagggucaccacugccagccucaggcaacauagagagccuccugu

SEQ ID NO: 730061 - RNA, 61 nt, Homo Sapiens
ccagagaggggcagguagaccugcauagcagcagccucagcagcugucuugguaaaggaga

SEQ ID NO: 730062 - RNA, 61 nt, Homo Sapiens
ggccugucuguccuccucccuaauucagacccagccucaagaggaaagggaguaaaauaaa

SEQ ID NO: 730063 - RNA, 61 nt, Homo Sapiens
gcaggagucccacuccuccaaaaacuggggucagccucaggcaucagaaccuggcagcccc

SEQ ID NO: 730064 - RNA, 61 nt, Homo Sapiens
auuugacuaccuauguacuaguagacacccucagccucaucucuguggcguuguguuauug

SEQ ID NO: 730065 - RNA, 61 nt, Homo Sapiens
agugugcauagaccauuuccucaagucuaaccagccucagcaguuuauugucaauugcuuc

SEQ ID NO: 730066 - RNA, 61 nt, Homo Sapiens
acucacaagcugugugacuuggcucaaauuccagccucaccccuuggguucagcccaucug

SEQ ID NO: 730067 - RNA, 61 nt, Homo Sapiens
gugcccugauucacacacuguuucaccagagcagccucacugggcuauaggagccucccac

SEQ ID NO: 730068 - RNA, 61 nt, Homo Sapiens
gaugcuggccucuuggcaccaagagucucuccagccucacaaguaacucccacuccuaauc

SEQ ID NO: 730069 - RNA, 61 nt, Homo Sapiens
accacccugcuguccaguccgugccucccugcagccucaaccuaugccuaguggagccaca

SEQ ID NO: 730070 - RNA, 61 nt, Homo Sapiens
gcagaggcaaggucagaaaggccaagaauggcagccucagccagccucaggauggggaaua

SEQ ID NO: 730071 - RNA, 61 nt, Homo Sapiens
auggggaauagccaagaauguggacuccacucagccucaggagccacuuagugcuuugucc

SEQ ID NO: 730072 - RNA, 50 nt, Homo Sapiens
cggggccaccagcacugcugcagccucagcagcgcuaccugcggaaauaa

SEQ ID NO: 730073 - RNA, 61 nt, Homo Sapiens
acccugaauguggggcucugugagccagaagcagccucauaugucuaccaacuccucauag

SEQ ID NO: 730074 - RNA, 61 nt, Homo Sapiens
ucuaggguaugggaaauccaggaccaggauccagccucacuggaaucuuuagcgcucaaua

SEQ ID NO: 730075 - RNA, 61 nt, Homo Sapiens
ugaaaacccgaaucugagaauaagaacugcccagccucagcuuguuuaugcaacucuaucu

SEQ ID NO: 730076 - RNA, 61 nt, Homo Sapiens
cugggacaccuagguggagagaaucuugucccagccucagcggagaaggcauuccaggguu

SEQ ID NO: 730077 - RNA, 61 nt, Homo Sapiens
caagcagaaacacuccuguguauggagggagcagccucacaugccgucagccgaacuuugu

SEQ ID NO: 730078 - RNA, 61 nt, Homo Sapiens
ucuccuucgagcuuuguaaaagcacaaacgacagccucaagccuguggcuagaggaacacc

SEQ ID NO: 730079 - RNA, 61 nt, Homo Sapiens
uuuacaaaugccuugguaugaacuuuaccagcagccucagcccuuaaaaagggcuucuugg

SEQ ID NO: 730080 - RNA, 61 nt, Homo Sapiens
uuucacacuucagcccuuaaaucugcacuugcagccucagcucuuuuuuuuuuuuuuuugu

SEQ ID NO: 730081 - RNA, 61 nt, Homo Sapiens
uuugaccugucucauuucccaacaccaucuccagccucagcccagaggguggggcuggcag

SEQ ID NO: 730082 - RNA, 61 nt, Homo Sapiens
uagcauuacccuucugacacuggcccaccuccagccucagcuuccauggcccuggaugguc

SEQ ID NO: 730083 - RNA, 61 nt, Homo Sapiens
agaagaagcagccaugcccaaucacuccaagcagccucagcuggccaagauuuccuucugu

SEQ ID NO: 730084 - RNA, 61 nt, Homo Sapiens
aacgcccucaagaacaugaucccagcagaaccagccucaaauccggccugcugucaagucc

SEQ ID NO: 730085 - RNA, 61 nt, Homo Sapiens
ccaccuuccuuccaucaaaacugcuaugcaccagccucacugcaaccacacagggauauuu

SEQ ID NO: 730086 - RNA, 61 nt, Homo Sapiens
ggucagccucgccucccagccaugguauugccagccucacuuucccaggugggcccacuca

SEQ ID NO: 730087 - RNA, 61 nt, Homo Sapiens
acucagugaguucaucaggggacauuguagccagccucagcuauuacuuccccucugauag

SEQ ID NO: 730088 - RNA, 61 nt, Homo Sapiens
uccccaggugaggggcgggugguagucaaggcagccucaucagcugucucaucaccaaaua

SEQ ID NO: 730089 - RNA, 61 nt, Homo Sapiens
cccugcuggaauuggggcugcacaucauucccagccucaggccauaaccaccccugggaaa

SEQ ID NO: 730090 - RNA, 61 nt, Homo Sapiens
ggagaugcuugguguggggauggagcacaugcagccucaguucccuaggaggacccaccag

SEQ ID NO: 730091 - RNA, 61 nt, Homo Sapiens
acugaaggagauuguugaccaacccccagaccagccucagauuaacccccaaguaaucauu

SEQ ID NO: 730092 - RNA, 61 nt, Homo Sapiens
gaugcccugguggccucucccuuccgauuagcagccucaggguugacugugagcaaagugu

SEQ ID NO: 730093 - RNA, 61 nt, Homo Sapiens
cucagucuucagauagacaguaagaagaaagcagccucauugauccgcagauguaggggcc

SEQ ID NO: 730094 - RNA, 61 nt, Homo Sapiens
guguaguccauagcccagccagaugagcuugcagccucauaggaggucagcaccuugcaaa

SEQ ID NO: 730095 - RNA, 61 nt, Homo Sapiens
uccuuuaaccagcacagccaguuaaaagaugcagccucacugcuucaacgcagauuuuaau

SEQ ID NO: 730096 - RNA, 61 nt, Homo Sapiens
aaccucugccuccuggguucaagugauucuccagccucagccucccgaguagcugggauua

SEQ ID NO: 730097 - RNA, 61 nt, Homo Sapiens
ugcaacucuguguaccaagaaccccuagcaucagccucauuccuaagccaauaacgccugu

SEQ ID NO: 730098 - RNA, 61 nt, Homo Sapiens
aucuucuggugcccacggccauuggcauugccagccucauuccaugccacuaugagucaac

SEQ ID NO: 730099 - RNA, 61 nt, Homo Sapiens
caaaccuguuaguuuuacuucugcauugaaccagccucagaagcuacuuacugcuuuaugu

SEQ ID NO: 730100 - RNA, 61 nt, Homo Sapiens
ugcugggauugcaggcaugagccaccgugcccagccucaaaaauauuuuuuaaaagaaaag

SEQ ID NO: 730101 - RNA, 61 nt, Homo Sapiens
caugacccccaagcagauauaacaagcugugcagccucaguaggcugcuugcccucuccag

SEQ ID NO: 730102 - RNA, 61 nt, Homo Sapiens
uuuuuuguguggaacagcucaccuugucagacagccucagggcaucucugagacacagggg

SEQ ID NO: 730103 - RNA, 61 nt, Homo Sapiens
caaccccaucucccacucagaaaucaccucccagccucaggaagaguagaaauuggguggu

SEQ ID NO: 730104 - RNA, 61 nt, Homo Sapiens
ccccucaggagggauugcaggccccagguggcagccucagagaggaggcgcaggcaggccc

SEQ ID NO: 730105 - RNA, 61 nt, Homo Sapiens
uuuugcuuuucagugucuucucagaaacaaccagccucaaagguaauuaaacucucauuua

SEQ ID NO: 730106 - RNA, 61 nt, Homo Sapiens
ggcagggccgccuucagaggcugcagggccucagccucaggaugcauuuaauguauccugg

SEQ ID NO: 730107 - RNA, 61 nt, Homo Sapiens
gauccuuugagguaaaaaaacauaaugucuucagccucauaauaaaggaaaguuaauuaaa

SEQ ID NO: 730108 - RNA, 61 nt, Homo Sapiens
ccagccuucuuccaucccaggacaccacacccagccucaguccuccccucacagccucuga

SEQ ID NO: 730109 - RNA, 61 nt, Homo Sapiens
gccguuggaccuucaccuccuagagauaaaccagccucagcuggcgcagcggggcccuucu

SEQ ID NO: 730110 - RNA, 61 nt, Homo Sapiens
ugagggucaccggcaggugggcugguggcugcagccucagagcccucccagguugcugcug

SEQ ID NO: 730111 - RNA, 61 nt, Homo Sapiens
gcacagcccugcaccccgccccugggguuggcagccucaguuggccccuggcagaggaaca

SEQ ID NO: 730112 - RNA, 61 nt, Homo Sapiens
uuucuucaugguggggggccauuuggaaugacagccucacuuccuucugauggcuacaucu

SEQ ID NO: 730113 - RNA, 61 nt, Homo Sapiens
auuuauaguugaauuuuugcuguaugaaaaucagccucauuagguuuauuucugugaguuu

SEQ ID NO: 730114 - RNA, 61 nt, Homo Sapiens
cccagccccagccccagugggccaguuuccccagccucagccucucucccuccuaccaccu

SEQ ID NO: 730115 - RNA, 61 nt, Homo Sapiens
ucuuuguucuaaagauggaagccaccgcgcccagccucaucugcugggauuacagggauga

SEQ ID NO: 730116 - RNA, 61 nt, Homo Sapiens
cgacaauucacggaacuguucaggaaauggccagccucaaaucuugucuggaagaguucug

SEQ ID NO: 730117 - RNA, 61 nt, Homo Sapiens
gcagcccccuccugaccccagggggaagcaccagccucagucaucugaaaggcccaaacca

SEQ ID NO: 730118 - RNA, 61 nt, Homo Sapiens
ggccccuugcugcuggcuccucucacucuggcagccucagaggccauacccaugugucgcc

SEQ ID NO: 730119 - RNA, 61 nt, Homo Sapiens
cccauuccccugagagcaagaccagccucuucagccucacauugucugugaguuacgggca

SEQ ID NO: 730120 - RNA, 61 nt, Homo Sapiens
uaaagguguaccuuccauguccuuucuguaacagccucaaauuugaguucuggguauccuc

SEQ ID NO: 730121 - RNA, 61 nt, Homo Sapiens
aacauggccuuuucucucuccuuugagugugcagccucacaaaauccgcaagcugggugug

SEQ ID NO: 730122 - RNA, 61 nt, Homo Sapiens
gaauuaccccucccaaaaugcacaaggaaagcagccucaaauugcuaaauagauuauaaua

SEQ ID NO: 730123 - RNA, 61 nt, Homo Sapiens
ugcaggcauuuuugaguggcuuuuaaaugcucagccucaaguguuacauaugaacauucau

SEQ ID NO: 730124 - RNA, 61 nt, Homo Sapiens
ugaauugcuuucauagcuuugccucaugaagcagccucauuuaaugccauaagucuagauu

SEQ ID NO: 730125 - RNA, 61 nt, Homo Sapiens
caacaacaauguguuguaaaucuuuguguugcagccucaacauggaacaagagaaguacua

SEQ ID NO: 730126 - RNA, 61 nt, Homo Sapiens
aaaagugguugugauugcaauagggaacgcacagccucacagacugaaaauucauugcaau

SEQ ID NO: 730127 - RNA, 61 nt, Homo Sapiens
uguaagcagcacugccucucugccauugucacagccucauucuggcacugucauuuguaaa

SEQ ID NO: 730128 - RNA, 61 nt, Homo Sapiens
gggaacacgggacagacgccccugggcguggcagccucacaucucgagacgcacaugcacg

SEQ ID NO: 730129 - RNA, 61 nt, Homo Sapiens
cauguggggaccacggaaggugguccuaugccagccucaccuguuuacugugcugcugcac

SEQ ID NO: 730130 - RNA, 61 nt, Homo Sapiens
aguaaaaaagguaggaaaucccuaaaacuuccagccucacauagcacgguucucaccuguc

SEQ ID NO: 730131 - RNA, 61 nt, Homo Sapiens
aagaugguggaagacauaggcuaaauuucuccagccucacaauggucuucacuuggucuga

SEQ ID NO: 730132 - RNA, 61 nt, Homo Sapiens
agaagauuccuggauggagaccccauugguucagccucaagucuggcccgucuucgaaaaa

SEQ ID NO: 730133 - RNA, 61 nt, Homo Sapiens
ccuggccagaagcaggagugugaggaggagacagccucagcggacaagcagcuggugcucc

SEQ ID NO: 730134 - RNA, 61 nt, Homo Sapiens
gaauucuagcaaccuuuguuaggaaaaagcacagccucagauggaggcagccuaaacugug

SEQ ID NO: 730135 - RNA, 61 nt, Homo Sapiens
uucagcuguuucaccaucagucaaugaauaacagccucauugaugucaaaaacuucaauau

SEQ ID NO: 730136 - RNA, 61 nt, Homo Sapiens
cauguuggccaggcuggucuugaacuccuggcagccucaagugauccacccaccucggucu

SEQ ID NO: 730137 - RNA, 61 nt, Homo Sapiens
gccagagggguuggccaguuggagccugggucagccucagcagccuauccccauguccucu

SEQ ID NO: 730138 - RNA, 61 nt, Homo Sapiens
auuuagugcacaguggccccaucauagccugcagccucaucauuucccaucuggaccuggu

SEQ ID NO: 730139 - RNA, 61 nt, Homo Sapiens
ucaaagcuaauuuuuuacuaaaguuuuuauacagccucaaauuguuuuauuaaaaaaaaga

SEQ ID NO: 730140 - RNA, 61 nt, Homo Sapiens
uccacgcagguggcuuguagaaaccuuugggcagccucaugucugcuaaaacagccaucuu

SEQ ID NO: 730141 - RNA, 61 nt, Homo Sapiens
gaaagguaauuuuaagcuaacaaccagugcacagccucagguuuuaaauuacaaccacagu

SEQ ID NO: 730142 - RNA, 61 nt, Homo Sapiens
gacccagcccuauuuuacgucauucuaaauucagccucauauaaugaaaauacauuaugaa

SEQ ID NO: 730143 - RNA, 61 nt, Homo Sapiens
uggagugcaguggcacaaugacgacucacugcagccucaaccuccuggggccaagugaucc

SEQ ID NO: 730144 - RNA, 61 nt, Homo Sapiens
ugggaccuuuguaggaagagacacaguccugcagccucauauggcucaauaaaacagaaag

SEQ ID NO: 730145 - RNA, 61 nt, Homo Sapiens
agcgcuuucagcuggaccacucaggccuggacagccucaucuccaugaggcuggugcuucg

SEQ ID NO: 730146 - RNA, 61 nt, Homo Sapiens
uggccucuucuugcuuugaccuggcagauaucagccucaacauugaguaugcaccucucug

SEQ ID NO: 730147 - RNA, 61 nt, Homo Sapiens
ucccaguccagacgggugcugccggcucagccagccucacgcugcuaggaaauggcucccu

SEQ ID NO: 730148 - RNA, 61 nt, Homo Sapiens
aaccuccuacccaugucugagguagcaagugcagccucacgacagauaccaggcaauccag

SEQ ID NO: 730149 - RNA, 61 nt, Homo Sapiens
aguagggaacauggcagagaguggugcuucccagccucacaaugugggaauuugacauagg

SEQ ID NO: 730150 - RNA, 61 nt, Homo Sapiens
aaaggauucuuucaacuucucauggagaauccagccucacaaggccauucuccuucucuuc

SEQ ID NO: 730151 - RNA, 61 nt, Homo Sapiens
caggcacguaccugcugaccggcugacaggccagccucacuagagauggaggagccccagu

SEQ ID NO: 730152 - RNA, 61 nt, Homo Sapiens
uucccacaggcucauacucaauggguaguaccagccucaaaacauacaaggacaguggguc

SEQ ID NO: 730153 - RNA, 61 nt, Homo Sapiens
cuuguauuuaguuuggggaaaugcacaaccacagccucaauacaugcaugcacaugaaaac

SEQ ID NO: 730154 - RNA, 61 nt, Homo Sapiens
ucuugagaggauaagacucuggccgggugggcagccucaggugacagcccagugucggccu

SEQ ID NO: 730155 - RNA, 61 nt, Homo Sapiens
ccuugcagccaguaagaaauuugcaccagggcagccucagccgcagcagugacuacaauag

SEQ ID NO: 730156 - RNA, 61 nt, Homo Sapiens
gaauaugcaacaacuccugucuucccgacaccagccucaugcuggcaacugugagucccug

SEQ ID NO: 730157 - RNA, 61 nt, Homo Sapiens
ccaagcuucuaccugccuuuggcaucucaggcagccucagccuguggaccagagugcuuga

SEQ ID NO: 730158 - RNA, 61 nt, Homo Sapiens
gacaaauaggcuucaucaugaggcagagccccagccucagacuggagcagaauaagucuaa

SEQ ID NO: 730159 - RNA, 61 nt, Homo Sapiens
caaccaugagggauaguaugucaucagcaggcagccucaugcauuuaaguuggcuugaauc

SEQ ID NO: 730160 - RNA, 61 nt, Homo Sapiens
ggguccuucuggaaccagcuacccggaagaccagccucagaacccucccacagcacauccu

SEQ ID NO: 730161 - RNA, 61 nt, Homo Sapiens
gaucuuugcaacacuccaacgaauguggaugcagccucacaucacuguauacucuugcuga

SEQ ID NO: 730162 - RNA, 61 nt, Homo Sapiens
cagggaccaaccggcugcuuaaugucuuccucagccucaacaaguauuuccagcaggaagu

SEQ ID NO: 730163 - RNA, 61 nt, Homo Sapiens
caugucuuaacaaaaugacauaucuggagcucagccucaauguaccguaaagaauauaucu

SEQ ID NO: 730164 - RNA, 61 nt, Homo Sapiens
uuacagacagcccccugagggggugccaccacagccucauucccuuauggugcccugugca

SEQ ID NO: 730165 - RNA, 61 nt, Homo Sapiens
accuuucugcuggggcugaagugccuuccuccagccucacagacuggaugugccgugggca

SEQ ID NO: 730166 - RNA, 61 nt, Homo Sapiens
ccuucacaagauggaaggcaugcagguagagcagccucauucccuccuggcuucagcaucc

SEQ ID NO: 730167 - RNA, 61 nt, Homo Sapiens
uucucacuugcugugggugauggagaagacacagccucaccacuauuaaggguguuagucu

SEQ ID NO: 730168 - RNA, 60 nt, Homo Sapiens
auaaaagaugauuucucaaaaugaaaagcacagccucagagagauuuagauucacuguga

SEQ ID NO: 730169 - RNA, 61 nt, Homo Sapiens
agaucaacggaccaaauaaaauuuaagaacucagccucacuuuuuaacuugggggugaaag

SEQ ID NO: 730170 - RNA, 61 nt, Homo Sapiens
cuccuggguuuaagcaguccacaguucauugcagccucaacaguacaggucugguacaauc

SEQ ID NO: 730171 - RNA, 61 nt, Homo Sapiens
uuacacuugguuacucaaaaaacacacaaaccagccucaaccacaaaaggaacaaaagcga

SEQ ID NO: 730172 - RNA, 61 nt, Homo Sapiens
ugaaugugucacuacucacaaccuagauuuacagccucacuucagguucuuagugucacuu

SEQ ID NO: 730173 - RNA, 61 nt, Homo Sapiens
ugauccucgcaucucagccuucucaaacccccagccucaaccaccauguugcccaggcugg

SEQ ID NO: 730174 - RNA, 61 nt, Homo Sapiens
caccugcuggguucaagcaauucuccugccucagccucaugaguagcugugacuacaggca

SEQ ID NO: 730175 - RNA, 61 nt, Homo Sapiens
cagaagcugcauuucagcugaaucuguguuucagccucaguugguugcaccguuagccccu

SEQ ID NO: 730176 - RNA, 61 nt, Homo Sapiens
ucacagaagcgaaggcuugaugcugucucagcagccucagcugugggggggaagcgcgugu

SEQ ID NO: 730177 - RNA, 61 nt, Homo Sapiens
gccgugagccaaguaaaccucuuuaauuacccagccucaggugcuccgggaacgccuuccg

SEQ ID NO: 730178 - RNA, 61 nt, Homo Sapiens
cgaagauguuguacuccaccgccugcaccaacagccucaguguuacuucccaggauuugcu

SEQ ID NO: 730179 - RNA, 61 nt, Homo Sapiens
uuuguaauauuuguccacuaagcuggagaagcagccucauacaguugauuuuguguaugug

SEQ ID NO: 730180 - RNA, 61 nt, Homo Sapiens
gcuugggcaauucagggcagaacuccuguaucagccucauggacacccagaauugguaucu

SEQ ID NO: 730181 - RNA, 61 nt, Homo Sapiens
acagcccaaccucuggcagaccagggguuaccagccucacagcugcagcugccuucaagcc

SEQ ID NO: 730182 - RNA, 61 nt, Homo Sapiens
uccccgcccugggcagcagggccagucccuccagccucaccugccccagcagacacaggcu

SEQ ID NO: 730183 - RNA, 61 nt, Homo Sapiens
caagucauccccgacaugacccccugccacccagccucauguagguaugugcaguucccgg

SEQ ID NO: 730184 - RNA, 61 nt, Homo Sapiens
gacugcacacccccuugccucagcaccacuccagccucagagaacgggaccuaggggacag

SEQ ID NO: 730185 - RNA, 61 nt, Homo Sapiens
gagcuaauaaagggaaacgagcaguacacaucagccucacucugugauuuuuuuuaaaugu

SEQ ID NO: 730186 - RNA, 61 nt, Homo Sapiens
cccucuguguguguugaccaacucggauucccagccucacuuuggcagucgaggagucaga

SEQ ID NO: 730187 - RNA, 61 nt, Homo Sapiens
aucauguuaaagagggaguugaaacugggggcagccucaaaaauauucuuuuuuuuuucua

SEQ ID NO: 730188 - RNA, 61 nt, Homo Sapiens
agcagacucugaagccggaggcccucccgcucagccucagagugaccggagagaaagagga

SEQ ID NO: 730189 - RNA, 61 nt, Homo Sapiens
cugccucccggguucaagcaauuucuugccucagccucaugaauagcugggauuacaggug

SEQ ID NO: 730190 - RNA, 61 nt, Homo Sapiens
aaucaaaaguauuuuauaaaaggagaaagaacagccucauuuuagauguaguccuguugga

SEQ ID NO: 730191 - RNA, 61 nt, Homo Sapiens
aaccuccgccucccggguucaagcgauucuccagccucagcuuccugaguagaugggauua

SEQ ID NO: 730192 - RNA, 61 nt, Homo Sapiens
cugccucccggguucaagcaauucccugccucagccucaugaauagcugggauuacaggug

SEQ ID NO: 730193 - RNA, 61 nt, Homo Sapiens
cucccugucuccaacuccaguaagcccuccucagccucaccuuacgaauccaaagaacugg

SEQ ID NO: 730194 - RNA, 61 nt, Homo Sapiens
uagaguacaauauugcaaucacagcucacugcagccucaaacuccugggcucaagugaucc

SEQ ID NO: 730195 - RNA, 61 nt, Homo Sapiens
uagcggguuggggguggugguggggugcuggcagccucaggagcgaucgcuccccuggaga

SEQ ID NO: 730196 - RNA, 61 nt, Homo Sapiens
guggggcucauaaaacaugaaucaagcaauccagccucaugggaaguccuggcacaguuuu

SEQ ID NO: 730197 - RNA, 61 nt, Homo Sapiens
uggagugcgcuggcuugaucuuggcucacugcagccucaauguccccaggcucagauuguc

SEQ ID NO: 730198 - RNA, 61 nt, Homo Sapiens
aacguggucaacucacaccugccucuuccugcagccucacuucuaccugcccccaucauaa

SEQ ID NO: 730199 - RNA, 61 nt, Homo Sapiens
cccauguacagacacgguccccacacccucccagccucaggcccaggcagacaugggcgag

SEQ ID NO: 730200 - RNA, 61 nt, Homo Sapiens
aauggggcugugugcaugcaggcccauguuucagccucagcccacgccaggugaaaggauc

SEQ ID NO: 730201 - RNA, 61 nt, Homo Sapiens
uuugagugugccaggguaaaggcuuccaguucagccucaguuauuuuagacaaucucgcca

SEQ ID NO: 730202 - RNA, 61 nt, Homo Sapiens
ucccuugaguucaggugcccugaacucaguacagccucaucuucucauccaccaccuucuc

SEQ ID NO: 730203 - RNA, 61 nt, Homo Sapiens
acggccuccugaacguccguccucaggagcacagccucacggacagugccaaacccugugg

SEQ ID NO: 730204 - RNA, 61 nt, Homo Sapiens
agacauugucucugucggccaggcuggagugcagccucaaccuccuggguccaagugaucc

SEQ ID NO: 730205 - RNA, 61 nt, Homo Sapiens
cuugaaagacgguguuugguggagcauggcacagccucacacagcgccccuccucccugag

SEQ ID NO: 730206 - RNA, 61 nt, Homo Sapiens
uuccucuacccaucuucuuuggccuggacaacagccucagcccgugccaggacucagcagu

SEQ ID NO: 730207 - RNA, 61 nt, Homo Sapiens
acaauuuuggacaaagcuagagguaauugaccagccucaacaucuuacucccagcaccaaa

SEQ ID NO: 730208 - RNA, 61 nt, Homo Sapiens
gguauggcacucuuaauuaaacauacuuuuccagccucaugaguuuuuagcccuugagagg

SEQ ID NO: 730209 - RNA, 61 nt, Homo Sapiens
ggagcucuacccugcucccucgaugcucccucagccucagagaaagugggguccuucgggg

SEQ ID NO: 730210 - RNA, 61 nt, Homo Sapiens
cagguacgcuguacauuuuuuccugacacugcagccucaagggccaaggaacacccccuag

SEQ ID NO: 730211 - RNA, 61 nt, Homo Sapiens
gugacuccacaguggccccuauggccggucacagccucaguccacgggcucuccugggcuu

SEQ ID NO: 730212 - RNA, 61 nt, Homo Sapiens
ccucccacccccauacugguccuucacuccacagccucaccagucucugcccuauacgccg

SEQ ID NO: 730213 - RNA, 61 nt, Homo Sapiens
ucccucauugguuaaaaggggagcucuucuucagccucaguguaauuaccgagcaaggucu

SEQ ID NO: 730214 - RNA, 61 nt, Homo Sapiens
ugcuguccgccugaucuguccccccucuccccagccucagcauggguguccacagcacugg

SEQ ID NO: 730215 - RNA, 61 nt, Homo Sapiens
uuauggaaaagggaugccacauucauauuaucagccucauuaaccaaaauuagauucaacu

SEQ ID NO: 730216 - RNA, 61 nt, Homo Sapiens
uacaccccaggagcccuggcagccccagccccagccucaucagccaggugcccaggacaga

SEQ ID NO: 730217 - RNA, 61 nt, Homo Sapiens
cccuugucuacuuguucuccauuccccuggccagccucagccagcccaugcccuggagggc

SEQ ID NO: 730218 - RNA, 50 nt, Homo Sapiens; identical to SEQ ID NO: 110858

SEQ ID NO: 730219 - RNA, 61 nt, Homo Sapiens
uucaggccaaaaccagggaagauucuagcuucagccucauguccauuuccagucugucagc

SEQ ID NO: 730220 - RNA, 61 nt, Homo Sapiens
uaugccuucaucagcgugaccccugugccugcagccucauagguguuaaucuguaauuuua

SEQ ID NO: 730221 - RNA, 61 nt, Homo Sapiens
ggagugcaguggugcagucuguagcucacugcagccucaaacuccuaggcucaggcgaucc

SEQ ID NO: 730222 - RNA, 61 nt, Homo Sapiens
gaagauccuuggcugccgcuuucucuccccacagccucaaggccacccuaccgucauauau

SEQ ID NO: 730223 - RNA, 61 nt, Homo Sapiens
ccuagggaagaagcaagaaacuucggggcugcagccucaggaugaggcagaaggaagggua

SEQ ID NO: 730224 - RNA, 61 nt, Homo Sapiens
agauggucucucuucucaaguaggaacaccccagccucagacagacacagcaggaaggggc

SEQ ID NO: 730225 - RNA, 61 nt, Homo Sapiens
caacagcccacuguuaggagguaguagaccccagccucaaggcucugaccuucuucaugug

SEQ ID NO: 730226 - RNA, 61 nt, Homo Sapiens
caccauguuacucaggcuggucucaaacucccagccucaagcgaugcucccaccuccaccu

SEQ ID NO: 730227 - RNA, 61 nt, Homo Sapiens
uugcucacccaagggggcugcuuaacacaaacagccucagacccgagguuuagauuucuga

SEQ ID NO: 730228 - RNA, 61 nt, Homo Sapiens
gaucucgaacucccgaccucaggugauccgccagccucagccucccaaagugcugggauua

SEQ ID NO: 730229 - RNA, 61 nt, Homo Sapiens
aaccuccgccuccuggguucaagcgauucuccagccucagccuccugaguagcuggaauua

SEQ ID NO: 730230 - RNA, 61 nt, Homo Sapiens
cucucauccucccgccgcccgucaggccggccagccucacaucagucucuccgccccgggg

SEQ ID NO: 730231 - RNA, 61 nt, Homo Sapiens
cagccaaaguccccccaccccuucagagaagcagccucaaauuccagaaguggaggcucca

SEQ ID NO: 730232 - RNA, 61 nt, Homo Sapiens
gccaccaaccgaaccgugaauguagggcccccagccucaccucugccccaggaccaacaac

SEQ ID NO: 730233 - RNA, 61 nt, Homo Sapiens
agccuguugcuguacuuuucugcuuauuuuacagccucaaauauuucucauuaucuuguca

SEQ ID NO: 730234 - RNA, 61 nt, Homo Sapiens
cagccccucaggaacccucauccuucaaagacagccucauuucggacuaaacucauuagag

SEQ ID NO: 730235 - RNA, 61 nt, Homo Sapiens
uuucuuucucaccauagaucggcgggugcugcagccucacuguguucuguguacgugacaa

SEQ ID NO: 730236 - RNA, 61 nt, Homo Sapiens
uguguaauugugacacaauuacagcugauugcagccucaaccuucccagcucaagugaucc

SEQ ID NO: 730237 - RNA, 61 nt, Homo Sapiens
auuuugcuugcucauauuucuggccaauguacagccucauauuuuucagaguaauacagau

SEQ ID NO: 730238 - RNA, 61 nt, Homo Sapiens
gugacucuuguuacagaucauggcggugcgucagccucacaggagacauagcaggucucag

SEQ ID NO: 730239 - RNA, 61 nt, Homo Sapiens
gauggaaaaguguagggacugagaagggcugcagccucagcaguguacagaguccccggcg

SEQ ID NO: 730240 - RNA, 61 nt, Homo Sapiens
acagcucucagccuaagagcgcagcacugaacagccucaucauuccacuuuucaugggaaa

SEQ ID NO: 730241 - RNA, 61 nt, Homo Sapiens
gcaucuuucucuucccaugcugccuccucagcagccucacugcugcucacugcucacacgc

SEQ ID NO: 730242 - RNA, 61 nt, Homo Sapiens
gcugaaguugccugaaugauucacagaugcccagccucauaacagccugagccuucagccc

SEQ ID NO: 730243 - RNA, 61 nt, Homo Sapiens
aacaauaaaaacaaugguagggcggcacugacagccucaguaaaaaguguuagugcuucca

SEQ ID NO: 730244 - RNA, 61 nt, Homo Sapiens
cgaguggcuuauagccuccauacccauaccucagccucaggaggguggugaugguaguuuc

SEQ ID NO: 730245 - RNA, 61 nt, Homo Sapiens
ccagaaauauuauuuuuuuaagaggagaccucagccucacauucagcuuggguacacacac

SEQ ID NO: 730246 - RNA, 61 nt, Homo Sapiens
guccacucaggcacaagagcucuggccuccccagccucaaguuccaugaaugaccccucag

SEQ ID NO: 730247 - RNA, 61 nt, Homo Sapiens
gaaacucuuagguuaagcagagcacagcgggcagccucagucaugccgugugccuuuaguu

SEQ ID NO: 730248 - RNA, 61 nt, Homo Sapiens
aacaaacauuuccuaaauggauuuauuuugucagccucagcaugacaugauuaaaugauga

SEQ ID NO: 730249 - RNA, 61 nt, Homo Sapiens
uuguauuaaaugauauuuuguagauuuauagcagccucaagguauaguuacgaugccagau

SEQ ID NO: 730250 - RNA, 61 nt, Homo Sapiens
ugcuugagacuuuguguguaaacuccagcuccagccucauuggucagauaaaugaagauca

SEQ ID NO: 730251 - RNA, 61 nt, Homo Sapiens
agaauaaaugacuugcuuuuugccacuaaaacagccucaggggucauucuugucacaaaag

SEQ ID NO: 730252 - RNA, 61 nt, Homo Sapiens
auuauguagggaccuuaugcucuucucguuucagccucaguugcuuuuacaguggacagcc

SEQ ID NO: 730253 - RNA, 61 nt, Homo Sapiens
acaaaugucguugagguuacguuguaguccacagccucaggccuacuuguaauuaacuuga

SEQ ID NO: 730254 - RNA, 61 nt, Homo Sapiens
aacuuccuuuucaaagcaguagaaggaaaugcagccucaguccaguggcagucucagguua

SEQ ID NO: 730255 - RNA, 61 nt, Homo Sapiens
uccacacacacaucucacgccccuggucucacagccucacaccuuguccuuccaccccugc

SEQ ID NO: 730256 - RNA, 61 nt, Homo Sapiens
gcaaacagcgcaauuccaagcucgagagcuucagccucaggaaagaacuuccccuucccug

SEQ ID NO: 730257 - RNA, 61 nt, Homo Sapiens
auaucacuuugcucuuaccauuccuuuugaucagccucaauucagccucauuguguaguau

SEQ ID NO: 730258 - RNA, 61 nt, Homo Sapiens
cucuuaccauuccuuuugaucagccucaauucagccucauuguguaguauguuuuuucuuu

SEQ ID NO: 730259 - RNA, 61 nt, Homo Sapiens
agaugugugcuccuggagggaaaaagaaauacagccucaacagauuaaaaaacaaaaguca

SEQ ID NO: 730260 - RNA, 61 nt, Homo Sapiens
acaaaacugugucuuaucugccaggaaagaccagccucacuccugggaacugucuggcagg

SEQ ID NO: 730261 - RNA, 61 nt, Homo Sapiens
agaggcggaacugcuguguccucauguggcgcagccucaaacuggcauccaggcacugggc

SEQ ID NO: 730262 - RNA, 61 nt, Homo Sapiens
agauuuuauuauguuaguuuaaaaggucaaucagccucaugacuuuauaguuaugucuugu

SEQ ID NO: 730263 - RNA, 61 nt, Homo Sapiens
aggcuuaugggucuccagaaacucugccagccagccucaguggagaagcuuccucuaccac

SEQ ID NO: 730264 - RNA, 61 nt, Homo Sapiens
caaggucccuugaaucccaaaagugccuccccagccucagcccccaccuccagccacacac

SEQ ID NO: 730265 - RNA, 61 nt, Homo Sapiens
cuccugaugaugaagacugaagguguagacucagccucacucuguacaagugggugugcuc

SEQ ID NO: 730266 - RNA, 61 nt, Homo Sapiens
ccuaaguaagaacauaauguaaaauugucagcagccucauggggaggaaaaaggaagaguc

SEQ ID NO: 730267 - RNA, 61 nt, Homo Sapiens
guccucacuggugcuccaggggaagaaacgacagccucacuucuguauggacugcugaugu

SEQ ID NO: 730268 - RNA, 61 nt, Homo Sapiens
gaaacguugggguuucuuccuccagugacagcagccucaguagcuuuccugggcuccaggc

SEQ ID NO: 730269 - RNA, 61 nt, Homo Sapiens
cuccaugcucaccagcagccgcccaggcccgcagccucacccggcucccucuccucacccu

SEQ ID NO: 730270 - RNA, 61 nt, Homo Sapiens
ucauuccaacaccugccauaacagaggaggccagccucaccaggaauaaagcugugagcaa

SEQ ID NO: 730271 - RNA, 61 nt, Homo Sapiens
acugugugacccugggucuggcccucagugccagccucauccagggugugaugagguggga

SEQ ID NO: 730272 - RNA, 61 nt, Homo Sapiens
gucagagcaguggagacugguuugccugccucagccucaugucauccccuuauaaaugugc

SEQ ID NO: 730273 - RNA, 61 nt, Homo Sapiens
ggccaaagcaucagcaccaggaugccgaccucagccucacagcuguaauugaacgggucga

SEQ ID NO: 730274 - RNA, 61 nt, Homo Sapiens
ggccaaagcaucagcaccagcuucucuagcucagccucacacggcacaucuaacaucuaca

SEQ ID NO: 730275 - RNA, 61 nt, Homo Sapiens
gugagccccgggcccaggcuagugcccagcccagccucaagaugggcucgugagcacacuc

SEQ ID NO: 730276 - RNA, 61 nt, Homo Sapiens
acuccucccuggaccugcagucaccuuccuccagccucacccugaaccuccuccuccagcc

SEQ ID NO: 730277 - RNA, 61 nt, Homo Sapiens; identical to SEQ ID NO: 110868

SEQ ID NO: 730278 - RNA, 61 nt, Homo Sapiens
cuggcgucuggacuguucuguauuggaauagcagccucacaagucaggcuagcugugcugg

SEQ ID NO: 730279 - RNA, 61 nt, Homo Sapiens
cagagcagccacgacagccaguggagcgcgccagccucagcugcgaaguccagaguccagg

SEQ ID NO: 730280 - RNA, 61 nt, Homo Sapiens
cccugccccuccagcccacacgguguggcugcagccucagucaggggagggugcguggggg

SEQ ID NO: 730281 - RNA, 54 nt, Homo Sapiens
caggaagaacaaaaaaucaaccuucagccucaaggugaagaccaagcagcguga

SEQ ID NO: 730282 - RNA, 61 nt, Homo Sapiens
uacauaaugucacccauuuuuuaauaggaugcagccucacagaucuggagucucugaacuc

SEQ ID NO: 730283 - RNA, 61 nt, Homo Sapiens
ucuaccuggacacucauccaaucucagggcacagccucagggugcugggagaugaucagaa

SEQ ID NO: 730284 - RNA, 61 nt, Homo Sapiens
ccuggccccuugacacauccgugguucccugcagccucauguugguuucacuaagggccau

SEQ ID NO: 730285 - RNA, 61 nt, Homo Sapiens
uuugcucucaaugucaugcaccuuuaguccccagccucaccugugacucccuucaggcagu

SEQ ID NO: 730286 - RNA, 54 nt, Homo Sapiens
ggccucaggggagcccccacgcggcagccucaggucaaggcccuuccccaguga

SEQ ID NO: 730287 - RNA, 61 nt, Homo Sapiens
uuuuguuaaaaaaaaaaaaaaaaaaaggaaacagccucacuuuuuugugcucccucagaau

SEQ ID NO: 730288 - RNA, 61 nt, Homo Sapiens
gagcuacaggggcacuuaacccaccacagcacagccucaucaaaaugcagcuggcaacuuc

SEQ ID NO: 730289 - RNA, 61 nt, Homo Sapiens
cauacuucuuuuuuuuccucugaugugaauccagccucagacugagugaacuguaauaauu

SEQ ID NO: 730290 - RNA, 61 nt, Homo Sapiens
gugcuagucccagaggaugcugcggagggggcagccucagcucucuuuucagagaagauca

SEQ ID NO: 730291 - RNA, 61 nt, Homo Sapiens
gaaggaucaccugagccuaggaguucaagaccagccucagcaacagcaggagccccacccc

SEQ ID NO: 730292 - RNA, 61 nt, Homo Sapiens
cuacuguccaugcggccucacugggggccaucagccucaccagcaaagcagagaugagagc

SEQ ID NO: 730293 - RNA, 61 nt, Homo Sapiens
ugcagugagccaagaucgcgccacugcacuccagccucagcaauagagugagacugucuca

SEQ ID NO: 730294 - RNA, 61 nt, Homo Sapiens
uagagugcaguggcaugaucagggcuuacugcagccucacccucgauuuccugggcucaag

SEQ ID NO: 730295 - RNA, 61 nt, Homo Sapiens
aagaaaacgaaaacaguuuaaaucucuaccacagccucacaagcaaaugcuaaggggaaca

SEQ ID NO: 730296 - RNA, 61 nt, Homo Sapiens
aggccucacauucguggggcucccugaauggcagccucagcacagcguaggcccuuaauaa

SEQ ID NO: 730297 - RNA, 61 nt, Homo Sapiens
aaggagaggaguagaugagauggaauuuuuccagccucauccuggccugcccucuagacuc

SEQ ID NO: 730298 - RNA, 61 nt, Homo Sapiens
ggugggcgcauagguacaagugcugcuuugucagccucacucccugcagcucucagcuccc

SEQ ID NO: 730299 - RNA, 61 nt, Homo Sapiens
ccacagaggccucccagggcucucggccagucagccucagaaugagaguuacaccacuggc

SEQ ID NO: 730300 - RNA, 61 nt, Homo Sapiens
cuccagggcuuaagcaauccauggcucacugcagccucaacuggagugcaguggcaugauc

SEQ ID NO: 730301 - RNA, 61 nt, Homo Sapiens
caugcuaagggcacaugcaccucacuuagcucagccucaccuuuuaaaaaggaaggguaga

SEQ ID NO: 730302 - RNA, 61 nt, Homo Sapiens
cuccugggcucaagcaauccauagcucacugcagccucauauggagugcaguggcaugauc

SEQ ID NO: 730303 - RNA, 61 nt, Homo Sapiens
gugacuuucucagaggugacagaggagagugcagccucacaugauggaggugacaucaggc

SEQ ID NO: 730304 - RNA, 61 nt, Homo Sapiens
cauccuugcccuucucagggugugacguggucagccucauucgucacucuuggaggacucc

SEQ ID NO: 730305 - RNA, 61 nt, Homo Sapiens
gcucagaaggugccaguccgugcaggacgcucagccucaggugccuuugcugggccuucug

SEQ ID NO: 730306 - RNA, 61 nt, Homo Sapiens
aacacagugaaacuccaucugaguuugagaccagccucaucgguggauugcuugagcucgg

SEQ ID NO: 730307 - RNA, 61 nt, Homo Sapiens
aaagcuccaagcccuuuggguggaagaugcucagccucacaaaccagugcaugcaccuggu

SEQ ID NO: 730308 - RNA, 56 nt, Homo Sapiens
gucaaucccaguugcuuuucuuaaggcagccucauaaacgagacgacgaagauuaa

SEQ ID NO: 730309 - RNA, 61 nt, Homo Sapiens
aaguagauuagaaaacuagaaaaaaaaaauccagccucauaauuuuaaauuagcuuuucua

SEQ ID NO: 730310 - RNA, 61 nt, Homo Sapiens
uaauucuggauaaugcugggaaguaauaaagcagccucauuguaugcaugcauuuucaagc

SEQ ID NO: 730311 - RNA, 61 nt, Homo Sapiens
caaguuuagacaaguggauuuacaaugcacacagccucaugcaaaacucuuuauggcauuu

SEQ ID NO: 730312 - RNA, 61 nt, Homo Sapiens
ugugugccugggcaccgcucgcuuggaggggcagccucagguggagccguuccaucccgga

SEQ ID NO: 730313 - RNA, 61 nt, Homo Sapiens
ccccaggccucaucuuucaugcugaucgugucagccucaugcgagggacguguguucccca

SEQ ID NO: 730314 - RNA, 61 nt, Homo Sapiens
ccccaggccucgucuuucaugcugaucaugucagccucaugcgaggggcguguguucccca

SEQ ID NO: 730315 - RNA, 61 nt, Homo Sapiens
uccguccccugccccacaagcccgggccggacagccucagcgggccuuuggguggggaggg

SEQ ID NO: 730316 - RNA, 61 nt, Homo Sapiens
auccccugguggcuucagcaguccuuaucaccagccucacaaucccacaggcccaccccca

SEQ ID NO: 730317 - RNA, 61 nt, Homo Sapiens
uguguggggaggauccaucccccacccacugcagccucacaccgaguccaccuuggacaug

SEQ ID NO: 730318 - RNA, 61 nt, Homo Sapiens
gagggccaucagaaggaagccaaagaguucacagccucagcaccaacaacucaacaugguc

SEQ ID NO: 730319 - RNA, 61 nt, Homo Sapiens
uuauguuuccuaaaggaaauuguuuauucuacagccucaguagguagacacaaacauaaag

SEQ ID NO: 730320 - RNA, 61 nt, Homo Sapiens
ugguauaaucuccauuucaaaaccaaggaagcagccucagaguggucgagugacacaccuc

SEQ ID NO: 730321 - RNA, 61 nt, Homo Sapiens
cugugcuaagccugccacgggcguauccuugcagccucacaacagugggaggucuguaucc

SEQ ID NO: 730322 - RNA, 61 nt, Homo Sapiens
guaugcugcacaagcguguacacccccugggcagccucaaaaccccgcuuacagcagcaac

SEQ ID NO: 730323 - RNA, 61 nt, Homo Sapiens
ggggccccucccugccucggcucugccgccccagccucaguuccugcuucuggucuucucc

SEQ ID NO: 730324 - RNA, 61 nt, Homo Sapiens
gggcuugcccacccaccccgaccccagcccccagccucagccccgguccgggggcagccag

SEQ ID NO: 730325 - RNA, 61 nt, Homo Sapiens
agccugcccugcgguccugucaccuggaggccagccucacaugcccaaaucuccagucucc

SEQ ID NO: 730326 - RNA, 61 nt, Homo Sapiens
uggggugcccgcugccuguccuccgugaaaccagccucagaucagggcccugccacccagg

SEQ ID NO: 730327 - RNA, 61 nt, Homo Sapiens
gcgugaccuuggcucacugcaaccuccaggccagccucagccucccuaguagcugggacua

SEQ ID NO: 730328 - RNA, 61 nt, Homo Sapiens
uaggaguuuuauauacugugaucucccaccccagccucaagugauaagcaagaaagauuuc

SEQ ID NO: 730329 - RNA, 61 nt, Homo Sapiens
uaccacaacauacugacuaaaaccacaucggcagccucagcacauguugccugagcugguu

SEQ ID NO: 730330 - RNA, 61 nt, Homo Sapiens
ggaccacucuucucuccaaguuaaagcaaaccagccucagcaucucuugauaaaggagagg

SEQ ID NO: 730331 - RNA, 61 nt, Homo Sapiens
caagcaacauggggugaaccguuugucccuccagccucagcuuccaguauggccccaccau

SEQ ID NO: 730332 - RNA, 61 nt, Homo Sapiens
agcgcuugaagccugaacccggagaccccaccagccucaccagugagcagccuggagcccu

SEQ ID NO: 730333 - RNA, 61 nt, Homo Sapiens
agcucucuucaccguuuuuugccaguccccacagccucauccacccugccagcagcuuccg

SEQ ID NO: 730334 - RNA, 61 nt, Homo Sapiens
uugcuguccucugacacugcccucacuuccccagccucaccggccucucugggcccuacag

SEQ ID NO: 730335 - RNA, 61 nt, Homo Sapiens
uccccagccucaccuugcugucugggcccuacagccucacuguuggaggcacuagggccuc

SEQ ID NO: 730336 - RNA, 61 nt, Homo Sapiens
cugagagaccugcccucucucgggggcugcucagccucauccuggcagguggccaggcagg

SEQ ID NO: 730337 - RNA, 61 nt, Homo Sapiens
uugaguccuccuugggguugaaguccucuuccagccucacugaguacuuucauacucuucu

SEQ ID NO: 730338 - RNA, 61 nt, Homo Sapiens
gagcugcccacuacuggaaggacuuucuauccagccucacugcuuacccacugccugccca

SEQ ID NO: 730339 - RNA, 61 nt, Homo Sapiens
uaaugccccccaaagacugauaaugauccuccagccucaucugaacugguuuuggucccuc

SEQ ID NO: 730340 - RNA, 60 nt, Homo Sapiens
cuguuccguagcucagagcccacuggccuccagccucaauagaaauccgggcagcaguga

SEQ ID NO: 730341 - RNA, 61 nt, Homo Sapiens
acucccgggacuauugccaaccaccaagugucagccucagcggcuuucugaguccuguugg

SEQ ID NO: 730342 - RNA, 61 nt, Homo Sapiens
cccagagaagacugaggcuacugccaaggagcagccucaaguuauuuuuuacuuuaaaugc

SEQ ID NO: 730343 - RNA, 61 nt, Homo Sapiens
ugugaacacccgugucuggguguggagcucacagccucacaagcaagccuccuuugugcua

SEQ ID NO: 730344 - RNA, 61 nt, Homo Sapiens
aaccaggccucucacuccaggugccaugcugcagccucagacuguagcacaggcaaugcca

SEQ ID NO: 730345 - RNA, 61 nt, Homo Sapiens
ccccacccagcaccuucccacacgcuggccccagccucagacaccugccggcaguagcccc

SEQ ID NO: 730346 - RNA, 59 nt, Homo Sapiens
uggcccucaccucuuuggacaacagaugcugcagccucaacgucucuuucuauucaaua

SEQ ID NO: 730347 - RNA, 61 nt, Homo Sapiens
ucggggaaccugcaccgcaucucaccgagaccagccucaucaugacguguuuggcuguugg

SEQ ID NO: 730348 - RNA, 61 nt, Homo Sapiens
guggaggcuccaucccagcaucagcuuuuaccagccucaguucucauugcugcuguugagu

SEQ ID NO: 730349 - RNA, 61 nt, Homo Sapiens
aaagagauuuugaaaaccaauuguauuuaaccagccucaaauugugcaaccaugauguaua

SEQ ID NO: 730350 - RNA, 61 nt, Homo Sapiens
gccaggaggcuguuccaggaguccugcccagcagccucaguggccaagcccagacacucac

SEQ ID NO: 730351 - RNA, 61 nt, Homo Sapiens
augauauugcaaaagugauacuuagauuuuacagccucaguagucugcccaguguccacau

SEQ ID NO: 730352 - RNA, 61 nt, Homo Sapiens
gcagcuaacacgcccgggguggccacagcgccagccucagacuggagggcaagggguuccc

SEQ ID NO: 730353 - RNA, 61 nt, Homo Sapiens
uuuucuccugcaggguacugggccaggcccucagccucagagagccugcagaagggcuugg

SEQ ID NO: 730354 - RNA, 61 nt, Homo Sapiens
gacgcgacgcgaugccucccggccaccgccccagccucaccccaucccacgacccccgcaa

SEQ ID NO: 730355 - RNA, 61 nt, Homo Sapiens
cuaguauguucugacaucuggcuucccuucucagccucauguccaccugccugccagccag

SEQ ID NO: 730356 - RNA, 61 nt, Homo Sapiens
cuacaccacacacaacagccaacagcuacaacagccucacuuggucugccaggcccccacc

SEQ ID NO: 730357 - RNA, 61 nt, Homo Sapiens
aagugaaugggucucaaagacuuggugaccccagccucaucuucuaggccuuuuccaccca

SEQ ID NO: 730358 - RNA, 61 nt, Homo Sapiens
aggccacuucucaagcagcuuuuggcaccuucagccucagaguggaaucuuuuaaagacag

SEQ ID NO: 730359 - RNA, 61 nt, Homo Sapiens
cuggugguugccucccguccugggcaggcugcagccucaugccaugucucucucccacuac

SEQ ID NO: 730360 - RNA, 61 nt, Homo Sapiens
cagcguucgcccuuuagcggggaggucauuacagccucauggccucuaccaaggccccaga

SEQ ID NO: 730361 - RNA, 61 nt, Homo Sapiens
acuucgcuucagccuccggaccauuccggagcagccucacauaccucacugucucgucugu

SEQ ID NO: 730362 - RNA, 61 nt, Homo Sapiens
aaccuccgccuccuggguucaagcgauucuccagccucagccucccgaguagcugggauua

SEQ ID NO: 730363 - RNA, 61 nt, Homo Sapiens
aggcuuucucuguguaaagaaaaaguuugaccagccucagacacuaguucuuaacauugua

SEQ ID NO: 730364 - RNA, 61 nt, Homo Sapiens
ugagacgggccaggacgcccgacauccccaccagccucagaaaacugggccgauguggugu

SEQ ID NO: 730365 - RNA, 61 nt, Homo Sapiens
agcaccacccauucaagcaucagacauuugucagccucaacaugaacaagucuguaaagcu

SEQ ID NO: 730366 - RNA, 61 nt, Homo Sapiens
cauuuguauaucuccagaaagcauaugaugccagccucacgcaauuuguaaagccacauuu

SEQ ID NO: 730367 - RNA, 61 nt, Homo Sapiens
uggcugaaccucgccgcuccaguacucccuccagccucagcgcuaccccuccuggccaccc

SEQ ID NO: 730368 - RNA, 61 nt, Homo Sapiens
gugccucucuggccgcccaccugggcucuuccagccucaguaaaaagaacuagcagagggc

SEQ ID NO: 730369 - RNA, 61 nt, Homo Sapiens
ccuacaucagacaaaauaucaccaaaagauccagccucauaucuaauucuggcaggaccuc

SEQ ID NO: 730370 - RNA, 61 nt, Homo Sapiens
cugaaggcgagggguggaggaggccccagcacagccucaucuccauguguacacgugugua

SEQ ID NO: 730371 - RNA, 61 nt, Homo Sapiens
cgcaguuggggcugaggcuggggcuggcugccagccucaguucugggagcgcuggggucgc

SEQ ID NO: 730372 - RNA, 61 nt, Homo Sapiens
ccugaggggagacagagcaaccccuggaccccagccucaaauccaggacccugccaggcac

SEQ ID NO: 730373 - RNA, 61 nt, Homo Sapiens
cuuuccuaggcacauucguccacuaagggaacagccucagaaacugguacagcaaugggug

SEQ ID NO: 730374 - RNA, 61 nt, Homo Sapiens
gggagauucaggaucccccugugccagagcacagccucaccggaugcugcuucccacacug

SEQ ID NO: 730375 - RNA, 61 nt, Homo Sapiens
aaccuccgucuccuggguucaagugauucuccagccucagccucccgaauagcugggauua

SEQ ID NO: 730376 - RNA, 61 nt, Homo Sapiens
guugggaagccuuccgucugcggugggcaggcagccucacccugggcccacagaccggccu

SEQ ID NO: 730377 - RNA, 61 nt, Homo Sapiens
ugucauuguuccuuccccagaagcuaagagccagccucagagccuacccaggagcugugaa

SEQ ID NO: 730378 - RNA, 61 nt, Homo Sapiens
caggaucagguuagggcgagcgcuaccucuccagccucagcucucaguugcagcccugcug

SEQ ID NO: 730379 - RNA, 61 nt, Homo Sapiens
ggcauguuauggggaggggaggggguucuuccagccucaggucccagcugucucacguugu

SEQ ID NO: 730380 - RNA, 61 nt, Homo Sapiens
ucccagccacuuucccuccuggcacugccaccagccucaccgccugcgggcagggggaggc

SEQ ID NO: 730381 - RNA, 61 nt, Homo Sapiens
uccucucagcuccgccccauacccgucacuacagccucaccucccaccccugucacuacgg

SEQ ID NO: 730382 - RNA, 61 nt, Homo Sapiens
acuacggccucaccucccaccccugucacuacagccucaccuccuacagccuuaaguccca

SEQ ID NO: 730383 - RNA, 61 nt, Homo Sapiens
cccacgugguugucccgggaaagcugccccacagccucagcaucuucagcacuuaccgauc

SEQ ID NO: 730384 - RNA, 61 nt, Homo Sapiens
gacguccugugugccaagugguuuauaugcccagccucauuuaauccucagaaugacucca

SEQ ID NO: 730385 - RNA, 61 nt, Homo Sapiens
uggccaggcccaaggacccagccaucaaaaccagccucaaaucugguugugauggagaagu

SEQ ID NO: 730386 - RNA, 61 nt, Homo Sapiens
uagccgggccucaccccaccccuacccgccacagccucagggugugcaggggagccugcug

SEQ ID NO: 730387 - RNA, 61 nt, Homo Sapiens
gugugaccuuaggaagucucugccccucucucagccucagugucccgagggccccgaagca

SEQ ID NO: 730388 - RNA, 61 nt, Homo Sapiens
ugcacaccagccugggugacagugugagacccagccucaaaaaaaaaaaaaaaaaagugau

SEQ ID NO: 730389 - RNA, 61 nt, Homo Sapiens
ggucucaaacuccugggcucaagcgaacugucagccucagccucccagugugcugggauua

SEQ ID NO: 730390 - RNA, 61 nt, Homo Sapiens
acugcaccugggcagcuccucccugugcccccagccucagcccaacuucuuacccgaaagc

SEQ ID NO: 730391 - RNA, 61 nt, Homo Sapiens
aagaguccccuuggguacaccccucugcccacagccucagcauuucuuggagcagcaaagg

SEQ ID NO: 730392 - RNA, 61 nt, Homo Sapiens
gucuuggaccccacgagagagaaucguuccucagccucauggugaacucgcgcccuccagc

SEQ ID NO: 730393 - RNA, 61 nt, Homo Sapiens
uucccgcacccagcaugcagcucugccuccgcagccucagugcgcuuuccugcgcgcacug

SEQ ID NO: 730394 - RNA, 61 nt, Homo Sapiens
cguuccgguuauguuguguaagucaacucuucagccucauucacuguccuggcuuuuauuu

SEQ ID NO: 730395 - RNA, 61 nt, Homo Sapiens
cagauauauacaaaugaaauuagaagaaacacagccucaugggacagaaauuugagggagg

SEQ ID NO: 730396 - RNA, 61 nt, Homo Sapiens
gaagccuguguucuucaagagcagguguucucagccucacaugcccugccgugcuggacuc

SEQ ID NO: 730397 - RNA, 61 nt, Homo Sapiens
cucugccuguccagcgccaacuggauagcagcagccucagcagcgugagggugugucuucc

SEQ ID NO: 730398 - RNA, 61 nt, Homo Sapiens
uggagccaaagcuuuguccugucuucucucccagccucaguagagaugguuugaaggccca

SEQ ID NO: 730399 - RNA, 61 nt, Homo Sapiens
ucagccucccccugcugcucugaggcugggccagccucagcagcccggccagggccuggug

SEQ ID NO: 730400 - RNA, 61 nt, Homo Sapiens
uauguuuuuaaaaaauaucagccaccaugcccagccucaaaugcuggaauuacuggcguga

SEQ ID NO: 730401 - RNA, 61 nt, Homo Sapiens
uguguuaguaacaugaaaaaugggaaaccuccagccucaaggcccagcagguaugggcauc

SEQ ID NO: 730402 - RNA, 61 nt, Homo Sapiens
uugccagauguuggcagaagaacguccaccccagccucacaacuccuggcaacaucaggcc

SEQ ID NO: 730403 - RNA, 61 nt, Homo Sapiens
aacgccccugguggacaggauuccaggcagacagccucagcuccgcgcccauuggugaccc

SEQ ID NO: 730404 - RNA, 61 nt, Homo Sapiens
aaaguguugggauuacuggucucuucugccucagccucaccgaacuccugggcuuaaauga

SEQ ID NO: 730405 - RNA, 61 nt, Homo Sapiens
caguguuuucauugccaacaagggccaggcucagccucaaggaggaccugagggugcucaa

SEQ ID NO: 730406 - RNA, 61 nt, Homo Sapiens
uugcuggagcugucacaugagcagguucccccagccucaggucacauuguuccuccagacc

SEQ ID NO: 730407 - RNA, 61 nt, Homo Sapiens
ccugccauucagggcuguuccaccaggccagcagccucauccuugacugugucccagccag

SEQ ID NO: 730408 - RNA, 61 nt, Homo Sapiens
ccugucuguacugcucguccggccauggagucagccucagcgguuugaccucugcccacau

SEQ ID NO: 730409 - RNA, 61 nt, Homo Sapiens
gugccaagccuucugugagacacacucaccccagccucauucaaagaacaaucacuaaaac

SEQ ID NO: 730410 - RNA, 61 nt, Homo Sapiens
augaaccagggaaucaaacucuccuuagaggcagccucaagagggccuggcucacaugccc

SEQ ID NO: 730411 - RNA, 61 nt, Homo Sapiens
ccagggcgggaaagcaggcucaggacugagccagccucaggagcaggacuggggagagauc

SEQ ID NO: 730412 - RNA, 61 nt, Homo Sapiens
cuugcgaaccgugagcaggacccaggccggccagccucaccgccugcuucccaccucccug

SEQ ID NO: 730413 - RNA, 61 nt, Homo Sapiens
gcuuccuuauguccuccaccagaaaggauggcagccucaggucaguaucaaggcugccugg

SEQ ID NO: 730414 - RNA, 61 nt, Homo Sapiens
auuaaggucuuauuuaauuuccagucauacacagccucauucacagugcuccuccauauca

SEQ ID NO: 730415 - RNA, 61 nt, Homo Sapiens
gggugggauacagcagcuuuucccaucuuugcagccucauaugcuacucucucccucucca

SEQ ID NO: 730416 - RNA, 61 nt, Homo Sapiens
cucucaaagugcugggauuaaagcaaucugccagccucagcgaucuugaacuccugggcuc

SEQ ID NO: 730417 - RNA, 61 nt, Homo Sapiens
ugccccagguuuaagcaaucucagcucacugcagccucaacuagagugcaguggugcaauc

SEQ ID NO: 730418 - RNA, 61 nt, Homo Sapiens
augugugugucuacgugcagcucacuaccaacagccucaugugcacuugaccugacagugc

SEQ ID NO: 730419 - RNA, 61 nt, Homo Sapiens
gaauaaggaacaagcauuauuccuuugccaacagccucacucuaagaggcuuuuuugcuga

SEQ ID NO: 730420 - RNA, 61 nt, Homo Sapiens
ccggcagacccacccacccccuggggcugcucagccucaggcacggacagggcacaugaua

SEQ ID NO: 730421 - RNA, 61 nt, Homo Sapiens
ucucucuuugcucucuuucucccuccccuaccagccucauucuuccuccgguagccucucc

SEQ ID NO: 730422 - RNA, 61 nt, Homo Sapiens
guagccucucccaccuaaccucugcaucccccagccucauguccugccccaucccuauccu

SEQ ID NO: 730423 - RNA, 61 nt, Homo Sapiens
aagacacuacgggaacaguuugccucccucccagccucaaccacaauucuuccaugcuggg

SEQ ID NO: 730424 - RNA, 61 nt, Homo Sapiens
ugcuaugcaccacuugaaggagcucuaucaccagccucaaacccgaaagacugaggcauuu

SEQ ID NO: 730425 - RNA, 61 nt, Homo Sapiens
aggacggcagggucauccugagccgccaaggcagccucagucagagcacccugaaguuuuu

SEQ ID NO: 730426 - RNA, 61 nt, Homo Sapiens
ggaaagaaguucaguggucccauuguuaacucagccucaaaucucaacugucaggcccuac

SEQ ID NO: 730427 - RNA, 61 nt, Homo Sapiens
accuggagauccugaacugucaagccacuggcagccucaugccaccacauuugccagaaau

SEQ ID NO: 730428 - RNA, 61 nt, Homo Sapiens
gaaagugaugucagaauagcuuccaauaaagcagccucauucugaggccugagugauccac

SEQ ID NO: 730429 - RNA, 61 nt, Homo Sapiens
gaaccuuggccugggccguaucuccggcucccagccucagcgcggcccucccgaguuaagg

SEQ ID NO: 730430 - RNA, 61 nt, Homo Sapiens
cccagccaguccugagccucccgccaaaucccagccucacuaggugggacccccuucccag

SEQ ID NO: 730431 - RNA, 61 nt, Homo Sapiens
uggagugcaguggugugaucacagcucacugcagccucaaccucugaaggcccagaugauc

SEQ ID NO: 730432 - RNA, 61 nt, Homo Sapiens
aaaaugccauuuagcaauaaauaacacuugucagccucagagcauuuaaggaaacuagaca

SEQ ID NO: 730433 - RNA, 61 nt, Homo Sapiens
ggucucaaacuccuaggcuuaagcaguccuccagccucagccuucucaaagugcuaggaug

SEQ ID NO: 730434 - RNA, 61 nt, Homo Sapiens
uggagugcaguggcauaaucauaccucauugcagccucagacuccuggguucaagcaaucc

SEQ ID NO: 730435 - RNA, 61 nt, Homo Sapiens
uggagugcagugacgacaucacagcucacugcagccucaaccuggguucaagugauccucu

SEQ ID NO: 730436 - RNA, 61 nt, Homo Sapiens
aauuuuguauaaauauauagaaacacacacacagccucagacuuacaaacugauuauacuc

SEQ ID NO: 730437 - RNA, 61 nt, Homo Sapiens
cccucuauccuaucauagauaacauucuccacagccucacuucauuccaccuauucucuga

SEQ ID NO: 730438 - RNA, 61 nt, Homo Sapiens
uuacgcccuuccccuugaccuuguccugccccagccucacggacagccugcgcagggggcu

SEQ ID NO: 730439 - RNA, 61 nt, Homo Sapiens
gcccaggaccccugaccccggccgcugcugccagccucagaaaggcacccaggugugcagg

SEQ ID NO: 730440 - RNA, 61 nt, Homo Sapiens
gugaauaaaauucuuauugucuaaauugagacagccucagauauuugcagauauuuacuuu

SEQ ID NO: 730441 - RNA, 61 nt, Homo Sapiens
uuuuggccccaucucugguuaguucaugauacagccucaccgccccacucuguucccaagc

SEQ ID NO: 730442 - RNA, 61 nt, Homo Sapiens
aggcuuggaaagaaaaaacacuaauagaccucagccucaaaauaguugggacaucagcuga

SEQ ID NO: 730443 - RNA, 61 nt, Homo Sapiens
cuccacacagaaaugugaacgacuuugcacacagccucagguccuggcucugcaaacccca

SEQ ID NO: 730444 - RNA, 61 nt, Homo Sapiens
gaagaauaugacagcuguccacagacaaaaacagccucacagagagacccaaggaggaaaa

SEQ ID NO: 730445 - RNA, 61 nt, Homo Sapiens
cagucccuaauuaugggacuucaaagggcuccagccucacuucaguucugccaucuuguuu

SEQ ID NO: 730446 - RNA, 61 nt, Homo Sapiens
uucagcuucaugccucuuccggggccuacagcagccucaccaugcuggccucaugggcuug

SEQ ID NO: 730447 - RNA, 61 nt, Homo Sapiens
cugcccuuccgccccccacacaguggaaacacagccucacaggcagguaugacaacucauc

SEQ ID NO: 730448 - RNA, 61 nt, Homo Sapiens
cuccuggguucaagcaauccacagcucacugcagccucaacuagagugcaauggugcaauc

SEQ ID NO: 730449 - RNA, 61 nt, Homo Sapiens
cauuccugcggcauguaugacgcaacacccucagccucaugugcugagugcugaagcagug

SEQ ID NO: 730450 - RNA, 61 nt, Homo Sapiens
gcgcgcgcugugugugugugugugugugugucagccucagacagagcgcgcugugugugug

SEQ ID NO: 730451 - RNA, 61 nt, Homo Sapiens
aacuaacaaguuuugagaaacacccuagauccagccucaggcaucaucccuuccauugcca

SEQ ID NO: 730452 - RNA, 61 nt, Homo Sapiens
gcggcacacguucuagcucaccuggugguggcagccucaccuucgcauccugcagaagagu

SEQ ID NO: 730453 - RNA, 61 nt, Homo Sapiens
caccaucccccucuuuccacuggagaagcugcagccucacgcagcaaagcugagacaaaau

SEQ ID NO: 730454 - RNA, 55 nt, Homo Sapiens; identical to SEQ ID NO: 110882

SEQ ID NO: 730455 - RNA, 61 nt, Homo Sapiens
cugcgccugagcugcaugcgcggccaagccccagccucagccccguuccaagugcacugcc

SEQ ID NO: 730456 - RNA, 61 nt, Homo Sapiens
gcacuauuguaaacccugcuuuugcacagcccagccucacaugguguguauucucaugugg

SEQ ID NO: 730457 - RNA, 61 nt, Homo Sapiens
ccugaaucaaauuuuuaauuucguucuuuaucagccucauguaaugaaaaaaaguaaaacu

SEQ ID NO: 730458 - RNA, 61 nt, Homo Sapiens
uggucgggggcgggggcggcugaccagcaggcagccucaucuguggagggggcugcagggc

SEQ ID NO: 730459 - RNA, 61 nt, Homo Sapiens
ccacgggcuggacgggccugaguguuguuuccagccucaggccccgccuggagcccaggcc

SEQ ID NO: 730460 - RNA, 61 nt, Homo Sapiens
aaaacaagaccucugugcacgaacccucuaucagccucagguuuggagccgggucuagagg

SEQ ID NO: 730461 - RNA, 61 nt, Homo Sapiens
ggagcaguuugugggcugguggcuggccccacagccucacaccuguuugcauggagaaaug

SEQ ID NO: 730462 - RNA, 61 nt, Homo Sapiens
cagacucucugucgccaggcuucuccugccucagccucacgaguagcugggacuacaggca

SEQ ID NO: 730463 - RNA, 61 nt, Homo Sapiens
cagaacggaggucaccuucuccgagcugccgcagccucaggccuccccuaccagcucagcc

SEQ ID NO: 730464 - RNA, 61 nt, Homo Sapiens
guuuuuaccuuaauuucaacgugauuuuguucagccucacuaugagaugcuuuuucuuaau

SEQ ID NO: 730465 - RNA, 61 nt, Homo Sapiens
gagccacggcccgucuaguccacaccacagccagccucaggagugugggcugugcccuagc

SEQ ID NO: 730466 - RNA, 61 nt, Homo Sapiens
gugaacugucaucaccuggcaaccccagccccagccucagcccugcccccuuucccuccuu

SEQ ID NO: 730467 - RNA, 61 nt, Homo Sapiens
cuagggccuuuuuucaauaacuugaaaaucacagccucaucauuagcaacuuuauauacac

SEQ ID NO: 730468 - RNA, 61 nt, Homo Sapiens
aaccuccaccuccuggguucaagcgcuucuccagccucagccuccugaguagcugggauua

SEQ ID NO: 730469 - RNA, 61 nt, Homo Sapiens
cccucaucuagucuugaccucuccagcaucccagccucagaagccuucuugcugcccacaa

SEQ ID NO: 730470 - RNA, 61 nt, Homo Sapiens
gcuaagauuaaaauccgucucccauuuguuacagccucaccugcaccaggauagaaagcac

SEQ ID NO: 730471 - RNA, 61 nt, Homo Sapiens
guuuguccugagccugcacuguccucgccugcagccucagaggggcaggcauccccgcaca

SEQ ID NO: 730472 - RNA, 61 nt, Homo Sapiens
aacucccuggaauaucccugagcuacgcacucagccucaagggaauuagugcuggauuuga

SEQ ID NO: 730473 - RNA, 61 nt, Homo Sapiens
aaggaccuuguggcuuuguacagagggcuuacagccucagcgaagccacaguacucaucug

SEQ ID NO: 730474 - RNA, 61 nt, Homo Sapiens
gagggccgugugacacucucgccugcggcgccagccucacgucucucagccagcuguuuaa

SEQ ID NO: 730475 - RNA, 61 nt, Homo Sapiens
ucacugugcuguggucugucagucguuuccucagccucaucgauauagccaaugcuguugu

SEQ ID NO: 730476 - RNA, 61 nt, Homo Sapiens
ugccgcucaggccucagaggcaggcgccugccagccucacccaucccccgcgugcucugag

SEQ ID NO: 730477 - RNA, 61 nt, Homo Sapiens
ccugugaauuucuuauuguagacacugcgcccagccucaucugcugggauuacaggcguga

SEQ ID NO: 730478 - RNA, 61 nt, Homo Sapiens
ugacucacagagcugcagaguuuaaugagaccagccucagcguggaaaugccucuucuugg

SEQ ID NO: 730479 - RNA, 61 nt, Homo Sapiens
acccagucuuuucccuaguuaucuggggacacagccucagucggcugcuucggaagcagac

SEQ ID NO: 730480 - RNA, 61 nt, Homo Sapiens
gcaaggagggcgcuucacugugucccaggcccagccucaaggcuggcugugaggccaccuu

SEQ ID NO: 730481 - RNA, 61 nt, Homo Sapiens
cuccugggcucaagcgauccauagcucacugcagccucaaauggagaacaguggcaccauc

SEQ ID NO: 730482 - RNA, 61 nt, Homo Sapiens
uuuucacauugaaaaucagucagauuugcuucagccucaaagaggguguuuauguaaaacu

SEQ ID NO: 730483 - RNA, 61 nt, Homo Sapiens
gcucauucugggcccuugcugccaaggagcccagccucaccuagcaggaaaggagaugaag

SEQ ID NO: 730484 - RNA, 61 nt, Homo Sapiens
ugccgaggaagccgagugcccgccgccgcgccagccucagcccgcgcagaaugugcucgcu

SEQ ID NO: 730485 - RNA, 61 nt, Homo Sapiens
cuuuccugcuucucugaaagcacaggucacccagccucagaaucacaccucccggcugcug

SEQ ID NO: 730486 - RNA, 61 nt, Homo Sapiens
gaccucucaacacaguaugccaaguggauuccagccucauggccuagcaaaagaacagacu

SEQ ID NO: 730487 - RNA, 61 nt, Homo Sapiens
uauuccuaggcaaagagccucauggcuaaggcagccucaaagccagccccuccucccaccu

SEQ ID NO: 730488 - RNA, 61 nt, Homo Sapiens
aaccucugccucccagguucaagugcuucuccagccucagccucccaaguagcugagacua

SEQ ID NO: 730489 - RNA, 61 nt, Homo Sapiens
gaccgggccccucucuagggaccccucgccccagccucauuccccauucugugucccaugu

SEQ ID NO: 730490 - RNA, 61 nt, Homo Sapiens
uaaagaaaacuaaauccuucuguguccccggcagccucagugcagcaacagaagccaaggg

SEQ ID NO: 730491 - RNA, 61 nt, Homo Sapiens
gaacccauuaccuucucccucauuucaggagcagccucagaacaaagugagacaguccagc

SEQ ID NO: 730492 - RNA, 61 nt, Homo Sapiens
gagucaggaacccagacaaggaaucccauuccagccucaccccaaccaugaccuuggcaag

SEQ ID NO: 730493 - RNA, 61 nt, Homo Sapiens
guaaaugacaugaccagugggcacgugacaccagccucaaauaucauccauuguuuuucaa

SEQ ID NO: 730494 - RNA, 61 nt, Homo Sapiens
cugcauagcuugcacaacauccugguuuccucagccucacccuccacauuccaaacagagu

SEQ ID NO: 730495 - RNA, 61 nt, Homo Sapiens
aguauuuggacuuuuuaaagcuucugauccacagccucaucaacacagucacuguugguuc

SEQ ID NO: 730496 - RNA, 61 nt, Homo Sapiens
auccuuuuauaaaugugagauuagcacuuggcagccucauguuacuagaccaucuccauuu

SEQ ID NO: 730497 - RNA, 61 nt, Homo Sapiens
acugccaggccugcccugaaaccaucuuuagcagccucagccucagaaauaagccugagag

SEQ ID NO: 730498 - RNA, 61 nt, Homo Sapiens
gccccucuugcagaguccccaaucagcaggacagccucacugagagaccaggagccaccuc

SEQ ID NO: 730499 - RNA, 61 nt, Homo Sapiens
ggccagaggaucaccagugcggaccaggaaacagccucaguacgugcauagaggucuggga

SEQ ID NO: 730500 - RNA, 61 nt, Homo Sapiens
cccagggacugggggcgauugccagaggcagcagccucagcguggccuuggcccagaagga

SEQ ID NO: 730501 - RNA, 61 nt, Homo Sapiens
uucccugcuuggaagcguggcagccgugcuccagccucacucaagaaagccugaugaaguc

SEQ ID NO: 730502 - RNA, 61 nt, Homo Sapiens
cugaugaugcugccaaggcgccuggggagcucagccucaucugccacuuucaaaguggucc

SEQ ID NO: 730503 - RNA, 61 nt, Homo Sapiens
ccgggcaggggcggcccucgcuggcgcugugcagccucacccaagcuggcccagccuggag

SEQ ID NO: 730504 - RNA, 61 nt, Homo Sapiens
guuuugagcugaagugaucccaggcucacugcagccucaaccagggucuugcucugucucc

SEQ ID NO: 730505 - RNA, 61 nt, Homo Sapiens
gagcaucgccaggcugcugugggggcgggagcagccucagugucaagggcccgcccacuga

SEQ ID NO: 730506 - RNA, 61 nt, Homo Sapiens
cccugcccccaggccccggcauugccaucagcagccucagcgucuccccggccaugugugc

SEQ ID NO: 730507 - RNA, 61 nt, Homo Sapiens
ggggcggcugaugccagggcggcccgcggggcagccucacggaagggcccggugggacgug

SEQ ID NO: 730508 - RNA, 61 nt, Homo Sapiens
gucccucaugucucuagauuuucucgucacccagccucaaaaauauaugugucugcaaccc

SEQ ID NO: 730509 - RNA, 61 nt, Homo Sapiens
ccucuccgggaucaguccuaggacacaggcucagccucagguugaugggggaugaugugcu

SEQ ID NO: 730510 - RNA, 61 nt, Homo Sapiens
ggccaggagcgcuggguucugcagcagggcucagccucaggggcguuaagacccuggauga

SEQ ID NO: 730511 - RNA, 61 nt, Homo Sapiens
guggaggugcuccccacaguccgggccaggacagccucaggggagagugaaggccugcagg

SEQ ID NO: 730512 - RNA, 61 nt, Homo Sapiens
ucacuuaggggccacuuccuaaguugcuguccagccucagugacccccuagugcuuccugg

SEQ ID NO: 730513 - RNA, 61 nt, Homo Sapiens
gggugguccgggcacacugggccugccucuccagccucaggaugcucuuguuuauucuggg

SEQ ID NO: 730514 - RNA, 61 nt, Homo Sapiens
uggaaugcagugguaugaucacggcucacugcagccucaaccuccugggcuaagugauccu

SEQ ID NO: 730515 - RNA, 61 nt, Homo Sapiens
acccugccccuggugcccugagacagacacacagccucacgcccccaggaaugcaaguggu

SEQ ID NO: 730516 - RNA, 61 nt, Homo Sapiens
gguucucauugguccagacgaggaagguauccagccucaagucaucauuguggccaggaag

SEQ ID NO: 730517 - RNA, 61 nt, Homo Sapiens
caggggugggcgacacaggcagcuucuucggcagccucacggcagcaaccccagccuuccc

SEQ ID NO: 730518 - RNA, 61 nt, Homo Sapiens
gcuggggugcaguggcgcgaucccagcacugcagccucaaccuccugggcucaagccaucc

SEQ ID NO: 730519 - RNA, 61 nt, Homo Sapiens
gcgucccuguccuugaaggaccuccuucccccagccucaucaccgugcucuucucagcgcc

SEQ ID NO: 730520 - RNA, 61 nt, Homo Sapiens
gcuccccaccagcacgcugaccugugaaccccagccucaccaucacccccagcacugccag

SEQ ID NO: 730521 - RNA, 61 nt, Homo Sapiens
uaagaccaacugcguuggacaccauaagccacagccucacaggaagugggggugaggagcc

SEQ ID NO: 730522 - RNA, 61 nt, Homo Sapiens
cuuuuucacaugggccacaguuucaguacuucagccucagugggguuccugauguuuaucu

SEQ ID NO: 730523 - RNA, 61 nt, Homo Sapiens
accugaggcccuucucuccagccccuggaugcagccucacaguccuuaccagcagagcacc

SEQ ID NO: 730524 - RNA, 61 nt, Homo Sapiens
caauccaguggacuucgcaguccacuucugacagccucagugacccuggcuccuugugcca

SEQ ID NO: 730525 - RNA, 61 nt, Homo Sapiens
agagggggcugcggacacagcaggcccccuacagccucagguucugccugagcccagccua

SEQ ID NO: 730526 - RNA, 61 nt, Homo Sapiens
aaauaugacucuuuuguaauuaacucauguacagccucauccuguauaguuuaaugaugaa

SEQ ID NO: 730527 - RNA, 61 nt, Homo Sapiens
ccccccauagggggcagugucuuguuccugccagccucagugucuugcuucugccagcucc

SEQ ID NO: 730528 - RNA, 61 nt, Homo Sapiens; identical to SEQ ID NO: 110891

SEQ ID NO: 730529 - RNA, 61 nt, Homo Sapiens
ccuucucccagugcguuugacuuugucaggucagccucacuugucccuuucacaguuggcc

SEQ ID NO: 730530 - RNA, 61 nt, Homo Sapiens
aggugaaacuuagauaucauggacuguuguccagccucaaugcuucauuuuccccuugcau

SEQ ID NO: 730531 - RNA, 61 nt, Homo Sapiens
ggguugagaaggcuuugcugccaccuggugucagccucagucacuuucucugaaugcuucu

SEQ ID NO: 730532 - RNA, 61 nt, Homo Sapiens
uacccuaguucugcccuuguuuguggaguuacagccucaagguuguagcaugugugcuggc

SEQ ID NO: 730533 - RNA, 61 nt, Homo Sapiens
gaggacagccccccacuguucuccucaucuccagccucaguaguuggggguagaaggagcu

SEQ ID NO: 730534 - RNA, 61 nt, Homo Sapiens
ucuagcagccuggacuccgcaguggcugugucagccucacccuucgugugcacccgcaugg

SEQ ID NO: 730535 - RNA, 61 nt, Homo Sapiens
gcccucggagcuggcugugcuauggcccaggcagccucaaggcgcacgcgcgagugugcug

SEQ ID NO: 730536 - RNA, 61 nt, Homo Sapiens
gacaagagauuccaguuuuaaagaccagagccagccucagggaaggacugggagagacaca

SEQ ID NO: 730537 - RNA, 61 nt, Homo Sapiens
cccacgucccaaccccucuccugcuggcauacagccucauccugccuccagcauccagugg

SEQ ID NO: 730538 - RNA, 61 nt, Homo Sapiens
cauccaaagccacaccacagcagaaucaacucagccucaggaagcgaggucagacauccac

SEQ ID NO: 730539 - RNA, 61 nt, Homo Sapiens
cccugccugauauccagucaugcaggcuguccagccucauccaaccuggaguuggaggcau

SEQ ID NO: 730540 - RNA, 61 nt, Homo Sapiens
gggcugucggccaagagccuuguaccguggacagccucaggugcugcggggcuggcugcag

SEQ ID NO: 730541 - RNA, 61 nt, Homo Sapiens
uucccccggugccucucccauuugcuguucgcagccucacaccaauggguuugccaagccc

SEQ ID NO: 730542 - RNA, 61 nt, Homo Sapiens
uucucccaucccagaagcgggcuuuggagaucagccucaccguguggggugggggggaccu

SEQ ID NO: 730543 - RNA, 61 nt, Homo Sapiens
gcauuuggcaaaugcuuacuuucccauugcccagccucagugccuuuaaagaacauaagaa

SEQ ID NO: 730544 - RNA, 61 nt, Homo Sapiens
aaaaauugauguaaaucagaaaugggacaaucagccucaugaauauucagacuauucuuaa

SEQ ID NO: 730545 - RNA, 61 nt, Homo Sapiens
agguccugacaacaggugccugcaccugugacagccucagguauuuugccaagguuaagga

SEQ ID NO: 730546 - RNA, 61 nt, Homo Sapiens
auggagaaaccccgucucuagaguucgagaccagccucaacggcggaucaccugaggucag

SEQ ID NO: 730547 - RNA, 61 nt, Homo Sapiens
aggauggcuaaaugcuccugggagucaggcgcagccucacaccagcugccuccuccacuca

SEQ ID NO: 730548 - RNA, 61 nt, Homo Sapiens
gggcguuuucccggcaggcccccgggguccucagccucagcaacccagggagaggacagaa

SEQ ID NO: 730549 - RNA, 61 nt, Homo Sapiens
gcccucggaucagggccgggaugggaggggucagccucagggagcagcugccuugggggac

SEQ ID NO: 730550 - RNA, 61 nt, Homo Sapiens
cacucaguaacaaguauugggacguagagcacagccucacucagcucugaaagguaauaca

SEQ ID NO: 730551 - RNA, 61 nt, Homo Sapiens
gcaguuaugagggaggaagucaacugcuguucagccucagaauaaaggugccguucacugg

SEQ ID NO: 730552 - RNA, 61 nt, Homo Sapiens
gaucucccaacuugaacuauaauccaccagccagccucagccuugagcuuuggaaccacau

SEQ ID NO: 730553 - RNA, 61 nt, Homo Sapiens
agccaaguuugagcucuuaaaaguugaugaacagccucauuuccccagcuucccugauuuc

SEQ ID NO: 730554 - RNA, 61 nt, Homo Sapiens
uuccugguaggggugugugcgugacguacugcagccucaaccuccugggcucaagugaucc

SEQ ID NO: 730555 - RNA, 61 nt, Homo Sapiens
uagcagucagcuugaggaggaugaaggaaggcagccucagacaggaauuaaggcaaugccc

SEQ ID NO: 730556 - RNA, 61 nt, Homo Sapiens
auuuauuuguuauuaaauugaucugacuucucagccucauuuggacuaaaaaaagaaagca

SEQ ID NO: 730557 - RNA, 61 nt, Homo Sapiens
ucccacucuguccaccaagugggggguagcacagccucacagcaaccgcccugaccuuggg

SEQ ID NO: 730558 - RNA, 61 nt, Homo Sapiens
auuaccuuuacuccccucccucucccaucaccagccucaaggccugaggggugcaggggcu

SEQ ID NO: 730559 - RNA, 61 nt, Homo Sapiens
aucagcaccgauucccgaaagcuuuccaccucagccucagaguccagcugcccggacucca

SEQ ID NO: 730560 - RNA, 61 nt, Homo Sapiens
aauuuggcaguuuguuagguuagacaacugacagccucauuucauuccuacaaguugguuu

SEQ ID NO: 730561 - RNA, 61 nt, Homo Sapiens
ggagcacuggaggaggagugggcucucugugcagccucacagggcuuugccacggagccac

SEQ ID NO: 730562 - RNA, 61 nt, Homo Sapiens
uccaugucccggagaggggucccucaacagucagccucaccugucagaccgggguucuccc

SEQ ID NO: 730563 - RNA, 61 nt, Homo Sapiens
gagaugccacuucucacucaccacuaccagccagccucagaaggccccagagagacccugc

SEQ ID NO: 730564 - RNA, 61 nt, Homo Sapiens
ccuggccauuuugacccugaguggacagucacagccucagcucaugucuggcugugacaca

SEQ ID NO: 730565 - RNA, 61 nt, Homo Sapiens
acuggggcucagagccggggugggguggcugcagccucaggacugggagcccccagccugu

SEQ ID NO: 730566 - RNA, 61 nt, Homo Sapiens
ccuacccccuccaaggggcagguuuccaguccagccucagagaucaggcucugggaccccu

SEQ ID NO: 730567 - RNA, 61 nt, Homo Sapiens
ccgaguccuugucccuaccuccagcuuccuccagccucaaaccgccucuggaucuagcugu

SEQ ID NO: 730568 - RNA, 61 nt, Homo Sapiens
cagcgccagggcccaggccauguggccugcccagccucaaugucacuugguggcggggugg

SEQ ID NO: 730569 - RNA, 61 nt, Homo Sapiens
caccggaagacucacuuugucugcccugcgccagccucaccucacccugcaguucccguuu

SEQ ID NO: 730570 - RNA, 61 nt, Homo Sapiens
gagccccacagccccaagcuccuucgcgucucagccucagggucacggcccagacugggca

SEQ ID NO: 730571 - RNA, 61 nt, Homo Sapiens
accgcaucccaccuccugcccugcccagccccagccucaccgccaccuuguacaaagccgg

SEQ ID NO: 730572 - RNA, 61 nt, Homo Sapiens
gaccaagaaccaucugcgaaguuuauauaagcagccucaagaccuccgcccagccuguaau

SEQ ID NO: 730573 - RNA, 61 nt, Homo Sapiens
agagcuugcugcacccaggccugcauguacucagccucagggcugugugccggccuucuug

SEQ ID NO: 730574 - RNA, 61 nt, Homo Sapiens
ccggcagguccuauguccuuaagggcaucuccagccucagggucaccaaggcuucagcccc

SEQ ID NO: 730575 - RNA, 61 nt, Homo Sapiens
guccugggcucaaaugauccacggcucacugcagccucagcagugcaguggugccaucacc

SEQ ID NO: 730576 - RNA, 61 nt, Homo Sapiens
ucaucucugucacucuggaacucaccuugagcagccucagaagugcccaugucccuuccag

SEQ ID NO: 730577 - RNA, 61 nt, Homo Sapiens
cuuaacuucguguucacacugggcucugaagcagccucacuuggauggacacaugggccag

SEQ ID NO: 730578 - RNA, 61 nt, Homo Sapiens
ccauggcacuuugagggggugccaauuaguucagccucagacgcugccuagcaucugcuug

SEQ ID NO: 730579 - RNA, 61 nt, Homo Sapiens
cugaaggcuuuuuuuuggcuuuuguguucuucagccucagcguaauccacagacaacucua

SEQ ID NO: 730580 - RNA, 61 nt, Homo Sapiens
ucuuauuuccucaacguugcgugauaucccccagccucaaggccuggggagauggaggaaa

SEQ ID NO: 730581 - RNA, 61 nt, Homo Sapiens
ugcugcugccccucuagguccaggaagcccacagccucacccccagcccuaaacccugccc

SEQ ID NO: 730582 - RNA, 61 nt, Homo Sapiens
ucauaacuauaugaacuuuauugacacuucucagccucaaugguuucagcaugguauugag

SEQ ID NO: 730583 - RNA, 61 nt, Homo Sapiens
aaugugcugagauuucucugaaaauaacaggcagccucaagcguacaucauuauuaauaua

SEQ ID NO: 730584 - RNA, 61 nt, Homo Sapiens
gccacacgggggaagcagagguggcuucaaccagccucacaacacgccccucuacugcuau

SEQ ID NO: 730585 - RNA, 61 nt, Homo Sapiens
ccccugcuucagucccuuccuccggccucuccagccucagcgccccaucugccccacaguc

SEQ ID NO: 730586 - RNA, 61 nt, Homo Sapiens
ccguggcaggugauguguccucagcucccaucagccucauucagcagccauugcacgugca

SEQ ID NO: 730587 - RNA, 61 nt, Homo Sapiens
ggaggaucuggaggauccacccucccuucuccagccucaggaaaugccuuaauuucacucu

SEQ ID NO: 730588 - RNA, 61 nt, Homo Sapiens
gacaucagcccuugggggucccaggacucugcagccucagagggggcuggaggagcccagg

SEQ ID NO: 730589 - RNA, 61 nt, Homo Sapiens
cucccuaacuccauuugaaccaaaugacuuacagccucaucuuuccuaggauaaaaauaaa

SEQ ID NO: 730590 - RNA, 61 nt, Homo Sapiens
cuauuuaacuuugcucucaggugcuugcgaccagccucauuaggaccgccaccucuuccca

SEQ ID NO: 730591 - RNA, 61 nt, Homo Sapiens
gaucucccuucucaucucccggagccucauccagccucagaugagcaccaccagggcucca

SEQ ID NO: 730592 - RNA, 61 nt, Homo Sapiens
uccagggcuaaggacucucgcagcccagaggcagccucagcgccacguacagccagcgggu

SEQ ID NO: 730593 - RNA, 61 nt, Homo Sapiens
cagacccccugcccugucuucaggcaucggacagccucaucugcaccaucacuguggcugg

SEQ ID NO: 730594 - RNA, 61 nt, Homo Sapiens
agccacuucagaccagccagacugcuacacucagccucauggcucccucagucuggcaccc

SEQ ID NO: 730595 - RNA, 61 nt, Homo Sapiens
ccaggcagugggucuucccuuugccucagagcagccucaucagguaggauacguacaccuc

SEQ ID NO: 730596 - RNA, 61 nt, Homo Sapiens
uggaaggggaaaagucaggggccguguucuucagccucagcgagcgaugauggacuugagc

SEQ ID NO: 730597 - RNA, 61 nt, Homo Sapiens
gccucuuggcccagggccagucucuggcccccagccucagucagccuuccucaggccccug

SEQ ID NO: 730598 - RNA, 61 nt, Homo Sapiens
ugagucuuuuuggucugcacgagcugcguuccagccucagcgggagcgagaaaccccagcu

SEQ ID NO: 730599 - RNA, 61 nt, Homo Sapiens
caccccaccugggcccagcccccucgauggacagccucaccagcccacgcccccccaagag

SEQ ID NO: 730600 - RNA, 61 nt, Homo Sapiens
cccaggcuggaggcccugccucgcugcuugccagccucaccugcuggggcuggaggccaug

SEQ ID NO: 730601 - RNA, 61 nt, Homo Sapiens
cacacagaggaggaagacagcagccuggcagcagccucaccgaagagaggaaccaccacac

SEQ ID NO: 730602 - RNA, 61 nt, Homo Sapiens
acuuucugcgugguggaaaccauugcauauucagccucauuucaagaguguuuccuucuca

SEQ ID NO: 730603 - RNA, 61 nt, Homo Sapiens
cugaagcaggaaggcagagcaucaucuuguucagccucagcugggaacauguguacugggu

SEQ ID NO: 730604 - RNA, 61 nt, Homo Sapiens
cuuucacccuaaacgacacuuccuccccagccagccucacucugucuccggcccgcagcag

SEQ ID NO: 730605 - RNA, 61 nt, Homo Sapiens
ggucacaguggguggcaggucuuaguccuuucagccucagaaaaugauggggaaaggaguc

SEQ ID NO: 730606 - RNA, 61 nt, Homo Sapiens
ggugcaagauuuaaaauuacacggcgacacacagccucaguagccuggcuguggaguuucc

SEQ ID NO: 730607 - RNA, 61 nt, Homo Sapiens
gggaaauccaggguaggaaggguggcccauucagccucaagcuauuuuugugacccacaua

SEQ ID NO: 730608 - RNA, 61 nt, Homo Sapiens
uuuuaugagggccacgggucuguguucgacucagccucagggacgacucugaccucuuggc

SEQ ID NO: 730609 - RNA, 61 nt, Homo Sapiens
ucacuugcccacaccgagggcgaccccgucacagccucaagucacucccaagcccccuccu

SEQ ID NO: 730610 - RNA, 61 nt, Homo Sapiens
gaaucgccuaccugugccugcguguaaaccacagccucagaccagcuauggggagaggaca

SEQ ID NO: 730611 - RNA, 61 nt, Homo Sapiens
ccccucccggcgccugcccacccuccacccacagccucacggguccaggacuuggcguguu

SEQ ID NO: 730612 - RNA, 61 nt, Homo Sapiens
caccuccaccuuccgggcucaagcgauucuccagccucagccuccugaguagcuaggacug

SEQ ID NO: 730613 - RNA, 61 nt, Homo Sapiens
auguugggcaacaacucagccagccugauggcagccucagaggcuuacucuaacccauccc

SEQ ID NO: 730614 - RNA, 61 nt, Homo Sapiens
gccccuguucuucacacugccccccaugccucagccucauacagaugugccaucauggggg

SEQ ID NO: 730615 - RNA, 61 nt, Homo Sapiens
caauguaagcaaugugggaaagccgucagaucagccucaagacuucaaaugcauggaagca

SEQ ID NO: 730616 - RNA, 61 nt, Homo Sapiens
accaggggaggugggguuuggugagagacgccagccucagacuuuuucccacugagggucc

SEQ ID NO: 730617 - RNA, 61 nt, Homo Sapiens
ggcugcuggagaagucuccucccguucggaccagccucagggcugcacguuaccucaggaa

SEQ ID NO: 730618 - RNA, 61 nt, Homo Sapiens
agccgcagccaaacccggcugccucccaccccagccucaaaaccucuuccugacgaccccc

SEQ ID NO: 730619 - RNA, 61 nt, Homo Sapiens
cucccugcuucccuggaagcuucaggaagcucagccucagccuucaggccugagcaagugc

SEQ ID NO: 730620 - RNA, 61 nt, Homo Sapiens
gguggaucaccugaggucaggaguucaagaccagccucaacauggagaaaccccaucucua

SEQ ID NO: 730621 - RNA, 61 nt, Homo Sapiens
uggaaguggugggugcccaggacggugccuccagccucaacagugggcauggacaggguua

SEQ ID NO: 730622 - RNA, 61 nt, Homo Sapiens
ccccuucccaguccauaaaaaccccggaccccagccucauacugggcaacuuauuuggauc

SEQ ID NO: 730623 - RNA, 61 nt, Homo Sapiens
caccaugcgggccucagguggcagagaggcccagccucacaggccuguggccccacacacc

SEQ ID NO: 730624 - RNA, 61 nt, Homo Sapiens
ccuucccuaaucaccucuccugccccuagcucagccucauccccaacuccaugccugucuc

SEQ ID NO: 730625 - RNA, 54 nt, Homo Sapiens
agaagacccaggcaguguaggcgacagccucaugggccacuguggcccgauguc

SEQ ID NO: 730626 - RNA, 61 nt, Homo Sapiens
acaaggcuucucuguccgcccuucacaccuccagccucacguucacuuaggcacaucacac

SEQ ID NO: 730627 - RNA, 61 nt, Homo Sapiens
gaccccacuccaggaccuaggcccagccccucagccucaucuggagccccugaagaccagu

SEQ ID NO: 730628 - RNA, 61 nt, Homo Sapiens
acgaugagcugugagcaccgcgcaccugccacagccucagaggcccgcacaaugaccggag

SEQ ID NO: 730629 - RNA, 61 nt, Homo Sapiens
ugcugggauuacaggcaugaaccauggugcccagccucauuuuugaaauggaauagagaac

SEQ ID NO: 730630 - RNA, 61 nt, Homo Sapiens
cggccauuugcugcccuccccaccccugccccagccucaggacugcaggagccauccgccc

SEQ ID NO: 730631 - RNA, 61 nt, Homo Sapiens
gugaaugugggaaagucuuuagauacaacuccagccucauuaaacaucggagaauucacac

SEQ ID NO: 730632 - RNA, 61 nt, Homo Sapiens
ggcagcagcugccggugguggguggccgcggcagccucagugcagcggcgcccagcucccu

SEQ ID NO: 730633 - RNA, 61 nt, Homo Sapiens
aggaacaaggcccccagaggugugcgagaugcagccucagagccccauucaccuguggauu

SEQ ID NO: 730634 - RNA, 61 nt, Homo Sapiens
uuccugggcucaagcgauccauggcucacugcagccucaaaugaagugcgguggugcaauc

SEQ ID NO: 730635 - RNA, 61 nt, Homo Sapiens
auuucuggcuggauuuccacgacaaucuuuucagccucagcuggcuaccaggaaacucgga

SEQ ID NO: 730636 - RNA, 61 nt, Homo Sapiens
gucaacguauuuccccucucauacaucugaccagccucaacggccacacacagcaagaaag

SEQ ID NO: 730637 - RNA, 61 nt, Homo Sapiens
cucccaaagugcugggauuauugugauccaccagccucagcauggucuugaucuccugacc

SEQ ID NO: 730638 - RNA, 61 nt, Homo Sapiens
uucugggcggacagcuugucugugcccaagucagccucauaccuuugggguauuccccuag

SEQ ID NO: 730639 - RNA, 61 nt, Homo Sapiens
ucgcugccacuucgccgcugcgggucuccuccagccucacucccccagcccucccuccugg

SEQ ID NO: 730640 - RNA, 61 nt, Homo Sapiens
cacugcagggccaggcucucucccgagcccccagccucacccaggcggaugaggucccuac

SEQ ID NO: 730641 - RNA, 61 nt, Homo Sapiens
aguagcuggaauuacaggcauucuccugccucagccucacgugccucccggguucaaguga

SEQ ID NO: 730642 - RNA, 61 nt, Homo Sapiens
ugucaguuucaaaucugcuucagaauuuuuccagccucauucuuacuuccagcuugcacau

SEQ ID NO: 730643 - RNA, 61 nt, Homo Sapiens
cacaccgugugccuuacuccgagggggaugucagccucacccugcuccaggaugaaaccaa

SEQ ID NO: 730644 - RNA, 61 nt, Homo Sapiens
ugguggugucuccguccuuacagcuuuguugcagccucagcccacuccacacacucccugc

SEQ ID NO: 730645 - RNA, 61 nt, Homo Sapiens
cagggcagggagggggacucggucacugcuccagccucagccaaagcuucuguggcuucgu

SEQ ID NO: 730646 - RNA, 61 nt, Homo Sapiens
gcagaauagagguauuuuuaauccucuggcccagccucauggguacuuucucuuccuggua

SEQ ID NO: 730647 - RNA, 61 nt, Homo Sapiens
cuccccaggaccccuguccacauccaggccucagccucaucgaaaccaaaaagagacugau

SEQ ID NO: 730648 - RNA, 61 nt, Homo Sapiens
guggccugaggcccagagggcuccuugggugcagccucagacccucugucccuacugauuc

SEQ ID NO: 730649 - RNA, 61 nt, Homo Sapiens
cccugccuuuccuuuacuuuccgagggggcgcagccucaaaccgcgccgcggaagggggcu

SEQ ID NO: 730650 - RNA, 61 nt, Homo Sapiens
gcagagcaaggguuguuuggaaucaguacgacagccucagaccccggcucagaucuuugca

SEQ ID NO: 730651 - RNA, 61 nt, Homo Sapiens
ggcccucagcacuuuguguuugacugucucucagccucacgaccccccucauuaucuacca

SEQ ID NO: 730652 - RNA, 61 nt, Homo Sapiens
ccuguggugggcuuuuuaagcccucccucaccagccucaccucccuguccccaccuccagu

SEQ ID NO: 730653 - RNA, 61 nt, Homo Sapiens
cuucuggccucaagugauccauaacucacugcagccucaaauggagugcaguggcaugauc

SEQ ID NO: 730654 - RNA, 61 nt, Homo Sapiens
ccugccucugguucccgccugcugugacccccagccucacacuccacagacccagccuccg

SEQ ID NO: 730655 - RNA, 61 nt, Homo Sapiens
uccaggcaggagcacgaggugacccuggacccagccucagaaaacgaucuaaagguaggca

SEQ ID NO: 730656 - RNA, 61 nt, Homo Sapiens
gguguggcuucuguggcuuuugcccaggcagcagccucaugggaggguauucugggccuuc

SEQ ID NO: 730657 - RNA, 61 nt, Homo Sapiens
gguucccgcccuggaccuccucguagggucccagccucaaugggcacgggguaggggguuc

SEQ ID NO: 730658 - RNA, 61 nt, Homo Sapiens
auggggcuguucucuaggaagcuccccuagacagccucagauacugaagugacuuaugguu

SEQ ID NO: 730659 - RNA, 61 nt, Homo Sapiens
accauggacacacgucaucaaaaccaaacugcagccucaacgugugucuguaaaaugugug

SEQ ID NO: 730660 - RNA, 61 nt, Homo Sapiens
caggugggccuguauauaggaagagucccgccagccucagccagggauccaagaaugugcc

SEQ ID NO: 730661 - RNA, 61 nt, Homo Sapiens
gccaaugggcugaaagguucggcugccugggcagccucauuucagauuugaccaggccucu

SEQ ID NO: 730662 - RNA, 61 nt, Homo Sapiens
caaacgcagugcccuguucugccgguguguacagccucagcgcaccaggagacccuagagu

SEQ ID NO: 730663 - RNA, 61 nt, Homo Sapiens
cuccuuguccccucccacccgccucaugacccagccucacagacccucucaggccucugac

SEQ ID NO: 730664 - RNA, 61 nt, Homo Sapiens
guauguuucuuucugccccguugaagaggugcagccucaggcugagaaacacugauagacc

SEQ ID NO: 730665 - RNA, 61 nt, Homo Sapiens
ucacugccccacauucucccaguggcucuaccagccucacccaucaaaccagugaauuucu

SEQ ID NO: 730666 - RNA, 61 nt, Homo Sapiens
cugagucucuaucauagcugaacccugaggacagccucauagcucauguaucagggacuuu

SEQ ID NO: 730667 - RNA, 61 nt, Homo Sapiens
gacugccaggcagaaaggacagggcccaggucagccucagucugcugugccuccagacugc

SEQ ID NO: 730668 - RNA, 61 nt, Homo Sapiens
uuucccuuuguucuugaacacuuuugcccugcagccucaguuuugaauucuuuuagcaacu

SEQ ID NO: 730669 - RNA, 61 nt, Homo Sapiens
ggcuggggccggggcugagggugcccuuuuccagccucagccuacuccgcucacugaacuc

SEQ ID NO: 730670 - RNA, 61 nt, Homo Sapiens
aucaaguugaggggcuuccggcucccuucuacagccucagaaaccagacucguucuucugg

SEQ ID NO: 730671 - RNA, 61 nt, Homo Sapiens
agagaaucguacgucgacuuucgauuuuucacagccucagccuaggaaaaaugguucaugg

SEQ ID NO: 730672 - RNA, 61 nt, Homo Sapiens
caggacaccacaugggagggggcucaggccucagccucaagaucuucagcuguggccucuc

SEQ ID NO: 730673 - RNA, 61 nt, Homo Sapiens
aacgaggaccuggacucagagccagacagggcagccucagacccuucucuggggcuccugg

SEQ ID NO: 730674 - RNA, 61 nt, Homo Sapiens
uugcuucacccgcugcagagcacacgcaacccagccucagcaucacagccgcagcucuguu

SEQ ID NO: 730675 - RNA, 61 nt, Homo Sapiens
cccggcugcugcauuuaggucaaagauaaaccagccucaauaguuccucaucacaaaagaa

SEQ ID NO: 730676 - RNA, 61 nt, Homo Sapiens
ggaaagcacccuugucugggacauccaaugacagccucaggcaauaaucaacauuuaccag

SEQ ID NO: 730677 - RNA, 61 nt, Homo Sapiens
gccugcuuauugccucuuucggggcugaggucagccucacucggucaccucggccgggccc

SEQ ID NO: 730678 - RNA, 53 nt, Homo Sapiens
ucgggcagucccugcaggucaggcagccucaccgaauguucuucuuugaguaa

SEQ ID NO: 730679 - RNA, 61 nt, Homo Sapiens
ucuuaaaugacuaggaauuuucucccauucccagccucauugccuugucuuccaguuccuu

SEQ ID NO: 730680 - RNA, 61 nt, Homo Sapiens
ugagucaccuuccaaguuguucccucauugacagccucaccuugccaccagcaugcgggau

SEQ ID NO: 730681 - RNA, 61 nt, Homo Sapiens
ucuacuguuaggugagggagaaaguuguuuucagccucaugagggguagcccuguccaggu

SEQ ID NO: 730682 - RNA, 61 nt, Homo Sapiens
uccuuugcccuuccuccugcgcuuucccgcccagccucacuaccugggugucugggcucaa

SEQ ID NO: 730683 - RNA, 61 nt, Homo Sapiens
uucccccacagcagcacggggcugaggcucccagccucagugacucuugacaccggucucu

SEQ ID NO: 730684 - RNA, 61 nt, Homo Sapiens
aacugugcagagaccuacaggcagucagcaccagccucagcgccuugagaggacccugcag

SEQ ID NO: 730685 - RNA, 61 nt, Homo Sapiens
ugggcugggaccuaggaagcccaauaucugacagccucaggucucuagccagugcuuaggc

SEQ ID NO: 730686 - RNA, 61 nt, Homo Sapiens
ugugcugggacgacccuuguuuaacgagucacagccucagcuucuagagaacuaaacuggc

SEQ ID NO: 730687 - RNA, 61 nt, Homo Sapiens
uucuuuucuuagaagaagcuuuaaccuugcccagccucaguaaaguaccaggagcuagcuu

SEQ ID NO: 730688 - RNA, 54 nt, Homo Sapiens
uggggcuuggacacaggcugugcacagccucacggguggggaggugggauuuag

SEQ ID NO: 730689 - RNA, 61 nt, Homo Sapiens
ccugcaggcgguauccagagagagcucagcacagccucaccuccguccuggcagggcaggc

SEQ ID NO: 730690 - RNA, 61 nt, Homo Sapiens
uacugauucaaaugcuaaucucuuccagaaacagccucacagacacacccagacaucuggu

SEQ ID NO: 730691 - RNA, 61 nt, Homo Sapiens
acucuagaugacaagagcaccucaaaggcagcagccucaaggagcagccauggccccagac

SEQ ID NO: 730692 - RNA, 61 nt, Homo Sapiens
uggagugcaguggcacaaucacaguucacugcagccucaaccucuccagauucaagugauc

SEQ ID NO: 730693 - RNA, 61 nt, Homo Sapiens
cuuccccuaaaagaggccgugauauuugcagcagccucaaauugcucuuaagggguuuagg

SEQ ID NO: 730694 - RNA, 61 nt, Homo Sapiens
ccccacucugcccguccaccuucccuggcuccagccucauucucucuuuaguuuaacuaug

SEQ ID NO: 730695 - RNA, 61 nt, Homo Sapiens
cccugccaguccuuggaccucccagcccacccagccucagcacagcucaacacagaaggag

SEQ ID NO: 730696 - RNA, 61 nt, Homo Sapiens
cucugauuagauaaucuuuucaacucaaaaccagccucaugucuguuaacugaagauauuc

SEQ ID NO: 730697 - RNA, 61 nt, Homo Sapiens
cucccuggcucaagcgauccacagcucacggcagccucaaccugagugcacuggcaggauc

SEQ ID NO: 730698 - RNA, 61 nt, Homo Sapiens
uuacccguaaaugcacuagcggcuucccucccagccucagucaccuccccauacagagaga

SEQ ID NO: 730699 - RNA, 61 nt, Homo Sapiens
acagcucagcacagaaggagcccagcccacccagccucagccccugccaguccuuggaccu

SEQ ID NO: 730700 - RNA, 61 nt, Homo Sapiens
gccgccuagccaagacugcagggauggcccgcagccucaucggggccaaggacacacgccu

SEQ ID NO: 730701 - RNA, 61 nt, Homo Sapiens
ccaccucucgccccucaucuugguaauuagccagccucagauacuucugugggcccugaag

SEQ ID NO: 730702 - RNA, 61 nt, Homo Sapiens
ccuugcagugaagccaccaugggugaccguccagccucacccgguggccugcacagugagg

SEQ ID NO: 730703 - RNA, 61 nt, Homo Sapiens
aggccucccggaacaaaagcggaagaggggccagccucaucccacugccagcugacccuca

SEQ ID NO: 730704 - RNA, 61 nt, Homo Sapiens
uauuuuuguuggagccacucuguuccuggcucagccucaaaugcaguauuuuuguuguguu

SEQ ID NO: 730705 - RNA, 61 nt, Homo Sapiens
uucaucuccucugugggaggacacaucucugcagccucaagaguuaggcagagacucaagu

SEQ ID NO: 730706 - RNA, 61 nt, Homo Sapiens
acuccaugccacccccaccagcuggaggacccagccucacaguguguccuuugugccagac

SEQ ID NO: 730707 - RNA, 61 nt, Homo Sapiens
uucaaguuaacaggaucagacaccagucaagcagccucaggucaucuugcgacuccacuga

SEQ ID NO: 730708 - RNA, 61 nt, Homo Sapiens
gccucaaaaauucaccaagcagaaugccucucagccucauguguugguccucugcuccucc

SEQ ID NO: 730709 - RNA, 61 nt, Homo Sapiens
gggucugguaccagggguuguacugaggugacagccucacaggggcccgcagaggugcccu

SEQ ID NO: 730710 - RNA, 61 nt, Homo Sapiens
acccaggauaggaaauggguagaggcagucccagccucagagggcagucccucagaauccc

SEQ ID NO: 730711 - RNA, 61 nt, Homo Sapiens
guaugggaaacccuuuccccggaagaucucgcagccucagucccuagccugaggcuccacu

SEQ ID NO: 730712 - RNA, 61 nt, Homo Sapiens
ccaucuggcagagucccaggauguggaacugcagccucagcuuggggcugcugggguugga

SEQ ID NO: 730713 - RNA, 61 nt, Homo Sapiens
ugacccgaucggacagugcccccgcgcgcugcagccucauggccugcagggggcgcugcau

SEQ ID NO: 730714 - RNA, 61 nt, Homo Sapiens
gaggcucaggacacggccacgaccaucugcccagccucacuacgccccauggaggcuccga

SEQ ID NO: 730715 - RNA, 61 nt, Homo Sapiens
uuugcagccccugagaaggccaaccccucaacagccucagcuaggggccccaaguucaacu

SEQ ID NO: 730716 - RNA, 61 nt, Homo Sapiens
acauccgacaccucccagcgucccugacuaacagccucagcucuguuucagcaaaucucag

SEQ ID NO: 730717 - RNA, 61 nt, Homo Sapiens
ggagauggggagguuagagagaggaaaugcucagccucaguugugcccccggccaggcccu

SEQ ID NO: 730718 - RNA, 61 nt, Homo Sapiens
ccugcagaagguuugugacgugcuauccccacagccucauucuguugggcccaguggcccc

SEQ ID NO: 730719 - RNA, 61 nt, Homo Sapiens
uggggcucucagcaccaaagggccuccuccacagccucagcagacaccagaccagguccag

SEQ ID NO: 730720 - RNA, 61 nt, Homo Sapiens
cucuauggcaaggcccugcugaagaugaggccagccucagcaauccuacuccuaugacccc

SEQ ID NO: 730721 - RNA, 61 nt, Homo Sapiens
cugguggacuucgaguacaggaaaaugcugacagccucaugucuugcugcucucagagcca

SEQ ID NO: 730722 - RNA, 61 nt, Homo Sapiens
cagggccugagggagccccuggcuuuccccucagccucaggaaagguggucaggaaaacuc

SEQ ID NO: 730723 - RNA, 61 nt, Homo Sapiens
uggagugcagugacguggucauagcucacugcagccucaaccuccugggcucaagugaccc

SEQ ID NO: 730724 - RNA, 61 nt, Homo Sapiens
ggugaguuggggggcagggguugucuugggccagccucaguuuuugucaggccaugaaucc

SEQ ID NO: 730725 - RNA, 61 nt, Homo Sapiens
ugcugggauuauaggcgugagccacugugcccagccucacagcugcaucuuaaccuuaccu

SEQ ID NO: 730726 - RNA, 61 nt, Homo Sapiens
ucuaccucccagaucggaucuguugcaaacucagccucaauaagccuugucguugacuuua

SEQ ID NO: 730727 - RNA, 61 nt, Homo Sapiens
aagaaaggagggacccggaacuugggccaaucagccucaccuugucccaguccacuccuaa

SEQ ID NO: 730728 - RNA, 61 nt, Homo Sapiens
aaccuccaccucccggauucaagugauucuccagccucagccuccugaguagcugggauua

SEQ ID NO: 730729 - RNA, 61 nt, Homo Sapiens
gaguuguggguccugcccagaguccagagagcagccucagcugagcacagguccgaggggg

SEQ ID NO: 730730 - RNA, 61 nt, Homo Sapiens
agaaguuacagaaacuaaagcaaugacuuaacagccucauuuugucaaccuucuacacagc

SEQ ID NO: 730731 - RNA, 61 nt, Homo Sapiens
ccugccccugugggacucauccuggggaucacagccucacccaugagaucagggccugccc

SEQ ID NO: 730732 - RNA, 61 nt, Homo Sapiens
cacuuaccuggagcugcucuggagagcauuacagccucaucaccuggggacucacguagcu

SEQ ID NO: 730733 - RNA, 61 nt, Homo Sapiens
cuucacuccugauugaggccaggcagcuccccagccucacuaggacccuggaaggacagca

SEQ ID NO: 730734 - RNA, 61 nt, Homo Sapiens
gcuagccacaaagcccccaggaagugcccuccagccucagaugaaggauuuagacggggau

SEQ ID NO: 730735 - RNA, 61 nt, Homo Sapiens
gugcaccgacuaguugcuugaguucuggccucagccucaaacuuuguagugcuuucggccc

SEQ ID NO: 730736 - RNA, 61 nt, Homo Sapiens
cccaggcacugauuguggcaggccacaagcucagccucagggagccaggucaggcuucgga

SEQ ID NO: 730737 - RNA, 61 nt, Homo Sapiens
gccacuugacauuccuugucgccuugcccgccagccucagucgugagagaaucugccugug

SEQ ID NO: 730738 - RNA, 61 nt, Homo Sapiens
ucuuaccaauuuccccaacuauguugcacaucagccucauuuucccccuuuauuggaaugc

SEQ ID NO: 730739 - RNA, 62 nt, Homo Sapiens
agguggcagcguggagggcucggcguggauggcagccucaggacacacaccccugccucaag

SEQ ID NO: 730740 - RNA, 62 nt, Homo Sapiens
gaggaagccucggccucccugagcucugaccccagccucacccgaaaggccagccuggggcu

SEQ ID NO: 730741 - RNA, 62 nt, Homo Sapiens
cugaggucccgggcuuagugugagcaucuugccagccucaggcuugagggagggcugggcua

SEQ ID NO: 730742 - RNA, 62 nt, Homo Sapiens
agacaaagguaaaucagccagccaggcacccacagccucagcuccugugcaguuccugggca

SEQ ID NO: 730743 - RNA, 62 nt, Homo Sapiens
gaggguccccucugggagaaacagcuucaccccagccucagggcccugggccaucacugcag

SEQ ID NO: 730744 - RNA, 62 nt, Homo Sapiens
gcacuacggccauucuccucuugggcgcuccucagccucacugugaccuuucugccagagcu

SEQ ID NO: 730745 - RNA, 62 nt, Homo Sapiens
guuuggaccuaacaucucgcacgugacucccucagccucagagccuugggaugcagagcagc

SEQ ID NO: 730746 - RNA, 52 nt, Homo Sapiens; identical to SEQ ID NO: 730028

SEQ ID NO: 730747 - RNA, 62 nt, Homo Sapiens
uggaagcccucuuuccccaaauccuacucccucagccucaggcaguggugcucccaucuucc

SEQ ID NO: 730748 - RNA, 62 nt, Homo Sapiens
gaaaaagaacucaaccaauuuggcaccccaugcagccucaaaauguuucaaaugccuaccgc

SEQ ID NO: 730749 - RNA, 62 nt, Homo Sapiens
cccaagcuucaaggaagugcuugggggacccccagccucauccucuuaguugggucucuugu

SEQ ID NO: 730750 - RNA, 62 nt, Homo Sapiens
cucuugacccugcauauccaggaaggaacugccagccucagaggaggcagcaccgagggugc

SEQ ID NO: 730751 - RNA, 62 nt, Homo Sapiens
cugcucagcagccagucucagagaccagcacucagccucauucagcauggguccuugaugcc

SEQ ID NO: 730752 - RNA, 62 nt, Homo Sapiens
gccccagcuggagcuggcugagagcaguccugcagccucauuccuuaguucccggagcuggc

SEQ ID NO: 730753 - RNA, 62 nt, Homo Sapiens
gucucuguuccccagcccaccuggcucacacacagccucauggguagggucagcaaaccaga

SEQ ID NO: 730754 - RNA, 62 nt, Homo Sapiens
cgaggcugcccccucacccagaagucugagcccagccucaggaggggccaagaaccaggggg

SEQ ID NO: 730755 - RNA, 62 nt, Homo Sapiens
aauuucaggcuggaaaacuaucaguaugaucucagccucaguucucuugucuguaaaaugga

SEQ ID NO: 730756 - RNA, 62 nt, Homo Sapiens
ugacuacuuaccacaucaaaucugggcccaaacagccucaguuaacugcauaauucaggaac

SEQ ID NO: 730757 - RNA, 62 nt, Homo Sapiens
ugaugucucuacuugcucuaugagccuuuugccagccucagaauaggcgagguaaccuugaa

SEQ ID NO: 730758 - RNA, 62 nt, Homo Sapiens
cggaucucuguggggcucuucaccaauuuuuccagccucauuuauaguaaacaaauuguucu

SEQ ID NO: 730759 - RNA, 62 nt, Homo Sapiens
ugagauggaaucuuagaucgucccccaugugccagccucauucgaauucuacucuuugguua

SEQ ID NO: 730760 - RNA, 52 nt, Homo Sapiens; identical to SEQ ID NO: 730042

SEQ ID NO: 730761 - RNA, 59 nt, Homo Sapiens; identical to SEQ ID NO: 730043

SEQ ID NO: 730762 - RNA, 62 nt, Homo Sapiens
gucuguauuucugugugguuguagcaaggacucagccucauguagcacgaauaggggugugg

SEQ ID NO: 730763 - RNA, 62 nt, Homo Sapiens
uccgccucccgguucaagccauucuucugccucagccucagcgaguagcugagacuaccggc

SEQ ID NO: 730764 - RNA, 62 nt, Homo Sapiens
ccugugccagaagcaacagaggugccaggccucagccucacccacagcagccccaucgccaa

SEQ ID NO: 730765 - RNA, 62 nt, Homo Sapiens
aaccaaagaaaugaagcuggcaagcuacuuuucagccucaagcuuuacacagcuguccuuac

SEQ ID NO: 730766 - RNA, 62 nt, Homo Sapiens
cacucccaccacaggcauaagcuaucaccuagcagccucaaaacgggucaguauuaagguuu

SEQ ID NO: 730767 - RNA, 62 nt, Homo Sapiens
cuguagcuccuccugacaaacgucugggaaaacagccucaccccacucuccucucucuuccc

SEQ ID NO: 730768 - RNA, 62 nt, Homo Sapiens
cuaaaccagaaggaagcccucucagaucaccccagccucacuccauuucccacuuccacccc

SEQ ID NO: 730769 - RNA, 62 nt, Homo Sapiens
ggacuuugucccuucuaauuauuaucucuuuccagccucauucagcuauucuuacugacaua

SEQ ID NO: 730770 - RNA, 62 nt, Homo Sapiens
uuuucuaaauauaauaaaaacuuaccuggcaucagccucauaccuaaaacuccugacucuua

SEQ ID NO: 730771 - RNA, 62 nt, Homo Sapiens
acacacacuggcacagggaggcuacaacuaagcagccucagaucuguaaaguugauuggugc

SEQ ID NO: 730772 - RNA, 62 nt, Homo Sapiens
ccuggcgaugagccauuuauugugucucacaccagccucauuuccaacuccgacuuccuacu

SEQ ID NO: 730773 - RNA, 62 nt, Homo Sapiens
aacuuuauccugcuauaacuuuauccucuucccagccucaucccuguuuuucuguuagggca

SEQ ID NO: 730774 - RNA, 62 nt, Homo Sapiens
ugucugcaaacaggucccugccuuuuuagaagcagccucauggucucaugcuuaaucuuguc

SEQ ID NO: 730775 - RNA, 62 nt, Homo Sapiens
cucgaggcagggaaaagccaucuauucuucugcagccucaggagcgagacuucaaggacuca

SEQ ID NO: 730776 - RNA, 62 nt, Homo Sapiens
aagagccccuucugcaucuuauucacagcuugcagccucagccccuuugaugaggcccucag

SEQ ID NO: 730777 - RNA, 62 nt, Homo Sapiens
uccuuguugcucuaacaguccagauguacacccagccucagggggaaggcagcucucuccag

SEQ ID NO: 730778 - RNA, 62 nt, Homo Sapiens
gcucccuugugauuucugagggucaccacugccagccucaggcaacauagagagccuccugu

SEQ ID NO: 730779 - RNA, 62 nt, Homo Sapiens
gccagagaggggcagguagaccugcauagcagcagccucagcagcugucuugguaaaggaga

SEQ ID NO: 730780 - RNA, 62 nt, Homo Sapiens
uggccugucuguccuccucccuaauucagacccagccucaagaggaaagggaguaaaauaaa

SEQ ID NO: 730781 - RNA, 62 nt, Homo Sapiens
gcaggagucccacuccuccacaaaacuggggucagccucaggccaucagaaccuggcagccc

SEQ ID NO: 730782 - RNA, 62 nt, Homo Sapiens
auuugacuaccuauguacuagguagacacccucagccucauccucuguggcguuguguuauu

SEQ ID NO: 730783 - RNA, 62 nt, Homo Sapiens
agugugcauagaccauuucccucaagucuaaccagccucagcgaguuuauugucaauugcuu

SEQ ID NO: 730784 - RNA, 62 nt, Homo Sapiens
acucacaagcugugugacuugggcucaaauuccagccucaccgccuuggguucagcccaucu

SEQ ID NO: 730785 - RNA, 62 nt, Homo Sapiens
gugcccugauucacacacugcuuucaccagagcagccucacuggggcuauaggagccuccca

SEQ ID NO: 730786 - RNA, 62 nt, Homo Sapiens
gaugcuggccucuuggcacccaagagucucuccagccucacaaaguaacucccacuccuaau

SEQ ID NO: 730787 - RNA, 62 nt, Homo Sapiens
accacccugcuguccaguccagugccucccugcagccucaacucuaugccuaguggagccac

SEQ ID NO: 730788 - RNA, 62 nt, Homo Sapiens
gcagaggcaaggucagaaagagccaagaauggcagccucagcucagccucaggauggggaau

SEQ ID NO: 730789 - RNA, 62 nt, Homo Sapiens
auggggaauagccaagaaugcuggacuccacucagccucaggcagccacuuagugcuuuguc

SEQ ID NO: 730790 - RNA, 50 nt, Homo Sapiens; identical to SEQ ID NO: 730072

SEQ ID NO: 730791 - RNA, 62 nt, Homo Sapiens
acccugaauguggggcucuggugagccagaagcagccucauacugucuaccaacuccucaua

SEQ ID NO: 730792 - RNA, 62 nt, Homo Sapiens
ucuaggguaugggaaauccaaggaccaggauccagccucacuuggaaucuuuagcgcucaau

SEQ ID NO: 730793 - RNA, 62 nt, Homo Sapiens
ugaaaacccgaaucugagaauuaagaacugcccagccucagcguuguuuaugcaacucuauc

SEQ ID NO: 730794 - RNA, 62 nt, Homo Sapiens
cugggacaccuagguggagaugaaucuugucccagccucagcuggagaaggcauuccagggu

SEQ ID NO: 730795 - RNA, 62 nt, Homo Sapiens
caagcagaaacacuccuguguuauggagggagcagccucacauugccgucagccgaacuuug

SEQ ID NO: 730796 - RNA, 62 nt, Homo Sapiens
ucuccuucgagcuuuguaaacagcacaaacgacagccucaagcccuguggcuagaggaacac

SEQ ID NO: 730797 - RNA, 62 nt, Homo Sapiens
uuuacaaaugccuugguauggaacuuuaccagcagccucagcgccuuaaaaagggcuucuug

SEQ ID NO: 730798 - RNA, 62 nt, Homo Sapiens
uuucacacuucagcccuuaauaucugcacuugcagccucagcaucuuuuuuuuuuuuuuuug

SEQ ID NO: 730799 - RNA, 62 nt, Homo Sapiens
uuugaccugucucauuucccgaacaccaucuccagccucagcgccagaggguggggcuggca

SEQ ID NO: 730800 - RNA, 62 nt, Homo Sapiens
uagcauuacccuucugacaccuggcccaccuccagccucagcuuuccauggcccuggauggu

SEQ ID NO: 730801 - RNA, 62 nt, Homo Sapiens
agaagaagcagccaugcccauaucacuccaagcagccucagccuggccaagauuuccuucug

SEQ ID NO: 730802 - RNA, 62 nt, Homo Sapiens
aacgcccucaagaacaugauccccagcagaaccagccucaaacuccggccugcugucaaguc

SEQ ID NO: 730803 - RNA, 62 nt, Homo Sapiens
ccaccuuccuuccaucaaaaucugcuaugcaccagccucacuugcaaccacacagggauauu

SEQ ID NO: 730804 - RNA, 62 nt, Homo Sapiens
ggucagccucgccucccagcacaugguauugccagccucacucuucccaggugggcccacuc

SEQ ID NO: 730805 - RNA, 62 nt, Homo Sapiens
acucagugaguucaucagggggacauuguagccagccucagcguauuacuuccccucugaua

SEQ ID NO: 730806 - RNA, 62 nt, Homo Sapiens
uccccaggugaggggcggguagguagucaaggcagccucaucaagcugucucaucaccaaau

SEQ ID NO: 730807 - RNA, 62 nt, Homo Sapiens
cccugcuggaauuggggcugacacaucauucccagccucaggaccauaaccaccccugggaa

SEQ ID NO: 730808 - RNA, 62 nt, Homo Sapiens
ggagaugcuugguguggggaguggagcacaugcagccucaguaucccuaggaggacccacca

SEQ ID NO: 730809 - RNA, 62 nt, Homo Sapiens
acugaaggagauuguugaccuaacccccagaccagccucagacuuaacccccaaguaaucau

SEQ ID NO: 730810 - RNA, 62 nt, Homo Sapiens
gaugcccugguggccucuccucuuccgauuagcagccucagguguugacugugagcaaagug

SEQ ID NO: 730811 - RNA, 62 nt, Homo Sapiens
ccucagucuucagauagacaguaagaagaaagcagccucauugauccgcagauguaggggcc

SEQ ID NO: 730812 - RNA, 62 nt, Homo Sapiens
uguguaguccauagcccagccagaugagcuugcagccucauaggaggucagcaccuugcaaa

SEQ ID NO: 730813 - RNA, 62 nt, Homo Sapiens
guccuuuaaccagcacagccaguuaaaagaugcagccucacugcuucaacgcagauuuuaau

SEQ ID NO: 730814 - RNA, 62 nt, Homo Sapiens
caaccucugccuccuggguucaagugauucuccagccucagccucccgaguagcugggauua

SEQ ID NO: 730815 - RNA, 62 nt, Homo Sapiens
uugcaacucuguguaccaagaaccccuagcaucagccucauuccuaagccaauaacgccugu

SEQ ID NO: 730816 - RNA, 62 nt, Homo Sapiens
caucuucuggugcccacggccauuggcauugccagccucauuccaugccacuaugagucaac

SEQ ID NO: 730817 - RNA, 62 nt, Homo Sapiens
gcaaaccuguuaguuuuacuucugcauugaaccagccucagaagcuacuuacugcuuuaugu

SEQ ID NO: 730818 - RNA, 62 nt, Homo Sapiens
gugcugggauugcaggcaugagccaccgugcccagccucaaaaauauuuuuuaaaagaaaag

SEQ ID NO: 730819 - RNA, 62 nt, Homo Sapiens
ccaugacccccaagcagauauaacaagcugugcagccucaguaggcugcuugcccucuccag

SEQ ID NO: 730820 - RNA, 62 nt, Homo Sapiens
guuuuuuguguggaacagcucaccuugucagacagccucagggcaucucugagacacagggg

SEQ ID NO: 730821 - RNA, 62 nt, Homo Sapiens
ccaaccccaucucccacucagaaaucaccucccagccucaggaagaguagaaauuggguggu

SEQ ID NO: 730822 - RNA, 62 nt, Homo Sapiens
accccucaggagggauugcaggccccagguggcagccucagagaggaggcgcaggcaggccc

SEQ ID NO: 730823 - RNA, 62 nt, Homo Sapiens
cuuuugcuuuucagugucuucucagaaacaaccagccucaaagguaauuaaacucucauuua

SEQ ID NO: 730824 - RNA, 62 nt, Homo Sapiens
uggcagggccgccuucagaggcugcagggccucagccucaggaugcauuuaauguauccugg

SEQ ID NO: 730825 - RNA, 62 nt, Homo Sapiens
ggauccuuugagguaaaaaaacauaaugucuucagccucauaauaaaggaaaguuaauuaaa

SEQ ID NO: 730826 - RNA, 62 nt, Homo Sapiens
gccagccuucuuccaucccaggacaccacacccagccucaguccuccccucacagccucuga

SEQ ID NO: 730827 - RNA, 62 nt, Homo Sapiens
ugccguuggaccuucaccuccuagagauaaaccagccucagcuggcgcagcggggcccuucu

SEQ ID NO: 730828 - RNA, 62 nt, Homo Sapiens
gugagggucaccggcaggugggcugguggcugcagccucagagcccucccagguugcugcug

SEQ ID NO: 730829 - RNA, 62 nt, Homo Sapiens
cgcacagcccugcaccccgccccugggguuggcagccucaguuggccccuggcagaggaaca

SEQ ID NO: 730830 - RNA, 62 nt, Homo Sapiens
guuucuucaugguggggggccauuuggaaugacagccucacuuccuucugauggcuacaucu

SEQ ID NO: 730831 - RNA, 62 nt, Homo Sapiens
auuuauaguugaauuuuugcuuguaugaaaaucagccucauuaagguuuauuucugugaguu

SEQ ID NO: 730832 - RNA, 62 nt, Homo Sapiens
cccagccccagccccaguggugccaguuuccccagccucagcccucucucccuccuaccacc

SEQ ID NO: 730833 - RNA, 62 nt, Homo Sapiens
ucuuuguucuaaagauggaaagccaccgcgcccagccucaucgugcugggauuacagggaug

SEQ ID NO: 730834 - RNA, 62 nt, Homo Sapiens
cgacaauucacggaacuguugcaggaaauggccagccucaaauucuugucuggaagaguucu

SEQ ID NO: 730835 - RNA, 62 nt, Homo Sapiens
gcagcccccuccugaccccaagggggaagcaccagccucaguucaucugaaaggcccaaacc

SEQ ID NO: 730836 - RNA, 62 nt, Homo Sapiens
ggccccuugcugcuggcucccucucacucuggcagccucagagggccauacccaugugucgc

SEQ ID NO: 730837 - RNA, 62 nt, Homo Sapiens
cccauuccccugagagcaagaaccagccucuucagccucacauuugucugugaguuacgggc

SEQ ID NO: 730838 - RNA, 62 nt, Homo Sapiens
uaaagguguaccuuccaugucccuuucuguaacagccucaaaguuugaguucuggguauccu

SEQ ID NO: 730839 - RNA, 62 nt, Homo Sapiens
aacauggccuuuucucucucgcuuugagugugcagccucacagaaauccgcaagcugggugu

SEQ ID NO: 730840 - RNA, 62 nt, Homo Sapiens
gaauuaccccucccaaaaugacacaaggaaagcagccucaaaguugcuaaauagauuauaau

SEQ ID NO: 730841 - RNA, 62 nt, Homo Sapiens
ugcaggcauuuuugaguggcuuuuuaaaugcucagccucaaguuguuacauaugaacauuca

SEQ ID NO: 730842 - RNA, 62 nt, Homo Sapiens
ugaauugcuuucauagcuuuugccucaugaagcagccucauuauaaugccauaagucuagau

SEQ ID NO: 730843 - RNA, 62 nt, Homo Sapiens
caacaacaauguguuguaaaaucuuuguguugcagccucaacgauggaacaagagaaguacu

SEQ ID NO: 730844 - RNA, 62 nt, Homo Sapiens
aaaagugguugugauugcaauuagggaacgcacagccucacaagacugaaaauucauugcaa

SEQ ID NO: 730845 - RNA, 62 nt, Homo Sapiens
uguaagcagcacugccucucaugccauugucacagccucauuacuggcacugucauuuguaa

SEQ ID NO: 730846 - RNA, 62 nt, Homo Sapiens
gggaacacgggacagacgccgccugggcguggcagccucacagucucgagacgcacaugcac

SEQ ID NO: 730847 - RNA, 62 nt, Homo Sapiens
cauguggggaccacggaaggcugguccuaugccagccucaccguguuuacugugcugcugca

SEQ ID NO: 730848 - RNA, 62 nt, Homo Sapiens
uaguaaaaaagguaggaaaucccuaaaacuuccagccucacauagcacgguucucaccuguc

SEQ ID NO: 730849 - RNA, 62 nt, Homo Sapiens
aaagaugguggaagacauaggcuaaauuucuccagccucacaauggucuucacuuggucuga

SEQ ID NO: 730850 - RNA, 62 nt, Homo Sapiens
uagaagauuccuggauggagaccccauugguucagccucaagucuggcccgucuucgaaaaa

SEQ ID NO: 730851 - RNA, 62 nt, Homo Sapiens
cccuggccagaagcaggagugugaggaggagacagccucagcggacaagcagcuggugcucc

SEQ ID NO: 730852 - RNA, 62 nt, Homo Sapiens
ugaauucuagcaaccuuuguuaggaaaaagcacagccucagauggaggcagccuaaacugug

SEQ ID NO: 730853 - RNA, 62 nt, Homo Sapiens
uuucagcuguuucaccaucagucaaugaauaacagccucauugaugucaaaaacuucaauau

SEQ ID NO: 730854 - RNA, 62 nt, Homo Sapiens
ccauguuggccaggcuggucuugaacuccuggcagccucaagugauccacccaccucggucu

SEQ ID NO: 730855 - RNA, 62 nt, Homo Sapiens
ugccagagggguuggccaguuggagccugggucagccucagcagccuauccccauguccucu

SEQ ID NO: 730856 - RNA, 62 nt, Homo Sapiens
cauuuagugcacaguggccccaucauagccugcagccucaucauuucccaucuggaccuggu

SEQ ID NO: 730857 - RNA, 62 nt, Homo Sapiens
cucaaagcuaauuuuuuacuaaaguuuuuauacagccucaaauuguuuuauuaaaaaaaaga

SEQ ID NO: 730858 - RNA, 62 nt, Homo Sapiens
guccacgcagguggcuuguagaaaccuuugggcagccucaugucugcuaaaacagccaucuu

SEQ ID NO: 730859 - RNA, 62 nt, Homo Sapiens
ggaaagguaauuuuaagcuaacaaccagugcacagccucagguuuuaaauuacaaccacagu

SEQ ID NO: 730860 - RNA, 62 nt, Homo Sapiens
ugacccagcccuauuuuacgucauucuaaauucagccucauauaaugaaaauacauuaugaa

SEQ ID NO: 730861 - RNA, 62 nt, Homo Sapiens
cuggagugcaguggcacaaugacgacucacugcagccucaaccuccuggggccaagugaucc

SEQ ID NO: 730862 - RNA, 62 nt, Homo Sapiens
augggaccuuuguaggaagagacacaguccugcagccucauauggcucaauaaaacagaaag

SEQ ID NO: 730863 - RNA, 62 nt, Homo Sapiens
cagcgcuuucagcuggaccacucaggccuggacagccucaucuccaugaggcuggugcuucg

SEQ ID NO: 730864 - RNA, 62 nt, Homo Sapiens
uuggccucuucuugcuuugaccuggcagauaucagccucaacauugaguaugcaccucucug

SEQ ID NO: 730865 - RNA, 62 nt, Homo Sapiens
aucccaguccagacgggugcugccggcucagccagccucacgcugcuaggaaauggcucccu

SEQ ID NO: 730866 - RNA, 62 nt, Homo Sapiens
aaaccuccuacccaugucugagguagcaagugcagccucacgacagauaccaggcaauccag

SEQ ID NO: 730867 - RNA, 62 nt, Homo Sapiens
aaguagggaacauggcagagaguggugcuucccagccucacaaugugggaauuugacauagg

SEQ ID NO: 730868 - RNA, 62 nt, Homo Sapiens
aaaggauucuuucaacuucuccauggagaauccagccucacauaggccauucuccuucucuu

SEQ ID NO: 730869 - RNA, 62 nt, Homo Sapiens
caggcacguaccugcugaccuggcugacaggccagccucacucagagauggaggagccccag

SEQ ID NO: 730870 - RNA, 62 nt, Homo Sapiens
uucccacaggcucauacucacauggguaguaccagccucaaagacauacaaggacagugggu

SEQ ID NO: 730871 - RNA, 62 nt, Homo Sapiens
cuuguauuuaguuuggggaacaugcacaaccacagccucaauuacaugcaugcacaugaaaa

SEQ ID NO: 730872 - RNA, 62 nt, Homo Sapiens
ucuugagaggauaagacucuuggccgggugggcagccucaggaugacagcccagugucggcc

SEQ ID NO: 730873 - RNA, 62 nt, Homo Sapiens
ccuugcagccaguaagaaauguugcaccagggcagccucagcccgcagcagugacuacaaua

SEQ ID NO: 730874 - RNA, 62 nt, Homo Sapiens
gaauaugcaacaacuccugugcuucccgacaccagccucaugccuggcaacugugagucccu

SEQ ID NO: 730875 - RNA, 62 nt, Homo Sapiens
ccaagcuucuaccugccuuuaggcaucucaggcagccucagcucuguggaccagagugcuug

SEQ ID NO: 730876 - RNA, 62 nt, Homo Sapiens
gacaaauaggcuucaucaugaaggcagagccccagccucagaacuggagcagaauaagucua

SEQ ID NO: 730877 - RNA, 62 nt, Homo Sapiens
caaccaugagggauaguaugcucaucagcaggcagccucaugucauuuaaguuggcuugaau

SEQ ID NO: 730878 - RNA, 62 nt, Homo Sapiens
ggguccuucuggaaccagcuuacccggaagaccagccucagaaacccucccacagcacaucc

SEQ ID NO: 730879 - RNA, 62 nt, Homo Sapiens
gaucuuugcaacacuccaacagaauguggaugcagccucacaaucacuguauacucuugcug

SEQ ID NO: 730880 - RNA, 62 nt, Homo Sapiens
cagggaccaaccggcugcuuuaaugucuuccucagccucaaccaaguauuuccagcaggaag

SEQ ID NO: 730881 - RNA, 62 nt, Homo Sapiens
caugucuuaacaaaaugacauuaucuggagcucagccucaauuguaccguaaagaauauauc

SEQ ID NO: 730882 - RNA, 62 nt, Homo Sapiens
uuacagacagcccccugaggagggugccaccacagccucauugcccuuauggugcccugugc

SEQ ID NO: 730883 - RNA, 62 nt, Homo Sapiens
accuuucugcuggggcugaaagugccuuccuccagccucacaggacuggaugugccgugggc

SEQ ID NO: 730884 - RNA, 62 nt, Homo Sapiens
ccuucacaagauggaaggcacugcagguagagcagccucauugcccuccuggcuucagcauc

SEQ ID NO: 730885 - RNA, 62 nt, Homo Sapiens
uucucacuugcugugggugauuggagaagacacagccucaccgacuauuaaggguguuaguc

SEQ ID NO: 730886 - RNA, 60 nt, Homo Sapiens; identical to SEQ ID NO: 730168

SEQ ID NO: 730887 - RNA, 62 nt, Homo Sapiens
agaucaacggaccaaauaaagauuuaagaacucagccucacuuuuuuaacuugggggugaaa

SEQ ID NO: 730888 - RNA, 62 nt, Homo Sapiens
cuccuggguuuaagcagucccacaguucauugcagccucaacgaguacaggucugguacaau

SEQ ID NO: 730889 - RNA, 62 nt, Homo Sapiens
uuacacuugguuacucaaaaaaacacacaaaccagccucaacacacaaaaggaacaaaagcg

SEQ ID NO: 730890 - RNA, 62 nt, Homo Sapiens
ugaaugugucacuacucacauaccuagauuuacagccucacuuucagguucuuagugucacu

SEQ ID NO: 730891 - RNA, 62 nt, Homo Sapiens
ugauccucgcaucucagccugucucaaacccccagccucaacucaccauguugcccaggcug

SEQ ID NO: 730892 - RNA, 62 nt, Homo Sapiens
ccaccugcuggguucaagcaauucuccugccucagccucaugaguagcugugacuacaggca

SEQ ID NO: 730893 - RNA, 62 nt, Homo Sapiens
gcagaagcugcauuucagcugaaucuguguuucagccucaguugguugcaccguuagccccu

SEQ ID NO: 730894 - RNA, 62 nt, Homo Sapiens
gucacagaagcgaaggcuugaugcugucucagcagccucagcugugggggggaagcgcgugu

SEQ ID NO: 730895 - RNA, 62 nt, Homo Sapiens
agccgugagccaaguaaaccucuuuaauuacccagccucaggugcuccgggaacgccuuccg

SEQ ID NO: 730896 - RNA, 62 nt, Homo Sapiens
ucgaagauguuguacuccaccgccugcaccaacagccucaguguuacuucccaggauuugcu

SEQ ID NO: 730897 - RNA, 62 nt, Homo Sapiens
uuuuguaauauuuguccacuaagcuggagaagcagccucauacaguugauuuuguguaugug

SEQ ID NO: 730898 - RNA, 62 nt, Homo Sapiens
agcuugggcaauucagggcagaacuccuguaucagccucauggacacccagaauugguaucu

SEQ ID NO: 730899 - RNA, 62 nt, Homo Sapiens
gacagcccaaccucuggcagaccagggguuaccagccucacagcugcagcugccuucaagcc

SEQ ID NO: 730900 - RNA, 62 nt, Homo Sapiens
uccccgcccugggcagcaggugccagucccuccagccucacccugccccagcagacacaggc

SEQ ID NO: 730901 - RNA, 62 nt, Homo Sapiens
caagucauccccgacaugacgccccugccacccagccucaugcuagguaugugcaguucccg

SEQ ID NO: 730902 - RNA, 62 nt, Homo Sapiens
gacugcacacccccuugccugcagcaccacuccagccucagaagaacgggaccuaggggaca

SEQ ID NO: 730903 - RNA, 62 nt, Homo Sapiens
gagcuaauaaagggaaacgaugcaguacacaucagccucacuccugugauuuuuuuuaaaug

SEQ ID NO: 730904 - RNA, 62 nt, Homo Sapiens
cccucuguguguguugaccaaacucggauucccagccucacuauuggcagucgaggagucag

SEQ ID NO: 730905 - RNA, 62 nt, Homo Sapiens
aucauguuaaagagggaguuagaaacugggggcagccucaaauaauauucuuuuuuuuuucu

SEQ ID NO: 730906 - RNA, 62 nt, Homo Sapiens
agcagacucugaagccggagagcccucccgcucagccucagaggugaccggagagaaagagg

SEQ ID NO: 730907 - RNA, 62 nt, Homo Sapiens
ucugccucccggguucaagcaauuucuugccucagccucaugaauagcugggauuacaggug

SEQ ID NO: 730908 - RNA, 62 nt, Homo Sapiens
gaaucaaaaguauuuuauaaaaggagaaagaacagccucauuuuagauguaguccuguugga

SEQ ID NO: 730909 - RNA, 62 nt, Homo Sapiens
caaccuccgccucccggguucaagcgauucuccagccucagcuuccugaguagaugggauua

SEQ ID NO: 730910 - RNA, 62 nt, Homo Sapiens
ucugccucccggguucaagcaauucccugccucagccucaugaauagcugggauuacaggug

SEQ ID NO: 730911 - RNA, 62 nt, Homo Sapiens
ucucccugucuccaacuccaguaagcccuccucagccucaccuuacgaauccaaagaacugg

SEQ ID NO: 730912 - RNA, 62 nt, Homo Sapiens
cuagaguacaauauugcaaucacagcucacugcagccucaaacuccugggcucaagugaucc

SEQ ID NO: 730913 - RNA, 62 nt, Homo Sapiens
cuagcggguuggggguggugguggggugcuggcagccucaggagcgaucgcuccccuggaga

SEQ ID NO: 730914 - RNA, 62 nt, Homo Sapiens
uguggggcucauaaaacaugaaucaagcaauccagccucaugggaaguccuggcacaguuuu

SEQ ID NO: 730915 - RNA, 62 nt, Homo Sapiens
cuggagugcgcuggcuugaucuuggcucacugcagccucaauguccccaggcucagauuguc

SEQ ID NO: 730916 - RNA, 62 nt, Homo Sapiens
gaacguggucaacucacaccugccucuuccugcagccucacuucuaccugcccccaucauaa

SEQ ID NO: 730917 - RNA, 62 nt, Homo Sapiens
ucccauguacagacacgguccccacacccucccagccucaggcccaggcagacaugggcgag

SEQ ID NO: 730918 - RNA, 62 nt, Homo Sapiens
aaauggggcugugugcaugcaggcccauguuucagccucagcccacgccaggugaaaggauc

SEQ ID NO: 730919 - RNA, 62 nt, Homo Sapiens
uuuugagugugccaggguaaaggcuuccaguucagccucaguuauuuuagacaaucucgcca

SEQ ID NO: 730920 - RNA, 62 nt, Homo Sapiens
cucccuugaguucaggugcccugaacucaguacagccucaucuucucauccaccaccuucuc

SEQ ID NO: 730921 - RNA, 62 nt, Homo Sapiens
cacggccuccugaacguccguccucaggagcacagccucacggacagugccaaacccugugg

SEQ ID NO: 730922 - RNA, 62 nt, Homo Sapiens
aagacauugucucugucggccaggcuggagugcagccucaaccuccuggguccaagugaucc

SEQ ID NO: 730923 - RNA, 62 nt, Homo Sapiens
cuugaaagacgguguuuggugggagcauggcacagccucacaccagcgccccuccucccuga

SEQ ID NO: 730924 - RNA, 62 nt, Homo Sapiens
uuccucuacccaucuucuuuuggccuggacaacagccucagccccgugccaggacucagcag

SEQ ID NO: 730925 - RNA, 62 nt, Homo Sapiens
acaauuuuggacaaagcuagaagguaauugaccagccucaacaaucuuacucccagcaccaa

SEQ ID NO: 730926 - RNA, 62 nt, Homo Sapiens
gguauggcacucuuaauuaagacauacuuuuccagccucaugcaguuuuuagcccuugagag

SEQ ID NO: 730927 - RNA, 62 nt, Homo Sapiens
ggagcucuacccugcucccugcgaugcucccucagccucagaggaaagugggguccuucggg

SEQ ID NO: 730928 - RNA, 62 nt, Homo Sapiens
cagguacgcuguacauuuuuguccugacacugcagccucaaggggccaaggaacacccccua

SEQ ID NO: 730929 - RNA, 62 nt, Homo Sapiens
gugacuccacaguggccccuuauggccggucacagccucagugccacgggcucuccugggcu

SEQ ID NO: 730930 - RNA, 62 nt, Homo Sapiens
ccucccacccccauacuggugccuucacuccacagccucaccuagucucugcccuauacgcc

SEQ ID NO: 730931 - RNA, 62 nt, Homo Sapiens
ucccucauugguuaaaagggugagcucuucuucagccucaguuguaauuaccgagcaagguc

SEQ ID NO: 730932 - RNA, 62 nt, Homo Sapiens
ugcuguccgccugaucugucgcccccucuccccagccucagccauggguguccacagcacug

SEQ ID NO: 730933 - RNA, 62 nt, Homo Sapiens
uuauggaaaagggaugccacuauucauauuaucagccucauugaaccaaaauuagauucaac

SEQ ID NO: 730934 - RNA, 62 nt, Homo Sapiens
uacaccccaggagcccuggcaagccccagccccagccucauccagccaggugcccaggacag

SEQ ID NO: 730935 - RNA, 62 nt, Homo Sapiens
cccuugucuacuuguucucccauuccccuggccagccucagcucagcccaugcccuggaggg

SEQ ID NO: 730936 - RNA, 50 nt, Homo Sapiens; identical to SEQ ID NO: 110858

SEQ ID NO: 730937 - RNA, 62 nt, Homo Sapiens
uuucaggccaaaaccagggaagauucuagcuucagccucauguccauuuccagucugucagc

SEQ ID NO: 730938 - RNA, 62 nt, Homo Sapiens
uuaugccuucaucagcgugaccccugugccugcagccucauagguguuaaucuguaauuuua

SEQ ID NO: 730939 - RNA, 62 nt, Homo Sapiens
uggagugcaguggugcagucuguagcucacugcagccucaaacuccuaggcucaggcgaucc

SEQ ID NO: 730940 - RNA, 62 nt, Homo Sapiens
ggaagauccuuggcugccgcuuucucuccccacagccucaaggccacccuaccgucauauau

SEQ ID NO: 730941 - RNA, 62 nt, Homo Sapiens
cccuagggaagaagcaagaaacuucggggcugcagccucaggaugaggcagaaggaagggua

SEQ ID NO: 730942 - RNA, 62 nt, Homo Sapiens
gagauggucucucuucucaaguaggaacaccccagccucagacagacacagcaggaaggggc

SEQ ID NO: 730943 - RNA, 62 nt, Homo Sapiens
ccaacagcccacuguuaggagguaguagaccccagccucaaggcucugaccuucuucaugug

SEQ ID NO: 730944 - RNA, 62 nt, Homo Sapiens
ucaccauguuacucaggcuggucucaaacucccagccucaagcgaugcucccaccuccaccu

SEQ ID NO: 730945 - RNA, 62 nt, Homo Sapiens
auugcucacccaagggggcugcuuaacacaaacagccucagacccgagguuuagauuucuga

SEQ ID NO: 730946 - RNA, 62 nt, Homo Sapiens
ugaucucgaacucccgaccucaggugauccgccagccucagccucccaaagugcugggauua

SEQ ID NO: 730947 - RNA, 62 nt, Homo Sapiens
caaccuccgccuccuggguucaagcgauucuccagccucagccuccugaguagcuggaauua

SEQ ID NO: 730948 - RNA, 62 nt, Homo Sapiens
ccucucauccucccgccgcccgucaggccggccagccucacaucagucucuccgccccgggg

SEQ ID NO: 730949 - RNA, 62 nt, Homo Sapiens
ccagccaaaguccccccaccccuucagagaagcagccucaaauuccagaaguggaggcucca

SEQ ID NO: 730950 - RNA, 62 nt, Homo Sapiens
ugccaccaaccgaaccgugaauguagggcccccagccucaccucugccccaggaccaacaac

SEQ ID NO: 730951 - RNA, 62 nt, Homo Sapiens
cagccuguugcuguacuuuucugcuuauuuuacagccucaaauauuucucauuaucuuguca

SEQ ID NO: 730952 - RNA, 62 nt, Homo Sapiens
ccagccccucaggaacccucauccuucaaagacagccucauuucggacuaaacucauuagag

SEQ ID NO: 730953 - RNA, 62 nt, Homo Sapiens
uuuucuuucucaccauagaucggcgggugcugcagccucacuguguucuguguacgugacaa

SEQ ID NO: 730954 - RNA, 62 nt, Homo Sapiens
uuguguaauugugacacaauuacagcugauugcagccucaaccuucccagcucaagugaucc

SEQ ID NO: 730955 - RNA, 62 nt, Homo Sapiens
aauuuugcuugcucauauuucuggccaauguacagccucauauuuuucagaguaauacagau

SEQ ID NO: 730956 - RNA, 62 nt, Homo Sapiens
ugugacucuuguuacagaucauggcggugcgucagccucacaggagacauagcaggucucag

SEQ ID NO: 730957 - RNA, 62 nt, Homo Sapiens
agauggaaaaguguagggacugagaagggcugcagccucagcaguguacagaguccccggcg

SEQ ID NO: 730958 - RNA, 62 nt, Homo Sapiens
uacagcucucagccuaagagcgcagcacugaacagccucaucauuccacuuuucaugggaaa

SEQ ID NO: 730959 - RNA, 62 nt, Homo Sapiens
gcaucuuucucuucccaugccugccuccucagcagccucacuagcugcucacugcucacacg

SEQ ID NO: 730960 - RNA, 62 nt, Homo Sapiens
gcugaaguugccugaaugaucucacagaugcccagccucauaaacagccugagccuucagcc

SEQ ID NO: 730961 - RNA, 62 nt, Homo Sapiens
aacaauaaaaacaaugguagaggcggcacugacagccucagugaaaaaguguuagugcuucc

SEQ ID NO: 730962 - RNA, 62 nt, Homo Sapiens
cgaguggcuuauagccuccacuacccauaccucagccucagggaggguggugaugguaguuu

SEQ ID NO: 730963 - RNA, 62 nt, Homo Sapiens
ccagaaauauuauuuuuuuacagaggagaccucagccucacacuucagcuuggguacacaca

SEQ ID NO: 730964 - RNA, 62 nt, Homo Sapiens
guccacucaggcacaagagcgucuggccuccccagccucaagcuuccaugaaugaccccuca

SEQ ID NO: 730965 - RNA, 62 nt, Homo Sapiens
gaaacucuuagguuaagcaguagcacagcgggcagccucaguacaugccgugugccuuuagu

SEQ ID NO: 730966 - RNA, 62 nt, Homo Sapiens
aacaaacauuuccuaaauggaauuuauuuugucagccucagcaaugacaugauuaaaugaug

SEQ ID NO: 730967 - RNA, 62 nt, Homo Sapiens
uuguauuaaaugauauuuuguuagauuuauagcagccucaaguguauaguuacgaugccaga

SEQ ID NO: 730968 - RNA, 62 nt, Homo Sapiens
ugcuugagacuuuguguguaaaacuccagcuccagccucauugggucagauaaaugaagauc

SEQ ID NO: 730969 - RNA, 62 nt, Homo Sapiens
agaauaaaugacuugcuuuugugccacuaaaacagccucagggggucauucuugucacaaaa

SEQ ID NO: 730970 - RNA, 62 nt, Homo Sapiens
auuauguagggaccuuaugccucuucucguuucagccucaguuugcuuuuacaguggacagc

SEQ ID NO: 730971 - RNA, 62 nt, Homo Sapiens
acaaaugucguugagguuacaguuguaguccacagccucaggaccuacuuguaauuaacuug

SEQ ID NO: 730972 - RNA, 62 nt, Homo Sapiens
aacuuccuuuucaaagcaguaagaaggaaaugcagccucagucccaguggcagucucagguu

SEQ ID NO: 730973 - RNA, 62 nt, Homo Sapiens
guccacacacacaucucacgccccuggucucacagccucacaccuuguccuuccaccccugc

SEQ ID NO: 730974 - RNA, 62 nt, Homo Sapiens
ugcaaacagcgcaauuccaagcucgagagcuucagccucaggaaagaacuuccccuucccug

SEQ ID NO: 730975 - RNA, 62 nt, Homo Sapiens
cauaucacuuugcucuuaccauuccuuuugaucagccucaauucagccucauuguguaguau

SEQ ID NO: 730976 - RNA, 62 nt, Homo Sapiens
gcucuuaccauuccuuuugaucagccucaauucagccucauuguguaguauguuuuuucuuu

SEQ ID NO: 730977 - RNA, 62 nt, Homo Sapiens
gagaugugugcuccuggagggaaaaagaaauacagccucaacagauuaaaaaacaaaaguca

SEQ ID NO: 730978 - RNA, 62 nt, Homo Sapiens
aacaaaacugugucuuaucugccaggaaagaccagccucacuccugggaacugucuggcagg

SEQ ID NO: 730979 - RNA, 62 nt, Homo Sapiens
gagaggcggaacugcuguguccucauguggcgcagccucaaacuggcauccaggcacugggc

SEQ ID NO: 730980 - RNA, 62 nt, Homo Sapiens
uagauuuuauuauguuaguuuaaaaggucaaucagccucaugacuuuauaguuaugucuugu

SEQ ID NO: 730981 - RNA, 62 nt, Homo Sapiens
aaggcuuaugggucuccagaaacucugccagccagccucaguggagaagcuuccucuaccac

SEQ ID NO: 730982 - RNA, 62 nt, Homo Sapiens
ucaaggucccuugaaucccaaaagugccuccccagccucagcccccaccuccagccacacac

SEQ ID NO: 730983 - RNA, 61 nt, Homo Sapiens; identical to SEQ ID NO: 730265

SEQ ID NO: 730984 - RNA, 62 nt, Homo Sapiens
uccuaaguaagaacauaauguaaaauugucagcagccucauggggaggaaaaaggaagaguc

SEQ ID NO: 730985 - RNA, 62 nt, Homo Sapiens
uguccucacuggugcuccaggggaagaaacgacagccucacuucuguauggacugcugaugu

SEQ ID NO: 730986 - RNA, 62 nt, Homo Sapiens
ggaaacguugggguuucuuccuccagugacagcagccucaguagcuuuccugggcuccaggc

SEQ ID NO: 730987 - RNA, 62 nt, Homo Sapiens
gcuccaugcucaccagcagccgcccaggcccgcagccucacccggcucccucuccucacccu

SEQ ID NO: 730988 - RNA, 62 nt, Homo Sapiens
ucauuccaacaccugccauaaacagaggaggccagccucaccgaggaauaaagcugugagca

SEQ ID NO: 730989 - RNA, 62 nt, Homo Sapiens
acugugugacccugggucugagcccucagugccagccucaucgcagggugugaugagguggg

SEQ ID NO: 730990 - RNA, 62 nt, Homo Sapiens
gucagagcaguggagacuggcuuugccugccucagccucaugcucauccccuuauaaaugug

SEQ ID NO: 730991 - RNA, 62 nt, Homo Sapiens
ggccaaagcaucagcaccagagaugccgaccucagccucacaugcuguaauugaacgggucg

SEQ ID NO: 730992 - RNA, 62 nt, Homo Sapiens
ggccaaagcaucagcaccagacuucucuagcucagccucacaccggcacaucuaacaucuac

SEQ ID NO: 730993 - RNA, 62 nt, Homo Sapiens
gugagccccgggcccaggcucagugcccagcccagccucaagcaugggcucgugagcacacu

SEQ ID NO: 730994 - RNA, 62 nt, Homo Sapiens
acuccucccuggaccugcagcucaccuuccuccagccucaccccugaaccuccuccuccagc

SEQ ID NO: 730995 - RNA, 61 nt, Homo Sapiens; identical to SEQ ID NO: 110868

SEQ ID NO: 730996 - RNA, 62 nt, Homo Sapiens
cuggcgucuggacuguucugguauuggaauagcagccucacaaagucaggcuagcugugcug

SEQ ID NO: 730997 - RNA, 62 nt, Homo Sapiens
cagagcagccacgacagccagguggagcgcgccagccucagccugcgaaguccagaguccag

SEQ ID NO: 730998 - RNA, 62 nt, Homo Sapiens
cccugccccuccagcccacagcgguguggcugcagccucaguccaggggagggugcgugggg

SEQ ID NO: 730999 - RNA, 54 nt, Homo Sapiens; identical to SEQ ID NO: 730281

SEQ ID NO: 731000 - RNA, 62 nt, Homo Sapiens
uacauaaugucacccauuuucuuaauaggaugcagccucacaggaucuggagucucugaacu

SEQ ID NO: 731001 - RNA, 62 nt, Homo Sapiens
ucuaccuggacacucauccaaaucucagggcacagccucaggagugcugggagaugaucaga

SEQ ID NO: 731002 - RNA, 62 nt, Homo Sapiens
ccuggccccuugacacauccugugguucccugcagccucauguuugguuucacuaagggcca

SEQ ID NO: 731003 - RNA, 62 nt, Homo Sapiens
uuugcucucaaugucaugcauccuuuaguccccagccucaccgugugacucccuucaggcag

SEQ ID NO: 731004 - RNA, 54 nt, Homo Sapiens; identical to SEQ ID NO: 730286

SEQ ID NO: 731005 - RNA, 62 nt, Homo Sapiens
guuuuguuaaaaaaaaaaaaaaaaaaaggaaacagccucacuuuuuugugcucccucagaau

SEQ ID NO: 731006 - RNA, 62 nt, Homo Sapiens
ggagcuacaggggcacuuaacccaccacagcacagccucaucaaaaugcagcuggcaacuuc

SEQ ID NO: 731007 - RNA, 62 nt, Homo Sapiens
ccauacuucuuuuuuuuccucugaugugaauccagccucagacugagugaacuguaauaauu

SEQ ID NO: 731008 - RNA, 62 nt, Homo Sapiens
agugcuagucccagaggaugcugcggagggggcagccucagcucucuuuucagagaagauca

SEQ ID NO: 731009 - RNA, 62 nt, Homo Sapiens
ggaaggaucaccugagccuaggaguucaagaccagccucagcaacagcaggagccccacccc

SEQ ID NO: 731010 - RNA, 62 nt, Homo Sapiens
ccuacuguccaugcggccucacugggggccaucagccucaccagcaaagcagagaugagagc

SEQ ID NO: 731011 - RNA, 62 nt, Homo Sapiens
uugcagugagccaagaucgcgccacugcacuccagccucagcaauagagugagacugucuca

SEQ ID NO: 731012 - RNA, 62 nt, Homo Sapiens
cuagagugcaguggcaugaucagggcuuacugcagccucacccucgauuuccugggcucaag

SEQ ID NO: 731013 - RNA, 62 nt, Homo Sapiens
aaagaaaacgaaaacaguuuaaaucucuaccacagccucacaagcaaaugcuaaggggaaca

SEQ ID NO: 731014 - RNA, 62 nt, Homo Sapiens
caggccucacauucguggggcucccugaauggcagccucagcacagcguaggcccuuaauaa

SEQ ID NO: 731015 - RNA, 62 nt, Homo Sapiens
aaaggagaggaguagaugagauggaauuuuuccagccucauccuggccugcccucuagacuc

SEQ ID NO: 731016 - RNA, 62 nt, Homo Sapiens
aggugggcgcauagguacaagugcugcuuugucagccucacucccugcagcucucagcuccc

SEQ ID NO: 731017 - RNA, 62 nt, Homo Sapiens
gccacagaggccucccagggcucucggccagucagccucagaaugagaguuacaccacuggc

SEQ ID NO: 731018 - RNA, 62 nt, Homo Sapiens
cuccagggcuuaagcaaucccauggcucacugcagccucaaccuggagugcaguggcaugau

SEQ ID NO: 731019 - RNA, 62 nt, Homo Sapiens
caugcuaagggcacaugcacacucacuuagcucagccucacccuuuuaaaaaggaaggguag

SEQ ID NO: 731020 - RNA, 62 nt, Homo Sapiens
cuccugggcucaagcaaucccauagcucacugcagccucauacuggagugcaguggcaugau

SEQ ID NO: 731021 - RNA, 62 nt, Homo Sapiens
gugacuuucucagaggugaccagaggagagugcagccucacaaugauggaggugacaucagg

SEQ ID NO: 731022 - RNA, 62 nt, Homo Sapiens
cauccuugcccuucucagggcugugacguggucagccucauuccgucacucuuggaggacuc

SEQ ID NO: 731023 - RNA, 62 nt, Homo Sapiens
gcucagaaggugccaguccggugcaggacgcucagccucagguugccuuugcugggccuucu

SEQ ID NO: 731024 - RNA, 62 nt, Homo Sapiens
aacacagugaaacuccaucuggaguuugagaccagccucaucagguggauugcuugagcucg

SEQ ID NO: 731025 - RNA, 62 nt, Homo Sapiens
aaagcuccaagcccuuuggguuggaagaugcucagccucacaaaaccagugcaugcaccugg

SEQ ID NO: 731026 - RNA, 56 nt, Homo Sapiens; identical to SEQ ID NO: 730308

SEQ ID NO: 731027 - RNA, 62 nt, Homo Sapiens
aaguagauuagaaaacuagaaaaaaaaaaauccagccucauauauuuuaaauuagcuuuucu

SEQ ID NO: 731028 - RNA, 62 nt, Homo Sapiens
uaauucuggauaaugcugggcaaguaauaaagcagccucauuuguaugcaugcauuuucaag

SEQ ID NO: 731029 - RNA, 62 nt, Homo Sapiens
caaguuuagacaaguggauuuuacaaugcacacagccucaugccaaaacucuuuauggcauu

SEQ ID NO: 731030 - RNA, 62 nt, Homo Sapiens
ugugugccugggcaccgcucagcuuggaggggcagccucaggcuggagccguuccaucccgg

SEQ ID NO: 731031 - RNA, 62 nt, Homo Sapiens
ccccaggccucaucuuucauagcugaucgugucagccucaugucgagggacguguguucccc

SEQ ID NO: 731032 - RNA, 62 nt, Homo Sapiens
ccccaggccucgucuuucauagcugaucaugucagccucaugucgaggggcguguguucccc

SEQ ID NO: 731033 - RNA, 62 nt, Homo Sapiens
uccguccccugccccacaaggcccgggccggacagccucagcagggccuuuggguggggagg

SEQ ID NO: 731034 - RNA, 62 nt, Homo Sapiens
cauccccugguggcuucagcaguccuuaucaccagccucacaaucccacaggcccaccccca

SEQ ID NO: 731035 - RNA, 62 nt, Homo Sapiens
auguguggggaggauccaucccccacccacugcagccucacaccgaguccaccuuggacaug

SEQ ID NO: 731036 - RNA, 62 nt, Homo Sapiens
agagggccaucagaaggaagccaaagaguucacagccucagcaccaacaacucaacaugguc

SEQ ID NO: 731037 - RNA, 62 nt, Homo Sapiens
uuuauguuuccuaaaggaaauuguuuauucuacagccucaguagguagacacaaacauaaag

SEQ ID NO: 731038 - RNA, 62 nt, Homo Sapiens
gugguauaaucuccauuucaaaaccaaggaagcagccucagaguggucgagugacacaccuc

SEQ ID NO: 731039 - RNA, 62 nt, Homo Sapiens
gcugugcuaagccugccacgggcguauccuugcagccucacaacagugggaggucuguaucc

SEQ ID NO: 731040 - RNA, 62 nt, Homo Sapiens
cguaugcugcacaagcguguacacccccugggcagccucaaaaccccgcuuacagcagcaac

SEQ ID NO: 731041 - RNA, 62 nt, Homo Sapiens
aggggccccucccugccucggcucugccgccccagccucaguuccugcuucuggucuucucc

SEQ ID NO: 731042 - RNA, 62 nt, Homo Sapiens
ggggcuugcccacccaccccgaccccagcccccagccucagccccgguccgggggcagccag

SEQ ID NO: 731043 - RNA, 62 nt, Homo Sapiens
cagccugcccugcgguccugucaccuggaggccagccucacaugcccaaaucuccagucucc

SEQ ID NO: 731044 - RNA, 62 nt, Homo Sapiens
guggggugcccgcugccuguccuccgugaaaccagccucagaucagggcccugccacccagg

SEQ ID NO: 731045 - RNA, 62 nt, Homo Sapiens
ggcgugaccuuggcucacugcaaccuccaggccagccucagccucccuaguagcugggacua

SEQ ID NO: 731046 - RNA, 62 nt, Homo Sapiens
uaggaguuuuauauacugugcaucucccaccccagccucaaguugauaagcaagaaagauuu

SEQ ID NO: 731047 - RNA, 62 nt, Homo Sapiens
uaccacaacauacugacuaauaaccacaucggcagccucagccacauguugccugagcuggu

SEQ ID NO: 731048 - RNA, 62 nt, Homo Sapiens
ggaccacucuucucuccaagguuaaagcaaaccagccucagccaucucuugauaaaggagag

SEQ ID NO: 731049 - RNA, 62 nt, Homo Sapiens
caagcaacauggggugaaccuguuugucccuccagccucagccuuccaguauggccccacca

SEQ ID NO: 731050 - RNA, 62 nt, Homo Sapiens
agcgcuugaagccugaacccuggagaccccaccagccucacccagugagcagccuggagccc

SEQ ID NO: 731051 - RNA, 62 nt, Homo Sapiens
agcucucuucaccguuuuuuggccaguccccacagccucaucccacccugccagcagcuucc

SEQ ID NO: 731052 - RNA, 62 nt, Homo Sapiens
uugcuguccucugacacugcgccucacuuccccagccucaccgggccucucugggcccuaca

SEQ ID NO: 731053 - RNA, 62 nt, Homo Sapiens
uccccagccucaccuugcugcucugggcccuacagccucacuuguuggaggcacuagggccu

SEQ ID NO: 731054 - RNA, 62 nt, Homo Sapiens
cugagagaccugcccucucugcgggggcugcucagccucaucccuggcagguggccaggcag

SEQ ID NO: 731055 - RNA, 62 nt, Homo Sapiens
uugaguccuccuugggguuguaaguccucuuccagccucacuagaguacuuucauacucuuc

SEQ ID NO: 731056 - RNA, 62 nt, Homo Sapiens
gagcugcccacuacuggaagagacuuucuauccagccucacuugcuuacccacugccugccc

SEQ ID NO: 731057 - RNA, 62 nt, Homo Sapiens
uaaugccccccaaagacugacuaaugauccuccagccucaucaugaacugguuuuggucccu

SEQ ID NO: 731058 - RNA, 60 nt, Homo Sapiens; identical to SEQ ID NO: 730340

SEQ ID NO: 731059 - RNA, 62 nt, Homo Sapiens
acucccgggacuauugccaagccaccaagugucagccucagcuggcuuucugaguccuguug

SEQ ID NO: 731060 - RNA, 62 nt, Homo Sapiens
cccagagaagacugaggcuaccugccaaggagcagccucaaguuuauuuuuuacuuuaaaug

SEQ ID NO: 731061 - RNA, 62 nt, Homo Sapiens
ugugaacacccgugucugggauguggagcucacagccucacacagcaagccuccuuugugcu

SEQ ID NO: 731062 - RNA, 62 nt, Homo Sapiens
aaccaggccucucacuccagagugccaugcugcagccucagaucuguagcacaggcaaugcc

SEQ ID NO: 731063 - RNA, 62 nt, Homo Sapiens
ccccacccagcaccuucccaccacgcuggccccagccucagaacaccugccggcaguagccc

SEQ ID NO: 731064 - RNA, 60 nt, Homo Sapiens
uggcccucaccucuuuggacaaacagaugcugcagccucagacgucucuuucuauucaau

SEQ ID NO: 731065 - RNA, 62 nt, Homo Sapiens
ucggggaaccugcaccgcaugcucaccgagaccagccucaucuaugacguguuuggcuguug

SEQ ID NO: 731066 - RNA, 62 nt, Homo Sapiens
guggaggcuccaucccagcauucagcuuuuaccagccucagucucucauugcugcuguugag

SEQ ID NO: 731067 - RNA, 62 nt, Homo Sapiens
caaagagauuuugaaaaccaauuguauuuaaccagccucaaauugugcaaccaugauguaua

SEQ ID NO: 731068 - RNA, 62 nt, Homo Sapiens
ggccaggaggcuguuccaggaguccugcccagcagccucaguggccaagcccagacacucac

SEQ ID NO: 731069 - RNA, 62 nt, Homo Sapiens
uaugauauugcaaaagugauacuuagauuuuacagccucaguagucugcccaguguccacau

SEQ ID NO: 731070 - RNA, 62 nt, Homo Sapiens
ggcagcuaacacgcccgggguggccacagcgccagccucagacuggagggcaagggguuccc

SEQ ID NO: 731071 - RNA, 62 nt, Homo Sapiens
uuuuucuccugcaggguacugggccaggcccucagccucagagagccugcagaagggcuugg

SEQ ID NO: 731072 - RNA, 62 nt, Homo Sapiens
cgacgcgacgcgaugccucccggccaccgccccagccucaccccaucccacgacccccgcaa

SEQ ID NO: 731073 - RNA, 62 nt, Homo Sapiens
ccuaguauguucugacaucuggcuucccuucucagccucauguccaccugccugccagccag

SEQ ID NO: 731074 - RNA, 62 nt, Homo Sapiens
acuacaccacacacaacagccaacagcuacaacagccucacuuggucugccaggcccccacc

SEQ ID NO: 731075 - RNA, 62 nt, Homo Sapiens
caagugaaugggucucaaagacuuggugaccccagccucaucuucuaggccuuuuccaccca

SEQ ID NO: 731076 - RNA, 62 nt, Homo Sapiens
aaggccacuucucaagcagcuuuuggcaccuucagccucagaguggaaucuuuuaaagacag

SEQ ID NO: 731077 - RNA, 62 nt, Homo Sapiens
gcuggugguugccucccguccugggcaggcugcagccucaugccaugucucucucccacuac

SEQ ID NO: 731078 - RNA, 62 nt, Homo Sapiens
acagcguucgcccuuuagcggggaggucauuacagccucauggccucuaccaaggccccaga

SEQ ID NO: 731079 - RNA, 62 nt, Homo Sapiens
cacuucgcuucagccuccggaccauuccggagcagccucacauaccucacugucucgucugu

SEQ ID NO: 731080 - RNA, 62 nt, Homo Sapiens
caaccuccgccuccuggguucaagcgauucuccagccucagccucccgaguagcugggauua

SEQ ID NO: 731081 - RNA, 62 nt, Homo Sapiens
aggcuuucucuguguaaagaaaaaaguuugaccagccucagaucacuaguucuuaacauugu

SEQ ID NO: 731082 - RNA, 62 nt, Homo Sapiens
ugagacgggccaggacgcccugacauccccaccagccucagaaaaacugggccgauguggug

SEQ ID NO: 731083 - RNA, 62 nt, Homo Sapiens
agcaccacccauucaagcauucagacauuugucagccucaaccaugaacaagucuguaaagc

SEQ ID NO: 731084 - RNA, 62 nt, Homo Sapiens
cauuuguauaucuccagaaaugcauaugaugccagccucacgccaauuuguaaagccacauu

SEQ ID NO: 731085 - RNA, 62 nt, Homo Sapiens
uggcugaaccucgccgcucccaguacucccuccagccucagcggcuaccccuccuggccacc

SEQ ID NO: 731086 - RNA, 62 nt, Homo Sapiens
gugccucucuggccgcccacccugggcucuuccagccucagugaaaaagaacuagcagaggg

SEQ ID NO: 731087 - RNA, 62 nt, Homo Sapiens
ccuacaucagacaaaauauccaccaaaagauccagccucauaaucuaauucuggcaggaccu

SEQ ID NO: 731088 - RNA, 62 nt, Homo Sapiens
gcugaaggcgagggguggaggaggccccagcacagccucaucuccauguguacacgugugua

SEQ ID NO: 731089 - RNA, 62 nt, Homo Sapiens
ucgcaguuggggcugaggcuggggcuggcugccagccucaguucugggagcgcuggggucgc

SEQ ID NO: 731090 - RNA, 62 nt, Homo Sapiens
uccugaggggagacagagcaaccccuggaccccagccucaaauccaggacccugccaggcac

SEQ ID NO: 731091 - RNA, 62 nt, Homo Sapiens
ccuuuccuaggcacauucguccacuaagggaacagccucagaaacugguacagcaaugggug

SEQ ID NO: 731092 - RNA, 62 nt, Homo Sapiens
ggggagauucaggaucccccugugccagagcacagccucaccggaugcugcuucccacacug

SEQ ID NO: 731093 - RNA, 62 nt, Homo Sapiens
uaaccuccgucuccuggguucaagugauucuccagccucagccucccgaauagcugggauua

SEQ ID NO: 731094 - RNA, 62 nt, Homo Sapiens
gguugggaagccuuccgucugcggugggcaggcagccucacccugggcccacagaccggccu

SEQ ID NO: 731095 - RNA, 62 nt, Homo Sapiens
cugucauuguuccuuccccagaagcuaagagccagccucagagccuacccaggagcugugaa

SEQ ID NO: 731096 - RNA, 62 nt, Homo Sapiens
gcaggaucagguuagggcgagcgcuaccucuccagccucagcucucaguugcagcccugcug

SEQ ID NO: 731097 - RNA, 62 nt, Homo Sapiens
gggcauguuauggggaggggaggggguucuuccagccucaggucccagcugucucacguugu

SEQ ID NO: 731098 - RNA, 62 nt, Homo Sapiens
cucccagccacuuucccuccuggcacugccaccagccucaccgccugcgggcagggggaggc

SEQ ID NO: 731099 - RNA, 62 nt, Homo Sapiens
uuccucucagcuccgccccauacccgucacuacagccucaccucccaccccugucacuacgg

SEQ ID NO: 731100 - RNA, 62 nt, Homo Sapiens
cacuacggccucaccucccaccccugucacuacagccucaccuccuacagccuuaaguccca

SEQ ID NO: 731101 - RNA, 62 nt, Homo Sapiens
ucccacgugguugucccgggaaagcugccccacagccucagcaucuucagcacuuaccgauc

SEQ ID NO: 731102 - RNA, 62 nt, Homo Sapiens
ggacguccugugugccaagugguuuauaugcccagccucauuuaauccucagaaugacucca

SEQ ID NO: 731103 - RNA, 62 nt, Homo Sapiens
cuggccaggcccaaggacccagccaucaaaaccagccucaaaucugguugugauggagaagu

SEQ ID NO: 731104 - RNA, 62 nt, Homo Sapiens
cuagccgggccucaccccaccccuacccgccacagccucagggugugcaggggagccugcug

SEQ ID NO: 731105 - RNA, 62 nt, Homo Sapiens
ugugugaccuuaggaagucucugccccucucucagccucagugucccgagggccccgaagca

SEQ ID NO: 731106 - RNA, 62 nt, Homo Sapiens
cugcacaccagccugggugacagugugagacccagccucaaaaaaaaaaaaaaaaaagugau

SEQ ID NO: 731107 - RNA, 62 nt, Homo Sapiens
uggucucaaacuccugggcucaagcgaacugucagccucagccucccagugugcugggauua

SEQ ID NO: 731108 - RNA, 62 nt, Homo Sapiens
aacugcaccugggcagcuccucccugugcccccagccucagcccaacuucuuacccgaaagc

SEQ ID NO: 731109 - RNA, 62 nt, Homo Sapiens
caagaguccccuuggguacaccccucugcccacagccucagcauuucuuggagcagcaaagg

SEQ ID NO: 731110 - RNA, 62 nt, Homo Sapiens
agucuuggaccccacgagagagaaucguuccucagccucauggugaacucgcgcccuccagc

SEQ ID NO: 731111 - RNA, 62 nt, Homo Sapiens
cuucccgcacccagcaugcagcucugccuccgcagccucagugcgcuuuccugcgcgcacug

SEQ ID NO: 731112 - RNA, 62 nt, Homo Sapiens
ucguuccgguuauguuguguaagucaacucuucagccucauucacuguccuggcuuuuauuu

SEQ ID NO: 731113 - RNA, 62 nt, Homo Sapiens
ucagauauauacaaaugaaauuagaagaaacacagccucaugggacagaaauuugagggagg

SEQ ID NO: 731114 - RNA, 62 nt, Homo Sapiens
agaagccuguguucuucaagagcagguguucucagccucacaugcccugccgugcuggacuc

SEQ ID NO: 731115 - RNA, 62 nt, Homo Sapiens
cucugccuguccagcgccaaccuggauagcagcagccucagccagcgugagggugugucuuc

SEQ ID NO: 731116 - RNA, 62 nt, Homo Sapiens
uggagccaaagcuuuguccuagucuucucucccagccucagucagagaugguuugaaggccc

SEQ ID NO: 731117 - RNA, 62 nt, Homo Sapiens
ucagccucccccugcugcucgugaggcugggccagccucagcuagcccggccagggccuggu

SEQ ID NO: 731118 - RNA, 62 nt, Homo Sapiens
uauguuuuuaaaaaauaucaagccaccaugcccagccucaaagugcuggaauuacuggcgug

SEQ ID NO: 731119 - RNA, 62 nt, Homo Sapiens
uguguuaguaacaugaaaaacugggaaaccuccagccucaagagcccagcagguaugggcau

SEQ ID NO: 731120 - RNA, 62 nt, Homo Sapiens
uugccagauguuggcagaagcaacguccaccccagccucacauacuccuggcaacaucaggc

SEQ ID NO: 731121 - RNA, 62 nt, Homo Sapiens
aacgccccugguggacaggacuuccaggcagacagccucagcuuccgcgcccauuggugacc

SEQ ID NO: 731122 - RNA, 62 nt, Homo Sapiens
aaaguguugggauuacugguacucuucugccucagccucacccgaacuccugggcuuaaaug

SEQ ID NO: 731123 - RNA, 62 nt, Homo Sapiens
caguguuuucauugccaacaaagggccaggcucagccucaagggaggaccugagggugcuca

SEQ ID NO: 731124 - RNA, 62 nt, Homo Sapiens
uugcuggagcugucacaugacgcagguucccccagccucaggcucacauuguuccuccagac

SEQ ID NO: 731125 - RNA, 62 nt, Homo Sapiens
ccugccauucagggcuguucgcaccaggccagcagccucaucccuugacugugucccagcca

SEQ ID NO: 731126 - RNA, 62 nt, Homo Sapiens
ccugucuguacugcucguccuggccauggagucagccucagcggguuugaccucugcccaca

SEQ ID NO: 731127 - RNA, 62 nt, Homo Sapiens
gugccaagccuucugugagaccacacucaccccagccucauuacaaagaacaaucacuaaaa

SEQ ID NO: 731128 - RNA, 62 nt, Homo Sapiens
augaaccagggaaucaaacuccuccuuagaggcagccucaagaagggccuggcucacaugcc

SEQ ID NO: 731129 - RNA, 62 nt, Homo Sapiens
ccagggcgggaaagcaggcuccaggacugagccagccucaggaagcaggacuggggagagau

SEQ ID NO: 731130 - RNA, 62 nt, Homo Sapiens
cuugcgaaccgugagcaggagcccaggccggccagccucaccagccugcuucccaccucccu

SEQ ID NO: 731131 - RNA, 62 nt, Homo Sapiens
gcuuccuuauguccuccaccgagaaaggauggcagccucagguucaguaucaaggcugccug

SEQ ID NO: 731132 - RNA, 62 nt, Homo Sapiens
auuaaggucuuauuuaauuuaccagucauacacagccucauugcacagugcuccuccauauc

SEQ ID NO: 731133 - RNA, 62 nt, Homo Sapiens
gggugggauacagcagcuuuaucccaucuuugcagccucauauugcuacucucucccucucc

SEQ ID NO: 731134 - RNA, 62 nt, Homo Sapiens
cucucaaagugcugggauuacaagcaaucugccagccucagcugaucuugaacuccugggcu

SEQ ID NO: 731135 - RNA, 62 nt, Homo Sapiens
ugccccagguuuaagcaauccucagcucacugcagccucaaccuagagugcaguggugcaau

SEQ ID NO: 731136 - RNA, 62 nt, Homo Sapiens
uaugugugugucuacgugcagcucacuaccaacagccucaugugcacuugaccugacagugc

SEQ ID NO: 731137 - RNA, 62 nt, Homo Sapiens
agaauaaggaacaagcauuauuccuuugccaacagccucacucuaagaggcuuuuuugcuga

SEQ ID NO: 731138 - RNA, 62 nt, Homo Sapiens
cccggcagacccacccacccccuggggcugcucagccucaggcacggacagggcacaugaua

SEQ ID NO: 731139 - RNA, 62 nt, Homo Sapiens
cucucucuuugcucucuuucucccuccccuaccagccucauucuuccuccgguagccucucc

SEQ ID NO: 731140 - RNA, 62 nt, Homo Sapiens
gguagccucucccaccuaaccucugcaucccccagccucauguccugccccaucccuauccu

SEQ ID NO: 731141 - RNA, 62 nt, Homo Sapiens
caagacacuacgggaacaguuugccucccucccagccucaaccacaauucuuccaugcuggg

SEQ ID NO: 731142 - RNA, 62 nt, Homo Sapiens
cugcuaugcaccacuugaaggagcucuaucaccagccucaaacccgaaagacugaggcauuu

SEQ ID NO: 731143 - RNA, 62 nt, Homo Sapiens
caggacggcagggucauccugagccgccaaggcagccucagucagagcacccugaaguuuuu

SEQ ID NO: 731144 - RNA, 62 nt, Homo Sapiens
uggaaagaaguucaguggucccauuguuaacucagccucaaaucucaacugucaggcccuac

SEQ ID NO: 731145 - RNA, 62 nt, Homo Sapiens
caccuggagauccugaacugucaagccacuggcagccucaugccaccacauuugccagaaau

SEQ ID NO: 731146 - RNA, 62 nt, Homo Sapiens
ggaaagugaugucagaauagcuuccaauaaagcagccucauucugaggccugagugauccac

SEQ ID NO: 731147 - RNA, 62 nt, Homo Sapiens
cgaaccuuggccugggccguaucuccggcucccagccucagcgcggcccucccgaguuaagg

SEQ ID NO: 731148 - RNA, 62 nt, Homo Sapiens
ccccagccaguccugagccucccgccaaaucccagccucacuaggugggacccccuucccag

SEQ ID NO: 731149 - RNA, 62 nt, Homo Sapiens
cuggagugcaguggugugaucacagcucacugcagccucaaccucugaaggcccagaugauc

SEQ ID NO: 731150 - RNA, 62 nt, Homo Sapiens
caaaaugccauuuagcaauaaauaacacuugucagccucagagcauuuaaggaaacuagaca

SEQ ID NO: 731151 - RNA, 62 nt, Homo Sapiens
uggucucaaacuccuaggcuuaagcaguccuccagccucagccuucucaaagugcuaggaug

SEQ ID NO: 731152 - RNA, 62 nt, Homo Sapiens
cuggagugcaguggcauaaucauaccucauugcagccucagacuccuggguucaagcaaucc

SEQ ID NO: 731153 - RNA, 62 nt, Homo Sapiens
guggagugcagugacgacaucacagcucacugcagccucaaccuggguucaagugauccucu

SEQ ID NO: 731154 - RNA, 62 nt, Homo Sapiens
caauuuuguauaaauauauagaaacacacacacagccucagacuuacaaacugauuauacuc

SEQ ID NO: 731155 - RNA, 62 nt, Homo Sapiens
gcccucuauccuaucauagauaacauucuccacagccucacuucauuccaccuauucucuga

SEQ ID NO: 731156 - RNA, 62 nt, Homo Sapiens
cuuacgcccuuccccuugaccuuguccugccccagccucacggacagccugcgcagggggcu

SEQ ID NO: 731157 - RNA, 62 nt, Homo Sapiens
agcccaggaccccugaccccggccgcugcugccagccucagaaaggcacccaggugugcagg

SEQ ID NO: 731158 - RNA, 62 nt, Homo Sapiens
ugugaauaaaauucuuauugucuaaauugagacagccucagauauuugcagauauuuacuuu

SEQ ID NO: 731159 - RNA, 62 nt, Homo Sapiens
uuuuggccccaucucugguucaguucaugauacagccucaccggccccacucuguucccaag

SEQ ID NO: 731160 - RNA, 62 nt, Homo Sapiens
aggcuuggaaagaaaaaacaacuaauagaccucagccucaaaaauaguugggacaucagcug

SEQ ID NO: 731161 - RNA, 62 nt, Homo Sapiens
cuccacacagaaaugugaacagacuuugcacacagccucagguuccuggcucugcaaacccc

SEQ ID NO: 731162 - RNA, 62 nt, Homo Sapiens
gaagaauaugacagcuguccaacagacaaaaacagccucacaugagagacccaaggaggaaa

SEQ ID NO: 731163 - RNA, 62 nt, Homo Sapiens
cagucccuaauuaugggacuuucaaagggcuccagccucacuuucaguucugccaucuuguu

SEQ ID NO: 731164 - RNA, 62 nt, Homo Sapiens
uucagcuucaugccucuuccgggggccuacagcagccucacccaugcuggccucaugggcuu

SEQ ID NO: 731165 - RNA, 62 nt, Homo Sapiens
cugcccuuccgccccccacaccaguggaaacacagccucacauggcagguaugacaacucau

SEQ ID NO: 731166 - RNA, 62 nt, Homo Sapiens
cuccuggguucaagcaaucccacagcucacugcagccucaaccuagagugcaauggugcaau

SEQ ID NO: 731167 - RNA, 62 nt, Homo Sapiens
cauuccugcggcauguaugagcgcaacacccucagccucauggugcugagugcugaagcagu

SEQ ID NO: 731168 - RNA, 62 nt, Homo Sapiens
gcgcgcgcuguguguguguggugugugugugucagccucagaucagagcgcgcugugugugu

SEQ ID NO: 731169 - RNA, 62 nt, Homo Sapiens
aacuaacaaguuuugagaaaacacccuagauccagccucaggccaucaucccuuccauugcc

SEQ ID NO: 731170 - RNA, 62 nt, Homo Sapiens
gcggcacacguucuagcucauccuggugguggcagccucacccuucgcauccugcagaagag

SEQ ID NO: 731171 - RNA, 62 nt, Homo Sapiens
caccaucccccucuuuccacuuggagaagcugcagccucacgccagcaaagcugagacaaaa

SEQ ID NO: 731172 - RNA, 55 nt, Homo Sapiens; identical to SEQ ID NO: 110882

SEQ ID NO: 731173 - RNA, 62 nt, Homo Sapiens
cugcgccugagcugcaugcgccggccaagccccagccucagcccccguuccaagugcacugc

SEQ ID NO: 731174 - RNA, 62 nt, Homo Sapiens
gcacuauuguaaacccugcuguuugcacagcccagccucacacugguguguauucucaugug

SEQ ID NO: 731175 - RNA, 62 nt, Homo Sapiens
ccugaaucaaauuuuuaauuuucguucuuuaucagccucauguuaaugaaaaaaaguaaaac

SEQ ID NO: 731176 - RNA, 62 nt, Homo Sapiens
uggucgggggcgggggcggccugaccagcaggcagccucauccuguggagggggcugcaggg

SEQ ID NO: 731177 - RNA, 62 nt, Homo Sapiens
ccacgggcuggacgggccugcaguguuguuuccagccucagggccccgccuggagcccaggc

SEQ ID NO: 731178 - RNA, 62 nt, Homo Sapiens
aaaacaagaccucugugcacggaacccucuaucagccucaggauuuggagccgggucuagag

SEQ ID NO: 731179 - RNA, 62 nt, Homo Sapiens
ggagcaguuugugggcuggugggcuggccccacagccucacaaccuguuugcauggagaaau

SEQ ID NO: 731180 - RNA, 62 nt, Homo Sapiens
gcagacucucugucgccaggcuucuccugccucagccucacgaguagcugggacuacaggca

SEQ ID NO: 731181 - RNA, 62 nt, Homo Sapiens
cagaacggaggucaccuucucccgagcugccgcagccucagguccuccccuaccagcucagc

SEQ ID NO: 731182 - RNA, 62 nt, Homo Sapiens
guuuuuaccuuaauuucaacugugauuuuguucagccucacucaugagaugcuuuuucuuaa

SEQ ID NO: 731183 - RNA, 62 nt, Homo Sapiens
gagccacggcccgucuagucccacaccacagccagccucaggaagugugggcugugcccuag

SEQ ID NO: 731184 - RNA, 62 nt, Homo Sapiens
cgugaacugucaucaccuggcaaccccagccccagccucagcccugcccccuuucccuccuu

SEQ ID NO: 731185 - RNA, 62 nt, Homo Sapiens
ucuagggccuuuuuucaauaacuugaaaaucacagccucaucauuagcaacuuuauauacac

SEQ ID NO: 731186 - RNA, 62 nt, Homo Sapiens
caaccuccaccuccuggguucaagcgcuucuccagccucagccuccugaguagcugggauua

SEQ ID NO: 731187 - RNA, 62 nt, Homo Sapiens
ucccucaucuagucuugaccucuccagcaucccagccucagaagccuucuugcugcccacaa

SEQ ID NO: 731188 - RNA, 62 nt, Homo Sapiens
ugcuaagauuaaaauccgucucccauuuguuacagccucaccugcaccaggauagaaagcac

SEQ ID NO: 731189 - RNA, 62 nt, Homo Sapiens
gguuuguccugagccugcacuguccucgccugcagccucagaggggcaggcauccccgcaca

SEQ ID NO: 731190 - RNA, 62 nt, Homo Sapiens
aacucccuggaauaucccugaagcuacgcacucagccucaagaggaauuagugcuggauuug

SEQ ID NO: 731191 - RNA, 62 nt, Homo Sapiens
aaggaccuuguggcuuuguagcagagggcuuacagccucagcagaagccacaguacucaucu

SEQ ID NO: 731192 - RNA, 62 nt, Homo Sapiens
gagggccgugugacacucucagccugcggcgccagccucacguucucucagccagcuguuua

SEQ ID NO: 731193 - RNA, 62 nt, Homo Sapiens
ucacugugcuguggucugucuagucguuuccucagccucaucugauauagccaaugcuguug

SEQ ID NO: 731194 - RNA, 62 nt, Homo Sapiens
ugccgcucaggccucagagggcaggcgccugccagccucaccucaucccccgcgugcucuga

SEQ ID NO: 731195 - RNA, 62 nt, Homo Sapiens
ccugugaauuucuuauuguaagacacugcgcccagccucaucgugcugggauuacaggcgug

SEQ ID NO: 731196 - RNA, 62 nt, Homo Sapiens
ugacucacagagcugcagagguuuaaugagaccagccucagcgguggaaaugccucuucuug

SEQ ID NO: 731197 - RNA, 62 nt, Homo Sapiens
acccagucuuuucccuaguucaucuggggacacagccucagugcggcugcuucggaagcaga

SEQ ID NO: 731198 - RNA, 62 nt, Homo Sapiens
gcaaggagggcgcuucacuguugucccaggcccagccucaagggcuggcugugaggccaccu

SEQ ID NO: 731199 - RNA, 62 nt, Homo Sapiens
cuccugggcucaagcgaucccauagcucacugcagccucaaacuggagaacaguggcaccau

SEQ ID NO: 731200 - RNA, 62 nt, Homo Sapiens
auuuucacauugaaaaucagucagauuugcuucagccucaaagaggguguuuauguaaaacu

SEQ ID NO: 731201 - RNA, 62 nt, Homo Sapiens
ugcucauucugggcccuugcugccaaggagcccagccucaccuagcaggaaaggagaugaag

SEQ ID NO: 731202 - RNA, 62 nt, Homo Sapiens
cugccgaggaagccgagugcccgccgccgcgccagccucagcccgcgcagaaugugcucgcu

SEQ ID NO: 731203 - RNA, 62 nt, Homo Sapiens
ccuuuccugcuucucugaaagcacaggucacccagccucagaaucacaccucccggcugcug

SEQ ID NO: 731204 - RNA, 62 nt, Homo Sapiens
agaccucucaacacaguaugccaaguggauuccagccucauggccuagcaaaagaacagacu

SEQ ID NO: 731205 - RNA, 62 nt, Homo Sapiens
cuauuccuaggcaaagagccucauggcuaaggcagccucaaagccagccccuccucccaccu

SEQ ID NO: 731206 - RNA, 62 nt, Homo Sapiens
caaccucugccucccagguucaagugcuucuccagccucagccucccaaguagcugagacua

SEQ ID NO: 731207 - RNA, 62 nt, Homo Sapiens
ggaccgggccccucucuagggaccccucgccccagccucauuccccauucugugucccaugu

SEQ ID NO: 731208 - RNA, 62 nt, Homo Sapiens
guaaagaaaacuaaauccuucuguguccccggcagccucagugcagcaacagaagccaaggg

SEQ ID NO: 731209 - RNA, 62 nt, Homo Sapiens
ggaacccauuaccuucucccucauuucaggagcagccucagaacaaagugagacaguccagc

SEQ ID NO: 731210 - RNA, 62 nt, Homo Sapiens
ggagucaggaacccagacaaggaaucccauuccagccucaccccaaccaugaccuuggcaag

SEQ ID NO: 731211 - RNA, 62 nt, Homo Sapiens
guaaaugacaugaccaguggagcacgugacaccagccucaaaauaucauccauuguuuuuca

SEQ ID NO: 731212 - RNA, 62 nt, Homo Sapiens
cugcauagcuugcacaacauuccugguuuccucagccucaccucuccacauuccaaacagag

SEQ ID NO: 731213 - RNA, 62 nt, Homo Sapiens
aguauuuggacuuuuuaaagccuucugauccacagccucaucaaacacagucacuguugguu

SEQ ID NO: 731214 - RNA, 62 nt, Homo Sapiens
auccuuuuauaaaugugagauuuagcacuuggcagccucaugguuacuagaccaucuccauu

SEQ ID NO: 731215 - RNA, 62 nt, Homo Sapiens
acugccaggccugcccugaagaccaucuuuagcagccucagcccucagaaauaagccugaga

SEQ ID NO: 731216 - RNA, 62 nt, Homo Sapiens
gccccucuugcagagucccccaaucagcaggacagccucacuagagagaccaggagccaccu

SEQ ID NO: 731217 - RNA, 62 nt, Homo Sapiens
ggccagaggaucaccagugcaggaccaggaaacagccucagucacgugcauagaggucuggg

SEQ ID NO: 731218 - RNA, 62 nt, Homo Sapiens
cccagggacugggggcgauuagccagaggcagcagccucagcgguggccuuggcccagaagg

SEQ ID NO: 731219 - RNA, 62 nt, Homo Sapiens
uucccugcuuggaagcguggccagccgugcuccagccucacuacaagaaagccugaugaagu

SEQ ID NO: 731220 - RNA, 62 nt, Homo Sapiens
cugaugaugcugccaaggcgcccuggggagcucagccucaucuugccacuuucaaagugguc

SEQ ID NO: 731221 - RNA, 62 nt, Homo Sapiens
ccgggcaggggcggcccucggcuggcgcugugcagccucaccccaagcuggcccagccugga

SEQ ID NO: 731222 - RNA, 62 nt, Homo Sapiens
guuuugagcugaagugauccccaggcucacugcagccucaacgcagggucuugcucugucuc

SEQ ID NO: 731223 - RNA, 62 nt, Homo Sapiens
ugagcaucgccaggcugcugugggggcgggagcagccucagugucaagggcccgcccacuga

SEQ ID NO: 731224 - RNA, 62 nt, Homo Sapiens
ucccugcccccaggccccggcauugccaucagcagccucagcgucuccccggccaugugugc

SEQ ID NO: 731225 - RNA, 62 nt, Homo Sapiens
uggggcggcugaugccagggcggcccgcggggcagccucacggaagggcccggugggacgug

SEQ ID NO: 731226 - RNA, 62 nt, Homo Sapiens
ugucccucaugucucuagauuuucucgucacccagccucaaaaauauaugugucugcaaccc

SEQ ID NO: 731227 - RNA, 62 nt, Homo Sapiens
gccucuccgggaucaguccuaggacacaggcucagccucagguugaugggggaugaugugcu

SEQ ID NO: 731228 - RNA, 62 nt, Homo Sapiens
aggccaggagcgcuggguucugcagcagggcucagccucaggggcguuaagacccuggauga

SEQ ID NO: 731229 - RNA, 62 nt, Homo Sapiens
gguggaggugcuccccacaguccgggccaggacagccucaggggagagugaaggccugcagg

SEQ ID NO: 731230 - RNA, 62 nt, Homo Sapiens
gucacuuaggggccacuuccuaaguugcuguccagccucagugacccccuagugcuuccugg

SEQ ID NO: 731231 - RNA, 62 nt, Homo Sapiens
agggugguccgggcacacugggccugccucuccagccucaggaugcucuuguuuauucuggg

SEQ ID NO: 731232 - RNA, 62 nt, Homo Sapiens
cuggaaugcagugguaugaucacggcucacugcagccucaaccuccugggcuaagugauccu

SEQ ID NO: 731233 - RNA, 62 nt, Homo Sapiens
cacccugccccuggugcccugagacagacacacagccucacgcccccaggaaugcaaguggu

SEQ ID NO: 731234 - RNA, 62 nt, Homo Sapiens
ugguucucauugguccagacgaggaagguauccagccucaagucaucauuguggccaggaag

SEQ ID NO: 731235 - RNA, 62 nt, Homo Sapiens
ccaggggugggcgacacaggcagcuucuucggcagccucacggcagcaaccccagccuuccc

SEQ ID NO: 731236 - RNA, 62 nt, Homo Sapiens
ggcuggggugcaguggcgcgaucccagcacugcagccucaaccuccugggcucaagccaucc

SEQ ID NO: 731237 - RNA, 62 nt, Homo Sapiens
cgcgucccuguccuugaaggaccuccuucccccagccucaucaccgugcucuucucagcgcc

SEQ ID NO: 731238 - RNA, 62 nt, Homo Sapiens
ugcuccccaccagcacgcugaccugugaaccccagccucaccaucacccccagcacugccag

SEQ ID NO: 731239 - RNA, 62 nt, Homo Sapiens
cuaagaccaacugcguuggacaccauaagccacagccucacaggaagugggggugaggagcc

SEQ ID NO: 731240 - RNA, 62 nt, Homo Sapiens
ucuuuuucacaugggccacaguuucaguacuucagccucagugggguuccugauguuuaucu

SEQ ID NO: 731241 - RNA, 62 nt, Homo Sapiens
gaccugaggcccuucucuccagccccuggaugcagccucacaguccuuaccagcagagcacc

SEQ ID NO: 731242 - RNA, 62 nt, Homo Sapiens
ccaauccaguggacuucgcaguccacuucugacagccucagugacccuggcuccuugugcca

SEQ ID NO: 731243 - RNA, 62 nt, Homo Sapiens
cagagggggcugcggacacagcaggcccccuacagccucagguucugccugagcccagccua

SEQ ID NO: 731244 - RNA, 62 nt, Homo Sapiens
uaaauaugacucuuuuguaauuaacucauguacagccucauccuguauaguuuaaugaugaa

SEQ ID NO: 731245 - RNA, 62 nt, Homo Sapiens
accccccauagggggcagugucuuguuccugccagccucagugucuugcuucugccagcucc

SEQ ID NO: 731246 - RNA, 61 nt, Homo Sapiens; identical to SEQ ID NO: 110891

SEQ ID NO: 731247 - RNA, 62 nt, Homo Sapiens
cccuucucccagugcguuugacuuugucaggucagccucacuugucccuuucacaguuggcc

SEQ ID NO: 731248 - RNA, 62 nt, Homo Sapiens
aaggugaaacuuagauaucauggacuguuguccagccucaaugcuucauuuuccccuugcau

SEQ ID NO: 731249 - RNA, 62 nt, Homo Sapiens
aggguugagaaggcuuugcugccaccuggugucagccucagucacuuucucugaaugcuucu

SEQ ID NO: 731250 - RNA, 62 nt, Homo Sapiens
uuacccuaguucugcccuuguuuguggaguuacagccucaagguuguagcaugugugcuggc

SEQ ID NO: 731251 - RNA, 62 nt, Homo Sapiens
ggaggacagccccccacuguucuccucaucuccagccucaguaguuggggguagaaggagcu

SEQ ID NO: 731252 - RNA, 62 nt, Homo Sapiens
cucuagcagccuggacuccgcaguggcugugucagccucacccuucgugugcacccgcaugg

SEQ ID NO: 731253 - RNA, 62 nt, Homo Sapiens
gcccucggagcuggcugugcguauggcccaggcagccucaagcgcgcacgcgcgagugugcu

SEQ ID NO: 731254 - RNA, 62 nt, Homo Sapiens
gacaagagauuccaguuuuaaaagaccagagccagccucaggggaaggacugggagagacac

SEQ ID NO: 731255 - RNA, 62 nt, Homo Sapiens
cccacgucccaaccccucucgcugcuggcauacagccucaucgcugccuccagcauccagug

SEQ ID NO: 731256 - RNA, 62 nt, Homo Sapiens
cauccaaagccacaccacagccagaaucaacucagccucagguaagcgaggucagacaucca

SEQ ID NO: 731257 - RNA, 62 nt, Homo Sapiens
cccugccugauauccagucauugcaggcuguccagccucaucgcaaccuggaguuggaggca

SEQ ID NO: 731258 - RNA, 62 nt, Homo Sapiens
gggcugucggccaagagccuguguaccguggacagccucaggcugcugcggggcuggcugca

SEQ ID NO: 731259 - RNA, 62 nt, Homo Sapiens
uucccccggugccucucccacuuugcuguucgcagccucacaaccaauggguuugccaagcc

SEQ ID NO: 731260 - RNA, 62 nt, Homo Sapiens
uucucccaucccagaagcggugcuuuggagaucagccucaccaguguggggugggggggacc

SEQ ID NO: 731261 - RNA, 62 nt, Homo Sapiens
gcauuuggcaaaugcuuacuauucccauugcccagccucaguggccuuuaaagaacauaaga

SEQ ID NO: 731262 - RNA, 62 nt, Homo Sapiens
aaaaauugauguaaaucagaaaaugggacaaucagccucauguaauauucagacuauucuua

SEQ ID NO: 731263 - RNA, 62 nt, Homo Sapiens
agguccugacaacaggugccaugcaccugugacagccucagguuauuuugccaagguuaagg

SEQ ID NO: 731264 - RNA, 62 nt, Homo Sapiens
auggagaaaccccgucucuaggaguucgagaccagccucaacgggcggaucaccugagguca

SEQ ID NO: 731265 - RNA, 62 nt, Homo Sapiens
aaggauggcuaaaugcuccugggagucaggcgcagccucacaccagcugccuccuccacuca

SEQ ID NO: 731266 - RNA, 62 nt, Homo Sapiens
ugggcguuuucccggcaggcccccgggguccucagccucagcaacccagggagaggacagaa

SEQ ID NO: 731267 - RNA, 62 nt, Homo Sapiens
ugcccucggaucagggccgggaugggaggggucagccucagggagcagcugccuugggggac

SEQ ID NO: 731268 - RNA, 62 nt, Homo Sapiens
ccacucaguaacaaguauugggacguagagcacagccucacucagcucugaaagguaauaca

SEQ ID NO: 731269 - RNA, 62 nt, Homo Sapiens
agcaguuaugagggaggaagucaacugcuguucagccucagaauaaaggugccguucacugg

SEQ ID NO: 731270 - RNA, 62 nt, Homo Sapiens
agaucucccaacuugaacuauaauccaccagccagccucagccuugagcuuuggaaccacau

SEQ ID NO: 731271 - RNA, 62 nt, Homo Sapiens
cagccaaguuugagcucuuaaaaguugaugaacagccucauuuccccagcuucccugauuuc

SEQ ID NO: 731272 - RNA, 62 nt, Homo Sapiens
auuccugguaggggugugugcgugacguacugcagccucaaccuccugggcucaagugaucc

SEQ ID NO: 731273 - RNA, 62 nt, Homo Sapiens
auagcagucagcuugaggaggaugaaggaaggcagccucagacaggaauuaaggcaaugccc

SEQ ID NO: 731274 - RNA, 62 nt, Homo Sapiens
uauuuauuuguuauuaaauugaucugacuucucagccucauuuggacuaaaaaaagaaagca

SEQ ID NO: 731275 - RNA, 62 nt, Homo Sapiens
uucccacucuguccaccaagugggggguagcacagccucacagcaaccgcccugaccuuggg

SEQ ID NO: 731276 - RNA, 62 nt, Homo Sapiens
uauuaccuuuacuccccucccucucccaucaccagccucaaggccugaggggugcaggggcu

SEQ ID NO: 731277 - RNA, 62 nt, Homo Sapiens
gaucagcaccgauucccgaaagcuuuccaccucagccucagaguccagcugcccggacucca

SEQ ID NO: 731278 - RNA, 62 nt, Homo Sapiens
uaauuuggcaguuuguuagguuagacaacugacagccucauuucauuccuacaaguugguuu

SEQ ID NO: 731279 - RNA, 62 nt, Homo Sapiens
aggagcacuggaggaggagugggcucucugugcagccucacagggcuuugccacggagccac

SEQ ID NO: 731280 - RNA, 62 nt, Homo Sapiens
auccaugucccggagaggggucccucaacagucagccucaccugucagaccgggguucuccc

SEQ ID NO: 731281 - RNA, 62 nt, Homo Sapiens
ggagaugccacuucucacucaccacuaccagccagccucagaaggccccagagagacccugc

SEQ ID NO: 731282 - RNA, 62 nt, Homo Sapiens
accuggccauuuugacccugaguggacagucacagccucagcucaugucuggcugugacaca

SEQ ID NO: 731283 - RNA, 62 nt, Homo Sapiens
cacuggggcucagagccggggugggguggcugcagccucaggacugggagcccccagccugu

SEQ ID NO: 731284 - RNA, 62 nt, Homo Sapiens
cccuacccccuccaaggggcagguuuccaguccagccucagagaucaggcucugggaccccu

SEQ ID NO: 731285 - RNA, 62 nt, Homo Sapiens
gccgaguccuugucccuaccuccagcuuccuccagccucaaaccgccucuggaucuagcugu

SEQ ID NO: 731286 - RNA, 62 nt, Homo Sapiens
ccagcgccagggcccaggccauguggccugcccagccucaaugucacuugguggcggggugg

SEQ ID NO: 731287 - RNA, 62 nt, Homo Sapiens
gcaccggaagacucacuuugucugcccugcgccagccucaccucacccugcaguucccguuu

SEQ ID NO: 731288 - RNA, 62 nt, Homo Sapiens
gagccccacagccccaagcuaccuucgcgucucagccucaggagucacggcccagacugggc

SEQ ID NO: 731289 - RNA, 62 nt, Homo Sapiens
accgcaucccaccuccugccgcugcccagccccagccucaccugccaccuuguacaaagccg

SEQ ID NO: 731290 - RNA, 62 nt, Homo Sapiens
gaccaagaaccaucugcgaauguuuauauaagcagccucaagcaccuccgcccagccuguaa

SEQ ID NO: 731291 - RNA, 62 nt, Homo Sapiens
agagcuugcugcacccaggcgcugcauguacucagccucaggggcugugugccggccuucuu

SEQ ID NO: 731292 - RNA, 62 nt, Homo Sapiens
ccggcagguccuauguccuucaagggcaucuccagccucaggagucaccaaggcuucagccc

SEQ ID NO: 731293 - RNA, 62 nt, Homo Sapiens
guccugggcucaaaugaucccacggcucacugcagccucagcgagugcaguggugccaucac

SEQ ID NO: 731294 - RNA, 62 nt, Homo Sapiens
ucaucucugucacucuggaagcucaccuugagcagccucagacagugcccaugucccuucca

SEQ ID NO: 731295 - RNA, 62 nt, Homo Sapiens
cuuaacuucguguucacacuggggcucugaagcagccucacucuggauggacacaugggcca

SEQ ID NO: 731296 - RNA, 62 nt, Homo Sapiens
ccauggcacuuugaggggguggccaauuaguucagccucagaccgcugccuagcaucugcuu

SEQ ID NO: 731297 - RNA, 62 nt, Homo Sapiens
cugaaggcuuuuuuuuggcuauuuguguucuucagccucagcuguaauccacagacaacucu

SEQ ID NO: 731298 - RNA, 62 nt, Homo Sapiens
ucuuauuuccucaacguugcagugauaucccccagccucaagggccuggggagauggaggaa

SEQ ID NO: 731299 - RNA, 62 nt, Homo Sapiens
ugcugcugccccucuaggucccaggaagcccacagccucaccucccagcccuaaacccugcc

SEQ ID NO: 731300 - RNA, 62 nt, Homo Sapiens
ucauaacuauaugaacuuuaguugacacuucucagccucaauugguuucagcaugguauuga

SEQ ID NO: 731301 - RNA, 62 nt, Homo Sapiens
aaugugcugagauuucucugaaaaauaacaggcagccucaagacguacaucauuauuaauau

SEQ ID NO: 731302 - RNA, 62 nt, Homo Sapiens
gccacacgggggaagcagaguguggcuucaaccagccucacacacacgccccucuacugcua

SEQ ID NO: 731303 - RNA, 62 nt, Homo Sapiens
ccccugcuucagucccuucccuccggccucuccagccucagccgccccaucugccccacagu

SEQ ID NO: 731304 - RNA, 62 nt, Homo Sapiens
ccguggcaggugauguguccaucagcucccaucagccucauuacagcagccauugcacgugc

SEQ ID NO: 731305 - RNA, 62 nt, Homo Sapiens
ggaggaucuggaggauccacuccucccuucuccagccucagggaaaugccuuaauuucacuc

SEQ ID NO: 731306 - RNA, 62 nt, Homo Sapiens
gacaucagcccuugggggucgccaggacucugcagccucagaagggggcuggaggagcccag

SEQ ID NO: 731307 - RNA, 62 nt, Homo Sapiens
cucccuaacuccauuugaacacaaaugacuuacagccucaucauuuccuaggauaaaaauaa

SEQ ID NO: 731308 - RNA, 62 nt, Homo Sapiens
cuauuuaacuuugcucucagagugcuugcgaccagccucauugaggaccgccaccucuuccc

SEQ ID NO: 731309 - RNA, 62 nt, Homo Sapiens
gaucucccuucucaucucccaggagccucauccagccucagagugagcaccaccagggcucc

SEQ ID NO: 731310 - RNA, 62 nt, Homo Sapiens
uccagggcuaaggacucucgucagcccagaggcagccucagcggccacguacagccagcggg

SEQ ID NO: 731311 - RNA, 62 nt, Homo Sapiens
cagacccccugcccugucuugcaggcaucggacagccucaucaugcaccaucacuguggcug

SEQ ID NO: 731312 - RNA, 62 nt, Homo Sapiens
agccacuucagaccagccagcacugcuacacucagccucaugagcucccucagucuggcacc

SEQ ID NO: 731313 - RNA, 62 nt, Homo Sapiens
ccaggcagugggucuucccucuugccucagagcagccucauccagguaggauacguacaccu

SEQ ID NO: 731314 - RNA, 62 nt, Homo Sapiens
uggaaggggaaaagucagggcgccguguucuucagccucagcagagcgaugauggacuugag

SEQ ID NO: 731315 - RNA, 62 nt, Homo Sapiens
gccucuuggcccagggccaggucucuggcccccagccucaguacagccuuccucaggccccu

SEQ ID NO: 731316 - RNA, 62 nt, Homo Sapiens
ugagucuuuuuggucugcacugagcugcguuccagccucagcugggagcgagaaaccccagc

SEQ ID NO: 731317 - RNA, 62 nt, Homo Sapiens
caccccaccugggcccagccgcccucgauggacagccucaccgagcccacgcccccccaaga

SEQ ID NO: 731318 - RNA, 62 nt, Homo Sapiens
gcccaggcuggaggcccugccucgcugcuugccagccucaccugcuggggcuggaggccaug

SEQ ID NO: 731319 - RNA, 62 nt, Homo Sapiens
ccacacagaggaggaagacagcagccuggcagcagccucaccgaagagaggaaccaccacac

SEQ ID NO: 731320 - RNA, 62 nt, Homo Sapiens
uacuuucugcgugguggaaaccauugcauauucagccucauuucaagaguguuuccuucuca

SEQ ID NO: 731321 - RNA, 62 nt, Homo Sapiens
acugaagcaggaaggcagagcaucaucuuguucagccucagcugggaacauguguacugggu

SEQ ID NO: 731322 - RNA, 62 nt, Homo Sapiens
acuuucacccuaaacgacacuuccuccccagccagccucacucugucuccggcccgcagcag

SEQ ID NO: 731323 - RNA, 62 nt, Homo Sapiens
ggucacaguggguggcagguccuuaguccuuucagccucagagaaaugauggggaaaggagu

SEQ ID NO: 731324 - RNA, 62 nt, Homo Sapiens
ggugcaagauuuaaaauuaccacggcgacacacagccucagucagccuggcuguggaguuuc

SEQ ID NO: 731325 - RNA, 62 nt, Homo Sapiens
gggaaauccaggguaggaagagguggcccauucagccucaaggcuauuuuugugacccacau

SEQ ID NO: 731326 - RNA, 62 nt, Homo Sapiens
auuuuaugagggccacgggucuguguucgacucagccucagggacgacucugaccucuuggc

SEQ ID NO: 731327 - RNA, 62 nt, Homo Sapiens
cucacuugcccacaccgagggcgaccccgucacagccucaagucacucccaagcccccuccu

SEQ ID NO: 731328 - RNA, 62 nt, Homo Sapiens
agaaucgccuaccugugccugcguguaaaccacagccucagaccagcuauggggagaggaca

SEQ ID NO: 731329 - RNA, 62 nt, Homo Sapiens
gccccucccggcgccugcccacccuccacccacagccucacggguccaggacuuggcguguu

SEQ ID NO: 731330 - RNA, 62 nt, Homo Sapiens
gcaccuccaccuuccgggcucaagcgauucuccagccucagccuccugaguagcuaggacug

SEQ ID NO: 731331 - RNA, 62 nt, Homo Sapiens
aauguugggcaacaacucagccagccugauggcagccucagaggcuuacucuaacccauccc

SEQ ID NO: 731332 - RNA, 62 nt, Homo Sapiens
ugccccuguucuucacacugccccccaugccucagccucauacagaugugccaucauggggg

SEQ ID NO: 731333 - RNA, 62 nt, Homo Sapiens
ucaauguaagcaaugugggaaagccgucagaucagccucaagacuucaaaugcauggaagca

SEQ ID NO: 731334 - RNA, 62 nt, Homo Sapiens
caccaggggaggugggguuuggugagagacgccagccucagacuuuuucccacugagggucc

SEQ ID NO: 731335 - RNA, 62 nt, Homo Sapiens
gggcugcuggagaagucuccucccguucggaccagccucagggcugcacguuaccucaggaa

SEQ ID NO: 731336 - RNA, 62 nt, Homo Sapiens
cagccgcagccaaacccggcugccucccaccccagccucaaaaccucuuccugacgaccccc

SEQ ID NO: 731337 - RNA, 62 nt, Homo Sapiens
acucccugcuucccuggaagcuucaggaagcucagccucagccuucaggccugagcaagugc

SEQ ID NO: 731338 - RNA, 62 nt, Homo Sapiens
ggguggaucaccugaggucaggaguucaagaccagccucaacauggagaaaccccaucucua

SEQ ID NO: 731339 - RNA, 62 nt, Homo Sapiens
uuggaaguggugggugcccaggacggugccuccagccucaacagugggcauggacaggguua

SEQ ID NO: 731340 - RNA, 62 nt, Homo Sapiens
uccccuucccaguccauaaaaaccccggaccccagccucauacugggcaacuuauuuggauc

SEQ ID NO: 731341 - RNA, 62 nt, Homo Sapiens
ccaccaugcgggccucagguggcagagaggcccagccucacaggccuguggccccacacacc

SEQ ID NO: 731342 - RNA, 62 nt, Homo Sapiens
cccuucccuaaucaccucuccugccccuagcucagccucauccccaacuccaugccugucuc

SEQ ID NO: 731343 - RNA, 54 nt, Homo Sapiens; identical to SEQ ID NO: 730625

SEQ ID NO: 731344 - RNA, 62 nt, Homo Sapiens
gacaaggcuucucuguccgcccuucacaccuccagccucacguucacuuaggcacaucacac

SEQ ID NO: 731345 - RNA, 62 nt, Homo Sapiens
ugaccccacuccaggaccuaggcccagccccucagccucaucuggagccccugaagaccagu

SEQ ID NO: 731346 - RNA, 62 nt, Homo Sapiens
cacgaugagcugugagcaccgcgcaccugccacagccucagaggcccgcacaaugaccggag

SEQ ID NO: 731347 - RNA, 62 nt, Homo Sapiens
gugcugggauuacaggcaugaaccauggugcccagccucauuuuugaaauggaauagagaac

SEQ ID NO: 731348 - RNA, 62 nt, Homo Sapiens
ccggccauuugcugcccuccccaccccugccccagccucaggacugcaggagccauccgccc

SEQ ID NO: 731349 - RNA, 62 nt, Homo Sapiens
agugaaugugggaaagucuuuagauacaacuccagccucauuaaacaucggagaauucacac

SEQ ID NO: 731350 - RNA, 62 nt, Homo Sapiens
ggcagcagcugccgguggugugguggccgcggcagccucaguggcagcggcgcccagcuccc

SEQ ID NO: 731351 - RNA, 62 nt, Homo Sapiens
aggaacaaggcccccagagguugugcgagaugcagccucagacgccccauucaccuguggau

SEQ ID NO: 731352 - RNA, 62 nt, Homo Sapiens
uuccugggcucaagcgaucccauggcucacugcagccucaaacugaagugcgguggugcaau

SEQ ID NO: 731353 - RNA, 62 nt, Homo Sapiens
auuucuggcuggauuuccacagacaaucuuuucagccucagccuggcuaccaggaaacucgg

SEQ ID NO: 731354 - RNA, 62 nt, Homo Sapiens
gucaacguauuuccccucucgauacaucugaccagccucaaccggccacacacagcaagaaa

SEQ ID NO: 731355 - RNA, 62 nt, Homo Sapiens
cucccaaagugcugggauuacuugugauccaccagccucagcgauggucuugaucuccugac

SEQ ID NO: 731356 - RNA, 62 nt, Homo Sapiens
uucugggcggacagcuugucgugugcccaagucagccucauagccuuugggguauuccccua

SEQ ID NO: 731357 - RNA, 62 nt, Homo Sapiens
ucgcugccacuucgccgcuggcgggucuccuccagccucacuucccccagcccucccuccug

SEQ ID NO: 731358 - RNA, 62 nt, Homo Sapiens
cacugcagggccaggcucuccucccgagcccccagccucaccucaggcggaugaggucccua

SEQ ID NO: 731359 - RNA, 62 nt, Homo Sapiens
aguagcuggaauuacaggcaauucuccugccucagccucacgcugccucccggguucaagug

SEQ ID NO: 731360 - RNA, 62 nt, Homo Sapiens
ugucaguuucaaaucugcuuucagaauuuuuccagccucauuccuuacuuccagcuugcaca

SEQ ID NO: 731361 - RNA, 62 nt, Homo Sapiens
cacaccgugugccuuacuccagagggggaugucagccucaccccugcuccaggaugaaacca

SEQ ID NO: 731362 - RNA, 62 nt, Homo Sapiens
ugguggugucuccguccuuaccagcuuuguugcagccucagccccacuccacacacucccug

SEQ ID NO: 731363 - RNA, 62 nt, Homo Sapiens
cagggcagggagggggacucuggucacugcuccagccucagcucaaagcuucuguggcuucg

SEQ ID NO: 731364 - RNA, 62 nt, Homo Sapiens
gcagaauagagguauuuuuaaauccucuggcccagccucaugugguacuuucucuuccuggu

SEQ ID NO: 731365 - RNA, 62 nt, Homo Sapiens
cuccccaggaccccuguccaucauccaggccucagccucaucugaaaccaaaaagagacuga

SEQ ID NO: 731366 - RNA, 62 nt, Homo Sapiens
guggccugaggcccagagggccuccuugggugcagccucagaacccucugucccuacugauu

SEQ ID NO: 731367 - RNA, 62 nt, Homo Sapiens
cccugccuuuccuuuacuuuuccgagggggcgcagccucaaaaccgcgccgcggaagggggc

SEQ ID NO: 731368 - RNA, 62 nt, Homo Sapiens
gcagagcaaggguuguuuggaaaucaguacgacagccucagacccccggcucagaucuuugc

SEQ ID NO: 731369 - RNA, 62 nt, Homo Sapiens
ggcccucagcacuuuguguuaugacugucucucagccucacgcaccccccucauuaucuacc

SEQ ID NO: 731370 - RNA, 62 nt, Homo Sapiens
ccuguggugggcuuuuuaagucccucccucaccagccucaccgucccuguccccaccuccag

SEQ ID NO: 731371 - RNA, 62 nt, Homo Sapiens
cuucuggccucaagugaucccauaacucacugcagccucaaacuggagugcaguggcaugau

SEQ ID NO: 731372 - RNA, 62 nt, Homo Sapiens
ccugccucugguucccgccuggcugugacccccagccucacaucuccacagacccagccucc

SEQ ID NO: 731373 - RNA, 62 nt, Homo Sapiens
uccaggcaggagcacgagguagacccuggacccagccucagaaaaacgaucuaaagguaggc

SEQ ID NO: 731374 - RNA, 62 nt, Homo Sapiens
gguguggcuucuguggcuuucugcccaggcagcagccucaugaggaggguauucugggccuu

SEQ ID NO: 731375 - RNA, 62 nt, Homo Sapiens
gguucccgcccuggaccucccucguagggucccagccucaauagggcacgggguaggggguu

SEQ ID NO: 731376 - RNA, 62 nt, Homo Sapiens
auggggcuguucucuaggaaugcuccccuagacagccucagacuacugaagugacuuauggu

SEQ ID NO: 731377 - RNA, 62 nt, Homo Sapiens
accauggacacacgucaucagaaaccaaacugcagccucaaccgugugucuguaaaaugugu

SEQ ID NO: 731378 - RNA, 62 nt, Homo Sapiens
caggugggccuguauauaggcaagagucccgccagccucagcgcagggauccaagaaugugc

SEQ ID NO: 731379 - RNA, 62 nt, Homo Sapiens
gccaaugggcugaaagguucuggcugccugggcagccucauucucagauuugaccaggccuc

SEQ ID NO: 731380 - RNA, 62 nt, Homo Sapiens
ccaaacgcagugcccuguucugccgguguguacagccucagcgcaccaggagacccuagagu

SEQ ID NO: 731381 - RNA, 62 nt, Homo Sapiens
gcuccuuguccccucccacccgccucaugacccagccucacagacccucucaggccucugac

SEQ ID NO: 731382 - RNA, 62 nt, Homo Sapiens
aguauguuucuuucugccccguugaagaggugcagccucaggcugagaaacacugauagacc

SEQ ID NO: 731383 - RNA, 62 nt, Homo Sapiens
cucacugccccacauucucccaguggcucuaccagccucacccaucaaaccagugaauuucu

SEQ ID NO: 731384 - RNA, 62 nt, Homo Sapiens
gcugagucucuaucauagcugaacccugaggacagccucauagcucauguaucagggacuuu

SEQ ID NO: 731385 - RNA, 62 nt, Homo Sapiens
ugacugccaggcagaaaggacagggcccaggucagccucagucugcugugccuccagacugc

SEQ ID NO: 731386 - RNA, 62 nt, Homo Sapiens
uuuucccuuuguucuugaacacuuuugcccugcagccucaguuuugaauucuuuuagcaacu

SEQ ID NO: 731387 - RNA, 62 nt, Homo Sapiens
gggcuggggccggggcugagggugcccuuuuccagccucagccuacuccgcucacugaacuc

SEQ ID NO: 731388 - RNA, 62 nt, Homo Sapiens
gaucaaguugaggggcuuccggcucccuucuacagccucagaaaccagacucguucuucugg

SEQ ID NO: 731389 - RNA, 62 nt, Homo Sapiens
aagagaaucguacgucgacuuucgauuuuucacagccucagccuaggaaaaaugguucaugg

SEQ ID NO: 731390 - RNA, 62 nt, Homo Sapiens
ccaggacaccacaugggagggggcucaggccucagccucaagaucuucagcuguggccucuc

SEQ ID NO: 731391 - RNA, 62 nt, Homo Sapiens
gaacgaggaccuggacucagagccagacagggcagccucagacccuucucuggggcuccugg

SEQ ID NO: 731392 - RNA, 62 nt, Homo Sapiens
guugcuucacccgcugcagagcacacgcaacccagccucagcaucacagccgcagcucuguu

SEQ ID NO: 731393 - RNA, 62 nt, Homo Sapiens
cccggcugcugcauuuagguacaaagauaaaccagccucaauuaguuccucaucacaaaaga

SEQ ID NO: 731394 - RNA, 62 nt, Homo Sapiens
ggaaagcacccuugucuggggacauccaaugacagccucagggcaauaaucaacauuuacca

SEQ ID NO: 731395 - RNA, 62 nt, Homo Sapiens
gccugcuuauugccucuuuccggggcugaggucagccucacuccggucaccucggccgggcc

SEQ ID NO: 731396 - RNA, 53 nt, Homo Sapiens; identical to SEQ ID NO: 730678

SEQ ID NO: 731397 - RNA, 62 nt, Homo Sapiens
ucuuaaaugacuaggaauuuuucucccauucccagccucauuggccuugucuuccaguuccu

SEQ ID NO: 731398 - RNA, 62 nt, Homo Sapiens
ugagucaccuuccaaguuguuucccucauugacagccucaccauugccaccagcaugcggga

SEQ ID NO: 731399 - RNA, 62 nt, Homo Sapiens
ucuacuguuaggugagggaguaaaguuguuuucagccucauguagggguagcccuguccagg

SEQ ID NO: 731400 - RNA, 62 nt, Homo Sapiens
uccuuugcccuuccuccugcagcuuucccgcccagccucacucaccugggugucugggcuca

SEQ ID NO: 731401 - RNA, 62 nt, Homo Sapiens
uucccccacagcagcacgggugcugaggcucccagccucaguagacucuugacaccggucuc

SEQ ID NO: 731402 - RNA, 62 nt, Homo Sapiens
aacugugcagagaccuacagggcagucagcaccagccucagcggccuugagaggacccugca

SEQ ID NO: 731403 - RNA, 62 nt, Homo Sapiens
ugggcugggaccuaggaagccccaauaucugacagccucaggaucucuagccagugcuuagg

SEQ ID NO: 731404 - RNA, 62 nt, Homo Sapiens
ugugcugggacgacccuugucuuaacgagucacagccucagcauucuagagaacuaaacugg

SEQ ID NO: 731405 - RNA, 62 nt, Homo Sapiens
uucuuuucuuagaagaagcuuuuaaccuugcccagccucaguaaaaguaccaggagcuagcu

SEQ ID NO: 731406 - RNA, 54 nt, Homo Sapiens; identical to SEQ ID NO: 730688

SEQ ID NO: 731407 - RNA, 62 nt, Homo Sapiens
ccugcaggcgguauccagagcagagcucagcacagccucacccuccguccuggcagggcagg

SEQ ID NO: 731408 - RNA, 62 nt, Homo Sapiens
cuacugauucaaaugcuaaucucuuccagaaacagccucacagacacacccagacaucuggu

SEQ ID NO: 731409 - RNA, 62 nt, Homo Sapiens
aacucuagaugacaagagcaccucaaaggcagcagccucaaggagcagccauggccccagac

SEQ ID NO: 731410 - RNA, 62 nt, Homo Sapiens
cuggagugcaguggcacaaucacaguucacugcagccucaaccucuccagauucaagugauc

SEQ ID NO: 731411 - RNA, 62 nt, Homo Sapiens
ucuuccccuaaaagaggccgugauauuugcagcagccucaaauugcucuuaagggguuuagg

SEQ ID NO: 731412 - RNA, 62 nt, Homo Sapiens
uccccacucugcccguccaccuucccuggcuccagccucauucucucuuuaguuuaacuaug

SEQ ID NO: 731413 - RNA, 62 nt, Homo Sapiens
ucccugccaguccuuggaccucccagcccacccagccucagcacagcucaacacagaaggag

SEQ ID NO: 731414 - RNA, 62 nt, Homo Sapiens
cucugauuagauaaucuuuuccaacucaaaaccagccucauguucuguuaacugaagauauu

SEQ ID NO: 731415 - RNA, 62 nt, Homo Sapiens
cucccuggcucaagcgaucccacagcucacggcagccucaacgcugagugcacuggcaggau

SEQ ID NO: 731416 - RNA, 62 nt, Homo Sapiens
uuacccguaaaugcacuagcaggcuucccucccagccucaguccaccuccccauacagagag

SEQ ID NO: 731417 - RNA, 62 nt, Homo Sapiens
acagcucagcacagaaggagucccagcccacccagccucagcucccugccaguccuuggacc

SEQ ID NO: 731418 - RNA, 62 nt, Homo Sapiens
agccgccuagccaagacugcagggauggcccgcagccucaucggggccaaggacacacgccu

SEQ ID NO: 731419 - RNA, 62 nt, Homo Sapiens
cccaccucucgccccucaucuugguaauuagccagccucagauacuucugugggcccugaag

SEQ ID NO: 731420 - RNA, 62 nt, Homo Sapiens
uccuugcagugaagccaccaugggugaccguccagccucacccgguggccugcacagugagg

SEQ ID NO: 731421 - RNA, 62 nt, Homo Sapiens
gaggccucccggaacaaaagcggaagaggggccagccucaucccacugccagcugacccuca

SEQ ID NO: 731422 - RNA, 62 nt, Homo Sapiens
uuauuuuuguuggagccacucuguuccuggcucagccucaaaugcaguauuuuuguuguguu

SEQ ID NO: 731423 - RNA, 62 nt, Homo Sapiens
uuucaucuccucugugggaggacacaucucugcagccucaagaguuaggcagagacucaagu

SEQ ID NO: 731424 - RNA, 62 nt, Homo Sapiens
cacuccaugccacccccaccagcuggaggacccagccucacaguguguccuuugugccagac

SEQ ID NO: 731425 - RNA, 62 nt, Homo Sapiens
cuucaaguuaacaggaucagacaccagucaagcagccucaggucaucuugcgacuccacuga

SEQ ID NO: 731426 - RNA, 62 nt, Homo Sapiens
ugccucaaaaauucaccaagcagaaugccucucagccucauguguugguccucugcuccucc

SEQ ID NO: 731427 - RNA, 62 nt, Homo Sapiens
gggucugguaccagggguuguuacugaggugacagccucacacggggcccgcagaggugccc

SEQ ID NO: 731428 - RNA, 62 nt, Homo Sapiens
acccaggauaggaaaugggucagaggcagucccagccucagaagggcagucccucagaaucc

SEQ ID NO: 731429 - RNA, 62 nt, Homo Sapiens
guaugggaaacccuuuccccuggaagaucucgcagccucaguacccuagccugaggcuccac

SEQ ID NO: 731430 - RNA, 62 nt, Homo Sapiens
ccaucuggcagagucccaggaauguggaacugcagccucagccuuggggcugcugggguugg

SEQ ID NO: 731431 - RNA, 62 nt, Homo Sapiens
ugacccgaucggacagugccucccgcgcgcugcagccucaugcgccugcagggggcgcugca

SEQ ID NO: 731432 - RNA, 62 nt, Homo Sapiens
gaggcucaggacacggccacagaccaucugcccagccucacuuacgccccauggaggcuccg

SEQ ID NO: 731433 - RNA, 62 nt, Homo Sapiens
uuugcagccccugagaaggcucaaccccucaacagccucagccuaggggccccaaguucaac

SEQ ID NO: 731434 - RNA, 62 nt, Homo Sapiens
acauccgacaccucccagcggucccugacuaacagccucagcuucuguuucagcaaaucuca

SEQ ID NO: 731435 - RNA, 62 nt, Homo Sapiens
ggagauggggagguuagagaugaggaaaugcucagccucagucugugcccccggccaggccc

SEQ ID NO: 731436 - RNA, 62 nt, Homo Sapiens
ccugcagaagguuugugacgcugcuauccccacagccucauuucuguugggcccaguggccc

SEQ ID NO: 731437 - RNA, 62 nt, Homo Sapiens
uggggcucucagcaccaaaggggccuccuccacagccucagccagacaccagaccaggucca

SEQ ID NO: 731438 - RNA, 62 nt, Homo Sapiens
cucuauggcaaggcccugcucgaagaugaggccagccucagcgaauccuacuccuaugaccc

SEQ ID NO: 731439 - RNA, 62 nt, Homo Sapiens
cugguggacuucgaguacagagaaaaugcugacagccucaugaucuugcugcucucagagcc

SEQ ID NO: 731440 - RNA, 62 nt, Homo Sapiens
gcagggccugagggagccccuggcuuuccccucagccucaggaaagguggucaggaaaacuc

SEQ ID NO: 731441 - RNA, 62 nt, Homo Sapiens
cuggagugcagugacguggucauagcucacugcagccucaaccuccugggcucaagugaccc

SEQ ID NO: 731442 - RNA, 62 nt, Homo Sapiens
uggugaguuggggggcagggguugucuugggccagccucaguuuuugucaggccaugaaucc

SEQ ID NO: 731443 - RNA, 62 nt, Homo Sapiens
gugcugggauuauaggcgugagccacugugcccagccucacagcugcaucuuaaccuuaccu

SEQ ID NO: 731444 - RNA, 62 nt, Homo Sapiens
uucuaccucccagaucggaucuguugcaaacucagccucaauaagccuugucguugacuuua

SEQ ID NO: 731445 - RNA, 62 nt, Homo Sapiens
gaagaaaggagggacccggaacuugggccaaucagccucaccuugucccaguccacuccuaa

SEQ ID NO: 731446 - RNA, 62 nt, Homo Sapiens
caaccuccaccucccggauucaagugauucuccagccucagccuccugaguagcugggauua

SEQ ID NO: 731447 - RNA, 62 nt, Homo Sapiens
ggaguuguggguccugcccagaguccagagagcagccucagcugagcacagguccgaggggg

SEQ ID NO: 731448 - RNA, 62 nt, Homo Sapiens
agaaguuacagaaacuaaagccaaugacuuaacagccucauuauugucaaccuucuacacag

SEQ ID NO: 731449 - RNA, 62 nt, Homo Sapiens
ccugccccugugggacucaucccuggggaucacagccucaccacaugagaucagggccugcc

SEQ ID NO: 731450 - RNA, 62 nt, Homo Sapiens
cacuuaccuggagcugcucuuggagagcauuacagccucauccaccuggggacucacguagc

SEQ ID NO: 731451 - RNA, 62 nt, Homo Sapiens
cuucacuccugauugaggccaaggcagcuccccagccucacugaggacccuggaaggacagc

SEQ ID NO: 731452 - RNA, 62 nt, Homo Sapiens
gcuagccacaaagcccccagugaagugcccuccagccucagacugaaggauuuagacgggga

SEQ ID NO: 731453 - RNA, 62 nt, Homo Sapiens
gugcaccgacuaguugcuugcaguucuggccucagccucaaaccuuuguagugcuuucggcc

SEQ ID NO: 731454 - RNA, 62 nt, Homo Sapiens
cccaggcacugauuguggcaaggccacaagcucagccucaggcgagccaggucaggcuucgg

SEQ ID NO: 731455 - RNA, 62 nt, Homo Sapiens
gccacuugacauuccuugucggccuugcccgccagccucaguacgugagagaaucugccugu

SEQ ID NO: 731456 - RNA, 62 nt, Homo Sapiens
uucuuaccaauuuccccaacuauguugcacaucagccucauuuucccccuuuauuggaaugc

SEQ ID NO: 731457 - RNA, 64 nt, Homo Sapiens
cgagguggcagcguggagggcucggcguggauggcagccucaggacacacaccccugccucaag

SEQ ID NO: 731458 - RNA, 64 nt, Homo Sapiens
aagaggaagccucggccucccugagcucugaccccagccucacccgaaaggccagccuggggcu

SEQ ID NO: 731459 - RNA, 64 nt, Homo Sapiens
ugcugaggucccgggcuuagugugagcaucuugccagccucaggcuugagggagggcugggcua

SEQ ID NO: 731460 - RNA, 64 nt, Homo Sapiens; identical to SEQ ID NO: 110836

SEQ ID NO: 731461 - RNA, 64 nt, Homo Sapiens; identical to SEQ ID NO: 110837

SEQ ID NO: 731462 - RNA, 64 nt, Homo Sapiens
cugcacuacggccauucuccucuugggcgcuccucagccucacugugaccuuucugccagagcu

SEQ ID NO: 731463 - RNA, 64 nt, Homo Sapiens
ugguuuggaccuaacaucucgcacgugacucccucagccucagagccuugggaugcagagcagc

SEQ ID NO: 731464 - RNA, 52 nt, Homo Sapiens; identical to SEQ ID NO: 730028

SEQ ID NO: 731465 - RNA, 64 nt, Homo Sapiens
aguggaagcccucuuuccccaaauccuacucccucagccucaggcaguggugcucccaucuucc

SEQ ID NO: 731466 - RNA, 64 nt, Homo Sapiens
cagaaaaagaacucaaccaauuuggcaccccaugcagccucaaaauguuucaaaugccuaccgc

SEQ ID NO: 731467 - RNA, 64 nt, Homo Sapiens
uacccaagcuucaaggaagugcuugggggacccccagccucauccucuuaguugggucucuugu

SEQ ID NO: 731468 - RNA, 64 nt, Homo Sapiens
cgcucuugacccugcauauccaggaaggaacugccagccucagaggaggcagcaccgagggugc

SEQ ID NO: 731469 - RNA, 64 nt, Homo Sapiens
gccugcucagcagccagucucagagaccagcacucagccucauucagcauggguccuugaugcc

SEQ ID NO: 731470 - RNA, 64 nt, Homo Sapiens
cggccccagcuggagcuggcugagagcaguccugcagccucauuccuuaguucccggagcuggc

SEQ ID NO: 731471 - RNA, 64 nt, Homo Sapiens
uggucucuguuccccagcccaccuggcucacacacagccucauggguagggucagcaaaccaga

SEQ ID NO: 731472 - RNA, 64 nt, Homo Sapiens
gccgaggcugcccccucacccagaagucugagcccagccucaggaggggccaagaaccaggggg

SEQ ID NO: 731473 - RNA, 64 nt, Homo Sapiens
ugaauuucaggcuggaaaacuaucaguaugaucucagccucaguucucuugucuguaaaaugga

SEQ ID NO: 731474 - RNA, 64 nt, Homo Sapiens
ucugacuacuuaccacaucaaaucugggcccaaacagccucaguuaacugcauaauucaggaac

SEQ ID NO: 731475 - RNA, 64 nt, Homo Sapiens
agugaugucucuacuugcucuaugagccuuuugccagccucagaauaggcgagguaaccuugaa

SEQ ID NO: 731476 - RNA, 64 nt, Homo Sapiens
uccggaucucuguggggcucuucaccaauuuuuccagccucauuuauaguaaacaaauuguucu

SEQ ID NO: 731477 - RNA, 64 nt, Homo Sapiens
ggugagauggaaucuuagaucgucccccaugugccagccucauucgaauucuacucuuugguua

SEQ ID NO: 731478 - RNA, 52 nt, Homo Sapiens; identical to SEQ ID NO: 730042

SEQ ID NO: 731479 - RNA, 59 nt, Homo Sapiens; identical to SEQ ID NO: 730043

SEQ ID NO: 731480 - RNA, 64 nt, Homo Sapiens
uugucuguauuucugugugguuguagcaaggacucagccucauguagcacgaauaggggugugg

SEQ ID NO: 731481 - RNA, 64 nt, Homo Sapiens
ccuccgccucccgguucaagccauucuucugccucagccucagcgaguagcugagacuaccggc

SEQ ID NO: 731482 - RNA, 64 nt, Homo Sapiens
acccugugccagaagcaacagaggugccaggccucagccucacccacagcagccccaucgccaa

SEQ ID NO: 731483 - RNA, 64 nt, Homo Sapiens
gaaaccaaagaaaugaagcuggcaagcuacuuuucagccucaagcuuuacacagcuguccuuac

SEQ ID NO: 731484 - RNA, 64 nt, Homo Sapiens
accacucccaccacaggcauaagcuaucaccuagcagccucaaaacgggucaguauuaagguuu

SEQ ID NO: 731485 - RNA, 64 nt, Homo Sapiens
cucuguagcuccuccugacaaacgucugggaaaacagccucaccccacucuccucucucuuccc

SEQ ID NO: 731486 - RNA, 64 nt, Homo Sapiens
aucuaaaccagaaggaagcccucucagaucaccccagccucacuccauuucccacuuccacccc

SEQ ID NO: 731487 - RNA, 64 nt, Homo Sapiens
ugggacuuugucccuucuaauuauuaucucuuuccagccucauucagcuauucuuacugacaua

SEQ ID NO: 731488 - RNA, 64 nt, Homo Sapiens
uuuuuucuaaauauaauaaaaacuuaccuggcaucagccucauaccuaaaacuccugacucuua

SEQ ID NO: 731489 - RNA, 64 nt, Homo Sapiens
acacacacacuggcacagggaggcuacaacuaagcagccucagaucuguaaaguugauuggugc

SEQ ID NO: 731490 - RNA, 64 nt, Homo Sapiens
uuccuggcgaugagccauuuauugugucucacaccagccucauuuccaacuccgacuuccuacu

SEQ ID NO: 731491 - RNA, 64 nt, Homo Sapiens
auaacuuuauccugcuauaacuuuauccucuucccagccucaucccuguuuuucuguuagggca

SEQ ID NO: 731492 - RNA, 64 nt, Homo Sapiens
cuugucugcaaacaggucccugccuuuuuagaagcagccucauggucucaugcuuaaucuuguc

SEQ ID NO: 731493 - RNA, 64 nt, Homo Sapiens; identical to SEQ ID NO: 110838

SEQ ID NO: 731494 - RNA, 64 nt, Homo Sapiens; identical to SEQ ID NO: 110839

SEQ ID NO: 731495 - RNA, 64 nt, Homo Sapiens
gguccuuguugcucuaacaguccagauguacacccagccucagggggaaggcagcucucuccag

SEQ ID NO: 731496 - RNA, 64 nt, Homo Sapiens
ccgcucccuugugauuucugagggucaccacugccagccucaggcaacauagagagccuccugu

SEQ ID NO: 731497 - RNA, 64 nt, Homo Sapiens
aggccagagaggggcagguagaccugcauagcagcagccucagcagcugucuugguaaaggaga

SEQ ID NO: 731498 - RNA, 64 nt, Homo Sapiens
uguggccugucuguccuccucccuaauucagacccagccucaagaggaaagggaguaaaauaaa

SEQ ID NO: 731499 - RNA, 64 nt, Homo Sapiens
gcaggagucccacuccuccacccaaaacuggggucagccucaggucccaucagaaccuggcagc

SEQ ID NO: 731500 - RNA, 64 nt, Homo Sapiens
auuugacuaccuauguacuauugguagacacccucagccucaucagcucuguggcguuguguua

SEQ ID NO: 731501 - RNA, 64 nt, Homo Sapiens
agugugcauagaccauuuccuucucaagucuaaccagccucagcuagaguuuauugucaauugc

SEQ ID NO: 731502 - RNA, 64 nt, Homo Sapiens
acucacaagcugugugacuucugggcucaaauuccagccucacccugccuuggguucagcccau

SEQ ID NO: 731503 - RNA, 64 nt, Homo Sapiens
gugcccugauucacacacugcacuuucaccagagcagccucacuauggggcuauaggagccucc

SEQ ID NO: 731504 - RNA, 64 nt, Homo Sapiens
gaugcuggccucuuggcaccaucaagagucucuccagccucacaagaaguaacucccacuccua

SEQ ID NO: 731505 - RNA, 64 nt, Homo Sapiens
accacccugcuguccaguccacagugccucccugcagccucaacguucuaugccuaguggagcc

SEQ ID NO: 731506 - RNA, 64 nt, Homo Sapiens; identical to SEQ ID NO: 110840

SEQ ID NO: 731507 - RNA, 64 nt, Homo Sapiens; identical to SEQ ID NO: 110841

SEQ ID NO: 731508 - RNA, 50 nt, Homo Sapiens; identical to SEQ ID NO: 730072

SEQ ID NO: 731509 - RNA, 64 nt, Homo Sapiens
acccugaauguggggcucuguagugagccagaagcagccucauaaucugucuaccaacuccuca

SEQ ID NO: 731510 - RNA, 64 nt, Homo Sapiens
ucuaggguaugggaaauccaauaggaccaggauccagccucacugguggaaucuuuagcgcuca

SEQ ID NO: 731511 - RNA, 64 nt, Homo Sapiens; identical to SEQ ID NO: 110842

SEQ ID NO: 731512 - RNA, 64 nt, Homo Sapiens; identical to SEQ ID NO: 110843

SEQ ID NO: 731513 - RNA, 64 nt, Homo Sapiens
caagcagaaacacuccuguguguuauggagggagcagccucacauguugccgucagccgaacuu

SEQ ID NO: 731514 - RNA, 64 nt, Homo Sapiens
ucuccuucgagcuuuguaaaaccagcacaaacgacagccucaaggccccuguggcuagaggaac

SEQ ID NO: 731515 - RNA, 64 nt, Homo Sapiens
uuuacaaaugccuugguauguggaacuuuaccagcagccucagccagccuuaaaaagggcuucu

SEQ ID NO: 731516 - RNA, 64 nt, Homo Sapiens
uuucacacuucagcccuuaauguaucugcacuugcagccucagcuaaucuuuuuuuuuuuuuuu

SEQ ID NO: 731517 - RNA, 64 nt, Homo Sapiens
uuugaccugucucauuuccccagaacaccaucuccagccucagcucgccagaggguggggcugg

SEQ ID NO: 731518 - RNA, 64 nt, Homo Sapiens
uagcauuacccuucugacacgucuggcccaccuccagccucagcaguuuccauggcccuggaug

SEQ ID NO: 731519 - RNA, 64 nt, Homo Sapiens
agaagaagcagccaugcccauguaucacuccaagcagccucagcuucuggccaagauuuccuuc

SEQ ID NO: 731520 - RNA, 64 nt, Homo Sapiens
aacgcccucaagaacaugauucccccagcagaaccagccucaaaagcuccggccugcugucaag

SEQ ID NO: 731521 - RNA, 64 nt, Homo Sapiens
ccaccuuccuuccaucaaaauuucugcuaugcaccagccucacuucugcaaccacacagggaua

SEQ ID NO: 731522 - RNA, 64 nt, Homo Sapiens
ggucagccucgccucccagcucacaugguauugccagccucacuaccuucccaggugggcccac

SEQ ID NO: 731523 - RNA, 64 nt, Homo Sapiens
acucagugaguucaucaggguaggacauuguagccagccucagcugguauuacuuccccucuga

SEQ ID NO: 731524 - RNA, 64 nt, Homo Sapiens
uccccaggugaggggcggguauagguagucaaggcagccucaucccaagcugucucaucaccaa

SEQ ID NO: 731525 - RNA, 64 nt, Homo Sapiens
cccugcuggaauuggggcugaaacacaucauucccagccucagggaaccauaaccaccccuggg

SEQ ID NO: 731526 - RNA, 64 nt, Homo Sapiens
ggagaugcuugguguggggacaguggagcacaugcagccucaguucaucccuaggaggacccac

SEQ ID NO: 731527 - RNA, 64 nt, Homo Sapiens
acugaaggagauuguugaccauuaacccccagaccagccucagauccuuaacccccaaguaauc

SEQ ID NO: 731528 - RNA, 64 nt, Homo Sapiens
gaugcccugguggccucuccugucuuccgauuagcagccucaggcauguugacugugagcaaag

SEQ ID NO: 731529 - RNA, 64 nt, Homo Sapiens; identical to SEQ ID NO: 110844

SEQ ID NO: 731530 - RNA, 64 nt, Homo Sapiens; identical to SEQ ID NO: 110845

SEQ ID NO: 731531 - RNA, 64 nt, Homo Sapiens
caguccuuuaaccagcacagccaguuaaaagaugcagccucacugcuucaacgcagauuuuaau

SEQ ID NO: 731532 - RNA, 64 nt, Homo Sapiens
ugcaaccucugccuccuggguucaagugauucuccagccucagccucccgaguagcugggauua

SEQ ID NO: 731533 - RNA, 64 nt, Homo Sapiens; identical to SEQ ID NO: 110846

SEQ ID NO: 731534 - RNA, 64 nt, Homo Sapiens; identical to SEQ ID NO: 110847

SEQ ID NO: 731535 - RNA, 64 nt, Homo Sapiens
uagcaaaccuguuaguuuuacuucugcauugaaccagccucagaagcuacuuacugcuuuaugu

SEQ ID NO: 731536 - RNA, 64 nt, Homo Sapiens
aagugcugggauugcaggcaugagccaccgugcccagccucaaaaauauuuuuuaaaagaaaag

SEQ ID NO: 731537 - RNA, 64 nt, Homo Sapiens
auccaugacccccaagcagauauaacaagcugugcagccucaguaggcugcuugcccucuccag

SEQ ID NO: 731538 - RNA, 64 nt, Homo Sapiens
uuguuuuuuguguggaacagcucaccuugucagacagccucagggcaucucugagacacagggg

SEQ ID NO: 731539 - RNA, 64 nt, Homo Sapiens
caccaaccccaucucccacucagaaaucaccucccagccucaggaagaguagaaauuggguggu

SEQ ID NO: 731540 - RNA, 64 nt, Homo Sapiens
ugaccccucaggagggauugcaggccccagguggcagccucagagaggaggcgcaggcaggccc

SEQ ID NO: 731541 - RNA, 64 nt, Homo Sapiens
cccuuuugcuuuucagugucuucucagaaacaaccagccucaaagguaauuaaacucucauuua

SEQ ID NO: 731542 - RNA, 64 nt, Homo Sapiens
gcuggcagggccgccuucagaggcugcagggccucagccucaggaugcauuuaauguauccugg

SEQ ID NO: 731543 - RNA, 64 nt, Homo Sapiens
uuggauccuuugagguaaaaaaacauaaugucuucagccucauaauaaaggaaaguuaauuaaa

SEQ ID NO: 731544 - RNA, 64 nt, Homo Sapiens
aagccagccuucuuccaucccaggacaccacacccagccucaguccuccccucacagccucuga

SEQ ID NO: 731545 - RNA, 64 nt, Homo Sapiens
ccugccguuggaccuucaccuccuagagauaaaccagccucagcuggcgcagcggggcccuucu

SEQ ID NO: 731546 - RNA, 64 nt, Homo Sapiens
gugugagggucaccggcaggugggcugguggcugcagccucagagcccucccagguugcugcug

SEQ ID NO: 731547 - RNA, 64 nt, Homo Sapiens
cccgcacagcccugcaccccgccccugggguuggcagccucaguuggccccuggcagaggaaca

SEQ ID NO: 731548 - RNA, 64 nt, Homo Sapiens
ggguuucuucaugguggggggccauuuggaaugacagccucacuuccuucugauggcuacaucu

SEQ ID NO: 731549 - RNA, 64 nt, Homo Sapiens
auuuauaguugaauuuuugcuuuuguaugaaaaucagccucauuauaagguuuauuucugugag

SEQ ID NO: 731550 - RNA, 64 nt, Homo Sapiens
cccagccccagccccaguggccugccaguuuccccagccucagcuuccucucucccuccuacca

SEQ ID NO: 731551 - RNA, 64 nt, Homo Sapiens
ucuuuguucuaaagauggaaugagccaccgcgcccagccucaucaagugcugggauuacaggga

SEQ ID NO: 731552 - RNA, 64 nt, Homo Sapiens
cgacaauucacggaacuguucugcaggaaauggccagccucaaaacuucuugucuggaagaguu

SEQ ID NO: 731553 - RNA, 64 nt, Homo Sapiens; identical to SEQ ID NO: 110848

SEQ ID NO: 731554 - RNA, 64 nt, Homo Sapiens; identical to SEQ ID NO: 110849

SEQ ID NO: 731555 - RNA, 64 nt, Homo Sapiens
cccauuccccugagagcaaggcaaccagccucuucagccucacauguuugucugugaguuacgg

SEQ ID NO: 731556 - RNA, 64 nt, Homo Sapiens
uaaagguguaccuuccaugucucccuuucuguaacagccucaaaagguuugaguucuggguauc

SEQ ID NO: 731557 - RNA, 64 nt, Homo Sapiens
aacauggccuuuucucucucgugcuuugagugugcagccucacauagaaauccgcaagcugggu

SEQ ID NO: 731558 - RNA, 64 nt, Homo Sapiens
gaauuaccccucccaaaaugauacacaaggaaagcagccucaaaauguugcuaaauagauuaua

SEQ ID NO: 731559 - RNA, 64 nt, Homo Sapiens
ugcaggcauuuuugaguggccauuuuuaaaugcucagccucaaguuuuguuacauaugaacauu

SEQ ID NO: 731560 - RNA, 64 nt, Homo Sapiens
ugaauugcuuucauagcuuuauugccucaugaagcagccucauuaaauaaugccauaagucuag

SEQ ID NO: 731561 - RNA, 64 nt, Homo Sapiens
caacaacaauguguuguaaacuaucuuuguguugcagccucaacgugauggaacaagagaagua

SEQ ID NO: 731562 - RNA, 64 nt, Homo Sapiens
aaaagugguugugauugcaaaauuagggaacgcacagccucacaaaagacugaaaauucauugc

SEQ ID NO: 731563 - RNA, 64 nt, Homo Sapiens
uguaagcagcacugccucucaaaugccauugucacagccucauuuaacuggcacugucauuugu

SEQ ID NO: 731564 - RNA, 64 nt, Homo Sapiens
gggaacacgggacagacgccacgccugggcguggcagccucacaaggucucgagacgcacaugc

SEQ ID NO: 731565 - RNA, 64 nt, Homo Sapiens
cauguggggaccacggaaggcacugguccuaugccagccucaccagguguuuacugugcugcug

SEQ ID NO: 731566 - RNA, 64 nt, Homo Sapiens
ucuaguaaaaaagguaggaaaucccuaaaacuuccagccucacauagcacgguucucaccuguc

SEQ ID NO: 731567 - RNA, 64 nt, Homo Sapiens; identical to SEQ ID NO: 110850

SEQ ID NO: 731568 - RNA, 64 nt, Homo Sapiens; identical to SEQ ID NO: 110851

SEQ ID NO: 731569 - RNA, 64 nt, Homo Sapiens
ggcccuggccagaagcaggagugugaggaggagacagccucagcggacaagcagcuggugcucc

SEQ ID NO: 731570 - RNA, 64 nt, Homo Sapiens
ugugaauucuagcaaccuuuguuaggaaaaagcacagccucagauggaggcagccuaaacugug

SEQ ID NO: 731571 - RNA, 64 nt, Homo Sapiens
cauuucagcuguuucaccaucagucaaugaauaacagccucauugaugucaaaaacuucaauau

SEQ ID NO: 731572 - RNA, 64 nt, Homo Sapiens
caccauguuggccaggcuggucuugaacuccuggcagccucaagugauccacccaccucggucu

SEQ ID NO: 731573 - RNA, 64 nt, Homo Sapiens
ugugccagagggguuggccaguuggagccugggucagccucagcagccuauccccauguccucu

SEQ ID NO: 731574 - RNA, 64 nt, Homo Sapiens
agcauuuagugcacaguggccccaucauagccugcagccucaucauuucccaucuggaccuggu

SEQ ID NO: 731575 - RNA, 64 nt, Homo Sapiens
cucucaaagcuaauuuuuuacuaaaguuuuuauacagccucaaauuguuuuauuaaaaaaaaga

SEQ ID NO: 731576 - RNA, 64 nt, Homo Sapiens
aaguccacgcagguggcuuguagaaaccuuugggcagccucaugucugcuaaaacagccaucuu

SEQ ID NO: 731577 - RNA, 64 nt, Homo Sapiens
aaggaaagguaauuuuaagcuaacaaccagugcacagccucagguuuuaaauuacaaccacagu

SEQ ID NO: 731578 - RNA, 64 nt, Homo Sapiens
caugacccagcccuauuuuacgucauucuaaauucagccucauauaaugaaaauacauuaugaa

SEQ ID NO: 731579 - RNA, 64 nt, Homo Sapiens
ggcuggagugcaguggcacaaugacgacucacugcagccucaaccuccuggggccaagugaucc

SEQ ID NO: 731580 - RNA, 64 nt, Homo Sapiens
ggaugggaccuuuguaggaagagacacaguccugcagccucauauggcucaauaaaacagaaag

SEQ ID NO: 731581 - RNA, 64 nt, Homo Sapiens; identical to SEQ ID NO: 110852

SEQ ID NO: 731582 - RNA, 64 nt, Homo Sapiens; identical to SEQ ID NO: 110853

SEQ ID NO: 731583 - RNA, 64 nt, Homo Sapiens
ugaucccaguccagacgggugcugccggcucagccagccucacgcugcuaggaaauggcucccu

SEQ ID NO: 731584 - RNA, 64 nt, Homo Sapiens
ggaaaccuccuacccaugucugagguagcaagugcagccucacgacagauaccaggcaauccag

SEQ ID NO: 731585 - RNA, 64 nt, Homo Sapiens
auaaguagggaacauggcagagaguggugcuucccagccucacaaugugggaauuugacauagg

SEQ ID NO: 731586 - RNA, 64 nt, Homo Sapiens
aaaggauucuuucaacuucuuuccauggagaauccagccucacacuuaggccauucuccuucuc

SEQ ID NO: 731587 - RNA, 64 nt, Homo Sapiens
caggcacguaccugcugaccaguggcugacaggccagccucacugccagagauggaggagcccc

SEQ ID NO: 731588 - RNA, 64 nt, Homo Sapiens
uucccacaggcucauacucagucauggguaguaccagccucaaagagacauacaaggacagugg

SEQ ID NO: 731589 - RNA, 64 nt, Homo Sapiens
cuuguauuuaguuuggggaaaacaugcacaaccacagccucaauaauacaugcaugcacaugaa

SEQ ID NO: 731590 - RNA, 64 nt, Homo Sapiens
ucuugagaggauaagacucuccuggccgggugggcagccucaggggaugacagcccagugucgg

SEQ ID NO: 731591 - RNA, 64 nt, Homo Sapiens
ccuugcagccaguaagaaauuaguugcaccagggcagccucagcagccgcagcagugacuacaa

SEQ ID NO: 731592 - RNA, 64 nt, Homo Sapiens
gaauaugcaacaacuccugucugcuucccgacaccagccucaugaaccuggcaacugugagucc

SEQ ID NO: 731593 - RNA, 64 nt, Homo Sapiens
ccaagcuucuaccugccuuuugaggcaucucaggcagccucagcucucuguggaccagagugcu

SEQ ID NO: 731594 - RNA, 64 nt, Homo Sapiens
gacaaauaggcuucaucauguaaaggcagagccccagccucagaugacuggagcagaauaaguc

SEQ ID NO: 731595 - RNA, 64 nt, Homo Sapiens
caaccaugagggauaguaugaucucaucagcaggcagccucaugcuucauuuaaguuggcuuga

SEQ ID NO: 731596 - RNA, 64 nt, Homo Sapiens
ggguccuucuggaaccagcuccuacccggaagaccagccucagaagaacccucccacagcacau

SEQ ID NO: 731597 - RNA, 64 nt, Homo Sapiens
gaucuuugcaacacuccaacugagaauguggaugcagccucacagcaucacuguauacucuugc

SEQ ID NO: 731598 - RNA, 64 nt, Homo Sapiens
cagggaccaaccggcugcuuaguaaugucuuccucagccucaaccccaaguauuuccagcagga

SEQ ID NO: 731599 - RNA, 64 nt, Homo Sapiens
caugucuuaacaaaaugacaucuuaucuggagcucagccucaauuguguaccguaaagaauaua

SEQ ID NO: 731600 - RNA, 64 nt, Homo Sapiens
uuacagacagcccccugagggcagggugccaccacagccucauuuggcccuuauggugcccugu

SEQ ID NO: 731601 - RNA, 64 nt, Homo Sapiens
accuuucugcuggggcugaagcagugccuuccuccagccucacaugggacuggaugugccgugg

SEQ ID NO: 731602 - RNA, 64 nt, Homo Sapiens
ccuucacaagauggaaggcauccugcagguagagcagccucauuuggcccuccuggcuucagca

SEQ ID NO: 731603 - RNA, 64 nt, Homo Sapiens
uucucacuugcugugggugaucuuggagaagacacagccucaccgggacuauuaaggguguuag

SEQ ID NO: 731604 - RNA, 60 nt, Homo Sapiens; identical to SEQ ID NO: 730168

SEQ ID NO: 731605 - RNA, 64 nt, Homo Sapiens
agaucaacggaccaaauaaaaagauuuaagaacucagccucacuaauuuuuaacuuggggguga

SEQ ID NO: 731606 - RNA, 64 nt, Homo Sapiens
cuccuggguuuaagcaguccaucacaguucauugcagccucaaccagaguacaggucugguaca

SEQ ID NO: 731607 - RNA, 64 nt, Homo Sapiens
uuacacuugguuacucaaaacgaaacacacaaaccagccucaacucacacaaaaggaacaaaag

SEQ ID NO: 731608 - RNA, 64 nt, Homo Sapiens
ugaaugugucacuacucacacuuaccuagauuuacagccucacuucuucagguucuuaguguca

SEQ ID NO: 731609 - RNA, 64 nt, Homo Sapiens
ugauccucgcaucucagccuuggucucaaacccccagccucaacucucaccauguugcccaggc

SEQ ID NO: 731610 - RNA, 64 nt, Homo Sapiens
cuccaccugcuggguucaagcaauucuccugccucagccucaugaguagcugugacuacaggca

SEQ ID NO: 731611 - RNA, 64 nt, Homo Sapiens
cugcagaagcugcauuucagcugaaucuguguuucagccucaguugguugcaccguuagccccu

SEQ ID NO: 731612 - RNA, 64 nt, Homo Sapiens
acgucacagaagcgaaggcuugaugcugucucagcagccucagcugugggggggaagcgcgugu

SEQ ID NO: 731613 - RNA, 64 nt, Homo Sapiens; identical to SEQ ID NO: 110854

SEQ ID NO: 731614 - RNA, 64 nt, Homo Sapiens; identical to SEQ ID NO: 110855

SEQ ID NO: 731615 - RNA, 64 nt, Homo Sapiens
auuuuuguaauauuuguccacuaagcuggagaagcagccucauacaguugauuuuguguaugug

SEQ ID NO: 731616 - RNA, 64 nt, Homo Sapiens
ccagcuugggcaauucagggcagaacuccuguaucagccucauggacacccagaauugguaucu

SEQ ID NO: 731617 - RNA, 64 nt, Homo Sapiens
uggacagcccaaccucuggcagaccagggguuaccagccucacagcugcagcugccuucaagcc

SEQ ID NO: 731618 - RNA, 64 nt, Homo Sapiens
uccccgcccugggcagcagggcugccagucccuccagccucacccccugccccagcagacacag

SEQ ID NO: 731619 - RNA, 64 nt, Homo Sapiens
caagucauccccgacaugaccggccccugccacccagccucaugcacuagguaugugcaguucc

SEQ ID NO: 731620 - RNA, 64 nt, Homo Sapiens
gacugcacacccccuugccucagcagcaccacuccagccucagagaagaacgggaccuagggga

SEQ ID NO: 731621 - RNA, 64 nt, Homo Sapiens
gagcuaauaaagggaaacgaugugcaguacacaucagccucacuuuccugugauuuuuuuuaaa

SEQ ID NO: 731622 - RNA, 64 nt, Homo Sapiens
cccucuguguguguugaccaagaacucggauucccagccucacuacauuggcagucgaggaguc

SEQ ID NO: 731623 - RNA, 64 nt, Homo Sapiens
aucauguuaaagagggaguucuagaaacugggggcagccucaaauauaauauucuuuuuuuuuu

SEQ ID NO: 731624 - RNA, 64 nt, Homo Sapiens
agcagacucugaagccggagggagcccucccgcucagccucagacuggugaccggagagaaaga

SEQ ID NO: 731625 - RNA, 64 nt, Homo Sapiens
ccucugccucccggguucaagcaauuucuugccucagccucaugaauagcugggauuacaggug

SEQ ID NO: 731626 - RNA, 64 nt, Homo Sapiens
aggaaucaaaaguauuuuauaaaaggagaaagaacagccucauuuuagauguaguccuguugga

SEQ ID NO: 731627 - RNA, 64 nt, Homo Sapiens
ugcaaccuccgccucccggguucaagcgauucuccagccucagcuuccugaguagaugggauua

SEQ ID NO: 731628 - RNA, 64 nt, Homo Sapiens
ccucugccucccggguucaagcaauucccugccucagccucaugaauagcugggauuacaggug

SEQ ID NO: 731629 - RNA, 64 nt, Homo Sapiens
gcucucccugucuccaacuccaguaagcccuccucagccucaccuuacgaauccaaagaacugg

SEQ ID NO: 731630 - RNA, 64 nt, Homo Sapiens
gacuagaguacaauauugcaaucacagcucacugcagccucaaacuccugggcucaagugaucc

SEQ ID NO: 731631 - RNA, 64 nt, Homo Sapiens
cacuagcggguuggggguggugguggggugcuggcagccucaggagcgaucgcuccccuggaga

SEQ ID NO: 731632 - RNA, 64 nt, Homo Sapiens
auuguggggcucauaaaacaugaaucaagcaauccagccucaugggaaguccuggcacaguuuu

SEQ ID NO: 731633 - RNA, 64 nt, Homo Sapiens
ggcuggagugcgcuggcuugaucuuggcucacugcagccucaauguccccaggcucagauuguc

SEQ ID NO: 731634 - RNA, 64 nt, Homo Sapiens
aggaacguggucaacucacaccugccucuuccugcagccucacuucuaccugcccccaucauaa

SEQ ID NO: 731635 - RNA, 64 nt, Homo Sapiens
guucccauguacagacacgguccccacacccucccagccucaggcccaggcagacaugggcgag

SEQ ID NO: 731636 - RNA, 64 nt, Homo Sapiens
uaaaauggggcugugugcaugcaggcccauguuucagccucagcccacgccaggugaaaggauc

SEQ ID NO: 731637 - RNA, 64 nt, Homo Sapiens
auuuuugagugugccaggguaaaggcuuccaguucagccucaguuauuuuagacaaucucgcca

SEQ ID NO: 731638 - RNA, 64 nt, Homo Sapiens
gucucccuugaguucaggugcccugaacucaguacagccucaucuucucauccaccaccuucuc

SEQ ID NO: 731639 - RNA, 64 nt, Homo Sapiens
uccacggccuccugaacguccguccucaggagcacagccucacggacagugccaaacccugugg

SEQ ID NO: 731640 - RNA, 64 nt, Homo Sapiens
ccaagacauugucucugucggccaggcuggagugcagccucaaccuccuggguccaagugaucc

SEQ ID NO: 731641 - RNA, 64 nt, Homo Sapiens
cuugaaagacgguguuuggugagggagcauggcacagccucacaacccagcgccccuccucccu

SEQ ID NO: 731642 - RNA, 64 nt, Homo Sapiens
uuccucuacccaucuucuuuaguggccuggacaacagccucagcaccccgugccaggacucagc

SEQ ID NO: 731643 - RNA, 64 nt, Homo Sapiens
acaauuuuggacaaagcuagaaaagguaauugaccagccucaacuuaaucuuacucccagcacc

SEQ ID NO: 731644 - RNA, 64 nt, Homo Sapiens
gguauggcacucuuaauuaaaggacauacuuuuccagccucaugcucaguuuuuagcccuugag

SEQ ID NO: 731645 - RNA, 64 nt, Homo Sapiens
ggagcucuacccugcucccugggcgaugcucccucagccucagaaaggaaagugggguccuucg

SEQ ID NO: 731646 - RNA, 64 nt, Homo Sapiens
cagguacgcuguacauuuuuuaguccugacacugcagccucaagcugggccaaggaacaccccc

SEQ ID NO: 731647 - RNA, 64 nt, Homo Sapiens
gugacuccacaguggccccucuuauggccggucacagccucagucugccacgggcucuccuggg

SEQ ID NO: 731648 - RNA, 64 nt, Homo Sapiens
ccucccacccccauacugguccgccuucacuccacagccucacccuuagucucugcccuauacg

SEQ ID NO: 731649 - RNA, 64 nt, Homo Sapiens; identical to SEQ ID NO: 110856

SEQ ID NO: 731650 - RNA, 64 nt, Homo Sapiens; identical to SEQ ID NO: 110857

SEQ ID NO: 731651 - RNA, 64 nt, Homo Sapiens
uuauggaaaagggaugccacacuauucauauuaucagccucauucugaaccaaaauuagauuca

SEQ ID NO: 731652 - RNA, 64 nt, Homo Sapiens
uacaccccaggagcccuggcagaagccccagccccagccucaucugcagccaggugcccaggac

SEQ ID NO: 731653 - RNA, 64 nt, Homo Sapiens
cccuugucuacuuguucuccggcauuccccuggccagccucagcucucagcccaugcccuggag

SEQ ID NO: 731654 - RNA, 50 nt, Homo Sapiens; identical to SEQ ID NO: 110858

SEQ ID NO: 731655 - RNA, 64 nt, Homo Sapiens; identical to SEQ ID NO: 110859

SEQ ID NO: 731656 - RNA, 64 nt, Homo Sapiens; identical to SEQ ID NO: 110860

SEQ ID NO: 731657 - RNA, 64 nt, Homo Sapiens; identical to SEQ ID NO: 110861

SEQ ID NO: 731658 - RNA, 64 nt, Homo Sapiens
ugggaagauccuuggcugccgcuuucucuccccacagccucaaggccacccuaccgucauauau

SEQ ID NO: 731659 - RNA, 64 nt, Homo Sapiens
gacccuagggaagaagcaagaaacuucggggcugcagccucaggaugaggcagaaggaagggua

SEQ ID NO: 731660 - RNA, 64 nt, Homo Sapiens
gggagauggucucucuucucaaguaggaacaccccagccucagacagacacagcaggaaggggc

SEQ ID NO: 731661 - RNA, 64 nt, Homo Sapiens
ucccaacagcccacuguuaggagguaguagaccccagccucaaggcucugaccuucuucaugug

SEQ ID NO: 731662 - RNA, 64 nt, Homo Sapiens
uuucaccauguuacucaggcuggucucaaacucccagccucaagcgaugcucccaccuccaccu

SEQ ID NO: 731663 - RNA, 64 nt, Homo Sapiens
uaauugcucacccaagggggcugcuuaacacaaacagccucagacccgagguuuagauuucuga

SEQ ID NO: 731664 - RNA, 64 nt, Homo Sapiens
gcugaucucgaacucccgaccucaggugauccgccagccucagccucccaaagugcugggauua

SEQ ID NO: 731665 - RNA, 64 nt, Homo Sapiens
ugcaaccuccgccuccuggguucaagcgauucuccagccucagccuccugaguagcuggaauua

SEQ ID NO: 731666 - RNA, 64 nt, Homo Sapiens; identical to SEQ ID NO: 110862

SEQ ID NO: 731667 - RNA, 64 nt, Homo Sapiens; identical to SEQ ID NO: 110863

SEQ ID NO: 731668 - RNA, 64 nt, Homo Sapiens; identical to SEQ ID NO: 110864

SEQ ID NO: 731669 - RNA, 64 nt, Homo Sapiens
accagccuguugcuguacuuuucugcuuauuuuacagccucaaauauuucucauuaucuuguca

SEQ ID NO: 731670 - RNA, 64 nt, Homo Sapiens
acccagccccucaggaacccucauccuucaaagacagccucauuucggacuaaacucauuagag

SEQ ID NO: 731671 - RNA, 64 nt, Homo Sapiens
uauuuucuuucucaccauagaucggcgggugcugcagccucacuguguucuguguacgugacaa

SEQ ID NO: 731672 - RNA, 64 nt, Homo Sapiens
uguuguguaauugugacacaauuacagcugauugcagccucaaccuucccagcucaagugaucc

SEQ ID NO: 731673 - RNA, 64 nt, Homo Sapiens
cuaauuuugcuugcucauauuucuggccaauguacagccucauauuuuucagaguaauacagau

SEQ ID NO: 731674 - RNA, 64 nt, Homo Sapiens
uaugugacucuuguuacagaucauggcggugcgucagccucacaggagacauagcaggucucag

SEQ ID NO: 731675 - RNA, 64 nt, Homo Sapiens
uuagauggaaaaguguagggacugagaagggcugcagccucagcaguguacagaguccccggcg

SEQ ID NO: 731676 - RNA, 64 nt, Homo Sapiens
cuuacagcucucagccuaagagcgcagcacugaacagccucaucauuccacuuuucaugggaaa

SEQ ID NO: 731677 - RNA, 64 nt, Homo Sapiens
gcaucuuucucuucccaugccgcugccuccucagcagccucacugaagcugcucacugcucaca

SEQ ID NO: 731678 - RNA, 64 nt, Homo Sapiens
gcugaaguugccugaaugaucccucacagaugcccagccucauaagaacagccugagccuucag

SEQ ID NO: 731679 - RNA, 64 nt, Homo Sapiens
aacaauaaaaacaaugguagccaggcggcacugacagccucagugggaaaaaguguuagugcuu

SEQ ID NO: 731680 - RNA, 64 nt, Homo Sapiens
cgaguggcuuauagccuccauucuacccauaccucagccucaggcugaggguggugaugguagu

SEQ ID NO: 731681 - RNA, 64 nt, Homo Sapiens
ccagaaauauuauuuuuuuacacagaggagaccucagccucacacccuucagcuuggguacaca

SEQ ID NO: 731682 - RNA, 64 nt, Homo Sapiens
guccacucaggcacaagagccagucuggccuccccagccucaagcccuuccaugaaugaccccu

SEQ ID NO: 731683 - RNA, 64 nt, Homo Sapiens
gaaacucuuagguuaagcagguuagcacagcgggcagccucagugaacaugccgugugccuuua

SEQ ID NO: 731684 - RNA, 64 nt, Homo Sapiens
aacaaacauuuccuaaauggugaauuuauuuugucagccucagcuaaaugacaugauuaaauga

SEQ ID NO: 731685 - RNA, 64 nt, Homo Sapiens
uuguauuaaaugauauuuuggauuagauuuauagcagccucaaguauguauaguuacgaugcca

SEQ ID NO: 731686 - RNA, 64 nt, Homo Sapiens
ugcuugagacuuuguguguaucaaacuccagcuccagccucauuuugggucagauaaaugaaga

SEQ ID NO: 731687 - RNA, 64 nt, Homo Sapiens
agaauaaaugacuugcuuuuaagugccacuaaaacagccucagggagggucauucuugucacaa

SEQ ID NO: 731688 - RNA, 64 nt, Homo Sapiens
auuauguagggaccuuaugcgccucuucucguuucagccucaguccuugcuuuuacaguggaca

SEQ ID NO: 731689 - RNA, 64 nt, Homo Sapiens
acaaaugucguugagguuacugaguuguaguccacagccucaggugaccuacuuguaauuaacu

SEQ ID NO: 731690 - RNA, 64 nt, Homo Sapiens
aacuuccuuuucaaagcaguuuaagaaggaaaugcagccucaguuacccaguggcagucucagg

SEQ ID NO: 731691 - RNA, 64 nt, Homo Sapiens
uuguccacacacacaucucacgccccuggucucacagccucacaccuuguccuuccaccccugc

SEQ ID NO: 731692 - RNA, 64 nt, Homo Sapiens
guugcaaacagcgcaauuccaagcucgagagcuucagccucaggaaagaacuuccccuucccug

SEQ ID NO: 731693 - RNA, 64 nt, Homo Sapiens; identical to SEQ ID NO: 110865

SEQ ID NO: 731694 - RNA, 64 nt, Homo Sapiens; identical to SEQ ID NO: 110866

SEQ ID NO: 731695 - RNA, 64 nt, Homo Sapiens
cagagaugugugcuccuggagggaaaaagaaauacagccucaacagauuaaaaaacaaaaguca

SEQ ID NO: 731696 - RNA, 64 nt, Homo Sapiens
ccaacaaaacugugucuuaucugccaggaaagaccagccucacuccugggaacugucuggcagg

SEQ ID NO: 731697 - RNA, 64 nt, Homo Sapiens
aagagaggcggaacugcuguguccucauguggcgcagccucaaacuggcauccaggcacugggc

SEQ ID NO: 731698 - RNA, 64 nt, Homo Sapiens
uauagauuuuauuauguuaguuuaaaaggucaaucagccucaugacuuuauaguuaugucuugu

SEQ ID NO: 731699 - RNA, 64 nt, Homo Sapiens
cgaaggcuuaugggucuccagaaacucugccagccagccucaguggagaagcuuccucuaccac

SEQ ID NO: 731700 - RNA, 64 nt, Homo Sapiens
agucaaggucccuugaaucccaaaagugccuccccagccucagcccccaccuccagccacacac

SEQ ID NO: 731701 - RNA, 61 nt, Homo Sapiens; identical to SEQ ID NO: 730265

SEQ ID NO: 731702 - RNA, 64 nt, Homo Sapiens
gauccuaaguaagaacauaauguaaaauugucagcagccucauggggaggaaaaaggaagaguc

SEQ ID NO: 731703 - RNA, 64 nt, Homo Sapiens
ccuguccucacuggugcuccaggggaagaaacgacagccucacuucuguauggacugcugaugu

SEQ ID NO: 731704 - RNA, 64 nt, Homo Sapiens
cuggaaacguugggguuucuuccuccagugacagcagccucaguagcuuuccugggcuccaggc

SEQ ID NO: 731705 - RNA, 64 nt, Homo Sapiens
cggcuccaugcucaccagcagccgcccaggcccgcagccucacccggcucccucuccucacccu

SEQ ID NO: 731706 - RNA, 64 nt, Homo Sapiens
ucauuccaacaccugccauacaaacagaggaggccagccucaccuagaggaauaaagcugugag

SEQ ID NO: 731707 - RNA, 64 nt, Homo Sapiens
acugugugacccugggucugggagcccucagugccagccucauccugcagggugugaugaggug

SEQ ID NO: 731708 - RNA, 64 nt, Homo Sapiens
gucagagcaguggagacuggugcuuugccugccucagccucaugugcucauccccuuauaaaug

SEQ ID NO: 731709 - RNA, 64 nt, Homo Sapiens
ggccaaagcaucagcaccagcgagaugccgaccucagccucacaguugcuguaauugaacgggu

SEQ ID NO: 731710 - RNA, 64 nt, Homo Sapiens
ggccaaagcaucagcaccagacacuucucuagcucagccucacacaccggcacaucuaacaucu

SEQ ID NO: 731711 - RNA, 64 nt, Homo Sapiens
gugagccccgggcccaggcucucagugcccagcccagccucaaguucaugggcucgugagcaca

SEQ ID NO: 731712 - RNA, 64 nt, Homo Sapiens; identical to SEQ ID NO: 110867

SEQ ID NO: 731713 - RNA, 61 nt, Homo Sapiens; identical to SEQ ID NO: 110868

SEQ ID NO: 731714 - RNA, 64 nt, Homo Sapiens
cuggcgucuggacuguucugugguauuggaauagcagccucacagaaagucaggcuagcugugc

SEQ ID NO: 731715 - RNA, 64 nt, Homo Sapiens
cagagcagccacgacagccaaggguggagcgcgccagccucagcaccugcgaaguccagagucc

SEQ ID NO: 731716 - RNA, 64 nt, Homo Sapiens
cccugccccuccagcccacagggcgguguggcugcagccucagucuccaggggagggugcgugg

SEQ ID NO: 731717 - RNA, 54 nt, Homo Sapiens; identical to SEQ ID NO: 730281

SEQ ID NO: 731718 - RNA, 64 nt, Homo Sapiens
uacauaaugucacccauuuucucuuaauaggaugcagccucacaauggaucuggagucucugaa

SEQ ID NO: 731719 - RNA, 64 nt, Homo Sapiens
ucuaccuggacacucauccagaaaucucagggcacagccucaggacagugcugggagaugauca

SEQ ID NO: 731720 - RNA, 64 nt, Homo Sapiens
ccuggccccuugacacaucccaugugguucccugcagccucaugcauuugguuucacuaagggc

SEQ ID NO: 731721 - RNA, 64 nt, Homo Sapiens
uuugcucucaaugucaugcaaguccuuuaguccccagccucaccuugugugacucccuucaggc

SEQ ID NO: 731722 - RNA, 54 nt, Homo Sapiens; identical to SEQ ID NO: 730286

SEQ ID NO: 731723 - RNA, 64 nt, Homo Sapiens
uaguuuuguuaaaaaaaaaaaaaaaaaaaggaaacagccucacuuuuuugugcucccucagaau

SEQ ID NO: 731724 - RNA, 64 nt, Homo Sapiens
ggggagcuacaggggcacuuaacccaccacagcacagccucaucaaaaugcagcuggcaacuuc

SEQ ID NO: 731725 - RNA, 64 nt, Homo Sapiens
aaccauacuucuuuuuuuuccucugaugugaauccagccucagacugagugaacuguaauaauu

SEQ ID NO: 731726 - RNA, 64 nt, Homo Sapiens
cuagugcuagucccagaggaugcugcggagggggcagccucagcucucuuuucagagaagauca

SEQ ID NO: 731727 - RNA, 64 nt, Homo Sapiens
gcggaaggaucaccugagccuaggaguucaagaccagccucagcaacagcaggagccccacccc

SEQ ID NO: 731728 - RNA, 64 nt, Homo Sapiens
cgccuacuguccaugcggccucacugggggccaucagccucaccagcaaagcagagaugagagc

SEQ ID NO: 731729 - RNA, 64 nt, Homo Sapiens
gguugcagugagccaagaucgcgccacugcacuccagccucagcaauagagugagacugucuca

SEQ ID NO: 731730 - RNA, 64 nt, Homo Sapiens
ggcuagagugcaguggcaugaucagggcuuacugcagccucacccucgauuuccugggcucaag

SEQ ID NO: 731731 - RNA, 64 nt, Homo Sapiens
gaaaagaaaacgaaaacaguuuaaaucucuaccacagccucacaagcaaaugcuaaggggaaca

SEQ ID NO: 731732 - RNA, 64 nt, Homo Sapiens
gccaggccucacauucguggggcucccugaauggcagccucagcacagcguaggcccuuaauaa

SEQ ID NO: 731733 - RNA, 64 nt, Homo Sapiens
ugaaaggagaggaguagaugagauggaauuuuuccagccucauccuggccugcccucuagacuc

SEQ ID NO: 731734 - RNA, 64 nt, Homo Sapiens
agaggugggcgcauagguacaagugcugcuuugucagccucacucccugcagcucucagcuccc

SEQ ID NO: 731735 - RNA, 64 nt, Homo Sapiens
uugccacagaggccucccagggcucucggccagucagccucagaaugagaguuacaccacuggc

SEQ ID NO: 731736 - RNA, 64 nt, Homo Sapiens; identical to SEQ ID NO: 110869

SEQ ID NO: 731737 - RNA, 64 nt, Homo Sapiens; identical to SEQ ID NO: 110870

SEQ ID NO: 731738 - RNA, 64 nt, Homo Sapiens
cuccugggcucaagcaauccaucauagcucacugcagccucauaggcuggagugcaguggcaug

SEQ ID NO: 731739 - RNA, 64 nt, Homo Sapiens
gugacuuucucagaggugacggcagaggagagugcagccucacaggaugauggaggugacauca

SEQ ID NO: 731740 - RNA, 64 nt, Homo Sapiens
cauccuugcccuucucaggguccugugacguggucagccucauuccccgucacucuuggaggac

SEQ ID NO: 731741 - RNA, 64 nt, Homo Sapiens
gcucagaaggugccaguccgcugugcaggacgcucagccucaggcuuugccuuugcugggccuu

SEQ ID NO: 731742 - RNA, 64 nt, Homo Sapiens
aacacagugaaacuccaucucgggaguuugagaccagccucaucgcagguggauugcuugagcu

SEQ ID NO: 731743 - RNA, 64 nt, Homo Sapiens
aaagcuccaagcccuuuggggguuggaagaugcucagccucacagcaaaccagugcaugcaccu

SEQ ID NO: 731744 - RNA, 56 nt, Homo Sapiens; identical to SEQ ID NO: 730308

SEQ ID NO: 731745 - RNA, 64 nt, Homo Sapiens
aaguagauuagaaaacuagacuaaaaaaaaaauccagccucauaaauauuuuaaauuagcuuuu

SEQ ID NO: 731746 - RNA, 64 nt, Homo Sapiens
uaauucuggauaaugcugggagcaaguaauaaagcagccucauucuuguaugcaugcauuuuca

SEQ ID NO: 731747 - RNA, 64 nt, Homo Sapiens
caaguuuagacaaguggauuuuuuacaaugcacacagccucaugacccaaaacucuuuauggca

SEQ ID NO: 731748 - RNA, 64 nt, Homo Sapiens
ugugugccugggcaccgcucggagcuuggaggggcagccucaggugcuggagccguuccauccc

SEQ ID NO: 731749 - RNA, 64 nt, Homo Sapiens
ccccaggccucaucuuucauccagcugaucgugucagccucaugucucgagggacguguguucc

SEQ ID NO: 731750 - RNA, 64 nt, Homo Sapiens
ccccaggccucgucuuucauccagcugaucaugucagccucaugucucgaggggcguguguucc

SEQ ID NO: 731751 - RNA, 64 nt, Homo Sapiens
uccguccccugccccacaaggggcccgggccggacagccucagccuagggccuuugggugggga

SEQ ID NO: 731752 - RNA, 64 nt, Homo Sapiens
uucauccccugguggcuucagcaguccuuaucaccagccucacaaucccacaggcccaccccca

SEQ ID NO: 731753 - RNA, 64 nt, Homo Sapiens
agauguguggggaggauccaucccccacccacugcagccucacaccgaguccaccuuggacaug

SEQ ID NO: 731754 - RNA, 64 nt, Homo Sapiens; identical to SEQ ID NO: 110871

SEQ ID NO: 731755 - RNA, 64 nt, Homo Sapiens; identical to SEQ ID NO: 110872

SEQ ID NO: 731756 - RNA, 64 nt, Homo Sapiens
gcgugguauaaucuccauuucaaaaccaaggaagcagccucagaguggucgagugacacaccuc

SEQ ID NO: 731757 - RNA, 64 nt, Homo Sapiens
cagcugugcuaagccugccacgggcguauccuugcagccucacaacagugggaggucuguaucc

SEQ ID NO: 731758 - RNA, 64 nt, Homo Sapiens
gccguaugcugcacaagcguguacacccccugggcagccucaaaaccccgcuuacagcagcaac

SEQ ID NO: 731759 - RNA, 64 nt, Homo Sapiens
gcaggggccccucccugccucggcucugccgccccagccucaguuccugcuucuggucuucucc

SEQ ID NO: 731760 - RNA, 64 nt, Homo Sapiens
agggggcuugcccacccaccccgaccccagcccccagccucagccccgguccgggggcagccag

SEQ ID NO: 731761 - RNA, 64 nt, Homo Sapiens
gccagccugcccugcgguccugucaccuggaggccagccucacaugcccaaaucuccagucucc

SEQ ID NO: 731762 - RNA, 64 nt, Homo Sapiens
caguggggugcccgcugccuguccuccgugaaaccagccucagaucagggcccugccacccagg

SEQ ID NO: 731763 - RNA, 64 nt, Homo Sapiens
guggcgugaccuuggcucacugcaaccuccaggccagccucagccucccuaguagcugggacua

SEQ ID NO: 731764 - RNA, 64 nt, Homo Sapiens
uaggaguuuuauauacuguguucaucucccaccccagccucaagauuugauaagcaagaaagau

SEQ ID NO: 731765 - RNA, 64 nt, Homo Sapiens
uaccacaacauacugacuaaguuaaccacaucggcagccucagcuacacauguugccugagcug

SEQ ID NO: 731766 - RNA, 64 nt, Homo Sapiens
ggaccacucuucucuccaagagguuaaagcaaaccagccucagcaucaucucuugauaaaggag

SEQ ID NO: 731767 - RNA, 64 nt, Homo Sapiens
caagcaacauggggugaacccauguuugucccuccagccucagcgccuuccaguauggccccac

SEQ ID NO: 731768 - RNA, 64 nt, Homo Sapiens
agcgcuugaagccugaacccccuggagaccccaccagccucacccccagugagcagccuggagc

SEQ ID NO: 731769 - RNA, 64 nt, Homo Sapiens
agcucucuucaccguuuuuuccggccaguccccacagccucauccuccacccugccagcagcuu

SEQ ID NO: 731770 - RNA, 64 nt, Homo Sapiens; identical to SEQ ID NO: 110873

SEQ ID NO: 731771 - RNA, 64 nt, Homo Sapiens; identical to SEQ ID NO: 110874

SEQ ID NO: 731772 - RNA, 64 nt, Homo Sapiens
cugagagaccugcccucucuaggcgggggcugcucagccucaucucccuggcagguggccaggc

SEQ ID NO: 731773 - RNA, 64 nt, Homo Sapiens
uugaguccuccuugggguugucuaaguccucuuccagccucacuuuagaguacuuucauacucu

SEQ ID NO: 731774 - RNA, 64 nt, Homo Sapiens
gagcugcccacuacuggaagccagacuuucuauccagccucacuauugcuuacccacugccugc

SEQ ID NO: 731775 - RNA, 64 nt, Homo Sapiens
uaaugccccccaaagacugacucuaaugauccuccagccucauccuaugaacugguuuuggucc

SEQ ID NO: 731776 - RNA, 60 nt, Homo Sapiens; identical to SEQ ID NO: 730340

SEQ ID NO: 731777 - RNA, 64 nt, Homo Sapiens
acucccgggacuauugccaauggccaccaagugucagccucagcgguggcuuucugaguccugu

SEQ ID NO: 731778 - RNA, 64 nt, Homo Sapiens
cccagagaagacugaggcuaugccugccaaggagcagccucaagauuuuauuuuuuacuuuaaa

SEQ ID NO: 731779 - RNA, 64 nt, Homo Sapiens
ugugaacacccgugucugggcuauguggagcucacagccucacagucagcaagccuccuuugug

SEQ ID NO: 731780 - RNA, 64 nt, Homo Sapiens
aaccaggccucucacuccagccagugccaugcugcagccucagacaucuguagcacaggcaaug

SEQ ID NO: 731781 - RNA, 64 nt, Homo Sapiens
ccccacccagcaccuucccaccccacgcuggccccagccucagaugacaccugccggcaguagc

SEQ ID NO: 731782 - RNA, 62 nt, Homo Sapiens
uggcccucaccucuuuggacauaaacagaugcugcagccucagggacgucucuuucuauuca

SEQ ID NO: 731783 - RNA, 64 nt, Homo Sapiens
ucggggaaccugcaccgcauuggcucaccgagaccagccucaucccuaugacguguuuggcugu

SEQ ID NO: 731784 - RNA, 64 nt, Homo Sapiens
guggaggcuccaucccagcaaguucagcuuuuaccagccucagucacucucauugcugcuguug

SEQ ID NO: 731785 - RNA, 64 nt, Homo Sapiens
uucaaagagauuuugaaaaccaauuguauuuaaccagccucaaauugugcaaccaugauguaua

SEQ ID NO: 731786 - RNA, 64 nt, Homo Sapiens
caggccaggaggcuguuccaggaguccugcccagcagccucaguggccaagcccagacacucac

SEQ ID NO: 731787 - RNA, 64 nt, Homo Sapiens
auuaugauauugcaaaagugauacuuagauuuuacagccucaguagucugcccaguguccacau

SEQ ID NO: 731788 - RNA, 64 nt, Homo Sapiens
cuggcagcuaacacgcccgggguggccacagcgccagccucagacuggagggcaagggguuccc

SEQ ID NO: 731789 - RNA, 64 nt, Homo Sapiens
gguuuuucuccugcaggguacugggccaggcccucagccucagagagccugcagaagggcuugg

SEQ ID NO: 731790 - RNA, 64 nt, Homo Sapiens
accgacgcgacgcgaugccucccggccaccgccccagccucaccccaucccacgacccccgcaa

SEQ ID NO: 731791 - RNA, 64 nt, Homo Sapiens
agccuaguauguucugacaucuggcuucccuucucagccucauguccaccugccugccagccag

SEQ ID NO: 731792 - RNA, 64 nt, Homo Sapiens
acacuacaccacacacaacagccaacagcuacaacagccucacuuggucugccaggcccccacc

SEQ ID NO: 731793 - RNA, 64 nt, Homo Sapiens
uccaagugaaugggucucaaagacuuggugaccccagccucaucuucuaggccuuuuccaccca

SEQ ID NO: 731794 - RNA, 64 nt, Homo Sapiens
caaaggccacuucucaagcagcuuuuggcaccuucagccucagaguggaaucuuuuaaagacag

SEQ ID NO: 731795 - RNA, 64 nt, Homo Sapiens
aggcuggugguugccucccguccugggcaggcugcagccucaugccaugucucucucccacuac

SEQ ID NO: 731796 - RNA, 64 nt, Homo Sapiens
ggacagcguucgcccuuuagcggggaggucauuacagccucauggccucuaccaaggccccaga

SEQ ID NO: 731797 - RNA, 64 nt, Homo Sapiens
cacacuucgcuucagccuccggaccauuccggagcagccucacauaccucacugucucgucugu

SEQ ID NO: 731798 - RNA, 64 nt, Homo Sapiens
ugcaaccuccgccuccuggguucaagcgauucuccagccucagccucccgaguagcugggauua

SEQ ID NO: 731799 - RNA, 64 nt, Homo Sapiens
aggcuuucucuguguaaagaguaaaaaguuugaccagccucagaauucacuaguucuuaacauu

SEQ ID NO: 731800 - RNA, 64 nt, Homo Sapiens
ugagacgggccaggacgcccugugacauccccaccagccucagaccaaaacugggccgaugugg

SEQ ID NO: 731801 - RNA, 64 nt, Homo Sapiens
agcaccacccauucaagcaugcucagacauuugucagccucaacaacaugaacaagucuguaaa

SEQ ID NO: 731802 - RNA, 64 nt, Homo Sapiens
cauuuguauaucuccagaaauuugcauaugaugccagccucacgaaccaauuuguaaagccaca

SEQ ID NO: 731803 - RNA, 64 nt, Homo Sapiens
uggcugaaccucgccgcucccccaguacucccuccagccucagccuggcuaccccuccuggcca

SEQ ID NO: 731804 - RNA, 64 nt, Homo Sapiens
gugccucucuggccgcccacggccugggcucuuccagccucagugagaaaaagaacuagcagag

SEQ ID NO: 731805 - RNA, 64 nt, Homo Sapiens
ccuacaucagacaaaauauccucaccaaaagauccagccucauaucaucuaauucuggcaggac

SEQ ID NO: 731806 - RNA, 64 nt, Homo Sapiens
aggcugaaggcgagggguggaggaggccccagcacagccucaucuccauguguacacgugugua

SEQ ID NO: 731807 - RNA, 64 nt, Homo Sapiens
ccucgcaguuggggcugaggcuggggcuggcugccagccucaguucugggagcgcuggggucgc

SEQ ID NO: 731808 - RNA, 64 nt, Homo Sapiens
cuuccugaggggagacagagcaaccccuggaccccagccucaaauccaggacccugccaggcac

SEQ ID NO: 731809 - RNA, 64 nt, Homo Sapiens
auccuuuccuaggcacauucguccacuaagggaacagccucagaaacugguacagcaaugggug

SEQ ID NO: 731810 - RNA, 64 nt, Homo Sapiens
auggggagauucaggaucccccugugccagagcacagccucaccggaugcugcuucccacacug

SEQ ID NO: 731811 - RNA, 64 nt, Homo Sapiens
uguaaccuccgucuccuggguucaagugauucuccagccucagccucccgaauagcugggauua

SEQ ID NO: 731812 - RNA, 64 nt, Homo Sapiens
aggguugggaagccuuccgucugcggugggcaggcagccucacccugggcccacagaccggccu

SEQ ID NO: 731813 - RNA, 64 nt, Homo Sapiens
agcugucauuguuccuuccccagaagcuaagagccagccucagagccuacccaggagcugugaa

SEQ ID NO: 731814 - RNA, 64 nt, Homo Sapiens
cugcaggaucagguuagggcgagcgcuaccucuccagccucagcucucaguugcagcccugcug

SEQ ID NO: 731815 - RNA, 64 nt, Homo Sapiens
gugggcauguuauggggaggggaggggguucuuccagccucaggucccagcugucucacguugu

SEQ ID NO: 731816 - RNA, 64 nt, Homo Sapiens
gucucccagccacuuucccuccuggcacugccaccagccucaccgccugcgggcagggggaggc

SEQ ID NO: 731817 - RNA, 64 nt, Homo Sapiens; identical to SEQ ID NO: 110875

SEQ ID NO: 731818 - RNA, 64 nt, Homo Sapiens; identical to SEQ ID NO: 110876

SEQ ID NO: 731819 - RNA, 64 nt, Homo Sapiens
ucucccacgugguugucccgggaaagcugccccacagccucagcaucuucagcacuuaccgauc

SEQ ID NO: 731820 - RNA, 64 nt, Homo Sapiens
gaggacguccugugugccaagugguuuauaugcccagccucauuuaauccucagaaugacucca

SEQ ID NO: 731821 - RNA, 64 nt, Homo Sapiens
gacuggccaggcccaaggacccagccaucaaaaccagccucaaaucugguugugauggagaagu

SEQ ID NO: 731822 - RNA, 64 nt, Homo Sapiens
ggcuagccgggccucaccccaccccuacccgccacagccucagggugugcaggggagccugcug

SEQ ID NO: 731823 - RNA, 64 nt, Homo Sapiens
gcugugugaccuuaggaagucucugccccucucucagccucagugucccgagggccccgaagca

SEQ ID NO: 731824 - RNA, 64 nt, Homo Sapiens
cacugcacaccagccugggugacagugugagacccagccucaaaaaaaaaaaaaaaaaagugau

SEQ ID NO: 731825 - RNA, 64 nt, Homo Sapiens
gguggucucaaacuccugggcucaagcgaacugucagccucagccucccagugugcugggauua

SEQ ID NO: 731826 - RNA, 64 nt, Homo Sapiens
guaacugcaccugggcagcuccucccugugcccccagccucagcccaacuucuuacccgaaagc

SEQ ID NO: 731827 - RNA, 64 nt, Homo Sapiens
agcaagaguccccuuggguacaccccucugcccacagccucagcauuucuuggagcagcaaagg

SEQ ID NO: 731828 - RNA, 64 nt, Homo Sapiens
cuagucuuggaccccacgagagagaaucguuccucagccucauggugaacucgcgcccuccagc

SEQ ID NO: 731829 - RNA, 64 nt, Homo Sapiens
cucuucccgcacccagcaugcagcucugccuccgcagccucagugcgcuuuccugcgcgcacug

SEQ ID NO: 731830 - RNA, 64 nt, Homo Sapiens
ugucguuccgguuauguuguguaagucaacucuucagccucauucacuguccuggcuuuuauuu

SEQ ID NO: 731831 - RNA, 64 nt, Homo Sapiens
aaucagauauauacaaaugaaauuagaagaaacacagccucaugggacagaaauuugagggagg

SEQ ID NO: 731832 - RNA, 64 nt, Homo Sapiens
ucagaagccuguguucuucaagagcagguguucucagccucacaugcccugccgugcuggacuc

SEQ ID NO: 731833 - RNA, 64 nt, Homo Sapiens
cucugccuguccagcgccaaucccuggauagcagcagccucagccgcagcgugagggugugucu

SEQ ID NO: 731834 - RNA, 64 nt, Homo Sapiens
uggagccaaagcuuuguccuccagucuucucucccagccucaguuucagagaugguuugaaggc

SEQ ID NO: 731835 - RNA, 64 nt, Homo Sapiens
ucagccucccccugcugcucgugugaggcugggccagccucagcuguagcccggccagggccug

SEQ ID NO: 731836 - RNA, 64 nt, Homo Sapiens
uauguuuuuaaaaaauaucaugagccaccaugcccagccucaaaaagugcuggaauuacuggcg

SEQ ID NO: 731837 - RNA, 64 nt, Homo Sapiens
uguguuaguaacaugaaaaaaucugggaaaccuccagccucaagucagcccagcagguaugggc

SEQ ID NO: 731838 - RNA, 64 nt, Homo Sapiens
uugccagauguuggcagaaggccaacguccaccccagccucacaccuacuccuggcaacaucag

SEQ ID NO: 731839 - RNA, 64 nt, Homo Sapiens
aacgccccugguggacaggacccuuccaggcagacagccucagccuuuccgcgcccauugguga

SEQ ID NO: 731840 - RNA, 64 nt, Homo Sapiens
aaaguguugggauuacugguugacucuucugccucagccucacccucgaacuccugggcuuaaa

SEQ ID NO: 731841 - RNA, 64 nt, Homo Sapiens
caguguuuucauugccaacacaaagggccaggcucagccucaagguggaggaccugagggugcu

SEQ ID NO: 731842 - RNA, 64 nt, Homo Sapiens
uugcuggagcugucacaugaaccgcagguucccccagccucaggaacucacauuguuccuccag

SEQ ID NO: 731843 - RNA, 64 nt, Homo Sapiens
ccugccauucagggcuguuccagcaccaggccagcagccucauccuccuugacugugucccagc

SEQ ID NO: 731844 - RNA, 64 nt, Homo Sapiens
ccugucuguacugcucgucccauggccauggagucagccucagcauggguuugaccucugccca

SEQ ID NO: 731845 - RNA, 64 nt, Homo Sapiens
gugccaagccuucugugagaaaccacacucaccccagccucauucaacaaagaacaaucacuaa

SEQ ID NO: 731846 - RNA, 64 nt, Homo Sapiens
augaaccagggaaucaaacuccccuccuuagaggcagccucaagggaagggccuggcucacaug

SEQ ID NO: 731847 - RNA, 64 nt, Homo Sapiens
ccagggcgggaaagcaggcuauccaggacugagccagccucagggaaagcaggacuggggagag

SEQ ID NO: 731848 - RNA, 64 nt, Homo Sapiens
cuugcgaaccgugagcaggacugcccaggccggccagccucaccgcagccugcuucccaccucc

SEQ ID NO: 731849 - RNA, 64 nt, Homo Sapiens
gcuuccuuauguccuccaccuggagaaaggauggcagccucaggccuucaguaucaaggcugcc

SEQ ID NO: 731850 - RNA, 64 nt, Homo Sapiens
auuaaggucuuauuuaauuuucaccagucauacacagccucauucagcacagugcuccuccaua

SEQ ID NO: 731851 - RNA, 64 nt, Homo Sapiens
gggugggauacagcagcuuuccaucccaucuuugcagccucauaacuugcuacucucucccucu

SEQ ID NO: 731852 - RNA, 64 nt, Homo Sapiens; identical to SEQ ID NO: 110877

SEQ ID NO: 731853 - RNA, 64 nt, Homo Sapiens; identical to SEQ ID NO: 110878

SEQ ID NO: 731854 - RNA, 64 nt, Homo Sapiens
ucuaugugugugucuacgugcagcucacuaccaacagccucaugugcacuugaccugacagugc

SEQ ID NO: 731855 - RNA, 64 nt, Homo Sapiens
uuagaauaaggaacaagcauuauuccuuugccaacagccucacucuaagaggcuuuuuugcuga

SEQ ID NO: 731856 - RNA, 64 nt, Homo Sapiens
cucccggcagacccacccacccccuggggcugcucagccucaggcacggacagggcacaugaua

SEQ ID NO: 731857 - RNA, 64 nt, Homo Sapiens; identical to SEQ ID NO: 110879

SEQ ID NO: 731858 - RNA, 64 nt, Homo Sapiens; identical to SEQ ID NO: 110880

SEQ ID NO: 731859 - RNA, 64 nt, Homo Sapiens
uacaagacacuacgggaacaguuugccucccucccagccucaaccacaauucuuccaugcuggg

SEQ ID NO: 731860 - RNA, 64 nt, Homo Sapiens
uacugcuaugcaccacuugaaggagcucuaucaccagccucaaacccgaaagacugaggcauuu

SEQ ID NO: 731861 - RNA, 64 nt, Homo Sapiens
accaggacggcagggucauccugagccgccaaggcagccucagucagagcacccugaaguuuuu

SEQ ID NO: 731862 - RNA, 64 nt, Homo Sapiens
auuggaaagaaguucaguggucccauuguuaacucagccucaaaucucaacugucaggcccuac

SEQ ID NO: 731863 - RNA, 64 nt, Homo Sapiens
cgcaccuggagauccugaacugucaagccacuggcagccucaugccaccacauuugccagaaau

SEQ ID NO: 731864 - RNA, 64 nt, Homo Sapiens
cuggaaagugaugucagaauagcuuccaauaaagcagccucauucugaggccugagugauccac

SEQ ID NO: 731865 - RNA, 64 nt, Homo Sapiens
aacgaaccuuggccugggccguaucuccggcucccagccucagcgcggcccucccgaguuaagg

SEQ ID NO: 731866 - RNA, 64 nt, Homo Sapiens
cuccccagccaguccugagccucccgccaaaucccagccucacuaggugggacccccuucccag

SEQ ID NO: 731867 - RNA, 64 nt, Homo Sapiens
ggcuggagugcaguggugugaucacagcucacugcagccucaaccucugaaggcccagaugauc

SEQ ID NO: 731868 - RNA, 64 nt, Homo Sapiens
gccaaaaugccauuuagcaauaaauaacacuugucagccucagagcauuuaaggaaacuagaca

SEQ ID NO: 731869 - RNA, 64 nt, Homo Sapiens
gcuggucucaaacuccuaggcuuaagcaguccuccagccucagccuucucaaagugcuaggaug

SEQ ID NO: 731870 - RNA, 64 nt, Homo Sapiens
ggcuggagugcaguggcauaaucauaccucauugcagccucagacuccuggguucaagcaaucc

SEQ ID NO: 731871 - RNA, 64 nt, Homo Sapiens
agguggagugcagugacgacaucacagcucacugcagccucaaccuggguucaagugauccucu

SEQ ID NO: 731872 - RNA, 64 nt, Homo Sapiens
aucaauuuuguauaaauauauagaaacacacacacagccucagacuuacaaacugauuauacuc

SEQ ID NO: 731873 - RNA, 64 nt, Homo Sapiens
augcccucuauccuaucauagauaacauucuccacagccucacuucauuccaccuauucucuga

SEQ ID NO: 731874 - RNA, 64 nt, Homo Sapiens
gccuuacgcccuuccccuugaccuuguccugccccagccucacggacagccugcgcagggggcu

SEQ ID NO: 731875 - RNA, 64 nt, Homo Sapiens
ggagcccaggaccccugaccccggccgcugcugccagccucagaaaggcacccaggugugcagg

SEQ ID NO: 731876 - RNA, 64 nt, Homo Sapiens
caugugaauaaaauucuuauugucuaaauugagacagccucagauauuugcagauauuuacuuu

SEQ ID NO: 731877 - RNA, 64 nt, Homo Sapiens
uuuuggccccaucucugguuagcaguucaugauacagccucaccauggccccacucuguuccca

SEQ ID NO: 731878 - RNA, 64 nt, Homo Sapiens
aggcuuggaaagaaaaaacaugacuaauagaccucagccucaaauaaauaguugggacaucagc

SEQ ID NO: 731879 - RNA, 64 nt, Homo Sapiens
cuccacacagaaaugugaacccagacuuugcacacagccucagguauuccuggcucugcaaacc

SEQ ID NO: 731880 - RNA, 64 nt, Homo Sapiens
gaagaauaugacagcuguccaaaacagacaaaaacagccucacagcugagagacccaaggagga

SEQ ID NO: 731881 - RNA, 64 nt, Homo Sapiens
cagucccuaauuaugggacuuuuucaaagggcuccagccucacuucuucaguucugccaucuug

SEQ ID NO: 731882 - RNA, 64 nt, Homo Sapiens
uucagcuucaugccucuuccuugggggccuacagcagccucaccggcaugcuggccucaugggc

SEQ ID NO: 731883 - RNA, 64 nt, Homo Sapiens
cugcccuuccgccccccacaauccaguggaaacacagccucacauguggcagguaugacaacuc

SEQ ID NO: 731884 - RNA, 64 nt, Homo Sapiens
cuccuggguucaagcaauccaucacagcucacugcagccucaacggcuagagugcaauggugca

SEQ ID NO: 731885 - RNA, 64 nt, Homo Sapiens
cauuccugcggcauguaugagugcgcaacacccucagccucauggugugcugagugcugaagca

SEQ ID NO: 731886 - RNA, 64 nt, Homo Sapiens
gcgcgcgcuguguguguguggugugugugugugucagccucagaccucagagcgcgcugugugu

SEQ ID NO: 731887 - RNA, 64 nt, Homo Sapiens
aacuaacaaguuuugagaaaccacacccuagauccagccucaggccccaucaucccuuccauug

SEQ ID NO: 731888 - RNA, 64 nt, Homo Sapiens
gcggcacacguucuagcucaaguccuggugguggcagccucacccccuucgcauccugcagaag

SEQ ID NO: 731889 - RNA, 64 nt, Homo Sapiens; identical to SEQ ID NO: 110881

SEQ ID NO: 731890 - RNA, 55 nt, Homo Sapiens; identical to SEQ ID NO: 110882

SEQ ID NO: 731891 - RNA, 64 nt, Homo Sapiens
cugcgccugagcugcaugcggcccggccaagccccagccucagcgaccccguuccaagugcacu

SEQ ID NO: 731892 - RNA, 64 nt, Homo Sapiens
gcacuauuguaaacccugcuugguuugcacagcccagccucacaaacugguguguauucucaug

SEQ ID NO: 731893 - RNA, 64 nt, Homo Sapiens
ccugaaucaaauuuuuaauuacuucguucuuuaucagccucauguuuuaaugaaaaaaaguaaa

SEQ ID NO: 731894 - RNA, 64 nt, Homo Sapiens
uggucgggggcgggggcggcggcugaccagcaggcagccucaucugcuguggagggggcugcag

SEQ ID NO: 731895 - RNA, 64 nt, Homo Sapiens
ccacgggcuggacgggccuggccaguguuguuuccagccucaggcugccccgccuggagcccag

SEQ ID NO: 731896 - RNA, 64 nt, Homo Sapiens; identical to SEQ ID NO: 110883

SEQ ID NO: 731897 - RNA, 64 nt, Homo Sapiens; identical to SEQ ID NO: 110884

SEQ ID NO: 731898 - RNA, 64 nt, Homo Sapiens
aggcagacucucugucgccaggcuucuccugccucagccucacgaguagcugggacuacaggca

SEQ ID NO: 731899 - RNA, 64 nt, Homo Sapiens
cagaacggaggucaccuucugccccgagcugccgcagccucaggguuccuccccuaccagcuca

SEQ ID NO: 731900 - RNA, 64 nt, Homo Sapiens
guuuuuaccuuaauuucaacaaugugauuuuguucagccucacucucaugagaugcuuuuucuu

SEQ ID NO: 731901 - RNA, 64 nt, Homo Sapiens
gagccacggcccgucuagucagccacaccacagccagccucaggggaagugugggcugugcccu

SEQ ID NO: 731902 - RNA, 64 nt, Homo Sapiens
cacgugaacugucaucaccuggcaaccccagccccagccucagcccugcccccuuucccuccuu

SEQ ID NO: 731903 - RNA, 64 nt, Homo Sapiens
ucucuagggccuuuuuucaauaacuugaaaaucacagccucaucauuagcaacuuuauauacac

SEQ ID NO: 731904 - RNA, 64 nt, Homo Sapiens
ugcaaccuccaccuccuggguucaagcgcuucuccagccucagccuccugaguagcugggauua

SEQ ID NO: 731905 - RNA, 64 nt, Homo Sapiens
caucccucaucuagucuugaccucuccagcaucccagccucagaagccuucuugcugcccacaa

SEQ ID NO: 731906 - RNA, 64 nt, Homo Sapiens
acugcuaagauuaaaauccgucucccauuuguuacagccucaccugcaccaggauagaaagcac

SEQ ID NO: 731907 - RNA, 64 nt, Homo Sapiens
cggguuuguccugagccugcacuguccucgccugcagccucagaggggcaggcauccccgcaca

SEQ ID NO: 731908 - RNA, 64 nt, Homo Sapiens
aacucccuggaauaucccugugaagcuacgcacucagccucaagugaggaauuagugcuggauu

SEQ ID NO: 731909 - RNA, 64 nt, Homo Sapiens
aaggaccuuguggcuuuguacugcagagggcuuacagccucagcguagaagccacaguacucau

SEQ ID NO: 731910 - RNA, 64 nt, Homo Sapiens
gagggccgugugacacucucuaagccugcggcgccagccucacggcuucucucagccagcuguu

SEQ ID NO: 731911 - RNA, 64 nt, Homo Sapiens
ucacugugcuguggucugucuguagucguuuccucagccucaucccugauauagccaaugcugu

SEQ ID NO: 731912 - RNA, 62 nt, Homo Sapiens; identical to SEQ ID NO: 731194

SEQ ID NO: 731913 - RNA, 64 nt, Homo Sapiens
ccugugaauuucuuauuguaugagacacugcgcccagccucaucaagugcugggauuacaggcg

SEQ ID NO: 731914 - RNA, 64 nt, Homo Sapiens
ugacucacagagcugcagagugguuuaaugagaccagccucagcaggguggaaaugccucuucu

SEQ ID NO: 731915 - RNA, 64 nt, Homo Sapiens
acccagucuuuucccuaguugacaucuggggacacagccucaguacgcggcugcuucggaagca

SEQ ID NO: 731916 - RNA, 64 nt, Homo Sapiens
gcaaggagggcgcuucacugcuuugucccaggcccagccucaagugggcuggcugugaggccac

SEQ ID NO: 731917 - RNA, 64 nt, Homo Sapiens
cuccugggcucaagcgauccaucauagcucacugcagccucaaaggcuggagaacaguggcacc

SEQ ID NO: 731918 - RNA, 64 nt, Homo Sapiens
uuauuuucacauugaaaaucagucagauuugcuucagccucaaagaggguguuuauguaaaacu

SEQ ID NO: 731919 - RNA, 64 nt, Homo Sapiens
ccugcucauucugggcccuugcugccaaggagcccagccucaccuagcaggaaaggagaugaag

SEQ ID NO: 731920 - RNA, 64 nt, Homo Sapiens
gccugccgaggaagccgagugcccgccgccgcgccagccucagcccgcgcagaaugugcucgcu

SEQ ID NO: 731921 - RNA, 64 nt, Homo Sapiens; identical to SEQ ID NO: 110885

SEQ ID NO: 731922 - RNA, 64 nt, Homo Sapiens; identical to SEQ ID NO: 110886

SEQ ID NO: 731923 - RNA, 64 nt, Homo Sapiens
agcuauuccuaggcaaagagccucauggcuaaggcagccucaaagccagccccuccucccaccu

SEQ ID NO: 731924 - RNA, 64 nt, Homo Sapiens
ugcaaccucugccucccagguucaagugcuucuccagccucagccucccaaguagcugagacua

SEQ ID NO: 731925 - RNA, 64 nt, Homo Sapiens
ggggaccgggccccucucuagggaccccucgccccagccucauuccccauucugugucccaugu

SEQ ID NO: 731926 - RNA, 64 nt, Homo Sapiens
uuguaaagaaaacuaaauccuucuguguccccggcagccucagugcagcaacagaagccaaggg

SEQ ID NO: 731927 - RNA, 64 nt, Homo Sapiens
guggaacccauuaccuucucccucauuucaggagcagccucagaacaaagugagacaguccagc

SEQ ID NO: 731928 - RNA, 64 nt, Homo Sapiens
ugggagucaggaacccagacaaggaaucccauuccagccucaccccaaccaugaccuuggcaag

SEQ ID NO: 731929 - RNA, 64 nt, Homo Sapiens
guaaaugacaugaccaguggcaagcacgugacaccagccucaaaucauaucauccauuguuuuu

SEQ ID NO: 731930 - RNA, 64 nt, Homo Sapiens
cugcauagcuugcacaacauaguccugguuuccucagccucaccucucuccacauuccaaacag

SEQ ID NO: 731931 - RNA, 64 nt, Homo Sapiens
aguauuuggacuuuuuaaaguuccuucugauccacagccucaucgcaaacacagucacuguugg

SEQ ID NO: 731932 - RNA, 64 nt, Homo Sapiens
auccuuuuauaaaugugagauuuuuagcacuuggcagccucauguaguuacuagaccaucucca

SEQ ID NO: 731933 - RNA, 64 nt, Homo Sapiens
acugccaggccugcccugaagagaccaucuuuagcagccucagcggccucagaaauaagccuga

SEQ ID NO: 731934 - RNA, 64 nt, Homo Sapiens
gccccucuugcagagucccccucaaucagcaggacagccucacuguagagagaccaggagccac

SEQ ID NO: 731935 - RNA, 64 nt, Homo Sapiens
ggccagaggaucaccagugcggaggaccaggaaacagccucagucacacgugcauagaggucug

SEQ ID NO: 731936 - RNA, 64 nt, Homo Sapiens
cccagggacugggggcgauuggagccagaggcagcagccucagcccgguggccuuggcccagaa

SEQ ID NO: 731937 - RNA, 64 nt, Homo Sapiens
uucccugcuuggaagcguggguccagccgugcuccagccucacuucacaagaaagccugaugaa

SEQ ID NO: 731938 - RNA, 64 nt, Homo Sapiens
cugaugaugcugccaaggcguccccuggggagcucagccucauccguugccacuuucaaagugg

SEQ ID NO: 731939 - RNA, 64 nt, Homo Sapiens
ccgggcaggggcggcccucggagcuggcgcugugcagccucaccggccaagcuggcccagccug

SEQ ID NO: 731940 - RNA, 64 nt, Homo Sapiens
guuuugagcugaagugauccucccaggcucacugcagccucaacaggcagggucuugcucuguc

SEQ ID NO: 731941 - RNA, 64 nt, Homo Sapiens
ugugagcaucgccaggcugcugugggggcgggagcagccucagugucaagggcccgcccacuga

SEQ ID NO: 731942 - RNA, 64 nt, Homo Sapiens; identical to SEQ ID NO: 110887

SEQ ID NO: 731943 - RNA, 64 nt, Homo Sapiens; identical to SEQ ID NO: 110888

SEQ ID NO: 731944 - RNA, 64 nt, Homo Sapiens
uaugucccucaugucucuagauuuucucgucacccagccucaaaaauauaugugucugcaaccc

SEQ ID NO: 731945 - RNA, 64 nt, Homo Sapiens
uggccucuccgggaucaguccuaggacacaggcucagccucagguugaugggggaugaugugcu

SEQ ID NO: 731946 - RNA, 64 nt, Homo Sapiens; identical to SEQ ID NO: 110889

SEQ ID NO: 731947 - RNA, 64 nt, Homo Sapiens; identical to SEQ ID NO: 110890

SEQ ID NO: 731948 - RNA, 64 nt, Homo Sapiens
gagucacuuaggggccacuuccuaaguugcuguccagccucagugacccccuagugcuuccugg

SEQ ID NO: 731949 - RNA, 64 nt, Homo Sapiens
gcagggugguccgggcacacugggccugccucuccagccucaggaugcucuuguuuauucuggg

SEQ ID NO: 731950 - RNA, 64 nt, Homo Sapiens
gucuggaaugcagugguaugaucacggcucacugcagccucaaccuccugggcuaagugauccu

SEQ ID NO: 731951 - RNA, 64 nt, Homo Sapiens
cacacccugccccuggugcccugagacagacacacagccucacgcccccaggaaugcaaguggu

SEQ ID NO: 731952 - RNA, 64 nt, Homo Sapiens
uuugguucucauugguccagacgaggaagguauccagccucaagucaucauuguggccaggaag

SEQ ID NO: 731953 - RNA, 64 nt, Homo Sapiens
gcccaggggugggcgacacaggcagcuucuucggcagccucacggcagcaaccccagccuuccc

SEQ ID NO: 731954 - RNA, 64 nt, Homo Sapiens
caggcuggggugcaguggcgcgaucccagcacugcagccucaaccuccugggcucaagccaucc

SEQ ID NO: 731955 - RNA, 64 nt, Homo Sapiens
cucgcgucccuguccuugaaggaccuccuucccccagccucaucaccgugcucuucucagcgcc

SEQ ID NO: 731956 - RNA, 64 nt, Homo Sapiens
acugcuccccaccagcacgcugaccugugaaccccagccucaccaucacccccagcacugccag

SEQ ID NO: 731957 - RNA, 64 nt, Homo Sapiens
gccuaagaccaacugcguuggacaccauaagccacagccucacaggaagugggggugaggagcc

SEQ ID NO: 731958 - RNA, 64 nt, Homo Sapiens
ccucuuuuucacaugggccacaguuucaguacuucagccucagugggguuccugauguuuaucu

SEQ ID NO: 731959 - RNA, 64 nt, Homo Sapiens
uugaccugaggcccuucucuccagccccuggaugcagccucacaguccuuaccagcagagcacc

SEQ ID NO: 731960 - RNA, 64 nt, Homo Sapiens
ucccaauccaguggacuucgcaguccacuucugacagccucagugacccuggcuccuugugcca

SEQ ID NO: 731961 - RNA, 64 nt, Homo Sapiens
ugcagagggggcugcggacacagcaggcccccuacagccucagguucugccugagcccagccua

SEQ ID NO: 731962 - RNA, 64 nt, Homo Sapiens
uguaaauaugacucuuuuguaauuaacucauguacagccucauccuguauaguuuaaugaugaa

SEQ ID NO: 731963 - RNA, 64 nt, Homo Sapiens
uuaccccccauagggggcagugucuuguuccugccagccucagugucuugcuucugccagcucc

SEQ ID NO: 731964 - RNA, 61 nt, Homo Sapiens; identical to SEQ ID NO: 110891

SEQ ID NO: 731965 - RNA, 64 nt, Homo Sapiens; identical to SEQ ID NO: 110892

SEQ ID NO: 731966 - RNA, 64 nt, Homo Sapiens; identical to SEQ ID NO: 110893

SEQ ID NO: 731967 - RNA, 64 nt, Homo Sapiens
agaggguugagaaggcuuugcugccaccuggugucagccucagucacuuucucugaaugcuucu

SEQ ID NO: 731968 - RNA, 64 nt, Homo Sapiens
cauuacccuaguucugcccuuguuuguggaguuacagccucaagguuguagcaugugugcuggc

SEQ ID NO: 731969 - RNA, 64 nt, Homo Sapiens
cuggaggacagccccccacuguucuccucaucuccagccucaguaguuggggguagaaggagcu

SEQ ID NO: 731970 - RNA, 64 nt, Homo Sapiens
accucuagcagccuggacuccgcaguggcugugucagccucacccuucgugugcacccgcaugg

SEQ ID NO: 731971 - RNA, 64 nt, Homo Sapiens
gcccucggagcuggcugugccuguauggcccaggcagccucaagcgcgcgcacgcgcgagugug

SEQ ID NO: 731972 - RNA, 64 nt, Homo Sapiens
gacaagagauuccaguuuuaacaaagaccagagccagccucaggagggaaggacugggagagac

SEQ ID NO: 731973 - RNA, 64 nt, Homo Sapiens
cccacgucccaaccccucucuggcugcuggcauacagccucauccagcugccuccagcauccag

SEQ ID NO: 731974 - RNA, 64 nt, Homo Sapiens
cauccaaagccacaccacagcaccagaaucaacucagccucaggguuaagcgaggucagacauc

SEQ ID NO: 731975 - RNA, 64 nt, Homo Sapiens
cccugccugauauccagucacauugcaggcuguccagccucaucccgcaaccuggaguuggagg

SEQ ID NO: 731976 - RNA, 64 nt, Homo Sapiens
gggcugucggccaagagccucaguguaccguggacagccucagggccugcugcggggcuggcug

SEQ ID NO: 731977 - RNA, 64 nt, Homo Sapiens
uucccccggugccucucccacccuuugcuguucgcagccucacaggaccaauggguuugccaag

SEQ ID NO: 731978 - RNA, 64 nt, Homo Sapiens
uucucccaucccagaagcggccugcuuuggagaucagccucaccagagugugggguggggggga

SEQ ID NO: 731979 - RNA, 64 nt, Homo Sapiens
gcauuuggcaaaugcuuacugaauucccauugcccagccucagucuggccuuuaaagaacauaa

SEQ ID NO: 731980 - RNA, 64 nt, Homo Sapiens
aaaaauugauguaaaucagauaaaaugggacaaucagccucauguauaauauucagacuauucu

SEQ ID NO: 731981 - RNA, 64 nt, Homo Sapiens
agguccugacaacaggugccggaugcaccugugacagccucaggguuuauuuugccaagguuaa

SEQ ID NO: 731982 - RNA, 64 nt, Homo Sapiens
auggagaaaccccgucucuacaggaguucgagaccagccucaacacgggcggaucaccugaggu

SEQ ID NO: 731983 - RNA, 64 nt, Homo Sapiens
aaaaggauggcuaaaugcuccugggagucaggcgcagccucacaccagcugccuccuccacuca

SEQ ID NO: 731984 - RNA, 64 nt, Homo Sapiens
agugggcguuuucccggcaggcccccgggguccucagccucagcaacccagggagaggacagaa

SEQ ID NO: 731985 - RNA, 64 nt, Homo Sapiens
gaugcccucggaucagggccgggaugggaggggucagccucagggagcagcugccuugggggac

SEQ ID NO: 731986 - RNA, 64 nt, Homo Sapiens
guccacucaguaacaaguauugggacguagagcacagccucacucagcucugaaagguaauaca

SEQ ID NO: 731987 - RNA, 64 nt, Homo Sapiens
ggagcaguuaugagggaggaagucaacugcuguucagccucagaauaaaggugccguucacugg

SEQ ID NO: 731988 - RNA, 64 nt, Homo Sapiens
gcagaucucccaacuugaacuauaauccaccagccagccucagccuugagcuuuggaaccacau

SEQ ID NO: 731989 - RNA, 64 nt, Homo Sapiens
cacagccaaguuugagcucuuaaaaguugaugaacagccucauuuccccagcuucccugauuuc

SEQ ID NO: 731990 - RNA, 64 nt, Homo Sapiens
uaauuccugguaggggugugugcgugacguacugcagccucaaccuccugggcucaagugaucc

SEQ ID NO: 731991 - RNA, 64 nt, Homo Sapiens
ugauagcagucagcuugaggaggaugaaggaaggcagccucagacaggaauuaaggcaaugccc

SEQ ID NO: 731992 - RNA, 64 nt, Homo Sapiens
uguauuuauuuguuauuaaauugaucugacuucucagccucauuuggacuaaaaaaagaaagca

SEQ ID NO: 731993 - RNA, 64 nt, Homo Sapiens
gauucccacucuguccaccaagugggggguagcacagccucacagcaaccgcccugaccuuggg

SEQ ID NO: 731994 - RNA, 64 nt, Homo Sapiens
uuuauuaccuuuacuccccucccucucccaucaccagccucaaggccugaggggugcaggggcu

SEQ ID NO: 731995 - RNA, 64 nt, Homo Sapiens
uggaucagcaccgauucccgaaagcuuuccaccucagccucagaguccagcugcccggacucca

SEQ ID NO: 731996 - RNA, 64 nt, Homo Sapiens
ccuaauuuggcaguuuguuagguuagacaacugacagccucauuucauuccuacaaguugguuu

SEQ ID NO: 731997 - RNA, 64 nt, Homo Sapiens; identical to SEQ ID NO: 110894

SEQ ID NO: 731998 - RNA, 64 nt, Homo Sapiens; identical to SEQ ID NO: 110895

SEQ ID NO: 731999 - RNA, 64 nt, Homo Sapiens
gaggagaugccacuucucacucaccacuaccagccagccucagaaggccccagagagacccugc

SEQ ID NO: 732000 - RNA, 64 nt, Homo Sapiens
ccaccuggccauuuugacccugaguggacagucacagccucagcucaugucuggcugugacaca

SEQ ID NO: 732001 - RNA, 64 nt, Homo Sapiens
gccacuggggcucagagccggggugggguggcugcagccucaggacugggagcccccagccugu

SEQ ID NO: 732002 - RNA, 64 nt, Homo Sapiens; identical to SEQ ID NO: 110896

SEQ ID NO: 732003 - RNA, 64 nt, Homo Sapiens; identical to SEQ ID NO: 110897

SEQ ID NO: 732004 - RNA, 64 nt, Homo Sapiens
ggccagcgccagggcccaggccauguggccugcccagccucaaugucacuugguggcggggugg

SEQ ID NO: 732005 - RNA, 64 nt, Homo Sapiens
cugcaccggaagacucacuuugucugcccugcgccagccucaccucacccugcaguucccguuu

SEQ ID NO: 732006 - RNA, 64 nt, Homo Sapiens; identical to SEQ ID NO: 110898

SEQ ID NO: 732007 - RNA, 64 nt, Homo Sapiens; identical to SEQ ID NO: 110899

SEQ ID NO: 732008 - RNA, 64 nt, Homo Sapiens
gaccaagaaccaucugcgaaaauguuuauauaagcagccucaaguccaccuccgcccagccugu

SEQ ID NO: 732009 - RNA, 64 nt, Homo Sapiens
agagcuugcugcacccaggcuugcugcauguacucagccucaggggggcugugugccggccuuc

SEQ ID NO: 732010 - RNA, 64 nt, Homo Sapiens
ccggcagguccuauguccuucccaagggcaucuccagccucaggggagucaccaaggcuucagc

SEQ ID NO: 732011 - RNA, 64 nt, Homo Sapiens
guccugggcucaaaugauccaccacggcucacugcagccucagcuggagugcaguggugccauc

SEQ ID NO: 732012 - RNA, 64 nt, Homo Sapiens
ucaucucugucacucuggaacagcucaccuugagcagccucagaaccagugcccaugucccuuc

SEQ ID NO: 732013 - RNA, 64 nt, Homo Sapiens
cuuaacuucguguucacacucaggggcucugaagcagccucacugucuggauggacacaugggc

SEQ ID NO: 732014 - RNA, 64 nt, Homo Sapiens
ccauggcacuuugaggggguuuggccaauuaguucagccucagacgccgcugccuagcaucugc

SEQ ID NO: 732015 - RNA, 64 nt, Homo Sapiens
cugaaggcuuuuuuuuggcucuauuuguguucuucagccucagccauguaauccacagacaacu

SEQ ID NO: 732016 - RNA, 64 nt, Homo Sapiens
ucuuauuuccucaacguugcaaagugauaucccccagccucaagagggccuggggagauggagg

SEQ ID NO: 732017 - RNA, 64 nt, Homo Sapiens
ugcugcugccccucuaggucccccaggaagcccacagccucacccuucccagcccuaaacccug

SEQ ID NO: 732018 - RNA, 64 nt, Homo Sapiens
ucauaacuauaugaacuuuagaguugacacuucucagccucaaugcugguuucagcaugguauu

SEQ ID NO: 732019 - RNA, 64 nt, Homo Sapiens
aaugugcugagauuucucugauaaaaauaacaggcagccucaagcuacguacaucauuauuaau

SEQ ID NO: 732020 - RNA, 64 nt, Homo Sapiens
gccacacgggggaagcagaguauguggcuucaaccagccucacacacacacgccccucuacugc

SEQ ID NO: 732021 - RNA, 64 nt, Homo Sapiens
ccccugcuucagucccuuccgucuccggccucuccagccucagcgccgccccaucugccccaca

SEQ ID NO: 732022 - RNA, 64 nt, Homo Sapiens
ccguggcaggugauguguccgcaucagcucccaucagccucauugcacagcagccauugcacgu

SEQ ID NO: 732023 - RNA, 64 nt, Homo Sapiens
ggaggaucuggaggauccacucuccucccuucuccagccucagggggaaaugccuuaauuucac

SEQ ID NO: 732024 - RNA, 64 nt, Homo Sapiens
gacaucagcccuugggggucaggccaggacucugcagccucagaguagggggcuggaggagccc

SEQ ID NO: 732025 - RNA, 64 nt, Homo Sapiens
cucccuaacuccauuugaacaaacaaaugacuuacagccucaucgcauuuccuaggauaaaaau

SEQ ID NO: 732026 - RNA, 64 nt, Homo Sapiens
cuauuuaacuuugcucucagccagugcuugcgaccagccucauuccgaggaccgccaccucuuc

SEQ ID NO: 732027 - RNA, 64 nt, Homo Sapiens
gaucucccuucucaucucccccaggagccucauccagccucagaccgugagcaccaccagggcu

SEQ ID NO: 732028 - RNA, 64 nt, Homo Sapiens
uccagggcuaaggacucucgggucagcccagaggcagccucagccuggccacguacagccagcg

SEQ ID NO: 732029 - RNA, 64 nt, Homo Sapiens
cagacccccugcccugucuuuggcaggcaucggacagccucaucccaugcaccaucacuguggc

SEQ ID NO: 732030 - RNA, 64 nt, Homo Sapiens
agccacuucagaccagccagcccacugcuacacucagccucaugccagcucccucagucuggca

SEQ ID NO: 732031 - RNA, 64 nt, Homo Sapiens
ccaggcagugggucuucccucucuugccucagagcagccucaucgccagguaggauacguacac

SEQ ID NO: 732032 - RNA, 64 nt, Homo Sapiens; identical to SEQ ID NO: 110900

SEQ ID NO: 732033 - RNA, 64 nt, Homo Sapiens; identical to SEQ ID NO: 110901

SEQ ID NO: 732034 - RNA, 64 nt, Homo Sapiens
ugagucuuuuuggucugcacgcugagcugcguuccagccucagcaaugggagcgagaaacccca

SEQ ID NO: 732035 - RNA, 64 nt, Homo Sapiens
caccccaccugggcccagccgagcccucgauggacagccucacccagagcccacgcccccccaa

SEQ ID NO: 732036 - RNA, 64 nt, Homo Sapiens
gcgcccaggcuggaggcccugccucgcugcuugccagccucaccugcuggggcuggaggccaug

SEQ ID NO: 732037 - RNA, 64 nt, Homo Sapiens
ggccacacagaggaggaagacagcagccuggcagcagccucaccgaagagaggaaccaccacac

SEQ ID NO: 732038 - RNA, 64 nt, Homo Sapiens
gauacuuucugcgugguggaaaccauugcauauucagccucauuucaagaguguuuccuucuca

SEQ ID NO: 732039 - RNA, 64 nt, Homo Sapiens
agacugaagcaggaaggcagagcaucaucuuguucagccucagcugggaacauguguacugggu

SEQ ID NO: 732040 - RNA, 64 nt, Homo Sapiens
ucacuuucacccuaaacgacacuuccuccccagccagccucacucugucuccggcccgcagcag

SEQ ID NO: 732041 - RNA, 64 nt, Homo Sapiens
ggucacaguggguggcagguguccuuaguccuuucagccucagacugaaaugauggggaaagga

SEQ ID NO: 732042 - RNA, 64 nt, Homo Sapiens
ggugcaagauuuaaaauuacuccacggcgacacacagccucaguggcagccuggcuguggaguu

SEQ ID NO: 732043 - RNA, 64 nt, Homo Sapiens
gggaaauccaggguaggaagauagguggcccauucagccucaaggggcuauuuuugugacccac

SEQ ID NO: 732044 - RNA, 64 nt, Homo Sapiens; identical to SEQ ID NO: 110902

SEQ ID NO: 732045 - RNA, 64 nt, Homo Sapiens; identical to SEQ ID NO: 110903

SEQ ID NO: 732046 - RNA, 64 nt, Homo Sapiens
ucagaaucgccuaccugugccugcguguaaaccacagccucagaccagcuauggggagaggaca

SEQ ID NO: 732047 - RNA, 64 nt, Homo Sapiens
cggccccucccggcgccugcccacccuccacccacagccucacggguccaggacuuggcguguu

SEQ ID NO: 732048 - RNA, 64 nt, Homo Sapiens
cugcaccuccaccuuccgggcucaagcgauucuccagccucagccuccugaguagcuaggacug

SEQ ID NO: 732049 - RNA, 64 nt, Homo Sapiens
acaauguugggcaacaacucagccagccugauggcagccucagaggcuuacucuaacccauccc

SEQ ID NO: 732050 - RNA, 64 nt, Homo Sapiens
ccugccccuguucuucacacugccccccaugccucagccucauacagaugugccaucauggggg

SEQ ID NO: 732051 - RNA, 64 nt, Homo Sapiens
uaucaauguaagcaaugugggaaagccgucagaucagccucaagacuucaaaugcauggaagca

SEQ ID NO: 732052 - RNA, 64 nt, Homo Sapiens
cccaccaggggaggugggguuuggugagagacgccagccucagacuuuuucccacugagggucc

SEQ ID NO: 732053 - RNA, 64 nt, Homo Sapiens
cugggcugcuggagaagucuccucccguucggaccagccucagggcugcacguuaccucaggaa

SEQ ID NO: 732054 - RNA, 64 nt, Homo Sapiens
agcagccgcagccaaacccggcugccucccaccccagccucaaaaccucuuccugacgaccccc

SEQ ID NO: 732055 - RNA, 64 nt, Homo Sapiens
agacucccugcuucccuggaagcuucaggaagcucagccucagccuucaggccugagcaagugc

SEQ ID NO: 732056 - RNA, 64 nt, Homo Sapiens
guggguggaucaccugaggucaggaguucaagaccagccucaacauggagaaaccccaucucua

SEQ ID NO: 732057 - RNA, 64 nt, Homo Sapiens
acuuggaaguggugggugcccaggacggugccuccagccucaacagugggcauggacaggguua

SEQ ID NO: 732058 - RNA, 64 nt, Homo Sapiens
cuuccccuucccaguccauaaaaaccccggaccccagccucauacugggcaacuuauuuggauc

SEQ ID NO: 732059 - RNA, 64 nt, Homo Sapiens
ccccaccaugcgggccucagguggcagagaggcccagccucacaggccuguggccccacacacc

SEQ ID NO: 732060 - RNA, 64 nt, Homo Sapiens
uccccuucccuaaucaccucuccugccccuagcucagccucauccccaacuccaugccugucuc

SEQ ID NO: 732061 - RNA, 54 nt, Homo Sapiens; identical to SEQ ID NO: 730625

SEQ ID NO: 732062 - RNA, 64 nt, Homo Sapiens
gggacaaggcuucucuguccgcccuucacaccuccagccucacguucacuuaggcacaucacac

SEQ ID NO: 732063 - RNA, 64 nt, Homo Sapiens
gcugaccccacuccaggaccuaggcccagccccucagccucaucuggagccccugaagaccagu

SEQ ID NO: 732064 - RNA, 64 nt, Homo Sapiens
accacgaugagcugugagcaccgcgcaccugccacagccucagaggcccgcacaaugaccggag

SEQ ID NO: 732065 - RNA, 64 nt, Homo Sapiens
aagugcugggauuacaggcaugaaccauggugcccagccucauuuuugaaauggaauagagaac

SEQ ID NO: 732066 - RNA, 64 nt, Homo Sapiens
ccccggccauuugcugcccuccccaccccugccccagccucaggacugcaggagccauccgccc

SEQ ID NO: 732067 - RNA, 64 nt, Homo Sapiens
gcagugaaugugggaaagucuuuagauacaacuccagccucauuaaacaucggagaauucacac

SEQ ID NO: 732068 - RNA, 64 nt, Homo Sapiens
ggcagcagcugccgguggugccugguggccgcggcagccucaguguggcagcggcgcccagcuc

SEQ ID NO: 732069 - RNA, 64 nt, Homo Sapiens
aggaacaaggcccccagaggauuugugcgagaugcagccucagacccgccccauucaccugugg

SEQ ID NO: 732070 - RNA, 64 nt, Homo Sapiens; identical to SEQ ID NO: 110904

SEQ ID NO: 732071 - RNA, 64 nt, Homo Sapiens; identical to SEQ ID NO: 110905

SEQ ID NO: 732072 - RNA, 64 nt, Homo Sapiens; identical to SEQ ID NO: 110906

SEQ ID NO: 732073 - RNA, 64 nt, Homo Sapiens
cucccaaagugcugggauuaaccuugugauccaccagccucagcaggauggucuugaucuccug

SEQ ID NO: 732074 - RNA, 64 nt, Homo Sapiens
uucugggcggacagcuugucuagugugcccaagucagccucauaaggccuuugggguauucccc

SEQ ID NO: 732075 - RNA, 64 nt, Homo Sapiens
ucgcugccacuucgccgcuguggcgggucuccuccagccucacuucucccccagcccucccucc

SEQ ID NO: 732076 - RNA, 64 nt, Homo Sapiens
cacugcagggccaggcucucuacucccgagcccccagccucaccggucaggcggaugagguccc

SEQ ID NO: 732077 - RNA, 64 nt, Homo Sapiens
aguagcuggaauuacaggcaugauucuccugccucagccucacgcucugccucccggguucaag

SEQ ID NO: 732078 - RNA, 64 nt, Homo Sapiens
ugucaguuucaaaucugcuucaucagaauuuuuccagccucauuaaccuuacuuccagcuugca

SEQ ID NO: 732079 - RNA, 64 nt, Homo Sapiens
cacaccgugugccuuacucccaagagggggaugucagccucaccucccugcuccaggaugaaac

SEQ ID NO: 732080 - RNA, 64 nt, Homo Sapiens
ugguggugucuccguccuuaugccagcuuuguugcagccucagcgacccacuccacacacuccc

SEQ ID NO: 732081 - RNA, 64 nt, Homo Sapiens
cagggcagggagggggacuccguggucacugcuccagccucagcccucaaagcuucuguggcuu

SEQ ID NO: 732082 - RNA, 64 nt, Homo Sapiens
gcagaauagagguauuuuuaguaauccucuggcccagccucaugagugguacuuucucuuccug

SEQ ID NO: 732083 - RNA, 64 nt, Homo Sapiens
cuccccaggaccccuguccagaucauccaggccucagccucauccaugaaaccaaaaagagacu

SEQ ID NO: 732084 - RNA, 64 nt, Homo Sapiens
guggccugaggcccagaggguuccuccuugggugcagccucagaugacccucugucccuacuga

SEQ ID NO: 732085 - RNA, 64 nt, Homo Sapiens
cccugccuuuccuuuacuuugcuccgagggggcgcagccucaaaacaccgcgccgcggaagggg

SEQ ID NO: 732086 - RNA, 64 nt, Homo Sapiens
gcagagcaaggguuguuugggcaaaucaguacgacagccucagacacccccggcucagaucuuu

SEQ ID NO: 732087 - RNA, 64 nt, Homo Sapiens
ggcccucagcacuuuguguuccaugacugucucucagccucacgugcaccccccucauuaucua

SEQ ID NO: 732088 - RNA, 64 nt, Homo Sapiens
ccuguggugggcuuuuuaagagucccucccucaccagccucaccgagucccuguccccaccucc

SEQ ID NO: 732089 - RNA, 64 nt, Homo Sapiens
cuucuggccucaagugauccaucauaacucacugcagccucaaaggcuggagugcaguggcaug

SEQ ID NO: 732090 - RNA, 64 nt, Homo Sapiens
ccugccucugguucccgccuccggcugugacccccagccucacaccucuccacagacccagccu

SEQ ID NO: 732091 - RNA, 64 nt, Homo Sapiens
uccaggcaggagcacgaggugcagacccuggacccagccucagaauaaaacgaucuaaagguag

SEQ ID NO: 732092 - RNA, 64 nt, Homo Sapiens
gguguggcuucuguggcuuuuucugcccaggcagcagccucauguuaggaggguauucugggcc

SEQ ID NO: 732093 - RNA, 64 nt, Homo Sapiens
gguucccgcccuggaccuccuucucguagggucccagccucaaugaagggcacgggguaggggg

SEQ ID NO: 732094 - RNA, 64 nt, Homo Sapiens
auggggcuguucucuaggaaguugcuccccuagacagccucagauacuacugaagugacuuaug

SEQ ID NO: 732095 - RNA, 64 nt, Homo Sapiens
accauggacacacgucaucagugaaaccaaacugcagccucaaccucgugugucuguaaaaugu

SEQ ID NO: 732096 - RNA, 64 nt, Homo Sapiens
caggugggccuguauauagggccaagagucccgccagccucagcgagcagggauccaagaaugu

SEQ ID NO: 732097 - RNA, 64 nt, Homo Sapiens
gccaaugggcugaaagguucucuggcugccugggcagccucauuaccucagauuugaccaggcc

SEQ ID NO: 732098 - RNA, 64 nt, Homo Sapiens
uuccaaacgcagugcccuguucugccgguguguacagccucagcgcaccaggagacccuagagu

SEQ ID NO: 732099 - RNA, 64 nt, Homo Sapiens
augcuccuuguccccucccacccgccucaugacccagccucacagacccucucaggccucugac

SEQ ID NO: 732100 - RNA, 64 nt, Homo Sapiens
ccaguauguuucuuucugccccguugaagaggugcagccucaggcugagaaacacugauagacc

SEQ ID NO: 732101 - RNA, 64 nt, Homo Sapiens
cccucacugccccacauucucccaguggcucuaccagccucacccaucaaaccagugaauuucu

SEQ ID NO: 732102 - RNA, 64 nt, Homo Sapiens
cagcugagucucuaucauagcugaacccugaggacagccucauagcucauguaucagggacuuu

SEQ ID NO: 732103 - RNA, 64 nt, Homo Sapiens
ugugacugccaggcagaaaggacagggcccaggucagccucagucugcugugccuccagacugc

SEQ ID NO: 732104 - RNA, 64 nt, Homo Sapiens
guuuuucccuuuguucuugaacacuuuugcccugcagccucaguuuugaauucuuuuagcaacu

SEQ ID NO: 732105 - RNA, 64 nt, Homo Sapiens
aagggcuggggccggggcugagggugcccuuuuccagccucagccuacuccgcucacugaacuc

SEQ ID NO: 732106 - RNA, 64 nt, Homo Sapiens
gugaucaaguugaggggcuuccggcucccuucuacagccucagaaaccagacucguucuucugg

SEQ ID NO: 732107 - RNA, 64 nt, Homo Sapiens
aaaagagaaucguacgucgacuuucgauuuuucacagccucagccuaggaaaaaugguucaugg

SEQ ID NO: 732108 - RNA, 64 nt, Homo Sapiens; identical to SEQ ID NO: 110907

SEQ ID NO: 732109 - RNA, 64 nt, Homo Sapiens; identical to SEQ ID NO: 110908

SEQ ID NO: 732110 - RNA, 64 nt, Homo Sapiens
ugguugcuucacccgcugcagagcacacgcaacccagccucagcaucacagccgcagcucuguu

SEQ ID NO: 732111 - RNA, 64 nt, Homo Sapiens
cccggcugcugcauuuaggugaacaaagauaaaccagccucaauuuuaguuccucaucacaaaa

SEQ ID NO: 732112 - RNA, 64 nt, Homo Sapiens
ggaaagcacccuugucugggcagacauccaaugacagccucagguagcaauaaucaacauuuac

SEQ ID NO: 732113 - RNA, 64 nt, Homo Sapiens
gccugcuuauugccucuuuccccggggcugaggucagccucacugcccggucaccucggccggg

SEQ ID NO: 732114 - RNA, 53 nt, Homo Sapiens; identical to SEQ ID NO: 730678

SEQ ID NO: 732115 - RNA, 64 nt, Homo Sapiens
ucuuaaaugacuaggaauuucuuucucccauucccagccucauuugggccuugucuuccaguuc

SEQ ID NO: 732116 - RNA, 64 nt, Homo Sapiens
ugagucaccuuccaaguugugauucccucauugacagccucaccccauugccaccagcaugcgg

SEQ ID NO: 732117 - RNA, 64 nt, Homo Sapiens
ucuacuguuaggugagggaggguaaaguuguuuucagccucauguguagggguagcccugucca

SEQ ID NO: 732118 - RNA, 64 nt, Homo Sapiens
uccuuugcccuuccuccugccaagcuuucccgcccagccucacuuucaccugggugucugggcu

SEQ ID NO: 732119 - RNA, 64 nt, Homo Sapiens; identical to SEQ ID NO: 110909

SEQ ID NO: 732120 - RNA, 64 nt, Homo Sapiens; identical to SEQ ID NO: 110910

SEQ ID NO: 732121 - RNA, 64 nt, Homo Sapiens
ugggcugggaccuaggaagcggcccaauaucugacagccucaggugaucucuagccagugcuua

SEQ ID NO: 732122 - RNA, 64 nt, Homo Sapiens
ugugcugggacgacccuuguggcuuaacgagucacagccucagccuauucuagagaacuaaacu

SEQ ID NO: 732123 - RNA, 64 nt, Homo Sapiens
uucuuuucuuagaagaagcucuuuuaaccuugcccagccucagugcaaaaguaccaggagcuag

SEQ ID NO: 732124 - RNA, 54 nt, Homo Sapiens; identical to SEQ ID NO: 730688

SEQ ID NO: 732125 - RNA, 64 nt, Homo Sapiens
ccugcaggcgguauccagagggcagagcucagcacagccucacccccuccguccuggcagggca

SEQ ID NO: 732126 - RNA, 64 nt, Homo Sapiens
gucuacugauucaaaugcuaaucucuuccagaaacagccucacagacacacccagacaucuggu

SEQ ID NO: 732127 - RNA, 64 nt, Homo Sapiens
caaacucuagaugacaagagcaccucaaaggcagcagccucaaggagcagccauggccccagac

SEQ ID NO: 732128 - RNA, 64 nt, Homo Sapiens
ggcuggagugcaguggcacaaucacaguucacugcagccucaaccucuccagauucaagugauc

SEQ ID NO: 732129 - RNA, 64 nt, Homo Sapiens
uaucuuccccuaaaagaggccgugauauuugcagcagccucaaauugcucuuaagggguuuagg

SEQ ID NO: 732130 - RNA, 64 nt, Homo Sapiens
gcuccccacucugcccguccaccuucccuggcuccagccucauucucucuuuaguuuaacuaug

SEQ ID NO: 732131 - RNA, 64 nt, Homo Sapiens
ccucccugccaguccuuggaccucccagcccacccagccucagcacagcucaacacagaaggag

SEQ ID NO: 732132 - RNA, 64 nt, Homo Sapiens
cucugauuagauaaucuuuuuuccaacucaaaaccagccucaugaauucuguuaacugaagaua

SEQ ID NO: 732133 - RNA, 64 nt, Homo Sapiens
cucccuggcucaagcgauccaucacagcucacggcagccucaacaggcugagugcacuggcagg

SEQ ID NO: 732134 - RNA, 64 nt, Homo Sapiens
uuacccguaaaugcacuagcagaggcuucccucccagccucagugaccaccuccccauacagag

SEQ ID NO: 732135 - RNA, 64 nt, Homo Sapiens
acagcucagcacagaaggagccucccagcccacccagccucagcccucccugccaguccuugga

SEQ ID NO: 732136 - RNA, 64 nt, Homo Sapiens
ucagccgccuagccaagacugcagggauggcccgcagccucaucggggccaaggacacacgccu

SEQ ID NO: 732137 - RNA, 64 nt, Homo Sapiens
ggcccaccucucgccccucaucuugguaauuagccagccucagauacuucugugggcccugaag

SEQ ID NO: 732138 - RNA, 64 nt, Homo Sapiens
gcuccuugcagugaagccaccaugggugaccguccagccucacccgguggccugcacagugagg

SEQ ID NO: 732139 - RNA, 64 nt, Homo Sapiens
gggaggccucccggaacaaaagcggaagaggggccagccucaucccacugccagcugacccuca

SEQ ID NO: 732140 - RNA, 64 nt, Homo Sapiens
ucuuauuuuuguuggagccacucuguuccuggcucagccucaaaugcaguauuuuuguuguguu

SEQ ID NO: 732141 - RNA, 64 nt, Homo Sapiens
gguuucaucuccucugugggaggacacaucucugcagccucaagaguuaggcagagacucaagu

SEQ ID NO: 732142 - RNA, 64 nt, Homo Sapiens
cccacuccaugccacccccaccagcuggaggacccagccucacaguguguccuuugugccagac

SEQ ID NO: 732143 - RNA, 64 nt, Homo Sapiens
ggcuucaaguuaacaggaucagacaccagucaagcagccucaggucaucuugcgacuccacuga

SEQ ID NO: 732144 - RNA, 64 nt, Homo Sapiens
ucugccucaaaaauucaccaagcagaaugccucucagccucauguguugguccucugcuccucc

SEQ ID NO: 732145 - RNA, 64 nt, Homo Sapiens
gggucugguaccagggguugccuuacugaggugacagccucacacccggggcccgcagaggugc

SEQ ID NO: 732146 - RNA, 64 nt, Homo Sapiens; identical to SEQ ID NO: 110911

SEQ ID NO: 732147 - RNA, 64 nt, Homo Sapiens; identical to SEQ ID NO: 110912

SEQ ID NO: 732148 - RNA, 64 nt, Homo Sapiens
ccaucuggcagagucccaggggaauguggaacugcagccucagcggcuuggggcugcugggguu

SEQ ID NO: 732149 - RNA, 64 nt, Homo Sapiens
ugacccgaucggacagugcccaucccgcgcgcugcagccucaugugcgccugcagggggcgcug

SEQ ID NO: 732150 - RNA, 64 nt, Homo Sapiens
gaggcucaggacacggccaccgagaccaucugcccagccucacugcuacgccccauggaggcuc

SEQ ID NO: 732151 - RNA, 64 nt, Homo Sapiens
uuugcagccccugagaaggcacucaaccccucaacagccucagccacuaggggccccaaguuca

SEQ ID NO: 732152 - RNA, 64 nt, Homo Sapiens
acauccgacaccucccagcgcagucccugacuaacagccucagccuuucuguuucagcaaaucu

SEQ ID NO: 732153 - RNA, 64 nt, Homo Sapiens; identical to SEQ ID NO: 110913

SEQ ID NO: 732154 - RNA, 64 nt, Homo Sapiens; identical to SEQ ID NO: 110914

SEQ ID NO: 732155 - RNA, 64 nt, Homo Sapiens
uggggcucucagcaccaaagcagggccuccuccacagccucagcgacagacaccagaccagguc

SEQ ID NO: 732156 - RNA, 64 nt, Homo Sapiens; identical to SEQ ID NO: 110915

SEQ ID NO: 732157 - RNA, 64 nt, Homo Sapiens; identical to SEQ ID NO: 110916

SEQ ID NO: 732158 - RNA, 64 nt, Homo Sapiens
aggcagggccugagggagccccuggcuuuccccucagccucaggaaagguggucaggaaaacuc

SEQ ID NO: 732159 - RNA, 64 nt, Homo Sapiens
ggcuggagugcagugacguggucauagcucacugcagccucaaccuccugggcucaagugaccc

SEQ ID NO: 732160 - RNA, 64 nt, Homo Sapiens
ccuggugaguuggggggcagggguugucuugggccagccucaguuuuugucaggccaugaaucc

SEQ ID NO: 732161 - RNA, 64 nt, Homo Sapiens
aagugcugggauuauaggcgugagccacugugcccagccucacagcugcaucuuaaccuuaccu

SEQ ID NO: 732162 - RNA, 64 nt, Homo Sapiens
guuucuaccucccagaucggaucuguugcaaacucagccucaauaagccuugucguugacuuua

SEQ ID NO: 732163 - RNA, 64 nt, Homo Sapiens
uugaagaaaggagggacccggaacuugggccaaucagccucaccuugucccaguccacuccuaa

SEQ ID NO: 732164 - RNA, 64 nt, Homo Sapiens
ugcaaccuccaccucccggauucaagugauucuccagccucagccuccugaguagcugggauua

SEQ ID NO: 732165 - RNA, 64 nt, Homo Sapiens
uuggaguuguggguccugcccagaguccagagagcagccucagcugagcacagguccgaggggg

SEQ ID NO: 732166 - RNA, 64 nt, Homo Sapiens
agaaguuacagaaacuaaagagccaaugacuuaacagccucauuauauugucaaccuucuacac

SEQ ID NO: 732167 - RNA, 64 nt, Homo Sapiens
ccugccccugugggacucaucccccuggggaucacagccucaccggacaugagaucagggccug

SEQ ID NO: 732168 - RNA, 64 nt, Homo Sapiens
cacuuaccuggagcugcucugcuggagagcauuacagccucaucaccaccuggggacucacgua

SEQ ID NO: 732169 - RNA, 64 nt, Homo Sapiens
cuucacuccugauugaggccgcaaggcagcuccccagccucacuuggaggacccuggaaggaca

SEQ ID NO: 732170 - RNA, 64 nt, Homo Sapiens
gcuagccacaaagcccccaggaugaagugcccuccagccucagaugcugaaggauuuagacggg

SEQ ID NO: 732171 - RNA, 64 nt, Homo Sapiens
gugcaccgacuaguugcuugcccaguucuggccucagccucaaaugccuuuguagugcuuucgg

SEQ ID NO: 732172 - RNA, 64 nt, Homo Sapiens
cccaggcacugauuguggcaggaggccacaagcucagccucagguccgagccaggucaggcuuc

SEQ ID NO: 732173 - RNA, 64 nt, Homo Sapiens
gccacuugacauuccuugucguggccuugcccgccagccucaguccacgugagagaaucugccu

SEQ ID NO: 732174 - RNA, 64 nt, Homo Sapiens
gcuucuuaccaauuuccccaacuauguugcacaucagccucauuuucccccuuuauuggaaugc

SEQ ID NO: 732175 - RNA, 63 nt, Homo Sapiens
gucagaggucaaaauuuaugaaaaacaaaaugcuguaugaauggaaaucauuuugcaauugag

SEQ ID NO: 732176 - RNA, 63 nt, Homo Sapiens
acaacacccugaccucuuucucuccuccuugauuguaugaauaacccugagaucaccucuuag

SEQ ID NO: 732177 - RNA, 63 nt, Homo Sapiens
ugugugcauguguguguguguucaugugugcccuguaugaauguggcuggcucccauaucccc

SEQ ID NO: 732178 - RNA, 63 nt, Homo Sapiens
uuuggaaaugcccauugccgacuugaauuuuuuuguaugaagucccuccugauuuugugugug

SEQ ID NO: 732179 - RNA, 63 nt, Homo Sapiens
ucuugauucuuggucuauaauugcagauguuauuguaugaauguaccauaauauauuugagca

SEQ ID NO: 732180 - RNA, 63 nt, Homo Sapiens
ccuguaacaaaucucauuuuuguuaccaagaacuguaugaaagaaguaaauccaccccgauuc

SEQ ID NO: 732181 - RNA, 63 nt, Homo Sapiens
uguauaaacacuaacauuuuccccuucuguaguuguaugaaaaaacaaauauuguuagcauag

SEQ ID NO: 732182 - RNA, 63 nt, Homo Sapiens
uauuuugcauuuguuuuuucaauguguuuacauuguaugaauugagcuuuuugcccacagauu

SEQ ID NO: 732183 - RNA, 63 nt, Homo Sapiens
cuaggcccgaaaugacuagcaaauaucauuuucuguaugaauuguggaacaucacaauaaaau

SEQ ID NO: 732184 - RNA, 63 nt, Homo Sapiens
gauuuucacugggguuugagucacagcaagcuguguaugaacuuguguuuuguggugacacau

SEQ ID NO: 732185 - RNA, 63 nt, Homo Sapiens
uucaccuauauuuuguguacuuuguuacuugcauguaugaauuuuguuauguaaaauauaguu

SEQ ID NO: 732186 - RNA, 63 nt, Homo Sapiens
caauuuuauuuuuuucugcaagaaaaaguguaauguaugaaauaaaccaaagucacuuguuug

SEQ ID NO: 732187 - RNA, 63 nt, Homo Sapiens
uucagauagguucagcccacccacccccaugauuguaugaaguuuuaaaaaaaacuacagcag

SEQ ID NO: 732188 - RNA, 63 nt, Homo Sapiens
auuuugacaugauuccuuuuuccuuuuaaacaauguaugaaagauguauuuuaaaucuaaaua

SEQ ID NO: 732189 - RNA, 63 nt, Homo Sapiens
guugagucuuccuugcccccacucagucaucuuuguaugaaucccaugauuuggggguuuuuu

SEQ ID NO: 732190 - RNA, 63 nt, Homo Sapiens
aaaacaacugcagaggcuggaacugccacaggcuguaugaaaggccacuuuggaaaggguuug

SEQ ID NO: 732191 - RNA, 63 nt, Homo Sapiens
uuaacaguucaaucucaauaagaccucgcauuauguaugaauguuauucacugacuagauuua

SEQ ID NO: 732192 - RNA, 63 nt, Homo Sapiens
cuuucuagagugaugagagucaagaagaggggauguaugaacggccaaauucccaugugagag

SEQ ID NO: 732193 - RNA, 63 nt, Homo Sapiens
ccaguguccugccaggcucuguacuguccuuuguguaugaagaaaaugcuguuagcccucucu

SEQ ID NO: 732194 - RNA, 63 nt, Homo Sapiens
guagguagcauccuuugaugcuucuuugaaacuuguaugaauuuggguaugaacagauugccu

SEQ ID NO: 732195 - RNA, 63 nt, Homo Sapiens
ucaugaguagaaauuucaacaacucuuuuugaauguaugaagaguagcaguccccuuuggaug

SEQ ID NO: 732196 - RNA, 63 nt, Homo Sapiens
guuuucagugaucagaagcagcaguuauuugaguguaugaauggaaugaugaucacugugcua

SEQ ID NO: 732197 - RNA, 63 nt, Homo Sapiens
gguugugccggugccaugcuccucccugugucuuguaugaaaggggccacugugugucuuccu

SEQ ID NO: 732198 - RNA, 63 nt, Homo Sapiens
aauguacaaaucaauguuuuagucaauuauuuguguaugaaacuguccugugcuuggauaguc

SEQ ID NO: 732199 - RNA, 63 nt, Homo Sapiens
cuacacaaaaaugggcagacaugaaaucuguacuguaugaaagcagaugugggagcgacauca

SEQ ID NO: 732200 - RNA, 63 nt, Homo Sapiens
aaccacuccguuucuauucuaucaucuuagacuuguaugaaauaaguaaaagcuaucaucagc

SEQ ID NO: 732201 - RNA, 63 nt, Homo Sapiens
ggaaauaaguauaaggaaacaauguguuucucuuguaugaauuugucauuauauauuuuuaaa

SEQ ID NO: 732202 - RNA, 63 nt, Homo Sapiens
guuuugacuuaggaaucauuaaaccauuccuuuuguaugaaaucucuugauuugucuggguua

SEQ ID NO: 732203 - RNA, 63 nt, Homo Sapiens
ccuucuauuuugggcuaguuuaaaucguauuuguguaugaaaauguuaaaagaaaucucuaca

SEQ ID NO: 732204 - RNA, 63 nt, Homo Sapiens
aagugcaauuauacuucucuuuaugcuaauuguuguaugaaauaauauuuuccauuuccguua

SEQ ID NO: 732205 - RNA, 63 nt, Homo Sapiens
ugguuuuccagaggccuguugccauuuuguacauguaugaaauauaucuauuugagagcagau

SEQ ID NO: 732206 - RNA, 63 nt, Homo Sapiens
aaagguguacaaaaauuugcgguauguaaaauauguaugaagagaaaaagggggcaauaaaag

SEQ ID NO: 732207 - RNA, 63 nt, Homo Sapiens
cauugcaaauuuacuucaucggaggaaucuugguguaugaaauuauaucuucagcuuugggua

SEQ ID NO: 732208 - RNA, 63 nt, Homo Sapiens
gagaaaggagaauugaaagacaaacaucucaauuguaugaaggcuuggggaaagugcaaagga

SEQ ID NO: 732209 - RNA, 63 nt, Homo Sapiens
uuuuuacuccacacagguguauguauguguucauguaugaaaacaacaguauugaaauguaau

SEQ ID NO: 732210 - RNA, 63 nt, Homo Sapiens
aaauguaucuuugggaaaacuguaugauggauguguaugaaaaacugcuuuuuuugguuacag

SEQ ID NO: 732211 - RNA, 63 nt, Homo Sapiens
ugucacauguaucacccccacaaauuauaugaguguaugaauucuacgcugauuugaucuuua

SEQ ID NO: 732212 - RNA, 63 nt, Homo Sapiens
augcuuuaaguagaauucagucaaauucucuacuguaugaauuacucuccauaccccguguac

SEQ ID NO: 732213 - RNA, 63 nt, Homo Sapiens
gcuguguaucuguuuuuccaacccaccugcugcuguaugaauaaaagcagacauuuuccucac

SEQ ID NO: 732214 - RNA, 63 nt, Homo Sapiens
agcauuuuggggguggguggguguggggugggcuguaugaagucaaugcuugguuuggggagu

SEQ ID NO: 732215 - RNA, 63 nt, Homo Sapiens
uuuaggaaaagucuuauauauguaagucuguuguguaugaaauucuacuugcuggaaaaucau

SEQ ID NO: 732216 - RNA, 63 nt, Homo Sapiens
acuggaagaggucaccuaggacuucaagaacaguguaugaaacgacaagaugacucaaaggag

SEQ ID NO: 732217 - RNA, 63 nt, Homo Sapiens
auguauaaauauaugaugcuucuaauacuauacuguaugaaauauucugugccauuuacaguu

SEQ ID NO: 732218 - RNA, 63 nt, Homo Sapiens
cauuauccuccuuauuuauuguuauuuuuauuuuguaugaauaaacauuuggccuuuuacuau

SEQ ID NO: 732219 - RNA, 63 nt, Homo Sapiens
agcaagugacuuucuaaguaauuaugauugcauuguaugaaagagacuacagcaugacguagu

SEQ ID NO: 732220 - RNA, 63 nt, Homo Sapiens
cagucaaauuggcaccuacuggcucugacuuuuuguaugaagcaugccucaguuuccucauuu

SEQ ID NO: 732221 - RNA, 63 nt, Homo Sapiens
gaugcugucaaugcccgagugacacaugagagcuguaugaauugagagaaaaggcaacaagua

SEQ ID NO: 732222 - RNA, 63 nt, Homo Sapiens
aggucauuuaggaaaaaacuucuguccaagcuuuguaugaauuaaauucauaaguauaccaaa

SEQ ID NO: 732223 - RNA, 56 nt, Homo Sapiens
ugaucagccagccuaacugaagaugauguaugaaggaguuggaguuguugaaacca

SEQ ID NO: 732224 - RNA, 63 nt, Homo Sapiens
auuacaguuaagaaggagaaacuucuauaagacuguaugaacaaggugauaucuucauagugg

SEQ ID NO: 732225 - RNA, 63 nt, Homo Sapiens
ccgguuugccccgggauauuauagaaaauuauuuguaugaauaaugaaaauaaaacacaccuc

SEQ ID NO: 732226 - RNA, 63 nt, Homo Sapiens
ccgauugcaggacacaagcacaguuuuaagaguuguaugaacauggagaggacuuuugguuuu

SEQ ID NO: 732227 - RNA, 63 nt, Homo Sapiens
cuggagaggaaaugacugcugaaauaaggcgauuguaugaauauuuaaaaugccuggaacacu

SEQ ID NO: 732228 - RNA, 63 nt, Homo Sapiens
agguagaccuaaauucaauaugacugguuuccuuguaugaaaaggagaggacacagagacaga

SEQ ID NO: 732229 - RNA, 63 nt, Homo Sapiens
uugacauuguagagcuucuggcacuuggagacuuguaugaaagauggcugugccucugccugu

SEQ ID NO: 732230 - RNA, 63 nt, Homo Sapiens
aguaaguaacugagagcauaaaauaaaccugacuguaugaagucaauuuaagugaugagaaca

SEQ ID NO: 732231 - RNA, 63 nt, Homo Sapiens
ggugaagggauguuguuucuuaaauaccuaccauguaugaagcuauacacagcauauaccgaa

SEQ ID NO: 732232 - RNA, 63 nt, Homo Sapiens
ucaacguuuguuccuguguguacaauuguacuuuguaugaacagcuuuaucauuuuuauaggc

SEQ ID NO: 732233 - RNA, 63 nt, Homo Sapiens
uauuauucaaaaaaauguacuggugugauaucuuguaugaaugaucauuuaaauacaguacau

SEQ ID NO: 732234 - RNA, 63 nt, Homo Sapiens
auauuauagugcauuuuagccuaauucauuaucuguaugaaguuauaaaaguagcuguagaug

SEQ ID NO: 732235 - RNA, 63 nt, Homo Sapiens
cuucccuucuucccuauugaaccuugauuaaaauguaugaauacaauacuuggauuuuuuuuu

SEQ ID NO: 732236 - RNA, 63 nt, Homo Sapiens
cacuuacauccaaggcacugucacuacggugauuguaugaaguuugaaugcugcaaguuauga

SEQ ID NO: 732237 - RNA, 63 nt, Homo Sapiens
cucguuuaagaggcagcuagaaucuuuaccauauguaugaauuuguauaauuucauuuuugga

SEQ ID NO: 732238 - RNA, 63 nt, Homo Sapiens
cugaaagagauugcuaauaaaaucaaauaaaacuguaugaacucuaauggagaaaaaucuaau

SEQ ID NO: 732239 - RNA, 63 nt, Homo Sapiens
ugucagcgggugacguguguucuuuugaguccuuguaugaauaaaaggcuggaaaccuacagc

SEQ ID NO: 732240 - RNA, 63 nt, Homo Sapiens
gaauuuaauuuuuaaaagacuuugauguguuuuuguaugaaguacuuuuaacguauguauuuc

SEQ ID NO: 732241 - RNA, 63 nt, Homo Sapiens
uaguauccacaucauaaauucaaugccgauaaauguaugaaguaaagaauaaaauauuuugga

SEQ ID NO: 732242 - RNA, 63 nt, Homo Sapiens
ucaaccauguuuucucucacauuuucauauaaauguaugaaaaacugugaaauaauaaggccg

SEQ ID NO: 732243 - RNA, 63 nt, Homo Sapiens
ucagccucauuauuuauaguuuucugugaguuuuguaugaaaauguauauguaauaagguuua

SEQ ID NO: 732244 - RNA, 63 nt, Homo Sapiens
ucuucugcagaaucagcauguuacuggauaaauuguaugaagaucuguauuaaugcuugaaua

SEQ ID NO: 732245 - RNA, 63 nt, Homo Sapiens
aaaccuggucuuguguuuuugugugaauaacauuguaugaaauuaaauuagaaaaugaaaaau

SEQ ID NO: 732246 - RNA, 63 nt, Homo Sapiens
gaacugagcgucacacccugaaugaccugcauuuguaugaaguucauagacauuuuacugaga

SEQ ID NO: 732247 - RNA, 63 nt, Homo Sapiens
gugccucugacccaaauccaauaagggcuguuauguaugaaauuggaggcagggcaaacguuu

SEQ ID NO: 732248 - RNA, 63 nt, Homo Sapiens
cagucaaauaaacuaaaaacugaagaucagauauguaugaaugccuuugucacaguguugucg

SEQ ID NO: 732249 - RNA, 63 nt, Homo Sapiens
gugugaauuagaaagucacaaaguuuuaguacuuguaugaaaggccuucauucuguugcaauu

SEQ ID NO: 732250 - RNA, 63 nt, Homo Sapiens
uauauacaaagacucagcuaucuaaggaagauauguaugaaugaauuacaguguaguguuuau

SEQ ID NO: 732251 - RNA, 63 nt, Homo Sapiens
agaaaauaaaauauuugaaagaaaacuucauacuguaugaauagucauguugugggaucuuua

SEQ ID NO: 732252 - RNA, 63 nt, Homo Sapiens
gacauaaaaugugaaagccuaguuguacauuuguguaugaacuauguguuuacguaucugaca

SEQ ID NO: 732253 - RNA, 63 nt, Homo Sapiens
aaaaugcaucuauuucagagccuaacuagcgaauguaugaauguuccuccuuagaagaacaga

SEQ ID NO: 732254 - RNA, 63 nt, Homo Sapiens
gugguuguugugugcccaaugcagcccauuugcuguaugaacuccaggugugcacuguucacu

SEQ ID NO: 732255 - RNA, 63 nt, Homo Sapiens
cuugucaaaauguacuccacccuggaaucaacuuguaugaaacucccaauaauuaucucuuuc

SEQ ID NO: 732256 - RNA, 63 nt, Homo Sapiens
ugauugguaacuaggauauguguucauuuucucuguaugaauguuguacaguaauauguuuaa

SEQ ID NO: 732257 - RNA, 63 nt, Homo Sapiens
gggcuuucugaaguuuaaauuuuuuuuuccagcuguaugaaauuuuuguguuuaauuuguguu

SEQ ID NO: 732258 - RNA, 63 nt, Homo Sapiens
auauguagcacuucacagcauggggcaacauauuguaugaagcuuuguauuuuuauuaucaga

SEQ ID NO: 732259 - RNA, 63 nt, Homo Sapiens
ggcaaagugaggcucugggguuuuuauucaaacuguaugaaauuuuuucucuaagguucuuuu

SEQ ID NO: 732260 - RNA, 63 nt, Homo Sapiens
gaauuuaaaaaaccacuaaauguuuuaaccucauguaugaacuacagaaauggcuauuaaaaa

SEQ ID NO: 732261 - RNA, 63 nt, Homo Sapiens
acccuaugaaauguaagcugccuuggaaaugcauguaugaacucacuggcaaugacccacucc

SEQ ID NO: 732262 - RNA, 63 nt, Homo Sapiens
ugcuuuaaccuaggauuucaagccaauuuucuauguaugaauaguauucaaauaagaucagga

SEQ ID NO: 732263 - RNA, 63 nt, Homo Sapiens
caggaaaauaaaagagaaauuuguuuucuuuacuguaugaaaaaaaugugaaugugcugcguu

SEQ ID NO: 732264 - RNA, 63 nt, Homo Sapiens
uuuucacaaaaagauccugaugcuguugauuuuuguaugaauuuauagcaaagaauauaaauu

SEQ ID NO: 732265 - RNA, 63 nt, Homo Sapiens
uucuauaauagagcucuaaaaacaugccaccaguguaugaauaagggaaagauuaauuuuggc

SEQ ID NO: 732266 - RNA, 63 nt, Homo Sapiens
ucagcaggguguguguguguguguguguguguguguaugaaugguauauuuauuacauuauuu

SEQ ID NO: 732267 - RNA, 63 nt, Homo Sapiens
ucuggaaacaauacauuguaaauaguuuuucauuguaugaaguaguguucacauuaaaaagau

SEQ ID NO: 732268 - RNA, 63 nt, Homo Sapiens
acaugauguuugacuguaaucucaucacggauauguaugaauuuuuacagguucguuuuugaa

SEQ ID NO: 732269 - RNA, 63 nt, Homo Sapiens
cuguguuaacuuagugacauuuaaugcccaauauguaugaauagaucuaagccauuuaauuuu

SEQ ID NO: 732270 - RNA, 63 nt, Homo Sapiens
guccacccccauaaaacuguaagacaagccuccuguaugaagccagaagcacaagugccuuca

SEQ ID NO: 732271 - RNA, 63 nt, Homo Sapiens
auuuguuaugggaguagaauauauauugaauuuuguaugaagaacuauuuguuuaaauuauau

SEQ ID NO: 732272 - RNA, 63 nt, Homo Sapiens
aaaagguauaaacaccaaaaaaaaaauuaacauuguaugaagauggaaaauaagaagaugcac

SEQ ID NO: 732273 - RNA, 63 nt, Homo Sapiens
ucacuuagcaaacacauguugacuuuuaacugauguaugaauauuaauacucuaaaaauagaa

SEQ ID NO: 732274 - RNA, 63 nt, Homo Sapiens
ugugcuuuuggucccuggaaacaaauccgccuauguaugaagcuaguugauuuccaguugcac

SEQ ID NO: 732275 - RNA, 63 nt, Homo Sapiens
gcaccucucugcuuaaucuuuucuaaaaucgccuguaugaaaaauaccucgcuggauggaaaa

SEQ ID NO: 732276 - RNA, 63 nt, Homo Sapiens
uauaaaacccuaacagcggugauaucauuagacuguaugaaucaguuuuauuaccuaguguac

SEQ ID NO: 732277 - RNA, 63 nt, Homo Sapiens
ccacaaggcauagccuccaaguauacucucaaauguaugaagcaacuggggugggcagaagac

SEQ ID NO: 732278 - RNA, 63 nt, Homo Sapiens
gauuauaccccauuggaggcuuuuaauuuuauuuguaugaauuuuccaggauuucauuaaaaa

SEQ ID NO: 732279 - RNA, 63 nt, Homo Sapiens
agcauguaccccauggauuuuuugacuuucaaauguaugaaccgauuguccaguuaucauaca

SEQ ID NO: 732280 - RNA, 63 nt, Homo Sapiens
uuaaaguaauaugaaugaaaauggcagaauacauguaugaauaaauuuggaaagguuauuuac

SEQ ID NO: 732281 - RNA, 63 nt, Homo Sapiens
aauugcuauacauuuauaagccucugugcaguuuguaugaauguuuuaguagguuuuguuuaa

SEQ ID NO: 732282 - RNA, 63 nt, Homo Sapiens
cuucaacugucuuacaagaguggggcuggaaaauguaugaauugugauucuguguggccuuuu

SEQ ID NO: 732283 - RNA, 63 nt, Homo Sapiens
uguauuggauuacauuaaguuuuaacugcuauuuguaugaagucgaaauuuuacuacguguga

SEQ ID NO: 732284 - RNA, 63 nt, Homo Sapiens
aagcuguaaggccuguagcucuaaacucauaccuguaugaauuuguauauugauugagacuau

SEQ ID NO: 732285 - RNA, 63 nt, Homo Sapiens
uaaguaagacacaagguacuugcuuucugggucuguaugaacaaacagaucuuuucauucacg

SEQ ID NO: 732286 - RNA, 63 nt, Homo Sapiens
uagagucacuguauaagggucuaugaguagcuguguaugaauaaauauuaccugucuaccuca

SEQ ID NO: 732287 - RNA, 63 nt, Homo Sapiens
uaaaggacagaagugcaauuuagcuuaaauggguguaugaauggucuagaaacauuucuauuu

SEQ ID NO: 732288 - RNA, 63 nt, Homo Sapiens
uauguauguaaaacuguuuccugaacaauaagauguaugaacggagcagaaauaaauacuuuu

SEQ ID NO: 732289 - RNA, 63 nt, Homo Sapiens
uucacaaguucaaucuguuuuucauguaaauuuuguaugaaaaaucaaugucaaguaccaaaa

SEQ ID NO: 732290 - RNA, 63 nt, Homo Sapiens
uuguguggcagugauuggucuguuuguggagaauguaugaaagcuauuaauauucuagaauag

SEQ ID NO: 732291 - RNA, 63 nt, Homo Sapiens
uaucguucucaauucuauagacuuucaagccuauguaugaauaugaagggguuuuuuuuuuuu

SEQ ID NO: 732292 - RNA, 63 nt, Homo Sapiens
gagaaacucuauuuugaugucaauauagauuacuguaugaaguagcuuugugucuguuaccug

SEQ ID NO: 732293 - RNA, 63 nt, Homo Sapiens
aaauauauauguauguguauauauauacauguauguaugaaauauauauaugugcgugugugu

SEQ ID NO: 732294 - RNA, 63 nt, Homo Sapiens
guguguaacuguggugagggguggacuguggucuguaugaaucuuugcuucgcgagcccuggu

SEQ ID NO: 732295 - RNA, 63 nt, Homo Sapiens
auuuuaaagaaauaaaaaucgacuguaaccauuuguaugaauuuugguuaaaaucauguuugu

SEQ ID NO: 732296 - RNA, 63 nt, Homo Sapiens
uuccugugauuuuuuuuaaaugguuuuauucauuguaugaaaacaauucuacauguauuguug

SEQ ID NO: 732297 - RNA, 63 nt, Homo Sapiens
cuuuuucaugguaguucauuaaguuuaacucauuguaugaauuaaauuuuguucucugagcca

SEQ ID NO: 732298 - RNA, 63 nt, Homo Sapiens
uucaagaacauaugucaguuuuguggucacgauuguaugaaagugugaaauccagcaacugaa

SEQ ID NO: 732299 - RNA, 63 nt, Homo Sapiens
gcugugcugcaaagccaaacuuguacaguauaguguaugaauuuuccagucuugcugguaauu

SEQ ID NO: 732300 - RNA, 63 nt, Homo Sapiens
caagaaacaucugguacagcgucuugaaccuuuuguaugaaacagcagcuccaugcucgcuac

SEQ ID NO: 732301 - RNA, 63 nt, Homo Sapiens
uguuaaauauuguaagaaagaacauuucaacucuguaugaaaaagggaaaauuauuccaugua

SEQ ID NO: 732302 - RNA, 63 nt, Homo Sapiens
accccacugaagcauuauacagaauuauuauguuguaugaacauagauuaguuuuguugggga

SEQ ID NO: 732303 - RNA, 63 nt, Homo Sapiens
acgauaauagccuuacacugcuagaaaauuuuauguaugaaaaaauugcauuguguuacagag

SEQ ID NO: 732304 - RNA, 63 nt, Homo Sapiens
agcauaaaaaauaaauaaauaaguaauaaauucuguaugaauaucuuaucccaaaauucuaga

SEQ ID NO: 732305 - RNA, 63 nt, Homo Sapiens
uuuuuuaauucuaauguucaaaucacugcgugcuguaugaaucuagaaagccuuaauuuacua

SEQ ID NO: 732306 - RNA, 63 nt, Homo Sapiens
aguguuuuuuuaaccauuguuaaucagcuuuuguguaugaaagacacaguaaaauuucuuucu

SEQ ID NO: 732307 - RNA, 63 nt, Homo Sapiens
cuguucaaguuaaucuagaaauuuauucaauucuguaugaacaccuggaagcaaaaucauagu

SEQ ID NO: 732308 - RNA, 63 nt, Homo Sapiens
aggugagaauaagaaauagccaacuaguuaaaauguaugaaaagaaaacuuuccccugcugua

SEQ ID NO: 732309 - RNA, 63 nt, Homo Sapiens
aauaauuuacagguucuuaggcuccauccuguuuguaugaaauuauaaucuguggauuggccu

SEQ ID NO: 732310 - RNA, 63 nt, Homo Sapiens
cuuuggcuuucagaaagauacagugauaauguguguaugaaucagucacaaugaauuuuacuu

SEQ ID NO: 732311 - RNA, 63 nt, Homo Sapiens
uuagccagugggggcuuaugguugugugaaccauguaugaaaauccagugggccccaaccaag

SEQ ID NO: 732312 - RNA, 63 nt, Homo Sapiens
cugauuuuaacugcuaggauuuuagguucucuguguaugaaucgugacaagugacaaaaucua

SEQ ID NO: 732313 - RNA, 63 nt, Homo Sapiens
uaaauauuuauauauuuuuaggugguuuguguguguaugaagguaagaaguauuuuacccacu

SEQ ID NO: 732314 - RNA, 63 nt, Homo Sapiens
uuaaggaagggggugaggauggggcauuuauaauguaugaaagaggguugaggagacuguugg

SEQ ID NO: 732315 - RNA, 63 nt, Homo Sapiens
caaauggauaggcaucuuguagcuacuaaaaccuguaugaacuuaaaaauguuuuuuaguucu

SEQ ID NO: 732316 - RNA, 63 nt, Homo Sapiens
guguuguuaguacucagauauguuaaguuucuuuguaugaacuauauaucuguauuuuacuac

SEQ ID NO: 732317 - RNA, 63 nt, Homo Sapiens
auguuuguacaaugaauugaucauagccuauuguguaugaaagacaccauaugccucauuuua

SEQ ID NO: 732318 - RNA, 63 nt, Homo Sapiens
aaaaaauuuuuuuaaagaaaauggaucuauuuuuguaugaaaagcugagaaauuguuuugcaa

SEQ ID NO: 732319 - RNA, 63 nt, Homo Sapiens
auauguuccagugaaaauggcccuugaauuauuuguaugaauuagguuuugucccauuuguug

SEQ ID NO: 732320 - RNA, 63 nt, Homo Sapiens
cugagaucagugagcucugaagggcucuucuccuguaugaacuuuccacccucgugauuguau

SEQ ID NO: 732321 - RNA, 63 nt, Homo Sapiens
ucugaggccuugauuuaaauuggucuugguguuuguaugaaauaauaccaauacuuaggauuu

SEQ ID NO: 732322 - RNA, 63 nt, Homo Sapiens
uaguuaggcuucugagcuugcaaucauauugaauguaugaagagcgaaaucaaauucuuauuu

SEQ ID NO: 732323 - RNA, 63 nt, Homo Sapiens
ugagguauauaugauuuuuaacuguauuagggguguaugaaccaguuuaaaaacgagguuuua

SEQ ID NO: 732324 - RNA, 63 nt, Homo Sapiens
cauguaccaagguuuugcuauaaaaguuuugucuguaugaauaauguggcuuuaguaaauaau

SEQ ID NO: 732325 - RNA, 63 nt, Homo Sapiens
agauuuguggguuuugugccuuauaaauggaaauguaugaacacaauauaugcucauguagaa

SEQ ID NO: 732326 - RNA, 63 nt, Homo Sapiens
ccugagaaaccaaacacagcuaaugcuaugggguguaugaauaugucaaguuuaggucauuua

SEQ ID NO: 732327 - RNA, 63 nt, Homo Sapiens
uguuugauauuaugaacaggaaacauaauuuaauguaugaauagaugugaauuugggauuuca

SEQ ID NO: 732328 - RNA, 63 nt, Homo Sapiens
ugcuuauugucucauuuuguagucuuuuaaaguuguaugaacccuuaauuugaagaacuaacu

SEQ ID NO: 732329 - RNA, 63 nt, Homo Sapiens
augggaugcauuugaucucagucgaccuucuaauguaugaagaacuuggucugcuucaaggag

SEQ ID NO: 732330 - RNA, 63 nt, Homo Sapiens
uccuggcuugcagcucgggaucuaaaauguauguguaugaagauuuugaaaggacuauuaucc

SEQ ID NO: 732331 - RNA, 63 nt, Homo Sapiens
ggccacugguauccugccauccuggguuuacucuguaugaagaucauggggacuccacuccug

SEQ ID NO: 732332 - RNA, 63 nt, Homo Sapiens
ucacuagccgcagcuuauaacucaaggagauauuguaugaaucaacaguagaaccuguguaac

SEQ ID NO: 732333 - RNA, 63 nt, Homo Sapiens
auaugugaaaggauaugaaucucugauuuauuuuguaugaaaugggcugccuccaagaggaac

SEQ ID NO: 732334 - RNA, 63 nt, Homo Sapiens
ccagaaauuugucaguucauaaauguuuaaauauguaugaaugucuguacaaauauuagcacu

SEQ ID NO: 732335 - RNA, 63 nt, Homo Sapiens
auuugcaucuuucaguggccgcuuacgcuauauuguaugaauucauauaauuuauauaugaaa

SEQ ID NO: 732336 - RNA, 63 nt, Homo Sapiens
uggaguguaauauuuauauuacaucaacucaguuguaugaaucaaucuacuacuuuaaaugua

SEQ ID NO: 732337 - RNA, 63 nt, Homo Sapiens
gaaaaaaggggcagagugcaaucugucugugguuguaugaaauuuaucccaaguacuccauau

SEQ ID NO: 732338 - RNA, 63 nt, Homo Sapiens
uguauauugcacaacaguccucaaauacacugauguaugaaacuauucauacaucaagcagca

SEQ ID NO: 732339 - RNA, 63 nt, Homo Sapiens
uauuguaacaaauucaauauccuagucuucauuuguaugaaugguuuguauuguacauaguuu

SEQ ID NO: 732340 - RNA, 63 nt, Homo Sapiens
gcuaaacguggaagaagggaaguuuucuaguauuguaugaaaauguuuaaauauuuucaagga

SEQ ID NO: 732341 - RNA, 63 nt, Homo Sapiens
cauaaugcaguacauuucaaaauuuuuagauuauguaugaacuuagauuuuuaaacauguuuu

SEQ ID NO: 732342 - RNA, 63 nt, Homo Sapiens
ugguggaccuguaauauccacauugugaagcuguguaugaaauucaacuauaauaugaauaaa

SEQ ID NO: 732343 - RNA, 63 nt, Homo Sapiens
agcauuaagagauguaaaugauaaaggaauuauuguaugaaauauuacaaagcguagacuaug

SEQ ID NO: 732344 - RNA, 63 nt, Homo Sapiens
cucauaaaauaggauuugaaggaugaaauuaauuguaugaagcaaugugauuauaugaagaga

SEQ ID NO: 732345 - RNA, 63 nt, Homo Sapiens
gcuuaaggcuguaacucuucuaucggggcuaauuguaugaauaggugucaguauguugaagau

SEQ ID NO: 732346 - RNA, 63 nt, Homo Sapiens
acaauugaaaaaaacuauuggaauaauagcacuuguaugaaauucaguuuuggaacuaaacag

SEQ ID NO: 732347 - RNA, 63 nt, Homo Sapiens
uuguauacugucuuuuaauccuucauuguuucauguaugaaguuuuuaaucacccccuaaccc

SEQ ID NO: 732348 - RNA, 63 nt, Homo Sapiens
gauguaauguacauagaugacauuaagaaaauuuguaugaaauaauuuagucaucaugaaaua

SEQ ID NO: 732349 - RNA, 63 nt, Homo Sapiens
uaaaguauauauauacauauauauauauauauauguaugaaacccgcauggaauuaucuguau

SEQ ID NO: 732350 - RNA, 63 nt, Homo Sapiens
uauauauauguaugaaacccgcauggaauuaucuguaugaaaucaaggugcgcuguggaaaca

SEQ ID NO: 732351 - RNA, 63 nt, Homo Sapiens
uggcuagugcuuacauuugcucaaaaagcauguuguaugaagcugacugccaccaugcuaaag

SEQ ID NO: 732352 - RNA, 63 nt, Homo Sapiens
gagugauagcuacuguagaaaggaaauagacuuuguaugaacucuuuaaguugaaaaguaaaa

SEQ ID NO: 732353 - RNA, 63 nt, Homo Sapiens
gcugauuuaaaguugugcaggaaacaucuucuguguaugaagcaaaugucgauguuuugaaaa

SEQ ID NO: 732354 - RNA, 63 nt, Homo Sapiens
aaaauacugcaggaugcuuagugcucaguguuauguaugaacuuguggacuuuacaaugcagg

SEQ ID NO: 732355 - RNA, 63 nt, Homo Sapiens
cuuuuggucucccugggaguccccaacuugagauguaugaaggccccuucccccuuuuuuguc

SEQ ID NO: 732356 - RNA, 63 nt, Homo Sapiens
ugauuuaauuaacaagaaaaguaaaauauuagcuguaugaauacauugucuuauuuuauuucu

SEQ ID NO: 732357 - RNA, 63 nt, Homo Sapiens
gcaccugaugaaaauauuugcacaaaaaugauguguaugaaaaugaaaacaggcauguggaaa

SEQ ID NO: 732358 - RNA, 63 nt, Homo Sapiens
agccucgggcaggggucucaucauucuggccgcuguaugaagcgccggacgcugugucacccc

SEQ ID NO: 732359 - RNA, 63 nt, Homo Sapiens
auauguugauacuaugacaugggagaaauacacuguaugaaguccuaccggaauauaauuaaa

SEQ ID NO: 732360 - RNA, 63 nt, Homo Sapiens
auaaucaacauaaugcugauuccagacuggaaauguaugaauggauucuuguagcuacuacau

SEQ ID NO: 732361 - RNA, 63 nt, Homo Sapiens
aucucaaacuggaacauaaauaaauauauguuguguaugaaguagcagaaguuuucagggcau

SEQ ID NO: 732362 - RNA, 63 nt, Homo Sapiens
ugugucuauaauuauuaccauuauccagauuauuguaugaaguaacaugaugcuucuugcaua

SEQ ID NO: 732363 - RNA, 63 nt, Homo Sapiens
aaauauugauuugauuacagacuuuucuacuccuguaugaauauauuucuguucaugucuucu

SEQ ID NO: 732364 - RNA, 63 nt, Homo Sapiens
gggaccccccuaauguaauggauuucucaauacuguaugaauaaugaaacuuacuaucauaaa

SEQ ID NO: 732365 - RNA, 63 nt, Homo Sapiens
ccuauaacuuuugguaucuacuucuacauccaauguaugaauuaagcuguaagauaauguugc

SEQ ID NO: 732366 - RNA, 63 nt, Homo Sapiens
cugcuaggauccuacauaggauuucuauagaaauguaugaaauucuguggucacugcauguca

SEQ ID NO: 732367 - RNA, 63 nt, Homo Sapiens
auuuuugaaccugcauuucuuucuuauguguaguguaugaagaaagacuagaauguagcuuua

SEQ ID NO: 732368 - RNA, 63 nt, Homo Sapiens
aaaaauguuguauaauaguguaauacuuuucuuuguaugaaaauguccucuucuucaaaggua

SEQ ID NO: 732369 - RNA, 63 nt, Homo Sapiens
ucaaucuacuuaucaucuugggucuuugaguauuguaugaaagauccuucgugcacaccacac

SEQ ID NO: 732370 - RNA, 63 nt, Homo Sapiens
aagaaauaugaguaauucuacauguaguagagguguaugaagaucauauaacaauuaaacaua

SEQ ID NO: 732371 - RNA, 63 nt, Homo Sapiens
uuuugauguguuaaguugaagaaagguaacucguguaugaaccccgagccauuucccuguugu

SEQ ID NO: 732372 - RNA, 63 nt, Homo Sapiens
caaggcacacuccaggaagagccuggcugcaucuguaugaaauuccaaaaguggguucuaaau

SEQ ID NO: 732373 - RNA, 63 nt, Homo Sapiens
aucucauaaaacaguaucacgcaguccagagcauguaugaauaaugauaugauugacugaugc

SEQ ID NO: 732374 - RNA, 63 nt, Homo Sapiens
auguuuuauauaaucuccuagcauauuauuuccuguaugaaauuuguugguuuuuugauuuua

SEQ ID NO: 732375 - RNA, 63 nt, Homo Sapiens
agagcuguaagaaggauuuucaaaagugaauaauguaugaauguaaauuuauuguguauggau

SEQ ID NO: 732376 - RNA, 63 nt, Homo Sapiens
auucguccagcagcaccagggaguuacaaacaguguaugaagcaauuagaaaaagccaggaau

SEQ ID NO: 732377 - RNA, 63 nt, Homo Sapiens
agaagagcagggacauaaaggcgagggaggcucuguaugaaacaccaagcgccuccacgggag

SEQ ID NO: 732378 - RNA, 63 nt, Homo Sapiens
agauacaggugugugugcaccucugcauaugccuguaugaagguggaccccgauuggugaggg

SEQ ID NO: 732379 - RNA, 63 nt, Homo Sapiens
ugagauguugucuauagcuaauugaaugaguucuguaugaaacuuuguguuuauuuuuauaug

SEQ ID NO: 732380 - RNA, 63 nt, Homo Sapiens
uaucacaguuuauccauucuaguacuauuucauuguaugaauauuuguuucuuuuuauuacca

SEQ ID NO: 732381 - RNA, 63 nt, Homo Sapiens
cagcagcaagaaaaaaaaauauuugcaaugggauguaugaauaagaaugaaaaaugaaagaug

SEQ ID NO: 732382 - RNA, 63 nt, Homo Sapiens
caucaaguauucauuuauugugggauucuugccuguaugaaugacagagcuucucugggaugc

SEQ ID NO: 732383 - RNA, 63 nt, Homo Sapiens
ucucuuuguuuuuaaacaaaagauauuauuuuguguaugaaucuaaaucaagcccaucuguca

SEQ ID NO: 732384 - RNA, 63 nt, Homo Sapiens
auauuaccaccucucuuuguaauuuacuuuacuuguaugaauuuaacaucucuagcauguauc

SEQ ID NO: 732385 - RNA, 63 nt, Homo Sapiens
aacagggaagggcuggggugugaaaaagaagauuguaugaaaaccauugguaauuuuuauuuu

SEQ ID NO: 732386 - RNA, 63 nt, Homo Sapiens
ugaagggcuauagccaaaguauuuuuacuagccuguaugaaaucacuaguccuuauuuuuaaa

SEQ ID NO: 732387 - RNA, 63 nt, Homo Sapiens
gcccccuggaucuuggacacuuacagauugagcuguaugaauucagcgggucucacuccagag

SEQ ID NO: 732388 - RNA, 63 nt, Homo Sapiens
cuuugaaaauuauauuacuuaagacuucuaguauguaugaauuauuuagaagcugcuuuuccu

SEQ ID NO: 732389 - RNA, 63 nt, Homo Sapiens
gacauuuaguaugcuuugaaggcauagaacauuuguaugaaaaauagugauguucuuuugcaa

SEQ ID NO: 732390 - RNA, 63 nt, Homo Sapiens
gaccacauugaaggagcacaaaggggcuauauguguaugaauacaccgacacugagcagugga

SEQ ID NO: 732391 - RNA, 63 nt, Homo Sapiens
uuguguuuuuuauauauaaaagguuuuuugugauguaugaaaccacuucuguguuauaaugga

SEQ ID NO: 732392 - RNA, 63 nt, Homo Sapiens
gcuacugcuguacuuccgauagcauaucagauauguaugaacuuuacugaauccuggugugaa

SEQ ID NO: 732393 - RNA, 63 nt, Homo Sapiens
ucucuuuaugauguuuguuucucugcacugccauguaugaaagcaacuuuuuauuuaaaaaag

SEQ ID NO: 732394 - RNA, 63 nt, Homo Sapiens
ccacguuugugaagagcugaaagcugagcaagcuguaugaacgccaaauggaccuucugggac

SEQ ID NO: 732395 - RNA, 63 nt, Homo Sapiens
agcaagugcuuuuuuaguguaugaucucacuccuguaugaauaguguaaaaagucacagcuaa

SEQ ID NO: 732396 - RNA, 63 nt, Homo Sapiens
uuuauguaaucucuggugcugcuuuccagucacuguaugaagugucuccccaacacuagcaaa

SEQ ID NO: 732397 - RNA, 63 nt, Homo Sapiens
auuuauuuaucucauuaacuuaaaacagcuauguguaugaaauaggucacaacagaacuugaa

SEQ ID NO: 732398 - RNA, 63 nt, Homo Sapiens
uucacauguguggguccaacacuuacuaccugguguaugaaauuggaccugaacuguuggauu

SEQ ID NO: 732399 - RNA, 63 nt, Homo Sapiens
agcuguugguugaaaucauaauuaaugcguuacuguaugaaccacaaaacagcacuauuuauu

SEQ ID NO: 732400 - RNA, 63 nt, Homo Sapiens
guuacuucuucaucaguuuuuccuuuugaaagguguaugaauucauuacauuuuuauucuaau

SEQ ID NO: 732401 - RNA, 63 nt, Homo Sapiens
caucauuaaauguguacugugaagagauuaauauguaugaagggcuuuaccaaaguccacuaa

SEQ ID NO: 732402 - RNA, 63 nt, Homo Sapiens
aaauuguacguaauguauuuaaaucaacgcaaauguaugaauaacaaauacaguucugaccuu

SEQ ID NO: 732403 - RNA, 63 nt, Homo Sapiens
aagcagguaaauugucgggggagagaguuagcauguaugaauguaaggaugagggaagcgaag

SEQ ID NO: 732404 - RNA, 63 nt, Homo Sapiens
uuuugacacagcaacuuccuguagugagcacuuuguaugaaucguggacuuccuguucucaag

SEQ ID NO: 732405 - RNA, 63 nt, Homo Sapiens
uguugcacauuaagucucagaguaacuauuauguguaugaagaaaauaauauaaucuuaguuc

SEQ ID NO: 732406 - RNA, 63 nt, Homo Sapiens
uaugcuccuaccggcaauguuuuccuaagugauuguaugaauucuuuaguagauauuaccagu

SEQ ID NO: 732407 - RNA, 63 nt, Homo Sapiens
accauacacuggaugaccuacucuaaugacauauguaugaaaacagcauucauugacacauag

SEQ ID NO: 732408 - RNA, 63 nt, Homo Sapiens
uaccuacaaugaauguuaugaacuaaauccuuauguaugaaauaacuugcccugagacuccag

SEQ ID NO: 732409 - RNA, 63 nt, Homo Sapiens
uaaagccuuuauuuguuaauuugucaguuuguuuguaugaaaccuagagaaauaagaucuuuu

SEQ ID NO: 732410 - RNA, 63 nt, Homo Sapiens
acuuuguaaauuuuguucuaaaaacacaaaaacuguaugaaugcaauuuucgaagucaguaaa

SEQ ID NO: 732411 - RNA, 63 nt, Homo Sapiens
auuuugucguccuacccuuuugcuugaaauuuuuguaugaauuaggaauaucuacagcaguga

SEQ ID NO: 732412 - RNA, 63 nt, Homo Sapiens
uugacggcgcuuuuguaaggagaagccgcuggcuguaugaaacaaaugugacucucccagaga

SEQ ID NO: 732413 - RNA, 63 nt, Homo Sapiens
agagaugugggcuuccuuuuuugcagcaaauccuguaugaaagcugguuggaagaauauagua

SEQ ID NO: 732414 - RNA, 63 nt, Homo Sapiens
accauguuugaaacucauagugauauuucacauuguaugaaauggagagggagggaugcugau

SEQ ID NO: 732415 - RNA, 63 nt, Homo Sapiens
uuuaaaucuuuuaauuucagaguuuuagggauguguaugaauaacacuccagcauaucgggug

SEQ ID NO: 732416 - RNA, 63 nt, Homo Sapiens
cuccagcagguaggggcacagugaauguguguauguaugaaggccacaucaacuuuauguagc

SEQ ID NO: 732417 - RNA, 63 nt, Homo Sapiens
uguugcagagcccuuacuuaaauccuucacugguguaugaauacuuugucauaaugcugcuuu

SEQ ID NO: 732418 - RNA, 63 nt, Homo Sapiens
gugcuauaguaaauuacaaagaaauagguagauuguaugaacauacccacaaaugccuaugau

SEQ ID NO: 732419 - RNA, 63 nt, Homo Sapiens
ugaaauuauauguguguggugugugaauaaauauguaugaauauauggucuguguuuucuuuu

SEQ ID NO: 732420 - RNA, 63 nt, Homo Sapiens
cccucaaggguguguauauuguauaggggcaacuguaugaaaaauuggggaggagggggccgg

SEQ ID NO: 732421 - RNA, 63 nt, Homo Sapiens
auucacucauguguuccagauguauucuaauuguguaugaaauguauguacacauaagugugu

SEQ ID NO: 732422 - RNA, 63 nt, Homo Sapiens
uggguucaaauucugaaacugucacuuauuaccuguaugaacaugggcaaauuaucuaaucuc

SEQ ID NO: 732423 - RNA, 63 nt, Homo Sapiens
gugccauucuccccagacuuuuuuuguacuuaauguaugaaagauccaaacuaauauugcugu

SEQ ID NO: 732424 - RNA, 63 nt, Homo Sapiens
aaauuguaaacuuaaaauauauauaaaauuuauuguaugaaaauuaagccucaauaaacguga

SEQ ID NO: 732425 - RNA, 63 nt, Homo Sapiens
uucugaaaaauuguaaaucugaucauaucaacauguaugaacuuaaaauauggagaauguuau

SEQ ID NO: 732426 - RNA, 63 nt, Homo Sapiens
acuguagcaguguguucugggcaguaucuguaauguaugaaauagagucuggaauagguuauc

SEQ ID NO: 732427 - RNA, 63 nt, Homo Sapiens
auaguguguacguauaccacauauacauauacuuguaugaagauauguguaaaauguuuuuac

SEQ ID NO: 732428 - RNA, 63 nt, Homo Sapiens
ugguuuauuuuauuucccaccuuugugugaguguguaugaaagagaagaaaaugcaauuuuua

SEQ ID NO: 732429 - RNA, 63 nt, Homo Sapiens
ccguuuuguaguuucaaauuauuuauggcagaauguaugaaaucugccuuauuguuuguuuuu

SEQ ID NO: 732430 - RNA, 63 nt, Homo Sapiens
cauggcaugauacaacuaauggucacuguauucuguaugaaugucuucucugucgcccugaag

SEQ ID NO: 732431 - RNA, 63 nt, Homo Sapiens
ggugaaggugggagcaccuuugaaaggaaugaguguaugaaaagguucaucauggugacagca

SEQ ID NO: 732432 - RNA, 63 nt, Homo Sapiens
augaccccaucacucucuuugcggucuucagaauguaugaaggccucgauggaugcgagugcg

SEQ ID NO: 732433 - RNA, 63 nt, Homo Sapiens
aaaugcugagugagccccagcuuuuuaagcagcuguaugaaaugaucucuauuuuaaaacuag

SEQ ID NO: 732434 - RNA, 63 nt, Homo Sapiens
caugaaggaaacagaggggcguacaacacaaacuguaugaagccaaugugaauucuuacgaau

SEQ ID NO: 732435 - RNA, 63 nt, Homo Sapiens
gacaugccuccauaugugcccuuaacugaauauuguaugaaaaugccauggccugaauguugg

SEQ ID NO: 732436 - RNA, 63 nt, Homo Sapiens
uuuccagaugguguucagugggcaugggcauucuguaugaaccaagcaaauccuuucaagaau

SEQ ID NO: 732437 - RNA, 61 nt, Homo Sapiens
ucugugggcagguacaugugaauaaggaaacuguaugaaugaccucuucccaggacauuaa

SEQ ID NO: 732438 - RNA, 63 nt, Homo Sapiens
ccaugcugucuguuaaauaacugauaauggauauguaugaaguguuguuugguuuucaaggca

SEQ ID NO: 732439 - RNA, 63 nt, Homo Sapiens
ucccaggauuccauccugaaauuuauuuuucuuuguaugaauauguguaaaugauuuaaaaau

SEQ ID NO: 732440 - RNA, 63 nt, Homo Sapiens
auggagagaaagggauuuuuuacugcaucccucuguaugaauaugaaaucagagaccagggca

SEQ ID NO: 732441 - RNA, 63 nt, Homo Sapiens
uaagagacauucuucauccaccaauguuguacauguaugaaaaugguguacuguauacuuuaa

SEQ ID NO: 732442 - RNA, 63 nt, Homo Sapiens
aaaguaaauaucuuuuucauauguccauuagaauguaugaaaaaaaucauuuuaacuaaaagc

SEQ ID NO: 732443 - RNA, 63 nt, Homo Sapiens
auggucucaugaguuucaaaauaauaauuuuuguguaugaacaaagcuguuguuuuuaccaug

SEQ ID NO: 732444 - RNA, 63 nt, Homo Sapiens
aauuaaugaucucuuuggaagagagcccagauuuguaugaaaacuuguuuuuccucucaauug

SEQ ID NO: 732445 - RNA, 63 nt, Homo Sapiens
agucugucuuuccuuagccgucugagugagcuguguaugaacaagucccaggaguuccaagag

SEQ ID NO: 732446 - RNA, 63 nt, Homo Sapiens
uuccccuaacgucucaacaggcgcucacugaaguguaugaauauuuuuuaaaaagguuuuugc

SEQ ID NO: 732447 - RNA, 63 nt, Homo Sapiens
ccucaaagcguugucauguggauugagaugauauguaugaaucacauaaaagagugccuggca

SEQ ID NO: 732448 - RNA, 63 nt, Homo Sapiens
uugaaugugauguauucacgauuaccggaagaguguaugaagagaguugaaaauugccuccaa

SEQ ID NO: 732449 - RNA, 63 nt, Homo Sapiens
caucaguagcugaaaauugcacaauaaaagauauguaugaaugacagauaagggcuuuauugu

SEQ ID NO: 732450 - RNA, 63 nt, Homo Sapiens
uacauaaauauuuuuaacucaaacauauauguauguaugaaugaaauuguuaaacauuuagac

SEQ ID NO: 732451 - RNA, 63 nt, Homo Sapiens
guaccaaagcauuaccgcauauaggcaagacccuguaugaauaggaaauggcaagucuuuagg

SEQ ID NO: 732452 - RNA, 63 nt, Homo Sapiens
acaauaguuugaugauuuccuuuguacguuucauguaugaauguuuaaaucauaacuauuugc

SEQ ID NO: 732453 - RNA, 63 nt, Homo Sapiens
uuuaaaaguuguugacuggacuuguguugugccuguaugaauuagauuguauagagagacuau

SEQ ID NO: 732454 - RNA, 63 nt, Homo Sapiens
uuugccaauguuuuugacacuaaauaaagaauuuguaugaaccuuaaauaggaaaauuguuau

SEQ ID NO: 732455 - RNA, 63 nt, Homo Sapiens
cuuuucuccucucccguuguuaauagguaguuuuguaugaaauuuauacuuuuuucuguauug

SEQ ID NO: 732456 - RNA, 63 nt, Homo Sapiens
agcaguauuuuccaguuuuuagguuaccuuugauguaugaaguauucacuuacggagaaugua

SEQ ID NO: 732457 - RNA, 63 nt, Homo Sapiens
cauuggcucuaucugcauuuaauuuaaguuccauguaugaaguccuguccagcagggagcuug

SEQ ID NO: 732458 - RNA, 63 nt, Homo Sapiens
uuuugcauuggcuugaagcaauagggaauauaauguaugaacuuauauucuaaacacaaugaa

SEQ ID NO: 732459 - RNA, 63 nt, Homo Sapiens
ggugagcggacaucuguuaauagacuuguaaaauguaugaacuagaagaauaucacuuauuuu

SEQ ID NO: 732460 - RNA, 63 nt, Homo Sapiens
gcccaaaggggcagaacaagaaagccacgggauuguaugaaaucaaacaugaguuuguggugu

SEQ ID NO: 732461 - RNA, 63 nt, Homo Sapiens
augaaacagaaagaucuguccaaggacacagcuuguaugaaaggguugaauuugggcuccauc

SEQ ID NO: 732462 - RNA, 63 nt, Homo Sapiens
ggggcauagaauaaaauauuaaauauuggcagauguaugaaaagaagugugaguuaaaaauau

SEQ ID NO: 732463 - RNA, 63 nt, Homo Sapiens
aaguguggugucuuuuauauuugaauuaguaacuguaugaagucauagauaauaguacauguc

SEQ ID NO: 732464 - RNA, 63 nt, Homo Sapiens
gacuuuuuaauuguaaaagauuaguugaaaaacuguaugaaugugaagaucacaugcuuaguc

SEQ ID NO: 732465 - RNA, 63 nt, Homo Sapiens
uuuuccaguaugaauguuaauguugucaguguauguaugaauaugaaagugcuuuguuuuguu

SEQ ID NO: 732466 - RNA, 63 nt, Homo Sapiens
uuagugcuuuugcaaguucaauuuguuaguuccuguaugaaagauugugggggaaaaauaaac

SEQ ID NO: 732467 - RNA, 63 nt, Homo Sapiens
guuuuaacgugcucaacuuuaauuuuuuucaauuguaugaaggccuuaaaaaagcuacauuaa

SEQ ID NO: 732468 - RNA, 63 nt, Homo Sapiens
guagcaacuguuugauuucuuucuggauacagcuguaugaacacuuuucuauuuuauacugaa

SEQ ID NO: 732469 - RNA, 63 nt, Homo Sapiens
aaugcaaugaggaaaucugacagggaaauuaucuguaugaacuaaaaguaagggaaccccggg

SEQ ID NO: 732470 - RNA, 63 nt, Homo Sapiens
caucuccgaauuagcauuucuuugcccccagacuguaugaaaagauuccuuuggauggcuuca

SEQ ID NO: 732471 - RNA, 63 nt, Homo Sapiens
aaauucuugaauucgucauuggaaagcaauuuauguaugaaaguuacccaucugcagaacuaa

SEQ ID NO: 732472 - RNA, 63 nt, Homo Sapiens
ccacacuauauaaacaauaagcccuuugauugcuguaugaauuaucuggguacagacaguaaa

SEQ ID NO: 732473 - RNA, 63 nt, Homo Sapiens
uuacuuauuaacaggccaggacaaugaccuuuuuguaugaaaaagaaaaguugggaaaagagu

SEQ ID NO: 732474 - RNA, 63 nt, Homo Sapiens
uguguggcagugaagagaacuuacuaagucauuuguaugaauaggaccacuucucauauuaga

SEQ ID NO: 732475 - RNA, 63 nt, Homo Sapiens
gugauaacuguugcccuugugacaugaaagguguguaugaacugugaggagugagugagacag

SEQ ID NO: 732476 - RNA, 63 nt, Homo Sapiens
uuaucaaauuguauucaucaaguuuuuauugaauguaugaaaaugucuuuauuguuguuaaaa

SEQ ID NO: 732477 - RNA, 63 nt, Homo Sapiens
acagugugucagauggucuuuauauauuuuuucuguaugaaggaauagccuugccuacugaag

SEQ ID NO: 732478 - RNA, 63 nt, Homo Sapiens
cggggagaagaggauacugaaacauuugugaaauguaugaaugcacuucuguaaccagauacu

SEQ ID NO: 732479 - RNA, 63 nt, Homo Sapiens
uauccuauuucugggggaggauguacguggccauguaugaagccaaauauuaggcuuaaaaac

SEQ ID NO: 732480 - RNA, 63 nt, Homo Sapiens
gauuuuuaugugucuuugacagcuagugucuaguguaugaaaguggaaaaggacauuucugua

SEQ ID NO: 732481 - RNA, 63 nt, Homo Sapiens
uuauuugugcauauuuuuuaacaaugcccaaucuguaugaauaauguaaacuucgauuuuuuu

SEQ ID NO: 732482 - RNA, 63 nt, Homo Sapiens
aaauuagcagacaauccauuccuacuguauuucuguaugaauguguuugugaauguaugugua

SEQ ID NO: 732483 - RNA, 63 nt, Homo Sapiens
cggggucaguauccuguuuguuauuguuaaauuuguaugaaccuuagaaaaguuauuaaagug

SEQ ID NO: 732484 - RNA, 63 nt, Homo Sapiens
ugaaagcugagaacuccugacuguaacauauucuguaugaacuuuaucuaaagaaaaauaaau

SEQ ID NO: 732485 - RNA, 63 nt, Homo Sapiens
auuaugcauacccaguauguauacuuauuaaucuguaugaagauguacauucuaaaauauaau

SEQ ID NO: 732486 - RNA, 63 nt, Homo Sapiens
uguuuuucuuaaucuuuaaguuuuaaaugcauguguaugaacuaauuuauugacugaaaugaa

SEQ ID NO: 732487 - RNA, 63 nt, Homo Sapiens
uaagaguuucagaguucauauaaaaauuagaauuguaugaaaucaucuauuauguaucaguuu

SEQ ID NO: 732488 - RNA, 63 nt, Homo Sapiens
ccauaaaauagagcuagucacugcaacauguacuguaugaagguguuugcaaauugagcagug

SEQ ID NO: 732489 - RNA, 63 nt, Homo Sapiens
guuucuuccuuuuuuucuuuccaaguuguugcauguaugaauaauaauucccuugaaauccau

SEQ ID NO: 732490 - RNA, 63 nt, Homo Sapiens
gaaucauacagaauguaaucauuucaagaauguuguaugaauguccaucucuguaauuuuguc

SEQ ID NO: 732491 - RNA, 63 nt, Homo Sapiens
ucauguuacaggccgagugcaauggaaaaacaguguaugaaagaggagaaggauugggaacag

SEQ ID NO: 732492 - RNA, 63 nt, Homo Sapiens
cguaucugugaaagguaggacaagagagccauauguaugaaagaaauucgaagaguuagucac

SEQ ID NO: 732493 - RNA, 63 nt, Homo Sapiens
uaccacaauuuguuuccuccaagaguuuuccauuguaugaauauuuguuccuucuuauuucug

SEQ ID NO: 732494 - RNA, 63 nt, Homo Sapiens
auauuuggugacauguugucccauuaacgcuguuguaugaacaaaaagguguuuuacuguuuu

SEQ ID NO: 732495 - RNA, 63 nt, Homo Sapiens
gagagagcaaagggugucuggcguggcacucgcuguaugaaaguauuuuuguaaaguuuccgu

SEQ ID NO: 732496 - RNA, 63 nt, Homo Sapiens
ggguccuugugacuucaacggacucuuccaaauuguaugaauguaucaauguauuagauaaac

SEQ ID NO: 732497 - RNA, 63 nt, Homo Sapiens
agcacuaaggggagggcgcauacccgagacgauuguaugaagaaaauauggaggaacuguuac

SEQ ID NO: 732498 - RNA, 63 nt, Homo Sapiens
gggcgcuguuuuuaacgugcccguuuguacugauguaugaacuugucaauaaacacaauuguu

SEQ ID NO: 732499 - RNA, 63 nt, Homo Sapiens
gaauuuaagugacccauuaaaaucuagcacaccuguaugaaaaaucaguguagaagaauaccu

SEQ ID NO: 732500 - RNA, 63 nt, Homo Sapiens
cauuacauagggacuguacagagccugugaagauguaugaaugguaucuuuuauaauccacaa

SEQ ID NO: 732501 - RNA, 63 nt, Homo Sapiens
acuggguaagauucauggaacuuagaaaaaagcuguaugaacugcuuuaccaaauaucacuac

SEQ ID NO: 732502 - RNA, 63 nt, Homo Sapiens
uagucccauuugggugguuucagcugcacuaucuguaugaaauggugucaccaaaacccuuuu

SEQ ID NO: 732503 - RNA, 63 nt, Homo Sapiens
gcuguuguaaacaacguguauagugccuaaaauuguaugaaaauccuuuuaaccauuuuaacc

SEQ ID NO: 732504 - RNA, 63 nt, Homo Sapiens
cacaagcuaguuuucuuaguuuuaaaauccuguuguaugaauggcauuuguauauuaaaacac

SEQ ID NO: 732505 - RNA, 63 nt, Homo Sapiens
uuaauagcagaggaagacuccuuuuuucaucacuguaugaauuuuuuauaauguuuuuuuaaa

SEQ ID NO: 732506 - RNA, 63 nt, Homo Sapiens
uaauuuuaaaaugguuucuauaaaggguuuuauuguaugaaauagaacuuuauauuuuugcau

SEQ ID NO: 732507 - RNA, 63 nt, Homo Sapiens
gauuguugcugcacauaguugccuuuguaucucuguaugaaauaaaaggucauuuguucaugu

SEQ ID NO: 732508 - RNA, 63 nt, Homo Sapiens
gauuaauaccugaccucacacaguuaccacugguguaugaaaucuuugcaaagacaguguguc

SEQ ID NO: 732509 - RNA, 63 nt, Homo Sapiens
uaucaauguauuagauaaacgacucuuccaaauuguaugaaugggguccuugugacuucaacg

SEQ ID NO: 732510 - RNA, 63 nt, Homo Sapiens
uaucaauguauuacacaaaugacucuuccaaauuguaugaauuggguccuuguaacuucaacu

SEQ ID NO: 732511 - RNA, 63 nt, Homo Sapiens
auucuaguuucauuuguucauuuuuaaauuauguguaugaacauucggugucuugaauauauu

SEQ ID NO: 732512 - RNA, 63 nt, Homo Sapiens
gaagauuucucccaggaaauagguauaaaccucuguaugaagagaugcuggaauuacuccugu

SEQ ID NO: 732513 - RNA, 63 nt, Homo Sapiens
auagcuauucuuuacagcauuaaaaccuaguauuguaugaaggugcugacauacuaaaaaaaa

SEQ ID NO: 732514 - RNA, 63 nt, Homo Sapiens
uacuaaguaguauuccacuggaugguagaaacauguaugaauguguauauauaaaaaucuuga

SEQ ID NO: 732515 - RNA, 63 nt, Homo Sapiens
cauguuugacaauacuguaaguuuauucaaguuuguaugaaauuugaccuaguuagauguggu

SEQ ID NO: 732516 - RNA, 63 nt, Homo Sapiens
agcccauucaugguaagucugugaguguguuuuuguaugaaugacuguuuuaaaagaauuagu

SEQ ID NO: 732517 - RNA, 63 nt, Homo Sapiens
cagcauaggcugcccaccuaauggggccuccauuguaugaagugcucccagcuccacuggccc

SEQ ID NO: 732518 - RNA, 63 nt, Homo Sapiens
cacaugcuugucggaacgcuuuggggguaugcauguaugaacaacacagugcauugcccuuug

SEQ ID NO: 732519 - RNA, 63 nt, Homo Sapiens
guuugcaaacccgaaaauaaaagacguucauuauguaugaaaaguaacugauuuguauucugu

SEQ ID NO: 732520 - RNA, 63 nt, Homo Sapiens
ccacaggacuuaccccuguauguacaggauuuuuguaugaaaguuuuguuugauucugagacu

SEQ ID NO: 732521 - RNA, 63 nt, Homo Sapiens
gcaggucacaacuuacccuuguguguuuagauguguaugaaauaccuguauacguuagugaaa

SEQ ID NO: 732522 - RNA, 63 nt, Homo Sapiens
ccaccuuugccuccuaccagugaaccucaucuuuguaugaaagacagcaaccuccuggguaaa

SEQ ID NO: 732523 - RNA, 63 nt, Homo Sapiens
aguauucaguuagcagacagaaguguaguaugcuguaugaauauuuuauauuaaaauaugaag

SEQ ID NO: 732524 - RNA, 63 nt, Homo Sapiens
ccaacauccugaaaguuaaagaaaaaaaucuaauguaugaaugugacucaccaauuuuuauca

SEQ ID NO: 732525 - RNA, 63 nt, Homo Sapiens
uacaagaaccccuuuuaucccuggaagaggcuguguaugaaaccaaugcccaggguuugaagg

SEQ ID NO: 732526 - RNA, 63 nt, Homo Sapiens
cagaaaugcacuugugccagguauugucccugcuguaugaaaagcuucuuggcaaugaauucu

SEQ ID NO: 732527 - RNA, 63 nt, Homo Sapiens
uauacuugaacaguuccaacuguacauacauacuguaugaagcuuguccucugacuagguuuc

SEQ ID NO: 732528 - RNA, 63 nt, Homo Sapiens
caaauaaacaugcagucucagugugcucucgcauguaugaauaucuaguccuuucugugguuc

SEQ ID NO: 732529 - RNA, 63 nt, Homo Sapiens
aauggaugaauguagacacaaaacagcaacacuuguaugaagauguaaagugcugaacauauu

SEQ ID NO: 732530 - RNA, 63 nt, Homo Sapiens
ggggugacaaggucccccugagaaccagggguguguaugaaggcacggggaagguuuuggagu

SEQ ID NO: 732531 - RNA, 63 nt, Homo Sapiens
uccaguaguuaauuugaacauaccuuauuuaucuguaugaaauugacaaaguaauguaauuuu

SEQ ID NO: 732532 - RNA, 63 nt, Homo Sapiens
uaacauggaaaauguuaagggaucauaucuacauguaugaacuccccuaaaaaugguaaaucu

SEQ ID NO: 732533 - RNA, 63 nt, Homo Sapiens
uuagauaauaauggcuguuuugcagaaaggauguguaugaagcuaauacugaagagagggguc

SEQ ID NO: 732534 - RNA, 63 nt, Homo Sapiens
ggauuugauaaaguuuuugcucuguccaguuuguguaugaaauuagagguuaugugcaacuga

SEQ ID NO: 732535 - RNA, 63 nt, Homo Sapiens
aaacccaccacaccaccacaaaauggccuuuaguguaugaaaugcacauggaggggauguagu

SEQ ID NO: 732536 - RNA, 63 nt, Homo Sapiens
aggugagacucuguuucuguuauuuuuaauugcuguaugaaaugugaucagauuauuuuacua

SEQ ID NO: 732537 - RNA, 63 nt, Homo Sapiens
ucccuuaaaaaaaaaugacacuuggaagaaaaauguaugaaauucagaaauuccgaucaaaga

SEQ ID NO: 732538 - RNA, 63 nt, Homo Sapiens
uguacuccagcauagcuuggucuuauuucuuacuguaugaaagcuuaacagcaaugugauuua

SEQ ID NO: 732539 - RNA, 63 nt, Homo Sapiens
ugaguaucacagcguccaacucaguagcuccaguguaugaaaaugucuccagggcuaaaggcu

SEQ ID NO: 732540 - RNA, 63 nt, Homo Sapiens
agaaacacauucuuauuaauucuucaccuguuauguaugaaggaaucauuccagugcuagaaa

SEQ ID NO: 732541 - RNA, 63 nt, Homo Sapiens
gcucauaauaaugaaaaaaauagaauuauauuuuguaugaauuguuucuaacaaaccuugauc

SEQ ID NO: 732542 - RNA, 63 nt, Homo Sapiens
auuuacaagcaaaagaugacaugacgugacaccuguaugaaaaugugaugauugaacucccug

SEQ ID NO: 732543 - RNA, 63 nt, Homo Sapiens
cugucagguguuaugcacuccauccaucauaacuguaugaaacacauuucauauguaaauaaa

SEQ ID NO: 732544 - RNA, 63 nt, Homo Sapiens
ugcaaacacauuucauugugagguuuuacccucuguaugaaugaagagaacgcuggaaggcug

SEQ ID NO: 732545 - RNA, 63 nt, Homo Sapiens
aacaguuuucacgucuguccuuggaaccuccucuguaugaauauucgacgggcgccucguggc

SEQ ID NO: 732546 - RNA, 63 nt, Homo Sapiens
ggggcggucaucauuucacuccaccaaacacaguguaugaagggggaagcagaaauccaagca

SEQ ID NO: 732547 - RNA, 63 nt, Homo Sapiens
agcaaacauauuugaaaguuaagggcauguauauguaugaauguuccugcauauauauguaug

SEQ ID NO: 732548 - RNA, 63 nt, Homo Sapiens
gcauguauauguaugaaugauccugcauauauauguaugaagguguaugaaugaacauacauu

SEQ ID NO: 732549 - RNA, 63 nt, Homo Sapiens
aacauacauuuccugcauaugagaguguauauguguaugaauguuaagaguauaaauagaagg

SEQ ID NO: 732550 - RNA, 63 nt, Homo Sapiens
aaagccuuauaaaaccagcuaucacagaacuuuuguaugaauaguaaauaaggcuuucugggg

SEQ ID NO: 732551 - RNA, 63 nt, Homo Sapiens
cugugggggucccggcaccuggcgugaguuucauguaugaaaacauaaaauugaaaaaaaaaa

SEQ ID NO: 732552 - RNA, 63 nt, Homo Sapiens
gugggaugcauuuagggggcgggcuugguauguuguaugaauccacucucuguuccuuuugga

SEQ ID NO: 732553 - RNA, 63 nt, Homo Sapiens
acaaauacauaagagacucacacugaaaaaaguuguaugaauauaaaaauguacuaaaaccuu

SEQ ID NO: 732554 - RNA, 63 nt, Homo Sapiens
cuugugccucucucuuucucucucuuucuuaauuguaugaaaacacaaagcacaggucaggau

SEQ ID NO: 732555 - RNA, 63 nt, Homo Sapiens
cacuuguuaucugaaagugugugaaagaaacaauguaugaaaauuuacauuugaucauccggc

SEQ ID NO: 732556 - RNA, 63 nt, Homo Sapiens
uuaacaucagaaaaauguauacuggggaaaaguuguaugaagguggugaacaugggagacuuu

SEQ ID NO: 732557 - RNA, 63 nt, Homo Sapiens
ggaaucuccugcaaacuccuacaggagaaaaguuguaugaauguggaaacuuuagaaauugaa

SEQ ID NO: 732558 - RNA, 63 nt, Homo Sapiens
aacuuuuauaugaugcauuuauucuaaugugauuguaugaacaagugaauaaaaaaccuugga

SEQ ID NO: 732559 - RNA, 63 nt, Homo Sapiens
aaaaaugauuauaaaauucaugugaaauagaaguguaugaauugcugcgacaauuuugaaaag

SEQ ID NO: 732560 - RNA, 63 nt, Homo Sapiens
guuaucugaauuccauugaagaaaaccuauuuuuguaugaauaugaccaguuucaagcagagc

SEQ ID NO: 732561 - RNA, 63 nt, Homo Sapiens
cuucuucuaccuuuauuuauucucagcucugaauguaugaaccugcucaaucaccucaucuua

SEQ ID NO: 732562 - RNA, 63 nt, Homo Sapiens
ucacuccauccagccucuugacaagcaccgcucuguaugaauuuuacuaguccggguaccuca

SEQ ID NO: 732563 - RNA, 63 nt, Homo Sapiens
ucaugcaacauaauuugaaauuuguccaugguauguaugaacaguccauuuuaaaauuacuga

SEQ ID NO: 732564 - RNA, 63 nt, Homo Sapiens
aaauggacaccauccaugaagcagcuggcacaguguaugaagaucugagguauaagcucuugc

SEQ ID NO: 732565 - RNA, 63 nt, Homo Sapiens
ugauauuacauccacaguaccacaguauuuauguguaugaauuaaggauuaaaagauaaugug

SEQ ID NO: 732566 - RNA, 63 nt, Homo Sapiens
cccgagcaaccucuccaguuauccucauaugcauguaugaauacugucauuuuucugugcgug

SEQ ID NO: 732567 - RNA, 63 nt, Homo Sapiens
cucagcagaaaaguacuuacggaauuuugcuuuuguaugaacauuuuagucggauuuuguuuu

SEQ ID NO: 732568 - RNA, 63 nt, Homo Sapiens
uagagaaucugggaauaccuacuggagagaaacuguaugaaugccaaacacaucagaaaucuc

SEQ ID NO: 732569 - RNA, 63 nt, Homo Sapiens
uaagcaguguucuaaagccuacuggggagaaacuguaugaauguaagacaugaaagaacacgu

SEQ ID NO: 732570 - RNA, 63 nt, Homo Sapiens
uguaccuguuuuccgaagaagagugaguuuguguguaugaauuuuaaguguaagaaaauuaua

SEQ ID NO: 732571 - RNA, 63 nt, Homo Sapiens
ucuguuuuuuaaacuccuuaaaaauaauaauaauguaugaagcauuugguuaaaaaauaaaau

SEQ ID NO: 732572 - RNA, 63 nt, Homo Sapiens
ccaccccacauggcccacagacccccagugccuuguaugaagcacccucugcacccucaagaa

SEQ ID NO: 732573 - RNA, 63 nt, Homo Sapiens
uuauucuauguuuuuauaaucaugucugaauuauguaugaaaauaauuuuuccuggcuaagau

SEQ ID NO: 732574 - RNA, 63 nt, Homo Sapiens
uaucagauugcaccccccucaaaaucaaaagucuguaugaaaauuuuauauauaauauauuaa

SEQ ID NO: 732575 - RNA, 63 nt, Homo Sapiens
acauucaaaagugugcucaagaaaaauacucucuguaugaagauuuuuuuuuaguccccagua

SEQ ID NO: 732576 - RNA, 63 nt, Homo Sapiens
cagacauagucaaagcuuugccgagaaaagaaauguaugaacuauauuugacaacauaaaauc

SEQ ID NO: 732577 - RNA, 63 nt, Homo Sapiens
uuuuauaguuguauuuuugaccugccuuuuauauguaugaauauuucauaguuuugcauauca

SEQ ID NO: 732578 - RNA, 63 nt, Homo Sapiens
agccuuugccagucuagccccagcagggcaccguguaugaaugcaguuuggugcuguuuuaga

SEQ ID NO: 732579 - RNA, 63 nt, Homo Sapiens
aauuguauugucaacaugggucauuuaaaguccuguaugaaccauaaccugcugugguaccuu

SEQ ID NO: 732580 - RNA, 63 nt, Homo Sapiens
cauggaacaguguggccucuuauuaaauuuuuuuguaugaaaaaaauuuugaaaaguaauauu

SEQ ID NO: 732581 - RNA, 63 nt, Homo Sapiens
gcuuguugacucuagcggcugcucuccauaguguguaugaaaaaaggguuauguggggcgugg

SEQ ID NO: 732582 - RNA, 63 nt, Homo Sapiens
gcauggugcuugcaguuuuaguaauaacaagauuguaugaaccuauuaguugauaaauuaaca

SEQ ID NO: 732583 - RNA, 63 nt, Homo Sapiens
cuucaguugccuuaauaaagccccccauuuauuuguaugaaggcuaugucuucaacuuucaga

SEQ ID NO: 732584 - RNA, 63 nt, Homo Sapiens
ugucuauugauaguacuuuuuuucagagguuauuguaugaaauuacuaauugguucuuucuau

SEQ ID NO: 732585 - RNA, 63 nt, Homo Sapiens
ugucuagcuaaugugggcagccaccacccacuguguaugaacaagucugaagcaaguuggccu

SEQ ID NO: 732586 - RNA, 63 nt, Homo Sapiens
ccuugggacuguuaugaacagaaaaugaugcaauguaugaaaaacugcuuugaggagaaaaac

SEQ ID NO: 732587 - RNA, 63 nt, Homo Sapiens
aauguaugugaugacuguauaaggaggccuguguguaugaauuuauagggaguagaaccgucu

SEQ ID NO: 732588 - RNA, 63 nt, Homo Sapiens
ggaccuccagcuuccacaaacaccaucuucagcuguaugaaagggacgguuguggugaaguuu

SEQ ID NO: 732589 - RNA, 63 nt, Homo Sapiens
auuuauuucagcauuaugugaauauaaaaauuauguaugaaauuauuuauaguuugcauuuua

SEQ ID NO: 732590 - RNA, 63 nt, Homo Sapiens
uugugagaaauuuaaaucaguaaaacuucuuuuuguaugaaaauuugguauuuuguggucaug

SEQ ID NO: 732591 - RNA, 63 nt, Homo Sapiens
caguagugugugugcaaaaucuucagugaacucuguaugaaugaaaagacacuugguaauaga

SEQ ID NO: 732592 - RNA, 63 nt, Homo Sapiens
aaaccagugggaggaaaugauuguuagaauagcuguaugaaggcaggugguguucugguaaaa

SEQ ID NO: 732593 - RNA, 63 nt, Homo Sapiens
gugggagacuucugaacaguagcacaguauuuuuguaugaaaaauuuuuucaacuguaucagu

SEQ ID NO: 732594 - RNA, 63 nt, Homo Sapiens
uuaaauggucguggccaauuaugucauagaaacuguaugaacaaccagauuuacauagcagag

SEQ ID NO: 732595 - RNA, 63 nt, Homo Sapiens
ucuuacuuaaacuuggucuucuuucaaauuguuuguaugaagaugcuguacccacuugaacag

SEQ ID NO: 732596 - RNA, 63 nt, Homo Sapiens
ccgguucucggguccuugaaaguauauacagcuuguaugaaggcuucucugggacagugugcu

SEQ ID NO: 732597 - RNA, 63 nt, Homo Sapiens
agucuuuaagccauuccagucaugaugaggugauguaugaauacaugcauacauucaaagcac

SEQ ID NO: 732598 - RNA, 63 nt, Homo Sapiens
gggggguuggguuccugaaugcaccauaaucgcuguaugaaauauuaaaaagucuaaagugaa

SEQ ID NO: 732599 - RNA, 63 nt, Homo Sapiens
aaauuguggcuggcuucccuuucugucugcuauuguaugaagaauacugauguuuaccuguau

SEQ ID NO: 732600 - RNA, 63 nt, Homo Sapiens
auaccaauacuuuagaaguuuggucgugucguuuguaugaaaaucugaggcuuugguuuaaau

SEQ ID NO: 732601 - RNA, 63 nt, Homo Sapiens
ugguuaacacuaagcuuaaguagacuauacaguuguaugaauuuguaaaaguauaugaacacc

SEQ ID NO: 732602 - RNA, 63 nt, Homo Sapiens
accaaguaagacaucucaaauacaguaguauaauguaugaauuuuguaaguauaagaaauuuu

SEQ ID NO: 732603 - RNA, 63 nt, Homo Sapiens
uaccacaauuuguuucaccuaauaaaauuccauuguaugaauauucauuccuuucuauggcug

SEQ ID NO: 732604 - RNA, 63 nt, Homo Sapiens
ugcuguacccacuugaacagcuuucaaguuguuuguaugaagaucuuacuuaaacuuggucuu

SEQ ID NO: 732605 - RNA, 63 nt, Homo Sapiens
ucaacucauuuuauucucggacacaaugugagauguaugaaaaaauguccaauuuuaccuuuu

SEQ ID NO: 732606 - RNA, 63 nt, Homo Sapiens
uggauuuaaacuuucuuauuggccaaaggccucuguaugaaauacuaauuuaaauguaauaaa

SEQ ID NO: 732607 - RNA, 63 nt, Homo Sapiens
uuuuauauccuaauuuaaaacacaacaacuaauuguaugaaacaaauucaaaccauauccaca

SEQ ID NO: 732608 - RNA, 63 nt, Homo Sapiens
uuuaccuaggguugauuccugugugaaaguauauguaugaaagacaggagcaucacuaugccu

SEQ ID NO: 732609 - RNA, 63 nt, Homo Sapiens
cauuaaaaauuguaaaguacuccaaugcacuguuguaugaauguuguagaggcucaguacuuu

SEQ ID NO: 732610 - RNA, 63 nt, Homo Sapiens
ugcccugauuuguacagauuuucuuaugagacuuguaugaagaaggccaaaucuaugcugugg

SEQ ID NO: 732611 - RNA, 63 nt, Homo Sapiens
cuacaacccuauaauaaauuaaggaguuuagguuguaugaauuguguaggugcugaaugcugu

SEQ ID NO: 732612 - RNA, 63 nt, Homo Sapiens
gaauggaggaauguuuucaagguuucuacuguauguaugaaccggauuaagggcagccacagu

SEQ ID NO: 732613 - RNA, 63 nt, Homo Sapiens
aacuuaaacugauuuuuucuucuccaaggaauauguaugaaauguguuuaugugucucagcuu

SEQ ID NO: 732614 - RNA, 63 nt, Homo Sapiens
uauaccuuugaauuuuagaauagaacaauuacuuguaugaaauuuaguaggaguucugcagua

SEQ ID NO: 732615 - RNA, 63 nt, Homo Sapiens
aaauugucccaugcaaauuauagaauuaccagcuguaugaaacgaaaaugaacacccuuguga

SEQ ID NO: 732616 - RNA, 64 nt, Homo Sapiens
ggucagaggucaaaauuuaugaaaaacaaaaugcuguaugaauggaaaucauuuugcaauugag

SEQ ID NO: 732617 - RNA, 64 nt, Homo Sapiens
uacaacacccugaccucuuucucuccuccuugauuguaugaauaacccugagaucaccucuuag

SEQ ID NO: 732618 - RNA, 64 nt, Homo Sapiens
gugugugcauguguguguguguucaugugugcccuguaugaauguggcuggcucccauaucccc

SEQ ID NO: 732619 - RNA, 64 nt, Homo Sapiens
uuuuggaaaugcccauugccgacuugaauuuuuuuguaugaagucccuccugauuuugugugug

SEQ ID NO: 732620 - RNA, 64 nt, Homo Sapiens
uucuugauucuuggucuauaauugcagauguuauuguaugaauguaccauaauauauuugagca

SEQ ID NO: 732621 - RNA, 64 nt, Homo Sapiens; identical to SEQ ID NO: 337391

SEQ ID NO: 732622 - RNA, 64 nt, Homo Sapiens; identical to SEQ ID NO: 337392

SEQ ID NO: 732623 - RNA, 64 nt, Homo Sapiens
uuauuuugcauuuguuuuuucaauguguuuacauuguaugaauugagcuuuuugcccacagauu

SEQ ID NO: 732624 - RNA, 64 nt, Homo Sapiens
ccuaggcccgaaaugacuagcaaauaucauuuucuguaugaauuguggaacaucacaauaaaau

SEQ ID NO: 732625 - RNA, 64 nt, Homo Sapiens
ugauuuucacugggguuugagucacagcaagcuguguaugaacuuguguuuuguggugacacau

SEQ ID NO: 732626 - RNA, 64 nt, Homo Sapiens
uuucaccuauauuuuguguacuuuguuacuugcauguaugaauuuuguuauguaaaauauaguu

SEQ ID NO: 732627 - RNA, 64 nt, Homo Sapiens
acaauuuuauuuuuuucugcaagaaaaaguguaauguaugaaauaaaccaaagucacuuguuug

SEQ ID NO: 732628 - RNA, 64 nt, Homo Sapiens
cuucagauagguucagcccacccacccccaugauuguaugaaguuuuaaaaaaaacuacagcag

SEQ ID NO: 732629 - RNA, 64 nt, Homo Sapiens
cauuuugacaugauuccuuuuuccuuuuaaacaauguaugaaagauguauuuuaaaucuaaaua

SEQ ID NO: 732630 - RNA, 64 nt, Homo Sapiens
gguugagucuuccuugcccccacucagucaucuuuguaugaaucccaugauuuggggguuuuuu

SEQ ID NO: 732631 - RNA, 64 nt, Homo Sapiens
aaaaacaacugcagaggcuggaacugccacaggcuguaugaaaggccacuuuggaaaggguuug

SEQ ID NO: 732632 - RNA, 64 nt, Homo Sapiens
uuuaacaguucaaucucaauaagaccucgcauuauguaugaauguuauucacugacuagauuua

SEQ ID NO: 732633 - RNA, 64 nt, Homo Sapiens
ccuuucuagagugaugagagucaagaagaggggauguaugaacggccaaauucccaugugagag

SEQ ID NO: 732634 - RNA, 64 nt, Homo Sapiens
uccaguguccugccaggcucuguacuguccuuuguguaugaagaaaaugcuguuagcccucucu

SEQ ID NO: 732635 - RNA, 64 nt, Homo Sapiens
uguagguagcauccuuugaugcuucuuugaaacuuguaugaauuuggguaugaacagauugccu

SEQ ID NO: 732636 - RNA, 64 nt, Homo Sapiens
uucaugaguagaaauuucaacaacucuuuuugaauguaugaagaguagcaguccccuuuggaug

SEQ ID NO: 732637 - RNA, 64 nt, Homo Sapiens
aguuuucagugaucagaagcagcaguuauuugaguguaugaauggaaugaugaucacugugcua

SEQ ID NO: 732638 - RNA, 64 nt, Homo Sapiens
agguugugccggugccaugcuccucccugugucuuguaugaaaggggccacugugugucuuccu

SEQ ID NO: 732639 - RNA, 64 nt, Homo Sapiens
aauguacaaaucaauguuuucagucaauuauuuguguaugaaaccuguccugugcuuggauagu

SEQ ID NO: 732640 - RNA, 64 nt, Homo Sapiens
cuacacaaaaaugggcagacaaugaaaucuguacuguaugaaagucagaugugggagcgacauc

SEQ ID NO: 732641 - RNA, 64 nt, Homo Sapiens
aaccacuccguuucuauucucaucaucuuagacuuguaugaaauaaaguaaaagcuaucaucag

SEQ ID NO: 732642 - RNA, 64 nt, Homo Sapiens
ggaaauaaguauaaggaaacaaauguguuucucuuguaugaauuaugucauuauauauuuuuaa

SEQ ID NO: 732643 - RNA, 64 nt, Homo Sapiens
guuuugacuuaggaaucauuaaaaccauuccuuuuguaugaaauccucuugauuugucuggguu

SEQ ID NO: 732644 - RNA, 64 nt, Homo Sapiens
ccuucuauuuugggcuaguuauaaaucguauuuguguaugaaaaauguuaaaagaaaucucuac

SEQ ID NO: 732645 - RNA, 64 nt, Homo Sapiens
aagugcaauuauacuucucuauuaugcuaauuguuguaugaaauaaauauuuuccauuuccguu

SEQ ID NO: 732646 - RNA, 64 nt, Homo Sapiens
ugguuuuccagaggccuguuugccauuuuguacauguaugaaauuauaucuauuugagagcaga

SEQ ID NO: 732647 - RNA, 64 nt, Homo Sapiens
aaagguguacaaaaauuugcggguauguaaaauauguaugaagaugaaaaagggggcaauaaaa

SEQ ID NO: 732648 - RNA, 64 nt, Homo Sapiens
cauugcaaauuuacuucaucaggaggaaucuugguguaugaaauauauaucuucagcuuugggu

SEQ ID NO: 732649 - RNA, 64 nt, Homo Sapiens
gagaaaggagaauugaaagaacaaacaucucaauuguaugaaggucuuggggaaagugcaaagg

SEQ ID NO: 732650 - RNA, 64 nt, Homo Sapiens
uuuuuacuccacacagguguuauguauguguucauguaugaaaaucaacaguauugaaauguaa

SEQ ID NO: 732651 - RNA, 64 nt, Homo Sapiens
aaauguaucuuugggaaaacguguaugauggauguguaugaaaacacugcuuuuuuugguuaca

SEQ ID NO: 732652 - RNA, 64 nt, Homo Sapiens
ugucacauguaucacccccaacaaauuauaugaguguaugaauuacuacgcugauuugaucuuu

SEQ ID NO: 732653 - RNA, 64 nt, Homo Sapiens
augcuuuaaguagaauucagcucaaauucucuacuguaugaauuuacucuccauaccccgugua

SEQ ID NO: 732654 - RNA, 64 nt, Homo Sapiens
gcuguguaucuguuuuuccacacccaccugcugcuguaugaauacaaagcagacauuuuccuca

SEQ ID NO: 732655 - RNA, 64 nt, Homo Sapiens
agcauuuugggggugggugguguguggggugggcuguaugaagugcaaugcuugguuuggggag

SEQ ID NO: 732656 - RNA, 64 nt, Homo Sapiens
uuuaggaaaagucuuauauauuguaagucuguuguguaugaaaucucuacuugcuggaaaauca

SEQ ID NO: 732657 - RNA, 64 nt, Homo Sapiens
acuggaagaggucaccuagggacuucaagaacaguguaugaaacugacaagaugacucaaagga

SEQ ID NO: 732658 - RNA, 64 nt, Homo Sapiens
auguauaaauauaugaugcuuucuaauacuauacuguaugaaauuauucugugccauuuacagu

SEQ ID NO: 732659 - RNA, 64 nt, Homo Sapiens
cauuauccuccuuauuuauuuguuauuuuuauuuuguaugaauaaaacauuuggccuuuuacua

SEQ ID NO: 732660 - RNA, 64 nt, Homo Sapiens
agcaagugacuuucuaaguauauuaugauugcauuguaugaaagaagacuacagcaugacguag

SEQ ID NO: 732661 - RNA, 64 nt, Homo Sapiens
gcagucaaauuggcaccuacuggcucugacuuuuuguaugaagcaugccucaguuuccucauuu

SEQ ID NO: 732662 - RNA, 64 nt, Homo Sapiens
ggaugcugucaaugcccgagugacacaugagagcuguaugaauugagagaaaaggcaacaagua

SEQ ID NO: 732663 - RNA, 64 nt, Homo Sapiens
uaggucauuuaggaaaaaacuucuguccaagcuuuguaugaauuaaauucauaaguauaccaaa

SEQ ID NO: 732664 - RNA, 56 nt, Homo Sapiens; identical to SEQ ID NO: 732223

SEQ ID NO: 732665 - RNA, 64 nt, Homo Sapiens
aauuacaguuaagaaggagaaacuucuauaagacuguaugaacaaggugauaucuucauagugg

SEQ ID NO: 732666 - RNA, 64 nt, Homo Sapiens
uccgguuugccccgggauauuauagaaaauuauuuguaugaauaaugaaaauaaaacacaccuc

SEQ ID NO: 732667 - RNA, 64 nt, Homo Sapiens
accgauugcaggacacaagcacaguuuuaagaguuguaugaacauggagaggacuuuugguuuu

SEQ ID NO: 732668 - RNA, 64 nt, Homo Sapiens
acuggagaggaaaugacugcugaaauaaggcgauuguaugaauauuuaaaaugccuggaacacu

SEQ ID NO: 732669 - RNA, 64 nt, Homo Sapiens
aagguagaccuaaauucaauaugacugguuuccuuguaugaaaaggagaggacacagagacaga

SEQ ID NO: 732670 - RNA, 64 nt, Homo Sapiens
cuugacauuguagagcuucuggcacuuggagacuuguaugaaagauggcugugccucugccugu

SEQ ID NO: 732671 - RNA, 64 nt, Homo Sapiens
uaguaaguaacugagagcauaaaauaaaccugacuguaugaagucaauuuaagugaugagaaca

SEQ ID NO: 732672 - RNA, 64 nt, Homo Sapiens
gggugaagggauguuguuucuuaaauaccuaccauguaugaagcuauacacagcauauaccgaa

SEQ ID NO: 732673 - RNA, 64 nt, Homo Sapiens
uucaacguuuguuccuguguguacaauuguacuuuguaugaacagcuuuaucauuuuuauaggc

SEQ ID NO: 732674 - RNA, 64 nt, Homo Sapiens
auauuauucaaaaaaauguacuggugugauaucuuguaugaaugaucauuuaaauacaguacau

SEQ ID NO: 732675 - RNA, 64 nt, Homo Sapiens
aauauuauagugcauuuuagccuaauucauuaucuguaugaaguuauaaaaguagcuguagaug

SEQ ID NO: 732676 - RNA, 64 nt, Homo Sapiens
ucuucccuucuucccuauugaaccuugauuaaaauguaugaauacaauacuuggauuuuuuuuu

SEQ ID NO: 732677 - RNA, 64 nt, Homo Sapiens
ccacuuacauccaaggcacugucacuacggugauuguaugaaguuugaaugcugcaaguuauga

SEQ ID NO: 732678 - RNA, 64 nt, Homo Sapiens
ucucguuuaagaggcagcuagaaucuuuaccauauguaugaauuuguauaauuucauuuuugga

SEQ ID NO: 732679 - RNA, 63 nt, Homo Sapiens; identical to SEQ ID NO: 732238

SEQ ID NO: 732680 - RNA, 64 nt, Homo Sapiens
gugucagcgggugacguguguucuuuugaguccuuguaugaauaaaaggcuggaaaccuacagc

SEQ ID NO: 732681 - RNA, 64 nt, Homo Sapiens
agaauuuaauuuuuaaaagacuuugauguguuuuuguaugaaguacuuuuaacguauguauuuc

SEQ ID NO: 732682 - RNA, 64 nt, Homo Sapiens
uaguauccacaucauaaauuacaaugccgauaaauguaugaaguuaaagaauaaaauauuuugg

SEQ ID NO: 732683 - RNA, 64 nt, Homo Sapiens; identical to SEQ ID NO: 337393

SEQ ID NO: 732684 - RNA, 64 nt, Homo Sapiens; identical to SEQ ID NO: 337394

SEQ ID NO: 732685 - RNA, 64 nt, Homo Sapiens
ucuucugcagaaucagcaugauuacuggauaaauuguaugaagaaucuguauuaaugcuugaau

SEQ ID NO: 732686 - RNA, 64 nt, Homo Sapiens
aaaccuggucuuguguuuuuugugugaauaacauuguaugaaauauaaauuagaaaaugaaaaa

SEQ ID NO: 732687 - RNA, 64 nt, Homo Sapiens
gaacugagcgucacacccugaaaugaccugcauuuguaugaaguuucauagacauuuuacugag

SEQ ID NO: 732688 - RNA, 64 nt, Homo Sapiens
gugccucugacccaaauccauauaagggcuguuauguaugaaauguggaggcagggcaaacguu

SEQ ID NO: 732689 - RNA, 64 nt, Homo Sapiens
cagucaaauaaacuaaaaacgugaagaucagauauguaugaaugcccuuugucacaguguuguc

SEQ ID NO: 732690 - RNA, 64 nt, Homo Sapiens; identical to SEQ ID NO: 337395

SEQ ID NO: 732691 - RNA, 64 nt, Homo Sapiens; identical to SEQ ID NO: 337396

SEQ ID NO: 732692 - RNA, 64 nt, Homo Sapiens
agaaaauaaaauauuugaaaagaaaacuucauacuguaugaauacgucauguugugggaucuuu

SEQ ID NO: 732693 - RNA, 64 nt, Homo Sapiens
gacauaaaaugugaaagccuaaguuguacauuuguguaugaacuaauguguuuacguaucugac

SEQ ID NO: 732694 - RNA, 64 nt, Homo Sapiens
aaaaugcaucuauuucagagaccuaacuagcgaauguaugaauguuuccuccuuagaagaacag

SEQ ID NO: 732695 - RNA, 64 nt, Homo Sapiens
gugguuguugugugcccaauugcagcccauuugcuguaugaacuaccaggugugcacuguucac

SEQ ID NO: 732696 - RNA, 64 nt, Homo Sapiens
cuugucaaaauguacuccaccccuggaaucaacuuguaugaaaccucccaauaauuaucucuuu

SEQ ID NO: 732697 - RNA, 64 nt, Homo Sapiens
ugauugguaacuaggauaugauguucauuuucucuguaugaauguuuguacaguaauauguuua

SEQ ID NO: 732698 - RNA, 64 nt, Homo Sapiens
gggcuuucugaaguuuaaauuuuuuuuuuccagcuguaugaaauauuuuguguuuaauuugugu

SEQ ID NO: 732699 - RNA, 64 nt, Homo Sapiens
auauguagcacuucacagcaauggggcaacauauuguaugaagccuuuguauuuuuauuaucag

SEQ ID NO: 732700 - RNA, 64 nt, Homo Sapiens
ggcaaagugaggcucugggguuuuuuauucaaacuguaugaaaucuuuuucucuaagguucuuu

SEQ ID NO: 732701 - RNA, 64 nt, Homo Sapiens
gaauuuaaaaaaccacuaaaauguuuuaaccucauguaugaacugacagaaauggcuauuaaaa

SEQ ID NO: 732702 - RNA, 64 nt, Homo Sapiens
acccuaugaaauguaagcugcccuuggaaaugcauguaugaacuacacuggcaaugacccacuc

SEQ ID NO: 732703 - RNA, 64 nt, Homo Sapiens
ugcuuuaaccuaggauuucaaagccaauuuucuauguaugaauaaguauucaaauaagaucagg

SEQ ID NO: 732704 - RNA, 64 nt, Homo Sapiens
caggaaaauaaaagagaaauuuuguuuucuuuacuguaugaaaaaaaaugugaaugugcugcgu

SEQ ID NO: 732705 - RNA, 64 nt, Homo Sapiens
uuuucacaaaaagauccugauugcuguugauuuuuguaugaauuuuauagcaaagaauauaaau

SEQ ID NO: 732706 - RNA, 64 nt, Homo Sapiens
uuucuauaauagagcucuaaaaacaugccaccaguguaugaauaagggaaagauuaauuuuggc

SEQ ID NO: 732707 - RNA, 64 nt, Homo Sapiens
uucagcaggguguguguguguguguguguguguguguaugaaugguauauuuauuacauuauuu

SEQ ID NO: 732708 - RNA, 64 nt, Homo Sapiens
aucuggaaacaauacauuguaaauaguuuuucauuguaugaaguaguguucacauuaaaaagau

SEQ ID NO: 732709 - RNA, 64 nt, Homo Sapiens
aacaugauguuugacuguaaucucaucacggauauguaugaauuuuuacagguucguuuuugaa

SEQ ID NO: 732710 - RNA, 64 nt, Homo Sapiens
acuguguuaacuuagugacauuuaaugcccaauauguaugaauagaucuaagccauuuaauuuu

SEQ ID NO: 732711 - RNA, 64 nt, Homo Sapiens
gguccacccccauaaaacuguaagacaagccuccuguaugaagccagaagcacaagugccuuca

SEQ ID NO: 732712 - RNA, 64 nt, Homo Sapiens
gauuuguuaugggaguagaauauauauugaauuuuguaugaagaacuauuuguuuaaauuauau

SEQ ID NO: 732713 - RNA, 64 nt, Homo Sapiens
uaaaagguauaaacaccaaaaaaaaaauuaacauuguaugaagauggaaaauaagaagaugcac

SEQ ID NO: 732714 - RNA, 64 nt, Homo Sapiens
aucacuuagcaaacacauguugacuuuuaacugauguaugaauauuaauacucuaaaaauagaa

SEQ ID NO: 732715 - RNA, 64 nt, Homo Sapiens
cugugcuuuuggucccuggaaacaaauccgccuauguaugaagcuaguugauuuccaguugcac

SEQ ID NO: 732716 - RNA, 64 nt, Homo Sapiens
ugcaccucucugcuuaaucuuuucuaaaaucgccuguaugaaaaauaccucgcuggauggaaaa

SEQ ID NO: 732717 - RNA, 64 nt, Homo Sapiens
uuauaaaacccuaacagcggugauaucauuagacuguaugaaucaguuuuauuaccuaguguac

SEQ ID NO: 732718 - RNA, 64 nt, Homo Sapiens
uccacaaggcauagccuccaaguauacucucaaauguaugaagcaacuggggugggcagaagac

SEQ ID NO: 732719 - RNA, 64 nt, Homo Sapiens
ggauuauaccccauuggaggcuuuuaauuuuauuuguaugaauuuuccaggauuucauuaaaaa

SEQ ID NO: 732720 - RNA, 64 nt, Homo Sapiens
agcauguaccccauggauuuauuugacuuucaaauguaugaaccugauuguccaguuaucauac

SEQ ID NO: 732721 - RNA, 64 nt, Homo Sapiens
uuaaaguaauaugaaugaaacauggcagaauacauguaugaauauaauuuggaaagguuauuua

SEQ ID NO: 732722 - RNA, 64 nt, Homo Sapiens
aauugcuauacauuuauaagaccucugugcaguuuguaugaauguuuuuaguagguuuuguuua

SEQ ID NO: 732723 - RNA, 64 nt, Homo Sapiens
cuucaacugucuuacaagaguuggggcuggaaaauguaugaauuugugauucuguguggccuuu

SEQ ID NO: 732724 - RNA, 64 nt, Homo Sapiens
uguauuggauuacauuaaguauuuaacugcuauuuguaugaaguacgaaauuuuacuacgugug

SEQ ID NO: 732725 - RNA, 64 nt, Homo Sapiens
aagcuguaaggccuguagcuucuaaacucauaccuguaugaauucuguauauugauugagacua

SEQ ID NO: 732726 - RNA, 64 nt, Homo Sapiens
uaaguaagacacaagguacugugcuuucugggucuguaugaacaaaacagaucuuuucauucac

SEQ ID NO: 732727 - RNA, 64 nt, Homo Sapiens
cuagagucacuguauaagggucuaugaguagcuguguaugaauaaauauuaccugucuaccuca

SEQ ID NO: 732728 - RNA, 64 nt, Homo Sapiens
cuaaaggacagaagugcaauuuagcuuaaauggguguaugaauggucuagaaacauuucuauuu

SEQ ID NO: 732729 - RNA, 64 nt, Homo Sapiens
auauguauguaaaacuguuuccugaacaauaagauguaugaacggagcagaaauaaauacuuuu

SEQ ID NO: 732730 - RNA, 64 nt, Homo Sapiens
uuucacaaguucaaucuguuuuucauguaaauuuuguaugaaaaaucaaugucaaguaccaaaa

SEQ ID NO: 732731 - RNA, 64 nt, Homo Sapiens; identical to SEQ ID NO: 337397

SEQ ID NO: 732732 - RNA, 64 nt, Homo Sapiens; identical to SEQ ID NO: 337398

SEQ ID NO: 732733 - RNA, 64 nt, Homo Sapiens
agagaaacucuauuuugaugucaauauagauuacuguaugaaguagcuuugugucuguuaccug

SEQ ID NO: 732734 - RNA, 64 nt, Homo Sapiens
gaaauauauauguauguguauauauauacauguauguaugaaauauauauaugugcgugugugu

SEQ ID NO: 732735 - RNA, 64 nt, Homo Sapiens
guguguaacuguggugaggguguggacuguggucuguaugaaucuuuugcuucgcgagcccugg

SEQ ID NO: 732736 - RNA, 64 nt, Homo Sapiens
auuuuaaagaaauaaaaaucugacuguaaccauuuguaugaauuuuugguuaaaaucauguuug

SEQ ID NO: 732737 - RNA, 64 nt, Homo Sapiens
uuccugugauuuuuuuuaaagugguuuuauucauuguaugaaaaccaauucuacauguauuguu

SEQ ID NO: 732738 - RNA, 64 nt, Homo Sapiens
cuuuuucaugguaguucauuaaaguuuaacucauuguaugaauugaaauuuuguucucugagcc

SEQ ID NO: 732739 - RNA, 64 nt, Homo Sapiens
uucaagaacauaugucaguuauuguggucacgauuguaugaaaggugugaaauccagcaacuga

SEQ ID NO: 732740 - RNA, 64 nt, Homo Sapiens
gcugugcugcaaagccaaacuuuguacaguauaguguaugaauuauuccagucuugcugguaau

SEQ ID NO: 732741 - RNA, 64 nt, Homo Sapiens
caagaaacaucugguacagccgucuugaaccuuuuguaugaaacuagcagcuccaugcucgcua

SEQ ID NO: 732742 - RNA, 64 nt, Homo Sapiens
uguuaaauauuguaagaaagaaacauuucaacucuguaugaaaauagggaaaauuauuccaugu

SEQ ID NO: 732743 - RNA, 64 nt, Homo Sapiens
accccacugaagcauuauacaagaauuauuauguuguaugaacauuagauuaguuuuguugggg

SEQ ID NO: 732744 - RNA, 64 nt, Homo Sapiens
acgauaauagccuuacacuggcuagaaaauuuuauguaugaaaaaaauugcauuguguuacaga

SEQ ID NO: 732745 - RNA, 64 nt, Homo Sapiens
agcauaaaaaauaaauaaauaaaguaauaaauucuguaugaauauucuuaucccaaaauucuag

SEQ ID NO: 732746 - RNA, 64 nt, Homo Sapiens
guuuuuuaauucuaauguucaaaucacugcgugcuguaugaaucuagaaagccuuaauuuacua

SEQ ID NO: 732747 - RNA, 64 nt, Homo Sapiens
uaguguuuuuuuaaccauuguuaaucagcuuuuguguaugaaagacacaguaaaauuucuuucu

SEQ ID NO: 732748 - RNA, 64 nt, Homo Sapiens
gcuguucaaguuaaucuagaaauuuauucaauucuguaugaacaccuggaagcaaaaucauagu

SEQ ID NO: 732749 - RNA, 64 nt, Homo Sapiens
aaggugagaauaagaaauagccaacuaguuaaaauguaugaaaagaaaacuuuccccugcugua

SEQ ID NO: 732750 - RNA, 64 nt, Homo Sapiens
uaauaauuuacagguucuuaggcuccauccuguuuguaugaaauuauaaucuguggauuggccu

SEQ ID NO: 732751 - RNA, 64 nt, Homo Sapiens
ucuuuggcuuucagaaagauacagugauaauguguguaugaaucagucacaaugaauuuuacuu

SEQ ID NO: 732752 - RNA, 64 nt, Homo Sapiens
auuagccagugggggcuuaugguugugugaaccauguaugaaaauccagugggccccaaccaag

SEQ ID NO: 732753 - RNA, 64 nt, Homo Sapiens
cugauuuuaacugcuaggauauuuagguucucuguguaugaaucagugacaagugacaaaaucu

SEQ ID NO: 732754 - RNA, 64 nt, Homo Sapiens
uaaauauuuauauauuuuuauggugguuuguguguguaugaaggcuaagaaguauuuuacccac

SEQ ID NO: 732755 - RNA, 64 nt, Homo Sapiens
uuaaggaagggggugaggaugggggcauuuauaauguaugaaagcaggguugaggagacuguug

SEQ ID NO: 732756 - RNA, 64 nt, Homo Sapiens
caaauggauaggcaucuuguuagcuacuaaaaccuguaugaacuuuaaaaauguuuuuuaguuc

SEQ ID NO: 732757 - RNA, 64 nt, Homo Sapiens
guguuguuaguacucagauacuguuaaguuucuuuguaugaacuuauauaucuguauuuuacua

SEQ ID NO: 732758 - RNA, 64 nt, Homo Sapiens
auguuuguacaaugaauugaaucauagccuauuguguaugaaaguacaccauaugccucauuuu

SEQ ID NO: 732759 - RNA, 64 nt, Homo Sapiens
aaaaaauuuuuuuaaagaaaaauggaucuauuuuuguaugaaaaggcugagaaauuguuuugca

SEQ ID NO: 732760 - RNA, 64 nt, Homo Sapiens; identical to SEQ ID NO: 337399

SEQ ID NO: 732761 - RNA, 64 nt, Homo Sapiens; identical to SEQ ID NO: 337400

SEQ ID NO: 732762 - RNA, 64 nt, Homo Sapiens
ucugaggccuugauuuaaauuuggucuugguguuuguaugaaaucaauaccaauacuuaggauu

SEQ ID NO: 732763 - RNA, 64 nt, Homo Sapiens
uuaguuaggcuucugagcuugcaaucauauugaauguaugaagagcgaaaucaaauucuuauuu

SEQ ID NO: 732764 - RNA, 64 nt, Homo Sapiens
uugagguauauaugauuuuuaacuguauuagggguguaugaaccaguuuaaaaacgagguuuua

SEQ ID NO: 732765 - RNA, 64 nt, Homo Sapiens
ucauguaccaagguuuugcuauaaaaguuuugucuguaugaauaauguggcuuuaguaaauaau

SEQ ID NO: 732766 - RNA, 64 nt, Homo Sapiens
gagauuuguggguuuugugccuuauaaauggaaauguaugaacacaauauaugcucauguagaa

SEQ ID NO: 732767 - RNA, 64 nt, Homo Sapiens
gccugagaaaccaaacacagcuaaugcuaugggguguaugaauaugucaaguuuaggucauuua

SEQ ID NO: 732768 - RNA, 64 nt, Homo Sapiens
auguuugauauuaugaacaggaaacauaauuuaauguaugaauagaugugaauuugggauuuca

SEQ ID NO: 732769 - RNA, 64 nt, Homo Sapiens
gugcuuauugucucauuuuguagucuuuuaaaguuguaugaacccuuaauuugaagaacuaacu

SEQ ID NO: 732770 - RNA, 64 nt, Homo Sapiens
augggaugcauuugaucucaggucgaccuucuaauguaugaagauacuuggucugcuucaagga

SEQ ID NO: 732771 - RNA, 64 nt, Homo Sapiens
uccuggcuugcagcucgggacucuaaaauguauguguaugaagacuuuugaaaggacuauuauc

SEQ ID NO: 732772 - RNA, 64 nt, Homo Sapiens
ggccacugguauccugccaugccuggguuuacucuguaugaagacucauggggacuccacuccu

SEQ ID NO: 732773 - RNA, 64 nt, Homo Sapiens
ucacuagccgcagcuuauaaccucaaggagauauuguaugaaucaaacaguagaaccuguguaa

SEQ ID NO: 732774 - RNA, 64 nt, Homo Sapiens
auaugugaaaggauaugaauccucugauuuauuuuguaugaaauagggcugccuccaagaggaa

SEQ ID NO: 732775 - RNA, 64 nt, Homo Sapiens
ccagaaauuugucaguucauuaaauguuuaaauauguaugaauguucuguacaaauauuagcac

SEQ ID NO: 732776 - RNA, 64 nt, Homo Sapiens
auuugcaucuuucaguggccagcuuacgcuauauuguaugaauuacauauaauuuauauaugaa

SEQ ID NO: 732777 - RNA, 64 nt, Homo Sapiens
uggaguguaauauuuauauuaacaucaacucaguuguaugaaucaaaucuacuacuuuaaaugu

SEQ ID NO: 732778 - RNA, 64 nt, Homo Sapiens
gaaaaaaggggcagagugcauaucugucugugguuguaugaaauauuaucccaaguacuccaua

SEQ ID NO: 732779 - RNA, 64 nt, Homo Sapiens
cuguauauugcacaacaguccucaaauacacugauguaugaaacuauucauacaucaagcagca

SEQ ID NO: 732780 - RNA, 64 nt, Homo Sapiens
auauuguaacaaauucaauauccuagucuucauuuguaugaaugguuuguauuguacauaguuu

SEQ ID NO: 732781 - RNA, 64 nt, Homo Sapiens
agcuaaacguggaagaagggaaguuuucuaguauuguaugaaaauguuuaaauauuuucaagga

SEQ ID NO: 732782 - RNA, 64 nt, Homo Sapiens
ucauaaugcaguacauuucaaaauuuuuagauuauguaugaacuuagauuuuuaaacauguuuu

SEQ ID NO: 732783 - RNA, 64 nt, Homo Sapiens
cugguggaccuguaauauccacauugugaagcuguguaugaaauucaacuauaauaugaauaaa

SEQ ID NO: 732784 - RNA, 64 nt, Homo Sapiens
uagcauuaagagauguaaaugauaaaggaauuauuguaugaaauauuacaaagcguagacuaug

SEQ ID NO: 732785 - RNA, 64 nt, Homo Sapiens
ucucauaaaauaggauuugaaggaugaaauuaauuguaugaagcaaugugauuauaugaagaga

SEQ ID NO: 732786 - RNA, 64 nt, Homo Sapiens
agcuuaaggcuguaacucuucuaucggggcuaauuguaugaauaggugucaguauguugaagau

SEQ ID NO: 732787 - RNA, 64 nt, Homo Sapiens
gacaauugaaaaaaacuauuggaauaauagcacuuguaugaaauucaguuuuggaacuaaacag

SEQ ID NO: 732788 - RNA, 64 nt, Homo Sapiens
auuguauacugucuuuuaauccuucauuguuucauguaugaaguuuuuaaucacccccuaaccc

SEQ ID NO: 732789 - RNA, 64 nt, Homo Sapiens
ggauguaauguacauagaugacauuaagaaaauuuguaugaaauaauuuagucaucaugaaaua

SEQ ID NO: 732790 - RNA, 64 nt, Homo Sapiens; identical to SEQ ID NO: 337401

SEQ ID NO: 732791 - RNA, 64 nt, Homo Sapiens; identical to SEQ ID NO: 337402

SEQ ID NO: 732792 - RNA, 64 nt, Homo Sapiens
cuggcuagugcuuacauuugcucaaaaagcauguuguaugaagcugacugccaccaugcuaaag

SEQ ID NO: 732793 - RNA, 64 nt, Homo Sapiens
ggagugauagcuacuguagaaaggaaauagacuuuguaugaacucuuuaaguugaaaaguaaaa

SEQ ID NO: 732794 - RNA, 64 nt, Homo Sapiens
ggcugauuuaaaguugugcaggaaacaucuucuguguaugaagcaaaugucgauguuuugaaaa

SEQ ID NO: 732795 - RNA, 64 nt, Homo Sapiens
uaaaauacugcaggaugcuuagugcucaguguuauguaugaacuuguggacuuuacaaugcagg

SEQ ID NO: 732796 - RNA, 64 nt, Homo Sapiens
cuuuuggucucccugggagucccccaacuugagauguaugaaggcccccuucccccuuuuuugu

SEQ ID NO: 732797 - RNA, 64 nt, Homo Sapiens
ugauuuaauuaacaagaaaauguaaaauauuagcuguaugaauaacauugucuuauuuuauuuc

SEQ ID NO: 732798 - RNA, 64 nt, Homo Sapiens
gcaccugaugaaaauauuugacacaaaaaugauguguaugaaaacugaaaacaggcauguggaa

SEQ ID NO: 732799 - RNA, 64 nt, Homo Sapiens
agccucgggcaggggucucacucauucuggccgcuguaugaagcggccggacgcugugucaccc

SEQ ID NO: 732800 - RNA, 64 nt, Homo Sapiens
auauguugauacuaugacauagggagaaauacacuguaugaaguuccuaccggaauauaauuaa

SEQ ID NO: 732801 - RNA, 64 nt, Homo Sapiens
auaaucaacauaaugcugauuuccagacuggaaauguaugaaugugauucuuguagcuacuaca

SEQ ID NO: 732802 - RNA, 64 nt, Homo Sapiens
aucucaaacuggaacauaaauuaaauauauguuguguaugaaguaagcagaaguuuucagggca

SEQ ID NO: 732803 - RNA, 64 nt, Homo Sapiens
ugugucuauaauuauuaccaauuauccagauuauuguaugaagucaacaugaugcuucuugcau

SEQ ID NO: 732804 - RNA, 64 nt, Homo Sapiens
aaauauugauuugauuacaguacuuuucuacuccuguaugaauauuauuucuguucaugucuuc

SEQ ID NO: 732805 - RNA, 64 nt, Homo Sapiens
ugggaccccccuaauguaauggauuucucaauacuguaugaauaaugaaacuuacuaucauaaa

SEQ ID NO: 732806 - RNA, 64 nt, Homo Sapiens
gccuauaacuuuugguaucuacuucuacauccaauguaugaauuaagcuguaagauaauguugc

SEQ ID NO: 732807 - RNA, 64 nt, Homo Sapiens
gcugcuaggauccuacauaggauuucuauagaaauguaugaaauucuguggucacugcauguca

SEQ ID NO: 732808 - RNA, 64 nt, Homo Sapiens
uauuuuugaaccugcauuucuuucuuauguguaguguaugaagaaagacuagaauguagcuuua

SEQ ID NO: 732809 - RNA, 64 nt, Homo Sapiens
uaaaaauguuguauaauaguguaauacuuuucuuuguaugaaaauguccucuucuucaaaggua

SEQ ID NO: 732810 - RNA, 64 nt, Homo Sapiens
aucaaucuacuuaucaucuugggucuuugaguauuguaugaaagauccuucgugcacaccacac

SEQ ID NO: 732811 - RNA, 64 nt, Homo Sapiens
aaagaaauaugaguaauucuacauguaguagagguguaugaagaucauauaacaauuaaacaua

SEQ ID NO: 732812 - RNA, 64 nt, Homo Sapiens
auuuugauguguuaaguugaagaaagguaacucguguaugaaccccgagccauuucccuguugu

SEQ ID NO: 732813 - RNA, 64 nt, Homo Sapiens
caaggcacacuccaggaagaugccuggcugcaucuguaugaaauuuccaaaaguggguucuaaa

SEQ ID NO: 732814 - RNA, 64 nt, Homo Sapiens; identical to SEQ ID NO: 337403

SEQ ID NO: 732815 - RNA, 64 nt, Homo Sapiens; identical to SEQ ID NO: 337404

SEQ ID NO: 732816 - RNA, 64 nt, Homo Sapiens
agagcuguaagaaggauuuuucaaaagugaauaauguaugaaugguaaauuuauuguguaugga

SEQ ID NO: 732817 - RNA, 64 nt, Homo Sapiens
auucguccagcagcaccaggugaguuacaaacaguguaugaagcaaauuagaaaaagccaggaa

SEQ ID NO: 732818 - RNA, 64 nt, Homo Sapiens
agaagagcagggacauaaagggcgagggaggcucuguaugaaacaaccaagcgccuccacggga

SEQ ID NO: 732819 - RNA, 64 nt, Homo Sapiens
agauacaggugugugugcacgcucugcauaugccuguaugaaggguggaccccgauuggugagg

SEQ ID NO: 732820 - RNA, 64 nt, Homo Sapiens
ugagauguugucuauagcuagauugaaugaguucuguaugaaacauuuguguuuauuuuuauau

SEQ ID NO: 732821 - RNA, 64 nt, Homo Sapiens
uaucacaguuuauccauucuaaguacuauuucauuguaugaauaguuuguuucuuuuuauuacc

SEQ ID NO: 732822 - RNA, 64 nt, Homo Sapiens
cagcagcaagaaaaaaaaaugauuugcaaugggauguaugaauacagaaugaaaaaugaaagau

SEQ ID NO: 732823 - RNA, 64 nt, Homo Sapiens
caucaaguauucauuuauugcugggauucuugccuguaugaauggacagagcuucucugggaug

SEQ ID NO: 732824 - RNA, 64 nt, Homo Sapiens
aucucuuuguuuuuaaacaaaagauauuauuuuguguaugaaucuaaaucaagcccaucuguca

SEQ ID NO: 732825 - RNA, 64 nt, Homo Sapiens
aauauuaccaccucucuuuguaauuuacuuuacuuguaugaauuuaacaucucuagcauguauc

SEQ ID NO: 732826 - RNA, 64 nt, Homo Sapiens
uaacagggaagggcuggggugugaaaaagaagauuguaugaaaaccauugguaauuuuuauuuu

SEQ ID NO: 732827 - RNA, 64 nt, Homo Sapiens
gugaagggcuauagccaaaguauuuuuacuagccuguaugaaaucacuaguccuuauuuuuaaa

SEQ ID NO: 732828 - RNA, 64 nt, Homo Sapiens
ugcccccuggaucuuggacacuuacagauugagcuguaugaauucagcgggucucacuccagag

SEQ ID NO: 732829 - RNA, 64 nt, Homo Sapiens
cuuugaaaauuauauuacuuuaagacuucuaguauguaugaauucauuuagaagcugcuuuucc

SEQ ID NO: 732830 - RNA, 64 nt, Homo Sapiens
gacauuuaguaugcuuugaaaggcauagaacauuuguaugaaaaaauagugauguucuuuugca

SEQ ID NO: 732831 - RNA, 64 nt, Homo Sapiens
gaccacauugaaggagcacaaaaggggcuauauguguaugaauaucaccgacacugagcagugg

SEQ ID NO: 732832 - RNA, 64 nt, Homo Sapiens
uuguguuuuuuauauauaaaaagguuuuuugugauguaugaaacucacuucuguguuauaaugg

SEQ ID NO: 732833 - RNA, 64 nt, Homo Sapiens
gcuacugcuguacuuccgauaagcauaucagauauguaugaacuuuuacugaauccugguguga

SEQ ID NO: 732834 - RNA, 64 nt, Homo Sapiens
ucucuuuaugauguuuguuugcucugcacugccauguaugaaaggcaacuuuuuauuuaaaaaa

SEQ ID NO: 732835 - RNA, 64 nt, Homo Sapiens
ccacguuugugaagagcugacaagcugagcaagcuguaugaacgaccaaauggaccuucuggga

SEQ ID NO: 732836 - RNA, 64 nt, Homo Sapiens
agcaagugcuuuuuuaguguaaugaucucacuccuguaugaauaaguguaaaaagucacagcua

SEQ ID NO: 732837 - RNA, 64 nt, Homo Sapiens
uuuuauguaaucucuggugcugcuuuccagucacuguaugaagugucuccccaacacuagcaaa

SEQ ID NO: 732838 - RNA, 64 nt, Homo Sapiens
gauuuauuuaucucauuaacuuaaaacagcuauguguaugaaauaggucacaacagaacuugaa

SEQ ID NO: 732839 - RNA, 64 nt, Homo Sapiens
guucacauguguggguccaacacuuacuaccugguguaugaaauuggaccugaacuguuggauu

SEQ ID NO: 732840 - RNA, 64 nt, Homo Sapiens
aagcuguugguugaaaucauaauuaaugcguuacuguaugaaccacaaaacagcacuauuuauu

SEQ ID NO: 732841 - RNA, 64 nt, Homo Sapiens
uguuacuucuucaucaguuuuuccuuuugaaagguguaugaauucauuacauuuuuauucuaau

SEQ ID NO: 732842 - RNA, 64 nt, Homo Sapiens
ccaucauuaaauguguacugugaagagauuaauauguaugaagggcuuuaccaaaguccacuaa

SEQ ID NO: 732843 - RNA, 64 nt, Homo Sapiens
gaaauuguacguaauguauuuaaaucaacgcaaauguaugaauaacaaauacaguucugaccuu

SEQ ID NO: 732844 - RNA, 64 nt, Homo Sapiens
aaagcagguaaauugucgggggagagaguuagcauguaugaauguaaggaugagggaagcgaag

SEQ ID NO: 732845 - RNA, 64 nt, Homo Sapiens
auuuugacacagcaacuuccuguagugagcacuuuguaugaaucguggacuuccuguucucaag

SEQ ID NO: 732846 - RNA, 64 nt, Homo Sapiens
uguugcacauuaagucucagcaguaacuauuauguguaugaagagaaauaauauaaucuuaguu

SEQ ID NO: 732847 - RNA, 64 nt, Homo Sapiens
uaugcuccuaccggcaauguuuuuccuaagugauuguaugaauugcuuuaguagauauuaccag

SEQ ID NO: 732848 - RNA, 64 nt, Homo Sapiens
accauacacuggaugaccuagcucuaaugacauauguaugaaaaucagcauucauugacacaua

SEQ ID NO: 732849 - RNA, 64 nt, Homo Sapiens
uaccuacaaugaauguuauggaacuaaauccuuauguaugaaauuaacuugcccugagacucca

SEQ ID NO: 732850 - RNA, 64 nt, Homo Sapiens
uaaagccuuuauuuguuaauuuugucaguuuguuuguaugaaacucuagagaaauaagaucuuu

SEQ ID NO: 732851 - RNA, 64 nt, Homo Sapiens
acuuuguaaauuuuguucuaaaaaacacaaaaacuguaugaaugccaauuuucgaagucaguaa

SEQ ID NO: 732852 - RNA, 64 nt, Homo Sapiens
auuuugucguccuacccuuuaugcuugaaauuuuuguaugaauugaggaauaucuacagcagug

SEQ ID NO: 732853 - RNA, 64 nt, Homo Sapiens
uugacggcgcuuuuguaaggaagaagccgcuggcuguaugaaacaaaaugugacucucccagag

SEQ ID NO: 732854 - RNA, 64 nt, Homo Sapiens
agagaugugggcuuccuuuuauugcagcaaauccuguaugaaagacugguuggaagaauauagu

SEQ ID NO: 732855 - RNA, 64 nt, Homo Sapiens
accauguuugaaacucauaguugauauuucacauuguaugaaaugggagagggagggaugcuga

SEQ ID NO: 732856 - RNA, 64 nt, Homo Sapiens
uuuaaaucuuuuaauuucaggaguuuuagggauguguaugaauauacacuccagcauaucgggu

SEQ ID NO: 732857 - RNA, 64 nt, Homo Sapiens
acuccagcagguaggggcacagugaauguguguauguaugaaggccacaucaacuuuauguagc

SEQ ID NO: 732858 - RNA, 64 nt, Homo Sapiens
auguugcagagcccuuacuuaaauccuucacugguguaugaauacuuugucauaaugcugcuuu

SEQ ID NO: 732859 - RNA, 64 nt, Homo Sapiens
agugcuauaguaaauuacaaagaaauagguagauuguaugaacauacccacaaaugccuaugau

SEQ ID NO: 732860 - RNA, 64 nt, Homo Sapiens
augaaauuauauguguguggugugugaauaaauauguaugaauauauggucuguguuuucuuuu

SEQ ID NO: 732861 - RNA, 64 nt, Homo Sapiens
gcccucaaggguguguauauuguauaggggcaacuguaugaaaaauuggggaggagggggccgg

SEQ ID NO: 732862 - RNA, 64 nt, Homo Sapiens
uauucacucauguguuccagauguauucuaauuguguaugaaauguauguacacauaagugugu

SEQ ID NO: 732863 - RNA, 64 nt, Homo Sapiens
cuggguucaaauucugaaacugucacuuauuaccuguaugaacaugggcaaauuaucuaaucuc

SEQ ID NO: 732864 - RNA, 64 nt, Homo Sapiens
cgugccauucuccccagacuuuuuuuguacuuaauguaugaaagauccaaacuaauauugcugu

SEQ ID NO: 732865 - RNA, 64 nt, Homo Sapiens
caaauuguaaacuuaaaauauauauaaaauuuauuguaugaaaauuaagccucaauaaacguga

SEQ ID NO: 732866 - RNA, 64 nt, Homo Sapiens
uuucugaaaaauuguaaaucugaucauaucaacauguaugaacuuaaaauauggagaauguuau

SEQ ID NO: 732867 - RNA, 64 nt, Homo Sapiens
aacuguagcaguguguucugggcaguaucuguaauguaugaaauagagucuggaauagguuauc

SEQ ID NO: 732868 - RNA, 64 nt, Homo Sapiens
uauaguguguacguauaccacauauacauauacuuguaugaagauauguguaaaauguuuuuac

SEQ ID NO: 732869 - RNA, 64 nt, Homo Sapiens
uugguuuauuuuauuucccaccuuugugugaguguguaugaaagagaagaaaaugcaauuuuua

SEQ ID NO: 732870 - RNA, 64 nt, Homo Sapiens
ccguuuuguaguuucaaauuuauuuauggcagaauguaugaaauccugccuuauuguuuguuuu

SEQ ID NO: 732871 - RNA, 64 nt, Homo Sapiens
cauggcaugauacaacuaaugggucacuguauucuguaugaaugcucuucucugucgcccugaa

SEQ ID NO: 732872 - RNA, 64 nt, Homo Sapiens
ggugaaggugggagcaccuuaugaaaggaaugaguguaugaaaaugguucaucauggugacagc

SEQ ID NO: 732873 - RNA, 64 nt, Homo Sapiens
augaccccaucacucucuuuggcggucuucagaauguaugaagggccucgauggaugcgagugc

SEQ ID NO: 732874 - RNA, 64 nt, Homo Sapiens
aaaugcugagugagccccaggcuuuuuaagcagcuguaugaaauugaucucuauuuuaaaacua

SEQ ID NO: 732875 - RNA, 64 nt, Homo Sapiens
caugaaggaaacagaggggcuguacaacacaaacuguaugaagcucaaugugaauucuuacgaa

SEQ ID NO: 732876 - RNA, 64 nt, Homo Sapiens
gacaugccuccauaugugccgcuuaacugaauauuguaugaaaauugccauggccugaauguug

SEQ ID NO: 732877 - RNA, 64 nt, Homo Sapiens
uuuccagaugguguucaguguggcaugggcauucuguaugaaccaaagcaaauccuuucaagaa

SEQ ID NO: 732878 - RNA, 61 nt, Homo Sapiens; identical to SEQ ID NO: 732437

SEQ ID NO: 732879 - RNA, 64 nt, Homo Sapiens
ccaugcugucuguuaaauaaacugauaauggauauguaugaaguaguuguuugguuuucaaggc

SEQ ID NO: 732880 - RNA, 64 nt, Homo Sapiens
gucccaggauuccauccugaaauuuauuuuucuuuguaugaauauguguaaaugauuuaaaaau

SEQ ID NO: 732881 - RNA, 64 nt, Homo Sapiens
aauggagagaaagggauuuuuuacugcaucccucuguaugaauaugaaaucagagaccagggca

SEQ ID NO: 732882 - RNA, 64 nt, Homo Sapiens
cuaagagacauucuucauccaccaauguuguacauguaugaaaaugguguacuguauacuuuaa

SEQ ID NO: 732883 - RNA, 64 nt, Homo Sapiens
aaaaguaaauaucuuuuucauauguccauuagaauguaugaaaaaaaucauuuuaacuaaaagc

SEQ ID NO: 732884 - RNA, 64 nt, Homo Sapiens
gauggucucaugaguuucaaaauaauaauuuuuguguaugaacaaagcuguuguuuuuaccaug

SEQ ID NO: 732885 - RNA, 64 nt, Homo Sapiens
gaauuaaugaucucuuuggaagagagcccagauuuguaugaaaacuuguuuuuccucucaauug

SEQ ID NO: 732886 - RNA, 64 nt, Homo Sapiens
gagucugucuuuccuuagccgucugagugagcuguguaugaacaagucccaggaguuccaagag

SEQ ID NO: 732887 - RNA, 64 nt, Homo Sapiens
guuccccuaacgucucaacaggcgcucacugaaguguaugaauauuuuuuaaaaagguuuuugc

SEQ ID NO: 732888 - RNA, 64 nt, Homo Sapiens
accucaaagcguugucauguggauugagaugauauguaugaaucacauaaaagagugccuggca

SEQ ID NO: 732889 - RNA, 64 nt, Homo Sapiens
uugaaugugauguauucacgaauuaccggaagaguguaugaagaagaguugaaaauugccucca

SEQ ID NO: 732890 - RNA, 64 nt, Homo Sapiens
caucaguagcugaaaauugcuacaauaaaagauauguaugaaugcacagauaagggcuuuauug

SEQ ID NO: 732891 - RNA, 64 nt, Homo Sapiens
uacauaaauauuuuuaacuccaaacauauauguauguaugaauguaaauuguuaaacauuuaga

SEQ ID NO: 732892 - RNA, 64 nt, Homo Sapiens
guaccaaagcauuaccgcaugauaggcaagacccuguaugaauagggaaauggcaagucuuuag

SEQ ID NO: 732893 - RNA, 64 nt, Homo Sapiens
acaauaguuugaugauuucccuuuguacguuucauguaugaaugcuuuaaaucauaacuauuug

SEQ ID NO: 732894 - RNA, 64 nt, Homo Sapiens
uuuaaaaguuguugacuggaucuuguguugugccuguaugaauuuagauuguauagagagacua

SEQ ID NO: 732895 - RNA, 64 nt, Homo Sapiens
uuugccaauguuuuugacacuuaaauaaagaauuuguaugaaccguuaaauaggaaaauuguua

SEQ ID NO: 732896 - RNA, 64 nt, Homo Sapiens
cuuuucuccucucccguuguguaauagguaguuuuguaugaaauuuuauacuuuuuucuguauu

SEQ ID NO: 732897 - RNA, 64 nt, Homo Sapiens
agcaguauuuuccaguuuuuaagguuaccuuugauguaugaagucauucacuuacggagaaugu

SEQ ID NO: 732898 - RNA, 64 nt, Homo Sapiens
cauuggcucuaucugcauuugaauuuaaguuccauguaugaagugccuguccagcagggagcuu

SEQ ID NO: 732899 - RNA, 64 nt, Homo Sapiens
uuuugcauuggcuugaagcaaauagggaauauaauguaugaacuauauauucuaaacacaauga

SEQ ID NO: 732900 - RNA, 64 nt, Homo Sapiens
ggugagcggacaucuguuaauuagacuuguaaaauguaugaacuuagaagaauaucacuuauuu

SEQ ID NO: 732901 - RNA, 64 nt, Homo Sapiens
agcccaaaggggcagaacaagaaagccacgggauuguaugaaaucaaacaugaguuuguggugu

SEQ ID NO: 732902 - RNA, 64 nt, Homo Sapiens
uaugaaacagaaagaucuguccaaggacacagcuuguaugaaaggguugaauuugggcuccauc

SEQ ID NO: 732903 - RNA, 64 nt, Homo Sapiens
aggggcauagaauaaaauauuaaauauuggcagauguaugaaaagaagugugaguuaaaaauau

SEQ ID NO: 732904 - RNA, 64 nt, Homo Sapiens
gaaguguggugucuuuuauauuugaauuaguaacuguaugaagucauagauaauaguacauguc

SEQ ID NO: 732905 - RNA, 64 nt, Homo Sapiens
ugacuuuuuaauuguaaaagauuaguugaaaaacuguaugaaugugaagaucacaugcuuaguc

SEQ ID NO: 732906 - RNA, 64 nt, Homo Sapiens
guuuuccaguaugaauguuaauguugucaguguauguaugaauaugaaagugcuuuguuuuguu

SEQ ID NO: 732907 - RNA, 64 nt, Homo Sapiens
uuuagugcuuuugcaaguucaauuuguuaguuccuguaugaaagauugugggggaaaaauaaac

SEQ ID NO: 732908 - RNA, 64 nt, Homo Sapiens
gguuuuaacgugcucaacuuuaauuuuuuucaauuguaugaaggccuuaaaaaagcuacauuaa

SEQ ID NO: 732909 - RNA, 64 nt, Homo Sapiens
uguagcaacuguuugauuucuuucuggauacagcuguaugaacacuuuucuauuuuauacugaa

SEQ ID NO: 732910 - RNA, 64 nt, Homo Sapiens
aaaugcaaugaggaaaucugacagggaaauuaucuguaugaacuaaaaguaagggaaccccggg

SEQ ID NO: 732911 - RNA, 64 nt, Homo Sapiens
caucuccgaauuagcauuucauuugcccccagacuguaugaaaacgauuccuuuggauggcuuc

SEQ ID NO: 732912 - RNA, 64 nt, Homo Sapiens
aaauucuugaauucgucauuaggaaagcaauuuauguaugaaagauuacccaucugcagaacua

SEQ ID NO: 732913 - RNA, 64 nt, Homo Sapiens
ccacacuauauaaacaauaaagcccuuugauugcuguaugaauucaucuggguacagacaguaa

SEQ ID NO: 732914 - RNA, 64 nt, Homo Sapiens
uuacuuauuaacaggccagguacaaugaccuuuuuguaugaaaacagaaaaguugggaaaagag

SEQ ID NO: 732915 - RNA, 64 nt, Homo Sapiens
uguguggcagugaagagaacauuacuaagucauuuguaugaauaaggaccacuucucauauuag

SEQ ID NO: 732916 - RNA, 64 nt, Homo Sapiens
gugauaacuguugcccuuguggacaugaaagguguguaugaacuugugaggagugagugagaca

SEQ ID NO: 732917 - RNA, 64 nt, Homo Sapiens
uuaucaaauuguauucaucaaaguuuuuauugaauguaugaaaaaugucuuuauuguuguuaaa

SEQ ID NO: 732918 - RNA, 64 nt, Homo Sapiens
aacagugugucagauggucuuuauauauuuuuucuguaugaaggaauagccuugccuacugaag

SEQ ID NO: 732919 - RNA, 64 nt, Homo Sapiens
ucggggagaagaggauacugaaacauuugugaaauguaugaaugcacuucuguaaccagauacu

SEQ ID NO: 732920 - RNA, 64 nt, Homo Sapiens
uuauccuauuucugggggaggauguacguggccauguaugaagccaaauauuaggcuuaaaaac

SEQ ID NO: 732921 - RNA, 64 nt, Homo Sapiens
agauuuuuaugugucuuugacagcuagugucuaguguaugaaaguggaaaaggacauuucugua

SEQ ID NO: 732922 - RNA, 64 nt, Homo Sapiens
guuauuugugcauauuuuuuaacaaugcccaaucuguaugaauaauguaaacuucgauuuuuuu

SEQ ID NO: 732923 - RNA, 64 nt, Homo Sapiens
aaaauuagcagacaauccauuccuacuguauuucuguaugaauguguuugugaauguaugugua

SEQ ID NO: 732924 - RNA, 64 nt, Homo Sapiens
ucggggucaguauccuguuuguuauuguuaaauuuguaugaaccuuagaaaaguuauuaaagug

SEQ ID NO: 732925 - RNA, 64 nt, Homo Sapiens
gugaaagcugagaacuccugacuguaacauauucuguaugaacuuuaucuaaagaaaaauaaau

SEQ ID NO: 732926 - RNA, 64 nt, Homo Sapiens
gauuaugcauacccaguauguauacuuauuaaucuguaugaagauguacauucuaaaauauaau

SEQ ID NO: 732927 - RNA, 64 nt, Homo Sapiens
uguuuuucuuaaucuuuaagauuuuaaaugcauguguaugaacuaaauuuauugacugaaauga

SEQ ID NO: 732928 - RNA, 64 nt, Homo Sapiens
uaagaguuucagaguucauauuaaaaauuagaauuguaugaaauacaucuauuauguaucaguu

SEQ ID NO: 732929 - RNA, 64 nt, Homo Sapiens
ccauaaaauagagcuagucagcugcaacauguacuguaugaaggcuguuugcaaauugagcagu

SEQ ID NO: 732930 - RNA, 64 nt, Homo Sapiens; identical to SEQ ID NO: 337405

SEQ ID NO: 732931 - RNA, 64 nt, Homo Sapiens; identical to SEQ ID NO: 337406

SEQ ID NO: 732932 - RNA, 64 nt, Homo Sapiens
ucauguuacaggccgagugcgaauggaaaaacaguguaugaaagcaggagaaggauugggaaca

SEQ ID NO: 732933 - RNA, 64 nt, Homo Sapiens
cguaucugugaaagguaggaccaagagagccauauguaugaaagcaaauucgaagaguuaguca

SEQ ID NO: 732934 - RNA, 64 nt, Homo Sapiens
uaccacaauuuguuuccuccgaagaguuuuccauuguaugaauaguuuguuccuucuuauuucu

SEQ ID NO: 732935 - RNA, 64 nt, Homo Sapiens
auauuuggugacauguugucuccauuaacgcuguuguaugaacauaaaagguguuuuacuguuu

SEQ ID NO: 732936 - RNA, 64 nt, Homo Sapiens
gagagagcaaagggugucugugcguggcacucgcuguaugaaagcuauuuuuguaaaguuuccg

SEQ ID NO: 732937 - RNA, 64 nt, Homo Sapiens
cggguccuugugacuucaacggacucuuccaaauuguaugaauguaucaauguauuagauaaac

SEQ ID NO: 732938 - RNA, 64 nt, Homo Sapiens
aagcacuaaggggagggcgcauacccgagacgauuguaugaagaaaauauggaggaacuguuac

SEQ ID NO: 732939 - RNA, 64 nt, Homo Sapiens
ggggcgcuguuuuuaacgugcccguuuguacugauguaugaacuugucaauaaacacaauuguu

SEQ ID NO: 732940 - RNA, 64 nt, Homo Sapiens
ugaauuuaagugacccauuaaaaucuagcacaccuguaugaaaaaucaguguagaagaauaccu

SEQ ID NO: 732941 - RNA, 64 nt, Homo Sapiens
ccauuacauagggacuguacagagccugugaagauguaugaaugguaucuuuuauaauccacaa

SEQ ID NO: 732942 - RNA, 64 nt, Homo Sapiens
cacuggguaagauucauggaacuuagaaaaaagcuguaugaacugcuuuaccaaauaucacuac

SEQ ID NO: 732943 - RNA, 64 nt, Homo Sapiens
auagucccauuugggugguuucagcugcacuaucuguaugaaauggugucaccaaaacccuuuu

SEQ ID NO: 732944 - RNA, 64 nt, Homo Sapiens
ugcuguuguaaacaacguguauagugccuaaaauuguaugaaaauccuuuuaaccauuuuaacc

SEQ ID NO: 732945 - RNA, 64 nt, Homo Sapiens
ccacaagcuaguuuucuuaguuuuaaaauccuguuguaugaauggcauuuguauauuaaaacac

SEQ ID NO: 732946 - RNA, 64 nt, Homo Sapiens
auuaauagcagaggaagacuccuuuuuucaucacuguaugaauuuuuuauaauguuuuuuuaaa

SEQ ID NO: 732947 - RNA, 64 nt, Homo Sapiens
uuaauuuuaaaaugguuucuauaaaggguuuuauuguaugaaauagaacuuuauauuuuugcau

SEQ ID NO: 732948 - RNA, 64 nt, Homo Sapiens
agauuguugcugcacauaguugccuuuguaucucuguaugaaauaaaaggucauuuguucaugu

SEQ ID NO: 732949 - RNA, 64 nt, Homo Sapiens
gauuaauaccugaccucacaccaguuaccacugguguaugaaauacuuugcaaagacagugugu

SEQ ID NO: 732950 - RNA, 64 nt, Homo Sapiens
uaucaauguauuagauaaacggacucuuccaaauuguaugaaugcggguccuugugacuucaac

SEQ ID NO: 732951 - RNA, 64 nt, Homo Sapiens
uaucaauguauuacacaaauugacucuuccaaauuguaugaauuuggguccuuguaacuucaac

SEQ ID NO: 732952 - RNA, 64 nt, Homo Sapiens
auucuaguuucauuuguucauuuuuuaaauuauguguaugaacauuucggugucuugaauauau

SEQ ID NO: 732953 - RNA, 64 nt, Homo Sapiens
gaagauuucucccaggaaauuagguauaaaccucuguaugaagaugaugcuggaauuacuccug

SEQ ID NO: 732954 - RNA, 64 nt, Homo Sapiens
auagcuauucuuuacagcauauaaaaccuaguauuguaugaaggaugcugacauacuaaaaaaa

SEQ ID NO: 732955 - RNA, 64 nt, Homo Sapiens
uacuaaguaguauuccacugagaugguagaaacauguaugaaugcuguauauauaaaaaucuug

SEQ ID NO: 732956 - RNA, 64 nt, Homo Sapiens
cauguuugacaauacuguaauguuuauucaaguuuguaugaaauuuugaccuaguuagaugugg

SEQ ID NO: 732957 - RNA, 64 nt, Homo Sapiens
agcccauucaugguaagucuugugaguguguuuuuguaugaauguacuguuuuaaaagaauuag

SEQ ID NO: 732958 - RNA, 64 nt, Homo Sapiens
cagcauaggcugcccaccuacauggggccuccauuguaugaaguggcucccagcuccacuggcc

SEQ ID NO: 732959 - RNA, 64 nt, Homo Sapiens
cacaugcuugucggaacgcuguuggggguaugcauguaugaacauacacagugcauugcccuuu

SEQ ID NO: 732960 - RNA, 64 nt, Homo Sapiens
uguuugcaaacccgaaaauaaaagacguucauuauguaugaaaaguaacugauuuguauucugu

SEQ ID NO: 732961 - RNA, 64 nt, Homo Sapiens
cccacaggacuuaccccuguauguacaggauuuuuguaugaaaguuuuguuugauucugagacu

SEQ ID NO: 732962 - RNA, 64 nt, Homo Sapiens
agcaggucacaacuuacccuuguguguuuagauguguaugaaauaccuguauacguuagugaaa

SEQ ID NO: 732963 - RNA, 64 nt, Homo Sapiens
cccaccuuugccuccuaccagugaaccucaucuuuguaugaaagacagcaaccuccuggguaaa

SEQ ID NO: 732964 - RNA, 64 nt, Homo Sapiens
caguauucaguuagcagacagaaguguaguaugcuguaugaauauuuuauauuaaaauaugaag

SEQ ID NO: 732965 - RNA, 64 nt, Homo Sapiens
accaacauccugaaaguuaaagaaaaaaaucuaauguaugaaugugacucaccaauuuuuauca

SEQ ID NO: 732966 - RNA, 64 nt, Homo Sapiens
guacaagaaccccuuuuaucccuggaagaggcuguguaugaaaccaaugcccaggguuugaagg

SEQ ID NO: 732967 - RNA, 64 nt, Homo Sapiens
ccagaaaugcacuugugccagguauugucccugcuguaugaaaagcuucuuggcaaugaauucu

SEQ ID NO: 732968 - RNA, 64 nt, Homo Sapiens
cuauacuugaacaguuccaacuguacauacauacuguaugaagcuuguccucugacuagguuuc

SEQ ID NO: 732969 - RNA, 64 nt, Homo Sapiens
ccaaauaaacaugcagucucagugugcucucgcauguaugaauaucuaguccuuucugugguuc

SEQ ID NO: 732970 - RNA, 64 nt, Homo Sapiens
caauggaugaauguagacacaaaacagcaacacuuguaugaagauguaaagugcugaacauauu

SEQ ID NO: 732971 - RNA, 64 nt, Homo Sapiens
ggggugacaaggucccccuguagaaccagggguguguaugaagggcacggggaagguuuuggag

SEQ ID NO: 732972 - RNA, 64 nt, Homo Sapiens
uccaguaguuaauuugaacauuaccuuauuuaucuguaugaaauuugacaaaguaauguaauuu

SEQ ID NO: 732973 - RNA, 64 nt, Homo Sapiens; identical to SEQ ID NO: 337407

SEQ ID NO: 732974 - RNA, 64 nt, Homo Sapiens; identical to SEQ ID NO: 337408

SEQ ID NO: 732975 - RNA, 64 nt, Homo Sapiens
ggauuugauaaaguuuuugcaucuguccaguuuguguaugaaauguagagguuaugugcaacug

SEQ ID NO: 732976 - RNA, 64 nt, Homo Sapiens
aaaacccaccacaccaccacaaaauggccuuuaguguaugaaaugcacauggaggggauguagu

SEQ ID NO: 732977 - RNA, 64 nt, Homo Sapiens; identical to SEQ ID NO: 337409

SEQ ID NO: 732978 - RNA, 64 nt, Homo Sapiens; identical to SEQ ID NO: 337410

SEQ ID NO: 732979 - RNA, 64 nt, Homo Sapiens
uuguacuccagcauagcuuggucuuauuucuuacuguaugaaagcuuaacagcaaugugauuua

SEQ ID NO: 732980 - RNA, 64 nt, Homo Sapiens
augaguaucacagcguccaacucaguagcuccaguguaugaaaaugucuccagggcuaaaggcu

SEQ ID NO: 732981 - RNA, 64 nt, Homo Sapiens
gagaaacacauucuuauuaauucuucaccuguuauguaugaaggaaucauuccagugcuagaaa

SEQ ID NO: 732982 - RNA, 64 nt, Homo Sapiens; identical to SEQ ID NO: 337411

SEQ ID NO: 732983 - RNA, 64 nt, Homo Sapiens; identical to SEQ ID NO: 337412

SEQ ID NO: 732984 - RNA, 64 nt, Homo Sapiens
gcugucagguguuaugcacuccauccaucauaacuguaugaaacacauuucauauguaaauaaa

SEQ ID NO: 732985 - RNA, 64 nt, Homo Sapiens
cugcaaacacauuucauugugagguuuuacccucuguaugaaugaagagaacgcuggaaggcug

SEQ ID NO: 732986 - RNA, 64 nt, Homo Sapiens
aacaguuuucacgucugucccuuggaaccuccucuguaugaauauuucgacgggcgccucgugg

SEQ ID NO: 732987 - RNA, 64 nt, Homo Sapiens
ggggcggucaucauuucacuaccaccaaacacaguguaugaaggggggaagcagaaauccaagc

SEQ ID NO: 732988 - RNA, 64 nt, Homo Sapiens; identical to SEQ ID NO: 337413

SEQ ID NO: 732989 - RNA, 64 nt, Homo Sapiens; identical to SEQ ID NO: 337414

SEQ ID NO: 732990 - RNA, 64 nt, Homo Sapiens; identical to SEQ ID NO: 337415

SEQ ID NO: 732991 - RNA, 64 nt, Homo Sapiens
aaagccuuauaaaaccagcugaucacagaacuuuuguaugaauauguaaauaaggcuuucuggg

SEQ ID NO: 732992 - RNA, 64 nt, Homo Sapiens
gcugugggggucccggcaccuggcgugaguuucauguaugaaaacauaaaauugaaaaaaaaaa

SEQ ID NO: 732993 - RNA, 64 nt, Homo Sapiens
agugggaugcauuuagggggcgggcuugguauguuguaugaauccacucucuguuccuuuugga

SEQ ID NO: 732994 - RNA, 64 nt, Homo Sapiens
uacaaauacauaagagacucacacugaaaaaaguuguaugaauauaaaaauguacuaaaaccuu

SEQ ID NO: 732995 - RNA, 64 nt, Homo Sapiens
ccuugugccucucucuuucucucucuuucuuaauuguaugaaaacacaaagcacaggucaggau

SEQ ID NO: 732996 - RNA, 64 nt, Homo Sapiens
acacuuguuaucugaaagugugugaaagaaacaauguaugaaaauuuacauuugaucauccggc

SEQ ID NO: 732997 - RNA, 64 nt, Homo Sapiens; identical to SEQ ID NO: 337416

SEQ ID NO: 732998 - RNA, 64 nt, Homo Sapiens; identical to SEQ ID NO: 337417

SEQ ID NO: 732999 - RNA, 64 nt, Homo Sapiens
gaacuuuuauaugaugcauuuauucuaaugugauuguaugaacaagugaauaaaaaaccuugga

SEQ ID NO: 733000 - RNA, 64 nt, Homo Sapiens
caaaaaugauuauaaaauucaugugaaauagaaguguaugaauugcugcgacaauuuugaaaag

SEQ ID NO: 733001 - RNA, 64 nt, Homo Sapiens
aguuaucugaauuccauugaagaaaaccuauuuuuguaugaauaugaccaguuucaagcagagc

SEQ ID NO: 733002 - RNA, 64 nt, Homo Sapiens
gcuucuucuaccuuuauuuauucucagcucugaauguaugaaccugcucaaucaccucaucuua

SEQ ID NO: 733003 - RNA, 64 nt, Homo Sapiens
cucacuccauccagccucuugacaagcaccgcucuguaugaauuuuacuaguccggguaccuca

SEQ ID NO: 733004 - RNA, 64 nt, Homo Sapiens
uucaugcaacauaauuugaaauuuguccaugguauguaugaacaguccauuuuaaaauuacuga

SEQ ID NO: 733005 - RNA, 64 nt, Homo Sapiens
caaauggacaccauccaugaagcagcuggcacaguguaugaagaucugagguauaagcucuugc

SEQ ID NO: 733006 - RNA, 64 nt, Homo Sapiens
cugauauuacauccacaguaccacaguauuuauguguaugaauuaaggauuaaaagauaaugug

SEQ ID NO: 733007 - RNA, 64 nt, Homo Sapiens
ccccgagcaaccucuccaguuauccucauaugcauguaugaauacugucauuuuucugugcgug

SEQ ID NO: 733008 - RNA, 64 nt, Homo Sapiens
cucagcagaaaaguacuuacuggaauuuugcuuuuguaugaacaauuuuagucggauuuuguuu

SEQ ID NO: 733009 - RNA, 64 nt, Homo Sapiens
uagagaaucugggaauaccucacuggagagaaacuguaugaaugaccaaacacaucagaaaucu

SEQ ID NO: 733010 - RNA, 64 nt, Homo Sapiens
uaagcaguguucuaaagccuuacuggggagaaacuguaugaaugcuaagacaugaaagaacacg

SEQ ID NO: 733011 - RNA, 64 nt, Homo Sapiens
uguaccuguuuuccgaagaaagagugaguuuguguguaugaauucuuaaguguaagaaaauuau

SEQ ID NO: 733012 - RNA, 64 nt, Homo Sapiens
ucuguuuuuuaaacuccuuauaaaauaauaauaauguaugaagcaauuugguuaaaaaauaaaa

SEQ ID NO: 733013 - RNA, 64 nt, Homo Sapiens
ccaccccacauggcccacagaacccccagugccuuguaugaagcuacccucugcacccucaaga

SEQ ID NO: 733014 - RNA, 64 nt, Homo Sapiens
uuauucuauguuuuuauaauucaugucugaauuauguaugaaaauuaauuuuuccuggcuaaga

SEQ ID NO: 733015 - RNA, 64 nt, Homo Sapiens
uaucagauugcaccccccucaaaaaucaaaagucuguaugaaaaguuuuauauauaauauauua

SEQ ID NO: 733016 - RNA, 64 nt, Homo Sapiens
acauucaaaagugugcucaaagaaaaauacucucuguaugaagaauuuuuuuuuaguccccagu

SEQ ID NO: 733017 - RNA, 64 nt, Homo Sapiens
ucagacauagucaaagcuuugccgagaaaagaaauguaugaacuauauuugacaacauaaaauc

SEQ ID NO: 733018 - RNA, 64 nt, Homo Sapiens
uuuuuauaguuguauuuuugaccugccuuuuauauguaugaauauuucauaguuuugcauauca

SEQ ID NO: 733019 - RNA, 64 nt, Homo Sapiens
cagccuuugccagucuagccccagcagggcaccguguaugaaugcaguuuggugcuguuuuaga

SEQ ID NO: 733020 - RNA, 64 nt, Homo Sapiens
aaauuguauugucaacaugggucauuuaaaguccuguaugaaccauaaccugcugugguaccuu

SEQ ID NO: 733021 - RNA, 64 nt, Homo Sapiens
cauggaacaguguggccucuuuauuaaauuuuuuuguaugaaaauaaauuuugaaaaguaauau

SEQ ID NO: 733022 - RNA, 64 nt, Homo Sapiens
gcuuguugacucuagcggcuggcucuccauaguguguaugaaaacaaggguuauguggggcgug

SEQ ID NO: 733023 - RNA, 64 nt, Homo Sapiens
gcauggugcuugcaguuuuaaguaauaacaagauuguaugaaccguauuaguugauaaauuaac

SEQ ID NO: 733024 - RNA, 64 nt, Homo Sapiens
cuucaguugccuuaauaaagaccccccauuuauuuguaugaaggucuaugucuucaacuuucag

SEQ ID NO: 733025 - RNA, 64 nt, Homo Sapiens
ugucuauugauaguacuuuuuuuucagagguuauuguaugaaauauacuaauugguucuuucua

SEQ ID NO: 733026 - RNA, 64 nt, Homo Sapiens
uugucuagcuaaugugggcagccaccacccacuguguaugaacaagucugaagcaaguuggccu

SEQ ID NO: 733027 - RNA, 64 nt, Homo Sapiens
uccuugggacuguuaugaacagaaaaugaugcaauguaugaaaaacugcuuugaggagaaaaac

SEQ ID NO: 733028 - RNA, 64 nt, Homo Sapiens
aaauguaugugaugacuguauaaggaggccuguguguaugaauuuauagggaguagaaccgucu

SEQ ID NO: 733029 - RNA, 64 nt, Homo Sapiens
gggaccuccagcuuccacaaacaccaucuucagcuguaugaaagggacgguuguggugaaguuu

SEQ ID NO: 733030 - RNA, 64 nt, Homo Sapiens
auuuauuucagcauuaugugaaauauaaaaauuauguaugaaauauauuuauaguuugcauuuu

SEQ ID NO: 733031 - RNA, 64 nt, Homo Sapiens
uugugagaaauuuaaaucagguaaaacuucuuuuuguaugaaaaauuugguauuuuguggucau

SEQ ID NO: 733032 - RNA, 64 nt, Homo Sapiens
caguagugugugugcaaaauacuucagugaacucuguaugaauguaaaagacacuugguaauag

SEQ ID NO: 733033 - RNA, 64 nt, Homo Sapiens
aaaccagugggaggaaaugaauuguuagaauagcuguaugaaggucaggugguguucugguaaa

SEQ ID NO: 733034 - RNA, 64 nt, Homo Sapiens
gugggagacuucugaacaguuagcacaguauuuuuguaugaaaaaauuuuuucaacuguaucag

SEQ ID NO: 733035 - RNA, 64 nt, Homo Sapiens
guuaaauggucguggccaauuaugucauagaaacuguaugaacaaccagauuuacauagcagag

SEQ ID NO: 733036 - RNA, 64 nt, Homo Sapiens
uucuuacuuaaacuuggucuucuuucaaauuguuuguaugaagaugcuguacccacuugaacag

SEQ ID NO: 733037 - RNA, 64 nt, Homo Sapiens
gccgguucucggguccuugaaaguauauacagcuuguaugaaggcuucucugggacagugugcu

SEQ ID NO: 733038 - RNA, 64 nt, Homo Sapiens
uagucuuuaagccauuccagucaugaugaggugauguaugaauacaugcauacauucaaagcac

SEQ ID NO: 733039 - RNA, 64 nt, Homo Sapiens
ugggggguuggguuccugaaugcaccauaaucgcuguaugaaauauuaaaaagucuaaagugaa

SEQ ID NO: 733040 - RNA, 64 nt, Homo Sapiens
uaaauuguggcuggcuucccuuucugucugcuauuguaugaagaauacugauguuuaccuguau

SEQ ID NO: 733041 - RNA, 64 nt, Homo Sapiens
aauaccaauacuuuagaaguuuggucgugucguuuguaugaaaaucugaggcuuugguuuaaau

SEQ ID NO: 733042 - RNA, 64 nt, Homo Sapiens
uugguuaacacuaagcuuaaguagacuauacaguuguaugaauuuguaaaaguauaugaacacc

SEQ ID NO: 733043 - RNA, 64 nt, Homo Sapiens
uaccaaguaagacaucucaaauacaguaguauaauguaugaauuuuguaaguauaagaaauuuu

SEQ ID NO: 733044 - RNA, 64 nt, Homo Sapiens
uaccacaauuuguuucaccugaauaaaauuccauuguaugaauauuucauuccuuucuauggcu

SEQ ID NO: 733045 - RNA, 64 nt, Homo Sapiens
ugcuguacccacuugaacagucuuucaaguuguuuguaugaagauucuuacuuaaacuuggucu

SEQ ID NO: 733046 - RNA, 64 nt, Homo Sapiens
ucaacucauuuuauucucgguacacaaugugagauguaugaaaaaaauguccaauuuuaccuuu

SEQ ID NO: 733047 - RNA, 64 nt, Homo Sapiens
uggauuuaaacuuucuuauuaggccaaaggccucuguaugaaaucacuaauuuaaauguaauaa

SEQ ID NO: 733048 - RNA, 64 nt, Homo Sapiens
uuuuauauccuaauuuaaaaacacaacaacuaauuguaugaaacuaaauucaaaccauauccac

SEQ ID NO: 733049 - RNA, 64 nt, Homo Sapiens
uuuaccuaggguugauuccuugugugaaaguauauguaugaaagcacaggagcaucacuaugcc

SEQ ID NO: 733050 - RNA, 64 nt, Homo Sapiens
cauuaaaaauuguaaaguacuuccaaugcacuguuguaugaauguuuguagaggcucaguacuu

SEQ ID NO: 733051 - RNA, 64 nt, Homo Sapiens
ugcccugauuuguacagauuguucuuaugagacuuguaugaagacaggccaaaucuaugcugug

SEQ ID NO: 733052 - RNA, 64 nt, Homo Sapiens
cuacaacccuauaauaaauuuaaggaguuuagguuguaugaauuuguguaggugcugaaugcug

SEQ ID NO: 733053 - RNA, 64 nt, Homo Sapiens
gaauggaggaauguuuucaaugguuucuacuguauguaugaaccuggauuaagggcagccacag

SEQ ID NO: 733054 - RNA, 64 nt, Homo Sapiens
aacuuaaacugauuuuuucuuucuccaaggaauauguaugaaauuguguuuaugugucucagcu

SEQ ID NO: 733055 - RNA, 64 nt, Homo Sapiens
uauaccuuugaauuuuagaaauagaacaauuacuuguaugaaaucuuaguaggaguucugcagu

SEQ ID NO: 733056 - RNA, 64 nt, Homo Sapiens
aaauugucccaugcaaauuaauagaauuaccagcuguaugaaacagaaaaugaacacccuugug

SEQ ID NO: 733057 - RNA, 64 nt, Homo Sapiens; identical to SEQ ID NO: 377795

SEQ ID NO: 733058 - RNA, 64 nt, Homo Sapiens; identical to SEQ ID NO: 377796

SEQ ID NO: 733059 - RNA, 64 nt, Homo Sapiens; identical to SEQ ID NO: 377797

SEQ ID NO: 733060 - RNA, 64 nt, Homo Sapiens; identical to SEQ ID NO: 377798

SEQ ID NO: 733061 - RNA, 64 nt, Homo Sapiens; identical to SEQ ID NO: 377799

SEQ ID NO: 733062 - RNA, 64 nt, Homo Sapiens; identical to SEQ ID NO: 377800

SEQ ID NO: 733063 - RNA, 64 nt, Homo Sapiens; identical to SEQ ID NO: 377801

SEQ ID NO: 733064 - RNA, 62 nt, Homo Sapiens; identical to SEQ ID NO: 377802

SEQ ID NO: 733065 - RNA, 64 nt, Homo Sapiens; identical to SEQ ID NO: 377803

SEQ ID NO: 733066 - RNA, 64 nt, Homo Sapiens; identical to SEQ ID NO: 377804

SEQ ID NO: 733067 - RNA, 64 nt, Homo Sapiens; identical to SEQ ID NO: 377805

SEQ ID NO: 733068 - RNA, 64 nt, Homo Sapiens; identical to SEQ ID NO: 377806

SEQ ID NO: 733069 - RNA, 64 nt, Homo Sapiens; identical to SEQ ID NO: 377807

SEQ ID NO: 733070 - RNA, 64 nt, Homo Sapiens; identical to SEQ ID NO: 377808

SEQ ID NO: 733071 - RNA, 64 nt, Homo Sapiens; identical to SEQ ID NO: 377809

SEQ ID NO: 733072 - RNA, 64 nt, Homo Sapiens; identical to SEQ ID NO: 377810

SEQ ID NO: 733073 - RNA, 64 nt, Homo Sapiens; identical to SEQ ID NO: 377811

SEQ ID NO: 733074 - RNA, 64 nt, Homo Sapiens; identical to SEQ ID NO: 377812

SEQ ID NO: 733075 - RNA, 64 nt, Homo Sapiens; identical to SEQ ID NO: 377813

SEQ ID NO: 733076 - RNA, 64 nt, Homo Sapiens; identical to SEQ ID NO: 377814

SEQ ID NO: 733077 - RNA, 64 nt, Homo Sapiens; identical to SEQ ID NO: 377815

SEQ ID NO: 733078 - RNA, 64 nt, Homo Sapiens; identical to SEQ ID NO: 377816

SEQ ID NO: 733079 - RNA, 64 nt, Homo Sapiens; identical to SEQ ID NO: 377817

SEQ ID NO: 733080 - RNA, 64 nt, Homo Sapiens; identical to SEQ ID NO: 377818

SEQ ID NO: 733081 - RNA, 64 nt, Homo Sapiens; identical to SEQ ID NO: 377819

SEQ ID NO: 733082 - RNA, 64 nt, Homo Sapiens; identical to SEQ ID NO: 377820

SEQ ID NO: 733083 - RNA, 64 nt, Homo Sapiens; identical to SEQ ID NO: 491300

SEQ ID NO: 733084 - RNA, 64 nt, Homo Sapiens; identical to SEQ ID NO: 491301

SEQ ID NO: 733085 - RNA, 64 nt, Homo Sapiens; identical to SEQ ID NO: 491302

SEQ ID NO: 733086 - RNA, 64 nt, Homo Sapiens; identical to SEQ ID NO: 491303

SEQ ID NO: 733087 - RNA, 64 nt, Homo Sapiens; identical to SEQ ID NO: 491304

SEQ ID NO: 733088 - RNA, 64 nt, Homo Sapiens; identical to SEQ ID NO: 491305

SEQ ID NO: 733089 - RNA, 64 nt, Homo Sapiens; identical to SEQ ID NO: 491306

SEQ ID NO: 733090 - RNA, 64 nt, Homo Sapiens; identical to SEQ ID NO: 491307

SEQ ID NO: 733091 - RNA, 64 nt, Homo Sapiens; identical to SEQ ID NO: 491308

SEQ ID NO: 733092 - RNA, 64 nt, Homo Sapiens; identical to SEQ ID NO: 491309

SEQ ID NO: 733093 - RNA, 64 nt, Homo Sapiens; identical to SEQ ID NO: 491310

SEQ ID NO: 733094 - RNA, 64 nt, Homo Sapiens; identical to SEQ ID NO: 491311

SEQ ID NO: 733095 - RNA, 64 nt, Homo Sapiens; identical to SEQ ID NO: 491312

SEQ ID NO: 733096 - RNA, 64 nt, Homo Sapiens; identical to SEQ ID NO: 491313

SEQ ID NO: 733097 - RNA, 64 nt, Homo Sapiens; identical to SEQ ID NO: 491314

SEQ ID NO: 733098 - RNA, 64 nt, Homo Sapiens; identical to SEQ ID NO: 491315

SEQ ID NO: 733099 - RNA, 64 nt, Homo Sapiens; identical to SEQ ID NO: 491316

SEQ ID NO: 733100 - RNA, 64 nt, Homo Sapiens; identical to SEQ ID NO: 491317

SEQ ID NO: 733101 - RNA, 64 nt, Homo Sapiens; identical to SEQ ID NO: 491318

SEQ ID NO: 733102 - RNA, 64 nt, Homo Sapiens; identical to SEQ ID NO: 491319

SEQ ID NO: 733103 - RNA, 64 nt, Homo Sapiens; identical to SEQ ID NO: 491320

SEQ ID NO: 733104 - RNA, 64 nt, Homo Sapiens; identical to SEQ ID NO: 491321

SEQ ID NO: 733105 - RNA, 64 nt, Homo Sapiens; identical to SEQ ID NO: 491322

SEQ ID NO: 733106 - RNA, 64 nt, Homo Sapiens; identical to SEQ ID NO: 491323

SEQ ID NO: 733107 - RNA, 64 nt, Homo Sapiens; identical to SEQ ID NO: 491324

SEQ ID NO: 733108 - RNA, 64 nt, Homo Sapiens; identical to SEQ ID NO: 491325

SEQ ID NO: 733109 - RNA, 64 nt, Homo Sapiens; identical to SEQ ID NO: 491326

SEQ ID NO: 733110 - RNA, 64 nt, Homo Sapiens; identical to SEQ ID NO: 491327

SEQ ID NO: 733111 - RNA, 64 nt, Homo Sapiens; identical to SEQ ID NO: 491328

SEQ ID NO: 733112 - RNA, 64 nt, Homo Sapiens; identical to SEQ ID NO: 491329

SEQ ID NO: 733113 - RNA, 64 nt, Homo Sapiens; identical to SEQ ID NO: 491330

SEQ ID NO: 733114 - RNA, 64 nt, Homo Sapiens; identical to SEQ ID NO: 491331

SEQ ID NO: 733115 - RNA, 64 nt, Homo Sapiens; identical to SEQ ID NO: 491332

SEQ ID NO: 733116 - RNA, 64 nt, Homo Sapiens; identical to SEQ ID NO: 491333

SEQ ID NO: 733117 - RNA, 64 nt, Homo Sapiens; identical to SEQ ID NO: 491334

SEQ ID NO: 733118 - RNA, 64 nt, Homo Sapiens; identical to SEQ ID NO: 491335

SEQ ID NO: 733119 - RNA, 64 nt, Homo Sapiens; identical to SEQ ID NO: 491336

SEQ ID NO: 733120 - RNA, 64 nt, Homo Sapiens; identical to SEQ ID NO: 491337

SEQ ID NO: 733121 - RNA, 64 nt, Homo Sapiens; identical to SEQ ID NO: 491338

SEQ ID NO: 733122 - RNA, 64 nt, Homo Sapiens; identical to SEQ ID NO: 491339

SEQ ID NO: 733123 - RNA, 64 nt, Homo Sapiens; identical to SEQ ID NO: 491340

SEQ ID NO: 733124 - RNA, 64 nt, Homo Sapiens; identical to SEQ ID NO: 491341

SEQ ID NO: 733125 - RNA, 64 nt, Homo Sapiens; identical to SEQ ID NO: 491342

SEQ ID NO: 733126 - RNA, 64 nt, Homo Sapiens; identical to SEQ ID NO: 491343

SEQ ID NO: 733127 - RNA, 64 nt, Homo Sapiens; identical to SEQ ID NO: 491344

SEQ ID NO: 733128 - RNA, 64 nt, Homo Sapiens; identical to SEQ ID NO: 491345

SEQ ID NO: 733129 - RNA, 64 nt, Homo Sapiens; identical to SEQ ID NO: 491346

SEQ ID NO: 733130 - RNA, 64 nt, Homo Sapiens; identical to SEQ ID NO: 491347

SEQ ID NO: 733131 - RNA, 64 nt, Homo Sapiens; identical to SEQ ID NO: 377795

SEQ ID NO: 733132 - RNA, 64 nt, Homo Sapiens; identical to SEQ ID NO: 377796

SEQ ID NO: 733133 - RNA, 64 nt, Homo Sapiens; identical to SEQ ID NO: 377797

SEQ ID NO: 733134 - RNA, 64 nt, Homo Sapiens; identical to SEQ ID NO: 377798

SEQ ID NO: 733135 - RNA, 64 nt, Homo Sapiens; identical to SEQ ID NO: 377799

SEQ ID NO: 733136 - RNA, 64 nt, Homo Sapiens; identical to SEQ ID NO: 377800

SEQ ID NO: 733137 - RNA, 64 nt, Homo Sapiens; identical to SEQ ID NO: 377801

SEQ ID NO: 733138 - RNA, 62 nt, Homo Sapiens; identical to SEQ ID NO: 377802

SEQ ID NO: 733139 - RNA, 64 nt, Homo Sapiens; identical to SEQ ID NO: 377803

SEQ ID NO: 733140 - RNA, 64 nt, Homo Sapiens; identical to SEQ ID NO: 377804

SEQ ID NO: 733141 - RNA, 64 nt, Homo Sapiens; identical to SEQ ID NO: 377805

SEQ ID NO: 733142 - RNA, 64 nt, Homo Sapiens; identical to SEQ ID NO: 377806

SEQ ID NO: 733143 - RNA, 64 nt, Homo Sapiens; identical to SEQ ID NO: 377807

SEQ ID NO: 733144 - RNA, 64 nt, Homo Sapiens; identical to SEQ ID NO: 377808

SEQ ID NO: 733145 - RNA, 64 nt, Homo Sapiens; identical to SEQ ID NO: 377809

SEQ ID NO: 733146 - RNA, 64 nt, Homo Sapiens; identical to SEQ ID NO: 377810

SEQ ID NO: 733147 - RNA, 64 nt, Homo Sapiens; identical to SEQ ID NO: 377811

SEQ ID NO: 733148 - RNA, 64 nt, Homo Sapiens; identical to SEQ ID NO: 377812

SEQ ID NO: 733149 - RNA, 64 nt, Homo Sapiens; identical to SEQ ID NO: 377813

SEQ ID NO: 733150 - RNA, 64 nt, Homo Sapiens; identical to SEQ ID NO: 377814

SEQ ID NO: 733151 - RNA, 64 nt, Homo Sapiens; identical to SEQ ID NO: 377815

SEQ ID NO: 733152 - RNA, 64 nt, Homo Sapiens; identical to SEQ ID NO: 377816

SEQ ID NO: 733153 - RNA, 64 nt, Homo Sapiens; identical to SEQ ID NO: 377817

SEQ ID NO: 733154 - RNA, 64 nt, Homo Sapiens; identical to SEQ ID NO: 377818

SEQ ID NO: 733155 - RNA, 64 nt, Homo Sapiens; identical to SEQ ID NO: 377819

SEQ ID NO: 733156 - RNA, 64 nt, Homo Sapiens; identical to SEQ ID NO: 377820

SEQ ID NO: 733157 - RNA, 64 nt, Homo Sapiens; identical to SEQ ID NO: 491300

SEQ ID NO: 733158 - RNA, 64 nt, Homo Sapiens; identical to SEQ ID NO: 491301

SEQ ID NO: 733159 - RNA, 64 nt, Homo Sapiens; identical to SEQ ID NO: 491302

SEQ ID NO: 733160 - RNA, 64 nt, Homo Sapiens; identical to SEQ ID NO: 491303

SEQ ID NO: 733161 - RNA, 64 nt, Homo Sapiens; identical to SEQ ID NO: 491304

SEQ ID NO: 733162 - RNA, 64 nt, Homo Sapiens; identical to SEQ ID NO: 491305

SEQ ID NO: 733163 - RNA, 64 nt, Homo Sapiens; identical to SEQ ID NO: 491306

SEQ ID NO: 733164 - RNA, 64 nt, Homo Sapiens; identical to SEQ ID NO: 491307

SEQ ID NO: 733165 - RNA, 64 nt, Homo Sapiens; identical to SEQ ID NO: 491308

SEQ ID NO: 733166 - RNA, 64 nt, Homo Sapiens; identical to SEQ ID NO: 491309

SEQ ID NO: 733167 - RNA, 64 nt, Homo Sapiens; identical to SEQ ID NO: 491310

SEQ ID NO: 733168 - RNA, 64 nt, Homo Sapiens; identical to SEQ ID NO: 491311

SEQ ID NO: 733169 - RNA, 64 nt, Homo Sapiens; identical to SEQ ID NO: 491312

SEQ ID NO: 733170 - RNA, 64 nt, Homo Sapiens; identical to SEQ ID NO: 491313

SEQ ID NO: 733171 - RNA, 64 nt, Homo Sapiens; identical to SEQ ID NO: 491314

SEQ ID NO: 733172 - RNA, 64 nt, Homo Sapiens; identical to SEQ ID NO: 491315

SEQ ID NO: 733173 - RNA, 64 nt, Homo Sapiens; identical to SEQ ID NO: 491316

SEQ ID NO: 733174 - RNA, 64 nt, Homo Sapiens; identical to SEQ ID NO: 491317

SEQ ID NO: 733175 - RNA, 64 nt, Homo Sapiens; identical to SEQ ID NO: 491318

SEQ ID NO: 733176 - RNA, 64 nt, Homo Sapiens; identical to SEQ ID NO: 491319

SEQ ID NO: 733177 - RNA, 64 nt, Homo Sapiens; identical to SEQ ID NO: 491320

SEQ ID NO: 733178 - RNA, 64 nt, Homo Sapiens; identical to SEQ ID NO: 491321

SEQ ID NO: 733179 - RNA, 64 nt, Homo Sapiens; identical to SEQ ID NO: 491322

SEQ ID NO: 733180 - RNA, 64 nt, Homo Sapiens; identical to SEQ ID NO: 491323

SEQ ID NO: 733181 - RNA, 64 nt, Homo Sapiens; identical to SEQ ID NO: 491324

SEQ ID NO: 733182 - RNA, 64 nt, Homo Sapiens; identical to SEQ ID NO: 491325

SEQ ID NO: 733183 - RNA, 64 nt, Homo Sapiens; identical to SEQ ID NO: 491326

SEQ ID NO: 733184 - RNA, 64 nt, Homo Sapiens; identical to SEQ ID NO: 491327

SEQ ID NO: 733185 - RNA, 64 nt, Homo Sapiens; identical to SEQ ID NO: 491328

SEQ ID NO: 733186 - RNA, 64 nt, Homo Sapiens; identical to SEQ ID NO: 491329

SEQ ID NO: 733187 - RNA, 64 nt, Homo Sapiens; identical to SEQ ID NO: 491330

SEQ ID NO: 733188 - RNA, 64 nt, Homo Sapiens; identical to SEQ ID NO: 491331

SEQ ID NO: 733189 - RNA, 64 nt, Homo Sapiens; identical to SEQ ID NO: 491332

SEQ ID NO: 733190 - RNA, 64 nt, Homo Sapiens; identical to SEQ ID NO: 491333

SEQ ID NO: 733191 - RNA, 64 nt, Homo Sapiens; identical to SEQ ID NO: 491334

SEQ ID NO: 733192 - RNA, 64 nt, Homo Sapiens; identical to SEQ ID NO: 491335

SEQ ID NO: 733193 - RNA, 64 nt, Homo Sapiens; identical to SEQ ID NO: 491336

SEQ ID NO: 733194 - RNA, 64 nt, Homo Sapiens; identical to SEQ ID NO: 491337

SEQ ID NO: 733195 - RNA, 64 nt, Homo Sapiens; identical to SEQ ID NO: 491338

SEQ ID NO: 733196 - RNA, 64 nt, Homo Sapiens; identical to SEQ ID NO: 491339

SEQ ID NO: 733197 - RNA, 64 nt, Homo Sapiens; identical to SEQ ID NO: 491340

SEQ ID NO: 733198 - RNA, 64 nt, Homo Sapiens; identical to SEQ ID NO: 491341

SEQ ID NO: 733199 - RNA, 64 nt, Homo Sapiens; identical to SEQ ID NO: 491342

SEQ ID NO: 733200 - RNA, 64 nt, Homo Sapiens; identical to SEQ ID NO: 491343

SEQ ID NO: 733201 - RNA, 64 nt, Homo Sapiens; identical to SEQ ID NO: 491344

SEQ ID NO: 733202 - RNA, 64 nt, Homo Sapiens; identical to SEQ ID NO: 491345

SEQ ID NO: 733203 - RNA, 64 nt, Homo Sapiens; identical to SEQ ID NO: 491346

SEQ ID NO: 733204 - RNA, 64 nt, Homo Sapiens; identical to SEQ ID NO: 491347

SEQ ID NO: 733205 - RNA, 64 nt, Homo Sapiens; identical to SEQ ID NO: 244198

SEQ ID NO: 733206 - RNA, 64 nt, Homo Sapiens; identical to SEQ ID NO: 244199

SEQ ID NO: 733207 - RNA, 64 nt, Homo Sapiens; identical to SEQ ID NO: 244200

SEQ ID NO: 733208 - RNA, 64 nt, Homo Sapiens; identical to SEQ ID NO: 244201

SEQ ID NO: 733209 - RNA, 64 nt, Homo Sapiens; identical to SEQ ID NO: 244202

SEQ ID NO: 733210 - RNA, 64 nt, Homo Sapiens; identical to SEQ ID NO: 244203

SEQ ID NO: 733211 - RNA, 64 nt, Homo Sapiens; identical to SEQ ID NO: 244204

SEQ ID NO: 733212 - RNA, 64 nt, Homo Sapiens; identical to SEQ ID NO: 244205

SEQ ID NO: 733213 - RNA, 64 nt, Homo Sapiens; identical to SEQ ID NO: 244206

SEQ ID NO: 733214 - RNA, 64 nt, Homo Sapiens; identical to SEQ ID NO: 244207

SEQ ID NO: 733215 - RNA, 64 nt, Homo Sapiens; identical to SEQ ID NO: 244208

SEQ ID NO: 733216 - RNA, 64 nt, Homo Sapiens; identical to SEQ ID NO: 244209

SEQ ID NO: 733217 - RNA, 64 nt, Homo Sapiens; identical to SEQ ID NO: 244210

SEQ ID NO: 733218 - RNA, 64 nt, Homo Sapiens; identical to SEQ ID NO: 244211

SEQ ID NO: 733219 - RNA, 64 nt, Homo Sapiens; identical to SEQ ID NO: 244212

SEQ ID NO: 733220 - RNA, 64 nt, Homo Sapiens; identical to SEQ ID NO: 244213

SEQ ID NO: 733221 - RNA, 64 nt, Homo Sapiens; identical to SEQ ID NO: 244214

SEQ ID NO: 733222 - RNA, 64 nt, Homo Sapiens; identical to SEQ ID NO: 244215

SEQ ID NO: 733223 - RNA, 64 nt, Homo Sapiens; identical to SEQ ID NO: 244216

SEQ ID NO: 733224 - RNA, 64 nt, Homo Sapiens; identical to SEQ ID NO: 244217

SEQ ID NO: 733225 - RNA, 64 nt, Homo Sapiens; identical to SEQ ID NO: 244218

SEQ ID NO: 733226 - RNA, 64 nt, Homo Sapiens; identical to SEQ ID NO: 244219

SEQ ID NO: 733227 - RNA, 64 nt, Homo Sapiens; identical to SEQ ID NO: 244220

SEQ ID NO: 733228 - RNA, 64 nt, Homo Sapiens; identical to SEQ ID NO: 244221

SEQ ID NO: 733229 - RNA, 64 nt, Homo Sapiens; identical to SEQ ID NO: 244222

SEQ ID NO: 733230 - RNA, 64 nt, Homo Sapiens; identical to SEQ ID NO: 244223

SEQ ID NO: 733231 - RNA, 64 nt, Homo Sapiens; identical to SEQ ID NO: 244224

SEQ ID NO: 733232 - RNA, 64 nt, Homo Sapiens; identical to SEQ ID NO: 244225

SEQ ID NO: 733233 - RNA, 64 nt, Homo Sapiens; identical to SEQ ID NO: 244226

SEQ ID NO: 733234 - RNA, 64 nt, Homo Sapiens; identical to SEQ ID NO: 244227

SEQ ID NO: 733235 - RNA, 64 nt, Homo Sapiens; identical to SEQ ID NO: 244228

SEQ ID NO: 733236 - RNA, 64 nt, Homo Sapiens; identical to SEQ ID NO: 244229

SEQ ID NO: 733237 - RNA, 64 nt, Homo Sapiens; identical to SEQ ID NO: 244230

SEQ ID NO: 733238 - RNA, 64 nt, Homo Sapiens; identical to SEQ ID NO: 244231

SEQ ID NO: 733239 - RNA, 64 nt, Homo Sapiens; identical to SEQ ID NO: 244232

SEQ ID NO: 733240 - RNA, 64 nt, Homo Sapiens; identical to SEQ ID NO: 244233

SEQ ID NO: 733241 - RNA, 64 nt, Homo Sapiens; identical to SEQ ID NO: 244234

SEQ ID NO: 733242 - RNA, 64 nt, Homo Sapiens; identical to SEQ ID NO: 244235

SEQ ID NO: 733243 - RNA, 64 nt, Homo Sapiens; identical to SEQ ID NO: 244236

SEQ ID NO: 733244 - RNA, 64 nt, Homo Sapiens; identical to SEQ ID NO: 244237

SEQ ID NO: 733245 - RNA, 64 nt, Homo Sapiens; identical to SEQ ID NO: 244238

SEQ ID NO: 733246 - RNA, 64 nt, Homo Sapiens; identical to SEQ ID NO: 244239

SEQ ID NO: 733247 - RNA, 64 nt, Homo Sapiens; identical to SEQ ID NO: 244240

SEQ ID NO: 733248 - RNA, 64 nt, Homo Sapiens; identical to SEQ ID NO: 244241

SEQ ID NO: 733249 - RNA, 64 nt, Homo Sapiens; identical to SEQ ID NO: 244242

SEQ ID NO: 733250 - RNA, 64 nt, Homo Sapiens; identical to SEQ ID NO: 244243

SEQ ID NO: 733251 - RNA, 64 nt, Homo Sapiens; identical to SEQ ID NO: 244244

SEQ ID NO: 733252 - RNA, 64 nt, Homo Sapiens; identical to SEQ ID NO: 244245

SEQ ID NO: 733253 - RNA, 64 nt, Homo Sapiens; identical to SEQ ID NO: 244246

SEQ ID NO: 733254 - RNA, 64 nt, Homo Sapiens; identical to SEQ ID NO: 244247

SEQ ID NO: 733255 - RNA, 64 nt, Homo Sapiens; identical to SEQ ID NO: 244248

SEQ ID NO: 733256 - RNA, 64 nt, Homo Sapiens; identical to SEQ ID NO: 244249

SEQ ID NO: 733257 - RNA, 64 nt, Homo Sapiens; identical to SEQ ID NO: 244250

SEQ ID NO: 733258 - RNA, 64 nt, Homo Sapiens; identical to SEQ ID NO: 244251

SEQ ID NO: 733259 - RNA, 64 nt, Homo Sapiens; identical to SEQ ID NO: 244252

SEQ ID NO: 733260 - RNA, 64 nt, Homo Sapiens; identical to SEQ ID NO: 244253

SEQ ID NO: 733261 - RNA, 64 nt, Homo Sapiens; identical to SEQ ID NO: 244254

SEQ ID NO: 733262 - RNA, 64 nt, Homo Sapiens; identical to SEQ ID NO: 244255

SEQ ID NO: 733263 - RNA, 64 nt, Homo Sapiens; identical to SEQ ID NO: 244256

SEQ ID NO: 733264 - RNA, 64 nt, Homo Sapiens; identical to SEQ ID NO: 244257

SEQ ID NO: 733265 - RNA, 64 nt, Homo Sapiens; identical to SEQ ID NO: 244258

SEQ ID NO: 733266 - RNA, 64 nt, Homo Sapiens; identical to SEQ ID NO: 244259

SEQ ID NO: 733267 - RNA, 64 nt, Homo Sapiens; identical to SEQ ID NO: 244260

SEQ ID NO: 733268 - RNA, 64 nt, Homo Sapiens; identical to SEQ ID NO: 244261

SEQ ID NO: 733269 - RNA, 64 nt, Homo Sapiens; identical to SEQ ID NO: 244262

SEQ ID NO: 733270 - RNA, 64 nt, Homo Sapiens; identical to SEQ ID NO: 244263

SEQ ID NO: 733271 - RNA, 59 nt, Homo Sapiens
agagcuagaaccuggagaacuagaaccuggagggcuagaacuggagaggcuagaaccaa

SEQ ID NO: 733272 - RNA, 59 nt, Homo Sapiens
agggcuggaaucuggagagcuagaaccuggagggcuagaaccuggagggcuagaaucug

SEQ ID NO: 733273 - RNA, 59 nt, Homo Sapiens
agagcuagaaccuggagggcuagaaccuggagggcuagaaucuggagagcuagaaccug

SEQ ID NO: 733274 - RNA, 59 nt, Homo Sapiens
agggcuagaaucuggagagcuagaaccuggagggcuagaaucuggagagcuagaaccug

SEQ ID NO: 733275 - RNA, 59 nt, Homo Sapiens
agggcuagaaucuggagagcuagaaccuggagggcuagaaccuggagagcuagaaccua

SEQ ID NO: 733276 - RNA, 59 nt, Homo Sapiens
agggcuggaaucuggagagcuagaaccuggagggcuagaaccuggagggcuagaaccua

SEQ ID NO: 733277 - RNA, 59 nt, Homo Sapiens
agagcuagaaccuggagggcuagaaccuggagggcuagaaccuagaagggcuagaaccu

SEQ ID NO: 733278 - RNA, 59 nt, Homo Sapiens; identical to SEQ ID NO: 733276

SEQ ID NO: 733279 - RNA, 59 nt, Homo Sapiens; identical to SEQ ID NO: 733277

SEQ ID NO: 733280 - RNA, 59 nt, Homo Sapiens
gggcuagaaccuagaagggcuagaaccuggagggcuagaaccuggcagguuagaaccua

SEQ ID NO: 733281 - RNA, 59 nt, Homo Sapiens
agggcuagaaccuggagagccagaaccuggagggcuagaaccuggaagggcuagaaccu

SEQ ID NO: 733282 - RNA, 59 nt, Homo Sapiens
caagcuagaaccuggagggaaugaaccuggagggcuagaaccuggagaaugagaaaaau

SEQ ID NO: 733283 - RNA, 64 nt, Homo Sapiens
aagggaaaaaagagaaaaacagccaaauuuaaauuauaagaaagcccaaacuuuuagaguaaaa

SEQ ID NO: 733284 - RNA, 64 nt, Homo Sapiens
gcagaaugcagaacaccuacauauguuucagcauuauaagaaaguguuuuaacuucuaaagaaa

SEQ ID NO: 733285 - RNA, 64 nt, Homo Sapiens
ggaaauuaaagucuuccauuaauggaagcaaaauuauaagaagacagcuuaaaauugguaauug

SEQ ID NO: 733286 - RNA, 64 nt, Homo Sapiens
aaucuuaauuuuguauuuuuugagcugaguuccuuauaagaauuuugucauauaaaccugaugu

SEQ ID NO: 733287 - RNA, 64 nt, Homo Sapiens
auagugccauagaugguucuuucagaaaacauaauauaagaaucuccuuguuuuaagauuguaa

SEQ ID NO: 733288 - RNA, 64 nt, Homo Sapiens
caaauguuuugguuauucaugaucacuugggcaguauaagaaaauguagcuucugaauauuggc

SEQ ID NO: 733289 - RNA, 64 nt, Homo Sapiens
aaacaauguuuggaugcaacgcagaauaaaagaauauaagaaauagcuuuuuguugcauuaaug

SEQ ID NO: 733290 - RNA, 64 nt, Homo Sapiens
uaauuuauuuuuacauaauuuuuuauuaccaauauauaagaaugaaaaaguuguauuuucuaau

SEQ ID NO: 733291 - RNA, 64 nt, Homo Sapiens
gaaaaccaaacaccgcauguauaaaaaccuucacuauaagaacagauguuuuagaauuuuuuuu

SEQ ID NO: 733292 - RNA, 64 nt, Homo Sapiens
ugccagucauguaaauugauucugcugagggucuuauaagaauugagauauaacaaugguaaaa

SEQ ID NO: 733293 - RNA, 64 nt, Homo Sapiens
caauggcaaaaguccuuguuguagaugagaagcauauaagaaaugguugccaaucuuuguuuug

SEQ ID NO: 733294 - RNA, 64 nt, Homo Sapiens
uuauuauggaaauguugucuuuuauacuuaguuauauaagaaaaaagggaguuaugcaauuaau

SEQ ID NO: 733295 - RNA, 64 nt, Homo Sapiens
aaagggaaggauguguuuuuuucucucacuauaguauaagaaucuauuuuggagaaaaaaagaa

SEQ ID NO: 733296 - RNA, 64 nt, Homo Sapiens
auaccuuuaacugcaaagaaaaggcaguuucaaauauaagaaauuuauuucagguaaggguaau

SEQ ID NO: 733297 - RNA, 64 nt, Homo Sapiens
uccaugggauuguaaauauaaacauuaacuuuccuauaagaauauuuuggcuuuguaaucuaua

SEQ ID NO: 733298 - RNA, 64 nt, Homo Sapiens
auccuaaaaauaggggguuuuugcacaagcaaaguauaagaauucaguuuuccaagaacaaauc

SEQ ID NO: 733299 - RNA, 64 nt, Homo Sapiens
ggcaaaaaauucauuugaaccaauaugugaugaauauaagaaagagacaauaaucugaauaaga

SEQ ID NO: 733300 - RNA, 64 nt, Homo Sapiens
gcaaugaaaacugacuugaaauaaauagcacauuuauaagaaccuaggacagguacaauuuugg

SEQ ID NO: 733301 - RNA, 64 nt, Homo Sapiens
aguaguuguugauuaaauuuuuuucuuuugugauuauaagaaagcauuucacccaggcaggcca

SEQ ID NO: 733302 - RNA, 64 nt, Homo Sapiens
ugccuccuagugcuccuccguauagcagauaagauauaagaaagaguauaacuccugcaguucc

SEQ ID NO: 733303 - RNA, 64 nt, Homo Sapiens
acaauuaaugcugauuugggauucaugggacuuauauaagaaggacugagaucagggaucccaa

SEQ ID NO: 733304 - RNA, 64 nt, Homo Sapiens
caguuguaaauuuguaaagauuaccuugccacuuuauaagaaaguguauuuaacuaaaaaguca

SEQ ID NO: 733305 - RNA, 64 nt, Homo Sapiens
agcacaaaauaguacuuuguggaucauuucaagauauaagaaauuuuggaaauuccaccauaaa

SEQ ID NO: 733306 - RNA, 50 nt, Homo Sapiens
aaacucauaauguaauuuaauauaagaaaagguuuccaugucaugcucua

SEQ ID NO: 733307 - RNA, 64 nt, Homo Sapiens
aggguggagccuucaugaguggaauuacugccuuuauaagaagaagccaaagagccagcuagcu

SEQ ID NO: 733308 - RNA, 64 nt, Homo Sapiens
aagacucauacuacaaauaauuuaauugauggcauauaagaauaugcaguuugaaaaagccaaa

SEQ ID NO: 733309 - RNA, 64 nt, Homo Sapiens
guaacucauagcugcugugcaaauugguagaccuuauaagaaggcacuuguuuguaagccagag

SEQ ID NO: 733310 - RNA, 64 nt, Homo Sapiens
uggaggcaaagaacuuaagugaggaaauuggguuuauaagaaaaauaguagagcugcaccuaaa

SEQ ID NO: 733311 - RNA, 64 nt, Homo Sapiens
ugucauguuuugugggaaaaacuucuaguccaaauauaagaaacuaaauguaucuuuauuagug

SEQ ID NO: 733312 - RNA, 64 nt, Homo Sapiens
guucaaaaacuaauuaauuuauauguuucaaaaauauaagaaaacuuguaguguuaguuaaaac

SEQ ID NO: 733313 - RNA, 64 nt, Homo Sapiens
cuuguguucuguauuuuucuauaguuacucaagguauaagaagcugaaauuaacugcccuagau

SEQ ID NO: 733314 - RNA, 64 nt, Homo Sapiens
guguccaggacuggaauaaauuggcuaagcccaugcagacuauuaugggaguggcugcuucucc

SEQ ID NO: 733315 - RNA, 64 nt, Homo Sapiens
augaugucaacagucuauaucacuagccuacucagcagacuaaaaaaaacuacuuauaauuaau

SEQ ID NO: 733316 - RNA, 64 nt, Homo Sapiens
aaagccuuuggugggaagauauccuaugaauguggcagacuauaaaaauuguauacugagaaaa

SEQ ID NO: 733317 - RNA, 64 nt, Homo Sapiens
ugguuguuuauuuagugaucguaauuucaugaaugcagacuacauaagauaucugcaaagaaga

SEQ ID NO: 733318 - RNA, 64 nt, Homo Sapiens; identical to SEQ ID NO: 592524

SEQ ID NO: 733319 - RNA, 64 nt, Homo Sapiens; identical to SEQ ID NO: 592525

SEQ ID NO: 733320 - RNA, 64 nt, Homo Sapiens; identical to SEQ ID NO: 592526

SEQ ID NO: 733321 - RNA, 64 nt, Homo Sapiens; identical to SEQ ID NO: 592527

SEQ ID NO: 733322 - RNA, 64 nt, Homo Sapiens; identical to SEQ ID NO: 592528

SEQ ID NO: 733323 - RNA, 64 nt, Homo Sapiens; identical to SEQ ID NO: 592529

SEQ ID NO: 733324 - RNA, 64 nt, Homo Sapiens; identical to SEQ ID NO: 592530

SEQ ID NO: 733325 - RNA, 64 nt, Homo Sapiens; identical to SEQ ID NO: 592531

SEQ ID NO: 733326 - RNA, 64 nt, Homo Sapiens; identical to SEQ ID NO: 592532

SEQ ID NO: 733327 - RNA, 64 nt, Homo Sapiens; identical to SEQ ID NO: 592533

SEQ ID NO: 733328 - RNA, 64 nt, Homo Sapiens; identical to SEQ ID NO: 592534

SEQ ID NO: 733329 - RNA, 64 nt, Homo Sapiens; identical to SEQ ID NO: 592535

SEQ ID NO: 733330 - RNA, 64 nt, Homo Sapiens; identical to SEQ ID NO: 592536

SEQ ID NO: 733331 - RNA, 64 nt, Homo Sapiens; identical to SEQ ID NO: 592537

SEQ ID NO: 733332 - RNA, 64 nt, Homo Sapiens; identical to SEQ ID NO: 592538

SEQ ID NO: 733333 - RNA, 64 nt, Homo Sapiens; identical to SEQ ID NO: 592539

SEQ ID NO: 733334 - RNA, 64 nt, Homo Sapiens; identical to SEQ ID NO: 592540

SEQ ID NO: 733335 - RNA, 64 nt, Homo Sapiens; identical to SEQ ID NO: 592541

SEQ ID NO: 733336 - RNA, 64 nt, Homo Sapiens; identical to SEQ ID NO: 592542

SEQ ID NO: 733337 - RNA, 64 nt, Homo Sapiens; identical to SEQ ID NO: 592543

SEQ ID NO: 733338 - RNA, 64 nt, Homo Sapiens; identical to SEQ ID NO: 592544

SEQ ID NO: 733339 - RNA, 64 nt, Homo Sapiens; identical to SEQ ID NO: 592545

SEQ ID NO: 733340 - RNA, 64 nt, Homo Sapiens; identical to SEQ ID NO: 592546

SEQ ID NO: 733341 - RNA, 64 nt, Homo Sapiens; identical to SEQ ID NO: 592547

SEQ ID NO: 733342 - RNA, 64 nt, Homo Sapiens; identical to SEQ ID NO: 592548

SEQ ID NO: 733343 - RNA, 64 nt, Homo Sapiens; identical to SEQ ID NO: 592549

SEQ ID NO: 733344 - RNA, 64 nt, Homo Sapiens; identical to SEQ ID NO: 592550

SEQ ID NO: 733345 - RNA, 64 nt, Homo Sapiens; identical to SEQ ID NO: 592551

SEQ ID NO: 733346 - RNA, 64 nt, Homo Sapiens; identical to SEQ ID NO: 592552

SEQ ID NO: 733347 - RNA, 64 nt, Homo Sapiens; identical to SEQ ID NO: 592553

SEQ ID NO: 733348 - RNA, 64 nt, Homo Sapiens; identical to SEQ ID NO: 592554

SEQ ID NO: 733349 - RNA, 64 nt, Homo Sapiens; identical to SEQ ID NO: 592555

SEQ ID NO: 733350 - RNA, 64 nt, Homo Sapiens; identical to SEQ ID NO: 592556

SEQ ID NO: 733351 - RNA, 64 nt, Homo Sapiens; identical to SEQ ID NO: 592557

SEQ ID NO: 733352 - RNA, 64 nt, Homo Sapiens; identical to SEQ ID NO: 592558

SEQ ID NO: 733353 - RNA, 64 nt, Homo Sapiens; identical to SEQ ID NO: 592559

SEQ ID NO: 733354 - RNA, 64 nt, Homo Sapiens; identical to SEQ ID NO: 592560

SEQ ID NO: 733355 - RNA, 64 nt, Homo Sapiens; identical to SEQ ID NO: 592561

SEQ ID NO: 733356 - RNA, 64 nt, Homo Sapiens; identical to SEQ ID NO: 592562

SEQ ID NO: 733357 - RNA, 64 nt, Homo Sapiens; identical to SEQ ID NO: 592563

SEQ ID NO: 733358 - RNA, 64 nt, Homo Sapiens; identical to SEQ ID NO: 592564

SEQ ID NO: 733359 - RNA, 64 nt, Homo Sapiens; identical to SEQ ID NO: 592565

SEQ ID NO: 733360 - RNA, 64 nt, Homo Sapiens; identical to SEQ ID NO: 592566

SEQ ID NO: 733361 - RNA, 64 nt, Homo Sapiens; identical to SEQ ID NO: 592567

SEQ ID NO: 733362 - RNA, 64 nt, Homo Sapiens; identical to SEQ ID NO: 592568

SEQ ID NO: 733363 - RNA, 64 nt, Homo Sapiens; identical to SEQ ID NO: 592569

SEQ ID NO: 733364 - RNA, 64 nt, Homo Sapiens; identical to SEQ ID NO: 592570

SEQ ID NO: 733365 - RNA, 64 nt, Homo Sapiens; identical to SEQ ID NO: 592571

SEQ ID NO: 733366 - RNA, 64 nt, Homo Sapiens; identical to SEQ ID NO: 592572

SEQ ID NO: 733367 - RNA, 64 nt, Homo Sapiens; identical to SEQ ID NO: 592573

SEQ ID NO: 733368 - RNA, 64 nt, Homo Sapiens; identical to SEQ ID NO: 592574

SEQ ID NO: 733369 - RNA, 64 nt, Homo Sapiens; identical to SEQ ID NO: 592575

SEQ ID NO: 733370 - RNA, 64 nt, Homo Sapiens; identical to SEQ ID NO: 592576

SEQ ID NO: 733371 - RNA, 64 nt, Homo Sapiens; identical to SEQ ID NO: 592577

SEQ ID NO: 733372 - RNA, 64 nt, Homo Sapiens; identical to SEQ ID NO: 592578

SEQ ID NO: 733373 - RNA, 64 nt, Homo Sapiens; identical to SEQ ID NO: 592579

SEQ ID NO: 733374 - RNA, 64 nt, Homo Sapiens; identical to SEQ ID NO: 592580

SEQ ID NO: 733375 - RNA, 64 nt, Homo Sapiens; identical to SEQ ID NO: 592581

SEQ ID NO: 733376 - RNA, 64 nt, Homo Sapiens; identical to SEQ ID NO: 592582

SEQ ID NO: 733377 - RNA, 64 nt, Homo Sapiens; identical to SEQ ID NO: 592583

SEQ ID NO: 733378 - RNA, 64 nt, Homo Sapiens; identical to SEQ ID NO: 592584

SEQ ID NO: 733379 - RNA, 64 nt, Homo Sapiens; identical to SEQ ID NO: 592585

SEQ ID NO: 733380 - RNA, 64 nt, Homo Sapiens; identical to SEQ ID NO: 592586

SEQ ID NO: 733381 - RNA, 64 nt, Homo Sapiens; identical to SEQ ID NO: 592587

SEQ ID NO: 733382 - RNA, 64 nt, Homo Sapiens; identical to SEQ ID NO: 592588

SEQ ID NO: 733383 - RNA, 64 nt, Homo Sapiens; identical to SEQ ID NO: 592589

SEQ ID NO: 733384 - RNA, 64 nt, Homo Sapiens; identical to SEQ ID NO: 592590

SEQ ID NO: 733385 - RNA, 64 nt, Homo Sapiens; identical to SEQ ID NO: 592591

SEQ ID NO: 733386 - RNA, 64 nt, Homo Sapiens; identical to SEQ ID NO: 592592

SEQ ID NO: 733387 - RNA, 64 nt, Homo Sapiens; identical to SEQ ID NO: 592593

SEQ ID NO: 733388 - RNA, 62 nt, Homo Sapiens; identical to SEQ ID NO: 592594

SEQ ID NO: 733389 - RNA, 64 nt, Homo Sapiens; identical to SEQ ID NO: 592595

SEQ ID NO: 733390 - RNA, 64 nt, Homo Sapiens; identical to SEQ ID NO: 592596

SEQ ID NO: 733391 - RNA, 64 nt, Homo Sapiens; identical to SEQ ID NO: 592597

SEQ ID NO: 733392 - RNA, 64 nt, Homo Sapiens; identical to SEQ ID NO: 592598

SEQ ID NO: 733393 - RNA, 64 nt, Homo Sapiens; identical to SEQ ID NO: 592599

SEQ ID NO: 733394 - RNA, 64 nt, Homo Sapiens; identical to SEQ ID NO: 592600

SEQ ID NO: 733395 - RNA, 64 nt, Homo Sapiens; identical to SEQ ID NO: 592601

SEQ ID NO: 733396 - RNA, 64 nt, Homo Sapiens; identical to SEQ ID NO: 592602

SEQ ID NO: 733397 - RNA, 64 nt, Homo Sapiens; identical to SEQ ID NO: 592603

SEQ ID NO: 733398 - RNA, 64 nt, Homo Sapiens; identical to SEQ ID NO: 592604

SEQ ID NO: 733399 - RNA, 64 nt, Homo Sapiens; identical to SEQ ID NO: 592605

SEQ ID NO: 733400 - RNA, 64 nt, Homo Sapiens; identical to SEQ ID NO: 592606

SEQ ID NO: 733401 - RNA, 64 nt, Homo Sapiens; identical to SEQ ID NO: 592607

SEQ ID NO: 733402 - RNA, 64 nt, Homo Sapiens; identical to SEQ ID NO: 592608

SEQ ID NO: 733403 - RNA, 64 nt, Homo Sapiens; identical to SEQ ID NO: 592609

SEQ ID NO: 733404 - RNA, 64 nt, Homo Sapiens; identical to SEQ ID NO: 592610

SEQ ID NO: 733405 - RNA, 64 nt, Homo Sapiens; identical to SEQ ID NO: 592611

SEQ ID NO: 733406 - RNA, 64 nt, Homo Sapiens; identical to SEQ ID NO: 592612

SEQ ID NO: 733407 - RNA, 64 nt, Homo Sapiens; identical to SEQ ID NO: 592613

SEQ ID NO: 733408 - RNA, 64 nt, Homo Sapiens; identical to SEQ ID NO: 592614

SEQ ID NO: 733409 - RNA, 64 nt, Homo Sapiens; identical to SEQ ID NO: 592615

SEQ ID NO: 733410 - RNA, 64 nt, Homo Sapiens; identical to SEQ ID NO: 592616

SEQ ID NO: 733411 - RNA, 64 nt, Homo Sapiens; identical to SEQ ID NO: 592617

SEQ ID NO: 733412 - RNA, 64 nt, Homo Sapiens; identical to SEQ ID NO: 592618

SEQ ID NO: 733413 - RNA, 64 nt, Homo Sapiens; identical to SEQ ID NO: 592619

SEQ ID NO: 733414 - RNA, 64 nt, Homo Sapiens; identical to SEQ ID NO: 592620

SEQ ID NO: 733415 - RNA, 64 nt, Homo Sapiens; identical to SEQ ID NO: 592621

SEQ ID NO: 733416 - RNA, 64 nt, Homo Sapiens; identical to SEQ ID NO: 592622

SEQ ID NO: 733417 - RNA, 64 nt, Homo Sapiens; identical to SEQ ID NO: 592623

SEQ ID NO: 733418 - RNA, 64 nt, Homo Sapiens; identical to SEQ ID NO: 592624

SEQ ID NO: 733419 - RNA, 64 nt, Homo Sapiens; identical to SEQ ID NO: 592625

SEQ ID NO: 733420 - RNA, 64 nt, Homo Sapiens; identical to SEQ ID NO: 592626

SEQ ID NO: 733421 - RNA, 64 nt, Homo Sapiens; identical to SEQ ID NO: 592627

SEQ ID NO: 733422 - RNA, 64 nt, Homo Sapiens; identical to SEQ ID NO: 592628

SEQ ID NO: 733423 - RNA, 64 nt, Homo Sapiens; identical to SEQ ID NO: 592629

SEQ ID NO: 733424 - RNA, 64 nt, Homo Sapiens; identical to SEQ ID NO: 592630

SEQ ID NO: 733425 - RNA, 64 nt, Homo Sapiens; identical to SEQ ID NO: 592631

SEQ ID NO: 733426 - RNA, 64 nt, Homo Sapiens; identical to SEQ ID NO: 592632

SEQ ID NO: 733427 - RNA, 64 nt, Homo Sapiens; identical to SEQ ID NO: 592633

SEQ ID NO: 733428 - RNA, 64 nt, Homo Sapiens; identical to SEQ ID NO: 592634

SEQ ID NO: 733429 - RNA, 64 nt, Homo Sapiens; identical to SEQ ID NO: 592635

SEQ ID NO: 733430 - RNA, 64 nt, Homo Sapiens; identical to SEQ ID NO: 617984

SEQ ID NO: 733431 - RNA, 64 nt, Homo Sapiens; identical to SEQ ID NO: 617985

SEQ ID NO: 733432 - RNA, 64 nt, Homo Sapiens; identical to SEQ ID NO: 617986

SEQ ID NO: 733433 - RNA, 64 nt, Homo Sapiens; identical to SEQ ID NO: 617987

SEQ ID NO: 733434 - RNA, 64 nt, Homo Sapiens; identical to SEQ ID NO: 617988

SEQ ID NO: 733435 - RNA, 64 nt, Homo Sapiens; identical to SEQ ID NO: 617989

SEQ ID NO: 733436 - RNA, 64 nt, Homo Sapiens; identical to SEQ ID NO: 617990

SEQ ID NO: 733437 - RNA, 64 nt, Homo Sapiens; identical to SEQ ID NO: 617991

SEQ ID NO: 733438 - RNA, 64 nt, Homo Sapiens; identical to SEQ ID NO: 617992

SEQ ID NO: 733439 - RNA, 64 nt, Homo Sapiens; identical to SEQ ID NO: 617993

SEQ ID NO: 733440 - RNA, 64 nt, Homo Sapiens; identical to SEQ ID NO: 617994

SEQ ID NO: 733441 - RNA, 64 nt, Homo Sapiens; identical to SEQ ID NO: 617995

SEQ ID NO: 733442 - RNA, 64 nt, Homo Sapiens; identical to SEQ ID NO: 617996

SEQ ID NO: 733443 - RNA, 64 nt, Homo Sapiens; identical to SEQ ID NO: 617997

SEQ ID NO: 733444 - RNA, 64 nt, Homo Sapiens; identical to SEQ ID NO: 617998

SEQ ID NO: 733445 - RNA, 64 nt, Homo Sapiens; identical to SEQ ID NO: 617999

SEQ ID NO: 733446 - RNA, 64 nt, Homo Sapiens; identical to SEQ ID NO: 618000

SEQ ID NO: 733447 - RNA, 64 nt, Homo Sapiens; identical to SEQ ID NO: 618001

SEQ ID NO: 733448 - RNA, 64 nt, Homo Sapiens; identical to SEQ ID NO: 618002

SEQ ID NO: 733449 - RNA, 64 nt, Homo Sapiens; identical to SEQ ID NO: 618003

SEQ ID NO: 733450 - RNA, 64 nt, Homo Sapiens; identical to SEQ ID NO: 618004

SEQ ID NO: 733451 - RNA, 64 nt, Homo Sapiens; identical to SEQ ID NO: 618005

SEQ ID NO: 733452 - RNA, 64 nt, Homo Sapiens; identical to SEQ ID NO: 618006

SEQ ID NO: 733453 - RNA, 64 nt, Homo Sapiens; identical to SEQ ID NO: 618007

SEQ ID NO: 733454 - RNA, 64 nt, Homo Sapiens; identical to SEQ ID NO: 618008

SEQ ID NO: 733455 - RNA, 64 nt, Homo Sapiens; identical to SEQ ID NO: 618009

SEQ ID NO: 733456 - RNA, 64 nt, Homo Sapiens; identical to SEQ ID NO: 618010

SEQ ID NO: 733457 - RNA, 64 nt, Homo Sapiens; identical to SEQ ID NO: 618011

SEQ ID NO: 733458 - RNA, 64 nt, Homo Sapiens; identical to SEQ ID NO: 618012

SEQ ID NO: 733459 - RNA, 64 nt, Homo Sapiens; identical to SEQ ID NO: 618013

SEQ ID NO: 733460 - RNA, 64 nt, Homo Sapiens; identical to SEQ ID NO: 618014

SEQ ID NO: 733461 - RNA, 64 nt, Homo Sapiens; identical to SEQ ID NO: 618015

SEQ ID NO: 733462 - RNA, 64 nt, Homo Sapiens; identical to SEQ ID NO: 618016

SEQ ID NO: 733463 - RNA, 64 nt, Homo Sapiens; identical to SEQ ID NO: 618017

SEQ ID NO: 733464 - RNA, 64 nt, Homo Sapiens; identical to SEQ ID NO: 618018

SEQ ID NO: 733465 - RNA, 64 nt, Homo Sapiens; identical to SEQ ID NO: 618019

SEQ ID NO: 733466 - RNA, 64 nt, Homo Sapiens; identical to SEQ ID NO: 618020

SEQ ID NO: 733467 - RNA, 64 nt, Homo Sapiens; identical to SEQ ID NO: 618021

SEQ ID NO: 733468 - RNA, 64 nt, Homo Sapiens; identical to SEQ ID NO: 618022

SEQ ID NO: 733469 - RNA, 64 nt, Homo Sapiens; identical to SEQ ID NO: 618023

SEQ ID NO: 733470 - RNA, 64 nt, Homo Sapiens; identical to SEQ ID NO: 618024

SEQ ID NO: 733471 - RNA, 64 nt, Homo Sapiens; identical to SEQ ID NO: 618025

SEQ ID NO: 733472 - RNA, 64 nt, Homo Sapiens; identical to SEQ ID NO: 618026

SEQ ID NO: 733473 - RNA, 64 nt, Homo Sapiens; identical to SEQ ID NO: 618027

SEQ ID NO: 733474 - RNA, 64 nt, Homo Sapiens; identical to SEQ ID NO: 618028

SEQ ID NO: 733475 - RNA, 64 nt, Homo Sapiens; identical to SEQ ID NO: 618029

SEQ ID NO: 733476 - RNA, 64 nt, Homo Sapiens; identical to SEQ ID NO: 618030

SEQ ID NO: 733477 - RNA, 64 nt, Homo Sapiens; identical to SEQ ID NO: 618031

SEQ ID NO: 733478 - RNA, 64 nt, Homo Sapiens; identical to SEQ ID NO: 618032

SEQ ID NO: 733479 - RNA, 64 nt, Homo Sapiens; identical to SEQ ID NO: 618033

SEQ ID NO: 733480 - RNA, 64 nt, Homo Sapiens; identical to SEQ ID NO: 618034

SEQ ID NO: 733481 - RNA, 64 nt, Homo Sapiens; identical to SEQ ID NO: 618035

SEQ ID NO: 733482 - RNA, 64 nt, Homo Sapiens; identical to SEQ ID NO: 618036

SEQ ID NO: 733483 - RNA, 64 nt, Homo Sapiens; identical to SEQ ID NO: 618037

SEQ ID NO: 733484 - RNA, 64 nt, Homo Sapiens; identical to SEQ ID NO: 618038

SEQ ID NO: 733485 - RNA, 64 nt, Homo Sapiens; identical to SEQ ID NO: 618039

SEQ ID NO: 733486 - RNA, 64 nt, Homo Sapiens; identical to SEQ ID NO: 618040

SEQ ID NO: 733487 - RNA, 64 nt, Homo Sapiens; identical to SEQ ID NO: 618041

SEQ ID NO: 733488 - RNA, 64 nt, Homo Sapiens; identical to SEQ ID NO: 618042

SEQ ID NO: 733489 - RNA, 64 nt, Homo Sapiens; identical to SEQ ID NO: 618043

SEQ ID NO: 733490 - RNA, 64 nt, Homo Sapiens; identical to SEQ ID NO: 618044

SEQ ID NO: 733491 - RNA, 64 nt, Homo Sapiens; identical to SEQ ID NO: 618045

SEQ ID NO: 733492 - RNA, 64 nt, Homo Sapiens; identical to SEQ ID NO: 618046

SEQ ID NO: 733493 - RNA, 64 nt, Homo Sapiens; identical to SEQ ID NO: 618047

SEQ ID NO: 733494 - RNA, 64 nt, Homo Sapiens; identical to SEQ ID NO: 618048

SEQ ID NO: 733495 - RNA, 64 nt, Homo Sapiens; identical to SEQ ID NO: 618049

SEQ ID NO: 733496 - RNA, 64 nt, Homo Sapiens; identical to SEQ ID NO: 618050

SEQ ID NO: 733497 - RNA, 64 nt, Homo Sapiens; identical to SEQ ID NO: 618051

SEQ ID NO: 733498 - RNA, 64 nt, Homo Sapiens; identical to SEQ ID NO: 618052

SEQ ID NO: 733499 - RNA, 64 nt, Homo Sapiens; identical to SEQ ID NO: 618053

SEQ ID NO: 733500 - RNA, 64 nt, Homo Sapiens; identical to SEQ ID NO: 618054

SEQ ID NO: 733501 - RNA, 64 nt, Homo Sapiens; identical to SEQ ID NO: 618055

SEQ ID NO: 733502 - RNA, 64 nt, Homo Sapiens; identical to SEQ ID NO: 618056

SEQ ID NO: 733503 - RNA, 64 nt, Homo Sapiens; identical to SEQ ID NO: 618057

SEQ ID NO: 733504 - RNA, 64 nt, Homo Sapiens; identical to SEQ ID NO: 618058

SEQ ID NO: 733505 - RNA, 64 nt, Homo Sapiens; identical to SEQ ID NO: 618059

SEQ ID NO: 733506 - RNA, 64 nt, Homo Sapiens; identical to SEQ ID NO: 618060

SEQ ID NO: 733507 - RNA, 64 nt, Homo Sapiens; identical to SEQ ID NO: 618061

SEQ ID NO: 733508 - RNA, 64 nt, Homo Sapiens; identical to SEQ ID NO: 618062

SEQ ID NO: 733509 - RNA, 64 nt, Homo Sapiens; identical to SEQ ID NO: 618063

SEQ ID NO: 733510 - RNA, 64 nt, Homo Sapiens; identical to SEQ ID NO: 618064

SEQ ID NO: 733511 - RNA, 64 nt, Homo Sapiens; identical to SEQ ID NO: 618065

SEQ ID NO: 733512 - RNA, 64 nt, Homo Sapiens; identical to SEQ ID NO: 618066

SEQ ID NO: 733513 - RNA, 64 nt, Homo Sapiens; identical to SEQ ID NO: 618067

SEQ ID NO: 733514 - RNA, 64 nt, Homo Sapiens; identical to SEQ ID NO: 618068

SEQ ID NO: 733515 - RNA, 64 nt, Homo Sapiens; identical to SEQ ID NO: 618069

SEQ ID NO: 733516 - RNA, 64 nt, Homo Sapiens; identical to SEQ ID NO: 618070

SEQ ID NO: 733517 - RNA, 64 nt, Homo Sapiens; identical to SEQ ID NO: 618071

SEQ ID NO: 733518 - RNA, 64 nt, Homo Sapiens; identical to SEQ ID NO: 618072

SEQ ID NO: 733519 - RNA, 64 nt, Homo Sapiens; identical to SEQ ID NO: 618073

SEQ ID NO: 733520 - RNA, 64 nt, Homo Sapiens; identical to SEQ ID NO: 618074

SEQ ID NO: 733521 - RNA, 64 nt, Homo Sapiens; identical to SEQ ID NO: 618075

SEQ ID NO: 733522 - RNA, 64 nt, Homo Sapiens; identical to SEQ ID NO: 618076

SEQ ID NO: 733523 - RNA, 64 nt, Homo Sapiens; identical to SEQ ID NO: 213308

SEQ ID NO: 733524 - RNA, 64 nt, Homo Sapiens; identical to SEQ ID NO: 213309

SEQ ID NO: 733525 - RNA, 64 nt, Homo Sapiens; identical to SEQ ID NO: 213310

SEQ ID NO: 733526 - RNA, 64 nt, Homo Sapiens; identical to SEQ ID NO: 213311

SEQ ID NO: 733527 - RNA, 64 nt, Homo Sapiens; identical to SEQ ID NO: 213312

SEQ ID NO: 733528 - RNA, 64 nt, Homo Sapiens; identical to SEQ ID NO: 213313

SEQ ID NO: 733529 - RNA, 64 nt, Homo Sapiens; identical to SEQ ID NO: 213314

SEQ ID NO: 733530 - RNA, 64 nt, Homo Sapiens; identical to SEQ ID NO: 213315

SEQ ID NO: 733531 - RNA, 64 nt, Homo Sapiens; identical to SEQ ID NO: 213316

SEQ ID NO: 733532 - RNA, 64 nt, Homo Sapiens; identical to SEQ ID NO: 213317

SEQ ID NO: 733533 - RNA, 64 nt, Homo Sapiens; identical to SEQ ID NO: 213318

SEQ ID NO: 733534 - RNA, 64 nt, Homo Sapiens; identical to SEQ ID NO: 213319

SEQ ID NO: 733535 - RNA, 64 nt, Homo Sapiens; identical to SEQ ID NO: 213320

SEQ ID NO: 733536 - RNA, 64 nt, Homo Sapiens; identical to SEQ ID NO: 213321

SEQ ID NO: 733537 - RNA, 64 nt, Homo Sapiens; identical to SEQ ID NO: 213322

SEQ ID NO: 733538 - RNA, 64 nt, Homo Sapiens; identical to SEQ ID NO: 213323

SEQ ID NO: 733539 - RNA, 64 nt, Homo Sapiens; identical to SEQ ID NO: 213324

SEQ ID NO: 733540 - RNA, 64 nt, Homo Sapiens; identical to SEQ ID NO: 213325

SEQ ID NO: 733541 - RNA, 64 nt, Homo Sapiens; identical to SEQ ID NO: 213326

SEQ ID NO: 733542 - RNA, 64 nt, Homo Sapiens; identical to SEQ ID NO: 213327

SEQ ID NO: 733543 - RNA, 64 nt, Homo Sapiens; identical to SEQ ID NO: 213328

SEQ ID NO: 733544 - RNA, 64 nt, Homo Sapiens; identical to SEQ ID NO: 213329

SEQ ID NO: 733545 - RNA, 64 nt, Homo Sapiens; identical to SEQ ID NO: 213330

SEQ ID NO: 733546 - RNA, 64 nt, Homo Sapiens; identical to SEQ ID NO: 213331

SEQ ID NO: 733547 - RNA, 64 nt, Homo Sapiens; identical to SEQ ID NO: 213332

SEQ ID NO: 733548 - RNA, 64 nt, Homo Sapiens; identical to SEQ ID NO: 213333

SEQ ID NO: 733549 - RNA, 64 nt, Homo Sapiens; identical to SEQ ID NO: 213334

SEQ ID NO: 733550 - RNA, 64 nt, Homo Sapiens; identical to SEQ ID NO: 213335

SEQ ID NO: 733551 - RNA, 64 nt, Homo Sapiens; identical to SEQ ID NO: 213336

SEQ ID NO: 733552 - RNA, 64 nt, Homo Sapiens; identical to SEQ ID NO: 213337

SEQ ID NO: 733553 - RNA, 64 nt, Homo Sapiens; identical to SEQ ID NO: 213338

SEQ ID NO: 733554 - RNA, 60 nt, Homo Sapiens
uguuuuguucaaucuggaagaaugacuguaucagucaauggggauuuuaacagacugccu

SEQ ID NO: 733555 - RNA, 60 nt, Homo Sapiens
uuucuguagggaugagaauuccucuuuuaaucagucaagggagaugcuucaaagcuggag

SEQ ID NO: 733556 - RNA, 60 nt, Homo Sapiens
uugagccagccucuggaucgccguuuccccucagucaaacugcuaggaacagccuucccu

SEQ ID NO: 733557 - RNA, 60 nt, Homo Sapiens
auuuaugaggaaaugagaucuaauuuuauuucagucaaacuaaacauucuucagugaaaa

SEQ ID NO: 733558 - RNA, 60 nt, Homo Sapiens
cacaugaauguaaugaauguggaaaagcuuucagucaaaccucaugccuuauucagcauc

SEQ ID NO: 733559 - RNA, 60 nt, Homo Sapiens
uccauugcugcaaugaaugugaaaaagccaucagucaaagaaacuaccuuguuuaguauc

SEQ ID NO: 733560 - RNA, 60 nt, Homo Sapiens
cccguagccuagagcaguguucucugcuccucagucaaccguucccuaaggaacagcauu

SEQ ID NO: 733561 - RNA, 60 nt, Homo Sapiens
aaccacagucuguuaaucauuuuuguggacucagucaagcugugguaggcauuuggcaua

SEQ ID NO: 733562 - RNA, 60 nt, Homo Sapiens
aacccuaaauugaaagacaaaacuaugguuucagucaacauauucaugaauuagggagcu

SEQ ID NO: 733563 - RNA, 60 nt, Homo Sapiens
aggggaugcucuacaucaagggaugcaccuucagucaaacugucaaaaagcccagaauuc

SEQ ID NO: 733564 - RNA, 64 nt, Homo Sapiens
auaugaguuaaauuuaaaaguuucaauuuauugcucaguguaccuguuaacauuauauuuaaca

SEQ ID NO: 733565 - RNA, 64 nt, Homo Sapiens
aauaaaaaaaguugguaaaacaugguuuuauaccucaguguauaagaugugcaagacaaauaug

SEQ ID NO: 733566 - RNA, 64 nt, Homo Sapiens
aaaagaccaaggaugcaguugaauggaaaauuacucaguguauagaaaggaaaaaaaccagaaa

SEQ ID NO: 733567 - RNA, 64 nt, Homo Sapiens
accagccccccaaaaaaccucucaguaguuucuuucaguguacaaaaugaugagcauuuuucua

SEQ ID NO: 733568 - RNA, 64 nt, Homo Sapiens
ugcauuucuaauaaaaauuuugugaaauccuuucucaguguaacuugugcacugauuugaccau

SEQ ID NO: 733569 - RNA, 64 nt, Homo Sapiens
aaacuagguaguauugugcaacaagacauuuuuuucaguguauauucuaaaaugauguagccug

SEQ ID NO: 733570 - RNA, 64 nt, Homo Sapiens
uuggaagagaacgcgcuugauggauagagcgccuucaguguacuguuucuuauuaacuuuacuu

SEQ ID NO: 733571 - RNA, 64 nt, Homo Sapiens
uuauuucaaaaaauccuacaaauauugucagcuuucaguguagugagauuauuccuguagguua

SEQ ID NO: 733572 - RNA, 64 nt, Homo Sapiens
agcugagcucuucugcuaaaguucaaaguucacaucaguguagccagagugaagcaucuuuguu

SEQ ID NO: 733573 - RNA, 64 nt, Homo Sapiens
aucaugaaaagguuuauauucacuauucuuuauuucaguguagcacuuuuagagccaaaaaaac

SEQ ID NO: 733574 - RNA, 64 nt, Homo Sapiens
uuucugcguauauaugaaaacugaaugauauuucucaguguauuuccuugcauuugaaugguuc

SEQ ID NO: 733575 - RNA, 64 nt, Homo Sapiens
ugaaucuuauuauuuaaaucacuucaguuagcuuucaguguauguuuaauaauauacauuuaau

SEQ ID NO: 733576 - RNA, 64 nt, Homo Sapiens
aaauguagaaaauccuuuauagugagaaaccguaucaguguaaagaaaucagagaauucacacu

SEQ ID NO: 733577 - RNA, 64 nt, Homo Sapiens
gaaugugggaagguuuuuaaggagagaaacccuaucaguguaaagacaucagagaauucacaaa

SEQ ID NO: 733578 - RNA, 56 nt, Homo Sapiens
accucuucugcuucaguugaggugacacgucucagccuuagcccugugcccccuga

SEQ ID NO: 733579 - RNA, 64 nt, Homo Sapiens
ucuggagggcuccugagccucugcguaaggcugaacgucucacugacugagcuagucuucuugu

SEQ ID NO: 733580 - RNA, 64 nt, Homo Sapiens
gcuugaauaaaaaccagagaagguuuuucccaggacgucucauguuuggcccuuuagaauuggg

SEQ ID NO: 733581 - RNA, 64 nt, Homo Sapiens
acaaggagcuugccaggcuucauguagccgacacacgucucaggauuuuaaguccacauuggcc

SEQ ID NO: 733582 - RNA, 64 nt, Homo Sapiens
cuucuaccaaaaugcuuuaaguucuauggaaagaacgucucauacugacauaaaugaagaaaau

SEQ ID NO: 733583 - RNA, 64 nt, Homo Sapiens
gcuaagucacuacacuacaucguuauuuucuauuacgucucauucuucccuuucuaaauggaac

SEQ ID NO: 733584 - RNA, 64 nt, Homo Sapiens
ugugcuuauaaagcuuccaauuugauucuagagaacgucucagaaaacaaauauagacaaauau

SEQ ID NO: 733585 - RNA, 64 nt, Homo Sapiens
cucugggugucucaggggccugcccucaucaucaacgucucagcccuucaguuuggucugcucc

SEQ ID NO: 733586 - RNA, 64 nt, Homo Sapiens
cuacaagcacuugaaaaugauauuuuuauuuuuaacgucucaacaaucugauaucggaugucgu

SEQ ID NO: 733587 - RNA, 64 nt, Homo Sapiens
ucccaugugugaugcugacaaaggcugugcagggacgucucaucugcucucaggaagcccaggg

SEQ ID NO: 733588 - RNA, 64 nt, Homo Sapiens
uguguauguaaaaaaaaugaguuauuuugcuuuuacgucucaacaaaguuuucuccucuuaaau

SEQ ID NO: 733589 - RNA, 64 nt, Homo Sapiens
cagggugacaucaggaauggggauucugaggaccacgucucaccaaagacaaaaaaggaaaucu

SEQ ID NO: 733590 - RNA, 64 nt, Homo Sapiens
acacacaucucaugcuguacaccugaggcugcucacgucucacgcccaguguuggugcacauuu

SEQ ID NO: 733591 - RNA, 64 nt, Homo Sapiens
gcuuuauuugcuuaaauaccuucauuuguauaguacgucucacuugaaauugcuuuguauacau

SEQ ID NO: 733592 - RNA, 64 nt, Homo Sapiens
cuucaauacuuuaaaauggcaggaaaaaagaaauacgucucauuuucuaauaauuuucaucaau

SEQ ID NO: 733593 - RNA, 64 nt, Homo Sapiens
gcuguagauaucagcccaguccagagcugguggaacgucucauuaguucgguucucucccacag

SEQ ID NO: 733594 - RNA, 64 nt, Homo Sapiens
uucuaugguguagaaucuuucuuucugauaaggaacgucucaggcuuagaaauauaugaaauug

SEQ ID NO: 733595 - RNA, 64 nt, Homo Sapiens
cauauuuugaguucuuaaauacuaccaacccugaacgucucaggacaaauaauucaaaaaagag

SEQ ID NO: 733596 - RNA, 64 nt, Homo Sapiens
aacagggagaggccacggggcccaaaaacgcaacacgucucaaggcaaacccgagggaggaacu

SEQ ID NO: 733597 - RNA, 64 nt, Homo Sapiens
cuucccuuucuaaauggaacguuuauuuucuauuacgucucauucuaagucacuacacuacauc

SEQ ID NO: 733598 - RNA, 64 nt, Homo Sapiens
uuuagacuuguucccccucuaauaguguggaagcacgucucaaacacuuuaaaguuugagaaag

SEQ ID NO: 733599 - RNA, 64 nt, Homo Sapiens
auuuuaaaccuccaaaaugaucaccuuugacuccacgucucacaaucaucucucucaaguucga

SEQ ID NO: 733600 - RNA, 64 nt, Homo Sapiens
acugaaacggccccauugcccaaacggaguacagacgucucaagaaugcuuguugaaucagggg

SEQ ID NO: 733601 - RNA, 64 nt, Homo Sapiens
caaagacauuuguugggaguucccacauugcuagacgucucacugagauuuuuuagaucuuccu

SEQ ID NO: 733602 - RNA, 64 nt, Homo Sapiens
acugugguugauucaaaagacugaaaagaaaaacacgucucaccuguaugccaucauggggcac

SEQ ID NO: 733603 - RNA, 64 nt, Homo Sapiens
uggguccauuuuucugacugugaaguaaggagagacgucucaguacccagggccucuucagcuc

SEQ ID NO: 733604 - RNA, 64 nt, Homo Sapiens
cuggacgggauguuuccaagcucuuguuccccuaacgucucaacaggcgcucacugaaguguau

SEQ ID NO: 733605 - RNA, 64 nt, Homo Sapiens
uuuuugccaugcagaaucaauuggauagacuugcacgucucaggcccaagguuguuuuagagga

SEQ ID NO: 733606 - RNA, 64 nt, Homo Sapiens
agccugucaccgauggcugacugaugaaauggacacgucucaucugacccacucuuccuuccac

SEQ ID NO: 733607 - RNA, 64 nt, Homo Sapiens
uacucaagcagaucucaucucaugacaggcagccacgucucaacauggguaaggggugggggug

SEQ ID NO: 733608 - RNA, 64 nt, Homo Sapiens
ggcugcuuauucacucuggggauucgccauggacacgucucaacugcgcaagcugcugcccaug

SEQ ID NO: 733609 - RNA, 64 nt, Homo Sapiens
uagcacuuacuuaaucuuuucaguuuuccaguuuacgucucaggaaugaaguguagucuauggu

SEQ ID NO: 733610 - RNA, 64 nt, Homo Sapiens
uggagucuuaggcaucucugguacaguggggugcacgucucagguggaggaagauuuacggcuc

SEQ ID NO: 733611 - RNA, 64 nt, Homo Sapiens
aggcagacagucugccuaggcacuggcuccuuccacgucucacccguccugagacggcugcgga

SEQ ID NO: 733612 - RNA, 64 nt, Homo Sapiens
gauuuuauuuagcaagcccagaccuuccggucuaacgucucacaccacgacggacuccccuucc

SEQ ID NO: 733613 - RNA, 64 nt, Homo Sapiens
uuauucguuacucuaagguaaacagaaagcauagacgucucagggauuucuaggccugauaucc

SEQ ID NO: 733614 - RNA, 64 nt, Homo Sapiens
cucagagccggcuggcccggcccagggcacuagaacgucucacacaugccucaggcuucugcag

SEQ ID NO: 733615 - RNA, 64 nt, Homo Sapiens
accaggggccuucacgucugcccuuugugaacggacgucucagggcugcugugccccuugggug

SEQ ID NO: 733616 - RNA, 64 nt, Homo Sapiens
ucuuguuuauucugggcucagacccuccucuuguacgucucaucacagcugguagagacccagg

SEQ ID NO: 733617 - RNA, 64 nt, Homo Sapiens
caaaugcuguuucccaacaccccaaagucugcacacgucucaugaaugcaucacauuucuguca

SEQ ID NO: 733618 - RNA, 64 nt, Homo Sapiens
ugacuuugguccacacugaguaaaagugaaggaaacgucucaagcaaggauuacauucuagagc

SEQ ID NO: 733619 - RNA, 64 nt, Homo Sapiens
ugcacgccccggccagcuaaugagcugugaguccacgucucaugccugacggacauggacgccc

SEQ ID NO: 733620 - RNA, 64 nt, Homo Sapiens
uuuauucuuuggguccuuccaucccacugggaaaacgucucagguggccucugaaacaccacuc

SEQ ID NO: 733621 - RNA, 64 nt, Homo Sapiens
gagugcaucacccucugggaaccuccguguguucacgucucaugaagcucuccaaauccagucc

SEQ ID NO: 733622 - RNA, 64 nt, Homo Sapiens
aaaaaaaucaauuuaaaggggagaaaacuucagcacgucucaacagaagaccaccaaauggcca

SEQ ID NO: 733623 - RNA, 64 nt, Homo Sapiens
cuggaucugcuuguugcauuuccagcugugcagcacgucucagagauucuugaagaaugaagac

SEQ ID NO: 733624 - RNA, 64 nt, Homo Sapiens
gccccuguguaagccagacccagcuaugccugccacgucucaugauucaugaccaguagcagcc

SEQ ID NO: 733625 - RNA, 64 nt, Homo Sapiens
ggcgcauggcggcgcaccugcugcaggagcggccacgucucagcuucauuauaccauggccugc

SEQ ID NO: 733626 - RNA, 64 nt, Homo Sapiens
gccccgggaguggccuuggcucccuggagagcccacgucucagccacaguucuccacucgccuc

SEQ ID NO: 733627 - RNA, 64 nt, Homo Sapiens; identical to SEQ ID NO: 145321

SEQ ID NO: 733628 - RNA, 64 nt, Homo Sapiens; identical to SEQ ID NO: 145322

SEQ ID NO: 733629 - RNA, 64 nt, Homo Sapiens; identical to SEQ ID NO: 145323

SEQ ID NO: 733630 - RNA, 64 nt, Homo Sapiens; identical to SEQ ID NO: 145324

SEQ ID NO: 733631 - RNA, 64 nt, Homo Sapiens; identical to SEQ ID NO: 145325

SEQ ID NO: 733632 - RNA, 64 nt, Homo Sapiens; identical to SEQ ID NO: 145326

SEQ ID NO: 733633 - RNA, 64 nt, Homo Sapiens; identical to SEQ ID NO: 145327

SEQ ID NO: 733634 - RNA, 64 nt, Homo Sapiens; identical to SEQ ID NO: 145328

SEQ ID NO: 733635 - RNA, 64 nt, Homo Sapiens; identical to SEQ ID NO: 145329

SEQ ID NO: 733636 - RNA, 64 nt, Homo Sapiens; identical to SEQ ID NO: 145330

SEQ ID NO: 733637 - RNA, 62 nt, Homo Sapiens; identical to SEQ ID NO: 145331

SEQ ID NO: 733638 - RNA, 64 nt, Homo Sapiens; identical to SEQ ID NO: 145332

SEQ ID NO: 733639 - RNA, 64 nt, Homo Sapiens; identical to SEQ ID NO: 145333

SEQ ID NO: 733640 - RNA, 64 nt, Homo Sapiens; identical to SEQ ID NO: 145334

SEQ ID NO: 733641 - RNA, 64 nt, Homo Sapiens; identical to SEQ ID NO: 145335

SEQ ID NO: 733642 - RNA, 64 nt, Homo Sapiens; identical to SEQ ID NO: 145336

SEQ ID NO: 733643 - RNA, 64 nt, Homo Sapiens; identical to SEQ ID NO: 145337

SEQ ID NO: 733644 - RNA, 64 nt, Homo Sapiens; identical to SEQ ID NO: 145338

SEQ ID NO: 733645 - RNA, 64 nt, Homo Sapiens; identical to SEQ ID NO: 145339

SEQ ID NO: 733646 - RNA, 64 nt, Homo Sapiens; identical to SEQ ID NO: 145340

SEQ ID NO: 733647 - RNA, 64 nt, Homo Sapiens; identical to SEQ ID NO: 145341

SEQ ID NO: 733648 - RNA, 64 nt, Homo Sapiens; identical to SEQ ID NO: 145342

SEQ ID NO: 733649 - RNA, 64 nt, Homo Sapiens; identical to SEQ ID NO: 145343

SEQ ID NO: 733650 - RNA, 64 nt, Homo Sapiens; identical to SEQ ID NO: 145344

SEQ ID NO: 733651 - RNA, 64 nt, Homo Sapiens; identical to SEQ ID NO: 145345

SEQ ID NO: 733652 - RNA, 64 nt, Homo Sapiens; identical to SEQ ID NO: 145346

SEQ ID NO: 733653 - RNA, 64 nt, Homo Sapiens; identical to SEQ ID NO: 145347

SEQ ID NO: 733654 - RNA, 64 nt, Homo Sapiens; identical to SEQ ID NO: 145348

SEQ ID NO: 733655 - RNA, 64 nt, Homo Sapiens; identical to SEQ ID NO: 145349

SEQ ID NO: 733656 - RNA, 64 nt, Homo Sapiens; identical to SEQ ID NO: 145350

SEQ ID NO: 733657 - RNA, 64 nt, Homo Sapiens; identical to SEQ ID NO: 145351

SEQ ID NO: 733658 - RNA, 64 nt, Homo Sapiens; identical to SEQ ID NO: 145352

SEQ ID NO: 733659 - RNA, 64 nt, Homo Sapiens; identical to SEQ ID NO: 145353

SEQ ID NO: 733660 - RNA, 64 nt, Homo Sapiens; identical to SEQ ID NO: 145354

SEQ ID NO: 733661 - RNA, 64 nt, Homo Sapiens; identical to SEQ ID NO: 145355

SEQ ID NO: 733662 - RNA, 64 nt, Homo Sapiens; identical to SEQ ID NO: 145356

SEQ ID NO: 733663 - RNA, 64 nt, Homo Sapiens; identical to SEQ ID NO: 145357

SEQ ID NO: 733664 - RNA, 64 nt, Homo Sapiens; identical to SEQ ID NO: 145358

SEQ ID NO: 733665 - RNA, 64 nt, Homo Sapiens
auguaccauguuuuauaaaccaaguaucuaacucauuuccaaacaucaguguguuuagacuuuu

SEQ ID NO: 733666 - RNA, 64 nt, Homo Sapiens
uugaaauauaggugugaacagcuugcaaauaugcauuuccaaacaugaauacuuuuguauugcu

SEQ ID NO: 733667 - RNA, 64 nt, Homo Sapiens
guugaagagaucuucucuggucagacuuggaagaauuuccaaaacugaaguuagccccaagacu

SEQ ID NO: 733668 - RNA, 64 nt, Homo Sapiens
ugcaacacuguucucuucuucucuacuaaauucuauuuccaaaauugguaauagagccagaagg

SEQ ID NO: 733669 - RNA, 64 nt, Homo Sapiens
ucauaaugcuuaaagccauauggaguuggaaauuauuuccaaagcauauuuauuccauuguuuu

SEQ ID NO: 733670 - RNA, 64 nt, Homo Sapiens
auuuauuuuccuccauucauguacuuuuccuuauauuuccaaaacuguuacugagaauggguca

SEQ ID NO: 733671 - RNA, 64 nt, Homo Sapiens
uuuuaugcuuugcuucccuuuagucaggcugcaaauuuccaaacgguuuuucuuuucuauugca

SEQ ID NO: 733672 - RNA, 64 nt, Homo Sapiens
acugcugcagcauuuugguaaugcaaaauaacucauuuccaacuugugauugaacacuuuagua

SEQ ID NO: 733673 - RNA, 64 nt, Homo Sapiens
cgcugucagcaauuuuuuccucccauuguugcugauuuccaaauucaugugacauauuucccuu

SEQ ID NO: 733674 - RNA, 64 nt, Homo Sapiens
agcucauuuuauucuaggucccccaccagggcaaauuuccaaauugacaugcugggaaucuuca

SEQ ID NO: 733675 - RNA, 64 nt, Homo Sapiens
aucucacucaggaagggagguccaaagccaccucauuuccaaaccuguuacagacaagcuuauu

SEQ ID NO: 733676 - RNA, 64 nt, Homo Sapiens
ccaccucauuuccaaacaucuuacagacaagcuuauuuccaaagagucuuuguggaaaccacug

SEQ ID NO: 733677 - RNA, 64 nt, Homo Sapiens
gugagauauauucaguauuguagauacuacacuaauuuccaacauaagaggcaggaagaguuuu

SEQ ID NO: 733678 - RNA, 64 nt, Homo Sapiens
uccucugugucccggcauggaagccaguauaagcauuuccaaaugagggaaaaguccuuggcuc

SEQ ID NO: 733679 - RNA, 64 nt, Homo Sapiens
gggaucccagcccacaagugaucagcagaguugcauuuccaaagaaaaaggcuaugagaugagc

SEQ ID NO: 733680 - RNA, 64 nt, Homo Sapiens
uuuuuaacaaaaugaaaugauguguuaaguuuuuauuuccaaaguguuuaguuuauuggcugau

SEQ ID NO: 733681 - RNA, 64 nt, Homo Sapiens
acaaagugagcauuucuuuuuaaauuuucuugacauuuccaagcuuauuaugaauaauauugca

SEQ ID NO: 733682 - RNA, 64 nt, Homo Sapiens
uauaacuugugguuucugaacucauuauuguuguauuuccaaaaaaguaauaccuuuuaauuag

SEQ ID NO: 733683 - RNA, 64 nt, Homo Sapiens
uauuguucagaagauuuuuacaaauuaaaaacugauuuccaaauauguucaacauuuacuucua

SEQ ID NO: 733684 - RNA, 64 nt, Homo Sapiens
ugguaugcauuggauauagcaggaaagaaagcacauuuccaaacagcagggaguaagcuuacau

SEQ ID NO: 733685 - RNA, 64 nt, Homo Sapiens
uuaacuaaaaccccuaggucauuuguagauauauauuuccaaauauucuaaaaaagauacugua

SEQ ID NO: 733686 - RNA, 64 nt, Homo Sapiens
ggugugaaguccacuuauguagacaaaacuuauaauuuccaaacuguugucuaguauacaguga

SEQ ID NO: 733687 - RNA, 64 nt, Homo Sapiens
ugguauuuuaaauagacacuuauuuccuuaguuuauuuccaaacauaucacauaguacauauau

SEQ ID NO: 733688 - RNA, 64 nt, Homo Sapiens
aaugcauuuucuuagcaucaccccuauuuuacuuauuuccaagacuuggaagggcaaaaaucau

SEQ ID NO: 733689 - RNA, 64 nt, Homo Sapiens
uuucaagcgggaaacaugaccuggauucaaauuuauuuccaaugaaggaaaccuuuucuuguau

SEQ ID NO: 733690 - RNA, 64 nt, Homo Sapiens
cucucuggcacuuugaguuacuacacuugagaugauuuccaagcagaugcuguagacaucuguc

SEQ ID NO: 733691 - RNA, 64 nt, Homo Sapiens
uagaccagaucuaauccgaagauuaaucuuuaggauuuccaauuuccaagccugaugggaucuc

SEQ ID NO: 733692 - RNA, 64 nt, Homo Sapiens
gaucuaauccgaagauuaaucuuuaggauuuccaauuuccaagccugaugggaucucccagcug

SEQ ID NO: 733693 - RNA, 64 nt, Homo Sapiens
acaacaugucacaauuuagugaggagcuacauguauuuccaagaauuccagcauagauuauaau

SEQ ID NO: 733694 - RNA, 64 nt, Homo Sapiens
uucuagucuagaggucuguugguugaaggcagacauuuccaaguuuguugaaauaauacgaagc

SEQ ID NO: 733695 - RNA, 64 nt, Homo Sapiens
uccuaccugcgcagucuaaacauagcuguggaucauuuccaacuuucaacuucacuccgggcca

SEQ ID NO: 733696 - RNA, 64 nt, Homo Sapiens
gcgaggcugguuuccugugcagcagguggaguucauuuccaacccagagguccgugcacagaac

SEQ ID NO: 733697 - RNA, 64 nt, Homo Sapiens
acaacuugauaucauucagcauuaucauaauugaauuuccaagaauuaguagucacuuguuuuc

SEQ ID NO: 733698 - RNA, 64 nt, Homo Sapiens
auuuguggguccgacaguaauuaauuuaaaaaaaauuuccaaaugcaauuaagugggaacauuu

SEQ ID NO: 733699 - RNA, 64 nt, Homo Sapiens
gcugaacuugggcagaaaaccuuaaaguggcuugauuuccaauacacaaaagucaguauuuuau

SEQ ID NO: 733700 - RNA, 64 nt, Homo Sapiens
ggaaaauaacuauauaauguuggguagcagaucaauuuccaacucacaucccagcagccgguuc

SEQ ID NO: 733701 - RNA, 64 nt, Homo Sapiens
aucaugauuuccauuuuaauuccaauuaaguuguauuuccaaaugaugagauuacuuaaugauu

SEQ ID NO: 733702 - RNA, 64 nt, Homo Sapiens
aaguuguauuuccaaauaucgagauuacuuaaugauuuccaauucccacuguaaaaagguugau

SEQ ID NO: 733703 - RNA, 64 nt, Homo Sapiens
caucagacuaaaaucuaagagauaauaucaauuuauuuccaaucccccaagcuauccuguuuca

SEQ ID NO: 733704 - RNA, 64 nt, Homo Sapiens
cuccaaagauggucacuguauguguaaugaggcuauuuccaaguuaguguauaacaucaaguuc

SEQ ID NO: 733705 - RNA, 64 nt, Homo Sapiens
aucuuaguaaacccaauuuccagucuuagucuguauuuccaauauuucuaauuccugagccacg

SEQ ID NO: 733706 - RNA, 64 nt, Homo Sapiens
gcuuaccuguuaugugacagugauuuaccuguccauuuccaacccaaaagccugucagaaagca

SEQ ID NO: 733707 - RNA, 64 nt, Homo Sapiens
gcaugagggcuaucaggccaaaauucauuauuguauuuccaauacaguuugucuugaaugucug

SEQ ID NO: 733708 - RNA, 64 nt, Homo Sapiens
uuacuauuauguggaauuuaacuuuucagagaaaauuuccaaaguccucuaccuuauuuggcuu

SEQ ID NO: 733709 - RNA, 64 nt, Homo Sapiens
ccagaacacauggagggaaugcucuaauuaguucauuuccaaucuaaguuuauuuccaacauua

SEQ ID NO: 733710 - RNA, 64 nt, Homo Sapiens
uuagcucuaauuaguucauucaauaaguaaguuuauuuccaacacccaaaucaugcagccuauc

SEQ ID NO: 733711 - RNA, 64 nt, Homo Sapiens
gggucagcugccugguguuugugguaaauaaaaaauuuccaacauuuggagcaaaaaccuugca

SEQ ID NO: 733712 - RNA, 64 nt, Homo Sapiens
uacuaucaaauuauaguaaccuuguaccagaaacauuuccaauuuagucuuugcaucagcuuac

SEQ ID NO: 733713 - RNA, 64 nt, Homo Sapiens
ugguacuaccuggugaguuuauaaaagcaaucugauuuccaacgauuaacuaucaaauaaauaa

SEQ ID NO: 733714 - RNA, 64 nt, Homo Sapiens
accugagggggagaaaauacuauguguuuggucuauuuccaaaaaggaaggugguuuugagaac

SEQ ID NO: 733715 - RNA, 64 nt, Homo Sapiens
cuugcauggccagucacuuagaaaaauaaguaaaauuuccaaccuuaacauaacuucuaccaag

SEQ ID NO: 733716 - RNA, 64 nt, Homo Sapiens
gcuaaugauguugaguaucuugguuuuaauuugcauuuccaaugguguguaaugauaccacaug

SEQ ID NO: 733717 - RNA, 64 nt, Homo Sapiens; identical to SEQ ID NO: 111411

SEQ ID NO: 733718 - RNA, 64 nt, Homo Sapiens; identical to SEQ ID NO: 111412

SEQ ID NO: 733719 - RNA, 64 nt, Homo Sapiens; identical to SEQ ID NO: 111413

SEQ ID NO: 733720 - RNA, 64 nt, Homo Sapiens; identical to SEQ ID NO: 111414

SEQ ID NO: 733721 - RNA, 64 nt, Homo Sapiens; identical to SEQ ID NO: 111415

SEQ ID NO: 733722 - RNA, 64 nt, Homo Sapiens; identical to SEQ ID NO: 111416

SEQ ID NO: 733723 - RNA, 64 nt, Homo Sapiens; identical to SEQ ID NO: 111417

SEQ ID NO: 733724 - RNA, 64 nt, Homo Sapiens; identical to SEQ ID NO: 111418

SEQ ID NO: 733725 - RNA, 64 nt, Homo Sapiens; identical to SEQ ID NO: 111419

SEQ ID NO: 733726 - RNA, 64 nt, Homo Sapiens; identical to SEQ ID NO: 111420

SEQ ID NO: 733727 - RNA, 64 nt, Homo Sapiens; identical to SEQ ID NO: 111421

SEQ ID NO: 733728 - RNA, 64 nt, Homo Sapiens; identical to SEQ ID NO: 111422

SEQ ID NO: 733729 - RNA, 64 nt, Homo Sapiens; identical to SEQ ID NO: 111423

SEQ ID NO: 733730 - RNA, 64 nt, Homo Sapiens; identical to SEQ ID NO: 111424

SEQ ID NO: 733731 - RNA, 64 nt, Homo Sapiens; identical to SEQ ID NO: 111425

SEQ ID NO: 733732 - RNA, 64 nt, Homo Sapiens; identical to SEQ ID NO: 111426

SEQ ID NO: 733733 - RNA, 64 nt, Homo Sapiens; identical to SEQ ID NO: 111427

SEQ ID NO: 733734 - RNA, 64 nt, Homo Sapiens; identical to SEQ ID NO: 111428

SEQ ID NO: 733735 - RNA, 64 nt, Homo Sapiens; identical to SEQ ID NO: 111429

SEQ ID NO: 733736 - RNA, 64 nt, Homo Sapiens; identical to SEQ ID NO: 111430

SEQ ID NO: 733737 - RNA, 64 nt, Homo Sapiens; identical to SEQ ID NO: 111431

SEQ ID NO: 733738 - RNA, 64 nt, Homo Sapiens; identical to SEQ ID NO: 111432

SEQ ID NO: 733739 - RNA, 64 nt, Homo Sapiens; identical to SEQ ID NO: 111433

SEQ ID NO: 733740 - RNA, 64 nt, Homo Sapiens; identical to SEQ ID NO: 111434

SEQ ID NO: 733741 - RNA, 58 nt, Homo Sapiens; identical to SEQ ID NO: 111435

SEQ ID NO: 733742 - RNA, 64 nt, Homo Sapiens; identical to SEQ ID NO: 111436

SEQ ID NO: 733743 - RNA, 64 nt, Homo Sapiens; identical to SEQ ID NO: 111437

SEQ ID NO: 733744 - RNA, 64 nt, Homo Sapiens; identical to SEQ ID NO: 111438

SEQ ID NO: 733745 - RNA, 64 nt, Homo Sapiens; identical to SEQ ID NO: 111439

SEQ ID NO: 733746 - RNA, 64 nt, Homo Sapiens; identical to SEQ ID NO: 111440

SEQ ID NO: 733747 - RNA, 64 nt, Homo Sapiens; identical to SEQ ID NO: 111441

SEQ ID NO: 733748 - RNA, 64 nt, Homo Sapiens; identical to SEQ ID NO: 111442

SEQ ID NO: 733749 - RNA, 64 nt, Homo Sapiens; identical to SEQ ID NO: 111443

SEQ ID NO: 733750 - RNA, 64 nt, Homo Sapiens; identical to SEQ ID NO: 111444

SEQ ID NO: 733751 - RNA, 64 nt, Homo Sapiens; identical to SEQ ID NO: 111445

SEQ ID NO: 733752 - RNA, 64 nt, Homo Sapiens; identical to SEQ ID NO: 111446

SEQ ID NO: 733753 - RNA, 64 nt, Homo Sapiens; identical to SEQ ID NO: 111447

SEQ ID NO: 733754 - RNA, 64 nt, Homo Sapiens; identical to SEQ ID NO: 111448

SEQ ID NO: 733755 - RNA, 64 nt, Homo Sapiens; identical to SEQ ID NO: 111449

SEQ ID NO: 733756 - RNA, 64 nt, Homo Sapiens; identical to SEQ ID NO: 111450

SEQ ID NO: 733757 - RNA, 64 nt, Homo Sapiens; identical to SEQ ID NO: 111451

SEQ ID NO: 733758 - RNA, 64 nt, Homo Sapiens; identical to SEQ ID NO: 111452

SEQ ID NO: 733759 - RNA, 64 nt, Homo Sapiens; identical to SEQ ID NO: 111453

SEQ ID NO: 733760 - RNA, 64 nt, Homo Sapiens; identical to SEQ ID NO: 111454

SEQ ID NO: 733761 - RNA, 64 nt, Homo Sapiens; identical to SEQ ID NO: 111455

SEQ ID NO: 733762 - RNA, 64 nt, Homo Sapiens; identical to SEQ ID NO: 111456

SEQ ID NO: 733763 - RNA, 64 nt, Homo Sapiens; identical to SEQ ID NO: 111457

SEQ ID NO: 733764 - RNA, 64 nt, Homo Sapiens; identical to SEQ ID NO: 111458

SEQ ID NO: 733765 - RNA, 64 nt, Homo Sapiens; identical to SEQ ID NO: 111459

SEQ ID NO: 733766 - RNA, 52 nt, Homo Sapiens; identical to SEQ ID NO: 111460

SEQ ID NO: 733767 - RNA, 64 nt, Homo Sapiens; identical to SEQ ID NO: 111461

SEQ ID NO: 733768 - RNA, 64 nt, Homo Sapiens; identical to SEQ ID NO: 111462

SEQ ID NO: 733769 - RNA, 64 nt, Homo Sapiens; identical to SEQ ID NO: 111463

SEQ ID NO: 733770 - RNA, 64 nt, Homo Sapiens; identical to SEQ ID NO: 111464

SEQ ID NO: 733771 - RNA, 64 nt, Homo Sapiens; identical to SEQ ID NO: 111465

SEQ ID NO: 733772 - RNA, 64 nt, Homo Sapiens; identical to SEQ ID NO: 111466

SEQ ID NO: 733773 - RNA, 64 nt, Homo Sapiens; identical to SEQ ID NO: 111467

SEQ ID NO: 733774 - RNA, 64 nt, Homo Sapiens; identical to SEQ ID NO: 390817

SEQ ID NO: 733775 - RNA, 64 nt, Homo Sapiens; identical to SEQ ID NO: 390818

SEQ ID NO: 733776 - RNA, 64 nt, Homo Sapiens; identical to SEQ ID NO: 215540

SEQ ID NO: 733777 - RNA, 64 nt, Homo Sapiens; identical to SEQ ID NO: 215541

SEQ ID NO: 733778 - RNA, 64 nt, Homo Sapiens; identical to SEQ ID NO: 215542

SEQ ID NO: 733779 - RNA, 64 nt, Homo Sapiens; identical to SEQ ID NO: 215543

SEQ ID NO: 733780 - RNA, 64 nt, Homo Sapiens; identical to SEQ ID NO: 215544

SEQ ID NO: 733781 - RNA, 64 nt, Homo Sapiens; identical to SEQ ID NO: 215545

SEQ ID NO: 733782 - RNA, 64 nt, Homo Sapiens; identical to SEQ ID NO: 215546

SEQ ID NO: 733783 - RNA, 64 nt, Homo Sapiens; identical to SEQ ID NO: 215547

SEQ ID NO: 733784 - RNA, 64 nt, Homo Sapiens; identical to SEQ ID NO: 215548

SEQ ID NO: 733785 - RNA, 64 nt, Homo Sapiens; identical to SEQ ID NO: 215549

SEQ ID NO: 733786 - RNA, 64 nt, Homo Sapiens; identical to SEQ ID NO: 215550

SEQ ID NO: 733787 - RNA, 64 nt, Homo Sapiens; identical to SEQ ID NO: 215551

SEQ ID NO: 733788 - RNA, 64 nt, Homo Sapiens; identical to SEQ ID NO: 215552

SEQ ID NO: 733789 - RNA, 64 nt, Homo Sapiens; identical to SEQ ID NO: 215553

SEQ ID NO: 733790 - RNA, 64 nt, Homo Sapiens; identical to SEQ ID NO: 215554

SEQ ID NO: 733791 - RNA, 64 nt, Homo Sapiens; identical to SEQ ID NO: 215555

SEQ ID NO: 733792 - RNA, 64 nt, Homo Sapiens; identical to SEQ ID NO: 215556

SEQ ID NO: 733793 - RNA, 64 nt, Homo Sapiens; identical to SEQ ID NO: 215557

SEQ ID NO: 733794 - RNA, 64 nt, Homo Sapiens; identical to SEQ ID NO: 215558

SEQ ID NO: 733795 - RNA, 64 nt, Homo Sapiens; identical to SEQ ID NO: 215559

SEQ ID NO: 733796 - RNA, 64 nt, Homo Sapiens; identical to SEQ ID NO: 215560

SEQ ID NO: 733797 - RNA, 64 nt, Homo Sapiens; identical to SEQ ID NO: 215561

SEQ ID NO: 733798 - RNA, 64 nt, Homo Sapiens; identical to SEQ ID NO: 215562

SEQ ID NO: 733799 - RNA, 64 nt, Homo Sapiens; identical to SEQ ID NO: 215563

SEQ ID NO: 733800 - RNA, 64 nt, Homo Sapiens; identical to SEQ ID NO: 215564

SEQ ID NO: 733801 - RNA, 64 nt, Homo Sapiens; identical to SEQ ID NO: 215565

SEQ ID NO: 733802 - RNA, 64 nt, Homo Sapiens; identical to SEQ ID NO: 215566

SEQ ID NO: 733803 - RNA, 64 nt, Homo Sapiens; identical to SEQ ID NO: 215567

SEQ ID NO: 733804 - RNA, 64 nt, Homo Sapiens; identical to SEQ ID NO: 215568

SEQ ID NO: 733805 - RNA, 64 nt, Homo Sapiens
caccagcacuuuaaacucuuuguguggguaugcguggguguauguuugggaagaaaaacaaagg

SEQ ID NO: 733806 - RNA, 64 nt, Homo Sapiens
accuguucucuagcugugaucuuaccacuucaaauggguguaauuugaauaaauuuuguauggu

SEQ ID NO: 733807 - RNA, 64 nt, Homo Sapiens
gcaugggcugcauuaucuacgacucuaguguucuuggguguauucauauuguacuuggguguag

SEQ ID NO: 733808 - RNA, 64 nt, Homo Sapiens
acucuaguguucuuggguguuaucauauuguacuuggguguaggccacuugcagagggcugcuu

SEQ ID NO: 733809 - RNA, 64 nt, Homo Sapiens
gaauaccugagaagacacacuuggagaaaccuuuuggguguaaugaaugugggaaaaccuuuca

SEQ ID NO: 733810 - RNA, 64 nt, Homo Sapiens
uucaccacagaacucauauaagacagaaacccuauggguguaaugaauguggaaaaucauucug

SEQ ID NO: 733811 - RNA, 64 nt, Homo Sapiens; identical to SEQ ID NO: 585216

SEQ ID NO: 733812 - RNA, 64 nt, Homo Sapiens; identical to SEQ ID NO: 585217

SEQ ID NO: 733813 - RNA, 64 nt, Homo Sapiens; identical to SEQ ID NO: 585218

SEQ ID NO: 733814 - RNA, 64 nt, Homo Sapiens; identical to SEQ ID NO: 585219

SEQ ID NO: 733815 - RNA, 64 nt, Homo Sapiens; identical to SEQ ID NO: 585220

SEQ ID NO: 733816 - RNA, 64 nt, Homo Sapiens; identical to SEQ ID NO: 585221

SEQ ID NO: 733817 - RNA, 64 nt, Homo Sapiens; identical to SEQ ID NO: 585222

SEQ ID NO: 733818 - RNA, 64 nt, Homo Sapiens; identical to SEQ ID NO: 585223

SEQ ID NO: 733819 - RNA, 64 nt, Homo Sapiens; identical to SEQ ID NO: 585224

SEQ ID NO: 733820 - RNA, 64 nt, Homo Sapiens; identical to SEQ ID NO: 585225

SEQ ID NO: 733821 - RNA, 64 nt, Homo Sapiens; identical to SEQ ID NO: 585226

SEQ ID NO: 733822 - RNA, 64 nt, Homo Sapiens; identical to SEQ ID NO: 585227

SEQ ID NO: 733823 - RNA, 64 nt, Homo Sapiens; identical to SEQ ID NO: 585228

SEQ ID NO: 733824 - RNA, 64 nt, Homo Sapiens; identical to SEQ ID NO: 585229

SEQ ID NO: 733825 - RNA, 64 nt, Homo Sapiens; identical to SEQ ID NO: 585230

SEQ ID NO: 733826 - RNA, 64 nt, Homo Sapiens; identical to SEQ ID NO: 585231

SEQ ID NO: 733827 - RNA, 64 nt, Homo Sapiens; identical to SEQ ID NO: 585232

SEQ ID NO: 733828 - RNA, 64 nt, Homo Sapiens; identical to SEQ ID NO: 585233

SEQ ID NO: 733829 - RNA, 64 nt, Homo Sapiens; identical to SEQ ID NO: 585234

SEQ ID NO: 733830 - RNA, 64 nt, Homo Sapiens; identical to SEQ ID NO: 585235

SEQ ID NO: 733831 - RNA, 64 nt, Homo Sapiens; identical to SEQ ID NO: 585236

SEQ ID NO: 733832 - RNA, 64 nt, Homo Sapiens; identical to SEQ ID NO: 585237

SEQ ID NO: 733833 - RNA, 64 nt, Homo Sapiens; identical to SEQ ID NO: 585238

SEQ ID NO: 733834 - RNA, 64 nt, Homo Sapiens; identical to SEQ ID NO: 585239

SEQ ID NO: 733835 - RNA, 64 nt, Homo Sapiens; identical to SEQ ID NO: 585240

SEQ ID NO: 733836 - RNA, 64 nt, Homo Sapiens; identical to SEQ ID NO: 585241

SEQ ID NO: 733837 - RNA, 64 nt, Homo Sapiens; identical to SEQ ID NO: 585242

SEQ ID NO: 733838 - RNA, 64 nt, Homo Sapiens; identical to SEQ ID NO: 585243

SEQ ID NO: 733839 - RNA, 64 nt, Homo Sapiens; identical to SEQ ID NO: 585244

SEQ ID NO: 733840 - RNA, 64 nt, Homo Sapiens; identical to SEQ ID NO: 585245

SEQ ID NO: 733841 - RNA, 64 nt, Homo Sapiens; identical to SEQ ID NO: 585246

SEQ ID NO: 733842 - RNA, 64 nt, Homo Sapiens; identical to SEQ ID NO: 585247

SEQ ID NO: 733843 - RNA, 64 nt, Homo Sapiens; identical to SEQ ID NO: 585248

SEQ ID NO: 733844 - RNA, 64 nt, Homo Sapiens; identical to SEQ ID NO: 585249

SEQ ID NO: 733845 - RNA, 64 nt, Homo Sapiens; identical to SEQ ID NO: 585250

SEQ ID NO: 733846 - RNA, 64 nt, Homo Sapiens; identical to SEQ ID NO: 585251

SEQ ID NO: 733847 - RNA, 64 nt, Homo Sapiens; identical to SEQ ID NO: 585252

SEQ ID NO: 733848 - RNA, 64 nt, Homo Sapiens; identical to SEQ ID NO: 585253

SEQ ID NO: 733849 - RNA, 64 nt, Homo Sapiens; identical to SEQ ID NO: 585254

SEQ ID NO: 733850 - RNA, 64 nt, Homo Sapiens; identical to SEQ ID NO: 585255

SEQ ID NO: 733851 - RNA, 64 nt, Homo Sapiens; identical to SEQ ID NO: 585256

SEQ ID NO: 733852 - RNA, 64 nt, Homo Sapiens; identical to SEQ ID NO: 585257

SEQ ID NO: 733853 - RNA, 64 nt, Homo Sapiens; identical to SEQ ID NO: 585258

SEQ ID NO: 733854 - RNA, 64 nt, Homo Sapiens; identical to SEQ ID NO: 585259

SEQ ID NO: 733855 - RNA, 64 nt, Homo Sapiens; identical to SEQ ID NO: 585260

SEQ ID NO: 733856 - RNA, 64 nt, Homo Sapiens; identical to SEQ ID NO: 585261

SEQ ID NO: 733857 - RNA, 64 nt, Homo Sapiens; identical to SEQ ID NO: 585262

SEQ ID NO: 733858 - RNA, 64 nt, Homo Sapiens; identical to SEQ ID NO: 585263

SEQ ID NO: 733859 - RNA, 63 nt, Homo Sapiens
ugauuucuacacuucccaagauguugcugaccaggugcccauaaccacacccuccauuuccuc

SEQ ID NO: 733860 - RNA, 63 nt, Homo Sapiens
cucccagcaugcucuagagagggaggcggcucuggugcccauccauccucccagcacgcucug

SEQ ID NO: 733861 - RNA, 63 nt, Homo Sapiens
cucccagcacgcucuggggagagaggcggcucuggugcccaucccgucucccagcaugcucua

SEQ ID NO: 733862 - RNA, 63 nt, Homo Sapiens
uucugcuaaugagagcuuugggcccugggugcaggugcccacagcucacagggacgugguaug

SEQ ID NO: 733863 - RNA, 63 nt, Homo Sapiens
ucuugggggcuuuccagucuguagagggcucugggugcccauuucuucccuuguuccccagaa

SEQ ID NO: 733864 - RNA, 63 nt, Homo Sapiens
aguuagaggcacgcccuccccacuuccaggguuggugcccacgacgcccccacucucccucca

SEQ ID NO: 733865 - RNA, 63 nt, Homo Sapiens
cccagcccugugcccccgcuggggaaggcggggggugcccaagggaugucaccucaccggccu

SEQ ID NO: 733866 - RNA, 63 nt, Homo Sapiens
ccucaggcuggcccggcaccggccggcuccggcggugcccacccacccagaccacacacugac

SEQ ID NO: 733867 - RNA, 63 nt, Homo Sapiens
gcuccgcucaaggaaggcuguguaaggauaggaggugcccagugguugucagguugcugugga

SEQ ID NO: 733868 - RNA, 63 nt, Homo Sapiens
aagauggaggaucccugugcuggcaaugccacaggugcccaagagccacccccucuggccugc

SEQ ID NO: 733869 - RNA, 63 nt, Homo Sapiens
cugagugaggaagggaaugggguaggggaugggggugcccacaaagccaucccacagcuggaa

SEQ ID NO: 733870 - RNA, 63 nt, Homo Sapiens
agucacccuguggcaaaugccaggacagcugcaggugcccauuagcaacgccugccuucuggg

SEQ ID NO: 733871 - RNA, 63 nt, Homo Sapiens
aaggugagggaugccauaccuugagaccaagccggugcccaccuaagggcuaaggccucuugc

SEQ ID NO: 733872 - RNA, 63 nt, Homo Sapiens
ccccgggaaacugaggaacuaaagaaagcugaaggugcccaccugggccaccagaaggugaca

SEQ ID NO: 733873 - RNA, 63 nt, Homo Sapiens
ccugccucagccucccgaguagcugggccuaaaggugcccaccacuauacccggcuaauuuuu

SEQ ID NO: 733874 - RNA, 63 nt, Homo Sapiens
ggcugggacccuuugcagugucuuccugagguuggugcccacuagcuccagguggggaccacg

SEQ ID NO: 733875 - RNA, 63 nt, Homo Sapiens
ucuccagggagcuucuggccagacgcuccucgaggugcccagcugggacagggugaggcuccc

SEQ ID NO: 733876 - RNA, 63 nt, Homo Sapiens
ggaccugaagugaagcucccggcccgaggucaaggugcccaagccuuggcaucggagugucag

SEQ ID NO: 733877 - RNA, 63 nt, Homo Sapiens
cuggauguggcagcaccgaccugugucgguaguggugcccaccccuagagacccgggaagggg

SEQ ID NO: 733878 - RNA, 63 nt, Homo Sapiens
gcucuucucccccaaacccacgcguguucugaaggugcccaggagcggcgaugcacucgcacu

SEQ ID NO: 733879 - RNA, 63 nt, Homo Sapiens
caugccucauccucccaaguaggugggauuacaggugcccaccaccaagcccugcaaauuuuu

SEQ ID NO: 733880 - RNA, 63 nt, Homo Sapiens
agggggcugagcucugagggaccugcuguggagggugcccagcggacagcucacgaggcuugg

SEQ ID NO: 733881 - RNA, 63 nt, Homo Sapiens
agacguggugugagagggacaccugccauggagggugcccagcggacgguucacaaggcuugg

SEQ ID NO: 733882 - RNA, 63 nt, Homo Sapiens
agacgugguaugagagggauaccugccguggagggugcccagcagauggcucaugaggcuugg

SEQ ID NO: 733883 - RNA, 63 nt, Homo Sapiens
agacguggugugagagggacggaccugguggagggugcccagcaggaacggcucacgagacuu

SEQ ID NO: 733884 - RNA, 63 nt, Homo Sapiens
agacguggugugagaggaacaccugcuguggagggugcccagcggacggcucacgaggcuugg

SEQ ID NO: 733885 - RNA, 63 nt, Homo Sapiens
accccccaccggaggacacgucugagcagggcaggugcccaacaugccuccugcacacagccg

SEQ ID NO: 733886 - RNA, 63 nt, Homo Sapiens
ucagggcagccagguggcuccgggugggccugaggugcccagcuccaggggugugaccuggga

SEQ ID NO: 733887 - RNA, 63 nt, Homo Sapiens
ggagguaaagaugauagaggcuuccaggagaggggugcccagccuugggguucagaggggacu

SEQ ID NO: 733888 - RNA, 64 nt, Homo Sapiens; identical to SEQ ID NO: 199907

SEQ ID NO: 733889 - RNA, 64 nt, Homo Sapiens; identical to SEQ ID NO: 199908

SEQ ID NO: 733890 - RNA, 64 nt, Homo Sapiens; identical to SEQ ID NO: 199909

SEQ ID NO: 733891 - RNA, 64 nt, Homo Sapiens; identical to SEQ ID NO: 199910

SEQ ID NO: 733892 - RNA, 64 nt, Homo Sapiens; identical to SEQ ID NO: 199911

SEQ ID NO: 733893 - RNA, 64 nt, Homo Sapiens; identical to SEQ ID NO: 199912

SEQ ID NO: 733894 - RNA, 64 nt, Homo Sapiens; identical to SEQ ID NO: 199913

SEQ ID NO: 733895 - RNA, 64 nt, Homo Sapiens; identical to SEQ ID NO: 199914

SEQ ID NO: 733896 - RNA, 64 nt, Homo Sapiens; identical to SEQ ID NO: 199915

SEQ ID NO: 733897 - RNA, 64 nt, Homo Sapiens; identical to SEQ ID NO: 199916

SEQ ID NO: 733898 - RNA, 64 nt, Homo Sapiens; identical to SEQ ID NO: 199917

SEQ ID NO: 733899 - RNA, 64 nt, Homo Sapiens; identical to SEQ ID NO: 199918

SEQ ID NO: 733900 - RNA, 64 nt, Homo Sapiens; identical to SEQ ID NO: 199919

SEQ ID NO: 733901 - RNA, 64 nt, Homo Sapiens; identical to SEQ ID NO: 199920

SEQ ID NO: 733902 - RNA, 64 nt, Homo Sapiens; identical to SEQ ID NO: 199921

SEQ ID NO: 733903 - RNA, 64 nt, Homo Sapiens; identical to SEQ ID NO: 199922

SEQ ID NO: 733904 - RNA, 64 nt, Homo Sapiens; identical to SEQ ID NO: 199923

SEQ ID NO: 733905 - RNA, 64 nt, Homo Sapiens; identical to SEQ ID NO: 199924

SEQ ID NO: 733906 - RNA, 64 nt, Homo Sapiens; identical to SEQ ID NO: 199925

SEQ ID NO: 733907 - RNA, 64 nt, Homo Sapiens; identical to SEQ ID NO: 199926

SEQ ID NO: 733908 - RNA, 64 nt, Homo Sapiens; identical to SEQ ID NO: 199927

SEQ ID NO: 733909 - RNA, 64 nt, Homo Sapiens; identical to SEQ ID NO: 199928

SEQ ID NO: 733910 - RNA, 64 nt, Homo Sapiens; identical to SEQ ID NO: 199929

SEQ ID NO: 733911 - RNA, 64 nt, Homo Sapiens; identical to SEQ ID NO: 199930

SEQ ID NO: 733912 - RNA, 64 nt, Homo Sapiens; identical to SEQ ID NO: 199931

SEQ ID NO: 733913 - RNA, 64 nt, Homo Sapiens; identical to SEQ ID NO: 199932

SEQ ID NO: 733914 - RNA, 64 nt, Homo Sapiens; identical to SEQ ID NO: 199933

SEQ ID NO: 733915 - RNA, 64 nt, Homo Sapiens; identical to SEQ ID NO: 199934

SEQ ID NO: 733916 - RNA, 64 nt, Homo Sapiens; identical to SEQ ID NO: 199935

SEQ ID NO: 733917 - RNA, 64 nt, Homo Sapiens; identical to SEQ ID NO: 199936

SEQ ID NO: 733918 - RNA, 64 nt, Homo Sapiens; identical to SEQ ID NO: 199937

SEQ ID NO: 733919 - RNA, 64 nt, Homo Sapiens; identical to SEQ ID NO: 199938

SEQ ID NO: 733920 - RNA, 64 nt, Homo Sapiens; identical to SEQ ID NO: 199939

SEQ ID NO: 733921 - RNA, 64 nt, Homo Sapiens; identical to SEQ ID NO: 199940

SEQ ID NO: 733922 - RNA, 64 nt, Homo Sapiens; identical to SEQ ID NO: 199941

SEQ ID NO: 733923 - RNA, 64 nt, Homo Sapiens; identical to SEQ ID NO: 199942

SEQ ID NO: 733924 - RNA, 64 nt, Homo Sapiens
guguccgugguguguauuaugugacuguccguggaggggugacugacuguguguguguggaggg

SEQ ID NO: 733925 - RNA, 64 nt, Homo Sapiens
guccguggaggggugacugucuguguguguguggaggggugacuccugugugaguguugacuga

SEQ ID NO: 733926 - RNA, 64 nt, Homo Sapiens
uagcagugacaauggcagucuuggcuuuaaagugaggggugacccuuuagugagcuuagcacag

SEQ ID NO: 733927 - RNA, 64 nt, Homo Sapiens
caaggagcuucuuaaguuaaaucacuagaaauuuaggggugaucugggccuucauaugugugag

SEQ ID NO: 733928 - RNA, 64 nt, Homo Sapiens
gagagagcaccagacaggcugucccaguuuggccaggggugaggaacagagcaucugacaaaag

SEQ ID NO: 733929 - RNA, 64 nt, Homo Sapiens
ccaacuucugccuguggagaagaguuucacgggcaggggugauuuggcuacaggccucuugugg

SEQ ID NO: 733930 - RNA, 64 nt, Homo Sapiens
acccucaaugcaugauugguauucucaacagcaaaggggugaaaaaucuagagacagaggaggc

SEQ ID NO: 733931 - RNA, 64 nt, Homo Sapiens
ggggugaaaaaucuagagacagaggaggccuggcaggggugauaaaaauggagauugaaaugaa

SEQ ID NO: 733932 - RNA, 64 nt, Homo Sapiens
ccaggagagagggacagguuggacagguucugucaggggugacaggggugacaccaggagagag

SEQ ID NO: 733933 - RNA, 64 nt, Homo Sapiens
ccaggacacagggacagguuggacagguucugucaggggugacaaccugcaaaccaggagagag

SEQ ID NO: 733934 - RNA, 64 nt, Homo Sapiens; identical to SEQ ID NO: 71989

SEQ ID NO: 733935 - RNA, 64 nt, Homo Sapiens; identical to SEQ ID NO: 71990

SEQ ID NO: 733936 - RNA, 64 nt, Homo Sapiens; identical to SEQ ID NO: 71991

SEQ ID NO: 733937 - RNA, 64 nt, Homo Sapiens; identical to SEQ ID NO: 71992

SEQ ID NO: 733938 - RNA, 64 nt, Homo Sapiens; identical to SEQ ID NO: 71993

SEQ ID NO: 733939 - RNA, 64 nt, Homo Sapiens; identical to SEQ ID NO: 71994

SEQ ID NO: 733940 - RNA, 64 nt, Homo Sapiens; identical to SEQ ID NO: 71995

SEQ ID NO: 733941 - RNA, 64 nt, Homo Sapiens; identical to SEQ ID NO: 71996

SEQ ID NO: 733942 - RNA, 64 nt, Homo Sapiens; identical to SEQ ID NO: 71997

SEQ ID NO: 733943 - RNA, 64 nt, Homo Sapiens; identical to SEQ ID NO: 71998

SEQ ID NO: 733944 - RNA, 64 nt, Homo Sapiens; identical to SEQ ID NO: 71999

SEQ ID NO: 733945 - RNA, 64 nt, Homo Sapiens; identical to SEQ ID NO: 72000

SEQ ID NO: 733946 - RNA, 64 nt, Homo Sapiens; identical to SEQ ID NO: 72001

SEQ ID NO: 733947 - RNA, 64 nt, Homo Sapiens; identical to SEQ ID NO: 72002

SEQ ID NO: 733948 - RNA, 64 nt, Homo Sapiens; identical to SEQ ID NO: 72003

SEQ ID NO: 733949 - RNA, 64 nt, Homo Sapiens; identical to SEQ ID NO: 72004

SEQ ID NO: 733950 - RNA, 64 nt, Homo Sapiens; identical to SEQ ID NO: 72005

SEQ ID NO: 733951 - RNA, 64 nt, Homo Sapiens; identical to SEQ ID NO: 72006

SEQ ID NO: 733952 - RNA, 64 nt, Homo Sapiens; identical to SEQ ID NO: 72007

SEQ ID NO: 733953 - RNA, 64 nt, Homo Sapiens; identical to SEQ ID NO: 72008

SEQ ID NO: 733954 - RNA, 64 nt, Homo Sapiens; identical to SEQ ID NO: 72009

SEQ ID NO: 733955 - RNA, 64 nt, Homo Sapiens; identical to SEQ ID NO: 72010

SEQ ID NO: 733956 - RNA, 64 nt, Homo Sapiens; identical to SEQ ID NO: 72011

SEQ ID NO: 733957 - RNA, 64 nt, Homo Sapiens; identical to SEQ ID NO: 72012

SEQ ID NO: 733958 - RNA, 64 nt, Homo Sapiens; identical to SEQ ID NO: 72013

SEQ ID NO: 733959 - RNA, 64 nt, Homo Sapiens; identical to SEQ ID NO: 72014

SEQ ID NO: 733960 - RNA, 64 nt, Homo Sapiens; identical to SEQ ID NO: 72015

SEQ ID NO: 733961 - RNA, 64 nt, Homo Sapiens; identical to SEQ ID NO: 72016

SEQ ID NO: 733962 - RNA, 64 nt, Homo Sapiens; identical to SEQ ID NO: 72017

SEQ ID NO: 733963 - RNA, 64 nt, Homo Sapiens; identical to SEQ ID NO: 72018

SEQ ID NO: 733964 - RNA, 64 nt, Homo Sapiens; identical to SEQ ID NO: 72019

SEQ ID NO: 733965 - RNA, 64 nt, Homo Sapiens; identical to SEQ ID NO: 72020

SEQ ID NO: 733966 - RNA, 64 nt, Homo Sapiens; identical to SEQ ID NO: 72021

SEQ ID NO: 733967 - RNA, 64 nt, Homo Sapiens; identical to SEQ ID NO: 72022

SEQ ID NO: 733968 - RNA, 64 nt, Homo Sapiens; identical to SEQ ID NO: 72023

SEQ ID NO: 733969 - RNA, 64 nt, Homo Sapiens; identical to SEQ ID NO: 276902

SEQ ID NO: 733970 - RNA, 64 nt, Homo Sapiens; identical to SEQ ID NO: 276903

SEQ ID NO: 733971 - RNA, 64 nt, Homo Sapiens; identical to SEQ ID NO: 276904

SEQ ID NO: 733972 - RNA, 64 nt, Homo Sapiens; identical to SEQ ID NO: 276905

SEQ ID NO: 733973 - RNA, 64 nt, Homo Sapiens; identical to SEQ ID NO: 276906

SEQ ID NO: 733974 - RNA, 64 nt, Homo Sapiens; identical to SEQ ID NO: 276907

SEQ ID NO: 733975 - RNA, 64 nt, Homo Sapiens; identical to SEQ ID NO: 276908

SEQ ID NO: 733976 - RNA, 64 nt, Homo Sapiens; identical to SEQ ID NO: 276909

SEQ ID NO: 733977 - RNA, 64 nt, Homo Sapiens; identical to SEQ ID NO: 276910

SEQ ID NO: 733978 - RNA, 64 nt, Homo Sapiens; identical to SEQ ID NO: 276911

SEQ ID NO: 733979 - RNA, 64 nt, Homo Sapiens; identical to SEQ ID NO: 276912

SEQ ID NO: 733980 - RNA, 64 nt, Homo Sapiens; identical to SEQ ID NO: 276913

SEQ ID NO: 733981 - RNA, 64 nt, Homo Sapiens; identical to SEQ ID NO: 276914

SEQ ID NO: 733982 - RNA, 64 nt, Homo Sapiens; identical to SEQ ID NO: 276915

SEQ ID NO: 733983 - RNA, 64 nt, Homo Sapiens; identical to SEQ ID NO: 276916

SEQ ID NO: 733984 - RNA, 64 nt, Homo Sapiens; identical to SEQ ID NO: 276917

SEQ ID NO: 733985 - RNA, 64 nt, Homo Sapiens; identical to SEQ ID NO: 276918

SEQ ID NO: 733986 - RNA, 64 nt, Homo Sapiens; identical to SEQ ID NO: 276919

SEQ ID NO: 733987 - RNA, 64 nt, Homo Sapiens; identical to SEQ ID NO: 276920

SEQ ID NO: 733988 - RNA, 64 nt, Homo Sapiens; identical to SEQ ID NO: 276921

SEQ ID NO: 733989 - RNA, 64 nt, Homo Sapiens; identical to SEQ ID NO: 276922

SEQ ID NO: 733990 - RNA, 64 nt, Homo Sapiens; identical to SEQ ID NO: 276923

SEQ ID NO: 733991 - RNA, 64 nt, Homo Sapiens; identical to SEQ ID NO: 276924

SEQ ID NO: 733992 - RNA, 64 nt, Homo Sapiens; identical to SEQ ID NO: 276925

SEQ ID NO: 733993 - RNA, 64 nt, Homo Sapiens; identical to SEQ ID NO: 276926

SEQ ID NO: 733994 - RNA, 64 nt, Homo Sapiens; identical to SEQ ID NO: 276927

SEQ ID NO: 733995 - RNA, 64 nt, Homo Sapiens; identical to SEQ ID NO: 276928

SEQ ID NO: 733996 - RNA, 64 nt, Homo Sapiens; identical to SEQ ID NO: 276929

SEQ ID NO: 733997 - RNA, 64 nt, Homo Sapiens; identical to SEQ ID NO: 276930

SEQ ID NO: 733998 - RNA, 64 nt, Homo Sapiens; identical to SEQ ID NO: 276931

SEQ ID NO: 733999 - RNA, 64 nt, Homo Sapiens; identical to SEQ ID NO: 276932

SEQ ID NO: 734000 - RNA, 64 nt, Homo Sapiens; identical to SEQ ID NO: 276933

SEQ ID NO: 734001 - RNA, 64 nt, Homo Sapiens; identical to SEQ ID NO: 276934

SEQ ID NO: 734002 - RNA, 64 nt, Homo Sapiens; identical to SEQ ID NO: 276935

SEQ ID NO: 734003 - RNA, 64 nt, Homo Sapiens; identical to SEQ ID NO: 276936

SEQ ID NO: 734004 - RNA, 64 nt, Homo Sapiens; identical to SEQ ID NO: 276937

SEQ ID NO: 734005 - RNA, 64 nt, Homo Sapiens; identical to SEQ ID NO: 276938

SEQ ID NO: 734006 - RNA, 64 nt, Homo Sapiens; identical to SEQ ID NO: 276939

SEQ ID NO: 734007 - RNA, 64 nt, Homo Sapiens; identical to SEQ ID NO: 276940

SEQ ID NO: 734008 - RNA, 64 nt, Homo Sapiens; identical to SEQ ID NO: 276941

SEQ ID NO: 734009 - RNA, 56 nt, Homo Sapiens; identical to SEQ ID NO: 276942

SEQ ID NO: 734010 - RNA, 64 nt, Homo Sapiens; identical to SEQ ID NO: 276943

SEQ ID NO: 734011 - RNA, 64 nt, Homo Sapiens; identical to SEQ ID NO: 276944

SEQ ID NO: 734012 - RNA, 64 nt, Homo Sapiens; identical to SEQ ID NO: 276945

SEQ ID NO: 734013 - RNA, 64 nt, Homo Sapiens; identical to SEQ ID NO: 276946

SEQ ID NO: 734014 - RNA, 64 nt, Homo Sapiens; identical to SEQ ID NO: 276947

SEQ ID NO: 734015 - RNA, 64 nt, Homo Sapiens; identical to SEQ ID NO: 276948

SEQ ID NO: 734016 - RNA, 64 nt, Homo Sapiens; identical to SEQ ID NO: 276949

SEQ ID NO: 734017 - RNA, 64 nt, Homo Sapiens; identical to SEQ ID NO: 276950

SEQ ID NO: 734018 - RNA, 64 nt, Homo Sapiens; identical to SEQ ID NO: 276951

SEQ ID NO: 734019 - RNA, 64 nt, Homo Sapiens; identical to SEQ ID NO: 276952

SEQ ID NO: 734020 - RNA, 64 nt, Homo Sapiens; identical to SEQ ID NO: 276953

SEQ ID NO: 734021 - RNA, 64 nt, Homo Sapiens; identical to SEQ ID NO: 276954

SEQ ID NO: 734022 - RNA, 64 nt, Homo Sapiens; identical to SEQ ID NO: 276955

SEQ ID NO: 734023 - RNA, 64 nt, Homo Sapiens; identical to SEQ ID NO: 276956

SEQ ID NO: 734024 - RNA, 64 nt, Homo Sapiens; identical to SEQ ID NO: 276957

SEQ ID NO: 734025 - RNA, 64 nt, Homo Sapiens; identical to SEQ ID NO: 276958

SEQ ID NO: 734026 - RNA, 64 nt, Homo Sapiens; identical to SEQ ID NO: 276959

SEQ ID NO: 734027 - RNA, 64 nt, Homo Sapiens; identical to SEQ ID NO: 276960

SEQ ID NO: 734028 - RNA, 57 nt, Homo Sapiens; identical to SEQ ID NO: 276961

SEQ ID NO: 734029 - RNA, 64 nt, Homo Sapiens; identical to SEQ ID NO: 276962

SEQ ID NO: 734030 - RNA, 64 nt, Homo Sapiens; identical to SEQ ID NO: 276963

SEQ ID NO: 734031 - RNA, 64 nt, Homo Sapiens; identical to SEQ ID NO: 276964

SEQ ID NO: 734032 - RNA, 64 nt, Homo Sapiens; identical to SEQ ID NO: 276965

SEQ ID NO: 734033 - RNA, 64 nt, Homo Sapiens; identical to SEQ ID NO: 276966

SEQ ID NO: 734034 - RNA, 64 nt, Homo Sapiens; identical to SEQ ID NO: 276967

SEQ ID NO: 734035 - RNA, 64 nt, Homo Sapiens; identical to SEQ ID NO: 276968

SEQ ID NO: 734036 - RNA, 64 nt, Homo Sapiens; identical to SEQ ID NO: 276969

SEQ ID NO: 734037 - RNA, 64 nt, Homo Sapiens; identical to SEQ ID NO: 276970

SEQ ID NO: 734038 - RNA, 64 nt, Homo Sapiens; identical to SEQ ID NO: 276971

SEQ ID NO: 734039 - RNA, 64 nt, Homo Sapiens; identical to SEQ ID NO: 276972

SEQ ID NO: 734040 - RNA, 64 nt, Homo Sapiens; identical to SEQ ID NO: 276973

SEQ ID NO: 734041 - RNA, 64 nt, Homo Sapiens; identical to SEQ ID NO: 276974

SEQ ID NO: 734042 - RNA, 64 nt, Homo Sapiens; identical to SEQ ID NO: 276975

SEQ ID NO: 734043 - RNA, 64 nt, Homo Sapiens; identical to SEQ ID NO: 276976

SEQ ID NO: 734044 - RNA, 64 nt, Homo Sapiens; identical to SEQ ID NO: 276977

SEQ ID NO: 734045 - RNA, 64 nt, Homo Sapiens; identical to SEQ ID NO: 276978

SEQ ID NO: 734046 - RNA, 64 nt, Homo Sapiens; identical to SEQ ID NO: 276979

SEQ ID NO: 734047 - RNA, 64 nt, Homo Sapiens; identical to SEQ ID NO: 276980

SEQ ID NO: 734048 - RNA, 64 nt, Homo Sapiens; identical to SEQ ID NO: 276981

SEQ ID NO: 734049 - RNA, 64 nt, Homo Sapiens; identical to SEQ ID NO: 276982

SEQ ID NO: 734050 - RNA, 64 nt, Homo Sapiens; identical to SEQ ID NO: 276983

SEQ ID NO: 734051 - RNA, 64 nt, Homo Sapiens; identical to SEQ ID NO: 276984

SEQ ID NO: 734052 - RNA, 64 nt, Homo Sapiens; identical to SEQ ID NO: 276985

SEQ ID NO: 734053 - RNA, 64 nt, Homo Sapiens; identical to SEQ ID NO: 276986

SEQ ID NO: 734054 - RNA, 64 nt, Homo Sapiens; identical to SEQ ID NO: 276987

SEQ ID NO: 734055 - RNA, 64 nt, Homo Sapiens; identical to SEQ ID NO: 276988

SEQ ID NO: 734056 - RNA, 63 nt, Homo Sapiens
aauuuuuuuuccccauugauguuuagaaaguuugagacugaaacaggaaaggccauaaaauau

SEQ ID NO: 734057 - RNA, 63 nt, Homo Sapiens
gagcauggauuacccaguagcuacuuuuuaauagagacugacuagguuuacaacuucugggag

SEQ ID NO: 734058 - RNA, 63 nt, Homo Sapiens
uccugauccuuuucccucauuccugaacugcaggagacugagccccuuugggcuuuggugacc

SEQ ID NO: 734059 - RNA, 63 nt, Homo Sapiens
cauauggcggguaccguaauccuagcuacucgggagacugacgggagaaucgcuugaacccag

SEQ ID NO: 734060 - RNA, 63 nt, Homo Sapiens
gcagguuaaguaucuuccauguuaauguguuaagagacugaaaauaccagccaucagaaacug

SEQ ID NO: 734061 - RNA, 63 nt, Homo Sapiens
auauuuuaggguggguuaggaguauccuuucuggagacugagaaagggguguauuuaauucca

SEQ ID NO: 734062 - RNA, 63 nt, Homo Sapiens
cuauggauuuuauaaugaaagaaaaaggcauuggagacugaaggcagaaaugguugugacagu

SEQ ID NO: 734063 - RNA, 63 nt, Homo Sapiens
aauaguacuuacaaaugacuccuaagggacugugagacugagagggcucacgccucuguguuc

SEQ ID NO: 734064 - RNA, 53 nt, Homo Sapiens; identical to SEQ ID NO: 615283

SEQ ID NO: 734065 - RNA, 63 nt, Homo Sapiens
auuagauuggaucucccaaguuuuaauugaaaggagacugaacgaaaaccuuucugcuuucug

SEQ ID NO: 734066 - RNA, 63 nt, Homo Sapiens
uaacagcuugauccagggcgugaaagguuaguugagacugaaguguucacuuccauagaagaa

SEQ ID NO: 734067 - RNA, 63 nt, Homo Sapiens
uucugugagaccaauuuugugcuaaugagcauugagacugaugcuuuguaagucacaccacaa

SEQ ID NO: 734068 - RNA, 63 nt, Homo Sapiens
cuggccuccacaccaaacguucccuugcagauggagacugaaucugagggcagcagacuuuua

SEQ ID NO: 734069 - RNA, 63 nt, Homo Sapiens
auuaaauuuagacaauuaaaacauuucuaaagugagacugaaaauaauauagaaaaucucauu

SEQ ID NO: 734070 - RNA, 63 nt, Homo Sapiens
gggcaucaacauggccaacagcauugccaaccugagacugaaggccaaggaauauaguuuaca

SEQ ID NO: 734071 - RNA, 63 nt, Homo Sapiens
ugguggcagaugccuguaacuccagcuacucgggagacugaaggacaagaaucacuugaaccu

SEQ ID NO: 734072 - RNA, 63 nt, Homo Sapiens
aggagcacaaaugagccuuuaaaaaccaauucugagacugaacuuuuuuauagccuauuucuu

SEQ ID NO: 734073 - RNA, 63 nt, Homo Sapiens
aauguggaacuugaugccacccccugcaauggagagacugauuuaggagcauugugucccuuc

SEQ ID NO: 734074 - RNA, 63 nt, Homo Sapiens
uacauuaaaaaucaguuaagaguuuacaggaaagagacugagauugguaaucugaaaaggacc

SEQ ID NO: 734075 - RNA, 63 nt, Homo Sapiens
gugucuuuuucuuuucauaaaguaacaacagacgagacugagguuaaacaucagaaaaaaacc

SEQ ID NO: 734076 - RNA, 63 nt, Homo Sapiens
gagcucuuaacgcaaagaccaugcacaucaucagagacugagaugggagaggccugagacgga

SEQ ID NO: 734077 - RNA, 63 nt, Homo Sapiens
aacacccacauggacacaaggaauguugcugcagagacugaaugacaugcaacaggugaaggu

SEQ ID NO: 734078 - RNA, 63 nt, Homo Sapiens
acugaggagucugcaauuuggaauauggagagagagacugauuugcugaauuuccuucuaaau

SEQ ID NO: 734079 - RNA, 63 nt, Homo Sapiens
gguuggugugucauggugccucaucauucuggggagacugaaaauaccuucaucacugaccug

SEQ ID NO: 734080 - RNA, 63 nt, Homo Sapiens
gcagcagcuaggacugaggagcagccgcuaggagagacugaaaucacuggcuggggcagaggg

SEQ ID NO: 734081 - RNA, 63 nt, Homo Sapiens
agggacaacuuuuuccuauggcuucuaaggaaagagacugaaggaauccuugucucaggcucu

SEQ ID NO: 734082 - RNA, 63 nt, Homo Sapiens
uggaaggcuugcuugagcccccuagcuacucgggagacugaagaaaaauuagccgggcguggu

SEQ ID NO: 734083 - RNA, 63 nt, Homo Sapiens
ugggagcaucacuugagacccucggcacuuugggagacugaggcaguggcucacgccuguaau

SEQ ID NO: 734084 - RNA, 63 nt, Homo Sapiens
cuagaagauccuuugaaccucccagcuacucaggagacugaggaugguggcacgcacuguagu

SEQ ID NO: 734085 - RNA, 63 nt, Homo Sapiens
ucacaaccccugacugcuccguauuggggaagagagacugaaggguaccaggcaccaugcuag

SEQ ID NO: 734086 - RNA, 63 nt, Homo Sapiens
ugugugaacuaacaugcaaagcaacggaagaaugagacugaacauacuauggaguaccaugug

SEQ ID NO: 734087 - RNA, 63 nt, Homo Sapiens
gaauuaaaaacaaagugccucguucauucuaaagagacugauauuccagaggacccagaccuu

SEQ ID NO: 734088 - RNA, 63 nt, Homo Sapiens
aaucacuucgucauaauguuaguggccuuugaagagacugaauuaaagcauugucuguuccag

SEQ ID NO: 734089 - RNA, 63 nt, Homo Sapiens
aaaggaaguccugggcugugcacuguccagguggagacugagcuucugaggcugccauacugc

SEQ ID NO: 734090 - RNA, 63 nt, Homo Sapiens
ggcagaagucagcccgaaugggucucuuaccgcgagacugagaucuaggacuagaaaaacuug

SEQ ID NO: 734091 - RNA, 63 nt, Homo Sapiens
cuaaagcaucacuuaauaaaccaguugcuggcagagacugagaugaguggagucaccccacuc

SEQ ID NO: 734092 - RNA, 63 nt, Homo Sapiens
caggagaaucgcuugaaccccccagcuacuugagagacugaggugguggugcaccccuaaaau

SEQ ID NO: 734093 - RNA, 63 nt, Homo Sapiens
gugagugcuggcuaaaagccccaacugaaguaggagacugacuagcucauuauccagucugug

SEQ ID NO: 734094 - RNA, 63 nt, Homo Sapiens
agaccuuagaagcgaauucccucucagguguaagagacugaugggaucugauaaacucauuua

SEQ ID NO: 734095 - RNA, 63 nt, Homo Sapiens
acccugcuugagccaaagaccugggguccgguggagacugaccgcuuugcuuaugggugcucg

SEQ ID NO: 734096 - RNA, 63 nt, Homo Sapiens
cccuuaucucuucauauucugaagggagagacugagacugacuggagcuaagcucaggagccc

SEQ ID NO: 734097 - RNA, 63 nt, Homo Sapiens
cugacucccuuaucucuucagagcccgaagggagagacugagauccccuggagcuaagcucag

SEQ ID NO: 734098 - RNA, 63 nt, Homo Sapiens
uuggguugguugugaugagcgucucuuccucuggagacugaacagaguaagacaugcucugcu

SEQ ID NO: 734099 - RNA, 63 nt, Homo Sapiens
caggagaaucgcuugaaccucccagcuacuugggagacugaggugguggcgggcaccuguaau

SEQ ID NO: 734100 - RNA, 63 nt, Homo Sapiens
ugggagaaucgcuugagacucccagcuacucuggagacugaggugauggcacgugucuguaau

SEQ ID NO: 734101 - RNA, 63 nt, Homo Sapiens
cuugcccgugcauauuuagggcccacuccucuggagacugagcgacagccccuaccuaccccu

SEQ ID NO: 734102 - RNA, 63 nt, Homo Sapiens
uugcacagaucagaccgagaugcaggcucagaagagacugagccgaugagggauggagguagc

SEQ ID NO: 734103 - RNA, 63 nt, Homo Sapiens
aaagaugcagucaccauagauguccacguagcagagacugacuuaggaucugagauaaagcau

SEQ ID NO: 734104 - RNA, 63 nt, Homo Sapiens
guuguacaaauuucugauugcccuaaauguagagagacugauggggaaaguaugauggguuug

SEQ ID NO: 734105 - RNA, 63 nt, Homo Sapiens
agcggcucuccugagaggugcugcaggcaaagugagacugacaccucacugaggaagggagac

SEQ ID NO: 734106 - RNA, 63 nt, Homo Sapiens
ugaugaaccuaucgggugaaaacgaccacucaagagacugacuucgccauucaagacaaggaa

SEQ ID NO: 734107 - RNA, 63 nt, Homo Sapiens
guggcuccugauagcguuuggaagaacgcgggggagacugaagagcaacugggaacucggauc

SEQ ID NO: 734108 - RNA, 63 nt, Homo Sapiens
aggggguggaauuauuacucuauacauucaacagagacugaauagauaugaaagcugauuuuu

SEQ ID NO: 734109 - RNA, 63 nt, Homo Sapiens
gccaaccaaggcaggcagaacccucuuaaauaugagacugauguauagguucucucuaugguc

SEQ ID NO: 734110 - RNA, 63 nt, Homo Sapiens
aacuggugaaacuagccuggaauaaugccaccagagacugaguggaaaucgccccuuuugaag

SEQ ID NO: 734111 - RNA, 63 nt, Homo Sapiens
cagggggauaacuaccagaaagguauaccuguugagacugauucagaggagcaacccuauuua

SEQ ID NO: 734112 - RNA, 63 nt, Homo Sapiens
uuagcuguuuagaagggauggcuugaaaggaaggagacugaaaaacacucugagagcauacac

SEQ ID NO: 734113 - RNA, 63 nt, Homo Sapiens
cauacacucauacauauauguauauuuuccugagagacugauacccaaaauuuauuaaaaagc

SEQ ID NO: 734114 - RNA, 63 nt, Homo Sapiens
gaucugccugaaauggggggggggugaaaccaugagacugacaauaugaagagugcugucguu

SEQ ID NO: 734115 - RNA, 63 nt, Homo Sapiens
uugcuuagaguacuucuuuggauaguaauucgugagacugaagucauguaugcccacgagggu

SEQ ID NO: 734116 - RNA, 63 nt, Homo Sapiens
uuugucuuuuuccuuuagccgcccuccggaccugagacugaguccaccuagacuguuuucuga

SEQ ID NO: 734117 - RNA, 63 nt, Homo Sapiens
auugcagacagaggggcacgggaccugcaggcagagacugaaagccugaaugccucccucaaa

SEQ ID NO: 734118 - RNA, 63 nt, Homo Sapiens
cuugaaccacagaagggaauccuuuuggggcuggagacugagucaacaaguuacuuuuaggau

SEQ ID NO: 734119 - RNA, 63 nt, Homo Sapiens
cauucacauuuuaacauaggccuacaguggagggagacugacccccccugggagagugcucaa

SEQ ID NO: 734120 - RNA, 63 nt, Homo Sapiens
cgccgcuacaagccaaagauccccacagacugcgagacugaacagacuuguugagaaauacga

SEQ ID NO: 734121 - RNA, 63 nt, Homo Sapiens
cucucucuguugcccaggcuuuuuuauuuuuuugagacugaguaagacaugcuuacuuuuuaa

SEQ ID NO: 734122 - RNA, 63 nt, Homo Sapiens
gcagagaccacuuauccucaggagaacucgccagagacugagaggacgauuuucuaaccccag

SEQ ID NO: 734123 - RNA, 63 nt, Homo Sapiens
ugggaguaccccuugagccucccagcuacuuuggagacugaggugguagugcaugccuguagu

SEQ ID NO: 734124 - RNA, 63 nt, Homo Sapiens
uaagagauggcagagggagagcagagcaggagggagacugaagcucccucacucuccaugcug

SEQ ID NO: 734125 - RNA, 63 nt, Homo Sapiens
ucuuccugggcccucauugcgaugggcccccaggagacugaggcugcccuugccaucuuuuag

SEQ ID NO: 734126 - RNA, 63 nt, Homo Sapiens
gacuucuggguacuggaauuaauaccagugggugagacugagggugagugaguuaguacauau

SEQ ID NO: 734127 - RNA, 63 nt, Homo Sapiens
cugggcuuuguuagucagagcaggggaucagaggagacugaagcagaaacccugcacacgggc

SEQ ID NO: 734128 - RNA, 63 nt, Homo Sapiens
ugggacguacguggaggcugcuggaccuggucagagacugaugugccuuagcggcaaugguua

SEQ ID NO: 734129 - RNA, 63 nt, Homo Sapiens
uaaccuuucaaucaaaacucaguaucauaaguagagacugaaaacuugccguuauugauuguu

SEQ ID NO: 734130 - RNA, 63 nt, Homo Sapiens
uugggaaggcaaagcuuuuguggagucaggggggagacugagaaaaaaugaauuaacccugug

SEQ ID NO: 734131 - RNA, 63 nt, Homo Sapiens
gagcuguaccaggaacuugcauaucuagagacagagacugagucacuggcccaucucuuugcu

SEQ ID NO: 734132 - RNA, 63 nt, Homo Sapiens
cagccacugcagcagacagaccaggaacacaaugagacugacauuucaaaaaaacaaaacugg

SEQ ID NO: 734133 - RNA, 63 nt, Homo Sapiens
cucgccaccacaccuggcuaauuuuuuuuuuuugagacugagucucgcacugucacccagggu

SEQ ID NO: 734134 - RNA, 63 nt, Homo Sapiens
cagaaacaaaacaucgaacaaaacccuauuuaagagacugaucacacacguauacacaacauu

SEQ ID NO: 734135 - RNA, 63 nt, Homo Sapiens
agguaucauuugaaaaauaccauaauggcauuugagacugaauuucuaaaaauugaaugccaa

SEQ ID NO: 734136 - RNA, 63 nt, Homo Sapiens
gcugcagagggaugagugaccaccauccaggcugagacugaaaggagcagaggcuggaacuac

SEQ ID NO: 734137 - RNA, 63 nt, Homo Sapiens
ggggcaggcugaggaguugcccuuugccccccagagacugacucucagagccagagaugggau

SEQ ID NO: 734138 - RNA, 63 nt, Homo Sapiens
ggucucagcauguugacugggauuggaaauaaugagacugagcccucggcuugggcugcacuc

SEQ ID NO: 734139 - RNA, 63 nt, Homo Sapiens
uauaauggacagguguuccugggaaggugggcagagacugauguggcuugucgggggugggag

SEQ ID NO: 734140 - RNA, 63 nt, Homo Sapiens
gaaacuaagauuuaucugcauaaaaaaauaauugagacugaaauguugaaauauaguugaaag

SEQ ID NO: 734141 - RNA, 63 nt, Homo Sapiens
uaauaauucucucuuuccuccaaggaaacaggagagacugaauucauuucauuauguuucuuc

SEQ ID NO: 734142 - RNA, 63 nt, Homo Sapiens
ugggugcacuggccaugcccgcccugcauguuggagacugagcuucugcccugccccaccagg

SEQ ID NO: 734143 - RNA, 63 nt, Homo Sapiens
ccccuggguuguggagggaaugauaguugauaugagacugaaaccuguuuucuguuucaaaca

SEQ ID NO: 734144 - RNA, 63 nt, Homo Sapiens
uccagaauaguaaucuuuuuauuccaucuucaagagacugauuucacuuccucuuagaucaua

SEQ ID NO: 734145 - RNA, 63 nt, Homo Sapiens
gugaagucaagucugagcaccaagcuguauguagagacugaauauuguuuuuaugauucuaau

SEQ ID NO: 734146 - RNA, 63 nt, Homo Sapiens
caagcagggcuugaugcugggguuuccucugcugagacugagacaggguuggggccuggacag

SEQ ID NO: 734147 - RNA, 63 nt, Homo Sapiens
ucuuuguggaaaccacuguuaguccaaugccaugagacugaaguuaugucaauguccaaacaa

SEQ ID NO: 734148 - RNA, 63 nt, Homo Sapiens
cucacuccaucagccaggcuuuuuuuuuuuuuugagacugagucuuuccaacuuccuuuuuuu

SEQ ID NO: 734149 - RNA, 63 nt, Homo Sapiens
aacugguaauuagacugugacccacuuuaaugggagacugauaguccuugcucucagggagcc

SEQ ID NO: 734150 - RNA, 63 nt, Homo Sapiens
ggcuuuguaaaacauuaguccacucucuggaaggagacugaggccuauccuuaauaaauccuc

SEQ ID NO: 734151 - RNA, 63 nt, Homo Sapiens
cagggccugugaguggacaggcacagcagacuggagacugaggggacauggcaggauguucug

SEQ ID NO: 734152 - RNA, 63 nt, Homo Sapiens
ggaaaucccccuuucuuucuagcagaauuuucugagacugaagccacauucccacaggccuug

SEQ ID NO: 734153 - RNA, 63 nt, Homo Sapiens
agacugaaaaugccuaaucgaaugauaaacuuagagacugauuuuauauauugccaagaauua

SEQ ID NO: 734154 - RNA, 63 nt, Homo Sapiens
uccaggcuuucccacuucccacccugccccucagagacugaaauuacggguaccugaagaugg

SEQ ID NO: 734155 - RNA, 63 nt, Homo Sapiens
uucuugccuaaugauguuaucuaggcaccauuggagacugaaaaaaaaaaaucccugcucugu

SEQ ID NO: 734156 - RNA, 63 nt, Homo Sapiens
ucuguucaagucccacuuuaaauuaugucuuaggagacugaaaguggaaucuucugagcauuc

SEQ ID NO: 734157 - RNA, 63 nt, Homo Sapiens
cucagccacagagaacucccuccuacaaagggggagacugaaacccgaguuaaggaggggccu

SEQ ID NO: 734158 - RNA, 62 nt, Homo Sapiens; identical to SEQ ID NO: 615292

SEQ ID NO: 734159 - RNA, 63 nt, Homo Sapiens
guuuuucacuuggaggauggugaacccuacugugagacugauuauuaugcccucuuugguacu

SEQ ID NO: 734160 - RNA, 63 nt, Homo Sapiens
ucaguuauuauauucauuuagcauuaagucaaggagacugagaaugacucaagggacgucaua

SEQ ID NO: 734161 - RNA, 63 nt, Homo Sapiens
guggugagcgggcaggaaccuggcgccgccaccgagacugagccuccugcagacgggcgaagc

SEQ ID NO: 734162 - RNA, 63 nt, Homo Sapiens
cauaucugcaguaagagaaaaaauaauucagaugagacugagcucaaaccaacacuuuuaaaa

SEQ ID NO: 734163 - RNA, 63 nt, Homo Sapiens
gcgggagguucaaugugaagaugugauaugucugagacugaauauacccucauaucuguccug

SEQ ID NO: 734164 - RNA, 63 nt, Homo Sapiens
uguucacugaagacacuugaacucagauuuugugagacugaaauuccugcagcugacagauag

SEQ ID NO: 734165 - RNA, 63 nt, Homo Sapiens
ggccaccuuuaggauuucuuagcuccuaaaacagagacugaaaauguagacauacacuucaga

SEQ ID NO: 734166 - RNA, 51 nt, Homo Sapiens
cugaagaagcuuaaaaucacggagacugacagcuuuguggaaaacauauga

SEQ ID NO: 734167 - RNA, 63 nt, Homo Sapiens
cuguccuuccaugcaaaggcuuccugaaauagggagacugacugaguagcucauucuugugac

SEQ ID NO: 734168 - RNA, 63 nt, Homo Sapiens
cauuuccuuuuaacucaguucaauuuuuguagugagacugagcaguuuuaaauccuuugcgug

SEQ ID NO: 734169 - RNA, 63 nt, Homo Sapiens
uuauaacucaggaucugaggucucaagcuaggagagacugagaauuuuaaucaguuugggcau

SEQ ID NO: 734170 - RNA, 63 nt, Homo Sapiens
uguuacauuagguuccaauucgcaauaguagcagagacugacaugcuuuuauugaccugcuaa

SEQ ID NO: 734171 - RNA, 63 nt, Homo Sapiens
uugcuaauugaaaaucauauccugaaucauacugagacugaucaacuuugguagcuuuuuugu

SEQ ID NO: 734172 - RNA, 63 nt, Homo Sapiens
acuguccccaguguagagggcuuugcugucccugagacugaggcagguuccuuuuccagguca

SEQ ID NO: 734173 - RNA, 63 nt, Homo Sapiens
caagcaggagauguugggucuggagcaagaucugagacugagaugucccccaagggugacagg

SEQ ID NO: 734174 - RNA, 52 nt, Homo Sapiens
uugcagaaucaggacuuuaguagagacugaguaccaggccacgggcugcaga

SEQ ID NO: 734175 - RNA, 63 nt, Homo Sapiens
gugauaugaaugcaguuuguauggaagaccuuugagacugaguagaugaauuauugaauguga

SEQ ID NO: 734176 - RNA, 63 nt, Homo Sapiens
cagugaaggugagcuggagcugguuggacuaaugagacugaggaagcagcuuuuccuacgauc

SEQ ID NO: 734177 - RNA, 63 nt, Homo Sapiens
cucacuuuaucacccagacuuuuguuuguuuuugagacugaguacaaaagcauuaguaguuug

SEQ ID NO: 734178 - RNA, 63 nt, Homo Sapiens
gcuaaaaaugaauggaacaucuaaugcguauaggagacugauaugucucuaaguaaguaaaau

SEQ ID NO: 734179 - RNA, 63 nt, Homo Sapiens
ggcugugaccucuccugaggaggggaaggagaagagacugagggcaggcagccuguugcaggc

SEQ ID NO: 734180 - RNA, 63 nt, Homo Sapiens
gccaugcuuuccuauacuugaugugagcagucagagacugacaugguagcugaaugugcucag

SEQ ID NO: 734181 - RNA, 63 nt, Homo Sapiens
uuuuguaaguuauguuuuacaugccccguuuuugagacugaucucgaugcagguggaucuccu

SEQ ID NO: 734182 - RNA, 63 nt, Homo Sapiens
ggccacauuaaaguugcaaauaacacuuuuuuugagacugaaauaaaggugaaauauuggaag

SEQ ID NO: 734183 - RNA, 63 nt, Homo Sapiens
auauuuuuuaaaauuauuuaaccccugggggcagagacugaggagggaggaugauaagggauc

SEQ ID NO: 734184 - RNA, 63 nt, Homo Sapiens
gacaucuugacuugagccugaagacuauguacagagacugaccucacagacugaccauuccau

SEQ ID NO: 734185 - RNA, 63 nt, Homo Sapiens
uuucuaccucuuuaggaagacaccuauuccacagagacugauuuauagggggcagcacuuuau

SEQ ID NO: 734186 - RNA, 63 nt, Homo Sapiens
agauauuaccacacaacaucaaguggccuugaagagacugagauaacgaauucuugaguuugu

SEQ ID NO: 734187 - RNA, 63 nt, Homo Sapiens
agcagcaugaauaguuuauacugugguuuuucagagacugaaugccaagagaacucgguaaau

SEQ ID NO: 734188 - RNA, 63 nt, Homo Sapiens
aauacugauuggccuauaauaaguuccuauagggagacugaggcuugcagaauuaagguucag

SEQ ID NO: 734189 - RNA, 63 nt, Homo Sapiens
gaaccauccauggacugugauucugaggcugcugagacugaacauguucacauugacagaaaa

SEQ ID NO: 734190 - RNA, 63 nt, Homo Sapiens
guccauaacgaagagugagacuauuuggaaacagagacugaucaucuuugggggaagcccugc

SEQ ID NO: 734191 - RNA, 63 nt, Homo Sapiens
gacaaguaguagaagaaaaugaaugcugcugcugagacugaagaccaguauuucagaacuuug

SEQ ID NO: 734192 - RNA, 63 nt, Homo Sapiens
gauacgagauuuggaaagcucacgacacacggagagacugacuacggaagcgcaggcagcucc

SEQ ID NO: 734193 - RNA, 63 nt, Homo Sapiens
gguuuacgggcugugaauggacccccgaucccugagacugaggcucccagucccacuaccagc

SEQ ID NO: 734194 - RNA, 63 nt, Homo Sapiens
gacacggcacaaaucucaauggcagggguaccagagacugaaacaugcccucaacucuugcuu

SEQ ID NO: 734195 - RNA, 63 nt, Homo Sapiens
cuuacuccgucccccagcguucgucaugccuuugagacugagucuaaagcauuuuugcuauuu

SEQ ID NO: 734196 - RNA, 63 nt, Homo Sapiens
uaggagcaagcagaacccuguccugagugagaagagacugaaaccaguaggaagcauggacuc

SEQ ID NO: 734197 - RNA, 63 nt, Homo Sapiens
ucagacaaaccuauuuauuaguccagggugauagagacugauucagccucguuggggaggcuu

SEQ ID NO: 734198 - RNA, 63 nt, Homo Sapiens
gguugaucagaaacucaccccucuguaaaauuggagacugauaggaaguagaaacaguagggc

SEQ ID NO: 734199 - RNA, 63 nt, Homo Sapiens
uuuuuuagacaagaauaagaauaacuauuuucugagacugaagcuccuucucagcucacuuca

SEQ ID NO: 734200 - RNA, 63 nt, Homo Sapiens
gacuguugaucaaagcacagaaaugacagcaaagagacugagaucaaaccuguagaugacaua

SEQ ID NO: 734201 - RNA, 63 nt, Homo Sapiens
caaguuguuccuuaagucagcuccagccaucaagagacugaguugacagcuaggaugugcauu

SEQ ID NO: 734202 - RNA, 63 nt, Homo Sapiens
aaaaaauuuacuuugaucucgagcauagacgcagagacugaaaugcucagaaaacauugauuu

SEQ ID NO: 734203 - RNA, 63 nt, Homo Sapiens
acuuucccucgggaugaaggugaacaugggggugagacugaagccugaggaauuaaaggucau

SEQ ID NO: 734204 - RNA, 63 nt, Homo Sapiens
uaagguaaugucaugauucauccucucuucagugagacugagccugauguguuaacaaauagg

SEQ ID NO: 734205 - RNA, 63 nt, Homo Sapiens
agcccaguccagcgacaccuugguuuggccugugagacugagaagagagccagccacgccaug

SEQ ID NO: 734206 - RNA, 63 nt, Homo Sapiens
ggccacuggcugcuggggacuggggacugggcagagacugagccaggcaggaaggcagcagcc

SEQ ID NO: 734207 - RNA, 63 nt, Homo Sapiens
cucugccucacccgcuucagcccagggccccuggagacugauccccucugaguccucugcccc

SEQ ID NO: 734208 - RNA, 63 nt, Homo Sapiens
auuuuuauauauuuaaauacaccuuaguggccagagacugacuucaagguuuuauuccagaga

SEQ ID NO: 734209 - RNA, 63 nt, Homo Sapiens
gggaagaagcaugaagcuuuguguggguuggaagagacugaagauauggguuauaaaauguua

SEQ ID NO: 734210 - RNA, 63 nt, Homo Sapiens
uuuaugucccacccaaaaauuggauuccuuuuggagacugaucuguuggucucaggcauuuca

SEQ ID NO: 734211 - RNA, 63 nt, Homo Sapiens
aaaauguucuucauccaggccugccguggagaugagacugaucgugggguugaccaacaagau

SEQ ID NO: 734212 - RNA, 63 nt, Homo Sapiens
gaggcaggcaauggaauauaauggaauauucuugagacugaucacaaaaaaaaaaaccuuuuu

SEQ ID NO: 734213 - RNA, 63 nt, Homo Sapiens
auauuuuauuaguauuuuggaaauagcauaucugagacugaagagaaauugacaauucacuua

SEQ ID NO: 734214 - RNA, 63 nt, Homo Sapiens
gaggaauuccagaauguaaggucgguuacagaggagacugacacugggcuggaagucaaagcc

SEQ ID NO: 734215 - RNA, 63 nt, Homo Sapiens
ucuugcaaugcauaagauauuucaacuguuugugagacugaaucuaccauuuuuaauuuaugg

SEQ ID NO: 734216 - RNA, 63 nt, Homo Sapiens
aucaauaauaaugugucuccccaacuucccugugagacugauuuguagcggggcagggggugu

SEQ ID NO: 734217 - RNA, 63 nt, Homo Sapiens
aaaaccuuaauguaauuuacaaauacuauaugugagacugacauuccaucaacaagggaguuu

SEQ ID NO: 734218 - RNA, 63 nt, Homo Sapiens
gguccgcagaagucgccaccgccucgcucucuugagacugaggacagaccccucaguccuccc

SEQ ID NO: 734219 - RNA, 63 nt, Homo Sapiens
cucacuccaucguccaggcuuuuuuuuuuuuuugagacugaauggcaguuguauuuuuuuuuu

SEQ ID NO: 734220 - RNA, 63 nt, Homo Sapiens
ugccccgggugcaccccacccugccagcaagaggagacugaugggccucggauaggaagcugc

SEQ ID NO: 734221 - RNA, 63 nt, Homo Sapiens
cacagauauccuauauagauuguauacagaacugagacugauuuuguaccgauuagaaugauu

SEQ ID NO: 734222 - RNA, 63 nt, Homo Sapiens
cagaacucagcugugacucuugcagaaucaacagagacugaagugggcuuuuguguuauaauu

SEQ ID NO: 734223 - RNA, 63 nt, Homo Sapiens
uuuagaauguauuaaaaauuuuaccuugccauagagacugaauuagucacagcucucagugau

SEQ ID NO: 734224 - RNA, 63 nt, Homo Sapiens
aguuuaaaauaaggagauccagaauaaaaagaagagacugaucucuucaauuauugucaucug

SEQ ID NO: 734225 - RNA, 63 nt, Homo Sapiens
cuauccugaaucuaacagugacuucauaacuaggagacugaauuagacccuuaagguauagug

SEQ ID NO: 734226 - RNA, 63 nt, Homo Sapiens
auugagcugaguuugaaaguccugauucagagagagacugaggguugacaaauaaacuguauc

SEQ ID NO: 734227 - RNA, 63 nt, Homo Sapiens
ucaaaugcaaccucacaaccuuggcugagucuugagacugaaagauuuagccauaauguaaac

SEQ ID NO: 734228 - RNA, 63 nt, Homo Sapiens
ggccaagccgcagagguccgcgagguccgcgaugagacugaggggugaguggagccaggggug

SEQ ID NO: 734229 - RNA, 63 nt, Homo Sapiens
cuugcucuaucacccaggcuuuaguauuauuuugagacugagucuuuauuuuuuuaauuauua

SEQ ID NO: 734230 - RNA, 63 nt, Homo Sapiens
ugcugggagaaaucuguccuucauuugguuguggagacugauugacuccuuggagaacaauau

SEQ ID NO: 734231 - RNA, 63 nt, Homo Sapiens
uuuaguacacuauguucuaguuuagcacaauuugagacugaaaugccauacuaaugaugagca

SEQ ID NO: 734232 - RNA, 63 nt, Homo Sapiens
gaaaauaauuuugucccaaggucuuuccauguggagacugauauauaauucauuaaagcugug

SEQ ID NO: 734233 - RNA, 63 nt, Homo Sapiens
uguguuuccugaauaccaguuaauugcacaacagagacugaaacuucuccaauacagcaaacc

SEQ ID NO: 734234 - RNA, 63 nt, Homo Sapiens
gcuugugagggaauuaggauaccucaggguggagagacugaauaugccugcagggauuucacc

SEQ ID NO: 734235 - RNA, 63 nt, Homo Sapiens
guucauacuaauuuacaaaccuugccguaucaggagacugaaagggaguguuaacuguuaacu

SEQ ID NO: 734236 - RNA, 63 nt, Homo Sapiens
aaggcagaggaauuuggcugcuucuacggccaugagacugaucccuggccacugaaaagcuuu

SEQ ID NO: 734237 - RNA, 63 nt, Homo Sapiens
caacuccacaucaacuccacaugcgcccagcucgagacugaugaguggaaucagcuuccaggu

SEQ ID NO: 734238 - RNA, 63 nt, Homo Sapiens
aucagacacccucuccuuaaaaacuggcccguggagacugagaucacugacucugacucaucc

SEQ ID NO: 734239 - RNA, 63 nt, Homo Sapiens
cugagaaguuaacccuuaaacaguuuucuggaagagacugaauuucuggguccuugcagcugu

SEQ ID NO: 734240 - RNA, 63 nt, Homo Sapiens
ucugggcugggcaggcccucugguucccaggcugagacugacggguuuucucaggaugauguc

SEQ ID NO: 734241 - RNA, 63 nt, Homo Sapiens
cuguccagcacgggggccgcuggugcuugcugugagacugagcugggcucugaguguaaacua

SEQ ID NO: 734242 - RNA, 63 nt, Homo Sapiens
acccuccuucuucuuccuaagcccucugggucagagacugacacuguuauaaauggagcuuca

SEQ ID NO: 734243 - RNA, 63 nt, Homo Sapiens
ugcguguucguauuuuuccagaauucagguuuugagacugagacugccgccuaagcuuuacug

SEQ ID NO: 734244 - RNA, 63 nt, Homo Sapiens
aauuuaacaauaaguaaaaacauuguacaauuugagacugaguuugucauaucuguuuucaag

SEQ ID NO: 734245 - RNA, 63 nt, Homo Sapiens
aucaagagggaagaggugagggacuggaaagcugagacugaaauauugcugguuugggggagg

SEQ ID NO: 734246 - RNA, 63 nt, Homo Sapiens
cuuuguuuuuauuuuaauauuacuucuugugaagagacugaaaaaaauucagagaauauaaau

SEQ ID NO: 734247 - RNA, 63 nt, Homo Sapiens
ugugacugcgggcuggggggugcagcaggauuggagacugacuauuugaagagcuaaagaguc

SEQ ID NO: 734248 - RNA, 63 nt, Homo Sapiens
auugugucuccacagcagaggcucacagaugcagagacugacaaaaguggcauuaugucuguu

SEQ ID NO: 734249 - RNA, 63 nt, Homo Sapiens
ucuuccugcugacagcuggauguggaggcaguggagacugacugacagcguggcagcggagac

SEQ ID NO: 734250 - RNA, 63 nt, Homo Sapiens
agccgccagcugggagcacuucgcccagcaggagagacugagcauagccccggccccccgcgc

SEQ ID NO: 734251 - RNA, 63 nt, Homo Sapiens
cagcccucuggcugaggacaaccggcgcugcuggagacugaccgcaagaaggagcuggcaagg

SEQ ID NO: 734252 - RNA, 63 nt, Homo Sapiens
acugagggcaggagcaagggccaggacgguucugagacugaaccucgggaugccacucugugc

SEQ ID NO: 734253 - RNA, 63 nt, Homo Sapiens
agaggaacaggugucagauauaagccucccuaagagacugaaguagcacaccugagacagauu

SEQ ID NO: 734254 - RNA, 63 nt, Homo Sapiens
gaauuggaaugcugaagacuaacgaagaaacuagagacugauaucgagcauucugcccaccuc

SEQ ID NO: 734255 - RNA, 63 nt, Homo Sapiens
aauaaacaaaauuaaaaagaaaaaaaaauaccugagacugaguaacuuauaaagaaaagaggu

SEQ ID NO: 734256 - RNA, 63 nt, Homo Sapiens
gcuggccuugaaaugauucccccacuuccuggagagacugagcggaguugggagccuuuuuag

SEQ ID NO: 734257 - RNA, 63 nt, Homo Sapiens
uccauauuaaguuuagauuuucaguuaauuuuugagacugaguaguauucuuggauacaggcu

SEQ ID NO: 734258 - RNA, 63 nt, Homo Sapiens
cccacacccauugagucauucacaggcaggagggagacugaucauuccucuggguuaucugca

SEQ ID NO: 734259 - RNA, 63 nt, Homo Sapiens
uaaaagauacuuaggcacuuuuuuuuuuuuuuugagacugaguuucgcucuugucauccuggc

SEQ ID NO: 734260 - RNA, 63 nt, Homo Sapiens
ucccagaacaaagaacuugggagaacaguacgggagacugagcagaaaggauggguuugcuga

SEQ ID NO: 734261 - RNA, 63 nt, Homo Sapiens
aauacuuuuuaauuuuuuuaacuuaaaauucaagagacugaaucacuuuucucauugauuaaa

SEQ ID NO: 734262 - RNA, 63 nt, Homo Sapiens
ugauuaaugaucagugugguacguuaguccuuugagacugacauaauacaaaauguacauaaa

SEQ ID NO: 734263 - RNA, 63 nt, Homo Sapiens
gaaguuagagagguggaggagcaggucacugcagagacugaugagccagaggagcacaggcgg

SEQ ID NO: 734264 - RNA, 63 nt, Homo Sapiens
caggaaaaugaacuuaaucaagaggugauuggggagacugacaucccugcccaccagaaacuc

SEQ ID NO: 734265 - RNA, 63 nt, Homo Sapiens
aucuaaaaugggcagccuccaagacagaaugaagagacugagccucacagccccagggagcag

SEQ ID NO: 734266 - RNA, 63 nt, Homo Sapiens
cauagccagcuucaaaagcguaagagugcagcagagacugaggaauacccagcugcuucuggc

SEQ ID NO: 734267 - RNA, 63 nt, Homo Sapiens
ucgauauuaauuccugcaaauuugaaggagcaggagacugaaacgccaucgucaaagagaaac

SEQ ID NO: 734268 - RNA, 63 nt, Homo Sapiens
aagggcagagccagaagcaacugccucugaggggagacugaggcacagccuugcccacaaacc

SEQ ID NO: 734269 - RNA, 63 nt, Homo Sapiens
acucagcaccuucagccacgcaucauccuuggagagacugagcaccaguacucuguaaagcau

SEQ ID NO: 734270 - RNA, 63 nt, Homo Sapiens
cuucccagcaauuauaagcacaccagauucagggagacugaccaccaagggauaguguaaaag

SEQ ID NO: 734271 - RNA, 63 nt, Homo Sapiens
ucccagagcugaugcuauuguacuugcacauuggagacugaaaggaaagaagggacuaaaugc

SEQ ID NO: 734272 - RNA, 63 nt, Homo Sapiens
acuauaacuugcccaaauuuuuuuuuuuuuuuugagacugagucucacucugucgccugggcu

SEQ ID NO: 734273 - RNA, 63 nt, Homo Sapiens
agcacaucaggccugguucaccucuggggucacgagacugagucuacaggagcuuugggccug

SEQ ID NO: 734274 - RNA, 63 nt, Homo Sapiens
cuggcuuguuugaccaaagagcccucuuuccacgagacugaagucuggggaggaggcuacagu

SEQ ID NO: 734275 - RNA, 63 nt, Homo Sapiens
caggguacccugacugucccucuguagacuguugagacugaguuccuguugggacagucaguu

SEQ ID NO: 734276 - RNA, 63 nt, Homo Sapiens
aguacaggcucccuaagagaggauggagagggagagacugaauuguuaguaggucuaaacauc

SEQ ID NO: 734277 - RNA, 63 nt, Homo Sapiens
gaacuuaaaauauaucuaaauuuuauaaaauuugagacugagcucuuagugaaguauauucug

SEQ ID NO: 734278 - RNA, 63 nt, Homo Sapiens
gguaaaugggcgaaauccaggccaggagccucagagacugaagcagaacagaguaagacucau

SEQ ID NO: 734279 - RNA, 63 nt, Homo Sapiens
caaccucgucaucauccccacuuuaaaccccaggagacugaaacucaaacaacccugggcaag

SEQ ID NO: 734280 - RNA, 63 nt, Homo Sapiens
gaaaagguuugagaggaauuauaucuaaguugugagacugaguucuauauucuggugaguuaa

SEQ ID NO: 734281 - RNA, 63 nt, Homo Sapiens
acugcuuucccaugcuucuuucggguuguaggggagacugacugccugcucaaggacacuccc

SEQ ID NO: 734282 - RNA, 63 nt, Homo Sapiens
uucucacugcuaucuggggagugauuaccccgggagacugaacugcaggguucaagccuucca

SEQ ID NO: 734283 - RNA, 63 nt, Homo Sapiens
aggcucggaggacccuggaaaacagacgggucugagacugaaauuguuuuaccagcucccagg

SEQ ID NO: 734284 - RNA, 63 nt, Homo Sapiens
agccaaauggaggcuauguguugccagugacaugagacugaacgaucagaacaggaauccaca

SEQ ID NO: 734285 - RNA, 63 nt, Homo Sapiens
ccaagaacagccaguagguuccucgugcaaggggagacugacauuaaucaccucuggcggggg

SEQ ID NO: 734286 - RNA, 63 nt, Homo Sapiens
uggacuaaacccguccucuggggucagaggagagagacugaaugggucacuagagacccuucu

SEQ ID NO: 734287 - RNA, 63 nt, Homo Sapiens
cuagccaggcaccuuaggagucccugcccuccagagacugaucgaggacaacggaacccccuu

SEQ ID NO: 734288 - RNA, 63 nt, Homo Sapiens
ugucucacccagcagccacucagcuucucaagugagacugaccccccaggccccuuuccucug

SEQ ID NO: 734289 - RNA, 63 nt, Homo Sapiens
auauugugcuucacaguagaccaucccucuaaugagacugacccaacuccagcaacuucuucu

SEQ ID NO: 734290 - RNA, 63 nt, Homo Sapiens
cagacuugaccuuucagggcgcuugggaucggugagacugauaaggcugguguaaggagcggg

SEQ ID NO: 734291 - RNA, 63 nt, Homo Sapiens
cuacugguguuuuucugccuauauuagggcaaugagacugaaacuaauaaaauauggaauucc

SEQ ID NO: 734292 - RNA, 63 nt, Homo Sapiens
uuaagugggcacagguggccagucuuggcuuuugagacugaaguuguauguuuuggaaggcaa

SEQ ID NO: 734293 - RNA, 63 nt, Homo Sapiens
uguuagcaggugugcuuagcaucagguuuguaggagacugaguauuuguuuugcuggagaaac

SEQ ID NO: 734294 - RNA, 63 nt, Homo Sapiens
aagaaucaaaggcagagaagguugaggcaucuggagacugagaucuuggccugagcuaugccu

SEQ ID NO: 734295 - RNA, 63 nt, Homo Sapiens
accaguaguaccugcagggugguggaguggggggagacugagggcagcugcaagccucgcaag

SEQ ID NO: 734296 - RNA, 63 nt, Homo Sapiens
uuuaaacuaagaaaaauguuggagagugcaucugagacugauacucugaaauauccuccaaaa

SEQ ID NO: 734297 - RNA, 63 nt, Homo Sapiens
aaaggcucuaguuagggugucauugucauuugagagacugacacacuccuagcagcugguaaa

SEQ ID NO: 734298 - RNA, 63 nt, Homo Sapiens
auuaccuguucucccacugcuaaugacauacccgagacugaguaauuuauaaauaaaagagau

SEQ ID NO: 734299 - RNA, 63 nt, Homo Sapiens
ucagacaagccagcaugucaaacacagguuagagagacugagcuuccagauugcauagccauu

SEQ ID NO: 734300 - RNA, 63 nt, Homo Sapiens
uuggagaaugaaaccugcuccaacagagaucaugagacugaaauuggucagaauuguguccag

SEQ ID NO: 734301 - RNA, 63 nt, Homo Sapiens
augcacagaucaacccacaucugcauggguugugagacugagcauagugagagcaguggugga

SEQ ID NO: 734302 - RNA, 63 nt, Homo Sapiens
guauauccacauuuucauggaaugguacugugggagacugagcaaacacucuuuuggcaacuu

SEQ ID NO: 734303 - RNA, 63 nt, Homo Sapiens
ucuacuuuucucuuuacgcaagauaauuauuuagagacugauuacagucuuucucagauuuuu

SEQ ID NO: 734304 - RNA, 63 nt, Homo Sapiens
ugggaggccgaggugggagaaucacaaggucaggagacugagaccauccuggcuaacaccaug

SEQ ID NO: 734305 - RNA, 63 nt, Homo Sapiens
uaacuuuggugcccaggccaaguagaaugagaugagacugaguuuggccucuggcucgguuuc

SEQ ID NO: 734306 - RNA, 63 nt, Homo Sapiens
ucauccuguuuucucugugaccugauuucagaagagacugauccaaaaauuauaacggcaggg

SEQ ID NO: 734307 - RNA, 63 nt, Homo Sapiens
agacagacgaggcagagacaaaacacugagaaagagacugaaauggaguaauaaaugaaagcc

SEQ ID NO: 734308 - RNA, 63 nt, Homo Sapiens
cuaguuaguguuuugccucaccuaauaggcugggagacugaagacucagcccggguggggcug

SEQ ID NO: 734309 - RNA, 63 nt, Homo Sapiens
ugguggugcacaccuguaaucccagcuacuugggagacugagacaugagaaucgcuugagccu

SEQ ID NO: 734310 - RNA, 63 nt, Homo Sapiens
guugagugaaauggccuuccuguucagcuguuagagacugaagauuguuagggcaccuuagaa

SEQ ID NO: 734311 - RNA, 63 nt, Homo Sapiens
ccaaacuuuucagaugaacuauuguuuaguacagagacugagcaaauacuacaaaauucaacu

SEQ ID NO: 734312 - RNA, 63 nt, Homo Sapiens
aaacaaggacugcagccuaaauuccaaauaccagagacugaaauuuucagccuugcuaaggga

SEQ ID NO: 734313 - RNA, 63 nt, Homo Sapiens
gggcuuucuccuucuguggccccggaggaaggagagacugaggcaaggcaaagugauaguaca

SEQ ID NO: 734314 - RNA, 63 nt, Homo Sapiens
agacccugcugcuuugggagccugacuugggaggagacugagguuugaggacgacugugacag

SEQ ID NO: 734315 - RNA, 63 nt, Homo Sapiens
cagcuugggggucagguaggacaccuuagcgcugagacugagcuguccggacccuuccauagu

SEQ ID NO: 734316 - RNA, 63 nt, Homo Sapiens
ugggaggaucccuggagccccccagcucccaaggagacugagacaugguggcacaugccuacu

SEQ ID NO: 734317 - RNA, 63 nt, Homo Sapiens
uuccggcauucuuacuaauacaccaggcugcaugagacugaccuuuguuuguuuguuuuauuu

SEQ ID NO: 734318 - RNA, 63 nt, Homo Sapiens
ugcuaucuucucuggacuagugagggcucuugcgagacugaagcuucgagccagaaaggggca

SEQ ID NO: 734319 - RNA, 63 nt, Homo Sapiens
gcaugugauggcucaggcugagggggagguuaggagacugauacaagcccugucuuaaggccc

SEQ ID NO: 734320 - RNA, 63 nt, Homo Sapiens
cccugaccaauucaccugaugucaggcucgagggagacugaucuggggcugucccagccguaa

SEQ ID NO: 734321 - RNA, 63 nt, Homo Sapiens
gagagagccagguggaaugcggcucugcuaguagagacugauggcucugggucauuugggagu

SEQ ID NO: 734322 - RNA, 63 nt, Homo Sapiens
uaagucauagguggccuuagccacucagaggcagagacugaguacuguggcagagaaaguccu

SEQ ID NO: 734323 - RNA, 63 nt, Homo Sapiens
ucuggucaccuguucauuccucggagggggccagagacugagcagcacagaggcuccccggac

SEQ ID NO: 734324 - RNA, 63 nt, Homo Sapiens
agaaugauagagagugaagcuugaaugaguauugagacugagggacaaggccagagggugcga

SEQ ID NO: 734325 - RNA, 63 nt, Homo Sapiens
aggugaaacugaaaauaaaaaaauaagaaagcugagacugaggacaaacggggccagcucuua

SEQ ID NO: 734326 - RNA, 63 nt, Homo Sapiens
cggaucaccugaggucaggacccagcacuuugggagacugaggugguggcucacgcuugugau

SEQ ID NO: 734327 - RNA, 63 nt, Homo Sapiens
cuugauuuaucaugagagaagaggagagagagagagacugagcgcuaggaguguguguaugug

SEQ ID NO: 734328 - RNA, 63 nt, Homo Sapiens
aaucucuuuguaccuacaguugaagcuaauguugagacugagacuuacgaaacugugaauccc

SEQ ID NO: 734329 - RNA, 63 nt, Homo Sapiens
uaauaacaaagacuuaaauggcuuuucucccuagagacugaaacuaguauucauuguguucag

SEQ ID NO: 734330 - RNA, 63 nt, Homo Sapiens
agagacagaaacagagagagacagagacagagagagacugagggagagacucugaggacaugg

SEQ ID NO: 734331 - RNA, 63 nt, Homo Sapiens
ccagugaaguaggaagaaaguaaucuagcaaaggagacugagggaggauggaaaggggcagag

SEQ ID NO: 734332 - RNA, 63 nt, Homo Sapiens
uaaauuguauaguuacuuaaucuacauuaaaaagagacugaaaaucuuauuacaaagugauuu

SEQ ID NO: 734333 - RNA, 63 nt, Homo Sapiens
cuugcucugucgcccaggcuauuuauuuauuuugagacugaguuauuuuauuuuauuuuauuu

SEQ ID NO: 734334 - RNA, 63 nt, Homo Sapiens
uaugccauuaucucuuuuccgcgaaagagacgugagacugacacacccauuucauugcucgcu

SEQ ID NO: 734335 - RNA, 63 nt, Homo Sapiens
caaagaacaauggucucuuuccacagcaacacagagacugauucuucugccuuaccguguuuc

SEQ ID NO: 734336 - RNA, 63 nt, Homo Sapiens
gggagugggggcugcuagaggggauuaguuccggagacugagacuguuggcuccaccuccaag

SEQ ID NO: 734337 - RNA, 63 nt, Homo Sapiens
gacucuauccugggccuacuaaacuucuguuuggagacugacccuuguguauaaagacgggag

SEQ ID NO: 734338 - RNA, 63 nt, Homo Sapiens
cacaaaauguagcgggauuuuuaaggaaucagagagacugaaaaaaaaaaaaaaauuaaugau

SEQ ID NO: 734339 - RNA, 63 nt, Homo Sapiens
uuguguauugucaauacuuaauugggggugggagagacugagcuacacuacugcuaaacuauu

SEQ ID NO: 734340 - RNA, 63 nt, Homo Sapiens
agagcauuggcugaagcccauuccauacccugggagacugaggccccucccuagaggugccca

SEQ ID NO: 734341 - RNA, 63 nt, Homo Sapiens
cagagaagacaagugaaagcucgggcucuucaggagacugagagguggggagacuugacuucc

SEQ ID NO: 734342 - RNA, 63 nt, Homo Sapiens
gcaggagaauguacaacagugucacuuguuaacgagacugauauucaacaggcuucuaagaau

SEQ ID NO: 734343 - RNA, 63 nt, Homo Sapiens
gaugggaacguaacacuuauuuuuauauaaaaagagacugaguaaacaaacauuauagaaaaa

SEQ ID NO: 734344 - RNA, 63 nt, Homo Sapiens
caacgcaugcgguauaguggagugggaagaguugagacugaaaguuaagagaaggguuuucaa

SEQ ID NO: 734345 - RNA, 63 nt, Homo Sapiens
ccgccaugacaucuucaccuugcagcuugugcugagacugacccaagugcagcuagcacuggg

SEQ ID NO: 734346 - RNA, 63 nt, Homo Sapiens
uuugggggcuugggagucccuuuguccucaucugagacugaaauguggggauccaggauggcc

SEQ ID NO: 734347 - RNA, 63 nt, Homo Sapiens
ccaaggcugagugucccaguuuuaucugcuccugagacugagcccagauccccaaaucuaauc

SEQ ID NO: 734348 - RNA, 63 nt, Homo Sapiens
uguagucuuuguuuuuuucuuuuuuuuuuuuuugagacugagucucauucuaucacccaggcu

SEQ ID NO: 734349 - RNA, 63 nt, Homo Sapiens
guucagcucuugcaacguuuacuggacaugggagagacugaccucaugcuggcggcucugcgu

SEQ ID NO: 734350 - RNA, 63 nt, Homo Sapiens
ggccgugaugggaaugacagaggagggaguggagagacugacuccguccucgagccaggcggg

SEQ ID NO: 734351 - RNA, 63 nt, Homo Sapiens
gccucagccucucacccccucccaagcagaagggagacugaguccaaugggacugugcaagca

SEQ ID NO: 734352 - RNA, 63 nt, Homo Sapiens
auguguucuuuuuuccaggaagaaauugugugugagacugaguaagagggucugugagccccc

SEQ ID NO: 734353 - RNA, 63 nt, Homo Sapiens
auuccgcuuuuucuuucuuaaauauuugauaaugagacugaucaucucaucagggcugugcug

SEQ ID NO: 734354 - RNA, 63 nt, Homo Sapiens
aucuuugcagcaggauaggcucuagggacaaaggagacugaacguuucucauuuuuauaccag

SEQ ID NO: 734355 - RNA, 63 nt, Homo Sapiens
gcuuugcagguagcaguaguucacuagucauuugagacugacauacuuuuuauuuccuuucau

SEQ ID NO: 734356 - RNA, 63 nt, Homo Sapiens
cuggugucuuuagucauuaaucuauaaaauaaugagacugauuuucugaauaaauauaaugug

SEQ ID NO: 734357 - RNA, 63 nt, Homo Sapiens
cacaaacugucacuugguuaugacagccauugugagacugaugucuucugcccucauuucaug

SEQ ID NO: 734358 - RNA, 63 nt, Homo Sapiens
gccaggcaagugggaccaggacucugagauguggagacugaugcaagccagggaugaagaaag

SEQ ID NO: 734359 - RNA, 63 nt, Homo Sapiens
uuugaaacuagugguuuuuaaucuucaaaaucagagacugagcuauggcguauaucuugguuc

SEQ ID NO: 734360 - RNA, 63 nt, Homo Sapiens
agccagugcucccuccuuucauguacuuggccugagacugaccucucccuagguccaaaugcc

SEQ ID NO: 734361 - RNA, 63 nt, Homo Sapiens
uccucuggaaaugcccacagggcuugccgcguggagacugaucuguuccauccguuagcgcga

SEQ ID NO: 734362 - RNA, 63 nt, Homo Sapiens
ggccucaugggaauuugaccuugacuagaaauagagacugagagugagcaaccagcuggaagg

SEQ ID NO: 734363 - RNA, 63 nt, Homo Sapiens
aaucagcgcuggcaauuuuugacagucucuacggagacugaauaagaaaaaagaaaagaaaag

SEQ ID NO: 734364 - RNA, 63 nt, Homo Sapiens
guauuuuugaaagcacuuucaccucuggcccaggagacugacccaaagugaaggacauugccg

SEQ ID NO: 734365 - RNA, 63 nt, Homo Sapiens
acaccaaauggacaggccuggcauguacccacagagacugagaguuggugcuggugguugugg

SEQ ID NO: 734366 - RNA, 63 nt, Homo Sapiens
ccgucugguuuccaucccaccacuccaaggacugagacugaccuccucuggugacacuggccu

SEQ ID NO: 734367 - RNA, 63 nt, Homo Sapiens
uggggcaggauucucugcagcccauucccaagggagacugaccaucaugcccucucucgggag

SEQ ID NO: 734368 - RNA, 63 nt, Homo Sapiens
gcagccccaccccgagcgcacacugugauggaggagacugagcucccuggggcgggcagcuga

SEQ ID NO: 734369 - RNA, 63 nt, Homo Sapiens
cacucuugcuguggugcuacguggaagugaauggagacugaucucaaaucugaacugcagcuu

SEQ ID NO: 734370 - RNA, 63 nt, Homo Sapiens
auuggucacuguaaagcagucgggaagacgacagagacugaagaucuucuucggaggaucacc

SEQ ID NO: 734371 - RNA, 63 nt, Homo Sapiens
acugaacuagagcuugcagugaaguguucugcugagacugagcaccuuacagauauuuuucuc

SEQ ID NO: 734372 - RNA, 63 nt, Homo Sapiens
ugguggcgcaugccuguaaucccagcuacuugggagacugaggcaagagaaucacuugaaccc

SEQ ID NO: 734373 - RNA, 63 nt, Homo Sapiens
gcucauggguggacuaacaccugguuugguacagagacugagaaguuuuucauucugguguca

SEQ ID NO: 734374 - RNA, 63 nt, Homo Sapiens
agggaguguggagagcuccuggugucgaggacugagacugagaggggagcccccuccaucugg

SEQ ID NO: 734375 - RNA, 63 nt, Homo Sapiens
agugacagugacacccacacccacaguaaagaggagacugaaugagacuggccuggcugcauc

SEQ ID NO: 734376 - RNA, 63 nt, Homo Sapiens
uugugaaggucucucugccugucggcuggggcagagacugaaauacugccaccuaccuuuggc

SEQ ID NO: 734377 - RNA, 63 nt, Homo Sapiens
guuuuagacgaggccacagcugccaucgaccuggagacugacaaccucauccaggcuaccauc

SEQ ID NO: 734378 - RNA, 63 nt, Homo Sapiens
uaaucauuagguuuuagauuuccuuuagcagcagagacugacuugcuguauagagggaaguca

SEQ ID NO: 734379 - RNA, 63 nt, Homo Sapiens
guguuggugggugccuguaauccagcuacuugggagacugaggcaggagaauugcuugaaccc

SEQ ID NO: 734380 - RNA, 63 nt, Homo Sapiens
agagacacaccuggcccucagggggcugagcuggagacugagcuggggcuggccgggacguga

SEQ ID NO: 734381 - RNA, 63 nt, Homo Sapiens
aaggccuggaggcaggggcacggaaccacaagagagacugaggauaucuaucuaucuauacag

SEQ ID NO: 734382 - RNA, 63 nt, Homo Sapiens
cacaagaucuguuugugaaaugccuccacccaggagacugaugacaagucagccccuucuacc

SEQ ID NO: 734383 - RNA, 63 nt, Homo Sapiens
ucccagaacauuguuugccacugauuucucugugagacugaaaggucacagcgugacugaaag

SEQ ID NO: 734384 - RNA, 63 nt, Homo Sapiens
caggccuaccagucccuggcacagagugggagggagacugauggcccuuuguggggucaggac

SEQ ID NO: 734385 - RNA, 63 nt, Homo Sapiens
ccccagugugcgcagcucgagucacugacucuggagacugaagaggcgacccucauggggaag

SEQ ID NO: 734386 - RNA, 63 nt, Homo Sapiens
gcuuucagaugaacagaauugaucaaauuguuagagacugaaacgaacuacaguugaauaccu

SEQ ID NO: 734387 - RNA, 63 nt, Homo Sapiens
ccugaugcugagcaugcugcgcugccuaauaaagagacugagcgcugggcuacccccccuccu

SEQ ID NO: 734388 - RNA, 63 nt, Homo Sapiens
aaguuccccggagcaggacuagccgggacacuggagacugaagaagcaucacugaacuugccc

SEQ ID NO: 734389 - RNA, 63 nt, Homo Sapiens
uuuuguuucaucugcauuugacccagaacuuaagagacugauucagaacaccuuuccuuucuc

SEQ ID NO: 734390 - RNA, 63 nt, Homo Sapiens
ugugcagguucuucuauguuucauguccaaugggagacugaagucauucagauagaaaaguga

SEQ ID NO: 734391 - RNA, 63 nt, Homo Sapiens
ugguguugcugaaaggggaggcugagccagugcgagacugaacuugugcagccuuagccaaga

SEQ ID NO: 734392 - RNA, 63 nt, Homo Sapiens
ucugagcagccugcguggccgucuggaguccgugagacugaaaggacccgugcaucuuacugu

SEQ ID NO: 734393 - RNA, 63 nt, Homo Sapiens
ccugccauuuccacccuccagucauuucucuaugagacugaagcaggaaggcagagcaucauc

SEQ ID NO: 734394 - RNA, 63 nt, Homo Sapiens
gcuacucaggacacugacguaggaggguugcuugagacugagaguuggaggcugcgaugagcc

SEQ ID NO: 734395 - RNA, 63 nt, Homo Sapiens
ugacguggaucauaaugaguugccuggaaaguggagacugagagcggugggacagggacacuu

SEQ ID NO: 734396 - RNA, 63 nt, Homo Sapiens
ggcaaucuuuccacacuguggagacacagcccagagacugaaccaaagcaguauguacaggcu

SEQ ID NO: 734397 - RNA, 63 nt, Homo Sapiens
ggcgcagccgcggcgggcgaggccaauggaaaggagacugaggggagucccggcagugagccc

SEQ ID NO: 734398 - RNA, 63 nt, Homo Sapiens
aacccacgaggaccaucgggggcagagucguuggagacugaagaggaagaggaggaggagaag

SEQ ID NO: 734399 - RNA, 63 nt, Homo Sapiens
ggaggguccagacuguccacucggggguggagugagacugacugcaagccccacccuccuuga

SEQ ID NO: 734400 - RNA, 63 nt, Homo Sapiens
cucagggagggucauccuccauguuuugaagaagagacugagguucagagaggauaagaggcg

SEQ ID NO: 734401 - RNA, 63 nt, Homo Sapiens
ugguggcuggcgccuguaaucccagcuacucaggagacugaggcagaaggaucgcuugaaccu

SEQ ID NO: 734402 - RNA, 63 nt, Homo Sapiens
agauucuuuuguuuguuuguucguuuguuuuuugagacugaguuucacucuuucgcccaggcu

SEQ ID NO: 734403 - RNA, 63 nt, Homo Sapiens
uguguauuuuuugugugccugggcuggagaugagagacugagucauaacugauuuaaaaguuu

SEQ ID NO: 734404 - RNA, 63 nt, Homo Sapiens
cgguggcucacgcuugcaaucccagugcuuugggagacugaggcaggaggaucacuuaaggcc

SEQ ID NO: 734405 - RNA, 63 nt, Homo Sapiens
cguuggggacaugagauuuuauuuuuugugagugagacugagggaucguagauuuuuacaauc

SEQ ID NO: 734406 - RNA, 63 nt, Homo Sapiens
augcagcuccaagccauuguauggcccaugugggagacugaugggacauggagaaugacagua

SEQ ID NO: 734407 - RNA, 63 nt, Homo Sapiens
ugugaggggacagcagcccuuggugcaaagccagagacugauccuggcucugacggcugaaga

SEQ ID NO: 734408 - RNA, 63 nt, Homo Sapiens
auuucuuuuucuuuuucuuuuuuuuuuuuuuuugagacugagucucgcucugccgcccaggcu

SEQ ID NO: 734409 - RNA, 63 nt, Homo Sapiens
cccaguccugccuuccaccccccaaccaggccugagacugaucaaacaauaaacacguuuccc

SEQ ID NO: 734410 - RNA, 63 nt, Homo Sapiens
auucccucuaugucaagaguaaauagaggcacagagacugaugagaaacguucauaacaugaa

SEQ ID NO: 734411 - RNA, 63 nt, Homo Sapiens
agagagggccacauaucgugugccagaggcugagagacugagagggaugacaggcuuagggga

SEQ ID NO: 734412 - RNA, 63 nt, Homo Sapiens
aggcggaaacuuccauguguaggcguuugcucugagacugacaccuguacuguaaagacuaaa

SEQ ID NO: 734413 - RNA, 63 nt, Homo Sapiens
auccaaccacaggaucccuaaccucagccacuggagacugaugcccaaucccucaccccccac

SEQ ID NO: 734414 - RNA, 63 nt, Homo Sapiens
aagcagagccuguaucauggggcucugaggugagagacugaagucucuguggcaaccgcaggu

SEQ ID NO: 734415 - RNA, 63 nt, Homo Sapiens
aaaccaccucuggcccauguccccucucuuauggagacugaaugacccaacugugccguuugu

SEQ ID NO: 734416 - RNA, 63 nt, Homo Sapiens
auccaggccucagccucaucaugaaaccaaaaagagacugaucuuucuguuuuuuaaaugauc

SEQ ID NO: 734417 - RNA, 63 nt, Homo Sapiens
acuagucccuugcggucacgcugcaucucacuggagacugaacagagaccggccguacaccuu

SEQ ID NO: 734418 - RNA, 63 nt, Homo Sapiens
ggugcagagugugagcuggguucuuuagcagcagagacugaggccccaucuaccugagucuga

SEQ ID NO: 734419 - RNA, 60 nt, Homo Sapiens
caguuguuucuguuuacauggauuuuuguagagacugaagagcccucgaagccacaauga

SEQ ID NO: 734420 - RNA, 63 nt, Homo Sapiens
cagaauauugaauucagaaacagucauaaaacugagacugagaaaaauuauuuguuguugaag

SEQ ID NO: 734421 - RNA, 63 nt, Homo Sapiens
acgucugaacccacucaucaauagugaauagaugagacugacacagugaagguugugaacuuu

SEQ ID NO: 734422 - RNA, 63 nt, Homo Sapiens
aaacaucaauacuagagcccguuuuauaaaauugagacugauguuauuacaaaguaaaggaug

SEQ ID NO: 734423 - RNA, 63 nt, Homo Sapiens
ccauccuggcuaacacggugaucacgaggucaggagacugagaugggaggccgagacgggcgg

SEQ ID NO: 734424 - RNA, 63 nt, Homo Sapiens
ccuuuagaauuaacagcccuagcaaagaagcccgagacugauuugagggcucacgaccccugc

SEQ ID NO: 734425 - RNA, 63 nt, Homo Sapiens
uugcuggacagaaagugaucugccuaggagugugagacugaugacuaacgguagaaaaguuau

SEQ ID NO: 734426 - RNA, 63 nt, Homo Sapiens
ucugguuugggagagaccaucgacuuggccagugagacugagaauggauuccgaguagugaug

SEQ ID NO: 734427 - RNA, 63 nt, Homo Sapiens
gggcaggggccaccagccuccccuucuuguggugagacugaauuuugggcucagacaccagca

SEQ ID NO: 734428 - RNA, 63 nt, Homo Sapiens
uugcaaagcccuccccugucccaggacaaagcugagacugacgggugauguugcucauaggcu

SEQ ID NO: 734429 - RNA, 63 nt, Homo Sapiens
gucacgugauccaaacuuuuuuucaguaauauggagacugagcugcaugguaguuggggauca

SEQ ID NO: 734430 - RNA, 63 nt, Homo Sapiens
guaaaccacagacgcucucccauccaucgccuugagacugaccucuaaacacaccaggacucc

SEQ ID NO: 734431 - RNA, 63 nt, Homo Sapiens
aaaagcaauguacuguacauaacacuggaaaaagagacugaaaggaacccuguucuacugcaa

SEQ ID NO: 734432 - RNA, 63 nt, Homo Sapiens
caggagucuuccggagucagagacauguugagagagacugagacacuugccccuaaguccuuc

SEQ ID NO: 734433 - RNA, 63 nt, Homo Sapiens
acuuggggaggcaagagacugcuaggcgcuggggagacugauaggaccuccuuagcccugucu

SEQ ID NO: 734434 - RNA, 63 nt, Homo Sapiens
cuuagagagaggaggcagcccuuccaggauaaggagacugaggggaaacuguugugggcgcug

SEQ ID NO: 734435 - RNA, 63 nt, Homo Sapiens
ccacuggaguggcuggcuuucacauccaauaaagagacugauauuacagucccuuuuggcccu

SEQ ID NO: 734436 - RNA, 63 nt, Homo Sapiens
uuaucaauaaucuaaccgacuggaaacuugucugagacugacuucuaguuaaauagcacaguu

SEQ ID NO: 734437 - RNA, 63 nt, Homo Sapiens
cgaagccagcagaggucagaagaugagauccgggagacugacacagccugcucuggagccugc

SEQ ID NO: 734438 - RNA, 63 nt, Homo Sapiens
agaagucuugggaccagaaaauggcaaugauaggagacugacauagaagaagaaugcuucccu

SEQ ID NO: 734439 - RNA, 63 nt, Homo Sapiens
aaccuauuugcuugauuaccaaaauagaucuaugagacugaaauuuaagucuuugaucgaagg

SEQ ID NO: 734440 - RNA, 63 nt, Homo Sapiens
cgggcggaucaugaggucagcccagcacuuugggagacugaggcuguggcucacgccugcaau

SEQ ID NO: 734441 - RNA, 63 nt, Homo Sapiens
ccauaaauuuccaggaucagacuaacggcuaaagagacugaugcaucaacaccaggcagagaa

SEQ ID NO: 734442 - RNA, 63 nt, Homo Sapiens
uucaggaaaauuacauccucccauggaggaugagagacugaggcucagggagggcaaggaaua

SEQ ID NO: 734443 - RNA, 63 nt, Homo Sapiens
ggaguggaggcagccugcagaggaagggugcgggagacugagccggcaguggcuugcuuggag

SEQ ID NO: 734444 - RNA, 63 nt, Homo Sapiens
accaccaccaugccuccaccugacuuuggcuuggagacugauccucucuguguaaauucugcc

SEQ ID NO: 734445 - RNA, 63 nt, Homo Sapiens
gggucgcucuuugggggaaauaagagugugagagagacugauguuaacuccaagaacuuggga

SEQ ID NO: 734446 - RNA, 63 nt, Homo Sapiens
guccccagccccaccuggcggcaaagugaugaggagacugagcacacaccuguaucccagaga

SEQ ID NO: 734447 - RNA, 63 nt, Homo Sapiens
uggaauuuguaaauuuacauuuuuuuuaaagaagagacugauguguagauagaaaacccuuuu

SEQ ID NO: 734448 - RNA, 63 nt, Homo Sapiens
gaagugugaggaaaugcagauguacgugacaaugagacugaccuuucucaggaauauuuggag

SEQ ID NO: 734449 - RNA, 63 nt, Homo Sapiens
ugggaggaucgcuugagacccccagcacuuugggagacugagaugguggcucaugccuguaau

SEQ ID NO: 734450 - RNA, 63 nt, Homo Sapiens
cuugagugaacugaaggcaagaaauggguaugagagacugaggcugcaaucauuguacagggg

SEQ ID NO: 734451 - RNA, 63 nt, Homo Sapiens
uugauucuaaaggggacagauuggaacauuugggagacugagcgccuauggaaaggguguggc

SEQ ID NO: 734452 - RNA, 63 nt, Homo Sapiens
uguuuaauauauaguuuaaaguaacaaauaaucgagacugaaagaauguuaagauuuaucugc

SEQ ID NO: 734453 - RNA, 63 nt, Homo Sapiens; identical to SEQ ID NO: 734452

SEQ ID NO: 734454 - RNA, 63 nt, Homo Sapiens
gaaaauggacugaaguuucuggagcccuugucugagacugaaccuccugagaaggggccccua

SEQ ID NO: 734455 - RNA, 63 nt, Homo Sapiens
ugaugcugccccaagcccagaaagacagaggcagagacugaagcacaaagcaggaggccacau

SEQ ID NO: 734456 - RNA, 64 nt, Homo Sapiens
gagccagcuggcgugucgggaaggauccaggaucugcaaacacaacugcucaggccuucucacg

SEQ ID NO: 734457 - RNA, 64 nt, Homo Sapiens
guuuucucuuuggugguuucuaaagugccuuaucugcaaacaacuucuuuucuccuucaggaac

SEQ ID NO: 734458 - RNA, 64 nt, Homo Sapiens
uggccuccauucucuugggggagucuuggcacuuugcaaacauccuggccaccaugggcaccag

SEQ ID NO: 734459 - RNA, 64 nt, Homo Sapiens
ccagcccccauacugacagacggacagacagacaugcaaacaccagacugaagcacauguaaua

SEQ ID NO: 734460 - RNA, 64 nt, Homo Sapiens
ugggcaauauccuucacuuuacuacaguuacuuuugcaaacagacagaaaggauacacuucuaa

SEQ ID NO: 734461 - RNA, 64 nt, Homo Sapiens
augaacugaauaaagcuucuguuguagcaugccaugcaaacacauuauuguguuugugguugau

SEQ ID NO: 734462 - RNA, 64 nt, Homo Sapiens
aauuacagcaguuucaaaacucuaccauggauaaugcaaacaaaccgaagcuacaugccaauga

SEQ ID NO: 734463 - RNA, 64 nt, Homo Sapiens
gugucugugagaggcagcuaucugcacucuaaacugcaaacagaaaucagguguuuuaagacug

SEQ ID NO: 734464 - RNA, 64 nt, Homo Sapiens; identical to SEQ ID NO: 55124

SEQ ID NO: 734465 - RNA, 64 nt, Homo Sapiens; identical to SEQ ID NO: 55125

SEQ ID NO: 734466 - RNA, 64 nt, Homo Sapiens; identical to SEQ ID NO: 55126

SEQ ID NO: 734467 - RNA, 64 nt, Homo Sapiens; identical to SEQ ID NO: 55127

SEQ ID NO: 734468 - RNA, 64 nt, Homo Sapiens
aacagccuaauuuugagugucugugucuuagaccugcaaacagcuaauaggaaauucuauuaau

SEQ ID NO: 734469 - RNA, 64 nt, Homo Sapiens
aguguugcagggagguguuaagaagagaacucugugcaaacagugauggaaggcuguugucuug

SEQ ID NO: 734470 - RNA, 64 nt, Homo Sapiens
ugaaucacugcaggcuguguucuugcaucuugucugcaaacaggucccugccuuuuuagaagca

SEQ ID NO: 734471 - RNA, 64 nt, Homo Sapiens
uugguuuuaaaaccaauacaccauacuuucuuucugcaaacagccaucuuuauacuuagggaag

SEQ ID NO: 734472 - RNA, 64 nt, Homo Sapiens
gguacugugugguggauacaugacaauauccauuugcaaacacaagaacuauacacauggccag

SEQ ID NO: 734473 - RNA, 64 nt, Homo Sapiens; identical to SEQ ID NO: 55128

SEQ ID NO: 734474 - RNA, 64 nt, Homo Sapiens; identical to SEQ ID NO: 55129

SEQ ID NO: 734475 - RNA, 64 nt, Homo Sapiens
ugccucaguuccucucaaaagcacuaaaucuaagugcaaacaaguauucauuuucauacaggaa

SEQ ID NO: 734476 - RNA, 64 nt, Homo Sapiens
cauuuuuuguucugugucccuucagauguuuauuugcaaacaaccaggucagcuguuacuuucu

SEQ ID NO: 734477 - RNA, 64 nt, Homo Sapiens
caaaggaugugagaguuuuuaaguuaugaugaacugcaaacaucguugcggaaagguaaccaca

SEQ ID NO: 734478 - RNA, 64 nt, Homo Sapiens
uaaaaucaaaaaagaccaucuauagccauuucagugcaaacaagucuucaauaaaaucuuucua

SEQ ID NO: 734479 - RNA, 64 nt, Homo Sapiens
uugguucgugcuucccuuuaucccagaagagcccugcaaacacagcaaaaccaagagcuguucu

SEQ ID NO: 734480 - RNA, 64 nt, Homo Sapiens
cccucagggccaggcaauguucuacaagaaguuuugcaaacagagugaguguucagaaauuaga

SEQ ID NO: 734481 - RNA, 64 nt, Homo Sapiens
uuaucauucuaaauggugacccucuuucauagugugcaaacauuauguggcaacauucugucag

SEQ ID NO: 734482 - RNA, 64 nt, Homo Sapiens
accuaaauaggcuggcaagauuaucuggaagaucugcaaacauucugcuuuuggugcucucacc

SEQ ID NO: 734483 - RNA, 64 nt, Homo Sapiens
ucuuggaccccugaauucaacuaaugauauuuuaugcaaacaguccuuugaccaucucuuaggu

SEQ ID NO: 734484 - RNA, 64 nt, Homo Sapiens
gaaaagccccuucacuucugcugcacaggcacugugcaaacaauguuuguuuaacugugagugg

SEQ ID NO: 734485 - RNA, 64 nt, Homo Sapiens; identical to SEQ ID NO: 55130

SEQ ID NO: 734486 - RNA, 64 nt, Homo Sapiens; identical to SEQ ID NO: 55131

SEQ ID NO: 734487 - RNA, 64 nt, Homo Sapiens
caaagguauaauuuuaugaaaauaaaagcauaaaugcaaacacagaggccaaacguuuugaacu

SEQ ID NO: 734488 - RNA, 64 nt, Homo Sapiens
uuaaaaacacaguuaaacuacuuuucaauauaauugcaaacaaauaaguaauuaucauugguug

SEQ ID NO: 734489 - RNA, 64 nt, Homo Sapiens
auuaggggauucuucuuuugaguggauguuagccugcaaacaaccccaaccagguugcaguagc

SEQ ID NO: 734490 - RNA, 64 nt, Homo Sapiens
uuagagcuggcagcugaaugugauguuuuaagugugcaaacaaguggcuucuugugcaauaaua

SEQ ID NO: 734491 - RNA, 64 nt, Homo Sapiens; identical to SEQ ID NO: 55132

SEQ ID NO: 734492 - RNA, 64 nt, Homo Sapiens; identical to SEQ ID NO: 55133

SEQ ID NO: 734493 - RNA, 64 nt, Homo Sapiens; identical to SEQ ID NO: 55134

SEQ ID NO: 734494 - RNA, 64 nt, Homo Sapiens; identical to SEQ ID NO: 55135

SEQ ID NO: 734495 - RNA, 64 nt, Homo Sapiens
gugcuaauaugcaaaugaugagacaccagcuguuugcaaacaauauguuccaagcacuuuaggc

SEQ ID NO: 734496 - RNA, 64 nt, Homo Sapiens
gaagaauuauguaauauauuuauauauuaggaucugcaaacaauauagaauaaaagcuauaaag

SEQ ID NO: 734497 - RNA, 64 nt, Homo Sapiens
agcacacucucuucgaacccaagaacuuacagaaugcaaacacggauaggggagggauuaagcu

SEQ ID NO: 734498 - RNA, 64 nt, Homo Sapiens
uuauuggggccuuuuauucuuucccaaagugcuuugcaaacauuaaguuuuagccacuagcugc

SEQ ID NO: 734499 - RNA, 64 nt, Homo Sapiens
uuacagugaccccaucuaaauaaaauacugcuuuugcaaacagaacacuguaauaggguaguuc

SEQ ID NO: 734500 - RNA, 64 nt, Homo Sapiens
uucaccauggcaauauguauuucccuuaaaacacugcaaacaaauauacuaggagugugcccuu

SEQ ID NO: 734501 - RNA, 64 nt, Homo Sapiens
cagccucuaggcuagcggcugcauucguggucugugcaaacacuucgugguucuauauaucagc

SEQ ID NO: 734502 - RNA, 64 nt, Homo Sapiens
auccagagcuauagguacagugugaucucagcuuugcaaacacauuuucuacauagauaguacu

SEQ ID NO: 734503 - RNA, 64 nt, Homo Sapiens
aacuccuuuugucuauaaccaggcccuggcaaagugcaaacaggaugcaacugcaguggcacaa

SEQ ID NO: 734504 - RNA, 64 nt, Homo Sapiens
caaugggguuuucuagauauacagucaugucgucugcaaacagggacaauuugacuuccucuuu

SEQ ID NO: 734505 - RNA, 64 nt, Homo Sapiens
caaguuuaguucuuuuuguagaucauauuaaaauugcaaacaaaaucaucuuuaaugggccagc

SEQ ID NO: 734506 - RNA, 64 nt, Homo Sapiens
ucuucucggagucucauauuuugugggacuccugugcaaacauauguuauuaaaauuuuuuucc

SEQ ID NO: 734507 - RNA, 64 nt, Homo Sapiens
ccuucuuggagucucauauuucguggaacuccugugcaaacauauauuauuaaauuuuuuuucc

SEQ ID NO: 734508 - RNA, 64 nt, Homo Sapiens
uggugaccacacauuugaggcuagagacccuuuuugcaaacauuugugccaaaaagaaaaaaag

SEQ ID NO: 734509 - RNA, 64 nt, Homo Sapiens
aacauguugggaaacuuggcugaccggacuuuucugcaaacaccccucugugcugugugugacg

SEQ ID NO: 734510 - RNA, 64 nt, Homo Sapiens
uuucccauaaagaaaccaaauagcuagcaaucuaugcaaacacccuguuuuccugcacacuaaa

SEQ ID NO: 734511 - RNA, 64 nt, Homo Sapiens
cuuucccuagaggugaaauaaugugggacucaaaugcaaacagaaaaguacagaaaaaagccac

SEQ ID NO: 734512 - RNA, 64 nt, Homo Sapiens
gugcagaugauagcaccuccagcuuugugguucaugcaaacaauuucuuaacuauuuggauuaa

SEQ ID NO: 734513 - RNA, 64 nt, Homo Sapiens
guaaaauacagcgacauguaaguuuacaguuuguugcaaacauucuguugguucaaacuauguu

SEQ ID NO: 734514 - RNA, 64 nt, Homo Sapiens
ggcacacacaugcacacaccuugauguccccaaaugcaaacacauggaucaaaucaaucugcag

SEQ ID NO: 734515 - RNA, 64 nt, Homo Sapiens
gcauuuuuuacaacuuucuuuuuaguccuguaaaugcaaacacauaucuguugcauacuuaguu

SEQ ID NO: 734516 - RNA, 64 nt, Homo Sapiens
cgauugaguugggcuuuaggcagaagcguagaugugcaaacaaguauagcuggaccuaaguucu

SEQ ID NO: 734517 - RNA, 64 nt, Homo Sapiens
acaaaaucacuuccauaguguaaaguguaacauaugcaaacauagccaucauguaaauuaccag

SEQ ID NO: 734518 - RNA, 64 nt, Homo Sapiens
ugcuuauuagagguagugacgcugcugagggcagugcaaacaggagcauggauuaacucauccu

SEQ ID NO: 734519 - RNA, 64 nt, Homo Sapiens
uaaauuaaagagaaaaaaaauaaugaaaauuaucugcaaacacccacacauacagcuacggaua

SEQ ID NO: 734520 - RNA, 64 nt, Homo Sapiens
aaugagugcuugagauaaaagcacuuugggcaaaugcaaacaaccuggccuucggagccagcca

SEQ ID NO: 734521 - RNA, 64 nt, Homo Sapiens
ccaccucaucauagaugggaacuuuuguuuucagugcaaacaauguuggagcuguaauaguaag

SEQ ID NO: 734522 - RNA, 64 nt, Homo Sapiens
agcaaagauguacugggcaguaacuaaacacacaugcaaacaugugaauggugguuuauuccuc

SEQ ID NO: 734523 - RNA, 64 nt, Homo Sapiens
uuuucuuugacaaaaauguguacuguguaagccuugcaaacaaaaaacaacaaaaaagaagcag

SEQ ID NO: 734524 - RNA, 64 nt, Homo Sapiens
ugaugagcuauccauaugaugguucugcagccauugcaaacauuuuuaaagacaauuuaaugcc

SEQ ID NO: 734525 - RNA, 64 nt, Homo Sapiens
uuaauaaauuccauguuauguauaaggaguuaauugcaaacaugcaauugagaaacuggauaga

SEQ ID NO: 734526 - RNA, 64 nt, Homo Sapiens
gcccugaacacacaccuucccuuugcccaggcggugcaaacaauccacuucuucaagcuccaac

SEQ ID NO: 734527 - RNA, 64 nt, Homo Sapiens
augcuagugaguccaagugguggaaaauauagacugcaaacaagugcuuguugccccacacggc

SEQ ID NO: 734528 - RNA, 64 nt, Homo Sapiens
guguuauaaaaugacugugcuuguucguaacagaugcaaacaagaaagaagaacugggaagucu

SEQ ID NO: 734529 - RNA, 64 nt, Homo Sapiens
ggaaauguauaaacuaaaguaagcugauuggcuuugcaaacauguucauuuguuuuucagacag

SEQ ID NO: 734530 - RNA, 64 nt, Homo Sapiens
aauuucagucaugucuucaugcuuucagccucucugcaaacauuuauuuugugugcuagauacu

SEQ ID NO: 734531 - RNA, 64 nt, Homo Sapiens
auuauugguauuaaugugcuuuuuuuguauaaagugcaaacauuucgucccaaagucuaaguac

SEQ ID NO: 734532 - RNA, 64 nt, Homo Sapiens
auucacggaaagcaaguugaugaccagaaaucagugcaaacacaucuucuguuaaacccauugg

SEQ ID NO: 734533 - RNA, 64 nt, Homo Sapiens
auauauauuuuguuucuuuaaauuucaaauguuuugcaaacaucacugaguuaggugggggugg

SEQ ID NO: 734534 - RNA, 64 nt, Homo Sapiens
uuacaauauuauuuuuuuaaccaauguauuuguuugcaaacauuugccauguugaagagugugu

SEQ ID NO: 734535 - RNA, 64 nt, Homo Sapiens
auauguagagcaauaaugcaaaagcuguucuauaugcaaacaugaugucuuuauuauucaggag

SEQ ID NO: 734536 - RNA, 64 nt, Homo Sapiens
ugcccagccugugcgugucaaccccaccgacugcugcaaacaguguccaggugagagagguggc

SEQ ID NO: 734537 - RNA, 64 nt, Homo Sapiens
guguuuguucagcguauucauucacucacucguuugcaaacauaaugggcaguggucauuuacu

SEQ ID NO: 734538 - RNA, 64 nt, Homo Sapiens
cucuuuucugagacuauuuaucuuaggcgggaacugcaaacagauuuuguuuguuuguuuguuu

SEQ ID NO: 734539 - RNA, 64 nt, Homo Sapiens
aucuaagcuuaggaauaauaguuauaaggaucucugcaaacaggcucauuacugaccucucaaa

SEQ ID NO: 734540 - RNA, 64 nt, Homo Sapiens
agccuccacucucccagcuuguaacauggcaucuugcaaacauccugguuccccccagacacga

SEQ ID NO: 734541 - RNA, 64 nt, Homo Sapiens
caagcagucucaccucaggcuggaagcuaccacaugcaaacauauuaaaacugaagauuuccuc

SEQ ID NO: 734542 - RNA, 64 nt, Homo Sapiens
acagggucauguuugcagggaaucuuggagacccugcaaacagaauuuuugucucagaagugaa

SEQ ID NO: 734543 - RNA, 64 nt, Homo Sapiens
guaagcuuagauuuucuguaagauccaaaugcugugcaaacaguugggacucauucacauuuca

SEQ ID NO: 734544 - RNA, 64 nt, Homo Sapiens
aaucauugaaaauacuaugcuucuguuucaucauugcaaacaaaagaugcugcacaaaguuacc

SEQ ID NO: 734545 - RNA, 64 nt, Homo Sapiens
gguguugcauugaauugaacaaaaaacauucuguugcaaacaguuauaauuugucacuacuuau

SEQ ID NO: 734546 - RNA, 64 nt, Homo Sapiens
uaaauauaguacaauguuuuauuaauauauuauaugcaaacauuauauuuuuagugugaaaaac

SEQ ID NO: 734547 - RNA, 64 nt, Homo Sapiens
uuaaaguuucauauauuuacuuguauguuucagaugcaaacauauugacuuuaucuuuaggcuu

SEQ ID NO: 734548 - RNA, 64 nt, Homo Sapiens
uuccaguuacuuaacugaucaaucauucuuuacaugcaaacauuacaagauaaaaaggauagug

SEQ ID NO: 734549 - RNA, 64 nt, Homo Sapiens
guucugugacaaaaaaaaaaccaguuuccucuacugcaaacaguuauaccaccagacugcaaug

SEQ ID NO: 734550 - RNA, 64 nt, Homo Sapiens
agugcacuuuguagcuuuucuccagagggcuguuugcaaacacucaguuccugcacaaaaagug

SEQ ID NO: 734551 - RNA, 64 nt, Homo Sapiens
uaaugaggauacacuguucauuaggaagaaacuuugcaaacauucuguaacuaguuguaagugc

SEQ ID NO: 734552 - RNA, 64 nt, Homo Sapiens
uaauguuugaaauauauaauguguuugguuauuaugcaaacaagcucugaugccugcugucuca

SEQ ID NO: 734553 - RNA, 64 nt, Homo Sapiens
cugacgagagauguauauuuaauuuuuuaacugcugcaaacauuguacauccaaauuaaaggaa

SEQ ID NO: 734554 - RNA, 64 nt, Homo Sapiens
ucuuccuucacucacccagcaggucaguuuucugugcaaacaaaccuguuuaggauucuuccaa

SEQ ID NO: 734555 - RNA, 64 nt, Homo Sapiens
ccauuugcauucuuucuguuugguauuaaaaguuugcaaacaaaaauacauugcaugagccauu

SEQ ID NO: 734556 - RNA, 64 nt, Homo Sapiens
caucuuacucacauccagauuuauuuuccuacagugcaaacacaccagaugaaacuuuaaaaug

SEQ ID NO: 734557 - RNA, 64 nt, Homo Sapiens
gaacuaucacuuuauaagaaucauuuucuaguaaugcaaacaaauuauuuuuuacaaaaaaaca

SEQ ID NO: 734558 - RNA, 64 nt, Homo Sapiens
ccugcuauaaaguuaaagucacacauuucuauuuugcaaacacugugauuacucuuugcuuugu

SEQ ID NO: 734559 - RNA, 64 nt, Homo Sapiens
ugacuuuagcugugugaauauauaauagucaaacugcaaacauuuugcaucccuuuugugaccu

SEQ ID NO: 734560 - RNA, 64 nt, Homo Sapiens
caucuccagguaggaaaaaaugaaagcuauuucaugcaaacauuaucuaauuuagcuuaaaagu

SEQ ID NO: 734561 - RNA, 64 nt, Homo Sapiens
cuuuguuuuaauauaaagcaacugaagcauauuaugcaaacaagcauagauugcucagcuugac

SEQ ID NO: 734562 - RNA, 64 nt, Homo Sapiens; identical to SEQ ID NO: 55136

SEQ ID NO: 734563 - RNA, 64 nt, Homo Sapiens; identical to SEQ ID NO: 55137

SEQ ID NO: 734564 - RNA, 64 nt, Homo Sapiens
uauacauguagauguacauaagugcuugaucacuugcaaacauaucauaugcuuuuuuuaauga

SEQ ID NO: 734565 - RNA, 64 nt, Homo Sapiens
aaaauguaaauauugaaacauucaucuauuuauaugcaaacauauaaaaauauaacauaaucua

SEQ ID NO: 734566 - RNA, 64 nt, Homo Sapiens
uacaauaaagccaucuacuucugauguaaaauugugcaaacacccugaaaacuucuuguauuuc

SEQ ID NO: 734567 - RNA, 64 nt, Homo Sapiens
uugcauuuuuaguaguugaucaaauuugauguuaugcaaacaucacucaaaagcuaaaacugaa

SEQ ID NO: 734568 - RNA, 64 nt, Homo Sapiens
caaaaugaaugaaacagucaguaaaggcgucacaugcaaacaaagaaacuauucaguuuuugua

SEQ ID NO: 734569 - RNA, 64 nt, Homo Sapiens
cacacuuuuccacauuccagugaugugugagcuaugcaaacaaaauccaagauucugcugguga

SEQ ID NO: 734570 - RNA, 64 nt, Homo Sapiens; identical to SEQ ID NO: 55138

SEQ ID NO: 734571 - RNA, 64 nt, Homo Sapiens; identical to SEQ ID NO: 55139

SEQ ID NO: 734572 - RNA, 64 nt, Homo Sapiens
auccaucagcauaaugacuguguguucugagaaaugcaaacaacuuuaugaaaguguggucauc

SEQ ID NO: 734573 - RNA, 64 nt, Homo Sapiens
acuaauuucaguuguacugugaaugcuaaauauuugcaaacaaguacaucuugaaaguaaaggu

SEQ ID NO: 734574 - RNA, 64 nt, Homo Sapiens
ucugggaauaauaaaauugcaaccaguuugguaaugcaaacagcagaauagaaugaaaucucag

SEQ ID NO: 734575 - RNA, 64 nt, Homo Sapiens
aaguacuaccuggagauuucaaauucacuuggccugcaaacaacagaguuauccguaucuucca

SEQ ID NO: 734576 - RNA, 64 nt, Homo Sapiens
uauauguuuucucuguccuaauuuaaaaguacauugcaaacaucaugaaacuugaucccugaaa

SEQ ID NO: 734577 - RNA, 64 nt, Homo Sapiens
cuuuccaaaggggaacuccagagacauuucauaaugcaaacagcacuguugcuuuaagaacaag

SEQ ID NO: 734578 - RNA, 64 nt, Homo Sapiens
uauaauauagguguuuuguagauucuugugucacugcaaacaauaugaacuccuuuuucguauu

SEQ ID NO: 734579 - RNA, 64 nt, Homo Sapiens
agggccccagagcuccugccugagcuggaccuuaugcaaacauuucugugccugcuggguaggg

SEQ ID NO: 734580 - RNA, 64 nt, Homo Sapiens
gaucuuggcuuaauuuaauguauuaaucuguuugugcaaacauaauaccaccauuuaaaaaugu

SEQ ID NO: 734581 - RNA, 64 nt, Homo Sapiens
gagaaaucuacugaauuggcagaaauuagauuugugcaaacaugcaaauuagugaaccaaaaau

SEQ ID NO: 734582 - RNA, 64 nt, Homo Sapiens
cacagccacauauauacaugaacacaaucccacaugcaaacacacauaaacauauacauacaca

SEQ ID NO: 734583 - RNA, 64 nt, Homo Sapiens
uaucuacagagagaaaaauuuuauuuuuugccacugcaaacauauaaccugaacuaauuuguuc

SEQ ID NO: 734584 - RNA, 64 nt, Homo Sapiens
gacauaauaguucacuuacaaguggacgaguaugugcaaacauguccuucaggugaucacacac

SEQ ID NO: 734585 - RNA, 64 nt, Homo Sapiens
cacauuagguaugucaucauuaaggagucaucaaugcaaacaguaggguugauguuacacuauu

SEQ ID NO: 734586 - RNA, 64 nt, Homo Sapiens
ucaugcaaugcagccaaggaaggauugccauaugugcaaacaaauauuauguucaaguuauuuc

SEQ ID NO: 734587 - RNA, 64 nt, Homo Sapiens
cugugagaucuugaauagugcgcccuggcugugcugcaaacaagagccagaggacccaaauugc

SEQ ID NO: 734588 - RNA, 64 nt, Homo Sapiens
uuaugcuuuugcacacacaccaaaugcaaaccuuugcaaacacacaugucuacacaugacuaca

SEQ ID NO: 734589 - RNA, 64 nt, Homo Sapiens
ucagcaccuguuccgcacguaauuggcaugugucugcaaacauccuuauucccaacuuaaagug

SEQ ID NO: 734590 - RNA, 64 nt, Homo Sapiens
aaaaagaggccuuauuucuuaacugugcugggauugcaaacacuuuuuaaaaaauuguuugcuu

SEQ ID NO: 734591 - RNA, 64 nt, Homo Sapiens
aaucugaucuuuguuuuguauuuuugugcuaaugugcaaacauguacagaagaaauagaauaca

SEQ ID NO: 734592 - RNA, 64 nt, Homo Sapiens
uaauuauuuuuagcaaaauguugccuuugucuugugcaaacauguagaauaugcucuuuaauuu

SEQ ID NO: 734593 - RNA, 64 nt, Homo Sapiens
uagugcuaacaugaagaccuuuuucugcacuauaugcaaacaggguaacuaacuaaaacaaagc

SEQ ID NO: 734594 - RNA, 64 nt, Homo Sapiens
aaauuaucaaauaaaaccagugaagaucugaagaugcaaacauuucaacuaugaagauuuacau

SEQ ID NO: 734595 - RNA, 64 nt, Homo Sapiens
gacaagccagagaucucccacaccuccagagaugugcaaacagcugggaggaaaagccugggag

SEQ ID NO: 734596 - RNA, 64 nt, Homo Sapiens
ggcacucuucaaauuuuuauuuuaaaaauuauaaugcaaacaucuggccaucaccuuaaccaag

SEQ ID NO: 734597 - RNA, 64 nt, Homo Sapiens
auuuuaugcugaguuuuaaaaaugaaauacuuuaugcaaacaggcaaaauugguaccaaaggga

SEQ ID NO: 734598 - RNA, 64 nt, Homo Sapiens
ggucugugugugcaaucucaugggcaggagugugugcaaacacauaccaccguggguacauugu

SEQ ID NO: 734599 - RNA, 64 nt, Homo Sapiens
guccauuuuuucauauuagaaacuagcugcuaugugcaaacagcuaacagaacaggagguauca

SEQ ID NO: 734600 - RNA, 64 nt, Homo Sapiens
uuugaaaauauguauuaaguaacuuuguuugaaaugcaaacaggauuugauuuacaaaaacgcu

SEQ ID NO: 734601 - RNA, 64 nt, Homo Sapiens
aguaccacguguagcauuuuuuuugaucaaacugugcaaacaguugacucaaaguagaucguua

SEQ ID NO: 734602 - RNA, 64 nt, Homo Sapiens
gcugugcccuugaagagaauaguuucagggccauugcaaacauauuguauguaugggagugagg

SEQ ID NO: 734603 - RNA, 64 nt, Homo Sapiens; identical to SEQ ID NO: 55140

SEQ ID NO: 734604 - RNA, 64 nt, Homo Sapiens; identical to SEQ ID NO: 55141

SEQ ID NO: 734605 - RNA, 64 nt, Homo Sapiens
auggaaauaguuguugaauaaccugaauuauaucugcaaacaaaacauucaaauggaaggaacc

SEQ ID NO: 734606 - RNA, 64 nt, Homo Sapiens
gugaucauagcgucaacauggcucuaugcaaucaugcaaacauauguucuguuucuucuuuuaa

SEQ ID NO: 734607 - RNA, 64 nt, Homo Sapiens
ucucucgaguguggacuggccauuuucuuaaaacugcaaacauuaaacuuaaauucuagccggu

SEQ ID NO: 734608 - RNA, 64 nt, Homo Sapiens
gacggcucaccgagagcauaucuaaaaaacacucugcaaacauuuggucacaugcaaguuagug

SEQ ID NO: 734609 - RNA, 64 nt, Homo Sapiens
cucccuucacugauacugaaaucaugguaucugcugcaaacaugaguagauccaugauggauua

SEQ ID NO: 734610 - RNA, 64 nt, Homo Sapiens
accggcagagcucuacaggccugcagccccuaagugcaaacacagcauggguccagaagacgug

SEQ ID NO: 734611 - RNA, 64 nt, Homo Sapiens
gaaaggaagggcugguccugccccuuugagggggugcaaacaugacugggaccuaagagccaga

SEQ ID NO: 734612 - RNA, 64 nt, Homo Sapiens
uggagaaacuaggagacugggacaagcaaaaggcugcaaacaacccagaagcccauccucagaa

SEQ ID NO: 734613 - RNA, 64 nt, Homo Sapiens; identical to SEQ ID NO: 55142

SEQ ID NO: 734614 - RNA, 64 nt, Homo Sapiens; identical to SEQ ID NO: 55143

SEQ ID NO: 734615 - RNA, 64 nt, Homo Sapiens
acgaaagugauacggagguuaggaugcuacuugcugcaaacaagcccuacuuuggccaacaucc

SEQ ID NO: 734616 - RNA, 64 nt, Homo Sapiens
acuguucuaugauuauaaaaguauuauaauaaaaugcaaacaugguuaaauguauauuuugguu

SEQ ID NO: 734617 - RNA, 64 nt, Homo Sapiens
gcauggaggacacagaugacucccucaggucugcugcaaacacauugucacggucacuagcuga

SEQ ID NO: 734618 - RNA, 64 nt, Homo Sapiens
uaggccuuuuauucauugaucaguguguggaagcugcaaacaagagagagguaguagguaggug

SEQ ID NO: 734619 - RNA, 64 nt, Homo Sapiens
acuaguuggcauccuuuugaacuuuugucuccuuugcaaacagugguccuaaaauacgaggucu

SEQ ID NO: 734620 - RNA, 64 nt, Homo Sapiens
aguuuggggucagugguauaaaggggguauauguugcaaacaaauguuuuaguaacaguuggcu

SEQ ID NO: 734621 - RNA, 64 nt, Homo Sapiens
cuccagugacaccucccagagaaguuccuauauaugcaaacagauuugcaguaccaaccuaugc

SEQ ID NO: 734622 - RNA, 64 nt, Homo Sapiens
uucugauaacuuguuccuuuuccugacuccuccuugcaaacaaaaugauaguugacacuuuauc

SEQ ID NO: 734623 - RNA, 64 nt, Homo Sapiens
uuuuuuuuuuuuuucuguaaaucuuucuucccauugcaaacaaguagugaucaguuuauacuuu

SEQ ID NO: 734624 - RNA, 64 nt, Homo Sapiens
gaugcguuuugcacuacucuuuccauuuauaugcugcaaacaacuacagucuuugaaauaugga

SEQ ID NO: 734625 - RNA, 64 nt, Homo Sapiens
cgugaaauuuuuuuuccugaauuggacauguguuugcaaacacuugucuugaagauuaugcugu

SEQ ID NO: 734626 - RNA, 64 nt, Homo Sapiens
acaugccacuguacauucagauauuauuuaaauuugcaaacacauuguucuauauguaagggua

SEQ ID NO: 734627 - RNA, 64 nt, Homo Sapiens
acagaccccacccaugcauauuuugcagguccaaugcaaacaucgaagaaacagggcuggauga

SEQ ID NO: 734628 - RNA, 64 nt, Homo Sapiens
uucagugcagaaggaagaguauuuuaacaaacaaugcaaacaucaauuuaaaucugauuaaucc

SEQ ID NO: 734629 - RNA, 64 nt, Homo Sapiens
gauuugcaaagaccguaugauuugauuacgugcaugcaaacagcaagaaaugucuuuugcccgu

SEQ ID NO: 734630 - RNA, 64 nt, Homo Sapiens
uaaagggauggucugguguuugucuucuuccagcugcaaacagcauccuuccauaugugugauu

SEQ ID NO: 734631 - RNA, 64 nt, Homo Sapiens
uugcuauacaguacuucauauacaguuguguacuugcaaacauucaccaaacaaaauuuucuau

SEQ ID NO: 734632 - RNA, 64 nt, Homo Sapiens
aaacuauuauauuuaagaacauuucuuugguugaugcaaacaaauaaccaguccuuauuucugc

SEQ ID NO: 734633 - RNA, 64 nt, Homo Sapiens
uauaaauggucucuaggccuugugaucaugauauugcaaacaacuaucaauucuugagaguuaa

SEQ ID NO: 734634 - RNA, 64 nt, Homo Sapiens
uuuaaaacauaaugccuacuagaaaaguuuaaccugcaaacacuuuuaauaugcacagcaucuu

SEQ ID NO: 734635 - RNA, 64 nt, Homo Sapiens
uuugauuuugcauccuaucaccucuucacugguaugcaaacagauugccaagauugagaaauag

SEQ ID NO: 734636 - RNA, 64 nt, Homo Sapiens
ucucuguuccaguauacaucuuuccuucuuauucugcaaacauuagaccacuugauauucuuua

SEQ ID NO: 734637 - RNA, 64 nt, Homo Sapiens; identical to SEQ ID NO: 55144

SEQ ID NO: 734638 - RNA, 64 nt, Homo Sapiens; identical to SEQ ID NO: 55145

SEQ ID NO: 734639 - RNA, 64 nt, Homo Sapiens
aacugaaagcauuuuaauggacuauuuauuaaagugcaaacaaacucagcaauccuuauguaga

SEQ ID NO: 734640 - RNA, 64 nt, Homo Sapiens
uaaggauuucagauuauagucuaugugagauaugugcaaacauguacauauuuccccuagaagc

SEQ ID NO: 734641 - RNA, 64 nt, Homo Sapiens
uuuagucuaaaaagcugucugguuguauaaacggugcaaacaaugucgccacagcacccacgcg

SEQ ID NO: 734642 - RNA, 62 nt, Homo Sapiens
uuuugguccucucagcguucaaugaaaguuuguuugcaaacagugaaagauugaacuagaau

SEQ ID NO: 734643 - RNA, 64 nt, Homo Sapiens
acauuaaaaacuguagcacauaauaauuuaucaaugcaaacaguaauuggcuauaaucacaauu

SEQ ID NO: 734644 - RNA, 64 nt, Homo Sapiens
gccacgaagaacaugcagccgggcccaaugucgcugcaaacacacuuugaccccaaggccugga

SEQ ID NO: 734645 - RNA, 64 nt, Homo Sapiens
gcuguaagauuuauacuacuuuggcaugcauuuuugcaaacaaucaguauugcuuauugugacu

SEQ ID NO: 734646 - RNA, 64 nt, Homo Sapiens
augccuacauccaggcacaccgauccagaaagggugcaaacaaagggcuauguacaaccuggca

SEQ ID NO: 734647 - RNA, 64 nt, Homo Sapiens
uuaacuucuaaccaaagacuggcagacagaaccuugcaaacaccgacaauguagcagaauacca

SEQ ID NO: 734648 - RNA, 64 nt, Homo Sapiens
gaggcgcugggauaucaaacucuuccuuaacaucugcaaacaagagaggaacggaaaugggacg

SEQ ID NO: 734649 - RNA, 64 nt, Homo Sapiens
gcaagaccacggaggcacagggccacaugcugccugcaaacagguccaggcugugugacugcag

SEQ ID NO: 734650 - RNA, 64 nt, Homo Sapiens
guguacuguauagacaguuuguaaauguuauuucugcaaacaaacaccuucuuauuauauauau

SEQ ID NO: 734651 - RNA, 64 nt, Homo Sapiens
uuuugcacgugcucuucuguucucaaaugcuaaaugcaaacacuguguauuuauuaguuaggug

SEQ ID NO: 734652 - RNA, 64 nt, Homo Sapiens
ucauuuaaucaucuuugagagacaaaaugaccucugcaaacagaaucuuggauauuucuucuga

SEQ ID NO: 734653 - RNA, 64 nt, Homo Sapiens
gucauacuagagauugguugugccuugucacaacugcaaacaauaccugaguggaguauucaaa

SEQ ID NO: 734654 - RNA, 64 nt, Homo Sapiens
uagaacaguuuuuaggcagccuuuacuaaaguuaugcaaacacacaguuccccauuuacuacau

SEQ ID NO: 734655 - RNA, 64 nt, Homo Sapiens
cugcccugggacauuucacuguaccaguauuaacugcaaacagcaauaauugucauuacagcaa

SEQ ID NO: 734656 - RNA, 64 nt, Homo Sapiens
uuucccccacaacaagccuuucucuucuucuuuaugcaaacacugcucauuccagccauuccaa

SEQ ID NO: 734657 - RNA, 58 nt, Homo Sapiens
gugcuuuuuccagaauaaccaugaucucugcaaacaaguuguagaaaaggaugauuaa

SEQ ID NO: 734658 - RNA, 64 nt, Homo Sapiens
acaguauacugcaacacaaaaucuuuuccaauuuugcaaacacuuaucaccuuauuuugauuaa

SEQ ID NO: 734659 - RNA, 64 nt, Homo Sapiens
uauaaaaccuguuucuguuuucaauuuugcagguugcaaacaaauuuuauaucagcaaaauaau

SEQ ID NO: 734660 - RNA, 64 nt, Homo Sapiens
auucauaacacuuggcacuuuucaaucaccaacuugcaaacagauuugcucugauuaacuagua

SEQ ID NO: 734661 - RNA, 64 nt, Homo Sapiens
caaggaguuuggugggcuuaucgcuaaucgcaggugcaaacacaggaccuaagugccuaccuac

SEQ ID NO: 734662 - RNA, 64 nt, Homo Sapiens
cagucuuuuaugauuuuuuacuuugauauuuuauugcaaacacuacagaaaaucuucuuauccu

SEQ ID NO: 734663 - RNA, 64 nt, Homo Sapiens
ucuugggaagcgaggagggcacggguguagacguugcaaacaaacuggugcuuaugcgguggug

SEQ ID NO: 734664 - RNA, 64 nt, Homo Sapiens
agcaauugggcuggcuuaggaauguggcgucuucugcaaacaauugggaaucuggcuuuuagcg

SEQ ID NO: 734665 - RNA, 64 nt, Homo Sapiens
cuacuucuucaugaacaauuauuaagaaucaacaugcaaacagcuuaaagauuuuauuuaaacu

SEQ ID NO: 734666 - RNA, 64 nt, Homo Sapiens
caguauccuaaggaagccuucuuauuuaucuuccugcaaacaaggguuaccugaaaagaaaaaa

SEQ ID NO: 734667 - RNA, 64 nt, Homo Sapiens
auaugaaugaaucagguuuuuuuuuuuuuuuuucugcaaacacuguguauagugagacuuguuc

SEQ ID NO: 734668 - RNA, 64 nt, Homo Sapiens
uuacaauuagaacuccugaccccagauucaacuuugcaaacaacaggggaaaaaaauggggaaa

SEQ ID NO: 734669 - RNA, 64 nt, Homo Sapiens
caucagagucaaaagcacuggcaaaggguaccccugcaaacaacuguggugggggcuggcagca

SEQ ID NO: 734670 - RNA, 64 nt, Homo Sapiens
gcucccaccagggcccgguggguccuggguuuucugcaaacauggaggaccacuuucugauagg

SEQ ID NO: 734671 - RNA, 64 nt, Homo Sapiens
acacaugguggaagagagaagaggcguguagguuugcaaacaaaguuaagaaauaggaaacuga

SEQ ID NO: 734672 - RNA, 64 nt, Homo Sapiens
guacagacagacacaugauaagccaaacuguuccugcaaacauagcuaugcuucaugaggcuua

SEQ ID NO: 734673 - RNA, 64 nt, Homo Sapiens
cacacacacacacacacacacuacagaagaggauugcaaacacauggcuccaucuucugcacac

SEQ ID NO: 734674 - RNA, 64 nt, Homo Sapiens
aaccuggcaaaaaugcaacaagagugcccugcuuugcaaacaucguuuuggggaaauguggaga

SEQ ID NO: 734675 - RNA, 64 nt, Homo Sapiens
aaauuaaguuuuauaauuagcuacuuuugaauuuugcaaacaugcacuaaauuuauugcuuuca

SEQ ID NO: 734676 - RNA, 64 nt, Homo Sapiens
cugauaaaauuucuccacaucuuuuuuuuuaaccugcaaacauggaaaggcuucauuuucuucu

SEQ ID NO: 734677 - RNA, 64 nt, Homo Sapiens
caagccacgggaaauauguauguucucaauaacaugcaaacaaaaacagugccuuuccuugccc

SEQ ID NO: 734678 - RNA, 64 nt, Homo Sapiens
gaggauugagcugugugggguuuuuucccaaacaugcaaacacuaguuccucuaguuguuguuu

SEQ ID NO: 734679 - RNA, 64 nt, Homo Sapiens
cucccuuccccccgucgaguuagcuaagucuuucugcaaacaacguucugguucacaugccuug

SEQ ID NO: 734680 - RNA, 64 nt, Homo Sapiens
cagugaacacugucugaauuguugugguucugauugcaaacaaaaaauauacuauugcacuaag

SEQ ID NO: 734681 - RNA, 64 nt, Homo Sapiens
uauacuaggagugugcccuuuucccuuaaaacacugcaaacaaauucaccauggcaauauguau

SEQ ID NO: 734682 - RNA, 64 nt, Homo Sapiens
augaaaauauacugccacauaaauaucuuacuuuugcaaacauucuuuaagaaaaagaauucua

SEQ ID NO: 734683 - RNA, 64 nt, Homo Sapiens
agaauuaauuuuacacucuaaagcaucagaaaauugcaaacacuaacucccauuaacauaauau

SEQ ID NO: 734684 - RNA, 55 nt, Homo Sapiens
cagucauguuccaacuucaaggacaugcaaacaacagcagccccgggaaaccuga

SEQ ID NO: 734685 - RNA, 64 nt, Homo Sapiens
agggagaaagugucagugacgauuaacacaacacugcaaacagagacuuaauuuucaagcacuu

SEQ ID NO: 734686 - RNA, 64 nt, Homo Sapiens
gugaggagcgacacacacaccuguaggcauccugugcaaacacuuugucauuaucaagagagau

SEQ ID NO: 734687 - RNA, 64 nt, Homo Sapiens
aucuccaacaagaucaggaaccucuccaccacacugcaaacaauagccaccaaauuaugucgug

SEQ ID NO: 734688 - RNA, 64 nt, Homo Sapiens
ccucggccuuacugacaaggacaccaaccuagggugcaaacagauggacuaugguucaaggaca

SEQ ID NO: 734689 - RNA, 64 nt, Homo Sapiens
acuggaagucaugucuucuaauugguugacauuuugcaaacaaauaaauuguaaucaaaagagc

SEQ ID NO: 734690 - RNA, 64 nt, Homo Sapiens
aaccgaauuggguuuagucaaucacugcacugcaugcaaacaagaaacgugucacacuugugac

SEQ ID NO: 734691 - RNA, 64 nt, Homo Sapiens
agagguguuucacuugcugagauuuccuguacauugcaaacaaauacagaaugcaaacccucaa

SEQ ID NO: 734692 - RNA, 64 nt, Homo Sapiens
acugucuuaaagauuaugcuagcuuuagaacacaugcaaacagcugcagcucugugauuaaaau

SEQ ID NO: 734693 - RNA, 64 nt, Homo Sapiens
aaaaaaaguuugcccagauugcuuaauuaaaaauugcaaacaaaaucucauuugaagucagcac

SEQ ID NO: 734694 - RNA, 64 nt, Homo Sapiens
ugugauuuguagucagguaucuuuuguauuugauugcaaacauuuggauuuuaguuuucucaug

SEQ ID NO: 734695 - RNA, 64 nt, Homo Sapiens
aaagcaaagaaggccaagaaaguucuaguagugcugcaaacacuaacccagcaguugccccacc

SEQ ID NO: 734696 - RNA, 64 nt, Homo Sapiens
gcucucuccacaaccucuugcuggaguucaguggugcaaacacagucuggcuguguugcccuga

SEQ ID NO: 734697 - RNA, 64 nt, Homo Sapiens
caugauucuccaagacaaaauagaacaauuucacugcaaacauggacuccacaggaccaaacca

SEQ ID NO: 734698 - RNA, 64 nt, Homo Sapiens
aauuugauucuguacuuuuaauagugauaagaacugcaaacagcugaauuucaguguuagauuc

SEQ ID NO: 734699 - RNA, 64 nt, Homo Sapiens
uagacucacuucauggauuccaccagagucccugugcaaacaccugugggcacaaaagaagggg

SEQ ID NO: 734700 - RNA, 64 nt, Homo Sapiens; identical to SEQ ID NO: 55146

SEQ ID NO: 734701 - RNA, 64 nt, Homo Sapiens; identical to SEQ ID NO: 55147

SEQ ID NO: 734702 - RNA, 64 nt, Homo Sapiens
ggaacauggcuuagguuuugaaguccaagguaacugcaaacaguucaacuugcacaucuaguua

SEQ ID NO: 734703 - RNA, 64 nt, Homo Sapiens
ucuucuuagggaaaucuccuuaagugcaauauuuugcaaacagcaggucccccuggauucaaau

SEQ ID NO: 734704 - RNA, 64 nt, Homo Sapiens
uuuaaugaugguguuaaagcuucucuguuccuuuugcaaacaauaaaaguguuuuguuuuuuaa

SEQ ID NO: 734705 - RNA, 64 nt, Homo Sapiens
agguuccagugauagaguuauaauuuugcuccuuugcaaacaaaugguaucuaauuaauaacua

SEQ ID NO: 734706 - RNA, 64 nt, Homo Sapiens
agcuuccucaagauaaauuucuaguuuauuaagaugcaaacagcucucauagauggcuacuacg

SEQ ID NO: 734707 - RNA, 64 nt, Homo Sapiens
uuuguauacugcaaguucccaggcaacucgaauuugcaaacacagccauggauacacuauuuac

SEQ ID NO: 734708 - RNA, 64 nt, Homo Sapiens
ugaaauguggaugugauugccguuugccaaucauugcaaacaacgaaggcuuuuuuaacucauc

SEQ ID NO: 734709 - RNA, 64 nt, Homo Sapiens
uaugggcaccacgaaauacaaaauuccauauaugugcaaacagagauuuaaaauuuucaaaaug

SEQ ID NO: 734710 - RNA, 64 nt, Homo Sapiens
aggaacaccaguuaaacuaaaugcaguugcuguuugcaaacaacuugcucagugcugucugaag

SEQ ID NO: 734711 - RNA, 64 nt, Homo Sapiens
ucuuuggauuauuaaauaagaacuuuuuugaaagugcaaacaaucuuguguucagccuuuuugu

SEQ ID NO: 734712 - RNA, 64 nt, Homo Sapiens
cucuuccuuuaaaaaggaauauuccacuccgcagugcaaacaauacuucuguucaauuccuaau

SEQ ID NO: 734713 - RNA, 64 nt, Homo Sapiens
aauguaguuaauguaauuuuuacuguuugguauuugcaaacaaagcuauuuccaaucacauugg

SEQ ID NO: 734714 - RNA, 64 nt, Homo Sapiens; identical to SEQ ID NO: 55148

SEQ ID NO: 734715 - RNA, 64 nt, Homo Sapiens; identical to SEQ ID NO: 55149

SEQ ID NO: 734716 - RNA, 64 nt, Homo Sapiens
ccaaguauuuuauaaagauuuaucauauaguaaaugcaaacaugguauaugcacauuuaaaaaa

SEQ ID NO: 734717 - RNA, 64 nt, Homo Sapiens
acuccauucugaggugucacaagcaaugaagcuaugcaaacaauaggagggugugacaggggaa

SEQ ID NO: 734718 - RNA, 62 nt, Homo Sapiens
auccucuugguauuauaugaguaggaagugauugcaaacaggcuggauuuggacaaaaagca

SEQ ID NO: 734719 - RNA, 64 nt, Homo Sapiens
aauugucaauuaaauauucaguuuuaugucuccaugcaaacauucaaagugcuuccaucagaac

SEQ ID NO: 734720 - RNA, 64 nt, Homo Sapiens
caugauccaggcacauuugaaauuugguaggcauugcaaacacauuugaauauuguguauuuca

SEQ ID NO: 734721 - RNA, 64 nt, Homo Sapiens
ugcugauaacaauucugggcacggugaagcccaaugcaaacagaauugcuuuagauuuccaaag

SEQ ID NO: 734722 - RNA, 64 nt, Homo Sapiens
acauugcaguaauguuaaggacagguauacuuuuugcaaacaaaugcauaaaugcaaauguaaa

SEQ ID NO: 734723 - RNA, 64 nt, Homo Sapiens
caugcacaguacaauaauguacucacauauaacaugcaaacagguuguuuucuacuuugccccu

SEQ ID NO: 734724 - RNA, 64 nt, Homo Sapiens
ugauuucugaagcgguucugcaauaaaacgcaguugcaaacaccaaccccuccacucuuucuuu

SEQ ID NO: 734725 - RNA, 64 nt, Homo Sapiens; identical to SEQ ID NO: 55150

SEQ ID NO: 734726 - RNA, 64 nt, Homo Sapiens; identical to SEQ ID NO: 55151

SEQ ID NO: 734727 - RNA, 64 nt, Homo Sapiens
ccuuuuguuuucuauauaccuaaauaaauaauuuugcaaacauguuuaaugugagcuuaagaug

SEQ ID NO: 734728 - RNA, 64 nt, Homo Sapiens
aucauuguucucacccucuuacuucucagaacuuugcaaacauaaaaguuuggacaguagaugg

SEQ ID NO: 734729 - RNA, 64 nt, Homo Sapiens
ugugccuguguauuugaacuaaucaauaauaauaugcaaacaguacuaugggaguguauuauaa

SEQ ID NO: 734730 - RNA, 64 nt, Homo Sapiens
uuauuucucaucuuuaaacaacucaacuuuacaaugcaaacaucgugugcauuuauuagcuauu

SEQ ID NO: 734731 - RNA, 64 nt, Homo Sapiens
caagcuuacuuccauugcaauagugaagaauaggugcaaacaaacucccaaaguaggugagcua

SEQ ID NO: 734732 - RNA, 64 nt, Homo Sapiens
augaugggaaaguggaacaagacuuuuagcgguuugcaaacaaaucaaagagaugaggaaauaa

SEQ ID NO: 734733 - RNA, 64 nt, Homo Sapiens
cagcggcccacagcuucacggguaauggagaguuugcaaacacagugcauuugauuccagccuu

SEQ ID NO: 734734 - RNA, 64 nt, Homo Sapiens
gucugaauuuuugggagcaggcaauaucugaaggugcaaacaggcccuacggcuguucccugca

SEQ ID NO: 734735 - RNA, 64 nt, Homo Sapiens
aaugugacuacauguucuccagauuagccacacaugcaaacaucaguguccuucuagcuuuagc

SEQ ID NO: 734736 - RNA, 64 nt, Homo Sapiens
gauggacuuccugccagugacagagcaugucuauugcaaacaauucucucaguuacguucagca

SEQ ID NO: 734737 - RNA, 64 nt, Homo Sapiens
ucuucgaccugcugauccuuggauccugaaucugugcaaacaguaacgugugcgcacgcgcagc

SEQ ID NO: 734738 - RNA, 64 nt, Homo Sapiens
auuacacacaugcacacacauaugcacacacaugugcaaacauagccacuuuuuugucaagagu

SEQ ID NO: 734739 - RNA, 64 nt, Homo Sapiens
ggguccuugugacuucaacgaaucacugaaagagugcaaacaucggaauaacagauuugccggc

SEQ ID NO: 734740 - RNA, 64 nt, Homo Sapiens
gcaugcauuuggccaaaauaauuaagagaauagaugcaaacaagcauagcagaugcugcugcug

SEQ ID NO: 734741 - RNA, 64 nt, Homo Sapiens
acucuaacagcaaagguuaugcaguuccacaccaugcaaacaaagucucuacucaguuuauaaa

SEQ ID NO: 734742 - RNA, 64 nt, Homo Sapiens
agugcauccugauuauuuuccauaaugaauaaagugcaaacagauggggagagaaaucuuaagu

SEQ ID NO: 734743 - RNA, 64 nt, Homo Sapiens
ccaggccucagggauccucuucuguagcucaaucugcaaacaugugcgacaccucaagguguuc

SEQ ID NO: 734744 - RNA, 64 nt, Homo Sapiens
aucucugacccagucuucgggacuacuguuggauugcaaacagcuccccucucagccgucucag

SEQ ID NO: 734745 - RNA, 64 nt, Homo Sapiens
cagcaucacucaaguuugaagcugccuggcaaacugcaaacaagauccugcauguacaauaacu

SEQ ID NO: 734746 - RNA, 64 nt, Homo Sapiens
auacauuuucuucuggccuaaaugaauauuuaugugcaaacauaggcaacuguuaaaggcugga

SEQ ID NO: 734747 - RNA, 52 nt, Homo Sapiens
aacgcaacagaaugaucuaaacugcaaacauuuucacacccaccaugcugcu

SEQ ID NO: 734748 - RNA, 64 nt, Homo Sapiens
ggggaacacgcugcccgcacugcccagagagcagugcaaacaccacaacacgagcguguuucuu

SEQ ID NO: 734749 - RNA, 64 nt, Homo Sapiens
ggucacccaugcaucuuccacuggaacguuucacugcaaacacaccuuggagaaguggcaucag

SEQ ID NO: 734750 - RNA, 64 nt, Homo Sapiens
guuuucguuuauuuuaaaacugaauccuuaaacuugcaaacacgccuacuguaagcaugcuugg

SEQ ID NO: 734751 - RNA, 64 nt, Homo Sapiens
ccuugagggcugugccaauccuagugaaccaaaaugcaaacaacucacacaagugaaaagcucc

SEQ ID NO: 734752 - RNA, 64 nt, Homo Sapiens
uguagagcaucaguuacaaaacaauuuuauccaaugcaaacaaauauaugguaaacaagcacac

SEQ ID NO: 734753 - RNA, 64 nt, Homo Sapiens
gcuagagucauuuugaagcuuuaaaacaaauuugugcaaacacuagucuucagaagaccucgcu

SEQ ID NO: 734754 - RNA, 64 nt, Homo Sapiens
uugaauacugugaauucauuaacucaaauaucuuugcaaacaguugaaagucagaaggcuguca

SEQ ID NO: 734755 - RNA, 64 nt, Homo Sapiens
cacuggguuuucaguguccuccacacaugaucucugcaaacagguaaagacaggguuucaauuu

SEQ ID NO: 734756 - RNA, 58 nt, Homo Sapiens
gcaauaaaaaccugucauuuaaagccacugcaaacauaggacauucuuacugugcuaa

SEQ ID NO: 734757 - RNA, 54 nt, Homo Sapiens
uugcacagguggauuuucuuacucugcaaacaaaugcagugugcccaucaguaa

SEQ ID NO: 734758 - RNA, 64 nt, Homo Sapiens
augcaagcguuaacuuugguauauaaccuugcuuugcaaacagaagaaagcuuauuuauuagcg

SEQ ID NO: 734759 - RNA, 64 nt, Homo Sapiens
uguccuccccugaauuguguaucuccccagcagaugcaaacaaggaagcaggaccaggccuagg

SEQ ID NO: 734760 - RNA, 64 nt, Homo Sapiens
accaugaauuuaauguauaaugacagcauuuaaaugcaaacacuugcacuuuuaauuuuauaua

SEQ ID NO: 734761 - RNA, 64 nt, Homo Sapiens
cgaguagugguuugagugggcaggaagggccauuugcaaacacugcuguguucuagacaaacaa

SEQ ID NO: 734762 - RNA, 64 nt, Homo Sapiens
gucagccuggauuucuggucuuugguuauuucugugcaaacaaaaggugugccuggcagccauu

SEQ ID NO: 734763 - RNA, 64 nt, Homo Sapiens
auuuuuaaaucauaccaaaaauaguaagaaaauaugcaaacacucugugaucaaacuuaaaagu

SEQ ID NO: 734764 - RNA, 64 nt, Homo Sapiens
ucucuuucucauauacauggacucucuguuggccugcaaacacauuuacuucuccucuuaugag

SEQ ID NO: 734765 - RNA, 64 nt, Homo Sapiens
acaaaacagcaaacuucagguaacuauuuuggauugcaaacaggauaaauuaaauguucaaaca

SEQ ID NO: 734766 - RNA, 64 nt, Homo Sapiens
acguggaggaaugcucccccauccuccccuucccugcaaacaugggguuggcugggcccagaag

SEQ ID NO: 734767 - RNA, 64 nt, Homo Sapiens
uuuagagauacuguuguuacuucugcauguucauugcaaacagaagguuccuugagcacccgga

SEQ ID NO: 734768 - RNA, 64 nt, Homo Sapiens
aagacaaaagaaacuuaccaauugauguuuuacgugcaaacaaccugaaucuuuuuuuuauaua

SEQ ID NO: 734769 - RNA, 64 nt, Homo Sapiens
uauguguguguauauauauguauuugauucuaccugcaaacaaauuuuuauuggugaggacuau

SEQ ID NO: 734770 - RNA, 64 nt, Homo Sapiens
ugucuguuccagcuguugugacugcugccauuuuugcaaacaucugcccaauccugggugauca

SEQ ID NO: 734771 - RNA, 64 nt, Homo Sapiens
ccaggaggggccgcagggcguguaugagcaguuuugcaaacagaacacaaccacaaugauggua

SEQ ID NO: 734772 - RNA, 64 nt, Homo Sapiens
accaucuacacacaucuacaaacagcuugggcccugcaaacacaccuuccacacuguguaugug

SEQ ID NO: 734773 - RNA, 64 nt, Homo Sapiens
uugccaucugguuugccuucucaguuucuuucucugcaaacaagggcugacccuucuuuggguc

SEQ ID NO: 734774 - RNA, 64 nt, Homo Sapiens
acacacacauggcaugcaugagaccaccucucccugcaaacaccugaaacauuucucuacuuca

SEQ ID NO: 734775 - RNA, 64 nt, Homo Sapiens
gugaaugcccauuaauagggggcaaagccccaacugcaaacaaaaaguacuguuuguagagggg

SEQ ID NO: 734776 - RNA, 64 nt, Homo Sapiens
ccacggucugcccugcaaaaggcuguccccaguaugcaaacacaggaaauagaaagccaggagu

SEQ ID NO: 734777 - RNA, 64 nt, Homo Sapiens
uucacccuaauagucccuccguuuauuuagcuguugcaaacaucaagggagacuuuccuccgau

SEQ ID NO: 734778 - RNA, 64 nt, Homo Sapiens
cuagauagccaugcagcuaccccagccagcagauugcaaacauccaucaguccucugucaguuu

SEQ ID NO: 734779 - RNA, 64 nt, Homo Sapiens
uccuuuacccaauauauauuuuuuuguuuguucaugcaaacagaauacuuacaagaauaugauu

SEQ ID NO: 734780 - RNA, 64 nt, Homo Sapiens
uucuacaaccugaugguuuuccugggguggacuuugcaaacacauaaaucgaccuuuaagaauu

SEQ ID NO: 734781 - RNA, 64 nt, Homo Sapiens; identical to SEQ ID NO: 55152

SEQ ID NO: 734782 - RNA, 64 nt, Homo Sapiens; identical to SEQ ID NO: 55153

SEQ ID NO: 734783 - RNA, 63 nt, Homo Sapiens
auuuuugauucuggccugguguuuccugccuuucugcaaacauagaaaagauuauucaauaaa

SEQ ID NO: 734784 - RNA, 64 nt, Homo Sapiens
uuuuaaauuaaauucggguaaauuuuguuuuguuugcaaacauggguuugccuuaaaggcuuuu

SEQ ID NO: 734785 - RNA, 64 nt, Homo Sapiens
uauaauuuugcaaaaaaggaacagguuuggaguaugcaaacagcuuugugcuuuucagcuugac

SEQ ID NO: 734786 - RNA, 64 nt, Homo Sapiens
ccuacacacacacacacucuuacauacaaacacaugcaaacauacacacacaagcacuugcaca

SEQ ID NO: 734787 - RNA, 64 nt, Homo Sapiens
uuauucaguugucuuuagcuuuccuuaaaacacuugcaaacauuuaaaaaugauuauauacauu

SEQ ID NO: 734788 - RNA, 64 nt, Homo Sapiens
aacugggggauuuuauuuauccucuagcugauaaugcaaacacuucauucuaccacauguuaac

SEQ ID NO: 734789 - RNA, 64 nt, Homo Sapiens
uaaaaccugcauagcagcgauuuugauuucagauugcaaacaugcguuaaacucuauuuuaugg

SEQ ID NO: 734790 - RNA, 64 nt, Homo Sapiens
aauuuaauaaauucauaaaaaagacucauaucuuugcaaacaaaagaagggcagauacugggcu

SEQ ID NO: 734791 - RNA, 64 nt, Homo Sapiens
auacuugaauucuggcugaugguguaaacagcucugcaaacaaucccuuucauaccacaaagcc

SEQ ID NO: 734792 - RNA, 64 nt, Homo Sapiens
ugcaagcugacagcagagcucaguccccacuuccugcaaacaauggccugcacccuaucccuug

SEQ ID NO: 734793 - RNA, 64 nt, Homo Sapiens
uugcuacuguaggaguauuuuuaggagcagaaacugcaaacacauuucauugugagguuuuacc

SEQ ID NO: 734794 - RNA, 64 nt, Homo Sapiens
gcucacugcagcuuugaccuacgaagugaaguagugcaaacauacugucacccaggcuggaaug

SEQ ID NO: 734795 - RNA, 64 nt, Homo Sapiens
ucugcuucugcuccucuacuaaaaacaaagcaaaugcaaacaucgauggaugguuagaaauguu

SEQ ID NO: 734796 - RNA, 64 nt, Homo Sapiens
ccauucauuagugugaucgacugauaauugaggaugcaaacauuugggauggcaccuauauugg

SEQ ID NO: 734797 - RNA, 64 nt, Homo Sapiens
cacaaaauaugaucuucguuaagcucagugugaaugcaaacaucuuaauaggaaaaaaagagua

SEQ ID NO: 734798 - RNA, 64 nt, Homo Sapiens
cacacacuggagagaaaccuaugaauguaaggaaugcaaacaagcauucaauuauuuuucuucc

SEQ ID NO: 734799 - RNA, 64 nt, Homo Sapiens
agguaagauaauucauauuggaacaaacuacaagugcaaacaauguggcaaaacuuaauuuaug

SEQ ID NO: 734800 - RNA, 64 nt, Homo Sapiens
augguauuuaacugaguuaacucugucagauugcugcaaacauuucuaaauacuugcucuuggu

SEQ ID NO: 734801 - RNA, 64 nt, Homo Sapiens
gucaccccuuuuuaagcacccugauucuaccaaaugcaaacacaucugggucugcgauuaugca

SEQ ID NO: 734802 - RNA, 64 nt, Homo Sapiens
ucuucuccuuauucaccggggaggcugugucuugugcaaacaagucauagaaacuugaugggag

SEQ ID NO: 734803 - RNA, 64 nt, Homo Sapiens
cccuggggucgugguuugacauuugucugccuggugcaaacaaggaauccuugccuuuaaggug

SEQ ID NO: 734804 - RNA, 64 nt, Homo Sapiens
uucugccauguaacuggaggaugugcuaugaguuugcaaacagcuggacugucaggcugcuuuu

SEQ ID NO: 734805 - RNA, 64 nt, Homo Sapiens
uaaugcuguuaacauuuucaccacccaugaggggugcaaacagagguuuuauugcuguuguuaa

SEQ ID NO: 734806 - RNA, 64 nt, Homo Sapiens
ugguaaagccuuaagauguuauaagccucaugaaugcaaacacaugaaagaaaucacauaggag

SEQ ID NO: 734807 - RNA, 64 nt, Homo Sapiens
ugcagacauuuaguuuugauguuuccugucugccugcaaacacaaauauuuauuuuuugagcau

SEQ ID NO: 734808 - RNA, 64 nt, Homo Sapiens
aaugugaaauaaauugaauuauugaugauguauuugcaaacauuuugauuugaaauauguaaga

SEQ ID NO: 734809 - RNA, 64 nt, Homo Sapiens
guaaauuauacagaagauacuuuuguuuuuuacaugcaaacauuuuuuuuuuaaggucuauggg

SEQ ID NO: 734810 - RNA, 64 nt, Homo Sapiens
acaaaaaggcaaauguacccuuccuuauaaaagaugcaaacauuaaguaaugugugaauauauu

SEQ ID NO: 734811 - RNA, 64 nt, Homo Sapiens
cugauaccuuugugaaguugacugucuaugaacuugcaaacaggcuuuaagaucacgccacugg

SEQ ID NO: 734812 - RNA, 64 nt, Homo Sapiens
cuuauucuacugaaauuaucaacuccaccuauuuugcaaacaaaaaucagaccacauuugaaga

SEQ ID NO: 734813 - RNA, 64 nt, Homo Sapiens
gagggcauuuggccacagauuuggccaaccugccugcaaacaugcccacccucccuguccccug

SEQ ID NO: 734814 - RNA, 64 nt, Homo Sapiens
agcagaaaauauuuucccacaaaaugggagaaaaugcaaacaugauuugcugaaagagagcaca

SEQ ID NO: 734815 - RNA, 64 nt, Homo Sapiens
ccacacaggaaagacaaagcgaggagacaauggaugcaaacagcgugacacccccagaccucug

SEQ ID NO: 734816 - RNA, 64 nt, Homo Sapiens
ggggugacaccacagagagaacuggaaugaaaugugcaaacaugccagacaugacaacacacac

SEQ ID NO: 734817 - RNA, 64 nt, Homo Sapiens
gaacucacaacccccucucugaccugggggacaaugcaaacaggucacagugcauucccauauu

SEQ ID NO: 734818 - RNA, 64 nt, Homo Sapiens
augggccuucagauuauuuccaguuuuuugccacugcaaacaauaaacauccuuguacauacua

SEQ ID NO: 734819 - RNA, 64 nt, Homo Sapiens
gucaucuuuuagaguaaacuauucuauaaacauaugcaaacagcccuaaauaaaucuaaagucu

SEQ ID NO: 734820 - RNA, 64 nt, Homo Sapiens; identical to SEQ ID NO: 55154

SEQ ID NO: 734821 - RNA, 64 nt, Homo Sapiens; identical to SEQ ID NO: 55155

SEQ ID NO: 734822 - RNA, 64 nt, Homo Sapiens
uuuguagcgguuauuuuuguaugaucuaguaacuugcaaacagaccaaauggaugagaggcggg

SEQ ID NO: 734823 - RNA, 64 nt, Homo Sapiens
cauaauuuuggggaccuuccgccuggcuggccucugcaaacaaaugaguccacacuccccugga

SEQ ID NO: 734824 - RNA, 64 nt, Homo Sapiens
uccugaguuuugcaauugagaacaguucugugaaugcaaacacccuuuguuacagcugggaaag

SEQ ID NO: 734825 - RNA, 64 nt, Homo Sapiens
ucucaaauauggaaaagaaauuuuuauuuuauugugcaaacauucccugcuuucuuccuuucuc

SEQ ID NO: 734826 - RNA, 64 nt, Homo Sapiens
cuaggacaccuccaccaaaccaaccuccuuggacugcaaacaaucaggccuguuacacucuccc

SEQ ID NO: 734827 - RNA, 64 nt, Homo Sapiens
acuuaaaugaacuuugaucuuuuauuuuuguuaaugcaaacagggguuccauuuuuauuucauu

SEQ ID NO: 734828 - RNA, 64 nt, Homo Sapiens
cgggagaagauagcaagaugaagugugccagaacugcaaacaauuuggcaauguccugagugca

SEQ ID NO: 734829 - RNA, 64 nt, Homo Sapiens
ggcaaauagcaucaauuaccuuauccgagaccuuugcaaacauuugauugcuaucuuauuuuug

SEQ ID NO: 734830 - RNA, 64 nt, Homo Sapiens
auuccaagaguaucccaguauuuuuuaaucccauugcaaacauucacacaacuacuuucaugaa

SEQ ID NO: 734831 - RNA, 64 nt, Homo Sapiens
uuuuaccugauuucaccgaagacccugcacaguuugcaaacagcauucucagggcaucugccga

SEQ ID NO: 734832 - RNA, 64 nt, Homo Sapiens
uaccguggccugguauaugaaacgugacccugcgugcaaacauguuagaauaaguuuguugcag

SEQ ID NO: 734833 - RNA, 64 nt, Homo Sapiens
gcugacugggucugguccuuaccaacauagacggugcaaacacucuuaacaguguuguuuuugu

SEQ ID NO: 734834 - RNA, 64 nt, Homo Sapiens
ccccuuggccucugccuccuuggccccacauuucugcaaacauaaauauuuacggauagauugc

SEQ ID NO: 734835 - RNA, 64 nt, Homo Sapiens
cuugucaguaauuugagaccacuucaaagcccucugcaaacaccccaaaggcagaaucugcuau

SEQ ID NO: 734836 - RNA, 64 nt, Homo Sapiens
ccugggacuucggguacccacccgcuguucuccaugcaaacaaagcgccagggaaaugacccac

SEQ ID NO: 734837 - RNA, 64 nt, Homo Sapiens
gauuacaggcgugagccaucgcuuuugacccaaaugcaaacauuuuauuagggggauaaagagg

SEQ ID NO: 734838 - RNA, 64 nt, Homo Sapiens
ugagcagcagaauaaaagaucuucuuccaagaaaugcaaacagaccguucaccaccaucuccag

SEQ ID NO: 734839 - RNA, 64 nt, Homo Sapiens; identical to SEQ ID NO: 734838

SEQ ID NO: 734840 - RNA, 64 nt, Homo Sapiens
ugagccucagaauaaaagaucuucuuccaagaaaugcaaacaggcuguucaccaccaucuccag

SEQ ID NO: 734841 - RNA, 64 nt, Homo Sapiens
gugcucagccuucaguucccuauauuuucauuccugcaaacacauugucuguucccuaagaaaa

SEQ ID NO: 734842 - RNA, 64 nt, Homo Sapiens
caaaaagagaaaaaucccaguuuuaacaguguuuugcaaacaaacaauauaggaggcaauaauc

SEQ ID NO: 734843 - RNA, 64 nt, Homo Sapiens
ccccucuaucagucacugacaguuaacaaaccuuugcaaacauuccccaguuguuuguuccucu

SEQ ID NO: 734844 - RNA, 64 nt, Homo Sapiens
gggaaucaaugcuguuucacucaaaaguguugcaugcaaacacuucucuuuauucugcauuuau

SEQ ID NO: 734845 - RNA, 64 nt, Homo Sapiens
aauguugaaauaauagauuaguuggguuuucacaugcaaacauucaaaaugaauacaaaauuaa

SEQ ID NO: 734846 - RNA, 64 nt, Homo Sapiens
cucucugguguaaucgucuaaaggcaaacauuccugcaaacagguuuuucucagcuucaggcag

SEQ ID NO: 734847 - RNA, 64 nt, Homo Sapiens
uuuuauaucagcaaaauaacucaauuuugcagauugcaaacaaauauaaaagcuguuucuguuu

SEQ ID NO: 734848 - RNA, 64 nt, Homo Sapiens
ucaaaggaaagcauaagcaaauuuuccuuuacaaugcaaacaugccacugguggcagcacaugg

SEQ ID NO: 734849 - RNA, 64 nt, Homo Sapiens
uacuuacucuccgaaaggcaucuaucugugcuauugcaaacacuccuugagauuuuaggggaau

SEQ ID NO: 734850 - RNA, 64 nt, Homo Sapiens
ggcuucaugggcuguggccuucugaagcuuggaaugcaaacacauggcccaacaauucccagau

SEQ ID NO: 734851 - RNA, 64 nt, Homo Sapiens
ucauauuggccaauaaacaguguuuaugaugcucugcaaacauugauacuggcagggcuauguu

SEQ ID NO: 734852 - RNA, 64 nt, Homo Sapiens
ggaagauuauugagagcccuaccacaaucaccgaugcaaacauuugguuuucuugggggaaaau

SEQ ID NO: 734853 - RNA, 64 nt, Homo Sapiens
ucauugaaauauuacauagauuuucauagugguaugcaaacauaagguguaaggaagguaaguu

SEQ ID NO: 734854 - RNA, 64 nt, Homo Sapiens
ugagacagcaaaugaaugagagacaaaaacaaagugcaaacaacuaaaaaaauaauaaaacuac

SEQ ID NO: 734855 - RNA, 64 nt, Homo Sapiens
ccugugguggaggguggucaccucguguucguuuugcaaacaugaugcaucugucuaacgcaug

SEQ ID NO: 734856 - RNA, 64 nt, Homo Sapiens
auuuuacuucuuuuacuuguuuaacuugguuagaugcaaacacguuggaugaguuugaaaggac

SEQ ID NO: 734857 - RNA, 64 nt, Homo Sapiens; identical to SEQ ID NO: 98025

SEQ ID NO: 734858 - RNA, 64 nt, Homo Sapiens; identical to SEQ ID NO: 98026

SEQ ID NO: 734859 - RNA, 64 nt, Homo Sapiens; identical to SEQ ID NO: 98027

SEQ ID NO: 734860 - RNA, 64 nt, Homo Sapiens; identical to SEQ ID NO: 98028

SEQ ID NO: 734861 - RNA, 64 nt, Homo Sapiens; identical to SEQ ID NO: 98029

SEQ ID NO: 734862 - RNA, 64 nt, Homo Sapiens; identical to SEQ ID NO: 98030

SEQ ID NO: 734863 - RNA, 64 nt, Homo Sapiens; identical to SEQ ID NO: 98031

SEQ ID NO: 734864 - RNA, 64 nt, Homo Sapiens; identical to SEQ ID NO: 98032

SEQ ID NO: 734865 - RNA, 64 nt, Homo Sapiens; identical to SEQ ID NO: 98033

SEQ ID NO: 734866 - RNA, 64 nt, Homo Sapiens; identical to SEQ ID NO: 98034

SEQ ID NO: 734867 - RNA, 64 nt, Homo Sapiens; identical to SEQ ID NO: 98035

SEQ ID NO: 734868 - RNA, 64 nt, Homo Sapiens; identical to SEQ ID NO: 98036

SEQ ID NO: 734869 - RNA, 64 nt, Homo Sapiens; identical to SEQ ID NO: 98037

SEQ ID NO: 734870 - RNA, 64 nt, Homo Sapiens; identical to SEQ ID NO: 98038

SEQ ID NO: 734871 - RNA, 64 nt, Homo Sapiens; identical to SEQ ID NO: 98039

SEQ ID NO: 734872 - RNA, 64 nt, Homo Sapiens; identical to SEQ ID NO: 98040

SEQ ID NO: 734873 - RNA, 64 nt, Homo Sapiens; identical to SEQ ID NO: 98041

SEQ ID NO: 734874 - RNA, 64 nt, Homo Sapiens; identical to SEQ ID NO: 98042

SEQ ID NO: 734875 - RNA, 64 nt, Homo Sapiens; identical to SEQ ID NO: 98043

SEQ ID NO: 734876 - RNA, 64 nt, Homo Sapiens; identical to SEQ ID NO: 98044

SEQ ID NO: 734877 - RNA, 64 nt, Homo Sapiens; identical to SEQ ID NO: 98045

SEQ ID NO: 734878 - RNA, 64 nt, Homo Sapiens; identical to SEQ ID NO: 98046

SEQ ID NO: 734879 - RNA, 64 nt, Homo Sapiens; identical to SEQ ID NO: 98047

SEQ ID NO: 734880 - RNA, 64 nt, Homo Sapiens; identical to SEQ ID NO: 98048

SEQ ID NO: 734881 - RNA, 64 nt, Homo Sapiens; identical to SEQ ID NO: 98049

SEQ ID NO: 734882 - RNA, 64 nt, Homo Sapiens; identical to SEQ ID NO: 98050

SEQ ID NO: 734883 - RNA, 64 nt, Homo Sapiens; identical to SEQ ID NO: 98051

SEQ ID NO: 734884 - RNA, 64 nt, Homo Sapiens; identical to SEQ ID NO: 98052

SEQ ID NO: 734885 - RNA, 64 nt, Homo Sapiens; identical to SEQ ID NO: 98053

SEQ ID NO: 734886 - RNA, 64 nt, Homo Sapiens; identical to SEQ ID NO: 98054

SEQ ID NO: 734887 - RNA, 63 nt, Homo Sapiens
gcagaaacuauucaguuuuuuauugcucugaguaacugacaaagaaaacaacuguuacaguuu

SEQ ID NO: 734888 - RNA, 63 nt, Homo Sapiens
auauuuuaaaaauauauaaaacguacaucguaaaacugacaaagggcuguggugaauggauga

SEQ ID NO: 734889 - RNA, 63 nt, Homo Sapiens
agaggcgucugcugucucaugaugacaaaccauaacugacaaguaagaaggaaaagaagaaga

SEQ ID NO: 734890 - RNA, 63 nt, Homo Sapiens
gucuaaaugagcacauguauuucugcuuugacaaacugacaaauagauguauuacuuggaaag

SEQ ID NO: 734891 - RNA, 63 nt, Homo Sapiens
ccaaauuaauuggcuuuguguccaauuaccuguaacugacagaaucauuauguuuuauuacuu

SEQ ID NO: 734892 - RNA, 63 nt, Homo Sapiens
uaccuuuuaaaauuugcacaacuuuccuuacuuaacugacaguuccaguuuaguuucuucugg

SEQ ID NO: 734893 - RNA, 63 nt, Homo Sapiens
aaaaaaguaacuuaaaaacauuuucauugguggaacugacacauuaaaguacaagccaaauga

SEQ ID NO: 734894 - RNA, 63 nt, Homo Sapiens
gcgggucugggcgucugcaccuggggccuagggaacugacacgugggaagcgcagugagccgg

SEQ ID NO: 734895 - RNA, 63 nt, Homo Sapiens
aaaaugguuuaaauaccccacagcaaauagaguaacugacaaaccaccaaaaacugaaacccc

SEQ ID NO: 734896 - RNA, 63 nt, Homo Sapiens
gugcagaccccaaccucccugacuuccuucaguaacugacaguguagcauuguucuugauuag

SEQ ID NO: 734897 - RNA, 63 nt, Homo Sapiens
uuuacccaaaaucacacagcucagaagcagcagaacugacauugggacccagguccauuggag

SEQ ID NO: 734898 - RNA, 64 nt, Homo Sapiens; identical to SEQ ID NO: 264315

SEQ ID NO: 734899 - RNA, 64 nt, Homo Sapiens; identical to SEQ ID NO: 264316

SEQ ID NO: 734900 - RNA, 64 nt, Homo Sapiens; identical to SEQ ID NO: 264317

SEQ ID NO: 734901 - RNA, 64 nt, Homo Sapiens; identical to SEQ ID NO: 264318

SEQ ID NO: 734902 - RNA, 64 nt, Homo Sapiens; identical to SEQ ID NO: 264319

SEQ ID NO: 734903 - RNA, 64 nt, Homo Sapiens; identical to SEQ ID NO: 264320

SEQ ID NO: 734904 - RNA, 64 nt, Homo Sapiens; identical to SEQ ID NO: 264321

SEQ ID NO: 734905 - RNA, 64 nt, Homo Sapiens; identical to SEQ ID NO: 264322

SEQ ID NO: 734906 - RNA, 60 nt, Homo Sapiens
gccaaacagcccugagaaaagcuggggaaacagucugagcuggaguccgagagugguugg

SEQ ID NO: 734907 - RNA, 60 nt, Homo Sapiens
ucacuuaggcaaagcauuauucauucccaucagucugaagcccgaaggacuguuuuguau

SEQ ID NO: 734908 - RNA, 60 nt, Homo Sapiens
gcuugcgacugcaucuguaucacugccacucagucugacaaucuccuggccgagagcagc

SEQ ID NO: 734909 - RNA, 60 nt, Homo Sapiens
uagguuuuguuuguagugaagucaauauuucagucugacacagcuuuggcuucuggugug

SEQ ID NO: 734910 - RNA, 60 nt, Homo Sapiens
gucuuuccuuuacaccuaugccacguggaccagucugaauuccucugccugcuaacaagc

SEQ ID NO: 734911 - RNA, 60 nt, Homo Sapiens
ugcagcucccuguccaaguguccacuuguucagucugaaacaucuaaaaacucuucaaac

SEQ ID NO: 734912 - RNA, 60 nt, Homo Sapiens
ggcauggagaccgggagauauggcaagguucagucugaauugcgcugggacggcccaucu

SEQ ID NO: 734913 - RNA, 60 nt, Homo Sapiens
gauuccccaccuccaaucccgagaccagagcagucugaaguguuuuuccguggauuuggc

SEQ ID NO: 734914 - RNA, 60 nt, Homo Sapiens
ggggacccagacugccuucaucucugauggcagucugaucacuguggccacugugcgagc

SEQ ID NO: 734915 - RNA, 60 nt, Homo Sapiens
ccugguuuccuagccguuccccuucugccccagucugagccagugagggguagcuuuuua

SEQ ID NO: 734916 - RNA, 60 nt, Homo Sapiens
cuggacaggggguuucuguuaguucagcuacagucugacucuccauucuccagucugaac

SEQ ID NO: 734917 - RNA, 60 nt, Homo Sapiens
aguucagcuacagucugacucuccauucuccagucugaacaggggugcgcccacagccug

SEQ ID NO: 734918 - RNA, 60 nt, Homo Sapiens
uuuuuuggcacuaggucauuaaguagcacacagucugaaugcccuuuucuggaguggcca

SEQ ID NO: 734919 - RNA, 60 nt, Homo Sapiens
ucgcacugacuguggcgcacuggggaauaacagucugagcuagcaccacccucagccagg

SEQ ID NO: 734920 - RNA, 60 nt, Homo Sapiens
ccagcuagaaggagggucagggauuuuuuacagucugagaaugagugugugugagugagg

SEQ ID NO: 734921 - RNA, 60 nt, Homo Sapiens
gaaaacgcccucuccugacuuguauuguggcagucugaacgcccccagaaaauugugcca

SEQ ID NO: 734922 - RNA, 60 nt, Homo Sapiens
uagagacucaggaaagacaguggcauaaugcagucugaguccaaaggccagguaaccuug

SEQ ID NO: 734923 - RNA, 60 nt, Homo Sapiens
ggaacaaaguaaaguaggguaagggaaugccagucugaggaguuagaaguuaccguuuua

SEQ ID NO: 734924 - RNA, 64 nt, Homo Sapiens; identical to SEQ ID NO: 81719

SEQ ID NO: 734925 - RNA, 64 nt, Homo Sapiens; identical to SEQ ID NO: 81720

SEQ ID NO: 734926 - RNA, 64 nt, Homo Sapiens; identical to SEQ ID NO: 81721

SEQ ID NO: 734927 - RNA, 64 nt, Homo Sapiens; identical to SEQ ID NO: 81722

SEQ ID NO: 734928 - RNA, 64 nt, Homo Sapiens; identical to SEQ ID NO: 81723

SEQ ID NO: 734929 - RNA, 64 nt, Homo Sapiens; identical to SEQ ID NO: 81724

SEQ ID NO: 734930 - RNA, 64 nt, Homo Sapiens; identical to SEQ ID NO: 81725

SEQ ID NO: 734931 - RNA, 64 nt, Homo Sapiens; identical to SEQ ID NO: 81726

SEQ ID NO: 734932 - RNA, 64 nt, Homo Sapiens; identical to SEQ ID NO: 81727

SEQ ID NO: 734933 - RNA, 64 nt, Homo Sapiens; identical to SEQ ID NO: 81728

SEQ ID NO: 734934 - RNA, 64 nt, Homo Sapiens; identical to SEQ ID NO: 81729

SEQ ID NO: 734935 - RNA, 64 nt, Homo Sapiens; identical to SEQ ID NO: 81730

SEQ ID NO: 734936 - RNA, 64 nt, Homo Sapiens; identical to SEQ ID NO: 81731

SEQ ID NO: 734937 - RNA, 64 nt, Homo Sapiens; identical to SEQ ID NO: 81732

SEQ ID NO: 734938 - RNA, 64 nt, Homo Sapiens; identical to SEQ ID NO: 81733

SEQ ID NO: 734939 - RNA, 64 nt, Homo Sapiens; identical to SEQ ID NO: 81734

SEQ ID NO: 734940 - RNA, 64 nt, Homo Sapiens; identical to SEQ ID NO: 522646

SEQ ID NO: 734941 - RNA, 64 nt, Homo Sapiens; identical to SEQ ID NO: 522647

SEQ ID NO: 734942 - RNA, 64 nt, Homo Sapiens; identical to SEQ ID NO: 522648

SEQ ID NO: 734943 - RNA, 64 nt, Homo Sapiens; identical to SEQ ID NO: 522649

SEQ ID NO: 734944 - RNA, 64 nt, Homo Sapiens; identical to SEQ ID NO: 522650

SEQ ID NO: 734945 - RNA, 64 nt, Homo Sapiens; identical to SEQ ID NO: 522651

SEQ ID NO: 734946 - RNA, 64 nt, Homo Sapiens; identical to SEQ ID NO: 522652

SEQ ID NO: 734947 - RNA, 64 nt, Homo Sapiens; identical to SEQ ID NO: 522653

SEQ ID NO: 734948 - RNA, 64 nt, Homo Sapiens; identical to SEQ ID NO: 522654

SEQ ID NO: 734949 - RNA, 64 nt, Homo Sapiens; identical to SEQ ID NO: 522655

SEQ ID NO: 734950 - RNA, 64 nt, Homo Sapiens; identical to SEQ ID NO: 522656

SEQ ID NO: 734951 - RNA, 64 nt, Homo Sapiens; identical to SEQ ID NO: 522657

SEQ ID NO: 734952 - RNA, 64 nt, Homo Sapiens; identical to SEQ ID NO: 522658

SEQ ID NO: 734953 - RNA, 64 nt, Homo Sapiens; identical to SEQ ID NO: 522659

SEQ ID NO: 734954 - RNA, 64 nt, Homo Sapiens; identical to SEQ ID NO: 522660

SEQ ID NO: 734955 - RNA, 64 nt, Homo Sapiens; identical to SEQ ID NO: 522661

SEQ ID NO: 734956 - RNA, 64 nt, Homo Sapiens; identical to SEQ ID NO: 113667

SEQ ID NO: 734957 - RNA, 64 nt, Homo Sapiens; identical to SEQ ID NO: 113668

SEQ ID NO: 734958 - RNA, 64 nt, Homo Sapiens; identical to SEQ ID NO: 113669

SEQ ID NO: 734959 - RNA, 64 nt, Homo Sapiens; identical to SEQ ID NO: 113670

SEQ ID NO: 734960 - RNA, 64 nt, Homo Sapiens; identical to SEQ ID NO: 113671

SEQ ID NO: 734961 - RNA, 64 nt, Homo Sapiens; identical to SEQ ID NO: 113672

SEQ ID NO: 734962 - RNA, 64 nt, Homo Sapiens; identical to SEQ ID NO: 113673

SEQ ID NO: 734963 - RNA, 64 nt, Homo Sapiens; identical to SEQ ID NO: 113674

SEQ ID NO: 734964 - RNA, 64 nt, Homo Sapiens; identical to SEQ ID NO: 113675

SEQ ID NO: 734965 - RNA, 64 nt, Homo Sapiens; identical to SEQ ID NO: 113676

SEQ ID NO: 734966 - RNA, 64 nt, Homo Sapiens; identical to SEQ ID NO: 113677

SEQ ID NO: 734967 - RNA, 64 nt, Homo Sapiens; identical to SEQ ID NO: 113678

SEQ ID NO: 734968 - RNA, 64 nt, Homo Sapiens; identical to SEQ ID NO: 113679

SEQ ID NO: 734969 - RNA, 64 nt, Homo Sapiens; identical to SEQ ID NO: 113680

SEQ ID NO: 734970 - RNA, 64 nt, Homo Sapiens; identical to SEQ ID NO: 113681

SEQ ID NO: 734971 - RNA, 64 nt, Homo Sapiens; identical to SEQ ID NO: 113682

SEQ ID NO: 734972 - RNA, 64 nt, Homo Sapiens; identical to SEQ ID NO: 113683

SEQ ID NO: 734973 - RNA, 64 nt, Homo Sapiens; identical to SEQ ID NO: 113684

SEQ ID NO: 734974 - RNA, 64 nt, Homo Sapiens; identical to SEQ ID NO: 113685

SEQ ID NO: 734975 - RNA, 64 nt, Homo Sapiens; identical to SEQ ID NO: 113686

SEQ ID NO: 734976 - RNA, 64 nt, Homo Sapiens; identical to SEQ ID NO: 113687

SEQ ID NO: 734977 - RNA, 64 nt, Homo Sapiens; identical to SEQ ID NO: 113688

SEQ ID NO: 734978 - RNA, 64 nt, Homo Sapiens; identical to SEQ ID NO: 113689

SEQ ID NO: 734979 - RNA, 62 nt, Homo Sapiens; identical to SEQ ID NO: 113690

SEQ ID NO: 734980 - RNA, 64 nt, Homo Sapiens; identical to SEQ ID NO: 113691

SEQ ID NO: 734981 - RNA, 59 nt, Homo Sapiens; identical to SEQ ID NO: 113692

SEQ ID NO: 734982 - RNA, 64 nt, Homo Sapiens; identical to SEQ ID NO: 113693

SEQ ID NO: 734983 - RNA, 64 nt, Homo Sapiens; identical to SEQ ID NO: 113694

SEQ ID NO: 734984 - RNA, 64 nt, Homo Sapiens; identical to SEQ ID NO: 113695

SEQ ID NO: 734985 - RNA, 64 nt, Homo Sapiens; identical to SEQ ID NO: 113696

SEQ ID NO: 734986 - RNA, 64 nt, Homo Sapiens; identical to SEQ ID NO: 113697

SEQ ID NO: 734987 - RNA, 64 nt, Homo Sapiens; identical to SEQ ID NO: 113698

SEQ ID NO: 734988 - RNA, 64 nt, Homo Sapiens; identical to SEQ ID NO: 113699

SEQ ID NO: 734989 - RNA, 64 nt, Homo Sapiens; identical to SEQ ID NO: 113700

SEQ ID NO: 734990 - RNA, 64 nt, Homo Sapiens; identical to SEQ ID NO: 113701

SEQ ID NO: 734991 - RNA, 64 nt, Homo Sapiens; identical to SEQ ID NO: 113702

SEQ ID NO: 734992 - RNA, 64 nt, Homo Sapiens; identical to SEQ ID NO: 113703

SEQ ID NO: 734993 - RNA, 64 nt, Homo Sapiens; identical to SEQ ID NO: 113704

SEQ ID NO: 734994 - RNA, 64 nt, Homo Sapiens; identical to SEQ ID NO: 113705

SEQ ID NO: 734995 - RNA, 64 nt, Homo Sapiens; identical to SEQ ID NO: 113706

SEQ ID NO: 734996 - RNA, 64 nt, Homo Sapiens; identical to SEQ ID NO: 113707

SEQ ID NO: 734997 - RNA, 64 nt, Homo Sapiens; identical to SEQ ID NO: 113708

SEQ ID NO: 734998 - RNA, 64 nt, Homo Sapiens; identical to SEQ ID NO: 113709

SEQ ID NO: 734999 - RNA, 64 nt, Homo Sapiens; identical to SEQ ID NO: 113710

SEQ ID NO: 735000 - RNA, 64 nt, Homo Sapiens; identical to SEQ ID NO: 113711

SEQ ID NO: 735001 - RNA, 64 nt, Homo Sapiens; identical to SEQ ID NO: 113712

SEQ ID NO: 735002 - RNA, 64 nt, Homo Sapiens; identical to SEQ ID NO: 113713

SEQ ID NO: 735003 - RNA, 64 nt, Homo Sapiens; identical to SEQ ID NO: 113714

SEQ ID NO: 735004 - RNA, 64 nt, Homo Sapiens; identical to SEQ ID NO: 113715

SEQ ID NO: 735005 - RNA, 64 nt, Homo Sapiens; identical to SEQ ID NO: 113716

SEQ ID NO: 735006 - RNA, 64 nt, Homo Sapiens; identical to SEQ ID NO: 113717

SEQ ID NO: 735007 - RNA, 64 nt, Homo Sapiens; identical to SEQ ID NO: 113718

SEQ ID NO: 735008 - RNA, 64 nt, Homo Sapiens; identical to SEQ ID NO: 113719

SEQ ID NO: 735009 - RNA, 64 nt, Homo Sapiens; identical to SEQ ID NO: 113720

SEQ ID NO: 735010 - RNA, 64 nt, Homo Sapiens; identical to SEQ ID NO: 113721

SEQ ID NO: 735011 - RNA, 64 nt, Homo Sapiens; identical to SEQ ID NO: 113722

SEQ ID NO: 735012 - RNA, 64 nt, Homo Sapiens; identical to SEQ ID NO: 113723

SEQ ID NO: 735013 - RNA, 64 nt, Homo Sapiens; identical to SEQ ID NO: 113724

SEQ ID NO: 735014 - RNA, 64 nt, Homo Sapiens; identical to SEQ ID NO: 113725

SEQ ID NO: 735015 - RNA, 64 nt, Homo Sapiens; identical to SEQ ID NO: 113726

SEQ ID NO: 735016 - RNA, 64 nt, Homo Sapiens; identical to SEQ ID NO: 113727

SEQ ID NO: 735017 - RNA, 64 nt, Homo Sapiens; identical to SEQ ID NO: 113728

SEQ ID NO: 735018 - RNA, 64 nt, Homo Sapiens; identical to SEQ ID NO: 113729

SEQ ID NO: 735019 - RNA, 64 nt, Homo Sapiens; identical to SEQ ID NO: 113730

SEQ ID NO: 735020 - RNA, 64 nt, Homo Sapiens; identical to SEQ ID NO: 113731

SEQ ID NO: 735021 - RNA, 64 nt, Homo Sapiens; identical to SEQ ID NO: 113732

SEQ ID NO: 735022 - RNA, 64 nt, Homo Sapiens; identical to SEQ ID NO: 113733

SEQ ID NO: 735023 - RNA, 64 nt, Homo Sapiens; identical to SEQ ID NO: 113734

SEQ ID NO: 735024 - RNA, 64 nt, Homo Sapiens; identical to SEQ ID NO: 113735

SEQ ID NO: 735025 - RNA, 64 nt, Homo Sapiens; identical to SEQ ID NO: 113736

SEQ ID NO: 735026 - RNA, 64 nt, Homo Sapiens; identical to SEQ ID NO: 113737

SEQ ID NO: 735027 - RNA, 64 nt, Homo Sapiens; identical to SEQ ID NO: 113738

SEQ ID NO: 735028 - RNA, 64 nt, Homo Sapiens; identical to SEQ ID NO: 113739

SEQ ID NO: 735029 - RNA, 64 nt, Homo Sapiens; identical to SEQ ID NO: 113740

SEQ ID NO: 735030 - RNA, 64 nt, Homo Sapiens; identical to SEQ ID NO: 113741

SEQ ID NO: 735031 - RNA, 64 nt, Homo Sapiens; identical to SEQ ID NO: 113742

SEQ ID NO: 735032 - RNA, 64 nt, Homo Sapiens; identical to SEQ ID NO: 113743

SEQ ID NO: 735033 - RNA, 64 nt, Homo Sapiens; identical to SEQ ID NO: 113744

SEQ ID NO: 735034 - RNA, 64 nt, Homo Sapiens; identical to SEQ ID NO: 113745

SEQ ID NO: 735035 - RNA, 64 nt, Homo Sapiens; identical to SEQ ID NO: 113746

SEQ ID NO: 735036 - RNA, 64 nt, Homo Sapiens; identical to SEQ ID NO: 113747

SEQ ID NO: 735037 - RNA, 64 nt, Homo Sapiens; identical to SEQ ID NO: 113748

SEQ ID NO: 735038 - RNA, 64 nt, Homo Sapiens; identical to SEQ ID NO: 113749

SEQ ID NO: 735039 - RNA, 64 nt, Homo Sapiens; identical to SEQ ID NO: 113750

SEQ ID NO: 735040 - RNA, 64 nt, Homo Sapiens; identical to SEQ ID NO: 113751

SEQ ID NO: 735041 - RNA, 64 nt, Homo Sapiens; identical to SEQ ID NO: 113752

SEQ ID NO: 735042 - RNA, 64 nt, Homo Sapiens; identical to SEQ ID NO: 113753

SEQ ID NO: 735043 - RNA, 64 nt, Homo Sapiens; identical to SEQ ID NO: 113754

SEQ ID NO: 735044 - RNA, 64 nt, Homo Sapiens; identical to SEQ ID NO: 113755

SEQ ID NO: 735045 - RNA, 64 nt, Homo Sapiens; identical to SEQ ID NO: 113756

SEQ ID NO: 735046 - RNA, 64 nt, Homo Sapiens; identical to SEQ ID NO: 113757

SEQ ID NO: 735047 - RNA, 64 nt, Homo Sapiens; identical to SEQ ID NO: 113758

SEQ ID NO: 735048 - RNA, 64 nt, Homo Sapiens; identical to SEQ ID NO: 113759

SEQ ID NO: 735049 - RNA, 64 nt, Homo Sapiens; identical to SEQ ID NO: 113760

SEQ ID NO: 735050 - RNA, 64 nt, Homo Sapiens; identical to SEQ ID NO: 113761

SEQ ID NO: 735051 - RNA, 64 nt, Homo Sapiens; identical to SEQ ID NO: 113762

SEQ ID NO: 735052 - RNA, 64 nt, Homo Sapiens; identical to SEQ ID NO: 113763

SEQ ID NO: 735053 - RNA, 64 nt, Homo Sapiens; identical to SEQ ID NO: 113764

SEQ ID NO: 735054 - RNA, 61 nt, Homo Sapiens; identical to SEQ ID NO: 113765

SEQ ID NO: 735055 - RNA, 64 nt, Homo Sapiens; identical to SEQ ID NO: 113766

SEQ ID NO: 735056 - RNA, 64 nt, Homo Sapiens; identical to SEQ ID NO: 113767

SEQ ID NO: 735057 - RNA, 64 nt, Homo Sapiens; identical to SEQ ID NO: 113768

SEQ ID NO: 735058 - RNA, 64 nt, Homo Sapiens; identical to SEQ ID NO: 113769

SEQ ID NO: 735059 - RNA, 64 nt, Homo Sapiens; identical to SEQ ID NO: 113770

SEQ ID NO: 735060 - RNA, 64 nt, Homo Sapiens; identical to SEQ ID NO: 113771

SEQ ID NO: 735061 - RNA, 64 nt, Homo Sapiens; identical to SEQ ID NO: 113772

SEQ ID NO: 735062 - RNA, 64 nt, Homo Sapiens; identical to SEQ ID NO: 113773

SEQ ID NO: 735063 - RNA, 64 nt, Homo Sapiens; identical to SEQ ID NO: 113774

SEQ ID NO: 735064 - RNA, 64 nt, Homo Sapiens; identical to SEQ ID NO: 113775

SEQ ID NO: 735065 - RNA, 64 nt, Homo Sapiens; identical to SEQ ID NO: 113776

SEQ ID NO: 735066 - RNA, 64 nt, Homo Sapiens; identical to SEQ ID NO: 113777

SEQ ID NO: 735067 - RNA, 64 nt, Homo Sapiens; identical to SEQ ID NO: 113778

SEQ ID NO: 735068 - RNA, 64 nt, Homo Sapiens; identical to SEQ ID NO: 113779

SEQ ID NO: 735069 - RNA, 64 nt, Homo Sapiens; identical to SEQ ID NO: 113780

SEQ ID NO: 735070 - RNA, 64 nt, Homo Sapiens; identical to SEQ ID NO: 113781

SEQ ID NO: 735071 - RNA, 64 nt, Homo Sapiens; identical to SEQ ID NO: 113782

SEQ ID NO: 735072 - RNA, 64 nt, Homo Sapiens; identical to SEQ ID NO: 113783

SEQ ID NO: 735073 - RNA, 64 nt, Homo Sapiens; identical to SEQ ID NO: 113784

SEQ ID NO: 735074 - RNA, 64 nt, Homo Sapiens; identical to SEQ ID NO: 113785

SEQ ID NO: 735075 - RNA, 64 nt, Homo Sapiens; identical to SEQ ID NO: 113786

SEQ ID NO: 735076 - RNA, 64 nt, Homo Sapiens; identical to SEQ ID NO: 113787

SEQ ID NO: 735077 - RNA, 64 nt, Homo Sapiens; identical to SEQ ID NO: 113788

SEQ ID NO: 735078 - RNA, 64 nt, Homo Sapiens; identical to SEQ ID NO: 113789

SEQ ID NO: 735079 - RNA, 64 nt, Homo Sapiens; identical to SEQ ID NO: 113790

SEQ ID NO: 735080 - RNA, 64 nt, Homo Sapiens; identical to SEQ ID NO: 113791

SEQ ID NO: 735081 - RNA, 64 nt, Homo Sapiens; identical to SEQ ID NO: 113792

SEQ ID NO: 735082 - RNA, 64 nt, Homo Sapiens; identical to SEQ ID NO: 113793

SEQ ID NO: 735083 - RNA, 64 nt, Homo Sapiens; identical to SEQ ID NO: 113794

SEQ ID NO: 735084 - RNA, 64 nt, Homo Sapiens; identical to SEQ ID NO: 113795

SEQ ID NO: 735085 - RNA, 64 nt, Homo Sapiens; identical to SEQ ID NO: 113796

SEQ ID NO: 735086 - RNA, 64 nt, Homo Sapiens; identical to SEQ ID NO: 113797

SEQ ID NO: 735087 - RNA, 64 nt, Homo Sapiens; identical to SEQ ID NO: 113798

SEQ ID NO: 735088 - RNA, 64 nt, Homo Sapiens; identical to SEQ ID NO: 113799

SEQ ID NO: 735089 - RNA, 64 nt, Homo Sapiens; identical to SEQ ID NO: 113800

SEQ ID NO: 735090 - RNA, 64 nt, Homo Sapiens; identical to SEQ ID NO: 113801

SEQ ID NO: 735091 - RNA, 64 nt, Homo Sapiens; identical to SEQ ID NO: 113802

SEQ ID NO: 735092 - RNA, 64 nt, Homo Sapiens; identical to SEQ ID NO: 113803

SEQ ID NO: 735093 - RNA, 64 nt, Homo Sapiens; identical to SEQ ID NO: 113804

SEQ ID NO: 735094 - RNA, 64 nt, Homo Sapiens; identical to SEQ ID NO: 113805

SEQ ID NO: 735095 - RNA, 64 nt, Homo Sapiens; identical to SEQ ID NO: 113806

SEQ ID NO: 735096 - RNA, 64 nt, Homo Sapiens; identical to SEQ ID NO: 113807

SEQ ID NO: 735097 - RNA, 64 nt, Homo Sapiens; identical to SEQ ID NO: 113808

SEQ ID NO: 735098 - RNA, 64 nt, Homo Sapiens; identical to SEQ ID NO: 113809

SEQ ID NO: 735099 - RNA, 64 nt, Homo Sapiens; identical to SEQ ID NO: 113810

SEQ ID NO: 735100 - RNA, 64 nt, Homo Sapiens; identical to SEQ ID NO: 113811

SEQ ID NO: 735101 - RNA, 64 nt, Homo Sapiens
gucauaccacuagucucuguccuauaccccaugaaauguaaauacuguaucauaaguagaagaa

SEQ ID NO: 735102 - RNA, 64 nt, Homo Sapiens
uuuuguuuucuaaaaaugcauuuugagauaguuuaauguaaaucugacaggagcauucugaagc

SEQ ID NO: 735103 - RNA, 64 nt, Homo Sapiens
uuccacgcuucccucaguucaccaaaguuaccaaaauguaaaauaaaauaagacuggcucaggu

SEQ ID NO: 735104 - RNA, 64 nt, Homo Sapiens
caaaaucuuuccaaauguucugguaucuuugaaaaauguaaauaguuuauuuauagagaacccu

SEQ ID NO: 735105 - RNA, 64 nt, Homo Sapiens
uaaacugaaauaugucaugugaaauuauuuuaaaaauguaaaaacaaaacuuucugcuaacaaa

SEQ ID NO: 735106 - RNA, 64 nt, Homo Sapiens
augcauuaggcuuuggaaauuuaauguuaguugaaauguaaaaugugaaaacuuuagaucauuu

SEQ ID NO: 735107 - RNA, 64 nt, Homo Sapiens
auuauuuuugguuaucauguuagaauaaauaauaaauguaaacuguuugggacagcaccuggua

SEQ ID NO: 735108 - RNA, 64 nt, Homo Sapiens
cuuucacugaauacaaauaggcucauuuacuugaaauguaaaaauuuuuuuuuuuuuaaugaag

SEQ ID NO: 735109 - RNA, 64 nt, Homo Sapiens
aaaucuuagcuauauuuuaauaaauauuugccacaauguaaagcaaaguuuguuuucuaaaaug

SEQ ID NO: 735110 - RNA, 64 nt, Homo Sapiens
uuugccacaauguaaagcaaaguuuguuuucuaaaauguaaauaauuauguugacuaaauacaa

SEQ ID NO: 735111 - RNA, 64 nt, Homo Sapiens
uuacauguauauuacuuggcuuucagcucuuaaaaauguaaaugaugacacagaacuuuguacu

SEQ ID NO: 735112 - RNA, 64 nt, Homo Sapiens
cucaaaagcaagggcuucaauuucauuaccaaauaauguaaaacgggaaggaagaaaaaacggc

SEQ ID NO: 735113 - RNA, 64 nt, Homo Sapiens
guggaaaggccucaagcucacuugucuguaauguaauguaaagguuuaaagaaauauguuguuu

SEQ ID NO: 735114 - RNA, 64 nt, Homo Sapiens
ggccaacuccaauauaggguggguaaggccuuauaauguaaagagcauauaauguaaagggcuu

SEQ ID NO: 735115 - RNA, 64 nt, Homo Sapiens
ggguggguaaggccuuauaauguaaagagcauauaauguaaagggcuuuagagugagacagacc

SEQ ID NO: 735116 - RNA, 64 nt, Homo Sapiens
gggcuaacuucgggaucccugcacuuuauguaagaauguaaaccuggagucucauuuaagaaug

SEQ ID NO: 735117 - RNA, 64 nt, Homo Sapiens
aauguacauuuagagguuaaaagaaacagugagaaauguaaacauucaaaaugauaauugaauc

SEQ ID NO: 735118 - RNA, 64 nt, Homo Sapiens
aaaaaaaaaaaaagacucuacuucuuaaaugacaaauguaaaaauaugaauaccgcagggcagc

SEQ ID NO: 735119 - RNA, 64 nt, Homo Sapiens
uguauuaaaaggggguccaauauucucuuguaggaauguaaauccagaauguaugguaggaaug

SEQ ID NO: 735120 - RNA, 64 nt, Homo Sapiens
uaacuauuuuuccuucaaguccaaacucugucuuaauguaaaugauugaaaaauauaaagguau

SEQ ID NO: 735121 - RNA, 64 nt, Homo Sapiens
gcagacucauacucaaugggccuggccugugcagaauguaaacacucacaccuucuguuccccu

SEQ ID NO: 735122 - RNA, 64 nt, Homo Sapiens
gagauuuuuaugccugugacuuccuuggaaaucaaauguaaaguuuaauugaaagaauguaaag

SEQ ID NO: 735123 - RNA, 64 nt, Homo Sapiens
uccuuggaaaucaaauguaaaguuuaauugaaagaauguaaagcaaccaaaaagaaaaaaaaaa

SEQ ID NO: 735124 - RNA, 64 nt, Homo Sapiens
aacuuagcuaaguuuuguuuuguuuuucagcguuaauguaaaggggcagcagugccaaaauaua

SEQ ID NO: 735125 - RNA, 64 nt, Homo Sapiens
ucuaugcuuguaacugucuucuagcagugagccaaauguaaaauagugaauaaagucauuauua

SEQ ID NO: 735126 - RNA, 64 nt, Homo Sapiens
aguaacaaucuuuggauuuggcagagguuauuaaaauguaaagauaaauguguaaaagaaaaau

SEQ ID NO: 735127 - RNA, 64 nt, Homo Sapiens
ugccucugccuuuuccuucacuguuuucugggauaauguaaacaaccaaauaaagccauuuauu

SEQ ID NO: 735128 - RNA, 64 nt, Homo Sapiens
agaguucugauaaaauauuuuccauuguaaaugcaauguaaaugaagacuaaguuauuuacaug

SEQ ID NO: 735129 - RNA, 64 nt, Homo Sapiens
cagaaacuugcacuguuuuaagaugggagcuaagaauguaaaguugggaucagggaaugggaga

SEQ ID NO: 735130 - RNA, 63 nt, Homo Sapiens
auaagaaaauucauacuugagagaaauccuacaaauguaaagaauguggcaaaccuuuggaug

SEQ ID NO: 735131 - RNA, 64 nt, Homo Sapiens
cagaagaaaauuauuacuggagauaaacccugcaaauguaaagaguguaacaaaaccuuuaaac

SEQ ID NO: 735132 - RNA, 64 nt, Homo Sapiens
auauaagaauucauccuagauauaaaaccauagaaauguaaaagaugugacaaaaccuuuaagc

SEQ ID NO: 735133 - RNA, 64 nt, Homo Sapiens
acuuuaauacagcucaguaaauggcuucuucuagaauguaaaguuauguauuuaaaguuguauc

SEQ ID NO: 735134 - RNA, 64 nt, Homo Sapiens
accgcacguagcauuuacauuagguauuacaaguaauguaaagaugauuuaaguauacaggagg

SEQ ID NO: 735135 - RNA, 64 nt, Homo Sapiens
caaauuuauguagcuauguggaaugauaugucauaauguaaaauuagauaaauucuuuuuucuu

SEQ ID NO: 735136 - RNA, 64 nt, Homo Sapiens
auauaauguacauaaauguuacauuuguaaagaaaauguaaaaauguaacuauagcauaugaau

SEQ ID NO: 735137 - RNA, 64 nt, Homo Sapiens
aguuuugcauauucuugugcuaaaaaguguguauaauguaaagugaauuuuguaucuccuuuga

SEQ ID NO: 735138 - RNA, 64 nt, Homo Sapiens
aaaucaauuuuuaaaaaauaaccagauuuuuauuaauguaaaaauugguuuuauaauguuuguc

SEQ ID NO: 735139 - RNA, 64 nt, Homo Sapiens
cauuucauuuaucauucauguaaauaguggugguaauguaaaauuaaugguaggaauguuaaug

SEQ ID NO: 735140 - RNA, 64 nt, Homo Sapiens
guggugguaauguaaaaucaaugguaggaauguuaauguaaauauuuuauuuuggagacggcua

SEQ ID NO: 735141 - RNA, 64 nt, Homo Sapiens
ggaaauaaaagucuuuugaaaaauuugcauaaugaauguaaaaggugagaaaagaauagaagug

SEQ ID NO: 735142 - RNA, 64 nt, Homo Sapiens
uuuuagaacucuuugcuguuacaguuguaagagaaauguaaauugaacuauuguucucugaaug

SEQ ID NO: 735143 - RNA, 64 nt, Homo Sapiens
aaaauaagcaaagaccacacauuuuuuacuacaaaauguaaaggauaaauguaaauccugcaua

SEQ ID NO: 735144 - RNA, 64 nt, Homo Sapiens
accacacauuuuuuacuacaaaauguaaaggauaaauguaaauccugcauaacuaaaaucacaa

SEQ ID NO: 735145 - RNA, 64 nt, Homo Sapiens
ccagugaagagccuaugugcauuuuguaguagauaauguaaaauuugucaucuuuuucuuuucu

SEQ ID NO: 735146 - RNA, 64 nt, Homo Sapiens
aauaauaugaaagaccuaguuaaaaauucuaaccaauguaaaaugaccauuuuucuguugcauu

SEQ ID NO: 735147 - RNA, 64 nt, Homo Sapiens
aaagccagccuguuuucagaguaugauguccuuuaauguaaacucaaauaucaauauuuuaaau

SEQ ID NO: 735148 - RNA, 64 nt, Homo Sapiens
ucaaaaauagaaaaaaaaaaaaaaagaaaaaaagaauguaaaauuuuaaaaauacaguuuaaca

SEQ ID NO: 735149 - RNA, 64 nt, Homo Sapiens
guuuauuuucucuuaaacaauuuuuaaaauucagaauguaaaaauuggguaaauuuacuacuga

SEQ ID NO: 735150 - RNA, 64 nt, Homo Sapiens
uguaguuacagaguaauuacauggugauuuuugcaauguaaaauaaaguguuucugauuauuuu

SEQ ID NO: 735151 - RNA, 64 nt, Homo Sapiens
cuaaagaaaagaaucagaaaucaaucuuucuacuaauguaaauuugagauuauuuuuaaaaaug

SEQ ID NO: 735152 - RNA, 64 nt, Homo Sapiens
ucuaaaaaccuaugaguauuuaauucauagaaaaaauguaaaaggucuuuuuaaaaaucaugaa

SEQ ID NO: 735153 - RNA, 64 nt, Homo Sapiens
ugaauuuucuuuuaaaaacagucacugaguuaauaauguaaauaaguguguggccuucuuuaaa

SEQ ID NO: 735154 - RNA, 64 nt, Homo Sapiens
caagugaaauuuuaauaaacuuuucaguuuuuuuaauguaaaaguauauauauuaaguuuaauu

SEQ ID NO: 735155 - RNA, 64 nt, Homo Sapiens
cagagugauccuuguguauaacaguuacagaaaaaauguaaacugccggaacugccuugggacc

SEQ ID NO: 735156 - RNA, 64 nt, Homo Sapiens
ugaaauuggugugucugcaauguuguuuuaauggaauguaaacccaacuagacaaagaaaaaau

SEQ ID NO: 735157 - RNA, 64 nt, Homo Sapiens
gaaagguggguggauaaaguaaacucuuguaaguaauguaaauaagaaaggcuaauauggaacc

SEQ ID NO: 735158 - RNA, 64 nt, Homo Sapiens
acugcuauauuaauguuuuaaccauaacugagcaaauguaaauucucuggacuuuauuuugcua

SEQ ID NO: 735159 - RNA, 64 nt, Homo Sapiens
guucauagaaaaggaacauaaaucuaauguuucaaauguaaauuccuucccucaucagugaaaa

SEQ ID NO: 735160 - RNA, 64 nt, Homo Sapiens
uggaacuuauuuuugucaaagcugaugacgcauuaauguaaaaaucagaggaucuaacauagaa

SEQ ID NO: 735161 - RNA, 64 nt, Homo Sapiens
aggucagaggaucuaacauagcaauuucauaguaaauguaaauacuuugagugacaugcuaaca

SEQ ID NO: 735162 - RNA, 64 nt, Homo Sapiens
gccacauucuuacacuguccagcuuguaaugguuaauguaaaacuuaccagaugaaccuugugu

SEQ ID NO: 735163 - RNA, 64 nt, Homo Sapiens
uaaaucaugaauugaacauguaaaauuccaguaaaauguaaaaacggaauaugcaucgcucuua

SEQ ID NO: 735164 - RNA, 64 nt, Homo Sapiens
acagaaacacauaguauuugcacuuuguacuuuaaauguaaauucacuuuguagaaaugagcua

SEQ ID NO: 735165 - RNA, 64 nt, Homo Sapiens
agucacagugccugggaggggcccauccuuccaaaauguaaauccagucgcggugugaccgagc

SEQ ID NO: 735166 - RNA, 64 nt, Homo Sapiens
uuuggaugaaguuuuucuuuaaaugucuuuuuaaaauguaaauauaauaaguagccuauuuuuu

SEQ ID NO: 735167 - RNA, 64 nt, Homo Sapiens
gccucuacagaguuuuaugguacagaauuuacgaaauguaaaugaugauacaguaagguguaau

SEQ ID NO: 735168 - RNA, 64 nt, Homo Sapiens
uaauaguacuuguaauuucugagguaacuuguuuaauguaaaucgagaaucgagaaauuugaua

SEQ ID NO: 735169 - RNA, 64 nt, Homo Sapiens
ggggggggcucuacagcaguugagugccacuauuaauguaaaaacagaucuuauuuuuuuauuu

SEQ ID NO: 735170 - RNA, 64 nt, Homo Sapiens
uguacaauguuguuaugguaugcaugugauuguaaauguaaauuuuuuuuuuaacuguagauca

SEQ ID NO: 735171 - RNA, 64 nt, Homo Sapiens
acacgagguauuuuauacuggugagaaaccuuacaauguaaagaauguggcacagcuuuuaacu

SEQ ID NO: 735172 - RNA, 64 nt, Homo Sapiens
uguaagaguauuuauacuggaaagaaacccuacaaauguaaaaaacguggcaaugccuuuaacu

SEQ ID NO: 735173 - RNA, 64 nt, Homo Sapiens
aaucaaauaacuagacauauaucagaaacuuuaaaauguaaaaguuguacacuuucaacauuuu

SEQ ID NO: 735174 - RNA, 64 nt, Homo Sapiens
ugugcuccucuuuuggauuuacagaaaugugucaaauguaaaucuuucaaagccauuuaaaaau

SEQ ID NO: 735175 - RNA, 64 nt, Homo Sapiens
aaucuauaucuguuagaaauaauguagccaaaagaauguaaauuugaggauuuuuuugccaaua

SEQ ID NO: 735176 - RNA, 64 nt, Homo Sapiens
aaauauaugaaccaaagugauuugaguuuguaaaaauguaaaauaguaugaacaaaauuugcac

SEQ ID NO: 735177 - RNA, 64 nt, Homo Sapiens
accucaggcaccaccuucgccuaagaaguuaucuaauguaaaagguggagaaccugacagagga

SEQ ID NO: 735178 - RNA, 64 nt, Homo Sapiens
aucucaauuuuuauauugguaagauguaccaaaaaauguaaacuaaaauacauaccagauuuua

SEQ ID NO: 735179 - RNA, 64 nt, Homo Sapiens
ggacagcucaggguuguuuuauuuaauugacaugaauguaaaggcauuugacuuuuauuuuugu

SEQ ID NO: 735180 - RNA, 64 nt, Homo Sapiens
gccuccacguggcggcagacgugaauuguuggagaauguaaaccuuuguauuuucccugccgaa

SEQ ID NO: 735181 - RNA, 64 nt, Homo Sapiens
aaaauuuuuuuucaaaaaugacauaacucugcugaauguaaaagaauguagaaauucuucauga

SEQ ID NO: 735182 - RNA, 64 nt, Homo Sapiens
caaaaccaucuucuguguuucacagaaaugugucaauguaaagcuuuucucuucuacauugaca

SEQ ID NO: 735183 - RNA, 64 nt, Homo Sapiens
ucuuacuggaaaugacaaguuuucucuggacaggaauguaaauggcugagugauggccaaguuu

SEQ ID NO: 735184 - RNA, 64 nt, Homo Sapiens
cagugaccauguuaaccuaccauauuuuuuugauaauguaaauauucaaacugauacauauaca

SEQ ID NO: 735185 - RNA, 64 nt, Homo Sapiens
aaauuaguucagccauugugacacuguugguggaaauguaaauuggagaaaaagauaugcuuau

SEQ ID NO: 735186 - RNA, 64 nt, Homo Sapiens
ccaaaacaguaaaaauccuguggauuaaagacuuaauguaaaacauacaaaaauuaacucaaga

SEQ ID NO: 735187 - RNA, 64 nt, Homo Sapiens
ugggcauuuuucucucuguucccucucuuuugaaaauguaaaauaaaaccaaaaauagacaacu

SEQ ID NO: 735188 - RNA, 64 nt, Homo Sapiens
uuugaacuuccaaguaugucuagucaccuuuuaaaauguaaacauuuucagaaaaaugaggauu

SEQ ID NO: 735189 - RNA, 64 nt, Homo Sapiens
uuggcugagucuugagacugaaagauuuagccauaauguaaacugccucaaauuggacuuuggg

SEQ ID NO: 735190 - RNA, 64 nt, Homo Sapiens
uuuacacaauguuucucuguaaauauugccauuaaauguaaauaacuuuaauaaaacguuuaua

SEQ ID NO: 735191 - RNA, 64 nt, Homo Sapiens
auaaagcaaguguaauuaauuuaaaaguacuguuaauguaaaaaauauauuagagaacugugau

SEQ ID NO: 735192 - RNA, 64 nt, Homo Sapiens
gauuaaacuuuacaauuuaguuaguacauucuagaauguaaaagcacuguaugguuuuaauaua

SEQ ID NO: 735193 - RNA, 64 nt, Homo Sapiens
ggggcuucaauauauauauaauguaaauuguaauaauguaaaugguaguauaauuuguggagaa

SEQ ID NO: 735194 - RNA, 64 nt, Homo Sapiens
guaauaauguaaaugggggcauaauuuguggagaaauguaaauuuuaaaauauuugggaguagu

SEQ ID NO: 735195 - RNA, 64 nt, Homo Sapiens
guauaaaaaguuugugaauaaaauuuagcaauagaauguaaauuuugacaucuggcucauuaaa

SEQ ID NO: 735196 - RNA, 64 nt, Homo Sapiens
cuaauguacugcugccuucugcauacguuaaauaaauguaaauauaauaaugaguguguaaacu

SEQ ID NO: 735197 - RNA, 64 nt, Homo Sapiens
uaaguaauuaagcauaugacaucuuagaggaaaaaauguaaaggucuuguuuauuguugaugcc

SEQ ID NO: 735198 - RNA, 64 nt, Homo Sapiens
ccguaaugcacuaagcuuuuuuuaaaaaagaagcaauguaaagauucauacuacuguuaacuuu

SEQ ID NO: 735199 - RNA, 64 nt, Homo Sapiens
cagccuauuuauauauguugcuuauacaauuucaaauguaaaaagauuaaaaguugugcauggg

SEQ ID NO: 735200 - RNA, 64 nt, Homo Sapiens
gaacacuaauuaaaaaacaagguggaaguucugcaauguaaauaaaaguuaaacuacugcaguu

SEQ ID NO: 735201 - RNA, 64 nt, Homo Sapiens
aaaaaaagagguagcuuuuagauugcaaacuggaaauguaaaacucaugaaauuuaagcaauau

SEQ ID NO: 735202 - RNA, 64 nt, Homo Sapiens
guaacuuugugggaacacugauucauauuuagaaaauguaaaugucuguagcacuuucuugcag

SEQ ID NO: 735203 - RNA, 64 nt, Homo Sapiens
gaacaucuauacauauggugaucuaaauguacaaaauguaaaauguauaagucaucucacuuuu

SEQ ID NO: 735204 - RNA, 64 nt, Homo Sapiens
uauaaaaaguuuauuuugcuauugugaaaaacuaaauguaaaggaaaucaccuacuuucaugca

SEQ ID NO: 735205 - RNA, 64 nt, Homo Sapiens
cuugggauuguuuuguggguuuuuguuuguuuuaaauguaaauugagaaucuuuuauaagaaau

SEQ ID NO: 735206 - RNA, 64 nt, Homo Sapiens
auguauaccugccaagauaccccaaaucucucaaaauguaaauuguaauauuguguauacaaaa

SEQ ID NO: 735207 - RNA, 64 nt, Homo Sapiens
uggugguuuggccauuaauucccauauuuuagaaaauguaaaaaagguggccugcugaggcugc

SEQ ID NO: 735208 - RNA, 64 nt, Homo Sapiens
aaaaaauuugguucucaagugaacaaacauauaaaauguaaacaaucccuacaauccagauaaa

SEQ ID NO: 735209 - RNA, 64 nt, Homo Sapiens
uguugauaggugaccacuguugguauuuacauuaaauguaaagaaauguguacugaucucauug

SEQ ID NO: 735210 - RNA, 64 nt, Homo Sapiens
acaaaagucugagauggggaguuucagauaaccgaauguaaauccuuuaucagauuuuaacuug

SEQ ID NO: 735211 - RNA, 64 nt, Homo Sapiens
gcuuugggguuuuuuuuuucuuuuuuuuuuuuuuaauguaaacuaaccuccugcaugacagagg

SEQ ID NO: 735212 - RNA, 64 nt, Homo Sapiens
aacaugccccauacuuuguauuggagaguacaauaauguaaauccuaaaagcaccacuauuuua

SEQ ID NO: 735213 - RNA, 64 nt, Homo Sapiens
ccaaccuaauguuacaacuacuuugagguggccaaauguaaacuaaaagccuuaauuaaagugg

SEQ ID NO: 735214 - RNA, 64 nt, Homo Sapiens
gaaugguggucagacugaugacagauccuagaccaauguaaagaauguguaucuguauauaaau

SEQ ID NO: 735215 - RNA, 64 nt, Homo Sapiens
gggguggcaauagcauugugccauuuugucauagaauguaaaaauugguuaacuuuacaaaugu

SEQ ID NO: 735216 - RNA, 64 nt, Homo Sapiens
gcucaugaagguuuugaaugaacuaagagcagaaaauguaaaauaaucuucucauuuuauugaa

SEQ ID NO: 735217 - RNA, 64 nt, Homo Sapiens
guguccauuaguaaaagugacuguucuuguuucuaauguaaauauugaccauaaaaagucauug

SEQ ID NO: 735218 - RNA, 64 nt, Homo Sapiens
uuuccaaacuaaauuacucgauauuuugacuaagaauguaaauaaccuuuagacucugaaagua

SEQ ID NO: 735219 - RNA, 64 nt, Homo Sapiens
uccaaguaaaaugagguaugacuuaauauuaaagaauguaaaggacaaaacauuuaagugccag

SEQ ID NO: 735220 - RNA, 64 nt, Homo Sapiens
uaucuauauacaaaaggcuaaagucagccuaaagaauguaaagggaaaaaagaugacaauuuaa

SEQ ID NO: 735221 - RNA, 64 nt, Homo Sapiens
aaaaaggaacuaguuagagugacaaugguuugagaauguaaaaccagagauauuuagaauauuu

SEQ ID NO: 735222 - RNA, 64 nt, Homo Sapiens
gaaaagaggcuuacauuuuaaugcuuuuaugacuaauguaaaauuauuauuuacaaagauucaa

SEQ ID NO: 735223 - RNA, 64 nt, Homo Sapiens
gaaaaccucuuguguucacaucggcauuuuuuaaaauguaaaagcuaauuuugauaucucauuu

SEQ ID NO: 735224 - RNA, 64 nt, Homo Sapiens
cuguguuugugcuguaagaguacaaagaacuugaaauguaaauaaaaauggcauacaucuuuug

SEQ ID NO: 735225 - RNA, 64 nt, Homo Sapiens
ccauguuuagcuugcagcugaacaacccucuaaaaauguaaaaaguuuaguuuguuuuuuuuca

SEQ ID NO: 735226 - RNA, 64 nt, Homo Sapiens
uuuccagugugccaacuccaaagucaacauuaaaaauguaaauggaccuguguaaauaucacag

SEQ ID NO: 735227 - RNA, 64 nt, Homo Sapiens
uccuuuaauaaguaaagaaaauaauauguuuaaaaauguaaauguuuuacaaauuugaaacuuu

SEQ ID NO: 735228 - RNA, 64 nt, Homo Sapiens
gcacuaaacguuuucuuucuagaguuuuaaaaugaauguaaauagaauuaaauuuguauagagc

SEQ ID NO: 735229 - RNA, 64 nt, Homo Sapiens
guuucaaauggucagcguugccuuacaaacauuaaauguaaaugcuguacuaagugucaacagc

SEQ ID NO: 735230 - RNA, 64 nt, Homo Sapiens
aaguacccaugauuucuauuaugccuuccaucugaauguaaaauuuuuuaauacauauccaaua

SEQ ID NO: 735231 - RNA, 64 nt, Homo Sapiens
uuuuauuuaggacauuugcauuaacugugaaaaaaauguaaagguaggcaguucagagcauaag

SEQ ID NO: 735232 - RNA, 64 nt, Homo Sapiens
gcauauuuuuuaacaaugcccaaucuguaugaauaauguaaacuucgauuuuuuuuuaaaaaaa

SEQ ID NO: 735233 - RNA, 64 nt, Homo Sapiens
uaaaaaaauuagauuuuagcuggagcuuuugacuaauguaaaguaaaugccaaacuaccgacuu

SEQ ID NO: 735234 - RNA, 64 nt, Homo Sapiens
uaaaaauguuuagaucuuguuuuuaaagacauuaaauguaaacucuuauagcuuuuaaaagacc

SEQ ID NO: 735235 - RNA, 64 nt, Homo Sapiens
ugacuuucuggaaaguuuaguaaaauguacaaugaauguaaauaaauuuguauuuauguguaua

SEQ ID NO: 735236 - RNA, 64 nt, Homo Sapiens
uaggguccagucauauccuacuucuugaaacuguaauguaaaucuuauacaugguugguugucu

SEQ ID NO: 735237 - RNA, 64 nt, Homo Sapiens
uaggguuuguaaaagucacaaguuacuauuuacuaauguaaacgccacauagcuuuugcacugc

SEQ ID NO: 735238 - RNA, 64 nt, Homo Sapiens
ucuaaaaccaaagcugauuuuuagaaaauuugaaaauguaaaucagcccuauccauacuauagu

SEQ ID NO: 735239 - RNA, 64 nt, Homo Sapiens
ugaauuuuaccaauuuaugaauucuuguaagcggaauguaaaacggaaauacugaaagacuuuu

SEQ ID NO: 735240 - RNA, 64 nt, Homo Sapiens
ggaaauacugaaagacuuuuauucuuguaagcggaauguaaaacugaauuuuaccaauuuauga

SEQ ID NO: 735241 - RNA, 64 nt, Homo Sapiens
agcccuauccauacuauaguuuagaaaauuugaaaauguaaaucucuaaaaccaaagcugauuu

SEQ ID NO: 735242 - RNA, 64 nt, Homo Sapiens
auuuuugaccuuauauauguuuugagaaaacagaaauguaaaggggguugggggaagauauuac

SEQ ID NO: 735243 - RNA, 64 nt, Homo Sapiens
guaaucuucugucccuuuaagcaagagacugcaaaauguaaacacaugaaauugucuuaaaaaa

SEQ ID NO: 735244 - RNA, 64 nt, Homo Sapiens
cuaaaauaaagcaucuauuagugucugauuuaggaauguaaaaugauucuguauuaauguaaau

SEQ ID NO: 735245 - RNA, 64 nt, Homo Sapiens
ugucugauuuaggaauguaaaaugauucuguauuaauguaaauaagauuaucuauugcaaaaag

SEQ ID NO: 735246 - RNA, 64 nt, Homo Sapiens
auuauuucaagcuagucauugagguauaugacaaaauguaaauaacaaaaaacugaaaucuacc

SEQ ID NO: 735247 - RNA, 64 nt, Homo Sapiens
ggagcucauggugccgcuggggacuuuuuagagaaauguaaagagaauagcuauucagugucua

SEQ ID NO: 735248 - RNA, 51 nt, Homo Sapiens
auacuagagaaaaacuuuaaaaauguaaaacauggagcagauuuuuuacuu

SEQ ID NO: 735249 - RNA, 64 nt, Homo Sapiens
uaauaucagcauuuuucauggaaguuuaaugccaaauguaaaacacaugaaaauuuuuaaaaau

SEQ ID NO: 735250 - RNA, 64 nt, Homo Sapiens
uugcaacacacaaacggaaggagaucugguuuugaauguaaaaguuacuaaccuugaaauguaa

SEQ ID NO: 735251 - RNA, 64 nt, Homo Sapiens
ggaaucuugccagauguagcuugacuauaggcuuaauguaaaaauaugccuuauuacagacuug

SEQ ID NO: 735252 - RNA, 64 nt, Homo Sapiens
ucugccucggccauucaaaagucuaauaacaaaaaauguaaaccuaauuuggcaguuuguuagg

SEQ ID NO: 735253 - RNA, 64 nt, Homo Sapiens
acuaaaauuagaaauguccccucacugcagaucaaauguaaagcuuccaguuaaggagcuaaau

SEQ ID NO: 735254 - RNA, 64 nt, Homo Sapiens
cuaaacugggauuuauaaaccagcugugauuaacaauguaaaguauuaauuauugaacuuugaa

SEQ ID NO: 735255 - RNA, 64 nt, Homo Sapiens
uaguugacuguauuauuugauuucggauugaaugaauguaaauagaaauuaaaugcaaauuuga

SEQ ID NO: 735256 - RNA, 64 nt, Homo Sapiens
aagagauguuaagcaagugguuguuuuagauccaaauguaaaggcagguuugggaagguguuua

SEQ ID NO: 735257 - RNA, 64 nt, Homo Sapiens
uaaaguuuaucagauauuuucauauuuaaagccaaauguaaauagaggucuguaaagaaaaaua

SEQ ID NO: 735258 - RNA, 64 nt, Homo Sapiens
cugccuuuaugguauaaaacuguaaaaacagaaaaauguaaauggagauaagggaaggggagac

SEQ ID NO: 735259 - RNA, 64 nt, Homo Sapiens
aacauguuuguugaaguacucaucaaugcauaagaauguaaauauccguuagaaauaaaagcag

SEQ ID NO: 735260 - RNA, 64 nt, Homo Sapiens
acauucagauuuaauuacuguaaguaaaauuuaaaauguaaauacaucaguucauguucuguau

SEQ ID NO: 735261 - RNA, 64 nt, Homo Sapiens
acucaugguguggcuaaucuacauuuaucaauaaaauguaaauuaucugaaaggacagaauaua

SEQ ID NO: 735262 - RNA, 64 nt, Homo Sapiens
uaaggguaauggucugucaucaguguugaaggcaaauguaaacagaaaaauuuguagcggaugg

SEQ ID NO: 735263 - RNA, 64 nt, Homo Sapiens
ucuucacucaccauuaugauaaaauccacugggaaauguaaaaauuuucccuauugacugucag

SEQ ID NO: 735264 - RNA, 64 nt, Homo Sapiens
aggcuuucuggggaucacagaaaauagacgagaaaauguaaauaacaguuggaggaauccaugg

SEQ ID NO: 735265 - RNA, 64 nt, Homo Sapiens
aucagcucacaggcaucaaugagauguggggagaaauguaaacacuacaugcugucauugaaca

SEQ ID NO: 735266 - RNA, 64 nt, Homo Sapiens
caugcaagaacacacaauggagagaaacccuaugaauguaaagaaugcagaaaagcauucagcu

SEQ ID NO: 735267 - RNA, 64 nt, Homo Sapiens
cagaccugacaagauucuuugaauacagauaaugaauguaaacaauuaacuguuuauaauaacu

SEQ ID NO: 735268 - RNA, 64 nt, Homo Sapiens
acaacugauaccagccgcugcaaaaucaugccaaaauguaaagaccaucgagacuaggaagaaa

SEQ ID NO: 735269 - RNA, 64 nt, Homo Sapiens
agcaucaaauucucacauaacaauauuagcuuuaaauguaaaugggcuaaaugcuccaauuaaa

SEQ ID NO: 735270 - RNA, 64 nt, Homo Sapiens
gaccacauaguuggaaguaaagcacuccucagcaaauguaaaggaacaaaaauuauaacaaacu

SEQ ID NO: 735271 - RNA, 64 nt, Homo Sapiens
ugagauaaaacaacacaaugcauguugccuuuuuaauguaaauacccguagguaucauuaauag

SEQ ID NO: 735272 - RNA, 64 nt, Homo Sapiens
uuguuuuuaaauguuagauggcacuauguauauuaauguaaaacaauguuaauuuacucaaguu

SEQ ID NO: 735273 - RNA, 64 nt, Homo Sapiens
caucuuuuauuccauacugcaaagaaauuuugcaaauguaaagaauaugacaaggucuucaaac

SEQ ID NO: 735274 - RNA, 64 nt, Homo Sapiens
agagaaaagcaaauacuuauacacugcuggugggaauguaaauuaauucagccauuguggaaag

SEQ ID NO: 735275 - RNA, 64 nt, Homo Sapiens
ucgaaaguuuuucaauuuuagaauagaaacuauaaauguaaauaaugugaagaaagugcacgcu

SEQ ID NO: 735276 - RNA, 64 nt, Homo Sapiens
auguggaaaacccuucaguuagagaaacccuaugaauguaaagacaugaacgaauucauacugg

SEQ ID NO: 735277 - RNA, 64 nt, Homo Sapiens
gugugguaaagccuucaguaagagaaaccuuaugaauguaaacacaugaaagaacccacacugg

SEQ ID NO: 735278 - RNA, 64 nt, Homo Sapiens
augugggaaaacauacauuaaaagaaacaguaugaauguaaaaacaugaaaggaugcacacugc

SEQ ID NO: 735279 - RNA, 64 nt, Homo Sapiens
gugugggaaaacuuacuuguacagaaacacuaugaauguaaacucaugagaggaaucacacugc

SEQ ID NO: 735280 - RNA, 64 nt, Homo Sapiens
augugggaaaguguucguauagaaaaacccuaugaauguaaaaacaugaaagaacucacacugg

SEQ ID NO: 735281 - RNA, 64 nt, Homo Sapiens
auguggaaaaaccuacauauacagaaacgcuaugaauguaaacacaugaaaggaaucacacugu

SEQ ID NO: 735282 - RNA, 64 nt, Homo Sapiens
cauaguaaagccuuaauuuuagauaaacccuaugaauguaaacaauagaaauaauucucauugg

SEQ ID NO: 735283 - RNA, 64 nt, Homo Sapiens
ugggaaagccuuucauaauuacagaaacccuauaaauguaaaugcaugaauaaacuuacacugg

SEQ ID NO: 735284 - RNA, 64 nt, Homo Sapiens
auguggugaaggcuuaagugaaauaaacucuaugaauguaaaccaaauaaaaaaaaagaaaaag

SEQ ID NO: 735285 - RNA, 64 nt, Homo Sapiens
augugggaaagcauuugguuagagaagccauaugaauguaaauacaugagacaacucauauggg

SEQ ID NO: 735286 - RNA, 64 nt, Homo Sapiens
ugggaaagccuuuagugaucggagaaaaucuauaaauguaaaugcaugaaaggacucacacuag

SEQ ID NO: 735287 - RNA, 64 nt, Homo Sapiens
uuuuaucgcuucuguuuucucaaauauauuuuaaaauguaaauauaaccccccaaaaaaucaca

SEQ ID NO: 735288 - RNA, 64 nt, Homo Sapiens
cucuuuuauaaccccccaaagaaugcaauuuuaaaauguaaagguuuaaugcauagccucuuca

SEQ ID NO: 735289 - RNA, 64 nt, Homo Sapiens
uaagauaguuagguauuaaacacuucagaauaucaauguaaaauuggaaaauaaggaacugggg

SEQ ID NO: 735290 - RNA, 64 nt, Homo Sapiens
guaucacaucuagcucccuuacuuguccacagauaauguaaacaaaggagggaaaaacuuauua

SEQ ID NO: 735291 - RNA, 64 nt, Homo Sapiens
aaacauauaauuugcuuaauuacgugaauaaugaaauguaaaauccggguccauaagccuuuau

SEQ ID NO: 735292 - RNA, 64 nt, Homo Sapiens
uggaagugcgguugagcucucugccacuuucuucaauguaaaaaguaggcaucaaagauacgac

SEQ ID NO: 735293 - RNA, 64 nt, Homo Sapiens
ugcuuccaaguuggggggaauucacaaaaacgguaauguaaaugaagcuuugaaaauaaaggac

SEQ ID NO: 735294 - RNA, 64 nt, Homo Sapiens
aaaaaaacuggcugaauggcuuugguauuaauaaaauguaaaaaaagcacaggccauuuuucac

SEQ ID NO: 735295 - RNA, 64 nt, Homo Sapiens
accaccagcccauccugaggaaagccuccuauggaauguaaagugcaaucauuucuucagauau

SEQ ID NO: 735296 - RNA, 64 nt, Homo Sapiens
uucaaaccauuuaccaucugaaaguuuugauuugaauguaaaacaggaaauuggaauuccuuug

SEQ ID NO: 735297 - RNA, 64 nt, Homo Sapiens
ucauuuucaucuguuuuuugaagaaaaauggaaaaauguaaaaggcagccccuccccaggcuuu

SEQ ID NO: 735298 - RNA, 64 nt, Homo Sapiens
uuuguguaaauacuagucuuuuuggaaaaaaaauaauguaaagauguuuuguauaaacucugaa

SEQ ID NO: 735299 - RNA, 64 nt, Homo Sapiens
uuuucuccaggugcuuauauugaucuggaauuguaauguaaaaagcaaugcaaacuuaggcgag

SEQ ID NO: 735300 - RNA, 64 nt, Homo Sapiens
ugucccaauuuguauugauucucuuuaaauauaaaauguaaauaaaauauuccaauaaaaguuu

SEQ ID NO: 735301 - RNA, 64 nt, Homo Sapiens
gugauuggcuaaacaaucucgcauuaaaaauucaaauguaaauugaauucacaugaaaaaucau

SEQ ID NO: 735302 - RNA, 64 nt, Homo Sapiens
uguuuucgucacaugcugaguaaaagugccuuacaauguaaaaauuguacaguacuuauguucc

SEQ ID NO: 735303 - RNA, 64 nt, Homo Sapiens
uucagaaaaggucuguuuucauagauagcucaggaauguaaaggagacuuaugaaggcauuagg

SEQ ID NO: 735304 - RNA, 64 nt, Homo Sapiens
acauaugagcaagaaaaaagauacaucaguauguaauguaaaagucuuugccaagcugccuagc

SEQ ID NO: 735305 - RNA, 64 nt, Homo Sapiens
uauuuuguagaggcucaguauucauuuguuuaaaaauguaaagcguaagugaaaaaaaaucaca

SEQ ID NO: 735306 - RNA, 64 nt, Homo Sapiens
aacaaccugaauugagucauuugagugguacuuaaauguaaagucuugcuuuuauguccacuuu

SEQ ID NO: 735307 - RNA, 64 nt, Homo Sapiens
cuguucugucacaaauguucggaauuugaacaacaauguaaaacgugaccaagguccucaaauu

SEQ ID NO: 735308 - RNA, 64 nt, Homo Sapiens
auaucuuuucauucaucuuauccaugaaagccuaaauguaaaaucuucauuuccccucccccaa

SEQ ID NO: 735309 - RNA, 64 nt, Homo Sapiens; identical to SEQ ID NO: 354755

SEQ ID NO: 735310 - RNA, 64 nt, Homo Sapiens; identical to SEQ ID NO: 354756

SEQ ID NO: 735311 - RNA, 64 nt, Homo Sapiens; identical to SEQ ID NO: 354757

SEQ ID NO: 735312 - RNA, 64 nt, Homo Sapiens; identical to SEQ ID NO: 354758

SEQ ID NO: 735313 - RNA, 64 nt, Homo Sapiens; identical to SEQ ID NO: 354759

SEQ ID NO: 735314 - RNA, 64 nt, Homo Sapiens; identical to SEQ ID NO: 354760

SEQ ID NO: 735315 - RNA, 64 nt, Homo Sapiens; identical to SEQ ID NO: 354761

SEQ ID NO: 735316 - RNA, 64 nt, Homo Sapiens; identical to SEQ ID NO: 354762

SEQ ID NO: 735317 - RNA, 64 nt, Homo Sapiens; identical to SEQ ID NO: 354763

SEQ ID NO: 735318 - RNA, 64 nt, Homo Sapiens; identical to SEQ ID NO: 354764

SEQ ID NO: 735319 - RNA, 64 nt, Homo Sapiens; identical to SEQ ID NO: 354765

SEQ ID NO: 735320 - RNA, 64 nt, Homo Sapiens; identical to SEQ ID NO: 354766

SEQ ID NO: 735321 - RNA, 64 nt, Homo Sapiens; identical to SEQ ID NO: 354767

SEQ ID NO: 735322 - RNA, 64 nt, Homo Sapiens; identical to SEQ ID NO: 354768

SEQ ID NO: 735323 - RNA, 64 nt, Homo Sapiens; identical to SEQ ID NO: 354769

SEQ ID NO: 735324 - RNA, 64 nt, Homo Sapiens; identical to SEQ ID NO: 354770

SEQ ID NO: 735325 - RNA, 64 nt, Homo Sapiens; identical to SEQ ID NO: 354771

SEQ ID NO: 735326 - RNA, 64 nt, Homo Sapiens; identical to SEQ ID NO: 354772

SEQ ID NO: 735327 - RNA, 64 nt, Homo Sapiens; identical to SEQ ID NO: 354773

SEQ ID NO: 735328 - RNA, 64 nt, Homo Sapiens; identical to SEQ ID NO: 354774

SEQ ID NO: 735329 - RNA, 64 nt, Homo Sapiens; identical to SEQ ID NO: 354775

SEQ ID NO: 735330 - RNA, 64 nt, Homo Sapiens; identical to SEQ ID NO: 354776

SEQ ID NO: 735331 - RNA, 64 nt, Homo Sapiens; identical to SEQ ID NO: 354777

SEQ ID NO: 735332 - RNA, 64 nt, Homo Sapiens; identical to SEQ ID NO: 354778

SEQ ID NO: 735333 - RNA, 64 nt, Homo Sapiens; identical to SEQ ID NO: 354779

SEQ ID NO: 735334 - RNA, 64 nt, Homo Sapiens; identical to SEQ ID NO: 354780

SEQ ID NO: 735335 - RNA, 64 nt, Homo Sapiens; identical to SEQ ID NO: 354781

SEQ ID NO: 735336 - RNA, 64 nt, Homo Sapiens; identical to SEQ ID NO: 354782

SEQ ID NO: 735337 - RNA, 64 nt, Homo Sapiens; identical to SEQ ID NO: 354783

SEQ ID NO: 735338 - RNA, 64 nt, Homo Sapiens; identical to SEQ ID NO: 354784

SEQ ID NO: 735339 - RNA, 64 nt, Homo Sapiens; identical to SEQ ID NO: 354785

SEQ ID NO: 735340 - RNA, 64 nt, Homo Sapiens; identical to SEQ ID NO: 354786

SEQ ID NO: 735341 - RNA, 64 nt, Homo Sapiens; identical to SEQ ID NO: 354787

SEQ ID NO: 735342 - RNA, 64 nt, Homo Sapiens; identical to SEQ ID NO: 354788

SEQ ID NO: 735343 - RNA, 64 nt, Homo Sapiens; identical to SEQ ID NO: 354789

SEQ ID NO: 735344 - RNA, 64 nt, Homo Sapiens; identical to SEQ ID NO: 354790

SEQ ID NO: 735345 - RNA, 64 nt, Homo Sapiens; identical to SEQ ID NO: 354791

SEQ ID NO: 735346 - RNA, 64 nt, Homo Sapiens; identical to SEQ ID NO: 354792

SEQ ID NO: 735347 - RNA, 64 nt, Homo Sapiens
ccuucucucuggcugccucuagaauucauauaaauucauauaugcuaacccgagucucacccac

SEQ ID NO: 735348 - RNA, 64 nt, Homo Sapiens
uucauauaugccuucucucuucucacccacagaauucauauaaaguaaguagaucuaacccgag

SEQ ID NO: 735349 - RNA, 64 nt, Homo Sapiens
uacugaaccagcuaaaaauuuugcugauguauuuuucauauacuucucuccugacacgcaaucc

SEQ ID NO: 735350 - RNA, 64 nt, Homo Sapiens
uuuuacagacacaauaccuucaugaauuucaaaauucauauaaaauuugaucuuaugcaauaca

SEQ ID NO: 735351 - RNA, 64 nt, Homo Sapiens
cuuccauauuuaucuguucaaaggagcaagaacuuucauauaggaauagaaacaugcuggccga

SEQ ID NO: 735352 - RNA, 64 nt, Homo Sapiens
gauugacccugauuuuaauugugaaauuauaugauucauauauuuuaugaaucagaauaaccuu

SEQ ID NO: 735353 - RNA, 64 nt, Homo Sapiens
uuugguuuaaaagaacuauaucuauauguauauuuucauauauaugacagaacaagaauaugua

SEQ ID NO: 735354 - RNA, 64 nt, Homo Sapiens
uguaauuuuauguaucccaucuccuuugugugaauucauauauuauagcaaaauacaagagaca

SEQ ID NO: 735355 - RNA, 64 nt, Homo Sapiens
acugcuacaguguuagcugagguaauuuaugugauucauauaccauggaauacauuuuguugga

SEQ ID NO: 735356 - RNA, 64 nt, Homo Sapiens
aagaguauucuaaacagcacuccuuauuuuguaauucauauaguauguuugaaaaaacguugua

SEQ ID NO: 735357 - RNA, 64 nt, Homo Sapiens
acaauuucauuguuguaauuguucccuuucuguuuucauauagugaauaaccuuuaaaggguug

SEQ ID NO: 735358 - RNA, 64 nt, Homo Sapiens
aagaaauuuugcauuaaaaauaguguaccaaugcuucauauacguuaguuauuugcuauuaugu

SEQ ID NO: 735359 - RNA, 64 nt, Homo Sapiens
ugcaugauuuucuagauacacagucuaugcauuauucauauacauuuauuuuagccuaaagugg

SEQ ID NO: 735360 - RNA, 64 nt, Homo Sapiens
auuugaauauucuugaacaccaccacugaagaguuucauauacaccaaauaaugucucaucucu

SEQ ID NO: 735361 - RNA, 64 nt, Homo Sapiens
aaacaugcuucgucagagguucaugauccuugccuucauauaacauauaacaugcuucgugcca

SEQ ID NO: 735362 - RNA, 64 nt, Homo Sapiens
augcuucgugccaucaugauucauggucauugccuucauauaacucauauaacaugcuucgugc

SEQ ID NO: 735363 - RNA, 64 nt, Homo Sapiens
augcuucgugcucauggucaucauggucauugccuucauauaacuauuuugguggcagcugcca

SEQ ID NO: 735364 - RNA, 64 nt, Homo Sapiens
gaaaaauaaugggcaaaaauuuuuguugcaacuuuucauauauauuuuccccuuaccaauuguu

SEQ ID NO: 735365 - RNA, 64 nt, Homo Sapiens
caaggugcguucuagaugucauccuaaaaaacacuucauauauaauuaaucacuauuuuguaua

SEQ ID NO: 735366 - RNA, 64 nt, Homo Sapiens
guuccagcuaauacaugcaacugaguaucguaguuucauauauguguuuguagguuagaaacag

SEQ ID NO: 735367 - RNA, 64 nt, Homo Sapiens
uuaaguugagccauauguaacugacauucuaggcuucauauacaucucuaaggcucuaucaguu

SEQ ID NO: 735368 - RNA, 64 nt, Homo Sapiens
guuaaugcacauuugguuauauaauauuuuuauauucauauacuuguaguauucaacugacuuc

SEQ ID NO: 735369 - RNA, 64 nt, Homo Sapiens
uuuaagucuguguaguauucauacauauauuuacuucauauauuuagaaaucauccauauguuu

SEQ ID NO: 735370 - RNA, 64 nt, Homo Sapiens
uauacauauauauauacacauaaccacagagaauuucauauauaggcuaguuuaaauauguuuc

SEQ ID NO: 735371 - RNA, 64 nt, Homo Sapiens
uucuuguuguuaggccuuacgaaagaaucuugguuucauauaaaaugggacugagaaaagcuug

SEQ ID NO: 735372 - RNA, 64 nt, Homo Sapiens
uaaucuaagacuuugaauacuuaauaaauuaguuuucauauacaucaucuuuguguacagaggu

SEQ ID NO: 735373 - RNA, 64 nt, Homo Sapiens
cuugcuauacagguauguucuuguaacuucauccuucauauauguuaguaauacuuuuacuuuu

SEQ ID NO: 735374 - RNA, 64 nt, Homo Sapiens
acaaugguuaaggcagaauaaugacuaaaauauguucauauauuaugauguggaaauaauugau

SEQ ID NO: 735375 - RNA, 64 nt, Homo Sapiens
uauggcauuucuaauuguaaguagagacaaaauauucauauagucagauauauguugucugcuu

SEQ ID NO: 735376 - RNA, 64 nt, Homo Sapiens
aaagcaaaaauuguucacagagguauuaauguaauucauauauuggcuucauauauguaacgug

SEQ ID NO: 735377 - RNA, 64 nt, Homo Sapiens
uaacgugagguauuaauguauaguguaauuuggcuucauauaugagguuguaagcaaacuaagu

SEQ ID NO: 735378 - RNA, 64 nt, Homo Sapiens
cacauauaauuagacuuuauaauauauauacuuuuucauauauaauuagaucuuucuuuguaau

SEQ ID NO: 735379 - RNA, 64 nt, Homo Sapiens
ccucauuuauuugauaauucacuaauguuuuauauucauauauuaggaaagugaacuuagcaag

SEQ ID NO: 735380 - RNA, 64 nt, Homo Sapiens
ugaauauauacucucgugagucucguguauauacuucauauaagauauaagugaaaucauacac

SEQ ID NO: 735381 - RNA, 64 nt, Homo Sapiens
ugaaaucauacacucucgugagagcuucuagaacuucauauaaguuauuggccuugccucuucu

SEQ ID NO: 735382 - RNA, 64 nt, Homo Sapiens
uugcuuggauuuaaaacuuuaugguauugguuccuucauauaccuaaguauauugauuaccacc

SEQ ID NO: 735383 - RNA, 64 nt, Homo Sapiens
ugauaucauuuauuuuucgccuucucuugucuucuucauauauaaguuacuccugguuaugcag

SEQ ID NO: 735384 - RNA, 64 nt, Homo Sapiens
ugugucacuucugacaugagccuguaaacauauauucauauauguaccugcacauguacccacc

SEQ ID NO: 735385 - RNA, 64 nt, Homo Sapiens
gucuuauuccuuuaguauggacuuaaaguacuuauucauauaccuuguaacuaaaaauuagaac

SEQ ID NO: 735386 - RNA, 64 nt, Homo Sapiens
uggaauuacacaauauauguucuauucuggauauuucauauaaguuuuuauuucuguggcuuuu

SEQ ID NO: 735387 - RNA, 64 nt, Homo Sapiens
ccuuauauacauagccuaaaaaauucauuuaugcuucauauacagagacucaagacuaaacaug

SEQ ID NO: 735388 - RNA, 64 nt, Homo Sapiens
uggaauucuacaauauucggcuuauucuggucauuucauauaaauuucucucucuguagauuug

SEQ ID NO: 735389 - RNA, 64 nt, Homo Sapiens
aauuauuuuuuuuuucauuuugagucuuugguauuucauauaggaguguaaguuauaugugaaa

SEQ ID NO: 735390 - RNA, 64 nt, Homo Sapiens; identical to SEQ ID NO: 542419

SEQ ID NO: 735391 - RNA, 64 nt, Homo Sapiens; identical to SEQ ID NO: 542420

SEQ ID NO: 735392 - RNA, 64 nt, Homo Sapiens; identical to SEQ ID NO: 542421

SEQ ID NO: 735393 - RNA, 64 nt, Homo Sapiens; identical to SEQ ID NO: 542422

SEQ ID NO: 735394 - RNA, 64 nt, Homo Sapiens; identical to SEQ ID NO: 542423

SEQ ID NO: 735395 - RNA, 64 nt, Homo Sapiens; identical to SEQ ID NO: 542424

SEQ ID NO: 735396 - RNA, 64 nt, Homo Sapiens; identical to SEQ ID NO: 542425

SEQ ID NO: 735397 - RNA, 64 nt, Homo Sapiens; identical to SEQ ID NO: 542426

SEQ ID NO: 735398 - RNA, 64 nt, Homo Sapiens; identical to SEQ ID NO: 478477

SEQ ID NO: 735399 - RNA, 64 nt, Homo Sapiens; identical to SEQ ID NO: 478478

SEQ ID NO: 735400 - RNA, 64 nt, Homo Sapiens; identical to SEQ ID NO: 478479

SEQ ID NO: 735401 - RNA, 64 nt, Homo Sapiens; identical to SEQ ID NO: 478480

SEQ ID NO: 735402 - RNA, 64 nt, Homo Sapiens; identical to SEQ ID NO: 478481

SEQ ID NO: 735403 - RNA, 64 nt, Homo Sapiens; identical to SEQ ID NO: 478482

SEQ ID NO: 735404 - RNA, 64 nt, Homo Sapiens; identical to SEQ ID NO: 478483

SEQ ID NO: 735405 - RNA, 64 nt, Homo Sapiens; identical to SEQ ID NO: 478484

SEQ ID NO: 735406 - RNA, 64 nt, Homo Sapiens; identical to SEQ ID NO: 478485

SEQ ID NO: 735407 - RNA, 64 nt, Homo Sapiens; identical to SEQ ID NO: 478486

SEQ ID NO: 735408 - RNA, 64 nt, Homo Sapiens; identical to SEQ ID NO: 478487

SEQ ID NO: 735409 - RNA, 64 nt, Homo Sapiens; identical to SEQ ID NO: 478488

SEQ ID NO: 735410 - RNA, 64 nt, Homo Sapiens; identical to SEQ ID NO: 478489

SEQ ID NO: 735411 - RNA, 64 nt, Homo Sapiens; identical to SEQ ID NO: 478490

SEQ ID NO: 735412 - RNA, 64 nt, Homo Sapiens; identical to SEQ ID NO: 478491

SEQ ID NO: 735413 - RNA, 64 nt, Homo Sapiens; identical to SEQ ID NO: 478492

SEQ ID NO: 735414 - RNA, 64 nt, Homo Sapiens; identical to SEQ ID NO: 478493

SEQ ID NO: 735415 - RNA, 64 nt, Homo Sapiens; identical to SEQ ID NO: 478494

SEQ ID NO: 735416 - RNA, 64 nt, Homo Sapiens; identical to SEQ ID NO: 478495

SEQ ID NO: 735417 - RNA, 64 nt, Homo Sapiens; identical to SEQ ID NO: 478496

SEQ ID NO: 735418 - RNA, 64 nt, Homo Sapiens; identical to SEQ ID NO: 478497

SEQ ID NO: 735419 - RNA, 64 nt, Homo Sapiens; identical to SEQ ID NO: 478498

SEQ ID NO: 735420 - RNA, 64 nt, Homo Sapiens; identical to SEQ ID NO: 478499

SEQ ID NO: 735421 - RNA, 64 nt, Homo Sapiens; identical to SEQ ID NO: 478500

SEQ ID NO: 735422 - RNA, 64 nt, Homo Sapiens; identical to SEQ ID NO: 478501

SEQ ID NO: 735423 - RNA, 64 nt, Homo Sapiens; identical to SEQ ID NO: 478502

SEQ ID NO: 735424 - RNA, 64 nt, Homo Sapiens; identical to SEQ ID NO: 478503

SEQ ID NO: 735425 - RNA, 64 nt, Homo Sapiens; identical to SEQ ID NO: 478504

SEQ ID NO: 735426 - RNA, 64 nt, Homo Sapiens; identical to SEQ ID NO: 478505

SEQ ID NO: 735427 - RNA, 64 nt, Homo Sapiens; identical to SEQ ID NO: 478506

SEQ ID NO: 735428 - RNA, 64 nt, Homo Sapiens; identical to SEQ ID NO: 478507

SEQ ID NO: 735429 - RNA, 64 nt, Homo Sapiens; identical to SEQ ID NO: 478508

SEQ ID NO: 735430 - RNA, 64 nt, Homo Sapiens; identical to SEQ ID NO: 478509

SEQ ID NO: 735431 - RNA, 55 nt, Homo Sapiens; identical to SEQ ID NO: 478510

SEQ ID NO: 735432 - RNA, 64 nt, Homo Sapiens; identical to SEQ ID NO: 478511

SEQ ID NO: 735433 - RNA, 64 nt, Homo Sapiens; identical to SEQ ID NO: 478512

SEQ ID NO: 735434 - RNA, 64 nt, Homo Sapiens; identical to SEQ ID NO: 478513

SEQ ID NO: 735435 - RNA, 64 nt, Homo Sapiens; identical to SEQ ID NO: 478514

SEQ ID NO: 735436 - RNA, 64 nt, Homo Sapiens; identical to SEQ ID NO: 478515

SEQ ID NO: 735437 - RNA, 64 nt, Homo Sapiens; identical to SEQ ID NO: 478516

SEQ ID NO: 735438 - RNA, 64 nt, Homo Sapiens; identical to SEQ ID NO: 478517

SEQ ID NO: 735439 - RNA, 64 nt, Homo Sapiens; identical to SEQ ID NO: 478518

SEQ ID NO: 735440 - RNA, 64 nt, Homo Sapiens; identical to SEQ ID NO: 478519

SEQ ID NO: 735441 - RNA, 57 nt, Homo Sapiens; identical to SEQ ID NO: 478520

SEQ ID NO: 735442 - RNA, 64 nt, Homo Sapiens; identical to SEQ ID NO: 478521

SEQ ID NO: 735443 - RNA, 64 nt, Homo Sapiens; identical to SEQ ID NO: 478522

SEQ ID NO: 735444 - RNA, 64 nt, Homo Sapiens; identical to SEQ ID NO: 478523

SEQ ID NO: 735445 - RNA, 64 nt, Homo Sapiens; identical to SEQ ID NO: 478524

SEQ ID NO: 735446 - RNA, 64 nt, Homo Sapiens; identical to SEQ ID NO: 478525

SEQ ID NO: 735447 - RNA, 64 nt, Homo Sapiens; identical to SEQ ID NO: 478526

SEQ ID NO: 735448 - RNA, 64 nt, Homo Sapiens; identical to SEQ ID NO: 478527

SEQ ID NO: 735449 - RNA, 64 nt, Homo Sapiens; identical to SEQ ID NO: 478528

SEQ ID NO: 735450 - RNA, 64 nt, Homo Sapiens; identical to SEQ ID NO: 478529

SEQ ID NO: 735451 - RNA, 64 nt, Homo Sapiens; identical to SEQ ID NO: 478530

SEQ ID NO: 735452 - RNA, 64 nt, Homo Sapiens; identical to SEQ ID NO: 478531

SEQ ID NO: 735453 - RNA, 64 nt, Homo Sapiens; identical to SEQ ID NO: 478532

SEQ ID NO: 735454 - RNA, 64 nt, Homo Sapiens; identical to SEQ ID NO: 478533

SEQ ID NO: 735455 - RNA, 64 nt, Homo Sapiens; identical to SEQ ID NO: 478534

SEQ ID NO: 735456 - RNA, 64 nt, Homo Sapiens; identical to SEQ ID NO: 478535

SEQ ID NO: 735457 - RNA, 64 nt, Homo Sapiens; identical to SEQ ID NO: 478536

SEQ ID NO: 735458 - RNA, 64 nt, Homo Sapiens; identical to SEQ ID NO: 478537

SEQ ID NO: 735459 - RNA, 64 nt, Homo Sapiens; identical to SEQ ID NO: 478538

SEQ ID NO: 735460 - RNA, 64 nt, Homo Sapiens; identical to SEQ ID NO: 478539

SEQ ID NO: 735461 - RNA, 64 nt, Homo Sapiens; identical to SEQ ID NO: 478540

SEQ ID NO: 735462 - RNA, 64 nt, Homo Sapiens; identical to SEQ ID NO: 478541

SEQ ID NO: 735463 - RNA, 64 nt, Homo Sapiens; identical to SEQ ID NO: 478542

SEQ ID NO: 735464 - RNA, 64 nt, Homo Sapiens; identical to SEQ ID NO: 478543

SEQ ID NO: 735465 - RNA, 64 nt, Homo Sapiens; identical to SEQ ID NO: 478544

SEQ ID NO: 735466 - RNA, 64 nt, Homo Sapiens; identical to SEQ ID NO: 478545

SEQ ID NO: 735467 - RNA, 64 nt, Homo Sapiens; identical to SEQ ID NO: 478546

SEQ ID NO: 735468 - RNA, 64 nt, Homo Sapiens; identical to SEQ ID NO: 478547

SEQ ID NO: 735469 - RNA, 64 nt, Homo Sapiens; identical to SEQ ID NO: 478548

SEQ ID NO: 735470 - RNA, 64 nt, Homo Sapiens; identical to SEQ ID NO: 478549

SEQ ID NO: 735471 - RNA, 64 nt, Homo Sapiens; identical to SEQ ID NO: 478550

SEQ ID NO: 735472 - RNA, 64 nt, Homo Sapiens; identical to SEQ ID NO: 478551

SEQ ID NO: 735473 - RNA, 64 nt, Homo Sapiens; identical to SEQ ID NO: 478552

SEQ ID NO: 735474 - RNA, 64 nt, Homo Sapiens; identical to SEQ ID NO: 478553

SEQ ID NO: 735475 - RNA, 64 nt, Homo Sapiens; identical to SEQ ID NO: 478554

SEQ ID NO: 735476 - RNA, 64 nt, Homo Sapiens; identical to SEQ ID NO: 478555

SEQ ID NO: 735477 - RNA, 64 nt, Homo Sapiens; identical to SEQ ID NO: 478556

SEQ ID NO: 735478 - RNA, 64 nt, Homo Sapiens; identical to SEQ ID NO: 478557

SEQ ID NO: 735479 - RNA, 50 nt, Homo Sapiens; identical to SEQ ID NO: 478558

SEQ ID NO: 735480 - RNA, 64 nt, Homo Sapiens; identical to SEQ ID NO: 478559

SEQ ID NO: 735481 - RNA, 64 nt, Homo Sapiens; identical to SEQ ID NO: 478560

SEQ ID NO: 735482 - RNA, 64 nt, Homo Sapiens; identical to SEQ ID NO: 478561

SEQ ID NO: 735483 - RNA, 64 nt, Homo Sapiens; identical to SEQ ID NO: 478562

SEQ ID NO: 735484 - RNA, 64 nt, Homo Sapiens; identical to SEQ ID NO: 478563

SEQ ID NO: 735485 - RNA, 64 nt, Homo Sapiens; identical to SEQ ID NO: 478564

SEQ ID NO: 735486 - RNA, 64 nt, Homo Sapiens; identical to SEQ ID NO: 478565

SEQ ID NO: 735487 - RNA, 64 nt, Homo Sapiens; identical to SEQ ID NO: 478566

SEQ ID NO: 735488 - RNA, 64 nt, Homo Sapiens; identical to SEQ ID NO: 478567

SEQ ID NO: 735489 - RNA, 64 nt, Homo Sapiens; identical to SEQ ID NO: 478568

SEQ ID NO: 735490 - RNA, 64 nt, Homo Sapiens; identical to SEQ ID NO: 478569

SEQ ID NO: 735491 - RNA, 64 nt, Homo Sapiens; identical to SEQ ID NO: 478570

SEQ ID NO: 735492 - RNA, 64 nt, Homo Sapiens; identical to SEQ ID NO: 478571

SEQ ID NO: 735493 - RNA, 64 nt, Homo Sapiens; identical to SEQ ID NO: 478572

SEQ ID NO: 735494 - RNA, 64 nt, Homo Sapiens; identical to SEQ ID NO: 478573

SEQ ID NO: 735495 - RNA, 64 nt, Homo Sapiens; identical to SEQ ID NO: 478574

SEQ ID NO: 735496 - RNA, 64 nt, Homo Sapiens; identical to SEQ ID NO: 478575

SEQ ID NO: 735497 - RNA, 64 nt, Homo Sapiens; identical to SEQ ID NO: 478576

SEQ ID NO: 735498 - RNA, 64 nt, Homo Sapiens; identical to SEQ ID NO: 478577

SEQ ID NO: 735499 - RNA, 64 nt, Homo Sapiens; identical to SEQ ID NO: 478578

SEQ ID NO: 735500 - RNA, 64 nt, Homo Sapiens; identical to SEQ ID NO: 478579

SEQ ID NO: 735501 - RNA, 64 nt, Homo Sapiens; identical to SEQ ID NO: 478580

SEQ ID NO: 735502 - RNA, 64 nt, Homo Sapiens; identical to SEQ ID NO: 478581

SEQ ID NO: 735503 - RNA, 64 nt, Homo Sapiens; identical to SEQ ID NO: 478582

SEQ ID NO: 735504 - RNA, 64 nt, Homo Sapiens; identical to SEQ ID NO: 478583

SEQ ID NO: 735505 - RNA, 64 nt, Homo Sapiens; identical to SEQ ID NO: 478584

SEQ ID NO: 735506 - RNA, 64 nt, Homo Sapiens; identical to SEQ ID NO: 478585

SEQ ID NO: 735507 - RNA, 64 nt, Homo Sapiens; identical to SEQ ID NO: 478586

SEQ ID NO: 735508 - RNA, 64 nt, Homo Sapiens; identical to SEQ ID NO: 478587

SEQ ID NO: 735509 - RNA, 64 nt, Homo Sapiens; identical to SEQ ID NO: 478588

SEQ ID NO: 735510 - RNA, 64 nt, Homo Sapiens; identical to SEQ ID NO: 478589

SEQ ID NO: 735511 - RNA, 64 nt, Homo Sapiens; identical to SEQ ID NO: 478590

SEQ ID NO: 735512 - RNA, 64 nt, Homo Sapiens; identical to SEQ ID NO: 478591

SEQ ID NO: 735513 - RNA, 64 nt, Homo Sapiens; identical to SEQ ID NO: 478592

SEQ ID NO: 735514 - RNA, 64 nt, Homo Sapiens; identical to SEQ ID NO: 245406

SEQ ID NO: 735515 - RNA, 64 nt, Homo Sapiens; identical to SEQ ID NO: 245407

SEQ ID NO: 735516 - RNA, 64 nt, Homo Sapiens; identical to SEQ ID NO: 245408

SEQ ID NO: 735517 - RNA, 64 nt, Homo Sapiens; identical to SEQ ID NO: 245409

SEQ ID NO: 735518 - RNA, 64 nt, Homo Sapiens; identical to SEQ ID NO: 245410

SEQ ID NO: 735519 - RNA, 64 nt, Homo Sapiens; identical to SEQ ID NO: 245411

SEQ ID NO: 735520 - RNA, 64 nt, Homo Sapiens; identical to SEQ ID NO: 532305

SEQ ID NO: 735521 - RNA, 64 nt, Homo Sapiens; identical to SEQ ID NO: 532306

SEQ ID NO: 735522 - RNA, 64 nt, Homo Sapiens; identical to SEQ ID NO: 532307

SEQ ID NO: 735523 - RNA, 64 nt, Homo Sapiens; identical to SEQ ID NO: 532308

SEQ ID NO: 735524 - RNA, 64 nt, Homo Sapiens; identical to SEQ ID NO: 532309

SEQ ID NO: 735525 - RNA, 57 nt, Homo Sapiens; identical to SEQ ID NO: 83127

SEQ ID NO: 735526 - RNA, 64 nt, Homo Sapiens; identical to SEQ ID NO: 532311

SEQ ID NO: 735527 - RNA, 64 nt, Homo Sapiens; identical to SEQ ID NO: 532312

SEQ ID NO: 735528 - RNA, 64 nt, Homo Sapiens; identical to SEQ ID NO: 532313

SEQ ID NO: 735529 - RNA, 64 nt, Homo Sapiens; identical to SEQ ID NO: 532314

SEQ ID NO: 735530 - RNA, 64 nt, Homo Sapiens; identical to SEQ ID NO: 532315

SEQ ID NO: 735531 - RNA, 64 nt, Homo Sapiens; identical to SEQ ID NO: 532316

SEQ ID NO: 735532 - RNA, 64 nt, Homo Sapiens; identical to SEQ ID NO: 532317

SEQ ID NO: 735533 - RNA, 64 nt, Homo Sapiens; identical to SEQ ID NO: 532318

SEQ ID NO: 735534 - RNA, 59 nt, Homo Sapiens; identical to SEQ ID NO: 83136

SEQ ID NO: 735535 - RNA, 64 nt, Homo Sapiens; identical to SEQ ID NO: 532320

SEQ ID NO: 735536 - RNA, 64 nt, Homo Sapiens; identical to SEQ ID NO: 532321

SEQ ID NO: 735537 - RNA, 64 nt, Homo Sapiens; identical to SEQ ID NO: 532322

SEQ ID NO: 735538 - RNA, 64 nt, Homo Sapiens; identical to SEQ ID NO: 532323

SEQ ID NO: 735539 - RNA, 64 nt, Homo Sapiens; identical to SEQ ID NO: 532324

SEQ ID NO: 735540 - RNA, 64 nt, Homo Sapiens; identical to SEQ ID NO: 532325

SEQ ID NO: 735541 - RNA, 64 nt, Homo Sapiens; identical to SEQ ID NO: 532326

SEQ ID NO: 735542 - RNA, 64 nt, Homo Sapiens; identical to SEQ ID NO: 532327

SEQ ID NO: 735543 - RNA, 64 nt, Homo Sapiens; identical to SEQ ID NO: 532328

SEQ ID NO: 735544 - RNA, 64 nt, Homo Sapiens; identical to SEQ ID NO: 532329

SEQ ID NO: 735545 - RNA, 64 nt, Homo Sapiens; identical to SEQ ID NO: 532330

SEQ ID NO: 735546 - RNA, 64 nt, Homo Sapiens; identical to SEQ ID NO: 532331

SEQ ID NO: 735547 - RNA, 64 nt, Homo Sapiens; identical to SEQ ID NO: 532332

SEQ ID NO: 735548 - RNA, 64 nt, Homo Sapiens; identical to SEQ ID NO: 532333

SEQ ID NO: 735549 - RNA, 64 nt, Homo Sapiens; identical to SEQ ID NO: 532334

SEQ ID NO: 735550 - RNA, 64 nt, Homo Sapiens; identical to SEQ ID NO: 532335

SEQ ID NO: 735551 - RNA, 64 nt, Homo Sapiens; identical to SEQ ID NO: 532336

SEQ ID NO: 735552 - RNA, 64 nt, Homo Sapiens; identical to SEQ ID NO: 532337

SEQ ID NO: 735553 - RNA, 64 nt, Homo Sapiens; identical to SEQ ID NO: 532338

SEQ ID NO: 735554 - RNA, 64 nt, Homo Sapiens; identical to SEQ ID NO: 539759

SEQ ID NO: 735555 - RNA, 64 nt, Homo Sapiens; identical to SEQ ID NO: 539760

SEQ ID NO: 735556 - RNA, 64 nt, Homo Sapiens; identical to SEQ ID NO: 539761

SEQ ID NO: 735557 - RNA, 64 nt, Homo Sapiens; identical to SEQ ID NO: 539762

SEQ ID NO: 735558 - RNA, 64 nt, Homo Sapiens; identical to SEQ ID NO: 539763

SEQ ID NO: 735559 - RNA, 64 nt, Homo Sapiens; identical to SEQ ID NO: 539764

SEQ ID NO: 735560 - RNA, 64 nt, Homo Sapiens; identical to SEQ ID NO: 539765

SEQ ID NO: 735561 - RNA, 64 nt, Homo Sapiens; identical to SEQ ID NO: 539766

SEQ ID NO: 735562 - RNA, 64 nt, Homo Sapiens; identical to SEQ ID NO: 539767

SEQ ID NO: 735563 - RNA, 64 nt, Homo Sapiens; identical to SEQ ID NO: 539768

SEQ ID NO: 735564 - RNA, 64 nt, Homo Sapiens; identical to SEQ ID NO: 539769

SEQ ID NO: 735565 - RNA, 64 nt, Homo Sapiens; identical to SEQ ID NO: 539770

SEQ ID NO: 735566 - RNA, 64 nt, Homo Sapiens; identical to SEQ ID NO: 539771

SEQ ID NO: 735567 - RNA, 64 nt, Homo Sapiens; identical to SEQ ID NO: 539772

SEQ ID NO: 735568 - RNA, 64 nt, Homo Sapiens; identical to SEQ ID NO: 539773

SEQ ID NO: 735569 - RNA, 64 nt, Homo Sapiens; identical to SEQ ID NO: 539774

SEQ ID NO: 735570 - RNA, 64 nt, Homo Sapiens; identical to SEQ ID NO: 539775

SEQ ID NO: 735571 - RNA, 64 nt, Homo Sapiens; identical to SEQ ID NO: 539776

SEQ ID NO: 735572 - RNA, 64 nt, Homo Sapiens; identical to SEQ ID NO: 539777

SEQ ID NO: 735573 - RNA, 64 nt, Homo Sapiens; identical to SEQ ID NO: 539778

SEQ ID NO: 735574 - RNA, 64 nt, Homo Sapiens; identical to SEQ ID NO: 539779

SEQ ID NO: 735575 - RNA, 64 nt, Homo Sapiens; identical to SEQ ID NO: 539780

SEQ ID NO: 735576 - RNA, 64 nt, Homo Sapiens; identical to SEQ ID NO: 539781

SEQ ID NO: 735577 - RNA, 64 nt, Homo Sapiens; identical to SEQ ID NO: 539782

SEQ ID NO: 735578 - RNA, 64 nt, Homo Sapiens; identical to SEQ ID NO: 539783

SEQ ID NO: 735579 - RNA, 64 nt, Homo Sapiens; identical to SEQ ID NO: 539784

SEQ ID NO: 735580 - RNA, 64 nt, Homo Sapiens; identical to SEQ ID NO: 539785

SEQ ID NO: 735581 - RNA, 64 nt, Homo Sapiens; identical to SEQ ID NO: 539786

SEQ ID NO: 735582 - RNA, 64 nt, Homo Sapiens; identical to SEQ ID NO: 539787

SEQ ID NO: 735583 - RNA, 64 nt, Homo Sapiens; identical to SEQ ID NO: 539788

SEQ ID NO: 735584 - RNA, 64 nt, Homo Sapiens; identical to SEQ ID NO: 156567

SEQ ID NO: 735585 - RNA, 64 nt, Homo Sapiens; identical to SEQ ID NO: 156568

SEQ ID NO: 735586 - RNA, 64 nt, Homo Sapiens; identical to SEQ ID NO: 156569

SEQ ID NO: 735587 - RNA, 64 nt, Homo Sapiens; identical to SEQ ID NO: 156570

SEQ ID NO: 735588 - RNA, 64 nt, Homo Sapiens; identical to SEQ ID NO: 156571

SEQ ID NO: 735589 - RNA, 64 nt, Homo Sapiens; identical to SEQ ID NO: 156572

SEQ ID NO: 735590 - RNA, 64 nt, Homo Sapiens; identical to SEQ ID NO: 156573

SEQ ID NO: 735591 - RNA, 64 nt, Homo Sapiens; identical to SEQ ID NO: 156574

SEQ ID NO: 735592 - RNA, 64 nt, Homo Sapiens; identical to SEQ ID NO: 156575

SEQ ID NO: 735593 - RNA, 64 nt, Homo Sapiens; identical to SEQ ID NO: 156576

SEQ ID NO: 735594 - RNA, 64 nt, Homo Sapiens; identical to SEQ ID NO: 156577

SEQ ID NO: 735595 - RNA, 64 nt, Homo Sapiens; identical to SEQ ID NO: 156578

SEQ ID NO: 735596 - RNA, 64 nt, Homo Sapiens; identical to SEQ ID NO: 156579

SEQ ID NO: 735597 - RNA, 64 nt, Homo Sapiens; identical to SEQ ID NO: 156580

SEQ ID NO: 735598 - RNA, 64 nt, Homo Sapiens; identical to SEQ ID NO: 156581

SEQ ID NO: 735599 - RNA, 64 nt, Homo Sapiens; identical to SEQ ID NO: 156582

SEQ ID NO: 735600 - RNA, 64 nt, Homo Sapiens; identical to SEQ ID NO: 156583

SEQ ID NO: 735601 - RNA, 64 nt, Homo Sapiens; identical to SEQ ID NO: 156584

SEQ ID NO: 735602 - RNA, 64 nt, Homo Sapiens; identical to SEQ ID NO: 156585

SEQ ID NO: 735603 - RNA, 64 nt, Homo Sapiens; identical to SEQ ID NO: 156586

SEQ ID NO: 735604 - RNA, 64 nt, Homo Sapiens; identical to SEQ ID NO: 156587

SEQ ID NO: 735605 - RNA, 64 nt, Homo Sapiens; identical to SEQ ID NO: 156588

SEQ ID NO: 735606 - RNA, 64 nt, Homo Sapiens; identical to SEQ ID NO: 156589

SEQ ID NO: 735607 - RNA, 64 nt, Homo Sapiens; identical to SEQ ID NO: 156590

SEQ ID NO: 735608 - RNA, 64 nt, Homo Sapiens; identical to SEQ ID NO: 156591

SEQ ID NO: 735609 - RNA, 64 nt, Homo Sapiens; identical to SEQ ID NO: 156592

SEQ ID NO: 735610 - RNA, 64 nt, Homo Sapiens; identical to SEQ ID NO: 156593

SEQ ID NO: 735611 - RNA, 64 nt, Homo Sapiens; identical to SEQ ID NO: 156594

SEQ ID NO: 735612 - RNA, 64 nt, Homo Sapiens; identical to SEQ ID NO: 156595

SEQ ID NO: 735613 - RNA, 64 nt, Homo Sapiens; identical to SEQ ID NO: 156596

SEQ ID NO: 735614 - RNA, 64 nt, Homo Sapiens; identical to SEQ ID NO: 156597

SEQ ID NO: 735615 - RNA, 64 nt, Homo Sapiens; identical to SEQ ID NO: 156598

SEQ ID NO: 735616 - RNA, 64 nt, Homo Sapiens; identical to SEQ ID NO: 156599

SEQ ID NO: 735617 - RNA, 64 nt, Homo Sapiens; identical to SEQ ID NO: 156600

SEQ ID NO: 735618 - RNA, 64 nt, Homo Sapiens; identical to SEQ ID NO: 156601

SEQ ID NO: 735619 - RNA, 64 nt, Homo Sapiens; identical to SEQ ID NO: 156602

SEQ ID NO: 735620 - RNA, 64 nt, Homo Sapiens; identical to SEQ ID NO: 156603

SEQ ID NO: 735621 - RNA, 64 nt, Homo Sapiens; identical to SEQ ID NO: 156604

SEQ ID NO: 735622 - RNA, 64 nt, Homo Sapiens; identical to SEQ ID NO: 156605

SEQ ID NO: 735623 - RNA, 64 nt, Homo Sapiens; identical to SEQ ID NO: 156606

SEQ ID NO: 735624 - RNA, 64 nt, Homo Sapiens; identical to SEQ ID NO: 156607

SEQ ID NO: 735625 - RNA, 64 nt, Homo Sapiens; identical to SEQ ID NO: 129730

SEQ ID NO: 735626 - RNA, 64 nt, Homo Sapiens; identical to SEQ ID NO: 129731

SEQ ID NO: 735627 - RNA, 64 nt, Homo Sapiens; identical to SEQ ID NO: 129732

SEQ ID NO: 735628 - RNA, 64 nt, Homo Sapiens; identical to SEQ ID NO: 129733

SEQ ID NO: 735629 - RNA, 64 nt, Homo Sapiens; identical to SEQ ID NO: 129734

SEQ ID NO: 735630 - RNA, 64 nt, Homo Sapiens; identical to SEQ ID NO: 129735

SEQ ID NO: 735631 - RNA, 64 nt, Homo Sapiens; identical to SEQ ID NO: 129736

SEQ ID NO: 735632 - RNA, 64 nt, Homo Sapiens; identical to SEQ ID NO: 129737

SEQ ID NO: 735633 - RNA, 64 nt, Homo Sapiens; identical to SEQ ID NO: 129738

SEQ ID NO: 735634 - RNA, 64 nt, Homo Sapiens; identical to SEQ ID NO: 129739

SEQ ID NO: 735635 - RNA, 64 nt, Homo Sapiens; identical to SEQ ID NO: 129740

SEQ ID NO: 735636 - RNA, 64 nt, Homo Sapiens; identical to SEQ ID NO: 129741

SEQ ID NO: 735637 - RNA, 64 nt, Homo Sapiens; identical to SEQ ID NO: 129742

SEQ ID NO: 735638 - RNA, 64 nt, Homo Sapiens; identical to SEQ ID NO: 129743

SEQ ID NO: 735639 - RNA, 64 nt, Homo Sapiens; identical to SEQ ID NO: 129744

SEQ ID NO: 735640 - RNA, 64 nt, Homo Sapiens; identical to SEQ ID NO: 129745

SEQ ID NO: 735641 - RNA, 64 nt, Homo Sapiens; identical to SEQ ID NO: 129746

SEQ ID NO: 735642 - RNA, 64 nt, Homo Sapiens; identical to SEQ ID NO: 129747

SEQ ID NO: 735643 - RNA, 64 nt, Homo Sapiens; identical to SEQ ID NO: 129748

SEQ ID NO: 735644 - RNA, 64 nt, Homo Sapiens
uccauguuauuuuccagugguuuuauuuugcacggcucuaaaccggccgacauuuuuaaaaaag

SEQ ID NO: 735645 - RNA, 64 nt, Homo Sapiens
uuaaauauuuugacuuuaagaauaccugcaaagugcucuaaaaaaaucgacuaccagcugauga

SEQ ID NO: 735646 - RNA, 64 nt, Homo Sapiens; identical to SEQ ID NO: 166123

SEQ ID NO: 735647 - RNA, 64 nt, Homo Sapiens; identical to SEQ ID NO: 166124

SEQ ID NO: 735648 - RNA, 64 nt, Homo Sapiens; identical to SEQ ID NO: 166125

SEQ ID NO: 735649 - RNA, 64 nt, Homo Sapiens; identical to SEQ ID NO: 166126

SEQ ID NO: 735650 - RNA, 64 nt, Homo Sapiens; identical to SEQ ID NO: 166127

SEQ ID NO: 735651 - RNA, 64 nt, Homo Sapiens; identical to SEQ ID NO: 166128

SEQ ID NO: 735652 - RNA, 64 nt, Homo Sapiens; identical to SEQ ID NO: 166129

SEQ ID NO: 735653 - RNA, 64 nt, Homo Sapiens; identical to SEQ ID NO: 166130

SEQ ID NO: 735654 - RNA, 64 nt, Homo Sapiens; identical to SEQ ID NO: 166131

SEQ ID NO: 735655 - RNA, 64 nt, Homo Sapiens; identical to SEQ ID NO: 166132

SEQ ID NO: 735656 - RNA, 64 nt, Homo Sapiens; identical to SEQ ID NO: 166133

SEQ ID NO: 735657 - RNA, 64 nt, Homo Sapiens; identical to SEQ ID NO: 166134

SEQ ID NO: 735658 - RNA, 64 nt, Homo Sapiens; identical to SEQ ID NO: 166135

SEQ ID NO: 735659 - RNA, 64 nt, Homo Sapiens; identical to SEQ ID NO: 166136

SEQ ID NO: 735660 - RNA, 64 nt, Homo Sapiens; identical to SEQ ID NO: 166137

SEQ ID NO: 735661 - RNA, 64 nt, Homo Sapiens; identical to SEQ ID NO: 166138

SEQ ID NO: 735662 - RNA, 64 nt, Homo Sapiens; identical to SEQ ID NO: 166139

SEQ ID NO: 735663 - RNA, 64 nt, Homo Sapiens; identical to SEQ ID NO: 166140

SEQ ID NO: 735664 - RNA, 64 nt, Homo Sapiens; identical to SEQ ID NO: 166141

SEQ ID NO: 735665 - RNA, 64 nt, Homo Sapiens; identical to SEQ ID NO: 166142

SEQ ID NO: 735666 - RNA, 64 nt, Homo Sapiens; identical to SEQ ID NO: 166143

SEQ ID NO: 735667 - RNA, 64 nt, Homo Sapiens; identical to SEQ ID NO: 166144

SEQ ID NO: 735668 - RNA, 64 nt, Homo Sapiens; identical to SEQ ID NO: 166145

SEQ ID NO: 735669 - RNA, 64 nt, Homo Sapiens; identical to SEQ ID NO: 166146

SEQ ID NO: 735670 - RNA, 64 nt, Homo Sapiens; identical to SEQ ID NO: 166147

SEQ ID NO: 735671 - RNA, 64 nt, Homo Sapiens; identical to SEQ ID NO: 166148

SEQ ID NO: 735672 - RNA, 64 nt, Homo Sapiens; identical to SEQ ID NO: 166149

SEQ ID NO: 735673 - RNA, 64 nt, Homo Sapiens; identical to SEQ ID NO: 102210

SEQ ID NO: 735674 - RNA, 64 nt, Homo Sapiens; identical to SEQ ID NO: 102211

SEQ ID NO: 735675 - RNA, 64 nt, Homo Sapiens; identical to SEQ ID NO: 102212

SEQ ID NO: 735676 - RNA, 64 nt, Homo Sapiens; identical to SEQ ID NO: 102213

SEQ ID NO: 735677 - RNA, 64 nt, Homo Sapiens; identical to SEQ ID NO: 102214

SEQ ID NO: 735678 - RNA, 64 nt, Homo Sapiens; identical to SEQ ID NO: 102215

SEQ ID NO: 735679 - RNA, 64 nt, Homo Sapiens; identical to SEQ ID NO: 102216

SEQ ID NO: 735680 - RNA, 64 nt, Homo Sapiens; identical to SEQ ID NO: 102217

SEQ ID NO: 735681 - RNA, 64 nt, Homo Sapiens; identical to SEQ ID NO: 102218

SEQ ID NO: 735682 - RNA, 64 nt, Homo Sapiens; identical to SEQ ID NO: 102219

SEQ ID NO: 735683 - RNA, 64 nt, Homo Sapiens; identical to SEQ ID NO: 102220

SEQ ID NO: 735684 - RNA, 64 nt, Homo Sapiens; identical to SEQ ID NO: 102221

SEQ ID NO: 735685 - RNA, 64 nt, Homo Sapiens; identical to SEQ ID NO: 102222

SEQ ID NO: 735686 - RNA, 64 nt, Homo Sapiens; identical to SEQ ID NO: 102223

SEQ ID NO: 735687 - RNA, 64 nt, Homo Sapiens; identical to SEQ ID NO: 102224

SEQ ID NO: 735688 - RNA, 64 nt, Homo Sapiens; identical to SEQ ID NO: 102225

SEQ ID NO: 735689 - RNA, 64 nt, Homo Sapiens; identical to SEQ ID NO: 102226

SEQ ID NO: 735690 - RNA, 64 nt, Homo Sapiens; identical to SEQ ID NO: 102227

SEQ ID NO: 735691 - RNA, 64 nt, Homo Sapiens; identical to SEQ ID NO: 102228

SEQ ID NO: 735692 - RNA, 64 nt, Homo Sapiens; identical to SEQ ID NO: 102229

SEQ ID NO: 735693 - RNA, 64 nt, Homo Sapiens; identical to SEQ ID NO: 102230

SEQ ID NO: 735694 - RNA, 64 nt, Homo Sapiens; identical to SEQ ID NO: 102231

SEQ ID NO: 735695 - RNA, 64 nt, Homo Sapiens; identical to SEQ ID NO: 102232

SEQ ID NO: 735696 - RNA, 64 nt, Homo Sapiens; identical to SEQ ID NO: 102233

SEQ ID NO: 735697 - RNA, 64 nt, Homo Sapiens; identical to SEQ ID NO: 102234

SEQ ID NO: 735698 - RNA, 64 nt, Homo Sapiens; identical to SEQ ID NO: 102235

SEQ ID NO: 735699 - RNA, 64 nt, Homo Sapiens; identical to SEQ ID NO: 102236

SEQ ID NO: 735700 - RNA, 64 nt, Homo Sapiens; identical to SEQ ID NO: 102237

SEQ ID NO: 735701 - RNA, 64 nt, Homo Sapiens; identical to SEQ ID NO: 102238

SEQ ID NO: 735702 - RNA, 64 nt, Homo Sapiens; identical to SEQ ID NO: 102239

SEQ ID NO: 735703 - RNA, 64 nt, Homo Sapiens; identical to SEQ ID NO: 102240

SEQ ID NO: 735704 - RNA, 64 nt, Homo Sapiens; identical to SEQ ID NO: 102241

SEQ ID NO: 735705 - RNA, 64 nt, Homo Sapiens; identical to SEQ ID NO: 102242

SEQ ID NO: 735706 - RNA, 64 nt, Homo Sapiens; identical to SEQ ID NO: 55156

SEQ ID NO: 735707 - RNA, 64 nt, Homo Sapiens; identical to SEQ ID NO: 55157

SEQ ID NO: 735708 - RNA, 64 nt, Homo Sapiens; identical to SEQ ID NO: 55157

SEQ ID NO: 735709 - RNA, 64 nt, Homo Sapiens; identical to SEQ ID NO: 55159

SEQ ID NO: 735710 - RNA, 64 nt, Homo Sapiens; identical to SEQ ID NO: 55160

SEQ ID NO: 735711 - RNA, 64 nt, Homo Sapiens; identical to SEQ ID NO: 55161

SEQ ID NO: 735712 - RNA, 64 nt, Homo Sapiens; identical to SEQ ID NO: 55162

SEQ ID NO: 735713 - RNA, 63 nt, Homo Sapiens; identical to SEQ ID NO: 55163

SEQ ID NO: 735714 - RNA, 64 nt, Homo Sapiens; identical to SEQ ID NO: 55164

SEQ ID NO: 735715 - RNA, 64 nt, Homo Sapiens; identical to SEQ ID NO: 55165

SEQ ID NO: 735716 - RNA, 64 nt, Homo Sapiens; identical to SEQ ID NO: 580105

SEQ ID NO: 735717 - RNA, 64 nt, Homo Sapiens; identical to SEQ ID NO: 580106

SEQ ID NO: 735718 - RNA, 64 nt, Homo Sapiens; identical to SEQ ID NO: 580107

SEQ ID NO: 735719 - RNA, 64 nt, Homo Sapiens; identical to SEQ ID NO: 580108

SEQ ID NO: 735720 - RNA, 64 nt, Homo Sapiens; identical to SEQ ID NO: 580109

SEQ ID NO: 735721 - RNA, 64 nt, Homo Sapiens; identical to SEQ ID NO: 580110

SEQ ID NO: 735722 - RNA, 64 nt, Homo Sapiens; identical to SEQ ID NO: 580111

SEQ ID NO: 735723 - RNA, 64 nt, Homo Sapiens; identical to SEQ ID NO: 580112

SEQ ID NO: 735724 - RNA, 64 nt, Homo Sapiens; identical to SEQ ID NO: 580113

SEQ ID NO: 735725 - RNA, 64 nt, Homo Sapiens; identical to SEQ ID NO: 580114

SEQ ID NO: 735726 - RNA, 64 nt, Homo Sapiens; identical to SEQ ID NO: 580115

SEQ ID NO: 735727 - RNA, 64 nt, Homo Sapiens; identical to SEQ ID NO: 580116

SEQ ID NO: 735728 - RNA, 64 nt, Homo Sapiens; identical to SEQ ID NO: 580117

SEQ ID NO: 735729 - RNA, 64 nt, Homo Sapiens; identical to SEQ ID NO: 580118

SEQ ID NO: 735730 - RNA, 64 nt, Homo Sapiens; identical to SEQ ID NO: 580119

SEQ ID NO: 735731 - RNA, 64 nt, Homo Sapiens; identical to SEQ ID NO: 580120

SEQ ID NO: 735732 - RNA, 64 nt, Homo Sapiens; identical to SEQ ID NO: 580121

SEQ ID NO: 735733 - RNA, 64 nt, Homo Sapiens; identical to SEQ ID NO: 580122

SEQ ID NO: 735734 - RNA, 64 nt, Homo Sapiens; identical to SEQ ID NO: 580123

SEQ ID NO: 735735 - RNA, 64 nt, Homo Sapiens; identical to SEQ ID NO: 580124

SEQ ID NO: 735736 - RNA, 64 nt, Homo Sapiens; identical to SEQ ID NO: 580125

SEQ ID NO: 735737 - RNA, 64 nt, Homo Sapiens; identical to SEQ ID NO: 580126

SEQ ID NO: 735738 - RNA, 64 nt, Homo Sapiens; identical to SEQ ID NO: 580127

SEQ ID NO: 735739 - RNA, 64 nt, Homo Sapiens; identical to SEQ ID NO: 580128

SEQ ID NO: 735740 - RNA, 64 nt, Homo Sapiens
ccuuuuccacccugggccccaaugccguccuuuccccgcagagacuggucuuggaaacccucag

SEQ ID NO: 735741 - RNA, 64 nt, Homo Sapiens
acccuuaccgguggcucuuccugccugggacccucccgcagagucccacuagccagcggccuca

SEQ ID NO: 735742 - RNA, 64 nt, Homo Sapiens
ccagagcagccaggcuggggccccucugucucaacccgcagacccuugacugaaugagagaggc

SEQ ID NO: 735743 - RNA, 64 nt, Homo Sapiens
cacaagcccuacccgugcugacuaguggcccagccccgcagaccagcuggcauggucagguaac

SEQ ID NO: 735744 - RNA, 64 nt, Homo Sapiens
ugggacaugaggggcagcuagacuucacccccuucccgcagaccugccuccagagcaaggagaa

SEQ ID NO: 735745 - RNA, 64 nt, Homo Sapiens
ggcaucaccugucaaaaauggaguuccacuucuccccgcagaccuaggucagacuuuuccuuuc

SEQ ID NO: 735746 - RNA, 64 nt, Homo Sapiens
ggagaggcaguacgcauccuuacccaggggaggacccgcagauccuguagacuaucugccagca

SEQ ID NO: 735747 - RNA, 64 nt, Homo Sapiens
aggguguugggauacugcagggccaggacugagccccgcagaccuccccagccccuagcccagg

SEQ ID NO: 735748 - RNA, 64 nt, Homo Sapiens
agagaggcccgcccgcccaccgugggcagugccacccgcagaugacacgcgcucuccaccaccc

SEQ ID NO: 735749 - RNA, 64 nt, Homo Sapiens
ccuuggacauccuccucccagagccgaggccuaccccgcagacaguggucacagcggaggugug

SEQ ID NO: 735750 - RNA, 64 nt, Homo Sapiens
ucucagaaucaugcugagaggcaggccagagcuacccgcagagugcgguagggcguggaaaggg

SEQ ID NO: 735751 - RNA, 64 nt, Homo Sapiens
gucugugugcuguuugaaaauagccuggcucugccccgcagacgguggggcccagacaccagcc

SEQ ID NO: 735752 - RNA, 64 nt, Homo Sapiens
gcagagcuggcugcuggacgcaccgugcucgcugcccgcagaagcggcacugugcuggcgggcu

SEQ ID NO: 735753 - RNA, 64 nt, Homo Sapiens
cugagacucuguuuaucacuagccuucugucccucccgcagaagacuguuggauugaacaaaau

SEQ ID NO: 735754 - RNA, 64 nt, Homo Sapiens
cccagagaugaugugggcaguggggcagagggcacccgcagaguugagucccuggcaguagccu

SEQ ID NO: 735755 - RNA, 64 nt, Homo Sapiens
agacccguucagacacugcguugcgggcuccuuccccgcagaggccggggccucccugacuuug

SEQ ID NO: 735756 - RNA, 64 nt, Homo Sapiens
gugccaguagccuaggugucucaggccccugggccccgcagauggccauuuccggugccugccc

SEQ ID NO: 735757 - RNA, 64 nt, Homo Sapiens
acuuucacacucugccauguuagaguccuggcuucccgcagacgccagugugaaguuucuggca

SEQ ID NO: 735758 - RNA, 64 nt, Homo Sapiens
ccguccacagcccugccucaaggaagagcuggagcccgcagaagaagcgcugagcugagggacg

SEQ ID NO: 735759 - RNA, 64 nt, Homo Sapiens
aaugcaccauguccugaaagauggcacccucccacccgcagagugcuuccugcaagcuggcguu

SEQ ID NO: 735760 - RNA, 64 nt, Homo Sapiens
uuaaggagguagcucccagcacucaaccaaccuccccgcagagcucccuuccugacccuccgcu

SEQ ID NO: 735761 - RNA, 64 nt, Homo Sapiens
cuccggugcagacgcgcugccuccggcuacaauccccgcagagugccucggagcccggcccgcc

SEQ ID NO: 735762 - RNA, 64 nt, Homo Sapiens
gcuggaauauuaaaauucuugugcagggcugcaucccgcagaugaacggaauaguguggggugu

SEQ ID NO: 735763 - RNA, 64 nt, Homo Sapiens
uggggugcuggggcugcaugggggagguggccagcccgcagagggauccuggccugagaauuga

SEQ ID NO: 735764 - RNA, 64 nt, Homo Sapiens
gccgcgcgucccucuugugccggccucgucauuccccgcagacccccugggucgcagacgaggu

SEQ ID NO: 735765 - RNA, 64 nt, Homo Sapiens
gguucugcccuguggaguauguuuaacaggaguccccgcagaugcuuuaucuuccgaggccacc

SEQ ID NO: 735766 - RNA, 64 nt, Homo Sapiens
guuguuuagcuuaccuuucugcuaggauuggcuucccgcagagggcagggcccauccuaagcag

SEQ ID NO: 735767 - RNA, 64 nt, Homo Sapiens
augcgcuuguuggcgcgacuguggcucgagcuggcccgcagacacguggguuucaucacucuga

SEQ ID NO: 735768 - RNA, 64 nt, Homo Sapiens
cacugccacagcugugagggggcugggaccauggcccgcagaggaagcauugcucagggugggg

SEQ ID NO: 735769 - RNA, 64 nt, Homo Sapiens
cuaagagggccuauugucagagcaagaaucaaggcccgcagaugcccuggcaccaugcacggcc

SEQ ID NO: 735770 - RNA, 64 nt, Homo Sapiens
uuggcacaaaguggagucaaaugaaauaugccuacccgcagagcauuacaagccuuuuuaagau

SEQ ID NO: 735771 - RNA, 64 nt, Homo Sapiens
gcacaggaagaggcaggggccagccugcaggcuccccgcagagagcggcguggaccgagggucc

SEQ ID NO: 735772 - RNA, 64 nt, Homo Sapiens
aaagagagugugacucccuuuugaugggugcguucccgcagaccccccaggugccccccucacc

SEQ ID NO: 735773 - RNA, 64 nt, Homo Sapiens
gcacccaaggccgggaaggguuagugugggucggcccgcagaugaaggccccaggaguggcacc

SEQ ID NO: 735774 - RNA, 64 nt, Homo Sapiens
ggugcucuccuuugcccucccccuuccugcccuacccgcagaaucacccaggguggggaggcca

SEQ ID NO: 735775 - RNA, 64 nt, Homo Sapiens
cugucccaugggcucuggccaccauccucuguuacccgcagaucuucagcagaaugacucugga

SEQ ID NO: 735776 - RNA, 64 nt, Homo Sapiens
aagcagguggugguggaaauuccagcaggugggucccgcagaggcccugaggccucacuuuucg

SEQ ID NO: 735777 - RNA, 64 nt, Homo Sapiens
ugagacuccccgcccgcccuccucugcccccucccccgcagacagacagacagacggacgggac

SEQ ID NO: 735778 - RNA, 64 nt, Homo Sapiens
uccucuuugagugucugucugacauccccacaugcccgcagagaugaagucacgccuuggcccu

SEQ ID NO: 735779 - RNA, 64 nt, Homo Sapiens
ccagcgaugccaggaaacaaaguugcuucugcagcccgcagauguccugcccauauauuauacc

SEQ ID NO: 735780 - RNA, 64 nt, Homo Sapiens
ggcuuccccaagcucuguuuuucccuagggcugccccgcagaggccuucuggccccucugagga

SEQ ID NO: 735781 - RNA, 64 nt, Homo Sapiens
ggaucaugucccauccaguccagugaauccacgacccgcagaccuguccccccgcaacagcuua

SEQ ID NO: 735782 - RNA, 64 nt, Homo Sapiens
uggcaugccccccagcuacuguaugcccccgacccccgcagaggcagaaugaacccauagggag

SEQ ID NO: 735783 - RNA, 64 nt, Homo Sapiens
ccgcaccccccggcccugcccggaggcaccgaugcccgcagagccacgcacgaccccaagcccg

SEQ ID NO: 735784 - RNA, 64 nt, Homo Sapiens
cucccggcgccuugagacccagggaccuucagggcccgcagaccccgacuuguggcucggaccc

SEQ ID NO: 735785 - RNA, 64 nt, Homo Sapiens
aggaaauccguaggcaggagcagcucugcagggccccgcagauggccucauuucauccuugcaa

SEQ ID NO: 735786 - RNA, 64 nt, Homo Sapiens
guccuccggauaaacagcauagaaucgucacgaccccgcagacuggaaaaacuucaagaagaaa

SEQ ID NO: 735787 - RNA, 64 nt, Homo Sapiens
aagcaaagaggcucuuuagaggcagcgggggaggcccgcagagcgcgccccuagccgguuccug

SEQ ID NO: 735788 - RNA, 64 nt, Homo Sapiens
cacugcauucccucccagccgauaccaccccucacccgcagaguucugucuugcugccggccuu

SEQ ID NO: 735789 - RNA, 64 nt, Homo Sapiens
acuuccaugcugagugaugcucagggaagugaugcccgcagaaggcgucugggccuaaggaucc

SEQ ID NO: 735790 - RNA, 61 nt, Homo Sapiens; identical to SEQ ID NO: 481711

SEQ ID NO: 735791 - RNA, 64 nt, Homo Sapiens
cccugaccucugcccccagggaggauggacugggcccgcagaugugaaggucaggaggcaagug

SEQ ID NO: 735792 - RNA, 64 nt, Homo Sapiens
aggggcacacagacuguggcagagcugcgcccaucccgcagaggccccuguccaccuggagacc

SEQ ID NO: 735793 - RNA, 64 nt, Homo Sapiens
cccuggcaucucaagagggacaccgccgccagcgcccgcagacacugggccucggcccuucccg

SEQ ID NO: 735794 - RNA, 64 nt, Homo Sapiens
uccaggguggccaaguggauguguccagcgcagccccgcagagcccccuccuaccccugggcag

SEQ ID NO: 735795 - RNA, 64 nt, Homo Sapiens
gccagggaccgccugcugccguguccaccauggccccgcagaaccggggugcagaucuccuggc

SEQ ID NO: 735796 - RNA, 64 nt, Homo Sapiens
uucucugagccgcggacaugcccucgcauugcuucccgcagagugcagagacaggaagcuggag

SEQ ID NO: 735797 - RNA, 64 nt, Homo Sapiens
gcugaggauggagccgcccccagccgacuccaagcccgcagagggcagacgccacccuggacug

SEQ ID NO: 735798 - RNA, 64 nt, Homo Sapiens
gggaggauuccagaacagcagcacugagcucccacccgcagagccucuggacggccuuggcaac

SEQ ID NO: 735799 - RNA, 64 nt, Homo Sapiens
ccaaggacgccuaccccgaaaccggccccgacgccccgcagaggcccgccugaagccagcccgg

SEQ ID NO: 735800 - RNA, 61 nt, Homo Sapiens; identical to SEQ ID NO: 481721

SEQ ID NO: 735801 - RNA, 64 nt, Homo Sapiens
ccaaaccacucaggacaguacccguggcacugggcccgcagaagcaagggaugacuugguucuu

SEQ ID NO: 735802 - RNA, 64 nt, Homo Sapiens
cagaggcccccgagguguguguaggaggcggaggcccgcagagcacagagcaggagaagggcuu

SEQ ID NO: 735803 - RNA, 64 nt, Homo Sapiens
ccgaguuggggggaggggguguggcaacgugccccccgcagaggccacgcauguuugaccaaag

SEQ ID NO: 735804 - RNA, 64 nt, Homo Sapiens
acugagucuuuuggaggcuccaagccucaaagugcccgcagagcccaccuugaggguuuugcua

SEQ ID NO: 735805 - RNA, 64 nt, Homo Sapiens
cauaguguagauggacauuugccacaacacacugcccgcagaaauggacuuaccgugaagccaa

SEQ ID NO: 735806 - RNA, 64 nt, Homo Sapiens
gcccacggacaguguccacucugucccagccagccccgcagagcggguggcgcuucucagccgg

SEQ ID NO: 735807 - RNA, 64 nt, Homo Sapiens
aaagguggaaacacgugccucggaggaggcgaagcccgcagagccuuuccaggagccccaggcc

SEQ ID NO: 735808 - RNA, 64 nt, Homo Sapiens
guggccauguggcacgcugcagggcagcaggcagcccgcagauggagggccaaggacaauuggg

SEQ ID NO: 735809 - RNA, 64 nt, Homo Sapiens
cuccuucccauccucugaaaggccaagccccacacccgcagaccggccccuccuucugcugccu

SEQ ID NO: 735810 - RNA, 64 nt, Homo Sapiens
ggggugcagaucaggcgccgugcaaugcaucacucccgcagaggacgguacccggccgccguuc

SEQ ID NO: 735811 - RNA, 64 nt, Homo Sapiens
cacugaacagaacgucgcugauggagaaagggcucccgcagaaggaacggccuguaccgugcgc

SEQ ID NO: 735812 - RNA, 64 nt, Homo Sapiens
uguguaugcgagcgcccgccucccagccccggugcccgcagaagacgcuuuuccccagcagguc

SEQ ID NO: 735813 - RNA, 64 nt, Homo Sapiens
gggcccucgggaagccuuggacagaacccuccaccccgcagaccaggcgucguguguguguggg

SEQ ID NO: 735814 - RNA, 64 nt, Homo Sapiens
guacgggggcgcggcagggguccccggccccucccccgcagaggucaaugccaacgaacaaacg

SEQ ID NO: 735815 - RNA, 64 nt, Homo Sapiens
ccgcccccuccgccgccccuuccccagcccugcccccgcagacucccccugccgccaagacuuc

SEQ ID NO: 735816 - RNA, 64 nt, Homo Sapiens
gcgguuucggggcucccccuuccucucccucccucccgcagaaggggguuuuaggggccugggc

SEQ ID NO: 735817 - RNA, 64 nt, Homo Sapiens
gggcugggccccuccaggagucacagaugaggcccccgcagagacuggugaguggugacccugu

SEQ ID NO: 735818 - RNA, 64 nt, Homo Sapiens
cuuaaaaaaaucacccacaacgacccccaagggacccgcagaccggguccggaagggugaucau

SEQ ID NO: 735819 - RNA, 56 nt, Homo Sapiens; identical to SEQ ID NO: 481740

SEQ ID NO: 735820 - RNA, 64 nt, Homo Sapiens
aaaacauggcugccaaagugaggugugagagggucccgcagaagguggaggucagaguggaagc

SEQ ID NO: 735821 - RNA, 64 nt, Homo Sapiens
cuggcuccuccgacuacacccucucccggcuccgcccgcagacuuccgggagcugauggccccu

SEQ ID NO: 735822 - RNA, 64 nt, Homo Sapiens
gcccauccccccucagauccagacaugccccucccccgcagacacaccccaaggcagcccaacc

SEQ ID NO: 735823 - RNA, 64 nt, Homo Sapiens
ccuccacuccaccuccacccacuguccgccucugcccgcagagcccacgcccgacuagcaggca

SEQ ID NO: 735824 - RNA, 64 nt, Homo Sapiens
ggugugaggggcuuggccugcgccccgccagcugcccgcagaggugcagccucgaggaaucuga

SEQ ID NO: 735825 - RNA, 64 nt, Homo Sapiens
gacuaggcguggaccugcccauggugccugucagcccgcagagcccaucuacgcccaacacaga

SEQ ID NO: 735826 - RNA, 64 nt, Homo Sapiens
guuaaugaauggucugcccugauucuuuguucaccccgcagauacugggacaucugaggauugg

SEQ ID NO: 735827 - RNA, 64 nt, Homo Sapiens
agauuaacggugcuaaccccgucugcuccucccucccgcagagacuggggccuggacuggacau

SEQ ID NO: 735828 - RNA, 64 nt, Homo Sapiens
gagcugcgcuuggggguccuccucugggucgugccccgcagacugccccguccucugcugcugg

SEQ ID NO: 735829 - RNA, 60 nt, Homo Sapiens; identical to SEQ ID NO: 481750

SEQ ID NO: 735830 - RNA, 64 nt, Homo Sapiens
ccccacgccucggggcccccgccgccccuccggacccgcagagcuggggacauggcaugcccug

SEQ ID NO: 735831 - RNA, 64 nt, Homo Sapiens
ugcccuuacugaggugacagaggcugucccggggcccgcagaggggugagcuagcccuuagaga

SEQ ID NO: 735832 - RNA, 64 nt, Homo Sapiens
cuacagcugccaggucaugccgagcaguggaggucccgcagaagagcuaccugagccugacgcc

SEQ ID NO: 735833 - RNA, 64 nt, Homo Sapiens
cgggcacuucucagcauggcggccccuaccagaccccgcagaccugccccucuccaauaggugu

SEQ ID NO: 735834 - RNA, 64 nt, Homo Sapiens
ggccuaaguauguggagcucugcuuuggcacugccccgcagaggccacgccuauuuauucuguu

SEQ ID NO: 735835 - RNA, 64 nt, Homo Sapiens
uggacagcgacacgcagggggguggcaggggagccccgcagagcccuguccccaaauuggccuc

SEQ ID NO: 735836 - RNA, 64 nt, Homo Sapiens
ugagggauguggucagcaguucucaugccauuuucccgcagagcauuccugaccauccucagaa

SEQ ID NO: 735837 - RNA, 57 nt, Homo Sapiens
ugugcagagaccaagaggugccaggcagagggaaaccuggagaauaggaagggcauu

SEQ ID NO: 735838 - RNA, 57 nt, Homo Sapiens
guuaacggugugggccacucccagggagagggaaagaggccugccccagcuccuugc

SEQ ID NO: 735839 - RNA, 57 nt, Homo Sapiens
gcagcuuccuggggcuugugcagcuaggagggaaaccgcugcacucgguccagaggc

SEQ ID NO: 735840 - RNA, 57 nt, Homo Sapiens
gagacaaguggggcugcacucaugguggagggaaaggcugacccagucggagccuga

SEQ ID NO: 735841 - RNA, 57 nt, Homo Sapiens
caagagagccaugaggagagacauuuggagggaaagagugggggccucucuggaagc

SEQ ID NO: 735842 - RNA, 57 nt, Homo Sapiens
accaaaaaacuaccaaacaaccagauagagggaaauaggagcccucccaccccaccc

SEQ ID NO: 735843 - RNA, 57 nt, Homo Sapiens
ugacggggaaacaaaauuauucucugagagggaaaggacauuugagggaaacaucaa

SEQ ID NO: 735844 - RNA, 57 nt, Homo Sapiens
uuauucucugagagggaaaggacauuugagggaaacaucaaauuuccccauaaauaa

SEQ ID NO: 735845 - RNA, 57 nt, Homo Sapiens
uugcugaaacacacaggccauuucauugagggaaaacauaauaucuugaagaauauu

SEQ ID NO: 735846 - RNA, 57 nt, Homo Sapiens
uuuucaaaacgccauguccuaggggccgagggaaaugcuguuggugagaaucgaccu

SEQ ID NO: 735847 - RNA, 57 nt, Homo Sapiens
ugauauucucagaggcaggggaaaauagagggaaaaauagagacuauugguauguuc

SEQ ID NO: 735848 - RNA, 57 nt, Homo Sapiens
ccacuggacgggaaggagaacagaggagagggaaagagaagcccaaccucugugauc

SEQ ID NO: 735849 - RNA, 57 nt, Homo Sapiens
cuguaauuucaguuuuugugucggggagagggaaaaacuauuugucuguaguugcuu

SEQ ID NO: 735850 - RNA, 57 nt, Homo Sapiens
cuguaaugagaauagacuggaacaugugagggaaaaauauuuaaaaaaagauggcag

SEQ ID NO: 735851 - RNA, 57 nt, Homo Sapiens
ggccauggacgguggcucacgaugaaagagggaaauauucagaaaauuauuuuaaaa

SEQ ID NO: 735852 - RNA, 57 nt, Homo Sapiens
auccuaacaaggaaaggcaguaaggcugagggaaagagaugaaaagagaagguaccc

SEQ ID NO: 735853 - RNA, 57 nt, Homo Sapiens
ugcauuuauuuuuauacagagggaaaggagggaaaaguggaaguuuuccauucacug

SEQ ID NO: 735854 - RNA, 57 nt, Homo Sapiens
uggaaacgggacauacacaauuuuggagagggaaauuguuuguuuauuugguuggcu

SEQ ID NO: 735855 - RNA, 57 nt, Homo Sapiens
ggccagguccuugaucauggauuaccugagggaaacuacuuuggugcuacuaccccc

SEQ ID NO: 735856 - RNA, 57 nt, Homo Sapiens
uuuuuuuuucccccugagugagcuggagagggaaauccaacuuucagaaauucaggg

SEQ ID NO: 735857 - RNA, 57 nt, Homo Sapiens
aaauuauuucagagaugugugcuccuggagggaaaaagaaauacagccucaacagau

SEQ ID NO: 735858 - RNA, 57 nt, Homo Sapiens
gcaacgacccaagcacuuauuuuuuaagagggaaaggacuuuggucauguuuacauu

SEQ ID NO: 735859 - RNA, 57 nt, Homo Sapiens
guggcauauacugcacauacugaaauagagggaaaucacugaauguaaagagguuuc

SEQ ID NO: 735860 - RNA, 57 nt, Homo Sapiens
gagggggcuacagcagcaucaugcaaagagggaaagaugaagggauagaagaagaga

SEQ ID NO: 735861 - RNA, 57 nt, Homo Sapiens
gaaccaagaaguagaaggaguacaaaggagggaaaagaaaacaauuaacguaagagc

SEQ ID NO: 735862 - RNA, 57 nt, Homo Sapiens
uggauuuucacaccuugccucagcccagagggaaauaucccaguaacuucuaccugc

SEQ ID NO: 735863 - RNA, 57 nt, Homo Sapiens
gagggagggggugucugcacgccuggagagggaaaaggggcucuggggaggcugugg

SEQ ID NO: 735864 - RNA, 57 nt, Homo Sapiens
aaaauugggagggggaagagucaucuggagggaaaccaccaacauucaaauucugcc

SEQ ID NO: 735865 - RNA, 57 nt, Homo Sapiens
augucuugcuaaaccuguuuguggugggagggaaaccgacgggggugggggguggua

SEQ ID NO: 735866 - RNA, 57 nt, Homo Sapiens
guuguuugcuuaaaaaaaauuucaugugagggaaaaaaaaaaaaccuauuccagaau

SEQ ID NO: 735867 - RNA, 57 nt, Homo Sapiens
guuuuaacgaguaauuggauaaacccugagggaaaacggagguagauucagcaccua

SEQ ID NO: 735868 - RNA, 57 nt, Homo Sapiens
guuauacuacaaaucauguuuuguacugagggaaacaucaauaaaaauucaaauaau

SEQ ID NO: 735869 - RNA, 57 nt, Homo Sapiens
uucagcuacaaucuuugcucaucaauagagggaaauuagguacaccuuaugaaucgc

SEQ ID NO: 735870 - RNA, 57 nt, Homo Sapiens
cuggggagggaggcaggugggugguaagagggaaacucuggagagccugcacccagg

SEQ ID NO: 735871 - RNA, 57 nt, Homo Sapiens
auuccaagugauggaacuccagggguggagggaaauuggcaguuccuggcaucucuu

SEQ ID NO: 735872 - RNA, 57 nt, Homo Sapiens
cccucgggccgcuccccugcaccuacagagggaaagaauguuccuacagagggaaag

SEQ ID NO: 735873 - RNA, 57 nt, Homo Sapiens
ccuacagagggaaagacccuuccuacagagggaaagauuccagaaucuucuggaugu

SEQ ID NO: 735874 - RNA, 57 nt, Homo Sapiens
gcuucuuuagauggaauaaugggaaaggagggaaaugggaaauggauggaaauggga

SEQ ID NO: 735875 - RNA, 57 nt, Homo Sapiens
aaugggaaauggauggaaaugggaaaggagggaaaauaauagcccagugagagcuga

SEQ ID NO: 735876 - RNA, 57 nt, Homo Sapiens
ucauguauuuagaaauuuaauucuguugagggaaaggaagauauauugauuaugcug

SEQ ID NO: 735877 - RNA, 57 nt, Homo Sapiens
cuacaguggccacauuucagugcuuuugagggaaaaguucagcucaccuuccaugau

SEQ ID NO: 735878 - RNA, 57 nt, Homo Sapiens
uuuguaauugugagacauuuucuuggggagggaaaauuggaaugguucccuuuuuua

SEQ ID NO: 735879 - RNA, 57 nt, Homo Sapiens
uuuuuguguuuaaaaaaaaauaggaaagagggaaacugcagcuuucauuacagauuc

SEQ ID NO: 735880 - RNA, 57 nt, Homo Sapiens
ggcagagaaggaaagagacaaggcagagagggaaagaagagagacagaggggaagag

SEQ ID NO: 735881 - RNA, 57 nt, Homo Sapiens
aggagggagagagauggagaggucagggagggaaaggggcccaggugcauaaauggg

SEQ ID NO: 735882 - RNA, 57 nt, Homo Sapiens
uaaccgggagacaaauugagagggggagagggaaaagcuccuuccucuacauuuuaa

SEQ ID NO: 735883 - RNA, 57 nt, Homo Sapiens
cagacacagaugcauagggaaucggaagagggaaauuccaauaugacuggaguccuu

SEQ ID NO: 735884 - RNA, 57 nt, Homo Sapiens
gcuuucacagggugggaaacgaaauucgagggaaauuccccggaaauaugagggaaa

SEQ ID NO: 735885 - RNA, 57 nt, Homo Sapiens
aauucgagggaaauuccccggaaauaugagggaaaucucugcauugcaccaccagag

SEQ ID NO: 735886 - RNA, 57 nt, Homo Sapiens
uccucuucuuuuagcaguaaaauagcugagggaaaagggagggaaaaggaaguuaug

SEQ ID NO: 735887 - RNA, 57 nt, Homo Sapiens
uagcaguaaaauagcugagggaaaagggagggaaaaggaaguuaugggaauaccugu

SEQ ID NO: 735888 - RNA, 64 nt, Homo Sapiens; identical to SEQ ID NO: 283773

SEQ ID NO: 735889 - RNA, 64 nt, Homo Sapiens; identical to SEQ ID NO: 283774

SEQ ID NO: 735890 - RNA, 64 nt, Homo Sapiens; identical to SEQ ID NO: 283775

SEQ ID NO: 735891 - RNA, 64 nt, Homo Sapiens; identical to SEQ ID NO: 283776

SEQ ID NO: 735892 - RNA, 64 nt, Homo Sapiens; identical to SEQ ID NO: 283777

SEQ ID NO: 735893 - RNA, 64 nt, Homo Sapiens; identical to SEQ ID NO: 283778

SEQ ID NO: 735894 - RNA, 64 nt, Homo Sapiens; identical to SEQ ID NO: 283779

SEQ ID NO: 735895 - RNA, 64 nt, Homo Sapiens; identical to SEQ ID NO: 283780

SEQ ID NO: 735896 - RNA, 64 nt, Homo Sapiens; identical to SEQ ID NO: 283781

SEQ ID NO: 735897 - RNA, 64 nt, Homo Sapiens; identical to SEQ ID NO: 283782

SEQ ID NO: 735898 - RNA, 64 nt, Homo Sapiens; identical to SEQ ID NO: 283783

SEQ ID NO: 735899 - RNA, 64 nt, Homo Sapiens; identical to SEQ ID NO: 283784

SEQ ID NO: 735900 - RNA, 64 nt, Homo Sapiens; identical to SEQ ID NO: 283785

SEQ ID NO: 735901 - RNA, 64 nt, Homo Sapiens; identical to SEQ ID NO: 283786

SEQ ID NO: 735902 - RNA, 64 nt, Homo Sapiens; identical to SEQ ID NO: 283787

SEQ ID NO: 735903 - RNA, 64 nt, Homo Sapiens; identical to SEQ ID NO: 283788

SEQ ID NO: 735904 - RNA, 64 nt, Homo Sapiens; identical to SEQ ID NO: 283789

SEQ ID NO: 735905 - RNA, 64 nt, Homo Sapiens; identical to SEQ ID NO: 283790

SEQ ID NO: 735906 - RNA, 64 nt, Homo Sapiens; identical to SEQ ID NO: 283791

SEQ ID NO: 735907 - RNA, 64 nt, Homo Sapiens; identical to SEQ ID NO: 283792

SEQ ID NO: 735908 - RNA, 64 nt, Homo Sapiens; identical to SEQ ID NO: 283793

SEQ ID NO: 735909 - RNA, 64 nt, Homo Sapiens; identical to SEQ ID NO: 283794

SEQ ID NO: 735910 - RNA, 64 nt, Homo Sapiens; identical to SEQ ID NO: 283795

SEQ ID NO: 735911 - RNA, 64 nt, Homo Sapiens; identical to SEQ ID NO: 283796

SEQ ID NO: 735912 - RNA, 64 nt, Homo Sapiens; identical to SEQ ID NO: 283797

SEQ ID NO: 735913 - RNA, 64 nt, Homo Sapiens; identical to SEQ ID NO: 283798

SEQ ID NO: 735914 - RNA, 64 nt, Homo Sapiens; identical to SEQ ID NO: 283799

SEQ ID NO: 735915 - RNA, 64 nt, Homo Sapiens; identical to SEQ ID NO: 283800

SEQ ID NO: 735916 - RNA, 64 nt, Homo Sapiens; identical to SEQ ID NO: 283801

SEQ ID NO: 735917 - RNA, 64 nt, Homo Sapiens; identical to SEQ ID NO: 283802

SEQ ID NO: 735918 - RNA, 64 nt, Homo Sapiens; identical to SEQ ID NO: 283803

SEQ ID NO: 735919 - RNA, 64 nt, Homo Sapiens; identical to SEQ ID NO: 283804

SEQ ID NO: 735920 - RNA, 64 nt, Homo Sapiens; identical to SEQ ID NO: 283805

SEQ ID NO: 735921 - RNA, 64 nt, Homo Sapiens; identical to SEQ ID NO: 283806

SEQ ID NO: 735922 - RNA, 64 nt, Homo Sapiens; identical to SEQ ID NO: 283807

SEQ ID NO: 735923 - RNA, 64 nt, Homo Sapiens; identical to SEQ ID NO: 283808

SEQ ID NO: 735924 - RNA, 64 nt, Homo Sapiens; identical to SEQ ID NO: 334267

SEQ ID NO: 735925 - RNA, 64 nt, Homo Sapiens; identical to SEQ ID NO: 334268

SEQ ID NO: 735926 - RNA, 64 nt, Homo Sapiens; identical to SEQ ID NO: 334269

SEQ ID NO: 735927 - RNA, 64 nt, Homo Sapiens; identical to SEQ ID NO: 334270

SEQ ID NO: 735928 - RNA, 64 nt, Homo Sapiens; identical to SEQ ID NO: 334271

SEQ ID NO: 735929 - RNA, 64 nt, Homo Sapiens; identical to SEQ ID NO: 334272

SEQ ID NO: 735930 - RNA, 64 nt, Homo Sapiens; identical to SEQ ID NO: 334273

SEQ ID NO: 735931 - RNA, 64 nt, Homo Sapiens; identical to SEQ ID NO: 334274

SEQ ID NO: 735932 - RNA, 64 nt, Homo Sapiens; identical to SEQ ID NO: 334275

SEQ ID NO: 735933 - RNA, 64 nt, Homo Sapiens; identical to SEQ ID NO: 334276

SEQ ID NO: 735934 - RNA, 64 nt, Homo Sapiens; identical to SEQ ID NO: 553500

SEQ ID NO: 735935 - RNA, 64 nt, Homo Sapiens; identical to SEQ ID NO: 553501

SEQ ID NO: 735936 - RNA, 64 nt, Homo Sapiens; identical to SEQ ID NO: 553502

SEQ ID NO: 735937 - RNA, 64 nt, Homo Sapiens; identical to SEQ ID NO: 553503

SEQ ID NO: 735938 - RNA, 64 nt, Homo Sapiens; identical to SEQ ID NO: 553504

SEQ ID NO: 735939 - RNA, 64 nt, Homo Sapiens; identical to SEQ ID NO: 553505

SEQ ID NO: 735940 - RNA, 64 nt, Homo Sapiens; identical to SEQ ID NO: 553506

SEQ ID NO: 735941 - RNA, 64 nt, Homo Sapiens; identical to SEQ ID NO: 553507

SEQ ID NO: 735942 - RNA, 64 nt, Homo Sapiens; identical to SEQ ID NO: 553508

SEQ ID NO: 735943 - RNA, 64 nt, Homo Sapiens; identical to SEQ ID NO: 553509

SEQ ID NO: 735944 - RNA, 64 nt, Homo Sapiens; identical to SEQ ID NO: 553510

SEQ ID NO: 735945 - RNA, 64 nt, Homo Sapiens; identical to SEQ ID NO: 553511

SEQ ID NO: 735946 - RNA, 64 nt, Homo Sapiens; identical to SEQ ID NO: 553512

SEQ ID NO: 735947 - RNA, 64 nt, Homo Sapiens; identical to SEQ ID NO: 553513

SEQ ID NO: 735948 - RNA, 64 nt, Homo Sapiens; identical to SEQ ID NO: 553514

SEQ ID NO: 735949 - RNA, 64 nt, Homo Sapiens; identical to SEQ ID NO: 553515

SEQ ID NO: 735950 - RNA, 64 nt, Homo Sapiens; identical to SEQ ID NO: 553516

SEQ ID NO: 735951 - RNA, 64 nt, Homo Sapiens; identical to SEQ ID NO: 553517

SEQ ID NO: 735952 - RNA, 64 nt, Homo Sapiens; identical to SEQ ID NO: 553518

SEQ ID NO: 735953 - RNA, 64 nt, Homo Sapiens; identical to SEQ ID NO: 553519

SEQ ID NO: 735954 - RNA, 64 nt, Homo Sapiens; identical to SEQ ID NO: 553520

SEQ ID NO: 735955 - RNA, 64 nt, Homo Sapiens; identical to SEQ ID NO: 553521

SEQ ID NO: 735956 - RNA, 64 nt, Homo Sapiens; identical to SEQ ID NO: 553522

SEQ ID NO: 735957 - RNA, 64 nt, Homo Sapiens; identical to SEQ ID NO: 553523

SEQ ID NO: 735958 - RNA, 64 nt, Homo Sapiens; identical to SEQ ID NO: 553524

SEQ ID NO: 735959 - RNA, 64 nt, Homo Sapiens; identical to SEQ ID NO: 553525

SEQ ID NO: 735960 - RNA, 64 nt, Homo Sapiens; identical to SEQ ID NO: 553526

SEQ ID NO: 735961 - RNA, 64 nt, Homo Sapiens; identical to SEQ ID NO: 553527

SEQ ID NO: 735962 - RNA, 64 nt, Homo Sapiens; identical to SEQ ID NO: 553528

SEQ ID NO: 735963 - RNA, 64 nt, Homo Sapiens; identical to SEQ ID NO: 553529

SEQ ID NO: 735964 - RNA, 64 nt, Homo Sapiens; identical to SEQ ID NO: 553530

SEQ ID NO: 735965 - RNA, 64 nt, Homo Sapiens; identical to SEQ ID NO: 553531

SEQ ID NO: 735966 - RNA, 64 nt, Homo Sapiens; identical to SEQ ID NO: 553532

SEQ ID NO: 735967 - RNA, 64 nt, Homo Sapiens; identical to SEQ ID NO: 553533

SEQ ID NO: 735968 - RNA, 64 nt, Homo Sapiens; identical to SEQ ID NO: 553534

SEQ ID NO: 735969 - RNA, 64 nt, Homo Sapiens; identical to SEQ ID NO: 553535

SEQ ID NO: 735970 - RNA, 64 nt, Homo Sapiens; identical to SEQ ID NO: 553536

SEQ ID NO: 735971 - RNA, 64 nt, Homo Sapiens; identical to SEQ ID NO: 553537

SEQ ID NO: 735972 - RNA, 64 nt, Homo Sapiens; identical to SEQ ID NO: 553538

SEQ ID NO: 735973 - RNA, 64 nt, Homo Sapiens; identical to SEQ ID NO: 553539

SEQ ID NO: 735974 - RNA, 64 nt, Homo Sapiens; identical to SEQ ID NO: 553540

SEQ ID NO: 735975 - RNA, 64 nt, Homo Sapiens; identical to SEQ ID NO: 553541

SEQ ID NO: 735976 - RNA, 62 nt, Homo Sapiens
gaggugggugucccaugugccugcuuaguggaagauguaaguuaucgaacgugagaguggag

SEQ ID NO: 735977 - RNA, 62 nt, Homo Sapiens
acauuuuuuucugagaugaaaugaacaggaaaagauguaaaacuugaaccaagagcacauga

SEQ ID NO: 735978 - RNA, 62 nt, Homo Sapiens
auuaagaauaucuaauuuuccucuuuaaccuaagauguaaguuaugucauauaucaaaucau

SEQ ID NO: 735979 - RNA, 62 nt, Homo Sapiens
gugccaagaauauauuauauagaugaugaaugagauguaaauaucaaacauaaugaugagua

SEQ ID NO: 735980 - RNA, 62 nt, Homo Sapiens
ugaguucagccuuuaucccucgugguuccacuagauguaacuuaaaggaguuaacauuugag

SEQ ID NO: 735981 - RNA, 62 nt, Homo Sapiens
ugaguucagccuuuaucccucgugguuccgcuagauguaacuuauaggaguuaacauuugag

SEQ ID NO: 735982 - RNA, 62 nt, Homo Sapiens
ucccaagagccugggggaucggaggagggagcagauguaagcuaaggcuucagccauaauau

SEQ ID NO: 735983 - RNA, 62 nt, Homo Sapiens
guucccuuuguacuuuuccaccaguaaucucuagauguaauaagcuuguguagucagauuag

SEQ ID NO: 735984 - RNA, 62 nt, Homo Sapiens
aucaaucagucagcaccuguuuggcugguccaagauguaauuagacguaaaaauaaaggcau

SEQ ID NO: 735985 - RNA, 62 nt, Homo Sapiens
gaugaaaauguuuuccuuauggggcuggaggaagauguaaaaagugucagaugagaauuuua

SEQ ID NO: 735986 - RNA, 62 nt, Homo Sapiens
uuuucuauguaaaaaauucuuguauaugguacagauguaaagauuuuuucagauggacaaaa

SEQ ID NO: 735987 - RNA, 62 nt, Homo Sapiens
auugaacuucuacaagaaguccaaagaacuauagauguaaaggguguggaagugaaacuuac

SEQ ID NO: 735988 - RNA, 62 nt, Homo Sapiens
acaaaauaaagguuaaagagguaacguguuauagauguaaaguggauauguaaacaaugacu

SEQ ID NO: 735989 - RNA, 62 nt, Homo Sapiens
cugaauaaagcauuauuucuguauaugaugaaagauguaaaggcaaguuuuuuggugcugua

SEQ ID NO: 735990 - RNA, 62 nt, Homo Sapiens
accauucuuaguuugugggcgaaaaagaaaaaagauguaaaaagcaagacucccucucaaaa

SEQ ID NO: 735991 - RNA, 62 nt, Homo Sapiens
cccggccgggcgcgguggcuccccuucuuuaaagauguaaaagccacugugcccaggcagac

SEQ ID NO: 735992 - RNA, 62 nt, Homo Sapiens
gauucccuaaguaugcuacacagcaucauauuagauguaagauguaagacuugcaaaggaca

SEQ ID NO: 735993 - RNA, 62 nt, Homo Sapiens
uaaguaugcuacacagcaucauauuagauguaagauguaagacuugcaaaggacagaaggaa

SEQ ID NO: 735994 - RNA, 62 nt, Homo Sapiens
acagacugagucuccacaacaccaaaauauccagauguaaaccccaaacuuguacacaaaag

SEQ ID NO: 735995 - RNA, 62 nt, Homo Sapiens
aaagcacagauuguuuaccuguuguggauuuuagauguaacaaauguuuauacaaauacaua

SEQ ID NO: 735996 - RNA, 62 nt, Homo Sapiens
auuccucuucaaaaauugagcgcuauguugcaagauguaauuuuucuuuuccuuuuuuuuga

SEQ ID NO: 735997 - RNA, 62 nt, Homo Sapiens
guuacaggugugagccacugcacccggccacaagauguaauuuuuacuuuaucucucacacg

SEQ ID NO: 735998 - RNA, 62 nt, Homo Sapiens
ucaggguuacacaguuccaauugggagcauugagauguaagcacauagcaagagcccagcuc

SEQ ID NO: 735999 - RNA, 62 nt, Homo Sapiens
gaagccaaauuaaauugauacuugauuucaguagauguaaugucauguuuaacaaguauagc

SEQ ID NO: 736000 - RNA, 62 nt, Homo Sapiens
agggacugugcaguauuucuaccacuguagaaagauguaaauauucuuaaaacauuuuaaaa

SEQ ID NO: 736001 - RNA, 62 nt, Homo Sapiens
uuacuacgcauagacuuuuacaagcuccugaaagauguaaguuuuguccagaacacauugac

SEQ ID NO: 736002 - RNA, 62 nt, Homo Sapiens
ucuuauuuaagaaaccuagaucaaguuuuuacagauguaaauaaaaguugaauaguuuaccu

SEQ ID NO: 736003 - RNA, 62 nt, Homo Sapiens
aauaaugcacaguaaauaugugaauuuuuccuagauguaaaaaaaaaaaucuuucauauaaa

SEQ ID NO: 736004 - RNA, 64 nt, Homo Sapiens; identical to SEQ ID NO: 169280

SEQ ID NO: 736005 - RNA, 64 nt, Homo Sapiens; identical to SEQ ID NO: 169281

SEQ ID NO: 736006 - RNA, 64 nt, Homo Sapiens; identical to SEQ ID NO: 169282

SEQ ID NO: 736007 - RNA, 64 nt, Homo Sapiens; identical to SEQ ID NO: 169283

SEQ ID NO: 736008 - RNA, 64 nt, Homo Sapiens; identical to SEQ ID NO: 169284

SEQ ID NO: 736009 - RNA, 64 nt, Homo Sapiens; identical to SEQ ID NO: 169285

SEQ ID NO: 736010 - RNA, 64 nt, Homo Sapiens; identical to SEQ ID NO: 169286

SEQ ID NO: 736011 - RNA, 64 nt, Homo Sapiens; identical to SEQ ID NO: 169287

SEQ ID NO: 736012 - RNA, 64 nt, Homo Sapiens; identical to SEQ ID NO: 169288

SEQ ID NO: 736013 - RNA, 64 nt, Homo Sapiens; identical to SEQ ID NO: 169289

SEQ ID NO: 736014 - RNA, 64 nt, Homo Sapiens; identical to SEQ ID NO: 169290

SEQ ID NO: 736015 - RNA, 64 nt, Homo Sapiens; identical to SEQ ID NO: 169291

SEQ ID NO: 736016 - RNA, 64 nt, Homo Sapiens; identical to SEQ ID NO: 169292

SEQ ID NO: 736017 - RNA, 64 nt, Homo Sapiens; identical to SEQ ID NO: 169293

SEQ ID NO: 736018 - RNA, 64 nt, Homo Sapiens; identical to SEQ ID NO: 169294

SEQ ID NO: 736019 - RNA, 64 nt, Homo Sapiens; identical to SEQ ID NO: 169295

SEQ ID NO: 736020 - RNA, 64 nt, Homo Sapiens; identical to SEQ ID NO: 169296

SEQ ID NO: 736021 - RNA, 64 nt, Homo Sapiens; identical to SEQ ID NO: 169297

SEQ ID NO: 736022 - RNA, 64 nt, Homo Sapiens; identical to SEQ ID NO: 169298

SEQ ID NO: 736023 - RNA, 64 nt, Homo Sapiens; identical to SEQ ID NO: 169299

SEQ ID NO: 736024 - RNA, 64 nt, Homo Sapiens; identical to SEQ ID NO: 169300

SEQ ID NO: 736025 - RNA, 64 nt, Homo Sapiens; identical to SEQ ID NO: 169301

SEQ ID NO: 736026 - RNA, 64 nt, Homo Sapiens; identical to SEQ ID NO: 169302

SEQ ID NO: 736027 - RNA, 64 nt, Homo Sapiens; identical to SEQ ID NO: 169303

SEQ ID NO: 736028 - RNA, 64 nt, Homo Sapiens; identical to SEQ ID NO: 169304

SEQ ID NO: 736029 - RNA, 64 nt, Homo Sapiens; identical to SEQ ID NO: 169305

SEQ ID NO: 736030 - RNA, 64 nt, Homo Sapiens; identical to SEQ ID NO: 169306

SEQ ID NO: 736031 - RNA, 64 nt, Homo Sapiens; identical to SEQ ID NO: 169307

SEQ ID NO: 736032 - RNA, 64 nt, Homo Sapiens; identical to SEQ ID NO: 243860

SEQ ID NO: 736033 - RNA, 64 nt, Homo Sapiens; identical to SEQ ID NO: 243861

SEQ ID NO: 736034 - RNA, 64 nt, Homo Sapiens; identical to SEQ ID NO: 243862

SEQ ID NO: 736035 - RNA, 64 nt, Homo Sapiens; identical to SEQ ID NO: 243863

SEQ ID NO: 736036 - RNA, 64 nt, Homo Sapiens; identical to SEQ ID NO: 243864

SEQ ID NO: 736037 - RNA, 64 nt, Homo Sapiens; identical to SEQ ID NO: 243865

SEQ ID NO: 736038 - RNA, 64 nt, Homo Sapiens; identical to SEQ ID NO: 243866

SEQ ID NO: 736039 - RNA, 64 nt, Homo Sapiens; identical to SEQ ID NO: 243867

SEQ ID NO: 736040 - RNA, 64 nt, Homo Sapiens; identical to SEQ ID NO: 243868

SEQ ID NO: 736041 - RNA, 64 nt, Homo Sapiens; identical to SEQ ID NO: 243869

SEQ ID NO: 736042 - RNA, 64 nt, Homo Sapiens; identical to SEQ ID NO: 243870

SEQ ID NO: 736043 - RNA, 64 nt, Homo Sapiens; identical to SEQ ID NO: 243871

SEQ ID NO: 736044 - RNA, 64 nt, Homo Sapiens; identical to SEQ ID NO: 243872

SEQ ID NO: 736045 - RNA, 64 nt, Homo Sapiens; identical to SEQ ID NO: 243873

SEQ ID NO: 736046 - RNA, 64 nt, Homo Sapiens; identical to SEQ ID NO: 243874

SEQ ID NO: 736047 - RNA, 64 nt, Homo Sapiens; identical to SEQ ID NO: 243875

SEQ ID NO: 736048 - RNA, 64 nt, Homo Sapiens; identical to SEQ ID NO: 243876

SEQ ID NO: 736049 - RNA, 64 nt, Homo Sapiens; identical to SEQ ID NO: 243877

SEQ ID NO: 736050 - RNA, 64 nt, Homo Sapiens; identical to SEQ ID NO: 243878

SEQ ID NO: 736051 - RNA, 64 nt, Homo Sapiens; identical to SEQ ID NO: 243879

SEQ ID NO: 736052 - RNA, 64 nt, Homo Sapiens; identical to SEQ ID NO: 243880

SEQ ID NO: 736053 - RNA, 64 nt, Homo Sapiens; identical to SEQ ID NO: 243881

SEQ ID NO: 736054 - RNA, 64 nt, Homo Sapiens; identical to SEQ ID NO: 243882

SEQ ID NO: 736055 - RNA, 64 nt, Homo Sapiens; identical to SEQ ID NO: 243883

SEQ ID NO: 736056 - RNA, 64 nt, Homo Sapiens; identical to SEQ ID NO: 243884

SEQ ID NO: 736057 - RNA, 64 nt, Homo Sapiens; identical to SEQ ID NO: 243885

SEQ ID NO: 736058 - RNA, 64 nt, Homo Sapiens; identical to SEQ ID NO: 243886

SEQ ID NO: 736059 - RNA, 64 nt, Homo Sapiens; identical to SEQ ID NO: 243887

SEQ ID NO: 736060 - RNA, 64 nt, Homo Sapiens; identical to SEQ ID NO: 243888

SEQ ID NO: 736061 - RNA, 64 nt, Homo Sapiens; identical to SEQ ID NO: 243889

SEQ ID NO: 736062 - RNA, 51 nt, Homo Sapiens; identical to SEQ ID NO: 243890

SEQ ID NO: 736063 - RNA, 64 nt, Homo Sapiens; identical to SEQ ID NO: 243891

SEQ ID NO: 736064 - RNA, 64 nt, Homo Sapiens; identical to SEQ ID NO: 243892

SEQ ID NO: 736065 - RNA, 64 nt, Homo Sapiens; identical to SEQ ID NO: 243893

SEQ ID NO: 736066 - RNA, 64 nt, Homo Sapiens; identical to SEQ ID NO: 243894

SEQ ID NO: 736067 - RNA, 64 nt, Homo Sapiens; identical to SEQ ID NO: 243895

SEQ ID NO: 736068 - RNA, 64 nt, Homo Sapiens; identical to SEQ ID NO: 243896

SEQ ID NO: 736069 - RNA, 64 nt, Homo Sapiens; identical to SEQ ID NO: 243897

SEQ ID NO: 736070 - RNA, 64 nt, Homo Sapiens; identical to SEQ ID NO: 243898

SEQ ID NO: 736071 - RNA, 64 nt, Homo Sapiens; identical to SEQ ID NO: 243899

SEQ ID NO: 736072 - RNA, 64 nt, Homo Sapiens; identical to SEQ ID NO: 243900

SEQ ID NO: 736073 - RNA, 64 nt, Homo Sapiens; identical to SEQ ID NO: 243901

SEQ ID NO: 736074 - RNA, 63 nt, Homo Sapiens; identical to SEQ ID NO: 243902

SEQ ID NO: 736075 - RNA, 64 nt, Homo Sapiens; identical to SEQ ID NO: 243903

SEQ ID NO: 736076 - RNA, 64 nt, Homo Sapiens; identical to SEQ ID NO: 243904

SEQ ID NO: 736077 - RNA, 64 nt, Homo Sapiens; identical to SEQ ID NO: 243905

SEQ ID NO: 736078 - RNA, 64 nt, Homo Sapiens; identical to SEQ ID NO: 243906

SEQ ID NO: 736079 - RNA, 64 nt, Homo Sapiens; identical to SEQ ID NO: 243907

SEQ ID NO: 736080 - RNA, 64 nt, Homo Sapiens; identical to SEQ ID NO: 243908

SEQ ID NO: 736081 - RNA, 64 nt, Homo Sapiens; identical to SEQ ID NO: 243909

SEQ ID NO: 736082 - RNA, 64 nt, Homo Sapiens; identical to SEQ ID NO: 243910

SEQ ID NO: 736083 - RNA, 64 nt, Homo Sapiens; identical to SEQ ID NO: 243911

SEQ ID NO: 736084 - RNA, 64 nt, Homo Sapiens; identical to SEQ ID NO: 243912

SEQ ID NO: 736085 - RNA, 64 nt, Homo Sapiens; identical to SEQ ID NO: 243913

SEQ ID NO: 736086 - RNA, 64 nt, Homo Sapiens; identical to SEQ ID NO: 243914

SEQ ID NO: 736087 - RNA, 64 nt, Homo Sapiens; identical to SEQ ID NO: 243915

SEQ ID NO: 736088 - RNA, 64 nt, Homo Sapiens; identical to SEQ ID NO: 243916

SEQ ID NO: 736089 - RNA, 64 nt, Homo Sapiens; identical to SEQ ID NO: 243917

SEQ ID NO: 736090 - RNA, 64 nt, Homo Sapiens; identical to SEQ ID NO: 243918

SEQ ID NO: 736091 - RNA, 64 nt, Homo Sapiens; identical to SEQ ID NO: 243919

SEQ ID NO: 736092 - RNA, 64 nt, Homo Sapiens; identical to SEQ ID NO: 243920

SEQ ID NO: 736093 - RNA, 64 nt, Homo Sapiens; identical to SEQ ID NO: 243921

SEQ ID NO: 736094 - RNA, 64 nt, Homo Sapiens; identical to SEQ ID NO: 243922

SEQ ID NO: 736095 - RNA, 64 nt, Homo Sapiens; identical to SEQ ID NO: 243923

SEQ ID NO: 736096 - RNA, 64 nt, Homo Sapiens; identical to SEQ ID NO: 243924

SEQ ID NO: 736097 - RNA, 64 nt, Homo Sapiens; identical to SEQ ID NO: 243925

SEQ ID NO: 736098 - RNA, 64 nt, Homo Sapiens; identical to SEQ ID NO: 243926

SEQ ID NO: 736099 - RNA, 64 nt, Homo Sapiens; identical to SEQ ID NO: 243927

SEQ ID NO: 736100 - RNA, 64 nt, Homo Sapiens; identical to SEQ ID NO: 243928

SEQ ID NO: 736101 - RNA, 64 nt, Homo Sapiens; identical to SEQ ID NO: 243929

SEQ ID NO: 736102 - RNA, 64 nt, Homo Sapiens; identical to SEQ ID NO: 243930

SEQ ID NO: 736103 - RNA, 64 nt, Homo Sapiens; identical to SEQ ID NO: 243931

SEQ ID NO: 736104 - RNA, 64 nt, Homo Sapiens; identical to SEQ ID NO: 243932

SEQ ID NO: 736105 - RNA, 64 nt, Homo Sapiens; identical to SEQ ID NO: 243933

SEQ ID NO: 736106 - RNA, 64 nt, Homo Sapiens; identical to SEQ ID NO: 243934

SEQ ID NO: 736107 - RNA, 64 nt, Homo Sapiens; identical to SEQ ID NO: 243935

SEQ ID NO: 736108 - RNA, 64 nt, Homo Sapiens; identical to SEQ ID NO: 243936

SEQ ID NO: 736109 - RNA, 64 nt, Homo Sapiens; identical to SEQ ID NO: 243937

SEQ ID NO: 736110 - RNA, 64 nt, Homo Sapiens; identical to SEQ ID NO: 243938

SEQ ID NO: 736111 - RNA, 64 nt, Homo Sapiens; identical to SEQ ID NO: 243939

SEQ ID NO: 736112 - RNA, 64 nt, Homo Sapiens; identical to SEQ ID NO: 243940

SEQ ID NO: 736113 - RNA, 64 nt, Homo Sapiens; identical to SEQ ID NO: 243941

SEQ ID NO: 736114 - RNA, 64 nt, Homo Sapiens; identical to SEQ ID NO: 243942

SEQ ID NO: 736115 - RNA, 64 nt, Homo Sapiens; identical to SEQ ID NO: 243943

SEQ ID NO: 736116 - RNA, 64 nt, Homo Sapiens; identical to SEQ ID NO: 243944

SEQ ID NO: 736117 - RNA, 64 nt, Homo Sapiens; identical to SEQ ID NO: 243945

SEQ ID NO: 736118 - RNA, 64 nt, Homo Sapiens; identical to SEQ ID NO: 243946

SEQ ID NO: 736119 - RNA, 64 nt, Homo Sapiens; identical to SEQ ID NO: 243947

SEQ ID NO: 736120 - RNA, 64 nt, Homo Sapiens; identical to SEQ ID NO: 243948

SEQ ID NO: 736121 - RNA, 64 nt, Homo Sapiens; identical to SEQ ID NO: 632047

SEQ ID NO: 736122 - RNA, 64 nt, Homo Sapiens; identical to SEQ ID NO: 632048

SEQ ID NO: 736123 - RNA, 64 nt, Homo Sapiens; identical to SEQ ID NO: 632049

SEQ ID NO: 736124 - RNA, 64 nt, Homo Sapiens; identical to SEQ ID NO: 632050

SEQ ID NO: 736125 - RNA, 64 nt, Homo Sapiens; identical to SEQ ID NO: 632051

SEQ ID NO: 736126 - RNA, 64 nt, Homo Sapiens; identical to SEQ ID NO: 632052

SEQ ID NO: 736127 - RNA, 64 nt, Homo Sapiens; identical to SEQ ID NO: 632053

SEQ ID NO: 736128 - RNA, 64 nt, Homo Sapiens; identical to SEQ ID NO: 632054

SEQ ID NO: 736129 - RNA, 64 nt, Homo Sapiens; identical to SEQ ID NO: 632055

SEQ ID NO: 736130 - RNA, 64 nt, Homo Sapiens; identical to SEQ ID NO: 632056

SEQ ID NO: 736131 - RNA, 64 nt, Homo Sapiens; identical to SEQ ID NO: 632057

SEQ ID NO: 736132 - RNA, 64 nt, Homo Sapiens; identical to SEQ ID NO: 632058

SEQ ID NO: 736133 - RNA, 64 nt, Homo Sapiens; identical to SEQ ID NO: 632059

SEQ ID NO: 736134 - RNA, 64 nt, Homo Sapiens; identical to SEQ ID NO: 632060

SEQ ID NO: 736135 - RNA, 64 nt, Homo Sapiens; identical to SEQ ID NO: 632061

SEQ ID NO: 736136 - RNA, 64 nt, Homo Sapiens; identical to SEQ ID NO: 632062

SEQ ID NO: 736137 - RNA, 64 nt, Homo Sapiens; identical to SEQ ID NO: 632063

SEQ ID NO: 736138 - RNA, 64 nt, Homo Sapiens; identical to SEQ ID NO: 632064

SEQ ID NO: 736139 - RNA, 64 nt, Homo Sapiens; identical to SEQ ID NO: 632065

SEQ ID NO: 736140 - RNA, 64 nt, Homo Sapiens; identical to SEQ ID NO: 632066

SEQ ID NO: 736141 - RNA, 64 nt, Homo Sapiens; identical to SEQ ID NO: 632067

SEQ ID NO: 736142 - RNA, 64 nt, Homo Sapiens; identical to SEQ ID NO: 632068

SEQ ID NO: 736143 - RNA, 64 nt, Homo Sapiens; identical to SEQ ID NO: 632069

SEQ ID NO: 736144 - RNA, 64 nt, Homo Sapiens; identical to SEQ ID NO: 632070

SEQ ID NO: 736145 - RNA, 64 nt, Homo Sapiens; identical to SEQ ID NO: 632071

SEQ ID NO: 736146 - RNA, 64 nt, Homo Sapiens; identical to SEQ ID NO: 632072

SEQ ID NO: 736147 - RNA, 64 nt, Homo Sapiens; identical to SEQ ID NO: 632073

SEQ ID NO: 736148 - RNA, 64 nt, Homo Sapiens; identical to SEQ ID NO: 632074

SEQ ID NO: 736149 - RNA, 64 nt, Homo Sapiens; identical to SEQ ID NO: 632075

SEQ ID NO: 736150 - RNA, 64 nt, Homo Sapiens; identical to SEQ ID NO: 87431

SEQ ID NO: 736151 - RNA, 64 nt, Homo Sapiens; identical to SEQ ID NO: 87432

SEQ ID NO: 736152 - RNA, 64 nt, Homo Sapiens; identical to SEQ ID NO: 87433

SEQ ID NO: 736153 - RNA, 64 nt, Homo Sapiens; identical to SEQ ID NO: 87434

SEQ ID NO: 736154 - RNA, 64 nt, Homo Sapiens; identical to SEQ ID NO: 87435

SEQ ID NO: 736155 - RNA, 64 nt, Homo Sapiens; identical to SEQ ID NO: 87436

SEQ ID NO: 736156 - RNA, 64 nt, Homo Sapiens; identical to SEQ ID NO: 87437

SEQ ID NO: 736157 - RNA, 64 nt, Homo Sapiens; identical to SEQ ID NO: 87438

SEQ ID NO: 736158 - RNA, 64 nt, Homo Sapiens; identical to SEQ ID NO: 87439

SEQ ID NO: 736159 - RNA, 64 nt, Homo Sapiens; identical to SEQ ID NO: 87440

SEQ ID NO: 736160 - RNA, 64 nt, Homo Sapiens; identical to SEQ ID NO: 87441

SEQ ID NO: 736161 - RNA, 64 nt, Homo Sapiens; identical to SEQ ID NO: 87442

SEQ ID NO: 736162 - RNA, 64 nt, Homo Sapiens; identical to SEQ ID NO: 87443

SEQ ID NO: 736163 - RNA, 64 nt, Homo Sapiens; identical to SEQ ID NO: 87444

SEQ ID NO: 736164 - RNA, 64 nt, Homo Sapiens; identical to SEQ ID NO: 87445

SEQ ID NO: 736165 - RNA, 64 nt, Homo Sapiens; identical to SEQ ID NO: 87446

SEQ ID NO: 736166 - RNA, 64 nt, Homo Sapiens; identical to SEQ ID NO: 87447

SEQ ID NO: 736167 - RNA, 64 nt, Homo Sapiens; identical to SEQ ID NO: 87448

SEQ ID NO: 736168 - RNA, 64 nt, Homo Sapiens; identical to SEQ ID NO: 87449

SEQ ID NO: 736169 - RNA, 64 nt, Homo Sapiens; identical to SEQ ID NO: 87450

SEQ ID NO: 736170 - RNA, 64 nt, Homo Sapiens; identical to SEQ ID NO: 87451

SEQ ID NO: 736171 - RNA, 64 nt, Homo Sapiens; identical to SEQ ID NO: 87452

SEQ ID NO: 736172 - RNA, 64 nt, Homo Sapiens; identical to SEQ ID NO: 87453

SEQ ID NO: 736173 - RNA, 64 nt, Homo Sapiens; identical to SEQ ID NO: 87454

SEQ ID NO: 736174 - RNA, 64 nt, Homo Sapiens; identical to SEQ ID NO: 87455

SEQ ID NO: 736175 - RNA, 64 nt, Homo Sapiens; identical to SEQ ID NO: 87456

SEQ ID NO: 736176 - RNA, 64 nt, Homo Sapiens; identical to SEQ ID NO: 87457

SEQ ID NO: 736177 - RNA, 64 nt, Homo Sapiens; identical to SEQ ID NO: 87458

SEQ ID NO: 736178 - RNA, 64 nt, Homo Sapiens; identical to SEQ ID NO: 87459

SEQ ID NO: 736179 - RNA, 64 nt, Homo Sapiens; identical to SEQ ID NO: 87460

SEQ ID NO: 736180 - RNA, 64 nt, Homo Sapiens; identical to SEQ ID NO: 87461

SEQ ID NO: 736181 - RNA, 64 nt, Homo Sapiens; identical to SEQ ID NO: 87462

SEQ ID NO: 736182 - RNA, 64 nt, Homo Sapiens; identical to SEQ ID NO: 87463

SEQ ID NO: 736183 - RNA, 64 nt, Homo Sapiens; identical to SEQ ID NO: 87464

SEQ ID NO: 736184 - RNA, 64 nt, Homo Sapiens; identical to SEQ ID NO: 87465

SEQ ID NO: 736185 - RNA, 64 nt, Homo Sapiens; identical to SEQ ID NO: 87466

SEQ ID NO: 736186 - RNA, 64 nt, Homo Sapiens; identical to SEQ ID NO: 87467

SEQ ID NO: 736187 - RNA, 64 nt, Homo Sapiens; identical to SEQ ID NO: 87468

SEQ ID NO: 736188 - RNA, 64 nt, Homo Sapiens; identical to SEQ ID NO: 87469

SEQ ID NO: 736189 - RNA, 64 nt, Homo Sapiens; identical to SEQ ID NO: 87470

SEQ ID NO: 736190 - RNA, 64 nt, Homo Sapiens; identical to SEQ ID NO: 87471

SEQ ID NO: 736191 - RNA, 64 nt, Homo Sapiens; identical to SEQ ID NO: 87472

SEQ ID NO: 736192 - RNA, 64 nt, Homo Sapiens; identical to SEQ ID NO: 87473

SEQ ID NO: 736193 - RNA, 64 nt, Homo Sapiens; identical to SEQ ID NO: 87474

SEQ ID NO: 736194 - RNA, 64 nt, Homo Sapiens; identical to SEQ ID NO: 87475

SEQ ID NO: 736195 - RNA, 64 nt, Homo Sapiens; identical to SEQ ID NO: 87476

SEQ ID NO: 736196 - RNA, 64 nt, Homo Sapiens; identical to SEQ ID NO: 87477

SEQ ID NO: 736197 - RNA, 64 nt, Homo Sapiens; identical to SEQ ID NO: 87478

SEQ ID NO: 736198 - RNA, 64 nt, Homo Sapiens; identical to SEQ ID NO: 87479

SEQ ID NO: 736199 - RNA, 64 nt, Homo Sapiens; identical to SEQ ID NO: 355748

SEQ ID NO: 736200 - RNA, 64 nt, Homo Sapiens; identical to SEQ ID NO: 355749

SEQ ID NO: 736201 - RNA, 64 nt, Homo Sapiens; identical to SEQ ID NO: 355750

SEQ ID NO: 736202 - RNA, 64 nt, Homo Sapiens; identical to SEQ ID NO: 355751

SEQ ID NO: 736203 - RNA, 64 nt, Homo Sapiens; identical to SEQ ID NO: 355752

SEQ ID NO: 736204 - RNA, 64 nt, Homo Sapiens; identical to SEQ ID NO: 355753

SEQ ID NO: 736205 - RNA, 64 nt, Homo Sapiens; identical to SEQ ID NO: 355754

SEQ ID NO: 736206 - RNA, 64 nt, Homo Sapiens; identical to SEQ ID NO: 355755

SEQ ID NO: 736207 - RNA, 64 nt, Homo Sapiens; identical to SEQ ID NO: 355756

SEQ ID NO: 736208 - RNA, 64 nt, Homo Sapiens; identical to SEQ ID NO: 355757

SEQ ID NO: 736209 - RNA, 64 nt, Homo Sapiens; identical to SEQ ID NO: 355758

SEQ ID NO: 736210 - RNA, 64 nt, Homo Sapiens; identical to SEQ ID NO: 355759

SEQ ID NO: 736211 - RNA, 64 nt, Homo Sapiens; identical to SEQ ID NO: 355760

SEQ ID NO: 736212 - RNA, 64 nt, Homo Sapiens; identical to SEQ ID NO: 355761

SEQ ID NO: 736213 - RNA, 64 nt, Homo Sapiens; identical to SEQ ID NO: 355762

SEQ ID NO: 736214 - RNA, 64 nt, Homo Sapiens; identical to SEQ ID NO: 355763

SEQ ID NO: 736215 - RNA, 64 nt, Homo Sapiens; identical to SEQ ID NO: 355764

SEQ ID NO: 736216 - RNA, 64 nt, Homo Sapiens; identical to SEQ ID NO: 355765

SEQ ID NO: 736217 - RNA, 64 nt, Homo Sapiens; identical to SEQ ID NO: 355766

SEQ ID NO: 736218 - RNA, 64 nt, Homo Sapiens; identical to SEQ ID NO: 355767

SEQ ID NO: 736219 - RNA, 64 nt, Homo Sapiens; identical to SEQ ID NO: 355768

SEQ ID NO: 736220 - RNA, 64 nt, Homo Sapiens; identical to SEQ ID NO: 355769

SEQ ID NO: 736221 - RNA, 64 nt, Homo Sapiens; identical to SEQ ID NO: 355770

SEQ ID NO: 736222 - RNA, 64 nt, Homo Sapiens; identical to SEQ ID NO: 355771

SEQ ID NO: 736223 - RNA, 64 nt, Homo Sapiens; identical to SEQ ID NO: 355772

SEQ ID NO: 736224 - RNA, 64 nt, Homo Sapiens; identical to SEQ ID NO: 355773

SEQ ID NO: 736225 - RNA, 64 nt, Homo Sapiens; identical to SEQ ID NO: 355774

SEQ ID NO: 736226 - RNA, 64 nt, Homo Sapiens; identical to SEQ ID NO: 355775

SEQ ID NO: 736227 - RNA, 64 nt, Homo Sapiens; identical to SEQ ID NO: 355776

SEQ ID NO: 736228 - RNA, 64 nt, Homo Sapiens; identical to SEQ ID NO: 355777

SEQ ID NO: 736229 - RNA, 64 nt, Homo Sapiens; identical to SEQ ID NO: 355778

SEQ ID NO: 736230 - RNA, 64 nt, Homo Sapiens; identical to SEQ ID NO: 355779

SEQ ID NO: 736231 - RNA, 64 nt, Homo Sapiens; identical to SEQ ID NO: 355780

SEQ ID NO: 736232 - RNA, 62 nt, Homo Sapiens; identical to SEQ ID NO: 355781

SEQ ID NO: 736233 - RNA, 64 nt, Homo Sapiens; identical to SEQ ID NO: 355782

SEQ ID NO: 736234 - RNA, 64 nt, Homo Sapiens; identical to SEQ ID NO: 355783

SEQ ID NO: 736235 - RNA, 64 nt, Homo Sapiens; identical to SEQ ID NO: 355784

SEQ ID NO: 736236 - RNA, 64 nt, Homo Sapiens; identical to SEQ ID NO: 326924

SEQ ID NO: 736237 - RNA, 64 nt, Homo Sapiens; identical to SEQ ID NO: 326925

SEQ ID NO: 736238 - RNA, 64 nt, Homo Sapiens; identical to SEQ ID NO: 326926

SEQ ID NO: 736239 - RNA, 64 nt, Homo Sapiens; identical to SEQ ID NO: 326927

SEQ ID NO: 736240 - RNA, 64 nt, Homo Sapiens; identical to SEQ ID NO: 326928

SEQ ID NO: 736241 - RNA, 64 nt, Homo Sapiens; identical to SEQ ID NO: 326929

SEQ ID NO: 736242 - RNA, 64 nt, Homo Sapiens; identical to SEQ ID NO: 326930

SEQ ID NO: 736243 - RNA, 64 nt, Homo Sapiens; identical to SEQ ID NO: 326931

SEQ ID NO: 736244 - RNA, 64 nt, Homo Sapiens; identical to SEQ ID NO: 326932

SEQ ID NO: 736245 - RNA, 64 nt, Homo Sapiens; identical to SEQ ID NO: 326933

SEQ ID NO: 736246 - RNA, 64 nt, Homo Sapiens; identical to SEQ ID NO: 326934

SEQ ID NO: 736247 - RNA, 64 nt, Homo Sapiens; identical to SEQ ID NO: 326935

SEQ ID NO: 736248 - RNA, 64 nt, Homo Sapiens; identical to SEQ ID NO: 326936

SEQ ID NO: 736249 - RNA, 64 nt, Homo Sapiens; identical to SEQ ID NO: 326937

SEQ ID NO: 736250 - RNA, 64 nt, Homo Sapiens; identical to SEQ ID NO: 326938

SEQ ID NO: 736251 - RNA, 64 nt, Homo Sapiens; identical to SEQ ID NO: 326939

SEQ ID NO: 736252 - RNA, 64 nt, Homo Sapiens; identical to SEQ ID NO: 326940

SEQ ID NO: 736253 - RNA, 56 nt, Homo Sapiens; identical to SEQ ID NO: 326941

SEQ ID NO: 736254 - RNA, 64 nt, Homo Sapiens; identical to SEQ ID NO: 326942

SEQ ID NO: 736255 - RNA, 64 nt, Homo Sapiens; identical to SEQ ID NO: 326943

SEQ ID NO: 736256 - RNA, 64 nt, Homo Sapiens; identical to SEQ ID NO: 326944

SEQ ID NO: 736257 - RNA, 64 nt, Homo Sapiens; identical to SEQ ID NO: 326945

SEQ ID NO: 736258 - RNA, 64 nt, Homo Sapiens; identical to SEQ ID NO: 326946

SEQ ID NO: 736259 - RNA, 64 nt, Homo Sapiens; identical to SEQ ID NO: 326947

SEQ ID NO: 736260 - RNA, 64 nt, Homo Sapiens; identical to SEQ ID NO: 326948

SEQ ID NO: 736261 - RNA, 64 nt, Homo Sapiens; identical to SEQ ID NO: 326949

SEQ ID NO: 736262 - RNA, 64 nt, Homo Sapiens; identical to SEQ ID NO: 326950

SEQ ID NO: 736263 - RNA, 64 nt, Homo Sapiens; identical to SEQ ID NO: 326951

SEQ ID NO: 736264 - RNA, 64 nt, Homo Sapiens; identical to SEQ ID NO: 326952

SEQ ID NO: 736265 - RNA, 64 nt, Homo Sapiens; identical to SEQ ID NO: 326953

SEQ ID NO: 736266 - RNA, 64 nt, Homo Sapiens; identical to SEQ ID NO: 326954

SEQ ID NO: 736267 - RNA, 64 nt, Homo Sapiens; identical to SEQ ID NO: 326955

SEQ ID NO: 736268 - RNA, 64 nt, Homo Sapiens; identical to SEQ ID NO: 144401

SEQ ID NO: 736269 - RNA, 64 nt, Homo Sapiens; identical to SEQ ID NO: 144402

SEQ ID NO: 736270 - RNA, 64 nt, Homo Sapiens; identical to SEQ ID NO: 144403

SEQ ID NO: 736271 - RNA, 64 nt, Homo Sapiens; identical to SEQ ID NO: 144404

SEQ ID NO: 736272 - RNA, 64 nt, Homo Sapiens; identical to SEQ ID NO: 144405

SEQ ID NO: 736273 - RNA, 64 nt, Homo Sapiens; identical to SEQ ID NO: 144406

SEQ ID NO: 736274 - RNA, 64 nt, Homo Sapiens; identical to SEQ ID NO: 144407

SEQ ID NO: 736275 - RNA, 64 nt, Homo Sapiens; identical to SEQ ID NO: 144408

SEQ ID NO: 736276 - RNA, 64 nt, Homo Sapiens; identical to SEQ ID NO: 144409

SEQ ID NO: 736277 - RNA, 64 nt, Homo Sapiens; identical to SEQ ID NO: 144410

SEQ ID NO: 736278 - RNA, 64 nt, Homo Sapiens; identical to SEQ ID NO: 144411

SEQ ID NO: 736279 - RNA, 64 nt, Homo Sapiens; identical to SEQ ID NO: 144412

SEQ ID NO: 736280 - RNA, 64 nt, Homo Sapiens; identical to SEQ ID NO: 144413

SEQ ID NO: 736281 - RNA, 64 nt, Homo Sapiens; identical to SEQ ID NO: 144414

SEQ ID NO: 736282 - RNA, 64 nt, Homo Sapiens; identical to SEQ ID NO: 144415

SEQ ID NO: 736283 - RNA, 64 nt, Homo Sapiens; identical to SEQ ID NO: 545865

SEQ ID NO: 736284 - RNA, 64 nt, Homo Sapiens; identical to SEQ ID NO: 545866

SEQ ID NO: 736285 - RNA, 64 nt, Homo Sapiens; identical to SEQ ID NO: 545867

SEQ ID NO: 736286 - RNA, 64 nt, Homo Sapiens; identical to SEQ ID NO: 545868

SEQ ID NO: 736287 - RNA, 64 nt, Homo Sapiens; identical to SEQ ID NO: 545869

SEQ ID NO: 736288 - RNA, 64 nt, Homo Sapiens; identical to SEQ ID NO: 545870

SEQ ID NO: 736289 - RNA, 64 nt, Homo Sapiens; identical to SEQ ID NO: 545871

SEQ ID NO: 736290 - RNA, 64 nt, Homo Sapiens; identical to SEQ ID NO: 545872

SEQ ID NO: 736291 - RNA, 64 nt, Homo Sapiens; identical to SEQ ID NO: 545873

SEQ ID NO: 736292 - RNA, 64 nt, Homo Sapiens; identical to SEQ ID NO: 545874

SEQ ID NO: 736293 - RNA, 64 nt, Homo Sapiens; identical to SEQ ID NO: 545875

SEQ ID NO: 736294 - RNA, 64 nt, Homo Sapiens; identical to SEQ ID NO: 545876

SEQ ID NO: 736295 - RNA, 64 nt, Homo Sapiens; identical to SEQ ID NO: 545877

SEQ ID NO: 736296 - RNA, 64 nt, Homo Sapiens; identical to SEQ ID NO: 545878

SEQ ID NO: 736297 - RNA, 64 nt, Homo Sapiens; identical to SEQ ID NO: 545879

SEQ ID NO: 736298 - RNA, 64 nt, Homo Sapiens
cccucucagagccucaagagggguagcucggcugccggaagagaggggugcccuaucccuggca

SEQ ID NO: 736299 - RNA, 64 nt, Homo Sapiens
agagagggcuggacauccugcguggaggacgggaccggaagacgccggcaacagucugaaagua

SEQ ID NO: 736300 - RNA, 64 nt, Homo Sapiens
uaaacacaggggguucuuaaccaucccaaaguagccggaagagcggggucucugacacaacaca

SEQ ID NO: 736301 - RNA, 64 nt, Homo Sapiens
ccaccuuucccuucagcauuuguacugugugccuccggaagacacccguguguaaccuguaaga

SEQ ID NO: 736302 - RNA, 64 nt, Homo Sapiens
ucaacgacuucaucuguggcagggagagaggaggccggaagaacaaccccugaacaauggaggc

SEQ ID NO: 736303 - RNA, 64 nt, Homo Sapiens
gaccuguuaaaagccacgcaugaucgccuugugaccggaagaguggggagagacccagcggcac

SEQ ID NO: 736304 - RNA, 64 nt, Homo Sapiens
accuaucuuccuucaugaagcaggugcucaggacccggaagaaucaucuaccucccagcuuugu

SEQ ID NO: 736305 - RNA, 64 nt, Homo Sapiens
agccucagaggguccuucugacagcacauccuacccggaagacccucggaaacagaacccuccc

SEQ ID NO: 736306 - RNA, 64 nt, Homo Sapiens
agcuaauaaauaggcuggaacauguauugggccaccggaagacaucaguguagagggaaaaaag

SEQ ID NO: 736307 - RNA, 64 nt, Homo Sapiens
ccagggcagcugggugugcagggacugggggcucccggaagauuuuuuggaggaaguaacagcu

SEQ ID NO: 736308 - RNA, 64 nt, Homo Sapiens
ugauagaugcauagacaaaacagguagucacaguccggaagagaaaaaauagccccuuuccuug

SEQ ID NO: 736309 - RNA, 64 nt, Homo Sapiens
aggaagaagcagaacagacugacccccucucaucccggaagaagucgcacagaccccuggcucu

SEQ ID NO: 736310 - RNA, 64 nt, Homo Sapiens
agcugcccuccgaccccucagggaggggucacugccggaagagcgcgcgggggcugccagaagc

SEQ ID NO: 736311 - RNA, 64 nt, Homo Sapiens
cccucgggaaguuccgcguccucugugggggcugccggaagacacggccccaggagucaggccc

SEQ ID NO: 736312 - RNA, 64 nt, Homo Sapiens
uggccccacuucuggucucugucccucugccuccccggaagaagaugaggaaucugaggauuau

SEQ ID NO: 736313 - RNA, 59 nt, Homo Sapiens
gugacccaguacgacccugaagaggacugccggaagauggccaaggaauauggagacua

SEQ ID NO: 736314 - RNA, 64 nt, Homo Sapiens
agaugcaauugcucccaucacgcaauugacaaacccggaagaucgaagaucguuccaccuucua

SEQ ID NO: 736315 - RNA, 64 nt, Homo Sapiens
gagaaacauugcaguggcuaaugggaggaaagcuccggaagaagccaggaguacaugugagacu

SEQ ID NO: 736316 - RNA, 64 nt, Homo Sapiens
gacucuccuguggccucacaauggacugauaacuccggaagaauucuucuccagugauggaugg

SEQ ID NO: 736317 - RNA, 64 nt, Homo Sapiens
aagccuuauagaagcaguaagaggcuugaccacgccggaagaguccuggagcuaaagcuggaag

SEQ ID NO: 736318 - RNA, 64 nt, Homo Sapiens
ugcuggggccaugccgagucgcggcccugcucagccggaagaggcucccggaccuggauguaca

SEQ ID NO: 736319 - RNA, 64 nt, Homo Sapiens
ugcagcuucucaacaccaguuuggacacaccauuccggaagaacgugucaguaacaucaggaca

SEQ ID NO: 736320 - RNA, 64 nt, Homo Sapiens
cuggagccacuaacauuagucaacugaccagcugccggaagauuauggcugccagacacugcug

SEQ ID NO: 736321 - RNA, 64 nt, Homo Sapiens
gucuucuuucccgggcgucgccuccuguguggugccggaagagcgccagguucaguguuacccu

SEQ ID NO: 736322 - RNA, 64 nt, Homo Sapiens
ggguuguuuugguuucggacgacccuugcucugaccggaagagaagucccuaucccacaccugc

SEQ ID NO: 736323 - RNA, 64 nt, Homo Sapiens
agcgcggcagcccuggcggagggaugcaggugggccggaagaucccacgauuccgaucgacugc

SEQ ID NO: 736324 - RNA, 64 nt, Homo Sapiens
cgggucuuggacuggggcagaauccccaguggaaccggaagagcuggacugaugagaaacauca

SEQ ID NO: 736325 - RNA, 64 nt, Homo Sapiens
cugcgcagcugaagcagaguggcucccagaguccccggaagagcacuccuccaucuaaccagca

SEQ ID NO: 736326 - RNA, 64 nt, Homo Sapiens
cuucggggaccagcccacagcacaccaagguggcccggaagaaccagaagugcagccccucuca

SEQ ID NO: 736327 - RNA, 64 nt, Homo Sapiens
guaugaagauugaaugugauuugccuccaaauuaccggaagaguaacugcagcagaguugaaaa

SEQ ID NO: 736328 - RNA, 51 nt, Homo Sapiens
uggcgaagcucaggcaaaaagccggaagauccgaaaucaaguggggcauga

SEQ ID NO: 736329 - RNA, 64 nt, Homo Sapiens
cggauccgcuccgacuccagaccuguaggaacucccggaagagcaagccugccucaccuccagc

SEQ ID NO: 736330 - RNA, 64 nt, Homo Sapiens
acauuuucagauuguuaaauugcaagacuuaaagccggaagaaccuuugacuuacgacccauuu

SEQ ID NO: 736331 - RNA, 64 nt, Homo Sapiens
acgucuccacggagcccucgaagagaacgggacuccggaagaagugcugcugcugcuaucuucc

SEQ ID NO: 736332 - RNA, 64 nt, Homo Sapiens
guuggggccccgcggguagaugccggcaggccuuccggaagaaaaagagccauugguuuuugua

SEQ ID NO: 736333 - RNA, 64 nt, Homo Sapiens
augauguguguaagggaagauuuuauuugcccuuccggaagaaaucaguaucuaugcaaaucuu

SEQ ID NO: 736334 - RNA, 64 nt, Homo Sapiens
uugcuaauguauuuuacuucuauaaagaugguguccggaagaugggaucuagaaguuuuacuuu

SEQ ID NO: 736335 - RNA, 64 nt, Homo Sapiens
uguuuugagugucuuucuuugcagguuucuguagccggaagaucuccguuccgcucccagcggc

SEQ ID NO: 736336 - RNA, 64 nt, Homo Sapiens
ccgauaguuucacacuauuccuauaccuccagguccggaagacagguaaaaaauucuauaaugu

SEQ ID NO: 736337 - RNA, 64 nt, Homo Sapiens
ugucggggaaccuuuagugacuucguuggaucugccggaagacuugugauuuuccugagucucc

SEQ ID NO: 736338 - RNA, 64 nt, Homo Sapiens
agggcugccugagcugguggcacccuccccugggccggaagacugggaauuccugcuaagugug

SEQ ID NO: 736339 - RNA, 64 nt, Homo Sapiens
gcaagagaaagagaaagcgggcgguggaggggucccggaagagcugguccccgugguugagcug

SEQ ID NO: 736340 - RNA, 57 nt, Homo Sapiens
cagugcccaaaauccacuaguccuaaaccggaagaggaugacaccggccauggguua

SEQ ID NO: 736341 - RNA, 64 nt, Homo Sapiens
acugcccgugacuuuuucugaauggacuucauaaccggaagacuuaaccgguggccucaucacc

SEQ ID NO: 736342 - RNA, 64 nt, Homo Sapiens
ggugcacacaaaugaguggguugcugugcugucuccggaagauucugucguugcccuuggccug

SEQ ID NO: 736343 - RNA, 64 nt, Homo Sapiens
ccucuucauucauugcuaguaaacagccugauucccggaagaauaucuuggauguuuuagauug

SEQ ID NO: 736344 - RNA, 64 nt, Homo Sapiens
cauccuuugacccucucagccacuccccgcugccccggaagagaagugaagguggcuuccggca

SEQ ID NO: 736345 - RNA, 64 nt, Homo Sapiens
gaaugccauugauuguuccaugcacugugcauacccggaagaaagaccuauaugaugcgguuug

SEQ ID NO: 736346 - RNA, 64 nt, Homo Sapiens
accacagcaagaagaggaggcaugcuggccugcaccggaagacucacuuugucugcccugcgcc

SEQ ID NO: 736347 - RNA, 64 nt, Homo Sapiens
acccccgcccagcgcacggcgaccucgcgccucaccggaagaccuugccucugugccgcggagg

SEQ ID NO: 736348 - RNA, 64 nt, Homo Sapiens
uggcaaaaggagccucacaccccuccacaccguuccggaagagcagaagucagcauuuuugaag

SEQ ID NO: 736349 - RNA, 55 nt, Homo Sapiens
acagggacacagccagagcccacugccggaagagcccgaggccacuacccccuga

SEQ ID NO: 736350 - RNA, 64 nt, Homo Sapiens
agggugucugcccccaaccucauguucaaggguaccggaagagaagcuagccacacccugacac

SEQ ID NO: 736351 - RNA, 64 nt, Homo Sapiens
augucauuaauguguugggaaaaaggccucugucccggaagagucaugggaggugaaaggggca

SEQ ID NO: 736352 - RNA, 64 nt, Homo Sapiens
uguacagcuggucuuuacucgcccagggcccccaccggaagauguucggaggggcggaugcaga

SEQ ID NO: 736353 - RNA, 64 nt, Homo Sapiens
uggauugucuggaagaugugaagacauggauuguccggaagacagaagacuuggagcuucuugg

SEQ ID NO: 736354 - RNA, 64 nt, Homo Sapiens
uuugcucggacacacuggaagucagugagcagauccggaagaacacagggacaucuuaggcucu

SEQ ID NO: 736355 - RNA, 61 nt, Homo Sapiens
ugcuggaggaacuugcugcugugccugcgucgcggcggauccgcggggacccugccgaggg

SEQ ID NO: 736356 - RNA, 61 nt, Homo Sapiens
uugaccaggcugccuucuugagugaggugcugcggcggaccugccacguuccaggugaguu

SEQ ID NO: 736357 - RNA, 61 nt, Homo Sapiens
ggcauugcacuuccgggaagaccuccccugggcggcggaggagaaacucaagagccuccgu

SEQ ID NO: 736358 - RNA, 61 nt, Homo Sapiens
gaauuuuuugagaaauaaaauaugggauggggcggcggaggacuuucuuaaaggccuaguc

SEQ ID NO: 736359 - RNA, 61 nt, Homo Sapiens
aaggguuagggguucauucuagcagcagagggcggcggaggaccucgaccagugacaggcc

SEQ ID NO: 736360 - RNA, 61 nt, Homo Sapiens
cugccgccgccucccgggucucaggccuccagcggcggaggcgcaggcgaccgggccuccc

SEQ ID NO: 736361 - RNA, 61 nt, Homo Sapiens
aggcugaagcaggauaaucgcuugaacccgggcggcggagauugcagugagccgaggucau

SEQ ID NO: 736362 - RNA, 61 nt, Homo Sapiens
cauugccguccugcagagauccaggcugcacgcggcggacugggcaggccgggcccgggca

SEQ ID NO: 736363 - RNA, 61 nt, Homo Sapiens
gggcccagcgcggccagugcuccuccugcacgcggcggacucggaggcgcagcggcgccug

SEQ ID NO: 736364 - RNA, 52 nt, Homo Sapiens
ccuuccggugguuucagugacggcggcggaacccaaagcugcccucuccgug

SEQ ID NO: 736365 - RNA, 61 nt, Homo Sapiens
ucucuuggucuguuucuccggccgcacccucgcggcggaugccugagccgcuuguuagguc

SEQ ID NO: 736366 - RNA, 61 nt, Homo Sapiens
caagccccccaucgaucccaugagaaugagagcggcggagagccuucucugaaaacaaugc

SEQ ID NO: 736367 - RNA, 61 nt, Homo Sapiens
aggcugaggcaggagaaucgccugaacccgggcggcggagguuguagugagccaagaucca

SEQ ID NO: 736368 - RNA, 61 nt, Homo Sapiens
cacccccuggccugugccaggcucacgggcggcggcggaccccgaccuccaguugccuaca

SEQ ID NO: 736369 - RNA, 61 nt, Homo Sapiens
gccuguaagccugcaagccugccaacggggagcggcggaaacaccuaauucgaugaaggcu

SEQ ID NO: 736370 - RNA, 61 nt, Homo Sapiens
cccccagcuucuaaggugggaaacuugcuaagcggcggauaagccacagcccaaacacauc

SEQ ID NO: 736371 - RNA, 61 nt, Homo Sapiens
cccugagccuugagcuccgcgcacagugugggcggcggaguggcauccaaaauaaggcggg

SEQ ID NO: 736372 - RNA, 61 nt, Homo Sapiens
gccugcgggaugagaccuuggcaggcgggcagcggcggaaacucagcucaagguucccggu

SEQ ID NO: 736373 - RNA, 61 nt, Homo Sapiens
agccaggaggugggguguggacccggcccuggcggcggagucagggucccaagaucccacc

SEQ ID NO: 736374 - RNA, 61 nt, Homo Sapiens
ccaggcagugggaagccaauggagggauuaagcggcggaagcuucuuagaagaggcagggg

SEQ ID NO: 736375 - RNA, 61 nt, Homo Sapiens
gcagagcagggcaggggagggugucugcagggcggcggaggguucccauaguccugggaga

SEQ ID NO: 736376 - RNA, 54 nt, Homo Sapiens
ucaggagcuaccggagcugagcccgcggcggacugccccaggacugcgggaagg

SEQ ID NO: 736377 - RNA, 61 nt, Homo Sapiens
gcccaguccccgauggcugcgcacacaggaggcggcggagcacaaggcaagugaguuugca

SEQ ID NO: 736378 - RNA, 61 nt, Homo Sapiens
gacuugagguaggagaaucacuugaaccucagcggcggagguugcagugagucgagaucgc

SEQ ID NO: 736379 - RNA, 61 nt, Homo Sapiens
cgauggucagccuucagcugcccucuuugaugcggcggagagaaacuccguuccuacaaaa

SEQ ID NO: 736380 - RNA, 61 nt, Homo Sapiens
ccacgcagccgggccuucuuacacaagcugggcggcggagggcggcggccgcgguccugcc

SEQ ID NO: 736381 - RNA, 61 nt, Homo Sapiens
caggagaugcuacacaaaaugaugaggagcugcggcggaugagaagcuuauccgagagaaa

SEQ ID NO: 736382 - RNA, 61 nt, Homo Sapiens
accuguaaccccagcacuuugggaggcuaaggcggcggaucacuugaggucaggaguucaa

SEQ ID NO: 736383 - RNA, 61 nt, Homo Sapiens
uauuuaacagggaggggaagagggggcgaucgcggcggagcuggccccgccgccugguacu

SEQ ID NO: 736384 - RNA, 56 nt, Homo Sapiens
cggggcugucccaguauuaaaagguggcggcggaagagcuaagcaacguggcuuag

SEQ ID NO: 736385 - RNA, 61 nt, Homo Sapiens
ucaggcccugucugggccagcgggacugcaggcggcggauguggaacggugacggccaccc

SEQ ID NO: 736386 - RNA, 61 nt, Homo Sapiens
cugguggccaccaaucuguuaaggauuuccagcggcggaucugucacgcuaucagcaguuc

SEQ ID NO: 736387 - RNA, 61 nt, Homo Sapiens
uccccaggggucacccugcaaggucuggcucgcggcggacggccgggacccccaggagacc

SEQ ID NO: 736388 - RNA, 61 nt, Homo Sapiens
guuggccagagggauggagauggaaaaaaaggcggcggacaugucuuaaggcaggacgacu

SEQ ID NO: 736389 - RNA, 61 nt, Homo Sapiens
ccaacgcagggcaccaccacacuggcccccugcggcggaggggcccaaggcuccggaccac

SEQ ID NO: 736390 - RNA, 60 nt, Homo Sapiens
ugggaccuaccugccugaguguccgggggcgcggcggagccggaccacgcugaccuguag

SEQ ID NO: 736391 - RNA, 61 nt, Homo Sapiens
cucaggguggggagcaggcccggaggcaucggcggcggaggcccaggccguggugaggagg

SEQ ID NO: 736392 - RNA, 61 nt, Homo Sapiens
cccaucaucccagcuacuugacccaggcacggcggcggacggacuaaaaaugcagaaauuu

SEQ ID NO: 736393 - RNA, 64 nt, Homo Sapiens; identical to SEQ ID NO: 155629

SEQ ID NO: 736394 - RNA, 64 nt, Homo Sapiens; identical to SEQ ID NO: 155630

SEQ ID NO: 736395 - RNA, 64 nt, Homo Sapiens; identical to SEQ ID NO: 155631

SEQ ID NO: 736396 - RNA, 64 nt, Homo Sapiens; identical to SEQ ID NO: 155632

SEQ ID NO: 736397 - RNA, 64 nt, Homo Sapiens; identical to SEQ ID NO: 155633

SEQ ID NO: 736398 - RNA, 64 nt, Homo Sapiens; identical to SEQ ID NO: 155634

SEQ ID NO: 736399 - RNA, 64 nt, Homo Sapiens; identical to SEQ ID NO: 155635

SEQ ID NO: 736400 - RNA, 64 nt, Homo Sapiens; identical to SEQ ID NO: 155636

SEQ ID NO: 736401 - RNA, 64 nt, Homo Sapiens; identical to SEQ ID NO: 155637

SEQ ID NO: 736402 - RNA, 64 nt, Homo Sapiens; identical to SEQ ID NO: 155638

SEQ ID NO: 736403 - RNA, 64 nt, Homo Sapiens; identical to SEQ ID NO: 155639

SEQ ID NO: 736404 - RNA, 64 nt, Homo Sapiens; identical to SEQ ID NO: 155640

SEQ ID NO: 736405 - RNA, 64 nt, Homo Sapiens; identical to SEQ ID NO: 155641

SEQ ID NO: 736406 - RNA, 64 nt, Homo Sapiens; identical to SEQ ID NO: 155642

SEQ ID NO: 736407 - RNA, 64 nt, Homo Sapiens; identical to SEQ ID NO: 155643

SEQ ID NO: 736408 - RNA, 64 nt, Homo Sapiens; identical to SEQ ID NO: 155644

SEQ ID NO: 736409 - RNA, 64 nt, Homo Sapiens; identical to SEQ ID NO: 155645

SEQ ID NO: 736410 - RNA, 64 nt, Homo Sapiens; identical to SEQ ID NO: 155646

SEQ ID NO: 736411 - RNA, 64 nt, Homo Sapiens; identical to SEQ ID NO: 155647

SEQ ID NO: 736412 - RNA, 64 nt, Homo Sapiens; identical to SEQ ID NO: 155648

SEQ ID NO: 736413 - RNA, 64 nt, Homo Sapiens; identical to SEQ ID NO: 155649

SEQ ID NO: 736414 - RNA, 64 nt, Homo Sapiens; identical to SEQ ID NO: 155650

SEQ ID NO: 736415 - RNA, 64 nt, Homo Sapiens; identical to SEQ ID NO: 155651

SEQ ID NO: 736416 - RNA, 64 nt, Homo Sapiens; identical to SEQ ID NO: 155652

SEQ ID NO: 736417 - RNA, 64 nt, Homo Sapiens; identical to SEQ ID NO: 155653

SEQ ID NO: 736418 - RNA, 64 nt, Homo Sapiens; identical to SEQ ID NO: 155654

SEQ ID NO: 736419 - RNA, 64 nt, Homo Sapiens; identical to SEQ ID NO: 155655

SEQ ID NO: 736420 - RNA, 64 nt, Homo Sapiens; identical to SEQ ID NO: 155656

SEQ ID NO: 736421 - RNA, 64 nt, Homo Sapiens; identical to SEQ ID NO: 155657

SEQ ID NO: 736422 - RNA, 64 nt, Homo Sapiens; identical to SEQ ID NO: 155658

SEQ ID NO: 736423 - RNA, 64 nt, Homo Sapiens; identical to SEQ ID NO: 155659

SEQ ID NO: 736424 - RNA, 64 nt, Homo Sapiens; identical to SEQ ID NO: 155660

SEQ ID NO: 736425 - RNA, 64 nt, Homo Sapiens; identical to SEQ ID NO: 155661

SEQ ID NO: 736426 - RNA, 64 nt, Homo Sapiens; identical to SEQ ID NO: 155662

SEQ ID NO: 736427 - RNA, 64 nt, Homo Sapiens; identical to SEQ ID NO: 155663

SEQ ID NO: 736428 - RNA, 64 nt, Homo Sapiens; identical to SEQ ID NO: 155664

SEQ ID NO: 736429 - RNA, 64 nt, Homo Sapiens; identical to SEQ ID NO: 155665

SEQ ID NO: 736430 - RNA, 64 nt, Homo Sapiens; identical to SEQ ID NO: 155666

SEQ ID NO: 736431 - RNA, 64 nt, Homo Sapiens; identical to SEQ ID NO: 155667

SEQ ID NO: 736432 - RNA, 64 nt, Homo Sapiens; identical to SEQ ID NO: 155668

SEQ ID NO: 736433 - RNA, 64 nt, Homo Sapiens; identical to SEQ ID NO: 155669

SEQ ID NO: 736434 - RNA, 64 nt, Homo Sapiens; identical to SEQ ID NO: 155670

SEQ ID NO: 736435 - RNA, 64 nt, Homo Sapiens; identical to SEQ ID NO: 155671

SEQ ID NO: 736436 - RNA, 64 nt, Homo Sapiens; identical to SEQ ID NO: 155672

SEQ ID NO: 736437 - RNA, 64 nt, Homo Sapiens; identical to SEQ ID NO: 155673

SEQ ID NO: 736438 - RNA, 64 nt, Homo Sapiens; identical to SEQ ID NO: 155674

SEQ ID NO: 736439 - RNA, 64 nt, Homo Sapiens; identical to SEQ ID NO: 155675

SEQ ID NO: 736440 - RNA, 64 nt, Homo Sapiens; identical to SEQ ID NO: 155676

SEQ ID NO: 736441 - RNA, 64 nt, Homo Sapiens; identical to SEQ ID NO: 155677

SEQ ID NO: 736442 - RNA, 64 nt, Homo Sapiens; identical to SEQ ID NO: 155678

SEQ ID NO: 736443 - RNA, 64 nt, Homo Sapiens; identical to SEQ ID NO: 155679

SEQ ID NO: 736444 - RNA, 64 nt, Homo Sapiens; identical to SEQ ID NO: 155680

SEQ ID NO: 736445 - RNA, 64 nt, Homo Sapiens; identical to SEQ ID NO: 155681

SEQ ID NO: 736446 - RNA, 64 nt, Homo Sapiens; identical to SEQ ID NO: 155682

SEQ ID NO: 736447 - RNA, 64 nt, Homo Sapiens; identical to SEQ ID NO: 155683

SEQ ID NO: 736448 - RNA, 64 nt, Homo Sapiens; identical to SEQ ID NO: 155684

SEQ ID NO: 736449 - RNA, 64 nt, Homo Sapiens; identical to SEQ ID NO: 155685

SEQ ID NO: 736450 - RNA, 64 nt, Homo Sapiens; identical to SEQ ID NO: 155686

SEQ ID NO: 736451 - RNA, 64 nt, Homo Sapiens; identical to SEQ ID NO: 155687

SEQ ID NO: 736452 - RNA, 64 nt, Homo Sapiens; identical to SEQ ID NO: 155688

SEQ ID NO: 736453 - RNA, 64 nt, Homo Sapiens; identical to SEQ ID NO: 155689

SEQ ID NO: 736454 - RNA, 64 nt, Homo Sapiens; identical to SEQ ID NO: 155690

SEQ ID NO: 736455 - RNA, 64 nt, Homo Sapiens; identical to SEQ ID NO: 155691

SEQ ID NO: 736456 - RNA, 64 nt, Homo Sapiens; identical to SEQ ID NO: 155692

SEQ ID NO: 736457 - RNA, 64 nt, Homo Sapiens; identical to SEQ ID NO: 155693

SEQ ID NO: 736458 - RNA, 64 nt, Homo Sapiens; identical to SEQ ID NO: 155694

SEQ ID NO: 736459 - RNA, 64 nt, Homo Sapiens; identical to SEQ ID NO: 155695

SEQ ID NO: 736460 - RNA, 64 nt, Homo Sapiens; identical to SEQ ID NO: 155696

SEQ ID NO: 736461 - RNA, 64 nt, Homo Sapiens; identical to SEQ ID NO: 155697

SEQ ID NO: 736462 - RNA, 64 nt, Homo Sapiens; identical to SEQ ID NO: 155698

SEQ ID NO: 736463 - RNA, 64 nt, Homo Sapiens; identical to SEQ ID NO: 155699

SEQ ID NO: 736464 - RNA, 64 nt, Homo Sapiens; identical to SEQ ID NO: 155700

SEQ ID NO: 736465 - RNA, 64 nt, Homo Sapiens; identical to SEQ ID NO: 155701

SEQ ID NO: 736466 - RNA, 64 nt, Homo Sapiens; identical to SEQ ID NO: 155702

SEQ ID NO: 736467 - RNA, 64 nt, Homo Sapiens; identical to SEQ ID NO: 155703

SEQ ID NO: 736468 - RNA, 64 nt, Homo Sapiens; identical to SEQ ID NO: 155704

SEQ ID NO: 736469 - RNA, 64 nt, Homo Sapiens; identical to SEQ ID NO: 155705

SEQ ID NO: 736470 - RNA, 64 nt, Homo Sapiens; identical to SEQ ID NO: 155706

SEQ ID NO: 736471 - RNA, 64 nt, Homo Sapiens; identical to SEQ ID NO: 155707

SEQ ID NO: 736472 - RNA, 64 nt, Homo Sapiens; identical to SEQ ID NO: 155708

SEQ ID NO: 736473 - RNA, 64 nt, Homo Sapiens; identical to SEQ ID NO: 155709

SEQ ID NO: 736474 - RNA, 64 nt, Homo Sapiens; identical to SEQ ID NO: 155710

SEQ ID NO: 736475 - RNA, 64 nt, Homo Sapiens; identical to SEQ ID NO: 155711

SEQ ID NO: 736476 - RNA, 64 nt, Homo Sapiens; identical to SEQ ID NO: 155712

SEQ ID NO: 736477 - RNA, 64 nt, Homo Sapiens; identical to SEQ ID NO: 155713

SEQ ID NO: 736478 - RNA, 64 nt, Homo Sapiens; identical to SEQ ID NO: 155714

SEQ ID NO: 736479 - RNA, 64 nt, Homo Sapiens; identical to SEQ ID NO: 155715

SEQ ID NO: 736480 - RNA, 64 nt, Homo Sapiens; identical to SEQ ID NO: 155716

SEQ ID NO: 736481 - RNA, 64 nt, Homo Sapiens; identical to SEQ ID NO: 155717

SEQ ID NO: 736482 - RNA, 64 nt, Homo Sapiens; identical to SEQ ID NO: 155718

SEQ ID NO: 736483 - RNA, 64 nt, Homo Sapiens; identical to SEQ ID NO: 155719

SEQ ID NO: 736484 - RNA, 64 nt, Homo Sapiens; identical to SEQ ID NO: 155720

SEQ ID NO: 736485 - RNA, 64 nt, Homo Sapiens; identical to SEQ ID NO: 155721

SEQ ID NO: 736486 - RNA, 64 nt, Homo Sapiens; identical to SEQ ID NO: 155722

SEQ ID NO: 736487 - RNA, 64 nt, Homo Sapiens; identical to SEQ ID NO: 155723

SEQ ID NO: 736488 - RNA, 64 nt, Homo Sapiens; identical to SEQ ID NO: 155724

SEQ ID NO: 736489 - RNA, 64 nt, Homo Sapiens; identical to SEQ ID NO: 155725

SEQ ID NO: 736490 - RNA, 64 nt, Homo Sapiens; identical to SEQ ID NO: 155726

SEQ ID NO: 736491 - RNA, 64 nt, Homo Sapiens; identical to SEQ ID NO: 155727

SEQ ID NO: 736492 - RNA, 64 nt, Homo Sapiens; identical to SEQ ID NO: 155728

SEQ ID NO: 736493 - RNA, 64 nt, Homo Sapiens; identical to SEQ ID NO: 155729

SEQ ID NO: 736494 - RNA, 58 nt, Homo Sapiens; identical to SEQ ID NO: 155730

SEQ ID NO: 736495 - RNA, 64 nt, Homo Sapiens; identical to SEQ ID NO: 155731

SEQ ID NO: 736496 - RNA, 64 nt, Homo Sapiens; identical to SEQ ID NO: 155732

SEQ ID NO: 736497 - RNA, 64 nt, Homo Sapiens; identical to SEQ ID NO: 155733

SEQ ID NO: 736498 - RNA, 64 nt, Homo Sapiens; identical to SEQ ID NO: 155734

SEQ ID NO: 736499 - RNA, 64 nt, Homo Sapiens; identical to SEQ ID NO: 155735

SEQ ID NO: 736500 - RNA, 64 nt, Homo Sapiens; identical to SEQ ID NO: 155736

SEQ ID NO: 736501 - RNA, 64 nt, Homo Sapiens; identical to SEQ ID NO: 155737

SEQ ID NO: 736502 - RNA, 64 nt, Homo Sapiens; identical to SEQ ID NO: 155738

SEQ ID NO: 736503 - RNA, 64 nt, Homo Sapiens; identical to SEQ ID NO: 155739

SEQ ID NO: 736504 - RNA, 64 nt, Homo Sapiens; identical to SEQ ID NO: 155740

SEQ ID NO: 736505 - RNA, 64 nt, Homo Sapiens; identical to SEQ ID NO: 155741

SEQ ID NO: 736506 - RNA, 64 nt, Homo Sapiens; identical to SEQ ID NO: 155742

SEQ ID NO: 736507 - RNA, 64 nt, Homo Sapiens; identical to SEQ ID NO: 155743

SEQ ID NO: 736508 - RNA, 64 nt, Homo Sapiens; identical to SEQ ID NO: 155744

SEQ ID NO: 736509 - RNA, 64 nt, Homo Sapiens; identical to SEQ ID NO: 155745

SEQ ID NO: 736510 - RNA, 64 nt, Homo Sapiens; identical to SEQ ID NO: 155746

SEQ ID NO: 736511 - RNA, 64 nt, Homo Sapiens; identical to SEQ ID NO: 155747

SEQ ID NO: 736512 - RNA, 64 nt, Homo Sapiens; identical to SEQ ID NO: 155748

SEQ ID NO: 736513 - RNA, 64 nt, Homo Sapiens; identical to SEQ ID NO: 155749

SEQ ID NO: 736514 - RNA, 64 nt, Homo Sapiens; identical to SEQ ID NO: 155750

SEQ ID NO: 736515 - RNA, 64 nt, Homo Sapiens; identical to SEQ ID NO: 155751

SEQ ID NO: 736516 - RNA, 64 nt, Homo Sapiens; identical to SEQ ID NO: 155752

SEQ ID NO: 736517 - RNA, 64 nt, Homo Sapiens; identical to SEQ ID NO: 155753

SEQ ID NO: 736518 - RNA, 63 nt, Homo Sapiens; identical to SEQ ID NO: 155754

SEQ ID NO: 736519 - RNA, 64 nt, Homo Sapiens; identical to SEQ ID NO: 155755

SEQ ID NO: 736520 - RNA, 64 nt, Homo Sapiens; identical to SEQ ID NO: 155756

SEQ ID NO: 736521 - RNA, 64 nt, Homo Sapiens; identical to SEQ ID NO: 155757

SEQ ID NO: 736522 - RNA, 64 nt, Homo Sapiens; identical to SEQ ID NO: 155758

SEQ ID NO: 736523 - RNA, 64 nt, Homo Sapiens; identical to SEQ ID NO: 155759

SEQ ID NO: 736524 - RNA, 64 nt, Homo Sapiens; identical to SEQ ID NO: 155760

SEQ ID NO: 736525 - RNA, 64 nt, Homo Sapiens; identical to SEQ ID NO: 155761

SEQ ID NO: 736526 - RNA, 64 nt, Homo Sapiens; identical to SEQ ID NO: 155762

SEQ ID NO: 736527 - RNA, 64 nt, Homo Sapiens; identical to SEQ ID NO: 155763

SEQ ID NO: 736528 - RNA, 64 nt, Homo Sapiens; identical to SEQ ID NO: 155764

SEQ ID NO: 736529 - RNA, 64 nt, Homo Sapiens; identical to SEQ ID NO: 155765

SEQ ID NO: 736530 - RNA, 64 nt, Homo Sapiens; identical to SEQ ID NO: 155766

SEQ ID NO: 736531 - RNA, 64 nt, Homo Sapiens; identical to SEQ ID NO: 155767

SEQ ID NO: 736532 - RNA, 64 nt, Homo Sapiens; identical to SEQ ID NO: 155768

SEQ ID NO: 736533 - RNA, 64 nt, Homo Sapiens; identical to SEQ ID NO: 155769

SEQ ID NO: 736534 - RNA, 64 nt, Homo Sapiens; identical to SEQ ID NO: 155770

SEQ ID NO: 736535 - RNA, 64 nt, Homo Sapiens; identical to SEQ ID NO: 155771

SEQ ID NO: 736536 - RNA, 64 nt, Homo Sapiens; identical to SEQ ID NO: 155772

SEQ ID NO: 736537 - RNA, 64 nt, Homo Sapiens; identical to SEQ ID NO: 155773

SEQ ID NO: 736538 - RNA, 64 nt, Homo Sapiens; identical to SEQ ID NO: 155774

SEQ ID NO: 736539 - RNA, 64 nt, Homo Sapiens; identical to SEQ ID NO: 155775

SEQ ID NO: 736540 - RNA, 64 nt, Homo Sapiens; identical to SEQ ID NO: 155776

SEQ ID NO: 736541 - RNA, 64 nt, Homo Sapiens; identical to SEQ ID NO: 155777

SEQ ID NO: 736542 - RNA, 64 nt, Homo Sapiens; identical to SEQ ID NO: 155778

SEQ ID NO: 736543 - RNA, 64 nt, Homo Sapiens; identical to SEQ ID NO: 155779

SEQ ID NO: 736544 - RNA, 64 nt, Homo Sapiens; identical to SEQ ID NO: 155780

SEQ ID NO: 736545 - RNA, 64 nt, Homo Sapiens; identical to SEQ ID NO: 155781

SEQ ID NO: 736546 - RNA, 64 nt, Homo Sapiens; identical to SEQ ID NO: 155782

SEQ ID NO: 736547 - RNA, 64 nt, Homo Sapiens; identical to SEQ ID NO: 155783

SEQ ID NO: 736548 - RNA, 64 nt, Homo Sapiens; identical to SEQ ID NO: 155784

SEQ ID NO: 736549 - RNA, 64 nt, Homo Sapiens; identical to SEQ ID NO: 155785

SEQ ID NO: 736550 - RNA, 64 nt, Homo Sapiens; identical to SEQ ID NO: 155786

SEQ ID NO: 736551 - RNA, 53 nt, Homo Sapiens; identical to SEQ ID NO: 155787

SEQ ID NO: 736552 - RNA, 64 nt, Homo Sapiens; identical to SEQ ID NO: 155788

SEQ ID NO: 736553 - RNA, 64 nt, Homo Sapiens; identical to SEQ ID NO: 155789

SEQ ID NO: 736554 - RNA, 64 nt, Homo Sapiens; identical to SEQ ID NO: 155790

SEQ ID NO: 736555 - RNA, 64 nt, Homo Sapiens; identical to SEQ ID NO: 155791

SEQ ID NO: 736556 - RNA, 64 nt, Homo Sapiens; identical to SEQ ID NO: 155792

SEQ ID NO: 736557 - RNA, 64 nt, Homo Sapiens; identical to SEQ ID NO: 155793

SEQ ID NO: 736558 - RNA, 64 nt, Homo Sapiens; identical to SEQ ID NO: 155794

SEQ ID NO: 736559 - RNA, 64 nt, Homo Sapiens; identical to SEQ ID NO: 155795

SEQ ID NO: 736560 - RNA, 64 nt, Homo Sapiens; identical to SEQ ID NO: 155796

SEQ ID NO: 736561 - RNA, 64 nt, Homo Sapiens; identical to SEQ ID NO: 155797

SEQ ID NO: 736562 - RNA, 64 nt, Homo Sapiens; identical to SEQ ID NO: 155798

SEQ ID NO: 736563 - RNA, 64 nt, Homo Sapiens; identical to SEQ ID NO: 155799

SEQ ID NO: 736564 - RNA, 64 nt, Homo Sapiens; identical to SEQ ID NO: 155800

SEQ ID NO: 736565 - RNA, 64 nt, Homo Sapiens; identical to SEQ ID NO: 155801

SEQ ID NO: 736566 - RNA, 64 nt, Homo Sapiens; identical to SEQ ID NO: 155802

SEQ ID NO: 736567 - RNA, 64 nt, Homo Sapiens; identical to SEQ ID NO: 155803

SEQ ID NO: 736568 - RNA, 64 nt, Homo Sapiens; identical to SEQ ID NO: 155804

SEQ ID NO: 736569 - RNA, 64 nt, Homo Sapiens; identical to SEQ ID NO: 155805

SEQ ID NO: 736570 - RNA, 64 nt, Homo Sapiens; identical to SEQ ID NO: 155806

SEQ ID NO: 736571 - RNA, 64 nt, Homo Sapiens; identical to SEQ ID NO: 155807

SEQ ID NO: 736572 - RNA, 64 nt, Homo Sapiens; identical to SEQ ID NO: 155808

SEQ ID NO: 736573 - RNA, 64 nt, Homo Sapiens; identical to SEQ ID NO: 243402

SEQ ID NO: 736574 - RNA, 64 nt, Homo Sapiens; identical to SEQ ID NO: 243403

SEQ ID NO: 736575 - RNA, 64 nt, Homo Sapiens; identical to SEQ ID NO: 155629

SEQ ID NO: 736576 - RNA, 64 nt, Homo Sapiens; identical to SEQ ID NO: 155630

SEQ ID NO: 736577 - RNA, 64 nt, Homo Sapiens; identical to SEQ ID NO: 155631

SEQ ID NO: 736578 - RNA, 64 nt, Homo Sapiens; identical to SEQ ID NO: 155632

SEQ ID NO: 736579 - RNA, 64 nt, Homo Sapiens; identical to SEQ ID NO: 155633

SEQ ID NO: 736580 - RNA, 64 nt, Homo Sapiens; identical to SEQ ID NO: 155634

SEQ ID NO: 736581 - RNA, 64 nt, Homo Sapiens; identical to SEQ ID NO: 155635

SEQ ID NO: 736582 - RNA, 64 nt, Homo Sapiens; identical to SEQ ID NO: 155636

SEQ ID NO: 736583 - RNA, 64 nt, Homo Sapiens; identical to SEQ ID NO: 155637

SEQ ID NO: 736584 - RNA, 64 nt, Homo Sapiens; identical to SEQ ID NO: 155638

SEQ ID NO: 736585 - RNA, 64 nt, Homo Sapiens; identical to SEQ ID NO: 155639

SEQ ID NO: 736586 - RNA, 64 nt, Homo Sapiens; identical to SEQ ID NO: 155640

SEQ ID NO: 736587 - RNA, 64 nt, Homo Sapiens; identical to SEQ ID NO: 155641

SEQ ID NO: 736588 - RNA, 64 nt, Homo Sapiens; identical to SEQ ID NO: 155642

SEQ ID NO: 736589 - RNA, 64 nt, Homo Sapiens; identical to SEQ ID NO: 155643

SEQ ID NO: 736590 - RNA, 64 nt, Homo Sapiens; identical to SEQ ID NO: 155644

SEQ ID NO: 736591 - RNA, 64 nt, Homo Sapiens; identical to SEQ ID NO: 155645

SEQ ID NO: 736592 - RNA, 64 nt, Homo Sapiens; identical to SEQ ID NO: 155646

SEQ ID NO: 736593 - RNA, 64 nt, Homo Sapiens; identical to SEQ ID NO: 155647

SEQ ID NO: 736594 - RNA, 64 nt, Homo Sapiens; identical to SEQ ID NO: 155648

SEQ ID NO: 736595 - RNA, 64 nt, Homo Sapiens; identical to SEQ ID NO: 155649

SEQ ID NO: 736596 - RNA, 64 nt, Homo Sapiens; identical to SEQ ID NO: 155650

SEQ ID NO: 736597 - RNA, 64 nt, Homo Sapiens; identical to SEQ ID NO: 155651

SEQ ID NO: 736598 - RNA, 64 nt, Homo Sapiens; identical to SEQ ID NO: 155652

SEQ ID NO: 736599 - RNA, 64 nt, Homo Sapiens; identical to SEQ ID NO: 155653

SEQ ID NO: 736600 - RNA, 64 nt, Homo Sapiens; identical to SEQ ID NO: 155654

SEQ ID NO: 736601 - RNA, 64 nt, Homo Sapiens; identical to SEQ ID NO: 155655

SEQ ID NO: 736602 - RNA, 64 nt, Homo Sapiens; identical to SEQ ID NO: 155656

SEQ ID NO: 736603 - RNA, 64 nt, Homo Sapiens; identical to SEQ ID NO: 155657

SEQ ID NO: 736604 - RNA, 64 nt, Homo Sapiens; identical to SEQ ID NO: 155658

SEQ ID NO: 736605 - RNA, 64 nt, Homo Sapiens; identical to SEQ ID NO: 155659

SEQ ID NO: 736606 - RNA, 64 nt, Homo Sapiens; identical to SEQ ID NO: 155660

SEQ ID NO: 736607 - RNA, 64 nt, Homo Sapiens; identical to SEQ ID NO: 155661

SEQ ID NO: 736608 - RNA, 64 nt, Homo Sapiens; identical to SEQ ID NO: 155662

SEQ ID NO: 736609 - RNA, 64 nt, Homo Sapiens; identical to SEQ ID NO: 155663

SEQ ID NO: 736610 - RNA, 64 nt, Homo Sapiens; identical to SEQ ID NO: 155664

SEQ ID NO: 736611 - RNA, 64 nt, Homo Sapiens; identical to SEQ ID NO: 155665

SEQ ID NO: 736612 - RNA, 64 nt, Homo Sapiens; identical to SEQ ID NO: 155666

SEQ ID NO: 736613 - RNA, 64 nt, Homo Sapiens; identical to SEQ ID NO: 155667

SEQ ID NO: 736614 - RNA, 64 nt, Homo Sapiens; identical to SEQ ID NO: 155668

SEQ ID NO: 736615 - RNA, 64 nt, Homo Sapiens; identical to SEQ ID NO: 155669

SEQ ID NO: 736616 - RNA, 64 nt, Homo Sapiens; identical to SEQ ID NO: 155670

SEQ ID NO: 736617 - RNA, 64 nt, Homo Sapiens; identical to SEQ ID NO: 155671

SEQ ID NO: 736618 - RNA, 64 nt, Homo Sapiens; identical to SEQ ID NO: 155672

SEQ ID NO: 736619 - RNA, 64 nt, Homo Sapiens; identical to SEQ ID NO: 155673

SEQ ID NO: 736620 - RNA, 64 nt, Homo Sapiens; identical to SEQ ID NO: 155674

SEQ ID NO: 736621 - RNA, 64 nt, Homo Sapiens; identical to SEQ ID NO: 155675

SEQ ID NO: 736622 - RNA, 64 nt, Homo Sapiens; identical to SEQ ID NO: 155676

SEQ ID NO: 736623 - RNA, 64 nt, Homo Sapiens; identical to SEQ ID NO: 155677

SEQ ID NO: 736624 - RNA, 64 nt, Homo Sapiens; identical to SEQ ID NO: 155678

SEQ ID NO: 736625 - RNA, 64 nt, Homo Sapiens; identical to SEQ ID NO: 155679

SEQ ID NO: 736626 - RNA, 64 nt, Homo Sapiens; identical to SEQ ID NO: 155680

SEQ ID NO: 736627 - RNA, 64 nt, Homo Sapiens; identical to SEQ ID NO: 155681

SEQ ID NO: 736628 - RNA, 64 nt, Homo Sapiens; identical to SEQ ID NO: 155682

SEQ ID NO: 736629 - RNA, 64 nt, Homo Sapiens; identical to SEQ ID NO: 155683

SEQ ID NO: 736630 - RNA, 64 nt, Homo Sapiens; identical to SEQ ID NO: 155684

SEQ ID NO: 736631 - RNA, 64 nt, Homo Sapiens; identical to SEQ ID NO: 155685

SEQ ID NO: 736632 - RNA, 64 nt, Homo Sapiens; identical to SEQ ID NO: 155686

SEQ ID NO: 736633 - RNA, 64 nt, Homo Sapiens; identical to SEQ ID NO: 155687

SEQ ID NO: 736634 - RNA, 64 nt, Homo Sapiens; identical to SEQ ID NO: 155688

SEQ ID NO: 736635 - RNA, 64 nt, Homo Sapiens; identical to SEQ ID NO: 155689

SEQ ID NO: 736636 - RNA, 64 nt, Homo Sapiens; identical to SEQ ID NO: 155690

SEQ ID NO: 736637 - RNA, 64 nt, Homo Sapiens; identical to SEQ ID NO: 155691

SEQ ID NO: 736638 - RNA, 64 nt, Homo Sapiens; identical to SEQ ID NO: 155692

SEQ ID NO: 736639 - RNA, 64 nt, Homo Sapiens; identical to SEQ ID NO: 155693

SEQ ID NO: 736640 - RNA, 64 nt, Homo Sapiens; identical to SEQ ID NO: 155694

SEQ ID NO: 736641 - RNA, 64 nt, Homo Sapiens; identical to SEQ ID NO: 155695

SEQ ID NO: 736642 - RNA, 64 nt, Homo Sapiens; identical to SEQ ID NO: 155696

SEQ ID NO: 736643 - RNA, 64 nt, Homo Sapiens; identical to SEQ ID NO: 155697

SEQ ID NO: 736644 - RNA, 64 nt, Homo Sapiens; identical to SEQ ID NO: 155698

SEQ ID NO: 736645 - RNA, 64 nt, Homo Sapiens; identical to SEQ ID NO: 155699

SEQ ID NO: 736646 - RNA, 64 nt, Homo Sapiens; identical to SEQ ID NO: 155700

SEQ ID NO: 736647 - RNA, 64 nt, Homo Sapiens; identical to SEQ ID NO: 155701

SEQ ID NO: 736648 - RNA, 64 nt, Homo Sapiens; identical to SEQ ID NO: 155702

SEQ ID NO: 736649 - RNA, 64 nt, Homo Sapiens; identical to SEQ ID NO: 155703

SEQ ID NO: 736650 - RNA, 64 nt, Homo Sapiens; identical to SEQ ID NO: 155704

SEQ ID NO: 736651 - RNA, 64 nt, Homo Sapiens; identical to SEQ ID NO: 155705

SEQ ID NO: 736652 - RNA, 64 nt, Homo Sapiens; identical to SEQ ID NO: 155706

SEQ ID NO: 736653 - RNA, 64 nt, Homo Sapiens; identical to SEQ ID NO: 155707

SEQ ID NO: 736654 - RNA, 64 nt, Homo Sapiens; identical to SEQ ID NO: 155708

SEQ ID NO: 736655 - RNA, 64 nt, Homo Sapiens; identical to SEQ ID NO: 155709

SEQ ID NO: 736656 - RNA, 64 nt, Homo Sapiens; identical to SEQ ID NO: 155710

SEQ ID NO: 736657 - RNA, 64 nt, Homo Sapiens; identical to SEQ ID NO: 155711

SEQ ID NO: 736658 - RNA, 64 nt, Homo Sapiens; identical to SEQ ID NO: 155712

SEQ ID NO: 736659 - RNA, 64 nt, Homo Sapiens; identical to SEQ ID NO: 155713

SEQ ID NO: 736660 - RNA, 64 nt, Homo Sapiens; identical to SEQ ID NO: 155714

SEQ ID NO: 736661 - RNA, 64 nt, Homo Sapiens; identical to SEQ ID NO: 155715

SEQ ID NO: 736662 - RNA, 64 nt, Homo Sapiens; identical to SEQ ID NO: 155716

SEQ ID NO: 736663 - RNA, 64 nt, Homo Sapiens; identical to SEQ ID NO: 155717

SEQ ID NO: 736664 - RNA, 64 nt, Homo Sapiens; identical to SEQ ID NO: 155718

SEQ ID NO: 736665 - RNA, 64 nt, Homo Sapiens; identical to SEQ ID NO: 155719

SEQ ID NO: 736666 - RNA, 64 nt, Homo Sapiens; identical to SEQ ID NO: 155720

SEQ ID NO: 736667 - RNA, 64 nt, Homo Sapiens; identical to SEQ ID NO: 155721

SEQ ID NO: 736668 - RNA, 64 nt, Homo Sapiens; identical to SEQ ID NO: 155722

SEQ ID NO: 736669 - RNA, 64 nt, Homo Sapiens; identical to SEQ ID NO: 155723

SEQ ID NO: 736670 - RNA, 64 nt, Homo Sapiens; identical to SEQ ID NO: 155724

SEQ ID NO: 736671 - RNA, 64 nt, Homo Sapiens; identical to SEQ ID NO: 155725

SEQ ID NO: 736672 - RNA, 64 nt, Homo Sapiens; identical to SEQ ID NO: 155726

SEQ ID NO: 736673 - RNA, 64 nt, Homo Sapiens; identical to SEQ ID NO: 155727

SEQ ID NO: 736674 - RNA, 64 nt, Homo Sapiens; identical to SEQ ID NO: 155728

SEQ ID NO: 736675 - RNA, 64 nt, Homo Sapiens; identical to SEQ ID NO: 155729

SEQ ID NO: 736676 - RNA, 58 nt, Homo Sapiens; identical to SEQ ID NO: 155730

SEQ ID NO: 736677 - RNA, 64 nt, Homo Sapiens; identical to SEQ ID NO: 155731

SEQ ID NO: 736678 - RNA, 64 nt, Homo Sapiens; identical to SEQ ID NO: 155732

SEQ ID NO: 736679 - RNA, 64 nt, Homo Sapiens; identical to SEQ ID NO: 155733

SEQ ID NO: 736680 - RNA, 64 nt, Homo Sapiens; identical to SEQ ID NO: 155734

SEQ ID NO: 736681 - RNA, 64 nt, Homo Sapiens; identical to SEQ ID NO: 155735

SEQ ID NO: 736682 - RNA, 64 nt, Homo Sapiens; identical to SEQ ID NO: 155736

SEQ ID NO: 736683 - RNA, 64 nt, Homo Sapiens; identical to SEQ ID NO: 155737

SEQ ID NO: 736684 - RNA, 64 nt, Homo Sapiens; identical to SEQ ID NO: 155738

SEQ ID NO: 736685 - RNA, 64 nt, Homo Sapiens; identical to SEQ ID NO: 155739

SEQ ID NO: 736686 - RNA, 64 nt, Homo Sapiens; identical to SEQ ID NO: 155740

SEQ ID NO: 736687 - RNA, 64 nt, Homo Sapiens; identical to SEQ ID NO: 155741

SEQ ID NO: 736688 - RNA, 64 nt, Homo Sapiens; identical to SEQ ID NO: 155742

SEQ ID NO: 736689 - RNA, 64 nt, Homo Sapiens; identical to SEQ ID NO: 155743

SEQ ID NO: 736690 - RNA, 64 nt, Homo Sapiens; identical to SEQ ID NO: 155744

SEQ ID NO: 736691 - RNA, 64 nt, Homo Sapiens; identical to SEQ ID NO: 155745

SEQ ID NO: 736692 - RNA, 64 nt, Homo Sapiens; identical to SEQ ID NO: 155746

SEQ ID NO: 736693 - RNA, 64 nt, Homo Sapiens; identical to SEQ ID NO: 155747

SEQ ID NO: 736694 - RNA, 64 nt, Homo Sapiens; identical to SEQ ID NO: 155748

SEQ ID NO: 736695 - RNA, 64 nt, Homo Sapiens; identical to SEQ ID NO: 155749

SEQ ID NO: 736696 - RNA, 64 nt, Homo Sapiens; identical to SEQ ID NO: 155750

SEQ ID NO: 736697 - RNA, 64 nt, Homo Sapiens; identical to SEQ ID NO: 155751

SEQ ID NO: 736698 - RNA, 64 nt, Homo Sapiens; identical to SEQ ID NO: 155752

SEQ ID NO: 736699 - RNA, 64 nt, Homo Sapiens; identical to SEQ ID NO: 155753

SEQ ID NO: 736700 - RNA, 63 nt, Homo Sapiens; identical to SEQ ID NO: 155754

SEQ ID NO: 736701 - RNA, 64 nt, Homo Sapiens; identical to SEQ ID NO: 155755

SEQ ID NO: 736702 - RNA, 64 nt, Homo Sapiens; identical to SEQ ID NO: 155756

SEQ ID NO: 736703 - RNA, 64 nt, Homo Sapiens; identical to SEQ ID NO: 155757

SEQ ID NO: 736704 - RNA, 64 nt, Homo Sapiens; identical to SEQ ID NO: 155758

SEQ ID NO: 736705 - RNA, 64 nt, Homo Sapiens; identical to SEQ ID NO: 155759

SEQ ID NO: 736706 - RNA, 64 nt, Homo Sapiens; identical to SEQ ID NO: 155760

SEQ ID NO: 736707 - RNA, 64 nt, Homo Sapiens; identical to SEQ ID NO: 155761

SEQ ID NO: 736708 - RNA, 64 nt, Homo Sapiens; identical to SEQ ID NO: 155762

SEQ ID NO: 736709 - RNA, 64 nt, Homo Sapiens; identical to SEQ ID NO: 155763

SEQ ID NO: 736710 - RNA, 64 nt, Homo Sapiens; identical to SEQ ID NO: 155764

SEQ ID NO: 736711 - RNA, 64 nt, Homo Sapiens; identical to SEQ ID NO: 155765

SEQ ID NO: 736712 - RNA, 64 nt, Homo Sapiens; identical to SEQ ID NO: 155766

SEQ ID NO: 736713 - RNA, 64 nt, Homo Sapiens; identical to SEQ ID NO: 155767

SEQ ID NO: 736714 - RNA, 64 nt, Homo Sapiens; identical to SEQ ID NO: 155768

SEQ ID NO: 736715 - RNA, 64 nt, Homo Sapiens; identical to SEQ ID NO: 155769

SEQ ID NO: 736716 - RNA, 64 nt, Homo Sapiens; identical to SEQ ID NO: 155770

SEQ ID NO: 736717 - RNA, 64 nt, Homo Sapiens; identical to SEQ ID NO: 155771

SEQ ID NO: 736718 - RNA, 64 nt, Homo Sapiens; identical to SEQ ID NO: 155772

SEQ ID NO: 736719 - RNA, 64 nt, Homo Sapiens; identical to SEQ ID NO: 155773

SEQ ID NO: 736720 - RNA, 64 nt, Homo Sapiens; identical to SEQ ID NO: 155774

SEQ ID NO: 736721 - RNA, 64 nt, Homo Sapiens; identical to SEQ ID NO: 155775

SEQ ID NO: 736722 - RNA, 64 nt, Homo Sapiens; identical to SEQ ID NO: 155776

SEQ ID NO: 736723 - RNA, 64 nt, Homo Sapiens; identical to SEQ ID NO: 155777

SEQ ID NO: 736724 - RNA, 64 nt, Homo Sapiens; identical to SEQ ID NO: 155778

SEQ ID NO: 736725 - RNA, 64 nt, Homo Sapiens; identical to SEQ ID NO: 155779

SEQ ID NO: 736726 - RNA, 64 nt, Homo Sapiens; identical to SEQ ID NO: 155780

SEQ ID NO: 736727 - RNA, 64 nt, Homo Sapiens; identical to SEQ ID NO: 155781

SEQ ID NO: 736728 - RNA, 64 nt, Homo Sapiens; identical to SEQ ID NO: 155782

SEQ ID NO: 736729 - RNA, 64 nt, Homo Sapiens; identical to SEQ ID NO: 155783

SEQ ID NO: 736730 - RNA, 64 nt, Homo Sapiens; identical to SEQ ID NO: 155784

SEQ ID NO: 736731 - RNA, 64 nt, Homo Sapiens; identical to SEQ ID NO: 155785

SEQ ID NO: 736732 - RNA, 64 nt, Homo Sapiens; identical to SEQ ID NO: 155786

SEQ ID NO: 736733 - RNA, 53 nt, Homo Sapiens; identical to SEQ ID NO: 155787

SEQ ID NO: 736734 - RNA, 64 nt, Homo Sapiens; identical to SEQ ID NO: 155788

SEQ ID NO: 736735 - RNA, 64 nt, Homo Sapiens; identical to SEQ ID NO: 155789

SEQ ID NO: 736736 - RNA, 64 nt, Homo Sapiens; identical to SEQ ID NO: 155790

SEQ ID NO: 736737 - RNA, 64 nt, Homo Sapiens; identical to SEQ ID NO: 155791

SEQ ID NO: 736738 - RNA, 64 nt, Homo Sapiens; identical to SEQ ID NO: 155792

SEQ ID NO: 736739 - RNA, 64 nt, Homo Sapiens; identical to SEQ ID NO: 155793

SEQ ID NO: 736740 - RNA, 64 nt, Homo Sapiens; identical to SEQ ID NO: 155794

SEQ ID NO: 736741 - RNA, 64 nt, Homo Sapiens; identical to SEQ ID NO: 155795

SEQ ID NO: 736742 - RNA, 64 nt, Homo Sapiens; identical to SEQ ID NO: 155796

SEQ ID NO: 736743 - RNA, 64 nt, Homo Sapiens; identical to SEQ ID NO: 155797

SEQ ID NO: 736744 - RNA, 64 nt, Homo Sapiens; identical to SEQ ID NO: 155798

SEQ ID NO: 736745 - RNA, 64 nt, Homo Sapiens; identical to SEQ ID NO: 155799

SEQ ID NO: 736746 - RNA, 64 nt, Homo Sapiens; identical to SEQ ID NO: 155800

SEQ ID NO: 736747 - RNA, 64 nt, Homo Sapiens; identical to SEQ ID NO: 155801

SEQ ID NO: 736748 - RNA, 64 nt, Homo Sapiens; identical to SEQ ID NO: 155802

SEQ ID NO: 736749 - RNA, 64 nt, Homo Sapiens; identical to SEQ ID NO: 155803

SEQ ID NO: 736750 - RNA, 64 nt, Homo Sapiens; identical to SEQ ID NO: 155804

SEQ ID NO: 736751 - RNA, 64 nt, Homo Sapiens; identical to SEQ ID NO: 155805

SEQ ID NO: 736752 - RNA, 64 nt, Homo Sapiens; identical to SEQ ID NO: 155806

SEQ ID NO: 736753 - RNA, 64 nt, Homo Sapiens; identical to SEQ ID NO: 155807

SEQ ID NO: 736754 - RNA, 64 nt, Homo Sapiens; identical to SEQ ID NO: 155808

SEQ ID NO: 736755 - RNA, 64 nt, Homo Sapiens; identical to SEQ ID NO: 243402

SEQ ID NO: 736756 - RNA, 64 nt, Homo Sapiens; identical to SEQ ID NO: 243403

SEQ ID NO: 736757 - RNA, 64 nt, Homo Sapiens; identical to SEQ ID NO: 155629

SEQ ID NO: 736758 - RNA, 64 nt, Homo Sapiens; identical to SEQ ID NO: 155630

SEQ ID NO: 736759 - RNA, 64 nt, Homo Sapiens; identical to SEQ ID NO: 155631

SEQ ID NO: 736760 - RNA, 64 nt, Homo Sapiens; identical to SEQ ID NO: 155632

SEQ ID NO: 736761 - RNA, 64 nt, Homo Sapiens; identical to SEQ ID NO: 155633

SEQ ID NO: 736762 - RNA, 64 nt, Homo Sapiens; identical to SEQ ID NO: 155634

SEQ ID NO: 736763 - RNA, 64 nt, Homo Sapiens; identical to SEQ ID NO: 155635

SEQ ID NO: 736764 - RNA, 64 nt, Homo Sapiens; identical to SEQ ID NO: 155636

SEQ ID NO: 736765 - RNA, 64 nt, Homo Sapiens; identical to SEQ ID NO: 155637

SEQ ID NO: 736766 - RNA, 64 nt, Homo Sapiens; identical to SEQ ID NO: 155638

SEQ ID NO: 736767 - RNA, 64 nt, Homo Sapiens; identical to SEQ ID NO: 155639

SEQ ID NO: 736768 - RNA, 64 nt, Homo Sapiens; identical to SEQ ID NO: 155640

SEQ ID NO: 736769 - RNA, 64 nt, Homo Sapiens; identical to SEQ ID NO: 155641

SEQ ID NO: 736770 - RNA, 64 nt, Homo Sapiens; identical to SEQ ID NO: 155642

SEQ ID NO: 736771 - RNA, 64 nt, Homo Sapiens; identical to SEQ ID NO: 155643

SEQ ID NO: 736772 - RNA, 64 nt, Homo Sapiens; identical to SEQ ID NO: 155644

SEQ ID NO: 736773 - RNA, 64 nt, Homo Sapiens; identical to SEQ ID NO: 155645

SEQ ID NO: 736774 - RNA, 64 nt, Homo Sapiens; identical to SEQ ID NO: 155646

SEQ ID NO: 736775 - RNA, 64 nt, Homo Sapiens; identical to SEQ ID NO: 155647

SEQ ID NO: 736776 - RNA, 64 nt, Homo Sapiens; identical to SEQ ID NO: 155648

SEQ ID NO: 736777 - RNA, 64 nt, Homo Sapiens; identical to SEQ ID NO: 155649

SEQ ID NO: 736778 - RNA, 64 nt, Homo Sapiens; identical to SEQ ID NO: 155650

SEQ ID NO: 736779 - RNA, 64 nt, Homo Sapiens; identical to SEQ ID NO: 155651

SEQ ID NO: 736780 - RNA, 64 nt, Homo Sapiens; identical to SEQ ID NO: 155652

SEQ ID NO: 736781 - RNA, 64 nt, Homo Sapiens; identical to SEQ ID NO: 155653

SEQ ID NO: 736782 - RNA, 64 nt, Homo Sapiens; identical to SEQ ID NO: 155654

SEQ ID NO: 736783 - RNA, 64 nt, Homo Sapiens; identical to SEQ ID NO: 155655

SEQ ID NO: 736784 - RNA, 64 nt, Homo Sapiens; identical to SEQ ID NO: 155656

SEQ ID NO: 736785 - RNA, 64 nt, Homo Sapiens; identical to SEQ ID NO: 155657

SEQ ID NO: 736786 - RNA, 64 nt, Homo Sapiens; identical to SEQ ID NO: 155658

SEQ ID NO: 736787 - RNA, 64 nt, Homo Sapiens; identical to SEQ ID NO: 155659

SEQ ID NO: 736788 - RNA, 64 nt, Homo Sapiens; identical to SEQ ID NO: 155660

SEQ ID NO: 736789 - RNA, 64 nt, Homo Sapiens; identical to SEQ ID NO: 155661

SEQ ID NO: 736790 - RNA, 64 nt, Homo Sapiens; identical to SEQ ID NO: 155662

SEQ ID NO: 736791 - RNA, 64 nt, Homo Sapiens; identical to SEQ ID NO: 155663

SEQ ID NO: 736792 - RNA, 64 nt, Homo Sapiens; identical to SEQ ID NO: 155664

SEQ ID NO: 736793 - RNA, 64 nt, Homo Sapiens; identical to SEQ ID NO: 155665

SEQ ID NO: 736794 - RNA, 64 nt, Homo Sapiens; identical to SEQ ID NO: 155666

SEQ ID NO: 736795 - RNA, 64 nt, Homo Sapiens; identical to SEQ ID NO: 155667

SEQ ID NO: 736796 - RNA, 64 nt, Homo Sapiens; identical to SEQ ID NO: 155668

SEQ ID NO: 736797 - RNA, 64 nt, Homo Sapiens; identical to SEQ ID NO: 155669

SEQ ID NO: 736798 - RNA, 64 nt, Homo Sapiens; identical to SEQ ID NO: 155670

SEQ ID NO: 736799 - RNA, 64 nt, Homo Sapiens; identical to SEQ ID NO: 155671

SEQ ID NO: 736800 - RNA, 64 nt, Homo Sapiens; identical to SEQ ID NO: 155672

SEQ ID NO: 736801 - RNA, 64 nt, Homo Sapiens; identical to SEQ ID NO: 155673

SEQ ID NO: 736802 - RNA, 64 nt, Homo Sapiens; identical to SEQ ID NO: 155674

SEQ ID NO: 736803 - RNA, 64 nt, Homo Sapiens; identical to SEQ ID NO: 155675

SEQ ID NO: 736804 - RNA, 64 nt, Homo Sapiens; identical to SEQ ID NO: 155676

SEQ ID NO: 736805 - RNA, 64 nt, Homo Sapiens; identical to SEQ ID NO: 155677

SEQ ID NO: 736806 - RNA, 64 nt, Homo Sapiens; identical to SEQ ID NO: 155678

SEQ ID NO: 736807 - RNA, 64 nt, Homo Sapiens; identical to SEQ ID NO: 155679

SEQ ID NO: 736808 - RNA, 64 nt, Homo Sapiens; identical to SEQ ID NO: 155680

SEQ ID NO: 736809 - RNA, 64 nt, Homo Sapiens; identical to SEQ ID NO: 155681

SEQ ID NO: 736810 - RNA, 64 nt, Homo Sapiens; identical to SEQ ID NO: 155682

SEQ ID NO: 736811 - RNA, 64 nt, Homo Sapiens; identical to SEQ ID NO: 155683

SEQ ID NO: 736812 - RNA, 64 nt, Homo Sapiens; identical to SEQ ID NO: 155684

SEQ ID NO: 736813 - RNA, 64 nt, Homo Sapiens; identical to SEQ ID NO: 155685

SEQ ID NO: 736814 - RNA, 64 nt, Homo Sapiens; identical to SEQ ID NO: 155686

SEQ ID NO: 736815 - RNA, 64 nt, Homo Sapiens; identical to SEQ ID NO: 155687

SEQ ID NO: 736816 - RNA, 64 nt, Homo Sapiens; identical to SEQ ID NO: 155688

SEQ ID NO: 736817 - RNA, 64 nt, Homo Sapiens; identical to SEQ ID NO: 155689

SEQ ID NO: 736818 - RNA, 64 nt, Homo Sapiens; identical to SEQ ID NO: 155690

SEQ ID NO: 736819 - RNA, 64 nt, Homo Sapiens; identical to SEQ ID NO: 155691

SEQ ID NO: 736820 - RNA, 64 nt, Homo Sapiens; identical to SEQ ID NO: 155692

SEQ ID NO: 736821 - RNA, 64 nt, Homo Sapiens; identical to SEQ ID NO: 155693

SEQ ID NO: 736822 - RNA, 64 nt, Homo Sapiens; identical to SEQ ID NO: 155694

SEQ ID NO: 736823 - RNA, 64 nt, Homo Sapiens; identical to SEQ ID NO: 155695

SEQ ID NO: 736824 - RNA, 64 nt, Homo Sapiens; identical to SEQ ID NO: 155696

SEQ ID NO: 736825 - RNA, 64 nt, Homo Sapiens; identical to SEQ ID NO: 155697

SEQ ID NO: 736826 - RNA, 64 nt, Homo Sapiens; identical to SEQ ID NO: 155698

SEQ ID NO: 736827 - RNA, 64 nt, Homo Sapiens; identical to SEQ ID NO: 155699

SEQ ID NO: 736828 - RNA, 64 nt, Homo Sapiens; identical to SEQ ID NO: 155700

SEQ ID NO: 736829 - RNA, 64 nt, Homo Sapiens; identical to SEQ ID NO: 155701

SEQ ID NO: 736830 - RNA, 64 nt, Homo Sapiens; identical to SEQ ID NO: 155702

SEQ ID NO: 736831 - RNA, 64 nt, Homo Sapiens; identical to SEQ ID NO: 155703

SEQ ID NO: 736832 - RNA, 64 nt, Homo Sapiens; identical to SEQ ID NO: 155704

SEQ ID NO: 736833 - RNA, 64 nt, Homo Sapiens; identical to SEQ ID NO: 155705

SEQ ID NO: 736834 - RNA, 64 nt, Homo Sapiens; identical to SEQ ID NO: 155706

SEQ ID NO: 736835 - RNA, 64 nt, Homo Sapiens; identical to SEQ ID NO: 155707

SEQ ID NO: 736836 - RNA, 64 nt, Homo Sapiens; identical to SEQ ID NO: 155708

SEQ ID NO: 736837 - RNA, 64 nt, Homo Sapiens; identical to SEQ ID NO: 155709

SEQ ID NO: 736838 - RNA, 64 nt, Homo Sapiens; identical to SEQ ID NO: 155710

SEQ ID NO: 736839 - RNA, 64 nt, Homo Sapiens; identical to SEQ ID NO: 155711

SEQ ID NO: 736840 - RNA, 64 nt, Homo Sapiens; identical to SEQ ID NO: 155712

SEQ ID NO: 736841 - RNA, 64 nt, Homo Sapiens; identical to SEQ ID NO: 155713

SEQ ID NO: 736842 - RNA, 64 nt, Homo Sapiens; identical to SEQ ID NO: 155714

SEQ ID NO: 736843 - RNA, 64 nt, Homo Sapiens; identical to SEQ ID NO: 155715

SEQ ID NO: 736844 - RNA, 64 nt, Homo Sapiens; identical to SEQ ID NO: 155716

SEQ ID NO: 736845 - RNA, 64 nt, Homo Sapiens; identical to SEQ ID NO: 155717

SEQ ID NO: 736846 - RNA, 64 nt, Homo Sapiens; identical to SEQ ID NO: 155718

SEQ ID NO: 736847 - RNA, 64 nt, Homo Sapiens; identical to SEQ ID NO: 155719

SEQ ID NO: 736848 - RNA, 64 nt, Homo Sapiens; identical to SEQ ID NO: 155720

SEQ ID NO: 736849 - RNA, 64 nt, Homo Sapiens; identical to SEQ ID NO: 155721

SEQ ID NO: 736850 - RNA, 64 nt, Homo Sapiens; identical to SEQ ID NO: 155722

SEQ ID NO: 736851 - RNA, 64 nt, Homo Sapiens; identical to SEQ ID NO: 155723

SEQ ID NO: 736852 - RNA, 64 nt, Homo Sapiens; identical to SEQ ID NO: 155724

SEQ ID NO: 736853 - RNA, 64 nt, Homo Sapiens; identical to SEQ ID NO: 155725

SEQ ID NO: 736854 - RNA, 64 nt, Homo Sapiens; identical to SEQ ID NO: 155726

SEQ ID NO: 736855 - RNA, 64 nt, Homo Sapiens; identical to SEQ ID NO: 155727

SEQ ID NO: 736856 - RNA, 64 nt, Homo Sapiens; identical to SEQ ID NO: 155728

SEQ ID NO: 736857 - RNA, 64 nt, Homo Sapiens; identical to SEQ ID NO: 155729

SEQ ID NO: 736858 - RNA, 58 nt, Homo Sapiens; identical to SEQ ID NO: 155730

SEQ ID NO: 736859 - RNA, 64 nt, Homo Sapiens; identical to SEQ ID NO: 155731

SEQ ID NO: 736860 - RNA, 64 nt, Homo Sapiens; identical to SEQ ID NO: 155732

SEQ ID NO: 736861 - RNA, 64 nt, Homo Sapiens; identical to SEQ ID NO: 155733

SEQ ID NO: 736862 - RNA, 64 nt, Homo Sapiens; identical to SEQ ID NO: 155734

SEQ ID NO: 736863 - RNA, 64 nt, Homo Sapiens; identical to SEQ ID NO: 155735

SEQ ID NO: 736864 - RNA, 64 nt, Homo Sapiens; identical to SEQ ID NO: 155736

SEQ ID NO: 736865 - RNA, 64 nt, Homo Sapiens; identical to SEQ ID NO: 155737

SEQ ID NO: 736866 - RNA, 64 nt, Homo Sapiens; identical to SEQ ID NO: 155738

SEQ ID NO: 736867 - RNA, 64 nt, Homo Sapiens; identical to SEQ ID NO: 155739

SEQ ID NO: 736868 - RNA, 64 nt, Homo Sapiens; identical to SEQ ID NO: 155740

SEQ ID NO: 736869 - RNA, 64 nt, Homo Sapiens; identical to SEQ ID NO: 155741

SEQ ID NO: 736870 - RNA, 64 nt, Homo Sapiens; identical to SEQ ID NO: 155742

SEQ ID NO: 736871 - RNA, 64 nt, Homo Sapiens; identical to SEQ ID NO: 155743

SEQ ID NO: 736872 - RNA, 64 nt, Homo Sapiens; identical to SEQ ID NO: 155744

SEQ ID NO: 736873 - RNA, 64 nt, Homo Sapiens; identical to SEQ ID NO: 155745

SEQ ID NO: 736874 - RNA, 64 nt, Homo Sapiens; identical to SEQ ID NO: 155746

SEQ ID NO: 736875 - RNA, 64 nt, Homo Sapiens; identical to SEQ ID NO: 155747

SEQ ID NO: 736876 - RNA, 64 nt, Homo Sapiens; identical to SEQ ID NO: 155748

SEQ ID NO: 736877 - RNA, 64 nt, Homo Sapiens; identical to SEQ ID NO: 155749

SEQ ID NO: 736878 - RNA, 64 nt, Homo Sapiens; identical to SEQ ID NO: 155750

SEQ ID NO: 736879 - RNA, 64 nt, Homo Sapiens; identical to SEQ ID NO: 155751

SEQ ID NO: 736880 - RNA, 64 nt, Homo Sapiens; identical to SEQ ID NO: 155752

SEQ ID NO: 736881 - RNA, 64 nt, Homo Sapiens; identical to SEQ ID NO: 155753

SEQ ID NO: 736882 - RNA, 63 nt, Homo Sapiens; identical to SEQ ID NO: 155754

SEQ ID NO: 736883 - RNA, 64 nt, Homo Sapiens; identical to SEQ ID NO: 155755

SEQ ID NO: 736884 - RNA, 64 nt, Homo Sapiens; identical to SEQ ID NO: 155756

SEQ ID NO: 736885 - RNA, 64 nt, Homo Sapiens; identical to SEQ ID NO: 155757

SEQ ID NO: 736886 - RNA, 64 nt, Homo Sapiens; identical to SEQ ID NO: 155758

SEQ ID NO: 736887 - RNA, 64 nt, Homo Sapiens; identical to SEQ ID NO: 155759

SEQ ID NO: 736888 - RNA, 64 nt, Homo Sapiens; identical to SEQ ID NO: 155760

SEQ ID NO: 736889 - RNA, 64 nt, Homo Sapiens; identical to SEQ ID NO: 155761

SEQ ID NO: 736890 - RNA, 64 nt, Homo Sapiens; identical to SEQ ID NO: 155762

SEQ ID NO: 736891 - RNA, 64 nt, Homo Sapiens; identical to SEQ ID NO: 155763

SEQ ID NO: 736892 - RNA, 64 nt, Homo Sapiens; identical to SEQ ID NO: 155764

SEQ ID NO: 736893 - RNA, 64 nt, Homo Sapiens; identical to SEQ ID NO: 155765

SEQ ID NO: 736894 - RNA, 64 nt, Homo Sapiens; identical to SEQ ID NO: 155766

SEQ ID NO: 736895 - RNA, 64 nt, Homo Sapiens; identical to SEQ ID NO: 155767

SEQ ID NO: 736896 - RNA, 64 nt, Homo Sapiens; identical to SEQ ID NO: 155768

SEQ ID NO: 736897 - RNA, 64 nt, Homo Sapiens; identical to SEQ ID NO: 155769

SEQ ID NO: 736898 - RNA, 64 nt, Homo Sapiens; identical to SEQ ID NO: 155770

SEQ ID NO: 736899 - RNA, 64 nt, Homo Sapiens; identical to SEQ ID NO: 155771

SEQ ID NO: 736900 - RNA, 64 nt, Homo Sapiens; identical to SEQ ID NO: 155772

SEQ ID NO: 736901 - RNA, 64 nt, Homo Sapiens; identical to SEQ ID NO: 155773

SEQ ID NO: 736902 - RNA, 64 nt, Homo Sapiens; identical to SEQ ID NO: 155774

SEQ ID NO: 736903 - RNA, 64 nt, Homo Sapiens; identical to SEQ ID NO: 155775

SEQ ID NO: 736904 - RNA, 64 nt, Homo Sapiens; identical to SEQ ID NO: 155776

SEQ ID NO: 736905 - RNA, 64 nt, Homo Sapiens; identical to SEQ ID NO: 155777

SEQ ID NO: 736906 - RNA, 64 nt, Homo Sapiens; identical to SEQ ID NO: 155778

SEQ ID NO: 736907 - RNA, 64 nt, Homo Sapiens; identical to SEQ ID NO: 155779

SEQ ID NO: 736908 - RNA, 64 nt, Homo Sapiens; identical to SEQ ID NO: 155780

SEQ ID NO: 736909 - RNA, 64 nt, Homo Sapiens; identical to SEQ ID NO: 155781

SEQ ID NO: 736910 - RNA, 64 nt, Homo Sapiens; identical to SEQ ID NO: 155782

SEQ ID NO: 736911 - RNA, 64 nt, Homo Sapiens; identical to SEQ ID NO: 155783

SEQ ID NO: 736912 - RNA, 64 nt, Homo Sapiens; identical to SEQ ID NO: 155784

SEQ ID NO: 736913 - RNA, 64 nt, Homo Sapiens; identical to SEQ ID NO: 155785

SEQ ID NO: 736914 - RNA, 64 nt, Homo Sapiens; identical to SEQ ID NO: 155786

SEQ ID NO: 736915 - RNA, 53 nt, Homo Sapiens; identical to SEQ ID NO: 155787

SEQ ID NO: 736916 - RNA, 64 nt, Homo Sapiens; identical to SEQ ID NO: 155788

SEQ ID NO: 736917 - RNA, 64 nt, Homo Sapiens; identical to SEQ ID NO: 155789

SEQ ID NO: 736918 - RNA, 64 nt, Homo Sapiens; identical to SEQ ID NO: 155790

SEQ ID NO: 736919 - RNA, 64 nt, Homo Sapiens; identical to SEQ ID NO: 155791

SEQ ID NO: 736920 - RNA, 64 nt, Homo Sapiens; identical to SEQ ID NO: 155792

SEQ ID NO: 736921 - RNA, 64 nt, Homo Sapiens; identical to SEQ ID NO: 155793

SEQ ID NO: 736922 - RNA, 64 nt, Homo Sapiens; identical to SEQ ID NO: 155794

SEQ ID NO: 736923 - RNA, 64 nt, Homo Sapiens; identical to SEQ ID NO: 155795

SEQ ID NO: 736924 - RNA, 64 nt, Homo Sapiens; identical to SEQ ID NO: 155796

SEQ ID NO: 736925 - RNA, 64 nt, Homo Sapiens; identical to SEQ ID NO: 155797

SEQ ID NO: 736926 - RNA, 64 nt, Homo Sapiens; identical to SEQ ID NO: 155798

SEQ ID NO: 736927 - RNA, 64 nt, Homo Sapiens; identical to SEQ ID NO: 155799

SEQ ID NO: 736928 - RNA, 64 nt, Homo Sapiens; identical to SEQ ID NO: 155800

SEQ ID NO: 736929 - RNA, 64 nt, Homo Sapiens; identical to SEQ ID NO: 155801

SEQ ID NO: 736930 - RNA, 64 nt, Homo Sapiens; identical to SEQ ID NO: 155802

SEQ ID NO: 736931 - RNA, 64 nt, Homo Sapiens; identical to SEQ ID NO: 155803

SEQ ID NO: 736932 - RNA, 64 nt, Homo Sapiens; identical to SEQ ID NO: 155804

SEQ ID NO: 736933 - RNA, 64 nt, Homo Sapiens; identical to SEQ ID NO: 155805

SEQ ID NO: 736934 - RNA, 64 nt, Homo Sapiens; identical to SEQ ID NO: 155806

SEQ ID NO: 736935 - RNA, 64 nt, Homo Sapiens; identical to SEQ ID NO: 155807

SEQ ID NO: 736936 - RNA, 64 nt, Homo Sapiens; identical to SEQ ID NO: 155808

SEQ ID NO: 736937 - RNA, 64 nt, Homo Sapiens; identical to SEQ ID NO: 243402

SEQ ID NO: 736938 - RNA, 64 nt, Homo Sapiens; identical to SEQ ID NO: 243403

SEQ ID NO: 736939 - RNA, 64 nt, Homo Sapiens
gaagcuucuugccucugaccaaaauacuuaggaagcuagccaugacagucuugagggucaaaaa

SEQ ID NO: 736940 - RNA, 64 nt, Homo Sapiens
aaugacugugauucugcugggaucuucucagcuugcuagccagaaugaaaugggcaccuaguca

SEQ ID NO: 736941 - RNA, 64 nt, Homo Sapiens
guaagccugagguggaauccacccaguuuugucugcuagccauaugggacaucuaauuggaaaa

SEQ ID NO: 736942 - RNA, 64 nt, Homo Sapiens
guagcuggcugacaaucuuugccaaaucuuccuugcuagccagaaguggaauuggcagcuucua

SEQ ID NO: 736943 - RNA, 64 nt, Homo Sapiens
uaaacucuuugcuucugcuaagaagcagucuaaauauaaucaacguacagugagcucuuugaag

SEQ ID NO: 736944 - RNA, 64 nt, Homo Sapiens
aaguuguauauucuugcaaugcauaaaaugacauuauaaucaacaaacuuaugguuuguuucaa

SEQ ID NO: 736945 - RNA, 64 nt, Homo Sapiens
auuuuuuacuuuuggguucaacacuaccauaauuuauaaucauuuuuauaacaggguuuuacag

SEQ ID NO: 736946 - RNA, 64 nt, Homo Sapiens
uguauuuuuuuacuuauguaaaaauugauguuuuuauaaucaaaauauggacaaucauauuuac

SEQ ID NO: 736947 - RNA, 64 nt, Homo Sapiens
gaaaaacauugccuucagcaggcuggugaaaccauauaaucacagauaauauuaucaucauaau

SEQ ID NO: 736948 - RNA, 64 nt, Homo Sapiens
auaaauuuuaauuauuccaguauaugccuagcuuuauaaucaguguaugucuuuugggauguau

SEQ ID NO: 736949 - RNA, 64 nt, Homo Sapiens
guaaguggcuaauuauaaaucuacucuagagacauauaaucauacagauuauucauaaaauuuu

SEQ ID NO: 736950 - RNA, 64 nt, Homo Sapiens
cucuaugugauuauuuuucuuaauuguuauuuuuuauaaucauuauuuuucugaaccauucuuc

SEQ ID NO: 736951 - RNA, 64 nt, Homo Sapiens
uuuuucugagaguugggugaggguaaagcuuuucuauaaucaagcucaauacaccaaggaaacu

SEQ ID NO: 736952 - RNA, 64 nt, Homo Sapiens
gguauccuuuccucaguguguauaugacagccaguauaaucaauacccuagguuaugcgucuau

SEQ ID NO: 736953 - RNA, 64 nt, Homo Sapiens
aaauguauagucuguuauaccauuuuucuguuacuauaaucagauucuuaauguuggcauguca

SEQ ID NO: 736954 - RNA, 64 nt, Homo Sapiens
cuuucuaaauucuuugcuagauaguuacauguauuauaaucauuuucuaaauauauguuauuua

SEQ ID NO: 736955 - RNA, 64 nt, Homo Sapiens
uuuauaucuggauauaauguucuuuuuaaacaaguauaaucauaucgucggagguuaagauuau

SEQ ID NO: 736956 - RNA, 64 nt, Homo Sapiens
aauugauaagauguuagaaauuuggaccauuauuuauaaucaggguagcauuaaaauggagaaa

SEQ ID NO: 736957 - RNA, 64 nt, Homo Sapiens
uaaauuuuaagguaccacugguauuuugggagauuauaaucaguuuguuuucaagauaauagaa

SEQ ID NO: 736958 - RNA, 64 nt, Homo Sapiens
gcagaaucaguaauuccuuggcuuaaagcucuuauauaaucaauauuauuggugguaaauacca

SEQ ID NO: 736959 - RNA, 64 nt, Homo Sapiens
cagguuuaaaaguugugcauuguauaaguguaaauauaaucagauuugguuccuguauauucca

SEQ ID NO: 736960 - RNA, 64 nt, Homo Sapiens
acuaguuaggauauugauuuaucaaaaauuauucuauaaucacuaccagguuagcaaaugaccu

SEQ ID NO: 736961 - RNA, 64 nt, Homo Sapiens; identical to SEQ ID NO: 165157

SEQ ID NO: 736962 - RNA, 64 nt, Homo Sapiens; identical to SEQ ID NO: 165158

SEQ ID NO: 736963 - RNA, 64 nt, Homo Sapiens; identical to SEQ ID NO: 165159

SEQ ID NO: 736964 - RNA, 64 nt, Homo Sapiens; identical to SEQ ID NO: 165160

SEQ ID NO: 736965 - RNA, 64 nt, Homo Sapiens; identical to SEQ ID NO: 165161

SEQ ID NO: 736966 - RNA, 64 nt, Homo Sapiens; identical to SEQ ID NO: 165162

SEQ ID NO: 736967 - RNA, 64 nt, Homo Sapiens; identical to SEQ ID NO: 165163

SEQ ID NO: 736968 - RNA, 64 nt, Homo Sapiens; identical to SEQ ID NO: 165164

SEQ ID NO: 736969 - RNA, 64 nt, Homo Sapiens; identical to SEQ ID NO: 165165

SEQ ID NO: 736970 - RNA, 59 nt, Homo Sapiens
ucaacaucaggauccacagcuuaaagaugggaauucagguaugaaagaaaacaggcaag

SEQ ID NO: 736971 - RNA, 59 nt, Homo Sapiens
ggguugugguugguugguauagaauggugggaauucaaauuuuucuaaacucaugguaa

SEQ ID NO: 736972 - RNA, 59 nt, Homo Sapiens
gcccugaggcugccccggugaauguuauuggaauucaucccucgugcacauccuguugu

SEQ ID NO: 736973 - RNA, 59 nt, Homo Sapiens
ucgaaaaugggaaucugaaugucuagaguggaauucaggcuugagaauacaugagggag

SEQ ID NO: 736974 - RNA, 59 nt, Homo Sapiens
uccagagcaaggagccauguuccucuaagggaauucaggaauucagacgugcuaguccc

SEQ ID NO: 736975 - RNA, 59 nt, Homo Sapiens
aaggagccauguuccucuaagggaauucaggaauucagacgugcuagucccacaccagu

SEQ ID NO: 736976 - RNA, 59 nt, Homo Sapiens
uugcacaguucuuuuuuuccauuggaaauggaauucauugccuuaggucuuuuuaaaua

SEQ ID NO: 736977 - RNA, 59 nt, Homo Sapiens
aauuuauacaaauuaagacuaacuuucuuggaauucacuauucuggcaauaaauuuugg

SEQ ID NO: 736978 - RNA, 59 nt, Homo Sapiens
aaaacugguugaacagcggaugaagauauggaauucaaagcucuaauggaccuuuuuga

SEQ ID NO: 736979 - RNA, 59 nt, Homo Sapiens
uuagugucuucucaagcuuucuuuacugaggaauucagcuugugacacagauacauccc

SEQ ID NO: 736980 - RNA, 59 nt, Homo Sapiens
aucaucuacccaucuauuuggaaagcacuggaauucagaugcaagagaacaauguuucu

SEQ ID NO: 736981 - RNA, 59 nt, Homo Sapiens
uggugcugucuagggguccacggguggcaggaauucagaggcuggccuugugcccuggc

SEQ ID NO: 736982 - RNA, 59 nt, Homo Sapiens
auauuucuaacauccuuaaauauacaaucggaauucaagcaucucccauugucccacaa

SEQ ID NO: 736983 - RNA, 59 nt, Homo Sapiens
augaucuauuucagugugccucauugcuuggaauucagcggaauauugauuagaaagaa

SEQ ID NO: 736984 - RNA, 59 nt, Homo Sapiens
uagaaaacacauuguacugugcuuuuucuggaauucaguauaauggcaucacugccugu

SEQ ID NO: 736985 - RNA, 59 nt, Homo Sapiens
gaguucuucaggucuggaaaguaugaccuggaauucaaguuucucgacgaccccaccag

SEQ ID NO: 736986 - RNA, 59 nt, Homo Sapiens
uuacuagauaaaaccagaaauggaaauaaggaauucaggggaguuccagagacuuacaa

SEQ ID NO: 736987 - RNA, 59 nt, Homo Sapiens
acccugggugccauucccagggagacccuggaauucagcugugccuguggcagaaaaga

SEQ ID NO: 736988 - RNA, 59 nt, Homo Sapiens
ucaagguuugaagacuuccuaccccuuauggaauucaaccaggauucaaaagccaaaua

SEQ ID NO: 736989 - RNA, 59 nt, Homo Sapiens
accagccuggccaacauggucugaggucaggaauucaagagcugaggcagguggaucac

SEQ ID NO: 736990 - RNA, 59 nt, Homo Sapiens
cccaugcacuacacucuggagugccucauggaauucaguaggaugggaucacccccuuc

SEQ ID NO: 736991 - RNA, 59 nt, Homo Sapiens
uauugagaaugaaagugaagcaguaauagggaauucacuaaagauuuuuuaggcaauaa

SEQ ID NO: 736992 - RNA, 59 nt, Homo Sapiens
ugaaauccugauaaguuuuaauguaacaaggaauucaacaaauaaugacaauuauuuga

SEQ ID NO: 736993 - RNA, 59 nt, Homo Sapiens
agaaauuugaagaccagaucuagugggguggaauucagaguaguaacugcuacuguauu

SEQ ID NO: 736994 - RNA, 59 nt, Homo Sapiens
gggaccaaugaaagcauggcgggaucuagggaauucaguacagagugugggaacugcug

SEQ ID NO: 736995 - RNA, 59 nt, Homo Sapiens
aauauaucaaauacuuuccuagauagaaaggaauucaacgugcaaauuugccagcuugg

SEQ ID NO: 736996 - RNA, 59 nt, Homo Sapiens
gaauuugguagcacaguguagagguucagggaauucagaguuuugauacuuggaauuuu

SEQ ID NO: 736997 - RNA, 59 nt, Homo Sapiens
augagucaucaucugguccuuugugaaauggaauucaugguauuuucuguaacguuuuc

SEQ ID NO: 736998 - RNA, 59 nt, Homo Sapiens
uccagaacuaccaugagaugguuuagacgggaauucaugcaaaugaggggucaaaaaug

SEQ ID NO: 736999 - RNA, 59 nt, Homo Sapiens
agaaaacugaaauuucaguugucaguuguggaauucaguuuuucaauuguggaaauuuc

SEQ ID NO: 737000 - RNA, 59 nt, Homo Sapiens
ugugacauuauuucaaggauaugugccagggaauucaggaaccaccucaccaaccccau

SEQ ID NO: 737001 - RNA, 59 nt, Homo Sapiens
ggcugaggugggcggaucacuugagcucaggaauucaaggucagccugggcaacauggc

SEQ ID NO: 737002 - RNA, 59 nt, Homo Sapiens
ggcuguggucacgugcucccagaagaccuggaauucaaaagaaauggagcuauucuuuu

SEQ ID NO: 737003 - RNA, 59 nt, Homo Sapiens
cuuccuauaacugugaaaggaggauuucuggaauucagaagagagcuauugaguuugcu

SEQ ID NO: 737004 - RNA, 59 nt, Homo Sapiens
acuuuggcucagcagauugcuugaacccaggaauucaaguccaaucugggcaacauggg

SEQ ID NO: 737005 - RNA, 59 nt, Homo Sapiens
uacuugcauacuuaugagaauuucacauuggaauucauaaugguaaaacaacauacauc

SEQ ID NO: 737006 - RNA, 59 nt, Homo Sapiens
gcuauuuuuauuuguuugugcauuuggggggaauucaucucucuuuaauauaaaguugg

SEQ ID NO: 737007 - RNA, 59 nt, Homo Sapiens
aucagagaagaaaauaacaacuuuuuuacggaauucaucagaggacccuuucacuuuuu

SEQ ID NO: 737008 - RNA, 59 nt, Homo Sapiens
uggagguugaaaagagaaaauccgcaucaggaauucaccccucagggcauggucucauc

SEQ ID NO: 737009 - RNA, 59 nt, Homo Sapiens
ucacagguaguguuucagacuuuugguaaggaauucauugaaucuucuuaaauugaaau

SEQ ID NO: 737010 - RNA, 59 nt, Homo Sapiens
uuuuguuucagugaccaauguuggauuuaggaauucaauaauaaacaucuuuugauugc

SEQ ID NO: 737011 - RNA, 59 nt, Homo Sapiens
uguugaaaucauuugaacuaacaucucaaggaauucagcaaaggaccaaccugccuuac

SEQ ID NO: 737012 - RNA, 59 nt, Homo Sapiens
aguguuccugaagcugcuguaaguccggcggaauucaccccaaagagccgcgucccggc

SEQ ID NO: 737013 - RNA, 59 nt, Homo Sapiens
uauuucacuuaacacaaacguuccaggugggaauucaucccgagugcaaugcuaaacac

SEQ ID NO: 737014 - RNA, 59 nt, Homo Sapiens
uuggcaaaacaaaauguaauuggauaauaggaauucaauguacuccacuggucugucuu

SEQ ID NO: 737015 - RNA, 59 nt, Homo Sapiens
ggaagcccuuuagaauuagauuuauaaagggaauucaaaagcucuucuuugcacaaagc

SEQ ID NO: 737016 - RNA, 59 nt, Homo Sapiens
guaugagccacauuuuguuguggacauauggaauucauaaucaaaugacauuuugacau

SEQ ID NO: 737017 - RNA, 59 nt, Homo Sapiens
caccgacucugagcugcuaggaauacacuggaauucagauuuaucaugcuacagagagu

SEQ ID NO: 737018 - RNA, 59 nt, Homo Sapiens
gcgacggucuaggugucgaggggaagaucggaauucaggggguugagaccaggaaguca

SEQ ID NO: 737019 - RNA, 59 nt, Homo Sapiens
uuuuucaugaccuagaaaaacauagauuuggaauucacuguauuauuuuagauuuauua

SEQ ID NO: 737020 - RNA, 59 nt, Homo Sapiens
ccagacucucugaaaacugcaaauggaaaggaauucaaaagaauuuagauuaaaaguua

SEQ ID NO: 737021 - RNA, 59 nt, Homo Sapiens
cucugguccccaggccccuccaguucaucggaauucagccaugaaacugacucaucagu

SEQ ID NO: 737022 - RNA, 59 nt, Homo Sapiens
uugacuauacuuugcacauguuuucuuuaggaauucacucacacauuuaaaccaguuag

SEQ ID NO: 737023 - RNA, 59 nt, Homo Sapiens
gugccauggauuaucuuuuccauguugauggaauucauucuguuggaauccuuuggcca

SEQ ID NO: 737024 - RNA, 59 nt, Homo Sapiens
uagagauuaggcugaaaaaaauaaguaauggaauucaccuuugcaucuuuugugucuuu

SEQ ID NO: 737025 - RNA, 59 nt, Homo Sapiens
cagauucccuauguaaagcaguuuaaaauggaauucaauguucagugcucagguaugua

SEQ ID NO: 737026 - RNA, 57 nt, Homo Sapiens
acauuuuuauuaguggauagcguuguuggaauucaaaaaacagacaauauugccaua

SEQ ID NO: 737027 - RNA, 59 nt, Homo Sapiens
ucuggaaaagaacuguuuacugcuugauaggaauucaucuuuugaggcuucuguuccuc

SEQ ID NO: 737028 - RNA, 59 nt, Homo Sapiens
ggaccuggcaguugcaacacaguaagucaggaauucaagcgugaacccauauugauaag

SEQ ID NO: 737029 - RNA, 59 nt, Homo Sapiens
uuuacaucgcacuuucaguuccuccauuuggaauucaaaaaggggagggauccugaaga

SEQ ID NO: 737030 - RNA, 59 nt, Homo Sapiens
gaggauaugaaaaaauacuuccgaaaccaggaauucaauguauguuuguuuuauacugu

SEQ ID NO: 737031 - RNA, 59 nt, Homo Sapiens
cagaaguaauaagagaaacaguuacguguggaauucaacaucuuugguuggaacgcauu

SEQ ID NO: 737032 - RNA, 59 nt, Homo Sapiens
uucuagaacagugucauccaacauccuauggaauucagguuuucagcaacacuuauccc

SEQ ID NO: 737033 - RNA, 59 nt, Homo Sapiens
ccugcagaugucaacugaagucacccuggggaauucaacacugugcuacugaugauaca

SEQ ID NO: 737034 - RNA, 59 nt, Homo Sapiens
acccagaauguaggugccacagaaacaagggaauucaagggaaggugagcaaagggagc

SEQ ID NO: 737035 - RNA, 59 nt, Homo Sapiens
gagguguugcagcguaucacuuggcuaauggaauucacacuauguuuuaaugacagaac

SEQ ID NO: 737036 - RNA, 59 nt, Homo Sapiens
agagaagugucuccuccucgaacugagauggaauucaagaagaguguggaaauaaagag

SEQ ID NO: 737037 - RNA, 59 nt, Homo Sapiens
gugggagccuucuuuuuuuucacacccauggaauucaagaccccgaagaaugaaaagua

SEQ ID NO: 737038 - RNA, 59 nt, Homo Sapiens
aaaauauaauuaaaacacauguucuuccuggaauucaugguaacauuaacugcaaugau

SEQ ID NO: 737039 - RNA, 59 nt, Homo Sapiens
agggggugugauggaugcaaagggaaugaggaauucagcacugcauucucuuugcaccc

SEQ ID NO: 737040 - RNA, 59 nt, Homo Sapiens
uugauuuggcuuuacuuacuaggaagccuggaauucauuauuuuuuuccuuuuaugugc

SEQ ID NO: 737041 - RNA, 59 nt, Homo Sapiens
uggcugggcagagccugugugaaaauacuggaauucaaagauaaggcaacaaaaugguu

SEQ ID NO: 737042 - RNA, 59 nt, Homo Sapiens
cagguuuuugaugaauauaaugaauguauggaauucaauugaauuugcauggucuucgg

SEQ ID NO: 737043 - RNA, 59 nt, Homo Sapiens
ccuguaaucaugguaucauuacaaugaaaggaauucacaaacuacugccagaggaaguu

SEQ ID NO: 737044 - RNA, 59 nt, Homo Sapiens
aacauuuggaguguguauuccccuggaauggaauucaguauuucaucugaguguggagu

SEQ ID NO: 737045 - RNA, 59 nt, Homo Sapiens
caugacucaaaccuggauguguugggauuggaauucaggaucauauaguaaguagcaga

SEQ ID NO: 737046 - RNA, 59 nt, Homo Sapiens
accagccuggccaacauggucugaggucaggaauucaagggccaagguggguagaucau

SEQ ID NO: 737047 - RNA, 59 nt, Homo Sapiens
auuaucauuuugaagucugugugaaauuuggaauucaguuuauagucaucuguuaugcu

SEQ ID NO: 737048 - RNA, 59 nt, Homo Sapiens
aaauuaaauauuacuuuaaauuguaaaugggaauucaugaucauuccuguccauuccac

SEQ ID NO: 737049 - RNA, 59 nt, Homo Sapiens
ugcucaaucacugccuuucucaaauggauggaauucagcacucugagguccuuacccac

SEQ ID NO: 737050 - RNA, 59 nt, Homo Sapiens
gcugcaguaagcuacgaucauugaacccaggaauucaagggcagaggagggaggaucac

SEQ ID NO: 737051 - RNA, 59 nt, Homo Sapiens
aacucauguguucagcucaagacuccacaggaauucaacccccagaaagacauaaacuu

SEQ ID NO: 737052 - RNA, 59 nt, Homo Sapiens
guguaguacuauauuaagugcacuugaguggaauucaacauuugacuaauaaaaugagu

SEQ ID NO: 737053 - RNA, 59 nt, Homo Sapiens
gcuuuuagggcagccaauauuuuauuauuggaauucagacacuguucuuaccguguuug

SEQ ID NO: 737054 - RNA, 59 nt, Homo Sapiens
guaucaacauuuggguugguauucagaugggaauucaaauaugaauccucucuggagag

SEQ ID NO: 737055 - RNA, 59 nt, Homo Sapiens
ccuaaguaucaaguauagaaaaucuucauggaauucacaaaguaauuuggaaauuaggu

SEQ ID NO: 737056 - RNA, 59 nt, Homo Sapiens
augggacuuuuaaaagaagggcuauuuaaggaauucacuugguaguacuuugcuuuagc

SEQ ID NO: 737057 - RNA, 59 nt, Homo Sapiens
uuuaugucuuugagagagauacaggucuuggaauucacuuuuuaaauguuacguuccaa

SEQ ID NO: 737058 - RNA, 59 nt, Homo Sapiens
uaguaauuuguauguaaugucaaauaaaaggaauucaaaucugaguaaauaacagccuc

SEQ ID NO: 737059 - RNA, 59 nt, Homo Sapiens
uaugaucuuagggaacuuugauacaaaugggaauucacucacuggaaucguggcuccca

SEQ ID NO: 737060 - RNA, 59 nt, Homo Sapiens
aaagucauuuugaaauuaaccuccuaaaaggaauucauauuuuaaaggaaaaaaauaca

SEQ ID NO: 737061 - RNA, 59 nt, Homo Sapiens
aacuggcaaugcuguagaagucagccguaggaauucaaaauggcuggccuaccuuggcu

SEQ ID NO: 737062 - RNA, 59 nt, Homo Sapiens
cacuuaagucagagccuuccuccccaucuggaauucacagcuguucccuggcagcacac

SEQ ID NO: 737063 - RNA, 59 nt, Homo Sapiens
ccgcauggacucugggaucaaacacguauggaauucauuugcuccuuaugugaauuuca

SEQ ID NO: 737064 - RNA, 59 nt, Homo Sapiens
gaauaaauguuauuuuuaagugcuguaaaggaauucaauacaucaaacaauugaucaug

SEQ ID NO: 737065 - RNA, 59 nt, Homo Sapiens
gcuuauggaaaucaaaucccgaaacggauggaauucaugucucuucuauacucugugcu

SEQ ID NO: 737066 - RNA, 59 nt, Homo Sapiens
acuuugcuuuaaaaaaauuucuuggauugggaauucaguauauauauauauaaaggaau

SEQ ID NO: 737067 - RNA, 59 nt, Homo Sapiens
ucaaaaucaucaaagucuaaaggaaaccaggaauucauuacuggcucccaggggaauag

SEQ ID NO: 737068 - RNA, 59 nt, Homo Sapiens
aagugcauauccuaacuugcaugcaucuuggaauucaguucugaucucaccauuucacc

SEQ ID NO: 737069 - RNA, 59 nt, Homo Sapiens
ucugauguuuuuaaagaaaaauuuuagaaggaauucagcguuguuguuguuguuguugu

SEQ ID NO: 737070 - RNA, 59 nt, Homo Sapiens
cugcgaaaagcaaugaauaaauguugcuaggaauucauauugcuaaacugcccucucaa

SEQ ID NO: 737071 - RNA, 59 nt, Homo Sapiens
ugguguccaagacuuaucuuuuaaaauguggaauucaguccaccaugccuggccccaau

SEQ ID NO: 737072 - RNA, 59 nt, Homo Sapiens
uuauuaaaaauuggugucugucccuuuggggaauucauuagccuuaauucagucaagac

SEQ ID NO: 737073 - RNA, 59 nt, Homo Sapiens
aaaaaaugugaacaauaauagcuacauuuggaauucaauuaauuuguuuuaaugauuuu

SEQ ID NO: 737074 - RNA, 59 nt, Homo Sapiens
cauccuggccuugccaaggucuuggcucuggaauucaugaggcccuguugacgggcugu

SEQ ID NO: 737075 - RNA, 59 nt, Homo Sapiens
uccaauugacugcccucuuacuguuuugaggaauucagaaguggagauuucaguucagc

SEQ ID NO: 737076 - RNA, 59 nt, Homo Sapiens
auuaguuuauacaccacuuuugccgcuggggaauucaaguugaaaugucccucaaucau

SEQ ID NO: 737077 - RNA, 59 nt, Homo Sapiens
auuuacuucuguuacagaccuaguuacugggaauucauuacuugccauggacuaccuuu

SEQ ID NO: 737078 - RNA, 59 nt, Homo Sapiens
uguuuugaaagaagaaacucccaggaauuggaauucagcaccuguuccgcacguaauug

SEQ ID NO: 737079 - RNA, 59 nt, Homo Sapiens
cacagcaggcagggcacccaggccuuauaggaauucacccuggaccaugcccuaaaaua

SEQ ID NO: 737080 - RNA, 59 nt, Homo Sapiens
aacaaaucuuugaaaagcaaucuuggaaaggaauucauuaacuaaaugggguaaaaggu

SEQ ID NO: 737081 - RNA, 59 nt, Homo Sapiens
uccacacaugguuuguucaaguaaugaauggaauucaauauuuagcagaaacuaacucc

SEQ ID NO: 737082 - RNA, 59 nt, Homo Sapiens
ggaucagagcacugagaaacgacagaggaggaauucacgauucauugggaaaucacggg

SEQ ID NO: 737083 - RNA, 59 nt, Homo Sapiens
uuuuugcuacaaccuccaguggcauuuccggaauucacuggguugcuacuguccacaua

SEQ ID NO: 737084 - RNA, 59 nt, Homo Sapiens
ggugagaguguucuuuuaacuuguacuagggaauucauugaguuucagaaacagaauuu

SEQ ID NO: 737085 - RNA, 59 nt, Homo Sapiens
uguugcaggacagaugagcuuuugugaaaggaauucaaggcuuucuggggaggugugug

SEQ ID NO: 737086 - RNA, 59 nt, Homo Sapiens
accagccugggcaacaugguuugagcccaggaauucaagggcugagguggguagauuac

SEQ ID NO: 737087 - RNA, 59 nt, Homo Sapiens
auuaaagauuccuaaaaauaauuuagagaggaauucaugaagucauaaaauauuuugaa

SEQ ID NO: 737088 - RNA, 59 nt, Homo Sapiens
uuguuauugguuaagaaaaaaggauaugaggaauucauuuuaucaauguagcugugaag

SEQ ID NO: 737089 - RNA, 59 nt, Homo Sapiens
ucguauuucucauaggcuaugccaugugcggaauucaaguuaccaauguaacacuggcc

SEQ ID NO: 737090 - RNA, 59 nt, Homo Sapiens
gcgaaugacaguagcauuaugaguaguguggaauucagguaguaaauaugaaacuaggg

SEQ ID NO: 737091 - RNA, 59 nt, Homo Sapiens
acuugagaaucacuuguuaguucuugguaggaauucaguugggcaaugauaacuuuuau

SEQ ID NO: 737092 - RNA, 59 nt, Homo Sapiens
aauauggguuggccuauauuaaacaacaaggaauucauuucagagaaaagcccuauacg

SEQ ID NO: 737093 - RNA, 59 nt, Homo Sapiens
gggggagguauaugaugagcagacuucucggaauucauaauaaauuuucuaaaagccua

SEQ ID NO: 737094 - RNA, 59 nt, Homo Sapiens
gaagaauguaucacucuuauucaagcaaaggaauucagacuuaaaugccuaccucugug

SEQ ID NO: 737095 - RNA, 59 nt, Homo Sapiens
guuaccugcaauuauucuuaacacuacauggaauucacuggguaauugugggucauuua

SEQ ID NO: 737096 - RNA, 59 nt, Homo Sapiens
uaaaaagucuugagaucccaccauucugaggaauucaauaugaucacuuuuuccuucuu

SEQ ID NO: 737097 - RNA, 59 nt, Homo Sapiens
caaacaagcauccuuuacuaacaagagcaggaauucagaggcacaagaaaaagcauugg

SEQ ID NO: 737098 - RNA, 59 nt, Homo Sapiens
guguuuucauuugaugucguucuaacauaggaauucacucagacauugccgagugacuu

SEQ ID NO: 737099 - RNA, 59 nt, Homo Sapiens
guguuuucauuugaugucguuguaacauaggaauucacucagugcagagcacaaugcug

SEQ ID NO: 737100 - RNA, 59 nt, Homo Sapiens
ccgaggcgagccggcagagcggucugcguggaauucaggguucuuuggccgaagacgug

SEQ ID NO: 737101 - RNA, 59 nt, Homo Sapiens
ggacccccugagaagagccagaagcagagggaauucacacaccaggcucagcgcaagag

SEQ ID NO: 737102 - RNA, 59 nt, Homo Sapiens
gcuagagugagccgugaucauugggcccaggaauucaagggcugaggugggagaauugc

SEQ ID NO: 737103 - RNA, 59 nt, Homo Sapiens
acacuuuucucccucuuacuuggauacauggaauucagcaguuaacaauggcugcaagc

SEQ ID NO: 737104 - RNA, 59 nt, Homo Sapiens
uggggaaguucggaaaacugauaaagaaaggaauucauauuuugcuguucuagaaaauc

SEQ ID NO: 737105 - RNA, 59 nt, Homo Sapiens
uucugaccagccagguaaggaaggccaagggaauucagaacccagaaugggaaggaaag

SEQ ID NO: 737106 - RNA, 59 nt, Homo Sapiens
gcccagucgccagggggcgcucuguuuccggaauucaccgcgggguuguugggggggcc

SEQ ID NO: 737107 - RNA, 59 nt, Homo Sapiens
uaucugucucucuccugcaagaagcugauggaauucauaauugggcagcuccccuggaa

SEQ ID NO: 737108 - RNA, 59 nt, Homo Sapiens
cauugacaccucuuuucugcacaaauacuggaauucaaugucaagagaaaaugaccucu

SEQ ID NO: 737109 - RNA, 59 nt, Homo Sapiens
uuuuuuaauguaaucauuugcauugguuaggaauucagaauuccgccggcucuauuacu

SEQ ID NO: 737110 - RNA, 59 nt, Homo Sapiens
gaggccgcuuucugcccaguggcguugggggaauucagccuucauuuauaaucagugag

SEQ ID NO: 737111 - RNA, 59 nt, Homo Sapiens
auucagucuguuuggugucugcacagacuggaauucaaucugucaaauuuguuuuauuc

SEQ ID NO: 737112 - RNA, 56 nt, Homo Sapiens
ucguuuuugaugcucgaugaaugcugggaauucagaggaaugucuucacuuauacu

SEQ ID NO: 737113 - RNA, 59 nt, Homo Sapiens
gagcagagcugugaagaacuaucagauuuggaauucaaugacacucgaguucuggucca

SEQ ID NO: 737114 - RNA, 59 nt, Homo Sapiens
gcauaaauguggacagauuucaguaaaaaggaauucauguagugaguccuacgguauuu

SEQ ID NO: 737115 - RNA, 59 nt, Homo Sapiens
auaccuaagcugcuucuuuaaacugggauggaauucagaucuuuauacucacuuaaacc

SEQ ID NO: 737116 - RNA, 59 nt, Homo Sapiens
uguuuaaagauaauccuuuccaagagcauggaauucaugcacccacagagagagagcug

SEQ ID NO: 737117 - RNA, 59 nt, Homo Sapiens
uaauuuguuuuuaaaauugagaguaagagggaauucagcagacuugaaauaacacuuca

SEQ ID NO: 737118 - RNA, 59 nt, Homo Sapiens
gaaguguuuucaccauggauuuccacugaggaauucaggagaaucugaacaccucuucu

SEQ ID NO: 737119 - RNA, 59 nt, Homo Sapiens
aagauuggguagaacugguaaaacaaguuggaauucaccacuaaagaagauaacuaagc

SEQ ID NO: 737120 - RNA, 59 nt, Homo Sapiens
uacauuaagcuuuagugaagaguucauuuggaauucagguuuccccagauuagucauac

SEQ ID NO: 737121 - RNA, 59 nt, Homo Sapiens
agcuuguaaugucuuaugaauucuugaugggaauucaaucaauuaaauagaaauagguu

SEQ ID NO: 737122 - RNA, 59 nt, Homo Sapiens
acuugacuggggauggcgcaugcaugggaggaauucaucuucagucuaccagcccccgc

SEQ ID NO: 737123 - RNA, 59 nt, Homo Sapiens
uuuugagacugagaugcgugagcuuuacuggaauucaggugccugugaccugccgccua

SEQ ID NO: 737124 - RNA, 59 nt, Homo Sapiens
ccccacaaggacaguguguaacacauccuggaauucauaacacauguaaauccuugaag

SEQ ID NO: 737125 - RNA, 59 nt, Homo Sapiens
ggaaaguguuucuuggguuucuuuuuuugggaauucaagcuccauguguauuuugccca

SEQ ID NO: 737126 - RNA, 59 nt, Homo Sapiens
aacagacucuggaguguccaucuugcaauggaauucaagugaaaguaggaaguuggagc

SEQ ID NO: 737127 - RNA, 59 nt, Homo Sapiens
uaagaucuguuaauaagaugaaauuaaguggaauucaacugucucagcuguccccaggg

SEQ ID NO: 737128 - RNA, 59 nt, Homo Sapiens
guauauugacuauauaguguauaguauaaggaauucacaauuacaaacccauucauuac

SEQ ID NO: 737129 - RNA, 59 nt, Homo Sapiens
augggaaaucuuuuucauuuuauagcaaaggaauucauagcuugggguguuugaauguc

SEQ ID NO: 737130 - RNA, 59 nt, Homo Sapiens
aaucuguuuuuugaucaguauauggcuuuggaauucaaucaugucugauaugguaguau

SEQ ID NO: 737131 - RNA, 59 nt, Homo Sapiens
uuacaguuauguacuggauggauuuguuuggaauucaaauggguuucuguguuauugag

SEQ ID NO: 737132 - RNA, 59 nt, Homo Sapiens
ccuaguggcuguguagaggcgaaugcuccggaauucauagcggcuccggcggaugucag

SEQ ID NO: 737133 - RNA, 59 nt, Homo Sapiens
auuuuuuagcaaguuugcuuuaaccucauggaauucagguguuuggaggauuucagagu

SEQ ID NO: 737134 - RNA, 59 nt, Homo Sapiens
gagucuugucaaaagguacagaccauugaggaauucauuagaaacaaggaugguguggu

SEQ ID NO: 737135 - RNA, 59 nt, Homo Sapiens
aaugaucacuguaaacuggcucugucucaggaauucacccaggcagccuggagucagcc

SEQ ID NO: 737136 - RNA, 59 nt, Homo Sapiens
ggccgaggcagguggaucauuugagcucaggaauucaagaccagccuggguaauauggc

SEQ ID NO: 737137 - RNA, 59 nt, Homo Sapiens
ucccuuggacuaauuuuuaagucucgauuggaauucagugaguagguucauaaugugca

SEQ ID NO: 737138 - RNA, 59 nt, Homo Sapiens
gaggugaacaagacaaggaaugccaucagggaauucaccuuuuauuaggaaaauauaaa

SEQ ID NO: 737139 - RNA, 59 nt, Homo Sapiens
uucaucacugggaguguccuaaauggaggggaauucauuauguacauaccuccuugcac

SEQ ID NO: 737140 - RNA, 59 nt, Homo Sapiens
cacacuccagaaagccaggagggggguggggaauucagcugggaacuuuuuugggggcg

SEQ ID NO: 737141 - RNA, 59 nt, Homo Sapiens
uugguguuucucucuguaauagcaacaguggaauucaccuaugccaauaaaaaugucuc

SEQ ID NO: 737142 - RNA, 59 nt, Homo Sapiens
aggaguaaauggcuuucaugggacccugaggaauucacccacggaaaguguugaaccug

SEQ ID NO: 737143 - RNA, 59 nt, Homo Sapiens
ugaucagcucuuaaaagaaacaaguacuaggaauucagaaaaaaaaaaaaauuuacuug

SEQ ID NO: 737144 - RNA, 59 nt, Homo Sapiens
agguguguuuucuagaaaaguucccuaauggaauucaugaguuugggggucucagucac

SEQ ID NO: 737145 - RNA, 59 nt, Homo Sapiens
ccauuuccugacaucugcauguaccucguggaauucagccagcuucauguugcaaauca

SEQ ID NO: 737146 - RNA, 59 nt, Homo Sapiens
cccucuuuggaacagauauuuagcucuguggaauucagugacaaaaugggaggaggaaa

SEQ ID NO: 737147 - RNA, 59 nt, Homo Sapiens
aucugcagcgggaucuccaaccagccgcuggaauucacguuccagaaaagagagcugcc

SEQ ID NO: 737148 - RNA, 59 nt, Homo Sapiens
cuccccccacacccaacaaaauacaguuuggaauucacugaaacaguaccagcaaguca

SEQ ID NO: 737149 - RNA, 59 nt, Homo Sapiens
ggcugccucaggaaaauuccuagauccuaggaauucagugagacccugggaaggaccag

SEQ ID NO: 737150 - RNA, 59 nt, Homo Sapiens
ucuguuaacuuucuuuguguguuccugauggaauucaccauagccuuacagcuuuucuc

SEQ ID NO: 737151 - RNA, 59 nt, Homo Sapiens
gcucccuaagguccuugacuuucuccccaggaauucacuuaaaaagggacugagcauug

SEQ ID NO: 737152 - RNA, 59 nt, Homo Sapiens
uguguuucguguauaugccuucugaacguggaauucaccccuuggggaugggacccaag

SEQ ID NO: 737153 - RNA, 59 nt, Homo Sapiens
acuccccaaagaaaauacaugacacacaaggaauucacaucauuacauagugauagcug

SEQ ID NO: 737154 - RNA, 59 nt, Homo Sapiens
uaggagcuaggagacaacaaaaagccaauggaauucaaauaacucaauaacuuucuaua

SEQ ID NO: 737155 - RNA, 59 nt, Homo Sapiens
auuuucuuaaagaaaggaugcucaucauuggaauucagucucuuaaacccagucagaag

SEQ ID NO: 737156 - RNA, 59 nt, Homo Sapiens
uuuuccaucugccacauggauugcugucuggaauucaguugcuauuaggugaggguuuc

SEQ ID NO: 737157 - RNA, 59 nt, Homo Sapiens
guaauguaaaagacuaaauauuccaacaaggaauucagacauuaaguaguuaauaauaa

SEQ ID NO: 737158 - RNA, 59 nt, Homo Sapiens
uuacaauagaaaugaacaagguugacaguggaauucaccccaacaaaaauaacaaugcu

SEQ ID NO: 737159 - RNA, 59 nt, Homo Sapiens
aauuuuucuucuuuauugaccuuuaauuuggaauucagucugugggagcucguuuuauu

SEQ ID NO: 737160 - RNA, 59 nt, Homo Sapiens
agaacuuugaauuuuuuuuuuuuuuucccggaauucaucuuuuaccacuuugggguugc

SEQ ID NO: 737161 - RNA, 59 nt, Homo Sapiens
uucuuuaguuuauucuuacuagaugcagaggaauucaucuacugucuguuauuaacugu

SEQ ID NO: 737162 - RNA, 59 nt, Homo Sapiens
cuuuuaaacucacuuuaaaauuuuggcaaggaauucaugcauaacugagacuuggaggc

SEQ ID NO: 737163 - RNA, 59 nt, Homo Sapiens
uuuuguuauguguaggauaccagcuucagggaauucauaguucaaauccuagaucguua

SEQ ID NO: 737164 - RNA, 59 nt, Homo Sapiens
gauagcugaaauagauacaacuaaagauaggaauucacugugggaaggggagugaggcc

SEQ ID NO: 737165 - RNA, 59 nt, Homo Sapiens
uauugguuucaguaccaaguaauuucauuggaauucaugagaguuaaagugaaaauugg

SEQ ID NO: 737166 - RNA, 59 nt, Homo Sapiens
cagcaaagugccagccaauuuguccuggaggaauucauagccucauggggcaaaaguaa

SEQ ID NO: 737167 - RNA, 51 nt, Homo Sapiens
caagaucuguaucaagauaaaggaauucaaauagcauauauaugaccaugu

SEQ ID NO: 737168 - RNA, 59 nt, Homo Sapiens
cuacuaaagaugcagaaauugaugaucuuggaauucaucauaacauggaaucuacagua

SEQ ID NO: 737169 - RNA, 59 nt, Homo Sapiens
aauaauuuuuuuuaaaacauuaaggaauuggaauucagaaagguuacccccuuccucug

SEQ ID NO: 737170 - RNA, 59 nt, Homo Sapiens
ccaacagaaaagaaacauuuguuugcauaggaauucaugaaggcgacccaaccuggaaa

SEQ ID NO: 737171 - RNA, 59 nt, Homo Sapiens
gucaguuccuuuacagaggaauuuacaaaggaauucagugacacuucagcugagauuga

SEQ ID NO: 737172 - RNA, 59 nt, Homo Sapiens
ucucuuccucccucauggaauguuccuggggaauucacucgagagcugaucaaguucuu

SEQ ID NO: 737173 - RNA, 59 nt, Homo Sapiens
cucaacugggccauccauguugggacuugggaauucacuccauauggccaccuggacau

SEQ ID NO: 737174 - RNA, 59 nt, Homo Sapiens
gccuucaacaacgugagagaggacccucaggaauucaguacgaggggcagggaaggaca

SEQ ID NO: 737175 - RNA, 59 nt, Homo Sapiens
accagccuggccaacaugguuugaggucaggaauucaagggcugaggcagguggcucac

SEQ ID NO: 737176 - RNA, 59 nt, Homo Sapiens
gccacacucugaauacauuuuaugucucaggaauucacauuccagguucaggaauuuua

SEQ ID NO: 737177 - RNA, 59 nt, Homo Sapiens
cccuccaccuacgagccccaccaggagggggaauucauccuccgggucuucucugaaaa

SEQ ID NO: 737178 - RNA, 59 nt, Homo Sapiens
gaggucgaggcagguagaucacgaggucaggaauucaagaccagccuggccaacaugug

SEQ ID NO: 737179 - RNA, 59 nt, Homo Sapiens
uuauaaaaacaguuuacauuaaacaucuuggaauucaacaauagugaucucacucaaau

SEQ ID NO: 737180 - RNA, 59 nt, Homo Sapiens
cucuucccuucccacccucuugucuucagggaauucagaggauugcucuccaaggccau

SEQ ID NO: 737181 - RNA, 59 nt, Homo Sapiens
augcauaucgaguuugcccuuagguggugggaauucaaacacacaaagacccacuaauu

SEQ ID NO: 737182 - RNA, 59 nt, Homo Sapiens
caaugggcuuugcugcuuaugagcacagaggaauucaguccccaggcagcccugccucu

SEQ ID NO: 737183 - RNA, 59 nt, Homo Sapiens
uuguguucugcucacuaagcauggaggcuggaauucagccacaagggcaccugcagcua

SEQ ID NO: 737184 - RNA, 59 nt, Homo Sapiens
accuuuauuaaccccuggcauaggaauuuggaauucacaccagcaaagccauauucggc

SEQ ID NO: 737185 - RNA, 59 nt, Homo Sapiens
aagcaaaucacauagugacauaucuuuuaggaauucaggacaguggcugcucugcugac

SEQ ID NO: 737186 - RNA, 59 nt, Homo Sapiens
accagccuggccaacauggccugaggucaggaauucaaggccugaggucggcggacugc

SEQ ID NO: 737187 - RNA, 59 nt, Homo Sapiens
acagaggcaaaugacuccuguguagucuuggaauucaugcccagcaucucuuaaaacuu

SEQ ID NO: 737188 - RNA, 59 nt, Homo Sapiens
guuuggggcaaggguaauugcugagauagggaauucaagcuuguuggauaguaguacca

SEQ ID NO: 737189 - RNA, 59 nt, Homo Sapiens
gcugcuugcuguaacugugucaagcagcaggaauucaaagaugggaugcacucucagac

SEQ ID NO: 737190 - RNA, 59 nt, Homo Sapiens
agagcuugcaggcaagccagugggcccaaggaauucagaugagcacuuugcaagagaga

SEQ ID NO: 737191 - RNA, 59 nt, Homo Sapiens
uuuguggaaucugguguuugacugacaaaggaauucagucuacugcuaaauauuggauu

SEQ ID NO: 737192 - RNA, 59 nt, Homo Sapiens
caaagaacaaaaccaguaacaaacacaaaggaauucagggucgcuuugcuugcucucug

SEQ ID NO: 737193 - RNA, 59 nt, Homo Sapiens
gggcuugcuccugcaaccaguaucuccuuggaauucauccaaagcccccauggacgcau

SEQ ID NO: 737194 - RNA, 59 nt, Homo Sapiens
aaaccucaugacaguauugagggaacaugggaauucauacugagaugcaaucucucaac

SEQ ID NO: 737195 - RNA, 59 nt, Homo Sapiens
auuccuuccgaaaccccugagcaugagacggaauucaucgguugccuucaucaguuaca

SEQ ID NO: 737196 - RNA, 59 nt, Homo Sapiens
auucccuucuccuuuuguacucuugcacuggaauucaaccuaauugugcuguguucgug

SEQ ID NO: 737197 - RNA, 59 nt, Homo Sapiens
cccagaaagacauaaacuuggucuccacaggaauucaacaacucaaacguucaguucaa

SEQ ID NO: 737198 - RNA, 59 nt, Homo Sapiens
cagaucgggagacaggauguugacauauaggaauucagcuccacaaagcuucaggccug

SEQ ID NO: 737199 - RNA, 59 nt, Homo Sapiens
cuguuuaauuuacagaaaaggaaauggugggaauucagugucuuuagauacugaagaca

SEQ ID NO: 737200 - RNA, 59 nt, Homo Sapiens
acaaaggggugggaagccaggagugagaaggaauucagggagagcaaaggagccagugc

SEQ ID NO: 737201 - RNA, 59 nt, Homo Sapiens
ggucucuacuguggcaaaugccaacuguuggaauucacuuuauuguagaaaaacccaaa

SEQ ID NO: 737202 - RNA, 59 nt, Homo Sapiens
cuuucccagcaaccccccauuucuguuugggaauucauaugaucugccagagccucucc

SEQ ID NO: 737203 - RNA, 59 nt, Homo Sapiens
ggcugagacaggcggaucaccugaggccaggaauucaagaccagccuggccaacauggu

SEQ ID NO: 737204 - RNA, 59 nt, Homo Sapiens
caacaucuacacugcugcucuucaccauuggaauucacugugguauuuauaguauuggc

SEQ ID NO: 737205 - RNA, 59 nt, Homo Sapiens
uauggacaaacacugaaauuacauuuuagggaauucauccucuaagaauuauguuuuug

SEQ ID NO: 737206 - RNA, 59 nt, Homo Sapiens
auuaaaagaaauauacaguuugacuuuuuggaauucagcaguuuuauccuggccuugua

SEQ ID NO: 737207 - RNA, 59 nt, Homo Sapiens
ggaugcaucuggggagagcaaagcacuaaggaauucagcaucagccugcagagggcuga

SEQ ID NO: 737208 - RNA, 59 nt, Homo Sapiens
gacaaucuccuaauaaauugccuuccaaaggaauucauuccuuuuguccaaacucccuu

SEQ ID NO: 737209 - RNA, 59 nt, Homo Sapiens
ucagcuucuuccuagguccaggcccuggaggaauucagcuccccuggggguuucaccug

SEQ ID NO: 737210 - RNA, 59 nt, Homo Sapiens
accgcaaggaaauuauggguuccccacuuggaauucagccucugaggggucucuaauaa

SEQ ID NO: 737211 - RNA, 59 nt, Homo Sapiens
cugugaaaucaaaaccauguggauuccagggaauucauauuaaccaauuaccuuuuccc

SEQ ID NO: 737212 - RNA, 59 nt, Homo Sapiens
uuaaaccccauaaaccaacuaagccuuauggaauucacagucacaaaaucgaaguuaau

SEQ ID NO: 737213 - RNA, 59 nt, Homo Sapiens
ggauuagcaaaggguagcaggagcuucagggaauucaggaaaugccagcauuggaauuu

SEQ ID NO: 737214 - RNA, 59 nt, Homo Sapiens
uauaucaugaccaaguggaauuuaucccaggaauucaagguugguucaacaucuaaaaa

SEQ ID NO: 737215 - RNA, 59 nt, Homo Sapiens
uugaaguucuagccacagcaguuagguuaggaauucaagguuuguucaacaucuaaaaa

SEQ ID NO: 737216 - RNA, 59 nt, Homo Sapiens
agcagaaggucaggauagcaggagcaugaggaauucagggcaauugcuaguugucuuga

SEQ ID NO: 737217 - RNA, 59 nt, Homo Sapiens
gaugaaaagaaagaauaauuuuguuuucaggaauucagguaauaaaaaaaaaugggaga

SEQ ID NO: 737218 - RNA, 59 nt, Homo Sapiens
cauguacggucugacuucuuaguggagcuggaauucaaaccccagauaacucaguaaac

SEQ ID NO: 737219 - RNA, 59 nt, Homo Sapiens
aagcaagugguaugugacaauucuuuuauggaauucaugcuuuacagcucucaucuaac

SEQ ID NO: 737220 - RNA, 59 nt, Homo Sapiens
acuguuccucaauccuuacuaaacauaagggaauucauaauagagaaacccuacaaaug

SEQ ID NO: 737221 - RNA, 59 nt, Homo Sapiens
cgccaccuugguccuagugucuauucccuggaauucacccucucauguuucccuacuaa

SEQ ID NO: 737222 - RNA, 59 nt, Homo Sapiens
ggugcaggcaggcagauggcuugagcccaggaauucaagaccaguccgagcaacauagc

SEQ ID NO: 737223 - RNA, 59 nt, Homo Sapiens
ggugguggguuuuuuuaaggaacugcguaggaauucaguugcugcggacggagcgcgga

SEQ ID NO: 737224 - RNA, 59 nt, Homo Sapiens
aacagcuuaucucuguaguuuacagaucaggaauucaagguuuauucucuaacaauuuc

SEQ ID NO: 737225 - RNA, 59 nt, Homo Sapiens
aaacauaucauccuuggagaaaggaaaagggaauucauugcauuaugaagaaugaagcu

SEQ ID NO: 737226 - RNA, 59 nt, Homo Sapiens
uuggagaaaaacccugcaaacaacaucagggaauucagagcaguuacuuaaacuuuguu

SEQ ID NO: 737227 - RNA, 59 nt, Homo Sapiens
aaccuaaaacaagauguuacuuccuaauaggaauucauuaaacugucccaaagugcugc

SEQ ID NO: 737228 - RNA, 59 nt, Homo Sapiens
gacggacccagccuggcuaacaacaggauggaauucaggacauugugacgcccagguug

SEQ ID NO: 737229 - RNA, 59 nt, Homo Sapiens
aauaucuguucccagccccuccugcggaaggaauucaggaaauugacccccaaauacau

SEQ ID NO: 737230 - RNA, 59 nt, Homo Sapiens
uauuuaucauaacucuugcuucucuucauggaauucagcuugucaugccaugagucuuu

SEQ ID NO: 737231 - RNA, 59 nt, Homo Sapiens
gccuguagcuggcuggcugauuucauuuuggaauucauuugccauccacagccuuacac

SEQ ID NO: 737232 - RNA, 59 nt, Homo Sapiens
uccauaagaagucguuuuuagggagaacgggaauucagacaagcugcauuucagaaaug

SEQ ID NO: 737233 - RNA, 59 nt, Homo Sapiens
aaaaauguuguguagugcaugcucuguguggaauucagaggaaaacccagauucaguga

SEQ ID NO: 737234 - RNA, 59 nt, Homo Sapiens
ucagaucccacagggccuccucuuuagcaggaauucacaacaguuuggaugcccuaaac

SEQ ID NO: 737235 - RNA, 59 nt, Homo Sapiens
uuuaaauuucuuacuacuguuagaucccaggaauucauuaauaaucauccuuggcuuuc

SEQ ID NO: 737236 - RNA, 59 nt, Homo Sapiens
gaaacccauacucuagucguaugcauauuggaauucaaaugagugucacuugauaggcu

SEQ ID NO: 737237 - RNA, 59 nt, Homo Sapiens
gcuuuccccauaucuucucucuucggugaggaauucaggcacuccccucugagauuggc

SEQ ID NO: 737238 - RNA, 59 nt, Homo Sapiens
auaucaucuugaguauagcaauaucaaaaggaauucaguaguuacugcuguuuaggaau

SEQ ID NO: 737239 - RNA, 59 nt, Homo Sapiens
gguucaugugggauucugggagcuuucugggaauucaguuggagucaagucaggaugcu

SEQ ID NO: 737240 - RNA, 59 nt, Homo Sapiens
uuuuguucacugauacaaaaaaaaaaaaaggaauucaugaugcuguacagaauuuuauu

SEQ ID NO: 737241 - RNA, 59 nt, Homo Sapiens
cccucaaucuggggucuagaguugugcaaggaauucagcuccaguaaggccuggauugc

SEQ ID NO: 737242 - RNA, 59 nt, Homo Sapiens
ugcacucuauucaagugcaauuugauuuuggaauucagguuuuuaauuguucuuuuuua

SEQ ID NO: 737243 - RNA, 59 nt, Homo Sapiens
uuuguagaccauagaccauuaaaaaauacggaauucaaaaguuacaaaaaggguauucu

SEQ ID NO: 737244 - RNA, 59 nt, Homo Sapiens
gccacccacugcugccccaagcucacucaggaauucacacccgccugguuucuugaagu

SEQ ID NO: 737245 - RNA, 59 nt, Homo Sapiens
aaaugccagacuucuaaaauaaauguuuuggaauucaauggguaaauaaaugcugcuuu

SEQ ID NO: 737246 - RNA, 59 nt, Homo Sapiens
uuguccugcagagguucauucucaguuugggaauucaaagcauauuuguuucgcucuua

SEQ ID NO: 737247 - RNA, 59 nt, Homo Sapiens
uaaaaucuagauaauucuacauauucugaggaauucaugcuccuguggcucuugcuuau

SEQ ID NO: 737248 - RNA, 59 nt, Homo Sapiens
cuuagguuugcucaauucuuauuuaccgaggaauucaaggccgguucucggguccuuga

SEQ ID NO: 737249 - RNA, 59 nt, Homo Sapiens
ugggcccagcgagcgaacccugaggaccuggaauucauccgcagcacgguccucaagga

SEQ ID NO: 737250 - RNA, 59 nt, Homo Sapiens
uucaguucugcucuaucuuacugcuauggggaauucacuucuucaaagcaggaccuauu

SEQ ID NO: 737251 - RNA, 59 nt, Homo Sapiens
ccaaauauauucucuuugguguacaaaauggaauucauucuggucucucuauuaccacu

SEQ ID NO: 737252 - RNA, 59 nt, Homo Sapiens
aaucauuaaggaacccauuacugccauuuggaauucaaauaaccuaaccaaccuccacc

SEQ ID NO: 737253 - RNA, 59 nt, Homo Sapiens
uuaagagaggucuggaaaguguccaacaaggaauucacaccucugccuccuuugcaaca

SEQ ID NO: 737254 - RNA, 59 nt, Homo Sapiens
cuuagcuucuucaucuuuguacuacauuaggaauucauuacauaugccuguuacagaua

SEQ ID NO: 737255 - RNA, 59 nt, Homo Sapiens
ggaacuuaucuucauuaaauuuuuccuuaggaauucaguauggugucggaauuguugua

SEQ ID NO: 737256 - RNA, 59 nt, Homo Sapiens
augcacauacugaaugcauaauuaaaaugggaauucaguucuuccaaaaagcagcuucc

SEQ ID NO: 737257 - RNA, 59 nt, Homo Sapiens
ccagaggaagggaaaggcuacaucugggaggaauucaccaacccuccuuuuucucagau

SEQ ID NO: 737258 - RNA, 63 nt, Homo Sapiens
uuuucccccaugcuguucucaugauagugagugaguucucacgagaucugaugguuuuacaag

SEQ ID NO: 737259 - RNA, 63 nt, Homo Sapiens
augcuauuuuuauuugaaccuuuggaacuugggaguucucauuguaacccuaacaugugagaa

SEQ ID NO: 737260 - RNA, 63 nt, Homo Sapiens
ccucuaccccuuuccauuuuggauucucggcugaguucucacagaagcauuuuccccaugugg

SEQ ID NO: 737261 - RNA, 63 nt, Homo Sapiens
agugcccuggcauucuggcagagaauccucaccaguucucaccaaccuuccccccaggcaagg

SEQ ID NO: 737262 - RNA, 63 nt, Homo Sapiens
ugauggucuucuauccacccuacuugguaacaaaguucucagauguuaggucauguuucauuu

SEQ ID NO: 737263 - RNA, 63 nt, Homo Sapiens
gcacaccuuuauucagaacuuuaguauuaaaucaguucucaauuucauuuuuuauguauuguu

SEQ ID NO: 737264 - RNA, 63 nt, Homo Sapiens
uuucaaucugaagauguaagacuuccugaaacaaguucucaagaagucuuuacauuauauuua

SEQ ID NO: 737265 - RNA, 63 nt, Homo Sapiens
gacuucguauuaucaugggaguacuguaaguucaguucucagggaaugcuaaauuagaguaau

SEQ ID NO: 737266 - RNA, 63 nt, Homo Sapiens
gggucauagagcuaccguauuuucuaggacaagaguucucagucacugugcaauaugcccccu

SEQ ID NO: 737267 - RNA, 63 nt, Homo Sapiens
agucaccccaaauggagacacucgcagaccugcaguucucagaccgaaggugcugccuucauc

SEQ ID NO: 737268 - RNA, 63 nt, Homo Sapiens
cuucaauuuauauuugugauaugaagacuauccaguucucaguuugaauuggaacaucauguu

SEQ ID NO: 737269 - RNA, 63 nt, Homo Sapiens
uuucacuggugcacacugaaauuuuacuugaacaguucucauaauaaagcacuugucuuuugc

SEQ ID NO: 737270 - RNA, 63 nt, Homo Sapiens
guuggcaacaucccuaaaaacucagucucuucuaguucucagagaaggguuucaucuucuaag

SEQ ID NO: 737271 - RNA, 63 nt, Homo Sapiens
aaccuuggcugugggccgauaaugcauauguccaguucucacuuaaauuaugcaaugauauuu

SEQ ID NO: 737272 - RNA, 63 nt, Homo Sapiens
uugccagucccgguguucaaugucaucaauggcaguucucaugcugucaccaagcuggccaug

SEQ ID NO: 737273 - RNA, 63 nt, Homo Sapiens
gguuuuuauucuugcugcaggcacagaaggcccaguucucaggaggagagcagcaggagaggc

SEQ ID NO: 737274 - RNA, 63 nt, Homo Sapiens
aagaacuuaugaguaagcagugcgucgcugacaaguucucaagcucuucaagacaaaacagau

SEQ ID NO: 737275 - RNA, 63 nt, Homo Sapiens
ccuaggagagccaaccucgggcagcccuugggcaguucucacugagcuggguggccuguuucu

SEQ ID NO: 737276 - RNA, 63 nt, Homo Sapiens
aguguuuuuuuaauccuaaauuauucaagauugaguucucacuagcgagauucuuucuaaaug

SEQ ID NO: 737277 - RNA, 63 nt, Homo Sapiens
auucuacagagaaggagggaagugaaccaaacuaguucucagacaucuccauugagaugauua

SEQ ID NO: 737278 - RNA, 63 nt, Homo Sapiens
guucaaauagagcuguucaaggugauaggacuaaguucucauucuucugugagauggcuggcu

SEQ ID NO: 737279 - RNA, 63 nt, Homo Sapiens
uuggaaagaaagauuccuuguuaaagugaguugaguucucaaauuuuguugcguguuuccauu

SEQ ID NO: 737280 - RNA, 63 nt, Homo Sapiens
auugaacugucugugcacugaugcaguuguauuaguucucauuggcuauuuuauuuauuucaa

SEQ ID NO: 737281 - RNA, 63 nt, Homo Sapiens
cuccgcaugcccucagccacagauccuuaauguaguucucaucaugauuuauugcuaugcccc

SEQ ID NO: 737282 - RNA, 63 nt, Homo Sapiens
uugcugcuuguuccaaauaacugcaccaaauaaaguucucauuggaacuaaauggagcccuga

SEQ ID NO: 737283 - RNA, 63 nt, Homo Sapiens
auaacuaccuccucacuuggucucuauuugagaaguucucagaucaguaguuuaguacaauaa

SEQ ID NO: 737284 - RNA, 63 nt, Homo Sapiens
ccuucuauggcugcaaguauugguuugaaugacaguucucauuaggugaauucccgacucuuu

SEQ ID NO: 737285 - RNA, 63 nt, Homo Sapiens
uucccuauucaaacuaauacugagcucaaagagaguucucauuuuuuuuuuuuuuuuuuuuuu

SEQ ID NO: 737286 - RNA, 63 nt, Homo Sapiens
gaugacccacuucugcaggcagagaugaguaacaguucucacuugccggacaaagcaaguuga

SEQ ID NO: 737287 - RNA, 63 nt, Homo Sapiens
gcaugcaauuguguaggauugcuacaaucaugaaguucucauucagagcuaggccagaucaau

SEQ ID NO: 737288 - RNA, 63 nt, Homo Sapiens
uggggggcaauuuugcacugaccuuaaggcaguaguucucaacaacugcauugguuuuccaug

SEQ ID NO: 737289 - RNA, 63 nt, Homo Sapiens
aaaugaccggugcuuauaaagacaaaccaaaucaguucucaaaaaaaauuguuuacuuuguug

SEQ ID NO: 737290 - RNA, 63 nt, Homo Sapiens
uagaggugaccaguuugccaucauggcaguuggaguucucauaugagacuuggccugugacca

SEQ ID NO: 737291 - RNA, 63 nt, Homo Sapiens
aauaauaauaaugacgauaaaugauaucuaaguaguucucagcuuauuuaaaaacaaaaccaa

SEQ ID NO: 737292 - RNA, 63 nt, Homo Sapiens
aaaguauuuacuuuuuaaaaguuucaucaaugcaguucucacgacacauuauaaaguucagau

SEQ ID NO: 737293 - RNA, 63 nt, Homo Sapiens
ucacuacuuaccaguuguauaaaccagaauuacaguucucauugagauggggaguuuuuuuga

SEQ ID NO: 737294 - RNA, 63 nt, Homo Sapiens
guauugcguaccaagugauacaacucgaaaugcaguucucaucuuccuguuuugagaaaugau

SEQ ID NO: 737295 - RNA, 63 nt, Homo Sapiens
gacagcccaaagacaaauauugggcaggaaaucaguucucacugagcccgguuuccauguaaa

SEQ ID NO: 737296 - RNA, 63 nt, Homo Sapiens
agaagguugagaugcaaagagucuaccuuuccaaguucucacugcuggaaagagcuagaagca

SEQ ID NO: 737297 - RNA, 63 nt, Homo Sapiens
cucacaaaacccuacuuaggucaucagggcaggaguucucacucccauuuuacagaugagaau

SEQ ID NO: 737298 - RNA, 63 nt, Homo Sapiens
agcugggcuggcugggaugccucuggcuggugaaguucucacauaggcugauuuaaauccagc

SEQ ID NO: 737299 - RNA, 63 nt, Homo Sapiens
ugauaauuucugucccacugugucucauuauagaguucucagccauuggaccucuucuaaagg

SEQ ID NO: 737300 - RNA, 63 nt, Homo Sapiens
uccccuucauuggcugcccaggccacuggccccaguucucagugucccuuggguccaggcucc

SEQ ID NO: 737301 - RNA, 63 nt, Homo Sapiens
gugcuuuucccaguuugguguuagguggccuuaaguucucaguaaugacacuuaucaaauagg

SEQ ID NO: 737302 - RNA, 63 nt, Homo Sapiens
uauaaacagauccccugcugaacagauacacagaguucucagaccccacccccacccucaggu

SEQ ID NO: 737303 - RNA, 63 nt, Homo Sapiens
gaaagucauauuuuauuuguggcauuuuuauauaguucucauccacaugcuaaauggaaagac

SEQ ID NO: 737304 - RNA, 63 nt, Homo Sapiens
uacguagugaucugcuuuuacuuuguaauuuguaguucucaaaagacuuuuuuuuaaaaaaau

SEQ ID NO: 737305 - RNA, 63 nt, Homo Sapiens
uagcuaaucucuacaaacccucuguaggccaguaguucucaaaguguggucucuggaagagca

SEQ ID NO: 737306 - RNA, 63 nt, Homo Sapiens
gcaccguguggcuccgccuccuggcccccagccaguucucagaaacguggcuggggcccagca

SEQ ID NO: 737307 - RNA, 63 nt, Homo Sapiens
uccauaaacguuaugcugaauaguuguugaaacaguucucauuuuguaguauuuaauaaucug

SEQ ID NO: 737308 - RNA, 63 nt, Homo Sapiens
agaucugcugguuuuaaagaauaauagagagggaguucucacaguuuccccuauguuguuauc

SEQ ID NO: 737309 - RNA, 63 nt, Homo Sapiens
ucuucugacuuaagugugcaagagugcuaauuuaguucucagccguguugacagcaaagaaac

SEQ ID NO: 737310 - RNA, 63 nt, Homo Sapiens
accuguucaagaaggugucugcuucuuccuuguaguucucaggagcaacuuuccuuuccugga

SEQ ID NO: 737311 - RNA, 63 nt, Homo Sapiens
guuugggacucuuaugcagagggaagacacccuaguucucagucuuuuuggaaggaaaggaag

SEQ ID NO: 737312 - RNA, 63 nt, Homo Sapiens
ggcuacgugugacuagugcuaguugcacuaucaaguucucaauaaugagaaauguaguuucuc

SEQ ID NO: 737313 - RNA, 63 nt, Homo Sapiens
uuaacauuuagauaacauaucugccuacuuuugaguucucauaagaauauguauucauauaau

SEQ ID NO: 737314 - RNA, 63 nt, Homo Sapiens
aucaugcugagagagcuggagagcuacccgcagaguucucagagcguggaaaggggcaggcca

SEQ ID NO: 737315 - RNA, 63 nt, Homo Sapiens
auggucuuugauccauuucggaacuauacuuuuaguucucacaaugccuguguuuucuucuaa

SEQ ID NO: 737316 - RNA, 63 nt, Homo Sapiens
agcguagaugugcaaacaagauagcuggaccuaaguucucagacucugcugguagcagugccu

SEQ ID NO: 737317 - RNA, 63 nt, Homo Sapiens
cugccuaugguuuuucugugccacuguuaccuaaguucucaagaauguuucgguuuagacucu

SEQ ID NO: 737318 - RNA, 63 nt, Homo Sapiens
uauaaaccucuguacacacaccucgcagaagaaaguucucacucuucaggcggggacccauug

SEQ ID NO: 737319 - RNA, 63 nt, Homo Sapiens
aaaauuuuauuaggacuauauauuugacuuacuaguucucaauuauuucuauguucuguaaag

SEQ ID NO: 737320 - RNA, 63 nt, Homo Sapiens
gguagggacaaaaccacaucgggauuauucuuuaguucucagauuucuuuuauuauaaacaag

SEQ ID NO: 737321 - RNA, 63 nt, Homo Sapiens
uucuucaccaucacuccaucuuuuuaaccugcaaguucucaguucuuauugcuguacauugcg

SEQ ID NO: 737322 - RNA, 63 nt, Homo Sapiens
ugagcugaagcuggauuauuaccugagaggggaaguucucagccuucucugccaucccuuugc

SEQ ID NO: 737323 - RNA, 63 nt, Homo Sapiens
ugccuacagaaccuugagguugacuccugcuucaguucucagcuguuuaccacagcccuccag

SEQ ID NO: 737324 - RNA, 63 nt, Homo Sapiens
agagugguuaacagauacaagugucaguuucuuaguucucauuuaagcacuaguggaauuuuu

SEQ ID NO: 737325 - RNA, 63 nt, Homo Sapiens
ucucucuucuguaacuuccaaagcaucccucucaguucucaugcucagcugaugguuauguuu

SEQ ID NO: 737326 - RNA, 63 nt, Homo Sapiens
gccucagugacuguguugcuaaacccaguggucaguucucaguucucagccaucagcagcauu

SEQ ID NO: 737327 - RNA, 63 nt, Homo Sapiens
ugacuguguugcuaaacccaguggucaguucucaguucucagccaucagcagcauuugcucgc

SEQ ID NO: 737328 - RNA, 63 nt, Homo Sapiens
uuuugcccacguguuugcgcuguuuuucucuggaguucucaagaguuggugacuuggaaggcc

SEQ ID NO: 737329 - RNA, 63 nt, Homo Sapiens
uuuucuccaugcacugugaacuucuguggcuucaguucucaugcugccucuuccaaaagggga

SEQ ID NO: 737330 - RNA, 63 nt, Homo Sapiens
auagagcccuuggcauuuuauuaucacauucuuaguucucagguugggacuucaauuacugcu

SEQ ID NO: 737331 - RNA, 63 nt, Homo Sapiens
uggcuuccauaugccacucuguaccccaaagagaguucucaugaaauauucuccagaauguau

SEQ ID NO: 737332 - RNA, 63 nt, Homo Sapiens
auuucuucuaguaaaauaaaauauuguuagauuaguucucauuaaauuuauuauaugcuaaag

SEQ ID NO: 737333 - RNA, 63 nt, Homo Sapiens
ccugccuuaauuauuuaucuuuaguuccuuauuaguucucaagaaacaaaugcuagcuucaua

SEQ ID NO: 737334 - RNA, 63 nt, Homo Sapiens
guacggacuuccuuuaggaucucaggcuucugcaguucucaugacuccuacuuuucauccuag

SEQ ID NO: 737335 - RNA, 63 nt, Homo Sapiens
uaugcucuagagaaaagucuaccccugcuaaggaguucucaucccucugucagggucaguaag

SEQ ID NO: 737336 - RNA, 63 nt, Homo Sapiens
gaagccagauccacccuaucccuguacagaguaaguucucaauuauuggccugcuaauagcug

SEQ ID NO: 737337 - RNA, 63 nt, Homo Sapiens
cuuccacagggccuguguaagaauggguucuggaguucucauggucuuuaggaaauauugagu

SEQ ID NO: 737338 - RNA, 63 nt, Homo Sapiens
gcuuuuaaguggugcuguuucccauagggcauuaguucucagauuuuggaaugugaaauaauc

SEQ ID NO: 737339 - RNA, 63 nt, Homo Sapiens
uuauuagugaaaacaaaacuaaagggaaguucaaguucucauguaaugccacauauauacuug

SEQ ID NO: 737340 - RNA, 63 nt, Homo Sapiens
cacauccuuuggaacuuacuaucaaugaaaggaaguucucaaaaggacagauagaccacccuc

SEQ ID NO: 737341 - RNA, 63 nt, Homo Sapiens
gugaaaaaugugucuguaaguaucuauuuauuaaguucucaauguggaguuugacauuguaug

SEQ ID NO: 737342 - RNA, 63 nt, Homo Sapiens
gguggcacucagucucucuucagaggagccaccaguucucaugacuguauccagguucccucc

SEQ ID NO: 737343 - RNA, 63 nt, Homo Sapiens
agcagacacucuguacaguuggggcaggggcccaguucucagcgguagcugggggaguggcau

SEQ ID NO: 737344 - RNA, 63 nt, Homo Sapiens
gauaauuuucaaauauuuucuucagcuaggcagaguucucauauuagacaugaacaugacaug

SEQ ID NO: 737345 - RNA, 63 nt, Homo Sapiens
uaaaaugagaucguuguuuaauauuuaugagaaaguucucauuaguuugaccucauuuguaaa

SEQ ID NO: 737346 - RNA, 63 nt, Homo Sapiens
ucucaacaucccagguagcucccggguucaagcaguucucauggcucacugcaaccucugccu

SEQ ID NO: 737347 - RNA, 63 nt, Homo Sapiens
uacuuucuuaaacaguguuugaagcugcuugagaguucucaauacuugaacuggacaucaggg

SEQ ID NO: 737348 - RNA, 63 nt, Homo Sapiens
uuaauagguagugaaacaauaaaaugaauccagaguucucauacuauaaacaugagauaaggg

SEQ ID NO: 737349 - RNA, 63 nt, Homo Sapiens
uaauuaguuuugcucaccacuauggccauugauaguucucauguugccuaggaaagcaaguca

SEQ ID NO: 737350 - RNA, 63 nt, Homo Sapiens
gcuccugccuucuguccugggcagagcgccgugaguucucaggggugggcggcuggagaccau

SEQ ID NO: 737351 - RNA, 63 nt, Homo Sapiens
aaagcccgcuagaagguuugggaacgaggggaaaguucucagaacuguuggcugcuccccacc

SEQ ID NO: 737352 - RNA, 63 nt, Homo Sapiens
gauuagaaacaaacaaaacucuuaaguccuaaaaguucucaauguagaggcauaaaccugugc

SEQ ID NO: 737353 - RNA, 63 nt, Homo Sapiens
guggaggcuggaugugcauuagccuggauccucaguucucaaauguguguggcagccaggaug

SEQ ID NO: 737354 - RNA, 63 nt, Homo Sapiens
aauuuugacccaaggcacagcagugaaauuuauaguucucaauuuaguugucauuauugacag

SEQ ID NO: 737355 - RNA, 63 nt, Homo Sapiens
acuugaagcaagaggccaagugaggggcugcccaguucucacaccagaaaccacacauucacu

SEQ ID NO: 737356 - RNA, 63 nt, Homo Sapiens
ucuuagauuuuuaaaaaagaauuaaaaugugggaguucucagaaagaaauaaacacaugagaa

SEQ ID NO: 737357 - RNA, 63 nt, Homo Sapiens
uauucaggauaccuauucuucuugauuuucuagaguucucauugaaggguagaauuuugaaac

SEQ ID NO: 737358 - RNA, 63 nt, Homo Sapiens
aaaagaaauuugcuuucauuaaguuuaauucugaguucucauuuaugacguugggucccucug

SEQ ID NO: 737359 - RNA, 63 nt, Homo Sapiens
accuacuuuugucaaaucuuuacugaauauccaaguucucagcuucuaguauagugaacuaca

SEQ ID NO: 737360 - RNA, 63 nt, Homo Sapiens
uaacuggugcuaugugaagaacuguguucgcacaguucucacuuaugcauaccagcaauuauu

SEQ ID NO: 737361 - RNA, 63 nt, Homo Sapiens
cugagugaacacccccagcugggugguccaccaaguucucauaaacagagucccucccauucc

SEQ ID NO: 737362 - RNA, 63 nt, Homo Sapiens
aggguaguguuuguuuuugaacgauaauuuagaaguucucauagaaagcguauaacauagguc

SEQ ID NO: 737363 - RNA, 63 nt, Homo Sapiens
uuugccggccauuuggaaagugaaaugccacuuaguucucaauugaugacaguguuugaauca

SEQ ID NO: 737364 - RNA, 63 nt, Homo Sapiens
aaguucuuaaagaaccagcuucuuagaauguucaguucucaaugugcugcugcuuucccuucu

SEQ ID NO: 737365 - RNA, 63 nt, Homo Sapiens
caaagugccugccucugaccucaucaugguucuaguucucauacagaacuccagaauuuuuaa

SEQ ID NO: 737366 - RNA, 63 nt, Homo Sapiens
cccagugaaagccaaguuggacugaauuucuggaguucucaucagugcacauuccauaguucu

SEQ ID NO: 737367 - RNA, 63 nt, Homo Sapiens
cauugucccagcugggaaggggacauucccacuaguucucauucauucuugcuuuuaugaaaa

SEQ ID NO: 737368 - RNA, 63 nt, Homo Sapiens
uuuauuaaauauaaugaauaugagaaaacucuuaguucucaucagauacuaaguuuuaagaau

SEQ ID NO: 737369 - RNA, 63 nt, Homo Sapiens
cccaccguguauauacaugaugagcaagcugucaguucucaccacucugcguucuccuagauc

SEQ ID NO: 737370 - RNA, 63 nt, Homo Sapiens
ccugagccuuccagagagagcucucaacaccacaguucucaacuaucuuguuaccugcuuucu

SEQ ID NO: 737371 - RNA, 63 nt, Homo Sapiens
gaauccuggaggcuggaacaacuugaaauaggaaguucucacuuugggacagcugggaacuua

SEQ ID NO: 737372 - RNA, 63 nt, Homo Sapiens
auuuuuaauuagaugucauauucacaguaguacaguucucaauuguuaccauggaaaaggaua

SEQ ID NO: 737373 - RNA, 63 nt, Homo Sapiens
cuacugcaaagaucuauugcgucauuuuggacuaguucucauguuuuuggauauaugcauguu

SEQ ID NO: 737374 - RNA, 63 nt, Homo Sapiens
uaacuguuauauuucauuuuguaaauaaaauugaguucucauucugaauggaaauaaauagau

SEQ ID NO: 737375 - RNA, 63 nt, Homo Sapiens
uaacacauuaaacuucucacgcagaaaacacaaaguucucagcgguaguaagcaugguuucuu

SEQ ID NO: 737376 - RNA, 63 nt, Homo Sapiens
augacugaaauuguuuucaucaucuucauugucaguucucaaaggagacuaagacuguauaaa

SEQ ID NO: 737377 - RNA, 63 nt, Homo Sapiens
cagcacuuccuguccccugcgucacagagagacaguucucaguauggauuugacagggugcau

SEQ ID NO: 737378 - RNA, 63 nt, Homo Sapiens
auucaggcucuggcuucaacgcaacucccaacgaguucucagguccaggacagagcccucaaa

SEQ ID NO: 737379 - RNA, 63 nt, Homo Sapiens
ucugugugcugcugucuuccgguaaacggaccaaguucucacuucccauccuccuccccaguc

SEQ ID NO: 737380 - RNA, 63 nt, Homo Sapiens
ugaagaaaguacuuuucuggcauagcuaccgugaguucucagcaggaacuucccagcgaugau

SEQ ID NO: 737381 - RNA, 63 nt, Homo Sapiens
uuaagaguuuguguguaaacaggcucaucucugaguucucaggacccuugcccccacccccau

SEQ ID NO: 737382 - RNA, 63 nt, Homo Sapiens
aagacuuugcauuuccuaguauuucuguuugucaguucucaauuuccuguguuugcaauguug

SEQ ID NO: 737383 - RNA, 63 nt, Homo Sapiens
ugaaaacuccagaaauacaucacccaagguggcaguucucaguauuuggcagaacaauugcaa

SEQ ID NO: 737384 - RNA, 63 nt, Homo Sapiens
uagcagugcauugguauaagcaauuauuucaucaguucucagauuaacaagcauuucugcucu

SEQ ID NO: 737385 - RNA, 63 nt, Homo Sapiens
gagaaugaaguguuucaaguaagcgagucugcaaguucucagaagcagacagauauccaaucu

SEQ ID NO: 737386 - RNA, 63 nt, Homo Sapiens
gauauauuuuccuuuaucacuuuaguauucugcaguucucagcuuggugaggcuccaaaagag

SEQ ID NO: 737387 - RNA, 63 nt, Homo Sapiens
cuaacaugguaaaauguuagguggagcauauacaguucucauuauacucuuauuuuaaauuua

SEQ ID NO: 737388 - RNA, 63 nt, Homo Sapiens
cuauuuuaagucaggggcuuuacuagccgauuuaguucucacaauaaccauguggagaagcug

SEQ ID NO: 737389 - RNA, 63 nt, Homo Sapiens
uuaagaaaggaaucuagccaaugagguccaagaaguucucacccauugaauuuuuaaauggcu

SEQ ID NO: 737390 - RNA, 63 nt, Homo Sapiens
uaggaccucugaaggcagagccugccacccaguaguucucaugccuuaauucuccuuuauucc

SEQ ID NO: 737391 - RNA, 63 nt, Homo Sapiens
cagggcugcuuguccccagaugggcagagcuggaguucucaucugagggacccacaggagagg

SEQ ID NO: 737392 - RNA, 63 nt, Homo Sapiens
cacccugaucuuaggguuaguugaggccucuccaguucucaugcuuucgucuaagucucagua

SEQ ID NO: 737393 - RNA, 63 nt, Homo Sapiens
ugaacuucaccauugugcuaauuugccuguucaaguucucauuucauuuuaguuuggucacgc

SEQ ID NO: 737394 - RNA, 63 nt, Homo Sapiens
uuuguaaguuuuuauacaucucauguauaguugaguucucaaagaauaucccaucauccuauu

SEQ ID NO: 737395 - RNA, 63 nt, Homo Sapiens
cuaggcuguggccacuaagaggcugcuucugugaguucucagccagguugugcuagaaaguag

SEQ ID NO: 737396 - RNA, 63 nt, Homo Sapiens
uuuaauauccugccuuuuacuagcuggagagagaguucucacauucgagacaggcagaaucag

SEQ ID NO: 737397 - RNA, 63 nt, Homo Sapiens
agacauagcuaggaaagcgaaugauaagggaaaaguucucagggaauugaaguguuguugcua

SEQ ID NO: 737398 - RNA, 63 nt, Homo Sapiens
aguuaggaggugcagacacuugcucuccuauguaguucucagaugcguaaagcagaacagccu

SEQ ID NO: 737399 - RNA, 63 nt, Homo Sapiens
uuuuuugcuaagagccagaggcaggucuucuggaguucucaggggggcccugugacccccucu

SEQ ID NO: 737400 - RNA, 63 nt, Homo Sapiens
acaaaugugaagaauguggcauaucuuuuaaccaguucucacaacuugcuauacauaagauga

SEQ ID NO: 737401 - RNA, 63 nt, Homo Sapiens
aaucaaugccaaauaaguacagucaucuucucuaguucucauaagacuaucuccccgccaccu

SEQ ID NO: 737402 - RNA, 63 nt, Homo Sapiens
uugguuguuugcuguuuuuuguuuuuuaaggugaguucucacuauguuucucagacuggucuc

SEQ ID NO: 737403 - RNA, 63 nt, Homo Sapiens
uguguacuauucuaucauuauuugggccauuucaguucucaugaguugggcuuucuuucuggg

SEQ ID NO: 737404 - RNA, 63 nt, Homo Sapiens
guucuuuuccaacacaucuaaaacugcugcaaaaguucucaaugguuuacuauguuuaaaacu

SEQ ID NO: 737405 - RNA, 63 nt, Homo Sapiens
gugcugaccucucucucccaugguagccccagcaguucucaggucugacccacccagccccug

SEQ ID NO: 737406 - RNA, 63 nt, Homo Sapiens
uuaaugaaccuaugagagugguuuccuguauaaaguucucaucaacuacauguaaagugaacu

SEQ ID NO: 737407 - RNA, 54 nt, Homo Sapiens
aggacccuuucuugcccacagccuaguucucacgcgcccccgcucuucuucuga

SEQ ID NO: 737408 - RNA, 63 nt, Homo Sapiens
cacacuccuuaagauuugguuuaucauacauucaguucucauuuugaacugaacaugcaacau

SEQ ID NO: 737409 - RNA, 63 nt, Homo Sapiens
gaccuauuuugugguguuuccuuggcagcaaaaaguucucaguugacaaauaaucauuuucau

SEQ ID NO: 737410 - RNA, 63 nt, Homo Sapiens
ccuguccgauuuuuccauggguuccaguuucagaguucucauuauuacucaaaguaaaagcgg

SEQ ID NO: 737411 - RNA, 63 nt, Homo Sapiens
uguccguguuacauaaucaagugcaauauacucaguucucaugcaggugacauucuaccauga

SEQ ID NO: 737412 - RNA, 63 nt, Homo Sapiens
gagaacuggacagaacugaaacacagcaacaccaguucucaaggacaaggugugugauggggg

SEQ ID NO: 737413 - RNA, 63 nt, Homo Sapiens
ugaguccaccaaaggauaaugccaacuuauauaaguucucaaaucaugccuuccgcuuagucu

SEQ ID NO: 737414 - RNA, 63 nt, Homo Sapiens
cagcaacuuuuaccaauaccuuuguauacucucaguucucauucaguauaaauaaaauuuuaa

SEQ ID NO: 737415 - RNA, 63 nt, Homo Sapiens
gaaguagaauauaauguauacuaagggauuucaaguucucagaauuuuugaguaguugcuuac

SEQ ID NO: 737416 - RNA, 63 nt, Homo Sapiens
auguugcuaguuuuuugcuuuacagaaagaagcaguucucacaacaauacauauaucuacaca

SEQ ID NO: 737417 - RNA, 63 nt, Homo Sapiens
uuuagucaacaucuagaaagggagcugguuucuaguucucacaagauucacacagccacccuu

SEQ ID NO: 737418 - RNA, 63 nt, Homo Sapiens
accaugugaguuaaugauacuguugaaagguccaguucucaguuuucuauagaaaaaaaaaau

SEQ ID NO: 737419 - RNA, 63 nt, Homo Sapiens
ugggcuaggccuuuuuuauacaauaauggcaguaguucucaaauaguuuuucaaauaggaaag

SEQ ID NO: 737420 - RNA, 63 nt, Homo Sapiens
ugaaugcaaaaggagcaggcaaucaaaacugggaguucucaagcauucuuuccauaacaaucu

SEQ ID NO: 737421 - RNA, 63 nt, Homo Sapiens
agugguuucauacuuuuuaccagagccuuugacaguucucaaauggaaacgugcaagagaagg

SEQ ID NO: 737422 - RNA, 63 nt, Homo Sapiens
uuuaugaagauaguuuauuauagucuguacuucaguucucaucuuguaaauaaugcuuaacau

SEQ ID NO: 737423 - RNA, 63 nt, Homo Sapiens
accagccaguagucacagaacugcuguuuacacaguucucaggaggcugugguuucuuagaau

SEQ ID NO: 737424 - RNA, 63 nt, Homo Sapiens
gguuacccccacacugcuguucucaugauacugaguucucacaaguccuguuuguuuuauaag

SEQ ID NO: 737425 - RNA, 63 nt, Homo Sapiens
ggggcaguuucucaaaagcagaaacaugccgccaguucucaaguuuuccuccuaacuccauuu

SEQ ID NO: 737426 - RNA, 63 nt, Homo Sapiens
ugccagccuuggcugucaaaaggaggcaggagcaguucucaacacaccaagccuuauucccac

SEQ ID NO: 737427 - RNA, 63 nt, Homo Sapiens
uggguacaaaccucacuguucagaugggcuguaaguucucacuucaaagcuauggaauggauu

SEQ ID NO: 737428 - RNA, 63 nt, Homo Sapiens
guguacccugagcaggggcagcuggccacucccaguucucaccaagucaccucccuccuugua

SEQ ID NO: 737429 - RNA, 63 nt, Homo Sapiens
cauacuaaagaggcgaggcaaugacuguuggccaguucucaccggggaaaaacccacuguuag

SEQ ID NO: 737430 - RNA, 63 nt, Homo Sapiens
agagccugugaggggaugucuaaguuacacuacaguucucacaucucagcaauugcaguuaag

SEQ ID NO: 737431 - RNA, 63 nt, Homo Sapiens
gaacuucuaucauuuuaaaccuguagauuucuuaguucucacauucuauuauuaaacuacagg

SEQ ID NO: 737432 - RNA, 63 nt, Homo Sapiens
ugucaauguagauaagagucaggaauaugggucaguucucaaaaaguuuaggcagcaagggaa

SEQ ID NO: 737433 - RNA, 63 nt, Homo Sapiens
gcaugaacuguccucagaagacauacuauugugaguucucagaccagcucccugagguguccc

SEQ ID NO: 737434 - RNA, 63 nt, Homo Sapiens
uaaugguaucaucacgcagucugcaugaaccaaaguucucaccgcaaccucugcggcagccga

SEQ ID NO: 737435 - RNA, 63 nt, Homo Sapiens
uguugaagcugucaccagcauacacauauauucaguucucagaguuugccuuagauaccuaaa

SEQ ID NO: 737436 - RNA, 63 nt, Homo Sapiens
auuauuacauagacugugauguguuuuuuuuuaaguucucaucaaguuguuggccuugugugu

SEQ ID NO: 737437 - RNA, 63 nt, Homo Sapiens
uaaugauaaugagaacaccuuugcccugaagucaguucucacaguauagaagagaacuuaaag

SEQ ID NO: 737438 - RNA, 63 nt, Homo Sapiens
aaaaaugaaaaaaaaaucaaagauuuuuuuaacaguucucagacuuaacuguugccuugaauu

SEQ ID NO: 737439 - RNA, 63 nt, Homo Sapiens
ccaagucuuuaauuugccaagaugaagaaaaugaguucucaaggagggaaugcuuugcuugag

SEQ ID NO: 737440 - RNA, 63 nt, Homo Sapiens
uagguuuauuuuggaagggacuguggccaggguaguucucagguugugcuagagcagcacuuu

SEQ ID NO: 737441 - RNA, 63 nt, Homo Sapiens
ggcagugcaaugcuuguagaaguaggaggaaacaguucucacugggaagaagcaagggcaaga

SEQ ID NO: 737442 - RNA, 63 nt, Homo Sapiens
uuuucauuggcuuagggcagauuuucaugcaaaaguucucauaugaguuagaggagaaaaagc

SEQ ID NO: 737443 - RNA, 63 nt, Homo Sapiens
uuacguaguggaaacauuuugcauuguuuacauaguucucauggaacauggaaauuuuugaaa

SEQ ID NO: 737444 - RNA, 63 nt, Homo Sapiens
uuucgugcgacugcuuuuucuucaaaggaguucaguucucaccauggagugaguggccuuuag

SEQ ID NO: 737445 - RNA, 63 nt, Homo Sapiens
gugaugguacaauguaaauggggacuucuguaaaguucucaguuucgguccaugugguuuauc

SEQ ID NO: 737446 - RNA, 63 nt, Homo Sapiens
guauuagauccuguugaaaauugguaaugagugaguucucacuaauggccuggugccauccuu

SEQ ID NO: 737447 - RNA, 63 nt, Homo Sapiens
uuuucuuauaggagaaauaugccuucaugguacaguucucaguagaguaggcaaacaaauuuu

SEQ ID NO: 737448 - RNA, 63 nt, Homo Sapiens
ugcagggaagaaguuuggcaauaaucauaauacaguucucagaauaauguauguguaauauac

SEQ ID NO: 737449 - RNA, 63 nt, Homo Sapiens
augcuuuuuaaauaagaaaaccauccuugaaucaguucucauacugaguacuaauugauuccu

SEQ ID NO: 737450 - RNA, 63 nt, Homo Sapiens
cuuauucuccaguacugacuguucuuuaguuggaguucucauuacuggggugagggaggcauu

SEQ ID NO: 737451 - RNA, 63 nt, Homo Sapiens
ucguuuuugcuauggauuuacugggaagcauccaguucucaaacauccacacaccugccaacc

SEQ ID NO: 737452 - RNA, 63 nt, Homo Sapiens
ccuuuguucauauuuuuaaaguuuucauucuguaguucucaccgucauauuuuuguaguucua

SEQ ID NO: 737453 - RNA, 63 nt, Homo Sapiens
agaucugaugauuuuauaagcuguucuugugauaguucucacguugggggcgguucccccaug

SEQ ID NO: 737454 - RNA, 63 nt, Homo Sapiens
cuccauccuuuuagcccaugaaguggagacagcaguucucaucgccucaguucuguacuugua

SEQ ID NO: 737455 - RNA, 63 nt, Homo Sapiens
cugguuguuuaugcaagagcauaguaaugagugaguucucacuuaugacuuugugccaucccc

SEQ ID NO: 737456 - RNA, 63 nt, Homo Sapiens
gaguguggguggcggcuccguuggugucuccucaguucucaggcuaaccauugagccaaugca

SEQ ID NO: 737457 - RNA, 63 nt, Homo Sapiens
cucuccaucccaauccaguagcaguucuuuuucaguucucauccuucugaggcagaggcugga

SEQ ID NO: 737458 - RNA, 63 nt, Homo Sapiens
ccaaggucucgcccaccaaauccugugaaccaaaguucucaggaaguauugucaagggaagcu

SEQ ID NO: 737459 - RNA, 63 nt, Homo Sapiens
gggcggaggaaggaucguuauacgucuucagaaaguucucauugccccagcugccuaguacua

SEQ ID NO: 737460 - RNA, 63 nt, Homo Sapiens
aacacgugguuuuuaaagccauuagguaaaaaaaguucucaauaaaggcauuacaauuuuuua

SEQ ID NO: 737461 - RNA, 63 nt, Homo Sapiens
cccuuuccuaaugagccuccucaauaagagagaaguucucauugugggaaucugacauaguuc

SEQ ID NO: 737462 - RNA, 63 nt, Homo Sapiens
gggagacucgcagaugcacacccacaaguauucaguucucaaacucuagacgaguguuggcaa

SEQ ID NO: 737463 - RNA, 63 nt, Homo Sapiens
guaauacagccugguuuuuaaguacucacuaaaaguucucaaauauuggguugggcacggcuu

SEQ ID NO: 737464 - RNA, 63 nt, Homo Sapiens
auggcaggaugugaacuuccccaucgcaaaugcaguucucagcccacugcaguggauacaagg

SEQ ID NO: 737465 - RNA, 63 nt, Homo Sapiens
gcaggaucucagccauaaagugccaguuugcuuaguucucacugucuccuggucugugcugcc

SEQ ID NO: 737466 - RNA, 63 nt, Homo Sapiens
cacucugauuuuuaaaauuaugcaguauuuuccaguucucagagaggucaugguugugcccag

SEQ ID NO: 737467 - RNA, 63 nt, Homo Sapiens
uuucucuuggccccuuguacaccccaggagagaaguucucaaucccagcaguucuuuguaguc

SEQ ID NO: 737468 - RNA, 63 nt, Homo Sapiens
uugccuuaguuuuggaaguaaauucuaguuuguaguucucauuuguaaugaacacauuaacga

SEQ ID NO: 737469 - RNA, 63 nt, Homo Sapiens
acaaagaaaugacacauauuagaggauuuugaaaguucucaacuauuuugaaauagcuagaag

SEQ ID NO: 737470 - RNA, 63 nt, Homo Sapiens
cagaggcagucuauugcaaguaauuacaucauaaguucucaagaguauauuagcagcaugcaa

SEQ ID NO: 737471 - RNA, 63 nt, Homo Sapiens
caccccaguuuuuccuccagcuuggaaaacuuaaguucucauuagaggauuugaaccauaauc

SEQ ID NO: 737472 - RNA, 63 nt, Homo Sapiens
uuuuuaaccuguuauagauucucuagaaaguugaguucucauugcccucgagaagaguuauug

SEQ ID NO: 737473 - RNA, 63 nt, Homo Sapiens
gguaaaggcaucagaugucuaaaguccuagcugaguucucaaucugcaaauggcauaaaaauu

SEQ ID NO: 737474 - RNA, 63 nt, Homo Sapiens
cuuuagcaugugaagagucagcagucacccggcaguucucaaaaaucaagcucaccaugcagg

SEQ ID NO: 737475 - RNA, 63 nt, Homo Sapiens
aguucuagaacugguagcuccacucuuuagaguaguucucauacucgugcugauagauggcca

SEQ ID NO: 737476 - RNA, 63 nt, Homo Sapiens
aauaaagaucuuuuguccguccuuuuguacgccaguucucagauucccuccccucccccucug

SEQ ID NO: 737477 - RNA, 63 nt, Homo Sapiens
auacauaugggguauaguuaucuuguccuacauaguucucagauuuaaucuucuuaaaaugua

SEQ ID NO: 737478 - RNA, 63 nt, Homo Sapiens
uuaaaagaaaacuguuagauugauucacuuuucaguucucaaacugaagaauauuugauguga

SEQ ID NO: 737479 - RNA, 63 nt, Homo Sapiens
ugggguagauuuuggccuucauucuagcccagaaguucucaucuacaauuauguccauauaaa

SEQ ID NO: 737480 - RNA, 63 nt, Homo Sapiens
ucuggguucuacuuuauuuuuuaaaaucuuuacaguucucaccauuucacguaccuuaaucca

SEQ ID NO: 737481 - RNA, 63 nt, Homo Sapiens
ugugauggaugugcauucucacuugggucuugaaguucucauuccuacaucucaagcuagcca

SEQ ID NO: 737482 - RNA, 63 nt, Homo Sapiens
aagagaaaccaaaugagcugauuacugacuauaaguucucagccuuuauggaccuaaucuuau

SEQ ID NO: 737483 - RNA, 63 nt, Homo Sapiens
ccuaguaauaggucauauuccccuaguaauaugaguucucaaagccuacauucaggaucuccc

SEQ ID NO: 737484 - RNA, 52 nt, Homo Sapiens
accaagcaaaagacauauaaacaguucucaugagaacuugguaguaagcuaa

SEQ ID NO: 737485 - RNA, 63 nt, Homo Sapiens
aguguaggaaauaaaagugaugauauuuaaaauaguucucaguugaagcagagaaaugccacu

SEQ ID NO: 737486 - RNA, 63 nt, Homo Sapiens
uacugcacugcccaagguguguguagcacaaacaguucucauuacaaaggaccaauucagaac

SEQ ID NO: 737487 - RNA, 63 nt, Homo Sapiens
uuucucccuauaaagaguuauaaaugaugguuuaguucucaggcagcuacaaaugccuauuua

SEQ ID NO: 737488 - RNA, 63 nt, Homo Sapiens
uuguugaggagaggcugcucaaucgacaccccgaguucucaugacugggaagauaguuuucuu

SEQ ID NO: 737489 - RNA, 63 nt, Homo Sapiens
gaaaucugcuugugugcuuauaagaauuuacugaguucucacuucccuuacagucauacaugg

SEQ ID NO: 737490 - RNA, 63 nt, Homo Sapiens
uugggaaagacagaggugcuccgagaacuuguaaguucucaacaaccagaguggugccucugu

SEQ ID NO: 737491 - RNA, 63 nt, Homo Sapiens
guucccucugcuccuggagcuauuuugguucuuaguucucacucaaacccuugucagugacag

SEQ ID NO: 737492 - RNA, 63 nt, Homo Sapiens
uuuacagcuuuuuuuugucauacaaaucacuacaguucucagagauaucuauaacuauaggga

SEQ ID NO: 737493 - RNA, 63 nt, Homo Sapiens
gcugcccugccuguuuuaggguuauguagagcuaguucucaaaacauggaacagcagguaguu

SEQ ID NO: 737494 - RNA, 63 nt, Homo Sapiens
ccccauuaugaacugagcuaucuaagaacuggaaguucucauugaagauuuaggaugccuccu

SEQ ID NO: 737495 - RNA, 63 nt, Homo Sapiens
ccccauuaugaacugagcuaucuaagaaccagaaguucucauugaggauuuaggaugccuccu

SEQ ID NO: 737496 - RNA, 63 nt, Homo Sapiens
ugacaagucaguuguccugaagcuacacucaggaguucucauccuaaccauccugcccauuau

SEQ ID NO: 737497 - RNA, 63 nt, Homo Sapiens
cagagacaucuuugggccugugccccaucacuuaguucucagguggccacuauuaaguggguu

SEQ ID NO: 737498 - RNA, 63 nt, Homo Sapiens
agaagggagaaaugaucauagccauauauaauuaguucucagacaugugaauagauauuaagu

SEQ ID NO: 737499 - RNA, 63 nt, Homo Sapiens
uauuucuucuaccucucccuguacaucuuuucaaguucucagcuugguuuguugacaauaaca

SEQ ID NO: 737500 - RNA, 63 nt, Homo Sapiens
cgagcuaaucuugucauuaacucucggccugccaguucucaagcagcucuggagcuccaccaa

SEQ ID NO: 737501 - RNA, 63 nt, Homo Sapiens
aacugagcccagaguaacugggcuccuuuccgaaguucucaguccguguguucggacggcacu

SEQ ID NO: 737502 - RNA, 63 nt, Homo Sapiens
uagguuuguaacauggcuaugaagugugaguugaguucucauuugcuuuugcuucucuccucu

SEQ ID NO: 737503 - RNA, 63 nt, Homo Sapiens
ggaaauaugcugccaaaaagcaccuuucccaucaguucucacccuucguccacgaauccacac

SEQ ID NO: 737504 - RNA, 63 nt, Homo Sapiens
aaacugauucuaugcaggugaaggaugcacuaaaguucucacuuuagugagaacuuuucuagc

SEQ ID NO: 737505 - RNA, 63 nt, Homo Sapiens
ggagaacugggaauggggccucaaggaggacugaguucucaggugacaggcaucaccaagucu

SEQ ID NO: 737506 - RNA, 63 nt, Homo Sapiens
ucacagacaaacugggauccagcacaguccagcaguucucaaaaugagguccucaggccacag

SEQ ID NO: 737507 - RNA, 63 nt, Homo Sapiens
cugccauagaauacucagucuuguggucaagagaguucucaagugacaaccauugggguuucu

SEQ ID NO: 737508 - RNA, 63 nt, Homo Sapiens
ggugguuacccucaugcuguucuugugauggugaguucucaugagaucugauggguguuuuuu

SEQ ID NO: 737509 - RNA, 63 nt, Homo Sapiens
uuucaaucucagugaaauggcucuuugcuuucgaguucucacgcaacguacugggcaaaugac

SEQ ID NO: 737510 - RNA, 63 nt, Homo Sapiens
uggagucccaccucuucagauaaguucaacaaaaguucucacaggcccauucuucaucauuug

SEQ ID NO: 737511 - RNA, 63 nt, Homo Sapiens
aauauuauuuuguugcauguuuuuggcuuucagaguucucaaaaauuguauagcaugugacuc

SEQ ID NO: 737512 - RNA, 63 nt, Homo Sapiens
agaucugaugguuuuauaaacugauagugggugaguucucacaguuuccccuacgauguucuc

SEQ ID NO: 737513 - RNA, 63 nt, Homo Sapiens
uauuaagaaguuguaugagugaauauuuuaaauaguucucagaucuuuauuuuuaugcauuua

SEQ ID NO: 737514 - RNA, 63 nt, Homo Sapiens
uauuugacuuuuuuauuuuauguuaauguuuucaguucucacuuugaggcacauuuacaucaa

SEQ ID NO: 737515 - RNA, 63 nt, Homo Sapiens
ggaacaguggggcugggaccgggugggagaaagaguucucagugguuccuuucuauacaguuu

SEQ ID NO: 737516 - RNA, 63 nt, Homo Sapiens
cuucccacaaguccauucugccuucaaaguguaaguucucaugucauuauggauuuggaguuu

SEQ ID NO: 737517 - RNA, 63 nt, Homo Sapiens
gcucaguucauuuaaaaaagauaucuauuugaaaguucucagaguuguacauauguuucacag

SEQ ID NO: 737518 - RNA, 63 nt, Homo Sapiens
ugccccaacaaacucauggcguugaaaccacacaguucucauuacuguuauuuauuagcugua

SEQ ID NO: 737519 - RNA, 63 nt, Homo Sapiens
uuguaguuugcaauccccuggccuuaguugaacaguucucagauuuuuagacaugaaagaauu

SEQ ID NO: 737520 - RNA, 63 nt, Homo Sapiens
ggauuggguuggccucuaacuguuaccccagggaguucucagaccugcaccagaggucucaua

SEQ ID NO: 737521 - RNA, 63 nt, Homo Sapiens
ugugcagucaugccguucuccucgggugcacccaguucucacaagggauuccuauugacacug

SEQ ID NO: 737522 - RNA, 63 nt, Homo Sapiens
aggcgggcgccaggcccgcugugggugggcaccaguucucagcaccgcucacugcugccgggc

SEQ ID NO: 737523 - RNA, 63 nt, Homo Sapiens
gcuaauaugauuacagcgaagacuuuccugauaaguucucaaacucgaugugugacuguuugg

SEQ ID NO: 737524 - RNA, 63 nt, Homo Sapiens
ccucugcccaucccccucaagggcugcaggcccaguucucaugcugcccuugggugggcaucu

SEQ ID NO: 737525 - RNA, 63 nt, Homo Sapiens
uucugcugcuugguguucuucuggaggagcgugaguucucagcggagcgcuucucggcacuuc

SEQ ID NO: 737526 - RNA, 63 nt, Homo Sapiens
gauucucuagcuguuagguagaccuaaauaaaaaguucucaauagauuccucuuuugaguaaa

SEQ ID NO: 737527 - RNA, 63 nt, Homo Sapiens
cuucccuuccaguucgaauuuggaaacucccaaaguucucaaugguuuguugugaguuccaug

SEQ ID NO: 737528 - RNA, 63 nt, Homo Sapiens
guaaugguaaaugcuuuuaaucaagcaggaaaaaguucucaugauuaugccaacuauaauagu

SEQ ID NO: 737529 - RNA, 63 nt, Homo Sapiens
cauguuucugguggacuaaauuguguaucugggaguucucacuuucuagccaggccugaugag

SEQ ID NO: 737530 - RNA, 63 nt, Homo Sapiens
ccguaucuagggacagaggcagcucugaaauggaguucucacauaaucuggggagcaaauucc

SEQ ID NO: 737531 - RNA, 63 nt, Homo Sapiens
acauggccccagucaagacagccagugacucccaguucucaacccccaaaucuuuuaaaugaa

SEQ ID NO: 737532 - RNA, 63 nt, Homo Sapiens
ugcgaucacguccugguuauaccgccucaacacaguucucaaccacugugcugaccaucgccc

SEQ ID NO: 737533 - RNA, 63 nt, Homo Sapiens
uucuccaugccuggaauccacuccuccucucccaguucucaacucucacaucauagaggaccc

SEQ ID NO: 737534 - RNA, 63 nt, Homo Sapiens
ccuuccuguccaguggaaugaggcaggucccucaguucucacggccucagcugugggggccuc

SEQ ID NO: 737535 - RNA, 63 nt, Homo Sapiens
ucugauaucugaggccaguaacuauuaauaucuaguucucagagcauuuggaaagguuaucuu

SEQ ID NO: 737536 - RNA, 63 nt, Homo Sapiens
ccgagccacaggcaauaaaaggauaucagcuguaguucucagcuacaucaugguguauagaug

SEQ ID NO: 737537 - RNA, 52 nt, Homo Sapiens
cucaucaggcccucgacugaaaaguucucaguggggccagacuggcuccugg

SEQ ID NO: 737538 - RNA, 63 nt, Homo Sapiens
ggacacugaaccuuguugaugccagcuguacugaguucucauccacagaggccaggcauggcc

SEQ ID NO: 737539 - RNA, 63 nt, Homo Sapiens
ccagaagaauaguuucucuggcucacaggcccaaguucucaaugaaaucguuuuuuaacuuuc

SEQ ID NO: 737540 - RNA, 63 nt, Homo Sapiens
uaaacuugguaaaagauaaucuaaaaauuccauaguucucaguuauuaaaauuuuucuuguuc

SEQ ID NO: 737541 - RNA, 63 nt, Homo Sapiens
ccguacacacacacucgggcacuucaggaggucaguucucaccccuuccucgauggggcuuua

SEQ ID NO: 737542 - RNA, 63 nt, Homo Sapiens
uaucaagaccucauccagcuggaagcuuuccaaaguucucagucccuucccagucucauuaga

SEQ ID NO: 737543 - RNA, 63 nt, Homo Sapiens
gcauuuggaaagguuaucuuacuauuaauaucuaguucucagaucugauaucugaggccagua

SEQ ID NO: 737544 - RNA, 63 nt, Homo Sapiens
gcaaccauaaagcugacucuggcuuaccauuaaaguucucaauacuggcaaacaugaaaaauc

SEQ ID NO: 737545 - RNA, 63 nt, Homo Sapiens
ucccuccaggcuucuagaagccuccacuuggaaaguucucaguucagggccuugccucugcgg

SEQ ID NO: 737546 - RNA, 63 nt, Homo Sapiens
cuuugcauugcuugugaugguggaccacuaacaaguucucagaguucaucccuugaccaccuc

SEQ ID NO: 737547 - RNA, 63 nt, Homo Sapiens
cucuccuccgccucuaccaaugagcauuuccuuaguucucagagcgugcacagagggagucgg

SEQ ID NO: 737548 - RNA, 63 nt, Homo Sapiens; identical to SEQ ID NO: 737543

SEQ ID NO: 737549 - RNA, 63 nt, Homo Sapiens
ggaggcugaggucgaagcaggcuuccuaagaauaguucucauucccuucuccaccagauauuu

SEQ ID NO: 737550 - RNA, 63 nt, Homo Sapiens
aaacuuacagcuuaacccauuuucaagcaaaacaguucucagaaaugucaugauugccggggu

SEQ ID NO: 737551 - RNA, 63 nt, Homo Sapiens
aguccuucucagauuagcuggaaauggggacagaguucucauuuaucccagauauauacauug

SEQ ID NO: 737552 - RNA, 63 nt, Homo Sapiens
uuuuagucaucccagcuuuuuagucuuaaccacaguucucacucucuuaaaugguaccucaaa

SEQ ID NO: 737553 - RNA, 63 nt, Homo Sapiens
guggcugaaacugagcuuuuuugugugggcuccaguucucacuguucugcaaugcucauggca

SEQ ID NO: 737554 - RNA, 63 nt, Homo Sapiens
augcggaggcgaggugagugauuccaucauuucaguucucaccugcaguuuuggugaagcagg

SEQ ID NO: 737555 - RNA, 63 nt, Homo Sapiens
cguagugugggagaggagagagcugaugacugcaguucucaaagguccucagugaaguuauuu

SEQ ID NO: 737556 - RNA, 63 nt, Homo Sapiens
uuuaaaagaaaggagagaacauuuuagaacaauaguucucaaaguguguuccccggacaagca

SEQ ID NO: 737557 - RNA, 63 nt, Homo Sapiens
gcacaggcugacaccaaaguggcacaacugcacaguucucagauuucuuugcacagauugauu

SEQ ID NO: 737558 - RNA, 63 nt, Homo Sapiens
auaauccaguauugcugauuuuaaaggcagagaaguucucaaaguuaauucaccuauguuauu

SEQ ID NO: 737559 - RNA, 63 nt, Homo Sapiens
acaucuaaaaaucaaauaagcuaauauacagucaguucucauuauucacaguaauuauguucu

SEQ ID NO: 737560 - RNA, 63 nt, Homo Sapiens
ggaauauacuuuucuuaaaaaaaaggaacaguuaguucucaucuagaaugaaaguuccauaua

SEQ ID NO: 737561 - RNA, 63 nt, Homo Sapiens
ugaccuggagugacagcugagucacccuggguaaguucucagaguggucaggauggcuugacc

SEQ ID NO: 737562 - RNA, 63 nt, Homo Sapiens
uuucgcuuuucaguaaaaacagucaaguuacugaguucucacauaaagagcucuucucacaca

SEQ ID NO: 737563 - RNA, 63 nt, Homo Sapiens
gaaugcaccuauuaaucguuaauugaaauaaaaaguucucauuuguaauauuguuuuguggau

SEQ ID NO: 737564 - RNA, 63 nt, Homo Sapiens
ggcaaaaccuaggaaggcucauccccuaaacacaguucucagugaugcagagacaauguugaa

SEQ ID NO: 737565 - RNA, 63 nt, Homo Sapiens
gacuuaguggcauauuuauugggaggcuguuggaguucucacucaccuugggggcuggcuuag

SEQ ID NO: 737566 - RNA, 63 nt, Homo Sapiens
cuguccaacuauucgcaggauccuuggaggccaaguucucacccauuuccucuccaacuuucu

SEQ ID NO: 737567 - RNA, 63 nt, Homo Sapiens
uuuaacuauaagaagucacgaauggucacuggcaguucucacuaugcuaauuuucauuucuag

SEQ ID NO: 737568 - RNA, 63 nt, Homo Sapiens
uuuguuuucugaaacagacgucauuugcacgugaguucucauccaaugucuuugagaaugcag

SEQ ID NO: 737569 - RNA, 63 nt, Homo Sapiens
ccggaguccacucccagugcuugcaagauuccaaguucucaccucuuaaagaaaacccacccc

SEQ ID NO: 737570 - RNA, 63 nt, Homo Sapiens
gugguguggaggcuguugauguuucuggugucaaguucucagaaguugcugccaccaacucuu

SEQ ID NO: 737571 - RNA, 63 nt, Homo Sapiens
cccggggacccccgcgggccccagaagcagcccaguucucagagagcccuuggaaggggucuc

SEQ ID NO: 737572 - RNA, 63 nt, Homo Sapiens
aaauauaaagaaugugacaaagcuuuuuaaggaaguucucaacccuuauuacacauaauucau

SEQ ID NO: 737573 - RNA, 63 nt, Homo Sapiens
gaagaauguggcaaaaccuauaaaccuauaacaaguucucaauuccuuuuuuuuugagaugga

SEQ ID NO: 737574 - RNA, 63 nt, Homo Sapiens
acagaugugaagaauguggcaaaggcuuuaauuaguucucaucccuuacuaaacauaagagaa

SEQ ID NO: 737575 - RNA, 63 nt, Homo Sapiens
ugaaaugugaugaauguggcauagccucuucccaguucucaacucuuacuaaacaugagaaca

SEQ ID NO: 737576 - RNA, 63 nt, Homo Sapiens
uacaaauaugaagaaugugacaaggccuuuaaaaguucucaacccuuauuacacauaauuuau

SEQ ID NO: 737577 - RNA, 63 nt, Homo Sapiens
ugacaaggaccaaugcuucuuuaucuggugcucaguucucagucagacgugcagcauggcugc

SEQ ID NO: 737578 - RNA, 63 nt, Homo Sapiens
acuuaauaaauguaugagucuuaaauaccucuuaguucucauuaaauuuaggaaaauucacac

SEQ ID NO: 737579 - RNA, 63 nt, Homo Sapiens
gcucccucuggggacggcuggcucacugucuccaguucucaauggccaacgaaggugcuugga

SEQ ID NO: 737580 - RNA, 63 nt, Homo Sapiens
gggauacagaguuguccauuaccaaagccuggaaguucucaucaccuccagguggacugcuug

SEQ ID NO: 737581 - RNA, 63 nt, Homo Sapiens
cacaaagugcuuccuuuuaaaugaaaaggugaaaguucucaacuuaaaaaagaaaagaaaaaa

SEQ ID NO: 737582 - RNA, 63 nt, Homo Sapiens
ccugggguggggccccggguccaucccaggaggaguucucaggcccccucucauaacuucucc

SEQ ID NO: 737583 - RNA, 63 nt, Homo Sapiens
aacuucucauugugggccagcaaccagacuuccaguucucaggugucaacguuguccucauga

SEQ ID NO: 737584 - RNA, 63 nt, Homo Sapiens
ccuuacugaacauaagggaaaaagcuuuucauuaguucucaacacaaaugugaaaaacguggc

SEQ ID NO: 737585 - RNA, 63 nt, Homo Sapiens
agagcugaugguuuuaagguucucaugauagugaguucucauggcagauuucucccuugcugu

SEQ ID NO: 737586 - RNA, 63 nt, Homo Sapiens
cauguccccaacucaaggcuccucaaaacccccaguucucacuauguguucacaaggguuacu

SEQ ID NO: 737587 - RNA, 63 nt, Homo Sapiens
ggauuccccaagggcacugcccacugcuccuggaguucucauccccuccccccccaccccccc

SEQ ID NO: 737588 - RNA, 63 nt, Homo Sapiens
cauugcagaaggauucauacucagucaccacucaguucucacucagugaauguaaggaucccu

SEQ ID NO: 737589 - RNA, 63 nt, Homo Sapiens
cuccugaccucgugaucugccuguuagccaggaaguucucaauaguagagaugggguuucacc

SEQ ID NO: 737590 - RNA, 63 nt, Homo Sapiens
uauggaaaggauacacacuuuguauuuccucagaguucucacauauuucuuuuguuccaaguu

SEQ ID NO: 737591 - RNA, 63 nt, Homo Sapiens
guagcucggcaccaacuaagaaaaaaagcacaaaguucucagagcucucgaggaaagugguug

SEQ ID NO: 737592 - RNA, 63 nt, Homo Sapiens
aauuuuagugaaacuugacucaacuauacacaaaguucucauccuaaaugaacuauuucaguc

SEQ ID NO: 737593 - RNA, 63 nt, Homo Sapiens
uugggaucuuguuuagagaauccacuuucuggaaguucucagcauaauuaguguugagagugg

SEQ ID NO: 737594 - RNA, 63 nt, Homo Sapiens
auuuauuaacagucagggccuauccuugccuguaguucucagucacuggaugcacaaaaucac

SEQ ID NO: 737595 - RNA, 63 nt, Homo Sapiens
agagcuucuggcaccagaacccugucuuccuccaguucucaacacgguguugcucuucaguca

SEQ ID NO: 737596 - RNA, 63 nt, Homo Sapiens
gcugguuucccuuacacauagcagagcucacucaguucucacaguagccaaaugaagcaguua

SEQ ID NO: 737597 - RNA, 63 nt, Homo Sapiens
cgcuuauucuccucccuguuaucugcuagaucuaguucucaaucacugcucccccguguguau

SEQ ID NO: 737598 - RNA, 63 nt, Homo Sapiens
agaucugguuuuuugaaaguuaagaucucagugaguucucaugcuugugauagugaguucuca

SEQ ID NO: 737599 - RNA, 63 nt, Homo Sapiens
agaucucagugaguucucauucuugugauagugaguucucauagcggacuucccccuugcugu

SEQ ID NO: 737600 - RNA, 63 nt, Homo Sapiens
gaccuggggcugcugugaagaaaacucaucuggaguucucaaacugaaaggcuuuucaaccac

SEQ ID NO: 737601 - RNA, 63 nt, Homo Sapiens
ggugaaaccagaugaucauuggguuguagaucgaguucucaaaacccauuuguuuuuuacaug

SEQ ID NO: 737602 - RNA, 63 nt, Homo Sapiens
agaucugaugguuuuauaaggugauagcgagugaguucucacggcuaccuccgugcuguucuc

SEQ ID NO: 737603 - RNA, 63 nt, Homo Sapiens
uuucauuuuauuucucauaauuugaacagagacaguucucauacaugaucagaugcuuuuuuu

SEQ ID NO: 737604 - RNA, 63 nt, Homo Sapiens
gugacaauuuucuuggaacuccuuuuuauuguuaguucucacuuguuuccauauuuagugaau

SEQ ID NO: 737605 - RNA, 63 nt, Homo Sapiens
ccucagccucccaaauagcuccucucucgcccaaguucucaugaauuuuuuuaacagggucuu

SEQ ID NO: 737606 - RNA, 63 nt, Homo Sapiens
cacagaauuccuccauagcaaucuugccccuuuaguucucaugugggcugaaguuaauuguuc

SEQ ID NO: 737607 - RNA, 63 nt, Homo Sapiens
cuggcaaguggcucugaagcacugagcccggauaguucucagcggggcagcagauaggagagc

SEQ ID NO: 737608 - RNA, 63 nt, Homo Sapiens
ggcaggcucaggucugucccguuugcacacucaaguucucaugguucucacaccugugcgcag

SEQ ID NO: 737609 - RNA, 63 nt, Homo Sapiens
ccuucaaugcccccucccuuagggacuuaguggaguucucaucauuggggagugggggguucg

SEQ ID NO: 737610 - RNA, 63 nt, Homo Sapiens
ucacacucaaaccagugacacagcacuuccuuaaguucucacagcccgcgugccugcccaugc

SEQ ID NO: 737611 - RNA, 63 nt, Homo Sapiens
auaaaucaucucaucacaaaagaacucccuaagaguucucauauugaugagaaauggaagaug

SEQ ID NO: 737612 - RNA, 63 nt, Homo Sapiens
cucagagacggugagucucccacaucuccagcaaguucucaaggcgagaacacgaucuucuuc

SEQ ID NO: 737613 - RNA, 63 nt, Homo Sapiens
ugcucuuggcuuggucucuacccucacuaccucaguucucaauaacuuagugaaucacugccc

SEQ ID NO: 737614 - RNA, 63 nt, Homo Sapiens
guggaagaauuucgugccauguggaaacuuuuuaguucucacuacaauguucacauugaugau

SEQ ID NO: 737615 - RNA, 63 nt, Homo Sapiens
ugagaaauacuucuucaaguuaugaugcuugaaaguucucaauaaaguucacgguuucauuac

SEQ ID NO: 737616 - RNA, 63 nt, Homo Sapiens
gaggggccuugcaaggaggggccuuugagccucaguucucauguauugggggguggggguggg

SEQ ID NO: 737617 - RNA, 63 nt, Homo Sapiens
uacauuuguuuugugugucacauggggucaguaaguucucaauaaaaauuguuaagaaaugcc

SEQ ID NO: 737618 - RNA, 63 nt, Homo Sapiens
gaucacaagucagcacuaccuccucccuucuugaguucucaacugagugagcaucauggaggg

SEQ ID NO: 737619 - RNA, 63 nt, Homo Sapiens
auagccauauccaaaucuuuucccccucccaagaguucucagugucuacauguagacuauucc

SEQ ID NO: 737620 - RNA, 63 nt, Homo Sapiens
gacuggacuguuuuuguuuuuuugguuacaauuaguucucaucucccugucgucgucauuguu

SEQ ID NO: 737621 - RNA, 63 nt, Homo Sapiens
auuaccuaagcugccaugcauuuuuuuuuuuacaguucucaaggaagagcacagaacaauuuc

SEQ ID NO: 737622 - RNA, 63 nt, Homo Sapiens
auucuucacucuguguuugaagagagcagucacaguucucaguaguggggagcauguugggug

SEQ ID NO: 737623 - RNA, 63 nt, Homo Sapiens
ccagcuccuuuguguggcaccucacauguacgaaguucucacccagggcaccccagccccaca

SEQ ID NO: 737624 - RNA, 63 nt, Homo Sapiens
aaaugguagauauuaauuuuugccuggcauauaaguucucaaugccuaaauauauauguacag

SEQ ID NO: 737625 - RNA, 63 nt, Homo Sapiens
uccuacccaucccugcaugagggucaaugcaagaguucucauuaguacuggagcacgugguca

SEQ ID NO: 737626 - RNA, 63 nt, Homo Sapiens
gugcacgaguccucagcacuucucauggucagaaguucucaugccaaauccggaagucaaagu

SEQ ID NO: 737627 - RNA, 63 nt, Homo Sapiens
gucagaaguucucauggugcauccggaagucaaaguucucaugcaccugggcagaucccccaa

SEQ ID NO: 737628 - RNA, 63 nt, Homo Sapiens
cacuaugcacucagaaaaaucacacuccaccaaaguucucaugcuuucaucagccccagcccc

SEQ ID NO: 737629 - RNA, 64 nt, Homo Sapiens
guuuucccccaugcuguucucaugauagugagugaguucucacgagaucugaugguuuuacaag

SEQ ID NO: 737630 - RNA, 64 nt, Homo Sapiens
aaugcuauuuuuauuugaaccuuuggaacuugggaguucucauuguaacccuaacaugugagaa

SEQ ID NO: 737631 - RNA, 64 nt, Homo Sapiens
accucuaccccuuuccauuuuggauucucggcugaguucucacagaagcauuuuccccaugugg

SEQ ID NO: 737632 - RNA, 64 nt, Homo Sapiens
cagugcccuggcauucuggcagagaauccucaccaguucucaccaaccuuccccccaggcaagg

SEQ ID NO: 737633 - RNA, 64 nt, Homo Sapiens
cugauggucuucuauccacccuacuugguaacaaaguucucagauguuaggucauguuucauuu

SEQ ID NO: 737634 - RNA, 64 nt, Homo Sapiens
ugcacaccuuuauucagaacuuuaguauuaaaucaguucucaauuucauuuuuuauguauuguu

SEQ ID NO: 737635 - RNA, 64 nt, Homo Sapiens
cuuucaaucugaagauguaagacuuccugaaacaaguucucaagaagucuuuacauuauauuua

SEQ ID NO: 737636 - RNA, 64 nt, Homo Sapiens
agacuucguauuaucaugggaguacuguaaguucaguucucagggaaugcuaaauuagaguaau

SEQ ID NO: 737637 - RNA, 64 nt, Homo Sapiens
cgggucauagagcuaccguauuuucuaggacaagaguucucagucacugugcaauaugcccccu

SEQ ID NO: 737638 - RNA, 64 nt, Homo Sapiens
cagucaccccaaauggagacacucgcagaccugcaguucucagaccgaaggugcugccuucauc

SEQ ID NO: 737639 - RNA, 64 nt, Homo Sapiens
acuucaauuuauauuugugauaugaagacuauccaguucucaguuugaauuggaacaucauguu

SEQ ID NO: 737640 - RNA, 64 nt, Homo Sapiens
cuuucacuggugcacacugaaauuuuacuugaacaguucucauaauaaagcacuugucuuuugc

SEQ ID NO: 737641 - RNA, 64 nt, Homo Sapiens
aguuggcaacaucccuaaaaacucagucucuucuaguucucagagaaggguuucaucuucuaag

SEQ ID NO: 737642 - RNA, 64 nt, Homo Sapiens
uaaccuuggcugugggccgauaaugcauauguccaguucucacuuaaauuaugcaaugauauuu

SEQ ID NO: 737643 - RNA, 64 nt, Homo Sapiens
cuugccagucccgguguucaaugucaucaauggcaguucucaugcugucaccaagcuggccaug

SEQ ID NO: 737644 - RNA, 64 nt, Homo Sapiens
gguuuuuauucuugcugcagcgcacagaaggcccaguucucaggcaggagagcagcaggagagg

SEQ ID NO: 737645 - RNA, 64 nt, Homo Sapiens
aagaacuuaugaguaagcaguugcgucgcugacaaguucucaaggcucuucaagacaaaacaga

SEQ ID NO: 737646 - RNA, 64 nt, Homo Sapiens
ccuaggagagccaaccucggugcagcccuugggcaguucucacuagagcuggguggccuguuuc

SEQ ID NO: 737647 - RNA, 64 nt, Homo Sapiens
aguguuuuuuuaauccuaaaguuauucaagauugaguucucacuuagcgagauucuuucuaaau

SEQ ID NO: 737648 - RNA, 64 nt, Homo Sapiens
auucuacagagaaggagggaaagugaaccaaacuaguucucagaccaucuccauugagaugauu

SEQ ID NO: 737649 - RNA, 64 nt, Homo Sapiens
guucaaauagagcuguucaauggugauaggacuaaguucucauuacuucugugagauggcuggc

SEQ ID NO: 737650 - RNA, 64 nt, Homo Sapiens
uuggaaagaaagauuccuuguuuaaagugaguugaguucucaaauuuuuguugcguguuuccau

SEQ ID NO: 737651 - RNA, 64 nt, Homo Sapiens
auugaacugucugugcacugaaugcaguuguauuaguucucauuaggcuauuuuauuuauuuca

SEQ ID NO: 737652 - RNA, 64 nt, Homo Sapiens
cuccgcaugcccucagccaccagauccuuaauguaguucucaucaaugauuuauugcuaugccc

SEQ ID NO: 737653 - RNA, 64 nt, Homo Sapiens
uugcugcuuguuccaaauaaacugcaccaaauaaaguucucauugggaacuaaauggagcccug

SEQ ID NO: 737654 - RNA, 64 nt, Homo Sapiens
auaacuaccuccucacuuggaucucuauuugagaaguucucagacucaguaguuuaguacaaua

SEQ ID NO: 737655 - RNA, 64 nt, Homo Sapiens
ccuucuauggcugcaaguauuugguuugaaugacaguucucauucaggugaauucccgacucuu

SEQ ID NO: 737656 - RNA, 64 nt, Homo Sapiens
uucccuauucaaacuaauacuugagcucaaagagaguucucauuuuuuuuuuuuuuuuuuuuuu

SEQ ID NO: 737657 - RNA, 64 nt, Homo Sapiens
gaugacccacuucugcaggcaagagaugaguaacaguucucacucugccggacaaagcaaguug

SEQ ID NO: 737658 - RNA, 64 nt, Homo Sapiens
gcaugcaauuguguaggauuugcuacaaucaugaaguucucauuccagagcuaggccagaucaa

SEQ ID NO: 737659 - RNA, 64 nt, Homo Sapiens
uggggggcaauuuugcacuggaccuuaaggcaguaguucucaaccaacugcauugguuuuccau

SEQ ID NO: 737660 - RNA, 64 nt, Homo Sapiens
aaaugaccggugcuuauaaaggacaaaccaaaucaguucucaaaaaaaaauuguuuacuuuguu

SEQ ID NO: 737661 - RNA, 64 nt, Homo Sapiens
uagaggugaccaguuugccaaucauggcaguuggaguucucauacugagacuuggccugugacc

SEQ ID NO: 737662 - RNA, 64 nt, Homo Sapiens
aauaauaauaaugacgauaaaaugauaucuaaguaguucucagccuuauuuaaaaacaaaacca

SEQ ID NO: 737663 - RNA, 64 nt, Homo Sapiens
aaaguauuuacuuuuuaaaauguuucaucaaugcaguucucacgaacacauuauaaaguucaga

SEQ ID NO: 737664 - RNA, 64 nt, Homo Sapiens
ucacuacuuaccaguuguauaaaaccagaauuacaguucucauuggagauggggaguuuuuuug

SEQ ID NO: 737665 - RNA, 64 nt, Homo Sapiens
aguauugcguaccaagugauacaacucgaaaugcaguucucaucuuccuguuuugagaaaugau

SEQ ID NO: 737666 - RNA, 64 nt, Homo Sapiens
agacagcccaaagacaaauauugggcaggaaaucaguucucacugagcccgguuuccauguaaa

SEQ ID NO: 737667 - RNA, 64 nt, Homo Sapiens
gagaagguugagaugcaaagagucuaccuuuccaaguucucacugcuggaaagagcuagaagca

SEQ ID NO: 737668 - RNA, 64 nt, Homo Sapiens
ucucacaaaacccuacuuaggucaucagggcaggaguucucacucccauuuuacagaugagaau

SEQ ID NO: 737669 - RNA, 64 nt, Homo Sapiens
aagcugggcuggcugggaugccucuggcuggugaaguucucacauaggcugauuuaaauccagc

SEQ ID NO: 737670 - RNA, 64 nt, Homo Sapiens
augauaauuucugucccacugugucucauuauagaguucucagccauuggaccucuucuaaagg

SEQ ID NO: 737671 - RNA, 64 nt, Homo Sapiens
cuccccuucauuggcugcccaggccacuggccccaguucucagugucccuuggguccaggcucc

SEQ ID NO: 737672 - RNA, 64 nt, Homo Sapiens
ugugcuuuucccaguuugguguuagguggccuuaaguucucaguaaugacacuuaucaaauagg

SEQ ID NO: 737673 - RNA, 64 nt, Homo Sapiens
auauaaacagauccccugcugaacagauacacagaguucucagaccccacccccacccucaggu

SEQ ID NO: 737674 - RNA, 64 nt, Homo Sapiens
ugaaagucauauuuuauuuguggcauuuuuauauaguucucauccacaugcuaaauggaaagac

SEQ ID NO: 737675 - RNA, 64 nt, Homo Sapiens
cuacguagugaucugcuuuuacuuuguaauuuguaguucucaaaagacuuuuuuuuaaaaaaau

SEQ ID NO: 737676 - RNA, 64 nt, Homo Sapiens
cuagcuaaucucuacaaacccucuguaggccaguaguucucaaaguguggucucuggaagagca

SEQ ID NO: 737677 - RNA, 64 nt, Homo Sapiens
cgcaccguguggcuccgccuccuggcccccagccaguucucagaaacguggcuggggcccagca

SEQ ID NO: 737678 - RNA, 64 nt, Homo Sapiens
guccauaaacguuaugcugaauaguuguugaaacaguucucauuuuguaguauuuaauaaucug

SEQ ID NO: 737679 - RNA, 64 nt, Homo Sapiens
agaucugcugguuuuaaagacauaauagagagggaguucucacagguuuccccuauguuguuau

SEQ ID NO: 737680 - RNA, 64 nt, Homo Sapiens
ucuucugacuuaagugugcacagagugcuaauuuaguucucagcucguguugacagcaaagaaa

SEQ ID NO: 737681 - RNA, 64 nt, Homo Sapiens
accuguucaagaaggugucuagcuucuuccuuguaguucucaggaagcaacuuuccuuuccugg

SEQ ID NO: 737682 - RNA, 64 nt, Homo Sapiens
guuugggacucuuaugcagaggggaagacacccuaguucucaguccuuuuuggaaggaaaggaa

SEQ ID NO: 737683 - RNA, 64 nt, Homo Sapiens
ggcuacgugugacuagugcucaguugcacuaucaaguucucaauaaaugagaaauguaguuucu

SEQ ID NO: 737684 - RNA, 64 nt, Homo Sapiens
uuaacauuuagauaacauauucugccuacuuuugaguucucauaaagaauauguauucauauaa

SEQ ID NO: 737685 - RNA, 64 nt, Homo Sapiens
aucaugcugagagagcuggaagagcuacccgcagaguucucagaggcguggaaaggggcaggcc

SEQ ID NO: 737686 - RNA, 64 nt, Homo Sapiens
auggucuuugauccauuucgagaacuauacuuuuaguucucacaaaugccuguguuuucuucua

SEQ ID NO: 737687 - RNA, 64 nt, Homo Sapiens
agcguagaugugcaaacaaguauagcuggaccuaaguucucagaccucugcugguagcagugcc

SEQ ID NO: 737688 - RNA, 64 nt, Homo Sapiens
cugccuaugguuuuucuguguccacuguuaccuaaguucucaagcaauguuucgguuuagacuc

SEQ ID NO: 737689 - RNA, 64 nt, Homo Sapiens
uauaaaccucuguacacacagccucgcagaagaaaguucucacuacuucaggcggggacccauu

SEQ ID NO: 737690 - RNA, 64 nt, Homo Sapiens
aaaauuuuauuaggacuauaguauuugacuuacuaguucucaauguauuucuauguucuguaaa

SEQ ID NO: 737691 - RNA, 64 nt, Homo Sapiens
gguagggacaaaaccacaucggggauuauucuuuaguucucagauuuucuuuuauuauaaacaa

SEQ ID NO: 737692 - RNA, 64 nt, Homo Sapiens
uucuucaccaucacuccaucguuuuuaaccugcaaguucucaguuucuuauugcuguacauugc

SEQ ID NO: 737693 - RNA, 64 nt, Homo Sapiens
ugagcugaagcuggauuauucaccugagaggggaaguucucagcacuucucugccaucccuuug

SEQ ID NO: 737694 - RNA, 64 nt, Homo Sapiens
cugccuacagaaccuugagguugacuccugcuucaguucucagcuguuuaccacagcccuccag

SEQ ID NO: 737695 - RNA, 64 nt, Homo Sapiens
uagagugguuaacagauacaagugucaguuucuuaguucucauuuaagcacuaguggaauuuuu

SEQ ID NO: 737696 - RNA, 64 nt, Homo Sapiens
uucucucuucuguaacuuccaaagcaucccucucaguucucaugcucagcugaugguuauguuu

SEQ ID NO: 737697 - RNA, 64 nt, Homo Sapiens; identical to SEQ ID NO: 338022

SEQ ID NO: 737698 - RNA, 64 nt, Homo Sapiens; identical to SEQ ID NO: 338023

SEQ ID NO: 737699 - RNA, 64 nt, Homo Sapiens
uuuuugcccacguguuugcgcuguuuuucucuggaguucucaagaguuggugacuuggaaggcc

SEQ ID NO: 737700 - RNA, 64 nt, Homo Sapiens
auuuucuccaugcacugugaacuucuguggcuucaguucucaugcugccucuuccaaaagggga

SEQ ID NO: 737701 - RNA, 64 nt, Homo Sapiens
gauagagcccuuggcauuuuauuaucacauucuuaguucucagguugggacuucaauuacugcu

SEQ ID NO: 737702 - RNA, 64 nt, Homo Sapiens
auggcuuccauaugccacucuguaccccaaagagaguucucaugaaauauucuccagaauguau

SEQ ID NO: 737703 - RNA, 64 nt, Homo Sapiens
uauuucuucuaguaaaauaaaauauuguuagauuaguucucauuaaauuuauuauaugcuaaag

SEQ ID NO: 737704 - RNA, 64 nt, Homo Sapiens
accugccuuaauuauuuaucuuuaguuccuuauuaguucucaagaaacaaaugcuagcuucaua

SEQ ID NO: 737705 - RNA, 64 nt, Homo Sapiens
gguacggacuuccuuuaggaucucaggcuucugcaguucucaugacuccuacuuuucauccuag

SEQ ID NO: 737706 - RNA, 64 nt, Homo Sapiens
cuaugcucuagagaaaagucuaccccugcuaaggaguucucaucccucugucagggucaguaag

SEQ ID NO: 737707 - RNA, 64 nt, Homo Sapiens
ugaagccagauccacccuaucccuguacagaguaaguucucaauuauuggccugcuaauagcug

SEQ ID NO: 737708 - RNA, 64 nt, Homo Sapiens
ucuuccacagggccuguguaagaauggguucuggaguucucauggucuuuaggaaauauugagu

SEQ ID NO: 737709 - RNA, 64 nt, Homo Sapiens
ugcuuuuaaguggugcuguuucccauagggcauuaguucucagauuuuggaaugugaaauaauc

SEQ ID NO: 737710 - RNA, 64 nt, Homo Sapiens
auuauuagugaaaacaaaacuaaagggaaguucaaguucucauguaaugccacauauauacuug

SEQ ID NO: 737711 - RNA, 64 nt, Homo Sapiens
cacauccuuuggaacuuacucaucaaugaaaggaaguucucaaaaaggacagauagaccacccu

SEQ ID NO: 737712 - RNA, 64 nt, Homo Sapiens
gugaaaaaugugucuguaagguaucuauuuauuaaguucucaauuguggaguuugacauuguau

SEQ ID NO: 737713 - RNA, 64 nt, Homo Sapiens
gguggcacucagucucucuuccagaggagccaccaguucucaugcacuguauccagguucccuc

SEQ ID NO: 737714 - RNA, 64 nt, Homo Sapiens
agcagacacucuguacaguuuggggcaggggcccaguucucagcagguagcugggggaguggca

SEQ ID NO: 737715 - RNA, 64 nt, Homo Sapiens
gauaauuuucaaauauuuucguucagcuaggcagaguucucauauuuagacaugaacaugacau

SEQ ID NO: 737716 - RNA, 64 nt, Homo Sapiens
uaaaaugagaucguuguuuaaauauuuaugagaaaguucucauuuaguuugaccucauuuguaa

SEQ ID NO: 737717 - RNA, 64 nt, Homo Sapiens
ucucaacaucccagguagcuucccggguucaagcaguucucaugggcucacugcaaccucugcc

SEQ ID NO: 737718 - RNA, 64 nt, Homo Sapiens
uacuuucuuaaacaguguuuggaagcugcuugagaguucucaaucacuugaacuggacaucagg

SEQ ID NO: 737719 - RNA, 64 nt, Homo Sapiens
uuaauagguagugaaacaaugaaaaugaauccagaguucucauaacuauaaacaugagauaagg

SEQ ID NO: 737720 - RNA, 64 nt, Homo Sapiens
uaauuaguuuugcucaccacauauggccauugauaguucucaugauugccuaggaaagcaaguc

SEQ ID NO: 737721 - RNA, 64 nt, Homo Sapiens
gcuccugccuucuguccuggugcagagcgccgugaguucucagggggugggcggcuggagacca

SEQ ID NO: 737722 - RNA, 64 nt, Homo Sapiens
gaaagcccgcuagaagguuugggaacgaggggaaaguucucagaacuguuggcugcuccccacc

SEQ ID NO: 737723 - RNA, 64 nt, Homo Sapiens; identical to SEQ ID NO: 338024

SEQ ID NO: 737724 - RNA, 64 nt, Homo Sapiens; identical to SEQ ID NO: 338025

SEQ ID NO: 737725 - RNA, 64 nt, Homo Sapiens
aaauuuugacccaaggcacagcagugaaauuuauaguucucaauuuaguugucauuauugacag

SEQ ID NO: 737726 - RNA, 64 nt, Homo Sapiens
gacuugaagcaagaggccaagugaggggcugcccaguucucacaccagaaaccacacauucacu

SEQ ID NO: 737727 - RNA, 64 nt, Homo Sapiens
aucuuagauuuuuaaaaaagaauuaaaaugugggaguucucagaaagaaauaaacacaugagaa

SEQ ID NO: 737728 - RNA, 64 nt, Homo Sapiens
uauucaggauaccuauucuuccuugauuuucuagaguucucauuggaaggguagaauuuugaaa

SEQ ID NO: 737729 - RNA, 64 nt, Homo Sapiens
aaaagaaauuugcuuucauugaaguuuaauucugaguucucauuguaugacguugggucccucu

SEQ ID NO: 737730 - RNA, 64 nt, Homo Sapiens
accuacuuuugucaaaucuuauacugaauauccaaguucucagcuuucuaguauagugaacuac

SEQ ID NO: 737731 - RNA, 64 nt, Homo Sapiens
uaacuggugcuaugugaagauacuguguucgcacaguucucacuauaugcauaccagcaauuau

SEQ ID NO: 737732 - RNA, 64 nt, Homo Sapiens
ccugagugaacacccccagcugggugguccaccaaguucucauaaacagagucccucccauucc

SEQ ID NO: 737733 - RNA, 64 nt, Homo Sapiens
aaggguaguguuuguuuuugaacgauaauuuagaaguucucauagaaagcguauaacauagguc

SEQ ID NO: 737734 - RNA, 64 nt, Homo Sapiens
auuugccggccauuuggaaagugaaaugccacuuaguucucaauugaugacaguguuugaauca

SEQ ID NO: 737735 - RNA, 64 nt, Homo Sapiens
uaaguucuuaaagaaccagcuucuuagaauguucaguucucaaugugcugcugcuuucccuucu

SEQ ID NO: 737736 - RNA, 64 nt, Homo Sapiens
gcaaagugccugccucugaccucaucaugguucuaguucucauacagaacuccagaauuuuuaa

SEQ ID NO: 737737 - RNA, 64 nt, Homo Sapiens
ccccagugaaagccaaguuggacugaauuucuggaguucucaucagugcacauuccauaguucu

SEQ ID NO: 737738 - RNA, 64 nt, Homo Sapiens
ccauugucccagcugggaaggggacauucccacuaguucucauucauucuugcuuuuaugaaaa

SEQ ID NO: 737739 - RNA, 64 nt, Homo Sapiens
auuuauuaaauauaaugaauaugagaaaacucuuaguucucaucagauacuaaguuuuaagaau

SEQ ID NO: 737740 - RNA, 64 nt, Homo Sapiens
cccaccguguauauacaugacugagcaagcugucaguucucacccacucugcguucuccuagau

SEQ ID NO: 737741 - RNA, 64 nt, Homo Sapiens
ccugagccuuccagagagagucucucaacaccacaguucucaacguaucuuguuaccugcuuuc

SEQ ID NO: 737742 - RNA, 64 nt, Homo Sapiens
gaauccuggaggcuggaacaaacuugaaauaggaaguucucacucuugggacagcugggaacuu

SEQ ID NO: 737743 - RNA, 64 nt, Homo Sapiens
auuuuuaauuagaugucauaauucacaguaguacaguucucaauguguuaccauggaaaaggau

SEQ ID NO: 737744 - RNA, 64 nt, Homo Sapiens
cuacugcaaagaucuauugcugucauuuuggacuaguucucauguuuuuuggauauaugcaugu

SEQ ID NO: 737745 - RNA, 64 nt, Homo Sapiens
uaacuguuauauuucauuuuuguaaauaaaauugaguucucauuacugaauggaaauaaauaga

SEQ ID NO: 737746 - RNA, 64 nt, Homo Sapiens
uaacacauuaaacuucucacugcagaaaacacaaaguucucagcggguaguaagcaugguuucu

SEQ ID NO: 737747 - RNA, 64 nt, Homo Sapiens
augacugaaauuguuuucauacaucuucauugucaguucucaaaaggagacuaagacuguauaa

SEQ ID NO: 737748 - RNA, 64 nt, Homo Sapiens
cagcacuuccuguccccugcugucacagagagacaguucucaguuauggauuugacagggugca

SEQ ID NO: 737749 - RNA, 64 nt, Homo Sapiens
auucaggcucuggcuucaacagcaacucccaacgaguucucaggcuccaggacagagcccucaa

SEQ ID NO: 737750 - RNA, 64 nt, Homo Sapiens
aucugugugcugcugucuuccgguaaacggaccaaguucucacuucccauccuccuccccaguc

SEQ ID NO: 737751 - RNA, 64 nt, Homo Sapiens
gugaagaaaguacuuuucuggcauagcuaccgugaguucucagcaggaacuucccagcgaugau

SEQ ID NO: 737752 - RNA, 64 nt, Homo Sapiens
cuuaagaguuuguguguaaacaggcucaucucugaguucucaggacccuugcccccacccccau

SEQ ID NO: 737753 - RNA, 64 nt, Homo Sapiens
caagacuuugcauuuccuaguauuucuguuugucaguucucaauuuccuguguuugcaauguug

SEQ ID NO: 737754 - RNA, 64 nt, Homo Sapiens
uugaaaacuccagaaauacaucacccaagguggcaguucucaguauuuggcagaacaauugcaa

SEQ ID NO: 737755 - RNA, 64 nt, Homo Sapiens
uuagcagugcauugguauaagcaauuauuucaucaguucucagauuaacaagcauuucugcucu

SEQ ID NO: 737756 - RNA, 64 nt, Homo Sapiens
ggagaaugaaguguuucaaguaagcgagucugcaaguucucagaagcagacagauauccaaucu

SEQ ID NO: 737757 - RNA, 64 nt, Homo Sapiens
ugauauauuuuccuuuaucacuuuaguauucugcaguucucagcuuggugaggcuccaaaagag

SEQ ID NO: 737758 - RNA, 64 nt, Homo Sapiens
acuaacaugguaaaauguuagguggagcauauacaguucucauuauacucuuauuuuaaauuua

SEQ ID NO: 737759 - RNA, 64 nt, Homo Sapiens
ucuauuuuaagucaggggcuuuacuagccgauuuaguucucacaauaaccauguggagaagcug

SEQ ID NO: 737760 - RNA, 64 nt, Homo Sapiens
uuuaagaaaggaaucuagccaaugagguccaagaaguucucacccauugaauuuuuaaauggcu

SEQ ID NO: 737761 - RNA, 64 nt, Homo Sapiens
uaggaccucugaaggcagagcccugccacccaguaguucucauguccuuaauucuccuuuauuc

SEQ ID NO: 737762 - RNA, 64 nt, Homo Sapiens
cagggcugcuuguccccagagugggcagagcuggaguucucaucuugagggacccacaggagag

SEQ ID NO: 737763 - RNA, 64 nt, Homo Sapiens
cacccugaucuuaggguuagauugaggccucuccaguucucaugccuuucgucuaagucucagu

SEQ ID NO: 737764 - RNA, 64 nt, Homo Sapiens
ugaacuucaccauugugcuacauuugccuguucaaguucucauuuucauuuuaguuuggucacg

SEQ ID NO: 737765 - RNA, 64 nt, Homo Sapiens
uuuguaaguuuuuauacaucuucauguauaguugaguucucaaaugaauaucccaucauccuau

SEQ ID NO: 737766 - RNA, 64 nt, Homo Sapiens
cuaggcuguggccacuaagagggcugcuucugugaguucucagcccagguugugcuagaaagua

SEQ ID NO: 737767 - RNA, 64 nt, Homo Sapiens
uuuaauauccugccuuuuacguagcuggagagagaguucucacaauucgagacaggcagaauca

SEQ ID NO: 737768 - RNA, 64 nt, Homo Sapiens
aagacauagcuaggaaagcgaaugauaagggaaaaguucucagggaauugaaguguuguugcua

SEQ ID NO: 737769 - RNA, 64 nt, Homo Sapiens
caguuaggaggugcagacacuugcucuccuauguaguucucagaugcguaaagcagaacagccu

SEQ ID NO: 737770 - RNA, 64 nt, Homo Sapiens
guuuuuugcuaagagccagaggcaggucuucuggaguucucaggggggcccugugacccccucu

SEQ ID NO: 737771 - RNA, 64 nt, Homo Sapiens
uacaaaugugaagaauguggcauaucuuuuaaccaguucucacaacuugcuauacauaagauga

SEQ ID NO: 737772 - RNA, 64 nt, Homo Sapiens
aaaucaaugccaaauaaguacagucaucuucucuaguucucauaagacuaucuccccgccaccu

SEQ ID NO: 737773 - RNA, 64 nt, Homo Sapiens
uuugguuguuugcuguuuuuuguuuuuuaaggugaguucucacuauguuucucagacuggucuc

SEQ ID NO: 737774 - RNA, 64 nt, Homo Sapiens
uguguacuauucuaucauuaguuugggccauuucaguucucauguaguugggcuuucuuucugg

SEQ ID NO: 737775 - RNA, 64 nt, Homo Sapiens
guucuuuuccaacacaucuauaaacugcugcaaaaguucucaauagguuuacuauguuuaaaac

SEQ ID NO: 737776 - RNA, 64 nt, Homo Sapiens
gugcugaccucucucucccagugguagccccagcaguucucaggcucugacccacccagccccu

SEQ ID NO: 737777 - RNA, 64 nt, Homo Sapiens
uuaaugaaccuaugagaguguguuuccuguauaaaguucucaucaaacuacauguaaagugaac

SEQ ID NO: 737778 - RNA, 54 nt, Homo Sapiens; identical to SEQ ID NO: 737407

SEQ ID NO: 737779 - RNA, 64 nt, Homo Sapiens
cacacuccuuaagauuugguuuuaucauacauucaguucucauuauugaacugaacaugcaaca

SEQ ID NO: 737780 - RNA, 64 nt, Homo Sapiens
gaccuauuuugugguguuucucuuggcagcaaaaaguucucagugugacaaauaaucauuuuca

SEQ ID NO: 737781 - RNA, 64 nt, Homo Sapiens; identical to SEQ ID NO: 338026

SEQ ID NO: 737782 - RNA, 64 nt, Homo Sapiens; identical to SEQ ID NO: 338027

SEQ ID NO: 737783 - RNA, 64 nt, Homo Sapiens
ggagaacuggacagaacugaaacacagcaacaccaguucucaaggacaaggugugugauggggg

SEQ ID NO: 737784 - RNA, 64 nt, Homo Sapiens
uugaguccaccaaaggauaaugccaacuuauauaaguucucaaaucaugccuuccgcuuagucu

SEQ ID NO: 737785 - RNA, 64 nt, Homo Sapiens
acagcaacuuuuaccaauaccuuuguauacucucaguucucauucaguauaaauaaaauuuuaa

SEQ ID NO: 737786 - RNA, 64 nt, Homo Sapiens
ugaaguagaauauaauguauacuaagggauuucaaguucucagaauuuuugaguaguugcuuac

SEQ ID NO: 737787 - RNA, 64 nt, Homo Sapiens
auguugcuaguuuuuugcuuauacagaaagaagcaguucucacauacaauacauauaucuacac

SEQ ID NO: 737788 - RNA, 64 nt, Homo Sapiens
uuuagucaacaucuagaaaguggagcugguuucuaguucucacaaagauucacacagccacccu

SEQ ID NO: 737789 - RNA, 64 nt, Homo Sapiens
accaugugaguuaaugauacuuguugaaagguccaguucucagucuuucuauagaaaaaaaaaa

SEQ ID NO: 737790 - RNA, 64 nt, Homo Sapiens
ugggcuaggccuuuuuuauagcaauaauggcaguaguucucaaaauaguuuuucaaauaggaaa

SEQ ID NO: 737791 - RNA, 64 nt, Homo Sapiens
ugaaugcaaaaggagcaggcuaaucaaaacugggaguucucaagccauucuuuccauaacaauc

SEQ ID NO: 737792 - RNA, 64 nt, Homo Sapiens
agugguuucauacuuuuuacgcagagccuuugacaguucucaaaguggaaacgugcaagagaag

SEQ ID NO: 737793 - RNA, 64 nt, Homo Sapiens
auuuaugaagauaguuuauuauagucuguacuucaguucucaucuuguaaauaaugcuuaacau

SEQ ID NO: 737794 - RNA, 64 nt, Homo Sapiens
gaccagccaguagucacagaacugcuguuuacacaguucucaggaggcugugguuucuuagaau

SEQ ID NO: 737795 - RNA, 64 nt, Homo Sapiens
ugguuacccccacacugcuguucucaugauacugaguucucacaaguccuguuuguuuuauaag

SEQ ID NO: 737796 - RNA, 64 nt, Homo Sapiens
aggggcaguuucucaaaagcagaaacaugccgccaguucucaaguuuuccuccuaacuccauuu

SEQ ID NO: 737797 - RNA, 64 nt, Homo Sapiens
uugccagccuuggcugucaaaaggaggcaggagcaguucucaacacaccaagccuuauucccac

SEQ ID NO: 737798 - RNA, 64 nt, Homo Sapiens
cuggguacaaaccucacuguucagaugggcuguaaguucucacuucaaagcuauggaauggauu

SEQ ID NO: 737799 - RNA, 64 nt, Homo Sapiens
gguguacccugagcaggggcagcuggccacucccaguucucaccaagucaccucccuccuugua

SEQ ID NO: 737800 - RNA, 64 nt, Homo Sapiens
acauacuaaagaggcgaggcaaugacuguuggccaguucucaccggggaaaaacccacuguuag

SEQ ID NO: 737801 - RNA, 64 nt, Homo Sapiens
agagccugugaggggaugucguaaguuacacuacaguucucacacucucagcaauugcaguuaa

SEQ ID NO: 737802 - RNA, 64 nt, Homo Sapiens
gaacuucuaucauuuuaaacgcuguagauuucuuaguucucacauuucuauuauuaaacuacag

SEQ ID NO: 737803 - RNA, 64 nt, Homo Sapiens
ugucaauguagauaagagucaaggaauaugggucaguucucaaacaaguuuaggcagcaaggga

SEQ ID NO: 737804 - RNA, 64 nt, Homo Sapiens
gcaugaacuguccucagaagcacauacuauugugaguucucagaaccagcucccugaggugucc

SEQ ID NO: 737805 - RNA, 64 nt, Homo Sapiens
uaaugguaucaucacgcaguacugcaugaaccaaaguucucaccugcaaccucugcggcagccg

SEQ ID NO: 737806 - RNA, 64 nt, Homo Sapiens
uguugaagcugucaccagcaauacacauauauucaguucucagagguuugccuuagauaccuaa

SEQ ID NO: 737807 - RNA, 64 nt, Homo Sapiens
auuauuacauagacugugauuguguuuuuuuuuaaguucucaucuaaguuguuggccuugugug

SEQ ID NO: 737808 - RNA, 64 nt, Homo Sapiens
auaaugauaaugagaacaccuuugcccugaagucaguucucacaguauagaagagaacuuaaag

SEQ ID NO: 737809 - RNA, 64 nt, Homo Sapiens
uaaaaaugaaaaaaaaaucaaagauuuuuuuaacaguucucagacuuaacuguugccuugaauu

SEQ ID NO: 737810 - RNA, 64 nt, Homo Sapiens
uccaagucuuuaauuugccaagaugaagaaaaugaguucucaaggagggaaugcuuugcuugag

SEQ ID NO: 737811 - RNA, 64 nt, Homo Sapiens
guagguuuauuuuggaagggacuguggccaggguaguucucagguugugcuagagcagcacuuu

SEQ ID NO: 737812 - RNA, 64 nt, Homo Sapiens
uggcagugcaaugcuuguagaaguaggaggaaacaguucucacugggaagaagcaagggcaaga

SEQ ID NO: 737813 - RNA, 64 nt, Homo Sapiens
uuuuucauuggcuuagggcagauuuucaugcaaaaguucucauaugaguuagaggagaaaaagc

SEQ ID NO: 737814 - RNA, 64 nt, Homo Sapiens
guuacguaguggaaacauuuugcauuguuuacauaguucucauggaacauggaaauuuuugaaa

SEQ ID NO: 737815 - RNA, 64 nt, Homo Sapiens
auuucgugcgacugcuuuuucuucaaaggaguucaguucucaccauggagugaguggccuuuag

SEQ ID NO: 737816 - RNA, 64 nt, Homo Sapiens
cgugaugguacaauguaaauggggacuucuguaaaguucucaguuucgguccaugugguuuauc

SEQ ID NO: 737817 - RNA, 64 nt, Homo Sapiens
guauuagauccuguugaaaauuugguaaugagugaguucucacugaauggccuggugccauccu

SEQ ID NO: 737818 - RNA, 64 nt, Homo Sapiens; identical to SEQ ID NO: 338028

SEQ ID NO: 737819 - RNA, 64 nt, Homo Sapiens; identical to SEQ ID NO: 338029

SEQ ID NO: 737820 - RNA, 64 nt, Homo Sapiens
augcuuuuuaaauaagaaaauccauccuugaaucaguucucauagcugaguacuaauugauucc

SEQ ID NO: 737821 - RNA, 64 nt, Homo Sapiens
cuuauucuccaguacugacuuguucuuuaguuggaguucucauuuacuggggugagggaggcau

SEQ ID NO: 737822 - RNA, 64 nt, Homo Sapiens
ucguuuuugcuauggauuuaccugggaagcauccaguucucaaaccauccacacaccugccaac

SEQ ID NO: 737823 - RNA, 64 nt, Homo Sapiens
ccuuuguucauauuuuuaaaaguuuucauucuguaguucucaccagucauauuuuuguaguucu

SEQ ID NO: 737824 - RNA, 64 nt, Homo Sapiens
agaucugaugauuuuauaaggcuguucuugugauaguucucacgcuugggggcgguucccccau

SEQ ID NO: 737825 - RNA, 64 nt, Homo Sapiens
cuccauccuuuuagcccaugaaaguggagacagcaguucucaucagccucaguucuguacuugu

SEQ ID NO: 737826 - RNA, 64 nt, Homo Sapiens
cugguuguuuaugcaagagccauaguaaugagugaguucucacuguaugacuuugugccauccc

SEQ ID NO: 737827 - RNA, 64 nt, Homo Sapiens
gaguguggguggcggcuccgauuggugucuccucaguucucaggccuaaccauugagccaaugc

SEQ ID NO: 737828 - RNA, 64 nt, Homo Sapiens
cucuccaucccaauccaguaagcaguucuuuuucaguucucaucucuucugaggcagaggcugg

SEQ ID NO: 737829 - RNA, 64 nt, Homo Sapiens
ccaaggucucgcccaccaaauuccugugaaccaaaguucucaggcaaguauugucaagggaagc

SEQ ID NO: 737830 - RNA, 64 nt, Homo Sapiens
ugggcggaggaaggaucguuauacgucuucagaaaguucucauugccccagcugccuaguacua

SEQ ID NO: 737831 - RNA, 64 nt, Homo Sapiens
aaacacgugguuuuuaaagccauuagguaaaaaaaguucucaauaaaggcauuacaauuuuuua

SEQ ID NO: 737832 - RNA, 64 nt, Homo Sapiens
acccuuuccuaaugagccuccucaauaagagagaaguucucauugugggaaucugacauaguuc

SEQ ID NO: 737833 - RNA, 64 nt, Homo Sapiens
agggagacucgcagaugcacacccacaaguauucaguucucaaacucuagacgaguguuggcaa

SEQ ID NO: 737834 - RNA, 64 nt, Homo Sapiens
aguaauacagccugguuuuuaaguacucacuaaaaguucucaaauauuggguugggcacggcuu

SEQ ID NO: 737835 - RNA, 64 nt, Homo Sapiens
aauggcaggaugugaacuuccccaucgcaaaugcaguucucagcccacugcaguggauacaagg

SEQ ID NO: 737836 - RNA, 64 nt, Homo Sapiens
ggcaggaucucagccauaaagugccaguuugcuuaguucucacugucuccuggucugugcugcc

SEQ ID NO: 737837 - RNA, 64 nt, Homo Sapiens
acacucugauuuuuaaaauuaugcaguauuuuccaguucucagagaggucaugguugugcccag

SEQ ID NO: 737838 - RNA, 64 nt, Homo Sapiens
cuuucucuuggccccuuguacaccccaggagagaaguucucaaucccagcaguucuuuguaguc

SEQ ID NO: 737839 - RNA, 64 nt, Homo Sapiens
uuugccuuaguuuuggaaguaaauucuaguuuguaguucucauuuguaaugaacacauuaacga

SEQ ID NO: 737840 - RNA, 64 nt, Homo Sapiens
acaaagaaaugacacauauugagaggauuuugaaaguucucaacauauuuugaaauagcuagaa

SEQ ID NO: 737841 - RNA, 64 nt, Homo Sapiens
cagaggcagucuauugcaagauaauuacaucauaaguucucaaguaguauauuagcagcaugca

SEQ ID NO: 737842 - RNA, 64 nt, Homo Sapiens; identical to SEQ ID NO: 338030

SEQ ID NO: 737843 - RNA, 64 nt, Homo Sapiens; identical to SEQ ID NO: 338031

SEQ ID NO: 737844 - RNA, 64 nt, Homo Sapiens; identical to SEQ ID NO: 338032

SEQ ID NO: 737845 - RNA, 64 nt, Homo Sapiens; identical to SEQ ID NO: 338033

SEQ ID NO: 737846 - RNA, 64 nt, Homo Sapiens
aguucuagaacugguagcucacacucuuuagaguaguucucauaccucgugcugauagauggcc

SEQ ID NO: 737847 - RNA, 64 nt, Homo Sapiens
aauaaagaucuuuuguccgugccuuuuguacgccaguucucagacuucccuccccucccccucu

SEQ ID NO: 737848 - RNA, 64 nt, Homo Sapiens
auacauaugggguauaguuaaucuuguccuacauaguucucagaguuuaaucuucuuaaaaugu

SEQ ID NO: 737849 - RNA, 64 nt, Homo Sapiens
uuaaaagaaaacuguuagauaugauucacuuuucaguucucaaaccugaagaauauuugaugug

SEQ ID NO: 737850 - RNA, 64 nt, Homo Sapiens
ugggguagauuuuggccuucaauucuagcccagaaguucucaucuuacaauuauguccauauaa

SEQ ID NO: 737851 - RNA, 64 nt, Homo Sapiens
cucuggguucuacuuuauuuuuuaaaaucuuuacaguucucaccauuucacguaccuuaaucca

SEQ ID NO: 737852 - RNA, 64 nt, Homo Sapiens
gugugauggaugugcauucucacuugggucuugaaguucucauuccuacaucucaagcuagcca

SEQ ID NO: 737853 - RNA, 64 nt, Homo Sapiens
aaagagaaaccaaaugagcugauuacugacuauaaguucucagccuuuauggaccuaaucuuau

SEQ ID NO: 737854 - RNA, 64 nt, Homo Sapiens
cccuaguaauaggucauauuccccuaguaauaugaguucucaaagccuacauucaggaucuccc

SEQ ID NO: 737855 - RNA, 52 nt, Homo Sapiens; identical to SEQ ID NO: 737484

SEQ ID NO: 737856 - RNA, 64 nt, Homo Sapiens
caguguaggaaauaaaagugaugauauuuaaaauaguucucaguugaagcagagaaaugccacu

SEQ ID NO: 737857 - RNA, 64 nt, Homo Sapiens
cuacugcacugcccaagguguguguagcacaaacaguucucauuacaaaggaccaauucagaac

SEQ ID NO: 737858 - RNA, 64 nt, Homo Sapiens
auuucucccuauaaagaguuauaaaugaugguuuaguucucaggcagcuacaaaugccuauuua

SEQ ID NO: 737859 - RNA, 64 nt, Homo Sapiens
auuguugaggagaggcugcucaaucgacaccccgaguucucaugacugggaagauaguuuucuu

SEQ ID NO: 737860 - RNA, 64 nt, Homo Sapiens
ugaaaucugcuugugugcuuauaagaauuuacugaguucucacuucccuuacagucauacaugg

SEQ ID NO: 737861 - RNA, 64 nt, Homo Sapiens
uugggaaagacagaggugcuuccgagaacuuguaaguucucaacaaaccagaguggugccucug

SEQ ID NO: 737862 - RNA, 64 nt, Homo Sapiens
guucccucugcuccuggagcguauuuugguucuuaguucucacuccaaacccuugucagugaca

SEQ ID NO: 737863 - RNA, 64 nt, Homo Sapiens; identical to SEQ ID NO: 338034

SEQ ID NO: 737864 - RNA, 64 nt, Homo Sapiens; identical to SEQ ID NO: 338035

SEQ ID NO: 737865 - RNA, 64 nt, Homo Sapiens
ccccauuaugaacugagcuauucuaagaacuggaaguucucauuagaagauuuaggaugccucc

SEQ ID NO: 737866 - RNA, 64 nt, Homo Sapiens
ccccauuaugaacugagcuauucuaagaaccagaaguucucauuagaggauuuaggaugccucc

SEQ ID NO: 737867 - RNA, 64 nt, Homo Sapiens
ugacaagucaguuguccugauagcuacacucaggaguucucaucgcuaaccauccugcccauua

SEQ ID NO: 737868 - RNA, 64 nt, Homo Sapiens
cagagacaucuuugggccuguugccccaucacuuaguucucaggcuggccacuauuaagugggu

SEQ ID NO: 737869 - RNA, 64 nt, Homo Sapiens
agaagggagaaaugaucauaugccauauauaauuaguucucagaacaugugaauagauauuaag

SEQ ID NO: 737870 - RNA, 64 nt, Homo Sapiens
uauuucuucuaccucucccuaguacaucuuuucaaguucucagcauugguuuguugacaauaac

SEQ ID NO: 737871 - RNA, 64 nt, Homo Sapiens; identical to SEQ ID NO: 338036

SEQ ID NO: 737872 - RNA, 64 nt, Homo Sapiens; identical to SEQ ID NO: 338037

SEQ ID NO: 737873 - RNA, 64 nt, Homo Sapiens
uagguuuguaacauggcuauugaagugugaguugaguucucauuuugcuuuugcuucucuccuc

SEQ ID NO: 737874 - RNA, 64 nt, Homo Sapiens
ggaaauaugcugccaaaaagccaccuuucccaucaguucucaccacuucguccacgaauccaca

SEQ ID NO: 737875 - RNA, 64 nt, Homo Sapiens
caaacugauucuaugcaggugaaggaugcacuaaaguucucacuuuagugagaacuuuucuagc

SEQ ID NO: 737876 - RNA, 64 nt, Homo Sapiens
ggagaacugggaauggggccuucaaggaggacugaguucucagguugacaggcaucaccaaguc

SEQ ID NO: 737877 - RNA, 64 nt, Homo Sapiens
gucacagacaaacugggauccagcacaguccagcaguucucaaaaugagguccucaggccacag

SEQ ID NO: 737878 - RNA, 64 nt, Homo Sapiens
ucugccauagaauacucagucuuguggucaagagaguucucaagugacaaccauugggguuucu

SEQ ID NO: 737879 - RNA, 64 nt, Homo Sapiens
uggugguuacccucaugcuguucuugugauggugaguucucaugagaucugauggguguuuuuu

SEQ ID NO: 737880 - RNA, 64 nt, Homo Sapiens
uuuucaaucucagugaaauggcucuuugcuuucgaguucucacgcaacguacugggcaaaugac

SEQ ID NO: 737881 - RNA, 64 nt, Homo Sapiens
uggagucccaccucuucagaguaaguucaacaaaaguucucacauggcccauucuucaucauuu

SEQ ID NO: 737882 - RNA, 64 nt, Homo Sapiens
aauauuauuuuguugcaugucuuuuggcuuucagaguucucaaaaaauuguauagcaugugacu

SEQ ID NO: 737883 - RNA, 64 nt, Homo Sapiens
agaucugaugguuuuauaaaccugauagugggugaguucucacagguuuccccuacgauguucu

SEQ ID NO: 737884 - RNA, 64 nt, Homo Sapiens
uauuaagaaguuguaugaguagaauauuuuaaauaguucucagaaucuuuauuuuuaugcauuu

SEQ ID NO: 737885 - RNA, 64 nt, Homo Sapiens
uuauuugacuuuuuuauuuuauguuaauguuuucaguucucacuuugaggcacauuuacaucaa

SEQ ID NO: 737886 - RNA, 64 nt, Homo Sapiens
gggaacaguggggcugggaccgggugggagaaagaguucucagugguuccuuucuauacaguuu

SEQ ID NO: 737887 - RNA, 64 nt, Homo Sapiens
ucuucccacaaguccauucugccuucaaaguguaaguucucaugucauuauggauuuggaguuu

SEQ ID NO: 737888 - RNA, 64 nt, Homo Sapiens
ggcucaguucauuuaaaaaagauaucuauuugaaaguucucagaguuguacauauguuucacag

SEQ ID NO: 737889 - RNA, 64 nt, Homo Sapiens
augccccaacaaacucauggcguugaaaccacacaguucucauuacuguuauuuauuagcugua

SEQ ID NO: 737890 - RNA, 64 nt, Homo Sapiens
uuguaguuugcaauccccugugccuuaguugaacaguucucagauuuuuuagacaugaaagaau

SEQ ID NO: 737891 - RNA, 64 nt, Homo Sapiens
ggauuggguuggccucuaacauguuaccccagggaguucucagacccugcaccagaggucucau

SEQ ID NO: 737892 - RNA, 64 nt, Homo Sapiens
ugugcagucaugccguucucgcucgggugcacccaguucucacaaagggauuccuauugacacu

SEQ ID NO: 737893 - RNA, 64 nt, Homo Sapiens
caggcgggcgccaggcccgcugugggugggcaccaguucucagcaccgcucacugcugccgggc

SEQ ID NO: 737894 - RNA, 64 nt, Homo Sapiens
cgcuaauaugauuacagcgaagacuuuccugauaaguucucaaacucgaugugugacuguuugg

SEQ ID NO: 737895 - RNA, 64 nt, Homo Sapiens
gccucugcccaucccccucaagggcugcaggcccaguucucaugcugcccuugggugggcaucu

SEQ ID NO: 737896 - RNA, 64 nt, Homo Sapiens
uuucugcugcuugguguucuucuggaggagcgugaguucucagcggagcgcuucucggcacuuc

SEQ ID NO: 737897 - RNA, 64 nt, Homo Sapiens
agauucucuagcuguuagguagaccuaaauaaaaaguucucaauagauuccucuuuugaguaaa

SEQ ID NO: 737898 - RNA, 64 nt, Homo Sapiens
ucuucccuuccaguucgaauuuggaaacucccaaaguucucaaugguuuguugugaguuccaug

SEQ ID NO: 737899 - RNA, 64 nt, Homo Sapiens
gguaaugguaaaugcuuuuaaucaagcaggaaaaaguucucaugauuaugccaacuauaauagu

SEQ ID NO: 737900 - RNA, 64 nt, Homo Sapiens
ccauguuucugguggacuaaauuguguaucugggaguucucacuuucuagccaggccugaugag

SEQ ID NO: 737901 - RNA, 64 nt, Homo Sapiens
ccguaucuagggacagaggccagcucugaaauggaguucucacauuaaucuggggagcaaauuc

SEQ ID NO: 737902 - RNA, 64 nt, Homo Sapiens
acauggccccagucaagacaagccagugacucccaguucucaacuccccaaaucuuuuaaauga

SEQ ID NO: 737903 - RNA, 64 nt, Homo Sapiens
ugcgaucacguccugguuaucaccgccucaacacaguucucaacgcacugugcugaccaucgcc

SEQ ID NO: 737904 - RNA, 64 nt, Homo Sapiens
uucuccaugccuggaauccaccuccuccucucccaguucucaacgucucacaucauagaggacc

SEQ ID NO: 737905 - RNA, 64 nt, Homo Sapiens
ccuuccuguccaguggaaugcaggcaggucccucaguucucacgcgccucagcugugggggccu

SEQ ID NO: 737906 - RNA, 64 nt, Homo Sapiens
uucugauaucugaggccaguaacuauuaauaucuaguucucagagcauuuggaaagguuaucuu

SEQ ID NO: 737907 - RNA, 64 nt, Homo Sapiens
uccgagccacaggcaauaaaaggauaucagcuguaguucucagcuacaucaugguguauagaug

SEQ ID NO: 737908 - RNA, 52 nt, Homo Sapiens; identical to SEQ ID NO: 737537

SEQ ID NO: 737909 - RNA, 64 nt, Homo Sapiens
gggacacugaaccuuguugaugccagcuguacugaguucucauccacagaggccaggcauggcc

SEQ ID NO: 737910 - RNA, 64 nt, Homo Sapiens
cccagaagaauaguuucucuggcucacaggcccaaguucucaaugaaaucguuuuuuaacuuuc

SEQ ID NO: 737911 - RNA, 64 nt, Homo Sapiens
uuaaacuugguaaaagauaaucuaaaaauuccauaguucucaguuauuaaaauuuuucuuguuc

SEQ ID NO: 737912 - RNA, 64 nt, Homo Sapiens
cccguacacacacacucgggcacuucaggaggucaguucucaccccuuccucgauggggcuuua

SEQ ID NO: 737913 - RNA, 64 nt, Homo Sapiens
uaucaagaccucauccagcuaggaagcuuuccaaaguucucagugcccuucccagucucauuag

SEQ ID NO: 737914 - RNA, 64 nt, Homo Sapiens
gcauuuggaaagguuaucuuaacuauuaauaucuaguucucagauucugauaucugaggccagu

SEQ ID NO: 737915 - RNA, 64 nt, Homo Sapiens
gcaaccauaaagcugacucucggcuuaccauuaaaguucucaauuacuggcaaacaugaaaaau

SEQ ID NO: 737916 - RNA, 64 nt, Homo Sapiens
ucccuccaggcuucuagaaggccuccacuuggaaaguucucagucucagggccuugccucugcg

SEQ ID NO: 737917 - RNA, 64 nt, Homo Sapiens
cuuugcauugcuugugauggcuggaccacuaacaaguucucagauguucaucccuugaccaccu

SEQ ID NO: 737918 - RNA, 64 nt, Homo Sapiens
cucuccuccgccucuaccaagugagcauuuccuuaguucucagaagcgugcacagagggagucg

SEQ ID NO: 737919 - RNA, 64 nt, Homo Sapiens; identical to SEQ ID NO: 737914

SEQ ID NO: 737920 - RNA, 64 nt, Homo Sapiens
ggaggcugaggucgaagcagugcuuccuaagaauaguucucauuccccuucuccaccagauauu

SEQ ID NO: 737921 - RNA, 64 nt, Homo Sapiens
aaaacuuacagcuuaacccauuuucaagcaaaacaguucucagaaaugucaugauugccggggu

SEQ ID NO: 737922 - RNA, 64 nt, Homo Sapiens
uaguccuucucagauuagcuggaaauggggacagaguucucauuuaucccagauauauacauug

SEQ ID NO: 737923 - RNA, 64 nt, Homo Sapiens
auuuuagucaucccagcuuuuuagucuuaaccacaguucucacucucuuaaaugguaccucaaa

SEQ ID NO: 737924 - RNA, 64 nt, Homo Sapiens
gguggcugaaacugagcuuuuuugugugggcuccaguucucacuguucugcaaugcucauggca

SEQ ID NO: 737925 - RNA, 64 nt, Homo Sapiens
gaugcggaggcgaggugagugauuccaucauuucaguucucaccugcaguuuuggugaagcagg

SEQ ID NO: 737926 - RNA, 64 nt, Homo Sapiens
gcguagugugggagaggagagagcugaugacugcaguucucaaagguccucagugaaguuauuu

SEQ ID NO: 737927 - RNA, 64 nt, Homo Sapiens; identical to SEQ ID NO: 338038

SEQ ID NO: 737928 - RNA, 64 nt, Homo Sapiens; identical to SEQ ID NO: 338039

SEQ ID NO: 737929 - RNA, 64 nt, Homo Sapiens
aauaauccaguauugcugauuuuaaaggcagagaaguucucaaaguuaauucaccuauguuauu

SEQ ID NO: 737930 - RNA, 64 nt, Homo Sapiens
aacaucuaaaaaucaaauaagcuaauauacagucaguucucauuauucacaguaauuauguucu

SEQ ID NO: 737931 - RNA, 64 nt, Homo Sapiens
uggaauauacuuuucuuaaaaaaaaggaacaguuaguucucaucuagaaugaaaguuccauaua

SEQ ID NO: 737932 - RNA, 64 nt, Homo Sapiens
gugaccuggagugacagcugagucacccuggguaaguucucagaguggucaggauggcuugacc

SEQ ID NO: 737933 - RNA, 64 nt, Homo Sapiens
auuucgcuuuucaguaaaaacagucaaguuacugaguucucacauaaagagcucuucucacaca

SEQ ID NO: 737934 - RNA, 64 nt, Homo Sapiens
gaaugcaccuauuaaucguuuaauugaaauaaaaaguucucauuuuguaauauuguuuugugga

SEQ ID NO: 737935 - RNA, 64 nt, Homo Sapiens
ggcaaaaccuaggaaggcucaauccccuaaacacaguucucaguggaugcagagacaauguuga

SEQ ID NO: 737936 - RNA, 64 nt, Homo Sapiens
gacuuaguggcauauuuauuggggaggcuguuggaguucucacuacaccuugggggcuggcuua

SEQ ID NO: 737937 - RNA, 64 nt, Homo Sapiens
cuguccaacuauucgcaggauuccuuggaggccaaguucucaccgcauuuccucuccaacuuuc

SEQ ID NO: 737938 - RNA, 64 nt, Homo Sapiens; identical to SEQ ID NO: 338040

SEQ ID NO: 737939 - RNA, 64 nt, Homo Sapiens; identical to SEQ ID NO: 338041

SEQ ID NO: 737940 - RNA, 64 nt, Homo Sapiens
gccggaguccacucccagugcuugcaagauuccaaguucucaccucuuaaagaaaacccacccc

SEQ ID NO: 737941 - RNA, 64 nt, Homo Sapiens
cgugguguggaggcuguugauguuucuggugucaaguucucagaaguugcugccaccaacucuu

SEQ ID NO: 737942 - RNA, 64 nt, Homo Sapiens
gcccggggacccccgcgggccccagaagcagcccaguucucagagagcccuuggaaggggucuc

SEQ ID NO: 737943 - RNA, 64 nt, Homo Sapiens; identical to SEQ ID NO: 338042

SEQ ID NO: 737944 - RNA, 64 nt, Homo Sapiens; identical to SEQ ID NO: 338043

SEQ ID NO: 737945 - RNA, 64 nt, Homo Sapiens
uacagaugugaagaauguggcaaaggcuuuaauuaguucucaucccuuacuaaacauaagagaa

SEQ ID NO: 737946 - RNA, 64 nt, Homo Sapiens; identical to SEQ ID NO: 338044

SEQ ID NO: 737947 - RNA, 64 nt, Homo Sapiens; identical to SEQ ID NO: 338045

SEQ ID NO: 737948 - RNA, 64 nt, Homo Sapiens
cugacaaggaccaaugcuucuuuaucuggugcucaguucucagucagacgugcagcauggcugc

SEQ ID NO: 737949 - RNA, 64 nt, Homo Sapiens
aacuuaauaaauguaugagucuuaaauaccucuuaguucucauuaaauuuaggaaaauucacac

SEQ ID NO: 737950 - RNA, 64 nt, Homo Sapiens
agcucccucuggggacggcuggcucacugucuccaguucucaauggccaacgaaggugcuugga

SEQ ID NO: 737951 - RNA, 64 nt, Homo Sapiens
agggauacagaguuguccauuaccaaagccuggaaguucucaucaccuccagguggacugcuug

SEQ ID NO: 737952 - RNA, 64 nt, Homo Sapiens
ccacaaagugcuuccuuuuaaaugaaaaggugaaaguucucaacuuaaaaaagaaaagaaaaaa

SEQ ID NO: 737953 - RNA, 64 nt, Homo Sapiens
ccugggguggggccccgggucccaucccaggaggaguucucaggucccccucucauaacuucuc

SEQ ID NO: 737954 - RNA, 64 nt, Homo Sapiens
aacuucucauugugggccagacaaccagacuuccaguucucaggcugucaacguuguccucaug

SEQ ID NO: 737955 - RNA, 64 nt, Homo Sapiens
ccuuacugaacauaagggaacaaagcuuuucauuaguucucaacuacaaaugugaaaaacgugg

SEQ ID NO: 737956 - RNA, 64 nt, Homo Sapiens
agagcugaugguuuuaagguuucucaugauagugaguucucaugggcagauuucucccuugcug

SEQ ID NO: 737957 - RNA, 64 nt, Homo Sapiens
cauguccccaacucaaggcuuccucaaaacccccaguucucacucauguguucacaaggguuac

SEQ ID NO: 737958 - RNA, 64 nt, Homo Sapiens
ggauuccccaagggcacugccccacugcuccuggaguucucaucucccuccccccccacccccc

SEQ ID NO: 737959 - RNA, 64 nt, Homo Sapiens
cauugcagaaggauucauacuucagucaccacucaguucucacuacagugaauguaaggauccc

SEQ ID NO: 737960 - RNA, 64 nt, Homo Sapiens
cuccugaccucgugaucugcccuguuagccaggaaguucucaauuaguagagaugggguuucac

SEQ ID NO: 737961 - RNA, 64 nt, Homo Sapiens
uauggaaaggauacacacuuuuguauuuccucagaguucucacacuauuucuuuuguuccaagu

SEQ ID NO: 737962 - RNA, 64 nt, Homo Sapiens
gguagcucggcaccaacuaagaaaaaaagcacaaaguucucagagcucucgaggaaagugguug

SEQ ID NO: 737963 - RNA, 64 nt, Homo Sapiens
aaauuuuagugaaacuugacucaacuauacacaaaguucucauccuaaaugaacuauuucaguc

SEQ ID NO: 737964 - RNA, 64 nt, Homo Sapiens; identical to SEQ ID NO: 338046

SEQ ID NO: 737965 - RNA, 64 nt, Homo Sapiens; identical to SEQ ID NO: 338047

SEQ ID NO: 737966 - RNA, 64 nt, Homo Sapiens
aagagcuucuggcaccagaacccugucuuccuccaguucucaacacgguguugcucuucaguca

SEQ ID NO: 737967 - RNA, 64 nt, Homo Sapiens
ugcugguuucccuuacacauagcagagcucacucaguucucacaguagccaaaugaagcaguua

SEQ ID NO: 737968 - RNA, 64 nt, Homo Sapiens
ccgcuuauucuccucccuguuaucugcuagaucuaguucucaaucacugcucccccguguguau

SEQ ID NO: 737969 - RNA, 64 nt, Homo Sapiens; identical to SEQ ID NO: 338048

SEQ ID NO: 737970 - RNA, 64 nt, Homo Sapiens; identical to SEQ ID NO: 338049

SEQ ID NO: 737971 - RNA, 64 nt, Homo Sapiens
gaccuggggcugcugugaagcaaaacucaucuggaguucucaaaacugaaaggcuuuucaacca

SEQ ID NO: 737972 - RNA, 64 nt, Homo Sapiens
ggugaaaccagaugaucauugggguuguagaucgaguucucaaauacccauuuguuuuuuacau

SEQ ID NO: 737973 - RNA, 64 nt, Homo Sapiens
agaucugaugguuuuauaagcgugauagcgagugaguucucacgggcuaccuccgugcuguucu

SEQ ID NO: 737974 - RNA, 64 nt, Homo Sapiens
uuuucauuuuauuucucauaauuugaacagagacaguucucauacaugaucagaugcuuuuuuu

SEQ ID NO: 737975 - RNA, 64 nt, Homo Sapiens
cgugacaauuuucuuggaacuccuuuuuauuguuaguucucacuuguuuccauauuuagugaau

SEQ ID NO: 737976 - RNA, 64 nt, Homo Sapiens
ccucagccucccaaauagcuuccucucucgcccaaguucucauguaauuuuuuuaacagggucu

SEQ ID NO: 737977 - RNA, 64 nt, Homo Sapiens
cacagaauuccuccauagcacaucuugccccuuuaguucucaugcugggcugaaguuaauuguu

SEQ ID NO: 737978 - RNA, 64 nt, Homo Sapiens
cuggcaaguggcucugaagccacugagcccggauaguucucagcaggggcagcagauaggagag

SEQ ID NO: 737979 - RNA, 64 nt, Homo Sapiens
ggcaggcucaggucugucccgguuugcacacucaaguucucauguguucucacaccugugcgca

SEQ ID NO: 737980 - RNA, 64 nt, Homo Sapiens
ccuucaaugcccccucccuugagggacuuaguggaguucucauccauuggggagugggggguuc

SEQ ID NO: 737981 - RNA, 64 nt, Homo Sapiens
ucacacucaaaccagugacaccagcacuuccuuaaguucucacacgcccgcgugccugcccaug

SEQ ID NO: 737982 - RNA, 64 nt, Homo Sapiens
auaaaucaucucaucacaaagagaacucccuaagaguucucauaauugaugagaaauggaagau

SEQ ID NO: 737983 - RNA, 64 nt, Homo Sapiens
cucagagacggugagucuccccacaucuccagcaaguucucaagggcgagaacacgaucuucuu

SEQ ID NO: 737984 - RNA, 64 nt, Homo Sapiens
cugcucuuggcuuggucucuacccucacuaccucaguucucaauaacuuagugaaucacugccc

SEQ ID NO: 737985 - RNA, 64 nt, Homo Sapiens
cguggaagaauuucgugccauguggaaacuuuuuaguucucacuacaauguucacauugaugau

SEQ ID NO: 737986 - RNA, 64 nt, Homo Sapiens
uugagaaauacuucuucaaguuaugaugcuugaaaguucucaauaaaguucacgguuucauuac

SEQ ID NO: 737987 - RNA, 64 nt, Homo Sapiens
agaggggccuugcaaggaggggccuuugagccucaguucucauguauugggggguggggguggg

SEQ ID NO: 737988 - RNA, 64 nt, Homo Sapiens
guacauuuguuuugugugucacauggggucaguaaguucucaauaaaaauuguuaagaaaugcc

SEQ ID NO: 737989 - RNA, 64 nt, Homo Sapiens
agaucacaagucagcacuaccuccucccuucuugaguucucaacugagugagcaucauggaggg

SEQ ID NO: 737990 - RNA, 64 nt, Homo Sapiens
uauagccauauccaaaucuuuucccccucccaagaguucucagugucuacauguagacuauucc

SEQ ID NO: 737991 - RNA, 64 nt, Homo Sapiens
cgacuggacuguuuuuguuuuuuugguuacaauuaguucucaucucccugucgucgucauuguu

SEQ ID NO: 737992 - RNA, 64 nt, Homo Sapiens
aauuaccuaagcugccaugcauuuuuuuuuuuacaguucucaaggaagagcacagaacaauuuc

SEQ ID NO: 737993 - RNA, 64 nt, Homo Sapiens
cauucuucacucuguguuugaagagagcagucacaguucucaguaguggggagcauguugggug

SEQ ID NO: 737994 - RNA, 64 nt, Homo Sapiens
ccagcuccuuuguguggcacacucacauguacgaaguucucaccucagggcaccccagccccac

SEQ ID NO: 737995 - RNA, 64 nt, Homo Sapiens
aaaugguagauauuaauuuugugccuggcauauaaguucucaauugccuaaauauauauguaca

SEQ ID NO: 737996 - RNA, 64 nt, Homo Sapiens
uccuacccaucccugcaugaagggucaaugcaagaguucucauuaaguacuggagcacgugguc

SEQ ID NO: 737997 - RNA, 64 nt, Homo Sapiens; identical to SEQ ID NO: 338050

SEQ ID NO: 737998 - RNA, 64 nt, Homo Sapiens; identical to SEQ ID NO: 338051

SEQ ID NO: 737999 - RNA, 64 nt, Homo Sapiens
cacuaugcacucagaaaaauccacacuccaccaaaguucucauggcuuucaucagccccagccc

SEQ ID NO: 738000 - RNA, 64 nt, Homo Sapiens; identical to SEQ ID NO: 314992

SEQ ID NO: 738001 - RNA, 64 nt, Homo Sapiens; identical to SEQ ID NO: 314993

SEQ ID NO: 738002 - RNA, 64 nt, Homo Sapiens; identical to SEQ ID NO: 314994

SEQ ID NO: 738003 - RNA, 64 nt, Homo Sapiens; identical to SEQ ID NO: 314995

SEQ ID NO: 738004 - RNA, 64 nt, Homo Sapiens; identical to SEQ ID NO: 314996

SEQ ID NO: 738005 - RNA, 64 nt, Homo Sapiens; identical to SEQ ID NO: 314997

SEQ ID NO: 738006 - RNA, 64 nt, Homo Sapiens; identical to SEQ ID NO: 314998

SEQ ID NO: 738007 - RNA, 64 nt, Homo Sapiens; identical to SEQ ID NO: 314999

SEQ ID NO: 738008 - RNA, 64 nt, Homo Sapiens; identical to SEQ ID NO: 315000

SEQ ID NO: 738009 - RNA, 64 nt, Homo Sapiens; identical to SEQ ID NO: 315001

SEQ ID NO: 738010 - RNA, 64 nt, Homo Sapiens; identical to SEQ ID NO: 315002

SEQ ID NO: 738011 - RNA, 64 nt, Homo Sapiens; identical to SEQ ID NO: 315003

SEQ ID NO: 738012 - RNA, 64 nt, Homo Sapiens; identical to SEQ ID NO: 315004

SEQ ID NO: 738013 - RNA, 64 nt, Homo Sapiens; identical to SEQ ID NO: 315005

SEQ ID NO: 738014 - RNA, 64 nt, Homo Sapiens; identical to SEQ ID NO: 315006

SEQ ID NO: 738015 - RNA, 64 nt, Homo Sapiens; identical to SEQ ID NO: 315007

SEQ ID NO: 738016 - RNA, 64 nt, Homo Sapiens; identical to SEQ ID NO: 315008

SEQ ID NO: 738017 - RNA, 64 nt, Homo Sapiens; identical to SEQ ID NO: 315009

SEQ ID NO: 738018 - RNA, 64 nt, Homo Sapiens; identical to SEQ ID NO: 315010

SEQ ID NO: 738019 - RNA, 64 nt, Homo Sapiens; identical to SEQ ID NO: 315011

SEQ ID NO: 738020 - RNA, 64 nt, Homo Sapiens; identical to SEQ ID NO: 315012

SEQ ID NO: 738021 - RNA, 64 nt, Homo Sapiens; identical to SEQ ID NO: 315013

SEQ ID NO: 738022 - RNA, 64 nt, Homo Sapiens; identical to SEQ ID NO: 315014

SEQ ID NO: 738023 - RNA, 64 nt, Homo Sapiens; identical to SEQ ID NO: 315015

SEQ ID NO: 738024 - RNA, 64 nt, Homo Sapiens; identical to SEQ ID NO: 315016

SEQ ID NO: 738025 - RNA, 64 nt, Homo Sapiens; identical to SEQ ID NO: 315017

SEQ ID NO: 738026 - RNA, 64 nt, Homo Sapiens; identical to SEQ ID NO: 315018

SEQ ID NO: 738027 - RNA, 64 nt, Homo Sapiens; identical to SEQ ID NO: 315019

SEQ ID NO: 738028 - RNA, 64 nt, Homo Sapiens; identical to SEQ ID NO: 522269

SEQ ID NO: 738029 - RNA, 64 nt, Homo Sapiens; identical to SEQ ID NO: 522270

SEQ ID NO: 738030 - RNA, 64 nt, Homo Sapiens; identical to SEQ ID NO: 522271

SEQ ID NO: 738031 - RNA, 64 nt, Homo Sapiens; identical to SEQ ID NO: 522272

SEQ ID NO: 738032 - RNA, 64 nt, Homo Sapiens; identical to SEQ ID NO: 522273

SEQ ID NO: 738033 - RNA, 64 nt, Homo Sapiens; identical to SEQ ID NO: 522274

SEQ ID NO: 738034 - RNA, 64 nt, Homo Sapiens; identical to SEQ ID NO: 522275

SEQ ID NO: 738035 - RNA, 64 nt, Homo Sapiens; identical to SEQ ID NO: 522276

SEQ ID NO: 738036 - RNA, 64 nt, Homo Sapiens; identical to SEQ ID NO: 522277

SEQ ID NO: 738037 - RNA, 64 nt, Homo Sapiens; identical to SEQ ID NO: 522278

SEQ ID NO: 738038 - RNA, 64 nt, Homo Sapiens; identical to SEQ ID NO: 522279

SEQ ID NO: 738039 - RNA, 64 nt, Homo Sapiens; identical to SEQ ID NO: 522280

SEQ ID NO: 738040 - RNA, 64 nt, Homo Sapiens; identical to SEQ ID NO: 522281

SEQ ID NO: 738041 - RNA, 64 nt, Homo Sapiens; identical to SEQ ID NO: 522282

SEQ ID NO: 738042 - RNA, 64 nt, Homo Sapiens; identical to SEQ ID NO: 522283

SEQ ID NO: 738043 - RNA, 64 nt, Homo Sapiens; identical to SEQ ID NO: 522284

SEQ ID NO: 738044 - RNA, 64 nt, Homo Sapiens; identical to SEQ ID NO: 522285

SEQ ID NO: 738045 - RNA, 64 nt, Homo Sapiens; identical to SEQ ID NO: 522286

SEQ ID NO: 738046 - RNA, 64 nt, Homo Sapiens; identical to SEQ ID NO: 522287

SEQ ID NO: 738047 - RNA, 64 nt, Homo Sapiens; identical to SEQ ID NO: 522288

SEQ ID NO: 738048 - RNA, 64 nt, Homo Sapiens; identical to SEQ ID NO: 522289

SEQ ID NO: 738049 - RNA, 64 nt, Homo Sapiens; identical to SEQ ID NO: 522290

SEQ ID NO: 738050 - RNA, 64 nt, Homo Sapiens; identical to SEQ ID NO: 522291

SEQ ID NO: 738051 - RNA, 64 nt, Homo Sapiens; identical to SEQ ID NO: 522292

SEQ ID NO: 738052 - RNA, 64 nt, Homo Sapiens; identical to SEQ ID NO: 522293

SEQ ID NO: 738053 - RNA, 64 nt, Homo Sapiens; identical to SEQ ID NO: 522294

SEQ ID NO: 738054 - RNA, 64 nt, Homo Sapiens; identical to SEQ ID NO: 522295

SEQ ID NO: 738055 - RNA, 64 nt, Homo Sapiens; identical to SEQ ID NO: 522296

SEQ ID NO: 738056 - RNA, 64 nt, Homo Sapiens; identical to SEQ ID NO: 522297

SEQ ID NO: 738057 - RNA, 64 nt, Homo Sapiens; identical to SEQ ID NO: 522298

SEQ ID NO: 738058 - RNA, 64 nt, Homo Sapiens; identical to SEQ ID NO: 522299

SEQ ID NO: 738059 - RNA, 64 nt, Homo Sapiens; identical to SEQ ID NO: 522300

SEQ ID NO: 738060 - RNA, 64 nt, Homo Sapiens; identical to SEQ ID NO: 522301

SEQ ID NO: 738061 - RNA, 64 nt, Homo Sapiens; identical to SEQ ID NO: 522302

SEQ ID NO: 738062 - RNA, 64 nt, Homo Sapiens; identical to SEQ ID NO: 522303

SEQ ID NO: 738063 - RNA, 64 nt, Homo Sapiens; identical to SEQ ID NO: 522304

SEQ ID NO: 738064 - RNA, 64 nt, Homo Sapiens; identical to SEQ ID NO: 522305

SEQ ID NO: 738065 - RNA, 64 nt, Homo Sapiens; identical to SEQ ID NO: 522306

SEQ ID NO: 738066 - RNA, 64 nt, Homo Sapiens; identical to SEQ ID NO: 522307

SEQ ID NO: 738067 - RNA, 64 nt, Homo Sapiens; identical to SEQ ID NO: 522308

SEQ ID NO: 738068 - RNA, 64 nt, Homo Sapiens; identical to SEQ ID NO: 522309

SEQ ID NO: 738069 - RNA, 64 nt, Homo Sapiens; identical to SEQ ID NO: 522310

SEQ ID NO: 738070 - RNA, 64 nt, Homo Sapiens; identical to SEQ ID NO: 522311

SEQ ID NO: 738071 - RNA, 64 nt, Homo Sapiens; identical to SEQ ID NO: 522312

SEQ ID NO: 738072 - RNA, 64 nt, Homo Sapiens; identical to SEQ ID NO: 522313

SEQ ID NO: 738073 - RNA, 64 nt, Homo Sapiens; identical to SEQ ID NO: 522314

SEQ ID NO: 738074 - RNA, 64 nt, Homo Sapiens; identical to SEQ ID NO: 522315

SEQ ID NO: 738075 - RNA, 64 nt, Homo Sapiens; identical to SEQ ID NO: 522316

SEQ ID NO: 738076 - RNA, 64 nt, Homo Sapiens; identical to SEQ ID NO: 522317

SEQ ID NO: 738077 - RNA, 64 nt, Homo Sapiens; identical to SEQ ID NO: 522318

SEQ ID NO: 738078 - RNA, 64 nt, Homo Sapiens; identical to SEQ ID NO: 522319

SEQ ID NO: 738079 - RNA, 64 nt, Homo Sapiens; identical to SEQ ID NO: 522320

SEQ ID NO: 738080 - RNA, 64 nt, Homo Sapiens; identical to SEQ ID NO: 522321

SEQ ID NO: 738081 - RNA, 64 nt, Homo Sapiens; identical to SEQ ID NO: 522322

SEQ ID NO: 738082 - RNA, 64 nt, Homo Sapiens; identical to SEQ ID NO: 522323

SEQ ID NO: 738083 - RNA, 64 nt, Homo Sapiens; identical to SEQ ID NO: 522324

SEQ ID NO: 738084 - RNA, 64 nt, Homo Sapiens; identical to SEQ ID NO: 522325

SEQ ID NO: 738085 - RNA, 64 nt, Homo Sapiens; identical to SEQ ID NO: 522326

SEQ ID NO: 738086 - RNA, 64 nt, Homo Sapiens; identical to SEQ ID NO: 333348

SEQ ID NO: 738087 - RNA, 64 nt, Homo Sapiens; identical to SEQ ID NO: 333349

SEQ ID NO: 738088 - RNA, 64 nt, Homo Sapiens; identical to SEQ ID NO: 333350

SEQ ID NO: 738089 - RNA, 64 nt, Homo Sapiens; identical to SEQ ID NO: 333351

SEQ ID NO: 738090 - RNA, 64 nt, Homo Sapiens; identical to SEQ ID NO: 333352

SEQ ID NO: 738091 - RNA, 64 nt, Homo Sapiens; identical to SEQ ID NO: 333353

SEQ ID NO: 738092 - RNA, 64 nt, Homo Sapiens; identical to SEQ ID NO: 333354

SEQ ID NO: 738093 - RNA, 64 nt, Homo Sapiens; identical to SEQ ID NO: 333355

SEQ ID NO: 738094 - RNA, 64 nt, Homo Sapiens; identical to SEQ ID NO: 333356

SEQ ID NO: 738095 - RNA, 64 nt, Homo Sapiens; identical to SEQ ID NO: 333357

SEQ ID NO: 738096 - RNA, 64 nt, Homo Sapiens; identical to SEQ ID NO: 333358

SEQ ID NO: 738097 - RNA, 64 nt, Homo Sapiens; identical to SEQ ID NO: 333359

SEQ ID NO: 738098 - RNA, 64 nt, Homo Sapiens; identical to SEQ ID NO: 333360

SEQ ID NO: 738099 - RNA, 64 nt, Homo Sapiens; identical to SEQ ID NO: 333361

SEQ ID NO: 738100 - RNA, 64 nt, Homo Sapiens; identical to SEQ ID NO: 333362

SEQ ID NO: 738101 - RNA, 64 nt, Homo Sapiens; identical to SEQ ID NO: 333363

SEQ ID NO: 738102 - RNA, 64 nt, Homo Sapiens; identical to SEQ ID NO: 333364

SEQ ID NO: 738103 - RNA, 64 nt, Homo Sapiens; identical to SEQ ID NO: 333365

SEQ ID NO: 738104 - RNA, 64 nt, Homo Sapiens; identical to SEQ ID NO: 333366

SEQ ID NO: 738105 - RNA, 64 nt, Homo Sapiens; identical to SEQ ID NO: 333367

SEQ ID NO: 738106 - RNA, 64 nt, Homo Sapiens; identical to SEQ ID NO: 333368

SEQ ID NO: 738107 - RNA, 64 nt, Homo Sapiens; identical to SEQ ID NO: 333369

SEQ ID NO: 738108 - RNA, 64 nt, Homo Sapiens; identical to SEQ ID NO: 333370

SEQ ID NO: 738109 - RNA, 64 nt, Homo Sapiens; identical to SEQ ID NO: 333371

SEQ ID NO: 738110 - RNA, 64 nt, Homo Sapiens; identical to SEQ ID NO: 333372

SEQ ID NO: 738111 - RNA, 64 nt, Homo Sapiens; identical to SEQ ID NO: 333373

SEQ ID NO: 738112 - RNA, 64 nt, Homo Sapiens; identical to SEQ ID NO: 333374

SEQ ID NO: 738113 - RNA, 64 nt, Homo Sapiens; identical to SEQ ID NO: 333375

SEQ ID NO: 738114 - RNA, 64 nt, Homo Sapiens; identical to SEQ ID NO: 333376

SEQ ID NO: 738115 - RNA, 64 nt, Homo Sapiens; identical to SEQ ID NO: 333377

SEQ ID NO: 738116 - RNA, 64 nt, Homo Sapiens; identical to SEQ ID NO: 333378

SEQ ID NO: 738117 - RNA, 64 nt, Homo Sapiens; identical to SEQ ID NO: 333379

SEQ ID NO: 738118 - RNA, 64 nt, Homo Sapiens; identical to SEQ ID NO: 333380

SEQ ID NO: 738119 - RNA, 64 nt, Homo Sapiens; identical to SEQ ID NO: 333381

SEQ ID NO: 738120 - RNA, 64 nt, Homo Sapiens; identical to SEQ ID NO: 333382

SEQ ID NO: 738121 - RNA, 64 nt, Homo Sapiens; identical to SEQ ID NO: 333383

SEQ ID NO: 738122 - RNA, 64 nt, Homo Sapiens; identical to SEQ ID NO: 333384

SEQ ID NO: 738123 - RNA, 64 nt, Homo Sapiens; identical to SEQ ID NO: 333385

SEQ ID NO: 738124 - RNA, 64 nt, Homo Sapiens; identical to SEQ ID NO: 333386

SEQ ID NO: 738125 - RNA, 64 nt, Homo Sapiens; identical to SEQ ID NO: 333387

SEQ ID NO: 738126 - RNA, 64 nt, Homo Sapiens; identical to SEQ ID NO: 333388

SEQ ID NO: 738127 - RNA, 64 nt, Homo Sapiens; identical to SEQ ID NO: 333389

SEQ ID NO: 738128 - RNA, 64 nt, Homo Sapiens; identical to SEQ ID NO: 333390

SEQ ID NO: 738129 - RNA, 64 nt, Homo Sapiens; identical to SEQ ID NO: 333391

SEQ ID NO: 738130 - RNA, 64 nt, Homo Sapiens; identical to SEQ ID NO: 333392

SEQ ID NO: 738131 - RNA, 64 nt, Homo Sapiens; identical to SEQ ID NO: 333393

SEQ ID NO: 738132 - RNA, 64 nt, Homo Sapiens; identical to SEQ ID NO: 333394

SEQ ID NO: 738133 - RNA, 64 nt, Homo Sapiens; identical to SEQ ID NO: 333395

SEQ ID NO: 738134 - RNA, 64 nt, Homo Sapiens; identical to SEQ ID NO: 333396

SEQ ID NO: 738135 - RNA, 64 nt, Homo Sapiens; identical to SEQ ID NO: 333397

SEQ ID NO: 738136 - RNA, 64 nt, Homo Sapiens; identical to SEQ ID NO: 333398

SEQ ID NO: 738137 - RNA, 64 nt, Homo Sapiens; identical to SEQ ID NO: 333399

SEQ ID NO: 738138 - RNA, 64 nt, Homo Sapiens; identical to SEQ ID NO: 333400

SEQ ID NO: 738139 - RNA, 64 nt, Homo Sapiens; identical to SEQ ID NO: 333401

SEQ ID NO: 738140 - RNA, 64 nt, Homo Sapiens; identical to SEQ ID NO: 333402

SEQ ID NO: 738141 - RNA, 64 nt, Homo Sapiens; identical to SEQ ID NO: 333403

SEQ ID NO: 738142 - RNA, 64 nt, Homo Sapiens; identical to SEQ ID NO: 333404

SEQ ID NO: 738143 - RNA, 64 nt, Homo Sapiens; identical to SEQ ID NO: 333405

SEQ ID NO: 738144 - RNA, 64 nt, Homo Sapiens; identical to SEQ ID NO: 333406

SEQ ID NO: 738145 - RNA, 64 nt, Homo Sapiens; identical to SEQ ID NO: 333407

SEQ ID NO: 738146 - RNA, 64 nt, Homo Sapiens; identical to SEQ ID NO: 333408

SEQ ID NO: 738147 - RNA, 64 nt, Homo Sapiens; identical to SEQ ID NO: 333409

SEQ ID NO: 738148 - RNA, 64 nt, Homo Sapiens; identical to SEQ ID NO: 333410

SEQ ID NO: 738149 - RNA, 64 nt, Homo Sapiens; identical to SEQ ID NO: 333411

SEQ ID NO: 738150 - RNA, 64 nt, Homo Sapiens; identical to SEQ ID NO: 333412

SEQ ID NO: 738151 - RNA, 64 nt, Homo Sapiens; identical to SEQ ID NO: 333413

SEQ ID NO: 738152 - RNA, 64 nt, Homo Sapiens; identical to SEQ ID NO: 333414

SEQ ID NO: 738153 - RNA, 64 nt, Homo Sapiens; identical to SEQ ID NO: 333415

SEQ ID NO: 738154 - RNA, 64 nt, Homo Sapiens; identical to SEQ ID NO: 333416

SEQ ID NO: 738155 - RNA, 64 nt, Homo Sapiens; identical to SEQ ID NO: 333417

SEQ ID NO: 738156 - RNA, 64 nt, Homo Sapiens; identical to SEQ ID NO: 333418

SEQ ID NO: 738157 - RNA, 64 nt, Homo Sapiens; identical to SEQ ID NO: 333419

SEQ ID NO: 738158 - RNA, 64 nt, Homo Sapiens; identical to SEQ ID NO: 333420

SEQ ID NO: 738159 - RNA, 64 nt, Homo Sapiens; identical to SEQ ID NO: 333421

SEQ ID NO: 738160 - RNA, 64 nt, Homo Sapiens; identical to SEQ ID NO: 333422

SEQ ID NO: 738161 - RNA, 64 nt, Homo Sapiens; identical to SEQ ID NO: 333423

SEQ ID NO: 738162 - RNA, 64 nt, Homo Sapiens; identical to SEQ ID NO: 333424

SEQ ID NO: 738163 - RNA, 64 nt, Homo Sapiens; identical to SEQ ID NO: 333425

SEQ ID NO: 738164 - RNA, 64 nt, Homo Sapiens; identical to SEQ ID NO: 333426

SEQ ID NO: 738165 - RNA, 64 nt, Homo Sapiens; identical to SEQ ID NO: 333427

SEQ ID NO: 738166 - RNA, 64 nt, Homo Sapiens; identical to SEQ ID NO: 333428

SEQ ID NO: 738167 - RNA, 64 nt, Homo Sapiens; identical to SEQ ID NO: 333429

SEQ ID NO: 738168 - RNA, 64 nt, Homo Sapiens; identical to SEQ ID NO: 333430

SEQ ID NO: 738169 - RNA, 64 nt, Homo Sapiens; identical to SEQ ID NO: 333431

SEQ ID NO: 738170 - RNA, 64 nt, Homo Sapiens; identical to SEQ ID NO: 333432

SEQ ID NO: 738171 - RNA, 64 nt, Homo Sapiens; identical to SEQ ID NO: 333433

SEQ ID NO: 738172 - RNA, 64 nt, Homo Sapiens; identical to SEQ ID NO: 333434

SEQ ID NO: 738173 - RNA, 64 nt, Homo Sapiens; identical to SEQ ID NO: 333435

SEQ ID NO: 738174 - RNA, 64 nt, Homo Sapiens; identical to SEQ ID NO: 333436

SEQ ID NO: 738175 - RNA, 64 nt, Homo Sapiens; identical to SEQ ID NO: 333437

SEQ ID NO: 738176 - RNA, 64 nt, Homo Sapiens; identical to SEQ ID NO: 333438

SEQ ID NO: 738177 - RNA, 64 nt, Homo Sapiens; identical to SEQ ID NO: 333439

SEQ ID NO: 738178 - RNA, 64 nt, Homo Sapiens; identical to SEQ ID NO: 333440

SEQ ID NO: 738179 - RNA, 64 nt, Homo Sapiens; identical to SEQ ID NO: 333441

SEQ ID NO: 738180 - RNA, 64 nt, Homo Sapiens; identical to SEQ ID NO: 333442

SEQ ID NO: 738181 - RNA, 64 nt, Homo Sapiens; identical to SEQ ID NO: 333443

SEQ ID NO: 738182 - RNA, 64 nt, Homo Sapiens; identical to SEQ ID NO: 333444

SEQ ID NO: 738183 - RNA, 64 nt, Homo Sapiens; identical to SEQ ID NO: 333445

SEQ ID NO: 738184 - RNA, 64 nt, Homo Sapiens; identical to SEQ ID NO: 333446

SEQ ID NO: 738185 - RNA, 64 nt, Homo Sapiens; identical to SEQ ID NO: 333447

SEQ ID NO: 738186 - RNA, 64 nt, Homo Sapiens; identical to SEQ ID NO: 333448

SEQ ID NO: 738187 - RNA, 64 nt, Homo Sapiens; identical to SEQ ID NO: 333449

SEQ ID NO: 738188 - RNA, 64 nt, Homo Sapiens; identical to SEQ ID NO: 333450

SEQ ID NO: 738189 - RNA, 64 nt, Homo Sapiens; identical to SEQ ID NO: 333451

SEQ ID NO: 738190 - RNA, 64 nt, Homo Sapiens; identical to SEQ ID NO: 333452

SEQ ID NO: 738191 - RNA, 64 nt, Homo Sapiens; identical to SEQ ID NO: 333453

SEQ ID NO: 738192 - RNA, 64 nt, Homo Sapiens; identical to SEQ ID NO: 333454

SEQ ID NO: 738193 - RNA, 55 nt, Homo Sapiens; identical to SEQ ID NO: 333455

SEQ ID NO: 738194 - RNA, 64 nt, Homo Sapiens; identical to SEQ ID NO: 333456

SEQ ID NO: 738195 - RNA, 64 nt, Homo Sapiens; identical to SEQ ID NO: 333457

SEQ ID NO: 738196 - RNA, 64 nt, Homo Sapiens; identical to SEQ ID NO: 333458

SEQ ID NO: 738197 - RNA, 64 nt, Homo Sapiens; identical to SEQ ID NO: 315524

SEQ ID NO: 738198 - RNA, 64 nt, Homo Sapiens; identical to SEQ ID NO: 315525

SEQ ID NO: 738199 - RNA, 64 nt, Homo Sapiens; identical to SEQ ID NO: 315526

SEQ ID NO: 738200 - RNA, 64 nt, Homo Sapiens; identical to SEQ ID NO: 315527

SEQ ID NO: 738201 - RNA, 64 nt, Homo Sapiens; identical to SEQ ID NO: 315528

SEQ ID NO: 738202 - RNA, 64 nt, Homo Sapiens; identical to SEQ ID NO: 315529

SEQ ID NO: 738203 - RNA, 64 nt, Homo Sapiens; identical to SEQ ID NO: 315530

SEQ ID NO: 738204 - RNA, 64 nt, Homo Sapiens; identical to SEQ ID NO: 315531

SEQ ID NO: 738205 - RNA, 64 nt, Homo Sapiens; identical to SEQ ID NO: 315532

SEQ ID NO: 738206 - RNA, 64 nt, Homo Sapiens; identical to SEQ ID NO: 315533

SEQ ID NO: 738207 - RNA, 64 nt, Homo Sapiens; identical to SEQ ID NO: 315534

SEQ ID NO: 738208 - RNA, 64 nt, Homo Sapiens; identical to SEQ ID NO: 315535

SEQ ID NO: 738209 - RNA, 64 nt, Homo Sapiens; identical to SEQ ID NO: 315536

SEQ ID NO: 738210 - RNA, 64 nt, Homo Sapiens; identical to SEQ ID NO: 315537

SEQ ID NO: 738211 - RNA, 64 nt, Homo Sapiens; identical to SEQ ID NO: 315538

SEQ ID NO: 738212 - RNA, 64 nt, Homo Sapiens; identical to SEQ ID NO: 315539

SEQ ID NO: 738213 - RNA, 64 nt, Homo Sapiens
cuacacagacugcagcaacgguugcaucugcauauccuaagaggaaaaaaugaccuucaagaga

SEQ ID NO: 738214 - RNA, 64 nt, Homo Sapiens
ugaccuuuuguuacucaaaguaaaguacuaggaguccuaagaaauguucuguucuuguacauua

SEQ ID NO: 738215 - RNA, 64 nt, Homo Sapiens
auuuuggugggcagggacugccuccucccggaauuccuaagauccgcccagcugccaccauuuu

SEQ ID NO: 738216 - RNA, 64 nt, Homo Sapiens
aucccuggguaauggaugguaagaugauggagauuccuaagauugguggaguugggcaaugcau

SEQ ID NO: 738217 - RNA, 64 nt, Homo Sapiens
aaaagccacuuucuuccaaugcaucuaccuuaccuccuaagaagcccauaucgauugccaaaga

SEQ ID NO: 738218 - RNA, 64 nt, Homo Sapiens
aaaggugguggcagccacaagagagacaagccaguccuaagagaucuucugcagccaccagugg

SEQ ID NO: 738219 - RNA, 64 nt, Homo Sapiens
aguguguauuuucauuccagguaaguaggugaauuccuaagauacauucuugucccccaaaccu

SEQ ID NO: 738220 - RNA, 64 nt, Homo Sapiens
ucuaagaacacuacuagaagucugacauuucagauccuaagaauaugaccagcgugugacucau

SEQ ID NO: 738221 - RNA, 64 nt, Homo Sapiens
cagucuuuaugaugggauuaagguggacaagaucuccuaagaucugugaaugggauuaaggugg

SEQ ID NO: 738222 - RNA, 64 nt, Homo Sapiens
aagaucugugaaugggauuaagguggacaagaucuccuaagaucugaaaagaaaccuuaauacg

SEQ ID NO: 738223 - RNA, 64 nt, Homo Sapiens
guuacuuuccuaaggaguccuagcauccuuagauuggcucaacuccacugaccuacugaauauc

SEQ ID NO: 738224 - RNA, 64 nt, Homo Sapiens
agaaaucuggaagucaucuucaccaucuacccauuggcucaagcuguauguaagugaaaagcau

SEQ ID NO: 738225 - RNA, 64 nt, Homo Sapiens
gauuucgugugaaaugucccgauuguuaaaaaguuggcucaauuauuuuuaaaacauuuuguaa

SEQ ID NO: 738226 - RNA, 64 nt, Homo Sapiens
ugguccacguccuauaucuuauuauauuuacucauggcucaaugggggccuccagagacccucu

SEQ ID NO: 738227 - RNA, 64 nt, Homo Sapiens
ugggaggcggguggguggucugucugggaaguuucccugaaaggcccucaccccugugugcuag

SEQ ID NO: 738228 - RNA, 64 nt, Homo Sapiens
aggaaaaaaaaaaaaaaagaacaucaccaagaggcccugaaaagugggggaggguuucacuguu

SEQ ID NO: 738229 - RNA, 64 nt, Homo Sapiens
guguccugaccagcuccaaaaauauacuucacugcccugaaaaacagacacagggagaguuggu

SEQ ID NO: 738230 - RNA, 64 nt, Homo Sapiens
agccucccggaaccuccccuuuggcuaaccgagccccugaaaugcccaguacugccauuugaca

SEQ ID NO: 738231 - RNA, 64 nt, Homo Sapiens
cugcagcugaggcuuggaaacguuucuuguguugcccugaaaaaucuuugagaccucagggagg

SEQ ID NO: 738232 - RNA, 64 nt, Homo Sapiens
caggccagggggcugccaucuucuucacagacaucccugaaaggaagccccuuuggggcaggga

SEQ ID NO: 738233 - RNA, 64 nt, Homo Sapiens
aacagaauucugaaguuuccgaauucaaccucagcccugaaaauguugauauuaaagcgcaaau

SEQ ID NO: 738234 - RNA, 64 nt, Homo Sapiens
gacugccugcagaaagaccaacccaguaauucuacccugaaagugugugaaaagcuacccugaa

SEQ ID NO: 738235 - RNA, 64 nt, Homo Sapiens
caguaauucuacccugaaagagugugaaaagcuacccugaaaccuccccagggccauaguguag

SEQ ID NO: 738236 - RNA, 64 nt, Homo Sapiens
cccagagugaaccguccuuucacacaucugggugcccugaaagggcccuuccccucccccacuc

SEQ ID NO: 738237 - RNA, 64 nt, Homo Sapiens
caucagggaggguuaggaaaaccacaaacggagccccugaaagccucacguauuucacagagca

SEQ ID NO: 738238 - RNA, 64 nt, Homo Sapiens
agaagugcccuuaaggaucaccggagacccacagcccugaaacgaacaugugccccugccaagg

SEQ ID NO: 738239 - RNA, 64 nt, Homo Sapiens
ugugccccugccaaggccggcuccccuccccgcccccugaaacaccgccacccugucucaguac

SEQ ID NO: 738240 - RNA, 64 nt, Homo Sapiens
aacuaaaaacuccuuaacuuacuguugcuuacaccccugaaagucuguuuuuaagcaaaugggu

SEQ ID NO: 738241 - RNA, 64 nt, Homo Sapiens
uuuaacccuuuuaaaagagaccuauguugaaaaccccugaaaauucacugaagaaaaaucauua

SEQ ID NO: 738242 - RNA, 64 nt, Homo Sapiens
gaaaauaaauauugugcuuuugccuaucuucuuacccugaaacauuucuuucuagaaacacauu

SEQ ID NO: 738243 - RNA, 64 nt, Homo Sapiens
cugaguuuaaguggcuugauuaucucuucuaacccccugaaaucgaaggauuuuagaaaucaua

SEQ ID NO: 738244 - RNA, 64 nt, Homo Sapiens
gggaaggacaagucaccucauuuugcuuucuuaccccugaaagaagcuuccugcucuuucuccu

SEQ ID NO: 738245 - RNA, 64 nt, Homo Sapiens
cccagaaguuacagaugccuuggcaagauaaaaacccugaaauuguacuuuagugagagcugac

SEQ ID NO: 738246 - RNA, 64 nt, Homo Sapiens
caagcuaacgcuaacuucccuauguaaugcuucacccugaaagggaaaaagaacacuuuugaac

SEQ ID NO: 738247 - RNA, 64 nt, Homo Sapiens
uuggcuaaacacaaaugagagcuucccucaggcucccugaaacagcuaggcccaaaucacaagu

SEQ ID NO: 738248 - RNA, 64 nt, Homo Sapiens
aggcccaaaucacaaguacaguccuuuccaacaccccugaaauucauagucaguagcagagaaa

SEQ ID NO: 738249 - RNA, 64 nt, Homo Sapiens
auauaaggcauucuguauaaagaaucccuaaguccccugaaauuagaauuauagaugggguuca

SEQ ID NO: 738250 - RNA, 64 nt, Homo Sapiens
uuaggccucucagagucaccaugaaagcauucuucccugaaaagagaagugaggagaaaccugc

SEQ ID NO: 738251 - RNA, 64 nt, Homo Sapiens
acaccccgagcgagcaccccaaagugcacaaagcugaguaaaaagcugcccccuucaaacagaa

SEQ ID NO: 738252 - RNA, 64 nt, Homo Sapiens
ccugaagguguaaaauuguaaauauuuuuaucuaugaguaaauguuaaguaguuguuuuaaaau

SEQ ID NO: 738253 - RNA, 64 nt, Homo Sapiens
cugucccuuuuucccccuuuuguacugggcaauaugaguaaaauugcauguauuuuguuuuuca

SEQ ID NO: 738254 - RNA, 64 nt, Homo Sapiens
aaaaaucuucugcugcacaugaauucagguccuuugaguaaaaacuuaaaaggacaugcccacu

SEQ ID NO: 738255 - RNA, 64 nt, Homo Sapiens
ccauuuccuuucucuguuucuaugucacuguuuuugaguaaaaugauuaaugguauaugcuccu

SEQ ID NO: 738256 - RNA, 64 nt, Homo Sapiens
uccagagcaggaaugagccucuagguugggaaacugaguaaaagcacacaguggagagguuaau

SEQ ID NO: 738257 - RNA, 64 nt, Homo Sapiens
uaaagaaauauugauaguaaaaaugguaaguacuugaguaaaucgguaagaaguaauaaugagu

SEQ ID NO: 738258 - RNA, 64 nt, Homo Sapiens
guaaguacuugaguaaaucuguaagaaguaauaaugaguaaaugucagaaaguaaaucugagag

SEQ ID NO: 738259 - RNA, 64 nt, Homo Sapiens
agcuggucaucgucuuagcauacauauccuacacugaguaaaccguaacgggaugucaucagca

SEQ ID NO: 738260 - RNA, 64 nt, Homo Sapiens
uuaaagcuauauaaacacaguuaacccuuguaaaugaguaaacaaauuuuuacauguaagauuc

SEQ ID NO: 738261 - RNA, 64 nt, Homo Sapiens
aauuaagaaauacauaugcaaauucuuuugugauugaguaaaagcagcuuaaauuacuuuucuu

SEQ ID NO: 738262 - RNA, 64 nt, Homo Sapiens
aaauuagcagauagucuuugcucuaaaugauaucugaguaaauagacuugaggaauccucuacc

SEQ ID NO: 738263 - RNA, 64 nt, Homo Sapiens
gagguggugugcagaggaaagcugcauucacuauugaguaaaaacuuguagaaagcacauuaua

SEQ ID NO: 738264 - RNA, 64 nt, Homo Sapiens
aaauguagagaugguuuccucauucagggucgauugaguaaaaaggcccuggauaaugcuguag

SEQ ID NO: 738265 - RNA, 64 nt, Homo Sapiens
ucuugauugcacagaauguaccacugugcccagcugaguaaauugcuggaauuacaggugugag

SEQ ID NO: 738266 - RNA, 64 nt, Homo Sapiens
aaugcccaaauccgaaugaccccaguuuuccuaaugaguaaaaugaucccagaugugccccaga

SEQ ID NO: 738267 - RNA, 64 nt, Homo Sapiens
agcucaaggcuauuagguugaauauuugcuuucaugaguaaauguggaucuuuggggaauggcu

SEQ ID NO: 738268 - RNA, 64 nt, Homo Sapiens
caggcuguuaucuuuagaauacaguccugguuucugaguaaagggaaugugugcaaaacacguc

SEQ ID NO: 738269 - RNA, 64 nt, Homo Sapiens
gaggcacagagaacauaaguuccuguuuaacacuugaguaaacuuguaauccucaugugaguau

SEQ ID NO: 738270 - RNA, 64 nt, Homo Sapiens
agugcuguuuacucauuggaccugacuuaggccagcccuacagacuucagguuaucuugaacug

SEQ ID NO: 738271 - RNA, 64 nt, Homo Sapiens
agugccuuuuacguauuggaacugacucaugccagcccuacagacuucaguuuaucuuggacug

SEQ ID NO: 738272 - RNA, 59 nt, Homo Sapiens; identical to SEQ ID NO: 494003

SEQ ID NO: 738273 - RNA, 62 nt, Homo Sapiens
ccccacaccagucaaggcuucucagcuggagaaccggggagcagcuggacacccagccaagg

SEQ ID NO: 738274 - RNA, 62 nt, Homo Sapiens
auguuccuaaaccaggaagcgggauugauacgaccggggaaacuguucauuuaccaaccugg

SEQ ID NO: 738275 - RNA, 62 nt, Homo Sapiens
cagaaguugcagugagccgaagaauugcuugaaccggggaggacucgggaggcugaggcagg

SEQ ID NO: 738276 - RNA, 62 nt, Homo Sapiens
caguuucagacaguucucuaugguaaggggagaccggggaguaaaugggguggggguggggg

SEQ ID NO: 738277 - RNA, 62 nt, Homo Sapiens
ucagucuuuccugcucagccaggggggaugauaccggggacucuccagagccaugacuagau

SEQ ID NO: 738278 - RNA, 62 nt, Homo Sapiens
acaccugaggcugaggcaggagaauugcuugaaccggggagacggagguugcagugagccga

SEQ ID NO: 738279 - RNA, 62 nt, Homo Sapiens
uccugcggacaccagcuccucucuccgccgucaccggggaggccggggauccuugcagggcu

SEQ ID NO: 738280 - RNA, 62 nt, Homo Sapiens
ggcuugcggacgccggcugucucguggagaccaccggggacauagcauaguacaaucagaac

SEQ ID NO: 738281 - RNA, 62 nt, Homo Sapiens
gaggguuuuuucuuuuucuucauuauuuccuuaccggggaauuuacagaaaaauaguguaaa

SEQ ID NO: 738282 - RNA, 62 nt, Homo Sapiens
gggauagaggaagggugagccucugaggaucgaccggggacuugccauccucuccuauuuau

SEQ ID NO: 738283 - RNA, 62 nt, Homo Sapiens
gagcgagugcgucaagaaaggcgcccggagcgaccggggagcgcagaagaagaagcgguaau

SEQ ID NO: 738284 - RNA, 62 nt, Homo Sapiens
gggggauacugaaccucuagacugaaguacuuaccggggagcacaguggacuaggggaugcc

SEQ ID NO: 738285 - RNA, 62 nt, Homo Sapiens
gcuuccagcaggauugagucacccugacgaugaccggggagaagccgugugcucuucauuau

SEQ ID NO: 738286 - RNA, 62 nt, Homo Sapiens
uauuguggccuuggaguuugauucaccgggcaaccggggaagaaaaaaaaaaaggaaaaaaa

SEQ ID NO: 738287 - RNA, 62 nt, Homo Sapiens
cccaacugggaaaggaggccugcccuggggaaaccggggaaccugcacucuugugccacagc

SEQ ID NO: 738288 - RNA, 62 nt, Homo Sapiens
caggcagaagccggacaggggcccuuccccacaccggggagagcugcucggacaggcccccu

SEQ ID NO: 738289 - RNA, 62 nt, Homo Sapiens
aaauggugauggagggcaacacugugcuuugcaccggggagagugucugcuccacgucaggc

SEQ ID NO: 738290 - RNA, 62 nt, Homo Sapiens
gagggaggcugaaauguuuauggggggcggggaccggggaaaaagacaaagccuugucuaug

SEQ ID NO: 738291 - RNA, 62 nt, Homo Sapiens
ugaaguaacugaggcuuagaaagguuaauagcaccggggaacaauuucucugggugagaauu

SEQ ID NO: 738292 - RNA, 62 nt, Homo Sapiens
ugccaugcccagagaaucagggcaggcuugccaccggggaacccagcccugggguaugagcu

SEQ ID NO: 738293 - RNA, 62 nt, Homo Sapiens
cucccgagccucaaggcaaguccaggacucagaccggggaggcccgggccagcagcucccag

SEQ ID NO: 738294 - RNA, 62 nt, Homo Sapiens
cauuucuguacuaacuguucucuuguuccgguaccggggagaaggaugaccccuccuuauuc

SEQ ID NO: 738295 - RNA, 62 nt, Homo Sapiens
gccucaacuaacaaacccuucaggaagcauauaccggggaauguguagccuucaggaaaaaa

SEQ ID NO: 738296 - RNA, 62 nt, Homo Sapiens
ucgcaugaaccacagaugcuggagaucaccagaccggggagagaagaggggcaccugggcug

SEQ ID NO: 738297 - RNA, 62 nt, Homo Sapiens
ugcccuguggugaccaggaggugaccgucaagaccggggaagacacaggugccaguucagca

SEQ ID NO: 738298 - RNA, 62 nt, Homo Sapiens
ggaccagggagcccugacucccagaggcugccaccggggagaagcagcgguccuccauccag

SEQ ID NO: 738299 - RNA, 62 nt, Homo Sapiens
gcugcccagcugucaaggucaggcaagugagcaccggggacugaggaucagggcgggacccc

SEQ ID NO: 738300 - RNA, 62 nt, Homo Sapiens
gaaggacauuugacuuuuaucaagucccgcaaaccggggacgcugggaauuccaccugagaa

SEQ ID NO: 738301 - RNA, 62 nt, Homo Sapiens
cgcgggcuucugcuggguccucccggcggggcaccggggacuccugccggcccacaggccca

SEQ ID NO: 738302 - RNA, 62 nt, Homo Sapiens
cuguacaugcauugagcucuacugcauaaauaaccggggauuagaugggcuucauccaaugg

SEQ ID NO: 738303 - RNA, 62 nt, Homo Sapiens
agggccucucaugggaaagcgggugucuucacaccggggaggagccagaaagguaugcaugu

SEQ ID NO: 738304 - RNA, 62 nt, Homo Sapiens
gauggaugguuggauacaggcagaucuucccuaccggggaggccugauguggagguacaggg

SEQ ID NO: 738305 - RNA, 62 nt, Homo Sapiens
agaggcgaggcaaugacuguuggccaguucucaccggggaaaaacccacuguuaggauggca

SEQ ID NO: 738306 - RNA, 62 nt, Homo Sapiens
ucugacaaggggagcugucaaucaaacaccaaaccggggagacaagaugauuggcagguauu

SEQ ID NO: 738307 - RNA, 62 nt, Homo Sapiens
gggaccugaccuggggcuggaagcaccugaggaccggggaucccugccucaagccugagugg

SEQ ID NO: 738308 - RNA, 62 nt, Homo Sapiens
cucaucccuagcuccaaucccuuccccacgugaccggggauucugguugcaauaaaacaugc

SEQ ID NO: 738309 - RNA, 62 nt, Homo Sapiens
ggaggcucccgaggggaaggggcggugcccacaccggggacaggccgcagcuccauuuucuu

SEQ ID NO: 738310 - RNA, 62 nt, Homo Sapiens
cugaggcaggagaaucgcuaguaaucccagcuaccggggagggggugcgguggcacacaccu

SEQ ID NO: 738311 - RNA, 62 nt, Homo Sapiens
uggagguugcagugagcugaagaaucgcuugaaccggggaggacccaggaggcugaggcagg

SEQ ID NO: 738312 - RNA, 62 nt, Homo Sapiens
cuucugcuuacuuuccacaugagaugcuuuguaccggggagcugugagcaggccucacgaug

SEQ ID NO: 738313 - RNA, 62 nt, Homo Sapiens
uggguugccaaagcagccaggcuuaugcugaaaccggggaagucugacauaugcaggaaacu

SEQ ID NO: 738314 - RNA, 62 nt, Homo Sapiens
uccgcugcguggaggugucggacgaucaggacaccggggacacucugggcagcguccuccgg

SEQ ID NO: 738315 - RNA, 62 nt, Homo Sapiens
ugucucauccccagaacaugccgucuguccccaccggggagugggccuugauggccgggccu

SEQ ID NO: 738316 - RNA, 62 nt, Homo Sapiens
cuccuugggccaccaaaggugguggccaugguaccggggacuugggagagugagacccagug

SEQ ID NO: 738317 - RNA, 62 nt, Homo Sapiens
uuguaaccccuauuuaagccgaccugaagagcaccggggaaucccuuugaaaagugccuggg

SEQ ID NO: 738318 - RNA, 61 nt, Homo Sapiens; identical to SEQ ID NO: 494049

SEQ ID NO: 738319 - RNA, 62 nt, Homo Sapiens
caggacugccugggacucccuggcaacccagcaccggggaagccgucagcugcugugacaau

SEQ ID NO: 738320 - RNA, 62 nt, Homo Sapiens
gccuggccgggggcuccaaggccggggcgcccaccggggaccacuccggccccuggacccgg

SEQ ID NO: 738321 - RNA, 62 nt, Homo Sapiens
aggcuacgugguccccuuggaacucacuguguaccggggaggaggguaucccaucuggggca

SEQ ID NO: 738322 - RNA, 62 nt, Homo Sapiens
gucucugucuuccaacccccaauaauauuuccaccggggaugcaucauuuuuacucccaaua

SEQ ID NO: 738323 - RNA, 55 nt, Homo Sapiens; identical to SEQ ID NO: 494054

SEQ ID NO: 738324 - RNA, 62 nt, Homo Sapiens
agguccugcaguacagucuuccccugaaugccaccggggacccagggggacuccaccccccu

SEQ ID NO: 738325 - RNA, 62 nt, Homo Sapiens
gaccauucugugaaaggagccucgagggcaugaccggggacuacacugucucccuggagggg

SEQ ID NO: 738326 - RNA, 62 nt, Homo Sapiens
ggcaugggcuagaagaggagcucccucccuccaccggggaaguggagagugagggcucccug

SEQ ID NO: 738327 - RNA, 62 nt, Homo Sapiens
ccucacuagcaggacuggugaaccuuacccucaccggggaacugaagcgcugcacccccacc

SEQ ID NO: 738328 - RNA, 62 nt, Homo Sapiens
aacagggcagacuggguaagcaccagugggugaccggggagacuggugcccagcgagcugag

SEQ ID NO: 738329 - RNA, 62 nt, Homo Sapiens
agguccaggacugggaaggaccgggugagugcaccggggacccaggccaggugccccccgga

SEQ ID NO: 738330 - RNA, 62 nt, Homo Sapiens
aagaaggcggauuaggggguggcccaaggggcaccggggagaggacccggacccaggacccu

SEQ ID NO: 738331 - RNA, 62 nt, Homo Sapiens
cucaggcguggaagagaaucuucuccuuauucaccggggaggcugugucuugugcaaacaag

SEQ ID NO: 738332 - RNA, 58 nt, Homo Sapiens; identical to SEQ ID NO: 494063

SEQ ID NO: 738333 - RNA, 62 nt, Homo Sapiens
ggaagagccaccaucccugcccccguuuucccaccggggagucuguacagagauuuuucuac

SEQ ID NO: 738334 - RNA, 62 nt, Homo Sapiens
ggucggccucuaagcucaugucucaacguucaaccggggaugucuccugggcuguggucuca

SEQ ID NO: 738335 - RNA, 62 nt, Homo Sapiens
ggagagcuaggaaaaauaaacaaccuuaugccaccggggaaaaaaucacaauaaauauuuau

SEQ ID NO: 738336 - RNA, 62 nt, Homo Sapiens
cagagguugcagugagccgaagaaucgcuugaaccggggaggacucaggaggcugaggcaug

SEQ ID NO: 738337 - RNA, 62 nt, Homo Sapiens
gaaggugaacauacaccucugugugugcauguaccggggaaugugaaugugugugagcaugu

SEQ ID NO: 738338 - RNA, 62 nt, Homo Sapiens
aggcgguggggcaugggaggaaggaggcacagaccggggaaauaugacagccgucauuucca

SEQ ID NO: 738339 - RNA, 62 nt, Homo Sapiens
cacugugguuugagaagaggcuggauccgcugaccggggagauggccuguguguacaagggc

SEQ ID NO: 738340 - RNA, 62 nt, Homo Sapiens
accacccucccuucuagagagcacaucgccugaccggggagaaguggggccgugguucgagg

SEQ ID NO: 738341 - RNA, 62 nt, Homo Sapiens
ccggcuccccgaggacccaggcuugacgauucaccggggaucuccugggcugggcucuccuu

SEQ ID NO: 738342 - RNA, 62 nt, Homo Sapiens
uuuucagugaugaaaauacaauuuuauuagucaccggggaacauguagcuugugacacuuuu

SEQ ID NO: 738343 - RNA, 64 nt, Homo Sapiens; identical to SEQ ID NO: 665165

SEQ ID NO: 738344 - RNA, 64 nt, Homo Sapiens; identical to SEQ ID NO: 665166

SEQ ID NO: 738345 - RNA, 64 nt, Homo Sapiens; identical to SEQ ID NO: 665167

SEQ ID NO: 738346 - RNA, 64 nt, Homo Sapiens; identical to SEQ ID NO: 665168

SEQ ID NO: 738347 - RNA, 64 nt, Homo Sapiens; identical to SEQ ID NO: 665169

SEQ ID NO: 738348 - RNA, 64 nt, Homo Sapiens; identical to SEQ ID NO: 665170

SEQ ID NO: 738349 - RNA, 64 nt, Homo Sapiens; identical to SEQ ID NO: 665171

SEQ ID NO: 738350 - RNA, 64 nt, Homo Sapiens; identical to SEQ ID NO: 665172

SEQ ID NO: 738351 - RNA, 64 nt, Homo Sapiens; identical to SEQ ID NO: 343074

SEQ ID NO: 738352 - RNA, 64 nt, Homo Sapiens; identical to SEQ ID NO: 343075

SEQ ID NO: 738353 - RNA, 64 nt, Homo Sapiens; identical to SEQ ID NO: 343076

SEQ ID NO: 738354 - RNA, 64 nt, Homo Sapiens; identical to SEQ ID NO: 343077

SEQ ID NO: 738355 - RNA, 64 nt, Homo Sapiens; identical to SEQ ID NO: 343078

SEQ ID NO: 738356 - RNA, 64 nt, Homo Sapiens; identical to SEQ ID NO: 343079

SEQ ID NO: 738357 - RNA, 64 nt, Homo Sapiens; identical to SEQ ID NO: 343080

SEQ ID NO: 738358 - RNA, 64 nt, Homo Sapiens; identical to SEQ ID NO: 343081

SEQ ID NO: 738359 - RNA, 64 nt, Homo Sapiens; identical to SEQ ID NO: 343082

SEQ ID NO: 738360 - RNA, 64 nt, Homo Sapiens; identical to SEQ ID NO: 343083

SEQ ID NO: 738361 - RNA, 64 nt, Homo Sapiens; identical to SEQ ID NO: 343084

SEQ ID NO: 738362 - RNA, 64 nt, Homo Sapiens; identical to SEQ ID NO: 343085

SEQ ID NO: 738363 - RNA, 64 nt, Homo Sapiens; identical to SEQ ID NO: 343086

SEQ ID NO: 738364 - RNA, 64 nt, Homo Sapiens; identical to SEQ ID NO: 343087

SEQ ID NO: 738365 - RNA, 64 nt, Homo Sapiens; identical to SEQ ID NO: 343088

SEQ ID NO: 738366 - RNA, 64 nt, Homo Sapiens; identical to SEQ ID NO: 343089

SEQ ID NO: 738367 - RNA, 64 nt, Homo Sapiens; identical to SEQ ID NO: 343090

SEQ ID NO: 738368 - RNA, 64 nt, Homo Sapiens; identical to SEQ ID NO: 343091

SEQ ID NO: 738369 - RNA, 64 nt, Homo Sapiens; identical to SEQ ID NO: 343092

SEQ ID NO: 738370 - RNA, 64 nt, Homo Sapiens; identical to SEQ ID NO: 343093

SEQ ID NO: 738371 - RNA, 64 nt, Homo Sapiens; identical to SEQ ID NO: 343094

SEQ ID NO: 738372 - RNA, 64 nt, Homo Sapiens; identical to SEQ ID NO: 343095

SEQ ID NO: 738373 - RNA, 64 nt, Homo Sapiens; identical to SEQ ID NO: 343096

SEQ ID NO: 738374 - RNA, 64 nt, Homo Sapiens; identical to SEQ ID NO: 343097

SEQ ID NO: 738375 - RNA, 64 nt, Homo Sapiens; identical to SEQ ID NO: 343098

SEQ ID NO: 738376 - RNA, 64 nt, Homo Sapiens; identical to SEQ ID NO: 343099

SEQ ID NO: 738377 - RNA, 64 nt, Homo Sapiens; identical to SEQ ID NO: 343100

SEQ ID NO: 738378 - RNA, 64 nt, Homo Sapiens; identical to SEQ ID NO: 343101

SEQ ID NO: 738379 - RNA, 64 nt, Homo Sapiens; identical to SEQ ID NO: 343102

SEQ ID NO: 738380 - RNA, 64 nt, Homo Sapiens; identical to SEQ ID NO: 343103

SEQ ID NO: 738381 - RNA, 64 nt, Homo Sapiens; identical to SEQ ID NO: 343104

SEQ ID NO: 738382 - RNA, 64 nt, Homo Sapiens; identical to SEQ ID NO: 343105

SEQ ID NO: 738383 - RNA, 64 nt, Homo Sapiens; identical to SEQ ID NO: 343106

SEQ ID NO: 738384 - RNA, 64 nt, Homo Sapiens; identical to SEQ ID NO: 343107

SEQ ID NO: 738385 - RNA, 64 nt, Homo Sapiens; identical to SEQ ID NO: 343108

SEQ ID NO: 738386 - RNA, 64 nt, Homo Sapiens
ggagcgaagugcacaccucaccauccuucagucuaaggaagaagggcaagcccugggaccaaga

SEQ ID NO: 738387 - RNA, 64 nt, Homo Sapiens
gaaugaccuuccucauuccaggaggcccuggaauaaggaagaggcuucuuucugagggagcuuu

SEQ ID NO: 738388 - RNA, 64 nt, Homo Sapiens
cugcuggcaauggugauaauggauuaauuccucaaaggaagagcagaacaccugaaaaucagca

SEQ ID NO: 738389 - RNA, 64 nt, Homo Sapiens
cugcuggcaauggugaugauggauuaauuccuccaaggaagagcagaacaccugaaagccagca

SEQ ID NO: 738390 - RNA, 64 nt, Homo Sapiens
agaucgcgcaccuucaggucgcgcaccuucgcugaaggaagaugacgcagagcuuuaucugaaa

SEQ ID NO: 738391 - RNA, 64 nt, Homo Sapiens
ucuccuugaaaaaaaaaucucuuggauguuuaggaaggaagacuuggccgugaugugguguccu

SEQ ID NO: 738392 - RNA, 64 nt, Homo Sapiens
caaaaccacccaacccccacccugccucuauccuaaggaagaccaagcaggccuggacccagag

SEQ ID NO: 738393 - RNA, 64 nt, Homo Sapiens
gggacaucuggaugcugggcauagauuucucaacaaggaagacuccccugccuccucaaggucu

SEQ ID NO: 738394 - RNA, 64 nt, Homo Sapiens
aagcauucaaaaguacuacaacaaguuauucuguaaggaagauagagcuugaagcauaaggaag

SEQ ID NO: 738395 - RNA, 64 nt, Homo Sapiens
aguuauucuguaaggaagauggagcuugaagcauaaggaagacagacuucuuccuuacccuuuu

SEQ ID NO: 738396 - RNA, 64 nt, Homo Sapiens
guugugccaagguauugaugaauugaaaagcaggaaggaagaggguagcaaauauuuauugaca

SEQ ID NO: 738397 - RNA, 64 nt, Homo Sapiens
uguaugaauguauauacaaaguaguguuuauucuaaggaagauauuuuuuaaagaaauuacagu

SEQ ID NO: 738398 - RNA, 64 nt, Homo Sapiens
cugacaauaagguuugacagguauaccauauugaaaggaagaggaugauaaacuuuaagaccuu

SEQ ID NO: 738399 - RNA, 64 nt, Homo Sapiens
aaaggccuugaauugacaaaauguaucaauuggaaaggaagaaagucugucucuaaaggguuaa

SEQ ID NO: 738400 - RNA, 64 nt, Homo Sapiens
aaggaaggaaauauuuugagaagaaaagacagaaaaggaagagguuuguacauacacacuuaga

SEQ ID NO: 738401 - RNA, 64 nt, Homo Sapiens
uauauuacaaaaguauaaaaucuuuuuauuuaauaaggaagaaagaaagcaacaccucaacuca

SEQ ID NO: 738402 - RNA, 64 nt, Homo Sapiens
ggacaaugcuuaguuauaagucuccgaguuggaaaaggaagaaagccagagcugucuaguuuca

SEQ ID NO: 738403 - RNA, 64 nt, Homo Sapiens
ccauauugugaaaaacuuuaguggacaagggcagaaggaagagggaagaccuguuaggaagcua

SEQ ID NO: 738404 - RNA, 64 nt, Homo Sapiens
gauuugcugagaguuugaauguggaguguaagagaaggaagaguuaaugaugacauuaagguuu

SEQ ID NO: 738405 - RNA, 64 nt, Homo Sapiens
ccacaaaaucaauaaaagauguuuuugagaaaaaaaggaagaaaccaacucauucagaaggcuc

SEQ ID NO: 738406 - RNA, 64 nt, Homo Sapiens
uuucugaucaccuuagaaauggcaguaagcccaaaaggaagaauuaugcugguaguaaauggga

SEQ ID NO: 738407 - RNA, 64 nt, Homo Sapiens
aaacaguaaaaaugacucccauccauccucugacaaggaagaaggugaggccacauccgauucu

SEQ ID NO: 738408 - RNA, 64 nt, Homo Sapiens
ccuaagugacuccgauuuucagcccugguagaauaaggaagacagcugaugccuccuuagcccc

SEQ ID NO: 738409 - RNA, 64 nt, Homo Sapiens
aacaaacugagcagcuguuauuugggcaaaaucaaaggaagaaagagacuauggucuucuauuu

SEQ ID NO: 738410 - RNA, 64 nt, Homo Sapiens
ugggccacggaagaacgggcggagccuuuguucaaaggaagaaguuucccgccacuggguccaa

SEQ ID NO: 738411 - RNA, 64 nt, Homo Sapiens
cugaccuuucccaucccgguugucucaggguucaaaggaagacaaggccucaagagccccuaau

SEQ ID NO: 738412 - RNA, 64 nt, Homo Sapiens
ugcuaaaacuaacccucuuuuuaagaggagauuuaaggaagacgucaaucaaaaugucaaauau

SEQ ID NO: 738413 - RNA, 64 nt, Homo Sapiens
uaaaauauauaaauauccuuuuuacuucaugaggaaggaagaauuuuuugauaauuacugaguu

SEQ ID NO: 738414 - RNA, 64 nt, Homo Sapiens
uuucaagaaacugcaaguuuaaauuccagauuuuaaggaagauuauuuucaaauauuuaauucu

SEQ ID NO: 738415 - RNA, 64 nt, Homo Sapiens
aaaaagacugcaagcuuuccaaaaagacagaaggaaggaagaagaaugaugcucuugaugaaag

SEQ ID NO: 738416 - RNA, 64 nt, Homo Sapiens
uucaaauugugauuucauugauuuuacuaacuggaaggaagaagaguaaaauuggcauauuuag

SEQ ID NO: 738417 - RNA, 64 nt, Homo Sapiens
ggagaaauuggggggaaauagaagaguacggagaaaggaagagaccagaguucuuuaaagcuca

SEQ ID NO: 738418 - RNA, 64 nt, Homo Sapiens
uugacgucucuauucugcccccaaggaggaaccuaaggaagauaguuucugcccuagacauuug

SEQ ID NO: 738419 - RNA, 64 nt, Homo Sapiens
agaaggaguggaggaaggugcggucuucacaaagaaggaagaaacaagauuugguggguccaca

SEQ ID NO: 738420 - RNA, 64 nt, Homo Sapiens
gcuauugauuuuuacuucaaugggcucuuccaacaaggaagaagcuugcugguagcacuugcua

SEQ ID NO: 738421 - RNA, 64 nt, Homo Sapiens
ucuccuagucaauauccaccccauccaauuuaucaaggaagaaaugguucagaaaauauuuuca

SEQ ID NO: 738422 - RNA, 64 nt, Homo Sapiens
agaugggcuuagcauugggaauagaaaagcaugcaaggaagaccauuugacuuaccaccagagc

SEQ ID NO: 738423 - RNA, 64 nt, Homo Sapiens
ucuugacuauuuagauucuaaaggagggaaagaaaaggaagaacgaguagugaaucucucagcc

SEQ ID NO: 738424 - RNA, 64 nt, Homo Sapiens
gggaccccucuccaguccuggcagaaccaauuggaaggaagaaacuacaggugucuucuggggg

SEQ ID NO: 738425 - RNA, 64 nt, Homo Sapiens
ggagaagccuggggaggagggggaggaagacaagaaggaagaggaggaggagaaggaagacgag

SEQ ID NO: 738426 - RNA, 64 nt, Homo Sapiens
gggggaggaagacaagaaggaagaggaggaggagaaggaagacgaggagcuggacugggccuug

SEQ ID NO: 738427 - RNA, 64 nt, Homo Sapiens
aguuaauuuaagaaugaaaccacaagggaaguggaaggaagaaccuuauuuugcuacugaguca

SEQ ID NO: 738428 - RNA, 64 nt, Homo Sapiens
uggauaaaaucuuccaaaucucaagugagacccaaaggaagaacgaaauaauacaaauuggcuu

SEQ ID NO: 738429 - RNA, 64 nt, Homo Sapiens
ccccgacuucuuuggccaguugaacacuuggugaaaggaagaugaaggagggucccuccaaagu

SEQ ID NO: 738430 - RNA, 64 nt, Homo Sapiens
cguggcagaucccugacaucaaaugcucuggaggaaggaagaaauccccgguuuuguuuuugua

SEQ ID NO: 738431 - RNA, 64 nt, Homo Sapiens
uagucucagcacaggaauugaggugggucaggugaaggaagaguguauguuccuauuuuuauuc

SEQ ID NO: 738432 - RNA, 64 nt, Homo Sapiens
caguuauaaaauggggcuugauuuguuuagacugaaggaagacguuuucccaaaauauacuaca

SEQ ID NO: 738433 - RNA, 64 nt, Homo Sapiens
uuacguaguguagauuuguuuaccucuuugaaagaaggaagacucuuucacaguaccaucugaa

SEQ ID NO: 738434 - RNA, 64 nt, Homo Sapiens
aaucaguugcgcguucugaacuuuguuuuguuuuaaggaagaaacccucccccucuggucuccu

SEQ ID NO: 738435 - RNA, 64 nt, Homo Sapiens
agccccagguucucuuuucuuccagggugccaagaaggaagaaagauaggugggaggacuaacu

SEQ ID NO: 738436 - RNA, 64 nt, Homo Sapiens
caggagcuaggcagaagccuaagcugccucugggaaggaagaaaguagcccccacccuccugcc

SEQ ID NO: 738437 - RNA, 64 nt, Homo Sapiens
gguaagaaagcugauagcucugaaucuugcugucaaggaagaaaauugugauuauugaaguuca

SEQ ID NO: 738438 - RNA, 64 nt, Homo Sapiens
uucuguagcaagggggaauauuuuuaaugcagaaaaggaagaugagagaaauacagccauuuug

SEQ ID NO: 738439 - RNA, 64 nt, Homo Sapiens
cguuaccauugucaaagaaaaugaggaugaagauaaggaagauaugaugaugaugaagaugaug

SEQ ID NO: 738440 - RNA, 64 nt, Homo Sapiens
uguauguuggaaaaaaauggaguaaauucauggaaaggaagaaaaugauauuauggauccaaua

SEQ ID NO: 738441 - RNA, 64 nt, Homo Sapiens
aggugacccggaugcugacaucugcugcugcagaaaggaagacuuuucauuguaauuucgcuua

SEQ ID NO: 738442 - RNA, 64 nt, Homo Sapiens
auucaaaauagucacuugagcucacaaaaaaagcaaggaagaauucucauguccuuugucuucc

SEQ ID NO: 738443 - RNA, 64 nt, Homo Sapiens
acgcaggcaggggcgucaagggguuucucugcccaaggaagacagaacauggagaaccgucagg

SEQ ID NO: 738444 - RNA, 64 nt, Homo Sapiens
ccaggcugugccagugugucccggacgcaucacuaaggaagagagaguuuauuuagucaacugg

SEQ ID NO: 738445 - RNA, 64 nt, Homo Sapiens
cuaguuuugcugaaaaugacaugauggugaaauaaaggaagauagacaccugaugaccuguuag

SEQ ID NO: 738446 - RNA, 64 nt, Homo Sapiens
aucaaggaaagaaugagucuuugaaugugaacaaaaggaagaaaacaaaguccaaaagucacuu

SEQ ID NO: 738447 - RNA, 64 nt, Homo Sapiens
guuucuugggcugguugaggccccucagggauggaaggaagagguaguucccaccaguugccuu

SEQ ID NO: 738448 - RNA, 64 nt, Homo Sapiens
gaaagagggcugccauuccucuguuggagccaugaaggaagagguuaacccuuucagacccagu

SEQ ID NO: 738449 - RNA, 64 nt, Homo Sapiens
gcccaaggguaggggagaaaaaaauauugaauccaaggaagagacuuguuccugcauauuuuuu

SEQ ID NO: 738450 - RNA, 64 nt, Homo Sapiens
aacaaaaaacaaaaaacuaagguuuauuuagaaaaaggaagaaaaacuucuccaccaagcauuu

SEQ ID NO: 738451 - RNA, 64 nt, Homo Sapiens
gcucaauuaaagauguuugaauccaaaggaagucaaggaagaaaaagcauggaaaggaagagaa

SEQ ID NO: 738452 - RNA, 64 nt, Homo Sapiens
aauccaaaggaagucaaggaagaaaaagcauggaaaggaagagaacugauuccuacugaaaauu

SEQ ID NO: 738453 - RNA, 64 nt, Homo Sapiens
ccaaacagauccagaaugugauaaagggcaccacaaggaagaaggcacauauggagggcuggcu

SEQ ID NO: 738454 - RNA, 64 nt, Homo Sapiens
uguagacauaauaaauguaggugaauucacguaaaaggaagaucuauuauugucauuaguauua

SEQ ID NO: 738455 - RNA, 64 nt, Homo Sapiens
uaauucuuggagggggaaauaagggaauaaggccaaggaagauguauagcuuuagcuuuagccu

SEQ ID NO: 738456 - RNA, 64 nt, Homo Sapiens
gaauccacauaccuuguguauugaaccccaggaaaaggaagaggucgaaccaacccugcggaag

SEQ ID NO: 738457 - RNA, 64 nt, Homo Sapiens
cccuguucagagcagccggaguuugcuggaccacaaggaagaagagaagagacuugcagugaac

SEQ ID NO: 738458 - RNA, 64 nt, Homo Sapiens
uccuuuuggggacacccaaaacacugcuugugagaaggaagauggaagguaaguucugucguuc

SEQ ID NO: 738459 - RNA, 64 nt, Homo Sapiens
ucauauguucuaaaaugacuagcaaugguuuaaaaaggaagaagaguggaagugaagaaggugg

SEQ ID NO: 738460 - RNA, 63 nt, Homo Sapiens
guuuuucuaccucuuuaacaguuaauauuuuuuaaaggaagaaauggaauguaccuucagggg

SEQ ID NO: 738461 - RNA, 64 nt, Homo Sapiens
ggaaugaauccuaagaggcagggaucuuaaggacaaggaagagaagagagagagggagggaucu

SEQ ID NO: 738462 - RNA, 64 nt, Homo Sapiens
aaaugaauuuuucauagaauuuacaguauauucaaaggaagaaagauaaaauuauuggucauca

SEQ ID NO: 738463 - RNA, 64 nt, Homo Sapiens
aaacaaguugcauuuuuaaguguugagaaaaaccaaggaagauaccagaauuuucuuuggaaau

SEQ ID NO: 738464 - RNA, 64 nt, Homo Sapiens
aaagcaaguuguucaauuuuuguucagaaaaaucaaggaagaaagcaaaaguuuccauggaagc

SEQ ID NO: 738465 - RNA, 64 nt, Homo Sapiens
uucucacccagcaccuggggagaucggugcuaccaaggaagagagcacacagauaagacagagg

SEQ ID NO: 738466 - RNA, 64 nt, Homo Sapiens
acuguuggacaaaaccauaacuuugucauuuuacaaggaagaaccucuuaagaaguccucagaa

SEQ ID NO: 738467 - RNA, 64 nt, Homo Sapiens
uaagcugccaugcauuuuuuuuuuuacaguucucaaggaagagcacagaacaauuucucauuuc

SEQ ID NO: 738468 - RNA, 64 nt, Homo Sapiens
uccucuccucuaaucuguguacacaucuccaagcaaggaagaaaaaacaaacucugcucagacg

SEQ ID NO: 738469 - RNA, 64 nt, Homo Sapiens; identical to SEQ ID NO: 655163

SEQ ID NO: 738470 - RNA, 64 nt, Homo Sapiens; identical to SEQ ID NO: 655164

SEQ ID NO: 738471 - RNA, 64 nt, Homo Sapiens; identical to SEQ ID NO: 115778

SEQ ID NO: 738472 - RNA, 64 nt, Homo Sapiens; identical to SEQ ID NO: 115779

SEQ ID NO: 738473 - RNA, 64 nt, Homo Sapiens; identical to SEQ ID NO: 115780

SEQ ID NO: 738474 - RNA, 64 nt, Homo Sapiens; identical to SEQ ID NO: 115781

SEQ ID NO: 738475 - RNA, 64 nt, Homo Sapiens; identical to SEQ ID NO: 115782

SEQ ID NO: 738476 - RNA, 64 nt, Homo Sapiens; identical to SEQ ID NO: 115783

SEQ ID NO: 738477 - RNA, 64 nt, Homo Sapiens; identical to SEQ ID NO: 115784

SEQ ID NO: 738478 - RNA, 64 nt, Homo Sapiens; identical to SEQ ID NO: 115785

SEQ ID NO: 738479 - RNA, 64 nt, Homo Sapiens; identical to SEQ ID NO: 115786

SEQ ID NO: 738480 - RNA, 64 nt, Homo Sapiens; identical to SEQ ID NO: 115787

SEQ ID NO: 738481 - RNA, 64 nt, Homo Sapiens; identical to SEQ ID NO: 115788

SEQ ID NO: 738482 - RNA, 64 nt, Homo Sapiens; identical to SEQ ID NO: 115789

SEQ ID NO: 738483 - RNA, 64 nt, Homo Sapiens; identical to SEQ ID NO: 115790

SEQ ID NO: 738484 - RNA, 64 nt, Homo Sapiens; identical to SEQ ID NO: 115791

SEQ ID NO: 738485 - RNA, 64 nt, Homo Sapiens; identical to SEQ ID NO: 115792

SEQ ID NO: 738486 - RNA, 64 nt, Homo Sapiens; identical to SEQ ID NO: 115793

SEQ ID NO: 738487 - RNA, 64 nt, Homo Sapiens; identical to SEQ ID NO: 115794

SEQ ID NO: 738488 - RNA, 64 nt, Homo Sapiens; identical to SEQ ID NO: 115795

SEQ ID NO: 738489 - RNA, 64 nt, Homo Sapiens; identical to SEQ ID NO: 115796

SEQ ID NO: 738490 - RNA, 64 nt, Homo Sapiens; identical to SEQ ID NO: 115797

SEQ ID NO: 738491 - RNA, 62 nt, Homo Sapiens
ccaauucuuagcaauggaauucaagucuauuacuuguagaguaagggaaaaaagagaaaaac

SEQ ID NO: 738492 - RNA, 62 nt, Homo Sapiens
uaaugggucugggauaaaaaucuuucuaguaucuuguagauccccacucacuuugcucuaau

SEQ ID NO: 738493 - RNA, 62 nt, Homo Sapiens
ucuuggauuccaggugugauguugucuuuggacuuguagacccaugcaaagcugauaacaca

SEQ ID NO: 738494 - RNA, 62 nt, Homo Sapiens
acauuuaucauuaaugcaagcaugaaggccaucuuguagauuucugauuccuuuuucuaauc

SEQ ID NO: 738495 - RNA, 62 nt, Homo Sapiens
uucucauucugugguacaacgaguuguauaaucuuguagaauaguguaaucuuguagaaaaa

SEQ ID NO: 738496 - RNA, 62 nt, Homo Sapiens
aagaguuguauaaucuuguagaguaguguaaucuuguagaaagaauggaauaaaaacaauau

SEQ ID NO: 738497 - RNA, 64 nt, Homo Sapiens
auuaaauaguugaugcaauuuuuaacguuaauugauauaaaaaaaaaaacaacaaaauuaggcu

SEQ ID NO: 738498 - RNA, 64 nt, Homo Sapiens
ccaaguuagucaaguaugucucaacacuagcaugauauaaaaagggacacugcagcugaaugaa

SEQ ID NO: 738499 - RNA, 64 nt, Homo Sapiens
aauaaagaauauugacaugaguauaccaguuuauauauaaaaauguuuuuaaacuugacaauca

SEQ ID NO: 738500 - RNA, 64 nt, Homo Sapiens
cuaguucauuauaaaaaauaucuaggcauuguggauauaaaacuguuggguauucuacaacuuc

SEQ ID NO: 738501 - RNA, 64 nt, Homo Sapiens
aaucuuaauuuggauuuaaggaagaaaucaauaaauauaaaauauaagcacauauuuauuauau

SEQ ID NO: 738502 - RNA, 64 nt, Homo Sapiens
aucaaauuuuauaauugagagaagaaauaugauaauauaaaaccuuaaugagguauuuaccacu

SEQ ID NO: 738503 - RNA, 64 nt, Homo Sapiens
uuuggauauguauuuuuaguaucuauuuaaaaggauauaaaagcccaaagaguugaaaucuuaa

SEQ ID NO: 738504 - RNA, 64 nt, Homo Sapiens
gauaauugcuuuauuuggaaaguaacuucuuaccauauaaaaacugaucuuaaaccuaugauuc

SEQ ID NO: 738505 - RNA, 64 nt, Homo Sapiens
aggaaacagguauaauuuuacaaaauauuuugagauauaaaaguagaccauuaauggucuucuc

SEQ ID NO: 738506 - RNA, 64 nt, Homo Sapiens
aucauauugcuaugaauaccccucauuguacaaaauauaaaauaucugaaggcuuguuuuuagu

SEQ ID NO: 738507 - RNA, 64 nt, Homo Sapiens
gacaaaaaauaaguagacuguugccuaaaauaggauauaaaaggauuuucuggguuuuaucauu

SEQ ID NO: 738508 - RNA, 64 nt, Homo Sapiens
guggcuuuaaaaaugcaugauacagcaacccuagauauaaaauuucuccagagauguugguuuc

SEQ ID NO: 738509 - RNA, 64 nt, Homo Sapiens
gaaaauggaaaaaaagucccgucuuaacacuuuuauauaaaaauaaaaaacuuuuuucauugug

SEQ ID NO: 738510 - RNA, 64 nt, Homo Sapiens
agaaagggacuuuuuuuccuacaacaaaaaauacauauaaaacuacauugaguuuaauucagca

SEQ ID NO: 738511 - RNA, 64 nt, Homo Sapiens
auuuaucuuagaauuugagauuuucugccuuacgauauaaaaauuuuaagucauuuuaacuuuu

SEQ ID NO: 738512 - RNA, 64 nt, Homo Sapiens
uaauuccaaagucucugcugucugcuuaaaaaccauauaaaauauuccagacuuucuaaaacau

SEQ ID NO: 738513 - RNA, 64 nt, Homo Sapiens
cacuaaaauuauauuuuaaauugguugauuguuuauauaaaacaaccaguagaauuuaaauugg

SEQ ID NO: 738514 - RNA, 64 nt, Homo Sapiens
aauuguacagcuguuguaauaaugaccuauuucuauauaaaauaaaauuguauggcuuaugugu

SEQ ID NO: 738515 - RNA, 64 nt, Homo Sapiens
auuuuguaucugagauaccaguuccuuuucccaaauauaaaaguauaaaaguuuucuuguguuu

SEQ ID NO: 738516 - RNA, 64 nt, Homo Sapiens
uccccauucgauaauauaguaacucagaauuuucauauaaaauugaauucuacucauuagagua

SEQ ID NO: 738517 - RNA, 64 nt, Homo Sapiens
gugccaaaaaucucuauuuuaaaugaaaauauuuauauaaaaauacauuuauucugcuuaacac

SEQ ID NO: 738518 - RNA, 64 nt, Homo Sapiens
uugugggggaaugccuaauaaauacauugacuauauauaaaaugaauauauacauacacaugua

SEQ ID NO: 738519 - RNA, 64 nt, Homo Sapiens
uagcaauaaaaucuaauuuuuaaaaaguauauaaauauaaaauguauaaaugauggauagauuu

SEQ ID NO: 738520 - RNA, 64 nt, Homo Sapiens
ugaaacucaauaauaaacagauauaaaauacacaauauaaaauaguaacuaguacuaauuauaa

SEQ ID NO: 738521 - RNA, 64 nt, Homo Sapiens
cacaauauaaaauaugaaacaguacuaauuauaaauauaaaauauccaugucauauguguaacu

SEQ ID NO: 738522 - RNA, 64 nt, Homo Sapiens
aaauaaaaccaagaggugaucacguaucaaacuaauauaaaaagaauuaaguuggacuaacauu

SEQ ID NO: 738523 - RNA, 64 nt, Homo Sapiens
uguaacauuuccuuuaaaacuaccaaaucaaauaauauaaaagcuacuuauaacuguuauuaaa

SEQ ID NO: 738524 - RNA, 64 nt, Homo Sapiens
ggguguuguucucccuuuaagcugguuaugugaaauauaaaauguaaagagaggcccaagcaua

SEQ ID NO: 738525 - RNA, 64 nt, Homo Sapiens
auuucccaugcuggaaauucuacuuacaaggcacauauaaaauacaucaauuuguaauuuaggg

SEQ ID NO: 738526 - RNA, 64 nt, Homo Sapiens
cucuguuggaauuugccuacgucuugacaaauguauauaaaauugaacauaaaaagcacacaua

SEQ ID NO: 738527 - RNA, 64 nt, Homo Sapiens
auguuuuauauagaacauaauauuugaauguugaauauaaaaaaaaaaguuuacuaucugaaaa

SEQ ID NO: 738528 - RNA, 64 nt, Homo Sapiens
ugguaaagauugccuucuguauaauguuuggauuauauaaaauugcaaaaaugauaacagcccg

SEQ ID NO: 738529 - RNA, 64 nt, Homo Sapiens
cacucauagcauuucuauauuugaaaguagcccaauauaaaacuuuugauucuaaaauuaaacc

SEQ ID NO: 738530 - RNA, 64 nt, Homo Sapiens
auuucaauuuuuaucaauucauaaauuaaaaacaauauaaaaauuccagagggguguguguaua

SEQ ID NO: 738531 - RNA, 64 nt, Homo Sapiens
uagagagguaagcauuaguggcacagcugagaaaauauaaaagguaguucugucucuauccugu

SEQ ID NO: 738532 - RNA, 64 nt, Homo Sapiens
cugccaugggccagccuagcccuugucccuuuuaauauaaaagauauauauauauauauauaua

SEQ ID NO: 738533 - RNA, 64 nt, Homo Sapiens
uuuuaauauaaaagauauauauauauauauauauauauaaaauaucuauauucuauacacaccc

SEQ ID NO: 738534 - RNA, 64 nt, Homo Sapiens
caagaauacagcuguagggucauugcuuuaaauuauauaaaauguaucugucuauaaagaagau

SEQ ID NO: 738535 - RNA, 64 nt, Homo Sapiens
uaaauuauauaaaauguaucugucuauaaagaagauauaaaauugugacuuuauucuacuguaa

SEQ ID NO: 738536 - RNA, 64 nt, Homo Sapiens
acuuauauagcaauuguuuaaaguuaucaauuguauauaaaaucacaguagccugcuaaaucau

SEQ ID NO: 738537 - RNA, 64 nt, Homo Sapiens
ugcaaauuauucagccuccaaaugcaaaugaaugauauaaaaauaaguagggaacauggcagag

SEQ ID NO: 738538 - RNA, 64 nt, Homo Sapiens
auauauuuuuuaaacaauguaagaguacuggacgauauaaaaauuugacucucucaucugucua

SEQ ID NO: 738539 - RNA, 64 nt, Homo Sapiens
auauauaaaggguuauuugacuauauauauauaaauauaaaauuuacuaucaguuuugauauaa

SEQ ID NO: 738540 - RNA, 64 nt, Homo Sapiens
gagaagagcuugauauucagaauuuugguacaauauauaaaaugcacugcugagcuguauuuaa

SEQ ID NO: 738541 - RNA, 64 nt, Homo Sapiens
ccaaaugguugaaaaaauagcagcgaaauuaauaauauaaaaugguauaaaauauuauuuuaaa

SEQ ID NO: 738542 - RNA, 64 nt, Homo Sapiens
auccuuaaugucaacacacuacugugauacaugcauauaaaaaaaauuuucccaaauuguaaua

SEQ ID NO: 738543 - RNA, 64 nt, Homo Sapiens
aacugauuauauauuggaauuaauuacagauuuaauauaaaauguaaguugaacugcucugcau

SEQ ID NO: 738544 - RNA, 64 nt, Homo Sapiens
gcguuaaaggcucgauuuugaagauauauuaaaaauauaaaacuaaauauauauaaaccuaaaa

SEQ ID NO: 738545 - RNA, 64 nt, Homo Sapiens
aauauauauaaaccuaaaaaauaaauauauauauauauaaaauauauggcagaguuguaaauau

SEQ ID NO: 738546 - RNA, 64 nt, Homo Sapiens
agauaugaaagaugaauauaagaauucauccuagauauaaaaccauagaaauguaaaagaugug

SEQ ID NO: 738547 - RNA, 64 nt, Homo Sapiens
augauauccuuuauauucgagaaaaguuauagaaauauaaaaaauauagaaaagucauaucucc

SEQ ID NO: 738548 - RNA, 64 nt, Homo Sapiens
auguugccuuuagcuucuugaagauuuagaaguuauauaaaaaauuaauuuaaaagcaaaccaa

SEQ ID NO: 738549 - RNA, 64 nt, Homo Sapiens
guuugguuucagugguccagcuuuauuuacaggcauauaaaaugaaauugugagauguuuugca

SEQ ID NO: 738550 - RNA, 64 nt, Homo Sapiens
gaggcauucacuagaggugaaaacuugucagaauauauaaaagcuuagauuguagcuguucuaa

SEQ ID NO: 738551 - RNA, 64 nt, Homo Sapiens
uaguuccaaaaccaaaaaaagugccuguggauguauauaaaauuaagaugauaagaaagugcuc

SEQ ID NO: 738552 - RNA, 64 nt, Homo Sapiens
ccugcuccuuauugccauacccacgaacuguuaaauauaaaaaaauucaaaguauuugacaucu

SEQ ID NO: 738553 - RNA, 64 nt, Homo Sapiens
ucacaguaaguucuauuagugaugauagaaccagauauaaaauuguucagugauggagaaaaga

SEQ ID NO: 738554 - RNA, 64 nt, Homo Sapiens
augccaaacauguuggcaucaauuuuauacagggauauaaaaaaguauauguggauaaauuuuu

SEQ ID NO: 738555 - RNA, 64 nt, Homo Sapiens
guauauguggauaaauuuuuuguaaucuuuagggauauaaaaaaguguauguggauaaauuuuu

SEQ ID NO: 738556 - RNA, 64 nt, Homo Sapiens
guguuuacuguacuauuucaaagcuucuaaauaaauauaaaauauauauauuauauuauauaau

SEQ ID NO: 738557 - RNA, 64 nt, Homo Sapiens
auuuuacauaguuuugugacuuaauuacacaugaauauaaaaucuauaauucuauaugaauaua

SEQ ID NO: 738558 - RNA, 64 nt, Homo Sapiens
guguuuuacguuuuuuauccugcugaaaaaguauauauaaaauaucuaacauuacaggauagag

SEQ ID NO: 738559 - RNA, 64 nt, Homo Sapiens
uccuccccacccacccauguuuuuaaacuaauuuauauaaaaucuggaggcuguuacagcuaac

SEQ ID NO: 738560 - RNA, 64 nt, Homo Sapiens
uuuaaauuauaaaggacugaauaaucuaaaaagcauauaaaaguuucacacagcauaaaagaua

SEQ ID NO: 738561 - RNA, 64 nt, Homo Sapiens
gacagagcaagaccaccaucuccaaaaauuauauauauaaaaauaauuaauauuauagaagaga

SEQ ID NO: 738562 - RNA, 64 nt, Homo Sapiens
agagaauauacacaacucagagaugcaauggauaauauaaaaagaguaccugagauguauuuuu

SEQ ID NO: 738563 - RNA, 64 nt, Homo Sapiens
gugugcauauauuaaauuuuugaugcugcauuauauauaaaacuaguaaaugcccuacauggug

SEQ ID NO: 738564 - RNA, 64 nt, Homo Sapiens
uuauagauuuaguguuuggcuuauaaacagcuuaauauaaaacauaaguuuguuaaaguauuuu

SEQ ID NO: 738565 - RNA, 64 nt, Homo Sapiens
uuacaauacagaacaacuguacauuaugaaucacauauaaaauccugugucuuguuauaguagu

SEQ ID NO: 738566 - RNA, 64 nt, Homo Sapiens
ugugucuuguuauaguaguaauuauuccaguaauauauaaaaacggaaaauucauuuucuuugc

SEQ ID NO: 738567 - RNA, 64 nt, Homo Sapiens
auggaagauuaaaaacucaaacaucaguccaaggauauaaaaaaaucauauuccggggaucauc

SEQ ID NO: 738568 - RNA, 64 nt, Homo Sapiens
augcuaaagauaggauaaaauuaaggaauaguucauauaaaaauaaaauuucuauuucuuuugc

SEQ ID NO: 738569 - RNA, 64 nt, Homo Sapiens
uagucuugcuuauuuuguugcgaaggccaguggaauauaaaaaucaauggcauuaaugaggagc

SEQ ID NO: 738570 - RNA, 64 nt, Homo Sapiens
agauugaaaagacuaaugagaagauaacaugacaauauaaaaagacagaaacucaaaaaguaua

SEQ ID NO: 738571 - RNA, 64 nt, Homo Sapiens
uuaagaaucuuuuaaaaaaaguguauuucuaauuauauaaaauaagaaguuuuguuuuugaaau

SEQ ID NO: 738572 - RNA, 64 nt, Homo Sapiens
uaagacagaguuugcaaagcuuuugcuuauuuucauauaaaaggauaaaaauauguacauuaca

SEQ ID NO: 738573 - RNA, 64 nt, Homo Sapiens
auguacauuacauuuugcuucuuauuaaauaaaaauauaaaaauauaaaucugggucugcaucu

SEQ ID NO: 738574 - RNA, 64 nt, Homo Sapiens
agcaguuaauaguaugaucuuuaaaguuuugacaauauaaaauaaacuugguaacuguuuuaca

SEQ ID NO: 738575 - RNA, 64 nt, Homo Sapiens
acaauauaaaauaaacuugguaacuguuuuacaaauauaaaaguauaauaaauaugcagcccag

SEQ ID NO: 738576 - RNA, 64 nt, Homo Sapiens
auauguugaauguuaacaggcauagaacagaaauauauaaaaauguugaaaaauaucuuugcau

SEQ ID NO: 738577 - RNA, 64 nt, Homo Sapiens
cugauauuuacuggaaaccuaacugcuuuugcccauauaaaauguaaaugaacugauuuuuauu

SEQ ID NO: 738578 - RNA, 64 nt, Homo Sapiens
ccaccauugccuguuagccauuaaucaaaguugaauauaaaaauucuuguaaaguccauuuaug

SEQ ID NO: 738579 - RNA, 64 nt, Homo Sapiens
ucacauauacugauuuuaaaucuuauggaaaaaaauauaaaagacgguguuuuuauuuuuuuuu

SEQ ID NO: 738580 - RNA, 64 nt, Homo Sapiens
auaaaugaugcuuuguauaaugucccaaagccaaauauaaaaauaaguucuccauauugccuua

SEQ ID NO: 738581 - RNA, 64 nt, Homo Sapiens
aauuauguuauguuauuagaucucuacugucacuauauaaaaccgauuuuagaaggaacuuugc

SEQ ID NO: 738582 - RNA, 64 nt, Homo Sapiens
ccuguauauuuuuuaaaaacuuucagauccaagcauauaaaaaggucauuguggauguuaccuu

SEQ ID NO: 738583 - RNA, 64 nt, Homo Sapiens
agacacauuucauuuguuaaugcuuuaugggcauauauaaaaguaaauuucaauguuaaguguc

SEQ ID NO: 738584 - RNA, 64 nt, Homo Sapiens
cccucacagaaacaccuagauaaaugucaaucucauauaaaacaucagaguucacugauugauu

SEQ ID NO: 738585 - RNA, 64 nt, Homo Sapiens
uguuaacugauaaugguauucagggauaauuuuaauauaaaaacaaccauaccauuaacuugaa

SEQ ID NO: 738586 - RNA, 64 nt, Homo Sapiens
uuuauuucuuuuacuuuuuuuaguaaguuaauguauauaaaaauggcuucggacaaaauaucuc

SEQ ID NO: 738587 - RNA, 64 nt, Homo Sapiens
aaaguuugaaaagcaauauuguauauuuuuaucuauauaaaauaacuaaaauguaucuaagaau

SEQ ID NO: 738588 - RNA, 64 nt, Homo Sapiens
aaccagccugggcaaaacccugucucuacuaaaaauauaaaaauuagccaggcaugauggcaca

SEQ ID NO: 738589 - RNA, 64 nt, Homo Sapiens
uggccaacauggcaaaaccccgucucuaugaaaaauauaaaaauuagcugggcaugguggcagg

SEQ ID NO: 738590 - RNA, 64 nt, Homo Sapiens
gauaaaaugcaucuuguuacuacaaauguuauauauauaaaaucaaguugagcuuugccuugau

SEQ ID NO: 738591 - RNA, 64 nt, Homo Sapiens
gauaauuuugaaaagaaauagaaauuaagcuacuauauaaaacaauuguuuacguguacuuuua

SEQ ID NO: 738592 - RNA, 64 nt, Homo Sapiens
augucuagcaucaaaugaguauuguaaaagacuaauauaaaaugguuuauaagacugauguaua

SEQ ID NO: 738593 - RNA, 64 nt, Homo Sapiens
aaauaaaauuuuaacccaaaugaauaacuaagaaauauaaaacaagcacaaaaucuuagggaag

SEQ ID NO: 738594 - RNA, 64 nt, Homo Sapiens
cugguuauaaaccuugcuaaugaaaauacaauacauauaaaaauguauagccauguuauuuucu

SEQ ID NO: 738595 - RNA, 64 nt, Homo Sapiens
aaaugcuacuuaaaacuuugguuguuuuccuguaauauaaaagaaaaaguuaauuuaucaauug

SEQ ID NO: 738596 - RNA, 64 nt, Homo Sapiens
ucuuuggaggaugggagagaucucauagcaguuaauauaaaacauuacgugaccggcaaauaaa

SEQ ID NO: 738597 - RNA, 64 nt, Homo Sapiens
aaaugugaaaaccaaaguggcuugaauugacgcaauauaaaacacgcugcccccugagaaaaca

SEQ ID NO: 738598 - RNA, 64 nt, Homo Sapiens
ggaugcuuuuauauauuuuuaaaaauauggaauuauauaaaaaguugauucuauguugucugga

SEQ ID NO: 738599 - RNA, 64 nt, Homo Sapiens
acuauaagacaaacauuugaguauuaucucacaaauauaaaaccuaaagcaaugaagcaaugga

SEQ ID NO: 738600 - RNA, 64 nt, Homo Sapiens
acaggaaauagauaaacaugucaccuuggauuauauauaaaaauguuuuccaugucuucucugg

SEQ ID NO: 738601 - RNA, 64 nt, Homo Sapiens
cuaaugcaauucuacagcauaauuuauauaaucaauauaaaauacuuagauagaaauuggucuu

SEQ ID NO: 738602 - RNA, 64 nt, Homo Sapiens
aaauuaauguuuuauagaccaaaaaaauaguaaaauauaaaaacauuuaaaaacaaaaaaacac

SEQ ID NO: 738603 - RNA, 64 nt, Homo Sapiens
aauaaaaaaaggaaaggaaaaaaaacauugcaaaauauaaaauaaaacuuaaauauuauggaaa

SEQ ID NO: 738604 - RNA, 64 nt, Homo Sapiens
cauuuccuugccugacaguauuuuugaauuauuuauauaaaauaucuaucuuuucaucaugucu

SEQ ID NO: 738605 - RNA, 64 nt, Homo Sapiens
uuaaaaaaauuugcuuaguaaagguuauuuugugauauaaaaugggauuuauaaaaauauuaga

SEQ ID NO: 738606 - RNA, 64 nt, Homo Sapiens
ucuugaaaagguaguuguuauuuacuccauuuacauauaaaagaguuugaguucagccucuuca

SEQ ID NO: 738607 - RNA, 64 nt, Homo Sapiens
uuuaaugaauuaggauaacauauaaaauccaaucauauaaaaaccucuagguaauugauuuaag

SEQ ID NO: 738608 - RNA, 64 nt, Homo Sapiens
cuucugcaacaucuuaagauccacaaaugaagggauauaaaaauaaugucauagguaagaaaca

SEQ ID NO: 738609 - RNA, 64 nt, Homo Sapiens
augugcugccugcaagcuucuuuuuucucauuaaauauaaaauauuuuguaaugcugcacagaa

SEQ ID NO: 738610 - RNA, 64 nt, Homo Sapiens
gucaaaaaucaaaaucaaacggacccacuggggcauauaaaaaacaguugagcucccaagacca

SEQ ID NO: 738611 - RNA, 64 nt, Homo Sapiens
ucugcuguauccuuucggcuggacccacuggggcauauaaaauccaguugagcucccaagacca

SEQ ID NO: 738612 - RNA, 64 nt, Homo Sapiens
acauguaacccauucaugaauaucuuagaauuguauauaaaacauuuauugaauaccaggguca

SEQ ID NO: 738613 - RNA, 64 nt, Homo Sapiens
uauugaggcuuagcuuuauugcgauucuuuuccuauauaaaagcgggaaauugauuuuuaagga

SEQ ID NO: 738614 - RNA, 64 nt, Homo Sapiens
uaggcauauaccucauauauuucauguaucuuguauauaaaauauguacaugaauauauauaua

SEQ ID NO: 738615 - RNA, 64 nt, Homo Sapiens
ucauguagcguaucacauaacuuuuuugcaaaaaauauaaaaagaaauaaacuucaauguauuu

SEQ ID NO: 738616 - RNA, 64 nt, Homo Sapiens
acugugcuagugacuggaggcccugcuacugcaaauauaaaacauaaaguuuguuuaaaaaaau

SEQ ID NO: 738617 - RNA, 64 nt, Homo Sapiens
uuaaaaaugugcauuuuauauaaagaugcauuuuauauaaaaaugcacaccuuuaaucucuaua

SEQ ID NO: 738618 - RNA, 64 nt, Homo Sapiens
uuuaaucucuauauggcagcauauacauauauauauauaaaaugcacacuuuuaaucucuauau

SEQ ID NO: 738619 - RNA, 64 nt, Homo Sapiens
uuauauacuguuaaaauuugagguacuguaguuuauauaaaagucggauguuaagauauuauau

SEQ ID NO: 738620 - RNA, 64 nt, Homo Sapiens
uuugcagucauuaacaugacaaauuaaguaauaaauauaaaagugauuguccauaaauuaucau

SEQ ID NO: 738621 - RNA, 64 nt, Homo Sapiens
accagccugggcaauguagcaagaccccaucucuauauaaaauauaaaaauguuggcugugcac

SEQ ID NO: 738622 - RNA, 64 nt, Homo Sapiens
ugggcaauguagcaagaccccaucucuauauaaaauauaaaaauguuggcugugcacgguagcu

SEQ ID NO: 738623 - RNA, 64 nt, Homo Sapiens
auguuucaaaacucagaugcauaaaacguaagguauauaaaaauacaucuaugcuugcguuuga

SEQ ID NO: 738624 - RNA, 64 nt, Homo Sapiens
cuggguauggaaauaacccugugaugauguguuaauauaaaauguugggagggaauauucccaa

SEQ ID NO: 738625 - RNA, 64 nt, Homo Sapiens
uuauuagccuuaucaaauaacugaucuacugugaauauaaaauguaugagcuccaagacacuua

SEQ ID NO: 738626 - RNA, 64 nt, Homo Sapiens
cauauuauuauaaauuuccucccuauaccccacuauauaaaagucacgugugcauacacacaua

SEQ ID NO: 738627 - RNA, 64 nt, Homo Sapiens
aaccucgaauauuaaaaaguaucuuuuuacuuagauauaaaauacagggcaggaguauucugga

SEQ ID NO: 738628 - RNA, 64 nt, Homo Sapiens
aguaauauuauuguuaugcuagagguauuggugcauauaaaaacuagagcuuuauauauuaaag

SEQ ID NO: 738629 - RNA, 64 nt, Homo Sapiens
gugggcauuuuguaacauucggcauauugacccuauauaaaaaauugaaaaauauaaguaauuu

SEQ ID NO: 738630 - RNA, 64 nt, Homo Sapiens
ggcuuagagaggaaaagcugaaauccacugacagauauaaaauaaugguaaaaugagugaucuc

SEQ ID NO: 738631 - RNA, 64 nt, Homo Sapiens
ugagcucagcucacugguccaaaaaaauccacucauauaaaagggacuccauuucaaaaaaaaa

SEQ ID NO: 738632 - RNA, 64 nt, Homo Sapiens
guagacuuaaaagguuugugccugauggaaaacuauauaaaauuaauuauauauaucuugccuc

SEQ ID NO: 738633 - RNA, 64 nt, Homo Sapiens
aaauuauauauaucuugccuaaaccuuuaguuaaauauaaaaaguuagagacuaagcccucuua

SEQ ID NO: 738634 - RNA, 64 nt, Homo Sapiens
cuagcccagaaguucucaucuuacaauuauguccauauaaaauuauugucuguguacccagagu

SEQ ID NO: 738635 - RNA, 64 nt, Homo Sapiens
ugugcccuagcguaaacaguuaugccuaaguaguauauaaaagcaaguuauauguggauaacug

SEQ ID NO: 738636 - RNA, 64 nt, Homo Sapiens
caauaguuugccccuuuuggaaugaucucugaauauauaaaacacacacacaaagagcaauagu

SEQ ID NO: 738637 - RNA, 64 nt, Homo Sapiens
caauaguuugccccuuuuggaacgaccccugaauauauaaaacacacacacaccccgcgcacuc

SEQ ID NO: 738638 - RNA, 64 nt, Homo Sapiens
aaauagaugaugguaugauucuauuauauauuuuauauaaaauccauccaaauuaaguuuuggg

SEQ ID NO: 738639 - RNA, 64 nt, Homo Sapiens
aggaauggaaucuucuccaguaugaaauuaccagauauaaaauaauguaaugaugcugaggaua

SEQ ID NO: 738640 - RNA, 64 nt, Homo Sapiens
guggaaaacaguguacuuuuuaaaaaauugcugaauauaaaaucuuugaaaauuuucuuuaugu

SEQ ID NO: 738641 - RNA, 64 nt, Homo Sapiens
uaggcuccaguguuauacuuuuuuuuauauauauauauaaaaauaaacuuuacguagugaaauc

SEQ ID NO: 738642 - RNA, 64 nt, Homo Sapiens
auauauacagaauaauacacacaguugugugugcauauaaaauacauauuuacgccaggcgugg

SEQ ID NO: 738643 - RNA, 64 nt, Homo Sapiens
auuugacuacauuaguauuagugacaucagguggauauaaaagaaaacccuuggaaagagaacu

SEQ ID NO: 738644 - RNA, 64 nt, Homo Sapiens
acauggaauuucauugaaaauaguuuaauuuuuuauauaaaagguuuuguauauaauguguguc

SEQ ID NO: 738645 - RNA, 64 nt, Homo Sapiens
uggucuuauagcuagacaugauucuauaucuagaauauaaaauccaauagaauuauucuggaua

SEQ ID NO: 738646 - RNA, 64 nt, Homo Sapiens
cucaggagagcaggcuuuugauuuguuuggggagauauaaaaggugguuugguugguuucaguc

SEQ ID NO: 738647 - RNA, 64 nt, Homo Sapiens
auauuuuguuaaucuaugccauuaguaguauuauauauaaaauauaguuccccgucccccuuuu

SEQ ID NO: 738648 - RNA, 64 nt, Homo Sapiens
uuuggaagaacauacaguauucagaaacuaaccuauauaaaauguaaacaauauauugauugca

SEQ ID NO: 738649 - RNA, 64 nt, Homo Sapiens
auaugcugaauuacuugugacauaaguaaacaugauauaaaaauuacuugcuuuaauucuuaag

SEQ ID NO: 738650 - RNA, 64 nt, Homo Sapiens
auuaccucugguguugacaguuacguauaaauuaauauaaaauggauaaagauuuuaaauggua

SEQ ID NO: 738651 - RNA, 64 nt, Homo Sapiens
cugaguucucuuucuuagucuauauuuauaucauauauaaaaguaucauaguauaaaucuauga

SEQ ID NO: 738652 - RNA, 64 nt, Homo Sapiens
uuuuuuucuuuuuaaaauaguuuaaaaaauauauauauaaaauaguauaugauuauaaugcuau

SEQ ID NO: 738653 - RNA, 64 nt, Homo Sapiens
aauauauuugucauaugcuccauagagaauacacauauaaaaacaggagcucaacuaaaagugg

SEQ ID NO: 738654 - RNA, 64 nt, Homo Sapiens
guguucuuaacuccagaaccugagaaauagagaaauauaaaaguauuuacuuuucugaucucuu

SEQ ID NO: 738655 - RNA, 64 nt, Homo Sapiens
aucuucaugcucugguaggggaacuuacucugcaauauaaaaaugacaaauucugacuguuggg

SEQ ID NO: 738656 - RNA, 64 nt, Homo Sapiens
aaauuuaggccaugggaacuaaaagcauauauauauauaaaauaguugcucucagaaaaaaaaa

SEQ ID NO: 738657 - RNA, 64 nt, Homo Sapiens
aaguggccacuauuccuaagcucauaucccugaaauauaaaagugaaaauucaugaacuauucu

SEQ ID NO: 738658 - RNA, 64 nt, Homo Sapiens
cuaugaaucacucacacucacuauguauguauauauauaaaaaagauauuugggauccucuuuu

SEQ ID NO: 738659 - RNA, 64 nt, Homo Sapiens
auauauauaaacacacauauugauaauccuaauuauauaaaaauuuuuuaauaguuugaaauga

SEQ ID NO: 738660 - RNA, 64 nt, Homo Sapiens
gguuuuuuuaaguuauuuuaguuuuugcugcuuuauauaaaaauuucugcagagaggaagauau

SEQ ID NO: 738661 - RNA, 64 nt, Homo Sapiens
uuuauauuuggaaauauauauuuaagaauuauauauauaaaaauauauauguauaagaguuaug

SEQ ID NO: 738662 - RNA, 64 nt, Homo Sapiens
auauauguauaagaguuauguauuugaaaaaaauauauaaaagaauauacaucacaauauaaua

SEQ ID NO: 738663 - RNA, 64 nt, Homo Sapiens
caccugugcccacuuugaccauuggugaggauagauauaaaaucacuucuuccaacgaagccua

SEQ ID NO: 738664 - RNA, 64 nt, Homo Sapiens
aaugguguaaaauuacauucagcuccuucuugucauauaaaaggaauuuggagggugucgcuua

SEQ ID NO: 738665 - RNA, 64 nt, Homo Sapiens
uccaugagaauuauuacuuuaaaaacaaaacaaaauauaaaaaacuguguuugaguaaacugau

SEQ ID NO: 738666 - RNA, 64 nt, Homo Sapiens
aguucaauaauaacuaaggcugugauuuuuuucaauauaaaaggcacagcuguuggccaaagug

SEQ ID NO: 738667 - RNA, 64 nt, Homo Sapiens
aauuuaaauaaaagugaaccauauuuaucugguuauauaaaacuaaaaauggggguguuuauau

SEQ ID NO: 738668 - RNA, 64 nt, Homo Sapiens
aucugguuauauaaaacuaaaaauggggguguuuauauaaaacuaaaaacuaagaaugauguaa

SEQ ID NO: 738669 - RNA, 64 nt, Homo Sapiens
auacaaguuucugaauauuuuaaaucuuaacaucauauaaaaagcagcagaggugagaacucag

SEQ ID NO: 738670 - RNA, 64 nt, Homo Sapiens
uuccccgaauucuauuuuuguccuugcagacagaauauaaaaacuccugggcuuaaggccuaag

SEQ ID NO: 738671 - RNA, 64 nt, Homo Sapiens
aacugagaccucagaguauguaggaguaaauaguauauaaaauagcucugguggcucaugccug

SEQ ID NO: 738672 - RNA, 64 nt, Homo Sapiens
aucugcuccccaaaaacuauugaaauaaaauaaaauauaaaaagaaagagaaagaaaagaaaau

SEQ ID NO: 738673 - RNA, 64 nt, Homo Sapiens
agaguagauauuugauauaccacucugauaacucauauaaaaauaucaucauaaaaagcuuaau

SEQ ID NO: 738674 - RNA, 64 nt, Homo Sapiens
aggaauaccucuuuauacgucuacauauuuuaguauauaaaaauagauaaugcucuuggacaca

SEQ ID NO: 738675 - RNA, 64 nt, Homo Sapiens
uagguuuuaaaucaguggguaucauaaaagccauauauaaaagauccuuucuuauaguaagacu

SEQ ID NO: 738676 - RNA, 64 nt, Homo Sapiens
guuuauguuuauuguauuuuauaugaucuacaacauauaaaauuguguauuuuucuuugguugu

SEQ ID NO: 738677 - RNA, 64 nt, Homo Sapiens
ucuggauugucaguaguauugugaaucagaucacauauaaaaagaauuccuaggauaugugauc

SEQ ID NO: 738678 - RNA, 64 nt, Homo Sapiens
cuacuuggauaauaucuacaaguuaccggcaagcauauaaaauggauuauucauucuaucucag

SEQ ID NO: 738679 - RNA, 64 nt, Homo Sapiens
acuguauauuaauugagguuacagaaaguucuuuauauaaaacuuauuuaaauuuuucauauuu

SEQ ID NO: 738680 - RNA, 64 nt, Homo Sapiens
guucucguuuuucuacagauauaaguaaauuuauauauaaaaauaccaaaaagaggcugggcgu

SEQ ID NO: 738681 - RNA, 64 nt, Homo Sapiens
acuuugugaguauucuauguaaaaauauauauguauauaaaauauauauugcauaggacagacu

SEQ ID NO: 738682 - RNA, 64 nt, Homo Sapiens
cuauauuuguaacuuugcauguucuuguuuuguuauauaaaaaaauuguaaauguuuaauaucu

SEQ ID NO: 738683 - RNA, 64 nt, Homo Sapiens
caagauaauucacucuacucagccggcguggcaaauauaaaacuuacagagcguggcugugcuc

SEQ ID NO: 738684 - RNA, 64 nt, Homo Sapiens
guauaaacauuaaaugucuuauauagcagcaaaaauauaaaauaguuguccauauuuucacagg

SEQ ID NO: 738685 - RNA, 64 nt, Homo Sapiens
agagaaauggcaaguuuugauaugaguauacaauauauaaaaauauauauagugcuauauauau

SEQ ID NO: 738686 - RNA, 64 nt, Homo Sapiens
guggaacuuuagaacuuggaaaauugugcccaaaauauaaaagucugccuuuugccacucuuaa

SEQ ID NO: 738687 - RNA, 64 nt, Homo Sapiens
guuuaaacugaacuuuaaggugcucugaaauccuauauaaaagaucuuaagauaucuggaggca

SEQ ID NO: 738688 - RNA, 64 nt, Homo Sapiens
caaaauuauaggauuuuuucuuuaguaaaaaccuauauaaaaacauuauaggauuuuuuucuuu

SEQ ID NO: 738689 - RNA, 64 nt, Homo Sapiens
caaaauuauaggauuuuuucgugaguaaaaaccuauauaaaaaccggggguaauagagccacug

SEQ ID NO: 738690 - RNA, 64 nt, Homo Sapiens
aauuuauauauauauauaugagauauauaaauauauauaaaauagcuauuuugcuuaaauuucu

SEQ ID NO: 738691 - RNA, 64 nt, Homo Sapiens
ucuuucuacuccaggacugguuuuguuuuuauauauauaaaaaaaaaaagugaaaacaccaaug

SEQ ID NO: 738692 - RNA, 64 nt, Homo Sapiens
ucuccuuucuucucucuguauauuuuguuauuuuauauaaaauaggagauaaaagucacauuga

SEQ ID NO: 738693 - RNA, 64 nt, Homo Sapiens
aaaaagagagagaaaagaaaagaaaucacaauguauauaaaacaguacuuauguuuuaaaauua

SEQ ID NO: 738694 - RNA, 64 nt, Homo Sapiens
gaauuauuaagcauaugugcuuucgcagcugauaauauaaaaggaaaucccacagucuagauau

SEQ ID NO: 738695 - RNA, 64 nt, Homo Sapiens
uaaaaaacguacucuuauuaucuggaacauagaaauauaaaagguaacaucuaaagcuuagaau

SEQ ID NO: 738696 - RNA, 64 nt, Homo Sapiens
auuauccaguagaaaauguuaggauaugugugcuauauaaaaaaaaaaaaagacuuguuaaguu

SEQ ID NO: 738697 - RNA, 64 nt, Homo Sapiens
auagcaaguauuuacugagagcauauuuaggucaauauaaaauauauaacugauugaugaaagg

SEQ ID NO: 738698 - RNA, 64 nt, Homo Sapiens
aguauacagaaaauuuuaaguccaaguguucuugauauaaaaucaccuuaauguuuauuuauca

SEQ ID NO: 738699 - RNA, 64 nt, Homo Sapiens
uuguuccuuucauaguuuuucugaugcaauuucaauauaaaaaguaacuuugcuacccuggauu

SEQ ID NO: 738700 - RNA, 64 nt, Homo Sapiens
ucuaaggucuaucaagucaaucauuucucacuguguacauaaugcuuaauuucuaaagauaaua

SEQ ID NO: 738701 - RNA, 64 nt, Homo Sapiens
uaaaaaaaaaaguuacagaaauacuauaacauauguacauaaauugcauaaagcauaaguauac

SEQ ID NO: 738702 - RNA, 64 nt, Homo Sapiens
caggacuuaaaaugacauucaguauauaaaauauguacauaauauuggaugacuaacuaucaaa

SEQ ID NO: 738703 - RNA, 64 nt, Homo Sapiens
gccaaaacagauccacaguaguuguugaguucaaguacauaaaguacauaacaagcgaacgucu

SEQ ID NO: 738704 - RNA, 64 nt, Homo Sapiens
gauccacaguaguuguugaguucaaguacauaaaguacauaacaagcgaacgucuaguacaauu

SEQ ID NO: 738705 - RNA, 64 nt, Homo Sapiens
cuuggugagucagggugccuguaggaaguggcuuguacauaaucccagcucugcaaagcucucu

SEQ ID NO: 738706 - RNA, 64 nt, Homo Sapiens
uucauuccugggauccuaucauuugaacagcauuguacauaacuuggggguaugugugcaggau

SEQ ID NO: 738707 - RNA, 64 nt, Homo Sapiens
auuucgauggcaaauguuaaauucaauaaaucuuguacauaacuaucauugccuagaagucaau

SEQ ID NO: 738708 - RNA, 64 nt, Homo Sapiens
auauguauuaaacugguauccuaacuuaacuacuguacauaauacggagacucaccuucccgag

SEQ ID NO: 738709 - RNA, 64 nt, Homo Sapiens
uuaaaauagucaagacaacacugaccuugcacuuguacauaacuauacaguaguguccagaaug

SEQ ID NO: 738710 - RNA, 64 nt, Homo Sapiens
acaguaguguccagaauguucagacauucggaguguacauaaaacagaaaaaaucuucauguau

SEQ ID NO: 738711 - RNA, 64 nt, Homo Sapiens
uagauuuuguuuucauaguuaagcugagccauauguacauaaucugaccuuuuuuccuguucac

SEQ ID NO: 738712 - RNA, 64 nt, Homo Sapiens
cauaugaggaaucugcaagggcugugauuguacuguacauaaaaggugaaagcuacugaaauaa

SEQ ID NO: 738713 - RNA, 64 nt, Homo Sapiens
cacagcauaaacugaggguguggguucuggcuuuguacauaacucauuuucucccuugcuuuuu

SEQ ID NO: 738714 - RNA, 64 nt, Homo Sapiens
accauaaaugaaacacuugagcacacuuuaaaaaguacauaaacccaugaguccauauguguaa

SEQ ID NO: 738715 - RNA, 64 nt, Homo Sapiens; identical to SEQ ID NO: 218381

SEQ ID NO: 738716 - RNA, 64 nt, Homo Sapiens; identical to SEQ ID NO: 218382

SEQ ID NO: 738717 - RNA, 64 nt, Homo Sapiens; identical to SEQ ID NO: 218383

SEQ ID NO: 738718 - RNA, 64 nt, Homo Sapiens; identical to SEQ ID NO: 218384

SEQ ID NO: 738719 - RNA, 64 nt, Homo Sapiens; identical to SEQ ID NO: 218385

SEQ ID NO: 738720 - RNA, 64 nt, Homo Sapiens; identical to SEQ ID NO: 218386

SEQ ID NO: 738721 - RNA, 64 nt, Homo Sapiens; identical to SEQ ID NO: 218387

SEQ ID NO: 738722 - RNA, 64 nt, Homo Sapiens; identical to SEQ ID NO: 218388

SEQ ID NO: 738723 - RNA, 64 nt, Homo Sapiens; identical to SEQ ID NO: 218389

SEQ ID NO: 738724 - RNA, 64 nt, Homo Sapiens; identical to SEQ ID NO: 218390

SEQ ID NO: 738725 - RNA, 64 nt, Homo Sapiens; identical to SEQ ID NO: 218391

SEQ ID NO: 738726 - RNA, 64 nt, Homo Sapiens; identical to SEQ ID NO: 218392

SEQ ID NO: 738727 - RNA, 64 nt, Homo Sapiens; identical to SEQ ID NO: 218393

SEQ ID NO: 738728 - RNA, 64 nt, Homo Sapiens; identical to SEQ ID NO: 218394

SEQ ID NO: 738729 - RNA, 64 nt, Homo Sapiens; identical to SEQ ID NO: 218395

SEQ ID NO: 738730 - RNA, 64 nt, Homo Sapiens; identical to SEQ ID NO: 218396

SEQ ID NO: 738731 - RNA, 64 nt, Homo Sapiens; identical to SEQ ID NO: 218397

SEQ ID NO: 738732 - RNA, 64 nt, Homo Sapiens; identical to SEQ ID NO: 218398

SEQ ID NO: 738733 - RNA, 64 nt, Homo Sapiens; identical to SEQ ID NO: 218399

SEQ ID NO: 738734 - RNA, 64 nt, Homo Sapiens; identical to SEQ ID NO: 218400

SEQ ID NO: 738735 - RNA, 64 nt, Homo Sapiens; identical to SEQ ID NO: 218401

SEQ ID NO: 738736 - RNA, 64 nt, Homo Sapiens; identical to SEQ ID NO: 218402

SEQ ID NO: 738737 - RNA, 64 nt, Homo Sapiens; identical to SEQ ID NO: 218403

SEQ ID NO: 738738 - RNA, 64 nt, Homo Sapiens; identical to SEQ ID NO: 218404

SEQ ID NO: 738739 - RNA, 64 nt, Homo Sapiens; identical to SEQ ID NO: 218405

SEQ ID NO: 738740 - RNA, 64 nt, Homo Sapiens; identical to SEQ ID NO: 218406

SEQ ID NO: 738741 - RNA, 64 nt, Homo Sapiens; identical to SEQ ID NO: 218407

SEQ ID NO: 738742 - RNA, 64 nt, Homo Sapiens; identical to SEQ ID NO: 218408

SEQ ID NO: 738743 - RNA, 64 nt, Homo Sapiens; identical to SEQ ID NO: 218409

SEQ ID NO: 738744 - RNA, 64 nt, Homo Sapiens; identical to SEQ ID NO: 218410

SEQ ID NO: 738745 - RNA, 64 nt, Homo Sapiens; identical to SEQ ID NO: 218411

SEQ ID NO: 738746 - RNA, 64 nt, Homo Sapiens; identical to SEQ ID NO: 218412

SEQ ID NO: 738747 - RNA, 64 nt, Homo Sapiens; identical to SEQ ID NO: 218413

SEQ ID NO: 738748 - RNA, 64 nt, Homo Sapiens; identical to SEQ ID NO: 218414

SEQ ID NO: 738749 - RNA, 64 nt, Homo Sapiens; identical to SEQ ID NO: 218415

SEQ ID NO: 738750 - RNA, 64 nt, Homo Sapiens; identical to SEQ ID NO: 218416

SEQ ID NO: 738751 - RNA, 64 nt, Homo Sapiens
auggaugugccacaugacagccagggacgccucagccccuuaacucagggcucugcauuccgug

SEQ ID NO: 738752 - RNA, 64 nt, Homo Sapiens
gaugcccaacuaauguguuucauuccuuuauguugccccuuacuuguucguuuuugaggggaac

SEQ ID NO: 738753 - RNA, 64 nt, Homo Sapiens
aacaaaaacaaaaaaugugcuccaggaggaguuagccaaacaacagcuaaaccagaaaggugau

SEQ ID NO: 738754 - RNA, 64 nt, Homo Sapiens
gcccagggagacuccgcugucugccuuaccgagagccaaacagaggagaggaaaagguguaggc

SEQ ID NO: 738755 - RNA, 64 nt, Homo Sapiens
aguaauucuuguaacuaccuuucuuucagcaaacgccaaacagucauauaauauucucacguac

SEQ ID NO: 738756 - RNA, 64 nt, Homo Sapiens
uacguguggcuacucauuggggacacuugguaaugccaaacaagugcaggcugcggccuugccc

SEQ ID NO: 738757 - RNA, 64 nt, Homo Sapiens
agaugccauuuuauauguggacguauuuauacuggccaaacauauuuuuucuuuugucccuuuu

SEQ ID NO: 738758 - RNA, 64 nt, Homo Sapiens
cggcccccgucuuguaaaaaggggaggagaauuagccaaacacuguaagcuuuuaagaaaaaca

SEQ ID NO: 738759 - RNA, 64 nt, Homo Sapiens
gugccgccuucuuguccuccuccucauugucgcugccaaacaggaggcaccggccacaggccca

SEQ ID NO: 738760 - RNA, 64 nt, Homo Sapiens
uacaauaagaaagagauaaaauggaaugcuuuaugccaaacauguuuauuuuuaucacacagcu

SEQ ID NO: 738761 - RNA, 64 nt, Homo Sapiens
uauucaaaucagcaucuagaggcugaaugacaaugccaaacacuccaccucugaucagaaccau

SEQ ID NO: 738762 - RNA, 64 nt, Homo Sapiens
cuggaagacacucagcucucuaagcaggggcucggccaaacaugggaguuaagugcugcuuguc

SEQ ID NO: 738763 - RNA, 64 nt, Homo Sapiens
ggcccagcagccuucugacacagggagccuggaagccaaacaaaugugaucuccacaccaaagu

SEQ ID NO: 738764 - RNA, 64 nt, Homo Sapiens
guuucuaacucaggggugaucuugcgaaaggaaagccaaacacuugccugcuccaagaaaaggg

SEQ ID NO: 738765 - RNA, 64 nt, Homo Sapiens; identical to SEQ ID NO: 201947

SEQ ID NO: 738766 - RNA, 64 nt, Homo Sapiens; identical to SEQ ID NO: 201948

SEQ ID NO: 738767 - RNA, 64 nt, Homo Sapiens; identical to SEQ ID NO: 201949

SEQ ID NO: 738768 - RNA, 64 nt, Homo Sapiens; identical to SEQ ID NO: 201950

SEQ ID NO: 738769 - RNA, 64 nt, Homo Sapiens; identical to SEQ ID NO: 201951

SEQ ID NO: 738770 - RNA, 64 nt, Homo Sapiens; identical to SEQ ID NO: 201952

SEQ ID NO: 738771 - RNA, 64 nt, Homo Sapiens; identical to SEQ ID NO: 201953

SEQ ID NO: 738772 - RNA, 64 nt, Homo Sapiens; identical to SEQ ID NO: 201954

SEQ ID NO: 738773 - RNA, 64 nt, Homo Sapiens; identical to SEQ ID NO: 201955

SEQ ID NO: 738774 - RNA, 64 nt, Homo Sapiens; identical to SEQ ID NO: 201956

SEQ ID NO: 738775 - RNA, 64 nt, Homo Sapiens; identical to SEQ ID NO: 201957

SEQ ID NO: 738776 - RNA, 64 nt, Homo Sapiens; identical to SEQ ID NO: 201958

SEQ ID NO: 738777 - RNA, 64 nt, Homo Sapiens; identical to SEQ ID NO: 201959

SEQ ID NO: 738778 - RNA, 64 nt, Homo Sapiens; identical to SEQ ID NO: 201960

SEQ ID NO: 738779 - RNA, 64 nt, Homo Sapiens; identical to SEQ ID NO: 201961

SEQ ID NO: 738780 - RNA, 64 nt, Homo Sapiens; identical to SEQ ID NO: 201962

SEQ ID NO: 738781 - RNA, 64 nt, Homo Sapiens; identical to SEQ ID NO: 201963

SEQ ID NO: 738782 - RNA, 64 nt, Homo Sapiens; identical to SEQ ID NO: 201964

SEQ ID NO: 738783 - RNA, 64 nt, Homo Sapiens; identical to SEQ ID NO: 201965

SEQ ID NO: 738784 - RNA, 64 nt, Homo Sapiens; identical to SEQ ID NO: 201966

SEQ ID NO: 738785 - RNA, 64 nt, Homo Sapiens; identical to SEQ ID NO: 201967

SEQ ID NO: 738786 - RNA, 64 nt, Homo Sapiens; identical to SEQ ID NO: 201968

SEQ ID NO: 738787 - RNA, 64 nt, Homo Sapiens; identical to SEQ ID NO: 201969

SEQ ID NO: 738788 - RNA, 64 nt, Homo Sapiens; identical to SEQ ID NO: 201970

SEQ ID NO: 738789 - RNA, 64 nt, Homo Sapiens; identical to SEQ ID NO: 201971

SEQ ID NO: 738790 - RNA, 64 nt, Homo Sapiens; identical to SEQ ID NO: 201972

SEQ ID NO: 738791 - RNA, 64 nt, Homo Sapiens; identical to SEQ ID NO: 361150

SEQ ID NO: 738792 - RNA, 64 nt, Homo Sapiens; identical to SEQ ID NO: 361151

SEQ ID NO: 738793 - RNA, 64 nt, Homo Sapiens; identical to SEQ ID NO: 361152

SEQ ID NO: 738794 - RNA, 64 nt, Homo Sapiens; identical to SEQ ID NO: 361153

SEQ ID NO: 738795 - RNA, 64 nt, Homo Sapiens; identical to SEQ ID NO: 361154

SEQ ID NO: 738796 - RNA, 64 nt, Homo Sapiens; identical to SEQ ID NO: 361155

SEQ ID NO: 738797 - RNA, 64 nt, Homo Sapiens; identical to SEQ ID NO: 361156

SEQ ID NO: 738798 - RNA, 64 nt, Homo Sapiens; identical to SEQ ID NO: 361157

SEQ ID NO: 738799 - RNA, 64 nt, Homo Sapiens; identical to SEQ ID NO: 361158

SEQ ID NO: 738800 - RNA, 64 nt, Homo Sapiens; identical to SEQ ID NO: 361159

SEQ ID NO: 738801 - RNA, 64 nt, Homo Sapiens; identical to SEQ ID NO: 361160

SEQ ID NO: 738802 - RNA, 64 nt, Homo Sapiens; identical to SEQ ID NO: 361161

SEQ ID NO: 738803 - RNA, 64 nt, Homo Sapiens; identical to SEQ ID NO: 361162

SEQ ID NO: 738804 - RNA, 64 nt, Homo Sapiens; identical to SEQ ID NO: 361163

SEQ ID NO: 738805 - RNA, 64 nt, Homo Sapiens; identical to SEQ ID NO: 361164

SEQ ID NO: 738806 - RNA, 64 nt, Homo Sapiens; identical to SEQ ID NO: 361165

SEQ ID NO: 738807 - RNA, 64 nt, Homo Sapiens; identical to SEQ ID NO: 361166

SEQ ID NO: 738808 - RNA, 64 nt, Homo Sapiens; identical to SEQ ID NO: 361167

SEQ ID NO: 738809 - RNA, 64 nt, Homo Sapiens; identical to SEQ ID NO: 361168

SEQ ID NO: 738810 - RNA, 64 nt, Homo Sapiens; identical to SEQ ID NO: 361169

SEQ ID NO: 738811 - RNA, 64 nt, Homo Sapiens; identical to SEQ ID NO: 361170

SEQ ID NO: 738812 - RNA, 64 nt, Homo Sapiens; identical to SEQ ID NO: 361171

SEQ ID NO: 738813 - RNA, 61 nt, Homo Sapiens
gggagaccacauguggugcacagggaagaaacggcuuuagacagcagucugcgggccccac

SEQ ID NO: 738814 - RNA, 61 nt, Homo Sapiens
acuccucaugugccauuuuguccucagagggcggcuuuacuuuuuugguaaaggaacaagc

SEQ ID NO: 738815 - RNA, 64 nt, Homo Sapiens; identical to SEQ ID NO: 98055

SEQ ID NO: 738816 - RNA, 64 nt, Homo Sapiens; identical to SEQ ID NO: 98056

SEQ ID NO: 738817 - RNA, 64 nt, Homo Sapiens; identical to SEQ ID NO: 98057

SEQ ID NO: 738818 - RNA, 64 nt, Homo Sapiens; identical to SEQ ID NO: 98058

SEQ ID NO: 738819 - RNA, 64 nt, Homo Sapiens; identical to SEQ ID NO: 98059

SEQ ID NO: 738820 - RNA, 64 nt, Homo Sapiens; identical to SEQ ID NO: 98060

SEQ ID NO: 738821 - RNA, 64 nt, Homo Sapiens; identical to SEQ ID NO: 98061

SEQ ID NO: 738822 - RNA, 64 nt, Homo Sapiens; identical to SEQ ID NO: 98062

SEQ ID NO: 738823 - RNA, 64 nt, Homo Sapiens; identical to SEQ ID NO: 98063

SEQ ID NO: 738824 - RNA, 64 nt, Homo Sapiens; identical to SEQ ID NO: 98064

SEQ ID NO: 738825 - RNA, 64 nt, Homo Sapiens; identical to SEQ ID NO: 98065

SEQ ID NO: 738826 - RNA, 64 nt, Homo Sapiens; identical to SEQ ID NO: 98066

SEQ ID NO: 738827 - RNA, 64 nt, Homo Sapiens; identical to SEQ ID NO: 98067

SEQ ID NO: 738828 - RNA, 64 nt, Homo Sapiens; identical to SEQ ID NO: 98068

SEQ ID NO: 738829 - RNA, 64 nt, Homo Sapiens; identical to SEQ ID NO: 98069

SEQ ID NO: 738830 - RNA, 64 nt, Homo Sapiens; identical to SEQ ID NO: 98070

SEQ ID NO: 738831 - RNA, 64 nt, Homo Sapiens; identical to SEQ ID NO: 98071

SEQ ID NO: 738832 - RNA, 64 nt, Homo Sapiens; identical to SEQ ID NO: 98072

SEQ ID NO: 738833 - RNA, 64 nt, Homo Sapiens; identical to SEQ ID NO: 98073

SEQ ID NO: 738834 - RNA, 64 nt, Homo Sapiens; identical to SEQ ID NO: 98074

SEQ ID NO: 738835 - RNA, 64 nt, Homo Sapiens; identical to SEQ ID NO: 98075

SEQ ID NO: 738836 - RNA, 64 nt, Homo Sapiens; identical to SEQ ID NO: 98076

SEQ ID NO: 738837 - RNA, 64 nt, Homo Sapiens; identical to SEQ ID NO: 98077

SEQ ID NO: 738838 - RNA, 64 nt, Homo Sapiens; identical to SEQ ID NO: 98078

SEQ ID NO: 738839 - RNA, 64 nt, Homo Sapiens; identical to SEQ ID NO: 98079

SEQ ID NO: 738840 - RNA, 64 nt, Homo Sapiens; identical to SEQ ID NO: 98080

SEQ ID NO: 738841 - RNA, 64 nt, Homo Sapiens; identical to SEQ ID NO: 98081

SEQ ID NO: 738842 - RNA, 64 nt, Homo Sapiens; identical to SEQ ID NO: 98082

SEQ ID NO: 738843 - RNA, 64 nt, Homo Sapiens; identical to SEQ ID NO: 98083

SEQ ID NO: 738844 - RNA, 64 nt, Homo Sapiens; identical to SEQ ID NO: 98084

SEQ ID NO: 738845 - RNA, 64 nt, Homo Sapiens; identical to SEQ ID NO: 98085

SEQ ID NO: 738846 - RNA, 64 nt, Homo Sapiens; identical to SEQ ID NO: 98086

SEQ ID NO: 738847 - RNA, 64 nt, Homo Sapiens; identical to SEQ ID NO: 98087

SEQ ID NO: 738848 - RNA, 64 nt, Homo Sapiens; identical to SEQ ID NO: 98088

SEQ ID NO: 738849 - RNA, 64 nt, Homo Sapiens; identical to SEQ ID NO: 98089

SEQ ID NO: 738850 - RNA, 64 nt, Homo Sapiens; identical to SEQ ID NO: 98090

SEQ ID NO: 738851 - RNA, 64 nt, Homo Sapiens; identical to SEQ ID NO: 98091

SEQ ID NO: 738852 - RNA, 64 nt, Homo Sapiens; identical to SEQ ID NO: 98092

SEQ ID NO: 738853 - RNA, 64 nt, Homo Sapiens; identical to SEQ ID NO: 98093

SEQ ID NO: 738854 - RNA, 64 nt, Homo Sapiens; identical to SEQ ID NO: 98094

SEQ ID NO: 738855 - RNA, 64 nt, Homo Sapiens; identical to SEQ ID NO: 98095

SEQ ID NO: 738856 - RNA, 64 nt, Homo Sapiens; identical to SEQ ID NO: 98096

SEQ ID NO: 738857 - RNA, 64 nt, Homo Sapiens; identical to SEQ ID NO: 98097

SEQ ID NO: 738858 - RNA, 64 nt, Homo Sapiens; identical to SEQ ID NO: 98098

SEQ ID NO: 738859 - RNA, 64 nt, Homo Sapiens; identical to SEQ ID NO: 98099

SEQ ID NO: 738860 - RNA, 64 nt, Homo Sapiens; identical to SEQ ID NO: 98100

SEQ ID NO: 738861 - RNA, 64 nt, Homo Sapiens; identical to SEQ ID NO: 98101

SEQ ID NO: 738862 - RNA, 64 nt, Homo Sapiens; identical to SEQ ID NO: 98102

SEQ ID NO: 738863 - RNA, 64 nt, Homo Sapiens; identical to SEQ ID NO: 98103

SEQ ID NO: 738864 - RNA, 64 nt, Homo Sapiens; identical to SEQ ID NO: 98104

SEQ ID NO: 738865 - RNA, 64 nt, Homo Sapiens; identical to SEQ ID NO: 98105

SEQ ID NO: 738866 - RNA, 64 nt, Homo Sapiens; identical to SEQ ID NO: 98106

SEQ ID NO: 738867 - RNA, 64 nt, Homo Sapiens; identical to SEQ ID NO: 98107

SEQ ID NO: 738868 - RNA, 64 nt, Homo Sapiens; identical to SEQ ID NO: 98108

SEQ ID NO: 738869 - RNA, 64 nt, Homo Sapiens; identical to SEQ ID NO: 98109

SEQ ID NO: 738870 - RNA, 64 nt, Homo Sapiens; identical to SEQ ID NO: 98110

SEQ ID NO: 738871 - RNA, 64 nt, Homo Sapiens; identical to SEQ ID NO: 98111

SEQ ID NO: 738872 - RNA, 64 nt, Homo Sapiens; identical to SEQ ID NO: 98112

SEQ ID NO: 738873 - RNA, 64 nt, Homo Sapiens; identical to SEQ ID NO: 98113

SEQ ID NO: 738874 - RNA, 64 nt, Homo Sapiens; identical to SEQ ID NO: 98114

SEQ ID NO: 738875 - RNA, 64 nt, Homo Sapiens; identical to SEQ ID NO: 98115

SEQ ID NO: 738876 - RNA, 64 nt, Homo Sapiens; identical to SEQ ID NO: 98116

SEQ ID NO: 738877 - RNA, 64 nt, Homo Sapiens; identical to SEQ ID NO: 98117

SEQ ID NO: 738878 - RNA, 64 nt, Homo Sapiens; identical to SEQ ID NO: 98118

SEQ ID NO: 738879 - RNA, 64 nt, Homo Sapiens; identical to SEQ ID NO: 98119

SEQ ID NO: 738880 - RNA, 64 nt, Homo Sapiens; identical to SEQ ID NO: 98120

SEQ ID NO: 738881 - RNA, 64 nt, Homo Sapiens; identical to SEQ ID NO: 98121

SEQ ID NO: 738882 - RNA, 64 nt, Homo Sapiens; identical to SEQ ID NO: 98122

SEQ ID NO: 738883 - RNA, 64 nt, Homo Sapiens; identical to SEQ ID NO: 98123

SEQ ID NO: 738884 - RNA, 64 nt, Homo Sapiens; identical to SEQ ID NO: 98124

SEQ ID NO: 738885 - RNA, 64 nt, Homo Sapiens; identical to SEQ ID NO: 98125

SEQ ID NO: 738886 - RNA, 64 nt, Homo Sapiens; identical to SEQ ID NO: 98126

SEQ ID NO: 738887 - RNA, 64 nt, Homo Sapiens; identical to SEQ ID NO: 98127

SEQ ID NO: 738888 - RNA, 64 nt, Homo Sapiens; identical to SEQ ID NO: 98128

SEQ ID NO: 738889 - RNA, 64 nt, Homo Sapiens; identical to SEQ ID NO: 98129

SEQ ID NO: 738890 - RNA, 64 nt, Homo Sapiens; identical to SEQ ID NO: 98130

SEQ ID NO: 738891 - RNA, 64 nt, Homo Sapiens; identical to SEQ ID NO: 98131

SEQ ID NO: 738892 - RNA, 64 nt, Homo Sapiens; identical to SEQ ID NO: 98132

SEQ ID NO: 738893 - RNA, 64 nt, Homo Sapiens; identical to SEQ ID NO: 98133

SEQ ID NO: 738894 - RNA, 64 nt, Homo Sapiens; identical to SEQ ID NO: 98134

SEQ ID NO: 738895 - RNA, 64 nt, Homo Sapiens; identical to SEQ ID NO: 98135

SEQ ID NO: 738896 - RNA, 64 nt, Homo Sapiens; identical to SEQ ID NO: 98136

SEQ ID NO: 738897 - RNA, 64 nt, Homo Sapiens; identical to SEQ ID NO: 98137

SEQ ID NO: 738898 - RNA, 64 nt, Homo Sapiens; identical to SEQ ID NO: 98138

SEQ ID NO: 738899 - RNA, 64 nt, Homo Sapiens; identical to SEQ ID NO: 98139

SEQ ID NO: 738900 - RNA, 64 nt, Homo Sapiens; identical to SEQ ID NO: 98140

SEQ ID NO: 738901 - RNA, 64 nt, Homo Sapiens; identical to SEQ ID NO: 98141

SEQ ID NO: 738902 - RNA, 64 nt, Homo Sapiens; identical to SEQ ID NO: 98142

SEQ ID NO: 738903 - RNA, 64 nt, Homo Sapiens; identical to SEQ ID NO: 98143

SEQ ID NO: 738904 - RNA, 64 nt, Homo Sapiens; identical to SEQ ID NO: 98144

SEQ ID NO: 738905 - RNA, 64 nt, Homo Sapiens; identical to SEQ ID NO: 98145

SEQ ID NO: 738906 - RNA, 64 nt, Homo Sapiens; identical to SEQ ID NO: 98146

SEQ ID NO: 738907 - RNA, 64 nt, Homo Sapiens; identical to SEQ ID NO: 98147

SEQ ID NO: 738908 - RNA, 64 nt, Homo Sapiens; identical to SEQ ID NO: 98148

SEQ ID NO: 738909 - RNA, 64 nt, Homo Sapiens; identical to SEQ ID NO: 98149

SEQ ID NO: 738910 - RNA, 64 nt, Homo Sapiens; identical to SEQ ID NO: 98150

SEQ ID NO: 738911 - RNA, 64 nt, Homo Sapiens; identical to SEQ ID NO: 98151

SEQ ID NO: 738912 - RNA, 64 nt, Homo Sapiens; identical to SEQ ID NO: 98152

SEQ ID NO: 738913 - RNA, 64 nt, Homo Sapiens; identical to SEQ ID NO: 98153

SEQ ID NO: 738914 - RNA, 64 nt, Homo Sapiens; identical to SEQ ID NO: 98154

SEQ ID NO: 738915 - RNA, 64 nt, Homo Sapiens; identical to SEQ ID NO: 98155

SEQ ID NO: 738916 - RNA, 64 nt, Homo Sapiens; identical to SEQ ID NO: 98156

SEQ ID NO: 738917 - RNA, 64 nt, Homo Sapiens; identical to SEQ ID NO: 98157

SEQ ID NO: 738918 - RNA, 64 nt, Homo Sapiens; identical to SEQ ID NO: 98158

SEQ ID NO: 738919 - RNA, 64 nt, Homo Sapiens; identical to SEQ ID NO: 98159

SEQ ID NO: 738920 - RNA, 64 nt, Homo Sapiens; identical to SEQ ID NO: 98160

SEQ ID NO: 738921 - RNA, 64 nt, Homo Sapiens; identical to SEQ ID NO: 98161

SEQ ID NO: 738922 - RNA, 64 nt, Homo Sapiens; identical to SEQ ID NO: 98162

SEQ ID NO: 738923 - RNA, 64 nt, Homo Sapiens; identical to SEQ ID NO: 98163

SEQ ID NO: 738924 - RNA, 64 nt, Homo Sapiens; identical to SEQ ID NO: 98164

SEQ ID NO: 738925 - RNA, 64 nt, Homo Sapiens; identical to SEQ ID NO: 98165

SEQ ID NO: 738926 - RNA, 64 nt, Homo Sapiens; identical to SEQ ID NO: 98166

SEQ ID NO: 738927 - RNA, 64 nt, Homo Sapiens; identical to SEQ ID NO: 98167

SEQ ID NO: 738928 - RNA, 64 nt, Homo Sapiens; identical to SEQ ID NO: 98168

SEQ ID NO: 738929 - RNA, 64 nt, Homo Sapiens; identical to SEQ ID NO: 98169

SEQ ID NO: 738930 - RNA, 64 nt, Homo Sapiens; identical to SEQ ID NO: 98170

SEQ ID NO: 738931 - RNA, 64 nt, Homo Sapiens; identical to SEQ ID NO: 98171

SEQ ID NO: 738932 - RNA, 64 nt, Homo Sapiens; identical to SEQ ID NO: 98172

SEQ ID NO: 738933 - RNA, 64 nt, Homo Sapiens; identical to SEQ ID NO: 98173

SEQ ID NO: 738934 - RNA, 64 nt, Homo Sapiens; identical to SEQ ID NO: 98174

SEQ ID NO: 738935 - RNA, 64 nt, Homo Sapiens; identical to SEQ ID NO: 98175

SEQ ID NO: 738936 - RNA, 64 nt, Homo Sapiens; identical to SEQ ID NO: 98176

SEQ ID NO: 738937 - RNA, 64 nt, Homo Sapiens; identical to SEQ ID NO: 98177

SEQ ID NO: 738938 - RNA, 64 nt, Homo Sapiens; identical to SEQ ID NO: 98178

SEQ ID NO: 738939 - RNA, 64 nt, Homo Sapiens; identical to SEQ ID NO: 98179

SEQ ID NO: 738940 - RNA, 64 nt, Homo Sapiens; identical to SEQ ID NO: 98180

SEQ ID NO: 738941 - RNA, 64 nt, Homo Sapiens; identical to SEQ ID NO: 98181

SEQ ID NO: 738942 - RNA, 64 nt, Homo Sapiens; identical to SEQ ID NO: 98182

SEQ ID NO: 738943 - RNA, 64 nt, Homo Sapiens; identical to SEQ ID NO: 98183

SEQ ID NO: 738944 - RNA, 64 nt, Homo Sapiens; identical to SEQ ID NO: 98184

SEQ ID NO: 738945 - RNA, 64 nt, Homo Sapiens; identical to SEQ ID NO: 98185

SEQ ID NO: 738946 - RNA, 64 nt, Homo Sapiens; identical to SEQ ID NO: 98186

SEQ ID NO: 738947 - RNA, 64 nt, Homo Sapiens; identical to SEQ ID NO: 98187

SEQ ID NO: 738948 - RNA, 64 nt, Homo Sapiens; identical to SEQ ID NO: 98188

SEQ ID NO: 738949 - RNA, 64 nt, Homo Sapiens; identical to SEQ ID NO: 98189

SEQ ID NO: 738950 - RNA, 64 nt, Homo Sapiens; identical to SEQ ID NO: 98190

SEQ ID NO: 738951 - RNA, 64 nt, Homo Sapiens; identical to SEQ ID NO: 98191

SEQ ID NO: 738952 - RNA, 64 nt, Homo Sapiens; identical to SEQ ID NO: 98192

SEQ ID NO: 738953 - RNA, 64 nt, Homo Sapiens; identical to SEQ ID NO: 98193

SEQ ID NO: 738954 - RNA, 64 nt, Homo Sapiens; identical to SEQ ID NO: 98194

SEQ ID NO: 738955 - RNA, 64 nt, Homo Sapiens; identical to SEQ ID NO: 98195

SEQ ID NO: 738956 - RNA, 64 nt, Homo Sapiens; identical to SEQ ID NO: 98196

SEQ ID NO: 738957 - RNA, 64 nt, Homo Sapiens; identical to SEQ ID NO: 98197

SEQ ID NO: 738958 - RNA, 64 nt, Homo Sapiens; identical to SEQ ID NO: 98198

SEQ ID NO: 738959 - RNA, 64 nt, Homo Sapiens; identical to SEQ ID NO: 98199

SEQ ID NO: 738960 - RNA, 64 nt, Homo Sapiens
gcuccuggaaggugaaaaguagucauuuguucuaaaucuauacauauuacuuguaucuagugca

SEQ ID NO: 738961 - RNA, 64 nt, Homo Sapiens
ucuuaaauguauauguuggucacuaauugcacaaaaucuauaauuugccagggcuuuagagauu

SEQ ID NO: 738962 - RNA, 64 nt, Homo Sapiens
ucgcauuucguuuucucugucucacugagacaacaaucuauacuguuuuggcaaguuugcauuu

SEQ ID NO: 738963 - RNA, 64 nt, Homo Sapiens
aagcagaaauaguaaaauucaguagguuuaaaacaaucuauaaauguauuuuauuuccaagaaa

SEQ ID NO: 738964 - RNA, 64 nt, Homo Sapiens
uugggaaaaaaacauacacaauauauuuuuuaaaaaucuauauuagcuucuauauauuguaugu

SEQ ID NO: 738965 - RNA, 64 nt, Homo Sapiens
cugcacccacuuaaucuacuuggggacauuuuauaaucuauaugggcaagcccccaaacugcug

SEQ ID NO: 738966 - RNA, 64 nt, Homo Sapiens
ugagaaacguuuggauaauaugaugagcaauagaaaucuauauaaagugaauguucaacaacaa

SEQ ID NO: 738967 - RNA, 64 nt, Homo Sapiens
uuaauucaagagaaugcuuuaauuuuuauacuaaaaucuauaauagagcucccuccgaagagaa

SEQ ID NO: 738968 - RNA, 64 nt, Homo Sapiens
uuuuacauucccaccagcagugcacaaggauugcaaucuauauacauccucaccaacauuguuc

SEQ ID NO: 738969 - RNA, 64 nt, Homo Sapiens
uuggauagcagcuaucuuguuggaugugagguggaaucuauagugucuuucauuuuuauuuugu

SEQ ID NO: 738970 - RNA, 64 nt, Homo Sapiens
aauaaugcuuaucacuggcuuuuaguuaaucuauaaucuauagauauuuccuguaagaaauguu

SEQ ID NO: 738971 - RNA, 64 nt, Homo Sapiens
cuauagaaauaaugcuuaucaaauguuuuuaguuaaucuauaauaucccuuuauuuccuguaag

SEQ ID NO: 738972 - RNA, 64 nt, Homo Sapiens
cucuugcauuucacuugaguggagguuuauaguuaaucuauaacuacauauugaauagggcuag

SEQ ID NO: 738973 - RNA, 64 nt, Homo Sapiens
auagaaagcaagauguacuauaacauagaauugcaaucuauaauauuuguguguucacuaaacu

SEQ ID NO: 738974 - RNA, 58 nt, Homo Sapiens; identical to SEQ ID NO: 244172

SEQ ID NO: 738975 - RNA, 64 nt, Homo Sapiens; identical to SEQ ID NO: 244173

SEQ ID NO: 738976 - RNA, 64 nt, Homo Sapiens; identical to SEQ ID NO: 244174

SEQ ID NO: 738977 - RNA, 64 nt, Homo Sapiens; identical to SEQ ID NO: 244175

SEQ ID NO: 738978 - RNA, 64 nt, Homo Sapiens; identical to SEQ ID NO: 244176

SEQ ID NO: 738979 - RNA, 64 nt, Homo Sapiens; identical to SEQ ID NO: 244177

SEQ ID NO: 738980 - RNA, 64 nt, Homo Sapiens; identical to SEQ ID NO: 244178

SEQ ID NO: 738981 - RNA, 64 nt, Homo Sapiens; identical to SEQ ID NO: 244179

SEQ ID NO: 738982 - RNA, 64 nt, Homo Sapiens; identical to SEQ ID NO: 244180

SEQ ID NO: 738983 - RNA, 64 nt, Homo Sapiens; identical to SEQ ID NO: 244181

SEQ ID NO: 738984 - RNA, 64 nt, Homo Sapiens; identical to SEQ ID NO: 244182

SEQ ID NO: 738985 - RNA, 64 nt, Homo Sapiens; identical to SEQ ID NO: 244183

SEQ ID NO: 738986 - RNA, 64 nt, Homo Sapiens; identical to SEQ ID NO: 244184

SEQ ID NO: 738987 - RNA, 64 nt, Homo Sapiens; identical to SEQ ID NO: 244185

SEQ ID NO: 738988 - RNA, 64 nt, Homo Sapiens; identical to SEQ ID NO: 244186

SEQ ID NO: 738989 - RNA, 64 nt, Homo Sapiens; identical to SEQ ID NO: 244187

SEQ ID NO: 738990 - RNA, 64 nt, Homo Sapiens; identical to SEQ ID NO: 244188

SEQ ID NO: 738991 - RNA, 64 nt, Homo Sapiens; identical to SEQ ID NO: 244189

SEQ ID NO: 738992 - RNA, 64 nt, Homo Sapiens; identical to SEQ ID NO: 244190

SEQ ID NO: 738993 - RNA, 64 nt, Homo Sapiens; identical to SEQ ID NO: 244191

SEQ ID NO: 738994 - RNA, 64 nt, Homo Sapiens; identical to SEQ ID NO: 244192

SEQ ID NO: 738995 - RNA, 64 nt, Homo Sapiens; identical to SEQ ID NO: 244193

SEQ ID NO: 738996 - RNA, 64 nt, Homo Sapiens; identical to SEQ ID NO: 244194

SEQ ID NO: 738997 - RNA, 64 nt, Homo Sapiens; identical to SEQ ID NO: 244195

SEQ ID NO: 738998 - RNA, 63 nt, Homo Sapiens
guguucucaacugaguaacuuuuaaguggaaaccaaguuuagauuuggggagugguaaaggaa

SEQ ID NO: 738999 - RNA, 63 nt, Homo Sapiens
uacugcccaaguuaaauauugauagccuaaagacaaguuuauguaguacuuaauguacaugau

SEQ ID NO: 739000 - RNA, 63 nt, Homo Sapiens
aaaugaauaagcuaucaauauauaauuuaaguacaaguuuaggcugggcgugguggcucacgc

SEQ ID NO: 739001 - RNA, 63 nt, Homo Sapiens
ucucaaaaaaagaaagaaagaaaaaagaaaguacaaguuuauaaaguauuauagugaaaaauu

SEQ ID NO: 739002 - RNA, 63 nt, Homo Sapiens
caaggaaaugaauauauuguuagaccagguaagcaaguuuauuuuuguuaaagagcacuuggu

SEQ ID NO: 739003 - RNA, 63 nt, Homo Sapiens
guccuuuuaauuuuugcuuagaauagaauggaacaaguuuaaauuucaaggaaauaugaaggc

SEQ ID NO: 739004 - RNA, 63 nt, Homo Sapiens
uaaaacugcuuucucaagucauuuuuucuauuacaaguuuauuauaggucuuaaacaugauga

SEQ ID NO: 739005 - RNA, 63 nt, Homo Sapiens
gaaaagaaagcaguaaaugcuuaaucugucuuucaaguuuacauuauugccaaaaaguuuuuu

SEQ ID NO: 739006 - RNA, 63 nt, Homo Sapiens
uuguauaaaacugcuuagaauacaaauuuuacucaaguuuaaaaauaaggucuuuuuuaaaua

SEQ ID NO: 739007 - RNA, 63 nt, Homo Sapiens
uccuagucaaacaaaauuuacaacuuaacuuuccaaguuuauauaauccauuguuuaaauuua

SEQ ID NO: 739008 - RNA, 63 nt, Homo Sapiens
cuucauauagcauugauaauggacacaaauuuucaaguuuacaauuguaucuuauuauaaaau

SEQ ID NO: 739009 - RNA, 63 nt, Homo Sapiens
agccauguauaaccaagugucauaacuguagcucaaguuuaaagaggguggggggauuuguag

SEQ ID NO: 739010 - RNA, 63 nt, Homo Sapiens
aucaaacagccaaacaccuggaaguauuagauacaaguuuaaaauaucuuuuauagguuuuau

SEQ ID NO: 739011 - RNA, 63 nt, Homo Sapiens
auuuaaugauauguuagugccucuguuauaugucaaguuuaaagcagggcacauuguugcagc

SEQ ID NO: 739012 - RNA, 63 nt, Homo Sapiens
cacgacacuaaucuccccugccagugacuuguccaaguuuacagcacucccuggagagaggac

SEQ ID NO: 739013 - RNA, 63 nt, Homo Sapiens
ucauccuuuauuuuuaaucacauccucucucuccaaguuuaucggcaagcagggcccaucuua

SEQ ID NO: 739014 - RNA, 63 nt, Homo Sapiens
ccuguuuuagucaguugggaggaagggaaaaaucaaguuuaauucccuuuaucuggguuaauu

SEQ ID NO: 739015 - RNA, 63 nt, Homo Sapiens
acuuauacucuugagaaugaauucaguuucaaucaaguuuacauuauguugcuuaaaaaaaua

SEQ ID NO: 739016 - RNA, 63 nt, Homo Sapiens
ugguuuucaauaccaccaagaggaaaauauugacaaguuuaaaggcugugucauugggccaug

SEQ ID NO: 739017 - RNA, 63 nt, Homo Sapiens
ggaauuaacaauugccagggaaaccagccaacccaaguuuauuauaucauuaaccuuaucaua

SEQ ID NO: 739018 - RNA, 64 nt, Homo Sapiens; identical to SEQ ID NO: 126433

SEQ ID NO: 739019 - RNA, 64 nt, Homo Sapiens; identical to SEQ ID NO: 126434

SEQ ID NO: 739020 - RNA, 64 nt, Homo Sapiens; identical to SEQ ID NO: 126435

SEQ ID NO: 739021 - RNA, 64 nt, Homo Sapiens; identical to SEQ ID NO: 126436

SEQ ID NO: 739022 - RNA, 64 nt, Homo Sapiens; identical to SEQ ID NO: 126437

SEQ ID NO: 739023 - RNA, 64 nt, Homo Sapiens; identical to SEQ ID NO: 126438

SEQ ID NO: 739024 - RNA, 64 nt, Homo Sapiens; identical to SEQ ID NO: 126439

SEQ ID NO: 739025 - RNA, 64 nt, Homo Sapiens; identical to SEQ ID NO: 126440

SEQ ID NO: 739026 - RNA, 64 nt, Homo Sapiens; identical to SEQ ID NO: 126441

SEQ ID NO: 739027 - RNA, 64 nt, Homo Sapiens; identical to SEQ ID NO: 126442

SEQ ID NO: 739028 - RNA, 64 nt, Homo Sapiens; identical to SEQ ID NO: 126443

SEQ ID NO: 739029 - RNA, 64 nt, Homo Sapiens; identical to SEQ ID NO: 126444

SEQ ID NO: 739030 - RNA, 64 nt, Homo Sapiens; identical to SEQ ID NO: 126445

SEQ ID NO: 739031 - RNA, 64 nt, Homo Sapiens; identical to SEQ ID NO: 126446

SEQ ID NO: 739032 - RNA, 64 nt, Homo Sapiens; identical to SEQ ID NO: 126447

SEQ ID NO: 739033 - RNA, 64 nt, Homo Sapiens; identical to SEQ ID NO: 126448

SEQ ID NO: 739034 - RNA, 64 nt, Homo Sapiens; identical to SEQ ID NO: 126449

SEQ ID NO: 739035 - RNA, 64 nt, Homo Sapiens; identical to SEQ ID NO: 126450

SEQ ID NO: 739036 - RNA, 64 nt, Homo Sapiens; identical to SEQ ID NO: 126451

SEQ ID NO: 739037 - RNA, 64 nt, Homo Sapiens; identical to SEQ ID NO: 126452

SEQ ID NO: 739038 - RNA, 64 nt, Homo Sapiens; identical to SEQ ID NO: 126453

SEQ ID NO: 739039 - RNA, 64 nt, Homo Sapiens; identical to SEQ ID NO: 126454

SEQ ID NO: 739040 - RNA, 64 nt, Homo Sapiens; identical to SEQ ID NO: 126455

SEQ ID NO: 739041 - RNA, 64 nt, Homo Sapiens; identical to SEQ ID NO: 126456

SEQ ID NO: 739042 - RNA, 64 nt, Homo Sapiens; identical to SEQ ID NO: 126457

SEQ ID NO: 739043 - RNA, 64 nt, Homo Sapiens; identical to SEQ ID NO: 126458

SEQ ID NO: 739044 - RNA, 64 nt, Homo Sapiens
cgggacaucacagggugggccucggccccucccacacccaaagcugagccugcagggaagcccc

SEQ ID NO: 739045 - RNA, 64 nt, Homo Sapiens
uucuuggggcccagugcaugguggccagaggugucacccaaaccggcaggugcgauuuuguuaa

SEQ ID NO: 739046 - RNA, 64 nt, Homo Sapiens
cuagaugugugugugcacacuucuuccuaaaaaccacccaaacauugaagucacauacuuaaua

SEQ ID NO: 739047 - RNA, 64 nt, Homo Sapiens
aaacauccuuaacugacccucaaaaguaggcuaucacccaaagcucagauaauaaauaagagac

SEQ ID NO: 739048 - RNA, 64 nt, Homo Sapiens
ucccaaaccaaacuaacagugcugguuuguccgacacccaaagcccacuucacacauuuauaag

SEQ ID NO: 739049 - RNA, 64 nt, Homo Sapiens
ccuuucucuuaccacuaguugcuuacaaaaauagcacccaaacacauggcacuuggaagaaaaa

SEQ ID NO: 739050 - RNA, 64 nt, Homo Sapiens; identical to SEQ ID NO: 68551

SEQ ID NO: 739051 - RNA, 64 nt, Homo Sapiens; identical to SEQ ID NO: 68552

SEQ ID NO: 739052 - RNA, 64 nt, Homo Sapiens; identical to SEQ ID NO: 68553

SEQ ID NO: 739053 - RNA, 64 nt, Homo Sapiens; identical to SEQ ID NO: 68554

SEQ ID NO: 739054 - RNA, 64 nt, Homo Sapiens; identical to SEQ ID NO: 68555

SEQ ID NO: 739055 - RNA, 64 nt, Homo Sapiens; identical to SEQ ID NO: 68556

SEQ ID NO: 739056 - RNA, 64 nt, Homo Sapiens; identical to SEQ ID NO: 68557

SEQ ID NO: 739057 - RNA, 64 nt, Homo Sapiens; identical to SEQ ID NO: 68558

SEQ ID NO: 739058 - RNA, 64 nt, Homo Sapiens; identical to SEQ ID NO: 560313

SEQ ID NO: 739059 - RNA, 64 nt, Homo Sapiens; identical to SEQ ID NO: 560314

SEQ ID NO: 739060 - RNA, 64 nt, Homo Sapiens; identical to SEQ ID NO: 560315

SEQ ID NO: 739061 - RNA, 64 nt, Homo Sapiens; identical to SEQ ID NO: 560316

SEQ ID NO: 739062 - RNA, 64 nt, Homo Sapiens; identical to SEQ ID NO: 560317

SEQ ID NO: 739063 - RNA, 64 nt, Homo Sapiens; identical to SEQ ID NO: 560318

SEQ ID NO: 739064 - RNA, 64 nt, Homo Sapiens; identical to SEQ ID NO: 560319

SEQ ID NO: 739065 - RNA, 64 nt, Homo Sapiens; identical to SEQ ID NO: 560320

SEQ ID NO: 739066 - RNA, 64 nt, Homo Sapiens; identical to SEQ ID NO: 560321

SEQ ID NO: 739067 - RNA, 62 nt, Homo Sapiens; identical to SEQ ID NO: 560322

SEQ ID NO: 739068 - RNA, 64 nt, Homo Sapiens; identical to SEQ ID NO: 560323

SEQ ID NO: 739069 - RNA, 64 nt, Homo Sapiens; identical to SEQ ID NO: 560324

SEQ ID NO: 739070 - RNA, 64 nt, Homo Sapiens; identical to SEQ ID NO: 560325

SEQ ID NO: 739071 - RNA, 64 nt, Homo Sapiens; identical to SEQ ID NO: 560326

SEQ ID NO: 739072 - RNA, 64 nt, Homo Sapiens; identical to SEQ ID NO: 560327

SEQ ID NO: 739073 - RNA, 64 nt, Homo Sapiens; identical to SEQ ID NO: 560328

SEQ ID NO: 739074 - RNA, 64 nt, Homo Sapiens; identical to SEQ ID NO: 560329

SEQ ID NO: 739075 - RNA, 64 nt, Homo Sapiens; identical to SEQ ID NO: 560330

SEQ ID NO: 739076 - RNA, 64 nt, Homo Sapiens; identical to SEQ ID NO: 420761

SEQ ID NO: 739077 - RNA, 64 nt, Homo Sapiens; identical to SEQ ID NO: 420762

SEQ ID NO: 739078 - RNA, 64 nt, Homo Sapiens; identical to SEQ ID NO: 420763

SEQ ID NO: 739079 - RNA, 64 nt, Homo Sapiens; identical to SEQ ID NO: 420764

SEQ ID NO: 739080 - RNA, 64 nt, Homo Sapiens; identical to SEQ ID NO: 420765

SEQ ID NO: 739081 - RNA, 64 nt, Homo Sapiens; identical to SEQ ID NO: 420766

SEQ ID NO: 739082 - RNA, 64 nt, Homo Sapiens; identical to SEQ ID NO: 420767

SEQ ID NO: 739083 - RNA, 64 nt, Homo Sapiens; identical to SEQ ID NO: 420768

SEQ ID NO: 739084 - RNA, 64 nt, Homo Sapiens; identical to SEQ ID NO: 244684

SEQ ID NO: 739085 - RNA, 64 nt, Homo Sapiens; identical to SEQ ID NO: 244685

SEQ ID NO: 739086 - RNA, 64 nt, Homo Sapiens
auagcaguuuuaaaaguuuucauuuguacauaaacuaguagaaauugauuuauuauuagcaugu

SEQ ID NO: 739087 - RNA, 64 nt, Homo Sapiens
ugcuugaagauuagacuagauaagauaauguuuccuaguagaguagucaauuuuaacuaaaaac

SEQ ID NO: 739088 - RNA, 64 nt, Homo Sapiens
guucucguucauuggcaacaugcaugccgccagccuaguagaaacagcugacagacgugggcuc

SEQ ID NO: 739089 - RNA, 64 nt, Homo Sapiens
aacauaaaagauauaaaagggggcagaaugcugacuaguagacuugggaguggcuuuccauuuu

SEQ ID NO: 739090 - RNA, 64 nt, Homo Sapiens
aucagugcauuugaaaauucaagccagcauauuccuaguagauggaagcaaaauuaaguugucu

SEQ ID NO: 739091 - RNA, 64 nt, Homo Sapiens
aaucucauuaaacaaauauucuccaugggccugucuaguagauuaauggaucugguuggccguu

SEQ ID NO: 739092 - RNA, 64 nt, Homo Sapiens
uucuuuguuuuuacagaucauauuaaggaaugcugaugaacaauuuugcuaucgacuacuaaau

SEQ ID NO: 739093 - RNA, 64 nt, Homo Sapiens
cuuaccgccuccuuuuuccuuuaaucuuauuuuugaugaacacauauauaggagaacaucuauc

SEQ ID NO: 739094 - RNA, 64 nt, Homo Sapiens
aacauuuuuuuguauagguauaccaugauuuguugaugaacaaauuuaccuguugaugaacauu

SEQ ID NO: 739095 - RNA, 64 nt, Homo Sapiens
uaccaugauuuguugaugaacaaauuuaccuguugaugaacauuuacguuguuaccaagauuuu

SEQ ID NO: 739096 - RNA, 64 nt, Homo Sapiens
uuuggcaaacauacauaauguuacaucauacuaugaugaacauccauguacuuuucacucaauu

SEQ ID NO: 739097 - RNA, 64 nt, Homo Sapiens
uuugugucuggcagaugaguaugucaaggauugagaugaacacauaagucuuggaaauuaaaua

SEQ ID NO: 739098 - RNA, 64 nt, Homo Sapiens; identical to SEQ ID NO: 484977

SEQ ID NO: 739099 - RNA, 64 nt, Homo Sapiens; identical to SEQ ID NO: 484978

SEQ ID NO: 739100 - RNA, 64 nt, Homo Sapiens; identical to SEQ ID NO: 484979

SEQ ID NO: 739101 - RNA, 64 nt, Homo Sapiens; identical to SEQ ID NO: 484980

SEQ ID NO: 739102 - RNA, 64 nt, Homo Sapiens; identical to SEQ ID NO: 484981

SEQ ID NO: 739103 - RNA, 64 nt, Homo Sapiens; identical to SEQ ID NO: 484982

SEQ ID NO: 739104 - RNA, 62 nt, Homo Sapiens
acacucucaaaugauucacauguucagccaaaguugagaaccaucgagccuguggaaguucu

SEQ ID NO: 739105 - RNA, 62 nt, Homo Sapiens
uauucacacucagggucaugcacuugcacaauguugagaaugaguaccacucucaccauugg

SEQ ID NO: 739106 - RNA, 62 nt, Homo Sapiens
agaacaguaucuugguuaauugcuacugaaagguugagaaaggaaugguuugauauuuacca

SEQ ID NO: 739107 - RNA, 62 nt, Homo Sapiens
uccugcugccaguucuuuccucuuuaggcgugguugagaaaaagcagaaacuuuacauaaag

SEQ ID NO: 739108 - RNA, 62 nt, Homo Sapiens
acacggggugaaaccugggucagcaucccuagguugagaagggaugcauuuuucugcuacua

SEQ ID NO: 739109 - RNA, 62 nt, Homo Sapiens
ugagagauugguaacacugagcaaauaaauauguugagaaugaugacagcaagauuucucca

SEQ ID NO: 739110 - RNA, 62 nt, Homo Sapiens
ucucucgugucacauacugcccucauaaaagaguugagaacaguuaucaaaagugacuuuga

SEQ ID NO: 739111 - RNA, 62 nt, Homo Sapiens
caagagucucugucaacucuaccaugucuggcguugagaagcagaacaaggaaagcucucca

SEQ ID NO: 739112 - RNA, 62 nt, Homo Sapiens
acugcacuagaucacuuuguauacacacuaaaguugagaaucccacaauccaagugauucug

SEQ ID NO: 739113 - RNA, 62 nt, Homo Sapiens
ccuguccuagccuaacugugauuaguccugagguugagaaacauuuuccaacccaaaauauc

SEQ ID NO: 739114 - RNA, 62 nt, Homo Sapiens
uuuuuuugcaauaacaaggugaaaucaauauuguugagaagauucuuccaucugguaauguu

SEQ ID NO: 739115 - RNA, 62 nt, Homo Sapiens
auauuguugagaagauucuuccaucugguaauguugagaagacuucauuugguaggaguccc

SEQ ID NO: 739116 - RNA, 62 nt, Homo Sapiens
gacagcuguaacuuugaauuaaggccugaaggguugagaacagaaugggaacucuagguccc

SEQ ID NO: 739117 - RNA, 62 nt, Homo Sapiens
acuacuaucauucacuagcuguugagaucuuuguugagaaccugccugucuucuugagacuc

SEQ ID NO: 739118 - RNA, 62 nt, Homo Sapiens
uuuacacacacuaagauaaaguccuugucuagguugagaacuauuggaaaauucuaaaauuu

SEQ ID NO: 739119 - RNA, 62 nt, Homo Sapiens
aauugauggcgagaguuugcauacuaaauguaguugagaaauaaaaucuaaaacugcgaaga

SEQ ID NO: 739120 - RNA, 62 nt, Homo Sapiens
ucuaucuguaguauuacauauaggcagcaaauguugagaaagcuggcugcagauccuuagca

SEQ ID NO: 739121 - RNA, 62 nt, Homo Sapiens
gguagguacugcuucugagauugccaucugcuguugagaauuugucguuaacuuguacaaca

SEQ ID NO: 739122 - RNA, 62 nt, Homo Sapiens
gaucaguccacccagaguuacugcccugggcuguugagaagaaggugaaugagggaccagcc

SEQ ID NO: 739123 - RNA, 62 nt, Homo Sapiens
aagagaaauuguccaaagagggagauugaaggguugagaagaggggguagggggguggauua

SEQ ID NO: 739124 - RNA, 62 nt, Homo Sapiens
ggaaaaaaacccagguucuaguucccaacuauguugagaaguguggguauuaauguuuccau

SEQ ID NO: 739125 - RNA, 62 nt, Homo Sapiens
uuuuuaauuguaaaaugagaaguugcuaaaguguugagaaccuaaaccuucauauucuguau

SEQ ID NO: 739126 - RNA, 64 nt, Homo Sapiens; identical to SEQ ID NO: 484977

SEQ ID NO: 739127 - RNA, 64 nt, Homo Sapiens; identical to SEQ ID NO: 484978

SEQ ID NO: 739128 - RNA, 64 nt, Homo Sapiens; identical to SEQ ID NO: 484979

SEQ ID NO: 739129 - RNA, 64 nt, Homo Sapiens; identical to SEQ ID NO: 484980

SEQ ID NO: 739130 - RNA, 64 nt, Homo Sapiens; identical to SEQ ID NO: 484981

SEQ ID NO: 739131 - RNA, 64 nt, Homo Sapiens; identical to SEQ ID NO: 484982

SEQ ID NO: 739132 - RNA, 62 nt, Homo Sapiens; identical to SEQ ID NO: 739104

SEQ ID NO: 739133 - RNA, 62 nt, Homo Sapiens; identical to SEQ ID NO: 739105

SEQ ID NO: 739134 - RNA, 62 nt, Homo Sapiens; identical to SEQ ID NO: 739106

SEQ ID NO: 739135 - RNA, 62 nt, Homo Sapiens; identical to SEQ ID NO: 739107

SEQ ID NO: 739136 - RNA, 62 nt, Homo Sapiens; identical to SEQ ID NO: 739108

SEQ ID NO: 739137 - RNA, 62 nt, Homo Sapiens; identical to SEQ ID NO: 739109

SEQ ID NO: 739138 - RNA, 62 nt, Homo Sapiens; identical to SEQ ID NO: 739110

SEQ ID NO: 739139 - RNA, 62 nt, Homo Sapiens; identical to SEQ ID NO: 739111

SEQ ID NO: 739140 - RNA, 62 nt, Homo Sapiens; identical to SEQ ID NO: 739112

SEQ ID NO: 739141 - RNA, 62 nt, Homo Sapiens; identical to SEQ ID NO: 739113

SEQ ID NO: 739142 - RNA, 62 nt, Homo Sapiens; identical to SEQ ID NO: 739114

SEQ ID NO: 739143 - RNA, 62 nt, Homo Sapiens; identical to SEQ ID NO: 739115

SEQ ID NO: 739144 - RNA, 62 nt, Homo Sapiens; identical to SEQ ID NO: 739116

SEQ ID NO: 739145 - RNA, 62 nt, Homo Sapiens; identical to SEQ ID NO: 739117

SEQ ID NO: 739146 - RNA, 62 nt, Homo Sapiens; identical to SEQ ID NO: 739118

SEQ ID NO: 739147 - RNA, 62 nt, Homo Sapiens; identical to SEQ ID NO: 739119

SEQ ID NO: 739148 - RNA, 62 nt, Homo Sapiens; identical to SEQ ID NO: 739120

SEQ ID NO: 739149 - RNA, 62 nt, Homo Sapiens; identical to SEQ ID NO: 739121

SEQ ID NO: 739150 - RNA, 62 nt, Homo Sapiens; identical to SEQ ID NO: 739122

SEQ ID NO: 739151 - RNA, 62 nt, Homo Sapiens; identical to SEQ ID NO: 739123

SEQ ID NO: 739152 - RNA, 62 nt, Homo Sapiens; identical to SEQ ID NO: 739124

SEQ ID NO: 739153 - RNA, 62 nt, Homo Sapiens; identical to SEQ ID NO: 739125

SEQ ID NO: 739154 - RNA, 55 nt, Homo Sapiens; identical to SEQ ID NO: 194635

SEQ ID NO: 739155 - RNA, 64 nt, Homo Sapiens; identical to SEQ ID NO: 417042

SEQ ID NO: 739156 - RNA, 64 nt, Homo Sapiens; identical to SEQ ID NO: 417043

SEQ ID NO: 739157 - RNA, 64 nt, Homo Sapiens; identical to SEQ ID NO: 417044

SEQ ID NO: 739158 - RNA, 64 nt, Homo Sapiens; identical to SEQ ID NO: 417045

SEQ ID NO: 739159 - RNA, 64 nt, Homo Sapiens; identical to SEQ ID NO: 417046

SEQ ID NO: 739160 - RNA, 64 nt, Homo Sapiens; identical to SEQ ID NO: 417047

SEQ ID NO: 739161 - RNA, 64 nt, Homo Sapiens; identical to SEQ ID NO: 417048

SEQ ID NO: 739162 - RNA, 64 nt, Homo Sapiens; identical to SEQ ID NO: 417049

SEQ ID NO: 739163 - RNA, 64 nt, Homo Sapiens; identical to SEQ ID NO: 417050

SEQ ID NO: 739164 - RNA, 64 nt, Homo Sapiens; identical to SEQ ID NO: 417051

SEQ ID NO: 739165 - RNA, 64 nt, Homo Sapiens; identical to SEQ ID NO: 417052

SEQ ID NO: 739166 - RNA, 64 nt, Homo Sapiens; identical to SEQ ID NO: 417053

SEQ ID NO: 739167 - RNA, 64 nt, Homo Sapiens; identical to SEQ ID NO: 417054

SEQ ID NO: 739168 - RNA, 64 nt, Homo Sapiens; identical to SEQ ID NO: 417055

SEQ ID NO: 739169 - RNA, 64 nt, Homo Sapiens; identical to SEQ ID NO: 417056

SEQ ID NO: 739170 - RNA, 64 nt, Homo Sapiens; identical to SEQ ID NO: 417057

SEQ ID NO: 739171 - RNA, 64 nt, Homo Sapiens; identical to SEQ ID NO: 417058

SEQ ID NO: 739172 - RNA, 64 nt, Homo Sapiens; identical to SEQ ID NO: 417059

SEQ ID NO: 739173 - RNA, 64 nt, Homo Sapiens; identical to SEQ ID NO: 417060

SEQ ID NO: 739174 - RNA, 64 nt, Homo Sapiens; identical to SEQ ID NO: 417061

SEQ ID NO: 739175 - RNA, 64 nt, Homo Sapiens; identical to SEQ ID NO: 417062

SEQ ID NO: 739176 - RNA, 64 nt, Homo Sapiens; identical to SEQ ID NO: 417063

SEQ ID NO: 739177 - RNA, 64 nt, Homo Sapiens; identical to SEQ ID NO: 417064

SEQ ID NO: 739178 - RNA, 64 nt, Homo Sapiens; identical to SEQ ID NO: 417065

SEQ ID NO: 739179 - RNA, 64 nt, Homo Sapiens; identical to SEQ ID NO: 417066

SEQ ID NO: 739180 - RNA, 64 nt, Homo Sapiens; identical to SEQ ID NO: 417067

SEQ ID NO: 739181 - RNA, 64 nt, Homo Sapiens; identical to SEQ ID NO: 417068

SEQ ID NO: 739182 - RNA, 64 nt, Homo Sapiens; identical to SEQ ID NO: 417069

SEQ ID NO: 739183 - RNA, 64 nt, Homo Sapiens; identical to SEQ ID NO: 417070

SEQ ID NO: 739184 - RNA, 64 nt, Homo Sapiens; identical to SEQ ID NO: 417071

SEQ ID NO: 739185 - RNA, 64 nt, Homo Sapiens; identical to SEQ ID NO: 417072

SEQ ID NO: 739186 - RNA, 64 nt, Homo Sapiens; identical to SEQ ID NO: 417073

SEQ ID NO: 739187 - RNA, 64 nt, Homo Sapiens; identical to SEQ ID NO: 417074

SEQ ID NO: 739188 - RNA, 64 nt, Homo Sapiens; identical to SEQ ID NO: 417075

SEQ ID NO: 739189 - RNA, 64 nt, Homo Sapiens; identical to SEQ ID NO: 417076

SEQ ID NO: 739190 - RNA, 64 nt, Homo Sapiens; identical to SEQ ID NO: 417077

SEQ ID NO: 739191 - RNA, 64 nt, Homo Sapiens; identical to SEQ ID NO: 417078

SEQ ID NO: 739192 - RNA, 64 nt, Homo Sapiens; identical to SEQ ID NO: 417079

SEQ ID NO: 739193 - RNA, 64 nt, Homo Sapiens; identical to SEQ ID NO: 417080

SEQ ID NO: 739194 - RNA, 64 nt, Homo Sapiens; identical to SEQ ID NO: 417081

SEQ ID NO: 739195 - RNA, 64 nt, Homo Sapiens; identical to SEQ ID NO: 124124

SEQ ID NO: 739196 - RNA, 64 nt, Homo Sapiens; identical to SEQ ID NO: 124125

SEQ ID NO: 739197 - RNA, 64 nt, Homo Sapiens; identical to SEQ ID NO: 124126

SEQ ID NO: 739198 - RNA, 64 nt, Homo Sapiens; identical to SEQ ID NO: 124127

SEQ ID NO: 739199 - RNA, 64 nt, Homo Sapiens; identical to SEQ ID NO: 124128

SEQ ID NO: 739200 - RNA, 64 nt, Homo Sapiens; identical to SEQ ID NO: 124129

SEQ ID NO: 739201 - RNA, 64 nt, Homo Sapiens; identical to SEQ ID NO: 124130

SEQ ID NO: 739202 - RNA, 64 nt, Homo Sapiens; identical to SEQ ID NO: 124131

SEQ ID NO: 739203 - RNA, 64 nt, Homo Sapiens; identical to SEQ ID NO: 124132

SEQ ID NO: 739204 - RNA, 64 nt, Homo Sapiens; identical to SEQ ID NO: 124133

SEQ ID NO: 739205 - RNA, 64 nt, Homo Sapiens; identical to SEQ ID NO: 124134

SEQ ID NO: 739206 - RNA, 64 nt, Homo Sapiens; identical to SEQ ID NO: 124135

SEQ ID NO: 739207 - RNA, 64 nt, Homo Sapiens; identical to SEQ ID NO: 124136

SEQ ID NO: 739208 - RNA, 64 nt, Homo Sapiens; identical to SEQ ID NO: 124137

SEQ ID NO: 739209 - RNA, 64 nt, Homo Sapiens; identical to SEQ ID NO: 124138

SEQ ID NO: 739210 - RNA, 64 nt, Homo Sapiens; identical to SEQ ID NO: 124139

SEQ ID NO: 739211 - RNA, 64 nt, Homo Sapiens; identical to SEQ ID NO: 124140

SEQ ID NO: 739212 - RNA, 64 nt, Homo Sapiens; identical to SEQ ID NO: 124141

SEQ ID NO: 739213 - RNA, 64 nt, Homo Sapiens; identical to SEQ ID NO: 124142

SEQ ID NO: 739214 - RNA, 64 nt, Homo Sapiens; identical to SEQ ID NO: 124143

SEQ ID NO: 739215 - RNA, 64 nt, Homo Sapiens; identical to SEQ ID NO: 124144

SEQ ID NO: 739216 - RNA, 61 nt, Homo Sapiens; identical to SEQ ID NO: 124145

SEQ ID NO: 739217 - RNA, 64 nt, Homo Sapiens; identical to SEQ ID NO: 124146

SEQ ID NO: 739218 - RNA, 64 nt, Homo Sapiens; identical to SEQ ID NO: 124147

SEQ ID NO: 739219 - RNA, 64 nt, Homo Sapiens
uggcccuguuaagacggcuugcccaaaaacuaccucaagagaccgucgauguaauuaacugaug

SEQ ID NO: 739220 - RNA, 64 nt, Homo Sapiens
ugacugccgccaacucacuauauggggaaaagaaucaagagacccugagaaguugggcugagag

SEQ ID NO: 739221 - RNA, 64 nt, Homo Sapiens
ggccaaagauuuguacuuuugacauacgaaaaugucaagagaaaaugaagguuuuuugcuuuuu

SEQ ID NO: 739222 - RNA, 64 nt, Homo Sapiens
cagucauucacgaugguuuuuuuaaaaauuuacaucaagagagguaugauacuguaauaauauu

SEQ ID NO: 739223 - RNA, 64 nt, Homo Sapiens
gaucucagcucacugcaaccucugccuccugggcucaagagaccagcccaccuccgccuccaag

SEQ ID NO: 739224 - RNA, 64 nt, Homo Sapiens
ccauauuucuuaggcuggccuuuaacuucugagcucaagagaugcacuccccucagccucccaa

SEQ ID NO: 739225 - RNA, 64 nt, Homo Sapiens
guagccuuauccugguuuuacagaugugaaacuuucaagagauuuacugacuuuccuagaauag

SEQ ID NO: 739226 - RNA, 64 nt, Homo Sapiens
auuccauguaagcauuaaacaguguauguagguuucaagagauugugaugauucuuaaauuuua

SEQ ID NO: 739227 - RNA, 64 nt, Homo Sapiens
cuggaaauacuuuuuaauuuuuuuaacuuaaaauucaagagacugaaucacuuuucucauugau

SEQ ID NO: 739228 - RNA, 64 nt, Homo Sapiens
aauauaugcugugccuguacuuauauacagucuuucaagagagauacaaacaaggcagaaacau

SEQ ID NO: 739229 - RNA, 64 nt, Homo Sapiens
cacuuuggggagcugaggcgggcggaucacgaggucaagagaucgagaccauccuggccaacau

SEQ ID NO: 739230 - RNA, 64 nt, Homo Sapiens
caauauuaaaaaacaauuugcaagaaaauguguuucaagagagcaaccuaagcuaagucacucu

SEQ ID NO: 739231 - RNA, 64 nt, Homo Sapiens
augccuauaaguagcaggccuuugugccucagugucaagagaaaucaagagaugcuaaaagcuu

SEQ ID NO: 739232 - RNA, 64 nt, Homo Sapiens
guagcaggccuuugugccucagugucaagagaaaucaagagaugcuaaaagcuuuacaauggaa

SEQ ID NO: 739233 - RNA, 64 nt, Homo Sapiens
acauaauaucugccuuuuauugccuaaggcugguucaagagacccuccugauccucaaccucca

SEQ ID NO: 739234 - RNA, 64 nt, Homo Sapiens
cacggcuccugccuucaugguacucacacauagaucaagagagagucaugugaaaaauauugau

SEQ ID NO: 739235 - RNA, 64 nt, Homo Sapiens
ucugucuggugagcucugcuuuuucagugcaccaucaagagaugcagccccguggacaugaaga

SEQ ID NO: 739236 - RNA, 64 nt, Homo Sapiens
aaaaaaucaccuuguguguuguagcucauuuguuucaagagagaaucaacagaucauauucagu

SEQ ID NO: 739237 - RNA, 64 nt, Homo Sapiens; identical to SEQ ID NO: 363444

SEQ ID NO: 739238 - RNA, 64 nt, Homo Sapiens; identical to SEQ ID NO: 363445

SEQ ID NO: 739239 - RNA, 64 nt, Homo Sapiens; identical to SEQ ID NO: 363446

SEQ ID NO: 739240 - RNA, 64 nt, Homo Sapiens; identical to SEQ ID NO: 363447

SEQ ID NO: 739241 - RNA, 64 nt, Homo Sapiens; identical to SEQ ID NO: 363448

SEQ ID NO: 739242 - RNA, 64 nt, Homo Sapiens; identical to SEQ ID NO: 363449

SEQ ID NO: 739243 - RNA, 64 nt, Homo Sapiens; identical to SEQ ID NO: 363450

SEQ ID NO: 739244 - RNA, 64 nt, Homo Sapiens; identical to SEQ ID NO: 363451

SEQ ID NO: 739245 - RNA, 64 nt, Homo Sapiens; identical to SEQ ID NO: 363452

SEQ ID NO: 739246 - RNA, 64 nt, Homo Sapiens; identical to SEQ ID NO: 363453

SEQ ID NO: 739247 - RNA, 64 nt, Homo Sapiens; identical to SEQ ID NO: 363454

SEQ ID NO: 739248 - RNA, 64 nt, Homo Sapiens; identical to SEQ ID NO: 363455

SEQ ID NO: 739249 - RNA, 64 nt, Homo Sapiens; identical to SEQ ID NO: 363456

SEQ ID NO: 739250 - RNA, 64 nt, Homo Sapiens; identical to SEQ ID NO: 363457

SEQ ID NO: 739251 - RNA, 64 nt, Homo Sapiens; identical to SEQ ID NO: 363458

SEQ ID NO: 739252 - RNA, 64 nt, Homo Sapiens; identical to SEQ ID NO: 363459

SEQ ID NO: 739253 - RNA, 64 nt, Homo Sapiens; identical to SEQ ID NO: 363460

SEQ ID NO: 739254 - RNA, 64 nt, Homo Sapiens; identical to SEQ ID NO: 363461

SEQ ID NO: 739255 - RNA, 64 nt, Homo Sapiens; identical to SEQ ID NO: 363462

SEQ ID NO: 739256 - RNA, 64 nt, Homo Sapiens; identical to SEQ ID NO: 363463

SEQ ID NO: 739257 - RNA, 64 nt, Homo Sapiens; identical to SEQ ID NO: 363464

SEQ ID NO: 739258 - RNA, 64 nt, Homo Sapiens; identical to SEQ ID NO: 363465

SEQ ID NO: 739259 - RNA, 64 nt, Homo Sapiens; identical to SEQ ID NO: 363466

SEQ ID NO: 739260 - RNA, 64 nt, Homo Sapiens; identical to SEQ ID NO: 363467

SEQ ID NO: 739261 - RNA, 64 nt, Homo Sapiens; identical to SEQ ID NO: 363468

SEQ ID NO: 739262 - RNA, 64 nt, Homo Sapiens; identical to SEQ ID NO: 363469

SEQ ID NO: 739263 - RNA, 64 nt, Homo Sapiens; identical to SEQ ID NO: 363470

SEQ ID NO: 739264 - RNA, 64 nt, Homo Sapiens; identical to SEQ ID NO: 363471

SEQ ID NO: 739265 - RNA, 64 nt, Homo Sapiens; identical to SEQ ID NO: 363472

SEQ ID NO: 739266 - RNA, 64 nt, Homo Sapiens; identical to SEQ ID NO: 363473

SEQ ID NO: 739267 - RNA, 56 nt, Homo Sapiens; identical to SEQ ID NO: 363474

SEQ ID NO: 739268 - RNA, 64 nt, Homo Sapiens; identical to SEQ ID NO: 363475

SEQ ID NO: 739269 - RNA, 64 nt, Homo Sapiens; identical to SEQ ID NO: 363476

SEQ ID NO: 739270 - RNA, 64 nt, Homo Sapiens; identical to SEQ ID NO: 363477

SEQ ID NO: 739271 - RNA, 64 nt, Homo Sapiens; identical to SEQ ID NO: 363478

SEQ ID NO: 739272 - RNA, 64 nt, Homo Sapiens; identical to SEQ ID NO: 363479

SEQ ID NO: 739273 - RNA, 64 nt, Homo Sapiens; identical to SEQ ID NO: 363480

SEQ ID NO: 739274 - RNA, 64 nt, Homo Sapiens; identical to SEQ ID NO: 363481

SEQ ID NO: 739275 - RNA, 64 nt, Homo Sapiens; identical to SEQ ID NO: 363482

SEQ ID NO: 739276 - RNA, 64 nt, Homo Sapiens; identical to SEQ ID NO: 363483

SEQ ID NO: 739277 - RNA, 64 nt, Homo Sapiens; identical to SEQ ID NO: 363484

SEQ ID NO: 739278 - RNA, 64 nt, Homo Sapiens; identical to SEQ ID NO: 363485

SEQ ID NO: 739279 - RNA, 64 nt, Homo Sapiens; identical to SEQ ID NO: 363486

SEQ ID NO: 739280 - RNA, 64 nt, Homo Sapiens; identical to SEQ ID NO: 363487

SEQ ID NO: 739281 - RNA, 64 nt, Homo Sapiens; identical to SEQ ID NO: 363488

SEQ ID NO: 739282 - RNA, 64 nt, Homo Sapiens; identical to SEQ ID NO: 363489

SEQ ID NO: 739283 - RNA, 64 nt, Homo Sapiens; identical to SEQ ID NO: 363490

SEQ ID NO: 739284 - RNA, 64 nt, Homo Sapiens; identical to SEQ ID NO: 363491

SEQ ID NO: 739285 - RNA, 64 nt, Homo Sapiens; identical to SEQ ID NO: 363492

SEQ ID NO: 739286 - RNA, 64 nt, Homo Sapiens; identical to SEQ ID NO: 363493

SEQ ID NO: 739287 - RNA, 64 nt, Homo Sapiens; identical to SEQ ID NO: 363494

SEQ ID NO: 739288 - RNA, 64 nt, Homo Sapiens; identical to SEQ ID NO: 363495

SEQ ID NO: 739289 - RNA, 64 nt, Homo Sapiens; identical to SEQ ID NO: 363496

SEQ ID NO: 739290 - RNA, 64 nt, Homo Sapiens; identical to SEQ ID NO: 363497

SEQ ID NO: 739291 - RNA, 64 nt, Homo Sapiens; identical to SEQ ID NO: 363498

SEQ ID NO: 739292 - RNA, 64 nt, Homo Sapiens; identical to SEQ ID NO: 363499

SEQ ID NO: 739293 - RNA, 64 nt, Homo Sapiens; identical to SEQ ID NO: 363500

SEQ ID NO: 739294 - RNA, 64 nt, Homo Sapiens; identical to SEQ ID NO: 363501

SEQ ID NO: 739295 - RNA, 64 nt, Homo Sapiens; identical to SEQ ID NO: 363502

SEQ ID NO: 739296 - RNA, 64 nt, Homo Sapiens; identical to SEQ ID NO: 363503

SEQ ID NO: 739297 - RNA, 64 nt, Homo Sapiens; identical to SEQ ID NO: 363504

SEQ ID NO: 739298 - RNA, 64 nt, Homo Sapiens; identical to SEQ ID NO: 363505

SEQ ID NO: 739299 - RNA, 64 nt, Homo Sapiens; identical to SEQ ID NO: 363506

SEQ ID NO: 739300 - RNA, 64 nt, Homo Sapiens; identical to SEQ ID NO: 363507

SEQ ID NO: 739301 - RNA, 64 nt, Homo Sapiens; identical to SEQ ID NO: 363508

SEQ ID NO: 739302 - RNA, 64 nt, Homo Sapiens; identical to SEQ ID NO: 363509

SEQ ID NO: 739303 - RNA, 64 nt, Homo Sapiens; identical to SEQ ID NO: 363510

SEQ ID NO: 739304 - RNA, 63 nt, Homo Sapiens; identical to SEQ ID NO: 363511

SEQ ID NO: 739305 - RNA, 64 nt, Homo Sapiens; identical to SEQ ID NO: 363512

SEQ ID NO: 739306 - RNA, 64 nt, Homo Sapiens; identical to SEQ ID NO: 363513

SEQ ID NO: 739307 - RNA, 64 nt, Homo Sapiens; identical to SEQ ID NO: 363514

SEQ ID NO: 739308 - RNA, 64 nt, Homo Sapiens; identical to SEQ ID NO: 363515

SEQ ID NO: 739309 - RNA, 64 nt, Homo Sapiens; identical to SEQ ID NO: 363516

SEQ ID NO: 739310 - RNA, 64 nt, Homo Sapiens; identical to SEQ ID NO: 363517

SEQ ID NO: 739311 - RNA, 64 nt, Homo Sapiens; identical to SEQ ID NO: 363518

SEQ ID NO: 739312 - RNA, 64 nt, Homo Sapiens; identical to SEQ ID NO: 363519

SEQ ID NO: 739313 - RNA, 64 nt, Homo Sapiens; identical to SEQ ID NO: 272964

SEQ ID NO: 739314 - RNA, 64 nt, Homo Sapiens; identical to SEQ ID NO: 272965

SEQ ID NO: 739315 - RNA, 64 nt, Homo Sapiens; identical to SEQ ID NO: 272966

SEQ ID NO: 739316 - RNA, 64 nt, Homo Sapiens; identical to SEQ ID NO: 272967

SEQ ID NO: 739317 - RNA, 64 nt, Homo Sapiens; identical to SEQ ID NO: 272968

SEQ ID NO: 739318 - RNA, 64 nt, Homo Sapiens; identical to SEQ ID NO: 272969

SEQ ID NO: 739319 - RNA, 64 nt, Homo Sapiens; identical to SEQ ID NO: 272970

SEQ ID NO: 739320 - RNA, 64 nt, Homo Sapiens; identical to SEQ ID NO: 272971

SEQ ID NO: 739321 - RNA, 64 nt, Homo Sapiens; identical to SEQ ID NO: 272972

SEQ ID NO: 739322 - RNA, 64 nt, Homo Sapiens; identical to SEQ ID NO: 272973

SEQ ID NO: 739323 - RNA, 64 nt, Homo Sapiens; identical to SEQ ID NO: 272974

SEQ ID NO: 739324 - RNA, 64 nt, Homo Sapiens; identical to SEQ ID NO: 272975

SEQ ID NO: 739325 - RNA, 64 nt, Homo Sapiens; identical to SEQ ID NO: 272976

SEQ ID NO: 739326 - RNA, 64 nt, Homo Sapiens; identical to SEQ ID NO: 272977

SEQ ID NO: 739327 - RNA, 64 nt, Homo Sapiens; identical to SEQ ID NO: 272978

SEQ ID NO: 739328 - RNA, 64 nt, Homo Sapiens; identical to SEQ ID NO: 272979

SEQ ID NO: 739329 - RNA, 64 nt, Homo Sapiens; identical to SEQ ID NO: 272980

SEQ ID NO: 739330 - RNA, 64 nt, Homo Sapiens; identical to SEQ ID NO: 272981

SEQ ID NO: 739331 - RNA, 64 nt, Homo Sapiens; identical to SEQ ID NO: 272982

SEQ ID NO: 739332 - RNA, 64 nt, Homo Sapiens; identical to SEQ ID NO: 272983

SEQ ID NO: 739333 - RNA, 64 nt, Homo Sapiens; identical to SEQ ID NO: 272984

SEQ ID NO: 739334 - RNA, 64 nt, Homo Sapiens; identical to SEQ ID NO: 272985

SEQ ID NO: 739335 - RNA, 64 nt, Homo Sapiens; identical to SEQ ID NO: 272986

SEQ ID NO: 739336 - RNA, 64 nt, Homo Sapiens; identical to SEQ ID NO: 272987

SEQ ID NO: 739337 - RNA, 64 nt, Homo Sapiens; identical to SEQ ID NO: 272988

SEQ ID NO: 739338 - RNA, 64 nt, Homo Sapiens; identical to SEQ ID NO: 272989

SEQ ID NO: 739339 - RNA, 64 nt, Homo Sapiens; identical to SEQ ID NO: 272990

SEQ ID NO: 739340 - RNA, 64 nt, Homo Sapiens; identical to SEQ ID NO: 272991

SEQ ID NO: 739341 - RNA, 64 nt, Homo Sapiens; identical to SEQ ID NO: 272992

SEQ ID NO: 739342 - RNA, 64 nt, Homo Sapiens; identical to SEQ ID NO: 272993

SEQ ID NO: 739343 - RNA, 64 nt, Homo Sapiens; identical to SEQ ID NO: 272994

SEQ ID NO: 739344 - RNA, 64 nt, Homo Sapiens; identical to SEQ ID NO: 272995

SEQ ID NO: 739345 - RNA, 64 nt, Homo Sapiens; identical to SEQ ID NO: 272996

SEQ ID NO: 739346 - RNA, 64 nt, Homo Sapiens; identical to SEQ ID NO: 272997

SEQ ID NO: 739347 - RNA, 64 nt, Homo Sapiens; identical to SEQ ID NO: 272998

SEQ ID NO: 739348 - RNA, 64 nt, Homo Sapiens; identical to SEQ ID NO: 272999

SEQ ID NO: 739349 - RNA, 64 nt, Homo Sapiens; identical to SEQ ID NO: 273000

SEQ ID NO: 739350 - RNA, 64 nt, Homo Sapiens; identical to SEQ ID NO: 273001

SEQ ID NO: 739351 - RNA, 64 nt, Homo Sapiens; identical to SEQ ID NO: 581471

SEQ ID NO: 739352 - RNA, 64 nt, Homo Sapiens; identical to SEQ ID NO: 581472

SEQ ID NO: 739353 - RNA, 64 nt, Homo Sapiens; identical to SEQ ID NO: 581473

SEQ ID NO: 739354 - RNA, 64 nt, Homo Sapiens; identical to SEQ ID NO: 581474

SEQ ID NO: 739355 - RNA, 64 nt, Homo Sapiens; identical to SEQ ID NO: 581475

SEQ ID NO: 739356 - RNA, 64 nt, Homo Sapiens; identical to SEQ ID NO: 581476

SEQ ID NO: 739357 - RNA, 64 nt, Homo Sapiens; identical to SEQ ID NO: 581477

SEQ ID NO: 739358 - RNA, 64 nt, Homo Sapiens; identical to SEQ ID NO: 581478

SEQ ID NO: 739359 - RNA, 64 nt, Homo Sapiens; identical to SEQ ID NO: 581479

SEQ ID NO: 739360 - RNA, 64 nt, Homo Sapiens; identical to SEQ ID NO: 581480

SEQ ID NO: 739361 - RNA, 64 nt, Homo Sapiens; identical to SEQ ID NO: 581481

SEQ ID NO: 739362 - RNA, 64 nt, Homo Sapiens; identical to SEQ ID NO: 581482

SEQ ID NO: 739363 - RNA, 64 nt, Homo Sapiens; identical to SEQ ID NO: 581483

SEQ ID NO: 739364 - RNA, 64 nt, Homo Sapiens; identical to SEQ ID NO: 581484

SEQ ID NO: 739365 - RNA, 64 nt, Homo Sapiens; identical to SEQ ID NO: 581485

SEQ ID NO: 739366 - RNA, 64 nt, Homo Sapiens; identical to SEQ ID NO: 581486

SEQ ID NO: 739367 - RNA, 64 nt, Homo Sapiens; identical to SEQ ID NO: 581487

SEQ ID NO: 739368 - RNA, 64 nt, Homo Sapiens; identical to SEQ ID NO: 581488

SEQ ID NO: 739369 - RNA, 64 nt, Homo Sapiens; identical to SEQ ID NO: 581489

SEQ ID NO: 739370 - RNA, 64 nt, Homo Sapiens; identical to SEQ ID NO: 581490

SEQ ID NO: 739371 - RNA, 64 nt, Homo Sapiens; identical to SEQ ID NO: 581491

SEQ ID NO: 739372 - RNA, 64 nt, Homo Sapiens; identical to SEQ ID NO: 581492

SEQ ID NO: 739373 - RNA, 64 nt, Homo Sapiens; identical to SEQ ID NO: 581493

SEQ ID NO: 739374 - RNA, 64 nt, Homo Sapiens; identical to SEQ ID NO: 581494

SEQ ID NO: 739375 - RNA, 64 nt, Homo Sapiens; identical to SEQ ID NO: 581495

SEQ ID NO: 739376 - RNA, 64 nt, Homo Sapiens; identical to SEQ ID NO: 581496

SEQ ID NO: 739377 - RNA, 64 nt, Homo Sapiens; identical to SEQ ID NO: 581497

SEQ ID NO: 739378 - RNA, 64 nt, Homo Sapiens; identical to SEQ ID NO: 581498

SEQ ID NO: 739379 - RNA, 64 nt, Homo Sapiens; identical to SEQ ID NO: 581499

SEQ ID NO: 739380 - RNA, 64 nt, Homo Sapiens; identical to SEQ ID NO: 581500

SEQ ID NO: 739381 - RNA, 64 nt, Homo Sapiens; identical to SEQ ID NO: 581501

SEQ ID NO: 739382 - RNA, 64 nt, Homo Sapiens; identical to SEQ ID NO: 581502

SEQ ID NO: 739383 - RNA, 64 nt, Homo Sapiens; identical to SEQ ID NO: 581503

SEQ ID NO: 739384 - RNA, 64 nt, Homo Sapiens; identical to SEQ ID NO: 581504

SEQ ID NO: 739385 - RNA, 64 nt, Homo Sapiens; identical to SEQ ID NO: 581505

SEQ ID NO: 739386 - RNA, 64 nt, Homo Sapiens; identical to SEQ ID NO: 581506

SEQ ID NO: 739387 - RNA, 64 nt, Homo Sapiens; identical to SEQ ID NO: 581507

SEQ ID NO: 739388 - RNA, 64 nt, Homo Sapiens; identical to SEQ ID NO: 581508

SEQ ID NO: 739389 - RNA, 64 nt, Homo Sapiens; identical to SEQ ID NO: 581509

SEQ ID NO: 739390 - RNA, 64 nt, Homo Sapiens; identical to SEQ ID NO: 581510

SEQ ID NO: 739391 - RNA, 64 nt, Homo Sapiens; identical to SEQ ID NO: 581511

SEQ ID NO: 739392 - RNA, 64 nt, Homo Sapiens; identical to SEQ ID NO: 581512

SEQ ID NO: 739393 - RNA, 64 nt, Homo Sapiens; identical to SEQ ID NO: 581513

SEQ ID NO: 739394 - RNA, 64 nt, Homo Sapiens; identical to SEQ ID NO: 581514

SEQ ID NO: 739395 - RNA, 64 nt, Homo Sapiens; identical to SEQ ID NO: 581515

SEQ ID NO: 739396 - RNA, 64 nt, Homo Sapiens; identical to SEQ ID NO: 581516

SEQ ID NO: 739397 - RNA, 64 nt, Homo Sapiens; identical to SEQ ID NO: 581517

SEQ ID NO: 739398 - RNA, 64 nt, Homo Sapiens; identical to SEQ ID NO: 581518

SEQ ID NO: 739399 - RNA, 64 nt, Homo Sapiens; identical to SEQ ID NO: 581519

SEQ ID NO: 739400 - RNA, 64 nt, Homo Sapiens; identical to SEQ ID NO: 581520

SEQ ID NO: 739401 - RNA, 64 nt, Homo Sapiens; identical to SEQ ID NO: 581521

SEQ ID NO: 739402 - RNA, 64 nt, Homo Sapiens; identical to SEQ ID NO: 581522

SEQ ID NO: 739403 - RNA, 64 nt, Homo Sapiens; identical to SEQ ID NO: 581523

SEQ ID NO: 739404 - RNA, 64 nt, Homo Sapiens; identical to SEQ ID NO: 581524

SEQ ID NO: 739405 - RNA, 64 nt, Homo Sapiens; identical to SEQ ID NO: 581525

SEQ ID NO: 739406 - RNA, 64 nt, Homo Sapiens; identical to SEQ ID NO: 581526

SEQ ID NO: 739407 - RNA, 64 nt, Homo Sapiens; identical to SEQ ID NO: 581527

SEQ ID NO: 739408 - RNA, 64 nt, Homo Sapiens; identical to SEQ ID NO: 581528

SEQ ID NO: 739409 - RNA, 64 nt, Homo Sapiens; identical to SEQ ID NO: 581529

SEQ ID NO: 739410 - RNA, 64 nt, Homo Sapiens; identical to SEQ ID NO: 581530

SEQ ID NO: 739411 - RNA, 64 nt, Homo Sapiens; identical to SEQ ID NO: 581531

SEQ ID NO: 739412 - RNA, 64 nt, Homo Sapiens; identical to SEQ ID NO: 581532

SEQ ID NO: 739413 - RNA, 64 nt, Homo Sapiens; identical to SEQ ID NO: 581533

SEQ ID NO: 739414 - RNA, 64 nt, Homo Sapiens; identical to SEQ ID NO: 581534

SEQ ID NO: 739415 - RNA, 64 nt, Homo Sapiens; identical to SEQ ID NO: 581535

SEQ ID NO: 739416 - RNA, 64 nt, Homo Sapiens; identical to SEQ ID NO: 581536

SEQ ID NO: 739417 - RNA, 64 nt, Homo Sapiens; identical to SEQ ID NO: 581537

SEQ ID NO: 739418 - RNA, 64 nt, Homo Sapiens; identical to SEQ ID NO: 581538

SEQ ID NO: 739419 - RNA, 64 nt, Homo Sapiens
cuuucugcccuccuucccaucccacaugcugagccgccacaaagaccaaagaagugauggcuuu

SEQ ID NO: 739420 - RNA, 64 nt, Homo Sapiens
aucuggggugucuguaaugucaccccuccagcagcgccacaaggacugagguuggguaggugug

SEQ ID NO: 739421 - RNA, 64 nt, Homo Sapiens
cuuaauguguugaaagaaugcuccuacauucauccgccacaaaucccacuggagacuuugaguu

SEQ ID NO: 739422 - RNA, 64 nt, Homo Sapiens
gugcucuugacauccgugacgacugcacgguuuacgccacaaaagaauagaacucguagcucgu

SEQ ID NO: 739423 - RNA, 64 nt, Homo Sapiens
cauaaaauggacaugacuguaaggaagcguucaccgccacaaauguuuaaaaaaauaaaaagga

SEQ ID NO: 739424 - RNA, 64 nt, Homo Sapiens
uugaacaaaauguuuucuguuguuuucucagagccgccacaagaggcaaaauaagauuuaguug

SEQ ID NO: 739425 - RNA, 64 nt, Homo Sapiens
cuugcugugcgucuuccaaacuaaagccugcaagcgccacaauucuaagugccgccuuccauuu

SEQ ID NO: 739426 - RNA, 64 nt, Homo Sapiens
ucaugucccugucucuugcauugcgugccagagacgccacaacuauugcucugucccaggacac

SEQ ID NO: 739427 - RNA, 64 nt, Homo Sapiens
gaacgccuuugaaauggcuuugcuaaaaugcucccgccacaaaguuguaggaaaugggaagagg

SEQ ID NO: 739428 - RNA, 64 nt, Homo Sapiens
auagagaaaauucaggucugagagaaacgugaaacgccacaaaacaaaauuauuaauccucuug

SEQ ID NO: 739429 - RNA, 64 nt, Homo Sapiens
cauuuucccccucacccuaacucucuuauucugccgccacaaugcaagcauaguuugauguuuu

SEQ ID NO: 739430 - RNA, 64 nt, Homo Sapiens
caccccgcuuucguaguuuugccacaacugcccccgccacaaccgucaccgaagguccuacagg

SEQ ID NO: 739431 - RNA, 64 nt, Homo Sapiens
uuacauggaggccagcugguccucucuucuucagcgccacaaaacuggccacggagggcuccug

SEQ ID NO: 739432 - RNA, 64 nt, Homo Sapiens
guaaaaaugauacugaagaggaaaguaauaaauccgccacaacagacaaugaaauaaguaggac

SEQ ID NO: 739433 - RNA, 64 nt, Homo Sapiens
uuccaguacuaacaaagggaauaaaaauaccucacgccacaauccagcauauugauguuuuaag

SEQ ID NO: 739434 - RNA, 64 nt, Homo Sapiens
cauccugcuuucuuuauccucuccgauuggaacgcgccacaaaugaucucugacuucuuauuac

SEQ ID NO: 739435 - RNA, 64 nt, Homo Sapiens
gcuuuucuucuaacuuuucccucuagccucuccucgccacaauuugcugcuuacugcugguguu

SEQ ID NO: 739436 - RNA, 64 nt, Homo Sapiens
acuuguguaaacagcagcagucacguuccucggccgccacaaccaacaccaaagcaggaaaacc

SEQ ID NO: 739437 - RNA, 64 nt, Homo Sapiens
uggcucuuugugagccugugcguggcugcaagcucgccacaacagaggggagcuugguggcccc

SEQ ID NO: 739438 - RNA, 64 nt, Homo Sapiens
ccaugucgcaauaggaagcacccagacauccuaucgccacaaugccgagguaggaaaggccagc

SEQ ID NO: 739439 - RNA, 64 nt, Homo Sapiens
agauuugggggugcuaauccaggacagcauuacacgccacaacuccaguguucccuucuggcug

SEQ ID NO: 739440 - RNA, 64 nt, Homo Sapiens
gguuaccuuugcugcuaaagauccaaucuucuaacgccacaacagcauagcaaauccuaggaua

SEQ ID NO: 739441 - RNA, 64 nt, Homo Sapiens
ccaguguucccuucuggcugaggacagcauuacacgccacaacuagauuugggggugcuaaucc

SEQ ID NO: 739442 - RNA, 64 nt, Homo Sapiens
cugcguguggacccuggcagugcagggguggucccgccacaaccgugggagacagagcuggacc

SEQ ID NO: 739443 - RNA, 64 nt, Homo Sapiens
caagggcgcugucccgcccaaccccgccuuuaaacgccacaaauaaagagcauuguuaccgcca

SEQ ID NO: 739444 - RNA, 64 nt, Homo Sapiens
acucggggccaccuccacuccaugugcccagccccgccacaaccucuccuccagcacauuccag

SEQ ID NO: 739445 - RNA, 64 nt, Homo Sapiens
acacgcauccgcaucggccucccugcccacaaagcgccacaacggugaccagccggagcagccg

SEQ ID NO: 739446 - RNA, 64 nt, Homo Sapiens
cauugacuuuuaguaaauuucuagcguuaugcaucgccacaauccaguuuuagaauauuuccau

SEQ ID NO: 739447 - RNA, 64 nt, Homo Sapiens
gccugcuuuuaggagaccgaccagagcaucaggccgccacaaguaucaggaaggcuagaguuac

SEQ ID NO: 739448 - RNA, 64 nt, Homo Sapiens
ccagggcucacgugggaaccccccucccacccaccgccacaauaaagaucgcccccaccuccac

SEQ ID NO: 739449 - RNA, 64 nt, Homo Sapiens
caggccaacauucagauucaggaaauacagagaacgccacaaagauacuccuugagaagagcaa

SEQ ID NO: 739450 - RNA, 64 nt, Homo Sapiens
gugagucuucaucuuagggcaucgcuccuccucacgccacaaaucuggugccucucucuugcuu

SEQ ID NO: 739451 - RNA, 64 nt, Homo Sapiens
aagcacaaccagcucgcccuuggggggcccccuccgccacaaggcccgcgacccacccgcggag

SEQ ID NO: 739452 - RNA, 64 nt, Homo Sapiens
ucuaucggagaacaugaaucauucaccagcccaucgccacaaacggcuuuucccaucagcgugc

SEQ ID NO: 739453 - RNA, 64 nt, Homo Sapiens
cagacagaaccaucugaggcucaccuuuggguuuugugacaagaaggggacguguuggguuuuu

SEQ ID NO: 739454 - RNA, 64 nt, Homo Sapiens
ggauccuuguaccugguuuggguuuucccuuccuugugacaauuauaauccagaugccucuucu

SEQ ID NO: 739455 - RNA, 64 nt, Homo Sapiens
gcgaaagucaaguaucugaggccacuugcaacauugugacaaagaagauggaagauagcagccu

SEQ ID NO: 739456 - RNA, 64 nt, Homo Sapiens
uuaaagcugacuuuucuugccagaaaguuuuccuugugacaagaaauuugcaagcuuuucaauc

SEQ ID NO: 739457 - RNA, 64 nt, Homo Sapiens
uuauuuauuaccuuuccauuuguucgccugaugaugugacaaugcauggucuuugugcaugcug

SEQ ID NO: 739458 - RNA, 64 nt, Homo Sapiens
auguacuucuggcaauucuaucuguauuuaaagaugugacaaucuugacaccaauuuuaagaau

SEQ ID NO: 739459 - RNA, 64 nt, Homo Sapiens
uugauuucccucauuguguaaacauugacagguaugugacaaaugggaaaaaaaauccaaauaa

SEQ ID NO: 739460 - RNA, 64 nt, Homo Sapiens
cauccuagauauaaaaccauagaaauguaaaagaugugacaaaaccuuuaagccauacuccagg

SEQ ID NO: 739461 - RNA, 64 nt, Homo Sapiens
auucacacugaagagaaacugcaaacguggaaagugugacaaagcuugcaaccacacucaaucu

SEQ ID NO: 739462 - RNA, 64 nt, Homo Sapiens
aacuacuugauauugaaaucuuuuuaggcacauuugugacaaacuacaaagaucuuuaaaguua

SEQ ID NO: 739463 - RNA, 64 nt, Homo Sapiens
gagagccugcccaaggacugggaaaaugcuguugugugacaaugauaaaaugacggaccuguua

SEQ ID NO: 739464 - RNA, 64 nt, Homo Sapiens
cuaaaaucaaccaggcuacuaagcaugauuuugcugugacaaaucugccaggccucgagcaucc

SEQ ID NO: 739465 - RNA, 64 nt, Homo Sapiens
cuaagaucaaccagguuacucaugaugauuuugcugugacaauuccaggccccaagcaucugag

SEQ ID NO: 739466 - RNA, 64 nt, Homo Sapiens
uuuuuuaaugauuaaaaaaaucaaaauaauauucugugacaaugacaggugaaauuuauaugug

SEQ ID NO: 739467 - RNA, 64 nt, Homo Sapiens
uaauauucugugacaaugacaggugaaauuuauaugugacaagugaaaauuauaugaaauuuaa

SEQ ID NO: 739468 - RNA, 64 nt, Homo Sapiens
aaauauugaaaggagguauaguucauuucaucucugugacaaauuuauagcaaggcacugaauu

SEQ ID NO: 739469 - RNA, 64 nt, Homo Sapiens
aauacacaaacaaaaaaagugacaguuacuuuuuugugacaagagcaauauuggguaugaacug

SEQ ID NO: 739470 - RNA, 64 nt, Homo Sapiens
aauagagaagacuggcucuggcuuauaugaaauaugugacaacaauuuguacuuuaagucaaau

SEQ ID NO: 739471 - RNA, 64 nt, Homo Sapiens
auuugaaaauugugguugcaaauccuggagaaauugugacaacacggaaaaugagaaugagggu

SEQ ID NO: 739472 - RNA, 64 nt, Homo Sapiens
gacagaauaugucugauguuaaugauuauugcuuugugacaauuguaaacgacuuuaaaaaaua

SEQ ID NO: 739473 - RNA, 64 nt, Homo Sapiens
ugaagaagccaaaucuaucagucuaaauacagcaugugacaagccaguguuugcuauucagacu

SEQ ID NO: 739474 - RNA, 64 nt, Homo Sapiens
ucauaccauagagaaauccuacaaauaugaagaaugugacaaagcuuuuaaccacuucucaacc

SEQ ID NO: 739475 - RNA, 64 nt, Homo Sapiens
ucauacaggagagaaacccuacaaaugugaagaaugugacaaagccuuuaaccaguccucaauu

SEQ ID NO: 739476 - RNA, 64 nt, Homo Sapiens
ccuuuaaauggcugucacacagaaaugugaagaaugugacaaagucauaugaaugagaaauccu

SEQ ID NO: 739477 - RNA, 64 nt, Homo Sapiens
cuuuuggcaacaccucagacacaaaccugaaagaugugacaaugauucauacaugagagacucu

SEQ ID NO: 739478 - RNA, 64 nt, Homo Sapiens
gcuucaaccgguccucaaacacaaacgugaagaaugugacaaagucaugcuggagagaaacacu

SEQ ID NO: 739479 - RNA, 64 nt, Homo Sapiens
ccaccaagccuggugucuauggggugacgucccuugugacaacaccugcagggcauuguguccu

SEQ ID NO: 739480 - RNA, 64 nt, Homo Sapiens
gcuacccagggcgccugacaucucggacacaucuugugacaagauugugccaacaucagcauua

SEQ ID NO: 739481 - RNA, 64 nt, Homo Sapiens
uugucagucacaaaucacagacaaaugugaagacugugacaaagucauacugcagagaaaucuu

SEQ ID NO: 739482 - RNA, 64 nt, Homo Sapiens
uuuucgguugcaaaucaaacacaaauaggaagaaugugacaaagucauacugcagagaaacuuu

SEQ ID NO: 739483 - RNA, 64 nt, Homo Sapiens
cuuucgggaaugauucacacagaaauguaagguuugugacaaggucacacuggagaaaagccau

SEQ ID NO: 739484 - RNA, 64 nt, Homo Sapiens
uuuucauucacaaauccagcacaaacgugaacaaugugacaaagucauacugcauagaaaucuu

SEQ ID NO: 739485 - RNA, 64 nt, Homo Sapiens
uuuuugcauauaaugcauauacagagguaagguuugugacaaggucacauugaagagaaaccau

SEQ ID NO: 739486 - RNA, 64 nt, Homo Sapiens
guuuucaguuguaaaucaaaacaaaugggaggaaugugacaaaaucauacuggagagaaaccuu

SEQ ID NO: 739487 - RNA, 64 nt, Homo Sapiens
acuacccuuccaugccccagaccucugucuugcaugugacaauugacaaucuggacuaccccaa

SEQ ID NO: 739488 - RNA, 64 nt, Homo Sapiens
aaagcaaaacaaaauggaaaguaggggagguggaugugacaacaacuuccaaauuggcucuuug

SEQ ID NO: 739489 - RNA, 64 nt, Homo Sapiens; identical to SEQ ID NO: 634929

SEQ ID NO: 739490 - RNA, 64 nt, Homo Sapiens; identical to SEQ ID NO: 634930

SEQ ID NO: 739491 - RNA, 64 nt, Homo Sapiens; identical to SEQ ID NO: 634931

SEQ ID NO: 739492 - RNA, 64 nt, Homo Sapiens; identical to SEQ ID NO: 634932

SEQ ID NO: 739493 - RNA, 64 nt, Homo Sapiens; identical to SEQ ID NO: 634933

SEQ ID NO: 739494 - RNA, 64 nt, Homo Sapiens; identical to SEQ ID NO: 634934

SEQ ID NO: 739495 - RNA, 64 nt, Homo Sapiens; identical to SEQ ID NO: 634935

SEQ ID NO: 739496 - RNA, 64 nt, Homo Sapiens; identical to SEQ ID NO: 634936

SEQ ID NO: 739497 - RNA, 64 nt, Homo Sapiens; identical to SEQ ID NO: 634937

SEQ ID NO: 739498 - RNA, 64 nt, Homo Sapiens; identical to SEQ ID NO: 634938

SEQ ID NO: 739499 - RNA, 64 nt, Homo Sapiens; identical to SEQ ID NO: 634939

SEQ ID NO: 739500 - RNA, 64 nt, Homo Sapiens; identical to SEQ ID NO: 634940

SEQ ID NO: 739501 - RNA, 64 nt, Homo Sapiens; identical to SEQ ID NO: 520126

SEQ ID NO: 739502 - RNA, 64 nt, Homo Sapiens; identical to SEQ ID NO: 520127

SEQ ID NO: 739503 - RNA, 64 nt, Homo Sapiens; identical to SEQ ID NO: 520128

SEQ ID NO: 739504 - RNA, 64 nt, Homo Sapiens; identical to SEQ ID NO: 520129

SEQ ID NO: 739505 - RNA, 64 nt, Homo Sapiens; identical to SEQ ID NO: 520130

SEQ ID NO: 739506 - RNA, 64 nt, Homo Sapiens; identical to SEQ ID NO: 520131

SEQ ID NO: 739507 - RNA, 64 nt, Homo Sapiens
aauaauaauaauaauaauaaaguugcauuauagccaguaguaaaacugcuuauaauaauccagg

SEQ ID NO: 739508 - RNA, 64 nt, Homo Sapiens
uucuauuccuuaccaguaauuccucaggagacuacaguaguauagacaauauuggauguacaau

SEQ ID NO: 739509 - RNA, 64 nt, Homo Sapiens
uuuucucuauuauaaaguauaaccuacauauaagcaguaguacuacaugaugcugauuucuuaa

SEQ ID NO: 739510 - RNA, 64 nt, Homo Sapiens
aaaaacaucaaagaugcagcuauucauugucaugcaguaguagucauuucuuuuuucuaucaga

SEQ ID NO: 739511 - RNA, 64 nt, Homo Sapiens
cauacaaaauaaaaaccugcaacucaacugguaacaguaguaauagugaaucaaugccauuugu

SEQ ID NO: 739512 - RNA, 64 nt, Homo Sapiens
uagagauguguaccugcuuauuauucuuaaaugccaguaguauuuuauuauaaucaucccucua

SEQ ID NO: 739513 - RNA, 64 nt, Homo Sapiens
gucaguauuaauguguagcccuaccaaaaauagccaguaguaucugaaaaugaaaaauaaauga

SEQ ID NO: 739514 - RNA, 64 nt, Homo Sapiens
uuuguuucugauaaaaugaagacuuuaaaucagucaguaguacuuuaccuuucaaggcauuagu

SEQ ID NO: 739515 - RNA, 64 nt, Homo Sapiens
accaucaugccuuuauaaaguucagaaagcaucugcaugugaacugcccccugccccagggcuc

SEQ ID NO: 739516 - RNA, 64 nt, Homo Sapiens
aucugcccagcaaccuguggcaggagaccccaaggcaugugagcuucugugccuuaagcagagu

SEQ ID NO: 739517 - RNA, 64 nt, Homo Sapiens
uauguaaacauaauguuuauuuuaucucacaaaugcaugugaaauguauaauuacaucuuagga

SEQ ID NO: 739518 - RNA, 64 nt, Homo Sapiens
gcuauuaccaacauuuuccugugcauuaaccucugcaugugaaaacuuuuaacaguuacugaac

SEQ ID NO: 739519 - RNA, 64 nt, Homo Sapiens
cauagggucacuagagacccugagaugagacuuggcaugugagacuaacaugagacguggcaug

SEQ ID NO: 739520 - RNA, 64 nt, Homo Sapiens
ugagacuuggcaugugagacuaacaugagacguggcaugugagaucuacagggcaucugacacc

SEQ ID NO: 739521 - RNA, 64 nt, Homo Sapiens
cuagugacgucacagaccugucuuggaacaccuggcaugugaccugguaaaauccucuccagaa

SEQ ID NO: 739522 - RNA, 64 nt, Homo Sapiens
caguaucauccucguuaguacauacauaacugaagcaugugaaaauaggcaucugguguuucag

SEQ ID NO: 739523 - RNA, 64 nt, Homo Sapiens
cgugugcuuuacgaagguggccacucgagcucaugcaugugaaagcacaguuuugaaguucuag

SEQ ID NO: 739524 - RNA, 64 nt, Homo Sapiens
guaaauagaggugaccagagaaggacaggaaggggcaugugagccugcuggugacgugcaggug

SEQ ID NO: 739525 - RNA, 64 nt, Homo Sapiens
uaauuucagggguaggggaguuugucauagagggaaccucuaaaaagcuaaaaaaaagcaaggg

SEQ ID NO: 739526 - RNA, 64 nt, Homo Sapiens
ggcaugcuuagaggucaagguuucugugaauucuaaccucuaaauguuugacaauugaauuugu

SEQ ID NO: 739527 - RNA, 64 nt, Homo Sapiens
uaugaacuuuccacucuaacauuuauggucaguuaaccucuaaacgacuaaccucuaacaagag

SEQ ID NO: 739528 - RNA, 64 nt, Homo Sapiens
aagagauuuauggucaguuaagaaacuaccgacuaaccucuaacaaacuucagcuuaaccaguc

SEQ ID NO: 739529 - RNA, 64 nt, Homo Sapiens; identical to SEQ ID NO: 134242

SEQ ID NO: 739530 - RNA, 64 nt, Homo Sapiens; identical to SEQ ID NO: 134243

SEQ ID NO: 739531 - RNA, 64 nt, Homo Sapiens; identical to SEQ ID NO: 134244

SEQ ID NO: 739532 - RNA, 64 nt, Homo Sapiens; identical to SEQ ID NO: 134245

SEQ ID NO: 739533 - RNA, 52 nt, Homo Sapiens; identical to SEQ ID NO: 134246

SEQ ID NO: 739534 - RNA, 64 nt, Homo Sapiens; identical to SEQ ID NO: 134247

SEQ ID NO: 739535 - RNA, 64 nt, Homo Sapiens; identical to SEQ ID NO: 134248

SEQ ID NO: 739536 - RNA, 64 nt, Homo Sapiens; identical to SEQ ID NO: 134249

SEQ ID NO: 739537 - RNA, 64 nt, Homo Sapiens; identical to SEQ ID NO: 134250

SEQ ID NO: 739538 - RNA, 64 nt, Homo Sapiens; identical to SEQ ID NO: 134251

SEQ ID NO: 739539 - RNA, 64 nt, Homo Sapiens; identical to SEQ ID NO: 134252

SEQ ID NO: 739540 - RNA, 64 nt, Homo Sapiens; identical to SEQ ID NO: 134253

SEQ ID NO: 739541 - RNA, 64 nt, Homo Sapiens; identical to SEQ ID NO: 134254

SEQ ID NO: 739542 - RNA, 64 nt, Homo Sapiens; identical to SEQ ID NO: 134255

SEQ ID NO: 739543 - RNA, 64 nt, Homo Sapiens; identical to SEQ ID NO: 134256

SEQ ID NO: 739544 - RNA, 64 nt, Homo Sapiens; identical to SEQ ID NO: 134257

SEQ ID NO: 739545 - RNA, 64 nt, Homo Sapiens; identical to SEQ ID NO: 134258

SEQ ID NO: 739546 - RNA, 64 nt, Homo Sapiens; identical to SEQ ID NO: 134259

SEQ ID NO: 739547 - RNA, 64 nt, Homo Sapiens; identical to SEQ ID NO: 134260

SEQ ID NO: 739548 - RNA, 64 nt, Homo Sapiens; identical to SEQ ID NO: 134261

SEQ ID NO: 739549 - RNA, 64 nt, Homo Sapiens; identical to SEQ ID NO: 134262

SEQ ID NO: 739550 - RNA, 64 nt, Homo Sapiens; identical to SEQ ID NO: 134263

SEQ ID NO: 739551 - RNA, 64 nt, Homo Sapiens; identical to SEQ ID NO: 134264

SEQ ID NO: 739552 - RNA, 64 nt, Homo Sapiens; identical to SEQ ID NO: 134265

SEQ ID NO: 739553 - RNA, 64 nt, Homo Sapiens; identical to SEQ ID NO: 134266

SEQ ID NO: 739554 - RNA, 64 nt, Homo Sapiens; identical to SEQ ID NO: 134267

SEQ ID NO: 739555 - RNA, 64 nt, Homo Sapiens; identical to SEQ ID NO: 134268

SEQ ID NO: 739556 - RNA, 64 nt, Homo Sapiens; identical to SEQ ID NO: 134269

SEQ ID NO: 739557 - RNA, 64 nt, Homo Sapiens
cgaauuucccauuuggcaaugaugauuuuauaaauugugugaagauuugaguagaaccacugau

SEQ ID NO: 739558 - RNA, 64 nt, Homo Sapiens
uggacggcuuuuugcauauuguagcuccuaacuguugugugauucucccugccagcugcccuau

SEQ ID NO: 739559 - RNA, 64 nt, Homo Sapiens
aaucaagauaacuuuauucaaagagcagcccgcuuugugugacuaaaaugaaacaagacaguug

SEQ ID NO: 739560 - RNA, 64 nt, Homo Sapiens
cuuugugugacuaaaaugaaacaagacaguugaauugugugacuugaagauuaccaaugauuuu

SEQ ID NO: 739561 - RNA, 64 nt, Homo Sapiens
uccuacccugguggauuuuauuccuagauuuggguugugugaaucagauuugggcaucuguuuu

SEQ ID NO: 739562 - RNA, 64 nt, Homo Sapiens
auauucugaauaauugccauucagaaugcuauuuuugugugaaaucaaaauaucauugggccau

SEQ ID NO: 739563 - RNA, 64 nt, Homo Sapiens
cccuucaggcaguccuuuagccucugucccuagauugugugacuuccugccuuccagccccacc

SEQ ID NO: 739564 - RNA, 64 nt, Homo Sapiens
ucgcaguccccuuccccgcuccaugcccuuugcauugugugacagcggcuucggacucagaauu

SEQ ID NO: 739565 - RNA, 64 nt, Homo Sapiens
gcaugguagcuaacgugugugugugugcaacuacuugugugaggugauaaguguaucuguguga

SEQ ID NO: 739566 - RNA, 64 nt, Homo Sapiens
auuccgaguguugcugcaagacauucccugguuuuugugugaucuuaauuuugugugugcacua

SEQ ID NO: 739567 - RNA, 64 nt, Homo Sapiens
auuauaaacuuugcauuguaaaaaggaacacuuuuugugugauuugugaagcuaaaugguggcu

SEQ ID NO: 739568 - RNA, 64 nt, Homo Sapiens
cuaaaugguggcuaaaaggauuuuccagucuucguugugugaagagaucuaaauaaaccacgua

SEQ ID NO: 739569 - RNA, 64 nt, Homo Sapiens
augagaaggaugcuuauuuuucaguauggaccaauugugugaccaggauuguuaccaaauggug

SEQ ID NO: 739570 - RNA, 64 nt, Homo Sapiens
aaggcagcaucuagcagaaauaaugugucagugauugugugaccuuguaaugcaguuuucuuca

SEQ ID NO: 739571 - RNA, 64 nt, Homo Sapiens
gcaucuaugcagacgccaguuuaauauauuuuacuugugugauuuugcauugagcaguggggac

SEQ ID NO: 739572 - RNA, 64 nt, Homo Sapiens
gugucacaaauguaggucuguauuacuuguaugcuugugugacuuacuguuaguccagcucuaa

SEQ ID NO: 739573 - RNA, 64 nt, Homo Sapiens
gauuuaaaguuuguaucuaaauaaugccuaugaguugugugaagcucuuggcuuuuuuccaacg

SEQ ID NO: 739574 - RNA, 64 nt, Homo Sapiens
gaauaaaaauauguuaccugaccacuggucaguuuugugugauacauucauaaauucaagcacu

SEQ ID NO: 739575 - RNA, 64 nt, Homo Sapiens
uuaguauauuuaauuuacuuuuuuauucuaccuguugugugagucauuauguaauuugguuuca

SEQ ID NO: 739576 - RNA, 64 nt, Homo Sapiens
gaccacggccccaagcccaggacgugcugcucccuugugugagugggcuggacgcaggucccag

SEQ ID NO: 739577 - RNA, 64 nt, Homo Sapiens
gaccgcggccccgagccugggacaugcugcucccuugugugagugggcuggacgcaggucccag

SEQ ID NO: 739578 - RNA, 64 nt, Homo Sapiens
auguugacuucauuuggauuuuuuaccaagauuuuugugugaccuugggcuuccauucuaguuc

SEQ ID NO: 739579 - RNA, 64 nt, Homo Sapiens
uguuuggacuauguuuucuuuguccuggguucccuugugugaucauaaugccaaagucagcauu

SEQ ID NO: 739580 - RNA, 64 nt, Homo Sapiens
uuuuaguuuucaaaucaauuucuaauucuggugauugugugauguaaagaggugcuaugauggu

SEQ ID NO: 739581 - RNA, 64 nt, Homo Sapiens
gacugggugggaugugaauggaauguuagaaauguugugugaauugaaguucuguauucauuau

SEQ ID NO: 739582 - RNA, 56 nt, Homo Sapiens; identical to SEQ ID NO: 86279

SEQ ID NO: 739583 - RNA, 63 nt, Homo Sapiens
cuauuuuuguuuguuuauacaaauaucugauuugcaagaaaaagugcaugggagggguuuuag

SEQ ID NO: 739584 - RNA, 63 nt, Homo Sapiens
gagcagucugccugugaguguggcaagaaaggugcaagaaaguuguggguguggccgagguga

SEQ ID NO: 739585 - RNA, 63 nt, Homo Sapiens
ugcaagaaagugagcagucuggccgaggugauggcaagaaagguauuggaggaaugugggugu

SEQ ID NO: 739586 - RNA, 63 nt, Homo Sapiens
aaguccuguguuguauuugucuuugugacuaaugcaagaaagcguuuucuagauugucacaug

SEQ ID NO: 739587 - RNA, 63 nt, Homo Sapiens
uuucuucucuccccuccuucuuugcuuccagaagcaagaaaagucucuaauuccaauaugucu

SEQ ID NO: 739588 - RNA, 63 nt, Homo Sapiens
agagugacuugauuugcuuuaaaguauaaauuagcaagaaaggaaaaaucauugccauaagaa

SEQ ID NO: 739589 - RNA, 63 nt, Homo Sapiens
cgaugaaguaaacgccuuagugcuucagacccagcaagaaauuauugguaauauuuaugucua

SEQ ID NO: 739590 - RNA, 63 nt, Homo Sapiens
guauacaggauaaacuacauacacugaucccuugcaagaaauuugaucucaguuauaaucuaa

SEQ ID NO: 739591 - RNA, 63 nt, Homo Sapiens
ccuaaaauucuagccauuugucacacaaccacagcaagaaacguguucuauaucuagagugug

SEQ ID NO: 739592 - RNA, 63 nt, Homo Sapiens
uuacuucacuauaauuacaaggacaaauuauuagcaagaaauaagaauaguauuagaagaauu

SEQ ID NO: 739593 - RNA, 63 nt, Homo Sapiens
uaucugucccuguggucugacaagaacugcucugcaagaaaaaguacugcauugcaccaugag

SEQ ID NO: 739594 - RNA, 63 nt, Homo Sapiens
aaaauuuaagaauuaaauugccuaaaugucauugcaagaaauaaaucucaaaucacacugaac

SEQ ID NO: 739595 - RNA, 63 nt, Homo Sapiens
acuuuuauuauauuguuuacaaauauauuucaugcaagaaacagaaaaaaaaaaaaacccuuu

SEQ ID NO: 739596 - RNA, 63 nt, Homo Sapiens
uaaacuauaggauagauagaaugguuauuuuaugcaagaaauauuguaccgcaagggugguuu

SEQ ID NO: 739597 - RNA, 63 nt, Homo Sapiens
guagagaggaaccagauugguggggggaaagcagcaagaaaagaagcaugaagauuccugggg

SEQ ID NO: 739598 - RNA, 63 nt, Homo Sapiens
gcaaaacaaauacugaagcaugaagacaugaaggcaagaaacagauauuggaaacaguaugca

SEQ ID NO: 739599 - RNA, 64 nt, Homo Sapiens
gauggggguuuaaaugauuugcucaaagucauuuagggguaauaaauacuuggcuuggaaauuu

SEQ ID NO: 739600 - RNA, 64 nt, Homo Sapiens
agcacaugaccuugggauuacauuuuuauggggcagggguaagcaaguuuuuaaaucauuugug

SEQ ID NO: 739601 - RNA, 64 nt, Homo Sapiens
ugggcucuccuauuggaaucuaguuggggguuggagggguaaggaacacagggugauaggggag

SEQ ID NO: 739602 - RNA, 64 nt, Homo Sapiens
acaggcacacaauuucagucccagccaaagcagaagggguaaugacauggacuuggcgggggga

SEQ ID NO: 739603 - RNA, 64 nt, Homo Sapiens
ucuuaguccaaaacccaagcuaugagacacggcuagggguaaaccaggacagggaaagaaaggg

SEQ ID NO: 739604 - RNA, 64 nt, Homo Sapiens
cuaugaaaacaggggaagccuguuuacagaagagagggguaaaccaggcuuuaguggaagcccu

SEQ ID NO: 739605 - RNA, 64 nt, Homo Sapiens; identical to SEQ ID NO: 140348

SEQ ID NO: 739606 - RNA, 64 nt, Homo Sapiens; identical to SEQ ID NO: 140349

SEQ ID NO: 739607 - RNA, 64 nt, Homo Sapiens; identical to SEQ ID NO: 94750

SEQ ID NO: 739608 - RNA, 64 nt, Homo Sapiens; identical to SEQ ID NO: 94751

SEQ ID NO: 739609 - RNA, 64 nt, Homo Sapiens; identical to SEQ ID NO: 94752

SEQ ID NO: 739610 - RNA, 64 nt, Homo Sapiens; identical to SEQ ID NO: 94753

SEQ ID NO: 739611 - RNA, 64 nt, Homo Sapiens; identical to SEQ ID NO: 94754

SEQ ID NO: 739612 - RNA, 64 nt, Homo Sapiens; identical to SEQ ID NO: 94755

SEQ ID NO: 739613 - RNA, 64 nt, Homo Sapiens; identical to SEQ ID NO: 94756

SEQ ID NO: 739614 - RNA, 64 nt, Homo Sapiens; identical to SEQ ID NO: 94757

SEQ ID NO: 739615 - RNA, 64 nt, Homo Sapiens; identical to SEQ ID NO: 94758

SEQ ID NO: 739616 - RNA, 64 nt, Homo Sapiens; identical to SEQ ID NO: 94759

SEQ ID NO: 739617 - RNA, 64 nt, Homo Sapiens; identical to SEQ ID NO: 94760

SEQ ID NO: 739618 - RNA, 64 nt, Homo Sapiens; identical to SEQ ID NO: 94761

SEQ ID NO: 739619 - RNA, 64 nt, Homo Sapiens; identical to SEQ ID NO: 94762

SEQ ID NO: 739620 - RNA, 64 nt, Homo Sapiens; identical to SEQ ID NO: 94763

SEQ ID NO: 739621 - RNA, 64 nt, Homo Sapiens; identical to SEQ ID NO: 94764

SEQ ID NO: 739622 - RNA, 64 nt, Homo Sapiens; identical to SEQ ID NO: 94765

SEQ ID NO: 739623 - RNA, 64 nt, Homo Sapiens; identical to SEQ ID NO: 94766

SEQ ID NO: 739624 - RNA, 64 nt, Homo Sapiens; identical to SEQ ID NO: 94767

SEQ ID NO: 739625 - RNA, 64 nt, Homo Sapiens; identical to SEQ ID NO: 94768

SEQ ID NO: 739626 - RNA, 64 nt, Homo Sapiens; identical to SEQ ID NO: 94769

SEQ ID NO: 739627 - RNA, 64 nt, Homo Sapiens; identical to SEQ ID NO: 94770

SEQ ID NO: 739628 - RNA, 64 nt, Homo Sapiens; identical to SEQ ID NO: 94771

SEQ ID NO: 739629 - RNA, 64 nt, Homo Sapiens; identical to SEQ ID NO: 94772

SEQ ID NO: 739630 - RNA, 64 nt, Homo Sapiens; identical to SEQ ID NO: 94773

SEQ ID NO: 739631 - RNA, 64 nt, Homo Sapiens; identical to SEQ ID NO: 94774

SEQ ID NO: 739632 - RNA, 64 nt, Homo Sapiens; identical to SEQ ID NO: 94775

SEQ ID NO: 739633 - RNA, 64 nt, Homo Sapiens; identical to SEQ ID NO: 94776

SEQ ID NO: 739634 - RNA, 64 nt, Homo Sapiens; identical to SEQ ID NO: 94777

SEQ ID NO: 739635 - RNA, 64 nt, Homo Sapiens; identical to SEQ ID NO: 94778

SEQ ID NO: 739636 - RNA, 64 nt, Homo Sapiens; identical to SEQ ID NO: 94779

SEQ ID NO: 739637 - RNA, 64 nt, Homo Sapiens; identical to SEQ ID NO: 94780

SEQ ID NO: 739638 - RNA, 64 nt, Homo Sapiens; identical to SEQ ID NO: 94781

SEQ ID NO: 739639 - RNA, 64 nt, Homo Sapiens; identical to SEQ ID NO: 94782

SEQ ID NO: 739640 - RNA, 64 nt, Homo Sapiens; identical to SEQ ID NO: 94783

SEQ ID NO: 739641 - RNA, 64 nt, Homo Sapiens; identical to SEQ ID NO: 94784

SEQ ID NO: 739642 - RNA, 64 nt, Homo Sapiens; identical to SEQ ID NO: 94785

SEQ ID NO: 739643 - RNA, 64 nt, Homo Sapiens; identical to SEQ ID NO: 94786

SEQ ID NO: 739644 - RNA, 64 nt, Homo Sapiens; identical to SEQ ID NO: 94787

SEQ ID NO: 739645 - RNA, 64 nt, Homo Sapiens; identical to SEQ ID NO: 94788

SEQ ID NO: 739646 - RNA, 64 nt, Homo Sapiens; identical to SEQ ID NO: 94789

SEQ ID NO: 739647 - RNA, 64 nt, Homo Sapiens; identical to SEQ ID NO: 94790

SEQ ID NO: 739648 - RNA, 64 nt, Homo Sapiens; identical to SEQ ID NO: 94791

SEQ ID NO: 739649 - RNA, 64 nt, Homo Sapiens; identical to SEQ ID NO: 94792

SEQ ID NO: 739650 - RNA, 64 nt, Homo Sapiens; identical to SEQ ID NO: 94793

SEQ ID NO: 739651 - RNA, 64 nt, Homo Sapiens; identical to SEQ ID NO: 94794

SEQ ID NO: 739652 - RNA, 64 nt, Homo Sapiens; identical to SEQ ID NO: 94795

SEQ ID NO: 739653 - RNA, 64 nt, Homo Sapiens; identical to SEQ ID NO: 94796

SEQ ID NO: 739654 - RNA, 64 nt, Homo Sapiens; identical to SEQ ID NO: 94797

SEQ ID NO: 739655 - RNA, 64 nt, Homo Sapiens; identical to SEQ ID NO: 94798

SEQ ID NO: 739656 - RNA, 64 nt, Homo Sapiens; identical to SEQ ID NO: 94799

SEQ ID NO: 739657 - RNA, 64 nt, Homo Sapiens; identical to SEQ ID NO: 94800

SEQ ID NO: 739658 - RNA, 64 nt, Homo Sapiens; identical to SEQ ID NO: 94801

SEQ ID NO: 739659 - RNA, 64 nt, Homo Sapiens; identical to SEQ ID NO: 94802

SEQ ID NO: 739660 - RNA, 64 nt, Homo Sapiens; identical to SEQ ID NO: 94803

SEQ ID NO: 739661 - RNA, 64 nt, Homo Sapiens; identical to SEQ ID NO: 94804

SEQ ID NO: 739662 - RNA, 64 nt, Homo Sapiens; identical to SEQ ID NO: 94805

SEQ ID NO: 739663 - RNA, 64 nt, Homo Sapiens; identical to SEQ ID NO: 94806

SEQ ID NO: 739664 - RNA, 64 nt, Homo Sapiens; identical to SEQ ID NO: 94807

SEQ ID NO: 739665 - RNA, 64 nt, Homo Sapiens; identical to SEQ ID NO: 94808

SEQ ID NO: 739666 - RNA, 64 nt, Homo Sapiens; identical to SEQ ID NO: 94809

SEQ ID NO: 739667 - RNA, 64 nt, Homo Sapiens; identical to SEQ ID NO: 94810

SEQ ID NO: 739668 - RNA, 64 nt, Homo Sapiens; identical to SEQ ID NO: 94811

SEQ ID NO: 739669 - RNA, 64 nt, Homo Sapiens; identical to SEQ ID NO: 94812

SEQ ID NO: 739670 - RNA, 64 nt, Homo Sapiens; identical to SEQ ID NO: 94813

SEQ ID NO: 739671 - RNA, 64 nt, Homo Sapiens; identical to SEQ ID NO: 94814

SEQ ID NO: 739672 - RNA, 64 nt, Homo Sapiens; identical to SEQ ID NO: 94815

SEQ ID NO: 739673 - RNA, 64 nt, Homo Sapiens; identical to SEQ ID NO: 94816

SEQ ID NO: 739674 - RNA, 64 nt, Homo Sapiens; identical to SEQ ID NO: 94817

SEQ ID NO: 739675 - RNA, 64 nt, Homo Sapiens; identical to SEQ ID NO: 94818

SEQ ID NO: 739676 - RNA, 64 nt, Homo Sapiens; identical to SEQ ID NO: 94819

SEQ ID NO: 739677 - RNA, 64 nt, Homo Sapiens; identical to SEQ ID NO: 94820

SEQ ID NO: 739678 - RNA, 64 nt, Homo Sapiens; identical to SEQ ID NO: 94821

SEQ ID NO: 739679 - RNA, 64 nt, Homo Sapiens; identical to SEQ ID NO: 94822

SEQ ID NO: 739680 - RNA, 64 nt, Homo Sapiens; identical to SEQ ID NO: 94823

SEQ ID NO: 739681 - RNA, 64 nt, Homo Sapiens; identical to SEQ ID NO: 94824

SEQ ID NO: 739682 - RNA, 64 nt, Homo Sapiens; identical to SEQ ID NO: 94825

SEQ ID NO: 739683 - RNA, 64 nt, Homo Sapiens; identical to SEQ ID NO: 94826

SEQ ID NO: 739684 - RNA, 64 nt, Homo Sapiens; identical to SEQ ID NO: 94827

SEQ ID NO: 739685 - RNA, 64 nt, Homo Sapiens; identical to SEQ ID NO: 94828

SEQ ID NO: 739686 - RNA, 64 nt, Homo Sapiens; identical to SEQ ID NO: 94829

SEQ ID NO: 739687 - RNA, 64 nt, Homo Sapiens; identical to SEQ ID NO: 94830

SEQ ID NO: 739688 - RNA, 64 nt, Homo Sapiens; identical to SEQ ID NO: 94831

SEQ ID NO: 739689 - RNA, 64 nt, Homo Sapiens; identical to SEQ ID NO: 94832

SEQ ID NO: 739690 - RNA, 64 nt, Homo Sapiens; identical to SEQ ID NO: 94833

SEQ ID NO: 739691 - RNA, 64 nt, Homo Sapiens; identical to SEQ ID NO: 94834

SEQ ID NO: 739692 - RNA, 64 nt, Homo Sapiens; identical to SEQ ID NO: 94835

SEQ ID NO: 739693 - RNA, 64 nt, Homo Sapiens; identical to SEQ ID NO: 109251

SEQ ID NO: 739694 - RNA, 64 nt, Homo Sapiens; identical to SEQ ID NO: 109252

SEQ ID NO: 739695 - RNA, 64 nt, Homo Sapiens; identical to SEQ ID NO: 109253

SEQ ID NO: 739696 - RNA, 64 nt, Homo Sapiens; identical to SEQ ID NO: 109254

SEQ ID NO: 739697 - RNA, 64 nt, Homo Sapiens; identical to SEQ ID NO: 109255

SEQ ID NO: 739698 - RNA, 64 nt, Homo Sapiens; identical to SEQ ID NO: 109256

SEQ ID NO: 739699 - RNA, 64 nt, Homo Sapiens; identical to SEQ ID NO: 488598

SEQ ID NO: 739700 - RNA, 64 nt, Homo Sapiens; identical to SEQ ID NO: 488599

SEQ ID NO: 739701 - RNA, 64 nt, Homo Sapiens; identical to SEQ ID NO: 488600

SEQ ID NO: 739702 - RNA, 64 nt, Homo Sapiens; identical to SEQ ID NO: 488601

SEQ ID NO: 739703 - RNA, 64 nt, Homo Sapiens; identical to SEQ ID NO: 488602

SEQ ID NO: 739704 - RNA, 64 nt, Homo Sapiens; identical to SEQ ID NO: 488603

SEQ ID NO: 739705 - RNA, 64 nt, Homo Sapiens; identical to SEQ ID NO: 488604

SEQ ID NO: 739706 - RNA, 64 nt, Homo Sapiens; identical to SEQ ID NO: 488605

SEQ ID NO: 739707 - RNA, 64 nt, Homo Sapiens; identical to SEQ ID NO: 488606

SEQ ID NO: 739708 - RNA, 64 nt, Homo Sapiens; identical to SEQ ID NO: 488607

SEQ ID NO: 739709 - RNA, 64 nt, Homo Sapiens; identical to SEQ ID NO: 488608

SEQ ID NO: 739710 - RNA, 64 nt, Homo Sapiens; identical to SEQ ID NO: 488609

SEQ ID NO: 739711 - RNA, 64 nt, Homo Sapiens; identical to SEQ ID NO: 488610

SEQ ID NO: 739712 - RNA, 64 nt, Homo Sapiens; identical to SEQ ID NO: 488611

SEQ ID NO: 739713 - RNA, 64 nt, Homo Sapiens; identical to SEQ ID NO: 488612

SEQ ID NO: 739714 - RNA, 64 nt, Homo Sapiens; identical to SEQ ID NO: 488613

SEQ ID NO: 739715 - RNA, 64 nt, Homo Sapiens; identical to SEQ ID NO: 488614

SEQ ID NO: 739716 - RNA, 64 nt, Homo Sapiens; identical to SEQ ID NO: 488615

SEQ ID NO: 739717 - RNA, 64 nt, Homo Sapiens; identical to SEQ ID NO: 488616

SEQ ID NO: 739718 - RNA, 64 nt, Homo Sapiens; identical to SEQ ID NO: 488617

SEQ ID NO: 739719 - RNA, 64 nt, Homo Sapiens; identical to SEQ ID NO: 488618

SEQ ID NO: 739720 - RNA, 64 nt, Homo Sapiens; identical to SEQ ID NO: 488619

SEQ ID NO: 739721 - RNA, 64 nt, Homo Sapiens; identical to SEQ ID NO: 488620

SEQ ID NO: 739722 - RNA, 64 nt, Homo Sapiens; identical to SEQ ID NO: 488621

SEQ ID NO: 739723 - RNA, 64 nt, Homo Sapiens; identical to SEQ ID NO: 488622

SEQ ID NO: 739724 - RNA, 64 nt, Homo Sapiens; identical to SEQ ID NO: 488623

SEQ ID NO: 739725 - RNA, 64 nt, Homo Sapiens; identical to SEQ ID NO: 488624

SEQ ID NO: 739726 - RNA, 64 nt, Homo Sapiens; identical to SEQ ID NO: 488625

SEQ ID NO: 739727 - RNA, 64 nt, Homo Sapiens; identical to SEQ ID NO: 488626

SEQ ID NO: 739728 - RNA, 64 nt, Homo Sapiens; identical to SEQ ID NO: 488627

SEQ ID NO: 739729 - RNA, 64 nt, Homo Sapiens; identical to SEQ ID NO: 488628

SEQ ID NO: 739730 - RNA, 64 nt, Homo Sapiens; identical to SEQ ID NO: 488629

SEQ ID NO: 739731 - RNA, 64 nt, Homo Sapiens; identical to SEQ ID NO: 488630

SEQ ID NO: 739732 - RNA, 64 nt, Homo Sapiens; identical to SEQ ID NO: 488631

SEQ ID NO: 739733 - RNA, 64 nt, Homo Sapiens; identical to SEQ ID NO: 488632

SEQ ID NO: 739734 - RNA, 64 nt, Homo Sapiens; identical to SEQ ID NO: 488633

SEQ ID NO: 739735 - RNA, 64 nt, Homo Sapiens; identical to SEQ ID NO: 488634

SEQ ID NO: 739736 - RNA, 64 nt, Homo Sapiens; identical to SEQ ID NO: 488635

SEQ ID NO: 739737 - RNA, 64 nt, Homo Sapiens; identical to SEQ ID NO: 488636

SEQ ID NO: 739738 - RNA, 64 nt, Homo Sapiens; identical to SEQ ID NO: 488637

SEQ ID NO: 739739 - RNA, 64 nt, Homo Sapiens; identical to SEQ ID NO: 488638

SEQ ID NO: 739740 - RNA, 64 nt, Homo Sapiens; identical to SEQ ID NO: 488639

SEQ ID NO: 739741 - RNA, 64 nt, Homo Sapiens; identical to SEQ ID NO: 488640

SEQ ID NO: 739742 - RNA, 64 nt, Homo Sapiens; identical to SEQ ID NO: 488641

SEQ ID NO: 739743 - RNA, 64 nt, Homo Sapiens; identical to SEQ ID NO: 488642

SEQ ID NO: 739744 - RNA, 64 nt, Homo Sapiens; identical to SEQ ID NO: 488643

SEQ ID NO: 739745 - RNA, 64 nt, Homo Sapiens; identical to SEQ ID NO: 488644

SEQ ID NO: 739746 - RNA, 64 nt, Homo Sapiens; identical to SEQ ID NO: 488645

SEQ ID NO: 739747 - RNA, 64 nt, Homo Sapiens; identical to SEQ ID NO: 488646

SEQ ID NO: 739748 - RNA, 64 nt, Homo Sapiens; identical to SEQ ID NO: 488647

SEQ ID NO: 739749 - RNA, 64 nt, Homo Sapiens; identical to SEQ ID NO: 488648

SEQ ID NO: 739750 - RNA, 64 nt, Homo Sapiens; identical to SEQ ID NO: 488649

SEQ ID NO: 739751 - RNA, 64 nt, Homo Sapiens; identical to SEQ ID NO: 488650

SEQ ID NO: 739752 - RNA, 64 nt, Homo Sapiens; identical to SEQ ID NO: 488651

SEQ ID NO: 739753 - RNA, 64 nt, Homo Sapiens; identical to SEQ ID NO: 488652

SEQ ID NO: 739754 - RNA, 64 nt, Homo Sapiens; identical to SEQ ID NO: 488653

SEQ ID NO: 739755 - RNA, 64 nt, Homo Sapiens; identical to SEQ ID NO: 488654

SEQ ID NO: 739756 - RNA, 64 nt, Homo Sapiens; identical to SEQ ID NO: 488655

SEQ ID NO: 739757 - RNA, 64 nt, Homo Sapiens; identical to SEQ ID NO: 488656

SEQ ID NO: 739758 - RNA, 64 nt, Homo Sapiens; identical to SEQ ID NO: 488657

SEQ ID NO: 739759 - RNA, 64 nt, Homo Sapiens; identical to SEQ ID NO: 488658

SEQ ID NO: 739760 - RNA, 64 nt, Homo Sapiens; identical to SEQ ID NO: 488659

SEQ ID NO: 739761 - RNA, 64 nt, Homo Sapiens; identical to SEQ ID NO: 488660

SEQ ID NO: 739762 - RNA, 64 nt, Homo Sapiens; identical to SEQ ID NO: 488661

SEQ ID NO: 739763 - RNA, 64 nt, Homo Sapiens; identical to SEQ ID NO: 488662

SEQ ID NO: 739764 - RNA, 64 nt, Homo Sapiens; identical to SEQ ID NO: 488663

SEQ ID NO: 739765 - RNA, 64 nt, Homo Sapiens; identical to SEQ ID NO: 488664

SEQ ID NO: 739766 - RNA, 64 nt, Homo Sapiens; identical to SEQ ID NO: 488665

SEQ ID NO: 739767 - RNA, 64 nt, Homo Sapiens; identical to SEQ ID NO: 488666

SEQ ID NO: 739768 - RNA, 64 nt, Homo Sapiens; identical to SEQ ID NO: 488667

SEQ ID NO: 739769 - RNA, 64 nt, Homo Sapiens; identical to SEQ ID NO: 488668

SEQ ID NO: 739770 - RNA, 64 nt, Homo Sapiens; identical to SEQ ID NO: 488669

SEQ ID NO: 739771 - RNA, 64 nt, Homo Sapiens; identical to SEQ ID NO: 488670

SEQ ID NO: 739772 - RNA, 64 nt, Homo Sapiens; identical to SEQ ID NO: 488671

SEQ ID NO: 739773 - RNA, 64 nt, Homo Sapiens; identical to SEQ ID NO: 488672

SEQ ID NO: 739774 - RNA, 64 nt, Homo Sapiens; identical to SEQ ID NO: 488673

SEQ ID NO: 739775 - RNA, 64 nt, Homo Sapiens; identical to SEQ ID NO: 488674

SEQ ID NO: 739776 - RNA, 64 nt, Homo Sapiens; identical to SEQ ID NO: 488675

SEQ ID NO: 739777 - RNA, 64 nt, Homo Sapiens; identical to SEQ ID NO: 488676

SEQ ID NO: 739778 - RNA, 64 nt, Homo Sapiens; identical to SEQ ID NO: 488677

SEQ ID NO: 739779 - RNA, 64 nt, Homo Sapiens; identical to SEQ ID NO: 488678

SEQ ID NO: 739780 - RNA, 64 nt, Homo Sapiens; identical to SEQ ID NO: 488679

SEQ ID NO: 739781 - RNA, 64 nt, Homo Sapiens; identical to SEQ ID NO: 488680

SEQ ID NO: 739782 - RNA, 64 nt, Homo Sapiens; identical to SEQ ID NO: 488681

SEQ ID NO: 739783 - RNA, 64 nt, Homo Sapiens; identical to SEQ ID NO: 488682

SEQ ID NO: 739784 - RNA, 64 nt, Homo Sapiens; identical to SEQ ID NO: 488683

SEQ ID NO: 739785 - RNA, 64 nt, Homo Sapiens; identical to SEQ ID NO: 488684

SEQ ID NO: 739786 - RNA, 64 nt, Homo Sapiens; identical to SEQ ID NO: 488685

SEQ ID NO: 739787 - RNA, 64 nt, Homo Sapiens; identical to SEQ ID NO: 488686

SEQ ID NO: 739788 - RNA, 64 nt, Homo Sapiens; identical to SEQ ID NO: 488687

SEQ ID NO: 739789 - RNA, 64 nt, Homo Sapiens; identical to SEQ ID NO: 488688

SEQ ID NO: 739790 - RNA, 64 nt, Homo Sapiens; identical to SEQ ID NO: 488689

SEQ ID NO: 739791 - RNA, 64 nt, Homo Sapiens; identical to SEQ ID NO: 488690

SEQ ID NO: 739792 - RNA, 64 nt, Homo Sapiens; identical to SEQ ID NO: 488691

SEQ ID NO: 739793 - RNA, 64 nt, Homo Sapiens; identical to SEQ ID NO: 488692

SEQ ID NO: 739794 - RNA, 64 nt, Homo Sapiens; identical to SEQ ID NO: 488693

SEQ ID NO: 739795 - RNA, 64 nt, Homo Sapiens; identical to SEQ ID NO: 488694

SEQ ID NO: 739796 - RNA, 64 nt, Homo Sapiens; identical to SEQ ID NO: 488695

SEQ ID NO: 739797 - RNA, 64 nt, Homo Sapiens; identical to SEQ ID NO: 488696

SEQ ID NO: 739798 - RNA, 64 nt, Homo Sapiens; identical to SEQ ID NO: 488697

SEQ ID NO: 739799 - RNA, 64 nt, Homo Sapiens; identical to SEQ ID NO: 488698

SEQ ID NO: 739800 - RNA, 64 nt, Homo Sapiens; identical to SEQ ID NO: 488699

SEQ ID NO: 739801 - RNA, 64 nt, Homo Sapiens; identical to SEQ ID NO: 488700

SEQ ID NO: 739802 - RNA, 64 nt, Homo Sapiens; identical to SEQ ID NO: 488701

SEQ ID NO: 739803 - RNA, 64 nt, Homo Sapiens; identical to SEQ ID NO: 488702

SEQ ID NO: 739804 - RNA, 64 nt, Homo Sapiens; identical to SEQ ID NO: 488703

SEQ ID NO: 739805 - RNA, 64 nt, Homo Sapiens; identical to SEQ ID NO: 488704

SEQ ID NO: 739806 - RNA, 64 nt, Homo Sapiens; identical to SEQ ID NO: 488705

SEQ ID NO: 739807 - RNA, 64 nt, Homo Sapiens; identical to SEQ ID NO: 488706

SEQ ID NO: 739808 - RNA, 64 nt, Homo Sapiens; identical to SEQ ID NO: 488707

SEQ ID NO: 739809 - RNA, 64 nt, Homo Sapiens; identical to SEQ ID NO: 488708

SEQ ID NO: 739810 - RNA, 64 nt, Homo Sapiens; identical to SEQ ID NO: 488709

SEQ ID NO: 739811 - RNA, 64 nt, Homo Sapiens; identical to SEQ ID NO: 488710

SEQ ID NO: 739812 - RNA, 64 nt, Homo Sapiens; identical to SEQ ID NO: 488711

SEQ ID NO: 739813 - RNA, 64 nt, Homo Sapiens; identical to SEQ ID NO: 488712

SEQ ID NO: 739814 - RNA, 64 nt, Homo Sapiens; identical to SEQ ID NO: 488713

SEQ ID NO: 739815 - RNA, 64 nt, Homo Sapiens; identical to SEQ ID NO: 488714

SEQ ID NO: 739816 - RNA, 64 nt, Homo Sapiens; identical to SEQ ID NO: 488715

SEQ ID NO: 739817 - RNA, 64 nt, Homo Sapiens; identical to SEQ ID NO: 488716

SEQ ID NO: 739818 - RNA, 64 nt, Homo Sapiens; identical to SEQ ID NO: 488717

SEQ ID NO: 739819 - RNA, 64 nt, Homo Sapiens; identical to SEQ ID NO: 488718

SEQ ID NO: 739820 - RNA, 64 nt, Homo Sapiens; identical to SEQ ID NO: 488719

SEQ ID NO: 739821 - RNA, 64 nt, Homo Sapiens; identical to SEQ ID NO: 488720

SEQ ID NO: 739822 - RNA, 64 nt, Homo Sapiens; identical to SEQ ID NO: 488721

SEQ ID NO: 739823 - RNA, 64 nt, Homo Sapiens; identical to SEQ ID NO: 488722

SEQ ID NO: 739824 - RNA, 64 nt, Homo Sapiens; identical to SEQ ID NO: 488723

SEQ ID NO: 739825 - RNA, 64 nt, Homo Sapiens; identical to SEQ ID NO: 488724

SEQ ID NO: 739826 - RNA, 64 nt, Homo Sapiens; identical to SEQ ID NO: 488725

SEQ ID NO: 739827 - RNA, 64 nt, Homo Sapiens; identical to SEQ ID NO: 488726

SEQ ID NO: 739828 - RNA, 64 nt, Homo Sapiens; identical to SEQ ID NO: 488727

SEQ ID NO: 739829 - RNA, 64 nt, Homo Sapiens; identical to SEQ ID NO: 488728

SEQ ID NO: 739830 - RNA, 64 nt, Homo Sapiens; identical to SEQ ID NO: 488729

SEQ ID NO: 739831 - RNA, 64 nt, Homo Sapiens; identical to SEQ ID NO: 488730

SEQ ID NO: 739832 - RNA, 64 nt, Homo Sapiens; identical to SEQ ID NO: 488731

SEQ ID NO: 739833 - RNA, 64 nt, Homo Sapiens; identical to SEQ ID NO: 488732

SEQ ID NO: 739834 - RNA, 64 nt, Homo Sapiens; identical to SEQ ID NO: 488733

SEQ ID NO: 739835 - RNA, 64 nt, Homo Sapiens; identical to SEQ ID NO: 488734

SEQ ID NO: 739836 - RNA, 64 nt, Homo Sapiens; identical to SEQ ID NO: 488735

SEQ ID NO: 739837 - RNA, 64 nt, Homo Sapiens; identical to SEQ ID NO: 488736

SEQ ID NO: 739838 - RNA, 64 nt, Homo Sapiens; identical to SEQ ID NO: 488737

SEQ ID NO: 739839 - RNA, 64 nt, Homo Sapiens; identical to SEQ ID NO: 488738

SEQ ID NO: 739840 - RNA, 64 nt, Homo Sapiens; identical to SEQ ID NO: 488739

SEQ ID NO: 739841 - RNA, 64 nt, Homo Sapiens; identical to SEQ ID NO: 488740

SEQ ID NO: 739842 - RNA, 64 nt, Homo Sapiens; identical to SEQ ID NO: 488741

SEQ ID NO: 739843 - RNA, 64 nt, Homo Sapiens; identical to SEQ ID NO: 488742

SEQ ID NO: 739844 - RNA, 64 nt, Homo Sapiens; identical to SEQ ID NO: 488743

SEQ ID NO: 739845 - RNA, 64 nt, Homo Sapiens; identical to SEQ ID NO: 488744

SEQ ID NO: 739846 - RNA, 64 nt, Homo Sapiens; identical to SEQ ID NO: 488745

SEQ ID NO: 739847 - RNA, 64 nt, Homo Sapiens; identical to SEQ ID NO: 488746

SEQ ID NO: 739848 - RNA, 64 nt, Homo Sapiens; identical to SEQ ID NO: 488747

SEQ ID NO: 739849 - RNA, 64 nt, Homo Sapiens; identical to SEQ ID NO: 488748

SEQ ID NO: 739850 - RNA, 64 nt, Homo Sapiens; identical to SEQ ID NO: 488749

SEQ ID NO: 739851 - RNA, 64 nt, Homo Sapiens; identical to SEQ ID NO: 488750

SEQ ID NO: 739852 - RNA, 64 nt, Homo Sapiens; identical to SEQ ID NO: 488751

SEQ ID NO: 739853 - RNA, 64 nt, Homo Sapiens; identical to SEQ ID NO: 488752

SEQ ID NO: 739854 - RNA, 64 nt, Homo Sapiens; identical to SEQ ID NO: 488753

SEQ ID NO: 739855 - RNA, 64 nt, Homo Sapiens; identical to SEQ ID NO: 488754

SEQ ID NO: 739856 - RNA, 64 nt, Homo Sapiens; identical to SEQ ID NO: 488755

SEQ ID NO: 739857 - RNA, 64 nt, Homo Sapiens; identical to SEQ ID NO: 488756

SEQ ID NO: 739858 - RNA, 64 nt, Homo Sapiens; identical to SEQ ID NO: 488757

SEQ ID NO: 739859 - RNA, 64 nt, Homo Sapiens; identical to SEQ ID NO: 488758

SEQ ID NO: 739860 - RNA, 64 nt, Homo Sapiens; identical to SEQ ID NO: 488759

SEQ ID NO: 739861 - RNA, 64 nt, Homo Sapiens; identical to SEQ ID NO: 488760

SEQ ID NO: 739862 - RNA, 64 nt, Homo Sapiens; identical to SEQ ID NO: 488761

SEQ ID NO: 739863 - RNA, 64 nt, Homo Sapiens; identical to SEQ ID NO: 488762

SEQ ID NO: 739864 - RNA, 64 nt, Homo Sapiens; identical to SEQ ID NO: 488763

SEQ ID NO: 739865 - RNA, 64 nt, Homo Sapiens; identical to SEQ ID NO: 488764

SEQ ID NO: 739866 - RNA, 64 nt, Homo Sapiens; identical to SEQ ID NO: 488765

SEQ ID NO: 739867 - RNA, 64 nt, Homo Sapiens; identical to SEQ ID NO: 488766

SEQ ID NO: 739868 - RNA, 64 nt, Homo Sapiens; identical to SEQ ID NO: 488767

SEQ ID NO: 739869 - RNA, 64 nt, Homo Sapiens; identical to SEQ ID NO: 488768

SEQ ID NO: 739870 - RNA, 64 nt, Homo Sapiens; identical to SEQ ID NO: 488769

SEQ ID NO: 739871 - RNA, 64 nt, Homo Sapiens; identical to SEQ ID NO: 488770

SEQ ID NO: 739872 - RNA, 64 nt, Homo Sapiens; identical to SEQ ID NO: 488771

SEQ ID NO: 739873 - RNA, 64 nt, Homo Sapiens; identical to SEQ ID NO: 488772

SEQ ID NO: 739874 - RNA, 64 nt, Homo Sapiens; identical to SEQ ID NO: 488773

SEQ ID NO: 739875 - RNA, 64 nt, Homo Sapiens; identical to SEQ ID NO: 488774

SEQ ID NO: 739876 - RNA, 64 nt, Homo Sapiens; identical to SEQ ID NO: 488775

SEQ ID NO: 739877 - RNA, 64 nt, Homo Sapiens; identical to SEQ ID NO: 488776

SEQ ID NO: 739878 - RNA, 64 nt, Homo Sapiens; identical to SEQ ID NO: 488777

SEQ ID NO: 739879 - RNA, 64 nt, Homo Sapiens; identical to SEQ ID NO: 488778

SEQ ID NO: 739880 - RNA, 64 nt, Homo Sapiens; identical to SEQ ID NO: 488779

SEQ ID NO: 739881 - RNA, 64 nt, Homo Sapiens; identical to SEQ ID NO: 488780

SEQ ID NO: 739882 - RNA, 64 nt, Homo Sapiens; identical to SEQ ID NO: 488781

SEQ ID NO: 739883 - RNA, 64 nt, Homo Sapiens; identical to SEQ ID NO: 488782

SEQ ID NO: 739884 - RNA, 64 nt, Homo Sapiens; identical to SEQ ID NO: 488783

SEQ ID NO: 739885 - RNA, 64 nt, Homo Sapiens; identical to SEQ ID NO: 488784

SEQ ID NO: 739886 - RNA, 64 nt, Homo Sapiens; identical to SEQ ID NO: 488785

SEQ ID NO: 739887 - RNA, 64 nt, Homo Sapiens; identical to SEQ ID NO: 488786

SEQ ID NO: 739888 - RNA, 64 nt, Homo Sapiens; identical to SEQ ID NO: 488787

SEQ ID NO: 739889 - RNA, 64 nt, Homo Sapiens; identical to SEQ ID NO: 488788

SEQ ID NO: 739890 - RNA, 64 nt, Homo Sapiens; identical to SEQ ID NO: 488789

SEQ ID NO: 739891 - RNA, 64 nt, Homo Sapiens; identical to SEQ ID NO: 488790

SEQ ID NO: 739892 - RNA, 64 nt, Homo Sapiens; identical to SEQ ID NO: 488791

SEQ ID NO: 739893 - RNA, 64 nt, Homo Sapiens; identical to SEQ ID NO: 488792

SEQ ID NO: 739894 - RNA, 64 nt, Homo Sapiens; identical to SEQ ID NO: 488793

SEQ ID NO: 739895 - RNA, 64 nt, Homo Sapiens; identical to SEQ ID NO: 488794

SEQ ID NO: 739896 - RNA, 64 nt, Homo Sapiens; identical to SEQ ID NO: 488795

SEQ ID NO: 739897 - RNA, 64 nt, Homo Sapiens; identical to SEQ ID NO: 488796

SEQ ID NO: 739898 - RNA, 64 nt, Homo Sapiens; identical to SEQ ID NO: 488797

SEQ ID NO: 739899 - RNA, 64 nt, Homo Sapiens; identical to SEQ ID NO: 488798

SEQ ID NO: 739900 - RNA, 64 nt, Homo Sapiens; identical to SEQ ID NO: 488799

SEQ ID NO: 739901 - RNA, 64 nt, Homo Sapiens; identical to SEQ ID NO: 488800

SEQ ID NO: 739902 - RNA, 64 nt, Homo Sapiens; identical to SEQ ID NO: 488801

SEQ ID NO: 739903 - RNA, 64 nt, Homo Sapiens; identical to SEQ ID NO: 488802

SEQ ID NO: 739904 - RNA, 64 nt, Homo Sapiens; identical to SEQ ID NO: 488803

SEQ ID NO: 739905 - RNA, 64 nt, Homo Sapiens; identical to SEQ ID NO: 488804

SEQ ID NO: 739906 - RNA, 64 nt, Homo Sapiens; identical to SEQ ID NO: 488805

SEQ ID NO: 739907 - RNA, 64 nt, Homo Sapiens; identical to SEQ ID NO: 488806

SEQ ID NO: 739908 - RNA, 64 nt, Homo Sapiens; identical to SEQ ID NO: 488807

SEQ ID NO: 739909 - RNA, 64 nt, Homo Sapiens; identical to SEQ ID NO: 488808

SEQ ID NO: 739910 - RNA, 64 nt, Homo Sapiens; identical to SEQ ID NO: 488809

SEQ ID NO: 739911 - RNA, 64 nt, Homo Sapiens; identical to SEQ ID NO: 488810

SEQ ID NO: 739912 - RNA, 64 nt, Homo Sapiens; identical to SEQ ID NO: 488811

SEQ ID NO: 739913 - RNA, 64 nt, Homo Sapiens; identical to SEQ ID NO: 488812

SEQ ID NO: 739914 - RNA, 64 nt, Homo Sapiens; identical to SEQ ID NO: 488813

SEQ ID NO: 739915 - RNA, 64 nt, Homo Sapiens; identical to SEQ ID NO: 488814

SEQ ID NO: 739916 - RNA, 64 nt, Homo Sapiens; identical to SEQ ID NO: 488815

SEQ ID NO: 739917 - RNA, 64 nt, Homo Sapiens; identical to SEQ ID NO: 488816

SEQ ID NO: 739918 - RNA, 64 nt, Homo Sapiens; identical to SEQ ID NO: 488817

SEQ ID NO: 739919 - RNA, 64 nt, Homo Sapiens; identical to SEQ ID NO: 488818

SEQ ID NO: 739920 - RNA, 64 nt, Homo Sapiens; identical to SEQ ID NO: 488819

SEQ ID NO: 739921 - RNA, 64 nt, Homo Sapiens; identical to SEQ ID NO: 488820

SEQ ID NO: 739922 - RNA, 64 nt, Homo Sapiens; identical to SEQ ID NO: 488821

SEQ ID NO: 739923 - RNA, 64 nt, Homo Sapiens; identical to SEQ ID NO: 488822

SEQ ID NO: 739924 - RNA, 64 nt, Homo Sapiens; identical to SEQ ID NO: 488823

SEQ ID NO: 739925 - RNA, 64 nt, Homo Sapiens; identical to SEQ ID NO: 488824

SEQ ID NO: 739926 - RNA, 64 nt, Homo Sapiens; identical to SEQ ID NO: 488825

SEQ ID NO: 739927 - RNA, 64 nt, Homo Sapiens; identical to SEQ ID NO: 488826

SEQ ID NO: 739928 - RNA, 64 nt, Homo Sapiens; identical to SEQ ID NO: 488827

SEQ ID NO: 739929 - RNA, 64 nt, Homo Sapiens; identical to SEQ ID NO: 488828

SEQ ID NO: 739930 - RNA, 64 nt, Homo Sapiens; identical to SEQ ID NO: 488829

SEQ ID NO: 739931 - RNA, 64 nt, Homo Sapiens; identical to SEQ ID NO: 488830

SEQ ID NO: 739932 - RNA, 64 nt, Homo Sapiens; identical to SEQ ID NO: 488831

SEQ ID NO: 739933 - RNA, 64 nt, Homo Sapiens; identical to SEQ ID NO: 488832

SEQ ID NO: 739934 - RNA, 64 nt, Homo Sapiens; identical to SEQ ID NO: 488833

SEQ ID NO: 739935 - RNA, 64 nt, Homo Sapiens; identical to SEQ ID NO: 488834

SEQ ID NO: 739936 - RNA, 64 nt, Homo Sapiens; identical to SEQ ID NO: 488835

SEQ ID NO: 739937 - RNA, 64 nt, Homo Sapiens; identical to SEQ ID NO: 488836

SEQ ID NO: 739938 - RNA, 64 nt, Homo Sapiens; identical to SEQ ID NO: 488837

SEQ ID NO: 739939 - RNA, 64 nt, Homo Sapiens; identical to SEQ ID NO: 488838

SEQ ID NO: 739940 - RNA, 64 nt, Homo Sapiens; identical to SEQ ID NO: 488839

SEQ ID NO: 739941 - RNA, 64 nt, Homo Sapiens; identical to SEQ ID NO: 488840

SEQ ID NO: 739942 - RNA, 64 nt, Homo Sapiens; identical to SEQ ID NO: 488841

SEQ ID NO: 739943 - RNA, 64 nt, Homo Sapiens; identical to SEQ ID NO: 488842

SEQ ID NO: 739944 - RNA, 64 nt, Homo Sapiens; identical to SEQ ID NO: 488843

SEQ ID NO: 739945 - RNA, 64 nt, Homo Sapiens; identical to SEQ ID NO: 488844

SEQ ID NO: 739946 - RNA, 64 nt, Homo Sapiens; identical to SEQ ID NO: 488845

SEQ ID NO: 739947 - RNA, 64 nt, Homo Sapiens; identical to SEQ ID NO: 488846

SEQ ID NO: 739948 - RNA, 64 nt, Homo Sapiens; identical to SEQ ID NO: 488847

SEQ ID NO: 739949 - RNA, 64 nt, Homo Sapiens; identical to SEQ ID NO: 488848

SEQ ID NO: 739950 - RNA, 64 nt, Homo Sapiens; identical to SEQ ID NO: 488849

SEQ ID NO: 739951 - RNA, 64 nt, Homo Sapiens; identical to SEQ ID NO: 488850

SEQ ID NO: 739952 - RNA, 64 nt, Homo Sapiens; identical to SEQ ID NO: 488851

SEQ ID NO: 739953 - RNA, 64 nt, Homo Sapiens; identical to SEQ ID NO: 488852

SEQ ID NO: 739954 - RNA, 64 nt, Homo Sapiens; identical to SEQ ID NO: 488853

SEQ ID NO: 739955 - RNA, 64 nt, Homo Sapiens; identical to SEQ ID NO: 488854

SEQ ID NO: 739956 - RNA, 64 nt, Homo Sapiens; identical to SEQ ID NO: 488855

SEQ ID NO: 739957 - RNA, 64 nt, Homo Sapiens; identical to SEQ ID NO: 488856

SEQ ID NO: 739958 - RNA, 64 nt, Homo Sapiens; identical to SEQ ID NO: 488857

SEQ ID NO: 739959 - RNA, 64 nt, Homo Sapiens; identical to SEQ ID NO: 488858

SEQ ID NO: 739960 - RNA, 64 nt, Homo Sapiens; identical to SEQ ID NO: 488859

SEQ ID NO: 739961 - RNA, 64 nt, Homo Sapiens; identical to SEQ ID NO: 488860

SEQ ID NO: 739962 - RNA, 64 nt, Homo Sapiens; identical to SEQ ID NO: 488861

SEQ ID NO: 739963 - RNA, 64 nt, Homo Sapiens; identical to SEQ ID NO: 488862

SEQ ID NO: 739964 - RNA, 64 nt, Homo Sapiens; identical to SEQ ID NO: 488863

SEQ ID NO: 739965 - RNA, 64 nt, Homo Sapiens; identical to SEQ ID NO: 488864

SEQ ID NO: 739966 - RNA, 64 nt, Homo Sapiens; identical to SEQ ID NO: 488865

SEQ ID NO: 739967 - RNA, 64 nt, Homo Sapiens; identical to SEQ ID NO: 488866

SEQ ID NO: 739968 - RNA, 64 nt, Homo Sapiens; identical to SEQ ID NO: 488867

SEQ ID NO: 739969 - RNA, 64 nt, Homo Sapiens; identical to SEQ ID NO: 488868

SEQ ID NO: 739970 - RNA, 64 nt, Homo Sapiens; identical to SEQ ID NO: 488869

SEQ ID NO: 739971 - RNA, 64 nt, Homo Sapiens; identical to SEQ ID NO: 488870

SEQ ID NO: 739972 - RNA, 64 nt, Homo Sapiens; identical to SEQ ID NO: 488871

SEQ ID NO: 739973 - RNA, 64 nt, Homo Sapiens; identical to SEQ ID NO: 488872

SEQ ID NO: 739974 - RNA, 64 nt, Homo Sapiens; identical to SEQ ID NO: 488873

SEQ ID NO: 739975 - RNA, 64 nt, Homo Sapiens; identical to SEQ ID NO: 488874

SEQ ID NO: 739976 - RNA, 64 nt, Homo Sapiens; identical to SEQ ID NO: 488875

SEQ ID NO: 739977 - RNA, 64 nt, Homo Sapiens; identical to SEQ ID NO: 488876

SEQ ID NO: 739978 - RNA, 64 nt, Homo Sapiens; identical to SEQ ID NO: 488877

SEQ ID NO: 739979 - RNA, 64 nt, Homo Sapiens; identical to SEQ ID NO: 488878

SEQ ID NO: 739980 - RNA, 64 nt, Homo Sapiens; identical to SEQ ID NO: 488879

SEQ ID NO: 739981 - RNA, 64 nt, Homo Sapiens; identical to SEQ ID NO: 488880

SEQ ID NO: 739982 - RNA, 64 nt, Homo Sapiens; identical to SEQ ID NO: 488881

SEQ ID NO: 739983 - RNA, 64 nt, Homo Sapiens; identical to SEQ ID NO: 488882

SEQ ID NO: 739984 - RNA, 64 nt, Homo Sapiens; identical to SEQ ID NO: 488883

SEQ ID NO: 739985 - RNA, 64 nt, Homo Sapiens; identical to SEQ ID NO: 488884

SEQ ID NO: 739986 - RNA, 64 nt, Homo Sapiens; identical to SEQ ID NO: 488885

SEQ ID NO: 739987 - RNA, 64 nt, Homo Sapiens; identical to SEQ ID NO: 488886

SEQ ID NO: 739988 - RNA, 64 nt, Homo Sapiens; identical to SEQ ID NO: 488887

SEQ ID NO: 739989 - RNA, 64 nt, Homo Sapiens; identical to SEQ ID NO: 488888

SEQ ID NO: 739990 - RNA, 64 nt, Homo Sapiens; identical to SEQ ID NO: 488889

SEQ ID NO: 739991 - RNA, 64 nt, Homo Sapiens; identical to SEQ ID NO: 488890

SEQ ID NO: 739992 - RNA, 64 nt, Homo Sapiens; identical to SEQ ID NO: 488891

SEQ ID NO: 739993 - RNA, 64 nt, Homo Sapiens; identical to SEQ ID NO: 488892

SEQ ID NO: 739994 - RNA, 64 nt, Homo Sapiens; identical to SEQ ID NO: 488893

SEQ ID NO: 739995 - RNA, 64 nt, Homo Sapiens; identical to SEQ ID NO: 488894

SEQ ID NO: 739996 - RNA, 64 nt, Homo Sapiens; identical to SEQ ID NO: 488895

SEQ ID NO: 739997 - RNA, 64 nt, Homo Sapiens; identical to SEQ ID NO: 488896

SEQ ID NO: 739998 - RNA, 64 nt, Homo Sapiens; identical to SEQ ID NO: 488897

SEQ ID NO: 739999 - RNA, 64 nt, Homo Sapiens; identical to SEQ ID NO: 488898

SEQ ID NO: 740000 - RNA, 64 nt, Homo Sapiens; identical to SEQ ID NO: 488899

SEQ ID NO: 740001 - RNA, 64 nt, Homo Sapiens; identical to SEQ ID NO: 488900

SEQ ID NO: 740002 - RNA, 64 nt, Homo Sapiens; identical to SEQ ID NO: 488901

SEQ ID NO: 740003 - RNA, 64 nt, Homo Sapiens; identical to SEQ ID NO: 488902

SEQ ID NO: 740004 - RNA, 64 nt, Homo Sapiens; identical to SEQ ID NO: 488903

SEQ ID NO: 740005 - RNA, 64 nt, Homo Sapiens; identical to SEQ ID NO: 488904

SEQ ID NO: 740006 - RNA, 64 nt, Homo Sapiens; identical to SEQ ID NO: 488905

SEQ ID NO: 740007 - RNA, 64 nt, Homo Sapiens; identical to SEQ ID NO: 488906

SEQ ID NO: 740008 - RNA, 64 nt, Homo Sapiens; identical to SEQ ID NO: 488907

SEQ ID NO: 740009 - RNA, 64 nt, Homo Sapiens; identical to SEQ ID NO: 488908

SEQ ID NO: 740010 - RNA, 64 nt, Homo Sapiens; identical to SEQ ID NO: 488909

SEQ ID NO: 740011 - RNA, 64 nt, Homo Sapiens; identical to SEQ ID NO: 488910

SEQ ID NO: 740012 - RNA, 64 nt, Homo Sapiens; identical to SEQ ID NO: 488911

SEQ ID NO: 740013 - RNA, 64 nt, Homo Sapiens; identical to SEQ ID NO: 488912

SEQ ID NO: 740014 - RNA, 64 nt, Homo Sapiens; identical to SEQ ID NO: 488913

SEQ ID NO: 740015 - RNA, 64 nt, Homo Sapiens; identical to SEQ ID NO: 488914

SEQ ID NO: 740016 - RNA, 64 nt, Homo Sapiens; identical to SEQ ID NO: 488915

SEQ ID NO: 740017 - RNA, 64 nt, Homo Sapiens; identical to SEQ ID NO: 488916

SEQ ID NO: 740018 - RNA, 64 nt, Homo Sapiens; identical to SEQ ID NO: 488917

SEQ ID NO: 740019 - RNA, 64 nt, Homo Sapiens; identical to SEQ ID NO: 488918

SEQ ID NO: 740020 - RNA, 64 nt, Homo Sapiens; identical to SEQ ID NO: 488919

SEQ ID NO: 740021 - RNA, 64 nt, Homo Sapiens; identical to SEQ ID NO: 488920

SEQ ID NO: 740022 - RNA, 64 nt, Homo Sapiens; identical to SEQ ID NO: 488921

SEQ ID NO: 740023 - RNA, 64 nt, Homo Sapiens; identical to SEQ ID NO: 488922

SEQ ID NO: 740024 - RNA, 64 nt, Homo Sapiens; identical to SEQ ID NO: 488923

SEQ ID NO: 740025 - RNA, 64 nt, Homo Sapiens; identical to SEQ ID NO: 488924

SEQ ID NO: 740026 - RNA, 64 nt, Homo Sapiens; identical to SEQ ID NO: 488925

SEQ ID NO: 740027 - RNA, 64 nt, Homo Sapiens; identical to SEQ ID NO: 488926

SEQ ID NO: 740028 - RNA, 64 nt, Homo Sapiens; identical to SEQ ID NO: 488927

SEQ ID NO: 740029 - RNA, 64 nt, Homo Sapiens; identical to SEQ ID NO: 488928

SEQ ID NO: 740030 - RNA, 64 nt, Homo Sapiens; identical to SEQ ID NO: 488929

SEQ ID NO: 740031 - RNA, 64 nt, Homo Sapiens; identical to SEQ ID NO: 488930

SEQ ID NO: 740032 - RNA, 64 nt, Homo Sapiens; identical to SEQ ID NO: 488931

SEQ ID NO: 740033 - RNA, 64 nt, Homo Sapiens; identical to SEQ ID NO: 488932

SEQ ID NO: 740034 - RNA, 64 nt, Homo Sapiens; identical to SEQ ID NO: 488933

SEQ ID NO: 740035 - RNA, 64 nt, Homo Sapiens; identical to SEQ ID NO: 488934

SEQ ID NO: 740036 - RNA, 64 nt, Homo Sapiens; identical to SEQ ID NO: 488935

SEQ ID NO: 740037 - RNA, 64 nt, Homo Sapiens; identical to SEQ ID NO: 488936

SEQ ID NO: 740038 - RNA, 64 nt, Homo Sapiens; identical to SEQ ID NO: 488937

SEQ ID NO: 740039 - RNA, 64 nt, Homo Sapiens; identical to SEQ ID NO: 488938

SEQ ID NO: 740040 - RNA, 64 nt, Homo Sapiens; identical to SEQ ID NO: 488939

SEQ ID NO: 740041 - RNA, 64 nt, Homo Sapiens; identical to SEQ ID NO: 488940

SEQ ID NO: 740042 - RNA, 64 nt, Homo Sapiens; identical to SEQ ID NO: 488941

SEQ ID NO: 740043 - RNA, 64 nt, Homo Sapiens; identical to SEQ ID NO: 488942

SEQ ID NO: 740044 - RNA, 64 nt, Homo Sapiens; identical to SEQ ID NO: 488943

SEQ ID NO: 740045 - RNA, 64 nt, Homo Sapiens; identical to SEQ ID NO: 488944

SEQ ID NO: 740046 - RNA, 64 nt, Homo Sapiens; identical to SEQ ID NO: 488945

SEQ ID NO: 740047 - RNA, 64 nt, Homo Sapiens; identical to SEQ ID NO: 488946

SEQ ID NO: 740048 - RNA, 64 nt, Homo Sapiens; identical to SEQ ID NO: 488947

SEQ ID NO: 740049 - RNA, 64 nt, Homo Sapiens; identical to SEQ ID NO: 488948

SEQ ID NO: 740050 - RNA, 64 nt, Homo Sapiens; identical to SEQ ID NO: 488949

SEQ ID NO: 740051 - RNA, 64 nt, Homo Sapiens; identical to SEQ ID NO: 488950

SEQ ID NO: 740052 - RNA, 64 nt, Homo Sapiens; identical to SEQ ID NO: 488951

SEQ ID NO: 740053 - RNA, 64 nt, Homo Sapiens; identical to SEQ ID NO: 488952

SEQ ID NO: 740054 - RNA, 64 nt, Homo Sapiens; identical to SEQ ID NO: 488953

SEQ ID NO: 740055 - RNA, 64 nt, Homo Sapiens; identical to SEQ ID NO: 488954

SEQ ID NO: 740056 - RNA, 64 nt, Homo Sapiens; identical to SEQ ID NO: 488955

SEQ ID NO: 740057 - RNA, 64 nt, Homo Sapiens; identical to SEQ ID NO: 488956

SEQ ID NO: 740058 - RNA, 64 nt, Homo Sapiens; identical to SEQ ID NO: 488957

SEQ ID NO: 740059 - RNA, 64 nt, Homo Sapiens; identical to SEQ ID NO: 488958

SEQ ID NO: 740060 - RNA, 64 nt, Homo Sapiens; identical to SEQ ID NO: 488959

SEQ ID NO: 740061 - RNA, 64 nt, Homo Sapiens; identical to SEQ ID NO: 488960

SEQ ID NO: 740062 - RNA, 64 nt, Homo Sapiens; identical to SEQ ID NO: 488961

SEQ ID NO: 740063 - RNA, 64 nt, Homo Sapiens; identical to SEQ ID NO: 488962

SEQ ID NO: 740064 - RNA, 64 nt, Homo Sapiens; identical to SEQ ID NO: 488963

SEQ ID NO: 740065 - RNA, 64 nt, Homo Sapiens; identical to SEQ ID NO: 488964

SEQ ID NO: 740066 - RNA, 64 nt, Homo Sapiens; identical to SEQ ID NO: 488965

SEQ ID NO: 740067 - RNA, 64 nt, Homo Sapiens; identical to SEQ ID NO: 488966

SEQ ID NO: 740068 - RNA, 64 nt, Homo Sapiens; identical to SEQ ID NO: 488967

SEQ ID NO: 740069 - RNA, 64 nt, Homo Sapiens; identical to SEQ ID NO: 488968

SEQ ID NO: 740070 - RNA, 64 nt, Homo Sapiens; identical to SEQ ID NO: 488969

SEQ ID NO: 740071 - RNA, 64 nt, Homo Sapiens; identical to SEQ ID NO: 488970

SEQ ID NO: 740072 - RNA, 64 nt, Homo Sapiens; identical to SEQ ID NO: 488971

SEQ ID NO: 740073 - RNA, 64 nt, Homo Sapiens; identical to SEQ ID NO: 488972

SEQ ID NO: 740074 - RNA, 64 nt, Homo Sapiens; identical to SEQ ID NO: 488973

SEQ ID NO: 740075 - RNA, 64 nt, Homo Sapiens; identical to SEQ ID NO: 488974

SEQ ID NO: 740076 - RNA, 64 nt, Homo Sapiens; identical to SEQ ID NO: 488975

SEQ ID NO: 740077 - RNA, 64 nt, Homo Sapiens; identical to SEQ ID NO: 488976

SEQ ID NO: 740078 - RNA, 64 nt, Homo Sapiens; identical to SEQ ID NO: 488977

SEQ ID NO: 740079 - RNA, 64 nt, Homo Sapiens; identical to SEQ ID NO: 488978

SEQ ID NO: 740080 - RNA, 64 nt, Homo Sapiens; identical to SEQ ID NO: 488979

SEQ ID NO: 740081 - RNA, 64 nt, Homo Sapiens; identical to SEQ ID NO: 488980

SEQ ID NO: 740082 - RNA, 64 nt, Homo Sapiens; identical to SEQ ID NO: 488981

SEQ ID NO: 740083 - RNA, 64 nt, Homo Sapiens; identical to SEQ ID NO: 488982

SEQ ID NO: 740084 - RNA, 64 nt, Homo Sapiens; identical to SEQ ID NO: 488983

SEQ ID NO: 740085 - RNA, 64 nt, Homo Sapiens; identical to SEQ ID NO: 488984

SEQ ID NO: 740086 - RNA, 64 nt, Homo Sapiens; identical to SEQ ID NO: 488985

SEQ ID NO: 740087 - RNA, 64 nt, Homo Sapiens; identical to SEQ ID NO: 488986

SEQ ID NO: 740088 - RNA, 64 nt, Homo Sapiens; identical to SEQ ID NO: 488987

SEQ ID NO: 740089 - RNA, 64 nt, Homo Sapiens; identical to SEQ ID NO: 488988

SEQ ID NO: 740090 - RNA, 64 nt, Homo Sapiens; identical to SEQ ID NO: 488989

SEQ ID NO: 740091 - RNA, 64 nt, Homo Sapiens; identical to SEQ ID NO: 488990

SEQ ID NO: 740092 - RNA, 64 nt, Homo Sapiens; identical to SEQ ID NO: 488991

SEQ ID NO: 740093 - RNA, 64 nt, Homo Sapiens; identical to SEQ ID NO: 488992

SEQ ID NO: 740094 - RNA, 64 nt, Homo Sapiens; identical to SEQ ID NO: 488993

SEQ ID NO: 740095 - RNA, 64 nt, Homo Sapiens; identical to SEQ ID NO: 488994

SEQ ID NO: 740096 - RNA, 64 nt, Homo Sapiens; identical to SEQ ID NO: 488995

SEQ ID NO: 740097 - RNA, 64 nt, Homo Sapiens; identical to SEQ ID NO: 488996

SEQ ID NO: 740098 - RNA, 64 nt, Homo Sapiens; identical to SEQ ID NO: 488997

SEQ ID NO: 740099 - RNA, 64 nt, Homo Sapiens; identical to SEQ ID NO: 488998

SEQ ID NO: 740100 - RNA, 64 nt, Homo Sapiens; identical to SEQ ID NO: 488999

SEQ ID NO: 740101 - RNA, 64 nt, Homo Sapiens; identical to SEQ ID NO: 489000

SEQ ID NO: 740102 - RNA, 64 nt, Homo Sapiens; identical to SEQ ID NO: 489001

SEQ ID NO: 740103 - RNA, 64 nt, Homo Sapiens; identical to SEQ ID NO: 489002

SEQ ID NO: 740104 - RNA, 64 nt, Homo Sapiens; identical to SEQ ID NO: 489003

SEQ ID NO: 740105 - RNA, 64 nt, Homo Sapiens; identical to SEQ ID NO: 489004

SEQ ID NO: 740106 - RNA, 64 nt, Homo Sapiens; identical to SEQ ID NO: 489005

SEQ ID NO: 740107 - RNA, 64 nt, Homo Sapiens; identical to SEQ ID NO: 489006

SEQ ID NO: 740108 - RNA, 64 nt, Homo Sapiens; identical to SEQ ID NO: 489007

SEQ ID NO: 740109 - RNA, 64 nt, Homo Sapiens; identical to SEQ ID NO: 489008

SEQ ID NO: 740110 - RNA, 64 nt, Homo Sapiens; identical to SEQ ID NO: 489009

SEQ ID NO: 740111 - RNA, 64 nt, Homo Sapiens; identical to SEQ ID NO: 489010

SEQ ID NO: 740112 - RNA, 64 nt, Homo Sapiens; identical to SEQ ID NO: 489011

SEQ ID NO: 740113 - RNA, 64 nt, Homo Sapiens; identical to SEQ ID NO: 489012

SEQ ID NO: 740114 - RNA, 64 nt, Homo Sapiens; identical to SEQ ID NO: 489013

SEQ ID NO: 740115 - RNA, 64 nt, Homo Sapiens; identical to SEQ ID NO: 489014

SEQ ID NO: 740116 - RNA, 64 nt, Homo Sapiens; identical to SEQ ID NO: 489015

SEQ ID NO: 740117 - RNA, 64 nt, Homo Sapiens; identical to SEQ ID NO: 489016

SEQ ID NO: 740118 - RNA, 64 nt, Homo Sapiens; identical to SEQ ID NO: 489017

SEQ ID NO: 740119 - RNA, 64 nt, Homo Sapiens; identical to SEQ ID NO: 489018

SEQ ID NO: 740120 - RNA, 64 nt, Homo Sapiens; identical to SEQ ID NO: 489019

SEQ ID NO: 740121 - RNA, 64 nt, Homo Sapiens; identical to SEQ ID NO: 489020

SEQ ID NO: 740122 - RNA, 64 nt, Homo Sapiens; identical to SEQ ID NO: 489021

SEQ ID NO: 740123 - RNA, 64 nt, Homo Sapiens; identical to SEQ ID NO: 489022

SEQ ID NO: 740124 - RNA, 64 nt, Homo Sapiens; identical to SEQ ID NO: 489023

SEQ ID NO: 740125 - RNA, 64 nt, Homo Sapiens; identical to SEQ ID NO: 489024

SEQ ID NO: 740126 - RNA, 64 nt, Homo Sapiens; identical to SEQ ID NO: 489025

SEQ ID NO: 740127 - RNA, 64 nt, Homo Sapiens; identical to SEQ ID NO: 489026

SEQ ID NO: 740128 - RNA, 64 nt, Homo Sapiens; identical to SEQ ID NO: 489027

SEQ ID NO: 740129 - RNA, 64 nt, Homo Sapiens; identical to SEQ ID NO: 489028

SEQ ID NO: 740130 - RNA, 64 nt, Homo Sapiens; identical to SEQ ID NO: 489029

SEQ ID NO: 740131 - RNA, 64 nt, Homo Sapiens; identical to SEQ ID NO: 489030

SEQ ID NO: 740132 - RNA, 64 nt, Homo Sapiens; identical to SEQ ID NO: 489031

SEQ ID NO: 740133 - RNA, 64 nt, Homo Sapiens; identical to SEQ ID NO: 489032

SEQ ID NO: 740134 - RNA, 64 nt, Homo Sapiens; identical to SEQ ID NO: 489033

SEQ ID NO: 740135 - RNA, 64 nt, Homo Sapiens; identical to SEQ ID NO: 489034

SEQ ID NO: 740136 - RNA, 64 nt, Homo Sapiens; identical to SEQ ID NO: 489035

SEQ ID NO: 740137 - RNA, 64 nt, Homo Sapiens; identical to SEQ ID NO: 489036

SEQ ID NO: 740138 - RNA, 64 nt, Homo Sapiens; identical to SEQ ID NO: 489037

SEQ ID NO: 740139 - RNA, 64 nt, Homo Sapiens; identical to SEQ ID NO: 489038

SEQ ID NO: 740140 - RNA, 64 nt, Homo Sapiens; identical to SEQ ID NO: 489039

SEQ ID NO: 740141 - RNA, 64 nt, Homo Sapiens; identical to SEQ ID NO: 489040

SEQ ID NO: 740142 - RNA, 64 nt, Homo Sapiens; identical to SEQ ID NO: 489041

SEQ ID NO: 740143 - RNA, 64 nt, Homo Sapiens; identical to SEQ ID NO: 489042

SEQ ID NO: 740144 - RNA, 64 nt, Homo Sapiens; identical to SEQ ID NO: 489043

SEQ ID NO: 740145 - RNA, 64 nt, Homo Sapiens; identical to SEQ ID NO: 489044

SEQ ID NO: 740146 - RNA, 64 nt, Homo Sapiens; identical to SEQ ID NO: 489045

SEQ ID NO: 740147 - RNA, 64 nt, Homo Sapiens; identical to SEQ ID NO: 489046

SEQ ID NO: 740148 - RNA, 64 nt, Homo Sapiens; identical to SEQ ID NO: 489047

SEQ ID NO: 740149 - RNA, 64 nt, Homo Sapiens; identical to SEQ ID NO: 489048

SEQ ID NO: 740150 - RNA, 64 nt, Homo Sapiens; identical to SEQ ID NO: 489049

SEQ ID NO: 740151 - RNA, 64 nt, Homo Sapiens; identical to SEQ ID NO: 489050

SEQ ID NO: 740152 - RNA, 64 nt, Homo Sapiens; identical to SEQ ID NO: 489051

SEQ ID NO: 740153 - RNA, 64 nt, Homo Sapiens; identical to SEQ ID NO: 489052

SEQ ID NO: 740154 - RNA, 64 nt, Homo Sapiens; identical to SEQ ID NO: 489053

SEQ ID NO: 740155 - RNA, 64 nt, Homo Sapiens; identical to SEQ ID NO: 489054

SEQ ID NO: 740156 - RNA, 64 nt, Homo Sapiens; identical to SEQ ID NO: 489055

SEQ ID NO: 740157 - RNA, 64 nt, Homo Sapiens; identical to SEQ ID NO: 489056

SEQ ID NO: 740158 - RNA, 64 nt, Homo Sapiens; identical to SEQ ID NO: 489057

SEQ ID NO: 740159 - RNA, 63 nt, Homo Sapiens
auauaggauuacaaaggaauucauguuuuuaaaugcauaaaaucuaugaaugccuucuuaaaa

SEQ ID NO: 740160 - RNA, 63 nt, Homo Sapiens
acaagcacuuuggaagaauuuaaaguaaagaaaugcauaaaagcacauauuuuuauauuaugu

SEQ ID NO: 740161 - RNA, 63 nt, Homo Sapiens
ugggcuaauuuguauguuuccauagcuacuauaugcauaaacaacaguaccugaaggauuauu

SEQ ID NO: 740162 - RNA, 63 nt, Homo Sapiens
aauggucacaaggucuuuacuuaugcacauuugugcauaaauuuccacccaauuuccaagaca

SEQ ID NO: 740163 - RNA, 63 nt, Homo Sapiens
agcaaaacucccuuuuuucucuugccuuuuuuaugcauaaauggaggucaauuugauuguccu

SEQ ID NO: 740164 - RNA, 63 nt, Homo Sapiens
accagaagacuuugaaguuguauauucuugcaaugcauaaaaugacauuauaaucaacaaacu

SEQ ID NO: 740165 - RNA, 64 nt, Homo Sapiens
acuggaauggauuucucaaugcgggaccagauuaugacuagaguuuuuaugccagaaggaauca

SEQ ID NO: 740166 - RNA, 64 nt, Homo Sapiens
acaagucccuaaguuuccuuauuuuaauuuacugugacuagauuugaagcaaauaaauacucca

SEQ ID NO: 740167 - RNA, 64 nt, Homo Sapiens
uuucucagguucuuaacagccugugcaaacucccugacuagauggucugucacuccuaucauua

SEQ ID NO: 740168 - RNA, 64 nt, Homo Sapiens
cuaagcauguggcauaaauuuggagaaaauaauaugacuagaaaaauuaguguuauauugggug

SEQ ID NO: 740169 - RNA, 64 nt, Homo Sapiens
ggcaagggaggcauagccggaaacaguuauuuggugacuagaaagcuccccuuuucuuguuuga

SEQ ID NO: 740170 - RNA, 64 nt, Homo Sapiens
agaaccgucuuuacccgggcgguaacccccaucaugacuagacgcacacuucuuuuggucugaa

SEQ ID NO: 740171 - RNA, 62 nt, Homo Sapiens
gugacuagagggugguggagguaaggccuuccagagcccauggcuucaggagagggucucuc

SEQ ID NO: 740172 - RNA, 62 nt, Homo Sapiens
gaagcuuuaacaugguucaggcccuuggugugagagcccagggggaggacagcuugucugcu

SEQ ID NO: 740173 - RNA, 62 nt, Homo Sapiens
cccaugcccaccaguguuggcucaccugccacagagcccacacacaucaguguuuccgucug

SEQ ID NO: 740174 - RNA, 62 nt, Homo Sapiens
uccgcccugggcaggagcccccuguuccccagagagcccaccugggaagacacauucccuuc

SEQ ID NO: 740175 - RNA, 62 nt, Homo Sapiens
cugcuggaacagccaaggaccauccggcucacagagcccagacgucugugcugccugguuug

SEQ ID NO: 740176 - RNA, 62 nt, Homo Sapiens
ccccacgucuuacagucgccguugagcaauggagagcccagcucucccagacaggagccagg

SEQ ID NO: 740177 - RNA, 62 nt, Homo Sapiens
agcagcccuggcccuguaagcacuugguagaaagagcccagauuguuuugaacuuccuuucc

SEQ ID NO: 740178 - RNA, 62 nt, Homo Sapiens
gggccggccggguuccugguccuccccaccggagagcccaggcagccuuauuucugccgggg

SEQ ID NO: 740179 - RNA, 62 nt, Homo Sapiens
agucagugcuggugguuggacugugauucuucagagcccaggauuuuauauaaaaaguguuu

SEQ ID NO: 740180 - RNA, 62 nt, Homo Sapiens
acaccacaaagagcagcaccgcagaacagaccagagcccaccgcucccaggcccagcaccga

SEQ ID NO: 740181 - RNA, 62 nt, Homo Sapiens
aucauugaaguggagcccggcacaggggucauagagcccagugaggucggggauuuugaguu

SEQ ID NO: 740182 - RNA, 62 nt, Homo Sapiens
cagccagcucccagccacauggcgcaugaaggagagcccagucucccuccaggaaaggccug

SEQ ID NO: 740183 - RNA, 62 nt, Homo Sapiens
ccugaccagaggggagguggauggcacuuuccagagcccagguucuuauggcauuucccagg

SEQ ID NO: 740184 - RNA, 62 nt, Homo Sapiens
ugugcccacugcccgugcagccuccuucagccagagcccagagcauagacaggaguguagga

SEQ ID NO: 740185 - RNA, 62 nt, Homo Sapiens
cugaguugaagaaccuauugugaugguuucccagagcccacaaaguguuccguacccacugc

SEQ ID NO: 740186 - RNA, 62 nt, Homo Sapiens
gaaguguuccguacccacugugaccccagggcagagcccagaugacucccauuugcucucag

SEQ ID NO: 740187 - RNA, 62 nt, Homo Sapiens
cugcaagaccuggcugagccuuagaucucagcagagcccauucagauagcaaaugugucugg

SEQ ID NO: 740188 - RNA, 62 nt, Homo Sapiens
gucaggaguucguucaguaagcucaucagcucagagcccaggauuaacaccuucuggagcca

SEQ ID NO: 740189 - RNA, 62 nt, Homo Sapiens
auccaucucugucaucaucuaccaggacccucagagcccagcccuggauguccuucgaagga

SEQ ID NO: 740190 - RNA, 62 nt, Homo Sapiens
aucucagaggccccuggaugaggccaggaaccagagcccaucccugcuccuacccaugcuac

SEQ ID NO: 740191 - RNA, 62 nt, Homo Sapiens
aaauccugagugucaguuugagcauuguaaugagagcccaucuuuguuccuguuaaauguau

SEQ ID NO: 740192 - RNA, 62 nt, Homo Sapiens
cuacagugggugguuuuggucaguaacauccaagagcccauuguuaccuugaccacgcugua

SEQ ID NO: 740193 - RNA, 62 nt, Homo Sapiens
ugcacugugugaugaugggagcaaggggcugcagagcccagguugcugcggcugcaauggag

SEQ ID NO: 740194 - RNA, 62 nt, Homo Sapiens
ccagugcagucccggcuguguagagagcaauaagagcccagcccuaucagugccccccagag

SEQ ID NO: 740195 - RNA, 62 nt, Homo Sapiens
ccccuccacgggggucccagcagugaccgggcagagcccaacuuguauauacccugcaccag

SEQ ID NO: 740196 - RNA, 62 nt, Homo Sapiens
cuggccucaucugcaccaugacccagacugccagagcccaggaccucccugcacauggcacu

SEQ ID NO: 740197 - RNA, 62 nt, Homo Sapiens
ugggcacagagaaggguggauacaucugcuggagagcccaggcuuuggagaaaccaaccaga

SEQ ID NO: 740198 - RNA, 62 nt, Homo Sapiens
aagaacugcugucaugaaggaacaguguuaccagagcccaguccuugaagggcaaggaggga

SEQ ID NO: 740199 - RNA, 62 nt, Homo Sapiens
aucaaaauguuaacacaaagcuaagauucaucagagcccacccuauucuaaggaaccacaau

SEQ ID NO: 740200 - RNA, 62 nt, Homo Sapiens
aacucugguaaagcauccuguggagggagaggagagcccagucauuugcuuagaugguguuu

SEQ ID NO: 740201 - RNA, 62 nt, Homo Sapiens
uccucaguuccuguggauagcuguaagaguccagagcccaccgucucacucucaggacuauu

SEQ ID NO: 740202 - RNA, 62 nt, Homo Sapiens
gggaugagaggagagagcaaaucucucccacuagagcccagaagccuaaacagggcacauag

SEQ ID NO: 740203 - RNA, 62 nt, Homo Sapiens
aauggaggcugcaggaggcucaggcccagccaagagcccaugguugaggcccuaacaaauuu

SEQ ID NO: 740204 - RNA, 62 nt, Homo Sapiens
cccaagccuggcaccaagccggcugacuuuccagagcccaguggccuugaaguagcagccuu

SEQ ID NO: 740205 - RNA, 62 nt, Homo Sapiens
gcuagugcuaagagggaaggcccagguuugagagagcccagaggggcagagcccagagccuu

SEQ ID NO: 740206 - RNA, 62 nt, Homo Sapiens
gaaggcccagguuugagagagcccagaggggcagagcccagagccuuguuuggcccugaucu

SEQ ID NO: 740207 - RNA, 62 nt, Homo Sapiens
auccccaucggcccuguccccuggagugugucagagcccaggggagaaugcagcccaccagg

SEQ ID NO: 740208 - RNA, 62 nt, Homo Sapiens
guugaucuacccgugccugggccccuccccucagagcccaugguaacgaaccccuagaaagg

SEQ ID NO: 740209 - RNA, 62 nt, Homo Sapiens
gucccagaagcagucccugacccccagcuuucagagcccagccaccagcuuggggcuggaug

SEQ ID NO: 740210 - RNA, 62 nt, Homo Sapiens
uacacagaagugauaaaggaauccaaaguugaagagcccaggaaacgggaaacuguauccau

SEQ ID NO: 740211 - RNA, 62 nt, Homo Sapiens
ugcaaccagucuggggccauucagccagggacagagcccacagagcccauacaccugucucc

SEQ ID NO: 740212 - RNA, 62 nt, Homo Sapiens
ucuggggccauucagccagggacagagcccacagagcccauacaccugucucccaccagcgg

SEQ ID NO: 740213 - RNA, 64 nt, Homo Sapiens
ggagagucaaggaaaccgcuugccaggcaaaacacuagcucaaagguauuaccucugugcucag

SEQ ID NO: 740214 - RNA, 64 nt, Homo Sapiens
ccaucucuaauuauaaaacauuauuauuucagaacuagcucagcaugucagguuuuugguuuua

SEQ ID NO: 740215 - RNA, 64 nt, Homo Sapiens
agggauuguaaauacaccgaugggcacucuguaucuagcucaagguuuguaaacacaccaauca

SEQ ID NO: 740216 - RNA, 64 nt, Homo Sapiens
aagguuuguaaacacaccaaucagcacccugugucuagcucaguguuugugaaugcaccaaucc

SEQ ID NO: 740217 - RNA, 64 nt, Homo Sapiens
gcuaaucuaguggggauguggagaaccuuugugucuagcucagggaucguaaacgcaccaauca

SEQ ID NO: 740218 - RNA, 64 nt, Homo Sapiens; identical to SEQ ID NO: 178899

SEQ ID NO: 740219 - RNA, 64 nt, Homo Sapiens; identical to SEQ ID NO: 178900

SEQ ID NO: 740220 - RNA, 64 nt, Homo Sapiens; identical to SEQ ID NO: 178901

SEQ ID NO: 740221 - RNA, 64 nt, Homo Sapiens; identical to SEQ ID NO: 178902

SEQ ID NO: 740222 - RNA, 64 nt, Homo Sapiens; identical to SEQ ID NO: 178903

SEQ ID NO: 740223 - RNA, 64 nt, Homo Sapiens; identical to SEQ ID NO: 178904

SEQ ID NO: 740224 - RNA, 64 nt, Homo Sapiens; identical to SEQ ID NO: 178905

SEQ ID NO: 740225 - RNA, 64 nt, Homo Sapiens; identical to SEQ ID NO: 178906

SEQ ID NO: 740226 - RNA, 64 nt, Homo Sapiens; identical to SEQ ID NO: 178907

SEQ ID NO: 740227 - RNA, 64 nt, Homo Sapiens; identical to SEQ ID NO: 178908

SEQ ID NO: 740228 - RNA, 64 nt, Homo Sapiens; identical to SEQ ID NO: 178909

SEQ ID NO: 740229 - RNA, 64 nt, Homo Sapiens; identical to SEQ ID NO: 178910

SEQ ID NO: 740230 - RNA, 64 nt, Homo Sapiens; identical to SEQ ID NO: 178911

SEQ ID NO: 740231 - RNA, 64 nt, Homo Sapiens; identical to SEQ ID NO: 178912

SEQ ID NO: 740232 - RNA, 64 nt, Homo Sapiens; identical to SEQ ID NO: 178913

SEQ ID NO: 740233 - RNA, 64 nt, Homo Sapiens; identical to SEQ ID NO: 178914

SEQ ID NO: 740234 - RNA, 64 nt, Homo Sapiens; identical to SEQ ID NO: 178915

SEQ ID NO: 740235 - RNA, 64 nt, Homo Sapiens; identical to SEQ ID NO: 178916

SEQ ID NO: 740236 - RNA, 64 nt, Homo Sapiens; identical to SEQ ID NO: 178917

SEQ ID NO: 740237 - RNA, 64 nt, Homo Sapiens; identical to SEQ ID NO: 178918

SEQ ID NO: 740238 - RNA, 64 nt, Homo Sapiens; identical to SEQ ID NO: 178919

SEQ ID NO: 740239 - RNA, 64 nt, Homo Sapiens; identical to SEQ ID NO: 178920

SEQ ID NO: 740240 - RNA, 64 nt, Homo Sapiens; identical to SEQ ID NO: 178921

SEQ ID NO: 740241 - RNA, 64 nt, Homo Sapiens; identical to SEQ ID NO: 178922

SEQ ID NO: 740242 - RNA, 64 nt, Homo Sapiens; identical to SEQ ID NO: 178923

SEQ ID NO: 740243 - RNA, 64 nt, Homo Sapiens; identical to SEQ ID NO: 178924

SEQ ID NO: 740244 - RNA, 58 nt, Homo Sapiens; identical to SEQ ID NO: 178925

SEQ ID NO: 740245 - RNA, 64 nt, Homo Sapiens; identical to SEQ ID NO: 178926

SEQ ID NO: 740246 - RNA, 64 nt, Homo Sapiens; identical to SEQ ID NO: 178927

SEQ ID NO: 740247 - RNA, 64 nt, Homo Sapiens; identical to SEQ ID NO: 178928

SEQ ID NO: 740248 - RNA, 64 nt, Homo Sapiens; identical to SEQ ID NO: 178929

SEQ ID NO: 740249 - RNA, 64 nt, Homo Sapiens; identical to SEQ ID NO: 178930

SEQ ID NO: 740250 - RNA, 64 nt, Homo Sapiens; identical to SEQ ID NO: 178931

SEQ ID NO: 740251 - RNA, 64 nt, Homo Sapiens; identical to SEQ ID NO: 178932

SEQ ID NO: 740252 - RNA, 64 nt, Homo Sapiens; identical to SEQ ID NO: 178933

SEQ ID NO: 740253 - RNA, 64 nt, Homo Sapiens; identical to SEQ ID NO: 178934

SEQ ID NO: 740254 - RNA, 64 nt, Homo Sapiens; identical to SEQ ID NO: 178935

SEQ ID NO: 740255 - RNA, 64 nt, Homo Sapiens; identical to SEQ ID NO: 178936

SEQ ID NO: 740256 - RNA, 64 nt, Homo Sapiens; identical to SEQ ID NO: 178937

SEQ ID NO: 740257 - RNA, 64 nt, Homo Sapiens; identical to SEQ ID NO: 178938

SEQ ID NO: 740258 - RNA, 64 nt, Homo Sapiens; identical to SEQ ID NO: 178939

SEQ ID NO: 740259 - RNA, 64 nt, Homo Sapiens; identical to SEQ ID NO: 178940

SEQ ID NO: 740260 - RNA, 64 nt, Homo Sapiens; identical to SEQ ID NO: 178941

SEQ ID NO: 740261 - RNA, 64 nt, Homo Sapiens; identical to SEQ ID NO: 178942

SEQ ID NO: 740262 - RNA, 64 nt, Homo Sapiens; identical to SEQ ID NO: 178943

SEQ ID NO: 740263 - RNA, 64 nt, Homo Sapiens; identical to SEQ ID NO: 178944

SEQ ID NO: 740264 - RNA, 60 nt, Homo Sapiens; identical to SEQ ID NO: 178945

SEQ ID NO: 740265 - RNA, 64 nt, Homo Sapiens; identical to SEQ ID NO: 178946

SEQ ID NO: 740266 - RNA, 64 nt, Homo Sapiens; identical to SEQ ID NO: 178947

SEQ ID NO: 740267 - RNA, 64 nt, Homo Sapiens; identical to SEQ ID NO: 178948

SEQ ID NO: 740268 - RNA, 64 nt, Homo Sapiens; identical to SEQ ID NO: 178949

SEQ ID NO: 740269 - RNA, 64 nt, Homo Sapiens; identical to SEQ ID NO: 178950

SEQ ID NO: 740270 - RNA, 64 nt, Homo Sapiens; identical to SEQ ID NO: 178951

SEQ ID NO: 740271 - RNA, 64 nt, Homo Sapiens; identical to SEQ ID NO: 178952

SEQ ID NO: 740272 - RNA, 64 nt, Homo Sapiens; identical to SEQ ID NO: 178953

SEQ ID NO: 740273 - RNA, 64 nt, Homo Sapiens; identical to SEQ ID NO: 178954

SEQ ID NO: 740274 - RNA, 64 nt, Homo Sapiens; identical to SEQ ID NO: 178955

SEQ ID NO: 740275 - RNA, 64 nt, Homo Sapiens; identical to SEQ ID NO: 178956

SEQ ID NO: 740276 - RNA, 64 nt, Homo Sapiens; identical to SEQ ID NO: 178957

SEQ ID NO: 740277 - RNA, 64 nt, Homo Sapiens; identical to SEQ ID NO: 178958

SEQ ID NO: 740278 - RNA, 64 nt, Homo Sapiens; identical to SEQ ID NO: 178959

SEQ ID NO: 740279 - RNA, 64 nt, Homo Sapiens; identical to SEQ ID NO: 178960

SEQ ID NO: 740280 - RNA, 64 nt, Homo Sapiens; identical to SEQ ID NO: 178961

SEQ ID NO: 740281 - RNA, 64 nt, Homo Sapiens; identical to SEQ ID NO: 178962

SEQ ID NO: 740282 - RNA, 64 nt, Homo Sapiens; identical to SEQ ID NO: 178963

SEQ ID NO: 740283 - RNA, 64 nt, Homo Sapiens; identical to SEQ ID NO: 178964

SEQ ID NO: 740284 - RNA, 64 nt, Homo Sapiens; identical to SEQ ID NO: 178965

SEQ ID NO: 740285 - RNA, 64 nt, Homo Sapiens; identical to SEQ ID NO: 178966

SEQ ID NO: 740286 - RNA, 64 nt, Homo Sapiens; identical to SEQ ID NO: 178967

SEQ ID NO: 740287 - RNA, 64 nt, Homo Sapiens; identical to SEQ ID NO: 178968

SEQ ID NO: 740288 - RNA, 64 nt, Homo Sapiens; identical to SEQ ID NO: 178969

SEQ ID NO: 740289 - RNA, 64 nt, Homo Sapiens; identical to SEQ ID NO: 178970

SEQ ID NO: 740290 - RNA, 64 nt, Homo Sapiens; identical to SEQ ID NO: 178971

SEQ ID NO: 740291 - RNA, 64 nt, Homo Sapiens; identical to SEQ ID NO: 178972

SEQ ID NO: 740292 - RNA, 64 nt, Homo Sapiens; identical to SEQ ID NO: 178973

SEQ ID NO: 740293 - RNA, 64 nt, Homo Sapiens; identical to SEQ ID NO: 178974

SEQ ID NO: 740294 - RNA, 64 nt, Homo Sapiens; identical to SEQ ID NO: 178975

SEQ ID NO: 740295 - RNA, 64 nt, Homo Sapiens; identical to SEQ ID NO: 178976

SEQ ID NO: 740296 - RNA, 64 nt, Homo Sapiens; identical to SEQ ID NO: 178977

SEQ ID NO: 740297 - RNA, 64 nt, Homo Sapiens; identical to SEQ ID NO: 178978

SEQ ID NO: 740298 - RNA, 64 nt, Homo Sapiens; identical to SEQ ID NO: 178979

SEQ ID NO: 740299 - RNA, 64 nt, Homo Sapiens; identical to SEQ ID NO: 178980

SEQ ID NO: 740300 - RNA, 64 nt, Homo Sapiens; identical to SEQ ID NO: 178981

SEQ ID NO: 740301 - RNA, 64 nt, Homo Sapiens; identical to SEQ ID NO: 178982

SEQ ID NO: 740302 - RNA, 64 nt, Homo Sapiens; identical to SEQ ID NO: 178983

SEQ ID NO: 740303 - RNA, 64 nt, Homo Sapiens; identical to SEQ ID NO: 178984

SEQ ID NO: 740304 - RNA, 64 nt, Homo Sapiens; identical to SEQ ID NO: 178985

SEQ ID NO: 740305 - RNA, 64 nt, Homo Sapiens; identical to SEQ ID NO: 178986

SEQ ID NO: 740306 - RNA, 64 nt, Homo Sapiens; identical to SEQ ID NO: 178987

SEQ ID NO: 740307 - RNA, 64 nt, Homo Sapiens; identical to SEQ ID NO: 178988

SEQ ID NO: 740308 - RNA, 64 nt, Homo Sapiens; identical to SEQ ID NO: 178989

SEQ ID NO: 740309 - RNA, 64 nt, Homo Sapiens; identical to SEQ ID NO: 178990

SEQ ID NO: 740310 - RNA, 64 nt, Homo Sapiens; identical to SEQ ID NO: 178991

SEQ ID NO: 740311 - RNA, 64 nt, Homo Sapiens
aggagcuggcuuucagccccguaaacagcccaugcacguggaggugcagaggaguuugggaggu

SEQ ID NO: 740312 - RNA, 64 nt, Homo Sapiens
cuaggaggucucaggugcugggagaaccucuguccacguggaggcuagugccucugcuugggga

SEQ ID NO: 740313 - RNA, 64 nt, Homo Sapiens
cccugggaggccggcagccaggccacagaauccacacguggaccauugugggucccugggaggc

SEQ ID NO: 740314 - RNA, 64 nt, Homo Sapiens
cccugggaggccggcagccaggccacggaauccacacguggaccauugugggucccuugggagg

SEQ ID NO: 740315 - RNA, 64 nt, Homo Sapiens
cagaggcagacuggagugauacagagcaggaggacacguggagaacagaagaggagacacagac

SEQ ID NO: 740316 - RNA, 64 nt, Homo Sapiens
uggaucccaggcucucuugggggugcugggacaucacguggaaugaagagcucugacucuccag

SEQ ID NO: 740317 - RNA, 64 nt, Homo Sapiens
uacuaaugggaauuucuacaauaucauaugaauuguauaucaaucaaauguguucauguauugu

SEQ ID NO: 740318 - RNA, 64 nt, Homo Sapiens
ugaauuguauaucaauuacuuguguucauguauuguauaucauagaaggugcugggcauucaaa

SEQ ID NO: 740319 - RNA, 64 nt, Homo Sapiens
gggguaguuuggcugccauucucacugacaaaauguauaucagcccccaccuccaccccccaau

SEQ ID NO: 740320 - RNA, 64 nt, Homo Sapiens
aacaguugguuuuaguguguuguauaacuuugcuguauaucaaacuaauuuugacaaguuuuca

SEQ ID NO: 740321 - RNA, 64 nt, Homo Sapiens
uucaucucuuaccaagacugaaauggccucugaaguauaucaguuaaaagcaguacuccuaggg

SEQ ID NO: 740322 - RNA, 64 nt, Homo Sapiens
aacauuuucccaaauaaacacuccuauguucuguguauaucauugcaugccuucuuuauuccag

SEQ ID NO: 740323 - RNA, 64 nt, Homo Sapiens
ucucuguuaguacuauuggcauauucaaaaccugguauaucaagguauuuuaagcuuuacuuag

SEQ ID NO: 740324 - RNA, 64 nt, Homo Sapiens
acauacuuccugguuuuggaaaugaggcagaaaaguauaucaagugagcauaggaaaauuuugg

SEQ ID NO: 740325 - RNA, 64 nt, Homo Sapiens
cauuauagagaaagacagaaggccauguuucacaguauaucaaggccagcuacagaguugagcu

SEQ ID NO: 740326 - RNA, 64 nt, Homo Sapiens; identical to SEQ ID NO: 23251

SEQ ID NO: 740327 - RNA, 64 nt, Homo Sapiens; identical to SEQ ID NO: 23252

SEQ ID NO: 740328 - RNA, 64 nt, Homo Sapiens; identical to SEQ ID NO: 23253

SEQ ID NO: 740329 - RNA, 64 nt, Homo Sapiens; identical to SEQ ID NO: 23254

SEQ ID NO: 740330 - RNA, 64 nt, Homo Sapiens; identical to SEQ ID NO: 23255

SEQ ID NO: 740331 - RNA, 64 nt, Homo Sapiens; identical to SEQ ID NO: 23256

SEQ ID NO: 740332 - RNA, 64 nt, Homo Sapiens; identical to SEQ ID NO: 23257

SEQ ID NO: 740333 - RNA, 64 nt, Homo Sapiens; identical to SEQ ID NO: 23258

SEQ ID NO: 740334 - RNA, 64 nt, Homo Sapiens; identical to SEQ ID NO: 23259

SEQ ID NO: 740335 - RNA, 64 nt, Homo Sapiens; identical to SEQ ID NO: 23260

SEQ ID NO: 740336 - RNA, 64 nt, Homo Sapiens; identical to SEQ ID NO: 23261

SEQ ID NO: 740337 - RNA, 64 nt, Homo Sapiens; identical to SEQ ID NO: 23262

SEQ ID NO: 740338 - RNA, 64 nt, Homo Sapiens; identical to SEQ ID NO: 23263

SEQ ID NO: 740339 - RNA, 64 nt, Homo Sapiens; identical to SEQ ID NO: 23264

SEQ ID NO: 740340 - RNA, 64 nt, Homo Sapiens; identical to SEQ ID NO: 23265

SEQ ID NO: 740341 - RNA, 64 nt, Homo Sapiens; identical to SEQ ID NO: 23266

SEQ ID NO: 740342 - RNA, 64 nt, Homo Sapiens; identical to SEQ ID NO: 23267

SEQ ID NO: 740343 - RNA, 64 nt, Homo Sapiens; identical to SEQ ID NO: 23268

SEQ ID NO: 740344 - RNA, 64 nt, Homo Sapiens; identical to SEQ ID NO: 23269

SEQ ID NO: 740345 - RNA, 64 nt, Homo Sapiens; identical to SEQ ID NO: 23270

SEQ ID NO: 740346 - RNA, 64 nt, Homo Sapiens; identical to SEQ ID NO: 23271

SEQ ID NO: 740347 - RNA, 64 nt, Homo Sapiens; identical to SEQ ID NO: 23272

SEQ ID NO: 740348 - RNA, 64 nt, Homo Sapiens; identical to SEQ ID NO: 23273

SEQ ID NO: 740349 - RNA, 64 nt, Homo Sapiens; identical to SEQ ID NO: 23274

SEQ ID NO: 740350 - RNA, 64 nt, Homo Sapiens; identical to SEQ ID NO: 23275

SEQ ID NO: 740351 - RNA, 64 nt, Homo Sapiens; identical to SEQ ID NO: 23276

SEQ ID NO: 740352 - RNA, 64 nt, Homo Sapiens; identical to SEQ ID NO: 23277

SEQ ID NO: 740353 - RNA, 64 nt, Homo Sapiens; identical to SEQ ID NO: 23278

SEQ ID NO: 740354 - RNA, 64 nt, Homo Sapiens; identical to SEQ ID NO: 23279

SEQ ID NO: 740355 - RNA, 64 nt, Homo Sapiens; identical to SEQ ID NO: 23280

SEQ ID NO: 740356 - RNA, 64 nt, Homo Sapiens; identical to SEQ ID NO: 23281

SEQ ID NO: 740357 - RNA, 64 nt, Homo Sapiens; identical to SEQ ID NO: 23282

SEQ ID NO: 740358 - RNA, 64 nt, Homo Sapiens; identical to SEQ ID NO: 23283

SEQ ID NO: 740359 - RNA, 64 nt, Homo Sapiens; identical to SEQ ID NO: 23284

SEQ ID NO: 740360 - RNA, 64 nt, Homo Sapiens; identical to SEQ ID NO: 23285

SEQ ID NO: 740361 - RNA, 64 nt, Homo Sapiens; identical to SEQ ID NO: 23286

SEQ ID NO: 740362 - RNA, 64 nt, Homo Sapiens; identical to SEQ ID NO: 23287

SEQ ID NO: 740363 - RNA, 64 nt, Homo Sapiens; identical to SEQ ID NO: 23288

SEQ ID NO: 740364 - RNA, 64 nt, Homo Sapiens; identical to SEQ ID NO: 23289

SEQ ID NO: 740365 - RNA, 64 nt, Homo Sapiens; identical to SEQ ID NO: 23290

SEQ ID NO: 740366 - RNA, 64 nt, Homo Sapiens; identical to SEQ ID NO: 23291

SEQ ID NO: 740367 - RNA, 64 nt, Homo Sapiens; identical to SEQ ID NO: 23292

SEQ ID NO: 740368 - RNA, 64 nt, Homo Sapiens; identical to SEQ ID NO: 23293

SEQ ID NO: 740369 - RNA, 64 nt, Homo Sapiens; identical to SEQ ID NO: 23294

SEQ ID NO: 740370 - RNA, 64 nt, Homo Sapiens; identical to SEQ ID NO: 23295

SEQ ID NO: 740371 - RNA, 64 nt, Homo Sapiens; identical to SEQ ID NO: 23296

SEQ ID NO: 740372 - RNA, 64 nt, Homo Sapiens; identical to SEQ ID NO: 23297

SEQ ID NO: 740373 - RNA, 64 nt, Homo Sapiens; identical to SEQ ID NO: 23298

SEQ ID NO: 740374 - RNA, 64 nt, Homo Sapiens; identical to SEQ ID NO: 23299

SEQ ID NO: 740375 - RNA, 64 nt, Homo Sapiens; identical to SEQ ID NO: 23300

SEQ ID NO: 740376 - RNA, 64 nt, Homo Sapiens; identical to SEQ ID NO: 23301

SEQ ID NO: 740377 - RNA, 64 nt, Homo Sapiens; identical to SEQ ID NO: 23302

SEQ ID NO: 740378 - RNA, 64 nt, Homo Sapiens; identical to SEQ ID NO: 23303

SEQ ID NO: 740379 - RNA, 64 nt, Homo Sapiens; identical to SEQ ID NO: 23304

SEQ ID NO: 740380 - RNA, 64 nt, Homo Sapiens; identical to SEQ ID NO: 23305

SEQ ID NO: 740381 - RNA, 64 nt, Homo Sapiens; identical to SEQ ID NO: 23306

SEQ ID NO: 740382 - RNA, 64 nt, Homo Sapiens; identical to SEQ ID NO: 23307

SEQ ID NO: 740383 - RNA, 64 nt, Homo Sapiens; identical to SEQ ID NO: 23308

SEQ ID NO: 740384 - RNA, 64 nt, Homo Sapiens; identical to SEQ ID NO: 23309

SEQ ID NO: 740385 - RNA, 64 nt, Homo Sapiens; identical to SEQ ID NO: 23310

SEQ ID NO: 740386 - RNA, 64 nt, Homo Sapiens; identical to SEQ ID NO: 23311

SEQ ID NO: 740387 - RNA, 64 nt, Homo Sapiens; identical to SEQ ID NO: 23312

SEQ ID NO: 740388 - RNA, 64 nt, Homo Sapiens; identical to SEQ ID NO: 23313

SEQ ID NO: 740389 - RNA, 64 nt, Homo Sapiens; identical to SEQ ID NO: 23314

SEQ ID NO: 740390 - RNA, 64 nt, Homo Sapiens; identical to SEQ ID NO: 23315

SEQ ID NO: 740391 - RNA, 64 nt, Homo Sapiens; identical to SEQ ID NO: 23316

SEQ ID NO: 740392 - RNA, 64 nt, Homo Sapiens; identical to SEQ ID NO: 23317

SEQ ID NO: 740393 - RNA, 64 nt, Homo Sapiens; identical to SEQ ID NO: 23318

SEQ ID NO: 740394 - RNA, 64 nt, Homo Sapiens; identical to SEQ ID NO: 23319

SEQ ID NO: 740395 - RNA, 64 nt, Homo Sapiens; identical to SEQ ID NO: 23320

SEQ ID NO: 740396 - RNA, 64 nt, Homo Sapiens; identical to SEQ ID NO: 23321

SEQ ID NO: 740397 - RNA, 64 nt, Homo Sapiens; identical to SEQ ID NO: 23322

SEQ ID NO: 740398 - RNA, 64 nt, Homo Sapiens; identical to SEQ ID NO: 23323

SEQ ID NO: 740399 - RNA, 64 nt, Homo Sapiens; identical to SEQ ID NO: 23324

SEQ ID NO: 740400 - RNA, 64 nt, Homo Sapiens; identical to SEQ ID NO: 23325

SEQ ID NO: 740401 - RNA, 64 nt, Homo Sapiens; identical to SEQ ID NO: 23326

SEQ ID NO: 740402 - RNA, 64 nt, Homo Sapiens; identical to SEQ ID NO: 23327

SEQ ID NO: 740403 - RNA, 64 nt, Homo Sapiens; identical to SEQ ID NO: 23328

SEQ ID NO: 740404 - RNA, 64 nt, Homo Sapiens; identical to SEQ ID NO: 23329

SEQ ID NO: 740405 - RNA, 64 nt, Homo Sapiens; identical to SEQ ID NO: 107827

SEQ ID NO: 740406 - RNA, 64 nt, Homo Sapiens; identical to SEQ ID NO: 107828

SEQ ID NO: 740407 - RNA, 64 nt, Homo Sapiens; identical to SEQ ID NO: 107829

SEQ ID NO: 740408 - RNA, 64 nt, Homo Sapiens; identical to SEQ ID NO: 107830

SEQ ID NO: 740409 - RNA, 64 nt, Homo Sapiens; identical to SEQ ID NO: 107831

SEQ ID NO: 740410 - RNA, 64 nt, Homo Sapiens; identical to SEQ ID NO: 107832

SEQ ID NO: 740411 - RNA, 64 nt, Homo Sapiens; identical to SEQ ID NO: 107833

SEQ ID NO: 740412 - RNA, 64 nt, Homo Sapiens; identical to SEQ ID NO: 107834

SEQ ID NO: 740413 - RNA, 64 nt, Homo Sapiens; identical to SEQ ID NO: 107835

SEQ ID NO: 740414 - RNA, 64 nt, Homo Sapiens; identical to SEQ ID NO: 107836

SEQ ID NO: 740415 - RNA, 64 nt, Homo Sapiens; identical to SEQ ID NO: 107837

SEQ ID NO: 740416 - RNA, 64 nt, Homo Sapiens; identical to SEQ ID NO: 107838

SEQ ID NO: 740417 - RNA, 64 nt, Homo Sapiens; identical to SEQ ID NO: 107839

SEQ ID NO: 740418 - RNA, 64 nt, Homo Sapiens; identical to SEQ ID NO: 107840

SEQ ID NO: 740419 - RNA, 64 nt, Homo Sapiens; identical to SEQ ID NO: 161784

SEQ ID NO: 740420 - RNA, 64 nt, Homo Sapiens; identical to SEQ ID NO: 161785

SEQ ID NO: 740421 - RNA, 64 nt, Homo Sapiens; identical to SEQ ID NO: 161786

SEQ ID NO: 740422 - RNA, 64 nt, Homo Sapiens; identical to SEQ ID NO: 161787

SEQ ID NO: 740423 - RNA, 64 nt, Homo Sapiens; identical to SEQ ID NO: 161788

SEQ ID NO: 740424 - RNA, 64 nt, Homo Sapiens; identical to SEQ ID NO: 161789

SEQ ID NO: 740425 - RNA, 64 nt, Homo Sapiens; identical to SEQ ID NO: 161790

SEQ ID NO: 740426 - RNA, 64 nt, Homo Sapiens; identical to SEQ ID NO: 161791

SEQ ID NO: 740427 - RNA, 64 nt, Homo Sapiens; identical to SEQ ID NO: 161792

SEQ ID NO: 740428 - RNA, 64 nt, Homo Sapiens; identical to SEQ ID NO: 161793

SEQ ID NO: 740429 - RNA, 64 nt, Homo Sapiens; identical to SEQ ID NO: 161794

SEQ ID NO: 740430 - RNA, 64 nt, Homo Sapiens; identical to SEQ ID NO: 161795

SEQ ID NO: 740431 - RNA, 64 nt, Homo Sapiens; identical to SEQ ID NO: 161796

SEQ ID NO: 740432 - RNA, 64 nt, Homo Sapiens; identical to SEQ ID NO: 161797

SEQ ID NO: 740433 - RNA, 64 nt, Homo Sapiens; identical to SEQ ID NO: 161798

SEQ ID NO: 740434 - RNA, 64 nt, Homo Sapiens; identical to SEQ ID NO: 161799

SEQ ID NO: 740435 - RNA, 64 nt, Homo Sapiens; identical to SEQ ID NO: 161800

SEQ ID NO: 740436 - RNA, 64 nt, Homo Sapiens; identical to SEQ ID NO: 161801

SEQ ID NO: 740437 - RNA, 64 nt, Homo Sapiens; identical to SEQ ID NO: 161802

SEQ ID NO: 740438 - RNA, 64 nt, Homo Sapiens; identical to SEQ ID NO: 161803

SEQ ID NO: 740439 - RNA, 64 nt, Homo Sapiens; identical to SEQ ID NO: 161804

SEQ ID NO: 740440 - RNA, 64 nt, Homo Sapiens; identical to SEQ ID NO: 161805

SEQ ID NO: 740441 - RNA, 64 nt, Homo Sapiens; identical to SEQ ID NO: 161806

SEQ ID NO: 740442 - RNA, 64 nt, Homo Sapiens; identical to SEQ ID NO: 161807

SEQ ID NO: 740443 - RNA, 64 nt, Homo Sapiens; identical to SEQ ID NO: 161808

SEQ ID NO: 740444 - RNA, 64 nt, Homo Sapiens; identical to SEQ ID NO: 161809

SEQ ID NO: 740445 - RNA, 64 nt, Homo Sapiens; identical to SEQ ID NO: 161810

SEQ ID NO: 740446 - RNA, 64 nt, Homo Sapiens; identical to SEQ ID NO: 161811

SEQ ID NO: 740447 - RNA, 64 nt, Homo Sapiens; identical to SEQ ID NO: 161812

SEQ ID NO: 740448 - RNA, 64 nt, Homo Sapiens; identical to SEQ ID NO: 161813

SEQ ID NO: 740449 - RNA, 64 nt, Homo Sapiens; identical to SEQ ID NO: 161814

SEQ ID NO: 740450 - RNA, 64 nt, Homo Sapiens; identical to SEQ ID NO: 161815

SEQ ID NO: 740451 - RNA, 64 nt, Homo Sapiens; identical to SEQ ID NO: 161816

SEQ ID NO: 740452 - RNA, 64 nt, Homo Sapiens; identical to SEQ ID NO: 161817

SEQ ID NO: 740453 - RNA, 64 nt, Homo Sapiens; identical to SEQ ID NO: 161818

SEQ ID NO: 740454 - RNA, 64 nt, Homo Sapiens; identical to SEQ ID NO: 161819

SEQ ID NO: 740455 - RNA, 64 nt, Homo Sapiens; identical to SEQ ID NO: 161820

SEQ ID NO: 740456 - RNA, 64 nt, Homo Sapiens; identical to SEQ ID NO: 161821

SEQ ID NO: 740457 - RNA, 64 nt, Homo Sapiens; identical to SEQ ID NO: 161822

SEQ ID NO: 740458 - RNA, 64 nt, Homo Sapiens; identical to SEQ ID NO: 161823

SEQ ID NO: 740459 - RNA, 64 nt, Homo Sapiens; identical to SEQ ID NO: 161824

SEQ ID NO: 740460 - RNA, 64 nt, Homo Sapiens; identical to SEQ ID NO: 161825

SEQ ID NO: 740461 - RNA, 64 nt, Homo Sapiens; identical to SEQ ID NO: 161826

SEQ ID NO: 740462 - RNA, 64 nt, Homo Sapiens; identical to SEQ ID NO: 161827

SEQ ID NO: 740463 - RNA, 64 nt, Homo Sapiens; identical to SEQ ID NO: 161828

SEQ ID NO: 740464 - RNA, 64 nt, Homo Sapiens; identical to SEQ ID NO: 161829

SEQ ID NO: 740465 - RNA, 64 nt, Homo Sapiens; identical to SEQ ID NO: 161830

SEQ ID NO: 740466 - RNA, 64 nt, Homo Sapiens; identical to SEQ ID NO: 161831

SEQ ID NO: 740467 - RNA, 64 nt, Homo Sapiens; identical to SEQ ID NO: 161832

SEQ ID NO: 740468 - RNA, 64 nt, Homo Sapiens; identical to SEQ ID NO: 161833

SEQ ID NO: 740469 - RNA, 64 nt, Homo Sapiens; identical to SEQ ID NO: 161834

SEQ ID NO: 740470 - RNA, 56 nt, Homo Sapiens; identical to SEQ ID NO: 161835

SEQ ID NO: 740471 - RNA, 64 nt, Homo Sapiens; identical to SEQ ID NO: 161836

SEQ ID NO: 740472 - RNA, 64 nt, Homo Sapiens; identical to SEQ ID NO: 161837

SEQ ID NO: 740473 - RNA, 64 nt, Homo Sapiens; identical to SEQ ID NO: 161838

SEQ ID NO: 740474 - RNA, 64 nt, Homo Sapiens; identical to SEQ ID NO: 161839

SEQ ID NO: 740475 - RNA, 64 nt, Homo Sapiens; identical to SEQ ID NO: 161840

SEQ ID NO: 740476 - RNA, 64 nt, Homo Sapiens; identical to SEQ ID NO: 161841

SEQ ID NO: 740477 - RNA, 64 nt, Homo Sapiens; identical to SEQ ID NO: 161842

SEQ ID NO: 740478 - RNA, 64 nt, Homo Sapiens; identical to SEQ ID NO: 161843

SEQ ID NO: 740479 - RNA, 51 nt, Homo Sapiens; identical to SEQ ID NO: 161844

SEQ ID NO: 740480 - RNA, 64 nt, Homo Sapiens; identical to SEQ ID NO: 161845

SEQ ID NO: 740481 - RNA, 64 nt, Homo Sapiens; identical to SEQ ID NO: 161846

SEQ ID NO: 740482 - RNA, 64 nt, Homo Sapiens; identical to SEQ ID NO: 161847

SEQ ID NO: 740483 - RNA, 64 nt, Homo Sapiens; identical to SEQ ID NO: 161848

SEQ ID NO: 740484 - RNA, 64 nt, Homo Sapiens; identical to SEQ ID NO: 161849

SEQ ID NO: 740485 - RNA, 64 nt, Homo Sapiens; identical to SEQ ID NO: 161850

SEQ ID NO: 740486 - RNA, 64 nt, Homo Sapiens; identical to SEQ ID NO: 161851

SEQ ID NO: 740487 - RNA, 64 nt, Homo Sapiens; identical to SEQ ID NO: 161852

SEQ ID NO: 740488 - RNA, 64 nt, Homo Sapiens; identical to SEQ ID NO: 161853

SEQ ID NO: 740489 - RNA, 64 nt, Homo Sapiens; identical to SEQ ID NO: 161854

SEQ ID NO: 740490 - RNA, 64 nt, Homo Sapiens; identical to SEQ ID NO: 161855

SEQ ID NO: 740491 - RNA, 64 nt, Homo Sapiens; identical to SEQ ID NO: 161856

SEQ ID NO: 740492 - RNA, 64 nt, Homo Sapiens; identical to SEQ ID NO: 161857

SEQ ID NO: 740493 - RNA, 64 nt, Homo Sapiens; identical to SEQ ID NO: 161858

SEQ ID NO: 740494 - RNA, 64 nt, Homo Sapiens; identical to SEQ ID NO: 161859

SEQ ID NO: 740495 - RNA, 64 nt, Homo Sapiens; identical to SEQ ID NO: 161860

SEQ ID NO: 740496 - RNA, 64 nt, Homo Sapiens; identical to SEQ ID NO: 161861

SEQ ID NO: 740497 - RNA, 64 nt, Homo Sapiens; identical to SEQ ID NO: 161862

SEQ ID NO: 740498 - RNA, 64 nt, Homo Sapiens; identical to SEQ ID NO: 161863

SEQ ID NO: 740499 - RNA, 64 nt, Homo Sapiens; identical to SEQ ID NO: 161864

SEQ ID NO: 740500 - RNA, 64 nt, Homo Sapiens; identical to SEQ ID NO: 161865

SEQ ID NO: 740501 - RNA, 64 nt, Homo Sapiens; identical to SEQ ID NO: 161866

SEQ ID NO: 740502 - RNA, 64 nt, Homo Sapiens; identical to SEQ ID NO: 161867

SEQ ID NO: 740503 - RNA, 64 nt, Homo Sapiens; identical to SEQ ID NO: 161868

SEQ ID NO: 740504 - RNA, 64 nt, Homo Sapiens; identical to SEQ ID NO: 161869

SEQ ID NO: 740505 - RNA, 64 nt, Homo Sapiens; identical to SEQ ID NO: 161870

SEQ ID NO: 740506 - RNA, 64 nt, Homo Sapiens; identical to SEQ ID NO: 161871

SEQ ID NO: 740507 - RNA, 64 nt, Homo Sapiens; identical to SEQ ID NO: 161872

SEQ ID NO: 740508 - RNA, 64 nt, Homo Sapiens; identical to SEQ ID NO: 161873

SEQ ID NO: 740509 - RNA, 64 nt, Homo Sapiens; identical to SEQ ID NO: 161874

SEQ ID NO: 740510 - RNA, 64 nt, Homo Sapiens; identical to SEQ ID NO: 161875

SEQ ID NO: 740511 - RNA, 64 nt, Homo Sapiens; identical to SEQ ID NO: 161876

SEQ ID NO: 740512 - RNA, 64 nt, Homo Sapiens; identical to SEQ ID NO: 161877

SEQ ID NO: 740513 - RNA, 64 nt, Homo Sapiens; identical to SEQ ID NO: 161878

SEQ ID NO: 740514 - RNA, 64 nt, Homo Sapiens; identical to SEQ ID NO: 161879

SEQ ID NO: 740515 - RNA, 64 nt, Homo Sapiens; identical to SEQ ID NO: 161880

SEQ ID NO: 740516 - RNA, 64 nt, Homo Sapiens; identical to SEQ ID NO: 161881

SEQ ID NO: 740517 - RNA, 64 nt, Homo Sapiens; identical to SEQ ID NO: 161882

SEQ ID NO: 740518 - RNA, 64 nt, Homo Sapiens; identical to SEQ ID NO: 161883

SEQ ID NO: 740519 - RNA, 64 nt, Homo Sapiens; identical to SEQ ID NO: 161884

SEQ ID NO: 740520 - RNA, 64 nt, Homo Sapiens; identical to SEQ ID NO: 161885

SEQ ID NO: 740521 - RNA, 64 nt, Homo Sapiens; identical to SEQ ID NO: 161886

SEQ ID NO: 740522 - RNA, 64 nt, Homo Sapiens; identical to SEQ ID NO: 161887

SEQ ID NO: 740523 - RNA, 64 nt, Homo Sapiens; identical to SEQ ID NO: 161888

SEQ ID NO: 740524 - RNA, 64 nt, Homo Sapiens; identical to SEQ ID NO: 161889

SEQ ID NO: 740525 - RNA, 64 nt, Homo Sapiens; identical to SEQ ID NO: 161890

SEQ ID NO: 740526 - RNA, 64 nt, Homo Sapiens; identical to SEQ ID NO: 161891

SEQ ID NO: 740527 - RNA, 50 nt, Homo Sapiens; identical to SEQ ID NO: 161892

SEQ ID NO: 740528 - RNA, 64 nt, Homo Sapiens; identical to SEQ ID NO: 161893

SEQ ID NO: 740529 - RNA, 64 nt, Homo Sapiens; identical to SEQ ID NO: 161894

SEQ ID NO: 740530 - RNA, 64 nt, Homo Sapiens; identical to SEQ ID NO: 161895

SEQ ID NO: 740531 - RNA, 64 nt, Homo Sapiens; identical to SEQ ID NO: 161896

SEQ ID NO: 740532 - RNA, 64 nt, Homo Sapiens; identical to SEQ ID NO: 161897

SEQ ID NO: 740533 - RNA, 64 nt, Homo Sapiens; identical to SEQ ID NO: 496488

SEQ ID NO: 740534 - RNA, 64 nt, Homo Sapiens; identical to SEQ ID NO: 496489

SEQ ID NO: 740535 - RNA, 64 nt, Homo Sapiens; identical to SEQ ID NO: 496490

SEQ ID NO: 740536 - RNA, 64 nt, Homo Sapiens; identical to SEQ ID NO: 496491

SEQ ID NO: 740537 - RNA, 64 nt, Homo Sapiens; identical to SEQ ID NO: 496492

SEQ ID NO: 740538 - RNA, 64 nt, Homo Sapiens; identical to SEQ ID NO: 496493

SEQ ID NO: 740539 - RNA, 64 nt, Homo Sapiens; identical to SEQ ID NO: 496494

SEQ ID NO: 740540 - RNA, 64 nt, Homo Sapiens; identical to SEQ ID NO: 496495

SEQ ID NO: 740541 - RNA, 64 nt, Homo Sapiens; identical to SEQ ID NO: 302562

SEQ ID NO: 740542 - RNA, 64 nt, Homo Sapiens; identical to SEQ ID NO: 302563

SEQ ID NO: 740543 - RNA, 64 nt, Homo Sapiens; identical to SEQ ID NO: 302564

SEQ ID NO: 740544 - RNA, 64 nt, Homo Sapiens; identical to SEQ ID NO: 302565

SEQ ID NO: 740545 - RNA, 64 nt, Homo Sapiens; identical to SEQ ID NO: 302566

SEQ ID NO: 740546 - RNA, 64 nt, Homo Sapiens; identical to SEQ ID NO: 302567

SEQ ID NO: 740547 - RNA, 64 nt, Homo Sapiens; identical to SEQ ID NO: 302568

SEQ ID NO: 740548 - RNA, 64 nt, Homo Sapiens; identical to SEQ ID NO: 302569

SEQ ID NO: 740549 - RNA, 64 nt, Homo Sapiens; identical to SEQ ID NO: 302570

SEQ ID NO: 740550 - RNA, 64 nt, Homo Sapiens; identical to SEQ ID NO: 302571

SEQ ID NO: 740551 - RNA, 64 nt, Homo Sapiens; identical to SEQ ID NO: 302572

SEQ ID NO: 740552 - RNA, 64 nt, Homo Sapiens; identical to SEQ ID NO: 302573

SEQ ID NO: 740553 - RNA, 64 nt, Homo Sapiens; identical to SEQ ID NO: 302574

SEQ ID NO: 740554 - RNA, 64 nt, Homo Sapiens; identical to SEQ ID NO: 302575

SEQ ID NO: 740555 - RNA, 64 nt, Homo Sapiens; identical to SEQ ID NO: 302576

SEQ ID NO: 740556 - RNA, 64 nt, Homo Sapiens; identical to SEQ ID NO: 302577

SEQ ID NO: 740557 - RNA, 64 nt, Homo Sapiens; identical to SEQ ID NO: 302578

SEQ ID NO: 740558 - RNA, 64 nt, Homo Sapiens; identical to SEQ ID NO: 302579

SEQ ID NO: 740559 - RNA, 64 nt, Homo Sapiens; identical to SEQ ID NO: 302580

SEQ ID NO: 740560 - RNA, 64 nt, Homo Sapiens; identical to SEQ ID NO: 302581

SEQ ID NO: 740561 - RNA, 64 nt, Homo Sapiens; identical to SEQ ID NO: 243769

SEQ ID NO: 740562 - RNA, 64 nt, Homo Sapiens; identical to SEQ ID NO: 243770

SEQ ID NO: 740563 - RNA, 64 nt, Homo Sapiens; identical to SEQ ID NO: 243771

SEQ ID NO: 740564 - RNA, 64 nt, Homo Sapiens; identical to SEQ ID NO: 243772

SEQ ID NO: 740565 - RNA, 64 nt, Homo Sapiens; identical to SEQ ID NO: 243773

SEQ ID NO: 740566 - RNA, 64 nt, Homo Sapiens; identical to SEQ ID NO: 243774

SEQ ID NO: 740567 - RNA, 64 nt, Homo Sapiens; identical to SEQ ID NO: 243775

SEQ ID NO: 740568 - RNA, 64 nt, Homo Sapiens; identical to SEQ ID NO: 243776

SEQ ID NO: 740569 - RNA, 64 nt, Homo Sapiens; identical to SEQ ID NO: 243777

SEQ ID NO: 740570 - RNA, 64 nt, Homo Sapiens; identical to SEQ ID NO: 243778

SEQ ID NO: 740571 - RNA, 64 nt, Homo Sapiens; identical to SEQ ID NO: 243779

SEQ ID NO: 740572 - RNA, 64 nt, Homo Sapiens; identical to SEQ ID NO: 243780

SEQ ID NO: 740573 - RNA, 64 nt, Homo Sapiens; identical to SEQ ID NO: 243781

SEQ ID NO: 740574 - RNA, 64 nt, Homo Sapiens; identical to SEQ ID NO: 243782

SEQ ID NO: 740575 - RNA, 64 nt, Homo Sapiens; identical to SEQ ID NO: 243783

SEQ ID NO: 740576 - RNA, 64 nt, Homo Sapiens; identical to SEQ ID NO: 243784

SEQ ID NO: 740577 - RNA, 64 nt, Homo Sapiens; identical to SEQ ID NO: 243785

SEQ ID NO: 740578 - RNA, 64 nt, Homo Sapiens; identical to SEQ ID NO: 243786

SEQ ID NO: 740579 - RNA, 64 nt, Homo Sapiens; identical to SEQ ID NO: 243787

SEQ ID NO: 740580 - RNA, 64 nt, Homo Sapiens; identical to SEQ ID NO: 243788

SEQ ID NO: 740581 - RNA, 64 nt, Homo Sapiens; identical to SEQ ID NO: 243789

SEQ ID NO: 740582 - RNA, 64 nt, Homo Sapiens; identical to SEQ ID NO: 243790

SEQ ID NO: 740583 - RNA, 64 nt, Homo Sapiens; identical to SEQ ID NO: 243791

SEQ ID NO: 740584 - RNA, 64 nt, Homo Sapiens; identical to SEQ ID NO: 243792

SEQ ID NO: 740585 - RNA, 64 nt, Homo Sapiens; identical to SEQ ID NO: 243793

SEQ ID NO: 740586 - RNA, 64 nt, Homo Sapiens; identical to SEQ ID NO: 243794

SEQ ID NO: 740587 - RNA, 64 nt, Homo Sapiens; identical to SEQ ID NO: 243795

SEQ ID NO: 740588 - RNA, 64 nt, Homo Sapiens; identical to SEQ ID NO: 243796

SEQ ID NO: 740589 - RNA, 64 nt, Homo Sapiens; identical to SEQ ID NO: 243797

SEQ ID NO: 740590 - RNA, 64 nt, Homo Sapiens; identical to SEQ ID NO: 243798

SEQ ID NO: 740591 - RNA, 64 nt, Homo Sapiens; identical to SEQ ID NO: 243799

SEQ ID NO: 740592 - RNA, 64 nt, Homo Sapiens; identical to SEQ ID NO: 243800

SEQ ID NO: 740593 - RNA, 64 nt, Homo Sapiens; identical to SEQ ID NO: 243801

SEQ ID NO: 740594 - RNA, 64 nt, Homo Sapiens; identical to SEQ ID NO: 243802

SEQ ID NO: 740595 - RNA, 64 nt, Homo Sapiens; identical to SEQ ID NO: 243803

SEQ ID NO: 740596 - RNA, 64 nt, Homo Sapiens; identical to SEQ ID NO: 243804

SEQ ID NO: 740597 - RNA, 64 nt, Homo Sapiens; identical to SEQ ID NO: 243805

SEQ ID NO: 740598 - RNA, 64 nt, Homo Sapiens; identical to SEQ ID NO: 243806

SEQ ID NO: 740599 - RNA, 64 nt, Homo Sapiens; identical to SEQ ID NO: 243807

SEQ ID NO: 740600 - RNA, 64 nt, Homo Sapiens; identical to SEQ ID NO: 243808

SEQ ID NO: 740601 - RNA, 64 nt, Homo Sapiens; identical to SEQ ID NO: 243809

SEQ ID NO: 740602 - RNA, 64 nt, Homo Sapiens; identical to SEQ ID NO: 243810

SEQ ID NO: 740603 - RNA, 64 nt, Homo Sapiens; identical to SEQ ID NO: 243811

SEQ ID NO: 740604 - RNA, 64 nt, Homo Sapiens; identical to SEQ ID NO: 243812

SEQ ID NO: 740605 - RNA, 64 nt, Homo Sapiens; identical to SEQ ID NO: 243813

SEQ ID NO: 740606 - RNA, 64 nt, Homo Sapiens; identical to SEQ ID NO: 243814

SEQ ID NO: 740607 - RNA, 64 nt, Homo Sapiens; identical to SEQ ID NO: 243815

SEQ ID NO: 740608 - RNA, 64 nt, Homo Sapiens; identical to SEQ ID NO: 243816

SEQ ID NO: 740609 - RNA, 64 nt, Homo Sapiens; identical to SEQ ID NO: 243817

SEQ ID NO: 740610 - RNA, 64 nt, Homo Sapiens; identical to SEQ ID NO: 243818

SEQ ID NO: 740611 - RNA, 64 nt, Homo Sapiens; identical to SEQ ID NO: 243819

SEQ ID NO: 740612 - RNA, 64 nt, Homo Sapiens; identical to SEQ ID NO: 243820

SEQ ID NO: 740613 - RNA, 64 nt, Homo Sapiens; identical to SEQ ID NO: 243821

SEQ ID NO: 740614 - RNA, 64 nt, Homo Sapiens; identical to SEQ ID NO: 243822

SEQ ID NO: 740615 - RNA, 64 nt, Homo Sapiens; identical to SEQ ID NO: 243823

SEQ ID NO: 740616 - RNA, 64 nt, Homo Sapiens; identical to SEQ ID NO: 243824

SEQ ID NO: 740617 - RNA, 64 nt, Homo Sapiens; identical to SEQ ID NO: 243825

SEQ ID NO: 740618 - RNA, 64 nt, Homo Sapiens
ccuguagacuauuuuuacuaaggugcuuuauaauguguuuuaaagcauugcauuuacaaaacaa

SEQ ID NO: 740619 - RNA, 64 nt, Homo Sapiens
ugauauaaauuuguguuugauaaauauccucucaguguuuuaucuuccauguuucaacaacuau

SEQ ID NO: 740620 - RNA, 64 nt, Homo Sapiens
guuucuacaguuuugcuauucuguuggacagucaguguuuuaauacaaccugcucucuguacug

SEQ ID NO: 740621 - RNA, 64 nt, Homo Sapiens
ggaguguugccuugaaugaagcguguguguguguguguuuuaaugugugugagagugugcgcgc

SEQ ID NO: 740622 - RNA, 64 nt, Homo Sapiens
auuuuguuuuccaccaggcagggaguagggcuuaguguuuuaaaacaccucugcuuucugaugu

SEQ ID NO: 740623 - RNA, 64 nt, Homo Sapiens
gcacacacaaaauaaaucagugggauuugguaauguguuuuagaguaagaaauuucagguuguu

SEQ ID NO: 740624 - RNA, 64 nt, Homo Sapiens
gagacuuccuaggaagggauccuagaaaaagugaguguuuuaaugugcagcauucaaaaucacc

SEQ ID NO: 740625 - RNA, 64 nt, Homo Sapiens
auuacuguguaaagacuugagaucucaaagcuggguguuuuagcguggcaauauauugacucag

SEQ ID NO: 740626 - RNA, 64 nt, Homo Sapiens
ccacugcaccuggcccagaugauauaauuuaacuguguuuuagguaacauguuaaugagggaaa

SEQ ID NO: 740627 - RNA, 64 nt, Homo Sapiens
caguguagcauuggaucaaaaaguuuaucacacaguguuuuaauaaaugguuuauucugcuuac

SEQ ID NO: 740628 - RNA, 64 nt, Homo Sapiens
ugaacaacugaauguauaaaaaaauuauaaacugguguuuuaacuaguauugcaauaagcaaau

SEQ ID NO: 740629 - RNA, 64 nt, Homo Sapiens
ugauguuugugaucucuaacucaaaaaauuugaaguguuuuaaguuguuucuggguaagggaga

SEQ ID NO: 740630 - RNA, 64 nt, Homo Sapiens
uaaaguaucauguauuaaaauguuuagacagcauguguuuuaaagugauaaaugcaaaauguua

SEQ ID NO: 740631 - RNA, 64 nt, Homo Sapiens
uaggggaaaaccuacuuuaaaguaugguaaauguguguuuuaaacuuccuaucaagugacauac

SEQ ID NO: 740632 - RNA, 64 nt, Homo Sapiens
ccacaugacuuuuuccucuaaaaacuggauccuaguguuuuaauuaccugugugcagcuauuuu

SEQ ID NO: 740633 - RNA, 64 nt, Homo Sapiens
gacauaacucauuuuucuaguuuuugacaauuguguguuuuagugucuagucugcagagagcug

SEQ ID NO: 740634 - RNA, 64 nt, Homo Sapiens
gaagauaauuaaaggauguuaucauaggcuauauguguuuuacuuauucagacugauaaucaua

SEQ ID NO: 740635 - RNA, 64 nt, Homo Sapiens
aggcaauuuagucauuaugauaauaaggaaaacaguguuuuagaugagagaucauuaaugcauu

SEQ ID NO: 740636 - RNA, 64 nt, Homo Sapiens
ccaggucugcgucccuaaccccuuccccagcuugguguuuuaccccgaaacaggaaggaacagg

SEQ ID NO: 740637 - RNA, 64 nt, Homo Sapiens
aggucgcagcaaauggcuucagccugggacgccaguguuuuaugcucuuaguucaguaaaauac

SEQ ID NO: 740638 - RNA, 64 nt, Homo Sapiens
aaaguucuuauugcacugguuuauauguguauguguguuuuauuguguguuuuuuuaauuugua

SEQ ID NO: 740639 - RNA, 64 nt, Homo Sapiens
uggagggggaaguuuaugaauauaauauagcucuguguuuuaaaccucagaaacagauuugagu

SEQ ID NO: 740640 - RNA, 64 nt, Homo Sapiens
guugaaauuuaaaacguguuucuagguugaccuuguguuuuagaaauuugcacuuaauggaauu

SEQ ID NO: 740641 - RNA, 64 nt, Homo Sapiens
guacuuugaucucuccacaucacuuauaacuuauguguuuuauuucuccaagugcgguguuccu

SEQ ID NO: 740642 - RNA, 64 nt, Homo Sapiens
aaauagaguguaguuuacaguguugauuuuuacuguguuuuauaugaccagaugcgucccaaga

SEQ ID NO: 740643 - RNA, 64 nt, Homo Sapiens
ugguuucuugcaagcaugcuuuagauguugccauguguuuuagaaacaagugaaagcauauggg

SEQ ID NO: 740644 - RNA, 64 nt, Homo Sapiens
uuuucaauugcuaucuuuugaaaggcaccaguauguguuuuagauugauuucccuguuucaggg

SEQ ID NO: 740645 - RNA, 64 nt, Homo Sapiens
gaguuaacaacuaguugagcagucagcuuccuaaguguuuuaggacauuuguucauuauauuuu

SEQ ID NO: 740646 - RNA, 64 nt, Homo Sapiens
ugucaacaaguagaaccucaguuugcuaacugaaguguuuuauuaguauuuuacucuaguggug

SEQ ID NO: 740647 - RNA, 64 nt, Homo Sapiens
ccagagaaugcaguagaccuuuugccacucaucuguguuuuacuugagacauguaaauaugaua

SEQ ID NO: 740648 - RNA, 64 nt, Homo Sapiens
uucauccaauaauucaagccaagcaaguauauagguguuuuaauaguuuuuguuugcaguccuc

SEQ ID NO: 740649 - RNA, 64 nt, Homo Sapiens
agucacugaaguggaaacuaagaaguggcaguuaguguuuuacccagcauuucugccuucucuc

SEQ ID NO: 740650 - RNA, 64 nt, Homo Sapiens
aucagugcuuuuagaaaugccucuugcagguuuuguguuuuaucuccauuacucuuuuuauugg

SEQ ID NO: 740651 - RNA, 64 nt, Homo Sapiens
ucagcagggaacuacgccaaguacuucauggccaguguuuuaucauauuucaccacgguaucau

SEQ ID NO: 740652 - RNA, 64 nt, Homo Sapiens
auuguguggaguugucgauacccacuuucucgcaguguuuuaauaaaauuccaggugugccgca

SEQ ID NO: 740653 - RNA, 64 nt, Homo Sapiens
caugaggcauccgcguggcuccaccgcgcccaguguguuuuaaggcugggauuacaggcaugag

SEQ ID NO: 740654 - RNA, 64 nt, Homo Sapiens
cuuugcuauuuuucccuuuugggaaaacaaugaaguguuuuaaguccuggguggacugagagau

SEQ ID NO: 740655 - RNA, 64 nt, Homo Sapiens
uuuaaucauguaauauauacaauuuaauguccuaguguuuuacuuaauaguguaucauguuuuc

SEQ ID NO: 740656 - RNA, 64 nt, Homo Sapiens
gcucuggaaauucguuaauguauuugaugucuuaguguuuuagugacuagggagaccauuaacu

SEQ ID NO: 740657 - RNA, 64 nt, Homo Sapiens
acaguggccuugcuucuuagacggucuucacuguguguuuuaaaacaacaacaacaacaacaac

SEQ ID NO: 740658 - RNA, 64 nt, Homo Sapiens
aaaaaccugcaaagaugaugugagauuuuuucuuguguuuuaauuauuuucacauuuucucucu

SEQ ID NO: 740659 - RNA, 64 nt, Homo Sapiens
acgugcauacacauucuuuucuuaaacuuuaccuguguuuuaacuaauauugugucaguguauu

SEQ ID NO: 740660 - RNA, 64 nt, Homo Sapiens
uugcuaccaaguaggaaaaaaaauguacauggcaguguuuuaguuggcaauauaaucuuugaau

SEQ ID NO: 740661 - RNA, 64 nt, Homo Sapiens
gaaagauagagauuguuuuuagagguugguuguuguguuuuaggauucuguccauuuucuuuua

SEQ ID NO: 740662 - RNA, 64 nt, Homo Sapiens; identical to SEQ ID NO: 740658

SEQ ID NO: 740663 - RNA, 64 nt, Homo Sapiens; identical to SEQ ID NO: 740659

SEQ ID NO: 740664 - RNA, 64 nt, Homo Sapiens
aaaaaaauccuuuucaauccugagaaaauuaaagguguuuuacucacauggauauuucaacauu

SEQ ID NO: 740665 - RNA, 64 nt, Homo Sapiens; identical to SEQ ID NO: 565539

SEQ ID NO: 740666 - RNA, 64 nt, Homo Sapiens; identical to SEQ ID NO: 565540

SEQ ID NO: 740667 - RNA, 64 nt, Homo Sapiens; identical to SEQ ID NO: 565541

SEQ ID NO: 740668 - RNA, 64 nt, Homo Sapiens; identical to SEQ ID NO: 565542

SEQ ID NO: 740669 - RNA, 64 nt, Homo Sapiens; identical to SEQ ID NO: 565543

SEQ ID NO: 740670 - RNA, 64 nt, Homo Sapiens; identical to SEQ ID NO: 565544

SEQ ID NO: 740671 - RNA, 64 nt, Homo Sapiens; identical to SEQ ID NO: 565545

SEQ ID NO: 740672 - RNA, 64 nt, Homo Sapiens; identical to SEQ ID NO: 565546

SEQ ID NO: 740673 - RNA, 64 nt, Homo Sapiens; identical to SEQ ID NO: 565547

SEQ ID NO: 740674 - RNA, 64 nt, Homo Sapiens; identical to SEQ ID NO: 565548

SEQ ID NO: 740675 - RNA, 64 nt, Homo Sapiens; identical to SEQ ID NO: 565549

SEQ ID NO: 740676 - RNA, 64 nt, Homo Sapiens; identical to SEQ ID NO: 565550

SEQ ID NO: 740677 - RNA, 64 nt, Homo Sapiens; identical to SEQ ID NO: 565551

SEQ ID NO: 740678 - RNA, 64 nt, Homo Sapiens; identical to SEQ ID NO: 565552

SEQ ID NO: 740679 - RNA, 64 nt, Homo Sapiens; identical to SEQ ID NO: 565553

SEQ ID NO: 740680 - RNA, 64 nt, Homo Sapiens; identical to SEQ ID NO: 565554

SEQ ID NO: 740681 - RNA, 64 nt, Homo Sapiens; identical to SEQ ID NO: 565555

SEQ ID NO: 740682 - RNA, 64 nt, Homo Sapiens; identical to SEQ ID NO: 565556

SEQ ID NO: 740683 - RNA, 64 nt, Homo Sapiens; identical to SEQ ID NO: 565557

SEQ ID NO: 740684 - RNA, 64 nt, Homo Sapiens; identical to SEQ ID NO: 565558

SEQ ID NO: 740685 - RNA, 64 nt, Homo Sapiens; identical to SEQ ID NO: 565559

SEQ ID NO: 740686 - RNA, 64 nt, Homo Sapiens; identical to SEQ ID NO: 565560

SEQ ID NO: 740687 - RNA, 64 nt, Homo Sapiens; identical to SEQ ID NO: 244630

SEQ ID NO: 740688 - RNA, 64 nt, Homo Sapiens; identical to SEQ ID NO: 244631

SEQ ID NO: 740689 - RNA, 64 nt, Homo Sapiens; identical to SEQ ID NO: 244632

SEQ ID NO: 740690 - RNA, 64 nt, Homo Sapiens; identical to SEQ ID NO: 244633

SEQ ID NO: 740691 - RNA, 64 nt, Homo Sapiens; identical to SEQ ID NO: 244634

SEQ ID NO: 740692 - RNA, 64 nt, Homo Sapiens; identical to SEQ ID NO: 244635

SEQ ID NO: 740693 - RNA, 64 nt, Homo Sapiens; identical to SEQ ID NO: 244636

SEQ ID NO: 740694 - RNA, 64 nt, Homo Sapiens; identical to SEQ ID NO: 244637

SEQ ID NO: 740695 - RNA, 64 nt, Homo Sapiens; identical to SEQ ID NO: 244638

SEQ ID NO: 740696 - RNA, 64 nt, Homo Sapiens; identical to SEQ ID NO: 244639

SEQ ID NO: 740697 - RNA, 64 nt, Homo Sapiens; identical to SEQ ID NO: 244640

SEQ ID NO: 740698 - RNA, 64 nt, Homo Sapiens; identical to SEQ ID NO: 244641

SEQ ID NO: 740699 - RNA, 64 nt, Homo Sapiens; identical to SEQ ID NO: 244642

SEQ ID NO: 740700 - RNA, 64 nt, Homo Sapiens; identical to SEQ ID NO: 244643

SEQ ID NO: 740701 - RNA, 64 nt, Homo Sapiens; identical to SEQ ID NO: 244644

SEQ ID NO: 740702 - RNA, 64 nt, Homo Sapiens; identical to SEQ ID NO: 244645

SEQ ID NO: 740703 - RNA, 64 nt, Homo Sapiens; identical to SEQ ID NO: 244646

SEQ ID NO: 740704 - RNA, 64 nt, Homo Sapiens; identical to SEQ ID NO: 244647

SEQ ID NO: 740705 - RNA, 64 nt, Homo Sapiens; identical to SEQ ID NO: 244648

SEQ ID NO: 740706 - RNA, 64 nt, Homo Sapiens; identical to SEQ ID NO: 244649

SEQ ID NO: 740707 - RNA, 64 nt, Homo Sapiens; identical to SEQ ID NO: 244650

SEQ ID NO: 740708 - RNA, 64 nt, Homo Sapiens; identical to SEQ ID NO: 244651

SEQ ID NO: 740709 - RNA, 64 nt, Homo Sapiens; identical to SEQ ID NO: 244652

SEQ ID NO: 740710 - RNA, 64 nt, Homo Sapiens; identical to SEQ ID NO: 244653

SEQ ID NO: 740711 - RNA, 64 nt, Homo Sapiens; identical to SEQ ID NO: 244654

SEQ ID NO: 740712 - RNA, 64 nt, Homo Sapiens; identical to SEQ ID NO: 244655

SEQ ID NO: 740713 - RNA, 64 nt, Homo Sapiens; identical to SEQ ID NO: 244656

SEQ ID NO: 740714 - RNA, 64 nt, Homo Sapiens; identical to SEQ ID NO: 244657

SEQ ID NO: 740715 - RNA, 64 nt, Homo Sapiens; identical to SEQ ID NO: 244658

SEQ ID NO: 740716 - RNA, 64 nt, Homo Sapiens; identical to SEQ ID NO: 244659

SEQ ID NO: 740717 - RNA, 64 nt, Homo Sapiens; identical to SEQ ID NO: 244660

SEQ ID NO: 740718 - RNA, 64 nt, Homo Sapiens; identical to SEQ ID NO: 244661

SEQ ID NO: 740719 - RNA, 64 nt, Homo Sapiens; identical to SEQ ID NO: 244662

SEQ ID NO: 740720 - RNA, 64 nt, Homo Sapiens; identical to SEQ ID NO: 244663

SEQ ID NO: 740721 - RNA, 64 nt, Homo Sapiens
aaagcugagauguuuuuucuugguucuggcugccaacugugaguuaaaacucaaggcuuguugu

SEQ ID NO: 740722 - RNA, 64 nt, Homo Sapiens
agguuuaaagccuaccaguguaaccuaccaguacaacugugaauccuaggcaaggcaaaaaugc

SEQ ID NO: 740723 - RNA, 64 nt, Homo Sapiens
cuugccgcaucacuuaaugugauccccauacugcaacugugaugcugaugaugcuaauggagau

SEQ ID NO: 740724 - RNA, 64 nt, Homo Sapiens
uaacuggaauugagaugaaggccagugacaugacaacugugaccuaagaaaugggaagauuauc

SEQ ID NO: 740725 - RNA, 64 nt, Homo Sapiens
caaggagguuacauguuuuccaacauauccuaaaaacugugauauaagcuaacauauaauuugc

SEQ ID NO: 740726 - RNA, 64 nt, Homo Sapiens
acccuuuugugaagaucacagcauuuaucuaagaaacugugaggcuuucugguuuacauauauc

SEQ ID NO: 740727 - RNA, 64 nt, Homo Sapiens
guuugguaguaaaccaguagaauagauucuauauaacugugagauugaguuaguuuauagugcu

SEQ ID NO: 740728 - RNA, 64 nt, Homo Sapiens
gaaugucccacaaaacauuucaaacagucaugccaacugugaagaaagcauuuagucagucccc

SEQ ID NO: 740729 - RNA, 64 nt, Homo Sapiens
guuuuaugacuaauccuuaauaacuaugguaaauaacugugacugugggguuuuuaaucucuug

SEQ ID NO: 740730 - RNA, 64 nt, Homo Sapiens
agcacaauauuaaguguuguacaauuacugugagaacugugaauauguguaacuuuuuuuuagu

SEQ ID NO: 740731 - RNA, 64 nt, Homo Sapiens
gacuuaaaugaccuggauugaucagagagaauugaacugugaccuuuaagacuucuagacuaau

SEQ ID NO: 740732 - RNA, 64 nt, Homo Sapiens
gauagagauucauuuagucaaagacaaaagcuuuaacugugagggcacagccuugaagugggag

SEQ ID NO: 740733 - RNA, 64 nt, Homo Sapiens
aacuguugugccaaaaauaguguaaugcacaggcaacugugagacagaaggaaauuauuuaggu

SEQ ID NO: 740734 - RNA, 64 nt, Homo Sapiens
uggggaggucagucauuuacagauuuaauccuaaaacugugacucaacagggggaagaaaaugg

SEQ ID NO: 740735 - RNA, 64 nt, Homo Sapiens
uggaaccuccugaucaguuugaaggacauugauaaacugugauuuuacaauaacauuaucaucu

SEQ ID NO: 740736 - RNA, 64 nt, Homo Sapiens
aaugccuacauugagugcuuaaaaaaaaaaaaacaacugugaugaugugagcagaauggcaagu

SEQ ID NO: 740737 - RNA, 64 nt, Homo Sapiens
uauggccauauauaauuuuugcuuuuggcugcguaacugugaacuaaaggcuguaauuggagca

SEQ ID NO: 740738 - RNA, 64 nt, Homo Sapiens
auacuuccugaaggggagggccagaggacuuuggaacugugaaucucuguugagagcauuucag

SEQ ID NO: 740739 - RNA, 64 nt, Homo Sapiens
gcacauuuugggaaguugcauuccuuugucuucaaacugugaagcauuuacagaaacgcaucca

SEQ ID NO: 740740 - RNA, 64 nt, Homo Sapiens
gguagcacuugcuacccugaguucauccaggcccaacugugagcaaggagcacaagccacaagu

SEQ ID NO: 740741 - RNA, 64 nt, Homo Sapiens
augccagccaucacucacugccaccugggccaucaacugugaauucucagcaccaguugccuuu

SEQ ID NO: 740742 - RNA, 64 nt, Homo Sapiens
uggcaccugcuccauucugcccuacaugauggguaacugugaucuuucuucccuguuagauugu

SEQ ID NO: 740743 - RNA, 64 nt, Homo Sapiens
uugucagacacccaguguccuccugcaaggacgcaacugugagcugaggugugagccuaggagc

SEQ ID NO: 740744 - RNA, 64 nt, Homo Sapiens
caggaaucaaggauagggcuaagguuuucaccuuaacugugaaggcaggaggaauaggugacug

SEQ ID NO: 740745 - RNA, 64 nt, Homo Sapiens
uggucuuuauaacuuuacugaacaagagggaagcaacugugaugggaagagauuaccuagccuu

SEQ ID NO: 740746 - RNA, 64 nt, Homo Sapiens
uuucuuuugauguugcaacuuuuggguucuuuuaaacugugauagugaugguaacugaugccuu

SEQ ID NO: 740747 - RNA, 64 nt, Homo Sapiens
aaaauguaaagguuuuauuuucagagcauaaguuaacugugaaaauuugugaucgguaggcagu

SEQ ID NO: 740748 - RNA, 64 nt, Homo Sapiens
ucgcacaaccgaaagggccuauaaguagauaaauaacugugagccgccaucagccuggaugggc

SEQ ID NO: 740749 - RNA, 64 nt, Homo Sapiens
ggcugggcugcugcgacacaggcagcgcuuuguaaacugugaagccauauacgugaaacugaag

SEQ ID NO: 740750 - RNA, 64 nt, Homo Sapiens
caguacauuuuuguuuaauguugggccugagguuaacugugaccaugguccagcuugaguggcu

SEQ ID NO: 740751 - RNA, 64 nt, Homo Sapiens
aauaucaauaaaaaggggauggacaagaccucauaacugugauuugcaaauugugcuuucugau

SEQ ID NO: 740752 - RNA, 64 nt, Homo Sapiens
ucacagugagcccuguggaaaaggggaugaggacaacugugaacagauugacauuauugaagga

SEQ ID NO: 740753 - RNA, 64 nt, Homo Sapiens
uauaugagccuuugaaaguugacaggugagaagaaacugugaagaucaauuauucugaugcugg

SEQ ID NO: 740754 - RNA, 64 nt, Homo Sapiens
augaugacgggcuuguagcacugucuuaagcuucaacugugaaacuagcauucaacagagaacu

SEQ ID NO: 740755 - RNA, 64 nt, Homo Sapiens
uugauucuuucaauccacaguauuguucuuguaaaacugugacauuccacagaguuacugccac

SEQ ID NO: 740756 - RNA, 64 nt, Homo Sapiens
cuuuuaaaaaaauaauauaaaugaaugaaauauaaacugugagauaaauaucauuauagcaugu

SEQ ID NO: 740757 - RNA, 64 nt, Homo Sapiens
aaccagguuuagaagacaguaucccagaaacuagaacugugagaugaaucacaucauccacuuu

SEQ ID NO: 740758 - RNA, 64 nt, Homo Sapiens
uuuuauccuucaaaacaaucacguugcauauucaaacugugaugugugaggaguuacuuuaugu

SEQ ID NO: 740759 - RNA, 64 nt, Homo Sapiens
cagcacaguacucaggcagugcaauacucagugcgguacucaguaacacagugcaguacucagu

SEQ ID NO: 740760 - RNA, 64 nt, Homo Sapiens
caguaauacaguacaguacucaguaaggcaguaugguacucaguaaagcaaugcaaugcucagu

SEQ ID NO: 740761 - RNA, 64 nt, Homo Sapiens
acacccguucccacgucagaggagggcaaggcuggguacucagcagccacucugagccggggcu

SEQ ID NO: 740762 - RNA, 64 nt, Homo Sapiens
aaauccaccugucuccaucuuccuugccugccuggguacucaugccaagcagagacugggauua

SEQ ID NO: 740763 - RNA, 63 nt, Homo Sapiens
ccacacuguacucugcacuggugugagggccccugccuggacugugggacccuccuggugcug

SEQ ID NO: 740764 - RNA, 63 nt, Homo Sapiens
ccuccccaugugaacauggggaacuucgggcccugccuggaguccuugaccgcucucuguggg

SEQ ID NO: 740765 - RNA, 63 nt, Homo Sapiens
gcaggaucugccauaaaggacaauaugaacugaugccuggacuaucaguaaccccacugcaca

SEQ ID NO: 740766 - RNA, 63 nt, Homo Sapiens
gcacaggcacacgaugcucugggacauaacuggugccuggaaaucaccaugguccucauaucu

SEQ ID NO: 740767 - RNA, 63 nt, Homo Sapiens
guaugacugcacaugacucguacugcgacuuucugccuggaguaaccuguguccgguauucga

SEQ ID NO: 740768 - RNA, 63 nt, Homo Sapiens
cuuagggcaccagggguuuccuucucugacuucugccuggagagugcugggagcuccacucug

SEQ ID NO: 740769 - RNA, 63 nt, Homo Sapiens
agccccuggacacacacacacagacacacacacugccuggaugcauguaugcacacacaugcg

SEQ ID NO: 740770 - RNA, 63 nt, Homo Sapiens
aacauacacacgcacacccaugcgcagaugugcugccuggacacacacacacacacggauaug

SEQ ID NO: 740771 - RNA, 63 nt, Homo Sapiens
augguauccggacacacacgugcacagauaugcugccuggacacacagauaaugcugccuuga

SEQ ID NO: 740772 - RNA, 63 nt, Homo Sapiens
uaaugcugccuugacacacacaugcacggauauugccuggacacacacacacacacgugugca

SEQ ID NO: 740773 - RNA, 63 nt, Homo Sapiens
gcugucuggacacgcacacacaugcagauaugcugccuggacacacacuuccagacacacgug

SEQ ID NO: 740774 - RNA, 63 nt, Homo Sapiens
cuuccagacacacgugcacaggcgcagauaugcugccuggacacacgcagauaugcugucuag

SEQ ID NO: 740775 - RNA, 63 nt, Homo Sapiens
gcuguccggacacacacacgcacgcagauaugcugccuggacacacacacagauaaugcugcc

SEQ ID NO: 740776 - RNA, 63 nt, Homo Sapiens
augcugccucaacacucacacacgugcagauauugccuggacacacacaugugcacagauaug

SEQ ID NO: 740777 - RNA, 63 nt, Homo Sapiens
cggacacacaugcacacacaggugcagauaugcugccuggacacacgcagacugacgugcuuu

SEQ ID NO: 740778 - RNA, 63 nt, Homo Sapiens
gcuccucacaccacagccaggagagaccuuuucugccuggagagaaacuuucagaccagcccc

SEQ ID NO: 740779 - RNA, 63 nt, Homo Sapiens
gccccacacaccacagccaggagaggccguuccugccuggagagaagcuuccagaccagcccu

SEQ ID NO: 740780 - RNA, 63 nt, Homo Sapiens
ugaggggcauccgaacgcguguagggggcauggugccuggagccagaaccugcccugcaggcu

SEQ ID NO: 740781 - RNA, 63 nt, Homo Sapiens
ccccucuagcuccugcucacagccccugggcugugccuggaucucaggggucaucuggcaaac

SEQ ID NO: 740782 - RNA, 63 nt, Homo Sapiens
ccuccaggagcaggccuggugcagcccacucugugccuggacaucccccgcaggccgccgcgu

SEQ ID NO: 740783 - RNA, 63 nt, Homo Sapiens
ccauucccgcuccuggaacacuuccugcagcugugccuggaggcagucggccugcagugccag

SEQ ID NO: 740784 - RNA, 63 nt, Homo Sapiens
caaggaauuagcucagagauugaaugcucauccugccuggauuacagagagggguccaaaugg

SEQ ID NO: 740785 - RNA, 63 nt, Homo Sapiens
ggguuaaaauagaccuuucuguaaccugcuuuuugccuggauaugaucuuagggauuuccaaa

SEQ ID NO: 740786 - RNA, 63 nt, Homo Sapiens
gcaguggggggacucgacccccugacauggggcugccuggagcaggccgcgugacguggggcu

SEQ ID NO: 740787 - RNA, 63 nt, Homo Sapiens
uaaaauaauggaaaauuuuaacaauuuguauagugccuggaucauuacuagugccauaacccu

SEQ ID NO: 740788 - RNA, 63 nt, Homo Sapiens
ccuuuucuuuuuuuacgcauagcuccgucaagcugccuggaugagcgcccaugcagcaaggcu

SEQ ID NO: 740789 - RNA, 63 nt, Homo Sapiens
ucccugugagaguucugcagagugcugggcaugugccuggaacuaccgaguaggagccauuuc

SEQ ID NO: 740790 - RNA, 63 nt, Homo Sapiens
cuucgaucucacacacacagaaacauacauucgugccuggagacccugcaggccagaguccaa

SEQ ID NO: 740791 - RNA, 63 nt, Homo Sapiens
agucagccaguugguugcugugguuacagccagugccuggaauuccuccuuagggcccuggga

SEQ ID NO: 740792 - RNA, 53 nt, Homo Sapiens; identical to SEQ ID NO: 332978

SEQ ID NO: 740793 - RNA, 63 nt, Homo Sapiens
aacugaauggcgucuguccugucauccauauggugccuggaaauauuuaccagucaaggucaa

SEQ ID NO: 740794 - RNA, 63 nt, Homo Sapiens
uguucuguaccucuuuguagcagguucuuaguuugccuggaaugccuguccuccaggcugggg

SEQ ID NO: 740795 - RNA, 63 nt, Homo Sapiens
uuucccuccugccccaccaacugcuguuuucccugccuggaaccuccaaccaccacacacucc

SEQ ID NO: 740796 - RNA, 63 nt, Homo Sapiens
aaggauggcagccucagggcucaguaucaaggcugccuggagauggcucuaacauuacugccu

SEQ ID NO: 740797 - RNA, 63 nt, Homo Sapiens
ucuuccuauuaggcuauaaggcccuauaaccccugccuggauuacauucauucaacagcugau

SEQ ID NO: 740798 - RNA, 63 nt, Homo Sapiens
cagcccgacuggaucgccaucugcuacaacaacugccuggagauacucagaguguaguguugg

SEQ ID NO: 740799 - RNA, 63 nt, Homo Sapiens
ccucccucuuugcaccuucuucucuucccucagugccuggagcugguacugggccccuggccc

SEQ ID NO: 740800 - RNA, 63 nt, Homo Sapiens
aaaauauaaaacugaaauaauguaauaagcacuugccuggaaucgagacaugaauacuaucca

SEQ ID NO: 740801 - RNA, 63 nt, Homo Sapiens
guaacuggggggccaccaugagaaggcagggaaugccuggagguugguuccuuggggggccaa

SEQ ID NO: 740802 - RNA, 63 nt, Homo Sapiens
cacggaaacccaacugagaagaaacccaagagcugccuggacaaaaaaagaaagaaagaaaag

SEQ ID NO: 740803 - RNA, 63 nt, Homo Sapiens
uugcuucuggccagggagggacacccuugcccaugccuggaccgagccaagggaacccagaug

SEQ ID NO: 740804 - RNA, 63 nt, Homo Sapiens
cucugcagaucagaacaacggaggauagcuuugugccuggacccagagagugugggacucccc

SEQ ID NO: 740805 - RNA, 63 nt, Homo Sapiens
cugacccucgucuuuguggcagcaaaaccaggaugccuggagcuguggccugagggccugcug

SEQ ID NO: 740806 - RNA, 63 nt, Homo Sapiens
ccgaguagcagggauuaccggugugcaccaccaugccuggauaacuuuuuuuuuuauuucuau

SEQ ID NO: 740807 - RNA, 63 nt, Homo Sapiens
uaccacccuaacguggacacccaggguaacauaugccuggacauccugaaggagaaguggucu

SEQ ID NO: 740808 - RNA, 63 nt, Homo Sapiens
cacugcuaccuuaugugagcccucauugccucuugccuggauuauagccggggucuccuuccu

SEQ ID NO: 740809 - RNA, 63 nt, Homo Sapiens
auacauuuucccacuuaugugccuuuguaccugugccuggaacccuccucuucuuuuucuuuu

SEQ ID NO: 740810 - RNA, 64 nt, Homo Sapiens; identical to SEQ ID NO: 91745

SEQ ID NO: 740811 - RNA, 64 nt, Homo Sapiens; identical to SEQ ID NO: 91746

SEQ ID NO: 740812 - RNA, 64 nt, Homo Sapiens; identical to SEQ ID NO: 91747

SEQ ID NO: 740813 - RNA, 64 nt, Homo Sapiens; identical to SEQ ID NO: 91748

SEQ ID NO: 740814 - RNA, 64 nt, Homo Sapiens; identical to SEQ ID NO: 91749

SEQ ID NO: 740815 - RNA, 64 nt, Homo Sapiens; identical to SEQ ID NO: 91750

SEQ ID NO: 740816 - RNA, 64 nt, Homo Sapiens; identical to SEQ ID NO: 91751

SEQ ID NO: 740817 - RNA, 64 nt, Homo Sapiens; identical to SEQ ID NO: 91752

SEQ ID NO: 740818 - RNA, 64 nt, Homo Sapiens; identical to SEQ ID NO: 91753

SEQ ID NO: 740819 - RNA, 64 nt, Homo Sapiens; identical to SEQ ID NO: 91754

SEQ ID NO: 740820 - RNA, 64 nt, Homo Sapiens; identical to SEQ ID NO: 91755

SEQ ID NO: 740821 - RNA, 64 nt, Homo Sapiens; identical to SEQ ID NO: 91756

SEQ ID NO: 740822 - RNA, 64 nt, Homo Sapiens; identical to SEQ ID NO: 91757

SEQ ID NO: 740823 - RNA, 64 nt, Homo Sapiens; identical to SEQ ID NO: 91758

SEQ ID NO: 740824 - RNA, 64 nt, Homo Sapiens; identical to SEQ ID NO: 91759

SEQ ID NO: 740825 - RNA, 64 nt, Homo Sapiens; identical to SEQ ID NO: 91760

SEQ ID NO: 740826 - RNA, 64 nt, Homo Sapiens; identical to SEQ ID NO: 91761

SEQ ID NO: 740827 - RNA, 64 nt, Homo Sapiens; identical to SEQ ID NO: 91762

SEQ ID NO: 740828 - RNA, 64 nt, Homo Sapiens; identical to SEQ ID NO: 91763

SEQ ID NO: 740829 - RNA, 64 nt, Homo Sapiens; identical to SEQ ID NO: 91764

SEQ ID NO: 740830 - RNA, 64 nt, Homo Sapiens; identical to SEQ ID NO: 91765

SEQ ID NO: 740831 - RNA, 64 nt, Homo Sapiens; identical to SEQ ID NO: 91766

SEQ ID NO: 740832 - RNA, 64 nt, Homo Sapiens; identical to SEQ ID NO: 91767

SEQ ID NO: 740833 - RNA, 64 nt, Homo Sapiens; identical to SEQ ID NO: 91768

SEQ ID NO: 740834 - RNA, 64 nt, Homo Sapiens; identical to SEQ ID NO: 91769

SEQ ID NO: 740835 - RNA, 64 nt, Homo Sapiens; identical to SEQ ID NO: 91770

SEQ ID NO: 740836 - RNA, 64 nt, Homo Sapiens; identical to SEQ ID NO: 91771

SEQ ID NO: 740837 - RNA, 64 nt, Homo Sapiens; identical to SEQ ID NO: 91772

SEQ ID NO: 740838 - RNA, 64 nt, Homo Sapiens; identical to SEQ ID NO: 91773

SEQ ID NO: 740839 - RNA, 64 nt, Homo Sapiens; identical to SEQ ID NO: 91774

SEQ ID NO: 740840 - RNA, 64 nt, Homo Sapiens; identical to SEQ ID NO: 91775

SEQ ID NO: 740841 - RNA, 64 nt, Homo Sapiens; identical to SEQ ID NO: 91776

SEQ ID NO: 740842 - RNA, 64 nt, Homo Sapiens; identical to SEQ ID NO: 91777

SEQ ID NO: 740843 - RNA, 64 nt, Homo Sapiens; identical to SEQ ID NO: 91778

SEQ ID NO: 740844 - RNA, 64 nt, Homo Sapiens; identical to SEQ ID NO: 91779

SEQ ID NO: 740845 - RNA, 64 nt, Homo Sapiens; identical to SEQ ID NO: 91780

SEQ ID NO: 740846 - RNA, 64 nt, Homo Sapiens; identical to SEQ ID NO: 91781

SEQ ID NO: 740847 - RNA, 64 nt, Homo Sapiens; identical to SEQ ID NO: 91782

SEQ ID NO: 740848 - RNA, 64 nt, Homo Sapiens; identical to SEQ ID NO: 91783

SEQ ID NO: 740849 - RNA, 64 nt, Homo Sapiens; identical to SEQ ID NO: 91784

SEQ ID NO: 740850 - RNA, 64 nt, Homo Sapiens; identical to SEQ ID NO: 91785

SEQ ID NO: 740851 - RNA, 64 nt, Homo Sapiens; identical to SEQ ID NO: 91786

SEQ ID NO: 740852 - RNA, 64 nt, Homo Sapiens; identical to SEQ ID NO: 91787

SEQ ID NO: 740853 - RNA, 64 nt, Homo Sapiens; identical to SEQ ID NO: 91788

SEQ ID NO: 740854 - RNA, 64 nt, Homo Sapiens; identical to SEQ ID NO: 91789

SEQ ID NO: 740855 - RNA, 64 nt, Homo Sapiens; identical to SEQ ID NO: 91790

SEQ ID NO: 740856 - RNA, 64 nt, Homo Sapiens; identical to SEQ ID NO: 91791

SEQ ID NO: 740857 - RNA, 64 nt, Homo Sapiens; identical to SEQ ID NO: 91792

SEQ ID NO: 740858 - RNA, 64 nt, Homo Sapiens; identical to SEQ ID NO: 91793

SEQ ID NO: 740859 - RNA, 64 nt, Homo Sapiens; identical to SEQ ID NO: 91794

SEQ ID NO: 740860 - RNA, 64 nt, Homo Sapiens; identical to SEQ ID NO: 91795

SEQ ID NO: 740861 - RNA, 64 nt, Homo Sapiens; identical to SEQ ID NO: 91796

SEQ ID NO: 740862 - RNA, 64 nt, Homo Sapiens; identical to SEQ ID NO: 91797

SEQ ID NO: 740863 - RNA, 64 nt, Homo Sapiens; identical to SEQ ID NO: 91798

SEQ ID NO: 740864 - RNA, 64 nt, Homo Sapiens; identical to SEQ ID NO: 91799

SEQ ID NO: 740865 - RNA, 64 nt, Homo Sapiens; identical to SEQ ID NO: 91800

SEQ ID NO: 740866 - RNA, 54 nt, Homo Sapiens; identical to SEQ ID NO: 91801

SEQ ID NO: 740867 - RNA, 64 nt, Homo Sapiens; identical to SEQ ID NO: 223610

SEQ ID NO: 740868 - RNA, 64 nt, Homo Sapiens; identical to SEQ ID NO: 223611

SEQ ID NO: 740869 - RNA, 64 nt, Homo Sapiens; identical to SEQ ID NO: 348706

SEQ ID NO: 740870 - RNA, 64 nt, Homo Sapiens; identical to SEQ ID NO: 348707

SEQ ID NO: 740871 - RNA, 64 nt, Homo Sapiens; identical to SEQ ID NO: 348708

SEQ ID NO: 740872 - RNA, 64 nt, Homo Sapiens; identical to SEQ ID NO: 348709

SEQ ID NO: 740873 - RNA, 64 nt, Homo Sapiens; identical to SEQ ID NO: 372098

SEQ ID NO: 740874 - RNA, 64 nt, Homo Sapiens; identical to SEQ ID NO: 372099

SEQ ID NO: 740875 - RNA, 64 nt, Homo Sapiens; identical to SEQ ID NO: 372100

SEQ ID NO: 740876 - RNA, 64 nt, Homo Sapiens; identical to SEQ ID NO: 372101

SEQ ID NO: 740877 - RNA, 64 nt, Homo Sapiens; identical to SEQ ID NO: 372102

SEQ ID NO: 740878 - RNA, 64 nt, Homo Sapiens; identical to SEQ ID NO: 372103

SEQ ID NO: 740879 - RNA, 64 nt, Homo Sapiens; identical to SEQ ID NO: 372104

SEQ ID NO: 740880 - RNA, 64 nt, Homo Sapiens; identical to SEQ ID NO: 372105

SEQ ID NO: 740881 - RNA, 64 nt, Homo Sapiens
agaugccacauggaagaggauacaauuagcaucgugauccaagcccaaaacaccccuuuccagu

SEQ ID NO: 740882 - RNA, 64 nt, Homo Sapiens
uuaacuaccuuuuuuucuguuuccguuuuacacaugauccaacguuuguuuagacucccugagg

SEQ ID NO: 740883 - RNA, 64 nt, Homo Sapiens
aggcauuaacaggcuuaauuaggccacaguacagugauccaaggcaggcaaggcagccaggaca

SEQ ID NO: 740884 - RNA, 64 nt, Homo Sapiens
augacaaaucucugaaagagguuuuuaaaacuuuugauccaacugcuucaccauuuuguuagcu

SEQ ID NO: 740885 - RNA, 64 nt, Homo Sapiens
acacuuuguauuaaauuguuuguucauuguauugugauccaauauuuauuuuugaaauggccuu

SEQ ID NO: 740886 - RNA, 64 nt, Homo Sapiens
cuaguuuguuaucucaucugaucagaugcccagaugauccaagaugaaucauuggcuucuagaa

SEQ ID NO: 740887 - RNA, 64 nt, Homo Sapiens
uucaauucauuuguguacucguuaggguaaauucugauccaauagauaacuuuuuacucuucaa

SEQ ID NO: 740888 - RNA, 64 nt, Homo Sapiens
uguauauaccauauauaaacuucuuagacucaugugauccaagcguuacaaaucgacaguuuua

SEQ ID NO: 740889 - RNA, 63 nt, Homo Sapiens
uuuaaagaaugguuccugaaaugaagucaguagaaauggcaugggauaagagcagagcucaca

SEQ ID NO: 740890 - RNA, 63 nt, Homo Sapiens
uccacuuuuucagguaaacauuuuucauuuggcaaauggcauaauuauuugaaagugacagga

SEQ ID NO: 740891 - RNA, 63 nt, Homo Sapiens
auacuagaaacacaaggaaaugcaaguuacgcuaaauggcaguaauacuacccaacugccuuu

SEQ ID NO: 740892 - RNA, 63 nt, Homo Sapiens
aucagcauacacauuuuugacuguacacacuauaaauggcaucaaauuuggauauuuuucuua

SEQ ID NO: 740893 - RNA, 63 nt, Homo Sapiens
uccuauuucauuagugaagacauaguucaccuaaaauggcauccugcucugaaucuagacuuu

SEQ ID NO: 740894 - RNA, 63 nt, Homo Sapiens
aauggcauccugcucugaaucuagacuuuuuagaaauggcauauguuuuugaugauaugucaa

SEQ ID NO: 740895 - RNA, 63 nt, Homo Sapiens
uuaagcaagccauaguuaguagacaacuuuauaaaauggcacuucuuucuggcuaauuaaaaa

SEQ ID NO: 740896 - RNA, 63 nt, Homo Sapiens
uucgugaucaccacagugagugcuaagagcugaaaauggcauccccuagagcuuucccugugu

SEQ ID NO: 740897 - RNA, 63 nt, Homo Sapiens
ggaugugcuucauccucuaaggcacaguauuugaaauggcaaagccuuccuaguccuccaccu

SEQ ID NO: 740898 - RNA, 63 nt, Homo Sapiens
gugguccgagguagcugcucaagaaucugguuuaaauggcauugauugagaauuuuauuugaa

SEQ ID NO: 740899 - RNA, 63 nt, Homo Sapiens
uaaauuacuugaucuuuuugauuuuguuuaugaaaauggcaaggaugagagaggggacuaauu

SEQ ID NO: 740900 - RNA, 63 nt, Homo Sapiens
gugaggcucugggguuagauuucaaacuguaugaaauggcaaaucuaagguucuuuuuuuuua

SEQ ID NO: 740901 - RNA, 63 nt, Homo Sapiens
uuuguaagcgugucauuuaacauuuaauuuuagaaauggcaaaaggaugucuugaaacccgug

SEQ ID NO: 740902 - RNA, 63 nt, Homo Sapiens
gccaggaguuggaccuaggugguugcuagcaggaaauggcagaauuauaccaguguuguccaa

SEQ ID NO: 740903 - RNA, 63 nt, Homo Sapiens
agaaaugcagauuucccaguaguuggguaacaaaaauggcaaaagcacuuugcgcauugugua

SEQ ID NO: 740904 - RNA, 63 nt, Homo Sapiens
auucccccuuggaauuugacaguuucuauggugaaauggcagaagguaacaacuauguugaaa

SEQ ID NO: 740905 - RNA, 63 nt, Homo Sapiens
auauacaguuuuuucuucuuaguucugcauuagaaauggcaucuguuuuaggucucaaaauau

SEQ ID NO: 740906 - RNA, 63 nt, Homo Sapiens
accacuaccaaccauucauuuuccucuuugacuaaauggcauuuccugcuccuccucucaugu

SEQ ID NO: 740907 - RNA, 63 nt, Homo Sapiens
agagcuuaaaaaccaaaguugggcaauuaaaauaaauggcauauuuagguggaauugaugucu

SEQ ID NO: 740908 - RNA, 63 nt, Homo Sapiens
augggacugaaacaugagaauuuuuuucaucucaaauggcagcuaaaauucugacaguugccu

SEQ ID NO: 740909 - RNA, 63 nt, Homo Sapiens
agagguaacuuaauuugggaauuuguuguguugaaauggcauuuaauuucaaccuaaauacug

SEQ ID NO: 740910 - RNA, 63 nt, Homo Sapiens
aaugaaauuuuuuaguauguucaacucucauccaaauggcauaugacccuguuuacacagccu

SEQ ID NO: 740911 - RNA, 63 nt, Homo Sapiens
uguauaccaauuuguagaaaauuugaauggauuaaauggcacccuugaagauguagcuuccaa

SEQ ID NO: 740912 - RNA, 63 nt, Homo Sapiens
acaaggugugcaguggccccuaacugcccuuuuaaauggcauggcugcaaaaccggcaaccug

SEQ ID NO: 740913 - RNA, 63 nt, Homo Sapiens
aacaccuuaagcaauauauuauugguaacuaagaaauggcacacugugaaugcagaauguaaa

SEQ ID NO: 740914 - RNA, 63 nt, Homo Sapiens
guuuuuaugacuuuuauacuauuuuacuacaguaaauggcaguacucaaauaaaaugccccac

SEQ ID NO: 740915 - RNA, 63 nt, Homo Sapiens
gaagcuggucuuuaaugaguggaaaugguuucuaaauggcaucauguuucacuggaauugaug

SEQ ID NO: 740916 - RNA, 63 nt, Homo Sapiens
ugggcucuguaaguuauuuuugacacaguauugaaauggcagguauacccagauuuacagaga

SEQ ID NO: 740917 - RNA, 63 nt, Homo Sapiens
augccaauaugagauauuucaggcacuacaaugaaauggcaggaguaucaauggaaaaaugau

SEQ ID NO: 740918 - RNA, 63 nt, Homo Sapiens
caaagaugaucauuuuuauguucaaaauuacugaaauggcaauagaaaauaacauacccugua

SEQ ID NO: 740919 - RNA, 63 nt, Homo Sapiens
gacguuaaaaaaaguuuuucuaacaugacacuaaaauggcagacuggggaagggaaguuucag

SEQ ID NO: 740920 - RNA, 63 nt, Homo Sapiens
ugcucuuguuuuacccauguuugccucucuugaaaauggcaggguauccugggugaagccugu

SEQ ID NO: 740921 - RNA, 63 nt, Homo Sapiens
gaaaaguuauuuuucaaaggucuugcaguuaauaaauggcagagugagcauucaaguccaggu

SEQ ID NO: 740922 - RNA, 63 nt, Homo Sapiens
gugaaaauguauaaaagaugcaucuguuguuucaaauggcacuaucuucuuuucaguacuaca

SEQ ID NO: 740923 - RNA, 63 nt, Homo Sapiens
uuuuaaacacucugaccauagaaauguuuuucaaaauggcaacaauggauaaaccaaggauuu

SEQ ID NO: 740924 - RNA, 63 nt, Homo Sapiens
gcaaaaucuauggccacacugagaagccuuugaaaauggcaaauacuuuucaucaccaauugc

SEQ ID NO: 740925 - RNA, 63 nt, Homo Sapiens
auccguguacgaaucgaauaaaaauuugggggaaaauggcacugcaauaaucaacugaauugc

SEQ ID NO: 740926 - RNA, 63 nt, Homo Sapiens
acauauguagaugugcugcacaaugugccuucuaaauggcauguguccauuuacagcccucag

SEQ ID NO: 740927 - RNA, 63 nt, Homo Sapiens
cguaucucuaauuuauggucuauauaccaauuuaaauggcauguaaaccugccuguuucuucu

SEQ ID NO: 740928 - RNA, 63 nt, Homo Sapiens
gagacauuuaagauugucagcaaacuugucccaaaauggcacaucaucauaauccauuuucuc

SEQ ID NO: 740929 - RNA, 63 nt, Homo Sapiens
auuguuuuuauucuuacacgacuacaguacuucaaauggcacauagauaggcaggauauuaca

SEQ ID NO: 740930 - RNA, 63 nt, Homo Sapiens
guuucagugucacagagacauucuuugauaaggaaauggcacaaacauaaagggaaaggcugc

SEQ ID NO: 740931 - RNA, 63 nt, Homo Sapiens
gucaauauuaaagauagcugagaagcaccuuucaaauggcacagucccucuucaagaugucua

SEQ ID NO: 740932 - RNA, 63 nt, Homo Sapiens
gcauuucccuaucuugcaguucuguuaacaugaaaauggcauuuuuccauaauagcuuuaaaa

SEQ ID NO: 740933 - RNA, 63 nt, Homo Sapiens
gauugucuuagucucaaugagauguagcuacaaaaauggcaccucuuagcagugaugaggcuc

SEQ ID NO: 740934 - RNA, 63 nt, Homo Sapiens
ucuugaaauagaauuggggcacuaauggaagacaaauggcaaaaauggcauaaauauggucgc

SEQ ID NO: 740935 - RNA, 63 nt, Homo Sapiens
aauauggucgcacuaauggauaaaagggaagguaaauggcauacaccuucagccacagccuua

SEQ ID NO: 740936 - RNA, 63 nt, Homo Sapiens
ucuccuaauuaauuuuccacaacagcauucuagaaauggcauucaaaugaagagaaaaagaaa

SEQ ID NO: 740937 - RNA, 63 nt, Homo Sapiens
aagacgucaggccacccucauaaugcuuuaaaaaaauggcaaacuggauaaccuaauuuuuuu

SEQ ID NO: 740938 - RNA, 63 nt, Homo Sapiens
uagacauggauaggagugcguuuuaggcacagcaaauggcacauacaagggccagggagcaag

SEQ ID NO: 740939 - RNA, 63 nt, Homo Sapiens
gccagggagcaagagagaggacagguccucaacaaauggcaugugacuuuguaaguguagaau

SEQ ID NO: 740940 - RNA, 63 nt, Homo Sapiens
cugcggaucgagagaggggguagagucuucuucaaauggcaguuuuacuucaaauggcagauu

SEQ ID NO: 740941 - RNA, 63 nt, Homo Sapiens
gguagagucuucuucaaauggcaguuuuacuucaaauggcagauuucacaagaguugguuauu

SEQ ID NO: 740942 - RNA, 63 nt, Homo Sapiens
agauggcucuauauuuuuuaguugaaugagguaaaauggcauucacauuucuuacaaaaaaga

SEQ ID NO: 740943 - RNA, 63 nt, Homo Sapiens
ucauauacauguaaaaucagugugcacauaugaaaauggcacaaguuucucuuaaucugauua

SEQ ID NO: 740944 - RNA, 63 nt, Homo Sapiens
uuuagguauagauaaccuaaaacugcuuuauaaaaauggcaacagagcaucuucauuuuaauu

SEQ ID NO: 740945 - RNA, 63 nt, Homo Sapiens
uugcugaagugucaaaauauauuuuuaucagaaaaauggcauauaaaagccugaauuugaaau

SEQ ID NO: 740946 - RNA, 63 nt, Homo Sapiens
accacgucuaaagcaguuucuuacucuugugccaaauggcaacuccacaucauggcaguucau

SEQ ID NO: 740947 - RNA, 63 nt, Homo Sapiens
uaaauaccuuaguuaaugacuaauauauguaagaaauggcaaacucccuagugaaaacuuggg

SEQ ID NO: 740948 - RNA, 64 nt, Homo Sapiens
uugggauuuuuuuuuuuuuaaaauacuuuagggacuguuguaauuucucauauggugcuggaaa

SEQ ID NO: 740949 - RNA, 64 nt, Homo Sapiens
ggcuagcggaggacuacccuugcucacugacuuccuguuguaacacacuuuccuuacggagccu

SEQ ID NO: 740950 - RNA, 64 nt, Homo Sapiens
cacugcuaauaguggauugucaauaauuuuuuugcuguuguacuuuuaguauguguaaauugua

SEQ ID NO: 740951 - RNA, 64 nt, Homo Sapiens
uugagauuucccaaauuaaggauuugguuucucccuguuguaauugggcucaaguacacauccu

SEQ ID NO: 740952 - RNA, 64 nt, Homo Sapiens
ccccuuucauauuauuuuuaaauuuuuuaauuaccuguuguaggguguuccuccagaagcaaag

SEQ ID NO: 740953 - RNA, 64 nt, Homo Sapiens
cgguucuuucguagaacaauuuccauguuguuaacuguuguagacuuaauugaaucacauuuug

SEQ ID NO: 740954 - RNA, 64 nt, Homo Sapiens
uuuugcuuuccaucuguuacugaacuuaagauagcuguuguacucaaccagcaauguugagagc

SEQ ID NO: 740955 - RNA, 64 nt, Homo Sapiens
aacuaaucuuugcuuguuuugauguauauagucacuguuguauaagcuagcauguuuucccucu

SEQ ID NO: 740956 - RNA, 64 nt, Homo Sapiens
auaacaguauuacaugucaaacucacaaguuuaacuguuguauuacagaugacuucuguuguag

SEQ ID NO: 740957 - RNA, 64 nt, Homo Sapiens
cucacaaguuuaacuguuguacuacagaugacuucuguuguagaucaacuuuguuuccuguuua

SEQ ID NO: 740958 - RNA, 64 nt, Homo Sapiens
uuucaguuagacaaggcaacugaguucaagagaucuguuguacagcuuggugacuguaauuaac

SEQ ID NO: 740959 - RNA, 64 nt, Homo Sapiens
auauaaaaaauuagccaggcauaguggcgcaugccuguuguagccccagcuacucaagaggcug

SEQ ID NO: 740960 - RNA, 64 nt, Homo Sapiens
uucucuuugccuggaguaaaucaagauccuaugucuguuguauuggaggagaacuacguugaaa

SEQ ID NO: 740961 - RNA, 64 nt, Homo Sapiens
gcaucucugcuacagcagucugucccuucucuugcuguuguaauuccauggucuuggaaaagau

SEQ ID NO: 740962 - RNA, 64 nt, Homo Sapiens
caauaaguuuauugcugugacuguucaaguaugucuguuguaacgccuuucuucccauccuuaa

SEQ ID NO: 740963 - RNA, 64 nt, Homo Sapiens
aacaguuuaacacaauacuaaaaaagaaaaaacucuguuguaaacuuacuggguuuaauuaaaa

SEQ ID NO: 740964 - RNA, 64 nt, Homo Sapiens
cuguccaacaaacacacacggguagauugcuggccuguuguaggugguagggacacagaugacc

SEQ ID NO: 740965 - RNA, 64 nt, Homo Sapiens
guagaagagaaucaagaagaaaaauaaaaaucagcuguuguaaucaccuagcaaacuggcguaa

SEQ ID NO: 740966 - RNA, 64 nt, Homo Sapiens
cacacacacacacacacacacacacucccuuacacuguuguacuuccgugggcccuccuuccag

SEQ ID NO: 740967 - RNA, 64 nt, Homo Sapiens
cuguuuaguuuacucagguggccacauacagucucuguuguauauucuugguuuuguuuuaaua

SEQ ID NO: 740968 - RNA, 64 nt, Homo Sapiens; identical to SEQ ID NO: 46370

SEQ ID NO: 740969 - RNA, 64 nt, Homo Sapiens; identical to SEQ ID NO: 46371

SEQ ID NO: 740970 - RNA, 64 nt, Homo Sapiens; identical to SEQ ID NO: 46372

SEQ ID NO: 740971 - RNA, 64 nt, Homo Sapiens; identical to SEQ ID NO: 46373

SEQ ID NO: 740972 - RNA, 64 nt, Homo Sapiens; identical to SEQ ID NO: 46374

SEQ ID NO: 740973 - RNA, 64 nt, Homo Sapiens; identical to SEQ ID NO: 46375

SEQ ID NO: 740974 - RNA, 64 nt, Homo Sapiens; identical to SEQ ID NO: 46376

SEQ ID NO: 740975 - RNA, 64 nt, Homo Sapiens; identical to SEQ ID NO: 46377

SEQ ID NO: 740976 - RNA, 64 nt, Homo Sapiens; identical to SEQ ID NO: 46378

SEQ ID NO: 740977 - RNA, 64 nt, Homo Sapiens; identical to SEQ ID NO: 46379

SEQ ID NO: 740978 - RNA, 64 nt, Homo Sapiens; identical to SEQ ID NO: 46380

SEQ ID NO: 740979 - RNA, 64 nt, Homo Sapiens; identical to SEQ ID NO: 46381

SEQ ID NO: 740980 - RNA, 64 nt, Homo Sapiens; identical to SEQ ID NO: 46382

SEQ ID NO: 740981 - RNA, 64 nt, Homo Sapiens; identical to SEQ ID NO: 46383

SEQ ID NO: 740982 - RNA, 64 nt, Homo Sapiens; identical to SEQ ID NO: 46384

SEQ ID NO: 740983 - RNA, 64 nt, Homo Sapiens; identical to SEQ ID NO: 46385

SEQ ID NO: 740984 - RNA, 64 nt, Homo Sapiens; identical to SEQ ID NO: 46386

SEQ ID NO: 740985 - RNA, 64 nt, Homo Sapiens; identical to SEQ ID NO: 46387

SEQ ID NO: 740986 - RNA, 64 nt, Homo Sapiens; identical to SEQ ID NO: 46388

SEQ ID NO: 740987 - RNA, 64 nt, Homo Sapiens; identical to SEQ ID NO: 46389

SEQ ID NO: 740988 - RNA, 64 nt, Homo Sapiens; identical to SEQ ID NO: 46390

SEQ ID NO: 740989 - RNA, 64 nt, Homo Sapiens; identical to SEQ ID NO: 46391

SEQ ID NO: 740990 - RNA, 64 nt, Homo Sapiens; identical to SEQ ID NO: 46392

SEQ ID NO: 740991 - RNA, 64 nt, Homo Sapiens; identical to SEQ ID NO: 46393

SEQ ID NO: 740992 - RNA, 64 nt, Homo Sapiens; identical to SEQ ID NO: 46394

SEQ ID NO: 740993 - RNA, 64 nt, Homo Sapiens; identical to SEQ ID NO: 46395

SEQ ID NO: 740994 - RNA, 64 nt, Homo Sapiens; identical to SEQ ID NO: 46396

SEQ ID NO: 740995 - RNA, 64 nt, Homo Sapiens; identical to SEQ ID NO: 46397

SEQ ID NO: 740996 - RNA, 64 nt, Homo Sapiens; identical to SEQ ID NO: 46398

SEQ ID NO: 740997 - RNA, 64 nt, Homo Sapiens; identical to SEQ ID NO: 46399

SEQ ID NO: 740998 - RNA, 64 nt, Homo Sapiens; identical to SEQ ID NO: 46400

SEQ ID NO: 740999 - RNA, 64 nt, Homo Sapiens; identical to SEQ ID NO: 46401

SEQ ID NO: 741000 - RNA, 64 nt, Homo Sapiens; identical to SEQ ID NO: 46402

SEQ ID NO: 741001 - RNA, 64 nt, Homo Sapiens; identical to SEQ ID NO: 46403

SEQ ID NO: 741002 - RNA, 64 nt, Homo Sapiens; identical to SEQ ID NO: 46404

SEQ ID NO: 741003 - RNA, 64 nt, Homo Sapiens; identical to SEQ ID NO: 46405

SEQ ID NO: 741004 - RNA, 64 nt, Homo Sapiens; identical to SEQ ID NO: 46406

SEQ ID NO: 741005 - RNA, 64 nt, Homo Sapiens; identical to SEQ ID NO: 46407

SEQ ID NO: 741006 - RNA, 64 nt, Homo Sapiens; identical to SEQ ID NO: 46408

SEQ ID NO: 741007 - RNA, 64 nt, Homo Sapiens; identical to SEQ ID NO: 46409

SEQ ID NO: 741008 - RNA, 64 nt, Homo Sapiens; identical to SEQ ID NO: 46410

SEQ ID NO: 741009 - RNA, 64 nt, Homo Sapiens; identical to SEQ ID NO: 46411

SEQ ID NO: 741010 - RNA, 64 nt, Homo Sapiens; identical to SEQ ID NO: 46412

SEQ ID NO: 741011 - RNA, 64 nt, Homo Sapiens; identical to SEQ ID NO: 46413

SEQ ID NO: 741012 - RNA, 64 nt, Homo Sapiens; identical to SEQ ID NO: 46414

SEQ ID NO: 741013 - RNA, 64 nt, Homo Sapiens; identical to SEQ ID NO: 46415

SEQ ID NO: 741014 - RNA, 64 nt, Homo Sapiens; identical to SEQ ID NO: 46416

SEQ ID NO: 741015 - RNA, 64 nt, Homo Sapiens; identical to SEQ ID NO: 46417

SEQ ID NO: 741016 - RNA, 64 nt, Homo Sapiens; identical to SEQ ID NO: 46418

SEQ ID NO: 741017 - RNA, 64 nt, Homo Sapiens; identical to SEQ ID NO: 46419

SEQ ID NO: 741018 - RNA, 64 nt, Homo Sapiens; identical to SEQ ID NO: 46420

SEQ ID NO: 741019 - RNA, 64 nt, Homo Sapiens; identical to SEQ ID NO: 46421

SEQ ID NO: 741020 - RNA, 64 nt, Homo Sapiens; identical to SEQ ID NO: 46422

SEQ ID NO: 741021 - RNA, 64 nt, Homo Sapiens; identical to SEQ ID NO: 46423

SEQ ID NO: 741022 - RNA, 64 nt, Homo Sapiens; identical to SEQ ID NO: 46424

SEQ ID NO: 741023 - RNA, 64 nt, Homo Sapiens; identical to SEQ ID NO: 46425

SEQ ID NO: 741024 - RNA, 64 nt, Homo Sapiens; identical to SEQ ID NO: 46426

SEQ ID NO: 741025 - RNA, 64 nt, Homo Sapiens; identical to SEQ ID NO: 46427

SEQ ID NO: 741026 - RNA, 64 nt, Homo Sapiens; identical to SEQ ID NO: 46428

SEQ ID NO: 741027 - RNA, 64 nt, Homo Sapiens; identical to SEQ ID NO: 46429

SEQ ID NO: 741028 - RNA, 64 nt, Homo Sapiens; identical to SEQ ID NO: 46430

SEQ ID NO: 741029 - RNA, 64 nt, Homo Sapiens; identical to SEQ ID NO: 46431

SEQ ID NO: 741030 - RNA, 64 nt, Homo Sapiens; identical to SEQ ID NO: 46432

SEQ ID NO: 741031 - RNA, 64 nt, Homo Sapiens; identical to SEQ ID NO: 46433

SEQ ID NO: 741032 - RNA, 64 nt, Homo Sapiens; identical to SEQ ID NO: 46434

SEQ ID NO: 741033 - RNA, 64 nt, Homo Sapiens; identical to SEQ ID NO: 46435

SEQ ID NO: 741034 - RNA, 64 nt, Homo Sapiens; identical to SEQ ID NO: 46436

SEQ ID NO: 741035 - RNA, 64 nt, Homo Sapiens; identical to SEQ ID NO: 46437

SEQ ID NO: 741036 - RNA, 64 nt, Homo Sapiens; identical to SEQ ID NO: 46438

SEQ ID NO: 741037 - RNA, 64 nt, Homo Sapiens; identical to SEQ ID NO: 46439

SEQ ID NO: 741038 - RNA, 64 nt, Homo Sapiens; identical to SEQ ID NO: 46440

SEQ ID NO: 741039 - RNA, 64 nt, Homo Sapiens; identical to SEQ ID NO: 46441

SEQ ID NO: 741040 - RNA, 64 nt, Homo Sapiens; identical to SEQ ID NO: 46442

SEQ ID NO: 741041 - RNA, 64 nt, Homo Sapiens; identical to SEQ ID NO: 46443

SEQ ID NO: 741042 - RNA, 64 nt, Homo Sapiens; identical to SEQ ID NO: 46444

SEQ ID NO: 741043 - RNA, 64 nt, Homo Sapiens; identical to SEQ ID NO: 46445

SEQ ID NO: 741044 - RNA, 64 nt, Homo Sapiens; identical to SEQ ID NO: 46446

SEQ ID NO: 741045 - RNA, 64 nt, Homo Sapiens; identical to SEQ ID NO: 46447

SEQ ID NO: 741046 - RNA, 64 nt, Homo Sapiens; identical to SEQ ID NO: 46448

SEQ ID NO: 741047 - RNA, 64 nt, Homo Sapiens; identical to SEQ ID NO: 46449

SEQ ID NO: 741048 - RNA, 64 nt, Homo Sapiens; identical to SEQ ID NO: 46450

SEQ ID NO: 741049 - RNA, 64 nt, Homo Sapiens; identical to SEQ ID NO: 46451

SEQ ID NO: 741050 - RNA, 64 nt, Homo Sapiens; identical to SEQ ID NO: 46452

SEQ ID NO: 741051 - RNA, 64 nt, Homo Sapiens; identical to SEQ ID NO: 46453

SEQ ID NO: 741052 - RNA, 64 nt, Homo Sapiens; identical to SEQ ID NO: 46454

SEQ ID NO: 741053 - RNA, 64 nt, Homo Sapiens; identical to SEQ ID NO: 46455

SEQ ID NO: 741054 - RNA, 64 nt, Homo Sapiens; identical to SEQ ID NO: 46456

SEQ ID NO: 741055 - RNA, 64 nt, Homo Sapiens; identical to SEQ ID NO: 46457

SEQ ID NO: 741056 - RNA, 64 nt, Homo Sapiens; identical to SEQ ID NO: 46458

SEQ ID NO: 741057 - RNA, 64 nt, Homo Sapiens; identical to SEQ ID NO: 46459

SEQ ID NO: 741058 - RNA, 64 nt, Homo Sapiens; identical to SEQ ID NO: 46460

SEQ ID NO: 741059 - RNA, 64 nt, Homo Sapiens; identical to SEQ ID NO: 46461

SEQ ID NO: 741060 - RNA, 64 nt, Homo Sapiens; identical to SEQ ID NO: 46462

SEQ ID NO: 741061 - RNA, 64 nt, Homo Sapiens; identical to SEQ ID NO: 46463

SEQ ID NO: 741062 - RNA, 64 nt, Homo Sapiens; identical to SEQ ID NO: 46464

SEQ ID NO: 741063 - RNA, 64 nt, Homo Sapiens; identical to SEQ ID NO: 46465

SEQ ID NO: 741064 - RNA, 64 nt, Homo Sapiens; identical to SEQ ID NO: 46466

SEQ ID NO: 741065 - RNA, 64 nt, Homo Sapiens; identical to SEQ ID NO: 46467

SEQ ID NO: 741066 - RNA, 64 nt, Homo Sapiens; identical to SEQ ID NO: 46468

SEQ ID NO: 741067 - RNA, 64 nt, Homo Sapiens; identical to SEQ ID NO: 46469

SEQ ID NO: 741068 - RNA, 64 nt, Homo Sapiens; identical to SEQ ID NO: 46470

SEQ ID NO: 741069 - RNA, 64 nt, Homo Sapiens; identical to SEQ ID NO: 46471

SEQ ID NO: 741070 - RNA, 64 nt, Homo Sapiens; identical to SEQ ID NO: 46472

SEQ ID NO: 741071 - RNA, 64 nt, Homo Sapiens; identical to SEQ ID NO: 46473

SEQ ID NO: 741072 - RNA, 64 nt, Homo Sapiens; identical to SEQ ID NO: 46474

SEQ ID NO: 741073 - RNA, 60 nt, Homo Sapiens; identical to SEQ ID NO: 46475

SEQ ID NO: 741074 - RNA, 64 nt, Homo Sapiens; identical to SEQ ID NO: 46476

SEQ ID NO: 741075 - RNA, 64 nt, Homo Sapiens; identical to SEQ ID NO: 46477

SEQ ID NO: 741076 - RNA, 64 nt, Homo Sapiens; identical to SEQ ID NO: 46478

SEQ ID NO: 741077 - RNA, 64 nt, Homo Sapiens; identical to SEQ ID NO: 46479

SEQ ID NO: 741078 - RNA, 64 nt, Homo Sapiens; identical to SEQ ID NO: 46480

SEQ ID NO: 741079 - RNA, 64 nt, Homo Sapiens; identical to SEQ ID NO: 46481

SEQ ID NO: 741080 - RNA, 64 nt, Homo Sapiens; identical to SEQ ID NO: 46482

SEQ ID NO: 741081 - RNA, 64 nt, Homo Sapiens; identical to SEQ ID NO: 46483

SEQ ID NO: 741082 - RNA, 64 nt, Homo Sapiens; identical to SEQ ID NO: 46484

SEQ ID NO: 741083 - RNA, 64 nt, Homo Sapiens; identical to SEQ ID NO: 46485

SEQ ID NO: 741084 - RNA, 64 nt, Homo Sapiens; identical to SEQ ID NO: 46486

SEQ ID NO: 741085 - RNA, 64 nt, Homo Sapiens; identical to SEQ ID NO: 46487

SEQ ID NO: 741086 - RNA, 64 nt, Homo Sapiens; identical to SEQ ID NO: 46488

SEQ ID NO: 741087 - RNA, 64 nt, Homo Sapiens; identical to SEQ ID NO: 46489

SEQ ID NO: 741088 - RNA, 64 nt, Homo Sapiens; identical to SEQ ID NO: 46490

SEQ ID NO: 741089 - RNA, 64 nt, Homo Sapiens; identical to SEQ ID NO: 46491

SEQ ID NO: 741090 - RNA, 64 nt, Homo Sapiens; identical to SEQ ID NO: 46492

SEQ ID NO: 741091 - RNA, 64 nt, Homo Sapiens; identical to SEQ ID NO: 46493

SEQ ID NO: 741092 - RNA, 64 nt, Homo Sapiens; identical to SEQ ID NO: 46494

SEQ ID NO: 741093 - RNA, 64 nt, Homo Sapiens; identical to SEQ ID NO: 46495

SEQ ID NO: 741094 - RNA, 64 nt, Homo Sapiens; identical to SEQ ID NO: 46496

SEQ ID NO: 741095 - RNA, 64 nt, Homo Sapiens; identical to SEQ ID NO: 46497

SEQ ID NO: 741096 - RNA, 64 nt, Homo Sapiens; identical to SEQ ID NO: 46498

SEQ ID NO: 741097 - RNA, 64 nt, Homo Sapiens; identical to SEQ ID NO: 46499

SEQ ID NO: 741098 - RNA, 64 nt, Homo Sapiens; identical to SEQ ID NO: 46500

SEQ ID NO: 741099 - RNA, 64 nt, Homo Sapiens; identical to SEQ ID NO: 46501

SEQ ID NO: 741100 - RNA, 64 nt, Homo Sapiens; identical to SEQ ID NO: 46502

SEQ ID NO: 741101 - RNA, 64 nt, Homo Sapiens; identical to SEQ ID NO: 46503

SEQ ID NO: 741102 - RNA, 64 nt, Homo Sapiens; identical to SEQ ID NO: 46504

SEQ ID NO: 741103 - RNA, 64 nt, Homo Sapiens; identical to SEQ ID NO: 46505

SEQ ID NO: 741104 - RNA, 64 nt, Homo Sapiens; identical to SEQ ID NO: 46506

SEQ ID NO: 741105 - RNA, 64 nt, Homo Sapiens; identical to SEQ ID NO: 46507

SEQ ID NO: 741106 - RNA, 64 nt, Homo Sapiens; identical to SEQ ID NO: 46508

SEQ ID NO: 741107 - RNA, 64 nt, Homo Sapiens; identical to SEQ ID NO: 46509

SEQ ID NO: 741108 - RNA, 64 nt, Homo Sapiens; identical to SEQ ID NO: 46510

SEQ ID NO: 741109 - RNA, 64 nt, Homo Sapiens; identical to SEQ ID NO: 46511

SEQ ID NO: 741110 - RNA, 64 nt, Homo Sapiens; identical to SEQ ID NO: 46512

SEQ ID NO: 741111 - RNA, 64 nt, Homo Sapiens; identical to SEQ ID NO: 46513

SEQ ID NO: 741112 - RNA, 64 nt, Homo Sapiens; identical to SEQ ID NO: 46514

SEQ ID NO: 741113 - RNA, 64 nt, Homo Sapiens; identical to SEQ ID NO: 46515

SEQ ID NO: 741114 - RNA, 64 nt, Homo Sapiens; identical to SEQ ID NO: 46516

SEQ ID NO: 741115 - RNA, 64 nt, Homo Sapiens; identical to SEQ ID NO: 46517

SEQ ID NO: 741116 - RNA, 64 nt, Homo Sapiens; identical to SEQ ID NO: 46518

SEQ ID NO: 741117 - RNA, 64 nt, Homo Sapiens; identical to SEQ ID NO: 46519

SEQ ID NO: 741118 - RNA, 64 nt, Homo Sapiens; identical to SEQ ID NO: 46520

SEQ ID NO: 741119 - RNA, 64 nt, Homo Sapiens; identical to SEQ ID NO: 46521

SEQ ID NO: 741120 - RNA, 64 nt, Homo Sapiens; identical to SEQ ID NO: 46522

SEQ ID NO: 741121 - RNA, 64 nt, Homo Sapiens; identical to SEQ ID NO: 46523

SEQ ID NO: 741122 - RNA, 64 nt, Homo Sapiens; identical to SEQ ID NO: 46524

SEQ ID NO: 741123 - RNA, 64 nt, Homo Sapiens; identical to SEQ ID NO: 46525

SEQ ID NO: 741124 - RNA, 64 nt, Homo Sapiens; identical to SEQ ID NO: 46526

SEQ ID NO: 741125 - RNA, 64 nt, Homo Sapiens; identical to SEQ ID NO: 46527

SEQ ID NO: 741126 - RNA, 64 nt, Homo Sapiens; identical to SEQ ID NO: 46528

SEQ ID NO: 741127 - RNA, 64 nt, Homo Sapiens; identical to SEQ ID NO: 46529

SEQ ID NO: 741128 - RNA, 50 nt, Homo Sapiens; identical to SEQ ID NO: 46530

SEQ ID NO: 741129 - RNA, 64 nt, Homo Sapiens; identical to SEQ ID NO: 46531

SEQ ID NO: 741130 - RNA, 64 nt, Homo Sapiens
uaaaugauguguuuacuuagcauguuuucagguagagcuuaaacguuuuguuuuaauaaaacag

SEQ ID NO: 741131 - RNA, 64 nt, Homo Sapiens
aacauuuuuaaaaauaauuagcaaacaaucauuggagcuuaauggacuguagauaaggauagca

SEQ ID NO: 741132 - RNA, 64 nt, Homo Sapiens; identical to SEQ ID NO: 528631

SEQ ID NO: 741133 - RNA, 64 nt, Homo Sapiens; identical to SEQ ID NO: 528632

SEQ ID NO: 741134 - RNA, 64 nt, Homo Sapiens; identical to SEQ ID NO: 528633

SEQ ID NO: 741135 - RNA, 64 nt, Homo Sapiens; identical to SEQ ID NO: 528634

SEQ ID NO: 741136 - RNA, 64 nt, Homo Sapiens; identical to SEQ ID NO: 528635

SEQ ID NO: 741137 - RNA, 64 nt, Homo Sapiens; identical to SEQ ID NO: 528636

SEQ ID NO: 741138 - RNA, 64 nt, Homo Sapiens; identical to SEQ ID NO: 528637

SEQ ID NO: 741139 - RNA, 64 nt, Homo Sapiens; identical to SEQ ID NO: 528638

SEQ ID NO: 741140 - RNA, 64 nt, Homo Sapiens; identical to SEQ ID NO: 528639

SEQ ID NO: 741141 - RNA, 64 nt, Homo Sapiens; identical to SEQ ID NO: 528640

SEQ ID NO: 741142 - RNA, 64 nt, Homo Sapiens; identical to SEQ ID NO: 528641

SEQ ID NO: 741143 - RNA, 64 nt, Homo Sapiens; identical to SEQ ID NO: 528642

SEQ ID NO: 741144 - RNA, 64 nt, Homo Sapiens; identical to SEQ ID NO: 528643

SEQ ID NO: 741145 - RNA, 64 nt, Homo Sapiens; identical to SEQ ID NO: 528644

SEQ ID NO: 741146 - RNA, 64 nt, Homo Sapiens; identical to SEQ ID NO: 528645

SEQ ID NO: 741147 - RNA, 64 nt, Homo Sapiens; identical to SEQ ID NO: 528646

SEQ ID NO: 741148 - RNA, 64 nt, Homo Sapiens; identical to SEQ ID NO: 528647

SEQ ID NO: 741149 - RNA, 64 nt, Homo Sapiens; identical to SEQ ID NO: 528648

SEQ ID NO: 741150 - RNA, 64 nt, Homo Sapiens; identical to SEQ ID NO: 528649

SEQ ID NO: 741151 - RNA, 64 nt, Homo Sapiens; identical to SEQ ID NO: 528650

SEQ ID NO: 741152 - RNA, 64 nt, Homo Sapiens; identical to SEQ ID NO: 528651

SEQ ID NO: 741153 - RNA, 64 nt, Homo Sapiens; identical to SEQ ID NO: 528652

SEQ ID NO: 741154 - RNA, 64 nt, Homo Sapiens; identical to SEQ ID NO: 528653

SEQ ID NO: 741155 - RNA, 64 nt, Homo Sapiens; identical to SEQ ID NO: 528654

SEQ ID NO: 741156 - RNA, 57 nt, Homo Sapiens; identical to SEQ ID NO: 528655

SEQ ID NO: 741157 - RNA, 64 nt, Homo Sapiens; identical to SEQ ID NO: 528656

SEQ ID NO: 741158 - RNA, 64 nt, Homo Sapiens; identical to SEQ ID NO: 528657

SEQ ID NO: 741159 - RNA, 64 nt, Homo Sapiens; identical to SEQ ID NO: 528658

SEQ ID NO: 741160 - RNA, 64 nt, Homo Sapiens; identical to SEQ ID NO: 528659

SEQ ID NO: 741161 - RNA, 64 nt, Homo Sapiens; identical to SEQ ID NO: 528660

SEQ ID NO: 741162 - RNA, 64 nt, Homo Sapiens; identical to SEQ ID NO: 286991

SEQ ID NO: 741163 - RNA, 64 nt, Homo Sapiens; identical to SEQ ID NO: 286992

SEQ ID NO: 741164 - RNA, 64 nt, Homo Sapiens; identical to SEQ ID NO: 286993

SEQ ID NO: 741165 - RNA, 64 nt, Homo Sapiens; identical to SEQ ID NO: 286994

SEQ ID NO: 741166 - RNA, 64 nt, Homo Sapiens; identical to SEQ ID NO: 286995

SEQ ID NO: 741167 - RNA, 64 nt, Homo Sapiens; identical to SEQ ID NO: 286996

SEQ ID NO: 741168 - RNA, 64 nt, Homo Sapiens; identical to SEQ ID NO: 286997

SEQ ID NO: 741169 - RNA, 64 nt, Homo Sapiens; identical to SEQ ID NO: 286998

SEQ ID NO: 741170 - RNA, 64 nt, Homo Sapiens; identical to SEQ ID NO: 286999

SEQ ID NO: 741171 - RNA, 64 nt, Homo Sapiens; identical to SEQ ID NO: 287000

SEQ ID NO: 741172 - RNA, 64 nt, Homo Sapiens; identical to SEQ ID NO: 287001

SEQ ID NO: 741173 - RNA, 64 nt, Homo Sapiens; identical to SEQ ID NO: 287002

SEQ ID NO: 741174 - RNA, 64 nt, Homo Sapiens; identical to SEQ ID NO: 287003

SEQ ID NO: 741175 - RNA, 64 nt, Homo Sapiens; identical to SEQ ID NO: 287004

SEQ ID NO: 741176 - RNA, 64 nt, Homo Sapiens; identical to SEQ ID NO: 287005

SEQ ID NO: 741177 - RNA, 64 nt, Homo Sapiens; identical to SEQ ID NO: 287006

SEQ ID NO: 741178 - RNA, 64 nt, Homo Sapiens; identical to SEQ ID NO: 287007

SEQ ID NO: 741179 - RNA, 64 nt, Homo Sapiens; identical to SEQ ID NO: 287008

SEQ ID NO: 741180 - RNA, 64 nt, Homo Sapiens; identical to SEQ ID NO: 287009

SEQ ID NO: 741181 - RNA, 64 nt, Homo Sapiens; identical to SEQ ID NO: 287010

SEQ ID NO: 741182 - RNA, 64 nt, Homo Sapiens; identical to SEQ ID NO: 287011

SEQ ID NO: 741183 - RNA, 64 nt, Homo Sapiens; identical to SEQ ID NO: 287012

SEQ ID NO: 741184 - RNA, 64 nt, Homo Sapiens; identical to SEQ ID NO: 287013

SEQ ID NO: 741185 - RNA, 64 nt, Homo Sapiens; identical to SEQ ID NO: 287014

SEQ ID NO: 741186 - RNA, 64 nt, Homo Sapiens; identical to SEQ ID NO: 287015

SEQ ID NO: 741187 - RNA, 64 nt, Homo Sapiens; identical to SEQ ID NO: 287016

SEQ ID NO: 741188 - RNA, 64 nt, Homo Sapiens; identical to SEQ ID NO: 287017

SEQ ID NO: 741189 - RNA, 64 nt, Homo Sapiens; identical to SEQ ID NO: 287018

SEQ ID NO: 741190 - RNA, 64 nt, Homo Sapiens; identical to SEQ ID NO: 287019

SEQ ID NO: 741191 - RNA, 64 nt, Homo Sapiens; identical to SEQ ID NO: 287020

SEQ ID NO: 741192 - RNA, 64 nt, Homo Sapiens; identical to SEQ ID NO: 287021

SEQ ID NO: 741193 - RNA, 64 nt, Homo Sapiens; identical to SEQ ID NO: 287022

SEQ ID NO: 741194 - RNA, 64 nt, Homo Sapiens; identical to SEQ ID NO: 287023

SEQ ID NO: 741195 - RNA, 64 nt, Homo Sapiens; identical to SEQ ID NO: 287024

SEQ ID NO: 741196 - RNA, 64 nt, Homo Sapiens; identical to SEQ ID NO: 287025

SEQ ID NO: 741197 - RNA, 64 nt, Homo Sapiens; identical to SEQ ID NO: 287026

SEQ ID NO: 741198 - RNA, 64 nt, Homo Sapiens; identical to SEQ ID NO: 287027

SEQ ID NO: 741199 - RNA, 64 nt, Homo Sapiens; identical to SEQ ID NO: 287028

SEQ ID NO: 741200 - RNA, 64 nt, Homo Sapiens; identical to SEQ ID NO: 287029

SEQ ID NO: 741201 - RNA, 64 nt, Homo Sapiens; identical to SEQ ID NO: 287030

SEQ ID NO: 741202 - RNA, 64 nt, Homo Sapiens; identical to SEQ ID NO: 287031

SEQ ID NO: 741203 - RNA, 64 nt, Homo Sapiens; identical to SEQ ID NO: 287032

SEQ ID NO: 741204 - RNA, 64 nt, Homo Sapiens; identical to SEQ ID NO: 287033

SEQ ID NO: 741205 - RNA, 64 nt, Homo Sapiens; identical to SEQ ID NO: 287034

SEQ ID NO: 741206 - RNA, 64 nt, Homo Sapiens; identical to SEQ ID NO: 287035

SEQ ID NO: 741207 - RNA, 64 nt, Homo Sapiens; identical to SEQ ID NO: 287036

SEQ ID NO: 741208 - RNA, 64 nt, Homo Sapiens; identical to SEQ ID NO: 287037

SEQ ID NO: 741209 - RNA, 64 nt, Homo Sapiens; identical to SEQ ID NO: 287038

SEQ ID NO: 741210 - RNA, 64 nt, Homo Sapiens; identical to SEQ ID NO: 287039

SEQ ID NO: 741211 - RNA, 64 nt, Homo Sapiens; identical to SEQ ID NO: 287040

SEQ ID NO: 741212 - RNA, 64 nt, Homo Sapiens; identical to SEQ ID NO: 287041

SEQ ID NO: 741213 - RNA, 64 nt, Homo Sapiens; identical to SEQ ID NO: 287042

SEQ ID NO: 741214 - RNA, 64 nt, Homo Sapiens; identical to SEQ ID NO: 287043

SEQ ID NO: 741215 - RNA, 64 nt, Homo Sapiens; identical to SEQ ID NO: 287044

SEQ ID NO: 741216 - RNA, 64 nt, Homo Sapiens; identical to SEQ ID NO: 287045

SEQ ID NO: 741217 - RNA, 64 nt, Homo Sapiens; identical to SEQ ID NO: 287046

SEQ ID NO: 741218 - RNA, 64 nt, Homo Sapiens; identical to SEQ ID NO: 287047

SEQ ID NO: 741219 - RNA, 64 nt, Homo Sapiens; identical to SEQ ID NO: 287048

SEQ ID NO: 741220 - RNA, 64 nt, Homo Sapiens; identical to SEQ ID NO: 287049

SEQ ID NO: 741221 - RNA, 64 nt, Homo Sapiens; identical to SEQ ID NO: 287050

SEQ ID NO: 741222 - RNA, 64 nt, Homo Sapiens; identical to SEQ ID NO: 287051

SEQ ID NO: 741223 - RNA, 64 nt, Homo Sapiens; identical to SEQ ID NO: 287052

SEQ ID NO: 741224 - RNA, 64 nt, Homo Sapiens; identical to SEQ ID NO: 287053

SEQ ID NO: 741225 - RNA, 64 nt, Homo Sapiens; identical to SEQ ID NO: 287054

SEQ ID NO: 741226 - RNA, 64 nt, Homo Sapiens; identical to SEQ ID NO: 287055

SEQ ID NO: 741227 - RNA, 64 nt, Homo Sapiens; identical to SEQ ID NO: 287056

SEQ ID NO: 741228 - RNA, 64 nt, Homo Sapiens; identical to SEQ ID NO: 287057

SEQ ID NO: 741229 - RNA, 64 nt, Homo Sapiens; identical to SEQ ID NO: 287058

SEQ ID NO: 741230 - RNA, 64 nt, Homo Sapiens; identical to SEQ ID NO: 287059

SEQ ID NO: 741231 - RNA, 64 nt, Homo Sapiens; identical to SEQ ID NO: 287060

SEQ ID NO: 741232 - RNA, 64 nt, Homo Sapiens; identical to SEQ ID NO: 287061

SEQ ID NO: 741233 - RNA, 64 nt, Homo Sapiens; identical to SEQ ID NO: 287062

SEQ ID NO: 741234 - RNA, 64 nt, Homo Sapiens; identical to SEQ ID NO: 287063

SEQ ID NO: 741235 - RNA, 64 nt, Homo Sapiens; identical to SEQ ID NO: 287064

SEQ ID NO: 741236 - RNA, 64 nt, Homo Sapiens; identical to SEQ ID NO: 287065

SEQ ID NO: 741237 - RNA, 64 nt, Homo Sapiens; identical to SEQ ID NO: 287066

SEQ ID NO: 741238 - RNA, 64 nt, Homo Sapiens; identical to SEQ ID NO: 287067

SEQ ID NO: 741239 - RNA, 64 nt, Homo Sapiens; identical to SEQ ID NO: 287068

SEQ ID NO: 741240 - RNA, 64 nt, Homo Sapiens; identical to SEQ ID NO: 287069

SEQ ID NO: 741241 - RNA, 64 nt, Homo Sapiens; identical to SEQ ID NO: 287070

SEQ ID NO: 741242 - RNA, 64 nt, Homo Sapiens; identical to SEQ ID NO: 287071

SEQ ID NO: 741243 - RNA, 64 nt, Homo Sapiens; identical to SEQ ID NO: 287072

SEQ ID NO: 741244 - RNA, 64 nt, Homo Sapiens; identical to SEQ ID NO: 287073

SEQ ID NO: 741245 - RNA, 64 nt, Homo Sapiens; identical to SEQ ID NO: 287074

SEQ ID NO: 741246 - RNA, 64 nt, Homo Sapiens; identical to SEQ ID NO: 287075

SEQ ID NO: 741247 - RNA, 55 nt, Homo Sapiens; identical to SEQ ID NO: 287076

SEQ ID NO: 741248 - RNA, 64 nt, Homo Sapiens; identical to SEQ ID NO: 287077

SEQ ID NO: 741249 - RNA, 64 nt, Homo Sapiens; identical to SEQ ID NO: 287078

SEQ ID NO: 741250 - RNA, 64 nt, Homo Sapiens; identical to SEQ ID NO: 287079

SEQ ID NO: 741251 - RNA, 64 nt, Homo Sapiens; identical to SEQ ID NO: 287080

SEQ ID NO: 741252 - RNA, 64 nt, Homo Sapiens; identical to SEQ ID NO: 287081

SEQ ID NO: 741253 - RNA, 64 nt, Homo Sapiens; identical to SEQ ID NO: 287082

SEQ ID NO: 741254 - RNA, 64 nt, Homo Sapiens; identical to SEQ ID NO: 287083

SEQ ID NO: 741255 - RNA, 64 nt, Homo Sapiens; identical to SEQ ID NO: 287084

SEQ ID NO: 741256 - RNA, 64 nt, Homo Sapiens; identical to SEQ ID NO: 287085

SEQ ID NO: 741257 - RNA, 64 nt, Homo Sapiens; identical to SEQ ID NO: 287086

SEQ ID NO: 741258 - RNA, 64 nt, Homo Sapiens; identical to SEQ ID NO: 287087

SEQ ID NO: 741259 - RNA, 64 nt, Homo Sapiens; identical to SEQ ID NO: 287088

SEQ ID NO: 741260 - RNA, 64 nt, Homo Sapiens; identical to SEQ ID NO: 287089

SEQ ID NO: 741261 - RNA, 64 nt, Homo Sapiens; identical to SEQ ID NO: 287090

SEQ ID NO: 741262 - RNA, 64 nt, Homo Sapiens; identical to SEQ ID NO: 287091

SEQ ID NO: 741263 - RNA, 64 nt, Homo Sapiens; identical to SEQ ID NO: 287092

SEQ ID NO: 741264 - RNA, 64 nt, Homo Sapiens; identical to SEQ ID NO: 287093

SEQ ID NO: 741265 - RNA, 64 nt, Homo Sapiens; identical to SEQ ID NO: 287094

SEQ ID NO: 741266 - RNA, 64 nt, Homo Sapiens; identical to SEQ ID NO: 287095

SEQ ID NO: 741267 - RNA, 64 nt, Homo Sapiens; identical to SEQ ID NO: 287096

SEQ ID NO: 741268 - RNA, 64 nt, Homo Sapiens; identical to SEQ ID NO: 287097

SEQ ID NO: 741269 - RNA, 64 nt, Homo Sapiens; identical to SEQ ID NO: 287098

SEQ ID NO: 741270 - RNA, 64 nt, Homo Sapiens; identical to SEQ ID NO: 287099

SEQ ID NO: 741271 - RNA, 64 nt, Homo Sapiens; identical to SEQ ID NO: 287100

SEQ ID NO: 741272 - RNA, 64 nt, Homo Sapiens; identical to SEQ ID NO: 287101

SEQ ID NO: 741273 - RNA, 64 nt, Homo Sapiens; identical to SEQ ID NO: 287102

SEQ ID NO: 741274 - RNA, 64 nt, Homo Sapiens; identical to SEQ ID NO: 287103

SEQ ID NO: 741275 - RNA, 64 nt, Homo Sapiens; identical to SEQ ID NO: 287104

SEQ ID NO: 741276 - RNA, 64 nt, Homo Sapiens; identical to SEQ ID NO: 287105

SEQ ID NO: 741277 - RNA, 64 nt, Homo Sapiens; identical to SEQ ID NO: 287106

SEQ ID NO: 741278 - RNA, 64 nt, Homo Sapiens; identical to SEQ ID NO: 287107

SEQ ID NO: 741279 - RNA, 64 nt, Homo Sapiens; identical to SEQ ID NO: 287108

SEQ ID NO: 741280 - RNA, 64 nt, Homo Sapiens; identical to SEQ ID NO: 287109

SEQ ID NO: 741281 - RNA, 64 nt, Homo Sapiens; identical to SEQ ID NO: 287110

SEQ ID NO: 741282 - RNA, 64 nt, Homo Sapiens; identical to SEQ ID NO: 287111

SEQ ID NO: 741283 - RNA, 64 nt, Homo Sapiens; identical to SEQ ID NO: 287112

SEQ ID NO: 741284 - RNA, 64 nt, Homo Sapiens; identical to SEQ ID NO: 287113

SEQ ID NO: 741285 - RNA, 64 nt, Homo Sapiens; identical to SEQ ID NO: 287114

SEQ ID NO: 741286 - RNA, 64 nt, Homo Sapiens; identical to SEQ ID NO: 287115

SEQ ID NO: 741287 - RNA, 64 nt, Homo Sapiens; identical to SEQ ID NO: 287116

SEQ ID NO: 741288 - RNA, 64 nt, Homo Sapiens; identical to SEQ ID NO: 287117

SEQ ID NO: 741289 - RNA, 64 nt, Homo Sapiens; identical to SEQ ID NO: 287118

SEQ ID NO: 741290 - RNA, 52 nt, Homo Sapiens; identical to SEQ ID NO: 287119

SEQ ID NO: 741291 - RNA, 64 nt, Homo Sapiens; identical to SEQ ID NO: 287120

SEQ ID NO: 741292 - RNA, 64 nt, Homo Sapiens; identical to SEQ ID NO: 287121

SEQ ID NO: 741293 - RNA, 64 nt, Homo Sapiens; identical to SEQ ID NO: 287122

SEQ ID NO: 741294 - RNA, 55 nt, Homo Sapiens; identical to SEQ ID NO: 287123

SEQ ID NO: 741295 - RNA, 64 nt, Homo Sapiens; identical to SEQ ID NO: 287124

SEQ ID NO: 741296 - RNA, 64 nt, Homo Sapiens; identical to SEQ ID NO: 287125

SEQ ID NO: 741297 - RNA, 64 nt, Homo Sapiens; identical to SEQ ID NO: 287126

SEQ ID NO: 741298 - RNA, 64 nt, Homo Sapiens; identical to SEQ ID NO: 287127

SEQ ID NO: 741299 - RNA, 64 nt, Homo Sapiens; identical to SEQ ID NO: 287128

SEQ ID NO: 741300 - RNA, 64 nt, Homo Sapiens; identical to SEQ ID NO: 287129

SEQ ID NO: 741301 - RNA, 64 nt, Homo Sapiens; identical to SEQ ID NO: 287130

SEQ ID NO: 741302 - RNA, 64 nt, Homo Sapiens; identical to SEQ ID NO: 287131

SEQ ID NO: 741303 - RNA, 64 nt, Homo Sapiens; identical to SEQ ID NO: 287132

SEQ ID NO: 741304 - RNA, 64 nt, Homo Sapiens; identical to SEQ ID NO: 287133

SEQ ID NO: 741305 - RNA, 64 nt, Homo Sapiens; identical to SEQ ID NO: 287134

SEQ ID NO: 741306 - RNA, 64 nt, Homo Sapiens; identical to SEQ ID NO: 287135

SEQ ID NO: 741307 - RNA, 64 nt, Homo Sapiens; identical to SEQ ID NO: 287136

SEQ ID NO: 741308 - RNA, 64 nt, Homo Sapiens; identical to SEQ ID NO: 287137

SEQ ID NO: 741309 - RNA, 64 nt, Homo Sapiens; identical to SEQ ID NO: 287138

SEQ ID NO: 741310 - RNA, 64 nt, Homo Sapiens; identical to SEQ ID NO: 287139

SEQ ID NO: 741311 - RNA, 64 nt, Homo Sapiens; identical to SEQ ID NO: 287140

SEQ ID NO: 741312 - RNA, 64 nt, Homo Sapiens; identical to SEQ ID NO: 287141

SEQ ID NO: 741313 - RNA, 64 nt, Homo Sapiens; identical to SEQ ID NO: 287142

SEQ ID NO: 741314 - RNA, 64 nt, Homo Sapiens; identical to SEQ ID NO: 287143

SEQ ID NO: 741315 - RNA, 64 nt, Homo Sapiens; identical to SEQ ID NO: 287144

SEQ ID NO: 741316 - RNA, 64 nt, Homo Sapiens; identical to SEQ ID NO: 287145

SEQ ID NO: 741317 - RNA, 64 nt, Homo Sapiens; identical to SEQ ID NO: 287146

SEQ ID NO: 741318 - RNA, 64 nt, Homo Sapiens; identical to SEQ ID NO: 287147

SEQ ID NO: 741319 - RNA, 64 nt, Homo Sapiens; identical to SEQ ID NO: 287148

SEQ ID NO: 741320 - RNA, 64 nt, Homo Sapiens; identical to SEQ ID NO: 287149

SEQ ID NO: 741321 - RNA, 64 nt, Homo Sapiens; identical to SEQ ID NO: 287150

SEQ ID NO: 741322 - RNA, 64 nt, Homo Sapiens; identical to SEQ ID NO: 287151

SEQ ID NO: 741323 - RNA, 64 nt, Homo Sapiens; identical to SEQ ID NO: 287152

SEQ ID NO: 741324 - RNA, 64 nt, Homo Sapiens; identical to SEQ ID NO: 287153

SEQ ID NO: 741325 - RNA, 64 nt, Homo Sapiens; identical to SEQ ID NO: 287154

SEQ ID NO: 741326 - RNA, 64 nt, Homo Sapiens; identical to SEQ ID NO: 287155

SEQ ID NO: 741327 - RNA, 64 nt, Homo Sapiens; identical to SEQ ID NO: 287156

SEQ ID NO: 741328 - RNA, 64 nt, Homo Sapiens; identical to SEQ ID NO: 287157

SEQ ID NO: 741329 - RNA, 64 nt, Homo Sapiens; identical to SEQ ID NO: 287158

SEQ ID NO: 741330 - RNA, 64 nt, Homo Sapiens; identical to SEQ ID NO: 287159

SEQ ID NO: 741331 - RNA, 64 nt, Homo Sapiens; identical to SEQ ID NO: 287160

SEQ ID NO: 741332 - RNA, 64 nt, Homo Sapiens; identical to SEQ ID NO: 287161

SEQ ID NO: 741333 - RNA, 64 nt, Homo Sapiens; identical to SEQ ID NO: 287162

SEQ ID NO: 741334 - RNA, 64 nt, Homo Sapiens; identical to SEQ ID NO: 287163

SEQ ID NO: 741335 - RNA, 64 nt, Homo Sapiens; identical to SEQ ID NO: 287164

SEQ ID NO: 741336 - RNA, 64 nt, Homo Sapiens; identical to SEQ ID NO: 287165

SEQ ID NO: 741337 - RNA, 64 nt, Homo Sapiens; identical to SEQ ID NO: 287166

SEQ ID NO: 741338 - RNA, 64 nt, Homo Sapiens; identical to SEQ ID NO: 287167

SEQ ID NO: 741339 - RNA, 64 nt, Homo Sapiens; identical to SEQ ID NO: 287168

SEQ ID NO: 741340 - RNA, 64 nt, Homo Sapiens; identical to SEQ ID NO: 287169

SEQ ID NO: 741341 - RNA, 64 nt, Homo Sapiens; identical to SEQ ID NO: 287170

SEQ ID NO: 741342 - RNA, 64 nt, Homo Sapiens; identical to SEQ ID NO: 287171

SEQ ID NO: 741343 - RNA, 64 nt, Homo Sapiens; identical to SEQ ID NO: 287172

SEQ ID NO: 741344 - RNA, 64 nt, Homo Sapiens; identical to SEQ ID NO: 287173

SEQ ID NO: 741345 - RNA, 64 nt, Homo Sapiens; identical to SEQ ID NO: 287174

SEQ ID NO: 741346 - RNA, 64 nt, Homo Sapiens; identical to SEQ ID NO: 287175

SEQ ID NO: 741347 - RNA, 64 nt, Homo Sapiens; identical to SEQ ID NO: 287176

SEQ ID NO: 741348 - RNA, 64 nt, Homo Sapiens; identical to SEQ ID NO: 572073

SEQ ID NO: 741349 - RNA, 64 nt, Homo Sapiens; identical to SEQ ID NO: 572074

SEQ ID NO: 741350 - RNA, 64 nt, Homo Sapiens; identical to SEQ ID NO: 572075

SEQ ID NO: 741351 - RNA, 64 nt, Homo Sapiens; identical to SEQ ID NO: 572076

SEQ ID NO: 741352 - RNA, 64 nt, Homo Sapiens; identical to SEQ ID NO: 572077

SEQ ID NO: 741353 - RNA, 64 nt, Homo Sapiens; identical to SEQ ID NO: 572078

SEQ ID NO: 741354 - RNA, 64 nt, Homo Sapiens; identical to SEQ ID NO: 572079

SEQ ID NO: 741355 - RNA, 64 nt, Homo Sapiens; identical to SEQ ID NO: 572080

SEQ ID NO: 741356 - RNA, 64 nt, Homo Sapiens; identical to SEQ ID NO: 572081

SEQ ID NO: 741357 - RNA, 64 nt, Homo Sapiens; identical to SEQ ID NO: 572082

SEQ ID NO: 741358 - RNA, 64 nt, Homo Sapiens; identical to SEQ ID NO: 572083

SEQ ID NO: 741359 - RNA, 64 nt, Homo Sapiens; identical to SEQ ID NO: 572084

SEQ ID NO: 741360 - RNA, 64 nt, Homo Sapiens; identical to SEQ ID NO: 572085

SEQ ID NO: 741361 - RNA, 64 nt, Homo Sapiens; identical to SEQ ID NO: 572086

SEQ ID NO: 741362 - RNA, 64 nt, Homo Sapiens; identical to SEQ ID NO: 572087

SEQ ID NO: 741363 - RNA, 64 nt, Homo Sapiens; identical to SEQ ID NO: 572088

SEQ ID NO: 741364 - RNA, 64 nt, Homo Sapiens; identical to SEQ ID NO: 572089

SEQ ID NO: 741365 - RNA, 64 nt, Homo Sapiens; identical to SEQ ID NO: 572090

SEQ ID NO: 741366 - RNA, 64 nt, Homo Sapiens; identical to SEQ ID NO: 572091

SEQ ID NO: 741367 - RNA, 64 nt, Homo Sapiens; identical to SEQ ID NO: 572092

SEQ ID NO: 741368 - RNA, 64 nt, Homo Sapiens; identical to SEQ ID NO: 572093

SEQ ID NO: 741369 - RNA, 64 nt, Homo Sapiens; identical to SEQ ID NO: 572094

SEQ ID NO: 741370 - RNA, 64 nt, Homo Sapiens; identical to SEQ ID NO: 572095

SEQ ID NO: 741371 - RNA, 64 nt, Homo Sapiens; identical to SEQ ID NO: 572096

SEQ ID NO: 741372 - RNA, 64 nt, Homo Sapiens; identical to SEQ ID NO: 572097

SEQ ID NO: 741373 - RNA, 64 nt, Homo Sapiens; identical to SEQ ID NO: 572098

SEQ ID NO: 741374 - RNA, 64 nt, Homo Sapiens; identical to SEQ ID NO: 572099

SEQ ID NO: 741375 - RNA, 64 nt, Homo Sapiens; identical to SEQ ID NO: 572100

SEQ ID NO: 741376 - RNA, 64 nt, Homo Sapiens; identical to SEQ ID NO: 572101

SEQ ID NO: 741377 - RNA, 64 nt, Homo Sapiens; identical to SEQ ID NO: 572102

SEQ ID NO: 741378 - RNA, 64 nt, Homo Sapiens; identical to SEQ ID NO: 572103

SEQ ID NO: 741379 - RNA, 64 nt, Homo Sapiens; identical to SEQ ID NO: 572104

SEQ ID NO: 741380 - RNA, 64 nt, Homo Sapiens; identical to SEQ ID NO: 572105

SEQ ID NO: 741381 - RNA, 64 nt, Homo Sapiens; identical to SEQ ID NO: 572106

SEQ ID NO: 741382 - RNA, 64 nt, Homo Sapiens; identical to SEQ ID NO: 572107

SEQ ID NO: 741383 - RNA, 64 nt, Homo Sapiens; identical to SEQ ID NO: 572108

SEQ ID NO: 741384 - RNA, 64 nt, Homo Sapiens; identical to SEQ ID NO: 572109

SEQ ID NO: 741385 - RNA, 55 nt, Homo Sapiens; identical to SEQ ID NO: 572110

SEQ ID NO: 741386 - RNA, 64 nt, Homo Sapiens; identical to SEQ ID NO: 572111

SEQ ID NO: 741387 - RNA, 64 nt, Homo Sapiens; identical to SEQ ID NO: 572112

SEQ ID NO: 741388 - RNA, 64 nt, Homo Sapiens; identical to SEQ ID NO: 572113

SEQ ID NO: 741389 - RNA, 64 nt, Homo Sapiens; identical to SEQ ID NO: 74140

SEQ ID NO: 741390 - RNA, 64 nt, Homo Sapiens; identical to SEQ ID NO: 74141

SEQ ID NO: 741391 - RNA, 64 nt, Homo Sapiens; identical to SEQ ID NO: 74142

SEQ ID NO: 741392 - RNA, 64 nt, Homo Sapiens; identical to SEQ ID NO: 74143

SEQ ID NO: 741393 - RNA, 64 nt, Homo Sapiens; identical to SEQ ID NO: 74144

SEQ ID NO: 741394 - RNA, 64 nt, Homo Sapiens; identical to SEQ ID NO: 74145

SEQ ID NO: 741395 - RNA, 64 nt, Homo Sapiens; identical to SEQ ID NO: 74146

SEQ ID NO: 741396 - RNA, 64 nt, Homo Sapiens; identical to SEQ ID NO: 74147

SEQ ID NO: 741397 - RNA, 64 nt, Homo Sapiens; identical to SEQ ID NO: 74148

SEQ ID NO: 741398 - RNA, 64 nt, Homo Sapiens; identical to SEQ ID NO: 74149

SEQ ID NO: 741399 - RNA, 64 nt, Homo Sapiens; identical to SEQ ID NO: 74150

SEQ ID NO: 741400 - RNA, 64 nt, Homo Sapiens; identical to SEQ ID NO: 74151

SEQ ID NO: 741401 - RNA, 64 nt, Homo Sapiens; identical to SEQ ID NO: 74152

SEQ ID NO: 741402 - RNA, 64 nt, Homo Sapiens; identical to SEQ ID NO: 74153

SEQ ID NO: 741403 - RNA, 64 nt, Homo Sapiens; identical to SEQ ID NO: 74154

SEQ ID NO: 741404 - RNA, 64 nt, Homo Sapiens; identical to SEQ ID NO: 74155

SEQ ID NO: 741405 - RNA, 64 nt, Homo Sapiens; identical to SEQ ID NO: 74156

SEQ ID NO: 741406 - RNA, 64 nt, Homo Sapiens; identical to SEQ ID NO: 74157

SEQ ID NO: 741407 - RNA, 64 nt, Homo Sapiens; identical to SEQ ID NO: 74158

SEQ ID NO: 741408 - RNA, 64 nt, Homo Sapiens; identical to SEQ ID NO: 74159

SEQ ID NO: 741409 - RNA, 64 nt, Homo Sapiens; identical to SEQ ID NO: 74160

SEQ ID NO: 741410 - RNA, 64 nt, Homo Sapiens; identical to SEQ ID NO: 74161

SEQ ID NO: 741411 - RNA, 64 nt, Homo Sapiens; identical to SEQ ID NO: 74162

SEQ ID NO: 741412 - RNA, 64 nt, Homo Sapiens; identical to SEQ ID NO: 74163

SEQ ID NO: 741413 - RNA, 64 nt, Homo Sapiens; identical to SEQ ID NO: 74164

SEQ ID NO: 741414 - RNA, 64 nt, Homo Sapiens; identical to SEQ ID NO: 74165

SEQ ID NO: 741415 - RNA, 64 nt, Homo Sapiens; identical to SEQ ID NO: 74166

SEQ ID NO: 741416 - RNA, 64 nt, Homo Sapiens; identical to SEQ ID NO: 74167

SEQ ID NO: 741417 - RNA, 64 nt, Homo Sapiens; identical to SEQ ID NO: 74168

SEQ ID NO: 741418 - RNA, 64 nt, Homo Sapiens; identical to SEQ ID NO: 74169

SEQ ID NO: 741419 - RNA, 64 nt, Homo Sapiens; identical to SEQ ID NO: 74170

SEQ ID NO: 741420 - RNA, 64 nt, Homo Sapiens; identical to SEQ ID NO: 74171

SEQ ID NO: 741421 - RNA, 64 nt, Homo Sapiens; identical to SEQ ID NO: 74172

SEQ ID NO: 741422 - RNA, 64 nt, Homo Sapiens; identical to SEQ ID NO: 74173

SEQ ID NO: 741423 - RNA, 64 nt, Homo Sapiens; identical to SEQ ID NO: 74174

SEQ ID NO: 741424 - RNA, 64 nt, Homo Sapiens; identical to SEQ ID NO: 74175

SEQ ID NO: 741425 - RNA, 64 nt, Homo Sapiens; identical to SEQ ID NO: 74176

SEQ ID NO: 741426 - RNA, 64 nt, Homo Sapiens; identical to SEQ ID NO: 74177

SEQ ID NO: 741427 - RNA, 64 nt, Homo Sapiens; identical to SEQ ID NO: 74178

SEQ ID NO: 741428 - RNA, 64 nt, Homo Sapiens; identical to SEQ ID NO: 74179

SEQ ID NO: 741429 - RNA, 64 nt, Homo Sapiens; identical to SEQ ID NO: 74180

SEQ ID NO: 741430 - RNA, 64 nt, Homo Sapiens; identical to SEQ ID NO: 74181

SEQ ID NO: 741431 - RNA, 64 nt, Homo Sapiens; identical to SEQ ID NO: 74182

SEQ ID NO: 741432 - RNA, 64 nt, Homo Sapiens; identical to SEQ ID NO: 74183

SEQ ID NO: 741433 - RNA, 64 nt, Homo Sapiens; identical to SEQ ID NO: 74184

SEQ ID NO: 741434 - RNA, 64 nt, Homo Sapiens; identical to SEQ ID NO: 74185

SEQ ID NO: 741435 - RNA, 64 nt, Homo Sapiens; identical to SEQ ID NO: 74186

SEQ ID NO: 741436 - RNA, 64 nt, Homo Sapiens; identical to SEQ ID NO: 74187

SEQ ID NO: 741437 - RNA, 64 nt, Homo Sapiens; identical to SEQ ID NO: 74188

SEQ ID NO: 741438 - RNA, 64 nt, Homo Sapiens; identical to SEQ ID NO: 74189

SEQ ID NO: 741439 - RNA, 64 nt, Homo Sapiens; identical to SEQ ID NO: 74190

SEQ ID NO: 741440 - RNA, 64 nt, Homo Sapiens; identical to SEQ ID NO: 74191

SEQ ID NO: 741441 - RNA, 64 nt, Homo Sapiens; identical to SEQ ID NO: 74192

SEQ ID NO: 741442 - RNA, 64 nt, Homo Sapiens; identical to SEQ ID NO: 74193

SEQ ID NO: 741443 - RNA, 64 nt, Homo Sapiens; identical to SEQ ID NO: 74194

SEQ ID NO: 741444 - RNA, 64 nt, Homo Sapiens; identical to SEQ ID NO: 74195

SEQ ID NO: 741445 - RNA, 64 nt, Homo Sapiens; identical to SEQ ID NO: 74196

SEQ ID NO: 741446 - RNA, 64 nt, Homo Sapiens; identical to SEQ ID NO: 74197

SEQ ID NO: 741447 - RNA, 64 nt, Homo Sapiens; identical to SEQ ID NO: 74198

SEQ ID NO: 741448 - RNA, 64 nt, Homo Sapiens; identical to SEQ ID NO: 74199

SEQ ID NO: 741449 - RNA, 64 nt, Homo Sapiens; identical to SEQ ID NO: 74200

SEQ ID NO: 741450 - RNA, 64 nt, Homo Sapiens; identical to SEQ ID NO: 74201

SEQ ID NO: 741451 - RNA, 64 nt, Homo Sapiens; identical to SEQ ID NO: 74202

SEQ ID NO: 741452 - RNA, 64 nt, Homo Sapiens; identical to SEQ ID NO: 74203

SEQ ID NO: 741453 - RNA, 64 nt, Homo Sapiens; identical to SEQ ID NO: 74204

SEQ ID NO: 741454 - RNA, 64 nt, Homo Sapiens; identical to SEQ ID NO: 74205

SEQ ID NO: 741455 - RNA, 64 nt, Homo Sapiens; identical to SEQ ID NO: 74206

SEQ ID NO: 741456 - RNA, 64 nt, Homo Sapiens; identical to SEQ ID NO: 74207

SEQ ID NO: 741457 - RNA, 64 nt, Homo Sapiens; identical to SEQ ID NO: 74208

SEQ ID NO: 741458 - RNA, 64 nt, Homo Sapiens; identical to SEQ ID NO: 74209

SEQ ID NO: 741459 - RNA, 64 nt, Homo Sapiens; identical to SEQ ID NO: 74210

SEQ ID NO: 741460 - RNA, 64 nt, Homo Sapiens; identical to SEQ ID NO: 74211

SEQ ID NO: 741461 - RNA, 64 nt, Homo Sapiens; identical to SEQ ID NO: 74212

SEQ ID NO: 741462 - RNA, 64 nt, Homo Sapiens; identical to SEQ ID NO: 74213

SEQ ID NO: 741463 - RNA, 64 nt, Homo Sapiens; identical to SEQ ID NO: 74214

SEQ ID NO: 741464 - RNA, 64 nt, Homo Sapiens; identical to SEQ ID NO: 74215

SEQ ID NO: 741465 - RNA, 64 nt, Homo Sapiens; identical to SEQ ID NO: 74216

SEQ ID NO: 741466 - RNA, 58 nt, Homo Sapiens; identical to SEQ ID NO: 74217

SEQ ID NO: 741467 - RNA, 64 nt, Homo Sapiens; identical to SEQ ID NO: 74218

SEQ ID NO: 741468 - RNA, 64 nt, Homo Sapiens; identical to SEQ ID NO: 74219

SEQ ID NO: 741469 - RNA, 64 nt, Homo Sapiens; identical to SEQ ID NO: 74220

SEQ ID NO: 741470 - RNA, 64 nt, Homo Sapiens; identical to SEQ ID NO: 74221

SEQ ID NO: 741471 - RNA, 56 nt, Homo Sapiens; identical to SEQ ID NO: 74222

SEQ ID NO: 741472 - RNA, 64 nt, Homo Sapiens; identical to SEQ ID NO: 74223

SEQ ID NO: 741473 - RNA, 64 nt, Homo Sapiens; identical to SEQ ID NO: 74224

SEQ ID NO: 741474 - RNA, 64 nt, Homo Sapiens; identical to SEQ ID NO: 74225

SEQ ID NO: 741475 - RNA, 64 nt, Homo Sapiens; identical to SEQ ID NO: 74226

SEQ ID NO: 741476 - RNA, 64 nt, Homo Sapiens; identical to SEQ ID NO: 74227

SEQ ID NO: 741477 - RNA, 64 nt, Homo Sapiens; identical to SEQ ID NO: 74228

SEQ ID NO: 741478 - RNA, 53 nt, Homo Sapiens; identical to SEQ ID NO: 74229

SEQ ID NO: 741479 - RNA, 64 nt, Homo Sapiens; identical to SEQ ID NO: 74230

SEQ ID NO: 741480 - RNA, 64 nt, Homo Sapiens; identical to SEQ ID NO: 74231

SEQ ID NO: 741481 - RNA, 64 nt, Homo Sapiens; identical to SEQ ID NO: 74232

SEQ ID NO: 741482 - RNA, 64 nt, Homo Sapiens; identical to SEQ ID NO: 74233

SEQ ID NO: 741483 - RNA, 64 nt, Homo Sapiens; identical to SEQ ID NO: 74234

SEQ ID NO: 741484 - RNA, 64 nt, Homo Sapiens; identical to SEQ ID NO: 74235

SEQ ID NO: 741485 - RNA, 64 nt, Homo Sapiens; identical to SEQ ID NO: 74236

SEQ ID NO: 741486 - RNA, 64 nt, Homo Sapiens; identical to SEQ ID NO: 74237

SEQ ID NO: 741487 - RNA, 64 nt, Homo Sapiens; identical to SEQ ID NO: 74238

SEQ ID NO: 741488 - RNA, 64 nt, Homo Sapiens; identical to SEQ ID NO: 74239

SEQ ID NO: 741489 - RNA, 64 nt, Homo Sapiens; identical to SEQ ID NO: 74240

SEQ ID NO: 741490 - RNA, 64 nt, Homo Sapiens; identical to SEQ ID NO: 74241

SEQ ID NO: 741491 - RNA, 64 nt, Homo Sapiens; identical to SEQ ID NO: 74242

SEQ ID NO: 741492 - RNA, 64 nt, Homo Sapiens; identical to SEQ ID NO: 74243

SEQ ID NO: 741493 - RNA, 64 nt, Homo Sapiens; identical to SEQ ID NO: 74244

SEQ ID NO: 741494 - RNA, 64 nt, Homo Sapiens; identical to SEQ ID NO: 74245

SEQ ID NO: 741495 - RNA, 64 nt, Homo Sapiens; identical to SEQ ID NO: 74246

SEQ ID NO: 741496 - RNA, 64 nt, Homo Sapiens; identical to SEQ ID NO: 74247

SEQ ID NO: 741497 - RNA, 64 nt, Homo Sapiens; identical to SEQ ID NO: 74248

SEQ ID NO: 741498 - RNA, 64 nt, Homo Sapiens; identical to SEQ ID NO: 74249

SEQ ID NO: 741499 - RNA, 64 nt, Homo Sapiens; identical to SEQ ID NO: 74250

SEQ ID NO: 741500 - RNA, 64 nt, Homo Sapiens; identical to SEQ ID NO: 74251

SEQ ID NO: 741501 - RNA, 64 nt, Homo Sapiens; identical to SEQ ID NO: 74252

SEQ ID NO: 741502 - RNA, 64 nt, Homo Sapiens; identical to SEQ ID NO: 74253

SEQ ID NO: 741503 - RNA, 64 nt, Homo Sapiens; identical to SEQ ID NO: 74254

SEQ ID NO: 741504 - RNA, 64 nt, Homo Sapiens; identical to SEQ ID NO: 74255

SEQ ID NO: 741505 - RNA, 64 nt, Homo Sapiens; identical to SEQ ID NO: 74256

SEQ ID NO: 741506 - RNA, 64 nt, Homo Sapiens; identical to SEQ ID NO: 74257

SEQ ID NO: 741507 - RNA, 64 nt, Homo Sapiens; identical to SEQ ID NO: 74258

SEQ ID NO: 741508 - RNA, 64 nt, Homo Sapiens; identical to SEQ ID NO: 74259

SEQ ID NO: 741509 - RNA, 64 nt, Homo Sapiens; identical to SEQ ID NO: 74260

SEQ ID NO: 741510 - RNA, 64 nt, Homo Sapiens; identical to SEQ ID NO: 74261

SEQ ID NO: 741511 - RNA, 64 nt, Homo Sapiens; identical to SEQ ID NO: 74262

SEQ ID NO: 741512 - RNA, 64 nt, Homo Sapiens; identical to SEQ ID NO: 74263

SEQ ID NO: 741513 - RNA, 64 nt, Homo Sapiens; identical to SEQ ID NO: 74264

SEQ ID NO: 741514 - RNA, 64 nt, Homo Sapiens; identical to SEQ ID NO: 632047

SEQ ID NO: 741515 - RNA, 64 nt, Homo Sapiens; identical to SEQ ID NO: 632048

SEQ ID NO: 741516 - RNA, 64 nt, Homo Sapiens; identical to SEQ ID NO: 632049

SEQ ID NO: 741517 - RNA, 64 nt, Homo Sapiens; identical to SEQ ID NO: 632050

SEQ ID NO: 741518 - RNA, 64 nt, Homo Sapiens; identical to SEQ ID NO: 632051

SEQ ID NO: 741519 - RNA, 64 nt, Homo Sapiens; identical to SEQ ID NO: 632052

SEQ ID NO: 741520 - RNA, 64 nt, Homo Sapiens; identical to SEQ ID NO: 632053

SEQ ID NO: 741521 - RNA, 64 nt, Homo Sapiens; identical to SEQ ID NO: 632054

SEQ ID NO: 741522 - RNA, 64 nt, Homo Sapiens; identical to SEQ ID NO: 632055

SEQ ID NO: 741523 - RNA, 64 nt, Homo Sapiens; identical to SEQ ID NO: 632056

SEQ ID NO: 741524 - RNA, 64 nt, Homo Sapiens; identical to SEQ ID NO: 632057

SEQ ID NO: 741525 - RNA, 64 nt, Homo Sapiens; identical to SEQ ID NO: 632058

SEQ ID NO: 741526 - RNA, 64 nt, Homo Sapiens; identical to SEQ ID NO: 632059

SEQ ID NO: 741527 - RNA, 64 nt, Homo Sapiens; identical to SEQ ID NO: 632060

SEQ ID NO: 741528 - RNA, 64 nt, Homo Sapiens; identical to SEQ ID NO: 632061

SEQ ID NO: 741529 - RNA, 64 nt, Homo Sapiens; identical to SEQ ID NO: 632062

SEQ ID NO: 741530 - RNA, 64 nt, Homo Sapiens; identical to SEQ ID NO: 632063

SEQ ID NO: 741531 - RNA, 64 nt, Homo Sapiens; identical to SEQ ID NO: 632064

SEQ ID NO: 741532 - RNA, 64 nt, Homo Sapiens; identical to SEQ ID NO: 632065

SEQ ID NO: 741533 - RNA, 64 nt, Homo Sapiens; identical to SEQ ID NO: 632066

SEQ ID NO: 741534 - RNA, 64 nt, Homo Sapiens; identical to SEQ ID NO: 632067

SEQ ID NO: 741535 - RNA, 64 nt, Homo Sapiens; identical to SEQ ID NO: 632068

SEQ ID NO: 741536 - RNA, 64 nt, Homo Sapiens; identical to SEQ ID NO: 632069

SEQ ID NO: 741537 - RNA, 64 nt, Homo Sapiens; identical to SEQ ID NO: 632070

SEQ ID NO: 741538 - RNA, 64 nt, Homo Sapiens; identical to SEQ ID NO: 632071

SEQ ID NO: 741539 - RNA, 64 nt, Homo Sapiens; identical to SEQ ID NO: 632072

SEQ ID NO: 741540 - RNA, 64 nt, Homo Sapiens; identical to SEQ ID NO: 632073

SEQ ID NO: 741541 - RNA, 64 nt, Homo Sapiens; identical to SEQ ID NO: 632074

SEQ ID NO: 741542 - RNA, 64 nt, Homo Sapiens; identical to SEQ ID NO: 632075

SEQ ID NO: 741543 - RNA, 64 nt, Homo Sapiens; identical to SEQ ID NO: 209887

SEQ ID NO: 741544 - RNA, 64 nt, Homo Sapiens; identical to SEQ ID NO: 209888

SEQ ID NO: 741545 - RNA, 64 nt, Homo Sapiens; identical to SEQ ID NO: 209889

SEQ ID NO: 741546 - RNA, 64 nt, Homo Sapiens; identical to SEQ ID NO: 209890

SEQ ID NO: 741547 - RNA, 64 nt, Homo Sapiens; identical to SEQ ID NO: 209891

SEQ ID NO: 741548 - RNA, 64 nt, Homo Sapiens; identical to SEQ ID NO: 209892

SEQ ID NO: 741549 - RNA, 64 nt, Homo Sapiens; identical to SEQ ID NO: 209893

SEQ ID NO: 741550 - RNA, 64 nt, Homo Sapiens; identical to SEQ ID NO: 209894

SEQ ID NO: 741551 - RNA, 64 nt, Homo Sapiens; identical to SEQ ID NO: 209895

SEQ ID NO: 741552 - RNA, 64 nt, Homo Sapiens; identical to SEQ ID NO: 209896

SEQ ID NO: 741553 - RNA, 64 nt, Homo Sapiens; identical to SEQ ID NO: 209897

SEQ ID NO: 741554 - RNA, 64 nt, Homo Sapiens; identical to SEQ ID NO: 209898

SEQ ID NO: 741555 - RNA, 64 nt, Homo Sapiens; identical to SEQ ID NO: 209899

SEQ ID NO: 741556 - RNA, 64 nt, Homo Sapiens; identical to SEQ ID NO: 209900

SEQ ID NO: 741557 - RNA, 64 nt, Homo Sapiens; identical to SEQ ID NO: 209901

SEQ ID NO: 741558 - RNA, 64 nt, Homo Sapiens; identical to SEQ ID NO: 209902

SEQ ID NO: 741559 - RNA, 64 nt, Homo Sapiens; identical to SEQ ID NO: 209903

SEQ ID NO: 741560 - RNA, 64 nt, Homo Sapiens; identical to SEQ ID NO: 209904

SEQ ID NO: 741561 - RNA, 64 nt, Homo Sapiens; identical to SEQ ID NO: 209905

SEQ ID NO: 741562 - RNA, 64 nt, Homo Sapiens; identical to SEQ ID NO: 209906

SEQ ID NO: 741563 - RNA, 64 nt, Homo Sapiens; identical to SEQ ID NO: 209907

SEQ ID NO: 741564 - RNA, 64 nt, Homo Sapiens; identical to SEQ ID NO: 209908

SEQ ID NO: 741565 - RNA, 64 nt, Homo Sapiens; identical to SEQ ID NO: 209909

SEQ ID NO: 741566 - RNA, 64 nt, Homo Sapiens; identical to SEQ ID NO: 209910

SEQ ID NO: 741567 - RNA, 64 nt, Homo Sapiens; identical to SEQ ID NO: 209911

SEQ ID NO: 741568 - RNA, 64 nt, Homo Sapiens; identical to SEQ ID NO: 209912

SEQ ID NO: 741569 - RNA, 64 nt, Homo Sapiens; identical to SEQ ID NO: 209913

SEQ ID NO: 741570 - RNA, 64 nt, Homo Sapiens; identical to SEQ ID NO: 209914

SEQ ID NO: 741571 - RNA, 64 nt, Homo Sapiens; identical to SEQ ID NO: 209915

SEQ ID NO: 741572 - RNA, 64 nt, Homo Sapiens; identical to SEQ ID NO: 209916

SEQ ID NO: 741573 - RNA, 64 nt, Homo Sapiens
aagagacuauauggccuucaauuucguucuuacuucccugaagcgcuauguguucuuuuuguuc

SEQ ID NO: 741574 - RNA, 64 nt, Homo Sapiens
uugaacccacacacaccccugcugaaauugaugaucccugaaggguauuggccacacgcuggaa

SEQ ID NO: 741575 - RNA, 64 nt, Homo Sapiens
caugauuggcauauguuagacgaacugauacaaaucccugaaacaaugauuguuuuagccugcu

SEQ ID NO: 741576 - RNA, 64 nt, Homo Sapiens
uaguuaacugugucuaaaguuauggaacuuuuguucccugaagcauuaauguuucuucauugau

SEQ ID NO: 741577 - RNA, 64 nt, Homo Sapiens
ugaggacggggcugugucugccucagacugggaaucccugaagauggggccgugucucccucaa

SEQ ID NO: 741578 - RNA, 64 nt, Homo Sapiens
ugaggacggggcugugucucccucagacuggggcucccugaagaaagggcugcuucucccucag

SEQ ID NO: 741579 - RNA, 64 nt, Homo Sapiens
ugaagaaagggcugcuucucccucagacuggagcucccugaagauggggcugugucccccucag

SEQ ID NO: 741580 - RNA, 64 nt, Homo Sapiens
aguaaauagacuugaggaauccucuaccacagugucccugaaaccacaugcaucauucaggaag

SEQ ID NO: 741581 - RNA, 64 nt, Homo Sapiens
auucaggaagccuucacccugugacuauucagccucccugaauaugcuuucucuauagaaccac

SEQ ID NO: 741582 - RNA, 64 nt, Homo Sapiens
agauuauuuuaagaugagacaagauuauugucaaucccugaaugucuggaguuaccucccaugg

SEQ ID NO: 741583 - RNA, 64 nt, Homo Sapiens
cuaauuaaggguugcagucccuugaagcccugccucccugaaggucuggugaccucuuccuaaa

SEQ ID NO: 741584 - RNA, 64 nt, Homo Sapiens
augaagaaacagggcuggauaaucuccaucugcaucccugaaaagcacaucacugucaccucug

SEQ ID NO: 741585 - RNA, 64 nt, Homo Sapiens
ccugcaaaugaaaccaaacgaaccccugcaacccucccugaaccugggacaagagcccucccug

SEQ ID NO: 741586 - RNA, 64 nt, Homo Sapiens
ccugcaacccucccugaaccugggacaagagcccucccugaacccccucucccuuccccgguug

SEQ ID NO: 741587 - RNA, 64 nt, Homo Sapiens
cagaacagacccugugccuggggucucuucaccuucccugaauugcuugagcuggauagaggug

SEQ ID NO: 741588 - RNA, 64 nt, Homo Sapiens
uucugaaaucucaaaugaguccuaagcuccagggucccugaaucaguggugggugcucccccuc

SEQ ID NO: 741589 - RNA, 64 nt, Homo Sapiens
ucucacaauuucucuaaucuuuacucauguuaugucccugaaugucuugguauagguuuaagug

SEQ ID NO: 741590 - RNA, 64 nt, Homo Sapiens
ugaaauagaaacaagagaaugcaccuagguuaauucccugaauccuacuugaacauuguauaaa

SEQ ID NO: 741591 - RNA, 64 nt, Homo Sapiens
uuaaccacagaggagucacugguuuuagacaggcucccugaaugccagcauauacaaaagggga

SEQ ID NO: 741592 - RNA, 64 nt, Homo Sapiens
ccccaccacuaccagcucccaccagaugccacccucccugaaccuggggcucaaucccccuuuc

SEQ ID NO: 741593 - RNA, 64 nt, Homo Sapiens
uggauucuuucauacgauacuuuggguuugcugcucccugaagcaagguggagcugggcaagau

SEQ ID NO: 741594 - RNA, 64 nt, Homo Sapiens
gacucagccaggcagacauggugccagcacgggaucccugaaguguggcucuuacagcucucug

SEQ ID NO: 741595 - RNA, 64 nt, Homo Sapiens
aagugcucuuuccagaugaaaaaaauugagucuuucccugaaguaggguuuaauaaaacugguu

SEQ ID NO: 741596 - RNA, 64 nt, Homo Sapiens
gcugcgggcccagucagugauucagaugucagggucccugaacucuucuguaaccagggcuguc

SEQ ID NO: 741597 - RNA, 64 nt, Homo Sapiens
ucuugauagcugauuaauuugcccucaauucugcucccugaacuucacacauaaaucuucccaa

SEQ ID NO: 741598 - RNA, 64 nt, Homo Sapiens
ugugaaaucacacucuuccucugggcauccuggaucccugaauuauccccccccccaugaagua

SEQ ID NO: 741599 - RNA, 64 nt, Homo Sapiens; identical to SEQ ID NO: 193898

SEQ ID NO: 741600 - RNA, 64 nt, Homo Sapiens; identical to SEQ ID NO: 193899

SEQ ID NO: 741601 - RNA, 64 nt, Homo Sapiens; identical to SEQ ID NO: 193900

SEQ ID NO: 741602 - RNA, 64 nt, Homo Sapiens; identical to SEQ ID NO: 193901

SEQ ID NO: 741603 - RNA, 64 nt, Homo Sapiens; identical to SEQ ID NO: 193902

SEQ ID NO: 741604 - RNA, 64 nt, Homo Sapiens; identical to SEQ ID NO: 193903

SEQ ID NO: 741605 - RNA, 64 nt, Homo Sapiens; identical to SEQ ID NO: 193904

SEQ ID NO: 741606 - RNA, 64 nt, Homo Sapiens; identical to SEQ ID NO: 193905

SEQ ID NO: 741607 - RNA, 64 nt, Homo Sapiens; identical to SEQ ID NO: 193906

SEQ ID NO: 741608 - RNA, 64 nt, Homo Sapiens; identical to SEQ ID NO: 193907

SEQ ID NO: 741609 - RNA, 64 nt, Homo Sapiens; identical to SEQ ID NO: 193908

SEQ ID NO: 741610 - RNA, 64 nt, Homo Sapiens; identical to SEQ ID NO: 193909

SEQ ID NO: 741611 - RNA, 64 nt, Homo Sapiens; identical to SEQ ID NO: 193910

SEQ ID NO: 741612 - RNA, 64 nt, Homo Sapiens; identical to SEQ ID NO: 193911

SEQ ID NO: 741613 - RNA, 64 nt, Homo Sapiens; identical to SEQ ID NO: 193912

SEQ ID NO: 741614 - RNA, 64 nt, Homo Sapiens; identical to SEQ ID NO: 193913

SEQ ID NO: 741615 - RNA, 64 nt, Homo Sapiens; identical to SEQ ID NO: 193914

SEQ ID NO: 741616 - RNA, 64 nt, Homo Sapiens; identical to SEQ ID NO: 193915

SEQ ID NO: 741617 - RNA, 64 nt, Homo Sapiens; identical to SEQ ID NO: 193916

SEQ ID NO: 741618 - RNA, 64 nt, Homo Sapiens; identical to SEQ ID NO: 193917

SEQ ID NO: 741619 - RNA, 64 nt, Homo Sapiens; identical to SEQ ID NO: 193918

SEQ ID NO: 741620 - RNA, 64 nt, Homo Sapiens; identical to SEQ ID NO: 193919

SEQ ID NO: 741621 - RNA, 64 nt, Homo Sapiens; identical to SEQ ID NO: 359890

SEQ ID NO: 741622 - RNA, 64 nt, Homo Sapiens; identical to SEQ ID NO: 359891

SEQ ID NO: 741623 - RNA, 64 nt, Homo Sapiens; identical to SEQ ID NO: 359892

SEQ ID NO: 741624 - RNA, 64 nt, Homo Sapiens; identical to SEQ ID NO: 359893

SEQ ID NO: 741625 - RNA, 64 nt, Homo Sapiens; identical to SEQ ID NO: 359894

SEQ ID NO: 741626 - RNA, 64 nt, Homo Sapiens; identical to SEQ ID NO: 359895

SEQ ID NO: 741627 - RNA, 64 nt, Homo Sapiens; identical to SEQ ID NO: 359896

SEQ ID NO: 741628 - RNA, 64 nt, Homo Sapiens; identical to SEQ ID NO: 359897

SEQ ID NO: 741629 - RNA, 64 nt, Homo Sapiens; identical to SEQ ID NO: 359898

SEQ ID NO: 741630 - RNA, 64 nt, Homo Sapiens; identical to SEQ ID NO: 359899

SEQ ID NO: 741631 - RNA, 64 nt, Homo Sapiens; identical to SEQ ID NO: 359900

SEQ ID NO: 741632 - RNA, 64 nt, Homo Sapiens; identical to SEQ ID NO: 359901

SEQ ID NO: 741633 - RNA, 64 nt, Homo Sapiens; identical to SEQ ID NO: 359902

SEQ ID NO: 741634 - RNA, 64 nt, Homo Sapiens; identical to SEQ ID NO: 359903

SEQ ID NO: 741635 - RNA, 64 nt, Homo Sapiens; identical to SEQ ID NO: 359904

SEQ ID NO: 741636 - RNA, 64 nt, Homo Sapiens; identical to SEQ ID NO: 359905

SEQ ID NO: 741637 - RNA, 64 nt, Homo Sapiens; identical to SEQ ID NO: 359906

SEQ ID NO: 741638 - RNA, 64 nt, Homo Sapiens; identical to SEQ ID NO: 359907

SEQ ID NO: 741639 - RNA, 64 nt, Homo Sapiens; identical to SEQ ID NO: 359908

SEQ ID NO: 741640 - RNA, 64 nt, Homo Sapiens; identical to SEQ ID NO: 359909

SEQ ID NO: 741641 - RNA, 64 nt, Homo Sapiens; identical to SEQ ID NO: 359910

SEQ ID NO: 741642 - RNA, 64 nt, Homo Sapiens; identical to SEQ ID NO: 359911

SEQ ID NO: 741643 - RNA, 64 nt, Homo Sapiens; identical to SEQ ID NO: 359912

SEQ ID NO: 741644 - RNA, 64 nt, Homo Sapiens; identical to SEQ ID NO: 359913

SEQ ID NO: 741645 - RNA, 64 nt, Homo Sapiens; identical to SEQ ID NO: 359914

SEQ ID NO: 741646 - RNA, 64 nt, Homo Sapiens; identical to SEQ ID NO: 359915

SEQ ID NO: 741647 - RNA, 64 nt, Homo Sapiens; identical to SEQ ID NO: 359916

SEQ ID NO: 741648 - RNA, 64 nt, Homo Sapiens; identical to SEQ ID NO: 359917

SEQ ID NO: 741649 - RNA, 64 nt, Homo Sapiens; identical to SEQ ID NO: 359918

SEQ ID NO: 741650 - RNA, 64 nt, Homo Sapiens; identical to SEQ ID NO: 359919

SEQ ID NO: 741651 - RNA, 64 nt, Homo Sapiens; identical to SEQ ID NO: 359920

SEQ ID NO: 741652 - RNA, 64 nt, Homo Sapiens; identical to SEQ ID NO: 359921

SEQ ID NO: 741653 - RNA, 64 nt, Homo Sapiens; identical to SEQ ID NO: 359922

SEQ ID NO: 741654 - RNA, 64 nt, Homo Sapiens; identical to SEQ ID NO: 359923

SEQ ID NO: 741655 - RNA, 64 nt, Homo Sapiens; identical to SEQ ID NO: 359924

SEQ ID NO: 741656 - RNA, 64 nt, Homo Sapiens; identical to SEQ ID NO: 359925

SEQ ID NO: 741657 - RNA, 64 nt, Homo Sapiens; identical to SEQ ID NO: 359926

SEQ ID NO: 741658 - RNA, 64 nt, Homo Sapiens; identical to SEQ ID NO: 359927

SEQ ID NO: 741659 - RNA, 62 nt, Homo Sapiens
ggaaacagaacucgaugcacugaccugcuccgccaggaaagugagcguguagcguccugagg

SEQ ID NO: 741660 - RNA, 62 nt, Homo Sapiens
gguccggcccauccccaggcaccucacaggccccaggaaaggcccagccaccgaagccgccu

SEQ ID NO: 741661 - RNA, 62 nt, Homo Sapiens
uguuuccgcucucaauagccccucuuguuuuaccaggaaagauccaguuaaaucacccacug

SEQ ID NO: 741662 - RNA, 62 nt, Homo Sapiens
uuccugaccaacagccagcucuguccuuccccccaggaaacacauguucauuugugugauca

SEQ ID NO: 741663 - RNA, 62 nt, Homo Sapiens
gcaaggaaccgguuuauaaaacaacagaacagccaggaaaauggugcuaggagagacagugg

SEQ ID NO: 741664 - RNA, 62 nt, Homo Sapiens
ugcaccugacuuaugaaauggggauaauacucccaggaaauagcgcaggacaucacaaggac

SEQ ID NO: 741665 - RNA, 62 nt, Homo Sapiens
caggggcauuugacauccccuccugguucucaccaggaaaacauccaaagcuuuggaggaaa

SEQ ID NO: 741666 - RNA, 62 nt, Homo Sapiens
cugaagaccaccccagucuaccucggugcuggccaggaaaccuuucggcuaccucucccacc

SEQ ID NO: 741667 - RNA, 62 nt, Homo Sapiens
aagaucaacaggucccccccacaugaggccacccaggaaaaaaggcaggggcaguggcaucc

SEQ ID NO: 741668 - RNA, 62 nt, Homo Sapiens
gauucauugccacacucuuuucucccagggacccaggaaacuaggacuuuguguguuugcug

SEQ ID NO: 741669 - RNA, 62 nt, Homo Sapiens
acuggaauggaaaaguguguuccuguucauagccaggaaacccagcucagcaaacucccuuu

SEQ ID NO: 741670 - RNA, 62 nt, Homo Sapiens
aguauuaaaacauuggauuauccugagguguaccaggaaaggauuuuauaaugcuuagaaaa

SEQ ID NO: 741671 - RNA, 62 nt, Homo Sapiens
uuccuugugugugucuuggagugcauuugacuccaggaaaagccauuuugguuuuccuuaac

SEQ ID NO: 741672 - RNA, 62 nt, Homo Sapiens
acaugaagaaaacuuguauauucuaauguuugccaggaaaggcuagguucaguagaugagac

SEQ ID NO: 741673 - RNA, 62 nt, Homo Sapiens
cuagaucauggcaaggccugacaacagcugagccaggaaagugcugcugaggcaagucgaca

SEQ ID NO: 741674 - RNA, 62 nt, Homo Sapiens
ccgugaacugaagaaugguauccagucaucagccaggaaagauggggauucacuuacaugcc

SEQ ID NO: 741675 - RNA, 62 nt, Homo Sapiens
gcauggguggauuuagccaaggaccuggcaacccaggaaacaugauguuuuaagcugcuaag

SEQ ID NO: 741676 - RNA, 62 nt, Homo Sapiens
aaucugcgagguaguuucuuugguauucuugcccaggaaauggguugauucaucacagauuu

SEQ ID NO: 741677 - RNA, 62 nt, Homo Sapiens
agcacuucgucuuacccauuuauguaggggccccaggaaaccuacacacagccagaaugagg

SEQ ID NO: 741678 - RNA, 62 nt, Homo Sapiens
ccuaauuucuccucccuuccuuuucccugcuuccaggaaacuccacaucugccuuaaaacca

SEQ ID NO: 741679 - RNA, 62 nt, Homo Sapiens
ggagagucuuuccucacgcuccagcacaguggccaggaaaagaaauacugaauuugccccag

SEQ ID NO: 741680 - RNA, 62 nt, Homo Sapiens
auuuuuuccaagccaaggagaccauuggccauccaggaaauuucguacagcugaaauauagg

SEQ ID NO: 741681 - RNA, 62 nt, Homo Sapiens
cugccuccauauauccugaacaucaaacuaucccaggaaaaccaucuagaguaguuuguuuc

SEQ ID NO: 741682 - RNA, 62 nt, Homo Sapiens
caaauaguauaaacaacacuaaauuuacugugccaggaaaucuuccugaacuccuugaacuc

SEQ ID NO: 741683 - RNA, 62 nt, Homo Sapiens
ccucugcugcuguccaugacuguccuuuugaaccaggaaaagucacagaguuuaaagagaag

SEQ ID NO: 741684 - RNA, 62 nt, Homo Sapiens
caaucccaaggauggaggcugugcccagagccccaggaaaaugggagugagaagaugccugg

SEQ ID NO: 741685 - RNA, 62 nt, Homo Sapiens
uagcuucuccuacagugauucaugucccagguccaggaaauccaauguuggugaaggcagcc

SEQ ID NO: 741686 - RNA, 62 nt, Homo Sapiens
acgaaggguuuuuagccagggaaaacugagccccaggaaaaccuaaccacugggcaggcaga

SEQ ID NO: 741687 - RNA, 62 nt, Homo Sapiens
uggccaugcuuaagccagcaauuggcugggguccaggaaacaaagcaaaagcacaauaugug

SEQ ID NO: 741688 - RNA, 62 nt, Homo Sapiens
cuggccagggcuccuuugggagacucgggcacccaggaaagccccuucuccucugccugguu

SEQ ID NO: 741689 - RNA, 62 nt, Homo Sapiens
auccaguagaguuggagauuaagcuuggggcuccaggaaauccguguccccagggacuucua

SEQ ID NO: 741690 - RNA, 62 nt, Homo Sapiens
ucccagccccaccagcagccaaauaauuucugccaggaaacuagccagugucuuucugaggu

SEQ ID NO: 741691 - RNA, 62 nt, Homo Sapiens
cagcagcugccugcucuccacccuaccaaggaccaggaaaagacgcaagccugaggacccuc

SEQ ID NO: 741692 - RNA, 62 nt, Homo Sapiens
accuacagaccggcuccuccagguucuuaaacccaggaaagcgaagaugagucuauggcauc

SEQ ID NO: 741693 - RNA, 62 nt, Homo Sapiens
acaguuauuucaucauaaaacaacaauuagcuccaggaaauaacaguugacaaacugucauu

SEQ ID NO: 741694 - RNA, 62 nt, Homo Sapiens
ugcccccaucugcaggaagcugucuguugugaccaggaaagcucccagcgccagauucauca

SEQ ID NO: 741695 - RNA, 62 nt, Homo Sapiens
agagcagugagggcgggcggcuugaaaugagcccaggaaaccggagacuggagguggugggg

SEQ ID NO: 741696 - RNA, 62 nt, Homo Sapiens
agccagucaugccggaaacauuguaguguuugccaggaaagggcuagcuguagugugacaca

SEQ ID NO: 741697 - RNA, 62 nt, Homo Sapiens
aucucccccaggaccuucugcccauccccaguccaggaaaccccccucuggguggacaugca

SEQ ID NO: 741698 - RNA, 62 nt, Homo Sapiens
caauuugagagucaugugaaugugcugcuuguccaggaaacaaacaaguucccaggugaugc

SEQ ID NO: 741699 - RNA, 62 nt, Homo Sapiens
ucauuccuaccuacacuggacaauuaagccgaccaggaaaccuauugaggaaucaucuagaa

SEQ ID NO: 741700 - RNA, 52 nt, Homo Sapiens
uuuuaaauagccaguuugaaaaccaggaaaccuggccgaagcagcuucauag

SEQ ID NO: 741701 - RNA, 62 nt, Homo Sapiens
gguuuagcacgaagaggcccagaacauaguguccaggaaaguugugaaaauuacaaaucuga

SEQ ID NO: 741702 - RNA, 62 nt, Homo Sapiens
gggaggagaacgccgcguggcguucagggaacccaggaaaauagacagcuuacuuggcucau

SEQ ID NO: 741703 - RNA, 62 nt, Homo Sapiens
cuuuagucuuauaccucaacaacuugugaaacccaggaaaaccucucaaaaggaacuuggga

SEQ ID NO: 741704 - RNA, 62 nt, Homo Sapiens
ccaccuacccaaccauccacagaaaccccaaaccaggaaacccccuagagggcccuugucug

SEQ ID NO: 741705 - RNA, 62 nt, Homo Sapiens
cccaucuugaugcaugaguuaaucccaagggcccaggaaaacgcgauuuuggaggaaacaag

SEQ ID NO: 741706 - RNA, 62 nt, Homo Sapiens
aaagcccugcugagcagagcaucuacagagauccaggaaaccugggaaacuuacauguugag

SEQ ID NO: 741707 - RNA, 62 nt, Homo Sapiens
ugacagcacauugccauaaacaggcacuaaccccaggaaagaaguuuucaagggguauuacu

SEQ ID NO: 741708 - RNA, 62 nt, Homo Sapiens
uggcagcucuuaaaggagaacuauggcaccagccaggaaaaacccaggcacccagaugauuc

SEQ ID NO: 741709 - RNA, 62 nt, Homo Sapiens
guuuuuuuuuguuguuguugcgguguaacaguccaggaaacucgaccuuuggaaaacguuag

SEQ ID NO: 741710 - RNA, 62 nt, Homo Sapiens
gacaagggugaacugggagacucuggcugagcccaggaaagcuguggggagcagggcuguga

SEQ ID NO: 741711 - RNA, 62 nt, Homo Sapiens
cauguguaacaucugcuuauggggugaucuuuccaggaaaaaucugggaaauuagaaaaagu

SEQ ID NO: 741712 - RNA, 62 nt, Homo Sapiens
aaacaaaggaaaacaggugcaacagucauaagccaggaaauggaacagccuuguccaggcag

SEQ ID NO: 741713 - RNA, 62 nt, Homo Sapiens
aaaucaguuugguugguaaccacaaagaaccaccaggaaagcuuuauuucucucaucuguua

SEQ ID NO: 741714 - RNA, 62 nt, Homo Sapiens
ugucccacagggaccacaucaaggccugugauccaggaaagaauguagcuggcaagcugcaa

SEQ ID NO: 741715 - RNA, 62 nt, Homo Sapiens
gaaugcacauugaauggaugguaacagauauuccaggaaaaacuuguuccugagaagggugg

SEQ ID NO: 741716 - RNA, 62 nt, Homo Sapiens
gacauggacccacgugcuugccagaugcccugccaggaaaggcaaaagagaagcagucuggg

SEQ ID NO: 741717 - RNA, 62 nt, Homo Sapiens
gcaagcauugccuguguucccccauuggguacccaggaaacuucucuuccugaucuucccug

SEQ ID NO: 741718 - RNA, 62 nt, Homo Sapiens
auggaacagugcacucuucuugauugucauauccaggaaaaaucccucugaucauuuccagu

SEQ ID NO: 741719 - RNA, 62 nt, Homo Sapiens
auugacucugucuaacacacgucuuugugaccccaggaaaaugucuuccuucauccuuaaag

SEQ ID NO: 741720 - RNA, 62 nt, Homo Sapiens
cuuaugaauuaaaacaaugcaccugauuguugccaggaaaucagcaaacgcagugaguauca

SEQ ID NO: 741721 - RNA, 62 nt, Homo Sapiens
gugggagaguguggggcaggaauucuagcacuccaggaaacuagccugcgugggagaacccc

SEQ ID NO: 741722 - RNA, 62 nt, Homo Sapiens
uuuuuuaaagauggauuuaaaccaagaugccuccaggaaagaggacgaaaugaguauauuca

SEQ ID NO: 741723 - RNA, 62 nt, Homo Sapiens
gacuuucuaguucuagaaguuccgcugcaaggccaggaaagcuugagaaagguauuguggaa

SEQ ID NO: 741724 - RNA, 62 nt, Homo Sapiens
agacaugugauagcaaaagaaacaaacaaaagccaggaaaacacucauuuucgccuugaaua

SEQ ID NO: 741725 - RNA, 62 nt, Homo Sapiens
uugguugaacugaacauaucuugucuuagcacccaggaaacagaacuuuaagauauauacag

SEQ ID NO: 741726 - RNA, 62 nt, Homo Sapiens
uuuuucaauuccagauuuuuaauuuuaaggcuccaggaaagaaaggagaguagaacauuuuu

SEQ ID NO: 741727 - RNA, 62 nt, Homo Sapiens
aaucuaggcagugaacaagucuucauccuggcccaggaaauagccuauuaaaaaaugcuguc

SEQ ID NO: 741728 - RNA, 62 nt, Homo Sapiens
ggaggaugacaagccgcugcccaccuccaagcccaggaaacaguacaagauggcuaaggaga

SEQ ID NO: 741729 - RNA, 62 nt, Homo Sapiens
ccaaggaggagcggcgcauggaccagaugaugccaggaaagaccaaagcagaugcugcugac

SEQ ID NO: 741730 - RNA, 62 nt, Homo Sapiens
aagcagccaugagaaggaaggauucaccaccuccaggaaaagguaaauuugccaauacaaau

SEQ ID NO: 741731 - RNA, 60 nt, Homo Sapiens
uuacguggaagaaacgcuaaggguuugcucccaggaaaggagaggaagagcuauauauau

SEQ ID NO: 741732 - RNA, 62 nt, Homo Sapiens
ccccaauuuucagguaguacuaagaguaugugccaggaaacucuugcuauugaauugagaug

SEQ ID NO: 741733 - RNA, 62 nt, Homo Sapiens
aaacaugcugccaaccagcuuguccaacaacuccaggaaaacuguuuuucaaaacgccaugu

SEQ ID NO: 741734 - RNA, 62 nt, Homo Sapiens
aagugcacaaauucuguaguuugccguaucauccaggaaaaccugagggaaaaaaauuauag

SEQ ID NO: 741735 - RNA, 62 nt, Homo Sapiens
gaauucggagcuagaggacauggaaaauaaagccaggaaagucaaaaaaacgaaagagaagg

SEQ ID NO: 741736 - RNA, 62 nt, Homo Sapiens
acugcagguugugcccuguggcugccugcaccccaggaaaggagggggcucaggccauccag

SEQ ID NO: 741737 - RNA, 62 nt, Homo Sapiens
ugauugauuuuaggaggcccacaccaaacuccccaggaaaugacugccuuccuugggaccaa

SEQ ID NO: 741738 - RNA, 62 nt, Homo Sapiens
auugauaacuaaauaaauuuggcuaacccuacccaggaaaggaaguguuuuccggcugauaa

SEQ ID NO: 741739 - RNA, 62 nt, Homo Sapiens
ccagcccaguccauggccuucuucccccuuucccaggaaaggcuaggccccaguucuuccuc

SEQ ID NO: 741740 - RNA, 62 nt, Homo Sapiens
acaauuuucaucagagcccagcuccuguccuuccaggaaaucgagccacccacuugccauuu

SEQ ID NO: 741741 - RNA, 62 nt, Homo Sapiens
uuccccucuugguaauuuguccauaaauaccuccaggaaacacauuaugcuguacuaucuac

SEQ ID NO: 741742 - RNA, 62 nt, Homo Sapiens
gacugcuuuuuuuuuuuuuuaaauuacaaccaccaggaaauugugugaaagguuacuuaauu

SEQ ID NO: 741743 - RNA, 62 nt, Homo Sapiens
agcagcuuagagaaaauguguaggugaacauuccaggaaagauuuggcaggacacagagagg

SEQ ID NO: 741744 - RNA, 62 nt, Homo Sapiens
cuuuugaaauaacagcauaaauuaaaaagaaaccaggaaacagcuuguauuuuaagacauuc

SEQ ID NO: 741745 - RNA, 62 nt, Homo Sapiens
caguaaagugauuguaaaaaguagaaauugaaccaggaaaauagaguuauugaaaugcaugg

SEQ ID NO: 741746 - RNA, 62 nt, Homo Sapiens
cugcauucuaguacuugggacuuaucccauagccaggaaacugcauuuugguccaaguugug

SEQ ID NO: 741747 - RNA, 62 nt, Homo Sapiens
uaaaaugggaacauggacacaaauggucugauccaggaaaaauuuuuuaagauuuguucaua

SEQ ID NO: 741748 - RNA, 62 nt, Homo Sapiens
guaccaauuuuucaguguugugugcuuacuggccaggaaaugaauauuuagccccucuguuc

SEQ ID NO: 741749 - RNA, 62 nt, Homo Sapiens
uuauuaccguuuaugauacuuuuuauggucuuccaggaaaaguauuacaagcaauccccaaa

SEQ ID NO: 741750 - RNA, 62 nt, Homo Sapiens
ucaggaaguaggaaacuguacaguuacaguuuccaggaaacauacuguuucuguugccugga

SEQ ID NO: 741751 - RNA, 62 nt, Homo Sapiens
gggcuuggacacuggccaagggcugaagauauccaggaaagggccuugugacuguucuuuaa

SEQ ID NO: 741752 - RNA, 62 nt, Homo Sapiens
aacacucacauaaguuuaaugagacccaaucuccaggaaaaccaaauuagaaugcuuauaau

SEQ ID NO: 741753 - RNA, 62 nt, Homo Sapiens
gcugugcccuauccccacuggucacauggcucccaggaaagucugccagaggaagaucuggc

SEQ ID NO: 741754 - RNA, 62 nt, Homo Sapiens
gugaggggugacacucggcucggcagcuuuccccaggaaaggagugacuccaagaagaguuc

SEQ ID NO: 741755 - RNA, 62 nt, Homo Sapiens
agaaaaaggucugaggcagaauccaagaucugccaggaaacacacaacaaaacaucugcugu

SEQ ID NO: 741756 - RNA, 62 nt, Homo Sapiens
aggugcuuugagcaguucugaaaaaugcaguuccaggaaagcaacugcuuugguuccuaagg

SEQ ID NO: 741757 - RNA, 62 nt, Homo Sapiens
ccugugccaaaguccugucaggcuggugggcaccaggaaaggccugcacccucuuccugcuc

SEQ ID NO: 741758 - RNA, 62 nt, Homo Sapiens
acccaaaggagcugccgcacugacccagccccccaggaaacagugagacaagaaucaaguau

SEQ ID NO: 741759 - RNA, 62 nt, Homo Sapiens
acauggcgcaugaaggagagcccagucucccuccaggaaaggccugaggauguaagucaggc

SEQ ID NO: 741760 - RNA, 62 nt, Homo Sapiens
ggagcuaagcugggaugccacauaggcagaagccaggaaaaaugaccaaccacagaaccaag

SEQ ID NO: 741761 - RNA, 62 nt, Homo Sapiens
aucuguuaccuguacgcuguauuaaaauagaaccaggaaaggcucaggauuucagacauuuc

SEQ ID NO: 741762 - RNA, 62 nt, Homo Sapiens
gagcagucaaguguucaggccacacagucagcccaggaaaaagagaagcagggccaaaugga

SEQ ID NO: 741763 - RNA, 62 nt, Homo Sapiens
cucaauaucuaucucagaggaaauaugguuacccaggaaagaaauggucugcuagagugaua

SEQ ID NO: 741764 - RNA, 62 nt, Homo Sapiens
aaaaugccagggccaggcuguguauuucuuucccaggaaauuagcuuuccagccccuuuaua

SEQ ID NO: 741765 - RNA, 62 nt, Homo Sapiens
ccgacccugccacagguuccuggaaagacucuccaggaaauggaagauacugauuuuuuuuu

SEQ ID NO: 741766 - RNA, 62 nt, Homo Sapiens
caauugauauauaauaaccguucuaaccucuuccaggaaaauauuuuuagaacuacuagcuu

SEQ ID NO: 741767 - RNA, 62 nt, Homo Sapiens
uuucaaaaugguauuuugaugccaucaaaugcccaggaaauugacuuugcagugucaccacu

SEQ ID NO: 741768 - RNA, 62 nt, Homo Sapiens
aaauaaagaagcugccaccuaacaggagucacccaggaaagcaccgcacaggcuggcgcggg

SEQ ID NO: 741769 - RNA, 62 nt, Homo Sapiens
cugaaugcaagcaguuuauaugggagaugauuccaggaaauaccgauaugagaauggggaaa

SEQ ID NO: 741770 - RNA, 62 nt, Homo Sapiens
gcagcucagaauuauucuggaaagaaagccugccaggaaauaaauucaaauacaguaugagc

SEQ ID NO: 741771 - RNA, 62 nt, Homo Sapiens
gcacacucuggagaccuugcuggcagugcuagccaggaaacagagugaccaagggacaagaa

SEQ ID NO: 741772 - RNA, 62 nt, Homo Sapiens
uuagcuuguccuaaaucuugcuguccacccuuccaggaaagggacauuguaaaugaauaaaa

SEQ ID NO: 741773 - RNA, 62 nt, Homo Sapiens
agucaacaaaaauugggcuaagucacuuuuccccaggaaagaauauuucccucuccugcauc

SEQ ID NO: 741774 - RNA, 62 nt, Homo Sapiens
acagcaaagaugaugggcucugcacaccaacuccaggaaacucauucugggccagcucuaug

SEQ ID NO: 741775 - RNA, 62 nt, Homo Sapiens
ugacugaauguugguaggugcuccauuacaauccaggaaagucuguguuacugauauuugug

SEQ ID NO: 741776 - RNA, 62 nt, Homo Sapiens
caugcccagucagaaaucuguucuauucugcuccaggaaaaucggaaaccugugagucagag

SEQ ID NO: 741777 - RNA, 62 nt, Homo Sapiens
acuuaacugugaaaaaguacggauguggcugcccaggaaaagagcccagcccagccugacgu

SEQ ID NO: 741778 - RNA, 62 nt, Homo Sapiens
ccuagaauuagggcacauuggcauccuucauuccaggaaagcagccggucucaaagauaacu

SEQ ID NO: 741779 - RNA, 62 nt, Homo Sapiens
agaagcccggguaauuaggugcuuuuuguccuccaggaaaccacccagaauacuugccgccu

SEQ ID NO: 741780 - RNA, 62 nt, Homo Sapiens
uuuucuggguuggggauuuuguuaguagagagccaggaaacgugggcucagcacauuuuacu

SEQ ID NO: 741781 - RNA, 62 nt, Homo Sapiens
ccagacagacuuucacacuaaagagaaaccagccaggaaaaaagaugccuuggccauggcac

SEQ ID NO: 741782 - RNA, 62 nt, Homo Sapiens
gaaggaaugucaugccagggagugguugagggccaggaaagacuuaagagccaaaggaagga

SEQ ID NO: 741783 - RNA, 62 nt, Homo Sapiens
guuucugggaggucaggaggccuuccugggcuccaggaaaguccgcucccugccaccauccu

SEQ ID NO: 741784 - RNA, 62 nt, Homo Sapiens
guaucagagcugcagccagcgagugcagagcuccaggaaaggggauuaaagaggggaggaga

SEQ ID NO: 741785 - RNA, 62 nt, Homo Sapiens
uuauauucaguauaugaauacucuagagugcuccaggaaaagauucuccaacuccaaacaag

SEQ ID NO: 741786 - RNA, 62 nt, Homo Sapiens
cucaccagaaucuggcacugauaaaucgggguccaggaaaucuuuuuaguguuuuuucagau

SEQ ID NO: 741787 - RNA, 62 nt, Homo Sapiens
aagggucaacagagcuguguaaggaggauagaccaggaaauacuggccuggaggaguucggg

SEQ ID NO: 741788 - RNA, 62 nt, Homo Sapiens
gagagggguuaagaugcaccggagccccgucuccaggaaaaggauggggggcacaggagcug

SEQ ID NO: 741789 - RNA, 62 nt, Homo Sapiens
ccuucagaacuagauuagcauguuuccacuuaccaggaaauuguaacaaaguaugcuuugcc

SEQ ID NO: 741790 - RNA, 62 nt, Homo Sapiens
ugcacaaaauucgaccugaugggcaucuugguccaggaaaugccacaggcaguuacuucuga

SEQ ID NO: 741791 - RNA, 62 nt, Homo Sapiens
acuucagcugacuccacgggcuccacgucugcccaggaaagaugaaauggagaauuucaggu

SEQ ID NO: 741792 - RNA, 62 nt, Homo Sapiens
cccaucaacaaccguccugcuccccaccucccccaggaaauaaggggccugcuccucucccu

SEQ ID NO: 741793 - RNA, 62 nt, Homo Sapiens
aaagacuaauggggagagggagggccgggaagccaggaaagcuugguguuuucucuggguac

SEQ ID NO: 741794 - RNA, 62 nt, Homo Sapiens
acugaagaaacugccgcucugagacugcacauccaggaaaaaagacuaggacuugccacaca

SEQ ID NO: 741795 - RNA, 62 nt, Homo Sapiens
cuugcaagugugcaugguucaaucccucacauccaggaaaugaauuuugcaauugggccaga

SEQ ID NO: 741796 - RNA, 62 nt, Homo Sapiens
ggauuuuaguuuugugcuuaguuaaaucuuuuccaggaaaaagaacuuccccauacaaauaa

SEQ ID NO: 741797 - RNA, 62 nt, Homo Sapiens
guuuugguuccuuuugcagagugaaaugccucccaggaaaaaaauacauauguauuuuuuug

SEQ ID NO: 741798 - RNA, 62 nt, Homo Sapiens
uauguguugcuaaaacacaugcuaugagcacuccaggaaacacuauauuuuuuccaaaaaau

SEQ ID NO: 741799 - RNA, 62 nt, Homo Sapiens
guaccaacacuugaaagauggguggauauuuuccaggaaacagauuuugggcaggacauucc

SEQ ID NO: 741800 - RNA, 62 nt, Homo Sapiens
agcugcacucagacaaugcccggcacaggcguccaggaaagcuaggauuuggaagacaggaa

SEQ ID NO: 741801 - RNA, 62 nt, Homo Sapiens
gacccagcugagguuauucuauauaacauaacccaggaaacauuuguuuuguuuuuuacaag

SEQ ID NO: 741802 - RNA, 62 nt, Homo Sapiens
uucacaaacaaggacucccacaccucccuaauccaggaaacauaauaauacauuuauguuga

SEQ ID NO: 741803 - RNA, 62 nt, Homo Sapiens
ccggaaccugauuuuaguucgacauucuauuuccaggaaaauaccuuugaacagaucccggu

SEQ ID NO: 741804 - RNA, 62 nt, Homo Sapiens
ucagucuuccaacugcaauauucauaauucuuccaggaaaaccauuuuaugcugaucuucag

SEQ ID NO: 741805 - RNA, 62 nt, Homo Sapiens
ugccauuucaaguucugaaacuguuaauaaggccaggaaaaccaauggagaucaugacacua

SEQ ID NO: 741806 - RNA, 62 nt, Homo Sapiens
agaagagcuuacacagagucuauaaauuguagccaggaaauaugcuggacuuggcucagugc

SEQ ID NO: 741807 - RNA, 62 nt, Homo Sapiens
aagcuuuucucacugaguugggcuuggauuaaccaggaaagagcuggcaaacaccaggcugc

SEQ ID NO: 741808 - RNA, 62 nt, Homo Sapiens
uaaguacuugugcauggcccagauggugaaacccaggaaaauguauuuuauuacugcauaau

SEQ ID NO: 741809 - RNA, 62 nt, Homo Sapiens
gggccagagaagauaauguucuuuaauguuguccaggaaacccuggcuugcuugccgagccu

SEQ ID NO: 741810 - RNA, 62 nt, Homo Sapiens
ucucuuguagaagauggacucugaaaaacauuccaggaaaccauggcagcauggagagccuc

SEQ ID NO: 741811 - RNA, 62 nt, Homo Sapiens
auauuuccuguucacuugugcaugggcuaaaaccaggaaaacuuccuugucuuauuacuuua

SEQ ID NO: 741812 - RNA, 62 nt, Homo Sapiens
uuagcuggaguaggagucugggaguggagaccccaggaaacagcaugaggugagggugugag

SEQ ID NO: 741813 - RNA, 62 nt, Homo Sapiens
gagcauggguccuuguucuuccuauuucaccuccaggaaagcaaaagugggagcagaaauuc

SEQ ID NO: 741814 - RNA, 62 nt, Homo Sapiens
uccaacugccaaauucugcuucccucugaaccccaggaaauacuuucuggagaggcuugucu

SEQ ID NO: 741815 - RNA, 62 nt, Homo Sapiens
cauuccacaaucuauggcuuccaccagcuagcccaggaaauacuugaaaucagcauuccaau

SEQ ID NO: 741816 - RNA, 62 nt, Homo Sapiens
ggguggguaagaguccaugggggugcccagucccaggaaaggggacaaugaagggacaggcc

SEQ ID NO: 741817 - RNA, 62 nt, Homo Sapiens
uuacuccccagcccagagagacgcugcuuuuaccaggaaagacuauugaaagauguuuuauu

SEQ ID NO: 741818 - RNA, 62 nt, Homo Sapiens
aucuguauguaucaauacaggguuuuuccaagccaggaaacgcccuccuuggcuacuaggag

SEQ ID NO: 741819 - RNA, 62 nt, Homo Sapiens
uauuuauuuaacuuacuuaucuggucaaagccccaggaaaccuaccaaagcuagaauuaaug

SEQ ID NO: 741820 - RNA, 62 nt, Homo Sapiens
agcccuuggcucccucuugcucguuguucucaccaggaaaguacacgggccugaggcaggau

SEQ ID NO: 741821 - RNA, 62 nt, Homo Sapiens
guguguguguguuuaauaugauuuagugacaaccaggaaaacuuacuugggauuauuagcac

SEQ ID NO: 741822 - RNA, 62 nt, Homo Sapiens
cuguuuauguucuugcagcaugguaugucucaccaggaaauugcauuggaggaugggggucc

SEQ ID NO: 741823 - RNA, 62 nt, Homo Sapiens
gguuuucucaaaguccauugaacuuuugggugccaggaaauguguuuugaaaagaguaauuu

SEQ ID NO: 741824 - RNA, 62 nt, Homo Sapiens
cuuauuuauuuugccugaaaccauuauuacuaccaggaaaguuauuuuucuaauaaauagga

SEQ ID NO: 741825 - RNA, 62 nt, Homo Sapiens
acagaggacaaaguuaauucaagaccuuaauuccaggaaagcgcaacugaagaacugcagcc

SEQ ID NO: 741826 - RNA, 60 nt, Homo Sapiens
aagcaugguauauaacaggaaaaaugacuuccaggaaaggcugugugcaccaaggucuga

SEQ ID NO: 741827 - RNA, 62 nt, Homo Sapiens
cucucugaccuaucaauaaaacccugggggugccaggaaaugagcaggagucagggggcugu

SEQ ID NO: 741828 - RNA, 62 nt, Homo Sapiens
acaccaaaugcuucuaguauaggaggugagugccaggaaaauucccgcucuccugcuuaccu

SEQ ID NO: 741829 - RNA, 62 nt, Homo Sapiens
gaagccauuauuauguaaaacauaguagaaguccaggaaaugaccuagcacacugccuagua

SEQ ID NO: 741830 - RNA, 62 nt, Homo Sapiens
ucuuugaauggaauuugacuacucugaaauagccaggaaacuuauugugacaacauuccagu

SEQ ID NO: 741831 - RNA, 62 nt, Homo Sapiens
cgggcacaucauauguccaugucucuggagcuccaggaaauucuaggaauucuugacguggg

SEQ ID NO: 741832 - RNA, 62 nt, Homo Sapiens
gcucuccaccagcacaucacuaugcaucuguuccaggaaagaagaaaagcgagcgaggaaga

SEQ ID NO: 741833 - RNA, 62 nt, Homo Sapiens
aagaguugugucuuuuguggccagugacaaauccaggaaaugaauguugcugauagggauaa

SEQ ID NO: 741834 - RNA, 62 nt, Homo Sapiens
uggagcugaucaaggucauguuucucacuguuccaggaaauugaucaacucuuccaauggga

SEQ ID NO: 741835 - RNA, 62 nt, Homo Sapiens
guaauauaaaggacuaggaagcagucauacuuccaggaaaugcuuggauucauguggacauu

SEQ ID NO: 741836 - RNA, 62 nt, Homo Sapiens
uuggccucuuugauacacuuuugcuugccuccccaggaaagaaggaauugcauccaagguau

SEQ ID NO: 741837 - RNA, 62 nt, Homo Sapiens
cauuuguucaaaaguuagaacaucuggcugcaccaggaaaaaaaaaaaaaaaaaguccuguu

SEQ ID NO: 741838 - RNA, 62 nt, Homo Sapiens
gcuuuccaccgaguacuguguuuauucucucuccaggaaagcagaucaaaagaaaguuagca

SEQ ID NO: 741839 - RNA, 62 nt, Homo Sapiens
ugagagaugaagcaucauauugacaacuuacuccaggaaaaaagguguguguauaggugugu

SEQ ID NO: 741840 - RNA, 62 nt, Homo Sapiens
aacacguaauaagacuguuccauaaaagaaguccaggaaaaugaaaacauaaauaucugcca

SEQ ID NO: 741841 - RNA, 62 nt, Homo Sapiens
uggagcauuguuucucacagacgcauacacagccaggaaacgcuguccuuauaacgccuuau

SEQ ID NO: 741842 - RNA, 62 nt, Homo Sapiens
uaauucccuggugacuagagggcugucuguguccaggaaacugugggguggggugggguggg

SEQ ID NO: 741843 - RNA, 54 nt, Homo Sapiens
uccauccaugaauuaugccaauuuccaggaaauacagguuugggaagcaauuga

SEQ ID NO: 741844 - RNA, 62 nt, Homo Sapiens
gcaguccugagggagaagacaacuugguguggccaggaaaggaacuuucuggagaggugcca

SEQ ID NO: 741845 - RNA, 62 nt, Homo Sapiens
agaguacuuugguuucugagguaguguuauugccaggaaagguccaaggaagggauguauuu

SEQ ID NO: 741846 - RNA, 62 nt, Homo Sapiens
agcagugacaauaaacaaagcaccaucgguggccaggaaaauuaaaaagggaauuuaggauc

SEQ ID NO: 741847 - RNA, 62 nt, Homo Sapiens
ugaagcauaauuuguuuaaacuuuuuauuaagccaggaaacauuggauaauaaaaauuguag

SEQ ID NO: 741848 - RNA, 62 nt, Homo Sapiens
gacaguggcugcaguauugaaaccucaaccauccaggaaauuccuugaaagaaucaacuucu

SEQ ID NO: 741849 - RNA, 62 nt, Homo Sapiens
aaauauuuaaguaagugaguuccacauuuucuccaggaaauuaacuuuucaaagcccaccaa

SEQ ID NO: 741850 - RNA, 62 nt, Homo Sapiens
uguugugcagagcucuucccgcccucuggcccccaggaaaccuuucuguuccuccccgagag

SEQ ID NO: 741851 - RNA, 62 nt, Homo Sapiens
ggaacccugggucauaaaauggggagaaaacaccaggaaagauaauaugcuuuccagcuaga

SEQ ID NO: 741852 - RNA, 62 nt, Homo Sapiens
auucuucaauguugcaugugucuaguacucauccaggaaaccaauggauagaaacaaaauuc

SEQ ID NO: 741853 - RNA, 62 nt, Homo Sapiens
agaugcuuagauuuugugucaacuuaagagugccaggaaagcuaacauauuuacucuugucu

SEQ ID NO: 741854 - RNA, 62 nt, Homo Sapiens
ugauggugcaagguccagucgaggcuggaaacccaggaaagcaaagcuggagugugaggcag

SEQ ID NO: 741855 - RNA, 62 nt, Homo Sapiens
auacccuugaaagggucuccacugagaguaccccaggaaagagagagcuaugauguccuagg

SEQ ID NO: 741856 - RNA, 62 nt, Homo Sapiens
cugacacagaacgcccaacgcccccagggaagccaggaaacuacucgaggggagaagucgcg

SEQ ID NO: 741857 - RNA, 62 nt, Homo Sapiens
gccgcugcaggaaacauuucugacaccgucgaccaggaaagccacacggagaggccacugug

SEQ ID NO: 741858 - RNA, 62 nt, Homo Sapiens
uuuuuaaguaaaguuuguagcuccucccaugcccaggaaagcacagaacucaaguguggugg

SEQ ID NO: 741859 - RNA, 62 nt, Homo Sapiens
gguuaaaagagccuuuuggacagaaaacugggccaggaaaaggcaucucagaccacaaauag

SEQ ID NO: 741860 - RNA, 62 nt, Homo Sapiens
uggggaagucagcugaaacuugucuuguuuugccaggaaaggaaguaguugccuuuggucau

SEQ ID NO: 741861 - RNA, 62 nt, Homo Sapiens
guucguaccagcaaguagacuaggaacugagcccaggaaagggggauguuuuccugguguuu

SEQ ID NO: 741862 - RNA, 62 nt, Homo Sapiens
caugucacuaaacaagaaaucugacaauagugccaggaaacuaauuuccugauacauuaaaa

SEQ ID NO: 741863 - RNA, 62 nt, Homo Sapiens
ucccgcgcccccaccccagaccccgagccaccccaggaaaagcacaaggacugccgccuucu

SEQ ID NO: 741864 - RNA, 62 nt, Homo Sapiens
cccugaagcaguuguucaaacuuuguucaauaccaggaaauuuauauuggagaaaaacccua

SEQ ID NO: 741865 - RNA, 62 nt, Homo Sapiens
cucauucacccaacaaaacugugucuuaucugccaggaaagaccagccucacuccugggaac

SEQ ID NO: 741866 - RNA, 62 nt, Homo Sapiens
aaugggaugucaccuaccaaaauccaaauccuccaggaaaaacuacuacacuaaauggacca

SEQ ID NO: 741867 - RNA, 62 nt, Homo Sapiens
uccauuucucuucuuugaccgugcuaggaauuccaggaaagugcauuccugcccuggugacc

SEQ ID NO: 741868 - RNA, 62 nt, Homo Sapiens
ucuagaauugggcuuguacagaaggauaaaacccaggaaaauggauauuucuauucagauuu

SEQ ID NO: 741869 - RNA, 62 nt, Homo Sapiens
uuucuccucuaaaugcaugauuuuccacuuaaccaggaaauacagaagccacauccgcacaa

SEQ ID NO: 741870 - RNA, 62 nt, Homo Sapiens
cuuaguaaguguucccuucaauaguggcauacccaggaaaugucauauuacuaggacuuaau

SEQ ID NO: 741871 - RNA, 62 nt, Homo Sapiens
acgagaaggccgaggaauccccggccaccccgccaggaaacgagggucucuugcccaucucu

SEQ ID NO: 741872 - RNA, 62 nt, Homo Sapiens
gcaucucagaccacaaauagcagaaaacugggccaggaaaaggguuaaaagagccuuuugga

SEQ ID NO: 741873 - RNA, 62 nt, Homo Sapiens
ccaagauggcgagccaguguagugaagccaagccaggaaacaggagggcauuuggaaggagc

SEQ ID NO: 741874 - RNA, 62 nt, Homo Sapiens
cccuacccccaccccagaggugggaaaaucauccaggaaacccgacugguguuugaucacga

SEQ ID NO: 741875 - RNA, 62 nt, Homo Sapiens
caagcuggcggccaccgcaggccuggagcucuccaggaaagcgcgcugcaccaacauugggg

SEQ ID NO: 741876 - RNA, 62 nt, Homo Sapiens
gccacuucauaauugaaaggguugaaaugccaccaggaaaauccugcucaguguggcuggag

SEQ ID NO: 741877 - RNA, 62 nt, Homo Sapiens
gugcucuccuggcccugccugccccuagccucccaggaaaugcuccuguagggcaccucccu

SEQ ID NO: 741878 - RNA, 62 nt, Homo Sapiens
acggcugagcauguggagcgcaggccaggugcccaggaaaggauacuggggaguaaacggcc

SEQ ID NO: 741879 - RNA, 62 nt, Homo Sapiens
gcccucugcccucuugcugcuucuccacauugccaggaaaagcugcugacgccugcccuccu

SEQ ID NO: 741880 - RNA, 62 nt, Homo Sapiens
cuagcugagagggccuggcccuggggugggcuccaggaaaacgcugguuaggccugggauug

SEQ ID NO: 741881 - RNA, 62 nt, Homo Sapiens
cuugucauucuacuuucuauauuguuaucaguccaggaaacagguaaacagauguaauuaga

SEQ ID NO: 741882 - RNA, 62 nt, Homo Sapiens
gggguguggaaaaggugauccuuuacccccacccaggaaaaccugcauugugcuagcaugga

SEQ ID NO: 741883 - RNA, 62 nt, Homo Sapiens
cauaaugcuucccauugaagggaaguugagaaccaggaaagcugcuuucacgucauugccau

SEQ ID NO: 741884 - RNA, 62 nt, Homo Sapiens
cuguacugguuuaaauaaguuuaccuuuuccuccaggaaauauaaugauuucugggaacaug

SEQ ID NO: 741885 - RNA, 62 nt, Homo Sapiens
uacuuuauuuauuguucccuugaaaugacugaccaggaaaaagaucauccuuaaauuuugaa

SEQ ID NO: 741886 - RNA, 62 nt, Homo Sapiens
gagauuuguuaaaacgguuaggacuguuuuguccaggaaagauaagaggaccaaacauauaa

SEQ ID NO: 741887 - RNA, 62 nt, Homo Sapiens
ugacauauauaaauuaagcauaaaauauguaaccaggaaaagacuguuaacauuacauuuau

SEQ ID NO: 741888 - RNA, 62 nt, Homo Sapiens
ucauagaauaacaacugcugggaauauccgugccaggaaaagaaaaauuucuggcaaauauu

SEQ ID NO: 741889 - RNA, 62 nt, Homo Sapiens
auggaaaguggaagacauauaccaauuauauuccaggaaaaaauacuuuaauaguauuguua

SEQ ID NO: 741890 - RNA, 62 nt, Homo Sapiens
gaccagaaaaaguuccaucuaaaauaucaugcccaggaaagcacaugggaucaaaaguaaaa

SEQ ID NO: 741891 - RNA, 62 nt, Homo Sapiens
gaaggggauuuggagggaggcugucgucgcccccaggaaagacgggccugggggaggcggga

SEQ ID NO: 741892 - RNA, 62 nt, Homo Sapiens
gguacucaagauguugaagcguuuacuaucugccaggaaacuaaaaucccuugugauuggau

SEQ ID NO: 741893 - RNA, 62 nt, Homo Sapiens
gcagucagaguccagugcucccccccccaacuccaggaaagaccccuccccaggcuggagac

SEQ ID NO: 741894 - RNA, 62 nt, Homo Sapiens
agauaggaggacuggaugagccuguuuccccaccaggaaaugcggccuauuuccuugccagg

SEQ ID NO: 741895 - RNA, 62 nt, Homo Sapiens
gugaagacccaaaacagcuuacaauugaacuuccaggaaaguagaguuuaaacaaaaaaccc

SEQ ID NO: 741896 - RNA, 62 nt, Homo Sapiens
ccugaccuugcuauuugaaccaguauuuauuuccaggaaaaggaaagauuuuuguaaaaagu

SEQ ID NO: 741897 - RNA, 62 nt, Homo Sapiens
uuucucuaacccuuucaaaacuucucagguugccaggaaaugaaguacugcuaucucgcauu

SEQ ID NO: 741898 - RNA, 62 nt, Homo Sapiens
ggaaugaaucaacucuuggucuaguaacagcuccaggaaaggacacuuaaagcaacaaccaa

SEQ ID NO: 741899 - RNA, 62 nt, Homo Sapiens
uggggaguccaaguggauuaaaaugcucagcuccaggaaagaucuggcauccauaugaggaa

SEQ ID NO: 741900 - RNA, 62 nt, Homo Sapiens
caagaggcugagaauucuuuaagcaaagaauuccaggaaaccuaguggaagaggagagcaug

SEQ ID NO: 741901 - RNA, 62 nt, Homo Sapiens
aggccaucugggcaggaggcagcuggacaucuccaggaaaccgccagcucugagucccaggc

SEQ ID NO: 741902 - RNA, 62 nt, Homo Sapiens
aagaaguugcaguauggauaucuuucacccucccaggaaacucuuucaaaccuaaucuguac

SEQ ID NO: 741903 - RNA, 62 nt, Homo Sapiens
ggcaggggucugcuucaggaaauggaagcuguccaggaaaugagcagagauucacaagacag

SEQ ID NO: 741904 - RNA, 62 nt, Homo Sapiens
uguuagcgggcaggggagccauugugggguccccaggaaagggcaagggcucagccacaucu

SEQ ID NO: 741905 - RNA, 62 nt, Homo Sapiens
ucaauuaaaaacuucccaggauuucuuuggacccaggaaacagccauguggguccuuucugu

SEQ ID NO: 741906 - RNA, 62 nt, Homo Sapiens
cugucuguuauuuucuguacauugugguagguccaggaaauaugacauuuucccccuugaug

SEQ ID NO: 741907 - RNA, 62 nt, Homo Sapiens
cuucucgcugcccuuccaagcccggcuuugggccaggaaaggcuuccccagguggcucuucu

SEQ ID NO: 741908 - RNA, 62 nt, Homo Sapiens
cgcguguggagagagccgcacaccagcgccacccaggaaaggcggagcgguuaccaguguuu

SEQ ID NO: 741909 - RNA, 62 nt, Homo Sapiens
cacaggacaggcuggugcaccuccaggcugugccaggaaacccgcugccuuugcgucaccac

SEQ ID NO: 741910 - RNA, 62 nt, Homo Sapiens
gaguuuccugaaggaguucugguuaacaaggaccaggaaaguuaaaaagaauuuacaugaua

SEQ ID NO: 741911 - RNA, 62 nt, Homo Sapiens
ggcucggagggagaaaggccgccucagccuaaccaggaaaggccaugaacucccaagccccg

SEQ ID NO: 741912 - RNA, 62 nt, Homo Sapiens
gacgcgugaaaacugagcccagaaaaguacucccaggaaacagagggauggaccccgaaagg

SEQ ID NO: 741913 - RNA, 62 nt, Homo Sapiens
cccagaaagcuuaaugauacuucacccuccugccaggaaaaugauuuuuuaaagcuuuucug

SEQ ID NO: 741914 - RNA, 62 nt, Homo Sapiens
ucguggaagcuuuggggcucuggccguagguuccaggaaagcuugaaaucucaggacucuuc

SEQ ID NO: 741915 - RNA, 62 nt, Homo Sapiens
gaagaaaacacucaguugauccauugccuuuuccaggaaaggagaaaucagggcacuugcau

SEQ ID NO: 741916 - RNA, 62 nt, Homo Sapiens
uuuguaccaaacagugaagcacuugaucuuguccaggaaagcaggucacucugaggauugaa

SEQ ID NO: 741917 - RNA, 62 nt, Homo Sapiens
caguauuuccuaugugucaguucuuggggaagccaggaaagcuccagggcaaagcugaaggu

SEQ ID NO: 741918 - RNA, 62 nt, Homo Sapiens
aucucuaagacuggguagcuuuuucaacuguuccaggaaagauuuucaaaguaggauuuccu

SEQ ID NO: 741919 - RNA, 62 nt, Homo Sapiens
cagaucccggccuggcuuccuccaguccuuguccaggaaacuugccuauaacgcugugagug

SEQ ID NO: 741920 - RNA, 62 nt, Homo Sapiens
gcuccucucagccaaccaaguacuuguggaaaccaggaaauuccaagggauggggcugucuu

SEQ ID NO: 741921 - RNA, 62 nt, Homo Sapiens
ggaacugagacucugguacccccuaaggcagcccaggaaauacccacccucagcgucucugc

SEQ ID NO: 741922 - RNA, 62 nt, Homo Sapiens
uuucagacuugacccuaauugaccauauaugaccaggaaacacuucugaguuuacagcuccg

SEQ ID NO: 741923 - RNA, 62 nt, Homo Sapiens
ugaagaagacaagauuucuggacaagcucagcccaggaaacaaaggguaaacaaaaaacuaa

SEQ ID NO: 741924 - RNA, 62 nt, Homo Sapiens
ggaggcuguccaccuugcuuggcucacugggaccaggaaagccugucuuugguuaggcucgu

SEQ ID NO: 741925 - RNA, 62 nt, Homo Sapiens
ggaauaaaauuaauuaggcuaauaggcuuaacccaggaaauccuaaguuccuugaauaucca

SEQ ID NO: 741926 - RNA, 62 nt, Homo Sapiens
aguggaaucuuuuaaagacaggaccccuauguccaggaaaggggaaaaggaacuuugccaau

SEQ ID NO: 741927 - RNA, 62 nt, Homo Sapiens
ggggggcaggaggaaagcacaauguuucuuagccaggaaagacaaauaauccaacgcugcua

SEQ ID NO: 741928 - RNA, 62 nt, Homo Sapiens
auugaucaccaugaaagaagugccuuuuguuuccaggaaaauuaguuaaauuggauugagaa

SEQ ID NO: 741929 - RNA, 62 nt, Homo Sapiens
aacuugcagcuuuaaccugcauuugccauuguccaggaaagauucucucuuagaauuggagg

SEQ ID NO: 741930 - RNA, 62 nt, Homo Sapiens
uccuucauggccacagaaaucuuagcccuuacccaggaaauaggacgguaccaagaguagcg

SEQ ID NO: 741931 - RNA, 62 nt, Homo Sapiens
aguugaaauccaggaaucucaugccagcgaugccaggaaacaguugcuucugcagcccgcag

SEQ ID NO: 741932 - RNA, 62 nt, Homo Sapiens
aaaguggcgacuaaaacagcacuucaagccagccaggaaauugacuugcuaguaaacagaag

SEQ ID NO: 741933 - RNA, 62 nt, Homo Sapiens
cugcuuggggcagcauuugucugcaagguuuuccaggaaaauggcaaaaauagacccagcuu

SEQ ID NO: 741934 - RNA, 62 nt, Homo Sapiens
cauuuuuucugggcugaugugcccaggccuucccaggaaaauagagagcccuauucaucgcu

SEQ ID NO: 741935 - RNA, 62 nt, Homo Sapiens
ucuacaaucauggagacagauuuguuuaaaaaccaggaaauugucauucuucucacugaguu

SEQ ID NO: 741936 - RNA, 62 nt, Homo Sapiens
gccaaaagaaugucuguuucgcaacaccagugccaggaaaagucacuucugcccaccugccg

SEQ ID NO: 741937 - RNA, 56 nt, Homo Sapiens
ccgggaauuuuccaaaagguaaagagccaggaaaaccucagagaaacaccaacuga

SEQ ID NO: 741938 - RNA, 62 nt, Homo Sapiens
aucuuccacuugagcaaccucgcugaaguuccccaggaaaugcaugugauuaagauccaggc

SEQ ID NO: 741939 - RNA, 62 nt, Homo Sapiens
uggggaaugcugccaucugguugcucaggcauccaggaaaaggccccaaggauggcugggag

SEQ ID NO: 741940 - RNA, 62 nt, Homo Sapiens
ggagcucucugcugagcagcccagcacaacccccaggaaacacaaaugggguccaggucacc

SEQ ID NO: 741941 - RNA, 62 nt, Homo Sapiens
cuucuggcagcagaaauccaugaagcccgggcccaggaaaauuagaaguuuuccauuccuga

SEQ ID NO: 741942 - RNA, 62 nt, Homo Sapiens
uauuccuuagccuuauagauuucuaguacugcccaggaaaucuaauuucaauacauuuaucc

SEQ ID NO: 741943 - RNA, 62 nt, Homo Sapiens
uauuggacucuugaaggcaauccuuccucuggccaggaaauuuuuuaaaaaauaauacugug

SEQ ID NO: 741944 - RNA, 62 nt, Homo Sapiens
aagccaagguugucaaagaacagccagugaggccaggaaagaaauuggucuugugguuuuca

SEQ ID NO: 741945 - RNA, 62 nt, Homo Sapiens
ugaaguuagugcgggcuuugcugcucccuggcccaggaaagagggacuaccugacccucacc

SEQ ID NO: 741946 - RNA, 62 nt, Homo Sapiens
uuuuuuuuuucccccuugaggauuguggaaaaccaggaaaagggagcuaugauuuuuuuuuc

SEQ ID NO: 741947 - RNA, 62 nt, Homo Sapiens
ugagauacccugcuaucgauggucgcuacaaaccaggaaauacucaaguuauuauguguaua

SEQ ID NO: 741948 - RNA, 62 nt, Homo Sapiens
cgccauggauuccucugggggcuggcgcaugcccaggaaagccugggccacacgggacacuc

SEQ ID NO: 741949 - RNA, 62 nt, Homo Sapiens
cugagcaaacccagggaauagcccuccucuccccaggaaacuucucugaaaucuuagacuua

SEQ ID NO: 741950 - RNA, 62 nt, Homo Sapiens
cggcgccuuuuucuuuuuagaugggaaggaggccaggaaagggucagcuuaaccauuuccua

SEQ ID NO: 741951 - RNA, 62 nt, Homo Sapiens
aauacuaugcauagcaaggagaugcagagccgccaggaaaauucugaguuccagcacaauuu

SEQ ID NO: 741952 - RNA, 62 nt, Homo Sapiens
gccucuuagcauguuugauuuaagaaaagccuccaggaaaucuugagagccugucuuggcau

SEQ ID NO: 741953 - RNA, 62 nt, Homo Sapiens
ggaggcccgcggcgguggagccgagcggggagccaggaaagaagaguuggagugagaugaag

SEQ ID NO: 741954 - RNA, 62 nt, Homo Sapiens
ccauaccccuuccuggaucuccagugccugggccaggaaagcccucuggguuccgggaagcc

SEQ ID NO: 741955 - RNA, 62 nt, Homo Sapiens
gaggaaaacaagugaggacacugguuuuaccuccaggaaacaugaaaaauaauccaaaucca

SEQ ID NO: 741956 - RNA, 62 nt, Homo Sapiens
uccauauaaauuguuuauucaaccaucagguuccaggaaaaagccuguuaguauuuucauug

SEQ ID NO: 741957 - RNA, 62 nt, Homo Sapiens
guaggaaggugcugugggcuggucccacacauccaggaaagaggccaguagagaauucugcc

SEQ ID NO: 741958 - RNA, 62 nt, Homo Sapiens
acagcagucagugccgcccaguucuacacccuccaggaaaugcgcgacaaggacgacauucu

SEQ ID NO: 741959 - RNA, 62 nt, Homo Sapiens
cugcugaccuuugcaaaggcaguucccccgccccaggaaacaccaggccuggggccccuccc

SEQ ID NO: 741960 - RNA, 62 nt, Homo Sapiens
aguuuaaaauuauacaucagaugaauaaggugccaggaaaacagaguuacauuaugcuuggc

SEQ ID NO: 741961 - RNA, 62 nt, Homo Sapiens
cccucaucuucucuuucucuagcuaccaacggccaggaaaagucuagaaucccuucaguuuu

SEQ ID NO: 741962 - RNA, 62 nt, Homo Sapiens
aauagcuucuuuaaaagucuagcugacccuacccaggaaagucaacggggccauggcaggaa

SEQ ID NO: 741963 - RNA, 62 nt, Homo Sapiens
agauccaauguuuuuucuaacaagcuccuauuccaggaaaaaugaugauauccuauccucuc

SEQ ID NO: 741964 - RNA, 62 nt, Homo Sapiens
acagggcccuugucgccccucacuuacgaacaccaggaaaccugcucuaacuggagcacauu

SEQ ID NO: 741965 - RNA, 62 nt, Homo Sapiens
uguaaccacccuuuucuaaccccucuccauguccaggaaacucuuggauuuagggauagugu

SEQ ID NO: 741966 - RNA, 62 nt, Homo Sapiens
acaagugucuucugugugucaguacagauugaccaggaaaagaggauugcgcacccugcaca

SEQ ID NO: 741967 - RNA, 62 nt, Homo Sapiens
aaagaauguguuaagggaugcaccaguauuuaccaggaaaaccauucucagcugucuuguuc

SEQ ID NO: 741968 - RNA, 62 nt, Homo Sapiens
auagacuuuauaaacaguggaaggauuuuuucccaggaaaaguagaccgaagccuugugcau

SEQ ID NO: 741969 - RNA, 62 nt, Homo Sapiens
acauaacguucaguugggauagccugcuguuuccaggaaauugucccccguuugccuccacg

SEQ ID NO: 741970 - RNA, 62 nt, Homo Sapiens
ccuguggguugugcuaauuuggaagacuuggcccaggaaaaagccaagacaguggcagcaaa

SEQ ID NO: 741971 - RNA, 62 nt, Homo Sapiens
caaugucucuucacgggccuaucaacuggggcccaggaaaagucuuuuuuuccucugcccug

SEQ ID NO: 741972 - RNA, 62 nt, Homo Sapiens
agcgcuaguggaggguuggaaugcagguuugaccaggaaagcuggggcaugacccagugaag

SEQ ID NO: 741973 - RNA, 62 nt, Homo Sapiens
acuucugauaauuuauugucuuuauuuuuaucccaggaaauaaaagguuaccuuguugaggc

SEQ ID NO: 741974 - RNA, 62 nt, Homo Sapiens
gccugggcucacccuguguggcucauucccacccaggaaacugaagauaaaagauuugggaa

SEQ ID NO: 741975 - RNA, 62 nt, Homo Sapiens
ucagccaugauaagaacagagugccugcauucccaggaaaauacgaaaaucccaugagauaa

SEQ ID NO: 741976 - RNA, 62 nt, Homo Sapiens
aucaauuuguucuuagaaccugguugaaaauaccaggaaacuguuacagacgccauuuuuuu

SEQ ID NO: 741977 - RNA, 62 nt, Homo Sapiens
gggaccucagggagccccagcuucuuacccacccaggaaacccuugguccagagaggacagg

SEQ ID NO: 741978 - RNA, 62 nt, Homo Sapiens
agcccuaagggugguaggaacccaggagggacccaggaaacuaagauuugagauucagugcc

SEQ ID NO: 741979 - RNA, 62 nt, Homo Sapiens
cuccucaggcuccuccuugcccccaccuugccccaggaaaggccaaaguccaggugacugcc

SEQ ID NO: 741980 - RNA, 62 nt, Homo Sapiens
gccagcugugcacuuucuucucuuucccaaccccaggaaagguuuuccuuauuuugugugcu

SEQ ID NO: 741981 - RNA, 62 nt, Homo Sapiens
gagacuuccugcugccuuuggacauaacuaagccaggaaacuuuaaaagccuucuagaaaua

SEQ ID NO: 741982 - RNA, 62 nt, Homo Sapiens
aaggcuagagcugauggcacugucugcacuguccaggaaaaaaguaaaacuguacuguugcg

SEQ ID NO: 741983 - RNA, 62 nt, Homo Sapiens
ggcgguggcuucacuccugagucugcaaaaucccaggaaacuugggucuugcugcccauccu

SEQ ID NO: 741984 - RNA, 62 nt, Homo Sapiens
cuuuaaagagccaaguugcuucggggaaacagccaggaaaauggucaagauuauuuuuagag

SEQ ID NO: 741985 - RNA, 62 nt, Homo Sapiens
cccacugcccccugagauguacacccugauugccaggaaaacagacugcuguguucaguaac

SEQ ID NO: 741986 - RNA, 62 nt, Homo Sapiens
aaugggucugugacucaaaaauugagcccuggccaggaaaauguggagacaguucuucuccu

SEQ ID NO: 741987 - RNA, 62 nt, Homo Sapiens
caauccauagauagccagcaguggauguuacuccaggaaaaugcaggauuaaaauuguccuu

SEQ ID NO: 741988 - RNA, 62 nt, Homo Sapiens
auccaggacuacgaggcggccaaggcucuguuccaggaaauucuugaagaguauaaugaaag

SEQ ID NO: 741989 - RNA, 62 nt, Homo Sapiens
gacacuuugucuaguguauucucuucacagugccaggaaagagugguuucugcguguguaua

SEQ ID NO: 741990 - RNA, 62 nt, Homo Sapiens
gcuugauuuuggccuauuuuacauuauuugguccaggaaauuagguuauauuagguuuuuug

SEQ ID NO: 741991 - RNA, 62 nt, Homo Sapiens
ggagucccuuacuuuacguguguaaauuccuaccaggaaagaauacauauccaauagauugg

SEQ ID NO: 741992 - RNA, 62 nt, Homo Sapiens
cuuccgugccagugauucguucuggaaacgcgccaggaaaagcauuguaguucgcaugguuc

SEQ ID NO: 741993 - RNA, 62 nt, Homo Sapiens
cugcacugugggcuuuuauuaaggaagaaauuccaggaaaaucaaacagaacuauggaaaaa

SEQ ID NO: 741994 - RNA, 62 nt, Homo Sapiens
aauauauccccaucuccguuuaggaauuucucccaggaaagaugauaauugucuccccucca

SEQ ID NO: 741995 - RNA, 62 nt, Homo Sapiens
guuuuuugagaccauauguacaacaguaagccccaggaaagggaucugggggaauaaaaagc

SEQ ID NO: 741996 - RNA, 62 nt, Homo Sapiens
agacccaaauuccauaaacauacacuuccacaccaggaaaacuuguuucacccuacuucaag

SEQ ID NO: 741997 - RNA, 62 nt, Homo Sapiens
aaaaaagguauuucugcauuaggcuuugaugaccaggaaaaauuuccccuuuguuuaggggu

SEQ ID NO: 741998 - RNA, 62 nt, Homo Sapiens
ggagggguagcgggggagggagauacgggguuccaggaaaggccuuccccccccccaccccg

SEQ ID NO: 741999 - RNA, 62 nt, Homo Sapiens
aaccagaucucuggauuucaggccaaauccugccaggaaaguaauguccauuuucauuuaua

SEQ ID NO: 742000 - RNA, 62 nt, Homo Sapiens
auaaaaagaguaugagucuucuuuuuuaauuuccaggaaaaacaauauuuaguaaagcuuuu

SEQ ID NO: 742001 - RNA, 62 nt, Homo Sapiens
ugcaaaaaaugggaaguaagccucccggcaguccaggaaaacuuauaaagcuuguacagcug

SEQ ID NO: 742002 - RNA, 62 nt, Homo Sapiens
aaaaaaaaagacucccuggaaaggaucagaggccaggaaaaauucucccacugggucaccuc

SEQ ID NO: 742003 - RNA, 62 nt, Homo Sapiens
ggaaaagccauuguauaaauagugaauguuggccaggaaaaugagcuuuuuuagaaagucga

SEQ ID NO: 742004 - RNA, 62 nt, Homo Sapiens
cacuccaccaguagugcuggggaccugcugcaccaggaaagcacgucuccacggagcccucg

SEQ ID NO: 742005 - RNA, 62 nt, Homo Sapiens
augcaauagacuugcucggaauauagcuuuggccaggaaagcgccugcuguucccgcuuucc

SEQ ID NO: 742006 - RNA, 62 nt, Homo Sapiens
aagcacuggaaagcagcaggcuugcacugaggccaggaaaagguccuuugacuuaguacuga

SEQ ID NO: 742007 - RNA, 62 nt, Homo Sapiens
gucagagaagacuggcgucagcagccaaaacaccaggaaacacauuucuguggccuuagcca

SEQ ID NO: 742008 - RNA, 62 nt, Homo Sapiens
uuugcugccauccagccccagaucgcuuuacuccaggaaaugcacguuacacauuuucgcuu

SEQ ID NO: 742009 - RNA, 62 nt, Homo Sapiens
ugcuaagaucagucacccaugugaauaagaagccaggaaaggaaagauggggaagcccagau

SEQ ID NO: 742010 - RNA, 62 nt, Homo Sapiens
gagugugacugggaaggagaacuuauuccuuaccaggaaacuggaagcuaaaaauacagagg

SEQ ID NO: 742011 - RNA, 62 nt, Homo Sapiens
cuuggcugguguaugcacagucccuucccagaccaggaaaggggccugcgucuuuuuucucu

SEQ ID NO: 742012 - RNA, 62 nt, Homo Sapiens
agcuuuugccaguauuaugcguauuuauacccccaggaaacuuuauuucuagaagcacaugu

SEQ ID NO: 742013 - RNA, 62 nt, Homo Sapiens
gauggugccccccaaauuguaaagagcuugacccaggaaauagagggaauuggguuuguggc

SEQ ID NO: 742014 - RNA, 62 nt, Homo Sapiens
cagacuacauauuuuucaugaaugaagcagagccaggaaaaacagugguuugcccuuggcua

SEQ ID NO: 742015 - RNA, 62 nt, Homo Sapiens
gaggcugcagugagccaugagauugcuggagcccaggaaauucagggagguugaggcagcag

SEQ ID NO: 742016 - RNA, 62 nt, Homo Sapiens
cuaauucucuuuagacuccuugggaaaauauuccaggaaacguaacacuguuuugauuuuug

SEQ ID NO: 742017 - RNA, 62 nt, Homo Sapiens
gucuuuaaaaacaaaaacaaagugcacauauuccaggaaaguuuguuuuuaauuuuaaccau

SEQ ID NO: 742018 - RNA, 62 nt, Homo Sapiens
uguuucaaugcuguaaguaggggccccaccagccaggaaaguccagggcccaaaagucagaa

SEQ ID NO: 742019 - RNA, 62 nt, Homo Sapiens
uccacugagguuagaguccauuuacaaagcugccaggaaaccggccacuucuaguaaaccac

SEQ ID NO: 742020 - RNA, 62 nt, Homo Sapiens
augaugcaauuaucuuacucagaggagauuugccaggaaauucucuccguuacaugcauuac

SEQ ID NO: 742021 - RNA, 62 nt, Homo Sapiens
ucucuucagaucugaaauacuccaguuuagagccaggaaauuucacaggucacaccgauuuu

SEQ ID NO: 742022 - RNA, 62 nt, Homo Sapiens
ccagggcacccauccaaggaaccuccgaacagccaggaaaagccaugaguugcaaccaaaac

SEQ ID NO: 742023 - RNA, 62 nt, Homo Sapiens
uauggagucaccuguaaauugauucaagugagccaggaaagcagcaaaggaaagagaaaccu

SEQ ID NO: 742024 - RNA, 62 nt, Homo Sapiens
gggaugggaaugacuuccucgagaccauacagccaggaaauagcggugaaucuagugaucuc

SEQ ID NO: 742025 - RNA, 62 nt, Homo Sapiens
acgcccagcacagcagcaggacacaccaugugccaggaaaugaccucagcaagaaaccucag

SEQ ID NO: 742026 - RNA, 62 nt, Homo Sapiens
auccccugcccugccgggcaccucgcucuaccccaggaaaaugugagcucguuuuccugcuc

SEQ ID NO: 742027 - RNA, 62 nt, Homo Sapiens
cagucuuuuuuuaaaaaaaaaguccucuaguuccaggaaacaauaaaagcuaugagacaaau

SEQ ID NO: 742028 - RNA, 62 nt, Homo Sapiens
agcaggagaggguggcucagugacuuaccaaaccaggaaaacaaccaucaaaccuuuccucc

SEQ ID NO: 742029 - RNA, 62 nt, Homo Sapiens
uccuucucuggcgucugcuucguauccaucucccaggaaauguccuuccuugagucauagaa

SEQ ID NO: 742030 - RNA, 62 nt, Homo Sapiens
gagucucccccuuaaauuuccuccaccugcccccaggaaaaauaucaguggucguguaccuu

SEQ ID NO: 742031 - RNA, 62 nt, Homo Sapiens
gaacagaguccauccaagcugugcuccucuggccaggaaaggcagaugcuuagggggcauuu

SEQ ID NO: 742032 - RNA, 53 nt, Homo Sapiens
cagcuuuagugcagaccuaggugccaggaaagggccuggaagggcacuucuga

SEQ ID NO: 742033 - RNA, 62 nt, Homo Sapiens
cauagcuaggagaugucaaaucacaucagaagccaggaaaugauaagaccucuuucagcaga

SEQ ID NO: 742034 - RNA, 62 nt, Homo Sapiens
uaaguauuuuauuaauauauccguugaugccuccaggaaacucugaugauuuauuuaaagag

SEQ ID NO: 742035 - RNA, 62 nt, Homo Sapiens
acaauagcuguuaaggaaagaagcaaccaaguccaggaaauuuucuuaacugcccaagugaa

SEQ ID NO: 742036 - RNA, 62 nt, Homo Sapiens
cacuggaauugucacacggccaucugauggugccaggaaagccccaagcuuguggcaccagg

SEQ ID NO: 742037 - RNA, 62 nt, Homo Sapiens
ugcagcuagaaaauggucuuuugugcuguuuuccaggaaagcaggagccacuuaagagauua

SEQ ID NO: 742038 - RNA, 62 nt, Homo Sapiens
uuauuuuauguuaaaaugugugcuaaacuaucccaggaaaguauuuaauccaacauuguaaa

SEQ ID NO: 742039 - RNA, 62 nt, Homo Sapiens
gccccacuucagggcugcugugagauggaauuccaggaaagaacuucaggugucuggacccu

SEQ ID NO: 742040 - RNA, 62 nt, Homo Sapiens
agauuuuuccucuugccuuacacauggagguuccaggaaaccucuugcagaacuucacacgu

SEQ ID NO: 742041 - RNA, 62 nt, Homo Sapiens
accccuaagcauggucccuugucaccaggcaaccaggaaacugcuacuuguggaccucacca

SEQ ID NO: 742042 - RNA, 62 nt, Homo Sapiens
uugaggucggaaacccucuacugccccauaagccaggaaaagugaaaagagaacacaguucc

SEQ ID NO: 742043 - RNA, 62 nt, Homo Sapiens
cccuccugcucuccaucuuauauguauucuaaccaggaaaaaugugauagcacauggguagc

SEQ ID NO: 742044 - RNA, 62 nt, Homo Sapiens
ccugagcugccagugcuggguaucccccagccccaggaaauguggggucggccaggacccuc

SEQ ID NO: 742045 - RNA, 62 nt, Homo Sapiens
gucauacacuuuaaaaaaaaaaaaaacuuuuuccaggaaaauauauugaaaucaugcugcug

SEQ ID NO: 742046 - RNA, 62 nt, Homo Sapiens
ggagccccagccuucugagggguucuauucccccaggaaaaacagccccuucucugggaugu

SEQ ID NO: 742047 - RNA, 62 nt, Homo Sapiens
cuccagugguucuuacuugaguguucuuuuuuccaggaaagguugugugugagacugaguau

SEQ ID NO: 742048 - RNA, 62 nt, Homo Sapiens
ccaucagucccaggcagauuaagucucuugccccaggaaaccucucccuguuuuagcacuga

SEQ ID NO: 742049 - RNA, 62 nt, Homo Sapiens
aagaugccuccccagcccuguugaggagggcaccaggaaacauccccaaagugucagcaacu

SEQ ID NO: 742050 - RNA, 62 nt, Homo Sapiens
gccucaguggccagaggaucggucugggaggaccaggaaacacuggcccacacgugcauaga

SEQ ID NO: 742051 - RNA, 62 nt, Homo Sapiens
auucuuacggaaaaaaauugacuuauuucuccccaggaaaugguuucugaaauauuuuaugg

SEQ ID NO: 742052 - RNA, 62 nt, Homo Sapiens
uuuguacagcuuuaaguuguagaagauuucucccaggaaaucguauaaaccucuguaugaag

SEQ ID NO: 742053 - RNA, 62 nt, Homo Sapiens
aucccguuuggccaccgugagugcugagucuuccaggaaaaaaaagcugcaaguggauucua

SEQ ID NO: 742054 - RNA, 62 nt, Homo Sapiens
gaguugcugagggcagguccguugcaggagacccaggaaagggcagagauggccugccaaga

SEQ ID NO: 742055 - RNA, 62 nt, Homo Sapiens
aaaaucgguguauccuaucuggcauuauagggccaggaaaagccagagggaccucagggugu

SEQ ID NO: 742056 - RNA, 62 nt, Homo Sapiens
gcucaucccagagaaggagagccagacugugaccaggaaacaacaugagaugagccagccga

SEQ ID NO: 742057 - RNA, 62 nt, Homo Sapiens
uuucuauggcaauuuuguacgucugccauucaccaggaaaaaauggaaauauuagcugcccc

SEQ ID NO: 742058 - RNA, 62 nt, Homo Sapiens
aguggcagccucugggguuuccuccaagcuccccaggaaagccugcagucacaugggugugg

SEQ ID NO: 742059 - RNA, 62 nt, Homo Sapiens
agccauaucuuacacuuugguaaagcagaaaaccaggaaaauuuucuuaaaauauccacaau

SEQ ID NO: 742060 - RNA, 62 nt, Homo Sapiens
ggccacaggcacaagggcugcagcugcuucuuccaggaaacugacacagggagcucagcggc

SEQ ID NO: 742061 - RNA, 62 nt, Homo Sapiens
ccagaugcccugcuccaucacaaccuccuuccccaggaaaacccacuuuccaaaagcccaag

SEQ ID NO: 742062 - RNA, 62 nt, Homo Sapiens
acuuuggucaguuaccugggaauucugggcugccaggaaacgauuugggccucugucaguuu

SEQ ID NO: 742063 - RNA, 54 nt, Homo Sapiens
ccccacccgcucccaccuaggaggccaggaaagggggagcggggcgcccagggc

SEQ ID NO: 742064 - RNA, 62 nt, Homo Sapiens
cuuguuccugacuccagaggaacgagagcauuccaggaaagagagauucccuggaaaauuga

SEQ ID NO: 742065 - RNA, 62 nt, Homo Sapiens
gguggcuacuuuuggucugaaacccacuuggcccaggaaagagaaaagguuguauguuuugu

SEQ ID NO: 742066 - RNA, 50 nt, Homo Sapiens
gggcccagauggaggaguaaccaggaaaaucacugccggcuagucccaag

SEQ ID NO: 742067 - RNA, 62 nt, Homo Sapiens
uauuuauauguuguggggacugcauaacuagcccaggaaaugacucugguuuugaguggccu

SEQ ID NO: 742068 - RNA, 62 nt, Homo Sapiens
gagggagggcuccagacacauguccaagaagcccaggaaaggcuccaggagcagccacauuc

SEQ ID NO: 742069 - RNA, 62 nt, Homo Sapiens
cucccuugugguuucagcacagaaccugaaugccaggaaaaauuccugggccaagaagcuaa

SEQ ID NO: 742070 - RNA, 62 nt, Homo Sapiens
cuuuuugugcauuguccucaugccuguauucuccaggaaacuuguccuucuggaaaucauau

SEQ ID NO: 742071 - RNA, 62 nt, Homo Sapiens
ugacucagugaccagugccugugagcauggggccaggaaagucugguaauaaaugugacuca

SEQ ID NO: 742072 - RNA, 62 nt, Homo Sapiens
aaugccacugcuugguuauugguccccuuugaccaggaaacccaagaggagacaccucaguc

SEQ ID NO: 742073 - RNA, 62 nt, Homo Sapiens
agggucuuccuguuccuagcccauaaauucuaccaggaaaccuggagagaaagcuguaggau

SEQ ID NO: 742074 - RNA, 62 nt, Homo Sapiens
ugaacagaaaccacaagugucugggcuccaagccaggaaaggacucugcucaugagacagau

SEQ ID NO: 742075 - RNA, 62 nt, Homo Sapiens
gcauuucagauuugguuuuugacuuuucccguccaggaaauaugaccaaaccacaugaacca

SEQ ID NO: 742076 - RNA, 62 nt, Homo Sapiens
aacaaaccccacucagaaacuguguguacaauccaggaaaaaaacuccauuccaccugaccc

SEQ ID NO: 742077 - RNA, 62 nt, Homo Sapiens
uggaaauccuagccaagggggccgccucacagccaggaaauugguaacaguugccgaaccag

SEQ ID NO: 742078 - RNA, 61 nt, Homo Sapiens
agaugcuuauuuuccagauccuucuccaauaccaggaaaaaaagucaaggaagaacuuuag

SEQ ID NO: 742079 - RNA, 62 nt, Homo Sapiens
ccaugacaaacuggccucugcauuuaagcuccccaggaaaucucaguucucugauccacuuc

SEQ ID NO: 742080 - RNA, 62 nt, Homo Sapiens
ccgcgggguggcccaugcaguacuaggaggcaccaggaaauccggagggguguguggccagg

SEQ ID NO: 742081 - RNA, 62 nt, Homo Sapiens
gccuccaacccuagcaaaagucugaggggcuaccaggaaagcuuauucccgcugacugaguc

SEQ ID NO: 742082 - RNA, 62 nt, Homo Sapiens
cccuuacugccaggcugaguuucagaggaaacccaggaaaugacccacuauuucuccucugc

SEQ ID NO: 742083 - RNA, 62 nt, Homo Sapiens
ggauauucuaggcuuugcgucgcagggugguaccaggaaagaucacacugugaguccagcgg

SEQ ID NO: 742084 - RNA, 62 nt, Homo Sapiens
aagaccagaaggaguaaugaguagcagaaaguccaggaaagaguucuugggaagcagauuaa

SEQ ID NO: 742085 - RNA, 62 nt, Homo Sapiens
ucuugcccucuugcccagcaucaagugaggguccaggaaagcguuggcagugcccagauucg

SEQ ID NO: 742086 - RNA, 62 nt, Homo Sapiens
gaaaugaucguuucuuuugugugccugcagggccaggaaaggcagccacgcagaaagcucac

SEQ ID NO: 742087 - RNA, 62 nt, Homo Sapiens
cccacagcccuucaccuucgcuaucaaacaucccaggaaaggguaagaauuuagggccaccg

SEQ ID NO: 742088 - RNA, 62 nt, Homo Sapiens
uucugcucuaacauggcaugcccuuucucagcccaggaaacagcaugugguucagagaaaag

SEQ ID NO: 742089 - RNA, 62 nt, Homo Sapiens
uggccaaccuagccaaggcugcagcauauagaccaggaaaucagguagcccagacuggugau

SEQ ID NO: 742090 - RNA, 62 nt, Homo Sapiens
caguucacagaggucuuucagcucauuuaaucccaggaaagaggcaucaaagcuagaaugug

SEQ ID NO: 742091 - RNA, 62 nt, Homo Sapiens
ggcaagaggugccugggaggaguggcccugauccaggaaaaugugaggggaaucuggaacgc

SEQ ID NO: 742092 - RNA, 62 nt, Homo Sapiens
gcgauucuggauaaagccacugaaaauucgaaccaggaaauggaaccccaccacuguugguc

SEQ ID NO: 742093 - RNA, 62 nt, Homo Sapiens
gggagucauuaaagccaagucauucauagcagccaggaaacaauaggaaccaaaagccucug

SEQ ID NO: 742094 - RNA, 62 nt, Homo Sapiens
gaacccuccaauucaggaagugggaaaaggagccaggaaaugugcuucuacuuugccaguua

SEQ ID NO: 742095 - RNA, 62 nt, Homo Sapiens
cccccaaccagagauguuaaagugagccugucccaggaaacaucuccacccaagacgucuuu

SEQ ID NO: 742096 - RNA, 62 nt, Homo Sapiens
gaugucaucguccaucccaucuuccuuugcccccaggaaaggacgcauccaccgguagcggc

SEQ ID NO: 742097 - RNA, 62 nt, Homo Sapiens
guguggaggacaaagcuucuuccugcguggcuccaggaaaagauguggcucacguagguggc

SEQ ID NO: 742098 - RNA, 62 nt, Homo Sapiens
aaagagggagcacauugacuugggaauuuccuccaggaaacucagggcuguuuucucuuccc

SEQ ID NO: 742099 - RNA, 62 nt, Homo Sapiens
ucaggaggggcucucagggacuccuggugacuccaggaaaaugcugccaucguuaaacauua

SEQ ID NO: 742100 - RNA, 62 nt, Homo Sapiens
uugucaucguuccccaccccuucgacaugcugccaggaaacaagggaaggggccucccuccg

SEQ ID NO: 742101 - RNA, 62 nt, Homo Sapiens
accuuugggaacaaacucuuaguaaaugaagcccaggaaaacuuuauauuauuaggagcaaa

SEQ ID NO: 742102 - RNA, 62 nt, Homo Sapiens
uguccacaguaguccccccuucucccaaucacccaggaaagcgguguucuaccagaaaaacg

SEQ ID NO: 742103 - RNA, 62 nt, Homo Sapiens
cucuucuucccuggucuggcgggaggcuguagccaggaaacccuuugcaggacuugcacaca

SEQ ID NO: 742104 - RNA, 62 nt, Homo Sapiens
uuucaaaggcaagcgccaguucuuggccucccccaggaaagaggagcuuagccugagagggu

SEQ ID NO: 742105 - RNA, 62 nt, Homo Sapiens
guagcuucuuaacuggugacgucaccccauccccaggaaacugggauuacagcuugaguucu

SEQ ID NO: 742106 - RNA, 62 nt, Homo Sapiens
ggagggggcugauccucugaccuuccucugugccaggaaacgauauuucuaaguguaacugu

SEQ ID NO: 742107 - RNA, 62 nt, Homo Sapiens
uuaauguaauauuauuuuuauugguuauuagaccaggaaaacuuccacuguacuucucaaag

SEQ ID NO: 742108 - RNA, 62 nt, Homo Sapiens
caguuuggaggcuugaugugugaggaugugauccaggaaaucgagguggcuuccuaguuaca

SEQ ID NO: 742109 - RNA, 62 nt, Homo Sapiens
ggguggggugggcauacacacuguuuuggccaccaggaaauggacaaggaagguggaauguu

SEQ ID NO: 742110 - RNA, 62 nt, Homo Sapiens
cagaagaggaaugugcaacaccguuuucaaauccaggaaaugcaaagcgccagucauuugcu

SEQ ID NO: 742111 - RNA, 53 nt, Homo Sapiens
uauucuucccucucuccugcaacccaggaaauauugaaguggaagaaagauga

SEQ ID NO: 742112 - RNA, 62 nt, Homo Sapiens
aaaaaaaagaaauucgcauggcagucuuucccccaggaaaaagaauguuugugucugugguu

SEQ ID NO: 742113 - RNA, 62 nt, Homo Sapiens
ggugguagucagaggagggacaagaugaggcaccaggaaaggcuguggguggggagcugggg

SEQ ID NO: 742114 - RNA, 62 nt, Homo Sapiens
ggugagagugauuguguuguggugggauuuagccaggaaagggagcuggcgggaggguggga

SEQ ID NO: 742115 - RNA, 62 nt, Homo Sapiens
ugucaucuugccaggcaccugugagcuucagaccaggaaaugcuucagugagaggauuggcu

SEQ ID NO: 742116 - RNA, 62 nt, Homo Sapiens
uuuuuuuuuuuuuucagacgggaacuuaguugccaggaaauucuucaccucuuggcugugga

SEQ ID NO: 742117 - RNA, 62 nt, Homo Sapiens
ugacugcugacugauugggaaaggacauucuuccaggaaaguuccugggcagauuggguaga

SEQ ID NO: 742118 - RNA, 62 nt, Homo Sapiens
acgcuugccuuccuucccggcagcgccuggcuccaggaaaaccaacacgguguccugccacc

SEQ ID NO: 742119 - RNA, 62 nt, Homo Sapiens
ucuuuuuucaucucacaguaaagccuauuuccccaggaaaaaaauaaaugccuuugaaugaa

SEQ ID NO: 742120 - RNA, 62 nt, Homo Sapiens
aacgaaugccaaaucagacuccaccuagagcaccaggaaacagcuuguacccugguagggaa

SEQ ID NO: 742121 - RNA, 62 nt, Homo Sapiens
cacucagacugagacuugaguuauuacagaagccaggaaaaguguauuagaaacuguugucu

SEQ ID NO: 742122 - RNA, 62 nt, Homo Sapiens
agaagugauaaaggaauccaaaguugaagagcccaggaaacgggaaacuguauccauaaugc

SEQ ID NO: 742123 - RNA, 62 nt, Homo Sapiens
uccggccuaggugacagagggaaacuccaucuccaggaaaaaaaaaaaaaaacccaauuugg

SEQ ID NO: 742124 - RNA, 62 nt, Homo Sapiens
agucuauaguacaaaaugcauaaaccauguccccaggaaauuugaaaggaagcaggugcuga

SEQ ID NO: 742125 - RNA, 62 nt, Homo Sapiens
gugcgcccucgacucccgauuucauuugcuggccaggaaaaucgaaagggaaacacccucaa

SEQ ID NO: 742126 - RNA, 62 nt, Homo Sapiens
agcagaaauguacaauuucuggucuguguuuuccaggaaauucauagagaagagaauagagu

SEQ ID NO: 742127 - RNA, 62 nt, Homo Sapiens
gaccacccggcauucucugcccacuuugccuuccaggaaaugggcuuuucaggaagugaauu

SEQ ID NO: 742128 - RNA, 52 nt, Homo Sapiens
cuggaaugaacaguaucacacaccaggaaacuguguaccauacaacaaauaa

SEQ ID NO: 742129 - RNA, 62 nt, Homo Sapiens
gaugcauugacacucuccugcuuuugaucugcccaggaaaggcuccucuuccuccggauccu

SEQ ID NO: 742130 - RNA, 62 nt, Homo Sapiens
cagaggaggucccagauaccaaguggcgccucccaggaaaggcugggagaagagguggccug

SEQ ID NO: 742131 - RNA, 62 nt, Homo Sapiens
gagcuaggggcccgccccgcggacugacagcaccaggaaaccaaaugaugucccugcccgcc

SEQ ID NO: 742132 - RNA, 62 nt, Homo Sapiens
gucuuucgagguggguuuguaccuuccuuaagccaggaaagggauucauggcgucggaaaug

SEQ ID NO: 742133 - RNA, 62 nt, Homo Sapiens
ccacgaggggacauccacccucugggguguggccaggaaaagacaagcucuucagcuugggg

SEQ ID NO: 742134 - RNA, 62 nt, Homo Sapiens
cacuggaacauuccaguggacccuggaccauuccaggaaaacugggacauaggaucgucccg

SEQ ID NO: 742135 - RNA, 62 nt, Homo Sapiens
cuggaaaacugggaaauggccagcugugugucccaggaaauuccuccccuuauucuuccuug

SEQ ID NO: 742136 - RNA, 62 nt, Homo Sapiens
cugugauggggaugugcagggacagugggaucccaggaaacagaccuccauggugggagauc

SEQ ID NO: 742137 - RNA, 62 nt, Homo Sapiens
agugcuccccuccugcuaaagaaccaguuaccccaggaaaauucgacuccuguuuuucuuua

SEQ ID NO: 742138 - RNA, 62 nt, Homo Sapiens
aaccuaaaaguauuaaauuccuagaagaaaacccaggaaaugccauucuggacauaagugcu

SEQ ID NO: 742139 - RNA, 62 nt, Homo Sapiens
cucaaacagaaaauaaugaagccuucuuccucccaggaaaggggacguucagcugagccgag

SEQ ID NO: 742140 - RNA, 62 nt, Homo Sapiens
uuucaguaucugcuuuacugguucaguaaaagccaggaaacacaacuuugugguaaucugaa

SEQ ID NO: 742141 - RNA, 62 nt, Homo Sapiens
uucauuuuguuaauuuuucccaguguuuacaaccaggaaauagcuugucaucuuugauacaa

SEQ ID NO: 742142 - RNA, 62 nt, Homo Sapiens
cggagacaaucuuuucagccuuccccuggcuaccaggaaacucaacguaccaauuuccccuu

SEQ ID NO: 742143 - RNA, 62 nt, Homo Sapiens
auuguaguuuuaguagagacgcgccaccacgcccaggaaauuguagcugggauuacaggugu

SEQ ID NO: 742144 - RNA, 62 nt, Homo Sapiens
agccggagagccggacagcacuaaaacagccaccaggaaagcaggugccacccaccuuggcc

SEQ ID NO: 742145 - RNA, 62 nt, Homo Sapiens
gauaacucagaagcaucuggaagguaugaauaccaggaaacauacaaugugagagacugcag

SEQ ID NO: 742146 - RNA, 62 nt, Homo Sapiens
ccagaccugccccuccaaaccccuaugcugacccaggaaaggccugugcccccaccugggug

SEQ ID NO: 742147 - RNA, 62 nt, Homo Sapiens
auuuauacuugagaaaaauucacaccuuauugccaggaaagccaaaauuuuuaaugaauacu

SEQ ID NO: 742148 - RNA, 62 nt, Homo Sapiens
agcauuucugauacuuucugauauuccuuuucccaggaaagaaaugugucuugcugucauuu

SEQ ID NO: 742149 - RNA, 62 nt, Homo Sapiens
ccacacaggaauucccauccuauucacaggcaccaggaaacccucccagacaccucaagccc

SEQ ID NO: 742150 - RNA, 62 nt, Homo Sapiens
caaucaugagguccuugugcaaucccaaguccccaggaaaccaaucccaaauuugaaaaucc

SEQ ID NO: 742151 - RNA, 62 nt, Homo Sapiens
caagguggaggcugagguggccgcuccuccccccaggaaagcggcagcccggcuggccgccg

SEQ ID NO: 742152 - RNA, 62 nt, Homo Sapiens
cagauuccagccugagugcuggcuacuucgaaccaggaaagcuugcuagggguccugaacca

SEQ ID NO: 742153 - RNA, 62 nt, Homo Sapiens
aucugaauaaagaggacccucacccggggucaccaggaaaggaagugaaugggccuguggcc

SEQ ID NO: 742154 - RNA, 62 nt, Homo Sapiens
agagagagagaaaguaaagguaaguacaugugccaggaaacagagguuauguccuuuuccau

SEQ ID NO: 742155 - RNA, 52 nt, Homo Sapiens
cccccucacugucccugguagcccaggaaagcaggcggccggcgaggccuga

SEQ ID NO: 742156 - RNA, 62 nt, Homo Sapiens
cgaggcaccuuggccgcgggugcuccaggaguccaggaaagacuacauuucccaagaggcuc

SEQ ID NO: 742157 - RNA, 59 nt, Homo Sapiens
aacagagcuggaugcugagagacccaugcccaggaaaaugccggacuggccgggccuga

SEQ ID NO: 742158 - RNA, 62 nt, Homo Sapiens
cugaucgccaguuucuaacggcagugcggaggccaggaaaccaacaccagcucagcauggca

SEQ ID NO: 742159 - RNA, 62 nt, Homo Sapiens
uccaaagagcugauucuaccaauccaauuucaccaggaaaauuccaucagggauuggaugac

SEQ ID NO: 742160 - RNA, 62 nt, Homo Sapiens
cuggagaauccacauaccuuguguauugaaccccaggaaaaggaagaggucgaaccaacccu

SEQ ID NO: 742161 - RNA, 62 nt, Homo Sapiens
aaucugcuuuuuuucuaaaaucugauuugcagccaggaaagaauuuucucacccaaggaaca

SEQ ID NO: 742162 - RNA, 62 nt, Homo Sapiens
gguucauucucaggcugggguggacucagaugccaggaaagggacagccucccauugucagg

SEQ ID NO: 742163 - RNA, 62 nt, Homo Sapiens
cucccuccagugaggagcugggaggagacaucccaggaaaagaauuugauacuccucuguga

SEQ ID NO: 742164 - RNA, 62 nt, Homo Sapiens
ugucuccagugccuguuaagcugaggauacaaccaggaaaugcaacggugucagauuguguu

SEQ ID NO: 742165 - RNA, 62 nt, Homo Sapiens
ucuuuucuucugcuacuuuggggaguugauggccaggaaagaagccagcacaggguuaaagu

SEQ ID NO: 742166 - RNA, 62 nt, Homo Sapiens
cccagcccuaugguuuuuuuauuucauguaccccaggaaauacugugugguuucuaaaagcc

SEQ ID NO: 742167 - RNA, 62 nt, Homo Sapiens
cgucggaggcaucauggaaagacugggacagcccaggaaacaaggggucugaggaugcauuc

SEQ ID NO: 742168 - RNA, 62 nt, Homo Sapiens
agugccaccgugcggggccuggcucugcacacccaggaaaagucugcagacccccagcccuc

SEQ ID NO: 742169 - RNA, 62 nt, Homo Sapiens
cccuguccaccaggauaagugacaccuaggacccaggaaauaaaugccgaugauuuguguga

SEQ ID NO: 742170 - RNA, 62 nt, Homo Sapiens
agccuugacuccuugagacuguagauuucgauccaggaaacauuuauuuagcaccugccaga

SEQ ID NO: 742171 - RNA, 62 nt, Homo Sapiens
uuuucucagucauccuggcagccaaaaaugugccaggaaaagaaagaauguggagcacgcgu

SEQ ID NO: 742172 - RNA, 62 nt, Homo Sapiens
aguuacacauuuuaagagaaaauuuugcucuaccaggaaaaccaacugggccccuuucaaga

SEQ ID NO: 742173 - RNA, 62 nt, Homo Sapiens
agucuccauagucaaucagagcaaccugaaacccaggaaagcaagauugcaaaaaugacugu

SEQ ID NO: 742174 - RNA, 62 nt, Homo Sapiens
aagugauguccccuuucccuaccaaugagggaccaggaaaaaagccauggcauaugacaaag

SEQ ID NO: 742175 - RNA, 62 nt, Homo Sapiens
gugcuuuccgaugagacucaugggacugagucccaggaaacaccagggagacagacucugaa

SEQ ID NO: 742176 - RNA, 62 nt, Homo Sapiens
ucucuauuccguagccugaggaggccgucccaccaggaaaucucaucuccagcuagccuugg

SEQ ID NO: 742177 - RNA, 62 nt, Homo Sapiens
acggaauccaggcaaucuguagcuguagaaccccaggaaagacccaaggugagggcuuaggc

SEQ ID NO: 742178 - RNA, 62 nt, Homo Sapiens
ucuccaccuguguuuauggcguaaugagaagcccaggaaauuuuuggggaagaugcaaggaa

SEQ ID NO: 742179 - RNA, 62 nt, Homo Sapiens
uccggagccaacaccaccacauuuuccuuuacccaggaaauccagugcccaggaauuugaac

SEQ ID NO: 742180 - RNA, 62 nt, Homo Sapiens
cagucucaucuaauuucuuaauucccagcuccccaggaaagccagauauauuuuaguaacac

SEQ ID NO: 742181 - RNA, 62 nt, Homo Sapiens
ggggaaggaacuagaaccacccggucucucugccaggaaauguuccucccuuccuuucacag

SEQ ID NO: 742182 - RNA, 62 nt, Homo Sapiens
cugccugcagaggacagguggcaacagcuggcccaggaaaggucagcuggauccccacguga

SEQ ID NO: 742183 - RNA, 62 nt, Homo Sapiens
aagaaacaacaaaggcaggaaaaacccagacgccaggaaaagccacccaccccauugggaga

SEQ ID NO: 742184 - RNA, 62 nt, Homo Sapiens
uccacgggcaggagaagguggauauuucagcuccaggaaagagagcuaauucacucucucuu

SEQ ID NO: 742185 - RNA, 62 nt, Homo Sapiens
aucaaauuccagaaugauuuuacggagauaucccaggaaaauuaaggcuucucuuaaacacu

SEQ ID NO: 742186 - RNA, 62 nt, Homo Sapiens
uuucugccuccaggaugccacugccucugcuuccaggaaaggcaagggggagggugcuuauc

SEQ ID NO: 742187 - RNA, 62 nt, Homo Sapiens
ggaagcccauccugaccagcugcuccgaggacccaggaaaggcaggauugaaaauguccagg

SEQ ID NO: 742188 - RNA, 62 nt, Homo Sapiens
cgaggacccaggaaaggcaggauugaaaauguccaggaaaguggccaagaagcaguggccuu

SEQ ID NO: 742189 - RNA, 62 nt, Homo Sapiens
aaauccgggcagagagguaaaacaccugaaugccaggaaacaggaagauuagacacuguggc

SEQ ID NO: 742190 - RNA, 62 nt, Homo Sapiens
ggagacuggggcgugugccacauugccagccaccaggaaagcuuuucuuuuucuuuuuuuuu

SEQ ID NO: 742191 - RNA, 62 nt, Homo Sapiens
agaugucuugcuguuuucagcauuucagugggccaggaaaauaacugaucacuauauuacau

SEQ ID NO: 742192 - RNA, 62 nt, Homo Sapiens
augcgaaguucuccaaacccucggagucaaucccaggaaaauacaaugccuccaauuccagc

SEQ ID NO: 742193 - RNA, 62 nt, Homo Sapiens
guuuggaaaacguaucaccuucuuuugggaagccaggaaagcuacaccguuguuguuuuaca

SEQ ID NO: 742194 - RNA, 62 nt, Homo Sapiens
cuuuuuugaagugugaauuauuagaaauacuuccaggaaauguauauuacaaaccaucacac

SEQ ID NO: 742195 - RNA, 62 nt, Homo Sapiens
aggaccggccggacgaugcccuccaccucgagccaggaaauguggaagggggaccugagggc

SEQ ID NO: 742196 - RNA, 62 nt, Homo Sapiens
ugcugggcccagaggugacauuugacuuuuuuccaggaaaaauguaagugugaggaaacccu

SEQ ID NO: 742197 - RNA, 62 nt, Homo Sapiens
uggcccguccugggaaggggggugucuagagcccaggaaacuucuucuuccguggcuuuugg

SEQ ID NO: 742198 - RNA, 62 nt, Homo Sapiens
gaggaggcuugaaggaaccagcaaugagaaggccaggaaaagaaagagcugaaaauggagaa

SEQ ID NO: 742199 - RNA, 62 nt, Homo Sapiens
caaaaaccuucagcucucagaggagauugggaccaggaaaaccugggaggaugggcagacuu

SEQ ID NO: 742200 - RNA, 62 nt, Homo Sapiens
caggugccucgauucccugcccuugugaccucccaggaaacagaacugaucugggacacuau

SEQ ID NO: 742201 - RNA, 62 nt, Homo Sapiens
cucccuccuccccaucaagcacaagagagggcccaggaaaaaagguuucacauaaguguaga

SEQ ID NO: 742202 - RNA, 62 nt, Homo Sapiens
gauguacccugugccauucaaggagaugugguccaggaaagugagccucaugguuuucagag

SEQ ID NO: 742203 - RNA, 62 nt, Homo Sapiens
cugccuguggucagggccaaguguucccuccuccaggaaagccuuuacccuccucaugcccu

SEQ ID NO: 742204 - RNA, 62 nt, Homo Sapiens
cucacuucccuccacccucacagcuaacaaggccaggaaauauuaagggugcaggaggacag

SEQ ID NO: 742205 - RNA, 62 nt, Homo Sapiens
aucagaagaacucuuuaaaaguugaauuaaacccaggaaaauuaaaugccaagagggagaaa

SEQ ID NO: 742206 - RNA, 62 nt, Homo Sapiens
uugugcuggaauugcugaugucugccuaccauccaggaaaacgaacccuuggguagcuugau

SEQ ID NO: 742207 - RNA, 62 nt, Homo Sapiens
uuuaggggcaggagacagacaagggaugggagccaggaaagacugcccagaggggcugggga

SEQ ID NO: 742208 - RNA, 62 nt, Homo Sapiens
gaagugaaauugucuuuauuggguuauucgucccaggaaauaaagggaagucaggguucuag

SEQ ID NO: 742209 - RNA, 62 nt, Homo Sapiens
aaagagcugaaaaugcagaagcaaugagaaggccaggaaaagggggaggugugcaggaacca

SEQ ID NO: 742210 - RNA, 62 nt, Homo Sapiens
aaagagcugaaaauggagaagcaaugagaagaccaggaaaagagggaggcacguaggaacaa

SEQ ID NO: 742211 - RNA, 62 nt, Homo Sapiens
aaagagcugaaaauggagaagcaaugagaaggccaggaaaaggggggagcuugcaggaacca

SEQ ID NO: 742212 - RNA, 62 nt, Homo Sapiens
aaucagagacaauucacagagaggcaggggcuccaggaaagggacgcaucccaggaggugac

SEQ ID NO: 742213 - RNA, 62 nt, Homo Sapiens
gggacugugucucauguuugugugaauguagaccaggaaagggggcugcaaaaauguugagu

SEQ ID NO: 742214 - RNA, 62 nt, Homo Sapiens
cucuuggguauguagaacuguaugggaagaagccaggaaaaccucugaguguugaaggggca

SEQ ID NO: 742215 - RNA, 62 nt, Homo Sapiens
cagggaagccuugaaaaccacggagguggaugccaggaaagggcccauguggcagaaggcaa

SEQ ID NO: 742216 - RNA, 62 nt, Homo Sapiens
uuugugcagccugaaggaucaguguaguaaugccaggaaagugcuuuuuaccuaagacuucc

SEQ ID NO: 742217 - RNA, 62 nt, Homo Sapiens
caugacaggucuauauuucuaccugggccaggccaggaaagagacuauuuaagaaaaaaaaa

SEQ ID NO: 742218 - RNA, 62 nt, Homo Sapiens
uauuauaaguaugcugauggaaaucuauauugccaggaaaagcuauucauuaugcguuguga

SEQ ID NO: 742219 - RNA, 62 nt, Homo Sapiens
caccagucaucagcuauucaguugguaagcuuccaggaaaaaggacaggcagaaagaguuug

SEQ ID NO: 742220 - RNA, 62 nt, Homo Sapiens
cgaauacuagcaucaguggggaagaaaccuccccaggaaauuggaauuaaagugaaaaauca

SEQ ID NO: 742221 - RNA, 62 nt, Homo Sapiens
ucacagacauuaccaaagaggagcuugugaauccaggaaaagcuccagggggcuagcugauc

SEQ ID NO: 742222 - RNA, 62 nt, Homo Sapiens
aaucaccgacacacuacuagugccaguuaaugccaggaaaaacaacaugccaaaaaugcuca

SEQ ID NO: 742223 - RNA, 62 nt, Homo Sapiens
uuugaacagagcaaaggcuuugcaccuucagcccaggaaagacuguccaguuagcugugccc

SEQ ID NO: 742224 - RNA, 62 nt, Homo Sapiens
cucuucucauucaaagaggacaaauagcaaguccaggaaaaauuucccacaugaaccuccag

SEQ ID NO: 742225 - RNA, 62 nt, Homo Sapiens
agaaacuuccucccaccccaguggggaaguagccaggaaauguucaugaaaugguccacaua

SEQ ID NO: 742226 - RNA, 62 nt, Homo Sapiens
cuggaagccuucccccagcagaccuccccagcccaggaaaaagaaggaaggggcuauccugg

SEQ ID NO: 742227 - RNA, 62 nt, Homo Sapiens
aggaccagucaggaugaggcggacuuucccacccaggaaaggcaggccucaccccuccccug

SEQ ID NO: 742228 - RNA, 62 nt, Homo Sapiens
uacaaagcaaguuguguggggcagggaauuuaccaggaaaucaaauucaauggccuucuacu

SEQ ID NO: 742229 - RNA, 62 nt, Homo Sapiens
gucugacuaauguggaaccuuaagaguaccucccaggaaacaggauaugacagcuuaccagc

SEQ ID NO: 742230 - RNA, 62 nt, Homo Sapiens
cucugguuacaccuggaagagcuggaaucgcuccaggaaaaaaaggcaccaaaaggaaacaa

SEQ ID NO: 742231 - RNA, 62 nt, Homo Sapiens
gagacacagagguaaaguaaucauucuucaggccaggaaaccacuccucuacuccaaauuuc

SEQ ID NO: 742232 - RNA, 62 nt, Homo Sapiens
gugaucaagugaaaaagcugaaagccucauauccaggaaaaaaggaggagguuuugaagaau

SEQ ID NO: 742233 - RNA, 62 nt, Homo Sapiens
uuuugauauuuuguguuuguaaaaagucuaacccaggaaagcuugccuauuccaaagagcua

SEQ ID NO: 742234 - RNA, 62 nt, Homo Sapiens
auuaagccccaauagcuacaugguaagaaucaccaggaaaccgggccauguuuauuguggau

SEQ ID NO: 742235 - RNA, 62 nt, Homo Sapiens
gauuuuggaaaaagugaaauguuuguguggugccaggaaauuauacauuuaccaguguucuu

SEQ ID NO: 742236 - RNA, 62 nt, Homo Sapiens
accuaugaauuccauucuuacagacacaaugaccaggaaaaauguguuucccugugagcuag

SEQ ID NO: 742237 - RNA, 62 nt, Homo Sapiens
auaccuacagacaggacaacggaagcuaagucccaggaaaacuguuaaaggccugggguuua

SEQ ID NO: 742238 - RNA, 62 nt, Homo Sapiens
gcugcuaugggggauggcaccucucagcccucccaggaaacacacagagcucugggcccauc

SEQ ID NO: 742239 - RNA, 63 nt, Homo Sapiens
cggaaacagaacucgaugcacugaccugcuccgccaggaaagugagcguguagcguccugagg

SEQ ID NO: 742240 - RNA, 63 nt, Homo Sapiens
agguccggcccauccccaggcaccucacaggccccaggaaaggcccagccaccgaagccgccu

SEQ ID NO: 742241 - RNA, 63 nt, Homo Sapiens
guguuuccgcucucaauagccccucuuguuuuaccaggaaagauccaguuaaaucacccacug

SEQ ID NO: 742242 - RNA, 63 nt, Homo Sapiens
cuuccugaccaacagccagcucuguccuuccccccaggaaacacauguucauuugugugauca

SEQ ID NO: 742243 - RNA, 63 nt, Homo Sapiens
ugcaaggaaccgguuuauaaaacaacagaacagccaggaaaauggugcuaggagagacagugg

SEQ ID NO: 742244 - RNA, 63 nt, Homo Sapiens
augcaccugacuuaugaaauggggauaauacucccaggaaauagcgcaggacaucacaaggac

SEQ ID NO: 742245 - RNA, 63 nt, Homo Sapiens
ucaggggcauuugacauccccuccugguucucaccaggaaaacauccaaagcuuuggaggaaa

SEQ ID NO: 742246 - RNA, 63 nt, Homo Sapiens
ccugaagaccaccccagucuaccucggugcuggccaggaaaccuuucggcuaccucucccacc

SEQ ID NO: 742247 - RNA, 63 nt, Homo Sapiens
uaagaucaacaggucccccccacaugaggccacccaggaaaaaaggcaggggcaguggcaucc

SEQ ID NO: 742248 - RNA, 63 nt, Homo Sapiens
ggauucauugccacacucuuuucucccagggacccaggaaacuaggacuuuguguguuugcug

SEQ ID NO: 742249 - RNA, 63 nt, Homo Sapiens
cacuggaauggaaaaguguguuccuguucauagccaggaaacccagcucagcaaacucccuuu

SEQ ID NO: 742250 - RNA, 63 nt, Homo Sapiens
aaguauuaaaacauuggauuauccugagguguaccaggaaaggauuuuauaaugcuuagaaaa

SEQ ID NO: 742251 - RNA, 63 nt, Homo Sapiens
auuccuugugugugucuuggagugcauuugacuccaggaaaagccauuuugguuuuccuuaac

SEQ ID NO: 742252 - RNA, 63 nt, Homo Sapiens
aacaugaagaaaacuuguauauucuaauguuugccaggaaaggcuagguucaguagaugagac

SEQ ID NO: 742253 - RNA, 63 nt, Homo Sapiens
ccuagaucauggcaaggccugacaacagcugagccaggaaagugcugcugaggcaagucgaca

SEQ ID NO: 742254 - RNA, 63 nt, Homo Sapiens
gccgugaacugaagaaugguauccagucaucagccaggaaagauggggauucacuuacaugcc

SEQ ID NO: 742255 - RNA, 63 nt, Homo Sapiens
ggcauggguggauuuagccaaggaccuggcaacccaggaaacaugauguuuuaagcugcuaag

SEQ ID NO: 742256 - RNA, 63 nt, Homo Sapiens
aaaucugcgagguaguuucuuugguauucuugcccaggaaauggguugauucaucacagauuu

SEQ ID NO: 742257 - RNA, 63 nt, Homo Sapiens
aagcacuucgucuuacccauuuauguaggggccccaggaaaccuacacacagccagaaugagg

SEQ ID NO: 742258 - RNA, 63 nt, Homo Sapiens
uccuaauuucuccucccuuccuuuucccugcuuccaggaaacuccacaucugccuuaaaacca

SEQ ID NO: 742259 - RNA, 63 nt, Homo Sapiens
uggagagucuuuccucacgcuccagcacaguggccaggaaaagaaauacugaauuugccccag

SEQ ID NO: 742260 - RNA, 63 nt, Homo Sapiens
aauuuuuuccaagccaaggagaccauuggccauccaggaaauuucguacagcugaaauauagg

SEQ ID NO: 742261 - RNA, 63 nt, Homo Sapiens
ucugccuccauauauccugaacaucaaacuaucccaggaaaaccaucuagaguaguuuguuuc

SEQ ID NO: 742262 - RNA, 63 nt, Homo Sapiens
gcaaauaguauaaacaacacuaaauuuacugugccaggaaaucuuccugaacuccuugaacuc

SEQ ID NO: 742263 - RNA, 63 nt, Homo Sapiens
uccucugcugcuguccaugacuguccuuuugaaccaggaaaagucacagaguuuaaagagaag

SEQ ID NO: 742264 - RNA, 63 nt, Homo Sapiens
ccaaucccaaggauggaggcugugcccagagccccaggaaaaugggagugagaagaugccugg

SEQ ID NO: 742265 - RNA, 63 nt, Homo Sapiens
auagcuucuccuacagugauucaugucccagguccaggaaauccaauguuggugaaggcagcc

SEQ ID NO: 742266 - RNA, 63 nt, Homo Sapiens
cacgaaggguuuuuagccagggaaaacugagccccaggaaaaccuaaccacugggcaggcaga

SEQ ID NO: 742267 - RNA, 63 nt, Homo Sapiens
auggccaugcuuaagccagcaauuggcugggguccaggaaacaaagcaaaagcacaauaugug

SEQ ID NO: 742268 - RNA, 63 nt, Homo Sapiens
cuggccagggcuccuuuggguagacucgggcacccaggaaagcucccuucuccucugccuggu

SEQ ID NO: 742269 - RNA, 63 nt, Homo Sapiens
auccaguagaguuggagauuaaagcuuggggcuccaggaaaucucguguccccagggacuucu

SEQ ID NO: 742270 - RNA, 63 nt, Homo Sapiens
ucccagccccaccagcagccuaaauaauuucugccaggaaacuaagccagugucuuucugagg

SEQ ID NO: 742271 - RNA, 63 nt, Homo Sapiens
cagcagcugccugcucuccaccccuaccaaggaccaggaaaagcacgcaagccugaggacccu

SEQ ID NO: 742272 - RNA, 63 nt, Homo Sapiens
accuacagaccggcuccucccagguucuuaaacccaggaaagcagaagaugagucuauggcau

SEQ ID NO: 742273 - RNA, 63 nt, Homo Sapiens
acaguuauuucaucauaaaaucaacaauuagcuccaggaaauaaacaguugacaaacugucau

SEQ ID NO: 742274 - RNA, 63 nt, Homo Sapiens
ugcccccaucugcaggaagcaugucuguugugaccaggaaagccucccagcgccagauucauc

SEQ ID NO: 742275 - RNA, 63 nt, Homo Sapiens
agagcagugagggcgggcgggcuugaaaugagcccaggaaaccuggagacuggaggugguggg

SEQ ID NO: 742276 - RNA, 63 nt, Homo Sapiens
agccagucaugccggaaacaauuguaguguuugccaggaaaggugcuagcuguagugugacac

SEQ ID NO: 742277 - RNA, 63 nt, Homo Sapiens
aucucccccaggaccuucugacccauccccaguccaggaaaccuccccucuggguggacaugc

SEQ ID NO: 742278 - RNA, 63 nt, Homo Sapiens
caauuugagagucaugugaacugugcugcuuguccaggaaacauaacaaguucccaggugaug

SEQ ID NO: 742279 - RNA, 63 nt, Homo Sapiens
ucauuccuaccuacacuggaacaauuaagccgaccaggaaaccauauugaggaaucaucuaga

SEQ ID NO: 742280 - RNA, 52 nt, Homo Sapiens; identical to SEQ ID NO: 741700

SEQ ID NO: 742281 - RNA, 63 nt, Homo Sapiens
gguuuagcacgaagaggcccaagaacauaguguccaggaaaguuugugaaaauuacaaaucug

SEQ ID NO: 742282 - RNA, 63 nt, Homo Sapiens
gggaggagaacgccgcguggucguucagggaacccaggaaaauaagacagcuuacuuggcuca

SEQ ID NO: 742283 - RNA, 63 nt, Homo Sapiens
cuuuagucuuauaccucaacaaacuugugaaacccaggaaaacucucucaaaaggaacuuggg

SEQ ID NO: 742284 - RNA, 63 nt, Homo Sapiens
ccaccuacccaaccauccacgagaaaccccaaaccaggaaaccucccuagagggcccuugucu

SEQ ID NO: 742285 - RNA, 63 nt, Homo Sapiens
cccaucuugaugcaugaguugaaucccaagggcccaggaaaacagcgauuuuggaggaaacaa

SEQ ID NO: 742286 - RNA, 63 nt, Homo Sapiens
aaagcccugcugagcagagcgaucuacagagauccaggaaaccuugggaaacuuacauguuga

SEQ ID NO: 742287 - RNA, 63 nt, Homo Sapiens
ugacagcacauugccauaaaucaggcacuaaccccaggaaagaaaguuuucaagggguauuac

SEQ ID NO: 742288 - RNA, 63 nt, Homo Sapiens
uggcagcucuuaaaggagaaccuauggcaccagccaggaaaaagcccaggcacccagaugauu

SEQ ID NO: 742289 - RNA, 63 nt, Homo Sapiens
guuuuuuuuuguuguuguuggcgguguaacaguccaggaaacugcgaccuuuggaaaacguua

SEQ ID NO: 742290 - RNA, 63 nt, Homo Sapiens
gacaagggugaacugggagaacucuggcugagcccaggaaagccuguggggagcagggcugug

SEQ ID NO: 742291 - RNA, 63 nt, Homo Sapiens
cauguguaacaucugcuuauuggggugaucuuuccaggaaaaauucugggaaauuagaaaaag

SEQ ID NO: 742292 - RNA, 63 nt, Homo Sapiens
aaacaaaggaaaacaggugcgaacagucauaagccaggaaaugggaacagccuuguccaggca

SEQ ID NO: 742293 - RNA, 63 nt, Homo Sapiens
aaaucaguuugguugguaacacacaaagaaccaccaggaaagccuuuauuucucucaucuguu

SEQ ID NO: 742294 - RNA, 63 nt, Homo Sapiens
ugucccacagggaccacaucaaaggccugugauccaggaaagacauguagcuggcaagcugca

SEQ ID NO: 742295 - RNA, 63 nt, Homo Sapiens
gaaugcacauugaauggauggguaacagauauuccaggaaaaaucuuguuccugagaagggug

SEQ ID NO: 742296 - RNA, 63 nt, Homo Sapiens
gacauggacccacgugcuuggccagaugcccugccaggaaaggccaaaagagaagcagucugg

SEQ ID NO: 742297 - RNA, 63 nt, Homo Sapiens
gcaagcauugccuguguuccgcccauuggguacccaggaaacuaucucuuccugaucuucccu

SEQ ID NO: 742298 - RNA, 63 nt, Homo Sapiens
auggaacagugcacucuucuuugauugucauauccaggaaaaacucccucugaucauuuccag

SEQ ID NO: 742299 - RNA, 63 nt, Homo Sapiens
auugacucugucuaacacacggucuuugugaccccaggaaaauugucuuccuucauccuuaaa

SEQ ID NO: 742300 - RNA, 63 nt, Homo Sapiens
cuuaugaauuaaaacaaugcaaccugauuguugccaggaaauccagcaaacgcagugaguauc

SEQ ID NO: 742301 - RNA, 63 nt, Homo Sapiens
gugggagaguguggggcaggcaauucuagcacuccaggaaacugagccugcgugggagaaccc

SEQ ID NO: 742302 - RNA, 63 nt, Homo Sapiens
uuuuuuuaaagauggauuuaaaccaagaugccuccaggaaagaggacgaaaugaguauauuca

SEQ ID NO: 742303 - RNA, 63 nt, Homo Sapiens
ugacuuucuaguucuagaaguuccgcugcaaggccaggaaagcuugagaaagguauuguggaa

SEQ ID NO: 742304 - RNA, 63 nt, Homo Sapiens
uagacaugugauagcaaaagaaacaaacaaaagccaggaaaacacucauuuucgccuugaaua

SEQ ID NO: 742305 - RNA, 63 nt, Homo Sapiens
guugguugaacugaacauaucuugucuuagcacccaggaaacagaacuuuaagauauauacag

SEQ ID NO: 742306 - RNA, 63 nt, Homo Sapiens
auuuuucaauuccagauuuuuaauuuuaaggcuccaggaaagaaaggagaguagaacauuuuu

SEQ ID NO: 742307 - RNA, 63 nt, Homo Sapiens
aaaucuaggcagugaacaagucuucauccuggcccaggaaauagccuauuaaaaaaugcuguc

SEQ ID NO: 742308 - RNA, 63 nt, Homo Sapiens
gggaggaugacaagccgcugcccaccuccaagcccaggaaacaguacaagauggcuaaggaga

SEQ ID NO: 742309 - RNA, 63 nt, Homo Sapiens
gccaaggaggagcggcgcauggaccagaugaugccaggaaagaccaaagcagaugcugcugac

SEQ ID NO: 742310 - RNA, 63 nt, Homo Sapiens
aaagcagccaugagaaggaaggauucaccaccuccaggaaaagguaaauuugccaauacaaau

SEQ ID NO: 742311 - RNA, 60 nt, Homo Sapiens; identical to SEQ ID NO: 741731

SEQ ID NO: 742312 - RNA, 63 nt, Homo Sapiens
gccccaauuuucagguaguacuaagaguaugugccaggaaacucuugcuauugaauugagaug

SEQ ID NO: 742313 - RNA, 63 nt, Homo Sapiens
uaaacaugcugccaaccagcuuguccaacaacuccaggaaaacuguuuuucaaaacgccaugu

SEQ ID NO: 742314 - RNA, 63 nt, Homo Sapiens
uaagugcacaaauucuguaguuugccguaucauccaggaaaaccugagggaaaaaaauuauag

SEQ ID NO: 742315 - RNA, 63 nt, Homo Sapiens
ggaauucggagcuagaggacauggaaaauaaagccaggaaagucaaaaaaacgaaagagaagg

SEQ ID NO: 742316 - RNA, 63 nt, Homo Sapiens
gacugcagguugugcccuguggcugccugcaccccaggaaaggagggggcucaggccauccag

SEQ ID NO: 742317 - RNA, 63 nt, Homo Sapiens
gugauugauuuuaggaggcccacaccaaacuccccaggaaaugacugccuuccuugggaccaa

SEQ ID NO: 742318 - RNA, 63 nt, Homo Sapiens
auugauaacuaaauaaauuuaggcuaacccuacccaggaaagguaaguguuuuccggcugaua

SEQ ID NO: 742319 - RNA, 63 nt, Homo Sapiens
ccagcccaguccauggccuuccuucccccuuucccaggaaagggcuaggccccaguucuuccu

SEQ ID NO: 742320 - RNA, 63 nt, Homo Sapiens
acaauuuucaucagagcccaugcuccuguccuuccaggaaaucugagccacccacuugccauu

SEQ ID NO: 742321 - RNA, 63 nt, Homo Sapiens
uuccccucuugguaauuugucccauaaauaccuccaggaaacaccauuaugcuguacuaucua

SEQ ID NO: 742322 - RNA, 63 nt, Homo Sapiens
gacugcuuuuuuuuuuuuuuuaaauuacaaccaccaggaaauuagugugaaagguuacuuaau

SEQ ID NO: 742323 - RNA, 63 nt, Homo Sapiens
agcagcuuagagaaaaugugguaggugaacauuccaggaaagaguuuggcaggacacagagag

SEQ ID NO: 742324 - RNA, 63 nt, Homo Sapiens
cuuuugaaauaacagcauaacauuaaaaagaaaccaggaaacaugcuuguauuuuaagacauu

SEQ ID NO: 742325 - RNA, 63 nt, Homo Sapiens
caguaaagugauuguaaaaagguagaaauugaaccaggaaaauaagaguuauugaaaugcaug

SEQ ID NO: 742326 - RNA, 63 nt, Homo Sapiens
cugcauucuaguacuugggagcuuaucccauagccaggaaacuggcauuuugguccaaguugu

SEQ ID NO: 742327 - RNA, 63 nt, Homo Sapiens
uaaaaugggaacauggacacaaaauggucugauccaggaaaaauuuuuuuaagauuuguucau

SEQ ID NO: 742328 - RNA, 63 nt, Homo Sapiens
guaccaauuuuucaguguugcugugcuuacuggccaggaaaugaaauauuuagccccucuguu

SEQ ID NO: 742329 - RNA, 63 nt, Homo Sapiens
uuauuaccguuuaugauacuauuuuauggucuuccaggaaaagauauuacaagcaauccccaa

SEQ ID NO: 742330 - RNA, 63 nt, Homo Sapiens
ucaggaaguaggaaacuguaacaguuacaguuuccaggaaacauuacuguuucuguugccugg

SEQ ID NO: 742331 - RNA, 63 nt, Homo Sapiens
gggcuuggacacuggccaagaggcugaagauauccaggaaaggggccuugugacuguucuuua

SEQ ID NO: 742332 - RNA, 63 nt, Homo Sapiens
aacacucacauaaguuuaauugagacccaaucuccaggaaaacccaaauuagaaugcuuauaa

SEQ ID NO: 742333 - RNA, 63 nt, Homo Sapiens
gcugugcccuauccccacugcgucacauggcucccaggaaaguacugccagaggaagaucugg

SEQ ID NO: 742334 - RNA, 63 nt, Homo Sapiens
gugaggggugacacucggcuccggcagcuuuccccaggaaagggagugacuccaagaagaguu

SEQ ID NO: 742335 - RNA, 63 nt, Homo Sapiens
aagaaaaaggucugaggcagaauccaagaucugccaggaaacacacaacaaaacaucugcugu

SEQ ID NO: 742336 - RNA, 63 nt, Homo Sapiens
gaggugcuuugagcaguucugaaaaaugcaguuccaggaaagcaacugcuuugguuccuaagg

SEQ ID NO: 742337 - RNA, 63 nt, Homo Sapiens
uccugugccaaaguccugucaggcuggugggcaccaggaaaggccugcacccucuuccugcuc

SEQ ID NO: 742338 - RNA, 63 nt, Homo Sapiens
aacccaaaggagcugccgcacugacccagccccccaggaaacagugagacaagaaucaaguau

SEQ ID NO: 742339 - RNA, 63 nt, Homo Sapiens
cacauggcgcaugaaggagagcccagucucccuccaggaaaggccugaggauguaagucaggc

SEQ ID NO: 742340 - RNA, 63 nt, Homo Sapiens
aggagcuaagcugggaugccacauaggcagaagccaggaaaaaugaccaaccacagaaccaag

SEQ ID NO: 742341 - RNA, 63 nt, Homo Sapiens
caucuguuaccuguacgcuguauuaaaauagaaccaggaaaggcucaggauuucagacauuuc

SEQ ID NO: 742342 - RNA, 63 nt, Homo Sapiens
ugagcagucaaguguucaggccacacagucagcccaggaaaaagagaagcagggccaaaugga

SEQ ID NO: 742343 - RNA, 63 nt, Homo Sapiens
acucaauaucuaucucagaggaaauaugguuacccaggaaagaaauggucugcuagagugaua

SEQ ID NO: 742344 - RNA, 63 nt, Homo Sapiens
uaaaaugccagggccaggcuguguauuucuuucccaggaaauuagcuuuccagccccuuuaua

SEQ ID NO: 742345 - RNA, 63 nt, Homo Sapiens
uccgacccugccacagguuccuggaaagacucuccaggaaauggaagauacugauuuuuuuuu

SEQ ID NO: 742346 - RNA, 63 nt, Homo Sapiens
ucaauugauauauaauaaccguucuaaccucuuccaggaaaauauuuuuagaacuacuagcuu

SEQ ID NO: 742347 - RNA, 63 nt, Homo Sapiens
auuucaaaaugguauuuugaugccaucaaaugcccaggaaauugacuuugcagugucaccacu

SEQ ID NO: 742348 - RNA, 63 nt, Homo Sapiens
aaaauaaagaagcugccaccuaacaggagucacccaggaaagcaccgcacaggcuggcgcggg

SEQ ID NO: 742349 - RNA, 63 nt, Homo Sapiens
ucugaaugcaagcaguuuauaugggagaugauuccaggaaauaccgauaugagaauggggaaa

SEQ ID NO: 742350 - RNA, 63 nt, Homo Sapiens
ggcagcucagaauuauucuggaaagaaagccugccaggaaauaaauucaaauacaguaugagc

SEQ ID NO: 742351 - RNA, 63 nt, Homo Sapiens
ggcacacucuggagaccuugcuggcagugcuagccaggaaacagagugaccaagggacaagaa

SEQ ID NO: 742352 - RNA, 63 nt, Homo Sapiens
uuuagcuuguccuaaaucuugcuguccacccuuccaggaaagggacauuguaaaugaauaaaa

SEQ ID NO: 742353 - RNA, 63 nt, Homo Sapiens
cagucaacaaaaauugggcuaagucacuuuuccccaggaaagaauauuucccucuccugcauc

SEQ ID NO: 742354 - RNA, 63 nt, Homo Sapiens
gacagcaaagaugaugggcucugcacaccaacuccaggaaacucauucugggccagcucuaug

SEQ ID NO: 742355 - RNA, 63 nt, Homo Sapiens
cugacugaauguugguaggugcuccauuacaauccaggaaagucuguguuacugauauuugug

SEQ ID NO: 742356 - RNA, 63 nt, Homo Sapiens
gcaugcccagucagaaaucuguucuauucugcuccaggaaaaucggaaaccugugagucagag

SEQ ID NO: 742357 - RNA, 63 nt, Homo Sapiens
acuuaacugugaaaaaguacuggauguggcugcccaggaaaagcagcccagcccagccugacg

SEQ ID NO: 742358 - RNA, 63 nt, Homo Sapiens
ccuagaauuagggcacauugugcauccuucauuccaggaaagcaagccggucucaaagauaac

SEQ ID NO: 742359 - RNA, 63 nt, Homo Sapiens
agaagcccggguaauuagguugcuuuuuguccuccaggaaaccuacccagaauacuugccgcc

SEQ ID NO: 742360 - RNA, 63 nt, Homo Sapiens
uuuucuggguuggggauuuuuguuaguagagagccaggaaacguugggcucagcacauuuuac

SEQ ID NO: 742361 - RNA, 63 nt, Homo Sapiens
ccagacagacuuucacacuacaagagaaaccagccaggaaaaagagaugccuuggccauggca

SEQ ID NO: 742362 - RNA, 63 nt, Homo Sapiens
gaaggaaugucaugccagggaagugguugagggccaggaaagaucuuaagagccaaaggaagg

SEQ ID NO: 742363 - RNA, 63 nt, Homo Sapiens
guuucugggaggucaggagguccuuccugggcuccaggaaaguuccgcucccugccaccaucc

SEQ ID NO: 742364 - RNA, 63 nt, Homo Sapiens
guaucagagcugcagccagcagagugcagagcuccaggaaagggggauuaaagaggggaggag

SEQ ID NO: 742365 - RNA, 63 nt, Homo Sapiens
uuauauucaguauaugaauagcucuagagugcuccaggaaaaguauucuccaacuccaaacaa

SEQ ID NO: 742366 - RNA, 63 nt, Homo Sapiens
cucaccagaaucuggcacuguauaaaucgggguccaggaaaucauuuuuaguguuuuuucaga

SEQ ID NO: 742367 - RNA, 63 nt, Homo Sapiens
aagggucaacagagcugugugaaggaggauagaccaggaaauagcuggccuggaggaguucgg

SEQ ID NO: 742368 - RNA, 63 nt, Homo Sapiens
gagagggguuaagaugcaccgggagccccgucuccaggaaaagggauggggggcacaggagcu

SEQ ID NO: 742369 - RNA, 63 nt, Homo Sapiens
ccuucagaacuagauuagcacuguuuccacuuaccaggaaauuaguaacaaaguaugcuuugc

SEQ ID NO: 742370 - RNA, 63 nt, Homo Sapiens
ugcacaaaauucgaccugauagggcaucuugguccaggaaaugaccacaggcaguuacuucug

SEQ ID NO: 742371 - RNA, 63 nt, Homo Sapiens
acuucagcugacuccacgggucuccacgucugcccaggaaagagugaaauggagaauuucagg

SEQ ID NO: 742372 - RNA, 63 nt, Homo Sapiens
ccccaucaacaaccguccugcuccccaccucccccaggaaauaaggggccugcuccucucccu

SEQ ID NO: 742373 - RNA, 63 nt, Homo Sapiens
caaagacuaauggggagagggagggccgggaagccaggaaagcuugguguuuucucuggguac

SEQ ID NO: 742374 - RNA, 63 nt, Homo Sapiens
aacugaagaaacugccgcucugagacugcacauccaggaaaaaagacuaggacuugccacaca

SEQ ID NO: 742375 - RNA, 63 nt, Homo Sapiens
gcuugcaagugugcaugguucaaucccucacauccaggaaaugaauuuugcaauugggccaga

SEQ ID NO: 742376 - RNA, 63 nt, Homo Sapiens
uggauuuuaguuuugugcuuaguuaaaucuuuuccaggaaaaagaacuuccccauacaaauaa

SEQ ID NO: 742377 - RNA, 63 nt, Homo Sapiens
aguuuugguuccuuuugcagagugaaaugccucccaggaaaaaaauacauauguauuuuuuug

SEQ ID NO: 742378 - RNA, 63 nt, Homo Sapiens
cuauguguugcuaaaacacaugcuaugagcacuccaggaaacacuauauuuuuuccaaaaaau

SEQ ID NO: 742379 - RNA, 63 nt, Homo Sapiens
uguaccaacacuugaaagauggguggauauuuuccaggaaacagauuuugggcaggacauucc

SEQ ID NO: 742380 - RNA, 63 nt, Homo Sapiens
agcugcacucagacaaugccacggcacaggcguccaggaaagcauaggauuuggaagacagga

SEQ ID NO: 742381 - RNA, 63 nt, Homo Sapiens
gacccagcugagguuauucugauauaacauaacccaggaaacauuuuguuuuguuuuuuacaa

SEQ ID NO: 742382 - RNA, 63 nt, Homo Sapiens
uucacaaacaaggacucccaacaccucccuaauccaggaaacauuaauaauacauuuauguug

SEQ ID NO: 742383 - RNA, 63 nt, Homo Sapiens
ccggaaccugauuuuaguucugacauucuauuuccaggaaaaucaccuuugaacagaucccgg

SEQ ID NO: 742384 - RNA, 63 nt, Homo Sapiens
ucagucuuccaacugcaauaguucauaauucuuccaggaaaacacauuuuaugcugaucuuca

SEQ ID NO: 742385 - RNA, 63 nt, Homo Sapiens
ugccauuucaaguucugaaaacuguuaauaaggccaggaaaacgcaauggagaucaugacacu

SEQ ID NO: 742386 - RNA, 63 nt, Homo Sapiens
agaagagcuuacacagaguccuauaaauuguagccaggaaauaaugcuggacuuggcucagug

SEQ ID NO: 742387 - RNA, 63 nt, Homo Sapiens
aagcuuuucucacugaguugcggcuuggauuaaccaggaaagaagcuggcaaacaccaggcug

SEQ ID NO: 742388 - RNA, 63 nt, Homo Sapiens
uaaguacuugugcauggcccuagauggugaaacccaggaaaaugguauuuuauuacugcauaa

SEQ ID NO: 742389 - RNA, 63 nt, Homo Sapiens
ugggccagagaagauaauguucuuuaauguuguccaggaaacccuggcuugcuugccgagccu

SEQ ID NO: 742390 - RNA, 63 nt, Homo Sapiens
gucucuuguagaagauggacucugaaaaacauuccaggaaaccauggcagcauggagagccuc

SEQ ID NO: 742391 - RNA, 63 nt, Homo Sapiens
gauauuuccuguucacuugugcaugggcuaaaaccaggaaaacuuccuugucuuauuacuuua

SEQ ID NO: 742392 - RNA, 63 nt, Homo Sapiens
auuagcuggaguaggagucugggaguggagaccccaggaaacagcaugaggugagggugugag

SEQ ID NO: 742393 - RNA, 63 nt, Homo Sapiens
ugagcauggguccuuguucuuccuauuucaccuccaggaaagcaaaagugggagcagaaauuc

SEQ ID NO: 742394 - RNA, 63 nt, Homo Sapiens
cuccaacugccaaauucugcuucccucugaaccccaggaaauacuuucuggagaggcuugucu

SEQ ID NO: 742395 - RNA, 63 nt, Homo Sapiens
acauuccacaaucuauggcuuccaccagcuagcccaggaaauacuugaaaucagcauuccaau

SEQ ID NO: 742396 - RNA, 63 nt, Homo Sapiens
aggguggguaagaguccaugggggugcccagucccaggaaaggggacaaugaagggacaggcc

SEQ ID NO: 742397 - RNA, 63 nt, Homo Sapiens
uuuacuccccagcccagagagacgcugcuuuuaccaggaaagacuauugaaagauguuuuauu

SEQ ID NO: 742398 - RNA, 63 nt, Homo Sapiens
aaucuguauguaucaauacaggguuuuuccaagccaggaaacgcccuccuuggcuacuaggag

SEQ ID NO: 742399 - RNA, 63 nt, Homo Sapiens
uuauuuauuuaacuuacuuaucuggucaaagccccaggaaaccuaccaaagcuagaauuaaug

SEQ ID NO: 742400 - RNA, 63 nt, Homo Sapiens
cagcccuuggcucccucuugcucguuguucucaccaggaaaguacacgggccugaggcaggau

SEQ ID NO: 742401 - RNA, 63 nt, Homo Sapiens
uguguguguguguuuaauaugauuuagugacaaccaggaaaacuuacuugggauuauuagcac

SEQ ID NO: 742402 - RNA, 63 nt, Homo Sapiens
cuguuuauguucuugcagcacugguaugucucaccaggaaauuggcauuggaggauggggguc

SEQ ID NO: 742403 - RNA, 63 nt, Homo Sapiens
gguuuucucaaaguccauuguaacuuuugggugccaggaaaugauguuuugaaaagaguaauu

SEQ ID NO: 742404 - RNA, 63 nt, Homo Sapiens
cuuauuuauuuugccugaaaaccauuauuacuaccaggaaaguuuauuuuucuaauaaauagg

SEQ ID NO: 742405 - RNA, 63 nt, Homo Sapiens
acagaggacaaaguuaauuccaagaccuuaauuccaggaaagcugcaacugaagaacugcagc

SEQ ID NO: 742406 - RNA, 60 nt, Homo Sapiens; identical to SEQ ID NO: 741826

SEQ ID NO: 742407 - RNA, 63 nt, Homo Sapiens
cucucugaccuaucaauaaauacccugggggugccaggaaauguagcaggagucagggggcug

SEQ ID NO: 742408 - RNA, 63 nt, Homo Sapiens
acaccaaaugcuucuaguauuaggaggugagugccaggaaaaugucccgcucuccugcuuacc

SEQ ID NO: 742409 - RNA, 63 nt, Homo Sapiens
gaagccauuauuauguaaaaacauaguagaaguccaggaaauguaccuagcacacugccuagu

SEQ ID NO: 742410 - RNA, 63 nt, Homo Sapiens
ucuuugaauggaauuugacuuacucugaaauagccaggaaacuuuauugugacaacauuccag

SEQ ID NO: 742411 - RNA, 63 nt, Homo Sapiens
cgggcacaucauauguccauggucucuggagcuccaggaaauuacuaggaauucuugacgugg

SEQ ID NO: 742412 - RNA, 63 nt, Homo Sapiens
ggcucuccaccagcacaucacuaugcaucuguuccaggaaagaagaaaagcgagcgaggaaga

SEQ ID NO: 742413 - RNA, 63 nt, Homo Sapiens
gaagaguugugucuuuuguggccagugacaaauccaggaaaugaauguugcugauagggauaa

SEQ ID NO: 742414 - RNA, 63 nt, Homo Sapiens
auggagcugaucaaggucauguuucucacuguuccaggaaauugaucaacucuuccaauggga

SEQ ID NO: 742415 - RNA, 63 nt, Homo Sapiens
gguaauauaaaggacuaggaagcagucauacuuccaggaaaugcuuggauucauguggacauu

SEQ ID NO: 742416 - RNA, 63 nt, Homo Sapiens
auuggccucuuugauacacuuuugcuugccuccccaggaaagaaggaauugcauccaagguau

SEQ ID NO: 742417 - RNA, 63 nt, Homo Sapiens
ucauuuguucaaaaguuagaacaucuggcugcaccaggaaaaaaaaaaaaaaaaaguccuguu

SEQ ID NO: 742418 - RNA, 63 nt, Homo Sapiens
ugcuuuccaccgaguacuguguuuauucucucuccaggaaagcagaucaaaagaaaguuagca

SEQ ID NO: 742419 - RNA, 63 nt, Homo Sapiens
cugagagaugaagcaucauauugacaacuuacuccaggaaaaaagguguguguauaggugugu

SEQ ID NO: 742420 - RNA, 63 nt, Homo Sapiens
aacacguaauaagacuguucacauaaaagaaguccaggaaaauugaaaacauaaauaucugcc

SEQ ID NO: 742421 - RNA, 63 nt, Homo Sapiens
uggagcauuguuucucacaguacgcauacacagccaggaaacggcuguccuuauaacgccuua

SEQ ID NO: 742422 - RNA, 63 nt, Homo Sapiens
uaauucccuggugacuagaggggcugucuguguccaggaaacugguggggugggguggggugg

SEQ ID NO: 742423 - RNA, 54 nt, Homo Sapiens; identical to SEQ ID NO: 741843

SEQ ID NO: 742424 - RNA, 63 nt, Homo Sapiens
gcaguccugagggagaagacaaacuugguguggccaggaaaggcaacuuucuggagaggugcc

SEQ ID NO: 742425 - RNA, 63 nt, Homo Sapiens
agaguacuuugguuucugaguguaguguuauugccaggaaaggauccaaggaagggauguauu

SEQ ID NO: 742426 - RNA, 63 nt, Homo Sapiens
agcagugacaauaaacaaagccaccaucgguggccaggaaaauauaaaaagggaauuuaggau

SEQ ID NO: 742427 - RNA, 63 nt, Homo Sapiens
ugaagcauaauuuguuuaaagcuuuuuauuaagccaggaaacauuuggauaauaaaaauugua

SEQ ID NO: 742428 - RNA, 63 nt, Homo Sapiens
gacaguggcugcaguauugauaaccucaaccauccaggaaauugccuugaaagaaucaacuuc

SEQ ID NO: 742429 - RNA, 63 nt, Homo Sapiens
aaauauuuaaguaagugaguauccacauuuucuccaggaaauucaacuuuucaaagcccacca

SEQ ID NO: 742430 - RNA, 63 nt, Homo Sapiens
uguugugcagagcucuucccggcccucuggcccccaggaaaccuuuucuguuccuccccgaga

SEQ ID NO: 742431 - RNA, 63 nt, Homo Sapiens
ggaacccugggucauaaaauaggggagaaaacaccaggaaagaauaauaugcuuuccagcuag

SEQ ID NO: 742432 - RNA, 63 nt, Homo Sapiens
auucuucaauguugcaugugcucuaguacucauccaggaaaccaaauggauagaaacaaaauu

SEQ ID NO: 742433 - RNA, 63 nt, Homo Sapiens
agaugcuuagauuuugugucuaacuuaagagugccaggaaagccuaacauauuuacucuuguc

SEQ ID NO: 742434 - RNA, 63 nt, Homo Sapiens
ugauggugcaagguccagucggaggcuggaaacccaggaaagcaaaagcuggagugugaggca

SEQ ID NO: 742435 - RNA, 63 nt, Homo Sapiens
auacccuugaaagggucuccgacugagaguaccccaggaaagaagagagcuaugauguccuag

SEQ ID NO: 742436 - RNA, 63 nt, Homo Sapiens
cugacacagaacgcccaacggcccccagggaagccaggaaacuaacucgaggggagaagucgc

SEQ ID NO: 742437 - RNA, 63 nt, Homo Sapiens
ugccgcugcaggaaacauuucugacaccgucgaccaggaaagccacacggagaggccacugug

SEQ ID NO: 742438 - RNA, 63 nt, Homo Sapiens
uuuuuuaaguaaaguuuguagcuccucccaugcccaggaaagcacagaacucaaguguggugg

SEQ ID NO: 742439 - RNA, 63 nt, Homo Sapiens
agguuaaaagagccuuuuggacagaaaacugggccaggaaaaggcaucucagaccacaaauag

SEQ ID NO: 742440 - RNA, 63 nt, Homo Sapiens
auggggaagucagcugaaacuugucuuguuuugccaggaaaggaaguaguugccuuuggucau

SEQ ID NO: 742441 - RNA, 63 nt, Homo Sapiens
gguucguaccagcaaguagacuaggaacugagcccaggaaagggggauguuuuccugguguuu

SEQ ID NO: 742442 - RNA, 63 nt, Homo Sapiens
ucaugucacuaaacaagaaaucugacaauagugccaggaaacuaauuuccugauacauuaaaa

SEQ ID NO: 742443 - RNA, 63 nt, Homo Sapiens
cucccgcgcccccaccccagaccccgagccaccccaggaaaagcacaaggacugccgccuucu

SEQ ID NO: 742444 - RNA, 63 nt, Homo Sapiens
acccugaagcaguuguucaaacuuuguucaauaccaggaaauuuauauuggagaaaaacccua

SEQ ID NO: 742445 - RNA, 63 nt, Homo Sapiens
gcucauucacccaacaaaacugugucuuaucugccaggaaagaccagccucacuccugggaac

SEQ ID NO: 742446 - RNA, 63 nt, Homo Sapiens
caaugggaugucaccuaccaaaauccaaauccuccaggaaaaacuacuacacuaaauggacca

SEQ ID NO: 742447 - RNA, 63 nt, Homo Sapiens
uuccauuucucuucuuugaccgugcuaggaauuccaggaaagugcauuccugcccuggugacc

SEQ ID NO: 742448 - RNA, 63 nt, Homo Sapiens
cucuagaauugggcuuguacagaaggauaaaacccaggaaaauggauauuucuauucagauuu

SEQ ID NO: 742449 - RNA, 63 nt, Homo Sapiens
uuucuccucuaaaugcaugaauuuuccacuuaaccaggaaauaccagaagccacauccgcaca

SEQ ID NO: 742450 - RNA, 63 nt, Homo Sapiens
cuuaguaaguguucccuucauauaguggcauacccaggaaaugaucauauuacuaggacuuaa

SEQ ID NO: 742451 - RNA, 63 nt, Homo Sapiens
acgagaaggccgaggaauccuccggccaccccgccaggaaacggagggucucuugcccaucuc

SEQ ID NO: 742452 - RNA, 63 nt, Homo Sapiens
gcaucucagaccacaaauagacagaaaacugggccaggaaaagagguuaaaagagccuuuugg

SEQ ID NO: 742453 - RNA, 63 nt, Homo Sapiens
ccaagauggcgagccagugucagugaagccaagccaggaaacauggagggcauuuggaaggag

SEQ ID NO: 742454 - RNA, 63 nt, Homo Sapiens
cccuacccccaccccagaggaugggaaaaucauccaggaaaccucgacugguguuugaucacg

SEQ ID NO: 742455 - RNA, 63 nt, Homo Sapiens
caagcuggcggccaccgcagggccuggagcucuccaggaaagcugcgcugcaccaacauuggg

SEQ ID NO: 742456 - RNA, 63 nt, Homo Sapiens
gccacuucauaauugaaagggguugaaaugccaccaggaaaauaccugcucaguguggcugga

SEQ ID NO: 742457 - RNA, 63 nt, Homo Sapiens
gugcucuccuggcccugccuugccccuagccucccaggaaaugucuccuguagggcaccuccc

SEQ ID NO: 742458 - RNA, 63 nt, Homo Sapiens
acggcugagcauguggagcgccaggccaggugcccaggaaagggauacuggggaguaaacggc

SEQ ID NO: 742459 - RNA, 63 nt, Homo Sapiens
cgcccucugcccucuugcugcuucuccacauugccaggaaaagcugcugacgccugcccuccu

SEQ ID NO: 742460 - RNA, 63 nt, Homo Sapiens
ucuagcugagagggccuggcccuggggugggcuccaggaaaacgcugguuaggccugggauug

SEQ ID NO: 742461 - RNA, 63 nt, Homo Sapiens
acuugucauucuacuuucuauauuguuaucaguccaggaaacagguaaacagauguaauuaga

SEQ ID NO: 742462 - RNA, 63 nt, Homo Sapiens
agggguguggaaaaggugauccuuuacccccacccaggaaaaccugcauugugcuagcaugga

SEQ ID NO: 742463 - RNA, 63 nt, Homo Sapiens
ccauaaugcuucccauugaagggaaguugagaaccaggaaagcugcuuucacgucauugccau

SEQ ID NO: 742464 - RNA, 63 nt, Homo Sapiens
ccuguacugguuuaaauaaguuuaccuuuuccuccaggaaauauaaugauuucugggaacaug

SEQ ID NO: 742465 - RNA, 63 nt, Homo Sapiens
cuacuuuauuuauuguucccuugaaaugacugaccaggaaaaagaucauccuuaaauuuugaa

SEQ ID NO: 742466 - RNA, 63 nt, Homo Sapiens
ugagauuuguuaaaacgguuaggacuguuuuguccaggaaagauaagaggaccaaacauauaa

SEQ ID NO: 742467 - RNA, 63 nt, Homo Sapiens
gugacauauauaaauuaagcauaaaauauguaaccaggaaaagacuguuaacauuacauuuau

SEQ ID NO: 742468 - RNA, 63 nt, Homo Sapiens
uucauagaauaacaacugcugggaauauccgugccaggaaaagaaaaauuucuggcaaauauu

SEQ ID NO: 742469 - RNA, 63 nt, Homo Sapiens
gauggaaaguggaagacauauaccaauuauauuccaggaaaaaauacuuuaauaguauuguua

SEQ ID NO: 742470 - RNA, 63 nt, Homo Sapiens
agaccagaaaaaguuccaucuaaaauaucaugcccaggaaagcacaugggaucaaaaguaaaa

SEQ ID NO: 742471 - RNA, 63 nt, Homo Sapiens
ggaaggggauuuggagggaggcugucgucgcccccaggaaagacgggccugggggaggcggga

SEQ ID NO: 742472 - RNA, 63 nt, Homo Sapiens
gguacucaagauguugaagcuguuuacuaucugccaggaaacuaaaaaucccuugugauugga

SEQ ID NO: 742473 - RNA, 63 nt, Homo Sapiens
gcagucagaguccagugcuccccccccccaacuccaggaaagacccccuccccaggcuggaga

SEQ ID NO: 742474 - RNA, 63 nt, Homo Sapiens
agauaggaggacuggaugaggccuguuuccccaccaggaaaugucggccuauuuccuugccag

SEQ ID NO: 742475 - RNA, 63 nt, Homo Sapiens
gugaagacccaaaacagcuucacaauugaacuuccaggaaaguaagaguuuaaacaaaaaacc

SEQ ID NO: 742476 - RNA, 63 nt, Homo Sapiens
ccugaccuugcuauuugaacucaguauuuauuuccaggaaaagugaaagauuuuuguaaaaag

SEQ ID NO: 742477 - RNA, 63 nt, Homo Sapiens
uuucucuaacccuuucaaaaucuucucagguugccaggaaauggaaguacugcuaucucgcau

SEQ ID NO: 742478 - RNA, 63 nt, Homo Sapiens
ggaaugaaucaacucuugguacuaguaacagcuccaggaaagguacacuuaaagcaacaacca

SEQ ID NO: 742479 - RNA, 63 nt, Homo Sapiens
uggggaguccaaguggauuaaaaaugcucagcuccaggaaagagucuggcauccauaugagga

SEQ ID NO: 742480 - RNA, 63 nt, Homo Sapiens
caagaggcugagaauucuuugaagcaaagaauuccaggaaaccauaguggaagaggagagcau

SEQ ID NO: 742481 - RNA, 63 nt, Homo Sapiens
aggccaucugggcaggaggccagcuggacaucuccaggaaacccgccagcucugagucccagg

SEQ ID NO: 742482 - RNA, 63 nt, Homo Sapiens
gaagaaguugcaguauggauaucuuucacccucccaggaaacucuuucaaaccuaaucuguac

SEQ ID NO: 742483 - RNA, 63 nt, Homo Sapiens
gggcaggggucugcuucaggaaauggaagcuguccaggaaaugagcagagauucacaagacag

SEQ ID NO: 742484 - RNA, 63 nt, Homo Sapiens
guguuagcgggcaggggagccauugugggguccccaggaaagggcaagggcucagccacaucu

SEQ ID NO: 742485 - RNA, 63 nt, Homo Sapiens
gucaauuaaaaacuucccaggauuucuuuggacccaggaaacagccauguggguccuuucugu

SEQ ID NO: 742486 - RNA, 63 nt, Homo Sapiens
acugucuguuauuuucuguacauugugguagguccaggaaauaugacauuuucccccuugaug

SEQ ID NO: 742487 - RNA, 63 nt, Homo Sapiens
acuucucgcugcccuuccaagcccggcuuugggccaggaaaggcuuccccagguggcucuucu

SEQ ID NO: 742488 - RNA, 63 nt, Homo Sapiens
acgcguguggagagagccgcacaccagcgccacccaggaaaggcggagcgguuaccaguguuu

SEQ ID NO: 742489 - RNA, 63 nt, Homo Sapiens
acacaggacaggcuggugcaccuccaggcugugccaggaaacccgcugccuuugcgucaccac

SEQ ID NO: 742490 - RNA, 63 nt, Homo Sapiens
gaguuuccugaaggaguucuagguuaacaaggaccaggaaaguauaaaaagaauuuacaugau

SEQ ID NO: 742491 - RNA, 63 nt, Homo Sapiens
ggcucggagggagaaaggccggccucagccuaaccaggaaagggccaugaacucccaagcccc

SEQ ID NO: 742492 - RNA, 63 nt, Homo Sapiens
gacgcgugaaaacugagcccgagaaaaguacucccaggaaacaggagggauggaccccgaaag

SEQ ID NO: 742493 - RNA, 63 nt, Homo Sapiens
cccagaaagcuuaaugauacguucacccuccugccaggaaaauggauuuuuuaaagcuuuucu

SEQ ID NO: 742494 - RNA, 63 nt, Homo Sapiens
ucguggaagcuuuggggcuccuggccguagguuccaggaaagcuuugaaaucucaggacucuu

SEQ ID NO: 742495 - RNA, 63 nt, Homo Sapiens
gaagaaaacacucaguugauuccauugccuuuuccaggaaaggcagaaaucagggcacuugca

SEQ ID NO: 742496 - RNA, 63 nt, Homo Sapiens
uuuguaccaaacagugaagcaacuugaucuuguccaggaaagcaaggucacucugaggauuga

SEQ ID NO: 742497 - RNA, 63 nt, Homo Sapiens
caguauuuccuaugugucaguuucuuggggaagccaggaaagccuccagggcaaagcugaagg

SEQ ID NO: 742498 - RNA, 63 nt, Homo Sapiens
aucucuaagacuggguagcuuuuuucaacuguuccaggaaagauuuuucaaaguaggauuucc

SEQ ID NO: 742499 - RNA, 63 nt, Homo Sapiens
cagaucccggccuggcuuccguccaguccuuguccaggaaacuaugccuauaacgcugugagu

SEQ ID NO: 742500 - RNA, 63 nt, Homo Sapiens
gcuccucucagccaaccaaguuacuuguggaaaccaggaaauucccaagggauggggcugucu

SEQ ID NO: 742501 - RNA, 63 nt, Homo Sapiens
ggaacugagacucugguaccccccuaaggcagcccaggaaauaccccacccucagcgucucug

SEQ ID NO: 742502 - RNA, 63 nt, Homo Sapiens
auuucagacuugacccuaauugaccauauaugaccaggaaacacuucugaguuuacagcuccg

SEQ ID NO: 742503 - RNA, 63 nt, Homo Sapiens
cugaagaagacaagauuucuggacaagcucagcccaggaaacaaaggguaaacaaaaaacuaa

SEQ ID NO: 742504 - RNA, 63 nt, Homo Sapiens
aggaggcuguccaccuugcuuggcucacugggaccaggaaagccugucuuugguuaggcucgu

SEQ ID NO: 742505 - RNA, 63 nt, Homo Sapiens
uggaauaaaauuaauuaggcuaauaggcuuaacccaggaaauccuaaguuccuugaauaucca

SEQ ID NO: 742506 - RNA, 63 nt, Homo Sapiens
gaguggaaucuuuuaaagacaggaccccuauguccaggaaaggggaaaaggaacuuugccaau

SEQ ID NO: 742507 - RNA, 63 nt, Homo Sapiens
uggggggcaggaggaaagcacaauguuucuuagccaggaaagacaaauaauccaacgcugcua

SEQ ID NO: 742508 - RNA, 63 nt, Homo Sapiens
auugaucaccaugaaagaagaugccuuuuguuuccaggaaaauuuaguuaaauuggauugaga

SEQ ID NO: 742509 - RNA, 63 nt, Homo Sapiens
aacuugcagcuuuaaccugcgauuugccauuguccaggaaagauuucucucuuagaauuggag

SEQ ID NO: 742510 - RNA, 63 nt, Homo Sapiens
uccuucauggccacagaaaugcuuagcccuuacccaggaaauagggacgguaccaagaguagc

SEQ ID NO: 742511 - RNA, 63 nt, Homo Sapiens
aguugaaauccaggaaucucgaugccagcgaugccaggaaacaaguugcuucugcagcccgca

SEQ ID NO: 742512 - RNA, 63 nt, Homo Sapiens
aaaguggcgacuaaaacagcgacuucaagccagccaggaaauuugacuugcuaguaaacagaa

SEQ ID NO: 742513 - RNA, 63 nt, Homo Sapiens
cugcuuggggcagcauuuguucugcaagguuuuccaggaaaaucggcaaaaauagacccagcu

SEQ ID NO: 742514 - RNA, 63 nt, Homo Sapiens
cauuuuuucugggcugauguugcccaggccuucccaggaaaauuagagagcccuauucaucgc

SEQ ID NO: 742515 - RNA, 63 nt, Homo Sapiens
ucuacaaucauggagacagauuuuguuuaaaaaccaggaaauuagucauucuucucacugagu

SEQ ID NO: 742516 - RNA, 63 nt, Homo Sapiens
gccaaaagaaugucuguuucggcaacaccagugccaggaaaagcucacuucugcccaccugcc

SEQ ID NO: 742517 - RNA, 56 nt, Homo Sapiens; identical to SEQ ID NO: 741937

SEQ ID NO: 742518 - RNA, 63 nt, Homo Sapiens
aucuuccacuugagcaaccuccgcugaaguuccccaggaaaugccaugugauuaagauccagg

SEQ ID NO: 742519 - RNA, 63 nt, Homo Sapiens
uggggaaugcugccaucuggguugcucaggcauccaggaaaagagccccaaggauggcuggga

SEQ ID NO: 742520 - RNA, 63 nt, Homo Sapiens
aggagcucucugcugagcagcccagcacaacccccaggaaacacaaaugggguccaggucacc

SEQ ID NO: 742521 - RNA, 63 nt, Homo Sapiens
ucuucuggcagcagaaauccaugaagcccgggcccaggaaaauuagaaguuuuccauuccuga

SEQ ID NO: 742522 - RNA, 63 nt, Homo Sapiens
cuauuccuuagccuuauagauuucuaguacugcccaggaaaucuaauuucaauacauuuaucc

SEQ ID NO: 742523 - RNA, 63 nt, Homo Sapiens
auauuggacucuugaaggcaauccuuccucuggccaggaaauuuuuuaaaaaauaauacugug

SEQ ID NO: 742524 - RNA, 63 nt, Homo Sapiens
aaagccaagguugucaaagaacagccagugaggccaggaaagaaauuggucuugugguuuuca

SEQ ID NO: 742525 - RNA, 63 nt, Homo Sapiens
augaaguuagugcgggcuuugcugcucccuggcccaggaaagagggacuaccugacccucacc

SEQ ID NO: 742526 - RNA, 63 nt, Homo Sapiens
uuuuuuuuuuucccccuugaggauuguggaaaaccaggaaaagggagcuaugauuuuuuuuuc

SEQ ID NO: 742527 - RNA, 63 nt, Homo Sapiens
uugagauacccugcuaucgauggucgcuacaaaccaggaaauacucaaguuauuauguguaua

SEQ ID NO: 742528 - RNA, 63 nt, Homo Sapiens
gcgccauggauuccucugggggcuggcgcaugcccaggaaagccugggccacacgggacacuc

SEQ ID NO: 742529 - RNA, 63 nt, Homo Sapiens
gcugagcaaacccagggaauagcccuccucuccccaggaaacuucucugaaaucuuagacuua

SEQ ID NO: 742530 - RNA, 63 nt, Homo Sapiens
ccggcgccuuuuucuuuuuagaugggaaggaggccaggaaagggucagcuuaaccauuuccua

SEQ ID NO: 742531 - RNA, 63 nt, Homo Sapiens
aaauacuaugcauagcaaggagaugcagagccgccaggaaaauucugaguuccagcacaauuu

SEQ ID NO: 742532 - RNA, 63 nt, Homo Sapiens
ugccucuuagcauguuugauuuaagaaaagccuccaggaaaucuugagagccugucuuggcau

SEQ ID NO: 742533 - RNA, 63 nt, Homo Sapiens
gggaggcccgcggcgguggagccgagcggggagccaggaaagaagaguuggagugagaugaag

SEQ ID NO: 742534 - RNA, 63 nt, Homo Sapiens
uccauaccccuuccuggaucuccagugccugggccaggaaagcccucuggguuccgggaagcc

SEQ ID NO: 742535 - RNA, 63 nt, Homo Sapiens
agaggaaaacaagugaggacacugguuuuaccuccaggaaacaugaaaaauaauccaaaucca

SEQ ID NO: 742536 - RNA, 63 nt, Homo Sapiens
uuccauauaaauuguuuauucaaccaucagguuccaggaaaaagccuguuaguauuuucauug

SEQ ID NO: 742537 - RNA, 63 nt, Homo Sapiens
gguaggaaggugcugugggcuggucccacacauccaggaaagaggccaguagagaauucugcc

SEQ ID NO: 742538 - RNA, 63 nt, Homo Sapiens
acagcagucagugccgcccauguucuacacccuccaggaaaugccgcgacaaggacgacauuc

SEQ ID NO: 742539 - RNA, 63 nt, Homo Sapiens
cugcugaccuuugcaaaggccaguucccccgccccaggaaacagccaggccuggggccccucc

SEQ ID NO: 742540 - RNA, 63 nt, Homo Sapiens
aguuuaaaauuauacaucagcaugaauaaggugccaggaaaacuagaguuacauuaugcuugg

SEQ ID NO: 742541 - RNA, 63 nt, Homo Sapiens
cccucaucuucucuuucucuuagcuaccaacggccaggaaaaguucuagaaucccuucaguuu

SEQ ID NO: 742542 - RNA, 63 nt, Homo Sapiens
aauagcuucuuuaaaagucuaagcugacccuacccaggaaaguucaacggggccauggcagga

SEQ ID NO: 742543 - RNA, 63 nt, Homo Sapiens
agauccaauguuuuuucuaaccaagcuccuauuccaggaaaaacugaugauauccuauccucu

SEQ ID NO: 742544 - RNA, 63 nt, Homo Sapiens
acagggcccuugucgccccuucacuuacgaacaccaggaaaccuugcucuaacuggagcacau

SEQ ID NO: 742545 - RNA, 63 nt, Homo Sapiens
uguaaccacccuuuucuaacucccucuccauguccaggaaacuccuuggauuuagggauagug

SEQ ID NO: 742546 - RNA, 63 nt, Homo Sapiens
acaagugucuucugugugucaaguacagauugaccaggaaaagaaggauugcgcacccugcac

SEQ ID NO: 742547 - RNA, 63 nt, Homo Sapiens
aaagaauguguuaagggaugccaccaguauuuaccaggaaaacacauucucagcugucuuguu

SEQ ID NO: 742548 - RNA, 63 nt, Homo Sapiens
auagacuuuauaaacagugguaaggauuuuuucccaggaaaagguagaccgaagccuugugca

SEQ ID NO: 742549 - RNA, 63 nt, Homo Sapiens
acauaacguucaguugggaugagccugcuguuuccaggaaauuugucccccguuugccuccac

SEQ ID NO: 742550 - RNA, 63 nt, Homo Sapiens
ccuguggguugugcuaauuuaggaagacuuggcccaggaaaaaagccaagacaguggcagcaa

SEQ ID NO: 742551 - RNA, 63 nt, Homo Sapiens
caaugucucuucacgggccugaucaacuggggcccaggaaaaggucuuuuuuuccucugcccu

SEQ ID NO: 742552 - RNA, 63 nt, Homo Sapiens
agcgcuaguggaggguuggagaugcagguuugaccaggaaagcuuggggcaugacccagugaa

SEQ ID NO: 742553 - RNA, 63 nt, Homo Sapiens
uacuucugauaauuuauugucuuuauuuuuaucccaggaaauaaaagguuaccuuguugaggc

SEQ ID NO: 742554 - RNA, 63 nt, Homo Sapiens
agccugggcucacccuguguggcucauucccacccaggaaacugaagauaaaagauuugggaa

SEQ ID NO: 742555 - RNA, 63 nt, Homo Sapiens
uucagccaugauaagaacagagugccugcauucccaggaaaauacgaaaaucccaugagauaa

SEQ ID NO: 742556 - RNA, 63 nt, Homo Sapiens
aaucaauuuguucuuagaaccugguugaaaauaccaggaaacuguuacagacgccauuuuuuu

SEQ ID NO: 742557 - RNA, 63 nt, Homo Sapiens
agggaccucagggagccccagcuucuuacccacccaggaaacccuugguccagagaggacagg

SEQ ID NO: 742558 - RNA, 63 nt, Homo Sapiens
aagcccuaagggugguaggaacccaggagggacccaggaaacuaagauuugagauucagugcc

SEQ ID NO: 742559 - RNA, 63 nt, Homo Sapiens
ucuccucaggcuccuccuugcccccaccuugccccaggaaaggccaaaguccaggugacugcc

SEQ ID NO: 742560 - RNA, 63 nt, Homo Sapiens
agccagcugugcacuuucuucucuuucccaaccccaggaaagguuuuccuuauuuugugugcu

SEQ ID NO: 742561 - RNA, 63 nt, Homo Sapiens
ugagacuuccugcugccuuuggacauaacuaagccaggaaacuuuaaaagccuucuagaaaua

SEQ ID NO: 742562 - RNA, 63 nt, Homo Sapiens
caaggcuagagcugauggcacugucugcacuguccaggaaaaaaguaaaacuguacuguugcg

SEQ ID NO: 742563 - RNA, 63 nt, Homo Sapiens
gggcgguggcuucacuccugagucugcaaaaucccaggaaacuugggucuugcugcccauccu

SEQ ID NO: 742564 - RNA, 63 nt, Homo Sapiens
ucuuuaaagagccaaguugcuucggggaaacagccaggaaaauggucaagauuauuuuuagag

SEQ ID NO: 742565 - RNA, 63 nt, Homo Sapiens
ucccacugcccccugagauguacacccugauugccaggaaaacagacugcuguguucaguaac

SEQ ID NO: 742566 - RNA, 63 nt, Homo Sapiens
caaugggucugugacucaaaaauugagcccuggccaggaaaauguggagacaguucuucuccu

SEQ ID NO: 742567 - RNA, 63 nt, Homo Sapiens
acaauccauagauagccagcaguggauguuacuccaggaaaaugcaggauuaaaauuguccuu

SEQ ID NO: 742568 - RNA, 63 nt, Homo Sapiens
cauccaggacuacgaggcggccaaggcucuguuccaggaaauucuugaagaguauaaugaaag

SEQ ID NO: 742569 - RNA, 63 nt, Homo Sapiens
agacacuuugucuaguguauucucuucacagugccaggaaagagugguuucugcguguguaua

SEQ ID NO: 742570 - RNA, 63 nt, Homo Sapiens
ggcuugauuuuggccuauuuuacauuauuugguccaggaaauuagguuauauuagguuuuuug

SEQ ID NO: 742571 - RNA, 63 nt, Homo Sapiens
aggagucccuuacuuuacguguguaaauuccuaccaggaaagaauacauauccaauagauugg

SEQ ID NO: 742572 - RNA, 63 nt, Homo Sapiens
cuuccgugccagugauucgucucuggaaacgcgccaggaaaagacauuguaguucgcaugguu

SEQ ID NO: 742573 - RNA, 63 nt, Homo Sapiens
cugcacugugggcuuuuauuaaaggaagaaauuccaggaaaauccaaacagaacuauggaaaa

SEQ ID NO: 742574 - RNA, 63 nt, Homo Sapiens
aauauauccccaucuccguuauaggaauuucucccaggaaagacugauaauugucuccccucc

SEQ ID NO: 742575 - RNA, 63 nt, Homo Sapiens
guuuuuugagaccauauguaccaacaguaagccccaggaaaggagaucugggggaauaaaaag

SEQ ID NO: 742576 - RNA, 63 nt, Homo Sapiens
agacccaaauuccauaaacaguacacuuccacaccaggaaaacuuuguuucacccuacuucaa

SEQ ID NO: 742577 - RNA, 63 nt, Homo Sapiens
aaaaaagguauuucugcauuuaggcuuugaugaccaggaaaaacuuuccccuuuguuuagggg

SEQ ID NO: 742578 - RNA, 63 nt, Homo Sapiens
ggagggguagcgggggaggggagauacgggguuccaggaaagguccuuccccccccccacccc

SEQ ID NO: 742579 - RNA, 63 nt, Homo Sapiens
aaccagaucucuggauuucaaggccaaauccugccaggaaaguaaauguccauuuucauuuau

SEQ ID NO: 742580 - RNA, 63 nt, Homo Sapiens
auaaaaagaguaugagucuuucuuuuuuaauuuccaggaaaaaucaauauuuaguaaagcuuu

SEQ ID NO: 742581 - RNA, 63 nt, Homo Sapiens
ugcaaaaaaugggaaguaaggccucccggcaguccaggaaaaccuuauaaagcuuguacagcu

SEQ ID NO: 742582 - RNA, 63 nt, Homo Sapiens
aaaaaaaaagacucccuggacaaggaucagaggccaggaaaaauuucucccacugggucaccu

SEQ ID NO: 742583 - RNA, 63 nt, Homo Sapiens
ggaaaagccauuguauaaauaagugaauguuggccaggaaaauugagcuuuuuuagaaagucg

SEQ ID NO: 742584 - RNA, 63 nt, Homo Sapiens
cacuccaccaguagugcugggggaccugcugcaccaggaaagcgacgucuccacggagcccuc

SEQ ID NO: 742585 - RNA, 63 nt, Homo Sapiens
augcaauagacuugcucggacauauagcuuuggccaggaaagcagccugcuguucccgcuuuc

SEQ ID NO: 742586 - RNA, 63 nt, Homo Sapiens
aagcacuggaaagcagcaggacuugcacugaggccaggaaaagaguccuuugacuuaguacug

SEQ ID NO: 742587 - RNA, 63 nt, Homo Sapiens
ugucagagaagacuggcgucagcagccaaaacaccaggaaacacauuucuguggccuuagcca

SEQ ID NO: 742588 - RNA, 63 nt, Homo Sapiens
cuuugcugccauccagccccagaucgcuuuacuccaggaaaugcacguuacacauuuucgcuu

SEQ ID NO: 742589 - RNA, 63 nt, Homo Sapiens
gugcuaagaucagucacccaugugaauaagaagccaggaaaggaaagauggggaagcccagau

SEQ ID NO: 742590 - RNA, 63 nt, Homo Sapiens
cgagugugacugggaaggagaacuuauuccuuaccaggaaacuggaagcuaaaaauacagagg

SEQ ID NO: 742591 - RNA, 63 nt, Homo Sapiens
cuuggcugguguaugcacaguucccuucccagaccaggaaagguggccugcgucuuuuuucuc

SEQ ID NO: 742592 - RNA, 63 nt, Homo Sapiens
agcuuuugccaguauuaugcuguauuuauacccccaggaaacucuuauuucuagaagcacaug

SEQ ID NO: 742593 - RNA, 63 nt, Homo Sapiens
gauggugccccccaaauugucaaagagcuugacccaggaaauaggagggaauuggguuugugg

SEQ ID NO: 742594 - RNA, 63 nt, Homo Sapiens
cagacuacauauuuuucaugaaaugaagcagagccaggaaaaaucagugguuugcccuuggcu

SEQ ID NO: 742595 - RNA, 63 nt, Homo Sapiens
gaggcugcagugagccaugaggauugcuggagcccaggaaauuucagggagguugaggcagca

SEQ ID NO: 742596 - RNA, 63 nt, Homo Sapiens
cuaauucucuuuagacuccugugggaaaauauuccaggaaacgcuaacacuguuuugauuuuu

SEQ ID NO: 742597 - RNA, 63 nt, Homo Sapiens
gucuuuaaaaacaaaaacaauagugcacauauuccaggaaaguuuuguuuuuaauuuuaacca

SEQ ID NO: 742598 - RNA, 63 nt, Homo Sapiens
uguuucaaugcuguaaguagagggccccaccagccaggaaagucccagggcccaaaagucaga

SEQ ID NO: 742599 - RNA, 63 nt, Homo Sapiens
uuccacugagguuagaguccauuuacaaagcugccaggaaaccggccacuucuaguaaaccac

SEQ ID NO: 742600 - RNA, 63 nt, Homo Sapiens
caugaugcaauuaucuuacucagaggagauuugccaggaaauucucuccguuacaugcauuac

SEQ ID NO: 742601 - RNA, 63 nt, Homo Sapiens
gucucuucagaucugaaauacuccaguuuagagccaggaaauuucacaggucacaccgauuuu

SEQ ID NO: 742602 - RNA, 63 nt, Homo Sapiens
accagggcacccauccaaggaaccuccgaacagccaggaaaagccaugaguugcaaccaaaac

SEQ ID NO: 742603 - RNA, 63 nt, Homo Sapiens
guauggagucaccuguaaauugauucaagugagccaggaaagcagcaaaggaaagagaaaccu

SEQ ID NO: 742604 - RNA, 63 nt, Homo Sapiens
ggggaugggaaugacuuccucgagaccauacagccaggaaauagcggugaaucuagugaucuc

SEQ ID NO: 742605 - RNA, 63 nt, Homo Sapiens
gacgcccagcacagcagcaggacacaccaugugccaggaaaugaccucagcaagaaaccucag

SEQ ID NO: 742606 - RNA, 63 nt, Homo Sapiens
cauccccugcccugccgggcaccucgcucuaccccaggaaaaugugagcucguuuuccugcuc

SEQ ID NO: 742607 - RNA, 63 nt, Homo Sapiens
cagucuuuuuuuaaaaaaaauaguccucuaguuccaggaaacaaauaaaagcuaugagacaaa

SEQ ID NO: 742608 - RNA, 63 nt, Homo Sapiens
agcaggagaggguggcucagcugacuuaccaaaccaggaaaacgaaccaucaaaccuuuccuc

SEQ ID NO: 742609 - RNA, 63 nt, Homo Sapiens
uccuucucuggcgucugcuuacguauccaucucccaggaaauguuccuuccuugagucauaga

SEQ ID NO: 742610 - RNA, 63 nt, Homo Sapiens
gagucucccccuuaaauuucucuccaccugcccccaggaaaaacuaucaguggucguguaccu

SEQ ID NO: 742611 - RNA, 63 nt, Homo Sapiens
gaacagaguccauccaagcuugugcuccucuggccaggaaaggucagaugcuuagggggcauu

SEQ ID NO: 742612 - RNA, 53 nt, Homo Sapiens; identical to SEQ ID NO: 742032

SEQ ID NO: 742613 - RNA, 63 nt, Homo Sapiens
cauagcuaggagaugucaaaaucacaucagaagccaggaaauguauaagaccucuuucagcag

SEQ ID NO: 742614 - RNA, 63 nt, Homo Sapiens
uaaguauuuuauuaauauaugccguugaugccuccaggaaacuucugaugauuuauuuaaaga

SEQ ID NO: 742615 - RNA, 63 nt, Homo Sapiens
acaauagcuguuaaggaaagaaagcaaccaaguccaggaaauucuucuuaacugcccaaguga

SEQ ID NO: 742616 - RNA, 63 nt, Homo Sapiens
cacuggaauugucacacggcgcaucugauggugccaggaaagcacccaagcuuguggcaccag

SEQ ID NO: 742617 - RNA, 63 nt, Homo Sapiens
ugcagcuagaaaauggucuuauugugcuguuuuccaggaaagccaggagccacuuaagagauu

SEQ ID NO: 742618 - RNA, 63 nt, Homo Sapiens
auuauuuuauguuaaaaugugugcuaaacuaucccaggaaaguauuuaauccaacauuguaaa

SEQ ID NO: 742619 - RNA, 63 nt, Homo Sapiens
ugccccacuucagggcugcugugagauggaauuccaggaaagaacuucaggugucuggacccu

SEQ ID NO: 742620 - RNA, 63 nt, Homo Sapiens
aagauuuuuccucuugccuuacacauggagguuccaggaaaccucuugcagaacuucacacgu

SEQ ID NO: 742621 - RNA, 63 nt, Homo Sapiens
caccccuaagcauggucccuugucaccaggcaaccaggaaacugcuacuuguggaccucacca

SEQ ID NO: 742622 - RNA, 63 nt, Homo Sapiens
uuugaggucggaaacccucuacugccccauaagccaggaaaagugaaaagagaacacaguucc

SEQ ID NO: 742623 - RNA, 63 nt, Homo Sapiens
ccccuccugcucuccaucuuauauguauucuaaccaggaaaaaugugauagcacauggguagc

SEQ ID NO: 742624 - RNA, 63 nt, Homo Sapiens
cccugagcugccagugcuggguaucccccagccccaggaaauguggggucggccaggacccuc

SEQ ID NO: 742625 - RNA, 63 nt, Homo Sapiens
agucauacacuuuaaaaaaaaaaaaaacuuuuuccaggaaaauauauugaaaucaugcugcug

SEQ ID NO: 742626 - RNA, 63 nt, Homo Sapiens
ggagccccagccuucugaggugguucuauucccccaggaaaaaucagccccuucucugggaug

SEQ ID NO: 742627 - RNA, 63 nt, Homo Sapiens
cuccagugguucuuacuugauguguucuuuuuuccaggaaaggauugugugugagacugagua

SEQ ID NO: 742628 - RNA, 63 nt, Homo Sapiens
ccaucagucccaggcagauuaaagucucuugccccaggaaacccucucccuguuuuagcacug

SEQ ID NO: 742629 - RNA, 63 nt, Homo Sapiens
aagaugccuccccagcccuguuugaggagggcaccaggaaacaguccccaaagugucagcaac

SEQ ID NO: 742630 - RNA, 63 nt, Homo Sapiens
gccucaguggccagaggaucaggucugggaggaccaggaaacaacuggcccacacgugcauag

SEQ ID NO: 742631 - RNA, 63 nt, Homo Sapiens
auucuuacggaaaaaaauuggacuuauuucuccccaggaaauggguuucugaaauauuuuaug

SEQ ID NO: 742632 - RNA, 63 nt, Homo Sapiens
uuuguacagcuuuaaguugugagaagauuucucccaggaaaucgguauaaaccucuguaugaa

SEQ ID NO: 742633 - RNA, 63 nt, Homo Sapiens
aucccguuuggccaccgugaagugcugagucuuccaggaaaaacaaagcugcaaguggauucu

SEQ ID NO: 742634 - RNA, 63 nt, Homo Sapiens
gaguugcugagggcagguccaguugcaggagacccaggaaaggagcagagauggccugccaag

SEQ ID NO: 742635 - RNA, 63 nt, Homo Sapiens
aaaaucgguguauccuaucuuggcauuauagggccaggaaaaggccagagggaccucagggug

SEQ ID NO: 742636 - RNA, 63 nt, Homo Sapiens
gcucaucccagagaaggagaagccagacugugaccaggaaacaaacaugagaugagccagccg

SEQ ID NO: 742637 - RNA, 63 nt, Homo Sapiens
uuucuauggcaauuuuguaccgucugccauucaccaggaaaaacauggaaauauuagcugccc

SEQ ID NO: 742638 - RNA, 63 nt, Homo Sapiens
aguggcagccucugggguuugccuccaagcuccccaggaaagcccugcagucacaugggugug

SEQ ID NO: 742639 - RNA, 63 nt, Homo Sapiens
cagccauaucuuacacuuugguaaagcagaaaaccaggaaaauuuucuuaaaauauccacaau

SEQ ID NO: 742640 - RNA, 63 nt, Homo Sapiens
uggccacaggcacaagggcugcagcugcuucuuccaggaaacugacacagggagcucagcggc

SEQ ID NO: 742641 - RNA, 63 nt, Homo Sapiens
accagaugcccugcuccaucacaaccuccuuccccaggaaaacccacuuuccaaaagcccaag

SEQ ID NO: 742642 - RNA, 63 nt, Homo Sapiens
gacuuuggucaguuaccugggaauucugggcugccaggaaacgauuugggccucugucaguuu

SEQ ID NO: 742643 - RNA, 54 nt, Homo Sapiens; identical to SEQ ID NO: 742063

SEQ ID NO: 742644 - RNA, 63 nt, Homo Sapiens
ucuuguuccugacuccagaggaacgagagcauuccaggaaagagagauucccuggaaaauuga

SEQ ID NO: 742645 - RNA, 63 nt, Homo Sapiens
ugguggcuacuuuuggucugaaacccacuuggcccaggaaagagaaaagguuguauguuuugu

SEQ ID NO: 742646 - RNA, 50 nt, Homo Sapiens; identical to SEQ ID NO: 742066

SEQ ID NO: 742647 - RNA, 63 nt, Homo Sapiens
uuauuuauauguuguggggacugcauaacuagcccaggaaaugacucugguuuugaguggccu

SEQ ID NO: 742648 - RNA, 63 nt, Homo Sapiens
ggagggagggcuccagacacauguccaagaagcccaggaaaggcuccaggagcagccacauuc

SEQ ID NO: 742649 - RNA, 63 nt, Homo Sapiens
ccucccuugugguuucagcacagaaccugaaugccaggaaaaauuccugggccaagaagcuaa

SEQ ID NO: 742650 - RNA, 63 nt, Homo Sapiens
ucuuuuugugcauuguccucaugccuguauucuccaggaaacuuguccuucuggaaaucauau

SEQ ID NO: 742651 - RNA, 63 nt, Homo Sapiens
cugacucagugaccagugccugugagcauggggccaggaaagucugguaauaaaugugacuca

SEQ ID NO: 742652 - RNA, 63 nt, Homo Sapiens
gaaugccacugcuugguuauugguccccuuugaccaggaaacccaagaggagacaccucaguc

SEQ ID NO: 742653 - RNA, 63 nt, Homo Sapiens
agggucuuccuguuccuagcuccauaaauucuaccaggaaaccauggagagaaagcuguagga

SEQ ID NO: 742654 - RNA, 63 nt, Homo Sapiens
ugaacagaaaccacaaguguucugggcuccaagccaggaaagguacucugcucaugagacaga

SEQ ID NO: 742655 - RNA, 63 nt, Homo Sapiens
gcauuucagauuugguuuuuagacuuuucccguccaggaaauagugaccaaaccacaugaacc

SEQ ID NO: 742656 - RNA, 63 nt, Homo Sapiens
aacaaaccccacucagaaaccuguguguacaauccaggaaaaagaacuccauuccaccugacc

SEQ ID NO: 742657 - RNA, 63 nt, Homo Sapiens
uggaaauccuagccaaggggggccgccucacagccaggaaauucgguaacaguugccgaacca

SEQ ID NO: 742658 - RNA, 61 nt, Homo Sapiens; identical to SEQ ID NO: 742078

SEQ ID NO: 742659 - RNA, 63 nt, Homo Sapiens
ccaugacaaacuggccucugccauuuaagcuccccaggaaaucaucaguucucugauccacuu

SEQ ID NO: 742660 - RNA, 63 nt, Homo Sapiens
ccgcgggguggcccaugcagguacuaggaggcaccaggaaaucgcggagggguguguggccag

SEQ ID NO: 742661 - RNA, 63 nt, Homo Sapiens
gccuccaacccuagcaaaagcucugaggggcuaccaggaaagccuuauucccgcugacugagu

SEQ ID NO: 742662 - RNA, 63 nt, Homo Sapiens
cccuuacugccaggcugagucuucagaggaaacccaggaaauggacccacuauuucuccucug

SEQ ID NO: 742663 - RNA, 63 nt, Homo Sapiens
ggauauucuaggcuuugcgugcgcagggugguaccaggaaagacucacacugugaguccagcg

SEQ ID NO: 742664 - RNA, 63 nt, Homo Sapiens
aagaccagaaggaguaaugaaguagcagaaaguccaggaaagauguucuugggaagcagauua

SEQ ID NO: 742665 - RNA, 63 nt, Homo Sapiens
ucuugcccucuugcccagcagucaagugaggguccaggaaagcgguuggcagugcccagauuc

SEQ ID NO: 742666 - RNA, 63 nt, Homo Sapiens
gaaaugaucguuucuuuugucgugccugcagggccaggaaaggucagccacgcagaaagcuca

SEQ ID NO: 742667 - RNA, 63 nt, Homo Sapiens
ccccacagcccuucaccuucgcuaucaaacaucccaggaaaggguaagaauuuagggccaccg

SEQ ID NO: 742668 - RNA, 63 nt, Homo Sapiens
guucugcucuaacauggcaugcccuuucucagcccaggaaacagcaugugguucagagaaaag

SEQ ID NO: 742669 - RNA, 63 nt, Homo Sapiens
uuggccaaccuagccaaggcugcagcauauagaccaggaaaucagguagcccagacuggugau

SEQ ID NO: 742670 - RNA, 63 nt, Homo Sapiens
acaguucacagaggucuuucagcucauuuaaucccaggaaagaggcaucaaagcuagaaugug

SEQ ID NO: 742671 - RNA, 63 nt, Homo Sapiens
gggcaagaggugccugggaggaguggcccugauccaggaaaaugugaggggaaucuggaacgc

SEQ ID NO: 742672 - RNA, 63 nt, Homo Sapiens
ugcgauucuggauaaagccacugaaaauucgaaccaggaaauggaaccccaccacuguugguc

SEQ ID NO: 742673 - RNA, 63 nt, Homo Sapiens
ugggagucauuaaagccaagucauucauagcagccaggaaacaauaggaaccaaaagccucug

SEQ ID NO: 742674 - RNA, 63 nt, Homo Sapiens
ugaacccuccaauucaggaagugggaaaaggagccaggaaaugugcuucuacuuugccaguua

SEQ ID NO: 742675 - RNA, 63 nt, Homo Sapiens
ucccccaaccagagauguuaaagugagccugucccaggaaacaucuccacccaagacgucuuu

SEQ ID NO: 742676 - RNA, 63 nt, Homo Sapiens
ugaugucaucguccaucccaucuuccuuugcccccaggaaaggacgcauccaccgguagcggc

SEQ ID NO: 742677 - RNA, 63 nt, Homo Sapiens
uguguggaggacaaagcuucuuccugcguggcuccaggaaaagauguggcucacguagguggc

SEQ ID NO: 742678 - RNA, 63 nt, Homo Sapiens
uaaagagggagcacauugacuugggaauuuccuccaggaaacucagggcuguuuucucuuccc

SEQ ID NO: 742679 - RNA, 63 nt, Homo Sapiens
cucaggaggggcucucagggacuccuggugacuccaggaaaaugcugccaucguuaaacauua

SEQ ID NO: 742680 - RNA, 63 nt, Homo Sapiens
uuugucaucguuccccaccccuucgacaugcugccaggaaacaagggaaggggccucccuccg

SEQ ID NO: 742681 - RNA, 63 nt, Homo Sapiens
accuuugggaacaaacucuuaaguaaaugaagcccaggaaaacuuuuauauuauuaggagcaa

SEQ ID NO: 742682 - RNA, 63 nt, Homo Sapiens
uguccacaguaguccccccugucucccaaucacccaggaaagcugguguucuaccagaaaaac

SEQ ID NO: 742683 - RNA, 63 nt, Homo Sapiens
cucuucuucccuggucuggcagggaggcuguagccaggaaaccccuuugcaggacuugcacac

SEQ ID NO: 742684 - RNA, 63 nt, Homo Sapiens
uuucaaaggcaagcgccaguuucuuggccucccccaggaaagauggagcuuagccugagaggg

SEQ ID NO: 742685 - RNA, 63 nt, Homo Sapiens
guagcuucuuaacuggugacugucaccccauccccaggaaacuugggauuacagcuugaguuc

SEQ ID NO: 742686 - RNA, 63 nt, Homo Sapiens
ggagggggcugauccucugauccuuccucugugccaggaaacguauauuucuaaguguaacug

SEQ ID NO: 742687 - RNA, 63 nt, Homo Sapiens
uuaauguaauauuauuuuuaguugguuauuagaccaggaaaaccuuccacuguacuucucaaa

SEQ ID NO: 742688 - RNA, 63 nt, Homo Sapiens
caguuuggaggcuugaugugaugaggaugugauccaggaaaucugagguggcuuccuaguuac

SEQ ID NO: 742689 - RNA, 63 nt, Homo Sapiens
ggguggggugggcauacacaucuguuuuggccaccaggaaaugagacaaggaagguggaaugu

SEQ ID NO: 742690 - RNA, 63 nt, Homo Sapiens
cagaagaggaaugugcaacauccguuuucaaauccaggaaaugucaaagcgccagucauuugc

SEQ ID NO: 742691 - RNA, 53 nt, Homo Sapiens; identical to SEQ ID NO: 742111

SEQ ID NO: 742692 - RNA, 63 nt, Homo Sapiens
aaaaaaaagaaauucgcaugugcagucuuucccccaggaaaaaugaauguuugugucuguggu

SEQ ID NO: 742693 - RNA, 63 nt, Homo Sapiens
ggugguagucagaggagggagcaagaugaggcaccaggaaaggccuguggguggggagcuggg

SEQ ID NO: 742694 - RNA, 63 nt, Homo Sapiens
ggugagagugauuguguuguaggugggauuuagccaggaaaggggagcuggcgggaggguggg

SEQ ID NO: 742695 - RNA, 63 nt, Homo Sapiens
ugucaucuugccaggcaccuugugagcuucagaccaggaaaugacuucagugagaggauuggc

SEQ ID NO: 742696 - RNA, 63 nt, Homo Sapiens
uuuuuuuuuuuuuucagacgaggaacuuaguugccaggaaauuacuucaccucuuggcugugg

SEQ ID NO: 742697 - RNA, 63 nt, Homo Sapiens
ugacugcugacugauugggaaaaggacauucuuccaggaaagucuccugggcagauuggguag

SEQ ID NO: 742698 - RNA, 63 nt, Homo Sapiens
acgcuugccuuccuucccggccagcgccuggcuccaggaaaacccaacacgguguccugccac

SEQ ID NO: 742699 - RNA, 63 nt, Homo Sapiens
cucuuuuuucaucucacaguaaagccuauuuccccaggaaaaaaauaaaugccuuugaaugaa

SEQ ID NO: 742700 - RNA, 63 nt, Homo Sapiens
gaacgaaugccaaaucagacuccaccuagagcaccaggaaacagcuuguacccugguagggaa

SEQ ID NO: 742701 - RNA, 63 nt, Homo Sapiens
ucacucagacugagacuugaguuauuacagaagccaggaaaaguguauuagaaacuguugucu

SEQ ID NO: 742702 - RNA, 63 nt, Homo Sapiens
cagaagugauaaaggaauccaaaguugaagagcccaggaaacgggaaacuguauccauaaugc

SEQ ID NO: 742703 - RNA, 63 nt, Homo Sapiens
cuccggccuaggugacagagggaaacuccaucuccaggaaaaaaaaaaaaaaacccaauuugg

SEQ ID NO: 742704 - RNA, 63 nt, Homo Sapiens
gagucuauaguacaaaaugcauaaaccauguccccaggaaauuugaaaggaagcaggugcuga

SEQ ID NO: 742705 - RNA, 63 nt, Homo Sapiens
ggugcgcccucgacucccgauuucauuugcuggccaggaaaaucgaaagggaaacacccucaa

SEQ ID NO: 742706 - RNA, 63 nt, Homo Sapiens
aagcagaaauguacaauuucuggucuguguuuuccaggaaauucauagagaagagaauagagu

SEQ ID NO: 742707 - RNA, 63 nt, Homo Sapiens
agaccacccggcauucucugcccacuuugccuuccaggaaaugggcuuuucaggaagugaauu

SEQ ID NO: 742708 - RNA, 52 nt, Homo Sapiens; identical to SEQ ID NO: 742128

SEQ ID NO: 742709 - RNA, 63 nt, Homo Sapiens
gaugcauugacacucuccugucuuuugaucugcccaggaaagggcuccucuuccuccggaucc

SEQ ID NO: 742710 - RNA, 63 nt, Homo Sapiens
gcagaggaggucccagauaccaaguggcgccucccaggaaaggcugggagaagagguggccug

SEQ ID NO: 742711 - RNA, 63 nt, Homo Sapiens
ggagcuaggggcccgccccgcggacugacagcaccaggaaaccaaaugaugucccugcccgcc

SEQ ID NO: 742712 - RNA, 63 nt, Homo Sapiens
ugucuuucgagguggguuuguaccuuccuuaagccaggaaagggauucauggcgucggaaaug

SEQ ID NO: 742713 - RNA, 63 nt, Homo Sapiens
cccacgaggggacauccacccucugggguguggccaggaaaagacaagcucuucagcuugggg

SEQ ID NO: 742714 - RNA, 63 nt, Homo Sapiens
acacuggaacauuccaguggacccuggaccauuccaggaaaacugggacauaggaucgucccg

SEQ ID NO: 742715 - RNA, 63 nt, Homo Sapiens
acuggaaaacugggaaauggccagcugugugucccaggaaauuccuccccuuauucuuccuug

SEQ ID NO: 742716 - RNA, 63 nt, Homo Sapiens
gcugugauggggaugugcagggacagugggaucccaggaaacagaccuccauggugggagauc

SEQ ID NO: 742717 - RNA, 63 nt, Homo Sapiens
cagugcuccccuccugcuaaagaaccaguuaccccaggaaaauucgacuccuguuuuucuuua

SEQ ID NO: 742718 - RNA, 63 nt, Homo Sapiens
aaaccuaaaaguauuaaauuccuagaagaaaacccaggaaaugccauucuggacauaagugcu

SEQ ID NO: 742719 - RNA, 63 nt, Homo Sapiens
ccucaaacagaaaauaaugaagccuucuuccucccaggaaaggggacguucagcugagccgag

SEQ ID NO: 742720 - RNA, 63 nt, Homo Sapiens
uuuucaguaucugcuuuacugguucaguaaaagccaggaaacacaacuuugugguaaucugaa

SEQ ID NO: 742721 - RNA, 63 nt, Homo Sapiens
uuucauuuuguuaauuuuucccaguguuuacaaccaggaaauagcuugucaucuuugauacaa

SEQ ID NO: 742722 - RNA, 63 nt, Homo Sapiens
cggagacaaucuuuucagccuuuccccuggcuaccaggaaacuccaacguaccaauuuccccu

SEQ ID NO: 742723 - RNA, 63 nt, Homo Sapiens
auuguaguuuuaguagagacugcgccaccacgcccaggaaauuaguagcugggauuacaggug

SEQ ID NO: 742724 - RNA, 63 nt, Homo Sapiens
agccggagagccggacagcaccuaaaacagccaccaggaaagccaggugccacccaccuuggc

SEQ ID NO: 742725 - RNA, 63 nt, Homo Sapiens
gauaacucagaagcaucugggaagguaugaauaccaggaaacaauacaaugugagagacugca

SEQ ID NO: 742726 - RNA, 63 nt, Homo Sapiens
ccagaccugccccuccaaacgcccuaugcugacccaggaaaggaccugugcccccaccugggu

SEQ ID NO: 742727 - RNA, 63 nt, Homo Sapiens
auuuauacuugagaaaaauuucacaccuuauugccaggaaagcgcaaaauuuuuaaugaauac

SEQ ID NO: 742728 - RNA, 63 nt, Homo Sapiens
agcauuucugauacuuucuguauauuccuuuucccaggaaagaaaaugugucuugcugucauu

SEQ ID NO: 742729 - RNA, 63 nt, Homo Sapiens
ccacacaggaauucccaucccuauucacaggcaccaggaaaccgcucccagacaccucaagcc

SEQ ID NO: 742730 - RNA, 63 nt, Homo Sapiens
caaucaugagguccuugugccaaucccaaguccccaggaaaccgaaucccaaauuugaaaauc

SEQ ID NO: 742731 - RNA, 63 nt, Homo Sapiens
caagguggaggcugaggugggccgcuccuccccccaggaaagcaggcagcccggcuggccgcc

SEQ ID NO: 742732 - RNA, 63 nt, Homo Sapiens
cagauuccagccugagugcuaggcuacuucgaaccaggaaagccuugcuagggguccugaacc

SEQ ID NO: 742733 - RNA, 63 nt, Homo Sapiens
aucugaauaaagaggacccuccacccggggucaccaggaaaggaaagugaaugggccuguggc

SEQ ID NO: 742734 - RNA, 63 nt, Homo Sapiens
agagagagagaaaguaaagguuaaguacaugugccaggaaacaugagguuauguccuuuucca

SEQ ID NO: 742735 - RNA, 52 nt, Homo Sapiens; identical to SEQ ID NO: 742155

SEQ ID NO: 742736 - RNA, 63 nt, Homo Sapiens
cgaggcaccuuggccgcgggcugcuccaggaguccaggaaagaacuacauuucccaagaggcu

SEQ ID NO: 742737 - RNA, 59 nt, Homo Sapiens; identical to SEQ ID NO: 742157

SEQ ID NO: 742738 - RNA, 63 nt, Homo Sapiens
cugaucgccaguuucuaacgagcagugcggaggccaggaaaccaaacaccagcucagcauggc

SEQ ID NO: 742739 - RNA, 63 nt, Homo Sapiens
auccaaagagcugauucuaccaauccaauuucaccaggaaaauuccaucagggauuggaugac

SEQ ID NO: 742740 - RNA, 63 nt, Homo Sapiens
ccuggagaauccacauaccuuguguauugaaccccaggaaaaggaagaggucgaaccaacccu

SEQ ID NO: 742741 - RNA, 63 nt, Homo Sapiens
caaucugcuuuuuuucuaaaaucugauuugcagccaggaaagaauuuucucacccaaggaaca

SEQ ID NO: 742742 - RNA, 63 nt, Homo Sapiens
ugguucauucucaggcugggguggacucagaugccaggaaagggacagccucccauugucagg

SEQ ID NO: 742743 - RNA, 63 nt, Homo Sapiens
acucccuccagugaggagcugggaggagacaucccaggaaaagaauuugauacuccucuguga

SEQ ID NO: 742744 - RNA, 63 nt, Homo Sapiens
cugucuccagugccuguuaagcugaggauacaaccaggaaaugcaacggugucagauuguguu

SEQ ID NO: 742745 - RNA, 63 nt, Homo Sapiens
aucuuuucuucugcuacuuuggggaguugauggccaggaaagaagccagcacaggguuaaagu

SEQ ID NO: 742746 - RNA, 63 nt, Homo Sapiens
ccccagcccuaugguuuuuuuauuucauguaccccaggaaauacugugugguuucuaaaagcc

SEQ ID NO: 742747 - RNA, 63 nt, Homo Sapiens
ucgucggaggcaucauggaaagacugggacagcccaggaaacaaggggucugaggaugcauuc

SEQ ID NO: 742748 - RNA, 63 nt, Homo Sapiens
aagugccaccgugcggggccuggcucugcacacccaggaaaagucugcagacccccagcccuc

SEQ ID NO: 742749 - RNA, 63 nt, Homo Sapiens
gcccuguccaccaggauaagugacaccuaggacccaggaaauaaaugccgaugauuuguguga

SEQ ID NO: 742750 - RNA, 63 nt, Homo Sapiens
uagccuugacuccuugagacuguagauuucgauccaggaaacauuuauuuagcaccugccaga

SEQ ID NO: 742751 - RNA, 63 nt, Homo Sapiens
auuuucucagucauccuggcagccaaaaaugugccaggaaaagaaagaauguggagcacgcgu

SEQ ID NO: 742752 - RNA, 63 nt, Homo Sapiens
aguuacacauuuuaagagaaaaauuuugcucuaccaggaaaacgcaacugggccccuuucaag

SEQ ID NO: 742753 - RNA, 63 nt, Homo Sapiens
agucuccauagucaaucagaugcaaccugaaacccaggaaagccaagauugcaaaaaugacug

SEQ ID NO: 742754 - RNA, 63 nt, Homo Sapiens
aagugauguccccuuucccugaccaaugagggaccaggaaaaagagccauggcauaugacaaa

SEQ ID NO: 742755 - RNA, 63 nt, Homo Sapiens
gugcuuuccgaugagacucaaugggacugagucccaggaaacauccagggagacagacucuga

SEQ ID NO: 742756 - RNA, 63 nt, Homo Sapiens
ucucuauuccguagccugagggaggccgucccaccaggaaauccucaucuccagcuagccuug

SEQ ID NO: 742757 - RNA, 63 nt, Homo Sapiens
acggaauccaggcaaucugucagcuguagaaccccaggaaagaccccaaggugagggcuuagg

SEQ ID NO: 742758 - RNA, 63 nt, Homo Sapiens
ucuccaccuguguuuauggcaguaaugagaagcccaggaaauuguuuggggaagaugcaagga

SEQ ID NO: 742759 - RNA, 63 nt, Homo Sapiens
uccggagccaacaccaccaccauuuuccuuuacccaggaaaucccagugcccaggaauuugaa

SEQ ID NO: 742760 - RNA, 63 nt, Homo Sapiens
cagucucaucuaauuucuuacauucccagcuccccaggaaagcucagauauauuuuaguaaca

SEQ ID NO: 742761 - RNA, 63 nt, Homo Sapiens
ggggaaggaacuagaaccacgccggucucucugccaggaaaugcuuccucccuuccuuucaca

SEQ ID NO: 742762 - RNA, 63 nt, Homo Sapiens
cugccugcagaggacaggugagcaacagcuggcccaggaaaggaucagcuggauccccacgug

SEQ ID NO: 742763 - RNA, 63 nt, Homo Sapiens
aagaaacaacaaaggcaggaaaaaacccagacgccaggaaaagaccacccaccccauugggag

SEQ ID NO: 742764 - RNA, 63 nt, Homo Sapiens
guccacgggcaggagaagguggauauuucagcuccaggaaagagagcuaauucacucucucuu

SEQ ID NO: 742765 - RNA, 63 nt, Homo Sapiens
aaucaaauuccagaaugauuuuacggagauaucccaggaaaauuaaggcuucucuuaaacacu

SEQ ID NO: 742766 - RNA, 63 nt, Homo Sapiens
auuucugccuccaggaugccacugccucugcuuccaggaaaggcaagggggagggugcuuauc

SEQ ID NO: 742767 - RNA, 63 nt, Homo Sapiens
gggaagcccauccugaccagcugcuccgaggacccaggaaaggcaggauugaaaauguccagg

SEQ ID NO: 742768 - RNA, 63 nt, Homo Sapiens
ccgaggacccaggaaaggcaggauugaaaauguccaggaaaguggccaagaagcaguggccuu

SEQ ID NO: 742769 - RNA, 62 nt, Homo Sapiens; identical to SEQ ID NO: 742189

SEQ ID NO: 742770 - RNA, 63 nt, Homo Sapiens
uggagacuggggcgugugccacauugccagccaccaggaaagcuuuucuuuuucuuuuuuuuu

SEQ ID NO: 742771 - RNA, 63 nt, Homo Sapiens
agaugucuugcuguuuucagucauuucagugggccaggaaaauuaacugaucacuauauuaca

SEQ ID NO: 742772 - RNA, 63 nt, Homo Sapiens
augcgaaguucuccaaaccccucggagucaaucccaggaaaauaacaaugccuccaauuccag

SEQ ID NO: 742773 - RNA, 63 nt, Homo Sapiens
guuuggaaaacguaucaccuaucuuuugggaagccaggaaagcuuacaccguuguuguuuuac

SEQ ID NO: 742774 - RNA, 63 nt, Homo Sapiens
cuuuuuugaagugugaauuacuuagaaauacuuccaggaaaugauauauuacaaaccaucaca

SEQ ID NO: 742775 - RNA, 63 nt, Homo Sapiens
aggaccggccggacgaugccccuccaccucgagccaggaaaugguggaagggggaccugaggg

SEQ ID NO: 742776 - RNA, 63 nt, Homo Sapiens
cugcugggcccagaggugacauuugacuuuuuuccaggaaaaauguaagugugaggaaacccu

SEQ ID NO: 742777 - RNA, 63 nt, Homo Sapiens
cuggcccguccugggaaggggggugucuagagcccaggaaacuucuucuuccguggcuuuugg

SEQ ID NO: 742778 - RNA, 63 nt, Homo Sapiens
agaggaggcuugaaggaaccagcaaugagaaggccaggaaaagaaagagcugaaaauggagaa

SEQ ID NO: 742779 - RNA, 63 nt, Homo Sapiens
gcaaaaaccuucagcucucagaggagauugggaccaggaaaaccugggaggaugggcagacuu

SEQ ID NO: 742780 - RNA, 63 nt, Homo Sapiens
gcaggugccucgauucccugcccuugugaccucccaggaaacagaacugaucugggacacuau

SEQ ID NO: 742781 - RNA, 63 nt, Homo Sapiens
gcucccuccuccccaucaagcacaagagagggcccaggaaaaaagguuucacauaaguguaga

SEQ ID NO: 742782 - RNA, 63 nt, Homo Sapiens
ugauguacccugugccauucaaggagaugugguccaggaaagugagccucaugguuuucagag

SEQ ID NO: 742783 - RNA, 63 nt, Homo Sapiens
ccugccuguggucagggccaaguguucccuccuccaggaaagccuuuacccuccucaugcccu

SEQ ID NO: 742784 - RNA, 63 nt, Homo Sapiens
cucacuucccuccacccucagcagcuaacaaggccaggaaauauuuaagggugcaggaggaca

SEQ ID NO: 742785 - RNA, 63 nt, Homo Sapiens
aucagaagaacucuuuaaaaaguugaauuaaacccaggaaaauauaaaugccaagagggagaa

SEQ ID NO: 742786 - RNA, 63 nt, Homo Sapiens
uugugcuggaauugcugauguucugccuaccauccaggaaaacugaacccuuggguagcuuga

SEQ ID NO: 742787 - RNA, 63 nt, Homo Sapiens
uuuaggggcaggagacagacaaagggaugggagccaggaaagaucugcccagaggggcugggg

SEQ ID NO: 742788 - RNA, 63 nt, Homo Sapiens
gaagugaaauugucuuuauugggguuauucgucccaggaaauaaaagggaagucaggguucua

SEQ ID NO: 742789 - RNA, 63 nt, Homo Sapiens
aaagagcugaaaaugcagaaagcaaugagaaggccaggaaaagaggggaggugugcaggaacc

SEQ ID NO: 742790 - RNA, 63 nt, Homo Sapiens
aaagagcugaaaauggagaaagcaaugagaagaccaggaaaaggagggaggcacguaggaaca

SEQ ID NO: 742791 - RNA, 63 nt, Homo Sapiens
aaagagcugaaaauggagaaagcaaugagaaggccaggaaaagagggggagcuugcaggaacc

SEQ ID NO: 742792 - RNA, 63 nt, Homo Sapiens
aaucagagacaauucacagacgaggcaggggcuccaggaaaggagacgcaucccaggagguga

SEQ ID NO: 742793 - RNA, 63 nt, Homo Sapiens
ugggacugugucucauguuugugugaauguagaccaggaaagggggcugcaaaaauguugagu

SEQ ID NO: 742794 - RNA, 63 nt, Homo Sapiens
gcucuuggguauguagaacuguaugggaagaagccaggaaaaccucugaguguugaaggggca

SEQ ID NO: 742795 - RNA, 63 nt, Homo Sapiens
ucagggaagccuugaaaaccacggagguggaugccaggaaagggcccauguggcagaaggcaa

SEQ ID NO: 742796 - RNA, 63 nt, Homo Sapiens
cuuugugcagccugaaggaucaguguaguaaugccaggaaagugcuuuuuaccuaagacuucc

SEQ ID NO: 742797 - RNA, 63 nt, Homo Sapiens
ucaugacaggucuauauuucuaccugggccaggccaggaaagagacuauuuaagaaaaaaaaa

SEQ ID NO: 742798 - RNA, 63 nt, Homo Sapiens
auauuauaaguaugcugauggaaaucuauauugccaggaaaagcuauucauuaugcguuguga

SEQ ID NO: 742799 - RNA, 63 nt, Homo Sapiens
gcaccagucaucagcuauucaguugguaagcuuccaggaaaaaggacaggcagaaagaguuug

SEQ ID NO: 742800 - RNA, 63 nt, Homo Sapiens
acgaauacuagcaucaguggggaagaaaccuccccaggaaauuggaauuaaagugaaaaauca

SEQ ID NO: 742801 - RNA, 63 nt, Homo Sapiens
cucacagacauuaccaaagaggagcuugugaauccaggaaaagcuccagggggcuagcugauc

SEQ ID NO: 742802 - RNA, 63 nt, Homo Sapiens
aaucaccgacacacuacuagaugccaguuaaugccaggaaaaaccaacaugccaaaaaugcuc

SEQ ID NO: 742803 - RNA, 63 nt, Homo Sapiens
uuugaacagagcaaaggcuucugcaccuucagcccaggaaagagcuguccaguuagcugugcc

SEQ ID NO: 742804 - RNA, 63 nt, Homo Sapiens
cucuucucauucaaagaggagcaaauagcaaguccaggaaaaauuuucccacaugaaccucca

SEQ ID NO: 742805 - RNA, 63 nt, Homo Sapiens
agaaacuuccucccaccccaaguggggaaguagccaggaaauguuucaugaaaugguccacau

SEQ ID NO: 742806 - RNA, 63 nt, Homo Sapiens
cuggaagccuucccccagcaggaccuccccagcccaggaaaaaugaaggaaggggcuauccug

SEQ ID NO: 742807 - RNA, 63 nt, Homo Sapiens
aggaccagucaggaugaggcgggacuuucccacccaggaaaggucaggccucaccccuccccu

SEQ ID NO: 742808 - RNA, 63 nt, Homo Sapiens
uacaaagcaaguugugugggugcagggaauuuaccaggaaaucaaaauucaauggccuucuac

SEQ ID NO: 742809 - RNA, 63 nt, Homo Sapiens
gucugacuaauguggaaccucuaagaguaccucccaggaaacaaggauaugacagcuuaccag

SEQ ID NO: 742810 - RNA, 63 nt, Homo Sapiens
cucugguuacaccuggaagaagcuggaaucgcuccaggaaaaagaaggcaccaaaaggaaaca

SEQ ID NO: 742811 - RNA, 63 nt, Homo Sapiens
gagacacagagguaaaguaacucauucuucaggccaggaaaccuacuccucuacuccaaauuu

SEQ ID NO: 742812 - RNA, 63 nt, Homo Sapiens
gugaucaagugaaaaagcuguaaagccucauauccaggaaaaauaggaggagguuuugaagaa

SEQ ID NO: 742813 - RNA, 63 nt, Homo Sapiens
uuuugauauuuuguguuuguaaaaaagucuaacccaggaaagcuuugccuauuccaaagagcu

SEQ ID NO: 742814 - RNA, 63 nt, Homo Sapiens
auuaagccccaauagcuacauugguaagaaucaccaggaaaccugggccauguuuauugugga

SEQ ID NO: 742815 - RNA, 63 nt, Homo Sapiens
gauuuuggaaaaagugaaauuguuuguguggugccaggaaauugauacauuuaccaguguucu

SEQ ID NO: 742816 - RNA, 63 nt, Homo Sapiens
accuaugaauuccauucuuagcagacacaaugaccaggaaaaaguguguuucccugugagcua

SEQ ID NO: 742817 - RNA, 63 nt, Homo Sapiens
auaccuacagacaggacaacaggaagcuaagucccaggaaaacauguuaaaggccugggguuu

SEQ ID NO: 742818 - RNA, 63 nt, Homo Sapiens
ggcugcuaugggggauggcaccucucagcccucccaggaaacacacagagcucugggcccauc

SEQ ID NO: 742819 - RNA, 65 nt, Homo Sapiens
ccugcauuaacccagaaauaccucgcuucuaucugugcacuuagcugggaacuuacccacuguaa

SEQ ID NO: 742820 - RNA, 65 nt, Homo Sapiens
agcguccuggcuccaguuggaacacuuuccugagaugcacuuacuucucagcuucugcgaucaga

SEQ ID NO: 742821 - RNA, 65 nt, Homo Sapiens
gcaagggcccaaaugcauaaguuucuuugcacuguugcacuuacuuaauacaaauaaauguuuuu

SEQ ID NO: 742822 - RNA, 65 nt, Homo Sapiens
uacuacuguucaguuuuuuaaaaguuuugaaaugcugcacuuacauuuaaaaaaacaacaacaac

SEQ ID NO: 742823 - RNA, 65 nt, Homo Sapiens
cucaccauuucccccugcucccccacagccgguucugcacuuaucaccgagucgccccuggaagc

SEQ ID NO: 742824 - RNA, 65 nt, Homo Sapiens
cuugaccaagaaauuggguuucuuuucccucagccugcacuuacucuucuauuaagaccagaaaa

SEQ ID NO: 742825 - RNA, 65 nt, Homo Sapiens
ucauccuucuucucuguguuuucugguuuaaaagcugcacuuauauuuuagccuuauuauuuucu

SEQ ID NO: 742826 - RNA, 65 nt, Homo Sapiens
caaugaaaugaugucauaagcgaucacuuccuauaugcacuuauucucaagaagaacaucuuuau

SEQ ID NO: 742827 - RNA, 65 nt, Homo Sapiens
uugaaaauuguuuuauuucaggcauguucccuuugugcacuuagguucauugugccucaguuccu

SEQ ID NO: 742828 - RNA, 65 nt, Homo Sapiens
caucucuguaaaauaauuggaaugaaaauacuucuugcacuuaaacacugcacaugccguacuuu

SEQ ID NO: 742829 - RNA, 65 nt, Homo Sapiens
cuuuucuuuagugggggaggguaagaaaagcaguuugcacuuaaaaagaaaaaaaaaaaacgggu

SEQ ID NO: 742830 - RNA, 65 nt, Homo Sapiens
caaaagcauuuugcacaguguuuguuuuccugucuugcacuuacaaauaaggucuaugggaguag

SEQ ID NO: 742831 - RNA, 65 nt, Homo Sapiens
ucccuugugcuggccagaugugucacuuagcagauugcacuuaagcaggaagacagucuuagcac

SEQ ID NO: 742832 - RNA, 65 nt, Homo Sapiens
ccucaugguucuaguaaacgugcuagaaugcuaauugcacuuaggcucugaggggcuguccaguc

SEQ ID NO: 742833 - RNA, 65 nt, Homo Sapiens
uuuuuggggggugggaaugucuuagaaguugauuuugcacuuauugacuuguuugagcucuugag

SEQ ID NO: 742834 - RNA, 65 nt, Homo Sapiens
ggucuguuucucagcaucaugugaugcaguguggcugcacuuaagugugaggcugacacgucugu

SEQ ID NO: 742835 - RNA, 65 nt, Homo Sapiens
gcauggucagaccacgucacugaguaauugcuguuugcacuuacuugccaguauucuaagacauu

SEQ ID NO: 742836 - RNA, 65 nt, Homo Sapiens
ccuguuucuaaauuauauauguuguacaaagaaaaugcacuuaaaguuuuuacaugugauaguca

SEQ ID NO: 742837 - RNA, 65 nt, Homo Sapiens
cccaccaccuggggacccccugguggguuugaaucugcacuuaucggguucagccagucagugac

SEQ ID NO: 742838 - RNA, 65 nt, Homo Sapiens
cggaggagggcgcaggguggggcagaaguuuugaaugcacuuaacacaugacuaggaguguuagg

SEQ ID NO: 742839 - RNA, 65 nt, Homo Sapiens
guccccuuuuuaguuuuuuuuuuucuuuuuuaucuugcacuuauucuaauuucauacuauuuaga

SEQ ID NO: 742840 - RNA, 65 nt, Homo Sapiens
guugcuuucaguaacauuuuguugauuucauuccaugcacuuagaccguagcagcuuagauuaac

SEQ ID NO: 742841 - RNA, 65 nt, Homo Sapiens
uuuuggagcaaauugacaugcaaaucaacacuuucugcacuuauccccuccuugggcucuucccg

SEQ ID NO: 742842 - RNA, 65 nt, Homo Sapiens
ggcuguugagggccacuuuucuugcuaaagcacuuugcacuuaaugagugcaggugacagcagga

SEQ ID NO: 742843 - RNA, 65 nt, Homo Sapiens
ucauagauuuaaguaaacagauguauuuugcacagugcacuuaugucuauuuuaacaauccuccu

SEQ ID NO: 742844 - RNA, 65 nt, Homo Sapiens
caaucacgucuuuuguuaugcuaguaucagucagaugcacuuagagugaagaaacacuguaauua

SEQ ID NO: 742845 - RNA, 65 nt, Homo Sapiens
ggaaaacaguucuuguggccuucuauuaaauaguuugcacuuaagccuugccaguguucugagcu

SEQ ID NO: 742846 - RNA, 65 nt, Homo Sapiens
uuucuuacugccaucauuauuuguuaaagauauuuugcacuuaauuuugugggaaaaauauugcu

SEQ ID NO: 742847 - RNA, 65 nt, Homo Sapiens
cacacgguucuaauuaagugugaagguauagcuauugcacuuaugccaucuccaaaauuucuuaa

SEQ ID NO: 742848 - RNA, 65 nt, Homo Sapiens
caccccacccaucacauggcuggcuggcugcugggugcacuuacccuccuuggcuugguuacuuc

SEQ ID NO: 742849 - RNA, 65 nt, Homo Sapiens
ucugcacaggccucagcuuugaagaacggagucuuugcacuuacacacacucuuccuguucugcc

SEQ ID NO: 742850 - RNA, 65 nt, Homo Sapiens
uguuugcagcggaucacuggacaucaaagauucauugcacuuaugaacaaggaaccuucuuuuca

SEQ ID NO: 742851 - RNA, 65 nt, Homo Sapiens
aaagggagaauuuuagacuuaauuuuuaacucuauugcacuuaaagauuuuaguuagguuaccac

SEQ ID NO: 742852 - RNA, 65 nt, Homo Sapiens
guuacaucuaaauuacaacccuuaauugccacgugugcacuuacuacucuccaguaugucuuauu

SEQ ID NO: 742853 - RNA, 65 nt, Homo Sapiens
aauacaaauuuaguuuaaguguuugaacaacuauaugcacuuacgguuguguguuuaaaaugucu

SEQ ID NO: 742854 - RNA, 65 nt, Homo Sapiens
acguaaaaagauauuucuaauuuacuguugcccauugcacuuacauaccaccaccaagaaagccu

SEQ ID NO: 742855 - RNA, 65 nt, Homo Sapiens
uuguuuaaaauuuuugugcaauucauauauuaaauugcacuuacuugcauacgcucauauucuag

SEQ ID NO: 742856 - RNA, 65 nt, Homo Sapiens
uuguccuauauauccguacgugccagucgacuauuugcacuuaccgggucauuguccccacaaug

SEQ ID NO: 742857 - RNA, 65 nt, Homo Sapiens
ugcuuauuugacaacguuucccagcccagggcuccugcacuuacugcugcagaggccagaggccc

SEQ ID NO: 742858 - RNA, 65 nt, Homo Sapiens
aaaucauguaaauaugucacaauuugugacaaguuugcacuuacaaagucaagcaagacuuugug

SEQ ID NO: 742859 - RNA, 65 nt, Homo Sapiens
acacccuucaacaaaaucuagcauauggauaaaguugcacuuauagaaaaugccuuaaaaggaau

SEQ ID NO: 742860 - RNA, 65 nt, Homo Sapiens
uaugccaaaaaaaguuugaaacagguuaucaaguuugcacuuaacaauggagaguugugacaagu

SEQ ID NO: 742861 - RNA, 65 nt, Homo Sapiens
ugaaaaccuuuucagugaugaaaguccuugguguuugcacuuaaaaggccugauggagugagaag

SEQ ID NO: 742862 - RNA, 65 nt, Homo Sapiens
aguuuuuacaaaacugcuuuauuauuuauuacuugugcacuuaguguuuauacacaacuuugcaa

SEQ ID NO: 742863 - RNA, 65 nt, Homo Sapiens
gugauuguacauauuguacacugcuuugcacagcuugcacuuacaaugaauuaguguucuagacu

SEQ ID NO: 742864 - RNA, 65 nt, Homo Sapiens
uaucaaucauuuuccuuuuuucuagguagucagucugcacuuaaauuaagucuuuuuuuuuuuug

SEQ ID NO: 742865 - RNA, 65 nt, Homo Sapiens
ggaaguuacaucaggcaaguugccuucauuauccuugcacuuaacauuauaaucacaggagacuc

SEQ ID NO: 742866 - RNA, 65 nt, Homo Sapiens
cuguaauuuuauuuguucuucucagaaauguaguuugcacuuaagguaugucuaccuggcagaua

SEQ ID NO: 742867 - RNA, 65 nt, Homo Sapiens
aucccaccuuuccucaaaugcacaugaagaaauacugcacuuacacccuaugaaguaaagaacug

SEQ ID NO: 742868 - RNA, 65 nt, Homo Sapiens
auuggcuugcuucaguuguugguagugccauaaucugcacuuagcaaagagaucuguuauuuuca

SEQ ID NO: 742869 - RNA, 65 nt, Homo Sapiens
caucuucuagccuuaugacccuguauucuaccacuugcacuuacuaagcauacaauuugagcaug

SEQ ID NO: 742870 - RNA, 65 nt, Homo Sapiens
aauaauugagaagaaaaacuagugcuuuguuuccgugcacuuaaaaugagcgugacacucauuuu

SEQ ID NO: 742871 - RNA, 65 nt, Homo Sapiens
caucaggguaauuguauugagaacucaaauauacgugcacuuacaugugugguucguacucaagu

SEQ ID NO: 742872 - RNA, 65 nt, Homo Sapiens
cucuuauaaauggagcacuuagaaauuuguuguucugcacuuaaccuagagagagaaaaaaugcu

SEQ ID NO: 742873 - RNA, 65 nt, Homo Sapiens
auuacaauuaaaaccucauuuuuuuuuuccauuuuugcacuuaacagugaugaauacuuuuacgu

SEQ ID NO: 742874 - RNA, 65 nt, Homo Sapiens
aauaauuucuuaauuuaaaaugauagcacuucucuugcacuuaagaauggcauccauaagauucu

SEQ ID NO: 742875 - RNA, 65 nt, Homo Sapiens
ucugugauuccacuggcggaggauucuuggaagcuugcacuuaguuuccccugacuucaccccau

SEQ ID NO: 742876 - RNA, 65 nt, Homo Sapiens
caaauuagaagcggauuuggaaaugcaaacuaacgugcacuuagauauccaagugggugagcuua

SEQ ID NO: 742877 - RNA, 65 nt, Homo Sapiens
uauuuaauuaaaaaggcaaaaccugaaccaccuucugcacuuaaagaagucuaacaguacaaaua

SEQ ID NO: 742878 - RNA, 65 nt, Homo Sapiens
uguauccagccuucacuccagcugguuaaaaauguugcacuuaucagcaacccuaccacuuucau

SEQ ID NO: 742879 - RNA, 65 nt, Homo Sapiens
guuauucaagaaaaugaacaugcucuucaaaaagaugcacuuaguauuaaguugaaacuugaaca

SEQ ID NO: 742880 - RNA, 65 nt, Homo Sapiens
uggcucuauaaauuaaguuugugcuuuccuugaaaugcacuuauucuuauuacaagcauuuuaua

SEQ ID NO: 742881 - RNA, 65 nt, Homo Sapiens
guuuaaaauguaauuuaaaugaaagaaaauugaguugcacuuauugaccauuuuuuaauuuacuu

SEQ ID NO: 742882 - RNA, 65 nt, Homo Sapiens
aaaaguggacagcuucugccucagcaacgaacaccugcacuuagaggaggaggagcacaagaucc

SEQ ID NO: 742883 - RNA, 65 nt, Homo Sapiens
ugacucauguguccucuuagguugucugaguuaaaugcacuuaugguauuucauuaggaucuaaa

SEQ ID NO: 742884 - RNA, 65 nt, Homo Sapiens
cguaugucuugcaugcuuagaacauuucacucaguugcacuuaguugauuaaaauuuaaaaaaaa

SEQ ID NO: 742885 - RNA, 65 nt, Homo Sapiens
agaaccacccacaccucucuaccuguugguuauugugcacuuaaaagaauuuuuccaggagggag

SEQ ID NO: 742886 - RNA, 65 nt, Homo Sapiens
acuuugguuccacaucuguccagaugcuugaaauaugcacuuagcggcuuuaaacauauucagaa

SEQ ID NO: 742887 - RNA, 65 nt, Homo Sapiens
acccuuaugcgcuaauuuuguguguuuacuucccaugcacuuaauaauuuuaaguguaacauaac

SEQ ID NO: 742888 - RNA, 65 nt, Homo Sapiens
gcaacacagucugcugcuauauagugggggaagcgugcacuuauuucuaaacauggguuuuuaac

SEQ ID NO: 742889 - RNA, 65 nt, Homo Sapiens
ugcuuucauugucuucaucuuccugccauacuuugugcacuuauugcucuccuucugagucagga

SEQ ID NO: 742890 - RNA, 65 nt, Homo Sapiens
cuugcagccagucacuguguaaagccucucugaugugcacuuaagaguggguugcuuucucacaa

SEQ ID NO: 742891 - RNA, 65 nt, Homo Sapiens
ggaaggcaucagucccuauguauuugcaguucaccugcacuuaaggcacucuguuauuuagacuc

SEQ ID NO: 742892 - RNA, 65 nt, Homo Sapiens
agcagaaugaaaccacauuuuuugguuugauaauaugcacuuauugacucccacucauuguuaug

SEQ ID NO: 742893 - RNA, 65 nt, Homo Sapiens
uguugcaauuuagcuugcuuucaagcuucaccccuugcacuuaacauaagcuauuuuuggcauug

SEQ ID NO: 742894 - RNA, 65 nt, Homo Sapiens
auuuaauaauguauauucuuucaugcuuuuuucugugcacuuaccuaagugugaauauguaaagg

SEQ ID NO: 742895 - RNA, 65 nt, Homo Sapiens
auuaguagguucuguuacaguuuuucuuuugaucgugcacuuauagucuucauuuaauuccucau

SEQ ID NO: 742896 - RNA, 65 nt, Homo Sapiens
uuguauuuguggaaauugguauuaucucuguuuuaugcacuuacauuuaucccuuacauuuuguu

SEQ ID NO: 742897 - RNA, 65 nt, Homo Sapiens
aaaauaauuuguuuuugcaagccuauggcuuguuuugcacuuaauccagagcuaauauauuuauu

SEQ ID NO: 742898 - RNA, 65 nt, Homo Sapiens
uauuuugaccacaagggggauugacauuucacagaugcacuuacaaaaacaccggcauaagaaau

SEQ ID NO: 742899 - RNA, 65 nt, Homo Sapiens
gcaauuuucaaauguacucauaugcugucuagucaugcacuuaaauacauaugcaaucacucguu

SEQ ID NO: 742900 - RNA, 65 nt, Homo Sapiens
uuucaguaguagucuugacuaguucuugauagaacugcacuuaauuacgcgugcaguucauuucu

SEQ ID NO: 742901 - RNA, 65 nt, Homo Sapiens
uuuuguauaauuuguguuucauuuuuauuuuugauugcacuuaaauaaccguuuauuuaacauau

SEQ ID NO: 742902 - RNA, 65 nt, Homo Sapiens
ggaugccucauagacgaugaagcccuggccacagcugcacuuacaaggaauugauugcauaugca

SEQ ID NO: 742903 - RNA, 65 nt, Homo Sapiens
ccauuguuuaaauuuacaaccguuuuacaauacauugcacuuaaugauacaauuauugaaugaag

SEQ ID NO: 742904 - RNA, 65 nt, Homo Sapiens
cuuaggaagugacuugaauguacaaagauacuugaugcacuuauuuuuuaaugugagacagcaag

SEQ ID NO: 742905 - RNA, 65 nt, Homo Sapiens
uuuacuguguuauuuaaaugcuaagccaaaguaucugcacuuagguauaccucuuuaugccaaua

SEQ ID NO: 742906 - RNA, 65 nt, Homo Sapiens
cacaaaaagacaaaugauuguaggauccauggaagugcacuuaggcuugcugugguggaggccau

SEQ ID NO: 742907 - RNA, 65 nt, Homo Sapiens
ggguggagaguggcaggaagcaagcauguuugcugugcacuuaggaaaggcuggugagccagagg

SEQ ID NO: 742908 - RNA, 65 nt, Homo Sapiens
aaagcuaaauuugucccuuuuuuauuguuauuaauugcacuuaacauuuuuaguuauacuggaua

SEQ ID NO: 742909 - RNA, 65 nt, Homo Sapiens
aaaauuguguucuuaaaauauuguguaagaaucacugcacuuagcuguuggaauguuguuaaaug

SEQ ID NO: 742910 - RNA, 65 nt, Homo Sapiens
auguaaaaauuggguaaauuuacuacugaggggagugcacuuauuuauuuaacuuacuuaucugg

SEQ ID NO: 742911 - RNA, 65 nt, Homo Sapiens
ccagcucugcccuugggggggaacagaagagcuggugcacuuaaugcaagaucuggggcugcaga

SEQ ID NO: 742912 - RNA, 65 nt, Homo Sapiens
cguacucaagggagcgcgccgugccuggugaauucugcacuuacaggggccguggggucucaggg

SEQ ID NO: 742913 - RNA, 65 nt, Homo Sapiens
cacacuuugcuuguauuuuaaaaggaggauauauuugcacuuauguauacuuuuacaguuugcca

SEQ ID NO: 742914 - RNA, 65 nt, Homo Sapiens
cugauuaaauaauacauuuauaaucuacaacuguuugcacuuacagcuuuuuuuguaaauauaaa

SEQ ID NO: 742915 - RNA, 65 nt, Homo Sapiens
acccccaugauguaaguuuaccuauguaacaaaccugcacuuauacccaugaacuuaaaaugaaa

SEQ ID NO: 742916 - RNA, 65 nt, Homo Sapiens
gggcaaagccuaguagagaaccagugcaccucaggugcacuuacauaugguggggcugaggcaaa

SEQ ID NO: 742917 - RNA, 65 nt, Homo Sapiens
ucaucaaacaaaaaauaaaucucgaagaaaaaaaaugcacuuacaugugcuuauuuggcuuuucu

SEQ ID NO: 742918 - RNA, 65 nt, Homo Sapiens
auguggcacuucaaaaggcagcaccacugggcgccugcacuuauuugaaaauggaacuuugggag

SEQ ID NO: 742919 - RNA, 65 nt, Homo Sapiens
ugcaauuuucucuuggugcuaccugauggaauuccugcacuuaaaguucuggcugacuaaacaag

SEQ ID NO: 742920 - RNA, 65 nt, Homo Sapiens
ucugggagggcaaaaaaaaaaaaaaaguuuuuaugugcacuuaaauuuggggacaauuuuaugua

SEQ ID NO: 742921 - RNA, 65 nt, Homo Sapiens
cggaaggcuucugacgcuuguggccagacugcaauugcacuuauguguuaugcuacuaauauuug

SEQ ID NO: 742922 - RNA, 54 nt, Homo Sapiens; identical to SEQ ID NO: 190234

SEQ ID NO: 742923 - RNA, 65 nt, Homo Sapiens
auuagcuugcuuaaggcauauguugugguuuuuagugcacuuaauaaggucauagauucuugagc

SEQ ID NO: 742924 - RNA, 65 nt, Homo Sapiens
aaaucaucccagcuaaguucugacacaggaucagcugcacuuaagcccacaugcacacagaacuc

SEQ ID NO: 742925 - RNA, 65 nt, Homo Sapiens
aaccaucuauugaauacacacuuacugguuuaauuugcacuuauuaaagcuacauugacgagaca

SEQ ID NO: 742926 - RNA, 65 nt, Homo Sapiens
cauuaguuaaaaaaagauaauagaguaucuuauucugcacuuauguguaaacaagauauuuaaac

SEQ ID NO: 742927 - RNA, 65 nt, Homo Sapiens
uugauuugaauuaauuuuggguuaaaaauaaacucugcacuuauugugucauagcuaugacauuu

SEQ ID NO: 742928 - RNA, 65 nt, Homo Sapiens
gcaaauaccaauaauuaagaaacuuggucucgucuugcacuuagugccgagggcaggaguggcuc

SEQ ID NO: 742929 - RNA, 65 nt, Homo Sapiens
uagaaccucauuuuuaaagaucaccacugaaacccugcacuuagcguguucacauggucaaaauu

SEQ ID NO: 742930 - RNA, 65 nt, Homo Sapiens
auuuuuuuuccuauuuuucuucuuuuugcuuuuuuugcacuuaucagaaauauuugaugugugca

SEQ ID NO: 742931 - RNA, 65 nt, Homo Sapiens
acugauuuagaagagacucuuugcugaaauugaauugcacuuauacauguaaauugucaacaugu

SEQ ID NO: 742932 - RNA, 65 nt, Homo Sapiens
caguuuuucauuuuaaaaaguccauaccuuauauaugcacuuaauuuguuggggcuuuacauacu

SEQ ID NO: 742933 - RNA, 65 nt, Homo Sapiens
ucaauuccaccagggccagagcagcuccaccacugugcacuuagccaugauggcaacagaaacca

SEQ ID NO: 742934 - RNA, 65 nt, Homo Sapiens
aauucuucaaccagaaaaaccuauuguucuaaaagugcacuuaagagaugggauuacaaguggac

SEQ ID NO: 742935 - RNA, 65 nt, Homo Sapiens
uuugucaucauaaucuuuauggugggggcagacuuugcacuuacugcagugcaacacuugcacuu

SEQ ID NO: 742936 - RNA, 65 nt, Homo Sapiens
aaugaauguucuuuucaaaaaauaaaguagaaaaaugcacuuacuaagaacaugaaaaaaaauga

SEQ ID NO: 742937 - RNA, 65 nt, Homo Sapiens
ugauaaacuauaauuguagaaagggguaauuucugugcacuuacaacaagcugaguguucauguu

SEQ ID NO: 742938 - RNA, 65 nt, Homo Sapiens
uaucauugaaaaaguccauagccaaaaccugacugugcacuuacuauaggacccugaccugccug

SEQ ID NO: 742939 - RNA, 65 nt, Homo Sapiens
ucugauuuuuaaaccugguuuacagguauuacuucugcacuuaccaaauaaugccagauggaaau

SEQ ID NO: 742940 - RNA, 65 nt, Homo Sapiens
aaaauauuuaaaaacugaaagaggaaucuaguauuugcacuuagcacuugccuuaaaacuggaga

SEQ ID NO: 742941 - RNA, 65 nt, Homo Sapiens
acuaauguccguguugguauuguaauuaauucaacugcacuuaacuccuggaauacaguuuucag

SEQ ID NO: 742942 - RNA, 65 nt, Homo Sapiens
aaaugauuugaacaaauaaauccagguguuucuuaugcacuuauaaguauuuuggcauauuauuc

SEQ ID NO: 742943 - RNA, 65 nt, Homo Sapiens
accugacaguaugaccgaucuugucuucucuuuucugcacuuaauugugccucagccuagauguu

SEQ ID NO: 742944 - RNA, 65 nt, Homo Sapiens
uccccuguuucuguuuaacuuagagugacaaacucugcacuuaagagcccauccccucccagaaa

SEQ ID NO: 742945 - RNA, 65 nt, Homo Sapiens
ccuuuugcuaauaaaagugucucuuucucccaugcugcacuuacuuugaggggaaggaggagccc

SEQ ID NO: 742946 - RNA, 65 nt, Homo Sapiens
aagggauauuguaaaugaaacacagcccucgacuuugcacuuaaaccccccaccgugguucuuuu

SEQ ID NO: 742947 - RNA, 65 nt, Homo Sapiens
uugguugacuuaauauauuugcuuuuuuucucaccugcacuuagaggaaauuugaacaaguugga

SEQ ID NO: 742948 - RNA, 65 nt, Homo Sapiens
gccucauuuagagaggaaaaguaaccaucacugguugcacuuaugauuucaugugcggggaucau

SEQ ID NO: 742949 - RNA, 65 nt, Homo Sapiens
uacugucaagguacuugcuugugucugaacucuagugcacuuaugauuuuguagaccaugugaaa

SEQ ID NO: 742950 - RNA, 65 nt, Homo Sapiens
uuuuguuguuuuguuugcuuugggaucuuguuggaugcacuuagauauggaaaauggaagccaaa

SEQ ID NO: 742951 - RNA, 65 nt, Homo Sapiens
cuugucucuaaauugauguucacccauuucaauauugcacuuauuaauggucuuuauuuuucuag

SEQ ID NO: 742952 - RNA, 65 nt, Homo Sapiens
acuguuuuguaagaaucacuguuacauucuucuuuugcacuuaaaguugcauugccuacuguuau

SEQ ID NO: 742953 - RNA, 65 nt, Homo Sapiens
aggcuguuuacauggguugcaaaaacuuuaggaaaugcacuuauuguauaaugauguaaacaugg

SEQ ID NO: 742954 - RNA, 65 nt, Homo Sapiens
uuuaauuuauauguuaguuaucauugaaaacuccuugcacuuagacacucucuugaauuuaggaa

SEQ ID NO: 742955 - RNA, 65 nt, Homo Sapiens
aagugcuaaauuuuaaaagcgaggugaauuauuuaugcacuuagguaaauauuuuuaacauuacu

SEQ ID NO: 742956 - RNA, 65 nt, Homo Sapiens
aacugcguucuggcuaacacccucccagugcugggugcacuuaacgcuccucucaagccacauuu

SEQ ID NO: 742957 - RNA, 65 nt, Homo Sapiens
ucuuacacuaaaaauccuugcauuuuaaagagagaugcacuuaagaauagagugaacugcucaua

SEQ ID NO: 742958 - RNA, 65 nt, Homo Sapiens
cauuguugcugcauuaguguaauguggugugguuuugcacuuaaaagagguauucauaugcucua

SEQ ID NO: 742959 - RNA, 61 nt, Homo Sapiens; identical to SEQ ID NO: 190271

SEQ ID NO: 742960 - RNA, 65 nt, Homo Sapiens
acguguuucuagguugaccuuguguuuuagaaauuugcacuuaauggaauuugcauuucagagau

SEQ ID NO: 742961 - RNA, 65 nt, Homo Sapiens
agaaaaaugucacuacugcaacauuaggaauguccugcacuuaauagaauuauuuuucaccgcua

SEQ ID NO: 742962 - RNA, 64 nt, Homo Sapiens
cugaguuuucggagaccaagaaauuaaaauacaauugcacuuacuguuuacuuguaaauguuau

SEQ ID NO: 742963 - RNA, 65 nt, Homo Sapiens
gucuacugcuuuguacgaauucuaaguauucuuguugcacuuaauuagccuguauauccucagaa

SEQ ID NO: 742964 - RNA, 65 nt, Homo Sapiens
uucucauucuauggccauugcagaaaaaauucaaaugcacuuaugcagagccuauagccagaacu

SEQ ID NO: 742965 - RNA, 65 nt, Homo Sapiens
caguaaauuaucuugggauacuuuuagaagauagaugcacuuaugcuaagaaauauuccaaaugu

SEQ ID NO: 742966 - RNA, 65 nt, Homo Sapiens
uguaaccaguggugauuugguauagugaugcaaaaugcacuuaugaugggaguauuauaucccug

SEQ ID NO: 742967 - RNA, 65 nt, Homo Sapiens
uaaguuuaaaucaaauacagcuuuccauaauucacugcacuuaaauauucaaaccuuuaaguuag

SEQ ID NO: 742968 - RNA, 65 nt, Homo Sapiens
gacuccuguuguugaaguuccagcugcauacaguuugcacuuaugaugcuaaaauuccugaaguu

SEQ ID NO: 742969 - RNA, 65 nt, Homo Sapiens
uuuugaauuuuaaaaugaugaacuuaaacucaaguugcacuuacauuagagguauggagcagugc

SEQ ID NO: 742970 - RNA, 65 nt, Homo Sapiens
cugacagucccuucagugguugucccaaaaggugaugcacuuaaguuuuucauucugagcauguu

SEQ ID NO: 742971 - RNA, 65 nt, Homo Sapiens
uccaaaaacuugcugaaacacuugauauugcacagugcacuuauuuuguggccaaagcauggccu

SEQ ID NO: 742972 - RNA, 65 nt, Homo Sapiens
uacaguaagcguuuuuuuucuuugaagauuuaugaugcacuuauucaauagcugucagccguucc

SEQ ID NO: 742973 - RNA, 65 nt, Homo Sapiens
cuaaagucuacaccaauggaauuagaugagugcuaugcacuuaauuuuaaaauaaaacuaguuuu

SEQ ID NO: 742974 - RNA, 65 nt, Homo Sapiens
gaggacaggagacuccaagcgcuaguauugcacgcugcacuuaauggacuggacucuugccaugg

SEQ ID NO: 742975 - RNA, 65 nt, Homo Sapiens
agaacccauuugagggguggggggguguuaauuuaugcacuuauaagguguuuucuguguaacca

SEQ ID NO: 742976 - RNA, 65 nt, Homo Sapiens
acuggcugcagcagaacacguugagggagucuuggugcacuuaggucacuguaagguucuagggc

SEQ ID NO: 742977 - RNA, 65 nt, Homo Sapiens
aucaaaguaguucaacaugcgugacuaucuauauuugcacuuaaaacugcaagugacaaucagag

SEQ ID NO: 742978 - RNA, 65 nt, Homo Sapiens
uuuuuuuuuuuuuuuuuagucucuccaagaguaguugcacuuaaccuuuugacuccccuuauucc

SEQ ID NO: 742979 - RNA, 65 nt, Homo Sapiens
ccgcagcugcuauagauagcaaaguaucuguuaugugcacuuaagggagguuaucagaauuaaua

SEQ ID NO: 742980 - RNA, 65 nt, Homo Sapiens
auuuuccuaauaaaguucugaugaaaaaauguauaugcacuuauaucuacuuugaagucauacca

SEQ ID NO: 742981 - RNA, 65 nt, Homo Sapiens
uucagaaacuuagagaguuguuuugaacuggagcaugcacuuauuuugugguguuguucugauug

SEQ ID NO: 742982 - RNA, 65 nt, Homo Sapiens
uuagucuuuauguauuugcugugauuuuacugaaaugcacuuauaaucauaaauguacuucacca

SEQ ID NO: 742983 - RNA, 65 nt, Homo Sapiens
guggaaaggcaaguuggucuuauagaaagcacuacugcacuuaguagcuaugugauuuugagcaa

SEQ ID NO: 742984 - RNA, 65 nt, Homo Sapiens
aaguuaagaagccaaagcuacuugaucaugcaaaaugcacuuauauauuuguuacacuguauugc

SEQ ID NO: 742985 - RNA, 65 nt, Homo Sapiens
uuaugguuuaucuccagcaacauuucucuaguacuugcacuuauuaucuuuugucuaauuuaacc

SEQ ID NO: 742986 - RNA, 65 nt, Homo Sapiens
uuuuuacucccaguagcaagggauucuaaguuaguugcacuuacaugauuauuguuauuuaaaac

SEQ ID NO: 742987 - RNA, 65 nt, Homo Sapiens
cccgacuuacuugcuagucucuaugagguccuuauugcacuuauugggguugaagcucuucagag

SEQ ID NO: 742988 - RNA, 65 nt, Homo Sapiens
cacucccuucuucccuguguggggcucaagccuggugcacuuaguauagaagagcuaacguacuc

SEQ ID NO: 742989 - RNA, 65 nt, Homo Sapiens
uggggcagaagcucugccuaaaaugaagugaaagcugcacuuaacccuuugugauaaugaugaca

SEQ ID NO: 742990 - RNA, 65 nt, Homo Sapiens
cuuggcagacccuugacuccacagaagugucuccuugcacuuagcuggaacuucuuuauuucaaa

SEQ ID NO: 742991 - RNA, 65 nt, Homo Sapiens
aagcucccaggccgagaagccggguacugagagucugcacuuaaccugauccaggaggccggggc

SEQ ID NO: 742992 - RNA, 65 nt, Homo Sapiens
ccucagguaagugcauaggccaucacucucuuuguugcacuuagcgaauguaugaaggaugaccc

SEQ ID NO: 742993 - RNA, 65 nt, Homo Sapiens
caaacauuuaugcgguaggcucagaugucguaauuugcacuuagguaccaggugucaggaaacag

SEQ ID NO: 742994 - RNA, 65 nt, Homo Sapiens
gauauauaaauagacuauauguucaauauuaucacugcacuuauaaaaaaagaaugauaugugag

SEQ ID NO: 742995 - RNA, 65 nt, Homo Sapiens
aaaaaucacuugguaaggauuauaaacuuaauuacugcacuuaaaaugaaacauuacuuuuuuua

SEQ ID NO: 742996 - RNA, 65 nt, Homo Sapiens
aaguucagcguuguaugucucucucuacacuguggugcacuuaacuuguggaauuuuuauacuaa

SEQ ID NO: 742997 - RNA, 65 nt, Homo Sapiens
aaccagugaaaaugaaaggaaguuucaguauuagaugcacuuaaguuagccuccaccacccuuuc

SEQ ID NO: 742998 - RNA, 65 nt, Homo Sapiens
aguuuuauauuugucgacgccaggucagucauuuuugcacuuaauuguauaugagauaacuagau

SEQ ID NO: 742999 - RNA, 65 nt, Homo Sapiens
aaaauauaaaugaagauauuuuaccaugaagagauugcacuuauccuugagaacagucuaaauau

SEQ ID NO: 743000 - RNA, 65 nt, Homo Sapiens
uaaauauaaaugaagauauuuuaccaugaagagauugcacuuauccuugagaacagucuaaugau

SEQ ID NO: 743001 - RNA, 65 nt, Homo Sapiens
gguagucuccuuauaguugaagauaaaauguugagugcacuuauuuuagaauauccuagacauaa

SEQ ID NO: 743002 - RNA, 65 nt, Homo Sapiens
ccuuaacuguauuaacguucugaauguauauuguuugcacuuaauuagccucgcuagucaagcug

SEQ ID NO: 743003 - RNA, 65 nt, Homo Sapiens
auuauuugguugaauuuguuauuuccuuguuuuacugcacuuaauuaacaggaaaagucaucccu

SEQ ID NO: 743004 - RNA, 65 nt, Homo Sapiens
auuugucauaugauggcacuaugccuuacgacugcugcacuuaccggcucccaagugccuaggcc

SEQ ID NO: 743005 - RNA, 65 nt, Homo Sapiens
uuacaaccuaguaauaauguuucuauaauuugcccugcacuuauucuugaauguuuauacuuuua

SEQ ID NO: 743006 - RNA, 65 nt, Homo Sapiens
gaaguauuuuuagaauaagaauacaugaagcuucaugcacuuaaagaggccaagaauauugcaaa

SEQ ID NO: 743007 - RNA, 65 nt, Homo Sapiens
uuuaugacugccggggggguguucuuuuuguguuaugcacuuaauuauuuucucuauuuuccccu

SEQ ID NO: 743008 - RNA, 65 nt, Homo Sapiens
auggaggcuuggaugggaauaugcugauuuuguucugcacuuaaaggcuucuccuccuggagggc

SEQ ID NO: 743009 - RNA, 65 nt, Homo Sapiens
ugaacagcccaaaagcauuauagagaugguaaagcugcacuuacuugauaauuauaacuuaaugu

SEQ ID NO: 743010 - RNA, 65 nt, Homo Sapiens
aaggaaaaucaggccuguuggccaaaugacaguagugcacuuaaacagcagcuccccaccccaga

SEQ ID NO: 743011 - RNA, 65 nt, Homo Sapiens
acgcaccuauuucucaauagagauguuguaaguauugcacuuaauuuuuggucauuugacaucag

SEQ ID NO: 743012 - RNA, 65 nt, Homo Sapiens
aaugagaaucaaauggaaacauaucauucuggaggugcacuuacucuucuacaauguggccggau

SEQ ID NO: 743013 - RNA, 65 nt, Homo Sapiens
aauauuaaaacgacuccccaauuauuuugcagaauugcacuuaauauugaaauguacuguauagg

SEQ ID NO: 743014 - RNA, 65 nt, Homo Sapiens
acagacgcugcaaucacagauuuuaaaaaauuguuugcacuuaaaaauaguugaaugcuggugga

SEQ ID NO: 743015 - RNA, 65 nt, Homo Sapiens
auaaacugauuuuauuugggagaaacaaggaagggugcacuuaacuagcaaccuaagcaugauuu

SEQ ID NO: 743016 - RNA, 65 nt, Homo Sapiens
gcuagcucugcuuuuuaugcgauuuucuucagauuugcacuuacuggcagcuuauuggacacaug

SEQ ID NO: 743017 - RNA, 65 nt, Homo Sapiens
cuuagauuugugaagggagaugcuuuuuagaagccugcacuuaagcauccuauuguacucucuuc

SEQ ID NO: 743018 - RNA, 65 nt, Homo Sapiens
uacuugauacugaaugcauacggacucuggauauuugcacuuaugguuccuaauggauucaauua

SEQ ID NO: 743019 - RNA, 65 nt, Homo Sapiens
aacagugguacgauuucuagcccguggcuuuaaaaugcacuuaaaguccuguccuugccuuuuau

SEQ ID NO: 743020 - RNA, 65 nt, Homo Sapiens
aaauuaucccagcuauuagauagaagggauguuacugcacuuauguguaaucagaucuuuauuua

SEQ ID NO: 743021 - RNA, 65 nt, Homo Sapiens
caaaccuagaugggacaccugugaacaucauggagugcacuuauauuguaaggugacuuuauugu

SEQ ID NO: 743022 - RNA, 65 nt, Homo Sapiens
auagaguuuuuauuaauuacaaaagcaugugaaagugcacuuaaguuguuuguuuauuauaaaca

SEQ ID NO: 743023 - RNA, 65 nt, Homo Sapiens
guccuguccuugccuuuuaucccguggcuuuaaaaugcacuuaaaaacagugguacgauuucucg

SEQ ID NO: 743024 - RNA, 65 nt, Homo Sapiens
aagggccagguuccaaauuaccuccaacuuccuccugcacuuaaauuacuucaugcauggcuucu

SEQ ID NO: 743025 - RNA, 65 nt, Homo Sapiens
uguauggguccauauguacggugugugugugugugugcacuuaugccaguccuuucugucauucu

SEQ ID NO: 743026 - RNA, 65 nt, Homo Sapiens
uaauggucuucaauuuaauugggaaaaauaucucaugcacuuaaaacaugcauucaagaagcuag

SEQ ID NO: 743027 - RNA, 65 nt, Homo Sapiens
aagccuuguaaauaaugacauggaagacccugugcugcacuuaaaauauugcugcuugauuauuu

SEQ ID NO: 743028 - RNA, 61 nt, Homo Sapiens; identical to SEQ ID NO: 190340

SEQ ID NO: 743029 - RNA, 65 nt, Homo Sapiens
uuacuuuauuacagagcuccuugguuuuuuacuucugcacuuaaauuuuuuuaaauaacaugaug

SEQ ID NO: 743030 - RNA, 65 nt, Homo Sapiens
uuuuuuuuuuaauuuucaggucaaguuuuuuauacugcacuuauuugucaaaauaaagauucuca

SEQ ID NO: 743031 - RNA, 65 nt, Homo Sapiens
acaguggcugaaauccagcauuuuuacauaggagaugcacuuagccucuaagccucguuuuacuc

SEQ ID NO: 743032 - RNA, 65 nt, Homo Sapiens
uucuuuggauggaggggagggccuuuguuaccuuuugcacuuauucuuucugugggugcuuugac

SEQ ID NO: 743033 - RNA, 65 nt, Homo Sapiens
guggaucccucugucuggggugggaugccuuacuuugcacuuaauuuaauaagggcauucucgga

SEQ ID NO: 743034 - RNA, 65 nt, Homo Sapiens
cucgaaguuaguaaauccuuaagcuuucguccccuugcacuuagaaaggaaugucugacaggcuu

SEQ ID NO: 743035 - RNA, 65 nt, Homo Sapiens
gaaaggucacuggcccgggcccugcuuccaggcagugcacuuagagagugcagaucacgaaugca

SEQ ID NO: 743036 - RNA, 65 nt, Homo Sapiens
aagggauuguagguagauaacauccaaucacuguuugcacuuaucugaaaucuucccucuuggcu

SEQ ID NO: 743037 - RNA, 65 nt, Homo Sapiens
caucauggcucuccacucagacugugccuggccccugcacuuacaacuuccugccgcucuguggc

SEQ ID NO: 743038 - RNA, 65 nt, Homo Sapiens
acauugaaaaguaaauguuuuauuaguucauugccugcacuuacugaucggaagagagaaagaac

SEQ ID NO: 743039 - RNA, 65 nt, Homo Sapiens
cauugggcuguuuucucaacaaauggaaugccauuugcacuuacacaagacuuuccccauacucu

SEQ ID NO: 743040 - RNA, 65 nt, Homo Sapiens
gagcugggagcagcacaaggacccagccuuuguucugcacuuaauaaaugguuuugcuacugcua

SEQ ID NO: 743041 - RNA, 65 nt, Homo Sapiens
cagugccgggaaggaacugccgggacucaccgagcugcacuuaacuguucucuuucuggcuauuu

SEQ ID NO: 743042 - RNA, 65 nt, Homo Sapiens
uauugcggggagacagcucucuugaggguuggggcugcacuuauuagcugagccugaaucugacu

SEQ ID NO: 743043 - RNA, 65 nt, Homo Sapiens
gucuggagagcuuuggauaaucaaauccuuguuuuugcacuuauuggaaucaaacaguccugaau

SEQ ID NO: 743044 - RNA, 65 nt, Homo Sapiens
aauaugaaauagaaacuuuuucucucucaacuuccugcacuuaacguguuuucacuggauuuuua

SEQ ID NO: 743045 - RNA, 65 nt, Homo Sapiens
cucaauccagccccggagaagaucuccagguguacugcacuuaccucaagaagggggcucccugg

SEQ ID NO: 743046 - RNA, 65 nt, Homo Sapiens
aauggaacccaaacagaagaugcugucuauuucugugcacuuaacgaggguuucaguacaaaugc

SEQ ID NO: 743047 - RNA, 65 nt, Homo Sapiens
caaauaguauguggggauuuaugacuguaccauguugcacuuaauaucguguaaagagauuacac

SEQ ID NO: 743048 - RNA, 65 nt, Homo Sapiens
uaugaaccugcccugcucccauuucaagaccucugugcacuuauugaagaacagauaaucccugu

SEQ ID NO: 743049 - RNA, 65 nt, Homo Sapiens
cugcgugggacaagggcugucuucaucaugcucccugcacuuaggggugccgacuggcugccuga

SEQ ID NO: 743050 - RNA, 65 nt, Homo Sapiens
cuaauuaacaaaauguucuuccuuuaguuugcuuuugcacuuaaaauauauauaauugacuuuuu

SEQ ID NO: 743051 - RNA, 65 nt, Homo Sapiens
aguauaaguaugcguuacaggguuugauacuuuccugcacuuagguuuguccuauucuucauuua

SEQ ID NO: 743052 - RNA, 65 nt, Homo Sapiens
aguuagcauaauuuuagaugccugugaaauaguacugcacuuacauaaagugagacauugugaaa

SEQ ID NO: 743053 - RNA, 65 nt, Homo Sapiens
aucauaauacauguaguauuuugugucuggcgucuugcacuuagcaugguguucuugagguucau

SEQ ID NO: 743054 - RNA, 65 nt, Homo Sapiens
caaaacuauuguguaaaacaguauguacaugaaauugcacuuaacguacauccuuaaacaaagua

SEQ ID NO: 743055 - RNA, 64 nt, Homo Sapiens
uaugugaaaauauccuggaaauaaauacauguuucugcacuuagagccagggaccugccgcguu

SEQ ID NO: 743056 - RNA, 65 nt, Homo Sapiens
gaagccccagcgagauuuuccggugaauacgggauugcacuuacucuuucaucacggaaacagac

SEQ ID NO: 743057 - RNA, 65 nt, Homo Sapiens
agauaagcccccgcggggcggagauuucuaccuucugcacuuacuccccaucagaagaucgaguu

SEQ ID NO: 743058 - RNA, 65 nt, Homo Sapiens
gagguuuauuucaccugaauauaauuccuaacugaugcacuuaguauaugucaguuuuuauaaau

SEQ ID NO: 743059 - RNA, 65 nt, Homo Sapiens
gggaaucucuaacaugcucuguuuacaucgauaaaugcacuuaaggaaaacaaacaaauuaaagc

SEQ ID NO: 743060 - RNA, 65 nt, Homo Sapiens
cuugacucauauguuuuaacaugauuuuaacaaacugcacuuauuaagaaauguguuugcccugu

SEQ ID NO: 743061 - RNA, 65 nt, Homo Sapiens
aaucacugugacucuagaguggccagacucagagcugcacuuaguagggguuccucaaaggaagg

SEQ ID NO: 743062 - RNA, 65 nt, Homo Sapiens
auaauucacccaugaaagagacccagugguuacugugcacuuaggaaaaccuucagccacaucuu

SEQ ID NO: 743063 - RNA, 65 nt, Homo Sapiens
agaauucacccaugagagagacccagugguugcuaugcacuuaggaaaacuuucagccacaucuu

SEQ ID NO: 743064 - RNA, 65 nt, Homo Sapiens
uaaacaaucagaccacauuucauugcuacucuugcugcacuuaugagaagacagccuacaugguc

SEQ ID NO: 743065 - RNA, 58 nt, Homo Sapiens; identical to SEQ ID NO: 190377

SEQ ID NO: 743066 - RNA, 65 nt, Homo Sapiens
guguauacaaauacaguauuuuccaugguucugccugcacuuacuuuguaaugccacgguugaga

SEQ ID NO: 743067 - RNA, 65 nt, Homo Sapiens
ggcuuuucccguugaugucuugaugcuccuaucugugcacuuaccguagguagggacacgugucc

SEQ ID NO: 743068 - RNA, 65 nt, Homo Sapiens
ucauuaccacggaagauauaaagccaagcaucacuugcacuuaaaaaagaaaugaaugugaaaga

SEQ ID NO: 743069 - RNA, 65 nt, Homo Sapiens
ucgaauuugaagagauugcugacagggcucauuuuugcacuuaucuuuggggaguaccuguccaa

SEQ ID NO: 743070 - RNA, 65 nt, Homo Sapiens
gggugagcgcgggugucgagcaccuaccuccagugugcacuuaggcccugcaguaacuaucuaua

SEQ ID NO: 743071 - RNA, 65 nt, Homo Sapiens
gaaggaagcacaugugcaccuuuccuuuacacuaaugcacuuaggauguuucugcaucaugucua

SEQ ID NO: 743072 - RNA, 65 nt, Homo Sapiens
cggcucagcgaccuuuccucucaaaugcggaagcgugcacuuacaguucagaccguucuccugua

SEQ ID NO: 743073 - RNA, 65 nt, Homo Sapiens
auuauauucuauaaacauuaagguugauaaccauaugcacuuaaccuauauuuucuggauucugg

SEQ ID NO: 743074 - RNA, 65 nt, Homo Sapiens
aagcaaaucuauuagaaaaacacagcaaacugcacugcacuuauaaauauguagaauguuaaaag

SEQ ID NO: 743075 - RNA, 65 nt, Homo Sapiens
uggacuucgguguccucggcucugaaggcgcucucugcacuuagaugcugucagcccucaacgua

SEQ ID NO: 743076 - RNA, 65 nt, Homo Sapiens
gucgguguggaaugucacucgacauccggggacugugcacuuacacauugagggugaugacaaga

SEQ ID NO: 743077 - RNA, 65 nt, Homo Sapiens
cucuccucucuucuccuaucggugagggagguaggugcacuuaccgagggagaccagcaguuaac

SEQ ID NO: 743078 - RNA, 65 nt, Homo Sapiens
ggccuugcucacagcugauugagcccucaggcaccugcacuuacacccagcuaacucugaccugg

SEQ ID NO: 743079 - RNA, 65 nt, Homo Sapiens
ugugagagucuucaaacuuucacaggauccugagcugcacuuaccuuaagacuuucugcugcacu

SEQ ID NO: 743080 - RNA, 65 nt, Homo Sapiens
accuucuugauagcucccugggacgagugcugguaugcacuuaggugcuuaugugugugggcuug

SEQ ID NO: 743081 - RNA, 65 nt, Homo Sapiens
gaaugcuggucagucugaaaaggugaagcuggcugugcacuuacccccaucuuucucccucgggg

SEQ ID NO: 743082 - RNA, 65 nt, Homo Sapiens
aguccccuuucccugucccagccccaucuguggguugcacuuacaaacccccacccaccuucaga

SEQ ID NO: 743083 - RNA, 65 nt, Homo Sapiens
uuuagaaaacuauugaaagaaaucacaggggaaacugcacuuagacugacagaauugaacaccaa

SEQ ID NO: 743084 - RNA, 65 nt, Homo Sapiens
uaaaauuuaggagagaacauaguguagaaacuucuugcacuuauuaaaaauguaugcaauuccug

SEQ ID NO: 743085 - RNA, 65 nt, Homo Sapiens
aauuagcaugcugcuuuuugauuaugagcuuucuuugcacuuaaauaauuuuaaaagucuauuuu

SEQ ID NO: 743086 - RNA, 65 nt, Homo Sapiens
uuaucaauaaagaggcaaauuacccuuaucuccucugcacuuauggcugcccaugccgcucaggc

SEQ ID NO: 743087 - RNA, 65 nt, Homo Sapiens
cuuauaaaauaacuugcaucaccuagauaacgaagugcacuuacaaaaugccaguguguccuaga

SEQ ID NO: 743088 - RNA, 62 nt, Homo Sapiens; identical to SEQ ID NO: 253135

SEQ ID NO: 743089 - RNA, 62 nt, Homo Sapiens; identical to SEQ ID NO: 253136

SEQ ID NO: 743090 - RNA, 62 nt, Homo Sapiens; identical to SEQ ID NO: 253137

SEQ ID NO: 743091 - RNA, 62 nt, Homo Sapiens; identical to SEQ ID NO: 253138

SEQ ID NO: 743092 - RNA, 62 nt, Homo Sapiens; identical to SEQ ID NO: 253139

SEQ ID NO: 743093 - RNA, 62 nt, Homo Sapiens; identical to SEQ ID NO: 253140

SEQ ID NO: 743094 - RNA, 62 nt, Homo Sapiens; identical to SEQ ID NO: 253141

SEQ ID NO: 743095 - RNA, 62 nt, Homo Sapiens; identical to SEQ ID NO: 253142

SEQ ID NO: 743096 - RNA, 62 nt, Homo Sapiens; identical to SEQ ID NO: 253143

SEQ ID NO: 743097 - RNA, 62 nt, Homo Sapiens; identical to SEQ ID NO: 253144

SEQ ID NO: 743098 - RNA, 62 nt, Homo Sapiens; identical to SEQ ID NO: 253145

SEQ ID NO: 743099 - RNA, 58 nt, Homo Sapiens; identical to SEQ ID NO: 102991

SEQ ID NO: 743100 - RNA, 62 nt, Homo Sapiens; identical to SEQ ID NO: 253147

SEQ ID NO: 743101 - RNA, 62 nt, Homo Sapiens; identical to SEQ ID NO: 253148

SEQ ID NO: 743102 - RNA, 62 nt, Homo Sapiens; identical to SEQ ID NO: 253149

SEQ ID NO: 743103 - RNA, 62 nt, Homo Sapiens; identical to SEQ ID NO: 253150

SEQ ID NO: 743104 - RNA, 62 nt, Homo Sapiens; identical to SEQ ID NO: 253151

SEQ ID NO: 743105 - RNA, 62 nt, Homo Sapiens; identical to SEQ ID NO: 253152

SEQ ID NO: 743106 - RNA, 62 nt, Homo Sapiens; identical to SEQ ID NO: 253153

SEQ ID NO: 743107 - RNA, 62 nt, Homo Sapiens; identical to SEQ ID NO: 253154

SEQ ID NO: 743108 - RNA, 62 nt, Homo Sapiens; identical to SEQ ID NO: 253155

SEQ ID NO: 743109 - RNA, 62 nt, Homo Sapiens; identical to SEQ ID NO: 253156

SEQ ID NO: 743110 - RNA, 62 nt, Homo Sapiens; identical to SEQ ID NO: 253157

SEQ ID NO: 743111 - RNA, 62 nt, Homo Sapiens; identical to SEQ ID NO: 253158

SEQ ID NO: 743112 - RNA, 62 nt, Homo Sapiens; identical to SEQ ID NO: 253159

SEQ ID NO: 743113 - RNA, 62 nt, Homo Sapiens; identical to SEQ ID NO: 253160

SEQ ID NO: 743114 - RNA, 62 nt, Homo Sapiens; identical to SEQ ID NO: 253161

SEQ ID NO: 743115 - RNA, 62 nt, Homo Sapiens; identical to SEQ ID NO: 253162

SEQ ID NO: 743116 - RNA, 62 nt, Homo Sapiens; identical to SEQ ID NO: 253163

SEQ ID NO: 743117 - RNA, 62 nt, Homo Sapiens; identical to SEQ ID NO: 253164

SEQ ID NO: 743118 - RNA, 62 nt, Homo Sapiens; identical to SEQ ID NO: 253165

SEQ ID NO: 743119 - RNA, 62 nt, Homo Sapiens; identical to SEQ ID NO: 253166

SEQ ID NO: 743120 - RNA, 62 nt, Homo Sapiens; identical to SEQ ID NO: 253167

SEQ ID NO: 743121 - RNA, 62 nt, Homo Sapiens; identical to SEQ ID NO: 253168

SEQ ID NO: 743122 - RNA, 53 nt, Homo Sapiens; identical to SEQ ID NO: 103014

SEQ ID NO: 743123 - RNA, 62 nt, Homo Sapiens; identical to SEQ ID NO: 253170

SEQ ID NO: 743124 - RNA, 62 nt, Homo Sapiens; identical to SEQ ID NO: 253171

SEQ ID NO: 743125 - RNA, 62 nt, Homo Sapiens; identical to SEQ ID NO: 253172

SEQ ID NO: 743126 - RNA, 62 nt, Homo Sapiens; identical to SEQ ID NO: 253173

SEQ ID NO: 743127 - RNA, 62 nt, Homo Sapiens; identical to SEQ ID NO: 253174

SEQ ID NO: 743128 - RNA, 62 nt, Homo Sapiens; identical to SEQ ID NO: 253175

SEQ ID NO: 743129 - RNA, 62 nt, Homo Sapiens; identical to SEQ ID NO: 253176

SEQ ID NO: 743130 - RNA, 62 nt, Homo Sapiens; identical to SEQ ID NO: 253177

SEQ ID NO: 743131 - RNA, 62 nt, Homo Sapiens; identical to SEQ ID NO: 253178

SEQ ID NO: 743132 - RNA, 62 nt, Homo Sapiens; identical to SEQ ID NO: 253179

SEQ ID NO: 743133 - RNA, 62 nt, Homo Sapiens; identical to SEQ ID NO: 253180

SEQ ID NO: 743134 - RNA, 62 nt, Homo Sapiens; identical to SEQ ID NO: 253181

SEQ ID NO: 743135 - RNA, 62 nt, Homo Sapiens; identical to SEQ ID NO: 253182

SEQ ID NO: 743136 - RNA, 62 nt, Homo Sapiens; identical to SEQ ID NO: 253183

SEQ ID NO: 743137 - RNA, 62 nt, Homo Sapiens; identical to SEQ ID NO: 253184

SEQ ID NO: 743138 - RNA, 62 nt, Homo Sapiens; identical to SEQ ID NO: 253185

SEQ ID NO: 743139 - RNA, 62 nt, Homo Sapiens; identical to SEQ ID NO: 253186

SEQ ID NO: 743140 - RNA, 62 nt, Homo Sapiens; identical to SEQ ID NO: 253187

SEQ ID NO: 743141 - RNA, 62 nt, Homo Sapiens; identical to SEQ ID NO: 253188

SEQ ID NO: 743142 - RNA, 62 nt, Homo Sapiens; identical to SEQ ID NO: 253189

SEQ ID NO: 743143 - RNA, 62 nt, Homo Sapiens; identical to SEQ ID NO: 253190

SEQ ID NO: 743144 - RNA, 62 nt, Homo Sapiens; identical to SEQ ID NO: 253191

SEQ ID NO: 743145 - RNA, 62 nt, Homo Sapiens; identical to SEQ ID NO: 253192

SEQ ID NO: 743146 - RNA, 62 nt, Homo Sapiens; identical to SEQ ID NO: 253193

SEQ ID NO: 743147 - RNA, 62 nt, Homo Sapiens; identical to SEQ ID NO: 253194

SEQ ID NO: 743148 - RNA, 62 nt, Homo Sapiens; identical to SEQ ID NO: 253195

SEQ ID NO: 743149 - RNA, 62 nt, Homo Sapiens; identical to SEQ ID NO: 253196

SEQ ID NO: 743150 - RNA, 62 nt, Homo Sapiens; identical to SEQ ID NO: 253197

SEQ ID NO: 743151 - RNA, 62 nt, Homo Sapiens; identical to SEQ ID NO: 253198

SEQ ID NO: 743152 - RNA, 62 nt, Homo Sapiens; identical to SEQ ID NO: 253199

SEQ ID NO: 743153 - RNA, 62 nt, Homo Sapiens; identical to SEQ ID NO: 253200

SEQ ID NO: 743154 - RNA, 62 nt, Homo Sapiens; identical to SEQ ID NO: 253201

SEQ ID NO: 743155 - RNA, 62 nt, Homo Sapiens; identical to SEQ ID NO: 253202

SEQ ID NO: 743156 - RNA, 62 nt, Homo Sapiens; identical to SEQ ID NO: 253203

SEQ ID NO: 743157 - RNA, 62 nt, Homo Sapiens; identical to SEQ ID NO: 253204

SEQ ID NO: 743158 - RNA, 62 nt, Homo Sapiens; identical to SEQ ID NO: 253205

SEQ ID NO: 743159 - RNA, 62 nt, Homo Sapiens; identical to SEQ ID NO: 253206

SEQ ID NO: 743160 - RNA, 62 nt, Homo Sapiens; identical to SEQ ID NO: 253207

SEQ ID NO: 743161 - RNA, 62 nt, Homo Sapiens; identical to SEQ ID NO: 253208

SEQ ID NO: 743162 - RNA, 62 nt, Homo Sapiens; identical to SEQ ID NO: 253209

SEQ ID NO: 743163 - RNA, 62 nt, Homo Sapiens; identical to SEQ ID NO: 253210

SEQ ID NO: 743164 - RNA, 62 nt, Homo Sapiens; identical to SEQ ID NO: 253211

SEQ ID NO: 743165 - RNA, 62 nt, Homo Sapiens; identical to SEQ ID NO: 253212

SEQ ID NO: 743166 - RNA, 62 nt, Homo Sapiens; identical to SEQ ID NO: 253213

SEQ ID NO: 743167 - RNA, 62 nt, Homo Sapiens; identical to SEQ ID NO: 253214

SEQ ID NO: 743168 - RNA, 62 nt, Homo Sapiens; identical to SEQ ID NO: 253215

SEQ ID NO: 743169 - RNA, 62 nt, Homo Sapiens; identical to SEQ ID NO: 253216

SEQ ID NO: 743170 - RNA, 62 nt, Homo Sapiens; identical to SEQ ID NO: 253217

SEQ ID NO: 743171 - RNA, 62 nt, Homo Sapiens; identical to SEQ ID NO: 253218

SEQ ID NO: 743172 - RNA, 62 nt, Homo Sapiens; identical to SEQ ID NO: 253219

SEQ ID NO: 743173 - RNA, 62 nt, Homo Sapiens; identical to SEQ ID NO: 253220

SEQ ID NO: 743174 - RNA, 62 nt, Homo Sapiens; identical to SEQ ID NO: 253221

SEQ ID NO: 743175 - RNA, 62 nt, Homo Sapiens; identical to SEQ ID NO: 253222

SEQ ID NO: 743176 - RNA, 62 nt, Homo Sapiens; identical to SEQ ID NO: 253223

SEQ ID NO: 743177 - RNA, 62 nt, Homo Sapiens; identical to SEQ ID NO: 253224

SEQ ID NO: 743178 - RNA, 62 nt, Homo Sapiens; identical to SEQ ID NO: 253225

SEQ ID NO: 743179 - RNA, 62 nt, Homo Sapiens; identical to SEQ ID NO: 253226

SEQ ID NO: 743180 - RNA, 62 nt, Homo Sapiens; identical to SEQ ID NO: 253227

SEQ ID NO: 743181 - RNA, 62 nt, Homo Sapiens; identical to SEQ ID NO: 253228

SEQ ID NO: 743182 - RNA, 62 nt, Homo Sapiens; identical to SEQ ID NO: 253229

SEQ ID NO: 743183 - RNA, 62 nt, Homo Sapiens; identical to SEQ ID NO: 253230

SEQ ID NO: 743184 - RNA, 62 nt, Homo Sapiens; identical to SEQ ID NO: 253231

SEQ ID NO: 743185 - RNA, 62 nt, Homo Sapiens; identical to SEQ ID NO: 253232

SEQ ID NO: 743186 - RNA, 62 nt, Homo Sapiens; identical to SEQ ID NO: 253233

SEQ ID NO: 743187 - RNA, 62 nt, Homo Sapiens; identical to SEQ ID NO: 253234

SEQ ID NO: 743188 - RNA, 62 nt, Homo Sapiens; identical to SEQ ID NO: 253235

SEQ ID NO: 743189 - RNA, 62 nt, Homo Sapiens; identical to SEQ ID NO: 253236

SEQ ID NO: 743190 - RNA, 62 nt, Homo Sapiens; identical to SEQ ID NO: 253237

SEQ ID NO: 743191 - RNA, 62 nt, Homo Sapiens; identical to SEQ ID NO: 253238

SEQ ID NO: 743192 - RNA, 62 nt, Homo Sapiens; identical to SEQ ID NO: 253239

SEQ ID NO: 743193 - RNA, 62 nt, Homo Sapiens; identical to SEQ ID NO: 253240

SEQ ID NO: 743194 - RNA, 62 nt, Homo Sapiens; identical to SEQ ID NO: 253241

SEQ ID NO: 743195 - RNA, 62 nt, Homo Sapiens; identical to SEQ ID NO: 253242

SEQ ID NO: 743196 - RNA, 62 nt, Homo Sapiens; identical to SEQ ID NO: 253243

SEQ ID NO: 743197 - RNA, 62 nt, Homo Sapiens; identical to SEQ ID NO: 253244

SEQ ID NO: 743198 - RNA, 62 nt, Homo Sapiens; identical to SEQ ID NO: 253245

SEQ ID NO: 743199 - RNA, 62 nt, Homo Sapiens; identical to SEQ ID NO: 253246

SEQ ID NO: 743200 - RNA, 62 nt, Homo Sapiens; identical to SEQ ID NO: 253247

SEQ ID NO: 743201 - RNA, 62 nt, Homo Sapiens; identical to SEQ ID NO: 253248

SEQ ID NO: 743202 - RNA, 62 nt, Homo Sapiens; identical to SEQ ID NO: 253249

SEQ ID NO: 743203 - RNA, 62 nt, Homo Sapiens; identical to SEQ ID NO: 253250

SEQ ID NO: 743204 - RNA, 62 nt, Homo Sapiens; identical to SEQ ID NO: 253251

SEQ ID NO: 743205 - RNA, 62 nt, Homo Sapiens; identical to SEQ ID NO: 253252

SEQ ID NO: 743206 - RNA, 60 nt, Homo Sapiens; identical to SEQ ID NO: 103098

SEQ ID NO: 743207 - RNA, 62 nt, Homo Sapiens; identical to SEQ ID NO: 253254

SEQ ID NO: 743208 - RNA, 62 nt, Homo Sapiens; identical to SEQ ID NO: 253255

SEQ ID NO: 743209 - RNA, 62 nt, Homo Sapiens; identical to SEQ ID NO: 253256

SEQ ID NO: 743210 - RNA, 62 nt, Homo Sapiens; identical to SEQ ID NO: 253257

SEQ ID NO: 743211 - RNA, 62 nt, Homo Sapiens; identical to SEQ ID NO: 253258

SEQ ID NO: 743212 - RNA, 62 nt, Homo Sapiens; identical to SEQ ID NO: 253259

SEQ ID NO: 743213 - RNA, 62 nt, Homo Sapiens; identical to SEQ ID NO: 253260

SEQ ID NO: 743214 - RNA, 62 nt, Homo Sapiens; identical to SEQ ID NO: 253261

SEQ ID NO: 743215 - RNA, 62 nt, Homo Sapiens; identical to SEQ ID NO: 253262

SEQ ID NO: 743216 - RNA, 62 nt, Homo Sapiens; identical to SEQ ID NO: 253263

SEQ ID NO: 743217 - RNA, 62 nt, Homo Sapiens; identical to SEQ ID NO: 253264

SEQ ID NO: 743218 - RNA, 62 nt, Homo Sapiens; identical to SEQ ID NO: 253265

SEQ ID NO: 743219 - RNA, 62 nt, Homo Sapiens; identical to SEQ ID NO: 253266

SEQ ID NO: 743220 - RNA, 62 nt, Homo Sapiens; identical to SEQ ID NO: 253267

SEQ ID NO: 743221 - RNA, 62 nt, Homo Sapiens; identical to SEQ ID NO: 253268

SEQ ID NO: 743222 - RNA, 62 nt, Homo Sapiens; identical to SEQ ID NO: 253269

SEQ ID NO: 743223 - RNA, 62 nt, Homo Sapiens; identical to SEQ ID NO: 253270

SEQ ID NO: 743224 - RNA, 62 nt, Homo Sapiens; identical to SEQ ID NO: 253271

SEQ ID NO: 743225 - RNA, 62 nt, Homo Sapiens; identical to SEQ ID NO: 253272

SEQ ID NO: 743226 - RNA, 62 nt, Homo Sapiens; identical to SEQ ID NO: 253273

SEQ ID NO: 743227 - RNA, 62 nt, Homo Sapiens; identical to SEQ ID NO: 253274

SEQ ID NO: 743228 - RNA, 62 nt, Homo Sapiens; identical to SEQ ID NO: 253275

SEQ ID NO: 743229 - RNA, 62 nt, Homo Sapiens; identical to SEQ ID NO: 253276

SEQ ID NO: 743230 - RNA, 62 nt, Homo Sapiens; identical to SEQ ID NO: 253277

SEQ ID NO: 743231 - RNA, 62 nt, Homo Sapiens; identical to SEQ ID NO: 253278

SEQ ID NO: 743232 - RNA, 62 nt, Homo Sapiens; identical to SEQ ID NO: 253279

SEQ ID NO: 743233 - RNA, 62 nt, Homo Sapiens; identical to SEQ ID NO: 253280

SEQ ID NO: 743234 - RNA, 62 nt, Homo Sapiens; identical to SEQ ID NO: 253281

SEQ ID NO: 743235 - RNA, 62 nt, Homo Sapiens; identical to SEQ ID NO: 253282

SEQ ID NO: 743236 - RNA, 62 nt, Homo Sapiens; identical to SEQ ID NO: 253283

SEQ ID NO: 743237 - RNA, 62 nt, Homo Sapiens; identical to SEQ ID NO: 253284

SEQ ID NO: 743238 - RNA, 62 nt, Homo Sapiens; identical to SEQ ID NO: 253285

SEQ ID NO: 743239 - RNA, 62 nt, Homo Sapiens; identical to SEQ ID NO: 253286

SEQ ID NO: 743240 - RNA, 62 nt, Homo Sapiens; identical to SEQ ID NO: 253287

SEQ ID NO: 743241 - RNA, 62 nt, Homo Sapiens; identical to SEQ ID NO: 253288

SEQ ID NO: 743242 - RNA, 62 nt, Homo Sapiens; identical to SEQ ID NO: 253289

SEQ ID NO: 743243 - RNA, 62 nt, Homo Sapiens; identical to SEQ ID NO: 253290

SEQ ID NO: 743244 - RNA, 62 nt, Homo Sapiens; identical to SEQ ID NO: 253291

SEQ ID NO: 743245 - RNA, 62 nt, Homo Sapiens; identical to SEQ ID NO: 253292

SEQ ID NO: 743246 - RNA, 62 nt, Homo Sapiens; identical to SEQ ID NO: 253293

SEQ ID NO: 743247 - RNA, 62 nt, Homo Sapiens; identical to SEQ ID NO: 253294

SEQ ID NO: 743248 - RNA, 62 nt, Homo Sapiens; identical to SEQ ID NO: 253295

SEQ ID NO: 743249 - RNA, 62 nt, Homo Sapiens; identical to SEQ ID NO: 253296

SEQ ID NO: 743250 - RNA, 62 nt, Homo Sapiens; identical to SEQ ID NO: 253297

SEQ ID NO: 743251 - RNA, 62 nt, Homo Sapiens; identical to SEQ ID NO: 253298

SEQ ID NO: 743252 - RNA, 62 nt, Homo Sapiens; identical to SEQ ID NO: 253299

SEQ ID NO: 743253 - RNA, 62 nt, Homo Sapiens; identical to SEQ ID NO: 253300

SEQ ID NO: 743254 - RNA, 62 nt, Homo Sapiens; identical to SEQ ID NO: 253301

SEQ ID NO: 743255 - RNA, 62 nt, Homo Sapiens; identical to SEQ ID NO: 253302

SEQ ID NO: 743256 - RNA, 62 nt, Homo Sapiens; identical to SEQ ID NO: 253303

SEQ ID NO: 743257 - RNA, 62 nt, Homo Sapiens; identical to SEQ ID NO: 253304

SEQ ID NO: 743258 - RNA, 62 nt, Homo Sapiens; identical to SEQ ID NO: 253305

SEQ ID NO: 743259 - RNA, 62 nt, Homo Sapiens; identical to SEQ ID NO: 253306

SEQ ID NO: 743260 - RNA, 62 nt, Homo Sapiens; identical to SEQ ID NO: 253307

SEQ ID NO: 743261 - RNA, 62 nt, Homo Sapiens; identical to SEQ ID NO: 253308

SEQ ID NO: 743262 - RNA, 62 nt, Homo Sapiens; identical to SEQ ID NO: 253309

SEQ ID NO: 743263 - RNA, 62 nt, Homo Sapiens; identical to SEQ ID NO: 253310

SEQ ID NO: 743264 - RNA, 62 nt, Homo Sapiens; identical to SEQ ID NO: 253311

SEQ ID NO: 743265 - RNA, 62 nt, Homo Sapiens; identical to SEQ ID NO: 253312

SEQ ID NO: 743266 - RNA, 62 nt, Homo Sapiens; identical to SEQ ID NO: 253313

SEQ ID NO: 743267 - RNA, 62 nt, Homo Sapiens; identical to SEQ ID NO: 253314

SEQ ID NO: 743268 - RNA, 62 nt, Homo Sapiens; identical to SEQ ID NO: 253315

SEQ ID NO: 743269 - RNA, 62 nt, Homo Sapiens; identical to SEQ ID NO: 253316

SEQ ID NO: 743270 - RNA, 62 nt, Homo Sapiens; identical to SEQ ID NO: 253317

SEQ ID NO: 743271 - RNA, 62 nt, Homo Sapiens; identical to SEQ ID NO: 253318

SEQ ID NO: 743272 - RNA, 62 nt, Homo Sapiens; identical to SEQ ID NO: 253319

SEQ ID NO: 743273 - RNA, 62 nt, Homo Sapiens; identical to SEQ ID NO: 253320

SEQ ID NO: 743274 - RNA, 62 nt, Homo Sapiens; identical to SEQ ID NO: 253321

SEQ ID NO: 743275 - RNA, 62 nt, Homo Sapiens; identical to SEQ ID NO: 253322

SEQ ID NO: 743276 - RNA, 62 nt, Homo Sapiens; identical to SEQ ID NO: 253323

SEQ ID NO: 743277 - RNA, 62 nt, Homo Sapiens; identical to SEQ ID NO: 253324

SEQ ID NO: 743278 - RNA, 62 nt, Homo Sapiens; identical to SEQ ID NO: 253325

SEQ ID NO: 743279 - RNA, 62 nt, Homo Sapiens; identical to SEQ ID NO: 253326

SEQ ID NO: 743280 - RNA, 62 nt, Homo Sapiens; identical to SEQ ID NO: 253327

SEQ ID NO: 743281 - RNA, 62 nt, Homo Sapiens; identical to SEQ ID NO: 253328

SEQ ID NO: 743282 - RNA, 62 nt, Homo Sapiens; identical to SEQ ID NO: 253329

SEQ ID NO: 743283 - RNA, 62 nt, Homo Sapiens; identical to SEQ ID NO: 253330

SEQ ID NO: 743284 - RNA, 62 nt, Homo Sapiens; identical to SEQ ID NO: 253331

SEQ ID NO: 743285 - RNA, 62 nt, Homo Sapiens; identical to SEQ ID NO: 253332

SEQ ID NO: 743286 - RNA, 62 nt, Homo Sapiens; identical to SEQ ID NO: 253333

SEQ ID NO: 743287 - RNA, 62 nt, Homo Sapiens; identical to SEQ ID NO: 253334

SEQ ID NO: 743288 - RNA, 62 nt, Homo Sapiens; identical to SEQ ID NO: 253335

SEQ ID NO: 743289 - RNA, 62 nt, Homo Sapiens; identical to SEQ ID NO: 253336

SEQ ID NO: 743290 - RNA, 62 nt, Homo Sapiens; identical to SEQ ID NO: 253337

SEQ ID NO: 743291 - RNA, 62 nt, Homo Sapiens; identical to SEQ ID NO: 253338

SEQ ID NO: 743292 - RNA, 62 nt, Homo Sapiens; identical to SEQ ID NO: 253339

SEQ ID NO: 743293 - RNA, 62 nt, Homo Sapiens; identical to SEQ ID NO: 253340

SEQ ID NO: 743294 - RNA, 62 nt, Homo Sapiens; identical to SEQ ID NO: 253341

SEQ ID NO: 743295 - RNA, 62 nt, Homo Sapiens; identical to SEQ ID NO: 253342

SEQ ID NO: 743296 - RNA, 62 nt, Homo Sapiens; identical to SEQ ID NO: 253343

SEQ ID NO: 743297 - RNA, 62 nt, Homo Sapiens; identical to SEQ ID NO: 253344

SEQ ID NO: 743298 - RNA, 62 nt, Homo Sapiens; identical to SEQ ID NO: 253345

SEQ ID NO: 743299 - RNA, 62 nt, Homo Sapiens; identical to SEQ ID NO: 253346

SEQ ID NO: 743300 - RNA, 62 nt, Homo Sapiens; identical to SEQ ID NO: 253347

SEQ ID NO: 743301 - RNA, 62 nt, Homo Sapiens; identical to SEQ ID NO: 253348

SEQ ID NO: 743302 - RNA, 62 nt, Homo Sapiens; identical to SEQ ID NO: 253349

SEQ ID NO: 743303 - RNA, 62 nt, Homo Sapiens; identical to SEQ ID NO: 253350

SEQ ID NO: 743304 - RNA, 51 nt, Homo Sapiens; identical to SEQ ID NO: 103196

SEQ ID NO: 743305 - RNA, 62 nt, Homo Sapiens; identical to SEQ ID NO: 253352

SEQ ID NO: 743306 - RNA, 62 nt, Homo Sapiens; identical to SEQ ID NO: 253353

SEQ ID NO: 743307 - RNA, 62 nt, Homo Sapiens; identical to SEQ ID NO: 253354

SEQ ID NO: 743308 - RNA, 62 nt, Homo Sapiens; identical to SEQ ID NO: 253355

SEQ ID NO: 743309 - RNA, 62 nt, Homo Sapiens; identical to SEQ ID NO: 253356

SEQ ID NO: 743310 - RNA, 62 nt, Homo Sapiens; identical to SEQ ID NO: 253357

SEQ ID NO: 743311 - RNA, 62 nt, Homo Sapiens; identical to SEQ ID NO: 253358

SEQ ID NO: 743312 - RNA, 62 nt, Homo Sapiens; identical to SEQ ID NO: 253359

SEQ ID NO: 743313 - RNA, 62 nt, Homo Sapiens; identical to SEQ ID NO: 253360

SEQ ID NO: 743314 - RNA, 62 nt, Homo Sapiens; identical to SEQ ID NO: 253361

SEQ ID NO: 743315 - RNA, 62 nt, Homo Sapiens; identical to SEQ ID NO: 253362

SEQ ID NO: 743316 - RNA, 62 nt, Homo Sapiens; identical to SEQ ID NO: 253363

SEQ ID NO: 743317 - RNA, 62 nt, Homo Sapiens; identical to SEQ ID NO: 253364

SEQ ID NO: 743318 - RNA, 62 nt, Homo Sapiens; identical to SEQ ID NO: 253365

SEQ ID NO: 743319 - RNA, 62 nt, Homo Sapiens; identical to SEQ ID NO: 253366

SEQ ID NO: 743320 - RNA, 62 nt, Homo Sapiens; identical to SEQ ID NO: 253367

SEQ ID NO: 743321 - RNA, 62 nt, Homo Sapiens; identical to SEQ ID NO: 253368

SEQ ID NO: 743322 - RNA, 62 nt, Homo Sapiens; identical to SEQ ID NO: 253369

SEQ ID NO: 743323 - RNA, 62 nt, Homo Sapiens; identical to SEQ ID NO: 253370

SEQ ID NO: 743324 - RNA, 62 nt, Homo Sapiens; identical to SEQ ID NO: 253371

SEQ ID NO: 743325 - RNA, 62 nt, Homo Sapiens; identical to SEQ ID NO: 253372

SEQ ID NO: 743326 - RNA, 62 nt, Homo Sapiens; identical to SEQ ID NO: 253373

SEQ ID NO: 743327 - RNA, 62 nt, Homo Sapiens; identical to SEQ ID NO: 253374

SEQ ID NO: 743328 - RNA, 62 nt, Homo Sapiens; identical to SEQ ID NO: 253375

SEQ ID NO: 743329 - RNA, 62 nt, Homo Sapiens; identical to SEQ ID NO: 253376

SEQ ID NO: 743330 - RNA, 62 nt, Homo Sapiens; identical to SEQ ID NO: 253377

SEQ ID NO: 743331 - RNA, 62 nt, Homo Sapiens; identical to SEQ ID NO: 253378

SEQ ID NO: 743332 - RNA, 62 nt, Homo Sapiens; identical to SEQ ID NO: 253379

SEQ ID NO: 743333 - RNA, 62 nt, Homo Sapiens; identical to SEQ ID NO: 253380

SEQ ID NO: 743334 - RNA, 62 nt, Homo Sapiens; identical to SEQ ID NO: 253381

SEQ ID NO: 743335 - RNA, 62 nt, Homo Sapiens; identical to SEQ ID NO: 253382

SEQ ID NO: 743336 - RNA, 62 nt, Homo Sapiens; identical to SEQ ID NO: 253383

SEQ ID NO: 743337 - RNA, 62 nt, Homo Sapiens; identical to SEQ ID NO: 253384

SEQ ID NO: 743338 - RNA, 62 nt, Homo Sapiens; identical to SEQ ID NO: 253385

SEQ ID NO: 743339 - RNA, 62 nt, Homo Sapiens; identical to SEQ ID NO: 253386

SEQ ID NO: 743340 - RNA, 62 nt, Homo Sapiens; identical to SEQ ID NO: 253387

SEQ ID NO: 743341 - RNA, 62 nt, Homo Sapiens; identical to SEQ ID NO: 253388

SEQ ID NO: 743342 - RNA, 62 nt, Homo Sapiens; identical to SEQ ID NO: 253389

SEQ ID NO: 743343 - RNA, 62 nt, Homo Sapiens; identical to SEQ ID NO: 253390

SEQ ID NO: 743344 - RNA, 62 nt, Homo Sapiens; identical to SEQ ID NO: 253391

SEQ ID NO: 743345 - RNA, 62 nt, Homo Sapiens; identical to SEQ ID NO: 253392

SEQ ID NO: 743346 - RNA, 62 nt, Homo Sapiens; identical to SEQ ID NO: 253393

SEQ ID NO: 743347 - RNA, 62 nt, Homo Sapiens; identical to SEQ ID NO: 253394

SEQ ID NO: 743348 - RNA, 62 nt, Homo Sapiens; identical to SEQ ID NO: 253395

SEQ ID NO: 743349 - RNA, 62 nt, Homo Sapiens; identical to SEQ ID NO: 253396

SEQ ID NO: 743350 - RNA, 62 nt, Homo Sapiens; identical to SEQ ID NO: 253397

SEQ ID NO: 743351 - RNA, 62 nt, Homo Sapiens; identical to SEQ ID NO: 253398

SEQ ID NO: 743352 - RNA, 62 nt, Homo Sapiens; identical to SEQ ID NO: 253399

SEQ ID NO: 743353 - RNA, 62 nt, Homo Sapiens; identical to SEQ ID NO: 253400

SEQ ID NO: 743354 - RNA, 62 nt, Homo Sapiens; identical to SEQ ID NO: 253401

SEQ ID NO: 743355 - RNA, 62 nt, Homo Sapiens; identical to SEQ ID NO: 253402

SEQ ID NO: 743356 - RNA, 62 nt, Homo Sapiens; identical to SEQ ID NO: 253403

SEQ ID NO: 743357 - RNA, 62 nt, Homo Sapiens; identical to SEQ ID NO: 253404

SEQ ID NO: 743358 - RNA, 62 nt, Homo Sapiens; identical to SEQ ID NO: 253405

SEQ ID NO: 743359 - RNA, 62 nt, Homo Sapiens; identical to SEQ ID NO: 253406

SEQ ID NO: 743360 - RNA, 62 nt, Homo Sapiens; identical to SEQ ID NO: 253407

SEQ ID NO: 743361 - RNA, 62 nt, Homo Sapiens; identical to SEQ ID NO: 253408

SEQ ID NO: 743362 - RNA, 62 nt, Homo Sapiens; identical to SEQ ID NO: 253409

SEQ ID NO: 743363 - RNA, 62 nt, Homo Sapiens; identical to SEQ ID NO: 253410

SEQ ID NO: 743364 - RNA, 62 nt, Homo Sapiens; identical to SEQ ID NO: 253411

SEQ ID NO: 743365 - RNA, 62 nt, Homo Sapiens; identical to SEQ ID NO: 253412

SEQ ID NO: 743366 - RNA, 62 nt, Homo Sapiens; identical to SEQ ID NO: 253413

SEQ ID NO: 743367 - RNA, 62 nt, Homo Sapiens; identical to SEQ ID NO: 253414

SEQ ID NO: 743368 - RNA, 62 nt, Homo Sapiens; identical to SEQ ID NO: 253415

SEQ ID NO: 743369 - RNA, 62 nt, Homo Sapiens; identical to SEQ ID NO: 253416

SEQ ID NO: 743370 - RNA, 62 nt, Homo Sapiens; identical to SEQ ID NO: 253417

SEQ ID NO: 743371 - RNA, 62 nt, Homo Sapiens; identical to SEQ ID NO: 253418

SEQ ID NO: 743372 - RNA, 62 nt, Homo Sapiens; identical to SEQ ID NO: 253419

SEQ ID NO: 743373 - RNA, 62 nt, Homo Sapiens; identical to SEQ ID NO: 253420

SEQ ID NO: 743374 - RNA, 62 nt, Homo Sapiens; identical to SEQ ID NO: 253421

SEQ ID NO: 743375 - RNA, 62 nt, Homo Sapiens; identical to SEQ ID NO: 253422

SEQ ID NO: 743376 - RNA, 62 nt, Homo Sapiens; identical to SEQ ID NO: 253423

SEQ ID NO: 743377 - RNA, 62 nt, Homo Sapiens; identical to SEQ ID NO: 253424

SEQ ID NO: 743378 - RNA, 62 nt, Homo Sapiens; identical to SEQ ID NO: 253425

SEQ ID NO: 743379 - RNA, 62 nt, Homo Sapiens; identical to SEQ ID NO: 253426

SEQ ID NO: 743380 - RNA, 62 nt, Homo Sapiens; identical to SEQ ID NO: 253427

SEQ ID NO: 743381 - RNA, 62 nt, Homo Sapiens; identical to SEQ ID NO: 253428

SEQ ID NO: 743382 - RNA, 62 nt, Homo Sapiens; identical to SEQ ID NO: 253429

SEQ ID NO: 743383 - RNA, 62 nt, Homo Sapiens; identical to SEQ ID NO: 253430

SEQ ID NO: 743384 - RNA, 62 nt, Homo Sapiens; identical to SEQ ID NO: 253431

SEQ ID NO: 743385 - RNA, 62 nt, Homo Sapiens; identical to SEQ ID NO: 253432

SEQ ID NO: 743386 - RNA, 62 nt, Homo Sapiens; identical to SEQ ID NO: 253433

SEQ ID NO: 743387 - RNA, 62 nt, Homo Sapiens; identical to SEQ ID NO: 253434

SEQ ID NO: 743388 - RNA, 62 nt, Homo Sapiens; identical to SEQ ID NO: 253435

SEQ ID NO: 743389 - RNA, 62 nt, Homo Sapiens; identical to SEQ ID NO: 253436

SEQ ID NO: 743390 - RNA, 62 nt, Homo Sapiens; identical to SEQ ID NO: 253437

SEQ ID NO: 743391 - RNA, 62 nt, Homo Sapiens; identical to SEQ ID NO: 253438

SEQ ID NO: 743392 - RNA, 62 nt, Homo Sapiens; identical to SEQ ID NO: 253439

SEQ ID NO: 743393 - RNA, 62 nt, Homo Sapiens; identical to SEQ ID NO: 253440

SEQ ID NO: 743394 - RNA, 62 nt, Homo Sapiens; identical to SEQ ID NO: 253441

SEQ ID NO: 743395 - RNA, 62 nt, Homo Sapiens; identical to SEQ ID NO: 253442

SEQ ID NO: 743396 - RNA, 62 nt, Homo Sapiens; identical to SEQ ID NO: 253443

SEQ ID NO: 743397 - RNA, 66 nt, Homo Sapiens; identical to SEQ ID NO: 253444

SEQ ID NO: 743398 - RNA, 66 nt, Homo Sapiens; identical to SEQ ID NO: 253445

SEQ ID NO: 743399 - RNA, 66 nt, Homo Sapiens; identical to SEQ ID NO: 253446

SEQ ID NO: 743400 - RNA, 66 nt, Homo Sapiens; identical to SEQ ID NO: 253447

SEQ ID NO: 743401 - RNA, 66 nt, Homo Sapiens; identical to SEQ ID NO: 253448

SEQ ID NO: 743402 - RNA, 66 nt, Homo Sapiens; identical to SEQ ID NO: 253449

SEQ ID NO: 743403 - RNA, 66 nt, Homo Sapiens; identical to SEQ ID NO: 253450

SEQ ID NO: 743404 - RNA, 66 nt, Homo Sapiens; identical to SEQ ID NO: 253451

SEQ ID NO: 743405 - RNA, 66 nt, Homo Sapiens; identical to SEQ ID NO: 253452

SEQ ID NO: 743406 - RNA, 66 nt, Homo Sapiens; identical to SEQ ID NO: 253453

SEQ ID NO: 743407 - RNA, 66 nt, Homo Sapiens; identical to SEQ ID NO: 253454

SEQ ID NO: 743408 - RNA, 58 nt, Homo Sapiens; identical to SEQ ID NO: 102991

SEQ ID NO: 743409 - RNA, 66 nt, Homo Sapiens; identical to SEQ ID NO: 253456

SEQ ID NO: 743410 - RNA, 66 nt, Homo Sapiens; identical to SEQ ID NO: 253457

SEQ ID NO: 743411 - RNA, 66 nt, Homo Sapiens; identical to SEQ ID NO: 253458

SEQ ID NO: 743412 - RNA, 66 nt, Homo Sapiens; identical to SEQ ID NO: 253459

SEQ ID NO: 743413 - RNA, 66 nt, Homo Sapiens; identical to SEQ ID NO: 253460

SEQ ID NO: 743414 - RNA, 66 nt, Homo Sapiens; identical to SEQ ID NO: 253461

SEQ ID NO: 743415 - RNA, 66 nt, Homo Sapiens; identical to SEQ ID NO: 253462

SEQ ID NO: 743416 - RNA, 66 nt, Homo Sapiens; identical to SEQ ID NO: 253463

SEQ ID NO: 743417 - RNA, 66 nt, Homo Sapiens; identical to SEQ ID NO: 253464

SEQ ID NO: 743418 - RNA, 66 nt, Homo Sapiens; identical to SEQ ID NO: 253465

SEQ ID NO: 743419 - RNA, 66 nt, Homo Sapiens; identical to SEQ ID NO: 253466

SEQ ID NO: 743420 - RNA, 66 nt, Homo Sapiens; identical to SEQ ID NO: 253467

SEQ ID NO: 743421 - RNA, 66 nt, Homo Sapiens; identical to SEQ ID NO: 253468

SEQ ID NO: 743422 - RNA, 66 nt, Homo Sapiens; identical to SEQ ID NO: 253469

SEQ ID NO: 743423 - RNA, 66 nt, Homo Sapiens; identical to SEQ ID NO: 253470

SEQ ID NO: 743424 - RNA, 66 nt, Homo Sapiens; identical to SEQ ID NO: 253471

SEQ ID NO: 743425 - RNA, 66 nt, Homo Sapiens; identical to SEQ ID NO: 253472

SEQ ID NO: 743426 - RNA, 66 nt, Homo Sapiens; identical to SEQ ID NO: 253473

SEQ ID NO: 743427 - RNA, 66 nt, Homo Sapiens; identical to SEQ ID NO: 253474

SEQ ID NO: 743428 - RNA, 66 nt, Homo Sapiens; identical to SEQ ID NO: 253475

SEQ ID NO: 743429 - RNA, 66 nt, Homo Sapiens; identical to SEQ ID NO: 253476

SEQ ID NO: 743430 - RNA, 66 nt, Homo Sapiens; identical to SEQ ID NO: 253477

SEQ ID NO: 743431 - RNA, 53 nt, Homo Sapiens; identical to SEQ ID NO: 103014

SEQ ID NO: 743432 - RNA, 66 nt, Homo Sapiens; identical to SEQ ID NO: 253479

SEQ ID NO: 743433 - RNA, 66 nt, Homo Sapiens; identical to SEQ ID NO: 253480

SEQ ID NO: 743434 - RNA, 66 nt, Homo Sapiens; identical to SEQ ID NO: 253481

SEQ ID NO: 743435 - RNA, 66 nt, Homo Sapiens; identical to SEQ ID NO: 253482

SEQ ID NO: 743436 - RNA, 66 nt, Homo Sapiens; identical to SEQ ID NO: 253483

SEQ ID NO: 743437 - RNA, 66 nt, Homo Sapiens; identical to SEQ ID NO: 253484

SEQ ID NO: 743438 - RNA, 66 nt, Homo Sapiens; identical to SEQ ID NO: 253485

SEQ ID NO: 743439 - RNA, 66 nt, Homo Sapiens; identical to SEQ ID NO: 253486

SEQ ID NO: 743440 - RNA, 66 nt, Homo Sapiens; identical to SEQ ID NO: 253487

SEQ ID NO: 743441 - RNA, 66 nt, Homo Sapiens; identical to SEQ ID NO: 253488

SEQ ID NO: 743442 - RNA, 66 nt, Homo Sapiens; identical to SEQ ID NO: 253489

SEQ ID NO: 743443 - RNA, 66 nt, Homo Sapiens; identical to SEQ ID NO: 253490

SEQ ID NO: 743444 - RNA, 66 nt, Homo Sapiens; identical to SEQ ID NO: 253491

SEQ ID NO: 743445 - RNA, 66 nt, Homo Sapiens; identical to SEQ ID NO: 253492

SEQ ID NO: 743446 - RNA, 66 nt, Homo Sapiens; identical to SEQ ID NO: 253493

SEQ ID NO: 743447 - RNA, 66 nt, Homo Sapiens; identical to SEQ ID NO: 253494

SEQ ID NO: 743448 - RNA, 66 nt, Homo Sapiens; identical to SEQ ID NO: 253495

SEQ ID NO: 743449 - RNA, 66 nt, Homo Sapiens; identical to SEQ ID NO: 253496

SEQ ID NO: 743450 - RNA, 66 nt, Homo Sapiens; identical to SEQ ID NO: 253497

SEQ ID NO: 743451 - RNA, 66 nt, Homo Sapiens; identical to SEQ ID NO: 253498

SEQ ID NO: 743452 - RNA, 66 nt, Homo Sapiens; identical to SEQ ID NO: 253499

SEQ ID NO: 743453 - RNA, 66 nt, Homo Sapiens; identical to SEQ ID NO: 253500

SEQ ID NO: 743454 - RNA, 66 nt, Homo Sapiens; identical to SEQ ID NO: 253501

SEQ ID NO: 743455 - RNA, 66 nt, Homo Sapiens; identical to SEQ ID NO: 253502

SEQ ID NO: 743456 - RNA, 66 nt, Homo Sapiens; identical to SEQ ID NO: 253503

SEQ ID NO: 743457 - RNA, 66 nt, Homo Sapiens; identical to SEQ ID NO: 253504

SEQ ID NO: 743458 - RNA, 66 nt, Homo Sapiens; identical to SEQ ID NO: 253505

SEQ ID NO: 743459 - RNA, 66 nt, Homo Sapiens; identical to SEQ ID NO: 253506

SEQ ID NO: 743460 - RNA, 66 nt, Homo Sapiens; identical to SEQ ID NO: 253507

SEQ ID NO: 743461 - RNA, 66 nt, Homo Sapiens; identical to SEQ ID NO: 253508

SEQ ID NO: 743462 - RNA, 66 nt, Homo Sapiens; identical to SEQ ID NO: 253509

SEQ ID NO: 743463 - RNA, 66 nt, Homo Sapiens; identical to SEQ ID NO: 253510

SEQ ID NO: 743464 - RNA, 66 nt, Homo Sapiens; identical to SEQ ID NO: 253511

SEQ ID NO: 743465 - RNA, 66 nt, Homo Sapiens; identical to SEQ ID NO: 253512

SEQ ID NO: 743466 - RNA, 66 nt, Homo Sapiens; identical to SEQ ID NO: 253513

SEQ ID NO: 743467 - RNA, 66 nt, Homo Sapiens; identical to SEQ ID NO: 253514

SEQ ID NO: 743468 - RNA, 66 nt, Homo Sapiens; identical to SEQ ID NO: 253515

SEQ ID NO: 743469 - RNA, 66 nt, Homo Sapiens; identical to SEQ ID NO: 253516

SEQ ID NO: 743470 - RNA, 66 nt, Homo Sapiens; identical to SEQ ID NO: 253517

SEQ ID NO: 743471 - RNA, 66 nt, Homo Sapiens; identical to SEQ ID NO: 253518

SEQ ID NO: 743472 - RNA, 66 nt, Homo Sapiens; identical to SEQ ID NO: 253519

SEQ ID NO: 743473 - RNA, 66 nt, Homo Sapiens; identical to SEQ ID NO: 253520

SEQ ID NO: 743474 - RNA, 66 nt, Homo Sapiens; identical to SEQ ID NO: 253521

SEQ ID NO: 743475 - RNA, 66 nt, Homo Sapiens; identical to SEQ ID NO: 253522

SEQ ID NO: 743476 - RNA, 66 nt, Homo Sapiens; identical to SEQ ID NO: 253523

SEQ ID NO: 743477 - RNA, 66 nt, Homo Sapiens; identical to SEQ ID NO: 253524

SEQ ID NO: 743478 - RNA, 66 nt, Homo Sapiens; identical to SEQ ID NO: 253525

SEQ ID NO: 743479 - RNA, 66 nt, Homo Sapiens; identical to SEQ ID NO: 253526

SEQ ID NO: 743480 - RNA, 66 nt, Homo Sapiens; identical to SEQ ID NO: 253527

SEQ ID NO: 743481 - RNA, 66 nt, Homo Sapiens; identical to SEQ ID NO: 253528

SEQ ID NO: 743482 - RNA, 66 nt, Homo Sapiens; identical to SEQ ID NO: 253529

SEQ ID NO: 743483 - RNA, 66 nt, Homo Sapiens; identical to SEQ ID NO: 253530

SEQ ID NO: 743484 - RNA, 66 nt, Homo Sapiens; identical to SEQ ID NO: 253531

SEQ ID NO: 743485 - RNA, 66 nt, Homo Sapiens; identical to SEQ ID NO: 253532

SEQ ID NO: 743486 - RNA, 66 nt, Homo Sapiens; identical to SEQ ID NO: 253533

SEQ ID NO: 743487 - RNA, 66 nt, Homo Sapiens; identical to SEQ ID NO: 253534

SEQ ID NO: 743488 - RNA, 66 nt, Homo Sapiens; identical to SEQ ID NO: 253535

SEQ ID NO: 743489 - RNA, 66 nt, Homo Sapiens; identical to SEQ ID NO: 253536

SEQ ID NO: 743490 - RNA, 66 nt, Homo Sapiens; identical to SEQ ID NO: 253537

SEQ ID NO: 743491 - RNA, 66 nt, Homo Sapiens; identical to SEQ ID NO: 253538

SEQ ID NO: 743492 - RNA, 66 nt, Homo Sapiens; identical to SEQ ID NO: 253539

SEQ ID NO: 743493 - RNA, 66 nt, Homo Sapiens; identical to SEQ ID NO: 253540

SEQ ID NO: 743494 - RNA, 66 nt, Homo Sapiens; identical to SEQ ID NO: 253541

SEQ ID NO: 743495 - RNA, 66 nt, Homo Sapiens; identical to SEQ ID NO: 253542

SEQ ID NO: 743496 - RNA, 66 nt, Homo Sapiens; identical to SEQ ID NO: 253543

SEQ ID NO: 743497 - RNA, 66 nt, Homo Sapiens; identical to SEQ ID NO: 253544

SEQ ID NO: 743498 - RNA, 66 nt, Homo Sapiens; identical to SEQ ID NO: 253545

SEQ ID NO: 743499 - RNA, 66 nt, Homo Sapiens; identical to SEQ ID NO: 253546

SEQ ID NO: 743500 - RNA, 66 nt, Homo Sapiens; identical to SEQ ID NO: 253547

SEQ ID NO: 743501 - RNA, 66 nt, Homo Sapiens; identical to SEQ ID NO: 253548

SEQ ID NO: 743502 - RNA, 66 nt, Homo Sapiens; identical to SEQ ID NO: 253549

SEQ ID NO: 743503 - RNA, 66 nt, Homo Sapiens; identical to SEQ ID NO: 253550

SEQ ID NO: 743504 - RNA, 66 nt, Homo Sapiens; identical to SEQ ID NO: 253551

SEQ ID NO: 743505 - RNA, 66 nt, Homo Sapiens; identical to SEQ ID NO: 253552

SEQ ID NO: 743506 - RNA, 66 nt, Homo Sapiens; identical to SEQ ID NO: 253553

SEQ ID NO: 743507 - RNA, 66 nt, Homo Sapiens; identical to SEQ ID NO: 253554

SEQ ID NO: 743508 - RNA, 66 nt, Homo Sapiens; identical to SEQ ID NO: 253555

SEQ ID NO: 743509 - RNA, 66 nt, Homo Sapiens; identical to SEQ ID NO: 253556

SEQ ID NO: 743510 - RNA, 66 nt, Homo Sapiens; identical to SEQ ID NO: 253557

SEQ ID NO: 743511 - RNA, 66 nt, Homo Sapiens; identical to SEQ ID NO: 253558

SEQ ID NO: 743512 - RNA, 66 nt, Homo Sapiens; identical to SEQ ID NO: 253559

SEQ ID NO: 743513 - RNA, 66 nt, Homo Sapiens; identical to SEQ ID NO: 253560

SEQ ID NO: 743514 - RNA, 66 nt, Homo Sapiens; identical to SEQ ID NO: 253561

SEQ ID NO: 743515 - RNA, 60 nt, Homo Sapiens; identical to SEQ ID NO: 103098

SEQ ID NO: 743516 - RNA, 66 nt, Homo Sapiens; identical to SEQ ID NO: 253563

SEQ ID NO: 743517 - RNA, 66 nt, Homo Sapiens; identical to SEQ ID NO: 253564

SEQ ID NO: 743518 - RNA, 66 nt, Homo Sapiens; identical to SEQ ID NO: 253565

SEQ ID NO: 743519 - RNA, 66 nt, Homo Sapiens; identical to SEQ ID NO: 253566

SEQ ID NO: 743520 - RNA, 66 nt, Homo Sapiens; identical to SEQ ID NO: 253567

SEQ ID NO: 743521 - RNA, 66 nt, Homo Sapiens; identical to SEQ ID NO: 253568

SEQ ID NO: 743522 - RNA, 66 nt, Homo Sapiens; identical to SEQ ID NO: 253569

SEQ ID NO: 743523 - RNA, 66 nt, Homo Sapiens; identical to SEQ ID NO: 253570

SEQ ID NO: 743524 - RNA, 66 nt, Homo Sapiens; identical to SEQ ID NO: 253571

SEQ ID NO: 743525 - RNA, 66 nt, Homo Sapiens; identical to SEQ ID NO: 253572

SEQ ID NO: 743526 - RNA, 66 nt, Homo Sapiens; identical to SEQ ID NO: 253573

SEQ ID NO: 743527 - RNA, 66 nt, Homo Sapiens; identical to SEQ ID NO: 253574

SEQ ID NO: 743528 - RNA, 66 nt, Homo Sapiens; identical to SEQ ID NO: 253575

SEQ ID NO: 743529 - RNA, 66 nt, Homo Sapiens; identical to SEQ ID NO: 253576

SEQ ID NO: 743530 - RNA, 66 nt, Homo Sapiens; identical to SEQ ID NO: 253577

SEQ ID NO: 743531 - RNA, 66 nt, Homo Sapiens; identical to SEQ ID NO: 253578

SEQ ID NO: 743532 - RNA, 66 nt, Homo Sapiens; identical to SEQ ID NO: 253579

SEQ ID NO: 743533 - RNA, 66 nt, Homo Sapiens; identical to SEQ ID NO: 253580

SEQ ID NO: 743534 - RNA, 66 nt, Homo Sapiens; identical to SEQ ID NO: 253581

SEQ ID NO: 743535 - RNA, 66 nt, Homo Sapiens; identical to SEQ ID NO: 253582

SEQ ID NO: 743536 - RNA, 66 nt, Homo Sapiens; identical to SEQ ID NO: 253583

SEQ ID NO: 743537 - RNA, 66 nt, Homo Sapiens; identical to SEQ ID NO: 253584

SEQ ID NO: 743538 - RNA, 66 nt, Homo Sapiens; identical to SEQ ID NO: 253585

SEQ ID NO: 743539 - RNA, 66 nt, Homo Sapiens; identical to SEQ ID NO: 253586

SEQ ID NO: 743540 - RNA, 66 nt, Homo Sapiens; identical to SEQ ID NO: 253587

SEQ ID NO: 743541 - RNA, 66 nt, Homo Sapiens; identical to SEQ ID NO: 253588

SEQ ID NO: 743542 - RNA, 66 nt, Homo Sapiens; identical to SEQ ID NO: 253589

SEQ ID NO: 743543 - RNA, 66 nt, Homo Sapiens; identical to SEQ ID NO: 253590

SEQ ID NO: 743544 - RNA, 66 nt, Homo Sapiens; identical to SEQ ID NO: 253591

SEQ ID NO: 743545 - RNA, 66 nt, Homo Sapiens; identical to SEQ ID NO: 253592

SEQ ID NO: 743546 - RNA, 66 nt, Homo Sapiens; identical to SEQ ID NO: 253593

SEQ ID NO: 743547 - RNA, 66 nt, Homo Sapiens; identical to SEQ ID NO: 253594

SEQ ID NO: 743548 - RNA, 66 nt, Homo Sapiens; identical to SEQ ID NO: 253595

SEQ ID NO: 743549 - RNA, 66 nt, Homo Sapiens; identical to SEQ ID NO: 253596

SEQ ID NO: 743550 - RNA, 66 nt, Homo Sapiens; identical to SEQ ID NO: 253597

SEQ ID NO: 743551 - RNA, 66 nt, Homo Sapiens; identical to SEQ ID NO: 253598

SEQ ID NO: 743552 - RNA, 66 nt, Homo Sapiens; identical to SEQ ID NO: 253599

SEQ ID NO: 743553 - RNA, 66 nt, Homo Sapiens; identical to SEQ ID NO: 253600

SEQ ID NO: 743554 - RNA, 66 nt, Homo Sapiens; identical to SEQ ID NO: 253601

SEQ ID NO: 743555 - RNA, 66 nt, Homo Sapiens; identical to SEQ ID NO: 253602

SEQ ID NO: 743556 - RNA, 66 nt, Homo Sapiens; identical to SEQ ID NO: 253603

SEQ ID NO: 743557 - RNA, 66 nt, Homo Sapiens; identical to SEQ ID NO: 253604

SEQ ID NO: 743558 - RNA, 66 nt, Homo Sapiens; identical to SEQ ID NO: 253605

SEQ ID NO: 743559 - RNA, 66 nt, Homo Sapiens; identical to SEQ ID NO: 253606

SEQ ID NO: 743560 - RNA, 66 nt, Homo Sapiens; identical to SEQ ID NO: 253607

SEQ ID NO: 743561 - RNA, 66 nt, Homo Sapiens; identical to SEQ ID NO: 253608

SEQ ID NO: 743562 - RNA, 66 nt, Homo Sapiens; identical to SEQ ID NO: 253609

SEQ ID NO: 743563 - RNA, 66 nt, Homo Sapiens; identical to SEQ ID NO: 253610

SEQ ID NO: 743564 - RNA, 66 nt, Homo Sapiens; identical to SEQ ID NO: 253611

SEQ ID NO: 743565 - RNA, 66 nt, Homo Sapiens; identical to SEQ ID NO: 253612

SEQ ID NO: 743566 - RNA, 66 nt, Homo Sapiens; identical to SEQ ID NO: 253613

SEQ ID NO: 743567 - RNA, 66 nt, Homo Sapiens; identical to SEQ ID NO: 253614

SEQ ID NO: 743568 - RNA, 66 nt, Homo Sapiens; identical to SEQ ID NO: 253615

SEQ ID NO: 743569 - RNA, 66 nt, Homo Sapiens; identical to SEQ ID NO: 253616

SEQ ID NO: 743570 - RNA, 66 nt, Homo Sapiens; identical to SEQ ID NO: 253617

SEQ ID NO: 743571 - RNA, 66 nt, Homo Sapiens; identical to SEQ ID NO: 253618

SEQ ID NO: 743572 - RNA, 66 nt, Homo Sapiens; identical to SEQ ID NO: 253619

SEQ ID NO: 743573 - RNA, 66 nt, Homo Sapiens; identical to SEQ ID NO: 253620

SEQ ID NO: 743574 - RNA, 66 nt, Homo Sapiens; identical to SEQ ID NO: 253621

SEQ ID NO: 743575 - RNA, 66 nt, Homo Sapiens; identical to SEQ ID NO: 253622

SEQ ID NO: 743576 - RNA, 66 nt, Homo Sapiens; identical to SEQ ID NO: 253623

SEQ ID NO: 743577 - RNA, 66 nt, Homo Sapiens; identical to SEQ ID NO: 253624

SEQ ID NO: 743578 - RNA, 66 nt, Homo Sapiens; identical to SEQ ID NO: 253625

SEQ ID NO: 743579 - RNA, 66 nt, Homo Sapiens; identical to SEQ ID NO: 253626

SEQ ID NO: 743580 - RNA, 66 nt, Homo Sapiens; identical to SEQ ID NO: 253627

SEQ ID NO: 743581 - RNA, 66 nt, Homo Sapiens; identical to SEQ ID NO: 253628

SEQ ID NO: 743582 - RNA, 66 nt, Homo Sapiens; identical to SEQ ID NO: 253629

SEQ ID NO: 743583 - RNA, 66 nt, Homo Sapiens; identical to SEQ ID NO: 253630

SEQ ID NO: 743584 - RNA, 66 nt, Homo Sapiens; identical to SEQ ID NO: 253631

SEQ ID NO: 743585 - RNA, 66 nt, Homo Sapiens; identical to SEQ ID NO: 253632

SEQ ID NO: 743586 - RNA, 66 nt, Homo Sapiens; identical to SEQ ID NO: 253633

SEQ ID NO: 743587 - RNA, 66 nt, Homo Sapiens; identical to SEQ ID NO: 253634

SEQ ID NO: 743588 - RNA, 66 nt, Homo Sapiens; identical to SEQ ID NO: 253635

SEQ ID NO: 743589 - RNA, 66 nt, Homo Sapiens; identical to SEQ ID NO: 253636

SEQ ID NO: 743590 - RNA, 66 nt, Homo Sapiens; identical to SEQ ID NO: 253637

SEQ ID NO: 743591 - RNA, 66 nt, Homo Sapiens; identical to SEQ ID NO: 253638

SEQ ID NO: 743592 - RNA, 66 nt, Homo Sapiens; identical to SEQ ID NO: 253639

SEQ ID NO: 743593 - RNA, 66 nt, Homo Sapiens; identical to SEQ ID NO: 253640

SEQ ID NO: 743594 - RNA, 66 nt, Homo Sapiens; identical to SEQ ID NO: 253641

SEQ ID NO: 743595 - RNA, 66 nt, Homo Sapiens; identical to SEQ ID NO: 253642

SEQ ID NO: 743596 - RNA, 66 nt, Homo Sapiens; identical to SEQ ID NO: 253643

SEQ ID NO: 743597 - RNA, 66 nt, Homo Sapiens; identical to SEQ ID NO: 253644

SEQ ID NO: 743598 - RNA, 66 nt, Homo Sapiens; identical to SEQ ID NO: 253645

SEQ ID NO: 743599 - RNA, 66 nt, Homo Sapiens; identical to SEQ ID NO: 253646

SEQ ID NO: 743600 - RNA, 66 nt, Homo Sapiens; identical to SEQ ID NO: 253647

SEQ ID NO: 743601 - RNA, 66 nt, Homo Sapiens; identical to SEQ ID NO: 253648

SEQ ID NO: 743602 - RNA, 66 nt, Homo Sapiens; identical to SEQ ID NO: 253649

SEQ ID NO: 743603 - RNA, 66 nt, Homo Sapiens; identical to SEQ ID NO: 253650

SEQ ID NO: 743604 - RNA, 66 nt, Homo Sapiens; identical to SEQ ID NO: 253651

SEQ ID NO: 743605 - RNA, 66 nt, Homo Sapiens; identical to SEQ ID NO: 253652

SEQ ID NO: 743606 - RNA, 66 nt, Homo Sapiens; identical to SEQ ID NO: 253653

SEQ ID NO: 743607 - RNA, 66 nt, Homo Sapiens; identical to SEQ ID NO: 253654

SEQ ID NO: 743608 - RNA, 66 nt, Homo Sapiens; identical to SEQ ID NO: 253655

SEQ ID NO: 743609 - RNA, 66 nt, Homo Sapiens; identical to SEQ ID NO: 253656

SEQ ID NO: 743610 - RNA, 66 nt, Homo Sapiens; identical to SEQ ID NO: 253657

SEQ ID NO: 743611 - RNA, 66 nt, Homo Sapiens; identical to SEQ ID NO: 253658

SEQ ID NO: 743612 - RNA, 63 nt, Homo Sapiens; identical to SEQ ID NO: 103195

SEQ ID NO: 743613 - RNA, 51 nt, Homo Sapiens; identical to SEQ ID NO: 103196

SEQ ID NO: 743614 - RNA, 66 nt, Homo Sapiens; identical to SEQ ID NO: 253661

SEQ ID NO: 743615 - RNA, 66 nt, Homo Sapiens; identical to SEQ ID NO: 253662

SEQ ID NO: 743616 - RNA, 66 nt, Homo Sapiens; identical to SEQ ID NO: 253663

SEQ ID NO: 743617 - RNA, 66 nt, Homo Sapiens; identical to SEQ ID NO: 253664

SEQ ID NO: 743618 - RNA, 66 nt, Homo Sapiens; identical to SEQ ID NO: 253665

SEQ ID NO: 743619 - RNA, 66 nt, Homo Sapiens; identical to SEQ ID NO: 253666

SEQ ID NO: 743620 - RNA, 66 nt, Homo Sapiens; identical to SEQ ID NO: 253667

SEQ ID NO: 743621 - RNA, 66 nt, Homo Sapiens; identical to SEQ ID NO: 253668

SEQ ID NO: 743622 - RNA, 66 nt, Homo Sapiens; identical to SEQ ID NO: 253669

SEQ ID NO: 743623 - RNA, 66 nt, Homo Sapiens; identical to SEQ ID NO: 253670

SEQ ID NO: 743624 - RNA, 66 nt, Homo Sapiens; identical to SEQ ID NO: 253671

SEQ ID NO: 743625 - RNA, 66 nt, Homo Sapiens; identical to SEQ ID NO: 253672

SEQ ID NO: 743626 - RNA, 66 nt, Homo Sapiens; identical to SEQ ID NO: 253673

SEQ ID NO: 743627 - RNA, 66 nt, Homo Sapiens; identical to SEQ ID NO: 253674

SEQ ID NO: 743628 - RNA, 66 nt, Homo Sapiens; identical to SEQ ID NO: 253675

SEQ ID NO: 743629 - RNA, 66 nt, Homo Sapiens; identical to SEQ ID NO: 253676

SEQ ID NO: 743630 - RNA, 66 nt, Homo Sapiens; identical to SEQ ID NO: 253677

SEQ ID NO: 743631 - RNA, 66 nt, Homo Sapiens; identical to SEQ ID NO: 253678

SEQ ID NO: 743632 - RNA, 66 nt, Homo Sapiens; identical to SEQ ID NO: 253679

SEQ ID NO: 743633 - RNA, 66 nt, Homo Sapiens; identical to SEQ ID NO: 253680

SEQ ID NO: 743634 - RNA, 66 nt, Homo Sapiens; identical to SEQ ID NO: 253681

SEQ ID NO: 743635 - RNA, 66 nt, Homo Sapiens; identical to SEQ ID NO: 253682

SEQ ID NO: 743636 - RNA, 66 nt, Homo Sapiens; identical to SEQ ID NO: 253683

SEQ ID NO: 743637 - RNA, 66 nt, Homo Sapiens; identical to SEQ ID NO: 253684

SEQ ID NO: 743638 - RNA, 66 nt, Homo Sapiens; identical to SEQ ID NO: 253685

SEQ ID NO: 743639 - RNA, 66 nt, Homo Sapiens; identical to SEQ ID NO: 253686

SEQ ID NO: 743640 - RNA, 66 nt, Homo Sapiens; identical to SEQ ID NO: 253687

SEQ ID NO: 743641 - RNA, 66 nt, Homo Sapiens; identical to SEQ ID NO: 253688

SEQ ID NO: 743642 - RNA, 66 nt, Homo Sapiens; identical to SEQ ID NO: 253689

SEQ ID NO: 743643 - RNA, 66 nt, Homo Sapiens; identical to SEQ ID NO: 253690

SEQ ID NO: 743644 - RNA, 66 nt, Homo Sapiens; identical to SEQ ID NO: 253691

SEQ ID NO: 743645 - RNA, 66 nt, Homo Sapiens; identical to SEQ ID NO: 253692

SEQ ID NO: 743646 - RNA, 66 nt, Homo Sapiens; identical to SEQ ID NO: 253693

SEQ ID NO: 743647 - RNA, 66 nt, Homo Sapiens; identical to SEQ ID NO: 253694

SEQ ID NO: 743648 - RNA, 66 nt, Homo Sapiens; identical to SEQ ID NO: 253695

SEQ ID NO: 743649 - RNA, 66 nt, Homo Sapiens; identical to SEQ ID NO: 253696

SEQ ID NO: 743650 - RNA, 66 nt, Homo Sapiens; identical to SEQ ID NO: 253697

SEQ ID NO: 743651 - RNA, 66 nt, Homo Sapiens; identical to SEQ ID NO: 253698

SEQ ID NO: 743652 - RNA, 66 nt, Homo Sapiens; identical to SEQ ID NO: 253699

SEQ ID NO: 743653 - RNA, 66 nt, Homo Sapiens; identical to SEQ ID NO: 253700

SEQ ID NO: 743654 - RNA, 66 nt, Homo Sapiens; identical to SEQ ID NO: 253701

SEQ ID NO: 743655 - RNA, 66 nt, Homo Sapiens; identical to SEQ ID NO: 253702

SEQ ID NO: 743656 - RNA, 66 nt, Homo Sapiens; identical to SEQ ID NO: 253703

SEQ ID NO: 743657 - RNA, 66 nt, Homo Sapiens; identical to SEQ ID NO: 253704

SEQ ID NO: 743658 - RNA, 66 nt, Homo Sapiens; identical to SEQ ID NO: 253705

SEQ ID NO: 743659 - RNA, 66 nt, Homo Sapiens; identical to SEQ ID NO: 253706

SEQ ID NO: 743660 - RNA, 66 nt, Homo Sapiens; identical to SEQ ID NO: 253707

SEQ ID NO: 743661 - RNA, 66 nt, Homo Sapiens; identical to SEQ ID NO: 253708

SEQ ID NO: 743662 - RNA, 66 nt, Homo Sapiens; identical to SEQ ID NO: 253709

SEQ ID NO: 743663 - RNA, 66 nt, Homo Sapiens; identical to SEQ ID NO: 253710

SEQ ID NO: 743664 - RNA, 66 nt, Homo Sapiens; identical to SEQ ID NO: 253711

SEQ ID NO: 743665 - RNA, 66 nt, Homo Sapiens; identical to SEQ ID NO: 253712

SEQ ID NO: 743666 - RNA, 66 nt, Homo Sapiens; identical to SEQ ID NO: 253713

SEQ ID NO: 743667 - RNA, 66 nt, Homo Sapiens; identical to SEQ ID NO: 253714

SEQ ID NO: 743668 - RNA, 66 nt, Homo Sapiens; identical to SEQ ID NO: 253715

SEQ ID NO: 743669 - RNA, 66 nt, Homo Sapiens; identical to SEQ ID NO: 253716

SEQ ID NO: 743670 - RNA, 66 nt, Homo Sapiens; identical to SEQ ID NO: 253717

SEQ ID NO: 743671 - RNA, 66 nt, Homo Sapiens; identical to SEQ ID NO: 253718

SEQ ID NO: 743672 - RNA, 66 nt, Homo Sapiens; identical to SEQ ID NO: 253719

SEQ ID NO: 743673 - RNA, 66 nt, Homo Sapiens; identical to SEQ ID NO: 253720

SEQ ID NO: 743674 - RNA, 66 nt, Homo Sapiens; identical to SEQ ID NO: 253721

SEQ ID NO: 743675 - RNA, 66 nt, Homo Sapiens; identical to SEQ ID NO: 253722

SEQ ID NO: 743676 - RNA, 66 nt, Homo Sapiens; identical to SEQ ID NO: 253723

SEQ ID NO: 743677 - RNA, 66 nt, Homo Sapiens; identical to SEQ ID NO: 253724

SEQ ID NO: 743678 - RNA, 66 nt, Homo Sapiens; identical to SEQ ID NO: 253725

SEQ ID NO: 743679 - RNA, 66 nt, Homo Sapiens; identical to SEQ ID NO: 253726

SEQ ID NO: 743680 - RNA, 66 nt, Homo Sapiens; identical to SEQ ID NO: 253727

SEQ ID NO: 743681 - RNA, 66 nt, Homo Sapiens; identical to SEQ ID NO: 253728

SEQ ID NO: 743682 - RNA, 66 nt, Homo Sapiens; identical to SEQ ID NO: 253729

SEQ ID NO: 743683 - RNA, 66 nt, Homo Sapiens; identical to SEQ ID NO: 253730

SEQ ID NO: 743684 - RNA, 66 nt, Homo Sapiens; identical to SEQ ID NO: 253731

SEQ ID NO: 743685 - RNA, 66 nt, Homo Sapiens; identical to SEQ ID NO: 253732

SEQ ID NO: 743686 - RNA, 66 nt, Homo Sapiens; identical to SEQ ID NO: 253733

SEQ ID NO: 743687 - RNA, 66 nt, Homo Sapiens; identical to SEQ ID NO: 253734

SEQ ID NO: 743688 - RNA, 66 nt, Homo Sapiens; identical to SEQ ID NO: 253735

SEQ ID NO: 743689 - RNA, 66 nt, Homo Sapiens; identical to SEQ ID NO: 253736

SEQ ID NO: 743690 - RNA, 66 nt, Homo Sapiens; identical to SEQ ID NO: 253737

SEQ ID NO: 743691 - RNA, 66 nt, Homo Sapiens; identical to SEQ ID NO: 253738

SEQ ID NO: 743692 - RNA, 66 nt, Homo Sapiens; identical to SEQ ID NO: 253739

SEQ ID NO: 743693 - RNA, 66 nt, Homo Sapiens; identical to SEQ ID NO: 253740

SEQ ID NO: 743694 - RNA, 66 nt, Homo Sapiens; identical to SEQ ID NO: 253741

SEQ ID NO: 743695 - RNA, 66 nt, Homo Sapiens; identical to SEQ ID NO: 253742

SEQ ID NO: 743696 - RNA, 66 nt, Homo Sapiens; identical to SEQ ID NO: 253743

SEQ ID NO: 743697 - RNA, 66 nt, Homo Sapiens; identical to SEQ ID NO: 253744

SEQ ID NO: 743698 - RNA, 66 nt, Homo Sapiens; identical to SEQ ID NO: 253745

SEQ ID NO: 743699 - RNA, 66 nt, Homo Sapiens; identical to SEQ ID NO: 253746

SEQ ID NO: 743700 - RNA, 66 nt, Homo Sapiens; identical to SEQ ID NO: 253747

SEQ ID NO: 743701 - RNA, 66 nt, Homo Sapiens; identical to SEQ ID NO: 253748

SEQ ID NO: 743702 - RNA, 66 nt, Homo Sapiens; identical to SEQ ID NO: 253749

SEQ ID NO: 743703 - RNA, 66 nt, Homo Sapiens; identical to SEQ ID NO: 253750

SEQ ID NO: 743704 - RNA, 66 nt, Homo Sapiens; identical to SEQ ID NO: 253751

SEQ ID NO: 743705 - RNA, 66 nt, Homo Sapiens; identical to SEQ ID NO: 253752

SEQ ID NO: 743706 - RNA, 64 nt, Homo Sapiens; identical to SEQ ID NO: 275532

SEQ ID NO: 743707 - RNA, 64 nt, Homo Sapiens; identical to SEQ ID NO: 275533

SEQ ID NO: 743708 - RNA, 64 nt, Homo Sapiens; identical to SEQ ID NO: 275534

SEQ ID NO: 743709 - RNA, 64 nt, Homo Sapiens; identical to SEQ ID NO: 275535

SEQ ID NO: 743710 - RNA, 64 nt, Homo Sapiens; identical to SEQ ID NO: 275536

SEQ ID NO: 743711 - RNA, 64 nt, Homo Sapiens; identical to SEQ ID NO: 275537

SEQ ID NO: 743712 - RNA, 64 nt, Homo Sapiens; identical to SEQ ID NO: 275538

SEQ ID NO: 743713 - RNA, 64 nt, Homo Sapiens; identical to SEQ ID NO: 275539

SEQ ID NO: 743714 - RNA, 64 nt, Homo Sapiens; identical to SEQ ID NO: 275540

SEQ ID NO: 743715 - RNA, 64 nt, Homo Sapiens; identical to SEQ ID NO: 275541

SEQ ID NO: 743716 - RNA, 64 nt, Homo Sapiens; identical to SEQ ID NO: 275542

SEQ ID NO: 743717 - RNA, 64 nt, Homo Sapiens; identical to SEQ ID NO: 275543

SEQ ID NO: 743718 - RNA, 64 nt, Homo Sapiens; identical to SEQ ID NO: 275544

SEQ ID NO: 743719 - RNA, 64 nt, Homo Sapiens; identical to SEQ ID NO: 275545

SEQ ID NO: 743720 - RNA, 64 nt, Homo Sapiens; identical to SEQ ID NO: 157838

SEQ ID NO: 743721 - RNA, 64 nt, Homo Sapiens; identical to SEQ ID NO: 157839

SEQ ID NO: 743722 - RNA, 64 nt, Homo Sapiens; identical to SEQ ID NO: 157840

SEQ ID NO: 743723 - RNA, 64 nt, Homo Sapiens; identical to SEQ ID NO: 157841

SEQ ID NO: 743724 - RNA, 64 nt, Homo Sapiens; identical to SEQ ID NO: 157842

SEQ ID NO: 743725 - RNA, 64 nt, Homo Sapiens; identical to SEQ ID NO: 157843

SEQ ID NO: 743726 - RNA, 64 nt, Homo Sapiens; identical to SEQ ID NO: 157844

SEQ ID NO: 743727 - RNA, 64 nt, Homo Sapiens; identical to SEQ ID NO: 157845

SEQ ID NO: 743728 - RNA, 64 nt, Homo Sapiens; identical to SEQ ID NO: 157846

SEQ ID NO: 743729 - RNA, 64 nt, Homo Sapiens; identical to SEQ ID NO: 157847

SEQ ID NO: 743730 - RNA, 64 nt, Homo Sapiens; identical to SEQ ID NO: 157848

SEQ ID NO: 743731 - RNA, 64 nt, Homo Sapiens; identical to SEQ ID NO: 157849

SEQ ID NO: 743732 - RNA, 64 nt, Homo Sapiens; identical to SEQ ID NO: 157850

SEQ ID NO: 743733 - RNA, 64 nt, Homo Sapiens; identical to SEQ ID NO: 157851

SEQ ID NO: 743734 - RNA, 64 nt, Homo Sapiens; identical to SEQ ID NO: 157852

SEQ ID NO: 743735 - RNA, 64 nt, Homo Sapiens; identical to SEQ ID NO: 157853

SEQ ID NO: 743736 - RNA, 64 nt, Homo Sapiens; identical to SEQ ID NO: 157854

SEQ ID NO: 743737 - RNA, 64 nt, Homo Sapiens; identical to SEQ ID NO: 157855

SEQ ID NO: 743738 - RNA, 64 nt, Homo Sapiens; identical to SEQ ID NO: 157856

SEQ ID NO: 743739 - RNA, 64 nt, Homo Sapiens; identical to SEQ ID NO: 157857

SEQ ID NO: 743740 - RNA, 64 nt, Homo Sapiens; identical to SEQ ID NO: 157858

SEQ ID NO: 743741 - RNA, 64 nt, Homo Sapiens; identical to SEQ ID NO: 157859

SEQ ID NO: 743742 - RNA, 64 nt, Homo Sapiens; identical to SEQ ID NO: 157860

SEQ ID NO: 743743 - RNA, 64 nt, Homo Sapiens; identical to SEQ ID NO: 157861

SEQ ID NO: 743744 - RNA, 64 nt, Homo Sapiens; identical to SEQ ID NO: 157862

SEQ ID NO: 743745 - RNA, 64 nt, Homo Sapiens; identical to SEQ ID NO: 157863

SEQ ID NO: 743746 - RNA, 64 nt, Homo Sapiens; identical to SEQ ID NO: 157864

SEQ ID NO: 743747 - RNA, 64 nt, Homo Sapiens; identical to SEQ ID NO: 157865

SEQ ID NO: 743748 - RNA, 64 nt, Homo Sapiens; identical to SEQ ID NO: 157866

SEQ ID NO: 743749 - RNA, 64 nt, Homo Sapiens; identical to SEQ ID NO: 157867

SEQ ID NO: 743750 - RNA, 64 nt, Homo Sapiens; identical to SEQ ID NO: 157868

SEQ ID NO: 743751 - RNA, 64 nt, Homo Sapiens; identical to SEQ ID NO: 157869

SEQ ID NO: 743752 - RNA, 64 nt, Homo Sapiens; identical to SEQ ID NO: 157870

SEQ ID NO: 743753 - RNA, 64 nt, Homo Sapiens; identical to SEQ ID NO: 157871

SEQ ID NO: 743754 - RNA, 64 nt, Homo Sapiens; identical to SEQ ID NO: 157872

SEQ ID NO: 743755 - RNA, 64 nt, Homo Sapiens; identical to SEQ ID NO: 157873

SEQ ID NO: 743756 - RNA, 64 nt, Homo Sapiens; identical to SEQ ID NO: 157874

SEQ ID NO: 743757 - RNA, 64 nt, Homo Sapiens; identical to SEQ ID NO: 157875

SEQ ID NO: 743758 - RNA, 64 nt, Homo Sapiens; identical to SEQ ID NO: 157876

SEQ ID NO: 743759 - RNA, 64 nt, Homo Sapiens; identical to SEQ ID NO: 157877

SEQ ID NO: 743760 - RNA, 64 nt, Homo Sapiens; identical to SEQ ID NO: 157878

SEQ ID NO: 743761 - RNA, 64 nt, Homo Sapiens; identical to SEQ ID NO: 157879

SEQ ID NO: 743762 - RNA, 64 nt, Homo Sapiens; identical to SEQ ID NO: 157880

SEQ ID NO: 743763 - RNA, 64 nt, Homo Sapiens; identical to SEQ ID NO: 157881

SEQ ID NO: 743764 - RNA, 64 nt, Homo Sapiens; identical to SEQ ID NO: 157882

SEQ ID NO: 743765 - RNA, 64 nt, Homo Sapiens; identical to SEQ ID NO: 157883

SEQ ID NO: 743766 - RNA, 64 nt, Homo Sapiens; identical to SEQ ID NO: 157884

SEQ ID NO: 743767 - RNA, 64 nt, Homo Sapiens; identical to SEQ ID NO: 157885

SEQ ID NO: 743768 - RNA, 64 nt, Homo Sapiens; identical to SEQ ID NO: 157886

SEQ ID NO: 743769 - RNA, 64 nt, Homo Sapiens; identical to SEQ ID NO: 157887

SEQ ID NO: 743770 - RNA, 64 nt, Homo Sapiens; identical to SEQ ID NO: 157888

SEQ ID NO: 743771 - RNA, 64 nt, Homo Sapiens; identical to SEQ ID NO: 157889

SEQ ID NO: 743772 - RNA, 64 nt, Homo Sapiens; identical to SEQ ID NO: 248259

SEQ ID NO: 743773 - RNA, 64 nt, Homo Sapiens; identical to SEQ ID NO: 248260

SEQ ID NO: 743774 - RNA, 64 nt, Homo Sapiens; identical to SEQ ID NO: 248261

SEQ ID NO: 743775 - RNA, 64 nt, Homo Sapiens; identical to SEQ ID NO: 248262

SEQ ID NO: 743776 - RNA, 64 nt, Homo Sapiens; identical to SEQ ID NO: 248263

SEQ ID NO: 743777 - RNA, 64 nt, Homo Sapiens; identical to SEQ ID NO: 248264

SEQ ID NO: 743778 - RNA, 64 nt, Homo Sapiens; identical to SEQ ID NO: 248265

SEQ ID NO: 743779 - RNA, 64 nt, Homo Sapiens; identical to SEQ ID NO: 248266

SEQ ID NO: 743780 - RNA, 64 nt, Homo Sapiens; identical to SEQ ID NO: 248267

SEQ ID NO: 743781 - RNA, 64 nt, Homo Sapiens; identical to SEQ ID NO: 248268

SEQ ID NO: 743782 - RNA, 64 nt, Homo Sapiens; identical to SEQ ID NO: 248269

SEQ ID NO: 743783 - RNA, 64 nt, Homo Sapiens; identical to SEQ ID NO: 248270

SEQ ID NO: 743784 - RNA, 64 nt, Homo Sapiens; identical to SEQ ID NO: 248271

SEQ ID NO: 743785 - RNA, 64 nt, Homo Sapiens; identical to SEQ ID NO: 248272

SEQ ID NO: 743786 - RNA, 64 nt, Homo Sapiens; identical to SEQ ID NO: 248273

SEQ ID NO: 743787 - RNA, 64 nt, Homo Sapiens; identical to SEQ ID NO: 248274

SEQ ID NO: 743788 - RNA, 64 nt, Homo Sapiens; identical to SEQ ID NO: 248275

SEQ ID NO: 743789 - RNA, 64 nt, Homo Sapiens; identical to SEQ ID NO: 248276

SEQ ID NO: 743790 - RNA, 64 nt, Homo Sapiens; identical to SEQ ID NO: 248277

SEQ ID NO: 743791 - RNA, 64 nt, Homo Sapiens; identical to SEQ ID NO: 248278

SEQ ID NO: 743792 - RNA, 64 nt, Homo Sapiens; identical to SEQ ID NO: 248279

SEQ ID NO: 743793 - RNA, 64 nt, Homo Sapiens; identical to SEQ ID NO: 248280

SEQ ID NO: 743794 - RNA, 64 nt, Homo Sapiens; identical to SEQ ID NO: 248281

SEQ ID NO: 743795 - RNA, 64 nt, Homo Sapiens; identical to SEQ ID NO: 248282

SEQ ID NO: 743796 - RNA, 64 nt, Homo Sapiens; identical to SEQ ID NO: 248283

SEQ ID NO: 743797 - RNA, 64 nt, Homo Sapiens; identical to SEQ ID NO: 248284

SEQ ID NO: 743798 - RNA, 64 nt, Homo Sapiens; identical to SEQ ID NO: 248285

SEQ ID NO: 743799 - RNA, 64 nt, Homo Sapiens; identical to SEQ ID NO: 248286

SEQ ID NO: 743800 - RNA, 64 nt, Homo Sapiens; identical to SEQ ID NO: 248287

SEQ ID NO: 743801 - RNA, 64 nt, Homo Sapiens; identical to SEQ ID NO: 248288

SEQ ID NO: 743802 - RNA, 64 nt, Homo Sapiens; identical to SEQ ID NO: 248289

SEQ ID NO: 743803 - RNA, 64 nt, Homo Sapiens; identical to SEQ ID NO: 248290

SEQ ID NO: 743804 - RNA, 54 nt, Homo Sapiens; identical to SEQ ID NO: 248291

SEQ ID NO: 743805 - RNA, 64 nt, Homo Sapiens; identical to SEQ ID NO: 248292

SEQ ID NO: 743806 - RNA, 64 nt, Homo Sapiens; identical to SEQ ID NO: 248293

SEQ ID NO: 743807 - RNA, 64 nt, Homo Sapiens; identical to SEQ ID NO: 248294

SEQ ID NO: 743808 - RNA, 64 nt, Homo Sapiens; identical to SEQ ID NO: 248295

SEQ ID NO: 743809 - RNA, 64 nt, Homo Sapiens; identical to SEQ ID NO: 248296

SEQ ID NO: 743810 - RNA, 64 nt, Homo Sapiens; identical to SEQ ID NO: 248297

SEQ ID NO: 743811 - RNA, 64 nt, Homo Sapiens; identical to SEQ ID NO: 248298

SEQ ID NO: 743812 - RNA, 64 nt, Homo Sapiens; identical to SEQ ID NO: 248299

SEQ ID NO: 743813 - RNA, 64 nt, Homo Sapiens; identical to SEQ ID NO: 79332

SEQ ID NO: 743814 - RNA, 64 nt, Homo Sapiens; identical to SEQ ID NO: 79333

SEQ ID NO: 743815 - RNA, 64 nt, Homo Sapiens; identical to SEQ ID NO: 79334

SEQ ID NO: 743816 - RNA, 64 nt, Homo Sapiens; identical to SEQ ID NO: 79335

SEQ ID NO: 743817 - RNA, 64 nt, Homo Sapiens; identical to SEQ ID NO: 79336

SEQ ID NO: 743818 - RNA, 64 nt, Homo Sapiens; identical to SEQ ID NO: 79337

SEQ ID NO: 743819 - RNA, 64 nt, Homo Sapiens; identical to SEQ ID NO: 79338

SEQ ID NO: 743820 - RNA, 64 nt, Homo Sapiens; identical to SEQ ID NO: 79339

SEQ ID NO: 743821 - RNA, 64 nt, Homo Sapiens; identical to SEQ ID NO: 79340

SEQ ID NO: 743822 - RNA, 64 nt, Homo Sapiens; identical to SEQ ID NO: 79341

SEQ ID NO: 743823 - RNA, 64 nt, Homo Sapiens; identical to SEQ ID NO: 79342

SEQ ID NO: 743824 - RNA, 64 nt, Homo Sapiens; identical to SEQ ID NO: 79343

SEQ ID NO: 743825 - RNA, 64 nt, Homo Sapiens; identical to SEQ ID NO: 79344

SEQ ID NO: 743826 - RNA, 64 nt, Homo Sapiens; identical to SEQ ID NO: 79345

SEQ ID NO: 743827 - RNA, 64 nt, Homo Sapiens; identical to SEQ ID NO: 79346

SEQ ID NO: 743828 - RNA, 64 nt, Homo Sapiens; identical to SEQ ID NO: 79347

SEQ ID NO: 743829 - RNA, 64 nt, Homo Sapiens; identical to SEQ ID NO: 172917

SEQ ID NO: 743830 - RNA, 64 nt, Homo Sapiens; identical to SEQ ID NO: 172918

SEQ ID NO: 743831 - RNA, 64 nt, Homo Sapiens; identical to SEQ ID NO: 172919

SEQ ID NO: 743832 - RNA, 64 nt, Homo Sapiens; identical to SEQ ID NO: 172920

SEQ ID NO: 743833 - RNA, 64 nt, Homo Sapiens; identical to SEQ ID NO: 172921

SEQ ID NO: 743834 - RNA, 64 nt, Homo Sapiens; identical to SEQ ID NO: 172922

SEQ ID NO: 743835 - RNA, 64 nt, Homo Sapiens; identical to SEQ ID NO: 172923

SEQ ID NO: 743836 - RNA, 64 nt, Homo Sapiens; identical to SEQ ID NO: 172924

SEQ ID NO: 743837 - RNA, 64 nt, Homo Sapiens; identical to SEQ ID NO: 172925

SEQ ID NO: 743838 - RNA, 64 nt, Homo Sapiens; identical to SEQ ID NO: 172926

SEQ ID NO: 743839 - RNA, 64 nt, Homo Sapiens; identical to SEQ ID NO: 172927

SEQ ID NO: 743840 - RNA, 64 nt, Homo Sapiens; identical to SEQ ID NO: 172928

SEQ ID NO: 743841 - RNA, 64 nt, Homo Sapiens; identical to SEQ ID NO: 172929

SEQ ID NO: 743842 - RNA, 64 nt, Homo Sapiens; identical to SEQ ID NO: 172930

SEQ ID NO: 743843 - RNA, 64 nt, Homo Sapiens; identical to SEQ ID NO: 172931

SEQ ID NO: 743844 - RNA, 64 nt, Homo Sapiens; identical to SEQ ID NO: 172932

SEQ ID NO: 743845 - RNA, 64 nt, Homo Sapiens; identical to SEQ ID NO: 172933

SEQ ID NO: 743846 - RNA, 64 nt, Homo Sapiens; identical to SEQ ID NO: 172934

SEQ ID NO: 743847 - RNA, 64 nt, Homo Sapiens; identical to SEQ ID NO: 172935

SEQ ID NO: 743848 - RNA, 64 nt, Homo Sapiens; identical to SEQ ID NO: 172936

SEQ ID NO: 743849 - RNA, 64 nt, Homo Sapiens; identical to SEQ ID NO: 172937

SEQ ID NO: 743850 - RNA, 64 nt, Homo Sapiens; identical to SEQ ID NO: 172938

SEQ ID NO: 743851 - RNA, 64 nt, Homo Sapiens; identical to SEQ ID NO: 172939

SEQ ID NO: 743852 - RNA, 64 nt, Homo Sapiens; identical to SEQ ID NO: 172940

SEQ ID NO: 743853 - RNA, 64 nt, Homo Sapiens; identical to SEQ ID NO: 172941

SEQ ID NO: 743854 - RNA, 64 nt, Homo Sapiens; identical to SEQ ID NO: 172942

SEQ ID NO: 743855 - RNA, 64 nt, Homo Sapiens; identical to SEQ ID NO: 172943

SEQ ID NO: 743856 - RNA, 64 nt, Homo Sapiens; identical to SEQ ID NO: 172944

SEQ ID NO: 743857 - RNA, 64 nt, Homo Sapiens; identical to SEQ ID NO: 172945

SEQ ID NO: 743858 - RNA, 64 nt, Homo Sapiens; identical to SEQ ID NO: 172946

SEQ ID NO: 743859 - RNA, 64 nt, Homo Sapiens; identical to SEQ ID NO: 172947

SEQ ID NO: 743860 - RNA, 64 nt, Homo Sapiens; identical to SEQ ID NO: 172948

SEQ ID NO: 743861 - RNA, 64 nt, Homo Sapiens; identical to SEQ ID NO: 172949

SEQ ID NO: 743862 - RNA, 64 nt, Homo Sapiens; identical to SEQ ID NO: 172950

SEQ ID NO: 743863 - RNA, 64 nt, Homo Sapiens; identical to SEQ ID NO: 172951

SEQ ID NO: 743864 - RNA, 64 nt, Homo Sapiens; identical to SEQ ID NO: 172952

SEQ ID NO: 743865 - RNA, 64 nt, Homo Sapiens; identical to SEQ ID NO: 172953

SEQ ID NO: 743866 - RNA, 64 nt, Homo Sapiens; identical to SEQ ID NO: 172954

SEQ ID NO: 743867 - RNA, 64 nt, Homo Sapiens; identical to SEQ ID NO: 172955

SEQ ID NO: 743868 - RNA, 64 nt, Homo Sapiens; identical to SEQ ID NO: 172956

SEQ ID NO: 743869 - RNA, 64 nt, Homo Sapiens; identical to SEQ ID NO: 172957

SEQ ID NO: 743870 - RNA, 64 nt, Homo Sapiens; identical to SEQ ID NO: 172958

SEQ ID NO: 743871 - RNA, 64 nt, Homo Sapiens; identical to SEQ ID NO: 172959

SEQ ID NO: 743872 - RNA, 64 nt, Homo Sapiens
aaagggccucccuugaauucgaacagaggauggagcuaagcagcgauucugggucuccagauug

SEQ ID NO: 743873 - RNA, 64 nt, Homo Sapiens
aaucuuccgaccuuccucccgguaugcaagauuugcuaagcaauuuguacuugccucuuuagcu

SEQ ID NO: 743874 - RNA, 64 nt, Homo Sapiens
gauuacggucccgggccaguaacagcaccugggagcuugguagaaaugcagaaucuuagccuag

SEQ ID NO: 743875 - RNA, 64 nt, Homo Sapiens
ccaccccagucccucuucccaccccucucuucuagcuugguaaugaaguauauuuauuggugaa

SEQ ID NO: 743876 - RNA, 64 nt, Homo Sapiens
ugugacucacagugcuaaagacucaugcuugacagcuugguaaggucaacucuguagcccugca

SEQ ID NO: 743877 - RNA, 64 nt, Homo Sapiens
gaaaucuccagugugcguuggaaucaccuggagggcuugguaaaacacagauuuuugggcucca

SEQ ID NO: 743878 - RNA, 64 nt, Homo Sapiens
uucacuucaaagcuaaaaaauuguuaaacuugcagcuugguauugcagagaagauuuuauaaga

SEQ ID NO: 743879 - RNA, 64 nt, Homo Sapiens
ccagaguuauuggugcagaaauggcuacccgagagcuugguaaauuugccuugguuucuuaugu

SEQ ID NO: 743880 - RNA, 64 nt, Homo Sapiens
uuuaguguuaagugugcaguaaaaguuacauugugcuugguagaaagugccuucugagcugucu

SEQ ID NO: 743881 - RNA, 64 nt, Homo Sapiens
ucuccaguuucuaggagguacaaauuggauauaugcuugguaauuguauuuuaagaaaucuaua

SEQ ID NO: 743882 - RNA, 64 nt, Homo Sapiens
gugcaucacucaccacagcucuagaagccacugugcuugguagaugaguauguguucuuuauuc

SEQ ID NO: 743883 - RNA, 64 nt, Homo Sapiens
aaugaccagggcaggaugccuggugcuccucucugcuugguagggcagcugguggagaugggcc

SEQ ID NO: 743884 - RNA, 60 nt, Homo Sapiens
uucaucauugugguguuuguagcuugcugugcuugguauuagguuucccagugggcuuga

SEQ ID NO: 743885 - RNA, 64 nt, Homo Sapiens
uaguuauugaauguauuuaucuacacaguaaguagcuugguagauaguuauuucacaguuguag

SEQ ID NO: 743886 - RNA, 64 nt, Homo Sapiens
uugaguagucugcauuuuggcaacuccucuagcagcuugguagccuaguacagguuguuuuuuu

SEQ ID NO: 743887 - RNA, 64 nt, Homo Sapiens
uuuguaguagacuuucaaaaugagugauuuguuagcuugguacuuuuaaguuugugguacagau

SEQ ID NO: 743888 - RNA, 64 nt, Homo Sapiens
agaugucuugugucuguguggcuagauggccucugcuugguaaucuuauuuuuaggccuaaaau

SEQ ID NO: 743889 - RNA, 64 nt, Homo Sapiens
uuaugguuccccugcccucucccaucuuugauuggcuugguauuuggagcuucuguuaacauua

SEQ ID NO: 743890 - RNA, 64 nt, Homo Sapiens
aaacauacauuaugaagccuuuccaaaauuaggugcuugguaaucacguuaaugguauaauuuu

SEQ ID NO: 743891 - RNA, 64 nt, Homo Sapiens
uguccaucuuugugugcacagagccuagcacagggcuugguagaggguauaucuagugaaugga

SEQ ID NO: 743892 - RNA, 64 nt, Homo Sapiens
caaaaacccgucucgacgaaaaauacaaaaaauagcuugguaugguggcacaugccuguaaucc

SEQ ID NO: 743893 - RNA, 64 nt, Homo Sapiens
aguuucugcuuuauauucuaugauggguacacaugcuugguaagccaaagacaggagguguggc

SEQ ID NO: 743894 - RNA, 64 nt, Homo Sapiens
aaagaaauucacuguaaaauuugguacauggcuggcuugguauucuccuaccgccccuaccccc

SEQ ID NO: 743895 - RNA, 64 nt, Homo Sapiens
aggggaaaaaagucaggaaagagagacuaggaaggcuugguagggagcaagcuccugaggcugg

SEQ ID NO: 743896 - RNA, 64 nt, Homo Sapiens
ugggcuuucuggaauccaaaccacagucuuaggggcuugguaguuuggaaaguucuuaggcacc

SEQ ID NO: 743897 - RNA, 64 nt, Homo Sapiens
gcugccauagucuccacggugcccuucacagagggcuugguaguggcagaauggccaugcccag

SEQ ID NO: 743898 - RNA, 64 nt, Homo Sapiens
cuucugccccagcagggcuggccgucaguccccugcuugguaguggugugggggugcagugugg

SEQ ID NO: 743899 - RNA, 64 nt, Homo Sapiens
gauaaaaaaugacaaaugacugucucuugcggaugcuugguacuguaauguuaauaauagucac

SEQ ID NO: 743900 - RNA, 64 nt, Homo Sapiens
aguaagcacauugcugcaaugugguacgugaauugcuugguacaaaauggccaguucacagagg

SEQ ID NO: 743901 - RNA, 64 nt, Homo Sapiens
uuucgcuuucauuauuuuucuuuuuuuggcaaaggcuugguacccaaggugcgguagggggucg

SEQ ID NO: 743902 - RNA, 64 nt, Homo Sapiens
cguacaagggggcccucaaacuguuuuuguacuugcuugguaucauguuguugggauuuguguu

SEQ ID NO: 743903 - RNA, 64 nt, Homo Sapiens
agucaucgccauucuccauuuuugcaggcuguaugcuugguagaugugccuuguuaacaauaug

SEQ ID NO: 743904 - RNA, 64 nt, Homo Sapiens
aaaacuucucuggcaguuacccauccacucauaagcuugguacauuuaaagaaaaguaacacuc

SEQ ID NO: 743905 - RNA, 64 nt, Homo Sapiens
uguuggcagcaguuucccuuuccaaggcuaguuggcuugguagcccauggcugcaguuguguga

SEQ ID NO: 743906 - RNA, 64 nt, Homo Sapiens
uuuuucaaauaugaaagugaucacuuagcaacaugcuugguaauuuggcaucuguuaagguagg

SEQ ID NO: 743907 - RNA, 64 nt, Homo Sapiens
uacauuuaaauuacuguuccuacuuaaguggugagcuugguaaccauuuucauaucaggugaua

SEQ ID NO: 743908 - RNA, 64 nt, Homo Sapiens
cauaagaaaaacuagagauuuaauguaauuggaagcuugguacaugagugcucagagucccugc

SEQ ID NO: 743909 - RNA, 64 nt, Homo Sapiens
aggaauaauuucugguguucgauacaaaguuacagcuugguagguagagagagauuuguuaaag

SEQ ID NO: 743910 - RNA, 64 nt, Homo Sapiens
aguaauaaaaucaguacaauaggaacauaaaauggcuugguaaauuauuucuuugcauugagug

SEQ ID NO: 743911 - RNA, 64 nt, Homo Sapiens
agacuauauaaaccagauuuuugguuucagguaggcuugguaauuuuacauuugauuccacaau

SEQ ID NO: 743912 - RNA, 64 nt, Homo Sapiens
guuuuaugacucugcugcagcugauauuccuuuugcuugguagugagauaggauugauuugcaa

SEQ ID NO: 743913 - RNA, 64 nt, Homo Sapiens
uuuuucuaaacacaauuguuaucaacuauuuuuagcuugguaaaucuuuuuuaugacaacuuag

SEQ ID NO: 743914 - RNA, 64 nt, Homo Sapiens
guaaaaacaauuuugucaaacaguacuccugacagcuugguaaagucuagguagaguuucugau

SEQ ID NO: 743915 - RNA, 62 nt, Homo Sapiens
gcagcagcagcagugaaugacaccaaaggaccgcuugguagccacuggaacccuuuccagaa

SEQ ID NO: 743916 - RNA, 64 nt, Homo Sapiens
ccaugagcagagaacugaugcgacuuguuuugcugcuugguagcacuuuaaaaaauuuuuugau

SEQ ID NO: 743917 - RNA, 64 nt, Homo Sapiens
uugaaaaauugucuuuccuuaucauuggugggaggcuugguagcaaaguaacauuuuuuggaaa

SEQ ID NO: 743918 - RNA, 64 nt, Homo Sapiens
cuggggcuagauguggaacuuacauugaauuaaugcuugguagcgauguuguagugacaccauu

SEQ ID NO: 743919 - RNA, 64 nt, Homo Sapiens
gcugacaaagcagauaaaauuuaacaagauuucagcuugguagacaucuucacgaacagcguuu

SEQ ID NO: 743920 - RNA, 64 nt, Homo Sapiens
ugaaaaugagaucacauacuuaaauggccucucagcuugguaugaaauuagcaaagagauaguc

SEQ ID NO: 743921 - RNA, 64 nt, Homo Sapiens
gcaugaaaacucgacuuuaugcugucuugcucaagcuugguaugagagcucaauuuguaccuuu

SEQ ID NO: 743922 - RNA, 64 nt, Homo Sapiens
augagcugaauuagauggcccuagugugcucagggcuugguacauaguaaagcauacaaagaau

SEQ ID NO: 743923 - RNA, 64 nt, Homo Sapiens
agacagaauucgaucugccuggaggcuccugcuggcuugguagagugcccucccuguugcucua

SEQ ID NO: 743924 - RNA, 64 nt, Homo Sapiens
gagcugaaguguaaagcaaagaauagcagaagcagcuugguaggauggaaggcacgcaguggca

SEQ ID NO: 743925 - RNA, 64 nt, Homo Sapiens
aagccuguuuuuccuugcaaacucaaaucugugagcuugguaccaaguccagguauaacauucc

SEQ ID NO: 743926 - RNA, 64 nt, Homo Sapiens
uuccucugggucgcagaucgacaagaugcuggaggcuugguaagggucccaugaguagggcugc

SEQ ID NO: 743927 - RNA, 64 nt, Homo Sapiens
uuaaaauuaauaaugccaguagauagaaaacuuugcuugguaauuaaauauccauguauaaaau

SEQ ID NO: 743928 - RNA, 64 nt, Homo Sapiens
aguuauuacagagccccaaaagcaagaaaggauggcuugguaucaacuggugaguucuaauuau

SEQ ID NO: 743929 - RNA, 64 nt, Homo Sapiens
uucccuccaggcagaggcucgcuguugccugggagcuugguacuuaguagccagaauucguaaa

SEQ ID NO: 743930 - RNA, 64 nt, Homo Sapiens
ucugggauuugccuuccuucccgaaagcagcuuggcuugguagccuugaccacuggaugcuuug

SEQ ID NO: 743931 - RNA, 64 nt, Homo Sapiens
cuuaccaucgagggugugguugauccuugaagcugcuugguaaaguuaucauuuccucagucuu

SEQ ID NO: 743932 - RNA, 64 nt, Homo Sapiens
uacaggaaaacuccuuguuauccuuguuuccuuagcuugguaugagacagaucggauccaguuu

SEQ ID NO: 743933 - RNA, 64 nt, Homo Sapiens
aaccuuuuuguauaucacaauugacauguagguugcuugguaauccuuccuaacuggggcuuuc

SEQ ID NO: 743934 - RNA, 64 nt, Homo Sapiens
cauuacuucauguauaucaaaggaaaaaugaauugcuugguauuaaauguaaaaguaaagaugc

SEQ ID NO: 743935 - RNA, 64 nt, Homo Sapiens
agauacuacuguuugcuuaguacuacuugguuuugcuugguauguuagcggcaggcugagcaga

SEQ ID NO: 743936 - RNA, 64 nt, Homo Sapiens
cauuuuguuuuuucuuucucaagcuauauugugggcuugguaagguuuaaucuaaauaucuuga

SEQ ID NO: 743937 - RNA, 64 nt, Homo Sapiens
cauaaauauugggauuggauaaaccaauuaagcagcuugguauuuaagggcagagucuaccuug

SEQ ID NO: 743938 - RNA, 64 nt, Homo Sapiens
gaugcuucuaaaacagcauugauagguuaaagaagcuugguauuuuuaauuuacuucaaugauu

SEQ ID NO: 743939 - RNA, 64 nt, Homo Sapiens
gccaaucuuuucacaguagagcauacuuaaggcugcuugguacugaguauacuuaaauauaacu

SEQ ID NO: 743940 - RNA, 64 nt, Homo Sapiens
ucagagacuuuaagucaguugguuuuuauuagcugcuugguaugcaguaacuuggguggaggca

SEQ ID NO: 743941 - RNA, 64 nt, Homo Sapiens
gaaaaaccaugccaucauuaucuuguuauagaaugcuugguauaucaaacugucaggcuugggu

SEQ ID NO: 743942 - RNA, 64 nt, Homo Sapiens
uuaauuuuuuauaccugauuucacaccuuugucugcuugguaccguacugauuugcacuuugau

SEQ ID NO: 743943 - RNA, 53 nt, Homo Sapiens
gaaugcuggagggaaggggcagggcuugguagagacaggcugacaagguuuga

SEQ ID NO: 743944 - RNA, 64 nt, Homo Sapiens
ugaaaccaaauguuaaacuauagccuuaagaaaugcuugguagaaguguccuaaugagacaaau

SEQ ID NO: 743945 - RNA, 64 nt, Homo Sapiens
aaacugcugacuuaauuugcuuuuguuugcuuuagcuugguaacagcggugaauagaguguagu

SEQ ID NO: 743946 - RNA, 64 nt, Homo Sapiens
auccucaugcccccuuugccacaaugguaugauggcuugguagccccucgaggcagaugcaccu

SEQ ID NO: 743947 - RNA, 59 nt, Homo Sapiens
uggccucggaucuacuguagagcaccccugcuugguacagacauacucaggggcuaccg

SEQ ID NO: 743948 - RNA, 64 nt, Homo Sapiens
cguggcagagcagaaugggaugccccgagacucugcuugguaaaaccaccaugguuacagcgga

SEQ ID NO: 743949 - RNA, 64 nt, Homo Sapiens
cugcgggggaaagagagagcgaaaaugcacaggagcuugguagaagcuagcagaucuauguggu

SEQ ID NO: 743950 - RNA, 64 nt, Homo Sapiens
cuuaccugggcuuguguaccgugugagggggcuugcuugguaugaagcuuuuuucagacaaaag

SEQ ID NO: 743951 - RNA, 64 nt, Homo Sapiens
uuggucuugaaaaggaaaauaaaaucacuuucuugcuugguaagcaagaagccauaucgauuuu

SEQ ID NO: 743952 - RNA, 64 nt, Homo Sapiens
uugccugcuuuuauaugcauuuuuguagggaucagcuugguagacaguauuagcggagaaacac

SEQ ID NO: 743953 - RNA, 64 nt, Homo Sapiens
uucacuuccuguagaagcaagaacaagcuccucugcuugguacuuagucuguguccaugugauc

SEQ ID NO: 743954 - RNA, 64 nt, Homo Sapiens
gcauuauacccugcaaguucacugcaugucugaugcuugguaaaacuagucuucccuguaaaau

SEQ ID NO: 743955 - RNA, 64 nt, Homo Sapiens
ugacugugugaaugauggugccagggaauccguggcuugguacacacuguuucauccaguggcc

SEQ ID NO: 743956 - RNA, 64 nt, Homo Sapiens
aucauagucccuagguugcuacggcuuaucaugugcuugguaaaaggugaucgcagguucucag

SEQ ID NO: 743957 - RNA, 64 nt, Homo Sapiens
cuguuugccauggagcacuaagcucuagagcauggcuugguaacggcuaccguuuggacaguau

SEQ ID NO: 743958 - RNA, 64 nt, Homo Sapiens
agcuuaugcugucuuaaauuguuacaaugcuuaugcuugguacaugcugaaaaguugcacuuuu

SEQ ID NO: 743959 - RNA, 64 nt, Homo Sapiens
gaaaaccucugcaccagcggugcagggcaagcuagcuugguaagcuuugggggaaguugcugau

SEQ ID NO: 743960 - RNA, 64 nt, Homo Sapiens
gaaaagggaagggcccagaauauuauuaaagauugcuugguagugcaaccucauuuuguggccu

SEQ ID NO: 743961 - RNA, 63 nt, Homo Sapiens
caaauguuagcuuaauucagcaaauaaaugcauugcuugguaaacugguaacugguauccuuc

SEQ ID NO: 743962 - RNA, 64 nt, Homo Sapiens
aacauauacuugauguagguaugaacucccauuagcuugguacucaagucccagacuauaaauu

SEQ ID NO: 743963 - RNA, 64 nt, Homo Sapiens
aaguuccuauuuccacccugcagcuggucauggggcuugguauauuuaaaacucacuugaagca

SEQ ID NO: 743964 - RNA, 64 nt, Homo Sapiens
ugccuuacugcagcgugucucucuauccaaaggagcuugguaaguggauugauuucuucuuucc

SEQ ID NO: 743965 - RNA, 64 nt, Homo Sapiens
gggagaauccaguguuucugcuuucaguuucuuggcuugguagccucugagugaaucugaugcu

SEQ ID NO: 743966 - RNA, 64 nt, Homo Sapiens
uccuaaauguuuaacaagaauugcaucuucauuggcuugguauuugcuuugucuuguauguuaa

SEQ ID NO: 743967 - RNA, 64 nt, Homo Sapiens
uuuuuuucauuguucaaauauaauugauuaggaugcuugguaggauauggaagcaagaacuaua

SEQ ID NO: 743968 - RNA, 64 nt, Homo Sapiens
cauugaauuauuaauuacaauuaauuacuaaaaagcuugguauguaaaauuauucuccacaaua

SEQ ID NO: 743969 - RNA, 64 nt, Homo Sapiens
aacaaggucugccucuuaugacgagaaugcaacagcuugguaaaucauaaaagaaacauuuaag

SEQ ID NO: 743970 - RNA, 64 nt, Homo Sapiens
gaggugacucagauagaaucugaucccauucagagcuugguaaaugucacuguacagaagacau

SEQ ID NO: 743971 - RNA, 64 nt, Homo Sapiens
gaacugcugcuguuggguuuggaaugugauggaggcuugguaggguggcugguuuguaaaguuc

SEQ ID NO: 743972 - RNA, 64 nt, Homo Sapiens
uauuaaaauauuuuuacaccuuugaaaauugcaggcuugguacaaagaggucugucaucuuccc

SEQ ID NO: 743973 - RNA, 64 nt, Homo Sapiens
ucauugaguagagauaaucaugguauuuucaucagcuugguacuuuuugaaacgugacugcguu

SEQ ID NO: 743974 - RNA, 64 nt, Homo Sapiens
uccccgaggugugguggcugcagucucaggaagagcuugguacuuguggggacuucuguuuucu

SEQ ID NO: 743975 - RNA, 64 nt, Homo Sapiens
ugugguggcguuauggcagcccaacaccugcugcgcuugguagggcgcccagagcuggccuccc

SEQ ID NO: 743976 - RNA, 64 nt, Homo Sapiens
aaauuucuuuucugcauuucgccucuaauuuauagcuugguaaucuccccccgcccaccccgcc

SEQ ID NO: 743977 - RNA, 64 nt, Homo Sapiens
aauagaaucaaggccaagcuuccaauucacacaggcuugguauuucagcacuucugcuuuccac

SEQ ID NO: 743978 - RNA, 64 nt, Homo Sapiens
ugccagaaccuucuuuuccucuagaagggauggugcuugguaaccuuaccuuuuaaaagcuggg

SEQ ID NO: 743979 - RNA, 64 nt, Homo Sapiens
cugcugccaccaucacugugugaagcuuucaagagcuugguacuucccagggcuaccggcaguc

SEQ ID NO: 743980 - RNA, 64 nt, Homo Sapiens
gaaaauaaaccaguucuuccaaggaaguuaaaaggcuugguauggauguuggugucagauaggu

SEQ ID NO: 743981 - RNA, 64 nt, Homo Sapiens
ugauauucaaggcuuuaaaagucauuauuccugggcuugguaagugaauuuaugagauuuacug

SEQ ID NO: 743982 - RNA, 64 nt, Homo Sapiens
guauuuuuuuauauugaucuaauauaccaguguagcuugguacuuuugaaguucuuaauaugga

SEQ ID NO: 743983 - RNA, 64 nt, Homo Sapiens
ucugucuuauacauaggaaacaaaaguagaaagugcuugguauuuccugggauuucugacaaca

SEQ ID NO: 743984 - RNA, 64 nt, Homo Sapiens
uuuuguuuaauuccuugcuuuugucgacugaccugcuugguagugucugaggugaacugugggg

SEQ ID NO: 743985 - RNA, 64 nt, Homo Sapiens
uaagugaccugagugggaugcauuuagggggcgggcuugguauguuguaugaauccacucucug

SEQ ID NO: 743986 - RNA, 60 nt, Homo Sapiens
gcccggggcgggagcccugaaacuaaacaagcuugguacccgccgggggcggggccuaca

SEQ ID NO: 743987 - RNA, 64 nt, Homo Sapiens
aaaagggccugagacauuccgacguaggacaugugcuugguacagcugcugcauugugggugau

SEQ ID NO: 743988 - RNA, 64 nt, Homo Sapiens
gauaaaacaucagguggugagguugagguuuggggcuugguagcaguugccccagucaugagau

SEQ ID NO: 743989 - RNA, 64 nt, Homo Sapiens
ggggacucagcggauacuaguucuuuuaccuucugcuugguaacuuagauuaaacugagcauug

SEQ ID NO: 743990 - RNA, 64 nt, Homo Sapiens
ggccgagcccagcaaaggugguaaucgcauuucugcuugguagauugcacccccaccucagagu

SEQ ID NO: 743991 - RNA, 64 nt, Homo Sapiens
gaugacuccggaaaugugggaggagagaauuacugcuugguacgcagagcaccgaggccgagcc

SEQ ID NO: 743992 - RNA, 64 nt, Homo Sapiens
ggagaugccccugacccuugacaaaucuaucggugcuugguaccagcaugagcuaacuuuaugg

SEQ ID NO: 743993 - RNA, 64 nt, Homo Sapiens
gccuaaccguauuuauguguaagauacaacucuugcuugguauacccucuuggcucuauaauau

SEQ ID NO: 743994 - RNA, 64 nt, Homo Sapiens
uggaauugauauauaccuuaaauuuuuauauuaugcuugguacuagaguaaacccaugaauuug

SEQ ID NO: 743995 - RNA, 64 nt, Homo Sapiens
agacugaagauacauuggugacagcugugguagagcuugguaaagcagcacauccaaggcaacc

SEQ ID NO: 743996 - RNA, 64 nt, Homo Sapiens
uaacacaucaaauauuucuuagcaaaauacaucagcuugguaguaccuaauguuuauaggagaa

SEQ ID NO: 743997 - RNA, 64 nt, Homo Sapiens
auaagcucagggauaaggugacauuguaagaauugcuugguagcguagucuaauagaacuccaa

SEQ ID NO: 743998 - RNA, 64 nt, Homo Sapiens; identical to SEQ ID NO: 358604

SEQ ID NO: 743999 - RNA, 64 nt, Homo Sapiens; identical to SEQ ID NO: 358605

SEQ ID NO: 744000 - RNA, 64 nt, Homo Sapiens; identical to SEQ ID NO: 358606

SEQ ID NO: 744001 - RNA, 64 nt, Homo Sapiens; identical to SEQ ID NO: 358607

SEQ ID NO: 744002 - RNA, 64 nt, Homo Sapiens; identical to SEQ ID NO: 358608

SEQ ID NO: 744003 - RNA, 64 nt, Homo Sapiens; identical to SEQ ID NO: 358609

SEQ ID NO: 744004 - RNA, 64 nt, Homo Sapiens; identical to SEQ ID NO: 358610

SEQ ID NO: 744005 - RNA, 64 nt, Homo Sapiens; identical to SEQ ID NO: 358611

SEQ ID NO: 744006 - RNA, 64 nt, Homo Sapiens; identical to SEQ ID NO: 358612

SEQ ID NO: 744007 - RNA, 64 nt, Homo Sapiens; identical to SEQ ID NO: 358613

SEQ ID NO: 744008 - RNA, 64 nt, Homo Sapiens; identical to SEQ ID NO: 358614

SEQ ID NO: 744009 - RNA, 64 nt, Homo Sapiens; identical to SEQ ID NO: 358615

SEQ ID NO: 744010 - RNA, 64 nt, Homo Sapiens; identical to SEQ ID NO: 358616

SEQ ID NO: 744011 - RNA, 64 nt, Homo Sapiens; identical to SEQ ID NO: 358617

SEQ ID NO: 744012 - RNA, 64 nt, Homo Sapiens; identical to SEQ ID NO: 358618

SEQ ID NO: 744013 - RNA, 64 nt, Homo Sapiens; identical to SEQ ID NO: 358619

SEQ ID NO: 744014 - RNA, 64 nt, Homo Sapiens; identical to SEQ ID NO: 358620

SEQ ID NO: 744015 - RNA, 64 nt, Homo Sapiens; identical to SEQ ID NO: 358621

SEQ ID NO: 744016 - RNA, 64 nt, Homo Sapiens; identical to SEQ ID NO: 358622

SEQ ID NO: 744017 - RNA, 64 nt, Homo Sapiens; identical to SEQ ID NO: 358623

SEQ ID NO: 744018 - RNA, 64 nt, Homo Sapiens; identical to SEQ ID NO: 529015

SEQ ID NO: 744019 - RNA, 64 nt, Homo Sapiens; identical to SEQ ID NO: 529016

SEQ ID NO: 744020 - RNA, 64 nt, Homo Sapiens; identical to SEQ ID NO: 529017

SEQ ID NO: 744021 - RNA, 64 nt, Homo Sapiens; identical to SEQ ID NO: 529018

SEQ ID NO: 744022 - RNA, 64 nt, Homo Sapiens; identical to SEQ ID NO: 529019

SEQ ID NO: 744023 - RNA, 64 nt, Homo Sapiens; identical to SEQ ID NO: 529020

SEQ ID NO: 744024 - RNA, 64 nt, Homo Sapiens; identical to SEQ ID NO: 529021

SEQ ID NO: 744025 - RNA, 64 nt, Homo Sapiens; identical to SEQ ID NO: 529022

SEQ ID NO: 744026 - RNA, 64 nt, Homo Sapiens; identical to SEQ ID NO: 529023

SEQ ID NO: 744027 - RNA, 64 nt, Homo Sapiens; identical to SEQ ID NO: 529024

SEQ ID NO: 744028 - RNA, 64 nt, Homo Sapiens; identical to SEQ ID NO: 529025

SEQ ID NO: 744029 - RNA, 64 nt, Homo Sapiens; identical to SEQ ID NO: 529026

SEQ ID NO: 744030 - RNA, 64 nt, Homo Sapiens; identical to SEQ ID NO: 529027

SEQ ID NO: 744031 - RNA, 64 nt, Homo Sapiens; identical to SEQ ID NO: 529028

SEQ ID NO: 744032 - RNA, 64 nt, Homo Sapiens; identical to SEQ ID NO: 529029

SEQ ID NO: 744033 - RNA, 64 nt, Homo Sapiens; identical to SEQ ID NO: 529030

SEQ ID NO: 744034 - RNA, 64 nt, Homo Sapiens; identical to SEQ ID NO: 529031

SEQ ID NO: 744035 - RNA, 64 nt, Homo Sapiens; identical to SEQ ID NO: 529032

SEQ ID NO: 744036 - RNA, 64 nt, Homo Sapiens; identical to SEQ ID NO: 529033

SEQ ID NO: 744037 - RNA, 64 nt, Homo Sapiens; identical to SEQ ID NO: 529034

SEQ ID NO: 744038 - RNA, 64 nt, Homo Sapiens; identical to SEQ ID NO: 529035

SEQ ID NO: 744039 - RNA, 64 nt, Homo Sapiens; identical to SEQ ID NO: 529036

SEQ ID NO: 744040 - RNA, 64 nt, Homo Sapiens; identical to SEQ ID NO: 529037

SEQ ID NO: 744041 - RNA, 64 nt, Homo Sapiens; identical to SEQ ID NO: 529038

SEQ ID NO: 744042 - RNA, 64 nt, Homo Sapiens; identical to SEQ ID NO: 529039

SEQ ID NO: 744043 - RNA, 64 nt, Homo Sapiens; identical to SEQ ID NO: 529040

SEQ ID NO: 744044 - RNA, 64 nt, Homo Sapiens; identical to SEQ ID NO: 529041

SEQ ID NO: 744045 - RNA, 64 nt, Homo Sapiens; identical to SEQ ID NO: 529042

SEQ ID NO: 744046 - RNA, 64 nt, Homo Sapiens; identical to SEQ ID NO: 529043

SEQ ID NO: 744047 - RNA, 64 nt, Homo Sapiens; identical to SEQ ID NO: 529044

SEQ ID NO: 744048 - RNA, 64 nt, Homo Sapiens; identical to SEQ ID NO: 529045

SEQ ID NO: 744049 - RNA, 64 nt, Homo Sapiens; identical to SEQ ID NO: 529046

SEQ ID NO: 744050 - RNA, 64 nt, Homo Sapiens; identical to SEQ ID NO: 529047

SEQ ID NO: 744051 - RNA, 64 nt, Homo Sapiens; identical to SEQ ID NO: 529048

SEQ ID NO: 744052 - RNA, 64 nt, Homo Sapiens; identical to SEQ ID NO: 529049

SEQ ID NO: 744053 - RNA, 64 nt, Homo Sapiens; identical to SEQ ID NO: 529050

SEQ ID NO: 744054 - RNA, 64 nt, Homo Sapiens; identical to SEQ ID NO: 529051

SEQ ID NO: 744055 - RNA, 64 nt, Homo Sapiens; identical to SEQ ID NO: 529052

SEQ ID NO: 744056 - RNA, 64 nt, Homo Sapiens; identical to SEQ ID NO: 529053

SEQ ID NO: 744057 - RNA, 64 nt, Homo Sapiens; identical to SEQ ID NO: 529054

SEQ ID NO: 744058 - RNA, 64 nt, Homo Sapiens; identical to SEQ ID NO: 529055

SEQ ID NO: 744059 - RNA, 64 nt, Homo Sapiens; identical to SEQ ID NO: 529056

SEQ ID NO: 744060 - RNA, 64 nt, Homo Sapiens; identical to SEQ ID NO: 529057

SEQ ID NO: 744061 - RNA, 64 nt, Homo Sapiens; identical to SEQ ID NO: 529058

SEQ ID NO: 744062 - RNA, 64 nt, Homo Sapiens; identical to SEQ ID NO: 529059

SEQ ID NO: 744063 - RNA, 64 nt, Homo Sapiens; identical to SEQ ID NO: 529060

SEQ ID NO: 744064 - RNA, 64 nt, Homo Sapiens; identical to SEQ ID NO: 529061

SEQ ID NO: 744065 - RNA, 64 nt, Homo Sapiens; identical to SEQ ID NO: 529062

SEQ ID NO: 744066 - RNA, 64 nt, Homo Sapiens; identical to SEQ ID NO: 529063

SEQ ID NO: 744067 - RNA, 64 nt, Homo Sapiens; identical to SEQ ID NO: 529064

SEQ ID NO: 744068 - RNA, 64 nt, Homo Sapiens; identical to SEQ ID NO: 529065

SEQ ID NO: 744069 - RNA, 64 nt, Homo Sapiens; identical to SEQ ID NO: 529066

SEQ ID NO: 744070 - RNA, 64 nt, Homo Sapiens; identical to SEQ ID NO: 529067

SEQ ID NO: 744071 - RNA, 64 nt, Homo Sapiens; identical to SEQ ID NO: 529068

SEQ ID NO: 744072 - RNA, 64 nt, Homo Sapiens; identical to SEQ ID NO: 529069

SEQ ID NO: 744073 - RNA, 64 nt, Homo Sapiens; identical to SEQ ID NO: 564721

SEQ ID NO: 744074 - RNA, 64 nt, Homo Sapiens; identical to SEQ ID NO: 564722

SEQ ID NO: 744075 - RNA, 64 nt, Homo Sapiens; identical to SEQ ID NO: 564723

SEQ ID NO: 744076 - RNA, 64 nt, Homo Sapiens; identical to SEQ ID NO: 564724

SEQ ID NO: 744077 - RNA, 64 nt, Homo Sapiens; identical to SEQ ID NO: 564725

SEQ ID NO: 744078 - RNA, 64 nt, Homo Sapiens; identical to SEQ ID NO: 564726

SEQ ID NO: 744079 - RNA, 64 nt, Homo Sapiens; identical to SEQ ID NO: 564727

SEQ ID NO: 744080 - RNA, 64 nt, Homo Sapiens; identical to SEQ ID NO: 564728

SEQ ID NO: 744081 - RNA, 64 nt, Homo Sapiens; identical to SEQ ID NO: 564729

SEQ ID NO: 744082 - RNA, 64 nt, Homo Sapiens; identical to SEQ ID NO: 564730

SEQ ID NO: 744083 - RNA, 64 nt, Homo Sapiens; identical to SEQ ID NO: 564731

SEQ ID NO: 744084 - RNA, 64 nt, Homo Sapiens; identical to SEQ ID NO: 564732

SEQ ID NO: 744085 - RNA, 64 nt, Homo Sapiens; identical to SEQ ID NO: 564733

SEQ ID NO: 744086 - RNA, 64 nt, Homo Sapiens; identical to SEQ ID NO: 564734

SEQ ID NO: 744087 - RNA, 64 nt, Homo Sapiens; identical to SEQ ID NO: 564734

SEQ ID NO: 744088 - RNA, 64 nt, Homo Sapiens; identical to SEQ ID NO: 564734

SEQ ID NO: 744089 - RNA, 64 nt, Homo Sapiens; identical to SEQ ID NO: 564737

SEQ ID NO: 744090 - RNA, 64 nt, Homo Sapiens; identical to SEQ ID NO: 564738

SEQ ID NO: 744091 - RNA, 64 nt, Homo Sapiens; identical to SEQ ID NO: 564739

SEQ ID NO: 744092 - RNA, 64 nt, Homo Sapiens; identical to SEQ ID NO: 564740

SEQ ID NO: 744093 - RNA, 64 nt, Homo Sapiens; identical to SEQ ID NO: 564741

SEQ ID NO: 744094 - RNA, 64 nt, Homo Sapiens; identical to SEQ ID NO: 564742

SEQ ID NO: 744095 - RNA, 64 nt, Homo Sapiens
auagauguuuguggauguagguuguuagugacccacaggacaguuacaccuuugggaugauagg

SEQ ID NO: 744096 - RNA, 64 nt, Homo Sapiens
aaguggguaagggcaggaagcaccuggccugcccacaggacaagaggggaagaagccagaaccc

SEQ ID NO: 744097 - RNA, 64 nt, Homo Sapiens
gacagagcagcccuuggguuaggcgagagguugcacaggacaugcuccucagcucuagggugaa

SEQ ID NO: 744098 - RNA, 64 nt, Homo Sapiens
auuugcuacacaguacccagagcagccuaucuacacaggacauuaauaaugguguacuuuaaaa

SEQ ID NO: 744099 - RNA, 64 nt, Homo Sapiens
uuccuaagaggcagcauggugugguagaaagaacacaggacaagggagagagagccaaacaggc

SEQ ID NO: 744100 - RNA, 64 nt, Homo Sapiens
cccuaggugaucacagaacuuagcuccuuuaacaacaggacaaugguuuuuuacccuagauguu

SEQ ID NO: 744101 - RNA, 64 nt, Homo Sapiens
ccuccgguucccucucaccccauggcugugaaugacaggacaggucacacguguguuuuccauu

SEQ ID NO: 744102 - RNA, 64 nt, Homo Sapiens
ugagcacagucaagauuuuaagacaggacacuucacaggacacugagaauggaauugagagugg

SEQ ID NO: 744103 - RNA, 64 nt, Homo Sapiens
ucacaggacacuugagcacaaauugagaguggagacaggacacugaagacccuacagagaaugg

SEQ ID NO: 744104 - RNA, 64 nt, Homo Sapiens
ucuauuuuggauagaaaugcccuggccuuaggacacaggacaaagggggguggggggacuuauc

SEQ ID NO: 744105 - RNA, 64 nt, Homo Sapiens
cugcacaucucaguauauguauuuaggugaucauacaggacagguccccgugucuguggucacc

SEQ ID NO: 744106 - RNA, 64 nt, Homo Sapiens; identical to SEQ ID NO: 474075

SEQ ID NO: 744107 - RNA, 64 nt, Homo Sapiens; identical to SEQ ID NO: 474076

SEQ ID NO: 744108 - RNA, 64 nt, Homo Sapiens; identical to SEQ ID NO: 474077

SEQ ID NO: 744109 - RNA, 64 nt, Homo Sapiens; identical to SEQ ID NO: 474078

SEQ ID NO: 744110 - RNA, 64 nt, Homo Sapiens; identical to SEQ ID NO: 474079

SEQ ID NO: 744111 - RNA, 64 nt, Homo Sapiens; identical to SEQ ID NO: 474080

SEQ ID NO: 744112 - RNA, 64 nt, Homo Sapiens; identical to SEQ ID NO: 474081

SEQ ID NO: 744113 - RNA, 64 nt, Homo Sapiens; identical to SEQ ID NO: 474082

SEQ ID NO: 744114 - RNA, 64 nt, Homo Sapiens; identical to SEQ ID NO: 474083

SEQ ID NO: 744115 - RNA, 64 nt, Homo Sapiens; identical to SEQ ID NO: 474084

SEQ ID NO: 744116 - RNA, 64 nt, Homo Sapiens
auacauuuguuauuaaauuuauuauuuaagaugguagcacuagucuuaaauuguauaaaauauc

SEQ ID NO: 744117 - RNA, 64 nt, Homo Sapiens
acauguuuguuauuaaauuuauuauuaaagauaguagcacuagucuuaaauuugauauaacauc

SEQ ID NO: 744118 - RNA, 64 nt, Homo Sapiens
uuugaauucuaaaauucaaaaaaugagcccuauguagcacuaggagacuccaucuuuccaauaa

SEQ ID NO: 744119 - RNA, 64 nt, Homo Sapiens
uugauuuuagaaaaugagcaaaacuguaaaauuauagcacuaaccauuguuccacauauugaaa

SEQ ID NO: 744120 - RNA, 64 nt, Homo Sapiens
guggacauuuuucuagcauugaaugaaggccugcuagcacuagcgcuagcacuagcguggucua

SEQ ID NO: 744121 - RNA, 64 nt, Homo Sapiens
guggucuagaaugaaggccugaaugaaggccugcuagcacuagcuauccuguuaagcuugagua

SEQ ID NO: 744122 - RNA, 64 nt, Homo Sapiens
ucuuaccaaaacaguuaacucuuucuuuccaaucaauuuauacaaaagaggucgcuccagcccu

SEQ ID NO: 744123 - RNA, 64 nt, Homo Sapiens
uuuuauauuaaugacuauugaaagugguaauaaaaauuuauauuauaggcuucaauguuuucau

SEQ ID NO: 744124 - RNA, 64 nt, Homo Sapiens
aucucuggaaauuuagaguucuagaccucugguuaauuuauaucuaauaugaagaagacaccuc

SEQ ID NO: 744125 - RNA, 64 nt, Homo Sapiens
cuuuggcugaacuacaaguguaggccaccauuauaauuuauaaauacagcauacuucaaaacug

SEQ ID NO: 744126 - RNA, 64 nt, Homo Sapiens
auagucacagaaauaauuuccauuaaccauuugcaauuuauauuaacugguaagauuaagaagc

SEQ ID NO: 744127 - RNA, 64 nt, Homo Sapiens
caugggaaacaagucagaaguugauugaacuaauaauuuauaaacacaaaaaacaaacuuaauu

SEQ ID NO: 744128 - RNA, 64 nt, Homo Sapiens
caaaaauauuuuccauuuccuaauuaagaaauggaauuuauauaaaugaaacuuuaauuuuacu

SEQ ID NO: 744129 - RNA, 64 nt, Homo Sapiens
guaaaugauuuguaucguauauguucaucuuuacaauuuauauuaacccuagcugugccagcac

SEQ ID NO: 744130 - RNA, 64 nt, Homo Sapiens
agguuagcuaaaauugggaggaucagagaaguagaauuuauaaccccuguauuuaaucuacuuu

SEQ ID NO: 744131 - RNA, 64 nt, Homo Sapiens
uuuuauggacucugaagacaaauugacagaagauaauuuauacccacuagaaaaauucuuuuaa

SEQ ID NO: 744132 - RNA, 64 nt, Homo Sapiens
gaacuuuaucugugucugucauaucauagauuaaaauuuauaguuuaucuuuagguaauauuuu

SEQ ID NO: 744133 - RNA, 64 nt, Homo Sapiens
uucaagacaaauugaaucuuaaauaucuguuacaaauuuauaauuugaaggcauguauuuugaa

SEQ ID NO: 744134 - RNA, 64 nt, Homo Sapiens
aggauuuuuuuccuccccaccuucaaugacuucuaauuuauauuauccauagguuucucucccu

SEQ ID NO: 744135 - RNA, 64 nt, Homo Sapiens
caaaaacauaacugaguuuuuuaaaagaggagaaaauuuauaucuggguuaaguguuuaucaua

SEQ ID NO: 744136 - RNA, 64 nt, Homo Sapiens
aacauauuuguguauauuaaauaugaauuuuuaaaauuuauaaauacuauuuuccaaaaguaca

SEQ ID NO: 744137 - RNA, 64 nt, Homo Sapiens
aaaauguauuucaaacuauucuuacugugcugugaauuuauaucuucuucugcaagaccugggg

SEQ ID NO: 744138 - RNA, 64 nt, Homo Sapiens
cagcucuauauggauuuauacuuuuauauuuauaaauuuauaacuucauacaaauuuauaaaca

SEQ ID NO: 744139 - RNA, 64 nt, Homo Sapiens
uacuuuuauauuuauaaauuuauaacuucauacaaauuuauaaacauuucuuuauaaauuguaa

SEQ ID NO: 744140 - RNA, 64 nt, Homo Sapiens
uaaaauguuucauuuucauuaaaaaugaaagccaaauuuauaugccaccgauugcaggacacaa

SEQ ID NO: 744141 - RNA, 64 nt, Homo Sapiens
auuuaauuaccgguuguuaaaacugguuuagcacaauuuauauuuucccucucuugccuuucuu

SEQ ID NO: 744142 - RNA, 64 nt, Homo Sapiens
uuauguaugucaauguuuuugucuuuaacagcauaauuuauauugcuuuuucaaaugauguagc

SEQ ID NO: 744143 - RNA, 64 nt, Homo Sapiens
uaaauaauggcaacucuuuguuuuauacauauauaauuuauaacugaaucuaaguauuagacug

SEQ ID NO: 744144 - RNA, 64 nt, Homo Sapiens
aauuuuuugaucuuuuuuuuuuaccagaauuuauaauuuauaguuuuuaaugccagaagaaaag

SEQ ID NO: 744145 - RNA, 64 nt, Homo Sapiens
uuauaguaauuuuuugaucuagaaaaguuaccagaauuuauaauuuguggcuuuuaaugccaga

SEQ ID NO: 744146 - RNA, 64 nt, Homo Sapiens
gauuauuuuuuucuguaaaguuagaaugugugucaauuuauaauuuaguauuuucuaaaaaagu

SEQ ID NO: 744147 - RNA, 64 nt, Homo Sapiens
uugaauuuuaugcucccgugaacgaaacaaagacaauuuauaauaggacauggcacuaucuuua

SEQ ID NO: 744148 - RNA, 64 nt, Homo Sapiens
uaagauauaugcacauagaagggggacuucuaggaauuuauaaccaaaauuuuaaaacuauuuu

SEQ ID NO: 744149 - RNA, 64 nt, Homo Sapiens
auucugaauuuugacauuuucacacaauaaaaauaauuuauaucaauauucuguuucucuuuuc

SEQ ID NO: 744150 - RNA, 64 nt, Homo Sapiens
gccuuugauuuuuuuuuuuuuguuacaguuuaguaauuuauauucaccagucacuucauauguc

SEQ ID NO: 744151 - RNA, 64 nt, Homo Sapiens
auuuuuuuuuuaaguaaauaguacuuuaggccaaaauuuauaugaauauuugaucuucuugaga

SEQ ID NO: 744152 - RNA, 64 nt, Homo Sapiens
ggaaacuggauauuuuuagcacgaugugcaugauaauuuauaugcuugguggcugugcugcuga

SEQ ID NO: 744153 - RNA, 64 nt, Homo Sapiens
cuguuuuuaauguucuuuucaaucccaucuagauaauuuauagaaauauaacccuaauuggaca

SEQ ID NO: 744154 - RNA, 64 nt, Homo Sapiens
aaauuuaugagcuuugaagauugcuaaauuaaauaauuuauagcuccaaaaacaaaaauauacu

SEQ ID NO: 744155 - RNA, 64 nt, Homo Sapiens
auacuuguauaugucacagagaaaaaaaaugcaaaauuuauaauagaguuacauuaaccuuguu

SEQ ID NO: 744156 - RNA, 64 nt, Homo Sapiens
ugaaauaaugguuuccauuuauuugugauuaauuaauuuauauaccuucuuagccauggagagc

SEQ ID NO: 744157 - RNA, 64 nt, Homo Sapiens
acauguuucauauuuaaauccaugccacuauauuaauuuauauucaucgagaaccugaauaaau

SEQ ID NO: 744158 - RNA, 64 nt, Homo Sapiens
aagauaguugcaguuaaauuaauggaauucucuuaauuuauaagucaucgcacuauggaacaca

SEQ ID NO: 744159 - RNA, 64 nt, Homo Sapiens
aacuucuuaaauauacgcuugaacaucacaaaacaauuuauaaaggcauaagaauuaaacauau

SEQ ID NO: 744160 - RNA, 64 nt, Homo Sapiens
gguuuucacuguauauuuuauaugguguuugccuaauuuauaccuuuccugauauucauuagau

SEQ ID NO: 744161 - RNA, 64 nt, Homo Sapiens
aucauguaggccauuuuuauuuaaaggaaaaaucaauuuauaaaauuaugccuucaucaaaacu

SEQ ID NO: 744162 - RNA, 64 nt, Homo Sapiens
uuggaugauccacaaaccuuaaugaacaugagaaaauuuauacuguagagaaacccuggaaaug

SEQ ID NO: 744163 - RNA, 64 nt, Homo Sapiens
uuaccacauccucaaacuuuguuaaacauaagagaauuuauaccagagagaaacccuacacaug

SEQ ID NO: 744164 - RNA, 64 nt, Homo Sapiens
gcuucaaggacauuggugagaguccaacagacacaauuuauacugcgacagaacuucagcauug

SEQ ID NO: 744165 - RNA, 64 nt, Homo Sapiens
aggcacauuaacuguugcacuuuugaauguccaaaauuuauauuuuagaaauaauaaaaagaaa

SEQ ID NO: 744166 - RNA, 64 nt, Homo Sapiens
auaugcaguaugauaccacuuuuaaaaaaagauaaauuuauagaaaaaaguuuauaugacugac

SEQ ID NO: 744167 - RNA, 64 nt, Homo Sapiens
acucuauuuggaguugugcaagugagaagccccaaauuuauaagucaauauccucauucagagc

SEQ ID NO: 744168 - RNA, 64 nt, Homo Sapiens
gaaauuggauugacuuacuaauuaugaagucauuaauuuauacuaaaaaucaaauaccuuagag

SEQ ID NO: 744169 - RNA, 64 nt, Homo Sapiens
aaucuucauauuuacuguucuaauacauuuuauuaauuuauacuuucucagagagccuaaauuc

SEQ ID NO: 744170 - RNA, 64 nt, Homo Sapiens
uuuaugcaaaaacauaugucguuuaaaaugaagcaauuuauaucuuuaaagaaacacuaaauua

SEQ ID NO: 744171 - RNA, 64 nt, Homo Sapiens
cagaucuuuaaauacagucaaauuucaggaauuuaauuuauaggguuuuucuuacauaauuugc

SEQ ID NO: 744172 - RNA, 64 nt, Homo Sapiens
uuaaguacuaaaaagacaaggauuucuuuuaagaaauuuauagcauuuacuguguuauuuaaau

SEQ ID NO: 744173 - RNA, 64 nt, Homo Sapiens
agaacauauucugaauguuuuauaaaucuuuaauaauuuauauguagguaauauuuuuguauca

SEQ ID NO: 744174 - RNA, 64 nt, Homo Sapiens
uauuauuccuuccuuagaaguugauguaucagaaaauuuauaaguuauuuguauuuauauauaa

SEQ ID NO: 744175 - RNA, 64 nt, Homo Sapiens
agagaguuuaauauguuuagcauuaucuuuauggaauuuauauucaccaauuucaggaaaacca

SEQ ID NO: 744176 - RNA, 64 nt, Homo Sapiens
auuacaggcacgagccaccacaccuggccaaaaaaauuuauauuuuuugagacaaggucucacu

SEQ ID NO: 744177 - RNA, 64 nt, Homo Sapiens
acaggcaaaagccaacacacccggccuggauaugaauuuauaauacccuacagugcaacacaag

SEQ ID NO: 744178 - RNA, 64 nt, Homo Sapiens
ugcauugauacauuuuuaaauguaaguugagaaaaauuuauaagccaaagguucagaaaauuaa

SEQ ID NO: 744179 - RNA, 64 nt, Homo Sapiens
uccagugucauuuugaucugcuuuucagaauggaaauuuauaauauaaauauauguuuuaauac

SEQ ID NO: 744180 - RNA, 64 nt, Homo Sapiens
accauaucaacacugacagauuaaaaaaauuaaaaauuuauagaaaaaauuuuaaaaauuuaaa

SEQ ID NO: 744181 - RNA, 64 nt, Homo Sapiens
agauuuauaucagacccuccggccagucauuuuuaauuuauaucucugcuuaugcuguggucaa

SEQ ID NO: 744182 - RNA, 64 nt, Homo Sapiens
cauuauuuuuuacuuuugggacagacacuaccauaauuuauaaucuccuuuauaacaggguuuu

SEQ ID NO: 744183 - RNA, 64 nt, Homo Sapiens
aaccaaagaaauagggcaaguuugagaagcaggaaauuuauagcgguagccaaaaauccagaua

SEQ ID NO: 744184 - RNA, 64 nt, Homo Sapiens
cccauuaaauuaucgauuauuuuuuaaugaauugaauuuauauugagucuucaaauuaacugaa

SEQ ID NO: 744185 - RNA, 64 nt, Homo Sapiens
gggcaaggcauuuuuuaacacuuuuuaaaauaaaaauuuauaccacaacuuuaggcuauugaug

SEQ ID NO: 744186 - RNA, 64 nt, Homo Sapiens
uguuccuccauauuacuucuagaauuagaccaacaauuuauaaaucaaacaaacccaagagcau

SEQ ID NO: 744187 - RNA, 64 nt, Homo Sapiens
caagagcauugaaauuuugauuggauuuguauugaauuuauagauuaaucugguaaaccauguc

SEQ ID NO: 744188 - RNA, 64 nt, Homo Sapiens
uauaccaaaauuuaguaggcauguuuuucuaauaaauuuauauauuuguaaagaaaacaacaga

SEQ ID NO: 744189 - RNA, 64 nt, Homo Sapiens
uuuuauauuauuauuccacuaggaauggcauaagaauuuauagauaaauucuuguaacauuaaa

SEQ ID NO: 744190 - RNA, 64 nt, Homo Sapiens
gguuucuccccacugauauuuuacauagagucauaauuuauaugucuuauaaauuauaagucuu

SEQ ID NO: 744191 - RNA, 64 nt, Homo Sapiens
aauuuauaugucuuauaaauuauaagucuuauauaauuuauaagucucccacaaucuuccaguu

SEQ ID NO: 744192 - RNA, 64 nt, Homo Sapiens
ucuuacacugagaaauaaaaaugucagugagaacaauuuauaugauuuuucuuuuaauaguuau

SEQ ID NO: 744193 - RNA, 64 nt, Homo Sapiens
ucuucuuuuuaaauuguuuuggauucagaaauacaauuuauauuuacacccccacaggugacuu

SEQ ID NO: 744194 - RNA, 64 nt, Homo Sapiens
gaagguaaaauuaaaauguauuacgccucauuuuaauuuauaauuuauggucucaauguuuuuc

SEQ ID NO: 744195 - RNA, 64 nt, Homo Sapiens
ugaaagcuuacgcuauauugaugaaaugacauauaauuuauauaacugaugauacuaacaguug

SEQ ID NO: 744196 - RNA, 64 nt, Homo Sapiens
ggaucaucagguuuucuguugggcugaugcuuccaauuuauaaacuaaaugcaacccauaggca

SEQ ID NO: 744197 - RNA, 64 nt, Homo Sapiens
ucuauuaaaaagguacuucuaguuaaauaacuauaauuuauauaacuaaaguuauuguuuucua

SEQ ID NO: 744198 - RNA, 64 nt, Homo Sapiens
ccuuuucuguuaagauaauaacauacagauagcaaauuuauauuuuuucccaaagggcaacaaa

SEQ ID NO: 744199 - RNA, 64 nt, Homo Sapiens
ugauuugaagguuuucuauuugcuauuuguugucaauuuauagcgaacacauucauucagacuu

SEQ ID NO: 744200 - RNA, 64 nt, Homo Sapiens
acuccuuucuuaucuugaccauacuaauaaauauaauuuauaagcauugccauugaaggcuuaa

SEQ ID NO: 744201 - RNA, 64 nt, Homo Sapiens
gaaaauauucaugcuugccaucuguucauuucuaaauuuauauucauaaaguuacaguuugaua

SEQ ID NO: 744202 - RNA, 64 nt, Homo Sapiens
uuaaucaguccucacaccuuucuacacauaagauaauuuauacuggagaggaacucuauaguug

SEQ ID NO: 744203 - RNA, 64 nt, Homo Sapiens
gaagcaguugcucaaauguuguucaacaccagaaaauuuauauuggagaaaagcacuguaaaug

SEQ ID NO: 744204 - RNA, 64 nt, Homo Sapiens
acaguaacuuucaugacauaggauucugccgccaaauuuauaucauuaacaaugugugccuuuu

SEQ ID NO: 744205 - RNA, 64 nt, Homo Sapiens
auuuuuuucuguauugauuuuaacagaaaauuucaauuuauagagguuaggaauuccaaacuac

SEQ ID NO: 744206 - RNA, 64 nt, Homo Sapiens
auuguaaauacugcccuagugucuccauggaccaaauuuauauuuauaauuguagauuuuuaua

SEQ ID NO: 744207 - RNA, 64 nt, Homo Sapiens
uggcauacggauaggcuuauuuaagaguuccugaaauuuauaucuuucuguaaaagaagagaca

SEQ ID NO: 744208 - RNA, 64 nt, Homo Sapiens
uuacuguuugaaguaaauaauuauagucuaaacaaauuuauagagaaggaaagguccuuaauua

SEQ ID NO: 744209 - RNA, 64 nt, Homo Sapiens
uuacacuuugaaccauggguuuugauuuuguuucaauuuauaaccacccucccuucuagcagau

SEQ ID NO: 744210 - RNA, 64 nt, Homo Sapiens
caaggcugguggcugucuacucuuauuuuguuugaauuuauaaacacccucccuucuagcagau

SEQ ID NO: 744211 - RNA, 64 nt, Homo Sapiens
agaauagguauuaguugguuuuuuauuauuuuuaaauuuauauagcucucauguauugaaggug

SEQ ID NO: 744212 - RNA, 64 nt, Homo Sapiens
uuaaugccacugaacuguacacuuuaaaauggaaaauuuauauguauuuuuaccacaauaaaca

SEQ ID NO: 744213 - RNA, 64 nt, Homo Sapiens
cagguaaaugugaguuaaauauuuauagacagauaauuuauagacaguuaaguaaaaauggaua

SEQ ID NO: 744214 - RNA, 64 nt, Homo Sapiens
cagauaauuuauagacagguaaguaaaaauggauaauuuauagaaguuaaauuuauagacaguu

SEQ ID NO: 744215 - RNA, 64 nt, Homo Sapiens
caguuaaguaaaaauggauauuuauagacaguuaaauuuauagaauuuuaaaauuaauggauaa

SEQ ID NO: 744216 - RNA, 64 nt, Homo Sapiens
caguuaaauuuauagacaguuaaaauuaauggauaauuuauagacucuacuccagccaacauuu

SEQ ID NO: 744217 - RNA, 64 nt, Homo Sapiens
aaauuugauuguacuauaaaugauuuuuguaaauaauuuauauucugcucuaauacuguacugu

SEQ ID NO: 744218 - RNA, 64 nt, Homo Sapiens
aguguucaaacacuaucccuaaugccugcggcagaauuuauauacgauccauucauuggggcuc

SEQ ID NO: 744219 - RNA, 64 nt, Homo Sapiens
auaugagaaauucauguacauuuuauauuuucugaauuuauaaucugugcacucccaauuuuaa

SEQ ID NO: 744220 - RNA, 64 nt, Homo Sapiens
cauagauaggcaggauauuacauagguaagcaggaauuuauacauuggguaccagagcuaaauc

SEQ ID NO: 744221 - RNA, 64 nt, Homo Sapiens
uaaaggggaaucaugauuauaagugcaauuuauaaauuuauaucaagaaacacuuaacagaggc

SEQ ID NO: 744222 - RNA, 64 nt, Homo Sapiens
uuuauaucuaaaggggaaucacagaggcaagugcaauuuauaaaccccacaaaagaaacacuua

SEQ ID NO: 744223 - RNA, 64 nt, Homo Sapiens
uucauauauuaaaacaauauuaaauuuauaaaauaauuuauaaauaaaauuuuuuaaauuauau

SEQ ID NO: 744224 - RNA, 64 nt, Homo Sapiens
auaauuuauaaauucauauauuuaaauuauauuaaauuuauaaaggauaacuacuuuaaaauuu

SEQ ID NO: 744225 - RNA, 64 nt, Homo Sapiens
gauuccucugcugccauuugaauuagaagaaaauaauuuauaugcaugcacaggaagauauugg

SEQ ID NO: 744226 - RNA, 64 nt, Homo Sapiens
caauuuuuucaaaugaaaggauucucuaauuagaaauuuauaugucagagcuguuauaaauuua

SEQ ID NO: 744227 - RNA, 64 nt, Homo Sapiens
acuagaaugacagauucagggauaccuugauuauaauuuauaggauaccacauauaaccaucaa

SEQ ID NO: 744228 - RNA, 64 nt, Homo Sapiens
agaagcuguccauaacugauuauugcugaauagcaauuuauacaaaucuuugaggcaguuuaug

SEQ ID NO: 744229 - RNA, 64 nt, Homo Sapiens
ggucugcacuccuuuaucugugucuugucauacaaauuuauaaauuuguuuaaacaaucuuuca

SEQ ID NO: 744230 - RNA, 64 nt, Homo Sapiens
guauuugaaaauuacauguuagaagaugccuguuaauuuauaauuacauuuaauaauaucaaag

SEQ ID NO: 744231 - RNA, 64 nt, Homo Sapiens
agcugcucuccuccacauugaaugauaucuuguuaauuuauaggcacauuugugguaauuuaua

SEQ ID NO: 744232 - RNA, 64 nt, Homo Sapiens
ugauaucuuguuaauuuauaggcacauuugugguaauuuauaugucuauagaguaaguauaaga

SEQ ID NO: 744233 - RNA, 64 nt, Homo Sapiens
acguuuuuccaaagaauucacagugcuccuuugcaauuuauagauuucauguugaaauauaugu

SEQ ID NO: 744234 - RNA, 64 nt, Homo Sapiens
uacuaucaagaaaaaauucugugaauuaagauguaauuuauaaaauaacauuucaaugggggua

SEQ ID NO: 744235 - RNA, 64 nt, Homo Sapiens
ucuaaaaccugaagauguuuaauuuuguuuaagcaauuuauaaacuugacauaagagaacuaua

SEQ ID NO: 744236 - RNA, 64 nt, Homo Sapiens
uauuuguguauuaagcacaaauccauaagaagcaaauuuauaccuauaauguuaguuuuuucug

SEQ ID NO: 744237 - RNA, 64 nt, Homo Sapiens
agaugcagaugauaaaacuaauuuugaacuuuuuaauuuauauaaauuauuuuauaucacuuac

SEQ ID NO: 744238 - RNA, 64 nt, Homo Sapiens
cauuuuaagcuccuccuuuucuuugaaauacaauaauuuauauagaaauguguagcagcaaauu

SEQ ID NO: 744239 - RNA, 64 nt, Homo Sapiens
cccucaacccuauucauuagcauuaccaugagugaauuuauaucuaauuauuuccacuugcccu

SEQ ID NO: 744240 - RNA, 64 nt, Homo Sapiens
acuggaagcugcagaucuuugcuaggacgcaauaaauuuauauacuuuuugagggguucuucug

SEQ ID NO: 744241 - RNA, 64 nt, Homo Sapiens
aauuaaguuugugaaugugauaagacugcugcugaauuuauaaaucuucuucuccuaggauucc

SEQ ID NO: 744242 - RNA, 63 nt, Homo Sapiens
ccagugaggugagugaugagaaaggaaaaugggaauuuauaacgccauucugagccacacuga

SEQ ID NO: 744243 - RNA, 64 nt, Homo Sapiens
uaguaacuucuguguuaauauuaccuuaaagcugaauuuauauuuguuuuuuagaacccagcag

SEQ ID NO: 744244 - RNA, 64 nt, Homo Sapiens
ccauuuacauaaggauacacuuuuacaacuauguaauuuauauuucaaacucuuaguuuuuuuu

SEQ ID NO: 744245 - RNA, 64 nt, Homo Sapiens
aacauuuucauuuuaaguugaaacuggauggguuaauuuauauaaagcauagcaaaucuacuuu

SEQ ID NO: 744246 - RNA, 64 nt, Homo Sapiens
uguuuagaggggaaagcaguaggaaggcucuguuaauuuauagcaaaucucagguaagaaggca

SEQ ID NO: 744247 - RNA, 64 nt, Homo Sapiens
uagcauauaggugauguuugcucuuguuuuuauuaauuuauauguauauuuuuuuaauuuaaca

SEQ ID NO: 744248 - RNA, 64 nt, Homo Sapiens
aguacucuugguuuuuauaccauucagaucacugaauuuauaaaguacccaucuaguacuugaa

SEQ ID NO: 744249 - RNA, 64 nt, Homo Sapiens
uuuugcuaucaccaaucauaguguacccaucuuuaauuuauaucagguguauaaauguacauuu

SEQ ID NO: 744250 - RNA, 64 nt, Homo Sapiens
uuugacauaaguaacuuuuaaaauuugucuuaaaaauuuauacaccagcaauuuagacaaagcc

SEQ ID NO: 744251 - RNA, 64 nt, Homo Sapiens
aaguauuuuuauaaugacuguaguucugacuuugaauuuauauauuuauaggcuuggauguuuu

SEQ ID NO: 744252 - RNA, 64 nt, Homo Sapiens
acuguuguugauaaggaacaggguacuuucugaaaauuuauauaaguggacucucugacaaagu

SEQ ID NO: 744253 - RNA, 64 nt, Homo Sapiens
ugggauauauggaaaaaagauauuaaugcagauuaauuuauauuuguaaacaaauuuccuuaca

SEQ ID NO: 744254 - RNA, 64 nt, Homo Sapiens
uuaaagaaaaacauuucuauauugaaauauauauaauuuauaaugaaaauuauaguaguuugua

SEQ ID NO: 744255 - RNA, 64 nt, Homo Sapiens
guguagguuguauacuuacauuuuuucuuuccuuaauuuauacaugauccuuuuuccuuaauuu

SEQ ID NO: 744256 - RNA, 64 nt, Homo Sapiens
ucuuuccuuaauuuauacaugauccuuuuuccuuaauuuauacaugauccaggcacauuugaaa

SEQ ID NO: 744257 - RNA, 64 nt, Homo Sapiens
agaacuuauagcuuuuaaaaauaauuuaguuggcaauuuauaaugagaaggugaguggcaauuu

SEQ ID NO: 744258 - RNA, 64 nt, Homo Sapiens
uuaguuggcaauuuauaauaagaaggugaguggcaauuuauaaucauuugugcaacaauuuuug

SEQ ID NO: 744259 - RNA, 64 nt, Homo Sapiens
uaggcaagauauucauucaucuuuagacacuaugaauuuauauagauaauugcaucuuaaggua

SEQ ID NO: 744260 - RNA, 64 nt, Homo Sapiens
acuagauggcaccuguuauauucugugcaguuuuaauuuauaacuaacuacacauuaguuauaa

SEQ ID NO: 744261 - RNA, 64 nt, Homo Sapiens
auugugagguuuuuugucuucuucauaguguaaaaauuuauauucauucaaauuccaaugugua

SEQ ID NO: 744262 - RNA, 64 nt, Homo Sapiens
aucccugaaacgggcuucaguccuucaggcugguaauuuauauaggugcuuuaagcauucagcu

SEQ ID NO: 744263 - RNA, 64 nt, Homo Sapiens
cuauguacuccugggaagauuuccauuuaaaacuaauuuauaaacauucaaaauauauauuuuu

SEQ ID NO: 744264 - RNA, 64 nt, Homo Sapiens
auuguuuaaaauguugguuuaaggaacaacgaguaauuuauaaaugagaaagaaacacuaacaa

SEQ ID NO: 744265 - RNA, 64 nt, Homo Sapiens
cucugggacacauucaaagcaguguguagagggaaauuuauagcacuaaaugcccacaagagaa

SEQ ID NO: 744266 - RNA, 64 nt, Homo Sapiens
caauaucaugaaaauggcccauacugcccaagguaauuuauagauucaaugccauccccaucaa

SEQ ID NO: 744267 - RNA, 64 nt, Homo Sapiens
guuuggcaacagagugagacuccgucucaaaaaaaauuuauacuguacaaaaaccccacaagug

SEQ ID NO: 744268 - RNA, 64 nt, Homo Sapiens
uuaagaagcccucaauucuuaacagacauaagauaauuuauacuggagagaaacucuacaaauc

SEQ ID NO: 744269 - RNA, 64 nt, Homo Sapiens
gaagcaguugaucaaacuuuguucaacaucagggaauuuauauugaaaaauugugcaaauauaa

SEQ ID NO: 744270 - RNA, 64 nt, Homo Sapiens
uuagccugucccuccaauuuacugcacauaagauaauuuauacuggagagaagcccuacaaaug

SEQ ID NO: 744271 - RNA, 64 nt, Homo Sapiens
gaagaggucacucaaacuuuguucaacaucagggaauuuauauuggagagcugucuugcaaaug

SEQ ID NO: 744272 - RNA, 64 nt, Homo Sapiens
aauuuuaauccaaauuugucuauguaaauaccagaauuuauaguagaaauauaugaggaagcga

SEQ ID NO: 744273 - RNA, 64 nt, Homo Sapiens
caaaaggaauccugcaaguaucuaaauuuauauuaauuuauauuaauucuagucuguuuucuac

SEQ ID NO: 744274 - RNA, 64 nt, Homo Sapiens
aauuuauauucaaaaggaauuguuuucuacucuaaauuuauauuaauacuugaaaauucuaguc

SEQ ID NO: 744275 - RNA, 64 nt, Homo Sapiens
ggagagaaaccucacaaguggcaaaacauaggagaauuuauacaucagucaagcuucauccuau

SEQ ID NO: 744276 - RNA, 64 nt, Homo Sapiens
ggagagaaagcuuacaaauguaaagacauaggagaauuuauacuuccauuuggaaaucacaccu

SEQ ID NO: 744277 - RNA, 64 nt, Homo Sapiens
uaaacacagccauuauaaaaaauuaaaugauuuaaauuuauaauuaaguaaauuacauuaaaac

SEQ ID NO: 744278 - RNA, 64 nt, Homo Sapiens
uugugugcaacaaacauacccuuuaucucuguaaaauuuauacacacaaaaauuaacaaaagau

SEQ ID NO: 744279 - RNA, 64 nt, Homo Sapiens
aaauuaauucuuuauccagagucgggugcuuuagaauuuauaagucacuuauguguuuugcuug

SEQ ID NO: 744280 - RNA, 64 nt, Homo Sapiens
gcacuuugcaaaauaguuuguacauuuauuuccuaauuuauacaugauuuuugguguuaauaua

SEQ ID NO: 744281 - RNA, 64 nt, Homo Sapiens
gguuaauuaaagcuuuugguauaauuuaaaauuaaauuuauaaaugcaguugucuuguuacaag

SEQ ID NO: 744282 - RNA, 64 nt, Homo Sapiens
uugauuucaaucuuagcugauaaaucuaauugguaauuuauagaacaaauauuugauaagcucc

SEQ ID NO: 744283 - RNA, 64 nt, Homo Sapiens
acuuugaauuuaagaaccaccaagcauaaacuaaaauuuauauguuaacugagugaguuaagug

SEQ ID NO: 744284 - RNA, 64 nt, Homo Sapiens
aaguuucagagaacuaccaaacaguaauaaauaaaauuuauacaucaaugugauuuuaguauuu

SEQ ID NO: 744285 - RNA, 64 nt, Homo Sapiens
aauacaugucugaaauuugauggagccaguuauuaauuuauaauuucaucuuuaaccuggugga

SEQ ID NO: 744286 - RNA, 64 nt, Homo Sapiens
agaguuaauaaguuaauguuauuaagcaguuaauaauuuauauguauggauauaauauaaaaug

SEQ ID NO: 744287 - RNA, 64 nt, Homo Sapiens
caccaauucaaaaguuauaggauuaggaaauauaaauuuauauuuggugauuggcagccucuga

SEQ ID NO: 744288 - RNA, 64 nt, Homo Sapiens; identical to SEQ ID NO: 452545

SEQ ID NO: 744289 - RNA, 64 nt, Homo Sapiens; identical to SEQ ID NO: 452546

SEQ ID NO: 744290 - RNA, 64 nt, Homo Sapiens; identical to SEQ ID NO: 452547

SEQ ID NO: 744291 - RNA, 64 nt, Homo Sapiens; identical to SEQ ID NO: 452548

SEQ ID NO: 744292 - RNA, 64 nt, Homo Sapiens; identical to SEQ ID NO: 452549

SEQ ID NO: 744293 - RNA, 64 nt, Homo Sapiens; identical to SEQ ID NO: 452550

SEQ ID NO: 744294 - RNA, 64 nt, Homo Sapiens; identical to SEQ ID NO: 452551

SEQ ID NO: 744295 - RNA, 64 nt, Homo Sapiens; identical to SEQ ID NO: 452552

SEQ ID NO: 744296 - RNA, 64 nt, Homo Sapiens; identical to SEQ ID NO: 452553

SEQ ID NO: 744297 - RNA, 64 nt, Homo Sapiens; identical to SEQ ID NO: 452554

SEQ ID NO: 744298 - RNA, 64 nt, Homo Sapiens; identical to SEQ ID NO: 452555

SEQ ID NO: 744299 - RNA, 64 nt, Homo Sapiens; identical to SEQ ID NO: 452556

SEQ ID NO: 744300 - RNA, 64 nt, Homo Sapiens; identical to SEQ ID NO: 452557

SEQ ID NO: 744301 - RNA, 64 nt, Homo Sapiens; identical to SEQ ID NO: 452558

SEQ ID NO: 744302 - RNA, 64 nt, Homo Sapiens; identical to SEQ ID NO: 452559

SEQ ID NO: 744303 - RNA, 64 nt, Homo Sapiens; identical to SEQ ID NO: 452560

SEQ ID NO: 744304 - RNA, 64 nt, Homo Sapiens; identical to SEQ ID NO: 452561

SEQ ID NO: 744305 - RNA, 64 nt, Homo Sapiens; identical to SEQ ID NO: 452562

SEQ ID NO: 744306 - RNA, 64 nt, Homo Sapiens; identical to SEQ ID NO: 452563

SEQ ID NO: 744307 - RNA, 64 nt, Homo Sapiens; identical to SEQ ID NO: 452564

SEQ ID NO: 744308 - RNA, 64 nt, Homo Sapiens; identical to SEQ ID NO: 452565

SEQ ID NO: 744309 - RNA, 64 nt, Homo Sapiens; identical to SEQ ID NO: 452566

SEQ ID NO: 744310 - RNA, 64 nt, Homo Sapiens; identical to SEQ ID NO: 452567

SEQ ID NO: 744311 - RNA, 64 nt, Homo Sapiens; identical to SEQ ID NO: 452568

SEQ ID NO: 744312 - RNA, 64 nt, Homo Sapiens; identical to SEQ ID NO: 452569

SEQ ID NO: 744313 - RNA, 64 nt, Homo Sapiens; identical to SEQ ID NO: 452570

SEQ ID NO: 744314 - RNA, 64 nt, Homo Sapiens; identical to SEQ ID NO: 452571

SEQ ID NO: 744315 - RNA, 64 nt, Homo Sapiens; identical to SEQ ID NO: 452572

SEQ ID NO: 744316 - RNA, 64 nt, Homo Sapiens; identical to SEQ ID NO: 452573

SEQ ID NO: 744317 - RNA, 64 nt, Homo Sapiens; identical to SEQ ID NO: 452574

SEQ ID NO: 744318 - RNA, 64 nt, Homo Sapiens; identical to SEQ ID NO: 452575

SEQ ID NO: 744319 - RNA, 64 nt, Homo Sapiens; identical to SEQ ID NO: 452576

SEQ ID NO: 744320 - RNA, 64 nt, Homo Sapiens; identical to SEQ ID NO: 452577

SEQ ID NO: 744321 - RNA, 64 nt, Homo Sapiens; identical to SEQ ID NO: 452578

SEQ ID NO: 744322 - RNA, 64 nt, Homo Sapiens; identical to SEQ ID NO: 452579

SEQ ID NO: 744323 - RNA, 64 nt, Homo Sapiens; identical to SEQ ID NO: 452580

SEQ ID NO: 744324 - RNA, 64 nt, Homo Sapiens; identical to SEQ ID NO: 452581

SEQ ID NO: 744325 - RNA, 64 nt, Homo Sapiens; identical to SEQ ID NO: 452582

SEQ ID NO: 744326 - RNA, 64 nt, Homo Sapiens; identical to SEQ ID NO: 452583

SEQ ID NO: 744327 - RNA, 64 nt, Homo Sapiens; identical to SEQ ID NO: 452584

SEQ ID NO: 744328 - RNA, 64 nt, Homo Sapiens; identical to SEQ ID NO: 452585

SEQ ID NO: 744329 - RNA, 64 nt, Homo Sapiens; identical to SEQ ID NO: 452586

SEQ ID NO: 744330 - RNA, 64 nt, Homo Sapiens; identical to SEQ ID NO: 452587

SEQ ID NO: 744331 - RNA, 64 nt, Homo Sapiens; identical to SEQ ID NO: 452588

SEQ ID NO: 744332 - RNA, 61 nt, Homo Sapiens; identical to SEQ ID NO: 452589

SEQ ID NO: 744333 - RNA, 64 nt, Homo Sapiens; identical to SEQ ID NO: 452590

SEQ ID NO: 744334 - RNA, 64 nt, Homo Sapiens; identical to SEQ ID NO: 452591

SEQ ID NO: 744335 - RNA, 64 nt, Homo Sapiens; identical to SEQ ID NO: 452592

SEQ ID NO: 744336 - RNA, 64 nt, Homo Sapiens; identical to SEQ ID NO: 218856

SEQ ID NO: 744337 - RNA, 64 nt, Homo Sapiens; identical to SEQ ID NO: 218857

SEQ ID NO: 744338 - RNA, 64 nt, Homo Sapiens; identical to SEQ ID NO: 218858

SEQ ID NO: 744339 - RNA, 64 nt, Homo Sapiens; identical to SEQ ID NO: 218859

SEQ ID NO: 744340 - RNA, 64 nt, Homo Sapiens; identical to SEQ ID NO: 218860

SEQ ID NO: 744341 - RNA, 64 nt, Homo Sapiens; identical to SEQ ID NO: 218861

SEQ ID NO: 744342 - RNA, 64 nt, Homo Sapiens; identical to SEQ ID NO: 218862

SEQ ID NO: 744343 - RNA, 64 nt, Homo Sapiens; identical to SEQ ID NO: 218863

SEQ ID NO: 744344 - RNA, 64 nt, Homo Sapiens; identical to SEQ ID NO: 218864

SEQ ID NO: 744345 - RNA, 64 nt, Homo Sapiens; identical to SEQ ID NO: 218865

SEQ ID NO: 744346 - RNA, 64 nt, Homo Sapiens; identical to SEQ ID NO: 218866

SEQ ID NO: 744347 - RNA, 64 nt, Homo Sapiens; identical to SEQ ID NO: 218867

SEQ ID NO: 744348 - RNA, 64 nt, Homo Sapiens; identical to SEQ ID NO: 218868

SEQ ID NO: 744349 - RNA, 64 nt, Homo Sapiens; identical to SEQ ID NO: 218869

SEQ ID NO: 744350 - RNA, 64 nt, Homo Sapiens; identical to SEQ ID NO: 218870

SEQ ID NO: 744351 - RNA, 64 nt, Homo Sapiens; identical to SEQ ID NO: 218871

SEQ ID NO: 744352 - RNA, 64 nt, Homo Sapiens; identical to SEQ ID NO: 218872

SEQ ID NO: 744353 - RNA, 64 nt, Homo Sapiens; identical to SEQ ID NO: 218873

SEQ ID NO: 744354 - RNA, 64 nt, Homo Sapiens; identical to SEQ ID NO: 218874

SEQ ID NO: 744355 - RNA, 64 nt, Homo Sapiens; identical to SEQ ID NO: 218875

SEQ ID NO: 744356 - RNA, 64 nt, Homo Sapiens; identical to SEQ ID NO: 218876

SEQ ID NO: 744357 - RNA, 64 nt, Homo Sapiens; identical to SEQ ID NO: 218877

SEQ ID NO: 744358 - RNA, 64 nt, Homo Sapiens; identical to SEQ ID NO: 84813

SEQ ID NO: 744359 - RNA, 64 nt, Homo Sapiens; identical to SEQ ID NO: 84814

SEQ ID NO: 744360 - RNA, 64 nt, Homo Sapiens; identical to SEQ ID NO: 84815

SEQ ID NO: 744361 - RNA, 64 nt, Homo Sapiens; identical to SEQ ID NO: 84816

SEQ ID NO: 744362 - RNA, 64 nt, Homo Sapiens; identical to SEQ ID NO: 84817

SEQ ID NO: 744363 - RNA, 64 nt, Homo Sapiens; identical to SEQ ID NO: 84818

SEQ ID NO: 744364 - RNA, 64 nt, Homo Sapiens; identical to SEQ ID NO: 84819

SEQ ID NO: 744365 - RNA, 64 nt, Homo Sapiens; identical to SEQ ID NO: 84820

SEQ ID NO: 744366 - RNA, 64 nt, Homo Sapiens; identical to SEQ ID NO: 84821

SEQ ID NO: 744367 - RNA, 64 nt, Homo Sapiens; identical to SEQ ID NO: 84822

SEQ ID NO: 744368 - RNA, 64 nt, Homo Sapiens; identical to SEQ ID NO: 84823

SEQ ID NO: 744369 - RNA, 64 nt, Homo Sapiens; identical to SEQ ID NO: 84824

SEQ ID NO: 744370 - RNA, 64 nt, Homo Sapiens; identical to SEQ ID NO: 84825

SEQ ID NO: 744371 - RNA, 64 nt, Homo Sapiens; identical to SEQ ID NO: 84826

SEQ ID NO: 744372 - RNA, 64 nt, Homo Sapiens; identical to SEQ ID NO: 84827

SEQ ID NO: 744373 - RNA, 64 nt, Homo Sapiens; identical to SEQ ID NO: 84828

SEQ ID NO: 744374 - RNA, 64 nt, Homo Sapiens; identical to SEQ ID NO: 84829

SEQ ID NO: 744375 - RNA, 64 nt, Homo Sapiens; identical to SEQ ID NO: 84830

SEQ ID NO: 744376 - RNA, 64 nt, Homo Sapiens; identical to SEQ ID NO: 84831

SEQ ID NO: 744377 - RNA, 64 nt, Homo Sapiens; identical to SEQ ID NO: 84832

SEQ ID NO: 744378 - RNA, 64 nt, Homo Sapiens; identical to SEQ ID NO: 84833

SEQ ID NO: 744379 - RNA, 64 nt, Homo Sapiens; identical to SEQ ID NO: 84834

SEQ ID NO: 744380 - RNA, 64 nt, Homo Sapiens; identical to SEQ ID NO: 84835

SEQ ID NO: 744381 - RNA, 64 nt, Homo Sapiens; identical to SEQ ID NO: 84836

SEQ ID NO: 744382 - RNA, 64 nt, Homo Sapiens; identical to SEQ ID NO: 84837

SEQ ID NO: 744383 - RNA, 64 nt, Homo Sapiens; identical to SEQ ID NO: 84838

SEQ ID NO: 744384 - RNA, 64 nt, Homo Sapiens; identical to SEQ ID NO: 84839

SEQ ID NO: 744385 - RNA, 64 nt, Homo Sapiens; identical to SEQ ID NO: 84840

SEQ ID NO: 744386 - RNA, 64 nt, Homo Sapiens; identical to SEQ ID NO: 84841

SEQ ID NO: 744387 - RNA, 64 nt, Homo Sapiens; identical to SEQ ID NO: 84842

SEQ ID NO: 744388 - RNA, 64 nt, Homo Sapiens; identical to SEQ ID NO: 84843

SEQ ID NO: 744389 - RNA, 64 nt, Homo Sapiens; identical to SEQ ID NO: 84844

SEQ ID NO: 744390 - RNA, 64 nt, Homo Sapiens; identical to SEQ ID NO: 84845

SEQ ID NO: 744391 - RNA, 64 nt, Homo Sapiens; identical to SEQ ID NO: 84846

SEQ ID NO: 744392 - RNA, 64 nt, Homo Sapiens; identical to SEQ ID NO: 84847

SEQ ID NO: 744393 - RNA, 64 nt, Homo Sapiens; identical to SEQ ID NO: 84848

SEQ ID NO: 744394 - RNA, 64 nt, Homo Sapiens; identical to SEQ ID NO: 84849

SEQ ID NO: 744395 - RNA, 64 nt, Homo Sapiens; identical to SEQ ID NO: 84850

SEQ ID NO: 744396 - RNA, 64 nt, Homo Sapiens; identical to SEQ ID NO: 84851

SEQ ID NO: 744397 - RNA, 64 nt, Homo Sapiens; identical to SEQ ID NO: 84852

SEQ ID NO: 744398 - RNA, 64 nt, Homo Sapiens; identical to SEQ ID NO: 84853

SEQ ID NO: 744399 - RNA, 64 nt, Homo Sapiens; identical to SEQ ID NO: 84854

SEQ ID NO: 744400 - RNA, 64 nt, Homo Sapiens; identical to SEQ ID NO: 84855

SEQ ID NO: 744401 - RNA, 64 nt, Homo Sapiens; identical to SEQ ID NO: 84856

SEQ ID NO: 744402 - RNA, 64 nt, Homo Sapiens; identical to SEQ ID NO: 84857

SEQ ID NO: 744403 - RNA, 64 nt, Homo Sapiens; identical to SEQ ID NO: 84858

SEQ ID NO: 744404 - RNA, 64 nt, Homo Sapiens; identical to SEQ ID NO: 84859

SEQ ID NO: 744405 - RNA, 64 nt, Homo Sapiens; identical to SEQ ID NO: 84860

SEQ ID NO: 744406 - RNA, 64 nt, Homo Sapiens
cuaagaaaccacuauuauauauuuuuucccuucagucacauagacuucagacaacucuccuauu

SEQ ID NO: 744407 - RNA, 64 nt, Homo Sapiens
ccgguucaacccuaccagcuugugguaacuuacugucacauagcucugacguuuuguuguaaua

SEQ ID NO: 744408 - RNA, 64 nt, Homo Sapiens
cugcccagauguugacccucacccagcgugagcugucacauaguaggagcuucuagaugcaugu

SEQ ID NO: 744409 - RNA, 64 nt, Homo Sapiens
uuugaauuucugagcuaaagagucagagagauuagucacauaguugccuaaauaggagagagaa

SEQ ID NO: 744410 - RNA, 64 nt, Homo Sapiens
uuucucccacuuucuaggaucauuuuuauguaaagucacauaucccaggcccucagguugaauc

SEQ ID NO: 744411 - RNA, 64 nt, Homo Sapiens
cugauacucccaagagcaggccccaggggucugugucacauaucucugugugauuccuucuggu

SEQ ID NO: 744412 - RNA, 64 nt, Homo Sapiens
acuguaagccuucucgacuuagacuuaaaaaguggucacauagauuaauuuugugacuuuuuag

SEQ ID NO: 744413 - RNA, 64 nt, Homo Sapiens
cagugcuccccacugaaaauuaaaccuaaaaaaugucacauauugguauguuguuaaccuggua

SEQ ID NO: 744414 - RNA, 64 nt, Homo Sapiens
ugugaugauuaauacaauauuaauuauaauaaaggucacauaaacuuuauaaauucauaacugg

SEQ ID NO: 744415 - RNA, 64 nt, Homo Sapiens
agcugcaucauugaccgcacucccuccccgacaggucacauaacugcucccuucccucgucccu

SEQ ID NO: 744416 - RNA, 64 nt, Homo Sapiens
gaaauagcaaauagaaauguccucagagauucaugucacauauuguauacgugugacaugcugg

SEQ ID NO: 744417 - RNA, 64 nt, Homo Sapiens
ucuuucccugacuuaguacaaaaacagcaacaaagucacauaaacuuagaugcagagagaggaa

SEQ ID NO: 744418 - RNA, 64 nt, Homo Sapiens
augaauuuuugcuucauuacuagaaagucuuuaagucacauaccaucccauggguacaaugucu

SEQ ID NO: 744419 - RNA, 64 nt, Homo Sapiens
aagaggaaaauuugcagcugagagaauagucucagucacauaugugggguaaagccauguaaga

SEQ ID NO: 744420 - RNA, 64 nt, Homo Sapiens
uagaugguaaagagaaugaggaggggcuuggagggucacauaggugagcaggggagaaauagca

SEQ ID NO: 744421 - RNA, 64 nt, Homo Sapiens
ggaaaauggaaaggcugauguggugggaauaaaggucacauauuggacucguuuauuugggaca

SEQ ID NO: 744422 - RNA, 64 nt, Homo Sapiens
ucuguaucuacuuagccagauugguguuuuauaggucacauauguacuucauuagcaagugagu

SEQ ID NO: 744423 - RNA, 64 nt, Homo Sapiens
uaagcacugcacaugagauaagugacucugaguagucacauauaaaggaugagauuacaccuac

SEQ ID NO: 744424 - RNA, 64 nt, Homo Sapiens
ugagagaaacugugaauguacaaaaacaugaacagucacauacuuuaaucacuacaguuuuugu

SEQ ID NO: 744425 - RNA, 64 nt, Homo Sapiens
uguagcuuuuucuguuaaaaaugguauacaugaagucacauacuuuuuuaaaggaacacucaga

SEQ ID NO: 744426 - RNA, 64 nt, Homo Sapiens
cauuuuauaacauugggcacgguacagagugauugucacauaagguacuugaagauuuauuagu

SEQ ID NO: 744427 - RNA, 64 nt, Homo Sapiens
cuaucaucagaaugggcagagaugaucuugaagugucacauacacuaaaguccaaacacuaugu

SEQ ID NO: 744428 - RNA, 64 nt, Homo Sapiens
ugaaugacaagaaaacaagggaaagaguuaaccugucacauagcagguuaacuuuuucaggguu

SEQ ID NO: 744429 - RNA, 64 nt, Homo Sapiens
agaaugcugaccuuucauaugggaucacaaaagugucacauauuuuaucugugacuauuauaua

SEQ ID NO: 744430 - RNA, 64 nt, Homo Sapiens
auuuugaagaaaacuuggcuuugagucguauucugucacauaaugaauuguuguagccggugaa

SEQ ID NO: 744431 - RNA, 64 nt, Homo Sapiens
cuuuccccuaauagucgggucugacucacauucugucacauacguuuuguaauguuuuuauguc

SEQ ID NO: 744432 - RNA, 64 nt, Homo Sapiens
uuguaaauuuuuaccuuguaaaaaauaaaaagcugucacauauuguauaugauguaacuguauc

SEQ ID NO: 744433 - RNA, 64 nt, Homo Sapiens
aaacuugaaaggucugaggaaacucacuauauaagucacauaggccagugguacuaagcacaga

SEQ ID NO: 744434 - RNA, 64 nt, Homo Sapiens
uacauauguaucuuauaaucgugugaauuagaaagucacauauauuuuaguacuuguaugaaag

SEQ ID NO: 744435 - RNA, 64 nt, Homo Sapiens
aggucaguguuucucguccccugugaccucaggggucacauauacucuuggugaucuauucauu

SEQ ID NO: 744436 - RNA, 64 nt, Homo Sapiens
cacacuguugacuaccucaugugugagaugaggggucacauaacccugaacgugccucugcgaa

SEQ ID NO: 744437 - RNA, 64 nt, Homo Sapiens
ggugauagaaugaauucaaccuugguuaaagaaugucacauauuucaauccauucuucacaagu

SEQ ID NO: 744438 - RNA, 64 nt, Homo Sapiens
caaagcaaucaagcaccaggguuugaagucaaaugucacauagguuuauaaagguaaaauggca

SEQ ID NO: 744439 - RNA, 64 nt, Homo Sapiens
auuauuuuuacaguucuccccugcuuucaucuuggucacauacauauccaaagcugaauacauu

SEQ ID NO: 744440 - RNA, 64 nt, Homo Sapiens
aguguuccaauaaaauggauaacaccagauucaagucacauaaauuuagaaaaaucaacaaccu

SEQ ID NO: 744441 - RNA, 64 nt, Homo Sapiens
gacauugagcucaguggccugauuguugucuaaagucacauauuagcuuccuaaaauaugaaga

SEQ ID NO: 744442 - RNA, 64 nt, Homo Sapiens
auugagcaucuccaucugguaaguguucucacacgucacauacgacaaauuuuaaacgaaucca

SEQ ID NO: 744443 - RNA, 64 nt, Homo Sapiens
auugagguucagcaaggugagagagguacccaaggucacauagcuaguuaugugagaaaguuag

SEQ ID NO: 744444 - RNA, 64 nt, Homo Sapiens
augauugugcauguuuuguaugucauaguaugucgucacauaaaagggagggagcgaaaaacca

SEQ ID NO: 744445 - RNA, 64 nt, Homo Sapiens
auagauuugcaguucugguuuauauaauaccaaagucacauacagguaauuucccaccauugaa

SEQ ID NO: 744446 - RNA, 64 nt, Homo Sapiens
uaacuaguuucagaauuaguaaaugugagauucagucacauaauuaucagacauuccauuuguc

SEQ ID NO: 744447 - RNA, 64 nt, Homo Sapiens
ggugucuaucauaugaagauaacgccuucccuaagucacauaucagaauaggaagauaugccac

SEQ ID NO: 744448 - RNA, 64 nt, Homo Sapiens
ccaccaggagcagcgccugugcagaaugaacgaagucacauaggcuccuuaauuuuuuuuuuuu

SEQ ID NO: 744449 - RNA, 64 nt, Homo Sapiens
uaagauggcuuauuuguauaaugguguuacuaaagucacauauaaaaguuaaacuacuuguaaa

SEQ ID NO: 744450 - RNA, 64 nt, Homo Sapiens
caguguccaaaauauauaaguaaauagcuguagagucacauauaugaagugaauagcauaugug

SEQ ID NO: 744451 - RNA, 64 nt, Homo Sapiens
cauugauuuuguuuugcuuguuaagcaaaggaaugucacauaccucuguccagcuuuuuaggaa

SEQ ID NO: 744452 - RNA, 64 nt, Homo Sapiens
ugguugaauggcuuuucuuagugugguauuugcugucacauaguuuuuccugggugagucugcc

SEQ ID NO: 744453 - RNA, 64 nt, Homo Sapiens
ugccuuugguacaacuaaauuaaaacucuugguggucacauauuguauauaaacaaaacaauau

SEQ ID NO: 744454 - RNA, 64 nt, Homo Sapiens
gcauuuuuuuaaaaagucaggcucuuccucaccugucacauaaacuucauccacaggaaacacu

SEQ ID NO: 744455 - RNA, 64 nt, Homo Sapiens
aaaaaaauacugcauugauaaaccuuguuucacugucacauaugaaaucaguuuuuuguuuaaa

SEQ ID NO: 744456 - RNA, 64 nt, Homo Sapiens
aaaggaggcuguguuagugaaagaagcggauccagucacauaggcugaugcacugauggcccug

SEQ ID NO: 744457 - RNA, 64 nt, Homo Sapiens
uuugaauuucacagccuucuacugaauuuucuuugucacauaguuaucaaagccugugguacgc

SEQ ID NO: 744458 - RNA, 64 nt, Homo Sapiens
uggguuuccuuuggguacccucagcccaaguugggucacauagacugcucugguuugcauucaa

SEQ ID NO: 744459 - RNA, 64 nt, Homo Sapiens
acuguaagguacaguuaggggagugacuagagaagucacauaucugccaucacuggauaaugug

SEQ ID NO: 744460 - RNA, 64 nt, Homo Sapiens
uuaaacuauuuaauuuguuuaugcuuaucugccugucacauaaggacuucauuaugcuuuugaa

SEQ ID NO: 744461 - RNA, 64 nt, Homo Sapiens
aauauauuaaaaaccauugauuauugugguaauggucacauaacuucaugaaaauggucuaaac

SEQ ID NO: 744462 - RNA, 64 nt, Homo Sapiens
cggcuauuagcaucagcuguccuaagaagcaguugucacauaaaggagucuuagggacuugaaa

SEQ ID NO: 744463 - RNA, 64 nt, Homo Sapiens
uuuggcaugugugugugaaauaaauauguagauagucacauauacacagacugagagauaaauu

SEQ ID NO: 744464 - RNA, 64 nt, Homo Sapiens
uuagugaaguucuuuuacuguaauuggugacaaugucacauaaugaaugcuauugaaaagguua

SEQ ID NO: 744465 - RNA, 64 nt, Homo Sapiens
caccuauaaaacagcauagauauaaaguacugaagucacauagcaagauugacuggcuauuuau

SEQ ID NO: 744466 - RNA, 64 nt, Homo Sapiens
uauucuuauccuacagauaucacacacacauacagucacauagauuuggugacuuuucuacaca

SEQ ID NO: 744467 - RNA, 64 nt, Homo Sapiens
guguuuuuauuuuaacauggcaagggacuccugugucacauacucagaucuccucaagaaacau

SEQ ID NO: 744468 - RNA, 64 nt, Homo Sapiens
ccaguagcuauuccgauuggauauuccguucgucgucacauagcuggcuuuucucuccucauga

SEQ ID NO: 744469 - RNA, 64 nt, Homo Sapiens
agaugccaaaaacaaaaaaagcaucucacugcaagucacauaaaaaugcaacgcuguaauaugg

SEQ ID NO: 744470 - RNA, 64 nt, Homo Sapiens
uuucuggggauugaaaucuuuaguccuuggagcugucacauagcaggggcaaccucacacugaa

SEQ ID NO: 744471 - RNA, 64 nt, Homo Sapiens
aagucuguguuccauugugccauucagguuugcugucacauaugcaucaucugaaaucauuuga

SEQ ID NO: 744472 - RNA, 64 nt, Homo Sapiens
acuuaccaccuuuuccuguaguuaaaguuuuauugucacauagccacauacauucauuuacaug

SEQ ID NO: 744473 - RNA, 64 nt, Homo Sapiens
aucuucucauccaccaccuucuccugcuucuccugucacauagggccucaugaaggucuuuaaa

SEQ ID NO: 744474 - RNA, 64 nt, Homo Sapiens
caucaucaucgaagucuuccccaguuauaaagaggucacauagucgugugggucgaggauucug

SEQ ID NO: 744475 - RNA, 64 nt, Homo Sapiens
gcuugggaguaccacuggaaggggaugauuauuagucacauagaugcuaugcugucaugacuag

SEQ ID NO: 744476 - RNA, 64 nt, Homo Sapiens
uauccucaguaacacagaacuuguuugaaugaaugucacauaggccauuucauuaggaacuuuu

SEQ ID NO: 744477 - RNA, 64 nt, Homo Sapiens
uuaagaauacuuuaugauuugaaauauuugaacugucacauauaucacugugggaaaauuugau

SEQ ID NO: 744478 - RNA, 64 nt, Homo Sapiens
acugauuuguuuuuuacagcuaauaguuauuggugucacauaaaguuuuaaaacacugaaacag

SEQ ID NO: 744479 - RNA, 64 nt, Homo Sapiens
uacucaugucucaaguaagcuuaaacuacaacuugucacauaaaggaagucuuaaguggaguuc

SEQ ID NO: 744480 - RNA, 64 nt, Homo Sapiens
gcccuuuuucaagcagauuuaugagcagauuucugucacauaagucgucuucugcuugaguauc

SEQ ID NO: 744481 - RNA, 64 nt, Homo Sapiens
gggcagagacucugguauaugaaaacgucugaaagucacauauugugaaaauuugaagcuaucu

SEQ ID NO: 744482 - RNA, 64 nt, Homo Sapiens
acuucaauuccugugcauuagugugaugauuucugucacauagcagcauuccgauucuauguaa

SEQ ID NO: 744483 - RNA, 64 nt, Homo Sapiens
gagaaggcaagcaugugugagugaagauuagagggucacauauaacuggcuguuuucuguucuu

SEQ ID NO: 744484 - RNA, 64 nt, Homo Sapiens
augauggcauuucuggaaauuuucuaaauucugugucacauacgccauucuucacaaagucauu

SEQ ID NO: 744485 - RNA, 64 nt, Homo Sapiens
auuauugccagaugagcauacuaaagacauauaggucacauauuuaauaugagaaauuaagucc

SEQ ID NO: 744486 - RNA, 64 nt, Homo Sapiens
uucuccauauugccuuauguguguuugugucagugucacauaaggugugugugugugugugugu

SEQ ID NO: 744487 - RNA, 64 nt, Homo Sapiens
auuaaauuuuacaauuugaguauaacuuucuuuggucacauaaugaggaaauugagguucuggg

SEQ ID NO: 744488 - RNA, 64 nt, Homo Sapiens
cucagaaguugcaucauuagccaguaguaggugggucacauaguaccugguguacacaucgggg

SEQ ID NO: 744489 - RNA, 64 nt, Homo Sapiens
ccagggcccucgucccgaggguugcuguggcucagucacauauccucuuaauuggcacccgaau

SEQ ID NO: 744490 - RNA, 64 nt, Homo Sapiens
accugguguacacaucggggccaguaguaggugggucacauaguuucagaaguugcaucauuag

SEQ ID NO: 744491 - RNA, 64 nt, Homo Sapiens
uacuuucguaauagcucagaaguagcugucagaugucacauaauaauucagugucacaugagga

SEQ ID NO: 744492 - RNA, 64 nt, Homo Sapiens
uucucuaaugcaguccuucugcaaaccuaacagggucacauaugugguuuauggccucgauucu

SEQ ID NO: 744493 - RNA, 64 nt, Homo Sapiens
gugggacuggagccauaguaauccaugcaaacgagucacauauggguuugauuagcauuuccgc

SEQ ID NO: 744494 - RNA, 64 nt, Homo Sapiens
uccuugccuguguuagacaugaagggaaaaagaggucacauauugugauuuccagcuguagcau

SEQ ID NO: 744495 - RNA, 64 nt, Homo Sapiens
cagccagagcuuucuauguacuguuaaaauugaggucacauauuuucuuuuguauccuggcaaa

SEQ ID NO: 744496 - RNA, 64 nt, Homo Sapiens
uaauggugccacguguuuucuccagucuauuauagucacauagaccucucuuccaaugaaaccc

SEQ ID NO: 744497 - RNA, 64 nt, Homo Sapiens
agucugugacuugaaguuuacccugcuccaaucugucacauaaauucucuacaugcauaacaaa

SEQ ID NO: 744498 - RNA, 64 nt, Homo Sapiens
ucucuuaggacuuuuaaagagacaguaacuaccugucacauauuagguagaaaauaucccuacu

SEQ ID NO: 744499 - RNA, 64 nt, Homo Sapiens
ggggugaugauuugcaagagaaaauuaguggagagucacauagguaaaucauuauuuaacuuag

SEQ ID NO: 744500 - RNA, 64 nt, Homo Sapiens
ggucacauuggcgccuagaacaguuaggucgcucgucacauaggcaguuaaguggagaaccagg

SEQ ID NO: 744501 - RNA, 64 nt, Homo Sapiens
uuuuacaguuuggacuuuuaagaaaacuugaauugucacauacauaccaccagacuccuaacau

SEQ ID NO: 744502 - RNA, 64 nt, Homo Sapiens
uaauauucuuccuaaaaaccacaugguuuuugaagucacauacuuuugauuggcagguuaaaua

SEQ ID NO: 744503 - RNA, 64 nt, Homo Sapiens
ggcacaaccaggccuagcacaaaugguuacuguagucacauaguacacccccacaacuuuguac

SEQ ID NO: 744504 - RNA, 64 nt, Homo Sapiens
agagaagaccagaugugcauagaagccagucucugucacauacaccgcagguggucaccgaguu

SEQ ID NO: 744505 - RNA, 64 nt, Homo Sapiens
gccugagcccugugaaguuaaacaccugcucauggucacauagcccaggcagaagaaaaucucg

SEQ ID NO: 744506 - RNA, 64 nt, Homo Sapiens
cuauucuccauacucuguaacaguugcauugacugucacauaaugcucauacuuaucuaauguu

SEQ ID NO: 744507 - RNA, 64 nt, Homo Sapiens
aauccaggauggaaagaaaugcagaacuaucauagucacauacauauaagagggaugguguuuu

SEQ ID NO: 744508 - RNA, 64 nt, Homo Sapiens
aauggaacauaauaaauuuuuccaauuuuggaacgucacauaacgcagugguuuugccuagugu

SEQ ID NO: 744509 - RNA, 64 nt, Homo Sapiens
gcaggugcaucaguuacuuuagaacaucucucgugucacauacuuugaccucauaaaagaguug

SEQ ID NO: 744510 - RNA, 64 nt, Homo Sapiens
aguuggaagaggagacugggaggcagcaagaggggucacauaccagcucaggggagaauggagu

SEQ ID NO: 744511 - RNA, 64 nt, Homo Sapiens
uuuagagugucugggacgcugcuguauucugaaagucacauagcacacaguaauguuaucugga

SEQ ID NO: 744512 - RNA, 64 nt, Homo Sapiens
ucaguauuuucuuuuccuccuagugcuaucauuagucacauaaugaccuugauuuuauuuuagg

SEQ ID NO: 744513 - RNA, 64 nt, Homo Sapiens
uuuuuggugagugcugcuuuuauaaauaugugaugucacauauuucagugacagcugauguuau

SEQ ID NO: 744514 - RNA, 64 nt, Homo Sapiens
uuaccccaccccuacugauuaugaugucacugcugucacauauugucauacguggggggcuguu

SEQ ID NO: 744515 - RNA, 64 nt, Homo Sapiens
caaaggagcugccugccugugucagggccaccccgucacauauacugguagggcuguguuuaca

SEQ ID NO: 744516 - RNA, 64 nt, Homo Sapiens
uuauagucuuaauaucuugugcugguucuuuguagucacauauuaauaucuauguauuuauuuc

SEQ ID NO: 744517 - RNA, 64 nt, Homo Sapiens
acuuuuuuuuuuuuugagauuauuaugguuagcugucacauacauuuuuucuuucuuuuuuuuu

SEQ ID NO: 744518 - RNA, 64 nt, Homo Sapiens
aaaggcugcccaaauccccauuuucuuccuaaaugucacauagcaguaauucaaaagcugguau

SEQ ID NO: 744519 - RNA, 64 nt, Homo Sapiens
aagucccgaggcagcaacagguccggcuuggcuagucacauaucaagacaaugacacuggaagg

SEQ ID NO: 744520 - RNA, 64 nt, Homo Sapiens
accaguaauugaaagacgucgggugggggcauuggucacauauguaucuuuuuuuuuuuggcug

SEQ ID NO: 744521 - RNA, 64 nt, Homo Sapiens
gugaucuuucccaagagaaguuagcuugcaccuugucacauagagcauucaaaugggcugcugc

SEQ ID NO: 744522 - RNA, 64 nt, Homo Sapiens
ccaauuccuaaaggguaaagaaggguuaaaguaggucacauauauacaguagcagcuguaaaua

SEQ ID NO: 744523 - RNA, 64 nt, Homo Sapiens
ugcuacucuuaaccucccaaaaagcaguaucuaagucacauacaugaugucuugggcauuuucu

SEQ ID NO: 744524 - RNA, 64 nt, Homo Sapiens
uuuucauacauacuuuacuugaauuauugcuguugucacauauuuuugccucugugaguucauc

SEQ ID NO: 744525 - RNA, 64 nt, Homo Sapiens
cucaucuuuucuagguugucaacagguacuauuugucacauaacuaacuuucgaggcacuggaa

SEQ ID NO: 744526 - RNA, 64 nt, Homo Sapiens
uguaaauaauagaugucaguauuuaucaugaugggucacauauagacauauguacauauuauau

SEQ ID NO: 744527 - RNA, 64 nt, Homo Sapiens
uggauuaauuacuaauuucacuguguuuuaucuagucacauaaagcuuuugaaucaucccuauu

SEQ ID NO: 744528 - RNA, 64 nt, Homo Sapiens
auuauuuaauuguacuugucuuccuaagggaaaugucacauauuucuuaacuuuuuauuagcuc

SEQ ID NO: 744529 - RNA, 64 nt, Homo Sapiens
aucaguaccuuguucuggucuuccuucuccucgagucacauaauaaaauuuuauauaucucccc

SEQ ID NO: 744530 - RNA, 64 nt, Homo Sapiens
aucagcacuuugugcuggucuuccuucuccucaagucacauaauaaaacuauauauaucucccc

SEQ ID NO: 744531 - RNA, 64 nt, Homo Sapiens
ucccuucccaguccaaugccccagaauuauuggggucacauaugaaugaccaggagugucaucu

SEQ ID NO: 744532 - RNA, 64 nt, Homo Sapiens
ugccuaaaugcacagucaugucuccuucuucuuggucacauauaucuccaguguuuuccauuuc

SEQ ID NO: 744533 - RNA, 64 nt, Homo Sapiens
augcggcacuauuucugaacugauugguuuaaaagucacauaaauuucuaacauaaguaagacu

SEQ ID NO: 744534 - RNA, 64 nt, Homo Sapiens
uguuuaguucugggaaauugaugaccuauguuuagucacauauuuuaguauucauuuaucaaaa

SEQ ID NO: 744535 - RNA, 64 nt, Homo Sapiens
uuuuucuuggaaaaauuuauauaacacuauuuuugucacauaucauuuuggcagaaauaagucu

SEQ ID NO: 744536 - RNA, 64 nt, Homo Sapiens
ccaacgccagagccccuccacuugcuccuauggagucacauaaggggggcucccggccaccugu

SEQ ID NO: 744537 - RNA, 64 nt, Homo Sapiens
gagagugguaauucagauuuggucaacgauucuagucacauauuuuccuccaaaaguauuccuu

SEQ ID NO: 744538 - RNA, 64 nt, Homo Sapiens
ucugccuuuauguugcauaaaaugucauuaucaggucacauaaagggggauuguuuuuuguaaa

SEQ ID NO: 744539 - RNA, 64 nt, Homo Sapiens
uuuaaaaaucaaacgauuucuccauacgcucauagucacauauggaauuuugagaaaauaaagc

SEQ ID NO: 744540 - RNA, 64 nt, Homo Sapiens
uggguaccuauccagccauuccugcuaguaagcagucacauaagugaggcauacaguaaggcug

SEQ ID NO: 744541 - RNA, 64 nt, Homo Sapiens
acauaaaauuaguuucuaugcaugucauucugaggucacauaacgcuuugcagagugccauggu

SEQ ID NO: 744542 - RNA, 64 nt, Homo Sapiens
aaagcauuuuuacaagauaguccuggucccucaggucacauaugccaggggcucccuucaccuc

SEQ ID NO: 744543 - RNA, 64 nt, Homo Sapiens
ugcauaagaaguuaaucaccuugccagugggguggucacauauaguguucucaagcuuuacugu

SEQ ID NO: 744544 - RNA, 64 nt, Homo Sapiens
ucaaacacaacuagauggggaaguuagaagaaaggucacauauuaaacagaaguuuaagaccac

SEQ ID NO: 744545 - RNA, 64 nt, Homo Sapiens
uaucuuugauaaagguagagaguuaugauacuuagucacauaauuccauuccauguaccagcuu

SEQ ID NO: 744546 - RNA, 64 nt, Homo Sapiens
uuuaaaaaaaaaaaaaaaagacggaaaaaaaugugucacauacuauuacauccacaccugcaua

SEQ ID NO: 744547 - RNA, 64 nt, Homo Sapiens
aaauuaguagcagagccggggugacuuggcuaaagucacauagcaaacaggcccaggagauuaa

SEQ ID NO: 744548 - RNA, 64 nt, Homo Sapiens
caugggacugccgguggccacuggagcuguaagggucacauaaugaaaggcuuucuguuuugau

SEQ ID NO: 744549 - RNA, 64 nt, Homo Sapiens
ccucggcagguggcgguaaaagcgcccccaucaagucacauaacauccugccuccgagagcgcg

SEQ ID NO: 744550 - RNA, 64 nt, Homo Sapiens
gcaugccauuauuagccaugaagggaauaucuuugucacauaggaauuguucagcaacagaaag

SEQ ID NO: 744551 - RNA, 64 nt, Homo Sapiens
aauccaaacauguaagcacacacucacuuauuaagucacauacuuuucuaggugcuggggauug

SEQ ID NO: 744552 - RNA, 64 nt, Homo Sapiens
auuagcuaacauacccucccucuccacaaccccugucacauaccuuucaggaggugacaguugu

SEQ ID NO: 744553 - RNA, 64 nt, Homo Sapiens
cuggauuuuccccugaagacuuacuuauucuuccgucacauauacaaaagcaagacuuccaggu

SEQ ID NO: 744554 - RNA, 64 nt, Homo Sapiens
ggagucuccccaggcugcuuuucuaggaauaccagucacauaguuuuuauuuuugugucuguga

SEQ ID NO: 744555 - RNA, 64 nt, Homo Sapiens
aaauucaauaaaacccaauauuaggccgaccuuggucacauacccccaggaccugcgccauccu

SEQ ID NO: 744556 - RNA, 64 nt, Homo Sapiens
ugggauuugaacugagccguugaacguacccaaggucacauagcuagcagucaucauuugucuu

SEQ ID NO: 744557 - RNA, 64 nt, Homo Sapiens
uguaguaggauuugccaagauuauuucccucuuugucacauauccagacuauaaggaaauggaa

SEQ ID NO: 744558 - RNA, 64 nt, Homo Sapiens
uggugucagugagguggggaaaggaagucuuccugucacauaugcagguucguuuucauucuag

SEQ ID NO: 744559 - RNA, 64 nt, Homo Sapiens
cggcccucuggccaccuacccgagagaucguagggucacauacauccaacuucaccacuuggcu

SEQ ID NO: 744560 - RNA, 64 nt, Homo Sapiens
ucaauaagaccgggguaagggggacaggauacuugucacauauuugaagaaauuccauacagug

SEQ ID NO: 744561 - RNA, 64 nt, Homo Sapiens
ugugcagcugaaauagugaucugcuucugucacugucacauagacagcccugcaugcccccugu

SEQ ID NO: 744562 - RNA, 64 nt, Homo Sapiens
uuaaaaaugaaauugcuguuuaacuuucuuaagugucacauaauuaauauucagaauaguugau

SEQ ID NO: 744563 - RNA, 61 nt, Homo Sapiens
uugucccaguucuuucaugagcaugaaaggagucacauagagaaaccccaugaaaguaaga

SEQ ID NO: 744564 - RNA, 64 nt, Homo Sapiens
caugauacugaaugaaagacaucagaugcaaaaggucacauaguguacuguccuuuuauaugaa

SEQ ID NO: 744565 - RNA, 64 nt, Homo Sapiens
gaguguggacucuggugccuccagaggggcucaggucacauaaaacuuuguauaucaacgagcu

SEQ ID NO: 744566 - RNA, 64 nt, Homo Sapiens
agcaauuuccccccaacuccgauggguaggaauugucacauacccaugugacccgauaggaggc

SEQ ID NO: 744567 - RNA, 64 nt, Homo Sapiens
augaaauguuuggccuuagucaaugucuaugcccgucacauaacagccgaggcaccgaggccca

SEQ ID NO: 744568 - RNA, 64 nt, Homo Sapiens
agacaaaauugggagaacaaaagaaaagcgucuugucacauacagaaggucccugauaaaguua

SEQ ID NO: 744569 - RNA, 64 nt, Homo Sapiens
agaggccccacacagggagaaaaggaaggcaucagucacauauuugagauuucaaaggcacaga

SEQ ID NO: 744570 - RNA, 64 nt, Homo Sapiens
aagacucuguuucaaaaaaauuacgccaaccugggucacauagcauggucacagugaacuauga

SEQ ID NO: 744571 - RNA, 64 nt, Homo Sapiens
guacuguccuuuuauacgaagucagaugcaaaaggucacauagucaugauacugaaugaaagac

SEQ ID NO: 744572 - RNA, 64 nt, Homo Sapiens
accguggugauggcgucacggcaacggcgcugacgucacauaucgcggagaugacgucacgcaa

SEQ ID NO: 744573 - RNA, 64 nt, Homo Sapiens
ccagcaucuuucuguaccucuggccaccagccucgucacauacaacugcacuguggugcuucag

SEQ ID NO: 744574 - RNA, 64 nt, Homo Sapiens
aucacucaccccuguccucagagugauaaacuaagucacauacagauaaagcacugaaaacacc

SEQ ID NO: 744575 - RNA, 64 nt, Homo Sapiens
aaacagcugguauuuguaucuaaaacucagauuggucacauaaaugccacggcauuccgaaguu

SEQ ID NO: 744576 - RNA, 64 nt, Homo Sapiens
gacaaguucaucagaaggaaggcaguccuuagaagucacauacguugagccacguugcuccuaa

SEQ ID NO: 744577 - RNA, 64 nt, Homo Sapiens
cuacggggcuagggcgagagcagguguuugugaagucacauaauaaguugcuugaagugcauua

SEQ ID NO: 744578 - RNA, 64 nt, Homo Sapiens
gauuuuucucuucuaauuugcuuuuaagcauacagucacauaauuacugaauuuuaucaaauac

SEQ ID NO: 744579 - RNA, 64 nt, Homo Sapiens
auccuucaaugauugauuauacuaagaauaaauggucacauauccuaaaagcuucuucaugaaa

SEQ ID NO: 744580 - RNA, 64 nt, Homo Sapiens
cuuuguacucagagaagaggccucacauggcugugucacauauaaauguuggacuaaacucuua

SEQ ID NO: 744581 - RNA, 64 nt, Homo Sapiens
uaaaaauucucauuacauagacgcacaagaauaugucacauaaagaaaauguguuuagaauacu

SEQ ID NO: 744582 - RNA, 64 nt, Homo Sapiens
gaauugguguuucccgcagucccugcucacuccagucacauagauccugaguugguugccucuc

SEQ ID NO: 744583 - RNA, 64 nt, Homo Sapiens
aagaccccgucucuacaaaacgagaccagccugggucacauagcaucacuugagcucaggaauu

SEQ ID NO: 744584 - RNA, 64 nt, Homo Sapiens
guaaacuuuucuuucucuuacacaaaugauaguagucacauacacuacacacacugugccacgu

SEQ ID NO: 744585 - RNA, 64 nt, Homo Sapiens
ccaaugaaaccaagaauuucucaaaauauuuaaugucacauauuauaagaaguuaccuaauccu

SEQ ID NO: 744586 - RNA, 64 nt, Homo Sapiens
acacucccguuuggcccucagcacuuugggccuggucacauaccccaucccuagagugcucuuu

SEQ ID NO: 744587 - RNA, 64 nt, Homo Sapiens
gacauucauaggucccaaaucugcccauucagaugucacauaauauggugggauaucaauuuac

SEQ ID NO: 744588 - RNA, 64 nt, Homo Sapiens
auaacauuaaagacucugaacacccaagguuggugucacauauaaaaauuaagcugaugacuuu

SEQ ID NO: 744589 - RNA, 64 nt, Homo Sapiens
uuauggugaacaaaaaaaaaaccagucucaaauggucacauacuguaugaucgcauuuauauaa

SEQ ID NO: 744590 - RNA, 64 nt, Homo Sapiens
aaaugaauggaaacuuuguuaagggaauugacaugucacauauccauauguaaaaaaaaaaaaa

SEQ ID NO: 744591 - RNA, 50 nt, Homo Sapiens
acauuuucuuuuuuuguugugucacauaagguggaaacuguucgugcuaa

SEQ ID NO: 744592 - RNA, 64 nt, Homo Sapiens
agacaggaucaaaccugaaauuguugcugaggaugucacauauaauaauucagaucauuuuagc

SEQ ID NO: 744593 - RNA, 64 nt, Homo Sapiens
ugucccccugagaaaccaaucauuucaacauagagucacauaaaguuuucccuuuucugaucug

SEQ ID NO: 744594 - RNA, 64 nt, Homo Sapiens
auccagcccacuuacagguuugcuuaaugaccaggucacauaaagcucacaaaaugaaucccua

SEQ ID NO: 744595 - RNA, 64 nt, Homo Sapiens
aacagcaguggaauauguauccauuuugugaguugucacauaauuucagauugggaaauccauu

SEQ ID NO: 744596 - RNA, 64 nt, Homo Sapiens
uuucacuggaaugaguugggagagaaaggcccucagcuuuuagagacacaaaaauccaugaagu

SEQ ID NO: 744597 - RNA, 64 nt, Homo Sapiens
uucccaucccacuaauguuaguguuuuuuaauggagcuuuuauucugagaauauguguuugucu

SEQ ID NO: 744598 - RNA, 64 nt, Homo Sapiens
aauguaggauagaggguacaacuauuuaauggugagcuuuuaaauauuuucuauaauaauuagu

SEQ ID NO: 744599 - RNA, 64 nt, Homo Sapiens
cccugugcaacaaaagauuaguuugcagucuugcagcuuuuauuggguguggcuguugaaggaa

SEQ ID NO: 744600 - RNA, 64 nt, Homo Sapiens
agggucugcuauuccugaggcugggggccagagaagcuuuuacgcauggaaaaacacuaaucau

SEQ ID NO: 744601 - RNA, 64 nt, Homo Sapiens
aaauguuucuuuuauuacaaagccuauuuugaguagcuuuuaaaacugaauuuccuuuaauugg

SEQ ID NO: 744602 - RNA, 64 nt, Homo Sapiens
uaaaauugaaaguucuggaauuuugcuagcuaugagcuuuuaaaaguuuuaauuuucuuguaua

SEQ ID NO: 744603 - RNA, 64 nt, Homo Sapiens
uaacagugcaaaaggaucguuucuuuucuccuaaagcuuuuauucugcuucauuuuucuuucuu

SEQ ID NO: 744604 - RNA, 64 nt, Homo Sapiens
uauuuaaggaauucacuugguaguacuuugcuuuagcuuuuaaauggcuugauuuuaaaggaga

SEQ ID NO: 744605 - RNA, 64 nt, Homo Sapiens
uugcuuuuuaaugcauuauaugauuguguuuggaagcuuuuacuguucuuuucagaaauacggc

SEQ ID NO: 744606 - RNA, 64 nt, Homo Sapiens
aaaugcuuuaaauaguuuacuucacuuucaucugagcuuuuaccacuagacucaaggaagaaua

SEQ ID NO: 744607 - RNA, 64 nt, Homo Sapiens
aaauauaaaauacauaaaagaauguacagaaaauagcuuuuauugaguaauauuacauuucauu

SEQ ID NO: 744608 - RNA, 64 nt, Homo Sapiens
caagagacauuuucauaauugcuuucuagcaaucagcuuuuauuugccuuaauauaagcuuuua

SEQ ID NO: 744609 - RNA, 64 nt, Homo Sapiens
uuucuagcaaucagcuuuuauuugccuuaauauaagcuuuuaagcaguuaucuaacuagugucc

SEQ ID NO: 744610 - RNA, 64 nt, Homo Sapiens
acucuaauauuaaucucuuauguugaaacuguaaagcuuuuaugucugugauuguguguaugug

SEQ ID NO: 744611 - RNA, 64 nt, Homo Sapiens
ugaaaacaaaagccuuucuaacaggaacauaaaaagcuuuuagacaaaauacaucucgccuggu

SEQ ID NO: 744612 - RNA, 64 nt, Homo Sapiens
ccuuugccugaaacauugaaucuuguuaaaccacagcuuuuagcuaaaaugagguauaccuaga

SEQ ID NO: 744613 - RNA, 64 nt, Homo Sapiens
ggguuuuaaaagaacaguauuuuacaaaagguguagcuuuuauaagagugcagaaaagggaagg

SEQ ID NO: 744614 - RNA, 64 nt, Homo Sapiens
ggugagaaaccuuacaauguaaagaauguggcacagcuuuuaacuaaucuucaaaccuuacuga

SEQ ID NO: 744615 - RNA, 64 nt, Homo Sapiens
gagaggaacucuauaguugugaagaauguggcaaagcuuuuaaccaauccucauaccuuacuau

SEQ ID NO: 744616 - RNA, 64 nt, Homo Sapiens
gagagaaagccuacaauugugaagaauguggcaaagcuuuuaaccuuccuuaacccuuaacugu

SEQ ID NO: 744617 - RNA, 64 nt, Homo Sapiens
gaaagaaacccuacaaaugugaagucuguggcaaagcuuuuaacugauucucaacucuuacuac

SEQ ID NO: 744618 - RNA, 64 nt, Homo Sapiens
gagagaaaccccacaaaugugaagaauguggcagagcuuuuaaccaguccgcaaagcucacuga

SEQ ID NO: 744619 - RNA, 64 nt, Homo Sapiens
gagaaaaacccuacaaaugugaagaauguggcaaagcuuuuaaccaguccucacaccuuaugag

SEQ ID NO: 744620 - RNA, 64 nt, Homo Sapiens
gagagaaacucuacaaaugugaagaauguggcaaagcuuuuaaccaagucucaacacuuacuau

SEQ ID NO: 744621 - RNA, 64 nt, Homo Sapiens
uguuaaaaacaauuugcaaaccagcagaauuuuaagcuuuuaaaauaauucaauggauauacau

SEQ ID NO: 744622 - RNA, 64 nt, Homo Sapiens
gaggaaaauaaccaugagcuguaucaugcuacuuagcuuuuauguaaauauuucuuaugucucc

SEQ ID NO: 744623 - RNA, 64 nt, Homo Sapiens
ugauuaauuagaaaaauuuauuugaaauuuuuguagcuuuuagcuaaguguucagauuaacacu

SEQ ID NO: 744624 - RNA, 64 nt, Homo Sapiens
cuuaccugaauuuaugugugucuuuuugugagacagcuuuuagugauccauuggauuucuuuuu

SEQ ID NO: 744625 - RNA, 64 nt, Homo Sapiens
aaauauuaauuuccuauacauuccuaucgcagggagcuuuuaagaaagugauuggguuuucgac

SEQ ID NO: 744626 - RNA, 64 nt, Homo Sapiens
gugcgccauguuucucaaagugaaugaguuucuuagcuuuuauauguacacaagcagugcuucg

SEQ ID NO: 744627 - RNA, 64 nt, Homo Sapiens
uuccucuguagcuuuucagaaaauguuacacuagagcuuuuauuuugucuaauauaucuacagu

SEQ ID NO: 744628 - RNA, 64 nt, Homo Sapiens
aauuuuuuucuccucaagauggagaaggaaaaauagcuuuuaucaauuaaaugcuuuaagaaau

SEQ ID NO: 744629 - RNA, 64 nt, Homo Sapiens
acagucugugaagcuuacuggauaaggagagaauagcuuuuauguacugacuucauaaaagcca

SEQ ID NO: 744630 - RNA, 64 nt, Homo Sapiens
uuuuuuaaucauugugcacagaagcaucauugguagcuuuuauaugcaaauggucauuucagau

SEQ ID NO: 744631 - RNA, 64 nt, Homo Sapiens
ugacugaauuaagauuuaagaaugauuaaaaauaagcuuuuacuuuuuaaaaccacuugagguu

SEQ ID NO: 744632 - RNA, 64 nt, Homo Sapiens
ugcugcaacucucaacauuucccuuauuugguucagcuuuuagcaaaaagggcuacaguucacc

SEQ ID NO: 744633 - RNA, 64 nt, Homo Sapiens
uagagaaauccuacaaauaugaagaaugugacaaagcuuuuaaccacuucucaacccugccuac

SEQ ID NO: 744634 - RNA, 64 nt, Homo Sapiens
gagauaaauuauacaaaugugaagaauguggcaaagcuuuuaacaaauccucauccauuaguaa

SEQ ID NO: 744635 - RNA, 64 nt, Homo Sapiens
gagagaaacccuacaaaugugaaaaauguggcaaagcuuuuaaccaauuuucaaaccuuacuaa

SEQ ID NO: 744636 - RNA, 64 nt, Homo Sapiens
gagagaaaccauacaacugugaagaauguggcaaagcuuuuaaccaguccucaaacuuuauuga

SEQ ID NO: 744637 - RNA, 64 nt, Homo Sapiens
ucccggacaagaaaaauugcaaucaaaugucagcagcuuuuauuaccuuaaucuuucagggccu

SEQ ID NO: 744638 - RNA, 64 nt, Homo Sapiens
uuagaauguaacagcuuuaacuugggauuuaagaagcuuuuaaaagguaauaauacucugaaag

SEQ ID NO: 744639 - RNA, 64 nt, Homo Sapiens
gagcuaaacaauuccuuacauuuaccaagaggaaagcuuuuacuguguugaagcuaaaaaaaua

SEQ ID NO: 744640 - RNA, 64 nt, Homo Sapiens
aaaaucuggagaaaugcuuauaaaauauacuacuagcuuuuaaguuuuaagaaagaagaacgua

SEQ ID NO: 744641 - RNA, 64 nt, Homo Sapiens
ggggauuaugaucaaaagugaagugaauaacuuuagcuuuuacaggaaaaacagaguuccuguu

SEQ ID NO: 744642 - RNA, 64 nt, Homo Sapiens
aagguugugcuuuucauuguuuucacuuugaaagagcuuuuagcaaaaaagcuuuuauuggugu

SEQ ID NO: 744643 - RNA, 64 nt, Homo Sapiens
gguguuuucacuuugaaagacaaacaagaaaaaaagcuuuuauuaaacaaaaaccacaaacaga

SEQ ID NO: 744644 - RNA, 64 nt, Homo Sapiens
caaacaaaaacugcagacaaacaaaaaagagaaaagcuuuuauuuguguuuucaguuugaaaga

SEQ ID NO: 744645 - RNA, 64 nt, Homo Sapiens
ggaaaagaagaguuccuguuaaaugaauagcuuuagcuuuuacaggggauuaugauuaaaagug

SEQ ID NO: 744646 - RNA, 63 nt, Homo Sapiens
gauaaguuccaaauauguuaagggcuuuaauacaaaaagcaaaaauugucaguguuuggauga

SEQ ID NO: 744647 - RNA, 63 nt, Homo Sapiens
acaauaagaaugaaucucagaaaauauuaaggaaaaaagcaaguuugaagagaccacaugggg

SEQ ID NO: 744648 - RNA, 63 nt, Homo Sapiens
uaaaaauuuaggggauauugaaguuauaccaauaaaaagcauucaaaauaagugggaaaugag

SEQ ID NO: 744649 - RNA, 63 nt, Homo Sapiens
cacugguccugcagcuuauucauugccggggguaaaaagcacagcccacgaaaauuagucuag

SEQ ID NO: 744650 - RNA, 63 nt, Homo Sapiens
gacacacauuccuuugaaauccacccaguguuuaaaaagcaacuuggaaauuuacacauuagc

SEQ ID NO: 744651 - RNA, 63 nt, Homo Sapiens
auccuuucuuaguuauuugcuccuugcaaauuaaaaaagcaacuaagagaaagaaaaacauug

SEQ ID NO: 744652 - RNA, 63 nt, Homo Sapiens
ugugcucugccuggagcuguuuccauaugauauaaaaagcaaguguaguauuccauuacuaug

SEQ ID NO: 744653 - RNA, 63 nt, Homo Sapiens
gagucccucaggaaaaaaaaaaaauucuguuuuaaaaagcaaucugauucuuagcucuugaaa

SEQ ID NO: 744654 - RNA, 63 nt, Homo Sapiens
guaccugccauuuuuacuaauuuuugucuuuaaaaaaagcaaaaaagcacauugaccuaaguu

SEQ ID NO: 744655 - RNA, 63 nt, Homo Sapiens
cauuuuuacuaauuuuugucuuuaaaaaaagcaaaaaagcacauugaccuaaguugaaaauua

SEQ ID NO: 744656 - RNA, 63 nt, Homo Sapiens
aaagaaaaaaagguuaagcauaaaaagaaagggaaaaagcagaaacacugcagaagacacaaa

SEQ ID NO: 744657 - RNA, 63 nt, Homo Sapiens
agauccagugggaaaaaaaauagcguuucacauaaaaagcauagcagcagcucugaaaagaca

SEQ ID NO: 744658 - RNA, 63 nt, Homo Sapiens
aaagugaaagagaaauugaaagggaaaaaagacaaaaagcauaaggcuccaaaacgaaagcaa

SEQ ID NO: 744659 - RNA, 63 nt, Homo Sapiens
gaaugacagcaaacagaucagaaagcaccaaggaaaaagcagaccucaaccugcuguccucca

SEQ ID NO: 744660 - RNA, 63 nt, Homo Sapiens
gucuuauuaaccaugucuguaauauaggcuuuaaaaaagcauaaaaaaauaaaauaaauauaa

SEQ ID NO: 744661 - RNA, 63 nt, Homo Sapiens
aaugauaacaacauaguaacauaugcuguauuuaaaaagcaacagguuaagagauccuguuuc

SEQ ID NO: 744662 - RNA, 63 nt, Homo Sapiens
ucuacuugguuuuuugaucauuucaagacuuuuaaaaagcacucauccuccugaagccuucgu

SEQ ID NO: 744663 - RNA, 63 nt, Homo Sapiens
uacuucauaauaugugaaaaacucggaucuuuuaaaaagcaucauagaucauuuuuccauaug

SEQ ID NO: 744664 - RNA, 63 nt, Homo Sapiens
caaaauguguuacaugggaagaaaaagauuaagaaaaagcaagauaauuuugaagaaggacga

SEQ ID NO: 744665 - RNA, 63 nt, Homo Sapiens
aucaugaccagcaaauacucauuuuaggaaaaaaaaaagcaugaucugaaaaauacuuuuggu

SEQ ID NO: 744666 - RNA, 63 nt, Homo Sapiens
cacacacgagagaucauaaccaugugaaaaggcaaaaagcauguguuugcaacaucugauaac

SEQ ID NO: 744667 - RNA, 63 nt, Homo Sapiens
acugaauauaucuaaaauuuccagcaauaaaaaaaaaagcauuuaacuugcaccaagcaagaa

SEQ ID NO: 744668 - RNA, 63 nt, Homo Sapiens
acaguauucuuuauuuucuggguguuauauuuaaaaaagcaaguuuggauuuuuacaccuaau

SEQ ID NO: 744669 - RNA, 63 nt, Homo Sapiens
ccacuuuguccuuucugcucuugugaagaaaaaaaaaagcauuuucgaggaaagaauuaugca

SEQ ID NO: 744670 - RNA, 63 nt, Homo Sapiens
augaauuaaagcaacaaaaagauauugauuggcaaaaagcaagauauaagagauucauuugcu

SEQ ID NO: 744671 - RNA, 63 nt, Homo Sapiens
cuuucucuccacucuggcuuguuuucagaaccuaaaaagcagacccaaguuuccuuucuccuc

SEQ ID NO: 744672 - RNA, 63 nt, Homo Sapiens
uuaauauaaaagagguaggagucuguuauuuaaaaaaagcauuaaauuuaaaaaaaaacuguc

SEQ ID NO: 744673 - RNA, 63 nt, Homo Sapiens
agcaagguaccuugccauuuaaaguauaucuuaaaaaagcagcauccaucugggcacucauuu

SEQ ID NO: 744674 - RNA, 63 nt, Homo Sapiens
aaguacgugugugugugugucugagaaaugaauaaaaagcauguguuucuuagggaaaacagu

SEQ ID NO: 744675 - RNA, 63 nt, Homo Sapiens
gauacuaauuuuuuaagccacacugccagcaucaaaaagcaaacacacaacucugagaauacc

SEQ ID NO: 744676 - RNA, 63 nt, Homo Sapiens
caagaucacaaauuacaguaaacaucucucgguaaaaagcagauaccuuaguacccuucaccu

SEQ ID NO: 744677 - RNA, 63 nt, Homo Sapiens
ugaagaaauauuuuaaggaaaccuauuugaaaaaaaaagcaaagaccauuugauaaaagccug

SEQ ID NO: 744678 - RNA, 63 nt, Homo Sapiens
gaauaauagaaaaauucuacuuuaauuuccauuaaaaagcaaauagcauugacacauuuaaag

SEQ ID NO: 744679 - RNA, 63 nt, Homo Sapiens
cagauuuacaaguguaagcuauaugauuucuucaaaaagcaaaagcaauauaccuaauucauu

SEQ ID NO: 744680 - RNA, 63 nt, Homo Sapiens
gucaaaacuagauuggaucuugguuugaaugaaaaaaagcauaaaauauucuugcaauaauug

SEQ ID NO: 744681 - RNA, 63 nt, Homo Sapiens
aucuaugauuguuguauaauucucuuuguagauaaaaagcauugggaggcugcagaagccauu

SEQ ID NO: 744682 - RNA, 63 nt, Homo Sapiens; identical to SEQ ID NO: 293179

SEQ ID NO: 744683 - RNA, 63 nt, Homo Sapiens
ccuaaaugaaaguguguaaaaaagauuuucuucaaaaagcaauuaaauuaaaauggcauucuu

SEQ ID NO: 744684 - RNA, 63 nt, Homo Sapiens
gaauuccuacucacacagcuuuucuugcaucuaaaaaagcauaaacuugcauuauguguuaau

SEQ ID NO: 744685 - RNA, 63 nt, Homo Sapiens
ccugugaauauaauuuaauuagcaaaaacaaacaaaaagcaaguguguuauaugacaggacaa

SEQ ID NO: 744686 - RNA, 63 nt, Homo Sapiens
auuuugauugagauuuuuuagacccaugcaaucaaaaagcaaauguuguuuucuguggguugc

SEQ ID NO: 744687 - RNA, 63 nt, Homo Sapiens
ugaauaagaaaauaauguuuaaagaaaaaaaaaaaaaagcaaaccuccaaaacguggaccuaa

SEQ ID NO: 744688 - RNA, 63 nt, Homo Sapiens
auaugguugaagaaucaaaacaaaagcaaaaaaaaaaagcaaaaaaagaaaagagaaaaaaag

SEQ ID NO: 744689 - RNA, 63 nt, Homo Sapiens
agaauucuugaaaaguuaacguagaaaauauccaaaaagcaguauuucuagaaaguguccaaa

SEQ ID NO: 744690 - RNA, 63 nt, Homo Sapiens
auauccaaaaagcaguauuucuagaaaguguccaaaaagcaguauuucuuucccuugguugug

SEQ ID NO: 744691 - RNA, 63 nt, Homo Sapiens
cuuugaagagcuugaagauuugaaagauucccaaaaaagcauuuuaaaguuuacauuuaaggg

SEQ ID NO: 744692 - RNA, 63 nt, Homo Sapiens
aaaccuacaucuggcuagugcuuacauuugcucaaaaagcauguuguaugaagcugacugcca

SEQ ID NO: 744693 - RNA, 63 nt, Homo Sapiens
agugagagauugagaaugaugcuuaauggaucaaaaaagcaauuaggaguauguuccugauuu

SEQ ID NO: 744694 - RNA, 63 nt, Homo Sapiens
aggcgccugucaucgacauuagaggacuucccuaaaaagcacauacaccuucacagccacccc

SEQ ID NO: 744695 - RNA, 63 nt, Homo Sapiens
uggauuuccaccugacaaauguucuuucaggccaaaaagcaaauguugacuucucauccccga

SEQ ID NO: 744696 - RNA, 63 nt, Homo Sapiens
caaagcaaaacaauaaacuaauauaaaugaacaaaaaagcaagauauccauggcaagcuuugu

SEQ ID NO: 744697 - RNA, 63 nt, Homo Sapiens
cuguuuauuuaccuguaagggaucuucagauagaaaaagcaauuucauaaaacauguaacacu

SEQ ID NO: 744698 - RNA, 63 nt, Homo Sapiens
aucaaucuuuuguuugaaaaaucuuuuuuauucaaaaagcacagugagguuggaagauacccu

SEQ ID NO: 744699 - RNA, 53 nt, Homo Sapiens; identical to SEQ ID NO: 293196

SEQ ID NO: 744700 - RNA, 63 nt, Homo Sapiens
ugucuugucuaagguggaaaucuugugcuguuuaaaaagcagauuuuauucuuugccuuuugc

SEQ ID NO: 744701 - RNA, 63 nt, Homo Sapiens
gaaaaaugcuggaacaugcuugauguauuauguaaaaagcauauuuaaacaaggguccucaac

SEQ ID NO: 744702 - RNA, 63 nt, Homo Sapiens
auugccccuuugcagagaaaaaaaaaaacuuaaaaaaagcacaugccuacugcugccuguccc

SEQ ID NO: 744703 - RNA, 63 nt, Homo Sapiens
gguuugacuggccuccagauuccaguuauuuuuaaaaagcaacuuaccacuaaauccuugagu

SEQ ID NO: 744704 - RNA, 63 nt, Homo Sapiens
aaaccuuuuagugacaaaauccuaauauguggaaaaaagcauaugcauaaaggaauaauauug

SEQ ID NO: 744705 - RNA, 63 nt, Homo Sapiens
uugcuuugguuggugcauuuaaguauccaacucaaaaagcauaucaaauauuuuggguacuag

SEQ ID NO: 744706 - RNA, 63 nt, Homo Sapiens
aguugcuugaauuaugaucaaaagccauagaagaaaaagcaauucagcauauacauuucagcc

SEQ ID NO: 744707 - RNA, 63 nt, Homo Sapiens
uuugguaaguugugugugcuagaagagcaagagaaaaagcaaaugaaaucagaagaacaaaaa

SEQ ID NO: 744708 - RNA, 63 nt, Homo Sapiens
aaaagaaaaugcacucuaaccauguuuaaaaaaaaaaagcaacccagauuuuuuauaugucug

SEQ ID NO: 744709 - RNA, 63 nt, Homo Sapiens
aauuuuggucacuuccaagcgugaugauuauuaaaaaagcaaaugcugaauacuuuuuauaau

SEQ ID NO: 744710 - RNA, 63 nt, Homo Sapiens
uaauaaaagaagacaaaauuuuuuaaauguuagaaaaagcagaucugucauugcaaaguaaca

SEQ ID NO: 744711 - RNA, 63 nt, Homo Sapiens
auauauugguaguaauuacuguaauuauucaacaaaaagcauauccguucaaaaauuuuucca

SEQ ID NO: 744712 - RNA, 63 nt, Homo Sapiens
uuuuuuccuuuguuuuaaaacugugguuuuuuaaaaaagcaauaauuaacucagaccucacua

SEQ ID NO: 744713 - RNA, 63 nt, Homo Sapiens
ucuuuguuuuucuuuuuuugggggaggaggggaaaaaagcagcaauacuguguuuggaaauua

SEQ ID NO: 744714 - RNA, 63 nt, Homo Sapiens
ccccauguaugccuauauguaguaaccaccuuuaaaaagcaacugauaauaucacaacccaga

SEQ ID NO: 744715 - RNA, 63 nt, Homo Sapiens
aaugauuacugauaauaucagcagaaauguauaaaaaagcaaaucauagaaaacuugaaaaau

SEQ ID NO: 744716 - RNA, 63 nt, Homo Sapiens
uauguguagauauaacuuaaauauggagcuuucaaaaagcacaaauaggcuggacaugguggc

SEQ ID NO: 744717 - RNA, 63 nt, Homo Sapiens
ccugagugacagagagagauucaaaaaacaaaaaaaaagcaaaaauauacuuugcuauugggu

SEQ ID NO: 744718 - RNA, 63 nt, Homo Sapiens
ggaaugagggagagaagggggcuguagaguuugaaaaagcauauucaauauuaaaauaguuuu

SEQ ID NO: 744719 - RNA, 63 nt, Homo Sapiens
gacuggggaggccucagaaucauggugggaggcaaaaagcacuucuuacauggcggcagcaag

SEQ ID NO: 744720 - RNA, 63 nt, Homo Sapiens
guaacuugugcuuugagagcccaauaaggcaagaaaaagcauagccuugcuuuuagagaaugc

SEQ ID NO: 744721 - RNA, 63 nt, Homo Sapiens
uggagugagcgaacauuuccauguugaauuuuuaaaaagcacuaaaaauuaaaacauugccau

SEQ ID NO: 744722 - RNA, 63 nt, Homo Sapiens
aguucccuaguuaccauuuaauguugaaaggagaaaaagcacaaagaaauuugggacuuuuuc

SEQ ID NO: 744723 - RNA, 63 nt, Homo Sapiens
agaaauuugggacuuuuucauaaaggaaaagugaaaaagcauauuagaaguguuaggguuaga

SEQ ID NO: 744724 - RNA, 63 nt, Homo Sapiens
uagaauaguuucugagucuggacaccagugguaaaaaagcaagggauuacaagcugucucucu

SEQ ID NO: 744725 - RNA, 63 nt, Homo Sapiens
aaacaaaaacaagucccauggccaaaaaaaaccaaaaagcaaauaggggccauaucauucaug

SEQ ID NO: 744726 - RNA, 63 nt, Homo Sapiens
caauugucuaauuuacagcaguugugaucccacaaaaagcaaguuuauaccucagauuggggu

SEQ ID NO: 744727 - RNA, 63 nt, Homo Sapiens
caguaaauccaugucuuuguuuguuuuucuauuaaaaagcaaucaagaaagauaaugugaaaa

SEQ ID NO: 744728 - RNA, 63 nt, Homo Sapiens
auugacuccaaugcagaauagugagaaaucaacaaaaagcaaaauaagacaauuccagacacu

SEQ ID NO: 744729 - RNA, 63 nt, Homo Sapiens
gucuggaccacuggggaaaauauuuuucuuuucaaaaagcagccccuucagucugcguuccca

SEQ ID NO: 744730 - RNA, 63 nt, Homo Sapiens
cugguguguauucucaugugugugggauuuuuuaaaaagcaaaaaaauuaugcagggccccua

SEQ ID NO: 744731 - RNA, 63 nt, Homo Sapiens
ugaccuuaugaggcucucgcgaaaaaaaagaaaaaaaagcacgcgaaacucugucucaaaaaa

SEQ ID NO: 744732 - RNA, 63 nt, Homo Sapiens
guuauuuagguuaaauaucuccaaacaaccuucaaaaagcauuuuuuacuaccucuggguuag

SEQ ID NO: 744733 - RNA, 63 nt, Homo Sapiens
gaauuguaagugugaggugucaucaauuauuacaaaaagcaguaggaagugguguucuuuaua

SEQ ID NO: 744734 - RNA, 63 nt, Homo Sapiens
caguguaaaaaaagucaucuaagagaaguuuuuaaaaagcaaagucacuaagcagaauuuaga

SEQ ID NO: 744735 - RNA, 59 nt, Homo Sapiens; identical to SEQ ID NO: 293232

SEQ ID NO: 744736 - RNA, 63 nt, Homo Sapiens
aaugauuuucucugccuugagauuugcaucaagaaaaagcaccucucuucaccugaaagcuuu

SEQ ID NO: 744737 - RNA, 63 nt, Homo Sapiens
ugguucugugauuuggaugucaacaacuucccuaaaaagcaccaguguguuagguucuaaugu

SEQ ID NO: 744738 - RNA, 63 nt, Homo Sapiens
ggagaaaagagaaaccgggaaaggaaaaaaagcaaaaagcaagcuaagacaugugaggaggaa

SEQ ID NO: 744739 - RNA, 63 nt, Homo Sapiens
aagcaagggagaaaagagaaggaggaaaaggaaaaaaagcaaaagcaggccuaagacauguga

SEQ ID NO: 744740 - RNA, 63 nt, Homo Sapiens
aggccauugugaaccaaugcccaacugaaggcuaaaaagcaacuugagcaauuucccccuaaa

SEQ ID NO: 744741 - RNA, 63 nt, Homo Sapiens
uauuagugcagccaaguagcucuauaagauuccaaaaagcacaaaaguucaacuuggugacac

SEQ ID NO: 744742 - RNA, 63 nt, Homo Sapiens
ugauuauuuuuuuuaaauacgaacaggucuuucaaaaagcauuaauauguguggcagugaaga

SEQ ID NO: 744743 - RNA, 63 nt, Homo Sapiens
aauuaaaguaguaaauucauaacuuuuuuucaaaaaaagcacauacuauugcucuuacuugaa

SEQ ID NO: 744744 - RNA, 63 nt, Homo Sapiens
aaaauuaugguguuccugaacaauuucaccuugaaaaagcaccacaucuuagguauaacagca

SEQ ID NO: 744745 - RNA, 63 nt, Homo Sapiens
uucacauauuaaaagauucaucagauccuacucaaaaagcaucugaguauugggaaaguuaau

SEQ ID NO: 744746 - RNA, 63 nt, Homo Sapiens
caaaaaaaaacugcaaaaguaaaacagcaaaacaaaaagcaaagagucccugaguauaaagga

SEQ ID NO: 744747 - RNA, 63 nt, Homo Sapiens
uggagauggcagaagugaaagcuggccaucugcaaaaagcagauaagugaguuugaaccuuuu

SEQ ID NO: 744748 - RNA, 63 nt, Homo Sapiens
aagucuuuaggagaguagaaaacacaauuaacuaaaaagcagggacaucugaaagagacguau

SEQ ID NO: 744749 - RNA, 63 nt, Homo Sapiens
ucaaguacguauucagcauuuucaacugaagaaaaaaagcaaggguaaaagggaugcuagaaa

SEQ ID NO: 744750 - RNA, 63 nt, Homo Sapiens
uauucccucaacaucagaacgcagucauuacagaaaaagcaaaaaagagcucccaucugaucu

SEQ ID NO: 744751 - RNA, 63 nt, Homo Sapiens
cacaagaaaucaaaauccaacaaaggaaauccaaaaaagcaaauaccggacacaccucugcuc

SEQ ID NO: 744752 - RNA, 63 nt, Homo Sapiens
ggaagcauacuugugaacuaaaaaguuuuuuuaaaaaagcaaauggcuuuaaguaaaaaucca

SEQ ID NO: 744753 - RNA, 63 nt, Homo Sapiens
cccccuaugguugauauuguaaaaaaaaaaaaaaaaaagcaaaauuuugucucauuugccaaa

SEQ ID NO: 744754 - RNA, 63 nt, Homo Sapiens
guugaggcaguguuugcuuuaaaacaagaagauaaaaagcacuucucagguaagccauuuuau

SEQ ID NO: 744755 - RNA, 63 nt, Homo Sapiens
caugcauuuauuauuaaacagaacgucaggcuaaaaaagcagcuccuuugguacaaaaggguu

SEQ ID NO: 744756 - RNA, 63 nt, Homo Sapiens
cagucuaaauaauaaacagucccauauauuauuaaaaagcauaacuaaugaaaauaauguuuu

SEQ ID NO: 744757 - RNA, 63 nt, Homo Sapiens
ugaggcucuuucuauaaauacauauuguuuaaaaaaaagcaagaaaaaaaggaaaacaaagga

SEQ ID NO: 744758 - RNA, 63 nt, Homo Sapiens
gcaacagagcgagacccugucuccaaaaaaaaaaaaaagcaauguuuauauuauaaaagagug

SEQ ID NO: 744759 - RNA, 63 nt, Homo Sapiens
uggcaguguuuugguucagacaccuguucacagaaaaagcaugaugggaaaauauuuccugac

SEQ ID NO: 744760 - RNA, 63 nt, Homo Sapiens
uuuuguaauuguguaaaaaauggaaaaaaacauaaaaagcagaauuuuaaugugaagacauuu

SEQ ID NO: 744761 - RNA, 63 nt, Homo Sapiens
aggucacuuuuaugccacauuauuuuaauugcaaaaaagcaucuauauauggaggaggguggg

SEQ ID NO: 744762 - RNA, 63 nt, Homo Sapiens
uuuccagcuuuaucaaagacauguuugaaaaauaaaaagcauccaagugagagcuggugagac

SEQ ID NO: 744763 - RNA, 63 nt, Homo Sapiens
uuucuaaaugcucaaauguuaaaucuauuagaaaaaaagcauucugcacugcacuuauaaagc

SEQ ID NO: 744764 - RNA, 63 nt, Homo Sapiens
auggccuuauaugcagggaaucuagcgcucccaaaaaagcacuacugucaaguggauggauau

SEQ ID NO: 744765 - RNA, 63 nt, Homo Sapiens
agcacuuuuuaaaacaaacaaacaaacaaaacaaaaaagcaaaccacauuuguuaucucaaau

SEQ ID NO: 744766 - RNA, 63 nt, Homo Sapiens
gauaaugggcuuuguuagcacuuucaaaaaaaaaaaaagcaaaccauacuuguccacuguccu

SEQ ID NO: 744767 - RNA, 63 nt, Homo Sapiens
cuuauucaaagacuagguuauuuucaacugggaaaaaagcagugcuaacaggauauuguucug

SEQ ID NO: 744768 - RNA, 63 nt, Homo Sapiens
uccaccagggggaaggcuggcacaaggagaaaaaaaaagcaagcaucagcgaauaguauagug

SEQ ID NO: 744769 - RNA, 63 nt, Homo Sapiens
cuuauaagcuuucaugaagucauauuuaaaggaaaaaagcaagcucuguauguuguauuugau

SEQ ID NO: 744770 - RNA, 63 nt, Homo Sapiens
uaacagguuaguauuggcauagucuacuucuuuaaaaagcauugacacagccgccacuccccc

SEQ ID NO: 744771 - RNA, 63 nt, Homo Sapiens
uuccauuaaaaugggaauucaaagaauucuuccaaaaagcagcucaaagaaaugugaaauuaa

SEQ ID NO: 744772 - RNA, 63 nt, Homo Sapiens
augaacccucuacuuauaaacuaauauuaauuuaaaaagcagcggagaaguagcuuaaauuca

SEQ ID NO: 744773 - RNA, 64 nt, Homo Sapiens; identical to SEQ ID NO: 719950

SEQ ID NO: 744774 - RNA, 64 nt, Homo Sapiens; identical to SEQ ID NO: 719951

SEQ ID NO: 744775 - RNA, 64 nt, Homo Sapiens; identical to SEQ ID NO: 719952

SEQ ID NO: 744776 - RNA, 64 nt, Homo Sapiens; identical to SEQ ID NO: 719953

SEQ ID NO: 744777 - RNA, 64 nt, Homo Sapiens
gggcgggagagcgaugcuuggauuuuuguuuccuauuagaaaccaacaguuuuguucuaauuuc

SEQ ID NO: 744778 - RNA, 64 nt, Homo Sapiens
uuuuuuuuuucuuuuuuuaggcauauguaguaauauuagaaacauuuaauuugggaaacuuuga

SEQ ID NO: 744779 - RNA, 64 nt, Homo Sapiens
guggggugaucuuuccaggauuuaauucugggaaauuagaaaaaauacagauaaaauacauucu

SEQ ID NO: 744780 - RNA, 64 nt, Homo Sapiens
cuucuaauaaaugaaguaaaguauuccuacacauauuagaaacuauaaucuuacauuuaaaauu

SEQ ID NO: 744781 - RNA, 64 nt, Homo Sapiens
uucuuguguugauuggagaauuuuucuguauguaauuagaaaaaaauguaaaacaugauuuaug

SEQ ID NO: 744782 - RNA, 64 nt, Homo Sapiens
uuauuaccaaacaagguuuuguuuauaugauuguauuagaaaugcucagacuuccccagaaaug

SEQ ID NO: 744783 - RNA, 64 nt, Homo Sapiens
acagaguuugcgauauuuagucuauguggaaaauauuagaaacuuguggaaaauauuagaaacu

SEQ ID NO: 744784 - RNA, 64 nt, Homo Sapiens
ucuauguggaaaauauuagaacuauguggaaaauauuagaaacuuuggauuugcagcuguuggu

SEQ ID NO: 744785 - RNA, 64 nt, Homo Sapiens
uaugcaguguguucuccaaacaugauggaacgaaauuagaaaucaauaaaauuugggaaauuca

SEQ ID NO: 744786 - RNA, 64 nt, Homo Sapiens
agauuuuauuaccaaacuuauagaaauaaaaauuauuagaaagaaauacuaugaacaauugaau

SEQ ID NO: 744787 - RNA, 64 nt, Homo Sapiens
uuuucugugacuaaauagcaauaauaaguggaaaauuagaaauuauuuccagguauuauauuug

SEQ ID NO: 744788 - RNA, 64 nt, Homo Sapiens
ucuucagucauacagcaagacacaugagacauagauuagaaaacauguuguacaauuuuaauuu

SEQ ID NO: 744789 - RNA, 64 nt, Homo Sapiens
gggaaauaucauucuuacuaugguuagaaagugaauuagaaauuucagcucaguuucuauuuua

SEQ ID NO: 744790 - RNA, 64 nt, Homo Sapiens
aauugaccucuuugucagauccuuaucaccaaacauuagaaaagaucucauaacuuuauacagc

SEQ ID NO: 744791 - RNA, 64 nt, Homo Sapiens
ugucauugcuuuaaaaucaugacuuuucagaucaauuagaaaaauguaaagacauuguuuuuca

SEQ ID NO: 744792 - RNA, 64 nt, Homo Sapiens
cgcauacauuuauaugaauauuuaaaacuuuuguauuagaaaugaaauuaagaacuuagacuuu

SEQ ID NO: 744793 - RNA, 64 nt, Homo Sapiens
guuagggucuuucccaggaccaguaggauacauuauuagaaacuccgccaccucaaugcauugu

SEQ ID NO: 744794 - RNA, 64 nt, Homo Sapiens
guuaaggucuuucccgggaccaguagaauacauuauuagaaacuccgccaccucaaugcauugu

SEQ ID NO: 744795 - RNA, 64 nt, Homo Sapiens
uuuuuaaaaguuuuugaaagcaaugaaauugugaauuagaaacauauggacucagcuagcuguu

SEQ ID NO: 744796 - RNA, 64 nt, Homo Sapiens
uuguaugagcaaauuugcaguccuauuuaucuauauuagaaauaaagaauucuuagacuuguau

SEQ ID NO: 744797 - RNA, 64 nt, Homo Sapiens
aaguacaagauuagacaacacagauaagaaucacauuagaaacuaagaacuucucauuuucuau

SEQ ID NO: 744798 - RNA, 64 nt, Homo Sapiens
ggagucaucuuaugugcuuaaagggcucauguccauuagaaaauaccagcuuaauuuccuuagg

SEQ ID NO: 744799 - RNA, 64 nt, Homo Sapiens
agaauccugagacugccuggaggugagguagaaaauuagaaauacuuccuaauucuucucaagg

SEQ ID NO: 744800 - RNA, 64 nt, Homo Sapiens
cucuguguguguaccuguuguauguccuaaacuuauuagaaaauuuuauauacuuuuuuacaug

SEQ ID NO: 744801 - RNA, 64 nt, Homo Sapiens
ugcagaauuuaagaaauuauccaagauuagaaacauuagaaauuguguuagaucuuguaggaaa

SEQ ID NO: 744802 - RNA, 64 nt, Homo Sapiens
uuagaaauuugcagaauuuauguaggaaaccaagauuagaaacaacaagcuuaguguuagaucu

SEQ ID NO: 744803 - RNA, 64 nt, Homo Sapiens
uuuacauuuaaaaaaaauguaaaaaaggcccacaauuagaaaaaaauccucaagcaauaacaag

SEQ ID NO: 744804 - RNA, 64 nt, Homo Sapiens
ggauuauaauaugguucaacaaauguugaugaguauuagaaauguacauuagaaauauuagaaa

SEQ ID NO: 744805 - RNA, 64 nt, Homo Sapiens
guucaacaaauguugaugaguauuagaaauguacauuagaaauauuagaaauguuuaugacuau

SEQ ID NO: 744806 - RNA, 64 nt, Homo Sapiens
auguugaugaguauuagaaauguacauuagaaauauuagaaauguuuaugacuauuagaaaagu

SEQ ID NO: 744807 - RNA, 64 nt, Homo Sapiens
auguacauuagaaauauuagaaauguuuaugacuauuagaaaaguacaggguauugggcguucc

SEQ ID NO: 744808 - RNA, 64 nt, Homo Sapiens
agaacuaauuuuagauuuuuacuuuauauuuuuuauuagaaaguauuccuuauacugaugaggc

SEQ ID NO: 744809 - RNA, 64 nt, Homo Sapiens
uucagacagcaucuucucuaacaaguacaacuccauuagaaaaaaggagaaacucaauacaaag

SEQ ID NO: 744810 - RNA, 64 nt, Homo Sapiens
aagugcaaaacagguguucuuaucuaaaacgucaauuagaaaauuaucugcgguuguuaaucua

SEQ ID NO: 744811 - RNA, 64 nt, Homo Sapiens
uauaaauaaaauuuuaaaauccuuucauaguucuauuagaaauaaguaguaaauuuugauauau

SEQ ID NO: 744812 - RNA, 64 nt, Homo Sapiens
uuuaugcaggaaaccuccugcaaagcugaaacugauuagaaaauucuuuauauuuuaaaauagc

SEQ ID NO: 744813 - RNA, 64 nt, Homo Sapiens
gacaucuccuagggaaugaugaaaacagcaggcuauuagaaaauuauuucauauaguucucgug

SEQ ID NO: 744814 - RNA, 64 nt, Homo Sapiens
gagcuuccuaaugcauguguugcauuauugcagcauuagaaaaggagagguagcauuuuugcug

SEQ ID NO: 744815 - RNA, 64 nt, Homo Sapiens
cagcacuuugauucuauguugaguuuguuucuauauuagaaaagcagcaagucaguaauccccc

SEQ ID NO: 744816 - RNA, 64 nt, Homo Sapiens
gcugcagagaaacuaugcauuaggucucuuuucaauuagaaaccuuuacuauuuccaauguaug

SEQ ID NO: 744817 - RNA, 64 nt, Homo Sapiens
uaaaugggguguucacagugacuuggauacaccaauuagaaauuaaauaagcaaauauauauau

SEQ ID NO: 744818 - RNA, 64 nt, Homo Sapiens
agcuucagaccaaauucaaauugaauuugaauaaauuagaaauacugugcauacauaaccuucu

SEQ ID NO: 744819 - RNA, 64 nt, Homo Sapiens
ucuugcccaacuaaacccagaacucaaacuuaacauuagaaaauaagguccagggccggacaca

SEQ ID NO: 744820 - RNA, 64 nt, Homo Sapiens
ccacaaauggaauccucacuguauccacuaggagauuagaaauuaagguuucuucacuacuucu

SEQ ID NO: 744821 - RNA, 64 nt, Homo Sapiens
aaaggcaguucugcaagauguacuaaauauguauauuagaaauuauagaaaaucauguuguccg

SEQ ID NO: 744822 - RNA, 64 nt, Homo Sapiens
ccaaugcaaaauacaguugucauuaauccugcacauuagaaauuauuagaaacauauuacuuuu

SEQ ID NO: 744823 - RNA, 64 nt, Homo Sapiens
auacaguugucauuaauccugcacauuagaaauuauuagaaacauauuacuuuuuaacuuuaaa

SEQ ID NO: 744824 - RNA, 64 nt, Homo Sapiens
aauauggacaacucuguccauggucaccaaaaggauuagaaagaggccaucauagcugauccua

SEQ ID NO: 744825 - RNA, 57 nt, Homo Sapiens
uccagccacaagucagccucauuggauauuagaaauugagaaaaaccuuaugaauga

SEQ ID NO: 744826 - RNA, 64 nt, Homo Sapiens
cuaggggaugaauaguggugcccauaccuacugaauuagaaacuuccagauucuggauccauac

SEQ ID NO: 744827 - RNA, 64 nt, Homo Sapiens
uaugaaagagguauaacacuuucaauucauuuuaauuagaaaaggggaguccucagaguugcag

SEQ ID NO: 744828 - RNA, 64 nt, Homo Sapiens
gaucuaaccuggcuuguuuagggccauaccacuaauuagaaaaucugugcuagaaccugugucu

SEQ ID NO: 744829 - RNA, 64 nt, Homo Sapiens
uaaaauuuagaguauaaauugucuuauauuucaaauuagaaaaguucaaaugaaguuuaauugu

SEQ ID NO: 744830 - RNA, 64 nt, Homo Sapiens
aagaaauauaccuacugcuauccguaugugguggauuagaaauguguuaaaucugcaaaaggua

SEQ ID NO: 744831 - RNA, 64 nt, Homo Sapiens
gucucuguuggugguacaucuuguugaauucaauauuagaaaguauuucuuuuugggguaauau

SEQ ID NO: 744832 - RNA, 64 nt, Homo Sapiens
aauuauccugaacucuucugcaaaaauggauauuauuagaaauuagaaaaaaauuacuaauuuu

SEQ ID NO: 744833 - RNA, 64 nt, Homo Sapiens
cugaacucuucugcaaaaauggauauuauuagaaauuagaaaaaaauuacuaauuuuacacauu

SEQ ID NO: 744834 - RNA, 64 nt, Homo Sapiens
auuuugugcaaaagcuucaaauuaaaacagcugcauuagaaaaagaggcgcuucuccccucccc

SEQ ID NO: 744835 - RNA, 64 nt, Homo Sapiens
cuauuucugaauuacgaaugaaauccgaguaccuauuagaaaugaguuaugcaaauuuagaugc

SEQ ID NO: 744836 - RNA, 64 nt, Homo Sapiens
agaaaugaguuaugcaaauuuagaugcaaauaacauuagaaaaaaaagauucuuccauaauuaa

SEQ ID NO: 744837 - RNA, 64 nt, Homo Sapiens
gggcucaaacugagaaacauugaguuauauggcuauuagaaauccacauucuuacacaagaaag

SEQ ID NO: 744838 - RNA, 64 nt, Homo Sapiens
uguauccauuaaaguaacuuuuuuaacuaugagaauuagaaaauaagggacaacagggguuaaa

SEQ ID NO: 744839 - RNA, 64 nt, Homo Sapiens
uuccaaacaaaucuuucuacgcuuaaaugaucaaauuagaaaaaccaauuccuauaauuaauau

SEQ ID NO: 744840 - RNA, 64 nt, Homo Sapiens
uucuugugcuugcuucggcagcauauauacugaaauuagaaaaagaaaacuuuucuuuuuuauu

SEQ ID NO: 744841 - RNA, 64 nt, Homo Sapiens
aaacucauaaaacucauaaucacuauucucuuugauuagaaaauugguuugagaaacaggcuga

SEQ ID NO: 744842 - RNA, 64 nt, Homo Sapiens
aaaacgaacucugguuggggacuaagugggagaaauuagaaaacauccagaagccagaggaugg

SEQ ID NO: 744843 - RNA, 64 nt, Homo Sapiens
aacuugaaaaucagcuuuggccaucuaccugagaauuagaaagucugauuuuuggaauuagaaa

SEQ ID NO: 744844 - RNA, 64 nt, Homo Sapiens
aucuaccugagaauuagaaagucugauuuuuggaauuagaaaucaugauuguaggcugggcaca

SEQ ID NO: 744845 - RNA, 64 nt, Homo Sapiens
uuuggaaaacauaugugauggacuuuacaaggagauuagaaaucagcugcugcucaguauugaa

SEQ ID NO: 744846 - RNA, 64 nt, Homo Sapiens
ugcagguuuguuguuucaugcagauuuguuauaaauuagaaaugccuuccacccauuaaggaaa

SEQ ID NO: 744847 - RNA, 64 nt, Homo Sapiens
accccaugaaagccuugaaagugggaaagcuuucauuagaaauuugcaccucaucaugccccag

SEQ ID NO: 744848 - RNA, 64 nt, Homo Sapiens
auauuuacuguggcuugauuuguaguagccaaaaauuagaaacaacugagaaagcccaucacga

SEQ ID NO: 744849 - RNA, 64 nt, Homo Sapiens
ucaccauuuucuagaccuuagaaggaauuagaggauuagaaaaagaagaagucuaauaaaucua

SEQ ID NO: 744850 - RNA, 64 nt, Homo Sapiens
aucaaaaauguggcuuaaaaacaguuuaaaauuaauuagaaacuacaaucccuguugucugacc

SEQ ID NO: 744851 - RNA, 64 nt, Homo Sapiens
ucaugccaaaaaugaauuucagcacuugagcugcauuagaaauugugaauguaggaaguucuuc

SEQ ID NO: 744852 - RNA, 64 nt, Homo Sapiens
cuauuguguaacacauaauguaauagaaaauuauauuagaaaaagcuaaugaaugcagaaagaa

SEQ ID NO: 744853 - RNA, 64 nt, Homo Sapiens
uccaggcuaaugaaugcagauaaaguucuucuuuauuagaaaaugcaaccagaaguuaaggagg

SEQ ID NO: 744854 - RNA, 64 nt, Homo Sapiens
uugagaguucaagugcuguucuacaauucaaagcauuagaaacaaauaaauauuuauuugugca

SEQ ID NO: 744855 - RNA, 64 nt, Homo Sapiens
cucacacucucaguuacaaauuuuuugucaaaauauuagaaacuucauucugugaccuuuacca

SEQ ID NO: 744856 - RNA, 64 nt, Homo Sapiens
uaauuucuucaugugaugucaauuugccauuuuuauuagaaauuugcgaucugcucaguaauau

SEQ ID NO: 744857 - RNA, 64 nt, Homo Sapiens
uuaacauuuaucuuuaggugccuccuuuuacagaauuagaaaaguacuuuacuaaauuaauacu

SEQ ID NO: 744858 - RNA, 64 nt, Homo Sapiens
uauaugcuuacauuuuucaccaauucaaaaauaaauuagaaaaacugauucacagcuuauuauc

SEQ ID NO: 744859 - RNA, 64 nt, Homo Sapiens
ugaaagaaaguguuaaaacugaaggccucacuuaauuagaaacgugauaaauauauggacaaau

SEQ ID NO: 744860 - RNA, 64 nt, Homo Sapiens
acuugucaaacuugucaagaaugagaaaagccaaauuagaaaauccuauguccuaguuuccuua

SEQ ID NO: 744861 - RNA, 64 nt, Homo Sapiens
augaguggaaauucuccagauucuauaaagaaucauuagaaauuaccuuuauaaaaauauauga

SEQ ID NO: 744862 - RNA, 64 nt, Homo Sapiens
uuacuuuaaaaguagcuauauugcagaaagaagcauuagaaaaaauguucugguuuuggcccuc

SEQ ID NO: 744863 - RNA, 64 nt, Homo Sapiens; identical to SEQ ID NO: 580316

SEQ ID NO: 744864 - RNA, 64 nt, Homo Sapiens; identical to SEQ ID NO: 580317

SEQ ID NO: 744865 - RNA, 64 nt, Homo Sapiens; identical to SEQ ID NO: 580318

SEQ ID NO: 744866 - RNA, 64 nt, Homo Sapiens; identical to SEQ ID NO: 580319

SEQ ID NO: 744867 - RNA, 64 nt, Homo Sapiens; identical to SEQ ID NO: 580320

SEQ ID NO: 744868 - RNA, 64 nt, Homo Sapiens; identical to SEQ ID NO: 580321

SEQ ID NO: 744869 - RNA, 64 nt, Homo Sapiens; identical to SEQ ID NO: 580322

SEQ ID NO: 744870 - RNA, 64 nt, Homo Sapiens; identical to SEQ ID NO: 580323

SEQ ID NO: 744871 - RNA, 64 nt, Homo Sapiens; identical to SEQ ID NO: 580324

SEQ ID NO: 744872 - RNA, 64 nt, Homo Sapiens; identical to SEQ ID NO: 580325

SEQ ID NO: 744873 - RNA, 64 nt, Homo Sapiens; identical to SEQ ID NO: 580326

SEQ ID NO: 744874 - RNA, 64 nt, Homo Sapiens; identical to SEQ ID NO: 580327

SEQ ID NO: 744875 - RNA, 64 nt, Homo Sapiens; identical to SEQ ID NO: 580328

SEQ ID NO: 744876 - RNA, 64 nt, Homo Sapiens; identical to SEQ ID NO: 580329

SEQ ID NO: 744877 - RNA, 64 nt, Homo Sapiens; identical to SEQ ID NO: 282946

SEQ ID NO: 744878 - RNA, 64 nt, Homo Sapiens; identical to SEQ ID NO: 282947

SEQ ID NO: 744879 - RNA, 64 nt, Homo Sapiens; identical to SEQ ID NO: 282948

SEQ ID NO: 744880 - RNA, 64 nt, Homo Sapiens; identical to SEQ ID NO: 282949

SEQ ID NO: 744881 - RNA, 64 nt, Homo Sapiens; identical to SEQ ID NO: 282950

SEQ ID NO: 744882 - RNA, 64 nt, Homo Sapiens; identical to SEQ ID NO: 282951

SEQ ID NO: 744883 - RNA, 64 nt, Homo Sapiens; identical to SEQ ID NO: 282952

SEQ ID NO: 744884 - RNA, 64 nt, Homo Sapiens; identical to SEQ ID NO: 282953

SEQ ID NO: 744885 - RNA, 64 nt, Homo Sapiens
uacuggccuuguccagaggccuuucuggcuggccaguggcaaucggguugggggagccccacag

SEQ ID NO: 744886 - RNA, 64 nt, Homo Sapiens
aaaagcacaagugcaugaguuuuacugaaaagacaguggcaaggggggcuggcuggauguucuc

SEQ ID NO: 744887 - RNA, 64 nt, Homo Sapiens
aacaacuacauaaaauauguuucuauuuagaugaaguggcaaacuaaucuguaguguuaaaaau

SEQ ID NO: 744888 - RNA, 64 nt, Homo Sapiens
uccaauagaugagaauuuuccguaucuugaucugaguggcaaauuguaaacuuaaaauauauau

SEQ ID NO: 744889 - RNA, 64 nt, Homo Sapiens
ggaaguguuuccuaggaggaaaauuccauuagagaguggcaauaggaugagguuucuucagggu

SEQ ID NO: 744890 - RNA, 64 nt, Homo Sapiens
gaagcaagugaggccugacaugguugucaucacuaguggcaaaugaccuuccaaguaagcagau

SEQ ID NO: 744891 - RNA, 64 nt, Homo Sapiens; identical to SEQ ID NO: 53018

SEQ ID NO: 744892 - RNA, 64 nt, Homo Sapiens; identical to SEQ ID NO: 53019

SEQ ID NO: 744893 - RNA, 64 nt, Homo Sapiens; identical to SEQ ID NO: 53020

SEQ ID NO: 744894 - RNA, 64 nt, Homo Sapiens; identical to SEQ ID NO: 53021

SEQ ID NO: 744895 - RNA, 64 nt, Homo Sapiens; identical to SEQ ID NO: 53022

SEQ ID NO: 744896 - RNA, 64 nt, Homo Sapiens; identical to SEQ ID NO: 53023

SEQ ID NO: 744897 - RNA, 64 nt, Homo Sapiens; identical to SEQ ID NO: 53024

SEQ ID NO: 744898 - RNA, 64 nt, Homo Sapiens; identical to SEQ ID NO: 53025

SEQ ID NO: 744899 - RNA, 64 nt, Homo Sapiens; identical to SEQ ID NO: 53026

SEQ ID NO: 744900 - RNA, 64 nt, Homo Sapiens; identical to SEQ ID NO: 53027

SEQ ID NO: 744901 - RNA, 64 nt, Homo Sapiens; identical to SEQ ID NO: 53028

SEQ ID NO: 744902 - RNA, 64 nt, Homo Sapiens; identical to SEQ ID NO: 53029

SEQ ID NO: 744903 - RNA, 64 nt, Homo Sapiens; identical to SEQ ID NO: 53030

SEQ ID NO: 744904 - RNA, 64 nt, Homo Sapiens; identical to SEQ ID NO: 53031

SEQ ID NO: 744905 - RNA, 64 nt, Homo Sapiens; identical to SEQ ID NO: 53032

SEQ ID NO: 744906 - RNA, 64 nt, Homo Sapiens; identical to SEQ ID NO: 53033

SEQ ID NO: 744907 - RNA, 64 nt, Homo Sapiens; identical to SEQ ID NO: 53034

SEQ ID NO: 744908 - RNA, 64 nt, Homo Sapiens; identical to SEQ ID NO: 53035

SEQ ID NO: 744909 - RNA, 64 nt, Homo Sapiens; identical to SEQ ID NO: 53036

SEQ ID NO: 744910 - RNA, 64 nt, Homo Sapiens; identical to SEQ ID NO: 53037

SEQ ID NO: 744911 - RNA, 64 nt, Homo Sapiens; identical to SEQ ID NO: 53038

SEQ ID NO: 744912 - RNA, 64 nt, Homo Sapiens; identical to SEQ ID NO: 53039

SEQ ID NO: 744913 - RNA, 64 nt, Homo Sapiens; identical to SEQ ID NO: 53040

SEQ ID NO: 744914 - RNA, 64 nt, Homo Sapiens; identical to SEQ ID NO: 53041

SEQ ID NO: 744915 - RNA, 64 nt, Homo Sapiens; identical to SEQ ID NO: 53042

SEQ ID NO: 744916 - RNA, 64 nt, Homo Sapiens; identical to SEQ ID NO: 53043

SEQ ID NO: 744917 - RNA, 64 nt, Homo Sapiens; identical to SEQ ID NO: 53044

SEQ ID NO: 744918 - RNA, 64 nt, Homo Sapiens; identical to SEQ ID NO: 53045

SEQ ID NO: 744919 - RNA, 64 nt, Homo Sapiens; identical to SEQ ID NO: 53046

SEQ ID NO: 744920 - RNA, 64 nt, Homo Sapiens; identical to SEQ ID NO: 53047

SEQ ID NO: 744921 - RNA, 64 nt, Homo Sapiens; identical to SEQ ID NO: 53048

SEQ ID NO: 744922 - RNA, 64 nt, Homo Sapiens; identical to SEQ ID NO: 53049

SEQ ID NO: 744923 - RNA, 64 nt, Homo Sapiens; identical to SEQ ID NO: 53050

SEQ ID NO: 744924 - RNA, 64 nt, Homo Sapiens; identical to SEQ ID NO: 53051

SEQ ID NO: 744925 - RNA, 64 nt, Homo Sapiens; identical to SEQ ID NO: 53052

SEQ ID NO: 744926 - RNA, 64 nt, Homo Sapiens; identical to SEQ ID NO: 53053

SEQ ID NO: 744927 - RNA, 64 nt, Homo Sapiens; identical to SEQ ID NO: 53054

SEQ ID NO: 744928 - RNA, 64 nt, Homo Sapiens; identical to SEQ ID NO: 53055

SEQ ID NO: 744929 - RNA, 64 nt, Homo Sapiens; identical to SEQ ID NO: 53056

SEQ ID NO: 744930 - RNA, 64 nt, Homo Sapiens; identical to SEQ ID NO: 53057

SEQ ID NO: 744931 - RNA, 64 nt, Homo Sapiens; identical to SEQ ID NO: 53058

SEQ ID NO: 744932 - RNA, 64 nt, Homo Sapiens; identical to SEQ ID NO: 53059

SEQ ID NO: 744933 - RNA, 64 nt, Homo Sapiens
cuauagaugauccauuggaguguggauggcuaaugagugugagguaucacuuaagggaguuggu

SEQ ID NO: 744934 - RNA, 64 nt, Homo Sapiens
caucagggcuauuccgcagcuugcagcaagcacagagugugaccucccaggauuugcugacagc

SEQ ID NO: 744935 - RNA, 64 nt, Homo Sapiens
gggacugcguuugcauuuuugauaaugcaggggugagugugagacagaaugugagugugagagu

SEQ ID NO: 744936 - RNA, 64 nt, Homo Sapiens
gugauaaugcaggggugaguucuugccagaaugugagugugagacgccugagggugggcaugag

SEQ ID NO: 744937 - RNA, 64 nt, Homo Sapiens
uaugaucacagagcaacggagcaaaggcuuucgggagugugaggcugcaucugcuggagcaaag

SEQ ID NO: 744938 - RNA, 64 nt, Homo Sapiens
gcaccuccuccuaaaugcaggcacuugcuaggaagagugugagcuggcgucuucuguucacccu

SEQ ID NO: 744939 - RNA, 64 nt, Homo Sapiens
cucuccuguaaaguauuuaugccaaagugucugagagugugaccaagcuccaagcccuuuggga

SEQ ID NO: 744940 - RNA, 64 nt, Homo Sapiens
agggcgagcugucuuucuauugcguguggagcuggagugugaggccuggccaucccacgccgcc

SEQ ID NO: 744941 - RNA, 64 nt, Homo Sapiens
gagagggugaguguggucaggugugugugagugugagugugagccagccaggacagggccuggg

SEQ ID NO: 744942 - RNA, 64 nt, Homo Sapiens
gugagcgagagggugaguguccuggggugugugugagugugaguccugaccagccaggacaggg

SEQ ID NO: 744943 - RNA, 64 nt, Homo Sapiens
cagugucaccugugccaaccauggggugucccgugagugugaguguggcagugagaagaagcau

SEQ ID NO: 744944 - RNA, 64 nt, Homo Sapiens
cauaggaaaagcuuccuugaugugagcucugggggagugugaaggaugcaucucuagcccccga

SEQ ID NO: 744945 - RNA, 64 nt, Homo Sapiens
uguaugucugcaggugucugacacgcaagugugugagugugagugugagagauggggcgggggu

SEQ ID NO: 744946 - RNA, 64 nt, Homo Sapiens
ucugcaggugucugacacgcaagugugugagugugagugugagagauggggcgggggugugucu

SEQ ID NO: 744947 - RNA, 64 nt, Homo Sapiens
gcagcacugggaagcuggagugaccuguccaggugagugugaggggcuuucauccugugucccc

SEQ ID NO: 744948 - RNA, 64 nt, Homo Sapiens
ggccaccggggcaagagggaccagggugcagugugagugugaugggguucagggaacugcuugc

SEQ ID NO: 744949 - RNA, 64 nt, Homo Sapiens
uuuuacaaucuguaucuuugacaauucugggugcgagugugagagugugagcagggcuugcucc

SEQ ID NO: 744950 - RNA, 64 nt, Homo Sapiens
ucuguaucuuugacaauucugggugcgagugugagagugugagcagggcuugcuccugccaacc

SEQ ID NO: 744951 - RNA, 64 nt, Homo Sapiens
cuguuagacuguuagauuuauggauagaguugaggagugugaggggagagaagaggagagggcu

SEQ ID NO: 744952 - RNA, 64 nt, Homo Sapiens
ugggcuaaaggcccccuuuucuugcucgcucucugagugugacuugaaaggggauuccaauaag

SEQ ID NO: 744953 - RNA, 64 nt, Homo Sapiens; identical to SEQ ID NO: 189763

SEQ ID NO: 744954 - RNA, 64 nt, Homo Sapiens; identical to SEQ ID NO: 189764

SEQ ID NO: 744955 - RNA, 64 nt, Homo Sapiens; identical to SEQ ID NO: 189765

SEQ ID NO: 744956 - RNA, 64 nt, Homo Sapiens; identical to SEQ ID NO: 189766

SEQ ID NO: 744957 - RNA, 64 nt, Homo Sapiens; identical to SEQ ID NO: 189767

SEQ ID NO: 744958 - RNA, 64 nt, Homo Sapiens; identical to SEQ ID NO: 189768

SEQ ID NO: 744959 - RNA, 64 nt, Homo Sapiens; identical to SEQ ID NO: 189769

SEQ ID NO: 744960 - RNA, 64 nt, Homo Sapiens; identical to SEQ ID NO: 189770

SEQ ID NO: 744961 - RNA, 64 nt, Homo Sapiens; identical to SEQ ID NO: 189771

SEQ ID NO: 744962 - RNA, 64 nt, Homo Sapiens; identical to SEQ ID NO: 189772

SEQ ID NO: 744963 - RNA, 64 nt, Homo Sapiens; identical to SEQ ID NO: 189773

SEQ ID NO: 744964 - RNA, 64 nt, Homo Sapiens; identical to SEQ ID NO: 189774

SEQ ID NO: 744965 - RNA, 64 nt, Homo Sapiens; identical to SEQ ID NO: 189775

SEQ ID NO: 744966 - RNA, 64 nt, Homo Sapiens; identical to SEQ ID NO: 189776

SEQ ID NO: 744967 - RNA, 64 nt, Homo Sapiens; identical to SEQ ID NO: 189777

SEQ ID NO: 744968 - RNA, 64 nt, Homo Sapiens; identical to SEQ ID NO: 189778

SEQ ID NO: 744969 - RNA, 64 nt, Homo Sapiens; identical to SEQ ID NO: 189779

SEQ ID NO: 744970 - RNA, 64 nt, Homo Sapiens; identical to SEQ ID NO: 189780

SEQ ID NO: 744971 - RNA, 64 nt, Homo Sapiens; identical to SEQ ID NO: 189781

SEQ ID NO: 744972 - RNA, 64 nt, Homo Sapiens; identical to SEQ ID NO: 189782

SEQ ID NO: 744973 - RNA, 64 nt, Homo Sapiens; identical to SEQ ID NO: 189783

SEQ ID NO: 744974 - RNA, 64 nt, Homo Sapiens; identical to SEQ ID NO: 91501

SEQ ID NO: 744975 - RNA, 64 nt, Homo Sapiens; identical to SEQ ID NO: 91502

SEQ ID NO: 744976 - RNA, 64 nt, Homo Sapiens; identical to SEQ ID NO: 91503

SEQ ID NO: 744977 - RNA, 64 nt, Homo Sapiens; identical to SEQ ID NO: 91504

SEQ ID NO: 744978 - RNA, 64 nt, Homo Sapiens; identical to SEQ ID NO: 91505

SEQ ID NO: 744979 - RNA, 64 nt, Homo Sapiens; identical to SEQ ID NO: 91506

SEQ ID NO: 744980 - RNA, 64 nt, Homo Sapiens; identical to SEQ ID NO: 91507

SEQ ID NO: 744981 - RNA, 64 nt, Homo Sapiens; identical to SEQ ID NO: 91508

SEQ ID NO: 744982 - RNA, 64 nt, Homo Sapiens; identical to SEQ ID NO: 244942

SEQ ID NO: 744983 - RNA, 64 nt, Homo Sapiens; identical to SEQ ID NO: 244943

SEQ ID NO: 744984 - RNA, 64 nt, Homo Sapiens; identical to SEQ ID NO: 244944

SEQ ID NO: 744985 - RNA, 64 nt, Homo Sapiens; identical to SEQ ID NO: 244945

SEQ ID NO: 744986 - RNA, 64 nt, Homo Sapiens; identical to SEQ ID NO: 244946

SEQ ID NO: 744987 - RNA, 64 nt, Homo Sapiens; identical to SEQ ID NO: 244947

SEQ ID NO: 744988 - RNA, 64 nt, Homo Sapiens; identical to SEQ ID NO: 244948

SEQ ID NO: 744989 - RNA, 64 nt, Homo Sapiens; identical to SEQ ID NO: 244949

SEQ ID NO: 744990 - RNA, 64 nt, Homo Sapiens; identical to SEQ ID NO: 244950

SEQ ID NO: 744991 - RNA, 64 nt, Homo Sapiens; identical to SEQ ID NO: 244951

SEQ ID NO: 744992 - RNA, 64 nt, Homo Sapiens; identical to SEQ ID NO: 244952

SEQ ID NO: 744993 - RNA, 64 nt, Homo Sapiens; identical to SEQ ID NO: 244953

SEQ ID NO: 744994 - RNA, 64 nt, Homo Sapiens; identical to SEQ ID NO: 244954

SEQ ID NO: 744995 - RNA, 64 nt, Homo Sapiens; identical to SEQ ID NO: 244955

SEQ ID NO: 744996 - RNA, 64 nt, Homo Sapiens; identical to SEQ ID NO: 244956

SEQ ID NO: 744997 - RNA, 64 nt, Homo Sapiens; identical to SEQ ID NO: 244957

SEQ ID NO: 744998 - RNA, 64 nt, Homo Sapiens; identical to SEQ ID NO: 244958

SEQ ID NO: 744999 - RNA, 64 nt, Homo Sapiens; identical to SEQ ID NO: 244959

SEQ ID NO: 745000 - RNA, 64 nt, Homo Sapiens; identical to SEQ ID NO: 244960

SEQ ID NO: 745001 - RNA, 64 nt, Homo Sapiens; identical to SEQ ID NO: 244961

SEQ ID NO: 745002 - RNA, 64 nt, Homo Sapiens; identical to SEQ ID NO: 244962

SEQ ID NO: 745003 - RNA, 64 nt, Homo Sapiens; identical to SEQ ID NO: 244963

SEQ ID NO: 745004 - RNA, 64 nt, Homo Sapiens; identical to SEQ ID NO: 244964

SEQ ID NO: 745005 - RNA, 64 nt, Homo Sapiens; identical to SEQ ID NO: 244965

SEQ ID NO: 745006 - RNA, 64 nt, Homo Sapiens; identical to SEQ ID NO: 244966

SEQ ID NO: 745007 - RNA, 64 nt, Homo Sapiens; identical to SEQ ID NO: 244967

SEQ ID NO: 745008 - RNA, 64 nt, Homo Sapiens; identical to SEQ ID NO: 244968

SEQ ID NO: 745009 - RNA, 64 nt, Homo Sapiens; identical to SEQ ID NO: 363385

SEQ ID NO: 745010 - RNA, 64 nt, Homo Sapiens; identical to SEQ ID NO: 363386

SEQ ID NO: 745011 - RNA, 64 nt, Homo Sapiens; identical to SEQ ID NO: 363387

SEQ ID NO: 745012 - RNA, 64 nt, Homo Sapiens; identical to SEQ ID NO: 363388

SEQ ID NO: 745013 - RNA, 64 nt, Homo Sapiens; identical to SEQ ID NO: 363389

SEQ ID NO: 745014 - RNA, 64 nt, Homo Sapiens; identical to SEQ ID NO: 363390

SEQ ID NO: 745015 - RNA, 64 nt, Homo Sapiens; identical to SEQ ID NO: 363391

SEQ ID NO: 745016 - RNA, 64 nt, Homo Sapiens; identical to SEQ ID NO: 363392

SEQ ID NO: 745017 - RNA, 64 nt, Homo Sapiens; identical to SEQ ID NO: 363393

SEQ ID NO: 745018 - RNA, 64 nt, Homo Sapiens; identical to SEQ ID NO: 363394

SEQ ID NO: 745019 - RNA, 64 nt, Homo Sapiens; identical to SEQ ID NO: 363395

SEQ ID NO: 745020 - RNA, 64 nt, Homo Sapiens; identical to SEQ ID NO: 363396

SEQ ID NO: 745021 - RNA, 64 nt, Homo Sapiens; identical to SEQ ID NO: 363397

SEQ ID NO: 745022 - RNA, 64 nt, Homo Sapiens; identical to SEQ ID NO: 363398

SEQ ID NO: 745023 - RNA, 64 nt, Homo Sapiens; identical to SEQ ID NO: 363399

SEQ ID NO: 745024 - RNA, 64 nt, Homo Sapiens; identical to SEQ ID NO: 363400

SEQ ID NO: 745025 - RNA, 64 nt, Homo Sapiens; identical to SEQ ID NO: 363401

SEQ ID NO: 745026 - RNA, 64 nt, Homo Sapiens; identical to SEQ ID NO: 363402

SEQ ID NO: 745027 - RNA, 64 nt, Homo Sapiens; identical to SEQ ID NO: 363403

SEQ ID NO: 745028 - RNA, 64 nt, Homo Sapiens; identical to SEQ ID NO: 363404

SEQ ID NO: 745029 - RNA, 64 nt, Homo Sapiens; identical to SEQ ID NO: 363405

SEQ ID NO: 745030 - RNA, 64 nt, Homo Sapiens; identical to SEQ ID NO: 363406

SEQ ID NO: 745031 - RNA, 64 nt, Homo Sapiens; identical to SEQ ID NO: 363407

SEQ ID NO: 745032 - RNA, 64 nt, Homo Sapiens; identical to SEQ ID NO: 363408

SEQ ID NO: 745033 - RNA, 64 nt, Homo Sapiens; identical to SEQ ID NO: 363409

SEQ ID NO: 745034 - RNA, 64 nt, Homo Sapiens; identical to SEQ ID NO: 363410

SEQ ID NO: 745035 - RNA, 64 nt, Homo Sapiens; identical to SEQ ID NO: 363411

SEQ ID NO: 745036 - RNA, 64 nt, Homo Sapiens; identical to SEQ ID NO: 363412

SEQ ID NO: 745037 - RNA, 64 nt, Homo Sapiens; identical to SEQ ID NO: 363413

SEQ ID NO: 745038 - RNA, 64 nt, Homo Sapiens; identical to SEQ ID NO: 363414

SEQ ID NO: 745039 - RNA, 64 nt, Homo Sapiens; identical to SEQ ID NO: 363415

SEQ ID NO: 745040 - RNA, 64 nt, Homo Sapiens; identical to SEQ ID NO: 363416

SEQ ID NO: 745041 - RNA, 64 nt, Homo Sapiens; identical to SEQ ID NO: 363417

SEQ ID NO: 745042 - RNA, 64 nt, Homo Sapiens; identical to SEQ ID NO: 363418

SEQ ID NO: 745043 - RNA, 64 nt, Homo Sapiens; identical to SEQ ID NO: 363419

SEQ ID NO: 745044 - RNA, 64 nt, Homo Sapiens; identical to SEQ ID NO: 363420

SEQ ID NO: 745045 - RNA, 64 nt, Homo Sapiens; identical to SEQ ID NO: 363421

SEQ ID NO: 745046 - RNA, 64 nt, Homo Sapiens; identical to SEQ ID NO: 363422

SEQ ID NO: 745047 - RNA, 64 nt, Homo Sapiens; identical to SEQ ID NO: 363423

SEQ ID NO: 745048 - RNA, 64 nt, Homo Sapiens; identical to SEQ ID NO: 363424

SEQ ID NO: 745049 - RNA, 64 nt, Homo Sapiens; identical to SEQ ID NO: 363425

SEQ ID NO: 745050 - RNA, 64 nt, Homo Sapiens; identical to SEQ ID NO: 363426

SEQ ID NO: 745051 - RNA, 64 nt, Homo Sapiens; identical to SEQ ID NO: 363427

SEQ ID NO: 745052 - RNA, 64 nt, Homo Sapiens; identical to SEQ ID NO: 363428

SEQ ID NO: 745053 - RNA, 64 nt, Homo Sapiens; identical to SEQ ID NO: 363429

SEQ ID NO: 745054 - RNA, 64 nt, Homo Sapiens; identical to SEQ ID NO: 534631

SEQ ID NO: 745055 - RNA, 64 nt, Homo Sapiens; identical to SEQ ID NO: 534632

SEQ ID NO: 745056 - RNA, 64 nt, Homo Sapiens; identical to SEQ ID NO: 534633

SEQ ID NO: 745057 - RNA, 64 nt, Homo Sapiens; identical to SEQ ID NO: 534634

SEQ ID NO: 745058 - RNA, 64 nt, Homo Sapiens; identical to SEQ ID NO: 534635

SEQ ID NO: 745059 - RNA, 64 nt, Homo Sapiens; identical to SEQ ID NO: 534636

SEQ ID NO: 745060 - RNA, 64 nt, Homo Sapiens; identical to SEQ ID NO: 534637

SEQ ID NO: 745061 - RNA, 64 nt, Homo Sapiens; identical to SEQ ID NO: 534638

SEQ ID NO: 745062 - RNA, 64 nt, Homo Sapiens; identical to SEQ ID NO: 534639

SEQ ID NO: 745063 - RNA, 64 nt, Homo Sapiens; identical to SEQ ID NO: 534640

SEQ ID NO: 745064 - RNA, 64 nt, Homo Sapiens; identical to SEQ ID NO: 534641

SEQ ID NO: 745065 - RNA, 64 nt, Homo Sapiens; identical to SEQ ID NO: 534642

SEQ ID NO: 745066 - RNA, 64 nt, Homo Sapiens; identical to SEQ ID NO: 534643

SEQ ID NO: 745067 - RNA, 64 nt, Homo Sapiens; identical to SEQ ID NO: 534644

SEQ ID NO: 745068 - RNA, 64 nt, Homo Sapiens; identical to SEQ ID NO: 534645

SEQ ID NO: 745069 - RNA, 64 nt, Homo Sapiens; identical to SEQ ID NO: 534646

SEQ ID NO: 745070 - RNA, 64 nt, Homo Sapiens; identical to SEQ ID NO: 534647

SEQ ID NO: 745071 - RNA, 64 nt, Homo Sapiens; identical to SEQ ID NO: 534648

SEQ ID NO: 745072 - RNA, 64 nt, Homo Sapiens; identical to SEQ ID NO: 534649

SEQ ID NO: 745073 - RNA, 64 nt, Homo Sapiens; identical to SEQ ID NO: 534650

SEQ ID NO: 745074 - RNA, 64 nt, Homo Sapiens; identical to SEQ ID NO: 534651

SEQ ID NO: 745075 - RNA, 64 nt, Homo Sapiens; identical to SEQ ID NO: 534652

SEQ ID NO: 745076 - RNA, 64 nt, Homo Sapiens; identical to SEQ ID NO: 534653

SEQ ID NO: 745077 - RNA, 64 nt, Homo Sapiens; identical to SEQ ID NO: 534654

SEQ ID NO: 745078 - RNA, 64 nt, Homo Sapiens; identical to SEQ ID NO: 534655

SEQ ID NO: 745079 - RNA, 64 nt, Homo Sapiens; identical to SEQ ID NO: 534656

SEQ ID NO: 745080 - RNA, 64 nt, Homo Sapiens; identical to SEQ ID NO: 534657

SEQ ID NO: 745081 - RNA, 64 nt, Homo Sapiens; identical to SEQ ID NO: 534658

SEQ ID NO: 745082 - RNA, 64 nt, Homo Sapiens; identical to SEQ ID NO: 534659

SEQ ID NO: 745083 - RNA, 64 nt, Homo Sapiens; identical to SEQ ID NO: 534660

SEQ ID NO: 745084 - RNA, 64 nt, Homo Sapiens; identical to SEQ ID NO: 534661

SEQ ID NO: 745085 - RNA, 64 nt, Homo Sapiens; identical to SEQ ID NO: 534662

SEQ ID NO: 745086 - RNA, 64 nt, Homo Sapiens; identical to SEQ ID NO: 534663

SEQ ID NO: 745087 - RNA, 64 nt, Homo Sapiens; identical to SEQ ID NO: 534664

SEQ ID NO: 745088 - RNA, 64 nt, Homo Sapiens; identical to SEQ ID NO: 534665

SEQ ID NO: 745089 - RNA, 64 nt, Homo Sapiens; identical to SEQ ID NO: 534666

SEQ ID NO: 745090 - RNA, 64 nt, Homo Sapiens; identical to SEQ ID NO: 534667

SEQ ID NO: 745091 - RNA, 64 nt, Homo Sapiens; identical to SEQ ID NO: 534668

SEQ ID NO: 745092 - RNA, 64 nt, Homo Sapiens; identical to SEQ ID NO: 534669

SEQ ID NO: 745093 - RNA, 64 nt, Homo Sapiens; identical to SEQ ID NO: 534670

SEQ ID NO: 745094 - RNA, 64 nt, Homo Sapiens; identical to SEQ ID NO: 534671

SEQ ID NO: 745095 - RNA, 64 nt, Homo Sapiens; identical to SEQ ID NO: 534672

SEQ ID NO: 745096 - RNA, 64 nt, Homo Sapiens; identical to SEQ ID NO: 534673

SEQ ID NO: 745097 - RNA, 64 nt, Homo Sapiens; identical to SEQ ID NO: 534674

SEQ ID NO: 745098 - RNA, 64 nt, Homo Sapiens; identical to SEQ ID NO: 534675

SEQ ID NO: 745099 - RNA, 64 nt, Homo Sapiens; identical to SEQ ID NO: 534676

SEQ ID NO: 745100 - RNA, 64 nt, Homo Sapiens; identical to SEQ ID NO: 534677

SEQ ID NO: 745101 - RNA, 64 nt, Homo Sapiens; identical to SEQ ID NO: 534678

SEQ ID NO: 745102 - RNA, 64 nt, Homo Sapiens; identical to SEQ ID NO: 534679

SEQ ID NO: 745103 - RNA, 64 nt, Homo Sapiens; identical to SEQ ID NO: 534680

SEQ ID NO: 745104 - RNA, 64 nt, Homo Sapiens; identical to SEQ ID NO: 534681

SEQ ID NO: 745105 - RNA, 64 nt, Homo Sapiens; identical to SEQ ID NO: 534682

SEQ ID NO: 745106 - RNA, 64 nt, Homo Sapiens; identical to SEQ ID NO: 534683

SEQ ID NO: 745107 - RNA, 64 nt, Homo Sapiens; identical to SEQ ID NO: 534684

SEQ ID NO: 745108 - RNA, 64 nt, Homo Sapiens; identical to SEQ ID NO: 534685

SEQ ID NO: 745109 - RNA, 64 nt, Homo Sapiens; identical to SEQ ID NO: 534686

SEQ ID NO: 745110 - RNA, 64 nt, Homo Sapiens; identical to SEQ ID NO: 534687

SEQ ID NO: 745111 - RNA, 64 nt, Homo Sapiens; identical to SEQ ID NO: 534688

SEQ ID NO: 745112 - RNA, 64 nt, Homo Sapiens; identical to SEQ ID NO: 534689

SEQ ID NO: 745113 - RNA, 64 nt, Homo Sapiens; identical to SEQ ID NO: 534690

SEQ ID NO: 745114 - RNA, 64 nt, Homo Sapiens; identical to SEQ ID NO: 534691

SEQ ID NO: 745115 - RNA, 64 nt, Homo Sapiens; identical to SEQ ID NO: 534692

SEQ ID NO: 745116 - RNA, 64 nt, Homo Sapiens; identical to SEQ ID NO: 534693

SEQ ID NO: 745117 - RNA, 64 nt, Homo Sapiens; identical to SEQ ID NO: 534694

SEQ ID NO: 745118 - RNA, 64 nt, Homo Sapiens; identical to SEQ ID NO: 534695

SEQ ID NO: 745119 - RNA, 64 nt, Homo Sapiens; identical to SEQ ID NO: 534696

SEQ ID NO: 745120 - RNA, 64 nt, Homo Sapiens; identical to SEQ ID NO: 534697

SEQ ID NO: 745121 - RNA, 64 nt, Homo Sapiens; identical to SEQ ID NO: 534698

SEQ ID NO: 745122 - RNA, 64 nt, Homo Sapiens; identical to SEQ ID NO: 534699

SEQ ID NO: 745123 - RNA, 64 nt, Homo Sapiens; identical to SEQ ID NO: 534700

SEQ ID NO: 745124 - RNA, 64 nt, Homo Sapiens; identical to SEQ ID NO: 534701

SEQ ID NO: 745125 - RNA, 64 nt, Homo Sapiens; identical to SEQ ID NO: 534702

SEQ ID NO: 745126 - RNA, 64 nt, Homo Sapiens; identical to SEQ ID NO: 534703

SEQ ID NO: 745127 - RNA, 64 nt, Homo Sapiens; identical to SEQ ID NO: 534704

SEQ ID NO: 745128 - RNA, 64 nt, Homo Sapiens; identical to SEQ ID NO: 534705

SEQ ID NO: 745129 - RNA, 64 nt, Homo Sapiens; identical to SEQ ID NO: 534706

SEQ ID NO: 745130 - RNA, 64 nt, Homo Sapiens; identical to SEQ ID NO: 534707

SEQ ID NO: 745131 - RNA, 64 nt, Homo Sapiens; identical to SEQ ID NO: 534708

SEQ ID NO: 745132 - RNA, 64 nt, Homo Sapiens; identical to SEQ ID NO: 534709

SEQ ID NO: 745133 - RNA, 64 nt, Homo Sapiens; identical to SEQ ID NO: 534710

SEQ ID NO: 745134 - RNA, 64 nt, Homo Sapiens; identical to SEQ ID NO: 534711

SEQ ID NO: 745135 - RNA, 64 nt, Homo Sapiens; identical to SEQ ID NO: 534712

SEQ ID NO: 745136 - RNA, 64 nt, Homo Sapiens; identical to SEQ ID NO: 534713

SEQ ID NO: 745137 - RNA, 64 nt, Homo Sapiens; identical to SEQ ID NO: 534714

SEQ ID NO: 745138 - RNA, 64 nt, Homo Sapiens; identical to SEQ ID NO: 534715

SEQ ID NO: 745139 - RNA, 64 nt, Homo Sapiens; identical to SEQ ID NO: 534716

SEQ ID NO: 745140 - RNA, 64 nt, Homo Sapiens; identical to SEQ ID NO: 534717

SEQ ID NO: 745141 - RNA, 64 nt, Homo Sapiens; identical to SEQ ID NO: 534718

SEQ ID NO: 745142 - RNA, 64 nt, Homo Sapiens; identical to SEQ ID NO: 534719

SEQ ID NO: 745143 - RNA, 64 nt, Homo Sapiens; identical to SEQ ID NO: 534720

SEQ ID NO: 745144 - RNA, 64 nt, Homo Sapiens; identical to SEQ ID NO: 534721

SEQ ID NO: 745145 - RNA, 64 nt, Homo Sapiens; identical to SEQ ID NO: 534722

SEQ ID NO: 745146 - RNA, 64 nt, Homo Sapiens; identical to SEQ ID NO: 534723

SEQ ID NO: 745147 - RNA, 64 nt, Homo Sapiens; identical to SEQ ID NO: 534724

SEQ ID NO: 745148 - RNA, 64 nt, Homo Sapiens; identical to SEQ ID NO: 534725

SEQ ID NO: 745149 - RNA, 64 nt, Homo Sapiens; identical to SEQ ID NO: 534726

SEQ ID NO: 745150 - RNA, 64 nt, Homo Sapiens; identical to SEQ ID NO: 534727

SEQ ID NO: 745151 - RNA, 64 nt, Homo Sapiens; identical to SEQ ID NO: 534728

SEQ ID NO: 745152 - RNA, 64 nt, Homo Sapiens; identical to SEQ ID NO: 534729

SEQ ID NO: 745153 - RNA, 64 nt, Homo Sapiens; identical to SEQ ID NO: 534730

SEQ ID NO: 745154 - RNA, 64 nt, Homo Sapiens; identical to SEQ ID NO: 534731

SEQ ID NO: 745155 - RNA, 64 nt, Homo Sapiens; identical to SEQ ID NO: 534732

SEQ ID NO: 745156 - RNA, 64 nt, Homo Sapiens; identical to SEQ ID NO: 534733

SEQ ID NO: 745157 - RNA, 64 nt, Homo Sapiens; identical to SEQ ID NO: 534734

SEQ ID NO: 745158 - RNA, 64 nt, Homo Sapiens; identical to SEQ ID NO: 534735

SEQ ID NO: 745159 - RNA, 64 nt, Homo Sapiens; identical to SEQ ID NO: 534736

SEQ ID NO: 745160 - RNA, 64 nt, Homo Sapiens; identical to SEQ ID NO: 534737

SEQ ID NO: 745161 - RNA, 64 nt, Homo Sapiens; identical to SEQ ID NO: 534738

SEQ ID NO: 745162 - RNA, 64 nt, Homo Sapiens; identical to SEQ ID NO: 534739

SEQ ID NO: 745163 - RNA, 64 nt, Homo Sapiens; identical to SEQ ID NO: 534740

SEQ ID NO: 745164 - RNA, 64 nt, Homo Sapiens; identical to SEQ ID NO: 534741

SEQ ID NO: 745165 - RNA, 64 nt, Homo Sapiens; identical to SEQ ID NO: 534742

SEQ ID NO: 745166 - RNA, 64 nt, Homo Sapiens; identical to SEQ ID NO: 534743

SEQ ID NO: 745167 - RNA, 64 nt, Homo Sapiens; identical to SEQ ID NO: 534744

SEQ ID NO: 745168 - RNA, 64 nt, Homo Sapiens; identical to SEQ ID NO: 534745

SEQ ID NO: 745169 - RNA, 64 nt, Homo Sapiens; identical to SEQ ID NO: 534746

SEQ ID NO: 745170 - RNA, 64 nt, Homo Sapiens; identical to SEQ ID NO: 534747

SEQ ID NO: 745171 - RNA, 64 nt, Homo Sapiens; identical to SEQ ID NO: 534748

SEQ ID NO: 745172 - RNA, 64 nt, Homo Sapiens; identical to SEQ ID NO: 534749

SEQ ID NO: 745173 - RNA, 64 nt, Homo Sapiens; identical to SEQ ID NO: 534750

SEQ ID NO: 745174 - RNA, 64 nt, Homo Sapiens; identical to SEQ ID NO: 534751

SEQ ID NO: 745175 - RNA, 64 nt, Homo Sapiens; identical to SEQ ID NO: 534752

SEQ ID NO: 745176 - RNA, 64 nt, Homo Sapiens; identical to SEQ ID NO: 534753

SEQ ID NO: 745177 - RNA, 64 nt, Homo Sapiens; identical to SEQ ID NO: 534754

SEQ ID NO: 745178 - RNA, 64 nt, Homo Sapiens; identical to SEQ ID NO: 534755

SEQ ID NO: 745179 - RNA, 64 nt, Homo Sapiens; identical to SEQ ID NO: 534756

SEQ ID NO: 745180 - RNA, 64 nt, Homo Sapiens; identical to SEQ ID NO: 534757

SEQ ID NO: 745181 - RNA, 64 nt, Homo Sapiens; identical to SEQ ID NO: 534758

SEQ ID NO: 745182 - RNA, 64 nt, Homo Sapiens; identical to SEQ ID NO: 534759

SEQ ID NO: 745183 - RNA, 64 nt, Homo Sapiens; identical to SEQ ID NO: 534760

SEQ ID NO: 745184 - RNA, 64 nt, Homo Sapiens; identical to SEQ ID NO: 534761

SEQ ID NO: 745185 - RNA, 64 nt, Homo Sapiens; identical to SEQ ID NO: 534762

SEQ ID NO: 745186 - RNA, 64 nt, Homo Sapiens; identical to SEQ ID NO: 534763

SEQ ID NO: 745187 - RNA, 64 nt, Homo Sapiens; identical to SEQ ID NO: 534764

SEQ ID NO: 745188 - RNA, 64 nt, Homo Sapiens; identical to SEQ ID NO: 534765

SEQ ID NO: 745189 - RNA, 64 nt, Homo Sapiens; identical to SEQ ID NO: 534766

SEQ ID NO: 745190 - RNA, 64 nt, Homo Sapiens; identical to SEQ ID NO: 534767

SEQ ID NO: 745191 - RNA, 64 nt, Homo Sapiens; identical to SEQ ID NO: 534768

SEQ ID NO: 745192 - RNA, 64 nt, Homo Sapiens; identical to SEQ ID NO: 534769

SEQ ID NO: 745193 - RNA, 64 nt, Homo Sapiens; identical to SEQ ID NO: 534770

SEQ ID NO: 745194 - RNA, 63 nt, Homo Sapiens; identical to SEQ ID NO: 534771

SEQ ID NO: 745195 - RNA, 64 nt, Homo Sapiens; identical to SEQ ID NO: 534772

SEQ ID NO: 745196 - RNA, 64 nt, Homo Sapiens; identical to SEQ ID NO: 534773

SEQ ID NO: 745197 - RNA, 64 nt, Homo Sapiens; identical to SEQ ID NO: 534774

SEQ ID NO: 745198 - RNA, 64 nt, Homo Sapiens; identical to SEQ ID NO: 534775

SEQ ID NO: 745199 - RNA, 64 nt, Homo Sapiens; identical to SEQ ID NO: 534776

SEQ ID NO: 745200 - RNA, 64 nt, Homo Sapiens; identical to SEQ ID NO: 534777

SEQ ID NO: 745201 - RNA, 64 nt, Homo Sapiens; identical to SEQ ID NO: 534778

SEQ ID NO: 745202 - RNA, 64 nt, Homo Sapiens; identical to SEQ ID NO: 534779

SEQ ID NO: 745203 - RNA, 64 nt, Homo Sapiens; identical to SEQ ID NO: 534780

SEQ ID NO: 745204 - RNA, 64 nt, Homo Sapiens; identical to SEQ ID NO: 534781

SEQ ID NO: 745205 - RNA, 64 nt, Homo Sapiens; identical to SEQ ID NO: 534782

SEQ ID NO: 745206 - RNA, 64 nt, Homo Sapiens; identical to SEQ ID NO: 534783

SEQ ID NO: 745207 - RNA, 64 nt, Homo Sapiens; identical to SEQ ID NO: 534784

SEQ ID NO: 745208 - RNA, 63 nt, Homo Sapiens; identical to SEQ ID NO: 534785

SEQ ID NO: 745209 - RNA, 64 nt, Homo Sapiens; identical to SEQ ID NO: 534786

SEQ ID NO: 745210 - RNA, 64 nt, Homo Sapiens; identical to SEQ ID NO: 534787

SEQ ID NO: 745211 - RNA, 64 nt, Homo Sapiens; identical to SEQ ID NO: 534788

SEQ ID NO: 745212 - RNA, 64 nt, Homo Sapiens; identical to SEQ ID NO: 534789

SEQ ID NO: 745213 - RNA, 64 nt, Homo Sapiens; identical to SEQ ID NO: 534790

SEQ ID NO: 745214 - RNA, 64 nt, Homo Sapiens; identical to SEQ ID NO: 534791

SEQ ID NO: 745215 - RNA, 64 nt, Homo Sapiens; identical to SEQ ID NO: 534792

SEQ ID NO: 745216 - RNA, 64 nt, Homo Sapiens; identical to SEQ ID NO: 534793

SEQ ID NO: 745217 - RNA, 64 nt, Homo Sapiens; identical to SEQ ID NO: 534794

SEQ ID NO: 745218 - RNA, 64 nt, Homo Sapiens; identical to SEQ ID NO: 534795

SEQ ID NO: 745219 - RNA, 64 nt, Homo Sapiens; identical to SEQ ID NO: 534796

SEQ ID NO: 745220 - RNA, 64 nt, Homo Sapiens; identical to SEQ ID NO: 534797

SEQ ID NO: 745221 - RNA, 64 nt, Homo Sapiens; identical to SEQ ID NO: 534798

SEQ ID NO: 745222 - RNA, 64 nt, Homo Sapiens; identical to SEQ ID NO: 534799

SEQ ID NO: 745223 - RNA, 64 nt, Homo Sapiens; identical to SEQ ID NO: 534800

SEQ ID NO: 745224 - RNA, 64 nt, Homo Sapiens; identical to SEQ ID NO: 534801

SEQ ID NO: 745225 - RNA, 64 nt, Homo Sapiens; identical to SEQ ID NO: 534802

SEQ ID NO: 745226 - RNA, 64 nt, Homo Sapiens; identical to SEQ ID NO: 534803

SEQ ID NO: 745227 - RNA, 64 nt, Homo Sapiens; identical to SEQ ID NO: 534804

SEQ ID NO: 745228 - RNA, 64 nt, Homo Sapiens; identical to SEQ ID NO: 534805

SEQ ID NO: 745229 - RNA, 64 nt, Homo Sapiens; identical to SEQ ID NO: 534806

SEQ ID NO: 745230 - RNA, 64 nt, Homo Sapiens; identical to SEQ ID NO: 534807

SEQ ID NO: 745231 - RNA, 64 nt, Homo Sapiens; identical to SEQ ID NO: 534808

SEQ ID NO: 745232 - RNA, 64 nt, Homo Sapiens; identical to SEQ ID NO: 534809

SEQ ID NO: 745233 - RNA, 64 nt, Homo Sapiens; identical to SEQ ID NO: 534810

SEQ ID NO: 745234 - RNA, 64 nt, Homo Sapiens; identical to SEQ ID NO: 534811

SEQ ID NO: 745235 - RNA, 64 nt, Homo Sapiens; identical to SEQ ID NO: 534812

SEQ ID NO: 745236 - RNA, 64 nt, Homo Sapiens; identical to SEQ ID NO: 534813

SEQ ID NO: 745237 - RNA, 64 nt, Homo Sapiens; identical to SEQ ID NO: 534814

SEQ ID NO: 745238 - RNA, 64 nt, Homo Sapiens; identical to SEQ ID NO: 534815

SEQ ID NO: 745239 - RNA, 64 nt, Homo Sapiens; identical to SEQ ID NO: 534816

SEQ ID NO: 745240 - RNA, 64 nt, Homo Sapiens; identical to SEQ ID NO: 534817

SEQ ID NO: 745241 - RNA, 64 nt, Homo Sapiens; identical to SEQ ID NO: 534818

SEQ ID NO: 745242 - RNA, 64 nt, Homo Sapiens; identical to SEQ ID NO: 534819

SEQ ID NO: 745243 - RNA, 64 nt, Homo Sapiens; identical to SEQ ID NO: 534820

SEQ ID NO: 745244 - RNA, 64 nt, Homo Sapiens; identical to SEQ ID NO: 534821

SEQ ID NO: 745245 - RNA, 64 nt, Homo Sapiens; identical to SEQ ID NO: 534822

SEQ ID NO: 745246 - RNA, 64 nt, Homo Sapiens; identical to SEQ ID NO: 534823

SEQ ID NO: 745247 - RNA, 64 nt, Homo Sapiens; identical to SEQ ID NO: 534824

SEQ ID NO: 745248 - RNA, 64 nt, Homo Sapiens; identical to SEQ ID NO: 534825

SEQ ID NO: 745249 - RNA, 64 nt, Homo Sapiens; identical to SEQ ID NO: 534826

SEQ ID NO: 745250 - RNA, 64 nt, Homo Sapiens; identical to SEQ ID NO: 534827

SEQ ID NO: 745251 - RNA, 64 nt, Homo Sapiens; identical to SEQ ID NO: 534828

SEQ ID NO: 745252 - RNA, 64 nt, Homo Sapiens; identical to SEQ ID NO: 534829

SEQ ID NO: 745253 - RNA, 64 nt, Homo Sapiens; identical to SEQ ID NO: 534830

SEQ ID NO: 745254 - RNA, 64 nt, Homo Sapiens; identical to SEQ ID NO: 534831

SEQ ID NO: 745255 - RNA, 64 nt, Homo Sapiens; identical to SEQ ID NO: 534832

SEQ ID NO: 745256 - RNA, 64 nt, Homo Sapiens; identical to SEQ ID NO: 534833

SEQ ID NO: 745257 - RNA, 64 nt, Homo Sapiens; identical to SEQ ID NO: 534834

SEQ ID NO: 745258 - RNA, 64 nt, Homo Sapiens; identical to SEQ ID NO: 534835

SEQ ID NO: 745259 - RNA, 64 nt, Homo Sapiens; identical to SEQ ID NO: 534836

SEQ ID NO: 745260 - RNA, 64 nt, Homo Sapiens; identical to SEQ ID NO: 534837

SEQ ID NO: 745261 - RNA, 64 nt, Homo Sapiens; identical to SEQ ID NO: 534838

SEQ ID NO: 745262 - RNA, 64 nt, Homo Sapiens; identical to SEQ ID NO: 534839

SEQ ID NO: 745263 - RNA, 64 nt, Homo Sapiens; identical to SEQ ID NO: 534840

SEQ ID NO: 745264 - RNA, 64 nt, Homo Sapiens; identical to SEQ ID NO: 534841

SEQ ID NO: 745265 - RNA, 64 nt, Homo Sapiens; identical to SEQ ID NO: 534842

SEQ ID NO: 745266 - RNA, 64 nt, Homo Sapiens; identical to SEQ ID NO: 534843

SEQ ID NO: 745267 - RNA, 64 nt, Homo Sapiens; identical to SEQ ID NO: 534844

SEQ ID NO: 745268 - RNA, 64 nt, Homo Sapiens; identical to SEQ ID NO: 534845

SEQ ID NO: 745269 - RNA, 64 nt, Homo Sapiens; identical to SEQ ID NO: 534846

SEQ ID NO: 745270 - RNA, 64 nt, Homo Sapiens; identical to SEQ ID NO: 534847

SEQ ID NO: 745271 - RNA, 64 nt, Homo Sapiens; identical to SEQ ID NO: 534848

SEQ ID NO: 745272 - RNA, 64 nt, Homo Sapiens; identical to SEQ ID NO: 534849

SEQ ID NO: 745273 - RNA, 64 nt, Homo Sapiens; identical to SEQ ID NO: 534850

SEQ ID NO: 745274 - RNA, 64 nt, Homo Sapiens; identical to SEQ ID NO: 534851

SEQ ID NO: 745275 - RNA, 64 nt, Homo Sapiens; identical to SEQ ID NO: 534852

SEQ ID NO: 745276 - RNA, 64 nt, Homo Sapiens; identical to SEQ ID NO: 534853

SEQ ID NO: 745277 - RNA, 64 nt, Homo Sapiens; identical to SEQ ID NO: 534854

SEQ ID NO: 745278 - RNA, 64 nt, Homo Sapiens; identical to SEQ ID NO: 534855

SEQ ID NO: 745279 - RNA, 64 nt, Homo Sapiens; identical to SEQ ID NO: 279762

SEQ ID NO: 745280 - RNA, 64 nt, Homo Sapiens; identical to SEQ ID NO: 279763

SEQ ID NO: 745281 - RNA, 64 nt, Homo Sapiens; identical to SEQ ID NO: 279764

SEQ ID NO: 745282 - RNA, 64 nt, Homo Sapiens; identical to SEQ ID NO: 279765

SEQ ID NO: 745283 - RNA, 64 nt, Homo Sapiens; identical to SEQ ID NO: 279766

SEQ ID NO: 745284 - RNA, 64 nt, Homo Sapiens; identical to SEQ ID NO: 279767

SEQ ID NO: 745285 - RNA, 64 nt, Homo Sapiens; identical to SEQ ID NO: 279768

SEQ ID NO: 745286 - RNA, 64 nt, Homo Sapiens; identical to SEQ ID NO: 279769

SEQ ID NO: 745287 - RNA, 64 nt, Homo Sapiens; identical to SEQ ID NO: 279770

SEQ ID NO: 745288 - RNA, 64 nt, Homo Sapiens; identical to SEQ ID NO: 279771

SEQ ID NO: 745289 - RNA, 64 nt, Homo Sapiens; identical to SEQ ID NO: 279772

SEQ ID NO: 745290 - RNA, 64 nt, Homo Sapiens; identical to SEQ ID NO: 279773

SEQ ID NO: 745291 - RNA, 64 nt, Homo Sapiens; identical to SEQ ID NO: 279774

SEQ ID NO: 745292 - RNA, 64 nt, Homo Sapiens; identical to SEQ ID NO: 279775

SEQ ID NO: 745293 - RNA, 63 nt, Homo Sapiens
guaauggcaaaaccaauauugguuuuaaaccuggcauuaaaauuaaagcugcagcuuucaaca

SEQ ID NO: 745294 - RNA, 63 nt, Homo Sapiens
gacuuuacacaccuguguaauggaaauccuuuugcauuaaaaggguucugucccuggagacuc

SEQ ID NO: 745295 - RNA, 63 nt, Homo Sapiens
auaccauauacagcucagaaguuucuucuuuaggcauuaaauuuuagcaaagauaucucaucu

SEQ ID NO: 745296 - RNA, 63 nt, Homo Sapiens
acaacuugucuauuaccuguuaguauuauuguugcauuaaaaaugcauauacuuuaauaaaug

SEQ ID NO: 745297 - RNA, 63 nt, Homo Sapiens
uguaaacgguaacaugaaacugugugugugugugcauuaaaguuugcaguagauauccuuuug

SEQ ID NO: 745298 - RNA, 63 nt, Homo Sapiens
ggauucuuagaaguauguccauuuaguuaaguagcauuaaauaccuucauuaaauguauacag

SEQ ID NO: 745299 - RNA, 63 nt, Homo Sapiens
uuguaauugaaauguugcuugguaguuuaacaggcauuaaaauacuucucagcuucucccaua

SEQ ID NO: 745300 - RNA, 63 nt, Homo Sapiens
gaagcaaaucauuugcacucauguagaauaaaagcauuaaaaauuagccuaugguaguaauuu

SEQ ID NO: 745301 - RNA, 63 nt, Homo Sapiens
cuguaguccauguucaugccuggcuuugggucugcauuaaacgaccuacuccccaaaaaugug

SEQ ID NO: 745302 - RNA, 63 nt, Homo Sapiens
gaagggauaaaggaccagcaaaccuuugagauugcauuaaagaaugaaaacuaauagccaaaa

SEQ ID NO: 745303 - RNA, 63 nt, Homo Sapiens
gcaggucuuucagaaucuagauggguugugcaagcauuaaaaugcagcuuuuguagauuuuaa

SEQ ID NO: 745304 - RNA, 63 nt, Homo Sapiens
ggacuugugcauuuauguuuguuuuaagacacugcauuaaagaaagauuugaaaaguauacac

SEQ ID NO: 745305 - RNA, 63 nt, Homo Sapiens
cacaaauaaucaugcuuuuuuccuaugguuacagcauuaaacucuauuuuaaguuguuuuuga

SEQ ID NO: 745306 - RNA, 64 nt, Homo Sapiens; identical to SEQ ID NO: 240065

SEQ ID NO: 745307 - RNA, 64 nt, Homo Sapiens; identical to SEQ ID NO: 240066

SEQ ID NO: 745308 - RNA, 64 nt, Homo Sapiens; identical to SEQ ID NO: 240067

SEQ ID NO: 745309 - RNA, 64 nt, Homo Sapiens; identical to SEQ ID NO: 240068

SEQ ID NO: 745310 - RNA, 64 nt, Homo Sapiens; identical to SEQ ID NO: 240069

SEQ ID NO: 745311 - RNA, 64 nt, Homo Sapiens; identical to SEQ ID NO: 240070

SEQ ID NO: 745312 - RNA, 61 nt, Homo Sapiens; identical to SEQ ID NO: 240071

SEQ ID NO: 745313 - RNA, 64 nt, Homo Sapiens; identical to SEQ ID NO: 240072

SEQ ID NO: 745314 - RNA, 64 nt, Homo Sapiens; identical to SEQ ID NO: 240073

SEQ ID NO: 745315 - RNA, 64 nt, Homo Sapiens; identical to SEQ ID NO: 240074

SEQ ID NO: 745316 - RNA, 64 nt, Homo Sapiens; identical to SEQ ID NO: 240075

SEQ ID NO: 745317 - RNA, 64 nt, Homo Sapiens; identical to SEQ ID NO: 240076

SEQ ID NO: 745318 - RNA, 64 nt, Homo Sapiens; identical to SEQ ID NO: 240077

SEQ ID NO: 745319 - RNA, 64 nt, Homo Sapiens; identical to SEQ ID NO: 240078

SEQ ID NO: 745320 - RNA, 64 nt, Homo Sapiens; identical to SEQ ID NO: 240079

SEQ ID NO: 745321 - RNA, 64 nt, Homo Sapiens; identical to SEQ ID NO: 240080

SEQ ID NO: 745322 - RNA, 64 nt, Homo Sapiens; identical to SEQ ID NO: 240081

SEQ ID NO: 745323 - RNA, 64 nt, Homo Sapiens; identical to SEQ ID NO: 240082

SEQ ID NO: 745324 - RNA, 64 nt, Homo Sapiens; identical to SEQ ID NO: 240083

SEQ ID NO: 745325 - RNA, 64 nt, Homo Sapiens; identical to SEQ ID NO: 240084

SEQ ID NO: 745326 - RNA, 64 nt, Homo Sapiens; identical to SEQ ID NO: 240085

SEQ ID NO: 745327 - RNA, 64 nt, Homo Sapiens; identical to SEQ ID NO: 240086

SEQ ID NO: 745328 - RNA, 64 nt, Homo Sapiens; identical to SEQ ID NO: 658151

SEQ ID NO: 745329 - RNA, 64 nt, Homo Sapiens; identical to SEQ ID NO: 658152

SEQ ID NO: 745330 - RNA, 64 nt, Homo Sapiens; identical to SEQ ID NO: 658153

SEQ ID NO: 745331 - RNA, 64 nt, Homo Sapiens; identical to SEQ ID NO: 658154

SEQ ID NO: 745332 - RNA, 64 nt, Homo Sapiens; identical to SEQ ID NO: 658155

SEQ ID NO: 745333 - RNA, 64 nt, Homo Sapiens; identical to SEQ ID NO: 658156

SEQ ID NO: 745334 - RNA, 64 nt, Homo Sapiens; identical to SEQ ID NO: 658157

SEQ ID NO: 745335 - RNA, 64 nt, Homo Sapiens; identical to SEQ ID NO: 658158

SEQ ID NO: 745336 - RNA, 64 nt, Homo Sapiens; identical to SEQ ID NO: 658159

SEQ ID NO: 745337 - RNA, 64 nt, Homo Sapiens; identical to SEQ ID NO: 658160

SEQ ID NO: 745338 - RNA, 64 nt, Homo Sapiens; identical to SEQ ID NO: 658161

SEQ ID NO: 745339 - RNA, 64 nt, Homo Sapiens; identical to SEQ ID NO: 658162

SEQ ID NO: 745340 - RNA, 64 nt, Homo Sapiens; identical to SEQ ID NO: 91216

SEQ ID NO: 745341 - RNA, 64 nt, Homo Sapiens; identical to SEQ ID NO: 91217

SEQ ID NO: 745342 - RNA, 64 nt, Homo Sapiens; identical to SEQ ID NO: 91218

SEQ ID NO: 745343 - RNA, 64 nt, Homo Sapiens; identical to SEQ ID NO: 91219

SEQ ID NO: 745344 - RNA, 64 nt, Homo Sapiens; identical to SEQ ID NO: 91220

SEQ ID NO: 745345 - RNA, 64 nt, Homo Sapiens; identical to SEQ ID NO: 91221

SEQ ID NO: 745346 - RNA, 64 nt, Homo Sapiens; identical to SEQ ID NO: 91222

SEQ ID NO: 745347 - RNA, 64 nt, Homo Sapiens; identical to SEQ ID NO: 91223

SEQ ID NO: 745348 - RNA, 64 nt, Homo Sapiens; identical to SEQ ID NO: 91224

SEQ ID NO: 745349 - RNA, 55 nt, Homo Sapiens; identical to SEQ ID NO: 91225

SEQ ID NO: 745350 - RNA, 64 nt, Homo Sapiens; identical to SEQ ID NO: 91226

SEQ ID NO: 745351 - RNA, 64 nt, Homo Sapiens; identical to SEQ ID NO: 91227

SEQ ID NO: 745352 - RNA, 64 nt, Homo Sapiens; identical to SEQ ID NO: 91228

SEQ ID NO: 745353 - RNA, 64 nt, Homo Sapiens; identical to SEQ ID NO: 91229

SEQ ID NO: 745354 - RNA, 64 nt, Homo Sapiens; identical to SEQ ID NO: 91230

SEQ ID NO: 745355 - RNA, 64 nt, Homo Sapiens; identical to SEQ ID NO: 91231

SEQ ID NO: 745356 - RNA, 64 nt, Homo Sapiens; identical to SEQ ID NO: 91232

SEQ ID NO: 745357 - RNA, 64 nt, Homo Sapiens; identical to SEQ ID NO: 91233

SEQ ID NO: 745358 - RNA, 64 nt, Homo Sapiens; identical to SEQ ID NO: 91234

SEQ ID NO: 745359 - RNA, 64 nt, Homo Sapiens; identical to SEQ ID NO: 91235

SEQ ID NO: 745360 - RNA, 64 nt, Homo Sapiens; identical to SEQ ID NO: 91236

SEQ ID NO: 745361 - RNA, 64 nt, Homo Sapiens; identical to SEQ ID NO: 91237

SEQ ID NO: 745362 - RNA, 64 nt, Homo Sapiens; identical to SEQ ID NO: 91238

SEQ ID NO: 745363 - RNA, 55 nt, Homo Sapiens; identical to SEQ ID NO: 91239

SEQ ID NO: 745364 - RNA, 64 nt, Homo Sapiens; identical to SEQ ID NO: 91240

SEQ ID NO: 745365 - RNA, 64 nt, Homo Sapiens; identical to SEQ ID NO: 91241

SEQ ID NO: 745366 - RNA, 64 nt, Homo Sapiens; identical to SEQ ID NO: 91242

SEQ ID NO: 745367 - RNA, 64 nt, Homo Sapiens; identical to SEQ ID NO: 91243

SEQ ID NO: 745368 - RNA, 64 nt, Homo Sapiens; identical to SEQ ID NO: 91244

SEQ ID NO: 745369 - RNA, 64 nt, Homo Sapiens; identical to SEQ ID NO: 91245

SEQ ID NO: 745370 - RNA, 64 nt, Homo Sapiens; identical to SEQ ID NO: 91246

SEQ ID NO: 745371 - RNA, 64 nt, Homo Sapiens; identical to SEQ ID NO: 91247

SEQ ID NO: 745372 - RNA, 64 nt, Homo Sapiens; identical to SEQ ID NO: 91248

SEQ ID NO: 745373 - RNA, 64 nt, Homo Sapiens; identical to SEQ ID NO: 91249

SEQ ID NO: 745374 - RNA, 64 nt, Homo Sapiens; identical to SEQ ID NO: 91250

SEQ ID NO: 745375 - RNA, 64 nt, Homo Sapiens; identical to SEQ ID NO: 91251

SEQ ID NO: 745376 - RNA, 64 nt, Homo Sapiens; identical to SEQ ID NO: 91252

SEQ ID NO: 745377 - RNA, 64 nt, Homo Sapiens; identical to SEQ ID NO: 91253

SEQ ID NO: 745378 - RNA, 64 nt, Homo Sapiens; identical to SEQ ID NO: 91254

SEQ ID NO: 745379 - RNA, 64 nt, Homo Sapiens; identical to SEQ ID NO: 91255

SEQ ID NO: 745380 - RNA, 64 nt, Homo Sapiens; identical to SEQ ID NO: 91256

SEQ ID NO: 745381 - RNA, 64 nt, Homo Sapiens; identical to SEQ ID NO: 91257

SEQ ID NO: 745382 - RNA, 64 nt, Homo Sapiens; identical to SEQ ID NO: 91258

SEQ ID NO: 745383 - RNA, 64 nt, Homo Sapiens; identical to SEQ ID NO: 91259

SEQ ID NO: 745384 - RNA, 64 nt, Homo Sapiens; identical to SEQ ID NO: 91260

SEQ ID NO: 745385 - RNA, 64 nt, Homo Sapiens; identical to SEQ ID NO: 91261

SEQ ID NO: 745386 - RNA, 64 nt, Homo Sapiens
cucggcuccugcacggcaccggcugcucccugaggccaagaagcuccugccaccuccuccgcag

SEQ ID NO: 745387 - RNA, 64 nt, Homo Sapiens
uggaguuccugaagcagaaguggugcauggcgaggccaagaagaagagccggagagcgugcugc

SEQ ID NO: 745388 - RNA, 64 nt, Homo Sapiens
uucuucucccucucaaccaucccacuaaguuauagccaagaagggaaggagacacggggauuug

SEQ ID NO: 745389 - RNA, 64 nt, Homo Sapiens
uuuugggucucacucaugcuuacugaaacauugugccaagaaacucugugggauuugugucccu

SEQ ID NO: 745390 - RNA, 64 nt, Homo Sapiens
aggcaaagcgccagcagcccugcacuccacgcuggccaagaaggccuuccacgcagaaugacaa

SEQ ID NO: 745391 - RNA, 64 nt, Homo Sapiens
gcaaacggugucaugguuuggaauguucauuaucgccaagaaccugguuagaggcauaaagacc

SEQ ID NO: 745392 - RNA, 64 nt, Homo Sapiens
caggaacggccugaaguucgagaccaguguucgugccaagaaugaucaaaggucagaagaagaa

SEQ ID NO: 745393 - RNA, 64 nt, Homo Sapiens
gaugacagugaugaugaugaagaaagcaaagaaggccaagaaaguucuaguagugcugcaaaca

SEQ ID NO: 745394 - RNA, 64 nt, Homo Sapiens
cacugugaguacugacauuuagaguuguuuaaaggccaagaacuggaaacagccuuuucccuau

SEQ ID NO: 745395 - RNA, 64 nt, Homo Sapiens
ugugcaggauagaguguguuucauuuguucuggugccaagaaugagcgcuguacuaugguaguu

SEQ ID NO: 745396 - RNA, 64 nt, Homo Sapiens
uagaguccucagaagagaacguuaccgaagaggggccaagaaauccauacacauuuggcucagg

SEQ ID NO: 745397 - RNA, 64 nt, Homo Sapiens
guaacaagccaaaugaacagaaccugcaacuggagccaagaagaacaacucauggaagguaaag

SEQ ID NO: 745398 - RNA, 64 nt, Homo Sapiens
aaauuuuaaaaccaaaccucggagaggagagccagccaagaagaguggauaaaggcaacuugca

SEQ ID NO: 745399 - RNA, 64 nt, Homo Sapiens
gcgagugauugcuuuccuucaccuuugaggaauugccaagaaugaaagauguuuggucucaaaa

SEQ ID NO: 745400 - RNA, 64 nt, Homo Sapiens
uuuauuaugggaauuggcucucgcaauuauggaggccaagaagucccacagucuugcauuugca

SEQ ID NO: 745401 - RNA, 64 nt, Homo Sapiens
uuuggucacaguucugaaggaaguuagggaggaagccaagaaaauaucuauugugauuaaaggu

SEQ ID NO: 745402 - RNA, 64 nt, Homo Sapiens
uugcugaaugaaacaaucaaaaucccaaaacagugccaagaauuucaucaucaaaauucaguga

SEQ ID NO: 745403 - RNA, 64 nt, Homo Sapiens
cuucaaugccagcuacugccaacagccgcuugaagccaagaacuaaacaagaccaaaaagacuc

SEQ ID NO: 745404 - RNA, 64 nt, Homo Sapiens; identical to SEQ ID NO: 132800

SEQ ID NO: 745405 - RNA, 64 nt, Homo Sapiens; identical to SEQ ID NO: 132801

SEQ ID NO: 745406 - RNA, 64 nt, Homo Sapiens; identical to SEQ ID NO: 132802

SEQ ID NO: 745407 - RNA, 64 nt, Homo Sapiens; identical to SEQ ID NO: 132803

SEQ ID NO: 745408 - RNA, 64 nt, Homo Sapiens; identical to SEQ ID NO: 132804

SEQ ID NO: 745409 - RNA, 64 nt, Homo Sapiens; identical to SEQ ID NO: 132805

SEQ ID NO: 745410 - RNA, 64 nt, Homo Sapiens; identical to SEQ ID NO: 132806

SEQ ID NO: 745411 - RNA, 64 nt, Homo Sapiens; identical to SEQ ID NO: 132807

SEQ ID NO: 745412 - RNA, 64 nt, Homo Sapiens; identical to SEQ ID NO: 132808

SEQ ID NO: 745413 - RNA, 64 nt, Homo Sapiens; identical to SEQ ID NO: 132809

SEQ ID NO: 745414 - RNA, 64 nt, Homo Sapiens; identical to SEQ ID NO: 132810

SEQ ID NO: 745415 - RNA, 64 nt, Homo Sapiens; identical to SEQ ID NO: 132811

SEQ ID NO: 745416 - RNA, 64 nt, Homo Sapiens; identical to SEQ ID NO: 132812

SEQ ID NO: 745417 - RNA, 64 nt, Homo Sapiens; identical to SEQ ID NO: 132813

SEQ ID NO: 745418 - RNA, 64 nt, Homo Sapiens; identical to SEQ ID NO: 132814

SEQ ID NO: 745419 - RNA, 64 nt, Homo Sapiens; identical to SEQ ID NO: 132815

SEQ ID NO: 745420 - RNA, 64 nt, Homo Sapiens; identical to SEQ ID NO: 132816

SEQ ID NO: 745421 - RNA, 64 nt, Homo Sapiens; identical to SEQ ID NO: 132817

SEQ ID NO: 745422 - RNA, 64 nt, Homo Sapiens; identical to SEQ ID NO: 132818

SEQ ID NO: 745423 - RNA, 64 nt, Homo Sapiens; identical to SEQ ID NO: 132819

SEQ ID NO: 745424 - RNA, 64 nt, Homo Sapiens; identical to SEQ ID NO: 132820

SEQ ID NO: 745425 - RNA, 64 nt, Homo Sapiens; identical to SEQ ID NO: 132821

SEQ ID NO: 745426 - RNA, 64 nt, Homo Sapiens; identical to SEQ ID NO: 132822

SEQ ID NO: 745427 - RNA, 64 nt, Homo Sapiens; identical to SEQ ID NO: 132823

SEQ ID NO: 745428 - RNA, 64 nt, Homo Sapiens; identical to SEQ ID NO: 132824

SEQ ID NO: 745429 - RNA, 64 nt, Homo Sapiens; identical to SEQ ID NO: 132825

SEQ ID NO: 745430 - RNA, 64 nt, Homo Sapiens; identical to SEQ ID NO: 132826

SEQ ID NO: 745431 - RNA, 64 nt, Homo Sapiens; identical to SEQ ID NO: 132827

SEQ ID NO: 745432 - RNA, 64 nt, Homo Sapiens; identical to SEQ ID NO: 132828

SEQ ID NO: 745433 - RNA, 64 nt, Homo Sapiens; identical to SEQ ID NO: 132829

SEQ ID NO: 745434 - RNA, 64 nt, Homo Sapiens; identical to SEQ ID NO: 132830

SEQ ID NO: 745435 - RNA, 64 nt, Homo Sapiens; identical to SEQ ID NO: 132831

SEQ ID NO: 745436 - RNA, 64 nt, Homo Sapiens; identical to SEQ ID NO: 132832

SEQ ID NO: 745437 - RNA, 64 nt, Homo Sapiens; identical to SEQ ID NO: 132833

SEQ ID NO: 745438 - RNA, 64 nt, Homo Sapiens; identical to SEQ ID NO: 132834

SEQ ID NO: 745439 - RNA, 64 nt, Homo Sapiens; identical to SEQ ID NO: 132835

SEQ ID NO: 745440 - RNA, 64 nt, Homo Sapiens; identical to SEQ ID NO: 132836

SEQ ID NO: 745441 - RNA, 64 nt, Homo Sapiens; identical to SEQ ID NO: 132837

SEQ ID NO: 745442 - RNA, 64 nt, Homo Sapiens; identical to SEQ ID NO: 132838

SEQ ID NO: 745443 - RNA, 64 nt, Homo Sapiens; identical to SEQ ID NO: 132839

SEQ ID NO: 745444 - RNA, 64 nt, Homo Sapiens; identical to SEQ ID NO: 132840

SEQ ID NO: 745445 - RNA, 64 nt, Homo Sapiens; identical to SEQ ID NO: 132841

SEQ ID NO: 745446 - RNA, 64 nt, Homo Sapiens; identical to SEQ ID NO: 132842

SEQ ID NO: 745447 - RNA, 64 nt, Homo Sapiens; identical to SEQ ID NO: 132843

SEQ ID NO: 745448 - RNA, 64 nt, Homo Sapiens; identical to SEQ ID NO: 132844

SEQ ID NO: 745449 - RNA, 58 nt, Homo Sapiens; identical to SEQ ID NO: 132845

SEQ ID NO: 745450 - RNA, 64 nt, Homo Sapiens; identical to SEQ ID NO: 132846

SEQ ID NO: 745451 - RNA, 64 nt, Homo Sapiens; identical to SEQ ID NO: 132847

SEQ ID NO: 745452 - RNA, 64 nt, Homo Sapiens; identical to SEQ ID NO: 132848

SEQ ID NO: 745453 - RNA, 64 nt, Homo Sapiens; identical to SEQ ID NO: 132849

SEQ ID NO: 745454 - RNA, 64 nt, Homo Sapiens; identical to SEQ ID NO: 132850

SEQ ID NO: 745455 - RNA, 64 nt, Homo Sapiens; identical to SEQ ID NO: 132851

SEQ ID NO: 745456 - RNA, 64 nt, Homo Sapiens; identical to SEQ ID NO: 132852

SEQ ID NO: 745457 - RNA, 64 nt, Homo Sapiens; identical to SEQ ID NO: 132853

SEQ ID NO: 745458 - RNA, 64 nt, Homo Sapiens; identical to SEQ ID NO: 132854

SEQ ID NO: 745459 - RNA, 64 nt, Homo Sapiens; identical to SEQ ID NO: 132855

SEQ ID NO: 745460 - RNA, 64 nt, Homo Sapiens; identical to SEQ ID NO: 132856

SEQ ID NO: 745461 - RNA, 64 nt, Homo Sapiens; identical to SEQ ID NO: 132857

SEQ ID NO: 745462 - RNA, 64 nt, Homo Sapiens; identical to SEQ ID NO: 132858

SEQ ID NO: 745463 - RNA, 64 nt, Homo Sapiens; identical to SEQ ID NO: 132859

SEQ ID NO: 745464 - RNA, 64 nt, Homo Sapiens; identical to SEQ ID NO: 132860

SEQ ID NO: 745465 - RNA, 64 nt, Homo Sapiens; identical to SEQ ID NO: 132861

SEQ ID NO: 745466 - RNA, 64 nt, Homo Sapiens; identical to SEQ ID NO: 132862

SEQ ID NO: 745467 - RNA, 64 nt, Homo Sapiens; identical to SEQ ID NO: 132863

SEQ ID NO: 745468 - RNA, 64 nt, Homo Sapiens; identical to SEQ ID NO: 132864

SEQ ID NO: 745469 - RNA, 64 nt, Homo Sapiens; identical to SEQ ID NO: 132865

SEQ ID NO: 745470 - RNA, 64 nt, Homo Sapiens; identical to SEQ ID NO: 132866

SEQ ID NO: 745471 - RNA, 64 nt, Homo Sapiens; identical to SEQ ID NO: 132867

SEQ ID NO: 745472 - RNA, 64 nt, Homo Sapiens; identical to SEQ ID NO: 132868

SEQ ID NO: 745473 - RNA, 64 nt, Homo Sapiens; identical to SEQ ID NO: 132869

SEQ ID NO: 745474 - RNA, 64 nt, Homo Sapiens; identical to SEQ ID NO: 132870

SEQ ID NO: 745475 - RNA, 64 nt, Homo Sapiens; identical to SEQ ID NO: 132871

SEQ ID NO: 745476 - RNA, 64 nt, Homo Sapiens; identical to SEQ ID NO: 132872

SEQ ID NO: 745477 - RNA, 64 nt, Homo Sapiens; identical to SEQ ID NO: 132873

SEQ ID NO: 745478 - RNA, 64 nt, Homo Sapiens; identical to SEQ ID NO: 132874

SEQ ID NO: 745479 - RNA, 64 nt, Homo Sapiens; identical to SEQ ID NO: 132875

SEQ ID NO: 745480 - RNA, 64 nt, Homo Sapiens; identical to SEQ ID NO: 132876

SEQ ID NO: 745481 - RNA, 64 nt, Homo Sapiens; identical to SEQ ID NO: 132877

SEQ ID NO: 745482 - RNA, 64 nt, Homo Sapiens; identical to SEQ ID NO: 132878

SEQ ID NO: 745483 - RNA, 64 nt, Homo Sapiens; identical to SEQ ID NO: 132879

SEQ ID NO: 745484 - RNA, 64 nt, Homo Sapiens; identical to SEQ ID NO: 132880

SEQ ID NO: 745485 - RNA, 64 nt, Homo Sapiens; identical to SEQ ID NO: 132881

SEQ ID NO: 745486 - RNA, 64 nt, Homo Sapiens; identical to SEQ ID NO: 132882

SEQ ID NO: 745487 - RNA, 64 nt, Homo Sapiens; identical to SEQ ID NO: 132883

SEQ ID NO: 745488 - RNA, 64 nt, Homo Sapiens; identical to SEQ ID NO: 132884

SEQ ID NO: 745489 - RNA, 64 nt, Homo Sapiens; identical to SEQ ID NO: 132885

SEQ ID NO: 745490 - RNA, 64 nt, Homo Sapiens; identical to SEQ ID NO: 132886

SEQ ID NO: 745491 - RNA, 64 nt, Homo Sapiens; identical to SEQ ID NO: 132887

SEQ ID NO: 745492 - RNA, 64 nt, Homo Sapiens; identical to SEQ ID NO: 132888

SEQ ID NO: 745493 - RNA, 64 nt, Homo Sapiens; identical to SEQ ID NO: 132889

SEQ ID NO: 745494 - RNA, 64 nt, Homo Sapiens; identical to SEQ ID NO: 188672

SEQ ID NO: 745495 - RNA, 64 nt, Homo Sapiens; identical to SEQ ID NO: 188673

SEQ ID NO: 745496 - RNA, 64 nt, Homo Sapiens; identical to SEQ ID NO: 188674

SEQ ID NO: 745497 - RNA, 64 nt, Homo Sapiens; identical to SEQ ID NO: 188675

SEQ ID NO: 745498 - RNA, 64 nt, Homo Sapiens; identical to SEQ ID NO: 188676

SEQ ID NO: 745499 - RNA, 64 nt, Homo Sapiens; identical to SEQ ID NO: 188677

SEQ ID NO: 745500 - RNA, 64 nt, Homo Sapiens; identical to SEQ ID NO: 188678

SEQ ID NO: 745501 - RNA, 64 nt, Homo Sapiens; identical to SEQ ID NO: 188679

SEQ ID NO: 745502 - RNA, 64 nt, Homo Sapiens; identical to SEQ ID NO: 667586

SEQ ID NO: 745503 - RNA, 64 nt, Homo Sapiens; identical to SEQ ID NO: 667587

SEQ ID NO: 745504 - RNA, 64 nt, Homo Sapiens; identical to SEQ ID NO: 217813

SEQ ID NO: 745505 - RNA, 64 nt, Homo Sapiens; identical to SEQ ID NO: 217814

SEQ ID NO: 745506 - RNA, 64 nt, Homo Sapiens; identical to SEQ ID NO: 217815

SEQ ID NO: 745507 - RNA, 64 nt, Homo Sapiens; identical to SEQ ID NO: 217816

SEQ ID NO: 745508 - RNA, 64 nt, Homo Sapiens; identical to SEQ ID NO: 217817

SEQ ID NO: 745509 - RNA, 64 nt, Homo Sapiens; identical to SEQ ID NO: 217818

SEQ ID NO: 745510 - RNA, 64 nt, Homo Sapiens; identical to SEQ ID NO: 217819

SEQ ID NO: 745511 - RNA, 64 nt, Homo Sapiens; identical to SEQ ID NO: 217820

SEQ ID NO: 745512 - RNA, 64 nt, Homo Sapiens; identical to SEQ ID NO: 217821

SEQ ID NO: 745513 - RNA, 64 nt, Homo Sapiens; identical to SEQ ID NO: 217822

SEQ ID NO: 745514 - RNA, 64 nt, Homo Sapiens; identical to SEQ ID NO: 217823

SEQ ID NO: 745515 - RNA, 64 nt, Homo Sapiens; identical to SEQ ID NO: 217824

SEQ ID NO: 745516 - RNA, 64 nt, Homo Sapiens; identical to SEQ ID NO: 217825

SEQ ID NO: 745517 - RNA, 64 nt, Homo Sapiens; identical to SEQ ID NO: 217826

SEQ ID NO: 745518 - RNA, 64 nt, Homo Sapiens; identical to SEQ ID NO: 217827

SEQ ID NO: 745519 - RNA, 64 nt, Homo Sapiens; identical to SEQ ID NO: 217828

SEQ ID NO: 745520 - RNA, 64 nt, Homo Sapiens; identical to SEQ ID NO: 217829

SEQ ID NO: 745521 - RNA, 64 nt, Homo Sapiens; identical to SEQ ID NO: 217830

SEQ ID NO: 745522 - RNA, 64 nt, Homo Sapiens; identical to SEQ ID NO: 217831

SEQ ID NO: 745523 - RNA, 64 nt, Homo Sapiens; identical to SEQ ID NO: 217832

SEQ ID NO: 745524 - RNA, 64 nt, Homo Sapiens; identical to SEQ ID NO: 217833

SEQ ID NO: 745525 - RNA, 64 nt, Homo Sapiens; identical to SEQ ID NO: 217834

SEQ ID NO: 745526 - RNA, 64 nt, Homo Sapiens; identical to SEQ ID NO: 217835

SEQ ID NO: 745527 - RNA, 64 nt, Homo Sapiens; identical to SEQ ID NO: 217836

SEQ ID NO: 745528 - RNA, 64 nt, Homo Sapiens; identical to SEQ ID NO: 217837

SEQ ID NO: 745529 - RNA, 64 nt, Homo Sapiens; identical to SEQ ID NO: 217838

SEQ ID NO: 745530 - RNA, 64 nt, Homo Sapiens; identical to SEQ ID NO: 217839

SEQ ID NO: 745531 - RNA, 64 nt, Homo Sapiens; identical to SEQ ID NO: 217840

SEQ ID NO: 745532 - RNA, 64 nt, Homo Sapiens; identical to SEQ ID NO: 217841

SEQ ID NO: 745533 - RNA, 63 nt, Homo Sapiens; identical to SEQ ID NO: 217842

SEQ ID NO: 745534 - RNA, 64 nt, Homo Sapiens; identical to SEQ ID NO: 217843

SEQ ID NO: 745535 - RNA, 64 nt, Homo Sapiens; identical to SEQ ID NO: 217844

SEQ ID NO: 745536 - RNA, 64 nt, Homo Sapiens; identical to SEQ ID NO: 217845

SEQ ID NO: 745537 - RNA, 64 nt, Homo Sapiens; identical to SEQ ID NO: 217846

SEQ ID NO: 745538 - RNA, 64 nt, Homo Sapiens; identical to SEQ ID NO: 217847

SEQ ID NO: 745539 - RNA, 64 nt, Homo Sapiens; identical to SEQ ID NO: 217848

SEQ ID NO: 745540 - RNA, 64 nt, Homo Sapiens; identical to SEQ ID NO: 217849

SEQ ID NO: 745541 - RNA, 64 nt, Homo Sapiens; identical to SEQ ID NO: 217850

SEQ ID NO: 745542 - RNA, 64 nt, Homo Sapiens; identical to SEQ ID NO: 217851

SEQ ID NO: 745543 - RNA, 64 nt, Homo Sapiens; identical to SEQ ID NO: 217852

SEQ ID NO: 745544 - RNA, 64 nt, Homo Sapiens; identical to SEQ ID NO: 217853

SEQ ID NO: 745545 - RNA, 64 nt, Homo Sapiens; identical to SEQ ID NO: 217854

SEQ ID NO: 745546 - RNA, 64 nt, Homo Sapiens; identical to SEQ ID NO: 217855

SEQ ID NO: 745547 - RNA, 64 nt, Homo Sapiens; identical to SEQ ID NO: 217856

SEQ ID NO: 745548 - RNA, 64 nt, Homo Sapiens; identical to SEQ ID NO: 217857

SEQ ID NO: 745549 - RNA, 64 nt, Homo Sapiens; identical to SEQ ID NO: 217858

SEQ ID NO: 745550 - RNA, 64 nt, Homo Sapiens; identical to SEQ ID NO: 217859

SEQ ID NO: 745551 - RNA, 64 nt, Homo Sapiens; identical to SEQ ID NO: 217860

SEQ ID NO: 745552 - RNA, 64 nt, Homo Sapiens; identical to SEQ ID NO: 217861

SEQ ID NO: 745553 - RNA, 64 nt, Homo Sapiens; identical to SEQ ID NO: 217862

SEQ ID NO: 745554 - RNA, 64 nt, Homo Sapiens; identical to SEQ ID NO: 217863

SEQ ID NO: 745555 - RNA, 64 nt, Homo Sapiens; identical to SEQ ID NO: 217864

SEQ ID NO: 745556 - RNA, 64 nt, Homo Sapiens; identical to SEQ ID NO: 217865

SEQ ID NO: 745557 - RNA, 64 nt, Homo Sapiens
gcuuacuguaaagaguccagucccuuuaauuuauuacauucauucuuuuugcucuuuagaaauu

SEQ ID NO: 745558 - RNA, 64 nt, Homo Sapiens
ugguuuucuccacugugaaccuuuuccacaguuuuacauucaugcucuggcuucuagcugaaaa

SEQ ID NO: 745559 - RNA, 64 nt, Homo Sapiens
guccaacauuucauagguaguaggggccacauauuacauucaguugcuauagguccagcaacug

SEQ ID NO: 745560 - RNA, 64 nt, Homo Sapiens
auaaccuuuauuauugcuauaucuuuguggauaauacauucagguggugcugggugauuuauua

SEQ ID NO: 745561 - RNA, 64 nt, Homo Sapiens
guuuaugcaaggaaggaaagcaaaaagggauccguacauucaauugagaagugucuaaaaacac

SEQ ID NO: 745562 - RNA, 64 nt, Homo Sapiens
ucauuccaacuucccaguucaagaaaaguagguuuacauucaucuccacccuauauguaguaua

SEQ ID NO: 745563 - RNA, 64 nt, Homo Sapiens
auguguuuauuuaacacacacacacaccuaauacuacauucaaaguauuuuauaaauacuaacc

SEQ ID NO: 745564 - RNA, 64 nt, Homo Sapiens
auguauauguuuugggguauaugugauaauuugauacauucagauaguguguaaagaucaaaua

SEQ ID NO: 745565 - RNA, 64 nt, Homo Sapiens
uaauuuguuuaauaagagauggauauauuaaaauuacauucaucaaggcaugauuuuuguuuca

SEQ ID NO: 745566 - RNA, 64 nt, Homo Sapiens
uaaauuaucuaccauugccuauuuacaggauaaguacauucaggacaauuuauuguaccauucu

SEQ ID NO: 745567 - RNA, 64 nt, Homo Sapiens
uugcacucuugugcuaguaugucuauagugugaauacauucauaaauuucuugaucaaagcuag

SEQ ID NO: 745568 - RNA, 64 nt, Homo Sapiens
uucauaaauuucuugaucaaagcuaggucaaaguuacauucauuuuaauuuugguacauaucca

SEQ ID NO: 745569 - RNA, 64 nt, Homo Sapiens
uucucacauuuuaugcuuucuucuuccugaauaauacauucaguuuaaaugaaggcacucagua

SEQ ID NO: 745570 - RNA, 64 nt, Homo Sapiens
uuuaguuaaaugaaggcacuugcaaauugacuuuuacauucaacaccagaggauuauaaagaag

SEQ ID NO: 745571 - RNA, 64 nt, Homo Sapiens
ucuaaagucuauguaauggucaccgcgcccagccuacauucacucugggauuacaggcgugagc

SEQ ID NO: 745572 - RNA, 64 nt, Homo Sapiens
uuuuuuuguuuucuuuuuugaucauguuugaaucuacauucacuuuuagaacuccaguuuucaa

SEQ ID NO: 745573 - RNA, 64 nt, Homo Sapiens
aacaaacaaaggaggggggacuuugccucacuuuuacauucacacacagccacacggaaagaga

SEQ ID NO: 745574 - RNA, 64 nt, Homo Sapiens
ucuuuagucauggauggucuagagggaaaacgcuuacauucaauaaaacuucccuccauggcua

SEQ ID NO: 745575 - RNA, 64 nt, Homo Sapiens
ccagucaugaugaggugauguaugaauacaugcauacauucaaagcacuguuuucaaaguuaau

SEQ ID NO: 745576 - RNA, 64 nt, Homo Sapiens
uuaucuuuguuguauuggcauaaucagugacuuguacauucagcaauagcauuugagcaaguuu

SEQ ID NO: 745577 - RNA, 64 nt, Homo Sapiens; identical to SEQ ID NO: 323443

SEQ ID NO: 745578 - RNA, 64 nt, Homo Sapiens; identical to SEQ ID NO: 323444

SEQ ID NO: 745579 - RNA, 64 nt, Homo Sapiens; identical to SEQ ID NO: 323445

SEQ ID NO: 745580 - RNA, 64 nt, Homo Sapiens; identical to SEQ ID NO: 323446

SEQ ID NO: 745581 - RNA, 64 nt, Homo Sapiens; identical to SEQ ID NO: 323447

SEQ ID NO: 745582 - RNA, 64 nt, Homo Sapiens; identical to SEQ ID NO: 323448

SEQ ID NO: 745583 - RNA, 64 nt, Homo Sapiens; identical to SEQ ID NO: 323449

SEQ ID NO: 745584 - RNA, 64 nt, Homo Sapiens; identical to SEQ ID NO: 323450

SEQ ID NO: 745585 - RNA, 64 nt, Homo Sapiens; identical to SEQ ID NO: 323451

SEQ ID NO: 745586 - RNA, 64 nt, Homo Sapiens; identical to SEQ ID NO: 323452

SEQ ID NO: 745587 - RNA, 64 nt, Homo Sapiens; identical to SEQ ID NO: 104209

SEQ ID NO: 745588 - RNA, 64 nt, Homo Sapiens; identical to SEQ ID NO: 104210

SEQ ID NO: 745589 - RNA, 64 nt, Homo Sapiens; identical to SEQ ID NO: 104211

SEQ ID NO: 745590 - RNA, 64 nt, Homo Sapiens; identical to SEQ ID NO: 104212

SEQ ID NO: 745591 - RNA, 64 nt, Homo Sapiens
ugaggggaaaaaaaaaugaccuuuucuugaaauguaacuugaaaacaaaauaaaauguggaaca

SEQ ID NO: 745592 - RNA, 64 nt, Homo Sapiens
cuuugggaaauggugccacucaaaagcaacuuccuaacuugaggaauaacuccuuuguaguuua

SEQ ID NO: 745593 - RNA, 64 nt, Homo Sapiens
aaauagaacuagaucuguaaaguuuccccaucuguaacuugagaccucccccugcuggggccuc

SEQ ID NO: 745594 - RNA, 64 nt, Homo Sapiens
ccuuucuccagacuggccauguauuuaaagucauuaacuugaucgucauuuguucagauuauuu

SEQ ID NO: 745595 - RNA, 64 nt, Homo Sapiens
agaagaagaaacccugagccauuaaugugucucguaacuugaggaaguucaugaauucucuggg

SEQ ID NO: 745596 - RNA, 64 nt, Homo Sapiens
uuccugccagaaaguugguucuugcaaaauagauuaacuugaugacuauguguauauuggauac

SEQ ID NO: 745597 - RNA, 64 nt, Homo Sapiens
guagaugguuugagccugagggcugagcugccuguaacuugagaaggaaagcaauaaaugaaug

SEQ ID NO: 745598 - RNA, 64 nt, Homo Sapiens
uuuaaggcuaaaacuuaacaaagugugagcaaacuaacuugacucuaauauuuuaugugagaga

SEQ ID NO: 745599 - RNA, 64 nt, Homo Sapiens
uuagaaaaugagcauuuuuuuaaaauuauagcacuaacuugauuuccacauauugaaaaaacug

SEQ ID NO: 745600 - RNA, 64 nt, Homo Sapiens
gcagcacagaggugagggaucagccacacagugguaacuugaagaacaacucgacaugccuaug

SEQ ID NO: 745601 - RNA, 64 nt, Homo Sapiens
accuuguaauuuuucucuuauuaucuaaaaaucguaacuugaauugaugucucaaauguagaga

SEQ ID NO: 745602 - RNA, 64 nt, Homo Sapiens
ggauagcaaaauauacuguguuucugguauuuaauaacuugaagcuuauggaaaaccuuuugug

SEQ ID NO: 745603 - RNA, 64 nt, Homo Sapiens
cauuuauaugaaugaaacucccuuuuaaaccuguuaacuugaaggagaacagaaaugguauuac

SEQ ID NO: 745604 - RNA, 64 nt, Homo Sapiens
acaucauuuaaaaaacccuugcuguaaaguaggauaacuugaauauucauucuaauaauuagac

SEQ ID NO: 745605 - RNA, 64 nt, Homo Sapiens
uuguuuacugaaauuuguuauacuucaaaagccauaacuugaaaaauacugguggcgucgaugg

SEQ ID NO: 745606 - RNA, 64 nt, Homo Sapiens
acauaugaggacaagguauacacccaguucugaauaacuugaagaacaggcuuggcaaagaagu

SEQ ID NO: 745607 - RNA, 64 nt, Homo Sapiens
uuaagggggaaacuacaugaagucaccguuacaguaacuugauguguauauuaauaaaaguaau

SEQ ID NO: 745608 - RNA, 64 nt, Homo Sapiens
cccuuguugacuuuucuacacugaacauuuuuuuuaacuugauuuaauaaaaauguuaauuuug

SEQ ID NO: 745609 - RNA, 64 nt, Homo Sapiens
uacacuaaaccacaugacagauaugauacaugcauaacuugagcaaagaacuugaaccuauguu

SEQ ID NO: 745610 - RNA, 64 nt, Homo Sapiens
aggucaugucacagaccauuaguuauguuuucucuaacuugaugauaguauauauuucaaacau

SEQ ID NO: 745611 - RNA, 64 nt, Homo Sapiens; identical to SEQ ID NO: 104346

SEQ ID NO: 745612 - RNA, 64 nt, Homo Sapiens; identical to SEQ ID NO: 104347

SEQ ID NO: 745613 - RNA, 64 nt, Homo Sapiens; identical to SEQ ID NO: 104348

SEQ ID NO: 745614 - RNA, 64 nt, Homo Sapiens; identical to SEQ ID NO: 104349

SEQ ID NO: 745615 - RNA, 64 nt, Homo Sapiens; identical to SEQ ID NO: 104350

SEQ ID NO: 745616 - RNA, 64 nt, Homo Sapiens; identical to SEQ ID NO: 104351

SEQ ID NO: 745617 - RNA, 64 nt, Homo Sapiens; identical to SEQ ID NO: 104352

SEQ ID NO: 745618 - RNA, 64 nt, Homo Sapiens; identical to SEQ ID NO: 104353

SEQ ID NO: 745619 - RNA, 64 nt, Homo Sapiens; identical to SEQ ID NO: 104354

SEQ ID NO: 745620 - RNA, 64 nt, Homo Sapiens; identical to SEQ ID NO: 104355

SEQ ID NO: 745621 - RNA, 64 nt, Homo Sapiens; identical to SEQ ID NO: 104356

SEQ ID NO: 745622 - RNA, 64 nt, Homo Sapiens; identical to SEQ ID NO: 104357

SEQ ID NO: 745623 - RNA, 64 nt, Homo Sapiens; identical to SEQ ID NO: 104358

SEQ ID NO: 745624 - RNA, 64 nt, Homo Sapiens; identical to SEQ ID NO: 104359

SEQ ID NO: 745625 - RNA, 64 nt, Homo Sapiens; identical to SEQ ID NO: 104360

SEQ ID NO: 745626 - RNA, 64 nt, Homo Sapiens; identical to SEQ ID NO: 104361

SEQ ID NO: 745627 - RNA, 64 nt, Homo Sapiens; identical to SEQ ID NO: 104362

SEQ ID NO: 745628 - RNA, 64 nt, Homo Sapiens; identical to SEQ ID NO: 104363

SEQ ID NO: 745629 - RNA, 64 nt, Homo Sapiens; identical to SEQ ID NO: 104364

SEQ ID NO: 745630 - RNA, 64 nt, Homo Sapiens; identical to SEQ ID NO: 104365

SEQ ID NO: 745631 - RNA, 64 nt, Homo Sapiens; identical to SEQ ID NO: 104366

SEQ ID NO: 745632 - RNA, 64 nt, Homo Sapiens; identical to SEQ ID NO: 104367

SEQ ID NO: 745633 - RNA, 64 nt, Homo Sapiens; identical to SEQ ID NO: 104368

SEQ ID NO: 745634 - RNA, 64 nt, Homo Sapiens; identical to SEQ ID NO: 104369

SEQ ID NO: 745635 - RNA, 64 nt, Homo Sapiens; identical to SEQ ID NO: 104370

SEQ ID NO: 745636 - RNA, 64 nt, Homo Sapiens; identical to SEQ ID NO: 104371

SEQ ID NO: 745637 - RNA, 64 nt, Homo Sapiens; identical to SEQ ID NO: 104372

SEQ ID NO: 745638 - RNA, 64 nt, Homo Sapiens; identical to SEQ ID NO: 104373

SEQ ID NO: 745639 - RNA, 64 nt, Homo Sapiens; identical to SEQ ID NO: 104374

SEQ ID NO: 745640 - RNA, 64 nt, Homo Sapiens; identical to SEQ ID NO: 104375

SEQ ID NO: 745641 - RNA, 64 nt, Homo Sapiens; identical to SEQ ID NO: 104376

SEQ ID NO: 745642 - RNA, 64 nt, Homo Sapiens; identical to SEQ ID NO: 104377

SEQ ID NO: 745643 - RNA, 64 nt, Homo Sapiens; identical to SEQ ID NO: 104378

SEQ ID NO: 745644 - RNA, 64 nt, Homo Sapiens; identical to SEQ ID NO: 104379

SEQ ID NO: 745645 - RNA, 64 nt, Homo Sapiens; identical to SEQ ID NO: 104380

SEQ ID NO: 745646 - RNA, 64 nt, Homo Sapiens; identical to SEQ ID NO: 104381

SEQ ID NO: 745647 - RNA, 64 nt, Homo Sapiens; identical to SEQ ID NO: 104382

SEQ ID NO: 745648 - RNA, 64 nt, Homo Sapiens; identical to SEQ ID NO: 104383

SEQ ID NO: 745649 - RNA, 64 nt, Homo Sapiens; identical to SEQ ID NO: 104384

SEQ ID NO: 745650 - RNA, 64 nt, Homo Sapiens; identical to SEQ ID NO: 104385

SEQ ID NO: 745651 - RNA, 64 nt, Homo Sapiens; identical to SEQ ID NO: 104386

SEQ ID NO: 745652 - RNA, 64 nt, Homo Sapiens; identical to SEQ ID NO: 104387

SEQ ID NO: 745653 - RNA, 64 nt, Homo Sapiens; identical to SEQ ID NO: 104388

SEQ ID NO: 745654 - RNA, 64 nt, Homo Sapiens; identical to SEQ ID NO: 104389

SEQ ID NO: 745655 - RNA, 64 nt, Homo Sapiens; identical to SEQ ID NO: 104390

SEQ ID NO: 745656 - RNA, 64 nt, Homo Sapiens; identical to SEQ ID NO: 104391

SEQ ID NO: 745657 - RNA, 64 nt, Homo Sapiens; identical to SEQ ID NO: 104392

SEQ ID NO: 745658 - RNA, 64 nt, Homo Sapiens; identical to SEQ ID NO: 104393

SEQ ID NO: 745659 - RNA, 64 nt, Homo Sapiens; identical to SEQ ID NO: 104394

SEQ ID NO: 745660 - RNA, 64 nt, Homo Sapiens; identical to SEQ ID NO: 104395

SEQ ID NO: 745661 - RNA, 64 nt, Homo Sapiens; identical to SEQ ID NO: 104396

SEQ ID NO: 745662 - RNA, 64 nt, Homo Sapiens; identical to SEQ ID NO: 104397

SEQ ID NO: 745663 - RNA, 64 nt, Homo Sapiens; identical to SEQ ID NO: 104398

SEQ ID NO: 745664 - RNA, 64 nt, Homo Sapiens; identical to SEQ ID NO: 104399

SEQ ID NO: 745665 - RNA, 64 nt, Homo Sapiens; identical to SEQ ID NO: 104400

SEQ ID NO: 745666 - RNA, 64 nt, Homo Sapiens; identical to SEQ ID NO: 104401

SEQ ID NO: 745667 - RNA, 64 nt, Homo Sapiens; identical to SEQ ID NO: 104402

SEQ ID NO: 745668 - RNA, 64 nt, Homo Sapiens; identical to SEQ ID NO: 104403

SEQ ID NO: 745669 - RNA, 64 nt, Homo Sapiens; identical to SEQ ID NO: 104404

SEQ ID NO: 745670 - RNA, 64 nt, Homo Sapiens; identical to SEQ ID NO: 104405

SEQ ID NO: 745671 - RNA, 64 nt, Homo Sapiens; identical to SEQ ID NO: 104406

SEQ ID NO: 745672 - RNA, 64 nt, Homo Sapiens; identical to SEQ ID NO: 104407

SEQ ID NO: 745673 - RNA, 64 nt, Homo Sapiens; identical to SEQ ID NO: 104408

SEQ ID NO: 745674 - RNA, 64 nt, Homo Sapiens; identical to SEQ ID NO: 104409

SEQ ID NO: 745675 - RNA, 64 nt, Homo Sapiens; identical to SEQ ID NO: 104410

SEQ ID NO: 745676 - RNA, 64 nt, Homo Sapiens; identical to SEQ ID NO: 104411

SEQ ID NO: 745677 - RNA, 64 nt, Homo Sapiens; identical to SEQ ID NO: 104412

SEQ ID NO: 745678 - RNA, 64 nt, Homo Sapiens; identical to SEQ ID NO: 104413

SEQ ID NO: 745679 - RNA, 64 nt, Homo Sapiens; identical to SEQ ID NO: 104414

SEQ ID NO: 745680 - RNA, 64 nt, Homo Sapiens; identical to SEQ ID NO: 104415

SEQ ID NO: 745681 - RNA, 64 nt, Homo Sapiens; identical to SEQ ID NO: 104416

SEQ ID NO: 745682 - RNA, 64 nt, Homo Sapiens; identical to SEQ ID NO: 104417

SEQ ID NO: 745683 - RNA, 64 nt, Homo Sapiens; identical to SEQ ID NO: 104418

SEQ ID NO: 745684 - RNA, 64 nt, Homo Sapiens; identical to SEQ ID NO: 104419

SEQ ID NO: 745685 - RNA, 64 nt, Homo Sapiens; identical to SEQ ID NO: 104420

SEQ ID NO: 745686 - RNA, 64 nt, Homo Sapiens; identical to SEQ ID NO: 104421

SEQ ID NO: 745687 - RNA, 64 nt, Homo Sapiens; identical to SEQ ID NO: 104422

SEQ ID NO: 745688 - RNA, 64 nt, Homo Sapiens; identical to SEQ ID NO: 104423

SEQ ID NO: 745689 - RNA, 64 nt, Homo Sapiens; identical to SEQ ID NO: 104424

SEQ ID NO: 745690 - RNA, 64 nt, Homo Sapiens; identical to SEQ ID NO: 104425

SEQ ID NO: 745691 - RNA, 62 nt, Homo Sapiens
cccaacccucagacagacuugacagaacccuccaccccuaccagucuccaccccuacacaag

SEQ ID NO: 745692 - RNA, 62 nt, Homo Sapiens
caaggacagaacccuccaccuagaaaagucuccaccccuacaugcacccuggacuucucuaa

SEQ ID NO: 745693 - RNA, 62 nt, Homo Sapiens
cacacacucccugcuugcagcuaucuccuucccaccccuacacucaggccugugcccacucc

SEQ ID NO: 745694 - RNA, 62 nt, Homo Sapiens
caccaguguccuccaagugcaacccucugucccaccccuagcugcuggggcagggggugaag

SEQ ID NO: 745695 - RNA, 62 nt, Homo Sapiens
ucuggaaugcuccaguuugaucucccuucugccaccccuaccucaccccuagucacucauau

SEQ ID NO: 745696 - RNA, 62 nt, Homo Sapiens
ccaguuugaucucccuucugccaccccuaccucaccccuagucacucauaucggagccugga

SEQ ID NO: 745697 - RNA, 62 nt, Homo Sapiens
cacauacacacacaccuagcgccaaucaauagcaccccuacucuccaggggggacaauaugu

SEQ ID NO: 745698 - RNA, 62 nt, Homo Sapiens
cuccaggggggacaauauguaaagcuuucugccaccccuaaauuuacuuuuuugguacuaua

SEQ ID NO: 745699 - RNA, 62 nt, Homo Sapiens
uccccaccugggcuccugccggucccuucagccaccccuaagcccuaucccugcagccugag

SEQ ID NO: 745700 - RNA, 62 nt, Homo Sapiens
uucccucccuaucccugcagcugcccaagccacaccccuagccgcccgcggucccccagcac

SEQ ID NO: 745701 - RNA, 65 nt, Homo Sapiens
guucuucaauauauagauauucauacuguaguguacaguauuauaauuuccuaauuuuauuuauu

SEQ ID NO: 745702 - RNA, 65 nt, Homo Sapiens
ccaaacuguuuuugcaacaaguucauuaauuuugucaguauuacaauuauuuucuguacuuuuuu

SEQ ID NO: 745703 - RNA, 65 nt, Homo Sapiens
agaauaggcagcaguuccuuuugaagcacccaugucaguauuagauguuaagcucacccuguucu

SEQ ID NO: 745704 - RNA, 65 nt, Homo Sapiens
auuccucuguacuuuccuuucgcacuacaaugcaucaguauuaugccuuuuuaauuuaaugugcu

SEQ ID NO: 745705 - RNA, 65 nt, Homo Sapiens
augucucccucucagggguacucuguccagccccucaguauuacccgcuugaggcucagaagagc

SEQ ID NO: 745706 - RNA, 65 nt, Homo Sapiens
gaauagucccagcuggagagcacuuccccuuuucccaguauuacuaccaggguccuucccugccc

SEQ ID NO: 745707 - RNA, 65 nt, Homo Sapiens
gauauucagcaaaaguauuauuuuucugauauaugcaguauuacaauuaucuuacugguucaaca

SEQ ID NO: 745708 - RNA, 65 nt, Homo Sapiens
ggaccaaauuugguguuuguuuaacaaagagcaaucaguauuauuguaccuguaucaaaggaauu

SEQ ID NO: 745709 - RNA, 65 nt, Homo Sapiens
cuuacccucuguaagauacugauucuuccuggggccaguauuaccuuguaugcaaauauuacaua

SEQ ID NO: 745710 - RNA, 65 nt, Homo Sapiens
uauacagauguacuagcuaaagucucuuuaugugucaguauuaagaguaauauguagccagauua

SEQ ID NO: 745711 - RNA, 65 nt, Homo Sapiens
uauuuguaaaaaccauuguuuuuuugagcaccuuucaguauuaugucaauucuguaaguggugac

SEQ ID NO: 745712 - RNA, 65 nt, Homo Sapiens
guuauauauauaguuaauauaauuaccccccauugcaguauuauuuacuuguuaggaaguagcuu

SEQ ID NO: 745713 - RNA, 65 nt, Homo Sapiens
augaaggcugugcgaccauccaggcuguguuaggacaguauuagccaaaggaaaucgccuagcuc

SEQ ID NO: 745714 - RNA, 65 nt, Homo Sapiens
cguucuagaaagccacuguucgcauucacucggggcaguauuaaccucauucguaccaugccaaa

SEQ ID NO: 745715 - RNA, 65 nt, Homo Sapiens
ggacuugccaaacagucuuuuaugaaggaaaguuacaguauuaauuuuugaaaagguuuuuuuua

SEQ ID NO: 745716 - RNA, 65 nt, Homo Sapiens
ugacccuacaacugcccugggacauuucacuguaccaguauuaacugcaaacagcaauaauuguc

SEQ ID NO: 745717 - RNA, 65 nt, Homo Sapiens
cacccuuaugagaagugaagguuuuguaaacuuuccaguauuaauuugggcggguauuccccgcu

SEQ ID NO: 745718 - RNA, 65 nt, Homo Sapiens
augauauuaagaucaaagggaggaagggaagacagcaguauuaauucacccuagauuacucaauu

SEQ ID NO: 745719 - RNA, 65 nt, Homo Sapiens
uuauaaccaauucuaaaauucuauuauuuuuaaagcaguauuauuacauaauuaaacuauuucug

SEQ ID NO: 745720 - RNA, 65 nt, Homo Sapiens
acaguaucugcagauacuaugaaaaucuauguuuucaguauuaugucauacacuucuuaaaaugu

SEQ ID NO: 745721 - RNA, 65 nt, Homo Sapiens
ggauucacuuuguguguguuagugcucuaaaguagcaguauuauuauuaaacuguccccagagua

SEQ ID NO: 745722 - RNA, 65 nt, Homo Sapiens
gucaugaacuuugagaaugggcuuccuuuuugguucaguauuagugagagggagagggagaugga

SEQ ID NO: 745723 - RNA, 65 nt, Homo Sapiens
cucauuuaaucuuuacuacacuccugcaacauagacaguauuauuacauucaguauuacaauggc

SEQ ID NO: 745724 - RNA, 65 nt, Homo Sapiens
cuacacuccugcaacauagacaguauuauuacauucaguauuacaauggcagaaacagacagaaa

SEQ ID NO: 745725 - RNA, 65 nt, Homo Sapiens
gucagugguacacagacauuaacuuuauagaaguacaguauuaaaauacaauauuuauaacuaua

SEQ ID NO: 745726 - RNA, 65 nt, Homo Sapiens
auaagcaguugcuucaaaauuagcgucuuaaacagcaguauuacugguucuaaucauuucagcag

SEQ ID NO: 745727 - RNA, 65 nt, Homo Sapiens
ccuucucugucucaugugugcucuucuucuuucuacaguauuauguacucuacugauaucuaaau

SEQ ID NO: 745728 - RNA, 65 nt, Homo Sapiens
gacauuuugccaaaauuauuaauauaagaagcuuucaguauuagugaugucaucugucacuauag

SEQ ID NO: 745729 - RNA, 65 nt, Homo Sapiens
uguaaagucauuguuuaaagguguugcucucuucacaguauuaugaacaguaucuuacaaaaaac

SEQ ID NO: 745730 - RNA, 65 nt, Homo Sapiens
guuuugcuaagccgcuucauaagaugaugucuugucaguauuacuuccauguuagcucauggugu

SEQ ID NO: 745731 - RNA, 64 nt, Homo Sapiens; identical to SEQ ID NO: 198310

SEQ ID NO: 745732 - RNA, 64 nt, Homo Sapiens; identical to SEQ ID NO: 198311

SEQ ID NO: 745733 - RNA, 64 nt, Homo Sapiens; identical to SEQ ID NO: 198312

SEQ ID NO: 745734 - RNA, 64 nt, Homo Sapiens; identical to SEQ ID NO: 198313

SEQ ID NO: 745735 - RNA, 64 nt, Homo Sapiens; identical to SEQ ID NO: 198314

SEQ ID NO: 745736 - RNA, 64 nt, Homo Sapiens; identical to SEQ ID NO: 198315

SEQ ID NO: 745737 - RNA, 64 nt, Homo Sapiens; identical to SEQ ID NO: 198316

SEQ ID NO: 745738 - RNA, 64 nt, Homo Sapiens; identical to SEQ ID NO: 198317

SEQ ID NO: 745739 - RNA, 64 nt, Homo Sapiens; identical to SEQ ID NO: 198318

SEQ ID NO: 745740 - RNA, 64 nt, Homo Sapiens; identical to SEQ ID NO: 198319

SEQ ID NO: 745741 - RNA, 64 nt, Homo Sapiens; identical to SEQ ID NO: 198320

SEQ ID NO: 745742 - RNA, 64 nt, Homo Sapiens; identical to SEQ ID NO: 198321

SEQ ID NO: 745743 - RNA, 64 nt, Homo Sapiens; identical to SEQ ID NO: 198322

SEQ ID NO: 745744 - RNA, 64 nt, Homo Sapiens; identical to SEQ ID NO: 198323

SEQ ID NO: 745745 - RNA, 64 nt, Homo Sapiens; identical to SEQ ID NO: 198324

SEQ ID NO: 745746 - RNA, 64 nt, Homo Sapiens; identical to SEQ ID NO: 198325

SEQ ID NO: 745747 - RNA, 64 nt, Homo Sapiens; identical to SEQ ID NO: 198326

SEQ ID NO: 745748 - RNA, 64 nt, Homo Sapiens; identical to SEQ ID NO: 198327

SEQ ID NO: 745749 - RNA, 64 nt, Homo Sapiens; identical to SEQ ID NO: 198328

SEQ ID NO: 745750 - RNA, 64 nt, Homo Sapiens; identical to SEQ ID NO: 198329

SEQ ID NO: 745751 - RNA, 64 nt, Homo Sapiens; identical to SEQ ID NO: 198330

SEQ ID NO: 745752 - RNA, 64 nt, Homo Sapiens; identical to SEQ ID NO: 198331

SEQ ID NO: 745753 - RNA, 64 nt, Homo Sapiens
gcuuaugacugugaauccuuccucucucuagggucuccuguagguccuguagaccugagggguc

SEQ ID NO: 745754 - RNA, 64 nt, Homo Sapiens
ccugaggggucccucucucuggacuggagcugggcuccuguagaggggccucucccucacugcu

SEQ ID NO: 745755 - RNA, 64 nt, Homo Sapiens
ucuauccuaugaauaagaaccuggucaugcuuuacuccuguauuguuauuuuguucauuuccaa

SEQ ID NO: 745756 - RNA, 64 nt, Homo Sapiens
aaaaauaaaaaaauuagcugggugugguggugcacuccuguaaucccagcuacucagaaggcug

SEQ ID NO: 745757 - RNA, 64 nt, Homo Sapiens
accccaccuugccaagcuuuccuguauaaucucucuccuguauauggccucagaccaacucucu

SEQ ID NO: 745758 - RNA, 64 nt, Homo Sapiens
aucucucuccuguauaaccccucagaccaacucucuccuguauauucccuugaacuguucuggc

SEQ ID NO: 745759 - RNA, 64 nt, Homo Sapiens
caagugguacaaagacaacgcugagggguagugacuccuguagcagcagagacgccuuggaguu

SEQ ID NO: 745760 - RNA, 64 nt, Homo Sapiens
aggacuuugaccuucccagggguccacacuuuaccuccuguaucuucauacgcguguguggaug

SEQ ID NO: 745761 - RNA, 64 nt, Homo Sapiens
uauuuucuuuuaguugaguuagguuuuuccccaucuccuguagagcgaauuuacauauuguauu

SEQ ID NO: 745762 - RNA, 64 nt, Homo Sapiens
ucacacuguagccucuuccuuaaaauuuguggugcuccuguaacaguaagaacuaauucugaaa

SEQ ID NO: 745763 - RNA, 64 nt, Homo Sapiens
aggagaaagagccuuggccuuaaggaaaucuuuacuccuguaagcaagagccaaccucacagga

SEQ ID NO: 745764 - RNA, 64 nt, Homo Sapiens
ucucccuggcccaccuuauagagagcccaaagagcuccuguaagagggagaacucuaucugugg

SEQ ID NO: 745765 - RNA, 64 nt, Homo Sapiens
gaccugaguagggggcagggaguucaggacaacccuccuguaaguuggggguggucugggggua

SEQ ID NO: 745766 - RNA, 64 nt, Homo Sapiens
uucucuacuuuucccuaauucccucuccuccugacuccuguagacauucccaaugauacccacc

SEQ ID NO: 745767 - RNA, 64 nt, Homo Sapiens; identical to SEQ ID NO: 38140

SEQ ID NO: 745768 - RNA, 64 nt, Homo Sapiens; identical to SEQ ID NO: 38141

SEQ ID NO: 745769 - RNA, 64 nt, Homo Sapiens; identical to SEQ ID NO: 38142

SEQ ID NO: 745770 - RNA, 64 nt, Homo Sapiens; identical to SEQ ID NO: 38143

SEQ ID NO: 745771 - RNA, 64 nt, Homo Sapiens; identical to SEQ ID NO: 38144

SEQ ID NO: 745772 - RNA, 64 nt, Homo Sapiens; identical to SEQ ID NO: 38145

SEQ ID NO: 745773 - RNA, 64 nt, Homo Sapiens; identical to SEQ ID NO: 38146

SEQ ID NO: 745774 - RNA, 64 nt, Homo Sapiens; identical to SEQ ID NO: 38147

SEQ ID NO: 745775 - RNA, 64 nt, Homo Sapiens; identical to SEQ ID NO: 38148

SEQ ID NO: 745776 - RNA, 64 nt, Homo Sapiens; identical to SEQ ID NO: 38149

SEQ ID NO: 745777 - RNA, 64 nt, Homo Sapiens; identical to SEQ ID NO: 38150

SEQ ID NO: 745778 - RNA, 64 nt, Homo Sapiens; identical to SEQ ID NO: 38151

SEQ ID NO: 745779 - RNA, 64 nt, Homo Sapiens; identical to SEQ ID NO: 38152

SEQ ID NO: 745780 - RNA, 64 nt, Homo Sapiens; identical to SEQ ID NO: 38153

SEQ ID NO: 745781 - RNA, 64 nt, Homo Sapiens; identical to SEQ ID NO: 38154

SEQ ID NO: 745782 - RNA, 64 nt, Homo Sapiens; identical to SEQ ID NO: 38155

SEQ ID NO: 745783 - RNA, 64 nt, Homo Sapiens; identical to SEQ ID NO: 38156

SEQ ID NO: 745784 - RNA, 64 nt, Homo Sapiens; identical to SEQ ID NO: 38157

SEQ ID NO: 745785 - RNA, 64 nt, Homo Sapiens; identical to SEQ ID NO: 38158

SEQ ID NO: 745786 - RNA, 64 nt, Homo Sapiens; identical to SEQ ID NO: 38159

SEQ ID NO: 745787 - RNA, 64 nt, Homo Sapiens; identical to SEQ ID NO: 38160

SEQ ID NO: 745788 - RNA, 64 nt, Homo Sapiens; identical to SEQ ID NO: 38161

SEQ ID NO: 745789 - RNA, 64 nt, Homo Sapiens; identical to SEQ ID NO: 333593

SEQ ID NO: 745790 - RNA, 64 nt, Homo Sapiens; identical to SEQ ID NO: 333594

SEQ ID NO: 745791 - RNA, 64 nt, Homo Sapiens; identical to SEQ ID NO: 333595

SEQ ID NO: 745792 - RNA, 64 nt, Homo Sapiens; identical to SEQ ID NO: 333596

SEQ ID NO: 745793 - RNA, 64 nt, Homo Sapiens; identical to SEQ ID NO: 333597

SEQ ID NO: 745794 - RNA, 64 nt, Homo Sapiens; identical to SEQ ID NO: 333598

SEQ ID NO: 745795 - RNA, 64 nt, Homo Sapiens; identical to SEQ ID NO: 333599

SEQ ID NO: 745796 - RNA, 64 nt, Homo Sapiens; identical to SEQ ID NO: 333600

SEQ ID NO: 745797 - RNA, 64 nt, Homo Sapiens; identical to SEQ ID NO: 333601

SEQ ID NO: 745798 - RNA, 64 nt, Homo Sapiens; identical to SEQ ID NO: 333602

SEQ ID NO: 745799 - RNA, 64 nt, Homo Sapiens; identical to SEQ ID NO: 333603

SEQ ID NO: 745800 - RNA, 64 nt, Homo Sapiens; identical to SEQ ID NO: 333604

SEQ ID NO: 745801 - RNA, 64 nt, Homo Sapiens; identical to SEQ ID NO: 574722

SEQ ID NO: 745802 - RNA, 64 nt, Homo Sapiens; identical to SEQ ID NO: 574723

SEQ ID NO: 745803 - RNA, 64 nt, Homo Sapiens; identical to SEQ ID NO: 574724

SEQ ID NO: 745804 - RNA, 64 nt, Homo Sapiens; identical to SEQ ID NO: 574725

SEQ ID NO: 745805 - RNA, 64 nt, Homo Sapiens; identical to SEQ ID NO: 574726

SEQ ID NO: 745806 - RNA, 64 nt, Homo Sapiens; identical to SEQ ID NO: 574727

SEQ ID NO: 745807 - RNA, 64 nt, Homo Sapiens; identical to SEQ ID NO: 574728

SEQ ID NO: 745808 - RNA, 64 nt, Homo Sapiens; identical to SEQ ID NO: 574729

SEQ ID NO: 745809 - RNA, 64 nt, Homo Sapiens; identical to SEQ ID NO: 51971

SEQ ID NO: 745810 - RNA, 64 nt, Homo Sapiens; identical to SEQ ID NO: 51972

SEQ ID NO: 745811 - RNA, 64 nt, Homo Sapiens; identical to SEQ ID NO: 51973

SEQ ID NO: 745812 - RNA, 64 nt, Homo Sapiens; identical to SEQ ID NO: 51974

SEQ ID NO: 745813 - RNA, 64 nt, Homo Sapiens; identical to SEQ ID NO: 51975

SEQ ID NO: 745814 - RNA, 64 nt, Homo Sapiens; identical to SEQ ID NO: 51976

SEQ ID NO: 745815 - RNA, 52 nt, Homo Sapiens; identical to SEQ ID NO: 51977

SEQ ID NO: 745816 - RNA, 64 nt, Homo Sapiens; identical to SEQ ID NO: 51978

SEQ ID NO: 745817 - RNA, 64 nt, Homo Sapiens; identical to SEQ ID NO: 51979

SEQ ID NO: 745818 - RNA, 64 nt, Homo Sapiens; identical to SEQ ID NO: 51980

SEQ ID NO: 745819 - RNA, 64 nt, Homo Sapiens; identical to SEQ ID NO: 51981

SEQ ID NO: 745820 - RNA, 64 nt, Homo Sapiens; identical to SEQ ID NO: 51982

SEQ ID NO: 745821 - RNA, 64 nt, Homo Sapiens; identical to SEQ ID NO: 51983

SEQ ID NO: 745822 - RNA, 64 nt, Homo Sapiens; identical to SEQ ID NO: 51984

SEQ ID NO: 745823 - RNA, 64 nt, Homo Sapiens; identical to SEQ ID NO: 51985

SEQ ID NO: 745824 - RNA, 64 nt, Homo Sapiens; identical to SEQ ID NO: 51986

SEQ ID NO: 745825 - RNA, 64 nt, Homo Sapiens; identical to SEQ ID NO: 51987

SEQ ID NO: 745826 - RNA, 64 nt, Homo Sapiens; identical to SEQ ID NO: 51988

SEQ ID NO: 745827 - RNA, 64 nt, Homo Sapiens; identical to SEQ ID NO: 51989

SEQ ID NO: 745828 - RNA, 64 nt, Homo Sapiens; identical to SEQ ID NO: 51990

SEQ ID NO: 745829 - RNA, 64 nt, Homo Sapiens; identical to SEQ ID NO: 51991

SEQ ID NO: 745830 - RNA, 64 nt, Homo Sapiens; identical to SEQ ID NO: 51992

SEQ ID NO: 745831 - RNA, 64 nt, Homo Sapiens; identical to SEQ ID NO: 51993

SEQ ID NO: 745832 - RNA, 64 nt, Homo Sapiens; identical to SEQ ID NO: 51994

SEQ ID NO: 745833 - RNA, 64 nt, Homo Sapiens; identical to SEQ ID NO: 51995

SEQ ID NO: 745834 - RNA, 64 nt, Homo Sapiens; identical to SEQ ID NO: 51996

SEQ ID NO: 745835 - RNA, 64 nt, Homo Sapiens; identical to SEQ ID NO: 51997

SEQ ID NO: 745836 - RNA, 64 nt, Homo Sapiens; identical to SEQ ID NO: 51998

SEQ ID NO: 745837 - RNA, 64 nt, Homo Sapiens; identical to SEQ ID NO: 51999

SEQ ID NO: 745838 - RNA, 64 nt, Homo Sapiens; identical to SEQ ID NO: 52000

SEQ ID NO: 745839 - RNA, 64 nt, Homo Sapiens; identical to SEQ ID NO: 52001

SEQ ID NO: 745840 - RNA, 64 nt, Homo Sapiens; identical to SEQ ID NO: 52002

SEQ ID NO: 745841 - RNA, 64 nt, Homo Sapiens; identical to SEQ ID NO: 52003

SEQ ID NO: 745842 - RNA, 64 nt, Homo Sapiens; identical to SEQ ID NO: 603756

SEQ ID NO: 745843 - RNA, 64 nt, Homo Sapiens; identical to SEQ ID NO: 603757

SEQ ID NO: 745844 - RNA, 64 nt, Homo Sapiens; identical to SEQ ID NO: 603758

SEQ ID NO: 745845 - RNA, 64 nt, Homo Sapiens; identical to SEQ ID NO: 603759

SEQ ID NO: 745846 - RNA, 64 nt, Homo Sapiens; identical to SEQ ID NO: 603760

SEQ ID NO: 745847 - RNA, 64 nt, Homo Sapiens; identical to SEQ ID NO: 603761

SEQ ID NO: 745848 - RNA, 64 nt, Homo Sapiens; identical to SEQ ID NO: 603762

SEQ ID NO: 745849 - RNA, 64 nt, Homo Sapiens; identical to SEQ ID NO: 603763

SEQ ID NO: 745850 - RNA, 64 nt, Homo Sapiens; identical to SEQ ID NO: 603764

SEQ ID NO: 745851 - RNA, 64 nt, Homo Sapiens; identical to SEQ ID NO: 603765

SEQ ID NO: 745852 - RNA, 64 nt, Homo Sapiens; identical to SEQ ID NO: 603766

SEQ ID NO: 745853 - RNA, 64 nt, Homo Sapiens; identical to SEQ ID NO: 603767

SEQ ID NO: 745854 - RNA, 64 nt, Homo Sapiens; identical to SEQ ID NO: 603768

SEQ ID NO: 745855 - RNA, 64 nt, Homo Sapiens; identical to SEQ ID NO: 603769

SEQ ID NO: 745856 - RNA, 64 nt, Homo Sapiens; identical to SEQ ID NO: 603770

SEQ ID NO: 745857 - RNA, 64 nt, Homo Sapiens; identical to SEQ ID NO: 603771

SEQ ID NO: 745858 - RNA, 64 nt, Homo Sapiens; identical to SEQ ID NO: 603772

SEQ ID NO: 745859 - RNA, 64 nt, Homo Sapiens; identical to SEQ ID NO: 603773

SEQ ID NO: 745860 - RNA, 64 nt, Homo Sapiens; identical to SEQ ID NO: 603774

SEQ ID NO: 745861 - RNA, 64 nt, Homo Sapiens; identical to SEQ ID NO: 603775

SEQ ID NO: 745862 - RNA, 64 nt, Homo Sapiens; identical to SEQ ID NO: 603776

SEQ ID NO: 745863 - RNA, 64 nt, Homo Sapiens; identical to SEQ ID NO: 603777

SEQ ID NO: 745864 - RNA, 64 nt, Homo Sapiens; identical to SEQ ID NO: 603778

SEQ ID NO: 745865 - RNA, 64 nt, Homo Sapiens; identical to SEQ ID NO: 603779

SEQ ID NO: 745866 - RNA, 64 nt, Homo Sapiens; identical to SEQ ID NO: 603780

SEQ ID NO: 745867 - RNA, 64 nt, Homo Sapiens; identical to SEQ ID NO: 603781

SEQ ID NO: 745868 - RNA, 64 nt, Homo Sapiens; identical to SEQ ID NO: 603782

SEQ ID NO: 745869 - RNA, 64 nt, Homo Sapiens; identical to SEQ ID NO: 603783

SEQ ID NO: 745870 - RNA, 64 nt, Homo Sapiens; identical to SEQ ID NO: 603784

SEQ ID NO: 745871 - RNA, 64 nt, Homo Sapiens; identical to SEQ ID NO: 603785

SEQ ID NO: 745872 - RNA, 64 nt, Homo Sapiens
uuuggcuaucaagucauuaauaucacuaaaucaucauuacgaugcucuuucauccagucuagua

SEQ ID NO: 745873 - RNA, 64 nt, Homo Sapiens
auugugauuauccauuaaauuaagucuuuguauacauuacgaccuuauacgagaaagugguaua

SEQ ID NO: 745874 - RNA, 64 nt, Homo Sapiens
uguaaugggaagaaauaaaacgaugcuuucuguggcuaaacagacuucugcagugaguauggcc

SEQ ID NO: 745875 - RNA, 64 nt, Homo Sapiens
gcuuaaucuuauuuuaucuuuuaaaauacucagugcuaaacaugacaaacaaaaaacccaugug

SEQ ID NO: 745876 - RNA, 64 nt, Homo Sapiens
cauaaaauagucauugugcaucaguaguucaacagcuaaacagugcaagaaacugcaggcugga

SEQ ID NO: 745877 - RNA, 64 nt, Homo Sapiens
aaaagcucuagguucuucagcuuugauauaaggugcuaaacaaacaucauacccauuuucauua

SEQ ID NO: 745878 - RNA, 64 nt, Homo Sapiens; identical to SEQ ID NO: 642878

SEQ ID NO: 745879 - RNA, 64 nt, Homo Sapiens; identical to SEQ ID NO: 642879

SEQ ID NO: 745880 - RNA, 64 nt, Homo Sapiens; identical to SEQ ID NO: 642880

SEQ ID NO: 745881 - RNA, 64 nt, Homo Sapiens; identical to SEQ ID NO: 642881

SEQ ID NO: 745882 - RNA, 64 nt, Homo Sapiens; identical to SEQ ID NO: 642882

SEQ ID NO: 745883 - RNA, 64 nt, Homo Sapiens; identical to SEQ ID NO: 642883

SEQ ID NO: 745884 - RNA, 64 nt, Homo Sapiens; identical to SEQ ID NO: 642884

SEQ ID NO: 745885 - RNA, 64 nt, Homo Sapiens; identical to SEQ ID NO: 642885

SEQ ID NO: 745886 - RNA, 64 nt, Homo Sapiens; identical to SEQ ID NO: 642886

SEQ ID NO: 745887 - RNA, 64 nt, Homo Sapiens; identical to SEQ ID NO: 324618

SEQ ID NO: 745888 - RNA, 64 nt, Homo Sapiens; identical to SEQ ID NO: 324619

SEQ ID NO: 745889 - RNA, 64 nt, Homo Sapiens; identical to SEQ ID NO: 324620

SEQ ID NO: 745890 - RNA, 64 nt, Homo Sapiens; identical to SEQ ID NO: 324621

SEQ ID NO: 745891 - RNA, 64 nt, Homo Sapiens; identical to SEQ ID NO: 324622

SEQ ID NO: 745892 - RNA, 64 nt, Homo Sapiens; identical to SEQ ID NO: 324623

SEQ ID NO: 745893 - RNA, 64 nt, Homo Sapiens; identical to SEQ ID NO: 324624

SEQ ID NO: 745894 - RNA, 64 nt, Homo Sapiens; identical to SEQ ID NO: 324625

SEQ ID NO: 745895 - RNA, 64 nt, Homo Sapiens; identical to SEQ ID NO: 490803

SEQ ID NO: 745896 - RNA, 64 nt, Homo Sapiens; identical to SEQ ID NO: 490804

SEQ ID NO: 745897 - RNA, 64 nt, Homo Sapiens; identical to SEQ ID NO: 490805

SEQ ID NO: 745898 - RNA, 64 nt, Homo Sapiens; identical to SEQ ID NO: 490806

SEQ ID NO: 745899 - RNA, 64 nt, Homo Sapiens; identical to SEQ ID NO: 490807

SEQ ID NO: 745900 - RNA, 64 nt, Homo Sapiens; identical to SEQ ID NO: 490808

SEQ ID NO: 745901 - RNA, 64 nt, Homo Sapiens; identical to SEQ ID NO: 490809

SEQ ID NO: 745902 - RNA, 64 nt, Homo Sapiens; identical to SEQ ID NO: 490810

SEQ ID NO: 745903 - RNA, 64 nt, Homo Sapiens; identical to SEQ ID NO: 490811

SEQ ID NO: 745904 - RNA, 64 nt, Homo Sapiens; identical to SEQ ID NO: 490812

SEQ ID NO: 745905 - RNA, 64 nt, Homo Sapiens
uacauuaguuuuuuucauacuugaaacgaaggaaguaucgaauuuuuacagaaagucuauuucu

SEQ ID NO: 745906 - RNA, 64 nt, Homo Sapiens
ugagaaugccuucauuuaucaaaacuuuaugaagguaucgaaugaacauaacucauucuagaga

SEQ ID NO: 745907 - RNA, 64 nt, Homo Sapiens
uuuguucucaguaucagcccgaguauuucggcccguaucgaacuuuccuacuuuaccaaccuca

SEQ ID NO: 745908 - RNA, 64 nt, Homo Sapiens
guucagcuugguugucauugacccaguucugcugguaucgaauacuuggcuuaaucccuaaaga

SEQ ID NO: 745909 - RNA, 64 nt, Homo Sapiens
agacugugaugagcucgucuguggaacaucacaaguaucgaaaauacaguaauggauguuuccu

SEQ ID NO: 745910 - RNA, 64 nt, Homo Sapiens
uuaaucaugcuggaauuuaaaaauuguuuuacuuguaucgaaauuaaccuugauuuauaacuau

SEQ ID NO: 745911 - RNA, 64 nt, Homo Sapiens
cgauccaaccuagagaccauuugcuggaaacauuguaucgaaacugcagaacauacaaucaagu

SEQ ID NO: 745912 - RNA, 64 nt, Homo Sapiens
ucugaaauuacaaacuuuaggaacuuuuccagauguaucgaauuuaauuugacauugaugucac

SEQ ID NO: 745913 - RNA, 64 nt, Homo Sapiens
agcagaagggcaggcccugcaacucaggcugggaguaucgaacccucugccuagggccggaguu

SEQ ID NO: 745914 - RNA, 64 nt, Homo Sapiens
uucuuccuguguagccauauacccaggcucugcaguaucgaaggaugcaaauguugacauagau

SEQ ID NO: 745915 - RNA, 64 nt, Homo Sapiens
auaagugcucaauagcuugaagcccaagaaguugguaucgaaauuuguuguuuguuuaaaccca

SEQ ID NO: 745916 - RNA, 64 nt, Homo Sapiens
uaaugucugcaugauauuugugcacauuuauuaaguaucgaagcuuaauaaauuauuguguccu

SEQ ID NO: 745917 - RNA, 64 nt, Homo Sapiens
gaugagagugaaggagacuucccugccugacgauguaucgaaaaugcggcguagugcccuucug

SEQ ID NO: 745918 - RNA, 64 nt, Homo Sapiens
augaaucugguaaaguuuggcagagacagauaguguaucgaaaauuguacuccagcauggguga

SEQ ID NO: 745919 - RNA, 64 nt, Homo Sapiens
ccagaaaccacuuuuaauaaauguuguuuggaugguaucgaaaaagucaguuuaaaaauuguuc

SEQ ID NO: 745920 - RNA, 64 nt, Homo Sapiens
ccacuucucugaaggagggcuggguucugggccuguaucgaauaaacacaaaccuggauggcgc

SEQ ID NO: 745921 - RNA, 64 nt, Homo Sapiens; identical to SEQ ID NO: 308450

SEQ ID NO: 745922 - RNA, 64 nt, Homo Sapiens; identical to SEQ ID NO: 308451

SEQ ID NO: 745923 - RNA, 64 nt, Homo Sapiens; identical to SEQ ID NO: 308452

SEQ ID NO: 745924 - RNA, 64 nt, Homo Sapiens; identical to SEQ ID NO: 308453

SEQ ID NO: 745925 - RNA, 64 nt, Homo Sapiens; identical to SEQ ID NO: 308454

SEQ ID NO: 745926 - RNA, 64 nt, Homo Sapiens; identical to SEQ ID NO: 308455

SEQ ID NO: 745927 - RNA, 64 nt, Homo Sapiens; identical to SEQ ID NO: 308456

SEQ ID NO: 745928 - RNA, 64 nt, Homo Sapiens; identical to SEQ ID NO: 308457

SEQ ID NO: 745929 - RNA, 64 nt, Homo Sapiens; identical to SEQ ID NO: 308458

SEQ ID NO: 745930 - RNA, 64 nt, Homo Sapiens; identical to SEQ ID NO: 308459

SEQ ID NO: 745931 - RNA, 64 nt, Homo Sapiens; identical to SEQ ID NO: 308460

SEQ ID NO: 745932 - RNA, 64 nt, Homo Sapiens; identical to SEQ ID NO: 308461

SEQ ID NO: 745933 - RNA, 64 nt, Homo Sapiens; identical to SEQ ID NO: 308462

SEQ ID NO: 745934 - RNA, 64 nt, Homo Sapiens; identical to SEQ ID NO: 308463

SEQ ID NO: 745935 - RNA, 64 nt, Homo Sapiens; identical to SEQ ID NO: 308464

SEQ ID NO: 745936 - RNA, 64 nt, Homo Sapiens; identical to SEQ ID NO: 308465

SEQ ID NO: 745937 - RNA, 64 nt, Homo Sapiens; identical to SEQ ID NO: 308466

SEQ ID NO: 745938 - RNA, 64 nt, Homo Sapiens; identical to SEQ ID NO: 537396

SEQ ID NO: 745939 - RNA, 64 nt, Homo Sapiens; identical to SEQ ID NO: 537397

SEQ ID NO: 745940 - RNA, 64 nt, Homo Sapiens; identical to SEQ ID NO: 537398

SEQ ID NO: 745941 - RNA, 64 nt, Homo Sapiens; identical to SEQ ID NO: 537399

SEQ ID NO: 745942 - RNA, 64 nt, Homo Sapiens; identical to SEQ ID NO: 537400

SEQ ID NO: 745943 - RNA, 64 nt, Homo Sapiens; identical to SEQ ID NO: 537401

SEQ ID NO: 745944 - RNA, 64 nt, Homo Sapiens; identical to SEQ ID NO: 537402

SEQ ID NO: 745945 - RNA, 64 nt, Homo Sapiens; identical to SEQ ID NO: 537403

SEQ ID NO: 745946 - RNA, 64 nt, Homo Sapiens; identical to SEQ ID NO: 537404

SEQ ID NO: 745947 - RNA, 64 nt, Homo Sapiens; identical to SEQ ID NO: 537405

SEQ ID NO: 745948 - RNA, 64 nt, Homo Sapiens; identical to SEQ ID NO: 537406

SEQ ID NO: 745949 - RNA, 64 nt, Homo Sapiens; identical to SEQ ID NO: 537407

SEQ ID NO: 745950 - RNA, 64 nt, Homo Sapiens; identical to SEQ ID NO: 537408

SEQ ID NO: 745951 - RNA, 64 nt, Homo Sapiens; identical to SEQ ID NO: 537409

SEQ ID NO: 745952 - RNA, 64 nt, Homo Sapiens; identical to SEQ ID NO: 537410

SEQ ID NO: 745953 - RNA, 64 nt, Homo Sapiens; identical to SEQ ID NO: 537411

SEQ ID NO: 745954 - RNA, 64 nt, Homo Sapiens; identical to SEQ ID NO: 537412

SEQ ID NO: 745955 - RNA, 64 nt, Homo Sapiens; identical to SEQ ID NO: 537413

SEQ ID NO: 745956 - RNA, 64 nt, Homo Sapiens; identical to SEQ ID NO: 537414

SEQ ID NO: 745957 - RNA, 64 nt, Homo Sapiens; identical to SEQ ID NO: 537415

SEQ ID NO: 745958 - RNA, 64 nt, Homo Sapiens; identical to SEQ ID NO: 537416

SEQ ID NO: 745959 - RNA, 64 nt, Homo Sapiens; identical to SEQ ID NO: 537417

SEQ ID NO: 745960 - RNA, 64 nt, Homo Sapiens; identical to SEQ ID NO: 537418

SEQ ID NO: 745961 - RNA, 64 nt, Homo Sapiens; identical to SEQ ID NO: 537419

SEQ ID NO: 745962 - RNA, 64 nt, Homo Sapiens; identical to SEQ ID NO: 537420

SEQ ID NO: 745963 - RNA, 64 nt, Homo Sapiens; identical to SEQ ID NO: 537421

SEQ ID NO: 745964 - RNA, 64 nt, Homo Sapiens; identical to SEQ ID NO: 537422

SEQ ID NO: 745965 - RNA, 64 nt, Homo Sapiens; identical to SEQ ID NO: 537423

SEQ ID NO: 745966 - RNA, 64 nt, Homo Sapiens; identical to SEQ ID NO: 105404

SEQ ID NO: 745967 - RNA, 64 nt, Homo Sapiens; identical to SEQ ID NO: 105405

SEQ ID NO: 745968 - RNA, 64 nt, Homo Sapiens; identical to SEQ ID NO: 105406

SEQ ID NO: 745969 - RNA, 64 nt, Homo Sapiens; identical to SEQ ID NO: 105407

SEQ ID NO: 745970 - RNA, 64 nt, Homo Sapiens
aagaaaucuaaagugaaaauuuugcuuagaaauaaaauacgacaaguuauguuuugaguuugau

SEQ ID NO: 745971 - RNA, 64 nt, Homo Sapiens
guaauccauugcaugcauuagcagcucaaagaugaaauacgaucauaucaauagguacagaaaa

SEQ ID NO: 745972 - RNA, 64 nt, Homo Sapiens
agcgcaccagcuaacaauguagaauaagagcgcaccagaauaagaggaagaauaagagugcacc

SEQ ID NO: 745973 - RNA, 64 nt, Homo Sapiens
agcgcaccagaauaagagcgagaauaagagugcaccagaauaagaaaaucuucucuugaaagga

SEQ ID NO: 745974 - RNA, 64 nt, Homo Sapiens
auagcagggagugaucggggugaaauaacuugggccagaauauuauuaaacaaucaucaggcuu

SEQ ID NO: 745975 - RNA, 64 nt, Homo Sapiens
auauuugugaguuguguuaucuguaauauacaucccagaauaaaggagugaauuaaauaguuua

SEQ ID NO: 745976 - RNA, 64 nt, Homo Sapiens
ggaaacugaaugccauaaucucgaucaaaccgauccagaauaccgaagguauggacaggacaga

SEQ ID NO: 745977 - RNA, 64 nt, Homo Sapiens
caacucaaagaggcagaagaggagaaugacuuuuccagaauagaaguggagcagugaucauuau

SEQ ID NO: 745978 - RNA, 64 nt, Homo Sapiens
acuuguauugaccaauuuagauuuuuacaugauuccagaauaacaacaguuaugaaaguaagug

SEQ ID NO: 745979 - RNA, 64 nt, Homo Sapiens
guuuauuucgugaauucuaaggggaggggauuuaccagaauacaguacauuacacucuuguugc

SEQ ID NO: 745980 - RNA, 64 nt, Homo Sapiens
agugucauuauuauagacuaauuuuuucuaaguuccagaauaauauuauuauauugcauuauuu

SEQ ID NO: 745981 - RNA, 64 nt, Homo Sapiens
aaguaucuguuuuugaaauugugugaugcuaugcccagaauauguauauugguaaugguuguau

SEQ ID NO: 745982 - RNA, 64 nt, Homo Sapiens
uuuugucuagagaccagcauguucuccccaaagaccagaauauucuaccuaaauaucaaggcca

SEQ ID NO: 745983 - RNA, 64 nt, Homo Sapiens
uucuacccagagaccugcauguucucuccaacgaccagaauauucuacccaaaugucaggacca

SEQ ID NO: 745984 - RNA, 64 nt, Homo Sapiens
gcccuggguaggcuugcuugaaaagugaguccuuccagaauauucucagagcugccagaaacau

SEQ ID NO: 745985 - RNA, 64 nt, Homo Sapiens
agccccuggcccuggccccugcacaccaguaggcccagaauaaccgccacccuugccauccugc

SEQ ID NO: 745986 - RNA, 64 nt, Homo Sapiens
uaggacucaaauucagaccauagccuugaagucaccagaauaacguuuugcccaugugcuuggg

SEQ ID NO: 745987 - RNA, 64 nt, Homo Sapiens
cgguaguuccacucuugaguacuucuaaaacauuccagaauaccaaaccuuagggcaggaaaga

SEQ ID NO: 745988 - RNA, 64 nt, Homo Sapiens
ccagauguuccugagucuggagcaagcacccaggccagaauaacagagcuuucuuaguugguga

SEQ ID NO: 745989 - RNA, 64 nt, Homo Sapiens
auagccaaguagauuuggguagaggauacuauuuccagaauaguguuuagcucaccuaggggga

SEQ ID NO: 745990 - RNA, 61 nt, Homo Sapiens; identical to SEQ ID NO: 490619

SEQ ID NO: 745991 - RNA, 64 nt, Homo Sapiens; identical to SEQ ID NO: 490620

SEQ ID NO: 745992 - RNA, 64 nt, Homo Sapiens; identical to SEQ ID NO: 490621

SEQ ID NO: 745993 - RNA, 64 nt, Homo Sapiens; identical to SEQ ID NO: 490622

SEQ ID NO: 745994 - RNA, 64 nt, Homo Sapiens; identical to SEQ ID NO: 490623

SEQ ID NO: 745995 - RNA, 64 nt, Homo Sapiens; identical to SEQ ID NO: 490624

SEQ ID NO: 745996 - RNA, 64 nt, Homo Sapiens; identical to SEQ ID NO: 490625

SEQ ID NO: 745997 - RNA, 64 nt, Homo Sapiens; identical to SEQ ID NO: 490626

SEQ ID NO: 745998 - RNA, 64 nt, Homo Sapiens; identical to SEQ ID NO: 490627

SEQ ID NO: 745999 - RNA, 64 nt, Homo Sapiens; identical to SEQ ID NO: 490628

SEQ ID NO: 746000 - RNA, 64 nt, Homo Sapiens; identical to SEQ ID NO: 490629

SEQ ID NO: 746001 - RNA, 64 nt, Homo Sapiens; identical to SEQ ID NO: 490630

SEQ ID NO: 746002 - RNA, 64 nt, Homo Sapiens; identical to SEQ ID NO: 490631

SEQ ID NO: 746003 - RNA, 64 nt, Homo Sapiens; identical to SEQ ID NO: 490632

SEQ ID NO: 746004 - RNA, 64 nt, Homo Sapiens; identical to SEQ ID NO: 490633

SEQ ID NO: 746005 - RNA, 64 nt, Homo Sapiens; identical to SEQ ID NO: 490634

SEQ ID NO: 746006 - RNA, 64 nt, Homo Sapiens; identical to SEQ ID NO: 490635

SEQ ID NO: 746007 - RNA, 64 nt, Homo Sapiens; identical to SEQ ID NO: 490636

SEQ ID NO: 746008 - RNA, 64 nt, Homo Sapiens; identical to SEQ ID NO: 520271

SEQ ID NO: 746009 - RNA, 64 nt, Homo Sapiens; identical to SEQ ID NO: 520272

SEQ ID NO: 746010 - RNA, 64 nt, Homo Sapiens; identical to SEQ ID NO: 520273

SEQ ID NO: 746011 - RNA, 64 nt, Homo Sapiens; identical to SEQ ID NO: 520274

SEQ ID NO: 746012 - RNA, 64 nt, Homo Sapiens; identical to SEQ ID NO: 520275

SEQ ID NO: 746013 - RNA, 64 nt, Homo Sapiens; identical to SEQ ID NO: 520276

SEQ ID NO: 746014 - RNA, 64 nt, Homo Sapiens; identical to SEQ ID NO: 520277

SEQ ID NO: 746015 - RNA, 64 nt, Homo Sapiens; identical to SEQ ID NO: 520278

SEQ ID NO: 746016 - RNA, 64 nt, Homo Sapiens; identical to SEQ ID NO: 520279

SEQ ID NO: 746017 - RNA, 64 nt, Homo Sapiens; identical to SEQ ID NO: 520280

SEQ ID NO: 746018 - RNA, 64 nt, Homo Sapiens; identical to SEQ ID NO: 520281

SEQ ID NO: 746019 - RNA, 64 nt, Homo Sapiens; identical to SEQ ID NO: 520282

SEQ ID NO: 746020 - RNA, 64 nt, Homo Sapiens; identical to SEQ ID NO: 520283

SEQ ID NO: 746021 - RNA, 64 nt, Homo Sapiens; identical to SEQ ID NO: 520284

SEQ ID NO: 746022 - RNA, 64 nt, Homo Sapiens; identical to SEQ ID NO: 520285

SEQ ID NO: 746023 - RNA, 64 nt, Homo Sapiens; identical to SEQ ID NO: 520286

SEQ ID NO: 746024 - RNA, 64 nt, Homo Sapiens
uuacugguuaaaauccaacauauuugcacaacuuuuaaaccagauauuuucauauuuuuuuguu

SEQ ID NO: 746025 - RNA, 64 nt, Homo Sapiens
auugcugaccagcauuauaugacuguacugcuucuuaaaccagcccaaauaaggcauuuuaaua

SEQ ID NO: 746026 - RNA, 64 nt, Homo Sapiens
uugaaaagcaucccaguuaaacuagaugugauaguuaaaccagaugaaagcaugaugauccauc

SEQ ID NO: 746027 - RNA, 64 nt, Homo Sapiens
cagggaaaaagggcaauguugauuaaucucaguauuaaaccacauuaaucuguaucccauuguc

SEQ ID NO: 746028 - RNA, 64 nt, Homo Sapiens
guaugaauggucuagaaacauuucuauuuuuuuuuuaaaccagcaggauacaaguugcaaauga

SEQ ID NO: 746029 - RNA, 64 nt, Homo Sapiens
uggcccuccguaaguuauugccauaguguaugcauuaaaccaaguccauuuugaaugaccuaaa

SEQ ID NO: 746030 - RNA, 64 nt, Homo Sapiens
acacugaagcaaucaccauucugauagaaagugcuuaaaccaccacucuuaggucugcucacuc

SEQ ID NO: 746031 - RNA, 64 nt, Homo Sapiens
gguaguauaauaaagguaaaugaagguacaauuuuuaaaccauuauuuucacccuguuggggua

SEQ ID NO: 746032 - RNA, 64 nt, Homo Sapiens
cauauacaauguguuucaaaugcugcuuguaaaauuaaaccaucaucuagaauagaguuaauuu

SEQ ID NO: 746033 - RNA, 64 nt, Homo Sapiens
uaauuuauuauaaucaagcuacaaauagguuuucuuaaaccagagaugcacugcccuugucuaa

SEQ ID NO: 746034 - RNA, 64 nt, Homo Sapiens
aagaaagcauuaguaaaaaugacuuaaccuaaaauuaaaccagcuugcuguuguggauaggaaa

SEQ ID NO: 746035 - RNA, 64 nt, Homo Sapiens
uccauuuguuucuuuaacauuuguuauaaggucuuuaaaccauuuucuuuugcuaggugggaga

SEQ ID NO: 746036 - RNA, 64 nt, Homo Sapiens
cucaaggggcuccccucccgugcauggacauuuuuuaaaccaccgauuccaagaggaugaggag

SEQ ID NO: 746037 - RNA, 64 nt, Homo Sapiens
gcaauugcucgcccuggagggaaccagaucauuuuuaaaccagaaauaauuuuuuuuauuauug

SEQ ID NO: 746038 - RNA, 64 nt, Homo Sapiens
gaggcccuuuuauuuuuuauucugauuagccauuuuaaaccaacgaggaauaaaaagaaauccu

SEQ ID NO: 746039 - RNA, 64 nt, Homo Sapiens
aaaaggcaucacuuuccuggauccaggauaauuuuuaaaccaaucaaaugaaaaaaacaaacaa

SEQ ID NO: 746040 - RNA, 64 nt, Homo Sapiens
aacaaacaaacaaaaaaggaaaugucaugugagguuaaaccaguuugcauuccccuaaugugga

SEQ ID NO: 746041 - RNA, 64 nt, Homo Sapiens
ucugcaaaguauuuuucagugcagguaaaauguguuaaaccauaagaguugacugaguuaaucc

SEQ ID NO: 746042 - RNA, 64 nt, Homo Sapiens
uuaaucccaauugguugugcucauaugccaccuuuuaaaccaauggaaauugcuauauuugggg

SEQ ID NO: 746043 - RNA, 64 nt, Homo Sapiens
aucugaguugaaugaagcugugcaaacccacccuuuaaaccauuccacccggcaguauucagcu

SEQ ID NO: 746044 - RNA, 64 nt, Homo Sapiens
cauccuaugugcaugccguaagaucaguuggauauuaaaccaucaauaaaguuucacaagauuu

SEQ ID NO: 746045 - RNA, 64 nt, Homo Sapiens
uucuuucaaaguuuaauacauccaauaugucaaguuaaaccauucugggauuugcaaaguuuaa

SEQ ID NO: 746046 - RNA, 64 nt, Homo Sapiens
gauuugcaaaguuuaauacauccaauaugucaaguuaaaccauucugggauuugcaaaguuuaa

SEQ ID NO: 746047 - RNA, 64 nt, Homo Sapiens
gauuugcaaaguuuaauacauccaauaugucaaguuaaaccauucugggauuugggaacuucuu

SEQ ID NO: 746048 - RNA, 64 nt, Homo Sapiens
cuguuccucuguuuuucuuuuugauuuuuguuuuuuaaaccaaaacagacaauagcuuauuuuc

SEQ ID NO: 746049 - RNA, 64 nt, Homo Sapiens
auaagcucauacccaaauucacaaagccuauuuuuuaaaccaaagcacauuuugaaugaguaug

SEQ ID NO: 746050 - RNA, 64 nt, Homo Sapiens
ucaguccuuccuuccuaaucucuaauccccugaagccuaacacaguuccuaauguguuuugccu

SEQ ID NO: 746051 - RNA, 64 nt, Homo Sapiens
agggcugugguuuacuccugucuaaaccccugaagccuaacacaguuccuggcacacaacaggu

SEQ ID NO: 746052 - RNA, 64 nt, Homo Sapiens
cagauaagguaggacucaacacuuucuagaaaaagccuaacaaaagucuggguaacagagcgag

SEQ ID NO: 746053 - RNA, 64 nt, Homo Sapiens
ggccgggucugguggcucauaucuccuuauaaaugccuaacacaucaccaggagcuggacugcc

SEQ ID NO: 746054 - RNA, 64 nt, Homo Sapiens; identical to SEQ ID NO: 411830

SEQ ID NO: 746055 - RNA, 64 nt, Homo Sapiens; identical to SEQ ID NO: 411831

SEQ ID NO: 746056 - RNA, 64 nt, Homo Sapiens; identical to SEQ ID NO: 411832

SEQ ID NO: 746057 - RNA, 64 nt, Homo Sapiens; identical to SEQ ID NO: 411833

SEQ ID NO: 746058 - RNA, 64 nt, Homo Sapiens; identical to SEQ ID NO: 411834

SEQ ID NO: 746059 - RNA, 64 nt, Homo Sapiens; identical to SEQ ID NO: 411835

SEQ ID NO: 746060 - RNA, 64 nt, Homo Sapiens; identical to SEQ ID NO: 411836

SEQ ID NO: 746061 - RNA, 64 nt, Homo Sapiens; identical to SEQ ID NO: 411837

SEQ ID NO: 746062 - RNA, 64 nt, Homo Sapiens; identical to SEQ ID NO: 411838

SEQ ID NO: 746063 - RNA, 64 nt, Homo Sapiens; identical to SEQ ID NO: 411839

SEQ ID NO: 746064 - RNA, 64 nt, Homo Sapiens; identical to SEQ ID NO: 411840

SEQ ID NO: 746065 - RNA, 64 nt, Homo Sapiens; identical to SEQ ID NO: 411841

SEQ ID NO: 746066 - RNA, 64 nt, Homo Sapiens; identical to SEQ ID NO: 411842

SEQ ID NO: 746067 - RNA, 64 nt, Homo Sapiens; identical to SEQ ID NO: 411843

SEQ ID NO: 746068 - RNA, 64 nt, Homo Sapiens; identical to SEQ ID NO: 411844

SEQ ID NO: 746069 - RNA, 64 nt, Homo Sapiens; identical to SEQ ID NO: 411845

SEQ ID NO: 746070 - RNA, 64 nt, Homo Sapiens; identical to SEQ ID NO: 411846

SEQ ID NO: 746071 - RNA, 64 nt, Homo Sapiens; identical to SEQ ID NO: 411847

SEQ ID NO: 746072 - RNA, 64 nt, Homo Sapiens; identical to SEQ ID NO: 411848

SEQ ID NO: 746073 - RNA, 64 nt, Homo Sapiens; identical to SEQ ID NO: 411849

SEQ ID NO: 746074 - RNA, 64 nt, Homo Sapiens; identical to SEQ ID NO: 411850

SEQ ID NO: 746075 - RNA, 64 nt, Homo Sapiens; identical to SEQ ID NO: 411851

SEQ ID NO: 746076 - RNA, 64 nt, Homo Sapiens; identical to SEQ ID NO: 411852

SEQ ID NO: 746077 - RNA, 64 nt, Homo Sapiens; identical to SEQ ID NO: 411853

SEQ ID NO: 746078 - RNA, 64 nt, Homo Sapiens; identical to SEQ ID NO: 411854

SEQ ID NO: 746079 - RNA, 64 nt, Homo Sapiens; identical to SEQ ID NO: 411855

SEQ ID NO: 746080 - RNA, 64 nt, Homo Sapiens; identical to SEQ ID NO: 411856

SEQ ID NO: 746081 - RNA, 64 nt, Homo Sapiens; identical to SEQ ID NO: 364288

SEQ ID NO: 746082 - RNA, 64 nt, Homo Sapiens; identical to SEQ ID NO: 364289

SEQ ID NO: 746083 - RNA, 64 nt, Homo Sapiens; identical to SEQ ID NO: 364290

SEQ ID NO: 746084 - RNA, 64 nt, Homo Sapiens; identical to SEQ ID NO: 364291

SEQ ID NO: 746085 - RNA, 64 nt, Homo Sapiens; identical to SEQ ID NO: 364292

SEQ ID NO: 746086 - RNA, 64 nt, Homo Sapiens; identical to SEQ ID NO: 364293

SEQ ID NO: 746087 - RNA, 64 nt, Homo Sapiens
gucuccagcuaaccucucaaucaggcaaacauucuucuuggaggaaucaggcaaacaucucaaa

SEQ ID NO: 746088 - RNA, 64 nt, Homo Sapiens
uccuucucucccuuucucauucucauuccaccuguucuuggaacucacggagaccuacaguccc

SEQ ID NO: 746089 - RNA, 64 nt, Homo Sapiens
cagagcauucuuuuccucaaaacgagcugcauaauucuuggaauuuaugucuuaccacauggug

SEQ ID NO: 746090 - RNA, 64 nt, Homo Sapiens
gcuugcucaggagagggaauaacgcaggucccuuuucuuggaaggcuuguacuauggccaugac

SEQ ID NO: 746091 - RNA, 64 nt, Homo Sapiens
ucccagcuagagggagauaaagagggcuaguuaguucuuggagcagcugcuuuugaggagaaaa

SEQ ID NO: 746092 - RNA, 64 nt, Homo Sapiens
aauuaucauugaacauauuaaugguuauuucuuuuucuuggauuuccagaaaagccucuuaauu

SEQ ID NO: 746093 - RNA, 64 nt, Homo Sapiens
ugucguccuggggcaguuuuggggcacuauaguguucuuggacuguggaguguucgggaugcag

SEQ ID NO: 746094 - RNA, 64 nt, Homo Sapiens
cucaguuucccugucuguaaggugagucauugucuucuuggagcuuccuugcugugugaccuug

SEQ ID NO: 746095 - RNA, 64 nt, Homo Sapiens
guauccugcucagaaccauucacauuuaauucaauucuuggaaaaaauuaaagcuuuuugccca

SEQ ID NO: 746096 - RNA, 64 nt, Homo Sapiens
ucaugauguugcauuaauaguuguuuuugucccuuucuuggaaauguuaaugccaaaguugccu

SEQ ID NO: 746097 - RNA, 64 nt, Homo Sapiens
uguaaugaugagcuugguggagaagaaugagucguucuuggaauaccuaugugcagccacuacc

SEQ ID NO: 746098 - RNA, 64 nt, Homo Sapiens
agccacuacccaucucaaugucaccuuguuugcauucuuggauagcuuguauauguaguaguuu

SEQ ID NO: 746099 - RNA, 64 nt, Homo Sapiens
gggaaaggccaguggcuggagaccccaugugcaguucuuggauacucugggagguguuccccuc

SEQ ID NO: 746100 - RNA, 64 nt, Homo Sapiens
ucacgaugguguaugagugucaaucaucugacccuucuuggagucucauauuucguggaacucc

SEQ ID NO: 746101 - RNA, 64 nt, Homo Sapiens
uuuagcuauuguccuccaaacucaaaccugaugauucuuggauaaaagugauuaagcaauauuu

SEQ ID NO: 746102 - RNA, 64 nt, Homo Sapiens
guacucuucgcauggacuggagaaauuugauuuauucuuggacuauguagcauaaaaugcguuc

SEQ ID NO: 746103 - RNA, 64 nt, Homo Sapiens
gucuggccagauucucacuugcccaucaaucucguucuuggaugauuucccucauugugaugcu

SEQ ID NO: 746104 - RNA, 64 nt, Homo Sapiens
gacuguggcauucacuguccuugaguguuucaccuucuuggauaacacacgggccuucucuucu

SEQ ID NO: 746105 - RNA, 64 nt, Homo Sapiens
auuaucuucucuacuuggauuaugagauaaccuuuucuuggaggaaagaaacaccgcuuuacaa

SEQ ID NO: 746106 - RNA, 64 nt, Homo Sapiens
auauucagucucagucugcuauagguauuuguuauucuuggauacuacacaccugcucagacug

SEQ ID NO: 746107 - RNA, 64 nt, Homo Sapiens
ugcugucuaaaugauauauauaugccuggucaccuucuuggaucagccauagaagaaacuugac

SEQ ID NO: 746108 - RNA, 64 nt, Homo Sapiens
ugauacuuucuucagauccugcuucaguaagauauucuuggacuccaguuuacuaccagaaagg

SEQ ID NO: 746109 - RNA, 64 nt, Homo Sapiens
agcagaaggaaaaacuaaaauggagugauugugguucuuggaaauguuucucauaagcgauguc

SEQ ID NO: 746110 - RNA, 64 nt, Homo Sapiens
gauccugugaaguauuguuaaucagcacugggcauucuuggaggcuuacugcuaguguugcuac

SEQ ID NO: 746111 - RNA, 64 nt, Homo Sapiens
gugcugugggccucaggcguuucugaagugcucuuucuuggauuggacaggagaucagcagcgu

SEQ ID NO: 746112 - RNA, 64 nt, Homo Sapiens
gucuucccuagaccuuggcauccugugcuucuauuucuuggaauacguucuccucugaccugcc

SEQ ID NO: 746113 - RNA, 64 nt, Homo Sapiens
cauauucagagucuggggcuuuuuuucagaauauuucuuggaauguuuauuccagcgaugugac

SEQ ID NO: 746114 - RNA, 64 nt, Homo Sapiens
gugaggguggcuugggaaccguuccauucaugccuucuuggaggcgugcucuguucucgggguu

SEQ ID NO: 746115 - RNA, 64 nt, Homo Sapiens
acuaaauacaggcuuagaacuugcagaguguguauucuuggauggcugaugcaucgacuugcau

SEQ ID NO: 746116 - RNA, 64 nt, Homo Sapiens
aaaucacuaguccuuauuuuuaaaggucuaugguuucuuggaaguaguuugauuguugagagag

SEQ ID NO: 746117 - RNA, 64 nt, Homo Sapiens
uguguuagaaugagugcuuugggguagccauugguucuuggaucuugaugcuguuaagguaccc

SEQ ID NO: 746118 - RNA, 64 nt, Homo Sapiens
uuccauuccuuggucaugcucaggccagggcacauucuuggauuagccaggccugagccccaca

SEQ ID NO: 746119 - RNA, 64 nt, Homo Sapiens
ucacagggaagauugaagagagagaucuugucguuucuuggaaggguuuaccgauggaugggcu

SEQ ID NO: 746120 - RNA, 64 nt, Homo Sapiens
aucuagguaauucaagcccuaaggaauugaacacuucuuggaaaaugccagaaugagcaaccuc

SEQ ID NO: 746121 - RNA, 64 nt, Homo Sapiens
cguguugauguggauggcaccucccugagacucuuucuuggacauuguuuuuugauacccuugu

SEQ ID NO: 746122 - RNA, 64 nt, Homo Sapiens
uuucuguuuuuacuugcaucuauucagaguuacauucuuggaagauuguucuauagggcuggaa

SEQ ID NO: 746123 - RNA, 64 nt, Homo Sapiens
cuucaugguccagggguaggagugcuuccagcccuucuuggagcccucaggagagagaaaacuu

SEQ ID NO: 746124 - RNA, 64 nt, Homo Sapiens
gcucaucccccgcuauaccucuagaaggagagacuucuuggaaccaugaguugggugcagacac

SEQ ID NO: 746125 - RNA, 64 nt, Homo Sapiens
cacugcuuuucaugcaggaguuacagacacugguuucuuggaaaauggagagaagcgcacuuug

SEQ ID NO: 746126 - RNA, 64 nt, Homo Sapiens
guugcacauuuugcacugguuuauggcgauuguuuucuuggacggauaguguaaaauaaacuuc

SEQ ID NO: 746127 - RNA, 64 nt, Homo Sapiens
ucugcguagaugggugacucagccuuaguuucuauucuuggaugucccaguugaaucagaaggg

SEQ ID NO: 746128 - RNA, 64 nt, Homo Sapiens
gggagucuccucggcucccuccugggcccucugcuucuuggaggccgaccgcuggagacugcgg

SEQ ID NO: 746129 - RNA, 64 nt, Homo Sapiens; identical to SEQ ID NO: 592636

SEQ ID NO: 746130 - RNA, 64 nt, Homo Sapiens; identical to SEQ ID NO: 592637

SEQ ID NO: 746131 - RNA, 64 nt, Homo Sapiens; identical to SEQ ID NO: 592638

SEQ ID NO: 746132 - RNA, 64 nt, Homo Sapiens; identical to SEQ ID NO: 592639

SEQ ID NO: 746133 - RNA, 64 nt, Homo Sapiens; identical to SEQ ID NO: 592640

SEQ ID NO: 746134 - RNA, 64 nt, Homo Sapiens; identical to SEQ ID NO: 592641

SEQ ID NO: 746135 - RNA, 64 nt, Homo Sapiens; identical to SEQ ID NO: 592642

SEQ ID NO: 746136 - RNA, 64 nt, Homo Sapiens; identical to SEQ ID NO: 592643

SEQ ID NO: 746137 - RNA, 64 nt, Homo Sapiens; identical to SEQ ID NO: 592644

SEQ ID NO: 746138 - RNA, 64 nt, Homo Sapiens; identical to SEQ ID NO: 592645

SEQ ID NO: 746139 - RNA, 64 nt, Homo Sapiens; identical to SEQ ID NO: 592646

SEQ ID NO: 746140 - RNA, 64 nt, Homo Sapiens; identical to SEQ ID NO: 592647

SEQ ID NO: 746141 - RNA, 64 nt, Homo Sapiens; identical to SEQ ID NO: 592648

SEQ ID NO: 746142 - RNA, 64 nt, Homo Sapiens; identical to SEQ ID NO: 592649

SEQ ID NO: 746143 - RNA, 64 nt, Homo Sapiens; identical to SEQ ID NO: 592650

SEQ ID NO: 746144 - RNA, 64 nt, Homo Sapiens; identical to SEQ ID NO: 592651

SEQ ID NO: 746145 - RNA, 64 nt, Homo Sapiens; identical to SEQ ID NO: 592652

SEQ ID NO: 746146 - RNA, 64 nt, Homo Sapiens; identical to SEQ ID NO: 592653

SEQ ID NO: 746147 - RNA, 64 nt, Homo Sapiens; identical to SEQ ID NO: 592654

SEQ ID NO: 746148 - RNA, 64 nt, Homo Sapiens; identical to SEQ ID NO: 592655

SEQ ID NO: 746149 - RNA, 64 nt, Homo Sapiens; identical to SEQ ID NO: 592656

SEQ ID NO: 746150 - RNA, 64 nt, Homo Sapiens; identical to SEQ ID NO: 592657

SEQ ID NO: 746151 - RNA, 64 nt, Homo Sapiens; identical to SEQ ID NO: 592658

SEQ ID NO: 746152 - RNA, 64 nt, Homo Sapiens; identical to SEQ ID NO: 592659

SEQ ID NO: 746153 - RNA, 64 nt, Homo Sapiens; identical to SEQ ID NO: 592660

SEQ ID NO: 746154 - RNA, 64 nt, Homo Sapiens; identical to SEQ ID NO: 592661

SEQ ID NO: 746155 - RNA, 64 nt, Homo Sapiens; identical to SEQ ID NO: 592662

SEQ ID NO: 746156 - RNA, 64 nt, Homo Sapiens; identical to SEQ ID NO: 592663

SEQ ID NO: 746157 - RNA, 64 nt, Homo Sapiens; identical to SEQ ID NO: 592664

SEQ ID NO: 746158 - RNA, 64 nt, Homo Sapiens; identical to SEQ ID NO: 592665

SEQ ID NO: 746159 - RNA, 64 nt, Homo Sapiens; identical to SEQ ID NO: 592666

SEQ ID NO: 746160 - RNA, 64 nt, Homo Sapiens; identical to SEQ ID NO: 592667

SEQ ID NO: 746161 - RNA, 64 nt, Homo Sapiens; identical to SEQ ID NO: 592668

SEQ ID NO: 746162 - RNA, 64 nt, Homo Sapiens; identical to SEQ ID NO: 592669

SEQ ID NO: 746163 - RNA, 64 nt, Homo Sapiens; identical to SEQ ID NO: 592670

SEQ ID NO: 746164 - RNA, 64 nt, Homo Sapiens; identical to SEQ ID NO: 592671

SEQ ID NO: 746165 - RNA, 64 nt, Homo Sapiens; identical to SEQ ID NO: 592672

SEQ ID NO: 746166 - RNA, 64 nt, Homo Sapiens; identical to SEQ ID NO: 592673

SEQ ID NO: 746167 - RNA, 64 nt, Homo Sapiens; identical to SEQ ID NO: 592674

SEQ ID NO: 746168 - RNA, 64 nt, Homo Sapiens; identical to SEQ ID NO: 592675

SEQ ID NO: 746169 - RNA, 64 nt, Homo Sapiens; identical to SEQ ID NO: 592676

SEQ ID NO: 746170 - RNA, 64 nt, Homo Sapiens; identical to SEQ ID NO: 592677

SEQ ID NO: 746171 - RNA, 64 nt, Homo Sapiens; identical to SEQ ID NO: 592678

SEQ ID NO: 746172 - RNA, 64 nt, Homo Sapiens; identical to SEQ ID NO: 592679

SEQ ID NO: 746173 - RNA, 64 nt, Homo Sapiens; identical to SEQ ID NO: 592680

SEQ ID NO: 746174 - RNA, 64 nt, Homo Sapiens; identical to SEQ ID NO: 592681

SEQ ID NO: 746175 - RNA, 64 nt, Homo Sapiens; identical to SEQ ID NO: 592682

SEQ ID NO: 746176 - RNA, 64 nt, Homo Sapiens; identical to SEQ ID NO: 592683

SEQ ID NO: 746177 - RNA, 64 nt, Homo Sapiens; identical to SEQ ID NO: 275105

SEQ ID NO: 746178 - RNA, 64 nt, Homo Sapiens; identical to SEQ ID NO: 275106

SEQ ID NO: 746179 - RNA, 64 nt, Homo Sapiens; identical to SEQ ID NO: 275107

SEQ ID NO: 746180 - RNA, 64 nt, Homo Sapiens; identical to SEQ ID NO: 275108

SEQ ID NO: 746181 - RNA, 64 nt, Homo Sapiens; identical to SEQ ID NO: 275109

SEQ ID NO: 746182 - RNA, 64 nt, Homo Sapiens; identical to SEQ ID NO: 275110

SEQ ID NO: 746183 - RNA, 64 nt, Homo Sapiens; identical to SEQ ID NO: 275111

SEQ ID NO: 746184 - RNA, 64 nt, Homo Sapiens; identical to SEQ ID NO: 275112

SEQ ID NO: 746185 - RNA, 64 nt, Homo Sapiens; identical to SEQ ID NO: 275113

SEQ ID NO: 746186 - RNA, 64 nt, Homo Sapiens; identical to SEQ ID NO: 275114

SEQ ID NO: 746187 - RNA, 64 nt, Homo Sapiens; identical to SEQ ID NO: 275115

SEQ ID NO: 746188 - RNA, 64 nt, Homo Sapiens; identical to SEQ ID NO: 275116

SEQ ID NO: 746189 - RNA, 64 nt, Homo Sapiens; identical to SEQ ID NO: 275117

SEQ ID NO: 746190 - RNA, 64 nt, Homo Sapiens; identical to SEQ ID NO: 275118

SEQ ID NO: 746191 - RNA, 64 nt, Homo Sapiens; identical to SEQ ID NO: 275119

SEQ ID NO: 746192 - RNA, 64 nt, Homo Sapiens; identical to SEQ ID NO: 275120

SEQ ID NO: 746193 - RNA, 64 nt, Homo Sapiens; identical to SEQ ID NO: 275121

SEQ ID NO: 746194 - RNA, 64 nt, Homo Sapiens; identical to SEQ ID NO: 275122

SEQ ID NO: 746195 - RNA, 64 nt, Homo Sapiens
gagccugcccucguuuccaguucugagcggaaccguccuggagacuucucaggaggccaggccc

SEQ ID NO: 746196 - RNA, 64 nt, Homo Sapiens
ggacugaacauccagaaagccagaaacuuagugaguccuggacucucccugcaugacagucccc

SEQ ID NO: 746197 - RNA, 64 nt, Homo Sapiens
ggggcacuccuccuacucuguggaugaugugauuguccuggaaaucgaggugaaaggcucagua

SEQ ID NO: 746198 - RNA, 64 nt, Homo Sapiens
cuuggaggcccugcacugccagcaucuggagaccguccuggagcuggagguggaaaauggugcc

SEQ ID NO: 746199 - RNA, 64 nt, Homo Sapiens
gaggaagcccuaauccgcccacaggaagccugcaguccuggaagcgcgagggccucaaaggccc

SEQ ID NO: 746200 - RNA, 64 nt, Homo Sapiens
ccccucugucuugugaaggcagggggaaggugggguccuggagcagaccaccccgccugcccuc

SEQ ID NO: 746201 - RNA, 64 nt, Homo Sapiens
ccccaaggucaccgacgaugagggcgcaccugcuguccuggagcuuccgaucucuguucgggga

SEQ ID NO: 746202 - RNA, 64 nt, Homo Sapiens
ggcuggugugggcagcuguucccugccucgcaguguccuggaggcagcugucucgcagacucag

SEQ ID NO: 746203 - RNA, 64 nt, Homo Sapiens
uccugcaggaugcugcauaggaaugggcagagauguccuggaugggaacaugguccuggaggug

SEQ ID NO: 746204 - RNA, 64 nt, Homo Sapiens
aggaaugggcagagauguccuggaugggaacaugguccuggaggugcccuaccugcauccugcu

SEQ ID NO: 746205 - RNA, 64 nt, Homo Sapiens
agacaugaguuccgagaugauguguuguugcuguguccuggaggaugaggcuguuccuugaaaa

SEQ ID NO: 746206 - RNA, 64 nt, Homo Sapiens
uucugcugcuucuccaagcugcgugcuuucaaguguccuggaaaucauccggggcuuugccaga

SEQ ID NO: 746207 - RNA, 64 nt, Homo Sapiens
ccucuugggggugggaccuuaugccuuggugcggguccuggaggagcagccacgaguguccccc

SEQ ID NO: 746208 - RNA, 64 nt, Homo Sapiens
ggggccgggcaggcaggggccaccuguuuggcagguccuggacucacuugcagagccuugagau

SEQ ID NO: 746209 - RNA, 64 nt, Homo Sapiens
uggccucccccaucccuaggcuaaagagccaugaguccuggaggaggagaggaccccucccaaa

SEQ ID NO: 746210 - RNA, 64 nt, Homo Sapiens
gggucuugugaagucugagguuuaacaguuuguuguccuggagggauuuucuuacagcgaagac

SEQ ID NO: 746211 - RNA, 64 nt, Homo Sapiens
ccagccccaccaaguacgcagagacccccuugucguccuggacaccacaggggcaccugcaggc

SEQ ID NO: 746212 - RNA, 64 nt, Homo Sapiens
ugaaaaaaaaaaaaggggagcagggaggcagaaaguccuggaaaaguaaauuguuuauuuuaca

SEQ ID NO: 746213 - RNA, 64 nt, Homo Sapiens
gcauuuccacacuauuggugugucauccccccagggucuccaagggcccgucagagucaagaga

SEQ ID NO: 746214 - RNA, 64 nt, Homo Sapiens
ucugcccaggaaagaacuucaauggagaauuucaggucuccacgacuggcccaguuuacaguga

SEQ ID NO: 746215 - RNA, 64 nt, Homo Sapiens
gcucuggcuucugugauggugcaagaggcaggauggucuccagacaccuucuugcagagugauu

SEQ ID NO: 746216 - RNA, 64 nt, Homo Sapiens
uguucuggaaaggaccccauggcagacuuggcaaggucuccacuucaggggcaaacaucuccau

SEQ ID NO: 746217 - RNA, 64 nt, Homo Sapiens
agcagcucacuucucuguguucugccuccccucuggucuccagaguuuuccuguccucuagagg

SEQ ID NO: 746218 - RNA, 64 nt, Homo Sapiens
auucccauugcucuccuggcucacucuuacggucggucuccagugacugaagcauuccccaccc

SEQ ID NO: 746219 - RNA, 64 nt, Homo Sapiens
aaggcuuuguuagcccccacuuuuuccuccuacuggucuccaccccugaccugccccuuccuug

SEQ ID NO: 746220 - RNA, 64 nt, Homo Sapiens
gccacuguggaccgggaccccaucccugucuguuggucuccauggccaugccagugucugugca

SEQ ID NO: 746221 - RNA, 64 nt, Homo Sapiens
gggcuccccggcccugggugggcggugggcagcuggucuccagggacucagugaguggcugugc

SEQ ID NO: 746222 - RNA, 64 nt, Homo Sapiens
ggaugcaaagggcaggugagucaagaaccgcauaggucuccaguccccacggggcucccaggcc

SEQ ID NO: 746223 - RNA, 64 nt, Homo Sapiens
ggaugacuguuuucaaucuccacuggggggcuggggucuccagggagaggcuggcacuaggggc

SEQ ID NO: 746224 - RNA, 64 nt, Homo Sapiens
agaggguguuguuuucuccuggcagagggggccuggucuccauuccuaaggguuguaggaccuu

SEQ ID NO: 746225 - RNA, 64 nt, Homo Sapiens
aaguuuuauuuuucauuuuuuaaauaauggaaauggucuccaaguaguuucauugauuuaauca

SEQ ID NO: 746226 - RNA, 64 nt, Homo Sapiens
uucugaaugaaaaagcuacacucagugaaaagauggucuccaguggaagaggaaggaauaacaa

SEQ ID NO: 746227 - RNA, 64 nt, Homo Sapiens
cuucacucaggguagagaaacaccggugaggaagggucuccaggccucccaggcacugcagagg

SEQ ID NO: 746228 - RNA, 64 nt, Homo Sapiens
cuuuauuccucccaggcacugcccgguggggaagggucuccaggugcucccaggcacugcagag

SEQ ID NO: 746229 - RNA, 64 nt, Homo Sapiens
cauaccaggugcuagggugccugcucuccuugcccugggccagcccaggauuguacgugggaga

SEQ ID NO: 746230 - RNA, 64 nt, Homo Sapiens
cggggaggagccuuggaguguaauuaccugucaucugggccaccagcuccacuggccugcccgu

SEQ ID NO: 746231 - RNA, 64 nt, Homo Sapiens
aacacguagacaggcuguaauauucaaaccaccucugggccaaugcauuuccaaaggaugccuu

SEQ ID NO: 746232 - RNA, 64 nt, Homo Sapiens
cgauuugagccucuccggcugccagccagggggccugggccagaccagggcucuguccuuccgu

SEQ ID NO: 746233 - RNA, 64 nt, Homo Sapiens
uggggcaccuuaccaccggagauaaccucuccuccugggccaccuccuggaagagcucccagaa

SEQ ID NO: 746234 - RNA, 64 nt, Homo Sapiens
acuguggacuccuccugggaucuucagacagaagcugggccagcaaggcuccucugcuugggau

SEQ ID NO: 746235 - RNA, 64 nt, Homo Sapiens
ucuguugccuaccuggccugccagaaagauauggcugggccaacucccaggggauucagagucu

SEQ ID NO: 746236 - RNA, 64 nt, Homo Sapiens
ucuggaagggcuguauuuggugcucuuccagcuccugggccagcguauaaagcuagugugaccc

SEQ ID NO: 746237 - RNA, 64 nt, Homo Sapiens
gaggguccuacagacaagguugugaaaucagccucugggccaagccucagucugguauccagac

SEQ ID NO: 746238 - RNA, 64 nt, Homo Sapiens
ccuggcccuguagcacagaccggcuugggauccucugggccaucggugcgaagcccagaggagg

SEQ ID NO: 746239 - RNA, 64 nt, Homo Sapiens
gccugagaugacaguggggacucacaccgugguccugggccaggcagcccuggagccaucacua

SEQ ID NO: 746240 - RNA, 64 nt, Homo Sapiens
acagauggggcuuuguggccuugaggccuggcagcugggccaagagggacauggacccacgugc

SEQ ID NO: 746241 - RNA, 64 nt, Homo Sapiens
ugcccugccaggaaagggacaaaagagaagcagucugggccagacacuaggacuacuuuuuacc

SEQ ID NO: 746242 - RNA, 64 nt, Homo Sapiens
cccuuggagcucucagaucucagaggaaugggggcugggccacuucuuuucagaaggcuaaagu

SEQ ID NO: 746243 - RNA, 64 nt, Homo Sapiens
ccuggccagggacaugaauucuggucuugaacuccugggccaugguuucacucuguuucccagg

SEQ ID NO: 746244 - RNA, 64 nt, Homo Sapiens
cucuccguccucagggcugugccucugggagccacugggccaggggccccgggucgcagagagc

SEQ ID NO: 746245 - RNA, 64 nt, Homo Sapiens
agggcuccucuggcccgcaguggccuggaucuaucugggccaugagugacgggcagugaccaga

SEQ ID NO: 746246 - RNA, 64 nt, Homo Sapiens
ggggccuucugcugcugccacacccagcucaggccugggccagccccugcccccagcccacuga

SEQ ID NO: 746247 - RNA, 64 nt, Homo Sapiens
ugguugauuuuucuaaagcuucaguccuucagggcugggccaugggaucccgcacaagcucccu

SEQ ID NO: 746248 - RNA, 64 nt, Homo Sapiens
gauggagggcggccgccagccccuagagcccggccugggccaauccagacagcuucccagcagg

SEQ ID NO: 746249 - RNA, 64 nt, Homo Sapiens
cuggucucccugccccaugccaccucuguccugucugggccaacccagcacccugucccuggag

SEQ ID NO: 746250 - RNA, 64 nt, Homo Sapiens
gagaggccucccccaugccugcucagugcagucccugggccaguccaggggcaggccaggcaug

SEQ ID NO: 746251 - RNA, 64 nt, Homo Sapiens
gcugguuguugccagguugcagcugcucuugcaucugggccagaaguccucccuccugcaggcu

SEQ ID NO: 746252 - RNA, 64 nt, Homo Sapiens
cccgugucuggaugcacagaugccauggccugugcugggccaguggcugggggugcuagacacc

SEQ ID NO: 746253 - RNA, 64 nt, Homo Sapiens
gugugggaaccccucugccuggcaccuggauacccugggccagguaaccugagggcaggggaga

SEQ ID NO: 746254 - RNA, 64 nt, Homo Sapiens
uuuucaugucccccaccucauguuuucaccuuuucugggccaggcauagauuaaguaacuggga

SEQ ID NO: 746255 - RNA, 64 nt, Homo Sapiens
ggccccagggcccaggagggacagugccuggagccugggccaggcccagcccaucugugugugu

SEQ ID NO: 746256 - RNA, 64 nt, Homo Sapiens
cgcauacacacggccaugcacgcacacacugggccugggccagggccccagagcuccugccuga

SEQ ID NO: 746257 - RNA, 64 nt, Homo Sapiens
acuggaaggagacaucugucgcucagaggacagucugggccagaggaggagcccugugcuccca

SEQ ID NO: 746258 - RNA, 64 nt, Homo Sapiens
cacguuuguuaucauggcuggggcaggucugggccugggccaacugcuguucucuguugccagg

SEQ ID NO: 746259 - RNA, 64 nt, Homo Sapiens
uggacagauucccaccuguauguagcacgccaugcugggccagcagugucauaggaguggaggg

SEQ ID NO: 746260 - RNA, 64 nt, Homo Sapiens
ugcccgccagggcucagguuccucugagcugguccugggccaggacgcaucugcauggcggugg

SEQ ID NO: 746261 - RNA, 64 nt, Homo Sapiens
ggggcugcucacccaccucucagaggcugcaccccugggccagcugcggugggugcugccauga

SEQ ID NO: 746262 - RNA, 64 nt, Homo Sapiens
ucuuaggugagacaguugccugccuggccccagccugggccaucggcacucagugagccuccug

SEQ ID NO: 746263 - RNA, 64 nt, Homo Sapiens
guuaggcuagagacagaugcugguggaggaagggcugggccaccagggaucacagaccacagga

SEQ ID NO: 746264 - RNA, 64 nt, Homo Sapiens
ugcugucugaguaguggccacuggggugccuucacugggccagucaacggggggcuccugccca

SEQ ID NO: 746265 - RNA, 64 nt, Homo Sapiens
cugaggagggcuggagcucgggaaguuguccuuccugggccagggccguuucuggcacugggag

SEQ ID NO: 746266 - RNA, 64 nt, Homo Sapiens
aggaugaggcagaggcaugaugcuuccugcucaccugggccacccucucuccaggacuugucag

SEQ ID NO: 746267 - RNA, 64 nt, Homo Sapiens
ggggcaccuccugggcacuugagccgugucacuccugggccaugaugggcucuggcugcugggg

SEQ ID NO: 746268 - RNA, 64 nt, Homo Sapiens
gauauugcuccagaccgaguacuaaagaggucagcugggccaaucacccuugauuggguuuugc

SEQ ID NO: 746269 - RNA, 64 nt, Homo Sapiens
gacucaacaauggggacagacugaccacccagagcugggccagggccagggaggacacgcucca

SEQ ID NO: 746270 - RNA, 60 nt, Homo Sapiens
gaggacacgcuccacugaccccacccagagcugggccaggacacggacacgcucugcuga

SEQ ID NO: 746271 - RNA, 64 nt, Homo Sapiens
gggccagggcccuggguggggagguguggguucccugggccaagaccagccuuuuuccucaguu

SEQ ID NO: 746272 - RNA, 64 nt, Homo Sapiens
gauggucacccagagccauagagcacccuuccuccugggccagagcuggguuaucaugguuggc

SEQ ID NO: 746273 - RNA, 64 nt, Homo Sapiens
ggcuuugaggagaggguaaacugcucugccugggcugggccaggaaugguccacugagggccuc

SEQ ID NO: 746274 - RNA, 64 nt, Homo Sapiens
cucccaggcaccagacacagggacaagauggacacugggccaccgggauguggcagcaucagug

SEQ ID NO: 746275 - RNA, 64 nt, Homo Sapiens
uccuccugcuggugcuccaucccccaauaccaggcugggccaccacucugaggaggguaggagg

SEQ ID NO: 746276 - RNA, 64 nt, Homo Sapiens
auuccucugggggcuggcgcaugcccaggaaagccugggccacacgggacacucucuucuuuau

SEQ ID NO: 746277 - RNA, 64 nt, Homo Sapiens
uccccuuccauaccccuuccuggaucuccagugccugggccaggaaagcccucuggguuccggg

SEQ ID NO: 746278 - RNA, 64 nt, Homo Sapiens
aaagcccucuggguuccgggaagccccguccacccugggccauggggccgguuggaaggauacu

SEQ ID NO: 746279 - RNA, 64 nt, Homo Sapiens
uggguggcuagguugccucauccccccuugaccacugggccaguugacuagcggccaccucauu

SEQ ID NO: 746280 - RNA, 64 nt, Homo Sapiens
agucugccaggagccaggaggacacaggccaggccugggccaggagcgcauggcuccggaagca

SEQ ID NO: 746281 - RNA, 64 nt, Homo Sapiens
cccacagacucaaaguuacucuccuucccccuaccugggccagugaaauagaaagccuuucuau

SEQ ID NO: 746282 - RNA, 64 nt, Homo Sapiens
gcccugaguuuccauuacugugggugggguuccccugggccaaacagugauuugucucccucaa

SEQ ID NO: 746283 - RNA, 64 nt, Homo Sapiens
gcaggcucgggagauagauugggcagggaaaggacugggccaggugugcaauagggugggguag

SEQ ID NO: 746284 - RNA, 64 nt, Homo Sapiens
cccauagccauguuuacauggccucacugcuguucugggccaucaucuguuuacacaucaaucu

SEQ ID NO: 746285 - RNA, 64 nt, Homo Sapiens
gcgccauaggcagaggcuuauaaagaaauggguucugggccaggugugguggcucaagccugua

SEQ ID NO: 746286 - RNA, 64 nt, Homo Sapiens
cgcgcccaccgcaggugggacucagguucgcccucugggccagguccuucacgaggagggagcu

SEQ ID NO: 746287 - RNA, 64 nt, Homo Sapiens
ucccuggauagcaggaacuugcagcagggaagcucugggccaccggacucugcuuccuccagga

SEQ ID NO: 746288 - RNA, 64 nt, Homo Sapiens
uuggacucugcuuccuccaggcccggggccucaucugggccagcacccacacagaagcagugcu

SEQ ID NO: 746289 - RNA, 64 nt, Homo Sapiens
uccagccauccuccugccucagcuucccagauagcugggccacaggcgugugccaccacaccug

SEQ ID NO: 746290 - RNA, 64 nt, Homo Sapiens
cucagccauggcugugugcuuuggcccugcagcucugggccaccugcugguguccaccucgucc

SEQ ID NO: 746291 - RNA, 64 nt, Homo Sapiens
uggaccugauggcccccuguggcgccuugaccugcugggccaggcugcccugggacucucagcc

SEQ ID NO: 746292 - RNA, 64 nt, Homo Sapiens
ccuggccagcccacuggauuggggacgggccaggcugggccaggucgggggcucagucugggag

SEQ ID NO: 746293 - RNA, 64 nt, Homo Sapiens
ugugccuucagcagccccuguccucaccaugggccugggccaggugugacagaguagagguagc

SEQ ID NO: 746294 - RNA, 64 nt, Homo Sapiens
uuugguucccacucagcuucugccggucggcagccugggccaggcccuuuuccugcaugugcca

SEQ ID NO: 746295 - RNA, 64 nt, Homo Sapiens
cacucuuauugguaagcuauaggagacucaggaucugggccaaccucaaggugggggcuucaga

SEQ ID NO: 746296 - RNA, 64 nt, Homo Sapiens
uuucagcacagaaccugaaugccaggaaaaauuccugggccaagaagcuaaagcuaaagaaacc

SEQ ID NO: 746297 - RNA, 64 nt, Homo Sapiens
ccagaaaggugcuuuccuucagacggugcagggccugggccagccuuacaggucaguagacuag

SEQ ID NO: 746298 - RNA, 64 nt, Homo Sapiens
augaugugacuuugaggccccaacaugacagccacugggccaccgggacccaagaagacagccc

SEQ ID NO: 746299 - RNA, 64 nt, Homo Sapiens
gcucauggcuggauaauuucgcuucuagaagcaucugggccaggaaguucucaguucccuccag

SEQ ID NO: 746300 - RNA, 64 nt, Homo Sapiens
gaugaggacacugugcucaacgguucguugauaccugggccaggcgugggcacguuuuugcaac

SEQ ID NO: 746301 - RNA, 64 nt, Homo Sapiens
gagcucccugucucuggaaguauuuaagaaaaggcugggccaggcacgauggcucacgccugua

SEQ ID NO: 746302 - RNA, 64 nt, Homo Sapiens
ucugugguugaccucucagcaagugcuauccaggcugggccaaccagacccacaauuaacugag

SEQ ID NO: 746303 - RNA, 56 nt, Homo Sapiens
agcuggugccaacuuccugauggguccugggccaggccagccagggagaagacaag

SEQ ID NO: 746304 - RNA, 64 nt, Homo Sapiens
cccgccuucggucuguuccuucaagcaagcuggccugggccaugugccugugaaaggcaggcuc

SEQ ID NO: 746305 - RNA, 64 nt, Homo Sapiens
uucugaugaggcaaaauccuccagcuauuccugucugggccaguuuuguagguccaucugugca

SEQ ID NO: 746306 - RNA, 64 nt, Homo Sapiens
acuuccuggucaagcuuauggugcuuauuuugaucugggccacuucccuccuuccagucaugag

SEQ ID NO: 746307 - RNA, 64 nt, Homo Sapiens
cagggguccuugggccucuacuggggugaagaaucugggccaacacuccaacauugcauccuuu

SEQ ID NO: 746308 - RNA, 64 nt, Homo Sapiens
ggggcugccucuuuuccuuuggccaagacuccuucugggccaaugaugcacucagcuucguguu

SEQ ID NO: 746309 - RNA, 64 nt, Homo Sapiens
ccccaacccagacccccuuuucuccauguaccugcugggccagcccauuucacaggugaggaac

SEQ ID NO: 746310 - RNA, 64 nt, Homo Sapiens
gggcugaacuuugggagggccccuguacuaccuccugggccaagaaacuggcacagccccacac

SEQ ID NO: 746311 - RNA, 64 nt, Homo Sapiens
aaagcugagaugcugagagagauagcucccugagcugggccaucugacuucuaccucccauguu

SEQ ID NO: 746312 - RNA, 64 nt, Homo Sapiens
uguccccagcaaguguaggaguggugggccugaacugggccauugaucagacuaaauaaauuaa

SEQ ID NO: 746313 - RNA, 64 nt, Homo Sapiens
auggccucuuccuccucagggaccucugacugcucugggccaaagaaucucuuguuucuucucc

SEQ ID NO: 746314 - RNA, 64 nt, Homo Sapiens
gguucugcucuuccaggcaggccagcaaguggcgcugggccacacuggcuucuuccugccccau

SEQ ID NO: 746315 - RNA, 64 nt, Homo Sapiens
ccccaggaaggugggguagaugcggggggccuggcugggccagagcccggacacccauagacgg

SEQ ID NO: 746316 - RNA, 64 nt, Homo Sapiens
uuguggagaggccgggugccccaggcugcaggggcugggccaauuugcuuuagggugucagggu

SEQ ID NO: 746317 - RNA, 64 nt, Homo Sapiens
cuuuguuucccucauccucgggggccagcccagucugggccacccuguuccccuagacuucuca

SEQ ID NO: 746318 - RNA, 64 nt, Homo Sapiens
gggaguugcuggcuggccaccacucccuuucaggcugggccacaauaggucugaccccaguccc

SEQ ID NO: 746319 - RNA, 64 nt, Homo Sapiens; identical to SEQ ID NO: 172863

SEQ ID NO: 746320 - RNA, 64 nt, Homo Sapiens; identical to SEQ ID NO: 172864

SEQ ID NO: 746321 - RNA, 64 nt, Homo Sapiens; identical to SEQ ID NO: 172865

SEQ ID NO: 746322 - RNA, 64 nt, Homo Sapiens; identical to SEQ ID NO: 172866

SEQ ID NO: 746323 - RNA, 64 nt, Homo Sapiens; identical to SEQ ID NO: 172867

SEQ ID NO: 746324 - RNA, 64 nt, Homo Sapiens; identical to SEQ ID NO: 172868

SEQ ID NO: 746325 - RNA, 64 nt, Homo Sapiens; identical to SEQ ID NO: 172869

SEQ ID NO: 746326 - RNA, 64 nt, Homo Sapiens; identical to SEQ ID NO: 172870

SEQ ID NO: 746327 - RNA, 64 nt, Homo Sapiens; identical to SEQ ID NO: 172871

SEQ ID NO: 746328 - RNA, 64 nt, Homo Sapiens; identical to SEQ ID NO: 172872

SEQ ID NO: 746329 - RNA, 64 nt, Homo Sapiens; identical to SEQ ID NO: 172873

SEQ ID NO: 746330 - RNA, 64 nt, Homo Sapiens; identical to SEQ ID NO: 172874

SEQ ID NO: 746331 - RNA, 64 nt, Homo Sapiens; identical to SEQ ID NO: 172875

SEQ ID NO: 746332 - RNA, 64 nt, Homo Sapiens; identical to SEQ ID NO: 172876

SEQ ID NO: 746333 - RNA, 64 nt, Homo Sapiens; identical to SEQ ID NO: 172877

SEQ ID NO: 746334 - RNA, 64 nt, Homo Sapiens; identical to SEQ ID NO: 172878

SEQ ID NO: 746335 - RNA, 64 nt, Homo Sapiens; identical to SEQ ID NO: 172879

SEQ ID NO: 746336 - RNA, 64 nt, Homo Sapiens; identical to SEQ ID NO: 172880

SEQ ID NO: 746337 - RNA, 64 nt, Homo Sapiens; identical to SEQ ID NO: 172881

SEQ ID NO: 746338 - RNA, 64 nt, Homo Sapiens; identical to SEQ ID NO: 172882

SEQ ID NO: 746339 - RNA, 64 nt, Homo Sapiens; identical to SEQ ID NO: 172883

SEQ ID NO: 746340 - RNA, 64 nt, Homo Sapiens; identical to SEQ ID NO: 172884

SEQ ID NO: 746341 - RNA, 64 nt, Homo Sapiens; identical to SEQ ID NO: 172885

SEQ ID NO: 746342 - RNA, 64 nt, Homo Sapiens; identical to SEQ ID NO: 172886

SEQ ID NO: 746343 - RNA, 64 nt, Homo Sapiens; identical to SEQ ID NO: 172887

SEQ ID NO: 746344 - RNA, 64 nt, Homo Sapiens; identical to SEQ ID NO: 172888

SEQ ID NO: 746345 - RNA, 64 nt, Homo Sapiens; identical to SEQ ID NO: 172889

SEQ ID NO: 746346 - RNA, 64 nt, Homo Sapiens; identical to SEQ ID NO: 172890

SEQ ID NO: 746347 - RNA, 64 nt, Homo Sapiens; identical to SEQ ID NO: 172891

SEQ ID NO: 746348 - RNA, 64 nt, Homo Sapiens; identical to SEQ ID NO: 172892

SEQ ID NO: 746349 - RNA, 64 nt, Homo Sapiens; identical to SEQ ID NO: 172893

SEQ ID NO: 746350 - RNA, 64 nt, Homo Sapiens; identical to SEQ ID NO: 172894

SEQ ID NO: 746351 - RNA, 64 nt, Homo Sapiens
ggugaccguggcuggcggucacgcccucagccccuccgggcacacgugccgccugaccgggcga

SEQ ID NO: 746352 - RNA, 64 nt, Homo Sapiens
uuccagcaaucuguugguuuugcaagucugaagcuccgggcagagcugagccugguauccaaug

SEQ ID NO: 746353 - RNA, 64 nt, Homo Sapiens
cugaaggcgccagagacuggcggugucuuaagacuccgggcaccgccacgcgcugucaagcaac

SEQ ID NO: 746354 - RNA, 64 nt, Homo Sapiens
guggcuuacgccuguuaaugaaggcccaugcuuguccgggcacauccuguugguguuguaagaa

SEQ ID NO: 746355 - RNA, 64 nt, Homo Sapiens
cagcucuccauccaucccccuugccaccuuccccuccgggcagucgagguuggaccccagcuuc

SEQ ID NO: 746356 - RNA, 64 nt, Homo Sapiens
guggcacaugccuguaaucuaaauacaaaaauuauccgggcaugugaaaccccgucucuacuaa

SEQ ID NO: 746357 - RNA, 64 nt, Homo Sapiens
gcuuucucaguuguauugcuggcaccugcuggaguccgggcagacuuucugggaccaaagaaug

SEQ ID NO: 746358 - RNA, 54 nt, Homo Sapiens
aacccucucuggcgguggccccuguccgggcaucagcccggggaucagacauag

SEQ ID NO: 746359 - RNA, 64 nt, Homo Sapiens
ucccccuucacucagcccccuccugggcccucauuccgggcagggagcccccuccuccccucuc

SEQ ID NO: 746360 - RNA, 64 nt, Homo Sapiens
ccaugacugcucugggccggggguagagcuagcauccgggcauguacgagggaagagggaggca

SEQ ID NO: 746361 - RNA, 64 nt, Homo Sapiens
auuuggguuuaaucucggagaagccuuccccggcuccgggcauucccccagggccuaggguuga

SEQ ID NO: 746362 - RNA, 64 nt, Homo Sapiens
gugaaaccccaucucuacuaaaauacaaaaauuauccgggcaugggggcacacaccgguaaucc

SEQ ID NO: 746363 - RNA, 64 nt, Homo Sapiens
cauccauccaggcacccaacgcugccacccgcuuuccgggcacccgcccgcccucauggacccc

SEQ ID NO: 746364 - RNA, 64 nt, Homo Sapiens
auggccagguugccuaggaggaauacugccugcauccgggcaccugacuuuggaagaaacucuu

SEQ ID NO: 746365 - RNA, 64 nt, Homo Sapiens
gaccaccgcgccccucugcgacgaccgacgccccuccgggcagaaacguuagacugcaauacua

SEQ ID NO: 746366 - RNA, 64 nt, Homo Sapiens
uuguggcguugaucuccuugcguccuugggcaucuccgggcaucagacccucucccuggcccuu

SEQ ID NO: 746367 - RNA, 64 nt, Homo Sapiens
agccuucccugcagccccuccccaacaggcuugguccgggcagccugcucugcggaagguggca

SEQ ID NO: 746368 - RNA, 55 nt, Homo Sapiens
aauucuauccaacuuaaaaaagguuuccgggcaguuucguggggagagagcguag

SEQ ID NO: 746369 - RNA, 64 nt, Homo Sapiens
acuggggacagguuggaaguccucccauuaaagauccgggcagggacugucagaguggggaacc

SEQ ID NO: 746370 - RNA, 64 nt, Homo Sapiens
aggaucgacgcccaguccagaucgagugagagguuccgggcagcgcucuacuucauugaguaaa

SEQ ID NO: 746371 - RNA, 64 nt, Homo Sapiens
cuuggugugagaagcuguuuuucaugaaggcuucuccgggcaguuuucauucacuguucuugac

SEQ ID NO: 746372 - RNA, 64 nt, Homo Sapiens
uggccacacugcccaccaccagccggcuuugccauccgggcauggagauagcugccugcuagau

SEQ ID NO: 746373 - RNA, 64 nt, Homo Sapiens
gacuuagccgacugcgcugcuuuuucaaaacggauccgggcaaugcuucguuuucuaaaggaug

SEQ ID NO: 746374 - RNA, 64 nt, Homo Sapiens
uccaggcgccaucuagcacagccuggcccugaucuccgggcagccaccaccuccucggucugcc

SEQ ID NO: 746375 - RNA, 64 nt, Homo Sapiens
auccaagguguagggcccggcgcggggcgcggacuccgggcacggcuucccaggggaacgagga

SEQ ID NO: 746376 - RNA, 64 nt, Homo Sapiens
caagggcucugaagauuugggagaugccagccccuccgggcaggaagaaaguuuauuuucgugu

SEQ ID NO: 746377 - RNA, 64 nt, Homo Sapiens
acaugguccuaggaagccuggacuggaaugcuucuccgggcaggcauuucuccaugaugagaag

SEQ ID NO: 746378 - RNA, 64 nt, Homo Sapiens
uccccucuccucccagccaccaucguucaucugcuccgggcagaacuguguggccccugccugu

SEQ ID NO: 746379 - RNA, 64 nt, Homo Sapiens
gcagcgccguggcuccccacagagcugguggaauuccgggcacggacuucagagucuucuucca

SEQ ID NO: 746380 - RNA, 64 nt, Homo Sapiens
aggccccugaccacacuucaccauccuucccgccuccgggcauacuggguacacugcagaagcc

SEQ ID NO: 746381 - RNA, 64 nt, Homo Sapiens
ucucaccaccccaggccccguccguccucugcuuuccgggcagcucuagauaccuccugagacc

SEQ ID NO: 746382 - RNA, 64 nt, Homo Sapiens
agaaaccagaguccugcccacaaacuguagucuuuccgggcacagagacaucugcugcuuggcu

SEQ ID NO: 746383 - RNA, 64 nt, Homo Sapiens
caagguuuacacugcggaagcugggccuccugccuccgggcaggcauggcccucggagguccag

SEQ ID NO: 746384 - RNA, 64 nt, Homo Sapiens
ggcuuggcugcagggggacgugccuaaaagacauuccgggcauuugcacuugggaaacuugccu

SEQ ID NO: 746385 - RNA, 64 nt, Homo Sapiens
uggcugagauggagguuuccccacaaccuucggcuccgggcaaacucacugagaggccuggagc

SEQ ID NO: 746386 - RNA, 64 nt, Homo Sapiens
ucucugugucccugcugcugccagggcuuccucuuccgggcagaaacaauaaaaccacuugugc

SEQ ID NO: 746387 - RNA, 64 nt, Homo Sapiens
cauuucaggaagaccgccuuucccagcauucuguuccgggcaggaaaauucacaguugagugca

SEQ ID NO: 746388 - RNA, 64 nt, Homo Sapiens
gugggcacaguucucccugcaaugccgccgggaguccgggcauggugggcgguggccugucuag

SEQ ID NO: 746389 - RNA, 64 nt, Homo Sapiens
aacccagcccauccucucaggcagagcagggugguccgggcacacugggccugccucuccagcc

SEQ ID NO: 746390 - RNA, 64 nt, Homo Sapiens
acugcuagaccaaggagcccuucugcuggcccuguccgggcauaacagaaggcucgcacucuug

SEQ ID NO: 746391 - RNA, 64 nt, Homo Sapiens
ccuggcucucgugugcauggacgugccugagggguccgggcacggccauacgcaggaccccugu

SEQ ID NO: 746392 - RNA, 64 nt, Homo Sapiens
gaggaggacauggggagguuguggggccucaggcuccgggcaccaggggccaaccucaggcucc

SEQ ID NO: 746393 - RNA, 64 nt, Homo Sapiens
uggcugcugguccugucugagugggggagcuccguccgggcaguggcggaaucccgaggguggu

SEQ ID NO: 746394 - RNA, 64 nt, Homo Sapiens
ucacccucugcagcugggagggcucuucugggcguccgggcagcugcagcugagaggacuuuca

SEQ ID NO: 746395 - RNA, 64 nt, Homo Sapiens
gaaccccagaccuguuuguaucauccgggcuccuuccgggcagaaacaacugaaaaugcacuuc

SEQ ID NO: 746396 - RNA, 64 nt, Homo Sapiens
ggagccaggguagagcaaaguaaauauuuuucccuccgggcaggaauuugucuccuacucugug

SEQ ID NO: 746397 - RNA, 64 nt, Homo Sapiens
ccccaccugccagcucuacugggcuuggagcacguccgggcaguggagggagggacacagccug

SEQ ID NO: 746398 - RNA, 64 nt, Homo Sapiens
ccgaggcaggccuucggggccccuuucgccugcuuccgggcagggacgaggccugguguccucg

SEQ ID NO: 746399 - RNA, 64 nt, Homo Sapiens
gguccuaacucccccaccccauaucuacguguccuccgggcauugcccucuccauggcucuggu

SEQ ID NO: 746400 - RNA, 64 nt, Homo Sapiens
acccucgaagaggagaccgaucagugccagccaauccgggcaggcuggaagguuccuuuugccc

SEQ ID NO: 746401 - RNA, 64 nt, Homo Sapiens
ggcuggucccagcggagccgcacucuucgcccgcuccgggcaaaagcgggggcgaguguagagc

SEQ ID NO: 746402 - RNA, 64 nt, Homo Sapiens
uuucuucuguauacauccagauggaucccaggcauccgggcaccacccuggugugucccuagaa

SEQ ID NO: 746403 - RNA, 64 nt, Homo Sapiens
uugcaucagaaaacaacuuuaaaaaagaaaaaguuccgggcauuuuguaaguuaaaaagaaaaa

SEQ ID NO: 746404 - RNA, 64 nt, Homo Sapiens
gagcaauauuuugugcugaagaccucuuuuacuuuccgggcaagugaaugucauuuuaaucaau

SEQ ID NO: 746405 - RNA, 64 nt, Homo Sapiens
gcgcgccggugccgagggccgaggagcgcccggguccgggcaggugaccgcccgccucuguccu

SEQ ID NO: 746406 - RNA, 64 nt, Homo Sapiens
cugcugugcucugugcuuucggcuauggagauguuccgggcauaugaaguguggccuugucaaa

SEQ ID NO: 746407 - RNA, 64 nt, Homo Sapiens
agcggacguucacaugagugggucuauagcccgcuccgggcaucaucuagacuuagcaugcauu

SEQ ID NO: 746408 - RNA, 64 nt, Homo Sapiens
auggccagccaguggcaagcugccgcccccacucuccgggcaccgucuccugccugugcguccg

SEQ ID NO: 746409 - RNA, 64 nt, Homo Sapiens
uccucugcccacagcagacucugucccauggcucuccgggcaguagagugugugagugcagacu

SEQ ID NO: 746410 - RNA, 64 nt, Homo Sapiens
ccauaggaaugugagagggguguuugcugagcgcuccgggcacggccagagggcaagugagcau

SEQ ID NO: 746411 - RNA, 64 nt, Homo Sapiens
ccagugcgucugucgcacguguggggugggcacguccgggcagcucuccgucugggcgcuguga

SEQ ID NO: 746412 - RNA, 64 nt, Homo Sapiens
cugccagcuuuugcuggcacguaggcuaccacucuccgggcaccggcuggggcccuggagcccc

SEQ ID NO: 746413 - RNA, 64 nt, Homo Sapiens
uuucauuuuacuguggauuuucaagcaucaugauuccgggcaguguauguaacccacugugcug

SEQ ID NO: 746414 - RNA, 64 nt, Homo Sapiens
accccgccuggagcuccuuccgcggccaccgugcuccgggcaccccgggagcuccugcaagagg

SEQ ID NO: 746415 - RNA, 64 nt, Homo Sapiens
ucagcaccuggaaccuggaucacauaauagaaaagaaacgcaccaucauuccuacacuggugga

SEQ ID NO: 746416 - RNA, 64 nt, Homo Sapiens
guggugagugccuucuguacagucgacugcaaaugaaacgcagaggaugggugcccagaagcac

SEQ ID NO: 746417 - RNA, 64 nt, Homo Sapiens
ugccugccaagcucacacagcaggaacugagccagaaacgcagauugggcuggcucugaagcca

SEQ ID NO: 746418 - RNA, 64 nt, Homo Sapiens
ugugguuccacuuccccugugcagaucgugggaugaaacgcaugggccaucgcaccugccuuug

SEQ ID NO: 746419 - RNA, 64 nt, Homo Sapiens
aauacagaauggcuucugugauacuggccuugcugaaacgcaucucacugucauucuauuguuu

SEQ ID NO: 746420 - RNA, 64 nt, Homo Sapiens
ugaguauuucggagcaugaaggauagaauacauggaaacgcaaagugaccgagaacuuuuaaga

SEQ ID NO: 746421 - RNA, 64 nt, Homo Sapiens
acagaagacagggagucaucggcuuuuuguaacugaaacgcacccgauggacacauuccccuug

SEQ ID NO: 746422 - RNA, 64 nt, Homo Sapiens
accugcaguuccugaguaccaguuucauggaggggaaacgcaaaagucagcccgaaugccuguc

SEQ ID NO: 746423 - RNA, 64 nt, Homo Sapiens
uuggacuuuuugcuuuagaucccuacauucagcagaaacgcacucaacccuuuccugucccagg

SEQ ID NO: 746424 - RNA, 64 nt, Homo Sapiens
caggucuugugagcccaggaaugaaagaggagaagaaacgcaacuaccugcgcccuccgugguc

SEQ ID NO: 746425 - RNA, 64 nt, Homo Sapiens
gagguuuguaaaaaguguccugugacuuaacacagaaacgcaauaaacacacacaaaauaguuu

SEQ ID NO: 746426 - RNA, 64 nt, Homo Sapiens
uggcgugguauauuuaaccacgggagcgugucuggaaacgcaaacuaucauuaauuucauacua

SEQ ID NO: 746427 - RNA, 64 nt, Homo Sapiens
cuucugagcacaauauggaaagagaucugcagaagaaacgcaauggaagagaucuuuuuuuacu

SEQ ID NO: 746428 - RNA, 64 nt, Homo Sapiens
auuuuugaaaagggagaaaguggacaaugacguugaaacgcagcacagaaagagagccucagaa

SEQ ID NO: 746429 - RNA, 64 nt, Homo Sapiens
acgcugcaaccaauacuguuggguguuuugcacugaaacgcagauaccuacuuuuggagccaca

SEQ ID NO: 746430 - RNA, 64 nt, Homo Sapiens
accccacugguucugaggcccuccuggagugggggaaacgcagcgcacuuucaucagauccugc

SEQ ID NO: 746431 - RNA, 64 nt, Homo Sapiens
cucuuagucuggcuuccaugaagcgucauggguggaaacgcauucuaguaaaaaagguaggaaa

SEQ ID NO: 746432 - RNA, 64 nt, Homo Sapiens
aggugacacuguuguacaagaugucagcuuugcugaaacgcacauuaccuggaauaagugcuuu

SEQ ID NO: 746433 - RNA, 64 nt, Homo Sapiens
cugagcauuugcaccucuguucauuucacacagugaaacgcaauuuuaccuaguuugcacuaua

SEQ ID NO: 746434 - RNA, 64 nt, Homo Sapiens
cucuugagaaaauacacgcuuucugcauguauuagaaacgcacgagcuccaccaagucuacaau

SEQ ID NO: 746435 - RNA, 64 nt, Homo Sapiens
agccgugagcgcccaguucagugccgucuugcaugaaacgcauggcugugaugcacuguggcug

SEQ ID NO: 746436 - RNA, 64 nt, Homo Sapiens
cucugggccugccccuugccugugucugugccaagaaacgcagguaauuuauuccauuucucuc

SEQ ID NO: 746437 - RNA, 64 nt, Homo Sapiens
ugcaaaguucuauggcugucucagaacuuuuauggaaacgcauuacuuuucauagucaaguaac

SEQ ID NO: 746438 - RNA, 64 nt, Homo Sapiens
cacccuuuagcuggaugcugucagaggcgauggagaaacgcaaaggugcguuaauuuuacucua

SEQ ID NO: 746439 - RNA, 64 nt, Homo Sapiens
ugugcuuuugcuauguaugguauccaaguuaguugaaacgcagacacugagaucuguuugaguu

SEQ ID NO: 746440 - RNA, 64 nt, Homo Sapiens
ccaaacccuucagugccaaaaacaacaacaaaaugaaacgcaaccaccaccaaccacugcgacc

SEQ ID NO: 746441 - RNA, 64 nt, Homo Sapiens
uuucauccagaacuaccaccugacauuccuugcugaaacgcaucuaguuccccuguuuauucau

SEQ ID NO: 746442 - RNA, 64 nt, Homo Sapiens
uuguagauugauacgcaguugugcaugggaaggggaaacgcacagcuuuauuuacuguaaagug

SEQ ID NO: 746443 - RNA, 64 nt, Homo Sapiens
cauuccuuugucuucaaacugugaagcauuuacagaaacgcauccagcaagaauauugucccuu

SEQ ID NO: 746444 - RNA, 64 nt, Homo Sapiens
cugccagggaaucacagagaggucucaguauugagaaacgcagcuagaagucagagcaaacuag

SEQ ID NO: 746445 - RNA, 64 nt, Homo Sapiens
uguguggcccagcacgagccaaggaggaaauguggaaacgcagucccaagagaauaggggagcc

SEQ ID NO: 746446 - RNA, 64 nt, Homo Sapiens
auacucaguucucaugcaggugacauucuaccaugaaacgcagaagauaagccauguuucugua

SEQ ID NO: 746447 - RNA, 64 nt, Homo Sapiens
ugucuaccugcugggggcacugaccaugcugagugaaacgcagcacaagcugcuggcggaggcg

SEQ ID NO: 746448 - RNA, 64 nt, Homo Sapiens
acuacgcagcagcagcaguuuccaagacgggccagaaacgcauccacagcaguggcacccgcgg

SEQ ID NO: 746449 - RNA, 64 nt, Homo Sapiens
gaaagggaggaacuuguccucugaaaaguucuuagaaacgcaguuaauuuuaaaagaaccugcc

SEQ ID NO: 746450 - RNA, 64 nt, Homo Sapiens
gcugccuuugcaguccuuuuacuacagcuaugaagaaacgcaacaagaaacucaaugcacaaca

SEQ ID NO: 746451 - RNA, 64 nt, Homo Sapiens
aaccacaagggaaaagaaaaacccaguuucuuaggaaacgcaaacgauuuauuauccagauuau

SEQ ID NO: 746452 - RNA, 64 nt, Homo Sapiens
cuugugucugcugaugagagcaccacucaucugcgaaacgcacguaaaacaaagugaaccguga

SEQ ID NO: 746453 - RNA, 64 nt, Homo Sapiens
ggaacgaaauaccucccagaagaugaaaacuccagaaacgcacauaugagucauuuuuuucaaa

SEQ ID NO: 746454 - RNA, 64 nt, Homo Sapiens
guacaaugaaucuuaaugaugacaaagccuuucugaaacgcaguaggccauuauuaucugcuuu

SEQ ID NO: 746455 - RNA, 64 nt, Homo Sapiens
gcaguccagaaccaguggcacaaauggccauggagaaacgcagacccuugcuuaucuguagaaa

SEQ ID NO: 746456 - RNA, 64 nt, Homo Sapiens
caagguuugcccaugagaaucugauguucagagagaaacgcacacagcagugccauugacugcc

SEQ ID NO: 746457 - RNA, 64 nt, Homo Sapiens
cacuccuggcuccuccagacaaauaaggagaaaggaaacgcagggagacugugugccugggugu

SEQ ID NO: 746458 - RNA, 64 nt, Homo Sapiens
aaaagaaaaggaaaaaccccucucuuacgaagaggaaacgcaaacucccuggcugccucaggcu

SEQ ID NO: 746459 - RNA, 64 nt, Homo Sapiens
gauaauauaaucaacuccucugccuggguuauaagaaacgcaccugacuuaaauaacauguauu

SEQ ID NO: 746460 - RNA, 64 nt, Homo Sapiens
cucuuuuaaggaagucccuauagcaaaucuucuggaaacgcaaauaauggguugaugucugaag

SEQ ID NO: 746461 - RNA, 64 nt, Homo Sapiens
gccugguuugggagagucacaguggcugcuugaggaaacgcagguaagcacuuugcugcccucc

SEQ ID NO: 746462 - RNA, 64 nt, Homo Sapiens
agaugcagacggugagugcagcugauccccgacagaaacgcagcagcuaugccgacagucagca

SEQ ID NO: 746463 - RNA, 64 nt, Homo Sapiens
caagaaauauuugugagauguuucucaagggcaagaaacgcaaagcaaaucagagcaagagcuc

SEQ ID NO: 746464 - RNA, 64 nt, Homo Sapiens
aguccuuccugguagccagcugaccuggcucucggaaacgcaggaccacggcuccuagagacgc

SEQ ID NO: 746465 - RNA, 64 nt, Homo Sapiens
accgaggucggagcugugaggacuuccagaacuggaaacgcaugaacgacccagaauaccaggc

SEQ ID NO: 746466 - RNA, 64 nt, Homo Sapiens
ucagcaauaugaugacugaaagggaaaaguggaggaaacgcagcugcaacugaagcggagacuc

SEQ ID NO: 746467 - RNA, 64 nt, Homo Sapiens
gaaaauaaagaacucuguagcucaccaagguggagaaacgcaauucagaaaaguaauuucucca

SEQ ID NO: 746468 - RNA, 64 nt, Homo Sapiens
aaagcuaguucugucuuuucgaucuguccuucgugaaacgcaacauagccuauacagacgaacu

SEQ ID NO: 746469 - RNA, 64 nt, Homo Sapiens
ugaccccuugauauuugcacagggauauuucuaagaaacgcagaggccagcguuccuggccucu

SEQ ID NO: 746470 - RNA, 64 nt, Homo Sapiens
acauaaaacuuuaaaaggcaacucaaagaugauggaaacgcacuuacaaguggugaccaaaauu

SEQ ID NO: 746471 - RNA, 64 nt, Homo Sapiens
cagacuggauugggauagaaaugggaagccuagagaaacgcaagucugcuucugucuugaggau

SEQ ID NO: 746472 - RNA, 64 nt, Homo Sapiens
uuucuugccauaauuaacauuuaguaauuauguagaaacgcacugcuuggucaggcuuccugcc

SEQ ID NO: 746473 - RNA, 64 nt, Homo Sapiens
cuccucuuccugacccucccuccccugggcagaagaaacgcauguggaccagaagacuuucccu

SEQ ID NO: 746474 - RNA, 64 nt, Homo Sapiens
gggggaggcagggagucuggggcggccagugagagaaacgcaguccucccucucacagguucug

SEQ ID NO: 746475 - RNA, 64 nt, Homo Sapiens
gaaaccgugcaagagagaacgucauguugaaaacgaaacgcagguugugauagaucagagaaga

SEQ ID NO: 746476 - RNA, 64 nt, Homo Sapiens
uaaaagggcaacauguuucuguacaguauucugagaaacgcaaaauaggauuuuuacucccuuu

SEQ ID NO: 746477 - RNA, 64 nt, Homo Sapiens
gccagugcucuggaaauugagagaucuuggaacugaaacgcacaagcugcagggcugccagaug

SEQ ID NO: 746478 - RNA, 64 nt, Homo Sapiens
gugagggaagcugguggugggaaguggaccacaagaaacgcaaacagacacacugacaccuccc

SEQ ID NO: 746479 - RNA, 64 nt, Homo Sapiens
gcggcuccucacgccuaauccagucuccagacuggaaacgcagagguauucugcaggcugaaug

SEQ ID NO: 746480 - RNA, 64 nt, Homo Sapiens
gcuccugcgugcgcccccacggcaccugcagccugaaacgcacccggaagugagacgggcagac

SEQ ID NO: 746481 - RNA, 64 nt, Homo Sapiens
gggguuugucuaucuuuguuucucucaccugagagaaacgcagguguuccagaggcuuccuugc

SEQ ID NO: 746482 - RNA, 64 nt, Homo Sapiens
cccgucccgucaaacaaguuucuucuuaggcuaagaaacgcaguauauacgaguaucucuauau

SEQ ID NO: 746483 - RNA, 64 nt, Homo Sapiens
ucugcccacaggaggcaugcacaaucugguaggagaaacgcacaaguacagauagcuugcucuc

SEQ ID NO: 746484 - RNA, 64 nt, Homo Sapiens
gaacuuccacgcucugcugguucaggcaggcacugaaacgcaccagcccuccuguccccaagcu

SEQ ID NO: 746485 - RNA, 64 nt, Homo Sapiens
gagacugugccucaaaaaaagcacuccaaccugggaaacgcaguugagccgagaucacaccacu

SEQ ID NO: 746486 - RNA, 64 nt, Homo Sapiens
ucgccaggccccgauacaugaauaacaaacccaagaaacgcauccccauugugugauguguuca

SEQ ID NO: 746487 - RNA, 64 nt, Homo Sapiens
aggcuccggcgcugaugcgaauacagcucacagagaaacgcaugugcuauuggagaacaggucu

SEQ ID NO: 746488 - RNA, 64 nt, Homo Sapiens
aaucccuugcucaccccuuucccccgccaaauaagaaacgcaagccagaccacgaugauuguag

SEQ ID NO: 746489 - RNA, 64 nt, Homo Sapiens
gcaaggaugucuaagcuaaucccgucacagaaaggaaacgcacaggcgccuaggcagaaacuug

SEQ ID NO: 746490 - RNA, 64 nt, Homo Sapiens
accccuaaucgcccugagcuuggccccaagcauggaaacgcacaccggguggcagcgcccagcc

SEQ ID NO: 746491 - RNA, 64 nt, Homo Sapiens
auggacugacaggccgagagcggauggacuacaugaaacgcaagagccgcgaguaugagcagcu

SEQ ID NO: 746492 - RNA, 64 nt, Homo Sapiens
ugacuuuguagcucugugguucgcuugguuuagugaaacgcaggaggagaggggaaagagacau

SEQ ID NO: 746493 - RNA, 64 nt, Homo Sapiens
aacauucuggguggcgucgagggaggguuuagaagaaacgcagggucugauucgaguucucccu

SEQ ID NO: 746494 - RNA, 64 nt, Homo Sapiens; identical to SEQ ID NO: 119910

SEQ ID NO: 746495 - RNA, 64 nt, Homo Sapiens; identical to SEQ ID NO: 119911

SEQ ID NO: 746496 - RNA, 64 nt, Homo Sapiens; identical to SEQ ID NO: 119912

SEQ ID NO: 746497 - RNA, 64 nt, Homo Sapiens; identical to SEQ ID NO: 119913

SEQ ID NO: 746498 - RNA, 64 nt, Homo Sapiens; identical to SEQ ID NO: 119914

SEQ ID NO: 746499 - RNA, 64 nt, Homo Sapiens; identical to SEQ ID NO: 119915

SEQ ID NO: 746500 - RNA, 64 nt, Homo Sapiens; identical to SEQ ID NO: 119916

SEQ ID NO: 746501 - RNA, 64 nt, Homo Sapiens; identical to SEQ ID NO: 119917

SEQ ID NO: 746502 - RNA, 64 nt, Homo Sapiens; identical to SEQ ID NO: 119918

SEQ ID NO: 746503 - RNA, 64 nt, Homo Sapiens; identical to SEQ ID NO: 119919

SEQ ID NO: 746504 - RNA, 64 nt, Homo Sapiens; identical to SEQ ID NO: 119920

SEQ ID NO: 746505 - RNA, 64 nt, Homo Sapiens; identical to SEQ ID NO: 119921

SEQ ID NO: 746506 - RNA, 64 nt, Homo Sapiens; identical to SEQ ID NO: 119922

SEQ ID NO: 746507 - RNA, 64 nt, Homo Sapiens; identical to SEQ ID NO: 119923

SEQ ID NO: 746508 - RNA, 64 nt, Homo Sapiens; identical to SEQ ID NO: 119924

SEQ ID NO: 746509 - RNA, 64 nt, Homo Sapiens; identical to SEQ ID NO: 119925

SEQ ID NO: 746510 - RNA, 64 nt, Homo Sapiens; identical to SEQ ID NO: 119926

SEQ ID NO: 746511 - RNA, 64 nt, Homo Sapiens; identical to SEQ ID NO: 119927

SEQ ID NO: 746512 - RNA, 64 nt, Homo Sapiens; identical to SEQ ID NO: 119928

SEQ ID NO: 746513 - RNA, 64 nt, Homo Sapiens; identical to SEQ ID NO: 119929

SEQ ID NO: 746514 - RNA, 64 nt, Homo Sapiens; identical to SEQ ID NO: 119930

SEQ ID NO: 746515 - RNA, 64 nt, Homo Sapiens; identical to SEQ ID NO: 119931

SEQ ID NO: 746516 - RNA, 64 nt, Homo Sapiens; identical to SEQ ID NO: 119932

SEQ ID NO: 746517 - RNA, 64 nt, Homo Sapiens; identical to SEQ ID NO: 119933

SEQ ID NO: 746518 - RNA, 64 nt, Homo Sapiens; identical to SEQ ID NO: 119934

SEQ ID NO: 746519 - RNA, 64 nt, Homo Sapiens; identical to SEQ ID NO: 119935

SEQ ID NO: 746520 - RNA, 64 nt, Homo Sapiens; identical to SEQ ID NO: 119936

SEQ ID NO: 746521 - RNA, 64 nt, Homo Sapiens; identical to SEQ ID NO: 119937

SEQ ID NO: 746522 - RNA, 64 nt, Homo Sapiens; identical to SEQ ID NO: 119938

SEQ ID NO: 746523 - RNA, 64 nt, Homo Sapiens; identical to SEQ ID NO: 119939

SEQ ID NO: 746524 - RNA, 64 nt, Homo Sapiens; identical to SEQ ID NO: 119940

SEQ ID NO: 746525 - RNA, 64 nt, Homo Sapiens; identical to SEQ ID NO: 119941

SEQ ID NO: 746526 - RNA, 64 nt, Homo Sapiens; identical to SEQ ID NO: 119942

SEQ ID NO: 746527 - RNA, 64 nt, Homo Sapiens; identical to SEQ ID NO: 119943

SEQ ID NO: 746528 - RNA, 64 nt, Homo Sapiens; identical to SEQ ID NO: 119944

SEQ ID NO: 746529 - RNA, 64 nt, Homo Sapiens; identical to SEQ ID NO: 119945

SEQ ID NO: 746530 - RNA, 64 nt, Homo Sapiens; identical to SEQ ID NO: 119946

SEQ ID NO: 746531 - RNA, 64 nt, Homo Sapiens; identical to SEQ ID NO: 119947

SEQ ID NO: 746532 - RNA, 64 nt, Homo Sapiens; identical to SEQ ID NO: 119948

SEQ ID NO: 746533 - RNA, 64 nt, Homo Sapiens; identical to SEQ ID NO: 119949

SEQ ID NO: 746534 - RNA, 64 nt, Homo Sapiens; identical to SEQ ID NO: 119950

SEQ ID NO: 746535 - RNA, 64 nt, Homo Sapiens; identical to SEQ ID NO: 119951

SEQ ID NO: 746536 - RNA, 64 nt, Homo Sapiens; identical to SEQ ID NO: 119952

SEQ ID NO: 746537 - RNA, 64 nt, Homo Sapiens; identical to SEQ ID NO: 119953

SEQ ID NO: 746538 - RNA, 64 nt, Homo Sapiens; identical to SEQ ID NO: 119954

SEQ ID NO: 746539 - RNA, 64 nt, Homo Sapiens; identical to SEQ ID NO: 119955

SEQ ID NO: 746540 - RNA, 64 nt, Homo Sapiens; identical to SEQ ID NO: 119956

SEQ ID NO: 746541 - RNA, 64 nt, Homo Sapiens; identical to SEQ ID NO: 119957

SEQ ID NO: 746542 - RNA, 64 nt, Homo Sapiens; identical to SEQ ID NO: 119958

SEQ ID NO: 746543 - RNA, 64 nt, Homo Sapiens; identical to SEQ ID NO: 119959

SEQ ID NO: 746544 - RNA, 64 nt, Homo Sapiens; identical to SEQ ID NO: 119960

SEQ ID NO: 746545 - RNA, 64 nt, Homo Sapiens; identical to SEQ ID NO: 119961

SEQ ID NO: 746546 - RNA, 58 nt, Homo Sapiens; identical to SEQ ID NO: 119962

SEQ ID NO: 746547 - RNA, 64 nt, Homo Sapiens; identical to SEQ ID NO: 119963

SEQ ID NO: 746548 - RNA, 64 nt, Homo Sapiens; identical to SEQ ID NO: 119964

SEQ ID NO: 746549 - RNA, 64 nt, Homo Sapiens; identical to SEQ ID NO: 119965

SEQ ID NO: 746550 - RNA, 64 nt, Homo Sapiens; identical to SEQ ID NO: 119966

SEQ ID NO: 746551 - RNA, 64 nt, Homo Sapiens; identical to SEQ ID NO: 119967

SEQ ID NO: 746552 - RNA, 64 nt, Homo Sapiens; identical to SEQ ID NO: 119968

SEQ ID NO: 746553 - RNA, 64 nt, Homo Sapiens; identical to SEQ ID NO: 119969

SEQ ID NO: 746554 - RNA, 64 nt, Homo Sapiens; identical to SEQ ID NO: 119970

SEQ ID NO: 746555 - RNA, 55 nt, Homo Sapiens; identical to SEQ ID NO: 119971

SEQ ID NO: 746556 - RNA, 64 nt, Homo Sapiens; identical to SEQ ID NO: 119972

SEQ ID NO: 746557 - RNA, 64 nt, Homo Sapiens; identical to SEQ ID NO: 119973

SEQ ID NO: 746558 - RNA, 64 nt, Homo Sapiens; identical to SEQ ID NO: 119974

SEQ ID NO: 746559 - RNA, 64 nt, Homo Sapiens; identical to SEQ ID NO: 119975

SEQ ID NO: 746560 - RNA, 64 nt, Homo Sapiens; identical to SEQ ID NO: 119976

SEQ ID NO: 746561 - RNA, 64 nt, Homo Sapiens; identical to SEQ ID NO: 119977

SEQ ID NO: 746562 - RNA, 64 nt, Homo Sapiens; identical to SEQ ID NO: 119978

SEQ ID NO: 746563 - RNA, 64 nt, Homo Sapiens; identical to SEQ ID NO: 119979

SEQ ID NO: 746564 - RNA, 64 nt, Homo Sapiens; identical to SEQ ID NO: 119980

SEQ ID NO: 746565 - RNA, 64 nt, Homo Sapiens; identical to SEQ ID NO: 119981

SEQ ID NO: 746566 - RNA, 64 nt, Homo Sapiens; identical to SEQ ID NO: 119982

SEQ ID NO: 746567 - RNA, 64 nt, Homo Sapiens; identical to SEQ ID NO: 119983

SEQ ID NO: 746568 - RNA, 64 nt, Homo Sapiens; identical to SEQ ID NO: 119984

SEQ ID NO: 746569 - RNA, 64 nt, Homo Sapiens; identical to SEQ ID NO: 119985

SEQ ID NO: 746570 - RNA, 64 nt, Homo Sapiens; identical to SEQ ID NO: 119986

SEQ ID NO: 746571 - RNA, 64 nt, Homo Sapiens; identical to SEQ ID NO: 119987

SEQ ID NO: 746572 - RNA, 55 nt, Homo Sapiens; identical to SEQ ID NO: 119988

SEQ ID NO: 746573 - RNA, 64 nt, Homo Sapiens; identical to SEQ ID NO: 119989

SEQ ID NO: 746574 - RNA, 64 nt, Homo Sapiens; identical to SEQ ID NO: 119990

SEQ ID NO: 746575 - RNA, 64 nt, Homo Sapiens; identical to SEQ ID NO: 119991

SEQ ID NO: 746576 - RNA, 64 nt, Homo Sapiens; identical to SEQ ID NO: 119992

SEQ ID NO: 746577 - RNA, 64 nt, Homo Sapiens; identical to SEQ ID NO: 119993

SEQ ID NO: 746578 - RNA, 64 nt, Homo Sapiens; identical to SEQ ID NO: 119994

SEQ ID NO: 746579 - RNA, 64 nt, Homo Sapiens; identical to SEQ ID NO: 119995

SEQ ID NO: 746580 - RNA, 64 nt, Homo Sapiens; identical to SEQ ID NO: 119996

SEQ ID NO: 746581 - RNA, 64 nt, Homo Sapiens; identical to SEQ ID NO: 119997

SEQ ID NO: 746582 - RNA, 64 nt, Homo Sapiens; identical to SEQ ID NO: 119998

SEQ ID NO: 746583 - RNA, 62 nt, Homo Sapiens; identical to SEQ ID NO: 119999

SEQ ID NO: 746584 - RNA, 64 nt, Homo Sapiens; identical to SEQ ID NO: 120000

SEQ ID NO: 746585 - RNA, 64 nt, Homo Sapiens; identical to SEQ ID NO: 120001

SEQ ID NO: 746586 - RNA, 64 nt, Homo Sapiens; identical to SEQ ID NO: 120002

SEQ ID NO: 746587 - RNA, 64 nt, Homo Sapiens; identical to SEQ ID NO: 120003

SEQ ID NO: 746588 - RNA, 64 nt, Homo Sapiens; identical to SEQ ID NO: 120004

SEQ ID NO: 746589 - RNA, 64 nt, Homo Sapiens; identical to SEQ ID NO: 120005

SEQ ID NO: 746590 - RNA, 64 nt, Homo Sapiens; identical to SEQ ID NO: 120006

SEQ ID NO: 746591 - RNA, 64 nt, Homo Sapiens; identical to SEQ ID NO: 120007

SEQ ID NO: 746592 - RNA, 64 nt, Homo Sapiens; identical to SEQ ID NO: 120008

SEQ ID NO: 746593 - RNA, 64 nt, Homo Sapiens; identical to SEQ ID NO: 46940

SEQ ID NO: 746594 - RNA, 64 nt, Homo Sapiens; identical to SEQ ID NO: 46941

SEQ ID NO: 746595 - RNA, 64 nt, Homo Sapiens; identical to SEQ ID NO: 46942

SEQ ID NO: 746596 - RNA, 64 nt, Homo Sapiens; identical to SEQ ID NO: 46943

SEQ ID NO: 746597 - RNA, 64 nt, Homo Sapiens; identical to SEQ ID NO: 46944

SEQ ID NO: 746598 - RNA, 64 nt, Homo Sapiens; identical to SEQ ID NO: 46945

SEQ ID NO: 746599 - RNA, 64 nt, Homo Sapiens; identical to SEQ ID NO: 46946

SEQ ID NO: 746600 - RNA, 64 nt, Homo Sapiens; identical to SEQ ID NO: 46947

SEQ ID NO: 746601 - RNA, 64 nt, Homo Sapiens; identical to SEQ ID NO: 46948

SEQ ID NO: 746602 - RNA, 64 nt, Homo Sapiens; identical to SEQ ID NO: 46949

SEQ ID NO: 746603 - RNA, 64 nt, Homo Sapiens; identical to SEQ ID NO: 46950

SEQ ID NO: 746604 - RNA, 64 nt, Homo Sapiens; identical to SEQ ID NO: 46951

SEQ ID NO: 746605 - RNA, 64 nt, Homo Sapiens; identical to SEQ ID NO: 46952

SEQ ID NO: 746606 - RNA, 64 nt, Homo Sapiens; identical to SEQ ID NO: 46953

SEQ ID NO: 746607 - RNA, 64 nt, Homo Sapiens; identical to SEQ ID NO: 46954

SEQ ID NO: 746608 - RNA, 64 nt, Homo Sapiens; identical to SEQ ID NO: 46955

SEQ ID NO: 746609 - RNA, 64 nt, Homo Sapiens; identical to SEQ ID NO: 46956

SEQ ID NO: 746610 - RNA, 64 nt, Homo Sapiens; identical to SEQ ID NO: 46957

SEQ ID NO: 746611 - RNA, 64 nt, Homo Sapiens; identical to SEQ ID NO: 46958

SEQ ID NO: 746612 - RNA, 60 nt, Homo Sapiens; identical to SEQ ID NO: 46959

SEQ ID NO: 746613 - RNA, 64 nt, Homo Sapiens; identical to SEQ ID NO: 46960

SEQ ID NO: 746614 - RNA, 64 nt, Homo Sapiens; identical to SEQ ID NO: 46961

SEQ ID NO: 746615 - RNA, 64 nt, Homo Sapiens; identical to SEQ ID NO: 46962

SEQ ID NO: 746616 - RNA, 64 nt, Homo Sapiens; identical to SEQ ID NO: 46963

SEQ ID NO: 746617 - RNA, 64 nt, Homo Sapiens; identical to SEQ ID NO: 46964

SEQ ID NO: 746618 - RNA, 64 nt, Homo Sapiens; identical to SEQ ID NO: 46965

SEQ ID NO: 746619 - RNA, 64 nt, Homo Sapiens; identical to SEQ ID NO: 46966

SEQ ID NO: 746620 - RNA, 64 nt, Homo Sapiens; identical to SEQ ID NO: 46967

SEQ ID NO: 746621 - RNA, 64 nt, Homo Sapiens; identical to SEQ ID NO: 46968

SEQ ID NO: 746622 - RNA, 64 nt, Homo Sapiens; identical to SEQ ID NO: 46969

SEQ ID NO: 746623 - RNA, 64 nt, Homo Sapiens; identical to SEQ ID NO: 46970

SEQ ID NO: 746624 - RNA, 64 nt, Homo Sapiens; identical to SEQ ID NO: 46971

SEQ ID NO: 746625 - RNA, 64 nt, Homo Sapiens; identical to SEQ ID NO: 46972

SEQ ID NO: 746626 - RNA, 64 nt, Homo Sapiens; identical to SEQ ID NO: 46973

SEQ ID NO: 746627 - RNA, 64 nt, Homo Sapiens; identical to SEQ ID NO: 46974

SEQ ID NO: 746628 - RNA, 64 nt, Homo Sapiens; identical to SEQ ID NO: 46975

SEQ ID NO: 746629 - RNA, 64 nt, Homo Sapiens; identical to SEQ ID NO: 46976

SEQ ID NO: 746630 - RNA, 64 nt, Homo Sapiens; identical to SEQ ID NO: 46977

SEQ ID NO: 746631 - RNA, 64 nt, Homo Sapiens; identical to SEQ ID NO: 46978

SEQ ID NO: 746632 - RNA, 64 nt, Homo Sapiens; identical to SEQ ID NO: 46979

SEQ ID NO: 746633 - RNA, 64 nt, Homo Sapiens; identical to SEQ ID NO: 46980

SEQ ID NO: 746634 - RNA, 64 nt, Homo Sapiens; identical to SEQ ID NO: 46981

SEQ ID NO: 746635 - RNA, 64 nt, Homo Sapiens; identical to SEQ ID NO: 46982

SEQ ID NO: 746636 - RNA, 64 nt, Homo Sapiens; identical to SEQ ID NO: 46983

SEQ ID NO: 746637 - RNA, 64 nt, Homo Sapiens; identical to SEQ ID NO: 46984

SEQ ID NO: 746638 - RNA, 64 nt, Homo Sapiens; identical to SEQ ID NO: 46985

SEQ ID NO: 746639 - RNA, 64 nt, Homo Sapiens; identical to SEQ ID NO: 46986

SEQ ID NO: 746640 - RNA, 64 nt, Homo Sapiens; identical to SEQ ID NO: 46987

SEQ ID NO: 746641 - RNA, 64 nt, Homo Sapiens; identical to SEQ ID NO: 46988

SEQ ID NO: 746642 - RNA, 64 nt, Homo Sapiens; identical to SEQ ID NO: 46989

SEQ ID NO: 746643 - RNA, 64 nt, Homo Sapiens; identical to SEQ ID NO: 46990

SEQ ID NO: 746644 - RNA, 64 nt, Homo Sapiens; identical to SEQ ID NO: 46991

SEQ ID NO: 746645 - RNA, 64 nt, Homo Sapiens; identical to SEQ ID NO: 46992

SEQ ID NO: 746646 - RNA, 64 nt, Homo Sapiens; identical to SEQ ID NO: 46993

SEQ ID NO: 746647 - RNA, 64 nt, Homo Sapiens; identical to SEQ ID NO: 46994

SEQ ID NO: 746648 - RNA, 64 nt, Homo Sapiens; identical to SEQ ID NO: 46995

SEQ ID NO: 746649 - RNA, 64 nt, Homo Sapiens; identical to SEQ ID NO: 46996

SEQ ID NO: 746650 - RNA, 64 nt, Homo Sapiens; identical to SEQ ID NO: 46997

SEQ ID NO: 746651 - RNA, 64 nt, Homo Sapiens; identical to SEQ ID NO: 46998

SEQ ID NO: 746652 - RNA, 64 nt, Homo Sapiens; identical to SEQ ID NO: 46999

SEQ ID NO: 746653 - RNA, 64 nt, Homo Sapiens; identical to SEQ ID NO: 47000

SEQ ID NO: 746654 - RNA, 64 nt, Homo Sapiens; identical to SEQ ID NO: 110487

SEQ ID NO: 746655 - RNA, 64 nt, Homo Sapiens; identical to SEQ ID NO: 110488

SEQ ID NO: 746656 - RNA, 64 nt, Homo Sapiens; identical to SEQ ID NO: 110489

SEQ ID NO: 746657 - RNA, 64 nt, Homo Sapiens; identical to SEQ ID NO: 110490

SEQ ID NO: 746658 - RNA, 64 nt, Homo Sapiens; identical to SEQ ID NO: 110491

SEQ ID NO: 746659 - RNA, 64 nt, Homo Sapiens; identical to SEQ ID NO: 110492

SEQ ID NO: 746660 - RNA, 64 nt, Homo Sapiens; identical to SEQ ID NO: 110493

SEQ ID NO: 746661 - RNA, 64 nt, Homo Sapiens; identical to SEQ ID NO: 110494

SEQ ID NO: 746662 - RNA, 64 nt, Homo Sapiens; identical to SEQ ID NO: 110495

SEQ ID NO: 746663 - RNA, 64 nt, Homo Sapiens; identical to SEQ ID NO: 110496

SEQ ID NO: 746664 - RNA, 64 nt, Homo Sapiens; identical to SEQ ID NO: 110497

SEQ ID NO: 746665 - RNA, 64 nt, Homo Sapiens; identical to SEQ ID NO: 110498

SEQ ID NO: 746666 - RNA, 64 nt, Homo Sapiens; identical to SEQ ID NO: 110499

SEQ ID NO: 746667 - RNA, 64 nt, Homo Sapiens; identical to SEQ ID NO: 110500

SEQ ID NO: 746668 - RNA, 64 nt, Homo Sapiens; identical to SEQ ID NO: 110501

SEQ ID NO: 746669 - RNA, 64 nt, Homo Sapiens; identical to SEQ ID NO: 110502

SEQ ID NO: 746670 - RNA, 56 nt, Homo Sapiens; identical to SEQ ID NO: 110503

SEQ ID NO: 746671 - RNA, 64 nt, Homo Sapiens; identical to SEQ ID NO: 110504

SEQ ID NO: 746672 - RNA, 64 nt, Homo Sapiens; identical to SEQ ID NO: 110505

SEQ ID NO: 746673 - RNA, 64 nt, Homo Sapiens; identical to SEQ ID NO: 110506

SEQ ID NO: 746674 - RNA, 64 nt, Homo Sapiens; identical to SEQ ID NO: 110507

SEQ ID NO: 746675 - RNA, 64 nt, Homo Sapiens; identical to SEQ ID NO: 110508

SEQ ID NO: 746676 - RNA, 64 nt, Homo Sapiens; identical to SEQ ID NO: 110509

SEQ ID NO: 746677 - RNA, 64 nt, Homo Sapiens; identical to SEQ ID NO: 110510

SEQ ID NO: 746678 - RNA, 64 nt, Homo Sapiens; identical to SEQ ID NO: 110511

SEQ ID NO: 746679 - RNA, 64 nt, Homo Sapiens; identical to SEQ ID NO: 110512

SEQ ID NO: 746680 - RNA, 64 nt, Homo Sapiens; identical to SEQ ID NO: 110513

SEQ ID NO: 746681 - RNA, 64 nt, Homo Sapiens; identical to SEQ ID NO: 110514

SEQ ID NO: 746682 - RNA, 64 nt, Homo Sapiens; identical to SEQ ID NO: 110515

SEQ ID NO: 746683 - RNA, 64 nt, Homo Sapiens; identical to SEQ ID NO: 110516

SEQ ID NO: 746684 - RNA, 64 nt, Homo Sapiens; identical to SEQ ID NO: 110517

SEQ ID NO: 746685 - RNA, 64 nt, Homo Sapiens; identical to SEQ ID NO: 110518

SEQ ID NO: 746686 - RNA, 64 nt, Homo Sapiens; identical to SEQ ID NO: 110519

SEQ ID NO: 746687 - RNA, 64 nt, Homo Sapiens; identical to SEQ ID NO: 110520

SEQ ID NO: 746688 - RNA, 64 nt, Homo Sapiens; identical to SEQ ID NO: 110521

SEQ ID NO: 746689 - RNA, 64 nt, Homo Sapiens; identical to SEQ ID NO: 110522

SEQ ID NO: 746690 - RNA, 64 nt, Homo Sapiens; identical to SEQ ID NO: 110523

SEQ ID NO: 746691 - RNA, 64 nt, Homo Sapiens; identical to SEQ ID NO: 225898

SEQ ID NO: 746692 - RNA, 64 nt, Homo Sapiens; identical to SEQ ID NO: 225899

SEQ ID NO: 746693 - RNA, 64 nt, Homo Sapiens
gccgguuguaagccuugcacgggacagaccacacccaccgcaaccucauccccucagcacuaac

SEQ ID NO: 746694 - RNA, 64 nt, Homo Sapiens
cagccucccaaguagcugggauaacaggcgcccaccaccgcacccugcuaauuuuuuguauuuu

SEQ ID NO: 746695 - RNA, 64 nt, Homo Sapiens; identical to SEQ ID NO: 534306

SEQ ID NO: 746696 - RNA, 64 nt, Homo Sapiens; identical to SEQ ID NO: 534307

SEQ ID NO: 746697 - RNA, 64 nt, Homo Sapiens; identical to SEQ ID NO: 534308

SEQ ID NO: 746698 - RNA, 64 nt, Homo Sapiens; identical to SEQ ID NO: 534309

SEQ ID NO: 746699 - RNA, 64 nt, Homo Sapiens; identical to SEQ ID NO: 534310

SEQ ID NO: 746700 - RNA, 64 nt, Homo Sapiens; identical to SEQ ID NO: 534311

SEQ ID NO: 746701 - RNA, 64 nt, Homo Sapiens; identical to SEQ ID NO: 534312

SEQ ID NO: 746702 - RNA, 64 nt, Homo Sapiens; identical to SEQ ID NO: 534313

SEQ ID NO: 746703 - RNA, 64 nt, Homo Sapiens; identical to SEQ ID NO: 534314

SEQ ID NO: 746704 - RNA, 64 nt, Homo Sapiens; identical to SEQ ID NO: 534315

SEQ ID NO: 746705 - RNA, 64 nt, Homo Sapiens; identical to SEQ ID NO: 534316

SEQ ID NO: 746706 - RNA, 64 nt, Homo Sapiens; identical to SEQ ID NO: 534317

SEQ ID NO: 746707 - RNA, 64 nt, Homo Sapiens; identical to SEQ ID NO: 534318

SEQ ID NO: 746708 - RNA, 64 nt, Homo Sapiens; identical to SEQ ID NO: 534319

SEQ ID NO: 746709 - RNA, 64 nt, Homo Sapiens; identical to SEQ ID NO: 534320

SEQ ID NO: 746710 - RNA, 64 nt, Homo Sapiens; identical to SEQ ID NO: 534321

SEQ ID NO: 746711 - RNA, 64 nt, Homo Sapiens; identical to SEQ ID NO: 534322

SEQ ID NO: 746712 - RNA, 64 nt, Homo Sapiens; identical to SEQ ID NO: 534323

SEQ ID NO: 746713 - RNA, 64 nt, Homo Sapiens; identical to SEQ ID NO: 534324

SEQ ID NO: 746714 - RNA, 64 nt, Homo Sapiens; identical to SEQ ID NO: 534325

SEQ ID NO: 746715 - RNA, 64 nt, Homo Sapiens; identical to SEQ ID NO: 534326

SEQ ID NO: 746716 - RNA, 64 nt, Homo Sapiens; identical to SEQ ID NO: 534327

SEQ ID NO: 746717 - RNA, 64 nt, Homo Sapiens; identical to SEQ ID NO: 534328

SEQ ID NO: 746718 - RNA, 64 nt, Homo Sapiens; identical to SEQ ID NO: 534329

SEQ ID NO: 746719 - RNA, 64 nt, Homo Sapiens; identical to SEQ ID NO: 534330

SEQ ID NO: 746720 - RNA, 64 nt, Homo Sapiens; identical to SEQ ID NO: 534331

SEQ ID NO: 746721 - RNA, 64 nt, Homo Sapiens; identical to SEQ ID NO: 534332

SEQ ID NO: 746722 - RNA, 64 nt, Homo Sapiens; identical to SEQ ID NO: 534333

SEQ ID NO: 746723 - RNA, 64 nt, Homo Sapiens; identical to SEQ ID NO: 534334

SEQ ID NO: 746724 - RNA, 64 nt, Homo Sapiens; identical to SEQ ID NO: 188813

SEQ ID NO: 746725 - RNA, 64 nt, Homo Sapiens; identical to SEQ ID NO: 188814

SEQ ID NO: 746726 - RNA, 64 nt, Homo Sapiens; identical to SEQ ID NO: 188815

SEQ ID NO: 746727 - RNA, 64 nt, Homo Sapiens; identical to SEQ ID NO: 188816

SEQ ID NO: 746728 - RNA, 64 nt, Homo Sapiens
ccauaucaccacaaaucacaacugaccugucuccuucacauaguguagaacacugagcaggaca

SEQ ID NO: 746729 - RNA, 64 nt, Homo Sapiens
ugugcagcacaugccgggaguuaggugugacacguucacauaaccugaagacaauggacccacg

SEQ ID NO: 746730 - RNA, 64 nt, Homo Sapiens
ugcuaaaaacucauuuuugugguuaaagccuuauuucacauaauguggcauuaagucuugcuuu

SEQ ID NO: 746731 - RNA, 64 nt, Homo Sapiens
uuuaggauuuucgaaaguuguuugacuaauuuuuuucacauaacuaucagauuuacagauuuuc

SEQ ID NO: 746732 - RNA, 64 nt, Homo Sapiens
agaaguuauguuuuaaauaucucuguuuuaggaguucacauauaguucagcauuuauuguuuag

SEQ ID NO: 746733 - RNA, 64 nt, Homo Sapiens
agagaauaaaauauguauuuaaauuuuugguguguucacauaaagggauguagcuaaaauguuu

SEQ ID NO: 746734 - RNA, 64 nt, Homo Sapiens
ucaauagauguuucucuagauaugggacuuuauuuucacauaagauaaguauagauuuuaaaga

SEQ ID NO: 746735 - RNA, 64 nt, Homo Sapiens
uauauuuucaauuguguacacuaacuuguaaaauuucacauaaauuagcaugccccuguucuuc

SEQ ID NO: 746736 - RNA, 64 nt, Homo Sapiens
uguaauuuagcaguccaaagguuuucuaaaguuguucacauauaaaccacugaacauuugcuuu

SEQ ID NO: 746737 - RNA, 64 nt, Homo Sapiens
cucaaacaaucaugagucagaggacagccugguuuucacauacauuugcuuugcuuuuuaauug

SEQ ID NO: 746738 - RNA, 64 nt, Homo Sapiens
uguauuuuagcaggguacauaaaauuuuaugugcuucacauaauuucauauuuucacaugacgu

SEQ ID NO: 746739 - RNA, 64 nt, Homo Sapiens
cacauacauugccaauuuucuuguuguggguuuuuucacauaaaaaccacccccuucuuuuuug

SEQ ID NO: 746740 - RNA, 64 nt, Homo Sapiens
aaaaagagcuuucauguacauauuuuuauagcucuucacauauuaugaaauuaaaucaaacugu

SEQ ID NO: 746741 - RNA, 64 nt, Homo Sapiens
caaaucguugcaagugauaaaagagaaugccauguucacauaaggagucuuugaccuuuugaac

SEQ ID NO: 746742 - RNA, 64 nt, Homo Sapiens
uauaacccuaggaauuuagacaaccugaaauuuauucacauauaucaaagugagaaaaugccuc

SEQ ID NO: 746743 - RNA, 64 nt, Homo Sapiens
uauucacauauaucaaagugagaaaaugccucaauucacauagauuucuucucuuuaguauaau

SEQ ID NO: 746744 - RNA, 64 nt, Homo Sapiens
auagaaacauguuaaaguugguuaggaucauaucuucacauauggcccuuucugaaucaaagug

SEQ ID NO: 746745 - RNA, 64 nt, Homo Sapiens
cucuugcaauuucuguugugauaguaccaucucuuucacauacuacauacaaauucccuaauaa

SEQ ID NO: 746746 - RNA, 64 nt, Homo Sapiens
gaugaaauagccauggcuuauauauuuuugucuuuucacauaugauguguuuggaacccaaauu

SEQ ID NO: 746747 - RNA, 64 nt, Homo Sapiens
uucuuuucuauuuucccuaaaaccagccccgauauucacauagggagguuauguccugucaggg

SEQ ID NO: 746748 - RNA, 64 nt, Homo Sapiens
gucacauugagguuuggaaccgcccccuucucuuuucacauacacggucggucuccccccuccc

SEQ ID NO: 746749 - RNA, 64 nt, Homo Sapiens
cagagucuuugcuaugcaccuuuuaaaaucuggcuucacauacauucagacacuuguuaccaua

SEQ ID NO: 746750 - RNA, 64 nt, Homo Sapiens
aaacacuggcauggcucagcguuccaguccuuguuucacauaaugacagacuuggucuugugag

SEQ ID NO: 746751 - RNA, 64 nt, Homo Sapiens; identical to SEQ ID NO: 409645

SEQ ID NO: 746752 - RNA, 64 nt, Homo Sapiens; identical to SEQ ID NO: 409646

SEQ ID NO: 746753 - RNA, 64 nt, Homo Sapiens; identical to SEQ ID NO: 409647

SEQ ID NO: 746754 - RNA, 64 nt, Homo Sapiens; identical to SEQ ID NO: 409648

SEQ ID NO: 746755 - RNA, 64 nt, Homo Sapiens; identical to SEQ ID NO: 409649

SEQ ID NO: 746756 - RNA, 64 nt, Homo Sapiens; identical to SEQ ID NO: 409650

SEQ ID NO: 746757 - RNA, 64 nt, Homo Sapiens; identical to SEQ ID NO: 648080

SEQ ID NO: 746758 - RNA, 64 nt, Homo Sapiens; identical to SEQ ID NO: 648081

SEQ ID NO: 746759 - RNA, 64 nt, Homo Sapiens; identical to SEQ ID NO: 648082

SEQ ID NO: 746760 - RNA, 64 nt, Homo Sapiens; identical to SEQ ID NO: 648083

SEQ ID NO: 746761 - RNA, 64 nt, Homo Sapiens; identical to SEQ ID NO: 648084

SEQ ID NO: 746762 - RNA, 64 nt, Homo Sapiens; identical to SEQ ID NO: 648085

SEQ ID NO: 746763 - RNA, 64 nt, Homo Sapiens; identical to SEQ ID NO: 648086

SEQ ID NO: 746764 - RNA, 64 nt, Homo Sapiens; identical to SEQ ID NO: 648087

SEQ ID NO: 746765 - RNA, 57 nt, Homo Sapiens; identical to SEQ ID NO: 130560

SEQ ID NO: 746766 - RNA, 64 nt, Homo Sapiens; identical to SEQ ID NO: 130561

SEQ ID NO: 746767 - RNA, 64 nt, Homo Sapiens; identical to SEQ ID NO: 130562

SEQ ID NO: 746768 - RNA, 64 nt, Homo Sapiens; identical to SEQ ID NO: 130563

SEQ ID NO: 746769 - RNA, 64 nt, Homo Sapiens; identical to SEQ ID NO: 130564

SEQ ID NO: 746770 - RNA, 64 nt, Homo Sapiens; identical to SEQ ID NO: 130565

SEQ ID NO: 746771 - RNA, 64 nt, Homo Sapiens; identical to SEQ ID NO: 130566

SEQ ID NO: 746772 - RNA, 64 nt, Homo Sapiens; identical to SEQ ID NO: 130567

SEQ ID NO: 746773 - RNA, 64 nt, Homo Sapiens; identical to SEQ ID NO: 130568

SEQ ID NO: 746774 - RNA, 64 nt, Homo Sapiens; identical to SEQ ID NO: 130569

SEQ ID NO: 746775 - RNA, 64 nt, Homo Sapiens; identical to SEQ ID NO: 130570

SEQ ID NO: 746776 - RNA, 64 nt, Homo Sapiens; identical to SEQ ID NO: 130571

SEQ ID NO: 746777 - RNA, 64 nt, Homo Sapiens; identical to SEQ ID NO: 130572

SEQ ID NO: 746778 - RNA, 64 nt, Homo Sapiens; identical to SEQ ID NO: 130573

SEQ ID NO: 746779 - RNA, 64 nt, Homo Sapiens; identical to SEQ ID NO: 130574

SEQ ID NO: 746780 - RNA, 64 nt, Homo Sapiens; identical to SEQ ID NO: 130575

SEQ ID NO: 746781 - RNA, 64 nt, Homo Sapiens; identical to SEQ ID NO: 130576

SEQ ID NO: 746782 - RNA, 64 nt, Homo Sapiens; identical to SEQ ID NO: 130577

SEQ ID NO: 746783 - RNA, 64 nt, Homo Sapiens; identical to SEQ ID NO: 130578

SEQ ID NO: 746784 - RNA, 64 nt, Homo Sapiens; identical to SEQ ID NO: 130579

SEQ ID NO: 746785 - RNA, 64 nt, Homo Sapiens; identical to SEQ ID NO: 130580

SEQ ID NO: 746786 - RNA, 64 nt, Homo Sapiens; identical to SEQ ID NO: 130581

SEQ ID NO: 746787 - RNA, 64 nt, Homo Sapiens; identical to SEQ ID NO: 130582

SEQ ID NO: 746788 - RNA, 64 nt, Homo Sapiens; identical to SEQ ID NO: 130583

SEQ ID NO: 746789 - RNA, 64 nt, Homo Sapiens; identical to SEQ ID NO: 130584

SEQ ID NO: 746790 - RNA, 64 nt, Homo Sapiens; identical to SEQ ID NO: 130585

SEQ ID NO: 746791 - RNA, 64 nt, Homo Sapiens; identical to SEQ ID NO: 130586

SEQ ID NO: 746792 - RNA, 64 nt, Homo Sapiens; identical to SEQ ID NO: 130587

SEQ ID NO: 746793 - RNA, 64 nt, Homo Sapiens; identical to SEQ ID NO: 130588

SEQ ID NO: 746794 - RNA, 64 nt, Homo Sapiens; identical to SEQ ID NO: 130589

SEQ ID NO: 746795 - RNA, 64 nt, Homo Sapiens; identical to SEQ ID NO: 130590

SEQ ID NO: 746796 - RNA, 64 nt, Homo Sapiens; identical to SEQ ID NO: 130591

SEQ ID NO: 746797 - RNA, 64 nt, Homo Sapiens; identical to SEQ ID NO: 130592

SEQ ID NO: 746798 - RNA, 64 nt, Homo Sapiens; identical to SEQ ID NO: 130593

SEQ ID NO: 746799 - RNA, 64 nt, Homo Sapiens; identical to SEQ ID NO: 130594

SEQ ID NO: 746800 - RNA, 64 nt, Homo Sapiens; identical to SEQ ID NO: 130595

SEQ ID NO: 746801 - RNA, 64 nt, Homo Sapiens; identical to SEQ ID NO: 130596

SEQ ID NO: 746802 - RNA, 64 nt, Homo Sapiens; identical to SEQ ID NO: 130597

SEQ ID NO: 746803 - RNA, 64 nt, Homo Sapiens; identical to SEQ ID NO: 130598

SEQ ID NO: 746804 - RNA, 64 nt, Homo Sapiens; identical to SEQ ID NO: 130599

SEQ ID NO: 746805 - RNA, 64 nt, Homo Sapiens; identical to SEQ ID NO: 130600

SEQ ID NO: 746806 - RNA, 64 nt, Homo Sapiens; identical to SEQ ID NO: 130601

SEQ ID NO: 746807 - RNA, 64 nt, Homo Sapiens; identical to SEQ ID NO: 130602

SEQ ID NO: 746808 - RNA, 64 nt, Homo Sapiens; identical to SEQ ID NO: 130603

SEQ ID NO: 746809 - RNA, 64 nt, Homo Sapiens; identical to SEQ ID NO: 130604

SEQ ID NO: 746810 - RNA, 64 nt, Homo Sapiens; identical to SEQ ID NO: 130605

SEQ ID NO: 746811 - RNA, 64 nt, Homo Sapiens; identical to SEQ ID NO: 130606

SEQ ID NO: 746812 - RNA, 64 nt, Homo Sapiens; identical to SEQ ID NO: 130607

SEQ ID NO: 746813 - RNA, 64 nt, Homo Sapiens; identical to SEQ ID NO: 130608

SEQ ID NO: 746814 - RNA, 64 nt, Homo Sapiens; identical to SEQ ID NO: 130609

SEQ ID NO: 746815 - RNA, 64 nt, Homo Sapiens; identical to SEQ ID NO: 130610

SEQ ID NO: 746816 - RNA, 64 nt, Homo Sapiens; identical to SEQ ID NO: 130611

SEQ ID NO: 746817 - RNA, 64 nt, Homo Sapiens; identical to SEQ ID NO: 276360

SEQ ID NO: 746818 - RNA, 64 nt, Homo Sapiens; identical to SEQ ID NO: 276361

SEQ ID NO: 746819 - RNA, 64 nt, Homo Sapiens; identical to SEQ ID NO: 276362

SEQ ID NO: 746820 - RNA, 64 nt, Homo Sapiens; identical to SEQ ID NO: 276363

SEQ ID NO: 746821 - RNA, 64 nt, Homo Sapiens; identical to SEQ ID NO: 276364

SEQ ID NO: 746822 - RNA, 64 nt, Homo Sapiens; identical to SEQ ID NO: 276365

SEQ ID NO: 746823 - RNA, 64 nt, Homo Sapiens; identical to SEQ ID NO: 276366

SEQ ID NO: 746824 - RNA, 64 nt, Homo Sapiens; identical to SEQ ID NO: 276367

SEQ ID NO: 746825 - RNA, 64 nt, Homo Sapiens; identical to SEQ ID NO: 276368

SEQ ID NO: 746826 - RNA, 64 nt, Homo Sapiens; identical to SEQ ID NO: 276369

SEQ ID NO: 746827 - RNA, 64 nt, Homo Sapiens; identical to SEQ ID NO: 276370

SEQ ID NO: 746828 - RNA, 64 nt, Homo Sapiens; identical to SEQ ID NO: 276371

SEQ ID NO: 746829 - RNA, 64 nt, Homo Sapiens; identical to SEQ ID NO: 276372

SEQ ID NO: 746830 - RNA, 64 nt, Homo Sapiens; identical to SEQ ID NO: 276373

SEQ ID NO: 746831 - RNA, 64 nt, Homo Sapiens; identical to SEQ ID NO: 276374

SEQ ID NO: 746832 - RNA, 64 nt, Homo Sapiens; identical to SEQ ID NO: 276375

SEQ ID NO: 746833 - RNA, 64 nt, Homo Sapiens; identical to SEQ ID NO: 276376

SEQ ID NO: 746834 - RNA, 64 nt, Homo Sapiens; identical to SEQ ID NO: 276377

SEQ ID NO: 746835 - RNA, 64 nt, Homo Sapiens; identical to SEQ ID NO: 276378

SEQ ID NO: 746836 - RNA, 64 nt, Homo Sapiens; identical to SEQ ID NO: 118026

SEQ ID NO: 746837 - RNA, 64 nt, Homo Sapiens; identical to SEQ ID NO: 118027

SEQ ID NO: 746838 - RNA, 64 nt, Homo Sapiens; identical to SEQ ID NO: 118028

SEQ ID NO: 746839 - RNA, 64 nt, Homo Sapiens; identical to SEQ ID NO: 118029

SEQ ID NO: 746840 - RNA, 64 nt, Homo Sapiens; identical to SEQ ID NO: 118030

SEQ ID NO: 746841 - RNA, 64 nt, Homo Sapiens; identical to SEQ ID NO: 118031

SEQ ID NO: 746842 - RNA, 64 nt, Homo Sapiens; identical to SEQ ID NO: 118032

SEQ ID NO: 746843 - RNA, 64 nt, Homo Sapiens; identical to SEQ ID NO: 118033

SEQ ID NO: 746844 - RNA, 64 nt, Homo Sapiens; identical to SEQ ID NO: 118034

SEQ ID NO: 746845 - RNA, 64 nt, Homo Sapiens; identical to SEQ ID NO: 118035

SEQ ID NO: 746846 - RNA, 64 nt, Homo Sapiens; identical to SEQ ID NO: 118036

SEQ ID NO: 746847 - RNA, 64 nt, Homo Sapiens; identical to SEQ ID NO: 118037

SEQ ID NO: 746848 - RNA, 64 nt, Homo Sapiens; identical to SEQ ID NO: 118038

SEQ ID NO: 746849 - RNA, 64 nt, Homo Sapiens; identical to SEQ ID NO: 118039

SEQ ID NO: 746850 - RNA, 64 nt, Homo Sapiens; identical to SEQ ID NO: 118040

SEQ ID NO: 746851 - RNA, 64 nt, Homo Sapiens; identical to SEQ ID NO: 118041

SEQ ID NO: 746852 - RNA, 64 nt, Homo Sapiens; identical to SEQ ID NO: 118042

SEQ ID NO: 746853 - RNA, 64 nt, Homo Sapiens; identical to SEQ ID NO: 118043

SEQ ID NO: 746854 - RNA, 64 nt, Homo Sapiens; identical to SEQ ID NO: 118044

SEQ ID NO: 746855 - RNA, 64 nt, Homo Sapiens; identical to SEQ ID NO: 118045

SEQ ID NO: 746856 - RNA, 64 nt, Homo Sapiens; identical to SEQ ID NO: 118046

SEQ ID NO: 746857 - RNA, 64 nt, Homo Sapiens; identical to SEQ ID NO: 118047

SEQ ID NO: 746858 - RNA, 64 nt, Homo Sapiens; identical to SEQ ID NO: 118048

SEQ ID NO: 746859 - RNA, 64 nt, Homo Sapiens; identical to SEQ ID NO: 118049

SEQ ID NO: 746860 - RNA, 64 nt, Homo Sapiens; identical to SEQ ID NO: 118050

SEQ ID NO: 746861 - RNA, 64 nt, Homo Sapiens; identical to SEQ ID NO: 118051

SEQ ID NO: 746862 - RNA, 64 nt, Homo Sapiens; identical to SEQ ID NO: 118052

SEQ ID NO: 746863 - RNA, 64 nt, Homo Sapiens; identical to SEQ ID NO: 118053

SEQ ID NO: 746864 - RNA, 64 nt, Homo Sapiens; identical to SEQ ID NO: 118054

SEQ ID NO: 746865 - RNA, 64 nt, Homo Sapiens; identical to SEQ ID NO: 118055

SEQ ID NO: 746866 - RNA, 64 nt, Homo Sapiens; identical to SEQ ID NO: 118056

SEQ ID NO: 746867 - RNA, 64 nt, Homo Sapiens; identical to SEQ ID NO: 118057

SEQ ID NO: 746868 - RNA, 64 nt, Homo Sapiens; identical to SEQ ID NO: 118058

SEQ ID NO: 746869 - RNA, 64 nt, Homo Sapiens; identical to SEQ ID NO: 118059

SEQ ID NO: 746870 - RNA, 64 nt, Homo Sapiens; identical to SEQ ID NO: 118060

SEQ ID NO: 746871 - RNA, 64 nt, Homo Sapiens; identical to SEQ ID NO: 118061

SEQ ID NO: 746872 - RNA, 64 nt, Homo Sapiens; identical to SEQ ID NO: 118062

SEQ ID NO: 746873 - RNA, 64 nt, Homo Sapiens; identical to SEQ ID NO: 118063

SEQ ID NO: 746874 - RNA, 64 nt, Homo Sapiens; identical to SEQ ID NO: 118064

SEQ ID NO: 746875 - RNA, 64 nt, Homo Sapiens; identical to SEQ ID NO: 118065

SEQ ID NO: 746876 - RNA, 64 nt, Homo Sapiens; identical to SEQ ID NO: 118066

SEQ ID NO: 746877 - RNA, 62 nt, Homo Sapiens
uuauuauugguuauauacuguccauagucuccugucccuacaucauggaucauguccaccuu

SEQ ID NO: 746878 - RNA, 62 nt, Homo Sapiens
cucuuagaggguggcaaaaugccuuugcccagugucccuauuuuaggcaucuuuuccuuccu

SEQ ID NO: 746879 - RNA, 64 nt, Homo Sapiens; identical to SEQ ID NO: 692395

SEQ ID NO: 746880 - RNA, 64 nt, Homo Sapiens; identical to SEQ ID NO: 692396

SEQ ID NO: 746881 - RNA, 64 nt, Homo Sapiens; identical to SEQ ID NO: 692397

SEQ ID NO: 746882 - RNA, 64 nt, Homo Sapiens; identical to SEQ ID NO: 692398

SEQ ID NO: 746883 - RNA, 64 nt, Homo Sapiens; identical to SEQ ID NO: 692399

SEQ ID NO: 746884 - RNA, 64 nt, Homo Sapiens; identical to SEQ ID NO: 692400

SEQ ID NO: 746885 - RNA, 64 nt, Homo Sapiens; identical to SEQ ID NO: 692401

SEQ ID NO: 746886 - RNA, 64 nt, Homo Sapiens; identical to SEQ ID NO: 692402

SEQ ID NO: 746887 - RNA, 64 nt, Homo Sapiens; identical to SEQ ID NO: 692403

SEQ ID NO: 746888 - RNA, 64 nt, Homo Sapiens; identical to SEQ ID NO: 692404

SEQ ID NO: 746889 - RNA, 64 nt, Homo Sapiens; identical to SEQ ID NO: 692405

SEQ ID NO: 746890 - RNA, 64 nt, Homo Sapiens; identical to SEQ ID NO: 692406

SEQ ID NO: 746891 - RNA, 64 nt, Homo Sapiens; identical to SEQ ID NO: 692407

SEQ ID NO: 746892 - RNA, 64 nt, Homo Sapiens; identical to SEQ ID NO: 692408

SEQ ID NO: 746893 - RNA, 64 nt, Homo Sapiens; identical to SEQ ID NO: 692409

SEQ ID NO: 746894 - RNA, 64 nt, Homo Sapiens; identical to SEQ ID NO: 692410

SEQ ID NO: 746895 - RNA, 64 nt, Homo Sapiens; identical to SEQ ID NO: 692411

SEQ ID NO: 746896 - RNA, 64 nt, Homo Sapiens; identical to SEQ ID NO: 692412

SEQ ID NO: 746897 - RNA, 64 nt, Homo Sapiens; identical to SEQ ID NO: 692413

SEQ ID NO: 746898 - RNA, 64 nt, Homo Sapiens; identical to SEQ ID NO: 692414

SEQ ID NO: 746899 - RNA, 64 nt, Homo Sapiens; identical to SEQ ID NO: 692415

SEQ ID NO: 746900 - RNA, 64 nt, Homo Sapiens; identical to SEQ ID NO: 692416

SEQ ID NO: 746901 - RNA, 64 nt, Homo Sapiens; identical to SEQ ID NO: 692417

SEQ ID NO: 746902 - RNA, 64 nt, Homo Sapiens; identical to SEQ ID NO: 692418

SEQ ID NO: 746903 - RNA, 64 nt, Homo Sapiens; identical to SEQ ID NO: 692419

SEQ ID NO: 746904 - RNA, 64 nt, Homo Sapiens; identical to SEQ ID NO: 692420

SEQ ID NO: 746905 - RNA, 64 nt, Homo Sapiens; identical to SEQ ID NO: 692421

SEQ ID NO: 746906 - RNA, 64 nt, Homo Sapiens; identical to SEQ ID NO: 692422

SEQ ID NO: 746907 - RNA, 64 nt, Homo Sapiens; identical to SEQ ID NO: 692423

SEQ ID NO: 746908 - RNA, 64 nt, Homo Sapiens; identical to SEQ ID NO: 692424

SEQ ID NO: 746909 - RNA, 64 nt, Homo Sapiens; identical to SEQ ID NO: 692425

SEQ ID NO: 746910 - RNA, 64 nt, Homo Sapiens; identical to SEQ ID NO: 692426

SEQ ID NO: 746911 - RNA, 64 nt, Homo Sapiens; identical to SEQ ID NO: 692427

SEQ ID NO: 746912 - RNA, 64 nt, Homo Sapiens; identical to SEQ ID NO: 692428

SEQ ID NO: 746913 - RNA, 64 nt, Homo Sapiens; identical to SEQ ID NO: 692429

SEQ ID NO: 746914 - RNA, 64 nt, Homo Sapiens; identical to SEQ ID NO: 692430

SEQ ID NO: 746915 - RNA, 64 nt, Homo Sapiens; identical to SEQ ID NO: 692431

SEQ ID NO: 746916 - RNA, 64 nt, Homo Sapiens; identical to SEQ ID NO: 692432

SEQ ID NO: 746917 - RNA, 64 nt, Homo Sapiens; identical to SEQ ID NO: 692433

SEQ ID NO: 746918 - RNA, 63 nt, Homo Sapiens
ugacuaauggugucacugcuggcaauggugauaauggauuaauuccucaaaggaagagcagaa

SEQ ID NO: 746919 - RNA, 63 nt, Homo Sapiens
ugacuaauggugccacugcuggcaauggugaugauggauuaauuccuccaaggaagagcagaa

SEQ ID NO: 746920 - RNA, 63 nt, Homo Sapiens
gugagucaucagaguuuauugcugaccuuucauauggauuauuaaagugucacauauuagaau

SEQ ID NO: 746921 - RNA, 63 nt, Homo Sapiens
gaggagcccucacggcugauacacugaaccuggauggauuauacucgugucaguagccuugug

SEQ ID NO: 746922 - RNA, 63 nt, Homo Sapiens
uguaagaaaugaaauaaguaaaggaaauggcauauggauuaacaaugagguuuuuugcauucc

SEQ ID NO: 746923 - RNA, 63 nt, Homo Sapiens
aucagcugccucucgaauggaagaacagugguaauggauuaacauccuauuuuguuguacuaa

SEQ ID NO: 746924 - RNA, 63 nt, Homo Sapiens
guuuguugucuuauuugugguggcacucguuuaauggauuaacugagguugcucaauguucag

SEQ ID NO: 746925 - RNA, 63 nt, Homo Sapiens
gacuuaaaaauagucauuuuuuuauaaagacaaauggauuauauuacuuagaugccagucuac

SEQ ID NO: 746926 - RNA, 63 nt, Homo Sapiens
auaaaauacuuaaauuugugucacaauuaugagauggauuauagccuuugucagaaaguauuc

SEQ ID NO: 746927 - RNA, 63 nt, Homo Sapiens
cugaaacauaugaaauugcuucaguacaaccccauggauuagggccgagaauggucagaaaga

SEQ ID NO: 746928 - RNA, 63 nt, Homo Sapiens
uuuuggguuuaacugaauauauaguacaacuuaauggauuagcauuacauuuaucugaagaaa

SEQ ID NO: 746929 - RNA, 63 nt, Homo Sapiens
uaaaaauaagauauuugggguauauucaagugcauggauuaguuuuccugacaaagcauguuu

SEQ ID NO: 746930 - RNA, 63 nt, Homo Sapiens
augguaucugcugcaaacaugaguagauccaugauggauuaauaaagcuugcugaaaaaaaaa

SEQ ID NO: 746931 - RNA, 63 nt, Homo Sapiens
ggugauugggccaugaggucugugcccuccugaauggauuaauccauucauggauuaauggau

SEQ ID NO: 746932 - RNA, 63 nt, Homo Sapiens
ggucugugcccuccugaauggauuaauccauucauggauuaauggauuauuaugaguggggga

SEQ ID NO: 746933 - RNA, 63 nt, Homo Sapiens
cccuccugaauggauuaauccauucauggauuaauggauuauuaugagugggggacuggugac

SEQ ID NO: 746934 - RNA, 64 nt, Homo Sapiens; identical to SEQ ID NO: 472962

SEQ ID NO: 746935 - RNA, 55 nt, Homo Sapiens; identical to SEQ ID NO: 472963

SEQ ID NO: 746936 - RNA, 64 nt, Homo Sapiens; identical to SEQ ID NO: 472964

SEQ ID NO: 746937 - RNA, 64 nt, Homo Sapiens; identical to SEQ ID NO: 472965

SEQ ID NO: 746938 - RNA, 64 nt, Homo Sapiens; identical to SEQ ID NO: 472966

SEQ ID NO: 746939 - RNA, 64 nt, Homo Sapiens; identical to SEQ ID NO: 472967

SEQ ID NO: 746940 - RNA, 64 nt, Homo Sapiens; identical to SEQ ID NO: 472968

SEQ ID NO: 746941 - RNA, 64 nt, Homo Sapiens; identical to SEQ ID NO: 472969

SEQ ID NO: 746942 - RNA, 64 nt, Homo Sapiens; identical to SEQ ID NO: 472970

SEQ ID NO: 746943 - RNA, 64 nt, Homo Sapiens; identical to SEQ ID NO: 472971

SEQ ID NO: 746944 - RNA, 62 nt, Homo Sapiens
acuggaaguucugggugguaguccgaacccguacgcugcacagagacauguuugaugacuac

SEQ ID NO: 746945 - RNA, 62 nt, Homo Sapiens
agacagcugaguacauccuuagcaaagcuaccacgcugcagaccugguggcgucugcaggug

SEQ ID NO: 746946 - RNA, 62 nt, Homo Sapiens
auuuugauuuggucagugcuaaccacagugaaacgcugcaguuuccuccuuuccauccuguu

SEQ ID NO: 746947 - RNA, 62 nt, Homo Sapiens
caccacuaucaccaggagugacagucagucagacgcugcagguccuucuucagcagcaccuc

SEQ ID NO: 746948 - RNA, 62 nt, Homo Sapiens
aagaggcagaaaaguugguuugguuugcaguaacgcugcaacuagaaaauauaugcacuuca

SEQ ID NO: 746949 - RNA, 62 nt, Homo Sapiens
uucugaaagccggcgcugcagccagaggccgcacgcugcacugucgcgacgcagagaggcuu

SEQ ID NO: 746950 - RNA, 64 nt, Homo Sapiens
cgcuggaguuauuugacucgacuugcccagggucccaggucagugcuccucaaaccugaacaug

SEQ ID NO: 746951 - RNA, 64 nt, Homo Sapiens
guggggcccagccauuuggcuuuucacaaguucuccaggucauucuugggcacgaucaaauuug

SEQ ID NO: 746952 - RNA, 64 nt, Homo Sapiens
gucuccuuccaccccugcagcacaugccaggucaccaggucaccacgucggaucccgugggccu

SEQ ID NO: 746953 - RNA, 64 nt, Homo Sapiens
aggucaccgucuccuuccacgugggccucacaugccaggucaccgcagggacacgucggauccc

SEQ ID NO: 746954 - RNA, 64 nt, Homo Sapiens
ugccuggugcacagugcuuagaaguaagcaauucccaggucauagcucaagaauuguuagcaaa

SEQ ID NO: 746955 - RNA, 64 nt, Homo Sapiens
uaaaccuuugaguagagucucccuggaucacauaccaggucagggaggaucuguucuuccucua

SEQ ID NO: 746956 - RNA, 64 nt, Homo Sapiens
uggaaccggccuggacuccucuucccaacuuccuccaggucauuucccagugugagcacaaugc

SEQ ID NO: 746957 - RNA, 64 nt, Homo Sapiens
uguuauaagaggcgugggcuccccugguggcugaccaggucagcugcccuggccuugcaccccu

SEQ ID NO: 746958 - RNA, 64 nt, Homo Sapiens
gucuggcgucccaaaugaaauagugaccucacuuccaggucaagucucacacuccacugcccaa

SEQ ID NO: 746959 - RNA, 64 nt, Homo Sapiens
ugucccuuccucuggccaccaagcccagauugugccaggucagcgcucuuguugugcccccuuc

SEQ ID NO: 746960 - RNA, 64 nt, Homo Sapiens
cggcuagcgaguggcgggcccucgguaaugagucccaggucauaagccgaggugcucagaaagg

SEQ ID NO: 746961 - RNA, 64 nt, Homo Sapiens
cauugacacuuuguaagaaaccugucuuucucauccaggucaggcugcauccagucuguguccu

SEQ ID NO: 746962 - RNA, 64 nt, Homo Sapiens
gucuaccccagcccagcccaaacccagccuguggccaggucacucagauauaaaacuagcugcc

SEQ ID NO: 746963 - RNA, 64 nt, Homo Sapiens
augcacauuucuggauugugugguuagacgccuuccaggucaggcauauuuccccuuggacacu

SEQ ID NO: 746964 - RNA, 64 nt, Homo Sapiens
caguuccuggcccaucaacuuacagggagaaaauccaggucaugcaauuaacaucgugggucac

SEQ ID NO: 746965 - RNA, 64 nt, Homo Sapiens
ggggaggaaagccaccuugacagcccaggucccuccaggucacccacagccaguuucaggaagg

SEQ ID NO: 746966 - RNA, 64 nt, Homo Sapiens
gcaacuguguuaccuuucaaguuuaucucaauaaccaggucaucagggacccauuguucucuuc

SEQ ID NO: 746967 - RNA, 64 nt, Homo Sapiens
aaugggauucuuuuugcucuacggccagcgacguccaggucaccugcucugcgggacagucccc

SEQ ID NO: 746968 - RNA, 64 nt, Homo Sapiens
gagaaacacaaacaccacccaucaaauuuggacaccaggucacgguagcgauagauauuuggac

SEQ ID NO: 746969 - RNA, 64 nt, Homo Sapiens
auccacccucguaacaacagagcauugagggaaaccaggucaccuguuuuagaagggagguggc

SEQ ID NO: 746970 - RNA, 64 nt, Homo Sapiens
gcaauccugccucaggccccgcaaccucugccucccaggucaaauaggcuggagugaaaguggc

SEQ ID NO: 746971 - RNA, 64 nt, Homo Sapiens
uaaaauccagcccacuuacaccuaugcuuaaugaccaggucacaaugagcucacaaaaugaauc

SEQ ID NO: 746972 - RNA, 64 nt, Homo Sapiens
aggggagggugcugggccugagcuagcccaagcuccaggucaggugcccccacaccccaucccc

SEQ ID NO: 746973 - RNA, 64 nt, Homo Sapiens; identical to SEQ ID NO: 49935

SEQ ID NO: 746974 - RNA, 64 nt, Homo Sapiens; identical to SEQ ID NO: 49936

SEQ ID NO: 746975 - RNA, 64 nt, Homo Sapiens; identical to SEQ ID NO: 49937

SEQ ID NO: 746976 - RNA, 64 nt, Homo Sapiens; identical to SEQ ID NO: 49938

SEQ ID NO: 746977 - RNA, 64 nt, Homo Sapiens; identical to SEQ ID NO: 49939

SEQ ID NO: 746978 - RNA, 64 nt, Homo Sapiens; identical to SEQ ID NO: 49940

SEQ ID NO: 746979 - RNA, 64 nt, Homo Sapiens; identical to SEQ ID NO: 49941

SEQ ID NO: 746980 - RNA, 64 nt, Homo Sapiens; identical to SEQ ID NO: 49942

SEQ ID NO: 746981 - RNA, 64 nt, Homo Sapiens; identical to SEQ ID NO: 49943

SEQ ID NO: 746982 - RNA, 64 nt, Homo Sapiens; identical to SEQ ID NO: 49944

SEQ ID NO: 746983 - RNA, 64 nt, Homo Sapiens; identical to SEQ ID NO: 49945

SEQ ID NO: 746984 - RNA, 64 nt, Homo Sapiens; identical to SEQ ID NO: 49946

SEQ ID NO: 746985 - RNA, 64 nt, Homo Sapiens; identical to SEQ ID NO: 49947

SEQ ID NO: 746986 - RNA, 64 nt, Homo Sapiens; identical to SEQ ID NO: 49948

SEQ ID NO: 746987 - RNA, 64 nt, Homo Sapiens; identical to SEQ ID NO: 49949

SEQ ID NO: 746988 - RNA, 64 nt, Homo Sapiens; identical to SEQ ID NO: 49950

SEQ ID NO: 746989 - RNA, 64 nt, Homo Sapiens; identical to SEQ ID NO: 49951

SEQ ID NO: 746990 - RNA, 64 nt, Homo Sapiens; identical to SEQ ID NO: 49952

SEQ ID NO: 746991 - RNA, 64 nt, Homo Sapiens; identical to SEQ ID NO: 49953

SEQ ID NO: 746992 - RNA, 64 nt, Homo Sapiens; identical to SEQ ID NO: 49954

SEQ ID NO: 746993 - RNA, 64 nt, Homo Sapiens; identical to SEQ ID NO: 49955

SEQ ID NO: 746994 - RNA, 64 nt, Homo Sapiens; identical to SEQ ID NO: 49956

SEQ ID NO: 746995 - RNA, 64 nt, Homo Sapiens; identical to SEQ ID NO: 49957

SEQ ID NO: 746996 - RNA, 64 nt, Homo Sapiens; identical to SEQ ID NO: 49958

SEQ ID NO: 746997 - RNA, 64 nt, Homo Sapiens; identical to SEQ ID NO: 49959

SEQ ID NO: 746998 - RNA, 64 nt, Homo Sapiens; identical to SEQ ID NO: 49960

SEQ ID NO: 746999 - RNA, 64 nt, Homo Sapiens; identical to SEQ ID NO: 49961

SEQ ID NO: 747000 - RNA, 64 nt, Homo Sapiens; identical to SEQ ID NO: 49962

SEQ ID NO: 747001 - RNA, 64 nt, Homo Sapiens; identical to SEQ ID NO: 49963

SEQ ID NO: 747002 - RNA, 64 nt, Homo Sapiens; identical to SEQ ID NO: 49964

SEQ ID NO: 747003 - RNA, 64 nt, Homo Sapiens; identical to SEQ ID NO: 49965

SEQ ID NO: 747004 - RNA, 64 nt, Homo Sapiens; identical to SEQ ID NO: 49966

SEQ ID NO: 747005 - RNA, 64 nt, Homo Sapiens; identical to SEQ ID NO: 49967

SEQ ID NO: 747006 - RNA, 64 nt, Homo Sapiens; identical to SEQ ID NO: 49968

SEQ ID NO: 747007 - RNA, 64 nt, Homo Sapiens; identical to SEQ ID NO: 49969

SEQ ID NO: 747008 - RNA, 64 nt, Homo Sapiens; identical to SEQ ID NO: 49970

SEQ ID NO: 747009 - RNA, 64 nt, Homo Sapiens; identical to SEQ ID NO: 49971

SEQ ID NO: 747010 - RNA, 64 nt, Homo Sapiens; identical to SEQ ID NO: 49972

SEQ ID NO: 747011 - RNA, 64 nt, Homo Sapiens; identical to SEQ ID NO: 49973

SEQ ID NO: 747012 - RNA, 64 nt, Homo Sapiens; identical to SEQ ID NO: 49974

SEQ ID NO: 747013 - RNA, 64 nt, Homo Sapiens; identical to SEQ ID NO: 49975

SEQ ID NO: 747014 - RNA, 64 nt, Homo Sapiens; identical to SEQ ID NO: 49976

SEQ ID NO: 747015 - RNA, 64 nt, Homo Sapiens; identical to SEQ ID NO: 49977

SEQ ID NO: 747016 - RNA, 64 nt, Homo Sapiens; identical to SEQ ID NO: 49978

SEQ ID NO: 747017 - RNA, 64 nt, Homo Sapiens; identical to SEQ ID NO: 49979

SEQ ID NO: 747018 - RNA, 64 nt, Homo Sapiens; identical to SEQ ID NO: 49980

SEQ ID NO: 747019 - RNA, 64 nt, Homo Sapiens; identical to SEQ ID NO: 49981

SEQ ID NO: 747020 - RNA, 64 nt, Homo Sapiens; identical to SEQ ID NO: 49982

SEQ ID NO: 747021 - RNA, 64 nt, Homo Sapiens; identical to SEQ ID NO: 49983

SEQ ID NO: 747022 - RNA, 64 nt, Homo Sapiens; identical to SEQ ID NO: 49984

SEQ ID NO: 747023 - RNA, 64 nt, Homo Sapiens; identical to SEQ ID NO: 49985

SEQ ID NO: 747024 - RNA, 64 nt, Homo Sapiens; identical to SEQ ID NO: 49986

SEQ ID NO: 747025 - RNA, 64 nt, Homo Sapiens; identical to SEQ ID NO: 49987

SEQ ID NO: 747026 - RNA, 64 nt, Homo Sapiens; identical to SEQ ID NO: 49988

SEQ ID NO: 747027 - RNA, 64 nt, Homo Sapiens; identical to SEQ ID NO: 49989

SEQ ID NO: 747028 - RNA, 64 nt, Homo Sapiens; identical to SEQ ID NO: 49990

SEQ ID NO: 747029 - RNA, 64 nt, Homo Sapiens; identical to SEQ ID NO: 49991

SEQ ID NO: 747030 - RNA, 64 nt, Homo Sapiens; identical to SEQ ID NO: 49992

SEQ ID NO: 747031 - RNA, 64 nt, Homo Sapiens; identical to SEQ ID NO: 49993

SEQ ID NO: 747032 - RNA, 64 nt, Homo Sapiens; identical to SEQ ID NO: 49994

SEQ ID NO: 747033 - RNA, 64 nt, Homo Sapiens; identical to SEQ ID NO: 49995

SEQ ID NO: 747034 - RNA, 64 nt, Homo Sapiens; identical to SEQ ID NO: 49996

SEQ ID NO: 747035 - RNA, 58 nt, Homo Sapiens; identical to SEQ ID NO: 49997

SEQ ID NO: 747036 - RNA, 50 nt, Homo Sapiens; identical to SEQ ID NO: 49998

SEQ ID NO: 747037 - RNA, 64 nt, Homo Sapiens; identical to SEQ ID NO: 49999

SEQ ID NO: 747038 - RNA, 64 nt, Homo Sapiens; identical to SEQ ID NO: 50000

SEQ ID NO: 747039 - RNA, 64 nt, Homo Sapiens; identical to SEQ ID NO: 50001

SEQ ID NO: 747040 - RNA, 64 nt, Homo Sapiens; identical to SEQ ID NO: 50002

SEQ ID NO: 747041 - RNA, 64 nt, Homo Sapiens; identical to SEQ ID NO: 50003

SEQ ID NO: 747042 - RNA, 64 nt, Homo Sapiens; identical to SEQ ID NO: 50004

SEQ ID NO: 747043 - RNA, 64 nt, Homo Sapiens; identical to SEQ ID NO: 50005

SEQ ID NO: 747044 - RNA, 64 nt, Homo Sapiens; identical to SEQ ID NO: 50006

SEQ ID NO: 747045 - RNA, 64 nt, Homo Sapiens; identical to SEQ ID NO: 50007

SEQ ID NO: 747046 - RNA, 64 nt, Homo Sapiens; identical to SEQ ID NO: 50008

SEQ ID NO: 747047 - RNA, 64 nt, Homo Sapiens; identical to SEQ ID NO: 50009

SEQ ID NO: 747048 - RNA, 64 nt, Homo Sapiens; identical to SEQ ID NO: 50010

SEQ ID NO: 747049 - RNA, 64 nt, Homo Sapiens; identical to SEQ ID NO: 50011

SEQ ID NO: 747050 - RNA, 64 nt, Homo Sapiens; identical to SEQ ID NO: 50012

SEQ ID NO: 747051 - RNA, 64 nt, Homo Sapiens; identical to SEQ ID NO: 50013

SEQ ID NO: 747052 - RNA, 64 nt, Homo Sapiens; identical to SEQ ID NO: 50014

SEQ ID NO: 747053 - RNA, 64 nt, Homo Sapiens; identical to SEQ ID NO: 50015

SEQ ID NO: 747054 - RNA, 64 nt, Homo Sapiens; identical to SEQ ID NO: 50016

SEQ ID NO: 747055 - RNA, 64 nt, Homo Sapiens; identical to SEQ ID NO: 50017

SEQ ID NO: 747056 - RNA, 64 nt, Homo Sapiens; identical to SEQ ID NO: 50018

SEQ ID NO: 747057 - RNA, 64 nt, Homo Sapiens; identical to SEQ ID NO: 50019

SEQ ID NO: 747058 - RNA, 64 nt, Homo Sapiens; identical to SEQ ID NO: 50020

SEQ ID NO: 747059 - RNA, 64 nt, Homo Sapiens; identical to SEQ ID NO: 50021

SEQ ID NO: 747060 - RNA, 64 nt, Homo Sapiens; identical to SEQ ID NO: 50022

SEQ ID NO: 747061 - RNA, 64 nt, Homo Sapiens; identical to SEQ ID NO: 50023

SEQ ID NO: 747062 - RNA, 64 nt, Homo Sapiens; identical to SEQ ID NO: 50024

SEQ ID NO: 747063 - RNA, 64 nt, Homo Sapiens; identical to SEQ ID NO: 50025

SEQ ID NO: 747064 - RNA, 64 nt, Homo Sapiens; identical to SEQ ID NO: 50026

SEQ ID NO: 747065 - RNA, 64 nt, Homo Sapiens; identical to SEQ ID NO: 50027

SEQ ID NO: 747066 - RNA, 64 nt, Homo Sapiens; identical to SEQ ID NO: 50028

SEQ ID NO: 747067 - RNA, 64 nt, Homo Sapiens; identical to SEQ ID NO: 50029

SEQ ID NO: 747068 - RNA, 64 nt, Homo Sapiens; identical to SEQ ID NO: 50030

SEQ ID NO: 747069 - RNA, 64 nt, Homo Sapiens; identical to SEQ ID NO: 50031

SEQ ID NO: 747070 - RNA, 64 nt, Homo Sapiens; identical to SEQ ID NO: 50032

SEQ ID NO: 747071 - RNA, 64 nt, Homo Sapiens; identical to SEQ ID NO: 50033

SEQ ID NO: 747072 - RNA, 64 nt, Homo Sapiens; identical to SEQ ID NO: 50034

SEQ ID NO: 747073 - RNA, 64 nt, Homo Sapiens; identical to SEQ ID NO: 50035

SEQ ID NO: 747074 - RNA, 64 nt, Homo Sapiens; identical to SEQ ID NO: 50036

SEQ ID NO: 747075 - RNA, 64 nt, Homo Sapiens; identical to SEQ ID NO: 50037

SEQ ID NO: 747076 - RNA, 64 nt, Homo Sapiens; identical to SEQ ID NO: 50038

SEQ ID NO: 747077 - RNA, 64 nt, Homo Sapiens; identical to SEQ ID NO: 50039

SEQ ID NO: 747078 - RNA, 64 nt, Homo Sapiens; identical to SEQ ID NO: 50040

SEQ ID NO: 747079 - RNA, 64 nt, Homo Sapiens; identical to SEQ ID NO: 50041

SEQ ID NO: 747080 - RNA, 64 nt, Homo Sapiens; identical to SEQ ID NO: 50042

SEQ ID NO: 747081 - RNA, 64 nt, Homo Sapiens; identical to SEQ ID NO: 50043

SEQ ID NO: 747082 - RNA, 64 nt, Homo Sapiens; identical to SEQ ID NO: 50044

SEQ ID NO: 747083 - RNA, 64 nt, Homo Sapiens; identical to SEQ ID NO: 50045

SEQ ID NO: 747084 - RNA, 64 nt, Homo Sapiens; identical to SEQ ID NO: 50046

SEQ ID NO: 747085 - RNA, 64 nt, Homo Sapiens; identical to SEQ ID NO: 50047

SEQ ID NO: 747086 - RNA, 64 nt, Homo Sapiens; identical to SEQ ID NO: 50048

SEQ ID NO: 747087 - RNA, 64 nt, Homo Sapiens; identical to SEQ ID NO: 50049

SEQ ID NO: 747088 - RNA, 64 nt, Homo Sapiens; identical to SEQ ID NO: 50050

SEQ ID NO: 747089 - RNA, 64 nt, Homo Sapiens; identical to SEQ ID NO: 50051

SEQ ID NO: 747090 - RNA, 64 nt, Homo Sapiens; identical to SEQ ID NO: 50052

SEQ ID NO: 747091 - RNA, 64 nt, Homo Sapiens; identical to SEQ ID NO: 50053

SEQ ID NO: 747092 - RNA, 64 nt, Homo Sapiens; identical to SEQ ID NO: 50054

SEQ ID NO: 747093 - RNA, 64 nt, Homo Sapiens; identical to SEQ ID NO: 50055

SEQ ID NO: 747094 - RNA, 64 nt, Homo Sapiens; identical to SEQ ID NO: 50056

SEQ ID NO: 747095 - RNA, 64 nt, Homo Sapiens; identical to SEQ ID NO: 50057

SEQ ID NO: 747096 - RNA, 64 nt, Homo Sapiens; identical to SEQ ID NO: 50058

SEQ ID NO: 747097 - RNA, 64 nt, Homo Sapiens; identical to SEQ ID NO: 50059

SEQ ID NO: 747098 - RNA, 64 nt, Homo Sapiens; identical to SEQ ID NO: 50060

SEQ ID NO: 747099 - RNA, 64 nt, Homo Sapiens; identical to SEQ ID NO: 50061

SEQ ID NO: 747100 - RNA, 64 nt, Homo Sapiens; identical to SEQ ID NO: 50062

SEQ ID NO: 747101 - RNA, 64 nt, Homo Sapiens; identical to SEQ ID NO: 50063

SEQ ID NO: 747102 - RNA, 64 nt, Homo Sapiens; identical to SEQ ID NO: 50064

SEQ ID NO: 747103 - RNA, 64 nt, Homo Sapiens; identical to SEQ ID NO: 50065

SEQ ID NO: 747104 - RNA, 64 nt, Homo Sapiens; identical to SEQ ID NO: 50066

SEQ ID NO: 747105 - RNA, 64 nt, Homo Sapiens; identical to SEQ ID NO: 50067

SEQ ID NO: 747106 - RNA, 64 nt, Homo Sapiens; identical to SEQ ID NO: 50068

SEQ ID NO: 747107 - RNA, 64 nt, Homo Sapiens; identical to SEQ ID NO: 50069

SEQ ID NO: 747108 - RNA, 64 nt, Homo Sapiens; identical to SEQ ID NO: 50070

SEQ ID NO: 747109 - RNA, 64 nt, Homo Sapiens; identical to SEQ ID NO: 50071

SEQ ID NO: 747110 - RNA, 64 nt, Homo Sapiens; identical to SEQ ID NO: 50072

SEQ ID NO: 747111 - RNA, 64 nt, Homo Sapiens; identical to SEQ ID NO: 50073

SEQ ID NO: 747112 - RNA, 64 nt, Homo Sapiens; identical to SEQ ID NO: 50074

SEQ ID NO: 747113 - RNA, 64 nt, Homo Sapiens; identical to SEQ ID NO: 50075

SEQ ID NO: 747114 - RNA, 64 nt, Homo Sapiens; identical to SEQ ID NO: 50076

SEQ ID NO: 747115 - RNA, 64 nt, Homo Sapiens; identical to SEQ ID NO: 50077

SEQ ID NO: 747116 - RNA, 64 nt, Homo Sapiens; identical to SEQ ID NO: 50078

SEQ ID NO: 747117 - RNA, 64 nt, Homo Sapiens; identical to SEQ ID NO: 50079

SEQ ID NO: 747118 - RNA, 64 nt, Homo Sapiens; identical to SEQ ID NO: 50080

SEQ ID NO: 747119 - RNA, 64 nt, Homo Sapiens; identical to SEQ ID NO: 50081

SEQ ID NO: 747120 - RNA, 64 nt, Homo Sapiens; identical to SEQ ID NO: 50082

SEQ ID NO: 747121 - RNA, 64 nt, Homo Sapiens; identical to SEQ ID NO: 50083

SEQ ID NO: 747122 - RNA, 64 nt, Homo Sapiens; identical to SEQ ID NO: 50084

SEQ ID NO: 747123 - RNA, 64 nt, Homo Sapiens; identical to SEQ ID NO: 50085

SEQ ID NO: 747124 - RNA, 64 nt, Homo Sapiens; identical to SEQ ID NO: 50086

SEQ ID NO: 747125 - RNA, 64 nt, Homo Sapiens; identical to SEQ ID NO: 50087

SEQ ID NO: 747126 - RNA, 64 nt, Homo Sapiens; identical to SEQ ID NO: 50088

SEQ ID NO: 747127 - RNA, 64 nt, Homo Sapiens; identical to SEQ ID NO: 50089

SEQ ID NO: 747128 - RNA, 64 nt, Homo Sapiens; identical to SEQ ID NO: 50090

SEQ ID NO: 747129 - RNA, 64 nt, Homo Sapiens; identical to SEQ ID NO: 50091

SEQ ID NO: 747130 - RNA, 64 nt, Homo Sapiens; identical to SEQ ID NO: 50092

SEQ ID NO: 747131 - RNA, 63 nt, Homo Sapiens; identical to SEQ ID NO: 50093

SEQ ID NO: 747132 - RNA, 64 nt, Homo Sapiens; identical to SEQ ID NO: 50094

SEQ ID NO: 747133 - RNA, 64 nt, Homo Sapiens; identical to SEQ ID NO: 50095

SEQ ID NO: 747134 - RNA, 64 nt, Homo Sapiens; identical to SEQ ID NO: 50096

SEQ ID NO: 747135 - RNA, 64 nt, Homo Sapiens; identical to SEQ ID NO: 50097

SEQ ID NO: 747136 - RNA, 64 nt, Homo Sapiens; identical to SEQ ID NO: 50098

SEQ ID NO: 747137 - RNA, 64 nt, Homo Sapiens; identical to SEQ ID NO: 50099

SEQ ID NO: 747138 - RNA, 64 nt, Homo Sapiens; identical to SEQ ID NO: 50100

SEQ ID NO: 747139 - RNA, 64 nt, Homo Sapiens; identical to SEQ ID NO: 50101

SEQ ID NO: 747140 - RNA, 64 nt, Homo Sapiens; identical to SEQ ID NO: 50102

SEQ ID NO: 747141 - RNA, 64 nt, Homo Sapiens; identical to SEQ ID NO: 50103

SEQ ID NO: 747142 - RNA, 64 nt, Homo Sapiens; identical to SEQ ID NO: 50104

SEQ ID NO: 747143 - RNA, 64 nt, Homo Sapiens; identical to SEQ ID NO: 50105

SEQ ID NO: 747144 - RNA, 64 nt, Homo Sapiens; identical to SEQ ID NO: 50106

SEQ ID NO: 747145 - RNA, 64 nt, Homo Sapiens; identical to SEQ ID NO: 50107

SEQ ID NO: 747146 - RNA, 64 nt, Homo Sapiens; identical to SEQ ID NO: 50108

SEQ ID NO: 747147 - RNA, 64 nt, Homo Sapiens; identical to SEQ ID NO: 50109

SEQ ID NO: 747148 - RNA, 64 nt, Homo Sapiens; identical to SEQ ID NO: 50110

SEQ ID NO: 747149 - RNA, 64 nt, Homo Sapiens; identical to SEQ ID NO: 50111

SEQ ID NO: 747150 - RNA, 64 nt, Homo Sapiens; identical to SEQ ID NO: 50112

SEQ ID NO: 747151 - RNA, 64 nt, Homo Sapiens; identical to SEQ ID NO: 50113

SEQ ID NO: 747152 - RNA, 64 nt, Homo Sapiens; identical to SEQ ID NO: 50114

SEQ ID NO: 747153 - RNA, 64 nt, Homo Sapiens; identical to SEQ ID NO: 50115

SEQ ID NO: 747154 - RNA, 64 nt, Homo Sapiens; identical to SEQ ID NO: 50116

SEQ ID NO: 747155 - RNA, 64 nt, Homo Sapiens; identical to SEQ ID NO: 50117

SEQ ID NO: 747156 - RNA, 64 nt, Homo Sapiens; identical to SEQ ID NO: 50118

SEQ ID NO: 747157 - RNA, 64 nt, Homo Sapiens; identical to SEQ ID NO: 50119

SEQ ID NO: 747158 - RNA, 64 nt, Homo Sapiens; identical to SEQ ID NO: 50120

SEQ ID NO: 747159 - RNA, 64 nt, Homo Sapiens; identical to SEQ ID NO: 50121

SEQ ID NO: 747160 - RNA, 64 nt, Homo Sapiens; identical to SEQ ID NO: 38255

SEQ ID NO: 747161 - RNA, 64 nt, Homo Sapiens; identical to SEQ ID NO: 38256

SEQ ID NO: 747162 - RNA, 64 nt, Homo Sapiens; identical to SEQ ID NO: 38257

SEQ ID NO: 747163 - RNA, 64 nt, Homo Sapiens; identical to SEQ ID NO: 38258

SEQ ID NO: 747164 - RNA, 64 nt, Homo Sapiens; identical to SEQ ID NO: 38259

SEQ ID NO: 747165 - RNA, 64 nt, Homo Sapiens; identical to SEQ ID NO: 38260

SEQ ID NO: 747166 - RNA, 64 nt, Homo Sapiens; identical to SEQ ID NO: 38261

SEQ ID NO: 747167 - RNA, 64 nt, Homo Sapiens; identical to SEQ ID NO: 38262

SEQ ID NO: 747168 - RNA, 64 nt, Homo Sapiens; identical to SEQ ID NO: 38263

SEQ ID NO: 747169 - RNA, 64 nt, Homo Sapiens; identical to SEQ ID NO: 38264

SEQ ID NO: 747170 - RNA, 64 nt, Homo Sapiens; identical to SEQ ID NO: 38265

SEQ ID NO: 747171 - RNA, 64 nt, Homo Sapiens; identical to SEQ ID NO: 38266

SEQ ID NO: 747172 - RNA, 64 nt, Homo Sapiens; identical to SEQ ID NO: 38267

SEQ ID NO: 747173 - RNA, 64 nt, Homo Sapiens; identical to SEQ ID NO: 38268

SEQ ID NO: 747174 - RNA, 64 nt, Homo Sapiens; identical to SEQ ID NO: 38269

SEQ ID NO: 747175 - RNA, 64 nt, Homo Sapiens; identical to SEQ ID NO: 38270

SEQ ID NO: 747176 - RNA, 64 nt, Homo Sapiens; identical to SEQ ID NO: 38271

SEQ ID NO: 747177 - RNA, 64 nt, Homo Sapiens; identical to SEQ ID NO: 38272

SEQ ID NO: 747178 - RNA, 64 nt, Homo Sapiens; identical to SEQ ID NO: 38273

SEQ ID NO: 747179 - RNA, 64 nt, Homo Sapiens; identical to SEQ ID NO: 38274

SEQ ID NO: 747180 - RNA, 64 nt, Homo Sapiens; identical to SEQ ID NO: 38275

SEQ ID NO: 747181 - RNA, 64 nt, Homo Sapiens; identical to SEQ ID NO: 38276

SEQ ID NO: 747182 - RNA, 64 nt, Homo Sapiens; identical to SEQ ID NO: 38277

SEQ ID NO: 747183 - RNA, 64 nt, Homo Sapiens; identical to SEQ ID NO: 38278

SEQ ID NO: 747184 - RNA, 64 nt, Homo Sapiens; identical to SEQ ID NO: 38279

SEQ ID NO: 747185 - RNA, 64 nt, Homo Sapiens; identical to SEQ ID NO: 38280

SEQ ID NO: 747186 - RNA, 64 nt, Homo Sapiens; identical to SEQ ID NO: 38281

SEQ ID NO: 747187 - RNA, 64 nt, Homo Sapiens; identical to SEQ ID NO: 38282

SEQ ID NO: 747188 - RNA, 64 nt, Homo Sapiens; identical to SEQ ID NO: 38283

SEQ ID NO: 747189 - RNA, 64 nt, Homo Sapiens; identical to SEQ ID NO: 38284

SEQ ID NO: 747190 - RNA, 62 nt, Homo Sapiens; identical to SEQ ID NO: 38285

SEQ ID NO: 747191 - RNA, 64 nt, Homo Sapiens; identical to SEQ ID NO: 38286

SEQ ID NO: 747192 - RNA, 64 nt, Homo Sapiens; identical to SEQ ID NO: 38287

SEQ ID NO: 747193 - RNA, 64 nt, Homo Sapiens; identical to SEQ ID NO: 38288

SEQ ID NO: 747194 - RNA, 64 nt, Homo Sapiens; identical to SEQ ID NO: 38289

SEQ ID NO: 747195 - RNA, 64 nt, Homo Sapiens; identical to SEQ ID NO: 38290

SEQ ID NO: 747196 - RNA, 64 nt, Homo Sapiens; identical to SEQ ID NO: 38291

SEQ ID NO: 747197 - RNA, 64 nt, Homo Sapiens; identical to SEQ ID NO: 38292

SEQ ID NO: 747198 - RNA, 64 nt, Homo Sapiens; identical to SEQ ID NO: 38293

SEQ ID NO: 747199 - RNA, 64 nt, Homo Sapiens; identical to SEQ ID NO: 38294

SEQ ID NO: 747200 - RNA, 64 nt, Homo Sapiens; identical to SEQ ID NO: 38295

SEQ ID NO: 747201 - RNA, 64 nt, Homo Sapiens; identical to SEQ ID NO: 38296

SEQ ID NO: 747202 - RNA, 64 nt, Homo Sapiens; identical to SEQ ID NO: 38297

SEQ ID NO: 747203 - RNA, 64 nt, Homo Sapiens; identical to SEQ ID NO: 38298

SEQ ID NO: 747204 - RNA, 64 nt, Homo Sapiens; identical to SEQ ID NO: 38299

SEQ ID NO: 747205 - RNA, 64 nt, Homo Sapiens; identical to SEQ ID NO: 38300

SEQ ID NO: 747206 - RNA, 64 nt, Homo Sapiens; identical to SEQ ID NO: 38301

SEQ ID NO: 747207 - RNA, 64 nt, Homo Sapiens; identical to SEQ ID NO: 38302

SEQ ID NO: 747208 - RNA, 64 nt, Homo Sapiens; identical to SEQ ID NO: 38303

SEQ ID NO: 747209 - RNA, 64 nt, Homo Sapiens; identical to SEQ ID NO: 38304

SEQ ID NO: 747210 - RNA, 64 nt, Homo Sapiens; identical to SEQ ID NO: 38305

SEQ ID NO: 747211 - RNA, 64 nt, Homo Sapiens; identical to SEQ ID NO: 38306

SEQ ID NO: 747212 - RNA, 64 nt, Homo Sapiens; identical to SEQ ID NO: 38307

SEQ ID NO: 747213 - RNA, 64 nt, Homo Sapiens; identical to SEQ ID NO: 38308

SEQ ID NO: 747214 - RNA, 64 nt, Homo Sapiens; identical to SEQ ID NO: 38309

SEQ ID NO: 747215 - RNA, 64 nt, Homo Sapiens; identical to SEQ ID NO: 38310

SEQ ID NO: 747216 - RNA, 64 nt, Homo Sapiens; identical to SEQ ID NO: 38311

SEQ ID NO: 747217 - RNA, 64 nt, Homo Sapiens; identical to SEQ ID NO: 38312

SEQ ID NO: 747218 - RNA, 64 nt, Homo Sapiens; identical to SEQ ID NO: 38313

SEQ ID NO: 747219 - RNA, 64 nt, Homo Sapiens; identical to SEQ ID NO: 38314

SEQ ID NO: 747220 - RNA, 64 nt, Homo Sapiens; identical to SEQ ID NO: 38315

SEQ ID NO: 747221 - RNA, 64 nt, Homo Sapiens; identical to SEQ ID NO: 38316

SEQ ID NO: 747222 - RNA, 64 nt, Homo Sapiens; identical to SEQ ID NO: 38317

SEQ ID NO: 747223 - RNA, 64 nt, Homo Sapiens; identical to SEQ ID NO: 38318

SEQ ID NO: 747224 - RNA, 64 nt, Homo Sapiens; identical to SEQ ID NO: 235641

SEQ ID NO: 747225 - RNA, 64 nt, Homo Sapiens; identical to SEQ ID NO: 235642

SEQ ID NO: 747226 - RNA, 64 nt, Homo Sapiens; identical to SEQ ID NO: 235643

SEQ ID NO: 747227 - RNA, 64 nt, Homo Sapiens; identical to SEQ ID NO: 235644

SEQ ID NO: 747228 - RNA, 64 nt, Homo Sapiens; identical to SEQ ID NO: 235645

SEQ ID NO: 747229 - RNA, 64 nt, Homo Sapiens; identical to SEQ ID NO: 235646

SEQ ID NO: 747230 - RNA, 64 nt, Homo Sapiens; identical to SEQ ID NO: 235647

SEQ ID NO: 747231 - RNA, 64 nt, Homo Sapiens; identical to SEQ ID NO: 235648

SEQ ID NO: 747232 - RNA, 64 nt, Homo Sapiens; identical to SEQ ID NO: 235649

SEQ ID NO: 747233 - RNA, 64 nt, Homo Sapiens; identical to SEQ ID NO: 235650

SEQ ID NO: 747234 - RNA, 64 nt, Homo Sapiens; identical to SEQ ID NO: 235651

SEQ ID NO: 747235 - RNA, 64 nt, Homo Sapiens; identical to SEQ ID NO: 235652

SEQ ID NO: 747236 - RNA, 64 nt, Homo Sapiens; identical to SEQ ID NO: 235653

SEQ ID NO: 747237 - RNA, 64 nt, Homo Sapiens; identical to SEQ ID NO: 235654

SEQ ID NO: 747238 - RNA, 64 nt, Homo Sapiens; identical to SEQ ID NO: 235655

SEQ ID NO: 747239 - RNA, 64 nt, Homo Sapiens; identical to SEQ ID NO: 235656

SEQ ID NO: 747240 - RNA, 64 nt, Homo Sapiens; identical to SEQ ID NO: 235657

SEQ ID NO: 747241 - RNA, 64 nt, Homo Sapiens; identical to SEQ ID NO: 235658

SEQ ID NO: 747242 - RNA, 64 nt, Homo Sapiens; identical to SEQ ID NO: 235659

SEQ ID NO: 747243 - RNA, 64 nt, Homo Sapiens; identical to SEQ ID NO: 235660

SEQ ID NO: 747244 - RNA, 64 nt, Homo Sapiens; identical to SEQ ID NO: 235661

SEQ ID NO: 747245 - RNA, 64 nt, Homo Sapiens; identical to SEQ ID NO: 235662

SEQ ID NO: 747246 - RNA, 64 nt, Homo Sapiens; identical to SEQ ID NO: 235663

SEQ ID NO: 747247 - RNA, 64 nt, Homo Sapiens; identical to SEQ ID NO: 235664

SEQ ID NO: 747248 - RNA, 64 nt, Homo Sapiens; identical to SEQ ID NO: 235665

SEQ ID NO: 747249 - RNA, 64 nt, Homo Sapiens; identical to SEQ ID NO: 235666

SEQ ID NO: 747250 - RNA, 64 nt, Homo Sapiens; identical to SEQ ID NO: 235667

SEQ ID NO: 747251 - RNA, 64 nt, Homo Sapiens; identical to SEQ ID NO: 235668

SEQ ID NO: 747252 - RNA, 64 nt, Homo Sapiens; identical to SEQ ID NO: 235669

SEQ ID NO: 747253 - RNA, 64 nt, Homo Sapiens; identical to SEQ ID NO: 235670

SEQ ID NO: 747254 - RNA, 64 nt, Homo Sapiens; identical to SEQ ID NO: 235671

SEQ ID NO: 747255 - RNA, 64 nt, Homo Sapiens; identical to SEQ ID NO: 235672

SEQ ID NO: 747256 - RNA, 64 nt, Homo Sapiens; identical to SEQ ID NO: 235673

SEQ ID NO: 747257 - RNA, 64 nt, Homo Sapiens; identical to SEQ ID NO: 235674

SEQ ID NO: 747258 - RNA, 64 nt, Homo Sapiens; identical to SEQ ID NO: 235675

SEQ ID NO: 747259 - RNA, 64 nt, Homo Sapiens; identical to SEQ ID NO: 235676

SEQ ID NO: 747260 - RNA, 64 nt, Homo Sapiens; identical to SEQ ID NO: 235677

SEQ ID NO: 747261 - RNA, 64 nt, Homo Sapiens; identical to SEQ ID NO: 235678

SEQ ID NO: 747262 - RNA, 64 nt, Homo Sapiens; identical to SEQ ID NO: 235679

SEQ ID NO: 747263 - RNA, 64 nt, Homo Sapiens; identical to SEQ ID NO: 235680

SEQ ID NO: 747264 - RNA, 64 nt, Homo Sapiens; identical to SEQ ID NO: 235681

SEQ ID NO: 747265 - RNA, 64 nt, Homo Sapiens; identical to SEQ ID NO: 235682

SEQ ID NO: 747266 - RNA, 64 nt, Homo Sapiens; identical to SEQ ID NO: 235683

SEQ ID NO: 747267 - RNA, 64 nt, Homo Sapiens; identical to SEQ ID NO: 235684

SEQ ID NO: 747268 - RNA, 64 nt, Homo Sapiens; identical to SEQ ID NO: 235685

SEQ ID NO: 747269 - RNA, 64 nt, Homo Sapiens; identical to SEQ ID NO: 235686

SEQ ID NO: 747270 - RNA, 64 nt, Homo Sapiens; identical to SEQ ID NO: 235687

SEQ ID NO: 747271 - RNA, 64 nt, Homo Sapiens; identical to SEQ ID NO: 235688

SEQ ID NO: 747272 - RNA, 64 nt, Homo Sapiens; identical to SEQ ID NO: 235689

SEQ ID NO: 747273 - RNA, 64 nt, Homo Sapiens; identical to SEQ ID NO: 235690

SEQ ID NO: 747274 - RNA, 64 nt, Homo Sapiens; identical to SEQ ID NO: 235691

SEQ ID NO: 747275 - RNA, 64 nt, Homo Sapiens; identical to SEQ ID NO: 235692

SEQ ID NO: 747276 - RNA, 64 nt, Homo Sapiens; identical to SEQ ID NO: 235693

SEQ ID NO: 747277 - RNA, 64 nt, Homo Sapiens; identical to SEQ ID NO: 235694

SEQ ID NO: 747278 - RNA, 64 nt, Homo Sapiens; identical to SEQ ID NO: 235695

SEQ ID NO: 747279 - RNA, 64 nt, Homo Sapiens; identical to SEQ ID NO: 235696

SEQ ID NO: 747280 - RNA, 64 nt, Homo Sapiens; identical to SEQ ID NO: 235697

SEQ ID NO: 747281 - RNA, 64 nt, Homo Sapiens; identical to SEQ ID NO: 464050

SEQ ID NO: 747282 - RNA, 64 nt, Homo Sapiens; identical to SEQ ID NO: 464051

SEQ ID NO: 747283 - RNA, 64 nt, Homo Sapiens; identical to SEQ ID NO: 464052

SEQ ID NO: 747284 - RNA, 64 nt, Homo Sapiens; identical to SEQ ID NO: 464053

SEQ ID NO: 747285 - RNA, 64 nt, Homo Sapiens; identical to SEQ ID NO: 464054

SEQ ID NO: 747286 - RNA, 64 nt, Homo Sapiens; identical to SEQ ID NO: 464055

SEQ ID NO: 747287 - RNA, 64 nt, Homo Sapiens; identical to SEQ ID NO: 464056

SEQ ID NO: 747288 - RNA, 61 nt, Homo Sapiens; identical to SEQ ID NO: 464057

SEQ ID NO: 747289 - RNA, 64 nt, Homo Sapiens; identical to SEQ ID NO: 464058

SEQ ID NO: 747290 - RNA, 64 nt, Homo Sapiens; identical to SEQ ID NO: 464059

SEQ ID NO: 747291 - RNA, 64 nt, Homo Sapiens; identical to SEQ ID NO: 464060

SEQ ID NO: 747292 - RNA, 64 nt, Homo Sapiens; identical to SEQ ID NO: 464061

SEQ ID NO: 747293 - RNA, 64 nt, Homo Sapiens; identical to SEQ ID NO: 464062

SEQ ID NO: 747294 - RNA, 64 nt, Homo Sapiens; identical to SEQ ID NO: 464063

SEQ ID NO: 747295 - RNA, 64 nt, Homo Sapiens; identical to SEQ ID NO: 464064

SEQ ID NO: 747296 - RNA, 64 nt, Homo Sapiens; identical to SEQ ID NO: 464065

SEQ ID NO: 747297 - RNA, 64 nt, Homo Sapiens; identical to SEQ ID NO: 464066

SEQ ID NO: 747298 - RNA, 64 nt, Homo Sapiens; identical to SEQ ID NO: 464067

SEQ ID NO: 747299 - RNA, 64 nt, Homo Sapiens; identical to SEQ ID NO: 464068

SEQ ID NO: 747300 - RNA, 64 nt, Homo Sapiens; identical to SEQ ID NO: 464069

SEQ ID NO: 747301 - RNA, 64 nt, Homo Sapiens; identical to SEQ ID NO: 300789

SEQ ID NO: 747302 - RNA, 64 nt, Homo Sapiens; identical to SEQ ID NO: 300790

SEQ ID NO: 747303 - RNA, 64 nt, Homo Sapiens; identical to SEQ ID NO: 300791

SEQ ID NO: 747304 - RNA, 64 nt, Homo Sapiens; identical to SEQ ID NO: 300792

SEQ ID NO: 747305 - RNA, 64 nt, Homo Sapiens; identical to SEQ ID NO: 300793

SEQ ID NO: 747306 - RNA, 64 nt, Homo Sapiens; identical to SEQ ID NO: 300794

SEQ ID NO: 747307 - RNA, 64 nt, Homo Sapiens; identical to SEQ ID NO: 300795

SEQ ID NO: 747308 - RNA, 64 nt, Homo Sapiens; identical to SEQ ID NO: 300796

SEQ ID NO: 747309 - RNA, 64 nt, Homo Sapiens; identical to SEQ ID NO: 300797

SEQ ID NO: 747310 - RNA, 64 nt, Homo Sapiens; identical to SEQ ID NO: 300798

SEQ ID NO: 747311 - RNA, 64 nt, Homo Sapiens; identical to SEQ ID NO: 300799

SEQ ID NO: 747312 - RNA, 64 nt, Homo Sapiens; identical to SEQ ID NO: 300800

SEQ ID NO: 747313 - RNA, 64 nt, Homo Sapiens; identical to SEQ ID NO: 300801

SEQ ID NO: 747314 - RNA, 64 nt, Homo Sapiens; identical to SEQ ID NO: 300802

SEQ ID NO: 747315 - RNA, 64 nt, Homo Sapiens; identical to SEQ ID NO: 556943

SEQ ID NO: 747316 - RNA, 64 nt, Homo Sapiens; identical to SEQ ID NO: 556944

SEQ ID NO: 747317 - RNA, 64 nt, Homo Sapiens; identical to SEQ ID NO: 556945

SEQ ID NO: 747318 - RNA, 64 nt, Homo Sapiens; identical to SEQ ID NO: 556946

SEQ ID NO: 747319 - RNA, 64 nt, Homo Sapiens; identical to SEQ ID NO: 556947

SEQ ID NO: 747320 - RNA, 64 nt, Homo Sapiens; identical to SEQ ID NO: 556948

SEQ ID NO: 747321 - RNA, 64 nt, Homo Sapiens; identical to SEQ ID NO: 556949

SEQ ID NO: 747322 - RNA, 64 nt, Homo Sapiens; identical to SEQ ID NO: 556950

SEQ ID NO: 747323 - RNA, 64 nt, Homo Sapiens; identical to SEQ ID NO: 556951

SEQ ID NO: 747324 - RNA, 64 nt, Homo Sapiens; identical to SEQ ID NO: 556952

SEQ ID NO: 747325 - RNA, 64 nt, Homo Sapiens; identical to SEQ ID NO: 556953

SEQ ID NO: 747326 - RNA, 64 nt, Homo Sapiens; identical to SEQ ID NO: 556954

SEQ ID NO: 747327 - RNA, 64 nt, Homo Sapiens; identical to SEQ ID NO: 556955

SEQ ID NO: 747328 - RNA, 64 nt, Homo Sapiens; identical to SEQ ID NO: 556956

SEQ ID NO: 747329 - RNA, 64 nt, Homo Sapiens; identical to SEQ ID NO: 556957

SEQ ID NO: 747330 - RNA, 64 nt, Homo Sapiens; identical to SEQ ID NO: 556958

SEQ ID NO: 747331 - RNA, 64 nt, Homo Sapiens; identical to SEQ ID NO: 556959

SEQ ID NO: 747332 - RNA, 58 nt, Homo Sapiens; identical to SEQ ID NO: 556960

SEQ ID NO: 747333 - RNA, 64 nt, Homo Sapiens; identical to SEQ ID NO: 556961

SEQ ID NO: 747334 - RNA, 64 nt, Homo Sapiens; identical to SEQ ID NO: 556962

SEQ ID NO: 747335 - RNA, 64 nt, Homo Sapiens; identical to SEQ ID NO: 556963

SEQ ID NO: 747336 - RNA, 64 nt, Homo Sapiens; identical to SEQ ID NO: 556964

SEQ ID NO: 747337 - RNA, 64 nt, Homo Sapiens; identical to SEQ ID NO: 556965

SEQ ID NO: 747338 - RNA, 64 nt, Homo Sapiens; identical to SEQ ID NO: 556966

SEQ ID NO: 747339 - RNA, 64 nt, Homo Sapiens; identical to SEQ ID NO: 556967

SEQ ID NO: 747340 - RNA, 64 nt, Homo Sapiens; identical to SEQ ID NO: 556968

SEQ ID NO: 747341 - RNA, 64 nt, Homo Sapiens; identical to SEQ ID NO: 556969

SEQ ID NO: 747342 - RNA, 64 nt, Homo Sapiens; identical to SEQ ID NO: 556970

SEQ ID NO: 747343 - RNA, 64 nt, Homo Sapiens; identical to SEQ ID NO: 556971

SEQ ID NO: 747344 - RNA, 64 nt, Homo Sapiens; identical to SEQ ID NO: 556972

SEQ ID NO: 747345 - RNA, 64 nt, Homo Sapiens; identical to SEQ ID NO: 556973

SEQ ID NO: 747346 - RNA, 64 nt, Homo Sapiens; identical to SEQ ID NO: 556974

SEQ ID NO: 747347 - RNA, 64 nt, Homo Sapiens; identical to SEQ ID NO: 556975

SEQ ID NO: 747348 - RNA, 64 nt, Homo Sapiens; identical to SEQ ID NO: 556976

SEQ ID NO: 747349 - RNA, 64 nt, Homo Sapiens; identical to SEQ ID NO: 556977

SEQ ID NO: 747350 - RNA, 64 nt, Homo Sapiens; identical to SEQ ID NO: 556978

SEQ ID NO: 747351 - RNA, 64 nt, Homo Sapiens; identical to SEQ ID NO: 556979

SEQ ID NO: 747352 - RNA, 64 nt, Homo Sapiens; identical to SEQ ID NO: 556980

SEQ ID NO: 747353 - RNA, 64 nt, Homo Sapiens; identical to SEQ ID NO: 556981

SEQ ID NO: 747354 - RNA, 64 nt, Homo Sapiens; identical to SEQ ID NO: 556982

SEQ ID NO: 747355 - RNA, 64 nt, Homo Sapiens; identical to SEQ ID NO: 556983

SEQ ID NO: 747356 - RNA, 64 nt, Homo Sapiens; identical to SEQ ID NO: 556984

SEQ ID NO: 747357 - RNA, 64 nt, Homo Sapiens; identical to SEQ ID NO: 556985

SEQ ID NO: 747358 - RNA, 64 nt, Homo Sapiens; identical to SEQ ID NO: 556986

SEQ ID NO: 747359 - RNA, 64 nt, Homo Sapiens; identical to SEQ ID NO: 556987

SEQ ID NO: 747360 - RNA, 64 nt, Homo Sapiens; identical to SEQ ID NO: 556988

SEQ ID NO: 747361 - RNA, 64 nt, Homo Sapiens; identical to SEQ ID NO: 556989

SEQ ID NO: 747362 - RNA, 64 nt, Homo Sapiens; identical to SEQ ID NO: 556990

SEQ ID NO: 747363 - RNA, 64 nt, Homo Sapiens; identical to SEQ ID NO: 556991

SEQ ID NO: 747364 - RNA, 64 nt, Homo Sapiens; identical to SEQ ID NO: 556992

SEQ ID NO: 747365 - RNA, 64 nt, Homo Sapiens; identical to SEQ ID NO: 556993

SEQ ID NO: 747366 - RNA, 64 nt, Homo Sapiens; identical to SEQ ID NO: 556994

SEQ ID NO: 747367 - RNA, 64 nt, Homo Sapiens; identical to SEQ ID NO: 556995

SEQ ID NO: 747368 - RNA, 64 nt, Homo Sapiens; identical to SEQ ID NO: 556996

SEQ ID NO: 747369 - RNA, 64 nt, Homo Sapiens; identical to SEQ ID NO: 556997

SEQ ID NO: 747370 - RNA, 64 nt, Homo Sapiens; identical to SEQ ID NO: 556998

SEQ ID NO: 747371 - RNA, 64 nt, Homo Sapiens; identical to SEQ ID NO: 556999

SEQ ID NO: 747372 - RNA, 64 nt, Homo Sapiens; identical to SEQ ID NO: 557000

SEQ ID NO: 747373 - RNA, 64 nt, Homo Sapiens; identical to SEQ ID NO: 557001

SEQ ID NO: 747374 - RNA, 64 nt, Homo Sapiens; identical to SEQ ID NO: 557002

SEQ ID NO: 747375 - RNA, 64 nt, Homo Sapiens; identical to SEQ ID NO: 557003

SEQ ID NO: 747376 - RNA, 64 nt, Homo Sapiens; identical to SEQ ID NO: 557004

SEQ ID NO: 747377 - RNA, 64 nt, Homo Sapiens; identical to SEQ ID NO: 557005

SEQ ID NO: 747378 - RNA, 64 nt, Homo Sapiens; identical to SEQ ID NO: 557006

SEQ ID NO: 747379 - RNA, 64 nt, Homo Sapiens; identical to SEQ ID NO: 557007

SEQ ID NO: 747380 - RNA, 64 nt, Homo Sapiens; identical to SEQ ID NO: 557008

SEQ ID NO: 747381 - RNA, 64 nt, Homo Sapiens; identical to SEQ ID NO: 557009

SEQ ID NO: 747382 - RNA, 64 nt, Homo Sapiens; identical to SEQ ID NO: 557010

SEQ ID NO: 747383 - RNA, 64 nt, Homo Sapiens; identical to SEQ ID NO: 557011

SEQ ID NO: 747384 - RNA, 64 nt, Homo Sapiens; identical to SEQ ID NO: 557012

SEQ ID NO: 747385 - RNA, 64 nt, Homo Sapiens; identical to SEQ ID NO: 557013

SEQ ID NO: 747386 - RNA, 64 nt, Homo Sapiens; identical to SEQ ID NO: 557014

SEQ ID NO: 747387 - RNA, 64 nt, Homo Sapiens; identical to SEQ ID NO: 557015

SEQ ID NO: 747388 - RNA, 64 nt, Homo Sapiens; identical to SEQ ID NO: 557016

SEQ ID NO: 747389 - RNA, 64 nt, Homo Sapiens; identical to SEQ ID NO: 557017

SEQ ID NO: 747390 - RNA, 64 nt, Homo Sapiens; identical to SEQ ID NO: 557018

SEQ ID NO: 747391 - RNA, 64 nt, Homo Sapiens; identical to SEQ ID NO: 557019

SEQ ID NO: 747392 - RNA, 64 nt, Homo Sapiens; identical to SEQ ID NO: 557020

SEQ ID NO: 747393 - RNA, 64 nt, Homo Sapiens; identical to SEQ ID NO: 557021

SEQ ID NO: 747394 - RNA, 64 nt, Homo Sapiens; identical to SEQ ID NO: 557022

SEQ ID NO: 747395 - RNA, 64 nt, Homo Sapiens; identical to SEQ ID NO: 557023

SEQ ID NO: 747396 - RNA, 64 nt, Homo Sapiens; identical to SEQ ID NO: 557024

SEQ ID NO: 747397 - RNA, 64 nt, Homo Sapiens; identical to SEQ ID NO: 557025

SEQ ID NO: 747398 - RNA, 64 nt, Homo Sapiens; identical to SEQ ID NO: 360094

SEQ ID NO: 747399 - RNA, 64 nt, Homo Sapiens; identical to SEQ ID NO: 360095

SEQ ID NO: 747400 - RNA, 64 nt, Homo Sapiens; identical to SEQ ID NO: 360096

SEQ ID NO: 747401 - RNA, 64 nt, Homo Sapiens; identical to SEQ ID NO: 360097

SEQ ID NO: 747402 - RNA, 64 nt, Homo Sapiens; identical to SEQ ID NO: 360098

SEQ ID NO: 747403 - RNA, 64 nt, Homo Sapiens; identical to SEQ ID NO: 360099

SEQ ID NO: 747404 - RNA, 64 nt, Homo Sapiens; identical to SEQ ID NO: 360100

SEQ ID NO: 747405 - RNA, 64 nt, Homo Sapiens; identical to SEQ ID NO: 360101

SEQ ID NO: 747406 - RNA, 64 nt, Homo Sapiens; identical to SEQ ID NO: 360102

SEQ ID NO: 747407 - RNA, 64 nt, Homo Sapiens; identical to SEQ ID NO: 360103

SEQ ID NO: 747408 - RNA, 64 nt, Homo Sapiens; identical to SEQ ID NO: 417229

SEQ ID NO: 747409 - RNA, 64 nt, Homo Sapiens; identical to SEQ ID NO: 417230

SEQ ID NO: 747410 - RNA, 64 nt, Homo Sapiens; identical to SEQ ID NO: 417231

SEQ ID NO: 747411 - RNA, 64 nt, Homo Sapiens; identical to SEQ ID NO: 417232

SEQ ID NO: 747412 - RNA, 64 nt, Homo Sapiens; identical to SEQ ID NO: 417233

SEQ ID NO: 747413 - RNA, 64 nt, Homo Sapiens; identical to SEQ ID NO: 417234

SEQ ID NO: 747414 - RNA, 64 nt, Homo Sapiens; identical to SEQ ID NO: 417235

SEQ ID NO: 747415 - RNA, 64 nt, Homo Sapiens; identical to SEQ ID NO: 417236

SEQ ID NO: 747416 - RNA, 64 nt, Homo Sapiens; identical to SEQ ID NO: 417237

SEQ ID NO: 747417 - RNA, 64 nt, Homo Sapiens; identical to SEQ ID NO: 417238

SEQ ID NO: 747418 - RNA, 64 nt, Homo Sapiens; identical to SEQ ID NO: 417239

SEQ ID NO: 747419 - RNA, 64 nt, Homo Sapiens; identical to SEQ ID NO: 417240

SEQ ID NO: 747420 - RNA, 64 nt, Homo Sapiens; identical to SEQ ID NO: 417241

SEQ ID NO: 747421 - RNA, 64 nt, Homo Sapiens; identical to SEQ ID NO: 417242

SEQ ID NO: 747422 - RNA, 64 nt, Homo Sapiens; identical to SEQ ID NO: 417243

SEQ ID NO: 747423 - RNA, 64 nt, Homo Sapiens; identical to SEQ ID NO: 417244

SEQ ID NO: 747424 - RNA, 64 nt, Homo Sapiens; identical to SEQ ID NO: 417245

SEQ ID NO: 747425 - RNA, 64 nt, Homo Sapiens; identical to SEQ ID NO: 417246

SEQ ID NO: 747426 - RNA, 64 nt, Homo Sapiens; identical to SEQ ID NO: 417247

SEQ ID NO: 747427 - RNA, 64 nt, Homo Sapiens; identical to SEQ ID NO: 417248

SEQ ID NO: 747428 - RNA, 64 nt, Homo Sapiens; identical to SEQ ID NO: 417249

SEQ ID NO: 747429 - RNA, 64 nt, Homo Sapiens; identical to SEQ ID NO: 417250

SEQ ID NO: 747430 - RNA, 64 nt, Homo Sapiens; identical to SEQ ID NO: 417251

SEQ ID NO: 747431 - RNA, 64 nt, Homo Sapiens; identical to SEQ ID NO: 417252

SEQ ID NO: 747432 - RNA, 64 nt, Homo Sapiens; identical to SEQ ID NO: 417253

SEQ ID NO: 747433 - RNA, 64 nt, Homo Sapiens; identical to SEQ ID NO: 417254

SEQ ID NO: 747434 - RNA, 64 nt, Homo Sapiens; identical to SEQ ID NO: 417255

SEQ ID NO: 747435 - RNA, 64 nt, Homo Sapiens; identical to SEQ ID NO: 411256

SEQ ID NO: 747436 - RNA, 64 nt, Homo Sapiens; identical to SEQ ID NO: 411257

SEQ ID NO: 747437 - RNA, 64 nt, Homo Sapiens; identical to SEQ ID NO: 411258

SEQ ID NO: 747438 - RNA, 64 nt, Homo Sapiens; identical to SEQ ID NO: 411259

SEQ ID NO: 747439 - RNA, 64 nt, Homo Sapiens; identical to SEQ ID NO: 411260

SEQ ID NO: 747440 - RNA, 64 nt, Homo Sapiens; identical to SEQ ID NO: 411261

SEQ ID NO: 747441 - RNA, 64 nt, Homo Sapiens; identical to SEQ ID NO: 411262

SEQ ID NO: 747442 - RNA, 64 nt, Homo Sapiens; identical to SEQ ID NO: 411263

SEQ ID NO: 747443 - RNA, 64 nt, Homo Sapiens; identical to SEQ ID NO: 411264

SEQ ID NO: 747444 - RNA, 64 nt, Homo Sapiens; identical to SEQ ID NO: 411265

SEQ ID NO: 747445 - RNA, 64 nt, Homo Sapiens; identical to SEQ ID NO: 411266

SEQ ID NO: 747446 - RNA, 64 nt, Homo Sapiens; identical to SEQ ID NO: 411267

SEQ ID NO: 747447 - RNA, 64 nt, Homo Sapiens; identical to SEQ ID NO: 411268

SEQ ID NO: 747448 - RNA, 64 nt, Homo Sapiens
aaacuaagugcagaguuuacagagugguaaauaucuauguuacauguagauuauacauauauau

SEQ ID NO: 747449 - RNA, 64 nt, Homo Sapiens
acuauauucccagcagacacauuuagaaacuaagcuauguuaaccucagugcucaacuauuuga

SEQ ID NO: 747450 - RNA, 64 nt, Homo Sapiens
uuuaaaggcagagaaguucucaaaguuaauucaccuauguuauuuuguguacaaguuguuauug

SEQ ID NO: 747451 - RNA, 64 nt, Homo Sapiens
ugaauaaacugaauauuuuggaaacugcuaaauucuauguuaaauacugugcagaauaauggaa

SEQ ID NO: 747452 - RNA, 64 nt, Homo Sapiens
aucucagggagggucucucuccauguuguugccucuauguuaguaguagacaacuguuauuacu

SEQ ID NO: 747453 - RNA, 64 nt, Homo Sapiens
gggaguaggguuucauuggagcuuugugccauuucuauguuaacagcagcccccuugcaggccu

SEQ ID NO: 747454 - RNA, 64 nt, Homo Sapiens; identical to SEQ ID NO: 59958

SEQ ID NO: 747455 - RNA, 64 nt, Homo Sapiens; identical to SEQ ID NO: 59959

SEQ ID NO: 747456 - RNA, 64 nt, Homo Sapiens; identical to SEQ ID NO: 59960

SEQ ID NO: 747457 - RNA, 64 nt, Homo Sapiens; identical to SEQ ID NO: 59961

SEQ ID NO: 747458 - RNA, 64 nt, Homo Sapiens; identical to SEQ ID NO: 59962

SEQ ID NO: 747459 - RNA, 64 nt, Homo Sapiens; identical to SEQ ID NO: 59963

SEQ ID NO: 747460 - RNA, 64 nt, Homo Sapiens; identical to SEQ ID NO: 59964

SEQ ID NO: 747461 - RNA, 64 nt, Homo Sapiens; identical to SEQ ID NO: 59965

SEQ ID NO: 747462 - RNA, 64 nt, Homo Sapiens; identical to SEQ ID NO: 59966

SEQ ID NO: 747463 - RNA, 64 nt, Homo Sapiens; identical to SEQ ID NO: 59967

SEQ ID NO: 747464 - RNA, 64 nt, Homo Sapiens; identical to SEQ ID NO: 59968

SEQ ID NO: 747465 - RNA, 64 nt, Homo Sapiens; identical to SEQ ID NO: 59969

SEQ ID NO: 747466 - RNA, 64 nt, Homo Sapiens; identical to SEQ ID NO: 59970

SEQ ID NO: 747467 - RNA, 64 nt, Homo Sapiens; identical to SEQ ID NO: 59971

SEQ ID NO: 747468 - RNA, 64 nt, Homo Sapiens; identical to SEQ ID NO: 59972

SEQ ID NO: 747469 - RNA, 64 nt, Homo Sapiens; identical to SEQ ID NO: 59973

SEQ ID NO: 747470 - RNA, 64 nt, Homo Sapiens; identical to SEQ ID NO: 59974

SEQ ID NO: 747471 - RNA, 64 nt, Homo Sapiens; identical to SEQ ID NO: 59975

SEQ ID NO: 747472 - RNA, 64 nt, Homo Sapiens; identical to SEQ ID NO: 59976

SEQ ID NO: 747473 - RNA, 64 nt, Homo Sapiens; identical to SEQ ID NO: 59977

SEQ ID NO: 747474 - RNA, 64 nt, Homo Sapiens; identical to SEQ ID NO: 59978

SEQ ID NO: 747475 - RNA, 64 nt, Homo Sapiens; identical to SEQ ID NO: 59979

SEQ ID NO: 747476 - RNA, 64 nt, Homo Sapiens; identical to SEQ ID NO: 59980

SEQ ID NO: 747477 - RNA, 64 nt, Homo Sapiens; identical to SEQ ID NO: 59981

SEQ ID NO: 747478 - RNA, 64 nt, Homo Sapiens; identical to SEQ ID NO: 59982

SEQ ID NO: 747479 - RNA, 64 nt, Homo Sapiens; identical to SEQ ID NO: 59983

SEQ ID NO: 747480 - RNA, 64 nt, Homo Sapiens; identical to SEQ ID NO: 59984

SEQ ID NO: 747481 - RNA, 64 nt, Homo Sapiens; identical to SEQ ID NO: 59985

SEQ ID NO: 747482 - RNA, 64 nt, Homo Sapiens; identical to SEQ ID NO: 59986

SEQ ID NO: 747483 - RNA, 64 nt, Homo Sapiens; identical to SEQ ID NO: 59987

SEQ ID NO: 747484 - RNA, 64 nt, Homo Sapiens; identical to SEQ ID NO: 59988

SEQ ID NO: 747485 - RNA, 64 nt, Homo Sapiens; identical to SEQ ID NO: 59989

SEQ ID NO: 747486 - RNA, 64 nt, Homo Sapiens; identical to SEQ ID NO: 59990

SEQ ID NO: 747487 - RNA, 64 nt, Homo Sapiens; identical to SEQ ID NO: 59991

SEQ ID NO: 747488 - RNA, 64 nt, Homo Sapiens; identical to SEQ ID NO: 59992

SEQ ID NO: 747489 - RNA, 64 nt, Homo Sapiens; identical to SEQ ID NO: 59993

SEQ ID NO: 747490 - RNA, 64 nt, Homo Sapiens; identical to SEQ ID NO: 59994

SEQ ID NO: 747491 - RNA, 64 nt, Homo Sapiens; identical to SEQ ID NO: 59995

SEQ ID NO: 747492 - RNA, 64 nt, Homo Sapiens; identical to SEQ ID NO: 59996

SEQ ID NO: 747493 - RNA, 64 nt, Homo Sapiens; identical to SEQ ID NO: 59997

SEQ ID NO: 747494 - RNA, 64 nt, Homo Sapiens; identical to SEQ ID NO: 59998

SEQ ID NO: 747495 - RNA, 64 nt, Homo Sapiens; identical to SEQ ID NO: 59999

SEQ ID NO: 747496 - RNA, 64 nt, Homo Sapiens; identical to SEQ ID NO: 60000

SEQ ID NO: 747497 - RNA, 64 nt, Homo Sapiens; identical to SEQ ID NO: 60001

SEQ ID NO: 747498 - RNA, 64 nt, Homo Sapiens; identical to SEQ ID NO: 60002

SEQ ID NO: 747499 - RNA, 64 nt, Homo Sapiens; identical to SEQ ID NO: 60003

SEQ ID NO: 747500 - RNA, 64 nt, Homo Sapiens; identical to SEQ ID NO: 60004

SEQ ID NO: 747501 - RNA, 64 nt, Homo Sapiens; identical to SEQ ID NO: 60005

SEQ ID NO: 747502 - RNA, 64 nt, Homo Sapiens; identical to SEQ ID NO: 60006

SEQ ID NO: 747503 - RNA, 64 nt, Homo Sapiens; identical to SEQ ID NO: 60007

SEQ ID NO: 747504 - RNA, 64 nt, Homo Sapiens; identical to SEQ ID NO: 60008

SEQ ID NO: 747505 - RNA, 64 nt, Homo Sapiens; identical to SEQ ID NO: 60009

SEQ ID NO: 747506 - RNA, 64 nt, Homo Sapiens; identical to SEQ ID NO: 60010

SEQ ID NO: 747507 - RNA, 64 nt, Homo Sapiens; identical to SEQ ID NO: 60011

SEQ ID NO: 747508 - RNA, 64 nt, Homo Sapiens
guuuuauauuguuugauacuggaagagagagaccuucuuauauuaacuugcagcuagaauugag

SEQ ID NO: 747509 - RNA, 64 nt, Homo Sapiens
uucuggauauuagaucuuugaaauuuuuugaagcuucuuauagaguugcuuguuuuucgcuugu

SEQ ID NO: 747510 - RNA, 64 nt, Homo Sapiens
augcuaguauauucucaaaaccuucuccucuuccuucuuauauacuccuuucccucuuauuccu

SEQ ID NO: 747511 - RNA, 64 nt, Homo Sapiens
uuacauaauguauguguuguagaauguacauuaauucuuauauuugucacugaaucugaccuug

SEQ ID NO: 747512 - RNA, 64 nt, Homo Sapiens
agacaagaauauguucacauacaaccugagccuuuucuuauauauaauucaaaguuuguggcau

SEQ ID NO: 747513 - RNA, 64 nt, Homo Sapiens
aagaacucugcacagcaacuugcugaagggcuucuucuuauagcguaaccacuucauaauauac

SEQ ID NO: 747514 - RNA, 64 nt, Homo Sapiens
ugcugacauuaauugcaagaugacuuaggaaagcuucuuauagugcaaccacauugaauucuug

SEQ ID NO: 747515 - RNA, 64 nt, Homo Sapiens
gaaggagugguuaguaaacuuacagcuacugaauuucuuauaaguugaaacugaaaaaaaauuu

SEQ ID NO: 747516 - RNA, 64 nt, Homo Sapiens
ugagugaagcggugauaaaaggaaauaauugguuuucuuauaaagguuugguuugauuuugcuu

SEQ ID NO: 747517 - RNA, 64 nt, Homo Sapiens
cuuuguuuucucuaaggagacccacauuugauauuucuuauauagcuuuggaauauguuacagu

SEQ ID NO: 747518 - RNA, 64 nt, Homo Sapiens
auccugugaaaguuuguuauuuucugaguagacauucuuauagaguauugucuuuaaaaucaga

SEQ ID NO: 747519 - RNA, 64 nt, Homo Sapiens
cauuuuuauguuuucuaauuuaaaaauuaauauuuucuuauagauauugugcaauaaagcugaa

SEQ ID NO: 747520 - RNA, 64 nt, Homo Sapiens
guaauuauaacagggauuuaaccaaagaaaguuguucuuauaauacauuaaauauaaauguuua

SEQ ID NO: 747521 - RNA, 64 nt, Homo Sapiens
guguucccaugaucauucucuucugucugggaucuucuuauaaacaccacaaggggcucugcuc

SEQ ID NO: 747522 - RNA, 64 nt, Homo Sapiens
aaaugaugcaguacccauuuuucguauccugcuuuucuuauauuggaguaaaaaggacagggua

SEQ ID NO: 747523 - RNA, 64 nt, Homo Sapiens
aguggaagauccugugcucuugaacuuauuuuaauucuuauaauuugcaccuauauaaacaaag

SEQ ID NO: 747524 - RNA, 64 nt, Homo Sapiens
uaaggaguuauaaggguuauauguauuucugucuuucuuauauguuuaaaauguuuuuucuuug

SEQ ID NO: 747525 - RNA, 64 nt, Homo Sapiens
acaguguuuguuuagcuauguaugucuaauggaguucuuauauuuggcuucaaugucuauuucu

SEQ ID NO: 747526 - RNA, 64 nt, Homo Sapiens
ugauaacaaucucuaauuugcaugggcaccacauuucuuauauuaaaagaauuaguguuuuggc

SEQ ID NO: 747527 - RNA, 64 nt, Homo Sapiens
cguuaaaauuguuacuaugcagcacagaacuucauucuuauaguauucuuggguucaaccuuug

SEQ ID NO: 747528 - RNA, 64 nt, Homo Sapiens
uuauaguaugaucaaguaugaaaggaacuuuaaauucuuauauuuacuuuucucucaguaaauu

SEQ ID NO: 747529 - RNA, 64 nt, Homo Sapiens
aauaccauagagaaaauauuuuagaauuuaauguuucuuauauuuauguaaacuuaugacucuu

SEQ ID NO: 747530 - RNA, 64 nt, Homo Sapiens
uauauccaggcuauaaauauccuuucaaaucauguucuuauaccuaauuuuagucuuucaaaug

SEQ ID NO: 747531 - RNA, 64 nt, Homo Sapiens
aaguugugugccccuauagaaaauauuugagaauuucuuauacuaucaagaaaaaauucuguga

SEQ ID NO: 747532 - RNA, 64 nt, Homo Sapiens
gcaucacuuuccucaguggaaaaacuuaugaaacuucuuauaagagagaguaaucucaggccgg

SEQ ID NO: 747533 - RNA, 64 nt, Homo Sapiens
gcuuuuguuuugagguuauucucaaaaccuuaauuucuuauauuuucuguugacuaaggcacca

SEQ ID NO: 747534 - RNA, 64 nt, Homo Sapiens
cugcauaaucuaccauucuucuccucucuuucucuucuuauacagacccucauuacuggggccc

SEQ ID NO: 747535 - RNA, 64 nt, Homo Sapiens
ugcuguaaguauuauauuucugaauacuaccccuuucuuauaaugaugaguuuuuuuccuagag

SEQ ID NO: 747536 - RNA, 64 nt, Homo Sapiens
uuaccuucaguaacuauucagaaaaugaugcuuauucuuauaaaguuucucacuuguuuuggag

SEQ ID NO: 747537 - RNA, 64 nt, Homo Sapiens
uucuaaauuuuauguuuauuuauaguccacugcauucuuauaaguuguagcuguuguuuuuaga

SEQ ID NO: 747538 - RNA, 64 nt, Homo Sapiens
auaaaaaggacacauuugugagaaaacaauuacauucuuauacaccauagcuuauuaacacuaa

SEQ ID NO: 747539 - RNA, 64 nt, Homo Sapiens
gagguuuacauuaugugaauacaugcacauuuguuucuuauacagguggugugaacucuagggc

SEQ ID NO: 747540 - RNA, 64 nt, Homo Sapiens
gagaacuuuucuagcuauuccaauacagaguucuuucuuauagggcuauugauauugacaccaa

SEQ ID NO: 747541 - RNA, 64 nt, Homo Sapiens
aucucagcccaccaaugccaagacaaaauuauuuuucuuauacuuauuuuuuauuaaacaaaau

SEQ ID NO: 747542 - RNA, 64 nt, Homo Sapiens
auguucaaaaaugauaaguaaucuggauaccuuuuucuuauacuuucuccuaggaaaacuuuaa

SEQ ID NO: 747543 - RNA, 64 nt, Homo Sapiens
aacacuaaaacuuucuuccuuucagagauacagcuucuuauaguacacuuauggagcuaacauu

SEQ ID NO: 747544 - RNA, 64 nt, Homo Sapiens
uggacccuuguguuuugaagauaaugugauauuuuucuuauaaucuaauucuguaggacuuuga

SEQ ID NO: 747545 - RNA, 64 nt, Homo Sapiens
aggaaucucauuugcauuugauguuagaauauauuucuuauacuaaacagaauauuuauuacaa

SEQ ID NO: 747546 - RNA, 64 nt, Homo Sapiens
acccugaucccagacuccaaccaucagcccucauuucuuauaauggccccuuucuggggguucc

SEQ ID NO: 747547 - RNA, 64 nt, Homo Sapiens
gugaucucaucaucauggauacucaauuuguuuuuucuuauagagaaaaugaguauauaagaca

SEQ ID NO: 747548 - RNA, 64 nt, Homo Sapiens
acagaaagaagaauuucuaaaauauuggauuuacuucuuauauugagucagaugcauacuuuua

SEQ ID NO: 747549 - RNA, 64 nt, Homo Sapiens; identical to SEQ ID NO: 116418

SEQ ID NO: 747550 - RNA, 64 nt, Homo Sapiens; identical to SEQ ID NO: 116419

SEQ ID NO: 747551 - RNA, 64 nt, Homo Sapiens; identical to SEQ ID NO: 116420

SEQ ID NO: 747552 - RNA, 64 nt, Homo Sapiens; identical to SEQ ID NO: 116421

SEQ ID NO: 747553 - RNA, 64 nt, Homo Sapiens; identical to SEQ ID NO: 116422

SEQ ID NO: 747554 - RNA, 64 nt, Homo Sapiens; identical to SEQ ID NO: 116423

SEQ ID NO: 747555 - RNA, 64 nt, Homo Sapiens; identical to SEQ ID NO: 116424

SEQ ID NO: 747556 - RNA, 64 nt, Homo Sapiens; identical to SEQ ID NO: 116425

SEQ ID NO: 747557 - RNA, 64 nt, Homo Sapiens; identical to SEQ ID NO: 116426

SEQ ID NO: 747558 - RNA, 64 nt, Homo Sapiens; identical to SEQ ID NO: 116427

SEQ ID NO: 747559 - RNA, 64 nt, Homo Sapiens; identical to SEQ ID NO: 116428

SEQ ID NO: 747560 - RNA, 64 nt, Homo Sapiens; identical to SEQ ID NO: 116429

SEQ ID NO: 747561 - RNA, 64 nt, Homo Sapiens; identical to SEQ ID NO: 116430

SEQ ID NO: 747562 - RNA, 64 nt, Homo Sapiens; identical to SEQ ID NO: 116431

SEQ ID NO: 747563 - RNA, 64 nt, Homo Sapiens; identical to SEQ ID NO: 116432

SEQ ID NO: 747564 - RNA, 64 nt, Homo Sapiens; identical to SEQ ID NO: 116433

SEQ ID NO: 747565 - RNA, 64 nt, Homo Sapiens; identical to SEQ ID NO: 116434

SEQ ID NO: 747566 - RNA, 64 nt, Homo Sapiens; identical to SEQ ID NO: 116435

SEQ ID NO: 747567 - RNA, 64 nt, Homo Sapiens; identical to SEQ ID NO: 116436

SEQ ID NO: 747568 - RNA, 64 nt, Homo Sapiens; identical to SEQ ID NO: 116437

SEQ ID NO: 747569 - RNA, 64 nt, Homo Sapiens; identical to SEQ ID NO: 116438

SEQ ID NO: 747570 - RNA, 64 nt, Homo Sapiens; identical to SEQ ID NO: 116439

SEQ ID NO: 747571 - RNA, 64 nt, Homo Sapiens; identical to SEQ ID NO: 116440

SEQ ID NO: 747572 - RNA, 64 nt, Homo Sapiens; identical to SEQ ID NO: 116441

SEQ ID NO: 747573 - RNA, 64 nt, Homo Sapiens; identical to SEQ ID NO: 116442

SEQ ID NO: 747574 - RNA, 64 nt, Homo Sapiens; identical to SEQ ID NO: 116443

SEQ ID NO: 747575 - RNA, 64 nt, Homo Sapiens; identical to SEQ ID NO: 116444

SEQ ID NO: 747576 - RNA, 64 nt, Homo Sapiens; identical to SEQ ID NO: 116445

SEQ ID NO: 747577 - RNA, 64 nt, Homo Sapiens; identical to SEQ ID NO: 116446

SEQ ID NO: 747578 - RNA, 64 nt, Homo Sapiens; identical to SEQ ID NO: 116447

SEQ ID NO: 747579 - RNA, 64 nt, Homo Sapiens; identical to SEQ ID NO: 116448

SEQ ID NO: 747580 - RNA, 64 nt, Homo Sapiens; identical to SEQ ID NO: 116449

SEQ ID NO: 747581 - RNA, 64 nt, Homo Sapiens; identical to SEQ ID NO: 116450

SEQ ID NO: 747582 - RNA, 64 nt, Homo Sapiens; identical to SEQ ID NO: 116451

SEQ ID NO: 747583 - RNA, 64 nt, Homo Sapiens; identical to SEQ ID NO: 116452

SEQ ID NO: 747584 - RNA, 64 nt, Homo Sapiens; identical to SEQ ID NO: 116453

SEQ ID NO: 747585 - RNA, 64 nt, Homo Sapiens; identical to SEQ ID NO: 116454

SEQ ID NO: 747586 - RNA, 64 nt, Homo Sapiens; identical to SEQ ID NO: 116455

SEQ ID NO: 747587 - RNA, 64 nt, Homo Sapiens; identical to SEQ ID NO: 116456

SEQ ID NO: 747588 - RNA, 64 nt, Homo Sapiens; identical to SEQ ID NO: 116457

SEQ ID NO: 747589 - RNA, 64 nt, Homo Sapiens; identical to SEQ ID NO: 116458

SEQ ID NO: 747590 - RNA, 64 nt, Homo Sapiens; identical to SEQ ID NO: 116459

SEQ ID NO: 747591 - RNA, 64 nt, Homo Sapiens; identical to SEQ ID NO: 116460

SEQ ID NO: 747592 - RNA, 64 nt, Homo Sapiens; identical to SEQ ID NO: 116461

SEQ ID NO: 747593 - RNA, 64 nt, Homo Sapiens; identical to SEQ ID NO: 116462

SEQ ID NO: 747594 - RNA, 64 nt, Homo Sapiens; identical to SEQ ID NO: 116463

SEQ ID NO: 747595 - RNA, 64 nt, Homo Sapiens; identical to SEQ ID NO: 116464

SEQ ID NO: 747596 - RNA, 64 nt, Homo Sapiens; identical to SEQ ID NO: 116465

SEQ ID NO: 747597 - RNA, 64 nt, Homo Sapiens; identical to SEQ ID NO: 116466

SEQ ID NO: 747598 - RNA, 64 nt, Homo Sapiens; identical to SEQ ID NO: 116467

SEQ ID NO: 747599 - RNA, 64 nt, Homo Sapiens; identical to SEQ ID NO: 116468

SEQ ID NO: 747600 - RNA, 64 nt, Homo Sapiens; identical to SEQ ID NO: 116469

SEQ ID NO: 747601 - RNA, 64 nt, Homo Sapiens; identical to SEQ ID NO: 116470

SEQ ID NO: 747602 - RNA, 64 nt, Homo Sapiens; identical to SEQ ID NO: 116471

SEQ ID NO: 747603 - RNA, 64 nt, Homo Sapiens; identical to SEQ ID NO: 116472

SEQ ID NO: 747604 - RNA, 64 nt, Homo Sapiens; identical to SEQ ID NO: 116473

SEQ ID NO: 747605 - RNA, 64 nt, Homo Sapiens; identical to SEQ ID NO: 116474

SEQ ID NO: 747606 - RNA, 64 nt, Homo Sapiens; identical to SEQ ID NO: 116475

SEQ ID NO: 747607 - RNA, 64 nt, Homo Sapiens; identical to SEQ ID NO: 116476

SEQ ID NO: 747608 - RNA, 64 nt, Homo Sapiens; identical to SEQ ID NO: 116477

SEQ ID NO: 747609 - RNA, 64 nt, Homo Sapiens; identical to SEQ ID NO: 116478

SEQ ID NO: 747610 - RNA, 64 nt, Homo Sapiens; identical to SEQ ID NO: 116479

SEQ ID NO: 747611 - RNA, 64 nt, Homo Sapiens; identical to SEQ ID NO: 116480

SEQ ID NO: 747612 - RNA, 64 nt, Homo Sapiens; identical to SEQ ID NO: 116481

SEQ ID NO: 747613 - RNA, 64 nt, Homo Sapiens; identical to SEQ ID NO: 116482

SEQ ID NO: 747614 - RNA, 64 nt, Homo Sapiens; identical to SEQ ID NO: 116483

SEQ ID NO: 747615 - RNA, 64 nt, Homo Sapiens; identical to SEQ ID NO: 116484

SEQ ID NO: 747616 - RNA, 64 nt, Homo Sapiens; identical to SEQ ID NO: 116485

SEQ ID NO: 747617 - RNA, 64 nt, Homo Sapiens; identical to SEQ ID NO: 116486

SEQ ID NO: 747618 - RNA, 64 nt, Homo Sapiens; identical to SEQ ID NO: 116487

SEQ ID NO: 747619 - RNA, 64 nt, Homo Sapiens; identical to SEQ ID NO: 116488

SEQ ID NO: 747620 - RNA, 64 nt, Homo Sapiens; identical to SEQ ID NO: 116489

SEQ ID NO: 747621 - RNA, 64 nt, Homo Sapiens; identical to SEQ ID NO: 116490

SEQ ID NO: 747622 - RNA, 64 nt, Homo Sapiens; identical to SEQ ID NO: 116491

SEQ ID NO: 747623 - RNA, 64 nt, Homo Sapiens; identical to SEQ ID NO: 116492

SEQ ID NO: 747624 - RNA, 64 nt, Homo Sapiens; identical to SEQ ID NO: 116493

SEQ ID NO: 747625 - RNA, 64 nt, Homo Sapiens; identical to SEQ ID NO: 116494

SEQ ID NO: 747626 - RNA, 64 nt, Homo Sapiens; identical to SEQ ID NO: 116495

SEQ ID NO: 747627 - RNA, 64 nt, Homo Sapiens; identical to SEQ ID NO: 116496

SEQ ID NO: 747628 - RNA, 64 nt, Homo Sapiens; identical to SEQ ID NO: 116497

SEQ ID NO: 747629 - RNA, 64 nt, Homo Sapiens; identical to SEQ ID NO: 116498

SEQ ID NO: 747630 - RNA, 64 nt, Homo Sapiens; identical to SEQ ID NO: 116499

SEQ ID NO: 747631 - RNA, 64 nt, Homo Sapiens; identical to SEQ ID NO: 116500

SEQ ID NO: 747632 - RNA, 64 nt, Homo Sapiens; identical to SEQ ID NO: 116501

SEQ ID NO: 747633 - RNA, 64 nt, Homo Sapiens; identical to SEQ ID NO: 116502

SEQ ID NO: 747634 - RNA, 64 nt, Homo Sapiens; identical to SEQ ID NO: 116503

SEQ ID NO: 747635 - RNA, 64 nt, Homo Sapiens; identical to SEQ ID NO: 116504

SEQ ID NO: 747636 - RNA, 64 nt, Homo Sapiens; identical to SEQ ID NO: 116505

SEQ ID NO: 747637 - RNA, 64 nt, Homo Sapiens; identical to SEQ ID NO: 116506

SEQ ID NO: 747638 - RNA, 64 nt, Homo Sapiens; identical to SEQ ID NO: 116507

SEQ ID NO: 747639 - RNA, 64 nt, Homo Sapiens; identical to SEQ ID NO: 116508

SEQ ID NO: 747640 - RNA, 64 nt, Homo Sapiens; identical to SEQ ID NO: 116509

SEQ ID NO: 747641 - RNA, 64 nt, Homo Sapiens; identical to SEQ ID NO: 116510

SEQ ID NO: 747642 - RNA, 64 nt, Homo Sapiens; identical to SEQ ID NO: 214864

SEQ ID NO: 747643 - RNA, 64 nt, Homo Sapiens; identical to SEQ ID NO: 214865

SEQ ID NO: 747644 - RNA, 64 nt, Homo Sapiens; identical to SEQ ID NO: 214866

SEQ ID NO: 747645 - RNA, 64 nt, Homo Sapiens; identical to SEQ ID NO: 214867

SEQ ID NO: 747646 - RNA, 64 nt, Homo Sapiens; identical to SEQ ID NO: 214868

SEQ ID NO: 747647 - RNA, 64 nt, Homo Sapiens; identical to SEQ ID NO: 214869

SEQ ID NO: 747648 - RNA, 64 nt, Homo Sapiens; identical to SEQ ID NO: 214870

SEQ ID NO: 747649 - RNA, 64 nt, Homo Sapiens; identical to SEQ ID NO: 214871

SEQ ID NO: 747650 - RNA, 64 nt, Homo Sapiens; identical to SEQ ID NO: 214872

SEQ ID NO: 747651 - RNA, 64 nt, Homo Sapiens; identical to SEQ ID NO: 214873

SEQ ID NO: 747652 - RNA, 64 nt, Homo Sapiens; identical to SEQ ID NO: 214874

SEQ ID NO: 747653 - RNA, 64 nt, Homo Sapiens; identical to SEQ ID NO: 214875

SEQ ID NO: 747654 - RNA, 64 nt, Homo Sapiens; identical to SEQ ID NO: 214876

SEQ ID NO: 747655 - RNA, 64 nt, Homo Sapiens; identical to SEQ ID NO: 214877

SEQ ID NO: 747656 - RNA, 64 nt, Homo Sapiens; identical to SEQ ID NO: 214878

SEQ ID NO: 747657 - RNA, 64 nt, Homo Sapiens; identical to SEQ ID NO: 214879

SEQ ID NO: 747658 - RNA, 64 nt, Homo Sapiens; identical to SEQ ID NO: 214880

SEQ ID NO: 747659 - RNA, 64 nt, Homo Sapiens; identical to SEQ ID NO: 214881

SEQ ID NO: 747660 - RNA, 64 nt, Homo Sapiens; identical to SEQ ID NO: 214882

SEQ ID NO: 747661 - RNA, 64 nt, Homo Sapiens; identical to SEQ ID NO: 214883

SEQ ID NO: 747662 - RNA, 64 nt, Homo Sapiens; identical to SEQ ID NO: 214884

SEQ ID NO: 747663 - RNA, 64 nt, Homo Sapiens; identical to SEQ ID NO: 214885

SEQ ID NO: 747664 - RNA, 64 nt, Homo Sapiens; identical to SEQ ID NO: 214886

SEQ ID NO: 747665 - RNA, 64 nt, Homo Sapiens; identical to SEQ ID NO: 214887

SEQ ID NO: 747666 - RNA, 64 nt, Homo Sapiens; identical to SEQ ID NO: 214888

SEQ ID NO: 747667 - RNA, 64 nt, Homo Sapiens; identical to SEQ ID NO: 214889

SEQ ID NO: 747668 - RNA, 64 nt, Homo Sapiens; identical to SEQ ID NO: 214890

SEQ ID NO: 747669 - RNA, 64 nt, Homo Sapiens; identical to SEQ ID NO: 214891

SEQ ID NO: 747670 - RNA, 64 nt, Homo Sapiens; identical to SEQ ID NO: 214892

SEQ ID NO: 747671 - RNA, 64 nt, Homo Sapiens; identical to SEQ ID NO: 214893

SEQ ID NO: 747672 - RNA, 64 nt, Homo Sapiens; identical to SEQ ID NO: 214894

SEQ ID NO: 747673 - RNA, 64 nt, Homo Sapiens; identical to SEQ ID NO: 214895

SEQ ID NO: 747674 - RNA, 64 nt, Homo Sapiens; identical to SEQ ID NO: 214896

SEQ ID NO: 747675 - RNA, 64 nt, Homo Sapiens; identical to SEQ ID NO: 214897

SEQ ID NO: 747676 - RNA, 62 nt, Homo Sapiens
ggaaagguuuugaaaaaggaugggucccacccucccuccagagccaccaguguuagagcgga

SEQ ID NO: 747677 - RNA, 62 nt, Homo Sapiens
gccccuggggaaaagcagccucccuucuccucucccuccacucccucgcucccucccucagc

SEQ ID NO: 747678 - RNA, 62 nt, Homo Sapiens
gugccagcuggcaaaugagggcuggacucucuucccuccagagaccaccccgcuccuugcug

SEQ ID NO: 747679 - RNA, 62 nt, Homo Sapiens
ggagggacuucccucccccucuuuuccauuucucccuccaucaccaccugcccucacauccu

SEQ ID NO: 747680 - RNA, 62 nt, Homo Sapiens
ugccucuucaucugggaaugcuuucagggacuucccuccagccucugcuggguagagaggca

SEQ ID NO: 747681 - RNA, 62 nt, Homo Sapiens
ccuuccucugacccuugcuguuuacucucuucucccuccagacuccugcccacccagggccc

SEQ ID NO: 747682 - RNA, 62 nt, Homo Sapiens
cccaucucaaaucacaaggaauaucguaccugucccuccaggcuuuccaucucugccuguca

SEQ ID NO: 747683 - RNA, 62 nt, Homo Sapiens
ccagacauugauggggacauccuguucuccugucccuccauccucccuucuccuuucuaagc

SEQ ID NO: 747684 - RNA, 62 nt, Homo Sapiens
ucuacccagaccuccaggccccauauuuucucucccuccauucugcccuagaccuccagaga

SEQ ID NO: 747685 - RNA, 62 nt, Homo Sapiens
ucuccuuaccaagcacccaacucacauucccuucccuccaccauuucccuaaacgacccuuc

SEQ ID NO: 747686 - RNA, 62 nt, Homo Sapiens
ccugaguggugaggggccacugggccccauucucccuccauggcaggaaggcgggggauuuc

SEQ ID NO: 747687 - RNA, 62 nt, Homo Sapiens
uggggcuguacacacccuccagcacagacuguucccuccaagguccucuuaggucccgggag

SEQ ID NO: 747688 - RNA, 62 nt, Homo Sapiens
cuggggcuugggacugcuuaccaauguguaggucccuccagguuucgagcucuugaccaccu

SEQ ID NO: 747689 - RNA, 62 nt, Homo Sapiens
cccuggaggggcuucuaguaauccccuucauuucccuccagucuucccacagccaaagcccc

SEQ ID NO: 747690 - RNA, 62 nt, Homo Sapiens
caagguaguaauaauaauuuuuccuccacaggucccuccacucauauggccucucccucccc

SEQ ID NO: 747691 - RNA, 62 nt, Homo Sapiens
cugccucugugccuucucucauucuccuucucucccuccauaccccacuuuugagguucugu

SEQ ID NO: 747692 - RNA, 62 nt, Homo Sapiens
ccagaguagaguguagagugugccccgugacaucccuccaucuucuccuccauuaucaucua

SEQ ID NO: 747693 - RNA, 62 nt, Homo Sapiens
auguuacagcaaaucuggagccacagacagguucccuccauuggcagcccauuguguuugaa

SEQ ID NO: 747694 - RNA, 62 nt, Homo Sapiens
uccagguggugcugggcucaagcgacccagcuucccuccacucagccucccucccuuccagc

SEQ ID NO: 747695 - RNA, 62 nt, Homo Sapiens
agcccugaucacaccaugaggccccuccacccucccuccagcccuugguuccuggagagugu

SEQ ID NO: 747696 - RNA, 62 nt, Homo Sapiens
ggcuauuccugucuuaggcgcuugcauuucccucccuccaggcaaccccgaggcagccccaa

SEQ ID NO: 747697 - RNA, 62 nt, Homo Sapiens
aagauucaguagaagaaauaucugguuuggagucccuccacccaaguuaucuuuuaguuuau

SEQ ID NO: 747698 - RNA, 62 nt, Homo Sapiens
cccuccccgcacccaccuccugucucccucccucccuccauaggaguggggggccccuagaa

SEQ ID NO: 747699 - RNA, 62 nt, Homo Sapiens
caccguaguggcuaccaccucagggcagccccucccuccagcuggcggggccucagcuuccc

SEQ ID NO: 747700 - RNA, 58 nt, Homo Sapiens; identical to SEQ ID NO: 111435

SEQ ID NO: 747701 - RNA, 62 nt, Homo Sapiens
ggagaucaucuuguuccccuggccccccacucucccuccauguccauccaaaaaccauaaaa

SEQ ID NO: 747702 - RNA, 62 nt, Homo Sapiens
gcacccaaccuguguuguugccgcccggcccuucccuccacagcucuccuuccucccgcccg

SEQ ID NO: 747703 - RNA, 62 nt, Homo Sapiens
cugcucaucucugcccugaggucaccccguggucccuccacgugcccaucucucugcagugc

SEQ ID NO: 747704 - RNA, 62 nt, Homo Sapiens
caaguauggccaccuguuugauagcagcgguaucccuccacccaccaaaucuucaucuggga

SEQ ID NO: 747705 - RNA, 62 nt, Homo Sapiens
cucagccaagcaacauggggccaccauguuugucccuccagccagugccuuccaguauggcc

SEQ ID NO: 747706 - RNA, 62 nt, Homo Sapiens
gugaacaagcuuuugcagcuaccuggagacagucccuccacugcaaaacuucgagaaucaac

SEQ ID NO: 747707 - RNA, 62 nt, Homo Sapiens
gagaacaacugagggccacccggucggggccaucccuccacacucugcauccuaccccaccu

SEQ ID NO: 747708 - RNA, 62 nt, Homo Sapiens
aacccugccucccugcuuccugguccagagccucccuccagugacuguggagccugagaagg

SEQ ID NO: 747709 - RNA, 62 nt, Homo Sapiens
cugcucacucaagcaaaagcagccucuggccuucccuccaccgcuuugcuccaucuggcuua

SEQ ID NO: 747710 - RNA, 62 nt, Homo Sapiens
uuuaauugucucaacgccucccccucccccauucccuccauuuuucucccaagaaaccugac

SEQ ID NO: 747711 - RNA, 62 nt, Homo Sapiens
guuacagggaaguggucuccccaauucuccccucccuccaguauugcccccucucacuuuag

SEQ ID NO: 747712 - RNA, 62 nt, Homo Sapiens
acccaguagauaaugaaccaaauuaaguucccucccuccagccagaaguuaaacaucuggga

SEQ ID NO: 747713 - RNA, 62 nt, Homo Sapiens
cucaacaccaaacuggacaguagacaucaugaucccuccaguuagcucuaauuacagacccc

SEQ ID NO: 747714 - RNA, 62 nt, Homo Sapiens
ggcugaggaggacaggagaagggcccagacacucccuccagugaguguccugcagcccuuau

SEQ ID NO: 747715 - RNA, 62 nt, Homo Sapiens
acucccuccagugaguguccugcagcccuuauucccuccauagaaagcauccucagagcacc

SEQ ID NO: 747716 - RNA, 62 nt, Homo Sapiens
gggccaaggucugggggugcuggaggccaugcucccuccaggcuugcggggagaacuucccu

SEQ ID NO: 747717 - RNA, 62 nt, Homo Sapiens
acuggucccggggcuaaggaccuugcuccaagucccuccacccaugaugcugugccuuccag

SEQ ID NO: 747718 - RNA, 62 nt, Homo Sapiens
ccucugucgccucccccucuugccucccccuuucccuccauuccucuccuguuucucucucu

SEQ ID NO: 747719 - RNA, 62 nt, Homo Sapiens
aauaauguggcauacacaguguuuuaaaguggucccuccaagguaaauuauccaucacuuuu

SEQ ID NO: 747720 - RNA, 62 nt, Homo Sapiens
ugcuccagcuugcuggauguuaccuguccucuucccuccacaagucuuggcccuuaaccuuu

SEQ ID NO: 747721 - RNA, 62 nt, Homo Sapiens
ugacugacuaaagaugcuaggcgugacaccguucccuccaaaagcagaccucggaaucacug

SEQ ID NO: 747722 - RNA, 62 nt, Homo Sapiens
cuaggucagagguggggacagcagaagggcccucccuccagcuguguaccaagagcagcagg

SEQ ID NO: 747723 - RNA, 62 nt, Homo Sapiens
ccuuggcuuuuaugacccugggaagccuggggucccuccacaagccgaaccagcacucuccc

SEQ ID NO: 747724 - RNA, 62 nt, Homo Sapiens
aaaccugauucugcugcccauccuacccccaaucccuccaaucaagccccaugccgugcuca

SEQ ID NO: 747725 - RNA, 52 nt, Homo Sapiens; identical to SEQ ID NO: 111460

SEQ ID NO: 747726 - RNA, 62 nt, Homo Sapiens
gaauccgccugcagaggacaaaaucugagaucucccuccaggagauccuacucuuccuuucu

SEQ ID NO: 747727 - RNA, 62 nt, Homo Sapiens
cggcuccugucauccccuaccugccuggaggaucccuccaucuggcaugucagagccaggcu

SEQ ID NO: 747728 - RNA, 62 nt, Homo Sapiens
ccuuugucgcucucauggcugucagauccuggucccuccacacugggugcuggggagggagg

SEQ ID NO: 747729 - RNA, 62 nt, Homo Sapiens
gcuugcagacacuguuguuuuggaaaugugcuucccuccaucugaaaucucaucccuccacc

SEQ ID NO: 747730 - RNA, 62 nt, Homo Sapiens
uggaaaugugcuucccuccaucugaaaucucaucccuccacccgcccacucgggcagcugug

SEQ ID NO: 747731 - RNA, 62 nt, Homo Sapiens
ccuccacccguccuggggugcugcgcccucccucccuccacacaccccucuucccccuuccc

SEQ ID NO: 747732 - RNA, 62 nt, Homo Sapiens
ccucccaacucuggccuuggcucuccucucucucccuccacuggugggcgugacuucagacu

SEQ ID NO: 747733 - RNA, 64 nt, Homo Sapiens
guggagguugcagugagcugagaucgugccauugugauaugaauaugccuuauaugcugauaug

SEQ ID NO: 747734 - RNA, 64 nt, Homo Sapiens
ucgugccauugugauaugaauaugccuuauaugcugauaugaauaugccuuaaaauaaaguguu

SEQ ID NO: 747735 - RNA, 64 nt, Homo Sapiens
guaaaguuauuagaaugguaucuguucauuuuagugauaugaagaucacaacuaacaacugaca

SEQ ID NO: 747736 - RNA, 64 nt, Homo Sapiens
ucaaauucagcauggcugcagcugauuaagaaauugauaugauuauucuuugcuagccucucuu

SEQ ID NO: 747737 - RNA, 64 nt, Homo Sapiens
aacauuuuagcucuauugauacucuuucuaaugcugauaugaucuugaguauaagaaaugcaua

SEQ ID NO: 747738 - RNA, 64 nt, Homo Sapiens
cugugcuaaauaucaaucaagccauguauaaaugugauaugauuggcaauauguguuuacuuua

SEQ ID NO: 747739 - RNA, 64 nt, Homo Sapiens
cucuugagaaagauuuaaaaugugucuaauacacugauaugaagcaguucaacuuuuuggauga

SEQ ID NO: 747740 - RNA, 64 nt, Homo Sapiens
uuuguacuugucuaucuguuuaccucaguguagaugauaugaggaugguauaacuauguaaauu

SEQ ID NO: 747741 - RNA, 64 nt, Homo Sapiens
uccauuugaaaaaucuugguacugcuaaauuauuugauaugaacucaauccagcauuuguagca

SEQ ID NO: 747742 - RNA, 64 nt, Homo Sapiens
auuuuugucaccagcaaaacuuuucacuaauuagugauaugaaaugugauuuuuguguuguuaa

SEQ ID NO: 747743 - RNA, 64 nt, Homo Sapiens
ugaagaaacuauagguauaguggugaauacucgcugauaugaaucccagaaaaaaauuuccugu

SEQ ID NO: 747744 - RNA, 64 nt, Homo Sapiens
guguguccaaagaguuacuugcaacagucuuucaugauaugaggaugcccccguauuaccacuc

SEQ ID NO: 747745 - RNA, 64 nt, Homo Sapiens
ggggacuuaucuccugcagacaguauaacugauaugauaugaagaaaugaagugauugcaaugc

SEQ ID NO: 747746 - RNA, 64 nt, Homo Sapiens
ugaagggggacuuaucuccuaaugccaguauaacugauaugauagaaaaaaaugaagugauugc

SEQ ID NO: 747747 - RNA, 64 nt, Homo Sapiens
auccuggaaagugaacugggugaccuaggaccucugauaugaaugugaucugagacuaaaguuu

SEQ ID NO: 747748 - RNA, 64 nt, Homo Sapiens
augauucacugaagaugaaaagauaggacggaugugauaugaaaaaaacccaaacauuuuggca

SEQ ID NO: 747749 - RNA, 64 nt, Homo Sapiens
aggguccucaucuacauucucaaacaucuguggcugauaugauaugauucuuggaauuugcuuc

SEQ ID NO: 747750 - RNA, 64 nt, Homo Sapiens
ccucaucuacauucucaaacaucuguggcugauaugauaugauucuuggaauuugcuucaaaau

SEQ ID NO: 747751 - RNA, 64 nt, Homo Sapiens; identical to SEQ ID NO: 307447

SEQ ID NO: 747752 - RNA, 64 nt, Homo Sapiens; identical to SEQ ID NO: 307448

SEQ ID NO: 747753 - RNA, 64 nt, Homo Sapiens; identical to SEQ ID NO: 307449

SEQ ID NO: 747754 - RNA, 64 nt, Homo Sapiens; identical to SEQ ID NO: 307450

SEQ ID NO: 747755 - RNA, 64 nt, Homo Sapiens; identical to SEQ ID NO: 307451

SEQ ID NO: 747756 - RNA, 64 nt, Homo Sapiens; identical to SEQ ID NO: 307452

SEQ ID NO: 747757 - RNA, 64 nt, Homo Sapiens; identical to SEQ ID NO: 307453

SEQ ID NO: 747758 - RNA, 64 nt, Homo Sapiens; identical to SEQ ID NO: 307454

SEQ ID NO: 747759 - RNA, 64 nt, Homo Sapiens; identical to SEQ ID NO: 307455

SEQ ID NO: 747760 - RNA, 64 nt, Homo Sapiens; identical to SEQ ID NO: 307456

SEQ ID NO: 747761 - RNA, 64 nt, Homo Sapiens; identical to SEQ ID NO: 307457

SEQ ID NO: 747762 - RNA, 64 nt, Homo Sapiens; identical to SEQ ID NO: 307458

SEQ ID NO: 747763 - RNA, 64 nt, Homo Sapiens; identical to SEQ ID NO: 307459

SEQ ID NO: 747764 - RNA, 64 nt, Homo Sapiens; identical to SEQ ID NO: 307460

SEQ ID NO: 747765 - RNA, 64 nt, Homo Sapiens; identical to SEQ ID NO: 307461

SEQ ID NO: 747766 - RNA, 64 nt, Homo Sapiens; identical to SEQ ID NO: 307462

SEQ ID NO: 747767 - RNA, 64 nt, Homo Sapiens; identical to SEQ ID NO: 307463

SEQ ID NO: 747768 - RNA, 64 nt, Homo Sapiens; identical to SEQ ID NO: 307464

SEQ ID NO: 747769 - RNA, 64 nt, Homo Sapiens; identical to SEQ ID NO: 307465

SEQ ID NO: 747770 - RNA, 64 nt, Homo Sapiens; identical to SEQ ID NO: 307466

SEQ ID NO: 747771 - RNA, 64 nt, Homo Sapiens; identical to SEQ ID NO: 307467

SEQ ID NO: 747772 - RNA, 64 nt, Homo Sapiens; identical to SEQ ID NO: 307468

SEQ ID NO: 747773 - RNA, 64 nt, Homo Sapiens; identical to SEQ ID NO: 307469

SEQ ID NO: 747774 - RNA, 64 nt, Homo Sapiens; identical to SEQ ID NO: 307470

SEQ ID NO: 747775 - RNA, 64 nt, Homo Sapiens; identical to SEQ ID NO: 307471

SEQ ID NO: 747776 - RNA, 64 nt, Homo Sapiens; identical to SEQ ID NO: 307472

SEQ ID NO: 747777 - RNA, 64 nt, Homo Sapiens; identical to SEQ ID NO: 307473

SEQ ID NO: 747778 - RNA, 64 nt, Homo Sapiens; identical to SEQ ID NO: 307474

SEQ ID NO: 747779 - RNA, 64 nt, Homo Sapiens; identical to SEQ ID NO: 307475

SEQ ID NO: 747780 - RNA, 64 nt, Homo Sapiens; identical to SEQ ID NO: 307476

SEQ ID NO: 747781 - RNA, 64 nt, Homo Sapiens; identical to SEQ ID NO: 307477

SEQ ID NO: 747782 - RNA, 64 nt, Homo Sapiens; identical to SEQ ID NO: 307478

SEQ ID NO: 747783 - RNA, 64 nt, Homo Sapiens; identical to SEQ ID NO: 307479

SEQ ID NO: 747784 - RNA, 64 nt, Homo Sapiens; identical to SEQ ID NO: 307480

SEQ ID NO: 747785 - RNA, 64 nt, Homo Sapiens; identical to SEQ ID NO: 307481

SEQ ID NO: 747786 - RNA, 64 nt, Homo Sapiens; identical to SEQ ID NO: 307482

SEQ ID NO: 747787 - RNA, 64 nt, Homo Sapiens; identical to SEQ ID NO: 307483

SEQ ID NO: 747788 - RNA, 64 nt, Homo Sapiens; identical to SEQ ID NO: 307484

SEQ ID NO: 747789 - RNA, 64 nt, Homo Sapiens; identical to SEQ ID NO: 307485

SEQ ID NO: 747790 - RNA, 64 nt, Homo Sapiens; identical to SEQ ID NO: 307486

SEQ ID NO: 747791 - RNA, 64 nt, Homo Sapiens; identical to SEQ ID NO: 307487

SEQ ID NO: 747792 - RNA, 64 nt, Homo Sapiens; identical to SEQ ID NO: 307488

SEQ ID NO: 747793 - RNA, 64 nt, Homo Sapiens; identical to SEQ ID NO: 660864

SEQ ID NO: 747794 - RNA, 64 nt, Homo Sapiens; identical to SEQ ID NO: 660865

SEQ ID NO: 747795 - RNA, 64 nt, Homo Sapiens; identical to SEQ ID NO: 660866

SEQ ID NO: 747796 - RNA, 64 nt, Homo Sapiens; identical to SEQ ID NO: 660867

SEQ ID NO: 747797 - RNA, 64 nt, Homo Sapiens; identical to SEQ ID NO: 660868

SEQ ID NO: 747798 - RNA, 64 nt, Homo Sapiens; identical to SEQ ID NO: 660869

SEQ ID NO: 747799 - RNA, 64 nt, Homo Sapiens; identical to SEQ ID NO: 660870

SEQ ID NO: 747800 - RNA, 64 nt, Homo Sapiens; identical to SEQ ID NO: 660871

SEQ ID NO: 747801 - RNA, 64 nt, Homo Sapiens; identical to SEQ ID NO: 660872

SEQ ID NO: 747802 - RNA, 64 nt, Homo Sapiens; identical to SEQ ID NO: 660873

SEQ ID NO: 747803 - RNA, 64 nt, Homo Sapiens; identical to SEQ ID NO: 660874

SEQ ID NO: 747804 - RNA, 64 nt, Homo Sapiens; identical to SEQ ID NO: 660875

SEQ ID NO: 747805 - RNA, 64 nt, Homo Sapiens; identical to SEQ ID NO: 660876

SEQ ID NO: 747806 - RNA, 64 nt, Homo Sapiens; identical to SEQ ID NO: 660877

SEQ ID NO: 747807 - RNA, 64 nt, Homo Sapiens; identical to SEQ ID NO: 660878

SEQ ID NO: 747808 - RNA, 64 nt, Homo Sapiens; identical to SEQ ID NO: 660879

SEQ ID NO: 747809 - RNA, 64 nt, Homo Sapiens; identical to SEQ ID NO: 660880

SEQ ID NO: 747810 - RNA, 64 nt, Homo Sapiens; identical to SEQ ID NO: 660881

SEQ ID NO: 747811 - RNA, 64 nt, Homo Sapiens; identical to SEQ ID NO: 660882

SEQ ID NO: 747812 - RNA, 64 nt, Homo Sapiens; identical to SEQ ID NO: 660883

SEQ ID NO: 747813 - RNA, 64 nt, Homo Sapiens; identical to SEQ ID NO: 660884

SEQ ID NO: 747814 - RNA, 64 nt, Homo Sapiens; identical to SEQ ID NO: 660885

SEQ ID NO: 747815 - RNA, 64 nt, Homo Sapiens; identical to SEQ ID NO: 660886

SEQ ID NO: 747816 - RNA, 64 nt, Homo Sapiens; identical to SEQ ID NO: 660887

SEQ ID NO: 747817 - RNA, 64 nt, Homo Sapiens; identical to SEQ ID NO: 660888

SEQ ID NO: 747818 - RNA, 64 nt, Homo Sapiens; identical to SEQ ID NO: 660889

SEQ ID NO: 747819 - RNA, 64 nt, Homo Sapiens; identical to SEQ ID NO: 660890

SEQ ID NO: 747820 - RNA, 64 nt, Homo Sapiens; identical to SEQ ID NO: 660891

SEQ ID NO: 747821 - RNA, 61 nt, Homo Sapiens; identical to SEQ ID NO: 660892

SEQ ID NO: 747822 - RNA, 64 nt, Homo Sapiens; identical to SEQ ID NO: 660893

SEQ ID NO: 747823 - RNA, 64 nt, Homo Sapiens; identical to SEQ ID NO: 660894

SEQ ID NO: 747824 - RNA, 64 nt, Homo Sapiens; identical to SEQ ID NO: 660895

SEQ ID NO: 747825 - RNA, 64 nt, Homo Sapiens; identical to SEQ ID NO: 660896

SEQ ID NO: 747826 - RNA, 64 nt, Homo Sapiens; identical to SEQ ID NO: 660897

SEQ ID NO: 747827 - RNA, 64 nt, Homo Sapiens; identical to SEQ ID NO: 660898

SEQ ID NO: 747828 - RNA, 64 nt, Homo Sapiens; identical to SEQ ID NO: 660899

SEQ ID NO: 747829 - RNA, 64 nt, Homo Sapiens; identical to SEQ ID NO: 660900

SEQ ID NO: 747830 - RNA, 64 nt, Homo Sapiens; identical to SEQ ID NO: 660901

SEQ ID NO: 747831 - RNA, 64 nt, Homo Sapiens; identical to SEQ ID NO: 660902

SEQ ID NO: 747832 - RNA, 64 nt, Homo Sapiens; identical to SEQ ID NO: 660903

SEQ ID NO: 747833 - RNA, 64 nt, Homo Sapiens; identical to SEQ ID NO: 660904

SEQ ID NO: 747834 - RNA, 64 nt, Homo Sapiens; identical to SEQ ID NO: 660905

SEQ ID NO: 747835 - RNA, 64 nt, Homo Sapiens; identical to SEQ ID NO: 660906

SEQ ID NO: 747836 - RNA, 64 nt, Homo Sapiens; identical to SEQ ID NO: 660907

SEQ ID NO: 747837 - RNA, 64 nt, Homo Sapiens; identical to SEQ ID NO: 660908

SEQ ID NO: 747838 - RNA, 64 nt, Homo Sapiens; identical to SEQ ID NO: 660909

SEQ ID NO: 747839 - RNA, 64 nt, Homo Sapiens; identical to SEQ ID NO: 660910

SEQ ID NO: 747840 - RNA, 64 nt, Homo Sapiens; identical to SEQ ID NO: 660911

SEQ ID NO: 747841 - RNA, 64 nt, Homo Sapiens; identical to SEQ ID NO: 660912

SEQ ID NO: 747842 - RNA, 64 nt, Homo Sapiens; identical to SEQ ID NO: 660913

SEQ ID NO: 747843 - RNA, 64 nt, Homo Sapiens; identical to SEQ ID NO: 660914

SEQ ID NO: 747844 - RNA, 64 nt, Homo Sapiens; identical to SEQ ID NO: 660915

SEQ ID NO: 747845 - RNA, 64 nt, Homo Sapiens; identical to SEQ ID NO: 660916

SEQ ID NO: 747846 - RNA, 64 nt, Homo Sapiens; identical to SEQ ID NO: 660917

SEQ ID NO: 747847 - RNA, 64 nt, Homo Sapiens; identical to SEQ ID NO: 660918

SEQ ID NO: 747848 - RNA, 64 nt, Homo Sapiens; identical to SEQ ID NO: 660919

SEQ ID NO: 747849 - RNA, 51 nt, Homo Sapiens; identical to SEQ ID NO: 660920

SEQ ID NO: 747850 - RNA, 64 nt, Homo Sapiens; identical to SEQ ID NO: 660921

SEQ ID NO: 747851 - RNA, 64 nt, Homo Sapiens; identical to SEQ ID NO: 660922

SEQ ID NO: 747852 - RNA, 64 nt, Homo Sapiens; identical to SEQ ID NO: 660923

SEQ ID NO: 747853 - RNA, 64 nt, Homo Sapiens; identical to SEQ ID NO: 660924

SEQ ID NO: 747854 - RNA, 64 nt, Homo Sapiens; identical to SEQ ID NO: 660925

SEQ ID NO: 747855 - RNA, 64 nt, Homo Sapiens; identical to SEQ ID NO: 660926

SEQ ID NO: 747856 - RNA, 64 nt, Homo Sapiens; identical to SEQ ID NO: 660927

SEQ ID NO: 747857 - RNA, 64 nt, Homo Sapiens; identical to SEQ ID NO: 660928

SEQ ID NO: 747858 - RNA, 64 nt, Homo Sapiens; identical to SEQ ID NO: 660929

SEQ ID NO: 747859 - RNA, 64 nt, Homo Sapiens; identical to SEQ ID NO: 660930

SEQ ID NO: 747860 - RNA, 62 nt, Homo Sapiens
acaagccacaaggaccaauguagguauucuccccgccccaucuucaaggcucagcgacugag

SEQ ID NO: 747861 - RNA, 62 nt, Homo Sapiens
caauuguucccucuggagggguccaggugcccccgccccacaaggccgcggagccucagcag

SEQ ID NO: 747862 - RNA, 62 nt, Homo Sapiens
aaaacaguucuuuuguuaagacuccuccugccccgccccauuacuucaguguuuucuacaau

SEQ ID NO: 747863 - RNA, 62 nt, Homo Sapiens
ccucaccagagaaaagaauccccucagucaccccgccccauugaccuggagcagucagaggg

SEQ ID NO: 747864 - RNA, 62 nt, Homo Sapiens
ucccuuccagcaaacucaacggccccccgacgccgccccauuacuggcagccaggccugucg

SEQ ID NO: 747865 - RNA, 62 nt, Homo Sapiens
ccgagucgcuaaggggcugcuucgugacucagccgccccauccgcaccugcccgccucggcg

SEQ ID NO: 747866 - RNA, 62 nt, Homo Sapiens
acccggccuuggucccuggcgcaguccccuguccgccccaaaccuccuugccgcuguguggg

SEQ ID NO: 747867 - RNA, 62 nt, Homo Sapiens
cacgcacgcacacucggggacggcgggugggcccgccccacgccccgccccgggcagggggg

SEQ ID NO: 747868 - RNA, 62 nt, Homo Sapiens
cgcccccagcccugcaugcaggugcccucgcuccgccccaucaguuccugccccugccccuc

SEQ ID NO: 747869 - RNA, 62 nt, Homo Sapiens
acgcacgcacgcacacggccccgcacacagccccgccccaccccgcaaccagcccugucgac

SEQ ID NO: 747870 - RNA, 61 nt, Homo Sapiens; identical to SEQ ID NO: 312339

SEQ ID NO: 747871 - RNA, 62 nt, Homo Sapiens
ccucggccgugacauucggggccgggcgggacccgccccacagacuccaacuuccccuccaa

SEQ ID NO: 747872 - RNA, 62 nt, Homo Sapiens
ugagagggggaagaagcggggaggaagaaaucccgccccaaacguccgcuuuccuuuucucu

SEQ ID NO: 747873 - RNA, 62 nt, Homo Sapiens
gagcccucgcccccgacucucggucggccuccccgccccaggcgucacucagugaucacggg

SEQ ID NO: 747874 - RNA, 62 nt, Homo Sapiens
gcauccuucucggagcugguagguuccccaccccgccccacccagagcugggcccccugggc

SEQ ID NO: 747875 - RNA, 62 nt, Homo Sapiens
gcugggcccccugggcagguggcgcccccgccccgccccagacggaccgcgggccggaagga

SEQ ID NO: 747876 - RNA, 62 nt, Homo Sapiens
cuuaguccccagggccaagcuuuuggcugaagccgccccagcuucauuuggggggugggaga

SEQ ID NO: 747877 - RNA, 62 nt, Homo Sapiens
aaucccauugcauagguuuacgugaccgccccccgccccaucugugaauccugugcucugcc

SEQ ID NO: 747878 - RNA, 64 nt, Homo Sapiens; identical to SEQ ID NO: 313188

SEQ ID NO: 747879 - RNA, 64 nt, Homo Sapiens; identical to SEQ ID NO: 313189

SEQ ID NO: 747880 - RNA, 64 nt, Homo Sapiens; identical to SEQ ID NO: 313190

SEQ ID NO: 747881 - RNA, 64 nt, Homo Sapiens; identical to SEQ ID NO: 313191

SEQ ID NO: 747882 - RNA, 64 nt, Homo Sapiens; identical to SEQ ID NO: 313192

SEQ ID NO: 747883 - RNA, 64 nt, Homo Sapiens; identical to SEQ ID NO: 313193

SEQ ID NO: 747884 - RNA, 64 nt, Homo Sapiens; identical to SEQ ID NO: 313194

SEQ ID NO: 747885 - RNA, 64 nt, Homo Sapiens; identical to SEQ ID NO: 313195

SEQ ID NO: 747886 - RNA, 64 nt, Homo Sapiens; identical to SEQ ID NO: 313196

SEQ ID NO: 747887 - RNA, 64 nt, Homo Sapiens; identical to SEQ ID NO: 313197

SEQ ID NO: 747888 - RNA, 64 nt, Homo Sapiens; identical to SEQ ID NO: 313198

SEQ ID NO: 747889 - RNA, 64 nt, Homo Sapiens; identical to SEQ ID NO: 313199

SEQ ID NO: 747890 - RNA, 64 nt, Homo Sapiens; identical to SEQ ID NO: 313200

SEQ ID NO: 747891 - RNA, 64 nt, Homo Sapiens; identical to SEQ ID NO: 313201

SEQ ID NO: 747892 - RNA, 60 nt, Homo Sapiens
aaccuggggaacuguauuuuuaaaugaagagcuauuuauauauauuauuuuuuuuuaaga

SEQ ID NO: 747893 - RNA, 60 nt, Homo Sapiens
uucuaaacugcucaauuuugacucaaaggugcuauuuaccaaacacucucccuacccauu

SEQ ID NO: 747894 - RNA, 60 nt, Homo Sapiens
uaccagagcaucuucuuaucuuuccacagagcuauuuacauccuggacuauauaacuuaa

SEQ ID NO: 747895 - RNA, 60 nt, Homo Sapiens
auuauggcuaaaauauaugucuaacccagugcuauuuaggugaaaaugcuaauugauaaa

SEQ ID NO: 747896 - RNA, 60 nt, Homo Sapiens
gaggacucucuuagaaugagugauucaccugcuauuuaaaugaauuauuuagauuuuuga

SEQ ID NO: 747897 - RNA, 60 nt, Homo Sapiens
cuuagcaaacuuuugaaucuuucuuuuauugcuauuuacacauacauacacacauacaaa

SEQ ID NO: 747898 - RNA, 60 nt, Homo Sapiens
gauggagcagcacuuagugcgaaaauaggagcuauuuauaguuuaaugugguaccaaacu

SEQ ID NO: 747899 - RNA, 60 nt, Homo Sapiens
accuguggcaaaaugaacgccauauucaucgcuauuuaaaagguuagaccggcuuuugac

SEQ ID NO: 747900 - RNA, 60 nt, Homo Sapiens
gaugcuucugggagacacccaaagggugaagcuauuuaucuguaguaaacuauuuaucug

SEQ ID NO: 747901 - RNA, 60 nt, Homo Sapiens
aacacaccagugucuguucuugaugcaguugcuauuuaggaugaguuaagugccugggga

SEQ ID NO: 747902 - RNA, 60 nt, Homo Sapiens
uuugauuaaauuuagguagcuuuuuguagugcuauuuaauuuggugccaauaaacuacuu

SEQ ID NO: 747903 - RNA, 60 nt, Homo Sapiens
caauuuuuuucuaacgugaaaauuuauggugcuauuuaaaaggugugccuuguauaacug

SEQ ID NO: 747904 - RNA, 60 nt, Homo Sapiens
uuaaauuaaguaguuuuaaucagcuuaaaagcuauuuaacccauuuuaauaagcuugcag

SEQ ID NO: 747905 - RNA, 60 nt, Homo Sapiens
caaguaacucuacuaacagauguugguauagcuauuuaaagacuacuucguaaguaguau

SEQ ID NO: 747906 - RNA, 64 nt, Homo Sapiens; identical to SEQ ID NO: 298084

SEQ ID NO: 747907 - RNA, 64 nt, Homo Sapiens; identical to SEQ ID NO: 298085

SEQ ID NO: 747908 - RNA, 64 nt, Homo Sapiens; identical to SEQ ID NO: 298086

SEQ ID NO: 747909 - RNA, 64 nt, Homo Sapiens; identical to SEQ ID NO: 298087

SEQ ID NO: 747910 - RNA, 64 nt, Homo Sapiens; identical to SEQ ID NO: 298088

SEQ ID NO: 747911 - RNA, 64 nt, Homo Sapiens; identical to SEQ ID NO: 298089

SEQ ID NO: 747912 - RNA, 64 nt, Homo Sapiens; identical to SEQ ID NO: 561895

SEQ ID NO: 747913 - RNA, 64 nt, Homo Sapiens; identical to SEQ ID NO: 561896

SEQ ID NO: 747914 - RNA, 64 nt, Homo Sapiens; identical to SEQ ID NO: 561897

SEQ ID NO: 747915 - RNA, 64 nt, Homo Sapiens; identical to SEQ ID NO: 561898

SEQ ID NO: 747916 - RNA, 64 nt, Homo Sapiens; identical to SEQ ID NO: 561899

SEQ ID NO: 747917 - RNA, 64 nt, Homo Sapiens; identical to SEQ ID NO: 561900

SEQ ID NO: 747918 - RNA, 64 nt, Homo Sapiens; identical to SEQ ID NO: 561901

SEQ ID NO: 747919 - RNA, 64 nt, Homo Sapiens; identical to SEQ ID NO: 561902

SEQ ID NO: 747920 - RNA, 64 nt, Homo Sapiens; identical to SEQ ID NO: 561903

SEQ ID NO: 747921 - RNA, 64 nt, Homo Sapiens; identical to SEQ ID NO: 561904

SEQ ID NO: 747922 - RNA, 64 nt, Homo Sapiens; identical to SEQ ID NO: 561905

SEQ ID NO: 747923 - RNA, 64 nt, Homo Sapiens; identical to SEQ ID NO: 561906

SEQ ID NO: 747924 - RNA, 64 nt, Homo Sapiens; identical to SEQ ID NO: 561907

SEQ ID NO: 747925 - RNA, 64 nt, Homo Sapiens; identical to SEQ ID NO: 561908

SEQ ID NO: 747926 - RNA, 64 nt, Homo Sapiens; identical to SEQ ID NO: 561909

SEQ ID NO: 747927 - RNA, 64 nt, Homo Sapiens; identical to SEQ ID NO: 561910

SEQ ID NO: 747928 - RNA, 64 nt, Homo Sapiens; identical to SEQ ID NO: 561911

SEQ ID NO: 747929 - RNA, 64 nt, Homo Sapiens; identical to SEQ ID NO: 561912

SEQ ID NO: 747930 - RNA, 64 nt, Homo Sapiens; identical to SEQ ID NO: 514253

SEQ ID NO: 747931 - RNA, 64 nt, Homo Sapiens; identical to SEQ ID NO: 514254

SEQ ID NO: 747932 - RNA, 64 nt, Homo Sapiens; identical to SEQ ID NO: 514255

SEQ ID NO: 747933 - RNA, 64 nt, Homo Sapiens; identical to SEQ ID NO: 514256

SEQ ID NO: 747934 - RNA, 64 nt, Homo Sapiens; identical to SEQ ID NO: 514257

SEQ ID NO: 747935 - RNA, 64 nt, Homo Sapiens; identical to SEQ ID NO: 514258

SEQ ID NO: 747936 - RNA, 64 nt, Homo Sapiens; identical to SEQ ID NO: 514259

SEQ ID NO: 747937 - RNA, 64 nt, Homo Sapiens; identical to SEQ ID NO: 514260

SEQ ID NO: 747938 - RNA, 64 nt, Homo Sapiens; identical to SEQ ID NO: 514261

SEQ ID NO: 747939 - RNA, 64 nt, Homo Sapiens; identical to SEQ ID NO: 514262

SEQ ID NO: 747940 - RNA, 64 nt, Homo Sapiens; identical to SEQ ID NO: 514263

SEQ ID NO: 747941 - RNA, 64 nt, Homo Sapiens; identical to SEQ ID NO: 514264

SEQ ID NO: 747942 - RNA, 64 nt, Homo Sapiens; identical to SEQ ID NO: 514265

SEQ ID NO: 747943 - RNA, 64 nt, Homo Sapiens; identical to SEQ ID NO: 514266

SEQ ID NO: 747944 - RNA, 64 nt, Homo Sapiens; identical to SEQ ID NO: 514267

SEQ ID NO: 747945 - RNA, 64 nt, Homo Sapiens; identical to SEQ ID NO: 514268

SEQ ID NO: 747946 - RNA, 64 nt, Homo Sapiens; identical to SEQ ID NO: 225411

SEQ ID NO: 747947 - RNA, 64 nt, Homo Sapiens; identical to SEQ ID NO: 225412

SEQ ID NO: 747948 - RNA, 64 nt, Homo Sapiens; identical to SEQ ID NO: 225413

SEQ ID NO: 747949 - RNA, 64 nt, Homo Sapiens; identical to SEQ ID NO: 225414

SEQ ID NO: 747950 - RNA, 64 nt, Homo Sapiens; identical to SEQ ID NO: 225415

SEQ ID NO: 747951 - RNA, 64 nt, Homo Sapiens; identical to SEQ ID NO: 225416

SEQ ID NO: 747952 - RNA, 64 nt, Homo Sapiens; identical to SEQ ID NO: 225417

SEQ ID NO: 747953 - RNA, 64 nt, Homo Sapiens; identical to SEQ ID NO: 225418

SEQ ID NO: 747954 - RNA, 64 nt, Homo Sapiens; identical to SEQ ID NO: 225419

SEQ ID NO: 747955 - RNA, 64 nt, Homo Sapiens; identical to SEQ ID NO: 225420

SEQ ID NO: 747956 - RNA, 64 nt, Homo Sapiens; identical to SEQ ID NO: 225421

SEQ ID NO: 747957 - RNA, 64 nt, Homo Sapiens; identical to SEQ ID NO: 225422

SEQ ID NO: 747958 - RNA, 64 nt, Homo Sapiens; identical to SEQ ID NO: 225423

SEQ ID NO: 747959 - RNA, 64 nt, Homo Sapiens; identical to SEQ ID NO: 225424

SEQ ID NO: 747960 - RNA, 64 nt, Homo Sapiens; identical to SEQ ID NO: 225425

SEQ ID NO: 747961 - RNA, 64 nt, Homo Sapiens; identical to SEQ ID NO: 225426

SEQ ID NO: 747962 - RNA, 64 nt, Homo Sapiens; identical to SEQ ID NO: 225427

SEQ ID NO: 747963 - RNA, 64 nt, Homo Sapiens; identical to SEQ ID NO: 133971

SEQ ID NO: 747964 - RNA, 64 nt, Homo Sapiens; identical to SEQ ID NO: 133972

SEQ ID NO: 747965 - RNA, 64 nt, Homo Sapiens; identical to SEQ ID NO: 133973

SEQ ID NO: 747966 - RNA, 64 nt, Homo Sapiens; identical to SEQ ID NO: 133974

SEQ ID NO: 747967 - RNA, 64 nt, Homo Sapiens; identical to SEQ ID NO: 133975

SEQ ID NO: 747968 - RNA, 64 nt, Homo Sapiens; identical to SEQ ID NO: 133976

SEQ ID NO: 747969 - RNA, 64 nt, Homo Sapiens; identical to SEQ ID NO: 133977

SEQ ID NO: 747970 - RNA, 64 nt, Homo Sapiens; identical to SEQ ID NO: 133978

SEQ ID NO: 747971 - RNA, 64 nt, Homo Sapiens; identical to SEQ ID NO: 133979

SEQ ID NO: 747972 - RNA, 64 nt, Homo Sapiens; identical to SEQ ID NO: 133980

SEQ ID NO: 747973 - RNA, 64 nt, Homo Sapiens; identical to SEQ ID NO: 133981

SEQ ID NO: 747974 - RNA, 64 nt, Homo Sapiens; identical to SEQ ID NO: 133982

SEQ ID NO: 747975 - RNA, 64 nt, Homo Sapiens; identical to SEQ ID NO: 133983

SEQ ID NO: 747976 - RNA, 64 nt, Homo Sapiens; identical to SEQ ID NO: 133984

SEQ ID NO: 747977 - RNA, 64 nt, Homo Sapiens; identical to SEQ ID NO: 133985

SEQ ID NO: 747978 - RNA, 64 nt, Homo Sapiens; identical to SEQ ID NO: 133986

SEQ ID NO: 747979 - RNA, 64 nt, Homo Sapiens; identical to SEQ ID NO: 133987

SEQ ID NO: 747980 - RNA, 64 nt, Homo Sapiens; identical to SEQ ID NO: 133988

SEQ ID NO: 747981 - RNA, 64 nt, Homo Sapiens; identical to SEQ ID NO: 133989

SEQ ID NO: 747982 - RNA, 64 nt, Homo Sapiens; identical to SEQ ID NO: 133990

SEQ ID NO: 747983 - RNA, 64 nt, Homo Sapiens; identical to SEQ ID NO: 133991

SEQ ID NO: 747984 - RNA, 64 nt, Homo Sapiens; identical to SEQ ID NO: 133992

SEQ ID NO: 747985 - RNA, 64 nt, Homo Sapiens; identical to SEQ ID NO: 218520

SEQ ID NO: 747986 - RNA, 64 nt, Homo Sapiens; identical to SEQ ID NO: 218521

SEQ ID NO: 747987 - RNA, 64 nt, Homo Sapiens; identical to SEQ ID NO: 218522

SEQ ID NO: 747988 - RNA, 64 nt, Homo Sapiens; identical to SEQ ID NO: 218523

SEQ ID NO: 747989 - RNA, 64 nt, Homo Sapiens; identical to SEQ ID NO: 218524

SEQ ID NO: 747990 - RNA, 64 nt, Homo Sapiens; identical to SEQ ID NO: 218525

SEQ ID NO: 747991 - RNA, 64 nt, Homo Sapiens; identical to SEQ ID NO: 218526

SEQ ID NO: 747992 - RNA, 64 nt, Homo Sapiens; identical to SEQ ID NO: 218527

SEQ ID NO: 747993 - RNA, 64 nt, Homo Sapiens; identical to SEQ ID NO: 218528

SEQ ID NO: 747994 - RNA, 64 nt, Homo Sapiens; identical to SEQ ID NO: 218529

SEQ ID NO: 747995 - RNA, 64 nt, Homo Sapiens; identical to SEQ ID NO: 218530

SEQ ID NO: 747996 - RNA, 64 nt, Homo Sapiens; identical to SEQ ID NO: 218531

SEQ ID NO: 747997 - RNA, 64 nt, Homo Sapiens; identical to SEQ ID NO: 218532

SEQ ID NO: 747998 - RNA, 64 nt, Homo Sapiens; identical to SEQ ID NO: 218533

SEQ ID NO: 747999 - RNA, 64 nt, Homo Sapiens; identical to SEQ ID NO: 218534

SEQ ID NO: 748000 - RNA, 64 nt, Homo Sapiens; identical to SEQ ID NO: 218535

SEQ ID NO: 748001 - RNA, 64 nt, Homo Sapiens; identical to SEQ ID NO: 218536

SEQ ID NO: 748002 - RNA, 64 nt, Homo Sapiens; identical to SEQ ID NO: 218537

SEQ ID NO: 748003 - RNA, 64 nt, Homo Sapiens; identical to SEQ ID NO: 218538

SEQ ID NO: 748004 - RNA, 61 nt, Homo Sapiens; identical to SEQ ID NO: 218539

SEQ ID NO: 748005 - RNA, 64 nt, Homo Sapiens; identical to SEQ ID NO: 218540

SEQ ID NO: 748006 - RNA, 64 nt, Homo Sapiens; identical to SEQ ID NO: 218541

SEQ ID NO: 748007 - RNA, 64 nt, Homo Sapiens; identical to SEQ ID NO: 218542

SEQ ID NO: 748008 - RNA, 64 nt, Homo Sapiens; identical to SEQ ID NO: 218543

SEQ ID NO: 748009 - RNA, 64 nt, Homo Sapiens; identical to SEQ ID NO: 218544

SEQ ID NO: 748010 - RNA, 64 nt, Homo Sapiens; identical to SEQ ID NO: 218545

SEQ ID NO: 748011 - RNA, 64 nt, Homo Sapiens; identical to SEQ ID NO: 218546

SEQ ID NO: 748012 - RNA, 64 nt, Homo Sapiens; identical to SEQ ID NO: 218547

SEQ ID NO: 748013 - RNA, 64 nt, Homo Sapiens; identical to SEQ ID NO: 218548

SEQ ID NO: 748014 - RNA, 64 nt, Homo Sapiens; identical to SEQ ID NO: 218549

SEQ ID NO: 748015 - RNA, 64 nt, Homo Sapiens; identical to SEQ ID NO: 218550

SEQ ID NO: 748016 - RNA, 64 nt, Homo Sapiens; identical to SEQ ID NO: 218551

SEQ ID NO: 748017 - RNA, 64 nt, Homo Sapiens; identical to SEQ ID NO: 218552

SEQ ID NO: 748018 - RNA, 64 nt, Homo Sapiens; identical to SEQ ID NO: 218553

SEQ ID NO: 748019 - RNA, 63 nt, Homo Sapiens; identical to SEQ ID NO: 218554

SEQ ID NO: 748020 - RNA, 64 nt, Homo Sapiens; identical to SEQ ID NO: 218555

SEQ ID NO: 748021 - RNA, 64 nt, Homo Sapiens; identical to SEQ ID NO: 218556

SEQ ID NO: 748022 - RNA, 64 nt, Homo Sapiens; identical to SEQ ID NO: 218557

SEQ ID NO: 748023 - RNA, 64 nt, Homo Sapiens; identical to SEQ ID NO: 218558

SEQ ID NO: 748024 - RNA, 64 nt, Homo Sapiens; identical to SEQ ID NO: 218559

SEQ ID NO: 748025 - RNA, 64 nt, Homo Sapiens; identical to SEQ ID NO: 218560

SEQ ID NO: 748026 - RNA, 64 nt, Homo Sapiens; identical to SEQ ID NO: 218561

SEQ ID NO: 748027 - RNA, 64 nt, Homo Sapiens; identical to SEQ ID NO: 218562

SEQ ID NO: 748028 - RNA, 64 nt, Homo Sapiens; identical to SEQ ID NO: 218563

SEQ ID NO: 748029 - RNA, 64 nt, Homo Sapiens; identical to SEQ ID NO: 218564

SEQ ID NO: 748030 - RNA, 64 nt, Homo Sapiens; identical to SEQ ID NO: 218565

SEQ ID NO: 748031 - RNA, 64 nt, Homo Sapiens; identical to SEQ ID NO: 218566

SEQ ID NO: 748032 - RNA, 64 nt, Homo Sapiens; identical to SEQ ID NO: 218567

SEQ ID NO: 748033 - RNA, 64 nt, Homo Sapiens; identical to SEQ ID NO: 218568

SEQ ID NO: 748034 - RNA, 64 nt, Homo Sapiens; identical to SEQ ID NO: 218569

SEQ ID NO: 748035 - RNA, 64 nt, Homo Sapiens; identical to SEQ ID NO: 218570

SEQ ID NO: 748036 - RNA, 64 nt, Homo Sapiens; identical to SEQ ID NO: 218571

SEQ ID NO: 748037 - RNA, 64 nt, Homo Sapiens; identical to SEQ ID NO: 218572

SEQ ID NO: 748038 - RNA, 64 nt, Homo Sapiens; identical to SEQ ID NO: 218573

SEQ ID NO: 748039 - RNA, 64 nt, Homo Sapiens; identical to SEQ ID NO: 218574

SEQ ID NO: 748040 - RNA, 64 nt, Homo Sapiens; identical to SEQ ID NO: 218575

SEQ ID NO: 748041 - RNA, 64 nt, Homo Sapiens; identical to SEQ ID NO: 218576

SEQ ID NO: 748042 - RNA, 64 nt, Homo Sapiens; identical to SEQ ID NO: 218577

SEQ ID NO: 748043 - RNA, 64 nt, Homo Sapiens; identical to SEQ ID NO: 218578

SEQ ID NO: 748044 - RNA, 64 nt, Homo Sapiens; identical to SEQ ID NO: 218579

SEQ ID NO: 748045 - RNA, 64 nt, Homo Sapiens; identical to SEQ ID NO: 218580

SEQ ID NO: 748046 - RNA, 64 nt, Homo Sapiens; identical to SEQ ID NO: 218581

SEQ ID NO: 748047 - RNA, 64 nt, Homo Sapiens; identical to SEQ ID NO: 218582

SEQ ID NO: 748048 - RNA, 64 nt, Homo Sapiens; identical to SEQ ID NO: 218583

SEQ ID NO: 748049 - RNA, 64 nt, Homo Sapiens; identical to SEQ ID NO: 218584

SEQ ID NO: 748050 - RNA, 64 nt, Homo Sapiens; identical to SEQ ID NO: 218585

SEQ ID NO: 748051 - RNA, 64 nt, Homo Sapiens; identical to SEQ ID NO: 218586

SEQ ID NO: 748052 - RNA, 64 nt, Homo Sapiens; identical to SEQ ID NO: 218587

SEQ ID NO: 748053 - RNA, 64 nt, Homo Sapiens; identical to SEQ ID NO: 218588

SEQ ID NO: 748054 - RNA, 64 nt, Homo Sapiens; identical to SEQ ID NO: 218589

SEQ ID NO: 748055 - RNA, 64 nt, Homo Sapiens; identical to SEQ ID NO: 218590

SEQ ID NO: 748056 - RNA, 64 nt, Homo Sapiens; identical to SEQ ID NO: 218591

SEQ ID NO: 748057 - RNA, 64 nt, Homo Sapiens; identical to SEQ ID NO: 218592

SEQ ID NO: 748058 - RNA, 64 nt, Homo Sapiens; identical to SEQ ID NO: 218593

SEQ ID NO: 748059 - RNA, 64 nt, Homo Sapiens; identical to SEQ ID NO: 218594

SEQ ID NO: 748060 - RNA, 64 nt, Homo Sapiens; identical to SEQ ID NO: 218595

SEQ ID NO: 748061 - RNA, 64 nt, Homo Sapiens; identical to SEQ ID NO: 218596

SEQ ID NO: 748062 - RNA, 64 nt, Homo Sapiens; identical to SEQ ID NO: 218597

SEQ ID NO: 748063 - RNA, 64 nt, Homo Sapiens; identical to SEQ ID NO: 218598

SEQ ID NO: 748064 - RNA, 64 nt, Homo Sapiens; identical to SEQ ID NO: 218599

SEQ ID NO: 748065 - RNA, 64 nt, Homo Sapiens; identical to SEQ ID NO: 218600

SEQ ID NO: 748066 - RNA, 64 nt, Homo Sapiens; identical to SEQ ID NO: 218601

SEQ ID NO: 748067 - RNA, 64 nt, Homo Sapiens; identical to SEQ ID NO: 218602

SEQ ID NO: 748068 - RNA, 64 nt, Homo Sapiens; identical to SEQ ID NO: 218603

SEQ ID NO: 748069 - RNA, 64 nt, Homo Sapiens; identical to SEQ ID NO: 218604

SEQ ID NO: 748070 - RNA, 64 nt, Homo Sapiens; identical to SEQ ID NO: 218605

SEQ ID NO: 748071 - RNA, 64 nt, Homo Sapiens; identical to SEQ ID NO: 218606

SEQ ID NO: 748072 - RNA, 64 nt, Homo Sapiens; identical to SEQ ID NO: 218607

SEQ ID NO: 748073 - RNA, 64 nt, Homo Sapiens; identical to SEQ ID NO: 218608

SEQ ID NO: 748074 - RNA, 64 nt, Homo Sapiens; identical to SEQ ID NO: 218609

SEQ ID NO: 748075 - RNA, 64 nt, Homo Sapiens; identical to SEQ ID NO: 218610

SEQ ID NO: 748076 - RNA, 64 nt, Homo Sapiens; identical to SEQ ID NO: 218611

SEQ ID NO: 748077 - RNA, 64 nt, Homo Sapiens; identical to SEQ ID NO: 218612

SEQ ID NO: 748078 - RNA, 62 nt, Homo Sapiens; identical to SEQ ID NO: 218613

SEQ ID NO: 748079 - RNA, 64 nt, Homo Sapiens; identical to SEQ ID NO: 218614

SEQ ID NO: 748080 - RNA, 64 nt, Homo Sapiens; identical to SEQ ID NO: 218615

SEQ ID NO: 748081 - RNA, 64 nt, Homo Sapiens; identical to SEQ ID NO: 218616

SEQ ID NO: 748082 - RNA, 64 nt, Homo Sapiens; identical to SEQ ID NO: 218617

SEQ ID NO: 748083 - RNA, 64 nt, Homo Sapiens; identical to SEQ ID NO: 218618

SEQ ID NO: 748084 - RNA, 64 nt, Homo Sapiens; identical to SEQ ID NO: 218619

SEQ ID NO: 748085 - RNA, 64 nt, Homo Sapiens; identical to SEQ ID NO: 218620

SEQ ID NO: 748086 - RNA, 64 nt, Homo Sapiens; identical to SEQ ID NO: 218621

SEQ ID NO: 748087 - RNA, 64 nt, Homo Sapiens; identical to SEQ ID NO: 218622

SEQ ID NO: 748088 - RNA, 64 nt, Homo Sapiens; identical to SEQ ID NO: 218623

SEQ ID NO: 748089 - RNA, 64 nt, Homo Sapiens; identical to SEQ ID NO: 218624

SEQ ID NO: 748090 - RNA, 64 nt, Homo Sapiens; identical to SEQ ID NO: 218625

SEQ ID NO: 748091 - RNA, 64 nt, Homo Sapiens; identical to SEQ ID NO: 218626

SEQ ID NO: 748092 - RNA, 64 nt, Homo Sapiens; identical to SEQ ID NO: 218627

SEQ ID NO: 748093 - RNA, 64 nt, Homo Sapiens; identical to SEQ ID NO: 218628

SEQ ID NO: 748094 - RNA, 64 nt, Homo Sapiens; identical to SEQ ID NO: 218629

SEQ ID NO: 748095 - RNA, 64 nt, Homo Sapiens; identical to SEQ ID NO: 218630

SEQ ID NO: 748096 - RNA, 64 nt, Homo Sapiens; identical to SEQ ID NO: 218631

SEQ ID NO: 748097 - RNA, 64 nt, Homo Sapiens; identical to SEQ ID NO: 218632

SEQ ID NO: 748098 - RNA, 64 nt, Homo Sapiens; identical to SEQ ID NO: 218633

SEQ ID NO: 748099 - RNA, 64 nt, Homo Sapiens; identical to SEQ ID NO: 218634

SEQ ID NO: 748100 - RNA, 64 nt, Homo Sapiens; identical to SEQ ID NO: 218635

SEQ ID NO: 748101 - RNA, 64 nt, Homo Sapiens; identical to SEQ ID NO: 218636

SEQ ID NO: 748102 - RNA, 64 nt, Homo Sapiens; identical to SEQ ID NO: 218637

SEQ ID NO: 748103 - RNA, 64 nt, Homo Sapiens; identical to SEQ ID NO: 218638

SEQ ID NO: 748104 - RNA, 64 nt, Homo Sapiens; identical to SEQ ID NO: 218639

SEQ ID NO: 748105 - RNA, 64 nt, Homo Sapiens; identical to SEQ ID NO: 218640

SEQ ID NO: 748106 - RNA, 64 nt, Homo Sapiens; identical to SEQ ID NO: 218641

SEQ ID NO: 748107 - RNA, 64 nt, Homo Sapiens; identical to SEQ ID NO: 218642

SEQ ID NO: 748108 - RNA, 64 nt, Homo Sapiens; identical to SEQ ID NO: 218643

SEQ ID NO: 748109 - RNA, 64 nt, Homo Sapiens; identical to SEQ ID NO: 218644

SEQ ID NO: 748110 - RNA, 64 nt, Homo Sapiens; identical to SEQ ID NO: 218645

SEQ ID NO: 748111 - RNA, 64 nt, Homo Sapiens; identical to SEQ ID NO: 218646

SEQ ID NO: 748112 - RNA, 64 nt, Homo Sapiens; identical to SEQ ID NO: 218647

SEQ ID NO: 748113 - RNA, 64 nt, Homo Sapiens; identical to SEQ ID NO: 218648

SEQ ID NO: 748114 - RNA, 64 nt, Homo Sapiens; identical to SEQ ID NO: 218649

SEQ ID NO: 748115 - RNA, 64 nt, Homo Sapiens; identical to SEQ ID NO: 218650

SEQ ID NO: 748116 - RNA, 64 nt, Homo Sapiens; identical to SEQ ID NO: 218651

SEQ ID NO: 748117 - RNA, 64 nt, Homo Sapiens; identical to SEQ ID NO: 218652

SEQ ID NO: 748118 - RNA, 64 nt, Homo Sapiens; identical to SEQ ID NO: 218653

SEQ ID NO: 748119 - RNA, 64 nt, Homo Sapiens; identical to SEQ ID NO: 218654

SEQ ID NO: 748120 - RNA, 64 nt, Homo Sapiens; identical to SEQ ID NO: 218655

SEQ ID NO: 748121 - RNA, 64 nt, Homo Sapiens; identical to SEQ ID NO: 218656

SEQ ID NO: 748122 - RNA, 64 nt, Homo Sapiens; identical to SEQ ID NO: 218657

SEQ ID NO: 748123 - RNA, 64 nt, Homo Sapiens; identical to SEQ ID NO: 218658

SEQ ID NO: 748124 - RNA, 64 nt, Homo Sapiens; identical to SEQ ID NO: 218659

SEQ ID NO: 748125 - RNA, 64 nt, Homo Sapiens; identical to SEQ ID NO: 218660

SEQ ID NO: 748126 - RNA, 64 nt, Homo Sapiens; identical to SEQ ID NO: 218661

SEQ ID NO: 748127 - RNA, 61 nt, Homo Sapiens; identical to SEQ ID NO: 218662

SEQ ID NO: 748128 - RNA, 64 nt, Homo Sapiens; identical to SEQ ID NO: 218663

SEQ ID NO: 748129 - RNA, 64 nt, Homo Sapiens; identical to SEQ ID NO: 218664

SEQ ID NO: 748130 - RNA, 64 nt, Homo Sapiens; identical to SEQ ID NO: 218665

SEQ ID NO: 748131 - RNA, 64 nt, Homo Sapiens; identical to SEQ ID NO: 218666

SEQ ID NO: 748132 - RNA, 64 nt, Homo Sapiens; identical to SEQ ID NO: 218667

SEQ ID NO: 748133 - RNA, 64 nt, Homo Sapiens; identical to SEQ ID NO: 218668

SEQ ID NO: 748134 - RNA, 64 nt, Homo Sapiens; identical to SEQ ID NO: 218669

SEQ ID NO: 748135 - RNA, 64 nt, Homo Sapiens; identical to SEQ ID NO: 218670

SEQ ID NO: 748136 - RNA, 64 nt, Homo Sapiens; identical to SEQ ID NO: 218671

SEQ ID NO: 748137 - RNA, 64 nt, Homo Sapiens; identical to SEQ ID NO: 218672

SEQ ID NO: 748138 - RNA, 64 nt, Homo Sapiens; identical to SEQ ID NO: 218673

SEQ ID NO: 748139 - RNA, 64 nt, Homo Sapiens; identical to SEQ ID NO: 218674

SEQ ID NO: 748140 - RNA, 64 nt, Homo Sapiens; identical to SEQ ID NO: 218675

SEQ ID NO: 748141 - RNA, 64 nt, Homo Sapiens; identical to SEQ ID NO: 218676

SEQ ID NO: 748142 - RNA, 64 nt, Homo Sapiens; identical to SEQ ID NO: 218677

SEQ ID NO: 748143 - RNA, 64 nt, Homo Sapiens; identical to SEQ ID NO: 218678

SEQ ID NO: 748144 - RNA, 64 nt, Homo Sapiens; identical to SEQ ID NO: 218679

SEQ ID NO: 748145 - RNA, 64 nt, Homo Sapiens; identical to SEQ ID NO: 218680

SEQ ID NO: 748146 - RNA, 64 nt, Homo Sapiens; identical to SEQ ID NO: 218681

SEQ ID NO: 748147 - RNA, 64 nt, Homo Sapiens; identical to SEQ ID NO: 218682

SEQ ID NO: 748148 - RNA, 64 nt, Homo Sapiens; identical to SEQ ID NO: 218683

SEQ ID NO: 748149 - RNA, 64 nt, Homo Sapiens; identical to SEQ ID NO: 218684

SEQ ID NO: 748150 - RNA, 64 nt, Homo Sapiens; identical to SEQ ID NO: 218685

SEQ ID NO: 748151 - RNA, 59 nt, Homo Sapiens; identical to SEQ ID NO: 218686

SEQ ID NO: 748152 - RNA, 64 nt, Homo Sapiens; identical to SEQ ID NO: 218687

SEQ ID NO: 748153 - RNA, 64 nt, Homo Sapiens; identical to SEQ ID NO: 218688

SEQ ID NO: 748154 - RNA, 64 nt, Homo Sapiens; identical to SEQ ID NO: 218689

SEQ ID NO: 748155 - RNA, 64 nt, Homo Sapiens; identical to SEQ ID NO: 218690

SEQ ID NO: 748156 - RNA, 64 nt, Homo Sapiens; identical to SEQ ID NO: 218691

SEQ ID NO: 748157 - RNA, 64 nt, Homo Sapiens; identical to SEQ ID NO: 218692

SEQ ID NO: 748158 - RNA, 64 nt, Homo Sapiens; identical to SEQ ID NO: 218693

SEQ ID NO: 748159 - RNA, 64 nt, Homo Sapiens; identical to SEQ ID NO: 218694

SEQ ID NO: 748160 - RNA, 64 nt, Homo Sapiens; identical to SEQ ID NO: 218695

SEQ ID NO: 748161 - RNA, 64 nt, Homo Sapiens; identical to SEQ ID NO: 218696

SEQ ID NO: 748162 - RNA, 64 nt, Homo Sapiens; identical to SEQ ID NO: 218697

SEQ ID NO: 748163 - RNA, 64 nt, Homo Sapiens; identical to SEQ ID NO: 218698

SEQ ID NO: 748164 - RNA, 64 nt, Homo Sapiens; identical to SEQ ID NO: 218699

SEQ ID NO: 748165 - RNA, 64 nt, Homo Sapiens; identical to SEQ ID NO: 218700

SEQ ID NO: 748166 - RNA, 64 nt, Homo Sapiens; identical to SEQ ID NO: 218701

SEQ ID NO: 748167 - RNA, 64 nt, Homo Sapiens; identical to SEQ ID NO: 218702

SEQ ID NO: 748168 - RNA, 64 nt, Homo Sapiens; identical to SEQ ID NO: 218703

SEQ ID NO: 748169 - RNA, 64 nt, Homo Sapiens; identical to SEQ ID NO: 218704

SEQ ID NO: 748170 - RNA, 64 nt, Homo Sapiens; identical to SEQ ID NO: 218705

SEQ ID NO: 748171 - RNA, 64 nt, Homo Sapiens; identical to SEQ ID NO: 218706

SEQ ID NO: 748172 - RNA, 64 nt, Homo Sapiens; identical to SEQ ID NO: 218707

SEQ ID NO: 748173 - RNA, 64 nt, Homo Sapiens; identical to SEQ ID NO: 218708

SEQ ID NO: 748174 - RNA, 64 nt, Homo Sapiens; identical to SEQ ID NO: 218709

SEQ ID NO: 748175 - RNA, 64 nt, Homo Sapiens; identical to SEQ ID NO: 218710

SEQ ID NO: 748176 - RNA, 64 nt, Homo Sapiens; identical to SEQ ID NO: 218711

SEQ ID NO: 748177 - RNA, 64 nt, Homo Sapiens; identical to SEQ ID NO: 218712

SEQ ID NO: 748178 - RNA, 64 nt, Homo Sapiens; identical to SEQ ID NO: 218713

SEQ ID NO: 748179 - RNA, 64 nt, Homo Sapiens; identical to SEQ ID NO: 218714

SEQ ID NO: 748180 - RNA, 64 nt, Homo Sapiens; identical to SEQ ID NO: 218715

SEQ ID NO: 748181 - RNA, 64 nt, Homo Sapiens; identical to SEQ ID NO: 218716

SEQ ID NO: 748182 - RNA, 64 nt, Homo Sapiens; identical to SEQ ID NO: 218717

SEQ ID NO: 748183 - RNA, 64 nt, Homo Sapiens; identical to SEQ ID NO: 218718

SEQ ID NO: 748184 - RNA, 64 nt, Homo Sapiens; identical to SEQ ID NO: 218719

SEQ ID NO: 748185 - RNA, 64 nt, Homo Sapiens; identical to SEQ ID NO: 218720

SEQ ID NO: 748186 - RNA, 64 nt, Homo Sapiens; identical to SEQ ID NO: 218721

SEQ ID NO: 748187 - RNA, 64 nt, Homo Sapiens; identical to SEQ ID NO: 218722

SEQ ID NO: 748188 - RNA, 64 nt, Homo Sapiens; identical to SEQ ID NO: 218723

SEQ ID NO: 748189 - RNA, 64 nt, Homo Sapiens; identical to SEQ ID NO: 218724

SEQ ID NO: 748190 - RNA, 64 nt, Homo Sapiens; identical to SEQ ID NO: 218725

SEQ ID NO: 748191 - RNA, 64 nt, Homo Sapiens; identical to SEQ ID NO: 218726

SEQ ID NO: 748192 - RNA, 64 nt, Homo Sapiens; identical to SEQ ID NO: 218727

SEQ ID NO: 748193 - RNA, 64 nt, Homo Sapiens; identical to SEQ ID NO: 218728

SEQ ID NO: 748194 - RNA, 64 nt, Homo Sapiens; identical to SEQ ID NO: 218729

SEQ ID NO: 748195 - RNA, 64 nt, Homo Sapiens; identical to SEQ ID NO: 218730

SEQ ID NO: 748196 - RNA, 64 nt, Homo Sapiens; identical to SEQ ID NO: 218731

SEQ ID NO: 748197 - RNA, 64 nt, Homo Sapiens; identical to SEQ ID NO: 218732

SEQ ID NO: 748198 - RNA, 64 nt, Homo Sapiens; identical to SEQ ID NO: 218733

SEQ ID NO: 748199 - RNA, 64 nt, Homo Sapiens; identical to SEQ ID NO: 218734

SEQ ID NO: 748200 - RNA, 64 nt, Homo Sapiens; identical to SEQ ID NO: 218735

SEQ ID NO: 748201 - RNA, 64 nt, Homo Sapiens; identical to SEQ ID NO: 218736

SEQ ID NO: 748202 - RNA, 64 nt, Homo Sapiens; identical to SEQ ID NO: 218737

SEQ ID NO: 748203 - RNA, 64 nt, Homo Sapiens; identical to SEQ ID NO: 218738

SEQ ID NO: 748204 - RNA, 64 nt, Homo Sapiens; identical to SEQ ID NO: 218739

SEQ ID NO: 748205 - RNA, 64 nt, Homo Sapiens; identical to SEQ ID NO: 218740

SEQ ID NO: 748206 - RNA, 64 nt, Homo Sapiens; identical to SEQ ID NO: 218741

SEQ ID NO: 748207 - RNA, 64 nt, Homo Sapiens; identical to SEQ ID NO: 218742

SEQ ID NO: 748208 - RNA, 64 nt, Homo Sapiens; identical to SEQ ID NO: 218743

SEQ ID NO: 748209 - RNA, 64 nt, Homo Sapiens; identical to SEQ ID NO: 218744

SEQ ID NO: 748210 - RNA, 64 nt, Homo Sapiens; identical to SEQ ID NO: 218745

SEQ ID NO: 748211 - RNA, 64 nt, Homo Sapiens; identical to SEQ ID NO: 218746

SEQ ID NO: 748212 - RNA, 64 nt, Homo Sapiens; identical to SEQ ID NO: 218747

SEQ ID NO: 748213 - RNA, 64 nt, Homo Sapiens; identical to SEQ ID NO: 218748

SEQ ID NO: 748214 - RNA, 64 nt, Homo Sapiens; identical to SEQ ID NO: 218749

SEQ ID NO: 748215 - RNA, 64 nt, Homo Sapiens; identical to SEQ ID NO: 218750

SEQ ID NO: 748216 - RNA, 64 nt, Homo Sapiens; identical to SEQ ID NO: 218751

SEQ ID NO: 748217 - RNA, 64 nt, Homo Sapiens; identical to SEQ ID NO: 218752

SEQ ID NO: 748218 - RNA, 64 nt, Homo Sapiens; identical to SEQ ID NO: 218753

SEQ ID NO: 748219 - RNA, 64 nt, Homo Sapiens; identical to SEQ ID NO: 218754

SEQ ID NO: 748220 - RNA, 64 nt, Homo Sapiens; identical to SEQ ID NO: 218755

SEQ ID NO: 748221 - RNA, 64 nt, Homo Sapiens; identical to SEQ ID NO: 218756

SEQ ID NO: 748222 - RNA, 64 nt, Homo Sapiens; identical to SEQ ID NO: 218757

SEQ ID NO: 748223 - RNA, 64 nt, Homo Sapiens; identical to SEQ ID NO: 218758

SEQ ID NO: 748224 - RNA, 64 nt, Homo Sapiens; identical to SEQ ID NO: 218759

SEQ ID NO: 748225 - RNA, 64 nt, Homo Sapiens; identical to SEQ ID NO: 218760

SEQ ID NO: 748226 - RNA, 64 nt, Homo Sapiens; identical to SEQ ID NO: 218761

SEQ ID NO: 748227 - RNA, 64 nt, Homo Sapiens; identical to SEQ ID NO: 218762

SEQ ID NO: 748228 - RNA, 64 nt, Homo Sapiens; identical to SEQ ID NO: 218763

SEQ ID NO: 748229 - RNA, 64 nt, Homo Sapiens; identical to SEQ ID NO: 218764

SEQ ID NO: 748230 - RNA, 64 nt, Homo Sapiens; identical to SEQ ID NO: 218765

SEQ ID NO: 748231 - RNA, 64 nt, Homo Sapiens; identical to SEQ ID NO: 218766

SEQ ID NO: 748232 - RNA, 64 nt, Homo Sapiens; identical to SEQ ID NO: 218767

SEQ ID NO: 748233 - RNA, 64 nt, Homo Sapiens; identical to SEQ ID NO: 218768

SEQ ID NO: 748234 - RNA, 64 nt, Homo Sapiens; identical to SEQ ID NO: 218769

SEQ ID NO: 748235 - RNA, 64 nt, Homo Sapiens; identical to SEQ ID NO: 218770

SEQ ID NO: 748236 - RNA, 64 nt, Homo Sapiens; identical to SEQ ID NO: 218771

SEQ ID NO: 748237 - RNA, 64 nt, Homo Sapiens; identical to SEQ ID NO: 218772

SEQ ID NO: 748238 - RNA, 64 nt, Homo Sapiens; identical to SEQ ID NO: 218773

SEQ ID NO: 748239 - RNA, 64 nt, Homo Sapiens; identical to SEQ ID NO: 218774

SEQ ID NO: 748240 - RNA, 64 nt, Homo Sapiens; identical to SEQ ID NO: 218775

SEQ ID NO: 748241 - RNA, 64 nt, Homo Sapiens; identical to SEQ ID NO: 218776

SEQ ID NO: 748242 - RNA, 64 nt, Homo Sapiens; identical to SEQ ID NO: 218777

SEQ ID NO: 748243 - RNA, 64 nt, Homo Sapiens; identical to SEQ ID NO: 218778

SEQ ID NO: 748244 - RNA, 64 nt, Homo Sapiens; identical to SEQ ID NO: 218779

SEQ ID NO: 748245 - RNA, 64 nt, Homo Sapiens; identical to SEQ ID NO: 218780

SEQ ID NO: 748246 - RNA, 64 nt, Homo Sapiens; identical to SEQ ID NO: 218781

SEQ ID NO: 748247 - RNA, 64 nt, Homo Sapiens; identical to SEQ ID NO: 218782

SEQ ID NO: 748248 - RNA, 64 nt, Homo Sapiens; identical to SEQ ID NO: 218783

SEQ ID NO: 748249 - RNA, 64 nt, Homo Sapiens; identical to SEQ ID NO: 218784

SEQ ID NO: 748250 - RNA, 64 nt, Homo Sapiens; identical to SEQ ID NO: 218785

SEQ ID NO: 748251 - RNA, 64 nt, Homo Sapiens; identical to SEQ ID NO: 218786

SEQ ID NO: 748252 - RNA, 64 nt, Homo Sapiens; identical to SEQ ID NO: 218787

SEQ ID NO: 748253 - RNA, 64 nt, Homo Sapiens; identical to SEQ ID NO: 218788

SEQ ID NO: 748254 - RNA, 64 nt, Homo Sapiens; identical to SEQ ID NO: 218789

SEQ ID NO: 748255 - RNA, 64 nt, Homo Sapiens; identical to SEQ ID NO: 218790

SEQ ID NO: 748256 - RNA, 64 nt, Homo Sapiens; identical to SEQ ID NO: 218791

SEQ ID NO: 748257 - RNA, 64 nt, Homo Sapiens; identical to SEQ ID NO: 218792

SEQ ID NO: 748258 - RNA, 64 nt, Homo Sapiens; identical to SEQ ID NO: 218793

SEQ ID NO: 748259 - RNA, 64 nt, Homo Sapiens; identical to SEQ ID NO: 218794

SEQ ID NO: 748260 - RNA, 64 nt, Homo Sapiens; identical to SEQ ID NO: 218795

SEQ ID NO: 748261 - RNA, 64 nt, Homo Sapiens; identical to SEQ ID NO: 218796

SEQ ID NO: 748262 - RNA, 64 nt, Homo Sapiens; identical to SEQ ID NO: 218797

SEQ ID NO: 748263 - RNA, 64 nt, Homo Sapiens; identical to SEQ ID NO: 218798

SEQ ID NO: 748264 - RNA, 64 nt, Homo Sapiens; identical to SEQ ID NO: 218799

SEQ ID NO: 748265 - RNA, 64 nt, Homo Sapiens; identical to SEQ ID NO: 218800

SEQ ID NO: 748266 - RNA, 64 nt, Homo Sapiens; identical to SEQ ID NO: 218801

SEQ ID NO: 748267 - RNA, 64 nt, Homo Sapiens; identical to SEQ ID NO: 218802

SEQ ID NO: 748268 - RNA, 64 nt, Homo Sapiens; identical to SEQ ID NO: 218803

SEQ ID NO: 748269 - RNA, 64 nt, Homo Sapiens; identical to SEQ ID NO: 218804

SEQ ID NO: 748270 - RNA, 64 nt, Homo Sapiens; identical to SEQ ID NO: 218805

SEQ ID NO: 748271 - RNA, 64 nt, Homo Sapiens; identical to SEQ ID NO: 218806

SEQ ID NO: 748272 - RNA, 64 nt, Homo Sapiens; identical to SEQ ID NO: 218807

SEQ ID NO: 748273 - RNA, 64 nt, Homo Sapiens; identical to SEQ ID NO: 218808

SEQ ID NO: 748274 - RNA, 59 nt, Homo Sapiens; identical to SEQ ID NO: 218809

SEQ ID NO: 748275 - RNA, 64 nt, Homo Sapiens; identical to SEQ ID NO: 218810

SEQ ID NO: 748276 - RNA, 64 nt, Homo Sapiens; identical to SEQ ID NO: 218811

SEQ ID NO: 748277 - RNA, 64 nt, Homo Sapiens; identical to SEQ ID NO: 570585

SEQ ID NO: 748278 - RNA, 64 nt, Homo Sapiens; identical to SEQ ID NO: 570586

SEQ ID NO: 748279 - RNA, 64 nt, Homo Sapiens; identical to SEQ ID NO: 570587

SEQ ID NO: 748280 - RNA, 64 nt, Homo Sapiens; identical to SEQ ID NO: 570588

SEQ ID NO: 748281 - RNA, 64 nt, Homo Sapiens; identical to SEQ ID NO: 570589

SEQ ID NO: 748282 - RNA, 64 nt, Homo Sapiens; identical to SEQ ID NO: 570590

SEQ ID NO: 748283 - RNA, 64 nt, Homo Sapiens; identical to SEQ ID NO: 570591

SEQ ID NO: 748284 - RNA, 64 nt, Homo Sapiens; identical to SEQ ID NO: 570592

SEQ ID NO: 748285 - RNA, 64 nt, Homo Sapiens; identical to SEQ ID NO: 570593

SEQ ID NO: 748286 - RNA, 64 nt, Homo Sapiens; identical to SEQ ID NO: 76092

SEQ ID NO: 748287 - RNA, 64 nt, Homo Sapiens; identical to SEQ ID NO: 76093

SEQ ID NO: 748288 - RNA, 64 nt, Homo Sapiens; identical to SEQ ID NO: 76094

SEQ ID NO: 748289 - RNA, 64 nt, Homo Sapiens; identical to SEQ ID NO: 76095

SEQ ID NO: 748290 - RNA, 64 nt, Homo Sapiens; identical to SEQ ID NO: 76096

SEQ ID NO: 748291 - RNA, 64 nt, Homo Sapiens; identical to SEQ ID NO: 76097

SEQ ID NO: 748292 - RNA, 64 nt, Homo Sapiens; identical to SEQ ID NO: 76098

SEQ ID NO: 748293 - RNA, 64 nt, Homo Sapiens; identical to SEQ ID NO: 76099

SEQ ID NO: 748294 - RNA, 64 nt, Homo Sapiens; identical to SEQ ID NO: 76100

SEQ ID NO: 748295 - RNA, 64 nt, Homo Sapiens; identical to SEQ ID NO: 76101

SEQ ID NO: 748296 - RNA, 64 nt, Homo Sapiens; identical to SEQ ID NO: 76102

SEQ ID NO: 748297 - RNA, 64 nt, Homo Sapiens; identical to SEQ ID NO: 76103

SEQ ID NO: 748298 - RNA, 53 nt, Homo Sapiens; identical to SEQ ID NO: 76104

SEQ ID NO: 748299 - RNA, 64 nt, Homo Sapiens; identical to SEQ ID NO: 76105

SEQ ID NO: 748300 - RNA, 64 nt, Homo Sapiens; identical to SEQ ID NO: 76106

SEQ ID NO: 748301 - RNA, 64 nt, Homo Sapiens; identical to SEQ ID NO: 76107

SEQ ID NO: 748302 - RNA, 64 nt, Homo Sapiens; identical to SEQ ID NO: 76108

SEQ ID NO: 748303 - RNA, 64 nt, Homo Sapiens; identical to SEQ ID NO: 76109

SEQ ID NO: 748304 - RNA, 64 nt, Homo Sapiens; identical to SEQ ID NO: 76110

SEQ ID NO: 748305 - RNA, 64 nt, Homo Sapiens; identical to SEQ ID NO: 76111

SEQ ID NO: 748306 - RNA, 64 nt, Homo Sapiens; identical to SEQ ID NO: 38562

SEQ ID NO: 748307 - RNA, 64 nt, Homo Sapiens; identical to SEQ ID NO: 38563

SEQ ID NO: 748308 - RNA, 64 nt, Homo Sapiens; identical to SEQ ID NO: 38564

SEQ ID NO: 748309 - RNA, 64 nt, Homo Sapiens; identical to SEQ ID NO: 38565

SEQ ID NO: 748310 - RNA, 64 nt, Homo Sapiens; identical to SEQ ID NO: 38566

SEQ ID NO: 748311 - RNA, 64 nt, Homo Sapiens; identical to SEQ ID NO: 38567

SEQ ID NO: 748312 - RNA, 64 nt, Homo Sapiens; identical to SEQ ID NO: 38568

SEQ ID NO: 748313 - RNA, 64 nt, Homo Sapiens; identical to SEQ ID NO: 38569

SEQ ID NO: 748314 - RNA, 64 nt, Homo Sapiens; identical to SEQ ID NO: 38570

SEQ ID NO: 748315 - RNA, 64 nt, Homo Sapiens; identical to SEQ ID NO: 38571

SEQ ID NO: 748316 - RNA, 64 nt, Homo Sapiens; identical to SEQ ID NO: 38572

SEQ ID NO: 748317 - RNA, 64 nt, Homo Sapiens; identical to SEQ ID NO: 38573

SEQ ID NO: 748318 - RNA, 64 nt, Homo Sapiens; identical to SEQ ID NO: 38574

SEQ ID NO: 748319 - RNA, 64 nt, Homo Sapiens; identical to SEQ ID NO: 38575

SEQ ID NO: 748320 - RNA, 64 nt, Homo Sapiens; identical to SEQ ID NO: 38576

SEQ ID NO: 748321 - RNA, 64 nt, Homo Sapiens; identical to SEQ ID NO: 38577

SEQ ID NO: 748322 - RNA, 64 nt, Homo Sapiens; identical to SEQ ID NO: 38578

SEQ ID NO: 748323 - RNA, 64 nt, Homo Sapiens; identical to SEQ ID NO: 38579

SEQ ID NO: 748324 - RNA, 64 nt, Homo Sapiens; identical to SEQ ID NO: 38580

SEQ ID NO: 748325 - RNA, 64 nt, Homo Sapiens; identical to SEQ ID NO: 38581

SEQ ID NO: 748326 - RNA, 64 nt, Homo Sapiens; identical to SEQ ID NO: 38582

SEQ ID NO: 748327 - RNA, 64 nt, Homo Sapiens; identical to SEQ ID NO: 38583

SEQ ID NO: 748328 - RNA, 64 nt, Homo Sapiens; identical to SEQ ID NO: 38584

SEQ ID NO: 748329 - RNA, 64 nt, Homo Sapiens; identical to SEQ ID NO: 38585

SEQ ID NO: 748330 - RNA, 64 nt, Homo Sapiens; identical to SEQ ID NO: 38586

SEQ ID NO: 748331 - RNA, 64 nt, Homo Sapiens; identical to SEQ ID NO: 38587

SEQ ID NO: 748332 - RNA, 64 nt, Homo Sapiens; identical to SEQ ID NO: 38588

SEQ ID NO: 748333 - RNA, 64 nt, Homo Sapiens; identical to SEQ ID NO: 38589

SEQ ID NO: 748334 - RNA, 64 nt, Homo Sapiens; identical to SEQ ID NO: 38590

SEQ ID NO: 748335 - RNA, 64 nt, Homo Sapiens; identical to SEQ ID NO: 38591

SEQ ID NO: 748336 - RNA, 64 nt, Homo Sapiens; identical to SEQ ID NO: 38592

SEQ ID NO: 748337 - RNA, 64 nt, Homo Sapiens; identical to SEQ ID NO: 38593

SEQ ID NO: 748338 - RNA, 64 nt, Homo Sapiens; identical to SEQ ID NO: 120942

SEQ ID NO: 748339 - RNA, 64 nt, Homo Sapiens; identical to SEQ ID NO: 120943

SEQ ID NO: 748340 - RNA, 64 nt, Homo Sapiens; identical to SEQ ID NO: 120944

SEQ ID NO: 748341 - RNA, 64 nt, Homo Sapiens; identical to SEQ ID NO: 120945

SEQ ID NO: 748342 - RNA, 64 nt, Homo Sapiens; identical to SEQ ID NO: 120946

SEQ ID NO: 748343 - RNA, 64 nt, Homo Sapiens; identical to SEQ ID NO: 120947

SEQ ID NO: 748344 - RNA, 64 nt, Homo Sapiens; identical to SEQ ID NO: 120948

SEQ ID NO: 748345 - RNA, 64 nt, Homo Sapiens; identical to SEQ ID NO: 120949

SEQ ID NO: 748346 - RNA, 64 nt, Homo Sapiens; identical to SEQ ID NO: 120950

SEQ ID NO: 748347 - RNA, 64 nt, Homo Sapiens; identical to SEQ ID NO: 120951

SEQ ID NO: 748348 - RNA, 64 nt, Homo Sapiens; identical to SEQ ID NO: 120952

SEQ ID NO: 748349 - RNA, 64 nt, Homo Sapiens; identical to SEQ ID NO: 120953

SEQ ID NO: 748350 - RNA, 64 nt, Homo Sapiens; identical to SEQ ID NO: 120954

SEQ ID NO: 748351 - RNA, 64 nt, Homo Sapiens; identical to SEQ ID NO: 120955

SEQ ID NO: 748352 - RNA, 64 nt, Homo Sapiens; identical to SEQ ID NO: 120956

SEQ ID NO: 748353 - RNA, 64 nt, Homo Sapiens; identical to SEQ ID NO: 120957

SEQ ID NO: 748354 - RNA, 64 nt, Homo Sapiens; identical to SEQ ID NO: 120958

SEQ ID NO: 748355 - RNA, 64 nt, Homo Sapiens; identical to SEQ ID NO: 120959

SEQ ID NO: 748356 - RNA, 64 nt, Homo Sapiens; identical to SEQ ID NO: 120960

SEQ ID NO: 748357 - RNA, 64 nt, Homo Sapiens; identical to SEQ ID NO: 120961

SEQ ID NO: 748358 - RNA, 64 nt, Homo Sapiens; identical to SEQ ID NO: 120962

SEQ ID NO: 748359 - RNA, 64 nt, Homo Sapiens; identical to SEQ ID NO: 120963

SEQ ID NO: 748360 - RNA, 64 nt, Homo Sapiens; identical to SEQ ID NO: 120964

SEQ ID NO: 748361 - RNA, 62 nt, Homo Sapiens; identical to SEQ ID NO: 120965

SEQ ID NO: 748362 - RNA, 64 nt, Homo Sapiens; identical to SEQ ID NO: 120966

SEQ ID NO: 748363 - RNA, 64 nt, Homo Sapiens; identical to SEQ ID NO: 120967

SEQ ID NO: 748364 - RNA, 64 nt, Homo Sapiens; identical to SEQ ID NO: 120968

SEQ ID NO: 748365 - RNA, 64 nt, Homo Sapiens; identical to SEQ ID NO: 120969

SEQ ID NO: 748366 - RNA, 64 nt, Homo Sapiens; identical to SEQ ID NO: 120970

SEQ ID NO: 748367 - RNA, 64 nt, Homo Sapiens; identical to SEQ ID NO: 120971

SEQ ID NO: 748368 - RNA, 64 nt, Homo Sapiens
gggccuuccuugagaccuuccaggagcaugggccacuguccaugcccaggcaccagacuuaccc

SEQ ID NO: 748369 - RNA, 64 nt, Homo Sapiens
auguccuuuuucacacagagccuuccuucuguccacuguccagaggugccauacuugguguaag

SEQ ID NO: 748370 - RNA, 64 nt, Homo Sapiens
guagggucauccgcaaagccucuauccugcccccacuguccacuucuuuucucauguccagagu

SEQ ID NO: 748371 - RNA, 64 nt, Homo Sapiens
auuugguuuuauaauguuuguuaaaggaguaaagacuguccagcauguuggaauauuuggaauu

SEQ ID NO: 748372 - RNA, 64 nt, Homo Sapiens
agacauaggaagccucuguuuacccugaagcaccacuguccagcccauugguucccacuggcag

SEQ ID NO: 748373 - RNA, 64 nt, Homo Sapiens
ggucagugaaggucugggguagggaaacauucagacuguccauugcauggcuguggagugagac

SEQ ID NO: 748374 - RNA, 64 nt, Homo Sapiens
uuacacuagcuuucugcauuuaauagguuagaauguaaauuaaaguguagcaauagcaacaaaa

SEQ ID NO: 748375 - RNA, 64 nt, Homo Sapiens
aaaaauugagccuugggacgugcccauuuuuacuguaaauuaugauuccguaacugacuuguag

SEQ ID NO: 748376 - RNA, 64 nt, Homo Sapiens
gcucuguuauuucuucaucugcuggggggaaaaaguaaauuacaaacaaacaaacaaagcagaa

SEQ ID NO: 748377 - RNA, 64 nt, Homo Sapiens
uuaggguauaaagaucucauaagaaauguaauauguaaauuauaucuugcuuuauguuguaaaa

SEQ ID NO: 748378 - RNA, 64 nt, Homo Sapiens
gugcuguugcuaugcagugugaucuuuauuuauaguaaauuauguuucauguaaaugauauauu

SEQ ID NO: 748379 - RNA, 64 nt, Homo Sapiens
guuuacucauggauuuuagcuauuuuuucacuggguaaauuauacuacauuuauuuacaaauga

SEQ ID NO: 748380 - RNA, 64 nt, Homo Sapiens
gugaaaccuggcccagcuugauuauauaugaaaaguaaauuaauuauuuauuuucauuuucugu

SEQ ID NO: 748381 - RNA, 64 nt, Homo Sapiens
gccuugguguauuaauaauaaaccuaaugacuugguaaauuauuuagacacuuucauaugguuc

SEQ ID NO: 748382 - RNA, 64 nt, Homo Sapiens
ugaacaccacugugauucuccaaggacgaauuacguaaauuauacuuucauacaaaggagacga

SEQ ID NO: 748383 - RNA, 64 nt, Homo Sapiens
gaucuaaaacuacuagaucucaucccauucccauguaaauuaccacagaccgcaguaccggggc

SEQ ID NO: 748384 - RNA, 64 nt, Homo Sapiens
auaugaaacauagauaaaacaucuuugaaauuauguaaauuauguaaauuaucaggcaaauuug

SEQ ID NO: 748385 - RNA, 64 nt, Homo Sapiens
auagauaaaacaucuuugaaauuauguaaauuauguaaauuaucaggcaaauuugcauuaaauu

SEQ ID NO: 748386 - RNA, 64 nt, Homo Sapiens
uagaagaaauauauuuauaaugaaaagagacguaguaaauuaaaacgaacauauuuauugguac

SEQ ID NO: 748387 - RNA, 64 nt, Homo Sapiens
aauagugauguucuuuugcaagccuuguacaaauguaaauuacuaaugaucuguguuuaucauu

SEQ ID NO: 748388 - RNA, 64 nt, Homo Sapiens
ccaguucaccuuuauuuuacguuuuauucagucuguaaauuaacuggcccuuugcaguaacuug

SEQ ID NO: 748389 - RNA, 64 nt, Homo Sapiens
agaguaaaugcauuucuggaguuguuucugugauguaaauuaugaucauuauuuaagaagucaa

SEQ ID NO: 748390 - RNA, 64 nt, Homo Sapiens
aguuuagauuugaauuccagcuaugugacauuggguaaauuaguaguaguccugagccucagcg

SEQ ID NO: 748391 - RNA, 64 nt, Homo Sapiens
ucagagaaagaaaauauaauuuaacuuuaaagauguaaauuauauauauaguauauuauauaua

SEQ ID NO: 748392 - RNA, 64 nt, Homo Sapiens
cuuagugaauuauuuucuaagguuuacuacuucaguaaauuauucaacuauaaagcacuauguu

SEQ ID NO: 748393 - RNA, 64 nt, Homo Sapiens
auucuggauuuaauuaguagcugguucaaucuuaguaaauuaacuccucccccccucucauuuu

SEQ ID NO: 748394 - RNA, 64 nt, Homo Sapiens
aaauguguguguaguuauagcaauuaaacauuggguaaauuauuuauuaaaugaauucauuacu

SEQ ID NO: 748395 - RNA, 64 nt, Homo Sapiens
uuucacccuauuuaaacauaaauaugaaauuaaaguaaauuaaaauuguuuuuaacauuaaaca

SEQ ID NO: 748396 - RNA, 64 nt, Homo Sapiens
aaaccuaaaauuaguaucagauuggcuauuuaagguaaauuauauuaacuuuuaauacccauuu

SEQ ID NO: 748397 - RNA, 64 nt, Homo Sapiens
cuuaacucuuuagccuuuauugacaggcauaaaaguaaauuaccuuaaaaaauguaugucaggg

SEQ ID NO: 748398 - RNA, 64 nt, Homo Sapiens
caucacuuuuguuuuaaaguagcaugugccucugguaaauuaucaaaaacagcuuuacuucaaa

SEQ ID NO: 748399 - RNA, 64 nt, Homo Sapiens
aguuguuuaauuuacuuggcuuaauuuacacuuaguaaauuaaaauguuuuucauuugauacuu

SEQ ID NO: 748400 - RNA, 64 nt, Homo Sapiens
acagaaagguuccuuucaaaguuacucacagcuuguaaauuacauuggaaacaaugauauagca

SEQ ID NO: 748401 - RNA, 64 nt, Homo Sapiens
uuuaaugauuugagugcauguuuauaaagugcugguaaauuauuuuuuauguuauaaacuugaa

SEQ ID NO: 748402 - RNA, 64 nt, Homo Sapiens; identical to SEQ ID NO: 48305

SEQ ID NO: 748403 - RNA, 64 nt, Homo Sapiens; identical to SEQ ID NO: 48306

SEQ ID NO: 748404 - RNA, 64 nt, Homo Sapiens; identical to SEQ ID NO: 48307

SEQ ID NO: 748405 - RNA, 64 nt, Homo Sapiens; identical to SEQ ID NO: 48308

SEQ ID NO: 748406 - RNA, 64 nt, Homo Sapiens; identical to SEQ ID NO: 48309

SEQ ID NO: 748407 - RNA, 64 nt, Homo Sapiens; identical to SEQ ID NO: 48310

SEQ ID NO: 748408 - RNA, 64 nt, Homo Sapiens; identical to SEQ ID NO: 48311

SEQ ID NO: 748409 - RNA, 64 nt, Homo Sapiens; identical to SEQ ID NO: 48312

SEQ ID NO: 748410 - RNA, 64 nt, Homo Sapiens; identical to SEQ ID NO: 48313

SEQ ID NO: 748411 - RNA, 64 nt, Homo Sapiens; identical to SEQ ID NO: 48314

SEQ ID NO: 748412 - RNA, 64 nt, Homo Sapiens; identical to SEQ ID NO: 48315

SEQ ID NO: 748413 - RNA, 64 nt, Homo Sapiens; identical to SEQ ID NO: 48316

SEQ ID NO: 748414 - RNA, 64 nt, Homo Sapiens; identical to SEQ ID NO: 48317

SEQ ID NO: 748415 - RNA, 64 nt, Homo Sapiens; identical to SEQ ID NO: 48318

SEQ ID NO: 748416 - RNA, 64 nt, Homo Sapiens; identical to SEQ ID NO: 48319

SEQ ID NO: 748417 - RNA, 64 nt, Homo Sapiens; identical to SEQ ID NO: 48320

SEQ ID NO: 748418 - RNA, 64 nt, Homo Sapiens; identical to SEQ ID NO: 48321

SEQ ID NO: 748419 - RNA, 64 nt, Homo Sapiens; identical to SEQ ID NO: 48322

SEQ ID NO: 748420 - RNA, 64 nt, Homo Sapiens; identical to SEQ ID NO: 48323

SEQ ID NO: 748421 - RNA, 64 nt, Homo Sapiens; identical to SEQ ID NO: 48324

SEQ ID NO: 748422 - RNA, 64 nt, Homo Sapiens; identical to SEQ ID NO: 48325

SEQ ID NO: 748423 - RNA, 64 nt, Homo Sapiens; identical to SEQ ID NO: 48326

SEQ ID NO: 748424 - RNA, 64 nt, Homo Sapiens; identical to SEQ ID NO: 48327

SEQ ID NO: 748425 - RNA, 64 nt, Homo Sapiens; identical to SEQ ID NO: 48328

SEQ ID NO: 748426 - RNA, 64 nt, Homo Sapiens; identical to SEQ ID NO: 48329

SEQ ID NO: 748427 - RNA, 51 nt, Homo Sapiens; identical to SEQ ID NO: 48330

SEQ ID NO: 748428 - RNA, 64 nt, Homo Sapiens; identical to SEQ ID NO: 48331

SEQ ID NO: 748429 - RNA, 64 nt, Homo Sapiens; identical to SEQ ID NO: 48332

SEQ ID NO: 748430 - RNA, 64 nt, Homo Sapiens; identical to SEQ ID NO: 48333

SEQ ID NO: 748431 - RNA, 64 nt, Homo Sapiens; identical to SEQ ID NO: 48334

SEQ ID NO: 748432 - RNA, 64 nt, Homo Sapiens; identical to SEQ ID NO: 48335

SEQ ID NO: 748433 - RNA, 64 nt, Homo Sapiens; identical to SEQ ID NO: 48336

SEQ ID NO: 748434 - RNA, 64 nt, Homo Sapiens; identical to SEQ ID NO: 48337

SEQ ID NO: 748435 - RNA, 64 nt, Homo Sapiens; identical to SEQ ID NO: 48338

SEQ ID NO: 748436 - RNA, 64 nt, Homo Sapiens; identical to SEQ ID NO: 48339

SEQ ID NO: 748437 - RNA, 64 nt, Homo Sapiens; identical to SEQ ID NO: 48340

SEQ ID NO: 748438 - RNA, 64 nt, Homo Sapiens; identical to SEQ ID NO: 48341

SEQ ID NO: 748439 - RNA, 64 nt, Homo Sapiens; identical to SEQ ID NO: 48342

SEQ ID NO: 748440 - RNA, 64 nt, Homo Sapiens; identical to SEQ ID NO: 48343

SEQ ID NO: 748441 - RNA, 64 nt, Homo Sapiens; identical to SEQ ID NO: 48344

SEQ ID NO: 748442 - RNA, 64 nt, Homo Sapiens; identical to SEQ ID NO: 48345

SEQ ID NO: 748443 - RNA, 64 nt, Homo Sapiens; identical to SEQ ID NO: 48346

SEQ ID NO: 748444 - RNA, 64 nt, Homo Sapiens; identical to SEQ ID NO: 48347

SEQ ID NO: 748445 - RNA, 64 nt, Homo Sapiens; identical to SEQ ID NO: 48348

SEQ ID NO: 748446 - RNA, 64 nt, Homo Sapiens; identical to SEQ ID NO: 48349

SEQ ID NO: 748447 - RNA, 64 nt, Homo Sapiens; identical to SEQ ID NO: 245118

SEQ ID NO: 748448 - RNA, 64 nt, Homo Sapiens; identical to SEQ ID NO: 245119

SEQ ID NO: 748449 - RNA, 64 nt, Homo Sapiens; identical to SEQ ID NO: 245120

SEQ ID NO: 748450 - RNA, 64 nt, Homo Sapiens; identical to SEQ ID NO: 245121

SEQ ID NO: 748451 - RNA, 64 nt, Homo Sapiens; identical to SEQ ID NO: 245122

SEQ ID NO: 748452 - RNA, 64 nt, Homo Sapiens; identical to SEQ ID NO: 245123

SEQ ID NO: 748453 - RNA, 64 nt, Homo Sapiens; identical to SEQ ID NO: 245124

SEQ ID NO: 748454 - RNA, 64 nt, Homo Sapiens; identical to SEQ ID NO: 245125

SEQ ID NO: 748455 - RNA, 64 nt, Homo Sapiens
cugcgccgcgcgggcaggcaccugugcgaccugugccccggaccugcggcgccgcccucgagcg

SEQ ID NO: 748456 - RNA, 64 nt, Homo Sapiens
cgccccccaccccagcgcugucugugggucccuugccccggagcugacucgccuccagugaguc

SEQ ID NO: 748457 - RNA, 64 nt, Homo Sapiens
caccacgcccuccccgcgcgccggcucaggggcugccccggaaucagcuccccggggccgccgc

SEQ ID NO: 748458 - RNA, 64 nt, Homo Sapiens
gaggcugggaggccgcucggggcccagcgugccagccccggaguucagccucccgagcugcggc

SEQ ID NO: 748459 - RNA, 64 nt, Homo Sapiens
ccuauauuaaggccacggagcucgcuggccccgcgccccggagccccggcgcgccugguagagc

SEQ ID NO: 748460 - RNA, 64 nt, Homo Sapiens
cccacuccgcggagggcacgguguguucccacgggccccggaggcgggauggcgcggguggugu

SEQ ID NO: 748461 - RNA, 57 nt, Homo Sapiens
cccgcgagacgcuguacuaggcugugcgccccggaacguguccaggaggagccuggc

SEQ ID NO: 748462 - RNA, 64 nt, Homo Sapiens
ucguaucacuagcuugcggccaggucaugauguggccccggaagcuggcccugcgugccaugag

SEQ ID NO: 748463 - RNA, 64 nt, Homo Sapiens; identical to SEQ ID NO: 134735

SEQ ID NO: 748464 - RNA, 64 nt, Homo Sapiens; identical to SEQ ID NO: 134736

SEQ ID NO: 748465 - RNA, 64 nt, Homo Sapiens; identical to SEQ ID NO: 134737

SEQ ID NO: 748466 - RNA, 64 nt, Homo Sapiens; identical to SEQ ID NO: 134738

SEQ ID NO: 748467 - RNA, 64 nt, Homo Sapiens; identical to SEQ ID NO: 134739

SEQ ID NO: 748468 - RNA, 64 nt, Homo Sapiens; identical to SEQ ID NO: 134740

SEQ ID NO: 748469 - RNA, 64 nt, Homo Sapiens; identical to SEQ ID NO: 134741

SEQ ID NO: 748470 - RNA, 64 nt, Homo Sapiens; identical to SEQ ID NO: 134742

SEQ ID NO: 748471 - RNA, 64 nt, Homo Sapiens; identical to SEQ ID NO: 134743

SEQ ID NO: 748472 - RNA, 64 nt, Homo Sapiens; identical to SEQ ID NO: 134744

SEQ ID NO: 748473 - RNA, 64 nt, Homo Sapiens; identical to SEQ ID NO: 134745

SEQ ID NO: 748474 - RNA, 64 nt, Homo Sapiens; identical to SEQ ID NO: 134746

SEQ ID NO: 748475 - RNA, 64 nt, Homo Sapiens; identical to SEQ ID NO: 134747

SEQ ID NO: 748476 - RNA, 64 nt, Homo Sapiens; identical to SEQ ID NO: 134748

SEQ ID NO: 748477 - RNA, 64 nt, Homo Sapiens; identical to SEQ ID NO: 134749

SEQ ID NO: 748478 - RNA, 64 nt, Homo Sapiens; identical to SEQ ID NO: 134750

SEQ ID NO: 748479 - RNA, 64 nt, Homo Sapiens; identical to SEQ ID NO: 134751

SEQ ID NO: 748480 - RNA, 64 nt, Homo Sapiens; identical to SEQ ID NO: 134752

SEQ ID NO: 748481 - RNA, 64 nt, Homo Sapiens; identical to SEQ ID NO: 134753

SEQ ID NO: 748482 - RNA, 64 nt, Homo Sapiens; identical to SEQ ID NO: 134754

SEQ ID NO: 748483 - RNA, 64 nt, Homo Sapiens
uaaugauguuagauaauacucaacaugauucaguaugacaaacuuuuuugagcaccuacuuuau

SEQ ID NO: 748484 - RNA, 64 nt, Homo Sapiens
acaaacuuuuuugagcaccuacuuuauauaaaacaugacaaauugcagugugauguaaucaaaa

SEQ ID NO: 748485 - RNA, 64 nt, Homo Sapiens
uaaaaaaaaaaaaaaaaaagggcagccuucuuaaaugacaaaugaugaauuaugaauaccgcag

SEQ ID NO: 748486 - RNA, 64 nt, Homo Sapiens
uaaacaguucaagugaagcauguugcaauguugaaugacaaaaaaagaauccauuugaagacaa

SEQ ID NO: 748487 - RNA, 64 nt, Homo Sapiens
cgcucugucacccaggcuggaguaugagauacuuaugacaaacuuaaguagccuuaugacaaac

SEQ ID NO: 748488 - RNA, 64 nt, Homo Sapiens
guaugagauacuuaugacaacauuaaguagccuuaugacaaacaucuacauaaaucuagauacu

SEQ ID NO: 748489 - RNA, 64 nt, Homo Sapiens
caaaaagcauacaagcaaccuggucauacauaggaugacaaaauucuuucugguuguuuuuaaa

SEQ ID NO: 748490 - RNA, 64 nt, Homo Sapiens
aacaguauaaaacagcccuauuucuugauaaaaaaugacaaaugacugucucuugcggaugcuu

SEQ ID NO: 748491 - RNA, 64 nt, Homo Sapiens
uuuuuagaacauagaguggcauggccgugcuggaaugacaaauaacuggcgugcuuuuuuuuug

SEQ ID NO: 748492 - RNA, 64 nt, Homo Sapiens
gguaaggcuaacuccugaucguuucuguagaaagaugacaaauaaagaaaaaguuauaauuauu

SEQ ID NO: 748493 - RNA, 64 nt, Homo Sapiens
uucaacucagacuaguuuaguuuuugguuugcagaugacaaaaaacugcaaaugucaucagaac

SEQ ID NO: 748494 - RNA, 64 nt, Homo Sapiens
guagacauuucucuuacugcauugaacucuuugaaugacaaagaaaaauuugaagaaugaacaa

SEQ ID NO: 748495 - RNA, 64 nt, Homo Sapiens
gaaccauauguaaguaaucuuugguuccaggauaaugacaaauuagggcucaaacuacucucua

SEQ ID NO: 748496 - RNA, 64 nt, Homo Sapiens
caguuuggagacagaaaaagcagcaguuucaaaaaugacaaaguuccauugagaggaauguuua

SEQ ID NO: 748497 - RNA, 64 nt, Homo Sapiens
ugauguuuacaggccugcuucucuguuucagccuaugacaaaaugaguaaaauccauuuccuuu

SEQ ID NO: 748498 - RNA, 64 nt, Homo Sapiens
uugccagaguuggggcauugcacccacucugaacaugacaaaaguuuccucuuuuccccgccug

SEQ ID NO: 748499 - RNA, 64 nt, Homo Sapiens
acugcuauuagacaauugaagaccugagaccuuaaugacaaaucuagauuuuaaauguauuauu

SEQ ID NO: 748500 - RNA, 64 nt, Homo Sapiens
uguguagcuguguucaauuuugaguagagcaaaaaugacaaagauaaacuuuuucagaaagaau

SEQ ID NO: 748501 - RNA, 64 nt, Homo Sapiens
acuuccccuacccugccccuccccaaaagaaaccaugacaaaccuagcuuuuaaaaaauauuuu

SEQ ID NO: 748502 - RNA, 64 nt, Homo Sapiens
uuuucccuuuuuaaaaaauaccauugaaaucagcaugacaaaaauaacacuguuggcacuuaua

SEQ ID NO: 748503 - RNA, 64 nt, Homo Sapiens
acagcaguguuuugagggagcuaggaggagcuaaaugacaaaacuucugguauuuaaaaaauau

SEQ ID NO: 748504 - RNA, 64 nt, Homo Sapiens
ugacuuuaaaaaaaaucuuugaaaaugggaagcgaugacaaauccgugguacucugaagcacuu

SEQ ID NO: 748505 - RNA, 64 nt, Homo Sapiens
gaaggaacauaccucaaaauaauaagagccaucuaugacaaaaccacagccaacaucauacuga

SEQ ID NO: 748506 - RNA, 64 nt, Homo Sapiens
uaccauucuggacauaggaacggaaaaagauuucaugacaaagaucccaaaaauaauuguaacg

SEQ ID NO: 748507 - RNA, 64 nt, Homo Sapiens
gaggggcauucacaaggcacaccagugcaagcagaugacaaaaaggugcagaaggcaaucuuaa

SEQ ID NO: 748508 - RNA, 64 nt, Homo Sapiens
aucggcucucauucgaucgagcuauucucuuaaaaugacaaaaaguguccauaaagaggcugcu

SEQ ID NO: 748509 - RNA, 64 nt, Homo Sapiens
cauaauaaaacuuggcagauucuacaagucuauuaugacaaaccaggaacuaauucuauaaugg

SEQ ID NO: 748510 - RNA, 64 nt, Homo Sapiens
aggaacuacuugaaauaguaauuuguuaaaagauaugacaaaaugaaaaugcuuaaacuacaga

SEQ ID NO: 748511 - RNA, 63 nt, Homo Sapiens
ggggagaggggcaaaugccuccgggacugacacuccaggcagcuuugccuucucuccccuguc

SEQ ID NO: 748512 - RNA, 63 nt, Homo Sapiens
cuguccccucuccuggggcuuaaguggguugcuuccaggcagaagcagccaaggaccgauucc

SEQ ID NO: 748513 - RNA, 63 nt, Homo Sapiens
guugcuuccaggcagaagcagccaaggaccgauuccaggcacuuucuguagcaaaugacugug

SEQ ID NO: 748514 - RNA, 63 nt, Homo Sapiens
ggcucagggugaauuacaagacuuucuccugccuccaggcauucaggcaccagagccuugagu

SEQ ID NO: 748515 - RNA, 63 nt, Homo Sapiens
agagccuugaguacuuucuccaggucuuguggcuccaggcaccugaagccuagacaaagccgc

SEQ ID NO: 748516 - RNA, 63 nt, Homo Sapiens
auccccaggugcugaaauggcuuuccaccucucuccaggcauuggagguguguggaaggcacu

SEQ ID NO: 748517 - RNA, 63 nt, Homo Sapiens
caccugccucugcuugcuuucagagccaucugcuccaggcaccugccccacugcugcccucug

SEQ ID NO: 748518 - RNA, 63 nt, Homo Sapiens
aaaucuuuaagugcacgauauaguauuguuaauuccaggcaccauguuguacaacagaucuuu

SEQ ID NO: 748519 - RNA, 63 nt, Homo Sapiens
gcugaggugggagaaucuccugagccuggaagguccaggcagugagccaagauugugccacca

SEQ ID NO: 748520 - RNA, 63 nt, Homo Sapiens
uaaacucaaaucuuugucaccaaacccaaguuguccaggcaaaaaaagaaaacaaaagccaga

SEQ ID NO: 748521 - RNA, 63 nt, Homo Sapiens
acaaaacuccuuuauucaaaagaaauucauauauccaggcaacaaccaacagaaguuauuuac

SEQ ID NO: 748522 - RNA, 63 nt, Homo Sapiens
ucuggaaguuauuacagggccagcuugccauauuccaggcacacguuaucaaguuugggccua

SEQ ID NO: 748523 - RNA, 63 nt, Homo Sapiens
ucccuuccauaauuccccucauccaccgcccacuccaggcacucacucaaacuugcucuucaa

SEQ ID NO: 748524 - RNA, 63 nt, Homo Sapiens
uuuuacaaaacgaaugcucuaaauucugaggauuccaggcaggccauccauagagaaauaacu

SEQ ID NO: 748525 - RNA, 63 nt, Homo Sapiens
gcaggaaguuccaagggauguauguuuauagcauccaggcaaugaucuuuuuuuuuccacgaa

SEQ ID NO: 748526 - RNA, 63 nt, Homo Sapiens
uugccgggcucggggccccacaugccgugaagauccaggcaucuggagcuggacagcacacgc

SEQ ID NO: 748527 - RNA, 63 nt, Homo Sapiens
caaggugaccagccagcugacagcuggcuggaguccaggcagcgagaugcccuagugguggcc

SEQ ID NO: 748528 - RNA, 63 nt, Homo Sapiens
auguugaggagagaugaaaauggacauugagccuccaggcacccugauuuucacaucucuacc

SEQ ID NO: 748529 - RNA, 63 nt, Homo Sapiens
cucgcccgccggcugcgcucagcagcuccacguuccaggcagccaggucagccggacagcucc

SEQ ID NO: 748530 - RNA, 63 nt, Homo Sapiens
acggcaggggugagcagcuuuagcauuucugccuccaggcaggggccuguuuucagguguucc

SEQ ID NO: 748531 - RNA, 63 nt, Homo Sapiens
ccugccccugaagacccucuuccuaggcugagguccaggcagcggggcaggaaagugagccau

SEQ ID NO: 748532 - RNA, 63 nt, Homo Sapiens
ggaaccaucuauuguuuuguuacaacucagagcuccaggcagcgcuucccucaugcccuggaa

SEQ ID NO: 748533 - RNA, 63 nt, Homo Sapiens
cucucuuacuugaacacaaaugcauauccuauuuccaggcaggugguauuuuuuaauuaugaa

SEQ ID NO: 748534 - RNA, 63 nt, Homo Sapiens
caccaagcucccugucacccagccauggugugguccaggcagggacaucucgguacccuuucu

SEQ ID NO: 748535 - RNA, 63 nt, Homo Sapiens
uccacaaacacuccguggcugagaggcagcggauccaggcagcgaugcugagccaccuccucc

SEQ ID NO: 748536 - RNA, 63 nt, Homo Sapiens
cugcucucaggaccagagaagggaaaugacuucuccaggcagaggcagaucugagucuagaac

SEQ ID NO: 748537 - RNA, 63 nt, Homo Sapiens
caaagcaaaggagaguccugggagcccacaagauccaggcagaaggagauggguuuggggcug

SEQ ID NO: 748538 - RNA, 63 nt, Homo Sapiens
ccccuccagaccucacacugccuaaaaaugggguccaggcagauuuauuggggaggggagcau

SEQ ID NO: 748539 - RNA, 63 nt, Homo Sapiens
caugggaggcggccucccugacugugccugccauccaggcagcguucagagcauuacucuccc

SEQ ID NO: 748540 - RNA, 63 nt, Homo Sapiens
caagggccccuuugccuucucauccucaggaguuccaggcacaugagucaccguccauccaca

SEQ ID NO: 748541 - RNA, 63 nt, Homo Sapiens
accacugggaggacguggagaggacagugaacuuccaggcaagagcuuccuucuuuugucuca

SEQ ID NO: 748542 - RNA, 63 nt, Homo Sapiens
agagggaagguuaagguuggcucuggccaggauuccaggcagcagguuggagugacugguggg

SEQ ID NO: 748543 - RNA, 63 nt, Homo Sapiens
cagaggaaugauggagaaucuaguguagcagccuccaggcaggauucagcacaacacugggga

SEQ ID NO: 748544 - RNA, 63 nt, Homo Sapiens
uggcccuggagagugggccugggugguaccugcuccaggcagggaaacugggggcucgcccuu

SEQ ID NO: 748545 - RNA, 63 nt, Homo Sapiens
gccacccacccaguuuuauaaucccgcucccucuccaggcaaccccacccaccagccuaggcc

SEQ ID NO: 748546 - RNA, 63 nt, Homo Sapiens
aggcuggaauaaacgcugcugaugauucugaaauccaggcagccugucuccuuugcuacaugu

SEQ ID NO: 748547 - RNA, 63 nt, Homo Sapiens
uguggacucaaggaguccagccaggggcugggguccaggcaucgugcaucaguggccugguug

SEQ ID NO: 748548 - RNA, 63 nt, Homo Sapiens
cggagcugugagugccugcauagucagguuguguccaggcaugagucugagggcugcuuggug

SEQ ID NO: 748549 - RNA, 63 nt, Homo Sapiens
accugcaaaugaguuaaagaagaggcgugggaauccaggcagugguuuuuccuuucggagccu

SEQ ID NO: 748550 - RNA, 63 nt, Homo Sapiens
aguccaggggcaccuggcuucagguagguuugauccaggcaucaggccauugcaucuauuuuu

SEQ ID NO: 748551 - RNA, 63 nt, Homo Sapiens
ccugaagauguguugcuacugucagaucuaagcuccaggcacgaaacuccaguauauuccaga

SEQ ID NO: 748552 - RNA, 63 nt, Homo Sapiens
ucccguugccaccuccugcuaggaaguuccuuuuccaggcaggcgauguaugcuuugguugac

SEQ ID NO: 748553 - RNA, 63 nt, Homo Sapiens
ugccccgaggagccaaguuugggacauuuacccuccaggcaucuguguccccucuugaagaga

SEQ ID NO: 748554 - RNA, 63 nt, Homo Sapiens
cccucuugaagagaaaacacacagcuucacacauccaggcauagggggcaagcucuuggggca

SEQ ID NO: 748555 - RNA, 63 nt, Homo Sapiens
cauguccaccauagaauuugcugugguccauccuccaggcauccaucccauuucuucuggggu

SEQ ID NO: 748556 - RNA, 63 nt, Homo Sapiens
uggaucagaagucgcagcucgugcuccagagccuccaggcaauauagaccaacgcuaaagccu

SEQ ID NO: 748557 - RNA, 64 nt, Homo Sapiens; identical to SEQ ID NO: 363995

SEQ ID NO: 748558 - RNA, 64 nt, Homo Sapiens; identical to SEQ ID NO: 363996

SEQ ID NO: 748559 - RNA, 64 nt, Homo Sapiens; identical to SEQ ID NO: 363997

SEQ ID NO: 748560 - RNA, 64 nt, Homo Sapiens; identical to SEQ ID NO: 363998

SEQ ID NO: 748561 - RNA, 64 nt, Homo Sapiens; identical to SEQ ID NO: 363999

SEQ ID NO: 748562 - RNA, 64 nt, Homo Sapiens; identical to SEQ ID NO: 364000

SEQ ID NO: 748563 - RNA, 64 nt, Homo Sapiens; identical to SEQ ID NO: 364001

SEQ ID NO: 748564 - RNA, 64 nt, Homo Sapiens; identical to SEQ ID NO: 364002

SEQ ID NO: 748565 - RNA, 64 nt, Homo Sapiens; identical to SEQ ID NO: 364003

SEQ ID NO: 748566 - RNA, 64 nt, Homo Sapiens; identical to SEQ ID NO: 364004

SEQ ID NO: 748567 - RNA, 64 nt, Homo Sapiens; identical to SEQ ID NO: 364005

SEQ ID NO: 748568 - RNA, 64 nt, Homo Sapiens; identical to SEQ ID NO: 364006

SEQ ID NO: 748569 - RNA, 64 nt, Homo Sapiens; identical to SEQ ID NO: 689078

SEQ ID NO: 748570 - RNA, 64 nt, Homo Sapiens; identical to SEQ ID NO: 689079

SEQ ID NO: 748571 - RNA, 64 nt, Homo Sapiens; identical to SEQ ID NO: 689080

SEQ ID NO: 748572 - RNA, 64 nt, Homo Sapiens; identical to SEQ ID NO: 689081

SEQ ID NO: 748573 - RNA, 64 nt, Homo Sapiens
ccaccuaguaacagucauuucugaaaauauguuggauagaaagucacucuuuggcaaaaguguu

SEQ ID NO: 748574 - RNA, 64 nt, Homo Sapiens
auuccuuuuaguuuguugguuggcugguuugaacgauagaaauaugcagcaugcaauauaugcu

SEQ ID NO: 748575 - RNA, 64 nt, Homo Sapiens
aaaugcauauuuauauguguauaccauauguggagauagaaaagaccuuuaagacaauaaaaga

SEQ ID NO: 748576 - RNA, 64 nt, Homo Sapiens
aagauaaacaaaugcauaguuuucuucuaugggugauagaaacagcuuuuugaaguaaugaaaa

SEQ ID NO: 748577 - RNA, 64 nt, Homo Sapiens
gacuaauaaucucuauuuauaacuaaaucauugagauagaaaaagauucccauugacuguagac

SEQ ID NO: 748578 - RNA, 64 nt, Homo Sapiens
gguuggaacgcauuggcuuuuuuuuucuuguuuugauagaaauggaauuaagcaaaaguaguuu

SEQ ID NO: 748579 - RNA, 64 nt, Homo Sapiens
aucuccuugagaacacugaagcaaucaccauucugauagaaagugcuuaaaccaccacucuuag

SEQ ID NO: 748580 - RNA, 64 nt, Homo Sapiens
gaggcuuagaugacuucugcaggauuuauauucagauagaaaacaucaaauauuuucaggggag

SEQ ID NO: 748581 - RNA, 64 nt, Homo Sapiens
ucacauucuuuucaguuggagagaauugggcuaagauagaaaauaacaugauuuguuccuuauu

SEQ ID NO: 748582 - RNA, 64 nt, Homo Sapiens
ccuauucauauugcugugaaugcuuuaucuuggagauagaaaauauaaugauaaauucaucaug

SEQ ID NO: 748583 - RNA, 64 nt, Homo Sapiens
ucggccuuaacuccaccugauggcaggugacccggauagaaaauggcccugcguuuagccagga

SEQ ID NO: 748584 - RNA, 64 nt, Homo Sapiens
uuuuucuuuaaaugauaucacagaauuaauguuggauagaaauaucauuggauagaaaucuguu

SEQ ID NO: 748585 - RNA, 64 nt, Homo Sapiens
aucacagaauuaauguuggauagaaauaucauuggauagaaaucuguuugaaggaauuuuccug

SEQ ID NO: 748586 - RNA, 64 nt, Homo Sapiens
ucccuacuaagucccaacagggccaugaucuagagauagaaaaaugguuucuuggcuuuccgaa

SEQ ID NO: 748587 - RNA, 64 nt, Homo Sapiens
aaaucuuuggggcacugcauaccugggcuauggggauagaaaaguaggguggccauuuagucug

SEQ ID NO: 748588 - RNA, 64 nt, Homo Sapiens
uccuuccaauuaaauggcauuuaugacuugcaaugauagaaaacuauucuuuuaaaaguuauau

SEQ ID NO: 748589 - RNA, 64 nt, Homo Sapiens
gaugguaguauuuaugaacuuccaggaggguggugauagaaacauaaaaccuuaacuuucuuuc

SEQ ID NO: 748590 - RNA, 64 nt, Homo Sapiens
ugucucaaaugcauucuacuagccccuuaucccagauagaaaagaaacaucuaucaagcaacac

SEQ ID NO: 748591 - RNA, 64 nt, Homo Sapiens
ugaaaugugacaguagcaaaacucauuagcaccugauagaaaucugggguauaacaugaugagu

SEQ ID NO: 748592 - RNA, 64 nt, Homo Sapiens; identical to SEQ ID NO: 38237

SEQ ID NO: 748593 - RNA, 64 nt, Homo Sapiens; identical to SEQ ID NO: 38238

SEQ ID NO: 748594 - RNA, 64 nt, Homo Sapiens; identical to SEQ ID NO: 38239

SEQ ID NO: 748595 - RNA, 64 nt, Homo Sapiens; identical to SEQ ID NO: 38240

SEQ ID NO: 748596 - RNA, 64 nt, Homo Sapiens; identical to SEQ ID NO: 38241

SEQ ID NO: 748597 - RNA, 64 nt, Homo Sapiens; identical to SEQ ID NO: 38242

SEQ ID NO: 748598 - RNA, 64 nt, Homo Sapiens; identical to SEQ ID NO: 38243

SEQ ID NO: 748599 - RNA, 64 nt, Homo Sapiens; identical to SEQ ID NO: 38244

SEQ ID NO: 748600 - RNA, 64 nt, Homo Sapiens; identical to SEQ ID NO: 38245

SEQ ID NO: 748601 - RNA, 64 nt, Homo Sapiens; identical to SEQ ID NO: 38246

SEQ ID NO: 748602 - RNA, 64 nt, Homo Sapiens; identical to SEQ ID NO: 38247

SEQ ID NO: 748603 - RNA, 64 nt, Homo Sapiens; identical to SEQ ID NO: 38248

SEQ ID NO: 748604 - RNA, 64 nt, Homo Sapiens; identical to SEQ ID NO: 38249

SEQ ID NO: 748605 - RNA, 64 nt, Homo Sapiens; identical to SEQ ID NO: 38250

SEQ ID NO: 748606 - RNA, 64 nt, Homo Sapiens; identical to SEQ ID NO: 38251

SEQ ID NO: 748607 - RNA, 64 nt, Homo Sapiens; identical to SEQ ID NO: 38252

SEQ ID NO: 748608 - RNA, 64 nt, Homo Sapiens; identical to SEQ ID NO: 38253

SEQ ID NO: 748609 - RNA, 64 nt, Homo Sapiens; identical to SEQ ID NO: 38254

SEQ ID NO: 748610 - RNA, 64 nt, Homo Sapiens; identical to SEQ ID NO: 110144

SEQ ID NO: 748611 - RNA, 64 nt, Homo Sapiens; identical to SEQ ID NO: 110145

SEQ ID NO: 748612 - RNA, 64 nt, Homo Sapiens; identical to SEQ ID NO: 110146

SEQ ID NO: 748613 - RNA, 64 nt, Homo Sapiens; identical to SEQ ID NO: 110147

SEQ ID NO: 748614 - RNA, 64 nt, Homo Sapiens; identical to SEQ ID NO: 110148

SEQ ID NO: 748615 - RNA, 64 nt, Homo Sapiens; identical to SEQ ID NO: 110149

SEQ ID NO: 748616 - RNA, 64 nt, Homo Sapiens; identical to SEQ ID NO: 110150

SEQ ID NO: 748617 - RNA, 64 nt, Homo Sapiens; identical to SEQ ID NO: 110151

SEQ ID NO: 748618 - RNA, 64 nt, Homo Sapiens; identical to SEQ ID NO: 110152

SEQ ID NO: 748619 - RNA, 64 nt, Homo Sapiens; identical to SEQ ID NO: 110153

SEQ ID NO: 748620 - RNA, 64 nt, Homo Sapiens; identical to SEQ ID NO: 110154

SEQ ID NO: 748621 - RNA, 64 nt, Homo Sapiens; identical to SEQ ID NO: 110155

SEQ ID NO: 748622 - RNA, 64 nt, Homo Sapiens; identical to SEQ ID NO: 110156

SEQ ID NO: 748623 - RNA, 64 nt, Homo Sapiens; identical to SEQ ID NO: 110157

SEQ ID NO: 748624 - RNA, 64 nt, Homo Sapiens; identical to SEQ ID NO: 110158

SEQ ID NO: 748625 - RNA, 64 nt, Homo Sapiens; identical to SEQ ID NO: 110159

SEQ ID NO: 748626 - RNA, 64 nt, Homo Sapiens; identical to SEQ ID NO: 110160

SEQ ID NO: 748627 - RNA, 64 nt, Homo Sapiens; identical to SEQ ID NO: 110161

SEQ ID NO: 748628 - RNA, 64 nt, Homo Sapiens; identical to SEQ ID NO: 110162

SEQ ID NO: 748629 - RNA, 64 nt, Homo Sapiens; identical to SEQ ID NO: 110163

SEQ ID NO: 748630 - RNA, 64 nt, Homo Sapiens; identical to SEQ ID NO: 110164

SEQ ID NO: 748631 - RNA, 64 nt, Homo Sapiens; identical to SEQ ID NO: 110165

SEQ ID NO: 748632 - RNA, 64 nt, Homo Sapiens; identical to SEQ ID NO: 110166

SEQ ID NO: 748633 - RNA, 62 nt, Homo Sapiens
agagcgcaccagcuaacaauagaauaagagcgcaccagaauaaggaagaauaagagugcacc

SEQ ID NO: 748634 - RNA, 62 nt, Homo Sapiens
agagcgcaccagaauaagagagaauaagagugcaccagaauaaaaaucuucucuugaaagga

SEQ ID NO: 748635 - RNA, 62 nt, Homo Sapiens
cggcccugagcacgagaagagcaucgggagcacaccagaaacccucgagaaaagagccaagc

SEQ ID NO: 748636 - RNA, 62 nt, Homo Sapiens
gcccgaucacagacgagcagcagacgagcggucaccagaaucucaucggacucacccgauca

SEQ ID NO: 748637 - RNA, 62 nt, Homo Sapiens
ugucugcauuacucauugcuuguacuggccugcaccagaagaagauaaccuuugaagcuuau

SEQ ID NO: 748638 - RNA, 62 nt, Homo Sapiens
ggacuggcagucuacuucuauuuaaaaugguacaccagaaaaguguuaugugccuguauuuu

SEQ ID NO: 748639 - RNA, 62 nt, Homo Sapiens
aaucuucagaggugcuaaauugucugccauuacaccagaaggaugccucugauaggaggaca

SEQ ID NO: 748640 - RNA, 62 nt, Homo Sapiens
auagcuuuguauuuuugucauugauuaaauugcaccagaaauguuuauggaaauauuaagaa

SEQ ID NO: 748641 - RNA, 62 nt, Homo Sapiens
cucuuccuacuccugagucuacacccgugcuucaccagaagacccugcaggccaugaagagc

SEQ ID NO: 748642 - RNA, 62 nt, Homo Sapiens
ccaaagccaucaugggagacauccagauggcacaccagaacuuaaugcuggaucccauggga

SEQ ID NO: 748643 - RNA, 62 nt, Homo Sapiens
gggccagccucucucuuuugcccugcucuccacaccagaaaugcccccaggugcuuggcugc

SEQ ID NO: 748644 - RNA, 62 nt, Homo Sapiens
gaugcucuuuaagaaguucgcaccccugcugacaccagaacagcccaaaucagaguucccag

SEQ ID NO: 748645 - RNA, 62 nt, Homo Sapiens
ccuccgcugcuccuuuuuggaaugcgagcucccaccagaagaagguuccggcacgaauccca

SEQ ID NO: 748646 - RNA, 62 nt, Homo Sapiens
ucacucagcucacagggcgugccaggcggcaacaccagaaucuuccagaagcccagcuccac

SEQ ID NO: 748647 - RNA, 62 nt, Homo Sapiens
cauuauuguagaauaagucauuguauuuuuaacaccagaaagaaccuugccgaucaccaggc

SEQ ID NO: 748648 - RNA, 62 nt, Homo Sapiens
gaaacacagaaaggcaucuaaguuagagcuggcaccagaacugagaccuccagaaaucuauu

SEQ ID NO: 748649 - RNA, 62 nt, Homo Sapiens
aauccuuuagccagcguuucaaccucauucaacaccagaaaguucacaguggaaaaaaucuu

SEQ ID NO: 748650 - RNA, 62 nt, Homo Sapiens
aagguuucagccaaaggccuaacccuauucaacaccagaaaguuuacacuggagaaaggccu

SEQ ID NO: 748651 - RNA, 64 nt, Homo Sapiens; identical to SEQ ID NO: 658151

SEQ ID NO: 748652 - RNA, 64 nt, Homo Sapiens; identical to SEQ ID NO: 658152

SEQ ID NO: 748653 - RNA, 64 nt, Homo Sapiens; identical to SEQ ID NO: 658153

SEQ ID NO: 748654 - RNA, 64 nt, Homo Sapiens; identical to SEQ ID NO: 658154

SEQ ID NO: 748655 - RNA, 64 nt, Homo Sapiens; identical to SEQ ID NO: 658155

SEQ ID NO: 748656 - RNA, 64 nt, Homo Sapiens; identical to SEQ ID NO: 658156

SEQ ID NO: 748657 - RNA, 64 nt, Homo Sapiens; identical to SEQ ID NO: 658157

SEQ ID NO: 748658 - RNA, 64 nt, Homo Sapiens; identical to SEQ ID NO: 658158

SEQ ID NO: 748659 - RNA, 64 nt, Homo Sapiens; identical to SEQ ID NO: 658159

SEQ ID NO: 748660 - RNA, 64 nt, Homo Sapiens; identical to SEQ ID NO: 658160

SEQ ID NO: 748661 - RNA, 64 nt, Homo Sapiens; identical to SEQ ID NO: 658161

SEQ ID NO: 748662 - RNA, 64 nt, Homo Sapiens; identical to SEQ ID NO: 658162

SEQ ID NO: 748663 - RNA, 64 nt, Homo Sapiens
ugcuuguuuacaacugaagaucaugcuauauuuuauauaugaagccccuaaugcaaagcucuuu

SEQ ID NO: 748664 - RNA, 64 nt, Homo Sapiens
aagaaaagauguuauucugaguuuguuuuaauacauauaugaacauauaguuuuauucaauuaa

SEQ ID NO: 748665 - RNA, 64 nt, Homo Sapiens
aggcuuguuucaagagguuugacagaagaaaggaauauaugaacuuaaugagaugucgacuugg

SEQ ID NO: 748666 - RNA, 64 nt, Homo Sapiens
gugaggaguacaguguuuucuaauucauucaaguauauaugauuuaaaccugggcuacugacac

SEQ ID NO: 748667 - RNA, 64 nt, Homo Sapiens
cuuuuaaagaaaguuauauaguuugguuauuaauauauaugagaaacugcaauuuaaaaagugu

SEQ ID NO: 748668 - RNA, 64 nt, Homo Sapiens
aaugcuaugcagauguugucaauuagaagugguuauauaugaugggacaguuucccauaugagu

SEQ ID NO: 748669 - RNA, 64 nt, Homo Sapiens
aauaaaacugaugaagcaaaaugaugaauucuggauauaugaccuuauuuugaaagauuuauau

SEQ ID NO: 748670 - RNA, 64 nt, Homo Sapiens
aauucuggauauaugaccaaauuuugaaagauuuauauaugauguauucuuguaauagcucauu

SEQ ID NO: 748671 - RNA, 64 nt, Homo Sapiens
aaaaguaaaauuguacauguaagaaaauauuuaaauauaugacaccugagauagcucugcagau

SEQ ID NO: 748672 - RNA, 64 nt, Homo Sapiens
uguuuauauuguaaaugcacugauuuguagcuucauauaugacauauccacuccagugagauua

SEQ ID NO: 748673 - RNA, 64 nt, Homo Sapiens
aacuaauuuuaaaaauguuaaaauagauaaauaaauauaugauugucucaaaaauaaauaaaua

SEQ ID NO: 748674 - RNA, 64 nt, Homo Sapiens
agccaggcacgguggcugacagucuuaauauuaaauauaugauuauaacuuuucuaaagccuua

SEQ ID NO: 748675 - RNA, 64 nt, Homo Sapiens
uguaaauacucgauauauaauuucauuuuaaguaauauaugaagcgcuauuuaugcauaaauau

SEQ ID NO: 748676 - RNA, 64 nt, Homo Sapiens
auguaacugaucuaaucaguaaggaaaguauaucauauaugaugcccuuuguuccuaucuucua

SEQ ID NO: 748677 - RNA, 64 nt, Homo Sapiens
gcccaaaauuugauggacuaauuauuauuuuaaaauauaugaagacaauaauucuacauguugu

SEQ ID NO: 748678 - RNA, 64 nt, Homo Sapiens
accaccagguaucaaaucaacuuuuaugcagcaaauauaugauucuagugucugacuuuuguua

SEQ ID NO: 748679 - RNA, 64 nt, Homo Sapiens
uggcggguaaaaaucacaaaaugcagucgaauauauauaugaaaacuugcauuaggugauaaag

SEQ ID NO: 748680 - RNA, 64 nt, Homo Sapiens
aauuacaacaucaaaauaguuacaucuugugaaaauauaugauuuuuaugucaaucaagacaaa

SEQ ID NO: 748681 - RNA, 64 nt, Homo Sapiens
cugcuuuauucaauaaaaaaaagaaaugaaaaagauauaugaauaugacaaaguauugcugagu

SEQ ID NO: 748682 - RNA, 64 nt, Homo Sapiens
cugaauaugaauagauacagcagaggcacuccugauauaugauuuuuauccaugcgucaguuuu

SEQ ID NO: 748683 - RNA, 64 nt, Homo Sapiens
uauauauauauaucacauauuauauauauaucauauauaugauauauauaugauauauauguga

SEQ ID NO: 748684 - RNA, 64 nt, Homo Sapiens
uauaugugauauauauauauugucuaaaugauauauauaugauaggucaccuucuuggaucugc

SEQ ID NO: 748685 - RNA, 64 nt, Homo Sapiens
gacuaggauuaaucugguguacagucuacugcauauauaugaauaugguaacuggucauauaug

SEQ ID NO: 748686 - RNA, 64 nt, Homo Sapiens
gucuacugcauauauaugaauaugguaacuggucauauaugacaaaauaugguauuauaguuug

SEQ ID NO: 748687 - RNA, 64 nt, Homo Sapiens
aaauccauacagugaggaaucagaguguuuauagauauaugaguugaaugcaauuuuuauuuuu

SEQ ID NO: 748688 - RNA, 64 nt, Homo Sapiens
uagaaaaaucgaaagugcacagcacuuaaagggaauauaugagguuuuuuuuuuuuuaaaaaaa

SEQ ID NO: 748689 - RNA, 64 nt, Homo Sapiens
auauguguguguguauguauauguacauauacauauauaugaguguauaauucuaaauuucuaa

SEQ ID NO: 748690 - RNA, 64 nt, Homo Sapiens
cuuuuaaacauuaaguuugaguaaaucaaaaucaauauaugauuccaucccccacaguccugga

SEQ ID NO: 748691 - RNA, 64 nt, Homo Sapiens
aaauugggucugucuaaagauuggguuuaacugaauauaugaagacaacuuaauggauuagcuu

SEQ ID NO: 748692 - RNA, 64 nt, Homo Sapiens
auaaaugaugaaaaaagaaccuaugacaguguacauauaugaaaaaacauacagauuccuaauu

SEQ ID NO: 748693 - RNA, 64 nt, Homo Sapiens
gcuaaggaaagcacaaaacaaagugccagaguguauauaugaaaagcauucuccagcaaugaca

SEQ ID NO: 748694 - RNA, 64 nt, Homo Sapiens
uagacccuucacacaggaaaugugaacaauuguuauauaugaacacucaaaucuuuuacuguaa

SEQ ID NO: 748695 - RNA, 64 nt, Homo Sapiens
gagaacgaaagccaaagugucauuuaagagagauauauaugaaaaaguaacauuaauauauaga

SEQ ID NO: 748696 - RNA, 64 nt, Homo Sapiens
aauaaagcuuaauugucccaaugaaaauauauauauauaugaaaauauguauguauauauauau

SEQ ID NO: 748697 - RNA, 64 nt, Homo Sapiens
auauauauauauaugaaaaaauguauguauauauauauaugaaagcaaauuguuuccuuuauau

SEQ ID NO: 748698 - RNA, 64 nt, Homo Sapiens
caguguuuauugguuaguuuuuuuuuuuacaauuauauaugaugcuauuguuugguuuuuccau

SEQ ID NO: 748699 - RNA, 64 nt, Homo Sapiens
ucucacuuuaaauaauuuaaaacaaauuaaagugauauaugaguuaaaugaccaagcagacuug

SEQ ID NO: 748700 - RNA, 64 nt, Homo Sapiens
uguuuacuacuuaaacaugauuuauuauuuuuaaauauaugacauucuguacugcuauucuaua

SEQ ID NO: 748701 - RNA, 64 nt, Homo Sapiens
cuauaaagaaucauuagaaaaaaccuuuauaaaaauauaugauuaauaaauacaucacagacag

SEQ ID NO: 748702 - RNA, 64 nt, Homo Sapiens
guugugacagugcuguuuggcuuuuucauucuucaaaugccaagucauccacuuuguuuuccug

SEQ ID NO: 748703 - RNA, 64 nt, Homo Sapiens
uuagcaaguuggcauuaacauuuaugcuuuaauuaaaugccaguauaccuaugugugcagcagu

SEQ ID NO: 748704 - RNA, 64 nt, Homo Sapiens
cagucugcccuguccuucugcucauaaccugacaaaaugccaaacuaguaagcaggauagcuga

SEQ ID NO: 748705 - RNA, 64 nt, Homo Sapiens
aucuuaagcauuucacuuauuagauauuguucaaaaaugccauuuuuaauauuuguauaauacc

SEQ ID NO: 748706 - RNA, 64 nt, Homo Sapiens
gccugguugggccugggcaaugggaaggagccagaaaugccaucuucacccagaaacaaagaau

SEQ ID NO: 748707 - RNA, 64 nt, Homo Sapiens
uuugacagagauacugcuggaaaaauuaaaauuaaaaugccauaauagcuaccuaacaaauaua

SEQ ID NO: 748708 - RNA, 64 nt, Homo Sapiens
auacaaauaugaaagcucuguucaaaaaauaaagaaaugccagauccugggcaacuaccuaugg

SEQ ID NO: 748709 - RNA, 64 nt, Homo Sapiens
uuuuacuguaauaaguaauggcuuuugaaggggaaaaugccaauauucuaagacuggugcuucu

SEQ ID NO: 748710 - RNA, 64 nt, Homo Sapiens
augugacauuaguaugaaauagcuacauccaaagaaaugccaauuaauguguuuuaaaauauaa

SEQ ID NO: 748711 - RNA, 64 nt, Homo Sapiens
augauaauaaaauacauuugauagcaacuaauacaaaugccaauguauagacauggugguagga

SEQ ID NO: 748712 - RNA, 64 nt, Homo Sapiens
cagaaugauacagaguuagcagguuuuucuaaggaaaugccauucaaaugccuccuaacuuuua

SEQ ID NO: 748713 - RNA, 64 nt, Homo Sapiens
cacuuuuuuuuuuucaaguaucucucuaauaacuaaaugccacuuauuugcauucuccuugugg

SEQ ID NO: 748714 - RNA, 64 nt, Homo Sapiens
agcaacaguuugucuccaguccacaaucuuucaaaaaugccauuuaugcuacuacugacuguau

SEQ ID NO: 748715 - RNA, 64 nt, Homo Sapiens
aaaucaggauuauauacauaagaauuccacuaagaaaugccaagauucuuaaauuugccagcgu

SEQ ID NO: 748716 - RNA, 64 nt, Homo Sapiens
guuuauuuauacuauauucugcauacaguacuuuaaaugccaauuacagugcaaucuuuauuua

SEQ ID NO: 748717 - RNA, 64 nt, Homo Sapiens
auguuuuuaaaaagauaagagcaucuagugcauuaaaugccaaaaaaaaaauacauuaucagug

SEQ ID NO: 748718 - RNA, 64 nt, Homo Sapiens
guaauuuuaaauuuacauuuccaauuaaugacccaaaugccaaggcauuauuagguuaauuaau

SEQ ID NO: 748719 - RNA, 64 nt, Homo Sapiens
cacacacacacacacacacaaagcuuaugcucagaaaugccauaauauuuuguucacacuaaua

SEQ ID NO: 748720 - RNA, 64 nt, Homo Sapiens
aagaaaaagaaaaaaaaaagugaccaaaccauccaaaugccaaauggaauaaggaagagaagau

SEQ ID NO: 748721 - RNA, 64 nt, Homo Sapiens
cccagagccaugugagauucagucccgggaagguaaaugccaaaugcgaaugccccauagcaga

SEQ ID NO: 748722 - RNA, 64 nt, Homo Sapiens
gaccuuuugcugccuaaaucgucuaucugguauuaaaugccaagucucuggcacuuugaguuaa

SEQ ID NO: 748723 - RNA, 64 nt, Homo Sapiens
aaaugaauaaugccuuuguaaagaacccauggaaaaaugccaucggcuacacaauuggaagucu

SEQ ID NO: 748724 - RNA, 64 nt, Homo Sapiens
ugagggcauugugaaaagcuuugcugugauuuaaaaaugccagcaauuuuaaucuagcaguguu

SEQ ID NO: 748725 - RNA, 64 nt, Homo Sapiens
uggacaauguaacccuaaacacaucauguauuuuaaaugccaccuacauaaauaaaacauaagc

SEQ ID NO: 748726 - RNA, 64 nt, Homo Sapiens
ucauaauugaaaggggaaagaaaugccaccaggaaaaugccacucucaguguggcuggagguug

SEQ ID NO: 748727 - RNA, 64 nt, Homo Sapiens
aggaaaaugccacuucauaaguggcuggagguugaaaugccaccuuauuagacaccugcucagu

SEQ ID NO: 748728 - RNA, 64 nt, Homo Sapiens
ugguagcucuggacaaugaaauuccugugcucugaaaugccacuacaucuggguggaggaguaa

SEQ ID NO: 748729 - RNA, 64 nt, Homo Sapiens
gugccuuuaacaagguuguaaaggcuuuaguuuuaaaugccacuaucuuuuacuguacauuccc

SEQ ID NO: 748730 - RNA, 64 nt, Homo Sapiens
aauggucaagcaauuauacacugggaggucauuuaaaugccagacucagggcuuguguaauauu

SEQ ID NO: 748731 - RNA, 64 nt, Homo Sapiens
cuuuuggcacuucagcacaucuguugacacuugaaaaugccaguguggcgcagugaugcauggc

SEQ ID NO: 748732 - RNA, 64 nt, Homo Sapiens
caaaguauuaguguuaacacucaguauagggcacaaaugccaaacuuguauaaaaauggucugg

SEQ ID NO: 748733 - RNA, 64 nt, Homo Sapiens
ucucaccagauggccuacguagaauggacacuacaaaugccagccacuucaguagauuagucuc

SEQ ID NO: 748734 - RNA, 64 nt, Homo Sapiens
augccucugucuucuggacuacucagauaagguaaaaugccaugggcaugagaaauacaaaaau

SEQ ID NO: 748735 - RNA, 64 nt, Homo Sapiens
cacuucuuuuucucgcugucgcggugcuugauagaaaugccaagggucuguagugucacucaag

SEQ ID NO: 748736 - RNA, 64 nt, Homo Sapiens
cugcagaauuaaccaucccacugucuguuaaauaaaaugccauuggauauguaugaaguccaug

SEQ ID NO: 748737 - RNA, 64 nt, Homo Sapiens
aaucaaagcauuaaguguguuaaguaggcaagaaaaaugccacuauuccauggaauguuuuuaa

SEQ ID NO: 748738 - RNA, 64 nt, Homo Sapiens
cauccuaagaauaauaacuguaauggcaaagcggaaaugccaguuccuccuguauuccauugag

SEQ ID NO: 748739 - RNA, 64 nt, Homo Sapiens
augauauuuaaaauaguucucaguugaagcagagaaaugccacugugcuaguugcccaaauguu

SEQ ID NO: 748740 - RNA, 64 nt, Homo Sapiens
guggccgcguguauauuguuaauagguuauacaaaaaugccacauuuuuuuucaaaguuugcuu

SEQ ID NO: 748741 - RNA, 64 nt, Homo Sapiens
agacccaaucaaaugaagaaagauagaggauaugaaaugccauaaaaaaaaaaauucugguuga

SEQ ID NO: 748742 - RNA, 64 nt, Homo Sapiens
guucuuggucauaagacacacuagggagccaaggaaaugccaugccgcuuugcccuugaccugg

SEQ ID NO: 748743 - RNA, 64 nt, Homo Sapiens
cuauuguagcuauuauaucuggccuuaaacugagaaaugccagguuggaauggaugcuacucua

SEQ ID NO: 748744 - RNA, 64 nt, Homo Sapiens
aacagagaaauagaggugaugcugcuaaagggagaaaugccaggcggacaaaguucagugucgg

SEQ ID NO: 748745 - RNA, 64 nt, Homo Sapiens
cuuacaagcuuaaagcuugauuugaucuuuguuuaaaugccaaaauguacuuaaaugaguuacu

SEQ ID NO: 748746 - RNA, 64 nt, Homo Sapiens
caggcacagcagaaaccuacaaaaaaguacaaccaaaugccaguagcagugaagagauaaagaa

SEQ ID NO: 748747 - RNA, 64 nt, Homo Sapiens
guagcugauguauuggacguggggagucugaaucaaaugccaaaguucugaugacucacaugau

SEQ ID NO: 748748 - RNA, 64 nt, Homo Sapiens
ccaccaagggaguuaaccuaccugaacuaaguagaaaugccagucuuccacuacccccucccug

SEQ ID NO: 748749 - RNA, 64 nt, Homo Sapiens
augggguuggggaauaggguugucuuuccuaugaaaaugccaucuguagaccuugugagucagc

SEQ ID NO: 748750 - RNA, 64 nt, Homo Sapiens
ucagaauguauaaaaguacuuuuuccaucugcugaaaugccauuuccugauuugccaccuucau

SEQ ID NO: 748751 - RNA, 64 nt, Homo Sapiens
cuuguuuauuuaauuguuuucuauaaaguuaugaaaaugccaaaauuuaauauucuguuuuaua

SEQ ID NO: 748752 - RNA, 64 nt, Homo Sapiens; identical to SEQ ID NO: 271043

SEQ ID NO: 748753 - RNA, 64 nt, Homo Sapiens; identical to SEQ ID NO: 271044

SEQ ID NO: 748754 - RNA, 64 nt, Homo Sapiens; identical to SEQ ID NO: 271045

SEQ ID NO: 748755 - RNA, 64 nt, Homo Sapiens; identical to SEQ ID NO: 271046

SEQ ID NO: 748756 - RNA, 64 nt, Homo Sapiens; identical to SEQ ID NO: 271047

SEQ ID NO: 748757 - RNA, 64 nt, Homo Sapiens; identical to SEQ ID NO: 271048

SEQ ID NO: 748758 - RNA, 64 nt, Homo Sapiens; identical to SEQ ID NO: 271049

SEQ ID NO: 748759 - RNA, 64 nt, Homo Sapiens; identical to SEQ ID NO: 271050

SEQ ID NO: 748760 - RNA, 64 nt, Homo Sapiens; identical to SEQ ID NO: 271051

SEQ ID NO: 748761 - RNA, 64 nt, Homo Sapiens; identical to SEQ ID NO: 271052

SEQ ID NO: 748762 - RNA, 64 nt, Homo Sapiens; identical to SEQ ID NO: 271053

SEQ ID NO: 748763 - RNA, 64 nt, Homo Sapiens; identical to SEQ ID NO: 271054

SEQ ID NO: 748764 - RNA, 64 nt, Homo Sapiens; identical to SEQ ID NO: 271055

SEQ ID NO: 748765 - RNA, 64 nt, Homo Sapiens; identical to SEQ ID NO: 271056

SEQ ID NO: 748766 - RNA, 64 nt, Homo Sapiens; identical to SEQ ID NO: 271057

SEQ ID NO: 748767 - RNA, 64 nt, Homo Sapiens; identical to SEQ ID NO: 271058

SEQ ID NO: 748768 - RNA, 64 nt, Homo Sapiens; identical to SEQ ID NO: 271059

SEQ ID NO: 748769 - RNA, 64 nt, Homo Sapiens; identical to SEQ ID NO: 271060

SEQ ID NO: 748770 - RNA, 64 nt, Homo Sapiens; identical to SEQ ID NO: 271061

SEQ ID NO: 748771 - RNA, 64 nt, Homo Sapiens; identical to SEQ ID NO: 271062

SEQ ID NO: 748772 - RNA, 64 nt, Homo Sapiens; identical to SEQ ID NO: 271063

SEQ ID NO: 748773 - RNA, 64 nt, Homo Sapiens; identical to SEQ ID NO: 271064

SEQ ID NO: 748774 - RNA, 64 nt, Homo Sapiens; identical to SEQ ID NO: 271065

SEQ ID NO: 748775 - RNA, 64 nt, Homo Sapiens; identical to SEQ ID NO: 271066

SEQ ID NO: 748776 - RNA, 64 nt, Homo Sapiens; identical to SEQ ID NO: 271067

SEQ ID NO: 748777 - RNA, 64 nt, Homo Sapiens; identical to SEQ ID NO: 271068

SEQ ID NO: 748778 - RNA, 64 nt, Homo Sapiens; identical to SEQ ID NO: 237976

SEQ ID NO: 748779 - RNA, 64 nt, Homo Sapiens; identical to SEQ ID NO: 237977

SEQ ID NO: 748780 - RNA, 64 nt, Homo Sapiens; identical to SEQ ID NO: 237978

SEQ ID NO: 748781 - RNA, 64 nt, Homo Sapiens; identical to SEQ ID NO: 237979

SEQ ID NO: 748782 - RNA, 64 nt, Homo Sapiens; identical to SEQ ID NO: 237980

SEQ ID NO: 748783 - RNA, 64 nt, Homo Sapiens; identical to SEQ ID NO: 237981

SEQ ID NO: 748784 - RNA, 64 nt, Homo Sapiens; identical to SEQ ID NO: 237982

SEQ ID NO: 748785 - RNA, 64 nt, Homo Sapiens; identical to SEQ ID NO: 237983

SEQ ID NO: 748786 - RNA, 64 nt, Homo Sapiens; identical to SEQ ID NO: 237984

SEQ ID NO: 748787 - RNA, 64 nt, Homo Sapiens; identical to SEQ ID NO: 237985

SEQ ID NO: 748788 - RNA, 64 nt, Homo Sapiens; identical to SEQ ID NO: 237986

SEQ ID NO: 748789 - RNA, 64 nt, Homo Sapiens; identical to SEQ ID NO: 237987

SEQ ID NO: 748790 - RNA, 64 nt, Homo Sapiens; identical to SEQ ID NO: 237988

SEQ ID NO: 748791 - RNA, 64 nt, Homo Sapiens; identical to SEQ ID NO: 237989

SEQ ID NO: 748792 - RNA, 64 nt, Homo Sapiens; identical to SEQ ID NO: 237990

SEQ ID NO: 748793 - RNA, 64 nt, Homo Sapiens; identical to SEQ ID NO: 237991

SEQ ID NO: 748794 - RNA, 64 nt, Homo Sapiens; identical to SEQ ID NO: 237992

SEQ ID NO: 748795 - RNA, 64 nt, Homo Sapiens; identical to SEQ ID NO: 237993

SEQ ID NO: 748796 - RNA, 64 nt, Homo Sapiens; identical to SEQ ID NO: 237994

SEQ ID NO: 748797 - RNA, 64 nt, Homo Sapiens; identical to SEQ ID NO: 237995

SEQ ID NO: 748798 - RNA, 64 nt, Homo Sapiens; identical to SEQ ID NO: 237996

SEQ ID NO: 748799 - RNA, 64 nt, Homo Sapiens; identical to SEQ ID NO: 237997

SEQ ID NO: 748800 - RNA, 64 nt, Homo Sapiens; identical to SEQ ID NO: 237998

SEQ ID NO: 748801 - RNA, 64 nt, Homo Sapiens; identical to SEQ ID NO: 237999

SEQ ID NO: 748802 - RNA, 64 nt, Homo Sapiens; identical to SEQ ID NO: 238000

SEQ ID NO: 748803 - RNA, 64 nt, Homo Sapiens; identical to SEQ ID NO: 238001

SEQ ID NO: 748804 - RNA, 64 nt, Homo Sapiens; identical to SEQ ID NO: 238002

SEQ ID NO: 748805 - RNA, 64 nt, Homo Sapiens; identical to SEQ ID NO: 238003

SEQ ID NO: 748806 - RNA, 64 nt, Homo Sapiens; identical to SEQ ID NO: 238004

SEQ ID NO: 748807 - RNA, 64 nt, Homo Sapiens; identical to SEQ ID NO: 238005

SEQ ID NO: 748808 - RNA, 64 nt, Homo Sapiens; identical to SEQ ID NO: 238006

SEQ ID NO: 748809 - RNA, 64 nt, Homo Sapiens; identical to SEQ ID NO: 238007

SEQ ID NO: 748810 - RNA, 64 nt, Homo Sapiens; identical to SEQ ID NO: 238008

SEQ ID NO: 748811 - RNA, 64 nt, Homo Sapiens; identical to SEQ ID NO: 238009

SEQ ID NO: 748812 - RNA, 64 nt, Homo Sapiens; identical to SEQ ID NO: 238010

SEQ ID NO: 748813 - RNA, 64 nt, Homo Sapiens; identical to SEQ ID NO: 238011

SEQ ID NO: 748814 - RNA, 64 nt, Homo Sapiens; identical to SEQ ID NO: 238012

SEQ ID NO: 748815 - RNA, 64 nt, Homo Sapiens; identical to SEQ ID NO: 238013

SEQ ID NO: 748816 - RNA, 64 nt, Homo Sapiens; identical to SEQ ID NO: 238014

SEQ ID NO: 748817 - RNA, 64 nt, Homo Sapiens; identical to SEQ ID NO: 238015

SEQ ID NO: 748818 - RNA, 64 nt, Homo Sapiens; identical to SEQ ID NO: 238016

SEQ ID NO: 748819 - RNA, 64 nt, Homo Sapiens; identical to SEQ ID NO: 238017

SEQ ID NO: 748820 - RNA, 64 nt, Homo Sapiens; identical to SEQ ID NO: 238018

SEQ ID NO: 748821 - RNA, 64 nt, Homo Sapiens; identical to SEQ ID NO: 238019

SEQ ID NO: 748822 - RNA, 64 nt, Homo Sapiens; identical to SEQ ID NO: 238020

SEQ ID NO: 748823 - RNA, 64 nt, Homo Sapiens; identical to SEQ ID NO: 238021

SEQ ID NO: 748824 - RNA, 64 nt, Homo Sapiens; identical to SEQ ID NO: 238022

SEQ ID NO: 748825 - RNA, 64 nt, Homo Sapiens; identical to SEQ ID NO: 238023

SEQ ID NO: 748826 - RNA, 64 nt, Homo Sapiens; identical to SEQ ID NO: 238024

SEQ ID NO: 748827 - RNA, 64 nt, Homo Sapiens; identical to SEQ ID NO: 238025

SEQ ID NO: 748828 - RNA, 64 nt, Homo Sapiens; identical to SEQ ID NO: 283920

SEQ ID NO: 748829 - RNA, 64 nt, Homo Sapiens; identical to SEQ ID NO: 283921

SEQ ID NO: 748830 - RNA, 64 nt, Homo Sapiens; identical to SEQ ID NO: 283922

SEQ ID NO: 748831 - RNA, 64 nt, Homo Sapiens; identical to SEQ ID NO: 283923

SEQ ID NO: 748832 - RNA, 64 nt, Homo Sapiens; identical to SEQ ID NO: 283924

SEQ ID NO: 748833 - RNA, 64 nt, Homo Sapiens; identical to SEQ ID NO: 283925

SEQ ID NO: 748834 - RNA, 64 nt, Homo Sapiens; identical to SEQ ID NO: 283926

SEQ ID NO: 748835 - RNA, 64 nt, Homo Sapiens; identical to SEQ ID NO: 283927

SEQ ID NO: 748836 - RNA, 64 nt, Homo Sapiens; identical to SEQ ID NO: 283928

SEQ ID NO: 748837 - RNA, 64 nt, Homo Sapiens; identical to SEQ ID NO: 283929

SEQ ID NO: 748838 - RNA, 64 nt, Homo Sapiens; identical to SEQ ID NO: 283930

SEQ ID NO: 748839 - RNA, 64 nt, Homo Sapiens; identical to SEQ ID NO: 283931

SEQ ID NO: 748840 - RNA, 64 nt, Homo Sapiens; identical to SEQ ID NO: 283932

SEQ ID NO: 748841 - RNA, 64 nt, Homo Sapiens; identical to SEQ ID NO: 283933

SEQ ID NO: 748842 - RNA, 64 nt, Homo Sapiens; identical to SEQ ID NO: 283934

SEQ ID NO: 748843 - RNA, 64 nt, Homo Sapiens; identical to SEQ ID NO: 283935

SEQ ID NO: 748844 - RNA, 64 nt, Homo Sapiens; identical to SEQ ID NO: 283930

SEQ ID NO: 748845 - RNA, 64 nt, Homo Sapiens; identical to SEQ ID NO: 283937

SEQ ID NO: 748846 - RNA, 64 nt, Homo Sapiens; identical to SEQ ID NO: 283938

SEQ ID NO: 748847 - RNA, 64 nt, Homo Sapiens; identical to SEQ ID NO: 283939

SEQ ID NO: 748848 - RNA, 64 nt, Homo Sapiens; identical to SEQ ID NO: 283940

SEQ ID NO: 748849 - RNA, 64 nt, Homo Sapiens; identical to SEQ ID NO: 283941

SEQ ID NO: 748850 - RNA, 64 nt, Homo Sapiens; identical to SEQ ID NO: 283942

SEQ ID NO: 748851 - RNA, 64 nt, Homo Sapiens; identical to SEQ ID NO: 283943

SEQ ID NO: 748852 - RNA, 64 nt, Homo Sapiens; identical to SEQ ID NO: 283944

SEQ ID NO: 748853 - RNA, 60 nt, Homo Sapiens; identical to SEQ ID NO: 283945

SEQ ID NO: 748854 - RNA, 64 nt, Homo Sapiens; identical to SEQ ID NO: 283946

SEQ ID NO: 748855 - RNA, 64 nt, Homo Sapiens; identical to SEQ ID NO: 283947

SEQ ID NO: 748856 - RNA, 64 nt, Homo Sapiens; identical to SEQ ID NO: 283948

SEQ ID NO: 748857 - RNA, 64 nt, Homo Sapiens; identical to SEQ ID NO: 283949

SEQ ID NO: 748858 - RNA, 64 nt, Homo Sapiens; identical to SEQ ID NO: 283950

SEQ ID NO: 748859 - RNA, 64 nt, Homo Sapiens; identical to SEQ ID NO: 283951

SEQ ID NO: 748860 - RNA, 64 nt, Homo Sapiens; identical to SEQ ID NO: 283952

SEQ ID NO: 748861 - RNA, 64 nt, Homo Sapiens; identical to SEQ ID NO: 283953

SEQ ID NO: 748862 - RNA, 64 nt, Homo Sapiens; identical to SEQ ID NO: 283954

SEQ ID NO: 748863 - RNA, 64 nt, Homo Sapiens; identical to SEQ ID NO: 283955

SEQ ID NO: 748864 - RNA, 64 nt, Homo Sapiens; identical to SEQ ID NO: 283956

SEQ ID NO: 748865 - RNA, 64 nt, Homo Sapiens; identical to SEQ ID NO: 283957

SEQ ID NO: 748866 - RNA, 64 nt, Homo Sapiens; identical to SEQ ID NO: 283958

SEQ ID NO: 748867 - RNA, 64 nt, Homo Sapiens; identical to SEQ ID NO: 283959

SEQ ID NO: 748868 - RNA, 64 nt, Homo Sapiens; identical to SEQ ID NO: 283960

SEQ ID NO: 748869 - RNA, 64 nt, Homo Sapiens; identical to SEQ ID NO: 283961

SEQ ID NO: 748870 - RNA, 64 nt, Homo Sapiens; identical to SEQ ID NO: 283962

SEQ ID NO: 748871 - RNA, 64 nt, Homo Sapiens; identical to SEQ ID NO: 283963

SEQ ID NO: 748872 - RNA, 64 nt, Homo Sapiens; identical to SEQ ID NO: 283964

SEQ ID NO: 748873 - RNA, 64 nt, Homo Sapiens; identical to SEQ ID NO: 283965

SEQ ID NO: 748874 - RNA, 64 nt, Homo Sapiens; identical to SEQ ID NO: 283966

SEQ ID NO: 748875 - RNA, 64 nt, Homo Sapiens; identical to SEQ ID NO: 283967

SEQ ID NO: 748876 - RNA, 64 nt, Homo Sapiens; identical to SEQ ID NO: 283968

SEQ ID NO: 748877 - RNA, 64 nt, Homo Sapiens; identical to SEQ ID NO: 283969

SEQ ID NO: 748878 - RNA, 64 nt, Homo Sapiens; identical to SEQ ID NO: 283970

SEQ ID NO: 748879 - RNA, 64 nt, Homo Sapiens; identical to SEQ ID NO: 283971

SEQ ID NO: 748880 - RNA, 64 nt, Homo Sapiens; identical to SEQ ID NO: 283972

SEQ ID NO: 748881 - RNA, 64 nt, Homo Sapiens; identical to SEQ ID NO: 283973

SEQ ID NO: 748882 - RNA, 64 nt, Homo Sapiens; identical to SEQ ID NO: 283974

SEQ ID NO: 748883 - RNA, 64 nt, Homo Sapiens; identical to SEQ ID NO: 283975

SEQ ID NO: 748884 - RNA, 64 nt, Homo Sapiens; identical to SEQ ID NO: 283976

SEQ ID NO: 748885 - RNA, 64 nt, Homo Sapiens; identical to SEQ ID NO: 283977

SEQ ID NO: 748886 - RNA, 64 nt, Homo Sapiens; identical to SEQ ID NO: 283978

SEQ ID NO: 748887 - RNA, 64 nt, Homo Sapiens; identical to SEQ ID NO: 283979

SEQ ID NO: 748888 - RNA, 64 nt, Homo Sapiens; identical to SEQ ID NO: 283980

SEQ ID NO: 748889 - RNA, 64 nt, Homo Sapiens; identical to SEQ ID NO: 283981

SEQ ID NO: 748890 - RNA, 64 nt, Homo Sapiens; identical to SEQ ID NO: 283982

SEQ ID NO: 748891 - RNA, 64 nt, Homo Sapiens; identical to SEQ ID NO: 283983

SEQ ID NO: 748892 - RNA, 64 nt, Homo Sapiens; identical to SEQ ID NO: 283984

SEQ ID NO: 748893 - RNA, 64 nt, Homo Sapiens; identical to SEQ ID NO: 302252

SEQ ID NO: 748894 - RNA, 64 nt, Homo Sapiens; identical to SEQ ID NO: 302253

SEQ ID NO: 748895 - RNA, 64 nt, Homo Sapiens; identical to SEQ ID NO: 302254

SEQ ID NO: 748896 - RNA, 64 nt, Homo Sapiens; identical to SEQ ID NO: 302255

SEQ ID NO: 748897 - RNA, 64 nt, Homo Sapiens; identical to SEQ ID NO: 302256

SEQ ID NO: 748898 - RNA, 64 nt, Homo Sapiens; identical to SEQ ID NO: 302257

SEQ ID NO: 748899 - RNA, 64 nt, Homo Sapiens; identical to SEQ ID NO: 302258

SEQ ID NO: 748900 - RNA, 64 nt, Homo Sapiens; identical to SEQ ID NO: 302259

SEQ ID NO: 748901 - RNA, 64 nt, Homo Sapiens; identical to SEQ ID NO: 302260

SEQ ID NO: 748902 - RNA, 64 nt, Homo Sapiens; identical to SEQ ID NO: 302261

SEQ ID NO: 748903 - RNA, 64 nt, Homo Sapiens; identical to SEQ ID NO: 302262

SEQ ID NO: 748904 - RNA, 64 nt, Homo Sapiens; identical to SEQ ID NO: 302263

SEQ ID NO: 748905 - RNA, 64 nt, Homo Sapiens; identical to SEQ ID NO: 302264

SEQ ID NO: 748906 - RNA, 64 nt, Homo Sapiens; identical to SEQ ID NO: 302265

SEQ ID NO: 748907 - RNA, 64 nt, Homo Sapiens; identical to SEQ ID NO: 302266

SEQ ID NO: 748908 - RNA, 64 nt, Homo Sapiens; identical to SEQ ID NO: 302267

SEQ ID NO: 748909 - RNA, 64 nt, Homo Sapiens; identical to SEQ ID NO: 302268

SEQ ID NO: 748910 - RNA, 64 nt, Homo Sapiens; identical to SEQ ID NO: 302269

SEQ ID NO: 748911 - RNA, 64 nt, Homo Sapiens; identical to SEQ ID NO: 302270

SEQ ID NO: 748912 - RNA, 64 nt, Homo Sapiens; identical to SEQ ID NO: 302271

SEQ ID NO: 748913 - RNA, 64 nt, Homo Sapiens; identical to SEQ ID NO: 302272

SEQ ID NO: 748914 - RNA, 64 nt, Homo Sapiens; identical to SEQ ID NO: 302273

SEQ ID NO: 748915 - RNA, 64 nt, Homo Sapiens; identical to SEQ ID NO: 355308

SEQ ID NO: 748916 - RNA, 64 nt, Homo Sapiens; identical to SEQ ID NO: 355309

SEQ ID NO: 748917 - RNA, 64 nt, Homo Sapiens; identical to SEQ ID NO: 355310

SEQ ID NO: 748918 - RNA, 64 nt, Homo Sapiens; identical to SEQ ID NO: 355311

SEQ ID NO: 748919 - RNA, 64 nt, Homo Sapiens; identical to SEQ ID NO: 355312

SEQ ID NO: 748920 - RNA, 64 nt, Homo Sapiens; identical to SEQ ID NO: 355313

SEQ ID NO: 748921 - RNA, 64 nt, Homo Sapiens; identical to SEQ ID NO: 355314

SEQ ID NO: 748922 - RNA, 64 nt, Homo Sapiens; identical to SEQ ID NO: 355315

SEQ ID NO: 748923 - RNA, 64 nt, Homo Sapiens; identical to SEQ ID NO: 355316

SEQ ID NO: 748924 - RNA, 64 nt, Homo Sapiens; identical to SEQ ID NO: 355317

SEQ ID NO: 748925 - RNA, 64 nt, Homo Sapiens; identical to SEQ ID NO: 355318

SEQ ID NO: 748926 - RNA, 64 nt, Homo Sapiens; identical to SEQ ID NO: 355319

SEQ ID NO: 748927 - RNA, 64 nt, Homo Sapiens; identical to SEQ ID NO: 355320

SEQ ID NO: 748928 - RNA, 64 nt, Homo Sapiens; identical to SEQ ID NO: 355321

SEQ ID NO: 748929 - RNA, 64 nt, Homo Sapiens; identical to SEQ ID NO: 355322

SEQ ID NO: 748930 - RNA, 63 nt, Homo Sapiens; identical to SEQ ID NO: 355323

SEQ ID NO: 748931 - RNA, 64 nt, Homo Sapiens; identical to SEQ ID NO: 355324

SEQ ID NO: 748932 - RNA, 64 nt, Homo Sapiens; identical to SEQ ID NO: 355325

SEQ ID NO: 748933 - RNA, 64 nt, Homo Sapiens; identical to SEQ ID NO: 355326

SEQ ID NO: 748934 - RNA, 64 nt, Homo Sapiens; identical to SEQ ID NO: 355327

SEQ ID NO: 748935 - RNA, 64 nt, Homo Sapiens; identical to SEQ ID NO: 355328

SEQ ID NO: 748936 - RNA, 64 nt, Homo Sapiens; identical to SEQ ID NO: 355329

SEQ ID NO: 748937 - RNA, 64 nt, Homo Sapiens; identical to SEQ ID NO: 355330

SEQ ID NO: 748938 - RNA, 64 nt, Homo Sapiens; identical to SEQ ID NO: 355331

SEQ ID NO: 748939 - RNA, 64 nt, Homo Sapiens; identical to SEQ ID NO: 355332

SEQ ID NO: 748940 - RNA, 65 nt, Homo Sapiens
aacccccuuccuugccuaaggugucugaguuucuggcucuugaggcauuuccagacuugaaauuc

SEQ ID NO: 748941 - RNA, 65 nt, Homo Sapiens
ggcauuuccagacuugaaauucucaucaguccauugcucuugagucuuugcagagaaccucagau

SEQ ID NO: 748942 - RNA, 65 nt, Homo Sapiens
auuguuaacccgcuaggcucucagaaccaccaacugcucuugacaccuuggcugaggauuguauu

SEQ ID NO: 748943 - RNA, 65 nt, Homo Sapiens
uggacagugaguaccuuacucaguaccuuggcuuggcucuugacgcuguuuacucauuggaggaa

SEQ ID NO: 748944 - RNA, 65 nt, Homo Sapiens
aaaaucaacugacuagugcaggaggcuguugauuggcucuugacugugaugcccgcaauucucaa

SEQ ID NO: 748945 - RNA, 65 nt, Homo Sapiens
gugaaaauguccaucuuugggaaauuuucuacccugcucuugagccugauaacccaugccagguc

SEQ ID NO: 748946 - RNA, 64 nt, Homo Sapiens; identical to SEQ ID NO: 292987

SEQ ID NO: 748947 - RNA, 65 nt, Homo Sapiens
caagagcagagccaggcugugcccgagggaccccagcucuugacugcaccuguuucaugccucuc

SEQ ID NO: 748948 - RNA, 65 nt, Homo Sapiens
aucccaggucuccucgaccucugcccauggaggaggcucuugaugaauauuuauuugguuaucaa

SEQ ID NO: 748949 - RNA, 65 nt, Homo Sapiens
ccauaauuugguaguguuggaacaagauguugcaugcucuugagguacaaugaagacuaaaacug

SEQ ID NO: 748950 - RNA, 65 nt, Homo Sapiens
agacaaguggaagggcuguaccuucugaagacagggcucuugaacaagguugucucuuccgaggg

SEQ ID NO: 748951 - RNA, 65 nt, Homo Sapiens
gugauagccaucuacuuuccggccaauuccagguagcucuugaagagcaguaagcuugugauaaa

SEQ ID NO: 748952 - RNA, 65 nt, Homo Sapiens
cggaaacgagugucuucacucauuucuuaggcucagcucuugauaccagccugaccaacgaugag

SEQ ID NO: 748953 - RNA, 65 nt, Homo Sapiens
ugggcacuggccccccggacuuggcgugugggaaagcucuugagcggggacaagugucagcagga

SEQ ID NO: 748954 - RNA, 64 nt, Homo Sapiens; identical to SEQ ID NO: 96419

SEQ ID NO: 748955 - RNA, 64 nt, Homo Sapiens; identical to SEQ ID NO: 96420

SEQ ID NO: 748956 - RNA, 64 nt, Homo Sapiens; identical to SEQ ID NO: 96421

SEQ ID NO: 748957 - RNA, 64 nt, Homo Sapiens; identical to SEQ ID NO: 96422

SEQ ID NO: 748958 - RNA, 64 nt, Homo Sapiens; identical to SEQ ID NO: 96423

SEQ ID NO: 748959 - RNA, 64 nt, Homo Sapiens; identical to SEQ ID NO: 96424

SEQ ID NO: 748960 - RNA, 64 nt, Homo Sapiens; identical to SEQ ID NO: 96425

SEQ ID NO: 748961 - RNA, 64 nt, Homo Sapiens; identical to SEQ ID NO: 96426

SEQ ID NO: 748962 - RNA, 52 nt, Homo Sapiens; identical to SEQ ID NO: 96427

SEQ ID NO: 748963 - RNA, 64 nt, Homo Sapiens; identical to SEQ ID NO: 96428

SEQ ID NO: 748964 - RNA, 64 nt, Homo Sapiens; identical to SEQ ID NO: 96429

SEQ ID NO: 748965 - RNA, 64 nt, Homo Sapiens; identical to SEQ ID NO: 96430

SEQ ID NO: 748966 - RNA, 64 nt, Homo Sapiens; identical to SEQ ID NO: 96431

SEQ ID NO: 748967 - RNA, 64 nt, Homo Sapiens; identical to SEQ ID NO: 96432

SEQ ID NO: 748968 - RNA, 64 nt, Homo Sapiens; identical to SEQ ID NO: 96433

SEQ ID NO: 748969 - RNA, 53 nt, Homo Sapiens; identical to SEQ ID NO: 96434

SEQ ID NO: 748970 - RNA, 64 nt, Homo Sapiens; identical to SEQ ID NO: 96435

SEQ ID NO: 748971 - RNA, 64 nt, Homo Sapiens; identical to SEQ ID NO: 96436

SEQ ID NO: 748972 - RNA, 64 nt, Homo Sapiens; identical to SEQ ID NO: 96437

SEQ ID NO: 748973 - RNA, 64 nt, Homo Sapiens; identical to SEQ ID NO: 96438

SEQ ID NO: 748974 - RNA, 64 nt, Homo Sapiens; identical to SEQ ID NO: 96439

SEQ ID NO: 748975 - RNA, 64 nt, Homo Sapiens; identical to SEQ ID NO: 96440

SEQ ID NO: 748976 - RNA, 64 nt, Homo Sapiens; identical to SEQ ID NO: 96441

SEQ ID NO: 748977 - RNA, 64 nt, Homo Sapiens; identical to SEQ ID NO: 96442

SEQ ID NO: 748978 - RNA, 64 nt, Homo Sapiens; identical to SEQ ID NO: 96443

SEQ ID NO: 748979 - RNA, 64 nt, Homo Sapiens; identical to SEQ ID NO: 96444

SEQ ID NO: 748980 - RNA, 64 nt, Homo Sapiens; identical to SEQ ID NO: 96445

SEQ ID NO: 748981 - RNA, 64 nt, Homo Sapiens; identical to SEQ ID NO: 96446

SEQ ID NO: 748982 - RNA, 64 nt, Homo Sapiens; identical to SEQ ID NO: 96447

SEQ ID NO: 748983 - RNA, 64 nt, Homo Sapiens; identical to SEQ ID NO: 96448

SEQ ID NO: 748984 - RNA, 64 nt, Homo Sapiens; identical to SEQ ID NO: 96449

SEQ ID NO: 748985 - RNA, 64 nt, Homo Sapiens; identical to SEQ ID NO: 96450

SEQ ID NO: 748986 - RNA, 64 nt, Homo Sapiens; identical to SEQ ID NO: 96451

SEQ ID NO: 748987 - RNA, 64 nt, Homo Sapiens; identical to SEQ ID NO: 96452

SEQ ID NO: 748988 - RNA, 64 nt, Homo Sapiens; identical to SEQ ID NO: 96453

SEQ ID NO: 748989 - RNA, 64 nt, Homo Sapiens; identical to SEQ ID NO: 96454

SEQ ID NO: 748990 - RNA, 64 nt, Homo Sapiens; identical to SEQ ID NO: 96455

SEQ ID NO: 748991 - RNA, 64 nt, Homo Sapiens; identical to SEQ ID NO: 96456

SEQ ID NO: 748992 - RNA, 64 nt, Homo Sapiens; identical to SEQ ID NO: 96457

SEQ ID NO: 748993 - RNA, 64 nt, Homo Sapiens; identical to SEQ ID NO: 96458

SEQ ID NO: 748994 - RNA, 64 nt, Homo Sapiens; identical to SEQ ID NO: 96459

SEQ ID NO: 748995 - RNA, 64 nt, Homo Sapiens; identical to SEQ ID NO: 96460

SEQ ID NO: 748996 - RNA, 64 nt, Homo Sapiens; identical to SEQ ID NO: 96461

SEQ ID NO: 748997 - RNA, 64 nt, Homo Sapiens; identical to SEQ ID NO: 96462

SEQ ID NO: 748998 - RNA, 64 nt, Homo Sapiens; identical to SEQ ID NO: 96463

SEQ ID NO: 748999 - RNA, 64 nt, Homo Sapiens; identical to SEQ ID NO: 96464

SEQ ID NO: 749000 - RNA, 64 nt, Homo Sapiens; identical to SEQ ID NO: 96465

SEQ ID NO: 749001 - RNA, 64 nt, Homo Sapiens; identical to SEQ ID NO: 96466

SEQ ID NO: 749002 - RNA, 64 nt, Homo Sapiens; identical to SEQ ID NO: 96467

SEQ ID NO: 749003 - RNA, 64 nt, Homo Sapiens; identical to SEQ ID NO: 96468

SEQ ID NO: 749004 - RNA, 64 nt, Homo Sapiens; identical to SEQ ID NO: 96469

SEQ ID NO: 749005 - RNA, 64 nt, Homo Sapiens; identical to SEQ ID NO: 96470

SEQ ID NO: 749006 - RNA, 64 nt, Homo Sapiens; identical to SEQ ID NO: 96471

SEQ ID NO: 749007 - RNA, 64 nt, Homo Sapiens; identical to SEQ ID NO: 96472

SEQ ID NO: 749008 - RNA, 64 nt, Homo Sapiens; identical to SEQ ID NO: 96473

SEQ ID NO: 749009 - RNA, 64 nt, Homo Sapiens; identical to SEQ ID NO: 96474

SEQ ID NO: 749010 - RNA, 64 nt, Homo Sapiens; identical to SEQ ID NO: 96475

SEQ ID NO: 749011 - RNA, 64 nt, Homo Sapiens; identical to SEQ ID NO: 96476

SEQ ID NO: 749012 - RNA, 64 nt, Homo Sapiens; identical to SEQ ID NO: 96477

SEQ ID NO: 749013 - RNA, 64 nt, Homo Sapiens; identical to SEQ ID NO: 96478

SEQ ID NO: 749014 - RNA, 64 nt, Homo Sapiens; identical to SEQ ID NO: 96479

SEQ ID NO: 749015 - RNA, 64 nt, Homo Sapiens; identical to SEQ ID NO: 96480

SEQ ID NO: 749016 - RNA, 64 nt, Homo Sapiens; identical to SEQ ID NO: 96481

SEQ ID NO: 749017 - RNA, 64 nt, Homo Sapiens; identical to SEQ ID NO: 96482

SEQ ID NO: 749018 - RNA, 64 nt, Homo Sapiens; identical to SEQ ID NO: 96483

SEQ ID NO: 749019 - RNA, 64 nt, Homo Sapiens; identical to SEQ ID NO: 96484

SEQ ID NO: 749020 - RNA, 64 nt, Homo Sapiens; identical to SEQ ID NO: 96485

SEQ ID NO: 749021 - RNA, 64 nt, Homo Sapiens; identical to SEQ ID NO: 96486

SEQ ID NO: 749022 - RNA, 64 nt, Homo Sapiens; identical to SEQ ID NO: 96487

SEQ ID NO: 749023 - RNA, 64 nt, Homo Sapiens; identical to SEQ ID NO: 96488

SEQ ID NO: 749024 - RNA, 64 nt, Homo Sapiens; identical to SEQ ID NO: 96489

SEQ ID NO: 749025 - RNA, 64 nt, Homo Sapiens; identical to SEQ ID NO: 96490

SEQ ID NO: 749026 - RNA, 64 nt, Homo Sapiens; identical to SEQ ID NO: 96491

SEQ ID NO: 749027 - RNA, 64 nt, Homo Sapiens; identical to SEQ ID NO: 96492

SEQ ID NO: 749028 - RNA, 64 nt, Homo Sapiens; identical to SEQ ID NO: 96493

SEQ ID NO: 749029 - RNA, 64 nt, Homo Sapiens; identical to SEQ ID NO: 96494

SEQ ID NO: 749030 - RNA, 64 nt, Homo Sapiens; identical to SEQ ID NO: 96495

SEQ ID NO: 749031 - RNA, 64 nt, Homo Sapiens; identical to SEQ ID NO: 96496

SEQ ID NO: 749032 - RNA, 64 nt, Homo Sapiens; identical to SEQ ID NO: 96497

SEQ ID NO: 749033 - RNA, 64 nt, Homo Sapiens; identical to SEQ ID NO: 96498

SEQ ID NO: 749034 - RNA, 64 nt, Homo Sapiens; identical to SEQ ID NO: 96499

SEQ ID NO: 749035 - RNA, 64 nt, Homo Sapiens; identical to SEQ ID NO: 96500

SEQ ID NO: 749036 - RNA, 64 nt, Homo Sapiens; identical to SEQ ID NO: 96501

SEQ ID NO: 749037 - RNA, 64 nt, Homo Sapiens; identical to SEQ ID NO: 96502

SEQ ID NO: 749038 - RNA, 64 nt, Homo Sapiens; identical to SEQ ID NO: 96503

SEQ ID NO: 749039 - RNA, 64 nt, Homo Sapiens; identical to SEQ ID NO: 96504

SEQ ID NO: 749040 - RNA, 64 nt, Homo Sapiens; identical to SEQ ID NO: 96505

SEQ ID NO: 749041 - RNA, 64 nt, Homo Sapiens; identical to SEQ ID NO: 96506

SEQ ID NO: 749042 - RNA, 64 nt, Homo Sapiens; identical to SEQ ID NO: 96507

SEQ ID NO: 749043 - RNA, 64 nt, Homo Sapiens; identical to SEQ ID NO: 96508

SEQ ID NO: 749044 - RNA, 64 nt, Homo Sapiens; identical to SEQ ID NO: 96509

SEQ ID NO: 749045 - RNA, 64 nt, Homo Sapiens; identical to SEQ ID NO: 96510

SEQ ID NO: 749046 - RNA, 64 nt, Homo Sapiens; identical to SEQ ID NO: 96511

SEQ ID NO: 749047 - RNA, 64 nt, Homo Sapiens; identical to SEQ ID NO: 96512

SEQ ID NO: 749048 - RNA, 64 nt, Homo Sapiens; identical to SEQ ID NO: 96513

SEQ ID NO: 749049 - RNA, 64 nt, Homo Sapiens; identical to SEQ ID NO: 96514

SEQ ID NO: 749050 - RNA, 64 nt, Homo Sapiens; identical to SEQ ID NO: 96515

SEQ ID NO: 749051 - RNA, 64 nt, Homo Sapiens; identical to SEQ ID NO: 96516

SEQ ID NO: 749052 - RNA, 64 nt, Homo Sapiens; identical to SEQ ID NO: 96517

SEQ ID NO: 749053 - RNA, 64 nt, Homo Sapiens; identical to SEQ ID NO: 96518

SEQ ID NO: 749054 - RNA, 64 nt, Homo Sapiens; identical to SEQ ID NO: 96519

SEQ ID NO: 749055 - RNA, 64 nt, Homo Sapiens; identical to SEQ ID NO: 96520

SEQ ID NO: 749056 - RNA, 64 nt, Homo Sapiens; identical to SEQ ID NO: 96521

SEQ ID NO: 749057 - RNA, 64 nt, Homo Sapiens; identical to SEQ ID NO: 96522

SEQ ID NO: 749058 - RNA, 64 nt, Homo Sapiens; identical to SEQ ID NO: 96523

SEQ ID NO: 749059 - RNA, 64 nt, Homo Sapiens; identical to SEQ ID NO: 96524

SEQ ID NO: 749060 - RNA, 64 nt, Homo Sapiens; identical to SEQ ID NO: 96525

SEQ ID NO: 749061 - RNA, 64 nt, Homo Sapiens; identical to SEQ ID NO: 96526

SEQ ID NO: 749062 - RNA, 64 nt, Homo Sapiens; identical to SEQ ID NO: 96527

SEQ ID NO: 749063 - RNA, 64 nt, Homo Sapiens; identical to SEQ ID NO: 96528

SEQ ID NO: 749064 - RNA, 64 nt, Homo Sapiens; identical to SEQ ID NO: 96529

SEQ ID NO: 749065 - RNA, 64 nt, Homo Sapiens; identical to SEQ ID NO: 96530

SEQ ID NO: 749066 - RNA, 64 nt, Homo Sapiens; identical to SEQ ID NO: 96531

SEQ ID NO: 749067 - RNA, 64 nt, Homo Sapiens; identical to SEQ ID NO: 96532

SEQ ID NO: 749068 - RNA, 64 nt, Homo Sapiens; identical to SEQ ID NO: 96533

SEQ ID NO: 749069 - RNA, 64 nt, Homo Sapiens; identical to SEQ ID NO: 96534

SEQ ID NO: 749070 - RNA, 64 nt, Homo Sapiens; identical to SEQ ID NO: 96535

SEQ ID NO: 749071 - RNA, 64 nt, Homo Sapiens; identical to SEQ ID NO: 96536

SEQ ID NO: 749072 - RNA, 64 nt, Homo Sapiens; identical to SEQ ID NO: 96537

SEQ ID NO: 749073 - RNA, 64 nt, Homo Sapiens; identical to SEQ ID NO: 96538

SEQ ID NO: 749074 - RNA, 64 nt, Homo Sapiens; identical to SEQ ID NO: 96539

SEQ ID NO: 749075 - RNA, 64 nt, Homo Sapiens; identical to SEQ ID NO: 96540

SEQ ID NO: 749076 - RNA, 64 nt, Homo Sapiens; identical to SEQ ID NO: 96541

SEQ ID NO: 749077 - RNA, 64 nt, Homo Sapiens; identical to SEQ ID NO: 96542

SEQ ID NO: 749078 - RNA, 64 nt, Homo Sapiens; identical to SEQ ID NO: 96543

SEQ ID NO: 749079 - RNA, 64 nt, Homo Sapiens; identical to SEQ ID NO: 96544

SEQ ID NO: 749080 - RNA, 64 nt, Homo Sapiens; identical to SEQ ID NO: 96545

SEQ ID NO: 749081 - RNA, 64 nt, Homo Sapiens; identical to SEQ ID NO: 96546

SEQ ID NO: 749082 - RNA, 64 nt, Homo Sapiens; identical to SEQ ID NO: 96547

SEQ ID NO: 749083 - RNA, 64 nt, Homo Sapiens; identical to SEQ ID NO: 96548

SEQ ID NO: 749084 - RNA, 64 nt, Homo Sapiens; identical to SEQ ID NO: 96549

SEQ ID NO: 749085 - RNA, 64 nt, Homo Sapiens; identical to SEQ ID NO: 96550

SEQ ID NO: 749086 - RNA, 64 nt, Homo Sapiens; identical to SEQ ID NO: 96551

SEQ ID NO: 749087 - RNA, 64 nt, Homo Sapiens; identical to SEQ ID NO: 96552

SEQ ID NO: 749088 - RNA, 64 nt, Homo Sapiens; identical to SEQ ID NO: 96553

SEQ ID NO: 749089 - RNA, 64 nt, Homo Sapiens; identical to SEQ ID NO: 96554

SEQ ID NO: 749090 - RNA, 64 nt, Homo Sapiens; identical to SEQ ID NO: 96555

SEQ ID NO: 749091 - RNA, 64 nt, Homo Sapiens; identical to SEQ ID NO: 96556

SEQ ID NO: 749092 - RNA, 64 nt, Homo Sapiens; identical to SEQ ID NO: 96557

SEQ ID NO: 749093 - RNA, 64 nt, Homo Sapiens; identical to SEQ ID NO: 96558

SEQ ID NO: 749094 - RNA, 64 nt, Homo Sapiens; identical to SEQ ID NO: 96559

SEQ ID NO: 749095 - RNA, 64 nt, Homo Sapiens; identical to SEQ ID NO: 96560

SEQ ID NO: 749096 - RNA, 64 nt, Homo Sapiens; identical to SEQ ID NO: 96561

SEQ ID NO: 749097 - RNA, 64 nt, Homo Sapiens; identical to SEQ ID NO: 96562

SEQ ID NO: 749098 - RNA, 64 nt, Homo Sapiens; identical to SEQ ID NO: 96563

SEQ ID NO: 749099 - RNA, 64 nt, Homo Sapiens; identical to SEQ ID NO: 96564

SEQ ID NO: 749100 - RNA, 64 nt, Homo Sapiens; identical to SEQ ID NO: 96565

SEQ ID NO: 749101 - RNA, 64 nt, Homo Sapiens; identical to SEQ ID NO: 96566

SEQ ID NO: 749102 - RNA, 64 nt, Homo Sapiens; identical to SEQ ID NO: 96567

SEQ ID NO: 749103 - RNA, 64 nt, Homo Sapiens; identical to SEQ ID NO: 96568

SEQ ID NO: 749104 - RNA, 64 nt, Homo Sapiens; identical to SEQ ID NO: 96569

SEQ ID NO: 749105 - RNA, 64 nt, Homo Sapiens; identical to SEQ ID NO: 96570

SEQ ID NO: 749106 - RNA, 64 nt, Homo Sapiens; identical to SEQ ID NO: 96571

SEQ ID NO: 749107 - RNA, 64 nt, Homo Sapiens; identical to SEQ ID NO: 96572

SEQ ID NO: 749108 - RNA, 64 nt, Homo Sapiens; identical to SEQ ID NO: 96573

SEQ ID NO: 749109 - RNA, 64 nt, Homo Sapiens; identical to SEQ ID NO: 96574

SEQ ID NO: 749110 - RNA, 64 nt, Homo Sapiens; identical to SEQ ID NO: 96575

SEQ ID NO: 749111 - RNA, 64 nt, Homo Sapiens; identical to SEQ ID NO: 96576

SEQ ID NO: 749112 - RNA, 64 nt, Homo Sapiens; identical to SEQ ID NO: 96577

SEQ ID NO: 749113 - RNA, 64 nt, Homo Sapiens; identical to SEQ ID NO: 96578

SEQ ID NO: 749114 - RNA, 64 nt, Homo Sapiens; identical to SEQ ID NO: 96579

SEQ ID NO: 749115 - RNA, 64 nt, Homo Sapiens; identical to SEQ ID NO: 96580

SEQ ID NO: 749116 - RNA, 64 nt, Homo Sapiens; identical to SEQ ID NO: 96581

SEQ ID NO: 749117 - RNA, 64 nt, Homo Sapiens; identical to SEQ ID NO: 96582

SEQ ID NO: 749118 - RNA, 64 nt, Homo Sapiens; identical to SEQ ID NO: 96583

SEQ ID NO: 749119 - RNA, 64 nt, Homo Sapiens; identical to SEQ ID NO: 96584

SEQ ID NO: 749120 - RNA, 64 nt, Homo Sapiens; identical to SEQ ID NO: 96585

SEQ ID NO: 749121 - RNA, 64 nt, Homo Sapiens; identical to SEQ ID NO: 96586

SEQ ID NO: 749122 - RNA, 64 nt, Homo Sapiens; identical to SEQ ID NO: 96587

SEQ ID NO: 749123 - RNA, 64 nt, Homo Sapiens; identical to SEQ ID NO: 96588

SEQ ID NO: 749124 - RNA, 64 nt, Homo Sapiens; identical to SEQ ID NO: 96589

SEQ ID NO: 749125 - RNA, 64 nt, Homo Sapiens; identical to SEQ ID NO: 96590

SEQ ID NO: 749126 - RNA, 64 nt, Homo Sapiens; identical to SEQ ID NO: 96591

SEQ ID NO: 749127 - RNA, 64 nt, Homo Sapiens; identical to SEQ ID NO: 96592

SEQ ID NO: 749128 - RNA, 64 nt, Homo Sapiens; identical to SEQ ID NO: 96593

SEQ ID NO: 749129 - RNA, 64 nt, Homo Sapiens; identical to SEQ ID NO: 96594

SEQ ID NO: 749130 - RNA, 64 nt, Homo Sapiens; identical to SEQ ID NO: 96595

SEQ ID NO: 749131 - RNA, 64 nt, Homo Sapiens; identical to SEQ ID NO: 96596

SEQ ID NO: 749132 - RNA, 64 nt, Homo Sapiens; identical to SEQ ID NO: 96597

SEQ ID NO: 749133 - RNA, 64 nt, Homo Sapiens; identical to SEQ ID NO: 96598

SEQ ID NO: 749134 - RNA, 64 nt, Homo Sapiens; identical to SEQ ID NO: 96599

SEQ ID NO: 749135 - RNA, 64 nt, Homo Sapiens; identical to SEQ ID NO: 96600

SEQ ID NO: 749136 - RNA, 64 nt, Homo Sapiens; identical to SEQ ID NO: 96601

SEQ ID NO: 749137 - RNA, 64 nt, Homo Sapiens; identical to SEQ ID NO: 96602

SEQ ID NO: 749138 - RNA, 64 nt, Homo Sapiens; identical to SEQ ID NO: 96603

SEQ ID NO: 749139 - RNA, 64 nt, Homo Sapiens; identical to SEQ ID NO: 96604

SEQ ID NO: 749140 - RNA, 64 nt, Homo Sapiens; identical to SEQ ID NO: 96605

SEQ ID NO: 749141 - RNA, 64 nt, Homo Sapiens; identical to SEQ ID NO: 96606

SEQ ID NO: 749142 - RNA, 64 nt, Homo Sapiens; identical to SEQ ID NO: 96607

SEQ ID NO: 749143 - RNA, 64 nt, Homo Sapiens; identical to SEQ ID NO: 96608

SEQ ID NO: 749144 - RNA, 64 nt, Homo Sapiens; identical to SEQ ID NO: 96609

SEQ ID NO: 749145 - RNA, 64 nt, Homo Sapiens; identical to SEQ ID NO: 96610

SEQ ID NO: 749146 - RNA, 64 nt, Homo Sapiens; identical to SEQ ID NO: 96611

SEQ ID NO: 749147 - RNA, 64 nt, Homo Sapiens; identical to SEQ ID NO: 96612

SEQ ID NO: 749148 - RNA, 64 nt, Homo Sapiens; identical to SEQ ID NO: 96613

SEQ ID NO: 749149 - RNA, 64 nt, Homo Sapiens; identical to SEQ ID NO: 96614

SEQ ID NO: 749150 - RNA, 64 nt, Homo Sapiens; identical to SEQ ID NO: 96615

SEQ ID NO: 749151 - RNA, 64 nt, Homo Sapiens; identical to SEQ ID NO: 96616

SEQ ID NO: 749152 - RNA, 64 nt, Homo Sapiens; identical to SEQ ID NO: 96617

SEQ ID NO: 749153 - RNA, 64 nt, Homo Sapiens; identical to SEQ ID NO: 96618

SEQ ID NO: 749154 - RNA, 64 nt, Homo Sapiens; identical to SEQ ID NO: 96619

SEQ ID NO: 749155 - RNA, 64 nt, Homo Sapiens; identical to SEQ ID NO: 96620

SEQ ID NO: 749156 - RNA, 64 nt, Homo Sapiens; identical to SEQ ID NO: 96621

SEQ ID NO: 749157 - RNA, 64 nt, Homo Sapiens; identical to SEQ ID NO: 96622

SEQ ID NO: 749158 - RNA, 64 nt, Homo Sapiens; identical to SEQ ID NO: 96623

SEQ ID NO: 749159 - RNA, 64 nt, Homo Sapiens; identical to SEQ ID NO: 96624

SEQ ID NO: 749160 - RNA, 64 nt, Homo Sapiens; identical to SEQ ID NO: 96625

SEQ ID NO: 749161 - RNA, 64 nt, Homo Sapiens; identical to SEQ ID NO: 96626

SEQ ID NO: 749162 - RNA, 64 nt, Homo Sapiens; identical to SEQ ID NO: 96627

SEQ ID NO: 749163 - RNA, 64 nt, Homo Sapiens; identical to SEQ ID NO: 96628

SEQ ID NO: 749164 - RNA, 64 nt, Homo Sapiens; identical to SEQ ID NO: 96629

SEQ ID NO: 749165 - RNA, 64 nt, Homo Sapiens; identical to SEQ ID NO: 96630

SEQ ID NO: 749166 - RNA, 64 nt, Homo Sapiens; identical to SEQ ID NO: 96631

SEQ ID NO: 749167 - RNA, 64 nt, Homo Sapiens; identical to SEQ ID NO: 96632

SEQ ID NO: 749168 - RNA, 64 nt, Homo Sapiens; identical to SEQ ID NO: 96633

SEQ ID NO: 749169 - RNA, 64 nt, Homo Sapiens; identical to SEQ ID NO: 96634

SEQ ID NO: 749170 - RNA, 64 nt, Homo Sapiens; identical to SEQ ID NO: 96635

SEQ ID NO: 749171 - RNA, 64 nt, Homo Sapiens; identical to SEQ ID NO: 96636

SEQ ID NO: 749172 - RNA, 64 nt, Homo Sapiens; identical to SEQ ID NO: 96637

SEQ ID NO: 749173 - RNA, 64 nt, Homo Sapiens; identical to SEQ ID NO: 96638

SEQ ID NO: 749174 - RNA, 64 nt, Homo Sapiens; identical to SEQ ID NO: 96639

SEQ ID NO: 749175 - RNA, 64 nt, Homo Sapiens; identical to SEQ ID NO: 96640

SEQ ID NO: 749176 - RNA, 64 nt, Homo Sapiens; identical to SEQ ID NO: 96641

SEQ ID NO: 749177 - RNA, 64 nt, Homo Sapiens; identical to SEQ ID NO: 96642

SEQ ID NO: 749178 - RNA, 64 nt, Homo Sapiens; identical to SEQ ID NO: 96643

SEQ ID NO: 749179 - RNA, 64 nt, Homo Sapiens; identical to SEQ ID NO: 96644

SEQ ID NO: 749180 - RNA, 64 nt, Homo Sapiens
ggcuugucauugggcugccagugucugccaagccagcauugagcuaauccugugggaggaugag

SEQ ID NO: 749181 - RNA, 64 nt, Homo Sapiens
ccccaacucuugaacgaugaugauauucagacgaagcauugauguuauggaagaaagaaagaaa

SEQ ID NO: 749182 - RNA, 64 nt, Homo Sapiens
cuuaugaaggcauuaggauacuuaugguugauugagcauugagauuuuauaaagaaaauucuau

SEQ ID NO: 749183 - RNA, 64 nt, Homo Sapiens
auuuucugaaucccucaugacaggcuaagugaacagcauugaguaccuaaaauuauagguaggg

SEQ ID NO: 749184 - RNA, 64 nt, Homo Sapiens; identical to SEQ ID NO: 414305

SEQ ID NO: 749185 - RNA, 64 nt, Homo Sapiens; identical to SEQ ID NO: 414306

SEQ ID NO: 749186 - RNA, 64 nt, Homo Sapiens; identical to SEQ ID NO: 189259

SEQ ID NO: 749187 - RNA, 64 nt, Homo Sapiens; identical to SEQ ID NO: 189260

SEQ ID NO: 749188 - RNA, 64 nt, Homo Sapiens; identical to SEQ ID NO: 189261

SEQ ID NO: 749189 - RNA, 64 nt, Homo Sapiens; identical to SEQ ID NO: 189262

SEQ ID NO: 749190 - RNA, 56 nt, Homo Sapiens; identical to SEQ ID NO: 189263

SEQ ID NO: 749191 - RNA, 64 nt, Homo Sapiens; identical to SEQ ID NO: 189264

SEQ ID NO: 749192 - RNA, 64 nt, Homo Sapiens; identical to SEQ ID NO: 189265

SEQ ID NO: 749193 - RNA, 64 nt, Homo Sapiens; identical to SEQ ID NO: 189266

SEQ ID NO: 749194 - RNA, 64 nt, Homo Sapiens; identical to SEQ ID NO: 189267

SEQ ID NO: 749195 - RNA, 64 nt, Homo Sapiens; identical to SEQ ID NO: 189268

SEQ ID NO: 749196 - RNA, 64 nt, Homo Sapiens; identical to SEQ ID NO: 189269

SEQ ID NO: 749197 - RNA, 64 nt, Homo Sapiens; identical to SEQ ID NO: 189270

SEQ ID NO: 749198 - RNA, 64 nt, Homo Sapiens; identical to SEQ ID NO: 189271

SEQ ID NO: 749199 - RNA, 64 nt, Homo Sapiens; identical to SEQ ID NO: 189272

SEQ ID NO: 749200 - RNA, 64 nt, Homo Sapiens; identical to SEQ ID NO: 189273

SEQ ID NO: 749201 - RNA, 64 nt, Homo Sapiens; identical to SEQ ID NO: 189274

SEQ ID NO: 749202 - RNA, 64 nt, Homo Sapiens; identical to SEQ ID NO: 189275

SEQ ID NO: 749203 - RNA, 64 nt, Homo Sapiens; identical to SEQ ID NO: 189276

SEQ ID NO: 749204 - RNA, 64 nt, Homo Sapiens; identical to SEQ ID NO: 189277

SEQ ID NO: 749205 - RNA, 64 nt, Homo Sapiens; identical to SEQ ID NO: 189278

SEQ ID NO: 749206 - RNA, 64 nt, Homo Sapiens; identical to SEQ ID NO: 189279

SEQ ID NO: 749207 - RNA, 64 nt, Homo Sapiens; identical to SEQ ID NO: 189280

SEQ ID NO: 749208 - RNA, 64 nt, Homo Sapiens; identical to SEQ ID NO: 61424

SEQ ID NO: 749209 - RNA, 64 nt, Homo Sapiens; identical to SEQ ID NO: 61425

SEQ ID NO: 749210 - RNA, 64 nt, Homo Sapiens; identical to SEQ ID NO: 61426

SEQ ID NO: 749211 - RNA, 64 nt, Homo Sapiens; identical to SEQ ID NO: 61427

SEQ ID NO: 749212 - RNA, 64 nt, Homo Sapiens; identical to SEQ ID NO: 61428

SEQ ID NO: 749213 - RNA, 64 nt, Homo Sapiens; identical to SEQ ID NO: 61429

SEQ ID NO: 749214 - RNA, 64 nt, Homo Sapiens; identical to SEQ ID NO: 61430

SEQ ID NO: 749215 - RNA, 64 nt, Homo Sapiens; identical to SEQ ID NO: 61431

SEQ ID NO: 749216 - RNA, 64 nt, Homo Sapiens; identical to SEQ ID NO: 61432

SEQ ID NO: 749217 - RNA, 64 nt, Homo Sapiens; identical to SEQ ID NO: 61433

SEQ ID NO: 749218 - RNA, 64 nt, Homo Sapiens; identical to SEQ ID NO: 114741

SEQ ID NO: 749219 - RNA, 64 nt, Homo Sapiens; identical to SEQ ID NO: 114742

SEQ ID NO: 749220 - RNA, 62 nt, Homo Sapiens; identical to SEQ ID NO: 114743

SEQ ID NO: 749221 - RNA, 62 nt, Homo Sapiens; identical to SEQ ID NO: 114744

SEQ ID NO: 749222 - RNA, 62 nt, Homo Sapiens; identical to SEQ ID NO: 114745

SEQ ID NO: 749223 - RNA, 62 nt, Homo Sapiens; identical to SEQ ID NO: 114746

SEQ ID NO: 749224 - RNA, 62 nt, Homo Sapiens; identical to SEQ ID NO: 114747

SEQ ID NO: 749225 - RNA, 62 nt, Homo Sapiens; identical to SEQ ID NO: 114748

SEQ ID NO: 749226 - RNA, 62 nt, Homo Sapiens; identical to SEQ ID NO: 114749

SEQ ID NO: 749227 - RNA, 62 nt, Homo Sapiens; identical to SEQ ID NO: 114750

SEQ ID NO: 749228 - RNA, 62 nt, Homo Sapiens; identical to SEQ ID NO: 114751

SEQ ID NO: 749229 - RNA, 62 nt, Homo Sapiens; identical to SEQ ID NO: 114752

SEQ ID NO: 749230 - RNA, 62 nt, Homo Sapiens; identical to SEQ ID NO: 114753

SEQ ID NO: 749231 - RNA, 62 nt, Homo Sapiens; identical to SEQ ID NO: 114754

SEQ ID NO: 749232 - RNA, 62 nt, Homo Sapiens; identical to SEQ ID NO: 114755

SEQ ID NO: 749233 - RNA, 62 nt, Homo Sapiens; identical to SEQ ID NO: 114756

SEQ ID NO: 749234 - RNA, 62 nt, Homo Sapiens; identical to SEQ ID NO: 114757

SEQ ID NO: 749235 - RNA, 62 nt, Homo Sapiens; identical to SEQ ID NO: 114758

SEQ ID NO: 749236 - RNA, 64 nt, Homo Sapiens; identical to SEQ ID NO: 189259

SEQ ID NO: 749237 - RNA, 64 nt, Homo Sapiens; identical to SEQ ID NO: 189260

SEQ ID NO: 749238 - RNA, 64 nt, Homo Sapiens; identical to SEQ ID NO: 189261

SEQ ID NO: 749239 - RNA, 64 nt, Homo Sapiens; identical to SEQ ID NO: 189262

SEQ ID NO: 749240 - RNA, 56 nt, Homo Sapiens; identical to SEQ ID NO: 189263

SEQ ID NO: 749241 - RNA, 64 nt, Homo Sapiens; identical to SEQ ID NO: 189264

SEQ ID NO: 749242 - RNA, 64 nt, Homo Sapiens; identical to SEQ ID NO: 189265

SEQ ID NO: 749243 - RNA, 64 nt, Homo Sapiens; identical to SEQ ID NO: 189266

SEQ ID NO: 749244 - RNA, 64 nt, Homo Sapiens; identical to SEQ ID NO: 189267

SEQ ID NO: 749245 - RNA, 64 nt, Homo Sapiens; identical to SEQ ID NO: 189268

SEQ ID NO: 749246 - RNA, 64 nt, Homo Sapiens; identical to SEQ ID NO: 189269

SEQ ID NO: 749247 - RNA, 64 nt, Homo Sapiens; identical to SEQ ID NO: 189270

SEQ ID NO: 749248 - RNA, 64 nt, Homo Sapiens; identical to SEQ ID NO: 189271

SEQ ID NO: 749249 - RNA, 64 nt, Homo Sapiens; identical to SEQ ID NO: 189272

SEQ ID NO: 749250 - RNA, 64 nt, Homo Sapiens; identical to SEQ ID NO: 189273

SEQ ID NO: 749251 - RNA, 64 nt, Homo Sapiens; identical to SEQ ID NO: 189274

SEQ ID NO: 749252 - RNA, 64 nt, Homo Sapiens; identical to SEQ ID NO: 189275

SEQ ID NO: 749253 - RNA, 64 nt, Homo Sapiens; identical to SEQ ID NO: 189276

SEQ ID NO: 749254 - RNA, 64 nt, Homo Sapiens; identical to SEQ ID NO: 189277

SEQ ID NO: 749255 - RNA, 64 nt, Homo Sapiens; identical to SEQ ID NO: 189278

SEQ ID NO: 749256 - RNA, 64 nt, Homo Sapiens; identical to SEQ ID NO: 189279

SEQ ID NO: 749257 - RNA, 64 nt, Homo Sapiens; identical to SEQ ID NO: 189280

SEQ ID NO: 749258 - RNA, 64 nt, Homo Sapiens; identical to SEQ ID NO: 97744

SEQ ID NO: 749259 - RNA, 64 nt, Homo Sapiens; identical to SEQ ID NO: 97745

SEQ ID NO: 749260 - RNA, 64 nt, Homo Sapiens; identical to SEQ ID NO: 97746

SEQ ID NO: 749261 - RNA, 64 nt, Homo Sapiens; identical to SEQ ID NO: 97747

SEQ ID NO: 749262 - RNA, 64 nt, Homo Sapiens; identical to SEQ ID NO: 97748

SEQ ID NO: 749263 - RNA, 64 nt, Homo Sapiens; identical to SEQ ID NO: 97749

SEQ ID NO: 749264 - RNA, 64 nt, Homo Sapiens; identical to SEQ ID NO: 97750

SEQ ID NO: 749265 - RNA, 64 nt, Homo Sapiens; identical to SEQ ID NO: 97751

SEQ ID NO: 749266 - RNA, 64 nt, Homo Sapiens; identical to SEQ ID NO: 97752

SEQ ID NO: 749267 - RNA, 64 nt, Homo Sapiens; identical to SEQ ID NO: 97753

SEQ ID NO: 749268 - RNA, 64 nt, Homo Sapiens; identical to SEQ ID NO: 97754

SEQ ID NO: 749269 - RNA, 64 nt, Homo Sapiens; identical to SEQ ID NO: 97755

SEQ ID NO: 749270 - RNA, 64 nt, Homo Sapiens; identical to SEQ ID NO: 97756

SEQ ID NO: 749271 - RNA, 64 nt, Homo Sapiens; identical to SEQ ID NO: 97757

SEQ ID NO: 749272 - RNA, 64 nt, Homo Sapiens; identical to SEQ ID NO: 97758

SEQ ID NO: 749273 - RNA, 64 nt, Homo Sapiens; identical to SEQ ID NO: 97759

SEQ ID NO: 749274 - RNA, 64 nt, Homo Sapiens; identical to SEQ ID NO: 97760

SEQ ID NO: 749275 - RNA, 64 nt, Homo Sapiens; identical to SEQ ID NO: 97761

SEQ ID NO: 749276 - RNA, 64 nt, Homo Sapiens; identical to SEQ ID NO: 97762

SEQ ID NO: 749277 - RNA, 64 nt, Homo Sapiens; identical to SEQ ID NO: 97763

SEQ ID NO: 749278 - RNA, 64 nt, Homo Sapiens; identical to SEQ ID NO: 97764

SEQ ID NO: 749279 - RNA, 64 nt, Homo Sapiens; identical to SEQ ID NO: 97765

SEQ ID NO: 749280 - RNA, 64 nt, Homo Sapiens; identical to SEQ ID NO: 97766

SEQ ID NO: 749281 - RNA, 64 nt, Homo Sapiens; identical to SEQ ID NO: 97767

SEQ ID NO: 749282 - RNA, 64 nt, Homo Sapiens; identical to SEQ ID NO: 97768

SEQ ID NO: 749283 - RNA, 64 nt, Homo Sapiens; identical to SEQ ID NO: 97769

SEQ ID NO: 749284 - RNA, 64 nt, Homo Sapiens; identical to SEQ ID NO: 97770

SEQ ID NO: 749285 - RNA, 64 nt, Homo Sapiens; identical to SEQ ID NO: 97771

SEQ ID NO: 749286 - RNA, 64 nt, Homo Sapiens; identical to SEQ ID NO: 97772

SEQ ID NO: 749287 - RNA, 64 nt, Homo Sapiens; identical to SEQ ID NO: 97773

SEQ ID NO: 749288 - RNA, 64 nt, Homo Sapiens; identical to SEQ ID NO: 97774

SEQ ID NO: 749289 - RNA, 64 nt, Homo Sapiens; identical to SEQ ID NO: 97775

SEQ ID NO: 749290 - RNA, 64 nt, Homo Sapiens; identical to SEQ ID NO: 97776

SEQ ID NO: 749291 - RNA, 64 nt, Homo Sapiens; identical to SEQ ID NO: 97777

SEQ ID NO: 749292 - RNA, 64 nt, Homo Sapiens; identical to SEQ ID NO: 97778

SEQ ID NO: 749293 - RNA, 64 nt, Homo Sapiens; identical to SEQ ID NO: 97779

SEQ ID NO: 749294 - RNA, 64 nt, Homo Sapiens; identical to SEQ ID NO: 97780

SEQ ID NO: 749295 - RNA, 64 nt, Homo Sapiens; identical to SEQ ID NO: 97781

SEQ ID NO: 749296 - RNA, 64 nt, Homo Sapiens; identical to SEQ ID NO: 97782

SEQ ID NO: 749297 - RNA, 64 nt, Homo Sapiens; identical to SEQ ID NO: 97783

SEQ ID NO: 749298 - RNA, 64 nt, Homo Sapiens; identical to SEQ ID NO: 97784

SEQ ID NO: 749299 - RNA, 64 nt, Homo Sapiens; identical to SEQ ID NO: 97785

SEQ ID NO: 749300 - RNA, 59 nt, Homo Sapiens; identical to SEQ ID NO: 76155

SEQ ID NO: 749301 - RNA, 64 nt, Homo Sapiens; identical to SEQ ID NO: 76156

SEQ ID NO: 749302 - RNA, 64 nt, Homo Sapiens; identical to SEQ ID NO: 76157

SEQ ID NO: 749303 - RNA, 64 nt, Homo Sapiens; identical to SEQ ID NO: 76158

SEQ ID NO: 749304 - RNA, 64 nt, Homo Sapiens; identical to SEQ ID NO: 76159

SEQ ID NO: 749305 - RNA, 64 nt, Homo Sapiens; identical to SEQ ID NO: 76160

SEQ ID NO: 749306 - RNA, 64 nt, Homo Sapiens; identical to SEQ ID NO: 76161

SEQ ID NO: 749307 - RNA, 64 nt, Homo Sapiens; identical to SEQ ID NO: 76162

SEQ ID NO: 749308 - RNA, 64 nt, Homo Sapiens; identical to SEQ ID NO: 76163

SEQ ID NO: 749309 - RNA, 64 nt, Homo Sapiens; identical to SEQ ID NO: 76164

SEQ ID NO: 749310 - RNA, 64 nt, Homo Sapiens; identical to SEQ ID NO: 76165

SEQ ID NO: 749311 - RNA, 64 nt, Homo Sapiens; identical to SEQ ID NO: 76166

SEQ ID NO: 749312 - RNA, 64 nt, Homo Sapiens; identical to SEQ ID NO: 76167

SEQ ID NO: 749313 - RNA, 64 nt, Homo Sapiens; identical to SEQ ID NO: 76168

SEQ ID NO: 749314 - RNA, 64 nt, Homo Sapiens; identical to SEQ ID NO: 76169

SEQ ID NO: 749315 - RNA, 58 nt, Homo Sapiens; identical to SEQ ID NO: 76170

SEQ ID NO: 749316 - RNA, 64 nt, Homo Sapiens; identical to SEQ ID NO: 76171

SEQ ID NO: 749317 - RNA, 64 nt, Homo Sapiens; identical to SEQ ID NO: 76172

SEQ ID NO: 749318 - RNA, 64 nt, Homo Sapiens; identical to SEQ ID NO: 76173

SEQ ID NO: 749319 - RNA, 64 nt, Homo Sapiens; identical to SEQ ID NO: 76174

SEQ ID NO: 749320 - RNA, 64 nt, Homo Sapiens; identical to SEQ ID NO: 76175

SEQ ID NO: 749321 - RNA, 52 nt, Homo Sapiens; identical to SEQ ID NO: 76176

SEQ ID NO: 749322 - RNA, 64 nt, Homo Sapiens; identical to SEQ ID NO: 76177

SEQ ID NO: 749323 - RNA, 64 nt, Homo Sapiens; identical to SEQ ID NO: 76178

SEQ ID NO: 749324 - RNA, 64 nt, Homo Sapiens; identical to SEQ ID NO: 76179

SEQ ID NO: 749325 - RNA, 64 nt, Homo Sapiens; identical to SEQ ID NO: 76180

SEQ ID NO: 749326 - RNA, 64 nt, Homo Sapiens; identical to SEQ ID NO: 76181

SEQ ID NO: 749327 - RNA, 64 nt, Homo Sapiens; identical to SEQ ID NO: 76182

SEQ ID NO: 749328 - RNA, 64 nt, Homo Sapiens; identical to SEQ ID NO: 76183

SEQ ID NO: 749329 - RNA, 64 nt, Homo Sapiens; identical to SEQ ID NO: 76184

SEQ ID NO: 749330 - RNA, 64 nt, Homo Sapiens; identical to SEQ ID NO: 76185

SEQ ID NO: 749331 - RNA, 64 nt, Homo Sapiens; identical to SEQ ID NO: 76186

SEQ ID NO: 749332 - RNA, 64 nt, Homo Sapiens; identical to SEQ ID NO: 76187

SEQ ID NO: 749333 - RNA, 64 nt, Homo Sapiens; identical to SEQ ID NO: 76188

SEQ ID NO: 749334 - RNA, 64 nt, Homo Sapiens; identical to SEQ ID NO: 76189

SEQ ID NO: 749335 - RNA, 64 nt, Homo Sapiens; identical to SEQ ID NO: 76190

SEQ ID NO: 749336 - RNA, 64 nt, Homo Sapiens; identical to SEQ ID NO: 76191

SEQ ID NO: 749337 - RNA, 64 nt, Homo Sapiens; identical to SEQ ID NO: 76192

SEQ ID NO: 749338 - RNA, 64 nt, Homo Sapiens; identical to SEQ ID NO: 76193

SEQ ID NO: 749339 - RNA, 64 nt, Homo Sapiens; identical to SEQ ID NO: 76194

SEQ ID NO: 749340 - RNA, 64 nt, Homo Sapiens; identical to SEQ ID NO: 76195

SEQ ID NO: 749341 - RNA, 64 nt, Homo Sapiens; identical to SEQ ID NO: 76196

SEQ ID NO: 749342 - RNA, 64 nt, Homo Sapiens; identical to SEQ ID NO: 76197

SEQ ID NO: 749343 - RNA, 64 nt, Homo Sapiens; identical to SEQ ID NO: 76198

SEQ ID NO: 749344 - RNA, 64 nt, Homo Sapiens; identical to SEQ ID NO: 76199

SEQ ID NO: 749345 - RNA, 64 nt, Homo Sapiens; identical to SEQ ID NO: 76200

SEQ ID NO: 749346 - RNA, 64 nt, Homo Sapiens; identical to SEQ ID NO: 76201

SEQ ID NO: 749347 - RNA, 64 nt, Homo Sapiens; identical to SEQ ID NO: 76202

SEQ ID NO: 749348 - RNA, 64 nt, Homo Sapiens; identical to SEQ ID NO: 76203

SEQ ID NO: 749349 - RNA, 64 nt, Homo Sapiens; identical to SEQ ID NO: 76204

SEQ ID NO: 749350 - RNA, 64 nt, Homo Sapiens; identical to SEQ ID NO: 76205

SEQ ID NO: 749351 - RNA, 64 nt, Homo Sapiens; identical to SEQ ID NO: 76206

SEQ ID NO: 749352 - RNA, 64 nt, Homo Sapiens; identical to SEQ ID NO: 76207

SEQ ID NO: 749353 - RNA, 64 nt, Homo Sapiens; identical to SEQ ID NO: 76208

SEQ ID NO: 749354 - RNA, 64 nt, Homo Sapiens; identical to SEQ ID NO: 76209

SEQ ID NO: 749355 - RNA, 64 nt, Homo Sapiens; identical to SEQ ID NO: 76210

SEQ ID NO: 749356 - RNA, 64 nt, Homo Sapiens; identical to SEQ ID NO: 76211

SEQ ID NO: 749357 - RNA, 64 nt, Homo Sapiens; identical to SEQ ID NO: 76212

SEQ ID NO: 749358 - RNA, 64 nt, Homo Sapiens; identical to SEQ ID NO: 76213

SEQ ID NO: 749359 - RNA, 64 nt, Homo Sapiens; identical to SEQ ID NO: 76214

SEQ ID NO: 749360 - RNA, 64 nt, Homo Sapiens; identical to SEQ ID NO: 76215

SEQ ID NO: 749361 - RNA, 64 nt, Homo Sapiens; identical to SEQ ID NO: 76216

SEQ ID NO: 749362 - RNA, 64 nt, Homo Sapiens; identical to SEQ ID NO: 76217

SEQ ID NO: 749363 - RNA, 64 nt, Homo Sapiens; identical to SEQ ID NO: 76218

SEQ ID NO: 749364 - RNA, 64 nt, Homo Sapiens; identical to SEQ ID NO: 76219

SEQ ID NO: 749365 - RNA, 64 nt, Homo Sapiens
uaugguuggucacgucuaucuugccuuugagaaaguucaagaacauggacuuugaagucagccu

SEQ ID NO: 749366 - RNA, 64 nt, Homo Sapiens
uguugaacuuuaaaaagacagccaggagcuaauuguucaagaagaagggauuacugguccuaca

SEQ ID NO: 749367 - RNA, 64 nt, Homo Sapiens
agucugggcaacacgaugaagccugagcucaggaguucaagaucgaggccgaggcaggcggauu

SEQ ID NO: 749368 - RNA, 64 nt, Homo Sapiens
agccugaccaacacggagaacccugaguucgggaguucaagaccggaggccaaggcaggcggau

SEQ ID NO: 749369 - RNA, 64 nt, Homo Sapiens
ggugauuuggaguaguuuacgcguguucaagacuguucaagacuaagaguacuuuaacgcccau

SEQ ID NO: 749370 - RNA, 64 nt, Homo Sapiens
guucaagacuggugauuugguaacgcccaugcguguucaagacuuguacagauaaagaguacuu

SEQ ID NO: 749371 - RNA, 64 nt, Homo Sapiens
agcccgggcaacguggugaagcuugaggucaggaguucaagaccgaggcugaggcgggcagauc

SEQ ID NO: 749372 - RNA, 64 nt, Homo Sapiens
agccuggccaacauggcgaaaccugaggucaggaguucaagaccgaggccgagucagguggauc

SEQ ID NO: 749373 - RNA, 64 nt, Homo Sapiens
cagacuguggagccaaaggucugucugcccuuggguucaagaaccaggccugggcuguagcaag

SEQ ID NO: 749374 - RNA, 64 nt, Homo Sapiens
cuuaguccuccacagugggugcuguguucuggaaguucaagacaaggccaaguauggggcccug

SEQ ID NO: 749375 - RNA, 64 nt, Homo Sapiens
aauuuacaaaauuucaguuagacaaggcaacugaguucaagagaucuguuguacagcuugguga

SEQ ID NO: 749376 - RNA, 64 nt, Homo Sapiens
gaggccgaggagggcagaucacuugaggucaggaguucaagaccagccuggccaacauggcgaa

SEQ ID NO: 749377 - RNA, 64 nt, Homo Sapiens
agccuggccaacauggugaaaccugaggucaggaguucaagacugaggcaggggcggguggauc

SEQ ID NO: 749378 - RNA, 64 nt, Homo Sapiens
agccuguccaacauggugaaaccugaggucaggaguucaagaccgaggcugaggugguaggauc

SEQ ID NO: 749379 - RNA, 64 nt, Homo Sapiens
agccugggcaaaguagggagaauugagccuagaaguucaagaccgaggccacuguaggaggauc

SEQ ID NO: 749380 - RNA, 64 nt, Homo Sapiens
agcuugggaaacauggcaaaacuugagcucaggaguucaagaccgaggcugaggcagguggauc

SEQ ID NO: 749381 - RNA, 64 nt, Homo Sapiens
ccccaaauuccugccauuuuguauguaacuagagguucaagagaugccaugucuccaauuccua

SEQ ID NO: 749382 - RNA, 64 nt, Homo Sapiens
cagauuucucaauuuggacauagauucucuuuagguucaagaugcauuccuggucuuuucacuu

SEQ ID NO: 749383 - RNA, 64 nt, Homo Sapiens
ggccugagcaacauagugaggcuugagcccaggaguucaagaccgaagacaaugugggagaaug

SEQ ID NO: 749384 - RNA, 64 nt, Homo Sapiens
aguacuucaggcugggcacaggcagcaaugcugaguucaagaaagcagcugggggaggguucag

SEQ ID NO: 749385 - RNA, 64 nt, Homo Sapiens
gaguccaaggcgggcggaucacuugaggucaggaguucaagaccagcuuggccaaggugauaaa

SEQ ID NO: 749386 - RNA, 64 nt, Homo Sapiens
gaggcugaggcgggcagaucacuugaggccaggaguucaagaccagcccaaccaacauggugaa

SEQ ID NO: 749387 - RNA, 64 nt, Homo Sapiens
uacaugccucuggcuuuugagguuacuaggguagguucaagagcuaauguaucuugugaaguau

SEQ ID NO: 749388 - RNA, 64 nt, Homo Sapiens
agccugggcaacauggcgaaacugaagcucaggaguucaagaccaaggccgaggcgggcagauc

SEQ ID NO: 749389 - RNA, 64 nt, Homo Sapiens
agccuggcaaacauggugaaacuugaggccaggaguucaagaccgaggcuaaggcagcuggauc

SEQ ID NO: 749390 - RNA, 64 nt, Homo Sapiens
agccaaggcaacauagugagacuugaaacuaggaguucaagaccgaggccaaggugagaggaua

SEQ ID NO: 749391 - RNA, 64 nt, Homo Sapiens
agccuggccaacauggugaaacuugaggucaggaguucaagaccccagcacugagaggccgauc

SEQ ID NO: 749392 - RNA, 64 nt, Homo Sapiens
agccuggccaacaugaugagacuugaggccaggaguucaagaccgaggccaagguggguggauc

SEQ ID NO: 749393 - RNA, 64 nt, Homo Sapiens
ccacauaauaucugccuuuucaugccuaaggcugguucaagagacacuccugauccucaaccuc

SEQ ID NO: 749394 - RNA, 64 nt, Homo Sapiens
agccuggucaacauggugaaaccuaaggucaggaguucaagaccgaggcugagguggucagauc

SEQ ID NO: 749395 - RNA, 64 nt, Homo Sapiens
agccugggcaauguaguaagaguugagccccagaguucaagaccgaggccaaggugggaggauc

SEQ ID NO: 749396 - RNA, 64 nt, Homo Sapiens
agccuggccaacauggugaaaccugaggucaggaguucaagaccgaggcugaggcaggcggauc

SEQ ID NO: 749397 - RNA, 64 nt, Homo Sapiens; identical to SEQ ID NO: 89670

SEQ ID NO: 749398 - RNA, 64 nt, Homo Sapiens; identical to SEQ ID NO: 89671

SEQ ID NO: 749399 - RNA, 64 nt, Homo Sapiens; identical to SEQ ID NO: 89672

SEQ ID NO: 749400 - RNA, 64 nt, Homo Sapiens; identical to SEQ ID NO: 89673

SEQ ID NO: 749401 - RNA, 64 nt, Homo Sapiens; identical to SEQ ID NO: 89674

SEQ ID NO: 749402 - RNA, 64 nt, Homo Sapiens; identical to SEQ ID NO: 89675

SEQ ID NO: 749403 - RNA, 64 nt, Homo Sapiens; identical to SEQ ID NO: 89676

SEQ ID NO: 749404 - RNA, 64 nt, Homo Sapiens; identical to SEQ ID NO: 89677

SEQ ID NO: 749405 - RNA, 64 nt, Homo Sapiens; identical to SEQ ID NO: 89678

SEQ ID NO: 749406 - RNA, 64 nt, Homo Sapiens; identical to SEQ ID NO: 89679

SEQ ID NO: 749407 - RNA, 64 nt, Homo Sapiens; identical to SEQ ID NO: 89680

SEQ ID NO: 749408 - RNA, 64 nt, Homo Sapiens; identical to SEQ ID NO: 89681

SEQ ID NO: 749409 - RNA, 64 nt, Homo Sapiens
gucuaagaugggaaacugugcagcccuugccagcugacgucacaaugaugaaucggccaacagc

SEQ ID NO: 749410 - RNA, 64 nt, Homo Sapiens
cucugggugucaaccucugacaagaguccuauccugacgucagggguguuucagugcggagugc

SEQ ID NO: 749411 - RNA, 64 nt, Homo Sapiens
ccgagaugcagcaacgacguuggggaacuuggcaugacgucacacagcacgucgcacacagaca

SEQ ID NO: 749412 - RNA, 64 nt, Homo Sapiens
uaucaccguggugauggcgugcaagcaacggcgcugacgucacaggccgcggagaugacgucac

SEQ ID NO: 749413 - RNA, 64 nt, Homo Sapiens
caagcaacggcgcugacguccacggccgcggagaugacgucacgacgaucccucacccagagca

SEQ ID NO: 749414 - RNA, 64 nt, Homo Sapiens; identical to SEQ ID NO: 76474

SEQ ID NO: 749415 - RNA, 64 nt, Homo Sapiens; identical to SEQ ID NO: 76475

SEQ ID NO: 749416 - RNA, 64 nt, Homo Sapiens; identical to SEQ ID NO: 76476

SEQ ID NO: 749417 - RNA, 64 nt, Homo Sapiens; identical to SEQ ID NO: 76477

SEQ ID NO: 749418 - RNA, 64 nt, Homo Sapiens; identical to SEQ ID NO: 76478

SEQ ID NO: 749419 - RNA, 64 nt, Homo Sapiens; identical to SEQ ID NO: 76479

SEQ ID NO: 749420 - RNA, 64 nt, Homo Sapiens; identical to SEQ ID NO: 76480

SEQ ID NO: 749421 - RNA, 64 nt, Homo Sapiens; identical to SEQ ID NO: 76481

SEQ ID NO: 749422 - RNA, 64 nt, Homo Sapiens; identical to SEQ ID NO: 76482

SEQ ID NO: 749423 - RNA, 64 nt, Homo Sapiens; identical to SEQ ID NO: 76483

SEQ ID NO: 749424 - RNA, 64 nt, Homo Sapiens; identical to SEQ ID NO: 23330

SEQ ID NO: 749425 - RNA, 64 nt, Homo Sapiens; identical to SEQ ID NO: 23331

SEQ ID NO: 749426 - RNA, 64 nt, Homo Sapiens; identical to SEQ ID NO: 23332

SEQ ID NO: 749427 - RNA, 64 nt, Homo Sapiens; identical to SEQ ID NO: 23333

SEQ ID NO: 749428 - RNA, 64 nt, Homo Sapiens; identical to SEQ ID NO: 23334

SEQ ID NO: 749429 - RNA, 64 nt, Homo Sapiens; identical to SEQ ID NO: 23335

SEQ ID NO: 749430 - RNA, 64 nt, Homo Sapiens; identical to SEQ ID NO: 23336

SEQ ID NO: 749431 - RNA, 64 nt, Homo Sapiens; identical to SEQ ID NO: 23337

SEQ ID NO: 749432 - RNA, 64 nt, Homo Sapiens; identical to SEQ ID NO: 23338

SEQ ID NO: 749433 - RNA, 64 nt, Homo Sapiens; identical to SEQ ID NO: 23339

SEQ ID NO: 749434 - RNA, 64 nt, Homo Sapiens; identical to SEQ ID NO: 532305

SEQ ID NO: 749435 - RNA, 64 nt, Homo Sapiens; identical to SEQ ID NO: 532306

SEQ ID NO: 749436 - RNA, 64 nt, Homo Sapiens; identical to SEQ ID NO: 532307

SEQ ID NO: 749437 - RNA, 64 nt, Homo Sapiens; identical to SEQ ID NO: 532308

SEQ ID NO: 749438 - RNA, 64 nt, Homo Sapiens; identical to SEQ ID NO: 532309

SEQ ID NO: 749439 - RNA, 57 nt, Homo Sapiens; identical to SEQ ID NO: 83127

SEQ ID NO: 749440 - RNA, 64 nt, Homo Sapiens; identical to SEQ ID NO: 532311

SEQ ID NO: 749441 - RNA, 64 nt, Homo Sapiens; identical to SEQ ID NO: 532312

SEQ ID NO: 749442 - RNA, 64 nt, Homo Sapiens; identical to SEQ ID NO: 532313

SEQ ID NO: 749443 - RNA, 64 nt, Homo Sapiens; identical to SEQ ID NO: 532314

SEQ ID NO: 749444 - RNA, 64 nt, Homo Sapiens; identical to SEQ ID NO: 532315

SEQ ID NO: 749445 - RNA, 64 nt, Homo Sapiens; identical to SEQ ID NO: 532316

SEQ ID NO: 749446 - RNA, 64 nt, Homo Sapiens; identical to SEQ ID NO: 532317

SEQ ID NO: 749447 - RNA, 64 nt, Homo Sapiens; identical to SEQ ID NO: 532318

SEQ ID NO: 749448 - RNA, 59 nt, Homo Sapiens; identical to SEQ ID NO: 83136

SEQ ID NO: 749449 - RNA, 64 nt, Homo Sapiens; identical to SEQ ID NO: 532320

SEQ ID NO: 749450 - RNA, 64 nt, Homo Sapiens; identical to SEQ ID NO: 532321

SEQ ID NO: 749451 - RNA, 64 nt, Homo Sapiens; identical to SEQ ID NO: 532322

SEQ ID NO: 749452 - RNA, 64 nt, Homo Sapiens; identical to SEQ ID NO: 532323

SEQ ID NO: 749453 - RNA, 64 nt, Homo Sapiens; identical to SEQ ID NO: 532324

SEQ ID NO: 749454 - RNA, 64 nt, Homo Sapiens; identical to SEQ ID NO: 532325

SEQ ID NO: 749455 - RNA, 64 nt, Homo Sapiens; identical to SEQ ID NO: 532326

SEQ ID NO: 749456 - RNA, 64 nt, Homo Sapiens; identical to SEQ ID NO: 532327

SEQ ID NO: 749457 - RNA, 64 nt, Homo Sapiens; identical to SEQ ID NO: 532328

SEQ ID NO: 749458 - RNA, 64 nt, Homo Sapiens; identical to SEQ ID NO: 532329

SEQ ID NO: 749459 - RNA, 64 nt, Homo Sapiens; identical to SEQ ID NO: 532330

SEQ ID NO: 749460 - RNA, 64 nt, Homo Sapiens; identical to SEQ ID NO: 532331

SEQ ID NO: 749461 - RNA, 64 nt, Homo Sapiens; identical to SEQ ID NO: 532332

SEQ ID NO: 749462 - RNA, 64 nt, Homo Sapiens; identical to SEQ ID NO: 532333

SEQ ID NO: 749463 - RNA, 64 nt, Homo Sapiens; identical to SEQ ID NO: 532334

SEQ ID NO: 749464 - RNA, 64 nt, Homo Sapiens; identical to SEQ ID NO: 532335

SEQ ID NO: 749465 - RNA, 64 nt, Homo Sapiens; identical to SEQ ID NO: 532336

SEQ ID NO: 749466 - RNA, 64 nt, Homo Sapiens; identical to SEQ ID NO: 532337

SEQ ID NO: 749467 - RNA, 64 nt, Homo Sapiens; identical to SEQ ID NO: 532338

SEQ ID NO: 749468 - RNA, 64 nt, Homo Sapiens
ccccgugaagguguaugccacaccuggccuuaaagagggacaggcugaagagagggacaggcac

SEQ ID NO: 749469 - RNA, 64 nt, Homo Sapiens
ccacaccuggccuuaaagagggacaggcugaagagagggacaggcacuccaaaccugucuuggg

SEQ ID NO: 749470 - RNA, 64 nt, Homo Sapiens
uucuguugggggugacaccagugacaccaggagagagggacaggagggacagguucugucaggg

SEQ ID NO: 749471 - RNA, 64 nt, Homo Sapiens
uucugucaggggugacaccagugacaccaggagagagggacaggagggacagguucugucgggg

SEQ ID NO: 749472 - RNA, 64 nt, Homo Sapiens
uucuguugggggugacaagagugacaccaggagagagggacaggagggacagguucuaucaugg

SEQ ID NO: 749473 - RNA, 64 nt, Homo Sapiens
uucugucaggggugacaccaugcaaaccaggagagagggacagggaauaacaaacugcacaacc

SEQ ID NO: 749474 - RNA, 64 nt, Homo Sapiens
gaggagaggugcugggcacccggucuguggggacgagggacacuaggcucgccaggcccugauc

SEQ ID NO: 749475 - RNA, 64 nt, Homo Sapiens
gaggacagcuuccccaucgccauugccuucuggggagggacacaagcacagagagcggcuuccc

SEQ ID NO: 749476 - RNA, 64 nt, Homo Sapiens
gaggacggcuuccccaucgccauugccuucuggggagggacacaagcacagaggauggcuuccc

SEQ ID NO: 749477 - RNA, 64 nt, Homo Sapiens
uuagcuggugaggaacgugcaggcacugaggcuggagggacauggagcccccucuuccagacac

SEQ ID NO: 749478 - RNA, 64 nt, Homo Sapiens
ucgcccauuggacuuccugaccucuucugucuuugagggacagagaccaagcuagauccuuuuu

SEQ ID NO: 749479 - RNA, 64 nt, Homo Sapiens
gggcacccuaaguuugggaagcuaacuucaaggugagggacauuagcaaaguugugguucucuu

SEQ ID NO: 749480 - RNA, 64 nt, Homo Sapiens
ggcaucuggaugaaaaucuccuguucugacgggugagggacagaagaaggugguaccugauggu

SEQ ID NO: 749481 - RNA, 64 nt, Homo Sapiens
uacauguuccuuccgaguuuucuuucgcuggaaagagggacaggggcccccacccgucaccacg

SEQ ID NO: 749482 - RNA, 64 nt, Homo Sapiens
cuacugggcuuggagcacguccgggcaguggagggagggacacagccugggacaggaagccucu

SEQ ID NO: 749483 - RNA, 64 nt, Homo Sapiens
gacccagagggcagcgucaggccagugggggagggagggacagaucaacaaacaaacaaaaaga

SEQ ID NO: 749484 - RNA, 64 nt, Homo Sapiens
gccaaaaggauagagaaagaguccagacaugauagagggacagagggggagaaaacuguacucu

SEQ ID NO: 749485 - RNA, 64 nt, Homo Sapiens; identical to SEQ ID NO: 568041

SEQ ID NO: 749486 - RNA, 64 nt, Homo Sapiens; identical to SEQ ID NO: 568042

SEQ ID NO: 749487 - RNA, 64 nt, Homo Sapiens; identical to SEQ ID NO: 568043

SEQ ID NO: 749488 - RNA, 64 nt, Homo Sapiens; identical to SEQ ID NO: 568044

SEQ ID NO: 749489 - RNA, 64 nt, Homo Sapiens; identical to SEQ ID NO: 568045

SEQ ID NO: 749490 - RNA, 64 nt, Homo Sapiens; identical to SEQ ID NO: 568046

SEQ ID NO: 749491 - RNA, 64 nt, Homo Sapiens; identical to SEQ ID NO: 568047

SEQ ID NO: 749492 - RNA, 64 nt, Homo Sapiens; identical to SEQ ID NO: 568048

SEQ ID NO: 749493 - RNA, 64 nt, Homo Sapiens; identical to SEQ ID NO: 568049

SEQ ID NO: 749494 - RNA, 64 nt, Homo Sapiens; identical to SEQ ID NO: 568050

SEQ ID NO: 749495 - RNA, 64 nt, Homo Sapiens; identical to SEQ ID NO: 568051

SEQ ID NO: 749496 - RNA, 64 nt, Homo Sapiens; identical to SEQ ID NO: 568052

SEQ ID NO: 749497 - RNA, 63 nt, Homo Sapiens
auggggagggagugggccuggaucugggaccucccuccagaauuuccuccagaugggggcagu

SEQ ID NO: 749498 - RNA, 63 nt, Homo Sapiens
ugggccuggaucugggaccucccuccagaauuuccuccagaugggggcagugcccagggaggg

SEQ ID NO: 749499 - RNA, 57 nt, Homo Sapiens; identical to SEQ ID NO: 510926

SEQ ID NO: 749500 - RNA, 63 nt, Homo Sapiens
accccugugcaaauuuuaaaaaggaacccuuuuccuccagacagauacagccccaaaccaggg

SEQ ID NO: 749501 - RNA, 63 nt, Homo Sapiens
ccugaguuucuuggcugcauaguaaggcucuccccuccagagcgugcauguggaaaguaucag

SEQ ID NO: 749502 - RNA, 63 nt, Homo Sapiens
ucccacccugacagcccaacucaaagagaaaccccuccagaacgcuuuccuagauccacacuu

SEQ ID NO: 749503 - RNA, 63 nt, Homo Sapiens
agcagauuaaccccaggcagaccgauaaaaagaccuccagauaggcagacagacagauggacc

SEQ ID NO: 749504 - RNA, 63 nt, Homo Sapiens
uugauggauggaccccagcuagucagacaugauccuccagauugacagacaagucccccaaau

SEQ ID NO: 749505 - RNA, 63 nt, Homo Sapiens
aagcucugcuucacccuggagaccacucuccugccuccagagaugccuguauuggucccuucu

SEQ ID NO: 749506 - RNA, 63 nt, Homo Sapiens
uugaaugguuccuuguucuucccuuccucuuggccuccagauuaaagccaguggcuccuuucu

SEQ ID NO: 749507 - RNA, 63 nt, Homo Sapiens
cauacuggaagccaccucugucuuggaagacccccuccagaagugacccuuaagugccacccu

SEQ ID NO: 749508 - RNA, 63 nt, Homo Sapiens
ggugggugccuggguugagaccucuucucacugccuccagagauaccauucccauuuucucag

SEQ ID NO: 749509 - RNA, 63 nt, Homo Sapiens
ucuuugugcauaggcacaagcuccugugaguggccuccagauggcccacagaccugucgggug

SEQ ID NO: 749510 - RNA, 63 nt, Homo Sapiens
ggaagcauggguuugcccaccccggcccauaccccuccagacaccuggugccaacaggggcau

SEQ ID NO: 749511 - RNA, 63 nt, Homo Sapiens
guccuuucaaggggaaaaugugaagcugaacccccuccagacacccagaauguagcaucugag

SEQ ID NO: 749512 - RNA, 63 nt, Homo Sapiens
cacagcugcuggccaggguagacuuggagcuguccuccagaggggucacguguaggagugaga

SEQ ID NO: 749513 - RNA, 63 nt, Homo Sapiens
aggcguccugucuucacgggggggucccgguggccuccagacguagccauuuccugacaucaa

SEQ ID NO: 749514 - RNA, 63 nt, Homo Sapiens
aguaaacuggaaaugagacauugacgugcugcuccuccagaggucugcacacuccacuucaca

SEQ ID NO: 749515 - RNA, 63 nt, Homo Sapiens
cagccagccccgucaggggcaggcugguccucaccuccagagcuucauauaccugccugagau

SEQ ID NO: 749516 - RNA, 63 nt, Homo Sapiens
gguaaugguggcagaacccaugcgcagcaggcaccuccagaaaagagcgagagcagagcaaac

SEQ ID NO: 749517 - RNA, 63 nt, Homo Sapiens
gagugaccguggcacuuggguguacagguaauuccuccagagcuguuugcuggcuucaggagu

SEQ ID NO: 749518 - RNA, 63 nt, Homo Sapiens
uugcauucugccguguuuauagguguucacuuuccuccagagcugauuaacuacugacaugac

SEQ ID NO: 749519 - RNA, 63 nt, Homo Sapiens
cuacugcuucugucccugcuggcagccucugucccuccagaacggcuaaccagagcacacugu

SEQ ID NO: 749520 - RNA, 63 nt, Homo Sapiens
ggccugcccguacuccuccacccagaugagggcccuccagagccugcaggcaucuguggggaa

SEQ ID NO: 749521 - RNA, 63 nt, Homo Sapiens
acugcagugaccaguggguguggcuggguccagccuccagaucuggcccgcacgaugccuugc

SEQ ID NO: 749522 - RNA, 63 nt, Homo Sapiens
gucacucugaaagggaguuguggagaggagacgccuccagacucucagaaguuuugaggacug

SEQ ID NO: 749523 - RNA, 63 nt, Homo Sapiens
ugugagaaauaaauguguuuuuggaccucccagccuccagaacugucugcuggcaccuugauc

SEQ ID NO: 749524 - RNA, 63 nt, Homo Sapiens
cauuuuguuugcuuugacccgggcuacacugaaccuccagaaucauacaacauacuuaaugca

SEQ ID NO: 749525 - RNA, 63 nt, Homo Sapiens
cggccuuucugguuaaccccaggugugcccagcccuccagaccgucaccaggagaugaggguu

SEQ ID NO: 749526 - RNA, 63 nt, Homo Sapiens
agcaggcacaggugggcauuugccuccaaguuaccuccagaucggagguuuuuaagcaguacg

SEQ ID NO: 749527 - RNA, 63 nt, Homo Sapiens
uagcugaggccaacgcaggccucccccacagagccuccagagcacugcaaggcccaccugccc

SEQ ID NO: 749528 - RNA, 63 nt, Homo Sapiens
cccgccaggugggcauggucagacaggcagaccccuccagaggagcucgagagccagacggcc

SEQ ID NO: 749529 - RNA, 63 nt, Homo Sapiens
ugaguacuuauggcccugaaagcggccacggugccuccagauggcagguuugcaauccaagca

SEQ ID NO: 749530 - RNA, 63 nt, Homo Sapiens
gauauaccugauauauuccaccaggauauccucccuccagauauacuugguucucuccaccag

SEQ ID NO: 749531 - RNA, 63 nt, Homo Sapiens
caaggcgucgaggaauuggaaagauuugcacacccuccagaaaggagagacgcaaucuccccu

SEQ ID NO: 749532 - RNA, 63 nt, Homo Sapiens
cgguuccucuccacgcaucucgaggcggcguuaccuccagauuccguagaguuagagucacau

SEQ ID NO: 749533 - RNA, 63 nt, Homo Sapiens
cagcgcucugcucauguccgccaucgcagugauccuccagagagugugcuggucuaaauuaau

SEQ ID NO: 749534 - RNA, 63 nt, Homo Sapiens
augcgccccuccugguucccccugccccaccguccuccagagaaccgagaaugaggagcccuc

SEQ ID NO: 749535 - RNA, 63 nt, Homo Sapiens
ucacacugccgaggaggccuguccaggcagaccccuccagaccgggagcauccuaaaaauggg

SEQ ID NO: 749536 - RNA, 63 nt, Homo Sapiens
aucaaagaagggaagaaacugccagcugcagguccuccagaaaauggagccugucucaggaag

SEQ ID NO: 749537 - RNA, 63 nt, Homo Sapiens
gaggaacgguguuauggacugaauguucauguuccuccagaauucauaugcugaagccucugu

SEQ ID NO: 749538 - RNA, 63 nt, Homo Sapiens
cgucugcuggcaccuugaucuugaacuucccagccuccagaacugugagaaagaaaucucuau

SEQ ID NO: 749539 - RNA, 63 nt, Homo Sapiens
aacccagggaggaagacuguuaaucauccccauccuccagagaacuaaggugcuaggaauucg

SEQ ID NO: 749540 - RNA, 63 nt, Homo Sapiens
ggaacucaagcugguuuuaaauggcgccugcucccuccagaauuugaccucaucucccgagca

SEQ ID NO: 749541 - RNA, 63 nt, Homo Sapiens
uuuggccaccaguucuucggccagcaccucugcccuccagaaccugcagccuggaggggugag

SEQ ID NO: 749542 - RNA, 63 nt, Homo Sapiens
ucuucucccgucugcccugcggguugcccgccuccuccagagacuugcccaagggcccaucac

SEQ ID NO: 749543 - RNA, 63 nt, Homo Sapiens
cucucaaugaagagucaccuuaaaagcucccagccuccagagguacauugcaaagccuuacuc

SEQ ID NO: 749544 - RNA, 63 nt, Homo Sapiens
auuggaaucacuguuugccaagaggccuagggaccuccagaccaagccccagguugagagaac

SEQ ID NO: 749545 - RNA, 63 nt, Homo Sapiens
agcuggaaaaguuuauggagcggagacuuccugccuccagacgggccggggcaagcacuucau

SEQ ID NO: 749546 - RNA, 63 nt, Homo Sapiens
aaccgugagaaccaggcauuuggaaaccauugcccuccagaacagcggacgggggucccgagg

SEQ ID NO: 749547 - RNA, 63 nt, Homo Sapiens
agcugggauuacaggcguacucuccugccucagccuccagaauaucuccuggauucaaacaau

SEQ ID NO: 749548 - RNA, 63 nt, Homo Sapiens
aaagagaaagacuucggacaaggcucuaugugaccuccagagccagcagaucuuggauggucc

SEQ ID NO: 749549 - RNA, 63 nt, Homo Sapiens
ccugcaugcacuggcugaagccugcuggcaucaccuccagagcccagugccucaccuccagau

SEQ ID NO: 749550 - RNA, 63 nt, Homo Sapiens
cugcuggcaucaccuccagaacccagugccucaccuccagauccuccgggugucugagaaacc

SEQ ID NO: 749551 - RNA, 63 nt, Homo Sapiens
gcuauccugggagaucuaccugaaggagaacuaccuccagaaccgacaguuccagcaaaagca

SEQ ID NO: 749552 - RNA, 63 nt, Homo Sapiens
gcgcaucccacucuaugcgaaccacaagacccuccuccagaaggcagccgcugaguucggggc

SEQ ID NO: 749553 - RNA, 63 nt, Homo Sapiens
uguggaaacaaagcaggaccagcaggcacagcaccuccagaacagugccccggaugaccagag

SEQ ID NO: 749554 - RNA, 63 nt, Homo Sapiens
ugcccagaggcaacccuugccagucuguuuaucccuccagauacagucucugauaguaaacuu

SEQ ID NO: 749555 - RNA, 63 nt, Homo Sapiens
uucugucuggggacgaaggguuggacgggaugaccuccagaagucccuucaauuucuaguacc

SEQ ID NO: 749556 - RNA, 63 nt, Homo Sapiens
gaugaccugccccaaguggugagcaagcaccaaccuccagacucagcagagugaggggguaaa

SEQ ID NO: 749557 - RNA, 64 nt, Homo Sapiens
uuauuacacaagcacagccgcccagugugcacaucaugugcagacaccuuggaaaccuuuccca

SEQ ID NO: 749558 - RNA, 64 nt, Homo Sapiens
ugccagugaggucagcuucugcccuccagcaauacaugugcagggguugcugcuuucccagugc

SEQ ID NO: 749559 - RNA, 64 nt, Homo Sapiens
auguaugguaggaauguauucaucuggaucguaacaugugcagaauuuuacuguggagcgcuaa

SEQ ID NO: 749560 - RNA, 64 nt, Homo Sapiens
uuugucuauuuuuucuauaaaaagcuguaaauugcaugugcauaagcacaaggauuaaguugga

SEQ ID NO: 749561 - RNA, 64 nt, Homo Sapiens
caagcugugugacaagauauuuauguacauauaucaugugcauuaaugcauugaugucauuuua

SEQ ID NO: 749562 - RNA, 56 nt, Homo Sapiens
ucgggaagcaggccugcauccagaagcaugugcacuacggugaaaguaacgucuga

SEQ ID NO: 749563 - RNA, 64 nt, Homo Sapiens
agguguaagcauagaugaaauaacuguccugucacaugugcagcaggccauggaguguagcggg

SEQ ID NO: 749564 - RNA, 64 nt, Homo Sapiens
cuccaucgagcuguuugguuccauguguguuuaacaugugcagaaguagcuucucuguuuaagu

SEQ ID NO: 749565 - RNA, 64 nt, Homo Sapiens
acauugggcaaaguugcuucuaauccuuauuucccaugugcacaagucuuuuuguauuccagcu

SEQ ID NO: 749566 - RNA, 64 nt, Homo Sapiens
uauaucaucccaucugaaaaacacuaauuauugacaugugcaucuguacaauaaacuuaaaaug

SEQ ID NO: 749567 - RNA, 64 nt, Homo Sapiens
gaaggauaaaagaucuagucaagguguacaugugcaugugcaugcaaaagcuuauaauggaacu

SEQ ID NO: 749568 - RNA, 64 nt, Homo Sapiens
ugcauggaaggauaaaagauggaacuaagguguacaugugcauguuucaccaaaagcuuauaau

SEQ ID NO: 749569 - RNA, 64 nt, Homo Sapiens
uugugcagguuaguuacauauaaguuuuaggguacaugugcacauucuuuuuuuuauuauacuc

SEQ ID NO: 749570 - RNA, 64 nt, Homo Sapiens
cccacucagagaugcauuugaguacaugcacacucaugugcaaaagauaaagagauagagagug

SEQ ID NO: 749571 - RNA, 64 nt, Homo Sapiens; identical to SEQ ID NO: 259948

SEQ ID NO: 749572 - RNA, 64 nt, Homo Sapiens; identical to SEQ ID NO: 259949

SEQ ID NO: 749573 - RNA, 64 nt, Homo Sapiens; identical to SEQ ID NO: 259950

SEQ ID NO: 749574 - RNA, 64 nt, Homo Sapiens; identical to SEQ ID NO: 259951

SEQ ID NO: 749575 - RNA, 64 nt, Homo Sapiens; identical to SEQ ID NO: 259952

SEQ ID NO: 749576 - RNA, 64 nt, Homo Sapiens; identical to SEQ ID NO: 259953

SEQ ID NO: 749577 - RNA, 64 nt, Homo Sapiens; identical to SEQ ID NO: 259954

SEQ ID NO: 749578 - RNA, 64 nt, Homo Sapiens; identical to SEQ ID NO: 259955

SEQ ID NO: 749579 - RNA, 64 nt, Homo Sapiens; identical to SEQ ID NO: 259956

SEQ ID NO: 749580 - RNA, 64 nt, Homo Sapiens; identical to SEQ ID NO: 259957

SEQ ID NO: 749581 - RNA, 64 nt, Homo Sapiens; identical to SEQ ID NO: 259958

SEQ ID NO: 749582 - RNA, 64 nt, Homo Sapiens; identical to SEQ ID NO: 259959

SEQ ID NO: 749583 - RNA, 64 nt, Homo Sapiens; identical to SEQ ID NO: 259960

SEQ ID NO: 749584 - RNA, 64 nt, Homo Sapiens; identical to SEQ ID NO: 259961

SEQ ID NO: 749585 - RNA, 64 nt, Homo Sapiens; identical to SEQ ID NO: 259962

SEQ ID NO: 749586 - RNA, 64 nt, Homo Sapiens; identical to SEQ ID NO: 259963

SEQ ID NO: 749587 - RNA, 64 nt, Homo Sapiens; identical to SEQ ID NO: 259964

SEQ ID NO: 749588 - RNA, 64 nt, Homo Sapiens; identical to SEQ ID NO: 259965

SEQ ID NO: 749589 - RNA, 64 nt, Homo Sapiens; identical to SEQ ID NO: 259966

SEQ ID NO: 749590 - RNA, 64 nt, Homo Sapiens; identical to SEQ ID NO: 259967

SEQ ID NO: 749591 - RNA, 64 nt, Homo Sapiens; identical to SEQ ID NO: 259968

SEQ ID NO: 749592 - RNA, 64 nt, Homo Sapiens; identical to SEQ ID NO: 259969

SEQ ID NO: 749593 - RNA, 64 nt, Homo Sapiens; identical to SEQ ID NO: 220121

SEQ ID NO: 749594 - RNA, 64 nt, Homo Sapiens; identical to SEQ ID NO: 220122

SEQ ID NO: 749595 - RNA, 64 nt, Homo Sapiens; identical to SEQ ID NO: 220123

SEQ ID NO: 749596 - RNA, 64 nt, Homo Sapiens; identical to SEQ ID NO: 220124

SEQ ID NO: 749597 - RNA, 64 nt, Homo Sapiens; identical to SEQ ID NO: 220125

SEQ ID NO: 749598 - RNA, 64 nt, Homo Sapiens; identical to SEQ ID NO: 220126

SEQ ID NO: 749599 - RNA, 64 nt, Homo Sapiens; identical to SEQ ID NO: 220127

SEQ ID NO: 749600 - RNA, 64 nt, Homo Sapiens; identical to SEQ ID NO: 220128

SEQ ID NO: 749601 - RNA, 64 nt, Homo Sapiens; identical to SEQ ID NO: 220129

SEQ ID NO: 749602 - RNA, 64 nt, Homo Sapiens; identical to SEQ ID NO: 220130

SEQ ID NO: 749603 - RNA, 64 nt, Homo Sapiens; identical to SEQ ID NO: 220131

SEQ ID NO: 749604 - RNA, 64 nt, Homo Sapiens; identical to SEQ ID NO: 220132

SEQ ID NO: 749605 - RNA, 63 nt, Homo Sapiens
caguguucaccuggugucacuuccaggcaauguucugugcagccgcucuuaguauucuuccuu

SEQ ID NO: 749606 - RNA, 63 nt, Homo Sapiens
agggucccaaaagugugggugccugacuuccucucugugcagcacucucugaaucccuccuau

SEQ ID NO: 749607 - RNA, 63 nt, Homo Sapiens
acacgguguuuuaagcuugaccuucuauucauaucugugcagaugcugcuacuguuuugccau

SEQ ID NO: 749608 - RNA, 63 nt, Homo Sapiens
ggaaggaggaggggcgaaagcauggacauguccucugugcaguccuuucccaagcaucugugg

SEQ ID NO: 749609 - RNA, 63 nt, Homo Sapiens
agaagucuugcuguccauggugguguaggaauuucugugcaacaccucaccacgucugguuaa

SEQ ID NO: 749610 - RNA, 63 nt, Homo Sapiens
uauguauuuaaagaaaaaugcaccaggauggugucugugcacgugacuauuagaggagcgucu

SEQ ID NO: 749611 - RNA, 63 nt, Homo Sapiens
gguaccuguuuucaguaaaaagggguccugaguucugugcagguggaagagcuacccgagaac

SEQ ID NO: 749612 - RNA, 63 nt, Homo Sapiens
cagguggaagagcuacccgagaacuaccugaguucugugcagguagagucccauuucuuaugg

SEQ ID NO: 749613 - RNA, 63 nt, Homo Sapiens
uccuuggaggcgagaugagcagaacaaaccauuucugugcacagcaccuugucucccuuccca

SEQ ID NO: 749614 - RNA, 63 nt, Homo Sapiens
ugggagugcuccacucccuaggagcaccuauuuucugugcacaacuucacuagagcuuacucu

SEQ ID NO: 749615 - RNA, 63 nt, Homo Sapiens
ugccaucccuauuggagauugugaauccugcugucugugcagggcucauagugaguguucugu

SEQ ID NO: 749616 - RNA, 63 nt, Homo Sapiens
uggcagggcaccccugcugggguugggggcuggucugugcauaauccuggacugugaugggaa

SEQ ID NO: 749617 - RNA, 63 nt, Homo Sapiens
cuggugcuuccgcagaaaggacauccuaugcuuucugugcagacucuagcccauuaauacaau

SEQ ID NO: 749618 - RNA, 63 nt, Homo Sapiens
ccagcagggccccaucucuaggucguugucccuucugugcaggcuaaaaggaccccaaauggu

SEQ ID NO: 749619 - RNA, 63 nt, Homo Sapiens
gugcugacuucaucucccaccuagcagcaccguucugugcacaaaacccagaccuguuagcag

SEQ ID NO: 749620 - RNA, 63 nt, Homo Sapiens
gccagcacacagggcagugagggagggcugucaucugugcacugcccauggacaggcuggcuc

SEQ ID NO: 749621 - RNA, 63 nt, Homo Sapiens
ugccucuguagagagcagcauuugcaggaucugucugugcacauggaaagucaugcaauccca

SEQ ID NO: 749622 - RNA, 63 nt, Homo Sapiens
cugcaguggcuccccugccccacucucugccauucugugcagggugaacuugucuggcuuugg

SEQ ID NO: 749623 - RNA, 64 nt, Homo Sapiens; identical to SEQ ID NO: 676524

SEQ ID NO: 749624 - RNA, 64 nt, Homo Sapiens; identical to SEQ ID NO: 676525

SEQ ID NO: 749625 - RNA, 64 nt, Homo Sapiens; identical to SEQ ID NO: 676526

SEQ ID NO: 749626 - RNA, 64 nt, Homo Sapiens; identical to SEQ ID NO: 676527

SEQ ID NO: 749627 - RNA, 64 nt, Homo Sapiens; identical to SEQ ID NO: 676528

SEQ ID NO: 749628 - RNA, 64 nt, Homo Sapiens; identical to SEQ ID NO: 676529

SEQ ID NO: 749629 - RNA, 64 nt, Homo Sapiens; identical to SEQ ID NO: 676530

SEQ ID NO: 749630 - RNA, 64 nt, Homo Sapiens; identical to SEQ ID NO: 676531

SEQ ID NO: 749631 - RNA, 64 nt, Homo Sapiens; identical to SEQ ID NO: 676532

SEQ ID NO: 749632 - RNA, 64 nt, Homo Sapiens; identical to SEQ ID NO: 676533

SEQ ID NO: 749633 - RNA, 64 nt, Homo Sapiens; identical to SEQ ID NO: 676534

SEQ ID NO: 749634 - RNA, 64 nt, Homo Sapiens; identical to SEQ ID NO: 676535

SEQ ID NO: 749635 - RNA, 64 nt, Homo Sapiens; identical to SEQ ID NO: 676536

SEQ ID NO: 749636 - RNA, 64 nt, Homo Sapiens; identical to SEQ ID NO: 676537

SEQ ID NO: 749637 - RNA, 64 nt, Homo Sapiens; identical to SEQ ID NO: 676538

SEQ ID NO: 749638 - RNA, 64 nt, Homo Sapiens; identical to SEQ ID NO: 676539

SEQ ID NO: 749639 - RNA, 64 nt, Homo Sapiens; identical to SEQ ID NO: 676540

SEQ ID NO: 749640 - RNA, 64 nt, Homo Sapiens; identical to SEQ ID NO: 676541

SEQ ID NO: 749641 - RNA, 64 nt, Homo Sapiens; identical to SEQ ID NO: 676542

SEQ ID NO: 749642 - RNA, 64 nt, Homo Sapiens; identical to SEQ ID NO: 676543

SEQ ID NO: 749643 - RNA, 64 nt, Homo Sapiens; identical to SEQ ID NO: 676544

SEQ ID NO: 749644 - RNA, 64 nt, Homo Sapiens; identical to SEQ ID NO: 676545

SEQ ID NO: 749645 - RNA, 64 nt, Homo Sapiens; identical to SEQ ID NO: 676546

SEQ ID NO: 749646 - RNA, 64 nt, Homo Sapiens; identical to SEQ ID NO: 676547

SEQ ID NO: 749647 - RNA, 64 nt, Homo Sapiens; identical to SEQ ID NO: 676548

SEQ ID NO: 749648 - RNA, 64 nt, Homo Sapiens; identical to SEQ ID NO: 676549

SEQ ID NO: 749649 - RNA, 64 nt, Homo Sapiens; identical to SEQ ID NO: 676550

SEQ ID NO: 749650 - RNA, 64 nt, Homo Sapiens; identical to SEQ ID NO: 676551

SEQ ID NO: 749651 - RNA, 64 nt, Homo Sapiens; identical to SEQ ID NO: 676552

SEQ ID NO: 749652 - RNA, 64 nt, Homo Sapiens; identical to SEQ ID NO: 676553

SEQ ID NO: 749653 - RNA, 64 nt, Homo Sapiens; identical to SEQ ID NO: 676554

SEQ ID NO: 749654 - RNA, 64 nt, Homo Sapiens; identical to SEQ ID NO: 676555

SEQ ID NO: 749655 - RNA, 64 nt, Homo Sapiens; identical to SEQ ID NO: 676556

SEQ ID NO: 749656 - RNA, 64 nt, Homo Sapiens; identical to SEQ ID NO: 676557

SEQ ID NO: 749657 - RNA, 64 nt, Homo Sapiens; identical to SEQ ID NO: 676558

SEQ ID NO: 749658 - RNA, 64 nt, Homo Sapiens; identical to SEQ ID NO: 676559

SEQ ID NO: 749659 - RNA, 64 nt, Homo Sapiens
cgaucacagacgagcggucaagacgagcagucaucggacucacccaucggaaucacccgaucac

SEQ ID NO: 749660 - RNA, 64 nt, Homo Sapiens; identical to SEQ ID NO: 749659

SEQ ID NO: 749661 - RNA, 64 nt, Homo Sapiens
cgaucacagacgagcggucaagacgagcagucaucggacucacccaccggaaucgcccggucac

SEQ ID NO: 749662 - RNA, 64 nt, Homo Sapiens
cccccaccuggcucaccuugccggacucaagccccggacucagggcucccugcugaccaggucc

SEQ ID NO: 749663 - RNA, 59 nt, Homo Sapiens
ccccggacucaggcccccacccagguccccggacucaagcccacuuugcucccugcuga

SEQ ID NO: 749664 - RNA, 64 nt, Homo Sapiens; identical to SEQ ID NO: 310460

SEQ ID NO: 749665 - RNA, 64 nt, Homo Sapiens; identical to SEQ ID NO: 310461

SEQ ID NO: 749666 - RNA, 64 nt, Homo Sapiens; identical to SEQ ID NO: 310462

SEQ ID NO: 749667 - RNA, 64 nt, Homo Sapiens; identical to SEQ ID NO: 310463

SEQ ID NO: 749668 - RNA, 64 nt, Homo Sapiens; identical to SEQ ID NO: 310464

SEQ ID NO: 749669 - RNA, 64 nt, Homo Sapiens; identical to SEQ ID NO: 310465

SEQ ID NO: 749670 - RNA, 64 nt, Homo Sapiens; identical to SEQ ID NO: 310466

SEQ ID NO: 749671 - RNA, 64 nt, Homo Sapiens; identical to SEQ ID NO: 310467

SEQ ID NO: 749672 - RNA, 64 nt, Homo Sapiens; identical to SEQ ID NO: 310468

SEQ ID NO: 749673 - RNA, 64 nt, Homo Sapiens; identical to SEQ ID NO: 310469

SEQ ID NO: 749674 - RNA, 64 nt, Homo Sapiens; identical to SEQ ID NO: 310470

SEQ ID NO: 749675 - RNA, 64 nt, Homo Sapiens; identical to SEQ ID NO: 310471

SEQ ID NO: 749676 - RNA, 64 nt, Homo Sapiens; identical to SEQ ID NO: 310472

SEQ ID NO: 749677 - RNA, 64 nt, Homo Sapiens; identical to SEQ ID NO: 310473

SEQ ID NO: 749678 - RNA, 64 nt, Homo Sapiens; identical to SEQ ID NO: 310474

SEQ ID NO: 749679 - RNA, 64 nt, Homo Sapiens; identical to SEQ ID NO: 310475

SEQ ID NO: 749680 - RNA, 64 nt, Homo Sapiens; identical to SEQ ID NO: 310476

SEQ ID NO: 749681 - RNA, 64 nt, Homo Sapiens; identical to SEQ ID NO: 310477

SEQ ID NO: 749682 - RNA, 64 nt, Homo Sapiens; identical to SEQ ID NO: 310478

SEQ ID NO: 749683 - RNA, 64 nt, Homo Sapiens; identical to SEQ ID NO: 310479

SEQ ID NO: 749684 - RNA, 64 nt, Homo Sapiens; identical to SEQ ID NO: 310480

SEQ ID NO: 749685 - RNA, 64 nt, Homo Sapiens; identical to SEQ ID NO: 310481

SEQ ID NO: 749686 - RNA, 64 nt, Homo Sapiens; identical to SEQ ID NO: 310482

SEQ ID NO: 749687 - RNA, 64 nt, Homo Sapiens; identical to SEQ ID NO: 310483

SEQ ID NO: 749688 - RNA, 64 nt, Homo Sapiens; identical to SEQ ID NO: 310484

SEQ ID NO: 749689 - RNA, 64 nt, Homo Sapiens; identical to SEQ ID NO: 310485

SEQ ID NO: 749690 - RNA, 64 nt, Homo Sapiens; identical to SEQ ID NO: 310486

SEQ ID NO: 749691 - RNA, 64 nt, Homo Sapiens; identical to SEQ ID NO: 310487

SEQ ID NO: 749692 - RNA, 64 nt, Homo Sapiens; identical to SEQ ID NO: 310488

SEQ ID NO: 749693 - RNA, 64 nt, Homo Sapiens; identical to SEQ ID NO: 310489

SEQ ID NO: 749694 - RNA, 64 nt, Homo Sapiens; identical to SEQ ID NO: 310490

SEQ ID NO: 749695 - RNA, 64 nt, Homo Sapiens; identical to SEQ ID NO: 310491

SEQ ID NO: 749696 - RNA, 64 nt, Homo Sapiens; identical to SEQ ID NO: 310492

SEQ ID NO: 749697 - RNA, 64 nt, Homo Sapiens; identical to SEQ ID NO: 310493

SEQ ID NO: 749698 - RNA, 64 nt, Homo Sapiens; identical to SEQ ID NO: 310494

SEQ ID NO: 749699 - RNA, 64 nt, Homo Sapiens; identical to SEQ ID NO: 310495

SEQ ID NO: 749700 - RNA, 64 nt, Homo Sapiens; identical to SEQ ID NO: 310496

SEQ ID NO: 749701 - RNA, 64 nt, Homo Sapiens; identical to SEQ ID NO: 310497

SEQ ID NO: 749702 - RNA, 64 nt, Homo Sapiens; identical to SEQ ID NO: 310498

SEQ ID NO: 749703 - RNA, 64 nt, Homo Sapiens; identical to SEQ ID NO: 310499

SEQ ID NO: 749704 - RNA, 64 nt, Homo Sapiens; identical to SEQ ID NO: 310500

SEQ ID NO: 749705 - RNA, 64 nt, Homo Sapiens; identical to SEQ ID NO: 310501

SEQ ID NO: 749706 - RNA, 64 nt, Homo Sapiens; identical to SEQ ID NO: 310502

SEQ ID NO: 749707 - RNA, 64 nt, Homo Sapiens; identical to SEQ ID NO: 310503

SEQ ID NO: 749708 - RNA, 64 nt, Homo Sapiens; identical to SEQ ID NO: 310504

SEQ ID NO: 749709 - RNA, 64 nt, Homo Sapiens; identical to SEQ ID NO: 310505

SEQ ID NO: 749710 - RNA, 64 nt, Homo Sapiens; identical to SEQ ID NO: 310506

SEQ ID NO: 749711 - RNA, 64 nt, Homo Sapiens; identical to SEQ ID NO: 310507

SEQ ID NO: 749712 - RNA, 64 nt, Homo Sapiens; identical to SEQ ID NO: 310508

SEQ ID NO: 749713 - RNA, 64 nt, Homo Sapiens; identical to SEQ ID NO: 310509

SEQ ID NO: 749714 - RNA, 64 nt, Homo Sapiens; identical to SEQ ID NO: 310510

SEQ ID NO: 749715 - RNA, 64 nt, Homo Sapiens; identical to SEQ ID NO: 310511

SEQ ID NO: 749716 - RNA, 64 nt, Homo Sapiens; identical to SEQ ID NO: 310512

SEQ ID NO: 749717 - RNA, 64 nt, Homo Sapiens; identical to SEQ ID NO: 310513

SEQ ID NO: 749718 - RNA, 64 nt, Homo Sapiens; identical to SEQ ID NO: 310514

SEQ ID NO: 749719 - RNA, 64 nt, Homo Sapiens; identical to SEQ ID NO: 310515

SEQ ID NO: 749720 - RNA, 64 nt, Homo Sapiens; identical to SEQ ID NO: 310516

SEQ ID NO: 749721 - RNA, 64 nt, Homo Sapiens; identical to SEQ ID NO: 310517

SEQ ID NO: 749722 - RNA, 64 nt, Homo Sapiens; identical to SEQ ID NO: 310518

SEQ ID NO: 749723 - RNA, 64 nt, Homo Sapiens; identical to SEQ ID NO: 310519

SEQ ID NO: 749724 - RNA, 64 nt, Homo Sapiens; identical to SEQ ID NO: 310520

SEQ ID NO: 749725 - RNA, 64 nt, Homo Sapiens; identical to SEQ ID NO: 310521

SEQ ID NO: 749726 - RNA, 64 nt, Homo Sapiens; identical to SEQ ID NO: 310522

SEQ ID NO: 749727 - RNA, 64 nt, Homo Sapiens; identical to SEQ ID NO: 310523

SEQ ID NO: 749728 - RNA, 64 nt, Homo Sapiens; identical to SEQ ID NO: 310524

SEQ ID NO: 749729 - RNA, 64 nt, Homo Sapiens; identical to SEQ ID NO: 310525

SEQ ID NO: 749730 - RNA, 64 nt, Homo Sapiens; identical to SEQ ID NO: 310526

SEQ ID NO: 749731 - RNA, 64 nt, Homo Sapiens; identical to SEQ ID NO: 310527

SEQ ID NO: 749732 - RNA, 64 nt, Homo Sapiens; identical to SEQ ID NO: 310528

SEQ ID NO: 749733 - RNA, 64 nt, Homo Sapiens; identical to SEQ ID NO: 310529

SEQ ID NO: 749734 - RNA, 64 nt, Homo Sapiens; identical to SEQ ID NO: 310530

SEQ ID NO: 749735 - RNA, 64 nt, Homo Sapiens; identical to SEQ ID NO: 310531

SEQ ID NO: 749736 - RNA, 64 nt, Homo Sapiens; identical to SEQ ID NO: 310532

SEQ ID NO: 749737 - RNA, 64 nt, Homo Sapiens; identical to SEQ ID NO: 310533

SEQ ID NO: 749738 - RNA, 64 nt, Homo Sapiens; identical to SEQ ID NO: 310534

SEQ ID NO: 749739 - RNA, 64 nt, Homo Sapiens
acuggcuccaacacugcaacauggggacauuugccaacucgaacaaaggcugagaagcagccac

SEQ ID NO: 749740 - RNA, 64 nt, Homo Sapiens
ccuggccccuucuccucuggggaagaccuugucccaacucgaugggcacagccagccaaccuaa

SEQ ID NO: 749741 - RNA, 64 nt, Homo Sapiens
cuggagccaagauccugccugaagcuccgugaaccaacucgaggaggccuccguggugaagaca

SEQ ID NO: 749742 - RNA, 59 nt, Homo Sapiens
auagccaucaggagcacuguccaucccuacaacucgagguuccagcuggagaggaauaa

SEQ ID NO: 749743 - RNA, 64 nt, Homo Sapiens
cacacagauugcaaguauugcguaccaagugauacaacucgaaaugcaguucucaucuuccugu

SEQ ID NO: 749744 - RNA, 64 nt, Homo Sapiens
uaauuuauuuccuuuugauaugcauuuauauaggcaacucgauauaggaugggagcaaacuagg

SEQ ID NO: 749745 - RNA, 64 nt, Homo Sapiens
uucuucuguuaauaugucagaauguaagauuuggcaacucgauaaauuuuuuucauuuucuuuu

SEQ ID NO: 749746 - RNA, 64 nt, Homo Sapiens
aucacaaaaguauauucaaaaauuauauuuugaacaacucgaaucacucauuuauuuccauauu

SEQ ID NO: 749747 - RNA, 64 nt, Homo Sapiens
ugugugaaugugaggauguagacauccaucagugcaacucgagcuccauccuccuccgauuucu

SEQ ID NO: 749748 - RNA, 64 nt, Homo Sapiens
aauuacuaaagaaauaaaaauaaugguguaaagccaacucgaggggaaucugaauaagcuucca

SEQ ID NO: 749749 - RNA, 64 nt, Homo Sapiens
ucuaguuuuauaugaacgguuguaucaggguaaccaacucgauuugggaugaaucuuagggcac

SEQ ID NO: 749750 - RNA, 64 nt, Homo Sapiens
auuaaaauccuucaacacuuuguucaugacacgucaacucgaugccaggguugcuucaaguauu

SEQ ID NO: 749751 - RNA, 64 nt, Homo Sapiens
gguuaaagcuuaaaaagugaggccccaagauccacaacucgagugguaaccccuaaucaagaga

SEQ ID NO: 749752 - RNA, 64 nt, Homo Sapiens
ugcuuucguccauguuucucaagaccaaaguuugcaacucgaaccuuccccugaggugcagggg

SEQ ID NO: 749753 - RNA, 64 nt, Homo Sapiens
ugccuaugcagccacacaguaucucauggcagaacaacucgacaaaacagcaccacugagauga

SEQ ID NO: 749754 - RNA, 64 nt, Homo Sapiens
ugacugacaauguggcaauagggcuucaugcucacaacucgaacuacuugugugaauugaguag

SEQ ID NO: 749755 - RNA, 64 nt, Homo Sapiens
cccccuagggcucaggcacuaugaauccagcagccaacucgaauugcaggccugcuugcaggaa

SEQ ID NO: 749756 - RNA, 64 nt, Homo Sapiens
agccucaguuuccucaucuguggcaucccagcuccaacucgaggucugccagguccaugggggc

SEQ ID NO: 749757 - RNA, 64 nt, Homo Sapiens
cugugugaaacuuucauucccaugcugggauuuccaacucgaauuguauauuacagauauuugu

SEQ ID NO: 749758 - RNA, 64 nt, Homo Sapiens
ugagggccuucucgugagguacugacaacaccagcaacucgagagcugggaaacucaaggagga

SEQ ID NO: 749759 - RNA, 64 nt, Homo Sapiens
ugcuuuuucauuuuguauacugcaaguucccaggcaacucgaauuugcaaacacagccauggau

SEQ ID NO: 749760 - RNA, 64 nt, Homo Sapiens
gcaggcgguugugugcggcacgcacuucggcagccaacucgaaaucgcaggaucauuucagacc

SEQ ID NO: 749761 - RNA, 64 nt, Homo Sapiens
cucccuccccucacccccaaccccucccccaacccaacucgacccuccucuccaauccugaggg

SEQ ID NO: 749762 - RNA, 64 nt, Homo Sapiens
gccgaucaaggcucuggcauucagagaacccuugcaacucgagaagcuguuuuuauuucguuuu

SEQ ID NO: 749763 - RNA, 64 nt, Homo Sapiens
guucagcccugugugcucucgguuuccuggucaccaacucgagucccuggagacuuugcucccu

SEQ ID NO: 749764 - RNA, 64 nt, Homo Sapiens
ucccgugacugacugucuuaacugagcauuuucucaacucgacucucauuucuucccugcuggu

SEQ ID NO: 749765 - RNA, 63 nt, Homo Sapiens
guuguuuuauuuaaaggagaaaauauauauauuucaacucgaaguuauuuaagaaaaauaucu

SEQ ID NO: 749766 - RNA, 64 nt, Homo Sapiens
caccaggaauaauccauucuuuggggccucuuuccaacucgagguuguuuucuuucaagauacu

SEQ ID NO: 749767 - RNA, 62 nt, Homo Sapiens
acucucgcgauaacuguacugagauaaaguguggcaacucgagcuggcuggugauucauccu

SEQ ID NO: 749768 - RNA, 64 nt, Homo Sapiens
uaaauuucaugggaaaacccaagcuggagguggacaacucgaugcucuguuccagaagcccuau

SEQ ID NO: 749769 - RNA, 64 nt, Homo Sapiens; identical to SEQ ID NO: 379229

SEQ ID NO: 749770 - RNA, 64 nt, Homo Sapiens; identical to SEQ ID NO: 379230

SEQ ID NO: 749771 - RNA, 64 nt, Homo Sapiens; identical to SEQ ID NO: 379231

SEQ ID NO: 749772 - RNA, 64 nt, Homo Sapiens; identical to SEQ ID NO: 379232

SEQ ID NO: 749773 - RNA, 64 nt, Homo Sapiens; identical to SEQ ID NO: 379233

SEQ ID NO: 749774 - RNA, 64 nt, Homo Sapiens; identical to SEQ ID NO: 379234

SEQ ID NO: 749775 - RNA, 64 nt, Homo Sapiens; identical to SEQ ID NO: 379235

SEQ ID NO: 749776 - RNA, 64 nt, Homo Sapiens; identical to SEQ ID NO: 379236

SEQ ID NO: 749777 - RNA, 64 nt, Homo Sapiens; identical to SEQ ID NO: 379237

SEQ ID NO: 749778 - RNA, 64 nt, Homo Sapiens; identical to SEQ ID NO: 379238

SEQ ID NO: 749779 - RNA, 64 nt, Homo Sapiens; identical to SEQ ID NO: 379239

SEQ ID NO: 749780 - RNA, 64 nt, Homo Sapiens; identical to SEQ ID NO: 379240

SEQ ID NO: 749781 - RNA, 64 nt, Homo Sapiens; identical to SEQ ID NO: 379241

SEQ ID NO: 749782 - RNA, 64 nt, Homo Sapiens; identical to SEQ ID NO: 379242

SEQ ID NO: 749783 - RNA, 64 nt, Homo Sapiens; identical to SEQ ID NO: 379243

SEQ ID NO: 749784 - RNA, 64 nt, Homo Sapiens; identical to SEQ ID NO: 379244

SEQ ID NO: 749785 - RNA, 64 nt, Homo Sapiens; identical to SEQ ID NO: 379245

SEQ ID NO: 749786 - RNA, 64 nt, Homo Sapiens; identical to SEQ ID NO: 379246

SEQ ID NO: 749787 - RNA, 64 nt, Homo Sapiens; identical to SEQ ID NO: 379247

SEQ ID NO: 749788 - RNA, 64 nt, Homo Sapiens; identical to SEQ ID NO: 379248

SEQ ID NO: 749789 - RNA, 64 nt, Homo Sapiens; identical to SEQ ID NO: 379249

SEQ ID NO: 749790 - RNA, 64 nt, Homo Sapiens; identical to SEQ ID NO: 379250

SEQ ID NO: 749791 - RNA, 64 nt, Homo Sapiens; identical to SEQ ID NO: 379251

SEQ ID NO: 749792 - RNA, 64 nt, Homo Sapiens; identical to SEQ ID NO: 379252

SEQ ID NO: 749793 - RNA, 64 nt, Homo Sapiens; identical to SEQ ID NO: 379253

SEQ ID NO: 749794 - RNA, 64 nt, Homo Sapiens; identical to SEQ ID NO: 379254

SEQ ID NO: 749795 - RNA, 64 nt, Homo Sapiens; identical to SEQ ID NO: 379255

SEQ ID NO: 749796 - RNA, 64 nt, Homo Sapiens; identical to SEQ ID NO: 379256

SEQ ID NO: 749797 - RNA, 64 nt, Homo Sapiens; identical to SEQ ID NO: 379257

SEQ ID NO: 749798 - RNA, 64 nt, Homo Sapiens; identical to SEQ ID NO: 379258

SEQ ID NO: 749799 - RNA, 64 nt, Homo Sapiens; identical to SEQ ID NO: 379259

SEQ ID NO: 749800 - RNA, 64 nt, Homo Sapiens; identical to SEQ ID NO: 229025

SEQ ID NO: 749801 - RNA, 64 nt, Homo Sapiens; identical to SEQ ID NO: 229026

SEQ ID NO: 749802 - RNA, 64 nt, Homo Sapiens; identical to SEQ ID NO: 229027

SEQ ID NO: 749803 - RNA, 64 nt, Homo Sapiens; identical to SEQ ID NO: 229028

SEQ ID NO: 749804 - RNA, 64 nt, Homo Sapiens; identical to SEQ ID NO: 229029

SEQ ID NO: 749805 - RNA, 64 nt, Homo Sapiens; identical to SEQ ID NO: 229030

SEQ ID NO: 749806 - RNA, 64 nt, Homo Sapiens; identical to SEQ ID NO: 229031

SEQ ID NO: 749807 - RNA, 64 nt, Homo Sapiens; identical to SEQ ID NO: 229032

SEQ ID NO: 749808 - RNA, 64 nt, Homo Sapiens; identical to SEQ ID NO: 229033

SEQ ID NO: 749809 - RNA, 64 nt, Homo Sapiens; identical to SEQ ID NO: 229034

SEQ ID NO: 749810 - RNA, 64 nt, Homo Sapiens; identical to SEQ ID NO: 229035

SEQ ID NO: 749811 - RNA, 64 nt, Homo Sapiens; identical to SEQ ID NO: 229036

SEQ ID NO: 749812 - RNA, 64 nt, Homo Sapiens; identical to SEQ ID NO: 229037

SEQ ID NO: 749813 - RNA, 64 nt, Homo Sapiens; identical to SEQ ID NO: 229038

SEQ ID NO: 749814 - RNA, 64 nt, Homo Sapiens; identical to SEQ ID NO: 229039

SEQ ID NO: 749815 - RNA, 64 nt, Homo Sapiens; identical to SEQ ID NO: 229040

SEQ ID NO: 749816 - RNA, 64 nt, Homo Sapiens; identical to SEQ ID NO: 229041

SEQ ID NO: 749817 - RNA, 64 nt, Homo Sapiens; identical to SEQ ID NO: 229042

SEQ ID NO: 749818 - RNA, 64 nt, Homo Sapiens; identical to SEQ ID NO: 229043

SEQ ID NO: 749819 - RNA, 64 nt, Homo Sapiens; identical to SEQ ID NO: 229044

SEQ ID NO: 749820 - RNA, 64 nt, Homo Sapiens; identical to SEQ ID NO: 229045

SEQ ID NO: 749821 - RNA, 64 nt, Homo Sapiens; identical to SEQ ID NO: 229046

SEQ ID NO: 749822 - RNA, 64 nt, Homo Sapiens; identical to SEQ ID NO: 229047

SEQ ID NO: 749823 - RNA, 64 nt, Homo Sapiens; identical to SEQ ID NO: 229048

SEQ ID NO: 749824 - RNA, 64 nt, Homo Sapiens; identical to SEQ ID NO: 229049

SEQ ID NO: 749825 - RNA, 64 nt, Homo Sapiens; identical to SEQ ID NO: 229050

SEQ ID NO: 749826 - RNA, 64 nt, Homo Sapiens; identical to SEQ ID NO: 229051

SEQ ID NO: 749827 - RNA, 64 nt, Homo Sapiens; identical to SEQ ID NO: 229052

SEQ ID NO: 749828 - RNA, 64 nt, Homo Sapiens; identical to SEQ ID NO: 229053

SEQ ID NO: 749829 - RNA, 64 nt, Homo Sapiens; identical to SEQ ID NO: 229054

SEQ ID NO: 749830 - RNA, 64 nt, Homo Sapiens
agugcggcccgggggggaggaagagggaaaaggaagauggaaggacaccaugcauuaucagaga

SEQ ID NO: 749831 - RNA, 64 nt, Homo Sapiens
ugcccuacggggcccuccuucccccaccaggaacagauggaaccugccacccaggauccugauc

SEQ ID NO: 749832 - RNA, 64 nt, Homo Sapiens
gacaaauauccccaagugaaauauguugcgguagagauggaauguauaaaauccgccaguagug

SEQ ID NO: 749833 - RNA, 64 nt, Homo Sapiens
uaggccugcuguucccuuugcucuugauuaggagagauggaaggagaugagcucccauaacuga

SEQ ID NO: 749834 - RNA, 64 nt, Homo Sapiens
guguccuucuugcucccccuugcuguuuguccugagauggaaaaagaagcacuacaccuugccu

SEQ ID NO: 749835 - RNA, 64 nt, Homo Sapiens
acugaggcuuagagauagaccacuccccauuaacagauggaaaagacagggagggaagaaugaa

SEQ ID NO: 749836 - RNA, 64 nt, Homo Sapiens
ucugucaggggacaaacagcggugaagguuagauagauggaaucaaaaguggccuuagaagaag

SEQ ID NO: 749837 - RNA, 64 nt, Homo Sapiens
gggauaucagauugguuuccagcaggaaggagggagauggaaagcaggacacauuggcaaguca

SEQ ID NO: 749838 - RNA, 64 nt, Homo Sapiens
ugcccuuccuagaaaauaugacccauuucacaaaagauggaauucccuaugauaaagccuaaug

SEQ ID NO: 749839 - RNA, 64 nt, Homo Sapiens
uagugcagaaaccucuuguuagcacgagucuggaagauggaagcugguggcuacuggauuagac

SEQ ID NO: 749840 - RNA, 64 nt, Homo Sapiens
gcucugcaucuccugucuuuucagguuugucaucagauggaaauauuuugauaauaaauugaaa

SEQ ID NO: 749841 - RNA, 64 nt, Homo Sapiens
ccaugcugcaguguucgaguggauuguaggugcaagauggaaaggauuguaggugcaagcuguc

SEQ ID NO: 749842 - RNA, 64 nt, Homo Sapiens
caggugaggaugucaggaugcucauuccuucacaagauggaaggcauccugcagguagagcagc

SEQ ID NO: 749843 - RNA, 64 nt, Homo Sapiens
agcaaacagccuauuuacaagaaaguugaguguaagauggaaaauccuguucugcaggcaucag

SEQ ID NO: 749844 - RNA, 64 nt, Homo Sapiens
ggacaaccgcaguuuuacuaagauaauuauacagagauggaaugaccguaucuuggugcagaac

SEQ ID NO: 749845 - RNA, 64 nt, Homo Sapiens
gccagauuucuggaaggagaacuuuaagaaagugagauggaacuauacagaaacacuccuuagc

SEQ ID NO: 749846 - RNA, 64 nt, Homo Sapiens
cuggagagaaugauugcuuuaaaaauguaagugaagauggaagguggggcuuaaucuuguuuaa

SEQ ID NO: 749847 - RNA, 64 nt, Homo Sapiens
aaugaggcucagggaaguuauauugaaauauuacagauggaaagcagcuugacagagcaacugu

SEQ ID NO: 749848 - RNA, 64 nt, Homo Sapiens
ucuguacuuuugcaucuguauaaaaauaucagugagauggaacuguaaauaauuguucugcuga

SEQ ID NO: 749849 - RNA, 64 nt, Homo Sapiens
uguacuuuuucuuaucacauauauuuaaacuuacagauggaaauugcccaaugugcaaauuguu

SEQ ID NO: 749850 - RNA, 64 nt, Homo Sapiens
ggcaguaugucucagcuggaauggaaagaaugugagauggaaccucaagucacuguuuuuacca

SEQ ID NO: 749851 - RNA, 64 nt, Homo Sapiens
gaacagggagcagagagacccaacugggagccagagauggaacuucaggucuuaagugcaaauc

SEQ ID NO: 749852 - RNA, 64 nt, Homo Sapiens
ugcuuguuggguggguaagcuugggcaaacccaaagauggaaaguuucauuuaugguaaacauc

SEQ ID NO: 749853 - RNA, 64 nt, Homo Sapiens
aauguucauggaaacugcuguauaacaaagaggaagauggaaacuaaaucugugucucugugug

SEQ ID NO: 749854 - RNA, 64 nt, Homo Sapiens
guuaauuauaaaaauuaaaagauuuuuuuuuuugagauggaauauugcucuguugcccaggcug

SEQ ID NO: 749855 - RNA, 64 nt, Homo Sapiens
cagaugugucuugugcccaccucuuccugagaagagauggaaguggagcugugacuaguacaag

SEQ ID NO: 749856 - RNA, 64 nt, Homo Sapiens
auacauaaaaccaccaaaauacauagcuucgacaagauggaaguuuauuucucucucccauaac

SEQ ID NO: 749857 - RNA, 64 nt, Homo Sapiens
gguauccagccucaagucaucauuguggccaggaagauggaauacaccaaauggacaggccugg

SEQ ID NO: 749858 - RNA, 64 nt, Homo Sapiens
caaaaagaacaaaaaaaaauuuuuaaauaccacaagauggaaaaaaaaaacaaaaaaauuuaaa

SEQ ID NO: 749859 - RNA, 64 nt, Homo Sapiens
acaagauggaaaaaaaaaacaaaaaaauuuaaaaagauggaauguaguguuuacauuaaagccg

SEQ ID NO: 749860 - RNA, 64 nt, Homo Sapiens
cauuugguauuguuucauuuacaauuugggacuaagauggaaacacuuuuuuuauaaguuuuua

SEQ ID NO: 749861 - RNA, 64 nt, Homo Sapiens
ugcuaauaugcguaaguauuaucgguaaguuacaagauggaagaagaauaacaguagggcacag

SEQ ID NO: 749862 - RNA, 64 nt, Homo Sapiens
ugaaggugcauucaugggugcccuuggaaacggaagauggaauacaucaaagugaauuucuguu

SEQ ID NO: 749863 - RNA, 64 nt, Homo Sapiens
guuaaaaugucuuaauguagguuguagucacuuuagauggaaaauuaccucacaucuguuuucu

SEQ ID NO: 749864 - RNA, 64 nt, Homo Sapiens
ggauccuauccgaagcuagggaucccaucugccuagauggaagaaggaucucugcugucucuug

SEQ ID NO: 749865 - RNA, 64 nt, Homo Sapiens
agcuccaggcugacaccagcgcuggccccucugcagauggaaucgcucagcaaacugucagggu

SEQ ID NO: 749866 - RNA, 64 nt, Homo Sapiens; identical to SEQ ID NO: 498200

SEQ ID NO: 749867 - RNA, 64 nt, Homo Sapiens; identical to SEQ ID NO: 498201

SEQ ID NO: 749868 - RNA, 64 nt, Homo Sapiens; identical to SEQ ID NO: 498202

SEQ ID NO: 749869 - RNA, 64 nt, Homo Sapiens; identical to SEQ ID NO: 498203

SEQ ID NO: 749870 - RNA, 64 nt, Homo Sapiens; identical to SEQ ID NO: 498204

SEQ ID NO: 749871 - RNA, 64 nt, Homo Sapiens; identical to SEQ ID NO: 498205

SEQ ID NO: 749872 - RNA, 64 nt, Homo Sapiens; identical to SEQ ID NO: 498206

SEQ ID NO: 749873 - RNA, 64 nt, Homo Sapiens; identical to SEQ ID NO: 498207

SEQ ID NO: 749874 - RNA, 64 nt, Homo Sapiens; identical to SEQ ID NO: 498208

SEQ ID NO: 749875 - RNA, 64 nt, Homo Sapiens; identical to SEQ ID NO: 498209

SEQ ID NO: 749876 - RNA, 64 nt, Homo Sapiens; identical to SEQ ID NO: 498210

SEQ ID NO: 749877 - RNA, 64 nt, Homo Sapiens; identical to SEQ ID NO: 498211

SEQ ID NO: 749878 - RNA, 53 nt, Homo Sapiens; identical to SEQ ID NO: 498212

SEQ ID NO: 749879 - RNA, 64 nt, Homo Sapiens; identical to SEQ ID NO: 498213

SEQ ID NO: 749880 - RNA, 64 nt, Homo Sapiens; identical to SEQ ID NO: 498214

SEQ ID NO: 749881 - RNA, 64 nt, Homo Sapiens; identical to SEQ ID NO: 498215

SEQ ID NO: 749882 - RNA, 64 nt, Homo Sapiens; identical to SEQ ID NO: 498216

SEQ ID NO: 749883 - RNA, 64 nt, Homo Sapiens; identical to SEQ ID NO: 498217

SEQ ID NO: 749884 - RNA, 64 nt, Homo Sapiens; identical to SEQ ID NO: 498218

SEQ ID NO: 749885 - RNA, 64 nt, Homo Sapiens; identical to SEQ ID NO: 498219

SEQ ID NO: 749886 - RNA, 64 nt, Homo Sapiens; identical to SEQ ID NO: 498220

SEQ ID NO: 749887 - RNA, 64 nt, Homo Sapiens; identical to SEQ ID NO: 498221

SEQ ID NO: 749888 - RNA, 64 nt, Homo Sapiens; identical to SEQ ID NO: 498222

SEQ ID NO: 749889 - RNA, 64 nt, Homo Sapiens; identical to SEQ ID NO: 498223

SEQ ID NO: 749890 - RNA, 64 nt, Homo Sapiens; identical to SEQ ID NO: 498224

SEQ ID NO: 749891 - RNA, 64 nt, Homo Sapiens; identical to SEQ ID NO: 498225

SEQ ID NO: 749892 - RNA, 64 nt, Homo Sapiens; identical to SEQ ID NO: 498226

SEQ ID NO: 749893 - RNA, 64 nt, Homo Sapiens; identical to SEQ ID NO: 498227

SEQ ID NO: 749894 - RNA, 64 nt, Homo Sapiens; identical to SEQ ID NO: 498228

SEQ ID NO: 749895 - RNA, 64 nt, Homo Sapiens; identical to SEQ ID NO: 498229

SEQ ID NO: 749896 - RNA, 64 nt, Homo Sapiens; identical to SEQ ID NO: 498230

SEQ ID NO: 749897 - RNA, 64 nt, Homo Sapiens; identical to SEQ ID NO: 498231

SEQ ID NO: 749898 - RNA, 64 nt, Homo Sapiens; identical to SEQ ID NO: 498232

SEQ ID NO: 749899 - RNA, 64 nt, Homo Sapiens; identical to SEQ ID NO: 498233

SEQ ID NO: 749900 - RNA, 64 nt, Homo Sapiens; identical to SEQ ID NO: 498234

SEQ ID NO: 749901 - RNA, 64 nt, Homo Sapiens; identical to SEQ ID NO: 498235

SEQ ID NO: 749902 - RNA, 64 nt, Homo Sapiens; identical to SEQ ID NO: 498236

SEQ ID NO: 749903 - RNA, 64 nt, Homo Sapiens; identical to SEQ ID NO: 498237

SEQ ID NO: 749904 - RNA, 64 nt, Homo Sapiens; identical to SEQ ID NO: 498238

SEQ ID NO: 749905 - RNA, 64 nt, Homo Sapiens; identical to SEQ ID NO: 498239

SEQ ID NO: 749906 - RNA, 64 nt, Homo Sapiens; identical to SEQ ID NO: 498240

SEQ ID NO: 749907 - RNA, 64 nt, Homo Sapiens; identical to SEQ ID NO: 498241

SEQ ID NO: 749908 - RNA, 64 nt, Homo Sapiens; identical to SEQ ID NO: 498242

SEQ ID NO: 749909 - RNA, 64 nt, Homo Sapiens; identical to SEQ ID NO: 498243

SEQ ID NO: 749910 - RNA, 64 nt, Homo Sapiens; identical to SEQ ID NO: 498244

SEQ ID NO: 749911 - RNA, 64 nt, Homo Sapiens; identical to SEQ ID NO: 498245

SEQ ID NO: 749912 - RNA, 64 nt, Homo Sapiens; identical to SEQ ID NO: 498246

SEQ ID NO: 749913 - RNA, 64 nt, Homo Sapiens; identical to SEQ ID NO: 498247

SEQ ID NO: 749914 - RNA, 64 nt, Homo Sapiens; identical to SEQ ID NO: 498248

SEQ ID NO: 749915 - RNA, 64 nt, Homo Sapiens; identical to SEQ ID NO: 498249

SEQ ID NO: 749916 - RNA, 64 nt, Homo Sapiens; identical to SEQ ID NO: 498250

SEQ ID NO: 749917 - RNA, 64 nt, Homo Sapiens; identical to SEQ ID NO: 498251

SEQ ID NO: 749918 - RNA, 64 nt, Homo Sapiens; identical to SEQ ID NO: 498252

SEQ ID NO: 749919 - RNA, 64 nt, Homo Sapiens; identical to SEQ ID NO: 498253

SEQ ID NO: 749920 - RNA, 64 nt, Homo Sapiens; identical to SEQ ID NO: 498254

SEQ ID NO: 749921 - RNA, 64 nt, Homo Sapiens; identical to SEQ ID NO: 498255

SEQ ID NO: 749922 - RNA, 64 nt, Homo Sapiens; identical to SEQ ID NO: 498256

SEQ ID NO: 749923 - RNA, 64 nt, Homo Sapiens; identical to SEQ ID NO: 126692

SEQ ID NO: 749924 - RNA, 64 nt, Homo Sapiens; identical to SEQ ID NO: 126693

SEQ ID NO: 749925 - RNA, 64 nt, Homo Sapiens; identical to SEQ ID NO: 126694

SEQ ID NO: 749926 - RNA, 64 nt, Homo Sapiens; identical to SEQ ID NO: 126695

SEQ ID NO: 749927 - RNA, 64 nt, Homo Sapiens; identical to SEQ ID NO: 126696

SEQ ID NO: 749928 - RNA, 64 nt, Homo Sapiens; identical to SEQ ID NO: 126697

SEQ ID NO: 749929 - RNA, 64 nt, Homo Sapiens; identical to SEQ ID NO: 126698

SEQ ID NO: 749930 - RNA, 64 nt, Homo Sapiens; identical to SEQ ID NO: 126699

SEQ ID NO: 749931 - RNA, 64 nt, Homo Sapiens; identical to SEQ ID NO: 126700

SEQ ID NO: 749932 - RNA, 64 nt, Homo Sapiens; identical to SEQ ID NO: 126701

SEQ ID NO: 749933 - RNA, 64 nt, Homo Sapiens; identical to SEQ ID NO: 126702

SEQ ID NO: 749934 - RNA, 64 nt, Homo Sapiens; identical to SEQ ID NO: 126703

SEQ ID NO: 749935 - RNA, 64 nt, Homo Sapiens; identical to SEQ ID NO: 126704

SEQ ID NO: 749936 - RNA, 64 nt, Homo Sapiens; identical to SEQ ID NO: 126705

SEQ ID NO: 749937 - RNA, 64 nt, Homo Sapiens; identical to SEQ ID NO: 126706

SEQ ID NO: 749938 - RNA, 64 nt, Homo Sapiens; identical to SEQ ID NO: 126707

SEQ ID NO: 749939 - RNA, 64 nt, Homo Sapiens; identical to SEQ ID NO: 126708

SEQ ID NO: 749940 - RNA, 64 nt, Homo Sapiens; identical to SEQ ID NO: 126709

SEQ ID NO: 749941 - RNA, 64 nt, Homo Sapiens; identical to SEQ ID NO: 126710

SEQ ID NO: 749942 - RNA, 64 nt, Homo Sapiens; identical to SEQ ID NO: 126711

SEQ ID NO: 749943 - RNA, 64 nt, Homo Sapiens; identical to SEQ ID NO: 126712

SEQ ID NO: 749944 - RNA, 56 nt, Homo Sapiens; identical to SEQ ID NO: 126713

SEQ ID NO: 749945 - RNA, 64 nt, Homo Sapiens; identical to SEQ ID NO: 126714

SEQ ID NO: 749946 - RNA, 64 nt, Homo Sapiens; identical to SEQ ID NO: 126715

SEQ ID NO: 749947 - RNA, 64 nt, Homo Sapiens; identical to SEQ ID NO: 126716

SEQ ID NO: 749948 - RNA, 64 nt, Homo Sapiens; identical to SEQ ID NO: 126717

SEQ ID NO: 749949 - RNA, 64 nt, Homo Sapiens; identical to SEQ ID NO: 126718

SEQ ID NO: 749950 - RNA, 64 nt, Homo Sapiens; identical to SEQ ID NO: 126719

SEQ ID NO: 749951 - RNA, 64 nt, Homo Sapiens; identical to SEQ ID NO: 126720

SEQ ID NO: 749952 - RNA, 64 nt, Homo Sapiens; identical to SEQ ID NO: 126721

SEQ ID NO: 749953 - RNA, 64 nt, Homo Sapiens; identical to SEQ ID NO: 126722

SEQ ID NO: 749954 - RNA, 64 nt, Homo Sapiens; identical to SEQ ID NO: 126723

SEQ ID NO: 749955 - RNA, 64 nt, Homo Sapiens; identical to SEQ ID NO: 126724

SEQ ID NO: 749956 - RNA, 64 nt, Homo Sapiens; identical to SEQ ID NO: 126725

SEQ ID NO: 749957 - RNA, 64 nt, Homo Sapiens; identical to SEQ ID NO: 126726

SEQ ID NO: 749958 - RNA, 64 nt, Homo Sapiens; identical to SEQ ID NO: 126727

SEQ ID NO: 749959 - RNA, 64 nt, Homo Sapiens; identical to SEQ ID NO: 126728

SEQ ID NO: 749960 - RNA, 64 nt, Homo Sapiens; identical to SEQ ID NO: 126729

SEQ ID NO: 749961 - RNA, 64 nt, Homo Sapiens; identical to SEQ ID NO: 126730

SEQ ID NO: 749962 - RNA, 64 nt, Homo Sapiens; identical to SEQ ID NO: 126731

SEQ ID NO: 749963 - RNA, 64 nt, Homo Sapiens; identical to SEQ ID NO: 126732

SEQ ID NO: 749964 - RNA, 64 nt, Homo Sapiens; identical to SEQ ID NO: 126733

SEQ ID NO: 749965 - RNA, 64 nt, Homo Sapiens; identical to SEQ ID NO: 126734

SEQ ID NO: 749966 - RNA, 64 nt, Homo Sapiens; identical to SEQ ID NO: 126735

SEQ ID NO: 749967 - RNA, 64 nt, Homo Sapiens; identical to SEQ ID NO: 126736

SEQ ID NO: 749968 - RNA, 64 nt, Homo Sapiens; identical to SEQ ID NO: 126737

SEQ ID NO: 749969 - RNA, 64 nt, Homo Sapiens; identical to SEQ ID NO: 126738

SEQ ID NO: 749970 - RNA, 64 nt, Homo Sapiens; identical to SEQ ID NO: 126739

SEQ ID NO: 749971 - RNA, 64 nt, Homo Sapiens; identical to SEQ ID NO: 126740

SEQ ID NO: 749972 - RNA, 64 nt, Homo Sapiens; identical to SEQ ID NO: 126741

SEQ ID NO: 749973 - RNA, 64 nt, Homo Sapiens; identical to SEQ ID NO: 126742

SEQ ID NO: 749974 - RNA, 64 nt, Homo Sapiens; identical to SEQ ID NO: 126743

SEQ ID NO: 749975 - RNA, 64 nt, Homo Sapiens; identical to SEQ ID NO: 126744

SEQ ID NO: 749976 - RNA, 64 nt, Homo Sapiens; identical to SEQ ID NO: 126745

SEQ ID NO: 749977 - RNA, 58 nt, Homo Sapiens; identical to SEQ ID NO: 126746

SEQ ID NO: 749978 - RNA, 64 nt, Homo Sapiens; identical to SEQ ID NO: 126747

SEQ ID NO: 749979 - RNA, 64 nt, Homo Sapiens; identical to SEQ ID NO: 126748

SEQ ID NO: 749980 - RNA, 64 nt, Homo Sapiens; identical to SEQ ID NO: 126749

SEQ ID NO: 749981 - RNA, 64 nt, Homo Sapiens; identical to SEQ ID NO: 126750

SEQ ID NO: 749982 - RNA, 64 nt, Homo Sapiens; identical to SEQ ID NO: 126751

SEQ ID NO: 749983 - RNA, 64 nt, Homo Sapiens; identical to SEQ ID NO: 126752

SEQ ID NO: 749984 - RNA, 64 nt, Homo Sapiens; identical to SEQ ID NO: 126753

SEQ ID NO: 749985 - RNA, 64 nt, Homo Sapiens; identical to SEQ ID NO: 126754

SEQ ID NO: 749986 - RNA, 64 nt, Homo Sapiens; identical to SEQ ID NO: 126755

SEQ ID NO: 749987 - RNA, 64 nt, Homo Sapiens; identical to SEQ ID NO: 126756

SEQ ID NO: 749988 - RNA, 64 nt, Homo Sapiens; identical to SEQ ID NO: 126757

SEQ ID NO: 749989 - RNA, 64 nt, Homo Sapiens; identical to SEQ ID NO: 126758

SEQ ID NO: 749990 - RNA, 64 nt, Homo Sapiens; identical to SEQ ID NO: 126759

SEQ ID NO: 749991 - RNA, 63 nt, Homo Sapiens; identical to SEQ ID NO: 126760

SEQ ID NO: 749992 - RNA, 64 nt, Homo Sapiens; identical to SEQ ID NO: 126761

SEQ ID NO: 749993 - RNA, 64 nt, Homo Sapiens; identical to SEQ ID NO: 126762

SEQ ID NO: 749994 - RNA, 64 nt, Homo Sapiens; identical to SEQ ID NO: 126763

SEQ ID NO: 749995 - RNA, 64 nt, Homo Sapiens; identical to SEQ ID NO: 126764

SEQ ID NO: 749996 - RNA, 64 nt, Homo Sapiens; identical to SEQ ID NO: 126765

SEQ ID NO: 749997 - RNA, 64 nt, Homo Sapiens; identical to SEQ ID NO: 126766

SEQ ID NO: 749998 - RNA, 64 nt, Homo Sapiens; identical to SEQ ID NO: 126767

SEQ ID NO: 749999 - RNA, 64 nt, Homo Sapiens; identical to SEQ ID NO: 126768

SEQ ID NO: 750000 - RNA, 64 nt, Homo Sapiens; identical to SEQ ID NO: 126769

SEQ ID NO: 750001 - RNA, 64 nt, Homo Sapiens; identical to SEQ ID NO: 126770

SEQ ID NO: 750002 - RNA, 64 nt, Homo Sapiens; identical to SEQ ID NO: 126771

SEQ ID NO: 750003 - RNA, 64 nt, Homo Sapiens; identical to SEQ ID NO: 126772

SEQ ID NO: 750004 - RNA, 64 nt, Homo Sapiens; identical to SEQ ID NO: 126773

SEQ ID NO: 750005 - RNA, 64 nt, Homo Sapiens; identical to SEQ ID NO: 126774

SEQ ID NO: 750006 - RNA, 64 nt, Homo Sapiens; identical to SEQ ID NO: 126775

SEQ ID NO: 750007 - RNA, 64 nt, Homo Sapiens; identical to SEQ ID NO: 126776

SEQ ID NO: 750008 - RNA, 64 nt, Homo Sapiens; identical to SEQ ID NO: 126777

SEQ ID NO: 750009 - RNA, 64 nt, Homo Sapiens; identical to SEQ ID NO: 126778

SEQ ID NO: 750010 - RNA, 64 nt, Homo Sapiens; identical to SEQ ID NO: 126779

SEQ ID NO: 750011 - RNA, 64 nt, Homo Sapiens; identical to SEQ ID NO: 126780

SEQ ID NO: 750012 - RNA, 64 nt, Homo Sapiens; identical to SEQ ID NO: 126781

SEQ ID NO: 750013 - RNA, 64 nt, Homo Sapiens; identical to SEQ ID NO: 126782

SEQ ID NO: 750014 - RNA, 64 nt, Homo Sapiens; identical to SEQ ID NO: 126783

SEQ ID NO: 750015 - RNA, 64 nt, Homo Sapiens; identical to SEQ ID NO: 126784

SEQ ID NO: 750016 - RNA, 64 nt, Homo Sapiens; identical to SEQ ID NO: 126785

SEQ ID NO: 750017 - RNA, 64 nt, Homo Sapiens; identical to SEQ ID NO: 126786

SEQ ID NO: 750018 - RNA, 64 nt, Homo Sapiens; identical to SEQ ID NO: 126787

SEQ ID NO: 750019 - RNA, 64 nt, Homo Sapiens; identical to SEQ ID NO: 126788

SEQ ID NO: 750020 - RNA, 64 nt, Homo Sapiens; identical to SEQ ID NO: 126789

SEQ ID NO: 750021 - RNA, 64 nt, Homo Sapiens; identical to SEQ ID NO: 126790

SEQ ID NO: 750022 - RNA, 64 nt, Homo Sapiens; identical to SEQ ID NO: 126791

SEQ ID NO: 750023 - RNA, 64 nt, Homo Sapiens; identical to SEQ ID NO: 126792

SEQ ID NO: 750024 - RNA, 64 nt, Homo Sapiens; identical to SEQ ID NO: 126793

SEQ ID NO: 750025 - RNA, 64 nt, Homo Sapiens; identical to SEQ ID NO: 126794

SEQ ID NO: 750026 - RNA, 56 nt, Homo Sapiens; identical to SEQ ID NO: 126795

SEQ ID NO: 750027 - RNA, 64 nt, Homo Sapiens; identical to SEQ ID NO: 126796

SEQ ID NO: 750028 - RNA, 64 nt, Homo Sapiens; identical to SEQ ID NO: 692060

SEQ ID NO: 750029 - RNA, 64 nt, Homo Sapiens; identical to SEQ ID NO: 692061

SEQ ID NO: 750030 - RNA, 64 nt, Homo Sapiens; identical to SEQ ID NO: 692062

SEQ ID NO: 750031 - RNA, 64 nt, Homo Sapiens; identical to SEQ ID NO: 692063

SEQ ID NO: 750032 - RNA, 64 nt, Homo Sapiens; identical to SEQ ID NO: 692064

SEQ ID NO: 750033 - RNA, 64 nt, Homo Sapiens; identical to SEQ ID NO: 692065

SEQ ID NO: 750034 - RNA, 64 nt, Homo Sapiens; identical to SEQ ID NO: 692066

SEQ ID NO: 750035 - RNA, 64 nt, Homo Sapiens; identical to SEQ ID NO: 692067

SEQ ID NO: 750036 - RNA, 64 nt, Homo Sapiens; identical to SEQ ID NO: 692068

SEQ ID NO: 750037 - RNA, 64 nt, Homo Sapiens; identical to SEQ ID NO: 692069

SEQ ID NO: 750038 - RNA, 64 nt, Homo Sapiens; identical to SEQ ID NO: 692070

SEQ ID NO: 750039 - RNA, 64 nt, Homo Sapiens; identical to SEQ ID NO: 692071

SEQ ID NO: 750040 - RNA, 64 nt, Homo Sapiens; identical to SEQ ID NO: 692072

SEQ ID NO: 750041 - RNA, 64 nt, Homo Sapiens; identical to SEQ ID NO: 692073

SEQ ID NO: 750042 - RNA, 64 nt, Homo Sapiens; identical to SEQ ID NO: 692074

SEQ ID NO: 750043 - RNA, 64 nt, Homo Sapiens; identical to SEQ ID NO: 692075

SEQ ID NO: 750044 - RNA, 64 nt, Homo Sapiens; identical to SEQ ID NO: 692076

SEQ ID NO: 750045 - RNA, 64 nt, Homo Sapiens; identical to SEQ ID NO: 692077

SEQ ID NO: 750046 - RNA, 64 nt, Homo Sapiens; identical to SEQ ID NO: 692078

SEQ ID NO: 750047 - RNA, 64 nt, Homo Sapiens; identical to SEQ ID NO: 692079

SEQ ID NO: 750048 - RNA, 64 nt, Homo Sapiens; identical to SEQ ID NO: 692080

SEQ ID NO: 750049 - RNA, 64 nt, Homo Sapiens; identical to SEQ ID NO: 692081

SEQ ID NO: 750050 - RNA, 64 nt, Homo Sapiens; identical to SEQ ID NO: 692082

SEQ ID NO: 750051 - RNA, 64 nt, Homo Sapiens; identical to SEQ ID NO: 692083

SEQ ID NO: 750052 - RNA, 64 nt, Homo Sapiens; identical to SEQ ID NO: 692084

SEQ ID NO: 750053 - RNA, 64 nt, Homo Sapiens; identical to SEQ ID NO: 692085

SEQ ID NO: 750054 - RNA, 64 nt, Homo Sapiens; identical to SEQ ID NO: 692086

SEQ ID NO: 750055 - RNA, 64 nt, Homo Sapiens; identical to SEQ ID NO: 692087

SEQ ID NO: 750056 - RNA, 64 nt, Homo Sapiens; identical to SEQ ID NO: 692088

SEQ ID NO: 750057 - RNA, 64 nt, Homo Sapiens; identical to SEQ ID NO: 692089

SEQ ID NO: 750058 - RNA, 64 nt, Homo Sapiens; identical to SEQ ID NO: 692090

SEQ ID NO: 750059 - RNA, 64 nt, Homo Sapiens; identical to SEQ ID NO: 692091

SEQ ID NO: 750060 - RNA, 64 nt, Homo Sapiens; identical to SEQ ID NO: 692092

SEQ ID NO: 750061 - RNA, 64 nt, Homo Sapiens; identical to SEQ ID NO: 692093

SEQ ID NO: 750062 - RNA, 64 nt, Homo Sapiens; identical to SEQ ID NO: 692094

SEQ ID NO: 750063 - RNA, 64 nt, Homo Sapiens; identical to SEQ ID NO: 692095

SEQ ID NO: 750064 - RNA, 64 nt, Homo Sapiens; identical to SEQ ID NO: 692096

SEQ ID NO: 750065 - RNA, 64 nt, Homo Sapiens; identical to SEQ ID NO: 692097

SEQ ID NO: 750066 - RNA, 64 nt, Homo Sapiens; identical to SEQ ID NO: 692098

SEQ ID NO: 750067 - RNA, 64 nt, Homo Sapiens; identical to SEQ ID NO: 692099

SEQ ID NO: 750068 - RNA, 64 nt, Homo Sapiens; identical to SEQ ID NO: 692100

SEQ ID NO: 750069 - RNA, 64 nt, Homo Sapiens; identical to SEQ ID NO: 692101

SEQ ID NO: 750070 - RNA, 64 nt, Homo Sapiens; identical to SEQ ID NO: 692102

SEQ ID NO: 750071 - RNA, 64 nt, Homo Sapiens; identical to SEQ ID NO: 692103

SEQ ID NO: 750072 - RNA, 64 nt, Homo Sapiens; identical to SEQ ID NO: 692104

SEQ ID NO: 750073 - RNA, 64 nt, Homo Sapiens; identical to SEQ ID NO: 692105

SEQ ID NO: 750074 - RNA, 64 nt, Homo Sapiens; identical to SEQ ID NO: 692106

SEQ ID NO: 750075 - RNA, 64 nt, Homo Sapiens; identical to SEQ ID NO: 692107

SEQ ID NO: 750076 - RNA, 64 nt, Homo Sapiens; identical to SEQ ID NO: 692108

SEQ ID NO: 750077 - RNA, 64 nt, Homo Sapiens; identical to SEQ ID NO: 692109

SEQ ID NO: 750078 - RNA, 64 nt, Homo Sapiens; identical to SEQ ID NO: 692110

SEQ ID NO: 750079 - RNA, 64 nt, Homo Sapiens; identical to SEQ ID NO: 692111

SEQ ID NO: 750080 - RNA, 64 nt, Homo Sapiens; identical to SEQ ID NO: 692112

SEQ ID NO: 750081 - RNA, 64 nt, Homo Sapiens; identical to SEQ ID NO: 692113

SEQ ID NO: 750082 - RNA, 64 nt, Homo Sapiens; identical to SEQ ID NO: 692114

SEQ ID NO: 750083 - RNA, 64 nt, Homo Sapiens; identical to SEQ ID NO: 692115

SEQ ID NO: 750084 - RNA, 64 nt, Homo Sapiens; identical to SEQ ID NO: 692116

SEQ ID NO: 750085 - RNA, 64 nt, Homo Sapiens; identical to SEQ ID NO: 692117

SEQ ID NO: 750086 - RNA, 64 nt, Homo Sapiens; identical to SEQ ID NO: 692118

SEQ ID NO: 750087 - RNA, 64 nt, Homo Sapiens; identical to SEQ ID NO: 692119

SEQ ID NO: 750088 - RNA, 64 nt, Homo Sapiens; identical to SEQ ID NO: 692120

SEQ ID NO: 750089 - RNA, 64 nt, Homo Sapiens; identical to SEQ ID NO: 692121

SEQ ID NO: 750090 - RNA, 64 nt, Homo Sapiens; identical to SEQ ID NO: 692122

SEQ ID NO: 750091 - RNA, 64 nt, Homo Sapiens; identical to SEQ ID NO: 692123

SEQ ID NO: 750092 - RNA, 64 nt, Homo Sapiens; identical to SEQ ID NO: 692124

SEQ ID NO: 750093 - RNA, 64 nt, Homo Sapiens; identical to SEQ ID NO: 692125

SEQ ID NO: 750094 - RNA, 64 nt, Homo Sapiens; identical to SEQ ID NO: 692126

SEQ ID NO: 750095 - RNA, 64 nt, Homo Sapiens; identical to SEQ ID NO: 692127

SEQ ID NO: 750096 - RNA, 64 nt, Homo Sapiens; identical to SEQ ID NO: 692128

SEQ ID NO: 750097 - RNA, 64 nt, Homo Sapiens; identical to SEQ ID NO: 692129

SEQ ID NO: 750098 - RNA, 64 nt, Homo Sapiens; identical to SEQ ID NO: 692130

SEQ ID NO: 750099 - RNA, 64 nt, Homo Sapiens; identical to SEQ ID NO: 692131

SEQ ID NO: 750100 - RNA, 64 nt, Homo Sapiens; identical to SEQ ID NO: 692132

SEQ ID NO: 750101 - RNA, 64 nt, Homo Sapiens; identical to SEQ ID NO: 692133

SEQ ID NO: 750102 - RNA, 64 nt, Homo Sapiens; identical to SEQ ID NO: 692134

SEQ ID NO: 750103 - RNA, 64 nt, Homo Sapiens; identical to SEQ ID NO: 692135

SEQ ID NO: 750104 - RNA, 64 nt, Homo Sapiens; identical to SEQ ID NO: 692136

SEQ ID NO: 750105 - RNA, 64 nt, Homo Sapiens; identical to SEQ ID NO: 692137

SEQ ID NO: 750106 - RNA, 64 nt, Homo Sapiens; identical to SEQ ID NO: 692138

SEQ ID NO: 750107 - RNA, 64 nt, Homo Sapiens; identical to SEQ ID NO: 692139

SEQ ID NO: 750108 - RNA, 64 nt, Homo Sapiens; identical to SEQ ID NO: 692140

SEQ ID NO: 750109 - RNA, 64 nt, Homo Sapiens; identical to SEQ ID NO: 692141

SEQ ID NO: 750110 - RNA, 64 nt, Homo Sapiens; identical to SEQ ID NO: 692142

SEQ ID NO: 750111 - RNA, 64 nt, Homo Sapiens; identical to SEQ ID NO: 692143

SEQ ID NO: 750112 - RNA, 64 nt, Homo Sapiens; identical to SEQ ID NO: 692144

SEQ ID NO: 750113 - RNA, 64 nt, Homo Sapiens; identical to SEQ ID NO: 692145

SEQ ID NO: 750114 - RNA, 64 nt, Homo Sapiens; identical to SEQ ID NO: 692146

SEQ ID NO: 750115 - RNA, 64 nt, Homo Sapiens; identical to SEQ ID NO: 692147

SEQ ID NO: 750116 - RNA, 64 nt, Homo Sapiens; identical to SEQ ID NO: 237917

SEQ ID NO: 750117 - RNA, 64 nt, Homo Sapiens; identical to SEQ ID NO: 237918

SEQ ID NO: 750118 - RNA, 64 nt, Homo Sapiens; identical to SEQ ID NO: 237919

SEQ ID NO: 750119 - RNA, 64 nt, Homo Sapiens; identical to SEQ ID NO: 237920

SEQ ID NO: 750120 - RNA, 64 nt, Homo Sapiens; identical to SEQ ID NO: 237921

SEQ ID NO: 750121 - RNA, 64 nt, Homo Sapiens; identical to SEQ ID NO: 237922

SEQ ID NO: 750122 - RNA, 64 nt, Homo Sapiens; identical to SEQ ID NO: 237923

SEQ ID NO: 750123 - RNA, 64 nt, Homo Sapiens; identical to SEQ ID NO: 237924

SEQ ID NO: 750124 - RNA, 64 nt, Homo Sapiens; identical to SEQ ID NO: 237925

SEQ ID NO: 750125 - RNA, 64 nt, Homo Sapiens; identical to SEQ ID NO: 237926

SEQ ID NO: 750126 - RNA, 64 nt, Homo Sapiens; identical to SEQ ID NO: 237927

SEQ ID NO: 750127 - RNA, 64 nt, Homo Sapiens; identical to SEQ ID NO: 237928

SEQ ID NO: 750128 - RNA, 64 nt, Homo Sapiens; identical to SEQ ID NO: 237927

SEQ ID NO: 750129 - RNA, 64 nt, Homo Sapiens; identical to SEQ ID NO: 237930

SEQ ID NO: 750130 - RNA, 64 nt, Homo Sapiens; identical to SEQ ID NO: 237931

SEQ ID NO: 750131 - RNA, 64 nt, Homo Sapiens; identical to SEQ ID NO: 237932

SEQ ID NO: 750132 - RNA, 64 nt, Homo Sapiens; identical to SEQ ID NO: 237933

SEQ ID NO: 750133 - RNA, 64 nt, Homo Sapiens; identical to SEQ ID NO: 237934

SEQ ID NO: 750134 - RNA, 64 nt, Homo Sapiens; identical to SEQ ID NO: 237935

SEQ ID NO: 750135 - RNA, 64 nt, Homo Sapiens; identical to SEQ ID NO: 237936

SEQ ID NO: 750136 - RNA, 64 nt, Homo Sapiens; identical to SEQ ID NO: 237937

SEQ ID NO: 750137 - RNA, 64 nt, Homo Sapiens; identical to SEQ ID NO: 237938

SEQ ID NO: 750138 - RNA, 64 nt, Homo Sapiens; identical to SEQ ID NO: 237939

SEQ ID NO: 750139 - RNA, 64 nt, Homo Sapiens; identical to SEQ ID NO: 237940

SEQ ID NO: 750140 - RNA, 64 nt, Homo Sapiens; identical to SEQ ID NO: 237941

SEQ ID NO: 750141 - RNA, 64 nt, Homo Sapiens; identical to SEQ ID NO: 237942

SEQ ID NO: 750142 - RNA, 64 nt, Homo Sapiens; identical to SEQ ID NO: 237943

SEQ ID NO: 750143 - RNA, 64 nt, Homo Sapiens; identical to SEQ ID NO: 237944

SEQ ID NO: 750144 - RNA, 64 nt, Homo Sapiens; identical to SEQ ID NO: 237945

SEQ ID NO: 750145 - RNA, 64 nt, Homo Sapiens; identical to SEQ ID NO: 237946

SEQ ID NO: 750146 - RNA, 64 nt, Homo Sapiens; identical to SEQ ID NO: 237947

SEQ ID NO: 750147 - RNA, 64 nt, Homo Sapiens; identical to SEQ ID NO: 237948

SEQ ID NO: 750148 - RNA, 64 nt, Homo Sapiens; identical to SEQ ID NO: 237949

SEQ ID NO: 750149 - RNA, 64 nt, Homo Sapiens; identical to SEQ ID NO: 237950

SEQ ID NO: 750150 - RNA, 64 nt, Homo Sapiens; identical to SEQ ID NO: 237951

SEQ ID NO: 750151 - RNA, 64 nt, Homo Sapiens; identical to SEQ ID NO: 237952

SEQ ID NO: 750152 - RNA, 64 nt, Homo Sapiens; identical to SEQ ID NO: 237953

SEQ ID NO: 750153 - RNA, 64 nt, Homo Sapiens; identical to SEQ ID NO: 237954

SEQ ID NO: 750154 - RNA, 64 nt, Homo Sapiens; identical to SEQ ID NO: 237955

SEQ ID NO: 750155 - RNA, 64 nt, Homo Sapiens; identical to SEQ ID NO: 237956

SEQ ID NO: 750156 - RNA, 64 nt, Homo Sapiens; identical to SEQ ID NO: 237957

SEQ ID NO: 750157 - RNA, 64 nt, Homo Sapiens; identical to SEQ ID NO: 237958

SEQ ID NO: 750158 - RNA, 64 nt, Homo Sapiens; identical to SEQ ID NO: 237959

SEQ ID NO: 750159 - RNA, 64 nt, Homo Sapiens; identical to SEQ ID NO: 237960

SEQ ID NO: 750160 - RNA, 64 nt, Homo Sapiens; identical to SEQ ID NO: 237961

SEQ ID NO: 750161 - RNA, 64 nt, Homo Sapiens; identical to SEQ ID NO: 237962

SEQ ID NO: 750162 - RNA, 64 nt, Homo Sapiens; identical to SEQ ID NO: 237963

SEQ ID NO: 750163 - RNA, 64 nt, Homo Sapiens; identical to SEQ ID NO: 237964

SEQ ID NO: 750164 - RNA, 64 nt, Homo Sapiens; identical to SEQ ID NO: 237965

SEQ ID NO: 750165 - RNA, 64 nt, Homo Sapiens; identical to SEQ ID NO: 237966

SEQ ID NO: 750166 - RNA, 64 nt, Homo Sapiens; identical to SEQ ID NO: 237967

SEQ ID NO: 750167 - RNA, 64 nt, Homo Sapiens; identical to SEQ ID NO: 388598

SEQ ID NO: 750168 - RNA, 64 nt, Homo Sapiens; identical to SEQ ID NO: 388599

SEQ ID NO: 750169 - RNA, 64 nt, Homo Sapiens; identical to SEQ ID NO: 388600

SEQ ID NO: 750170 - RNA, 64 nt, Homo Sapiens; identical to SEQ ID NO: 388601

SEQ ID NO: 750171 - RNA, 64 nt, Homo Sapiens; identical to SEQ ID NO: 388602

SEQ ID NO: 750172 - RNA, 64 nt, Homo Sapiens; identical to SEQ ID NO: 388603

SEQ ID NO: 750173 - RNA, 64 nt, Homo Sapiens; identical to SEQ ID NO: 388604

SEQ ID NO: 750174 - RNA, 64 nt, Homo Sapiens; identical to SEQ ID NO: 388605

SEQ ID NO: 750175 - RNA, 64 nt, Homo Sapiens; identical to SEQ ID NO: 388606

SEQ ID NO: 750176 - RNA, 64 nt, Homo Sapiens; identical to SEQ ID NO: 388607

SEQ ID NO: 750177 - RNA, 64 nt, Homo Sapiens; identical to SEQ ID NO: 388608

SEQ ID NO: 750178 - RNA, 64 nt, Homo Sapiens; identical to SEQ ID NO: 388609

SEQ ID NO: 750179 - RNA, 64 nt, Homo Sapiens; identical to SEQ ID NO: 388610

SEQ ID NO: 750180 - RNA, 64 nt, Homo Sapiens; identical to SEQ ID NO: 93186

SEQ ID NO: 750181 - RNA, 64 nt, Homo Sapiens; identical to SEQ ID NO: 93187

SEQ ID NO: 750182 - RNA, 64 nt, Homo Sapiens; identical to SEQ ID NO: 93188

SEQ ID NO: 750183 - RNA, 64 nt, Homo Sapiens; identical to SEQ ID NO: 93189

SEQ ID NO: 750184 - RNA, 64 nt, Homo Sapiens; identical to SEQ ID NO: 93190

SEQ ID NO: 750185 - RNA, 64 nt, Homo Sapiens; identical to SEQ ID NO: 93191

SEQ ID NO: 750186 - RNA, 64 nt, Homo Sapiens; identical to SEQ ID NO: 93192

SEQ ID NO: 750187 - RNA, 64 nt, Homo Sapiens; identical to SEQ ID NO: 93193

SEQ ID NO: 750188 - RNA, 64 nt, Homo Sapiens; identical to SEQ ID NO: 93194

SEQ ID NO: 750189 - RNA, 64 nt, Homo Sapiens; identical to SEQ ID NO: 93195

SEQ ID NO: 750190 - RNA, 64 nt, Homo Sapiens; identical to SEQ ID NO: 93196

SEQ ID NO: 750191 - RNA, 64 nt, Homo Sapiens; identical to SEQ ID NO: 93197

SEQ ID NO: 750192 - RNA, 64 nt, Homo Sapiens; identical to SEQ ID NO: 93198

SEQ ID NO: 750193 - RNA, 64 nt, Homo Sapiens; identical to SEQ ID NO: 93199

SEQ ID NO: 750194 - RNA, 64 nt, Homo Sapiens; identical to SEQ ID NO: 608232

SEQ ID NO: 750195 - RNA, 64 nt, Homo Sapiens; identical to SEQ ID NO: 608233

SEQ ID NO: 750196 - RNA, 64 nt, Homo Sapiens; identical to SEQ ID NO: 608234

SEQ ID NO: 750197 - RNA, 64 nt, Homo Sapiens; identical to SEQ ID NO: 608235

SEQ ID NO: 750198 - RNA, 64 nt, Homo Sapiens; identical to SEQ ID NO: 608236

SEQ ID NO: 750199 - RNA, 64 nt, Homo Sapiens; identical to SEQ ID NO: 608237

SEQ ID NO: 750200 - RNA, 64 nt, Homo Sapiens; identical to SEQ ID NO: 608238

SEQ ID NO: 750201 - RNA, 64 nt, Homo Sapiens; identical to SEQ ID NO: 608239

SEQ ID NO: 750202 - RNA, 64 nt, Homo Sapiens; identical to SEQ ID NO: 608240

SEQ ID NO: 750203 - RNA, 64 nt, Homo Sapiens; identical to SEQ ID NO: 608241

SEQ ID NO: 750204 - RNA, 64 nt, Homo Sapiens; identical to SEQ ID NO: 608242

SEQ ID NO: 750205 - RNA, 64 nt, Homo Sapiens; identical to SEQ ID NO: 608243

SEQ ID NO: 750206 - RNA, 64 nt, Homo Sapiens; identical to SEQ ID NO: 608244

SEQ ID NO: 750207 - RNA, 64 nt, Homo Sapiens; identical to SEQ ID NO: 608245

SEQ ID NO: 750208 - RNA, 64 nt, Homo Sapiens; identical to SEQ ID NO: 608246

SEQ ID NO: 750209 - RNA, 64 nt, Homo Sapiens; identical to SEQ ID NO: 608247

SEQ ID NO: 750210 - RNA, 64 nt, Homo Sapiens; identical to SEQ ID NO: 608248

SEQ ID NO: 750211 - RNA, 64 nt, Homo Sapiens; identical to SEQ ID NO: 608249

SEQ ID NO: 750212 - RNA, 64 nt, Homo Sapiens; identical to SEQ ID NO: 608250

SEQ ID NO: 750213 - RNA, 64 nt, Homo Sapiens; identical to SEQ ID NO: 608251

SEQ ID NO: 750214 - RNA, 64 nt, Homo Sapiens; identical to SEQ ID NO: 608252

SEQ ID NO: 750215 - RNA, 64 nt, Homo Sapiens; identical to SEQ ID NO: 608253

SEQ ID NO: 750216 - RNA, 64 nt, Homo Sapiens; identical to SEQ ID NO: 608254

SEQ ID NO: 750217 - RNA, 64 nt, Homo Sapiens; identical to SEQ ID NO: 608255

SEQ ID NO: 750218 - RNA, 64 nt, Homo Sapiens
aacgacagguggaagguuguccagagacaccuacagcguggaugcuguuccgagucagcguagg

SEQ ID NO: 750219 - RNA, 64 nt, Homo Sapiens
gacagaagacggcgagggcaucgucauugcccugagcguggacacgccaccggcagccguaagg

SEQ ID NO: 750220 - RNA, 64 nt, Homo Sapiens; identical to SEQ ID NO: 74512

SEQ ID NO: 750221 - RNA, 64 nt, Homo Sapiens; identical to SEQ ID NO: 74513

SEQ ID NO: 750222 - RNA, 64 nt, Homo Sapiens; identical to SEQ ID NO: 74514

SEQ ID NO: 750223 - RNA, 64 nt, Homo Sapiens; identical to SEQ ID NO: 74515

SEQ ID NO: 750224 - RNA, 64 nt, Homo Sapiens; identical to SEQ ID NO: 74516

SEQ ID NO: 750225 - RNA, 64 nt, Homo Sapiens; identical to SEQ ID NO: 74517

SEQ ID NO: 750226 - RNA, 64 nt, Homo Sapiens; identical to SEQ ID NO: 74518

SEQ ID NO: 750227 - RNA, 64 nt, Homo Sapiens; identical to SEQ ID NO: 74519

SEQ ID NO: 750228 - RNA, 64 nt, Homo Sapiens; identical to SEQ ID NO: 74520

SEQ ID NO: 750229 - RNA, 64 nt, Homo Sapiens; identical to SEQ ID NO: 74521

SEQ ID NO: 750230 - RNA, 64 nt, Homo Sapiens; identical to SEQ ID NO: 74522

SEQ ID NO: 750231 - RNA, 64 nt, Homo Sapiens; identical to SEQ ID NO: 74523

SEQ ID NO: 750232 - RNA, 64 nt, Homo Sapiens; identical to SEQ ID NO: 74524

SEQ ID NO: 750233 - RNA, 64 nt, Homo Sapiens; identical to SEQ ID NO: 74525

SEQ ID NO: 750234 - RNA, 64 nt, Homo Sapiens; identical to SEQ ID NO: 74526

SEQ ID NO: 750235 - RNA, 64 nt, Homo Sapiens; identical to SEQ ID NO: 74527

SEQ ID NO: 750236 - RNA, 64 nt, Homo Sapiens; identical to SEQ ID NO: 74528

SEQ ID NO: 750237 - RNA, 64 nt, Homo Sapiens; identical to SEQ ID NO: 74529

SEQ ID NO: 750238 - RNA, 64 nt, Homo Sapiens; identical to SEQ ID NO: 74530

SEQ ID NO: 750239 - RNA, 64 nt, Homo Sapiens; identical to SEQ ID NO: 74531

SEQ ID NO: 750240 - RNA, 64 nt, Homo Sapiens; identical to SEQ ID NO: 74532

SEQ ID NO: 750241 - RNA, 64 nt, Homo Sapiens; identical to SEQ ID NO: 74533

SEQ ID NO: 750242 - RNA, 54 nt, Homo Sapiens; identical to SEQ ID NO: 74534

SEQ ID NO: 750243 - RNA, 64 nt, Homo Sapiens; identical to SEQ ID NO: 74535

SEQ ID NO: 750244 - RNA, 64 nt, Homo Sapiens; identical to SEQ ID NO: 74536

SEQ ID NO: 750245 - RNA, 64 nt, Homo Sapiens; identical to SEQ ID NO: 74537

SEQ ID NO: 750246 - RNA, 64 nt, Homo Sapiens; identical to SEQ ID NO: 74538

SEQ ID NO: 750247 - RNA, 64 nt, Homo Sapiens; identical to SEQ ID NO: 74539

SEQ ID NO: 750248 - RNA, 64 nt, Homo Sapiens; identical to SEQ ID NO: 74540

SEQ ID NO: 750249 - RNA, 64 nt, Homo Sapiens; identical to SEQ ID NO: 74541

SEQ ID NO: 750250 - RNA, 64 nt, Homo Sapiens; identical to SEQ ID NO: 74542

SEQ ID NO: 750251 - RNA, 64 nt, Homo Sapiens; identical to SEQ ID NO: 95596

SEQ ID NO: 750252 - RNA, 64 nt, Homo Sapiens; identical to SEQ ID NO: 95597

SEQ ID NO: 750253 - RNA, 64 nt, Homo Sapiens; identical to SEQ ID NO: 95598

SEQ ID NO: 750254 - RNA, 64 nt, Homo Sapiens; identical to SEQ ID NO: 95599

SEQ ID NO: 750255 - RNA, 64 nt, Homo Sapiens; identical to SEQ ID NO: 95600

SEQ ID NO: 750256 - RNA, 64 nt, Homo Sapiens; identical to SEQ ID NO: 95601

SEQ ID NO: 750257 - RNA, 64 nt, Homo Sapiens; identical to SEQ ID NO: 95602

SEQ ID NO: 750258 - RNA, 64 nt, Homo Sapiens; identical to SEQ ID NO: 95603

SEQ ID NO: 750259 - RNA, 64 nt, Homo Sapiens; identical to SEQ ID NO: 95604

SEQ ID NO: 750260 - RNA, 64 nt, Homo Sapiens; identical to SEQ ID NO: 95605

SEQ ID NO: 750261 - RNA, 64 nt, Homo Sapiens
cuggcaagucuaggugggcgggugacagggaaagcaugggcauuuuuguauugcugucacaugc

SEQ ID NO: 750262 - RNA, 64 nt, Homo Sapiens
uugcaaguguggugagaggcucuacuagcaaagacaugggcaccggaguaggucccguguagca

SEQ ID NO: 750263 - RNA, 64 nt, Homo Sapiens
augugcacaggggacagagucuugaggccugucacaugggcagcaugaugcuugggcuuaggau

SEQ ID NO: 750264 - RNA, 64 nt, Homo Sapiens
gacagcccaucccugcuccacaaggcaugcugagcaugggcacacggccaccaccuccuccccu

SEQ ID NO: 750265 - RNA, 64 nt, Homo Sapiens
agacagucugcacugcgccucaucccagcgcccacaugggcaugugagacaucuguacaggaag

SEQ ID NO: 750266 - RNA, 64 nt, Homo Sapiens
cacagacugcgugcuuucauagcacgagaguccucaugggcacuagccagggccacgggggccc

SEQ ID NO: 750267 - RNA, 64 nt, Homo Sapiens
caggaaguggaggugaaugugaaggccgcgaagccaugggcagacaguuggccagcugggguga

SEQ ID NO: 750268 - RNA, 64 nt, Homo Sapiens
gcgaggcccauaguggugggccccucaggcccggcaugggcaguauacuaaagucugagccagg

SEQ ID NO: 750269 - RNA, 64 nt, Homo Sapiens
gguuguggguccuggugaaggcuccacaggucuucaugggcaggugcaucaggggaugcccuga

SEQ ID NO: 750270 - RNA, 64 nt, Homo Sapiens
acauguuuauugcacagaguuccugacugaggaacaugggcagagcucuccgggagccugaacc

SEQ ID NO: 750271 - RNA, 64 nt, Homo Sapiens
uagugcccucuugagagucauggaccugugaagccaugggcaggcuucugcuugcugggcuggc

SEQ ID NO: 750272 - RNA, 64 nt, Homo Sapiens
cauuaguggcuucagauugggaucuucauggagacaugggcaaggcuuuuccucuuugccacug

SEQ ID NO: 750273 - RNA, 64 nt, Homo Sapiens
gccuucccugccuguggggggcagagagacacagcaugggcagugccucaugggcagggccaca

SEQ ID NO: 750274 - RNA, 64 nt, Homo Sapiens
gccacagcagagagacacagacaggaaauugccucaugggcaggagagugcaaccccacccucc

SEQ ID NO: 750275 - RNA, 64 nt, Homo Sapiens
uuccugcuggggcggugcggagggaaggccucuucaugggcaugggaggccccugcuugugcuc

SEQ ID NO: 750276 - RNA, 64 nt, Homo Sapiens
gguucuggguaggacggucauggccagagcucagcaugggcaggguccauccucccuauggccc

SEQ ID NO: 750277 - RNA, 64 nt, Homo Sapiens
ggcugagggggccgggcugaaacguggaggcccucaugggcaaugaugccagcgaccaucagac

SEQ ID NO: 750278 - RNA, 64 nt, Homo Sapiens
ggggucuccaucagccucuguggcagagauggggcaugggcauuugcuguggccccugcaggug

SEQ ID NO: 750279 - RNA, 64 nt, Homo Sapiens
agucucccaggacccccuuuggagaugcccauggcaugggcacugcccacaggcucagccagaa

SEQ ID NO: 750280 - RNA, 64 nt, Homo Sapiens
caggucucucuuguuggccagagggccugcuucccaugggcauugcaagugccaccgugcgggg

SEQ ID NO: 750281 - RNA, 64 nt, Homo Sapiens
ucccugagagcagugggagacagcauaagugaaucaugggcauuagcugcacuuguuguugaua

SEQ ID NO: 750282 - RNA, 64 nt, Homo Sapiens
gcuaacauuaucccccagugaggccauucauucccaugggcacaucucguacaguugggauagg

SEQ ID NO: 750283 - RNA, 64 nt, Homo Sapiens
cuuucuuuacccagugcaauugguuuguuugugugcaaaccaaaguugagccuugcuggacaag

SEQ ID NO: 750284 - RNA, 64 nt, Homo Sapiens
cugugaccaacacaugugagggugacuucccuuugcaaaccagggucaucagucaucucuuuau

SEQ ID NO: 750285 - RNA, 64 nt, Homo Sapiens
agcuuuggcuucugguguggugaagcguuguuuggcaaaccaacacguuucacauuaaauggug

SEQ ID NO: 750286 - RNA, 64 nt, Homo Sapiens
cuuuuuaaaacaaacaaacaaacaaaacaaaaaagcaaaccacauuuguuaucucaaauuuuga

SEQ ID NO: 750287 - RNA, 64 nt, Homo Sapiens
augggcuuuguuagcacuuucaaaaaaaaaaaaagcaaaccauacuuguccacuguccugugcu

SEQ ID NO: 750288 - RNA, 64 nt, Homo Sapiens; identical to SEQ ID NO: 681250

SEQ ID NO: 750289 - RNA, 64 nt, Homo Sapiens; identical to SEQ ID NO: 681251

SEQ ID NO: 750290 - RNA, 64 nt, Homo Sapiens; identical to SEQ ID NO: 681252

SEQ ID NO: 750291 - RNA, 64 nt, Homo Sapiens; identical to SEQ ID NO: 681253

SEQ ID NO: 750292 - RNA, 64 nt, Homo Sapiens; identical to SEQ ID NO: 681254

SEQ ID NO: 750293 - RNA, 64 nt, Homo Sapiens; identical to SEQ ID NO: 681255

SEQ ID NO: 750294 - RNA, 64 nt, Homo Sapiens; identical to SEQ ID NO: 681256

SEQ ID NO: 750295 - RNA, 64 nt, Homo Sapiens; identical to SEQ ID NO: 681257

SEQ ID NO: 750296 - RNA, 64 nt, Homo Sapiens; identical to SEQ ID NO: 681258

SEQ ID NO: 750297 - RNA, 64 nt, Homo Sapiens; identical to SEQ ID NO: 681259

SEQ ID NO: 750298 - RNA, 64 nt, Homo Sapiens; identical to SEQ ID NO: 681260

SEQ ID NO: 750299 - RNA, 64 nt, Homo Sapiens; identical to SEQ ID NO: 681261

SEQ ID NO: 750300 - RNA, 64 nt, Homo Sapiens; identical to SEQ ID NO: 681262

SEQ ID NO: 750301 - RNA, 64 nt, Homo Sapiens; identical to SEQ ID NO: 681263

SEQ ID NO: 750302 - RNA, 64 nt, Homo Sapiens; identical to SEQ ID NO: 681264

SEQ ID NO: 750303 - RNA, 64 nt, Homo Sapiens; identical to SEQ ID NO: 681265

SEQ ID NO: 750304 - RNA, 64 nt, Homo Sapiens; identical to SEQ ID NO: 681266

SEQ ID NO: 750305 - RNA, 64 nt, Homo Sapiens; identical to SEQ ID NO: 681267

SEQ ID NO: 750306 - RNA, 64 nt, Homo Sapiens; identical to SEQ ID NO: 681268

SEQ ID NO: 750307 - RNA, 64 nt, Homo Sapiens; identical to SEQ ID NO: 681269

SEQ ID NO: 750308 - RNA, 64 nt, Homo Sapiens; identical to SEQ ID NO: 681270

SEQ ID NO: 750309 - RNA, 64 nt, Homo Sapiens; identical to SEQ ID NO: 681271

SEQ ID NO: 750310 - RNA, 64 nt, Homo Sapiens; identical to SEQ ID NO: 681272

SEQ ID NO: 750311 - RNA, 64 nt, Homo Sapiens; identical to SEQ ID NO: 681273

SEQ ID NO: 750312 - RNA, 64 nt, Homo Sapiens; identical to SEQ ID NO: 681274

SEQ ID NO: 750313 - RNA, 64 nt, Homo Sapiens; identical to SEQ ID NO: 681275

SEQ ID NO: 750314 - RNA, 64 nt, Homo Sapiens; identical to SEQ ID NO: 681276

SEQ ID NO: 750315 - RNA, 64 nt, Homo Sapiens; identical to SEQ ID NO: 681277

SEQ ID NO: 750316 - RNA, 64 nt, Homo Sapiens; identical to SEQ ID NO: 681278

SEQ ID NO: 750317 - RNA, 64 nt, Homo Sapiens; identical to SEQ ID NO: 681279

SEQ ID NO: 750318 - RNA, 64 nt, Homo Sapiens; identical to SEQ ID NO: 681280

SEQ ID NO: 750319 - RNA, 64 nt, Homo Sapiens; identical to SEQ ID NO: 681281

SEQ ID NO: 750320 - RNA, 64 nt, Homo Sapiens; identical to SEQ ID NO: 681282

SEQ ID NO: 750321 - RNA, 64 nt, Homo Sapiens; identical to SEQ ID NO: 681283

SEQ ID NO: 750322 - RNA, 64 nt, Homo Sapiens; identical to SEQ ID NO: 681284

SEQ ID NO: 750323 - RNA, 64 nt, Homo Sapiens; identical to SEQ ID NO: 681285

SEQ ID NO: 750324 - RNA, 64 nt, Homo Sapiens; identical to SEQ ID NO: 681286

SEQ ID NO: 750325 - RNA, 64 nt, Homo Sapiens; identical to SEQ ID NO: 681287

SEQ ID NO: 750326 - RNA, 64 nt, Homo Sapiens; identical to SEQ ID NO: 681288

SEQ ID NO: 750327 - RNA, 64 nt, Homo Sapiens; identical to SEQ ID NO: 681289

SEQ ID NO: 750328 - RNA, 64 nt, Homo Sapiens; identical to SEQ ID NO: 115857

SEQ ID NO: 750329 - RNA, 64 nt, Homo Sapiens; identical to SEQ ID NO: 115858

SEQ ID NO: 750330 - RNA, 64 nt, Homo Sapiens; identical to SEQ ID NO: 115859

SEQ ID NO: 750331 - RNA, 64 nt, Homo Sapiens; identical to SEQ ID NO: 115860

SEQ ID NO: 750332 - RNA, 64 nt, Homo Sapiens
ugacuguguuugugaaaacuguaaaucuggaaauuugauagacuuuuagagggcacauuuugcu

SEQ ID NO: 750333 - RNA, 64 nt, Homo Sapiens
acuuuucauucuauaaauacgugaaaaguguauuuugauagagauauuuuauuuauuuuuccca

SEQ ID NO: 750334 - RNA, 64 nt, Homo Sapiens
uaauauucuagcucucuuuauuauggaacagaucuugauagaugguuuaauuuucuccuaaaga

SEQ ID NO: 750335 - RNA, 64 nt, Homo Sapiens
caguuuacagugucauucuuccacgaauagguaauugauagaguuuaugggucuuagucuuaag

SEQ ID NO: 750336 - RNA, 64 nt, Homo Sapiens
aauaauucuucugucaaaggagguuaaauuuuaguugauagaguacuuaaaugcauuacuuuau

SEQ ID NO: 750337 - RNA, 64 nt, Homo Sapiens
aaacuguguaguaccuuagacuuggcauuuauuuuugauagagcagagauaaaauauuuugaug

SEQ ID NO: 750338 - RNA, 64 nt, Homo Sapiens
caaacagauaguaugagaaauaccucagagaaauuugauagacuauugcuugaaaaugagugag

SEQ ID NO: 750339 - RNA, 64 nt, Homo Sapiens
uuuagcuccugagauauuuauucauuauuaaaaauugauagaauuugguuaagauuuugacuac

SEQ ID NO: 750340 - RNA, 64 nt, Homo Sapiens
uuucaggcuugugacucaacaaagggcuuuuccauugauagaagcaguuugggauuuguaguug

SEQ ID NO: 750341 - RNA, 64 nt, Homo Sapiens
uugguuggaacgcauuggcuuuuuuuuucuuguuuugauagaaauggaauuaagcaaaaguagu

SEQ ID NO: 750342 - RNA, 64 nt, Homo Sapiens
auuacccacggugcuuauuagacucuauuggcaauugauagaguguacugccuaaaaagaguua

SEQ ID NO: 750343 - RNA, 64 nt, Homo Sapiens
uuacaucuuugauauaaagcuuaucuuaaagcaauugauagauucuuacuuucauuuauguuua

SEQ ID NO: 750344 - RNA, 64 nt, Homo Sapiens
aaccuuucauuuuuuuaggugaagcgcucaugauuugauagauuagcuagucauccauaucauu

SEQ ID NO: 750345 - RNA, 64 nt, Homo Sapiens
ugcacuuaauuuucaguaguuucauuucuaguucuugauagaacaagugacacuacgcgugcag

SEQ ID NO: 750346 - RNA, 64 nt, Homo Sapiens
uaucauagcucuauauugaaggauucagggucucuugauagacuaucauauuacaaguacguaa

SEQ ID NO: 750347 - RNA, 64 nt, Homo Sapiens
uaaauuuaaauuuguccucccuccaacuaaauuuuugauagaaugaauuaaauuuaaauuuauc

SEQ ID NO: 750348 - RNA, 64 nt, Homo Sapiens
uaaauuuaaauuuauccuccaauuugauaaauuuuugauagaauuggaguguuugcacaauuua

SEQ ID NO: 750349 - RNA, 64 nt, Homo Sapiens
cccaacugauguggagaaaaauugauguuugauguugauagauaugcuuauaccuaauuuuuag

SEQ ID NO: 750350 - RNA, 64 nt, Homo Sapiens
uuaauauauagaacuuuaccaucaccagccguaguugauagaaaauauuaguuucagaauuacc

SEQ ID NO: 750351 - RNA, 64 nt, Homo Sapiens
uuauauuauuuuuauuuuauaauuucuuuauaauuugauagagauguggucaacauuuugauag

SEQ ID NO: 750352 - RNA, 64 nt, Homo Sapiens
uucuuuauaauuugauagagauguggucaacauuuugauagaaugcaaauggucugacuucuuu

SEQ ID NO: 750353 - RNA, 64 nt, Homo Sapiens
auacauaaagaaauguuucaguuaggcauuaaccuugauagaaucacucaguuuggugcuuuaa

SEQ ID NO: 750354 - RNA, 64 nt, Homo Sapiens
gaauaugaagggauuguaaaaaacaaaauguccauugauagaccaucguguacaaguagauuuc

SEQ ID NO: 750355 - RNA, 64 nt, Homo Sapiens
uggagaugagcuuugcaaagagaagaauugagaauugauagauugugguuagucuuuuauuuua

SEQ ID NO: 750356 - RNA, 64 nt, Homo Sapiens
gcacaggagauaccuuaugaucagcagcccucgguugauagaaaacagaggaaugucuuauacu

SEQ ID NO: 750357 - RNA, 64 nt, Homo Sapiens
uucauguuuaaauuauacauacaguacaucuauauugauagaggaugauaguuuguuuugcuau

SEQ ID NO: 750358 - RNA, 59 nt, Homo Sapiens
ggacugcaguuugcuuugagcauuugcuuuugauagaaacugaguuagagaagcaguag

SEQ ID NO: 750359 - RNA, 64 nt, Homo Sapiens
guauguaagcuuuuggcauuuauaugaauuuuuauugauagagauaaauuuuauauaaauaagu

SEQ ID NO: 750360 - RNA, 64 nt, Homo Sapiens
caugaugaccaugacaaaguaagugagcuuauuguugauagaaauucaucauagauuucaacgu

SEQ ID NO: 750361 - RNA, 64 nt, Homo Sapiens; identical to SEQ ID NO: 746229

SEQ ID NO: 750362 - RNA, 64 nt, Homo Sapiens; identical to SEQ ID NO: 746230

SEQ ID NO: 750363 - RNA, 64 nt, Homo Sapiens; identical to SEQ ID NO: 746231

SEQ ID NO: 750364 - RNA, 64 nt, Homo Sapiens; identical to SEQ ID NO: 746232

SEQ ID NO: 750365 - RNA, 64 nt, Homo Sapiens; identical to SEQ ID NO: 746233

SEQ ID NO: 750366 - RNA, 64 nt, Homo Sapiens; identical to SEQ ID NO: 746234

SEQ ID NO: 750367 - RNA, 64 nt, Homo Sapiens; identical to SEQ ID NO: 746235

SEQ ID NO: 750368 - RNA, 64 nt, Homo Sapiens; identical to SEQ ID NO: 746236

SEQ ID NO: 750369 - RNA, 64 nt, Homo Sapiens; identical to SEQ ID NO: 746237

SEQ ID NO: 750370 - RNA, 64 nt, Homo Sapiens; identical to SEQ ID NO: 746238

SEQ ID NO: 750371 - RNA, 64 nt, Homo Sapiens; identical to SEQ ID NO: 746239

SEQ ID NO: 750372 - RNA, 64 nt, Homo Sapiens; identical to SEQ ID NO: 746240

SEQ ID NO: 750373 - RNA, 64 nt, Homo Sapiens; identical to SEQ ID NO: 746241

SEQ ID NO: 750374 - RNA, 64 nt, Homo Sapiens; identical to SEQ ID NO: 746242

SEQ ID NO: 750375 - RNA, 64 nt, Homo Sapiens; identical to SEQ ID NO: 746243

SEQ ID NO: 750376 - RNA, 64 nt, Homo Sapiens; identical to SEQ ID NO: 746244

SEQ ID NO: 750377 - RNA, 64 nt, Homo Sapiens; identical to SEQ ID NO: 746245

SEQ ID NO: 750378 - RNA, 64 nt, Homo Sapiens; identical to SEQ ID NO: 746246

SEQ ID NO: 750379 - RNA, 64 nt, Homo Sapiens; identical to SEQ ID NO: 746247

SEQ ID NO: 750380 - RNA, 64 nt, Homo Sapiens; identical to SEQ ID NO: 746248

SEQ ID NO: 750381 - RNA, 64 nt, Homo Sapiens; identical to SEQ ID NO: 746249

SEQ ID NO: 750382 - RNA, 64 nt, Homo Sapiens; identical to SEQ ID NO: 746250

SEQ ID NO: 750383 - RNA, 64 nt, Homo Sapiens; identical to SEQ ID NO: 746251

SEQ ID NO: 750384 - RNA, 64 nt, Homo Sapiens; identical to SEQ ID NO: 746252

SEQ ID NO: 750385 - RNA, 64 nt, Homo Sapiens; identical to SEQ ID NO: 746253

SEQ ID NO: 750386 - RNA, 64 nt, Homo Sapiens; identical to SEQ ID NO: 746254

SEQ ID NO: 750387 - RNA, 64 nt, Homo Sapiens; identical to SEQ ID NO: 746255

SEQ ID NO: 750388 - RNA, 64 nt, Homo Sapiens; identical to SEQ ID NO: 746256

SEQ ID NO: 750389 - RNA, 64 nt, Homo Sapiens; identical to SEQ ID NO: 746257

SEQ ID NO: 750390 - RNA, 64 nt, Homo Sapiens; identical to SEQ ID NO: 746258

SEQ ID NO: 750391 - RNA, 64 nt, Homo Sapiens; identical to SEQ ID NO: 746259

SEQ ID NO: 750392 - RNA, 64 nt, Homo Sapiens; identical to SEQ ID NO: 746260

SEQ ID NO: 750393 - RNA, 64 nt, Homo Sapiens; identical to SEQ ID NO: 746261

SEQ ID NO: 750394 - RNA, 64 nt, Homo Sapiens; identical to SEQ ID NO: 746262

SEQ ID NO: 750395 - RNA, 64 nt, Homo Sapiens; identical to SEQ ID NO: 746263

SEQ ID NO: 750396 - RNA, 64 nt, Homo Sapiens; identical to SEQ ID NO: 746264

SEQ ID NO: 750397 - RNA, 64 nt, Homo Sapiens; identical to SEQ ID NO: 746265

SEQ ID NO: 750398 - RNA, 64 nt, Homo Sapiens; identical to SEQ ID NO: 746266

SEQ ID NO: 750399 - RNA, 64 nt, Homo Sapiens; identical to SEQ ID NO: 746267

SEQ ID NO: 750400 - RNA, 64 nt, Homo Sapiens; identical to SEQ ID NO: 746268

SEQ ID NO: 750401 - RNA, 64 nt, Homo Sapiens; identical to SEQ ID NO: 746269

SEQ ID NO: 750402 - RNA, 60 nt, Homo Sapiens; identical to SEQ ID NO: 746270

SEQ ID NO: 750403 - RNA, 64 nt, Homo Sapiens; identical to SEQ ID NO: 746271

SEQ ID NO: 750404 - RNA, 64 nt, Homo Sapiens; identical to SEQ ID NO: 746272

SEQ ID NO: 750405 - RNA, 64 nt, Homo Sapiens; identical to SEQ ID NO: 746273

SEQ ID NO: 750406 - RNA, 64 nt, Homo Sapiens; identical to SEQ ID NO: 746274

SEQ ID NO: 750407 - RNA, 64 nt, Homo Sapiens; identical to SEQ ID NO: 746275

SEQ ID NO: 750408 - RNA, 64 nt, Homo Sapiens; identical to SEQ ID NO: 746276

SEQ ID NO: 750409 - RNA, 64 nt, Homo Sapiens; identical to SEQ ID NO: 746277

SEQ ID NO: 750410 - RNA, 64 nt, Homo Sapiens; identical to SEQ ID NO: 746278

SEQ ID NO: 750411 - RNA, 64 nt, Homo Sapiens; identical to SEQ ID NO: 746279

SEQ ID NO: 750412 - RNA, 64 nt, Homo Sapiens; identical to SEQ ID NO: 746280

SEQ ID NO: 750413 - RNA, 64 nt, Homo Sapiens; identical to SEQ ID NO: 746281

SEQ ID NO: 750414 - RNA, 64 nt, Homo Sapiens; identical to SEQ ID NO: 746282

SEQ ID NO: 750415 - RNA, 64 nt, Homo Sapiens; identical to SEQ ID NO: 746283

SEQ ID NO: 750416 - RNA, 64 nt, Homo Sapiens; identical to SEQ ID NO: 746284

SEQ ID NO: 750417 - RNA, 64 nt, Homo Sapiens; identical to SEQ ID NO: 746285

SEQ ID NO: 750418 - RNA, 64 nt, Homo Sapiens; identical to SEQ ID NO: 746286

SEQ ID NO: 750419 - RNA, 64 nt, Homo Sapiens; identical to SEQ ID NO: 746287

SEQ ID NO: 750420 - RNA, 64 nt, Homo Sapiens; identical to SEQ ID NO: 746288

SEQ ID NO: 750421 - RNA, 64 nt, Homo Sapiens; identical to SEQ ID NO: 746289

SEQ ID NO: 750422 - RNA, 64 nt, Homo Sapiens; identical to SEQ ID NO: 746290

SEQ ID NO: 750423 - RNA, 64 nt, Homo Sapiens; identical to SEQ ID NO: 746291

SEQ ID NO: 750424 - RNA, 64 nt, Homo Sapiens; identical to SEQ ID NO: 746292

SEQ ID NO: 750425 - RNA, 64 nt, Homo Sapiens; identical to SEQ ID NO: 746293

SEQ ID NO: 750426 - RNA, 64 nt, Homo Sapiens; identical to SEQ ID NO: 746294

SEQ ID NO: 750427 - RNA, 64 nt, Homo Sapiens; identical to SEQ ID NO: 746295

SEQ ID NO: 750428 - RNA, 64 nt, Homo Sapiens; identical to SEQ ID NO: 746296

SEQ ID NO: 750429 - RNA, 64 nt, Homo Sapiens; identical to SEQ ID NO: 746297

SEQ ID NO: 750430 - RNA, 64 nt, Homo Sapiens; identical to SEQ ID NO: 746298

SEQ ID NO: 750431 - RNA, 64 nt, Homo Sapiens; identical to SEQ ID NO: 746299

SEQ ID NO: 750432 - RNA, 64 nt, Homo Sapiens; identical to SEQ ID NO: 746300

SEQ ID NO: 750433 - RNA, 64 nt, Homo Sapiens; identical to SEQ ID NO: 746301

SEQ ID NO: 750434 - RNA, 64 nt, Homo Sapiens; identical to SEQ ID NO: 746302

SEQ ID NO: 750435 - RNA, 56 nt, Homo Sapiens; identical to SEQ ID NO: 746303

SEQ ID NO: 750436 - RNA, 64 nt, Homo Sapiens; identical to SEQ ID NO: 746304

SEQ ID NO: 750437 - RNA, 64 nt, Homo Sapiens; identical to SEQ ID NO: 746305

SEQ ID NO: 750438 - RNA, 64 nt, Homo Sapiens; identical to SEQ ID NO: 746306

SEQ ID NO: 750439 - RNA, 64 nt, Homo Sapiens; identical to SEQ ID NO: 746307

SEQ ID NO: 750440 - RNA, 64 nt, Homo Sapiens; identical to SEQ ID NO: 746308

SEQ ID NO: 750441 - RNA, 64 nt, Homo Sapiens; identical to SEQ ID NO: 746309

SEQ ID NO: 750442 - RNA, 64 nt, Homo Sapiens; identical to SEQ ID NO: 746310

SEQ ID NO: 750443 - RNA, 64 nt, Homo Sapiens; identical to SEQ ID NO: 746311

SEQ ID NO: 750444 - RNA, 64 nt, Homo Sapiens; identical to SEQ ID NO: 746312

SEQ ID NO: 750445 - RNA, 64 nt, Homo Sapiens; identical to SEQ ID NO: 746313

SEQ ID NO: 750446 - RNA, 64 nt, Homo Sapiens; identical to SEQ ID NO: 746314

SEQ ID NO: 750447 - RNA, 64 nt, Homo Sapiens; identical to SEQ ID NO: 746315

SEQ ID NO: 750448 - RNA, 64 nt, Homo Sapiens; identical to SEQ ID NO: 746316

SEQ ID NO: 750449 - RNA, 64 nt, Homo Sapiens; identical to SEQ ID NO: 746317

SEQ ID NO: 750450 - RNA, 64 nt, Homo Sapiens; identical to SEQ ID NO: 746318

SEQ ID NO: 750451 - RNA, 62 nt, Homo Sapiens
acaagacaggaagcacggucuuaggcggauggaggccugacgucccuggaguugaaagccca

SEQ ID NO: 750452 - RNA, 62 nt, Homo Sapiens
uauauuugucaccagauuagagaggcgugucaaggccugaaggagcccaugugguuggauaa

SEQ ID NO: 750453 - RNA, 62 nt, Homo Sapiens
ggcagauugguucaugccugccagaggaagggaggccugaggcaugccccacucugcugagg

SEQ ID NO: 750454 - RNA, 62 nt, Homo Sapiens
uaggugcuggcaugucuggggugcuggucucuaggccugaacaugccagugacugcugcgcu

SEQ ID NO: 750455 - RNA, 62 nt, Homo Sapiens
ccccggacauggcccugccccuaugggacaccaggccugacucaggcagguucugcccccca

SEQ ID NO: 750456 - RNA, 62 nt, Homo Sapiens
cacggccgccccacgugcugucgcucagcccgaggccugacuucucugggcugaggcugguc

SEQ ID NO: 750457 - RNA, 62 nt, Homo Sapiens
gaguguccagccaagggcugaguguccggcugaggccugagcgcauguccggcugaaggcug

SEQ ID NO: 750458 - RNA, 62 nt, Homo Sapiens
gaguguuuggccgaggccuggcugggagucugaggccugagucccacacccaggcccgcacc

SEQ ID NO: 750459 - RNA, 62 nt, Homo Sapiens
aaggaguggcucagccccaccugcccaucuggaggccugaguggcccucggugcccacgccu

SEQ ID NO: 750460 - RNA, 62 nt, Homo Sapiens
augugcacccucccagggacggguuugcaggaaggccugaacgugaaccccaugaagcugau

SEQ ID NO: 750461 - RNA, 62 nt, Homo Sapiens
gggaggaaacucaaagccgaaagcaaaauuccaggccugauucuggcuuuugagguuccugg

SEQ ID NO: 750462 - RNA, 62 nt, Homo Sapiens
ucuggcuuuugagguuccugguucuugaagccaggccugacccgacucucagauggggucag

SEQ ID NO: 750463 - RNA, 62 nt, Homo Sapiens
gguugagaacagacagcugucucuaggucccaaggccugaagagaaugccccugaaugggaa

SEQ ID NO: 750464 - RNA, 62 nt, Homo Sapiens
uccaggagggguaggggagaaaucacaggcuaaggccugaucgcaguuuauugauuagucca

SEQ ID NO: 750465 - RNA, 62 nt, Homo Sapiens
aaaacaggcuguuugcuguguuuccaggcuucaggccugaaccuggcuaggcucggcggccu

SEQ ID NO: 750466 - RNA, 62 nt, Homo Sapiens
cacgcugcuuccccccacagugcaccagggugaggccugacugggagaccugcuggugcccu

SEQ ID NO: 750467 - RNA, 62 nt, Homo Sapiens
cuguagagaggccugccuccagggcuggacugaggccugagcgcuccugccgcagagcuggc

SEQ ID NO: 750468 - RNA, 62 nt, Homo Sapiens
caaccuggggggcagugguguggagaagccacaggccugagauuucaucugcucuccuuccu

SEQ ID NO: 750469 - RNA, 62 nt, Homo Sapiens
uuggauuuacacuguaauaaggggcccaggggaggccugagcccaacgccggggcuuugcau

SEQ ID NO: 750470 - RNA, 62 nt, Homo Sapiens
gucucccuccucugccuccuaguggucuucacaggccugaugaaggacacgaggacgucagg

SEQ ID NO: 750471 - RNA, 62 nt, Homo Sapiens
ugcgccaguccugcuaccucccuugccuuucgaggccugaagccagcugcccuaugggccug

SEQ ID NO: 750472 - RNA, 62 nt, Homo Sapiens
auuauccuugggggcucccagggcaaggguuaaggccugaaucaugagccugcuggaagccc

SEQ ID NO: 750473 - RNA, 62 nt, Homo Sapiens
cuuuucucaucaaucacugaugcugaagcugcaggccugagcccuuugucucccuggaugcu

SEQ ID NO: 750474 - RNA, 62 nt, Homo Sapiens
guccaggguacaggugcgggugguggggaugaaggccugaccagggagggagaagcagguuu

SEQ ID NO: 750475 - RNA, 62 nt, Homo Sapiens
cccggugggcugaggcaggggccgcugucgucaggccugagccagggugagcuggugccugc

SEQ ID NO: 750476 - RNA, 62 nt, Homo Sapiens
gccucuggggugcuuggucucugcgaagucaaaggccugacagcucuguggccugggaaucc

SEQ ID NO: 750477 - RNA, 64 nt, Homo Sapiens; identical to SEQ ID NO: 99218

SEQ ID NO: 750478 - RNA, 64 nt, Homo Sapiens; identical to SEQ ID NO: 99219

SEQ ID NO: 750479 - RNA, 64 nt, Homo Sapiens; identical to SEQ ID NO: 99220

SEQ ID NO: 750480 - RNA, 64 nt, Homo Sapiens; identical to SEQ ID NO: 99221

SEQ ID NO: 750481 - RNA, 64 nt, Homo Sapiens; identical to SEQ ID NO: 99222

SEQ ID NO: 750482 - RNA, 64 nt, Homo Sapiens; identical to SEQ ID NO: 99223

SEQ ID NO: 750483 - RNA, 64 nt, Homo Sapiens; identical to SEQ ID NO: 99224

SEQ ID NO: 750484 - RNA, 64 nt, Homo Sapiens; identical to SEQ ID NO: 99225

SEQ ID NO: 750485 - RNA, 64 nt, Homo Sapiens; identical to SEQ ID NO: 99226

SEQ ID NO: 750486 - RNA, 64 nt, Homo Sapiens; identical to SEQ ID NO: 99227

SEQ ID NO: 750487 - RNA, 64 nt, Homo Sapiens; identical to SEQ ID NO: 99228

SEQ ID NO: 750488 - RNA, 64 nt, Homo Sapiens; identical to SEQ ID NO: 99229

SEQ ID NO: 750489 - RNA, 64 nt, Homo Sapiens; identical to SEQ ID NO: 99230

SEQ ID NO: 750490 - RNA, 64 nt, Homo Sapiens; identical to SEQ ID NO: 99231

SEQ ID NO: 750491 - RNA, 64 nt, Homo Sapiens; identical to SEQ ID NO: 99232

SEQ ID NO: 750492 - RNA, 64 nt, Homo Sapiens; identical to SEQ ID NO: 99233

SEQ ID NO: 750493 - RNA, 64 nt, Homo Sapiens; identical to SEQ ID NO: 99234

SEQ ID NO: 750494 - RNA, 64 nt, Homo Sapiens; identical to SEQ ID NO: 99235

SEQ ID NO: 750495 - RNA, 64 nt, Homo Sapiens; identical to SEQ ID NO: 99236

SEQ ID NO: 750496 - RNA, 64 nt, Homo Sapiens; identical to SEQ ID NO: 99237

SEQ ID NO: 750497 - RNA, 64 nt, Homo Sapiens; identical to SEQ ID NO: 99238

SEQ ID NO: 750498 - RNA, 64 nt, Homo Sapiens; identical to SEQ ID NO: 99239

SEQ ID NO: 750499 - RNA, 64 nt, Homo Sapiens; identical to SEQ ID NO: 99240

SEQ ID NO: 750500 - RNA, 64 nt, Homo Sapiens; identical to SEQ ID NO: 99241

SEQ ID NO: 750501 - RNA, 64 nt, Homo Sapiens; identical to SEQ ID NO: 534582

SEQ ID NO: 750502 - RNA, 64 nt, Homo Sapiens; identical to SEQ ID NO: 534583

SEQ ID NO: 750503 - RNA, 64 nt, Homo Sapiens; identical to SEQ ID NO: 534584

SEQ ID NO: 750504 - RNA, 64 nt, Homo Sapiens; identical to SEQ ID NO: 534585

SEQ ID NO: 750505 - RNA, 64 nt, Homo Sapiens; identical to SEQ ID NO: 534586

SEQ ID NO: 750506 - RNA, 64 nt, Homo Sapiens; identical to SEQ ID NO: 534587

SEQ ID NO: 750507 - RNA, 64 nt, Homo Sapiens; identical to SEQ ID NO: 534588

SEQ ID NO: 750508 - RNA, 64 nt, Homo Sapiens; identical to SEQ ID NO: 534589

SEQ ID NO: 750509 - RNA, 64 nt, Homo Sapiens; identical to SEQ ID NO: 534590

SEQ ID NO: 750510 - RNA, 64 nt, Homo Sapiens; identical to SEQ ID NO: 534591

SEQ ID NO: 750511 - RNA, 64 nt, Homo Sapiens; identical to SEQ ID NO: 534592

SEQ ID NO: 750512 - RNA, 64 nt, Homo Sapiens; identical to SEQ ID NO: 534593

SEQ ID NO: 750513 - RNA, 64 nt, Homo Sapiens; identical to SEQ ID NO: 534594

SEQ ID NO: 750514 - RNA, 64 nt, Homo Sapiens; identical to SEQ ID NO: 534595

SEQ ID NO: 750515 - RNA, 64 nt, Homo Sapiens; identical to SEQ ID NO: 534596

SEQ ID NO: 750516 - RNA, 64 nt, Homo Sapiens; identical to SEQ ID NO: 53255

SEQ ID NO: 750517 - RNA, 64 nt, Homo Sapiens; identical to SEQ ID NO: 53256

SEQ ID NO: 750518 - RNA, 64 nt, Homo Sapiens; identical to SEQ ID NO: 53257

SEQ ID NO: 750519 - RNA, 64 nt, Homo Sapiens; identical to SEQ ID NO: 53258

SEQ ID NO: 750520 - RNA, 64 nt, Homo Sapiens; identical to SEQ ID NO: 53259

SEQ ID NO: 750521 - RNA, 64 nt, Homo Sapiens; identical to SEQ ID NO: 53260

SEQ ID NO: 750522 - RNA, 64 nt, Homo Sapiens; identical to SEQ ID NO: 53261

SEQ ID NO: 750523 - RNA, 64 nt, Homo Sapiens; identical to SEQ ID NO: 53262

SEQ ID NO: 750524 - RNA, 64 nt, Homo Sapiens; identical to SEQ ID NO: 53263

SEQ ID NO: 750525 - RNA, 64 nt, Homo Sapiens; identical to SEQ ID NO: 53264

SEQ ID NO: 750526 - RNA, 64 nt, Homo Sapiens; identical to SEQ ID NO: 53265

SEQ ID NO: 750527 - RNA, 64 nt, Homo Sapiens; identical to SEQ ID NO: 53266

SEQ ID NO: 750528 - RNA, 64 nt, Homo Sapiens; identical to SEQ ID NO: 53267

SEQ ID NO: 750529 - RNA, 64 nt, Homo Sapiens; identical to SEQ ID NO: 53268

SEQ ID NO: 750530 - RNA, 62 nt, Homo Sapiens
ggcacuuaaaauaaauauaugccagaacugauaugcaugaaugugucauuaggauuguugcu

SEQ ID NO: 750531 - RNA, 62 nt, Homo Sapiens
uuuggucccuuucuuugaaaguaugucuguguaugcaugacaccugcuguuucuguugucuu

SEQ ID NO: 750532 - RNA, 62 nt, Homo Sapiens
gcucuuguuaaagauuuguuugaauauagaagaugcaugauuucuggguuuuuuuuuuuuuu

SEQ ID NO: 750533 - RNA, 62 nt, Homo Sapiens
uacaggcauaagccacugcgcccagccagaagaugcaugauuucuuaggaucauaugcuguu

SEQ ID NO: 750534 - RNA, 54 nt, Homo Sapiens; identical to SEQ ID NO: 102966

SEQ ID NO: 750535 - RNA, 62 nt, Homo Sapiens
guucuauaaucauauuauaugcacuaaacuauaugcaugaaaguucuuugcauggauuaaug

SEQ ID NO: 750536 - RNA, 62 nt, Homo Sapiens
caguuuuccuccugcucccagaauguccugugaugcaugauucuaagaacuggaagaaccug

SEQ ID NO: 750537 - RNA, 62 nt, Homo Sapiens
uccagaugucagaaaagaaagcauacaugcuuaugcaugaaacaauucugcaaaaaaaggau

SEQ ID NO: 750538 - RNA, 62 nt, Homo Sapiens
ucuguggaagaguaagaacauuaaaaugaaagaugcaugaugaaaaucuaaguagagaggcu

SEQ ID NO: 750539 - RNA, 62 nt, Homo Sapiens
aggcucuugugguuaacugauaauauugagugaugcaugagguagguguucagaguaauauu

SEQ ID NO: 750540 - RNA, 62 nt, Homo Sapiens
gaaaaauaaaaaccuguaucuuguaaguuugcaugcaugauguucuuaaacaguauaaauag

SEQ ID NO: 750541 - RNA, 62 nt, Homo Sapiens
uuaagggcaagaaacaguauugacugcugggcaugcaugaagauguucugcagaauggcacu

SEQ ID NO: 750542 - RNA, 62 nt, Homo Sapiens
cauaacuaugugggcaaaauagauagaauuaaaugcaugaauuuuccucagacuuauuuuau

SEQ ID NO: 750543 - RNA, 62 nt, Homo Sapiens
uaauacucugacagaaaaaaaucuuggauaauaugcaugagaaaaauccuucaauaaacaca

SEQ ID NO: 750544 - RNA, 62 nt, Homo Sapiens
aaucuucuuuuauuucuaggcuguacagucugaugcaugauuuuuuuauaaauauuucauac

SEQ ID NO: 750545 - RNA, 62 nt, Homo Sapiens
cagaugcuuuuuuuuucuucuuaccaucauuuaugcaugacauagguaaugugacuaauuuc

SEQ ID NO: 750546 - RNA, 62 nt, Homo Sapiens
acaugaaggcaagaaacagcauuggaaacaguaugcaugaagaguagaaggaauuuccagau

SEQ ID NO: 750547 - RNA, 62 nt, Homo Sapiens
ucauucuccuuuugagaaguaauuacccaaauaugcaugaauuuaaaaguuaaguccauucu

SEQ ID NO: 750548 - RNA, 65 nt, Homo Sapiens; identical to SEQ ID NO: 489615

SEQ ID NO: 750549 - RNA, 65 nt, Homo Sapiens; identical to SEQ ID NO: 489616

SEQ ID NO: 750550 - RNA, 65 nt, Homo Sapiens; identical to SEQ ID NO: 489617

SEQ ID NO: 750551 - RNA, 65 nt, Homo Sapiens; identical to SEQ ID NO: 489618

SEQ ID NO: 750552 - RNA, 65 nt, Homo Sapiens; identical to SEQ ID NO: 489619

SEQ ID NO: 750553 - RNA, 65 nt, Homo Sapiens; identical to SEQ ID NO: 489625

SEQ ID NO: 750554 - RNA, 65 nt, Homo Sapiens; identical to SEQ ID NO: 489626

SEQ ID NO: 750555 - RNA, 65 nt, Homo Sapiens; identical to SEQ ID NO: 489658

SEQ ID NO: 750556 - RNA, 65 nt, Homo Sapiens; identical to SEQ ID NO: 489659

SEQ ID NO: 750557 - RNA, 65 nt, Homo Sapiens; identical to SEQ ID NO: 489665

SEQ ID NO: 750558 - RNA, 65 nt, Homo Sapiens; identical to SEQ ID NO: 489666

SEQ ID NO: 750559 - RNA, 65 nt, Homo Sapiens; identical to SEQ ID NO: 489682

SEQ ID NO: 750560 - RNA, 65 nt, Homo Sapiens; identical to SEQ ID NO: 489683

SEQ ID NO: 750561 - RNA, 65 nt, Homo Sapiens; identical to SEQ ID NO: 489692

SEQ ID NO: 750562 - RNA, 65 nt, Homo Sapiens; identical to SEQ ID NO: 489693

SEQ ID NO: 750563 - RNA, 65 nt, Homo Sapiens; identical to SEQ ID NO: 489712

SEQ ID NO: 750564 - RNA, 65 nt, Homo Sapiens; identical to SEQ ID NO: 489713

SEQ ID NO: 750565 - RNA, 65 nt, Homo Sapiens; identical to SEQ ID NO: 489714

SEQ ID NO: 750566 - RNA, 65 nt, Homo Sapiens; identical to SEQ ID NO: 489715

SEQ ID NO: 750567 - RNA, 65 nt, Homo Sapiens; identical to SEQ ID NO: 489731

SEQ ID NO: 750568 - RNA, 65 nt, Homo Sapiens; identical to SEQ ID NO: 489732

SEQ ID NO: 750569 - RNA, 65 nt, Homo Sapiens; identical to SEQ ID NO: 489745

SEQ ID NO: 750570 - RNA, 65 nt, Homo Sapiens; identical to SEQ ID NO: 489746

SEQ ID NO: 750571 - RNA, 65 nt, Homo Sapiens; identical to SEQ ID NO: 489754

SEQ ID NO: 750572 - RNA, 65 nt, Homo Sapiens; identical to SEQ ID NO: 489755

SEQ ID NO: 750573 - RNA, 65 nt, Homo Sapiens; identical to SEQ ID NO: 489756

SEQ ID NO: 750574 - RNA, 65 nt, Homo Sapiens; identical to SEQ ID NO: 489760

SEQ ID NO: 750575 - RNA, 65 nt, Homo Sapiens; identical to SEQ ID NO: 489761

SEQ ID NO: 750576 - RNA, 65 nt, Homo Sapiens; identical to SEQ ID NO: 489762

SEQ ID NO: 750577 - RNA, 65 nt, Homo Sapiens; identical to SEQ ID NO: 489777

SEQ ID NO: 750578 - RNA, 65 nt, Homo Sapiens; identical to SEQ ID NO: 489778

SEQ ID NO: 750579 - RNA, 65 nt, Homo Sapiens; identical to SEQ ID NO: 489781

SEQ ID NO: 750580 - RNA, 65 nt, Homo Sapiens; identical to SEQ ID NO: 489782

SEQ ID NO: 750581 - RNA, 65 nt, Homo Sapiens; identical to SEQ ID NO: 489849

SEQ ID NO: 750582 - RNA, 65 nt, Homo Sapiens; identical to SEQ ID NO: 489850

SEQ ID NO: 750583 - RNA, 65 nt, Homo Sapiens; identical to SEQ ID NO: 489855

SEQ ID NO: 750584 - RNA, 65 nt, Homo Sapiens; identical to SEQ ID NO: 489856

SEQ ID NO: 750585 - RNA, 65 nt, Homo Sapiens; identical to SEQ ID NO: 489893

SEQ ID NO: 750586 - RNA, 65 nt, Homo Sapiens; identical to SEQ ID NO: 489894

SEQ ID NO: 750587 - RNA, 65 nt, Homo Sapiens; identical to SEQ ID NO: 489898

SEQ ID NO: 750588 - RNA, 65 nt, Homo Sapiens; identical to SEQ ID NO: 489899

SEQ ID NO: 750589 - RNA, 65 nt, Homo Sapiens; identical to SEQ ID NO: 489914

SEQ ID NO: 750590 - RNA, 65 nt, Homo Sapiens; identical to SEQ ID NO: 489915

SEQ ID NO: 750591 - RNA, 65 nt, Homo Sapiens; identical to SEQ ID NO: 489918

SEQ ID NO: 750592 - RNA, 65 nt, Homo Sapiens; identical to SEQ ID NO: 489919

SEQ ID NO: 750593 - RNA, 65 nt, Homo Sapiens; identical to SEQ ID NO: 489925

SEQ ID NO: 750594 - RNA, 65 nt, Homo Sapiens; identical to SEQ ID NO: 489926

SEQ ID NO: 750595 - RNA, 65 nt, Homo Sapiens; identical to SEQ ID NO: 489956

SEQ ID NO: 750596 - RNA, 65 nt, Homo Sapiens; identical to SEQ ID NO: 489957

SEQ ID NO: 750597 - RNA, 65 nt, Homo Sapiens; identical to SEQ ID NO: 490016

SEQ ID NO: 750598 - RNA, 65 nt, Homo Sapiens; identical to SEQ ID NO: 490017

SEQ ID NO: 750599 - RNA, 65 nt, Homo Sapiens; identical to SEQ ID NO: 490087

SEQ ID NO: 750600 - RNA, 65 nt, Homo Sapiens; identical to SEQ ID NO: 490088

SEQ ID NO: 750601 - RNA, 65 nt, Homo Sapiens; identical to SEQ ID NO: 490090

SEQ ID NO: 750602 - RNA, 65 nt, Homo Sapiens; identical to SEQ ID NO: 490091

SEQ ID NO: 750603 - RNA, 65 nt, Homo Sapiens; identical to SEQ ID NO: 490105

SEQ ID NO: 750604 - RNA, 65 nt, Homo Sapiens; identical to SEQ ID NO: 490106

SEQ ID NO: 750605 - RNA, 62 nt, Homo Sapiens
uauucuuaaucauuaauaaaccaugaaaacgcuuagugaauauaggaacaagacucccaaau

SEQ ID NO: 750606 - RNA, 62 nt, Homo Sapiens
acuuuugaaaagugcccuuuuuuuauuauuuuuuagugaaagagaauuuguuuaacugguac

SEQ ID NO: 750607 - RNA, 62 nt, Homo Sapiens
gaguauaagaaugcuuugaacaauuuguagacuuagugaaauaaaauaagaggaaagccaaa

SEQ ID NO: 750608 - RNA, 62 nt, Homo Sapiens
aauacauaauuucucauguauucguguauccauuagugaauaguucaagucuguuuaagagu

SEQ ID NO: 750609 - RNA, 62 nt, Homo Sapiens
uaggacucuagacaaaaccuucuauuuuagcuuuagugaauuucaaaaguaaugggucuugg

SEQ ID NO: 750610 - RNA, 62 nt, Homo Sapiens
cuaaaauuuguaauuugcuaacuugauuugaguuagugaaaacugguacaguguucugcuug

SEQ ID NO: 750611 - RNA, 62 nt, Homo Sapiens
cuaaggaacucagggggcacaaugauauggacuuagugaauucugggguuuuguaaccucug

SEQ ID NO: 750612 - RNA, 62 nt, Homo Sapiens
uauugaaaauacuaaauuauuuaugaugucaauuagugaaagcaaagaaaaaucuugaacau

SEQ ID NO: 750613 - RNA, 62 nt, Homo Sapiens
gcuuugcuuuaucaguucauuccagcucccuguuagugaaggacacugcuguuagugaagga

SEQ ID NO: 750614 - RNA, 62 nt, Homo Sapiens
uuccagcucccuguuagugaaggacacugcuguuagugaaggaacaaagucuaugaguccua

SEQ ID NO: 750615 - RNA, 62 nt, Homo Sapiens
cugaauccaaguuucauguauuucuaaaagcuuuagugaaggauacucacuuuauauguaug

SEQ ID NO: 750616 - RNA, 62 nt, Homo Sapiens
uuuuuuaaacuuacagcaugucaacuaauuuuuuagugaauuuaguguuaaguguauuuuuu

SEQ ID NO: 750617 - RNA, 62 nt, Homo Sapiens
uuguucacucuuccgugucugcuguauuuuacuuagugaauaaugugagagacaucucaucu

SEQ ID NO: 750618 - RNA, 62 nt, Homo Sapiens
gaaaauugcuuuggaagagaagugccuguagauuagugaacaguuuuaauuacaguuccauu

SEQ ID NO: 750619 - RNA, 62 nt, Homo Sapiens
cugaaugauuguugcuaggggugcacacugaauuagugaauguuagguucugugaauuuucu

SEQ ID NO: 750620 - RNA, 62 nt, Homo Sapiens
cauaguggugacauaccuuuguguguuugucuuuagugaacuuacaggaaggccuauuacaa

SEQ ID NO: 750621 - RNA, 62 nt, Homo Sapiens
auaauccucaguuuuugugaaaagcuccauuuuuagugaaauauuauuuuauagcuacuaau

SEQ ID NO: 750622 - RNA, 62 nt, Homo Sapiens
uuguguauggguguuggugaacuugguuuuaauuagugaacugcugagagacagagcuauuc

SEQ ID NO: 750623 - RNA, 64 nt, Homo Sapiens; identical to SEQ ID NO: 417300

SEQ ID NO: 750624 - RNA, 64 nt, Homo Sapiens; identical to SEQ ID NO: 417301

SEQ ID NO: 750625 - RNA, 64 nt, Homo Sapiens; identical to SEQ ID NO: 417302

SEQ ID NO: 750626 - RNA, 64 nt, Homo Sapiens; identical to SEQ ID NO: 417303

SEQ ID NO: 750627 - RNA, 64 nt, Homo Sapiens; identical to SEQ ID NO: 417304

SEQ ID NO: 750628 - RNA, 64 nt, Homo Sapiens; identical to SEQ ID NO: 417305

SEQ ID NO: 750629 - RNA, 64 nt, Homo Sapiens; identical to SEQ ID NO: 417306

SEQ ID NO: 750630 - RNA, 64 nt, Homo Sapiens; identical to SEQ ID NO: 417307

SEQ ID NO: 750631 - RNA, 62 nt, Homo Sapiens
aaaaaagaaccauuucugaacuggacagacaugcucgucaugcaaacaaacaugauugauag

SEQ ID NO: 750632 - RNA, 62 nt, Homo Sapiens
uccucuuaaaaaggaggagccagaaggcuuuggcucgucauugcuaggaucucuaacaaacg

SEQ ID NO: 750633 - RNA, 62 nt, Homo Sapiens
uccggacucucugcugcggacuuuuccagcgcgcucgucauuuuccucuucggcaagaggag

SEQ ID NO: 750634 - RNA, 62 nt, Homo Sapiens
aaugagcucaccauggaugaugauaccgccgugcucgucauugacaacggcucuggcaugug

SEQ ID NO: 750635 - RNA, 62 nt, Homo Sapiens
gcuguagaugcugggcccagggcccuagguuugcucgucacaguguggggaagcccauuccu

SEQ ID NO: 750636 - RNA, 62 nt, Homo Sapiens
ugacaccaaaaugaaccuugcuaucaagaaaugcucgucauacaguaaacucuggaugauuc

SEQ ID NO: 750637 - RNA, 62 nt, Homo Sapiens
auggaugucgagggugguuuguguggagcugugcucgucagcugggucugcccucuuccccc

SEQ ID NO: 750638 - RNA, 62 nt, Homo Sapiens
ccacguuuuugacaagccagcauauugccaaugcucgucaaagacauuuauguuucuuuuac

SEQ ID NO: 750639 - RNA, 62 nt, Homo Sapiens
auggucacauuggcgccuagaacaguuaggucgcucgucacauaggcaguuaaguggagaac

SEQ ID NO: 750640 - RNA, 62 nt, Homo Sapiens
ggaggugaacaagcaaaccccagucuguccaggcucgucauuauggggugccaguuugaaug

SEQ ID NO: 750641 - RNA, 62 nt, Homo Sapiens
uuucugguuuuucucugcucgguaagagcagugcucgucaagaacgccuacauuuaauuccu

SEQ ID NO: 750642 - RNA, 62 nt, Homo Sapiens
aagcacuguucuggaaccuuuuguagggagaggcucgucaacggagcugcugcugaagggac

SEQ ID NO: 750643 - RNA, 62 nt, Homo Sapiens
aaugagcucaccauggaugaugauacugccgugcucgucauugacaacggcucuggcaugug

SEQ ID NO: 750644 - RNA, 62 nt, Homo Sapiens
gacaacggcucuggcaugugugauacugccgugcucgucauuaaugagcucaccauggauga

SEQ ID NO: 750645 - RNA, 62 nt, Homo Sapiens
caccugggaacacaguucugggcacgugacaggcucgucagcagcgcaggcagcgcagggcu

SEQ ID NO: 750646 - RNA, 62 nt, Homo Sapiens
ggggaccucucugagcaggcucucgugaaucagcucgucaucagauggcuuuggugcauggc

SEQ ID NO: 750647 - RNA, 62 nt, Homo Sapiens
gggcuuccuguguguagcccuggcauagacuugcucgucaggguguucgacucugggaugcu

SEQ ID NO: 750648 - RNA, 62 nt, Homo Sapiens
cuuggggcgugguuccuguggaccccagcucagcucgucaagcugcaggggcggggcuccug

SEQ ID NO: 750649 - RNA, 62 nt, Homo Sapiens
ggguucaucagagcagugugaacaaagugagugcucgucacuuuaaagauaauuaaaaauga

SEQ ID NO: 750650 - RNA, 62 nt, Homo Sapiens
acccccagcugcuugugucccuccugggaucugcucgucaucauuuuuccuucccuucucca

SEQ ID NO: 750651 - RNA, 62 nt, Homo Sapiens
cacuuuuuuuuuuuuuuuugagauggaauuuugcucgucacccaggcuggagugcaauugug

SEQ ID NO: 750652 - RNA, 53 nt, Homo Sapiens
ucuuagaucuugggggccuagacgcucgucaguagaggcaaguguuggccuga

SEQ ID NO: 750653 - RNA, 62 nt, Homo Sapiens
guggcuguugauuaauuugacugcuucucguugcucgucaccuccaugccaggcacugugcu

SEQ ID NO: 750654 - RNA, 62 nt, Homo Sapiens
ggcacaaacuuccugagccucugaaaugggaggcucgucaauuucagaccaaccucuuuuca

SEQ ID NO: 750655 - RNA, 62 nt, Homo Sapiens
ggccuagugaaggguuugugugcccagugucugcucgucaucuguggcugcaggggucagac

SEQ ID NO: 750656 - RNA, 62 nt, Homo Sapiens
ucggcccuuguccacacucuccacagcucauagcucgucaucucugcuucccccauucccuu

SEQ ID NO: 750657 - RNA, 64 nt, Homo Sapiens; identical to SEQ ID NO: 173300

SEQ ID NO: 750658 - RNA, 64 nt, Homo Sapiens; identical to SEQ ID NO: 173301

SEQ ID NO: 750659 - RNA, 64 nt, Homo Sapiens; identical to SEQ ID NO: 173302

SEQ ID NO: 750660 - RNA, 64 nt, Homo Sapiens; identical to SEQ ID NO: 173303

SEQ ID NO: 750661 - RNA, 64 nt, Homo Sapiens; identical to SEQ ID NO: 173304

SEQ ID NO: 750662 - RNA, 64 nt, Homo Sapiens; identical to SEQ ID NO: 173305

SEQ ID NO: 750663 - RNA, 64 nt, Homo Sapiens; identical to SEQ ID NO: 173306

SEQ ID NO: 750664 - RNA, 64 nt, Homo Sapiens; identical to SEQ ID NO: 173307

SEQ ID NO: 750665 - RNA, 62 nt, Homo Sapiens
aggcuaaacuguugaugaaugucaaauaaucaacacuaaaggcucuuccauuuugcagauaa

SEQ ID NO: 750666 - RNA, 62 nt, Homo Sapiens
cugcucuagauaaacugcucguacacaucacuacacuaaacaagauuaauauggccaacccu

SEQ ID NO: 750667 - RNA, 62 nt, Homo Sapiens
gguuucaccugaucauauaguugcaagauuuaacacuaaaaaauuuaauggccaaaugguuu

SEQ ID NO: 750668 - RNA, 62 nt, Homo Sapiens
gcaggugguucuaauauuuuguuuauuuuguuacacuaaagguaaguaaaccaaaaaggcua

SEQ ID NO: 750669 - RNA, 62 nt, Homo Sapiens
gaacaaauuuucgguuacagaucagcucucaaacacuaaaguccuuaauggcaaggucuuuu

SEQ ID NO: 750670 - RNA, 62 nt, Homo Sapiens
aaccagaggacauacuagucacauguuauuauacacuaaaaaauaggaagucaucuugaaag

SEQ ID NO: 750671 - RNA, 62 nt, Homo Sapiens
gucucauuuugcaguaacuccuacaguguguaacacuaaaaauaagaacuaaugauggcuaa

SEQ ID NO: 750672 - RNA, 62 nt, Homo Sapiens
uaacacuaaaaauaagaacuaaugauggcuaaacacuaaaguagccauucauacuuaugcau

SEQ ID NO: 750673 - RNA, 62 nt, Homo Sapiens
guacuaauuguacaaaggucguacucuaaaagacacuaaauucuuuuaaaagacacuaaauu

SEQ ID NO: 750674 - RNA, 62 nt, Homo Sapiens
guacucuaaaagacacuaaaagcuuuuaaaagacacuaaauuaauguuuuaaauauuuagga

SEQ ID NO: 750675 - RNA, 62 nt, Homo Sapiens
auugaaacuucaucuagucucuuaauuuuuuaacacuaaauucaagucauuuguuuuaaguc

SEQ ID NO: 750676 - RNA, 62 nt, Homo Sapiens
uccauucauaugcauggggucugaucgcaaauacacuaaauguggaguguaggaaccaaaau

SEQ ID NO: 750677 - RNA, 62 nt, Homo Sapiens
cuucuugcuuuugcauuauauguacaguucguacacuaaacugauagagcuacaaacucagc

SEQ ID NO: 750678 - RNA, 62 nt, Homo Sapiens
cauguugaucuauaauuacaauaaaagaauagacacuaaaauugcguuccuaauuuaguaaa

SEQ ID NO: 750679 - RNA, 62 nt, Homo Sapiens
cuagaaaguacuuuggccuccaguuuuacgcaacacuaaauuagcuaaagaugagaggggcu

SEQ ID NO: 750680 - RNA, 62 nt, Homo Sapiens
cuggguuacauaugccuccagcucuauagcagacacuaaagagccauaugacaagccuuugu

SEQ ID NO: 750681 - RNA, 62 nt, Homo Sapiens
cuaagcacugucuuaagaggggcuaucuuggcacacuaaauguauacauacauacaaacaua

SEQ ID NO: 750682 - RNA, 62 nt, Homo Sapiens
uugcaagucaaguaaccaaagcaugaaacccaacacuaaauugauuugaaguuuggggcuau

SEQ ID NO: 750683 - RNA, 62 nt, Homo Sapiens
uuucuuccucuuuggacugacuucuuauaguaacacuaaaacuaacauuuucagagauacag

SEQ ID NO: 750684 - RNA, 62 nt, Homo Sapiens
uuccucagucugauuaauuuuaagccaguuuuacacuaaaugauucugcugacaaaaaauuu

SEQ ID NO: 750685 - RNA, 62 nt, Homo Sapiens
ggugacauggugacaucuaucccuuuauuuugacacuaaaacauggacacaacuagaaagag

SEQ ID NO: 750686 - RNA, 62 nt, Homo Sapiens
gaaaguauuuguuaauuaucugcuuaguauuaacacuaaauuuguagaaugacuuucagguu

SEQ ID NO: 750687 - RNA, 62 nt, Homo Sapiens
agcuaaaauggcuuaacaucaugcuacacuuuacacuaaaaaucuauuacugugaguggucu

SEQ ID NO: 750688 - RNA, 62 nt, Homo Sapiens
aucugagggaaaacauguucagggcuucuagaacacuaaaaaauuuggcuuaaaccaguguu

SEQ ID NO: 750689 - RNA, 64 nt, Homo Sapiens
uaugaacaaugggcacgggguuuucagccacaguucccucgaggccaguguucagcaggaucau

SEQ ID NO: 750690 - RNA, 64 nt, Homo Sapiens
ggucugugaggaccaauuuguggguaguucaucuucccucgauugguuaacuccuuaguuucag

SEQ ID NO: 750691 - RNA, 64 nt, Homo Sapiens
ggcaagcccugggaccaagagcucucccgccuucucccucgagcagcagcaaggacccugacgc

SEQ ID NO: 750692 - RNA, 64 nt, Homo Sapiens
ucguggcaucucacuucugacgccuccucccuggucccucgaaagggcuguggccccgcggcgc

SEQ ID NO: 750693 - RNA, 64 nt, Homo Sapiens
uugucuucccguuccuccccuggcccuguaacauucccucgaucgaggugcccgccaggaucug

SEQ ID NO: 750694 - RNA, 64 nt, Homo Sapiens
ugcuaucuccucugaaagcccucuucucguuggcucccucgaccaguccuucccugcuggcagu

SEQ ID NO: 750695 - RNA, 64 nt, Homo Sapiens
acagucagcuagacacacucgcugcuuuuacgugucccucgauacugcaguccaguuuugugau

SEQ ID NO: 750696 - RNA, 64 nt, Homo Sapiens
ucagcauucgguucuucuguuccugccucuccccucccucgaugcuaaucccucggcccaugcc

SEQ ID NO: 750697 - RNA, 64 nt, Homo Sapiens
cuuucaaagcuucacaucugugcccugucacaguucccucgacucaggagcuguccuugcugca

SEQ ID NO: 750698 - RNA, 64 nt, Homo Sapiens
aacagugccgccggugugauagaagagcauguccucccucgagacuguccucauuugcauucca

SEQ ID NO: 750699 - RNA, 64 nt, Homo Sapiens
caccacgcaugcucagugccuuuugguuucaccuucccucgacuugacccuuuccucccccagc

SEQ ID NO: 750700 - RNA, 53 nt, Homo Sapiens
cugcuguucucuugucuguccacucccucgaagaagaggagccgccccuguag

SEQ ID NO: 750701 - RNA, 64 nt, Homo Sapiens
acccaacgugaugcuaugcaugucugaccgacgaucccucgaccagaaucagauucaggagcuc

SEQ ID NO: 750702 - RNA, 64 nt, Homo Sapiens
uccagagaaaaaacugccuuucccuucaaagugcucccucgagguuccuuagugaguuuuguac

SEQ ID NO: 750703 - RNA, 64 nt, Homo Sapiens
uuccgaggucugcguuugcaucccugucguguucucccucgagggguccuuccccagccugugg

SEQ ID NO: 750704 - RNA, 64 nt, Homo Sapiens
ccagagauuuuugagggaugauuucuucccugcuucccucgaacccuagccccccuugccccuu

SEQ ID NO: 750705 - RNA, 64 nt, Homo Sapiens
gcccucugaaauacucucccuccucucagagcccucccucgagagccugagugcaccaugucuu

SEQ ID NO: 750706 - RNA, 64 nt, Homo Sapiens
uuccugucauuaagcaucucagaggaagcagcccucccucgauggccucuagcccagagaagcc

SEQ ID NO: 750707 - RNA, 64 nt, Homo Sapiens
augggcagaccccucccuuccugggcugaccugcucccucgaggccagccugcucccuggcuga

SEQ ID NO: 750708 - RNA, 64 nt, Homo Sapiens
gcugucuucucuuucuccaaucaagaaauaauaaucccucgaguuuacaaaacacuuccaaguc

SEQ ID NO: 750709 - RNA, 64 nt, Homo Sapiens
ccccagcgagaaagaaagcaugacagccagaucaucccucgaguggcuccaaggugacuucugg

SEQ ID NO: 750710 - RNA, 64 nt, Homo Sapiens
guccauuaagcauggaauuuauaaggugcuuuauucccucgaauagccccgaauuugauagugu

SEQ ID NO: 750711 - RNA, 64 nt, Homo Sapiens
uuauguugcagacuauucagacuaugaagacaguucccucgaauuuuuggaaaggugcucuucu

SEQ ID NO: 750712 - RNA, 64 nt, Homo Sapiens
aauagacaguaccuuuccccuaucucugguugaaucccucgaacacaugcuuguauauagguuu

SEQ ID NO: 750713 - RNA, 57 nt, Homo Sapiens
uggcucccagggcacccccgcugcaccucccucgagcuccuagcuggaaugaucuga

SEQ ID NO: 750714 - RNA, 64 nt, Homo Sapiens
cuggccagcccaccucuccccucacagcugccccucccucgagacccacagccuggcgccaggg

SEQ ID NO: 750715 - RNA, 64 nt, Homo Sapiens
cucugucguccugggauggcggcuuccgagggucucccucgacccuuugucuggagucacuggg

SEQ ID NO: 750716 - RNA, 64 nt, Homo Sapiens
ccagccauucaucgacaguccacaccagagcucuucccucgauggcucggcaaggcaagcaaga

SEQ ID NO: 750717 - RNA, 64 nt, Homo Sapiens
cuuccuacguaaacucccacagaaccucuuuuucucccucgacuauacacagauuucaccuggg

SEQ ID NO: 750718 - RNA, 64 nt, Homo Sapiens
cugggccucugccccucccaacccagcccucgucucccucgacagcgccccugcugucuucccc

SEQ ID NO: 750719 - RNA, 64 nt, Homo Sapiens
cuauuagucaguucuuuuauaugcugauaaaugaucccucgaguucaguuaguauucuguccag

SEQ ID NO: 750720 - RNA, 64 nt, Homo Sapiens
caagugcuacauccaauaaugcuccucaucugccucccucgaaucccaggcugccugcuacgaa

SEQ ID NO: 750721 - RNA, 64 nt, Homo Sapiens
uugcuggacaagcugcugcaggcccccauucugcucccucgagggcuugcccagcugcugccug

SEQ ID NO: 750722 - RNA, 64 nt, Homo Sapiens
cagucuaccccucuccuuucacuccuuuccucccucccucgauccccccauuuucucuauucuu

SEQ ID NO: 750723 - RNA, 64 nt, Homo Sapiens
cgggcuguguaaacacagucaaaauaauucuaaaucccucgauauuuuuaaagaucuguaagua

SEQ ID NO: 750724 - RNA, 64 nt, Homo Sapiens
uucacuuuguggguaaaucauggaaacugaauuuucccucgacuaucgcauagaguucagagac

SEQ ID NO: 750725 - RNA, 64 nt, Homo Sapiens
gaaugugcuagagacagcccaaggggccccggacucccucgagacuuuugcaguugcgucuggg

SEQ ID NO: 750726 - RNA, 64 nt, Homo Sapiens
cagagaaacggaacccacaccggccaccccgcacucccucgagaccuuagcuuugccaaagcaa

SEQ ID NO: 750727 - RNA, 64 nt, Homo Sapiens
cuugauuggagggcugucgacugccguuuucugcucccucgacaaacuugaccggcagaauguu

SEQ ID NO: 750728 - RNA, 64 nt, Homo Sapiens
auauuuccccuuggacacuuccuccucucaccucucccucgaucuccugucugcccucuggguc

SEQ ID NO: 750729 - RNA, 64 nt, Homo Sapiens
ccaagaguucaugaccagcccaaagguggaaguaucccucgaggaaucucagcauuuggggagg

SEQ ID NO: 750730 - RNA, 64 nt, Homo Sapiens
uuuucucccucuuucuucccuccccuuauccuucucccucgacaucuaagggguacuccucuca

SEQ ID NO: 750731 - RNA, 64 nt, Homo Sapiens
uuggcgccgagagccccugcacucaaggccacauucccucgacaacggcugcacgggcuguccg

SEQ ID NO: 750732 - RNA, 64 nt, Homo Sapiens
gucaggaggcaggguuuuaucucugucuaccaucucccucgaacccacacugcaacaggaacug

SEQ ID NO: 750733 - RNA, 64 nt, Homo Sapiens
ccacucaccaccauuccuuggccagccuuuugccucccucgauacucaacaaagagaagcaaag

SEQ ID NO: 750734 - RNA, 64 nt, Homo Sapiens
gugcuuuggccuuugcgcugucccggggccagcuucccucgaccuggggaggccguggccugug

SEQ ID NO: 750735 - RNA, 64 nt, Homo Sapiens
ggaacccccuccuccucccuggagucugccugagucccucgagccgcgagccuucgcugaagug

SEQ ID NO: 750736 - RNA, 64 nt, Homo Sapiens
ccgcccccguuagcgucauaaaguccagcuugucucccucgauccaaaggccguuuucucgagg

SEQ ID NO: 750737 - RNA, 64 nt, Homo Sapiens
cagaaggggcucccuguccggcccacgugcccuuucccucgacgacagucgagggcucgggcuc

SEQ ID NO: 750738 - RNA, 64 nt, Homo Sapiens
aaccgggccgggcacagcguggcuacagagggucucccucgaugacgacgacgacgacgccacc

SEQ ID NO: 750739 - RNA, 64 nt, Homo Sapiens
ggaaugaggccugcuccucuuguaaauacccccuucccucgaagcucccucccggugcuggggg

SEQ ID NO: 750740 - RNA, 64 nt, Homo Sapiens
uugggggaucuuuuuaaaagcugguagccaggguucccucgaacgggcagacgcacuguugaau

SEQ ID NO: 750741 - RNA, 64 nt, Homo Sapiens
gugcuuuaggcccaggcgggggucguggccucguucccucgacaccuccguccugcucucgccu

SEQ ID NO: 750742 - RNA, 64 nt, Homo Sapiens
ucucucuccccguaagugaucccuuuccugucccucccucgaauaguccuuuccucucugccug

SEQ ID NO: 750743 - RNA, 64 nt, Homo Sapiens
ucuguagccuggucugugcaggccccuucccacgucccucgagcccagugcaguagugccaaaa

SEQ ID NO: 750744 - RNA, 64 nt, Homo Sapiens
gcuuccaaugucagccugcuuggguuuuugugcaucccucgacaccuccacaccuggcccaugc

SEQ ID NO: 750745 - RNA, 64 nt, Homo Sapiens
ccaagucaggaauaccguggcccuccguucugucucccucgacuacucugucuucagcucgggc

SEQ ID NO: 750746 - RNA, 64 nt, Homo Sapiens
cuggggcacggaaccccgcccccaagcccacggcucccucgacucccgcggccgcgauccggac

SEQ ID NO: 750747 - RNA, 64 nt, Homo Sapiens
ggccacuauggcugcugugguuugaauauuuuuuucccucgaaaacucauguugaaacuuaacu

SEQ ID NO: 750748 - RNA, 63 nt, Homo Sapiens
gggacuccucccuggggguggggcuccuaccugggggcagaacuccuaccugaaggcagggcu

SEQ ID NO: 750749 - RNA, 63 nt, Homo Sapiens
ggguuuuaugguggaugaggcuucuuccuggauggggcagagcuucuccugaccagggcaagg

SEQ ID NO: 750750 - RNA, 63 nt, Homo Sapiens
auaauaaauauucugagugaugcaaggccccauggggcagaauauagcuugggucccuuuucc

SEQ ID NO: 750751 - RNA, 63 nt, Homo Sapiens
ccugggacucuguauuucuagaucuggggaggaggggcagagaugucucuacucccucucuug

SEQ ID NO: 750752 - RNA, 63 nt, Homo Sapiens
uaaacauuagccacaauggcccuugcugaaggaggggcagagugggcugcuggggcuaaagug

SEQ ID NO: 750753 - RNA, 63 nt, Homo Sapiens
agccaaccagaggguuccuguggcccucuaggaggggcagaagacucaacacaccuaagccag

SEQ ID NO: 750754 - RNA, 63 nt, Homo Sapiens
ucaaaucagcccaaggauauagucugucgggugggggcagaaaggggaagggggacaaggguc

SEQ ID NO: 750755 - RNA, 63 nt, Homo Sapiens
cauacguguggccaggaagugagcagaaaguaaggggcagaguuccuguauucaggcagcuca

SEQ ID NO: 750756 - RNA, 63 nt, Homo Sapiens
uguguugaguauuuguguggauacaagggaguaggggcagaccaaauaaacacauuucuaaca

SEQ ID NO: 750757 - RNA, 63 nt, Homo Sapiens
gagaauguuuuacacaugcuuaauccauucagaggggcagauugaguacauacugaucuuuca

SEQ ID NO: 750758 - RNA, 63 nt, Homo Sapiens
ggucauacugccaaucuuuagacaaauggccauggggcagaggacaggggagcugagguuggu

SEQ ID NO: 750759 - RNA, 63 nt, Homo Sapiens
acuuuugcacuucuccaagugcaggucacaccaggggcagacccugucgcugcguuucugaac

SEQ ID NO: 750760 - RNA, 63 nt, Homo Sapiens
uuuuagguguaaaagauggagucccacggaggaggggcagagccaggaggcaguggggcugug

SEQ ID NO: 750761 - RNA, 63 nt, Homo Sapiens
ccuggguacccugguggggaugcagggaaggccggggcagagaaagugaaggucgacccaggg

SEQ ID NO: 750762 - RNA, 63 nt, Homo Sapiens
gaggaagguccaugaugcucgugggagcucaacggggcagagggcuucucaguuuugcuaaca

SEQ ID NO: 750763 - RNA, 63 nt, Homo Sapiens
caggguccaccaacuccccaacacuccuuguaaggggcagagagugcucugguuuccucagca

SEQ ID NO: 750764 - RNA, 63 nt, Homo Sapiens
ccuaauuucgcacaaugcauaggugcuggggcuggggcagauguagcaggcagcugggcaugg

SEQ ID NO: 750765 - RNA, 63 nt, Homo Sapiens
cuccccguccucguggagcuugagcauccucucggggcagacccagccuacagccagaacuuc

SEQ ID NO: 750766 - RNA, 63 nt, Homo Sapiens
gcgauguggaccacgggauuucauggccuccugggggcagaaggcagcagccuggcugccuug

SEQ ID NO: 750767 - RNA, 63 nt, Homo Sapiens
ccacaggccuggaacccugggcccacccagcaaggggcagaggccuuaggccacccuccucau

SEQ ID NO: 750768 - RNA, 63 nt, Homo Sapiens
auagggaaucucuuauuaaaguuagguuuuacuggggcagagguaaccugucaggcuggcuug

SEQ ID NO: 750769 - RNA, 63 nt, Homo Sapiens
cuuccagucacugagucuccucaccaagagugaggggcagagacagcugcugaaauuagcuac

SEQ ID NO: 750770 - RNA, 63 nt, Homo Sapiens
uugcagugagccgagauugcugcuugaacccagggggcagaggucaggagguuggggcagaau

SEQ ID NO: 750771 - RNA, 63 nt, Homo Sapiens
ugcuugaacccagggggcaguacucaggagguuggggcagaauccugugccuguaaacccagc

SEQ ID NO: 750772 - RNA, 63 nt, Homo Sapiens
gcauugcucuaccucucccugacauuuugcuccggggcagauccaaccuuaccuggggcagca

SEQ ID NO: 750773 - RNA, 63 nt, Homo Sapiens
ucuggaccaguagcccaucccgcaguuuucuugggggcagaggaaaacgcuucuuucuccucc

SEQ ID NO: 750774 - RNA, 63 nt, Homo Sapiens
uagccgugcaugcacuuuguggccccuuugcaaggggcagaggguacuggaagugggaggagg

SEQ ID NO: 750775 - RNA, 63 nt, Homo Sapiens
aaauauucuucugggcucaaaagcuagcuugagggggcagaugccccaggugucccagcucca

SEQ ID NO: 750776 - RNA, 63 nt, Homo Sapiens
uuuuccucuuuugugagaagaugggggcuggagggggcagaguggccugugagcaagagccag

SEQ ID NO: 750777 - RNA, 63 nt, Homo Sapiens
gcaagagccaggggugucccagucccagccucuggggcagagcuuguagcccuggauggccuc

SEQ ID NO: 750778 - RNA, 57 nt, Homo Sapiens; identical to SEQ ID NO: 111335

SEQ ID NO: 750779 - RNA, 63 nt, Homo Sapiens
auaagagauauggagaugggagggggaggacaaggggcagagaguagggucuagcuggcuauc

SEQ ID NO: 750780 - RNA, 63 nt, Homo Sapiens
agaggcagguccuaaaggagggggggucuccugggggcagaccgagggucucggaggauagaa

SEQ ID NO: 750781 - RNA, 63 nt, Homo Sapiens
acuuggcaagcggcugggccugacggaggccgaggggcagaccggggcuccagccagaccccu

SEQ ID NO: 750782 - RNA, 63 nt, Homo Sapiens
ccuccaaucccaccggacccaggcccugggcuaggggcagagcaggccccgccccagggcaau

SEQ ID NO: 750783 - RNA, 63 nt, Homo Sapiens
uauuuauuccccuuuagguuugcagaggggguaggggcagagucaggggcuggccagaggguc

SEQ ID NO: 750784 - RNA, 63 nt, Homo Sapiens
cccaagauuccgagagcccugcgcucuagggcaggggcagaguuuuggaaacagugcaggcuc

SEQ ID NO: 750785 - RNA, 63 nt, Homo Sapiens
aagucacuugcucaaggucaggcagcuuaggaaggggcagaucgggggcuugaacccaggugg

SEQ ID NO: 750786 - RNA, 63 nt, Homo Sapiens
ccauuucuguccuuggccuugggaguagcugagggggcagacuagggaguagggcuggcaggg

SEQ ID NO: 750787 - RNA, 63 nt, Homo Sapiens
ggggcagacuagggaguagggcuggcaggggagggggcagacagccucgccucgcacccuuca

SEQ ID NO: 750788 - RNA, 63 nt, Homo Sapiens
agaggcggauacagaaacuuuggggguggggugggggcagagguaguuuuuagcccuuuuugu

SEQ ID NO: 750789 - RNA, 63 nt, Homo Sapiens
caugcuccuggcaucgaguggacauuuuugguuggggcagagggacaucaggcaaggucugga

SEQ ID NO: 750790 - RNA, 57 nt, Homo Sapiens; identical to SEQ ID NO: 111347

SEQ ID NO: 750791 - RNA, 63 nt, Homo Sapiens
cagcaggugccagggcuggugaggaagagcuggggggcagagguaaagcccugcaggggaggc

SEQ ID NO: 750792 - RNA, 63 nt, Homo Sapiens
ugguggggucuccucaggacugcucccugacugggggcagacacuccgaaaugcugucuuucu

SEQ ID NO: 750793 - RNA, 63 nt, Homo Sapiens
agaacuugcugccucggaucggaggcuggaguuggggcagaggcccucuccagcaggcccaug

SEQ ID NO: 750794 - RNA, 64 nt, Homo Sapiens; identical to SEQ ID NO: 368571

SEQ ID NO: 750795 - RNA, 64 nt, Homo Sapiens; identical to SEQ ID NO: 368572

SEQ ID NO: 750796 - RNA, 64 nt, Homo Sapiens; identical to SEQ ID NO: 368573

SEQ ID NO: 750797 - RNA, 64 nt, Homo Sapiens; identical to SEQ ID NO: 368574

SEQ ID NO: 750798 - RNA, 64 nt, Homo Sapiens; identical to SEQ ID NO: 368575

SEQ ID NO: 750799 - RNA, 64 nt, Homo Sapiens; identical to SEQ ID NO: 368576

SEQ ID NO: 750800 - RNA, 64 nt, Homo Sapiens; identical to SEQ ID NO: 368577

SEQ ID NO: 750801 - RNA, 64 nt, Homo Sapiens; identical to SEQ ID NO: 368578

SEQ ID NO: 750802 - RNA, 64 nt, Homo Sapiens; identical to SEQ ID NO: 368579

SEQ ID NO: 750803 - RNA, 64 nt, Homo Sapiens; identical to SEQ ID NO: 368580

SEQ ID NO: 750804 - RNA, 64 nt, Homo Sapiens; identical to SEQ ID NO: 368581

SEQ ID NO: 750805 - RNA, 64 nt, Homo Sapiens; identical to SEQ ID NO: 368582

SEQ ID NO: 750806 - RNA, 64 nt, Homo Sapiens; identical to SEQ ID NO: 368583

SEQ ID NO: 750807 - RNA, 64 nt, Homo Sapiens; identical to SEQ ID NO: 368584

SEQ ID NO: 750808 - RNA, 64 nt, Homo Sapiens; identical to SEQ ID NO: 368585

SEQ ID NO: 750809 - RNA, 64 nt, Homo Sapiens; identical to SEQ ID NO: 368586

SEQ ID NO: 750810 - RNA, 64 nt, Homo Sapiens; identical to SEQ ID NO: 368587

SEQ ID NO: 750811 - RNA, 64 nt, Homo Sapiens; identical to SEQ ID NO: 368588

SEQ ID NO: 750812 - RNA, 64 nt, Homo Sapiens; identical to SEQ ID NO: 368589

SEQ ID NO: 750813 - RNA, 64 nt, Homo Sapiens; identical to SEQ ID NO: 368590

SEQ ID NO: 750814 - RNA, 64 nt, Homo Sapiens; identical to SEQ ID NO: 368591

SEQ ID NO: 750815 - RNA, 64 nt, Homo Sapiens; identical to SEQ ID NO: 368592

SEQ ID NO: 750816 - RNA, 64 nt, Homo Sapiens; identical to SEQ ID NO: 368593

SEQ ID NO: 750817 - RNA, 64 nt, Homo Sapiens; identical to SEQ ID NO: 368594

SEQ ID NO: 750818 - RNA, 64 nt, Homo Sapiens; identical to SEQ ID NO: 368595

SEQ ID NO: 750819 - RNA, 64 nt, Homo Sapiens; identical to SEQ ID NO: 368596

SEQ ID NO: 750820 - RNA, 64 nt, Homo Sapiens; identical to SEQ ID NO: 368597

SEQ ID NO: 750821 - RNA, 64 nt, Homo Sapiens; identical to SEQ ID NO: 368598

SEQ ID NO: 750822 - RNA, 64 nt, Homo Sapiens; identical to SEQ ID NO: 368599

SEQ ID NO: 750823 - RNA, 64 nt, Homo Sapiens; identical to SEQ ID NO: 368600

SEQ ID NO: 750824 - RNA, 64 nt, Homo Sapiens; identical to SEQ ID NO: 368601

SEQ ID NO: 750825 - RNA, 64 nt, Homo Sapiens; identical to SEQ ID NO: 368602

SEQ ID NO: 750826 - RNA, 64 nt, Homo Sapiens; identical to SEQ ID NO: 368603

SEQ ID NO: 750827 - RNA, 64 nt, Homo Sapiens; identical to SEQ ID NO: 368604

SEQ ID NO: 750828 - RNA, 64 nt, Homo Sapiens; identical to SEQ ID NO: 368605

SEQ ID NO: 750829 - RNA, 64 nt, Homo Sapiens; identical to SEQ ID NO: 368606

SEQ ID NO: 750830 - RNA, 64 nt, Homo Sapiens; identical to SEQ ID NO: 368607

SEQ ID NO: 750831 - RNA, 64 nt, Homo Sapiens; identical to SEQ ID NO: 368608

SEQ ID NO: 750832 - RNA, 64 nt, Homo Sapiens; identical to SEQ ID NO: 368609

SEQ ID NO: 750833 - RNA, 64 nt, Homo Sapiens; identical to SEQ ID NO: 368610

SEQ ID NO: 750834 - RNA, 64 nt, Homo Sapiens; identical to SEQ ID NO: 368611

SEQ ID NO: 750835 - RNA, 64 nt, Homo Sapiens; identical to SEQ ID NO: 368612

SEQ ID NO: 750836 - RNA, 64 nt, Homo Sapiens; identical to SEQ ID NO: 368613

SEQ ID NO: 750837 - RNA, 64 nt, Homo Sapiens; identical to SEQ ID NO: 187011

SEQ ID NO: 750838 - RNA, 64 nt, Homo Sapiens; identical to SEQ ID NO: 187012

SEQ ID NO: 750839 - RNA, 64 nt, Homo Sapiens; identical to SEQ ID NO: 187013

SEQ ID NO: 750840 - RNA, 64 nt, Homo Sapiens; identical to SEQ ID NO: 187014

SEQ ID NO: 750841 - RNA, 64 nt, Homo Sapiens; identical to SEQ ID NO: 187015

SEQ ID NO: 750842 - RNA, 64 nt, Homo Sapiens; identical to SEQ ID NO: 187016

SEQ ID NO: 750843 - RNA, 56 nt, Homo Sapiens; identical to SEQ ID NO: 187017

SEQ ID NO: 750844 - RNA, 64 nt, Homo Sapiens; identical to SEQ ID NO: 187018

SEQ ID NO: 750845 - RNA, 64 nt, Homo Sapiens; identical to SEQ ID NO: 187019

SEQ ID NO: 750846 - RNA, 64 nt, Homo Sapiens; identical to SEQ ID NO: 187020

SEQ ID NO: 750847 - RNA, 64 nt, Homo Sapiens; identical to SEQ ID NO: 187021

SEQ ID NO: 750848 - RNA, 64 nt, Homo Sapiens; identical to SEQ ID NO: 187022

SEQ ID NO: 750849 - RNA, 64 nt, Homo Sapiens; identical to SEQ ID NO: 187023

SEQ ID NO: 750850 - RNA, 64 nt, Homo Sapiens; identical to SEQ ID NO: 187024

SEQ ID NO: 750851 - RNA, 64 nt, Homo Sapiens; identical to SEQ ID NO: 187025

SEQ ID NO: 750852 - RNA, 64 nt, Homo Sapiens; identical to SEQ ID NO: 187026

SEQ ID NO: 750853 - RNA, 64 nt, Homo Sapiens; identical to SEQ ID NO: 187027

SEQ ID NO: 750854 - RNA, 64 nt, Homo Sapiens; identical to SEQ ID NO: 187028

SEQ ID NO: 750855 - RNA, 64 nt, Homo Sapiens; identical to SEQ ID NO: 187029

SEQ ID NO: 750856 - RNA, 64 nt, Homo Sapiens; identical to SEQ ID NO: 187030

SEQ ID NO: 750857 - RNA, 64 nt, Homo Sapiens; identical to SEQ ID NO: 187031

SEQ ID NO: 750858 - RNA, 64 nt, Homo Sapiens; identical to SEQ ID NO: 187032

SEQ ID NO: 750859 - RNA, 64 nt, Homo Sapiens; identical to SEQ ID NO: 187033

SEQ ID NO: 750860 - RNA, 64 nt, Homo Sapiens; identical to SEQ ID NO: 187034

SEQ ID NO: 750861 - RNA, 64 nt, Homo Sapiens; identical to SEQ ID NO: 187035

SEQ ID NO: 750862 - RNA, 64 nt, Homo Sapiens; identical to SEQ ID NO: 187036

SEQ ID NO: 750863 - RNA, 64 nt, Homo Sapiens; identical to SEQ ID NO: 187037

SEQ ID NO: 750864 - RNA, 64 nt, Homo Sapiens; identical to SEQ ID NO: 187038

SEQ ID NO: 750865 - RNA, 64 nt, Homo Sapiens; identical to SEQ ID NO: 187039

SEQ ID NO: 750866 - RNA, 64 nt, Homo Sapiens; identical to SEQ ID NO: 187040

SEQ ID NO: 750867 - RNA, 64 nt, Homo Sapiens; identical to SEQ ID NO: 187041

SEQ ID NO: 750868 - RNA, 64 nt, Homo Sapiens; identical to SEQ ID NO: 187042

SEQ ID NO: 750869 - RNA, 64 nt, Homo Sapiens; identical to SEQ ID NO: 187043

SEQ ID NO: 750870 - RNA, 64 nt, Homo Sapiens; identical to SEQ ID NO: 187044

SEQ ID NO: 750871 - RNA, 64 nt, Homo Sapiens; identical to SEQ ID NO: 187045

SEQ ID NO: 750872 - RNA, 64 nt, Homo Sapiens; identical to SEQ ID NO: 187046

SEQ ID NO: 750873 - RNA, 64 nt, Homo Sapiens; identical to SEQ ID NO: 187047

SEQ ID NO: 750874 - RNA, 64 nt, Homo Sapiens; identical to SEQ ID NO: 187048

SEQ ID NO: 750875 - RNA, 64 nt, Homo Sapiens; identical to SEQ ID NO: 187049

SEQ ID NO: 750876 - RNA, 64 nt, Homo Sapiens; identical to SEQ ID NO: 187050

SEQ ID NO: 750877 - RNA, 64 nt, Homo Sapiens; identical to SEQ ID NO: 187051

SEQ ID NO: 750878 - RNA, 64 nt, Homo Sapiens; identical to SEQ ID NO: 187052

SEQ ID NO: 750879 - RNA, 64 nt, Homo Sapiens; identical to SEQ ID NO: 187053

SEQ ID NO: 750880 - RNA, 64 nt, Homo Sapiens; identical to SEQ ID NO: 187054

SEQ ID NO: 750881 - RNA, 64 nt, Homo Sapiens; identical to SEQ ID NO: 187055

SEQ ID NO: 750882 - RNA, 64 nt, Homo Sapiens; identical to SEQ ID NO: 187056

SEQ ID NO: 750883 - RNA, 64 nt, Homo Sapiens; identical to SEQ ID NO: 187057

SEQ ID NO: 750884 - RNA, 64 nt, Homo Sapiens; identical to SEQ ID NO: 187058

SEQ ID NO: 750885 - RNA, 64 nt, Homo Sapiens; identical to SEQ ID NO: 187059

SEQ ID NO: 750886 - RNA, 64 nt, Homo Sapiens; identical to SEQ ID NO: 187060

SEQ ID NO: 750887 - RNA, 64 nt, Homo Sapiens; identical to SEQ ID NO: 187061

SEQ ID NO: 750888 - RNA, 64 nt, Homo Sapiens; identical to SEQ ID NO: 187062

SEQ ID NO: 750889 - RNA, 64 nt, Homo Sapiens; identical to SEQ ID NO: 187063

SEQ ID NO: 750890 - RNA, 64 nt, Homo Sapiens; identical to SEQ ID NO: 187064

SEQ ID NO: 750891 - RNA, 64 nt, Homo Sapiens; identical to SEQ ID NO: 187065

SEQ ID NO: 750892 - RNA, 64 nt, Homo Sapiens; identical to SEQ ID NO: 187066

SEQ ID NO: 750893 - RNA, 64 nt, Homo Sapiens; identical to SEQ ID NO: 187067

SEQ ID NO: 750894 - RNA, 64 nt, Homo Sapiens; identical to SEQ ID NO: 187068

SEQ ID NO: 750895 - RNA, 64 nt, Homo Sapiens; identical to SEQ ID NO: 187069

SEQ ID NO: 750896 - RNA, 64 nt, Homo Sapiens; identical to SEQ ID NO: 187070

SEQ ID NO: 750897 - RNA, 64 nt, Homo Sapiens; identical to SEQ ID NO: 187071

SEQ ID NO: 750898 - RNA, 64 nt, Homo Sapiens; identical to SEQ ID NO: 187072

SEQ ID NO: 750899 - RNA, 64 nt, Homo Sapiens; identical to SEQ ID NO: 187073

SEQ ID NO: 750900 - RNA, 64 nt, Homo Sapiens; identical to SEQ ID NO: 187074

SEQ ID NO: 750901 - RNA, 64 nt, Homo Sapiens; identical to SEQ ID NO: 187075

SEQ ID NO: 750902 - RNA, 64 nt, Homo Sapiens; identical to SEQ ID NO: 187076

SEQ ID NO: 750903 - RNA, 64 nt, Homo Sapiens; identical to SEQ ID NO: 187077

SEQ ID NO: 750904 - RNA, 64 nt, Homo Sapiens; identical to SEQ ID NO: 187078

SEQ ID NO: 750905 - RNA, 64 nt, Homo Sapiens; identical to SEQ ID NO: 187079

SEQ ID NO: 750906 - RNA, 64 nt, Homo Sapiens; identical to SEQ ID NO: 187080

SEQ ID NO: 750907 - RNA, 64 nt, Homo Sapiens; identical to SEQ ID NO: 187081

SEQ ID NO: 750908 - RNA, 64 nt, Homo Sapiens; identical to SEQ ID NO: 187082

SEQ ID NO: 750909 - RNA, 64 nt, Homo Sapiens; identical to SEQ ID NO: 187083

SEQ ID NO: 750910 - RNA, 57 nt, Homo Sapiens; identical to SEQ ID NO: 187084

SEQ ID NO: 750911 - RNA, 64 nt, Homo Sapiens; identical to SEQ ID NO: 187085

SEQ ID NO: 750912 - RNA, 64 nt, Homo Sapiens; identical to SEQ ID NO: 187086

SEQ ID NO: 750913 - RNA, 64 nt, Homo Sapiens; identical to SEQ ID NO: 187087

SEQ ID NO: 750914 - RNA, 64 nt, Homo Sapiens; identical to SEQ ID NO: 187088

SEQ ID NO: 750915 - RNA, 64 nt, Homo Sapiens; identical to SEQ ID NO: 187089

SEQ ID NO: 750916 - RNA, 64 nt, Homo Sapiens; identical to SEQ ID NO: 187090

SEQ ID NO: 750917 - RNA, 64 nt, Homo Sapiens; identical to SEQ ID NO: 187091

SEQ ID NO: 750918 - RNA, 64 nt, Homo Sapiens; identical to SEQ ID NO: 187092

SEQ ID NO: 750919 - RNA, 64 nt, Homo Sapiens; identical to SEQ ID NO: 187093

SEQ ID NO: 750920 - RNA, 64 nt, Homo Sapiens; identical to SEQ ID NO: 187094

SEQ ID NO: 750921 - RNA, 64 nt, Homo Sapiens; identical to SEQ ID NO: 187095

SEQ ID NO: 750922 - RNA, 64 nt, Homo Sapiens; identical to SEQ ID NO: 187096

SEQ ID NO: 750923 - RNA, 64 nt, Homo Sapiens; identical to SEQ ID NO: 187097

SEQ ID NO: 750924 - RNA, 64 nt, Homo Sapiens; identical to SEQ ID NO: 187098

SEQ ID NO: 750925 - RNA, 64 nt, Homo Sapiens; identical to SEQ ID NO: 187099

SEQ ID NO: 750926 - RNA, 64 nt, Homo Sapiens; identical to SEQ ID NO: 187100

SEQ ID NO: 750927 - RNA, 64 nt, Homo Sapiens; identical to SEQ ID NO: 187101

SEQ ID NO: 750928 - RNA, 64 nt, Homo Sapiens; identical to SEQ ID NO: 187102

SEQ ID NO: 750929 - RNA, 64 nt, Homo Sapiens; identical to SEQ ID NO: 187103

SEQ ID NO: 750930 - RNA, 64 nt, Homo Sapiens; identical to SEQ ID NO: 187104

SEQ ID NO: 750931 - RNA, 64 nt, Homo Sapiens; identical to SEQ ID NO: 187105

SEQ ID NO: 750932 - RNA, 64 nt, Homo Sapiens; identical to SEQ ID NO: 187106

SEQ ID NO: 750933 - RNA, 64 nt, Homo Sapiens; identical to SEQ ID NO: 187107

SEQ ID NO: 750934 - RNA, 64 nt, Homo Sapiens; identical to SEQ ID NO: 187108

SEQ ID NO: 750935 - RNA, 64 nt, Homo Sapiens; identical to SEQ ID NO: 187109

SEQ ID NO: 750936 - RNA, 64 nt, Homo Sapiens; identical to SEQ ID NO: 187110

SEQ ID NO: 750937 - RNA, 64 nt, Homo Sapiens; identical to SEQ ID NO: 187111

SEQ ID NO: 750938 - RNA, 64 nt, Homo Sapiens; identical to SEQ ID NO: 187112

SEQ ID NO: 750939 - RNA, 64 nt, Homo Sapiens; identical to SEQ ID NO: 187113

SEQ ID NO: 750940 - RNA, 64 nt, Homo Sapiens; identical to SEQ ID NO: 187114

SEQ ID NO: 750941 - RNA, 64 nt, Homo Sapiens; identical to SEQ ID NO: 83612

SEQ ID NO: 750942 - RNA, 64 nt, Homo Sapiens; identical to SEQ ID NO: 83613

SEQ ID NO: 750943 - RNA, 64 nt, Homo Sapiens; identical to SEQ ID NO: 83614

SEQ ID NO: 750944 - RNA, 64 nt, Homo Sapiens; identical to SEQ ID NO: 83615

SEQ ID NO: 750945 - RNA, 64 nt, Homo Sapiens; identical to SEQ ID NO: 83616

SEQ ID NO: 750946 - RNA, 64 nt, Homo Sapiens; identical to SEQ ID NO: 83617

SEQ ID NO: 750947 - RNA, 64 nt, Homo Sapiens; identical to SEQ ID NO: 83618

SEQ ID NO: 750948 - RNA, 64 nt, Homo Sapiens; identical to SEQ ID NO: 83619

SEQ ID NO: 750949 - RNA, 64 nt, Homo Sapiens; identical to SEQ ID NO: 83620

SEQ ID NO: 750950 - RNA, 64 nt, Homo Sapiens; identical to SEQ ID NO: 83621

SEQ ID NO: 750951 - RNA, 64 nt, Homo Sapiens; identical to SEQ ID NO: 83622

SEQ ID NO: 750952 - RNA, 64 nt, Homo Sapiens; identical to SEQ ID NO: 83623

SEQ ID NO: 750953 - RNA, 64 nt, Homo Sapiens; identical to SEQ ID NO: 83624

SEQ ID NO: 750954 - RNA, 64 nt, Homo Sapiens; identical to SEQ ID NO: 83625

SEQ ID NO: 750955 - RNA, 64 nt, Homo Sapiens; identical to SEQ ID NO: 83626

SEQ ID NO: 750956 - RNA, 64 nt, Homo Sapiens; identical to SEQ ID NO: 83627

SEQ ID NO: 750957 - RNA, 64 nt, Homo Sapiens; identical to SEQ ID NO: 83628

SEQ ID NO: 750958 - RNA, 64 nt, Homo Sapiens; identical to SEQ ID NO: 83629

SEQ ID NO: 750959 - RNA, 64 nt, Homo Sapiens; identical to SEQ ID NO: 83630

SEQ ID NO: 750960 - RNA, 64 nt, Homo Sapiens; identical to SEQ ID NO: 83631

SEQ ID NO: 750961 - RNA, 64 nt, Homo Sapiens; identical to SEQ ID NO: 83632

SEQ ID NO: 750962 - RNA, 60 nt, Homo Sapiens; identical to SEQ ID NO: 83633

SEQ ID NO: 750963 - RNA, 64 nt, Homo Sapiens; identical to SEQ ID NO: 83634

SEQ ID NO: 750964 - RNA, 64 nt, Homo Sapiens; identical to SEQ ID NO: 83635

SEQ ID NO: 750965 - RNA, 64 nt, Homo Sapiens; identical to SEQ ID NO: 83636

SEQ ID NO: 750966 - RNA, 64 nt, Homo Sapiens; identical to SEQ ID NO: 83637

SEQ ID NO: 750967 - RNA, 64 nt, Homo Sapiens; identical to SEQ ID NO: 83638

SEQ ID NO: 750968 - RNA, 64 nt, Homo Sapiens; identical to SEQ ID NO: 83639

SEQ ID NO: 750969 - RNA, 64 nt, Homo Sapiens; identical to SEQ ID NO: 83640

SEQ ID NO: 750970 - RNA, 64 nt, Homo Sapiens; identical to SEQ ID NO: 83641

SEQ ID NO: 750971 - RNA, 64 nt, Homo Sapiens; identical to SEQ ID NO: 83642

SEQ ID NO: 750972 - RNA, 64 nt, Homo Sapiens; identical to SEQ ID NO: 83643

SEQ ID NO: 750973 - RNA, 64 nt, Homo Sapiens; identical to SEQ ID NO: 83644

SEQ ID NO: 750974 - RNA, 64 nt, Homo Sapiens; identical to SEQ ID NO: 83645

SEQ ID NO: 750975 - RNA, 64 nt, Homo Sapiens; identical to SEQ ID NO: 83646

SEQ ID NO: 750976 - RNA, 64 nt, Homo Sapiens; identical to SEQ ID NO: 83647

SEQ ID NO: 750977 - RNA, 64 nt, Homo Sapiens; identical to SEQ ID NO: 83648

SEQ ID NO: 750978 - RNA, 64 nt, Homo Sapiens; identical to SEQ ID NO: 83649

SEQ ID NO: 750979 - RNA, 64 nt, Homo Sapiens; identical to SEQ ID NO: 83650

SEQ ID NO: 750980 - RNA, 54 nt, Homo Sapiens; identical to SEQ ID NO: 83651

SEQ ID NO: 750981 - RNA, 64 nt, Homo Sapiens; identical to SEQ ID NO: 83652

SEQ ID NO: 750982 - RNA, 64 nt, Homo Sapiens; identical to SEQ ID NO: 83653

SEQ ID NO: 750983 - RNA, 64 nt, Homo Sapiens; identical to SEQ ID NO: 83654

SEQ ID NO: 750984 - RNA, 64 nt, Homo Sapiens; identical to SEQ ID NO: 83655

SEQ ID NO: 750985 - RNA, 64 nt, Homo Sapiens; identical to SEQ ID NO: 83656

SEQ ID NO: 750986 - RNA, 64 nt, Homo Sapiens; identical to SEQ ID NO: 83657

SEQ ID NO: 750987 - RNA, 59 nt, Homo Sapiens; identical to SEQ ID NO: 83658

SEQ ID NO: 750988 - RNA, 64 nt, Homo Sapiens; identical to SEQ ID NO: 83659

SEQ ID NO: 750989 - RNA, 64 nt, Homo Sapiens; identical to SEQ ID NO: 83660

SEQ ID NO: 750990 - RNA, 64 nt, Homo Sapiens; identical to SEQ ID NO: 83661

SEQ ID NO: 750991 - RNA, 64 nt, Homo Sapiens; identical to SEQ ID NO: 83662

SEQ ID NO: 750992 - RNA, 64 nt, Homo Sapiens; identical to SEQ ID NO: 83663

SEQ ID NO: 750993 - RNA, 64 nt, Homo Sapiens; identical to SEQ ID NO: 83664

SEQ ID NO: 750994 - RNA, 64 nt, Homo Sapiens; identical to SEQ ID NO: 83665

SEQ ID NO: 750995 - RNA, 64 nt, Homo Sapiens; identical to SEQ ID NO: 83666

SEQ ID NO: 750996 - RNA, 64 nt, Homo Sapiens; identical to SEQ ID NO: 83667

SEQ ID NO: 750997 - RNA, 64 nt, Homo Sapiens; identical to SEQ ID NO: 83668

SEQ ID NO: 750998 - RNA, 62 nt, Homo Sapiens
uuagccaagcaguuucuuucaaagaagccagcaggcgaaaagcagggacugccacugcauuu

SEQ ID NO: 750999 - RNA, 62 nt, Homo Sapiens
cugccauauccccagugccaggcugugcuugaaggcgaaaccagggcaaaggagggugucuu

SEQ ID NO: 751000 - RNA, 62 nt, Homo Sapiens
gauauauuauuuuauuccaagaaagaucagguaggcgaaaagaugacaggauacagagucaa

SEQ ID NO: 751001 - RNA, 62 nt, Homo Sapiens
gugggggaggugagcgcagcgggguggggaagaggcgaaagcugucugcuuagcccagcuca

SEQ ID NO: 751002 - RNA, 62 nt, Homo Sapiens
agaggaggccaaaaguuaaacguucuaaaaagaggcgaaaggaagcaagcaguucagaagag

SEQ ID NO: 751003 - RNA, 62 nt, Homo Sapiens
uaaaacugagacuguauaugucccagcugcugaggcgaaauaggcucuggaaagcaacuuca

SEQ ID NO: 751004 - RNA, 62 nt, Homo Sapiens
cugccccgucucccguggacggaacacgacagaggcgaaaucccccuagacugcucgcuagu

SEQ ID NO: 751005 - RNA, 62 nt, Homo Sapiens
ccuccccuucagcugugacaucgugccugggaaggcgaaauauacccccagccccuuccaac

SEQ ID NO: 751006 - RNA, 62 nt, Homo Sapiens
accagccugcagcacaccccacagccaaguagaggcgaaagcaguggcucauccuaccuguu

SEQ ID NO: 751007 - RNA, 62 nt, Homo Sapiens
ggcugacacacacucgcagacgagccgccccgaggcgaaaccucgcgguuccucuucccuuc

SEQ ID NO: 751008 - RNA, 62 nt, Homo Sapiens
ugcuuuguggaaagacggugugugucgugugaaggcgaaacccgguguacauaaccccuccc

SEQ ID NO: 751009 - RNA, 62 nt, Homo Sapiens
ccucacaggagggccaggcauguauuccucagaggcgaaacugccaaacucuuucuccuguc

SEQ ID NO: 751010 - RNA, 62 nt, Homo Sapiens
uagaugauucacuuuuugccccuagggaugagaggcgaaagccacuucucauacaagccccu

SEQ ID NO: 751011 - RNA, 62 nt, Homo Sapiens
aaucucccggcagugcuuggggcaggucugagaggcgaaacggcaugcugaugagcaaggca

SEQ ID NO: 751012 - RNA, 62 nt, Homo Sapiens
agauccagugggguccggacacugggccccgcaggcgaaagcacguuccagccaccaggagg

SEQ ID NO: 751013 - RNA, 62 nt, Homo Sapiens
aggucgggaguuggagacccgccuggcuaacaaggcgaaauccugucuguacuaaaaauaca

SEQ ID NO: 751014 - RNA, 62 nt, Homo Sapiens
cagugcuuugguaaagguccccgccacugcagaggcgaaagccuuacagguaaguauugcuu

SEQ ID NO: 751015 - RNA, 62 nt, Homo Sapiens
cagccacaccccucugccaccacgcgagaugcaggcgaaaagccagacugaucugccuaaag

SEQ ID NO: 751016 - RNA, 62 nt, Homo Sapiens
gaagcagaaaucuaggaagugccuguaauuuuaggcgaaaugaaauugacuucauauacaaa

SEQ ID NO: 751017 - RNA, 62 nt, Homo Sapiens
augacaggaaaccugccgccauaugagaaggaaggcgaaagcaugaacucuagcacuggugu

SEQ ID NO: 751018 - RNA, 62 nt, Homo Sapiens
gguggccugagccgauggggccccccaggcccaggcgaaagggcagcagcauguggcccaug

SEQ ID NO: 751019 - RNA, 62 nt, Homo Sapiens
guggaauuucauucaaaggcucuggacaauggaggcgaaagacaagcugauaugugccuguu

SEQ ID NO: 751020 - RNA, 62 nt, Homo Sapiens
aggucaggaguucaagaccagccuggccaacaaggcgaaacccugucucuacuaaaaauaaa

SEQ ID NO: 751021 - RNA, 62 nt, Homo Sapiens
ugagggaaggaagaaacuccuucuaggcuuccaggcgaaagcgggcuagggcuggaagccag

SEQ ID NO: 751022 - RNA, 62 nt, Homo Sapiens
agaagcuguggugauuggcccuguggucuaucaggcgaaaaccacagauucuccuucuaguu

SEQ ID NO: 751023 - RNA, 62 nt, Homo Sapiens
ggaugcugcauugcgaggaccauauaaaccacaggcgaaagauuggccucacucucuguaag

SEQ ID NO: 751024 - RNA, 59 nt, Homo Sapiens
ugccccaagacacagggacccacgccuuuaggcgaaacagcgcccaggcuccucucuga

SEQ ID NO: 751025 - RNA, 62 nt, Homo Sapiens
agcucaggaguucgagaucauucuggccaacaaggcgaaacccugucucuaccaaaaauaca

SEQ ID NO: 751026 - RNA, 62 nt, Homo Sapiens
uuuuacuaugccuguugaucuaugggaaaucuaggcgaaaguaauggggaagauuagaaaga

SEQ ID NO: 751027 - RNA, 62 nt, Homo Sapiens
aaacucuauuuagaugcauaaaaauaauugacaggcgaaagauuuuuaaugcuaaucuugug

SEQ ID NO: 751028 - RNA, 64 nt, Homo Sapiens; identical to SEQ ID NO: 108245

SEQ ID NO: 751029 - RNA, 64 nt, Homo Sapiens; identical to SEQ ID NO: 108246

SEQ ID NO: 751030 - RNA, 64 nt, Homo Sapiens; identical to SEQ ID NO: 108247

SEQ ID NO: 751031 - RNA, 64 nt, Homo Sapiens; identical to SEQ ID NO: 108248

SEQ ID NO: 751032 - RNA, 64 nt, Homo Sapiens; identical to SEQ ID NO: 108249

SEQ ID NO: 751033 - RNA, 64 nt, Homo Sapiens; identical to SEQ ID NO: 108250

SEQ ID NO: 751034 - RNA, 64 nt, Homo Sapiens; identical to SEQ ID NO: 108251

SEQ ID NO: 751035 - RNA, 64 nt, Homo Sapiens; identical to SEQ ID NO: 108252

SEQ ID NO: 751036 - RNA, 64 nt, Homo Sapiens; identical to SEQ ID NO: 108253

SEQ ID NO: 751037 - RNA, 64 nt, Homo Sapiens; identical to SEQ ID NO: 108254

SEQ ID NO: 751038 - RNA, 64 nt, Homo Sapiens; identical to SEQ ID NO: 108255

SEQ ID NO: 751039 - RNA, 64 nt, Homo Sapiens; identical to SEQ ID NO: 108256

SEQ ID NO: 751040 - RNA, 64 nt, Homo Sapiens; identical to SEQ ID NO: 108257

SEQ ID NO: 751041 - RNA, 64 nt, Homo Sapiens; identical to SEQ ID NO: 108258

SEQ ID NO: 751042 - RNA, 64 nt, Homo Sapiens; identical to SEQ ID NO: 108259

SEQ ID NO: 751043 - RNA, 64 nt, Homo Sapiens; identical to SEQ ID NO: 108260

SEQ ID NO: 751044 - RNA, 64 nt, Homo Sapiens; identical to SEQ ID NO: 108261

SEQ ID NO: 751045 - RNA, 64 nt, Homo Sapiens; identical to SEQ ID NO: 108262

SEQ ID NO: 751046 - RNA, 64 nt, Homo Sapiens; identical to SEQ ID NO: 108263

SEQ ID NO: 751047 - RNA, 64 nt, Homo Sapiens; identical to SEQ ID NO: 108264

SEQ ID NO: 751048 - RNA, 64 nt, Homo Sapiens; identical to SEQ ID NO: 108265

SEQ ID NO: 751049 - RNA, 64 nt, Homo Sapiens; identical to SEQ ID NO: 108266

SEQ ID NO: 751050 - RNA, 64 nt, Homo Sapiens; identical to SEQ ID NO: 108267

SEQ ID NO: 751051 - RNA, 64 nt, Homo Sapiens; identical to SEQ ID NO: 108268

SEQ ID NO: 751052 - RNA, 64 nt, Homo Sapiens; identical to SEQ ID NO: 108269

SEQ ID NO: 751053 - RNA, 64 nt, Homo Sapiens; identical to SEQ ID NO: 108270

SEQ ID NO: 751054 - RNA, 64 nt, Homo Sapiens; identical to SEQ ID NO: 108271

SEQ ID NO: 751055 - RNA, 64 nt, Homo Sapiens; identical to SEQ ID NO: 108272

SEQ ID NO: 751056 - RNA, 64 nt, Homo Sapiens; identical to SEQ ID NO: 108273

SEQ ID NO: 751057 - RNA, 64 nt, Homo Sapiens; identical to SEQ ID NO: 108274

SEQ ID NO: 751058 - RNA, 64 nt, Homo Sapiens; identical to SEQ ID NO: 108275

SEQ ID NO: 751059 - RNA, 64 nt, Homo Sapiens; identical to SEQ ID NO: 108276

SEQ ID NO: 751060 - RNA, 64 nt, Homo Sapiens; identical to SEQ ID NO: 108277

SEQ ID NO: 751061 - RNA, 64 nt, Homo Sapiens; identical to SEQ ID NO: 108278

SEQ ID NO: 751062 - RNA, 64 nt, Homo Sapiens; identical to SEQ ID NO: 108279

SEQ ID NO: 751063 - RNA, 64 nt, Homo Sapiens; identical to SEQ ID NO: 108280

SEQ ID NO: 751064 - RNA, 64 nt, Homo Sapiens; identical to SEQ ID NO: 108281

SEQ ID NO: 751065 - RNA, 64 nt, Homo Sapiens; identical to SEQ ID NO: 108282

SEQ ID NO: 751066 - RNA, 64 nt, Homo Sapiens; identical to SEQ ID NO: 108283

SEQ ID NO: 751067 - RNA, 64 nt, Homo Sapiens; identical to SEQ ID NO: 108284

SEQ ID NO: 751068 - RNA, 64 nt, Homo Sapiens; identical to SEQ ID NO: 712932

SEQ ID NO: 751069 - RNA, 64 nt, Homo Sapiens; identical to SEQ ID NO: 712933

SEQ ID NO: 751070 - RNA, 64 nt, Homo Sapiens; identical to SEQ ID NO: 712934

SEQ ID NO: 751071 - RNA, 64 nt, Homo Sapiens; identical to SEQ ID NO: 712935

SEQ ID NO: 751072 - RNA, 64 nt, Homo Sapiens; identical to SEQ ID NO: 712936

SEQ ID NO: 751073 - RNA, 64 nt, Homo Sapiens; identical to SEQ ID NO: 712937

SEQ ID NO: 751074 - RNA, 64 nt, Homo Sapiens; identical to SEQ ID NO: 712938

SEQ ID NO: 751075 - RNA, 64 nt, Homo Sapiens; identical to SEQ ID NO: 712939

SEQ ID NO: 751076 - RNA, 64 nt, Homo Sapiens; identical to SEQ ID NO: 712940

SEQ ID NO: 751077 - RNA, 64 nt, Homo Sapiens; identical to SEQ ID NO: 712941

SEQ ID NO: 751078 - RNA, 64 nt, Homo Sapiens; identical to SEQ ID NO: 712942

SEQ ID NO: 751079 - RNA, 64 nt, Homo Sapiens; identical to SEQ ID NO: 712943

SEQ ID NO: 751080 - RNA, 64 nt, Homo Sapiens; identical to SEQ ID NO: 712944

SEQ ID NO: 751081 - RNA, 64 nt, Homo Sapiens; identical to SEQ ID NO: 712945

SEQ ID NO: 751082 - RNA, 64 nt, Homo Sapiens; identical to SEQ ID NO: 712946

SEQ ID NO: 751083 - RNA, 64 nt, Homo Sapiens; identical to SEQ ID NO: 712947

SEQ ID NO: 751084 - RNA, 64 nt, Homo Sapiens; identical to SEQ ID NO: 712948

SEQ ID NO: 751085 - RNA, 64 nt, Homo Sapiens; identical to SEQ ID NO: 712949

SEQ ID NO: 751086 - RNA, 64 nt, Homo Sapiens; identical to SEQ ID NO: 204913

SEQ ID NO: 751087 - RNA, 64 nt, Homo Sapiens; identical to SEQ ID NO: 204914

SEQ ID NO: 751088 - RNA, 64 nt, Homo Sapiens; identical to SEQ ID NO: 204915

SEQ ID NO: 751089 - RNA, 64 nt, Homo Sapiens; identical to SEQ ID NO: 204916

SEQ ID NO: 751090 - RNA, 64 nt, Homo Sapiens; identical to SEQ ID NO: 204917

SEQ ID NO: 751091 - RNA, 64 nt, Homo Sapiens; identical to SEQ ID NO: 204918

SEQ ID NO: 751092 - RNA, 64 nt, Homo Sapiens; identical to SEQ ID NO: 204919

SEQ ID NO: 751093 - RNA, 64 nt, Homo Sapiens; identical to SEQ ID NO: 204920

SEQ ID NO: 751094 - RNA, 64 nt, Homo Sapiens; identical to SEQ ID NO: 204921

SEQ ID NO: 751095 - RNA, 64 nt, Homo Sapiens; identical to SEQ ID NO: 204922

SEQ ID NO: 751096 - RNA, 64 nt, Homo Sapiens; identical to SEQ ID NO: 204923

SEQ ID NO: 751097 - RNA, 64 nt, Homo Sapiens; identical to SEQ ID NO: 204924

SEQ ID NO: 751098 - RNA, 64 nt, Homo Sapiens; identical to SEQ ID NO: 204925

SEQ ID NO: 751099 - RNA, 64 nt, Homo Sapiens; identical to SEQ ID NO: 204926

SEQ ID NO: 751100 - RNA, 64 nt, Homo Sapiens; identical to SEQ ID NO: 204927

SEQ ID NO: 751101 - RNA, 64 nt, Homo Sapiens; identical to SEQ ID NO: 204928

SEQ ID NO: 751102 - RNA, 64 nt, Homo Sapiens; identical to SEQ ID NO: 204929

SEQ ID NO: 751103 - RNA, 64 nt, Homo Sapiens; identical to SEQ ID NO: 204930

SEQ ID NO: 751104 - RNA, 64 nt, Homo Sapiens; identical to SEQ ID NO: 204931

SEQ ID NO: 751105 - RNA, 64 nt, Homo Sapiens; identical to SEQ ID NO: 204932

SEQ ID NO: 751106 - RNA, 64 nt, Homo Sapiens; identical to SEQ ID NO: 204933

SEQ ID NO: 751107 - RNA, 64 nt, Homo Sapiens; identical to SEQ ID NO: 204934

SEQ ID NO: 751108 - RNA, 64 nt, Homo Sapiens; identical to SEQ ID NO: 204935

SEQ ID NO: 751109 - RNA, 64 nt, Homo Sapiens; identical to SEQ ID NO: 204936

SEQ ID NO: 751110 - RNA, 64 nt, Homo Sapiens; identical to SEQ ID NO: 204937

SEQ ID NO: 751111 - RNA, 64 nt, Homo Sapiens; identical to SEQ ID NO: 204938

SEQ ID NO: 751112 - RNA, 64 nt, Homo Sapiens; identical to SEQ ID NO: 204939

SEQ ID NO: 751113 - RNA, 64 nt, Homo Sapiens; identical to SEQ ID NO: 204940

SEQ ID NO: 751114 - RNA, 64 nt, Homo Sapiens; identical to SEQ ID NO: 204941

SEQ ID NO: 751115 - RNA, 63 nt, Homo Sapiens
gcugucaugguccuuugcagagcugcugcuuuuggcauucauagauaaacagcucaggcauaa

SEQ ID NO: 751116 - RNA, 63 nt, Homo Sapiens
ugaaauggagaugauaacacugugucuuagguuggcauucaggucacaugaaaggugugugga

SEQ ID NO: 751117 - RNA, 63 nt, Homo Sapiens
agaaucuagucuuuguaauagaaguuucccaguggcauucacuagugagaguuuuagacaaau

SEQ ID NO: 751118 - RNA, 63 nt, Homo Sapiens
uuuggugaaauguccuguacagaacaguaccuuggcauucagcagcuguaauuggggaacauu

SEQ ID NO: 751119 - RNA, 63 nt, Homo Sapiens
cagagcaaagcacuuuaaccugccacccucucuggcauucaugccaccugucccaggcugugg

SEQ ID NO: 751120 - RNA, 63 nt, Homo Sapiens
gcugggggaaggaaagcuacgguucuaaguacaggcauucaaggcucaaacugaaagagugug

SEQ ID NO: 751121 - RNA, 63 nt, Homo Sapiens
gugacaugaugguacuaaauucgagguauugcuggcauucagggcuuccugcguguguaaaag

SEQ ID NO: 751122 - RNA, 63 nt, Homo Sapiens
caguggacagugggaauuaauuaauauuugaaaggcauucauuuaaauacuguaauauauuua

SEQ ID NO: 751123 - RNA, 63 nt, Homo Sapiens
auuaaaaagcggauccaaagaucuggggaacuuggcauucaacugucagaggagccuuucgau

SEQ ID NO: 751124 - RNA, 63 nt, Homo Sapiens
uacagacuccaacaaggccuuccgugggagggaggcauucaucugcagucggaaguuuccuuu

SEQ ID NO: 751125 - RNA, 64 nt, Homo Sapiens; identical to SEQ ID NO: 744406

SEQ ID NO: 751126 - RNA, 64 nt, Homo Sapiens; identical to SEQ ID NO: 744407

SEQ ID NO: 751127 - RNA, 64 nt, Homo Sapiens; identical to SEQ ID NO: 744408

SEQ ID NO: 751128 - RNA, 64 nt, Homo Sapiens; identical to SEQ ID NO: 744409

SEQ ID NO: 751129 - RNA, 64 nt, Homo Sapiens; identical to SEQ ID NO: 744410

SEQ ID NO: 751130 - RNA, 64 nt, Homo Sapiens; identical to SEQ ID NO: 744411

SEQ ID NO: 751131 - RNA, 64 nt, Homo Sapiens; identical to SEQ ID NO: 744412

SEQ ID NO: 751132 - RNA, 64 nt, Homo Sapiens; identical to SEQ ID NO: 744413

SEQ ID NO: 751133 - RNA, 64 nt, Homo Sapiens; identical to SEQ ID NO: 744414

SEQ ID NO: 751134 - RNA, 64 nt, Homo Sapiens; identical to SEQ ID NO: 744415

SEQ ID NO: 751135 - RNA, 64 nt, Homo Sapiens; identical to SEQ ID NO: 744416

SEQ ID NO: 751136 - RNA, 64 nt, Homo Sapiens; identical to SEQ ID NO: 744417

SEQ ID NO: 751137 - RNA, 64 nt, Homo Sapiens; identical to SEQ ID NO: 744418

SEQ ID NO: 751138 - RNA, 64 nt, Homo Sapiens; identical to SEQ ID NO: 744419

SEQ ID NO: 751139 - RNA, 64 nt, Homo Sapiens; identical to SEQ ID NO: 744420

SEQ ID NO: 751140 - RNA, 64 nt, Homo Sapiens; identical to SEQ ID NO: 744421

SEQ ID NO: 751141 - RNA, 64 nt, Homo Sapiens; identical to SEQ ID NO: 744422

SEQ ID NO: 751142 - RNA, 64 nt, Homo Sapiens; identical to SEQ ID NO: 744423

SEQ ID NO: 751143 - RNA, 64 nt, Homo Sapiens; identical to SEQ ID NO: 744424

SEQ ID NO: 751144 - RNA, 64 nt, Homo Sapiens; identical to SEQ ID NO: 744425

SEQ ID NO: 751145 - RNA, 64 nt, Homo Sapiens; identical to SEQ ID NO: 744426

SEQ ID NO: 751146 - RNA, 64 nt, Homo Sapiens; identical to SEQ ID NO: 744427

SEQ ID NO: 751147 - RNA, 64 nt, Homo Sapiens; identical to SEQ ID NO: 744428

SEQ ID NO: 751148 - RNA, 64 nt, Homo Sapiens; identical to SEQ ID NO: 744429

SEQ ID NO: 751149 - RNA, 64 nt, Homo Sapiens; identical to SEQ ID NO: 744430

SEQ ID NO: 751150 - RNA, 64 nt, Homo Sapiens; identical to SEQ ID NO: 744431

SEQ ID NO: 751151 - RNA, 64 nt, Homo Sapiens; identical to SEQ ID NO: 744432

SEQ ID NO: 751152 - RNA, 64 nt, Homo Sapiens; identical to SEQ ID NO: 744433

SEQ ID NO: 751153 - RNA, 64 nt, Homo Sapiens; identical to SEQ ID NO: 744434

SEQ ID NO: 751154 - RNA, 64 nt, Homo Sapiens; identical to SEQ ID NO: 744435

SEQ ID NO: 751155 - RNA, 64 nt, Homo Sapiens; identical to SEQ ID NO: 744436

SEQ ID NO: 751156 - RNA, 64 nt, Homo Sapiens; identical to SEQ ID NO: 744437

SEQ ID NO: 751157 - RNA, 64 nt, Homo Sapiens; identical to SEQ ID NO: 744438

SEQ ID NO: 751158 - RNA, 64 nt, Homo Sapiens; identical to SEQ ID NO: 744439

SEQ ID NO: 751159 - RNA, 64 nt, Homo Sapiens; identical to SEQ ID NO: 744440

SEQ ID NO: 751160 - RNA, 64 nt, Homo Sapiens; identical to SEQ ID NO: 744441

SEQ ID NO: 751161 - RNA, 64 nt, Homo Sapiens; identical to SEQ ID NO: 744442

SEQ ID NO: 751162 - RNA, 64 nt, Homo Sapiens; identical to SEQ ID NO: 744443

SEQ ID NO: 751163 - RNA, 64 nt, Homo Sapiens; identical to SEQ ID NO: 744444

SEQ ID NO: 751164 - RNA, 64 nt, Homo Sapiens; identical to SEQ ID NO: 744445

SEQ ID NO: 751165 - RNA, 64 nt, Homo Sapiens; identical to SEQ ID NO: 744446

SEQ ID NO: 751166 - RNA, 64 nt, Homo Sapiens; identical to SEQ ID NO: 744447

SEQ ID NO: 751167 - RNA, 64 nt, Homo Sapiens; identical to SEQ ID NO: 744448

SEQ ID NO: 751168 - RNA, 64 nt, Homo Sapiens; identical to SEQ ID NO: 744449

SEQ ID NO: 751169 - RNA, 64 nt, Homo Sapiens; identical to SEQ ID NO: 744450

SEQ ID NO: 751170 - RNA, 64 nt, Homo Sapiens; identical to SEQ ID NO: 744451

SEQ ID NO: 751171 - RNA, 64 nt, Homo Sapiens; identical to SEQ ID NO: 744452

SEQ ID NO: 751172 - RNA, 64 nt, Homo Sapiens; identical to SEQ ID NO: 744453

SEQ ID NO: 751173 - RNA, 64 nt, Homo Sapiens; identical to SEQ ID NO: 744454

SEQ ID NO: 751174 - RNA, 64 nt, Homo Sapiens; identical to SEQ ID NO: 744455

SEQ ID NO: 751175 - RNA, 64 nt, Homo Sapiens; identical to SEQ ID NO: 744456

SEQ ID NO: 751176 - RNA, 64 nt, Homo Sapiens; identical to SEQ ID NO: 744457

SEQ ID NO: 751177 - RNA, 64 nt, Homo Sapiens; identical to SEQ ID NO: 744458

SEQ ID NO: 751178 - RNA, 64 nt, Homo Sapiens; identical to SEQ ID NO: 744459

SEQ ID NO: 751179 - RNA, 64 nt, Homo Sapiens; identical to SEQ ID NO: 744460

SEQ ID NO: 751180 - RNA, 64 nt, Homo Sapiens; identical to SEQ ID NO: 744461

SEQ ID NO: 751181 - RNA, 64 nt, Homo Sapiens; identical to SEQ ID NO: 744462

SEQ ID NO: 751182 - RNA, 64 nt, Homo Sapiens; identical to SEQ ID NO: 744463

SEQ ID NO: 751183 - RNA, 64 nt, Homo Sapiens; identical to SEQ ID NO: 744464

SEQ ID NO: 751184 - RNA, 64 nt, Homo Sapiens; identical to SEQ ID NO: 744465

SEQ ID NO: 751185 - RNA, 64 nt, Homo Sapiens; identical to SEQ ID NO: 744466

SEQ ID NO: 751186 - RNA, 64 nt, Homo Sapiens; identical to SEQ ID NO: 744467

SEQ ID NO: 751187 - RNA, 64 nt, Homo Sapiens; identical to SEQ ID NO: 744468

SEQ ID NO: 751188 - RNA, 64 nt, Homo Sapiens; identical to SEQ ID NO: 744469

SEQ ID NO: 751189 - RNA, 64 nt, Homo Sapiens; identical to SEQ ID NO: 744470

SEQ ID NO: 751190 - RNA, 64 nt, Homo Sapiens; identical to SEQ ID NO: 744471

SEQ ID NO: 751191 - RNA, 64 nt, Homo Sapiens; identical to SEQ ID NO: 744472

SEQ ID NO: 751192 - RNA, 64 nt, Homo Sapiens; identical to SEQ ID NO: 744473

SEQ ID NO: 751193 - RNA, 64 nt, Homo Sapiens; identical to SEQ ID NO: 744474

SEQ ID NO: 751194 - RNA, 64 nt, Homo Sapiens; identical to SEQ ID NO: 744475

SEQ ID NO: 751195 - RNA, 64 nt, Homo Sapiens; identical to SEQ ID NO: 744476

SEQ ID NO: 751196 - RNA, 64 nt, Homo Sapiens; identical to SEQ ID NO: 744477

SEQ ID NO: 751197 - RNA, 64 nt, Homo Sapiens; identical to SEQ ID NO: 744478

SEQ ID NO: 751198 - RNA, 64 nt, Homo Sapiens; identical to SEQ ID NO: 744479

SEQ ID NO: 751199 - RNA, 64 nt, Homo Sapiens; identical to SEQ ID NO: 744480

SEQ ID NO: 751200 - RNA, 64 nt, Homo Sapiens; identical to SEQ ID NO: 744481

SEQ ID NO: 751201 - RNA, 64 nt, Homo Sapiens; identical to SEQ ID NO: 744482

SEQ ID NO: 751202 - RNA, 64 nt, Homo Sapiens; identical to SEQ ID NO: 744483

SEQ ID NO: 751203 - RNA, 64 nt, Homo Sapiens; identical to SEQ ID NO: 744484

SEQ ID NO: 751204 - RNA, 64 nt, Homo Sapiens; identical to SEQ ID NO: 744485

SEQ ID NO: 751205 - RNA, 64 nt, Homo Sapiens; identical to SEQ ID NO: 744486

SEQ ID NO: 751206 - RNA, 64 nt, Homo Sapiens; identical to SEQ ID NO: 744487

SEQ ID NO: 751207 - RNA, 64 nt, Homo Sapiens; identical to SEQ ID NO: 744488

SEQ ID NO: 751208 - RNA, 64 nt, Homo Sapiens; identical to SEQ ID NO: 744489

SEQ ID NO: 751209 - RNA, 64 nt, Homo Sapiens; identical to SEQ ID NO: 744490

SEQ ID NO: 751210 - RNA, 64 nt, Homo Sapiens; identical to SEQ ID NO: 744491

SEQ ID NO: 751211 - RNA, 64 nt, Homo Sapiens; identical to SEQ ID NO: 744492

SEQ ID NO: 751212 - RNA, 64 nt, Homo Sapiens; identical to SEQ ID NO: 744493

SEQ ID NO: 751213 - RNA, 64 nt, Homo Sapiens; identical to SEQ ID NO: 744494

SEQ ID NO: 751214 - RNA, 64 nt, Homo Sapiens; identical to SEQ ID NO: 744495

SEQ ID NO: 751215 - RNA, 64 nt, Homo Sapiens; identical to SEQ ID NO: 744496

SEQ ID NO: 751216 - RNA, 64 nt, Homo Sapiens; identical to SEQ ID NO: 744497

SEQ ID NO: 751217 - RNA, 64 nt, Homo Sapiens; identical to SEQ ID NO: 744498

SEQ ID NO: 751218 - RNA, 64 nt, Homo Sapiens; identical to SEQ ID NO: 744499

SEQ ID NO: 751219 - RNA, 64 nt, Homo Sapiens; identical to SEQ ID NO: 744500

SEQ ID NO: 751220 - RNA, 64 nt, Homo Sapiens; identical to SEQ ID NO: 744501

SEQ ID NO: 751221 - RNA, 64 nt, Homo Sapiens; identical to SEQ ID NO: 744502

SEQ ID NO: 751222 - RNA, 64 nt, Homo Sapiens; identical to SEQ ID NO: 744503

SEQ ID NO: 751223 - RNA, 64 nt, Homo Sapiens; identical to SEQ ID NO: 744504

SEQ ID NO: 751224 - RNA, 64 nt, Homo Sapiens; identical to SEQ ID NO: 744505

SEQ ID NO: 751225 - RNA, 64 nt, Homo Sapiens; identical to SEQ ID NO: 744506

SEQ ID NO: 751226 - RNA, 64 nt, Homo Sapiens; identical to SEQ ID NO: 744507

SEQ ID NO: 751227 - RNA, 64 nt, Homo Sapiens; identical to SEQ ID NO: 744508

SEQ ID NO: 751228 - RNA, 64 nt, Homo Sapiens; identical to SEQ ID NO: 744509

SEQ ID NO: 751229 - RNA, 64 nt, Homo Sapiens; identical to SEQ ID NO: 744510

SEQ ID NO: 751230 - RNA, 64 nt, Homo Sapiens; identical to SEQ ID NO: 744511

SEQ ID NO: 751231 - RNA, 64 nt, Homo Sapiens; identical to SEQ ID NO: 744512

SEQ ID NO: 751232 - RNA, 64 nt, Homo Sapiens; identical to SEQ ID NO: 744513

SEQ ID NO: 751233 - RNA, 64 nt, Homo Sapiens; identical to SEQ ID NO: 744514

SEQ ID NO: 751234 - RNA, 64 nt, Homo Sapiens; identical to SEQ ID NO: 744515

SEQ ID NO: 751235 - RNA, 64 nt, Homo Sapiens; identical to SEQ ID NO: 744516

SEQ ID NO: 751236 - RNA, 64 nt, Homo Sapiens; identical to SEQ ID NO: 744517

SEQ ID NO: 751237 - RNA, 64 nt, Homo Sapiens; identical to SEQ ID NO: 744518

SEQ ID NO: 751238 - RNA, 64 nt, Homo Sapiens; identical to SEQ ID NO: 744519

SEQ ID NO: 751239 - RNA, 64 nt, Homo Sapiens; identical to SEQ ID NO: 744520

SEQ ID NO: 751240 - RNA, 64 nt, Homo Sapiens; identical to SEQ ID NO: 744521

SEQ ID NO: 751241 - RNA, 64 nt, Homo Sapiens; identical to SEQ ID NO: 744522

SEQ ID NO: 751242 - RNA, 64 nt, Homo Sapiens; identical to SEQ ID NO: 744523

SEQ ID NO: 751243 - RNA, 64 nt, Homo Sapiens; identical to SEQ ID NO: 744524

SEQ ID NO: 751244 - RNA, 64 nt, Homo Sapiens; identical to SEQ ID NO: 744525

SEQ ID NO: 751245 - RNA, 64 nt, Homo Sapiens; identical to SEQ ID NO: 744526

SEQ ID NO: 751246 - RNA, 64 nt, Homo Sapiens; identical to SEQ ID NO: 744527

SEQ ID NO: 751247 - RNA, 64 nt, Homo Sapiens; identical to SEQ ID NO: 744528

SEQ ID NO: 751248 - RNA, 64 nt, Homo Sapiens; identical to SEQ ID NO: 744529

SEQ ID NO: 751249 - RNA, 64 nt, Homo Sapiens; identical to SEQ ID NO: 744530

SEQ ID NO: 751250 - RNA, 64 nt, Homo Sapiens; identical to SEQ ID NO: 744531

SEQ ID NO: 751251 - RNA, 64 nt, Homo Sapiens; identical to SEQ ID NO: 744532

SEQ ID NO: 751252 - RNA, 64 nt, Homo Sapiens; identical to SEQ ID NO: 744533

SEQ ID NO: 751253 - RNA, 64 nt, Homo Sapiens; identical to SEQ ID NO: 744534

SEQ ID NO: 751254 - RNA, 64 nt, Homo Sapiens; identical to SEQ ID NO: 744535

SEQ ID NO: 751255 - RNA, 64 nt, Homo Sapiens; identical to SEQ ID NO: 744536

SEQ ID NO: 751256 - RNA, 64 nt, Homo Sapiens; identical to SEQ ID NO: 744537

SEQ ID NO: 751257 - RNA, 64 nt, Homo Sapiens; identical to SEQ ID NO: 744538

SEQ ID NO: 751258 - RNA, 64 nt, Homo Sapiens; identical to SEQ ID NO: 744539

SEQ ID NO: 751259 - RNA, 64 nt, Homo Sapiens; identical to SEQ ID NO: 744540

SEQ ID NO: 751260 - RNA, 64 nt, Homo Sapiens; identical to SEQ ID NO: 744541

SEQ ID NO: 751261 - RNA, 64 nt, Homo Sapiens; identical to SEQ ID NO: 744542

SEQ ID NO: 751262 - RNA, 64 nt, Homo Sapiens; identical to SEQ ID NO: 744543

SEQ ID NO: 751263 - RNA, 64 nt, Homo Sapiens; identical to SEQ ID NO: 744544

SEQ ID NO: 751264 - RNA, 64 nt, Homo Sapiens; identical to SEQ ID NO: 744545

SEQ ID NO: 751265 - RNA, 64 nt, Homo Sapiens; identical to SEQ ID NO: 744546

SEQ ID NO: 751266 - RNA, 64 nt, Homo Sapiens; identical to SEQ ID NO: 744547

SEQ ID NO: 751267 - RNA, 64 nt, Homo Sapiens; identical to SEQ ID NO: 744548

SEQ ID NO: 751268 - RNA, 64 nt, Homo Sapiens; identical to SEQ ID NO: 744549

SEQ ID NO: 751269 - RNA, 64 nt, Homo Sapiens; identical to SEQ ID NO: 744550

SEQ ID NO: 751270 - RNA, 64 nt, Homo Sapiens; identical to SEQ ID NO: 744551

SEQ ID NO: 751271 - RNA, 64 nt, Homo Sapiens; identical to SEQ ID NO: 744552

SEQ ID NO: 751272 - RNA, 64 nt, Homo Sapiens; identical to SEQ ID NO: 744553

SEQ ID NO: 751273 - RNA, 64 nt, Homo Sapiens; identical to SEQ ID NO: 744554

SEQ ID NO: 751274 - RNA, 64 nt, Homo Sapiens; identical to SEQ ID NO: 744555

SEQ ID NO: 751275 - RNA, 64 nt, Homo Sapiens; identical to SEQ ID NO: 744556

SEQ ID NO: 751276 - RNA, 64 nt, Homo Sapiens; identical to SEQ ID NO: 744557

SEQ ID NO: 751277 - RNA, 64 nt, Homo Sapiens; identical to SEQ ID NO: 744558

SEQ ID NO: 751278 - RNA, 64 nt, Homo Sapiens; identical to SEQ ID NO: 744559

SEQ ID NO: 751279 - RNA, 64 nt, Homo Sapiens; identical to SEQ ID NO: 744560

SEQ ID NO: 751280 - RNA, 64 nt, Homo Sapiens; identical to SEQ ID NO: 744561

SEQ ID NO: 751281 - RNA, 64 nt, Homo Sapiens; identical to SEQ ID NO: 744562

SEQ ID NO: 751282 - RNA, 61 nt, Homo Sapiens; identical to SEQ ID NO: 744563

SEQ ID NO: 751283 - RNA, 64 nt, Homo Sapiens; identical to SEQ ID NO: 744564

SEQ ID NO: 751284 - RNA, 64 nt, Homo Sapiens; identical to SEQ ID NO: 744565

SEQ ID NO: 751285 - RNA, 64 nt, Homo Sapiens; identical to SEQ ID NO: 744566

SEQ ID NO: 751286 - RNA, 64 nt, Homo Sapiens; identical to SEQ ID NO: 744567

SEQ ID NO: 751287 - RNA, 64 nt, Homo Sapiens; identical to SEQ ID NO: 744568

SEQ ID NO: 751288 - RNA, 64 nt, Homo Sapiens; identical to SEQ ID NO: 744569

SEQ ID NO: 751289 - RNA, 64 nt, Homo Sapiens; identical to SEQ ID NO: 744570

SEQ ID NO: 751290 - RNA, 64 nt, Homo Sapiens; identical to SEQ ID NO: 744571

SEQ ID NO: 751291 - RNA, 64 nt, Homo Sapiens; identical to SEQ ID NO: 744572

SEQ ID NO: 751292 - RNA, 64 nt, Homo Sapiens; identical to SEQ ID NO: 744573

SEQ ID NO: 751293 - RNA, 64 nt, Homo Sapiens; identical to SEQ ID NO: 744574

SEQ ID NO: 751294 - RNA, 64 nt, Homo Sapiens; identical to SEQ ID NO: 744575

SEQ ID NO: 751295 - RNA, 64 nt, Homo Sapiens; identical to SEQ ID NO: 744576

SEQ ID NO: 751296 - RNA, 64 nt, Homo Sapiens; identical to SEQ ID NO: 744577

SEQ ID NO: 751297 - RNA, 64 nt, Homo Sapiens; identical to SEQ ID NO: 744578

SEQ ID NO: 751298 - RNA, 64 nt, Homo Sapiens; identical to SEQ ID NO: 744579

SEQ ID NO: 751299 - RNA, 64 nt, Homo Sapiens; identical to SEQ ID NO: 744580

SEQ ID NO: 751300 - RNA, 64 nt, Homo Sapiens; identical to SEQ ID NO: 744581

SEQ ID NO: 751301 - RNA, 64 nt, Homo Sapiens; identical to SEQ ID NO: 744582

SEQ ID NO: 751302 - RNA, 64 nt, Homo Sapiens; identical to SEQ ID NO: 744583

SEQ ID NO: 751303 - RNA, 64 nt, Homo Sapiens; identical to SEQ ID NO: 744584

SEQ ID NO: 751304 - RNA, 64 nt, Homo Sapiens; identical to SEQ ID NO: 744585

SEQ ID NO: 751305 - RNA, 64 nt, Homo Sapiens; identical to SEQ ID NO: 744586

SEQ ID NO: 751306 - RNA, 64 nt, Homo Sapiens; identical to SEQ ID NO: 744587

SEQ ID NO: 751307 - RNA, 64 nt, Homo Sapiens; identical to SEQ ID NO: 744588

SEQ ID NO: 751308 - RNA, 64 nt, Homo Sapiens; identical to SEQ ID NO: 744589

SEQ ID NO: 751309 - RNA, 64 nt, Homo Sapiens; identical to SEQ ID NO: 744590

SEQ ID NO: 751310 - RNA, 50 nt, Homo Sapiens; identical to SEQ ID NO: 744591

SEQ ID NO: 751311 - RNA, 64 nt, Homo Sapiens; identical to SEQ ID NO: 744592

SEQ ID NO: 751312 - RNA, 64 nt, Homo Sapiens; identical to SEQ ID NO: 744593

SEQ ID NO: 751313 - RNA, 64 nt, Homo Sapiens; identical to SEQ ID NO: 744594

SEQ ID NO: 751314 - RNA, 64 nt, Homo Sapiens; identical to SEQ ID NO: 744595

SEQ ID NO: 751315 - RNA, 64 nt, Homo Sapiens
uauguagucuaagcauacguauacaauaaaacuaugcuauuaaaaaaaaagaagguaacugaua

SEQ ID NO: 751316 - RNA, 64 nt, Homo Sapiens
guuccuccugguaggcuuacaaguguuuacuauaugcuauuaauacauuauacuuuauaacuaa

SEQ ID NO: 751317 - RNA, 64 nt, Homo Sapiens
uacagaaaaaauaaaauggaugcccauguuuuauugcuauuacuaaaugucaagauuguaugcu

SEQ ID NO: 751318 - RNA, 64 nt, Homo Sapiens
uguuuuauugcuauuacuaaaugucaagauuguaugcuauuaugucuuguaaauuucuuuuguu

SEQ ID NO: 751319 - RNA, 64 nt, Homo Sapiens
aguaucagguaaaaaguacauccaggaucaucaaugcuauuaacuaaagcagccaucuuuaaaa

SEQ ID NO: 751320 - RNA, 64 nt, Homo Sapiens
auauauugagauuaauacauugagaccauauguaugcuauuaaaagccccaggaaaggguuuuu

SEQ ID NO: 751321 - RNA, 64 nt, Homo Sapiens
uuucagauaaccucucaaaaagacuuuaaaauaaugcuauuacacaaagcugcauuuaccaaaa

SEQ ID NO: 751322 - RNA, 64 nt, Homo Sapiens
gucuuaaagagagaacugaagcuuuugaugaaggugcuauuaaucuagaaaggcaaacccauuu

SEQ ID NO: 751323 - RNA, 64 nt, Homo Sapiens; identical to SEQ ID NO: 271043

SEQ ID NO: 751324 - RNA, 64 nt, Homo Sapiens; identical to SEQ ID NO: 271044

SEQ ID NO: 751325 - RNA, 64 nt, Homo Sapiens; identical to SEQ ID NO: 271045

SEQ ID NO: 751326 - RNA, 64 nt, Homo Sapiens; identical to SEQ ID NO: 271046

SEQ ID NO: 751327 - RNA, 64 nt, Homo Sapiens; identical to SEQ ID NO: 271047

SEQ ID NO: 751328 - RNA, 64 nt, Homo Sapiens; identical to SEQ ID NO: 271048

SEQ ID NO: 751329 - RNA, 64 nt, Homo Sapiens; identical to SEQ ID NO: 271049

SEQ ID NO: 751330 - RNA, 64 nt, Homo Sapiens; identical to SEQ ID NO: 271050

SEQ ID NO: 751331 - RNA, 64 nt, Homo Sapiens; identical to SEQ ID NO: 271051

SEQ ID NO: 751332 - RNA, 64 nt, Homo Sapiens; identical to SEQ ID NO: 271052

SEQ ID NO: 751333 - RNA, 64 nt, Homo Sapiens; identical to SEQ ID NO: 271053

SEQ ID NO: 751334 - RNA, 64 nt, Homo Sapiens; identical to SEQ ID NO: 271054

SEQ ID NO: 751335 - RNA, 64 nt, Homo Sapiens; identical to SEQ ID NO: 271055

SEQ ID NO: 751336 - RNA, 64 nt, Homo Sapiens; identical to SEQ ID NO: 271056

SEQ ID NO: 751337 - RNA, 64 nt, Homo Sapiens; identical to SEQ ID NO: 271057

SEQ ID NO: 751338 - RNA, 64 nt, Homo Sapiens; identical to SEQ ID NO: 271058

SEQ ID NO: 751339 - RNA, 64 nt, Homo Sapiens; identical to SEQ ID NO: 271059

SEQ ID NO: 751340 - RNA, 64 nt, Homo Sapiens; identical to SEQ ID NO: 271060

SEQ ID NO: 751341 - RNA, 64 nt, Homo Sapiens; identical to SEQ ID NO: 271061

SEQ ID NO: 751342 - RNA, 64 nt, Homo Sapiens; identical to SEQ ID NO: 271062

SEQ ID NO: 751343 - RNA, 64 nt, Homo Sapiens; identical to SEQ ID NO: 271063

SEQ ID NO: 751344 - RNA, 64 nt, Homo Sapiens; identical to SEQ ID NO: 271064

SEQ ID NO: 751345 - RNA, 64 nt, Homo Sapiens; identical to SEQ ID NO: 271065

SEQ ID NO: 751346 - RNA, 64 nt, Homo Sapiens; identical to SEQ ID NO: 271066

SEQ ID NO: 751347 - RNA, 64 nt, Homo Sapiens; identical to SEQ ID NO: 271067

SEQ ID NO: 751348 - RNA, 64 nt, Homo Sapiens; identical to SEQ ID NO: 271068

SEQ ID NO: 751349 - RNA, 63 nt, Homo Sapiens
uauucuuuggcauuggugucuuuuugcaaaaaaacccugaaacuguucauggaugacacaaug

SEQ ID NO: 751350 - RNA, 63 nt, Homo Sapiens
uucuaucaccacagauaaaguuccauauauauuacccugaacucacaauuuuucauuucaugc

SEQ ID NO: 751351 - RNA, 63 nt, Homo Sapiens
cucaauguugggaaaacagaugagcaacccacuacccugaagucauccaccguguagugggga

SEQ ID NO: 751352 - RNA, 63 nt, Homo Sapiens
ugaggccauauuuugaguucuuaaauacuaccaacccugaacgucucaggacaaauaauucaa

SEQ ID NO: 751353 - RNA, 63 nt, Homo Sapiens
ugacugccugcagaaagaccacccaguaauucuacccugaaaggugugaaaagcuacccugaa

SEQ ID NO: 751354 - RNA, 63 nt, Homo Sapiens
ccaguaauucuacccugaaaagugugaaaagcuacccugaaacuccccagggccauaguguag

SEQ ID NO: 751355 - RNA, 63 nt, Homo Sapiens
uuacaaagaggccagcuaauagcagaaaucaugacccugaaagagagaugaaauucaagcugu

SEQ ID NO: 751356 - RNA, 63 nt, Homo Sapiens
ggaguuugcuuuuggcuucucacucuccaaguaacccugaauuaggcccagaauggcugaggc

SEQ ID NO: 751357 - RNA, 63 nt, Homo Sapiens
uguuuuaauaauccaaaauaauuccagugccgaacccugaauuuaacauaugguagacauuca

SEQ ID NO: 751358 - RNA, 63 nt, Homo Sapiens
agcagcuuugaaagcagacugagaugaguugagacccugaaucccugggcuguuguuccuguc

SEQ ID NO: 751359 - RNA, 63 nt, Homo Sapiens
ccaaggccugcuuugaaaaggugcuugaaguggacccugaaaacccugaauccagcgcugggu

SEQ ID NO: 751360 - RNA, 63 nt, Homo Sapiens
gcuuugaaaaggugcuugaaguggacccugaaaacccugaauccagcgcuggguaugcgaucu

SEQ ID NO: 751361 - RNA, 63 nt, Homo Sapiens
gggcuuguaaacagacauaggaagccucuguuuacccugaagcaccacuguccagcccauugg

SEQ ID NO: 751362 - RNA, 63 nt, Homo Sapiens
gagucuucccgaggcauccugucugugcuuccaacccugaacaagaccuuacaugagagaugg

SEQ ID NO: 751363 - RNA, 63 nt, Homo Sapiens
ucccagaaguuacagaugccuggcaagauaaaaacccugaaauguacuuuagugagagcugac

SEQ ID NO: 751364 - RNA, 63 nt, Homo Sapiens
gcaagcuaacgcuaacuuccuauguaaugcuucacccugaaaggaaaaagaacacuuuugaac

SEQ ID NO: 751365 - RNA, 63 nt, Homo Sapiens
agaaaacaauguuaaggauguauuuauuccccuacccugaagaaaguguaggauagaauuguu

SEQ ID NO: 751366 - RNA, 63 nt, Homo Sapiens
uaaccagucucaaacaugcuuaucccauuaucaacccugaaaguuugcuuguccuuuaagaua

SEQ ID NO: 751367 - RNA, 64 nt, Homo Sapiens; identical to SEQ ID NO: 56766

SEQ ID NO: 751368 - RNA, 64 nt, Homo Sapiens; identical to SEQ ID NO: 56767

SEQ ID NO: 751369 - RNA, 64 nt, Homo Sapiens; identical to SEQ ID NO: 56768

SEQ ID NO: 751370 - RNA, 64 nt, Homo Sapiens; identical to SEQ ID NO: 56769

SEQ ID NO: 751371 - RNA, 64 nt, Homo Sapiens; identical to SEQ ID NO: 56770

SEQ ID NO: 751372 - RNA, 64 nt, Homo Sapiens; identical to SEQ ID NO: 56771

SEQ ID NO: 751373 - RNA, 64 nt, Homo Sapiens; identical to SEQ ID NO: 56772

SEQ ID NO: 751374 - RNA, 64 nt, Homo Sapiens; identical to SEQ ID NO: 56773

SEQ ID NO: 751375 - RNA, 64 nt, Homo Sapiens; identical to SEQ ID NO: 56774

SEQ ID NO: 751376 - RNA, 64 nt, Homo Sapiens; identical to SEQ ID NO: 56775

SEQ ID NO: 751377 - RNA, 64 nt, Homo Sapiens; identical to SEQ ID NO: 56776

SEQ ID NO: 751378 - RNA, 64 nt, Homo Sapiens; identical to SEQ ID NO: 56777

SEQ ID NO: 751379 - RNA, 64 nt, Homo Sapiens; identical to SEQ ID NO: 56778

SEQ ID NO: 751380 - RNA, 64 nt, Homo Sapiens; identical to SEQ ID NO: 56779

SEQ ID NO: 751381 - RNA, 64 nt, Homo Sapiens; identical to SEQ ID NO: 56780

SEQ ID NO: 751382 - RNA, 64 nt, Homo Sapiens; identical to SEQ ID NO: 56781

SEQ ID NO: 751383 - RNA, 64 nt, Homo Sapiens; identical to SEQ ID NO: 56782

SEQ ID NO: 751384 - RNA, 64 nt, Homo Sapiens; identical to SEQ ID NO: 56783

SEQ ID NO: 751385 - RNA, 64 nt, Homo Sapiens; identical to SEQ ID NO: 56784

SEQ ID NO: 751386 - RNA, 64 nt, Homo Sapiens; identical to SEQ ID NO: 56785

SEQ ID NO: 751387 - RNA, 64 nt, Homo Sapiens; identical to SEQ ID NO: 56786

SEQ ID NO: 751388 - RNA, 64 nt, Homo Sapiens; identical to SEQ ID NO: 56787

SEQ ID NO: 751389 - RNA, 64 nt, Homo Sapiens; identical to SEQ ID NO: 56788

SEQ ID NO: 751390 - RNA, 64 nt, Homo Sapiens; identical to SEQ ID NO: 56789

SEQ ID NO: 751391 - RNA, 64 nt, Homo Sapiens; identical to SEQ ID NO: 56790

SEQ ID NO: 751392 - RNA, 64 nt, Homo Sapiens; identical to SEQ ID NO: 56791

SEQ ID NO: 751393 - RNA, 64 nt, Homo Sapiens; identical to SEQ ID NO: 56792

SEQ ID NO: 751394 - RNA, 64 nt, Homo Sapiens; identical to SEQ ID NO: 56793

SEQ ID NO: 751395 - RNA, 64 nt, Homo Sapiens; identical to SEQ ID NO: 56794

SEQ ID NO: 751396 - RNA, 64 nt, Homo Sapiens; identical to SEQ ID NO: 56795

SEQ ID NO: 751397 - RNA, 64 nt, Homo Sapiens; identical to SEQ ID NO: 56796

SEQ ID NO: 751398 - RNA, 64 nt, Homo Sapiens; identical to SEQ ID NO: 56797

SEQ ID NO: 751399 - RNA, 64 nt, Homo Sapiens; identical to SEQ ID NO: 56798

SEQ ID NO: 751400 - RNA, 64 nt, Homo Sapiens; identical to SEQ ID NO: 56799

SEQ ID NO: 751401 - RNA, 64 nt, Homo Sapiens; identical to SEQ ID NO: 56800

SEQ ID NO: 751402 - RNA, 64 nt, Homo Sapiens; identical to SEQ ID NO: 56801

SEQ ID NO: 751403 - RNA, 64 nt, Homo Sapiens; identical to SEQ ID NO: 56802

SEQ ID NO: 751404 - RNA, 64 nt, Homo Sapiens; identical to SEQ ID NO: 56803

SEQ ID NO: 751405 - RNA, 64 nt, Homo Sapiens; identical to SEQ ID NO: 56804

SEQ ID NO: 751406 - RNA, 64 nt, Homo Sapiens; identical to SEQ ID NO: 56805

SEQ ID NO: 751407 - RNA, 64 nt, Homo Sapiens; identical to SEQ ID NO: 56806

SEQ ID NO: 751408 - RNA, 64 nt, Homo Sapiens; identical to SEQ ID NO: 56807

SEQ ID NO: 751409 - RNA, 64 nt, Homo Sapiens; identical to SEQ ID NO: 56808

SEQ ID NO: 751410 - RNA, 64 nt, Homo Sapiens; identical to SEQ ID NO: 56809

SEQ ID NO: 751411 - RNA, 64 nt, Homo Sapiens; identical to SEQ ID NO: 56810

SEQ ID NO: 751412 - RNA, 64 nt, Homo Sapiens; identical to SEQ ID NO: 56811

SEQ ID NO: 751413 - RNA, 63 nt, Homo Sapiens; identical to SEQ ID NO: 56812

SEQ ID NO: 751414 - RNA, 64 nt, Homo Sapiens; identical to SEQ ID NO: 56813

SEQ ID NO: 751415 - RNA, 64 nt, Homo Sapiens; identical to SEQ ID NO: 56814

SEQ ID NO: 751416 - RNA, 64 nt, Homo Sapiens; identical to SEQ ID NO: 56815

SEQ ID NO: 751417 - RNA, 64 nt, Homo Sapiens; identical to SEQ ID NO: 56816

SEQ ID NO: 751418 - RNA, 64 nt, Homo Sapiens; identical to SEQ ID NO: 56817

SEQ ID NO: 751419 - RNA, 64 nt, Homo Sapiens; identical to SEQ ID NO: 56818

SEQ ID NO: 751420 - RNA, 64 nt, Homo Sapiens; identical to SEQ ID NO: 56819

SEQ ID NO: 751421 - RNA, 64 nt, Homo Sapiens; identical to SEQ ID NO: 56820

SEQ ID NO: 751422 - RNA, 64 nt, Homo Sapiens; identical to SEQ ID NO: 56821

SEQ ID NO: 751423 - RNA, 64 nt, Homo Sapiens; identical to SEQ ID NO: 56822

SEQ ID NO: 751424 - RNA, 64 nt, Homo Sapiens; identical to SEQ ID NO: 56823

SEQ ID NO: 751425 - RNA, 64 nt, Homo Sapiens; identical to SEQ ID NO: 56824

SEQ ID NO: 751426 - RNA, 64 nt, Homo Sapiens; identical to SEQ ID NO: 56825

SEQ ID NO: 751427 - RNA, 64 nt, Homo Sapiens; identical to SEQ ID NO: 56826

SEQ ID NO: 751428 - RNA, 64 nt, Homo Sapiens; identical to SEQ ID NO: 56827

SEQ ID NO: 751429 - RNA, 64 nt, Homo Sapiens; identical to SEQ ID NO: 56828

SEQ ID NO: 751430 - RNA, 64 nt, Homo Sapiens; identical to SEQ ID NO: 56829

SEQ ID NO: 751431 - RNA, 64 nt, Homo Sapiens; identical to SEQ ID NO: 56830

SEQ ID NO: 751432 - RNA, 64 nt, Homo Sapiens; identical to SEQ ID NO: 56831

SEQ ID NO: 751433 - RNA, 64 nt, Homo Sapiens; identical to SEQ ID NO: 56832

SEQ ID NO: 751434 - RNA, 64 nt, Homo Sapiens; identical to SEQ ID NO: 56833

SEQ ID NO: 751435 - RNA, 64 nt, Homo Sapiens; identical to SEQ ID NO: 56834

SEQ ID NO: 751436 - RNA, 64 nt, Homo Sapiens
gaagggcgaguaggggcaccuggacgcugaugguggccaggaugcucagcuggccaggagggca

SEQ ID NO: 751437 - RNA, 64 nt, Homo Sapiens
accuggacgcugaugguggccaggaugcucagcuggccaggagggcagcaccugcuggggacgg

SEQ ID NO: 751438 - RNA, 64 nt, Homo Sapiens
guuuguuuuggaaauaacagaaaagauauuuauuggccaggaaguuggugcugcuaagaccgag

SEQ ID NO: 751439 - RNA, 64 nt, Homo Sapiens
ugcccugaagaccaccccagucuaccucggugcuggccaggaaaccuuucggcuaccucuccca

SEQ ID NO: 751440 - RNA, 64 nt, Homo Sapiens
ugccugcaucugccacuuucugcuacccuagggaggccaggaggagcuucggaggaccaucgcc

SEQ ID NO: 751441 - RNA, 64 nt, Homo Sapiens
aguuuagagauuugcggcaauggaccgaagaacgggccaggaaguccuccaauuuccuuugguc

SEQ ID NO: 751442 - RNA, 64 nt, Homo Sapiens
uccuucaaagaaaacgacuuacuuucucgacuuuggccaggauuuugaccucauaauggugccc

SEQ ID NO: 751443 - RNA, 64 nt, Homo Sapiens
gaaaaaaaaaugcccaccugugaagaagcuucugggccaggaaguaucccucuaaggcgcaagg

SEQ ID NO: 751444 - RNA, 64 nt, Homo Sapiens
cacuuuggguggcugaggcagguggauuacuugaggccaggagauugagaccaguguggccaac

SEQ ID NO: 751445 - RNA, 64 nt, Homo Sapiens
aaucacuugaaccuacgaggcggagguugcagugggccaggaucgugccacugcacuuuauuua

SEQ ID NO: 751446 - RNA, 64 nt, Homo Sapiens
ucgagaccagccuggccaacggcagaucacuugaggccaggagucauuuugggaggcugaggug

SEQ ID NO: 751447 - RNA, 64 nt, Homo Sapiens
agguuagacgcaaugugaaaacccaagauuaagaggccaggaagaaagcaaauaagauuuaaca

SEQ ID NO: 751448 - RNA, 64 nt, Homo Sapiens
cugaggagcucugaacccaggaucccaccugggaggccaggacacagcugcacccacccugcuu

SEQ ID NO: 751449 - RNA, 64 nt, Homo Sapiens
gggaggagagugagggccaacggguccagaugagggccaggaagccacaaggcagcagaaagcg

SEQ ID NO: 751450 - RNA, 64 nt, Homo Sapiens
aggucgugggcccagcucugacaggauguggaguggccaggaccaagacagcaagcuacgcaau

SEQ ID NO: 751451 - RNA, 64 nt, Homo Sapiens
gcagccacccggccgccaaggcaggcuugggcugggccaggacacguggggugccugggacgcu

SEQ ID NO: 751452 - RNA, 64 nt, Homo Sapiens
uggagguuaaaagagccuuuuggacagaaaacugggccaggaaaaggcaucucagaccacaaau

SEQ ID NO: 751453 - RNA, 64 nt, Homo Sapiens
uguauuuuuaguagagacgggguuucacuguguuggccaggauggucucaaucucgaccucgug

SEQ ID NO: 751454 - RNA, 64 nt, Homo Sapiens
uacugaaaugagccucguggggagcaucagagaaggccaggaagaaugguguguuucccuagac

SEQ ID NO: 751455 - RNA, 64 nt, Homo Sapiens
auagcugggcuuacaggcaugagccaccacaccuggccaggauuugguuguuuaaauauaaauc

SEQ ID NO: 751456 - RNA, 64 nt, Homo Sapiens
gucucaaucucgaccucguggguuucaccguguuggccaggauguguauuuuugguagagacgg

SEQ ID NO: 751457 - RNA, 64 nt, Homo Sapiens
aggcaucucagaccacaaauuggacagaaaacugggccaggaaauggagguuaaaagagccuuu

SEQ ID NO: 751458 - RNA, 64 nt, Homo Sapiens
ucgagaccacccugggcaacggaggaucgcuugaggccaggagucacuuugggaggucgaggug

SEQ ID NO: 751459 - RNA, 64 nt, Homo Sapiens
cccuggaacugaggccacgagagcacuuggcccuggccaggaaccgugcaggccucugcagaag

SEQ ID NO: 751460 - RNA, 64 nt, Homo Sapiens
gguagcucauacuuguaaccaaauggacaaaaguggccaggagcaaugcaaaagaauacauuag

SEQ ID NO: 751461 - RNA, 64 nt, Homo Sapiens
gcugagaguagcagaugcuuagagagcucacacuggccaggaauugagggaugcugaaucuccc

SEQ ID NO: 751462 - RNA, 64 nt, Homo Sapiens
aauaauuuaaaaugcacauuugaaaaaaagacuuggccaggagagcuaauauaaaaaugcuaag

SEQ ID NO: 751463 - RNA, 64 nt, Homo Sapiens
caggaguggggaagggaggggggaucaagggacaggccaggagcggugggccucagggaggaug

SEQ ID NO: 751464 - RNA, 64 nt, Homo Sapiens
agcaggcaaggagccuggguugagggcgccugagggccaggagccugggguccccucauccacu

SEQ ID NO: 751465 - RNA, 64 nt, Homo Sapiens
cccagccacagcaagcccugccucagaugagacgggccaggacguggugugacauccccaccag

SEQ ID NO: 751466 - RNA, 64 nt, Homo Sapiens
ccaggcccagcgauagaucaggaggcaucauugaggccaggagcucugcccgugaccuguaucc

SEQ ID NO: 751467 - RNA, 64 nt, Homo Sapiens
uacucuaucuuccauuccucgcccugcccccagaggccaggagcucugcccuugaccuguauuc

SEQ ID NO: 751468 - RNA, 64 nt, Homo Sapiens
agggucugcuccugcugaggaccagcuguggcugggccaggacagaggacucaacccugcuccu

SEQ ID NO: 751469 - RNA, 64 nt, Homo Sapiens
ucuacccuauggccacagcaggaggucagcccagggccaggagacacauggcuggacaaggcuu

SEQ ID NO: 751470 - RNA, 64 nt, Homo Sapiens
uccaggccgcaaugagauguggcauaguaccugaggccaggaggaaaauaaaaaaaauuagcua

SEQ ID NO: 751471 - RNA, 64 nt, Homo Sapiens
ucaagaccagccugggcaacggaggaucacuugaggccaggagucccuuuggaagguaaagacg

SEQ ID NO: 751472 - RNA, 64 nt, Homo Sapiens
gaggccuaccucucguuucugcccagcccucuguggccaggagcccuggcccgcaagagggaca

SEQ ID NO: 751473 - RNA, 64 nt, Homo Sapiens
ggaagucccgcgaaacccggugcaucuggcacguggccaggagccaugacaggggcgcuuggga

SEQ ID NO: 751474 - RNA, 64 nt, Homo Sapiens
caauacgaguccaggggugagacucuagcacaguggccaggaucgccaccuggucccuugugcu

SEQ ID NO: 751475 - RNA, 64 nt, Homo Sapiens
uuccuacauagucagaacuuuucuuaguuccacuggccaggauucccuugcccaaacaagaaua

SEQ ID NO: 751476 - RNA, 64 nt, Homo Sapiens
cuaggacugaaugacucgaugggagagaaaagguggccaggaucacuuccucuuugagagucug

SEQ ID NO: 751477 - RNA, 63 nt, Homo Sapiens
acguggccugagagcugggcccuugggcaguggggccaggaacgcccaggcuccaggaaguga

SEQ ID NO: 751478 - RNA, 64 nt, Homo Sapiens
ugcagaaggacuucuuccuguacaacgccuccaaggccaggagcaaaaccuacaucaacaugcg

SEQ ID NO: 751479 - RNA, 64 nt, Homo Sapiens
gagcccuccaucaccuucacgcugucccaccaugggccaggaaccaaaccagcacuggguucua

SEQ ID NO: 751480 - RNA, 64 nt, Homo Sapiens
ggaccuggugugucaccugccuggguggggcagaggccaggagggguagccgugcaggagaggg

SEQ ID NO: 751481 - RNA, 64 nt, Homo Sapiens
cgggccccugcccuccucuguuagaguguuucugggccaggaucucucaggaucggauucuguu

SEQ ID NO: 751482 - RNA, 64 nt, Homo Sapiens
uccacacagcauggggcuucagcugcuggcccaaggccaggagcgcuggguucugcagcagggc

SEQ ID NO: 751483 - RNA, 64 nt, Homo Sapiens
ugcuccgggggguggaggugcuccccacaguccgggccaggacagccucaggggagagugaagg

SEQ ID NO: 751484 - RNA, 55 nt, Homo Sapiens
ugcucauagagaacaagugagcuggggccaggaggcagcagccgugcagagccug

SEQ ID NO: 751485 - RNA, 64 nt, Homo Sapiens
ucccggcagugcugacccugcagggcaagucaggggccaggaugcccucggaucagggccggga

SEQ ID NO: 751486 - RNA, 64 nt, Homo Sapiens
cggcgguggcucacaccugcauaggcagugcuuuggccaggaggaucccuugaucccuuguggc

SEQ ID NO: 751487 - RNA, 64 nt, Homo Sapiens
gugcuuuggccaggaggaucccuugaucccuuguggccaggaguugggagaccagccuggggac

SEQ ID NO: 751488 - RNA, 64 nt, Homo Sapiens
gggugugacaccugcuugacagaggcagggcuguggccaggaccaaccuucaauuccauuccaa

SEQ ID NO: 751489 - RNA, 64 nt, Homo Sapiens
agcacugggauuacaggcaugagccaccaugccuggccaggacauauuugaaauggggagauuu

SEQ ID NO: 751490 - RNA, 64 nt, Homo Sapiens
ccucuccuccugauucccuugugcccucuucccuggccaggacaguugugugggcugggcucug

SEQ ID NO: 751491 - RNA, 64 nt, Homo Sapiens
uaccccaggagugggccagggagggagcagcaggggccaggagccuccugcccaucccucucuu

SEQ ID NO: 751492 - RNA, 64 nt, Homo Sapiens
auccuccuaccccucauaccgugaguuuagggagggccaggaccaucauggcuuuuggagggag

SEQ ID NO: 751493 - RNA, 64 nt, Homo Sapiens
gaagaacuccauaugggaugagaccagauuugggggccaggaggcauauggccuauucugggcu

SEQ ID NO: 751494 - RNA, 64 nt, Homo Sapiens
gaaaggcuggcaagugggagggagucaguggggaggccaggauagaacuagagcugguguccca

SEQ ID NO: 751495 - RNA, 64 nt, Homo Sapiens
aagcagagggugagcaggggcugccccuccaccuggccaggacccccuucggcacccaguugcc

SEQ ID NO: 751496 - RNA, 64 nt, Homo Sapiens
uaguccuggaaauguuugaggcuagacggggaggggccaggacccacccacugcuccuggggga

SEQ ID NO: 751497 - RNA, 64 nt, Homo Sapiens
ugggcugaguucacccccagggcuggccagauggggccaggagggacagagcaaggggggugaa

SEQ ID NO: 751498 - RNA, 64 nt, Homo Sapiens
auugucuuccaagauaggaagccaaguggguccaggccaggagauggggggggcgggggcagcu

SEQ ID NO: 751499 - RNA, 64 nt, Homo Sapiens
ccccugaaacacugacucaggagguuugguugggggccaggagucuguuccuaaauauuccagg

SEQ ID NO: 751500 - RNA, 64 nt, Homo Sapiens
cacuuuggaaggccgaggugggcagaucaucugaggccaggaguucaagaccagccuggcuaac

SEQ ID NO: 751501 - RNA, 64 nt, Homo Sapiens
ucuguggggcagcggcgggcgcaggcucgacccgggccaggaggcccggggcgcugagcucagg

SEQ ID NO: 751502 - RNA, 64 nt, Homo Sapiens
ggaaggugcuuuuggccccauugcgaggggccuuggccaggacuggcccuguggccaggaggcg

SEQ ID NO: 751503 - RNA, 64 nt, Homo Sapiens
cauugcgaggggccuuggccaggacuggcccuguggccaggaggcgagaagguggcuguucccg

SEQ ID NO: 751504 - RNA, 64 nt, Homo Sapiens
cacuuuggaaggcugaggaaggaggaucgcuugaggccaggaguuugagacuagccuaggcaac

SEQ ID NO: 751505 - RNA, 64 nt, Homo Sapiens
cuacuucagaggcugagguggaaggaucacuugaggccaggaguuugaggcugcagugaguuau

SEQ ID NO: 751506 - RNA, 64 nt, Homo Sapiens
aagcugugaagaagaaaaaaaccccuggccuuugggccaggaggaaucuguuacucgaauccac

SEQ ID NO: 751507 - RNA, 64 nt, Homo Sapiens
gguuuugaagagucccuuaauaugugguggaacaggccaggaguuagagaaagggcuggcuucu

SEQ ID NO: 751508 - RNA, 64 nt, Homo Sapiens
cagggcagccaccaggagagauaugccuggcaggggccaggacaaaaugcaaacuuuuuuuuuu

SEQ ID NO: 751509 - RNA, 64 nt, Homo Sapiens
uguauuuuuaauagagaugggguuucaccauguuggccaggauggucucgaucuccugaccucu

SEQ ID NO: 751510 - RNA, 64 nt, Homo Sapiens
uagagaggaggcuugaaggaaccagcaaugagaaggccaggaaaagaaagagcugaaaauggag

SEQ ID NO: 751511 - RNA, 64 nt, Homo Sapiens
acccaccccacgacccgugacuacugugcaagcuggccaggagguagguggagggcaaggccac

SEQ ID NO: 751512 - RNA, 64 nt, Homo Sapiens
ucccaggcaggggugaggguggccuggcccaggaggccaggaaggagggcccugucugccucca

SEQ ID NO: 751513 - RNA, 64 nt, Homo Sapiens
aggucuucugcccuuucuaucaggugcagaagagggccaggacuaugccaaagccccauggauu

SEQ ID NO: 751514 - RNA, 64 nt, Homo Sapiens
ggcgucuccuagguugugccauuucggcugcuggggccaggacaucagcggggaaguucaccag

SEQ ID NO: 751515 - RNA, 64 nt, Homo Sapiens
agaaagagcugaaaauggagaccagcaaugagaaggccaggaaauagagggggagcuugcagga

SEQ ID NO: 751516 - RNA, 64 nt, Homo Sapiens
aaaugcagacuuuuuuuuuuaaaugccgggcacaggccaggacacagugcagccaccagggcag

SEQ ID NO: 751517 - RNA, 64 nt, Homo Sapiens
uuuucaugacaggucuauauuucuaccugggccaggccaggaaagagacuauuuaagaaaaaaa

SEQ ID NO: 751518 - RNA, 64 nt, Homo Sapiens
aguaacuugccaccuuaaggcagggucauccccgggccaggaggaugagguuguccugaggggc

SEQ ID NO: 751519 - RNA, 64 nt, Homo Sapiens
ggcuaaucccugcauuuccauucagggaaaaggugguagugagcauagaacugcaacaguuaua

SEQ ID NO: 751520 - RNA, 64 nt, Homo Sapiens
ucugccucagaaaaaaaaaaaaauaauaaugcuggguagugaccuugugauuguuacagcuccc

SEQ ID NO: 751521 - RNA, 64 nt, Homo Sapiens
augcuguuucuaugucguggaagcacuggauggggguagugagcaaaucugcccugcucagcag

SEQ ID NO: 751522 - RNA, 64 nt, Homo Sapiens
ccacaagcacuuuuuuuuuuuuuaaagaaaaaaagguagugaauuuuuaaucaucuggacuuua

SEQ ID NO: 751523 - RNA, 64 nt, Homo Sapiens
ccagucagaauaaugucaaagugcuuacagugcagguagugauaugugcaucuacugcagugaa

SEQ ID NO: 751524 - RNA, 64 nt, Homo Sapiens
auucugcugugcaaauccaugcaaaacugacugugguagugaaaagucuguagaaaaguaaggg

SEQ ID NO: 751525 - RNA, 64 nt, Homo Sapiens
aaguuaauaaauguguauguuuuguuguggguuugguagugaucugugguucuauaggguuuaa

SEQ ID NO: 751526 - RNA, 64 nt, Homo Sapiens
aaugaaugcauuggcccugacaaaaaggugcuacgguagugaugaaauuauaaguagauuugua

SEQ ID NO: 751527 - RNA, 64 nt, Homo Sapiens
auucauagaagggcuagaauaggagaaaaugaaagguagugaguaauucuuugauaagaugagg

SEQ ID NO: 751528 - RNA, 64 nt, Homo Sapiens
ucaugacccuuucuggcagccucuuggugcucuggguagugagggaugaccagucuuguccuga

SEQ ID NO: 751529 - RNA, 64 nt, Homo Sapiens
guauuugcuaaacacuaacuuaagcuaaugcuaggguagugacugagauguaaaaauagauuuu

SEQ ID NO: 751530 - RNA, 64 nt, Homo Sapiens; identical to SEQ ID NO: 151176

SEQ ID NO: 751531 - RNA, 64 nt, Homo Sapiens; identical to SEQ ID NO: 151177

SEQ ID NO: 751532 - RNA, 64 nt, Homo Sapiens; identical to SEQ ID NO: 151178

SEQ ID NO: 751533 - RNA, 64 nt, Homo Sapiens; identical to SEQ ID NO: 151179

SEQ ID NO: 751534 - RNA, 64 nt, Homo Sapiens; identical to SEQ ID NO: 151180

SEQ ID NO: 751535 - RNA, 64 nt, Homo Sapiens; identical to SEQ ID NO: 151181

SEQ ID NO: 751536 - RNA, 64 nt, Homo Sapiens; identical to SEQ ID NO: 151182

SEQ ID NO: 751537 - RNA, 64 nt, Homo Sapiens; identical to SEQ ID NO: 151183

SEQ ID NO: 751538 - RNA, 64 nt, Homo Sapiens; identical to SEQ ID NO: 151184

SEQ ID NO: 751539 - RNA, 64 nt, Homo Sapiens; identical to SEQ ID NO: 151185

SEQ ID NO: 751540 - RNA, 64 nt, Homo Sapiens; identical to SEQ ID NO: 151186

SEQ ID NO: 751541 - RNA, 64 nt, Homo Sapiens; identical to SEQ ID NO: 151187

SEQ ID NO: 751542 - RNA, 64 nt, Homo Sapiens
agucauuauuuuuccuauucuuauugcugcaugauguaagcaaaucugaauaacaaaugaaugc

SEQ ID NO: 751543 - RNA, 64 nt, Homo Sapiens
caacuguaaaugucuauuuuaaguuaaacuauguuguaagcagcagagugauucucaccaaaaa

SEQ ID NO: 751544 - RNA, 64 nt, Homo Sapiens
ugagacuuugaucaccugaacuuucucuagcaaguguaagcagaauggagugugguuccaagag

SEQ ID NO: 751545 - RNA, 64 nt, Homo Sapiens
ucuuuugugcucuuuuauaacuugcauuacauguuguaagcaugguccguucuauaccuuuuuc

SEQ ID NO: 751546 - RNA, 64 nt, Homo Sapiens
gucaugaucacagaaugcaaaaaggcuuugugauuguaagcacuguuaucuuagaaagaccccc

SEQ ID NO: 751547 - RNA, 64 nt, Homo Sapiens
ugaagaaaaaaauauagauuaaacuggauuucaauguaagcaaaaaaaggauuuuuuuuguuua

SEQ ID NO: 751548 - RNA, 64 nt, Homo Sapiens
gugcuguaggaagauggacuguguugaucauggguguaagcaacccaguuuaagaaacauggca

SEQ ID NO: 751549 - RNA, 64 nt, Homo Sapiens
auauagaguguuucuaggguaagggaccugcagguguaagcauagaugaaauaacuguccuguc

SEQ ID NO: 751550 - RNA, 64 nt, Homo Sapiens
ugaaaaaucuuacacuggagagaaacccuaugaguguaagcaaugugggaaagccuuuguuucc

SEQ ID NO: 751551 - RNA, 64 nt, Homo Sapiens
ugaaaggacucacacuggagagaaccccuaugaguguaagcaauuugggaaagccuucagaucu

SEQ ID NO: 751552 - RNA, 64 nt, Homo Sapiens
ugaaaggaugcacagaggagagaagcucugugaauguaagcauugugggaaagcauucauaucu

SEQ ID NO: 751553 - RNA, 64 nt, Homo Sapiens
caugaaagaacacacuagggagaaacccuaucaauguaagcaaugugcaaaagccuuuauuucu

SEQ ID NO: 751554 - RNA, 64 nt, Homo Sapiens
uggaaggacucacacuggagaaaaacccuaugaauguaagcaguaugggaaagcguucagaccu

SEQ ID NO: 751555 - RNA, 64 nt, Homo Sapiens
uaaaaggacucacaguggagaaaaacucuaugaguguaagcaaugugggaaagucuucagaucu

SEQ ID NO: 751556 - RNA, 64 nt, Homo Sapiens
augaaaguugcacagaggagaggcgcccuaagaauguaagcauugugggaaagcauucauaucu

SEQ ID NO: 751557 - RNA, 64 nt, Homo Sapiens
cauguaaagacacaccagaaggaaacccuaugaauguaagcaauguggcaaaagcuuucacuuc

SEQ ID NO: 751558 - RNA, 64 nt, Homo Sapiens
ugaaaggacucacacuggggagaaaccguaucaauguaagcaaugugggaaagccgucagauca

SEQ ID NO: 751559 - RNA, 64 nt, Homo Sapiens
uggaagcacucacacuuggcagaaacucuaugaauguaagcaguaugggaaagccuucagaucg

SEQ ID NO: 751560 - RNA, 64 nt, Homo Sapiens
ugaaaggacucacacuggagagaaacccuaugaguguaagcaaugugggaaagccuucagaugu

SEQ ID NO: 751561 - RNA, 64 nt, Homo Sapiens
ugaaaggacucacacuggagagaaacccuaugaguguaagcaaugugggaaagccuucagaucu

SEQ ID NO: 751562 - RNA, 64 nt, Homo Sapiens
ugcugggacucacccugaagagaagcccuacgaguguaagcaaugugggaaagccuucagaucu

SEQ ID NO: 751563 - RNA, 64 nt, Homo Sapiens
ugaaaaaucuuacacuggagagaaacccuaugaguguaagcaaugugggaaagccuuuauuucu

SEQ ID NO: 751564 - RNA, 64 nt, Homo Sapiens
ugaaaggacucacacuggagagaaacccuaugaguguaagcaauguggaaaaaccuucagaucu

SEQ ID NO: 751565 - RNA, 64 nt, Homo Sapiens
gugggaaagcauuugaucauagaaaccccaugaauguaagcaauugaaaccacucacagugcag

SEQ ID NO: 751566 - RNA, 64 nt, Homo Sapiens
guucuaaagccuucccugauagaaacuguaugaauguaagcaguugaaagaacacguacugggg

SEQ ID NO: 751567 - RNA, 64 nt, Homo Sapiens
guucuaaagccuuucauuuuagaaacuauaugaauguaagcaguugaaagaacucacucuggag

SEQ ID NO: 751568 - RNA, 64 nt, Homo Sapiens
gcugcgucagaccaguacugggaaggaggacgguuguaagcaguuguuauuuagugauauugug

SEQ ID NO: 751569 - RNA, 64 nt, Homo Sapiens
auggugagguguggauaaggcuuaggugccaggcuguaagcauucugagcugggcuuguuguuu

SEQ ID NO: 751570 - RNA, 64 nt, Homo Sapiens
aucgugucucaagguaguugcauaccuagucuggaguugugauuauuuucccaaaaaauguguu

SEQ ID NO: 751571 - RNA, 64 nt, Homo Sapiens
aauuagcaggcugauuucuuuuuccucuuccgcuaguugugaaagacaggggaaggguguucuu

SEQ ID NO: 751572 - RNA, 64 nt, Homo Sapiens
gugcauauauucauauuaaauucccauucauuugaguugugaccauuauuuuucauucacugaa

SEQ ID NO: 751573 - RNA, 64 nt, Homo Sapiens
cuucauuuacuaaaucagccaguuaaugugauucaguugugaccugugggauuuuaaaauuuuc

SEQ ID NO: 751574 - RNA, 64 nt, Homo Sapiens
agggcacaauagaaaccauggggcguggagcaugaguugugaauggcagggaucauucugggua

SEQ ID NO: 751575 - RNA, 64 nt, Homo Sapiens
gacaacuaauuccuguuccaauucuaccuguuuuaguugugaagguaguuuuguguaauccagu

SEQ ID NO: 751576 - RNA, 64 nt, Homo Sapiens
aacaugggagaggagugacuaucccuuccuuccuaguugugauaauacuuuuauuucuuccccu

SEQ ID NO: 751577 - RNA, 64 nt, Homo Sapiens
cucuuaccaagugcuuuccugugggaaagcuggaaguugugacugagaagaggacagaggaugu

SEQ ID NO: 751578 - RNA, 64 nt, Homo Sapiens
agagaaaguacguccauuucauuauggauuuuggaguugugagugauaggaucccaaaauucau

SEQ ID NO: 751579 - RNA, 64 nt, Homo Sapiens
auauuuuaagaaguugaaagagaauuuauuuucaaguugugaguaaauccuccuuugaaauuca

SEQ ID NO: 751580 - RNA, 64 nt, Homo Sapiens
uacaauuaauugcauacaguuuuuguaagaugcuaguugugaaaaggcacagugguacugucuu

SEQ ID NO: 751581 - RNA, 64 nt, Homo Sapiens
uuuggugguuucaugugguacuguagacccuaacaguugugauacauuugaagaaaaaauaaaa

SEQ ID NO: 751582 - RNA, 64 nt, Homo Sapiens
uguccucgguguuaccgagguucccugcuuguccaguugugagcuggcuucccugagcuggggu

SEQ ID NO: 751583 - RNA, 64 nt, Homo Sapiens
uuaguguuucugugcauggugaaguguuaauacuaguugugaccugaaacaauacucauaaugu

SEQ ID NO: 751584 - RNA, 64 nt, Homo Sapiens
cacuggggaggcaggcacacccuuuagagaugugaguugugaggauggugucccaccugagugg

SEQ ID NO: 751585 - RNA, 64 nt, Homo Sapiens
acucaaaauguccccagaggaguagcacccucuaaguugugagagucuccacccacaggacgcc

SEQ ID NO: 751586 - RNA, 64 nt, Homo Sapiens; identical to SEQ ID NO: 214333

SEQ ID NO: 751587 - RNA, 64 nt, Homo Sapiens; identical to SEQ ID NO: 214334

SEQ ID NO: 751588 - RNA, 64 nt, Homo Sapiens; identical to SEQ ID NO: 172152

SEQ ID NO: 751589 - RNA, 64 nt, Homo Sapiens; identical to SEQ ID NO: 172153

SEQ ID NO: 751590 - RNA, 64 nt, Homo Sapiens; identical to SEQ ID NO: 172154

SEQ ID NO: 751591 - RNA, 64 nt, Homo Sapiens; identical to SEQ ID NO: 172155

SEQ ID NO: 751592 - RNA, 64 nt, Homo Sapiens; identical to SEQ ID NO: 172156

SEQ ID NO: 751593 - RNA, 64 nt, Homo Sapiens; identical to SEQ ID NO: 172157

SEQ ID NO: 751594 - RNA, 64 nt, Homo Sapiens; identical to SEQ ID NO: 172158

SEQ ID NO: 751595 - RNA, 64 nt, Homo Sapiens; identical to SEQ ID NO: 172159

SEQ ID NO: 751596 - RNA, 64 nt, Homo Sapiens; identical to SEQ ID NO: 172160

SEQ ID NO: 751597 - RNA, 64 nt, Homo Sapiens; identical to SEQ ID NO: 172161

SEQ ID NO: 751598 - RNA, 64 nt, Homo Sapiens; identical to SEQ ID NO: 172162

SEQ ID NO: 751599 - RNA, 64 nt, Homo Sapiens; identical to SEQ ID NO: 172163

SEQ ID NO: 751600 - RNA, 64 nt, Homo Sapiens; identical to SEQ ID NO: 172164

SEQ ID NO: 751601 - RNA, 64 nt, Homo Sapiens; identical to SEQ ID NO: 172165

SEQ ID NO: 751602 - RNA, 64 nt, Homo Sapiens; identical to SEQ ID NO: 214349

SEQ ID NO: 751603 - RNA, 64 nt, Homo Sapiens; identical to SEQ ID NO: 214350

SEQ ID NO: 751604 - RNA, 64 nt, Homo Sapiens; identical to SEQ ID NO: 214351

SEQ ID NO: 751605 - RNA, 64 nt, Homo Sapiens; identical to SEQ ID NO: 214352

SEQ ID NO: 751606 - RNA, 64 nt, Homo Sapiens; identical to SEQ ID NO: 214353

SEQ ID NO: 751607 - RNA, 64 nt, Homo Sapiens; identical to SEQ ID NO: 214354

SEQ ID NO: 751608 - RNA, 64 nt, Homo Sapiens; identical to SEQ ID NO: 214355

SEQ ID NO: 751609 - RNA, 64 nt, Homo Sapiens; identical to SEQ ID NO: 214356

SEQ ID NO: 751610 - RNA, 64 nt, Homo Sapiens; identical to SEQ ID NO: 214357

SEQ ID NO: 751611 - RNA, 64 nt, Homo Sapiens; identical to SEQ ID NO: 214358

SEQ ID NO: 751612 - RNA, 50 nt, Homo Sapiens; identical to SEQ ID NO: 214359

SEQ ID NO: 751613 - RNA, 64 nt, Homo Sapiens; identical to SEQ ID NO: 214360

SEQ ID NO: 751614 - RNA, 64 nt, Homo Sapiens; identical to SEQ ID NO: 214361

SEQ ID NO: 751615 - RNA, 64 nt, Homo Sapiens; identical to SEQ ID NO: 214362

SEQ ID NO: 751616 - RNA, 64 nt, Homo Sapiens; identical to SEQ ID NO: 214363

SEQ ID NO: 751617 - RNA, 64 nt, Homo Sapiens; identical to SEQ ID NO: 214364

SEQ ID NO: 751618 - RNA, 64 nt, Homo Sapiens; identical to SEQ ID NO: 214365

SEQ ID NO: 751619 - RNA, 64 nt, Homo Sapiens; identical to SEQ ID NO: 214366

SEQ ID NO: 751620 - RNA, 64 nt, Homo Sapiens; identical to SEQ ID NO: 214367

SEQ ID NO: 751621 - RNA, 64 nt, Homo Sapiens; identical to SEQ ID NO: 214368

SEQ ID NO: 751622 - RNA, 64 nt, Homo Sapiens; identical to SEQ ID NO: 214369

SEQ ID NO: 751623 - RNA, 64 nt, Homo Sapiens; identical to SEQ ID NO: 214370

SEQ ID NO: 751624 - RNA, 64 nt, Homo Sapiens; identical to SEQ ID NO: 214371

SEQ ID NO: 751625 - RNA, 64 nt, Homo Sapiens; identical to SEQ ID NO: 214372

SEQ ID NO: 751626 - RNA, 64 nt, Homo Sapiens; identical to SEQ ID NO: 214373

SEQ ID NO: 751627 - RNA, 64 nt, Homo Sapiens; identical to SEQ ID NO: 214374

SEQ ID NO: 751628 - RNA, 64 nt, Homo Sapiens; identical to SEQ ID NO: 214375

SEQ ID NO: 751629 - RNA, 64 nt, Homo Sapiens; identical to SEQ ID NO: 214376

SEQ ID NO: 751630 - RNA, 64 nt, Homo Sapiens; identical to SEQ ID NO: 214377

SEQ ID NO: 751631 - RNA, 64 nt, Homo Sapiens; identical to SEQ ID NO: 214378

SEQ ID NO: 751632 - RNA, 64 nt, Homo Sapiens; identical to SEQ ID NO: 214379

SEQ ID NO: 751633 - RNA, 64 nt, Homo Sapiens; identical to SEQ ID NO: 214380

SEQ ID NO: 751634 - RNA, 64 nt, Homo Sapiens; identical to SEQ ID NO: 214381

SEQ ID NO: 751635 - RNA, 64 nt, Homo Sapiens; identical to SEQ ID NO: 214382

SEQ ID NO: 751636 - RNA, 64 nt, Homo Sapiens; identical to SEQ ID NO: 214383

SEQ ID NO: 751637 - RNA, 64 nt, Homo Sapiens; identical to SEQ ID NO: 214384

SEQ ID NO: 751638 - RNA, 64 nt, Homo Sapiens; identical to SEQ ID NO: 214385

SEQ ID NO: 751639 - RNA, 64 nt, Homo Sapiens; identical to SEQ ID NO: 214386

SEQ ID NO: 751640 - RNA, 64 nt, Homo Sapiens; identical to SEQ ID NO: 214387

SEQ ID NO: 751641 - RNA, 64 nt, Homo Sapiens; identical to SEQ ID NO: 214388

SEQ ID NO: 751642 - RNA, 64 nt, Homo Sapiens; identical to SEQ ID NO: 214389

SEQ ID NO: 751643 - RNA, 64 nt, Homo Sapiens; identical to SEQ ID NO: 214390

SEQ ID NO: 751644 - RNA, 64 nt, Homo Sapiens; identical to SEQ ID NO: 214391

SEQ ID NO: 751645 - RNA, 64 nt, Homo Sapiens; identical to SEQ ID NO: 214392

SEQ ID NO: 751646 - RNA, 64 nt, Homo Sapiens; identical to SEQ ID NO: 214393

SEQ ID NO: 751647 - RNA, 64 nt, Homo Sapiens; identical to SEQ ID NO: 214394

SEQ ID NO: 751648 - RNA, 64 nt, Homo Sapiens; identical to SEQ ID NO: 214395

SEQ ID NO: 751649 - RNA, 64 nt, Homo Sapiens; identical to SEQ ID NO: 214396

SEQ ID NO: 751650 - RNA, 64 nt, Homo Sapiens; identical to SEQ ID NO: 214397

SEQ ID NO: 751651 - RNA, 64 nt, Homo Sapiens; identical to SEQ ID NO: 214398

SEQ ID NO: 751652 - RNA, 64 nt, Homo Sapiens; identical to SEQ ID NO: 214399

SEQ ID NO: 751653 - RNA, 64 nt, Homo Sapiens; identical to SEQ ID NO: 214400

SEQ ID NO: 751654 - RNA, 64 nt, Homo Sapiens; identical to SEQ ID NO: 214401

SEQ ID NO: 751655 - RNA, 64 nt, Homo Sapiens; identical to SEQ ID NO: 214402

SEQ ID NO: 751656 - RNA, 64 nt, Homo Sapiens; identical to SEQ ID NO: 214403

SEQ ID NO: 751657 - RNA, 64 nt, Homo Sapiens; identical to SEQ ID NO: 214404

SEQ ID NO: 751658 - RNA, 64 nt, Homo Sapiens; identical to SEQ ID NO: 214405

SEQ ID NO: 751659 - RNA, 64 nt, Homo Sapiens; identical to SEQ ID NO: 214406

SEQ ID NO: 751660 - RNA, 64 nt, Homo Sapiens; identical to SEQ ID NO: 214407

SEQ ID NO: 751661 - RNA, 64 nt, Homo Sapiens; identical to SEQ ID NO: 214408

SEQ ID NO: 751662 - RNA, 64 nt, Homo Sapiens; identical to SEQ ID NO: 214409

SEQ ID NO: 751663 - RNA, 64 nt, Homo Sapiens; identical to SEQ ID NO: 214410

SEQ ID NO: 751664 - RNA, 64 nt, Homo Sapiens; identical to SEQ ID NO: 214411

SEQ ID NO: 751665 - RNA, 64 nt, Homo Sapiens; identical to SEQ ID NO: 214412

SEQ ID NO: 751666 - RNA, 64 nt, Homo Sapiens; identical to SEQ ID NO: 214413

SEQ ID NO: 751667 - RNA, 64 nt, Homo Sapiens; identical to SEQ ID NO: 214414

SEQ ID NO: 751668 - RNA, 64 nt, Homo Sapiens; identical to SEQ ID NO: 214415

SEQ ID NO: 751669 - RNA, 64 nt, Homo Sapiens; identical to SEQ ID NO: 214416

SEQ ID NO: 751670 - RNA, 64 nt, Homo Sapiens; identical to SEQ ID NO: 214417

SEQ ID NO: 751671 - RNA, 64 nt, Homo Sapiens; identical to SEQ ID NO: 214418

SEQ ID NO: 751672 - RNA, 64 nt, Homo Sapiens; identical to SEQ ID NO: 214419

SEQ ID NO: 751673 - RNA, 64 nt, Homo Sapiens; identical to SEQ ID NO: 214420

SEQ ID NO: 751674 - RNA, 64 nt, Homo Sapiens; identical to SEQ ID NO: 214421

SEQ ID NO: 751675 - RNA, 64 nt, Homo Sapiens; identical to SEQ ID NO: 214422

SEQ ID NO: 751676 - RNA, 64 nt, Homo Sapiens; identical to SEQ ID NO: 214423

SEQ ID NO: 751677 - RNA, 64 nt, Homo Sapiens; identical to SEQ ID NO: 214424

SEQ ID NO: 751678 - RNA, 64 nt, Homo Sapiens; identical to SEQ ID NO: 214425

SEQ ID NO: 751679 - RNA, 64 nt, Homo Sapiens; identical to SEQ ID NO: 214426

SEQ ID NO: 751680 - RNA, 64 nt, Homo Sapiens; identical to SEQ ID NO: 214427

SEQ ID NO: 751681 - RNA, 64 nt, Homo Sapiens; identical to SEQ ID NO: 214428

SEQ ID NO: 751682 - RNA, 64 nt, Homo Sapiens; identical to SEQ ID NO: 214429

SEQ ID NO: 751683 - RNA, 62 nt, Homo Sapiens; identical to SEQ ID NO: 214430

SEQ ID NO: 751684 - RNA, 64 nt, Homo Sapiens; identical to SEQ ID NO: 214431

SEQ ID NO: 751685 - RNA, 64 nt, Homo Sapiens; identical to SEQ ID NO: 214432

SEQ ID NO: 751686 - RNA, 64 nt, Homo Sapiens; identical to SEQ ID NO: 214433

SEQ ID NO: 751687 - RNA, 64 nt, Homo Sapiens; identical to SEQ ID NO: 214434

SEQ ID NO: 751688 - RNA, 64 nt, Homo Sapiens; identical to SEQ ID NO: 214435

SEQ ID NO: 751689 - RNA, 64 nt, Homo Sapiens; identical to SEQ ID NO: 214436

SEQ ID NO: 751690 - RNA, 53 nt, Homo Sapiens; identical to SEQ ID NO: 214437

SEQ ID NO: 751691 - RNA, 64 nt, Homo Sapiens; identical to SEQ ID NO: 214438

SEQ ID NO: 751692 - RNA, 64 nt, Homo Sapiens; identical to SEQ ID NO: 214439

SEQ ID NO: 751693 - RNA, 64 nt, Homo Sapiens; identical to SEQ ID NO: 214440

SEQ ID NO: 751694 - RNA, 64 nt, Homo Sapiens; identical to SEQ ID NO: 214441

SEQ ID NO: 751695 - RNA, 64 nt, Homo Sapiens; identical to SEQ ID NO: 214442

SEQ ID NO: 751696 - RNA, 64 nt, Homo Sapiens; identical to SEQ ID NO: 214443

SEQ ID NO: 751697 - RNA, 64 nt, Homo Sapiens; identical to SEQ ID NO: 214444

SEQ ID NO: 751698 - RNA, 64 nt, Homo Sapiens; identical to SEQ ID NO: 214445

SEQ ID NO: 751699 - RNA, 64 nt, Homo Sapiens; identical to SEQ ID NO: 214446

SEQ ID NO: 751700 - RNA, 64 nt, Homo Sapiens; identical to SEQ ID NO: 214447

SEQ ID NO: 751701 - RNA, 64 nt, Homo Sapiens; identical to SEQ ID NO: 214448

SEQ ID NO: 751702 - RNA, 64 nt, Homo Sapiens; identical to SEQ ID NO: 214449

SEQ ID NO: 751703 - RNA, 64 nt, Homo Sapiens; identical to SEQ ID NO: 214450

SEQ ID NO: 751704 - RNA, 64 nt, Homo Sapiens; identical to SEQ ID NO: 214451

SEQ ID NO: 751705 - RNA, 64 nt, Homo Sapiens; identical to SEQ ID NO: 214452

SEQ ID NO: 751706 - RNA, 64 nt, Homo Sapiens; identical to SEQ ID NO: 214453

SEQ ID NO: 751707 - RNA, 64 nt, Homo Sapiens; identical to SEQ ID NO: 214454

SEQ ID NO: 751708 - RNA, 64 nt, Homo Sapiens; identical to SEQ ID NO: 214455

SEQ ID NO: 751709 - RNA, 64 nt, Homo Sapiens; identical to SEQ ID NO: 214456

SEQ ID NO: 751710 - RNA, 64 nt, Homo Sapiens; identical to SEQ ID NO: 214457

SEQ ID NO: 751711 - RNA, 64 nt, Homo Sapiens; identical to SEQ ID NO: 214458

SEQ ID NO: 751712 - RNA, 64 nt, Homo Sapiens; identical to SEQ ID NO: 214459

SEQ ID NO: 751713 - RNA, 64 nt, Homo Sapiens; identical to SEQ ID NO: 214460

SEQ ID NO: 751714 - RNA, 63 nt, Homo Sapiens; identical to SEQ ID NO: 214461

SEQ ID NO: 751715 - RNA, 64 nt, Homo Sapiens; identical to SEQ ID NO: 214462

SEQ ID NO: 751716 - RNA, 64 nt, Homo Sapiens; identical to SEQ ID NO: 214463

SEQ ID NO: 751717 - RNA, 64 nt, Homo Sapiens; identical to SEQ ID NO: 214464

SEQ ID NO: 751718 - RNA, 64 nt, Homo Sapiens; identical to SEQ ID NO: 214465

SEQ ID NO: 751719 - RNA, 64 nt, Homo Sapiens; identical to SEQ ID NO: 214466

SEQ ID NO: 751720 - RNA, 64 nt, Homo Sapiens; identical to SEQ ID NO: 214467

SEQ ID NO: 751721 - RNA, 64 nt, Homo Sapiens; identical to SEQ ID NO: 214468

SEQ ID NO: 751722 - RNA, 64 nt, Homo Sapiens; identical to SEQ ID NO: 214469

SEQ ID NO: 751723 - RNA, 64 nt, Homo Sapiens; identical to SEQ ID NO: 214470

SEQ ID NO: 751724 - RNA, 64 nt, Homo Sapiens; identical to SEQ ID NO: 214471

SEQ ID NO: 751725 - RNA, 64 nt, Homo Sapiens; identical to SEQ ID NO: 214472

SEQ ID NO: 751726 - RNA, 64 nt, Homo Sapiens; identical to SEQ ID NO: 214473

SEQ ID NO: 751727 - RNA, 64 nt, Homo Sapiens; identical to SEQ ID NO: 214474

SEQ ID NO: 751728 - RNA, 64 nt, Homo Sapiens; identical to SEQ ID NO: 214475

SEQ ID NO: 751729 - RNA, 64 nt, Homo Sapiens; identical to SEQ ID NO: 214476

SEQ ID NO: 751730 - RNA, 64 nt, Homo Sapiens; identical to SEQ ID NO: 214477

SEQ ID NO: 751731 - RNA, 64 nt, Homo Sapiens; identical to SEQ ID NO: 214478

SEQ ID NO: 751732 - RNA, 64 nt, Homo Sapiens; identical to SEQ ID NO: 214479

SEQ ID NO: 751733 - RNA, 64 nt, Homo Sapiens; identical to SEQ ID NO: 214480

SEQ ID NO: 751734 - RNA, 64 nt, Homo Sapiens; identical to SEQ ID NO: 214481

SEQ ID NO: 751735 - RNA, 64 nt, Homo Sapiens; identical to SEQ ID NO: 214482

SEQ ID NO: 751736 - RNA, 64 nt, Homo Sapiens; identical to SEQ ID NO: 214483

SEQ ID NO: 751737 - RNA, 64 nt, Homo Sapiens; identical to SEQ ID NO: 214484

SEQ ID NO: 751738 - RNA, 64 nt, Homo Sapiens; identical to SEQ ID NO: 214485

SEQ ID NO: 751739 - RNA, 64 nt, Homo Sapiens; identical to SEQ ID NO: 214486

SEQ ID NO: 751740 - RNA, 64 nt, Homo Sapiens; identical to SEQ ID NO: 214487

SEQ ID NO: 751741 - RNA, 64 nt, Homo Sapiens; identical to SEQ ID NO: 214488

SEQ ID NO: 751742 - RNA, 64 nt, Homo Sapiens; identical to SEQ ID NO: 214489

SEQ ID NO: 751743 - RNA, 64 nt, Homo Sapiens; identical to SEQ ID NO: 214490

SEQ ID NO: 751744 - RNA, 64 nt, Homo Sapiens; identical to SEQ ID NO: 214491

SEQ ID NO: 751745 - RNA, 64 nt, Homo Sapiens; identical to SEQ ID NO: 214492

SEQ ID NO: 751746 - RNA, 64 nt, Homo Sapiens; identical to SEQ ID NO: 214493

SEQ ID NO: 751747 - RNA, 64 nt, Homo Sapiens; identical to SEQ ID NO: 214494

SEQ ID NO: 751748 - RNA, 64 nt, Homo Sapiens; identical to SEQ ID NO: 214495

SEQ ID NO: 751749 - RNA, 64 nt, Homo Sapiens; identical to SEQ ID NO: 214496

SEQ ID NO: 751750 - RNA, 64 nt, Homo Sapiens; identical to SEQ ID NO: 214497

SEQ ID NO: 751751 - RNA, 64 nt, Homo Sapiens; identical to SEQ ID NO: 214498

SEQ ID NO: 751752 - RNA, 64 nt, Homo Sapiens; identical to SEQ ID NO: 214499

SEQ ID NO: 751753 - RNA, 64 nt, Homo Sapiens; identical to SEQ ID NO: 214500

SEQ ID NO: 751754 - RNA, 64 nt, Homo Sapiens; identical to SEQ ID NO: 214501

SEQ ID NO: 751755 - RNA, 64 nt, Homo Sapiens; identical to SEQ ID NO: 214502

SEQ ID NO: 751756 - RNA, 64 nt, Homo Sapiens; identical to SEQ ID NO: 214503

SEQ ID NO: 751757 - RNA, 64 nt, Homo Sapiens; identical to SEQ ID NO: 214504

SEQ ID NO: 751758 - RNA, 64 nt, Homo Sapiens; identical to SEQ ID NO: 214505

SEQ ID NO: 751759 - RNA, 64 nt, Homo Sapiens; identical to SEQ ID NO: 214506

SEQ ID NO: 751760 - RNA, 64 nt, Homo Sapiens; identical to SEQ ID NO: 214507

SEQ ID NO: 751761 - RNA, 64 nt, Homo Sapiens; identical to SEQ ID NO: 214508

SEQ ID NO: 751762 - RNA, 64 nt, Homo Sapiens; identical to SEQ ID NO: 214509

SEQ ID NO: 751763 - RNA, 64 nt, Homo Sapiens; identical to SEQ ID NO: 214510

SEQ ID NO: 751764 - RNA, 64 nt, Homo Sapiens; identical to SEQ ID NO: 214511

SEQ ID NO: 751765 - RNA, 64 nt, Homo Sapiens; identical to SEQ ID NO: 214512

SEQ ID NO: 751766 - RNA, 64 nt, Homo Sapiens; identical to SEQ ID NO: 214513

SEQ ID NO: 751767 - RNA, 64 nt, Homo Sapiens; identical to SEQ ID NO: 214514

SEQ ID NO: 751768 - RNA, 64 nt, Homo Sapiens; identical to SEQ ID NO: 214515

SEQ ID NO: 751769 - RNA, 64 nt, Homo Sapiens; identical to SEQ ID NO: 214516

SEQ ID NO: 751770 - RNA, 64 nt, Homo Sapiens; identical to SEQ ID NO: 214517

SEQ ID NO: 751771 - RNA, 64 nt, Homo Sapiens; identical to SEQ ID NO: 214518

SEQ ID NO: 751772 - RNA, 64 nt, Homo Sapiens; identical to SEQ ID NO: 214519

SEQ ID NO: 751773 - RNA, 64 nt, Homo Sapiens; identical to SEQ ID NO: 214520

SEQ ID NO: 751774 - RNA, 64 nt, Homo Sapiens; identical to SEQ ID NO: 214521

SEQ ID NO: 751775 - RNA, 64 nt, Homo Sapiens; identical to SEQ ID NO: 214522

SEQ ID NO: 751776 - RNA, 64 nt, Homo Sapiens; identical to SEQ ID NO: 214523

SEQ ID NO: 751777 - RNA, 64 nt, Homo Sapiens; identical to SEQ ID NO: 214524

SEQ ID NO: 751778 - RNA, 64 nt, Homo Sapiens; identical to SEQ ID NO: 214525

SEQ ID NO: 751779 - RNA, 64 nt, Homo Sapiens; identical to SEQ ID NO: 214526

SEQ ID NO: 751780 - RNA, 64 nt, Homo Sapiens; identical to SEQ ID NO: 214527

SEQ ID NO: 751781 - RNA, 64 nt, Homo Sapiens; identical to SEQ ID NO: 214528

SEQ ID NO: 751782 - RNA, 64 nt, Homo Sapiens; identical to SEQ ID NO: 214529

SEQ ID NO: 751783 - RNA, 64 nt, Homo Sapiens; identical to SEQ ID NO: 214530

SEQ ID NO: 751784 - RNA, 64 nt, Homo Sapiens; identical to SEQ ID NO: 214531

SEQ ID NO: 751785 - RNA, 64 nt, Homo Sapiens; identical to SEQ ID NO: 214532

SEQ ID NO: 751786 - RNA, 64 nt, Homo Sapiens; identical to SEQ ID NO: 214533

SEQ ID NO: 751787 - RNA, 64 nt, Homo Sapiens; identical to SEQ ID NO: 214534

SEQ ID NO: 751788 - RNA, 64 nt, Homo Sapiens; identical to SEQ ID NO: 214535

SEQ ID NO: 751789 - RNA, 64 nt, Homo Sapiens; identical to SEQ ID NO: 214536

SEQ ID NO: 751790 - RNA, 64 nt, Homo Sapiens; identical to SEQ ID NO: 214537

SEQ ID NO: 751791 - RNA, 64 nt, Homo Sapiens; identical to SEQ ID NO: 214538

SEQ ID NO: 751792 - RNA, 64 nt, Homo Sapiens; identical to SEQ ID NO: 214539

SEQ ID NO: 751793 - RNA, 64 nt, Homo Sapiens; identical to SEQ ID NO: 214540

SEQ ID NO: 751794 - RNA, 62 nt, Homo Sapiens; identical to SEQ ID NO: 214541

SEQ ID NO: 751795 - RNA, 62 nt, Homo Sapiens; identical to SEQ ID NO: 214542

SEQ ID NO: 751796 - RNA, 62 nt, Homo Sapiens; identical to SEQ ID NO: 214543

SEQ ID NO: 751797 - RNA, 62 nt, Homo Sapiens; identical to SEQ ID NO: 214544

SEQ ID NO: 751798 - RNA, 62 nt, Homo Sapiens; identical to SEQ ID NO: 214545

SEQ ID NO: 751799 - RNA, 62 nt, Homo Sapiens; identical to SEQ ID NO: 214546

SEQ ID NO: 751800 - RNA, 62 nt, Homo Sapiens; identical to SEQ ID NO: 214547

SEQ ID NO: 751801 - RNA, 62 nt, Homo Sapiens; identical to SEQ ID NO: 214548

SEQ ID NO: 751802 - RNA, 62 nt, Homo Sapiens; identical to SEQ ID NO: 214549

SEQ ID NO: 751803 - RNA, 62 nt, Homo Sapiens; identical to SEQ ID NO: 214550

SEQ ID NO: 751804 - RNA, 62 nt, Homo Sapiens; identical to SEQ ID NO: 214551

SEQ ID NO: 751805 - RNA, 62 nt, Homo Sapiens; identical to SEQ ID NO: 214552

SEQ ID NO: 751806 - RNA, 62 nt, Homo Sapiens; identical to SEQ ID NO: 214553

SEQ ID NO: 751807 - RNA, 62 nt, Homo Sapiens; identical to SEQ ID NO: 214554

SEQ ID NO: 751808 - RNA, 62 nt, Homo Sapiens; identical to SEQ ID NO: 214555

SEQ ID NO: 751809 - RNA, 62 nt, Homo Sapiens; identical to SEQ ID NO: 214556

SEQ ID NO: 751810 - RNA, 62 nt, Homo Sapiens; identical to SEQ ID NO: 214557

SEQ ID NO: 751811 - RNA, 62 nt, Homo Sapiens; identical to SEQ ID NO: 214558

SEQ ID NO: 751812 - RNA, 62 nt, Homo Sapiens; identical to SEQ ID NO: 214559

SEQ ID NO: 751813 - RNA, 62 nt, Homo Sapiens; identical to SEQ ID NO: 214560

SEQ ID NO: 751814 - RNA, 62 nt, Homo Sapiens; identical to SEQ ID NO: 214561

SEQ ID NO: 751815 - RNA, 54 nt, Homo Sapiens; identical to SEQ ID NO: 214562

SEQ ID NO: 751816 - RNA, 62 nt, Homo Sapiens; identical to SEQ ID NO: 214563

SEQ ID NO: 751817 - RNA, 62 nt, Homo Sapiens; identical to SEQ ID NO: 214564

SEQ ID NO: 751818 - RNA, 62 nt, Homo Sapiens; identical to SEQ ID NO: 214565

SEQ ID NO: 751819 - RNA, 62 nt, Homo Sapiens; identical to SEQ ID NO: 214566

SEQ ID NO: 751820 - RNA, 62 nt, Homo Sapiens; identical to SEQ ID NO: 214567

SEQ ID NO: 751821 - RNA, 62 nt, Homo Sapiens; identical to SEQ ID NO: 214568

SEQ ID NO: 751822 - RNA, 62 nt, Homo Sapiens; identical to SEQ ID NO: 214569

SEQ ID NO: 751823 - RNA, 62 nt, Homo Sapiens; identical to SEQ ID NO: 214570

SEQ ID NO: 751824 - RNA, 62 nt, Homo Sapiens; identical to SEQ ID NO: 214571

SEQ ID NO: 751825 - RNA, 62 nt, Homo Sapiens; identical to SEQ ID NO: 214572

SEQ ID NO: 751826 - RNA, 62 nt, Homo Sapiens; identical to SEQ ID NO: 214573

SEQ ID NO: 751827 - RNA, 62 nt, Homo Sapiens; identical to SEQ ID NO: 214574

SEQ ID NO: 751828 - RNA, 62 nt, Homo Sapiens; identical to SEQ ID NO: 214575

SEQ ID NO: 751829 - RNA, 62 nt, Homo Sapiens; identical to SEQ ID NO: 214576

SEQ ID NO: 751830 - RNA, 62 nt, Homo Sapiens; identical to SEQ ID NO: 214577

SEQ ID NO: 751831 - RNA, 62 nt, Homo Sapiens; identical to SEQ ID NO: 214578

SEQ ID NO: 751832 - RNA, 62 nt, Homo Sapiens; identical to SEQ ID NO: 214579

SEQ ID NO: 751833 - RNA, 62 nt, Homo Sapiens; identical to SEQ ID NO: 214580

SEQ ID NO: 751834 - RNA, 62 nt, Homo Sapiens; identical to SEQ ID NO: 214581

SEQ ID NO: 751835 - RNA, 62 nt, Homo Sapiens; identical to SEQ ID NO: 214582

SEQ ID NO: 751836 - RNA, 62 nt, Homo Sapiens; identical to SEQ ID NO: 214583

SEQ ID NO: 751837 - RNA, 62 nt, Homo Sapiens; identical to SEQ ID NO: 214584

SEQ ID NO: 751838 - RNA, 62 nt, Homo Sapiens; identical to SEQ ID NO: 214585

SEQ ID NO: 751839 - RNA, 62 nt, Homo Sapiens; identical to SEQ ID NO: 214586

SEQ ID NO: 751840 - RNA, 62 nt, Homo Sapiens; identical to SEQ ID NO: 214587

SEQ ID NO: 751841 - RNA, 62 nt, Homo Sapiens; identical to SEQ ID NO: 214588

SEQ ID NO: 751842 - RNA, 62 nt, Homo Sapiens; identical to SEQ ID NO: 214589

SEQ ID NO: 751843 - RNA, 62 nt, Homo Sapiens; identical to SEQ ID NO: 214590

SEQ ID NO: 751844 - RNA, 62 nt, Homo Sapiens; identical to SEQ ID NO: 214591

SEQ ID NO: 751845 - RNA, 62 nt, Homo Sapiens; identical to SEQ ID NO: 214592

SEQ ID NO: 751846 - RNA, 62 nt, Homo Sapiens; identical to SEQ ID NO: 214593

SEQ ID NO: 751847 - RNA, 62 nt, Homo Sapiens; identical to SEQ ID NO: 214594

SEQ ID NO: 751848 - RNA, 62 nt, Homo Sapiens; identical to SEQ ID NO: 214595

SEQ ID NO: 751849 - RNA, 62 nt, Homo Sapiens; identical to SEQ ID NO: 214596

SEQ ID NO: 751850 - RNA, 62 nt, Homo Sapiens; identical to SEQ ID NO: 214597

SEQ ID NO: 751851 - RNA, 62 nt, Homo Sapiens; identical to SEQ ID NO: 214598

SEQ ID NO: 751852 - RNA, 62 nt, Homo Sapiens; identical to SEQ ID NO: 214599

SEQ ID NO: 751853 - RNA, 62 nt, Homo Sapiens; identical to SEQ ID NO: 214600

SEQ ID NO: 751854 - RNA, 62 nt, Homo Sapiens; identical to SEQ ID NO: 214601

SEQ ID NO: 751855 - RNA, 62 nt, Homo Sapiens; identical to SEQ ID NO: 214602

SEQ ID NO: 751856 - RNA, 62 nt, Homo Sapiens; identical to SEQ ID NO: 214603

SEQ ID NO: 751857 - RNA, 62 nt, Homo Sapiens; identical to SEQ ID NO: 214604

SEQ ID NO: 751858 - RNA, 62 nt, Homo Sapiens; identical to SEQ ID NO: 214605

SEQ ID NO: 751859 - RNA, 62 nt, Homo Sapiens; identical to SEQ ID NO: 214606

SEQ ID NO: 751860 - RNA, 62 nt, Homo Sapiens; identical to SEQ ID NO: 214607

SEQ ID NO: 751861 - RNA, 62 nt, Homo Sapiens; identical to SEQ ID NO: 214608

SEQ ID NO: 751862 - RNA, 62 nt, Homo Sapiens; identical to SEQ ID NO: 214609

SEQ ID NO: 751863 - RNA, 62 nt, Homo Sapiens; identical to SEQ ID NO: 214610

SEQ ID NO: 751864 - RNA, 62 nt, Homo Sapiens; identical to SEQ ID NO: 214611

SEQ ID NO: 751865 - RNA, 62 nt, Homo Sapiens; identical to SEQ ID NO: 214612

SEQ ID NO: 751866 - RNA, 62 nt, Homo Sapiens; identical to SEQ ID NO: 214613

SEQ ID NO: 751867 - RNA, 62 nt, Homo Sapiens; identical to SEQ ID NO: 214614

SEQ ID NO: 751868 - RNA, 62 nt, Homo Sapiens; identical to SEQ ID NO: 214615

SEQ ID NO: 751869 - RNA, 62 nt, Homo Sapiens; identical to SEQ ID NO: 214616

SEQ ID NO: 751870 - RNA, 62 nt, Homo Sapiens; identical to SEQ ID NO: 214617

SEQ ID NO: 751871 - RNA, 62 nt, Homo Sapiens; identical to SEQ ID NO: 214618

SEQ ID NO: 751872 - RNA, 62 nt, Homo Sapiens; identical to SEQ ID NO: 214619

SEQ ID NO: 751873 - RNA, 62 nt, Homo Sapiens; identical to SEQ ID NO: 214620

SEQ ID NO: 751874 - RNA, 62 nt, Homo Sapiens; identical to SEQ ID NO: 214621

SEQ ID NO: 751875 - RNA, 62 nt, Homo Sapiens; identical to SEQ ID NO: 214622

SEQ ID NO: 751876 - RNA, 62 nt, Homo Sapiens; identical to SEQ ID NO: 214623

SEQ ID NO: 751877 - RNA, 62 nt, Homo Sapiens; identical to SEQ ID NO: 214624

SEQ ID NO: 751878 - RNA, 62 nt, Homo Sapiens; identical to SEQ ID NO: 214625

SEQ ID NO: 751879 - RNA, 62 nt, Homo Sapiens; identical to SEQ ID NO: 214626

SEQ ID NO: 751880 - RNA, 62 nt, Homo Sapiens; identical to SEQ ID NO: 214627

SEQ ID NO: 751881 - RNA, 62 nt, Homo Sapiens; identical to SEQ ID NO: 214628

SEQ ID NO: 751882 - RNA, 62 nt, Homo Sapiens; identical to SEQ ID NO: 214629

SEQ ID NO: 751883 - RNA, 62 nt, Homo Sapiens; identical to SEQ ID NO: 214630

SEQ ID NO: 751884 - RNA, 62 nt, Homo Sapiens; identical to SEQ ID NO: 214631

SEQ ID NO: 751885 - RNA, 62 nt, Homo Sapiens; identical to SEQ ID NO: 214632

SEQ ID NO: 751886 - RNA, 62 nt, Homo Sapiens; identical to SEQ ID NO: 214633

SEQ ID NO: 751887 - RNA, 62 nt, Homo Sapiens; identical to SEQ ID NO: 214634

SEQ ID NO: 751888 - RNA, 62 nt, Homo Sapiens; identical to SEQ ID NO: 214635

SEQ ID NO: 751889 - RNA, 62 nt, Homo Sapiens; identical to SEQ ID NO: 214636

SEQ ID NO: 751890 - RNA, 62 nt, Homo Sapiens; identical to SEQ ID NO: 214637

SEQ ID NO: 751891 - RNA, 62 nt, Homo Sapiens; identical to SEQ ID NO: 214638

SEQ ID NO: 751892 - RNA, 62 nt, Homo Sapiens; identical to SEQ ID NO: 214639

SEQ ID NO: 751893 - RNA, 62 nt, Homo Sapiens; identical to SEQ ID NO: 214640

SEQ ID NO: 751894 - RNA, 62 nt, Homo Sapiens; identical to SEQ ID NO: 214641

SEQ ID NO: 751895 - RNA, 62 nt, Homo Sapiens; identical to SEQ ID NO: 214642

SEQ ID NO: 751896 - RNA, 62 nt, Homo Sapiens; identical to SEQ ID NO: 214643

SEQ ID NO: 751897 - RNA, 62 nt, Homo Sapiens; identical to SEQ ID NO: 214644

SEQ ID NO: 751898 - RNA, 62 nt, Homo Sapiens; identical to SEQ ID NO: 214645

SEQ ID NO: 751899 - RNA, 62 nt, Homo Sapiens; identical to SEQ ID NO: 214646

SEQ ID NO: 751900 - RNA, 62 nt, Homo Sapiens; identical to SEQ ID NO: 214647

SEQ ID NO: 751901 - RNA, 62 nt, Homo Sapiens; identical to SEQ ID NO: 214648

SEQ ID NO: 751902 - RNA, 62 nt, Homo Sapiens; identical to SEQ ID NO: 214649

SEQ ID NO: 751903 - RNA, 62 nt, Homo Sapiens; identical to SEQ ID NO: 214650

SEQ ID NO: 751904 - RNA, 62 nt, Homo Sapiens; identical to SEQ ID NO: 214651

SEQ ID NO: 751905 - RNA, 62 nt, Homo Sapiens; identical to SEQ ID NO: 214652

SEQ ID NO: 751906 - RNA, 62 nt, Homo Sapiens; identical to SEQ ID NO: 214653

SEQ ID NO: 751907 - RNA, 62 nt, Homo Sapiens; identical to SEQ ID NO: 214654

SEQ ID NO: 751908 - RNA, 62 nt, Homo Sapiens; identical to SEQ ID NO: 214655

SEQ ID NO: 751909 - RNA, 62 nt, Homo Sapiens; identical to SEQ ID NO: 214656

SEQ ID NO: 751910 - RNA, 62 nt, Homo Sapiens; identical to SEQ ID NO: 214657

SEQ ID NO: 751911 - RNA, 62 nt, Homo Sapiens; identical to SEQ ID NO: 214658

SEQ ID NO: 751912 - RNA, 62 nt, Homo Sapiens; identical to SEQ ID NO: 214659

SEQ ID NO: 751913 - RNA, 62 nt, Homo Sapiens; identical to SEQ ID NO: 214660

SEQ ID NO: 751914 - RNA, 62 nt, Homo Sapiens; identical to SEQ ID NO: 214661

SEQ ID NO: 751915 - RNA, 62 nt, Homo Sapiens; identical to SEQ ID NO: 214662

SEQ ID NO: 751916 - RNA, 62 nt, Homo Sapiens; identical to SEQ ID NO: 214663

SEQ ID NO: 751917 - RNA, 62 nt, Homo Sapiens; identical to SEQ ID NO: 214664

SEQ ID NO: 751918 - RNA, 62 nt, Homo Sapiens; identical to SEQ ID NO: 214665

SEQ ID NO: 751919 - RNA, 62 nt, Homo Sapiens; identical to SEQ ID NO: 214666

SEQ ID NO: 751920 - RNA, 62 nt, Homo Sapiens; identical to SEQ ID NO: 214667

SEQ ID NO: 751921 - RNA, 62 nt, Homo Sapiens; identical to SEQ ID NO: 214668

SEQ ID NO: 751922 - RNA, 62 nt, Homo Sapiens; identical to SEQ ID NO: 214669

SEQ ID NO: 751923 - RNA, 62 nt, Homo Sapiens; identical to SEQ ID NO: 214670

SEQ ID NO: 751924 - RNA, 62 nt, Homo Sapiens; identical to SEQ ID NO: 214671

SEQ ID NO: 751925 - RNA, 61 nt, Homo Sapiens; identical to SEQ ID NO: 214672

SEQ ID NO: 751926 - RNA, 61 nt, Homo Sapiens; identical to SEQ ID NO: 214673

SEQ ID NO: 751927 - RNA, 61 nt, Homo Sapiens; identical to SEQ ID NO: 214674

SEQ ID NO: 751928 - RNA, 61 nt, Homo Sapiens; identical to SEQ ID NO: 214675

SEQ ID NO: 751929 - RNA, 61 nt, Homo Sapiens; identical to SEQ ID NO: 214676

SEQ ID NO: 751930 - RNA, 61 nt, Homo Sapiens; identical to SEQ ID NO: 214677

SEQ ID NO: 751931 - RNA, 61 nt, Homo Sapiens; identical to SEQ ID NO: 214678

SEQ ID NO: 751932 - RNA, 61 nt, Homo Sapiens; identical to SEQ ID NO: 214679

SEQ ID NO: 751933 - RNA, 61 nt, Homo Sapiens; identical to SEQ ID NO: 214680

SEQ ID NO: 751934 - RNA, 61 nt, Homo Sapiens; identical to SEQ ID NO: 214681

SEQ ID NO: 751935 - RNA, 61 nt, Homo Sapiens; identical to SEQ ID NO: 214682

SEQ ID NO: 751936 - RNA, 61 nt, Homo Sapiens; identical to SEQ ID NO: 214683

SEQ ID NO: 751937 - RNA, 61 nt, Homo Sapiens; identical to SEQ ID NO: 214684

SEQ ID NO: 751938 - RNA, 55 nt, Homo Sapiens; identical to SEQ ID NO: 214685

SEQ ID NO: 751939 - RNA, 61 nt, Homo Sapiens; identical to SEQ ID NO: 214686

SEQ ID NO: 751940 - RNA, 61 nt, Homo Sapiens; identical to SEQ ID NO: 214687

SEQ ID NO: 751941 - RNA, 61 nt, Homo Sapiens; identical to SEQ ID NO: 214688

SEQ ID NO: 751942 - RNA, 61 nt, Homo Sapiens; identical to SEQ ID NO: 214689

SEQ ID NO: 751943 - RNA, 61 nt, Homo Sapiens; identical to SEQ ID NO: 214690

SEQ ID NO: 751944 - RNA, 61 nt, Homo Sapiens; identical to SEQ ID NO: 214691

SEQ ID NO: 751945 - RNA, 61 nt, Homo Sapiens; identical to SEQ ID NO: 214692

SEQ ID NO: 751946 - RNA, 61 nt, Homo Sapiens; identical to SEQ ID NO: 214693

SEQ ID NO: 751947 - RNA, 61 nt, Homo Sapiens; identical to SEQ ID NO: 214694

SEQ ID NO: 751948 - RNA, 61 nt, Homo Sapiens; identical to SEQ ID NO: 214695

SEQ ID NO: 751949 - RNA, 61 nt, Homo Sapiens; identical to SEQ ID NO: 214696

SEQ ID NO: 751950 - RNA, 61 nt, Homo Sapiens; identical to SEQ ID NO: 214697

SEQ ID NO: 751951 - RNA, 61 nt, Homo Sapiens; identical to SEQ ID NO: 214698

SEQ ID NO: 751952 - RNA, 61 nt, Homo Sapiens; identical to SEQ ID NO: 214699

SEQ ID NO: 751953 - RNA, 61 nt, Homo Sapiens; identical to SEQ ID NO: 214700

SEQ ID NO: 751954 - RNA, 61 nt, Homo Sapiens; identical to SEQ ID NO: 214701

SEQ ID NO: 751955 - RNA, 61 nt, Homo Sapiens; identical to SEQ ID NO: 214702

SEQ ID NO: 751956 - RNA, 61 nt, Homo Sapiens; identical to SEQ ID NO: 214703

SEQ ID NO: 751957 - RNA, 61 nt, Homo Sapiens; identical to SEQ ID NO: 214704

SEQ ID NO: 751958 - RNA, 61 nt, Homo Sapiens; identical to SEQ ID NO: 214705

SEQ ID NO: 751959 - RNA, 61 nt, Homo Sapiens; identical to SEQ ID NO: 214706

SEQ ID NO: 751960 - RNA, 61 nt, Homo Sapiens; identical to SEQ ID NO: 214707

SEQ ID NO: 751961 - RNA, 61 nt, Homo Sapiens; identical to SEQ ID NO: 214708

SEQ ID NO: 751962 - RNA, 61 nt, Homo Sapiens; identical to SEQ ID NO: 214709

SEQ ID NO: 751963 - RNA, 61 nt, Homo Sapiens; identical to SEQ ID NO: 214710

SEQ ID NO: 751964 - RNA, 61 nt, Homo Sapiens; identical to SEQ ID NO: 214711

SEQ ID NO: 751965 - RNA, 61 nt, Homo Sapiens; identical to SEQ ID NO: 214712

SEQ ID NO: 751966 - RNA, 61 nt, Homo Sapiens; identical to SEQ ID NO: 214713

SEQ ID NO: 751967 - RNA, 61 nt, Homo Sapiens; identical to SEQ ID NO: 214714

SEQ ID NO: 751968 - RNA, 61 nt, Homo Sapiens; identical to SEQ ID NO: 214715

SEQ ID NO: 751969 - RNA, 61 nt, Homo Sapiens; identical to SEQ ID NO: 214716

SEQ ID NO: 751970 - RNA, 61 nt, Homo Sapiens; identical to SEQ ID NO: 214717

SEQ ID NO: 751971 - RNA, 61 nt, Homo Sapiens; identical to SEQ ID NO: 214718

SEQ ID NO: 751972 - RNA, 61 nt, Homo Sapiens; identical to SEQ ID NO: 214719

SEQ ID NO: 751973 - RNA, 61 nt, Homo Sapiens; identical to SEQ ID NO: 214720

SEQ ID NO: 751974 - RNA, 61 nt, Homo Sapiens; identical to SEQ ID NO: 214721

SEQ ID NO: 751975 - RNA, 61 nt, Homo Sapiens; identical to SEQ ID NO: 214722

SEQ ID NO: 751976 - RNA, 61 nt, Homo Sapiens; identical to SEQ ID NO: 214723

SEQ ID NO: 751977 - RNA, 61 nt, Homo Sapiens; identical to SEQ ID NO: 214724

SEQ ID NO: 751978 - RNA, 61 nt, Homo Sapiens; identical to SEQ ID NO: 214725

SEQ ID NO: 751979 - RNA, 61 nt, Homo Sapiens; identical to SEQ ID NO: 214726

SEQ ID NO: 751980 - RNA, 61 nt, Homo Sapiens; identical to SEQ ID NO: 214727

SEQ ID NO: 751981 - RNA, 61 nt, Homo Sapiens; identical to SEQ ID NO: 214728

SEQ ID NO: 751982 - RNA, 61 nt, Homo Sapiens; identical to SEQ ID NO: 214729

SEQ ID NO: 751983 - RNA, 61 nt, Homo Sapiens; identical to SEQ ID NO: 214730

SEQ ID NO: 751984 - RNA, 61 nt, Homo Sapiens; identical to SEQ ID NO: 214731

SEQ ID NO: 751985 - RNA, 61 nt, Homo Sapiens; identical to SEQ ID NO: 214732

SEQ ID NO: 751986 - RNA, 61 nt, Homo Sapiens; identical to SEQ ID NO: 214733

SEQ ID NO: 751987 - RNA, 61 nt, Homo Sapiens; identical to SEQ ID NO: 214734

SEQ ID NO: 751988 - RNA, 61 nt, Homo Sapiens; identical to SEQ ID NO: 214735

SEQ ID NO: 751989 - RNA, 61 nt, Homo Sapiens; identical to SEQ ID NO: 214736

SEQ ID NO: 751990 - RNA, 61 nt, Homo Sapiens; identical to SEQ ID NO: 214737

SEQ ID NO: 751991 - RNA, 61 nt, Homo Sapiens; identical to SEQ ID NO: 214738

SEQ ID NO: 751992 - RNA, 61 nt, Homo Sapiens; identical to SEQ ID NO: 214739

SEQ ID NO: 751993 - RNA, 61 nt, Homo Sapiens; identical to SEQ ID NO: 214740

SEQ ID NO: 751994 - RNA, 61 nt, Homo Sapiens; identical to SEQ ID NO: 214741

SEQ ID NO: 751995 - RNA, 61 nt, Homo Sapiens; identical to SEQ ID NO: 214742

SEQ ID NO: 751996 - RNA, 61 nt, Homo Sapiens; identical to SEQ ID NO: 214743

SEQ ID NO: 751997 - RNA, 61 nt, Homo Sapiens; identical to SEQ ID NO: 214744

SEQ ID NO: 751998 - RNA, 61 nt, Homo Sapiens; identical to SEQ ID NO: 214745

SEQ ID NO: 751999 - RNA, 61 nt, Homo Sapiens; identical to SEQ ID NO: 214746

SEQ ID NO: 752000 - RNA, 61 nt, Homo Sapiens; identical to SEQ ID NO: 214747

SEQ ID NO: 752001 - RNA, 61 nt, Homo Sapiens; identical to SEQ ID NO: 214748

SEQ ID NO: 752002 - RNA, 61 nt, Homo Sapiens; identical to SEQ ID NO: 214749

SEQ ID NO: 752003 - RNA, 61 nt, Homo Sapiens; identical to SEQ ID NO: 214750

SEQ ID NO: 752004 - RNA, 61 nt, Homo Sapiens; identical to SEQ ID NO: 214751

SEQ ID NO: 752005 - RNA, 61 nt, Homo Sapiens; identical to SEQ ID NO: 214752

SEQ ID NO: 752006 - RNA, 61 nt, Homo Sapiens; identical to SEQ ID NO: 214753

SEQ ID NO: 752007 - RNA, 61 nt, Homo Sapiens; identical to SEQ ID NO: 214754

SEQ ID NO: 752008 - RNA, 61 nt, Homo Sapiens; identical to SEQ ID NO: 214755

SEQ ID NO: 752009 - RNA, 61 nt, Homo Sapiens; identical to SEQ ID NO: 214756

SEQ ID NO: 752010 - RNA, 61 nt, Homo Sapiens; identical to SEQ ID NO: 214757

SEQ ID NO: 752011 - RNA, 61 nt, Homo Sapiens; identical to SEQ ID NO: 214758

SEQ ID NO: 752012 - RNA, 61 nt, Homo Sapiens; identical to SEQ ID NO: 214759

SEQ ID NO: 752013 - RNA, 61 nt, Homo Sapiens; identical to SEQ ID NO: 214760

SEQ ID NO: 752014 - RNA, 61 nt, Homo Sapiens; identical to SEQ ID NO: 214761

SEQ ID NO: 752015 - RNA, 61 nt, Homo Sapiens; identical to SEQ ID NO: 214762

SEQ ID NO: 752016 - RNA, 61 nt, Homo Sapiens; identical to SEQ ID NO: 214763

SEQ ID NO: 752017 - RNA, 61 nt, Homo Sapiens; identical to SEQ ID NO: 214764

SEQ ID NO: 752018 - RNA, 61 nt, Homo Sapiens; identical to SEQ ID NO: 214765

SEQ ID NO: 752019 - RNA, 61 nt, Homo Sapiens; identical to SEQ ID NO: 214766

SEQ ID NO: 752020 - RNA, 61 nt, Homo Sapiens; identical to SEQ ID NO: 214767

SEQ ID NO: 752021 - RNA, 61 nt, Homo Sapiens; identical to SEQ ID NO: 214768

SEQ ID NO: 752022 - RNA, 61 nt, Homo Sapiens; identical to SEQ ID NO: 214769

SEQ ID NO: 752023 - RNA, 61 nt, Homo Sapiens; identical to SEQ ID NO: 214770

SEQ ID NO: 752024 - RNA, 61 nt, Homo Sapiens; identical to SEQ ID NO: 214771

SEQ ID NO: 752025 - RNA, 61 nt, Homo Sapiens; identical to SEQ ID NO: 214772

SEQ ID NO: 752026 - RNA, 61 nt, Homo Sapiens; identical to SEQ ID NO: 214773

SEQ ID NO: 752027 - RNA, 61 nt, Homo Sapiens; identical to SEQ ID NO: 214774

SEQ ID NO: 752028 - RNA, 61 nt, Homo Sapiens; identical to SEQ ID NO: 214775

SEQ ID NO: 752029 - RNA, 61 nt, Homo Sapiens; identical to SEQ ID NO: 214776

SEQ ID NO: 752030 - RNA, 61 nt, Homo Sapiens; identical to SEQ ID NO: 214777

SEQ ID NO: 752031 - RNA, 61 nt, Homo Sapiens; identical to SEQ ID NO: 214778

SEQ ID NO: 752032 - RNA, 61 nt, Homo Sapiens; identical to SEQ ID NO: 214779

SEQ ID NO: 752033 - RNA, 61 nt, Homo Sapiens; identical to SEQ ID NO: 214780

SEQ ID NO: 752034 - RNA, 61 nt, Homo Sapiens; identical to SEQ ID NO: 214781

SEQ ID NO: 752035 - RNA, 61 nt, Homo Sapiens; identical to SEQ ID NO: 214782

SEQ ID NO: 752036 - RNA, 61 nt, Homo Sapiens; identical to SEQ ID NO: 214783

SEQ ID NO: 752037 - RNA, 58 nt, Homo Sapiens; identical to SEQ ID NO: 214784

SEQ ID NO: 752038 - RNA, 61 nt, Homo Sapiens; identical to SEQ ID NO: 214785

SEQ ID NO: 752039 - RNA, 61 nt, Homo Sapiens; identical to SEQ ID NO: 214786

SEQ ID NO: 752040 - RNA, 61 nt, Homo Sapiens; identical to SEQ ID NO: 214787

SEQ ID NO: 752041 - RNA, 61 nt, Homo Sapiens; identical to SEQ ID NO: 214788

SEQ ID NO: 752042 - RNA, 61 nt, Homo Sapiens; identical to SEQ ID NO: 214789

SEQ ID NO: 752043 - RNA, 61 nt, Homo Sapiens; identical to SEQ ID NO: 214790

SEQ ID NO: 752044 - RNA, 61 nt, Homo Sapiens; identical to SEQ ID NO: 214791

SEQ ID NO: 752045 - RNA, 61 nt, Homo Sapiens; identical to SEQ ID NO: 214792

SEQ ID NO: 752046 - RNA, 61 nt, Homo Sapiens; identical to SEQ ID NO: 214793

SEQ ID NO: 752047 - RNA, 61 nt, Homo Sapiens; identical to SEQ ID NO: 214794

SEQ ID NO: 752048 - RNA, 61 nt, Homo Sapiens; identical to SEQ ID NO: 214795

SEQ ID NO: 752049 - RNA, 61 nt, Homo Sapiens; identical to SEQ ID NO: 214796

SEQ ID NO: 752050 - RNA, 61 nt, Homo Sapiens; identical to SEQ ID NO: 214797

SEQ ID NO: 752051 - RNA, 61 nt, Homo Sapiens; identical to SEQ ID NO: 214798

SEQ ID NO: 752052 - RNA, 61 nt, Homo Sapiens; identical to SEQ ID NO: 214799

SEQ ID NO: 752053 - RNA, 61 nt, Homo Sapiens; identical to SEQ ID NO: 214800

SEQ ID NO: 752054 - RNA, 61 nt, Homo Sapiens; identical to SEQ ID NO: 214801

SEQ ID NO: 752055 - RNA, 61 nt, Homo Sapiens; identical to SEQ ID NO: 214802

SEQ ID NO: 752056 - RNA, 61 nt, Homo Sapiens; identical to SEQ ID NO: 214803

SEQ ID NO: 752057 - RNA, 61 nt, Homo Sapiens; identical to SEQ ID NO: 214804

SEQ ID NO: 752058 - RNA, 61 nt, Homo Sapiens; identical to SEQ ID NO: 214805

SEQ ID NO: 752059 - RNA, 61 nt, Homo Sapiens; identical to SEQ ID NO: 214806

SEQ ID NO: 752060 - RNA, 61 nt, Homo Sapiens; identical to SEQ ID NO: 214807

SEQ ID NO: 752061 - RNA, 61 nt, Homo Sapiens; identical to SEQ ID NO: 214808

SEQ ID NO: 752062 - RNA, 61 nt, Homo Sapiens; identical to SEQ ID NO: 214809

SEQ ID NO: 752063 - RNA, 61 nt, Homo Sapiens; identical to SEQ ID NO: 214810

SEQ ID NO: 752064 - RNA, 61 nt, Homo Sapiens; identical to SEQ ID NO: 214811

SEQ ID NO: 752065 - RNA, 61 nt, Homo Sapiens; identical to SEQ ID NO: 214812

SEQ ID NO: 752066 - RNA, 61 nt, Homo Sapiens; identical to SEQ ID NO: 214813

SEQ ID NO: 752067 - RNA, 61 nt, Homo Sapiens; identical to SEQ ID NO: 214814

SEQ ID NO: 752068 - RNA, 61 nt, Homo Sapiens; identical to SEQ ID NO: 214815

SEQ ID NO: 752069 - RNA, 61 nt, Homo Sapiens; identical to SEQ ID NO: 214816

SEQ ID NO: 752070 - RNA, 61 nt, Homo Sapiens; identical to SEQ ID NO: 214817

SEQ ID NO: 752071 - RNA, 61 nt, Homo Sapiens; identical to SEQ ID NO: 214818

SEQ ID NO: 752072 - RNA, 61 nt, Homo Sapiens; identical to SEQ ID NO: 214819

SEQ ID NO: 752073 - RNA, 61 nt, Homo Sapiens; identical to SEQ ID NO: 214820

SEQ ID NO: 752074 - RNA, 61 nt, Homo Sapiens; identical to SEQ ID NO: 214821

SEQ ID NO: 752075 - RNA, 61 nt, Homo Sapiens; identical to SEQ ID NO: 214822

SEQ ID NO: 752076 - RNA, 61 nt, Homo Sapiens; identical to SEQ ID NO: 214823

SEQ ID NO: 752077 - RNA, 61 nt, Homo Sapiens; identical to SEQ ID NO: 214824

SEQ ID NO: 752078 - RNA, 61 nt, Homo Sapiens; identical to SEQ ID NO: 214825

SEQ ID NO: 752079 - RNA, 58 nt, Homo Sapiens; identical to SEQ ID NO: 214826

SEQ ID NO: 752080 - RNA, 61 nt, Homo Sapiens; identical to SEQ ID NO: 214827

SEQ ID NO: 752081 - RNA, 61 nt, Homo Sapiens; identical to SEQ ID NO: 214828

SEQ ID NO: 752082 - RNA, 61 nt, Homo Sapiens; identical to SEQ ID NO: 214829

SEQ ID NO: 752083 - RNA, 61 nt, Homo Sapiens; identical to SEQ ID NO: 214830

SEQ ID NO: 752084 - RNA, 61 nt, Homo Sapiens; identical to SEQ ID NO: 214831

SEQ ID NO: 752085 - RNA, 61 nt, Homo Sapiens; identical to SEQ ID NO: 214832

SEQ ID NO: 752086 - RNA, 61 nt, Homo Sapiens; identical to SEQ ID NO: 214833

SEQ ID NO: 752087 - RNA, 61 nt, Homo Sapiens; identical to SEQ ID NO: 214834

SEQ ID NO: 752088 - RNA, 61 nt, Homo Sapiens; identical to SEQ ID NO: 214835

SEQ ID NO: 752089 - RNA, 61 nt, Homo Sapiens; identical to SEQ ID NO: 214836

SEQ ID NO: 752090 - RNA, 61 nt, Homo Sapiens; identical to SEQ ID NO: 214837

SEQ ID NO: 752091 - RNA, 61 nt, Homo Sapiens; identical to SEQ ID NO: 214838

SEQ ID NO: 752092 - RNA, 61 nt, Homo Sapiens; identical to SEQ ID NO: 214839

SEQ ID NO: 752093 - RNA, 64 nt, Homo Sapiens; identical to SEQ ID NO: 669302

SEQ ID NO: 752094 - RNA, 64 nt, Homo Sapiens; identical to SEQ ID NO: 669303

SEQ ID NO: 752095 - RNA, 64 nt, Homo Sapiens; identical to SEQ ID NO: 669304

SEQ ID NO: 752096 - RNA, 64 nt, Homo Sapiens; identical to SEQ ID NO: 669305

SEQ ID NO: 752097 - RNA, 64 nt, Homo Sapiens; identical to SEQ ID NO: 669306

SEQ ID NO: 752098 - RNA, 64 nt, Homo Sapiens; identical to SEQ ID NO: 669307

SEQ ID NO: 752099 - RNA, 64 nt, Homo Sapiens; identical to SEQ ID NO: 669308

SEQ ID NO: 752100 - RNA, 64 nt, Homo Sapiens; identical to SEQ ID NO: 669309

SEQ ID NO: 752101 - RNA, 64 nt, Homo Sapiens; identical to SEQ ID NO: 669310

SEQ ID NO: 752102 - RNA, 64 nt, Homo Sapiens; identical to SEQ ID NO: 669311

SEQ ID NO: 752103 - RNA, 64 nt, Homo Sapiens; identical to SEQ ID NO: 669312

SEQ ID NO: 752104 - RNA, 64 nt, Homo Sapiens; identical to SEQ ID NO: 669313

SEQ ID NO: 752105 - RNA, 62 nt, Homo Sapiens
cguauaaaaucuggauuuuucuccauguccugggccuaaaauugccuugcuuaacucuaaag

SEQ ID NO: 752106 - RNA, 62 nt, Homo Sapiens
acaggagaaaaggucuucaacuuuugagaggaggccuaaagguuaggaguugugcaacagcu

SEQ ID NO: 752107 - RNA, 64 nt, Homo Sapiens
uugguacuacauaaugacuugcuccacacaugcaguaaacuacauaaugauguacugguaaacu

SEQ ID NO: 752108 - RNA, 64 nt, Homo Sapiens
ccacacaugcaguaaacuacauaaugauguacugguaaacuagaaacaaagaaugcagcaggau

SEQ ID NO: 752109 - RNA, 64 nt, Homo Sapiens
agcuuaaacuauugacucuagcauuuuaaucguuguaaacuaaccagaaugugcaagaacuuuu

SEQ ID NO: 752110 - RNA, 64 nt, Homo Sapiens
gagacauaauuagagaugcaaauuacauauuuugguaaacuagauaaauauuuacacuaauauc

SEQ ID NO: 752111 - RNA, 64 nt, Homo Sapiens
gacugauguauguaaucaacuucauugggcugcaguaaacuaguggaaauuagagaguuguuuu

SEQ ID NO: 752112 - RNA, 64 nt, Homo Sapiens
uggucuggucaguauugccuggcugacgugaaauguaaacuaguaggcguguuauugaucugcu

SEQ ID NO: 752113 - RNA, 64 nt, Homo Sapiens
auucacugguuccagggauuacacauuuugccauguaaacuaacauauuaaacacaucugcagg

SEQ ID NO: 752114 - RNA, 64 nt, Homo Sapiens
gccacuuccagcuuguagagcuuucuugcugacuguaaacuaaguggcagggccaaggucccca

SEQ ID NO: 752115 - RNA, 64 nt, Homo Sapiens
ugauuuuuuuuuguuguuacgauugaauugugagguaaacuaccuugaggaaaagcacuugugu

SEQ ID NO: 752116 - RNA, 64 nt, Homo Sapiens
uuacucaacugaguauuaccgccgugcacucacaguaaacuacaaguuucuguauuagucaccu

SEQ ID NO: 752117 - RNA, 64 nt, Homo Sapiens
uuaucuuaaaaucauauuugaagacaguaagacaguaaacuauuuuaggaagucaacccccauu

SEQ ID NO: 752118 - RNA, 64 nt, Homo Sapiens
cucucccaagauucauuuaguucaaacaguauccguaaacuaggaauaaugccacaugcauuca

SEQ ID NO: 752119 - RNA, 64 nt, Homo Sapiens; identical to SEQ ID NO: 110917

SEQ ID NO: 752120 - RNA, 64 nt, Homo Sapiens; identical to SEQ ID NO: 110918

SEQ ID NO: 752121 - RNA, 64 nt, Homo Sapiens; identical to SEQ ID NO: 110919

SEQ ID NO: 752122 - RNA, 64 nt, Homo Sapiens; identical to SEQ ID NO: 110920

SEQ ID NO: 752123 - RNA, 64 nt, Homo Sapiens; identical to SEQ ID NO: 110921

SEQ ID NO: 752124 - RNA, 64 nt, Homo Sapiens; identical to SEQ ID NO: 110922

SEQ ID NO: 752125 - RNA, 64 nt, Homo Sapiens; identical to SEQ ID NO: 110923

SEQ ID NO: 752126 - RNA, 64 nt, Homo Sapiens; identical to SEQ ID NO: 110924

SEQ ID NO: 752127 - RNA, 64 nt, Homo Sapiens; identical to SEQ ID NO: 110925

SEQ ID NO: 752128 - RNA, 64 nt, Homo Sapiens; identical to SEQ ID NO: 110926

SEQ ID NO: 752129 - RNA, 64 nt, Homo Sapiens; identical to SEQ ID NO: 110927

SEQ ID NO: 752130 - RNA, 64 nt, Homo Sapiens; identical to SEQ ID NO: 110928

SEQ ID NO: 752131 - RNA, 61 nt, Homo Sapiens; identical to SEQ ID NO: 110929

SEQ ID NO: 752132 - RNA, 64 nt, Homo Sapiens; identical to SEQ ID NO: 110930

SEQ ID NO: 752133 - RNA, 64 nt, Homo Sapiens; identical to SEQ ID NO: 110931

SEQ ID NO: 752134 - RNA, 64 nt, Homo Sapiens; identical to SEQ ID NO: 110932

SEQ ID NO: 752135 - RNA, 64 nt, Homo Sapiens; identical to SEQ ID NO: 110933

SEQ ID NO: 752136 - RNA, 64 nt, Homo Sapiens; identical to SEQ ID NO: 110934

SEQ ID NO: 752137 - RNA, 64 nt, Homo Sapiens; identical to SEQ ID NO: 110935

SEQ ID NO: 752138 - RNA, 64 nt, Homo Sapiens; identical to SEQ ID NO: 110936

SEQ ID NO: 752139 - RNA, 64 nt, Homo Sapiens; identical to SEQ ID NO: 110937

SEQ ID NO: 752140 - RNA, 64 nt, Homo Sapiens; identical to SEQ ID NO: 110938

SEQ ID NO: 752141 - RNA, 64 nt, Homo Sapiens; identical to SEQ ID NO: 110939

SEQ ID NO: 752142 - RNA, 64 nt, Homo Sapiens; identical to SEQ ID NO: 110940

SEQ ID NO: 752143 - RNA, 64 nt, Homo Sapiens; identical to SEQ ID NO: 110941

SEQ ID NO: 752144 - RNA, 64 nt, Homo Sapiens; identical to SEQ ID NO: 110942

SEQ ID NO: 752145 - RNA, 64 nt, Homo Sapiens; identical to SEQ ID NO: 110943

SEQ ID NO: 752146 - RNA, 64 nt, Homo Sapiens; identical to SEQ ID NO: 110944

SEQ ID NO: 752147 - RNA, 64 nt, Homo Sapiens; identical to SEQ ID NO: 110945

SEQ ID NO: 752148 - RNA, 64 nt, Homo Sapiens; identical to SEQ ID NO: 110946

SEQ ID NO: 752149 - RNA, 64 nt, Homo Sapiens; identical to SEQ ID NO: 110947

SEQ ID NO: 752150 - RNA, 64 nt, Homo Sapiens; identical to SEQ ID NO: 110948

SEQ ID NO: 752151 - RNA, 64 nt, Homo Sapiens; identical to SEQ ID NO: 110949

SEQ ID NO: 752152 - RNA, 64 nt, Homo Sapiens; identical to SEQ ID NO: 110950

SEQ ID NO: 752153 - RNA, 64 nt, Homo Sapiens; identical to SEQ ID NO: 110951

SEQ ID NO: 752154 - RNA, 64 nt, Homo Sapiens; identical to SEQ ID NO: 110952

SEQ ID NO: 752155 - RNA, 64 nt, Homo Sapiens; identical to SEQ ID NO: 110953

SEQ ID NO: 752156 - RNA, 64 nt, Homo Sapiens; identical to SEQ ID NO: 110954

SEQ ID NO: 752157 - RNA, 64 nt, Homo Sapiens; identical to SEQ ID NO: 110955

SEQ ID NO: 752158 - RNA, 64 nt, Homo Sapiens; identical to SEQ ID NO: 110956

SEQ ID NO: 752159 - RNA, 64 nt, Homo Sapiens; identical to SEQ ID NO: 110957

SEQ ID NO: 752160 - RNA, 64 nt, Homo Sapiens; identical to SEQ ID NO: 110958

SEQ ID NO: 752161 - RNA, 64 nt, Homo Sapiens; identical to SEQ ID NO: 665692

SEQ ID NO: 752162 - RNA, 64 nt, Homo Sapiens; identical to SEQ ID NO: 665693

SEQ ID NO: 752163 - RNA, 64 nt, Homo Sapiens; identical to SEQ ID NO: 665694

SEQ ID NO: 752164 - RNA, 64 nt, Homo Sapiens; identical to SEQ ID NO: 665695

SEQ ID NO: 752165 - RNA, 64 nt, Homo Sapiens; identical to SEQ ID NO: 81043

SEQ ID NO: 752166 - RNA, 64 nt, Homo Sapiens; identical to SEQ ID NO: 81044

SEQ ID NO: 752167 - RNA, 64 nt, Homo Sapiens; identical to SEQ ID NO: 81045

SEQ ID NO: 752168 - RNA, 64 nt, Homo Sapiens; identical to SEQ ID NO: 81046

SEQ ID NO: 752169 - RNA, 64 nt, Homo Sapiens; identical to SEQ ID NO: 81047

SEQ ID NO: 752170 - RNA, 64 nt, Homo Sapiens; identical to SEQ ID NO: 81048

SEQ ID NO: 752171 - RNA, 64 nt, Homo Sapiens; identical to SEQ ID NO: 81049

SEQ ID NO: 752172 - RNA, 64 nt, Homo Sapiens; identical to SEQ ID NO: 81050

SEQ ID NO: 752173 - RNA, 64 nt, Homo Sapiens; identical to SEQ ID NO: 81051

SEQ ID NO: 752174 - RNA, 64 nt, Homo Sapiens; identical to SEQ ID NO: 81052

SEQ ID NO: 752175 - RNA, 64 nt, Homo Sapiens; identical to SEQ ID NO: 81053

SEQ ID NO: 752176 - RNA, 64 nt, Homo Sapiens; identical to SEQ ID NO: 81054

SEQ ID NO: 752177 - RNA, 64 nt, Homo Sapiens; identical to SEQ ID NO: 81055

SEQ ID NO: 752178 - RNA, 64 nt, Homo Sapiens; identical to SEQ ID NO: 81056

SEQ ID NO: 752179 - RNA, 64 nt, Homo Sapiens; identical to SEQ ID NO: 81057

SEQ ID NO: 752180 - RNA, 64 nt, Homo Sapiens; identical to SEQ ID NO: 81058

SEQ ID NO: 752181 - RNA, 64 nt, Homo Sapiens; identical to SEQ ID NO: 81059

SEQ ID NO: 752182 - RNA, 64 nt, Homo Sapiens; identical to SEQ ID NO: 81060

SEQ ID NO: 752183 - RNA, 64 nt, Homo Sapiens; identical to SEQ ID NO: 81061

SEQ ID NO: 752184 - RNA, 64 nt, Homo Sapiens; identical to SEQ ID NO: 81062

SEQ ID NO: 752185 - RNA, 64 nt, Homo Sapiens; identical to SEQ ID NO: 81063

SEQ ID NO: 752186 - RNA, 64 nt, Homo Sapiens; identical to SEQ ID NO: 81064

SEQ ID NO: 752187 - RNA, 64 nt, Homo Sapiens; identical to SEQ ID NO: 81065

SEQ ID NO: 752188 - RNA, 64 nt, Homo Sapiens; identical to SEQ ID NO: 81066

SEQ ID NO: 752189 - RNA, 64 nt, Homo Sapiens; identical to SEQ ID NO: 81067

SEQ ID NO: 752190 - RNA, 64 nt, Homo Sapiens; identical to SEQ ID NO: 81068

SEQ ID NO: 752191 - RNA, 64 nt, Homo Sapiens; identical to SEQ ID NO: 81069

SEQ ID NO: 752192 - RNA, 64 nt, Homo Sapiens; identical to SEQ ID NO: 81070

SEQ ID NO: 752193 - RNA, 64 nt, Homo Sapiens; identical to SEQ ID NO: 81071

SEQ ID NO: 752194 - RNA, 64 nt, Homo Sapiens; identical to SEQ ID NO: 81072

SEQ ID NO: 752195 - RNA, 64 nt, Homo Sapiens; identical to SEQ ID NO: 81073

SEQ ID NO: 752196 - RNA, 64 nt, Homo Sapiens; identical to SEQ ID NO: 81074

SEQ ID NO: 752197 - RNA, 64 nt, Homo Sapiens; identical to SEQ ID NO: 81075

SEQ ID NO: 752198 - RNA, 64 nt, Homo Sapiens; identical to SEQ ID NO: 81076

SEQ ID NO: 752199 - RNA, 64 nt, Homo Sapiens; identical to SEQ ID NO: 81077

SEQ ID NO: 752200 - RNA, 64 nt, Homo Sapiens; identical to SEQ ID NO: 81078

SEQ ID NO: 752201 - RNA, 64 nt, Homo Sapiens; identical to SEQ ID NO: 81079

SEQ ID NO: 752202 - RNA, 64 nt, Homo Sapiens; identical to SEQ ID NO: 81080

SEQ ID NO: 752203 - RNA, 64 nt, Homo Sapiens; identical to SEQ ID NO: 81081

SEQ ID NO: 752204 - RNA, 64 nt, Homo Sapiens; identical to SEQ ID NO: 81082

SEQ ID NO: 752205 - RNA, 64 nt, Homo Sapiens; identical to SEQ ID NO: 81083

SEQ ID NO: 752206 - RNA, 64 nt, Homo Sapiens; identical to SEQ ID NO: 81084

SEQ ID NO: 752207 - RNA, 64 nt, Homo Sapiens; identical to SEQ ID NO: 81085

SEQ ID NO: 752208 - RNA, 64 nt, Homo Sapiens; identical to SEQ ID NO: 81086

SEQ ID NO: 752209 - RNA, 64 nt, Homo Sapiens; identical to SEQ ID NO: 81087

SEQ ID NO: 752210 - RNA, 64 nt, Homo Sapiens; identical to SEQ ID NO: 81088

SEQ ID NO: 752211 - RNA, 64 nt, Homo Sapiens; identical to SEQ ID NO: 81089

SEQ ID NO: 752212 - RNA, 64 nt, Homo Sapiens
ccuuacuaagcugagagaugucauugcugcaggcaggacguauaggcacauguagguuugaaug

SEQ ID NO: 752213 - RNA, 64 nt, Homo Sapiens
gacuuguguauauggucauaggcuuugggaagacaggacguaaaggaaaaugagagaaacaaaa

SEQ ID NO: 752214 - RNA, 64 nt, Homo Sapiens
uucuucauaccaaagucacuugagagaugcugucaggacguaucuggggcuucaagacaguagg

SEQ ID NO: 752215 - RNA, 64 nt, Homo Sapiens
uuccauguuuauuuguuaaauccacaguuaauuaaggacguaugcaaagagacagacuauuaac

SEQ ID NO: 752216 - RNA, 64 nt, Homo Sapiens
gcuaggaaguguuacuaucuuuuugauuuccucuaggacguauaggaaacuaagguuagaaaca

SEQ ID NO: 752217 - RNA, 64 nt, Homo Sapiens
aaucaaaaucucuccacuuucagcugucuuuuggaggacguacguaauaagguuuuaauuuagu

SEQ ID NO: 752218 - RNA, 64 nt, Homo Sapiens
uugccaugucccccagacccugcuucugauacuaaggacguauccaggaguaccacaaccacca

SEQ ID NO: 752219 - RNA, 64 nt, Homo Sapiens
ggucagccuggcuguguggcgcuggucccagcugaggacguacucacauaggcgagguugagcu

SEQ ID NO: 752220 - RNA, 64 nt, Homo Sapiens
auuucacuggaucagcaaugacugcucaagcuggaggacguagaagauuugugaauccuauaau

SEQ ID NO: 752221 - RNA, 64 nt, Homo Sapiens
uuagcauggaucaccaaucaacugagcuccagaaaggacguaacauggaauuuuuucaucuuau

SEQ ID NO: 752222 - RNA, 54 nt, Homo Sapiens
cagaaccugacaccagcuccgagaaggacguaaacacgagaagagcuaggguaa

SEQ ID NO: 752223 - RNA, 64 nt, Homo Sapiens
auuuacagucaaucuaugagugagggaccaaaaaaggacguaaauuaaaauucucuuuggucau

SEQ ID NO: 752224 - RNA, 64 nt, Homo Sapiens
uauuuaacuugcacauuuuuuguuguuguucuuuaggacguauugucuaaaucuguaggcauug

SEQ ID NO: 752225 - RNA, 64 nt, Homo Sapiens
gcagagaagagaacauuuuuaaccgggaagugggaggacguagacgggacaccagugaaacuug

SEQ ID NO: 752226 - RNA, 64 nt, Homo Sapiens
cauuucauuuaucaaauauacuuagauacugaagaggacguaguaagugcccaguucuugauuu

SEQ ID NO: 752227 - RNA, 64 nt, Homo Sapiens
accugcagaguaaacaaucucagaaguaucgacuaggacguaaauagcaguuccuuauauaaag

SEQ ID NO: 752228 - RNA, 64 nt, Homo Sapiens
uaggccuuccuguaaacagaagcaugaggugaacaggacguaguuuacuggaaaguuacccaau

SEQ ID NO: 752229 - RNA, 64 nt, Homo Sapiens
agacugcaaaucaaugaagguauuggcauuguuaaggacguagcguagacaacagcagucauaa

SEQ ID NO: 752230 - RNA, 64 nt, Homo Sapiens
auuaaaaaauuacaauuaaauguccaugcaagcaaggacguaaacuggauuuugcagauuuucc

SEQ ID NO: 752231 - RNA, 64 nt, Homo Sapiens
gugugacugaaugguggcuaagcaugaggaaacgaggacguaggugaggugucggaacgcugaa

SEQ ID NO: 752232 - RNA, 64 nt, Homo Sapiens
caauauccugcugcugggaaaguuuacagccuacaggacguacauuucaggagaagggagcaua

SEQ ID NO: 752233 - RNA, 64 nt, Homo Sapiens
caugccuccugcauuucgcuauguaagucccaucaggacguagucaguguggccagggguggcc

SEQ ID NO: 752234 - RNA, 64 nt, Homo Sapiens
uauaauagguauauagaacagggagaaggaagauaggacguauuaguaaauuaugauguccagg

SEQ ID NO: 752235 - RNA, 64 nt, Homo Sapiens
guuauugaaaaugcagauggucuagaaggucuggaggacguagaacgagaccucuuucguuccu

SEQ ID NO: 752236 - RNA, 64 nt, Homo Sapiens
gggcuggcaugggugccgacccucgggucuucggaggacguaggaugagggacacuggccuggc

SEQ ID NO: 752237 - RNA, 64 nt, Homo Sapiens
ucauuuccuucuuucuucugaggccuuuucuuugaggacguaccugugcgugcguggcuggggg

SEQ ID NO: 752238 - RNA, 64 nt, Homo Sapiens
agauaccaauagagagguuuucuuaauuaacaaaaggacguaugccauggagaaacacacccgc

SEQ ID NO: 752239 - RNA, 64 nt, Homo Sapiens
gcugagggggaucugguucggcugcugucggaugaggacguagcgcucauggugcggcaggcuc

SEQ ID NO: 752240 - RNA, 64 nt, Homo Sapiens; identical to SEQ ID NO: 88546

SEQ ID NO: 752241 - RNA, 64 nt, Homo Sapiens; identical to SEQ ID NO: 88547

SEQ ID NO: 752242 - RNA, 51 nt, Homo Sapiens; identical to SEQ ID NO: 88548

SEQ ID NO: 752243 - RNA, 64 nt, Homo Sapiens; identical to SEQ ID NO: 88549

SEQ ID NO: 752244 - RNA, 64 nt, Homo Sapiens; identical to SEQ ID NO: 88550

SEQ ID NO: 752245 - RNA, 64 nt, Homo Sapiens; identical to SEQ ID NO: 88551

SEQ ID NO: 752246 - RNA, 64 nt, Homo Sapiens; identical to SEQ ID NO: 88552

SEQ ID NO: 752247 - RNA, 64 nt, Homo Sapiens; identical to SEQ ID NO: 88553

SEQ ID NO: 752248 - RNA, 64 nt, Homo Sapiens; identical to SEQ ID NO: 88554

SEQ ID NO: 752249 - RNA, 64 nt, Homo Sapiens; identical to SEQ ID NO: 88555

SEQ ID NO: 752250 - RNA, 64 nt, Homo Sapiens; identical to SEQ ID NO: 88556

SEQ ID NO: 752251 - RNA, 64 nt, Homo Sapiens; identical to SEQ ID NO: 88557

SEQ ID NO: 752252 - RNA, 64 nt, Homo Sapiens; identical to SEQ ID NO: 88558

SEQ ID NO: 752253 - RNA, 64 nt, Homo Sapiens; identical to SEQ ID NO: 88559

SEQ ID NO: 752254 - RNA, 64 nt, Homo Sapiens; identical to SEQ ID NO: 88560

SEQ ID NO: 752255 - RNA, 64 nt, Homo Sapiens; identical to SEQ ID NO: 88561

SEQ ID NO: 752256 - RNA, 64 nt, Homo Sapiens; identical to SEQ ID NO: 88562

SEQ ID NO: 752257 - RNA, 64 nt, Homo Sapiens; identical to SEQ ID NO: 88563

SEQ ID NO: 752258 - RNA, 64 nt, Homo Sapiens; identical to SEQ ID NO: 88564

SEQ ID NO: 752259 - RNA, 64 nt, Homo Sapiens; identical to SEQ ID NO: 88565

SEQ ID NO: 752260 - RNA, 64 nt, Homo Sapiens; identical to SEQ ID NO: 88566

SEQ ID NO: 752261 - RNA, 64 nt, Homo Sapiens; identical to SEQ ID NO: 88567

SEQ ID NO: 752262 - RNA, 64 nt, Homo Sapiens; identical to SEQ ID NO: 88568

SEQ ID NO: 752263 - RNA, 64 nt, Homo Sapiens; identical to SEQ ID NO: 88569

SEQ ID NO: 752264 - RNA, 64 nt, Homo Sapiens; identical to SEQ ID NO: 88570

SEQ ID NO: 752265 - RNA, 64 nt, Homo Sapiens; identical to SEQ ID NO: 88571

SEQ ID NO: 752266 - RNA, 64 nt, Homo Sapiens; identical to SEQ ID NO: 88572

SEQ ID NO: 752267 - RNA, 64 nt, Homo Sapiens; identical to SEQ ID NO: 88573

SEQ ID NO: 752268 - RNA, 64 nt, Homo Sapiens; identical to SEQ ID NO: 88574

SEQ ID NO: 752269 - RNA, 64 nt, Homo Sapiens; identical to SEQ ID NO: 88575

SEQ ID NO: 752270 - RNA, 64 nt, Homo Sapiens; identical to SEQ ID NO: 88576

SEQ ID NO: 752271 - RNA, 64 nt, Homo Sapiens; identical to SEQ ID NO: 88577

SEQ ID NO: 752272 - RNA, 64 nt, Homo Sapiens; identical to SEQ ID NO: 88578

SEQ ID NO: 752273 - RNA, 64 nt, Homo Sapiens; identical to SEQ ID NO: 88579

SEQ ID NO: 752274 - RNA, 64 nt, Homo Sapiens; identical to SEQ ID NO: 88580

SEQ ID NO: 752275 - RNA, 64 nt, Homo Sapiens; identical to SEQ ID NO: 88581

SEQ ID NO: 752276 - RNA, 64 nt, Homo Sapiens; identical to SEQ ID NO: 88582

SEQ ID NO: 752277 - RNA, 64 nt, Homo Sapiens; identical to SEQ ID NO: 88583

SEQ ID NO: 752278 - RNA, 64 nt, Homo Sapiens; identical to SEQ ID NO: 88584

SEQ ID NO: 752279 - RNA, 64 nt, Homo Sapiens; identical to SEQ ID NO: 88585

SEQ ID NO: 752280 - RNA, 64 nt, Homo Sapiens; identical to SEQ ID NO: 88586

SEQ ID NO: 752281 - RNA, 64 nt, Homo Sapiens; identical to SEQ ID NO: 88587

SEQ ID NO: 752282 - RNA, 64 nt, Homo Sapiens; identical to SEQ ID NO: 88588

SEQ ID NO: 752283 - RNA, 64 nt, Homo Sapiens; identical to SEQ ID NO: 88589

SEQ ID NO: 752284 - RNA, 64 nt, Homo Sapiens; identical to SEQ ID NO: 88590

SEQ ID NO: 752285 - RNA, 64 nt, Homo Sapiens; identical to SEQ ID NO: 88591

SEQ ID NO: 752286 - RNA, 64 nt, Homo Sapiens; identical to SEQ ID NO: 88592

SEQ ID NO: 752287 - RNA, 64 nt, Homo Sapiens; identical to SEQ ID NO: 88593

SEQ ID NO: 752288 - RNA, 64 nt, Homo Sapiens; identical to SEQ ID NO: 110389

SEQ ID NO: 752289 - RNA, 64 nt, Homo Sapiens; identical to SEQ ID NO: 110390

SEQ ID NO: 752290 - RNA, 64 nt, Homo Sapiens; identical to SEQ ID NO: 110391

SEQ ID NO: 752291 - RNA, 64 nt, Homo Sapiens; identical to SEQ ID NO: 110392

SEQ ID NO: 752292 - RNA, 64 nt, Homo Sapiens; identical to SEQ ID NO: 110393

SEQ ID NO: 752293 - RNA, 63 nt, Homo Sapiens; identical to SEQ ID NO: 110394

SEQ ID NO: 752294 - RNA, 60 nt, Homo Sapiens; identical to SEQ ID NO: 110395

SEQ ID NO: 752295 - RNA, 64 nt, Homo Sapiens; identical to SEQ ID NO: 110396

SEQ ID NO: 752296 - RNA, 64 nt, Homo Sapiens; identical to SEQ ID NO: 110397

SEQ ID NO: 752297 - RNA, 64 nt, Homo Sapiens; identical to SEQ ID NO: 110398

SEQ ID NO: 752298 - RNA, 64 nt, Homo Sapiens; identical to SEQ ID NO: 110399

SEQ ID NO: 752299 - RNA, 64 nt, Homo Sapiens; identical to SEQ ID NO: 110400

SEQ ID NO: 752300 - RNA, 64 nt, Homo Sapiens; identical to SEQ ID NO: 110401

SEQ ID NO: 752301 - RNA, 58 nt, Homo Sapiens; identical to SEQ ID NO: 110402

SEQ ID NO: 752302 - RNA, 64 nt, Homo Sapiens; identical to SEQ ID NO: 110403

SEQ ID NO: 752303 - RNA, 64 nt, Homo Sapiens; identical to SEQ ID NO: 110404

SEQ ID NO: 752304 - RNA, 64 nt, Homo Sapiens; identical to SEQ ID NO: 110405

SEQ ID NO: 752305 - RNA, 64 nt, Homo Sapiens; identical to SEQ ID NO: 110406

SEQ ID NO: 752306 - RNA, 64 nt, Homo Sapiens; identical to SEQ ID NO: 110407

SEQ ID NO: 752307 - RNA, 64 nt, Homo Sapiens; identical to SEQ ID NO: 110408

SEQ ID NO: 752308 - RNA, 64 nt, Homo Sapiens; identical to SEQ ID NO: 110409

SEQ ID NO: 752309 - RNA, 64 nt, Homo Sapiens; identical to SEQ ID NO: 110410

SEQ ID NO: 752310 - RNA, 64 nt, Homo Sapiens; identical to SEQ ID NO: 110411

SEQ ID NO: 752311 - RNA, 64 nt, Homo Sapiens; identical to SEQ ID NO: 110412

SEQ ID NO: 752312 - RNA, 64 nt, Homo Sapiens; identical to SEQ ID NO: 110413

SEQ ID NO: 752313 - RNA, 64 nt, Homo Sapiens; identical to SEQ ID NO: 110414

SEQ ID NO: 752314 - RNA, 64 nt, Homo Sapiens; identical to SEQ ID NO: 110415

SEQ ID NO: 752315 - RNA, 64 nt, Homo Sapiens; identical to SEQ ID NO: 110416

SEQ ID NO: 752316 - RNA, 64 nt, Homo Sapiens; identical to SEQ ID NO: 110417

SEQ ID NO: 752317 - RNA, 64 nt, Homo Sapiens; identical to SEQ ID NO: 110418

SEQ ID NO: 752318 - RNA, 64 nt, Homo Sapiens; identical to SEQ ID NO: 110419

SEQ ID NO: 752319 - RNA, 64 nt, Homo Sapiens; identical to SEQ ID NO: 110420

SEQ ID NO: 752320 - RNA, 64 nt, Homo Sapiens; identical to SEQ ID NO: 110421

SEQ ID NO: 752321 - RNA, 64 nt, Homo Sapiens; identical to SEQ ID NO: 110422

SEQ ID NO: 752322 - RNA, 64 nt, Homo Sapiens; identical to SEQ ID NO: 110423

SEQ ID NO: 752323 - RNA, 64 nt, Homo Sapiens; identical to SEQ ID NO: 110424

SEQ ID NO: 752324 - RNA, 64 nt, Homo Sapiens; identical to SEQ ID NO: 110425

SEQ ID NO: 752325 - RNA, 64 nt, Homo Sapiens; identical to SEQ ID NO: 110426

SEQ ID NO: 752326 - RNA, 64 nt, Homo Sapiens; identical to SEQ ID NO: 110427

SEQ ID NO: 752327 - RNA, 64 nt, Homo Sapiens; identical to SEQ ID NO: 110428

SEQ ID NO: 752328 - RNA, 64 nt, Homo Sapiens; identical to SEQ ID NO: 110429

SEQ ID NO: 752329 - RNA, 64 nt, Homo Sapiens; identical to SEQ ID NO: 110430

SEQ ID NO: 752330 - RNA, 64 nt, Homo Sapiens; identical to SEQ ID NO: 110431

SEQ ID NO: 752331 - RNA, 64 nt, Homo Sapiens; identical to SEQ ID NO: 110432

SEQ ID NO: 752332 - RNA, 64 nt, Homo Sapiens; identical to SEQ ID NO: 110433

SEQ ID NO: 752333 - RNA, 64 nt, Homo Sapiens; identical to SEQ ID NO: 110434

SEQ ID NO: 752334 - RNA, 64 nt, Homo Sapiens; identical to SEQ ID NO: 110435

SEQ ID NO: 752335 - RNA, 64 nt, Homo Sapiens; identical to SEQ ID NO: 110436

SEQ ID NO: 752336 - RNA, 64 nt, Homo Sapiens; identical to SEQ ID NO: 110437

SEQ ID NO: 752337 - RNA, 64 nt, Homo Sapiens; identical to SEQ ID NO: 110438

SEQ ID NO: 752338 - RNA, 64 nt, Homo Sapiens; identical to SEQ ID NO: 110439

SEQ ID NO: 752339 - RNA, 64 nt, Homo Sapiens; identical to SEQ ID NO: 206029

SEQ ID NO: 752340 - RNA, 64 nt, Homo Sapiens; identical to SEQ ID NO: 206030

SEQ ID NO: 752341 - RNA, 64 nt, Homo Sapiens; identical to SEQ ID NO: 206031

SEQ ID NO: 752342 - RNA, 64 nt, Homo Sapiens; identical to SEQ ID NO: 206032

SEQ ID NO: 752343 - RNA, 64 nt, Homo Sapiens; identical to SEQ ID NO: 206033

SEQ ID NO: 752344 - RNA, 64 nt, Homo Sapiens; identical to SEQ ID NO: 206034

SEQ ID NO: 752345 - RNA, 64 nt, Homo Sapiens; identical to SEQ ID NO: 206035

SEQ ID NO: 752346 - RNA, 64 nt, Homo Sapiens; identical to SEQ ID NO: 206036

SEQ ID NO: 752347 - RNA, 64 nt, Homo Sapiens; identical to SEQ ID NO: 206037

SEQ ID NO: 752348 - RNA, 64 nt, Homo Sapiens; identical to SEQ ID NO: 206038

SEQ ID NO: 752349 - RNA, 64 nt, Homo Sapiens; identical to SEQ ID NO: 206039

SEQ ID NO: 752350 - RNA, 64 nt, Homo Sapiens; identical to SEQ ID NO: 206040

SEQ ID NO: 752351 - RNA, 64 nt, Homo Sapiens; identical to SEQ ID NO: 206041

SEQ ID NO: 752352 - RNA, 64 nt, Homo Sapiens; identical to SEQ ID NO: 206042

SEQ ID NO: 752353 - RNA, 64 nt, Homo Sapiens; identical to SEQ ID NO: 206043

SEQ ID NO: 752354 - RNA, 64 nt, Homo Sapiens; identical to SEQ ID NO: 206044

SEQ ID NO: 752355 - RNA, 64 nt, Homo Sapiens; identical to SEQ ID NO: 206045

SEQ ID NO: 752356 - RNA, 64 nt, Homo Sapiens; identical to SEQ ID NO: 206046

SEQ ID NO: 752357 - RNA, 64 nt, Homo Sapiens; identical to SEQ ID NO: 206047

SEQ ID NO: 752358 - RNA, 64 nt, Homo Sapiens; identical to SEQ ID NO: 206048

SEQ ID NO: 752359 - RNA, 64 nt, Homo Sapiens; identical to SEQ ID NO: 206049

SEQ ID NO: 752360 - RNA, 64 nt, Homo Sapiens; identical to SEQ ID NO: 206050

SEQ ID NO: 752361 - RNA, 64 nt, Homo Sapiens; identical to SEQ ID NO: 206051

SEQ ID NO: 752362 - RNA, 64 nt, Homo Sapiens; identical to SEQ ID NO: 206052

SEQ ID NO: 752363 - RNA, 64 nt, Homo Sapiens; identical to SEQ ID NO: 206053

SEQ ID NO: 752364 - RNA, 64 nt, Homo Sapiens; identical to SEQ ID NO: 206054

SEQ ID NO: 752365 - RNA, 64 nt, Homo Sapiens; identical to SEQ ID NO: 206055

SEQ ID NO: 752366 - RNA, 64 nt, Homo Sapiens; identical to SEQ ID NO: 206056

SEQ ID NO: 752367 - RNA, 64 nt, Homo Sapiens; identical to SEQ ID NO: 206057

SEQ ID NO: 752368 - RNA, 64 nt, Homo Sapiens; identical to SEQ ID NO: 206058

SEQ ID NO: 752369 - RNA, 64 nt, Homo Sapiens; identical to SEQ ID NO: 206059

SEQ ID NO: 752370 - RNA, 64 nt, Homo Sapiens; identical to SEQ ID NO: 206060

SEQ ID NO: 752371 - RNA, 64 nt, Homo Sapiens; identical to SEQ ID NO: 206061

SEQ ID NO: 752372 - RNA, 64 nt, Homo Sapiens; identical to SEQ ID NO: 206062

SEQ ID NO: 752373 - RNA, 64 nt, Homo Sapiens; identical to SEQ ID NO: 206063

SEQ ID NO: 752374 - RNA, 64 nt, Homo Sapiens; identical to SEQ ID NO: 206064

SEQ ID NO: 752375 - RNA, 64 nt, Homo Sapiens; identical to SEQ ID NO: 206065

SEQ ID NO: 752376 - RNA, 64 nt, Homo Sapiens; identical to SEQ ID NO: 206066

SEQ ID NO: 752377 - RNA, 64 nt, Homo Sapiens; identical to SEQ ID NO: 206067

SEQ ID NO: 752378 - RNA, 64 nt, Homo Sapiens; identical to SEQ ID NO: 206068

SEQ ID NO: 752379 - RNA, 64 nt, Homo Sapiens; identical to SEQ ID NO: 206069

SEQ ID NO: 752380 - RNA, 64 nt, Homo Sapiens; identical to SEQ ID NO: 206070

SEQ ID NO: 752381 - RNA, 64 nt, Homo Sapiens; identical to SEQ ID NO: 206071

SEQ ID NO: 752382 - RNA, 64 nt, Homo Sapiens; identical to SEQ ID NO: 206072

SEQ ID NO: 752383 - RNA, 64 nt, Homo Sapiens; identical to SEQ ID NO: 206073

SEQ ID NO: 752384 - RNA, 64 nt, Homo Sapiens; identical to SEQ ID NO: 206074

SEQ ID NO: 752385 - RNA, 64 nt, Homo Sapiens; identical to SEQ ID NO: 206075

SEQ ID NO: 752386 - RNA, 64 nt, Homo Sapiens; identical to SEQ ID NO: 206076

SEQ ID NO: 752387 - RNA, 64 nt, Homo Sapiens; identical to SEQ ID NO: 206077

SEQ ID NO: 752388 - RNA, 64 nt, Homo Sapiens; identical to SEQ ID NO: 206078

SEQ ID NO: 752389 - RNA, 64 nt, Homo Sapiens; identical to SEQ ID NO: 199302

SEQ ID NO: 752390 - RNA, 64 nt, Homo Sapiens; identical to SEQ ID NO: 199303

SEQ ID NO: 752391 - RNA, 64 nt, Homo Sapiens; identical to SEQ ID NO: 199304

SEQ ID NO: 752392 - RNA, 64 nt, Homo Sapiens; identical to SEQ ID NO: 199305

SEQ ID NO: 752393 - RNA, 64 nt, Homo Sapiens; identical to SEQ ID NO: 199306

SEQ ID NO: 752394 - RNA, 64 nt, Homo Sapiens; identical to SEQ ID NO: 199307

SEQ ID NO: 752395 - RNA, 64 nt, Homo Sapiens; identical to SEQ ID NO: 199308

SEQ ID NO: 752396 - RNA, 64 nt, Homo Sapiens; identical to SEQ ID NO: 199309

SEQ ID NO: 752397 - RNA, 64 nt, Homo Sapiens; identical to SEQ ID NO: 199310

SEQ ID NO: 752398 - RNA, 64 nt, Homo Sapiens; identical to SEQ ID NO: 199311

SEQ ID NO: 752399 - RNA, 64 nt, Homo Sapiens
aaagacuauuuugauaaauuuauaaauauauaaaauuauguaaaaacuacacuauauuuugauu

SEQ ID NO: 752400 - RNA, 64 nt, Homo Sapiens
uaugauuuaggaaucaaaaacuaaaauaaguggaauuauguaucuuuucuaaaguuaaaaaagu

SEQ ID NO: 752401 - RNA, 64 nt, Homo Sapiens
auacuauuauaaguuagguugacaaaugauguugauuauguaaggauauacuuagcuacauuuu

SEQ ID NO: 752402 - RNA, 64 nt, Homo Sapiens
aauauuuaacaguucaaucucaauaagaccucgcauuauguaugaauguuauucacugacuaga

SEQ ID NO: 752403 - RNA, 64 nt, Homo Sapiens
gaagugccaaaauaguuaucuucuaaauaaacacauuauguaaggucugucauuaauaagguau

SEQ ID NO: 752404 - RNA, 64 nt, Homo Sapiens
acuuguggaacuuugauaaauaacugaauuaaaaauuauguaauguuccguagucuaagauaac

SEQ ID NO: 752405 - RNA, 64 nt, Homo Sapiens
auuagcuuaaauaagcagcagaagguuaguuuuaauuauguagcuucuguuaauauuaaguguu

SEQ ID NO: 752406 - RNA, 64 nt, Homo Sapiens
auucugcugguaaaugugacaguuaaaauggugcauuauguauauauauuauaauuuagaaaua

SEQ ID NO: 752407 - RNA, 64 nt, Homo Sapiens
ugauaacauuucaaacccugaaggacagugacuuauuauguaaguucaauuuuguaaguucauu

SEQ ID NO: 752408 - RNA, 64 nt, Homo Sapiens
gugacuuauuauguaaguucaauuuuguaaguucauuauguaagauccuuuuuuuuuucauaau

SEQ ID NO: 752409 - RNA, 64 nt, Homo Sapiens
cguauaguauucauuuuuaaaugcaugauuguacauuauguauagacgacaauguuuuuaauuu

SEQ ID NO: 752410 - RNA, 64 nt, Homo Sapiens
ugaauuauuuuggagaugagaaaacguucauuuaauuauguauuuucugaaaacucucauuuua

SEQ ID NO: 752411 - RNA, 64 nt, Homo Sapiens
uagagucgggucccguuguggaugugaaacaugaauuauguaaucaggcuauauguauaaggug

SEQ ID NO: 752412 - RNA, 64 nt, Homo Sapiens
ugcuagacacuuuucuuucccagccgaaaagccuauuauguaauuuuuacauucauaauuuuaa

SEQ ID NO: 752413 - RNA, 64 nt, Homo Sapiens
uguuuuccaagcaguguaaauacuuuuuccugugauuauguauagccuuggaauggcaccuuuu

SEQ ID NO: 752414 - RNA, 64 nt, Homo Sapiens
cuuguauuuuucuguauguguguauauauauauaauuauguacuucuggcaauucuaucuguau

SEQ ID NO: 752415 - RNA, 64 nt, Homo Sapiens
uuuaacuaaucagaucuuuuuacaguauccauuuauuauguaaugcuucuuagaaaagaaucuu

SEQ ID NO: 752416 - RNA, 64 nt, Homo Sapiens
gcuagcggcaguauucuguacaguagacacaagaauuauguacgccuuuuaucaaagacuuaag

SEQ ID NO: 752417 - RNA, 64 nt, Homo Sapiens
uugaaaagacagacuaugguguaaccaugauucuauuauguauugguacgucuguagaccaaga

SEQ ID NO: 752418 - RNA, 64 nt, Homo Sapiens
aucugcugaaaggacaaaugugcuugguuuuacuauuauguaaucacaacuuacuuucugcuug

SEQ ID NO: 752419 - RNA, 64 nt, Homo Sapiens
aucacaacuuacuuucugcuuguaguugcuuaaaauuauguauuuugucuugggcugcaauuug

SEQ ID NO: 752420 - RNA, 64 nt, Homo Sapiens
auuuuguuucuuggaacccaaugauccuaagaaaauuauguacuuuuaccugaaaauuaaaacc

SEQ ID NO: 752421 - RNA, 64 nt, Homo Sapiens
augauaaucguuagucaucauuaaggaacuaaguauuauguacuccuugccuuggaauacucua

SEQ ID NO: 752422 - RNA, 64 nt, Homo Sapiens
aucuaagagcuuuucaguuucagggaggagguggauuauguaaugacugauuccucauuuauaa

SEQ ID NO: 752423 - RNA, 64 nt, Homo Sapiens
ugaaaguaaaaaucagggcauauaagugaaaagcauuauguacugaauaugguacagauuguuc

SEQ ID NO: 752424 - RNA, 64 nt, Homo Sapiens
cugaaauacuuugcuucagaauuggaauguuuauauuauguagaaaucuucaaagguagcauua

SEQ ID NO: 752425 - RNA, 64 nt, Homo Sapiens
uaggaaaauauuuuauucuguaauucauguuaagauuauguaugguuugcauuuuaaggggauu

SEQ ID NO: 752426 - RNA, 64 nt, Homo Sapiens
cuacaggcagaugggacuaaguguuuaugggacaauuauguacuauuuaacuuaaauauauuuu

SEQ ID NO: 752427 - RNA, 64 nt, Homo Sapiens
aauguguugagcaaguugcagugcaaacacugucauuauguagagaguuuauaugcacauaaua

SEQ ID NO: 752428 - RNA, 64 nt, Homo Sapiens
uauuuuaauugagcauuuauauggauaaucauacauuauguaagcccauauguauuuacaucca

SEQ ID NO: 752429 - RNA, 64 nt, Homo Sapiens
uuuuuauaucucugugguuuuacaaagaccaaggauuauguauaaaguagaucaugcagugaca

SEQ ID NO: 752430 - RNA, 64 nt, Homo Sapiens
cauaauuuugcuguuguuacuguuuaaaguauguauuauguaugaaaaauuuagguuuuauuca

SEQ ID NO: 752431 - RNA, 64 nt, Homo Sapiens
cuuccuaauaucauaaacauauuguggaaauuaaauuauguaagguaauggccauuauuguucc

SEQ ID NO: 752432 - RNA, 64 nt, Homo Sapiens
uaaagugaguguuuaagaaaauuuugaacuuuaaauuauguauuacucuuaaauaguaccaaac

SEQ ID NO: 752433 - RNA, 64 nt, Homo Sapiens
uuugucauauguauuuuguccuuaaucuaagaaaauuauguauuaagaaaauuuacuguaacuu

SEQ ID NO: 752434 - RNA, 64 nt, Homo Sapiens
cgugcaugcgugcgcgcacagcaucuauauguguauuauguaugaauuuaccuacucuauguau

SEQ ID NO: 752435 - RNA, 64 nt, Homo Sapiens
caaacugaaauuaucugcuucuuugauaauuuguauuauguaucuuaaaauacuuugcgccuug

SEQ ID NO: 752436 - RNA, 64 nt, Homo Sapiens
cgcucaggcaugacuacgcuagaagaugaauuucauuauguaaaagaagaaauuuauaaugaaa

SEQ ID NO: 752437 - RNA, 64 nt, Homo Sapiens
aaagaauaugaaacauagauaaaacaucuuugaaauuauguaaauuauguaaauuaucaggcaa

SEQ ID NO: 752438 - RNA, 64 nt, Homo Sapiens
gaaacauagauaaaacaucuuugaaauuauguaaauuauguaaauuaucaggcaaauuugcauu

SEQ ID NO: 752439 - RNA, 64 nt, Homo Sapiens
cucuaauguaguuucuuugauuaccgacuacacaauuauguaccaucacaguauuaguggaaaa

SEQ ID NO: 752440 - RNA, 64 nt, Homo Sapiens
aauucuccauuccuccaauguaacucuuaaaauuauuauguauguguguguguuuuacuuuuug

SEQ ID NO: 752441 - RNA, 64 nt, Homo Sapiens
guauuuagaaaaagcccuuaugugaaaauguguaauuauguacgucauaggauuacccucuaag

SEQ ID NO: 752442 - RNA, 64 nt, Homo Sapiens
aaauaucaaagcaagauaaguaucacucagaaacauuauguaaaugcuaccugacucacaucug

SEQ ID NO: 752443 - RNA, 64 nt, Homo Sapiens
ucuuuaacuucuuucuuuccuaggauuaaaguauauuauguaugugccaauuauuuuaaauuac

SEQ ID NO: 752444 - RNA, 64 nt, Homo Sapiens
uucucuugccuucauuauuuuuuucacugccuucauuauguaucuccuacauuuuguagguuuu

SEQ ID NO: 752445 - RNA, 64 nt, Homo Sapiens
uucaguucauguaguucuuuaauagaaagcugcuauuauguauauugucauuugugaaggaagu

SEQ ID NO: 752446 - RNA, 64 nt, Homo Sapiens
uguuguguucuuuguauucuugagaugauaauauauuauguauuugaauuccugaaaaauggaa

SEQ ID NO: 752447 - RNA, 64 nt, Homo Sapiens
acaaaaagucuggaaacuuucauaucaauaauugauuauguauuaacugaaacaaaagacuaga

SEQ ID NO: 752448 - RNA, 64 nt, Homo Sapiens
aacaaaagacuagagaaagacacagugggaauugauuauguauuaacugaggaauaaaagacug

SEQ ID NO: 752449 - RNA, 64 nt, Homo Sapiens
acuguuuuacaguaucaaaaaucuuuuugcauuuauuauguaaacuaaaaauuuagaaaauguu

SEQ ID NO: 752450 - RNA, 64 nt, Homo Sapiens
uugguuucauuuuauucuacauguauaaccugccauuauguaauguggaaagagauucuuuaaa

SEQ ID NO: 752451 - RNA, 64 nt, Homo Sapiens
uuaaaaaauauuccuuuuuacuuuucuguaauacauuauguaauuccuguuuauuuuuccaaug

SEQ ID NO: 752452 - RNA, 64 nt, Homo Sapiens
uuuguaacuaugaauauuuaggcauguacuuucaauuauguagcaguuucuuaauaaaugauau

SEQ ID NO: 752453 - RNA, 64 nt, Homo Sapiens
auggaaugugaaaauuauuuuuggaaauguccucauuauguagaguaaugugggccaaugcauu

SEQ ID NO: 752454 - RNA, 64 nt, Homo Sapiens
aaauguauguuuacaggguuuuuacacuuguacaauuauguagucuugccuuuacuagauauuc

SEQ ID NO: 752455 - RNA, 64 nt, Homo Sapiens
caaagugucugccuguguacauguacuuguauugauuauguaguucaguaagaugugcccaagu

SEQ ID NO: 752456 - RNA, 64 nt, Homo Sapiens
aaguagguuaccauuuugaggcaguuggauauaaauuauguaaauauguaugauuaugauuuuu

SEQ ID NO: 752457 - RNA, 64 nt, Homo Sapiens
uaugugaacuuuugagagagacuguaaauguaauauuauguaauugcugccuuuaugguauaaa

SEQ ID NO: 752458 - RNA, 64 nt, Homo Sapiens
agauguuuuucuuaaucuagauuaauccuuugucauuauguagcgcuuuuuauauauuuuugau

SEQ ID NO: 752459 - RNA, 64 nt, Homo Sapiens
agauaccaaauuagggaaguaggauaaugcaaaaauuauguaauauuuagauguauaaugaaaa

SEQ ID NO: 752460 - RNA, 64 nt, Homo Sapiens
gaugauuuuaacaacuuuuuagaguugcauucuuauuauguaagaaacuauuuaagaguuuaaa

SEQ ID NO: 752461 - RNA, 64 nt, Homo Sapiens
acugcagcaaugauauuucagucugugaacuucuauuauguaaagaaucucuaguguacaaagg

SEQ ID NO: 752462 - RNA, 64 nt, Homo Sapiens
cuauauuuauggggccauugcuuaaagauuauaaauuauguaaauacauuaauaaauucuaagu

SEQ ID NO: 752463 - RNA, 64 nt, Homo Sapiens; identical to SEQ ID NO: 544427

SEQ ID NO: 752464 - RNA, 64 nt, Homo Sapiens; identical to SEQ ID NO: 544428

SEQ ID NO: 752465 - RNA, 64 nt, Homo Sapiens; identical to SEQ ID NO: 474087

SEQ ID NO: 752466 - RNA, 64 nt, Homo Sapiens; identical to SEQ ID NO: 474088

SEQ ID NO: 752467 - RNA, 64 nt, Homo Sapiens; identical to SEQ ID NO: 474089

SEQ ID NO: 752468 - RNA, 64 nt, Homo Sapiens; identical to SEQ ID NO: 474090

SEQ ID NO: 752469 - RNA, 64 nt, Homo Sapiens; identical to SEQ ID NO: 474091

SEQ ID NO: 752470 - RNA, 64 nt, Homo Sapiens; identical to SEQ ID NO: 474092

SEQ ID NO: 752471 - RNA, 64 nt, Homo Sapiens; identical to SEQ ID NO: 474093

SEQ ID NO: 752472 - RNA, 64 nt, Homo Sapiens; identical to SEQ ID NO: 474094

SEQ ID NO: 752473 - RNA, 64 nt, Homo Sapiens; identical to SEQ ID NO: 474095

SEQ ID NO: 752474 - RNA, 64 nt, Homo Sapiens; identical to SEQ ID NO: 474096

SEQ ID NO: 752475 - RNA, 64 nt, Homo Sapiens; identical to SEQ ID NO: 474097

SEQ ID NO: 752476 - RNA, 64 nt, Homo Sapiens; identical to SEQ ID NO: 474098

SEQ ID NO: 752477 - RNA, 64 nt, Homo Sapiens; identical to SEQ ID NO: 474099

SEQ ID NO: 752478 - RNA, 64 nt, Homo Sapiens; identical to SEQ ID NO: 474100

SEQ ID NO: 752479 - RNA, 64 nt, Homo Sapiens; identical to SEQ ID NO: 474101

SEQ ID NO: 752480 - RNA, 64 nt, Homo Sapiens; identical to SEQ ID NO: 474102

SEQ ID NO: 752481 - RNA, 64 nt, Homo Sapiens
uaccuuaaaaccaaaaugaaacacaaaaauuaauccuuaauaaugauagcaagugaucuuucuu

SEQ ID NO: 752482 - RNA, 64 nt, Homo Sapiens
uuuuuuuaaaaaagcaccuuuuuuuguuguuuccccuuaauaaaagagguuucuaauuuauguu

SEQ ID NO: 752483 - RNA, 64 nt, Homo Sapiens
uuuuuuaagggaugugccuaccccuuuuuggggaccuuaauauaagagugacaaaguugauuca

SEQ ID NO: 752484 - RNA, 64 nt, Homo Sapiens
aauucuacagcuuuggacagagcugucacacuaaccuuaauaaguaucuacacguguauuuugu

SEQ ID NO: 752485 - RNA, 64 nt, Homo Sapiens
gggagcuaacauuaauuaugcauguacuauauuuccuuaauaugagagauaauuuuuuaauugc

SEQ ID NO: 752486 - RNA, 64 nt, Homo Sapiens
cuauuuggagauucagugcauaacuaaguauuuuccuuaauacuaaagauuuuaaauaauaaau

SEQ ID NO: 752487 - RNA, 64 nt, Homo Sapiens
uggacguaaucuccacagucccagaaauuagaaaccuuaauaugaauuuauuaguuaauauauc

SEQ ID NO: 752488 - RNA, 53 nt, Homo Sapiens
aaugguugccuuaaagaaagcugccuuaauaaguucuguuucaucaaaaguga

SEQ ID NO: 752489 - RNA, 64 nt, Homo Sapiens
ucauaauugcuuucuagcaaucagcuuuuauuugccuuaauauaagcuuuuaagcaguuaucua

SEQ ID NO: 752490 - RNA, 64 nt, Homo Sapiens
ggucacugugaggcugcauauuucagaaagauguccuuaauaagggaagucauguauaagaugu

SEQ ID NO: 752491 - RNA, 64 nt, Homo Sapiens
gggauauuguuaugcaauuuuaugccaugacugaccuuaauauucuucccaggcugccucacuu

SEQ ID NO: 752492 - RNA, 64 nt, Homo Sapiens
uuuauaaaauuguugacauuuuuaguuauacauaccuuaauaguuauuuuuauaauuucaugga

SEQ ID NO: 752493 - RNA, 64 nt, Homo Sapiens
gaccugugacaugcccagcaagggaccugugacuccuuaauaagaauaugucacacuccuuaau

SEQ ID NO: 752494 - RNA, 64 nt, Homo Sapiens
gaccugugacuccuuaauaagaauaugucacacuccuuaauagguucuaccaagacacucaaug

SEQ ID NO: 752495 - RNA, 64 nt, Homo Sapiens
uaaggaaggugagucuacuuucccugaggcuuuggggucagaguauauguuguuuggagaaaga

SEQ ID NO: 752496 - RNA, 64 nt, Homo Sapiens
gauuucagggaguucccucauuuguaaaaugagggggucagagcaggugauauccauguuucuu

SEQ ID NO: 752497 - RNA, 64 nt, Homo Sapiens
ugggccugauucaggugcagugggcacuccugaagggucagagcggcaucugccaggcagcccc

SEQ ID NO: 752498 - RNA, 64 nt, Homo Sapiens
aggcuggacgggaggguagccuuguggcugagaggggucagacuagguggcacaggggcuccug

SEQ ID NO: 752499 - RNA, 64 nt, Homo Sapiens
aacuggaguguagacagcauggagggagucagaagggucagaugggucuguguggcaggauggg

SEQ ID NO: 752500 - RNA, 64 nt, Homo Sapiens
cccaggccagcugggcucuaacggcagucucaaugggucagaaaaggugacggagcaucguggc

SEQ ID NO: 752501 - RNA, 64 nt, Homo Sapiens
caggaccggguggaagggauucucuuuuucuccagggucagaaaagaccuggacacaggccugc

SEQ ID NO: 752502 - RNA, 64 nt, Homo Sapiens
aaacaaaacaaaacaaaacuauacuugaacaaaagggucagaggaccuguauuuaagcaaauac

SEQ ID NO: 752503 - RNA, 64 nt, Homo Sapiens
aaggaaaaagcuccaugugccucuuugucugcgugggucagaagaguugugcacgcagauuagc

SEQ ID NO: 752504 - RNA, 64 nt, Homo Sapiens
ugacucacugcccauaguuucagaaacagauggugggucagauuaaaaacuauucuuagcugua

SEQ ID NO: 752505 - RNA, 64 nt, Homo Sapiens
ucccauucagacgccccucuguacacuaugacgagggucagauuaagccugucuauaaaaucug

SEQ ID NO: 752506 - RNA, 64 nt, Homo Sapiens; identical to SEQ ID NO: 311803

SEQ ID NO: 752507 - RNA, 64 nt, Homo Sapiens; identical to SEQ ID NO: 311804

SEQ ID NO: 752508 - RNA, 64 nt, Homo Sapiens; identical to SEQ ID NO: 311805

SEQ ID NO: 752509 - RNA, 64 nt, Homo Sapiens; identical to SEQ ID NO: 311806

SEQ ID NO: 752510 - RNA, 64 nt, Homo Sapiens; identical to SEQ ID NO: 311807

SEQ ID NO: 752511 - RNA, 64 nt, Homo Sapiens; identical to SEQ ID NO: 311808

SEQ ID NO: 752512 - RNA, 64 nt, Homo Sapiens; identical to SEQ ID NO: 311809

SEQ ID NO: 752513 - RNA, 64 nt, Homo Sapiens; identical to SEQ ID NO: 311810

SEQ ID NO: 752514 - RNA, 64 nt, Homo Sapiens; identical to SEQ ID NO: 311811

SEQ ID NO: 752515 - RNA, 64 nt, Homo Sapiens; identical to SEQ ID NO: 311812

SEQ ID NO: 752516 - RNA, 64 nt, Homo Sapiens; identical to SEQ ID NO: 311813

SEQ ID NO: 752517 - RNA, 64 nt, Homo Sapiens; identical to SEQ ID NO: 311814

SEQ ID NO: 752518 - RNA, 64 nt, Homo Sapiens; identical to SEQ ID NO: 311815

SEQ ID NO: 752519 - RNA, 64 nt, Homo Sapiens; identical to SEQ ID NO: 311816

SEQ ID NO: 752520 - RNA, 64 nt, Homo Sapiens; identical to SEQ ID NO: 311817

SEQ ID NO: 752521 - RNA, 64 nt, Homo Sapiens; identical to SEQ ID NO: 311818

SEQ ID NO: 752522 - RNA, 64 nt, Homo Sapiens; identical to SEQ ID NO: 311819

SEQ ID NO: 752523 - RNA, 64 nt, Homo Sapiens; identical to SEQ ID NO: 311820

SEQ ID NO: 752524 - RNA, 64 nt, Homo Sapiens; identical to SEQ ID NO: 311821

SEQ ID NO: 752525 - RNA, 64 nt, Homo Sapiens; identical to SEQ ID NO: 311822

SEQ ID NO: 752526 - RNA, 64 nt, Homo Sapiens; identical to SEQ ID NO: 311823

SEQ ID NO: 752527 - RNA, 64 nt, Homo Sapiens; identical to SEQ ID NO: 311824

SEQ ID NO: 752528 - RNA, 64 nt, Homo Sapiens; identical to SEQ ID NO: 311825

SEQ ID NO: 752529 - RNA, 64 nt, Homo Sapiens; identical to SEQ ID NO: 311824

SEQ ID NO: 752530 - RNA, 64 nt, Homo Sapiens; identical to SEQ ID NO: 311824

SEQ ID NO: 752531 - RNA, 64 nt, Homo Sapiens; identical to SEQ ID NO: 311828

SEQ ID NO: 752532 - RNA, 64 nt, Homo Sapiens; identical to SEQ ID NO: 311829

SEQ ID NO: 752533 - RNA, 64 nt, Homo Sapiens; identical to SEQ ID NO: 311830

SEQ ID NO: 752534 - RNA, 64 nt, Homo Sapiens; identical to SEQ ID NO: 311831

SEQ ID NO: 752535 - RNA, 64 nt, Homo Sapiens; identical to SEQ ID NO: 311832

SEQ ID NO: 752536 - RNA, 64 nt, Homo Sapiens; identical to SEQ ID NO: 311833

SEQ ID NO: 752537 - RNA, 64 nt, Homo Sapiens; identical to SEQ ID NO: 311834

SEQ ID NO: 752538 - RNA, 64 nt, Homo Sapiens; identical to SEQ ID NO: 311835

SEQ ID NO: 752539 - RNA, 64 nt, Homo Sapiens; identical to SEQ ID NO: 311836

SEQ ID NO: 752540 - RNA, 64 nt, Homo Sapiens; identical to SEQ ID NO: 311837

SEQ ID NO: 752541 - RNA, 64 nt, Homo Sapiens; identical to SEQ ID NO: 311838

SEQ ID NO: 752542 - RNA, 64 nt, Homo Sapiens; identical to SEQ ID NO: 311839

SEQ ID NO: 752543 - RNA, 64 nt, Homo Sapiens; identical to SEQ ID NO: 311840

SEQ ID NO: 752544 - RNA, 64 nt, Homo Sapiens; identical to SEQ ID NO: 311841

SEQ ID NO: 752545 - RNA, 64 nt, Homo Sapiens; identical to SEQ ID NO: 311842

SEQ ID NO: 752546 - RNA, 64 nt, Homo Sapiens; identical to SEQ ID NO: 311843

SEQ ID NO: 752547 - RNA, 64 nt, Homo Sapiens; identical to SEQ ID NO: 311844

SEQ ID NO: 752548 - RNA, 64 nt, Homo Sapiens; identical to SEQ ID NO: 311845

SEQ ID NO: 752549 - RNA, 64 nt, Homo Sapiens; identical to SEQ ID NO: 311846

SEQ ID NO: 752550 - RNA, 64 nt, Homo Sapiens; identical to SEQ ID NO: 233973

SEQ ID NO: 752551 - RNA, 64 nt, Homo Sapiens; identical to SEQ ID NO: 233974

SEQ ID NO: 752552 - RNA, 64 nt, Homo Sapiens; identical to SEQ ID NO: 233975

SEQ ID NO: 752553 - RNA, 64 nt, Homo Sapiens; identical to SEQ ID NO: 233976

SEQ ID NO: 752554 - RNA, 64 nt, Homo Sapiens; identical to SEQ ID NO: 233977

SEQ ID NO: 752555 - RNA, 64 nt, Homo Sapiens; identical to SEQ ID NO: 233978

SEQ ID NO: 752556 - RNA, 64 nt, Homo Sapiens; identical to SEQ ID NO: 233979

SEQ ID NO: 752557 - RNA, 64 nt, Homo Sapiens; identical to SEQ ID NO: 233980

SEQ ID NO: 752558 - RNA, 64 nt, Homo Sapiens; identical to SEQ ID NO: 233981

SEQ ID NO: 752559 - RNA, 64 nt, Homo Sapiens; identical to SEQ ID NO: 233982

SEQ ID NO: 752560 - RNA, 64 nt, Homo Sapiens; identical to SEQ ID NO: 233983

SEQ ID NO: 752561 - RNA, 64 nt, Homo Sapiens; identical to SEQ ID NO: 233984

SEQ ID NO: 752562 - RNA, 64 nt, Homo Sapiens; identical to SEQ ID NO: 233985

SEQ ID NO: 752563 - RNA, 64 nt, Homo Sapiens; identical to SEQ ID NO: 233986

SEQ ID NO: 752564 - RNA, 64 nt, Homo Sapiens; identical to SEQ ID NO: 233987

SEQ ID NO: 752565 - RNA, 64 nt, Homo Sapiens; identical to SEQ ID NO: 233988

SEQ ID NO: 752566 - RNA, 64 nt, Homo Sapiens; identical to SEQ ID NO: 233989

SEQ ID NO: 752567 - RNA, 58 nt, Homo Sapiens; identical to SEQ ID NO: 233990

SEQ ID NO: 752568 - RNA, 64 nt, Homo Sapiens; identical to SEQ ID NO: 233991

SEQ ID NO: 752569 - RNA, 64 nt, Homo Sapiens; identical to SEQ ID NO: 233992

SEQ ID NO: 752570 - RNA, 64 nt, Homo Sapiens; identical to SEQ ID NO: 233993

SEQ ID NO: 752571 - RNA, 64 nt, Homo Sapiens; identical to SEQ ID NO: 233994

SEQ ID NO: 752572 - RNA, 64 nt, Homo Sapiens; identical to SEQ ID NO: 233995

SEQ ID NO: 752573 - RNA, 64 nt, Homo Sapiens; identical to SEQ ID NO: 233996

SEQ ID NO: 752574 - RNA, 64 nt, Homo Sapiens; identical to SEQ ID NO: 233997

SEQ ID NO: 752575 - RNA, 64 nt, Homo Sapiens; identical to SEQ ID NO: 233998

SEQ ID NO: 752576 - RNA, 64 nt, Homo Sapiens; identical to SEQ ID NO: 233999

SEQ ID NO: 752577 - RNA, 64 nt, Homo Sapiens; identical to SEQ ID NO: 234000

SEQ ID NO: 752578 - RNA, 64 nt, Homo Sapiens; identical to SEQ ID NO: 234001

SEQ ID NO: 752579 - RNA, 64 nt, Homo Sapiens; identical to SEQ ID NO: 234002

SEQ ID NO: 752580 - RNA, 64 nt, Homo Sapiens; identical to SEQ ID NO: 234003

SEQ ID NO: 752581 - RNA, 64 nt, Homo Sapiens; identical to SEQ ID NO: 234004

SEQ ID NO: 752582 - RNA, 64 nt, Homo Sapiens; identical to SEQ ID NO: 234005

SEQ ID NO: 752583 - RNA, 64 nt, Homo Sapiens; identical to SEQ ID NO: 234006

SEQ ID NO: 752584 - RNA, 64 nt, Homo Sapiens; identical to SEQ ID NO: 234007

SEQ ID NO: 752585 - RNA, 64 nt, Homo Sapiens; identical to SEQ ID NO: 234008

SEQ ID NO: 752586 - RNA, 64 nt, Homo Sapiens; identical to SEQ ID NO: 234009

SEQ ID NO: 752587 - RNA, 64 nt, Homo Sapiens; identical to SEQ ID NO: 234010

SEQ ID NO: 752588 - RNA, 64 nt, Homo Sapiens; identical to SEQ ID NO: 234011

SEQ ID NO: 752589 - RNA, 64 nt, Homo Sapiens; identical to SEQ ID NO: 234012

SEQ ID NO: 752590 - RNA, 64 nt, Homo Sapiens; identical to SEQ ID NO: 234013

SEQ ID NO: 752591 - RNA, 64 nt, Homo Sapiens; identical to SEQ ID NO: 234014

SEQ ID NO: 752592 - RNA, 64 nt, Homo Sapiens; identical to SEQ ID NO: 234015

SEQ ID NO: 752593 - RNA, 64 nt, Homo Sapiens; identical to SEQ ID NO: 234016

SEQ ID NO: 752594 - RNA, 64 nt, Homo Sapiens; identical to SEQ ID NO: 234017

SEQ ID NO: 752595 - RNA, 64 nt, Homo Sapiens; identical to SEQ ID NO: 234018

SEQ ID NO: 752596 - RNA, 64 nt, Homo Sapiens; identical to SEQ ID NO: 234019

SEQ ID NO: 752597 - RNA, 64 nt, Homo Sapiens; identical to SEQ ID NO: 234020

SEQ ID NO: 752598 - RNA, 64 nt, Homo Sapiens; identical to SEQ ID NO: 234021

SEQ ID NO: 752599 - RNA, 64 nt, Homo Sapiens; identical to SEQ ID NO: 234022

SEQ ID NO: 752600 - RNA, 64 nt, Homo Sapiens; identical to SEQ ID NO: 234023

SEQ ID NO: 752601 - RNA, 64 nt, Homo Sapiens; identical to SEQ ID NO: 234024

SEQ ID NO: 752602 - RNA, 64 nt, Homo Sapiens; identical to SEQ ID NO: 234025

SEQ ID NO: 752603 - RNA, 64 nt, Homo Sapiens; identical to SEQ ID NO: 234026

SEQ ID NO: 752604 - RNA, 64 nt, Homo Sapiens; identical to SEQ ID NO: 234027

SEQ ID NO: 752605 - RNA, 64 nt, Homo Sapiens; identical to SEQ ID NO: 234028

SEQ ID NO: 752606 - RNA, 64 nt, Homo Sapiens; identical to SEQ ID NO: 234029

SEQ ID NO: 752607 - RNA, 64 nt, Homo Sapiens; identical to SEQ ID NO: 234030

SEQ ID NO: 752608 - RNA, 64 nt, Homo Sapiens; identical to SEQ ID NO: 234031

SEQ ID NO: 752609 - RNA, 64 nt, Homo Sapiens; identical to SEQ ID NO: 234032

SEQ ID NO: 752610 - RNA, 64 nt, Homo Sapiens; identical to SEQ ID NO: 234033

SEQ ID NO: 752611 - RNA, 64 nt, Homo Sapiens; identical to SEQ ID NO: 234034

SEQ ID NO: 752612 - RNA, 64 nt, Homo Sapiens; identical to SEQ ID NO: 234035

SEQ ID NO: 752613 - RNA, 64 nt, Homo Sapiens; identical to SEQ ID NO: 234036

SEQ ID NO: 752614 - RNA, 64 nt, Homo Sapiens; identical to SEQ ID NO: 234037

SEQ ID NO: 752615 - RNA, 64 nt, Homo Sapiens; identical to SEQ ID NO: 234038

SEQ ID NO: 752616 - RNA, 64 nt, Homo Sapiens; identical to SEQ ID NO: 234039

SEQ ID NO: 752617 - RNA, 64 nt, Homo Sapiens; identical to SEQ ID NO: 234040

SEQ ID NO: 752618 - RNA, 64 nt, Homo Sapiens; identical to SEQ ID NO: 234041

SEQ ID NO: 752619 - RNA, 64 nt, Homo Sapiens; identical to SEQ ID NO: 234042

SEQ ID NO: 752620 - RNA, 64 nt, Homo Sapiens; identical to SEQ ID NO: 234043

SEQ ID NO: 752621 - RNA, 64 nt, Homo Sapiens; identical to SEQ ID NO: 234044

SEQ ID NO: 752622 - RNA, 64 nt, Homo Sapiens; identical to SEQ ID NO: 234045

SEQ ID NO: 752623 - RNA, 64 nt, Homo Sapiens; identical to SEQ ID NO: 234046

SEQ ID NO: 752624 - RNA, 64 nt, Homo Sapiens; identical to SEQ ID NO: 234047

SEQ ID NO: 752625 - RNA, 64 nt, Homo Sapiens; identical to SEQ ID NO: 492612

SEQ ID NO: 752626 - RNA, 64 nt, Homo Sapiens; identical to SEQ ID NO: 492613

SEQ ID NO: 752627 - RNA, 64 nt, Homo Sapiens; identical to SEQ ID NO: 492614

SEQ ID NO: 752628 - RNA, 64 nt, Homo Sapiens; identical to SEQ ID NO: 492615

SEQ ID NO: 752629 - RNA, 64 nt, Homo Sapiens; identical to SEQ ID NO: 492616

SEQ ID NO: 752630 - RNA, 64 nt, Homo Sapiens; identical to SEQ ID NO: 492617

SEQ ID NO: 752631 - RNA, 64 nt, Homo Sapiens
uuaugcuucugaccuuguauggucuguaagcuugcccagaaauaagaccacuguuuugaacuac

SEQ ID NO: 752632 - RNA, 64 nt, Homo Sapiens
uguuuuuuuucuuuuguaaaggcaaugagcuagucccagaaaggauccuucaguuacauacaau

SEQ ID NO: 752633 - RNA, 64 nt, Homo Sapiens
acauuaccuaaaaggcacuaacaugcucagguuccccagaaagaggcguaagaagggccucucc

SEQ ID NO: 752634 - RNA, 64 nt, Homo Sapiens
gcuucaaggcucacaauggaagcacugucauuuccccagaaaagcuguguucccuaugcugaac

SEQ ID NO: 752635 - RNA, 64 nt, Homo Sapiens
gugacuucuguguucucuccguaaacaguagacacccagaaaucuugccaugagauaacacagu

SEQ ID NO: 752636 - RNA, 64 nt, Homo Sapiens
uagugaguccuggacuggaccugcaugacagucccccagaaacuugagacugguuuggaucucc

SEQ ID NO: 752637 - RNA, 64 nt, Homo Sapiens
aaaacaaaauaaugcuuuuccucuccucucccaucccagaaaacuaaacgcaaaucuguagauu

SEQ ID NO: 752638 - RNA, 64 nt, Homo Sapiens
ugucuucuaaaagggaggacagcuaagugguuaucccagaaacuuucucuucccuaaccaauga

SEQ ID NO: 752639 - RNA, 64 nt, Homo Sapiens
aggagggcauugcccacauuccccacccaugacccccagaaagccgcugaucuucuauuuaauu

SEQ ID NO: 752640 - RNA, 64 nt, Homo Sapiens
agaaaugauguuauaaaaaaugagaaaacuaacacccagaaaggaauuucuuaccucacauaga

SEQ ID NO: 752641 - RNA, 64 nt, Homo Sapiens
caaauuccuacaguuucuggcuggcuucauuaaacccagaaagaauguucagguaacuauucac

SEQ ID NO: 752642 - RNA, 64 nt, Homo Sapiens
aagagaaaaaaaagacuuguuucugaucuaauaucccagaaaaaguaacucauugcucuguuaa

SEQ ID NO: 752643 - RNA, 64 nt, Homo Sapiens
gauccagaugagauacagcucagagugccacgcccccagaaagaggaaucaggcaaguacuguc

SEQ ID NO: 752644 - RNA, 64 nt, Homo Sapiens
ugcauauuaauucaugcaaaaaguuagauauuagcccagaaauguuaguaacaagaaacuacug

SEQ ID NO: 752645 - RNA, 64 nt, Homo Sapiens
agcuuccccugccugccugagggguccaggggugcccagaaaggcaucuccuuccggccccacu

SEQ ID NO: 752646 - RNA, 64 nt, Homo Sapiens
aaaaaaaaaccauuuuuaaaggcagagaggcuuucccagaaaaacugcugcggcagcuucagcu

SEQ ID NO: 752647 - RNA, 64 nt, Homo Sapiens
uuucacacccuuacaagaauaccacauuuugaaacccagaaagaccuggaaaggagcccagcau

SEQ ID NO: 752648 - RNA, 64 nt, Homo Sapiens
uugucaugaccagacaagauaggaaaggggaaaccccagaaacgugcucuucaucugucagccu

SEQ ID NO: 752649 - RNA, 64 nt, Homo Sapiens
gagugacaaacucugcacuugcagcccauccccucccagaaauaccagccccauugcacacugu

SEQ ID NO: 752650 - RNA, 64 nt, Homo Sapiens
gccuuuuuuccugccucugauccccagccaaccccccagaaacggagagaagggaaggggagug

SEQ ID NO: 752651 - RNA, 64 nt, Homo Sapiens
uagagggcaucccucugggguagcgacagacaaucccagaaacacgcauaauacauuuccgucc

SEQ ID NO: 752652 - RNA, 64 nt, Homo Sapiens
caugcccuaaagcuaguccuguaaacaauggugccccagaaagcugcaggugguguuuggagaa

SEQ ID NO: 752653 - RNA, 64 nt, Homo Sapiens
cccacagcauagugaccucaaaagguaaugggcccccagaaauauaccugggaaaucuuaacag

SEQ ID NO: 752654 - RNA, 64 nt, Homo Sapiens
auguuuugagucccuauaguuuggcccacagucucccagaaaugccuauuuaguuaauucuuuc

SEQ ID NO: 752655 - RNA, 64 nt, Homo Sapiens
acacugauggcucaagacaaggcuggcaaacccucccagaaacaucucuggcccagaaagccuc

SEQ ID NO: 752656 - RNA, 64 nt, Homo Sapiens
caaggcuggcaaacccucccagaaacaucucuggcccagaaagccucucucucccucccucucu

SEQ ID NO: 752657 - RNA, 64 nt, Homo Sapiens
uagacagaaugaucauucaacccagaaaauguuucccagaaaacgaucauucccagaaacauuu

SEQ ID NO: 752658 - RNA, 64 nt, Homo Sapiens
guuucccagaaaacuagacaucccagaaacauuucccagaaaauaaacaaggcagaaugaucau

SEQ ID NO: 752659 - RNA, 64 nt, Homo Sapiens
uuucccagaaaauguuucccgcagaaugaucauucccagaaacacugaauuuccagaaaacaag

SEQ ID NO: 752660 - RNA, 64 nt, Homo Sapiens
gagauggguaaagcguuucuucuaaaggggucuacccagaaagcaugauuuccugcccuaaguc

SEQ ID NO: 752661 - RNA, 64 nt, Homo Sapiens
gggcaaggcgcugagggaggaugcuuaggggacccccagaaacaggagucaggaaaaugaggca

SEQ ID NO: 752662 - RNA, 64 nt, Homo Sapiens
caccaaucggcuuucauuuuccugaugacuccuccccagaaaaccaaagugucacaaugcuccu

SEQ ID NO: 752663 - RNA, 64 nt, Homo Sapiens
ugucauuuagcuggcugcaggccaaacaugagagcccagaaaaccuauucuuugucacuugggu

SEQ ID NO: 752664 - RNA, 64 nt, Homo Sapiens
acaggaaaauuauugacagcaaugguuucccgggcccagaaacucuggaaagauuuuguccaga

SEQ ID NO: 752665 - RNA, 64 nt, Homo Sapiens
aaagaaaaaauaaaaauuaucuauaaucucagaacccagaaauagccacuauuaacauuuccua

SEQ ID NO: 752666 - RNA, 64 nt, Homo Sapiens
cuuccugcaacugcacuuuaucuguggucugcugcccagaaacaucucuucucaggaaaggauc

SEQ ID NO: 752667 - RNA, 64 nt, Homo Sapiens
uaugccacccuaggucaucagagcuaaaggggcucccagaaaccacugggcagcaucugccuuc

SEQ ID NO: 752668 - RNA, 64 nt, Homo Sapiens
cacuucugggucuuugccugggauguugcugacacccagaaagucccaccaccugcacaugugu

SEQ ID NO: 752669 - RNA, 64 nt, Homo Sapiens
agcacugcagacaggcccuggcucagaaucagagcccagaaaguggcugcagacaaaaucaaua

SEQ ID NO: 752670 - RNA, 64 nt, Homo Sapiens
cauuuucaacuucaagucauugcaguuucuuuuucccagaaaacaagggguuagauguugcauu

SEQ ID NO: 752671 - RNA, 64 nt, Homo Sapiens
cucuccugacuuguauuguggcagucugaacgcccccagaaaauugugccaaagaguuuagaaa

SEQ ID NO: 752672 - RNA, 64 nt, Homo Sapiens
cuccugccccuguucucuuccacucuccuugcuacccagaaauccaucuaaauaccugcccuga

SEQ ID NO: 752673 - RNA, 64 nt, Homo Sapiens
aauauuaugcccaguuucugccucugagggaaagcccagaaaaggacagaaacgaaguagaaag

SEQ ID NO: 752674 - RNA, 64 nt, Homo Sapiens
ucucuauuuuuuaaguaacggugcuggccagacucccagaaaauccacauggcccacagcuccu

SEQ ID NO: 752675 - RNA, 64 nt, Homo Sapiens
gauucccugaguagcaccuucagaccccaugucacccagaaagacccauaauaacccccaaaua

SEQ ID NO: 752676 - RNA, 64 nt, Homo Sapiens
ccuuccagaucugauaugggggacaucagacagccccagaaaccuguucacuacaacaggauag

SEQ ID NO: 752677 - RNA, 64 nt, Homo Sapiens
auuuucugcuauuguguucauuauagcagauggacccagaaagaaaugcuguuuuaccaagacu

SEQ ID NO: 752678 - RNA, 64 nt, Homo Sapiens
uaaaauaggugucacgcuguuaaauaguguguagcccagaaaagucugaguccuagagauuaca

SEQ ID NO: 752679 - RNA, 64 nt, Homo Sapiens
agagugaaacucuuauuugccacugccccugccccccagaaagggacacagaauaugauucccu

SEQ ID NO: 752680 - RNA, 64 nt, Homo Sapiens
cucuucugccacugacgcccgggacuggucggugcccagaaaguaaaggcucaugcuuggagug

SEQ ID NO: 752681 - RNA, 64 nt, Homo Sapiens
cucccuucuucuccagguccuuuggagaccuagccccagaaagcuggccccucccuggacugac

SEQ ID NO: 752682 - RNA, 64 nt, Homo Sapiens; identical to SEQ ID NO: 652179

SEQ ID NO: 752683 - RNA, 64 nt, Homo Sapiens; identical to SEQ ID NO: 652180

SEQ ID NO: 752684 - RNA, 64 nt, Homo Sapiens; identical to SEQ ID NO: 652181

SEQ ID NO: 752685 - RNA, 64 nt, Homo Sapiens; identical to SEQ ID NO: 652182

SEQ ID NO: 752686 - RNA, 64 nt, Homo Sapiens; identical to SEQ ID NO: 652183

SEQ ID NO: 752687 - RNA, 64 nt, Homo Sapiens; identical to SEQ ID NO: 652184

SEQ ID NO: 752688 - RNA, 64 nt, Homo Sapiens; identical to SEQ ID NO: 652185

SEQ ID NO: 752689 - RNA, 64 nt, Homo Sapiens; identical to SEQ ID NO: 652186

SEQ ID NO: 752690 - RNA, 64 nt, Homo Sapiens; identical to SEQ ID NO: 652187

SEQ ID NO: 752691 - RNA, 64 nt, Homo Sapiens; identical to SEQ ID NO: 652188

SEQ ID NO: 752692 - RNA, 64 nt, Homo Sapiens; identical to SEQ ID NO: 652189

SEQ ID NO: 752693 - RNA, 64 nt, Homo Sapiens; identical to SEQ ID NO: 652190

SEQ ID NO: 752694 - RNA, 64 nt, Homo Sapiens; identical to SEQ ID NO: 292995

SEQ ID NO: 752695 - RNA, 64 nt, Homo Sapiens; identical to SEQ ID NO: 292996

SEQ ID NO: 752696 - RNA, 64 nt, Homo Sapiens; identical to SEQ ID NO: 292997

SEQ ID NO: 752697 - RNA, 64 nt, Homo Sapiens; identical to SEQ ID NO: 292998

SEQ ID NO: 752698 - RNA, 64 nt, Homo Sapiens; identical to SEQ ID NO: 292999

SEQ ID NO: 752699 - RNA, 64 nt, Homo Sapiens; identical to SEQ ID NO: 293000

SEQ ID NO: 752700 - RNA, 64 nt, Homo Sapiens; identical to SEQ ID NO: 293001

SEQ ID NO: 752701 - RNA, 64 nt, Homo Sapiens; identical to SEQ ID NO: 293002

SEQ ID NO: 752702 - RNA, 64 nt, Homo Sapiens; identical to SEQ ID NO: 293003

SEQ ID NO: 752703 - RNA, 64 nt, Homo Sapiens; identical to SEQ ID NO: 293004

SEQ ID NO: 752704 - RNA, 64 nt, Homo Sapiens; identical to SEQ ID NO: 293005

SEQ ID NO: 752705 - RNA, 64 nt, Homo Sapiens; identical to SEQ ID NO: 293006

SEQ ID NO: 752706 - RNA, 64 nt, Homo Sapiens; identical to SEQ ID NO: 293007

SEQ ID NO: 752707 - RNA, 64 nt, Homo Sapiens; identical to SEQ ID NO: 293008

SEQ ID NO: 752708 - RNA, 64 nt, Homo Sapiens; identical to SEQ ID NO: 293009

SEQ ID NO: 752709 - RNA, 64 nt, Homo Sapiens; identical to SEQ ID NO: 293010

SEQ ID NO: 752710 - RNA, 64 nt, Homo Sapiens; identical to SEQ ID NO: 293011

SEQ ID NO: 752711 - RNA, 64 nt, Homo Sapiens; identical to SEQ ID NO: 293012

SEQ ID NO: 752712 - RNA, 64 nt, Homo Sapiens; identical to SEQ ID NO: 293013

SEQ ID NO: 752713 - RNA, 64 nt, Homo Sapiens; identical to SEQ ID NO: 293014

SEQ ID NO: 752714 - RNA, 64 nt, Homo Sapiens; identical to SEQ ID NO: 293015

SEQ ID NO: 752715 - RNA, 55 nt, Homo Sapiens; identical to SEQ ID NO: 293016

SEQ ID NO: 752716 - RNA, 64 nt, Homo Sapiens; identical to SEQ ID NO: 293017

SEQ ID NO: 752717 - RNA, 55 nt, Homo Sapiens; identical to SEQ ID NO: 293018

SEQ ID NO: 752718 - RNA, 64 nt, Homo Sapiens; identical to SEQ ID NO: 293019

SEQ ID NO: 752719 - RNA, 64 nt, Homo Sapiens; identical to SEQ ID NO: 293020

SEQ ID NO: 752720 - RNA, 64 nt, Homo Sapiens; identical to SEQ ID NO: 293021

SEQ ID NO: 752721 - RNA, 64 nt, Homo Sapiens; identical to SEQ ID NO: 293022

SEQ ID NO: 752722 - RNA, 64 nt, Homo Sapiens; identical to SEQ ID NO: 293023

SEQ ID NO: 752723 - RNA, 64 nt, Homo Sapiens; identical to SEQ ID NO: 293024

SEQ ID NO: 752724 - RNA, 64 nt, Homo Sapiens; identical to SEQ ID NO: 293025

SEQ ID NO: 752725 - RNA, 64 nt, Homo Sapiens; identical to SEQ ID NO: 293026

SEQ ID NO: 752726 - RNA, 64 nt, Homo Sapiens; identical to SEQ ID NO: 293027

SEQ ID NO: 752727 - RNA, 64 nt, Homo Sapiens; identical to SEQ ID NO: 293028

SEQ ID NO: 752728 - RNA, 52 nt, Homo Sapiens; identical to SEQ ID NO: 293029

SEQ ID NO: 752729 - RNA, 63 nt, Homo Sapiens; identical to SEQ ID NO: 293030

SEQ ID NO: 752730 - RNA, 64 nt, Homo Sapiens; identical to SEQ ID NO: 293031

SEQ ID NO: 752731 - RNA, 64 nt, Homo Sapiens; identical to SEQ ID NO: 293032

SEQ ID NO: 752732 - RNA, 64 nt, Homo Sapiens; identical to SEQ ID NO: 293033

SEQ ID NO: 752733 - RNA, 64 nt, Homo Sapiens; identical to SEQ ID NO: 293034

SEQ ID NO: 752734 - RNA, 64 nt, Homo Sapiens; identical to SEQ ID NO: 293035

SEQ ID NO: 752735 - RNA, 64 nt, Homo Sapiens; identical to SEQ ID NO: 293036

SEQ ID NO: 752736 - RNA, 55 nt, Homo Sapiens; identical to SEQ ID NO: 293037

SEQ ID NO: 752737 - RNA, 64 nt, Homo Sapiens; identical to SEQ ID NO: 293038

SEQ ID NO: 752738 - RNA, 64 nt, Homo Sapiens; identical to SEQ ID NO: 293039

SEQ ID NO: 752739 - RNA, 64 nt, Homo Sapiens; identical to SEQ ID NO: 293040

SEQ ID NO: 752740 - RNA, 64 nt, Homo Sapiens; identical to SEQ ID NO: 293041

SEQ ID NO: 752741 - RNA, 64 nt, Homo Sapiens; identical to SEQ ID NO: 293042

SEQ ID NO: 752742 - RNA, 64 nt, Homo Sapiens; identical to SEQ ID NO: 293043

SEQ ID NO: 752743 - RNA, 64 nt, Homo Sapiens; identical to SEQ ID NO: 293044

SEQ ID NO: 752744 - RNA, 64 nt, Homo Sapiens; identical to SEQ ID NO: 293045

SEQ ID NO: 752745 - RNA, 64 nt, Homo Sapiens; identical to SEQ ID NO: 293046

SEQ ID NO: 752746 - RNA, 64 nt, Homo Sapiens; identical to SEQ ID NO: 293047

SEQ ID NO: 752747 - RNA, 64 nt, Homo Sapiens; identical to SEQ ID NO: 293048

SEQ ID NO: 752748 - RNA, 64 nt, Homo Sapiens; identical to SEQ ID NO: 293049

SEQ ID NO: 752749 - RNA, 64 nt, Homo Sapiens; identical to SEQ ID NO: 293050

SEQ ID NO: 752750 - RNA, 64 nt, Homo Sapiens; identical to SEQ ID NO: 293051

SEQ ID NO: 752751 - RNA, 64 nt, Homo Sapiens; identical to SEQ ID NO: 293052

SEQ ID NO: 752752 - RNA, 64 nt, Homo Sapiens; identical to SEQ ID NO: 414348

SEQ ID NO: 752753 - RNA, 64 nt, Homo Sapiens; identical to SEQ ID NO: 414349

SEQ ID NO: 752754 - RNA, 64 nt, Homo Sapiens; identical to SEQ ID NO: 414350

SEQ ID NO: 752755 - RNA, 64 nt, Homo Sapiens; identical to SEQ ID NO: 414351

SEQ ID NO: 752756 - RNA, 64 nt, Homo Sapiens; identical to SEQ ID NO: 414352

SEQ ID NO: 752757 - RNA, 64 nt, Homo Sapiens; identical to SEQ ID NO: 414353

SEQ ID NO: 752758 - RNA, 64 nt, Homo Sapiens; identical to SEQ ID NO: 414354

SEQ ID NO: 752759 - RNA, 64 nt, Homo Sapiens; identical to SEQ ID NO: 414355

SEQ ID NO: 752760 - RNA, 64 nt, Homo Sapiens; identical to SEQ ID NO: 414356

SEQ ID NO: 752761 - RNA, 64 nt, Homo Sapiens; identical to SEQ ID NO: 414357

SEQ ID NO: 752762 - RNA, 64 nt, Homo Sapiens; identical to SEQ ID NO: 414358

SEQ ID NO: 752763 - RNA, 64 nt, Homo Sapiens; identical to SEQ ID NO: 414359

SEQ ID NO: 752764 - RNA, 64 nt, Homo Sapiens; identical to SEQ ID NO: 414360

SEQ ID NO: 752765 - RNA, 64 nt, Homo Sapiens; identical to SEQ ID NO: 414361

SEQ ID NO: 752766 - RNA, 64 nt, Homo Sapiens; identical to SEQ ID NO: 414362

SEQ ID NO: 752767 - RNA, 64 nt, Homo Sapiens; identical to SEQ ID NO: 583005

SEQ ID NO: 752768 - RNA, 64 nt, Homo Sapiens; identical to SEQ ID NO: 583006

SEQ ID NO: 752769 - RNA, 64 nt, Homo Sapiens; identical to SEQ ID NO: 583007

SEQ ID NO: 752770 - RNA, 64 nt, Homo Sapiens; identical to SEQ ID NO: 583008

SEQ ID NO: 752771 - RNA, 64 nt, Homo Sapiens; identical to SEQ ID NO: 583009

SEQ ID NO: 752772 - RNA, 64 nt, Homo Sapiens; identical to SEQ ID NO: 583010

SEQ ID NO: 752773 - RNA, 64 nt, Homo Sapiens; identical to SEQ ID NO: 583011

SEQ ID NO: 752774 - RNA, 64 nt, Homo Sapiens; identical to SEQ ID NO: 583012

SEQ ID NO: 752775 - RNA, 64 nt, Homo Sapiens; identical to SEQ ID NO: 583013

SEQ ID NO: 752776 - RNA, 64 nt, Homo Sapiens; identical to SEQ ID NO: 583014

SEQ ID NO: 752777 - RNA, 64 nt, Homo Sapiens; identical to SEQ ID NO: 583015

SEQ ID NO: 752778 - RNA, 64 nt, Homo Sapiens; identical to SEQ ID NO: 583016

SEQ ID NO: 752779 - RNA, 64 nt, Homo Sapiens; identical to SEQ ID NO: 583017

SEQ ID NO: 752780 - RNA, 64 nt, Homo Sapiens; identical to SEQ ID NO: 583018

SEQ ID NO: 752781 - RNA, 64 nt, Homo Sapiens; identical to SEQ ID NO: 583019

SEQ ID NO: 752782 - RNA, 64 nt, Homo Sapiens; identical to SEQ ID NO: 583020

SEQ ID NO: 752783 - RNA, 64 nt, Homo Sapiens; identical to SEQ ID NO: 583021

SEQ ID NO: 752784 - RNA, 64 nt, Homo Sapiens; identical to SEQ ID NO: 583022

SEQ ID NO: 752785 - RNA, 64 nt, Homo Sapiens; identical to SEQ ID NO: 583023

SEQ ID NO: 752786 - RNA, 64 nt, Homo Sapiens; identical to SEQ ID NO: 583024

SEQ ID NO: 752787 - RNA, 64 nt, Homo Sapiens; identical to SEQ ID NO: 583025

SEQ ID NO: 752788 - RNA, 64 nt, Homo Sapiens; identical to SEQ ID NO: 583026

SEQ ID NO: 752789 - RNA, 64 nt, Homo Sapiens; identical to SEQ ID NO: 583027

SEQ ID NO: 752790 - RNA, 64 nt, Homo Sapiens; identical to SEQ ID NO: 583028

SEQ ID NO: 752791 - RNA, 64 nt, Homo Sapiens; identical to SEQ ID NO: 583029

SEQ ID NO: 752792 - RNA, 64 nt, Homo Sapiens; identical to SEQ ID NO: 583030

SEQ ID NO: 752793 - RNA, 64 nt, Homo Sapiens; identical to SEQ ID NO: 583031

SEQ ID NO: 752794 - RNA, 64 nt, Homo Sapiens; identical to SEQ ID NO: 583032

SEQ ID NO: 752795 - RNA, 64 nt, Homo Sapiens; identical to SEQ ID NO: 583033

SEQ ID NO: 752796 - RNA, 64 nt, Homo Sapiens; identical to SEQ ID NO: 583034

SEQ ID NO: 752797 - RNA, 64 nt, Homo Sapiens; identical to SEQ ID NO: 583035

SEQ ID NO: 752798 - RNA, 64 nt, Homo Sapiens; identical to SEQ ID NO: 583036

SEQ ID NO: 752799 - RNA, 64 nt, Homo Sapiens; identical to SEQ ID NO: 583037

SEQ ID NO: 752800 - RNA, 64 nt, Homo Sapiens; identical to SEQ ID NO: 583038

SEQ ID NO: 752801 - RNA, 64 nt, Homo Sapiens; identical to SEQ ID NO: 583039

SEQ ID NO: 752802 - RNA, 64 nt, Homo Sapiens; identical to SEQ ID NO: 583040

SEQ ID NO: 752803 - RNA, 64 nt, Homo Sapiens; identical to SEQ ID NO: 583041

SEQ ID NO: 752804 - RNA, 64 nt, Homo Sapiens; identical to SEQ ID NO: 583042

SEQ ID NO: 752805 - RNA, 64 nt, Homo Sapiens; identical to SEQ ID NO: 583043

SEQ ID NO: 752806 - RNA, 64 nt, Homo Sapiens; identical to SEQ ID NO: 583044

SEQ ID NO: 752807 - RNA, 64 nt, Homo Sapiens; identical to SEQ ID NO: 583045

SEQ ID NO: 752808 - RNA, 64 nt, Homo Sapiens; identical to SEQ ID NO: 583046

SEQ ID NO: 752809 - RNA, 64 nt, Homo Sapiens; identical to SEQ ID NO: 583047

SEQ ID NO: 752810 - RNA, 64 nt, Homo Sapiens; identical to SEQ ID NO: 583048

SEQ ID NO: 752811 - RNA, 64 nt, Homo Sapiens; identical to SEQ ID NO: 583049

SEQ ID NO: 752812 - RNA, 64 nt, Homo Sapiens; identical to SEQ ID NO: 583050

SEQ ID NO: 752813 - RNA, 64 nt, Homo Sapiens; identical to SEQ ID NO: 583051

SEQ ID NO: 752814 - RNA, 64 nt, Homo Sapiens; identical to SEQ ID NO: 583052

SEQ ID NO: 752815 - RNA, 64 nt, Homo Sapiens; identical to SEQ ID NO: 583053

SEQ ID NO: 752816 - RNA, 64 nt, Homo Sapiens; identical to SEQ ID NO: 583054

SEQ ID NO: 752817 - RNA, 64 nt, Homo Sapiens; identical to SEQ ID NO: 583055

SEQ ID NO: 752818 - RNA, 64 nt, Homo Sapiens; identical to SEQ ID NO: 583056

SEQ ID NO: 752819 - RNA, 64 nt, Homo Sapiens; identical to SEQ ID NO: 583057

SEQ ID NO: 752820 - RNA, 64 nt, Homo Sapiens; identical to SEQ ID NO: 583058

SEQ ID NO: 752821 - RNA, 64 nt, Homo Sapiens; identical to SEQ ID NO: 583059

SEQ ID NO: 752822 - RNA, 64 nt, Homo Sapiens; identical to SEQ ID NO: 583060

SEQ ID NO: 752823 - RNA, 64 nt, Homo Sapiens; identical to SEQ ID NO: 583061

SEQ ID NO: 752824 - RNA, 64 nt, Homo Sapiens; identical to SEQ ID NO: 583062

SEQ ID NO: 752825 - RNA, 64 nt, Homo Sapiens; identical to SEQ ID NO: 583063

SEQ ID NO: 752826 - RNA, 64 nt, Homo Sapiens; identical to SEQ ID NO: 583064

SEQ ID NO: 752827 - RNA, 64 nt, Homo Sapiens; identical to SEQ ID NO: 583065

SEQ ID NO: 752828 - RNA, 64 nt, Homo Sapiens; identical to SEQ ID NO: 262953

SEQ ID NO: 752829 - RNA, 64 nt, Homo Sapiens; identical to SEQ ID NO: 262954

SEQ ID NO: 752830 - RNA, 64 nt, Homo Sapiens; identical to SEQ ID NO: 262955

SEQ ID NO: 752831 - RNA, 64 nt, Homo Sapiens; identical to SEQ ID NO: 262956

SEQ ID NO: 752832 - RNA, 64 nt, Homo Sapiens; identical to SEQ ID NO: 262957

SEQ ID NO: 752833 - RNA, 64 nt, Homo Sapiens; identical to SEQ ID NO: 262958

SEQ ID NO: 752834 - RNA, 64 nt, Homo Sapiens; identical to SEQ ID NO: 262959

SEQ ID NO: 752835 - RNA, 64 nt, Homo Sapiens; identical to SEQ ID NO: 262960

SEQ ID NO: 752836 - RNA, 64 nt, Homo Sapiens; identical to SEQ ID NO: 262961

SEQ ID NO: 752837 - RNA, 64 nt, Homo Sapiens; identical to SEQ ID NO: 262962

SEQ ID NO: 752838 - RNA, 64 nt, Homo Sapiens; identical to SEQ ID NO: 262963

SEQ ID NO: 752839 - RNA, 64 nt, Homo Sapiens; identical to SEQ ID NO: 262964

SEQ ID NO: 752840 - RNA, 64 nt, Homo Sapiens; identical to SEQ ID NO: 262965

SEQ ID NO: 752841 - RNA, 57 nt, Homo Sapiens; identical to SEQ ID NO: 262966

SEQ ID NO: 752842 - RNA, 64 nt, Homo Sapiens; identical to SEQ ID NO: 276332

SEQ ID NO: 752843 - RNA, 64 nt, Homo Sapiens; identical to SEQ ID NO: 276333

SEQ ID NO: 752844 - RNA, 64 nt, Homo Sapiens; identical to SEQ ID NO: 276334

SEQ ID NO: 752845 - RNA, 64 nt, Homo Sapiens; identical to SEQ ID NO: 276335

SEQ ID NO: 752846 - RNA, 64 nt, Homo Sapiens; identical to SEQ ID NO: 276336

SEQ ID NO: 752847 - RNA, 64 nt, Homo Sapiens; identical to SEQ ID NO: 276337

SEQ ID NO: 752848 - RNA, 64 nt, Homo Sapiens; identical to SEQ ID NO: 276338

SEQ ID NO: 752849 - RNA, 64 nt, Homo Sapiens; identical to SEQ ID NO: 276339

SEQ ID NO: 752850 - RNA, 64 nt, Homo Sapiens; identical to SEQ ID NO: 276340

SEQ ID NO: 752851 - RNA, 64 nt, Homo Sapiens; identical to SEQ ID NO: 276341

SEQ ID NO: 752852 - RNA, 64 nt, Homo Sapiens; identical to SEQ ID NO: 276342

SEQ ID NO: 752853 - RNA, 64 nt, Homo Sapiens; identical to SEQ ID NO: 276343

SEQ ID NO: 752854 - RNA, 64 nt, Homo Sapiens; identical to SEQ ID NO: 276344

SEQ ID NO: 752855 - RNA, 64 nt, Homo Sapiens; identical to SEQ ID NO: 276345

SEQ ID NO: 752856 - RNA, 64 nt, Homo Sapiens; identical to SEQ ID NO: 276346

SEQ ID NO: 752857 - RNA, 64 nt, Homo Sapiens; identical to SEQ ID NO: 276347

SEQ ID NO: 752858 - RNA, 64 nt, Homo Sapiens; identical to SEQ ID NO: 276348

SEQ ID NO: 752859 - RNA, 64 nt, Homo Sapiens; identical to SEQ ID NO: 276349

SEQ ID NO: 752860 - RNA, 64 nt, Homo Sapiens; identical to SEQ ID NO: 276350

SEQ ID NO: 752861 - RNA, 64 nt, Homo Sapiens; identical to SEQ ID NO: 276351

SEQ ID NO: 752862 - RNA, 64 nt, Homo Sapiens; identical to SEQ ID NO: 276352

SEQ ID NO: 752863 - RNA, 64 nt, Homo Sapiens; identical to SEQ ID NO: 276353

SEQ ID NO: 752864 - RNA, 64 nt, Homo Sapiens; identical to SEQ ID NO: 276354

SEQ ID NO: 752865 - RNA, 64 nt, Homo Sapiens; identical to SEQ ID NO: 276355

SEQ ID NO: 752866 - RNA, 64 nt, Homo Sapiens; identical to SEQ ID NO: 276356

SEQ ID NO: 752867 - RNA, 64 nt, Homo Sapiens; identical to SEQ ID NO: 276357

SEQ ID NO: 752868 - RNA, 64 nt, Homo Sapiens; identical to SEQ ID NO: 276358

SEQ ID NO: 752869 - RNA, 64 nt, Homo Sapiens; identical to SEQ ID NO: 276359

SEQ ID NO: 752870 - RNA, 64 nt, Homo Sapiens; identical to SEQ ID NO: 147180

SEQ ID NO: 752871 - RNA, 64 nt, Homo Sapiens; identical to SEQ ID NO: 147181

SEQ ID NO: 752872 - RNA, 64 nt, Homo Sapiens; identical to SEQ ID NO: 147182

SEQ ID NO: 752873 - RNA, 64 nt, Homo Sapiens; identical to SEQ ID NO: 147183

SEQ ID NO: 752874 - RNA, 64 nt, Homo Sapiens; identical to SEQ ID NO: 147184

SEQ ID NO: 752875 - RNA, 64 nt, Homo Sapiens; identical to SEQ ID NO: 147185

SEQ ID NO: 752876 - RNA, 64 nt, Homo Sapiens; identical to SEQ ID NO: 147186

SEQ ID NO: 752877 - RNA, 64 nt, Homo Sapiens; identical to SEQ ID NO: 147187

SEQ ID NO: 752878 - RNA, 64 nt, Homo Sapiens; identical to SEQ ID NO: 147188

SEQ ID NO: 752879 - RNA, 64 nt, Homo Sapiens; identical to SEQ ID NO: 147189

SEQ ID NO: 752880 - RNA, 64 nt, Homo Sapiens; identical to SEQ ID NO: 147190

SEQ ID NO: 752881 - RNA, 64 nt, Homo Sapiens; identical to SEQ ID NO: 147191

SEQ ID NO: 752882 - RNA, 64 nt, Homo Sapiens; identical to SEQ ID NO: 147192

SEQ ID NO: 752883 - RNA, 64 nt, Homo Sapiens; identical to SEQ ID NO: 147193

SEQ ID NO: 752884 - RNA, 64 nt, Homo Sapiens
cuaggcaaacuacuaacaugcauugugagaaugccguguauaccucacguacuguguacuuugu

SEQ ID NO: 752885 - RNA, 64 nt, Homo Sapiens
gaaagcuagaaacacuagguucuuccuguacauacguguauauaugugaacagugagauggccg

SEQ ID NO: 752886 - RNA, 55 nt, Homo Sapiens
ugggcacugcaucagccugaaugaggcuggccaccugccacuuugcccugcccuc

SEQ ID NO: 752887 - RNA, 64 nt, Homo Sapiens
uuugcuuggcuggggagccccccaggccagguuugcuggccauagauaccuuugggcugccugg

SEQ ID NO: 752888 - RNA, 64 nt, Homo Sapiens
aauggcuccuccagagggccccucagagccaggugcuggccagaugccuugaucacagccucca

SEQ ID NO: 752889 - RNA, 64 nt, Homo Sapiens
agaacaguuccccacccagcgauuagggagcugggcuggccaguacagccaguggggagugggu

SEQ ID NO: 752890 - RNA, 64 nt, Homo Sapiens
cuauaggguccuccuucccugccaguggccccuugcuggccacccucaggcuuccugaccuacc

SEQ ID NO: 752891 - RNA, 64 nt, Homo Sapiens
gccagguuuucccuaagaaguucaggaggugcccgcuggccacagccucugcagcaagcagggc

SEQ ID NO: 752892 - RNA, 64 nt, Homo Sapiens
acauauauacacaugcacauacacagauuuuucugcuggccaggugggccaacuggguuucccu

SEQ ID NO: 752893 - RNA, 64 nt, Homo Sapiens
gaggaaggucucacaucugucucugggcacccaugcuggccagcaguuucccagggcucccugg

SEQ ID NO: 752894 - RNA, 64 nt, Homo Sapiens
caagaguucccuuccagcucuccccuuugugcaggcuggccagcuuuucugugaaaugugcugc

SEQ ID NO: 752895 - RNA, 64 nt, Homo Sapiens
ugguaccgugagaaaggaaaggcugacaaaccaagcuggccauucauggugggauaagacaaca

SEQ ID NO: 752896 - RNA, 64 nt, Homo Sapiens
gagugagccaaugcucaccagccccagagucagagcuggccacaggcuggcagccuccaggggc

SEQ ID NO: 752897 - RNA, 64 nt, Homo Sapiens
aggcuaagccauguggcagggaccgucuugcccugcuggccacacucuggagaagcacuucuca

SEQ ID NO: 752898 - RNA, 64 nt, Homo Sapiens
ggagucagggucccaagaucccaccuguauggucgcuggccagugauucuccuucugagccgug

SEQ ID NO: 752899 - RNA, 64 nt, Homo Sapiens
cccugacugggggcaggggaagagacagggcacagcuggccacagggcucagccacugagcagg

SEQ ID NO: 752900 - RNA, 64 nt, Homo Sapiens
ucuggaggggccucagggguugggggagugaggggcuggccagggaaccacacgaaaccucaac

SEQ ID NO: 752901 - RNA, 64 nt, Homo Sapiens
acgagccuguagccaacggcccgcagacuucacagcuggccacagaugcuggggcuucagcccg

SEQ ID NO: 752902 - RNA, 64 nt, Homo Sapiens
gccagccagucugguggagcucagcgucuggcuggcuggccagccugugggucuguugggagca

SEQ ID NO: 752903 - RNA, 64 nt, Homo Sapiens
aggggugauucagagguggggaugggcagagagggcuggccacucugccucaggacuugaccuc

SEQ ID NO: 752904 - RNA, 64 nt, Homo Sapiens
gccauucuguguucagaaagagauaauggacaaugcuggccacuuuaguaaacaagcggaacau

SEQ ID NO: 752905 - RNA, 64 nt, Homo Sapiens
uuacauguuacaguaucuuuuguguuguaacuuggcuggccaagcauaauacaguugugaggaa

SEQ ID NO: 752906 - RNA, 64 nt, Homo Sapiens
cauggugcaugagugaucucagccuagcgaugccgcuggccagaccgugaccaugcugccagug

SEQ ID NO: 752907 - RNA, 64 nt, Homo Sapiens
uuuuauauuuuugguagagaugggguuucaccaugcuggccaggcuggucucgaacuccugacc

SEQ ID NO: 752908 - RNA, 64 nt, Homo Sapiens
agcuagugguccuggggcccuggagggcaugacugcuggccagauuuccacggacccagcucug

SEQ ID NO: 752909 - RNA, 64 nt, Homo Sapiens
ccaaaagggcucuguccuggggaggcuggguagugcuggccauccccugaccucccucaccagu

SEQ ID NO: 752910 - RNA, 64 nt, Homo Sapiens
ugguuccaaacaacaccaccgagaucucccucaggcuggccagguuuugcagcuggaauucucc

SEQ ID NO: 752911 - RNA, 64 nt, Homo Sapiens
gaaugccacaguggauacgccagcaggccacauggcuggccaagcaauuauuauuauggauccc

SEQ ID NO: 752912 - RNA, 64 nt, Homo Sapiens
agagcccacacugccagucgaggccuggcuggaggcuggccacaguggaaauucugccgagccu

SEQ ID NO: 752913 - RNA, 64 nt, Homo Sapiens
ucccugcucugcugcauggggccccauggcuuuggcuggccacugaggguaggguguggaggug

SEQ ID NO: 752914 - RNA, 64 nt, Homo Sapiens
uccacccaccccacgacccgugacuacugugcaagcuggccaggagguagguggagggcaaggc

SEQ ID NO: 752915 - RNA, 64 nt, Homo Sapiens
accggggagaaguggggccgugguucgagggagggcuggccaggggugggacccuuaugagacu

SEQ ID NO: 752916 - RNA, 63 nt, Homo Sapiens
uuucccugacuccuggugcccucucccuuuguccccccagagagacauaugcccccagagaga

SEQ ID NO: 752917 - RNA, 63 nt, Homo Sapiens
cccucucccuuuguccccccagagagacauaugcccccagagagagcaaaucgaagcguggga

SEQ ID NO: 752918 - RNA, 63 nt, Homo Sapiens
agccucagaacugaaggagaaaguaaucauuaacccccagaccugaagugauccuuaaccccc

SEQ ID NO: 752919 - RNA, 63 nt, Homo Sapiens
uuggguuccucucuccucucgaggaaagugcaucccccagagcgucacagggggugucgggcg

SEQ ID NO: 752920 - RNA, 63 nt, Homo Sapiens
cugcccuagacccugccagaaaagggggcucuucccccagagaaguggcuuggagggaacuuc

SEQ ID NO: 752921 - RNA, 63 nt, Homo Sapiens
uuuggacaucuggggaaguggagauuaaccccucccccagacucgugccuugccucucaggac

SEQ ID NO: 752922 - RNA, 63 nt, Homo Sapiens
acuucgagaguagcccugucuuguccccuccuacccccagauuagcaccaccccucucacucu

SEQ ID NO: 752923 - RNA, 63 nt, Homo Sapiens
cuaacauaacuuauuaaaggaggggucccuccucccccagagcaguccucaacacuaugucag

SEQ ID NO: 752924 - RNA, 63 nt, Homo Sapiens
agugcuggaaaugcagccacuggcagaucuggccccccagacgucaccgcagggccucugaag

SEQ ID NO: 752925 - RNA, 63 nt, Homo Sapiens
ccgcugggacuggaugugccgcacugaggggugcccccagaccugcagggcagacagugccug

SEQ ID NO: 752926 - RNA, 63 nt, Homo Sapiens
uaagcagcucuuggacccaccucagcaugggugcccccagaagcagcucugccucgcagcccc

SEQ ID NO: 752927 - RNA, 63 nt, Homo Sapiens
gccaucucuuccauuuuugaagaaggcugcuugcccccagagagugguucagguggggucucc

SEQ ID NO: 752928 - RNA, 63 nt, Homo Sapiens
aacugcucccaccucuccuuagcccggcagcagcccccagaggaaggucugugggcucuaggc

SEQ ID NO: 752929 - RNA, 63 nt, Homo Sapiens
gacucugcaccuggcccuuuaugccauccauggcccccagacuggauccugaccugacuaucc

SEQ ID NO: 752930 - RNA, 63 nt, Homo Sapiens
cccaggcucacuucaguguucccuuggaagaggcccccagaugggggcugagucuucccuggc

SEQ ID NO: 752931 - RNA, 63 nt, Homo Sapiens
ccacagucagaacugaaucucucaaagauucagcccccagaucuagcuuuuagcuauaaacca

SEQ ID NO: 752932 - RNA, 63 nt, Homo Sapiens
gcuggagugggguacagaguugagccggcuggucccccagaaacucaauucucagggcuggaa

SEQ ID NO: 752933 - RNA, 63 nt, Homo Sapiens
ugggacaccaggccugacucaggcagguucugccccccagaccccacacacggccgccccacg

SEQ ID NO: 752934 - RNA, 63 nt, Homo Sapiens
ccaccgggucugggcucuggaaggagccagaugcccccagaaaggugggugguggagacggca

SEQ ID NO: 752935 - RNA, 63 nt, Homo Sapiens
aggcguggagguguccccaccccuuccaccugucccccagacccaaagcucucuccccacccu

SEQ ID NO: 752936 - RNA, 63 nt, Homo Sapiens
uacuuucagagcgcuagcugacuccuuggguuucccccagacauggcgggaaaacacugacug

SEQ ID NO: 752937 - RNA, 63 nt, Homo Sapiens
aaaaccuggauucgacagggaugguuccaugagcccccagaugcagcccuggacugaggaugg

SEQ ID NO: 752938 - RNA, 63 nt, Homo Sapiens
gggcccagcuugcucagucaaggggcugccaggcccccagaaaacacuuggagccaucgggua

SEQ ID NO: 752939 - RNA, 63 nt, Homo Sapiens
auucagcacgcacacaacacacaagggagagaacccccagaugagaaaauaggaaggagcaau

SEQ ID NO: 752940 - RNA, 63 nt, Homo Sapiens
ccugaccacccccugggucccuugggcugcccucccccagaccuccauggcaggcaucccugc

SEQ ID NO: 752941 - RNA, 63 nt, Homo Sapiens
agagagcaauaagagcccagguccuaucagugccccccagagucaaugagagaccaggaguag

SEQ ID NO: 752942 - RNA, 63 nt, Homo Sapiens
ucacccuccucccccauggagguuuccaggggucccccagacaugaaagaggggugagcugga

SEQ ID NO: 752943 - RNA, 63 nt, Homo Sapiens
auagucacauguuuuucuuccuuguccccacggcccccagaacaacauucucccugcuggcag

SEQ ID NO: 752944 - RNA, 63 nt, Homo Sapiens
auaccucugacccacccagccuccgcgguuggccccccagaccggggagccuaggcccagcuc

SEQ ID NO: 752945 - RNA, 63 nt, Homo Sapiens
cagguaccucccuuggucccuggacagcaggcgcccccagaugccugccacagggcacuggaa

SEQ ID NO: 752946 - RNA, 63 nt, Homo Sapiens
cugggcccccagccucuggcccccacucuggugcccccagaccacagacacugaccucagagg

SEQ ID NO: 752947 - RNA, 63 nt, Homo Sapiens
ggaggagugggcuuugaacucacgaaacugggacccccagaagaaggaaagggaagaagagau

SEQ ID NO: 752948 - RNA, 63 nt, Homo Sapiens
uggcucagccaaccuccuucgaagucccugaggcccccagaccuuguggguuaugaggacaca

SEQ ID NO: 752949 - RNA, 63 nt, Homo Sapiens
gaggucauaauaucccucuaggacuuaccuguucccccagaucuugccuugggaccacauuug

SEQ ID NO: 752950 - RNA, 63 nt, Homo Sapiens
aaucuuaacuaccuacccaaaggauuugcauuacccccagauucugugccaacaaccuuuuaa

SEQ ID NO: 752951 - RNA, 63 nt, Homo Sapiens
cugcagggccuggugaugcucccccagagaccccccccagacaggccucucaucaggaucugc

SEQ ID NO: 752952 - RNA, 63 nt, Homo Sapiens
ccccccccagacacugcaggcaucaggaucugccccccagagaaguaaaggcuccuggccucu

SEQ ID NO: 752953 - RNA, 63 nt, Homo Sapiens
aucaguccuugaagagcagcaaggaaggagcugcccccagagccugccaccugagaagaugga

SEQ ID NO: 752954 - RNA, 63 nt, Homo Sapiens
uccucuuccuucagcaaaggcaggugucuuuuccccccagaucgccacuuuaggauggcgaug

SEQ ID NO: 752955 - RNA, 63 nt, Homo Sapiens
gcuggggguccgcaucccuaccucagcuuaggacccccagagccaagguggcugggaucuggc

SEQ ID NO: 752956 - RNA, 63 nt, Homo Sapiens
aucugugguccaggccggcaucguccuggccaccccccagaucuggugccugcuggccggccc

SEQ ID NO: 752957 - RNA, 63 nt, Homo Sapiens
guucuuggagagaagugcaauacccucccugugcccccagaagugauaaauugagggcacuug

SEQ ID NO: 752958 - RNA, 63 nt, Homo Sapiens
accgggaggcaccccacccugccccgagggacgcccccagagggccccccggagguggcagca

SEQ ID NO: 752959 - RNA, 63 nt, Homo Sapiens
aagcuggagugcauaggucauccuggagagcugcccccagaagccaggagcucggacugcugg

SEQ ID NO: 752960 - RNA, 63 nt, Homo Sapiens
ccugaggccaagggggccacccaccaagcuccucccccagaacccccaccgccauuggcaucc

SEQ ID NO: 752961 - RNA, 63 nt, Homo Sapiens
auggagcagcagcaggacagacccccacgaggccccccagagaggaggaagaucccacggagg

SEQ ID NO: 752962 - RNA, 63 nt, Homo Sapiens
cacugccugagggacaacagacaucagaacaaacccccagagagaaacagucaaaaucagggc

SEQ ID NO: 752963 - RNA, 63 nt, Homo Sapiens
uggcccuuguuuacagugaggucccacccccaacccccagagggcuucuccccccaucccagg

SEQ ID NO: 752964 - RNA, 63 nt, Homo Sapiens
gcugucgggaccacaucuguuccuugggcgucucccccagaguggcagucaccacccagcccu

SEQ ID NO: 752965 - RNA, 61 nt, Homo Sapiens; identical to SEQ ID NO: 88249

SEQ ID NO: 752966 - RNA, 63 nt, Homo Sapiens
uagaaugccacagucccccaacccuccacagagcccccagacccaccagaacuuccacagacg

SEQ ID NO: 752967 - RNA, 63 nt, Homo Sapiens
gcucggucacuugaguguuuaccucccuuccagcccccagaaacugagcacagaccagcagcg

SEQ ID NO: 752968 - RNA, 63 nt, Homo Sapiens
cuucuugaaacgagagccagaacucccuuacagcccccagacccuccuccacucccuuuuugu

SEQ ID NO: 752969 - RNA, 63 nt, Homo Sapiens
acgaagaggucaagaaccuuucagaaaguuucacccccagaggcagaagucgcaggcagccuc

SEQ ID NO: 752970 - RNA, 63 nt, Homo Sapiens
gagccgagacucggaaagugccuuaaaguuucacccccagaggaaccccaguacugacagccu

SEQ ID NO: 752971 - RNA, 63 nt, Homo Sapiens
uccuucccuuggaugcuuucccaaguggacugacccccagauucucucaggcagaugccgagg

SEQ ID NO: 752972 - RNA, 63 nt, Homo Sapiens
agguucaccugccaacaggcuucuggagcgagacccccagaagcaaagacuucauccggcacc

SEQ ID NO: 752973 - RNA, 64 nt, Homo Sapiens; identical to SEQ ID NO: 283916

SEQ ID NO: 752974 - RNA, 64 nt, Homo Sapiens; identical to SEQ ID NO: 283917

SEQ ID NO: 752975 - RNA, 64 nt, Homo Sapiens; identical to SEQ ID NO: 283918

SEQ ID NO: 752976 - RNA, 64 nt, Homo Sapiens; identical to SEQ ID NO: 283919

SEQ ID NO: 752977 - RNA, 64 nt, Homo Sapiens; identical to SEQ ID NO: 92229

SEQ ID NO: 752978 - RNA, 64 nt, Homo Sapiens; identical to SEQ ID NO: 92230

SEQ ID NO: 752979 - RNA, 64 nt, Homo Sapiens; identical to SEQ ID NO: 92231

SEQ ID NO: 752980 - RNA, 64 nt, Homo Sapiens; identical to SEQ ID NO: 92232

SEQ ID NO: 752981 - RNA, 64 nt, Homo Sapiens; identical to SEQ ID NO: 92233

SEQ ID NO: 752982 - RNA, 64 nt, Homo Sapiens; identical to SEQ ID NO: 92234

SEQ ID NO: 752983 - RNA, 64 nt, Homo Sapiens; identical to SEQ ID NO: 92235

SEQ ID NO: 752984 - RNA, 64 nt, Homo Sapiens; identical to SEQ ID NO: 92236

SEQ ID NO: 752985 - RNA, 64 nt, Homo Sapiens; identical to SEQ ID NO: 92237

SEQ ID NO: 752986 - RNA, 64 nt, Homo Sapiens; identical to SEQ ID NO: 92238

SEQ ID NO: 752987 - RNA, 64 nt, Homo Sapiens; identical to SEQ ID NO: 92239

SEQ ID NO: 752988 - RNA, 64 nt, Homo Sapiens; identical to SEQ ID NO: 92240

SEQ ID NO: 752989 - RNA, 64 nt, Homo Sapiens; identical to SEQ ID NO: 92241

SEQ ID NO: 752990 - RNA, 64 nt, Homo Sapiens; identical to SEQ ID NO: 92242

SEQ ID NO: 752991 - RNA, 64 nt, Homo Sapiens; identical to SEQ ID NO: 92243

SEQ ID NO: 752992 - RNA, 64 nt, Homo Sapiens; identical to SEQ ID NO: 92244

SEQ ID NO: 752993 - RNA, 64 nt, Homo Sapiens; identical to SEQ ID NO: 92245

SEQ ID NO: 752994 - RNA, 64 nt, Homo Sapiens; identical to SEQ ID NO: 92246

SEQ ID NO: 752995 - RNA, 64 nt, Homo Sapiens; identical to SEQ ID NO: 92247

SEQ ID NO: 752996 - RNA, 64 nt, Homo Sapiens; identical to SEQ ID NO: 92248

SEQ ID NO: 752997 - RNA, 64 nt, Homo Sapiens; identical to SEQ ID NO: 92249

SEQ ID NO: 752998 - RNA, 64 nt, Homo Sapiens; identical to SEQ ID NO: 92250

SEQ ID NO: 752999 - RNA, 64 nt, Homo Sapiens; identical to SEQ ID NO: 92251

SEQ ID NO: 753000 - RNA, 64 nt, Homo Sapiens; identical to SEQ ID NO: 92252

SEQ ID NO: 753001 - RNA, 64 nt, Homo Sapiens; identical to SEQ ID NO: 92253

SEQ ID NO: 753002 - RNA, 64 nt, Homo Sapiens; identical to SEQ ID NO: 92254

SEQ ID NO: 753003 - RNA, 64 nt, Homo Sapiens; identical to SEQ ID NO: 92255

SEQ ID NO: 753004 - RNA, 64 nt, Homo Sapiens; identical to SEQ ID NO: 92256

SEQ ID NO: 753005 - RNA, 64 nt, Homo Sapiens; identical to SEQ ID NO: 92257

SEQ ID NO: 753006 - RNA, 64 nt, Homo Sapiens; identical to SEQ ID NO: 92258

SEQ ID NO: 753007 - RNA, 64 nt, Homo Sapiens; identical to SEQ ID NO: 92259

SEQ ID NO: 753008 - RNA, 64 nt, Homo Sapiens; identical to SEQ ID NO: 92260

SEQ ID NO: 753009 - RNA, 64 nt, Homo Sapiens; identical to SEQ ID NO: 92261

SEQ ID NO: 753010 - RNA, 64 nt, Homo Sapiens; identical to SEQ ID NO: 92262

SEQ ID NO: 753011 - RNA, 64 nt, Homo Sapiens; identical to SEQ ID NO: 92263

SEQ ID NO: 753012 - RNA, 64 nt, Homo Sapiens; identical to SEQ ID NO: 92264

SEQ ID NO: 753013 - RNA, 64 nt, Homo Sapiens; identical to SEQ ID NO: 92265

SEQ ID NO: 753014 - RNA, 64 nt, Homo Sapiens; identical to SEQ ID NO: 92266

SEQ ID NO: 753015 - RNA, 64 nt, Homo Sapiens; identical to SEQ ID NO: 92267

SEQ ID NO: 753016 - RNA, 64 nt, Homo Sapiens; identical to SEQ ID NO: 92268

SEQ ID NO: 753017 - RNA, 64 nt, Homo Sapiens; identical to SEQ ID NO: 92269

SEQ ID NO: 753018 - RNA, 61 nt, Homo Sapiens; identical to SEQ ID NO: 92270

SEQ ID NO: 753019 - RNA, 64 nt, Homo Sapiens; identical to SEQ ID NO: 92271

SEQ ID NO: 753020 - RNA, 64 nt, Homo Sapiens; identical to SEQ ID NO: 92272

SEQ ID NO: 753021 - RNA, 64 nt, Homo Sapiens; identical to SEQ ID NO: 92273

SEQ ID NO: 753022 - RNA, 64 nt, Homo Sapiens; identical to SEQ ID NO: 92274

SEQ ID NO: 753023 - RNA, 64 nt, Homo Sapiens; identical to SEQ ID NO: 92275

SEQ ID NO: 753024 - RNA, 64 nt, Homo Sapiens; identical to SEQ ID NO: 92276

SEQ ID NO: 753025 - RNA, 64 nt, Homo Sapiens; identical to SEQ ID NO: 92277

SEQ ID NO: 753026 - RNA, 64 nt, Homo Sapiens; identical to SEQ ID NO: 92278

SEQ ID NO: 753027 - RNA, 64 nt, Homo Sapiens; identical to SEQ ID NO: 92279

SEQ ID NO: 753028 - RNA, 64 nt, Homo Sapiens; identical to SEQ ID NO: 92280

SEQ ID NO: 753029 - RNA, 64 nt, Homo Sapiens; identical to SEQ ID NO: 92281

SEQ ID NO: 753030 - RNA, 64 nt, Homo Sapiens; identical to SEQ ID NO: 92282

SEQ ID NO: 753031 - RNA, 64 nt, Homo Sapiens; identical to SEQ ID NO: 92283

SEQ ID NO: 753032 - RNA, 64 nt, Homo Sapiens; identical to SEQ ID NO: 92284

SEQ ID NO: 753033 - RNA, 64 nt, Homo Sapiens; identical to SEQ ID NO: 92285

SEQ ID NO: 753034 - RNA, 64 nt, Homo Sapiens; identical to SEQ ID NO: 92286

SEQ ID NO: 753035 - RNA, 64 nt, Homo Sapiens; identical to SEQ ID NO: 92287

SEQ ID NO: 753036 - RNA, 64 nt, Homo Sapiens; identical to SEQ ID NO: 92288

SEQ ID NO: 753037 - RNA, 64 nt, Homo Sapiens; identical to SEQ ID NO: 92289

SEQ ID NO: 753038 - RNA, 62 nt, Homo Sapiens; identical to SEQ ID NO: 92290

SEQ ID NO: 753039 - RNA, 64 nt, Homo Sapiens; identical to SEQ ID NO: 92291

SEQ ID NO: 753040 - RNA, 64 nt, Homo Sapiens; identical to SEQ ID NO: 92292

SEQ ID NO: 753041 - RNA, 64 nt, Homo Sapiens; identical to SEQ ID NO: 92293

SEQ ID NO: 753042 - RNA, 64 nt, Homo Sapiens; identical to SEQ ID NO: 92294

SEQ ID NO: 753043 - RNA, 64 nt, Homo Sapiens; identical to SEQ ID NO: 92295

SEQ ID NO: 753044 - RNA, 64 nt, Homo Sapiens; identical to SEQ ID NO: 92296

SEQ ID NO: 753045 - RNA, 64 nt, Homo Sapiens; identical to SEQ ID NO: 92297

SEQ ID NO: 753046 - RNA, 64 nt, Homo Sapiens; identical to SEQ ID NO: 92298

SEQ ID NO: 753047 - RNA, 64 nt, Homo Sapiens; identical to SEQ ID NO: 92299

SEQ ID NO: 753048 - RNA, 64 nt, Homo Sapiens; identical to SEQ ID NO: 92300

SEQ ID NO: 753049 - RNA, 64 nt, Homo Sapiens; identical to SEQ ID NO: 92301

SEQ ID NO: 753050 - RNA, 64 nt, Homo Sapiens; identical to SEQ ID NO: 92302

SEQ ID NO: 753051 - RNA, 64 nt, Homo Sapiens; identical to SEQ ID NO: 92303

SEQ ID NO: 753052 - RNA, 64 nt, Homo Sapiens; identical to SEQ ID NO: 92304

SEQ ID NO: 753053 - RNA, 64 nt, Homo Sapiens; identical to SEQ ID NO: 92305

SEQ ID NO: 753054 - RNA, 64 nt, Homo Sapiens; identical to SEQ ID NO: 92306

SEQ ID NO: 753055 - RNA, 64 nt, Homo Sapiens; identical to SEQ ID NO: 92307

SEQ ID NO: 753056 - RNA, 64 nt, Homo Sapiens; identical to SEQ ID NO: 92308

SEQ ID NO: 753057 - RNA, 64 nt, Homo Sapiens; identical to SEQ ID NO: 92309

SEQ ID NO: 753058 - RNA, 64 nt, Homo Sapiens; identical to SEQ ID NO: 92310

SEQ ID NO: 753059 - RNA, 64 nt, Homo Sapiens; identical to SEQ ID NO: 92311

SEQ ID NO: 753060 - RNA, 64 nt, Homo Sapiens; identical to SEQ ID NO: 92312

SEQ ID NO: 753061 - RNA, 64 nt, Homo Sapiens; identical to SEQ ID NO: 92313

SEQ ID NO: 753062 - RNA, 64 nt, Homo Sapiens; identical to SEQ ID NO: 92314

SEQ ID NO: 753063 - RNA, 64 nt, Homo Sapiens; identical to SEQ ID NO: 92315

SEQ ID NO: 753064 - RNA, 64 nt, Homo Sapiens; identical to SEQ ID NO: 92316

SEQ ID NO: 753065 - RNA, 64 nt, Homo Sapiens; identical to SEQ ID NO: 92317

SEQ ID NO: 753066 - RNA, 64 nt, Homo Sapiens; identical to SEQ ID NO: 92318

SEQ ID NO: 753067 - RNA, 64 nt, Homo Sapiens; identical to SEQ ID NO: 92319

SEQ ID NO: 753068 - RNA, 64 nt, Homo Sapiens; identical to SEQ ID NO: 92320

SEQ ID NO: 753069 - RNA, 64 nt, Homo Sapiens; identical to SEQ ID NO: 92321

SEQ ID NO: 753070 - RNA, 64 nt, Homo Sapiens; identical to SEQ ID NO: 92322

SEQ ID NO: 753071 - RNA, 64 nt, Homo Sapiens; identical to SEQ ID NO: 92323

SEQ ID NO: 753072 - RNA, 64 nt, Homo Sapiens; identical to SEQ ID NO: 92324

SEQ ID NO: 753073 - RNA, 64 nt, Homo Sapiens; identical to SEQ ID NO: 92325

SEQ ID NO: 753074 - RNA, 64 nt, Homo Sapiens; identical to SEQ ID NO: 92326

SEQ ID NO: 753075 - RNA, 64 nt, Homo Sapiens; identical to SEQ ID NO: 92327

SEQ ID NO: 753076 - RNA, 64 nt, Homo Sapiens; identical to SEQ ID NO: 92328

SEQ ID NO: 753077 - RNA, 64 nt, Homo Sapiens; identical to SEQ ID NO: 92329

SEQ ID NO: 753078 - RNA, 64 nt, Homo Sapiens; identical to SEQ ID NO: 92330

SEQ ID NO: 753079 - RNA, 64 nt, Homo Sapiens; identical to SEQ ID NO: 92331

SEQ ID NO: 753080 - RNA, 64 nt, Homo Sapiens; identical to SEQ ID NO: 92332

SEQ ID NO: 753081 - RNA, 64 nt, Homo Sapiens; identical to SEQ ID NO: 92333

SEQ ID NO: 753082 - RNA, 64 nt, Homo Sapiens; identical to SEQ ID NO: 92334

SEQ ID NO: 753083 - RNA, 64 nt, Homo Sapiens; identical to SEQ ID NO: 92335

SEQ ID NO: 753084 - RNA, 64 nt, Homo Sapiens; identical to SEQ ID NO: 92336

SEQ ID NO: 753085 - RNA, 64 nt, Homo Sapiens; identical to SEQ ID NO: 92337

SEQ ID NO: 753086 - RNA, 64 nt, Homo Sapiens; identical to SEQ ID NO: 92338

SEQ ID NO: 753087 - RNA, 64 nt, Homo Sapiens; identical to SEQ ID NO: 92339

SEQ ID NO: 753088 - RNA, 64 nt, Homo Sapiens; identical to SEQ ID NO: 92340

SEQ ID NO: 753089 - RNA, 64 nt, Homo Sapiens; identical to SEQ ID NO: 92341

SEQ ID NO: 753090 - RNA, 64 nt, Homo Sapiens; identical to SEQ ID NO: 92342

SEQ ID NO: 753091 - RNA, 64 nt, Homo Sapiens; identical to SEQ ID NO: 92343

SEQ ID NO: 753092 - RNA, 64 nt, Homo Sapiens; identical to SEQ ID NO: 92344

SEQ ID NO: 753093 - RNA, 64 nt, Homo Sapiens; identical to SEQ ID NO: 92345

SEQ ID NO: 753094 - RNA, 64 nt, Homo Sapiens; identical to SEQ ID NO: 92346

SEQ ID NO: 753095 - RNA, 64 nt, Homo Sapiens; identical to SEQ ID NO: 92347

SEQ ID NO: 753096 - RNA, 64 nt, Homo Sapiens; identical to SEQ ID NO: 50148

SEQ ID NO: 753097 - RNA, 64 nt, Homo Sapiens; identical to SEQ ID NO: 50149

SEQ ID NO: 753098 - RNA, 64 nt, Homo Sapiens; identical to SEQ ID NO: 50150

SEQ ID NO: 753099 - RNA, 64 nt, Homo Sapiens; identical to SEQ ID NO: 50151

SEQ ID NO: 753100 - RNA, 64 nt, Homo Sapiens; identical to SEQ ID NO: 50152

SEQ ID NO: 753101 - RNA, 64 nt, Homo Sapiens; identical to SEQ ID NO: 50153

SEQ ID NO: 753102 - RNA, 64 nt, Homo Sapiens; identical to SEQ ID NO: 50154

SEQ ID NO: 753103 - RNA, 64 nt, Homo Sapiens; identical to SEQ ID NO: 50155

SEQ ID NO: 753104 - RNA, 64 nt, Homo Sapiens; identical to SEQ ID NO: 50156

SEQ ID NO: 753105 - RNA, 64 nt, Homo Sapiens; identical to SEQ ID NO: 50157

SEQ ID NO: 753106 - RNA, 64 nt, Homo Sapiens; identical to SEQ ID NO: 50158

SEQ ID NO: 753107 - RNA, 64 nt, Homo Sapiens; identical to SEQ ID NO: 50159

SEQ ID NO: 753108 - RNA, 64 nt, Homo Sapiens; identical to SEQ ID NO: 50160

SEQ ID NO: 753109 - RNA, 64 nt, Homo Sapiens; identical to SEQ ID NO: 50161

SEQ ID NO: 753110 - RNA, 64 nt, Homo Sapiens; identical to SEQ ID NO: 50162

SEQ ID NO: 753111 - RNA, 64 nt, Homo Sapiens; identical to SEQ ID NO: 50163

SEQ ID NO: 753112 - RNA, 64 nt, Homo Sapiens; identical to SEQ ID NO: 50164

SEQ ID NO: 753113 - RNA, 64 nt, Homo Sapiens; identical to SEQ ID NO: 50165

SEQ ID NO: 753114 - RNA, 64 nt, Homo Sapiens; identical to SEQ ID NO: 50166

SEQ ID NO: 753115 - RNA, 64 nt, Homo Sapiens; identical to SEQ ID NO: 50167

SEQ ID NO: 753116 - RNA, 64 nt, Homo Sapiens; identical to SEQ ID NO: 50168

SEQ ID NO: 753117 - RNA, 64 nt, Homo Sapiens; identical to SEQ ID NO: 50169

SEQ ID NO: 753118 - RNA, 64 nt, Homo Sapiens; identical to SEQ ID NO: 50170

SEQ ID NO: 753119 - RNA, 64 nt, Homo Sapiens; identical to SEQ ID NO: 50171

SEQ ID NO: 753120 - RNA, 64 nt, Homo Sapiens; identical to SEQ ID NO: 50172

SEQ ID NO: 753121 - RNA, 64 nt, Homo Sapiens; identical to SEQ ID NO: 50173

SEQ ID NO: 753122 - RNA, 64 nt, Homo Sapiens; identical to SEQ ID NO: 158460

SEQ ID NO: 753123 - RNA, 64 nt, Homo Sapiens; identical to SEQ ID NO: 158461

SEQ ID NO: 753124 - RNA, 64 nt, Homo Sapiens; identical to SEQ ID NO: 158462

SEQ ID NO: 753125 - RNA, 64 nt, Homo Sapiens; identical to SEQ ID NO: 158463

SEQ ID NO: 753126 - RNA, 64 nt, Homo Sapiens; identical to SEQ ID NO: 158464

SEQ ID NO: 753127 - RNA, 64 nt, Homo Sapiens; identical to SEQ ID NO: 158465

SEQ ID NO: 753128 - RNA, 64 nt, Homo Sapiens; identical to SEQ ID NO: 158466

SEQ ID NO: 753129 - RNA, 64 nt, Homo Sapiens; identical to SEQ ID NO: 158467

SEQ ID NO: 753130 - RNA, 64 nt, Homo Sapiens; identical to SEQ ID NO: 158468

SEQ ID NO: 753131 - RNA, 64 nt, Homo Sapiens; identical to SEQ ID NO: 158469

SEQ ID NO: 753132 - RNA, 64 nt, Homo Sapiens; identical to SEQ ID NO: 158470

SEQ ID NO: 753133 - RNA, 64 nt, Homo Sapiens
gauugcagcaacacgcucggcugcccaaacccaaggcgaagaccuugccagaguucaucaagga

SEQ ID NO: 753134 - RNA, 64 nt, Homo Sapiens
auccucuucacccugcccugccugcaguugagggggcgaagaagaacccuguguucucaggaag

SEQ ID NO: 753135 - RNA, 64 nt, Homo Sapiens
uuagauguacagugaagggaaaagaaaaaaaaugggcgaagagaggguggaaaauaaaaggauu

SEQ ID NO: 753136 - RNA, 64 nt, Homo Sapiens
cacgaacgaaugucgagaggaucgcuccagccaaggcgaagaagccccaccccugcucgccccu

SEQ ID NO: 753137 - RNA, 64 nt, Homo Sapiens
gcccgguaggcugcgucgccccucuccggugagcggcgaagacaaaaccaaacacccggacgac

SEQ ID NO: 753138 - RNA, 64 nt, Homo Sapiens
ccuucccugcccugguuugguuggccuugcccagggcgaagacacaagacugcacgugucccuc

SEQ ID NO: 753139 - RNA, 64 nt, Homo Sapiens
uugucuuuaggauaaggcaguauuuuacaaaaugggcgaagauaucauuauauuuugaauuauu

SEQ ID NO: 753140 - RNA, 64 nt, Homo Sapiens
cuuauuacacggaaaacgguuauacacugucuagggcgaagaccccagauaaugcuacuuuauu

SEQ ID NO: 753141 - RNA, 64 nt, Homo Sapiens
aaacaaaaucacaaaaccuggacaucccucaaggggcgaagaggcggccgggagacugcagaag

SEQ ID NO: 753142 - RNA, 64 nt, Homo Sapiens
gcagggcucauucauugcccacuaggaucccacuggcgaagauggucuccauaucagcucucug

SEQ ID NO: 753143 - RNA, 64 nt, Homo Sapiens
gucacugcucguguggucuccagcaagggauucgggcgaagacaaacggaugcacccgucuuua

SEQ ID NO: 753144 - RNA, 64 nt, Homo Sapiens
gaggcugaagcaggagaauugcucaaaccugggaggcgaagauugcagugagcugaaaucacac

SEQ ID NO: 753145 - RNA, 64 nt, Homo Sapiens
acauguggauauccagccaggagcagggcugaggggcgaagaggugugguugaccugccuuggg

SEQ ID NO: 753146 - RNA, 64 nt, Homo Sapiens
aagggagagggaaucggagggagcagcggaaugcggcgaagacucuggacagcgagggcacagg

SEQ ID NO: 753147 - RNA, 64 nt, Homo Sapiens
gagagaaaaccuuccagcagcccaguaaacugcgggcgaagagaucuacccgucucccucccuc

SEQ ID NO: 753148 - RNA, 64 nt, Homo Sapiens
ggauuacaccagaagauuuaaagugggaggguggggcgaagaaauuggcuugucucaggguggg

SEQ ID NO: 753149 - RNA, 64 nt, Homo Sapiens
cuuccaucgauuggguaguguccuucaaguggguggcgaagagccagucgggcauaugucauga

SEQ ID NO: 753150 - RNA, 64 nt, Homo Sapiens
ugggagagaaccugucaaaaugucgaagaaggaaggcgaagaaucaaguaaucucuaggcaaau

SEQ ID NO: 753151 - RNA, 64 nt, Homo Sapiens
uccuuccugguagguaccccgagaguacugacgaggcgaagaugaauuugacacaaaaggcauc

SEQ ID NO: 753152 - RNA, 64 nt, Homo Sapiens
ugcaggaggcacagggacuccgggagacucagagggcgaagagcacuggcauuuggcaugucca

SEQ ID NO: 753153 - RNA, 64 nt, Homo Sapiens
agcucacucgaccuugaggaggccucccacgaagggcgaagauggccgagaugauccuaaaaau

SEQ ID NO: 753154 - RNA, 64 nt, Homo Sapiens
cucccucuggcauuugggaggggcagggagggagggcgaagagggcugaugguugagggauggu

SEQ ID NO: 753155 - RNA, 64 nt, Homo Sapiens
gauccacguuucaucuuuaaucguuuucagcuuuggcgaagauguaggaggaggcugcagcucc

SEQ ID NO: 753156 - RNA, 64 nt, Homo Sapiens
gcuuuugguuguaggcggcucacucaacccagaaggcgaagauaauuuccacacuuggcuugag

SEQ ID NO: 753157 - RNA, 64 nt, Homo Sapiens
gauccugcauguuaauggguuuaauggagagggcggcgaagaggacccgcaggcugcaaggagc

SEQ ID NO: 753158 - RNA, 64 nt, Homo Sapiens
ugaagcucaggugucucacgucugggcugcaccaggcgaagagagaaauuaaagauuugagguu

SEQ ID NO: 753159 - RNA, 64 nt, Homo Sapiens
aaauugaagauaaaauggaaugaagcauauuuguggcgaagaucaaugaaaaugucuucugaag

SEQ ID NO: 753160 - RNA, 64 nt, Homo Sapiens
agaaagauguguuuuguuuugugcccaugguggcggcgaagaagaaugaaugugcugaagcaaa

SEQ ID NO: 753161 - RNA, 64 nt, Homo Sapiens
agagggggagcuugcaggaauaaagaauauauugggcgaagaauagaaguaguuuacuuuggac

SEQ ID NO: 753162 - RNA, 64 nt, Homo Sapiens
cuuauaaggcuuucuguaaaagguacuauagaagggcgaagaaucguucaacugucaaucagcc

SEQ ID NO: 753163 - RNA, 64 nt, Homo Sapiens; identical to SEQ ID NO: 264315

SEQ ID NO: 753164 - RNA, 64 nt, Homo Sapiens; identical to SEQ ID NO: 264316

SEQ ID NO: 753165 - RNA, 64 nt, Homo Sapiens; identical to SEQ ID NO: 264317

SEQ ID NO: 753166 - RNA, 64 nt, Homo Sapiens; identical to SEQ ID NO: 264318

SEQ ID NO: 753167 - RNA, 64 nt, Homo Sapiens; identical to SEQ ID NO: 264319

SEQ ID NO: 753168 - RNA, 64 nt, Homo Sapiens; identical to SEQ ID NO: 264320

SEQ ID NO: 753169 - RNA, 64 nt, Homo Sapiens; identical to SEQ ID NO: 264321

SEQ ID NO: 753170 - RNA, 64 nt, Homo Sapiens; identical to SEQ ID NO: 264322

SEQ ID NO: 753171 - RNA, 64 nt, Homo Sapiens
uuacauaacaaucuucuuugcuuuuuuggcagauaaacccaacagaggugaggcccagcuagua

SEQ ID NO: 753172 - RNA, 64 nt, Homo Sapiens
ccugggaaacugaucacuucacaugccauuaauaaaacccaagaucuuuuaaaucaaaaccauu

SEQ ID NO: 753173 - RNA, 64 nt, Homo Sapiens
aaucugcaauucaaaucagacuacaaagaaaaaaaaacccaacccuaauuuacugaucuuacua

SEQ ID NO: 753174 - RNA, 64 nt, Homo Sapiens
auaaugcaugcauaauuuaauuaaaaauaaaaaaaaacccaaaaguauuaaauacauaucauuu

SEQ ID NO: 753175 - RNA, 64 nt, Homo Sapiens
uuaugugaacaagcaaaauugagaaggggaaaaaaaacccaaaagacugagagaagucagaaca

SEQ ID NO: 753176 - RNA, 64 nt, Homo Sapiens
auugaucuguguacgugucccaggauaaaauuaaaaacccaagcgcgaacuugaucagcuucuc

SEQ ID NO: 753177 - RNA, 64 nt, Homo Sapiens
aagcucuagucugugcuuaauguaaugcaggaagaaacccaagcacauuaacaaauuuuuaccu

SEQ ID NO: 753178 - RNA, 64 nt, Homo Sapiens
uguccaggcaaauaaacucaaacaaaagccagacaaacccaaguuuauuuuuaaagaaaaagaa

SEQ ID NO: 753179 - RNA, 64 nt, Homo Sapiens
uccagaugaauauccgagauuuguaucacaaaacaaacccaauaccaguuaaggugaauaugua

SEQ ID NO: 753180 - RNA, 64 nt, Homo Sapiens
guaaauaacauaugacuucuuucccaucccacacaaacccaauucacuggcucauccgcccuac

SEQ ID NO: 753181 - RNA, 64 nt, Homo Sapiens
gcagguggcccuuugacuguaaaauguccuugguaaacccaaaggcuuauucuguugccugcgu

SEQ ID NO: 753182 - RNA, 64 nt, Homo Sapiens
ggaacaagagugaaacucucaaaagcagaaacaaaaacccaacauauaugggcuguuagauagu

SEQ ID NO: 753183 - RNA, 64 nt, Homo Sapiens
cucucugcauguacacauuacagcgaaaaaaaugaaacccaaaaaacauguaaagaaaauaagu

SEQ ID NO: 753184 - RNA, 64 nt, Homo Sapiens
accuaguuaauugagggaugagguagaaaagacaaaacccaaacuuuuuguacauaguagcauu

SEQ ID NO: 753185 - RNA, 64 nt, Homo Sapiens
guaggaaggucaaggucauuaauagaaaaaaaacaaacccaaagggaagaaacacguggucaug

SEQ ID NO: 753186 - RNA, 64 nt, Homo Sapiens
cagucuaguuuccugguucccaaaggaaagcuuaaaacccaauaacauuuaauucagcuuuguc

SEQ ID NO: 753187 - RNA, 64 nt, Homo Sapiens
accugaaaaaguuugacuuucaguuauguucaggaaacccaauauguugaaaguuccuuuuugc

SEQ ID NO: 753188 - RNA, 64 nt, Homo Sapiens
ggucaggggauuuuauaaacuaauaauuuuuuuaaaacccaagaaaaacauuuauucuuuuaaa

SEQ ID NO: 753189 - RNA, 64 nt, Homo Sapiens
cugccauguuuuugcaaauaggguccaccaaaggaaacccaauugguugggaaacucauuuacu

SEQ ID NO: 753190 - RNA, 64 nt, Homo Sapiens
ggaaucaucacuuaauuacuucuugcccuuugagaaacccaaguuuaauucuucucuuucucau

SEQ ID NO: 753191 - RNA, 64 nt, Homo Sapiens
cuaagcagaaaaagaaaaaacuuuucuucccuagaaacccaauuggcuguuuuuaaugcagggg

SEQ ID NO: 753192 - RNA, 64 nt, Homo Sapiens
cagauccaccauaggauucuagguacaguagcugaaacccaauuuuuuuuaauucacaaggacc

SEQ ID NO: 753193 - RNA, 64 nt, Homo Sapiens
uggauaauuuucauuaucuuacagaagaacucaaaaacccaauuuuuaggguagagcacucuuu

SEQ ID NO: 753194 - RNA, 64 nt, Homo Sapiens
cugcauggucaaguggugcugagaagaaaaaccaaaacccaaccacuuugagaccagaauuaca

SEQ ID NO: 753195 - RNA, 64 nt, Homo Sapiens
ggaaacacagacacauccucguaagagaugagaaaaacccaacaaaaauugaaguuuguaugau

SEQ ID NO: 753196 - RNA, 64 nt, Homo Sapiens
acaacccagaacaaagcaaacaaacaaacaaaaaaaacccaacaaagaaaaccaaaaaccaaaa

SEQ ID NO: 753197 - RNA, 64 nt, Homo Sapiens
gagaacaaaauccuggcccggccuggacacacggaaacccaacugaaaaggaaacccaagagcu

SEQ ID NO: 753198 - RNA, 64 nt, Homo Sapiens
gcugccuggacacacggaaaaaagaaagaaaaggaaacccaagacgucucaaaaaaaaaaaaag

SEQ ID NO: 753199 - RNA, 64 nt, Homo Sapiens
gcuggccaggugugguggcuucuguucaaguagaaaacccaagaguguaacaaaucagagacua

SEQ ID NO: 753200 - RNA, 62 nt, Homo Sapiens
acucaguugauagucuggaaauauuuuccaucugaaaguaucuguggacaggagcauuuugc

SEQ ID NO: 753201 - RNA, 62 nt, Homo Sapiens
aauaaaccagagugaucaagaaucuuacaauuugaaaguaaauaauauaaaauguuuugcua

SEQ ID NO: 753202 - RNA, 62 nt, Homo Sapiens
acucaagcaucaauucagcucuucuuuuggaaugaaaguauagccaaaacauaaaaaaaaaa

SEQ ID NO: 753203 - RNA, 62 nt, Homo Sapiens
auguacagaggaaacuguucaaguauuggauuugaaaguaagugacuuauguuuaacagaac

SEQ ID NO: 753204 - RNA, 62 nt, Homo Sapiens
uguaugagcagagcaguucaugauauaaagaaugaaaguagcagguuugcuccuagaacugg

SEQ ID NO: 753205 - RNA, 62 nt, Homo Sapiens
aaaauaauugagacugaaaguugaaauauaguugaaaguaaaauuuagaaacugguucugug

SEQ ID NO: 753206 - RNA, 62 nt, Homo Sapiens
guuaaacucauucagaucauuuguaauuuauuugaaaguaguucggaauacauuaacuuccu

SEQ ID NO: 753207 - RNA, 62 nt, Homo Sapiens
aguuauugauacugcuggacagauuaagauuaugaaaguaacauuaagacacugcuaggaga

SEQ ID NO: 753208 - RNA, 62 nt, Homo Sapiens
acgaucauauuguacuguaucauuccuagccaugaaaguagcaaagagaaacccaacaacuu

SEQ ID NO: 753209 - RNA, 62 nt, Homo Sapiens
gcccagucuuccugaauccuaucccaguuuccugaaaguaaucagcagugcuauuuugaguc

SEQ ID NO: 753210 - RNA, 62 nt, Homo Sapiens
agcaaagacagagggcucauucacagagaaucugaaaguagcugaaaaguaacagucuuuug

SEQ ID NO: 753211 - RNA, 62 nt, Homo Sapiens
ugauuuuuacaugauuccagucuaaacaguuaugaaaguaagaaagggaaaacauuuggggu

SEQ ID NO: 753212 - RNA, 62 nt, Homo Sapiens
aggauggauuagucaguucuuuucauuggucuugaaaguaauuuuggcuggucgcgguggcu

SEQ ID NO: 753213 - RNA, 62 nt, Homo Sapiens
auauugucuccauuuaucauacaggaucauuaugaaaguaaaaugaaguaguauauaugaaa

SEQ ID NO: 753214 - RNA, 62 nt, Homo Sapiens
ugaaugcuaaauauuugcaaacaaguacaucuugaaaguaaaggugacuuagagaaaagaga

SEQ ID NO: 753215 - RNA, 62 nt, Homo Sapiens
aaaguauguaauacccauuuuaaaaaaccauuugaaaguagacaacuuauuccaaaauagca

SEQ ID NO: 753216 - RNA, 62 nt, Homo Sapiens
aaccuuuuguuuuuuuccugaaaguuuuuaauugaaaguauuauuaguuaaagauguaaacc

SEQ ID NO: 753217 - RNA, 62 nt, Homo Sapiens
gaaaaacagcaaccaccagaauagcauauaucugaaaguagucuucagcuuuaggcagaugc

SEQ ID NO: 753218 - RNA, 62 nt, Homo Sapiens
gaaaaugcagcaugaaguugacauuguggaaaugaaaguaauuggguauuagaaaucugaaa

SEQ ID NO: 753219 - RNA, 62 nt, Homo Sapiens
guggaaaugaaaguaauuggguauuagaaaucugaaaguacugucaucuaaaagcaauugug

SEQ ID NO: 753220 - RNA, 62 nt, Homo Sapiens
uucacucuuuacuuuugaggcagccauuagguugaaaguauauauuuaucauauaaaacuug

SEQ ID NO: 753221 - RNA, 62 nt, Homo Sapiens
uaaggcacuaauuuuacuuaccuauuagauuuugaaaguaucugagauauacaaaucucccu

SEQ ID NO: 753222 - RNA, 62 nt, Homo Sapiens
agucagaaugaauuaugguuuuaaaauauaucugaaaguaguccacgauggauauugguucu

SEQ ID NO: 753223 - RNA, 62 nt, Homo Sapiens
cugaagcagaucaccaccgaacugaagucacaugaaaguaaggauuuccugcaggaggagca

SEQ ID NO: 753224 - RNA, 62 nt, Homo Sapiens
gaacaauaccugggaaauaauuuagcuaguuuugaaaguaagaaccaugcuaacauuuuccu

SEQ ID NO: 753225 - RNA, 62 nt, Homo Sapiens
acugaaguaaaacaccaacuccaaaaccaacaugaaaguaccguuuucuucuuuuuucuuca

SEQ ID NO: 753226 - RNA, 62 nt, Homo Sapiens
uauuacauuauuuuuauuuuauuguuauauuuugaaaguacuuguuauaugggagaacgaaa

SEQ ID NO: 753227 - RNA, 62 nt, Homo Sapiens
auuuugacuaagaauguaaaaccuuuagacucugaaaguaaugaaccaauuuuguuuuuaaa

SEQ ID NO: 753228 - RNA, 62 nt, Homo Sapiens
acugaaagagacaaagagaaagaaaauauuccugaaaguagaaguguuggaagauguaggug

SEQ ID NO: 753229 - RNA, 62 nt, Homo Sapiens
auuucuuauuuaaagaacccaaaucagugaguugaaaguaaauuuuaaagccucuaaguaua

SEQ ID NO: 753230 - RNA, 62 nt, Homo Sapiens
caagguagugaaguaauuggaaugaaggaggcugaaaguauugucuaaagugagcccagagg

SEQ ID NO: 753231 - RNA, 62 nt, Homo Sapiens
auuaaaguuacuguugcauuuaggaggcuccuugaaaguaacaccuuuuccaaggacaaugg

SEQ ID NO: 753232 - RNA, 62 nt, Homo Sapiens
cuuauuuauuuaauaggcugcagugucgcuuaugaaaguacgauguacaguaacuuaaugga

SEQ ID NO: 753233 - RNA, 62 nt, Homo Sapiens
guagccggguucuaccacaaacagaaacagaaugaaaguagcugucaguccuuguagagagc

SEQ ID NO: 753234 - RNA, 62 nt, Homo Sapiens
uagcuccccuucuucaugagcaucuguagagcugaaaguauucuggaacuuuagacagaaag

SEQ ID NO: 753235 - RNA, 62 nt, Homo Sapiens
uucagguucugaauaacaauauuuuuccaaauugaaaguaaauauuccagaaguugauagcc

SEQ ID NO: 753236 - RNA, 62 nt, Homo Sapiens
aaagggaggggaaacuuugcuuugguuuuguuugaaaguaaguuccagaugaaaacuacucu

SEQ ID NO: 753237 - RNA, 62 nt, Homo Sapiens
ugauuacuauugcuguagugagucccucuugcugaaaguagaucuuuuuccuuguuuaaagg

SEQ ID NO: 753238 - RNA, 62 nt, Homo Sapiens
cacacuggagauaaacccuuuuuucaagcacaugaaaguacuacuuacuugucuccuuuagg

SEQ ID NO: 753239 - RNA, 62 nt, Homo Sapiens
gaagguagucauggcggagaagagagacucugugaaaguaaauuuuacagaaaucauauggu

SEQ ID NO: 753240 - RNA, 64 nt, Homo Sapiens; identical to SEQ ID NO: 507092

SEQ ID NO: 753241 - RNA, 64 nt, Homo Sapiens; identical to SEQ ID NO: 507093

SEQ ID NO: 753242 - RNA, 64 nt, Homo Sapiens; identical to SEQ ID NO: 507094

SEQ ID NO: 753243 - RNA, 64 nt, Homo Sapiens; identical to SEQ ID NO: 507095

SEQ ID NO: 753244 - RNA, 64 nt, Homo Sapiens; identical to SEQ ID NO: 228081

SEQ ID NO: 753245 - RNA, 64 nt, Homo Sapiens; identical to SEQ ID NO: 228082

SEQ ID NO: 753246 - RNA, 64 nt, Homo Sapiens; identical to SEQ ID NO: 228083

SEQ ID NO: 753247 - RNA, 64 nt, Homo Sapiens; identical to SEQ ID NO: 228084

SEQ ID NO: 753248 - RNA, 64 nt, Homo Sapiens; identical to SEQ ID NO: 228085

SEQ ID NO: 753249 - RNA, 64 nt, Homo Sapiens; identical to SEQ ID NO: 228086

SEQ ID NO: 753250 - RNA, 64 nt, Homo Sapiens; identical to SEQ ID NO: 228087

SEQ ID NO: 753251 - RNA, 64 nt, Homo Sapiens; identical to SEQ ID NO: 228088

SEQ ID NO: 753252 - RNA, 64 nt, Homo Sapiens; identical to SEQ ID NO: 228089

SEQ ID NO: 753253 - RNA, 64 nt, Homo Sapiens; identical to SEQ ID NO: 228090

SEQ ID NO: 753254 - RNA, 64 nt, Homo Sapiens; identical to SEQ ID NO: 228091

SEQ ID NO: 753255 - RNA, 64 nt, Homo Sapiens; identical to SEQ ID NO: 228092

SEQ ID NO: 753256 - RNA, 64 nt, Homo Sapiens; identical to SEQ ID NO: 228093

SEQ ID NO: 753257 - RNA, 64 nt, Homo Sapiens; identical to SEQ ID NO: 228094

SEQ ID NO: 753258 - RNA, 64 nt, Homo Sapiens; identical to SEQ ID NO: 228095

SEQ ID NO: 753259 - RNA, 64 nt, Homo Sapiens; identical to SEQ ID NO: 228096

SEQ ID NO: 753260 - RNA, 64 nt, Homo Sapiens; identical to SEQ ID NO: 228097

SEQ ID NO: 753261 - RNA, 64 nt, Homo Sapiens; identical to SEQ ID NO: 228098

SEQ ID NO: 753262 - RNA, 64 nt, Homo Sapiens; identical to SEQ ID NO: 228099

SEQ ID NO: 753263 - RNA, 64 nt, Homo Sapiens; identical to SEQ ID NO: 228100

SEQ ID NO: 753264 - RNA, 64 nt, Homo Sapiens; identical to SEQ ID NO: 228101

SEQ ID NO: 753265 - RNA, 64 nt, Homo Sapiens; identical to SEQ ID NO: 228102

SEQ ID NO: 753266 - RNA, 64 nt, Homo Sapiens; identical to SEQ ID NO: 228103

SEQ ID NO: 753267 - RNA, 64 nt, Homo Sapiens; identical to SEQ ID NO: 228104

SEQ ID NO: 753268 - RNA, 64 nt, Homo Sapiens; identical to SEQ ID NO: 228105

SEQ ID NO: 753269 - RNA, 64 nt, Homo Sapiens; identical to SEQ ID NO: 228106

SEQ ID NO: 753270 - RNA, 64 nt, Homo Sapiens; identical to SEQ ID NO: 228107

SEQ ID NO: 753271 - RNA, 64 nt, Homo Sapiens; identical to SEQ ID NO: 228108

SEQ ID NO: 753272 - RNA, 64 nt, Homo Sapiens; identical to SEQ ID NO: 228109

SEQ ID NO: 753273 - RNA, 64 nt, Homo Sapiens; identical to SEQ ID NO: 228110

SEQ ID NO: 753274 - RNA, 64 nt, Homo Sapiens; identical to SEQ ID NO: 228111

SEQ ID NO: 753275 - RNA, 64 nt, Homo Sapiens; identical to SEQ ID NO: 228112

SEQ ID NO: 753276 - RNA, 64 nt, Homo Sapiens; identical to SEQ ID NO: 228113

SEQ ID NO: 753277 - RNA, 64 nt, Homo Sapiens; identical to SEQ ID NO: 228114

SEQ ID NO: 753278 - RNA, 64 nt, Homo Sapiens; identical to SEQ ID NO: 228115

SEQ ID NO: 753279 - RNA, 64 nt, Homo Sapiens; identical to SEQ ID NO: 228116

SEQ ID NO: 753280 - RNA, 64 nt, Homo Sapiens; identical to SEQ ID NO: 228117

SEQ ID NO: 753281 - RNA, 64 nt, Homo Sapiens; identical to SEQ ID NO: 228118

SEQ ID NO: 753282 - RNA, 64 nt, Homo Sapiens; identical to SEQ ID NO: 228119

SEQ ID NO: 753283 - RNA, 64 nt, Homo Sapiens; identical to SEQ ID NO: 228120

SEQ ID NO: 753284 - RNA, 64 nt, Homo Sapiens; identical to SEQ ID NO: 228121

SEQ ID NO: 753285 - RNA, 64 nt, Homo Sapiens; identical to SEQ ID NO: 228122

SEQ ID NO: 753286 - RNA, 64 nt, Homo Sapiens; identical to SEQ ID NO: 228123

SEQ ID NO: 753287 - RNA, 64 nt, Homo Sapiens; identical to SEQ ID NO: 228124

SEQ ID NO: 753288 - RNA, 64 nt, Homo Sapiens; identical to SEQ ID NO: 228125

SEQ ID NO: 753289 - RNA, 64 nt, Homo Sapiens; identical to SEQ ID NO: 228126

SEQ ID NO: 753290 - RNA, 64 nt, Homo Sapiens; identical to SEQ ID NO: 228127

SEQ ID NO: 753291 - RNA, 64 nt, Homo Sapiens; identical to SEQ ID NO: 228128

SEQ ID NO: 753292 - RNA, 64 nt, Homo Sapiens; identical to SEQ ID NO: 228129

SEQ ID NO: 753293 - RNA, 64 nt, Homo Sapiens; identical to SEQ ID NO: 228130

SEQ ID NO: 753294 - RNA, 64 nt, Homo Sapiens; identical to SEQ ID NO: 228131

SEQ ID NO: 753295 - RNA, 64 nt, Homo Sapiens; identical to SEQ ID NO: 228132

SEQ ID NO: 753296 - RNA, 64 nt, Homo Sapiens; identical to SEQ ID NO: 228133

SEQ ID NO: 753297 - RNA, 64 nt, Homo Sapiens; identical to SEQ ID NO: 228134

SEQ ID NO: 753298 - RNA, 64 nt, Homo Sapiens; identical to SEQ ID NO: 228135

SEQ ID NO: 753299 - RNA, 64 nt, Homo Sapiens; identical to SEQ ID NO: 228136

SEQ ID NO: 753300 - RNA, 64 nt, Homo Sapiens; identical to SEQ ID NO: 228137

SEQ ID NO: 753301 - RNA, 64 nt, Homo Sapiens; identical to SEQ ID NO: 228138

SEQ ID NO: 753302 - RNA, 64 nt, Homo Sapiens; identical to SEQ ID NO: 228139

SEQ ID NO: 753303 - RNA, 64 nt, Homo Sapiens; identical to SEQ ID NO: 228140

SEQ ID NO: 753304 - RNA, 64 nt, Homo Sapiens; identical to SEQ ID NO: 228141

SEQ ID NO: 753305 - RNA, 64 nt, Homo Sapiens; identical to SEQ ID NO: 228142

SEQ ID NO: 753306 - RNA, 64 nt, Homo Sapiens; identical to SEQ ID NO: 228143

SEQ ID NO: 753307 - RNA, 64 nt, Homo Sapiens; identical to SEQ ID NO: 228144

SEQ ID NO: 753308 - RNA, 64 nt, Homo Sapiens; identical to SEQ ID NO: 228145

SEQ ID NO: 753309 - RNA, 64 nt, Homo Sapiens; identical to SEQ ID NO: 228146

SEQ ID NO: 753310 - RNA, 64 nt, Homo Sapiens; identical to SEQ ID NO: 228147

SEQ ID NO: 753311 - RNA, 64 nt, Homo Sapiens; identical to SEQ ID NO: 228148

SEQ ID NO: 753312 - RNA, 64 nt, Homo Sapiens; identical to SEQ ID NO: 228149

SEQ ID NO: 753313 - RNA, 64 nt, Homo Sapiens; identical to SEQ ID NO: 228150

SEQ ID NO: 753314 - RNA, 64 nt, Homo Sapiens; identical to SEQ ID NO: 228151

SEQ ID NO: 753315 - RNA, 64 nt, Homo Sapiens; identical to SEQ ID NO: 228152

SEQ ID NO: 753316 - RNA, 64 nt, Homo Sapiens; identical to SEQ ID NO: 228153

SEQ ID NO: 753317 - RNA, 64 nt, Homo Sapiens; identical to SEQ ID NO: 228154

SEQ ID NO: 753318 - RNA, 64 nt, Homo Sapiens; identical to SEQ ID NO: 228155

SEQ ID NO: 753319 - RNA, 64 nt, Homo Sapiens; identical to SEQ ID NO: 228156

SEQ ID NO: 753320 - RNA, 64 nt, Homo Sapiens; identical to SEQ ID NO: 228157

SEQ ID NO: 753321 - RNA, 64 nt, Homo Sapiens; identical to SEQ ID NO: 228158

SEQ ID NO: 753322 - RNA, 64 nt, Homo Sapiens; identical to SEQ ID NO: 228159

SEQ ID NO: 753323 - RNA, 64 nt, Homo Sapiens; identical to SEQ ID NO: 228160

SEQ ID NO: 753324 - RNA, 64 nt, Homo Sapiens; identical to SEQ ID NO: 228161

SEQ ID NO: 753325 - RNA, 64 nt, Homo Sapiens; identical to SEQ ID NO: 228162

SEQ ID NO: 753326 - RNA, 64 nt, Homo Sapiens; identical to SEQ ID NO: 228163

SEQ ID NO: 753327 - RNA, 64 nt, Homo Sapiens; identical to SEQ ID NO: 228164

SEQ ID NO: 753328 - RNA, 64 nt, Homo Sapiens; identical to SEQ ID NO: 228165

SEQ ID NO: 753329 - RNA, 64 nt, Homo Sapiens; identical to SEQ ID NO: 228166

SEQ ID NO: 753330 - RNA, 64 nt, Homo Sapiens; identical to SEQ ID NO: 228167

SEQ ID NO: 753331 - RNA, 64 nt, Homo Sapiens; identical to SEQ ID NO: 228168

SEQ ID NO: 753332 - RNA, 52 nt, Homo Sapiens; identical to SEQ ID NO: 228169

SEQ ID NO: 753333 - RNA, 64 nt, Homo Sapiens; identical to SEQ ID NO: 228170

SEQ ID NO: 753334 - RNA, 64 nt, Homo Sapiens; identical to SEQ ID NO: 228171

SEQ ID NO: 753335 - RNA, 64 nt, Homo Sapiens; identical to SEQ ID NO: 228172

SEQ ID NO: 753336 - RNA, 64 nt, Homo Sapiens; identical to SEQ ID NO: 228173

SEQ ID NO: 753337 - RNA, 64 nt, Homo Sapiens; identical to SEQ ID NO: 228174

SEQ ID NO: 753338 - RNA, 64 nt, Homo Sapiens; identical to SEQ ID NO: 228175

SEQ ID NO: 753339 - RNA, 64 nt, Homo Sapiens; identical to SEQ ID NO: 228176

SEQ ID NO: 753340 - RNA, 64 nt, Homo Sapiens; identical to SEQ ID NO: 228177

SEQ ID NO: 753341 - RNA, 64 nt, Homo Sapiens; identical to SEQ ID NO: 228178

SEQ ID NO: 753342 - RNA, 64 nt, Homo Sapiens; identical to SEQ ID NO: 228179

SEQ ID NO: 753343 - RNA, 64 nt, Homo Sapiens; identical to SEQ ID NO: 228180

SEQ ID NO: 753344 - RNA, 64 nt, Homo Sapiens; identical to SEQ ID NO: 228181

SEQ ID NO: 753345 - RNA, 64 nt, Homo Sapiens; identical to SEQ ID NO: 228182

SEQ ID NO: 753346 - RNA, 64 nt, Homo Sapiens; identical to SEQ ID NO: 228183

SEQ ID NO: 753347 - RNA, 64 nt, Homo Sapiens; identical to SEQ ID NO: 228184

SEQ ID NO: 753348 - RNA, 64 nt, Homo Sapiens; identical to SEQ ID NO: 228185

SEQ ID NO: 753349 - RNA, 64 nt, Homo Sapiens; identical to SEQ ID NO: 228186

SEQ ID NO: 753350 - RNA, 64 nt, Homo Sapiens; identical to SEQ ID NO: 228187

SEQ ID NO: 753351 - RNA, 64 nt, Homo Sapiens; identical to SEQ ID NO: 228188

SEQ ID NO: 753352 - RNA, 64 nt, Homo Sapiens; identical to SEQ ID NO: 228189

SEQ ID NO: 753353 - RNA, 64 nt, Homo Sapiens; identical to SEQ ID NO: 228190

SEQ ID NO: 753354 - RNA, 64 nt, Homo Sapiens; identical to SEQ ID NO: 228191

SEQ ID NO: 753355 - RNA, 64 nt, Homo Sapiens; identical to SEQ ID NO: 228192

SEQ ID NO: 753356 - RNA, 64 nt, Homo Sapiens; identical to SEQ ID NO: 228193

SEQ ID NO: 753357 - RNA, 64 nt, Homo Sapiens; identical to SEQ ID NO: 228194

SEQ ID NO: 753358 - RNA, 64 nt, Homo Sapiens; identical to SEQ ID NO: 228195

SEQ ID NO: 753359 - RNA, 64 nt, Homo Sapiens; identical to SEQ ID NO: 228196

SEQ ID NO: 753360 - RNA, 64 nt, Homo Sapiens; identical to SEQ ID NO: 228197

SEQ ID NO: 753361 - RNA, 64 nt, Homo Sapiens; identical to SEQ ID NO: 228198

SEQ ID NO: 753362 - RNA, 64 nt, Homo Sapiens; identical to SEQ ID NO: 228199

SEQ ID NO: 753363 - RNA, 64 nt, Homo Sapiens; identical to SEQ ID NO: 228200

SEQ ID NO: 753364 - RNA, 64 nt, Homo Sapiens; identical to SEQ ID NO: 228201

SEQ ID NO: 753365 - RNA, 64 nt, Homo Sapiens; identical to SEQ ID NO: 228202

SEQ ID NO: 753366 - RNA, 64 nt, Homo Sapiens; identical to SEQ ID NO: 228203

SEQ ID NO: 753367 - RNA, 64 nt, Homo Sapiens; identical to SEQ ID NO: 228204

SEQ ID NO: 753368 - RNA, 64 nt, Homo Sapiens; identical to SEQ ID NO: 228205

SEQ ID NO: 753369 - RNA, 64 nt, Homo Sapiens; identical to SEQ ID NO: 228206

SEQ ID NO: 753370 - RNA, 64 nt, Homo Sapiens; identical to SEQ ID NO: 228207

SEQ ID NO: 753371 - RNA, 64 nt, Homo Sapiens; identical to SEQ ID NO: 228208

SEQ ID NO: 753372 - RNA, 64 nt, Homo Sapiens; identical to SEQ ID NO: 228209

SEQ ID NO: 753373 - RNA, 64 nt, Homo Sapiens; identical to SEQ ID NO: 228210

SEQ ID NO: 753374 - RNA, 64 nt, Homo Sapiens; identical to SEQ ID NO: 228211

SEQ ID NO: 753375 - RNA, 64 nt, Homo Sapiens; identical to SEQ ID NO: 228212

SEQ ID NO: 753376 - RNA, 64 nt, Homo Sapiens; identical to SEQ ID NO: 228213

SEQ ID NO: 753377 - RNA, 64 nt, Homo Sapiens; identical to SEQ ID NO: 228214

SEQ ID NO: 753378 - RNA, 64 nt, Homo Sapiens; identical to SEQ ID NO: 228215

SEQ ID NO: 753379 - RNA, 64 nt, Homo Sapiens; identical to SEQ ID NO: 228216

SEQ ID NO: 753380 - RNA, 64 nt, Homo Sapiens; identical to SEQ ID NO: 228217

SEQ ID NO: 753381 - RNA, 64 nt, Homo Sapiens; identical to SEQ ID NO: 228218

SEQ ID NO: 753382 - RNA, 64 nt, Homo Sapiens; identical to SEQ ID NO: 228219

SEQ ID NO: 753383 - RNA, 64 nt, Homo Sapiens
cacaaaccagaagucggcaugaauuuaauaaaauaugggaaaggaauuuuuuaaaauaaaacac

SEQ ID NO: 753384 - RNA, 64 nt, Homo Sapiens
gcguuguuaucgccuuggguuuaaaugaguuuagaugggaaauacauugcgacauugugaaggc

SEQ ID NO: 753385 - RNA, 64 nt, Homo Sapiens
gagacuacaaaauuugucgugaaacgaugauugaaugggaaaaacguucuguaauagaaaaccu

SEQ ID NO: 753386 - RNA, 64 nt, Homo Sapiens
cuggcccccaugauucaauuaucacaagaauagcaugggaaagaucuugugaaacuuauucacu

SEQ ID NO: 753387 - RNA, 64 nt, Homo Sapiens
aauauggcguuucuauuuuuuggaaagacaagccaugggaaagacuuaaaaacaacacauuauu

SEQ ID NO: 753388 - RNA, 64 nt, Homo Sapiens
aaacccugcauauaugaaaacacuaggaaaaguaaugggaaaguacauggugaaaacuaagugu

SEQ ID NO: 753389 - RNA, 64 nt, Homo Sapiens
agaccauuuucuuagaaagcuaaucuacuggcgaaugggaaaggccacaccguagaacauauau

SEQ ID NO: 753390 - RNA, 64 nt, Homo Sapiens
uaagaugacugggaaaaagacccuguucaauaguaugggaaaaacauacguuaucagcaacuuc

SEQ ID NO: 753391 - RNA, 64 nt, Homo Sapiens
aaaaaguagcuguccucccuucuggaagucaaaaaugggaaagcuuuaaggaauuaaaaguguu

SEQ ID NO: 753392 - RNA, 64 nt, Homo Sapiens
cuuagauuccaguagauggauuuuuuuuuuucacaugggaaaguauuggagacuuugauuuuuu

SEQ ID NO: 753393 - RNA, 64 nt, Homo Sapiens
caucuaucuacagccuaaguguaaaauuaugaauaugggaaauccuaauauugagugauuauuu

SEQ ID NO: 753394 - RNA, 64 nt, Homo Sapiens
gguuggguggggcaauaccccuggguagaaucaaaugggaaaggcuuccaacugcaauaaaaua

SEQ ID NO: 753395 - RNA, 64 nt, Homo Sapiens
aguguugaaauaggauucauaauaacaacgaugaaugggaaacugcaaucauaagaaacaucug

SEQ ID NO: 753396 - RNA, 64 nt, Homo Sapiens
aaguauacuuaaggaucuguaaugcuuuauaaaaaugggaaaaauuuuccuuuuuaauaugagu

SEQ ID NO: 753397 - RNA, 64 nt, Homo Sapiens
uuugguaaaaauaaagacaaugaaugcucaaacuaugggaaaucauuuuuauauuuuauugcuu

SEQ ID NO: 753398 - RNA, 64 nt, Homo Sapiens
gcaauuaauauggaggugauauuucuuuuuaguaaugggaaaaucaacaguggauuuaaacaag

SEQ ID NO: 753399 - RNA, 64 nt, Homo Sapiens
agcgaaggaaccauccuuggugugcucaguggucaugggaaagggaguccaccucagugccucg

SEQ ID NO: 753400 - RNA, 64 nt, Homo Sapiens
ugacccaguggcaaguugcacucaaauugucuccaugggaaacugaacuucccagggccccucc

SEQ ID NO: 753401 - RNA, 64 nt, Homo Sapiens
aaauaguaaagaaaaccaaacaaacccaggccugaugggaaaaaugauuccuuuauucuagcaa

SEQ ID NO: 753402 - RNA, 64 nt, Homo Sapiens
auuccuuuauucuagcaacuuacuuucuguugguaugggaaauguuauuaauuucuauuacuaa

SEQ ID NO: 753403 - RNA, 64 nt, Homo Sapiens
aauggcucauaccccgaaggcaguuccuagacacaugggaaauuucccucaccaaagagcaauu

SEQ ID NO: 753404 - RNA, 64 nt, Homo Sapiens
uuucugaaugcaucaaggguacgagaacuugccaaugggaaauucauccgaguggcacuggcag

SEQ ID NO: 753405 - RNA, 64 nt, Homo Sapiens
uaauucauccuguugaauugcaccaucgugaaagaugggaaaaaucgugaugauggguaagggg

SEQ ID NO: 753406 - RNA, 64 nt, Homo Sapiens
ccggaaggcaauggggcaaggaaaaagaaagccuaugggaaauggcugugcucccaacauagcu

SEQ ID NO: 753407 - RNA, 64 nt, Homo Sapiens
cauuuugggaauuccugcuuaacuugaaaaaaauaugggaaagacaugcagcuuucaugcccuu

SEQ ID NO: 753408 - RNA, 64 nt, Homo Sapiens
uuuugguuuccgcaaaggauggauggugagcaucaugggaaagcuguaguuuagugacuuagcc

SEQ ID NO: 753409 - RNA, 64 nt, Homo Sapiens
gggauuccuuuucagaaguacuaggaaaagaaagaugggaaaacugagacaggauuugauaagu

SEQ ID NO: 753410 - RNA, 64 nt, Homo Sapiens
uuauuuuaugucuccuaagccuggcuugacuuuuaugggaaaagugguuaguugaagccaauuu

SEQ ID NO: 753411 - RNA, 64 nt, Homo Sapiens
aagcaggcaagacuuuuucucuguguuaggaaagaugggaaaugguuucuguaaccauuguuug

SEQ ID NO: 753412 - RNA, 64 nt, Homo Sapiens
uguuuauucuauaugaauauuguuucauguuuguaugggaaaauuguagcuaaacauuucauug

SEQ ID NO: 753413 - RNA, 64 nt, Homo Sapiens
acuucauauauaaugagugcuucauauuuuuguuaugggaaagcaauauauuaugcagccaguc

SEQ ID NO: 753414 - RNA, 64 nt, Homo Sapiens
uuuucuuuuauguuuaaaacugaaguuuugccaaaugggaaaauuacuguuaccucuaccaucu

SEQ ID NO: 753415 - RNA, 64 nt, Homo Sapiens
ggcagagaaagaagaaagaccuagaagguuguagaugggaaaucaggaaugauuugaacugaua

SEQ ID NO: 753416 - RNA, 64 nt, Homo Sapiens
cgcaggcccaucgugauaaggaauuaggucacaaaugggaaauaaaucagaagcaaugaaauuc

SEQ ID NO: 753417 - RNA, 64 nt, Homo Sapiens
gaaaacauuagcuuaugcuucuuuagauggaauaaugggaaaggagggaaaugggaaauggaug

SEQ ID NO: 753418 - RNA, 64 nt, Homo Sapiens
gcuucuuuagauggaauaaugggaaaggagggaaaugggaaauggauggaaaugggaaaggagg

SEQ ID NO: 753419 - RNA, 64 nt, Homo Sapiens
aaugggaaaggagggaaaugggaaauggauggaaaugggaaaggagggaaaauaauagcccagu

SEQ ID NO: 753420 - RNA, 64 nt, Homo Sapiens
ucaagagucaagguugcgaguacaggccaagaccaugggaaaaaaagccaugcucacuggccaa

SEQ ID NO: 753421 - RNA, 64 nt, Homo Sapiens
agcaguuuugcucaugacuuaccauuccagcugcaugggaaagcaaagcagaaaacagugcccc

SEQ ID NO: 753422 - RNA, 64 nt, Homo Sapiens
gcagucuuguuguucauauaccaccuaaggcuggaugggaaaguauuucuuaaaacagugugug

SEQ ID NO: 753423 - RNA, 64 nt, Homo Sapiens
ugguaagcaaaacuuuccucguguuuagagaauuaugggaaaccaugaaguuguauaccuuuuu

SEQ ID NO: 753424 - RNA, 64 nt, Homo Sapiens
aacugaagaguuucacauaaucugguuaaauaguaugggaaaaagcuacuaugcuucaggauug

SEQ ID NO: 753425 - RNA, 64 nt, Homo Sapiens
ugucgugugucugcacgcccagauagucuccaagaugggaaacauuuuagaaaagccgaacagu

SEQ ID NO: 753426 - RNA, 64 nt, Homo Sapiens
aacaaaagggcuucagucucuugucuugcucucuaugggaaaaaugacugcuugcugccuuuaa

SEQ ID NO: 753427 - RNA, 64 nt, Homo Sapiens
caauuuagacucuaaaaagucuuuucaaaaagaaaugggaaauaggcagacuguuuauguuaaa

SEQ ID NO: 753428 - RNA, 64 nt, Homo Sapiens
agaagcugauuuugcuaaacuccuguucccuacaaugggaaaugucacaagaaugugcaaaaau

SEQ ID NO: 753429 - RNA, 64 nt, Homo Sapiens
cagcaguguagacugacuuuucccgagggggaugaugggaaauuagccauuugcccagggcugc

SEQ ID NO: 753430 - RNA, 64 nt, Homo Sapiens
ugggagaucugucuacagagugugugaggaacagaugggaaagucagcuguuuuuaaaugaaug

SEQ ID NO: 753431 - RNA, 64 nt, Homo Sapiens
cuugauaaaugaaacuguacuaauaauggaauuaaugggaaacaggucacuuguuagcugucac

SEQ ID NO: 753432 - RNA, 54 nt, Homo Sapiens
gguggagauggggaagccgugcccaugggaaacaugauguauggcaaugaguga

SEQ ID NO: 753433 - RNA, 61 nt, Homo Sapiens
ucuggagaaagaccuuauaaauauaagauauaugggaaacacuuuuauucugccaaguuau

SEQ ID NO: 753434 - RNA, 64 nt, Homo Sapiens
cacacuuggcagaaacucuaugaauguaagcaguaugggaaagccuucagaucggcuaggauuc

SEQ ID NO: 753435 - RNA, 64 nt, Homo Sapiens
ugaucauguaaauauuacacaucaaaccaaugacaugggaaaaugggagcuucuaaugaggaca

SEQ ID NO: 753436 - RNA, 64 nt, Homo Sapiens
aguugauaccaaaaccugaaaaggaaacuacagaaugggaaagucauagaagaucucucacaga

SEQ ID NO: 753437 - RNA, 64 nt, Homo Sapiens
acaugaaauauacuguuacguacaugaaaaaauuaugggaaacucaaagaauuacaugaguuag

SEQ ID NO: 753438 - RNA, 64 nt, Homo Sapiens
cuauuuagccacucugcauaugauauaagcgaugaugggaaaggauuacacaggaaaccucugu

SEQ ID NO: 753439 - RNA, 64 nt, Homo Sapiens
gcuuugaaggaacuacuucagcagugacugauucaugggaaaggaccggucacauuuucuauug

SEQ ID NO: 753440 - RNA, 64 nt, Homo Sapiens
aaggggugacagggaguaaagagucucuucaagaaugggaaaucgcuaugcagcccaccuagau

SEQ ID NO: 753441 - RNA, 64 nt, Homo Sapiens
acuauuaaucuaguucaaugcccuuauuuuacagaugggaaaacugaggccuggagguaggaag

SEQ ID NO: 753442 - RNA, 64 nt, Homo Sapiens
aaguacagagagccugugcugugaacccccuucaaugggaaaaagcugcaguggugauggcagg

SEQ ID NO: 753443 - RNA, 64 nt, Homo Sapiens; identical to SEQ ID NO: 119910

SEQ ID NO: 753444 - RNA, 64 nt, Homo Sapiens; identical to SEQ ID NO: 119911

SEQ ID NO: 753445 - RNA, 64 nt, Homo Sapiens; identical to SEQ ID NO: 119912

SEQ ID NO: 753446 - RNA, 64 nt, Homo Sapiens; identical to SEQ ID NO: 119913

SEQ ID NO: 753447 - RNA, 64 nt, Homo Sapiens; identical to SEQ ID NO: 119914

SEQ ID NO: 753448 - RNA, 64 nt, Homo Sapiens; identical to SEQ ID NO: 119915

SEQ ID NO: 753449 - RNA, 64 nt, Homo Sapiens; identical to SEQ ID NO: 119916

SEQ ID NO: 753450 - RNA, 64 nt, Homo Sapiens; identical to SEQ ID NO: 119917

SEQ ID NO: 753451 - RNA, 64 nt, Homo Sapiens; identical to SEQ ID NO: 119918

SEQ ID NO: 753452 - RNA, 64 nt, Homo Sapiens; identical to SEQ ID NO: 119919

SEQ ID NO: 753453 - RNA, 64 nt, Homo Sapiens; identical to SEQ ID NO: 119920

SEQ ID NO: 753454 - RNA, 64 nt, Homo Sapiens; identical to SEQ ID NO: 119921

SEQ ID NO: 753455 - RNA, 64 nt, Homo Sapiens; identical to SEQ ID NO: 119922

SEQ ID NO: 753456 - RNA, 64 nt, Homo Sapiens; identical to SEQ ID NO: 119923

SEQ ID NO: 753457 - RNA, 64 nt, Homo Sapiens; identical to SEQ ID NO: 119924

SEQ ID NO: 753458 - RNA, 64 nt, Homo Sapiens; identical to SEQ ID NO: 119925

SEQ ID NO: 753459 - RNA, 64 nt, Homo Sapiens; identical to SEQ ID NO: 119926

SEQ ID NO: 753460 - RNA, 64 nt, Homo Sapiens; identical to SEQ ID NO: 119927

SEQ ID NO: 753461 - RNA, 64 nt, Homo Sapiens; identical to SEQ ID NO: 119928

SEQ ID NO: 753462 - RNA, 64 nt, Homo Sapiens; identical to SEQ ID NO: 119929

SEQ ID NO: 753463 - RNA, 64 nt, Homo Sapiens; identical to SEQ ID NO: 119930

SEQ ID NO: 753464 - RNA, 64 nt, Homo Sapiens; identical to SEQ ID NO: 119931

SEQ ID NO: 753465 - RNA, 64 nt, Homo Sapiens; identical to SEQ ID NO: 119932

SEQ ID NO: 753466 - RNA, 64 nt, Homo Sapiens; identical to SEQ ID NO: 119933

SEQ ID NO: 753467 - RNA, 64 nt, Homo Sapiens; identical to SEQ ID NO: 119934

SEQ ID NO: 753468 - RNA, 64 nt, Homo Sapiens; identical to SEQ ID NO: 119935

SEQ ID NO: 753469 - RNA, 64 nt, Homo Sapiens; identical to SEQ ID NO: 119936

SEQ ID NO: 753470 - RNA, 64 nt, Homo Sapiens; identical to SEQ ID NO: 119937

SEQ ID NO: 753471 - RNA, 64 nt, Homo Sapiens; identical to SEQ ID NO: 119938

SEQ ID NO: 753472 - RNA, 64 nt, Homo Sapiens; identical to SEQ ID NO: 119939

SEQ ID NO: 753473 - RNA, 64 nt, Homo Sapiens; identical to SEQ ID NO: 119940

SEQ ID NO: 753474 - RNA, 64 nt, Homo Sapiens; identical to SEQ ID NO: 119941

SEQ ID NO: 753475 - RNA, 64 nt, Homo Sapiens; identical to SEQ ID NO: 119942

SEQ ID NO: 753476 - RNA, 64 nt, Homo Sapiens; identical to SEQ ID NO: 119943

SEQ ID NO: 753477 - RNA, 64 nt, Homo Sapiens; identical to SEQ ID NO: 119944

SEQ ID NO: 753478 - RNA, 64 nt, Homo Sapiens; identical to SEQ ID NO: 119945

SEQ ID NO: 753479 - RNA, 64 nt, Homo Sapiens; identical to SEQ ID NO: 119946

SEQ ID NO: 753480 - RNA, 64 nt, Homo Sapiens; identical to SEQ ID NO: 119947

SEQ ID NO: 753481 - RNA, 64 nt, Homo Sapiens; identical to SEQ ID NO: 119948

SEQ ID NO: 753482 - RNA, 64 nt, Homo Sapiens; identical to SEQ ID NO: 119949

SEQ ID NO: 753483 - RNA, 64 nt, Homo Sapiens; identical to SEQ ID NO: 119950

SEQ ID NO: 753484 - RNA, 64 nt, Homo Sapiens; identical to SEQ ID NO: 119951

SEQ ID NO: 753485 - RNA, 64 nt, Homo Sapiens; identical to SEQ ID NO: 119952

SEQ ID NO: 753486 - RNA, 64 nt, Homo Sapiens; identical to SEQ ID NO: 119953

SEQ ID NO: 753487 - RNA, 64 nt, Homo Sapiens; identical to SEQ ID NO: 119954

SEQ ID NO: 753488 - RNA, 64 nt, Homo Sapiens; identical to SEQ ID NO: 119955

SEQ ID NO: 753489 - RNA, 64 nt, Homo Sapiens; identical to SEQ ID NO: 119956

SEQ ID NO: 753490 - RNA, 64 nt, Homo Sapiens; identical to SEQ ID NO: 119957

SEQ ID NO: 753491 - RNA, 64 nt, Homo Sapiens; identical to SEQ ID NO: 119958

SEQ ID NO: 753492 - RNA, 64 nt, Homo Sapiens; identical to SEQ ID NO: 119959

SEQ ID NO: 753493 - RNA, 64 nt, Homo Sapiens; identical to SEQ ID NO: 119960

SEQ ID NO: 753494 - RNA, 64 nt, Homo Sapiens; identical to SEQ ID NO: 119961

SEQ ID NO: 753495 - RNA, 58 nt, Homo Sapiens; identical to SEQ ID NO: 119962

SEQ ID NO: 753496 - RNA, 64 nt, Homo Sapiens; identical to SEQ ID NO: 119963

SEQ ID NO: 753497 - RNA, 64 nt, Homo Sapiens; identical to SEQ ID NO: 119964

SEQ ID NO: 753498 - RNA, 64 nt, Homo Sapiens; identical to SEQ ID NO: 119965

SEQ ID NO: 753499 - RNA, 64 nt, Homo Sapiens; identical to SEQ ID NO: 119966

SEQ ID NO: 753500 - RNA, 64 nt, Homo Sapiens; identical to SEQ ID NO: 119967

SEQ ID NO: 753501 - RNA, 64 nt, Homo Sapiens; identical to SEQ ID NO: 119968

SEQ ID NO: 753502 - RNA, 64 nt, Homo Sapiens; identical to SEQ ID NO: 119969

SEQ ID NO: 753503 - RNA, 64 nt, Homo Sapiens; identical to SEQ ID NO: 119970

SEQ ID NO: 753504 - RNA, 55 nt, Homo Sapiens; identical to SEQ ID NO: 119971

SEQ ID NO: 753505 - RNA, 64 nt, Homo Sapiens; identical to SEQ ID NO: 119972

SEQ ID NO: 753506 - RNA, 64 nt, Homo Sapiens; identical to SEQ ID NO: 119973

SEQ ID NO: 753507 - RNA, 64 nt, Homo Sapiens; identical to SEQ ID NO: 119974

SEQ ID NO: 753508 - RNA, 64 nt, Homo Sapiens; identical to SEQ ID NO: 119975

SEQ ID NO: 753509 - RNA, 64 nt, Homo Sapiens; identical to SEQ ID NO: 119976

SEQ ID NO: 753510 - RNA, 64 nt, Homo Sapiens; identical to SEQ ID NO: 119977

SEQ ID NO: 753511 - RNA, 64 nt, Homo Sapiens; identical to SEQ ID NO: 119978

SEQ ID NO: 753512 - RNA, 64 nt, Homo Sapiens; identical to SEQ ID NO: 119979

SEQ ID NO: 753513 - RNA, 64 nt, Homo Sapiens; identical to SEQ ID NO: 119980

SEQ ID NO: 753514 - RNA, 64 nt, Homo Sapiens; identical to SEQ ID NO: 119981

SEQ ID NO: 753515 - RNA, 64 nt, Homo Sapiens; identical to SEQ ID NO: 119982

SEQ ID NO: 753516 - RNA, 64 nt, Homo Sapiens; identical to SEQ ID NO: 119983

SEQ ID NO: 753517 - RNA, 64 nt, Homo Sapiens; identical to SEQ ID NO: 119984

SEQ ID NO: 753518 - RNA, 64 nt, Homo Sapiens; identical to SEQ ID NO: 119985

SEQ ID NO: 753519 - RNA, 64 nt, Homo Sapiens; identical to SEQ ID NO: 119986

SEQ ID NO: 753520 - RNA, 64 nt, Homo Sapiens; identical to SEQ ID NO: 119987

SEQ ID NO: 753521 - RNA, 55 nt, Homo Sapiens; identical to SEQ ID NO: 119988

SEQ ID NO: 753522 - RNA, 64 nt, Homo Sapiens; identical to SEQ ID NO: 119989

SEQ ID NO: 753523 - RNA, 64 nt, Homo Sapiens; identical to SEQ ID NO: 119990

SEQ ID NO: 753524 - RNA, 64 nt, Homo Sapiens; identical to SEQ ID NO: 119991

SEQ ID NO: 753525 - RNA, 64 nt, Homo Sapiens; identical to SEQ ID NO: 119992

SEQ ID NO: 753526 - RNA, 64 nt, Homo Sapiens; identical to SEQ ID NO: 119993

SEQ ID NO: 753527 - RNA, 64 nt, Homo Sapiens; identical to SEQ ID NO: 119994

SEQ ID NO: 753528 - RNA, 64 nt, Homo Sapiens; identical to SEQ ID NO: 119995

SEQ ID NO: 753529 - RNA, 64 nt, Homo Sapiens; identical to SEQ ID NO: 119996

SEQ ID NO: 753530 - RNA, 64 nt, Homo Sapiens; identical to SEQ ID NO: 119997

SEQ ID NO: 753531 - RNA, 64 nt, Homo Sapiens; identical to SEQ ID NO: 119998

SEQ ID NO: 753532 - RNA, 62 nt, Homo Sapiens; identical to SEQ ID NO: 119999

SEQ ID NO: 753533 - RNA, 64 nt, Homo Sapiens; identical to SEQ ID NO: 120000

SEQ ID NO: 753534 - RNA, 64 nt, Homo Sapiens; identical to SEQ ID NO: 120001

SEQ ID NO: 753535 - RNA, 64 nt, Homo Sapiens; identical to SEQ ID NO: 120002

SEQ ID NO: 753536 - RNA, 64 nt, Homo Sapiens; identical to SEQ ID NO: 120003

SEQ ID NO: 753537 - RNA, 64 nt, Homo Sapiens; identical to SEQ ID NO: 120004

SEQ ID NO: 753538 - RNA, 64 nt, Homo Sapiens; identical to SEQ ID NO: 120005

SEQ ID NO: 753539 - RNA, 64 nt, Homo Sapiens; identical to SEQ ID NO: 120006

SEQ ID NO: 753540 - RNA, 64 nt, Homo Sapiens; identical to SEQ ID NO: 120007

SEQ ID NO: 753541 - RNA, 64 nt, Homo Sapiens; identical to SEQ ID NO: 120008

SEQ ID NO: 753542 - RNA, 64 nt, Homo Sapiens; identical to SEQ ID NO: 141261

SEQ ID NO: 753543 - RNA, 64 nt, Homo Sapiens; identical to SEQ ID NO: 141262

SEQ ID NO: 753544 - RNA, 64 nt, Homo Sapiens; identical to SEQ ID NO: 141263

SEQ ID NO: 753545 - RNA, 64 nt, Homo Sapiens; identical to SEQ ID NO: 141264

SEQ ID NO: 753546 - RNA, 64 nt, Homo Sapiens; identical to SEQ ID NO: 141265

SEQ ID NO: 753547 - RNA, 64 nt, Homo Sapiens; identical to SEQ ID NO: 141266

SEQ ID NO: 753548 - RNA, 64 nt, Homo Sapiens; identical to SEQ ID NO: 141267

SEQ ID NO: 753549 - RNA, 64 nt, Homo Sapiens; identical to SEQ ID NO: 141268

SEQ ID NO: 753550 - RNA, 64 nt, Homo Sapiens; identical to SEQ ID NO: 141269

SEQ ID NO: 753551 - RNA, 64 nt, Homo Sapiens; identical to SEQ ID NO: 141270

SEQ ID NO: 753552 - RNA, 64 nt, Homo Sapiens; identical to SEQ ID NO: 141271

SEQ ID NO: 753553 - RNA, 64 nt, Homo Sapiens; identical to SEQ ID NO: 141272

SEQ ID NO: 753554 - RNA, 64 nt, Homo Sapiens; identical to SEQ ID NO: 141273

SEQ ID NO: 753555 - RNA, 64 nt, Homo Sapiens; identical to SEQ ID NO: 141274

SEQ ID NO: 753556 - RNA, 64 nt, Homo Sapiens; identical to SEQ ID NO: 141275

SEQ ID NO: 753557 - RNA, 64 nt, Homo Sapiens; identical to SEQ ID NO: 141276

SEQ ID NO: 753558 - RNA, 64 nt, Homo Sapiens; identical to SEQ ID NO: 141277

SEQ ID NO: 753559 - RNA, 64 nt, Homo Sapiens; identical to SEQ ID NO: 141278

SEQ ID NO: 753560 - RNA, 64 nt, Homo Sapiens; identical to SEQ ID NO: 141279

SEQ ID NO: 753561 - RNA, 56 nt, Homo Sapiens; identical to SEQ ID NO: 141280

SEQ ID NO: 753562 - RNA, 64 nt, Homo Sapiens; identical to SEQ ID NO: 141281

SEQ ID NO: 753563 - RNA, 64 nt, Homo Sapiens; identical to SEQ ID NO: 141282

SEQ ID NO: 753564 - RNA, 64 nt, Homo Sapiens; identical to SEQ ID NO: 141283

SEQ ID NO: 753565 - RNA, 64 nt, Homo Sapiens; identical to SEQ ID NO: 141284

SEQ ID NO: 753566 - RNA, 64 nt, Homo Sapiens; identical to SEQ ID NO: 141285

SEQ ID NO: 753567 - RNA, 64 nt, Homo Sapiens; identical to SEQ ID NO: 141286

SEQ ID NO: 753568 - RNA, 64 nt, Homo Sapiens; identical to SEQ ID NO: 141287

SEQ ID NO: 753569 - RNA, 64 nt, Homo Sapiens; identical to SEQ ID NO: 141288

SEQ ID NO: 753570 - RNA, 64 nt, Homo Sapiens; identical to SEQ ID NO: 141289

SEQ ID NO: 753571 - RNA, 64 nt, Homo Sapiens; identical to SEQ ID NO: 141290

SEQ ID NO: 753572 - RNA, 64 nt, Homo Sapiens; identical to SEQ ID NO: 141291

SEQ ID NO: 753573 - RNA, 64 nt, Homo Sapiens; identical to SEQ ID NO: 141292

SEQ ID NO: 753574 - RNA, 64 nt, Homo Sapiens; identical to SEQ ID NO: 141293

SEQ ID NO: 753575 - RNA, 64 nt, Homo Sapiens; identical to SEQ ID NO: 141294

SEQ ID NO: 753576 - RNA, 64 nt, Homo Sapiens; identical to SEQ ID NO: 141295

SEQ ID NO: 753577 - RNA, 64 nt, Homo Sapiens; identical to SEQ ID NO: 141296

SEQ ID NO: 753578 - RNA, 64 nt, Homo Sapiens; identical to SEQ ID NO: 141297

SEQ ID NO: 753579 - RNA, 64 nt, Homo Sapiens; identical to SEQ ID NO: 141298

SEQ ID NO: 753580 - RNA, 64 nt, Homo Sapiens; identical to SEQ ID NO: 141299

SEQ ID NO: 753581 - RNA, 50 nt, Homo Sapiens; identical to SEQ ID NO: 141300

SEQ ID NO: 753582 - RNA, 64 nt, Homo Sapiens; identical to SEQ ID NO: 141301

SEQ ID NO: 753583 - RNA, 64 nt, Homo Sapiens; identical to SEQ ID NO: 141302

SEQ ID NO: 753584 - RNA, 64 nt, Homo Sapiens; identical to SEQ ID NO: 141303

SEQ ID NO: 753585 - RNA, 64 nt, Homo Sapiens; identical to SEQ ID NO: 141304

SEQ ID NO: 753586 - RNA, 64 nt, Homo Sapiens; identical to SEQ ID NO: 141305

SEQ ID NO: 753587 - RNA, 64 nt, Homo Sapiens; identical to SEQ ID NO: 141306

SEQ ID NO: 753588 - RNA, 64 nt, Homo Sapiens; identical to SEQ ID NO: 141307

SEQ ID NO: 753589 - RNA, 64 nt, Homo Sapiens; identical to SEQ ID NO: 141308

SEQ ID NO: 753590 - RNA, 64 nt, Homo Sapiens; identical to SEQ ID NO: 141309

SEQ ID NO: 753591 - RNA, 64 nt, Homo Sapiens; identical to SEQ ID NO: 141310

SEQ ID NO: 753592 - RNA, 64 nt, Homo Sapiens; identical to SEQ ID NO: 141311

SEQ ID NO: 753593 - RNA, 64 nt, Homo Sapiens; identical to SEQ ID NO: 141312

SEQ ID NO: 753594 - RNA, 64 nt, Homo Sapiens; identical to SEQ ID NO: 141313

SEQ ID NO: 753595 - RNA, 64 nt, Homo Sapiens; identical to SEQ ID NO: 141314

SEQ ID NO: 753596 - RNA, 64 nt, Homo Sapiens; identical to SEQ ID NO: 141315

SEQ ID NO: 753597 - RNA, 64 nt, Homo Sapiens; identical to SEQ ID NO: 141316

SEQ ID NO: 753598 - RNA, 64 nt, Homo Sapiens; identical to SEQ ID NO: 141317

SEQ ID NO: 753599 - RNA, 64 nt, Homo Sapiens; identical to SEQ ID NO: 141318

SEQ ID NO: 753600 - RNA, 64 nt, Homo Sapiens; identical to SEQ ID NO: 141319

SEQ ID NO: 753601 - RNA, 64 nt, Homo Sapiens; identical to SEQ ID NO: 141320

SEQ ID NO: 753602 - RNA, 63 nt, Homo Sapiens
ccacauugugugguagccaucaaggugacaaaugucauacauuaugauuuuaaucacauucug

SEQ ID NO: 753603 - RNA, 63 nt, Homo Sapiens
acagcuaaccauuaugccaaugacuuuuugaaagucauacaacugagaacuggagagguucag

SEQ ID NO: 753604 - RNA, 64 nt, Homo Sapiens
aauuugcaauagaaagccuuuuuacagagcauugaaucuguaccguaagucuuaaagucugcua

SEQ ID NO: 753605 - RNA, 64 nt, Homo Sapiens
gcuagauauugacuauccuuaaaauuuuacuuaaaaucuguaacacacauucuguuucuucaua

SEQ ID NO: 753606 - RNA, 64 nt, Homo Sapiens
aaccgugugucaugucaaagugaaagacauuucaaaucuguagcauaggcuagugggcaggucc

SEQ ID NO: 753607 - RNA, 64 nt, Homo Sapiens
uauuugaguuugacauuuaauaacuuugcuggaaaaucuguaaaaaagaaaaacaaguuugcua

SEQ ID NO: 753608 - RNA, 64 nt, Homo Sapiens
ugaauuuucauaagaaacuuggacugcaggacuuaaucuguagucuuuagacaacaguugcuuu

SEQ ID NO: 753609 - RNA, 64 nt, Homo Sapiens
uguaaaauuaaauuuuaucuuuauuucuucuaaaaaucuguauaccaggaacugaaaaucuuug

SEQ ID NO: 753610 - RNA, 64 nt, Homo Sapiens
uccuuucugacccacaaaguaugaaaaguucuguaaucuguaaacucaguucuguaaucuguau

SEQ ID NO: 753611 - RNA, 64 nt, Homo Sapiens
ugaaaaguucuguaaucuguaaacucaguucuguaaucuguauuauugagaugauuaauauaaa

SEQ ID NO: 753612 - RNA, 64 nt, Homo Sapiens
uugucaaagaagguuuguguuuuucugcuuuugaaaucuguaucuguagugagauagcauugug

SEQ ID NO: 753613 - RNA, 64 nt, Homo Sapiens
augguuacuaggcuuaauaccugggugauuacauaaucuguacaaugaacccccaugauguaag

SEQ ID NO: 753614 - RNA, 64 nt, Homo Sapiens
aauaauuuuaauuagcauaacccuaaggaaaaguaaucuguaaauucacuaaaauguuuuuugu

SEQ ID NO: 753615 - RNA, 64 nt, Homo Sapiens
uguuccuuuguaaaacuuguaauaacagaaacaaaaucuguaaacauccacaaacaaacaaaca

SEQ ID NO: 753616 - RNA, 64 nt, Homo Sapiens
auuacuacacuggguaccuuccuuuuuaguguuaaaucuguaacaagcuguuuauagcuuugga

SEQ ID NO: 753617 - RNA, 64 nt, Homo Sapiens
cauaagcuuaugcuuaaauuagcuagcaaauaguaaucuguaagaauucaaauaauaauuagua

SEQ ID NO: 753618 - RNA, 64 nt, Homo Sapiens
acuaagaaacuuaaauuuuacaugccuucaaaucaaucuguaaauuucaauauuagcaagacag

SEQ ID NO: 753619 - RNA, 64 nt, Homo Sapiens
uccccaacauguaauaagguuuccccaugguuuuaaucuguauucuguggauguaaagugauau

SEQ ID NO: 753620 - RNA, 64 nt, Homo Sapiens
gcuuucgauaguguuaacuuuaucuaguuuaauuaaucuguaaucuuuugcauccuacauuaau

SEQ ID NO: 753621 - RNA, 64 nt, Homo Sapiens
ggaagacugccaguauuaaaaaaauccuucugggaaucuguagguuauuucuuggaaauugcaa

SEQ ID NO: 753622 - RNA, 64 nt, Homo Sapiens
gguacagaauaguugauauuaacagaaaaaaaaaaaucuguagcuucaugaauaugccacucug

SEQ ID NO: 753623 - RNA, 64 nt, Homo Sapiens
ccacgacagacuuaacuguauaauuucguuguaaaaucuguaaguuguaaauauuguacauagu

SEQ ID NO: 753624 - RNA, 64 nt, Homo Sapiens
aaaaucuguaaguuguaaauauuguacauaguuaaaucuguauucuguuuugaauuuuuuuaau

SEQ ID NO: 753625 - RNA, 64 nt, Homo Sapiens
uagucuuggagguuaugauucuguacguaguucuaaucuguauaaagaguaaauuuuacauaau

SEQ ID NO: 753626 - RNA, 64 nt, Homo Sapiens
uaguucuaaucuguauauagaguaaauuuuacauaaucuguacgaauaacucaugugucacaag

SEQ ID NO: 753627 - RNA, 64 nt, Homo Sapiens
agugcaucuuugccucaacuccaggauuuaggccuuaacacacuggccauucuuauguuccaga

SEQ ID NO: 753628 - RNA, 64 nt, Homo Sapiens
uugucagcaagaggaggacagaauucucccagcguuaacacaaaauccaugggcaguaugaugg

SEQ ID NO: 753629 - RNA, 64 nt, Homo Sapiens
cuuuauugaacuugaaugacagaacuugaaauuuuuaacacauccuucuuggugaagauuuuaa

SEQ ID NO: 753630 - RNA, 64 nt, Homo Sapiens
ugaaaauauuuauauaaaaauacauuuauucugcuuaacacaaauuaaaacugacauaaaauuu

SEQ ID NO: 753631 - RNA, 64 nt, Homo Sapiens
guggacagaaauguacagggagaauuacauuauuuuaacacacagaagugcaacuuucugcuuu

SEQ ID NO: 753632 - RNA, 64 nt, Homo Sapiens
ugcuuauacaucuauucuauaacagugaugaauauuaacacaaaggaaauauggagaacuguua

SEQ ID NO: 753633 - RNA, 64 nt, Homo Sapiens
acucauagcaccuaagacaggaaaagccaaccacuuaacacauuaccuuuaauuuuuccuauuu

SEQ ID NO: 753634 - RNA, 64 nt, Homo Sapiens
uaugauucugugauaauauuugauauuacaauuuuuaacacauuaauuccaggagguaauuugu

SEQ ID NO: 753635 - RNA, 64 nt, Homo Sapiens
gaugaugugagccugugagaaguccuauuguauguuaacacacuucaauccuguaaaaggguac

SEQ ID NO: 753636 - RNA, 64 nt, Homo Sapiens
aauggugguuaugggaacuaugauguugugggaauuaacacaucuggaacuaauucuuuauuuu

SEQ ID NO: 753637 - RNA, 64 nt, Homo Sapiens
acaggucaaguugaagucaugggaaaaaaaaauguuaacacaucuggagguacuguagcuuuua

SEQ ID NO: 753638 - RNA, 64 nt, Homo Sapiens
aacacccauuccugggaccgguaaaugccacacguuaacacaauaugagauguuuguuacucug

SEQ ID NO: 753639 - RNA, 64 nt, Homo Sapiens
aaaauauucaauaagaagucauaaauaaugagcguuaacacaguucuguaaaccuaaugucugu

SEQ ID NO: 753640 - RNA, 64 nt, Homo Sapiens
aauuucugccauauuaauuucuaagaaguuccacuuaacacaugucucuuaaaugaagugccca

SEQ ID NO: 753641 - RNA, 64 nt, Homo Sapiens
uaaaagccacugcuuuuaacaucccauuguacauuuaacacauaaaugguguuaacaucccauu

SEQ ID NO: 753642 - RNA, 64 nt, Homo Sapiens
aacacauaaaugguguuaacaucccauuguacauuuaacacauaaauggccauugucuuugucu

SEQ ID NO: 753643 - RNA, 64 nt, Homo Sapiens
uuuaccauuugacauacucuucagauuaagaaaauuaacacaauuugcugguaaucuaauagaa

SEQ ID NO: 753644 - RNA, 64 nt, Homo Sapiens
agcugcauuguaaagaaacauuguaagcugaauguuaacacacuguuuggaaacaucacucuga

SEQ ID NO: 753645 - RNA, 64 nt, Homo Sapiens
ggaaaaaaguucagacaucggucacuauuuucucuuaacacauaaaaggguuugugauacagcg

SEQ ID NO: 753646 - RNA, 64 nt, Homo Sapiens
gucucuagaagaggugcagaagucggucguguuuuuaacacagaugaaagggggcagaauguuc

SEQ ID NO: 753647 - RNA, 64 nt, Homo Sapiens
aaaaauuuuuuaaaaauuucaagugacuauuugauuaacacauuaaguauuuauuucucuuugc

SEQ ID NO: 753648 - RNA, 64 nt, Homo Sapiens
guagauccuuuuuuucuguuacacccuuuuuaaauuaacacacuuuuugcuguaggcuaggaau

SEQ ID NO: 753649 - RNA, 64 nt, Homo Sapiens
gcaaugcucuccuugucaaggcauggaccagggucauucagacacauucagauacugcacugag

SEQ ID NO: 753650 - RNA, 64 nt, Homo Sapiens
ccuugucaaggcauggaccagggucauucagacacauucagauacugcacugagaaggagcugg

SEQ ID NO: 753651 - RNA, 64 nt, Homo Sapiens
ucaaggcugagcuuuaaugucagugucucuuagacauucagagggugaaccaccaucccuucac

SEQ ID NO: 753652 - RNA, 64 nt, Homo Sapiens
guaacuggauucgauuuugggauaucuuuucucacauucagacuuacacuuaaugguguuagaa

SEQ ID NO: 753653 - RNA, 64 nt, Homo Sapiens
aauuauuaauguugguucugaaacagccucuuagcauucagauuguauuuuaaauacuuaaaca

SEQ ID NO: 753654 - RNA, 64 nt, Homo Sapiens
cuggccaauuuaaguuuguaagaaaaaaaguacacauucagaauucaugagugcauuuugaaaa

SEQ ID NO: 753655 - RNA, 64 nt, Homo Sapiens
accucuggaaucucugugguauuggugcguguuucauucagaucuuuuccuuuuggaucuggcc

SEQ ID NO: 753656 - RNA, 64 nt, Homo Sapiens
ucuaaacacacauccgucccaacauuccccagaccauucagaaucacacagcguauuaaacacu

SEQ ID NO: 753657 - RNA, 64 nt, Homo Sapiens
cccuccuuggcuacuaggagcaccuaucccauaucauucagauaaacaaugauagcuacaaagu

SEQ ID NO: 753658 - RNA, 64 nt, Homo Sapiens
augauaauccuucauaauuuauuauacaauuuaucauucagaaagcaauaauuaaaaaaguuua

SEQ ID NO: 753659 - RNA, 64 nt, Homo Sapiens
ccaccgcccugcccuccccaccgaguccuguggccauucagagcggccacaugacuuuugcauc

SEQ ID NO: 753660 - RNA, 64 nt, Homo Sapiens
caccaauccuagacucacgugugccccagaauaacauucagacucucagcuggucuuguguuac

SEQ ID NO: 753661 - RNA, 64 nt, Homo Sapiens
ugccuagcacagagcucaguggauuugauucuuccauucagauacucauagcgauugcacacuu

SEQ ID NO: 753662 - RNA, 64 nt, Homo Sapiens
uaaauauuuaaaaacaguucuucucaaacauuuucauucagauagcuuucugaaaguucccuau

SEQ ID NO: 753663 - RNA, 64 nt, Homo Sapiens
gaaagcaauauauuaugcagccagucuguagaaacauucagaucccucuuccuuuacucaaaua

SEQ ID NO: 753664 - RNA, 64 nt, Homo Sapiens
auagcauugguugccuauuuguccagagaccuaacauucagaaugggugggugggugggacuca

SEQ ID NO: 753665 - RNA, 64 nt, Homo Sapiens
ccacuccugaguggguggguagaggucugagggccauucagaacccccauuaagacucaccagg

SEQ ID NO: 753666 - RNA, 64 nt, Homo Sapiens
ugcuuuaacuuucaacacuuagaaaaucuacaaacauucagaccugucuggguugguauugcca

SEQ ID NO: 753667 - RNA, 64 nt, Homo Sapiens
ucaggccuucagaauuuaaggguuuuaaauauagcauucagauuguaauugguauguuuuugcc

SEQ ID NO: 753668 - RNA, 64 nt, Homo Sapiens
gaaauucuaauuagcucauucuuuaaaauaaaaccauucagauucaauauuauuuugaaauugg

SEQ ID NO: 753669 - RNA, 64 nt, Homo Sapiens
ucauggauuuuaaaaauauuuaaagagaaaaacucauucagaaaaauucaacuaaaguuauaaa

SEQ ID NO: 753670 - RNA, 64 nt, Homo Sapiens
acuuuucauugcacuucuaaaauucagccuuguucauucagaaaauaaggauggauuuugugaa

SEQ ID NO: 753671 - RNA, 64 nt, Homo Sapiens
ucugugauuucucacauuuuuauuugcugagaaacauucagaaaauuauuccaaaaaugaaggu

SEQ ID NO: 753672 - RNA, 64 nt, Homo Sapiens
ggccaaaugaggugacucagauagaaucugaucccauucagagcuugguaaaugucacuguaca

SEQ ID NO: 753673 - RNA, 64 nt, Homo Sapiens
gaggacaacaucuucaugcugugauugaagcauccauucagaacacgaggcaauauugcagucc

SEQ ID NO: 753674 - RNA, 64 nt, Homo Sapiens
agacuugagauucaguugccgaucaaggcucuggcauucagagaacccuugcaacucgagaagc

SEQ ID NO: 753675 - RNA, 64 nt, Homo Sapiens
gaaaauguaaaaccacaccagggaggaaaaaugacauucagaaccagcaaacacugaauuucuc

SEQ ID NO: 753676 - RNA, 64 nt, Homo Sapiens
augguuggccacaaacaaugcgcugucauucagacauucagagaaaaaaaaccuuaaacauagu

SEQ ID NO: 753677 - RNA, 64 nt, Homo Sapiens
uucagagaaugguuggccacaacauagucgcugucauucagacaauuuacaaaaaaaaaccuua

SEQ ID NO: 753678 - RNA, 64 nt, Homo Sapiens
ccaccugcagacagcgagaggguccccaugaaggcauucagagugggaggaagcugggcugugu

SEQ ID NO: 753679 - RNA, 64 nt, Homo Sapiens
gcauuguucuuucagucagacaugauaugcgcaacauucagacaugauaugcgcaucauucaga

SEQ ID NO: 753680 - RNA, 64 nt, Homo Sapiens
ugauaugcgcaacauucagacaugauaugcgcaucauucagacaugauaugcggggucaaguuc

SEQ ID NO: 753681 - RNA, 64 nt, Homo Sapiens
ugugggucuucuacguaugucacauugauucacacauucagaaaagaggguccucacagauuuu

SEQ ID NO: 753682 - RNA, 64 nt, Homo Sapiens
uccuaauuuuagcaucuuuuuuuuuuuuuacaaucauucagauugugaauucaggcucagaauu

SEQ ID NO: 753683 - RNA, 64 nt, Homo Sapiens
auaugccugauucauaguaaucuaaaaguuucuacauucagauugacugaaugcuguuaauauu

SEQ ID NO: 753684 - RNA, 64 nt, Homo Sapiens
aaaaauacaccguuuagaaaguuuucauuuuagacauucagacuucuugaauuaguauuucagu

SEQ ID NO: 753685 - RNA, 64 nt, Homo Sapiens
cuuguacugaaugacacauuaccuccacacucucccggacuagguggucaacagggccacaggg

SEQ ID NO: 753686 - RNA, 64 nt, Homo Sapiens
cauggcuccgaaucuaagugagagaccuuggacuccggacuaucggccgacugucugcucaccc

SEQ ID NO: 753687 - RNA, 64 nt, Homo Sapiens
ucauagagugagagggcuugagacccucccucaaccggacuaauuaaagaaagacacuuguguu

SEQ ID NO: 753688 - RNA, 64 nt, Homo Sapiens
gauuucaugcuguucuuuguaaugauaaauguuuccggacuaaacacucuauaauacaaaucaa

SEQ ID NO: 753689 - RNA, 64 nt, Homo Sapiens
uaaaccaggaacaagaagaguugauuuccuaguaccggacuacuaaacuuagagaaagauaaaa

SEQ ID NO: 753690 - RNA, 64 nt, Homo Sapiens
agcucagagaggcuagaugauugauuaccaagugccggacuagcaagugcuggagucgggacua

SEQ ID NO: 753691 - RNA, 64 nt, Homo Sapiens
gacacuaccccaucagguggaugcacugucguccccggacuauagaaauauuucccacaacugg

SEQ ID NO: 753692 - RNA, 64 nt, Homo Sapiens
acggcaugacguggugcggggcagcguggccccaccggacuagcacaugaugaauguaaaguug

SEQ ID NO: 753693 - RNA, 64 nt, Homo Sapiens; identical to SEQ ID NO: 282773

SEQ ID NO: 753694 - RNA, 64 nt, Homo Sapiens; identical to SEQ ID NO: 282774

SEQ ID NO: 753695 - RNA, 64 nt, Homo Sapiens; identical to SEQ ID NO: 282775

SEQ ID NO: 753696 - RNA, 64 nt, Homo Sapiens; identical to SEQ ID NO: 282776

SEQ ID NO: 753697 - RNA, 64 nt, Homo Sapiens; identical to SEQ ID NO: 282777

SEQ ID NO: 753698 - RNA, 64 nt, Homo Sapiens; identical to SEQ ID NO: 282778

SEQ ID NO: 753699 - RNA, 64 nt, Homo Sapiens; identical to SEQ ID NO: 282779

SEQ ID NO: 753700 - RNA, 64 nt, Homo Sapiens; identical to SEQ ID NO: 282780

SEQ ID NO: 753701 - RNA, 64 nt, Homo Sapiens; identical to SEQ ID NO: 282781

SEQ ID NO: 753702 - RNA, 64 nt, Homo Sapiens; identical to SEQ ID NO: 282782

SEQ ID NO: 753703 - RNA, 64 nt, Homo Sapiens; identical to SEQ ID NO: 282783

SEQ ID NO: 753704 - RNA, 54 nt, Homo Sapiens; identical to SEQ ID NO: 282784

SEQ ID NO: 753705 - RNA, 64 nt, Homo Sapiens; identical to SEQ ID NO: 282785

SEQ ID NO: 753706 - RNA, 64 nt, Homo Sapiens; identical to SEQ ID NO: 282786

SEQ ID NO: 753707 - RNA, 64 nt, Homo Sapiens; identical to SEQ ID NO: 282787

SEQ ID NO: 753708 - RNA, 64 nt, Homo Sapiens; identical to SEQ ID NO: 282788

SEQ ID NO: 753709 - RNA, 64 nt, Homo Sapiens; identical to SEQ ID NO: 282789

SEQ ID NO: 753710 - RNA, 64 nt, Homo Sapiens; identical to SEQ ID NO: 282790

SEQ ID NO: 753711 - RNA, 64 nt, Homo Sapiens; identical to SEQ ID NO: 282791

SEQ ID NO: 753712 - RNA, 64 nt, Homo Sapiens; identical to SEQ ID NO: 282792

SEQ ID NO: 753713 - RNA, 64 nt, Homo Sapiens; identical to SEQ ID NO: 282793

SEQ ID NO: 753714 - RNA, 64 nt, Homo Sapiens; identical to SEQ ID NO: 282794

SEQ ID NO: 753715 - RNA, 64 nt, Homo Sapiens; identical to SEQ ID NO: 282795

SEQ ID NO: 753716 - RNA, 64 nt, Homo Sapiens; identical to SEQ ID NO: 282796

SEQ ID NO: 753717 - RNA, 64 nt, Homo Sapiens; identical to SEQ ID NO: 282797

SEQ ID NO: 753718 - RNA, 64 nt, Homo Sapiens; identical to SEQ ID NO: 282798

SEQ ID NO: 753719 - RNA, 64 nt, Homo Sapiens; identical to SEQ ID NO: 282799

SEQ ID NO: 753720 - RNA, 64 nt, Homo Sapiens; identical to SEQ ID NO: 282800

SEQ ID NO: 753721 - RNA, 64 nt, Homo Sapiens; identical to SEQ ID NO: 282801

SEQ ID NO: 753722 - RNA, 64 nt, Homo Sapiens; identical to SEQ ID NO: 282802

SEQ ID NO: 753723 - RNA, 64 nt, Homo Sapiens; identical to SEQ ID NO: 282803

SEQ ID NO: 753724 - RNA, 64 nt, Homo Sapiens; identical to SEQ ID NO: 282804

SEQ ID NO: 753725 - RNA, 64 nt, Homo Sapiens; identical to SEQ ID NO: 282805

SEQ ID NO: 753726 - RNA, 64 nt, Homo Sapiens; identical to SEQ ID NO: 282806

SEQ ID NO: 753727 - RNA, 64 nt, Homo Sapiens; identical to SEQ ID NO: 282807

SEQ ID NO: 753728 - RNA, 64 nt, Homo Sapiens; identical to SEQ ID NO: 282808

SEQ ID NO: 753729 - RNA, 64 nt, Homo Sapiens; identical to SEQ ID NO: 282809

SEQ ID NO: 753730 - RNA, 64 nt, Homo Sapiens; identical to SEQ ID NO: 282810

SEQ ID NO: 753731 - RNA, 64 nt, Homo Sapiens; identical to SEQ ID NO: 282811

SEQ ID NO: 753732 - RNA, 64 nt, Homo Sapiens; identical to SEQ ID NO: 282812

SEQ ID NO: 753733 - RNA, 64 nt, Homo Sapiens; identical to SEQ ID NO: 282813

SEQ ID NO: 753734 - RNA, 64 nt, Homo Sapiens; identical to SEQ ID NO: 282814

SEQ ID NO: 753735 - RNA, 64 nt, Homo Sapiens; identical to SEQ ID NO: 282815

SEQ ID NO: 753736 - RNA, 64 nt, Homo Sapiens; identical to SEQ ID NO: 282816

SEQ ID NO: 753737 - RNA, 64 nt, Homo Sapiens; identical to SEQ ID NO: 282817

SEQ ID NO: 753738 - RNA, 64 nt, Homo Sapiens; identical to SEQ ID NO: 282818

SEQ ID NO: 753739 - RNA, 64 nt, Homo Sapiens; identical to SEQ ID NO: 282819

SEQ ID NO: 753740 - RNA, 64 nt, Homo Sapiens; identical to SEQ ID NO: 282820

SEQ ID NO: 753741 - RNA, 64 nt, Homo Sapiens; identical to SEQ ID NO: 282821

SEQ ID NO: 753742 - RNA, 64 nt, Homo Sapiens; identical to SEQ ID NO: 282822

SEQ ID NO: 753743 - RNA, 64 nt, Homo Sapiens; identical to SEQ ID NO: 282823

SEQ ID NO: 753744 - RNA, 64 nt, Homo Sapiens; identical to SEQ ID NO: 282824

SEQ ID NO: 753745 - RNA, 64 nt, Homo Sapiens; identical to SEQ ID NO: 282825

SEQ ID NO: 753746 - RNA, 64 nt, Homo Sapiens; identical to SEQ ID NO: 282826

SEQ ID NO: 753747 - RNA, 64 nt, Homo Sapiens; identical to SEQ ID NO: 282827

SEQ ID NO: 753748 - RNA, 64 nt, Homo Sapiens; identical to SEQ ID NO: 282828

SEQ ID NO: 753749 - RNA, 64 nt, Homo Sapiens; identical to SEQ ID NO: 282829

SEQ ID NO: 753750 - RNA, 64 nt, Homo Sapiens; identical to SEQ ID NO: 282830

SEQ ID NO: 753751 - RNA, 64 nt, Homo Sapiens; identical to SEQ ID NO: 282831

SEQ ID NO: 753752 - RNA, 64 nt, Homo Sapiens; identical to SEQ ID NO: 282832

SEQ ID NO: 753753 - RNA, 64 nt, Homo Sapiens; identical to SEQ ID NO: 282833

SEQ ID NO: 753754 - RNA, 53 nt, Homo Sapiens; identical to SEQ ID NO: 282834

SEQ ID NO: 753755 - RNA, 64 nt, Homo Sapiens; identical to SEQ ID NO: 282835

SEQ ID NO: 753756 - RNA, 64 nt, Homo Sapiens; identical to SEQ ID NO: 282836

SEQ ID NO: 753757 - RNA, 64 nt, Homo Sapiens; identical to SEQ ID NO: 282837

SEQ ID NO: 753758 - RNA, 64 nt, Homo Sapiens; identical to SEQ ID NO: 282838

SEQ ID NO: 753759 - RNA, 64 nt, Homo Sapiens; identical to SEQ ID NO: 282839

SEQ ID NO: 753760 - RNA, 64 nt, Homo Sapiens; identical to SEQ ID NO: 282840

SEQ ID NO: 753761 - RNA, 64 nt, Homo Sapiens; identical to SEQ ID NO: 282841

SEQ ID NO: 753762 - RNA, 64 nt, Homo Sapiens; identical to SEQ ID NO: 282842

SEQ ID NO: 753763 - RNA, 64 nt, Homo Sapiens; identical to SEQ ID NO: 282843

SEQ ID NO: 753764 - RNA, 64 nt, Homo Sapiens; identical to SEQ ID NO: 282844

SEQ ID NO: 753765 - RNA, 64 nt, Homo Sapiens; identical to SEQ ID NO: 282845

SEQ ID NO: 753766 - RNA, 64 nt, Homo Sapiens; identical to SEQ ID NO: 282846

SEQ ID NO: 753767 - RNA, 53 nt, Homo Sapiens; identical to SEQ ID NO: 282847

SEQ ID NO: 753768 - RNA, 64 nt, Homo Sapiens; identical to SEQ ID NO: 282848

SEQ ID NO: 753769 - RNA, 64 nt, Homo Sapiens; identical to SEQ ID NO: 282849

SEQ ID NO: 753770 - RNA, 64 nt, Homo Sapiens; identical to SEQ ID NO: 282850

SEQ ID NO: 753771 - RNA, 64 nt, Homo Sapiens; identical to SEQ ID NO: 282851

SEQ ID NO: 753772 - RNA, 64 nt, Homo Sapiens; identical to SEQ ID NO: 282852

SEQ ID NO: 753773 - RNA, 64 nt, Homo Sapiens; identical to SEQ ID NO: 282853

SEQ ID NO: 753774 - RNA, 64 nt, Homo Sapiens; identical to SEQ ID NO: 282854

SEQ ID NO: 753775 - RNA, 64 nt, Homo Sapiens; identical to SEQ ID NO: 282855

SEQ ID NO: 753776 - RNA, 64 nt, Homo Sapiens; identical to SEQ ID NO: 282856

SEQ ID NO: 753777 - RNA, 64 nt, Homo Sapiens; identical to SEQ ID NO: 282857

SEQ ID NO: 753778 - RNA, 64 nt, Homo Sapiens; identical to SEQ ID NO: 282858

SEQ ID NO: 753779 - RNA, 64 nt, Homo Sapiens; identical to SEQ ID NO: 282859

SEQ ID NO: 753780 - RNA, 64 nt, Homo Sapiens; identical to SEQ ID NO: 282860

SEQ ID NO: 753781 - RNA, 64 nt, Homo Sapiens; identical to SEQ ID NO: 282861

SEQ ID NO: 753782 - RNA, 64 nt, Homo Sapiens; identical to SEQ ID NO: 282862

SEQ ID NO: 753783 - RNA, 64 nt, Homo Sapiens; identical to SEQ ID NO: 282863

SEQ ID NO: 753784 - RNA, 64 nt, Homo Sapiens; identical to SEQ ID NO: 282864

SEQ ID NO: 753785 - RNA, 64 nt, Homo Sapiens; identical to SEQ ID NO: 282865

SEQ ID NO: 753786 - RNA, 64 nt, Homo Sapiens; identical to SEQ ID NO: 282866

SEQ ID NO: 753787 - RNA, 64 nt, Homo Sapiens; identical to SEQ ID NO: 282867

SEQ ID NO: 753788 - RNA, 64 nt, Homo Sapiens; identical to SEQ ID NO: 282868

SEQ ID NO: 753789 - RNA, 64 nt, Homo Sapiens; identical to SEQ ID NO: 282869

SEQ ID NO: 753790 - RNA, 64 nt, Homo Sapiens; identical to SEQ ID NO: 282870

SEQ ID NO: 753791 - RNA, 64 nt, Homo Sapiens; identical to SEQ ID NO: 282871

SEQ ID NO: 753792 - RNA, 64 nt, Homo Sapiens; identical to SEQ ID NO: 282872

SEQ ID NO: 753793 - RNA, 64 nt, Homo Sapiens; identical to SEQ ID NO: 282873

SEQ ID NO: 753794 - RNA, 64 nt, Homo Sapiens; identical to SEQ ID NO: 282874

SEQ ID NO: 753795 - RNA, 64 nt, Homo Sapiens; identical to SEQ ID NO: 282875

SEQ ID NO: 753796 - RNA, 64 nt, Homo Sapiens; identical to SEQ ID NO: 282876

SEQ ID NO: 753797 - RNA, 64 nt, Homo Sapiens; identical to SEQ ID NO: 282877

SEQ ID NO: 753798 - RNA, 64 nt, Homo Sapiens; identical to SEQ ID NO: 282878

SEQ ID NO: 753799 - RNA, 64 nt, Homo Sapiens; identical to SEQ ID NO: 282879

SEQ ID NO: 753800 - RNA, 64 nt, Homo Sapiens; identical to SEQ ID NO: 282880

SEQ ID NO: 753801 - RNA, 64 nt, Homo Sapiens; identical to SEQ ID NO: 282881

SEQ ID NO: 753802 - RNA, 64 nt, Homo Sapiens; identical to SEQ ID NO: 282882

SEQ ID NO: 753803 - RNA, 64 nt, Homo Sapiens; identical to SEQ ID NO: 282883

SEQ ID NO: 753804 - RNA, 64 nt, Homo Sapiens; identical to SEQ ID NO: 282884

SEQ ID NO: 753805 - RNA, 64 nt, Homo Sapiens; identical to SEQ ID NO: 282885

SEQ ID NO: 753806 - RNA, 64 nt, Homo Sapiens; identical to SEQ ID NO: 282886

SEQ ID NO: 753807 - RNA, 64 nt, Homo Sapiens; identical to SEQ ID NO: 282887

SEQ ID NO: 753808 - RNA, 64 nt, Homo Sapiens; identical to SEQ ID NO: 282888

SEQ ID NO: 753809 - RNA, 64 nt, Homo Sapiens; identical to SEQ ID NO: 282889

SEQ ID NO: 753810 - RNA, 64 nt, Homo Sapiens; identical to SEQ ID NO: 282890

SEQ ID NO: 753811 - RNA, 64 nt, Homo Sapiens; identical to SEQ ID NO: 282891

SEQ ID NO: 753812 - RNA, 64 nt, Homo Sapiens; identical to SEQ ID NO: 282892

SEQ ID NO: 753813 - RNA, 64 nt, Homo Sapiens; identical to SEQ ID NO: 282893

SEQ ID NO: 753814 - RNA, 64 nt, Homo Sapiens; identical to SEQ ID NO: 282894

SEQ ID NO: 753815 - RNA, 64 nt, Homo Sapiens; identical to SEQ ID NO: 282895

SEQ ID NO: 753816 - RNA, 64 nt, Homo Sapiens; identical to SEQ ID NO: 282896

SEQ ID NO: 753817 - RNA, 64 nt, Homo Sapiens; identical to SEQ ID NO: 282897

SEQ ID NO: 753818 - RNA, 64 nt, Homo Sapiens; identical to SEQ ID NO: 282898

SEQ ID NO: 753819 - RNA, 64 nt, Homo Sapiens; identical to SEQ ID NO: 282899

SEQ ID NO: 753820 - RNA, 64 nt, Homo Sapiens; identical to SEQ ID NO: 282900

SEQ ID NO: 753821 - RNA, 64 nt, Homo Sapiens; identical to SEQ ID NO: 282901

SEQ ID NO: 753822 - RNA, 64 nt, Homo Sapiens; identical to SEQ ID NO: 282902

SEQ ID NO: 753823 - RNA, 64 nt, Homo Sapiens; identical to SEQ ID NO: 282903

SEQ ID NO: 753824 - RNA, 64 nt, Homo Sapiens; identical to SEQ ID NO: 282904

SEQ ID NO: 753825 - RNA, 64 nt, Homo Sapiens; identical to SEQ ID NO: 282905

SEQ ID NO: 753826 - RNA, 64 nt, Homo Sapiens; identical to SEQ ID NO: 282906

SEQ ID NO: 753827 - RNA, 64 nt, Homo Sapiens; identical to SEQ ID NO: 282907

SEQ ID NO: 753828 - RNA, 64 nt, Homo Sapiens; identical to SEQ ID NO: 282908

SEQ ID NO: 753829 - RNA, 64 nt, Homo Sapiens; identical to SEQ ID NO: 282909

SEQ ID NO: 753830 - RNA, 64 nt, Homo Sapiens; identical to SEQ ID NO: 282910

SEQ ID NO: 753831 - RNA, 64 nt, Homo Sapiens; identical to SEQ ID NO: 282911

SEQ ID NO: 753832 - RNA, 62 nt, Homo Sapiens
uguuuucugcuuuuacagcagcuucucucccacaccacaacuuuauuaagguauaguggaua

SEQ ID NO: 753833 - RNA, 62 nt, Homo Sapiens
caacuugauauguguauauacaguaaaguguucaccacaagcaagccaauuaacauauccuc

SEQ ID NO: 753834 - RNA, 62 nt, Homo Sapiens
ggccugaaauucuuaaaggaacaggcaugagccaccacaacuccucccaaacuggugagauu

SEQ ID NO: 753835 - RNA, 62 nt, Homo Sapiens
cucagcuaauuuuuaaaauugccacaggugugcaccacaacucagccucccaaauaacuggg

SEQ ID NO: 753836 - RNA, 62 nt, Homo Sapiens
gcaaccucagcaguucccaucaaggccaccuccaccacaaccgaaaguaucaucucagggaa

SEQ ID NO: 753837 - RNA, 62 nt, Homo Sapiens
ccuuucuguugcaacuaugaaugaaaacaaaacaccacaaaacagacuucacuaacacagaa

SEQ ID NO: 753838 - RNA, 62 nt, Homo Sapiens
cacacaggaucacucacauauguacauguacccaccacaaacgugcaagcuccugcacacau

SEQ ID NO: 753839 - RNA, 62 nt, Homo Sapiens
cagccuccugcacacgugcacauucauguguacaccacaaaugaguucccagacguguaaac

SEQ ID NO: 753840 - RNA, 62 nt, Homo Sapiens
cacaggcuccuacacacaugcacacacguguacaccacaaacgagcucccagacauguaaac

SEQ ID NO: 753841 - RNA, 62 nt, Homo Sapiens
ugagcucccacacguacacaugcacauguacgcaccacaaacacaugcgcaggcuccugcag

SEQ ID NO: 753842 - RNA, 64 nt, Homo Sapiens; identical to SEQ ID NO: 274946

SEQ ID NO: 753843 - RNA, 64 nt, Homo Sapiens; identical to SEQ ID NO: 274947

SEQ ID NO: 753844 - RNA, 64 nt, Homo Sapiens; identical to SEQ ID NO: 274948

SEQ ID NO: 753845 - RNA, 64 nt, Homo Sapiens; identical to SEQ ID NO: 274949

SEQ ID NO: 753846 - RNA, 64 nt, Homo Sapiens; identical to SEQ ID NO: 274950

SEQ ID NO: 753847 - RNA, 64 nt, Homo Sapiens; identical to SEQ ID NO: 274951

SEQ ID NO: 753848 - RNA, 64 nt, Homo Sapiens; identical to SEQ ID NO: 274952

SEQ ID NO: 753849 - RNA, 64 nt, Homo Sapiens; identical to SEQ ID NO: 274953

SEQ ID NO: 753850 - RNA, 64 nt, Homo Sapiens; identical to SEQ ID NO: 274954

SEQ ID NO: 753851 - RNA, 64 nt, Homo Sapiens; identical to SEQ ID NO: 274955

SEQ ID NO: 753852 - RNA, 64 nt, Homo Sapiens; identical to SEQ ID NO: 274956

SEQ ID NO: 753853 - RNA, 64 nt, Homo Sapiens; identical to SEQ ID NO: 274957

SEQ ID NO: 753854 - RNA, 64 nt, Homo Sapiens; identical to SEQ ID NO: 274958

SEQ ID NO: 753855 - RNA, 64 nt, Homo Sapiens; identical to SEQ ID NO: 274959

SEQ ID NO: 753856 - RNA, 64 nt, Homo Sapiens; identical to SEQ ID NO: 274960

SEQ ID NO: 753857 - RNA, 64 nt, Homo Sapiens; identical to SEQ ID NO: 274961

SEQ ID NO: 753858 - RNA, 64 nt, Homo Sapiens; identical to SEQ ID NO: 274962

SEQ ID NO: 753859 - RNA, 64 nt, Homo Sapiens; identical to SEQ ID NO: 274963

SEQ ID NO: 753860 - RNA, 64 nt, Homo Sapiens; identical to SEQ ID NO: 274964

SEQ ID NO: 753861 - RNA, 64 nt, Homo Sapiens; identical to SEQ ID NO: 274965

SEQ ID NO: 753862 - RNA, 64 nt, Homo Sapiens; identical to SEQ ID NO: 274966

SEQ ID NO: 753863 - RNA, 64 nt, Homo Sapiens; identical to SEQ ID NO: 274967

SEQ ID NO: 753864 - RNA, 64 nt, Homo Sapiens; identical to SEQ ID NO: 274968

SEQ ID NO: 753865 - RNA, 64 nt, Homo Sapiens; identical to SEQ ID NO: 274969

SEQ ID NO: 753866 - RNA, 64 nt, Homo Sapiens; identical to SEQ ID NO: 274970

SEQ ID NO: 753867 - RNA, 64 nt, Homo Sapiens; identical to SEQ ID NO: 274971

SEQ ID NO: 753868 - RNA, 64 nt, Homo Sapiens; identical to SEQ ID NO: 274972

SEQ ID NO: 753869 - RNA, 64 nt, Homo Sapiens; identical to SEQ ID NO: 274973

SEQ ID NO: 753870 - RNA, 64 nt, Homo Sapiens; identical to SEQ ID NO: 274974

SEQ ID NO: 753871 - RNA, 64 nt, Homo Sapiens; identical to SEQ ID NO: 274975

SEQ ID NO: 753872 - RNA, 64 nt, Homo Sapiens; identical to SEQ ID NO: 274976

SEQ ID NO: 753873 - RNA, 64 nt, Homo Sapiens; identical to SEQ ID NO: 274977

SEQ ID NO: 753874 - RNA, 64 nt, Homo Sapiens; identical to SEQ ID NO: 274978

SEQ ID NO: 753875 - RNA, 64 nt, Homo Sapiens; identical to SEQ ID NO: 274979

SEQ ID NO: 753876 - RNA, 64 nt, Homo Sapiens; identical to SEQ ID NO: 274980

SEQ ID NO: 753877 - RNA, 64 nt, Homo Sapiens; identical to SEQ ID NO: 274981

SEQ ID NO: 753878 - RNA, 59 nt, Homo Sapiens; identical to SEQ ID NO: 274982

SEQ ID NO: 753879 - RNA, 64 nt, Homo Sapiens
cugagucaccuucugacacgagcucccucugcuugcuuuccaggucuugaaaaucugaauucac

SEQ ID NO: 753880 - RNA, 64 nt, Homo Sapiens
uugggagcccaggugguccuuggccaccauucaggcuuuccaagaagccaaccaccuuggagau

SEQ ID NO: 753881 - RNA, 64 nt, Homo Sapiens
ccuuuguagggccuugcugccagggggcagggaugcuuuccagccugcagcaacagaacacuug

SEQ ID NO: 753882 - RNA, 64 nt, Homo Sapiens
augccccuccagaaggaccuaggagaguaggugagcuuuccaaagugagagacgaaucuuucuu

SEQ ID NO: 753883 - RNA, 64 nt, Homo Sapiens
cuccagaacucuuuuuuccucuucuuacaccauugcuuuccauuccaggcuucagucuucccaa

SEQ ID NO: 753884 - RNA, 64 nt, Homo Sapiens
aacucucaucucaggcccucucaccaugagacuggcuuuccacaccucagcucaccuucucucu

SEQ ID NO: 753885 - RNA, 64 nt, Homo Sapiens
aacuagucuugaaaugccuuuucauaauguugcugcuuuccauuuguggaguuugaucacacaa

SEQ ID NO: 753886 - RNA, 64 nt, Homo Sapiens
cuaacuuaaucuuugugauauaaaggaauccaaagcuuuccauuacaugucuugaauguacaca

SEQ ID NO: 753887 - RNA, 64 nt, Homo Sapiens
gcaagaaaccucaggccgugugaagagcagcaaagcuuuccagaaggcauaaaaggaaacuuga

SEQ ID NO: 753888 - RNA, 64 nt, Homo Sapiens
gccccugcacaaggaugacucgcaaauucauaaagcuuuccauaaauauauuuauuaaaaacca

SEQ ID NO: 753889 - RNA, 64 nt, Homo Sapiens
cuauagagaucuacuuuucuccuaugucuccuaggcuuuccaugauaauuagguaauacauuua

SEQ ID NO: 753890 - RNA, 64 nt, Homo Sapiens
gauguauuuuaugaugcccagcuuggaaauaguugcuuuccauagucucaacuguauuguguca

SEQ ID NO: 753891 - RNA, 64 nt, Homo Sapiens
cacuaaccaaggcuuccaggcggcccucuccacugcuuuccagagccuggcugccccuccccuc

SEQ ID NO: 753892 - RNA, 64 nt, Homo Sapiens
gggcagcacagccagggccgcugguaucagagcugcuuuccagacugugcccugacagccgcuc

SEQ ID NO: 753893 - RNA, 64 nt, Homo Sapiens
gggcccacaccugcuuaguuuaugaggaccggcugcuuuccagugguagcccuuuugccaugga

SEQ ID NO: 753894 - RNA, 64 nt, Homo Sapiens
auucuaaguguccaccccagggaggcaaggggcugcuuuccacuguggguaccuggugaucagg

SEQ ID NO: 753895 - RNA, 64 nt, Homo Sapiens
ucgagaacauaaauagauugcgcgcccagauccugcuuuccauucuccaaguugcauugccucc

SEQ ID NO: 753896 - RNA, 64 nt, Homo Sapiens
augacaccugaacaucuuccccgcgaggucagaugcuuuccaacacaccuaagcagguagacau

SEQ ID NO: 753897 - RNA, 64 nt, Homo Sapiens; identical to SEQ ID NO: 178825

SEQ ID NO: 753898 - RNA, 64 nt, Homo Sapiens; identical to SEQ ID NO: 178826

SEQ ID NO: 753899 - RNA, 64 nt, Homo Sapiens; identical to SEQ ID NO: 178827

SEQ ID NO: 753900 - RNA, 64 nt, Homo Sapiens; identical to SEQ ID NO: 178828

SEQ ID NO: 753901 - RNA, 64 nt, Homo Sapiens; identical to SEQ ID NO: 178829

SEQ ID NO: 753902 - RNA, 64 nt, Homo Sapiens; identical to SEQ ID NO: 178830

SEQ ID NO: 753903 - RNA, 64 nt, Homo Sapiens; identical to SEQ ID NO: 178831

SEQ ID NO: 753904 - RNA, 64 nt, Homo Sapiens; identical to SEQ ID NO: 178832

SEQ ID NO: 753905 - RNA, 64 nt, Homo Sapiens; identical to SEQ ID NO: 178833

SEQ ID NO: 753906 - RNA, 64 nt, Homo Sapiens; identical to SEQ ID NO: 178834

SEQ ID NO: 753907 - RNA, 64 nt, Homo Sapiens; identical to SEQ ID NO: 178835

SEQ ID NO: 753908 - RNA, 64 nt, Homo Sapiens; identical to SEQ ID NO: 178836

SEQ ID NO: 753909 - RNA, 64 nt, Homo Sapiens; identical to SEQ ID NO: 178837

SEQ ID NO: 753910 - RNA, 64 nt, Homo Sapiens; identical to SEQ ID NO: 178838

SEQ ID NO: 753911 - RNA, 62 nt, Homo Sapiens
ccaccuaaaauucauaugugacaaaauuaucucgaccuuacauaggaggagaauacuugaag

SEQ ID NO: 753912 - RNA, 62 nt, Homo Sapiens
agugacauuuaaugccaucuagcuagcaauugcgaccuuaauuuaacuuuccagucuuagcu

SEQ ID NO: 753913 - RNA, 62 nt, Homo Sapiens
caaggcccucagagaugaucaguccaacugaacgaccuuacaaaugaggaaaccaagauaaa

SEQ ID NO: 753914 - RNA, 62 nt, Homo Sapiens
ucuaaaguaggucaucagguucacuuauuauccgaccuuaaucugggauaaagguuuuggua

SEQ ID NO: 753915 - RNA, 62 nt, Homo Sapiens
ccucccugccuuagagaugaggcucagacaaacgaccuuagcacccauagccuaugccauga

SEQ ID NO: 753916 - RNA, 62 nt, Homo Sapiens
agcacaguaaauaucccaaacugugaugaagccgaccuuagauuuaguaguguaagcuagaa

SEQ ID NO: 753917 - RNA, 62 nt, Homo Sapiens
ccagacuuguagggaagaaaacaaugacuugacgaccuuaaaaaggguuagauugacauugc

SEQ ID NO: 753918 - RNA, 62 nt, Homo Sapiens
cuguauccuuuaucccagccagucauccagcucgaccuuaugagaagguaccuugcccaggu

SEQ ID NO: 753919 - RNA, 62 nt, Homo Sapiens
gauguagcugcugcuuguccaucuuacuuucccgaccuuaagaaugcaggauccaaauccuc

SEQ ID NO: 753920 - RNA, 62 nt, Homo Sapiens
gaucugauacaucuaguuauaaauacacuucccgaccuuaaguggagauaaaaagaagagua

SEQ ID NO: 753921 - RNA, 62 nt, Homo Sapiens
uauuacccuccccucccacagcccucagcccccgaccuuauucgccacccccuccaaccacu

SEQ ID NO: 753922 - RNA, 62 nt, Homo Sapiens
gauaaugcggguaacagacaauauaauagccccgaccuuaaacgaagcuuuuguacugcaga

SEQ ID NO: 753923 - RNA, 62 nt, Homo Sapiens
gagggccacguccugggguagcuccugaccuccgaccuuauguccaaauuucacacccaugg

SEQ ID NO: 753924 - RNA, 62 nt, Homo Sapiens
guucugauuucugaggagccaggacaaguuggcgaccuuacuccuccaaaacugaacacaag

SEQ ID NO: 753925 - RNA, 62 nt, Homo Sapiens
uggggugccuagguugguuuccccugcacucccgaccuuagcuuauugaucccacauuucca

SEQ ID NO: 753926 - RNA, 62 nt, Homo Sapiens
uuaucugggagagaaacaagcucagccccugccgaccuuagcauccucccugccucacuccc

SEQ ID NO: 753927 - RNA, 62 nt, Homo Sapiens
gagaagagggaggagucacgcccugaagcguacgaccuuacacuuucucaguacaagcaacu

SEQ ID NO: 753928 - RNA, 62 nt, Homo Sapiens
caggaaugcuuagcacguuuuucaagauccaucgaccuuaaaagugcauaaggucuuuggcc

SEQ ID NO: 753929 - RNA, 64 nt, Homo Sapiens; identical to SEQ ID NO: 682747

SEQ ID NO: 753930 - RNA, 64 nt, Homo Sapiens; identical to SEQ ID NO: 682748

SEQ ID NO: 753931 - RNA, 64 nt, Homo Sapiens; identical to SEQ ID NO: 682749

SEQ ID NO: 753932 - RNA, 64 nt, Homo Sapiens; identical to SEQ ID NO: 682750

SEQ ID NO: 753933 - RNA, 64 nt, Homo Sapiens; identical to SEQ ID NO: 682751

SEQ ID NO: 753934 - RNA, 64 nt, Homo Sapiens; identical to SEQ ID NO: 682752

SEQ ID NO: 753935 - RNA, 64 nt, Homo Sapiens; identical to SEQ ID NO: 682753

SEQ ID NO: 753936 - RNA, 64 nt, Homo Sapiens; identical to SEQ ID NO: 682754

SEQ ID NO: 753937 - RNA, 64 nt, Homo Sapiens; identical to SEQ ID NO: 682755

SEQ ID NO: 753938 - RNA, 64 nt, Homo Sapiens; identical to SEQ ID NO: 682756

SEQ ID NO: 753939 - RNA, 64 nt, Homo Sapiens; identical to SEQ ID NO: 682757

SEQ ID NO: 753940 - RNA, 64 nt, Homo Sapiens; identical to SEQ ID NO: 682758

SEQ ID NO: 753941 - RNA, 64 nt, Homo Sapiens; identical to SEQ ID NO: 682759

SEQ ID NO: 753942 - RNA, 64 nt, Homo Sapiens; identical to SEQ ID NO: 682760

SEQ ID NO: 753943 - RNA, 64 nt, Homo Sapiens; identical to SEQ ID NO: 682761

SEQ ID NO: 753944 - RNA, 64 nt, Homo Sapiens; identical to SEQ ID NO: 682762

SEQ ID NO: 753945 - RNA, 64 nt, Homo Sapiens; identical to SEQ ID NO: 682763

SEQ ID NO: 753946 - RNA, 64 nt, Homo Sapiens; identical to SEQ ID NO: 682764

SEQ ID NO: 753947 - RNA, 64 nt, Homo Sapiens; identical to SEQ ID NO: 682765

SEQ ID NO: 753948 - RNA, 64 nt, Homo Sapiens; identical to SEQ ID NO: 682766

SEQ ID NO: 753949 - RNA, 64 nt, Homo Sapiens; identical to SEQ ID NO: 682767

SEQ ID NO: 753950 - RNA, 64 nt, Homo Sapiens; identical to SEQ ID NO: 682768

SEQ ID NO: 753951 - RNA, 64 nt, Homo Sapiens; identical to SEQ ID NO: 682769

SEQ ID NO: 753952 - RNA, 64 nt, Homo Sapiens; identical to SEQ ID NO: 682770

SEQ ID NO: 753953 - RNA, 64 nt, Homo Sapiens; identical to SEQ ID NO: 682771

SEQ ID NO: 753954 - RNA, 64 nt, Homo Sapiens; identical to SEQ ID NO: 682772

SEQ ID NO: 753955 - RNA, 64 nt, Homo Sapiens; identical to SEQ ID NO: 682773

SEQ ID NO: 753956 - RNA, 64 nt, Homo Sapiens; identical to SEQ ID NO: 682774

SEQ ID NO: 753957 - RNA, 64 nt, Homo Sapiens; identical to SEQ ID NO: 682775

SEQ ID NO: 753958 - RNA, 64 nt, Homo Sapiens; identical to SEQ ID NO: 682776

SEQ ID NO: 753959 - RNA, 64 nt, Homo Sapiens; identical to SEQ ID NO: 682777

SEQ ID NO: 753960 - RNA, 64 nt, Homo Sapiens; identical to SEQ ID NO: 682778

SEQ ID NO: 753961 - RNA, 64 nt, Homo Sapiens; identical to SEQ ID NO: 682779

SEQ ID NO: 753962 - RNA, 64 nt, Homo Sapiens; identical to SEQ ID NO: 682780

SEQ ID NO: 753963 - RNA, 64 nt, Homo Sapiens; identical to SEQ ID NO: 682781

SEQ ID NO: 753964 - RNA, 64 nt, Homo Sapiens; identical to SEQ ID NO: 682782

SEQ ID NO: 753965 - RNA, 64 nt, Homo Sapiens; identical to SEQ ID NO: 682783

SEQ ID NO: 753966 - RNA, 64 nt, Homo Sapiens; identical to SEQ ID NO: 682784

SEQ ID NO: 753967 - RNA, 64 nt, Homo Sapiens; identical to SEQ ID NO: 682785

SEQ ID NO: 753968 - RNA, 64 nt, Homo Sapiens; identical to SEQ ID NO: 682786

SEQ ID NO: 753969 - RNA, 64 nt, Homo Sapiens; identical to SEQ ID NO: 682787

SEQ ID NO: 753970 - RNA, 64 nt, Homo Sapiens; identical to SEQ ID NO: 682788

SEQ ID NO: 753971 - RNA, 64 nt, Homo Sapiens; identical to SEQ ID NO: 682789

SEQ ID NO: 753972 - RNA, 64 nt, Homo Sapiens; identical to SEQ ID NO: 682790

SEQ ID NO: 753973 - RNA, 64 nt, Homo Sapiens; identical to SEQ ID NO: 682791

SEQ ID NO: 753974 - RNA, 64 nt, Homo Sapiens; identical to SEQ ID NO: 682792

SEQ ID NO: 753975 - RNA, 64 nt, Homo Sapiens; identical to SEQ ID NO: 682793

SEQ ID NO: 753976 - RNA, 64 nt, Homo Sapiens; identical to SEQ ID NO: 682794

SEQ ID NO: 753977 - RNA, 64 nt, Homo Sapiens; identical to SEQ ID NO: 682795

SEQ ID NO: 753978 - RNA, 64 nt, Homo Sapiens; identical to SEQ ID NO: 682796

SEQ ID NO: 753979 - RNA, 64 nt, Homo Sapiens; identical to SEQ ID NO: 173300

SEQ ID NO: 753980 - RNA, 64 nt, Homo Sapiens; identical to SEQ ID NO: 173301

SEQ ID NO: 753981 - RNA, 64 nt, Homo Sapiens; identical to SEQ ID NO: 173302

SEQ ID NO: 753982 - RNA, 64 nt, Homo Sapiens; identical to SEQ ID NO: 173303

SEQ ID NO: 753983 - RNA, 64 nt, Homo Sapiens; identical to SEQ ID NO: 173304

SEQ ID NO: 753984 - RNA, 64 nt, Homo Sapiens; identical to SEQ ID NO: 173305

SEQ ID NO: 753985 - RNA, 64 nt, Homo Sapiens; identical to SEQ ID NO: 173306

SEQ ID NO: 753986 - RNA, 64 nt, Homo Sapiens; identical to SEQ ID NO: 173307

SEQ ID NO: 753987 - RNA, 64 nt, Homo Sapiens; identical to SEQ ID NO: 55280

SEQ ID NO: 753988 - RNA, 64 nt, Homo Sapiens; identical to SEQ ID NO: 55281

SEQ ID NO: 753989 - RNA, 64 nt, Homo Sapiens; identical to SEQ ID NO: 55282

SEQ ID NO: 753990 - RNA, 64 nt, Homo Sapiens; identical to SEQ ID NO: 55283

SEQ ID NO: 753991 - RNA, 64 nt, Homo Sapiens; identical to SEQ ID NO: 55284

SEQ ID NO: 753992 - RNA, 64 nt, Homo Sapiens; identical to SEQ ID NO: 55285

SEQ ID NO: 753993 - RNA, 64 nt, Homo Sapiens; identical to SEQ ID NO: 55286

SEQ ID NO: 753994 - RNA, 64 nt, Homo Sapiens; identical to SEQ ID NO: 55287

SEQ ID NO: 753995 - RNA, 64 nt, Homo Sapiens; identical to SEQ ID NO: 55288

SEQ ID NO: 753996 - RNA, 64 nt, Homo Sapiens; identical to SEQ ID NO: 55289

SEQ ID NO: 753997 - RNA, 64 nt, Homo Sapiens; identical to SEQ ID NO: 55290

SEQ ID NO: 753998 - RNA, 64 nt, Homo Sapiens; identical to SEQ ID NO: 55291

SEQ ID NO: 753999 - RNA, 64 nt, Homo Sapiens; identical to SEQ ID NO: 55292

SEQ ID NO: 754000 - RNA, 64 nt, Homo Sapiens; identical to SEQ ID NO: 55293

SEQ ID NO: 754001 - RNA, 64 nt, Homo Sapiens; identical to SEQ ID NO: 55294

SEQ ID NO: 754002 - RNA, 64 nt, Homo Sapiens; identical to SEQ ID NO: 55295

SEQ ID NO: 754003 - RNA, 64 nt, Homo Sapiens; identical to SEQ ID NO: 55296

SEQ ID NO: 754004 - RNA, 64 nt, Homo Sapiens; identical to SEQ ID NO: 55297

SEQ ID NO: 754005 - RNA, 64 nt, Homo Sapiens; identical to SEQ ID NO: 55298

SEQ ID NO: 754006 - RNA, 64 nt, Homo Sapiens; identical to SEQ ID NO: 55299

SEQ ID NO: 754007 - RNA, 64 nt, Homo Sapiens; identical to SEQ ID NO: 55300

SEQ ID NO: 754008 - RNA, 64 nt, Homo Sapiens; identical to SEQ ID NO: 55301

SEQ ID NO: 754009 - RNA, 64 nt, Homo Sapiens; identical to SEQ ID NO: 55302

SEQ ID NO: 754010 - RNA, 64 nt, Homo Sapiens; identical to SEQ ID NO: 55303

SEQ ID NO: 754011 - RNA, 64 nt, Homo Sapiens; identical to SEQ ID NO: 55304

SEQ ID NO: 754012 - RNA, 64 nt, Homo Sapiens; identical to SEQ ID NO: 55305

SEQ ID NO: 754013 - RNA, 64 nt, Homo Sapiens; identical to SEQ ID NO: 55306

SEQ ID NO: 754014 - RNA, 64 nt, Homo Sapiens; identical to SEQ ID NO: 55307

SEQ ID NO: 754015 - RNA, 64 nt, Homo Sapiens; identical to SEQ ID NO: 55308

SEQ ID NO: 754016 - RNA, 64 nt, Homo Sapiens; identical to SEQ ID NO: 55309

SEQ ID NO: 754017 - RNA, 64 nt, Homo Sapiens; identical to SEQ ID NO: 55310

SEQ ID NO: 754018 - RNA, 64 nt, Homo Sapiens; identical to SEQ ID NO: 55311

SEQ ID NO: 754019 - RNA, 64 nt, Homo Sapiens; identical to SEQ ID NO: 55312

SEQ ID NO: 754020 - RNA, 64 nt, Homo Sapiens; identical to SEQ ID NO: 55313

SEQ ID NO: 754021 - RNA, 64 nt, Homo Sapiens; identical to SEQ ID NO: 55314

SEQ ID NO: 754022 - RNA, 64 nt, Homo Sapiens; identical to SEQ ID NO: 55315

SEQ ID NO: 754023 - RNA, 64 nt, Homo Sapiens; identical to SEQ ID NO: 55316

SEQ ID NO: 754024 - RNA, 64 nt, Homo Sapiens; identical to SEQ ID NO: 55317

SEQ ID NO: 754025 - RNA, 64 nt, Homo Sapiens; identical to SEQ ID NO: 55318

SEQ ID NO: 754026 - RNA, 64 nt, Homo Sapiens; identical to SEQ ID NO: 55319

SEQ ID NO: 754027 - RNA, 64 nt, Homo Sapiens; identical to SEQ ID NO: 55320

SEQ ID NO: 754028 - RNA, 64 nt, Homo Sapiens; identical to SEQ ID NO: 55321

SEQ ID NO: 754029 - RNA, 64 nt, Homo Sapiens; identical to SEQ ID NO: 55322

SEQ ID NO: 754030 - RNA, 64 nt, Homo Sapiens; identical to SEQ ID NO: 55323

SEQ ID NO: 754031 - RNA, 64 nt, Homo Sapiens; identical to SEQ ID NO: 55324

SEQ ID NO: 754032 - RNA, 64 nt, Homo Sapiens; identical to SEQ ID NO: 55325

SEQ ID NO: 754033 - RNA, 64 nt, Homo Sapiens; identical to SEQ ID NO: 55326

SEQ ID NO: 754034 - RNA, 64 nt, Homo Sapiens; identical to SEQ ID NO: 55327

SEQ ID NO: 754035 - RNA, 64 nt, Homo Sapiens; identical to SEQ ID NO: 55328

SEQ ID NO: 754036 - RNA, 64 nt, Homo Sapiens; identical to SEQ ID NO: 55329

SEQ ID NO: 754037 - RNA, 64 nt, Homo Sapiens; identical to SEQ ID NO: 55330

SEQ ID NO: 754038 - RNA, 64 nt, Homo Sapiens; identical to SEQ ID NO: 55331

SEQ ID NO: 754039 - RNA, 64 nt, Homo Sapiens; identical to SEQ ID NO: 55332

SEQ ID NO: 754040 - RNA, 64 nt, Homo Sapiens; identical to SEQ ID NO: 55333

SEQ ID NO: 754041 - RNA, 64 nt, Homo Sapiens; identical to SEQ ID NO: 55334

SEQ ID NO: 754042 - RNA, 64 nt, Homo Sapiens; identical to SEQ ID NO: 55335

SEQ ID NO: 754043 - RNA, 64 nt, Homo Sapiens; identical to SEQ ID NO: 138909

SEQ ID NO: 754044 - RNA, 64 nt, Homo Sapiens; identical to SEQ ID NO: 138910

SEQ ID NO: 754045 - RNA, 64 nt, Homo Sapiens; identical to SEQ ID NO: 138911

SEQ ID NO: 754046 - RNA, 64 nt, Homo Sapiens; identical to SEQ ID NO: 138912

SEQ ID NO: 754047 - RNA, 64 nt, Homo Sapiens; identical to SEQ ID NO: 138913

SEQ ID NO: 754048 - RNA, 64 nt, Homo Sapiens; identical to SEQ ID NO: 138914

SEQ ID NO: 754049 - RNA, 64 nt, Homo Sapiens; identical to SEQ ID NO: 138915

SEQ ID NO: 754050 - RNA, 64 nt, Homo Sapiens; identical to SEQ ID NO: 138916

SEQ ID NO: 754051 - RNA, 64 nt, Homo Sapiens; identical to SEQ ID NO: 138917

SEQ ID NO: 754052 - RNA, 64 nt, Homo Sapiens; identical to SEQ ID NO: 138918

SEQ ID NO: 754053 - RNA, 64 nt, Homo Sapiens; identical to SEQ ID NO: 138919

SEQ ID NO: 754054 - RNA, 64 nt, Homo Sapiens; identical to SEQ ID NO: 138920

SEQ ID NO: 754055 - RNA, 64 nt, Homo Sapiens; identical to SEQ ID NO: 138921

SEQ ID NO: 754056 - RNA, 64 nt, Homo Sapiens; identical to SEQ ID NO: 138922

SEQ ID NO: 754057 - RNA, 64 nt, Homo Sapiens; identical to SEQ ID NO: 138923

SEQ ID NO: 754058 - RNA, 64 nt, Homo Sapiens; identical to SEQ ID NO: 138924

SEQ ID NO: 754059 - RNA, 64 nt, Homo Sapiens; identical to SEQ ID NO: 138925

SEQ ID NO: 754060 - RNA, 64 nt, Homo Sapiens; identical to SEQ ID NO: 138926

SEQ ID NO: 754061 - RNA, 64 nt, Homo Sapiens; identical to SEQ ID NO: 138927

SEQ ID NO: 754062 - RNA, 64 nt, Homo Sapiens; identical to SEQ ID NO: 138928

SEQ ID NO: 754063 - RNA, 64 nt, Homo Sapiens; identical to SEQ ID NO: 138929

SEQ ID NO: 754064 - RNA, 64 nt, Homo Sapiens; identical to SEQ ID NO: 138930

SEQ ID NO: 754065 - RNA, 64 nt, Homo Sapiens; identical to SEQ ID NO: 138931

SEQ ID NO: 754066 - RNA, 64 nt, Homo Sapiens; identical to SEQ ID NO: 138932

SEQ ID NO: 754067 - RNA, 64 nt, Homo Sapiens; identical to SEQ ID NO: 138933

SEQ ID NO: 754068 - RNA, 64 nt, Homo Sapiens; identical to SEQ ID NO: 138934

SEQ ID NO: 754069 - RNA, 64 nt, Homo Sapiens; identical to SEQ ID NO: 138935

SEQ ID NO: 754070 - RNA, 64 nt, Homo Sapiens; identical to SEQ ID NO: 138936

SEQ ID NO: 754071 - RNA, 64 nt, Homo Sapiens; identical to SEQ ID NO: 138937

SEQ ID NO: 754072 - RNA, 64 nt, Homo Sapiens; identical to SEQ ID NO: 138938

SEQ ID NO: 754073 - RNA, 64 nt, Homo Sapiens; identical to SEQ ID NO: 138939

SEQ ID NO: 754074 - RNA, 64 nt, Homo Sapiens; identical to SEQ ID NO: 138940

SEQ ID NO: 754075 - RNA, 64 nt, Homo Sapiens
cucugucacccuacagguguuaacagaacugaaauccgacaaccagaggcugaaagaugaaaau

SEQ ID NO: 754076 - RNA, 64 nt, Homo Sapiens
cccaucuccuucccuccucagagaucugagggcauccgacaagguaagagucccacagucuagg

SEQ ID NO: 754077 - RNA, 64 nt, Homo Sapiens
ggucacauguccaucguuaugagaacuguguuuuuccgacaaacgagcuuuaguaagcaauuga

SEQ ID NO: 754078 - RNA, 64 nt, Homo Sapiens
aagauccuccuagaccuugaaggcgccuugcaaauccgacaauuagccuuaugauaucaugcug

SEQ ID NO: 754079 - RNA, 64 nt, Homo Sapiens
ggccauuucccuuuacauucaguccaguggcuuguccgacaacaaggagacucauuuuaacccc

SEQ ID NO: 754080 - RNA, 64 nt, Homo Sapiens
ucaaacuaacaagaggcagucauuacuuucauuuuccgacaacauuuuaaaaacuacauugcuu

SEQ ID NO: 754081 - RNA, 64 nt, Homo Sapiens
uggagguccuguggccacgcggggcaagugccuuuccgacaagacccccggggaaugcaggugc

SEQ ID NO: 754082 - RNA, 64 nt, Homo Sapiens
ucacucgccucgguugcggaagagucuucaucuguccgacaagugcugaucguuucuuccaguu

SEQ ID NO: 754083 - RNA, 64 nt, Homo Sapiens
uggaaagauuuuuguuuucacaagaaggagaaaauccgacaacccuaguugcuuuuuauaagac

SEQ ID NO: 754084 - RNA, 64 nt, Homo Sapiens
guacauaccagggaaagaaaggacagcagucaccuccgacaaugcuccguucuauggaauauug

SEQ ID NO: 754085 - RNA, 64 nt, Homo Sapiens
aauuugaaucuuaacuuucccggaccuguucucuuccgacaagcgcauucugaguguuuacagg

SEQ ID NO: 754086 - RNA, 64 nt, Homo Sapiens
auugggguggggcugcaucacagacacagcugaguccgacaaccggcugggaguucacagaccu

SEQ ID NO: 754087 - RNA, 64 nt, Homo Sapiens
cucccaguacaacaacaugcgcguggaguucaaguccgacaacaccguguccaaaaagggcuuc

SEQ ID NO: 754088 - RNA, 64 nt, Homo Sapiens
aaaauuuagcuggaacgaagacgucugucaaaaauccgacaaauaaacucaauguauaauuuag

SEQ ID NO: 754089 - RNA, 64 nt, Homo Sapiens
gaaggaagcccuccuggacugcuucuuuuggcucuccgacaacuccggccaauaaacacuuucu

SEQ ID NO: 754090 - RNA, 64 nt, Homo Sapiens
ccaggaggcuucauugacguacauguuuucuauuuccgacaaugugcauuucgaagauuuuuau

SEQ ID NO: 754091 - RNA, 64 nt, Homo Sapiens
acacaucaccuugcaaaugacgacagccuucagcuccgacaaagccauggagacagccgaccgg

SEQ ID NO: 754092 - RNA, 64 nt, Homo Sapiens
uuuggcugcaggagguuuuacuuagaucugcaguuccgacaagccuccaggcucuuccugggcc

SEQ ID NO: 754093 - RNA, 64 nt, Homo Sapiens
uaacaggaacaaaaugaauuguuggcuccagucuuccgacaaacuauccucucaaaugcugcuu

SEQ ID NO: 754094 - RNA, 64 nt, Homo Sapiens
agcccaaccggggagcccccgccccgccccacauuccgacaaccgaugcuccagccaaccccug

SEQ ID NO: 754095 - RNA, 64 nt, Homo Sapiens
cauccuccucuucuuucuccuucaucgcuggugcuccgacaaaaaaaguaagucucacgaagca

SEQ ID NO: 754096 - RNA, 64 nt, Homo Sapiens
gaggugaaggcagagaggagccaggacuguggaguccgacaaagcuacuugaaggacacaagag

SEQ ID NO: 754097 - RNA, 64 nt, Homo Sapiens
cuucagccacagggagccacccucuuacggaaaauccgacaagccauagacagcccugggggag

SEQ ID NO: 754098 - RNA, 64 nt, Homo Sapiens
cuggcgucuauaccaacaucaccccugugggagguccgacaaaccaucacauccuggggcucag

SEQ ID NO: 754099 - RNA, 64 nt, Homo Sapiens
ugaugguacuaauuaugguaggccuccaaguuccuccgacaagacaaacccugagcgggcugcc

SEQ ID NO: 754100 - RNA, 64 nt, Homo Sapiens
ggcaaauauuucaccauugcagccucaguuaaagugccucaaggccaccuguggcaaaugcugg

SEQ ID NO: 754101 - RNA, 64 nt, Homo Sapiens
cccuugugcacuguaacucagagguuauacaacuugccucaaauugaggaaaacgaggcaaaga

SEQ ID NO: 754102 - RNA, 64 nt, Homo Sapiens
acaugggagaaaaagucauccaguuuuucauguuugccucaaguaaucuuuacaguguuacaaa

SEQ ID NO: 754103 - RNA, 64 nt, Homo Sapiens
agaaguugcuuugcucagugcuuugccccaggauugccucaaaucugaguggacuucauccuuu

SEQ ID NO: 754104 - RNA, 64 nt, Homo Sapiens
uggaauaugagaggaugggaggcccuuuagaaccugccucaaugccaucucucacucuccuucu

SEQ ID NO: 754105 - RNA, 64 nt, Homo Sapiens
auugacccuuuuuugccuucucuuucuccuucacugccucaaguuacagccagaggaaaggagg

SEQ ID NO: 754106 - RNA, 64 nt, Homo Sapiens
cguagcagacaaggggugucugacuggcuucuuuugccucaagaugguguaugucguaagugau

SEQ ID NO: 754107 - RNA, 64 nt, Homo Sapiens
aauacaaauccuaugaucucuaugcccaauaugcugccucaacucugagcugucugcaaggcuu

SEQ ID NO: 754108 - RNA, 64 nt, Homo Sapiens
guggccggaugcuuccaacuuugucagucuuuucugccucaacuucuuccagacaucagucacc

SEQ ID NO: 754109 - RNA, 64 nt, Homo Sapiens
caagaaccuguauauguguuguguuagaggcaucugccucaagucuauguacaguguuugcugc

SEQ ID NO: 754110 - RNA, 64 nt, Homo Sapiens
aaaaaguuacaugcaccuucacaaugccuuguugugccucaauagccucaaguccaggcaaguu

SEQ ID NO: 754111 - RNA, 64 nt, Homo Sapiens
ccaggcaaguuacaaugccucuuacuaaacugacugccucaaguuuaacuguauuaacguucag

SEQ ID NO: 754112 - RNA, 64 nt, Homo Sapiens
cucaguuuauugaagacauuuuuuuuuuuuguucugccucaaagagagagguuuuagauuuuug

SEQ ID NO: 754113 - RNA, 64 nt, Homo Sapiens
auagcaccuuaaguuaaaggaucauagucaauggugccucaaaccugcucuccuaugaccccaa

SEQ ID NO: 754114 - RNA, 64 nt, Homo Sapiens
auuguuuaccuaaaacagaaguuuggauaauauuugccucaagggaaaucuauauaugagaaac

SEQ ID NO: 754115 - RNA, 64 nt, Homo Sapiens
aauguuuccaagguugugugugucagggauuuugugccucaaaacuuuccauguaccucuggug

SEQ ID NO: 754116 - RNA, 64 nt, Homo Sapiens; identical to SEQ ID NO: 687969

SEQ ID NO: 754117 - RNA, 64 nt, Homo Sapiens; identical to SEQ ID NO: 687970

SEQ ID NO: 754118 - RNA, 64 nt, Homo Sapiens; identical to SEQ ID NO: 687971

SEQ ID NO: 754119 - RNA, 64 nt, Homo Sapiens; identical to SEQ ID NO: 687972

SEQ ID NO: 754120 - RNA, 64 nt, Homo Sapiens; identical to SEQ ID NO: 687973

SEQ ID NO: 754121 - RNA, 64 nt, Homo Sapiens; identical to SEQ ID NO: 687974

SEQ ID NO: 754122 - RNA, 64 nt, Homo Sapiens; identical to SEQ ID NO: 266194

SEQ ID NO: 754123 - RNA, 64 nt, Homo Sapiens; identical to SEQ ID NO: 266195

SEQ ID NO: 754124 - RNA, 64 nt, Homo Sapiens; identical to SEQ ID NO: 266196

SEQ ID NO: 754125 - RNA, 64 nt, Homo Sapiens; identical to SEQ ID NO: 266197

SEQ ID NO: 754126 - RNA, 64 nt, Homo Sapiens; identical to SEQ ID NO: 266198

SEQ ID NO: 754127 - RNA, 64 nt, Homo Sapiens; identical to SEQ ID NO: 266199

SEQ ID NO: 754128 - RNA, 64 nt, Homo Sapiens; identical to SEQ ID NO: 266200

SEQ ID NO: 754129 - RNA, 64 nt, Homo Sapiens; identical to SEQ ID NO: 266201

SEQ ID NO: 754130 - RNA, 64 nt, Homo Sapiens; identical to SEQ ID NO: 266202

SEQ ID NO: 754131 - RNA, 64 nt, Homo Sapiens; identical to SEQ ID NO: 266203

SEQ ID NO: 754132 - RNA, 64 nt, Homo Sapiens; identical to SEQ ID NO: 266204

SEQ ID NO: 754133 - RNA, 64 nt, Homo Sapiens; identical to SEQ ID NO: 266205

SEQ ID NO: 754134 - RNA, 64 nt, Homo Sapiens; identical to SEQ ID NO: 266206

SEQ ID NO: 754135 - RNA, 64 nt, Homo Sapiens; identical to SEQ ID NO: 266207

SEQ ID NO: 754136 - RNA, 64 nt, Homo Sapiens; identical to SEQ ID NO: 266208

SEQ ID NO: 754137 - RNA, 64 nt, Homo Sapiens; identical to SEQ ID NO: 266209

SEQ ID NO: 754138 - RNA, 64 nt, Homo Sapiens; identical to SEQ ID NO: 266210

SEQ ID NO: 754139 - RNA, 64 nt, Homo Sapiens; identical to SEQ ID NO: 266211

SEQ ID NO: 754140 - RNA, 64 nt, Homo Sapiens; identical to SEQ ID NO: 266212

SEQ ID NO: 754141 - RNA, 64 nt, Homo Sapiens; identical to SEQ ID NO: 266213

SEQ ID NO: 754142 - RNA, 64 nt, Homo Sapiens; identical to SEQ ID NO: 266214

SEQ ID NO: 754143 - RNA, 64 nt, Homo Sapiens; identical to SEQ ID NO: 266215

SEQ ID NO: 754144 - RNA, 64 nt, Homo Sapiens; identical to SEQ ID NO: 266216

SEQ ID NO: 754145 - RNA, 64 nt, Homo Sapiens; identical to SEQ ID NO: 266217

SEQ ID NO: 754146 - RNA, 64 nt, Homo Sapiens; identical to SEQ ID NO: 266218

SEQ ID NO: 754147 - RNA, 64 nt, Homo Sapiens; identical to SEQ ID NO: 266219

SEQ ID NO: 754148 - RNA, 64 nt, Homo Sapiens; identical to SEQ ID NO: 266220

SEQ ID NO: 754149 - RNA, 64 nt, Homo Sapiens; identical to SEQ ID NO: 266221

SEQ ID NO: 754150 - RNA, 64 nt, Homo Sapiens; identical to SEQ ID NO: 266222

SEQ ID NO: 754151 - RNA, 64 nt, Homo Sapiens; identical to SEQ ID NO: 266223

SEQ ID NO: 754152 - RNA, 64 nt, Homo Sapiens; identical to SEQ ID NO: 266224

SEQ ID NO: 754153 - RNA, 64 nt, Homo Sapiens; identical to SEQ ID NO: 266225

SEQ ID NO: 754154 - RNA, 64 nt, Homo Sapiens; identical to SEQ ID NO: 266226

SEQ ID NO: 754155 - RNA, 64 nt, Homo Sapiens; identical to SEQ ID NO: 266227

SEQ ID NO: 754156 - RNA, 64 nt, Homo Sapiens; identical to SEQ ID NO: 266228

SEQ ID NO: 754157 - RNA, 64 nt, Homo Sapiens; identical to SEQ ID NO: 266229

SEQ ID NO: 754158 - RNA, 64 nt, Homo Sapiens; identical to SEQ ID NO: 266230

SEQ ID NO: 754159 - RNA, 64 nt, Homo Sapiens; identical to SEQ ID NO: 266231

SEQ ID NO: 754160 - RNA, 64 nt, Homo Sapiens; identical to SEQ ID NO: 266232

SEQ ID NO: 754161 - RNA, 64 nt, Homo Sapiens; identical to SEQ ID NO: 266233

SEQ ID NO: 754162 - RNA, 64 nt, Homo Sapiens; identical to SEQ ID NO: 266234

SEQ ID NO: 754163 - RNA, 64 nt, Homo Sapiens; identical to SEQ ID NO: 266235

SEQ ID NO: 754164 - RNA, 64 nt, Homo Sapiens; identical to SEQ ID NO: 266236

SEQ ID NO: 754165 - RNA, 64 nt, Homo Sapiens; identical to SEQ ID NO: 266237

SEQ ID NO: 754166 - RNA, 64 nt, Homo Sapiens; identical to SEQ ID NO: 266238

SEQ ID NO: 754167 - RNA, 64 nt, Homo Sapiens; identical to SEQ ID NO: 266239

SEQ ID NO: 754168 - RNA, 64 nt, Homo Sapiens; identical to SEQ ID NO: 266240

SEQ ID NO: 754169 - RNA, 64 nt, Homo Sapiens; identical to SEQ ID NO: 266241

SEQ ID NO: 754170 - RNA, 64 nt, Homo Sapiens; identical to SEQ ID NO: 266242

SEQ ID NO: 754171 - RNA, 64 nt, Homo Sapiens; identical to SEQ ID NO: 266243

SEQ ID NO: 754172 - RNA, 64 nt, Homo Sapiens; identical to SEQ ID NO: 266244

SEQ ID NO: 754173 - RNA, 64 nt, Homo Sapiens; identical to SEQ ID NO: 266245

SEQ ID NO: 754174 - RNA, 64 nt, Homo Sapiens; identical to SEQ ID NO: 266246

SEQ ID NO: 754175 - RNA, 64 nt, Homo Sapiens; identical to SEQ ID NO: 266247

SEQ ID NO: 754176 - RNA, 64 nt, Homo Sapiens; identical to SEQ ID NO: 266248

SEQ ID NO: 754177 - RNA, 64 nt, Homo Sapiens; identical to SEQ ID NO: 266249

SEQ ID NO: 754178 - RNA, 64 nt, Homo Sapiens; identical to SEQ ID NO: 266250

SEQ ID NO: 754179 - RNA, 64 nt, Homo Sapiens; identical to SEQ ID NO: 266251

SEQ ID NO: 754180 - RNA, 64 nt, Homo Sapiens; identical to SEQ ID NO: 266252

SEQ ID NO: 754181 - RNA, 64 nt, Homo Sapiens; identical to SEQ ID NO: 235460

SEQ ID NO: 754182 - RNA, 64 nt, Homo Sapiens; identical to SEQ ID NO: 235461

SEQ ID NO: 754183 - RNA, 64 nt, Homo Sapiens; identical to SEQ ID NO: 235462

SEQ ID NO: 754184 - RNA, 64 nt, Homo Sapiens; identical to SEQ ID NO: 235463

SEQ ID NO: 754185 - RNA, 64 nt, Homo Sapiens; identical to SEQ ID NO: 235464

SEQ ID NO: 754186 - RNA, 64 nt, Homo Sapiens; identical to SEQ ID NO: 235465

SEQ ID NO: 754187 - RNA, 64 nt, Homo Sapiens; identical to SEQ ID NO: 235466

SEQ ID NO: 754188 - RNA, 64 nt, Homo Sapiens; identical to SEQ ID NO: 235467

SEQ ID NO: 754189 - RNA, 64 nt, Homo Sapiens; identical to SEQ ID NO: 235468

SEQ ID NO: 754190 - RNA, 64 nt, Homo Sapiens; identical to SEQ ID NO: 235469

SEQ ID NO: 754191 - RNA, 64 nt, Homo Sapiens; identical to SEQ ID NO: 235470

SEQ ID NO: 754192 - RNA, 64 nt, Homo Sapiens; identical to SEQ ID NO: 235471

SEQ ID NO: 754193 - RNA, 64 nt, Homo Sapiens; identical to SEQ ID NO: 235472

SEQ ID NO: 754194 - RNA, 64 nt, Homo Sapiens; identical to SEQ ID NO: 235473

SEQ ID NO: 754195 - RNA, 64 nt, Homo Sapiens; identical to SEQ ID NO: 235474

SEQ ID NO: 754196 - RNA, 64 nt, Homo Sapiens; identical to SEQ ID NO: 235475

SEQ ID NO: 754197 - RNA, 64 nt, Homo Sapiens; identical to SEQ ID NO: 235476

SEQ ID NO: 754198 - RNA, 64 nt, Homo Sapiens; identical to SEQ ID NO: 235477

SEQ ID NO: 754199 - RNA, 64 nt, Homo Sapiens; identical to SEQ ID NO: 235478

SEQ ID NO: 754200 - RNA, 64 nt, Homo Sapiens; identical to SEQ ID NO: 235479

SEQ ID NO: 754201 - RNA, 64 nt, Homo Sapiens; identical to SEQ ID NO: 235480

SEQ ID NO: 754202 - RNA, 64 nt, Homo Sapiens; identical to SEQ ID NO: 235481

SEQ ID NO: 754203 - RNA, 64 nt, Homo Sapiens; identical to SEQ ID NO: 235482

SEQ ID NO: 754204 - RNA, 64 nt, Homo Sapiens; identical to SEQ ID NO: 235483

SEQ ID NO: 754205 - RNA, 64 nt, Homo Sapiens; identical to SEQ ID NO: 235484

SEQ ID NO: 754206 - RNA, 64 nt, Homo Sapiens; identical to SEQ ID NO: 235485

SEQ ID NO: 754207 - RNA, 64 nt, Homo Sapiens; identical to SEQ ID NO: 235486

SEQ ID NO: 754208 - RNA, 64 nt, Homo Sapiens; identical to SEQ ID NO: 235487

SEQ ID NO: 754209 - RNA, 64 nt, Homo Sapiens; identical to SEQ ID NO: 235488

SEQ ID NO: 754210 - RNA, 64 nt, Homo Sapiens; identical to SEQ ID NO: 235489

SEQ ID NO: 754211 - RNA, 64 nt, Homo Sapiens; identical to SEQ ID NO: 235490

SEQ ID NO: 754212 - RNA, 64 nt, Homo Sapiens; identical to SEQ ID NO: 235491

SEQ ID NO: 754213 - RNA, 64 nt, Homo Sapiens; identical to SEQ ID NO: 235492

SEQ ID NO: 754214 - RNA, 64 nt, Homo Sapiens; identical to SEQ ID NO: 235493

SEQ ID NO: 754215 - RNA, 64 nt, Homo Sapiens; identical to SEQ ID NO: 235494

SEQ ID NO: 754216 - RNA, 64 nt, Homo Sapiens; identical to SEQ ID NO: 235495

SEQ ID NO: 754217 - RNA, 64 nt, Homo Sapiens; identical to SEQ ID NO: 235496

SEQ ID NO: 754218 - RNA, 64 nt, Homo Sapiens; identical to SEQ ID NO: 235497

SEQ ID NO: 754219 - RNA, 64 nt, Homo Sapiens; identical to SEQ ID NO: 235498

SEQ ID NO: 754220 - RNA, 64 nt, Homo Sapiens; identical to SEQ ID NO: 235499

SEQ ID NO: 754221 - RNA, 64 nt, Homo Sapiens; identical to SEQ ID NO: 235500

SEQ ID NO: 754222 - RNA, 64 nt, Homo Sapiens; identical to SEQ ID NO: 235501

SEQ ID NO: 754223 - RNA, 64 nt, Homo Sapiens; identical to SEQ ID NO: 235502

SEQ ID NO: 754224 - RNA, 64 nt, Homo Sapiens; identical to SEQ ID NO: 235503

SEQ ID NO: 754225 - RNA, 64 nt, Homo Sapiens; identical to SEQ ID NO: 235504

SEQ ID NO: 754226 - RNA, 64 nt, Homo Sapiens; identical to SEQ ID NO: 235505

SEQ ID NO: 754227 - RNA, 64 nt, Homo Sapiens; identical to SEQ ID NO: 235506

SEQ ID NO: 754228 - RNA, 64 nt, Homo Sapiens; identical to SEQ ID NO: 235507

SEQ ID NO: 754229 - RNA, 64 nt, Homo Sapiens; identical to SEQ ID NO: 235508

SEQ ID NO: 754230 - RNA, 64 nt, Homo Sapiens; identical to SEQ ID NO: 235509

SEQ ID NO: 754231 - RNA, 64 nt, Homo Sapiens; identical to SEQ ID NO: 235510

SEQ ID NO: 754232 - RNA, 64 nt, Homo Sapiens; identical to SEQ ID NO: 235511

SEQ ID NO: 754233 - RNA, 64 nt, Homo Sapiens; identical to SEQ ID NO: 235512

SEQ ID NO: 754234 - RNA, 64 nt, Homo Sapiens; identical to SEQ ID NO: 235513

SEQ ID NO: 754235 - RNA, 64 nt, Homo Sapiens; identical to SEQ ID NO: 235514

SEQ ID NO: 754236 - RNA, 64 nt, Homo Sapiens; identical to SEQ ID NO: 235515

SEQ ID NO: 754237 - RNA, 64 nt, Homo Sapiens; identical to SEQ ID NO: 235516

SEQ ID NO: 754238 - RNA, 64 nt, Homo Sapiens; identical to SEQ ID NO: 235517

SEQ ID NO: 754239 - RNA, 64 nt, Homo Sapiens; identical to SEQ ID NO: 235518

SEQ ID NO: 754240 - RNA, 64 nt, Homo Sapiens; identical to SEQ ID NO: 235519

SEQ ID NO: 754241 - RNA, 64 nt, Homo Sapiens; identical to SEQ ID NO: 235520

SEQ ID NO: 754242 - RNA, 64 nt, Homo Sapiens; identical to SEQ ID NO: 235521

SEQ ID NO: 754243 - RNA, 64 nt, Homo Sapiens; identical to SEQ ID NO: 235522

SEQ ID NO: 754244 - RNA, 64 nt, Homo Sapiens; identical to SEQ ID NO: 235523

SEQ ID NO: 754245 - RNA, 64 nt, Homo Sapiens; identical to SEQ ID NO: 235524

SEQ ID NO: 754246 - RNA, 64 nt, Homo Sapiens; identical to SEQ ID NO: 235525

SEQ ID NO: 754247 - RNA, 64 nt, Homo Sapiens; identical to SEQ ID NO: 235526

SEQ ID NO: 754248 - RNA, 64 nt, Homo Sapiens; identical to SEQ ID NO: 235527

SEQ ID NO: 754249 - RNA, 64 nt, Homo Sapiens; identical to SEQ ID NO: 235528

SEQ ID NO: 754250 - RNA, 64 nt, Homo Sapiens; identical to SEQ ID NO: 235529

SEQ ID NO: 754251 - RNA, 64 nt, Homo Sapiens; identical to SEQ ID NO: 235530

SEQ ID NO: 754252 - RNA, 64 nt, Homo Sapiens; identical to SEQ ID NO: 235531

SEQ ID NO: 754253 - RNA, 64 nt, Homo Sapiens; identical to SEQ ID NO: 235532

SEQ ID NO: 754254 - RNA, 64 nt, Homo Sapiens; identical to SEQ ID NO: 235533

SEQ ID NO: 754255 - RNA, 64 nt, Homo Sapiens; identical to SEQ ID NO: 235534

SEQ ID NO: 754256 - RNA, 64 nt, Homo Sapiens; identical to SEQ ID NO: 235535

SEQ ID NO: 754257 - RNA, 64 nt, Homo Sapiens; identical to SEQ ID NO: 235536

SEQ ID NO: 754258 - RNA, 64 nt, Homo Sapiens; identical to SEQ ID NO: 235537

SEQ ID NO: 754259 - RNA, 64 nt, Homo Sapiens; identical to SEQ ID NO: 235538

SEQ ID NO: 754260 - RNA, 64 nt, Homo Sapiens; identical to SEQ ID NO: 235539

SEQ ID NO: 754261 - RNA, 64 nt, Homo Sapiens; identical to SEQ ID NO: 235540

SEQ ID NO: 754262 - RNA, 64 nt, Homo Sapiens; identical to SEQ ID NO: 235541

SEQ ID NO: 754263 - RNA, 64 nt, Homo Sapiens; identical to SEQ ID NO: 235542

SEQ ID NO: 754264 - RNA, 64 nt, Homo Sapiens; identical to SEQ ID NO: 235543

SEQ ID NO: 754265 - RNA, 64 nt, Homo Sapiens; identical to SEQ ID NO: 235544

SEQ ID NO: 754266 - RNA, 64 nt, Homo Sapiens; identical to SEQ ID NO: 235545

SEQ ID NO: 754267 - RNA, 64 nt, Homo Sapiens; identical to SEQ ID NO: 235546

SEQ ID NO: 754268 - RNA, 64 nt, Homo Sapiens; identical to SEQ ID NO: 235547

SEQ ID NO: 754269 - RNA, 64 nt, Homo Sapiens; identical to SEQ ID NO: 235548

SEQ ID NO: 754270 - RNA, 64 nt, Homo Sapiens; identical to SEQ ID NO: 235549

SEQ ID NO: 754271 - RNA, 64 nt, Homo Sapiens; identical to SEQ ID NO: 235550

SEQ ID NO: 754272 - RNA, 64 nt, Homo Sapiens; identical to SEQ ID NO: 235551

SEQ ID NO: 754273 - RNA, 64 nt, Homo Sapiens; identical to SEQ ID NO: 235552

SEQ ID NO: 754274 - RNA, 64 nt, Homo Sapiens; identical to SEQ ID NO: 235553

SEQ ID NO: 754275 - RNA, 64 nt, Homo Sapiens; identical to SEQ ID NO: 235554

SEQ ID NO: 754276 - RNA, 64 nt, Homo Sapiens; identical to SEQ ID NO: 235555

SEQ ID NO: 754277 - RNA, 64 nt, Homo Sapiens; identical to SEQ ID NO: 235556

SEQ ID NO: 754278 - RNA, 64 nt, Homo Sapiens; identical to SEQ ID NO: 235557

SEQ ID NO: 754279 - RNA, 64 nt, Homo Sapiens; identical to SEQ ID NO: 235558

SEQ ID NO: 754280 - RNA, 64 nt, Homo Sapiens; identical to SEQ ID NO: 235559

SEQ ID NO: 754281 - RNA, 64 nt, Homo Sapiens; identical to SEQ ID NO: 235560

SEQ ID NO: 754282 - RNA, 64 nt, Homo Sapiens; identical to SEQ ID NO: 235561

SEQ ID NO: 754283 - RNA, 64 nt, Homo Sapiens; identical to SEQ ID NO: 235562

SEQ ID NO: 754284 - RNA, 64 nt, Homo Sapiens; identical to SEQ ID NO: 235563

SEQ ID NO: 754285 - RNA, 64 nt, Homo Sapiens; identical to SEQ ID NO: 235564

SEQ ID NO: 754286 - RNA, 64 nt, Homo Sapiens; identical to SEQ ID NO: 235565

SEQ ID NO: 754287 - RNA, 64 nt, Homo Sapiens; identical to SEQ ID NO: 235566

SEQ ID NO: 754288 - RNA, 64 nt, Homo Sapiens; identical to SEQ ID NO: 235567

SEQ ID NO: 754289 - RNA, 64 nt, Homo Sapiens; identical to SEQ ID NO: 235568

SEQ ID NO: 754290 - RNA, 64 nt, Homo Sapiens; identical to SEQ ID NO: 235569

SEQ ID NO: 754291 - RNA, 64 nt, Homo Sapiens; identical to SEQ ID NO: 235570

SEQ ID NO: 754292 - RNA, 64 nt, Homo Sapiens; identical to SEQ ID NO: 235571

SEQ ID NO: 754293 - RNA, 64 nt, Homo Sapiens; identical to SEQ ID NO: 235572

SEQ ID NO: 754294 - RNA, 64 nt, Homo Sapiens; identical to SEQ ID NO: 235573

SEQ ID NO: 754295 - RNA, 64 nt, Homo Sapiens; identical to SEQ ID NO: 235574

SEQ ID NO: 754296 - RNA, 64 nt, Homo Sapiens; identical to SEQ ID NO: 235575

SEQ ID NO: 754297 - RNA, 64 nt, Homo Sapiens; identical to SEQ ID NO: 235576

SEQ ID NO: 754298 - RNA, 64 nt, Homo Sapiens; identical to SEQ ID NO: 235577

SEQ ID NO: 754299 - RNA, 64 nt, Homo Sapiens; identical to SEQ ID NO: 235578

SEQ ID NO: 754300 - RNA, 64 nt, Homo Sapiens; identical to SEQ ID NO: 235579

SEQ ID NO: 754301 - RNA, 64 nt, Homo Sapiens; identical to SEQ ID NO: 235580

SEQ ID NO: 754302 - RNA, 64 nt, Homo Sapiens; identical to SEQ ID NO: 235581

SEQ ID NO: 754303 - RNA, 64 nt, Homo Sapiens; identical to SEQ ID NO: 235582

SEQ ID NO: 754304 - RNA, 64 nt, Homo Sapiens; identical to SEQ ID NO: 235583

SEQ ID NO: 754305 - RNA, 64 nt, Homo Sapiens; identical to SEQ ID NO: 235584

SEQ ID NO: 754306 - RNA, 64 nt, Homo Sapiens; identical to SEQ ID NO: 235585

SEQ ID NO: 754307 - RNA, 64 nt, Homo Sapiens; identical to SEQ ID NO: 235586

SEQ ID NO: 754308 - RNA, 64 nt, Homo Sapiens; identical to SEQ ID NO: 235587

SEQ ID NO: 754309 - RNA, 64 nt, Homo Sapiens; identical to SEQ ID NO: 235588

SEQ ID NO: 754310 - RNA, 64 nt, Homo Sapiens; identical to SEQ ID NO: 235589

SEQ ID NO: 754311 - RNA, 64 nt, Homo Sapiens; identical to SEQ ID NO: 235590

SEQ ID NO: 754312 - RNA, 64 nt, Homo Sapiens; identical to SEQ ID NO: 235591

SEQ ID NO: 754313 - RNA, 54 nt, Homo Sapiens; identical to SEQ ID NO: 235592

SEQ ID NO: 754314 - RNA, 64 nt, Homo Sapiens; identical to SEQ ID NO: 235593

SEQ ID NO: 754315 - RNA, 64 nt, Homo Sapiens; identical to SEQ ID NO: 235594

SEQ ID NO: 754316 - RNA, 64 nt, Homo Sapiens; identical to SEQ ID NO: 235595

SEQ ID NO: 754317 - RNA, 64 nt, Homo Sapiens; identical to SEQ ID NO: 235596

SEQ ID NO: 754318 - RNA, 64 nt, Homo Sapiens; identical to SEQ ID NO: 235597

SEQ ID NO: 754319 - RNA, 64 nt, Homo Sapiens; identical to SEQ ID NO: 235598

SEQ ID NO: 754320 - RNA, 64 nt, Homo Sapiens; identical to SEQ ID NO: 235599

SEQ ID NO: 754321 - RNA, 64 nt, Homo Sapiens; identical to SEQ ID NO: 235600

SEQ ID NO: 754322 - RNA, 64 nt, Homo Sapiens; identical to SEQ ID NO: 235601

SEQ ID NO: 754323 - RNA, 64 nt, Homo Sapiens; identical to SEQ ID NO: 235602

SEQ ID NO: 754324 - RNA, 64 nt, Homo Sapiens; identical to SEQ ID NO: 235603

SEQ ID NO: 754325 - RNA, 64 nt, Homo Sapiens; identical to SEQ ID NO: 235604

SEQ ID NO: 754326 - RNA, 64 nt, Homo Sapiens; identical to SEQ ID NO: 235605

SEQ ID NO: 754327 - RNA, 64 nt, Homo Sapiens; identical to SEQ ID NO: 235606

SEQ ID NO: 754328 - RNA, 64 nt, Homo Sapiens; identical to SEQ ID NO: 235607

SEQ ID NO: 754329 - RNA, 64 nt, Homo Sapiens; identical to SEQ ID NO: 235608

SEQ ID NO: 754330 - RNA, 64 nt, Homo Sapiens; identical to SEQ ID NO: 235609

SEQ ID NO: 754331 - RNA, 64 nt, Homo Sapiens; identical to SEQ ID NO: 235610

SEQ ID NO: 754332 - RNA, 64 nt, Homo Sapiens; identical to SEQ ID NO: 235611

SEQ ID NO: 754333 - RNA, 64 nt, Homo Sapiens; identical to SEQ ID NO: 235612

SEQ ID NO: 754334 - RNA, 64 nt, Homo Sapiens; identical to SEQ ID NO: 235613

SEQ ID NO: 754335 - RNA, 64 nt, Homo Sapiens; identical to SEQ ID NO: 235614

SEQ ID NO: 754336 - RNA, 64 nt, Homo Sapiens; identical to SEQ ID NO: 235615

SEQ ID NO: 754337 - RNA, 64 nt, Homo Sapiens; identical to SEQ ID NO: 235616

SEQ ID NO: 754338 - RNA, 63 nt, Homo Sapiens
agugguuaauagaguuuacagugagcuugccuuaggauggaccagcaagcccccguggacccu

SEQ ID NO: 754339 - RNA, 63 nt, Homo Sapiens
ucuguguagauagagauggugucaaggaggugcaggauggagaugggagauuucauggagccu

SEQ ID NO: 754340 - RNA, 63 nt, Homo Sapiens
cccccugcguguguauauuggugggaggcauagaggauggauguucuagaaaugaguaagaca

SEQ ID NO: 754341 - RNA, 63 nt, Homo Sapiens
cggucacaugccagguccccagcuacgcauucaaggauggauaauauacauagcagcacaucc

SEQ ID NO: 754342 - RNA, 63 nt, Homo Sapiens
cagauucugcuuugaauauagcuacagaaauaaaggauggacuacagugugggacagguaauu

SEQ ID NO: 754343 - RNA, 63 nt, Homo Sapiens
aagacucuguuucgaauauagccacagaaauaaaggauggagaaaaaucugggacagguaauu

SEQ ID NO: 754344 - RNA, 63 nt, Homo Sapiens
aagauucuguuucgaacauagccacagaaauaaaggauggagaaaaaucugggacagguaauu

SEQ ID NO: 754345 - RNA, 63 nt, Homo Sapiens
aagguucuguuuugaguauagccagagaaaacaaggauggagaaaaaucuaggacagguaauu

SEQ ID NO: 754346 - RNA, 63 nt, Homo Sapiens
aggauucuuuuucgaauauaaccagaggaaaaaaggauggagaaauaucuaggaaagguaauu

SEQ ID NO: 754347 - RNA, 63 nt, Homo Sapiens
aggauucuuuuucgaauauaaccagagaaaaaaaggauggagaaauaucuaggaaagguaauu

SEQ ID NO: 754348 - RNA, 63 nt, Homo Sapiens
aagauucuguuuuggguauagccagagaaaacaaggauggagaaaaaucuaggacagguaauu

SEQ ID NO: 754349 - RNA, 63 nt, Homo Sapiens
aagggagacagcuugcagauaaggguuucaccaaggauggagauccacguugccuucugcgca

SEQ ID NO: 754350 - RNA, 63 nt, Homo Sapiens
gaaguaucagcacccagaagcaccaagaacaugaggauggagaaaacacaaaacauaauaaaa

SEQ ID NO: 754351 - RNA, 63 nt, Homo Sapiens
gaaagcugggacaagcagggcucccugggguggaggauggaaguucuggccagucccugcauc

SEQ ID NO: 754352 - RNA, 63 nt, Homo Sapiens
ggucagggggagaaaggaaaauugggguuucccaggauggauuauguggcaaucaaugacacu

SEQ ID NO: 754353 - RNA, 63 nt, Homo Sapiens
uacuuugcugcccuugccauaaauuguaggagcaggauggaaacacuaaaaaagaagguuucu

SEQ ID NO: 754354 - RNA, 63 nt, Homo Sapiens
ccaccgcugcccugccauccguuccuguggcccaggauggagguauagacaaggcugagcagg

SEQ ID NO: 754355 - RNA, 63 nt, Homo Sapiens
uguggcucuucucaucuuugauaggauggagauaggauggagauuggggagagaaggauggag

SEQ ID NO: 754356 - RNA, 63 nt, Homo Sapiens
uaggauggagauguggcucugaaggauggagauaggauggagaaccacacgcuguuggggaga

SEQ ID NO: 754357 - RNA, 63 nt, Homo Sapiens
uaggauggagauaggauggauguuggggagagaaggauggagaugaaacagacaaccacacgc

SEQ ID NO: 754358 - RNA, 63 nt, Homo Sapiens
aaaacagacugugggaaggaaggugaggauggaaggauggagaagaaaguuaucaagagaaag

SEQ ID NO: 754359 - RNA, 63 nt, Homo Sapiens
gauggagaaaaacagacuguagagaaagaggugaggauggaaguugggaagagaaaguuauca

SEQ ID NO: 754360 - RNA, 63 nt, Homo Sapiens
cauggucaguugugagcauuuugguuuccgcaaaggauggauggugagcaucaugggaaagcu

SEQ ID NO: 754361 - RNA, 63 nt, Homo Sapiens
uauuggcccagcaaggcaaagaacugaaguuccaggauggaagaaccuguguucuccucauaa

SEQ ID NO: 754362 - RNA, 63 nt, Homo Sapiens
cuuuuagaugacauucuacagggggaccauaaaaggauggaaaucgaguuuuucaaauuguga

SEQ ID NO: 754363 - RNA, 63 nt, Homo Sapiens
uuucuagagguugggccuuaugaauaagaaaguaggauggagcuaauguauuguaucaaauug

SEQ ID NO: 754364 - RNA, 63 nt, Homo Sapiens
ccuauuugcuuaaaaguacaggcucccuaagagaggauggagagggagagacugaauuguuag

SEQ ID NO: 754365 - RNA, 63 nt, Homo Sapiens
cauauuccaaaacccuucuuuuuaaaaggaaaaaggauggagagaaggauggaaagccuggac

SEQ ID NO: 754366 - RNA, 63 nt, Homo Sapiens
cccuucuuuuuaaaaggaaaaaggauggagagaaggauggaaagccuggacuuaaaccuuuag

SEQ ID NO: 754367 - RNA, 63 nt, Homo Sapiens
cgggcgcuguccuugccgggacaguauuaggugaggauggauguccuuagcccgucacuccau

SEQ ID NO: 754368 - RNA, 63 nt, Homo Sapiens
ugugugcacaagaacuguggaggcaggggugagaggauggaauguuccugggccuggcggggg

SEQ ID NO: 754369 - RNA, 63 nt, Homo Sapiens
ucacuauggcaugcuucccuccuggugggcccuaggauggaugacacucaagauacuacagau

SEQ ID NO: 754370 - RNA, 63 nt, Homo Sapiens
aucucuacuuggaucaauucuggucauuucaagaggauggaggccucaagugugggaacuucc

SEQ ID NO: 754371 - RNA, 63 nt, Homo Sapiens
cuuuguacugcucucugggagccucccugcuugaggauggaaggaugaaauuugacgaauaua

SEQ ID NO: 754372 - RNA, 63 nt, Homo Sapiens
aaagccggggaccaucuguauugcuuuguuuuuaggauggagaaugucagaucaaguuagaaa

SEQ ID NO: 754373 - RNA, 63 nt, Homo Sapiens
augagaaggcccgucugcagcaccaggucacugaggauggagaguucuggugaguccagaacc

SEQ ID NO: 754374 - RNA, 63 nt, Homo Sapiens
auucuuucacaggagcuuuucaugcauuugacaaggauggagaugguaucaucaagcucaacg

SEQ ID NO: 754375 - RNA, 63 nt, Homo Sapiens
auggagagcucugauuccuacauaauaugaauaaggauggauaggccgggcgugguggcucau

SEQ ID NO: 754376 - RNA, 63 nt, Homo Sapiens
aacagagcgagaccccgacucaauaaauaaauaaggauggauaaauuguagcguaugcaccau

SEQ ID NO: 754377 - RNA, 63 nt, Homo Sapiens
ggggacacuugcuuaggggcuccaguguuggacaggauggaggguuucuguugacccccaccu

SEQ ID NO: 754378 - RNA, 63 nt, Homo Sapiens
ucagggacggacccagccugcccagguugcaacaggauggaauacagaaccaacauugugacg

SEQ ID NO: 754379 - RNA, 64 nt, Homo Sapiens; identical to SEQ ID NO: 168029

SEQ ID NO: 754380 - RNA, 64 nt, Homo Sapiens; identical to SEQ ID NO: 168030

SEQ ID NO: 754381 - RNA, 64 nt, Homo Sapiens; identical to SEQ ID NO: 168031

SEQ ID NO: 754382 - RNA, 64 nt, Homo Sapiens; identical to SEQ ID NO: 168032

SEQ ID NO: 754383 - RNA, 64 nt, Homo Sapiens; identical to SEQ ID NO: 168033

SEQ ID NO: 754384 - RNA, 64 nt, Homo Sapiens; identical to SEQ ID NO: 168034

SEQ ID NO: 754385 - RNA, 64 nt, Homo Sapiens; identical to SEQ ID NO: 168035

SEQ ID NO: 754386 - RNA, 64 nt, Homo Sapiens; identical to SEQ ID NO: 168036

SEQ ID NO: 754387 - RNA, 64 nt, Homo Sapiens; identical to SEQ ID NO: 168037

SEQ ID NO: 754388 - RNA, 64 nt, Homo Sapiens; identical to SEQ ID NO: 168038

SEQ ID NO: 754389 - RNA, 64 nt, Homo Sapiens; identical to SEQ ID NO: 168039

SEQ ID NO: 754390 - RNA, 64 nt, Homo Sapiens; identical to SEQ ID NO: 168040

SEQ ID NO: 754391 - RNA, 64 nt, Homo Sapiens; identical to SEQ ID NO: 168041

SEQ ID NO: 754392 - RNA, 64 nt, Homo Sapiens; identical to SEQ ID NO: 168042

SEQ ID NO: 754393 - RNA, 64 nt, Homo Sapiens; identical to SEQ ID NO: 168043

SEQ ID NO: 754394 - RNA, 64 nt, Homo Sapiens; identical to SEQ ID NO: 168044

SEQ ID NO: 754395 - RNA, 64 nt, Homo Sapiens; identical to SEQ ID NO: 168045

SEQ ID NO: 754396 - RNA, 64 nt, Homo Sapiens; identical to SEQ ID NO: 168046

SEQ ID NO: 754397 - RNA, 64 nt, Homo Sapiens; identical to SEQ ID NO: 168047

SEQ ID NO: 754398 - RNA, 64 nt, Homo Sapiens; identical to SEQ ID NO: 168048

SEQ ID NO: 754399 - RNA, 64 nt, Homo Sapiens; identical to SEQ ID NO: 168049

SEQ ID NO: 754400 - RNA, 64 nt, Homo Sapiens; identical to SEQ ID NO: 168050

SEQ ID NO: 754401 - RNA, 64 nt, Homo Sapiens; identical to SEQ ID NO: 168051

SEQ ID NO: 754402 - RNA, 64 nt, Homo Sapiens; identical to SEQ ID NO: 168052

SEQ ID NO: 754403 - RNA, 64 nt, Homo Sapiens; identical to SEQ ID NO: 168053

SEQ ID NO: 754404 - RNA, 64 nt, Homo Sapiens; identical to SEQ ID NO: 168054

SEQ ID NO: 754405 - RNA, 64 nt, Homo Sapiens; identical to SEQ ID NO: 168055

SEQ ID NO: 754406 - RNA, 64 nt, Homo Sapiens; identical to SEQ ID NO: 168056

SEQ ID NO: 754407 - RNA, 64 nt, Homo Sapiens; identical to SEQ ID NO: 168057

SEQ ID NO: 754408 - RNA, 64 nt, Homo Sapiens; identical to SEQ ID NO: 168058

SEQ ID NO: 754409 - RNA, 64 nt, Homo Sapiens; identical to SEQ ID NO: 168059

SEQ ID NO: 754410 - RNA, 64 nt, Homo Sapiens; identical to SEQ ID NO: 168060

SEQ ID NO: 754411 - RNA, 64 nt, Homo Sapiens; identical to SEQ ID NO: 168061

SEQ ID NO: 754412 - RNA, 64 nt, Homo Sapiens; identical to SEQ ID NO: 168062

SEQ ID NO: 754413 - RNA, 64 nt, Homo Sapiens; identical to SEQ ID NO: 168063

SEQ ID NO: 754414 - RNA, 64 nt, Homo Sapiens; identical to SEQ ID NO: 168064

SEQ ID NO: 754415 - RNA, 64 nt, Homo Sapiens; identical to SEQ ID NO: 168065

SEQ ID NO: 754416 - RNA, 64 nt, Homo Sapiens; identical to SEQ ID NO: 168066

SEQ ID NO: 754417 - RNA, 64 nt, Homo Sapiens
cauuccuuugaauacgcuaauaagugacaaauaagauuaauaagauuuuucaaaaucgccagga

SEQ ID NO: 754418 - RNA, 64 nt, Homo Sapiens
uacauuugguuauguugauaaaccaaaaacauuugauuaauaaaauaucuauuugaauaaauua

SEQ ID NO: 754419 - RNA, 64 nt, Homo Sapiens
cccaauuuauauuuuaaaaagcuaaagaacacuggauuaauaaucuuuugggaggguagaauaa

SEQ ID NO: 754420 - RNA, 64 nt, Homo Sapiens
auacuggaccaucauuaaauguguacugugaagagauuaauauguaugaagggcuuuaccaaag

SEQ ID NO: 754421 - RNA, 64 nt, Homo Sapiens
uccgcccacccugacagagaacaagcuggagaagaacgaggaggcggcccugcuauccugggag

SEQ ID NO: 754422 - RNA, 64 nt, Homo Sapiens
cacgcuguaccccauggucacgcgguggaggcggaacgaggauggagccaucugcaggaagagc

SEQ ID NO: 754423 - RNA, 62 nt, Homo Sapiens
ccuggaccuggaguaggagacuuccaggagagcgggaugaaccuuucugggguccugagugg

SEQ ID NO: 754424 - RNA, 62 nt, Homo Sapiens
uuuuuuucccacuaagcaaggggcccugaccucgggaugagauaacaaauuguaauaaagua

SEQ ID NO: 754425 - RNA, 62 nt, Homo Sapiens
acacauauuagcucauucaguccccagacagacgggaugaaguagguauuguuacuguuccc

SEQ ID NO: 754426 - RNA, 62 nt, Homo Sapiens
gccuggguguugggguucugaucagaauuuggcgggaugauauguuugccauuuucucacug

SEQ ID NO: 754427 - RNA, 62 nt, Homo Sapiens
gggugaaagaggaguagcucaaacuggccagucgggaugacuugucagggggauuggguuga

SEQ ID NO: 754428 - RNA, 62 nt, Homo Sapiens
ggagccuuaaagaguuaggacacacacacacacgggaugaauuauacacacacacagacaca

SEQ ID NO: 754429 - RNA, 62 nt, Homo Sapiens
aggagaguucaagugaugagcagacgccuagucgggaugaugauagccaguccaggagucca

SEQ ID NO: 754430 - RNA, 62 nt, Homo Sapiens
ucuuguaccaggcaggggugccucacugugagcgggaugacuguucacugccacuguccugu

SEQ ID NO: 754431 - RNA, 62 nt, Homo Sapiens
agccauaucuagucaauaacguuccuguuccucgggaugaaacccccagcgcuuagaaacau

SEQ ID NO: 754432 - RNA, 62 nt, Homo Sapiens
ucauuucagguugggcauacacugugaugauacgggaugacaucguacugaaaaagcaacau

SEQ ID NO: 754433 - RNA, 62 nt, Homo Sapiens
agacaugaaaaaccacacuggugcuuggacaacgggaugaaagucuguauccagacaucuau

SEQ ID NO: 754434 - RNA, 62 nt, Homo Sapiens
cccugaugcccggaagcuccugcgugcauccccgggaugaccagacucccggacuccucagg

SEQ ID NO: 754435 - RNA, 62 nt, Homo Sapiens
uugaggagcucaaugccgccgcccagcagcugcgggaugagagugcgggcuugcaggaggag

SEQ ID NO: 754436 - RNA, 62 nt, Homo Sapiens
gcuugagcucaggaguuugagggaggccaagacgggaugauugccuguaaucccagaacuuu

SEQ ID NO: 754437 - RNA, 62 nt, Homo Sapiens
ucagaggccccaccugauuuugaagcggccuccgggaugaggagagacauccauucgagaac

SEQ ID NO: 754438 - RNA, 62 nt, Homo Sapiens
cccacagacagguugucaucgccagucuugaccgggaugaggcugcuggagcagcaccaaga

SEQ ID NO: 754439 - RNA, 62 nt, Homo Sapiens
ucgguuggugagugcagggagagugcccguagcgggaugaucuuucagacaaugaaaccuuu

SEQ ID NO: 754440 - RNA, 62 nt, Homo Sapiens
aagaguguggcaaagaacacccgugcuggggucgggaugagguugaagggucuuggucaaug

SEQ ID NO: 754441 - RNA, 62 nt, Homo Sapiens
uguuacagcugccucccucuccuggagaucaacgggaugaggggaaacaaguaucugaguuc

SEQ ID NO: 754442 - RNA, 62 nt, Homo Sapiens
ucaggacucugucgguuucccccccuuccucccgggaugacccugcugcuucuggaaguagu

SEQ ID NO: 754443 - RNA, 62 nt, Homo Sapiens
ccaugcgccgggcccagagcucccucugccugcgggaugagaccuuggcaggcgggcagcgg

SEQ ID NO: 754444 - RNA, 62 nt, Homo Sapiens
caccacggcguuguaccuguaggacucucauucgggaugauuggaauagcuucuggaauuug

SEQ ID NO: 754445 - RNA, 62 nt, Homo Sapiens
ccuucuacaaccacgagcagaugggccuucuccgggaugaggcccuggcagaggugaaggac

SEQ ID NO: 754446 - RNA, 62 nt, Homo Sapiens
ugccccagcauuuccaacuggagcuggcucagcgggaugaggaugaaaaugucaacaucuau

SEQ ID NO: 754447 - RNA, 62 nt, Homo Sapiens
cugugccggagucccugggggaggugcuggcgcgggaugaggacgggccacccuggcaccgg

SEQ ID NO: 754448 - RNA, 62 nt, Homo Sapiens
ccaccaccacaaagcaaauuuauggguaguaccgggaugaacgucucauuuacugauucguu

SEQ ID NO: 754449 - RNA, 62 nt, Homo Sapiens
accugaggucaggaguucaagagaggcugaggcgggaugaucgccuguaaucccagcacugu

SEQ ID NO: 754450 - RNA, 62 nt, Homo Sapiens
agcucgucuucggucgugugcacaaugguucacgggaugaccaucagugggacuccaacaag

SEQ ID NO: 754451 - RNA, 62 nt, Homo Sapiens
aauccauagaauauauucuuguucauauuuaucgggaugacaugcuuuuuuuuguuaauuuu

SEQ ID NO: 754452 - RNA, 62 nt, Homo Sapiens
ccccagugcggccggugcucucccgggugggccgggaugaugagcccucccacggcccaucg

SEQ ID NO: 754453 - RNA, 62 nt, Homo Sapiens
accaagucacuuccccugcucgugcagaggcacgggaugagucugggugaccucugcgccau

SEQ ID NO: 754454 - RNA, 62 nt, Homo Sapiens
gccacagcccagagaaccagccuaggaacacucgggaugacaccccuuaucacaccaaggac

SEQ ID NO: 754455 - RNA, 62 nt, Homo Sapiens
ugcuuugugacuuggaaagggcuccuugagggcgggaugaacggcucugggcugcccugucg

SEQ ID NO: 754456 - RNA, 62 nt, Homo Sapiens
agaccaugccgggcgcgcaccacuggccccggcgggaugagggggcaaagcccccagagccu

SEQ ID NO: 754457 - RNA, 62 nt, Homo Sapiens
auggcgguucugcccaguggugucucugagcgcgggaugacaggagcaaccgaagcacccug

SEQ ID NO: 754458 - RNA, 62 nt, Homo Sapiens
uccaguggacucuggggcgcggccacaggggacgggaugaggagcgggaggguuccgccacu

SEQ ID NO: 754459 - RNA, 62 nt, Homo Sapiens
uaccccauuuguggucacagccaugaagucaccgggaugaaccuauccuuccaguggcucgc

SEQ ID NO: 754460 - RNA, 62 nt, Homo Sapiens
ggaagcaggaagcggggcagggggucaagacacgggaugacgcucagagaaacagcaagggc

SEQ ID NO: 754461 - RNA, 62 nt, Homo Sapiens
uuguaggagaucugucuccccucguuaagcuccgggaugaccgugcuuuuuagcagagacac

SEQ ID NO: 754462 - RNA, 62 nt, Homo Sapiens
cuuucgcccgccugguggagcuguucuguagccgggaugacagcucucgcccaagccgagca

SEQ ID NO: 754463 - RNA, 62 nt, Homo Sapiens
uggcggccagagaacgcccaagcccagagcagcgggaugagccccguccaccuggccgaggc

SEQ ID NO: 754464 - RNA, 62 nt, Homo Sapiens
caagagugugaauaaguccucacucaagagaacgggaugauauaaguuacuaggauagucca

SEQ ID NO: 754465 - RNA, 62 nt, Homo Sapiens
auccaaugggcauugugugggugcuuggaacccgggaugacugagggggacacuggaguggg

SEQ ID NO: 754466 - RNA, 62 nt, Homo Sapiens
acacccagcuggccauauccaccccucgacgccgggaugagccggcucugccugugucacag

SEQ ID NO: 754467 - RNA, 62 nt, Homo Sapiens
ugauucaccuccagcccagggacaguccccuccgggaugaccauucagugcuuccauugggg

SEQ ID NO: 754468 - RNA, 62 nt, Homo Sapiens
aaucaaauucugucuggggacgaaggguuggacgggaugaccuccagaagucccuucaauuu

SEQ ID NO: 754469 - RNA, 64 nt, Homo Sapiens
ucucugcagaggcaaagucuacuuucugguaccucaaagaaaucauuguucaaucuuccauaag

SEQ ID NO: 754470 - RNA, 64 nt, Homo Sapiens
uaacaugguauucuuuaagaagaaaaaacaaagccaaagaaaacucauuaucuggcauguucgc

SEQ ID NO: 754471 - RNA, 64 nt, Homo Sapiens
gauuguaugaaguuuuaaaaaaaacuacagcagccaaagaaacuauauauauauauauauauau

SEQ ID NO: 754472 - RNA, 64 nt, Homo Sapiens
ugggaauaucauagaguaacaagugcuggucagccaaagaaacauucacugcuggugaaccaau

SEQ ID NO: 754473 - RNA, 64 nt, Homo Sapiens
ccuucaucaagcaguccagaaguauugcucacuucaaagaaacuugaauucauucauauuugcc

SEQ ID NO: 754474 - RNA, 64 nt, Homo Sapiens
uaagacaagacuaugauaucaauccugccuaaggcaaagaaauacacaaucagaaucacagaaa

SEQ ID NO: 754475 - RNA, 64 nt, Homo Sapiens
gugaccuguacaagugaugcagaaaggaggguuucaaagaaaaaggauuuuguuuaaaauacuu

SEQ ID NO: 754476 - RNA, 64 nt, Homo Sapiens
gcagcagaaugagccaggaguagcaggagaugggcaaagaaaacuggggugcacucagcucuca

SEQ ID NO: 754477 - RNA, 64 nt, Homo Sapiens
ucuacaguguccuaagugcuugcaauuaaacuuccaaagaaaguuuucaaguuuuaaaguucau

SEQ ID NO: 754478 - RNA, 64 nt, Homo Sapiens
aaaaaaagccagccaagcuuauuugaauuaucagcaaagaaaaauuugcuugccaaaguacaga

SEQ ID NO: 754479 - RNA, 64 nt, Homo Sapiens
aauuccuaugaccaaauugccauuuaaaacaagacaaagaaacaugcauuucauauagcuuuuu

SEQ ID NO: 754480 - RNA, 64 nt, Homo Sapiens
augcuuucugaggagauaguaguagaugauauaacaaagaaagcgaaagucuggccaacagagc

SEQ ID NO: 754481 - RNA, 64 nt, Homo Sapiens
auacccaucaguaauuucuccuuuuuuguaacaucaaagaaaacuucaaauauaaguuuccaug

SEQ ID NO: 754482 - RNA, 64 nt, Homo Sapiens
ccacgugugcauguugucauuuccuacccucuuccaaagaaagaaagcacagauacuuugugag

SEQ ID NO: 754483 - RNA, 64 nt, Homo Sapiens
cagagagagagaauauuggaaaaaaaaaagaugacaaagaaaaacuugaaaauguuuauuuaaa

SEQ ID NO: 754484 - RNA, 64 nt, Homo Sapiens
auuccacaaugaaagaauguaccaaucaaccaaacaaagaaaaaaacaggaacccaccaaacca

SEQ ID NO: 754485 - RNA, 64 nt, Homo Sapiens
ugguacuuacccuucuacaaaaaaagaaaacaaccaaagaaaauuacuuugaacauuaauguug

SEQ ID NO: 754486 - RNA, 64 nt, Homo Sapiens
agaagggguagggauuuggcucuugauauuccuacaaagaaaaagaaauauuugcucaauauga

SEQ ID NO: 754487 - RNA, 64 nt, Homo Sapiens
gaaacuuaagaugugcaaggagauuuaaugauuucaaagaaaauaaugguucuuuguuuuuaau

SEQ ID NO: 754488 - RNA, 64 nt, Homo Sapiens
auuuggaaaaaugaaauuuaguaguuccaaguuucaaagaaaugucaacauuuuauuccauuca

SEQ ID NO: 754489 - RNA, 64 nt, Homo Sapiens
augaacuaauucuuuacaaaaaaaacucgagcuacaaagaaagauguaaaauguucuaagauaa

SEQ ID NO: 754490 - RNA, 64 nt, Homo Sapiens
aggccacguauguugggguacauuaaaaaaaaaucaaagaaagauccauguaguccaaauuugu

SEQ ID NO: 754491 - RNA, 64 nt, Homo Sapiens
uuauacaaacucguauaaagaggccuuuguucagcaaagaaacccauaaauguaauaacugagg

SEQ ID NO: 754492 - RNA, 64 nt, Homo Sapiens
acaggucuuuccucaaacuuaagaaucaggcuggcaaagaaaucagaaggcugugccuagaaca

SEQ ID NO: 754493 - RNA, 64 nt, Homo Sapiens
uuugcacagaggagugugaacucaccaagaugagcaaagaaagggguacucuuggauguguuuu

SEQ ID NO: 754494 - RNA, 64 nt, Homo Sapiens
uacaagcuggaguguaggaagucuaauccugaaacaaagaaaacccuugaagaauggguucugu

SEQ ID NO: 754495 - RNA, 64 nt, Homo Sapiens
uacuauaucccuuaaugaaaauaacacaaaugcucaaagaaaucauuguccuuaauugaugcaa

SEQ ID NO: 754496 - RNA, 64 nt, Homo Sapiens
cggagaagcugccaggugaggauuaugaaagcaacaaagaaaucgaaagcgcaaugucagaagc

SEQ ID NO: 754497 - RNA, 64 nt, Homo Sapiens
ucucucaguccuuuugcuacauucacuuucuuuucaaagaaauguuaauuauuacaaaaauuga

SEQ ID NO: 754498 - RNA, 64 nt, Homo Sapiens
augaaguaaaccaauagauacucuuuugauucuccaaagaaauauaauuuugguuuuuguuccu

SEQ ID NO: 754499 - RNA, 64 nt, Homo Sapiens
acuccagccugggugacagagcgagacuguguuucaaagaaaaaaaaaaacaagcagccuuuug

SEQ ID NO: 754500 - RNA, 64 nt, Homo Sapiens
guccauguacucagauaaacaugaagaaaauaagcaaagaaaaauggagacugggaaagcaaag

SEQ ID NO: 754501 - RNA, 64 nt, Homo Sapiens
agaaaguaacuaucuugaagguuugaaaaacaaccaaagaaagggagugaggacuauggcugca

SEQ ID NO: 754502 - RNA, 64 nt, Homo Sapiens
gaagacaaagaagguaggaacggaauuuugagggcaaagaaaccuguguuuccauggaauugcu

SEQ ID NO: 754503 - RNA, 64 nt, Homo Sapiens
agaggcuggcuucacuagaggacacagguucuugcaaagaaacuacuuguggggacuuaggcau

SEQ ID NO: 754504 - RNA, 64 nt, Homo Sapiens
ucagagaaaugcaugggaauaaacuagaaugauacaaagaaaggaaagugauugcugggagcaa

SEQ ID NO: 754505 - RNA, 64 nt, Homo Sapiens
uuaagacucgugaaaagaauauuugccuguuguacaaagaaauguugauggaagguauuaaacu

SEQ ID NO: 754506 - RNA, 64 nt, Homo Sapiens
acggcuucucuugcauuauuuuugccaaccuaagcaaagaaaauuugcugcaaagagcugcugc

SEQ ID NO: 754507 - RNA, 64 nt, Homo Sapiens
aguaaacagaguaauguuuuuuuucuuauuuucccaaagaaagaaaagggggaaaauauauuug

SEQ ID NO: 754508 - RNA, 64 nt, Homo Sapiens
acagguuuaaacuggacuuagcuugaguuaaaggcaaagaaaaucuaaaaacauaaauguuaua

SEQ ID NO: 754509 - RNA, 64 nt, Homo Sapiens
ggagugggucuaucucagaggaaggaacaggaaacaaagaaaggaagccacugaacaucccuuc

SEQ ID NO: 754510 - RNA, 64 nt, Homo Sapiens
aguccagaacugaauccuaagaaaugcaggacugcaaagaaauuggugugugugugugugugug

SEQ ID NO: 754511 - RNA, 64 nt, Homo Sapiens
ugaaauauauaguaaaugcugggagaaccccaaccaaagaaaucagaaauauuaauaccacaug

SEQ ID NO: 754512 - RNA, 64 nt, Homo Sapiens
uccaagcaauaaaguggaagaccuuaaccaacaccaaagaaacaaaagcaaaaagcaggccaca

SEQ ID NO: 754513 - RNA, 64 nt, Homo Sapiens
agauuauccaugggugaugagggacuggcugaaccaaagaaacaauuuucuucuuccuuauuuc

SEQ ID NO: 754514 - RNA, 64 nt, Homo Sapiens
auuguaaaaauuuuuaaaacacagaaacuauaugcaaagaaaaaauaaaaauuaucuauaaucu

SEQ ID NO: 754515 - RNA, 64 nt, Homo Sapiens
aaaauuugauucauaauaauuacguuaccauugucaaagaaagcgaggaugaagauaaggaaga

SEQ ID NO: 754516 - RNA, 64 nt, Homo Sapiens
aaaauacaaacacaauauuuacuuccaugaucuccaaagaaaccaauuggcaauuuaacgagcc

SEQ ID NO: 754517 - RNA, 64 nt, Homo Sapiens
gagacucgcuuguauuuuaagagaaccaaguggccaaagaaacucuuucuaacuuuggcaacau

SEQ ID NO: 754518 - RNA, 64 nt, Homo Sapiens
uugcacaaaugucaaaaaaaagaugguaauaucucaaagaaaugaacuuguagauuaccaagca

SEQ ID NO: 754519 - RNA, 64 nt, Homo Sapiens
ccugggcauccuaaugcuuacucugguuguuacacaaagaaaauauuggggucacuggcgagcc

SEQ ID NO: 754520 - RNA, 64 nt, Homo Sapiens
ggauuuuaauuguuucaucacaccuuccccguggcaaagaaacagucaguccucuucagguguc

SEQ ID NO: 754521 - RNA, 64 nt, Homo Sapiens
uuuuucuauugcuaggagccuaaaugaugaaauucaaagaaaacuguagcauuuguaagauuug

SEQ ID NO: 754522 - RNA, 64 nt, Homo Sapiens
cugucuuaauaaagaaagcuugcaacaagggacacaaagaaauuaguauacuucaguauacuag

SEQ ID NO: 754523 - RNA, 64 nt, Homo Sapiens
uuaagguagcccucucaucgucuuuuaguuccaacaaagaaaggugccaugucuuuacuagacu

SEQ ID NO: 754524 - RNA, 64 nt, Homo Sapiens
aguuguaaaaugucaagaaauucugcuguuacgacaaagaaacauuuuacgcuagauuaaaaua

SEQ ID NO: 754525 - RNA, 64 nt, Homo Sapiens
gaaccugauuugcacucuguaguguuuaaagaaacaaagaaacucuaauauugaaucucuuaaa

SEQ ID NO: 754526 - RNA, 64 nt, Homo Sapiens
cguauugucuaaaugcauuuaaaucuguuuuauucaaagaaaagcuaaagcaaaaacacuggca

SEQ ID NO: 754527 - RNA, 64 nt, Homo Sapiens
cggccacaagggacugaggcaagcacaaugguuucaaagaaagacuguaagcuccaugauuagc

SEQ ID NO: 754528 - RNA, 64 nt, Homo Sapiens
ggcuugggaaacugagguguuauuuucaaugaaacaaagaaagagauguuaagcaagugguugu

SEQ ID NO: 754529 - RNA, 64 nt, Homo Sapiens
aacuguauaaagggauugguagucaaaacauguacaaagaaauaccuguaaaacuguuuugucu

SEQ ID NO: 754530 - RNA, 64 nt, Homo Sapiens
acuguguuggacauauuauuuagacuuagucauacaaagaaacuuagcucuuuuuucaucucac

SEQ ID NO: 754531 - RNA, 64 nt, Homo Sapiens
gaauuucugaugauuuggguucuuuuccauaguccaaagaaacagaucagcucuucagguauca

SEQ ID NO: 754532 - RNA, 64 nt, Homo Sapiens
guuacaugguaacagugaauggcuuaguaccuggcaaagaaaguaaaauuguuuuuucuguccg

SEQ ID NO: 754533 - RNA, 64 nt, Homo Sapiens
ucaagccuuacuacccaucuuuuauuccauacugcaaagaaauuuugcaaauguaaagaauaug

SEQ ID NO: 754534 - RNA, 64 nt, Homo Sapiens
aagauuucuacaaugagaauuacaaagcagugcacaaagaaaucagaaacaauaaaaauugaaa

SEQ ID NO: 754535 - RNA, 64 nt, Homo Sapiens
augcaauuaccauaaaugguuaucauuugcuuaacaaagaaaucaguuaaaaaaacagccagau

SEQ ID NO: 754536 - RNA, 64 nt, Homo Sapiens
uuuauggauguaaauuguuccugaaaauucauaucaaagaaaaugguaagccuuuauccuaagu

SEQ ID NO: 754537 - RNA, 64 nt, Homo Sapiens
cuuggauuacauuaacauuuuuuaguauuguugucaaagaaaaguaaaaaauuguaaggcaauu

SEQ ID NO: 754538 - RNA, 64 nt, Homo Sapiens
cuugugcagugcuaagugucacuacucaagaagccaaagaaacaguauaggcaguauacacagc

SEQ ID NO: 754539 - RNA, 64 nt, Homo Sapiens
agaggggguggggagguaaauuccucugacuugccaaagaaaaagaagggaaccacaguggaua

SEQ ID NO: 754540 - RNA, 64 nt, Homo Sapiens
ggcauuccugaauaauuuccaaauguuuuuaauccaaagaaaaagguuuaaagcuuauuucccu

SEQ ID NO: 754541 - RNA, 64 nt, Homo Sapiens; identical to SEQ ID NO: 45780

SEQ ID NO: 754542 - RNA, 64 nt, Homo Sapiens; identical to SEQ ID NO: 45781

SEQ ID NO: 754543 - RNA, 64 nt, Homo Sapiens; identical to SEQ ID NO: 45782

SEQ ID NO: 754544 - RNA, 64 nt, Homo Sapiens; identical to SEQ ID NO: 45783

SEQ ID NO: 754545 - RNA, 64 nt, Homo Sapiens; identical to SEQ ID NO: 45784

SEQ ID NO: 754546 - RNA, 64 nt, Homo Sapiens; identical to SEQ ID NO: 45785

SEQ ID NO: 754547 - RNA, 64 nt, Homo Sapiens; identical to SEQ ID NO: 45786

SEQ ID NO: 754548 - RNA, 64 nt, Homo Sapiens; identical to SEQ ID NO: 45787

SEQ ID NO: 754549 - RNA, 64 nt, Homo Sapiens; identical to SEQ ID NO: 45788

SEQ ID NO: 754550 - RNA, 64 nt, Homo Sapiens; identical to SEQ ID NO: 45789

SEQ ID NO: 754551 - RNA, 64 nt, Homo Sapiens; identical to SEQ ID NO: 45790

SEQ ID NO: 754552 - RNA, 64 nt, Homo Sapiens; identical to SEQ ID NO: 45791

SEQ ID NO: 754553 - RNA, 64 nt, Homo Sapiens; identical to SEQ ID NO: 45792

SEQ ID NO: 754554 - RNA, 64 nt, Homo Sapiens; identical to SEQ ID NO: 45793

SEQ ID NO: 754555 - RNA, 64 nt, Homo Sapiens; identical to SEQ ID NO: 45794

SEQ ID NO: 754556 - RNA, 64 nt, Homo Sapiens; identical to SEQ ID NO: 45795

SEQ ID NO: 754557 - RNA, 64 nt, Homo Sapiens; identical to SEQ ID NO: 45796

SEQ ID NO: 754558 - RNA, 64 nt, Homo Sapiens; identical to SEQ ID NO: 45797

SEQ ID NO: 754559 - RNA, 64 nt, Homo Sapiens; identical to SEQ ID NO: 45798

SEQ ID NO: 754560 - RNA, 64 nt, Homo Sapiens; identical to SEQ ID NO: 45799

SEQ ID NO: 754561 - RNA, 64 nt, Homo Sapiens; identical to SEQ ID NO: 45800

SEQ ID NO: 754562 - RNA, 64 nt, Homo Sapiens; identical to SEQ ID NO: 45801

SEQ ID NO: 754563 - RNA, 64 nt, Homo Sapiens; identical to SEQ ID NO: 45802

SEQ ID NO: 754564 - RNA, 64 nt, Homo Sapiens; identical to SEQ ID NO: 45803

SEQ ID NO: 754565 - RNA, 64 nt, Homo Sapiens; identical to SEQ ID NO: 45804

SEQ ID NO: 754566 - RNA, 64 nt, Homo Sapiens; identical to SEQ ID NO: 45805

SEQ ID NO: 754567 - RNA, 64 nt, Homo Sapiens; identical to SEQ ID NO: 45806

SEQ ID NO: 754568 - RNA, 64 nt, Homo Sapiens
gugaagcaugaagggaaucauaggaaaaauguacugaucauauaauuaacauuauguacuguau

SEQ ID NO: 754569 - RNA, 64 nt, Homo Sapiens
ucauuucaccuucccuguacuguauguuuggaauugaucauaaaacaucuccaaaagaaaauaa

SEQ ID NO: 754570 - RNA, 64 nt, Homo Sapiens
ucauuguaaccucaaacuccggagugcaguggcaugaucauagccugacucuguugcccaagcu

SEQ ID NO: 754571 - RNA, 64 nt, Homo Sapiens
gucaacauggucuggaguguucaugcaaacauagugaucauagcuucuuuuaagcucuaugcaa

SEQ ID NO: 754572 - RNA, 64 nt, Homo Sapiens
ucaaaaauguauuuaauauaauaaguugaaaauaugaucauaagcauaaguugaaaauaugauc

SEQ ID NO: 754573 - RNA, 64 nt, Homo Sapiens
uugaaaauaugaucauaaguauaaguugaaaauaugaucauaagugcauccugauaaacccauc

SEQ ID NO: 754574 - RNA, 64 nt, Homo Sapiens
uccucuaccaagucuggaaauauuaaauauagggugaucauagugugcacauucaaaguuaagc

SEQ ID NO: 754575 - RNA, 64 nt, Homo Sapiens
ucauacauauaaauggugguacauaggcaagccuugaucauaguucuuggccuugcuccacagg

SEQ ID NO: 754576 - RNA, 62 nt, Homo Sapiens
cauguauuauuauuauuuuugagauggaguuuugcucuuaaugauauuauuauuauuugaga

SEQ ID NO: 754577 - RNA, 62 nt, Homo Sapiens
uaaugauauuauuauuauuugagacagaguuuugcucuuauugcccaggcuggagugcagug

SEQ ID NO: 754578 - RNA, 62 nt, Homo Sapiens
aaucuugguuugguacaguuuuuguaccauauugcucuuaaaauugucugucugcucuuauu

SEQ ID NO: 754579 - RNA, 62 nt, Homo Sapiens
uuuguaccauauugcucuuaaaauugucugucugcucuuauuuugaaugccugucccagucc

SEQ ID NO: 754580 - RNA, 62 nt, Homo Sapiens
cugucuggcauuacaauugcugauacaugcauugcucuuauucuuugccucucaauugucau

SEQ ID NO: 754581 - RNA, 62 nt, Homo Sapiens
gauuuacagacugaugccagcuuuuguuauuaugcucuuaauaugaaaaccugaagaguuca

SEQ ID NO: 754582 - RNA, 62 nt, Homo Sapiens
aguggauggauagucugcuuguuuuuaguuuuugcucuuaacaaacacugcugcagucagca

SEQ ID NO: 754583 - RNA, 62 nt, Homo Sapiens
uaacaaauacucagcaaaugugaaacuuuauuugcucuuacuucaaaauuaguccaaaaugu

SEQ ID NO: 754584 - RNA, 62 nt, Homo Sapiens
cuguugaacaccccucuuagggauguuucuuuugcucuuauuuccugcaucuuuccuuaagg

SEQ ID NO: 754585 - RNA, 62 nt, Homo Sapiens
gguuucuaugauugaccuugagguuuacuccuugcucuuacaacauuucuaaggauuuuuaa

SEQ ID NO: 754586 - RNA, 62 nt, Homo Sapiens
uucucggcuuuuuaaugacuucuuaaauguugugcucuuaugaaucggcuuaaaauucccuu

SEQ ID NO: 754587 - RNA, 62 nt, Homo Sapiens
auuuugaaaugggcucuugacuacauacuaaaugcucuuaucagaaacugugcauuccagau

SEQ ID NO: 754588 - RNA, 62 nt, Homo Sapiens
ugaaguaaauugauauaaccaggccugaauuaugcucuuauguuuuuguuauuaaauggaaa

SEQ ID NO: 754589 - RNA, 62 nt, Homo Sapiens
aguuuuuaauaaguugauauaauuauagacagugcucuuaauauuggguuugaaagauuuug

SEQ ID NO: 754590 - RNA, 62 nt, Homo Sapiens
guuuuuaaggaugguugugacuggccgugguuugcucuuaauacaggugugagccaccaugc

SEQ ID NO: 754591 - RNA, 62 nt, Homo Sapiens
guuuucuuuguuuuguuuugcucuaaaagguuugcucuuaauaagaaaucuuaaguagaauu

SEQ ID NO: 754592 - RNA, 62 nt, Homo Sapiens
cuggugagaagaaccuuacuuguuaucccaagugcucuuauuugggugaggggacccuacuc

SEQ ID NO: 754593 - RNA, 62 nt, Homo Sapiens
ugggcaagggugcuuuccuuacuuaguucauaugcucuuacucuccuacuaccaccacacaa

SEQ ID NO: 754594 - RNA, 64 nt, Homo Sapiens
cccucuuccuuugaaggccccagcaccucugcccuguggucaccgaaucuguacuaaggaccug

SEQ ID NO: 754595 - RNA, 64 nt, Homo Sapiens
acaaguuggcuagaagauacauggagaggaaugguguggucaacaguuaaugaaacgguucuau

SEQ ID NO: 754596 - RNA, 64 nt, Homo Sapiens
caaaaauucagcccugaaauuucugcccgaggcuuguggucaaguucagucauaggcgaaucug

SEQ ID NO: 754597 - RNA, 64 nt, Homo Sapiens
guggcugcauaacaguggaucuauucaguugcucuguggucaguaucaacaauccaaugcucac

SEQ ID NO: 754598 - RNA, 64 nt, Homo Sapiens
aggccagagaccccaggcagccugagcucuuggauguggucagcucuccaggagcaaguccugu

SEQ ID NO: 754599 - RNA, 64 nt, Homo Sapiens
acggugcagucggcugcauacucccagucgggaguguggucagucugccugcugcugugcggua

SEQ ID NO: 754600 - RNA, 64 nt, Homo Sapiens
caugcaaaggaagggauggggugagcgcaaggccuguggucagcagcuacugaugguuuuuucu

SEQ ID NO: 754601 - RNA, 64 nt, Homo Sapiens
auuuauuugccuguuuuuguuuuuuuacuugagcuguggucacagcugccagguaccuaagcaa

SEQ ID NO: 754602 - RNA, 64 nt, Homo Sapiens
ggcuuucuaagaaaaacuuuauuuugcauaagcauguggucagaucauuuugugcauaugcagc

SEQ ID NO: 754603 - RNA, 64 nt, Homo Sapiens
aaucuguuuuuauuuuugucauguagaauacuacuguggucaucauaauguaaucuauuucugu

SEQ ID NO: 754604 - RNA, 64 nt, Homo Sapiens
acaaagauacuccaaaauacaauggcuuaaagaauguggucauuuauucuuuauuauuuauuua

SEQ ID NO: 754605 - RNA, 64 nt, Homo Sapiens
aauguggucauuuauucuuuauuauuuauuuauuuguggucaaauaaauaaauaagguuauuua

SEQ ID NO: 754606 - RNA, 64 nt, Homo Sapiens
ugccuucaguuuguguuguguauauuuugauguauguggucacuaacaggucacuuuuauuuuu

SEQ ID NO: 754607 - RNA, 64 nt, Homo Sapiens
uuaauguugucuuaaaauuucuugauugugauacuguggucauaugcccguguuugucacuuac

SEQ ID NO: 754608 - RNA, 64 nt, Homo Sapiens
uugacuucuuccgucgagugcgugcauccuacuauguggucagugggaaugacccugccaaugg

SEQ ID NO: 754609 - RNA, 64 nt, Homo Sapiens
gaucccuucucauccccugcuuggcuucucugcauguggucaucugcuguggcuugguguuuaa

SEQ ID NO: 754610 - RNA, 64 nt, Homo Sapiens
ugaagcucuuucugcaucaguuguucguggggauuguggucacaaacacuaccugaugcuuucc

SEQ ID NO: 754611 - RNA, 64 nt, Homo Sapiens
ucagcccuaacuucugugugcggacgugguguuauguggucauuagcgccacaguugcccuccc

SEQ ID NO: 754612 - RNA, 64 nt, Homo Sapiens
ugcucaauuccuucuucaacgccaucuccacucuuguggucaucauggccagcacgccgcucuu

SEQ ID NO: 754613 - RNA, 64 nt, Homo Sapiens
uuguggucaucauggccagcacgccgcucuucacuguggucauccugccccuggcugugcucua

SEQ ID NO: 754614 - RNA, 64 nt, Homo Sapiens
ccagucuuucuuuaacaucaaucaaccguagcaauguggucaucacgaagucuucauugacuca

SEQ ID NO: 754615 - RNA, 64 nt, Homo Sapiens
cacuauuaagcagcuugguuuugacauguuauguuguggucaucuuuucaugucaauacauaga

SEQ ID NO: 754616 - RNA, 64 nt, Homo Sapiens
ccaaggcccaggagggacuugggcaguauguucauguggucauauguuuuuguaaaaaauugug

SEQ ID NO: 754617 - RNA, 64 nt, Homo Sapiens
gaauuauucauuugcccaaaaggacuuaagugguuguggucauccaucauuguauuuaucaaga

SEQ ID NO: 754618 - RNA, 64 nt, Homo Sapiens
uccgagcuccuguggaaguugcuccuugcgcugauguggucacucggcuagcaggcccuucugu

SEQ ID NO: 754619 - RNA, 64 nt, Homo Sapiens
gcgcugauguggucacucggcuagcaggcccuucuguggucaaccacaugaugccugcuaguua

SEQ ID NO: 754620 - RNA, 64 nt, Homo Sapiens
guuaccauccauacugugucuugccuguucucaguguggucaguaggagcagaaggaagacuac

SEQ ID NO: 754621 - RNA, 64 nt, Homo Sapiens
acuaucauggaaugugccugucuuuuguacuacuuguggucagcgggagaccucuuagaucagu

SEQ ID NO: 754622 - RNA, 64 nt, Homo Sapiens
ugggaucaauuucauuaccguguaccuuucccauuguggucaugccauuuggcagggggagaau

SEQ ID NO: 754623 - RNA, 64 nt, Homo Sapiens
cucugugaggcaucuggccauucgcacucccugguguggucagccucucucacacaaggaggaa

SEQ ID NO: 754624 - RNA, 64 nt, Homo Sapiens
aacaagagucagaacauuaauucuugguuagguugcauuauaauaauagcaggagcauguugau

SEQ ID NO: 754625 - RNA, 64 nt, Homo Sapiens
agagauuggacaaaccagucagcaauggaauuuagcauuauaagagaucauuucuggaggcuuc

SEQ ID NO: 754626 - RNA, 64 nt, Homo Sapiens
uuccaaacuauacccauaaauuccugcucugaaugcauuauauuucucucuuuauccuauguga

SEQ ID NO: 754627 - RNA, 64 nt, Homo Sapiens
augguggaaaauaagguucaguuguguauuuaaugcauuauagccaucaauugcagacugugaa

SEQ ID NO: 754628 - RNA, 64 nt, Homo Sapiens
uuacucaacauuagagaguuaguacguaauaaaagcauuauaaaugcaauuuuugucaagagau

SEQ ID NO: 754629 - RNA, 64 nt, Homo Sapiens
uccaugaaguagguuuucagagcaauauucuucugcauuauaguaagagaaaaccauuuuuaau

SEQ ID NO: 754630 - RNA, 64 nt, Homo Sapiens
cauucagucaggcacugggaucaucuguuuacaggcauuauauuuauuuggcacuccuggaaca

SEQ ID NO: 754631 - RNA, 64 nt, Homo Sapiens
uacaaagaaggcaaauucuuuaaucaaauaaagcgcauuauaaaaugagauguuuauuggauua

SEQ ID NO: 754632 - RNA, 64 nt, Homo Sapiens
uuucaaccuagucuaagugggagcauuauauuuugcauuauaugguuuguguuuuucuauagca

SEQ ID NO: 754633 - RNA, 64 nt, Homo Sapiens
uugcauuauauguuucaaccuuuucuauagcagagcauuauauuagccauuuacauguuugugu

SEQ ID NO: 754634 - RNA, 64 nt, Homo Sapiens
cucuuuguaccagcaaauuaucccagcaggaagagcauuauauugugaauauguggaaauaauu

SEQ ID NO: 754635 - RNA, 64 nt, Homo Sapiens
cacccaugauauuucuaauagacauuuuuauguugcauuauauaugcuuccacagucaaagcug

SEQ ID NO: 754636 - RNA, 64 nt, Homo Sapiens; identical to SEQ ID NO: 558528

SEQ ID NO: 754637 - RNA, 64 nt, Homo Sapiens; identical to SEQ ID NO: 558529

SEQ ID NO: 754638 - RNA, 64 nt, Homo Sapiens; identical to SEQ ID NO: 558530

SEQ ID NO: 754639 - RNA, 64 nt, Homo Sapiens; identical to SEQ ID NO: 558531

SEQ ID NO: 754640 - RNA, 64 nt, Homo Sapiens; identical to SEQ ID NO: 558532

SEQ ID NO: 754641 - RNA, 64 nt, Homo Sapiens; identical to SEQ ID NO: 558533

SEQ ID NO: 754642 - RNA, 64 nt, Homo Sapiens; identical to SEQ ID NO: 558534

SEQ ID NO: 754643 - RNA, 64 nt, Homo Sapiens; identical to SEQ ID NO: 558535

SEQ ID NO: 754644 - RNA, 64 nt, Homo Sapiens; identical to SEQ ID NO: 558536

SEQ ID NO: 754645 - RNA, 64 nt, Homo Sapiens; identical to SEQ ID NO: 558537

SEQ ID NO: 754646 - RNA, 64 nt, Homo Sapiens; identical to SEQ ID NO: 558538

SEQ ID NO: 754647 - RNA, 64 nt, Homo Sapiens; identical to SEQ ID NO: 558539

SEQ ID NO: 754648 - RNA, 64 nt, Homo Sapiens; identical to SEQ ID NO: 558540

SEQ ID NO: 754649 - RNA, 64 nt, Homo Sapiens; identical to SEQ ID NO: 558541

SEQ ID NO: 754650 - RNA, 54 nt, Homo Sapiens; identical to SEQ ID NO: 558542

SEQ ID NO: 754651 - RNA, 64 nt, Homo Sapiens; identical to SEQ ID NO: 558543

SEQ ID NO: 754652 - RNA, 64 nt, Homo Sapiens; identical to SEQ ID NO: 558544

SEQ ID NO: 754653 - RNA, 64 nt, Homo Sapiens; identical to SEQ ID NO: 558545

SEQ ID NO: 754654 - RNA, 64 nt, Homo Sapiens; identical to SEQ ID NO: 558546

SEQ ID NO: 754655 - RNA, 64 nt, Homo Sapiens; identical to SEQ ID NO: 558547

SEQ ID NO: 754656 - RNA, 64 nt, Homo Sapiens; identical to SEQ ID NO: 558548

SEQ ID NO: 754657 - RNA, 64 nt, Homo Sapiens; identical to SEQ ID NO: 558549

SEQ ID NO: 754658 - RNA, 64 nt, Homo Sapiens; identical to SEQ ID NO: 558550

SEQ ID NO: 754659 - RNA, 64 nt, Homo Sapiens; identical to SEQ ID NO: 558551

SEQ ID NO: 754660 - RNA, 64 nt, Homo Sapiens; identical to SEQ ID NO: 558552

SEQ ID NO: 754661 - RNA, 64 nt, Homo Sapiens; identical to SEQ ID NO: 558553

SEQ ID NO: 754662 - RNA, 64 nt, Homo Sapiens; identical to SEQ ID NO: 558554

SEQ ID NO: 754663 - RNA, 64 nt, Homo Sapiens; identical to SEQ ID NO: 628786

SEQ ID NO: 754664 - RNA, 64 nt, Homo Sapiens; identical to SEQ ID NO: 628787

SEQ ID NO: 754665 - RNA, 64 nt, Homo Sapiens; identical to SEQ ID NO: 628788

SEQ ID NO: 754666 - RNA, 64 nt, Homo Sapiens; identical to SEQ ID NO: 628789

SEQ ID NO: 754667 - RNA, 64 nt, Homo Sapiens; identical to SEQ ID NO: 628790

SEQ ID NO: 754668 - RNA, 64 nt, Homo Sapiens; identical to SEQ ID NO: 628791

SEQ ID NO: 754669 - RNA, 64 nt, Homo Sapiens; identical to SEQ ID NO: 628792

SEQ ID NO: 754670 - RNA, 64 nt, Homo Sapiens; identical to SEQ ID NO: 628793

SEQ ID NO: 754671 - RNA, 64 nt, Homo Sapiens
aauaguacacacuucagaguaagacaaaugcaaagcaucuuaaggagugaaaauagaguguaaa

SEQ ID NO: 754672 - RNA, 64 nt, Homo Sapiens
cuccucugcuuuaugaaguuugaguuguauuugugcaucuuaaaguagguugaggcuugaggcu

SEQ ID NO: 754673 - RNA, 64 nt, Homo Sapiens
gaagaguaaacuggugagagguuuauucucugcugcaucuuacauaagguagcauucauuaccu

SEQ ID NO: 754674 - RNA, 64 nt, Homo Sapiens
augcucucuagguguuucuuggaaucuuccaucugcaucuuaacaaucucugcuaaguggaccu

SEQ ID NO: 754675 - RNA, 62 nt, Homo Sapiens
cgccugguuuuuccauauggcucaugaucuaauuuaaggaacaaguaacuaaaaauguuaag

SEQ ID NO: 754676 - RNA, 62 nt, Homo Sapiens
cucaaaaucaggugaagcuaggaagauggagcuuuaaggagcauggcuagugcucugaguag

SEQ ID NO: 754677 - RNA, 62 nt, Homo Sapiens
ugcauuuucacccauucugugguucauuguaguuuaaggaaaccaagcauauagaugcauua

SEQ ID NO: 754678 - RNA, 62 nt, Homo Sapiens
ucucuuaaaaauaccacaguuuguauuuuuucuuuaaggaguaaagauuugccuuuaaauaa

SEQ ID NO: 754679 - RNA, 62 nt, Homo Sapiens
guuguugaccauaauauugcguuauucuaaaguuuaaggagcaaaaggaauauucuuaugua

SEQ ID NO: 754680 - RNA, 62 nt, Homo Sapiens
aaggaauauucuuauguaguggcaaaaauaauuuuaaggaaaaauuugagcaggucguugau

SEQ ID NO: 754681 - RNA, 62 nt, Homo Sapiens
aauuggagugacguaucuuaaggaaguuuauauuuaaggaaggggguuaauauaaaucaagg

SEQ ID NO: 754682 - RNA, 62 nt, Homo Sapiens
cgaucaaacuaaaaugucuugggacugaaagguuuaaggagguuuuauaaugaugucuuaga

SEQ ID NO: 754683 - RNA, 62 nt, Homo Sapiens
aaaaaauauuaaauuuugaaaaguacauguuauuuaaggaggccuaauagcugccucaugac

SEQ ID NO: 754684 - RNA, 62 nt, Homo Sapiens
ugaggcagggguaauuauuaugugauauugaguuuaaggauuauuugcuuauacucagugcc

SEQ ID NO: 754685 - RNA, 62 nt, Homo Sapiens
ggaggauaacuuugggaagguuaguuauacaauuuaaggaaguagucagaaagaugagagga

SEQ ID NO: 754686 - RNA, 62 nt, Homo Sapiens
aauaaaaaauaaaguaguaaagugagcauucauuuaaggauaguacugauggauguuuugaa

SEQ ID NO: 754687 - RNA, 62 nt, Homo Sapiens
auugagagaauguacccacagcaucacugggauuuaaggagacacguguugcaaguauaaaa

SEQ ID NO: 754688 - RNA, 62 nt, Homo Sapiens
augaagaaaaagaaccaaaauuuagaggugacuuuaaggaaagauauaaacagagaaauacc

SEQ ID NO: 754689 - RNA, 62 nt, Homo Sapiens
uuuuaaauucaaauaaggauggcagugcccauuuuaaggaggauuucagcuauaacugagga

SEQ ID NO: 754690 - RNA, 62 nt, Homo Sapiens
ugaaccucaugggacuuuuaaaagaagggcuauuuaaggaauucacuugguaguacuuugcu

SEQ ID NO: 754691 - RNA, 62 nt, Homo Sapiens
aaagauuuuuaauucugugaaacucauuuuuuuuuaaggaguugauacauugaacaaaaugg

SEQ ID NO: 754692 - RNA, 62 nt, Homo Sapiens
ggaaaaccuuauaaugacgaaaagacuuuuuuuuuaaggaaaacauuuugaaauaugcaaag

SEQ ID NO: 754693 - RNA, 62 nt, Homo Sapiens
aaacauuuuuaaucaauuguauugaugcacaauuuaaggauuaaaauuuggagucauaggau

SEQ ID NO: 754694 - RNA, 62 nt, Homo Sapiens
caaaucuuacaaaauccugguuuaaaacuguauuuaaggaauuuucccuccauaaguuuaac

SEQ ID NO: 754695 - RNA, 62 nt, Homo Sapiens
gcucaagugagcaaggguuucauguagcuaauuuuaaggagggcuugcuaagaauuugagca

SEQ ID NO: 754696 - RNA, 62 nt, Homo Sapiens
aguaacuuaauuggguuuuuuacugcacauguuuuaaggaaauuucucuuuugauucaauua

SEQ ID NO: 754697 - RNA, 62 nt, Homo Sapiens
gcuuucucaaucauuaauaguuucguauuuucuuuaaggaguuuuacauauuuuucauuuua

SEQ ID NO: 754698 - RNA, 62 nt, Homo Sapiens
aaggcaugcuuucugacugauuuuuuuuuguuuuuaaggaaauuuucaaaaguuggcagauu

SEQ ID NO: 754699 - RNA, 62 nt, Homo Sapiens
caaaacgguaaugaacagauguuagauaguucuuuaaggagaaacauuuugggaaacacuau

SEQ ID NO: 754700 - RNA, 62 nt, Homo Sapiens
aauuacugugauggacacaguuaaguacaacuuuuaaggacuguuuauuaaagauugacauu

SEQ ID NO: 754701 - RNA, 62 nt, Homo Sapiens
auuaauucugagguaguauagaugauuacuuuuuuaaggaggcugcaguuuuuucuaugugg

SEQ ID NO: 754702 - RNA, 62 nt, Homo Sapiens
agaugaagcucugcaguuuuuacuugaaaauauuuaaggaagauggauuuguguucuuacag

SEQ ID NO: 754703 - RNA, 62 nt, Homo Sapiens
aagagaaugacucuguuauucugauaaggauauuuaaggaagacagcuuccuuuuagaaggu

SEQ ID NO: 754704 - RNA, 62 nt, Homo Sapiens
gauugaaucuaagcugugaaucccggcuacacuuuaaggaaacagaaucacacuccugugua

SEQ ID NO: 754705 - RNA, 62 nt, Homo Sapiens
agcaauaaauaacacuugucagccucagagcauuuaaggaaacuagacaaguaaaauuaucc

SEQ ID NO: 754706 - RNA, 62 nt, Homo Sapiens
uuacccuccaagucuguaccucaaaugaauucuuuaaggagauggacuaauugacuugcaaa

SEQ ID NO: 754707 - RNA, 62 nt, Homo Sapiens
acauugauuuuuaaaacugcugcuuuuuaugcuuuaaggaaaauguauuucauauuugaguu

SEQ ID NO: 754708 - RNA, 62 nt, Homo Sapiens
aacuauuuaguuuuuccacuuuaccuucaugauuuaaggaacauguauuagcuguguuuuag

SEQ ID NO: 754709 - RNA, 62 nt, Homo Sapiens
aguuccauuucagauuucuucuuugccacccuuuuaaggacuuugaauuuuucuuugucuuu

SEQ ID NO: 754710 - RNA, 62 nt, Homo Sapiens
uucugcucggcaauuuguaaguuuacauguuauuuaaggauaaagguaaaucauucaaggca

SEQ ID NO: 754711 - RNA, 62 nt, Homo Sapiens
uuugauguaauaaaacuugguuggcuugauauuuuaaggaauugaaaccuagcaaucuuauu

SEQ ID NO: 754712 - RNA, 62 nt, Homo Sapiens
aucaaauuucugugguuuuuauggccagaaauuuuaaggacuugugugugcugggauaugag

SEQ ID NO: 754713 - RNA, 62 nt, Homo Sapiens
acuuagaguguucauugaugucucauauuacguuuaaggaagaagaguacuagacuggaccu

SEQ ID NO: 754714 - RNA, 62 nt, Homo Sapiens
gcacuacagaagaauguaccaucucugggauuuuuaaggauuuccuaaagugauuagcacua

SEQ ID NO: 754715 - RNA, 62 nt, Homo Sapiens
uuucagcgagacaaagugcagcucagacaauauuuaaggacauugcuuuugcagaauuuggu

SEQ ID NO: 754716 - RNA, 62 nt, Homo Sapiens
acuaauaacuuuuuccauguaaauuuaggcacuuuaaggagauggacaaaauuaagucuuua

SEQ ID NO: 754717 - RNA, 62 nt, Homo Sapiens
auggguuuuuguuuuuccuucauuguugagaauuuaaggaccuuugauacugcugcacaaua

SEQ ID NO: 754718 - RNA, 62 nt, Homo Sapiens
uggguaaaauaacggaucugauuagaaacuguuuuaaggaggggcugggcucgguggcucac

SEQ ID NO: 754719 - RNA, 62 nt, Homo Sapiens
ucauuucaugagucaaauuggguaaaauuacauuuaaggaugguccuaguguuugccuucuu

SEQ ID NO: 754720 - RNA, 62 nt, Homo Sapiens
aguugguguugaagugugacucugaugucccuuuuaaggagggggaguucuauuccauuuau

SEQ ID NO: 754721 - RNA, 64 nt, Homo Sapiens; identical to SEQ ID NO: 608660

SEQ ID NO: 754722 - RNA, 64 nt, Homo Sapiens; identical to SEQ ID NO: 608661

SEQ ID NO: 754723 - RNA, 64 nt, Homo Sapiens; identical to SEQ ID NO: 608662

SEQ ID NO: 754724 - RNA, 64 nt, Homo Sapiens; identical to SEQ ID NO: 608663

SEQ ID NO: 754725 - RNA, 64 nt, Homo Sapiens; identical to SEQ ID NO: 608664

SEQ ID NO: 754726 - RNA, 64 nt, Homo Sapiens; identical to SEQ ID NO: 608665

SEQ ID NO: 754727 - RNA, 64 nt, Homo Sapiens; identical to SEQ ID NO: 608666

SEQ ID NO: 754728 - RNA, 64 nt, Homo Sapiens; identical to SEQ ID NO: 608667

SEQ ID NO: 754729 - RNA, 64 nt, Homo Sapiens; identical to SEQ ID NO: 608668

SEQ ID NO: 754730 - RNA, 64 nt, Homo Sapiens; identical to SEQ ID NO: 608669

SEQ ID NO: 754731 - RNA, 64 nt, Homo Sapiens; identical to SEQ ID NO: 608670

SEQ ID NO: 754732 - RNA, 64 nt, Homo Sapiens; identical to SEQ ID NO: 608671

SEQ ID NO: 754733 - RNA, 64 nt, Homo Sapiens; identical to SEQ ID NO: 627326

SEQ ID NO: 754734 - RNA, 64 nt, Homo Sapiens; identical to SEQ ID NO: 627327

SEQ ID NO: 754735 - RNA, 64 nt, Homo Sapiens; identical to SEQ ID NO: 627328

SEQ ID NO: 754736 - RNA, 64 nt, Homo Sapiens; identical to SEQ ID NO: 627329

SEQ ID NO: 754737 - RNA, 64 nt, Homo Sapiens; identical to SEQ ID NO: 627330

SEQ ID NO: 754738 - RNA, 64 nt, Homo Sapiens; identical to SEQ ID NO: 627331

SEQ ID NO: 754739 - RNA, 64 nt, Homo Sapiens; identical to SEQ ID NO: 627332

SEQ ID NO: 754740 - RNA, 64 nt, Homo Sapiens; identical to SEQ ID NO: 627333

SEQ ID NO: 754741 - RNA, 64 nt, Homo Sapiens; identical to SEQ ID NO: 627334

SEQ ID NO: 754742 - RNA, 64 nt, Homo Sapiens; identical to SEQ ID NO: 627335

SEQ ID NO: 754743 - RNA, 64 nt, Homo Sapiens; identical to SEQ ID NO: 627336

SEQ ID NO: 754744 - RNA, 64 nt, Homo Sapiens; identical to SEQ ID NO: 627337

SEQ ID NO: 754745 - RNA, 64 nt, Homo Sapiens; identical to SEQ ID NO: 627338

SEQ ID NO: 754746 - RNA, 64 nt, Homo Sapiens; identical to SEQ ID NO: 627339

SEQ ID NO: 754747 - RNA, 64 nt, Homo Sapiens; identical to SEQ ID NO: 627340

SEQ ID NO: 754748 - RNA, 64 nt, Homo Sapiens; identical to SEQ ID NO: 627341

SEQ ID NO: 754749 - RNA, 64 nt, Homo Sapiens; identical to SEQ ID NO: 627342

SEQ ID NO: 754750 - RNA, 64 nt, Homo Sapiens; identical to SEQ ID NO: 627343

SEQ ID NO: 754751 - RNA, 64 nt, Homo Sapiens; identical to SEQ ID NO: 627344

SEQ ID NO: 754752 - RNA, 64 nt, Homo Sapiens; identical to SEQ ID NO: 627345

SEQ ID NO: 754753 - RNA, 64 nt, Homo Sapiens; identical to SEQ ID NO: 627346

SEQ ID NO: 754754 - RNA, 64 nt, Homo Sapiens; identical to SEQ ID NO: 627347

SEQ ID NO: 754755 - RNA, 64 nt, Homo Sapiens; identical to SEQ ID NO: 627348

SEQ ID NO: 754756 - RNA, 64 nt, Homo Sapiens; identical to SEQ ID NO: 627349

SEQ ID NO: 754757 - RNA, 64 nt, Homo Sapiens; identical to SEQ ID NO: 627350

SEQ ID NO: 754758 - RNA, 64 nt, Homo Sapiens; identical to SEQ ID NO: 627351

SEQ ID NO: 754759 - RNA, 64 nt, Homo Sapiens; identical to SEQ ID NO: 627352

SEQ ID NO: 754760 - RNA, 64 nt, Homo Sapiens; identical to SEQ ID NO: 627353

SEQ ID NO: 754761 - RNA, 64 nt, Homo Sapiens; identical to SEQ ID NO: 627354

SEQ ID NO: 754762 - RNA, 64 nt, Homo Sapiens; identical to SEQ ID NO: 627355

SEQ ID NO: 754763 - RNA, 64 nt, Homo Sapiens; identical to SEQ ID NO: 627356

SEQ ID NO: 754764 - RNA, 64 nt, Homo Sapiens; identical to SEQ ID NO: 627357

SEQ ID NO: 754765 - RNA, 64 nt, Homo Sapiens; identical to SEQ ID NO: 627358

SEQ ID NO: 754766 - RNA, 64 nt, Homo Sapiens; identical to SEQ ID NO: 627359

SEQ ID NO: 754767 - RNA, 59 nt, Homo Sapiens
cagagcuugaacacgcguagacuggggucccgcccgacgugucuacgucggcugaagag

SEQ ID NO: 754768 - RNA, 54 nt, Homo Sapiens
aacuaccccaugaggccugaggagccgcccgaaggucgcggugaccuggugccu

SEQ ID NO: 754769 - RNA, 64 nt, Homo Sapiens
uugacucugaaucagcauuucccuccugcuccccccgcccgacuaaggcagcucgguaaaguuu

SEQ ID NO: 754770 - RNA, 64 nt, Homo Sapiens
cgccuagagcugugcagccggcucgaacgagaggccgcccgacuugcagaccuagguugagcag

SEQ ID NO: 754771 - RNA, 64 nt, Homo Sapiens
gcagacccccgcgcacaccagaaccucuggcaagccgcccgacugcaacugcugacccugcaga

SEQ ID NO: 754772 - RNA, 64 nt, Homo Sapiens
cagccaaaaaguuggagugaaaagacccuggcacccgcccgacaccugcgugagcccuaggauc

SEQ ID NO: 754773 - RNA, 64 nt, Homo Sapiens
uucacacggcggcuucggaccaacucccucacucccgcccgaggggcaggccucaaagcccgcc

SEQ ID NO: 754774 - RNA, 64 nt, Homo Sapiens
gagccugcuuugguacuaugugccgagacucuggccgcccgaagggcaccaaacagcccaggac

SEQ ID NO: 754775 - RNA, 64 nt, Homo Sapiens
ccugcgccgguggcucccgcuaagccugucuccaccgcccgaggugcugcucuuuccuggaagc

SEQ ID NO: 754776 - RNA, 64 nt, Homo Sapiens
gccgugcaguccauggcuaggcucuccgcguuccccgcccgacuucucacaggucggugcgcuc

SEQ ID NO: 754777 - RNA, 64 nt, Homo Sapiens
accagaaccgcacggaggggccuccgccagccucccgcccgagugcucuccaacauccuccacg

SEQ ID NO: 754778 - RNA, 64 nt, Homo Sapiens
agacugcugacaguaaaccaauauuggcaaaaugccgcccgaaccuuucccuuaggauagggcu

SEQ ID NO: 754779 - RNA, 64 nt, Homo Sapiens
cccauuaaccucgagaaccuagccccagagcaccccgcccgacuucuccaagcggcccccgggc

SEQ ID NO: 754780 - RNA, 64 nt, Homo Sapiens
uuucccggagcguggagaggcagugcugcugcucccgcccgaggcucaugacaacucaauaaag

SEQ ID NO: 754781 - RNA, 64 nt, Homo Sapiens
uccaguuccgggagagcggcugcccgacucagguccgcccgaccaggaucagccccgcuccucc

SEQ ID NO: 754782 - RNA, 64 nt, Homo Sapiens
uuccauuucugcagcuuagcuuguguccugcccuccgcccgaggcaaaacguauccugaggacu

SEQ ID NO: 754783 - RNA, 64 nt, Homo Sapiens
agcaacucaguuguaacuuggggaaguuaacgauccgcccgagugcagaggaaaaccagaaacg

SEQ ID NO: 754784 - RNA, 64 nt, Homo Sapiens
gucgcccgcgcccgggaacccugacgcucagcucccgcccgacggcagcgccgccgccgcccag

SEQ ID NO: 754785 - RNA, 64 nt, Homo Sapiens
uaccaggugcucugaggggaugguggccgcccacccgcccgagggauggugccccuaggguccc

SEQ ID NO: 754786 - RNA, 64 nt, Homo Sapiens
aaguccguguccuaccuccgucuucgccaaggccccgcccgagccuaguuguucucccccugaa

SEQ ID NO: 754787 - RNA, 64 nt, Homo Sapiens
cccuaacauaaguuuucacuguggugggauggugccgcccgauaugcuugauaugcuuuuccuu

SEQ ID NO: 754788 - RNA, 64 nt, Homo Sapiens
cgccucuuauuuaugaagucuuugaccgucccccccgcccgaccccaccgcccucccgccccca

SEQ ID NO: 754789 - RNA, 64 nt, Homo Sapiens
gccugucauccauggggccauugcaggcacucugccgcccgaccuugagggcugugccaauccu

SEQ ID NO: 754790 - RNA, 64 nt, Homo Sapiens
gccucaggccccgccuccaaacccccuccccgacccgcccgacgacggcugcugcggaaaggaa

SEQ ID NO: 754791 - RNA, 64 nt, Homo Sapiens
aggaggcccugcagguaauaggccagggcaggccccgcccgaccgaugcugagcauguaccgca

SEQ ID NO: 754792 - RNA, 64 nt, Homo Sapiens
gggcagcuccggccaggccuuguaggaaaaggccccgcccgagguuccagcgucaacggccacu

SEQ ID NO: 754793 - RNA, 64 nt, Homo Sapiens
cccgcuccucgcagccgccucggugucgcugcacccgcccgagcgcgggcgcagggacccaacc

SEQ ID NO: 754794 - RNA, 64 nt, Homo Sapiens
agccucccaagccagcgcggcaccgaggcgucggccgcccgaagccugacgggagucgcggccc

SEQ ID NO: 754795 - RNA, 64 nt, Homo Sapiens
augaagaaaaaugaccugacaggaauuccuuuucccgcccgaaccuugccuuagaaaaggagaa

SEQ ID NO: 754796 - RNA, 64 nt, Homo Sapiens
gccccacuauuucuagcuccacaaguguguggccccgcccgagccccugcccacgcccuuggag

SEQ ID NO: 754797 - RNA, 64 nt, Homo Sapiens
ggagagcugagccgcgggcagccaggcccagcccccgcccgagcucaggcugccccucuccuuc

SEQ ID NO: 754798 - RNA, 64 nt, Homo Sapiens
ggaguugguaacuuguuggggcgauucgugagcgccgcccgagcccccaccccaugacuauugu

SEQ ID NO: 754799 - RNA, 64 nt, Homo Sapiens
aaauucuucagccacgaaggaaacacaagacccuccgcccgaguuuccuuuauagcgaagcaaa

SEQ ID NO: 754800 - RNA, 64 nt, Homo Sapiens
uguuccuuccucugaaucgaauggaugugggugaccgcccgaaggccuucacaggauggaagua

SEQ ID NO: 754801 - RNA, 64 nt, Homo Sapiens
cuuggagagacugucauggaagaggguggagccgccgcccgaagcgccgaggaggcugagccac

SEQ ID NO: 754802 - RNA, 64 nt, Homo Sapiens
gaccgcguuccucagccuccucuccuaggucccuccgcccgacaguugugcuuuguugugguug

SEQ ID NO: 754803 - RNA, 64 nt, Homo Sapiens
gggccagguauagaaaccgcagugggccugcaagccgcccgagccuccccagcagccuccuaca

SEQ ID NO: 754804 - RNA, 64 nt, Homo Sapiens
uggcugccuggagccccacucaagccccauccugccgcccgaggcauugcugcuccuuagcugc

SEQ ID NO: 754805 - RNA, 64 nt, Homo Sapiens
cagcccggaucugagggccccagagccgccgccgccgcccgaaccacguugcacacgcagucug

SEQ ID NO: 754806 - RNA, 64 nt, Homo Sapiens
ccgagucgggaggacuccggcacccuccuucccgccgcccgaccaccuccacccccgccacggc

SEQ ID NO: 754807 - RNA, 64 nt, Homo Sapiens
guccacuccaagccugagcaugccccaaagcgggccgcccgagcgccggugacacggccgcacc

SEQ ID NO: 754808 - RNA, 64 nt, Homo Sapiens; identical to SEQ ID NO: 147964

SEQ ID NO: 754809 - RNA, 64 nt, Homo Sapiens; identical to SEQ ID NO: 147965

SEQ ID NO: 754810 - RNA, 64 nt, Homo Sapiens; identical to SEQ ID NO: 147966

SEQ ID NO: 754811 - RNA, 64 nt, Homo Sapiens; identical to SEQ ID NO: 147967

SEQ ID NO: 754812 - RNA, 64 nt, Homo Sapiens; identical to SEQ ID NO: 147968

SEQ ID NO: 754813 - RNA, 64 nt, Homo Sapiens; identical to SEQ ID NO: 147969

SEQ ID NO: 754814 - RNA, 64 nt, Homo Sapiens; identical to SEQ ID NO: 147970

SEQ ID NO: 754815 - RNA, 64 nt, Homo Sapiens; identical to SEQ ID NO: 147971

SEQ ID NO: 754816 - RNA, 64 nt, Homo Sapiens; identical to SEQ ID NO: 147972

SEQ ID NO: 754817 - RNA, 64 nt, Homo Sapiens; identical to SEQ ID NO: 128601

SEQ ID NO: 754818 - RNA, 64 nt, Homo Sapiens; identical to SEQ ID NO: 128602

SEQ ID NO: 754819 - RNA, 64 nt, Homo Sapiens; identical to SEQ ID NO: 128603

SEQ ID NO: 754820 - RNA, 64 nt, Homo Sapiens; identical to SEQ ID NO: 128604

SEQ ID NO: 754821 - RNA, 64 nt, Homo Sapiens; identical to SEQ ID NO: 128605

SEQ ID NO: 754822 - RNA, 64 nt, Homo Sapiens; identical to SEQ ID NO: 128606

SEQ ID NO: 754823 - RNA, 64 nt, Homo Sapiens; identical to SEQ ID NO: 128607

SEQ ID NO: 754824 - RNA, 64 nt, Homo Sapiens; identical to SEQ ID NO: 128608

SEQ ID NO: 754825 - RNA, 64 nt, Homo Sapiens; identical to SEQ ID NO: 128609

SEQ ID NO: 754826 - RNA, 64 nt, Homo Sapiens; identical to SEQ ID NO: 128610

SEQ ID NO: 754827 - RNA, 64 nt, Homo Sapiens; identical to SEQ ID NO: 128611

SEQ ID NO: 754828 - RNA, 64 nt, Homo Sapiens; identical to SEQ ID NO: 128612

SEQ ID NO: 754829 - RNA, 64 nt, Homo Sapiens; identical to SEQ ID NO: 128613

SEQ ID NO: 754830 - RNA, 64 nt, Homo Sapiens; identical to SEQ ID NO: 128614

SEQ ID NO: 754831 - RNA, 64 nt, Homo Sapiens; identical to SEQ ID NO: 128615

SEQ ID NO: 754832 - RNA, 64 nt, Homo Sapiens; identical to SEQ ID NO: 128616

SEQ ID NO: 754833 - RNA, 64 nt, Homo Sapiens; identical to SEQ ID NO: 128617

SEQ ID NO: 754834 - RNA, 64 nt, Homo Sapiens; identical to SEQ ID NO: 128618

SEQ ID NO: 754835 - RNA, 64 nt, Homo Sapiens; identical to SEQ ID NO: 128619

SEQ ID NO: 754836 - RNA, 64 nt, Homo Sapiens; identical to SEQ ID NO: 128620

SEQ ID NO: 754837 - RNA, 64 nt, Homo Sapiens; identical to SEQ ID NO: 128621

SEQ ID NO: 754838 - RNA, 64 nt, Homo Sapiens; identical to SEQ ID NO: 128622

SEQ ID NO: 754839 - RNA, 64 nt, Homo Sapiens; identical to SEQ ID NO: 128623

SEQ ID NO: 754840 - RNA, 64 nt, Homo Sapiens; identical to SEQ ID NO: 128624

SEQ ID NO: 754841 - RNA, 64 nt, Homo Sapiens; identical to SEQ ID NO: 128625

SEQ ID NO: 754842 - RNA, 64 nt, Homo Sapiens; identical to SEQ ID NO: 128626

SEQ ID NO: 754843 - RNA, 64 nt, Homo Sapiens; identical to SEQ ID NO: 128627

SEQ ID NO: 754844 - RNA, 64 nt, Homo Sapiens; identical to SEQ ID NO: 128628

SEQ ID NO: 754845 - RNA, 64 nt, Homo Sapiens; identical to SEQ ID NO: 128629

SEQ ID NO: 754846 - RNA, 64 nt, Homo Sapiens; identical to SEQ ID NO: 128630

SEQ ID NO: 754847 - RNA, 64 nt, Homo Sapiens; identical to SEQ ID NO: 128631

SEQ ID NO: 754848 - RNA, 64 nt, Homo Sapiens; identical to SEQ ID NO: 128632

SEQ ID NO: 754849 - RNA, 64 nt, Homo Sapiens; identical to SEQ ID NO: 128633

SEQ ID NO: 754850 - RNA, 64 nt, Homo Sapiens; identical to SEQ ID NO: 128634

SEQ ID NO: 754851 - RNA, 64 nt, Homo Sapiens; identical to SEQ ID NO: 128635

SEQ ID NO: 754852 - RNA, 64 nt, Homo Sapiens; identical to SEQ ID NO: 128636

SEQ ID NO: 754853 - RNA, 64 nt, Homo Sapiens; identical to SEQ ID NO: 128637

SEQ ID NO: 754854 - RNA, 64 nt, Homo Sapiens; identical to SEQ ID NO: 128638

SEQ ID NO: 754855 - RNA, 64 nt, Homo Sapiens; identical to SEQ ID NO: 128639

SEQ ID NO: 754856 - RNA, 64 nt, Homo Sapiens; identical to SEQ ID NO: 128640

SEQ ID NO: 754857 - RNA, 64 nt, Homo Sapiens; identical to SEQ ID NO: 128641

SEQ ID NO: 754858 - RNA, 64 nt, Homo Sapiens; identical to SEQ ID NO: 128642

SEQ ID NO: 754859 - RNA, 64 nt, Homo Sapiens; identical to SEQ ID NO: 128643

SEQ ID NO: 754860 - RNA, 64 nt, Homo Sapiens; identical to SEQ ID NO: 128644

SEQ ID NO: 754861 - RNA, 64 nt, Homo Sapiens; identical to SEQ ID NO: 128645

SEQ ID NO: 754862 - RNA, 64 nt, Homo Sapiens; identical to SEQ ID NO: 128646

SEQ ID NO: 754863 - RNA, 64 nt, Homo Sapiens; identical to SEQ ID NO: 128647

SEQ ID NO: 754864 - RNA, 64 nt, Homo Sapiens; identical to SEQ ID NO: 697595

SEQ ID NO: 754865 - RNA, 64 nt, Homo Sapiens; identical to SEQ ID NO: 697596

SEQ ID NO: 754866 - RNA, 64 nt, Homo Sapiens; identical to SEQ ID NO: 697597

SEQ ID NO: 754867 - RNA, 64 nt, Homo Sapiens; identical to SEQ ID NO: 697598

SEQ ID NO: 754868 - RNA, 64 nt, Homo Sapiens; identical to SEQ ID NO: 697599

SEQ ID NO: 754869 - RNA, 64 nt, Homo Sapiens; identical to SEQ ID NO: 697600

SEQ ID NO: 754870 - RNA, 64 nt, Homo Sapiens; identical to SEQ ID NO: 697601

SEQ ID NO: 754871 - RNA, 64 nt, Homo Sapiens; identical to SEQ ID NO: 697602

SEQ ID NO: 754872 - RNA, 64 nt, Homo Sapiens; identical to SEQ ID NO: 697603

SEQ ID NO: 754873 - RNA, 64 nt, Homo Sapiens; identical to SEQ ID NO: 697604

SEQ ID NO: 754874 - RNA, 64 nt, Homo Sapiens; identical to SEQ ID NO: 697605

SEQ ID NO: 754875 - RNA, 64 nt, Homo Sapiens; identical to SEQ ID NO: 697606

SEQ ID NO: 754876 - RNA, 64 nt, Homo Sapiens; identical to SEQ ID NO: 697607

SEQ ID NO: 754877 - RNA, 64 nt, Homo Sapiens; identical to SEQ ID NO: 697608

SEQ ID NO: 754878 - RNA, 64 nt, Homo Sapiens; identical to SEQ ID NO: 697609

SEQ ID NO: 754879 - RNA, 64 nt, Homo Sapiens; identical to SEQ ID NO: 697610

SEQ ID NO: 754880 - RNA, 64 nt, Homo Sapiens; identical to SEQ ID NO: 697611

SEQ ID NO: 754881 - RNA, 64 nt, Homo Sapiens; identical to SEQ ID NO: 697612

SEQ ID NO: 754882 - RNA, 64 nt, Homo Sapiens; identical to SEQ ID NO: 697613

SEQ ID NO: 754883 - RNA, 64 nt, Homo Sapiens; identical to SEQ ID NO: 697614

SEQ ID NO: 754884 - RNA, 64 nt, Homo Sapiens; identical to SEQ ID NO: 697615

SEQ ID NO: 754885 - RNA, 64 nt, Homo Sapiens; identical to SEQ ID NO: 697616

SEQ ID NO: 754886 - RNA, 64 nt, Homo Sapiens; identical to SEQ ID NO: 697617

SEQ ID NO: 754887 - RNA, 64 nt, Homo Sapiens; identical to SEQ ID NO: 697618

SEQ ID NO: 754888 - RNA, 64 nt, Homo Sapiens; identical to SEQ ID NO: 697619

SEQ ID NO: 754889 - RNA, 64 nt, Homo Sapiens; identical to SEQ ID NO: 697620

SEQ ID NO: 754890 - RNA, 64 nt, Homo Sapiens; identical to SEQ ID NO: 697621

SEQ ID NO: 754891 - RNA, 64 nt, Homo Sapiens; identical to SEQ ID NO: 697622

SEQ ID NO: 754892 - RNA, 64 nt, Homo Sapiens; identical to SEQ ID NO: 697623

SEQ ID NO: 754893 - RNA, 64 nt, Homo Sapiens; identical to SEQ ID NO: 697624

SEQ ID NO: 754894 - RNA, 64 nt, Homo Sapiens; identical to SEQ ID NO: 697625

SEQ ID NO: 754895 - RNA, 64 nt, Homo Sapiens; identical to SEQ ID NO: 153734

SEQ ID NO: 754896 - RNA, 64 nt, Homo Sapiens; identical to SEQ ID NO: 153735

SEQ ID NO: 754897 - RNA, 64 nt, Homo Sapiens; identical to SEQ ID NO: 153736

SEQ ID NO: 754898 - RNA, 64 nt, Homo Sapiens; identical to SEQ ID NO: 153737

SEQ ID NO: 754899 - RNA, 64 nt, Homo Sapiens; identical to SEQ ID NO: 153738

SEQ ID NO: 754900 - RNA, 64 nt, Homo Sapiens; identical to SEQ ID NO: 153739

SEQ ID NO: 754901 - RNA, 64 nt, Homo Sapiens; identical to SEQ ID NO: 153740

SEQ ID NO: 754902 - RNA, 64 nt, Homo Sapiens; identical to SEQ ID NO: 153741

SEQ ID NO: 754903 - RNA, 64 nt, Homo Sapiens; identical to SEQ ID NO: 153742

SEQ ID NO: 754904 - RNA, 64 nt, Homo Sapiens; identical to SEQ ID NO: 153743

SEQ ID NO: 754905 - RNA, 64 nt, Homo Sapiens; identical to SEQ ID NO: 153744

SEQ ID NO: 754906 - RNA, 64 nt, Homo Sapiens; identical to SEQ ID NO: 153745

SEQ ID NO: 754907 - RNA, 64 nt, Homo Sapiens; identical to SEQ ID NO: 153746

SEQ ID NO: 754908 - RNA, 64 nt, Homo Sapiens; identical to SEQ ID NO: 153747

SEQ ID NO: 754909 - RNA, 64 nt, Homo Sapiens; identical to SEQ ID NO: 153748

SEQ ID NO: 754910 - RNA, 64 nt, Homo Sapiens; identical to SEQ ID NO: 153749

SEQ ID NO: 754911 - RNA, 64 nt, Homo Sapiens; identical to SEQ ID NO: 153750

SEQ ID NO: 754912 - RNA, 64 nt, Homo Sapiens; identical to SEQ ID NO: 153751

SEQ ID NO: 754913 - RNA, 64 nt, Homo Sapiens; identical to SEQ ID NO: 153752

SEQ ID NO: 754914 - RNA, 64 nt, Homo Sapiens; identical to SEQ ID NO: 153753

SEQ ID NO: 754915 - RNA, 64 nt, Homo Sapiens; identical to SEQ ID NO: 153754

SEQ ID NO: 754916 - RNA, 64 nt, Homo Sapiens; identical to SEQ ID NO: 153755

SEQ ID NO: 754917 - RNA, 64 nt, Homo Sapiens; identical to SEQ ID NO: 153756

SEQ ID NO: 754918 - RNA, 64 nt, Homo Sapiens; identical to SEQ ID NO: 153757

SEQ ID NO: 754919 - RNA, 64 nt, Homo Sapiens; identical to SEQ ID NO: 153758

SEQ ID NO: 754920 - RNA, 64 nt, Homo Sapiens; identical to SEQ ID NO: 153759

SEQ ID NO: 754921 - RNA, 64 nt, Homo Sapiens; identical to SEQ ID NO: 153760

SEQ ID NO: 754922 - RNA, 64 nt, Homo Sapiens; identical to SEQ ID NO: 153761

SEQ ID NO: 754923 - RNA, 64 nt, Homo Sapiens; identical to SEQ ID NO: 153762

SEQ ID NO: 754924 - RNA, 64 nt, Homo Sapiens; identical to SEQ ID NO: 153763

SEQ ID NO: 754925 - RNA, 64 nt, Homo Sapiens; identical to SEQ ID NO: 153764

SEQ ID NO: 754926 - RNA, 64 nt, Homo Sapiens; identical to SEQ ID NO: 153765

SEQ ID NO: 754927 - RNA, 64 nt, Homo Sapiens; identical to SEQ ID NO: 153766

SEQ ID NO: 754928 - RNA, 64 nt, Homo Sapiens; identical to SEQ ID NO: 153767

SEQ ID NO: 754929 - RNA, 64 nt, Homo Sapiens; identical to SEQ ID NO: 153768

SEQ ID NO: 754930 - RNA, 64 nt, Homo Sapiens; identical to SEQ ID NO: 153769

SEQ ID NO: 754931 - RNA, 64 nt, Homo Sapiens; identical to SEQ ID NO: 153770

SEQ ID NO: 754932 - RNA, 64 nt, Homo Sapiens; identical to SEQ ID NO: 153771

SEQ ID NO: 754933 - RNA, 64 nt, Homo Sapiens; identical to SEQ ID NO: 153772

SEQ ID NO: 754934 - RNA, 64 nt, Homo Sapiens; identical to SEQ ID NO: 153773

SEQ ID NO: 754935 - RNA, 64 nt, Homo Sapiens; identical to SEQ ID NO: 153774

SEQ ID NO: 754936 - RNA, 64 nt, Homo Sapiens; identical to SEQ ID NO: 153775

SEQ ID NO: 754937 - RNA, 64 nt, Homo Sapiens; identical to SEQ ID NO: 153776

SEQ ID NO: 754938 - RNA, 64 nt, Homo Sapiens; identical to SEQ ID NO: 153777

SEQ ID NO: 754939 - RNA, 64 nt, Homo Sapiens; identical to SEQ ID NO: 153778

SEQ ID NO: 754940 - RNA, 64 nt, Homo Sapiens; identical to SEQ ID NO: 153779

SEQ ID NO: 754941 - RNA, 64 nt, Homo Sapiens; identical to SEQ ID NO: 153780

SEQ ID NO: 754942 - RNA, 64 nt, Homo Sapiens; identical to SEQ ID NO: 153781

SEQ ID NO: 754943 - RNA, 64 nt, Homo Sapiens; identical to SEQ ID NO: 153782

SEQ ID NO: 754944 - RNA, 64 nt, Homo Sapiens; identical to SEQ ID NO: 153783

SEQ ID NO: 754945 - RNA, 64 nt, Homo Sapiens; identical to SEQ ID NO: 153784

SEQ ID NO: 754946 - RNA, 64 nt, Homo Sapiens; identical to SEQ ID NO: 153785

SEQ ID NO: 754947 - RNA, 64 nt, Homo Sapiens; identical to SEQ ID NO: 153786

SEQ ID NO: 754948 - RNA, 64 nt, Homo Sapiens; identical to SEQ ID NO: 153787

SEQ ID NO: 754949 - RNA, 64 nt, Homo Sapiens; identical to SEQ ID NO: 153788

SEQ ID NO: 754950 - RNA, 64 nt, Homo Sapiens; identical to SEQ ID NO: 153789

SEQ ID NO: 754951 - RNA, 64 nt, Homo Sapiens; identical to SEQ ID NO: 153790

SEQ ID NO: 754952 - RNA, 64 nt, Homo Sapiens; identical to SEQ ID NO: 153791

SEQ ID NO: 754953 - RNA, 64 nt, Homo Sapiens; identical to SEQ ID NO: 153792

SEQ ID NO: 754954 - RNA, 64 nt, Homo Sapiens; identical to SEQ ID NO: 153793

SEQ ID NO: 754955 - RNA, 64 nt, Homo Sapiens; identical to SEQ ID NO: 153794

SEQ ID NO: 754956 - RNA, 64 nt, Homo Sapiens; identical to SEQ ID NO: 153795

SEQ ID NO: 754957 - RNA, 64 nt, Homo Sapiens; identical to SEQ ID NO: 153796

SEQ ID NO: 754958 - RNA, 64 nt, Homo Sapiens; identical to SEQ ID NO: 153797

SEQ ID NO: 754959 - RNA, 64 nt, Homo Sapiens; identical to SEQ ID NO: 153798

SEQ ID NO: 754960 - RNA, 64 nt, Homo Sapiens; identical to SEQ ID NO: 153799

SEQ ID NO: 754961 - RNA, 64 nt, Homo Sapiens; identical to SEQ ID NO: 153800

SEQ ID NO: 754962 - RNA, 64 nt, Homo Sapiens; identical to SEQ ID NO: 153801

SEQ ID NO: 754963 - RNA, 64 nt, Homo Sapiens; identical to SEQ ID NO: 153802

SEQ ID NO: 754964 - RNA, 64 nt, Homo Sapiens; identical to SEQ ID NO: 153803

SEQ ID NO: 754965 - RNA, 64 nt, Homo Sapiens; identical to SEQ ID NO: 153804

SEQ ID NO: 754966 - RNA, 64 nt, Homo Sapiens; identical to SEQ ID NO: 153805

SEQ ID NO: 754967 - RNA, 64 nt, Homo Sapiens; identical to SEQ ID NO: 153806

SEQ ID NO: 754968 - RNA, 64 nt, Homo Sapiens; identical to SEQ ID NO: 153807

SEQ ID NO: 754969 - RNA, 64 nt, Homo Sapiens; identical to SEQ ID NO: 153808

SEQ ID NO: 754970 - RNA, 64 nt, Homo Sapiens; identical to SEQ ID NO: 153809

SEQ ID NO: 754971 - RNA, 64 nt, Homo Sapiens; identical to SEQ ID NO: 153810

SEQ ID NO: 754972 - RNA, 64 nt, Homo Sapiens; identical to SEQ ID NO: 153811

SEQ ID NO: 754973 - RNA, 64 nt, Homo Sapiens; identical to SEQ ID NO: 153812

SEQ ID NO: 754974 - RNA, 64 nt, Homo Sapiens; identical to SEQ ID NO: 153813

SEQ ID NO: 754975 - RNA, 64 nt, Homo Sapiens; identical to SEQ ID NO: 153814

SEQ ID NO: 754976 - RNA, 64 nt, Homo Sapiens; identical to SEQ ID NO: 153815

SEQ ID NO: 754977 - RNA, 64 nt, Homo Sapiens; identical to SEQ ID NO: 153816

SEQ ID NO: 754978 - RNA, 64 nt, Homo Sapiens; identical to SEQ ID NO: 153817

SEQ ID NO: 754979 - RNA, 64 nt, Homo Sapiens; identical to SEQ ID NO: 153818

SEQ ID NO: 754980 - RNA, 64 nt, Homo Sapiens; identical to SEQ ID NO: 153819

SEQ ID NO: 754981 - RNA, 64 nt, Homo Sapiens; identical to SEQ ID NO: 153820

SEQ ID NO: 754982 - RNA, 64 nt, Homo Sapiens; identical to SEQ ID NO: 153821

SEQ ID NO: 754983 - RNA, 64 nt, Homo Sapiens; identical to SEQ ID NO: 153822

SEQ ID NO: 754984 - RNA, 64 nt, Homo Sapiens; identical to SEQ ID NO: 153823

SEQ ID NO: 754985 - RNA, 64 nt, Homo Sapiens; identical to SEQ ID NO: 153824

SEQ ID NO: 754986 - RNA, 64 nt, Homo Sapiens; identical to SEQ ID NO: 153825

SEQ ID NO: 754987 - RNA, 64 nt, Homo Sapiens; identical to SEQ ID NO: 153826

SEQ ID NO: 754988 - RNA, 64 nt, Homo Sapiens; identical to SEQ ID NO: 153827

SEQ ID NO: 754989 - RNA, 64 nt, Homo Sapiens; identical to SEQ ID NO: 153828

SEQ ID NO: 754990 - RNA, 64 nt, Homo Sapiens; identical to SEQ ID NO: 153829

SEQ ID NO: 754991 - RNA, 64 nt, Homo Sapiens; identical to SEQ ID NO: 153830

SEQ ID NO: 754992 - RNA, 64 nt, Homo Sapiens; identical to SEQ ID NO: 153831

SEQ ID NO: 754993 - RNA, 64 nt, Homo Sapiens; identical to SEQ ID NO: 153832

SEQ ID NO: 754994 - RNA, 64 nt, Homo Sapiens; identical to SEQ ID NO: 153833

SEQ ID NO: 754995 - RNA, 64 nt, Homo Sapiens; identical to SEQ ID NO: 153834

SEQ ID NO: 754996 - RNA, 64 nt, Homo Sapiens; identical to SEQ ID NO: 153835

SEQ ID NO: 754997 - RNA, 64 nt, Homo Sapiens; identical to SEQ ID NO: 153836

SEQ ID NO: 754998 - RNA, 64 nt, Homo Sapiens; identical to SEQ ID NO: 153837

SEQ ID NO: 754999 - RNA, 64 nt, Homo Sapiens; identical to SEQ ID NO: 153838

SEQ ID NO: 755000 - RNA, 64 nt, Homo Sapiens; identical to SEQ ID NO: 153839

SEQ ID NO: 755001 - RNA, 64 nt, Homo Sapiens; identical to SEQ ID NO: 153840

SEQ ID NO: 755002 - RNA, 64 nt, Homo Sapiens; identical to SEQ ID NO: 153841

SEQ ID NO: 755003 - RNA, 64 nt, Homo Sapiens; identical to SEQ ID NO: 153842

SEQ ID NO: 755004 - RNA, 64 nt, Homo Sapiens; identical to SEQ ID NO: 153843

SEQ ID NO: 755005 - RNA, 64 nt, Homo Sapiens; identical to SEQ ID NO: 153844

SEQ ID NO: 755006 - RNA, 64 nt, Homo Sapiens; identical to SEQ ID NO: 153845

SEQ ID NO: 755007 - RNA, 64 nt, Homo Sapiens; identical to SEQ ID NO: 153846

SEQ ID NO: 755008 - RNA, 64 nt, Homo Sapiens
agaacuaagaaugccaagguuuuauauauguguguauauauauauauauauauauauauauaug

SEQ ID NO: 755009 - RNA, 64 nt, Homo Sapiens
aacuaagaaugccaagguuuuauauauguguguauauauauauauauauauauauauauauguu

SEQ ID NO: 755010 - RNA, 64 nt, Homo Sapiens
cuaagaaugccaagguuuuauauauguguguauauauauauauauauauauauauauauguuug

SEQ ID NO: 755011 - RNA, 64 nt, Homo Sapiens
aagaaugccaagguuuuauauauguguguauauauauauauauauauauauauauauguuugug

SEQ ID NO: 755012 - RNA, 64 nt, Homo Sapiens
gaaugccaagguuuuauauauguguguauauauauauauauauauauauauauauguuugugug

SEQ ID NO: 755013 - RNA, 64 nt, Homo Sapiens
augccaagguuuuauauauguguguauauauauauauauauauauauauauauguuugugugug

SEQ ID NO: 755014 - RNA, 64 nt, Homo Sapiens
gccaagguuuuauauauguguguauauauauauauauauauauauauauauguuugugugugua

SEQ ID NO: 755015 - RNA, 64 nt, Homo Sapiens
caagguuuuauauauguguguauauauauauauauauauauauauauauguuuguguguguaua

SEQ ID NO: 755016 - RNA, 64 nt, Homo Sapiens
uguguguguauauauauauauauauauauauauauauauauauauauguuuguguguguauaua

SEQ ID NO: 755017 - RNA, 64 nt, Homo Sapiens
uguguguauauauauauauauauauauauauauauauauauauauguuuguguguguauauaua

SEQ ID NO: 755018 - RNA, 64 nt, Homo Sapiens
uguguauauauauauauauauauauauauauauauauauauauguuuguguguguauauauaua

SEQ ID NO: 755019 - RNA, 64 nt, Homo Sapiens
uauauauauauauauauauauauguuuguguguguauauauauauauauauauauauguuugug

SEQ ID NO: 755020 - RNA, 64 nt, Homo Sapiens
uauauauauauauauauauauguuuguguguguauauauauauauauauauauauguuugugug

SEQ ID NO: 755021 - RNA, 64 nt, Homo Sapiens
uauauauauauauauauauguuuguguguguauauauauauauauauauauauguuugugugug

SEQ ID NO: 755022 - RNA, 64 nt, Homo Sapiens
uauauauauauauauauguuuguguguguauauauauauauauauauauauguuugugugugua

SEQ ID NO: 755023 - RNA, 64 nt, Homo Sapiens
uauauauauauauauguuuguguguguauauauauauauauauauauauguuuguguguguaua

SEQ ID NO: 755024 - RNA, 64 nt, Homo Sapiens
uauauauauauauguuuguguguguauauauauauauauauauauauguuuguguguguauaua

SEQ ID NO: 755025 - RNA, 64 nt, Homo Sapiens
uauauauauauguuuguguguguauauauauauauauauauauauguuuguguguguauauaua

SEQ ID NO: 755026 - RNA, 64 nt, Homo Sapiens
uauauauauguuuguguguguauauauauauauauauauauauguuuguguguguauauauaug

SEQ ID NO: 755027 - RNA, 64 nt, Homo Sapiens
uauauauauauauauauauauauguuuguguguguauauauauguuuguguauauauauacaca

SEQ ID NO: 755028 - RNA, 64 nt, Homo Sapiens
uauauauguuuguguguguauauauauguuuguguauauauauacacauaugcauacauaugau

SEQ ID NO: 755029 - RNA, 64 nt, Homo Sapiens
uauauguuuguguguguauauauauguuuguguauauauauacacauaugcauacauaugauuu

SEQ ID NO: 755030 - RNA, 64 nt, Homo Sapiens
acaauagaugacuuuauuuguuuaaaauguuuaauauauauacauacauauauauauauuuguc

SEQ ID NO: 755031 - RNA, 64 nt, Homo Sapiens
uauuuguuuaaaauguuuaauauauauacauacauauauauauauuugucuguaagaauuaugu

SEQ ID NO: 755032 - RNA, 64 nt, Homo Sapiens
uuuguuuaaaauguuuaauauauauacauacauauauauauauuugucuguaagaauuauguuu

SEQ ID NO: 755033 - RNA, 64 nt, Homo Sapiens
cucuuggugggauaugcagaacuugggauguguguauauauaaauauauaauauauauaaauau

SEQ ID NO: 755034 - RNA, 64 nt, Homo Sapiens
agaacuugggauguguguauauauaaauauauaauauauauaaauauauauaauacugacuuaa

SEQ ID NO: 755035 - RNA, 64 nt, Homo Sapiens
auguguguauauauaaauauauaauauauauaaauauauauaauacugacuuaaaaaaucaaau

SEQ ID NO: 755036 - RNA, 64 nt, Homo Sapiens
uuguauacauuucuuauuuacgauuuucauuuguuauauauauauauaaauauacuguauauau

SEQ ID NO: 755037 - RNA, 64 nt, Homo Sapiens
guauacauuucuuauuuacgauuuucauuuguuauauauauauauaaauauacuguauauauau

SEQ ID NO: 755038 - RNA, 64 nt, Homo Sapiens
auacauuucuuauuuacgauuuucauuuguuauauauauauauaaauauacuguauauauaugc

SEQ ID NO: 755039 - RNA, 64 nt, Homo Sapiens
acauuucuuauuuacgauuuucauuuguuauauauauauauaaauauacuguauauauaugcaa

SEQ ID NO: 755040 - RNA, 64 nt, Homo Sapiens
uuuucauuuguuauauauauauauaaauauacuguauauauaugcaacauuuuauauuuuucau

SEQ ID NO: 755041 - RNA, 64 nt, Homo Sapiens
ucauauaaucucgggauacacacacacacacacauauauauacacacacauacguauacacaca

SEQ ID NO: 755042 - RNA, 64 nt, Homo Sapiens
uauauacacacacauacguauacacacacauacauauauauaaauauaccugaugccagauuuu

SEQ ID NO: 755043 - RNA, 64 nt, Homo Sapiens
acgaauccugaaaauuaugcuagcaugauuuuuuuauauauagaaguuuaaaaauaaaccaggu

SEQ ID NO: 755044 - RNA, 64 nt, Homo Sapiens
uuguuugaaugaugcauguuauugacaaggcaaauauauauauauacacagucuguuucuucua

SEQ ID NO: 755045 - RNA, 64 nt, Homo Sapiens
guuugaaugaugcauguuauugacaaggcaaauauauauauauacacagucuguuucuucuauu

SEQ ID NO: 755046 - RNA, 64 nt, Homo Sapiens
uugaaugaugcauguuauugacaaggcaaauauauauauauacacagucuguuucuucuauucc

SEQ ID NO: 755047 - RNA, 64 nt, Homo Sapiens
aauuuuaaagauaauguuauguguguaugugaaauauauauacauauauauauauauguuuauu

SEQ ID NO: 755048 - RNA, 64 nt, Homo Sapiens
auaauguuauguguguaugugaaauauauauacauauauauauauauguuuauuuccuaaaaga

SEQ ID NO: 755049 - RNA, 64 nt, Homo Sapiens
aauguuauguguguaugugaaauauauauacauauauauauauauguuuauuuccuaaaagaag

SEQ ID NO: 755050 - RNA, 64 nt, Homo Sapiens
uguuauguguguaugugaaauauauauacauauauauauauauuuccuaaaagaagaaaagaua

SEQ ID NO: 755051 - RNA, 64 nt, Homo Sapiens
aauuaucuuuuuaaaguaaauaaaauuaugaaaauauauauaguauauauaaaguacuguguuu

SEQ ID NO: 755052 - RNA, 64 nt, Homo Sapiens
uuuaaaguaaauaaaauuaugaaaauauauauaguauauauaaaguacuguguuuaaaaaaaug

SEQ ID NO: 755053 - RNA, 64 nt, Homo Sapiens
uguguguguauguguauguguauguacacauacauauauauaguugacacuugaaaaaugcagg

SEQ ID NO: 755054 - RNA, 64 nt, Homo Sapiens
agccuguuauugacugggagccugacugauguauuauauauauuguauacuguauucuuaaagu

SEQ ID NO: 755055 - RNA, 64 nt, Homo Sapiens
cuguucagacauauauauguauguauguaaaaauuauauauacacaaauuagcugcacguauau

SEQ ID NO: 755056 - RNA, 64 nt, Homo Sapiens
uuauauauacacaaauuagcugcacguauauacauauauauauuucuuuuuaaauuucauauug

SEQ ID NO: 755057 - RNA, 64 nt, Homo Sapiens
uugcccaggaaauggguugauucaucacagauuuuauauauauacuuuuuuuuaacuaagugug

SEQ ID NO: 755058 - RNA, 64 nt, Homo Sapiens
gcccaggaaauggguugauucaucacagauuuuauauauauacuuuuuuuuaacuaagugugag

SEQ ID NO: 755059 - RNA, 64 nt, Homo Sapiens
uuuuuucauauuuuguuugucuauauuauauaaauauauauauacaguuauauauauauauauu

SEQ ID NO: 755060 - RNA, 64 nt, Homo Sapiens
uuuucauauuuuguuugucuauauuauauaaauauauauauacaguuauauauauauauauuau

SEQ ID NO: 755061 - RNA, 64 nt, Homo Sapiens
guuugucuauauuauauaaauauauauauacaguuauauauauauauauuauuuuuugguucuc

SEQ ID NO: 755062 - RNA, 64 nt, Homo Sapiens
uugucuauauuauauaaauauauauauacaguuauauauauauauauuauuuuuugguucucuc

SEQ ID NO: 755063 - RNA, 64 nt, Homo Sapiens
gucuauauuauauaaauauauauauacaguuauauauauauauauuauuuuuugguucucucuc

SEQ ID NO: 755064 - RNA, 64 nt, Homo Sapiens
cuauauuauauaaauauauauauacaguuauauauauauauauuauuuuuugguucucucucgu

SEQ ID NO: 755065 - RNA, 64 nt, Homo Sapiens
uguuuuugucuuuuuccuuuauucuuuuuguaaauauauauauaaugaguuucauuaaaauaga

SEQ ID NO: 755066 - RNA, 64 nt, Homo Sapiens
uuuuugucuuuuuccuuuauucuuuuuguaaauauauauauaaugaguuucauuaaaauagauu

SEQ ID NO: 755067 - RNA, 64 nt, Homo Sapiens
gcgagacccugucucaaaauauguauauauuuaauauauauauaaaaccagagcugacaaugac

SEQ ID NO: 755068 - RNA, 64 nt, Homo Sapiens
gagacccugucucaaaauauguauauauuuaauauauauauaaaaccagagcugacaaugacac

SEQ ID NO: 755069 - RNA, 64 nt, Homo Sapiens
aaguuuuaaaaaaaacuacagcagccaaagaaacuauauauauauauauauauauauauaucca

SEQ ID NO: 755070 - RNA, 64 nt, Homo Sapiens
guuuuaaaaaaaacuacagcagccaaagaaacuauauauauauauauauauauauauauccaga

SEQ ID NO: 755071 - RNA, 64 nt, Homo Sapiens
uuuaaaaaaaacuacagcagccaaagaaacuauauauauauauauauauauauauauccagaau

SEQ ID NO: 755072 - RNA, 64 nt, Homo Sapiens
uaaaaaaaacuacagcagccaaagaaacuauauauauauauauauauauauauauccagaauga

SEQ ID NO: 755073 - RNA, 64 nt, Homo Sapiens
aaaaaaacuacagcagccaaagaaacuauauauauauauauauauauauauauccagaaugauu

SEQ ID NO: 755074 - RNA, 64 nt, Homo Sapiens
aaaaacuacagcagccaaagaaacuauauauauauauauauauauauauauccagaaugauugc

SEQ ID NO: 755075 - RNA, 64 nt, Homo Sapiens
aaacuacagcagccaaagaaacuauauauauauauauauauauauauauccagaaugauugccu

SEQ ID NO: 755076 - RNA, 64 nt, Homo Sapiens
acuacagcagccaaagaaacuauauauauauauauauauauauauauccagaaugauugccucu

SEQ ID NO: 755077 - RNA, 64 nt, Homo Sapiens
uacagcagccaaagaaacuauauauauauauauauauauauauauccagaaugauugccucuac

SEQ ID NO: 755078 - RNA, 64 nt, Homo Sapiens
cagcagccaaagaaacuauauauauauauauauauauauauauccagaaugauugccucuacug

SEQ ID NO: 755079 - RNA, 64 nt, Homo Sapiens
ucuuucgugccuuaaggauagugagaugcacacuuauauauauacuguauauauuuauauauuu

SEQ ID NO: 755080 - RNA, 64 nt, Homo Sapiens
uuucgugccuuaaggauagugagaugcacacuuauauauauacuguauauauuuauauauuuau

SEQ ID NO: 755081 - RNA, 64 nt, Homo Sapiens
acacuuauauauauacuguauauauuuauauauuuauauauauauuucauauauauauauaaua

SEQ ID NO: 755082 - RNA, 64 nt, Homo Sapiens
acuuauauauauacuguauauauuuauauauuuauauauauauuucauauauauauauaauauu

SEQ ID NO: 755083 - RNA, 64 nt, Homo Sapiens
cuguauauauuuauauauuuauauauauauuucauauauauauauaauauugcaagcuuaaguu

SEQ ID NO: 755084 - RNA, 64 nt, Homo Sapiens
guauauauuuauauauuuauauauauauuucauauauauauauaauauugcaagcuuaaguuug

SEQ ID NO: 755085 - RNA, 64 nt, Homo Sapiens
auauauuuauauauuuauauauauauuucauauauauauauaauauugcaagcuuaaguuugca

SEQ ID NO: 755086 - RNA, 64 nt, Homo Sapiens
cuugguugauggccaugcaucuucagucagaauuuauauauaaauguaugcacccauuuuuuug

SEQ ID NO: 755087 - RNA, 64 nt, Homo Sapiens
gcauaacauacugcuauuggucuuuuuauauaaauauauauauauauauacauauauauauaua

SEQ ID NO: 755088 - RNA, 64 nt, Homo Sapiens
auaacauacugcuauuggucuuuuuauauaaauauauauauauauauacauauauauauauaau

SEQ ID NO: 755089 - RNA, 64 nt, Homo Sapiens
aacauacugcuauuggucuuuuuauauaaauauauauauauauauacauauauauauauaauuu

SEQ ID NO: 755090 - RNA, 64 nt, Homo Sapiens
cauacugcuauuggucuuuuuauauaaauauauauauauauauacauauauauauauaauuuga

SEQ ID NO: 755091 - RNA, 64 nt, Homo Sapiens
uacugcuauuggucuuuuuauauaaauauauauauauauauacauauauauauauaauuugaau

SEQ ID NO: 755092 - RNA, 64 nt, Homo Sapiens
ggucuuuuuauauaaauauauauauauauauacauauauauauauaauuugaauuuuuggaaac

SEQ ID NO: 755093 - RNA, 64 nt, Homo Sapiens
ucuuuuuauauaaauauauauauauauauacauauauauauauaauuugaauuuuuggaaacuu

SEQ ID NO: 755094 - RNA, 64 nt, Homo Sapiens
uuuuuauauaaauauauauauauauauacauauauauauauaauuugaauuuuuggaaacuuua

SEQ ID NO: 755095 - RNA, 64 nt, Homo Sapiens
acaagcaugagugugauuguaugugcacuguguguauauauauaaauauauguauauguauggu

SEQ ID NO: 755096 - RNA, 64 nt, Homo Sapiens
aagcaugagugugauuguaugugcacuguguguauauauauaaauauauguauauguaugguug

SEQ ID NO: 755097 - RNA, 64 nt, Homo Sapiens
uguagagucuagauuuauauacugcaauguaaaauauauauauauuuaccuuuuuuaaagacaa

SEQ ID NO: 755098 - RNA, 64 nt, Homo Sapiens
uagagucuagauuuauauacugcaauguaaaauauauauauauuuaccuuuuuuaaagacaaug

SEQ ID NO: 755099 - RNA, 64 nt, Homo Sapiens
uauuuuauuuuugagaaggaaaaaaaaagucauguauauauacacauaaaggcauauagcuaua

SEQ ID NO: 755100 - RNA, 64 nt, Homo Sapiens
aagucauguauauauacacauaaaggcauauagcuauauauaaagagauaaggguguuuaugaa

SEQ ID NO: 755101 - RNA, 64 nt, Homo Sapiens
aaauuagcaguuucauaagauucaaccaaauaaauauauauauacacacacacauacauauaca

SEQ ID NO: 755102 - RNA, 64 nt, Homo Sapiens
auuagcaguuucauaagauucaaccaaauaaauauauauauacacacacacauacauauacacc

SEQ ID NO: 755103 - RNA, 64 nt, Homo Sapiens
augcugguuuuguguuuuauccaacuuuugugcauauauauaaaguaugucauggcaugguuug

SEQ ID NO: 755104 - RNA, 64 nt, Homo Sapiens
agaaguauuuccuguaacuauagaaagaauuauguauauauacaugcagaaauauauaugugug

SEQ ID NO: 755105 - RNA, 64 nt, Homo Sapiens
uguaucuguggauggauauauguauaucucuuccuauauauauccauaguggacuuauucagaa

SEQ ID NO: 755106 - RNA, 53 nt, Homo Sapiens
cucaagaacuuuggaaauaauuuuauauauauauaaauaauauauauauauau

SEQ ID NO: 755107 - RNA, 55 nt, Homo Sapiens
cucaagaacuuuggaaauaauuuuauauauauauaaauaauauauauauauauac

SEQ ID NO: 755108 - RNA, 57 nt, Homo Sapiens
cucaagaacuuuggaaauaauuuuauauauauauaaauaauauauauauauauacau

SEQ ID NO: 755109 - RNA, 64 nt, Homo Sapiens
aacuuuggaaauaauuuuauauauauauaaauaauauauauauauauacauauauauaaauaga

SEQ ID NO: 755110 - RNA, 64 nt, Homo Sapiens
cuuuggaaauaauuuuauauauauauaaauaauauauauauauauacauauauauaaauagauc

SEQ ID NO: 755111 - RNA, 64 nt, Homo Sapiens
uuggaaauaauuuuauauauauauaaauaauauauauauauauacauauauauaaauagaucuc

SEQ ID NO: 755112 - RNA, 64 nt, Homo Sapiens
ggaaauaauuuuauauauauauaaauaauauauauauauauacauauauauaaauagaucucua

SEQ ID NO: 755113 - RNA, 64 nt, Homo Sapiens
uuauauauauauaaauaauauauauauauauacauauauauaaauagaucucuauauaguugug

SEQ ID NO: 755114 - RNA, 64 nt, Homo Sapiens
uagagagaucuauacagguacuuuuauauauauauauauauaaacuauuuaacugcuaaagaac

SEQ ID NO: 755115 - RNA, 64 nt, Homo Sapiens
aauagagagaucuauacaggaccuuuuauauauauauauauauaaucuauuuaacugcuaaaga

SEQ ID NO: 755116 - RNA, 64 nt, Homo Sapiens
uaaauagagagaucuauacagaaccuuuuauauauauauauauagaaucuauuuaacugcuaaa

SEQ ID NO: 755117 - RNA, 64 nt, Homo Sapiens
uauaaauagagagaucuauaaagaaccuuuuauauauauauauauggaaucuauuuaacugcua

SEQ ID NO: 755118 - RNA, 64 nt, Homo Sapiens
uauauaaauagagagaucuauaaagaaccuuuuauauauauauaauuggaaucuauuuaacugc

SEQ ID NO: 755119 - RNA, 64 nt, Homo Sapiens
uauauauaaauagagagaucgcuaaagaaccuuuuauauauauaauauuggaaucuauuuaacu

SEQ ID NO: 755120 - RNA, 64 nt, Homo Sapiens
cacauauacacaugccuucuaagaaauauauauauauauauacaucucaccaaucaacacuuuu

SEQ ID NO: 755121 - RNA, 64 nt, Homo Sapiens
cacacauauacacaugccuuuuaagaaauauauauauauauauauuucucaccaaucaacacuu

SEQ ID NO: 755122 - RNA, 64 nt, Homo Sapiens
uacacacauauacacaugccuuuuaagaaauauauauauauauacuuuucucaccaaucaacac

SEQ ID NO: 755123 - RNA, 64 nt, Homo Sapiens
uauacacacauauacacaugacuuuuaagaaauauauauauauauucuuuucucaccaaucaac

SEQ ID NO: 755124 - RNA, 64 nt, Homo Sapiens
uauauacacacauauacacaacacuuuuaagaaauauauauauauauucuuuucucaccaauca

SEQ ID NO: 755125 - RNA, 64 nt, Homo Sapiens
ucuuggaguaaacauuuuaauauuauuuuuuuuauauauauauuguuuagugcuguaauugucu

SEQ ID NO: 755126 - RNA, 64 nt, Homo Sapiens
uuucuuggaguaaacauuuucuuauuauuuuuuuuauauauauaugguuuagugcuguaauugu

SEQ ID NO: 755127 - RNA, 64 nt, Homo Sapiens
gaaaaagguuucagaguugcuauauauauauauauauauauaaucacuguuuauaaaaaauaua

SEQ ID NO: 755128 - RNA, 64 nt, Homo Sapiens
augaaaaagguuucagaguuuauauauauauauauauauauauaaacacuguuuauaaaaaaua

SEQ ID NO: 755129 - RNA, 64 nt, Homo Sapiens
uaaugaaaaagguuucagaguauauauauauauauauauauauauuaacacuguuuauaaaaaa

SEQ ID NO: 755130 - RNA, 64 nt, Homo Sapiens
uauaaugaaaaagguuucagaauauauauauauauauauauauaauuuaacacuguuuauaaaa

SEQ ID NO: 755131 - RNA, 64 nt, Homo Sapiens
uauauaaugaaaaagguuucaaaauauauauauauauauauauagcauuuaacacuguuuauaa

SEQ ID NO: 755132 - RNA, 64 nt, Homo Sapiens
uauauauaaugaaaaagguuaaaaaauauauauauauauauauauggcauuuaacacuguuuau

SEQ ID NO: 755133 - RNA, 64 nt, Homo Sapiens
uauauauauaaugaaaaaggauaaaaaauauauauauauauauaacuggcauuuaacacuguuu

SEQ ID NO: 755134 - RNA, 64 nt, Homo Sapiens
uauauauauauaaugaaaaauuauaaaaaauauauauauauauaaaacuggcauuuaacacugu

SEQ ID NO: 755135 - RNA, 64 nt, Homo Sapiens
uauauauauauauaaugaaaguuuauaaaaaauauauauauauaccaaacuggcauuuaacacu

SEQ ID NO: 755136 - RNA, 64 nt, Homo Sapiens
uauauauauauauauaaugacuguuuauaaaaaauauauauauaccccaaacuggcauuuaaca

SEQ ID NO: 755137 - RNA, 64 nt, Homo Sapiens
auuuuauguagacacguuuauggaagaaaaaauauauauauaaacaagagaaaagacuguuaac

SEQ ID NO: 755138 - RNA, 64 nt, Homo Sapiens
aaauuuuauguagacacguuacuggaagaaaaaauauauauauacccaagagaaaagacuguua

SEQ ID NO: 755139 - RNA, 64 nt, Homo Sapiens
cuaaaucuuuauauacagaacaugauagcuguuauauauauaugaaaaaucuuuuuucacuucu

SEQ ID NO: 755140 - RNA, 64 nt, Homo Sapiens
ugcuaaaucuuuauauacagcucaugauagcuguuauauauauaggaaaaaucuuuuuucacuu

SEQ ID NO: 755141 - RNA, 64 nt, Homo Sapiens
ccuuuguguauacacuuaucgguguuuguguguauauauauauguauaguauauaagagagagg

SEQ ID NO: 755142 - RNA, 64 nt, Homo Sapiens
ugccuuuguguauacacuuagggguguuuguguguauauauauauguauaguauauaagagaga

SEQ ID NO: 755143 - RNA, 64 nt, Homo Sapiens
uugaauucuaguuuucauaaauucauuuguucaguauauauauuuauccccaauugcuucaguc

SEQ ID NO: 755144 - RNA, 64 nt, Homo Sapiens
uauguguuuuuaaaauauguacuuuugaucuauuuauauauaugcuuuuauauauucuuuuucc

SEQ ID NO: 755145 - RNA, 64 nt, Homo Sapiens
gauagauagaugaguaucaaaaauguuuccugaauauauauacaaauuuaaaugaauuugauuu

SEQ ID NO: 755146 - RNA, 64 nt, Homo Sapiens
uuacagucuuaucugccuuuuauauauauauauauauauauauuuauauauauauauauauaua

SEQ ID NO: 755147 - RNA, 64 nt, Homo Sapiens
uuuuacagucuuaucugccuuauauauauauauauauauauauagaaauaauuuguuucauaug

SEQ ID NO: 755148 - RNA, 64 nt, Homo Sapiens
uauuuuacagucuuaucugcuguauauauauauauauauauauauggaaauaauuuguuucaua

SEQ ID NO: 755149 - RNA, 64 nt, Homo Sapiens
uauauuuuacagucuuaucuuauguauauauauauauauauauauuuggaaauaauuuguuuca

SEQ ID NO: 755150 - RNA, 64 nt, Homo Sapiens
uauauauuuuacagucuuaucauauguauauauauauauauauauuuuuggaaauaauuuguuu

SEQ ID NO: 755151 - RNA, 64 nt, Homo Sapiens
uauauauauuuuacagucuuuucauauguauauauauauauauagcuuuuuggaaauaauuugu

SEQ ID NO: 755152 - RNA, 64 nt, Homo Sapiens
uauauauauauuuuacagucguuucauauguauauauauauauagggcuuuuuggaaauaauuu

SEQ ID NO: 755153 - RNA, 64 nt, Homo Sapiens
uauauauauauauuuuacaguuguuucauauguauauauauauauagggcuuuuuggaaauaau

SEQ ID NO: 755154 - RNA, 64 nt, Homo Sapiens
uauauauauauauauuuuacauuuguuucauauguauauauauaauuagggcuuuuuggaaaua

SEQ ID NO: 755155 - RNA, 64 nt, Homo Sapiens
aacuuguuaaauuauuucauauaauauauauauauauauauaucguaugacuguguuauacuug

SEQ ID NO: 755156 - RNA, 64 nt, Homo Sapiens
ucaacuuguuaaauuauuucugauaauauauauauauauauauauuguaugacuguguuauacu

SEQ ID NO: 755157 - RNA, 64 nt, Homo Sapiens
uaucaacuuguuaaauuauucuugauaauauauauauauauauauuuuguaugacuguguuaua

SEQ ID NO: 755158 - RNA, 64 nt, Homo Sapiens
uauaucaacuuguuaaauuauacuugauaauauauauauauauaguuuuuguaugacuguguua

SEQ ID NO: 755159 - RNA, 64 nt, Homo Sapiens
uauauaucaacuuguuaaauuauacuugauaauauauauauauaauguuuuuguaugacugugu

SEQ ID NO: 755160 - RNA, 64 nt, Homo Sapiens
uauauauaucaacuuguuaaguuauacuugauaauauauauauaaaauguuuuuguaugacugu

SEQ ID NO: 755161 - RNA, 64 nt, Homo Sapiens
caaggaaaguugaauuuucagguaucucuuugcauauauauacagcucucuuuuuuaaaauaua

SEQ ID NO: 755162 - RNA, 64 nt, Homo Sapiens
auauugugacauguuuuggauaaauacuauguaauauauauaaacuauggaaggggcuuuguug

SEQ ID NO: 755163 - RNA, 64 nt, Homo Sapiens
uacacauauacauaaauuuuuguguguguauauauauauauacauacauguauguauauacaga

SEQ ID NO: 755164 - RNA, 64 nt, Homo Sapiens
cauacacauauacauaaauugauguguguguauauauauauauauauacauguauguauauaca

SEQ ID NO: 755165 - RNA, 64 nt, Homo Sapiens
uacauacacauauacauaaacagauguguguguauauauauauauauauacauguauguauaua

SEQ ID NO: 755166 - RNA, 64 nt, Homo Sapiens
uauacauacacauauacauauacagauguguguguauauauauaaauauauacauguauguaua

SEQ ID NO: 755167 - RNA, 64 nt, Homo Sapiens
uauauaaucccuauauaucuagacacacauauaauauauauagaauauauauauauaucuguau

SEQ ID NO: 755168 - RNA, 64 nt, Homo Sapiens
uguauagacacacauauaaugaugaauauauauauauauauaucuauacacacacacacagaaa

SEQ ID NO: 755169 - RNA, 64 nt, Homo Sapiens
ucuguauagacacacauauaaagaugaauauauauauauauauauauauacacacacacacaga

SEQ ID NO: 755170 - RNA, 64 nt, Homo Sapiens
uaucuguauagacacacauagaaagaugaauauauauauauauauauauauacacacacacaca

SEQ ID NO: 755171 - RNA, 64 nt, Homo Sapiens
uauaucuguauagacacacacagaaagaugaauauauauauauagauauauauacacacacaca

SEQ ID NO: 755172 - RNA, 64 nt, Homo Sapiens
uauauaucuguauagacacacacagaaagaugaauauauauauauggauauauauacacacaca

SEQ ID NO: 755173 - RNA, 64 nt, Homo Sapiens
cacacacacagaaagaugaauauguguguguggauauauauacacuaagcaacaauagauuuua

SEQ ID NO: 755174 - RNA, 64 nt, Homo Sapiens
cagaacaaaaauaauguucugaaacaaaaauacuuauauauacaggcaacagaaacaaguuaag

SEQ ID NO: 755175 - RNA, 64 nt, Homo Sapiens
uuuguacguuuucuucaucuuauauauauaaauauauauauaauacauagauaugucauguuau

SEQ ID NO: 755176 - RNA, 64 nt, Homo Sapiens
auuuuguacguuuucuucauauuauauauauaaauauauauauaguacauagauaugucauguu

SEQ ID NO: 755177 - RNA, 64 nt, Homo Sapiens
uauauauauaauuuuguacgaugucauguuauuauauauauaaacagccauguuguacauagau

SEQ ID NO: 755178 - RNA, 64 nt, Homo Sapiens
aauauauauauaauuuuguaauaugucauguuauuauauauauacccagccauguuguacauag

SEQ ID NO: 755179 - RNA, 64 nt, Homo Sapiens
gauauauucuuacaucuuuuuaaaauuauauauauauauauaaaaacugggucugggauuauuu

SEQ ID NO: 755180 - RNA, 64 nt, Homo Sapiens
aagauauauucuuacaucuuuuuaaaauuauauauauauauauaggaacugggucugggauuau

SEQ ID NO: 755181 - RNA, 64 nt, Homo Sapiens
uaaagauauauucuuacaucauuuuaaaauuauauauauauauaauggaacugggucugggauu

SEQ ID NO: 755182 - RNA, 64 nt, Homo Sapiens
uauaaagauauauucuuacauuauuuuaaaauuauauauauauauaauggaacugggucuggga

SEQ ID NO: 755183 - RNA, 64 nt, Homo Sapiens
uauauaaagauauauucuuagauuauuuuaaaauuauauauauaguuaauggaacugggucugg

SEQ ID NO: 755184 - RNA, 64 nt, Homo Sapiens
auauaaaauauagauauggauauauauauaaauauauauauaauuagguguauauauacauaua

SEQ ID NO: 755185 - RNA, 64 nt, Homo Sapiens
auauauaaaauauagauauguauauauauauaaauauauauauagcuagguguauauauacaua

SEQ ID NO: 755186 - RNA, 64 nt, Homo Sapiens
uauauauauaauauauaaaauauauacauauauauauauauaaauacacacugugcuaggugua

SEQ ID NO: 755187 - RNA, 64 nt, Homo Sapiens
aauauauauauaauauauaauauauauacauauauauauauauauauacacacugugcuaggug

SEQ ID NO: 755188 - RNA, 64 nt, Homo Sapiens
uaaauauauauauaauauauuguauauauacauauauauauauaaauauacacacugugcuagg

SEQ ID NO: 755189 - RNA, 64 nt, Homo Sapiens
uauaaauauauauauaauaugguguauauauacauauauauauaagaauauacacacugugcua

SEQ ID NO: 755190 - RNA, 64 nt, Homo Sapiens
uauauauauauauaaauauacacugugcuagguguauauauacaccugaugaauagaauauaca

SEQ ID NO: 755191 - RNA, 64 nt, Homo Sapiens
aagauguauauagauguauaaaacagagauaauauauauauagaagguuuaucuaagaagaaag

SEQ ID NO: 755192 - RNA, 64 nt, Homo Sapiens
gaaagauguauauagauguaagaaacagagauaauauauauauaaaagguuuaucuaagaagaa

SEQ ID NO: 755193 - RNA, 64 nt, Homo Sapiens
uauauacauguauguauaugaaaggcagauaguauauauauauuagaaaaguuuagacuuauaa

SEQ ID NO: 755194 - RNA, 64 nt, Homo Sapiens
uuuauauacauguauguauaaaaaaggcagauaguauauauauaguagaaaaguuuagacuuau

SEQ ID NO: 755195 - RNA, 64 nt, Homo Sapiens
uuaauuuuuuaauuuaagcaacaguauauauauguauauauauuucuguuauuguccugugugu

SEQ ID NO: 755196 - RNA, 64 nt, Homo Sapiens
uauauauauuuuaauuuuuuuccuguguguacaguauauauauguucaacacucucuguuauug

SEQ ID NO: 755197 - RNA, 64 nt, Homo Sapiens
cacacacacacacacacacgauuauauauauauauauauauacaaaaauaugauauacacacac

SEQ ID NO: 755198 - RNA, 64 nt, Homo Sapiens
cacacacacacacacacacaacauuauauauauauauauauauaaaaaaauaugauauacacac

SEQ ID NO: 755199 - RNA, 64 nt, Homo Sapiens
uacacacacacacacacacaacacauuauauauauauauauauaagaaaaaauaugauauacac

SEQ ID NO: 755200 - RNA, 64 nt, Homo Sapiens
uauacacacacacacacacaacacacauuauauauauauauauauaagaaaaaauaugauauac

SEQ ID NO: 755201 - RNA, 64 nt, Homo Sapiens
uauauacacacacacacacaacacacacauuauauauauauauaacuaagaaaaaauaugauau

SEQ ID NO: 755202 - RNA, 64 nt, Homo Sapiens
uauauauacacacacacacaauacacacacauuauauauauauaaaacuaagaaaaaauaugau

SEQ ID NO: 755203 - RNA, 64 nt, Homo Sapiens
uauauauauacacacacacaauauacacacacauuauauauauauaaaacuaagaaaaaauaug

SEQ ID NO: 755204 - RNA, 64 nt, Homo Sapiens
uucagugccauugugaagaagucucuuguaaauuuauauauacuuaccuagcuacaacuuuuau

SEQ ID NO: 755205 - RNA, 64 nt, Homo Sapiens
uugcuuguuugugacacuuaaaauaaaauugcaguauauauauguaacuucguuugugcgauug

SEQ ID NO: 755206 - RNA, 64 nt, Homo Sapiens
caagacaagggaaauguagauauaucuccauauauauauauaucaaaacugcuugaauuguaua

SEQ ID NO: 755207 - RNA, 64 nt, Homo Sapiens
uccaagacaagggaaauguauauauaucuccauauauauauauauuaaaacugcuugaauugua

SEQ ID NO: 755208 - RNA, 64 nt, Homo Sapiens
uauccaagacaagggaaauguauauauaucuccauauauauauaaauuaaaacugcuugaauug

SEQ ID NO: 755209 - RNA, 64 nt, Homo Sapiens
uccauauauauauauauccaaacugcuugaauuguauauauauccaaugauuacccuuaauuaa

SEQ ID NO: 755210 - RNA, 64 nt, Homo Sapiens
uuuuuuuuuuuaaauuccuggggauauauauauauauauauaauagaaggacugaacaacuguu

SEQ ID NO: 755211 - RNA, 64 nt, Homo Sapiens
auuuuuuuuuuuuaaauuccuugggauauauauauauauauauaguagaaggacugaacaacug

SEQ ID NO: 755212 - RNA, 64 nt, Homo Sapiens
uaauuuuuuuuuuuuaaauuuguugggauauauauauauauauaugguagaaggacugaacaac

SEQ ID NO: 755213 - RNA, 64 nt, Homo Sapiens
uauaauuuuuuuuuuuuaaaacuguugggauauauauauauauauuugguagaaggacugaaca

SEQ ID NO: 755214 - RNA, 64 nt, Homo Sapiens
uauauaauuuuuuuuuuuuacaacuguugggauauauauauauacauuugguagaaggacugaa

SEQ ID NO: 755215 - RNA, 64 nt, Homo Sapiens
uauauauaauuuuuuuuuuuaacaacuguugggauauauauauaagcauuugguagaaggacug

SEQ ID NO: 755216 - RNA, 64 nt, Homo Sapiens
uauauaauaugaaaguagucguuuuugauuuuauuauauauaugaaaaccauguggcaguuccu

SEQ ID NO: 755217 - RNA, 64 nt, Homo Sapiens
cauguugacugucaucuuguuuguugguuuuugcuauauauacacauaguuuuguucaauugcg

SEQ ID NO: 755218 - RNA, 64 nt, Homo Sapiens
cucagauucucauuuauuagugagcacaccuguguauauauauaaaucacaaggagaucaucaa

SEQ ID NO: 755219 - RNA, 64 nt, Homo Sapiens
cagauucucauuuauuagugagcacaccuguguauauauauaaaucacaaggagaucaucaagg

SEQ ID NO: 755220 - RNA, 64 nt, Homo Sapiens
uuuugaacuaagaaacuuuuguaaagaaauuuacuauauauauaugccuuuuuccuagccuguu

SEQ ID NO: 755221 - RNA, 64 nt, Homo Sapiens
uugaacuaagaaacuuuuguaaagaaauuuacuauauauauaugccuuuuuccuagccuguuuc

SEQ ID NO: 755222 - RNA, 64 nt, Homo Sapiens
aaaaacaaaaguauuugugugcauguguauauaauauauauauauacauauauauuuauacaca

SEQ ID NO: 755223 - RNA, 64 nt, Homo Sapiens
aaacaaaaguauuugugugcauguguauauaauauauauauauacauauauauuuauacacaua

SEQ ID NO: 755224 - RNA, 64 nt, Homo Sapiens
acaaaaguauuugugugcauguguauauaauauauauauauacauauauauuuauacacauaca

SEQ ID NO: 755225 - RNA, 64 nt, Homo Sapiens
uaacuuggauuccuuuguauauaguaaaguuuaguauauauauauuuuuuucuuuuugcuacuu

SEQ ID NO: 755226 - RNA, 64 nt, Homo Sapiens
acuuggauuccuuuguauauaguaaaguuuaguauauauauauuuuuuucuuuuugcuacuuuc

SEQ ID NO: 755227 - RNA, 64 nt, Homo Sapiens
ccaggaaacagaacuuuaagauauauacagcacauauauauauauauacauauauauauacaca

SEQ ID NO: 755228 - RNA, 64 nt, Homo Sapiens
aggaaacagaacuuuaagauauauacagcacauauauauauauauacauauauauauacacaua

SEQ ID NO: 755229 - RNA, 64 nt, Homo Sapiens
gaaacagaacuuuaagauauauacagcacauauauauauauauacauauauauauacacauaua

SEQ ID NO: 755230 - RNA, 64 nt, Homo Sapiens
aacagaacuuuaagauauauacagcacauauauauauauauacauauauauauacacauauaua

SEQ ID NO: 755231 - RNA, 64 nt, Homo Sapiens
uaagauauauacagcacauauauauauauauacauauauauauacacauauauaaaaaacaaaa

SEQ ID NO: 755232 - RNA, 64 nt, Homo Sapiens
agauauauacagcacauauauauauauauacauauauauauacacauauauaaaaaacaaaagc

SEQ ID NO: 755233 - RNA, 64 nt, Homo Sapiens
uucaggcuucaguaaaucuuuuuuucuuccuucauauauauauacacaacacacacacacauau

SEQ ID NO: 755234 - RNA, 64 nt, Homo Sapiens
caggcuucaguaaaucuuuuuuucuuccuucauauauauauacacaacacacacacacauaugu

SEQ ID NO: 755235 - RNA, 64 nt, Homo Sapiens
acacacacacgugcacacacacacacacacacacuauauauauauauauuauuuacagggaaau

SEQ ID NO: 755236 - RNA, 64 nt, Homo Sapiens
acacacacgugcacacacacacacacacacacuauauauauauauauuauuuacagggaaauuu

SEQ ID NO: 755237 - RNA, 64 nt, Homo Sapiens
acacacgugcacacacacacacacacacacuauauauauauauauuauuuacagggaaauuuuu

SEQ ID NO: 755238 - RNA, 64 nt, Homo Sapiens
acacgugcacacacacacacacacacacuauauauauauauauuauuuacagggaaauuuuuca

SEQ ID NO: 755239 - RNA, 64 nt, Homo Sapiens
ccccuugauuggcguguguguauauauggauaaauauauauauacacacacacauauuacugca

SEQ ID NO: 755240 - RNA, 64 nt, Homo Sapiens
ccuugauuggcguguguguauauauggauaaauauauauauacacacacacauauuacugcaau

SEQ ID NO: 755241 - RNA, 64 nt, Homo Sapiens
gcauuaaauuguuuugguucuaaauuuggaacaguauauauaauuaaaaguaaggaacauuaga

SEQ ID NO: 755242 - RNA, 64 nt, Homo Sapiens
cuagcuagguauuccugggauuauuauacugagauauauauauauacacacacacacacauaug

SEQ ID NO: 755243 - RNA, 64 nt, Homo Sapiens
agcuagguauuccugggauuauuauacugagauauauauauauacacacacacacacauaugug

SEQ ID NO: 755244 - RNA, 64 nt, Homo Sapiens
cuagguauuccugggauuauuauacugagauauauauauauacacacacacacacauaugugua

SEQ ID NO: 755245 - RNA, 64 nt, Homo Sapiens
uauauacacacacacacacauauguguauauauguauauauauaugugaguauauauacacaca

SEQ ID NO: 755246 - RNA, 64 nt, Homo Sapiens
uauacacacacacacacauauguguauauauguauauauauaugugaguauauauacacacaca

SEQ ID NO: 755247 - RNA, 64 nt, Homo Sapiens
cacauauguguauauauguauauauauaugugaguauauauacacacacacacacacacacaca

SEQ ID NO: 755248 - RNA, 64 nt, Homo Sapiens
ugaguauauauacacacacacacacacacacacauauauauauauacacacacgcacacauaua

SEQ ID NO: 755249 - RNA, 64 nt, Homo Sapiens
aguauauauacacacacacacacacacacacauauauauauauacacacacgcacacauauaug

SEQ ID NO: 755250 - RNA, 64 nt, Homo Sapiens
uauauauacacacacacacacacacacacauauauauauauacacacacgcacacauauauguu

SEQ ID NO: 755251 - RNA, 64 nt, Homo Sapiens
uggcauauuuauauuguauauucuggaaaaaaaauauauauauauauuuaaaggggagauacuc

SEQ ID NO: 755252 - RNA, 64 nt, Homo Sapiens
gcauauuuauauuguauauucuggaaaaaaaauauauauauauauuuaaaggggagauacucuc

SEQ ID NO: 755253 - RNA, 64 nt, Homo Sapiens
auauuuauauuguauauucuggaaaaaaaauauauauauauauuuaaaggggagauacucuccc

SEQ ID NO: 755254 - RNA, 64 nt, Homo Sapiens
uguguguguguguguauguauacacacauauacauauauauauacacauacauacacauacaua

SEQ ID NO: 755255 - RNA, 64 nt, Homo Sapiens
uguguguguguguauguauacacacauauacauauauauauacacauacauacacauacauaca

SEQ ID NO: 755256 - RNA, 64 nt, Homo Sapiens
cuuuugugggggaaugccuaauaaauacauugacuauauauaaaaugaauauauacauacacau

SEQ ID NO: 755257 - RNA, 64 nt, Homo Sapiens
auaaaaugaauauauacauacacauguaugccuguauauauauauucauucuccaguguugcug

SEQ ID NO: 755258 - RNA, 64 nt, Homo Sapiens
aaaaugaauauauacauacacauguaugccuguauauauauauucauucuccaguguugcugaa

SEQ ID NO: 755259 - RNA, 64 nt, Homo Sapiens
guucgugcugcaagugaucuguaaucccuaugaguauauauauauauauauauauauauauaua

SEQ ID NO: 755260 - RNA, 64 nt, Homo Sapiens
ucgugcugcaagugaucuguaaucccuaugaguauauauauauauauauauauauauauauaaa

SEQ ID NO: 755261 - RNA, 64 nt, Homo Sapiens
gugcugcaagugaucuguaaucccuaugaguauauauauauauauauauauauauauauaaaaa

SEQ ID NO: 755262 - RNA, 64 nt, Homo Sapiens
gcugcaagugaucuguaaucccuaugaguauauauauauauauauauauauauauauaaaaacu

SEQ ID NO: 755263 - RNA, 64 nt, Homo Sapiens
ugcaagugaucuguaaucccuaugaguauauauauauauauauauauauauauauaaaaacuua

SEQ ID NO: 755264 - RNA, 64 nt, Homo Sapiens
caagugaucuguaaucccuaugaguauauauauauauauauauauauauauauaaaaacuuagc

SEQ ID NO: 755265 - RNA, 64 nt, Homo Sapiens
agugaucuguaaucccuaugaguauauauauauauauauauauauauauauaaaaacuuagcac

SEQ ID NO: 755266 - RNA, 64 nt, Homo Sapiens
ugaucuguaaucccuaugaguauauauauauauauauauauauauauauaaaaacuuagcacgu

SEQ ID NO: 755267 - RNA, 64 nt, Homo Sapiens
aucuguaaucccuaugaguauauauauauauauauauauauauauauaaaaacuuagcacgugu

SEQ ID NO: 755268 - RNA, 64 nt, Homo Sapiens
cuguaaucccuaugaguauauauauauauauauauauauauauauaaaaacuuagcacguguaa

SEQ ID NO: 755269 - RNA, 64 nt, Homo Sapiens
guaaucccuaugaguauauauauauauauauauauauauauauaaaaacuuagcacguguaauu

SEQ ID NO: 755270 - RNA, 64 nt, Homo Sapiens
aaucccuaugaguauauauauauauauauauauauauauauaaaaacuuagcacguguaauuua

SEQ ID NO: 755271 - RNA, 64 nt, Homo Sapiens
guuugaaauaucacacaaaggcugauuucuaaaauauauauauauuaaaacaauaaaguauuua

SEQ ID NO: 755272 - RNA, 64 nt, Homo Sapiens
uugaaauaucacacaaaggcugauuucuaaaauauauauauauuaaaacaauaaaguauuuauu

SEQ ID NO: 755273 - RNA, 64 nt, Homo Sapiens
ccagugaugcuaaagguuguauugcauauauacauauauauauauauauauauauauauauaua

SEQ ID NO: 755274 - RNA, 64 nt, Homo Sapiens
agugaugcuaaagguuguauugcauauauacauauauauauauauauauauauauauauauaua

SEQ ID NO: 755275 - RNA, 64 nt, Homo Sapiens
ugaugcuaaagguuguauugcauauauacauauauauauauauauauauauauauauauauaua

SEQ ID NO: 755276 - RNA, 64 nt, Homo Sapiens
augcuaaagguuguauugcauauauacauauauauauauauauauauauauauauauauauaua

SEQ ID NO: 755277 - RNA, 64 nt, Homo Sapiens
gcuaaagguuguauugcauauauacauauauauauauauauauauauauauauauauauauaua

SEQ ID NO: 755278 - RNA, 64 nt, Homo Sapiens
uaaagguuguauugcauauauacauauauauauauauauauauauauauauauauauauauaua

SEQ ID NO: 755279 - RNA, 64 nt, Homo Sapiens
aagguuguauugcauauauacauauauauauauauauauauauauauauauauauauauauaua

SEQ ID NO: 755280 - RNA, 64 nt, Homo Sapiens
ugcauauauacauauauauauauauauauauauauauauauauauauauauauauauauauaua

SEQ ID NO: 755281 - RNA, 64 nt, Homo Sapiens
cauauauacauauauauauauauauauauauauauauauauauauauauauauauauauauaua

SEQ ID NO: 755282 - RNA, 64 nt, Homo Sapiens
uauauacauauauauauauauauauauauauauauauauauauauauauauauauauauauauu

SEQ ID NO: 755283 - RNA, 64 nt, Homo Sapiens
uauacauauauauauauauauauauauauauauauauauauauauauauauauauauauauuuu

SEQ ID NO: 755284 - RNA, 64 nt, Homo Sapiens
uacauauauauauauauauauauauauauauauauauauauauauauauauauauauauuuuaa

SEQ ID NO: 755285 - RNA, 64 nt, Homo Sapiens
cauauauauauauauauauauauauauauauauauauauauauauauauauauauauuuuaauu

SEQ ID NO: 755286 - RNA, 64 nt, Homo Sapiens
uauauauauauauauauauauauauauauauauauauauauauauauauauauauuuuaauuug

SEQ ID NO: 755287 - RNA, 64 nt, Homo Sapiens
uauauauauauauauauauauauauauauauauauauauauauauauauauauuuuaauuugau

SEQ ID NO: 755288 - RNA, 64 nt, Homo Sapiens
uauauauauauauauauauauauauauauauauauauauauauauauauauuuuaauuugauag

SEQ ID NO: 755289 - RNA, 64 nt, Homo Sapiens
uauauauauauauauauauauauauauauauauauauauauauauauauuuuaauuugauagua

SEQ ID NO: 755290 - RNA, 64 nt, Homo Sapiens
uauauauauauauauauauauauauauauauauauauauauauauauuuuaauuugauaguauu

SEQ ID NO: 755291 - RNA, 64 nt, Homo Sapiens
uauauauauauauauauauauauauauauauauauauauauauauuuuaauuugauaguauugu

SEQ ID NO: 755292 - RNA, 64 nt, Homo Sapiens
uauauauauauauauauauauauauauauauauauauauauauuuuaauuugauaguauugugc

SEQ ID NO: 755293 - RNA, 64 nt, Homo Sapiens
uuccaucuguuugauacaguauuauagauauaaauauauauauauuucucuguggccauuugug

SEQ ID NO: 755294 - RNA, 64 nt, Homo Sapiens
ccaucuguuugauacaguauuauagauauaaauauauauauauuucucuguggccauuugugau

SEQ ID NO: 755295 - RNA, 64 nt, Homo Sapiens
uaaggaugacacuaauuguuagcuguuuugaaauuauauauauauaaauauauauaaauauaua

SEQ ID NO: 755296 - RNA, 64 nt, Homo Sapiens
aggaugacacuaauuguuagcuguuuugaaauuauauauauauaaauauauauaaauauauaaa

SEQ ID NO: 755297 - RNA, 64 nt, Homo Sapiens
gaugacacuaauuguuagcuguuuugaaauuauauauauauaaauauauauaaauauauaaaua

SEQ ID NO: 755298 - RNA, 64 nt, Homo Sapiens
auuguuagcuguuuugaaauuauauauauauaaauauauauaaauauauaaauauaugccaguc

SEQ ID NO: 755299 - RNA, 64 nt, Homo Sapiens
uguauaaauauauguauaucacucaaccucgguauauauauauggacgaauauucugauacaau

SEQ ID NO: 755300 - RNA, 64 nt, Homo Sapiens
uguguauaaauauauguauaauacucaaccucgguauauauauaacgacgaauauucugauaca

SEQ ID NO: 755301 - RNA, 64 nt, Homo Sapiens
uauauaagugcugugacuguaaggguaaaauauauauauauaucuuggaaacauguaacaaagc

SEQ ID NO: 755302 - RNA, 64 nt, Homo Sapiens
ucuauauaagugcugugacugcaaggguaaaauauauauauauaauuuggaaacauguaacaaa

SEQ ID NO: 755303 - RNA, 64 nt, Homo Sapiens
uaucuauauaagugcugugaaagcaaggguaaaauauauauauaaaauuuggaaacauguaaca

SEQ ID NO: 755304 - RNA, 64 nt, Homo Sapiens
acucuaauacugcaagaaggcacauauauauauauauauauaguuauauauauauaaacacaca

SEQ ID NO: 755305 - RNA, 64 nt, Homo Sapiens
guacucuaauacugcaagaacacacauauauauauauauauauauguauauauauauaaacaca

SEQ ID NO: 755306 - RNA, 64 nt, Homo Sapiens
uaguacucuaauacugcaagcacacacauauauauauauauauauguguauauauauauaaaca

SEQ ID NO: 755307 - RNA, 64 nt, Homo Sapiens
uauaguacucuaauacugcacacacacacauauauauauauauaacuguguauauauauauaaa

SEQ ID NO: 755308 - RNA, 64 nt, Homo Sapiens
uauauaguacucuaauacugaacacacacacauauauauauauaauacuguguauauauauaua

SEQ ID NO: 755309 - RNA, 64 nt, Homo Sapiens
uauauauaguacucuaauacuaaacacacacacauauauauauauuauacuguguauauauaua

SEQ ID NO: 755310 - RNA, 64 nt, Homo Sapiens
cacacacacauauauauauauuauacuguguauauauauauaaagcaucuuuaagaagugacca

SEQ ID NO: 755311 - RNA, 64 nt, Homo Sapiens
aacacacacacauauauauacauuauacuguguauauauauauacugcaucuuuaagaagugac

SEQ ID NO: 755312 - RNA, 64 nt, Homo Sapiens
uaaacacacacacauauauaaccauuauacuguguauauauauagacugcaucuuuaagaagug

SEQ ID NO: 755313 - RNA, 64 nt, Homo Sapiens
agguacuguuaacuacuguaauagauaugagauauauauauaaauuacaguuuauauauauaug

SEQ ID NO: 755314 - RNA, 64 nt, Homo Sapiens
aaagguacuguuaacuacugugauagauaugagauauauauauaguuuacaguuuauauauaua

SEQ ID NO: 755315 - RNA, 64 nt, Homo Sapiens
auagauaugagauauauauauuguuuacaguuuauauauauaugcuagaagccgcuguuaccuc

SEQ ID NO: 755316 - RNA, 64 nt, Homo Sapiens
ugauagauaugagauauauaucuuguuuacaguuuauauauauauucuagaagccgcuguuacc

SEQ ID NO: 755317 - RNA, 64 nt, Homo Sapiens
acauuccccucuguccccuuguaauauauaaauauauauauaaauaugacuauacgggacauau

SEQ ID NO: 755318 - RNA, 64 nt, Homo Sapiens
aaacauuccccucuguccccauguaauauauaaauauauauauacauaugacuauacgggacau

SEQ ID NO: 755319 - RNA, 64 nt, Homo Sapiens
uauaaauauauguuuguuugucucuuuauauauauauauauaaaacuuaauuugucuucccauu

SEQ ID NO: 755320 - RNA, 64 nt, Homo Sapiens
aauauaaauauauguuuguuuuucucuuuauauauauauauauaucacuuaauuugucuuccca

SEQ ID NO: 755321 - RNA, 64 nt, Homo Sapiens
uaaauauaaauauauguuugcauuucucuuuauauauauauauagcucacuuaauuugucuucc

SEQ ID NO: 755322 - RNA, 64 nt, Homo Sapiens
uauaaauauaaauauauguucccauuucucuuuauauauauauaaggcucacuuaauuugucuu

SEQ ID NO: 755323 - RNA, 64 nt, Homo Sapiens
uauauaaauauaaauauauguucccauuucucuuuauauauauaauaggcucacuuaauuuguc

SEQ ID NO: 755324 - RNA, 64 nt, Homo Sapiens
uaaaaauuauguauaauggauuuauauauauacauauauauacagaacuaucagauauaguaaa

SEQ ID NO: 755325 - RNA, 64 nt, Homo Sapiens
uauauauacauaaaaauuauauauaguaaauuuauauauauacagcuucuaaaggaacuaucag

SEQ ID NO: 755326 - RNA, 64 nt, Homo Sapiens
cauauauauacauaaaaauuagauauaguaaauuuauauauauaaggcuucuaaaggaacuauc

SEQ ID NO: 755327 - RNA, 64 nt, Homo Sapiens
uuauuuagauaaucucaguaagaagaaaacuauauauauauaucaguuuuauugcaagagguaa

SEQ ID NO: 755328 - RNA, 64 nt, Homo Sapiens
ucuuauuuagauaaucucagaaagaagaaaacuauauauauauauaaguuuuauugcaagaggu

SEQ ID NO: 755329 - RNA, 64 nt, Homo Sapiens
uaucuuauuuagauaaucucguaaagaagaaaacuauauauauauauaaguuuuauugcaagag

SEQ ID NO: 755330 - RNA, 64 nt, Homo Sapiens
uagaagacuguacaauuugaauuucacacaguuuuauauauagacauaaaacauccuuacuuuu

SEQ ID NO: 755331 - RNA, 64 nt, Homo Sapiens
uauauguagcuuucuauauacauauguaaauauuuauauauagacaagaaaguaucuauauaua

SEQ ID NO: 755332 - RNA, 64 nt, Homo Sapiens
uauguaaauauuuauauauaaacaagaaaguaucuauauauacauauuuuucuucaucuuuuau

SEQ ID NO: 755333 - RNA, 64 nt, Homo Sapiens
gagaacuaaaauggauauaucaaucccuaauauauauauauaguuuugccuaaggagguagcag

SEQ ID NO: 755334 - RNA, 64 nt, Homo Sapiens
gugagaacuaaaauggauauagcaaucccuaauauauauauauacauuugccuaaggagguagc

SEQ ID NO: 755335 - RNA, 64 nt, Homo Sapiens
uagugagaacuaaaauggaugcagcaaucccuaauauauauauaaccauuugccuaaggaggua

SEQ ID NO: 755336 - RNA, 64 nt, Homo Sapiens
uuauuauauuuuauaaucucugucuaauucuguauauauauaacuuaauugucaauauuauuuu

SEQ ID NO: 755337 - RNA, 64 nt, Homo Sapiens
acuuauuauauuuuauaaucuuugucuaauucuguauauauauaucuuaauugucaauauuauu

SEQ ID NO: 755338 - RNA, 64 nt, Homo Sapiens
ggucuauuugaagagcucacuuuuuuaacacuuauauauauaauuuagggacuagaccaugugc

SEQ ID NO: 755339 - RNA, 64 nt, Homo Sapiens
auggucuauuugaagagcucgcuuuuuuaacacuuauauauauauuuuagggacuagaccaugu

SEQ ID NO: 755340 - RNA, 64 nt, Homo Sapiens
uugcugcaucacuuguguaguacaaguacauuuauauauauaugaagaaacuuuacuguagagu

SEQ ID NO: 755341 - RNA, 64 nt, Homo Sapiens
uguugcugcaucacuuguguguuacaaguacauuuauauauauaaaaagaaacuuuacuguaga

SEQ ID NO: 755342 - RNA, 64 nt, Homo Sapiens
auggagucucacugugcugcugaagugcuauauauauauauaugggccaagaggccucugguaa

SEQ ID NO: 755343 - RNA, 64 nt, Homo Sapiens
ugauggagucucacugugcuaaugaagugcuauauauauauauacaggccaagaggccucuggu

SEQ ID NO: 755344 - RNA, 64 nt, Homo Sapiens
uaugauggagucucacugugguaaugaagugcuauauauauauaaacaggccaagaggccucug

SEQ ID NO: 755345 - RNA, 64 nt, Homo Sapiens
uauaugauggagucucacugugguaaugaagugcuauauauauaucaacaggccaagaggccuc

SEQ ID NO: 755346 - RNA, 64 nt, Homo Sapiens
gaauauuucaaaauucaaacuuaaaucgauuauauauauauauguuguuuaucaaaugauuucu

SEQ ID NO: 755347 - RNA, 64 nt, Homo Sapiens
uggaauauuucaaaauucaacuuuaaaucgauuauauauauauauuuuguuuaucaaaugauuu

SEQ ID NO: 755348 - RNA, 64 nt, Homo Sapiens
uauggaauauuucaaaauucuucuuuaaaucgauuauauauauaaguuuuguuuaucaaaugau

SEQ ID NO: 755349 - RNA, 64 nt, Homo Sapiens
uaauaaaaccugugcuugauuuggcaguuuaaaauauauauaauuuuguuuuuguuuuuugcug

SEQ ID NO: 755350 - RNA, 64 nt, Homo Sapiens
cugauaaacaacuucuauuauguuugggcaaauauauauauagcuuauuuuauccuguggugca

SEQ ID NO: 755351 - RNA, 64 nt, Homo Sapiens
gccugauaaacaacuucuaucauguuugggcaaauauauauauaaguuauuuuauccuguggug

SEQ ID NO: 755352 - RNA, 64 nt, Homo Sapiens
uacauucacacacucacaaucacuuagggauauauauauauagcugauguuuguguguuuugua

SEQ ID NO: 755353 - RNA, 64 nt, Homo Sapiens
gcuacauucacacacucacauacacuuagggauauauauauauaagugauguuuguguguuuug

SEQ ID NO: 755354 - RNA, 64 nt, Homo Sapiens
uagcuacauucacacacucauguacacuuagggauauauauauaaaagugauguuuguguguuu

SEQ ID NO: 755355 - RNA, 64 nt, Homo Sapiens
auuauauuuguacuuuggcacaugcuaacugcuguauauauauuucuuauucugugccaggcaa

SEQ ID NO: 755356 - RNA, 64 nt, Homo Sapiens
ggguauuaaaauuaaaagcagaacaucucaaaguuauauauacuuucagauugccuagcuauuu

SEQ ID NO: 755357 - RNA, 64 nt, Homo Sapiens
cauacauacaaaccuguguguacauacauacauauauauauacaaagacuauguacccacacca

SEQ ID NO: 755358 - RNA, 64 nt, Homo Sapiens
cacauacauacaaaccugugcauacauacauacauauauauauauuaagacuauguacccacac

SEQ ID NO: 755359 - RNA, 64 nt, Homo Sapiens
uaacccaagccccauaacccguggauuuaaaauauauauauacgggccuggaaagaaagggaaa

SEQ ID NO: 755360 - RNA, 64 nt, Homo Sapiens
cguaacccaagccccauaacaaguggauuuaaaauauauauauaggggccuggaaagaaaggga

SEQ ID NO: 755361 - RNA, 64 nt, Homo Sapiens
augaaugcagauugcgaaggaaaaaguauauauauauauauaaauauuuauaaugcauuuauag

SEQ ID NO: 755362 - RNA, 64 nt, Homo Sapiens
aaaugaaugcagauugcgaaagaaaaaguauauauauauauauaaauauuuauaaugcauuuau

SEQ ID NO: 755363 - RNA, 64 nt, Homo Sapiens
uaaaaugaaugcagauugcgauagaaaaaguauauauauauauaaaaauauuuauaaugcauuu

SEQ ID NO: 755364 - RNA, 64 nt, Homo Sapiens
uauaaaaugaaugcagauuguuauagaaaaaguauauauauauaauaaaauauuuauaaugcau

SEQ ID NO: 755365 - RNA, 64 nt, Homo Sapiens
uauauaaaaugaaugcagauauuuauagaaaaaguauauauauaugauaaaauauuuauaaugc

SEQ ID NO: 755366 - RNA, 64 nt, Homo Sapiens
uauaauauauauuccaauguuagguauaaauaaauauauauaugaugaaguauugcuuaaauuu

SEQ ID NO: 755367 - RNA, 64 nt, Homo Sapiens
gucccaucuacugaauagaaaacuuugagaauaauauauauauauauuuuaaauguuuucacug

SEQ ID NO: 755368 - RNA, 64 nt, Homo Sapiens
cccaucuacugaauagaaaacuuugagaauaauauauauauauauuuuaaauguuuucacugac

SEQ ID NO: 755369 - RNA, 64 nt, Homo Sapiens
caucuacugaauagaaaacuuugagaauaauauauauauauauuuuaaauguuuucacugacuc

SEQ ID NO: 755370 - RNA, 64 nt, Homo Sapiens
gugaaauaaacaaugauuugcuuuucagugagaauauauauaugagauauauauagauauauau

SEQ ID NO: 755371 - RNA, 64 nt, Homo Sapiens
ugauuugcuuuucagugagaauauauauaugagauauauauagauauauauucuagguugggug

SEQ ID NO: 755372 - RNA, 64 nt, Homo Sapiens
uggaaaaacagucuuguauuuuucuguauguguguauauauauauaauuauguacuucuggcaa

SEQ ID NO: 755373 - RNA, 64 nt, Homo Sapiens
gaaaaacagucuuguauuuuucuguauguguguauauauauauaauuauguacuucuggcaauu

SEQ ID NO: 755374 - RNA, 64 nt, Homo Sapiens
aaaacagucuuguauuuuucuguauguguguauauauauauaauuauguacuucuggcaauucu

SEQ ID NO: 755375 - RNA, 64 nt, Homo Sapiens
ccagccuagcccuugucccuuuuaauauaaaagauauauauauauauauauauauauaaaauau

SEQ ID NO: 755376 - RNA, 64 nt, Homo Sapiens
agccuagcccuugucccuuuuaauauaaaagauauauauauauauauauauauauaaaauaucu

SEQ ID NO: 755377 - RNA, 64 nt, Homo Sapiens
ccuagcccuugucccuuuuaauauaaaagauauauauauauauauauauauauaaaauaucuau

SEQ ID NO: 755378 - RNA, 64 nt, Homo Sapiens
uagcccuugucccuuuuaauauaaaagauauauauauauauauauauauauaaaauaucuauau

SEQ ID NO: 755379 - RNA, 64 nt, Homo Sapiens
gcccuugucccuuuuaauauaaaagauauauauauauauauauauauauaaaauaucuauauuc

SEQ ID NO: 755380 - RNA, 64 nt, Homo Sapiens
ccuugucccuuuuaauauaaaagauauauauauauauauauauauauaaaauaucuauauucua

SEQ ID NO: 755381 - RNA, 64 nt, Homo Sapiens
uugucccuuuuaauauaaaagauauauauauauauauauauauauaaaauaucuauauucuaua

SEQ ID NO: 755382 - RNA, 64 nt, Homo Sapiens
gucccuuuuaauauaaaagauauauauauauauauauauauauaaaauaucuauauucuauaca

SEQ ID NO: 755383 - RNA, 64 nt, Homo Sapiens
cccuuuuaauauaaaagauauauauauauauauauauauauaaaauaucuauauucuauacaca

SEQ ID NO: 755384 - RNA, 64 nt, Homo Sapiens
uaucuauugaaaauauauauuauauacauagacauauauauauauauaauaggcuguauauauu

SEQ ID NO: 755385 - RNA, 64 nt, Homo Sapiens
ucuauugaaaauauauauuauauacauagacauauauauauauauaauaggcuguauauauugc

SEQ ID NO: 755386 - RNA, 64 nt, Homo Sapiens
uauugaaaauauauauuauauacauagacauauauauauauauaauaggcuguauauauugcuc

SEQ ID NO: 755387 - RNA, 64 nt, Homo Sapiens
uugaaaauauauauuauauacauagacauauauauauauauaauaggcuguauauauugcucag

SEQ ID NO: 755388 - RNA, 64 nt, Homo Sapiens
gggacuggugauauguugaucuuuuucaaaaaaauauauauaugacaaaaaaaaaaaaaaagga

SEQ ID NO: 755389 - RNA, 64 nt, Homo Sapiens
gaaauuauguuuucauguguuucacaugaaaaaguauauauauacaaaguuaauauagugggua

SEQ ID NO: 755390 - RNA, 64 nt, Homo Sapiens
aauuauguuuucauguguuucacaugaaaaaguauauauauacaaaguuaauauaguggguaaa

SEQ ID NO: 755391 - RNA, 64 nt, Homo Sapiens
aucuauaguuacuuuguaccauuugaaauauauguauauauauauauauaauauuuugaaauau

SEQ ID NO: 755392 - RNA, 64 nt, Homo Sapiens
cuauaguuacuuuguaccauuugaaauauauguauauauauauauauaauauuuugaaauauua

SEQ ID NO: 755393 - RNA, 64 nt, Homo Sapiens
auaguuacuuuguaccauuugaaauauauguauauauauauauauaauauuuugaaauauuauc

SEQ ID NO: 755394 - RNA, 64 nt, Homo Sapiens
aguuacuuuguaccauuugaaauauauguauauauauauauauaauauuuugaaauauuaucua

SEQ ID NO: 755395 - RNA, 64 nt, Homo Sapiens
uuacuuuguaccauuugaaauauauguauauauauauauauaauauuuugaaauauuaucuauu

SEQ ID NO: 755396 - RNA, 64 nt, Homo Sapiens
aaauaauaaaccucacuuuacuuguuaaaagggauauauauauauauauauaugucugcaacuu

SEQ ID NO: 755397 - RNA, 64 nt, Homo Sapiens
auaauaaaccucacuuuacuuguuaaaagggauauauauauauauauauaugucugcaacuuca

SEQ ID NO: 755398 - RNA, 64 nt, Homo Sapiens
aauaaaccucacuuuacuuguuaaaagggauauauauauauauauauaugucugcaacuucagg

SEQ ID NO: 755399 - RNA, 64 nt, Homo Sapiens
uaaaccucacuuuacuuguuaaaagggauauauauauauauauauaugucugcaacuucaggga

SEQ ID NO: 755400 - RNA, 64 nt, Homo Sapiens
aaccucacuuuacuuguuaaaagggauauauauauauauauauaugucugcaacuucagggaga

SEQ ID NO: 755401 - RNA, 64 nt, Homo Sapiens
ccucacuuuacuuguuaaaagggauauauauauauauauauaugucugcaacuucagggagaaa

SEQ ID NO: 755402 - RNA, 64 nt, Homo Sapiens
gcagugucaccacugguguaagcuacuauauauguauauauauauguaguaaaccacuuuuugu

SEQ ID NO: 755403 - RNA, 64 nt, Homo Sapiens
agugucaccacugguguaagcuacuauauauguauauauauauguaguaaaccacuuuuuguaa

SEQ ID NO: 755404 - RNA, 64 nt, Homo Sapiens
acaauaaggauaauacuuuauauaauguauaaaguauauauaauauaauauauauguuauauaa

SEQ ID NO: 755405 - RNA, 64 nt, Homo Sapiens
ucugucaaaccuuuuaaguugacaacaugacucauauauauacauguguauaagaugagcaugu

SEQ ID NO: 755406 - RNA, 64 nt, Homo Sapiens
aguguaaguuguuuucgcuguuaaauuggauauuuauauauauauauagcaagauuuucaugug

SEQ ID NO: 755407 - RNA, 64 nt, Homo Sapiens
uguaaguuguuuucgcuguuaaauuggauauuuauauauauauauagcaagauuuucauguguu

SEQ ID NO: 755408 - RNA, 64 nt, Homo Sapiens
uaaguuguuuucgcuguuaaauuggauauuuauauauauauauagcaagauuuucauguguuau

SEQ ID NO: 755409 - RNA, 64 nt, Homo Sapiens
aguuguuuucgcuguuaaauuggauauuuauauauauauauagcaagauuuucauguguuauuu

SEQ ID NO: 755410 - RNA, 64 nt, Homo Sapiens
ccacuaguuuuaauauaguacaaugaaaaaauaauauauauauauauaguacaaugguccagac

SEQ ID NO: 755411 - RNA, 64 nt, Homo Sapiens
acuaguuuuaauauaguacaaugaaaaaauaauauauauauauauaguacaaugguccagacau

SEQ ID NO: 755412 - RNA, 64 nt, Homo Sapiens
uaguuuuaauauaguacaaugaaaaaauaauauauauauauauaguacaaugguccagacauaa

SEQ ID NO: 755413 - RNA, 64 nt, Homo Sapiens
guuuuaauauaguacaaugaaaaaauaauauauauauauauaguacaaugguccagacauaaua

SEQ ID NO: 755414 - RNA, 64 nt, Homo Sapiens
gagagaaugcauucuuaaaagaaagcuguacauguauauauaugcauauauauauauguggcuc

SEQ ID NO: 755415 - RNA, 64 nt, Homo Sapiens
ucuuaaaagaaagcuguacauguauauauaugcauauauauauauguggcucuagccucaggcu

SEQ ID NO: 755416 - RNA, 64 nt, Homo Sapiens
uuaaaagaaagcuguacauguauauauaugcauauauauauauguggcucuagccucaggcucc

SEQ ID NO: 755417 - RNA, 64 nt, Homo Sapiens
aaacuguucauaaaaauuuccauaauaaaaguucuauauauauauaaauauauacauacauaug

SEQ ID NO: 755418 - RNA, 64 nt, Homo Sapiens
acuguucauaaaaauuuccauaauaaaaguucuauauauauauaaauauauacauacauaugag

SEQ ID NO: 755419 - RNA, 64 nt, Homo Sapiens
uguucauaaaaauuuccauaauaaaaguucuauauauauauaaauauauacauacauaugagaa

SEQ ID NO: 755420 - RNA, 64 nt, Homo Sapiens
cucucaauacagauaaacucacacauacuggagauauauauauaauagauauauauaaaauuau

SEQ ID NO: 755421 - RNA, 64 nt, Homo Sapiens
cucaauacagauaaacucacacauacuggagauauauauauaauagauauauauaaaauuauuu

SEQ ID NO: 755422 - RNA, 64 nt, Homo Sapiens
aacucacacauacuggagauauauauauaauagauauauauaaaauuauuuuaaugcauuguag

SEQ ID NO: 755423 - RNA, 64 nt, Homo Sapiens
uuuauaaagcauguucacccuuauagucuaagacuauauauauaaauguauaaauauacaguau

SEQ ID NO: 755424 - RNA, 64 nt, Homo Sapiens
uauaaagcauguucacccuuauagucuaagacuauauauauaaauguauaaauauacaguauag

SEQ ID NO: 755425 - RNA, 64 nt, Homo Sapiens
gugguaaauaucuauguuacauguagauuauacauauauauacacacguguauaugagauauau

SEQ ID NO: 755426 - RNA, 64 nt, Homo Sapiens
gagauauauaucuuauaucuccacaaacacaaauuauauauauacauauccacacacauacauu

SEQ ID NO: 755427 - RNA, 64 nt, Homo Sapiens
gauauauaucuuauaucuccacaaacacaaauuauauauauacauauccacacacauacauuac

SEQ ID NO: 755428 - RNA, 64 nt, Homo Sapiens
auaucuguguauauaaauccacaugcacaugaaauauauauauauauauaauuugugugugugu

SEQ ID NO: 755429 - RNA, 64 nt, Homo Sapiens
aucuguguauauaaauccacaugcacaugaaauauauauauauauauaauuuguguguguguau

SEQ ID NO: 755430 - RNA, 64 nt, Homo Sapiens
cuguguauauaaauccacaugcacaugaaauauauauauauauauaauuuguguguguguaugu

SEQ ID NO: 755431 - RNA, 64 nt, Homo Sapiens
guguauauaaauccacaugcacaugaaauauauauauauauauaauuuguguguguguaugugu

SEQ ID NO: 755432 - RNA, 64 nt, Homo Sapiens
guauauaaauccacaugcacaugaaauauauauauauauauaauuuguguguguguauguguau

SEQ ID NO: 755433 - RNA, 64 nt, Homo Sapiens
uaugcaucuauauacauauagguguguguauauauauauauauuuacguauguacgugucugua

SEQ ID NO: 755434 - RNA, 64 nt, Homo Sapiens
uuuaugcaucuauauacauauagguguguguauauauauauauauauacguauguacgugucug

SEQ ID NO: 755435 - RNA, 64 nt, Homo Sapiens
uauuuaugcaucuauauacauguagguguguguauauauauauauguauacguauguacguguc

SEQ ID NO: 755436 - RNA, 64 nt, Homo Sapiens
uauauuuaugcaucuauauaucuguagguguguguauauauauacauguauacguauguacgug

SEQ ID NO: 755437 - RNA, 64 nt, Homo Sapiens
uggauauauaaaguuucuuuuauauauauauaaauauauauacauauagauagguagauauaua

SEQ ID NO: 755438 - RNA, 64 nt, Homo Sapiens
uauauauacauggauauauauagauauauauauauauauauaaauauacguccauauagauagg

SEQ ID NO: 755439 - RNA, 64 nt, Homo Sapiens
aauauauauacauggauauagguagauauauauauauauauauauguauacguccauauagaua

SEQ ID NO: 755440 - RNA, 64 nt, Homo Sapiens
uaaauauauauacauggauauagguagauauauauauauauauaacuguauacguccauauaga

SEQ ID NO: 755441 - RNA, 64 nt, Homo Sapiens
uauaaauauauauacauggagauagguagauauauauauauauaagacuguauacguccauaua

SEQ ID NO: 755442 - RNA, 64 nt, Homo Sapiens
uauauaaauauauauacauguagauagguagauauauauauauacgagacuguauacguccaua

SEQ ID NO: 755443 - RNA, 64 nt, Homo Sapiens
uauauauaaauauauauacauauagauagguagauauauauauauccgagacuguauacgucca

SEQ ID NO: 755444 - RNA, 64 nt, Homo Sapiens
cacauauauguuucuguguuguguauaguauauauauauauacaacacacacauacauaugugu

SEQ ID NO: 755445 - RNA, 64 nt, Homo Sapiens
cacacauauauguuucugugguguguauaguauauauauauauaauacacacacauacauaugu

SEQ ID NO: 755446 - RNA, 64 nt, Homo Sapiens
uacacacauauauguuucugguguguguauaguauauauauauaauauacacacacauacauau

SEQ ID NO: 755447 - RNA, 64 nt, Homo Sapiens
uauacacacauauauguuucauguguguguauaguauauauauaauauauacacacacauacau

SEQ ID NO: 755448 - RNA, 64 nt, Homo Sapiens
cacacauacauauguguguguacauauauauguauauauauacaguuucugugauauacauaua

SEQ ID NO: 755449 - RNA, 64 nt, Homo Sapiens
cacacacauacauauguguguauacauauauauguauauauauaauguuucugugauauacaua

SEQ ID NO: 755450 - RNA, 64 nt, Homo Sapiens
ucaaagcacaauaauugaaacacacauauauauauauauauaauuauauauauauauacacaca

SEQ ID NO: 755451 - RNA, 64 nt, Homo Sapiens
auucaaagcacaauaauugacacacacauauauauauauauauauauauauauauauauacaca

SEQ ID NO: 755452 - RNA, 64 nt, Homo Sapiens
uaauucaaagcacaauaauucacacacacauauauauauauauauauauauauauauauauaca

SEQ ID NO: 755453 - RNA, 64 nt, Homo Sapiens
uauaauucaaagcacaauaacacacacacacauauauauauauauauauauauauauauauaua

SEQ ID NO: 755454 - RNA, 64 nt, Homo Sapiens
uauauaauucaaagcacaauuacacacacacacauauauauauaauuauauauauauauauaua

SEQ ID NO: 755455 - RNA, 64 nt, Homo Sapiens
cacacacacauauauauauaauuauauauauauauauauauacaauccauucucaaaaguuaaa

SEQ ID NO: 755456 - RNA, 64 nt, Homo Sapiens
cacacacacacauauauauaaaauuauauauauauauauauauauuauccauucucaaaaguua

SEQ ID NO: 755457 - RNA, 64 nt, Homo Sapiens
uacacacacacacauauauauaaaauuauauauauauauauauaaauuauccauucucaaaagu

SEQ ID NO: 755458 - RNA, 64 nt, Homo Sapiens
uauacacacacacacauauaguuaaaauuauauauauauauauaaaaauuauccauucucaaaa

SEQ ID NO: 755459 - RNA, 64 nt, Homo Sapiens
uauauacacacacacacauaaaguuaaaauuauauauauauauauuaaaauuauccauucucaa

SEQ ID NO: 755460 - RNA, 64 nt, Homo Sapiens
uauauauacacacacacacaaaaaguuaaaauuauauauauauaaguuaaaauuauccauucuc

SEQ ID NO: 755461 - RNA, 64 nt, Homo Sapiens
uauauauauacacacacacaucaaaaguuaaaauuauauauauaaaaguuaaaauuauccauuc

SEQ ID NO: 755462 - RNA, 64 nt, Homo Sapiens
gcuuugccuuaauauaccccuauacauauauauauauauauauguaacaaucuuuggauuuguc

SEQ ID NO: 755463 - RNA, 64 nt, Homo Sapiens
uggcuuugccuuaauauaccucuauacauauauauauauauauaaguaacaaucuuuggauuug

SEQ ID NO: 755464 - RNA, 64 nt, Homo Sapiens
uauggcuuugccuuaauauaugucuauacauauauauauauauagaaguaacaaucuuuggauu

SEQ ID NO: 755465 - RNA, 64 nt, Homo Sapiens
uauauggcuuugccuuaauauuugucuauacauauauauauauaaagaaguaacaaucuuugga

SEQ ID NO: 755466 - RNA, 64 nt, Homo Sapiens
uauauauggcuuugccuuaagauuugucuauacauauauauauauaaagaaguaacaaucuuug

SEQ ID NO: 755467 - RNA, 64 nt, Homo Sapiens
uucaauaaagcuuucuguuucucagauauauauauauauauaaaacccuuucacaagcuaccau

SEQ ID NO: 755468 - RNA, 64 nt, Homo Sapiens
aauucaauaaagcuuucuguaucucagauauauauauauauauacuacccuuucacaagcuacc

SEQ ID NO: 755469 - RNA, 64 nt, Homo Sapiens
uaaauucaauaaagcuuucuccaucucagauauauauauauauauacuacccuuucacaagcua

SEQ ID NO: 755470 - RNA, 64 nt, Homo Sapiens
uauaaauucaauaaagcuuuuaccaucucagauauauauauauaauuacuacccuuucacaagc

SEQ ID NO: 755471 - RNA, 64 nt, Homo Sapiens
uauauaaauucaauaaagcugcuaccaucucagauauauauauacaauuacuacccuuucacaa

SEQ ID NO: 755472 - RNA, 64 nt, Homo Sapiens
ggauuucuaaggaugguggugccuuuuucauauauauauauauuuaauuuaacugagaaagaaa

SEQ ID NO: 755473 - RNA, 64 nt, Homo Sapiens
uuggauuucuaaggauggugaagccuuuuucauauauauauauaucuaauuuaacugagaaaga

SEQ ID NO: 755474 - RNA, 64 nt, Homo Sapiens
uauuggauuucuaaggaugggaaagccuuuuucauauauauauauaucuaauuuaacugagaaa

SEQ ID NO: 755475 - RNA, 64 nt, Homo Sapiens
cagcagcaaaagagccauguauuaauaaaaaauuuauauauagggaucuucccaauacaagaaa

SEQ ID NO: 755476 - RNA, 64 nt, Homo Sapiens
uauaaauauaaauauaucucuauauauauauacauauauauaaaagucuuuuguacauaacaua

SEQ ID NO: 755477 - RNA, 64 nt, Homo Sapiens
uauauauaaauauaaauauaacauaacauauauauauauauacagauaucucaaagucuuuugu

SEQ ID NO: 755478 - RNA, 64 nt, Homo Sapiens
cauauauauaaauauaaauaguacauaacauauauauauauauacugauaucucaaagucuuuu

SEQ ID NO: 755479 - RNA, 64 nt, Homo Sapiens
uacauauauauaaauauaaauuguacauaacauauauauauauagccugauaucucaaagucuu

SEQ ID NO: 755480 - RNA, 64 nt, Homo Sapiens
uauacauauauauaaauauauuuuguacauaacauauauauauagugccugauaucucaaaguc

SEQ ID NO: 755481 - RNA, 64 nt, Homo Sapiens
ggguuauuugaaaccaauccuauaaauauaaaauuauauauaaauuuugauauaacuauauaua

SEQ ID NO: 755482 - RNA, 64 nt, Homo Sapiens
uauaaaauuauauauaaagguugauauaacuauauauauauaaauauacuauguacuaucaguu

SEQ ID NO: 755483 - RNA, 64 nt, Homo Sapiens
aauauaaaauuauauauaaauuuugauauaacuauauauauauaguuauacuauguacuaucag

SEQ ID NO: 755484 - RNA, 64 nt, Homo Sapiens
uaaauauaaaauuauauauaaguuuugauauaacuauauauauacaguuauacuauguacuauc

SEQ ID NO: 755485 - RNA, 64 nt, Homo Sapiens
uaauaaaacauuuuaagcuauuacccuguaauauuauauauacuaaaacauaacuuuguaaaua

SEQ ID NO: 755486 - RNA, 64 nt, Homo Sapiens
uauguauauacacacauguauauauacguauaucuauauauacgaaaaaauauguauacacaaa

SEQ ID NO: 755487 - RNA, 64 nt, Homo Sapiens
uauucuuuaguuuuugugauuauguuuauauauauauauauauugacgauuucucagcagggcc

SEQ ID NO: 755488 - RNA, 64 nt, Homo Sapiens
uuuauucuuuaguuuuugugccuauguuuauauauauauauauaaugacgauuucucagcaggg

SEQ ID NO: 755489 - RNA, 64 nt, Homo Sapiens
uauuuauucuuuaguuuuugggccuauguuuauauauauauauauuaugacgauuucucagcag

SEQ ID NO: 755490 - RNA, 64 nt, Homo Sapiens
uauauuuauucuuuaguuuuagggccuauguuuauauauauauaauuuaugacgauuucucagc

SEQ ID NO: 755491 - RNA, 64 nt, Homo Sapiens
uauauauuuauucuuuaguugcagggccuauguuuauauauauagaauuuaugacgauuucuca

SEQ ID NO: 755492 - RNA, 64 nt, Homo Sapiens
uagcauaagacgugauauuuauaauaaauauaucuauauauauuauuccaaaaccugcugcauc

SEQ ID NO: 755493 - RNA, 64 nt, Homo Sapiens
auaaguugccagaucucuaaggucacagaugccuuauauauaaauuuaauucauaacgucucuu

SEQ ID NO: 755494 - RNA, 64 nt, Homo Sapiens
ugugugugugugugugugugauuguuacuccauauauauauaugcaguugacuagaaucgacaa

SEQ ID NO: 755495 - RNA, 64 nt, Homo Sapiens
ugugugugugugugugugugaaauuguuacuccauauauauauaggcaguugacuagaaucgac

SEQ ID NO: 755496 - RNA, 64 nt, Homo Sapiens
gaguauuguaccacuugagagaguauauucccuuuauauauauuuggucaugcccacucuuugg

SEQ ID NO: 755497 - RNA, 64 nt, Homo Sapiens
auaaaagcaauauguucucuuauauauauauauauauauauacccuugauguuauauguagaga

SEQ ID NO: 755498 - RNA, 64 nt, Homo Sapiens
ccauaaaagcaauauguucugauauauauauauauauauauauagacuugauguuauauguaga

SEQ ID NO: 755499 - RNA, 64 nt, Homo Sapiens
uaccauaaaagcaauauguugagauauauauauauauauauauaaugacuugauguuauaugua

SEQ ID NO: 755500 - RNA, 64 nt, Homo Sapiens
uauaccauaaaagcaauauguagagauauauauauauauauauagcaugacuugauguuauaug

SEQ ID NO: 755501 - RNA, 64 nt, Homo Sapiens
uauauaccauaaaagcaauauguagagauauauauauauauauagugcaugacuugauguuaua

SEQ ID NO: 755502 - RNA, 64 nt, Homo Sapiens
uauauauaccauaaaagcaauauguagagauauauauauauauaaugugcaugacuugauguua

SEQ ID NO: 755503 - RNA, 64 nt, Homo Sapiens
uauauauauaccauaaaagcuauauguagagauauauauauauauaaugugcaugacuugaugu

SEQ ID NO: 755504 - RNA, 64 nt, Homo Sapiens
uauauauauauaccauaaaaguuauauguagagauauauauauacuuaaugugcaugacuugau

SEQ ID NO: 755505 - RNA, 64 nt, Homo Sapiens
cacacacacaaagggauagaauguaugauauauauauauauacaagaugcauagauaugggauu

SEQ ID NO: 755506 - RNA, 64 nt, Homo Sapiens
cacacacacacaaagggauauuauguaugauauauauauauauaauagaugcauagauauggga

SEQ ID NO: 755507 - RNA, 64 nt, Homo Sapiens
uacacacacacacaaagggagauuauguaugauauauauauauaguauagaugcauagauaugg

SEQ ID NO: 755508 - RNA, 64 nt, Homo Sapiens
uauacacacacacacaaagggggauuauguaugauauauauauaggguauagaugcauagauau

SEQ ID NO: 755509 - RNA, 64 nt, Homo Sapiens
aagguuugauccaucaagcuuauauauauauacauauauauaaauauauguguguguguauaua

SEQ ID NO: 755510 - RNA, 64 nt, Homo Sapiens
uauauauaaaaagguuugauuguguauauauauauauauauacauauauauauauauaugugug

SEQ ID NO: 755511 - RNA, 64 nt, Homo Sapiens
cauauauauaaaaagguuuguguguguauauauauauauauauagauauauauauauauaugug

SEQ ID NO: 755512 - RNA, 64 nt, Homo Sapiens
uacauauauauaaaaagguuuguguguguauauauauauauauagagauauauauauauauaug

SEQ ID NO: 755513 - RNA, 64 nt, Homo Sapiens
uauacauauauauaaaaagguguguguguguauauauauauauacugagauauauauauauaua

SEQ ID NO: 755514 - RNA, 64 nt, Homo Sapiens
uauauacauauauauaaaaauauguguguguguauauauauauacacugagauauauauauaua

SEQ ID NO: 755515 - RNA, 64 nt, Homo Sapiens
uauauauacauauauauaaauauauguguguguguauauauauaagcacugagauauauauaua

SEQ ID NO: 755516 - RNA, 64 nt, Homo Sapiens
uguguguguauauauauauacacugagauauauauauauauaugggaaguuagguacaaugcag

SEQ ID NO: 755517 - RNA, 64 nt, Homo Sapiens
uguguguguguauauauauaagcacugagauauauauauauauaguggaaguuagguacaaugc

SEQ ID NO: 755518 - RNA, 64 nt, Homo Sapiens
uauguguguguguauauauagcagcacugagauauauauauauauuguggaaguuagguacaau

SEQ ID NO: 755519 - RNA, 64 nt, Homo Sapiens
uauauguguguguguauauaaugcagcacugagauauauauauauguuguggaaguuagguaca

SEQ ID NO: 755520 - RNA, 64 nt, Homo Sapiens
auuaaaaaaagcaacugggucacuuucuuauauauauauauaaugauuuuuuggagaacaucug

SEQ ID NO: 755521 - RNA, 64 nt, Homo Sapiens
auauuaaaaaaagcaacuggugcacuuucuuauauauauauauaaagauuuuuuggagaacauc

SEQ ID NO: 755522 - RNA, 64 nt, Homo Sapiens
uaauauuaaaaaaagcaacuucugcacuuucuuauauauauauaccaagauuuuuuggagaaca

SEQ ID NO: 755523 - RNA, 64 nt, Homo Sapiens
uauaauauuaaaaaaagcaacaucugcacuuucuuauauauauaugccaagauuuuuuggagaa

SEQ ID NO: 755524 - RNA, 64 nt, Homo Sapiens
uacuguuuuguuuccugucuuauaucuauauaucuauauauaugaaaaauuuuuaaaagauaua

SEQ ID NO: 755525 - RNA, 64 nt, Homo Sapiens
uauauaucuauauauauguaaaauuuuuaaaagauauauauaucagaggaacuucaauuaugaa

SEQ ID NO: 755526 - RNA, 64 nt, Homo Sapiens
uguccuacagggagcuuuuaaccuuacccauguuuauauauagccacagaacuagucugcgcuu

SEQ ID NO: 755527 - RNA, 64 nt, Homo Sapiens
aagccccaggcugaauacucugagaacauauauauauauauauuaagaggaagauaauggagaa

SEQ ID NO: 755528 - RNA, 64 nt, Homo Sapiens
uuaagccccaggcugaauacaaugagaacauauauauauauauaaaaagaggaagauaauggag

SEQ ID NO: 755529 - RNA, 64 nt, Homo Sapiens
uauuaagccccaggcugaauagaaugagaacauauauauauauaaaaaaagaggaagauaaugg

SEQ ID NO: 755530 - RNA, 64 nt, Homo Sapiens
uauauuaagccccaggcugaggagaaugagaacauauauauauaaaaaaaaagaggaagauaau

SEQ ID NO: 755531 - RNA, 64 nt, Homo Sapiens
ccuaaaaaagauauauuaaaauauauaaaauaaauauauauaaaguaaauauauaaauauauau

SEQ ID NO: 755532 - RNA, 64 nt, Homo Sapiens
auaaauauauauaaaccuaauauauaaauauauauauauauaaaauauauggcagaguuguaaa

SEQ ID NO: 755533 - RNA, 64 nt, Homo Sapiens
aaauaaauauauauaaaccuaauauauaaauauauauauauauagaauauauggcagaguugua

SEQ ID NO: 755534 - RNA, 64 nt, Homo Sapiens
uaaaauaaauauauauaaacuaaauauauaaauauauauauauaaggaauauauggcagaguug

SEQ ID NO: 755535 - RNA, 64 nt, Homo Sapiens
uauaaaauaaauauauauaauguaaauauauaaauauauauauagaaggaauauauggcagagu

SEQ ID NO: 755536 - RNA, 64 nt, Homo Sapiens
uauguaacagucaaauaucauuuucuuuuucgucuauauauacaugaagauguuuauugguaua

SEQ ID NO: 755537 - RNA, 64 nt, Homo Sapiens
uguuuuucuauuaaaaauaguauauauagauauguauauauacagggaaggggugcuccuuaaa

SEQ ID NO: 755538 - RNA, 64 nt, Homo Sapiens
uauguauauauacauguuuugggugcuccuuaaauauauauagaucauacucaacugggggaag

SEQ ID NO: 755539 - RNA, 64 nt, Homo Sapiens
uacauauaugaaagaaggcuacgucuguauauuuuauauauagaaugaacagacuucuaaaaua

SEQ ID NO: 755540 - RNA, 64 nt, Homo Sapiens
cuugugccuaguacuuuaccaaaugccuaaucgauauauauauuuuagagacugauuagacuga

SEQ ID NO: 755541 - RNA, 64 nt, Homo Sapiens
ggcaaagccuucaaaugcuugucacaucuuacuguauauauauaauuccuacugaagaaauccc

SEQ ID NO: 755542 - RNA, 64 nt, Homo Sapiens
caaagccuucaaaugcuugucacaucuuacuguauauauauaauuccuacugaagaaauccccu

SEQ ID NO: 755543 - RNA, 64 nt, Homo Sapiens
uguacauuucuauaaauagaugcuguguauaugguauauauacauauauauauauaacauauau

SEQ ID NO: 755544 - RNA, 64 nt, Homo Sapiens
uauaaauagaugcuguguauaugguauauauacauauauauauauaacauauauggaagaggaa

SEQ ID NO: 755545 - RNA, 64 nt, Homo Sapiens
uaaauagaugcuguguauaugguauauauacauauauauauauaacauauauggaagaggaaaa

SEQ ID NO: 755546 - RNA, 64 nt, Homo Sapiens
aauagaugcuguguauaugguauauauacauauauauauauaacauauauggaagaggaaaagg

SEQ ID NO: 755547 - RNA, 64 nt, Homo Sapiens
gugcagguuccgauguuauuagauguuacaaguuuauauauaucuauauauauaauuuauugag

SEQ ID NO: 755548 - RNA, 64 nt, Homo Sapiens
cgauguuauuagauguuacaaguuuauauauaucuauauauauaauuuauugaguuuuuacaag

SEQ ID NO: 755549 - RNA, 64 nt, Homo Sapiens
auguuauuagauguuacaaguuuauauauaucuauauauauaauuuauugaguuuuuacaagau

SEQ ID NO: 755550 - RNA, 64 nt, Homo Sapiens
auuuguccauagcaaacauauguguguguguguguauauauauauguggguugccaauguuugg

SEQ ID NO: 755551 - RNA, 64 nt, Homo Sapiens
uuguccauagcaaacauauguguguguguguguauauauauauguggguugccaauguuugguu

SEQ ID NO: 755552 - RNA, 64 nt, Homo Sapiens
augugauacuggaauaugggauacuuuucauguuuauauauauauauauauguauauauauaua

SEQ ID NO: 755553 - RNA, 64 nt, Homo Sapiens
gugauacuggaauaugggauacuuuucauguuuauauauauauauauauguauauauauauaca

SEQ ID NO: 755554 - RNA, 64 nt, Homo Sapiens
gauacuggaauaugggauacuuuucauguuuauauauauauauauauguauauauauauacaua

SEQ ID NO: 755555 - RNA, 64 nt, Homo Sapiens
uacuggaauaugggauacuuuucauguuuauauauauauauauauguauauauauauacauaua

SEQ ID NO: 755556 - RNA, 64 nt, Homo Sapiens
cuggaauaugggauacuuuucauguuuauauauauauauauauguauauauauauacauauaua

SEQ ID NO: 755557 - RNA, 64 nt, Homo Sapiens
ggauacuuuucauguuuauauauauauauauauguauauauauauacauauauauauauauaua

SEQ ID NO: 755558 - RNA, 64 nt, Homo Sapiens
auacuuuucauguuuauauauauauauauauguauauauauauacauauauauauauauauaaa

SEQ ID NO: 755559 - RNA, 64 nt, Homo Sapiens
acuuuucauguuuauauauauauauauauguauauauauauacauauauauauauauauaaaca

SEQ ID NO: 755560 - RNA, 64 nt, Homo Sapiens
uuuauauauauauauauauguauauauauauacauauauauauauauauaaacaugaaauauau

SEQ ID NO: 755561 - RNA, 64 nt, Homo Sapiens
uauauauauauauauauguauauauauauacauauauauauauauauaaacaugaaauauauau

SEQ ID NO: 755562 - RNA, 64 nt, Homo Sapiens
uauauauauauauauguauauauauauacauauauauauauauauaaacaugaaauauauauau

SEQ ID NO: 755563 - RNA, 64 nt, Homo Sapiens
uauauauauauauguauauauauauacauauauauauauauauaaacaugaaauauauauauau

SEQ ID NO: 755564 - RNA, 64 nt, Homo Sapiens
uauauauauauguauauauauauacauauauauauauauauaaacaugaaauauauauauaugg

SEQ ID NO: 755565 - RNA, 64 nt, Homo Sapiens
auauauacauauauauauauauauaaacaugaaauauauauauauggcuccuuugugccccaug

SEQ ID NO: 755566 - RNA, 64 nt, Homo Sapiens
auauacauauauauauauauauaaacaugaaauauauauauauggcuccuuugugccccauguc

SEQ ID NO: 755567 - RNA, 64 nt, Homo Sapiens
auuuccucuuuuggauaggucuuuaaccaguucauauauauacuuugucaaauauauggaugug

SEQ ID NO: 755568 - RNA, 64 nt, Homo Sapiens
agaauuguuagcaaaugacagauuucuguaagccuauauauauagucaaaucgauuuaguaagu

SEQ ID NO: 755569 - RNA, 64 nt, Homo Sapiens
aauuguuagcaaaugacagauuucuguaagccuauauauauagucaaaucgauuuaguaaguau

SEQ ID NO: 755570 - RNA, 64 nt, Homo Sapiens
aaacaaguaaauauauauggucauauacauauuguauauauauucauauacaaacauguaugua

SEQ ID NO: 755571 - RNA, 64 nt, Homo Sapiens
uuagucuaacucccccauuuuacagauuucucacuauauauauuucuagaaggggcuaugcaua

SEQ ID NO: 755572 - RNA, 64 nt, Homo Sapiens
uugcugaggaaaugaagauaagcaaaaauauaaauauauauauaaauauaugaguuauuaaaau

SEQ ID NO: 755573 - RNA, 64 nt, Homo Sapiens
gcugaggaaaugaagauaagcaaaaauauaaauauauauauaaauauaugaguuauuaaaauca

SEQ ID NO: 755574 - RNA, 64 nt, Homo Sapiens
ugucaguauuuuuguaauuauuucuaccuccaaauauauauauauugucuuucacuggauaaug

SEQ ID NO: 755575 - RNA, 64 nt, Homo Sapiens
ucaguauuuuuguaauuauuucuaccuccaaauauauauauauugucuuucacuggauaaugug

SEQ ID NO: 755576 - RNA, 64 nt, Homo Sapiens
auaguguuuuacguuuuuuauccugcugaaaaaguauauauaaaauaucuaacauuacaggaua

SEQ ID NO: 755577 - RNA, 64 nt, Homo Sapiens
ugagcaaauaagauuaaguaaaacaaaucaauuguauauauaauugaccuuuuuguggaacaug

SEQ ID NO: 755578 - RNA, 64 nt, Homo Sapiens
aagauggcagauuuucugcauuuacacuguauauuauauauauauuuuuauugugguucuuacc

SEQ ID NO: 755579 - RNA, 64 nt, Homo Sapiens
gauggcagauuuucugcauuuacacuguauauuauauauauauuuuuauugugguucuuacccc

SEQ ID NO: 755580 - RNA, 64 nt, Homo Sapiens
guacagcagaaaaucuuuuacuaguguguguguguauauauauaaacaauuguaaauuucuuuu

SEQ ID NO: 755581 - RNA, 64 nt, Homo Sapiens
acagcagaaaaucuuuuacuaguguguguguguauauauauaaacaauuguaaauuucuuuuag

SEQ ID NO: 755582 - RNA, 64 nt, Homo Sapiens
uauguauacaugauuaggguaagauagaauguauuauauauauauauauauacacacacacaua

SEQ ID NO: 755583 - RNA, 64 nt, Homo Sapiens
uguauacaugauuaggguaagauagaauguauuauauauauauauauauacacacacacauaua

SEQ ID NO: 755584 - RNA, 64 nt, Homo Sapiens
uauacaugauuaggguaagauagaauguauuauauauauauauauauacacacacacauauaua

SEQ ID NO: 755585 - RNA, 64 nt, Homo Sapiens
uacaugauuaggguaagauagaauguauuauauauauauauauauacacacacacauauauaua

SEQ ID NO: 755586 - RNA, 64 nt, Homo Sapiens
caugauuaggguaagauagaauguauuauauauauauauauauacacacacacauauauauagc

SEQ ID NO: 755587 - RNA, 64 nt, Homo Sapiens
ugauuaggguaagauagaauguauuauauauauauauauauacacacacacauauauauagcug

SEQ ID NO: 755588 - RNA, 64 nt, Homo Sapiens
auguauuauauauauauauauauacacacacacauauauauagcugaaucuuugguguauugaa

SEQ ID NO: 755589 - RNA, 64 nt, Homo Sapiens
aaauagcagugaauuuuagucauuaacuucaaaauauauauauauauauaauuuaaaggaaaaa

SEQ ID NO: 755590 - RNA, 64 nt, Homo Sapiens
auagcagugaauuuuagucauuaacuucaaaauauauauauauauauaauuuaaaggaaaaaua

SEQ ID NO: 755591 - RNA, 64 nt, Homo Sapiens
agcagugaauuuuagucauuaacuucaaaauauauauauauauauaauuuaaaggaaaaauagg

SEQ ID NO: 755592 - RNA, 64 nt, Homo Sapiens
cagugaauuuuagucauuaacuucaaaauauauauauauauauaauuuaaaggaaaaauaggug

SEQ ID NO: 755593 - RNA, 64 nt, Homo Sapiens
gugaauuuuagucauuaacuucaaaauauauauauauauauaauuuaaaggaaaaauaggugcc

SEQ ID NO: 755594 - RNA, 64 nt, Homo Sapiens
aauuggcggguaaaaaucacaaaaugcagucgaauauauauaugaaaacuugcauuaggugaua

SEQ ID NO: 755595 - RNA, 64 nt, Homo Sapiens
ugggcgacagagcaagaccaccaucuccaaaaauuauauauauaaaaauaauuaauauuauaga

SEQ ID NO: 755596 - RNA, 64 nt, Homo Sapiens
ggcgacagagcaagaccaccaucuccaaaaauuauauauauaaaaauaauuaauauuauagaag

SEQ ID NO: 755597 - RNA, 64 nt, Homo Sapiens
gucaaucaagacaaaugaaauauauauguauguguauauauauacauguauguaugaaauauau

SEQ ID NO: 755598 - RNA, 64 nt, Homo Sapiens
caaucaagacaaaugaaauauauauguauguguauauauauacauguauguaugaaauauauau

SEQ ID NO: 755599 - RNA, 64 nt, Homo Sapiens
auguauguguauauauauacauguauguaugaaauauauauaugugcguguguguguguauaua

SEQ ID NO: 755600 - RNA, 64 nt, Homo Sapiens
auguaugaaauauauauaugugcguguguguguguauauauauauauauauauauauauuucua

SEQ ID NO: 755601 - RNA, 64 nt, Homo Sapiens
guaugaaauauauauaugugcguguguguguguauauauauauauauauauauauauuucuaug

SEQ ID NO: 755602 - RNA, 64 nt, Homo Sapiens
augaaauauauauaugugcguguguguguguauauauauauauauauauauauauuucuaugaa

SEQ ID NO: 755603 - RNA, 64 nt, Homo Sapiens
gaaauauauauaugugcguguguguguguauauauauauauauauauauauauuucuaugaaau

SEQ ID NO: 755604 - RNA, 64 nt, Homo Sapiens
aauauauauaugugcguguguguguguauauauauauauauauauauauauuucuaugaaauug

SEQ ID NO: 755605 - RNA, 64 nt, Homo Sapiens
uauauauaugugcguguguguguguauauauauauauauauauauauauuucuaugaaauuguc

SEQ ID NO: 755606 - RNA, 64 nt, Homo Sapiens
uauauaugugcguguguguguguauauauauauauauauauauauauuucuaugaaauugucca

SEQ ID NO: 755607 - RNA, 64 nt, Homo Sapiens
uauaugugcguguguguguguauauauauauauauauauauauauuucuaugaaauuguccaga

SEQ ID NO: 755608 - RNA, 64 nt, Homo Sapiens
uaugugcguguguguguguauauauauauauauauauauauauuucuaugaaauuguccagaug

SEQ ID NO: 755609 - RNA, 64 nt, Homo Sapiens
ugauuguaaaaacaaaaagacugaacuuacugcuuauauauauuuacacuaacauauuuagaag

SEQ ID NO: 755610 - RNA, 64 nt, Homo Sapiens
uuaaaaaggaaagaaaacuauauauauauauauauauauauaaagaaauauauauauauauaua

SEQ ID NO: 755611 - RNA, 64 nt, Homo Sapiens
aauuaaaaaggaaagaaaacuauauauauauauauauauauauaaggaaauauauauauauaua

SEQ ID NO: 755612 - RNA, 64 nt, Homo Sapiens
uaaauuaaaaaggaaagaaauauauauauauauauauauauauaaaaggaaauauauauauaua

SEQ ID NO: 755613 - RNA, 64 nt, Homo Sapiens
uauaaauuaaaaaggaaagauauauauauauauauauauauauacaaaaggaaauauauauaua

SEQ ID NO: 755614 - RNA, 64 nt, Homo Sapiens
uauauaaauuaaaaaggaaauauauauauauauauauauauauauucaaaaggaaauauauaua

SEQ ID NO: 755615 - RNA, 64 nt, Homo Sapiens
uauauauaaauuaaaaaggauauauauauauauauauauauauauauucaaaaggaaauauaua

SEQ ID NO: 755616 - RNA, 64 nt, Homo Sapiens
uauauauauaaauuaaaaaguauauauauauauauauauauauaucuauucaaaaggaaauaua

SEQ ID NO: 755617 - RNA, 64 nt, Homo Sapiens
uauauauauauaaauuaaaauauauauauauauauauauauauaauucuauucaaaaggaaaua

SEQ ID NO: 755618 - RNA, 64 nt, Homo Sapiens
uauauauauauauaaauuaauauauauauauauauauauauauaguauucuauucaaaaggaaa

SEQ ID NO: 755619 - RNA, 64 nt, Homo Sapiens
uauauauauauauauaaauuaauauauauauauauauauauauaucguauucuauucaaaagga

SEQ ID NO: 755620 - RNA, 64 nt, Homo Sapiens
uauauauauauauauauaaagaaauauauauauauauauauauaguucguauucuauucaaaag

SEQ ID NO: 755621 - RNA, 64 nt, Homo Sapiens
uauauauauauauauauauaaggaaauauauauauauauauauaauguucguauucuauucaaa

SEQ ID NO: 755622 - RNA, 64 nt, Homo Sapiens
uauauauauauauauauauaaaaggaaauauauauauauauauaaaauguucguauucuauuca

SEQ ID NO: 755623 - RNA, 64 nt, Homo Sapiens
uauauauauauauauauauacaaaaggaaauauauauauauauacaaaauguucguauucuauu

SEQ ID NO: 755624 - RNA, 64 nt, Homo Sapiens
uauauauauauauauauauauucaaaaggaaauauauauauauauucaaaauguucguauucua

SEQ ID NO: 755625 - RNA, 64 nt, Homo Sapiens
uauauauauauauauauauauauucaaaaggaaauauauauauaacuucaaaauguucguauuc

SEQ ID NO: 755626 - RNA, 64 nt, Homo Sapiens
cauacacaaauauaugcauauauauauauacacauauauauacauguguacguguguauaugug

SEQ ID NO: 755627 - RNA, 64 nt, Homo Sapiens
cauauauauacacauacacauguguauauguguauauauauacauuucaaaauauguguguacg

SEQ ID NO: 755628 - RNA, 64 nt, Homo Sapiens
cacauauauauacacauacacguguguauauguguauauauauauauuucaaaauaugugugua

SEQ ID NO: 755629 - RNA, 64 nt, Homo Sapiens
caauagaauacuaugcagccuaaagaaaaugugguauauauacauccaacaacagaugaaugga

SEQ ID NO: 755630 - RNA, 64 nt, Homo Sapiens
gaaaucuauuacaauaaaaauaguugacuuuguauauauauaaaaaaaaaagguuaagaagucc

SEQ ID NO: 755631 - RNA, 64 nt, Homo Sapiens
aagaaaucuauuacaauaaaccuaguugacuuuguauauauauaacaaaaaaagguuaagaagu

SEQ ID NO: 755632 - RNA, 64 nt, Homo Sapiens
ucaauguauuuuuuauuuuauuucaugcaaaaaauauauauauuucagggguucuuaaccuaca

SEQ ID NO: 755633 - RNA, 64 nt, Homo Sapiens
auauauuauauauuuagcauauauauuauauauuuauauauaauugguaaaaacguauguauuu

SEQ ID NO: 755634 - RNA, 64 nt, Homo Sapiens
guggccacgcuggggcaaguguagaauauauaauuauauauaaggaagaaggccagcauuuaug

SEQ ID NO: 755635 - RNA, 64 nt, Homo Sapiens
uuccaauucaggauauugcccauauauauauauauauauauaauuuuucuuguauuucuguuuc

SEQ ID NO: 755636 - RNA, 64 nt, Homo Sapiens
auuuccaauucaggauauuguccauauauauauauauauauauauauuuucuuguauuucuguu

SEQ ID NO: 755637 - RNA, 64 nt, Homo Sapiens
uaauuuccaauucaggauauuuuccauauauauauauauauauacauauuuucuuguauuucug

SEQ ID NO: 755638 - RNA, 64 nt, Homo Sapiens
uauaauuuccaauucaggauuguuuccauauauauauauauauaagcauauuuucuuguauuuc

SEQ ID NO: 755639 - RNA, 64 nt, Homo Sapiens
uauauaauuuccaauucaggucuguuuccauauauauauauauacaagcauauuuucuuguauu

SEQ ID NO: 755640 - RNA, 64 nt, Homo Sapiens
uauauauaauuuccaauucauuucuguuuccauauauauauauacccaagcauauuuucuugua

SEQ ID NO: 755641 - RNA, 64 nt, Homo Sapiens
uauauauauaauuuccaauuuauuucuguuuccauauauauauacccccaagcauauuuucuug

SEQ ID NO: 755642 - RNA, 64 nt, Homo Sapiens
auauauuaaaaaugaaacaauguacauauauauauauauauaauauuuuuuuaaauguguguua

SEQ ID NO: 755643 - RNA, 64 nt, Homo Sapiens
auauauauuaaaaaugaaacuauguacauauauauauauauauaggauuuuuuuaaaugugugu

SEQ ID NO: 755644 - RNA, 64 nt, Homo Sapiens
uaauauauauuaaaaaugaaguuauguacauauauauauauauaugggauuuuuuuaaaugugu

SEQ ID NO: 755645 - RNA, 64 nt, Homo Sapiens
uauaauauauauuaaaaaugguguuauguacauauauauauauaggugggauuuuuuuaaaugu

SEQ ID NO: 755646 - RNA, 64 nt, Homo Sapiens
uauauaauauauauuaaaaaguguguuauguacauauauauauaguggugggauuuuuuuaaau

SEQ ID NO: 755647 - RNA, 64 nt, Homo Sapiens
cauacauauauacacauauauuuccuaguagauauauauauacaaaacaccuuaagcaauauau

SEQ ID NO: 755648 - RNA, 64 nt, Homo Sapiens
cacauacauauauacacauaauuuuccuaguagauauauauauaacaaacaccuuaagcaauau

SEQ ID NO: 755649 - RNA, 64 nt, Homo Sapiens
uuucuuuuccugugaaaagcuucuauuuuauauauauauauaugcacuuggguuuuuuaauuaa

SEQ ID NO: 755650 - RNA, 64 nt, Homo Sapiens
uguuucuuuuccugugaaaaaauucuauuuuauauauauauauagacacuuggguuuuuuaauu

SEQ ID NO: 755651 - RNA, 64 nt, Homo Sapiens
uauguuucuuuuccugugaauuaauucuauuuuauauauauauaaugacacuuggguuuuuuaa

SEQ ID NO: 755652 - RNA, 64 nt, Homo Sapiens
uauauguuucuuuuccugugaauuaauucuauuuuauauauauaauaugacacuuggguuuuuu

SEQ ID NO: 755653 - RNA, 64 nt, Homo Sapiens
aacaguaguucaaggugccagcacugcuauuuauuauauauaucguauuugaauauuuuguaau

SEQ ID NO: 755654 - RNA, 64 nt, Homo Sapiens
uauaaaaauuuguuaaaggcuauauucuuauauuuauauauaaauuaguuaugugcaagcuuug

SEQ ID NO: 755655 - RNA, 64 nt, Homo Sapiens
auauagcuuaagcugauuuauauauacauacauauauauauaucuuuauauauauauauauaua

SEQ ID NO: 755656 - RNA, 64 nt, Homo Sapiens
ucauauagcuuaagcugauuuauauauacauacauauauauauaauuuuauauauauauauaua

SEQ ID NO: 755657 - RNA, 64 nt, Homo Sapiens
uacauauauauauaucauauuauauauauauauauauauauacaaaagaucuagugcgauuuua

SEQ ID NO: 755658 - RNA, 64 nt, Homo Sapiens
cauacauauauauauaucauuauauauauauauauauauauauaaaaaagaucuagugcgauuu

SEQ ID NO: 755659 - RNA, 64 nt, Homo Sapiens
uacauacauauauauauaucuuuauauauauauauauauauauaaaaaaaagaucuagugcgau

SEQ ID NO: 755660 - RNA, 64 nt, Homo Sapiens
uauacauacauauauauauaauuuuauauauauauauauauauagcaaaaaaagaucuagugcg

SEQ ID NO: 755661 - RNA, 64 nt, Homo Sapiens
uauauacauacauauauauacgauuuuauauauauauauauauauagcaaaaaaagaucuagug

SEQ ID NO: 755662 - RNA, 64 nt, Homo Sapiens
uauauauacauacauauauaugcgauuuuauauauauauauauagauagcaaaaaaagaucuag

SEQ ID NO: 755663 - RNA, 64 nt, Homo Sapiens
uauauauauacauacauauaagugcgauuuuauauauauauauaaggauagcaaaaaaagaucu

SEQ ID NO: 755664 - RNA, 64 nt, Homo Sapiens
uauauauauauacauacauacuagugcgauuuuauauauauauaagaggauagcaaaaaaagau

SEQ ID NO: 755665 - RNA, 64 nt, Homo Sapiens
uauauauauauauacauacaaucuagugcgauuuuauauauauaaaagaggauagcaaaaaaag

SEQ ID NO: 755666 - RNA, 64 nt, Homo Sapiens
acugugugcauauauuaaaugugugaugcugcauuauauauaaaaagaguaaaugcccuacaug

SEQ ID NO: 755667 - RNA, 64 nt, Homo Sapiens
uaucuuuugaaguguuaaaacuuguaaaaaaaaguauauauacaugugaucauuugugauguua

SEQ ID NO: 755668 - RNA, 64 nt, Homo Sapiens
auccuuguuuugaaaaccuaaaagacaggcucuguauauauauauacuuaagaauaugcugacu

SEQ ID NO: 755669 - RNA, 64 nt, Homo Sapiens
ccuuguuuugaaaaccuaaaagacaggcucuguauauauauauacuuaagaauaugcugacuuc

SEQ ID NO: 755670 - RNA, 64 nt, Homo Sapiens
uuguuuugaaaaccuaaaagacaggcucuguauauauauauacuuaagaauaugcugacuucac

SEQ ID NO: 755671 - RNA, 64 nt, Homo Sapiens
accaugagauagcauuagcugcccaggaugcugcuauauauauauauauauauauauaugugug

SEQ ID NO: 755672 - RNA, 64 nt, Homo Sapiens
caugagauagcauuagcugcccaggaugcugcuauauauauauauauauauauauaugugugug

SEQ ID NO: 755673 - RNA, 64 nt, Homo Sapiens
ugagauagcauuagcugcccaggaugcugcuauauauauauauauauauauauaugugugugug

SEQ ID NO: 755674 - RNA, 64 nt, Homo Sapiens
agauagcauuagcugcccaggaugcugcuauauauauauauauauauauauaugugugugugug

SEQ ID NO: 755675 - RNA, 64 nt, Homo Sapiens
auagcauuagcugcccaggaugcugcuauauauauauauauauauauauaugugugugugugug

SEQ ID NO: 755676 - RNA, 64 nt, Homo Sapiens
agcauuagcugcccaggaugcugcuauauauauauauauauauauauaugugugugugugugug

SEQ ID NO: 755677 - RNA, 64 nt, Homo Sapiens
cauuagcugcccaggaugcugcuauauauauauauauauauauauaugugugugugugugugug

SEQ ID NO: 755678 - RNA, 64 nt, Homo Sapiens
uuagcugcccaggaugcugcuauauauauauauauauauauauaugugugugugugugugugug

SEQ ID NO: 755679 - RNA, 64 nt, Homo Sapiens
agcugcccaggaugcugcuauauauauauauauauauauauaugugugugugugugugugugug

SEQ ID NO: 755680 - RNA, 64 nt, Homo Sapiens
uauauauauguguguguguguguguguguguguguauauauauauauauauauauauauauaua

SEQ ID NO: 755681 - RNA, 64 nt, Homo Sapiens
uauauauguguguguguguguguguguguguguauauauauauauauauauauauauauauaua

SEQ ID NO: 755682 - RNA, 64 nt, Homo Sapiens
uauauguguguguguguguguguguguguguauauauauauauauauauauauauauauauaua

SEQ ID NO: 755683 - RNA, 64 nt, Homo Sapiens
uauguguguguguguguguguguguguguauauauauauauauauauauauauauauauauaua

SEQ ID NO: 755684 - RNA, 64 nt, Homo Sapiens
uguguguguguguguguguguguguguauauauauauauauauauauauauauauauauauaua

SEQ ID NO: 755685 - RNA, 64 nt, Homo Sapiens
uguguguguguguguguguguguguauauauauauauauauauauauauauauauauauauaua

SEQ ID NO: 755686 - RNA, 64 nt, Homo Sapiens
uguguguguguguguguguguguauauauauauauauauauauauauauauauauauauauaug

SEQ ID NO: 755687 - RNA, 64 nt, Homo Sapiens
uguguguguguguguguguguauauauauauauauauauauauauauauauauauauauaugug

SEQ ID NO: 755688 - RNA, 64 nt, Homo Sapiens
uguguguguguguguguguauauauauauauauauauauauauauauauauauauauaugugug

SEQ ID NO: 755689 - RNA, 64 nt, Homo Sapiens
uguguguguguguguguauauauauauauauauauauauauauauauauauauauaugugugug

SEQ ID NO: 755690 - RNA, 64 nt, Homo Sapiens
uguguguguguguguauauauauauauauauauauauauauauauauauauauaugugugugua

SEQ ID NO: 755691 - RNA, 64 nt, Homo Sapiens
uguguguguguguauauauauauauauauauauauauauauauauauauauauguguguguaua

SEQ ID NO: 755692 - RNA, 64 nt, Homo Sapiens
uguguguguguauauauauauauauauauauauauauauauauauauauauguguguguauaua

SEQ ID NO: 755693 - RNA, 64 nt, Homo Sapiens
uguguguguauauauauauauauauauauauauauauauauauauauauguguguguauauaua

SEQ ID NO: 755694 - RNA, 64 nt, Homo Sapiens
uguguguauauauauauauauauauauauauauauauauauauauauguguguguauauauaua

SEQ ID NO: 755695 - RNA, 64 nt, Homo Sapiens
uguguauauauauauauauauauauauauauauauauauauauauguguguguauauauauaua

SEQ ID NO: 755696 - RNA, 64 nt, Homo Sapiens
uguauauauauauauauauauauauauauauauauauauauauguguguguauauauauauaua

SEQ ID NO: 755697 - RNA, 64 nt, Homo Sapiens
uauauauauauauauauauauauauauguguguguauauauauauauauguguauauauauaug

SEQ ID NO: 755698 - RNA, 64 nt, Homo Sapiens
uauauauauauauauauauauauauguguguguauauauauauauauguguauauauauaugua

SEQ ID NO: 755699 - RNA, 64 nt, Homo Sapiens
uauauauauauauauauauauauguguguguauauauauauauauguguauauauauauguaua

SEQ ID NO: 755700 - RNA, 64 nt, Homo Sapiens
uauauauauauauauauauauguguguguauauauauauauauguguauauauauauguauaua

SEQ ID NO: 755701 - RNA, 64 nt, Homo Sapiens
uauauauauguguguguauauauauauauauguguauauauauauguauauacauauauguaua

SEQ ID NO: 755702 - RNA, 64 nt, Homo Sapiens
uauauauguguguguauauauauauauauguguauauauauauguauauacauauauguauaua

SEQ ID NO: 755703 - RNA, 64 nt, Homo Sapiens
uauauguguauauauauauguauauacauauauguauauauaugcacauauauauauguauuua

SEQ ID NO: 755704 - RNA, 64 nt, Homo Sapiens
uauauguauauacauauauguauauauaugcacauauauauauguauuuaaaaaaaucaaaaca

SEQ ID NO: 755705 - RNA, 64 nt, Homo Sapiens
gacuuggugugaagacucacuucucagcugaaauuauauauauacacauauauauauuuuacau

SEQ ID NO: 755706 - RNA, 64 nt, Homo Sapiens
cuuggugugaagacucacuucucagcugaaauuauauauauacacauauauauauuuuacaucu

SEQ ID NO: 755707 - RNA, 64 nt, Homo Sapiens
acucacuucucagcugaaauuauauauauacacauauauauauuuuacaucugggaucaugaua

SEQ ID NO: 755708 - RNA, 64 nt, Homo Sapiens
gggauuuaugucuacauauuuguguguguguguguauauauauguaauaugcauacacagaugc

SEQ ID NO: 755709 - RNA, 64 nt, Homo Sapiens
auauauguaauaugcauacacagaugcauauguguauauauaaugaaauuuauguugcugguau

SEQ ID NO: 755710 - RNA, 64 nt, Homo Sapiens
aaaaauauucucucacagauuucauuccuguuuuuauauauauauuuuuuguugucguuuuaac

SEQ ID NO: 755711 - RNA, 64 nt, Homo Sapiens
aaauauucucucacagauuucauuccuguuuuuauauauauauuuuuuguugucguuuuaacau

SEQ ID NO: 755712 - RNA, 64 nt, Homo Sapiens
aguuuauacccugggugcuggggucgcacuguguuauauauauauauauauauauauaaugugu

SEQ ID NO: 755713 - RNA, 64 nt, Homo Sapiens
uuuauacccugggugcuggggucgcacuguguuauauauauauauauauauauauaauguguau

SEQ ID NO: 755714 - RNA, 64 nt, Homo Sapiens
uauacccugggugcuggggucgcacuguguuauauauauauauauauauauauaauguguauau

SEQ ID NO: 755715 - RNA, 64 nt, Homo Sapiens
uacccugggugcuggggucgcacuguguuauauauauauauauauauauauaauguguauauau

SEQ ID NO: 755716 - RNA, 64 nt, Homo Sapiens
cccugggugcuggggucgcacuguguuauauauauauauauauauauauaauguguauauauau

SEQ ID NO: 755717 - RNA, 64 nt, Homo Sapiens
cugggugcuggggucgcacuguguuauauauauauauauauauauauaauguguauauauauau

SEQ ID NO: 755718 - RNA, 64 nt, Homo Sapiens
gggugcuggggucgcacuguguuauauauauauauauauauauauaauguguauauauauauau

SEQ ID NO: 755719 - RNA, 64 nt, Homo Sapiens
gugcuggggucgcacuguguuauauauauauauauauauauauaauguguauauauauauauuc

SEQ ID NO: 755720 - RNA, 64 nt, Homo Sapiens
gcuggggucgcacuguguuauauauauauauauauauauauaauguguauauauauauauucua

SEQ ID NO: 755721 - RNA, 64 nt, Homo Sapiens
uguguuauauauauauauauauauauauaauguguauauauauauauucuauuuuuuuugguug

SEQ ID NO: 755722 - RNA, 64 nt, Homo Sapiens
uguuauauauauauauauauauauauaauguguauauauauauauucuauuuuuuuugguuggg

SEQ ID NO: 755723 - RNA, 64 nt, Homo Sapiens
uuauauauauauauauauauauauaauguguauauauauauauucuauuuuuuuugguuggguu

SEQ ID NO: 755724 - RNA, 64 nt, Homo Sapiens
ucuucuaaggggggagggaaaggggggagauuuuuauauauauauacauauauauauaucaagu

SEQ ID NO: 755725 - RNA, 64 nt, Homo Sapiens
uucuaaggggggagggaaaggggggagauuuuuauauauauauacauauauauauaucaaguuu

SEQ ID NO: 755726 - RNA, 64 nt, Homo Sapiens
cuaaggggggagggaaaggggggagauuuuuauauauauauacauauauauauaucaaguuuua

SEQ ID NO: 755727 - RNA, 64 nt, Homo Sapiens
agggaaaggggggagauuuuuauauauauauacauauauauauaucaaguuuuaaauuauugau

SEQ ID NO: 755728 - RNA, 64 nt, Homo Sapiens
ggaaaggggggagauuuuuauauauauauacauauauauauaucaaguuuuaaauuauugauag

SEQ ID NO: 755729 - RNA, 64 nt, Homo Sapiens
cuugaguguguucgcguguguggguggauauaaauauauauaaauauauauaaauaaauauaua

SEQ ID NO: 755730 - RNA, 64 nt, Homo Sapiens
uucgcguguguggguggauauaaauauauauaaauauauauaaauaaauauauauauccucugu

SEQ ID NO: 755731 - RNA, 64 nt, Homo Sapiens
uggauauaaauauauauaaauauauauaaauaaauauauauauccucuguauaaaaugagguuu

SEQ ID NO: 755732 - RNA, 64 nt, Homo Sapiens
gaagaauaaauguauaaauguuauuuuugauguuuauauauaaacucuauauccuaauuuacua

SEQ ID NO: 755733 - RNA, 64 nt, Homo Sapiens
aguguuugauucagagaugucugcucuuuuaaauuauauauaaggaaaaaaaauagccugccuu

SEQ ID NO: 755734 - RNA, 64 nt, Homo Sapiens
ccuuuccccuucuggucccugcgcuuugguauaauauauauacuucuccauacacagaccucug

SEQ ID NO: 755735 - RNA, 64 nt, Homo Sapiens
acaaagauuggcucugaugguuuuuauguauaaauauauauauauaauaaaauauaauacauuu

SEQ ID NO: 755736 - RNA, 64 nt, Homo Sapiens
aaagauuggcucugaugguuuuuauguauaaauauauauauauaauaaaauauaauacauuuuu

SEQ ID NO: 755737 - RNA, 64 nt, Homo Sapiens
agauuggcucugaugguuuuuauguauaaauauauauauauaauaaaauauaauacauuuuuau

SEQ ID NO: 755738 - RNA, 64 nt, Homo Sapiens
uuuguaaugaccaaaggaaugaggcugacauagguauauauauauauuuuuuuccuuuauuuga

SEQ ID NO: 755739 - RNA, 64 nt, Homo Sapiens
uguaaugaccaaaggaaugaggcugacauagguauauauauauauuuuuuuccuuuauuugaua

SEQ ID NO: 755740 - RNA, 64 nt, Homo Sapiens
uaaugaccaaaggaaugaggcugacauagguauauauauauauuuuuuuccuuuauuugauaaa

SEQ ID NO: 755741 - RNA, 64 nt, Homo Sapiens
auagggguuuuaucgggcgugaauguaaauaaauuauauauauauauugcuaaccugagugcua

SEQ ID NO: 755742 - RNA, 64 nt, Homo Sapiens
agggguuuuaucgggcgugaauguaaauaaauuauauauauauauugcuaaccugagugcuacu

SEQ ID NO: 755743 - RNA, 64 nt, Homo Sapiens
ggguuuuaucgggcgugaauguaaauaaauuauauauauauauugcuaaccugagugcuacuuc

SEQ ID NO: 755744 - RNA, 64 nt, Homo Sapiens
agggcauggaaguuuuuuuaaauaauuaaaaaaauauauauauaauuuugagaauugagcauuu

SEQ ID NO: 755745 - RNA, 64 nt, Homo Sapiens
ggcauggaaguuuuuuuaaauaauuaaaaaaauauauauauaauuuugagaauugagcauuuaa

SEQ ID NO: 755746 - RNA, 64 nt, Homo Sapiens
acacacuacuguuguuuucuauaguacauguguauauauauauuuauauaguacauguauauau

SEQ ID NO: 755747 - RNA, 64 nt, Homo Sapiens
uuacacacuacuguuguuuuauauaguacauguguauauauauauauauauaguacauguauau

SEQ ID NO: 755748 - RNA, 64 nt, Homo Sapiens
acauguguauauauauauuaauauaguacauguauauauauaguuguaauauauauauguauau

SEQ ID NO: 755749 - RNA, 64 nt, Homo Sapiens
guacauguguauauauauauauauauaguacauguauauauauauguguaauauauauauguau

SEQ ID NO: 755750 - RNA, 64 nt, Homo Sapiens
acauguauauauauaguacaaauauauauauguauauauauaguaugugugugugugugugugu

SEQ ID NO: 755751 - RNA, 64 nt, Homo Sapiens
guacauguauauauauaguaguaauauauauauguauauauauaauaugugugugugugugugu

SEQ ID NO: 755752 - RNA, 64 nt, Homo Sapiens
uauauauauaguacauguauguguguguguguaauauauauaugauauauauauauaugugugu

SEQ ID NO: 755753 - RNA, 64 nt, Homo Sapiens
uguguguguguguguguaauaaaaaaaaaauauauauauauaugacuccuuuaccuagggaagg

SEQ ID NO: 755754 - RNA, 64 nt, Homo Sapiens
uguguguguguguguguguaggaaaaaaaaaauauauauauauaucacuccuuuaccuagggaa

SEQ ID NO: 755755 - RNA, 64 nt, Homo Sapiens
uaugugugugugugugugugaaggaaaaaaaaaauauauauauauaucacuccuuuaccuaggg

SEQ ID NO: 755756 - RNA, 64 nt, Homo Sapiens
auauauaugauauauauauaauauauaugugauauauauauaucgucuaaaugauauauauaug

SEQ ID NO: 755757 - RNA, 64 nt, Homo Sapiens
ucauauauaugauauauauaugauauauaugugauauauauauacugucuaaaugauauauaua

SEQ ID NO: 755758 - RNA, 64 nt, Homo Sapiens
auauauaugugauauauauaugcugucuaaaugauauauauaugccuggucaccuucuuggauc

SEQ ID NO: 755759 - RNA, 64 nt, Homo Sapiens
cacacacacacacacuaugagauauauauauauauauauauacaagacacaauuauauauuguu

SEQ ID NO: 755760 - RNA, 64 nt, Homo Sapiens
cacacacacacacacacuauuugauauauauauauauauauauaugagacacaauuauauauug

SEQ ID NO: 755761 - RNA, 64 nt, Homo Sapiens
uacacacacacacacacacuuguugauauauauauauauauauaauugagacacaauuauauau

SEQ ID NO: 755762 - RNA, 64 nt, Homo Sapiens
uauacacacacacacacacaauuguugauauauauauauauauauaauugagacacaauuauau

SEQ ID NO: 755763 - RNA, 64 nt, Homo Sapiens
uauauacacacacacacacaauauuguugauauauauauauauaucuaauugagacacaauuau

SEQ ID NO: 755764 - RNA, 64 nt, Homo Sapiens
uauauauacacacacacacaauauauuguugauauauauauauaccucuaauugagacacaauu

SEQ ID NO: 755765 - RNA, 64 nt, Homo Sapiens
uauauauauacacacacacauuauauauuguugauauauauauacaccucuaauugagacacaa

SEQ ID NO: 755766 - RNA, 64 nt, Homo Sapiens
aguuuauuauguacaguuaauuaaaauguguauauauauauaauuaaacuuuauucccuauaac

SEQ ID NO: 755767 - RNA, 64 nt, Homo Sapiens
auaguuuauuauguacaguuacuuaaaauguguauauauauauaaauaaacuuuauucccuaua

SEQ ID NO: 755768 - RNA, 64 nt, Homo Sapiens
uaauaguuuauuauguacaguaacuuaaaauguguauauauauaaaaauaaacuuuauucccua

SEQ ID NO: 755769 - RNA, 64 nt, Homo Sapiens
ggaaucuuggauugggaauucauauauauauauauauauauaaaaaagaugguaauuuaggaug

SEQ ID NO: 755770 - RNA, 64 nt, Homo Sapiens
aaggaaucuuggauugggaaugcauauauauauauauauauauacaaaagaugguaauuuagga

SEQ ID NO: 755771 - RNA, 64 nt, Homo Sapiens
uaaaggaaucuuggauuggggaugcauauauauauauauauauacucaaaagaugguaauuuag

SEQ ID NO: 755772 - RNA, 64 nt, Homo Sapiens
uauaaaggaaucuuggauugaggaugcauauauauauauauauaaucucaaaagaugguaauuu

SEQ ID NO: 755773 - RNA, 64 nt, Homo Sapiens
uauauaaaggaaucuuggauuuaggaugcauauauauauauauaacaucucaaaagaugguaau

SEQ ID NO: 755774 - RNA, 64 nt, Homo Sapiens
uauauauaaaggaaucuuggauuuaggaugcauauauauauauaauacaucucaaaagauggua

SEQ ID NO: 755775 - RNA, 64 nt, Homo Sapiens
uauauauauaaaggaaucuuuaauuuaggaugcauauauauauauuauacaucucaaaagaugg

SEQ ID NO: 755776 - RNA, 64 nt, Homo Sapiens
auaugccauaguuuagaaagauauuuaaaaaugcuauauauagugcaaauaauuauauauaaau

SEQ ID NO: 755777 - RNA, 64 nt, Homo Sapiens
uauauuuaaaaaugcuauaucaugugcaaauaauuauauauaaaugcaaauuccuucuaaauuu

SEQ ID NO: 755778 - RNA, 64 nt, Homo Sapiens
gagcacuuuaaacuuaaugcacuuuuacugucuauauauauagguguuguaaguuucuuugcuu

SEQ ID NO: 755779 - RNA, 64 nt, Homo Sapiens
gggagcacuuuaaacuuaauuuacuuuuacugucuauauauauauguguuguaaguuucuuugc

SEQ ID NO: 755780 - RNA, 64 nt, Homo Sapiens
uauaaauauauucuuuacuuuauauacauauauauauauauaaauauacguauacauaucugua

SEQ ID NO: 755781 - RNA, 64 nt, Homo Sapiens
aauauaaauauauucuuuacuauauauacauauauauauauauauauauacguauacauaucug

SEQ ID NO: 755782 - RNA, 64 nt, Homo Sapiens
uaaauauaaauauauucuuuuguauauauacauauauauauauauauauauacguauacauauc

SEQ ID NO: 755783 - RNA, 64 nt, Homo Sapiens
uauaaauauaaauauauucuucuguauauauacauauauauauauauauauauacguauacaua

SEQ ID NO: 755784 - RNA, 64 nt, Homo Sapiens
uauauauauauauaaauauacguauacauaucuguauauauacauucuguuuuauauauauaua

SEQ ID NO: 755785 - RNA, 64 nt, Homo Sapiens
uauacauaucuguauauauaacuucuguuuuauauauauauacgacaaauguugcuguaauuaa

SEQ ID NO: 755786 - RNA, 64 nt, Homo Sapiens
cguauacauaucuguauauaaaacuucuguuuuauauauauauauaacaaauguugcuguaauu

SEQ ID NO: 755787 - RNA, 64 nt, Homo Sapiens
uacguauacauaucuguauauuaaacuucuguuuuauauauauaaguaacaaauguugcuguaa

SEQ ID NO: 755788 - RNA, 64 nt, Homo Sapiens
aaacuuagaugauaaucaaacacacacacauauauauauauauuuuuuuuauuacuauuucaaa

SEQ ID NO: 755789 - RNA, 64 nt, Homo Sapiens
uuaaacuuagaugauaaucaaacacacacacauauauauauauaccuuuuuuauuacuauuuca

SEQ ID NO: 755790 - RNA, 64 nt, Homo Sapiens
uauuaaacuuagaugauaaucaaacacacacacauauauauauauuccuuuuuuauuacuauuu

SEQ ID NO: 755791 - RNA, 64 nt, Homo Sapiens
cacccccagcccaaccgagggagaaagagaaauauauauauaucgauuuuuuuuaauacauuaa

SEQ ID NO: 755792 - RNA, 64 nt, Homo Sapiens
uccacccccagcccaaccgaaagagaaagagaaauauauauauauugauuuuuuuuaauacauu

SEQ ID NO: 755793 - RNA, 64 nt, Homo Sapiens
uguauacugauugaaauuuucuaguauguuguauuauauauaugguuuguagcauuuaacauaa

SEQ ID NO: 755794 - RNA, 64 nt, Homo Sapiens
auuacauauauauguagaaaagaaagguuuuauauauauauaaacagcgccuguguucuguguu

SEQ ID NO: 755795 - RNA, 64 nt, Homo Sapiens
aaauuacauauauauguagauuagaaagguuuuauauauauauacccagcgccuguguucugug

SEQ ID NO: 755796 - RNA, 64 nt, Homo Sapiens
uaaaauuacauauauauguauguuagaaagguuuuauauauauaggcccagcgccuguguucug

SEQ ID NO: 755797 - RNA, 64 nt, Homo Sapiens
uuauuuacauucacgcccgaagguuagcaauauauauauauaaucccugagagaaguagcacuc

SEQ ID NO: 755798 - RNA, 64 nt, Homo Sapiens
auuuauuuacauucacgcccucagguuagcaauauauauauauauucccugagagaaguagcac

SEQ ID NO: 755799 - RNA, 64 nt, Homo Sapiens
uaauuuauuuacauucacgcacucagguuagcaauauauauauacuuucccugagagaaguagc

SEQ ID NO: 755800 - RNA, 64 nt, Homo Sapiens
cugccuaagcacucaccuuccgauuuuacccaaguauauauauaggauagaaaaaaaugcauua

SEQ ID NO: 755801 - RNA, 64 nt, Homo Sapiens
gccuaagcacucaccuuccgauuuuacccaaguauauauauaggauagaaaaaaaugcauuaua

SEQ ID NO: 755802 - RNA, 64 nt, Homo Sapiens
augauuguguaauuuaaagguauauaaauacaaauauauauauauaucaguugugauuguauga

SEQ ID NO: 755803 - RNA, 64 nt, Homo Sapiens
gauuguguaauuuaaagguauauaaauacaaauauauauauauaucaguugugauuguaugacu

SEQ ID NO: 755804 - RNA, 64 nt, Homo Sapiens
uuguguaauuuaaagguauauaaauacaaauauauauauauaucaguugugauuguaugacugu

SEQ ID NO: 755805 - RNA, 64 nt, Homo Sapiens
cccaggucugugucugauagcauacacacacacauauauauacacacacacacacacacacaca

SEQ ID NO: 755806 - RNA, 64 nt, Homo Sapiens
cacacacacacacacacauacauacacacacacauauauauacacacacacacacacacacaca

SEQ ID NO: 755807 - RNA, 64 nt, Homo Sapiens
uaauaucuauagaaaaguagagugagggugaauuuauauauauauuuuguuuugccaauaugaa

SEQ ID NO: 755808 - RNA, 64 nt, Homo Sapiens
auaucuauagaaaaguagagugagggugaauuuauauauauauuuuguuuugccaauaugaaga

SEQ ID NO: 755809 - RNA, 64 nt, Homo Sapiens
uguguguguguguguguguguguguguguguguguauauauauauauauauuuuuacuuuuauc

SEQ ID NO: 755810 - RNA, 64 nt, Homo Sapiens
uguguguguguguguguguguguguguguguguauauauauauauauauuuuuacuuuuauccu

SEQ ID NO: 755811 - RNA, 64 nt, Homo Sapiens
uguguguguguguguguguguguguguguguauauauauauauauauuuuuacuuuuauccucu

SEQ ID NO: 755812 - RNA, 64 nt, Homo Sapiens
uguguguguguguguguguguguguguguauauauauauauauauuuuuacuuuuauccucuua

SEQ ID NO: 755813 - RNA, 64 nt, Homo Sapiens
uguguguguguguguguguguguguguauauauauauauauauuuuuacuuuuauccucuuacc

SEQ ID NO: 755814 - RNA, 64 nt, Homo Sapiens
cuaaguuauaaaugugugugugugcguguguguguauauauauauauauauauauauauauaua

SEQ ID NO: 755815 - RNA, 64 nt, Homo Sapiens
aaguuauaaaugugugugugugcguguguguguauauauauauauauauauauauauauauaua

SEQ ID NO: 755816 - RNA, 64 nt, Homo Sapiens
guuauaaaugugugugugugcguguguguguauauauauauauauauauauauauauauauaua

SEQ ID NO: 755817 - RNA, 64 nt, Homo Sapiens
uauaaaugugugugugugcguguguguguauauauauauauauauauauauauauauauauaua

SEQ ID NO: 755818 - RNA, 64 nt, Homo Sapiens
uaaaugugugugugugcguguguguguauauauauauauauauauauauauauauauauauaua

SEQ ID NO: 755819 - RNA, 64 nt, Homo Sapiens
aaugugugugugugcguguguguguauauauauauauauauauauauauauauauauauauaua

SEQ ID NO: 755820 - RNA, 64 nt, Homo Sapiens
ugugugugugugcguguguguguauauauauauauauauauauauauauauauauauauauaua

SEQ ID NO: 755821 - RNA, 64 nt, Homo Sapiens
ugugugugugcguguguguguauauauauauauauauauauauauauauauauauauauauaua

SEQ ID NO: 755822 - RNA, 64 nt, Homo Sapiens
ugugugugcguguguguguauauauauauauauauauauauauauauauauauauauauauaua

SEQ ID NO: 755823 - RNA, 64 nt, Homo Sapiens
ugugugcguguguguguauauauauauauauauauauauauauauauauauauauauauauaua

SEQ ID NO: 755824 - RNA, 64 nt, Homo Sapiens
ugugcguguguguguauauauauauauauauauauauauauauauauauauauauauauauaug

SEQ ID NO: 755825 - RNA, 64 nt, Homo Sapiens
ugcguguguguguauauauauauauauauauauauauauauauauauauauauauauauaugga

SEQ ID NO: 755826 - RNA, 64 nt, Homo Sapiens
cguguguguguauauauauauauauauauauauauauauauauauauauauauauauauggaau

SEQ ID NO: 755827 - RNA, 64 nt, Homo Sapiens
uguguguguauauauauauauauauauauauauauauauauauauauauauauauauggaauug

SEQ ID NO: 755828 - RNA, 64 nt, Homo Sapiens
uguguguauauauauauauauauauauauauauauauauauauauauauauauauggaauugga

SEQ ID NO: 755829 - RNA, 64 nt, Homo Sapiens
uguguauauauauauauauauauauauauauauauauauauauauauauauauggaauuggaac

SEQ ID NO: 755830 - RNA, 64 nt, Homo Sapiens
uguauauauauauauauauauauauauauauauauauauauauauauauauggaauuggaacuu

SEQ ID NO: 755831 - RNA, 64 nt, Homo Sapiens
uauauauauauauauauauauauauauauauauauauauauauauauauggaauuggaacuuau

SEQ ID NO: 755832 - RNA, 64 nt, Homo Sapiens
uauauauauauauauauauauauauauauauauauauauauauauauggaauuggaacuuauuu

SEQ ID NO: 755833 - RNA, 64 nt, Homo Sapiens
uauauauauauauauauauauauauauauauauauauauauauauggaauuggaacuuauuuua

SEQ ID NO: 755834 - RNA, 64 nt, Homo Sapiens
uauauauauauauauauauauauauauauauauauauauauauggaauuggaacuuauuuuaaa

SEQ ID NO: 755835 - RNA, 64 nt, Homo Sapiens
cuuuaugucguguaguuuguauaauguguuuaaauauauauauauaugauggcuuuggaagaaa

SEQ ID NO: 755836 - RNA, 64 nt, Homo Sapiens
uuaugucguguaguuuguauaauguguuuaaauauauauauauaugauggcuuuggaagaaaau

SEQ ID NO: 755837 - RNA, 64 nt, Homo Sapiens
augucguguaguuuguauaauguguuuaaauauauauauauaugauggcuuuggaagaaaauau

SEQ ID NO: 755838 - RNA, 64 nt, Homo Sapiens
uuauacuuuuuauaauguuuacguuuguccugaauauauauauauauauauauauauauauaua

SEQ ID NO: 755839 - RNA, 64 nt, Homo Sapiens
auacuuuuuauaauguuuacguuuguccugaauauauauauauauauauauauauauauauaua

SEQ ID NO: 755840 - RNA, 64 nt, Homo Sapiens
acuuuuuauaauguuuacguuuguccugaauauauauauauauauauauauauauauauauaug

SEQ ID NO: 755841 - RNA, 64 nt, Homo Sapiens
uuuuuauaauguuuacguuuguccugaauauauauauauauauauauauauauauauauauggu

SEQ ID NO: 755842 - RNA, 64 nt, Homo Sapiens
uuuauaauguuuacguuuguccugaauauauauauauauauauauauauauauauauaugguau

SEQ ID NO: 755843 - RNA, 64 nt, Homo Sapiens
uauaauguuuacguuuguccugaauauauauauauauauauauauauauauauauaugguauag

SEQ ID NO: 755844 - RNA, 64 nt, Homo Sapiens
uaauguuuacguuuguccugaauauauauauauauauauauauauauauauauaugguauagga

SEQ ID NO: 755845 - RNA, 64 nt, Homo Sapiens
auguuuacguuuguccugaauauauauauauauauauauauauauauauauaugguauaggaga

SEQ ID NO: 755846 - RNA, 64 nt, Homo Sapiens
guuuacguuuguccugaauauauauauauauauauauauauauauauauaugguauaggagaua

SEQ ID NO: 755847 - RNA, 64 nt, Homo Sapiens
uuacguuuguccugaauauauauauauauauauauauauauauauauaugguauaggagauaag

SEQ ID NO: 755848 - RNA, 64 nt, Homo Sapiens
acguuuguccugaauauauauauauauauauauauauauauauauaugguauaggagauaagcu

SEQ ID NO: 755849 - RNA, 64 nt, Homo Sapiens
guuuguccugaauauauauauauauauauauauauauauauauaugguauaggagauaagcuau

SEQ ID NO: 755850 - RNA, 64 nt, Homo Sapiens
uuguccugaauauauauauauauauauauauauauauauauaugguauaggagauaagcuauuu

SEQ ID NO: 755851 - RNA, 64 nt, Homo Sapiens
guuggcucauacugauuauggugccuaagagagcuauauauauacacauguaaaguccauuguu

SEQ ID NO: 755852 - RNA, 64 nt, Homo Sapiens
uggcucauacugauuauggugccuaagagagcuauauauauacacauguaaaguccauuguuuu

SEQ ID NO: 755853 - RNA, 64 nt, Homo Sapiens
cugaaaucucagggcaugaacaaggcaaaggccauauauauauauauauauauaucuguauaca

SEQ ID NO: 755854 - RNA, 64 nt, Homo Sapiens
gaaaucucagggcaugaacaaggcaaaggccauauauauauauauauauauaucuguauacaua

SEQ ID NO: 755855 - RNA, 64 nt, Homo Sapiens
aaucucagggcaugaacaaggcaaaggccauauauauauauauauauauaucuguauacauauu

SEQ ID NO: 755856 - RNA, 64 nt, Homo Sapiens
ucucagggcaugaacaaggcaaaggccauauauauauauauauauauaucuguauacauauuau

SEQ ID NO: 755857 - RNA, 64 nt, Homo Sapiens
ucagggcaugaacaaggcaaaggccauauauauauauauauauauaucuguauacauauuauau

SEQ ID NO: 755858 - RNA, 64 nt, Homo Sapiens
agggcaugaacaaggcaaaggccauauauauauauauauauauaucuguauacauauuauauau

SEQ ID NO: 755859 - RNA, 64 nt, Homo Sapiens
ggcaugaacaaggcaaaggccauauauauauauauauauauaucuguauacauauuauauauac

SEQ ID NO: 755860 - RNA, 64 nt, Homo Sapiens
auauauauauauauauauauaucuguauacauauuauauauacuuauuuacaccugugucuaua

SEQ ID NO: 755861 - RNA, 64 nt, Homo Sapiens
auuuauaaaucuauuuauaccacuauaucauauguauauauauuuauaaccacuuaaauuguga

SEQ ID NO: 755862 - RNA, 64 nt, Homo Sapiens
uuuggcagaacaauugcaauugcacuggguauauuauauauauauauguaugcauauauaucau

SEQ ID NO: 755863 - RNA, 64 nt, Homo Sapiens
uggcagaacaauugcaauugcacuggguauauuauauauauauauguaugcauauauaucauau

SEQ ID NO: 755864 - RNA, 64 nt, Homo Sapiens
gcagaacaauugcaauugcacuggguauauuauauauauauauguaugcauauauaucauauuu

SEQ ID NO: 755865 - RNA, 64 nt, Homo Sapiens
ugacuuguuucaaugguuacuuguauaaggauuuuauauauaugauacuauagauaaaauccua

SEQ ID NO: 755866 - RNA, 64 nt, Homo Sapiens
ucuuuuuaauaaaucuauccugaaagcuauauaauauauauaauuuauaucaaugaauuuacaa

SEQ ID NO: 755867 - RNA, 64 nt, Homo Sapiens
ugacuaugcacuaguauuucagacuuuuuaauuuuauauauauauacauuuuuuuuccuucugc

SEQ ID NO: 755868 - RNA, 64 nt, Homo Sapiens
acuaugcacuaguauuucagacuuuuuaauuuuauauauauauacauuuuuuuuccuucugcaa

SEQ ID NO: 755869 - RNA, 64 nt, Homo Sapiens
uaugcacuaguauuucagacuuuuuaauuuuauauauauauacauuuuuuuuccuucugcaaua

SEQ ID NO: 755870 - RNA, 64 nt, Homo Sapiens
uuuagauucaucaacagaccaguuuuugugggcauauauauauacacgugcaaauaucagaauu

SEQ ID NO: 755871 - RNA, 64 nt, Homo Sapiens
uagauucaucaacagaccaguuuuugugggcauauauauauacacgugcaaauaucagaauugu

SEQ ID NO: 755872 - RNA, 64 nt, Homo Sapiens
cugacuaaaaaucaauauagauauuuuauauacauauauauauauaaaaauacaaaauucagug

SEQ ID NO: 755873 - RNA, 64 nt, Homo Sapiens
gacuaaaaaucaauauagauauuuuauauacauauauauauauaaaaauacaaaauucagugua

SEQ ID NO: 755874 - RNA, 64 nt, Homo Sapiens
cuaaaaaucaauauagauauuuuauauacauauauauauauaaaaauacaaaauucaguguacu

SEQ ID NO: 755875 - RNA, 64 nt, Homo Sapiens
acauaauguccucuuuugcacaauugugcauagauauauauaugcccacacacacugggccaug

SEQ ID NO: 755876 - RNA, 64 nt, Homo Sapiens
cuaacugcaauuagaaauugucuuuugaauauacuauauauauuuuuuauguuccaauaauguu

SEQ ID NO: 755877 - RNA, 64 nt, Homo Sapiens
auuuucuuuuuggucugaguguuuguuguaaauauauauauauucaauaguauuaucgucuacu

SEQ ID NO: 755878 - RNA, 64 nt, Homo Sapiens
uuauuuucuuuuuggucugacuguuuguuguaaauauauauauacacaauaguauuaucgucua

SEQ ID NO: 755879 - RNA, 64 nt, Homo Sapiens
uguaaaaauguauuuuguuaaacuuauauauauauauauauaucacaccagacaaaucgauaac

SEQ ID NO: 755880 - RNA, 64 nt, Homo Sapiens
ucuguaaaaauguauuuuguacaacuuauauauauauauauauaaaacaccagacaaaucgaua

SEQ ID NO: 755881 - RNA, 64 nt, Homo Sapiens
uaucuguaaaaauguauuuuuaacaacuuauauauauauauauauaaaacaccagacaaaucga

SEQ ID NO: 755882 - RNA, 64 nt, Homo Sapiens
uauaucuguaaaaauguauugauaacaacuuauauauauauauacuuaaaacaccagacaaauc

SEQ ID NO: 755883 - RNA, 64 nt, Homo Sapiens
uauauaucuguaaaaauguaucgauaacaacuuauauauauauacccuuaaaacaccagacaaa

SEQ ID NO: 755884 - RNA, 64 nt, Homo Sapiens
uauauauaucuguaaaaaugaaucgauaacaacuuauauauauauccccuuaaaacaccagaca

SEQ ID NO: 755885 - RNA, 64 nt, Homo Sapiens
uaaauacacauauauauuguuauauauacauauguauauauauugguuucucugugcauauaua

SEQ ID NO: 755886 - RNA, 64 nt, Homo Sapiens
uauguauauauauuuaaauaucugugcauauauauauauauacagauuuguuggcuaagguuuc

SEQ ID NO: 755887 - RNA, 64 nt, Homo Sapiens
cauauguauauauauuuaaaucucugugcauauauauauauauagggauuuguuggcuaagguu

SEQ ID NO: 755888 - RNA, 64 nt, Homo Sapiens
uacauauguauauauauuuauuucucugugcauauauauauauacagggauuuguuggcuaagg

SEQ ID NO: 755889 - RNA, 64 nt, Homo Sapiens
uauacauauguauauauauugguuucucugugcauauauauauacucagggauuuguuggcuaa

SEQ ID NO: 755890 - RNA, 64 nt, Homo Sapiens
gaaggaauauaguuucauuuacaagaugcauguuuauauauaugguauucaguacugauugcau

SEQ ID NO: 755891 - RNA, 64 nt, Homo Sapiens
uuugugaagcaagaaacaauuuuauugacacaucuauauauacauaguuuaaaugucucauugu

SEQ ID NO: 755892 - RNA, 64 nt, Homo Sapiens
cauaugcaaaaguccugcauuauauauauauauauauauauaucuauauaauauauauauaaaa

SEQ ID NO: 755893 - RNA, 64 nt, Homo Sapiens
uccauaugcaaaaguccugcaauauauauauauauauauauauauauauauaauauauauauaa

SEQ ID NO: 755894 - RNA, 64 nt, Homo Sapiens
uauccauaugcaaaaguccuaaaauauauauauauauauauauaauuauauauaauauauauau

SEQ ID NO: 755895 - RNA, 64 nt, Homo Sapiens
uauauccauaugcaaaagucauaaaauauauauauauauauauaauauuauauauaauauauau

SEQ ID NO: 755896 - RNA, 64 nt, Homo Sapiens
uauauauccauaugcaaaagauauaaaauauauauauauauauaacauauuauauauaauauau

SEQ ID NO: 755897 - RNA, 64 nt, Homo Sapiens
uauauauauccauaugcaaaauauauaaaauauauauauauauaguacauauuauauauaauau

SEQ ID NO: 755898 - RNA, 64 nt, Homo Sapiens
uauauauauauccauaugcaauauauauaaaauauauauauauacuguacauauuauauauaau

SEQ ID NO: 755899 - RNA, 64 nt, Homo Sapiens
uauauauauauauccauaugauauauauauaaaauauauauauagacuguacauauuauauaua

SEQ ID NO: 755900 - RNA, 64 nt, Homo Sapiens
auauauauauauauauauauuauuauauauaauauauauauaaauuuuauagcuagacuguaca

SEQ ID NO: 755901 - RNA, 64 nt, Homo Sapiens
aaauauauauauauauauaucauauuauauauaauauauauauaaguuuuauagcuagacugua

SEQ ID NO: 755902 - RNA, 64 nt, Homo Sapiens
auauauauaaaauauauauauagacuguacauauuauauauaauacacaucaaaguuuuauagc

SEQ ID NO: 755903 - RNA, 64 nt, Homo Sapiens
uacacacauacauauaauuuuauauauauauacauauauauacacacauacauacauacauaua

SEQ ID NO: 755904 - RNA, 64 nt, Homo Sapiens
uauauauacauacacacauacauacauauauauauauauauacacacacacacacacauacaua

SEQ ID NO: 755905 - RNA, 64 nt, Homo Sapiens
cauauauauacauacacacauacauacauauauauauauauauacacacacacacacacauaca

SEQ ID NO: 755906 - RNA, 64 nt, Homo Sapiens
uacauauauauacauacacacauacauacauauauauauauauacacacacacacacacacaua

SEQ ID NO: 755907 - RNA, 64 nt, Homo Sapiens
uauacauauauauacauacauacauacauacauauauauauauacacacacacacacacacaca

SEQ ID NO: 755908 - RNA, 64 nt, Homo Sapiens
uauauacauauauauacauacauacauacauacauauauauauacacacacacacacacacaca

SEQ ID NO: 755909 - RNA, 64 nt, Homo Sapiens
uaauauguuguacaucacaacaguauuauuguuauauauauaguagcuuaauuaccccccauug

SEQ ID NO: 755910 - RNA, 64 nt, Homo Sapiens
guuaauauguuguacaucacugcaguauuauuguuauauauauaguagcuuaauuaccccccau

SEQ ID NO: 755911 - RNA, 64 nt, Homo Sapiens
gaaaaucaaaggaggcaaaaaagacaaaaaaauauauauauauuucuagccugggcaacagagu

SEQ ID NO: 755912 - RNA, 64 nt, Homo Sapiens
uugaaaaucaaaggaggcaaguaagacaaaaaaauauauauauaacucuagccugggcaacaga

SEQ ID NO: 755913 - RNA, 64 nt, Homo Sapiens
uacaguuaucuaaguuaauuuguguguguauauauauauauaugguaaauauugugugugugug

SEQ ID NO: 755914 - RNA, 64 nt, Homo Sapiens
uguacaguuaucuaaguuaauguguguguguauauauauauauauuguaaauauugugugugug

SEQ ID NO: 755915 - RNA, 64 nt, Homo Sapiens
uauguacaguuaucuaaguuuguguguguguguauauauauauauauuguaaauauugugugug

SEQ ID NO: 755916 - RNA, 64 nt, Homo Sapiens
uauauguacaguuaucuaaguguguguguguguguauauauauauauauuguaaauauugugug

SEQ ID NO: 755917 - RNA, 64 nt, Homo Sapiens
ugcauuauuacacauacauucacguaucuauauguauauauaaauuuguuuauauacauauaug

SEQ ID NO: 755918 - RNA, 64 nt, Homo Sapiens
cguauguauagaugugugaaguacuuauuauauguauauauacacauaauauauacauacgugu

SEQ ID NO: 755919 - RNA, 64 nt, Homo Sapiens
aaacaagaauuuucuuugcuuggaauuaaaaauauauauauauuggaauuuaagaaaauauuac

SEQ ID NO: 755920 - RNA, 64 nt, Homo Sapiens
uuaaacaagaauuuucuuugacuggaauuaaaaauauauauauacaggaauuuaagaaaauauu

SEQ ID NO: 755921 - RNA, 64 nt, Homo Sapiens
uguuugucauauggaauuuaaaaaugacggcugcuauauauaaguauugucauaaccaacaucc

SEQ ID NO: 755922 - RNA, 64 nt, Homo Sapiens
cuuuguugaugaaaaacgaccucauuuauauauauauauauaggccauggugagagcacagcaa

SEQ ID NO: 755923 - RNA, 64 nt, Homo Sapiens
ggcuuuguugaugaaaaacgaacucauuuauauauauauauauacuccauggugagagcacagc

SEQ ID NO: 755924 - RNA, 64 nt, Homo Sapiens
uaggcuuuguugaugaaaaagcaacucauuuauauauauauauaugcuccauggugagagcaca

SEQ ID NO: 755925 - RNA, 64 nt, Homo Sapiens
uauaggcuuuguugaugaaacagcaacucauuuauauauauauaacugcuccauggugagagca

SEQ ID NO: 755926 - RNA, 64 nt, Homo Sapiens
uauauaggcuuuguugaugacacagcaacucauuuauauauauaacacugcuccauggugagag

SEQ ID NO: 755927 - RNA, 64 nt, Homo Sapiens
auaaugguuguguacugaaccacuucauauuuguuauauauaauauauauauauauaaucuccu

SEQ ID NO: 755928 - RNA, 64 nt, Homo Sapiens
guguacugaaccacuucauauuuguuauauauaauauauauauauauaaucuccuuaagacuca

SEQ ID NO: 755929 - RNA, 64 nt, Homo Sapiens
guacugaaccacuucauauuuguuauauauaauauauauauauauaaucuccuuaagacucagc

SEQ ID NO: 755930 - RNA, 64 nt, Homo Sapiens
acugaaccacuucauauuuguuauauauaauauauauauauauaaucuccuuaagacucagccu

SEQ ID NO: 755931 - RNA, 64 nt, Homo Sapiens
ugaaccacuucauauuuguuauauauaauauauauauauauaaucuccuuaagacucagccucc

SEQ ID NO: 755932 - RNA, 64 nt, Homo Sapiens
agaugaagcucaauaauuguucacauuguucuuuuauauauauuuauauauauauauaaaaauu

SEQ ID NO: 755933 - RNA, 64 nt, Homo Sapiens
caauaauuguucacauuguucuuuuauauauauuuauauauauauauaaaaauugggucuuaga

SEQ ID NO: 755934 - RNA, 64 nt, Homo Sapiens
auaauuguucacauuguucuuuuauauauauuuauauauauauauaaaaauugggucuuagauu

SEQ ID NO: 755935 - RNA, 64 nt, Homo Sapiens
aauuguucacauuguucuuuuauauauauuuauauauauauauaaaaauugggucuuagauuuu

SEQ ID NO: 755936 - RNA, 64 nt, Homo Sapiens
uuguucacauuguucuuuuauauauauuuauauauauauauaaaaauugggucuuagauuuuga

SEQ ID NO: 755937 - RNA, 64 nt, Homo Sapiens
uucuguaaacacacacacacagaguauauauguguauauauauauagauauauucaaaaacauu

SEQ ID NO: 755938 - RNA, 64 nt, Homo Sapiens
cuguaaacacacacacacagaguauauauguguauauauauauagauauauucaaaaacauugc

SEQ ID NO: 755939 - RNA, 64 nt, Homo Sapiens
guaaacacacacacacagaguauauauguguauauauauauagauauauucaaaaacauugcau

SEQ ID NO: 755940 - RNA, 64 nt, Homo Sapiens
uguauuuaguuauaauuuuuguaucuuacaacaguauauauaaagacuauuauuaauagacaaa

SEQ ID NO: 755941 - RNA, 64 nt, Homo Sapiens
guuccuguaguuuuuugaugagaguuauaguuguuauauauacauaaagauaauuuucuuuuca

SEQ ID NO: 755942 - RNA, 64 nt, Homo Sapiens
gagaauucaguugugauuuuuaacaugugucagauauauauacuaacacgucuaauauauacua

SEQ ID NO: 755943 - RNA, 64 nt, Homo Sapiens
auauaguauauuuauacucuagaacaugcacauuuauauauauauguauauguauauauauaua

SEQ ID NO: 755944 - RNA, 64 nt, Homo Sapiens
auaguauauuuauacucuagaacaugcacauuuauauauauauguauauguauauauauauagu

SEQ ID NO: 755945 - RNA, 64 nt, Homo Sapiens
cuagaacaugcacauuuauauauauauguauauguauauauauauaguaacuacuuuuuauacu

SEQ ID NO: 755946 - RNA, 64 nt, Homo Sapiens
agaacaugcacauuuauauauauauguauauguauauauauauaguaacuacuuuuuauacucc

SEQ ID NO: 755947 - RNA, 64 nt, Homo Sapiens
aacaugcacauuuauauauauauguauauguauauauauauaguaacuacuuuuuauacuccau

SEQ ID NO: 755948 - RNA, 64 nt, Homo Sapiens
aauuuuagguuuuagaauagagcugacauuaacauauauauauauauauaaauauauauauaua

SEQ ID NO: 755949 - RNA, 64 nt, Homo Sapiens
uuuuagguuuuagaauagagcugacauuaacauauauauauauauauaaauauauauauauauu

SEQ ID NO: 755950 - RNA, 64 nt, Homo Sapiens
uuagguuuuagaauagagcugacauuaacauauauauauauauauaaauauauauauauauuuu

SEQ ID NO: 755951 - RNA, 64 nt, Homo Sapiens
agguuuuagaauagagcugacauuaacauauauauauauauauaaauauauauauauauuuugu

SEQ ID NO: 755952 - RNA, 64 nt, Homo Sapiens
guuuuagaauagagcugacauuaacauauauauauauauauaaauauauauauauauuuuguaa

SEQ ID NO: 755953 - RNA, 64 nt, Homo Sapiens
agagcugacauuaacauauauauauauauauaaauauauauauauauuuuguaauaugagccag

SEQ ID NO: 755954 - RNA, 64 nt, Homo Sapiens
agcugacauuaacauauauauauauauauaaauauauauauauauuuuguaauaugagccagaa

SEQ ID NO: 755955 - RNA, 64 nt, Homo Sapiens
cugacauuaacauauauauauauauauaaauauauauauauauuuuguaauaugagccagaauu

SEQ ID NO: 755956 - RNA, 64 nt, Homo Sapiens
uuugguacuuuuuccccuaauuccaacacuaguuuauauauauagcgaauaaaucuaguuguau

SEQ ID NO: 755957 - RNA, 64 nt, Homo Sapiens
ugguacuuuuuccccuaauuccaacacuaguuuauauauauagcgaauaaaucuaguuguauaa

SEQ ID NO: 755958 - RNA, 64 nt, Homo Sapiens
caaaaucaucuauauuuauagaggaauagaaguuuauauauauauaauaccauauuuuuaauuu

SEQ ID NO: 755959 - RNA, 64 nt, Homo Sapiens
aaaucaucuauauuuauagaggaauagaaguuuauauauauauaauaccauauuuuuaauuuca

SEQ ID NO: 755960 - RNA, 64 nt, Homo Sapiens
aucaucuauauuuauagaggaauagaaguuuauauauauauaauaccauauuuuuaauuucaca

SEQ ID NO: 755961 - RNA, 64 nt, Homo Sapiens
gggcaacauaccaagacccccgucucuuuaaaaauauauauauuuuaaauauacuuaaauauau

SEQ ID NO: 755962 - RNA, 64 nt, Homo Sapiens
auauacuuaaauauauauuucuaauaucuuuaaauauauauauauauuuuaaagaccaauuuau

SEQ ID NO: 755963 - RNA, 64 nt, Homo Sapiens
auacuuaaauauauauuucuaauaucuuuaaauauauauauauauuuuaaagaccaauuuaugg

SEQ ID NO: 755964 - RNA, 64 nt, Homo Sapiens
acuuaaauauauauuucuaauaucuuuaaauauauauauauauuuuaaagaccaauuuauggga

SEQ ID NO: 755965 - RNA, 64 nt, Homo Sapiens
gugauuucauuuugggaaacagguuucaaaugaauauauauacauggguaaaauuacucugugc

SEQ ID NO: 755966 - RNA, 64 nt, Homo Sapiens
augaaaaugugguuagaauguuaauuggauaauguauauauaagaaguuaaaguauguaaagua

SEQ ID NO: 755967 - RNA, 64 nt, Homo Sapiens
accagcaaauuauauguggacagguucuaaacucuauauauacauauauauauauauaucuaua

SEQ ID NO: 755968 - RNA, 64 nt, Homo Sapiens
uauauguggacagguucuaaacucuauauauacauauauauauauauaucuauauaucuauaua

SEQ ID NO: 755969 - RNA, 64 nt, Homo Sapiens
uauguggacagguucuaaacucuauauauacauauauauauauauaucuauauaucuauauacg

SEQ ID NO: 755970 - RNA, 64 nt, Homo Sapiens
uguggacagguucuaaacucuauauauacauauauauauauauaucuauauaucuauauacgua

SEQ ID NO: 755971 - RNA, 64 nt, Homo Sapiens
uggacagguucuaaacucuauauauacauauauauauauauaucuauauaucuauauacguaau

SEQ ID NO: 755972 - RNA, 64 nt, Homo Sapiens
uguauauguguacauauggacauacacauuuacauauauauaaaguauauauauacauauauau

SEQ ID NO: 755973 - RNA, 64 nt, Homo Sapiens
acauauggacauacacauuuacauauauauaaaguauauauauacauauauauauauauauaug

SEQ ID NO: 755974 - RNA, 64 nt, Homo Sapiens
auauggacauacacauuuacauauauauaaaguauauauauacauauauauauauauauaugua

SEQ ID NO: 755975 - RNA, 64 nt, Homo Sapiens
acacauuuacauauauauaaaguauauauauacauauauauauauauauauguaugaaacccgc

SEQ ID NO: 755976 - RNA, 64 nt, Homo Sapiens
acauuuacauauauauaaaguauauauauacauauauauauauauauauguaugaaacccgcau

SEQ ID NO: 755977 - RNA, 64 nt, Homo Sapiens
auuuacauauauauaaaguauauauauacauauauauauauauauauguaugaaacccgcaugg

SEQ ID NO: 755978 - RNA, 64 nt, Homo Sapiens
uuacauauauauaaaguauauauauacauauauauauauauauauguaugaaacccgcauggaa

SEQ ID NO: 755979 - RNA, 64 nt, Homo Sapiens
acauauauauaaaguauauauauacauauauauauauauauauguaugaaacccgcauggaauu

SEQ ID NO: 755980 - RNA, 64 nt, Homo Sapiens
uaauaaagugaaauugguauacuuuccaguuaaauauauauauauauauauuuuuucuuacuuu

SEQ ID NO: 755981 - RNA, 64 nt, Homo Sapiens
auaaagugaaauugguauacuuuccaguuaaauauauauauauauauauuuuuucuuacuuuau

SEQ ID NO: 755982 - RNA, 64 nt, Homo Sapiens
aaagugaaauugguauacuuuccaguuaaauauauauauauauauauuuuuucuuacuuuaucu

SEQ ID NO: 755983 - RNA, 64 nt, Homo Sapiens
agugaaauugguauacuuuccaguuaaauauauauauauauauauuuuuucuuacuuuaucuuu

SEQ ID NO: 755984 - RNA, 64 nt, Homo Sapiens
ugaaauugguauacuuuccaguuaaauauauauauauauauauuuuuucuuacuuuaucuuuua

SEQ ID NO: 755985 - RNA, 64 nt, Homo Sapiens
uggauggauuacuaauauuugauuuauuacucaauauauauauaauuccagccuuggaaaguag

SEQ ID NO: 755986 - RNA, 64 nt, Homo Sapiens
gauggauuacuaauauuugauuuauuacucaauauauauauaauuccagccuuggaaaguagga

SEQ ID NO: 755987 - RNA, 64 nt, Homo Sapiens
aaauauguuuaauguauauaaugugauuuuuaaauauauauauauauauacacacauugugaaa

SEQ ID NO: 755988 - RNA, 64 nt, Homo Sapiens
auauguuuaauguauauaaugugauuuuuaaauauauauauauauauacacacauugugaaaua

SEQ ID NO: 755989 - RNA, 64 nt, Homo Sapiens
auguuuaauguauauaaugugauuuuuaaauauauauauauauauacacacauugugaaauaau

SEQ ID NO: 755990 - RNA, 64 nt, Homo Sapiens
guuuaauguauauaaugugauuuuuaaauauauauauauauauacacacauugugaaauaauga

SEQ ID NO: 755991 - RNA, 64 nt, Homo Sapiens
uuaauguauauaaugugauuuuuaaauauauauauauauauacacacauugugaaauaaugaaa

SEQ ID NO: 755992 - RNA, 64 nt, Homo Sapiens
cuauaugauuaaagaaaauaugucuugucuauuguauauauaauguccauuaucuauauagucc

SEQ ID NO: 755993 - RNA, 64 nt, Homo Sapiens
uuuaaaaaucuaccuguuccuguguguuagcuuguauauauauuggcauuagugcugauagcug

SEQ ID NO: 755994 - RNA, 64 nt, Homo Sapiens
ucccugaaggaaccaaagcguauuauauuauauauauauauauugaauuauuuuaaaagauaaa

SEQ ID NO: 755995 - RNA, 64 nt, Homo Sapiens
uuucccugaaggaaccaaagaauauuauauuauauauauauauauggaauuauuuuaaaagaua

SEQ ID NO: 755996 - RNA, 64 nt, Homo Sapiens
uauuucccugaaggaaccaauaaauauuauauuauauauauauagguggaauuauuuuaaaaga

SEQ ID NO: 755997 - RNA, 64 nt, Homo Sapiens
uauauuucccugaaggaaccgauaaauauuauauuauauauauagagguggaauuauuuuaaaa

SEQ ID NO: 755998 - RNA, 64 nt, Homo Sapiens
gacacacagucacgcaagcuuuccaacacaucuauauauauaugcaaaaguucucaauguucuu

SEQ ID NO: 755999 - RNA, 64 nt, Homo Sapiens
uggacacacagucacgcaaguuuuccaacacaucuauauauauaugcaaaaguucucaauguuc

SEQ ID NO: 756000 - RNA, 64 nt, Homo Sapiens
gucagugacgaggaacuccccauucuuuuuuuuauauauauaaagugaacguggcccgcaugug

SEQ ID NO: 756001 - RNA, 64 nt, Homo Sapiens
aagucagugacgaggaacucugcauucuuuuuuuuauauauauacugugaacguggcccgcaug

SEQ ID NO: 756002 - RNA, 64 nt, Homo Sapiens
uuuaaggugaaauacuaaacauauauuauauauauauauauauuaugagugggaagacugaucu

SEQ ID NO: 756003 - RNA, 64 nt, Homo Sapiens
uuuuuaaggugaaauacuaacuauauauuauauauauauauauaugaugagugggaagacugau

SEQ ID NO: 756004 - RNA, 63 nt, Homo Sapiens
uauuuuuaaggugaaauacuucuauauauuauauauauauauaaugaugagugggaagacuga

SEQ ID NO: 756005 - RNA, 61 nt, Homo Sapiens
uauauuuuuaaggugaaauaucuauauauuauauauauauaaugaugagugggaagacuga

SEQ ID NO: 756006 - RNA, 59 nt, Homo Sapiens
uauauauuuuuaaggugaaaucuauauauuauauauauaaugaugagugggaagacuga

SEQ ID NO: 756007 - RNA, 64 nt, Homo Sapiens
uuuguguauguuauuugccaaacauuuauauauauauauauagaugaauauucaauuuuauaca

SEQ ID NO: 756008 - RNA, 64 nt, Homo Sapiens
gauuuguguauguuauuugccaaacauuuauauauauauauauacaugaauauucaauuuuaua

SEQ ID NO: 756009 - RNA, 64 nt, Homo Sapiens
uagauuuguguauguuauuuuacaaacauuuauauauauauauaaucaugaauauucaauuuua

SEQ ID NO: 756010 - RNA, 64 nt, Homo Sapiens
uauagauuuguguauguuauuauacaaacauuuauauauauauaaaaucaugaauauucaauuu

SEQ ID NO: 756011 - RNA, 64 nt, Homo Sapiens
uauauagauuuguguauguuuuuauacaaacauuuauauauauauaaaaucaugaauauucaau

SEQ ID NO: 756012 - RNA, 64 nt, Homo Sapiens
auauaucacccuuuagaucuuaauagcauugauauauauauauucuaaacaagguuuuuaugaa

SEQ ID NO: 756013 - RNA, 64 nt, Homo Sapiens
uuauauaucacccuuuagauaauaauagcauugauauauauauauacuaaacaagguuuuuaug

SEQ ID NO: 756014 - RNA, 64 nt, Homo Sapiens
uuuguaaauaaacaggaacuuacauacauacacauauauauauuagcugagggguuaauauaua

SEQ ID NO: 756015 - RNA, 64 nt, Homo Sapiens
uacauacacauauauauauuagcugagggguuaauauauauacaaaaggaugaucaugggaggg

SEQ ID NO: 756016 - RNA, 64 nt, Homo Sapiens
ucaguauucccucugauaacugacaguuuauguauauauauaauaucauguaaucacaguuuaa

SEQ ID NO: 756017 - RNA, 64 nt, Homo Sapiens
auucaguauucccucugauaaaugacaguuuauguauauauauaguaucauguaaucacaguuu

SEQ ID NO: 756018 - RNA, 64 nt, Homo Sapiens
auuaaaaugugaaauuuugcguacucucucucucuauauauauaguucaaaaauacuuuaggug

SEQ ID NO: 756019 - RNA, 64 nt, Homo Sapiens
uaaaaugugaaauuuugcguacucucucucucuauauauauaguucaaaaauacuuuagguggu

SEQ ID NO: 756020 - RNA, 64 nt, Homo Sapiens
ccauuuacgcuacaugugauuuuuuuaauguauguauauauauauauucucaaauugcucuauc

SEQ ID NO: 756021 - RNA, 64 nt, Homo Sapiens
auuuacgcuacaugugauuuuuuuaauguauguauauauauauauucucaaauugcucuaucag

SEQ ID NO: 756022 - RNA, 64 nt, Homo Sapiens
uuacgcuacaugugauuuuuuuaauguauguauauauauauauucucaaauugcucuaucagcu

SEQ ID NO: 756023 - RNA, 64 nt, Homo Sapiens
aaacagauaaaaugcaucuuguuacuacaaauguuauauauauaaaaucaaguugagcuuugcc

SEQ ID NO: 756024 - RNA, 64 nt, Homo Sapiens
acagauaaaaugcaucuuguuacuacaaauguuauauauauaaaaucaaguugagcuuugccuu

SEQ ID NO: 756025 - RNA, 64 nt, Homo Sapiens
uguuuguuaacaguuacauauguuuguaugaguguauauauauaucuguguguguguaucucua

SEQ ID NO: 756026 - RNA, 64 nt, Homo Sapiens
uuuguuaacaguuacauauguuuguaugaguguauauauauaucuguguguguguaucucuaac

SEQ ID NO: 756027 - RNA, 64 nt, Homo Sapiens
cugguaaauuguagaacaauugcauguguuuaaauauauauacaaacauaucacacauuaaaua

SEQ ID NO: 756028 - RNA, 64 nt, Homo Sapiens
uuuaaauauauauacaaacauaucacacauuaaauauauauauauuuaaaucaugcuuuguuaa

SEQ ID NO: 756029 - RNA, 64 nt, Homo Sapiens
uaaauauauauacaaacauaucacacauuaaauauauauauauuuaaaucaugcuuuguuaaua

SEQ ID NO: 756030 - RNA, 64 nt, Homo Sapiens
aggaaauauaaugauuucugggaacaugggcauguauauauauauauggagagagaauuuugca

SEQ ID NO: 756031 - RNA, 64 nt, Homo Sapiens
gaaauauaaugauuucugggaacaugggcauguauauauauauauggagagagaauuuugcaca

SEQ ID NO: 756032 - RNA, 64 nt, Homo Sapiens
aauauaaugauuucugggaacaugggcauguauauauauauauggagagagaauuuugcacaua

SEQ ID NO: 756033 - RNA, 64 nt, Homo Sapiens
uuuuauucucaaguggagaacuucucccacauaauauauauauauauauauauuuuaauuuaug

SEQ ID NO: 756034 - RNA, 64 nt, Homo Sapiens
uuauucucaaguggagaacuucucccacauaauauauauauauauauauauuuuaauuuaugag

SEQ ID NO: 756035 - RNA, 64 nt, Homo Sapiens
auucucaaguggagaacuucucccacauaauauauauauauauauauauuuuaauuuaugagaa

SEQ ID NO: 756036 - RNA, 64 nt, Homo Sapiens
ucucaaguggagaacuucucccacauaauauauauauauauauauauuuuaauuuaugagaauu

SEQ ID NO: 756037 - RNA, 64 nt, Homo Sapiens
ucaaguggagaacuucucccacauaauauauauauauauauauauuuuaauuuaugagaauuuu

SEQ ID NO: 756038 - RNA, 64 nt, Homo Sapiens
aaguggagaacuucucccacauaauauauauauauauauauauuuuaauuuaugagaauuuugg

SEQ ID NO: 756039 - RNA, 64 nt, Homo Sapiens
aacaguaccaaaccuuuauacacuguuuuuuccauauauauauaccuaugauaaaguauaaugu

SEQ ID NO: 756040 - RNA, 64 nt, Homo Sapiens
caguaccaaaccuuuauacacuguuuuuuccauauauauauaccuaugauaaaguauaauguau

SEQ ID NO: 756041 - RNA, 64 nt, Homo Sapiens
cuguaucucaacauuuucuuuuuaaaggaaaaaauauauauauauaguuucuuuuuauugauca

SEQ ID NO: 756042 - RNA, 64 nt, Homo Sapiens
guaucucaacauuuucuuuuuaaaggaaaaaauauauauauauaguuucuuuuuauugaucagg

SEQ ID NO: 756043 - RNA, 64 nt, Homo Sapiens
aucucaacauuuucuuuuuaaaggaaaaaauauauauauauaguuucuuuuuauugaucagguc

SEQ ID NO: 756044 - RNA, 64 nt, Homo Sapiens
accaguccauccaaaaccuauauaucaccuauacuauauauaucauauauauaguugaauggca

SEQ ID NO: 756045 - RNA, 64 nt, Homo Sapiens
caaaaccuauauaucaccuauacuauauauaucauauauauaguugaauggcaguauucaggcu

SEQ ID NO: 756046 - RNA, 64 nt, Homo Sapiens
aagucaaaauuguaauaacuuauauauauauacauauauauaaaaagaggaaaacuagaauaua

SEQ ID NO: 756047 - RNA, 64 nt, Homo Sapiens
uauauauaaaaagucaaaaucuagaauauauauauauauauacaaaauaacacaaagaggaaaa

SEQ ID NO: 756048 - RNA, 64 nt, Homo Sapiens
cauauauauaaaaagucaaaaacuagaauauauauauauauauaaaaaauaacacaaagaggaa

SEQ ID NO: 756049 - RNA, 64 nt, Homo Sapiens
uacauauauauaaaaagucaaaaacuagaauauauauauauauaaaaaaaauaacacaaagagg

SEQ ID NO: 756050 - RNA, 64 nt, Homo Sapiens
uauacauauauauaaaaaguggaaaacuagaauauauauauauaaaaaaaaaauaacacaaaga

SEQ ID NO: 756051 - RNA, 64 nt, Homo Sapiens
uauauacauauauauaaaaagaggaaaacuagaauauauauauaaaaaaaaaaaauaacacaaa

SEQ ID NO: 756052 - RNA, 64 nt, Homo Sapiens
gacaaaagagacugugaaauuuugcaaucuauuuuauauauauucuuauuuuuuuguguauauc

SEQ ID NO: 756053 - RNA, 64 nt, Homo Sapiens
ugauaaaauuaccugaggaguauucucauauauauauauauagcaaaacaacaaaauauauaua

SEQ ID NO: 756054 - RNA, 64 nt, Homo Sapiens
gcugauaaaauuaccugagguauauucucauauauauauauauaacaaaacaacaaaauauaua

SEQ ID NO: 756055 - RNA, 64 nt, Homo Sapiens
uagcugauaaaauuaccugauauauauucucauauauauauauaguacaaaacaacaaaauaua

SEQ ID NO: 756056 - RNA, 64 nt, Homo Sapiens
uauagcugauaaaauuaccuuauauauauucucauauauauauaugguacaaaacaacaaaaua

SEQ ID NO: 756057 - RNA, 64 nt, Homo Sapiens
cucauauauauauauauagcaaaacaacaaaauauauauauauuauaauggagagauuugguac

SEQ ID NO: 756058 - RNA, 64 nt, Homo Sapiens
uucucauauauauauauauaacaaaacaacaaaauauauauauaaaauaauggagagauuuggu

SEQ ID NO: 756059 - RNA, 64 nt, Homo Sapiens
gugaaagaucaauccaucuggaaaaaaauauauauauauauauucuuccauaagaagaaaugga

SEQ ID NO: 756060 - RNA, 64 nt, Homo Sapiens
uugugaaagaucaauccaucgagaaaaaaauauauauauauauaggcuuccauaagaagaaaug

SEQ ID NO: 756061 - RNA, 64 nt, Homo Sapiens
uauugugaaagaucaauccauggagaaaaaaauauauauauauacuggcuuccauaagaagaaa

SEQ ID NO: 756062 - RNA, 64 nt, Homo Sapiens
uauauugugaaagaucaaucaauggagaaaaaaauauauauauauucuggcuuccauaagaaga

SEQ ID NO: 756063 - RNA, 64 nt, Homo Sapiens
uauguacauauucucauaugaacuucuuagaauauauauauacaugggucagaucaugggacau

SEQ ID NO: 756064 - RNA, 64 nt, Homo Sapiens
cauauguacauauucucauaauaacuucuuagaauauauauauauaugggucagaucaugggac

SEQ ID NO: 756065 - RNA, 64 nt, Homo Sapiens
guaaaauuauaaauuuuuuuuuuaaaaaaaauucuauauauacuaaaacaguucagaauauuuu

SEQ ID NO: 756066 - RNA, 64 nt, Homo Sapiens
cacacacacacauacuuaaauguguguguguguguauauauacauauguauguauguguaugug

SEQ ID NO: 756067 - RNA, 64 nt, Homo Sapiens
acacacacacacacacaugcggggcuucaauauauauauauaauaaauuguaauaauguaaaug

SEQ ID NO: 756068 - RNA, 64 nt, Homo Sapiens
auacacacacacacacacauugggggcuucaauauauauauauaguaaauuguaauaauguaaa

SEQ ID NO: 756069 - RNA, 64 nt, Homo Sapiens
uaauacacacacacacacacaaugggggcuucaauauauauauaauguaaauuguaauaaugua

SEQ ID NO: 756070 - RNA, 64 nt, Homo Sapiens
guucuuuucaguguucacaucaucauauuuacaguauauauauuauagcuacauuugguuuauu

SEQ ID NO: 756071 - RNA, 64 nt, Homo Sapiens
uguaucucuacagaaaggcuuggauaaauauauauauauauauuaucuguauaaaacauauuuu

SEQ ID NO: 756072 - RNA, 64 nt, Homo Sapiens
uuuguaucucuacagaaagguuuggauaaauauauauauauauauuaucuguauaaaacauauu

SEQ ID NO: 756073 - RNA, 64 nt, Homo Sapiens
uauuuguaucucuacagaaauuuuuggauaaauauauauauauaauuuaucuguauaaaacaua

SEQ ID NO: 756074 - RNA, 64 nt, Homo Sapiens
uauauuuguaucucuacagauauuuuuggauaaauauauauauaacauuuaucuguauaaaaca

SEQ ID NO: 756075 - RNA, 64 nt, Homo Sapiens
aagguguggcuguuuaaaaugguaucuugauguauauauauauuuuacuaucuaaaaguuuauc

SEQ ID NO: 756076 - RNA, 64 nt, Homo Sapiens
uuaagguguggcuguuuaaaucgguaucuugauguauauauauacuuuacuaucuaaaaguuua

SEQ ID NO: 756077 - RNA, 64 nt, Homo Sapiens
cacacacacacgcacauauauauauauauauauauauauauacaaauacaaaaggcuccauaua

SEQ ID NO: 756078 - RNA, 64 nt, Homo Sapiens
cacacacacacacgcacauauauauauauauauauauauauauaauaauacaaaaggcuccaua

SEQ ID NO: 756079 - RNA, 64 nt, Homo Sapiens
uacacacacacacacgcacauauauauauauauauauauauauaccauaauacaaaaggcucca

SEQ ID NO: 756080 - RNA, 64 nt, Homo Sapiens
uauacacacacacacacgcacauauauauauauauauauauauaugccauaauacaaaaggcuc

SEQ ID NO: 756081 - RNA, 64 nt, Homo Sapiens
uauauacacacacacacacguccauauauauauauauauauauaaaugccauaauacaaaaggc

SEQ ID NO: 756082 - RNA, 64 nt, Homo Sapiens
uauauauacacacacacacagcuccauauauauauauauauauaaaaaugccauaauacaaaag

SEQ ID NO: 756083 - RNA, 64 nt, Homo Sapiens
uauauauauacacacacacaaggcuccauauauauauauauauaaaaaaaugccauaauacaaa

SEQ ID NO: 756084 - RNA, 64 nt, Homo Sapiens
uauauauauauacacacacaaaaggcuccauauauauauauauaaaaaaaaaugccauaauaca

SEQ ID NO: 756085 - RNA, 64 nt, Homo Sapiens
uauauauauauauacacacacaaaaggcuccauauauauauauagaaaaaaaaaugccauaaua

SEQ ID NO: 756086 - RNA, 64 nt, Homo Sapiens
uauauauauauauauacacauacaaaaggcuccauauauauauaaagaaaaaaaaaugccauaa

SEQ ID NO: 756087 - RNA, 64 nt, Homo Sapiens
uuuuagaguuccguuuuuaucuccccaguuuuuauauauauauuauuguuguaaaacuuaauuu

SEQ ID NO: 756088 - RNA, 64 nt, Homo Sapiens
uuuuuuagaguuccguuuuuuucuccccaguuuuuauauauauacaauuguuguaaaacuuaau

SEQ ID NO: 756089 - RNA, 64 nt, Homo Sapiens
cugguaacuguuaacccaguguucagcauagagcuauauauauauauauauguauauauuuauu

SEQ ID NO: 756090 - RNA, 64 nt, Homo Sapiens
gguaacuguuaacccaguguucagcauagagcuauauauauauauauauguauauauuuauuau

SEQ ID NO: 756091 - RNA, 64 nt, Homo Sapiens
uaacuguuaacccaguguucagcauagagcuauauauauauauauauguauauauuuauuauuu

SEQ ID NO: 756092 - RNA, 64 nt, Homo Sapiens
acuguuaacccaguguucagcauagagcuauauauauauauauauguauauauuuauuauuuuc

SEQ ID NO: 756093 - RNA, 64 nt, Homo Sapiens
uguuaacccaguguucagcauagagcuauauauauauauauauguauauauuuauuauuuucau

SEQ ID NO: 756094 - RNA, 64 nt, Homo Sapiens
cuuuaaaaccauaucagagaugcauacaaagaauuauauauaaagaaggguguuuaauaaugau

SEQ ID NO: 756095 - RNA, 64 nt, Homo Sapiens
ugcuauguaaauauacaaaaaaacuagaaagaaauauauauaaccuuguuauuguauuuggggg

SEQ ID NO: 756096 - RNA, 64 nt, Homo Sapiens
ugagaagcauguaauguuaauguuauaucauauguauauauauauaugcacuauguauauacau

SEQ ID NO: 756097 - RNA, 64 nt, Homo Sapiens
agaagcauguaauguuaauguuauaucauauguauauauauauaugcacuauguauauacauau

SEQ ID NO: 756098 - RNA, 64 nt, Homo Sapiens
aagcauguaauguuaauguuauaucauauguauauauauauaugcacuauguauauacauauau

SEQ ID NO: 756099 - RNA, 64 nt, Homo Sapiens
cuuggauacaccaauuagaaauuaaauaagcaaauauauauauauauauaaauauagcagguua

SEQ ID NO: 756100 - RNA, 64 nt, Homo Sapiens
uggauacaccaauuagaaauuaaauaagcaaauauauauauauauauaaauauagcagguuaca

SEQ ID NO: 756101 - RNA, 64 nt, Homo Sapiens
gauacaccaauuagaaauuaaauaagcaaauauauauauauauauaaauauagcagguuacaua

SEQ ID NO: 756102 - RNA, 64 nt, Homo Sapiens
uacaccaauuagaaauuaaauaagcaaauauauauauauauauaaauauagcagguuacauaua

SEQ ID NO: 756103 - RNA, 64 nt, Homo Sapiens
caccaauuagaaauuaaauaagcaaauauauauauauauauaaauauagcagguuacauauaua

SEQ ID NO: 756104 - RNA, 64 nt, Homo Sapiens
aauauauauauauauauaaauauagcagguuacauauauauauuuauaaugugucuuuuuauua

SEQ ID NO: 756105 - RNA, 64 nt, Homo Sapiens
ugacauauaagccguauauagaucaauguccacauauauauacacacacacauauauauauaua

SEQ ID NO: 756106 - RNA, 64 nt, Homo Sapiens
uagaucaauguccacauauauauacacacacacauauauauauauaaaguguaacaaggaacac

SEQ ID NO: 756107 - RNA, 64 nt, Homo Sapiens
gaucaauguccacauauauauacacacacacauauauauauauaaaguguaacaaggaacacua

SEQ ID NO: 756108 - RNA, 64 nt, Homo Sapiens
ucaauguccacauauauauacacacacacauauauauauauaaaguguaacaaggaacacuaaa

SEQ ID NO: 756109 - RNA, 64 nt, Homo Sapiens
auuuuuuuucuaaaccuuuuuuuuuuaauauacauauauauauauauauauauauauauauaua

SEQ ID NO: 756110 - RNA, 64 nt, Homo Sapiens
uuuuuuucuaaaccuuuuuuuuuuaauauacauauauauauauauauauauauauauauauaua

SEQ ID NO: 756111 - RNA, 64 nt, Homo Sapiens
uuuuucuaaaccuuuuuuuuuuaauauacauauauauauauauauauauauauauauauauaua

SEQ ID NO: 756112 - RNA, 64 nt, Homo Sapiens
uuucuaaaccuuuuuuuuuuaauauacauauauauauauauauauauauauauauauauauaua

SEQ ID NO: 756113 - RNA, 64 nt, Homo Sapiens
ucuaaaccuuuuuuuuuuaauauacauauauauauauauauauauauauauauauauauauaua

SEQ ID NO: 756114 - RNA, 64 nt, Homo Sapiens
uaaaccuuuuuuuuuuaauauacauauauauauauauauauauauauauauauauauauauaua

SEQ ID NO: 756115 - RNA, 64 nt, Homo Sapiens
aaccuuuuuuuuuuaauauacauauauauauauauauauauauauauauauauauauauauaua

SEQ ID NO: 756116 - RNA, 64 nt, Homo Sapiens
ccuuuuuuuuuuaauauacauauauauauauauauauauauauauauauauauauauauauaua

SEQ ID NO: 756117 - RNA, 64 nt, Homo Sapiens
uuuuuuuuuuaauauacauauauauauauauauauauauauauauauauauauauauauauaua

SEQ ID NO: 756118 - RNA, 64 nt, Homo Sapiens
uuuuuuuuaauauacauauauauauauauauauauauauauauauauauauauauauauauaua

SEQ ID NO: 756119 - RNA, 64 nt, Homo Sapiens
uuuuuuaauauacauauauauauauauauauauauauauauauauauauauauauauauauagu

SEQ ID NO: 756120 - RNA, 64 nt, Homo Sapiens
uuuuaauauacauauauauauauauauauauauauauauauauauauauauauauauauagugg

SEQ ID NO: 756121 - RNA, 64 nt, Homo Sapiens
uuaauauacauauauauauauauauauauauauauauauauauauauauauauauauagugggg

SEQ ID NO: 756122 - RNA, 64 nt, Homo Sapiens
aauauacauauauauauauauauauauauauauauauauauauauauauauauauagugggggu

SEQ ID NO: 756123 - RNA, 64 nt, Homo Sapiens
uauacauauauauauauauauauauauauauauauauauauauauauauauauagugggggugg

SEQ ID NO: 756124 - RNA, 64 nt, Homo Sapiens
uacauauauauauauauauauauauauauauauauauauauauauauauauagugggggugggg

SEQ ID NO: 756125 - RNA, 64 nt, Homo Sapiens
cauauauauauauauauauauauauauauauauauauauauauauauauaguggggguggggca

SEQ ID NO: 756126 - RNA, 64 nt, Homo Sapiens
uauauauauauauauauauauauauauauauauauauauauauauauaguggggguggggcaag

SEQ ID NO: 756127 - RNA, 64 nt, Homo Sapiens
uauauauauauauauauauauauauauauauauauauauauauauaguggggguggggcaaggg

SEQ ID NO: 756128 - RNA, 64 nt, Homo Sapiens
uauauauauauauauauauauauauauauauauauauauauauaguggggguggggcaagggau

SEQ ID NO: 756129 - RNA, 64 nt, Homo Sapiens
uauauauauauauauauauauauauauauauauauauauauaguggggguggggcaagggauca

SEQ ID NO: 756130 - RNA, 64 nt, Homo Sapiens
uguguguguguguguguguguguguguguguauguauauauauauauaaauaucuuucccaaua

SEQ ID NO: 756131 - RNA, 64 nt, Homo Sapiens
uguguguguguguguguguguguguguguauguauauauauauauaaauaucuuucccaauaug

SEQ ID NO: 756132 - RNA, 64 nt, Homo Sapiens
uguguguguguguguguguguguguguauguauauauauauauaaauaucuuucccaauaugcc

SEQ ID NO: 756133 - RNA, 64 nt, Homo Sapiens
uguguguguguguguguguguguguauguauauauauauauaaauaucuuucccaauaugcccc

SEQ ID NO: 756134 - RNA, 64 nt, Homo Sapiens
uaucuguguuuuaagauuguuuugauuuuguguauauauauauuuuauaguacaaucacauugc

SEQ ID NO: 756135 - RNA, 64 nt, Homo Sapiens
uuuaucuguguuuuaagauugcuuugauuuuguguauauauauaauuuauaguacaaucacauu

SEQ ID NO: 756136 - RNA, 64 nt, Homo Sapiens
cuccuuuuaauggugggggguggaaaaaaaauuauauauauauucuggguguaagaagggaaau

SEQ ID NO: 756137 - RNA, 64 nt, Homo Sapiens
uucuccuuuuaaugguggggauuggaaaaaaaauuauauauauacucuggguguaagaagggaa

SEQ ID NO: 756138 - RNA, 64 nt, Homo Sapiens
uugaaauauggcugagaacauggcauaaagaauguauauauauuagcagaguucccuauucccc

SEQ ID NO: 756139 - RNA, 64 nt, Homo Sapiens
auugcagguuaaauuacuuuuccuuccaaaguuguauauauaauaaccuguaaaacaccacucc

SEQ ID NO: 756140 - RNA, 64 nt, Homo Sapiens
uuuauuuuugagauggaguuauuuuauauauauauauauauauuaauacauauggaauauauau

SEQ ID NO: 756141 - RNA, 64 nt, Homo Sapiens
uuuuuauuuuugagauggagauauuuuauauauauauauauauaaaaauacauauggaauauau

SEQ ID NO: 756142 - RNA, 64 nt, Homo Sapiens
uauuuuuauuuuugagauggauauauuuuauauauauauauauaauaaaauacauauggaauau

SEQ ID NO: 756143 - RNA, 64 nt, Homo Sapiens
uauauuuuuauuuuugagauauauauauuuuauauauauauauaauauaaaauacauauggaau

SEQ ID NO: 756144 - RNA, 64 nt, Homo Sapiens
uauauauuuuuauuuuugagauauauauauuuuauauauauauaauauauaaaauacauaugga

SEQ ID NO: 756145 - RNA, 64 nt, Homo Sapiens
uauauauauuuuuauuuuuggaauauauauauuuuauauauauaauauauauaaaauacauaug

SEQ ID NO: 756146 - RNA, 64 nt, Homo Sapiens
uuauauauauauauauauauaaauacauauggaauauauauauuauauauauauuauauauaua

SEQ ID NO: 756147 - RNA, 64 nt, Homo Sapiens
auacauauggaauauauauagaauauauauauuauauauauaaauuauauauauaauauauaug

SEQ ID NO: 756148 - RNA, 64 nt, Homo Sapiens
aaauacauauggaauauauauggaauauauauauuauauauauauuuuauauauauaauauaua

SEQ ID NO: 756149 - RNA, 64 nt, Homo Sapiens
auauauauaaaauacauauguaauauauauggaauauauauauuuauauauauuuuuauauaua

SEQ ID NO: 756150 - RNA, 64 nt, Homo Sapiens
auauauggaauauauauauuuauauauauuuuuauauauauaauuauauauggaauauguauau

SEQ ID NO: 756151 - RNA, 64 nt, Homo Sapiens
auauauauggaauauauauaauuauauauauuuuuauauauauaaauauauauggaauauguau

SEQ ID NO: 756152 - RNA, 64 nt, Homo Sapiens
uuuauauauauaauauauauuggaauauguauauuauauauauuccuuccauauauaauauaua

SEQ ID NO: 756153 - RNA, 64 nt, Homo Sapiens
uucauaaaaaguuaugugauauuguauuuaugucuauauauaugauuugucaccucacccacag

SEQ ID NO: 756154 - RNA, 64 nt, Homo Sapiens
uguuuuuccauuguaugcaaaacuuuguaaaauauauauauacucucuagugucuuauuaguua

SEQ ID NO: 756155 - RNA, 64 nt, Homo Sapiens
cuuguuuuuccauuguaugcuaaacuuuguaaaauauauauauaugcucuagugucuuauuagu

SEQ ID NO: 756156 - RNA, 64 nt, Homo Sapiens
uuuuuuuugguuaggaagugauauauauauuauauauauauauuuuccuuaauguuagugagau

SEQ ID NO: 756157 - RNA, 64 nt, Homo Sapiens
uuuuuuuuuugguuaggaagauauauauauauuauauauauauauuuuccuuaauguuagugag

SEQ ID NO: 756158 - RNA, 64 nt, Homo Sapiens
uauuuuuuuuuugguuaggaagauauauauauauuauauauauagcuuuuccuuaauguuagug

SEQ ID NO: 756159 - RNA, 64 nt, Homo Sapiens
auauauauauauuuuuuuuuauguuagugagauauauauauauuacaaccgacgcuuuuccuua

SEQ ID NO: 756160 - RNA, 64 nt, Homo Sapiens
uuauauauauauauuuuuuuuaauguuagugagauauauauauagcacaaccgacgcuuuuccu

SEQ ID NO: 756161 - RNA, 64 nt, Homo Sapiens
auuaaaaauguguguguauguguguguguguguguauauauauauauauuuuuaaaucacauua

SEQ ID NO: 756162 - RNA, 64 nt, Homo Sapiens
uaaaaauguguguguauguguguguguguguguauauauauauauauuuuuaaaucacauuaau

SEQ ID NO: 756163 - RNA, 64 nt, Homo Sapiens
aaaauguguguguauguguguguguguguguauauauauauauauuuuuaaaucacauuaauuu

SEQ ID NO: 756164 - RNA, 64 nt, Homo Sapiens
aauguguguguauguguguguguguguguauauauauauauauuuuuaaaucacauuaauuuua

SEQ ID NO: 756165 - RNA, 64 nt, Homo Sapiens
aggccauuuuagguggcucacuuucucauuaagauauauauauagaaccacuuuuuguagauua

SEQ ID NO: 756166 - RNA, 64 nt, Homo Sapiens
gccauuuuagguggcucacuuucucauuaagauauauauauagaaccacuuuuuguagauuagu

SEQ ID NO: 756167 - RNA, 64 nt, Homo Sapiens
ugaucaagccacugaaucacuuugcauuucaguuuauauauauagagagaaagaaggugucugc

SEQ ID NO: 756168 - RNA, 64 nt, Homo Sapiens
aucaagccacugaaucacuuugcauuucaguuuauauauauagagagaaagaaggugucugcuc

SEQ ID NO: 756169 - RNA, 64 nt, Homo Sapiens
cuauacagccacugugcccuguggaauaaagccauauauauaaauguuuuauauguauauguuu

SEQ ID NO: 756170 - RNA, 64 nt, Homo Sapiens
uauguuuuauacauaaauaaaacauuucaucuaauauauauaugugugugugaguauaugugug

SEQ ID NO: 756171 - RNA, 64 nt, Homo Sapiens
aacugaaccuuuuacuaauugugagcuaaagagauauauauauauauguguguguauauauaua

SEQ ID NO: 756172 - RNA, 64 nt, Homo Sapiens
cugaaccuuuuacuaauugugagcuaaagagauauauauauauauguguguguauauauauaua

SEQ ID NO: 756173 - RNA, 64 nt, Homo Sapiens
gaaccuuuuacuaauugugagcuaaagagauauauauauauauguguguguauauauauauauc

SEQ ID NO: 756174 - RNA, 64 nt, Homo Sapiens
gugagcuaaagagauauauauauauauguguguguauauauauauaucuacaugucuuucugua

SEQ ID NO: 756175 - RNA, 64 nt, Homo Sapiens
gagcuaaagagauauauauauauauguguguguauauauauauaucuacaugucuuucuguagc

SEQ ID NO: 756176 - RNA, 64 nt, Homo Sapiens
gcuaaagagauauauauauauauguguguguauauauauauaucuacaugucuuucuguagccu

SEQ ID NO: 756177 - RNA, 64 nt, Homo Sapiens
uaaauguuauuucugcaaacaaacaccuucuuauuauauauauaauauauauauauaucaguuu

SEQ ID NO: 756178 - RNA, 64 nt, Homo Sapiens
aauguuauuucugcaaacaaacaccuucuuauuauauauauaauauauauauauaucaguuuga

SEQ ID NO: 756179 - RNA, 64 nt, Homo Sapiens
ucugcaaacaaacaccuucuuauuauauauauaauauauauauauaucaguuugaucacacuau

SEQ ID NO: 756180 - RNA, 64 nt, Homo Sapiens
ugcaaacaaacaccuucuuauuauauauauaauauauauauauaucaguuugaucacacuauuu

SEQ ID NO: 756181 - RNA, 64 nt, Homo Sapiens
caaacaaacaccuucuuauuauauauauaauauauauauauaucaguuugaucacacuauuuua

SEQ ID NO: 756182 - RNA, 64 nt, Homo Sapiens
uagauucccauggccauaaaauggcuuuaaagaauauauauauauuuuuaaaguagcuugagaa

SEQ ID NO: 756183 - RNA, 64 nt, Homo Sapiens
gauucccauggccauaaaauggcuuuaaagaauauauauauauuuuuaaaguagcuugagaagc

SEQ ID NO: 756184 - RNA, 64 nt, Homo Sapiens
ugaaguaaaaguugugucuauaauuaaaaaaaaauauauauauauacacacacacauauacaua

SEQ ID NO: 756185 - RNA, 64 nt, Homo Sapiens
aaguaaaaguugugucuauaauuaaaaaaaaauauauauauauacacacacacauauacauaca

SEQ ID NO: 756186 - RNA, 64 nt, Homo Sapiens
guaaaaguugugucuauaauuaaaaaaaaauauauauauauacacacacacauauacauacaaa

SEQ ID NO: 756187 - RNA, 64 nt, Homo Sapiens
ucaaauaacauauguacucaauagguuucaaucauauauauaauauauuuuuuguaacuaugaa

SEQ ID NO: 756188 - RNA, 64 nt, Homo Sapiens
gguauauguagauagaugugcauguauguguuuguauauauaauuuuauaaguuucacgcauaa

SEQ ID NO: 756189 - RNA, 64 nt, Homo Sapiens
gccugugugcauacauauguaugggauauauuuguauauauauguacagguaauaaacaucccc

SEQ ID NO: 756190 - RNA, 64 nt, Homo Sapiens
ugauguuauggaagaaagaaagaaacaaacaaaauauauauauauauguccaaaaacagacaaa

SEQ ID NO: 756191 - RNA, 64 nt, Homo Sapiens
auguuauggaagaaagaaagaaacaaacaaaauauauauauauauguccaaaaacagacaaauc

SEQ ID NO: 756192 - RNA, 64 nt, Homo Sapiens
guuauggaagaaagaaagaaacaaacaaaauauauauauauauguccaaaaacagacaaaucca

SEQ ID NO: 756193 - RNA, 64 nt, Homo Sapiens
ccugagcacacuuauuuuugaaaaugauauaauguauauauaugggaggaaaggccacauuuug

SEQ ID NO: 756194 - RNA, 64 nt, Homo Sapiens
cuaaacacuggaauacaaaugcaugacucauaucuauauauacaguauauguacauauacuguu

SEQ ID NO: 756195 - RNA, 64 nt, Homo Sapiens
acagcuguuuaaagucuuuguagcguuuaaaaaauauauauauauacauaacuguuauguaguu

SEQ ID NO: 756196 - RNA, 64 nt, Homo Sapiens
agcuguuuaaagucuuuguagcguuuaaaaaauauauauauauacauaacuguuauguaguucg

SEQ ID NO: 756197 - RNA, 64 nt, Homo Sapiens
cuguuuaaagucuuuguagcguuuaaaaaauauauauauauacauaacuguuauguaguucgga

SEQ ID NO: 756198 - RNA, 64 nt, Homo Sapiens
guuuuugaaucacacugcagcugcuuuccauuuuuauauauauauaaauauauauaaauauaua

SEQ ID NO: 756199 - RNA, 64 nt, Homo Sapiens
uuuugaaucacacugcagcugcuuuccauuuuuauauauauauaaauauauauaaauauauacu

SEQ ID NO: 756200 - RNA, 64 nt, Homo Sapiens
uugaaucacacugcagcugcuuuccauuuuuauauauauauaaauauauauaaauauauacuuu

SEQ ID NO: 756201 - RNA, 64 nt, Homo Sapiens
cugcagcugcuuuccauuuuuauauauauauaaauauauauaaauauauacuuuuuaaaaauaa

SEQ ID NO: 756202 - RNA, 64 nt, Homo Sapiens
gacccacacaaagguucuggagauuacuggagaauauauauaaauauauauauguacguauaua

SEQ ID NO: 756203 - RNA, 64 nt, Homo Sapiens
aagguucuggagauuacuggagaauauauauaaauauauauauguacguauauauguaaauaca

SEQ ID NO: 756204 - RNA, 64 nt, Homo Sapiens
uauauguacguauauauguaaauacacauauacguauauauaaauauauauauacauaugugug

SEQ ID NO: 756205 - RNA, 64 nt, Homo Sapiens
uauauauguaaauacacauauacguauauauaaauauauauauacauauguguguguauauaua

SEQ ID NO: 756206 - RNA, 64 nt, Homo Sapiens
uauauguaaauacacauauacguauauauaaauauauauauacauauguguguguauauauaua

SEQ ID NO: 756207 - RNA, 64 nt, Homo Sapiens
cguauauauaaauauauauauacauauguguguguauauauauauauauuuuuuuuuuuuuuuu

SEQ ID NO: 756208 - RNA, 64 nt, Homo Sapiens
uauauauaaauauauauauacauauguguguguauauauauauauauuuuuuuuuuuuuuuuuu

SEQ ID NO: 756209 - RNA, 64 nt, Homo Sapiens
uauauaaauauauauauacauauguguguguauauauauauauauuuuuuuuuuuuuuuuuuuu

SEQ ID NO: 756210 - RNA, 64 nt, Homo Sapiens
uauaaauauauauauacauauguguguguauauauauauauauuuuuuuuuuuuuuuuuuuuuu

SEQ ID NO: 756211 - RNA, 64 nt, Homo Sapiens
uaaaaauauaucggauaguuaacauauauauauauauauauauuugcauuacuacagccagaag

SEQ ID NO: 756212 - RNA, 64 nt, Homo Sapiens
uuuaaaaauauaucggauagagaacauauauauauauauauauaagugcauuacuacagccaga

SEQ ID NO: 756213 - RNA, 64 nt, Homo Sapiens
uauuuaaaaauauaucggaugaagaacauauauauauauauauaacagugcauuacuacagcca

SEQ ID NO: 756214 - RNA, 64 nt, Homo Sapiens
uauauuuaaaaauauaucggcagaagaacauauauauauauauauuacagugcauuacuacagc

SEQ ID NO: 756215 - RNA, 64 nt, Homo Sapiens
uauauauuuaaaaauauaucgccagaagaacauauauauauauacuuuacagugcauuacuaca

SEQ ID NO: 756216 - RNA, 64 nt, Homo Sapiens
uauauauauuuaaaaauauacagccagaagaacauauauauauaagcuuuacagugcauuacua

SEQ ID NO: 756217 - RNA, 64 nt, Homo Sapiens
uauauaaacaccauauaaguuggauucuaaaauauauauauauuaguguuauuuugauaguuug

SEQ ID NO: 756218 - RNA, 64 nt, Homo Sapiens
uuuauauaaacaccauauaauguggauucuaaaauauauauauaaaaguguuauuuugauaguu

SEQ ID NO: 756219 - RNA, 64 nt, Homo Sapiens
gcuuuccaauaaccaccuaauguauauauauguauauauauauguauacacauauauaugugua

SEQ ID NO: 756220 - RNA, 64 nt, Homo Sapiens
uggcuuuccaauaaccaccuuauguauauauauguauauauauauauauacacauauauaugug

SEQ ID NO: 756221 - RNA, 64 nt, Homo Sapiens
uauauauauauggcuuuccauauauauguguauguauauauaugcacacacauguauauacaca

SEQ ID NO: 756222 - RNA, 64 nt, Homo Sapiens
cacacacacauguauauacacagcuggagguguguauauauacagcugagcucugguuagguua

SEQ ID NO: 756223 - RNA, 64 nt, Homo Sapiens
cuacuuuuuaaacucugcaguaugaagauauauauauauauaguuuuauauguaaauaggcaua

SEQ ID NO: 756224 - RNA, 64 nt, Homo Sapiens
gucuacuuuuuaaacucugcuauaugaagauauauauauauauauauuuauauguaaauaggca

SEQ ID NO: 756225 - RNA, 64 nt, Homo Sapiens
uagucuacuuuuuaaacucucauauaugaagauauauauauauaucuauuuauauguaaauagg

SEQ ID NO: 756226 - RNA, 64 nt, Homo Sapiens
uauagucuacuuuuuaaacuggcauauaugaagauauauauauauaucuauuuauauguaaaua

SEQ ID NO: 756227 - RNA, 64 nt, Homo Sapiens
uauuuauauguaaauaggcagaugcguguauauguauauauaucuccauagaauguaauuuaua

SEQ ID NO: 756228 - RNA, 64 nt, Homo Sapiens
uuuuuuuuuuuuuagaauuuuguuuauauauauauauauauauucaugguguuauucuucacca

SEQ ID NO: 756229 - RNA, 64 nt, Homo Sapiens
uuuuuuuuuuuuuuuagaaucauguuuauauauauauauauauacucaugguguuauucuucac

SEQ ID NO: 756230 - RNA, 64 nt, Homo Sapiens
uauuuuuuuuuuuuuuuagaaccauguuuauauauauauauauaaccucaugguguuauucuuc

SEQ ID NO: 756231 - RNA, 64 nt, Homo Sapiens
uauauuuuuuuuuuuuuuuaucaccauguuuauauauauauauaacaccucaugguguuauucu

SEQ ID NO: 756232 - RNA, 64 nt, Homo Sapiens
uauauauuuuuuuuuuuuuucuucaccauguuuauauauauauauaacaccucaugguguuauu

SEQ ID NO: 756233 - RNA, 64 nt, Homo Sapiens
uauauauauuuuuuuuuuuuuucuucaccauguuuauauauauacuuaacaccucaugguguua

SEQ ID NO: 756234 - RNA, 64 nt, Homo Sapiens
uaauuaugugucuuuaaaauaguuugaagcauuauauauauaaguuaaugauaauuaauaaagu

SEQ ID NO: 756235 - RNA, 64 nt, Homo Sapiens
aguaauuaugugucuuuaaaguaguuugaagcauuauauauauagauuaaugauaauuaauaaa

SEQ ID NO: 756236 - RNA, 64 nt, Homo Sapiens
cauguaucuuguauauaaaauauguacaugaauauauauauauuguuuauauuuuauauacaca

SEQ ID NO: 756237 - RNA, 64 nt, Homo Sapiens
uucauguaucuuguauauaacauauguacaugaauauauauauacaguuuauauuuuauauaca

SEQ ID NO: 756238 - RNA, 61 nt, Homo Sapiens
acaggcuuguaaaggacugaacaugguuauuuauauauauagauaucuguauauacacaca

SEQ ID NO: 756239 - RNA, 63 nt, Homo Sapiens
acaggcuuguaaaggacugaacaugguuauuuauauauauagauaucuguauauacacacaca

SEQ ID NO: 756240 - RNA, 64 nt, Homo Sapiens
aauuaagacagaaccaaaugagcuaaguugcaaauauauauauauacacacacacacauauaug

SEQ ID NO: 756241 - RNA, 64 nt, Homo Sapiens
uuaagacagaaccaaaugagcuaaguugcaaauauauauauauacacacacacacauauaugua

SEQ ID NO: 756242 - RNA, 64 nt, Homo Sapiens
aagacagaaccaaaugagcuaaguugcaaauauauauauauacacacacacacauauauguaca

SEQ ID NO: 756243 - RNA, 64 nt, Homo Sapiens
aauuaaauacuauaugaaacuugugccacagagcuauauauaauaugaaaagauuaacuucaua

SEQ ID NO: 756244 - RNA, 64 nt, Homo Sapiens
uaggacaauacauuauauuaaaauggucucucucuauauauaucuguauaucuuauacaugucc

SEQ ID NO: 756245 - RNA, 64 nt, Homo Sapiens
uacauacauaagcauauauguguguguguguguguauauauauauauaugcaugcugugaaacu

SEQ ID NO: 756246 - RNA, 64 nt, Homo Sapiens
cauacauaagcauauauguguguguguguguguauauauauauauaugcaugcugugaaacuug

SEQ ID NO: 756247 - RNA, 64 nt, Homo Sapiens
uacauaagcauauauguguguguguguguguauauauauauauaugcaugcugugaaacuugac

SEQ ID NO: 756248 - RNA, 64 nt, Homo Sapiens
cauaagcauauauguguguguguguguguauauauauauauaugcaugcugugaaacuugacua

SEQ ID NO: 756249 - RNA, 64 nt, Homo Sapiens
ucuucugcguuaccagguguguguguacauauaauauauauauauauauauuauaaauaucaaa

SEQ ID NO: 756250 - RNA, 64 nt, Homo Sapiens
uucugcguuaccagguguguguguacauauaauauauauauauauauauuauaaauaucaaaga

SEQ ID NO: 756251 - RNA, 64 nt, Homo Sapiens
cugcguuaccagguguguguguacauauaauauauauauauauauauuauaaauaucaaagaaa

SEQ ID NO: 756252 - RNA, 64 nt, Homo Sapiens
gcguuaccagguguguguguacauauaauauauauauauauauauuauaaauaucaaagaaauu

SEQ ID NO: 756253 - RNA, 64 nt, Homo Sapiens
guuaccagguguguguguacauauaauauauauauauauauauuauaaauaucaaagaaauuau

SEQ ID NO: 756254 - RNA, 64 nt, Homo Sapiens
gauuguaagaaaacuuuaauuaaaaauuaaagacuauauauaauuaaacuacucugcccuggac

SEQ ID NO: 756255 - RNA, 64 nt, Homo Sapiens
auaaauaaaaaaauaaauaaaaauaaaaauagacuauauauagucuuugaauucauuuauuuua

SEQ ID NO: 756256 - RNA, 64 nt, Homo Sapiens
uuccuaaauaaaugaggaguagcauaguuuaaaauauauauaucuuauaacuuucuacaacaaa

SEQ ID NO: 756257 - RNA, 64 nt, Homo Sapiens
uauauguauaucaaaacauguaguacacccuaaauauauauaauuuuuauuugucaaauauacc

SEQ ID NO: 756258 - RNA, 64 nt, Homo Sapiens
ggggcgaaaaaccacaaaggaaaggaagaaaauuuauauauauauaauauaaaaucacuuggug

SEQ ID NO: 756259 - RNA, 64 nt, Homo Sapiens
ggcgaaaaaccacaaaggaaaggaagaaaauuuauauauauauaauauaaaaucacuuggugau

SEQ ID NO: 756260 - RNA, 64 nt, Homo Sapiens
cgaaaaaccacaaaggaaaggaagaaaauuuauauauauauaauauaaaaucacuuggugauua

SEQ ID NO: 756261 - RNA, 64 nt, Homo Sapiens
uuaaaccaguguauuuuuuuagaacugguuuguguauauauauagugauuauggauacuaauuc

SEQ ID NO: 756262 - RNA, 64 nt, Homo Sapiens
aaaccaguguauuuuuuuagaacugguuuguguauauauauagugauuauggauacuaauucaa

SEQ ID NO: 756263 - RNA, 64 nt, Homo Sapiens
cuguuggaucuagaaggugaagaauuuuuuuauguauauauagacauaucuauauaaauugucu

SEQ ID NO: 756264 - RNA, 64 nt, Homo Sapiens
aauuuuaaagauaaaauaggacauauuuugcagauauauauauauauauacacaaacacaucuc

SEQ ID NO: 756265 - RNA, 64 nt, Homo Sapiens
uuuuaaagauaaaauaggacauauuuugcagauauauauauauauauacacaaacacaucucca

SEQ ID NO: 756266 - RNA, 64 nt, Homo Sapiens
uuaaagauaaaauaggacauauuuugcagauauauauauauauauacacaaacacaucuccagg

SEQ ID NO: 756267 - RNA, 64 nt, Homo Sapiens
aaagauaaaauaggacauauuuugcagauauauauauauauauacacaaacacaucuccaggua

SEQ ID NO: 756268 - RNA, 64 nt, Homo Sapiens
agauaaaauaggacauauuuugcagauauauauauauauauacacaaacacaucuccagguaua

SEQ ID NO: 756269 - RNA, 64 nt, Homo Sapiens
aaagaaaauauaauuuaacuuuaaagauguaaauuauauauauaguauauuauauauauuuuua

SEQ ID NO: 756270 - RNA, 64 nt, Homo Sapiens
agaaaauauaauuuaacuuuaaagauguaaauuauauauauaguauauuauauauauuuuuaaa

SEQ ID NO: 756271 - RNA, 64 nt, Homo Sapiens
aacuuuaaagauguaaauuauauauauaguauauuauauauauuuuuaaagcuuuauaugccuc

SEQ ID NO: 756272 - RNA, 64 nt, Homo Sapiens
gcacaccuuuaaucucuauauggcagcauauacauauauauauauaaaaugcacacuuuuaauc

SEQ ID NO: 756273 - RNA, 64 nt, Homo Sapiens
acaccuuuaaucucuauauggcagcauauacauauauauauauaaaaugcacacuuuuaaucuc

SEQ ID NO: 756274 - RNA, 64 nt, Homo Sapiens
accuuuaaucucuauauggcagcauauacauauauauauauaaaaugcacacuuuuaaucucua

SEQ ID NO: 756275 - RNA, 64 nt, Homo Sapiens
uuuuguaguguucuguauuuaucugcacuuuguguauauauacacacauacauaugccaacaug

SEQ ID NO: 756276 - RNA, 64 nt, Homo Sapiens
auauuagagaauucuuuaaugcacacuugucaaauauauauauauaguaccaauguuaccuuuu

SEQ ID NO: 756277 - RNA, 64 nt, Homo Sapiens
auuagagaauucuuuaaugcacacuugucaaauauauauauauaguaccaauguuaccuuuuua

SEQ ID NO: 756278 - RNA, 64 nt, Homo Sapiens
uagagaauucuuuaaugcacacuugucaaauauauauauauaguaccaauguuaccuuuuuauu

SEQ ID NO: 756279 - RNA, 64 nt, Homo Sapiens
ggcuaugcuuccuuugaugacauauauuauacaguauauauauacauauauuuuuuuuguuaga

SEQ ID NO: 756280 - RNA, 64 nt, Homo Sapiens
cuaugcuuccuuugaugacauauauuauacaguauauauauacauauauuuuuuuuguuagagu

SEQ ID NO: 756281 - RNA, 64 nt, Homo Sapiens
cccccuugugguuaauuauuaucuaaggaguauauauauauaugaaacuagucuuucugcugga

SEQ ID NO: 756282 - RNA, 64 nt, Homo Sapiens
ugcccccuugugguuaauuagaaucuaaggaguauauauauauauaaaacuagucuuucugcug

SEQ ID NO: 756283 - RNA, 64 nt, Homo Sapiens
uaugcccccuugugguuaauuggaaucuaaggaguauauauauacuuaaaacuagucuuucugc

SEQ ID NO: 756284 - RNA, 64 nt, Homo Sapiens
cacacacacacacacacacauuuucauacauauauauauauacaaaugugaaaucagauaguug

SEQ ID NO: 756285 - RNA, 64 nt, Homo Sapiens
cacacacacacacacacacauguuuucauacauauauauauauaucaaugugaaaucagauagu

SEQ ID NO: 756286 - RNA, 64 nt, Homo Sapiens
uacacacacacacacacacaguuguuuucauacauauauauauaguucaaugugaaaucagaua

SEQ ID NO: 756287 - RNA, 64 nt, Homo Sapiens
caaguuuguugacaccuacuuauauauauauauauauauauaaauguguguauguauguguaua

SEQ ID NO: 756288 - RNA, 64 nt, Homo Sapiens
aacaaguuuguugacaccuauauauauauauauauauauauauauguguguguauguaugugua

SEQ ID NO: 756289 - RNA, 64 nt, Homo Sapiens
uauauauauaaacaaguuuguauauauauauauauauauauauaacuguguguguauguaugug

SEQ ID NO: 756290 - RNA, 64 nt, Homo Sapiens
uauauauauauaaacaaguuuguauauauauauauauauauauaugacuguguguguauguaug

SEQ ID NO: 756291 - RNA, 64 nt, Homo Sapiens
uauauauauauauaaacaaguguguauauauauauauauauauaugugacuguguguguaugua

SEQ ID NO: 756292 - RNA, 64 nt, Homo Sapiens
uauauauauauauauaaacauauguguauauauauauauauauaaaugugacuguguguguaug

SEQ ID NO: 756293 - RNA, 64 nt, Homo Sapiens
uauauauauauauauauaaauguauguguauauauauauauauaggaaugugacugugugugua

SEQ ID NO: 756294 - RNA, 64 nt, Homo Sapiens
uauauauauauauauauauauauguauguguauauauauauauacuggaaugugacugugugug

SEQ ID NO: 756295 - RNA, 64 nt, Homo Sapiens
uauauauauauauauauauauguauguauguguauauauauauacacuggaaugugacugugug

SEQ ID NO: 756296 - RNA, 64 nt, Homo Sapiens
uauauauauauauauauauauguguauguauguguauauauauacacacuggaaugugacugug

SEQ ID NO: 756297 - RNA, 64 nt, Homo Sapiens
uucaguuuuuuugccuuauuaaacaaaacacaacuauauauauugguggaauaaagucacauga

SEQ ID NO: 756298 - RNA, 64 nt, Homo Sapiens
uagagaaaaaucuaauuuuuaaauaucuguauauuauauauaugcaccucuggaauaauguguu

SEQ ID NO: 756299 - RNA, 64 nt, Homo Sapiens
uuuuugcauugacugcugagcuuaagauuucauauauauauauugcaaagucaacaguauuugc

SEQ ID NO: 756300 - RNA, 64 nt, Homo Sapiens
uuuuuuugcauugacugcuggccuuaagauuucauauauauauagugcaaagucaacaguauuu

SEQ ID NO: 756301 - RNA, 64 nt, Homo Sapiens
aaaacaucagccuugggugguguguacauauauauauauauaacgaguagcaggccuuuguaug

SEQ ID NO: 756302 - RNA, 64 nt, Homo Sapiens
acaaaacaucagccuuggguuguguguacauauauauauauauaaagaguagcaggccuuugua

SEQ ID NO: 756303 - RNA, 64 nt, Homo Sapiens
uaacaaaacaucagccuugguauguguguacauauauauauauagaaagaguagcaggccuuug

SEQ ID NO: 756304 - RNA, 64 nt, Homo Sapiens
uauaacaaaacaucagccuuuguauguguguacauauauauauaaagaaagaguagcaggccuu

SEQ ID NO: 756305 - RNA, 64 nt, Homo Sapiens
gaucucuauuuuaaaacuaguaaauauauauguauauauauaaucuuuauauauuuuauauaua

SEQ ID NO: 756306 - RNA, 64 nt, Homo Sapiens
augaucucuauuuuaaaacuuauaaauauauauguauauauauacucuuuauauauuuuauaua

SEQ ID NO: 756307 - RNA, 64 nt, Homo Sapiens
uauauauguauauauauaaucuuuauauauuuuauauauauaaagguggcacuucucaauuccu

SEQ ID NO: 756308 - RNA, 64 nt, Homo Sapiens
aauauauauguauauauauacucuuuauauauuuuauauauauagggguggcacuucucaauuc

SEQ ID NO: 756309 - RNA, 64 nt, Homo Sapiens
ccaaaaguaguuggaaagauuacauauauauauauauauauaaauacugaauuauauauauaua

SEQ ID NO: 756310 - RNA, 64 nt, Homo Sapiens
aaccaaaaguaguuggaaaguauacauauauauauauauauauaccuacugaauuauauauaua

SEQ ID NO: 756311 - RNA, 64 nt, Homo Sapiens
uaaaccaaaaguaguuggaauauauacauauauauauauauauaugccuacugaauuauauaua

SEQ ID NO: 756312 - RNA, 64 nt, Homo Sapiens
uauaaaccaaaaguaguugguauauauacauauauauauauauaagugccuacugaauuauaua

SEQ ID NO: 756313 - RNA, 64 nt, Homo Sapiens
uauauaaaccaaaaguaguuuauauauauacauauauauauauauuagugccuacugaauuaua

SEQ ID NO: 756314 - RNA, 64 nt, Homo Sapiens
uauauauaaaccaaaaguaguauauauauauacauauauauauauuuuagugccuacugaauua

SEQ ID NO: 756315 - RNA, 64 nt, Homo Sapiens
uauauauauauauauauaaauacugaauuauauauauauauacacugcauggguuuuuagugcc

SEQ ID NO: 756316 - RNA, 64 nt, Homo Sapiens
cauauauauauauauauauaccuacugaauuauauauauauauaagcugcauggguuuuuagug

SEQ ID NO: 756317 - RNA, 64 nt, Homo Sapiens
uacauauauauauauauauaugccuacugaauuauauauauauagcagcugcauggguuuuuag

SEQ ID NO: 756318 - RNA, 64 nt, Homo Sapiens
uauacauauauauauauauaagugccuacugaauuauauauauaaugcagcugcauggguuuuu

SEQ ID NO: 756319 - RNA, 64 nt, Homo Sapiens
uuuuaaauaaaauaaauuuuuugggacuuauguauauauauaccuauguuuagaacuuuauauc

SEQ ID NO: 756320 - RNA, 64 nt, Homo Sapiens
ccuuuuaaauaaaauaaauuucuugggacuuauguauauauauaucuauguuuagaacuuuaua

SEQ ID NO: 756321 - RNA, 64 nt, Homo Sapiens
uuguucacauacccugaaggauucauuuauauuuuauauauaccgauccaagucuaaacacaaa

SEQ ID NO: 756322 - RNA, 64 nt, Homo Sapiens
uauauguagagaaaaauacucauaugcaaaacuauauauauaugaaaaaaaaaaaaccagcaua

SEQ ID NO: 756323 - RNA, 64 nt, Homo Sapiens
uguauauguagagaaaaauauacauaugcaaaacuauauauauaaaaaaaaaaaaaaaccagca

SEQ ID NO: 756324 - RNA, 64 nt, Homo Sapiens
uauauauucuauuacauuuugauagaucuauauauauauauaaaggaaagauggcaucaaaaaa

SEQ ID NO: 756325 - RNA, 64 nt, Homo Sapiens
aauauauauucuauuacauuaagauagaucuauauauauauauaauggaaagauggcaucaaaa

SEQ ID NO: 756326 - RNA, 64 nt, Homo Sapiens
uaaauauauauucuauuacaaaaagauagaucuauauauauauacuauggaaagauggcaucaa

SEQ ID NO: 756327 - RNA, 64 nt, Homo Sapiens
uauaaauauauauucuauuaaaaaaagauagaucuauauauauacccuauggaaagauggcauc

SEQ ID NO: 756328 - RNA, 64 nt, Homo Sapiens
cucuccucuuucagccucuuauauauaaaauauauauauauaugauauauuauauauauaauau

SEQ ID NO: 756329 - RNA, 64 nt, Homo Sapiens
ugcucuccucuuucagccucauauauauaaaauauauauauauaauauauauuauauauauaau

SEQ ID NO: 756330 - RNA, 64 nt, Homo Sapiens
uaugcucuccucuuucagccauauauauauaaaauauauauauaauauauauauuauauauaua

SEQ ID NO: 756331 - RNA, 64 nt, Homo Sapiens
auauauauauauaugcucucuuauauauauaauauauauauaaauauaauauauuauauauaua

SEQ ID NO: 756332 - RNA, 64 nt, Homo Sapiens
aaauauauauauauaugcucuauuauauauauaauauauauauaaauauaauauauuauauaua

SEQ ID NO: 756333 - RNA, 64 nt, Homo Sapiens
auauauauaaaauauauauauuauauauauauuauauauauaauauaauauauaauauaauaua

SEQ ID NO: 756334 - RNA, 64 nt, Homo Sapiens
auauauauauaaaauauauauauuauauauauauuauauauauaauauaauauauaauauaaua

SEQ ID NO: 756335 - RNA, 64 nt, Homo Sapiens
auauauauaauauauauauaaauauaauauauuauauauauauuauauuauauauauaauauau

SEQ ID NO: 756336 - RNA, 64 nt, Homo Sapiens
uuauauauauaauauauauaauaauauaauauauuauauauauaauauauuauauauauaauau

SEQ ID NO: 756337 - RNA, 64 nt, Homo Sapiens
auauaauauaauauauuauaguauauauauauuauauauauaauauauauaauauaauauaugu

SEQ ID NO: 756338 - RNA, 64 nt, Homo Sapiens
auauauaauauaauauauuaguguauauauauauuauauauauaauauauauaauauaauauau

SEQ ID NO: 756339 - RNA, 64 nt, Homo Sapiens
auauauauaauauauaauauauaauauauguguauauauauauuuauguguguauauauauaau

SEQ ID NO: 756340 - RNA, 64 nt, Homo Sapiens
uuauauauauaauauauaauauauaauauauguguauauauauauauauguguguauauauaua

SEQ ID NO: 756341 - RNA, 64 nt, Homo Sapiens
auaauauauguguauauauauauauauguguguauauauauaauuuguuucuccauauauauau

SEQ ID NO: 756342 - RNA, 64 nt, Homo Sapiens
auauaauauauguguauauaauuauauauguguguauauauauagauuguuucuccauauauau

SEQ ID NO: 756343 - RNA, 64 nt, Homo Sapiens
auauauguguguauauauauggauuguuucuccauauauauauuuuuauauugugcuauaaaaa

SEQ ID NO: 756344 - RNA, 64 nt, Homo Sapiens
gcacagauuugcauuucagagucauugagcaguauauauauaaagaauucuauugaguggcagu

SEQ ID NO: 756345 - RNA, 64 nt, Homo Sapiens
aagcacagauuugcauuucagugucauugagcaguauauauauaaggaauucuauugaguggca

SEQ ID NO: 756346 - RNA, 64 nt, Homo Sapiens
uuuuuuuggaugaagguugcuauauauauacauauauauauauuuuucuggguucauauauaua

SEQ ID NO: 756347 - RNA, 64 nt, Homo Sapiens
uuuuuuuuuggaugaagguuuauauauauauacauauauauauauuuuucuggguucauauaua

SEQ ID NO: 756348 - RNA, 64 nt, Homo Sapiens
uauauauauauuuuuuuuuguucauauauauauauauauauacaaaauaaguuuuuuuucuggg

SEQ ID NO: 756349 - RNA, 64 nt, Homo Sapiens
cauauauauauauuuuuuuugguucauauauauauauauauauaguaaauaaguuuuuuuucug

SEQ ID NO: 756350 - RNA, 64 nt, Homo Sapiens
uacauauauauauauuuuuuuggguucauauauauauauauauauuguaaauaaguuuuuuuuc

SEQ ID NO: 756351 - RNA, 64 nt, Homo Sapiens
uauacauauauauauauuuuucuggguucauauauauauauauacuuuguaaauaaguuuuuuu

SEQ ID NO: 756352 - RNA, 64 nt, Homo Sapiens
uauauacauauauauauauuuuucuggguucauauauauauauaaacuuuguaaauaaguuuuu

SEQ ID NO: 756353 - RNA, 64 nt, Homo Sapiens
uauauauacauauauauauauuuuucuggguucauauauauauaauaacuuuguaaauaaguuu

SEQ ID NO: 756354 - RNA, 64 nt, Homo Sapiens
aaaaauaaagcuuaauugucuauaugaaaauauauauauauauguauauauguauguauauaua

SEQ ID NO: 756355 - RNA, 64 nt, Homo Sapiens
ugaaaaauaaagcuuaauuguauauaugaaaauauauauauauauuuauauauguauguauaua

SEQ ID NO: 756356 - RNA, 64 nt, Homo Sapiens
uaugaaaaauaaagcuuaauuauauauaugaaaauauauauauaccuuuauauauguauguaua

SEQ ID NO: 756357 - RNA, 64 nt, Homo Sapiens
aaaauauauauauauaugaauauauguauguauauauauauauguuugcaaauuguuuccuuua

SEQ ID NO: 756358 - RNA, 64 nt, Homo Sapiens
ugaaaauauauauauauauguauauauguauguauauauauauaaauuugcaaauuguuuccuu

SEQ ID NO: 756359 - RNA, 64 nt, Homo Sapiens
uaugaaaauauauauauauauuuauauauguauguauauauauauaaauuugcaaauuguuucc

SEQ ID NO: 756360 - RNA, 64 nt, Homo Sapiens
uuugugaccuuuuuuguaaaggugacuacauauauauauauauuuuacaggaaccauaguucuu

SEQ ID NO: 756361 - RNA, 64 nt, Homo Sapiens
uuuuugugaccuuuuuuguauuggugacuacauauauauauauauuuuacaggaaccauaguuc

SEQ ID NO: 756362 - RNA, 64 nt, Homo Sapiens
uauuuuugugaccuuuuuugucuuggugacuacauauauauauauauuuuacaggaaccauagu

SEQ ID NO: 756363 - RNA, 64 nt, Homo Sapiens
ugugaaagaacuuuuagaacuuuuaauauuuaaauauauauauuuaaaaauccuagguagccua

SEQ ID NO: 756364 - RNA, 64 nt, Homo Sapiens
guaugccccuugccccuuccccacacuaauaauuuauauauauaaauaucuauaugacgcucuu

SEQ ID NO: 756365 - RNA, 64 nt, Homo Sapiens
augccccuugccccuuccccacacuaauaauuuauauauauaaauaucuauaugacgcucuuaa

SEQ ID NO: 756366 - RNA, 64 nt, Homo Sapiens
cugauguuguuuuccuauggaaauauauaucuauuauauauauauuuuuugcaaaucucacaaa

SEQ ID NO: 756367 - RNA, 64 nt, Homo Sapiens
gauguuguuuuccuauggaaauauauaucuauuauauauauauuuuuugcaaaucucacaaagu

SEQ ID NO: 756368 - RNA, 64 nt, Homo Sapiens
uagacuuuguguccauccccaagaucucucauuuuauauauauauauauauauauauauauaua

SEQ ID NO: 756369 - RNA, 64 nt, Homo Sapiens
gacuuuguguccauccccaagaucucucauuuuauauauauauauauauauauauauauauaua

SEQ ID NO: 756370 - RNA, 64 nt, Homo Sapiens
cuuuguguccauccccaagaucucucauuuuauauauauauauauauauauauauauauauaua

SEQ ID NO: 756371 - RNA, 64 nt, Homo Sapiens
uuguguccauccccaagaucucucauuuuauauauauauauauauauauauauauauauauaua

SEQ ID NO: 756372 - RNA, 64 nt, Homo Sapiens
guguccauccccaagaucucucauuuuauauauauauauauauauauauauauauauauauaua

SEQ ID NO: 756373 - RNA, 64 nt, Homo Sapiens
guccauccccaagaucucucauuuuauauauauauauauauauauauauauauauauauauaua

SEQ ID NO: 756374 - RNA, 64 nt, Homo Sapiens
ccauccccaagaucucucauuuuauauauauauauauauauauauauauauauauauauauaua

SEQ ID NO: 756375 - RNA, 64 nt, Homo Sapiens
auccccaagaucucucauuuuauauauauauauauauauauauauauauauauauauauauaua

SEQ ID NO: 756376 - RNA, 64 nt, Homo Sapiens
ccccaagaucucucauuuuauauauauauauauauauauauauauauauauauauauauauaua

SEQ ID NO: 756377 - RNA, 64 nt, Homo Sapiens
ccaagaucucucauuuuauauauauauauauauauauauauauauauauauauauauauauaua

SEQ ID NO: 756378 - RNA, 64 nt, Homo Sapiens
aagaucucucauuuuauauauauauauauauauauauauauauauauauauauauauauauaca

SEQ ID NO: 756379 - RNA, 64 nt, Homo Sapiens
gaucucucauuuuauauauauauauauauauauauauauauauauauauauauauauauacaca

SEQ ID NO: 756380 - RNA, 64 nt, Homo Sapiens
ucucucauuuuauauauauauauauauauauauauauauauauauauauauauauauacacaca

SEQ ID NO: 756381 - RNA, 64 nt, Homo Sapiens
ucucauuuuauauauauauauauauauauauauauauauauauauauauauauauacacacaca

SEQ ID NO: 756382 - RNA, 64 nt, Homo Sapiens
ucauuuuauauauauauauauauauauauauauauauauauauauauauauauacacacacaca

SEQ ID NO: 756383 - RNA, 64 nt, Homo Sapiens
auuuuauauauauauauauauauauauauauauauauauauauauauauauacacacacacaca

SEQ ID NO: 756384 - RNA, 64 nt, Homo Sapiens
uuuauauauauauauauauauauauauauauauauauauauauauauauacacacacacacaca

SEQ ID NO: 756385 - RNA, 64 nt, Homo Sapiens
uauauauauauauauauauauauauauauauauauauauauauauauacacacacacacacaua

SEQ ID NO: 756386 - RNA, 64 nt, Homo Sapiens
uauauauauauauauauauauauauauauauauauauauauauauacacacacacacacauaca

SEQ ID NO: 756387 - RNA, 64 nt, Homo Sapiens
uauauauauauauauauauauauauauauauauauauauauauacacacacacacacauacaca

SEQ ID NO: 756388 - RNA, 64 nt, Homo Sapiens
uauauauauauauauauauauauauauauauauauauauauacacacacacacacauacacaaa

SEQ ID NO: 756389 - RNA, 64 nt, Homo Sapiens
ccagauuucgauguuucuuaagucuaggugaauuuauauauauauuuuuuugcuuuucauuuuc

SEQ ID NO: 756390 - RNA, 64 nt, Homo Sapiens
agauuucgauguuucuuaagucuaggugaauuuauauauauauuuuuuugcuuuucauuuucua

SEQ ID NO: 756391 - RNA, 64 nt, Homo Sapiens
gugcuuuuguuucacacuugauuuguaaaaauuuuauauauauguauuuaaaaugugccauuuu

SEQ ID NO: 756392 - RNA, 64 nt, Homo Sapiens
cuggcuccacaauuuaguaacauuuauauuaagauauauauauaguggucacugugauauaaua

SEQ ID NO: 756393 - RNA, 64 nt, Homo Sapiens
ggcuccacaauuuaguaacauuuauauuaagauauauauauaguggucacugugauauaauaaa

SEQ ID NO: 756394 - RNA, 64 nt, Homo Sapiens
uguaauguuacagagagugugauuugguuugugauauauauauauugugcucuacuuuucucuu

SEQ ID NO: 756395 - RNA, 64 nt, Homo Sapiens
uaauguuacagagagugugauuugguuugugauauauauauauugugcucuacuuuucucuuua

SEQ ID NO: 756396 - RNA, 64 nt, Homo Sapiens
uuuuuaaaugcuggaggauuccaaucaauauaaauauauauauauauauacacacacauauaua

SEQ ID NO: 756397 - RNA, 64 nt, Homo Sapiens
uuuaaaugcuggaggauuccaaucaauauaaauauauauauauauauacacacacauauauaaa

SEQ ID NO: 756398 - RNA, 64 nt, Homo Sapiens
uaaaugcuggaggauuccaaucaauauaaauauauauauauauauacacacacauauauaaaaa

SEQ ID NO: 756399 - RNA, 64 nt, Homo Sapiens
aaugcuggaggauuccaaucaauauaaauauauauauauauauacacacacauauauaaaaagu

SEQ ID NO: 756400 - RNA, 64 nt, Homo Sapiens
ugcuggaggauuccaaucaauauaaauauauauauauauauacacacacauauauaaaaaguau

SEQ ID NO: 756401 - RNA, 64 nt, Homo Sapiens
gagaguguguguguguguauguguguguaauauuuauauauauucacaguauguauuuagcauu

SEQ ID NO: 756402 - RNA, 64 nt, Homo Sapiens
acugggguuaagucucugguauuuaggcuggcaauauauauauuaaccauauuuuaaaaguacc

SEQ ID NO: 756403 - RNA, 64 nt, Homo Sapiens
auccaccucugccuaaguaaaucugcucucaaccuauauauauacaaggucauucauucuagca

SEQ ID NO: 756404 - RNA, 64 nt, Homo Sapiens
ccaccucugccuaaguaaaucugcucucaaccuauauauauacaaggucauucauucuagcauu

SEQ ID NO: 756405 - RNA, 64 nt, Homo Sapiens
aauacuuuuuaacaaaaaacagauucuauauuauuauauauauauauauauauauaaagauaua

SEQ ID NO: 756406 - RNA, 64 nt, Homo Sapiens
uacuuuuuaacaaaaaacagauucuauauuauuauauauauauauauauauauaaagauauaua

SEQ ID NO: 756407 - RNA, 64 nt, Homo Sapiens
cuuuuuaacaaaaaacagauucuauauuauuauauauauauauauauauauaaagauauauaga

SEQ ID NO: 756408 - RNA, 64 nt, Homo Sapiens
uuuuaacaaaaaacagauucuauauuauuauauauauauauauauauauaaagauauauagaga

SEQ ID NO: 756409 - RNA, 64 nt, Homo Sapiens
uuaacaaaaaacagauucuauauuauuauauauauauauauauauauaaagauauauagagaug

SEQ ID NO: 756410 - RNA, 64 nt, Homo Sapiens
aacaaaaaacagauucuauauuauuauauauauauauauauauauaaagauauauagagaugca

SEQ ID NO: 756411 - RNA, 64 nt, Homo Sapiens
caaaaaacagauucuauauuauuauauauauauauauauauauaaagauauauagagaugcauu

SEQ ID NO: 756412 - RNA, 64 nt, Homo Sapiens
aaaaacagauucuauauuauuauauauauauauauauauauaaagauauauagagaugcauuca

SEQ ID NO: 756413 - RNA, 64 nt, Homo Sapiens
cacacacaaauugacucuuauuuauagaauuuaauauauauauauauauauauauauauagguu

SEQ ID NO: 756414 - RNA, 64 nt, Homo Sapiens
cacacaaauugacucuuauuuauagaauuuaauauauauauauauauauauauauauagguucu

SEQ ID NO: 756415 - RNA, 64 nt, Homo Sapiens
cacaaauugacucuuauuuauagaauuuaauauauauauauauauauauauauauagguucuuu

SEQ ID NO: 756416 - RNA, 64 nt, Homo Sapiens
caaauugacucuuauuuauagaauuuaauauauauauauauauauauauauauagguucuuuuc

SEQ ID NO: 756417 - RNA, 64 nt, Homo Sapiens
aauugacucuuauuuauagaauuuaauauauauauauauauauauauauauagguucuuuucuc

SEQ ID NO: 756418 - RNA, 64 nt, Homo Sapiens
uugacucuuauuuauagaauuuaauauauauauauauauauauauauauagguucuuuucucuc

SEQ ID NO: 756419 - RNA, 64 nt, Homo Sapiens
gacucuuauuuauagaauuuaauauauauauauauauauauauauauagguucuuuucucucuu

SEQ ID NO: 756420 - RNA, 64 nt, Homo Sapiens
cucuuauuuauagaauuuaauauauauauauauauauauauauauagguucuuuucucucuucc

SEQ ID NO: 756421 - RNA, 64 nt, Homo Sapiens
cuuauuuauagaauuuaauauauauauauauauauauauauauagguucuuuucucucuuccuc

SEQ ID NO: 756422 - RNA, 64 nt, Homo Sapiens
uauuuauagaauuuaauauauauauauauauauauauauauagguucuuuucucucuuccucuc

SEQ ID NO: 756423 - RNA, 64 nt, Homo Sapiens
gaaugguuuuaggcuccaguguuauacuuuuuuuuauauauauauauaaaaauaaacuuuacgu

SEQ ID NO: 756424 - RNA, 64 nt, Homo Sapiens
augguuuuaggcuccaguguuauacuuuuuuuuauauauauauauaaaaauaaacuuuacguag

SEQ ID NO: 756425 - RNA, 64 nt, Homo Sapiens
gguuuuaggcuccaguguuauacuuuuuuuuauauauauauauaaaaauaaacuuuacguagug

SEQ ID NO: 756426 - RNA, 64 nt, Homo Sapiens
uuuuaggcuccaguguuauacuuuuuuuuauauauauauauaaaaauaaacuuuacguagugaa

SEQ ID NO: 756427 - RNA, 64 nt, Homo Sapiens
uguguguguauauauguauguguguauguguguguauauauagauguauauauauacacacaca

SEQ ID NO: 756428 - RNA, 64 nt, Homo Sapiens
uauguauguguguauguguguguauauauagauguauauauauacacacacagagauauauaca

SEQ ID NO: 756429 - RNA, 64 nt, Homo Sapiens
uguauguguguauguguguguauauauagauguauauauauacacacacagagauauauacaua

SEQ ID NO: 756430 - RNA, 64 nt, Homo Sapiens
uuaugucucagaugcuaacgugugaaaauauaaauauauauaauauauaaaguaaccagucuuc

SEQ ID NO: 756431 - RNA, 64 nt, Homo Sapiens
ggccaauggaacaguaagaacaucauaaaauuuuuauauauauaguuuauuuuugugggagaua

SEQ ID NO: 756432 - RNA, 64 nt, Homo Sapiens
ccaauggaacaguaagaacaucauaaaauuuuuauauauauaguuuauuuuugugggagauaaa

SEQ ID NO: 756433 - RNA, 64 nt, Homo Sapiens
acagagcaagacacugucucucucucucucuccauauauauauguguguguguguauauauaua

SEQ ID NO: 756434 - RNA, 64 nt, Homo Sapiens
ucucucucucuccauauauauauguguguguguguauauauauauauaugugugugugugugug

SEQ ID NO: 756435 - RNA, 64 nt, Homo Sapiens
ucucucucuccauauauauauguguguguguguauauauauauauaugugugugugugugugug

SEQ ID NO: 756436 - RNA, 64 nt, Homo Sapiens
ucucucuccauauauauauguguguguguguauauauauauauaugugugugugugugugugua

SEQ ID NO: 756437 - RNA, 64 nt, Homo Sapiens
ucucuccauauauauauguguguguguguauauauauauauauguguguguguguguguguaua

SEQ ID NO: 756438 - RNA, 64 nt, Homo Sapiens
cacauauauacacacacacauacauauacauguguauauauauaccaucccauauauauguggg

SEQ ID NO: 756439 - RNA, 64 nt, Homo Sapiens
cauauauacacacacacauacauauacauguguauauauauaccaucccauauauaugugggau

SEQ ID NO: 756440 - RNA, 64 nt, Homo Sapiens
guguauauauauaccaucccauauauaugugggauauauauauauauauauauggauaugguua

SEQ ID NO: 756441 - RNA, 64 nt, Homo Sapiens
guauauauauaccaucccauauauaugugggauauauauauauauauauauggauaugguuaua

SEQ ID NO: 756442 - RNA, 64 nt, Homo Sapiens
auauauauaccaucccauauauaugugggauauauauauauauauauauggauaugguuauaua

SEQ ID NO: 756443 - RNA, 64 nt, Homo Sapiens
auauauaccaucccauauauaugugggauauauauauauauauauauggauaugguuauauaua

SEQ ID NO: 756444 - RNA, 64 nt, Homo Sapiens
auauaccaucccauauauaugugggauauauauauauauauauauggauaugguuauauauaug

SEQ ID NO: 756445 - RNA, 64 nt, Homo Sapiens
auaccaucccauauauaugugggauauauauauauauauauauggauaugguuauauauauggg

SEQ ID NO: 756446 - RNA, 64 nt, Homo Sapiens
gugggauauauauauauauauauauggauaugguuauauauaugggaugguuugguugguccca

SEQ ID NO: 756447 - RNA, 64 nt, Homo Sapiens
auugauugaggguagcuuguugcaaugcuuaacuuauauauacauauauauauauuauaaauau

SEQ ID NO: 756448 - RNA, 64 nt, Homo Sapiens
gguagcuuguugcaaugcuuaacuuauauauacauauauauauauuauaaauauugcucaucaa

SEQ ID NO: 756449 - RNA, 64 nt, Homo Sapiens
uagcuuguugcaaugcuuaacuuauauauacauauauauauauuauaaauauugcucaucaaaa

SEQ ID NO: 756450 - RNA, 64 nt, Homo Sapiens
cuaguaaaucacagugguucaaaauauauauccauauauauauauauccauauauauaucucau

SEQ ID NO: 756451 - RNA, 64 nt, Homo Sapiens
aguaaaucacagugguucaaaauauauauccauauauauauauauccauauauauaucucaugu

SEQ ID NO: 756452 - RNA, 64 nt, Homo Sapiens
uaaaucacagugguucaaaauauauauccauauauauauauauccauauauauaucucauguca

SEQ ID NO: 756453 - RNA, 64 nt, Homo Sapiens
guucaaaauauauauccauauauauauauauccauauauauaucucaugucaucacauuacagg

SEQ ID NO: 756454 - RNA, 64 nt, Homo Sapiens
auucauaaugauaaaauaauaaaaugcgaauuacuauauauaaugugccucacucaugagaaag

SEQ ID NO: 756455 - RNA, 64 nt, Homo Sapiens
caguggcuaaaguugaaaagggguugguuuccuguauauauauguauguauauacacacguaca

SEQ ID NO: 756456 - RNA, 64 nt, Homo Sapiens
uauauguauguauauacacacguacauacauucauauauauacauauauacauaaugugcuuaa

SEQ ID NO: 756457 - RNA, 64 nt, Homo Sapiens
agaaccaauuguuguacauaaaacagauugcgcauauauauauauguauaaaaaauaauaaaau

SEQ ID NO: 756458 - RNA, 64 nt, Homo Sapiens
aaccaauuguuguacauaaaacagauugcgcauauauauauauguauaaaaaauaauaaaauaa

SEQ ID NO: 756459 - RNA, 64 nt, Homo Sapiens
aaaguuuuaguuuuuuaagaaguacucaugcagauauauauauauauauuuuucccaguccuuu

SEQ ID NO: 756460 - RNA, 64 nt, Homo Sapiens
aguuuuaguuuuuuaagaaguacucaugcagauauauauauauauauuuuucccaguccuuuuu

SEQ ID NO: 756461 - RNA, 64 nt, Homo Sapiens
uuuuaguuuuuuaagaaguacucaugcagauauauauauauauauuuuucccaguccuuuuuuu

SEQ ID NO: 756462 - RNA, 64 nt, Homo Sapiens
uuaguuuuuuaagaaguacucaugcagauauauauauauauauuuuucccaguccuuuuuuuaa

SEQ ID NO: 756463 - RNA, 64 nt, Homo Sapiens
auuucagccaaauaaaugggccaagggaaaaaaauauauauauauagacaggacuagagaaaac

SEQ ID NO: 756464 - RNA, 64 nt, Homo Sapiens
uucagccaaauaaaugggccaagggaaaaaaauauauauauauagacaggacuagagaaaaccu

SEQ ID NO: 756465 - RNA, 64 nt, Homo Sapiens
cagccaaauaaaugggccaagggaaaaaaauauauauauauagacaggacuagagaaaaccuau

SEQ ID NO: 756466 - RNA, 64 nt, Homo Sapiens
uugauauggccaaagggagagaggccuuuuaaaauauauauauauauacacauauauauguaua

SEQ ID NO: 756467 - RNA, 64 nt, Homo Sapiens
gauauggccaaagggagagaggccuuuuaaaauauauauauauauacacauauauauguauaua

SEQ ID NO: 756468 - RNA, 64 nt, Homo Sapiens
uauggccaaagggagagaggccuuuuaaaauauauauauauauacacauauauauguauauaua

SEQ ID NO: 756469 - RNA, 64 nt, Homo Sapiens
uggccaaagggagagaggccuuuuaaaauauauauauauauacacauauauauguauauauaca

SEQ ID NO: 756470 - RNA, 64 nt, Homo Sapiens
uuuuaaaauauauauauauauacacauauauauguauauauacacauauauguauguauacaca

SEQ ID NO: 756471 - RNA, 64 nt, Homo Sapiens
uacacauauauguauguauacacauauacacauguauauauacauguguguauguauacaugua

SEQ ID NO: 756472 - RNA, 64 nt, Homo Sapiens
cacauguauauauacauguguguauguauacauguauauauauauacauacacauauauguaua

SEQ ID NO: 756473 - RNA, 64 nt, Homo Sapiens
cauguauauauacauguguguauguauacauguauauauauauacauacacauauauguauaca

SEQ ID NO: 756474 - RNA, 64 nt, Homo Sapiens
uguauauauacauguguguauguauacauguauauauauauacauacacauauauguauacaua

SEQ ID NO: 756475 - RNA, 64 nt, Homo Sapiens
cauauauguauacauauauacacauauguauacauauauauauauucuacaguaaaacuguaga

SEQ ID NO: 756476 - RNA, 64 nt, Homo Sapiens
uauauguauacauauauacacauauguauacauauauauauauucuacaguaaaacuguagacu

SEQ ID NO: 756477 - RNA, 64 nt, Homo Sapiens
ucaugaugggucacauauagacauauguacauauuauauauauauauauauauauauauauaua

SEQ ID NO: 756478 - RNA, 64 nt, Homo Sapiens
augaugggucacauauagacauauguacauauuauauauauauauauauauauauauauauaua

SEQ ID NO: 756479 - RNA, 64 nt, Homo Sapiens
gaugggucacauauagacauauguacauauuauauauauauauauauauauauauauauauaua

SEQ ID NO: 756480 - RNA, 64 nt, Homo Sapiens
ugggucacauauagacauauguacauauuauauauauauauauauauauauauauauauauaua

SEQ ID NO: 756481 - RNA, 64 nt, Homo Sapiens
ggucacauauagacauauguacauauuauauauauauauauauauauauauauauauauauaua

SEQ ID NO: 756482 - RNA, 64 nt, Homo Sapiens
ucacauauagacauauguacauauuauauauauauauauauauauauauauauauauauauaua

SEQ ID NO: 756483 - RNA, 64 nt, Homo Sapiens
acauauagacauauguacauauuauauauauauauauauauauauauauauauauauauauaua

SEQ ID NO: 756484 - RNA, 64 nt, Homo Sapiens
auauagacauauguacauauuauauauauauauauauauauauauauauauauauauauauaua

SEQ ID NO: 756485 - RNA, 64 nt, Homo Sapiens
auagacauauguacauauuauauauauauauauauauauauauauauauauauauauauauaua

SEQ ID NO: 756486 - RNA, 64 nt, Homo Sapiens
agacauauguacauauuauauauauauauauauauauauauauauauauauauauauauauaua

SEQ ID NO: 756487 - RNA, 64 nt, Homo Sapiens
acauauguacauauuauauauauauauauauauauauauauauauauauauauauauauauaag

SEQ ID NO: 756488 - RNA, 64 nt, Homo Sapiens
auauguacauauuauauauauauauauauauauauauauauauauauauauauauauauaagcu

SEQ ID NO: 756489 - RNA, 64 nt, Homo Sapiens
auguacauauuauauauauauauauauauauauauauauauauauauauauauauauaagcucu

SEQ ID NO: 756490 - RNA, 64 nt, Homo Sapiens
guacauauuauauauauauauauauauauauauauauauauauauauauauauauaagcucuuu

SEQ ID NO: 756491 - RNA, 64 nt, Homo Sapiens
acauauuauauauauauauauauauauauauauauauauauauauauauauauaagcucuuuuu

SEQ ID NO: 756492 - RNA, 64 nt, Homo Sapiens
auauuauauauauauauauauauauauauauauauauauauauauauauauaagcucuuuuuuc

SEQ ID NO: 756493 - RNA, 64 nt, Homo Sapiens
auuauauauauauauauauauauauauauauauauauauauauauauauaagcucuuuuuucug

SEQ ID NO: 756494 - RNA, 64 nt, Homo Sapiens
uauauauauauauauauauauauauauauauauauauauauauauauaagcucuuuuuucugag

SEQ ID NO: 756495 - RNA, 64 nt, Homo Sapiens
uauauauauauauauauauauauauauauauauauauauauauauaagcucuuuuuucugaggc

SEQ ID NO: 756496 - RNA, 64 nt, Homo Sapiens
uauauauauauauauauauauauauauauauauauauauauauaagcucuuuuuucugaggcua

SEQ ID NO: 756497 - RNA, 64 nt, Homo Sapiens
uauauauauauauauauauauauauauauauauauauauauaagcucuuuuuucugaggcuauu

SEQ ID NO: 756498 - RNA, 64 nt, Homo Sapiens
acuuuauuuuuuaauguaacuuguucuaucuaucuauauauauauuugauaguuuguggaauaa

SEQ ID NO: 756499 - RNA, 64 nt, Homo Sapiens
uuuauuuuuuaauguaacuuguucuaucuaucuauauauauauuugauaguuuguggaauaaua

SEQ ID NO: 756500 - RNA, 64 nt, Homo Sapiens
gcuuaucugaaaugcuugaaaacaaaauagaauauauauauauuagcaaaucguauaccuuauu

SEQ ID NO: 756501 - RNA, 64 nt, Homo Sapiens
uugcuuaucugaaaugcuuguuaacaaaauagaauauauauauaaaagcaaaucguauaccuua

SEQ ID NO: 756502 - RNA, 64 nt, Homo Sapiens
gaugauauguauuacugagaauauaagaugaugauauauauaaucagggguauuauauauauac

SEQ ID NO: 756503 - RNA, 64 nt, Homo Sapiens
uauaagaugaugauauauauguacagggguauuauauauauacaacauguguacauauaucuau

SEQ ID NO: 756504 - RNA, 64 nt, Homo Sapiens
cauauaagaugaugauauauauguacagggguauuauauauauaauacauguguacauauaucu

SEQ ID NO: 756505 - RNA, 64 nt, Homo Sapiens
uauauuauacucacucaucauauauauaaauauauauauauaaaucagaugccggacacggauu

SEQ ID NO: 756506 - RNA, 64 nt, Homo Sapiens
aauauauuauacucacucauuuuauauauaaauauauauauauaagucagaugccggacacgga

SEQ ID NO: 756507 - RNA, 64 nt, Homo Sapiens
uaaauauauuauacucacucgauuuauauauaaauauauauauaacagucagaugccggacacg

SEQ ID NO: 756508 - RNA, 64 nt, Homo Sapiens
uauauauauauaaauauauugccggacacggauuuauauauaaaccuaggugccacagucagau

SEQ ID NO: 756509 - RNA, 64 nt, Homo Sapiens
uauauuuauauguguaugucaggcaaaaaauauauauauauaccauaugaguuucucccugcca

SEQ ID NO: 756510 - RNA, 64 nt, Homo Sapiens
ccuauauuuauauguguaugcaaggcaaaaaauauauauauauaugauaugaguuucucccugc

SEQ ID NO: 756511 - RNA, 64 nt, Homo Sapiens
uaccuauauuuauauguguagccaaggcaaaaaauauauauauaaaugauaugaguuucucccu

SEQ ID NO: 756512 - RNA, 64 nt, Homo Sapiens
cuuaguucuaagauuuccuuauauauauauauauuauauauauugcaaaaguccaucuuaagaa

SEQ ID NO: 756513 - RNA, 64 nt, Homo Sapiens
auauauauucuuaguucuaaucuuaagaaauauauauauauauugugacaaaagcaaaagucca

SEQ ID NO: 756514 - RNA, 64 nt, Homo Sapiens
uuauauauauucuuaguucucaucuuaagaaauauauauauauagggugacaaaagcaaaaguc

SEQ ID NO: 756515 - RNA, 64 nt, Homo Sapiens
uauuauauauauucuuaguuuccaucuuaagaaauauauauauacugggugacaaaagcaaaag

SEQ ID NO: 756516 - RNA, 64 nt, Homo Sapiens
uauauuuaaaaagugaauauugaauauacauauauauauauaugcucaucucuaugaaaaaauu

SEQ ID NO: 756517 - RNA, 64 nt, Homo Sapiens
uguauauuuaaaaagugaauuuugaauauacauauauauauauaagcucaucucuaugaaaaaa

SEQ ID NO: 756518 - RNA, 64 nt, Homo Sapiens
uauguauauuuaaaaagugaaauuugaauauacauauauauauaaaagcucaucucuaugaaaa

SEQ ID NO: 756519 - RNA, 64 nt, Homo Sapiens
uauguauaaaauuucacaggcauacauauauauauauauauauguauauacauauauauauaca

SEQ ID NO: 756520 - RNA, 64 nt, Homo Sapiens
uguauguauaaaauuucacacacauacauauauauauauauauauauauauacauauauauaua

SEQ ID NO: 756521 - RNA, 64 nt, Homo Sapiens
uauguauguauaaaauuucauacacauacauauauauauauauauauauauauacauauauaua

SEQ ID NO: 756522 - RNA, 64 nt, Homo Sapiens
uauauguauguauaaaauuuuauacacauacauauauauauauacauauauauauacauauaua

SEQ ID NO: 756523 - RNA, 64 nt, Homo Sapiens
uauauauguauguauaaaauuauauacacauacauauauauauauucauauauauauacauaua

SEQ ID NO: 756524 - RNA, 64 nt, Homo Sapiens
cauacauauauauauauauauauauauauacauauauauauacaucuaaccacagagaauuuca

SEQ ID NO: 756525 - RNA, 64 nt, Homo Sapiens
cacauacauauauauauauacauauauauauacauauauauauauuucuaaccacagagaauuu

SEQ ID NO: 756526 - RNA, 64 nt, Homo Sapiens
uauauauauacacauacauacagagaauuucauauauauauacauuuaaauauguuucuaacca

SEQ ID NO: 756527 - RNA, 64 nt, Homo Sapiens
cauauauauauacacauacacacagagaauuucauauauauauaaguuuaaauauguuucuaac

SEQ ID NO: 756528 - RNA, 64 nt, Homo Sapiens
cgccacauaaucaacagaaauauauacauauauauauauauaugauauuuauauaaauuauaua

SEQ ID NO: 756529 - RNA, 64 nt, Homo Sapiens
ugcgccacauaaucaacagauauauauacauauauauauauauaaaauauuuauauaaauuaua

SEQ ID NO: 756530 - RNA, 64 nt, Homo Sapiens
uaugcgccacauaaucaacauauauauauacauauauauauauaagaaauauuuauauaaauua

SEQ ID NO: 756531 - RNA, 64 nt, Homo Sapiens
uauaugcgccacauaaucaauauauauauauacauauauauauaagagaaauauuuauauaaau

SEQ ID NO: 756532 - RNA, 64 nt, Homo Sapiens
uauauauauauauaugcgccuuauauaaauuauauauauauacaccuuguacauagagaaauau

SEQ ID NO: 756533 - RNA, 64 nt, Homo Sapiens
cauauauauauauauaugcgauuuauauaaauuauauauauauauuccuuguacauagagaaau

SEQ ID NO: 756534 - RNA, 64 nt, Homo Sapiens
uacauauauauauauauaugauauuuauauaaauuauauauauauauuccuuguacauagagaa

SEQ ID NO: 756535 - RNA, 64 nt, Homo Sapiens
agggagaacgccucacccaguaaauauauauauauauauauaugagcuugcccagauacauacc

SEQ ID NO: 756536 - RNA, 64 nt, Homo Sapiens
ugagggagaacgccucacccccuaaauauauauauauauauauaucagcuugcccagauacaua

SEQ ID NO: 756537 - RNA, 64 nt, Homo Sapiens
uaugagggagaacgccucacuaccuaaauauauauauauauauaccucagcuugcccagauaca

SEQ ID NO: 756538 - RNA, 64 nt, Homo Sapiens
uauaugagggagaacgccuccauaccuaaauauauauauauauaggccucagcuugcccagaua

SEQ ID NO: 756539 - RNA, 64 nt, Homo Sapiens
uauauaugagggagaacgccuacauaccuaaauauauauauauaugggccucagcuugcccaga

SEQ ID NO: 756540 - RNA, 64 nt, Homo Sapiens
uauauauaugagggagaacggauacauaccuaaauauauauauaccugggccucagcuugccca

SEQ ID NO: 756541 - RNA, 64 nt, Homo Sapiens
gcuuuguuaauuuguuuuuagacuugcaaauauauauauauauuuuuuucucugaaguccugug

SEQ ID NO: 756542 - RNA, 64 nt, Homo Sapiens
uugcuuuguuaauuuguuuuuggacuugcaaauauauauauauauuuuuuucucugaaguccug

SEQ ID NO: 756543 - RNA, 64 nt, Homo Sapiens
uauugcuuuguuaauuuguuuguggacuugcaaauauauauauaccuuuuuuucucugaagucc

SEQ ID NO: 756544 - RNA, 64 nt, Homo Sapiens
uuagucccugccucucaagaaaaaaauauauauauauauauaucauguucuauagaaaagaaaa

SEQ ID NO: 756545 - RNA, 64 nt, Homo Sapiens
ucuuagucccugccucucaaaaaaaaaauauauauauauauauauaauguucuauagaaaagaa

SEQ ID NO: 756546 - RNA, 64 nt, Homo Sapiens
uaucuuagucccugccucucaaaaaaaaaauauauauauauauaaauaauguucuauagaaaag

SEQ ID NO: 756547 - RNA, 64 nt, Homo Sapiens
uauaucuuagucccugccucagaaaaaaaaaauauauauauauaucaauaauguucuauagaaa

SEQ ID NO: 756548 - RNA, 64 nt, Homo Sapiens
uauauaucuuagucccugccaaagaaaaaaaaaauauauauauauaucaauaauguucuauaga

SEQ ID NO: 756549 - RNA, 64 nt, Homo Sapiens
agaaacaaagguuuuuaauggagauauguauguguauauauaaaaguaaaaauaacuauguuuu

SEQ ID NO: 756550 - RNA, 64 nt, Homo Sapiens
accacugcuuaucuguaucuaaaagcugcaaggauauauauaagaauauguauguccgaaggga

SEQ ID NO: 756551 - RNA, 64 nt, Homo Sapiens
uuagcaccugagcuaagguuaaugcacauagauuuauauauaaauguaagucaaaauugaaaug

SEQ ID NO: 756552 - RNA, 64 nt, Homo Sapiens
cuuacaugaguaaaaagcacaaaaaauauauauauauauauauucuauaaauuguguacaguua

SEQ ID NO: 756553 - RNA, 64 nt, Homo Sapiens
uucuuacaugaguaaaaagcuaaaaaaauauauauauauauauauacuauaaauuguguacagu

SEQ ID NO: 756554 - RNA, 64 nt, Homo Sapiens
uauucuuacaugaguaaaaaguuaaaaaaauauauauauauauauguacuauaaauuguguaca

SEQ ID NO: 756555 - RNA, 64 nt, Homo Sapiens
uauauucuuacaugaguaaacaguuaaaaaaauauauauauauacauguacuauaaauugugua

SEQ ID NO: 756556 - RNA, 64 nt, Homo Sapiens
uauauauucuuacaugaguauacaguuaaaaaaauauauauauacucauguacuauaaauugug

SEQ ID NO: 756557 - RNA, 64 nt, Homo Sapiens
acuugaaaauuaagauuuaauauauauauacacauauauauauggugagucauauauauacaua

SEQ ID NO: 756558 - RNA, 64 nt, Homo Sapiens
cauauauauaugacuugaaauauauauacauauauauauauacauucauugguuuugugaguca

SEQ ID NO: 756559 - RNA, 64 nt, Homo Sapiens
cacauauauauaugacuugacauauauauacauauauauauauaauuucauugguuuugugagu

SEQ ID NO: 756560 - RNA, 64 nt, Homo Sapiens
uacacauauauauaugacuugucauauauauacauauauauauauuauuucauugguuuuguga

SEQ ID NO: 756561 - RNA, 64 nt, Homo Sapiens
uauauauauauacacauauagguuuugugagucauauauauacaaguaugauacuuauuucauu

SEQ ID NO: 756562 - RNA, 64 nt, Homo Sapiens
uuuccuucacugugucaaguucagugcggauuuauauauauauugguguucaaagacaucuccc

SEQ ID NO: 756563 - RNA, 64 nt, Homo Sapiens
uuuuuccuucacugugucaaccucagugcggauuuauauauauagagguguucaaagacaucuc

SEQ ID NO: 756564 - RNA, 64 nt, Homo Sapiens
aaaagaaaauaugaauauuauacauacagcucuauauauauaaaacagacaccccaaugcuauu

SEQ ID NO: 756565 - RNA, 64 nt, Homo Sapiens
aaaaaagaaaauaugaauauuuuacauacagcucuauauauauaaaacagacaccccaaugcua

SEQ ID NO: 756566 - RNA, 64 nt, Homo Sapiens
cacacacauagauauauaugcauacguacauauauauauauaaaacaagggcacgguuuuuaua

SEQ ID NO: 756567 - RNA, 64 nt, Homo Sapiens
aacacacacauagauauauauacauacguacauauauauauauagaacaagggcacgguuuuua

SEQ ID NO: 756568 - RNA, 64 nt, Homo Sapiens
uaaacacacacauagauauauauacauacguacauauauauauagugaacaagggcacgguuuu

SEQ ID NO: 756569 - RNA, 64 nt, Homo Sapiens
ggcuuucugcaucacccaaucaauaaaaaacaaauauauauauguauauauauguauguaugug

SEQ ID NO: 756570 - RNA, 64 nt, Homo Sapiens
aucacccaaucaauaaaaaacaaauauauauauguauauauauguauguauguguguguguaua

SEQ ID NO: 756571 - RNA, 64 nt, Homo Sapiens
uauauauguauauauauguauguauguguguguguauauauauauauauauauauauauauaaa

SEQ ID NO: 756572 - RNA, 64 nt, Homo Sapiens
uauauguauauauauguauguauguguguguguauauauauauauauauauauauauauaaaug

SEQ ID NO: 756573 - RNA, 64 nt, Homo Sapiens
uauguauauauauguauguauguguguguguauauauauauauauauauauauauauaaaugau

SEQ ID NO: 756574 - RNA, 64 nt, Homo Sapiens
uguauauauauguauguauguguguguguauauauauauauauauauauauauauaaaugauug

SEQ ID NO: 756575 - RNA, 64 nt, Homo Sapiens
uauauauauguauguauguguguguguauauauauauauauauauauauauauaaaugauugua

SEQ ID NO: 756576 - RNA, 64 nt, Homo Sapiens
uauauauguauguauguguguguguauauauauauauauauauauauauauaaaugauuguaag

SEQ ID NO: 756577 - RNA, 64 nt, Homo Sapiens
uauauguauguauguguguguguauauauauauauauauauauauauauaaaugauuguaaguu

SEQ ID NO: 756578 - RNA, 64 nt, Homo Sapiens
uauguauguauguguguguguauauauauauauauauauauauauauaaaugauuguaaguuga

SEQ ID NO: 756579 - RNA, 64 nt, Homo Sapiens
uguauguauguguguguguauauauauauauauauauauauauauaaaugauuguaaguugaaa

SEQ ID NO: 756580 - RNA, 64 nt, Homo Sapiens
uauguauguguguguguauauauauauauauauauauauauauaaaugauuguaaguugaaaac

SEQ ID NO: 756581 - RNA, 62 nt, Homo Sapiens
uguauguguguguguauauauauauauauauauauauauauaaaugauuguaaguugaaaac

SEQ ID NO: 756582 - RNA, 64 nt, Homo Sapiens
ccaaaaaaaaaaaaaaaaaaaaaaaaaaaaaaaauauauauauauauauacacacacacacaca

SEQ ID NO: 756583 - RNA, 64 nt, Homo Sapiens
aaaaaaaaaaaaaaaaaaaaaaaaaaaaaaaauauauauauauauauacacacacacacacaca

SEQ ID NO: 756584 - RNA, 64 nt, Homo Sapiens
aaaaaaaaaaaaaaaaaaaaaaaaaaaaaauauauauauauauauacacacacacacacacaua

SEQ ID NO: 756585 - RNA, 64 nt, Homo Sapiens
aaaaaaaaaaaaaaaaaaaaaaaaaaaauauauauauauauauacacacacacacacacauaug

SEQ ID NO: 756586 - RNA, 64 nt, Homo Sapiens
aaaaaaaaaaaaaaaaaaaaaaaaaauauauauauauauauacacacacacacacacauaugua

SEQ ID NO: 756587 - RNA, 64 nt, Homo Sapiens
uauacacacacacacacacauauguacacauacauauauauacauauauauguauauauagaac

SEQ ID NO: 756588 - RNA, 64 nt, Homo Sapiens
cauauguacacauacauauauauacauauauauguauauauagaacacauggcaagagcaggaa

SEQ ID NO: 756589 - RNA, 64 nt, Homo Sapiens
ccccucccaguaauaaaaaaaaaaaaaaaaaaaauauauauauauauauauauauauauauaua

SEQ ID NO: 756590 - RNA, 64 nt, Homo Sapiens
ccucccaguaauaaaaaaaaaaaaaaaaaaaauauauauauauauauauauauauauauauaua

SEQ ID NO: 756591 - RNA, 64 nt, Homo Sapiens
ucccaguaauaaaaaaaaaaaaaaaaaaaauauauauauauauauauauauauauauauauaua

SEQ ID NO: 756592 - RNA, 64 nt, Homo Sapiens
ccaguaauaaaaaaaaaaaaaaaaaaaauauauauauauauauauauauauauauauauauaua

SEQ ID NO: 756593 - RNA, 64 nt, Homo Sapiens
aguaauaaaaaaaaaaaaaaaaaaaauauauauauauauauauauauauauauauauauauaua

SEQ ID NO: 756594 - RNA, 64 nt, Homo Sapiens
uaauaaaaaaaaaaaaaaaaaaaauauauauauauauauauauauauauauauauauauauaua

SEQ ID NO: 756595 - RNA, 64 nt, Homo Sapiens
auaaaaaaaaaaaaaaaaaaaauauauauauauauauauauauauauauauauauauauauaua

SEQ ID NO: 756596 - RNA, 64 nt, Homo Sapiens
aaaaaaaaaaaaaaaaaaaauauauauauauauauauauauauauauauauauauauauauaua

SEQ ID NO: 756597 - RNA, 64 nt, Homo Sapiens
aaaaaaaaaaaaaaaaaauauauauauauauauauauauauauauauauauauauauauauaua

SEQ ID NO: 756598 - RNA, 64 nt, Homo Sapiens
aaaaaaaaaaaaaaaauauauauauauauauauauauauauauauauauauauauauauauaua

SEQ ID NO: 756599 - RNA, 64 nt, Homo Sapiens
aaaaaaaaaaaaaauauauauauauauauauauauauauauauauauauauauauauauauaua

SEQ ID NO: 756600 - RNA, 64 nt, Homo Sapiens
aaaaaaaaaaaauauauauauauauauauauauauauauauauauauauauauauauauauaua

SEQ ID NO: 756601 - RNA, 64 nt, Homo Sapiens
aaaaaaaaaauauauauauauauauauauauauauauauauauauauauauauauauauauaua

SEQ ID NO: 756602 - RNA, 64 nt, Homo Sapiens
aaaaaaaauauauauauauauauauauauauauauauauauauauauauauauauauauauaua

SEQ ID NO: 756603 - RNA, 64 nt, Homo Sapiens
aaaaaauauauauauauauauauauauauauauauauauauauauauauauauauauauauagu

SEQ ID NO: 756604 - RNA, 64 nt, Homo Sapiens
aaaauauauauauauauauauauauauauauauauauauauauauauauauauauauauaguuu

SEQ ID NO: 756605 - RNA, 64 nt, Homo Sapiens
aauauauauauauauauauauauauauauauauauauauauauauauauauauauauaguuuua

SEQ ID NO: 756606 - RNA, 64 nt, Homo Sapiens
uauauauauauauauauauauauauauauauauauauauauauauauauauauauaguuuuacu

SEQ ID NO: 756607 - RNA, 64 nt, Homo Sapiens
uauauauauauauauauauauauauauauauauauauauauauauauauauauaguuuuacuag

SEQ ID NO: 756608 - RNA, 64 nt, Homo Sapiens
uauauauauauauauauauauauauauauauauauauauauauauauauauaguuuuacuaggu

SEQ ID NO: 756609 - RNA, 64 nt, Homo Sapiens
uauauauauauauauauauauauauauauauauauauauauauauauauaguuuuacuagguuu

SEQ ID NO: 756610 - RNA, 64 nt, Homo Sapiens
uauauauauauauauauauauauauauauauauauauauauauauauaguuuuacuagguuuuc

SEQ ID NO: 756611 - RNA, 64 nt, Homo Sapiens
uauauauauauauauauauauauauauauauauauauauauauauaguuuuacuagguuuucau

SEQ ID NO: 756612 - RNA, 64 nt, Homo Sapiens
uauauauauauauauauauauauauauauauauauauauauauaguuuuacuagguuuucaugg

SEQ ID NO: 756613 - RNA, 64 nt, Homo Sapiens
uauauauauauauauauauauauauauauauauauauauauaguuuuacuagguuuucauggau

SEQ ID NO: 756614 - RNA, 64 nt, Homo Sapiens
gugaacuaaauauauauguguauauguauacacauauauauacacacacacauauauauauuua

SEQ ID NO: 756615 - RNA, 64 nt, Homo Sapiens
uguauauguauacacauauauauacacacacacauauauauauuuagaaacgugaguguuaaag

SEQ ID NO: 756616 - RNA, 64 nt, Homo Sapiens
aguauaaaaaacuuuaauacaaguacauacauauuauauauacacauacauauauauacuauau

SEQ ID NO: 756617 - RNA, 64 nt, Homo Sapiens
auacaaguacauacauauuauauauacacauacauauauauacuauauauggaugaaacauauu

SEQ ID NO: 756618 - RNA, 64 nt, Homo Sapiens
gaaaaugaaauguacuucuguuuauucuuaauacuauauauauauauacacacauaguuuuagc

SEQ ID NO: 756619 - RNA, 64 nt, Homo Sapiens
aaaugaaauguacuucuguuuauucuuaauacuauauauauauauacacacauaguuuuagcaa

SEQ ID NO: 756620 - RNA, 64 nt, Homo Sapiens
augaaauguacuucuguuuauucuuaauacuauauauauauauacacacauaguuuuagcaaau

SEQ ID NO: 756621 - RNA, 64 nt, Homo Sapiens
gaaauguacuucuguuuauucuuaauacuauauauauauauacacacauaguuuuagcaaauug

SEQ ID NO: 756622 - RNA, 64 nt, Homo Sapiens
uauauaauuuuaagguuaaagcauaccauagguguauauauaggaauguuaaauuuaauaugca

SEQ ID NO: 756623 - RNA, 64 nt, Homo Sapiens
uuacuugaaauguuaaauuuggcugaauguuugcuauauauaugcuuuucaugaaagaguauuu

SEQ ID NO: 756624 - RNA, 64 nt, Homo Sapiens
uugaacuauuuuucgugugcgaaaaauaacagauuauauauaguugugauuagcuaaccaggau

SEQ ID NO: 756625 - RNA, 64 nt, Homo Sapiens
guuacugcauaaugauuucaaaaaauuggauuuauauauauaagugguuuucuucuacaaagga

SEQ ID NO: 756626 - RNA, 64 nt, Homo Sapiens
agguuacugcauaaugauuugaaaaaauuggauuuauauauauauuugguuuucuucuacaaag

SEQ ID NO: 756627 - RNA, 64 nt, Homo Sapiens
auauaaaaugguacaccuauaauauauauauagauauauauaagcauagaaaagguacaguaaa

SEQ ID NO: 756628 - RNA, 64 nt, Homo Sapiens
uauauauaagauauaaaaugguacaguaaaaauauauauauagacauaucuaaacauagaaaag

SEQ ID NO: 756629 - RNA, 64 nt, Homo Sapiens
gauauauauaagauauaaaaagguacaguaaaaauauauauauaaacauaucuaaacauagaaa

SEQ ID NO: 756630 - RNA, 64 nt, Homo Sapiens
augaacauaguucaugcuuuuguacauauaaauauauauauaaaacugguuuuuguuguugcua

SEQ ID NO: 756631 - RNA, 64 nt, Homo Sapiens
aaaugaacauaguucaugcuuauguacauauaaauauauauauaagacugguuuuuguuguugc

SEQ ID NO: 756632 - RNA, 64 nt, Homo Sapiens
aguaauuuauauagaugucaaaaaauuaaauauauauauauauuaagaugguccaaaaauaguc

SEQ ID NO: 756633 - RNA, 64 nt, Homo Sapiens
uuaguaauuuauauagauguucaaaaauuaaauauauauauauauaaagaugguccaaaaauag

SEQ ID NO: 756634 - RNA, 64 nt, Homo Sapiens
uauuaguaauuuauauagauagucaaaaauuaaauauauauauaaauaaagaugguccaaaaau

SEQ ID NO: 756635 - RNA, 64 nt, Homo Sapiens
uuugauccuaucgacaaucauaauaauaauaaauuauauauauaacccauauaauaacgauggu

SEQ ID NO: 756636 - RNA, 64 nt, Homo Sapiens
ugauccuaucgacaaucauaauaauaauaaauuauauauauaacccauauaauaacgaugguga

SEQ ID NO: 756637 - RNA, 64 nt, Homo Sapiens
uauuuacagcuaaccuaucuauucauauuuuacauauauauauauauauauacaugcacacaca

SEQ ID NO: 756638 - RNA, 64 nt, Homo Sapiens
uuuacagcuaaccuaucuauucauauuuuacauauauauauauauauauacaugcacacacacc

SEQ ID NO: 756639 - RNA, 64 nt, Homo Sapiens
uacagcuaaccuaucuauucauauuuuacauauauauauauauauauacaugcacacacaccga

SEQ ID NO: 756640 - RNA, 64 nt, Homo Sapiens
cagcuaaccuaucuauucauauuuuacauauauauauauauauauacaugcacacacaccgaua

SEQ ID NO: 756641 - RNA, 64 nt, Homo Sapiens
gcuaaccuaucuauucauauuuuacauauauauauauauauauacaugcacacacaccgauaca

SEQ ID NO: 756642 - RNA, 64 nt, Homo Sapiens
uaaccuaucuauucauauuuuacauauauauauauauauauacaugcacacacaccgauacauu

SEQ ID NO: 756643 - RNA, 64 nt, Homo Sapiens
cuuuccaggagacauauauaggggaacaucacccuauauauaauuugaguguauauauauuuau

SEQ ID NO: 756644 - RNA, 64 nt, Homo Sapiens
auaggggaacaucacccuauauauaauuugaguguauauauauuuauauauaugauguggacau

SEQ ID NO: 756645 - RNA, 64 nt, Homo Sapiens
aucacccuauauauaauuugaguguauauauauuuauauauaugauguggacauauguauacuu

SEQ ID NO: 756646 - RNA, 64 nt, Homo Sapiens
cuccauuaccccuaaguuauuaguuugucuaguuuauauauaaagaccauguuuuaaaguacau

SEQ ID NO: 756647 - RNA, 64 nt, Homo Sapiens
uaaaauguuaaagaaaaacauuucuauauugaaauauauauaauuuauaaugaaaauuauagua

SEQ ID NO: 756648 - RNA, 64 nt, Homo Sapiens
gagauuuuagucuggcuauaaaugcuuuguuugauauauauaugugcacauauauauauuacuu

SEQ ID NO: 756649 - RNA, 64 nt, Homo Sapiens
uauaaaugcuuuguuugauauauauaugugcacauauauauauuacuuaaccauaugaauuuua

SEQ ID NO: 756650 - RNA, 64 nt, Homo Sapiens
gugacacacacacaaaaggaauuuaauaguauaauauauauauaaauaaauauauauacagaua

SEQ ID NO: 756651 - RNA, 64 nt, Homo Sapiens
gacacacacacaaaaggaauuuaauaguauaauauauauauaaauaaauauauauacagauaua

SEQ ID NO: 756652 - RNA, 64 nt, Homo Sapiens
aggaauuuaauaguauaauauauauauaaauaaauauauauacagauauauuuaucaugguaug

SEQ ID NO: 756653 - RNA, 64 nt, Homo Sapiens
cacacacaucuacuauuuuagauaaauguacuguuauauauauauguaaacuacuauugcucuc

SEQ ID NO: 756654 - RNA, 64 nt, Homo Sapiens
cacacaucuacuauuuuagauaaauguacuguuauauauauauguaaacuacuauugcucucuu

SEQ ID NO: 756655 - RNA, 64 nt, Homo Sapiens
uuuuuacucuaaaauucaauguaauuaaauuucauauauauauaauauauacauauauacauag

SEQ ID NO: 756656 - RNA, 64 nt, Homo Sapiens
uuuacucuaaaauucaauguaauuaaauuucauauauauauaauauauacauauauacauagug

SEQ ID NO: 756657 - RNA, 64 nt, Homo Sapiens
cuuccaagauagaaguuuacuguacggauauauauauauauaguagaaauauuuuccuuuguua

SEQ ID NO: 756658 - RNA, 64 nt, Homo Sapiens
gucuuccaagauagaaguuuuauguacggauauauauauauauaccagaaauauuuuccuuugu

SEQ ID NO: 756659 - RNA, 64 nt, Homo Sapiens
uagucuuccaagauagaaguguuauguacggauauauauauauaagccagaaauauuuuccuuu

SEQ ID NO: 756660 - RNA, 64 nt, Homo Sapiens
uauagucuuccaagauagaauuguuauguacggauauauauauaagagccagaaauauuuuccu

SEQ ID NO: 756661 - RNA, 64 nt, Homo Sapiens
auaggccagcuacaagggguuauaacaucuaauauauauauauugacuugguaagucuacugua

SEQ ID NO: 756662 - RNA, 64 nt, Homo Sapiens
uuauaggccagcuacaaggguauauaacaucuaauauauauauauugacuugguaagucuacug

SEQ ID NO: 756663 - RNA, 64 nt, Homo Sapiens
acaggccaaaugaacuaaacuauauaacaucuaauauauauauuuugacuugguaagucuacug

SEQ ID NO: 756664 - RNA, 64 nt, Homo Sapiens
uuuuaaagaguuugaagcaaugggaaacucauuauauauauauuugaauauagacucgagucuu

SEQ ID NO: 756665 - RNA, 64 nt, Homo Sapiens
uuuuuuaaagaguuugaagcuuugggaaacucauuauauauauauuugaauauagacucgaguc

SEQ ID NO: 756666 - RNA, 64 nt, Homo Sapiens
uggaaauguuuuauauguuuauaugcuauauauauauauauaacauggggagguuuuuaguuau

SEQ ID NO: 756667 - RNA, 64 nt, Homo Sapiens
acuggaaauguuuuauauguauauaugcuauauauauauauauaagauggggagguuuuuaguu

SEQ ID NO: 756668 - RNA, 64 nt, Homo Sapiens
uaacuggaaauguuuuauauuuauauaugcuauauauauauauaagagauggggagguuuuuag

SEQ ID NO: 756669 - RNA, 64 nt, Homo Sapiens
uauaacuggaaauguuuuauaguuauauaugcuauauauauauaagagagauggggagguuuuu

SEQ ID NO: 756670 - RNA, 64 nt, Homo Sapiens
uauauaacuggaaauguuuuuuaguuauauaugcuauauauauacaagagagauggggagguuu

SEQ ID NO: 756671 - RNA, 64 nt, Homo Sapiens
cacacacaccucuuuuucaguuaaguagcaugcauauauauaugaaugguacauauuuuuaaag

SEQ ID NO: 756672 - RNA, 64 nt, Homo Sapiens
uucacuugcuuucaagaugaauacaguauauacauauauauauuguauauacauauguguguau

SEQ ID NO: 756673 - RNA, 64 nt, Homo Sapiens
uauauauuuguuaauauauuaaauccacuuuuaauauauauacaaccugaaucugacaaagaug

SEQ ID NO: 756674 - RNA, 63 nt, Homo Sapiens
aucuuauuggcucucugcuuuauauauauauauauauauauauggcuguauuuuauauauaua

SEQ ID NO: 756675 - RNA, 64 nt, Homo Sapiens
uaucuuauuggcucucugcuuauauauauauauauauauauauaagggcuguauuuuauauaua

SEQ ID NO: 756676 - RNA, 64 nt, Homo Sapiens
uauaucuuauuggcucucuguauauauauauauauauauauauacuagggcuguauuuuauaua

SEQ ID NO: 756677 - RNA, 64 nt, Homo Sapiens
uauauaucuuauuggcucucuauauauauauauauauauauauaaucuagggcuguauuuuaua

SEQ ID NO: 756678 - RNA, 64 nt, Homo Sapiens
uauauauaucuuauuggcucuauauauauauauauauauauauaaaaucuagggcuguauuuua

SEQ ID NO: 756679 - RNA, 64 nt, Homo Sapiens
uauauauauaucuuauuggcuauauauauauauauauauauauacaaaaucuagggcuguauuu

SEQ ID NO: 756680 - RNA, 64 nt, Homo Sapiens
uauauauauauaucuuauuguuuauauauauauauauauauauaaacaaaaucuagggcuguau

SEQ ID NO: 756681 - RNA, 64 nt, Homo Sapiens
uauauauauauauaucuuauauuuuauauauauauauauauauaaaaacaaaaucuagggcugu

SEQ ID NO: 756682 - RNA, 64 nt, Homo Sapiens
uauauauauauauauaucuuguauuuuauauauauauauauauaaaaaaacaaaaucuagggcu

SEQ ID NO: 756683 - RNA, 64 nt, Homo Sapiens
uauauauauauauauauauccuguauuuuauauauauauauauaaaaaaaaacaaaaucuaggg

SEQ ID NO: 756684 - RNA, 64 nt, Homo Sapiens
uauauauauauauauauauaggcuguauuuuauauauauauauaacaaaaaaaacaaaaucuag

SEQ ID NO: 756685 - RNA, 64 nt, Homo Sapiens
uauauauauauauauauauaagggcuguauuuuauauauauauaaaacaaaaaaaacaaaaucu

SEQ ID NO: 756686 - RNA, 64 nt, Homo Sapiens
uauauauauauauauauauacuagggcuguauuuuauauauauaaaaaacaaaaaaaacaaaau

SEQ ID NO: 756687 - RNA, 64 nt, Homo Sapiens
auaauauaccuaaguguuuuuaucugauauauauuauauauaaaguacauaauaugcaauuaua

SEQ ID NO: 756688 - RNA, 64 nt, Homo Sapiens
guacauaauaugcaauuauacaacuuauauauaauauauauaagagaguuuuguauuauggauu

SEQ ID NO: 756689 - RNA, 64 nt, Homo Sapiens
auauauaagguacauaauauuuauggauucaacuuauauauaauaauguuuggagaguuuugua

SEQ ID NO: 756690 - RNA, 64 nt, Homo Sapiens
uguacugaugaaaauuuauaaaucaaauguaaguuauauauauucuuuugaacguuggccuuac

SEQ ID NO: 756691 - RNA, 64 nt, Homo Sapiens
aaaagccaaaaucuuuauuuaacagaauaaauauuauauauaucguugagcuuccauuuugagu

SEQ ID NO: 756692 - RNA, 64 nt, Homo Sapiens
uagauuccaacuuccuccuuagucagaguuaaaauauauauagucccuaaaugguauggccaaa

SEQ ID NO: 756693 - RNA, 64 nt, Homo Sapiens
auauuuuuuucuuuuuaaaauauuuuaaaaaauauauauauaaaauaguauaugauuauaaugc

SEQ ID NO: 756694 - RNA, 64 nt, Homo Sapiens
aaauauuuuuuucuuuuuaagcuauuuuaaaaaauauauauauacuauaguauaugauuauaau

SEQ ID NO: 756695 - RNA, 64 nt, Homo Sapiens
cucagcugcugcgggagguacauacaaauauauguauauauauucauacacacauacauacaua

SEQ ID NO: 756696 - RNA, 64 nt, Homo Sapiens
uauuacacauuauuaugacuagugaaucucauaauauauauaugcagcugauauuuguuuugaa

SEQ ID NO: 756697 - RNA, 64 nt, Homo Sapiens
aauuuuuuuuuauuuugcuuguauuuuauuaauauauauauagggaugccuccaggaaacuuaa

SEQ ID NO: 756698 - RNA, 64 nt, Homo Sapiens
ggaauuuuuuuuuauuuugcaaguauuuuauuaauauauauauauugaugccuccaggaaacuu

SEQ ID NO: 756699 - RNA, 64 nt, Homo Sapiens
auaaaauuuaggccaugggaaaaaaaagcauauauauauauaaaaagguugcucucagaaaaaa

SEQ ID NO: 756700 - RNA, 64 nt, Homo Sapiens
aaauaaaauuuaggccauggaaaaaaaaagcauauauauauauaguaagguugcucucagaaaa

SEQ ID NO: 756701 - RNA, 64 nt, Homo Sapiens
uaaaauaaaauuuaggccauaaaaaaaaaaagcauauauauauagaguaagguugcucucagaa

SEQ ID NO: 756702 - RNA, 64 nt, Homo Sapiens
aaacuaugaaucacucacacuuucuauguauguauauauauaaacaggauauuugggauccucu

SEQ ID NO: 756703 - RNA, 64 nt, Homo Sapiens
aaaaacuaugaaucacucaccuuuucuauguauguauauauauaugcaggauauuugggauccu

SEQ ID NO: 756704 - RNA, 64 nt, Homo Sapiens
gauuucuaaagauuuguuuauauauaaacacacauauauauaguccuaauuauauaaaaauaua

SEQ ID NO: 756705 - RNA, 64 nt, Homo Sapiens
cacacauauauauagugauuauuauauaaaaauauauauauaaauugaaaugaugauaauccua

SEQ ID NO: 756706 - RNA, 64 nt, Homo Sapiens
aacacacauauauauagugauaauuauauaaaaauauauauauaguuugaaaugaugauaaucc

SEQ ID NO: 756707 - RNA, 64 nt, Homo Sapiens
aauaauuuauauuuggaaauauauauuuaagaauuauauauauaaaaauauauauguauaagag

SEQ ID NO: 756708 - RNA, 64 nt, Homo Sapiens
uaauuuauauuuggaaauauauauuuaagaauuauauauauaaaaauauauauguauaagaguu

SEQ ID NO: 756709 - RNA, 64 nt, Homo Sapiens
aaacuuuucuuccccuuccuaguucugaaguagauauauauauauauauaucuacugucacauu

SEQ ID NO: 756710 - RNA, 64 nt, Homo Sapiens
acuuuucuuccccuuccuaguucugaaguagauauauauauauauauaucuacugucacauucc

SEQ ID NO: 756711 - RNA, 64 nt, Homo Sapiens
uuuucuuccccuuccuaguucugaaguagauauauauauauauauaucuacugucacauuccau

SEQ ID NO: 756712 - RNA, 64 nt, Homo Sapiens
uucuuccccuuccuaguucugaaguagauauauauauauauauaucuacugucacauuccauau

SEQ ID NO: 756713 - RNA, 64 nt, Homo Sapiens
cuuccccuuccuaguucugaaguagauauauauauauauauaucuacugucacauuccauauau

SEQ ID NO: 756714 - RNA, 64 nt, Homo Sapiens
uaucuaaaaggccagcuaccugccuaggagccacuauauauauagauagauguagguuaugaac

SEQ ID NO: 756715 - RNA, 64 nt, Homo Sapiens
ucuaaaaggccagcuaccugccuaggagccacuauauauauagauagauguagguuaugaaccc

SEQ ID NO: 756716 - RNA, 64 nt, Homo Sapiens
uugucaguacuuuacuuuuuuccccccaaauagguauauauagacugcagaagcuucaguccca

SEQ ID NO: 756717 - RNA, 64 nt, Homo Sapiens
gaaauuguuaggugaaaguguuuuugagaauuuuuauauauauuacucacugcagagaucaugu

SEQ ID NO: 756718 - RNA, 64 nt, Homo Sapiens
uucuuucucuuccuccuuccucuuccuuacuuuuuauauauauauauaaagaaaaugauacagc

SEQ ID NO: 756719 - RNA, 64 nt, Homo Sapiens
cuuucucuuccuccuuccucuuccuuacuuuuuauauauauauauaaagaaaaugauacagcag

SEQ ID NO: 756720 - RNA, 64 nt, Homo Sapiens
uucucuuccuccuuccucuuccuuacuuuuuauauauauauauaaagaaaaugauacagcagag

SEQ ID NO: 756721 - RNA, 64 nt, Homo Sapiens
cucuuccuccuuccucuuccuuacuuuuuauauauauauauaaagaaaaugauacagcagagcu

SEQ ID NO: 756722 - RNA, 64 nt, Homo Sapiens
caaaaaaaaaaacaaacaaacaaaaaaaaaaccauauauauacauauauauauagcagcuuuau

SEQ ID NO: 756723 - RNA, 64 nt, Homo Sapiens
aacaaacaaacaaaaaaaaaaccauauauauacauauauauauagcagcuuuauggagauauaa

SEQ ID NO: 756724 - RNA, 64 nt, Homo Sapiens
caaacaaacaaaaaaaaaaccauauauauacauauauauauagcagcuuuauggagauauaauu

SEQ ID NO: 756725 - RNA, 64 nt, Homo Sapiens
uucuccuucccuacuuuguacaaaggaccagaguuauauauauauauauauguauaugucugua

SEQ ID NO: 756726 - RNA, 64 nt, Homo Sapiens
cuccuucccuacuuuguacaaaggaccagaguuauauauauauauauauguauaugucuguacc

SEQ ID NO: 756727 - RNA, 64 nt, Homo Sapiens
ccuucccuacuuuguacaaaggaccagaguuauauauauauauauauguauaugucuguacccc

SEQ ID NO: 756728 - RNA, 64 nt, Homo Sapiens
uucccuacuuuguacaaaggaccagaguuauauauauauauauauguauaugucuguaccccag

SEQ ID NO: 756729 - RNA, 64 nt, Homo Sapiens
cccuacuuuguacaaaggaccagaguuauauauauauauauauguauaugucuguaccccagcc

SEQ ID NO: 756730 - RNA, 64 nt, Homo Sapiens
uuuuuaaaacugaaaauauuuuucucuugcuauuuauauauauaugauaaaaaugcuuggaaga

SEQ ID NO: 756731 - RNA, 64 nt, Homo Sapiens
uuuaaaacugaaaauauuuuucucuugcuauuuauauauauaugauaaaaaugcuuggaagagu

SEQ ID NO: 756732 - RNA, 64 nt, Homo Sapiens
uuuucuuuguuaaaguguaaaacagugaccagaauauauauaucuauaccugcauauauauauu

SEQ ID NO: 756733 - RNA, 64 nt, Homo Sapiens
aacagugaccagaauauauauaucuauaccugcauauauauauugaccugaguauuuauaacug

SEQ ID NO: 756734 - RNA, 64 nt, Homo Sapiens
ggacaugaguuaaauauauuuauauguacauacauauauauaucccuuuacauauauauguaug

SEQ ID NO: 756735 - RNA, 64 nt, Homo Sapiens
uauaugaaagaaaacacccuuaugaauugaugacuauauauaaaauuauauucacuacuuuuga

SEQ ID NO: 756736 - RNA, 64 nt, Homo Sapiens
uuugguugguuuucauuguaggggagggauuuuuuauauauauauaaaaacacacaccacaugc

SEQ ID NO: 756737 - RNA, 64 nt, Homo Sapiens
ugguugguuuucauuguaggggagggauuuuuuauauauauauaaaaacacacaccacaugcuu

SEQ ID NO: 756738 - RNA, 64 nt, Homo Sapiens
guugguuuucauuguaggggagggauuuuuuauauauauauaaaaacacacaccacaugcuuga

SEQ ID NO: 756739 - RNA, 64 nt, Homo Sapiens
uauacuuucagcauaacagaaauaucuauaucuauauauauaaaaaacugucuacagagaagua

SEQ ID NO: 756740 - RNA, 64 nt, Homo Sapiens
aauauacuuucagcauaacauaaauaucuauaucuauauauauaaaaaacugucuacagagaag

SEQ ID NO: 756741 - RNA, 64 nt, Homo Sapiens
auacacguguauaugaggaugaacuuucucagcauauauauaaaacgcaauuguauauauaugu

SEQ ID NO: 756742 - RNA, 64 nt, Homo Sapiens
ugaacuuucucagcauauauuacauacgcaauuguauauauaugcaagcagacacacacauaua

SEQ ID NO: 756743 - RNA, 64 nt, Homo Sapiens
uguaaugagagcaaguauauaaagaucaguuauauauauauauugcuguggucauuuguaaugu

SEQ ID NO: 756744 - RNA, 64 nt, Homo Sapiens
uuuguaaugagagcaaguauguaaagaucaguuauauauauauacugcuguggucauuuguaau

SEQ ID NO: 756745 - RNA, 64 nt, Homo Sapiens
uauuuguaaugagagcaaguauguaaagaucaguuauauauauacacugcuguggucauuugua

SEQ ID NO: 756746 - RNA, 64 nt, Homo Sapiens
aagauugauguaucaaaauuucugacacaguaaauauauauaucuauuugacuuuuuaaaaucu

SEQ ID NO: 756747 - RNA, 64 nt, Homo Sapiens
cacccugugagaacuguaaaucuucuuaaauauauauauauacauuguaaauauauguuacgaa

SEQ ID NO: 756748 - RNA, 64 nt, Homo Sapiens
cacacccugugagaacuguaaaucuucuuaaauauauauauauaaauuguaaauauauguuacg

SEQ ID NO: 756749 - RNA, 64 nt, Homo Sapiens
uacacacccugugagaacugcgaaucuucuuaaauauauauauaauaauuguaaauauauguua

SEQ ID NO: 756750 - RNA, 64 nt, Homo Sapiens
uuuuauuacuugggagaauguguauaucuaucuauauauauauuuacagcugcagaucucucug

SEQ ID NO: 756751 - RNA, 64 nt, Homo Sapiens
uuuuuuauuacuugggagaauguguauaucuaucuauauauauaaguacagcugcagaucucuc

SEQ ID NO: 756752 - RNA, 64 nt, Homo Sapiens
uaucugaaacgugauauuuuauagcugauauauauauauauauucucaucaacaucagcuaaau

SEQ ID NO: 756753 - RNA, 64 nt, Homo Sapiens
uuuaucugaaacgugauauuauauagcugauauauauauauauauacucaucaacaucagcuaa

SEQ ID NO: 756754 - RNA, 64 nt, Homo Sapiens
uauuuaucugaaacgugauaaaauauagcugauauauauauauagcuacucaucaacaucagcu

SEQ ID NO: 756755 - RNA, 64 nt, Homo Sapiens
uauauuuaucugaaacgugacuaaauauagcugauauauauauacagcuacucaucaacaucag

SEQ ID NO: 756756 - RNA, 64 nt, Homo Sapiens
uauauuuuugggggugggaguauaaauauauauauauauauauuaccuacagauauauacagua

SEQ ID NO: 756757 - RNA, 64 nt, Homo Sapiens
uuuauauuuuuggggguggguauauaaauauauauauauauauaaaaccuacagauauauacag

SEQ ID NO: 756758 - RNA, 64 nt, Homo Sapiens
uauuuauauuuuugggggugaguauauaaauauauauauauauacaaaaccuacagauauauac

SEQ ID NO: 756759 - RNA, 64 nt, Homo Sapiens
uauauuuauauuuuugggggacaguauauaaauauauauauauaagcaaaaccuacagauauau

SEQ ID NO: 756760 - RNA, 64 nt, Homo Sapiens
uauauauuuauauuuuugggauacaguauauaaauauauauauaacagcaaaaccuacagauau

SEQ ID NO: 756761 - RNA, 63 nt, Homo Sapiens
aaaaaaaacucuuuuaugucaauaaauaaauauauauauauaucauccccuggaguuuuuaaa

SEQ ID NO: 756762 - RNA, 64 nt, Homo Sapiens
uaaaaaaaacucuuuuauguaaaauaaauaaauauauauauauagacauccccuggaguuuuua

SEQ ID NO: 756763 - RNA, 64 nt, Homo Sapiens
uauaaaaaaaacucuuuuauuaaaaauaaauaaauauauauauagggacauccccuggaguuuu

SEQ ID NO: 756764 - RNA, 64 nt, Homo Sapiens
uaguuuggguuuguuuuuguugaaagauucuuguuauauauagcucuuucaauaguuugggaau

SEQ ID NO: 756765 - RNA, 64 nt, Homo Sapiens
uacuuucaagagaaaacuguguauacacaugaaauauauauauauauauauauauauauaugua

SEQ ID NO: 756766 - RNA, 64 nt, Homo Sapiens
cuuucaagagaaaacuguguauacacaugaaauauauauauauauauauauauauauauguaua

SEQ ID NO: 756767 - RNA, 64 nt, Homo Sapiens
uucaagagaaaacuguguauacacaugaaauauauauauauauauauauauauauauguauaau

SEQ ID NO: 756768 - RNA, 64 nt, Homo Sapiens
caagagaaaacuguguauacacaugaaauauauauauauauauauauauauauauguauaauau

SEQ ID NO: 756769 - RNA, 64 nt, Homo Sapiens
agagaaaacuguguauacacaugaaauauauauauauauauauauauauauauguauaauauau

SEQ ID NO: 756770 - RNA, 64 nt, Homo Sapiens
agaaaacuguguauacacaugaaauauauauauauauauauauauauauauguauaauauauaa

SEQ ID NO: 756771 - RNA, 64 nt, Homo Sapiens
aaaacuguguauacacaugaaauauauauauauauauauauauauauauguauaauauauaaag

SEQ ID NO: 756772 - RNA, 64 nt, Homo Sapiens
aacuguguauacacaugaaauauauauauauauauauauauauauauguauaauauauaaagac

SEQ ID NO: 756773 - RNA, 64 nt, Homo Sapiens
cuguguauacacaugaaauauauauauauauauauauauauauauguauaauauauaaagacug

SEQ ID NO: 756774 - RNA, 64 nt, Homo Sapiens
guguauacacaugaaauauauauauauauauauauauauauauguauaauauauaaagacuggc

SEQ ID NO: 756775 - RNA, 64 nt, Homo Sapiens
cuuuauccucuaaaauauguuaagggauaaauucuauauauauaguuaugcauuugcugucaua

SEQ ID NO: 756776 - RNA, 64 nt, Homo Sapiens
uuauccucuaaaauauguuaagggauaaauucuauauauauaguuaugcauuugcugucauacc

SEQ ID NO: 756777 - RNA, 64 nt, Homo Sapiens
uuucuuuuauauacauguuuuucuuuuacaugcauauauauauauuuuauuuuauuuuauguuu

SEQ ID NO: 756778 - RNA, 64 nt, Homo Sapiens
ucuuuuauauacauguuuuucuuuuacaugcauauauauauauuuuauuuuauuuuauguuuuu

SEQ ID NO: 756779 - RNA, 64 nt, Homo Sapiens
ggcaaagaugaaaguauagccaacuauucuuggcuauauauauauauucaagugggccgggcgu

SEQ ID NO: 756780 - RNA, 64 nt, Homo Sapiens
caaagaugaaaguauagccaacuauucuuggcuauauauauauauucaagugggccgggcguga

SEQ ID NO: 756781 - RNA, 64 nt, Homo Sapiens
aagaugaaaguauagccaacuauucuuggcuauauauauauauucaagugggccgggcgugaug

SEQ ID NO: 756782 - RNA, 64 nt, Homo Sapiens
uucuuaacccagucuuaggcugguauucccuuuuuauauauaucuauauuacuuuucaccucuu

SEQ ID NO: 756783 - RNA, 64 nt, Homo Sapiens
acugagugaguacauuggcauaaauauagaaauuuauauauauacauauauauaaacuauucuu

SEQ ID NO: 756784 - RNA, 64 nt, Homo Sapiens
ugagugaguacauuggcauaaauauagaaauuuauauauauacauauauauaaacuauucuuuu

SEQ ID NO: 756785 - RNA, 64 nt, Homo Sapiens
cauuggcauaaauauagaaauuuauauauauacauauauauaaacuauucuuuuuugccacaca

SEQ ID NO: 756786 - RNA, 64 nt, Homo Sapiens
guguaaaaacaaauuuccauauguuuuauauaaauauauauauaauaugaaggacuacccuccu

SEQ ID NO: 756787 - RNA, 64 nt, Homo Sapiens
guaaaaacaaauuuccauauguuuuauauaaauauauauauaauaugaaggacuacccuccuuu

SEQ ID NO: 756788 - RNA, 64 nt, Homo Sapiens
guaaacaagcacacacaauuuauauauauauauauauauauauguauauauauauauauauaua

SEQ ID NO: 756789 - RNA, 64 nt, Homo Sapiens
ugguaaacaagcacacacaauauauauauauauauauauauauauauauauauauauauauaua

SEQ ID NO: 756790 - RNA, 64 nt, Homo Sapiens
uaugguaaacaagcacacacuauauauauauauauauauauauacauauauauauauauauaua

SEQ ID NO: 756791 - RNA, 64 nt, Homo Sapiens
uauaugguaaacaagcacacuauauauauauauauauauauauauccauauauauauauauaua

SEQ ID NO: 756792 - RNA, 64 nt, Homo Sapiens
uauauaugguaaacaagcacuauauauauauauauauauauauauauccauauauauauauaua

SEQ ID NO: 756793 - RNA, 64 nt, Homo Sapiens
uauauauaugguaaacaagcuauauauauauauauauauauauauauauccauauauauauaua

SEQ ID NO: 756794 - RNA, 64 nt, Homo Sapiens
uauauauauaugguaaacaauauauauauauauauauauauauauauauauccauauauauaua

SEQ ID NO: 756795 - RNA, 64 nt, Homo Sapiens
uauauauauauaugguaaacuauauauauauauauauauauauaauuauauauccauauauaua

SEQ ID NO: 756796 - RNA, 64 nt, Homo Sapiens
uauauauauauauaugguaauauauauauauauauauauauauagaauuauauauccauauaua

SEQ ID NO: 756797 - RNA, 64 nt, Homo Sapiens
uauauauauauauauaugguuauauauauauauauauauauauaucgaauuauauauccauaua

SEQ ID NO: 756798 - RNA, 64 nt, Homo Sapiens
uauauauauauauauauauguauauauauauauauauauauauagaucgaauuauauauccaua

SEQ ID NO: 756799 - RNA, 64 nt, Homo Sapiens
uauauauauauauauauauauauauauauauauauauauauauacagaucgaauuauauaucca

SEQ ID NO: 756800 - RNA, 64 nt, Homo Sapiens
uauauauauauauauauauacauauauauauauauauauauauacucagaucgaauuauauauc

SEQ ID NO: 756801 - RNA, 64 nt, Homo Sapiens
uauauauauauauauauauauccauauauauauauauauauauaagcucagaucgaauuauaua

SEQ ID NO: 756802 - RNA, 64 nt, Homo Sapiens
uauauauauauauauauauauauccauauauauauauauauauaccagcucagaucgaauuaua

SEQ ID NO: 756803 - RNA, 64 nt, Homo Sapiens
uauauauauauauauauauauauauccauauauauauauauauaucccagcucagaucgaauua

SEQ ID NO: 756804 - RNA, 64 nt, Homo Sapiens
uauauauauauauauauauauauauauccauauauauauauauaagucccagcucagaucgaau

SEQ ID NO: 756805 - RNA, 64 nt, Homo Sapiens
uauauauauauauauauauaauuauauauccauauauauauauaucagucccagcucagaucga

SEQ ID NO: 756806 - RNA, 64 nt, Homo Sapiens
uauauauauauauauauauagaauuauauauccauauauauauaucucagucccagcucagauc

SEQ ID NO: 756807 - RNA, 64 nt, Homo Sapiens
aaaaaaaaagacaguauuuauauauauauaaaaauauauauauuaaaacaaaugagauuauaua

SEQ ID NO: 756808 - RNA, 64 nt, Homo Sapiens
aauauauauauuaaaaaaaaugagauuauauauauauauauaaauuucauaaguaaaaaacaaa

SEQ ID NO: 756809 - RNA, 64 nt, Homo Sapiens
aaaauauauauauuaaaaaaaaugagauuauauauauauauauaauuuucauaaguaaaaaaca

SEQ ID NO: 756810 - RNA, 64 nt, Homo Sapiens
uaaaaauauauauauuaaaacaaaugagauuauauauauauauauuauuuucauaaguaaaaaa

SEQ ID NO: 756811 - RNA, 64 nt, Homo Sapiens
uauaaaaauauauauauuaaaacaaaugagauuauauauauauauauuauuuucauaaguaaaa

SEQ ID NO: 756812 - RNA, 64 nt, Homo Sapiens
uauauaaaaauauauauauuaaaacaaaugagauuauauauauacuuauuauuuucauaaguaa

SEQ ID NO: 756813 - RNA, 64 nt, Homo Sapiens
uuuuuuaaacuuaaauuuugccuuuguuuacuuauauauauauugggcccuuuuucccuucccu

SEQ ID NO: 756814 - RNA, 64 nt, Homo Sapiens
uuuuuuuuaaacuuaaauuucuccuuuguuuacuuauauauauauugggcccuuuuucccuucc

SEQ ID NO: 756815 - RNA, 64 nt, Homo Sapiens
aauaggaucacugccugccagaucuucaaacuuuuauauauauauauauauauauauauauaua

SEQ ID NO: 756816 - RNA, 64 nt, Homo Sapiens
uaggaucacugccugccagaucuucaaacuuuuauauauauauauauauauauauauauauaua

SEQ ID NO: 756817 - RNA, 64 nt, Homo Sapiens
ggaucacugccugccagaucuucaaacuuuuauauauauauauauauauauauauauauauaua

SEQ ID NO: 756818 - RNA, 64 nt, Homo Sapiens
aucacugccugccagaucuucaaacuuuuauauauauauauauauauauaaaugccacgguccu

SEQ ID NO: 756819 - RNA, 64 nt, Homo Sapiens
cacugccugccagaucuucaaacuuuuauauauauauauauauauauaaaugccacgguccugc

SEQ ID NO: 756820 - RNA, 64 nt, Homo Sapiens
cugccugccagaucuucaaacuuuuauauauauauauauauauauaaaugccacgguccugcuc

SEQ ID NO: 756821 - RNA, 64 nt, Homo Sapiens
gccugccagaucuucaaacuuuuauauauauauauauauauauaaaugccacgguccugcucug

SEQ ID NO: 756822 - RNA, 64 nt, Homo Sapiens
cugccagaucuucaaacuuuuauauauauauauauauauauaaaugccacgguccugcucuggu

SEQ ID NO: 756823 - RNA, 64 nt, Homo Sapiens
aaaagaggauuaaguaaaauaaaaugagagcaauuauauauauaaauauauaucauacacagag

SEQ ID NO: 756824 - RNA, 64 nt, Homo Sapiens
aagaggauuaaguaaaauaaaaugagagcaauuauauauauaaauauauaucauacacagagcc

SEQ ID NO: 756825 - RNA, 64 nt, Homo Sapiens
gcuagauuucguguacaaaaccuguguaccccucuauauauauguuacauagaauguauauaug

SEQ ID NO: 756826 - RNA, 64 nt, Homo Sapiens
acguguguauuauaucuggccucguuauauaguguauauauauguauacauauacauauauaua

SEQ ID NO: 756827 - RNA, 64 nt, Homo Sapiens
cguuauauaguguauauauauguauacauauacauauauauaauauauaugaagacuguaaaug

SEQ ID NO: 756828 - RNA, 64 nt, Homo Sapiens
agacuaaacuuuuguuuuccuuacccaguauaaauauauauauauauauuuaaucuauuuuuau

SEQ ID NO: 756829 - RNA, 64 nt, Homo Sapiens
acuaaacuuuuguuuuccuuacccaguauaaauauauauauauauauuuaaucuauuuuuauua

SEQ ID NO: 756830 - RNA, 64 nt, Homo Sapiens
uaaacuuuuguuuuccuuacccaguauaaauauauauauauauauuuaaucuauuuuuauuaga

SEQ ID NO: 756831 - RNA, 64 nt, Homo Sapiens
aacuuuuguuuuccuuacccaguauaaauauauauauauauauuuaaucuauuuuuauuagaag

SEQ ID NO: 756832 - RNA, 64 nt, Homo Sapiens
ucaucuaaacugaguccagcugccuaauucugaauauauauauauauauaucuuuucaccauau

SEQ ID NO: 756833 - RNA, 64 nt, Homo Sapiens
aucuaaacugaguccagcugccuaauucugaauauauauauauauauaucuuuucaccauauac

SEQ ID NO: 756834 - RNA, 64 nt, Homo Sapiens
cuaaacugaguccagcugccuaauucugaauauauauauauauauaucuuuucaccauauacau

SEQ ID NO: 756835 - RNA, 64 nt, Homo Sapiens
aaacugaguccagcugccuaauucugaauauauauauauauauaucuuuucaccauauacaugc

SEQ ID NO: 756836 - RNA, 64 nt, Homo Sapiens
acugaguccagcugccuaauucugaauauauauauauauauaucuuuucaccauauacaugccu

SEQ ID NO: 756837 - RNA, 64 nt, Homo Sapiens
accucauuaucaguccaaagggcauggguuuuauuauauauauauauuuuuuuuuuuaaaaaaa

SEQ ID NO: 756838 - RNA, 64 nt, Homo Sapiens
cucauuaucaguccaaagggcauggguuuuauuauauauauauauuuuuuuuuuuaaaaaaaaa

SEQ ID NO: 756839 - RNA, 64 nt, Homo Sapiens
cauuaucaguccaaagggcauggguuuuauuauauauauauauuuuuuuuuuuaaaaaaaaaac

SEQ ID NO: 756840 - RNA, 64 nt, Homo Sapiens
augcugcuucauuuacccaggaggucauauucuuuauauauauuuuuuguugcaaagugucucu

SEQ ID NO: 756841 - RNA, 64 nt, Homo Sapiens
ucuauauauuauucgaauuuuuaaauuauuuguuuauauauaaaagaaaagcucaauuggcugu

SEQ ID NO: 756842 - RNA, 64 nt, Homo Sapiens
gcauauaauggaguuaacgggugaauaauaaaaguauauauauauauuauauauauauaaauau

SEQ ID NO: 756843 - RNA, 64 nt, Homo Sapiens
auauaauggaguuaacgggugaauaauaaaaguauauauauauauuauauauauauaaauauuu

SEQ ID NO: 756844 - RNA, 64 nt, Homo Sapiens
auaauggaguuaacgggugaauaauaaaaguauauauauauauuauauauauauaaauauuuua

SEQ ID NO: 756845 - RNA, 64 nt, Homo Sapiens
uuaacgggugaauaauaaaaguauauauauauauuauauauauauaaauauuuuaaauaucuuu

SEQ ID NO: 756846 - RNA, 64 nt, Homo Sapiens
aacgggugaauaauaaaaguauauauauauauuauauauauauaaauauuuuaaauaucuuuca

SEQ ID NO: 756847 - RNA, 64 nt, Homo Sapiens
cgggugaauaauaaaaguauauauauauauuauauauauauaaauauuuuaaauaucuuucaug

SEQ ID NO: 756848 - RNA, 64 nt, Homo Sapiens
uuacuuaagauucaguuuucccacuuuuugguaauauauauauuuuugugaauuauacuuuguu

SEQ ID NO: 756849 - RNA, 64 nt, Homo Sapiens
uaaauacugacaauguauuuuggaagacauauauuauauauagaaaagaggagaggaaaacuau

SEQ ID NO: 756850 - RNA, 64 nt, Homo Sapiens
caguagcuauagccauuaaccaaaggacagaugauauauauauauaugauauauauauauauau

SEQ ID NO: 756851 - RNA, 64 nt, Homo Sapiens
guagcuauagccauuaaccaaaggacagaugauauauauauauaugauauauauauauauauaa

SEQ ID NO: 756852 - RNA, 64 nt, Homo Sapiens
agcuauagccauuaaccaaaggacagaugauauauauauauaugauauauauauauauauaagu

SEQ ID NO: 756853 - RNA, 64 nt, Homo Sapiens
uuaaccaaaggacagaugauauauauauauaugauauauauauauauauaaguucuuuuuuagc

SEQ ID NO: 756854 - RNA, 64 nt, Homo Sapiens
aaccaaaggacagaugauauauauauauaugauauauauauauauauaaguucuuuuuuagcug

SEQ ID NO: 756855 - RNA, 64 nt, Homo Sapiens
ccaaaggacagaugauauauauauauaugauauauauauauauauaaguucuuuuuuagcugua

SEQ ID NO: 756856 - RNA, 64 nt, Homo Sapiens
aaaggacagaugauauauauauauaugauauauauauauauauaaguucuuuuuuagcuguacc

SEQ ID NO: 756857 - RNA, 64 nt, Homo Sapiens
aggacagaugauauauauauauaugauauauauauauauauaaguucuuuuuuagcuguaccua

SEQ ID NO: 756858 - RNA, 64 nt, Homo Sapiens
caaaugcacagucccccuccuauauauauauauauauauauacauauauauauauauauauaua

SEQ ID NO: 756859 - RNA, 64 nt, Homo Sapiens
cacaaaugcacagucccccuuauauauauauauauauauauauacauauauauauauauauaua

SEQ ID NO: 756860 - RNA, 64 nt, Homo Sapiens
uacacaaaugcacaguccccuauauauauauauauauauauauauacauauauauauauauaua

SEQ ID NO: 756861 - RNA, 64 nt, Homo Sapiens
uauacacaaaugcacaguccuauauauauauauauauauauauaucuacauauauauauauaua

SEQ ID NO: 756862 - RNA, 64 nt, Homo Sapiens
uauauacacaaaugcacaguuauauauauauauauauauauauaacucuacauauauauauaua

SEQ ID NO: 756863 - RNA, 64 nt, Homo Sapiens
uauauauacacaaaugcacauauauauauauauauauauauauaacacucuacauauauauaua

SEQ ID NO: 756864 - RNA, 64 nt, Homo Sapiens
uauauauauacacaaaugcauauauauauauauauauauauauaucacacucuacauauauaua

SEQ ID NO: 756865 - RNA, 64 nt, Homo Sapiens
uauauauauauacacaaauguauauauauauauauauauauauaauucacacucuacauauaua

SEQ ID NO: 756866 - RNA, 64 nt, Homo Sapiens
uauauauauauauacacaaauauauauauauauauauauauauaauauucacacucuacauaua

SEQ ID NO: 756867 - RNA, 64 nt, Homo Sapiens
uauauauauauauauacacauauauauauauauauauauauauaauauauucacacucuacaua

SEQ ID NO: 756868 - RNA, 64 nt, Homo Sapiens
uauauauauauauauauacauauauauauauauauauauauauaauauauauucacacucuaca

SEQ ID NO: 756869 - RNA, 64 nt, Homo Sapiens
uauauauauauauauauauacauauauauauauauauauauauauuauauauauucacacucua

SEQ ID NO: 756870 - RNA, 64 nt, Homo Sapiens
uauauauauauauauauauauacauauauauauauauauauauaacuuauauauauucacacuc

SEQ ID NO: 756871 - RNA, 64 nt, Homo Sapiens
uauauauauauauauauauaucuacauauauauauauauauauaccacuuauauauauucacac

SEQ ID NO: 756872 - RNA, 64 nt, Homo Sapiens
uauauauauauauauauauaacucuacauauauauauauauauaguccacuuauauauauucac

SEQ ID NO: 756873 - RNA, 64 nt, Homo Sapiens
uauauauauauauauauauaacacucuacauauauauauauauaacguccacuuauauauauuc

SEQ ID NO: 756874 - RNA, 64 nt, Homo Sapiens
uauauauauauauauauauaucacacucuacauauauauauauacuacguccacuuauauauau

SEQ ID NO: 756875 - RNA, 64 nt, Homo Sapiens
uauauauauauauauauauaauucacacucuacauauauauauaaacuacguccacuuauauau

SEQ ID NO: 756876 - RNA, 64 nt, Homo Sapiens
cacacucuacauauauauauuaacuacguccacuuauauauauuagaaggugcaguuuuauaac

SEQ ID NO: 756877 - RNA, 64 nt, Homo Sapiens
uacacacaaauuauauaucuauaaagaauacauauauauauaucaaacugcaaaaaaauacgua

SEQ ID NO: 756878 - RNA, 64 nt, Homo Sapiens
ucuacacacaaauuauauauuaauaaagaauacauauauauauaaaaaacugcaaaaaaauacg

SEQ ID NO: 756879 - RNA, 64 nt, Homo Sapiens
ucuaaguguaacuguccuucauauauauauauuauauauauauuauuuuuauagacauauauaa

SEQ ID NO: 756880 - RNA, 64 nt, Homo Sapiens
uuucuaaguguaacuguccuaaauauauauauauuauauauauaaaauuuuuauagacauauau

SEQ ID NO: 756881 - RNA, 64 nt, Homo Sapiens
auauauauauuucuaagugugacauauauaaauauauauauauuaagugugauaaauuuuuaua

SEQ ID NO: 756882 - RNA, 64 nt, Homo Sapiens
uuauauauauauuucuaaguuagacauauauaaauauauauauaucaagugugauaaauuuuua

SEQ ID NO: 756883 - RNA, 64 nt, Homo Sapiens
auaacuuauuguaucaguccauaauauauauauauauauauaaaaacaaaacuuuuuuuuauac

SEQ ID NO: 756884 - RNA, 64 nt, Homo Sapiens
aaauaacuuauuguaucaguacauaauauauauauauauauauauaaacaaaacuuuuuuuuau

SEQ ID NO: 756885 - RNA, 64 nt, Homo Sapiens
uaaaauaacuuauuguaucaauacauaauauauauauauauauauguaaacaaaacuuuuuuuu

SEQ ID NO: 756886 - RNA, 64 nt, Homo Sapiens
uauaaaauaacuuauuguauuuauacauaauauauauauauauagauguaaacaaaacuuuuuu

SEQ ID NO: 756887 - RNA, 64 nt, Homo Sapiens
uauauaaaauaacuuauuguuuuuauacauaauauauauauauauugauguaaacaaaacuuuu

SEQ ID NO: 756888 - RNA, 64 nt, Homo Sapiens
uauauauaaaauaacuuauuuuuuuuauacauaauauauauauaacuugauguaaacaaaacuu

SEQ ID NO: 756889 - RNA, 64 nt, Homo Sapiens
uauuuaaaaaaggcaacugauauauacauauauauauauauaguauaauauauacaaauauaua

SEQ ID NO: 756890 - RNA, 64 nt, Homo Sapiens
guuauuuaaaaaaggcaacuuauauauacauauauauauauauaggauaauauauacaaauaua

SEQ ID NO: 756891 - RNA, 64 nt, Homo Sapiens
uaguuauuuaaaaaaggcaauauauauauacauauauauauauacaggauaauauauacaaaua

SEQ ID NO: 756892 - RNA, 64 nt, Homo Sapiens
uauaguuauuuaaaaaaggcuauauauauauacauauauauauacacaggauaauauauacaaa

SEQ ID NO: 756893 - RNA, 64 nt, Homo Sapiens
uauauauauauauaguuauuuauauacaaauauauauauauacauaaguagaaucacaggauaa

SEQ ID NO: 756894 - RNA, 64 nt, Homo Sapiens
cauauauauauauauaguuaaauauauacaaauauauauauauacauaaguagaaucacaggau

SEQ ID NO: 756895 - RNA, 64 nt, Homo Sapiens
uacauauauauauauauaguauaauauauacaaauauauauauaaccauaaguagaaucacagg

SEQ ID NO: 756896 - RNA, 64 nt, Homo Sapiens
uacauaggaaaaaccaaauauauaaauaaauauauauauauauguggggguggggggcggguuu

SEQ ID NO: 756897 - RNA, 64 nt, Homo Sapiens
uguacauaggaaaaaccaaauuuauaaauaaauauauauauauacuuggggguggggggcgggu

SEQ ID NO: 756898 - RNA, 64 nt, Homo Sapiens
uauguacauaggaaaaaccaguuuuauaaauaaauauauauauaaccuuggggguggggggcgg

SEQ ID NO: 756899 - RNA, 64 nt, Homo Sapiens
cacacacacacagacauauauauaugucuauauauauauauagagauaaaaaacaaaguauaca

SEQ ID NO: 756900 - RNA, 64 nt, Homo Sapiens
gacacacacacacagacauacauauaugucuauauauauauauauggauaaaaaacaaaguaua

SEQ ID NO: 756901 - RNA, 64 nt, Homo Sapiens
uagacacacacacacagacauacauauaugucuauauauauauaaauggauaaaaaacaaagua

SEQ ID NO: 756902 - RNA, 64 nt, Homo Sapiens
uauagacacacacacacagauauacauauaugucuauauauauacuaauggauaaaaaacaaag

SEQ ID NO: 756903 - RNA, 64 nt, Homo Sapiens
auuuuuaaaaauuagcauuggaaacaaaaauauauauauauauuaaauaccaccauccuuaaca

SEQ ID NO: 756904 - RNA, 64 nt, Homo Sapiens
uuauuuuuaaaaauuagcaucagaaacaaaaauauauauauauagcaaauaccaccauccuuaa

SEQ ID NO: 756905 - RNA, 64 nt, Homo Sapiens
uauuauuuuuaaaaauuagcaacagaaacaaaaauauauauauaaagcaaauaccaccauccuu

SEQ ID NO: 756906 - RNA, 64 nt, Homo Sapiens
guuaauaaaaaagacgaaaaacuggacucaucuuuauauauaaucuucucauuucugcuuucuu

SEQ ID NO: 756907 - RNA, 64 nt, Homo Sapiens
uauauaguaaguuuuuuuuugaagacuguagcuauauauauaaaaaaaaaaaaaaggagaggua

SEQ ID NO: 756908 - RNA, 64 nt, Homo Sapiens
aauauauaguaaguuuuuuuuagaagacuguagcuauauauauaaaaaaaaaaaaaaggagagg

SEQ ID NO: 756909 - RNA, 64 nt, Homo Sapiens
guuucuacgacaugguauugaauaucagaggauauauauauauuauuuaguacaaaguuuguaa

SEQ ID NO: 756910 - RNA, 64 nt, Homo Sapiens
uuguuucuacgacaugguauaaaauaucagaggauauauauauauaauuuaguacaaaguuugu

SEQ ID NO: 756911 - RNA, 64 nt, Homo Sapiens
uugaacuucauaaaugugaauaaguauauauauauauauauaacuuuuacuaauaaacaaauuu

SEQ ID NO: 756912 - RNA, 64 nt, Homo Sapiens
acuugaacuucauaaauguguuuaaguauauauauauauauauacauuuuacuaauaaacaaau

SEQ ID NO: 756913 - RNA, 64 nt, Homo Sapiens
uaacuugaacuucauaaaugauuuuaaguauauauauauauauaaacauuuuacuaauaaacaa

SEQ ID NO: 756914 - RNA, 64 nt, Homo Sapiens
uauaacuugaacuucauaaaaaauuuuaaguauauauauauauacaaacauuuuacuaauaaac

SEQ ID NO: 756915 - RNA, 64 nt, Homo Sapiens
uauauaacuugaacuucauaacaaauuuuaaguauauauauauaaccaaacauuuuacuaauaa

SEQ ID NO: 756916 - RNA, 64 nt, Homo Sapiens
uauauauaacuugaacuucaaaacaaauuuuaaguauauauauaagaccaaacauuuuacuaau

SEQ ID NO: 756917 - RNA, 64 nt, Homo Sapiens
cacauacauaucuagaauguuauauauauacauauauauauacaauauacgagcuauauauaaa

SEQ ID NO: 756918 - RNA, 64 nt, Homo Sapiens
cacacauacauaucuagaauaauauauauauacauauauauauacuauauacgagcuauauaua

SEQ ID NO: 756919 - RNA, 64 nt, Homo Sapiens
uauauauauacacacauacagcuauauauaaauauauauauacacagauauauucuauauacga

SEQ ID NO: 756920 - RNA, 64 nt, Homo Sapiens
cauauauauauacacacauagagcuauauauaaauauauauauauacagauauauucuauauac

SEQ ID NO: 756921 - RNA, 64 nt, Homo Sapiens
uauauauauacauauauauauucuauauacgagcuauauauaaacuaccauauauacagauaua

SEQ ID NO: 756922 - RNA, 64 nt, Homo Sapiens
uuaagaaggcucuccauuugaaauaguggcaauauauauauagucgcucaaauaccuucacaau

SEQ ID NO: 756923 - RNA, 64 nt, Homo Sapiens
guuuaagaaggcucuccauuauaaauaguggcaauauauauauagccgcucaaauaccuucaca

SEQ ID NO: 756924 - RNA, 64 nt, Homo Sapiens
uauuuguagguauuuauauaccuucgggcugcuauauauauauuucaaaaggcccgaccacccc

SEQ ID NO: 756925 - RNA, 64 nt, Homo Sapiens
uuuauuuguagguauuuauaccccuucgggcugcuauauauauagcucaaaaggcccgaccacc

SEQ ID NO: 756926 - RNA, 64 nt, Homo Sapiens
acuuuguggaccaauuauugauauauauuauaaauauauauaaagaauauauauauauauauau

SEQ ID NO: 756927 - RNA, 64 nt, Homo Sapiens
auuauugauauauauuauaaauauauauaaagaauauauauauauauauauauauaaaguauag

SEQ ID NO: 756928 - RNA, 64 nt, Homo Sapiens
uauugauauauauuauaaauauauauaaagaauauauauauauauauauauauaaaguauagag

SEQ ID NO: 756929 - RNA, 64 nt, Homo Sapiens
uugauauauauuauaaauauauauaaagaauauauauauauauauauauauaaaguauagagag

SEQ ID NO: 756930 - RNA, 64 nt, Homo Sapiens
gauauauauuauaaauauauauaaagaauauauauauauauauauauauaaaguauagagagaa

SEQ ID NO: 756931 - RNA, 64 nt, Homo Sapiens
uauauauuauaaauauauauaaagaauauauauauauauauauauauaaaguauagagagaagu

SEQ ID NO: 756932 - RNA, 64 nt, Homo Sapiens
uauauuauaaauauauauaaagaauauauauauauauauauauauaaaguauagagagaaguuc

SEQ ID NO: 756933 - RNA, 64 nt, Homo Sapiens
uauuauaaauauauauaaagaauauauauauauauauauauauaaaguauagagagaaguucau

SEQ ID NO: 756934 - RNA, 64 nt, Homo Sapiens
auauaaagaauauauauauauauauauauauauauauauauaaaguauagagagaaguucauac

SEQ ID NO: 756935 - RNA, 64 nt, Homo Sapiens
cugaaacuauaggaaagguuaauuugccuauaauuauauauacauuccauagucaucaaggaau

SEQ ID NO: 756936 - RNA, 64 nt, Homo Sapiens
auugcagaagcugcaucaaaaguaugcuuugagguauauauagugaaacagagccuuucugaag

SEQ ID NO: 756937 - RNA, 64 nt, Homo Sapiens
ucucaguuuagaaauuuauucaaagcuaaagauguauauauacauauacuuuuguguguauaua

SEQ ID NO: 756938 - RNA, 64 nt, Homo Sapiens
gcuaaagauguauauauacauauacuuuuguguguauauauacacauauguguguaugcaguuu

SEQ ID NO: 756939 - RNA, 64 nt, Homo Sapiens
auauacacauauguguguaugcaguuugucagguuauauauagaauuucuauuaaggauuuuuu

SEQ ID NO: 756940 - RNA, 64 nt, Homo Sapiens
uggucuuuggagaaaaaauaauaaaacagaguguuauauauauauuuuuuggugcaagauaaga

SEQ ID NO: 756941 - RNA, 64 nt, Homo Sapiens
gucuuuggagaaaaaauaauaaaacagaguguuauauauauauuuuuuggugcaagauaagauu

SEQ ID NO: 756942 - RNA, 64 nt, Homo Sapiens
aaguguuauguuuguagauagagugaaauauauuuauauauauauaaauauauacagauacaua

SEQ ID NO: 756943 - RNA, 64 nt, Homo Sapiens
guguuauguuuguagauagagugaaauauauuuauauauauauaaauauauacagauacauauc

SEQ ID NO: 756944 - RNA, 64 nt, Homo Sapiens
guuauguuuguagauagagugaaauauauuuauauauauauaaauauauacagauacauaucug

SEQ ID NO: 756945 - RNA, 64 nt, Homo Sapiens
uguaagccuugcaaugugacggauaaggcccguauauauauauucagaacagaaccccacagcu

SEQ ID NO: 756946 - RNA, 64 nt, Homo Sapiens
uuuguaagccuugcaaugugcuggauaaggcccguauauauauacacagaacagaaccccacag

SEQ ID NO: 756947 - RNA, 64 nt, Homo Sapiens
ucaaaagguaggaaaugcaaaauauauaaauauauauauauauggauauccucaagguguaaaa

SEQ ID NO: 756948 - RNA, 64 nt, Homo Sapiens
ugucaaaagguaggaaaugcaaaauauauaaauauauauauauagugauauccucaagguguaa

SEQ ID NO: 756949 - RNA, 64 nt, Homo Sapiens
uaugucaaaagguaggaaauaaaaaauauauaaauauauauauauagugauauccucaaggugu

SEQ ID NO: 756950 - RNA, 64 nt, Homo Sapiens
uauauguauauccagugcaaguuguaaaaauauauauauauaaauguucagauccaaaggaucc

SEQ ID NO: 756951 - RNA, 64 nt, Homo Sapiens
aauauauguauauccagugcccguuguaaaaauauauauauauauauguucagauccaaaggau

SEQ ID NO: 756952 - RNA, 64 nt, Homo Sapiens
uaaauauauguauauccaguauccguuguaaaaauauauauauauguauguucagauccaaagg

SEQ ID NO: 756953 - RNA, 55 nt, Homo Sapiens
uaaauacuauaucucuauaucuauauauauauacacaauccaaauucacucuuaa

SEQ ID NO: 756954 - RNA, 53 nt, Homo Sapiens
cauaaauacuauaucucuaucuauauauauauacaauccaaauucacucuuaa

SEQ ID NO: 756955 - RNA, 51 nt, Homo Sapiens
uacauaaauacuauaucucucuauauauauacaauccaaauucacucuuaa

SEQ ID NO: 756956 - RNA, 64 nt, Homo Sapiens
gccacagcugacgccaaaaagaaaagaaaaaagauauauauauauauauauauauauacacgua

SEQ ID NO: 756957 - RNA, 64 nt, Homo Sapiens
cacagcugacgccaaaaagaaaagaaaaaagauauauauauauauauauauauauacacguaua

SEQ ID NO: 756958 - RNA, 64 nt, Homo Sapiens
cagcugacgccaaaaagaaaagaaaaaagauauauauauauauauauauauauacacguauaua

SEQ ID NO: 756959 - RNA, 64 nt, Homo Sapiens
gcugacgccaaaaagaaaagaaaaaagauauauauauauauauauauauauacacguauauaua

SEQ ID NO: 756960 - RNA, 64 nt, Homo Sapiens
ugacgccaaaaagaaaagaaaaaagauauauauauauauauauauauauacacguauauauaua

SEQ ID NO: 756961 - RNA, 64 nt, Homo Sapiens
acgccaaaaagaaaagaaaaaagauauauauauauauauauauauauacacguauauauauaaa

SEQ ID NO: 756962 - RNA, 64 nt, Homo Sapiens
gccaaaaagaaaagaaaaaagauauauauauauauauauauauauacacguauauauauaaaga

SEQ ID NO: 756963 - RNA, 64 nt, Homo Sapiens
caaaaagaaaagaaaaaagauauauauauauauauauauauauacacguauauauauaaagaga

SEQ ID NO: 756964 - RNA, 64 nt, Homo Sapiens
aaaagaaaagaaaaaagauauauauauauauauauauauauacacguauauauauaaagagaau

SEQ ID NO: 756965 - RNA, 64 nt, Homo Sapiens
aaaagauauauauauauauauauauauauacacguauauauauaaagagaauuuaauaaaacag

SEQ ID NO: 756966 - RNA, 64 nt, Homo Sapiens
aagauauauauauauauauauauauauacacguauauauauaaagagaauuuaauaaaacaggg

SEQ ID NO: 756967 - RNA, 64 nt, Homo Sapiens
auauuuauucugagccugagcucagauaauauauuauauauauuauauauauauauauauuucu

SEQ ID NO: 756968 - RNA, 64 nt, Homo Sapiens
cugagccugagcucagauaauauauuauauauauuauauauauauauauauuucuauuuaaaga

SEQ ID NO: 756969 - RNA, 64 nt, Homo Sapiens
gagccugagcucagauaauauauuauauauauuauauauauauauauauuucuauuuaaagagg

SEQ ID NO: 756970 - RNA, 64 nt, Homo Sapiens
gccugagcucagauaauauauuauauauauuauauauauauauauauuucuauuuaaagaggau

SEQ ID NO: 756971 - RNA, 64 nt, Homo Sapiens
cugagcucagauaauauauuauauauauuauauauauauauauauuucuauuuaaagaggaucc

SEQ ID NO: 756972 - RNA, 64 nt, Homo Sapiens
gagcucagauaauauauuauauauauuauauauauauauauauuucuauuuaaagaggauccug

SEQ ID NO: 756973 - RNA, 64 nt, Homo Sapiens
ugcacuuuguauauugguugaaacuguuaucacuuauauauauauauauacacacauauauaua

SEQ ID NO: 756974 - RNA, 64 nt, Homo Sapiens
cacuuuguauauugguugaaacuguuaucacuuauauauauauauauacacacauauauauaaa

SEQ ID NO: 756975 - RNA, 64 nt, Homo Sapiens
cuuuguauauugguugaaacuguuaucacuuauauauauauauauacacacauauauauaaaau

SEQ ID NO: 756976 - RNA, 64 nt, Homo Sapiens
uuguauauugguugaaacuguuaucacuuauauauauauauauacacacauauauauaaaaucu

SEQ ID NO: 756977 - RNA, 64 nt, Homo Sapiens
guauauugguugaaacuguuaucacuuauauauauauauauacacacauauauauaaaaucuau

SEQ ID NO: 756978 - RNA, 64 nt, Homo Sapiens
acuguuaucacuuauauauauauauauacacacauauauauaaaaucuauuuauuuuugcaaac

SEQ ID NO: 756979 - RNA, 64 nt, Homo Sapiens
uuuugaaaacaugaccaaacucauacuucaaaaauauauauauaaugaaugugaggaauaugaa

SEQ ID NO: 756980 - RNA, 64 nt, Homo Sapiens
uugaaaacaugaccaaacucauacuucaaaaauauauauauaaugaaugugaggaauaugaaaa

SEQ ID NO: 756981 - RNA, 64 nt, Homo Sapiens
cccuuauuccaugaaaguuuuauaaaagaaaaaauauauauauauucauguuuauuuaagaaau

SEQ ID NO: 756982 - RNA, 64 nt, Homo Sapiens
cuuauuccaugaaaguuuuauaaaagaaaaaauauauauauauucauguuuauuuaagaaaugg

SEQ ID NO: 756983 - RNA, 64 nt, Homo Sapiens
agccugggagacagagugagacuccaucucaaaauauauauauauuuccaaauauucaguuugg

SEQ ID NO: 756984 - RNA, 64 nt, Homo Sapiens
ccugggagacagagugagacuccaucucaaaauauauauauauuuccaaauauucaguuugguc

SEQ ID NO: 756985 - RNA, 64 nt, Homo Sapiens
uauguucucguuuuucuacagauauaaguaaauuuauauauaaaaauaccaaaaagaggcuggg

SEQ ID NO: 756986 - RNA, 64 nt, Homo Sapiens
gagauuccgucucaacaagaaaaaaaaaaaagaauauauauauauguauguauguauguaugua

SEQ ID NO: 756987 - RNA, 64 nt, Homo Sapiens
gauuccgucucaacaagaaaaaaaaaaaagaauauauauauauguauguauguauguauguaaa

SEQ ID NO: 756988 - RNA, 64 nt, Homo Sapiens
caagacaaaaggacucuguaauuccacuucuagguauauauacauccuauagaaacucacaaau

SEQ ID NO: 756989 - RNA, 64 nt, Homo Sapiens
auccuauagaaacucacaaauaaugcauaagaaauauauauauaauauauguauguauguauag

SEQ ID NO: 756990 - RNA, 64 nt, Homo Sapiens
ccuauagaaacucacaaauaaugcauaagaaauauauauauaauauauguauguauguauagcc

SEQ ID NO: 756991 - RNA, 64 nt, Homo Sapiens
gugagauuaucgaaaauuauaauauacaaaaucauauauauauauauguucuuguuuuuugaga

SEQ ID NO: 756992 - RNA, 64 nt, Homo Sapiens
gagauuaucgaaaauuauaauauacaaaaucauauauauauauauguucuuguuuuuugagaca

SEQ ID NO: 756993 - RNA, 64 nt, Homo Sapiens
gauuaucgaaaauuauaauauacaaaaucauauauauauauauguucuuguuuuuugagacaga

SEQ ID NO: 756994 - RNA, 64 nt, Homo Sapiens
ggauuacaggcgugagucaccgugcccagccauguauauauauaauuuuaaaaauuaagcugaa

SEQ ID NO: 756995 - RNA, 64 nt, Homo Sapiens
auuacaggcgugagucaccgugcccagccauguauauauauaauuuuaaaaauuaagcugaaau

SEQ ID NO: 756996 - RNA, 64 nt, Homo Sapiens
ccuucaaaguuuugguuuuuuuaagaaaaaaaaauauauauauauuuggguuuugggggaaaag

SEQ ID NO: 756997 - RNA, 64 nt, Homo Sapiens
uucaaaguuuugguuuuuuuaagaaaaaaaaauauauauauauuuggguuuugggggaaaaggg

SEQ ID NO: 756998 - RNA, 64 nt, Homo Sapiens
uagcacuuuagaguccaugaaauaugguaaaaaauauauauauaucauaauaaaugacagcuga

SEQ ID NO: 756999 - RNA, 64 nt, Homo Sapiens
gcacuuuagaguccaugaaauaugguaaaaaauauauauauaucauaauaaaugacagcugaug

SEQ ID NO: 757000 - RNA, 64 nt, Homo Sapiens
uuaugugugugugugcgccuuauguauauaagcauauauauaauauauaagcauauuauuauau

SEQ ID NO: 757001 - RNA, 64 nt, Homo Sapiens
ccuguauguacguauauuucuguaucuauguauguauauauaugcauaugcagacauauguaua

SEQ ID NO: 757002 - RNA, 64 nt, Homo Sapiens
ugugcaguguacuuccccuuuaaauuaaaaaacauauauauauauauauuuggaggucaguaau

SEQ ID NO: 757003 - RNA, 64 nt, Homo Sapiens
ugcaguguacuuccccuuuaaauuaaaaaacauauauauauauauauuuggaggucaguaauuu

SEQ ID NO: 757004 - RNA, 64 nt, Homo Sapiens
caguguacuuccccuuuaaauuaaaaaacauauauauauauauauuuggaggucaguaauuucc

SEQ ID NO: 757005 - RNA, 64 nt, Homo Sapiens
guguacuuccccuuuaaauuaaaaaacauauauauauauauauuuggaggucaguaauuuccaa

SEQ ID NO: 757006 - RNA, 64 nt, Homo Sapiens
ucaagaagaaaaaaaaaauacauauacacauaaauauauauauguguguguguauauauauaua

SEQ ID NO: 757007 - RNA, 64 nt, Homo Sapiens
uacauauacacauaaauauauauauguguguguguauauauauauauauauauauauaugcuau

SEQ ID NO: 757008 - RNA, 64 nt, Homo Sapiens
cauauacacauaaauauauauauguguguguguauauauauauauauauauauauaugcuauau

SEQ ID NO: 757009 - RNA, 64 nt, Homo Sapiens
uauacacauaaauauauauauguguguguguauauauauauauauauauauauaugcuauauaa

SEQ ID NO: 757010 - RNA, 64 nt, Homo Sapiens
uacacauaaauauauauauguguguguguauauauauauauauauauauauaugcuauauaaag

SEQ ID NO: 757011 - RNA, 64 nt, Homo Sapiens
cacauaaauauauauauguguguguguauauauauauauauauauauauaugcuauauaaaguu

SEQ ID NO: 757012 - RNA, 64 nt, Homo Sapiens
cauaaauauauauauguguguguguauauauauauauauauauauauaugcuauauaaaguuua

SEQ ID NO: 757013 - RNA, 64 nt, Homo Sapiens
uaaauauauauauguguguguguauauauauauauauauauauauaugcuauauaaaguuuaaa

SEQ ID NO: 757014 - RNA, 64 nt, Homo Sapiens
aauauauauauguguguguguauauauauauauauauauauauaugcuauauaaaguuuaaaug

SEQ ID NO: 757015 - RNA, 64 nt, Homo Sapiens
uauauauauguguguguguauauauauauauauauauauauaugcuauauaaaguuuaaaugaa

SEQ ID NO: 757016 - RNA, 64 nt, Homo Sapiens
uaauauacuuuuccucagaguauagauauauauauauauauaaaccuuaaaaacaaaauuuaua

SEQ ID NO: 757017 - RNA, 64 nt, Homo Sapiens
aauaauauacuuuuccucaguauauagauauauauauauauauacuccuuaaaaacaaaauuua

SEQ ID NO: 757018 - RNA, 64 nt, Homo Sapiens
uaaauaauauacuuuuccucuauauauagauauauauauauauauccuccuuaaaaacaaaauu

SEQ ID NO: 757019 - RNA, 64 nt, Homo Sapiens
uauaaauaauauacuuuuccuuuauauauagauauauauauauauuuccuccuuaaaaacaaaa

SEQ ID NO: 757020 - RNA, 64 nt, Homo Sapiens
uauauaaauaauauacuuuuaauuuauauauagauauauauauaucuuuccuccuuaaaaacaa

SEQ ID NO: 757021 - RNA, 64 nt, Homo Sapiens
uauauauauauauauaaauauuaaaaacaaaauuuauauauagauuuuuuuuucucuuuccucc

SEQ ID NO: 757022 - RNA, 64 nt, Homo Sapiens
acgcgucacagaaucuaggguauauauacagauauauauauaugcagauaucuauaucuauaua

SEQ ID NO: 757023 - RNA, 64 nt, Homo Sapiens
ugacgcgucacagaaucuaguauauauauacagauauauauauauacagauaucuauaucuaua

SEQ ID NO: 757024 - RNA, 64 nt, Homo Sapiens
gauauauauauaugacgcguucuauaucuauauauauauauacaaaucuaucuauauacagaua

SEQ ID NO: 757025 - RNA, 64 nt, Homo Sapiens
cagauauauauauaugacgcuaucuauaucuauauauauauauaaaaaucuaucuauauacaga

SEQ ID NO: 757026 - RNA, 64 nt, Homo Sapiens
uacagauauauauauaugacgauaucuauaucuauauauauauaagaaaaucuaucuauauaca

SEQ ID NO: 757027 - RNA, 64 nt, Homo Sapiens
uauacagauauauauauaugcagauaucuauaucuauauauauaaaagaaaaucuaucuauaua

SEQ ID NO: 757028 - RNA, 64 nt, Homo Sapiens
aaaaagucucuauucuucacuauaaaauuauauauauauauauuacaaagagcaaagcagaacu

SEQ ID NO: 757029 - RNA, 64 nt, Homo Sapiens
uuaaaaagucucuauucuuccuuauaaaauuauauauauauauaacacaaagagcaaagcagaa

SEQ ID NO: 757030 - RNA, 64 nt, Homo Sapiens
uauuaaaaagucucuauucuaacuuauaaaauuauauauauauaaaacacaaagagcaaagcag

SEQ ID NO: 757031 - RNA, 64 nt, Homo Sapiens
uauauuaaaaagucucuauuagaacuuauaaaauuauauauauaaaaaacacaaagagcaaagc

SEQ ID NO: 757032 - RNA, 64 nt, Homo Sapiens
cauauguauguauaccuaacuauauauauauacauauauauacauguguguguguguguaugug

SEQ ID NO: 757033 - RNA, 64 nt, Homo Sapiens
uauauauacacauauguauguguguauguguauauauauauacaugugugugugugugugugug

SEQ ID NO: 757034 - RNA, 64 nt, Homo Sapiens
cauauauauacacauauguauguguguauguguauauauauauaacugugugugugugugugug

SEQ ID NO: 757035 - RNA, 64 nt, Homo Sapiens
uacauauauauacacauauguguguguguauguguauauauauaucacugugugugugugugug

SEQ ID NO: 757036 - RNA, 64 nt, Homo Sapiens
uuuaaauauggaaugcuuuuuguguauauauauuuauauauauuuauauuugucuagagggcug

SEQ ID NO: 757037 - RNA, 64 nt, Homo Sapiens
uauauauauuuuuaaauauguagagggcuguguguauauauauugugauuuuuguauauuuguc

SEQ ID NO: 757038 - RNA, 64 nt, Homo Sapiens
augaaauauauguuucauuuguaauauauauauauauauauaaagccauagauagaagguaucu

SEQ ID NO: 757039 - RNA, 64 nt, Homo Sapiens
aaaugaaauauauguuucaucuguaauauauauauauauauauauugccauagauagaagguau

SEQ ID NO: 757040 - RNA, 64 nt, Homo Sapiens
uaaaaugaaauauauguuucaucuguaauauauauauauauauaaauugccauagauagaaggu

SEQ ID NO: 757041 - RNA, 64 nt, Homo Sapiens
uauaaaaugaaauauauguuguaucuguaauauauauauauauauaaauugccauagauagaag

SEQ ID NO: 757042 - RNA, 64 nt, Homo Sapiens
uauauaaaaugaaauauaugagguaucuguaauauauauauauacauaaauugccauagauaga

SEQ ID NO: 757043 - RNA, 64 nt, Homo Sapiens
uauauauaaaaugaaauauagaagguaucuguaauauauauauaaacauaaauugccauagaua

SEQ ID NO: 757044 - RNA, 64 nt, Homo Sapiens
uuuuuuuuuuuccugaggaucacacauauauauauauauauauucacacacacacacacacaca

SEQ ID NO: 757045 - RNA, 64 nt, Homo Sapiens
uuuuuuuuuuuuuccugaggcacacacauauauauauauauauacacacacacacacacacaca

SEQ ID NO: 757046 - RNA, 64 nt, Homo Sapiens
uauuuuuuuuuuuuuccugacacacacacauauauauauauauacacacacacacacacacaca

SEQ ID NO: 757047 - RNA, 64 nt, Homo Sapiens
uauauuuuuuuuuuuuuccucacacacacacauauauauauauacacacacacacacacacaca

SEQ ID NO: 757048 - RNA, 64 nt, Homo Sapiens
uauauauuuuuuuuuuuuuccacacacacacacauauauauauacacacacacacacacacaca

SEQ ID NO: 757049 - RNA, 64 nt, Homo Sapiens
cacacacacacacacacacaauauuauauauauauauauauacaagauauguauauauauauau

SEQ ID NO: 757050 - RNA, 64 nt, Homo Sapiens
cacacacacacacacacacaauauauuauauauauauauauauauaagauauguauauauauau

SEQ ID NO: 757051 - RNA, 64 nt, Homo Sapiens
uacacacacacacacacacaauauauauuauauauauauauauauauaagauauguauauauau

SEQ ID NO: 757052 - RNA, 64 nt, Homo Sapiens
uauacacacacacacacacaauauauauauuauauauauauauacauauaagauauguauauau

SEQ ID NO: 757053 - RNA, 64 nt, Homo Sapiens
uauauacacacacacacacaauauauauauauuauauauauauaugcauauaagauauguauau

SEQ ID NO: 757054 - RNA, 64 nt, Homo Sapiens
uauauauacacacacacacaauauauauauauauuauauauauaugugcauauaagauauguau

SEQ ID NO: 757055 - RNA, 64 nt, Homo Sapiens
auauauauauauauauacacgauauguauauauauauauauauucuagagggcugugcauauaa

SEQ ID NO: 757056 - RNA, 64 nt, Homo Sapiens
uuauauauauauauauauacaagauauguauauauauauauauauccuagagggcugugcauau

SEQ ID NO: 757057 - RNA, 64 nt, Homo Sapiens
uauuauauauauauauauauauaagauauguauauauauauauaucuccuagagggcugugcau

SEQ ID NO: 757058 - RNA, 64 nt, Homo Sapiens
uauauuauauauauauauauauauaagauauguauauauauauacuucuccuagagggcugugc

SEQ ID NO: 757059 - RNA, 64 nt, Homo Sapiens
uauauauuauauauauauaugcauauaagauauguauauauauacucuucuccuagagggcugu

SEQ ID NO: 757060 - RNA, 64 nt, Homo Sapiens
caucuacccaagaaacaugauaagggggaacuacuauauauaugauggaaagcaaagcugugga

SEQ ID NO: 757061 - RNA, 64 nt, Homo Sapiens
uaccuaugauaaaauuuagucuauguuuuuuucuuauauauacagauaggaccaaacucuaugu

SEQ ID NO: 757062 - RNA, 64 nt, Homo Sapiens
guguauguguguuauauugguacugggcacuauauauauauaguuauauaguauauacacuaua

SEQ ID NO: 757063 - RNA, 64 nt, Homo Sapiens
guguguauguguguuauauuuauacugggcacuauauauauauauauauauaguauauacacua

SEQ ID NO: 757064 - RNA, 64 nt, Homo Sapiens
uaguguguauguguguuauauauauacugggcacuauauauauauguauauauaguauauacac

SEQ ID NO: 757065 - RNA, 64 nt, Homo Sapiens
auauacacuauauacugggcacacacaauauauguauauauaguauauauauauacacacacac

SEQ ID NO: 757066 - RNA, 64 nt, Homo Sapiens
cacacacacacacaauauauacuauauauauauauauauauacaacacaugcacuacauaacac

SEQ ID NO: 757067 - RNA, 64 nt, Homo Sapiens
cacacacacacacacaauauacacuauauauauauauauauauaccacacaugcacuacauaac

SEQ ID NO: 757068 - RNA, 64 nt, Homo Sapiens
uacacacacacacacacaauacacacuauauauauauauauauagcccacacaugcacuacaua

SEQ ID NO: 757069 - RNA, 64 nt, Homo Sapiens
uauacacacacacacacacauaacacacuauauauauauauauaaugcccacacaugcacuaca

SEQ ID NO: 757070 - RNA, 64 nt, Homo Sapiens
uauauacacacacacacacacauaacacacuauauauauauauaauaugcccacacaugcacua

SEQ ID NO: 757071 - RNA, 64 nt, Homo Sapiens
uauauauacacacacacacauacauaacacacuauauauauauaauauaugcccacacaugcac

SEQ ID NO: 757072 - RNA, 64 nt, Homo Sapiens
uauauauauacacacacacaacuacauaacacacuauauauauacuauauaugcccacacaugc

SEQ ID NO: 757073 - RNA, 64 nt, Homo Sapiens
ccauauguauauguguguguacauauguauuccauauauauauuaccauauauguauauauucc

SEQ ID NO: 757074 - RNA, 64 nt, Homo Sapiens
uauauuccacauguguguauccaagguaguuccauauauauacaauuucuuaacaaaaugaugg

SEQ ID NO: 757075 - RNA, 64 nt, Homo Sapiens
ggugucgcuaguacagcaaaauuaaauacauaaauauauauauauauauauauuuuagaaaaaa

SEQ ID NO: 757076 - RNA, 62 nt, Homo Sapiens
ugucgcuaguacagcaaaauuaaauacauaaauauauauauauauauauauuuuagaaaaaa

SEQ ID NO: 757077 - RNA, 64 nt, Homo Sapiens
ucaagacuuuuagcauaaugaaaaacccucucucuauauauauauguguauaugaauuaugugg

SEQ ID NO: 757078 - RNA, 64 nt, Homo Sapiens
aagacuuuuagcauaaugaaaaacccucucucuauauauauauguguauaugaauuaugugggc

SEQ ID NO: 757079 - RNA, 64 nt, Homo Sapiens
uaugugugcauguguguauaagugcacacagaaauauauauacauauguagacuauauacaugu

SEQ ID NO: 757080 - RNA, 64 nt, Homo Sapiens
auauguagacuauauacauguguguauauauguguauauauacauacacuuguauaaauguaua

SEQ ID NO: 757081 - RNA, 64 nt, Homo Sapiens
gcaaguuuugauaugaguauacaauauauaaaaauauauauagugcuauauauauaaauauuug

SEQ ID NO: 757082 - RNA, 64 nt, Homo Sapiens
augaguauacaauauauaaaaauauauauagugcuauauauauaaauauuuggucucuauuuca

SEQ ID NO: 757083 - RNA, 64 nt, Homo Sapiens
gaguauacaauauauaaaaauauauauagugcuauauauauaaauauuuggucucuauuucauu

SEQ ID NO: 757084 - RNA, 64 nt, Homo Sapiens
cugucacugaugagagacugggaagggaaaagcauauauauauagauauauagagauauagaua

SEQ ID NO: 757085 - RNA, 64 nt, Homo Sapiens
gucacugaugagagacugggaagggaaaagcauauauauauagauauauagagauauagauaua

SEQ ID NO: 757086 - RNA, 64 nt, Homo Sapiens
aaagcauauauauauagauauauagagauauagauauauauacaggaaacaccgcauccuugca

SEQ ID NO: 757087 - RNA, 64 nt, Homo Sapiens
uucuggaagacuuuuaaaaaaauauaaauaugcauauauauauauaaauuauaaauagauuccc

SEQ ID NO: 757088 - RNA, 64 nt, Homo Sapiens
cuggaagacuuuuaaaaaaauauaaauaugcauauauauauauaaauuauaaauagauucccca

SEQ ID NO: 757089 - RNA, 64 nt, Homo Sapiens
ggaagacuuuuaaaaaaauauaaauaugcauauauauauauaaauuauaaauagauuccccacg

SEQ ID NO: 757090 - RNA, 64 nt, Homo Sapiens
gguguuugugaaaauccuauaagauuuaaagaaauauauauauacuuuuuuucuuuuuucuuuu

SEQ ID NO: 757091 - RNA, 64 nt, Homo Sapiens
uguuugugaaaauccuauaagauuuaaagaaauauauauauacuuuuuuucuuuuuucuuuuuu

SEQ ID NO: 757092 - RNA, 64 nt, Homo Sapiens
guuucuuaaaaaacauauauguguguggcguguguauauauauguauauauauuuuuucauugu

SEQ ID NO: 757093 - RNA, 64 nt, Homo Sapiens
aaacauauauguguguggcguguguauauauauguauauauauuuuuucauuguauuauuacgg

SEQ ID NO: 757094 - RNA, 64 nt, Homo Sapiens
cgcggggagcccgucgguaauuuuaauauuuuauuauauauauauaucuauauuuuuguccaaa

SEQ ID NO: 757095 - RNA, 64 nt, Homo Sapiens
cggggagcccgucgguaauuuuaauauuuuauuauauauauauaucuauauuuuuguccaaacc

SEQ ID NO: 757096 - RNA, 64 nt, Homo Sapiens
gggagcccgucgguaauuuuaauauuuuauuauauauauauaucuauauuuuuguccaaaccaa

SEQ ID NO: 757097 - RNA, 64 nt, Homo Sapiens
agcuagaaugcacaccaaaaaaauacuugagcuguauauauauaugugugugugugugugugug

SEQ ID NO: 757098 - RNA, 64 nt, Homo Sapiens
cuagaaugcacaccaaaaaaauacuugagcuguauauauauaugugugugugugugugugugug

SEQ ID NO: 757099 - RNA, 64 nt, Homo Sapiens
acuuuguccuucauaugugaccuugcuguguguauauauauaaucuuguuacagccccgccacc

SEQ ID NO: 757100 - RNA, 64 nt, Homo Sapiens
auacuuuguccuucauauguccccuugcuguguguauauauauacucuuguuacagccccgcca

SEQ ID NO: 757101 - RNA, 64 nt, Homo Sapiens
uauauaucucuaccauauguaaauuauauauaaauauauauaaagggacguccaaccacaaaag

SEQ ID NO: 757102 - RNA, 64 nt, Homo Sapiens
uauauauaaauauauaucucaccacaaaagaaauuauauauaaaacucagcuuugggacgucca

SEQ ID NO: 757103 - RNA, 64 nt, Homo Sapiens
ugagaaauaauucugauacuaaaugaaaacuaaauauauauaauguugaccucuuucucuguag

SEQ ID NO: 757104 - RNA, 64 nt, Homo Sapiens
cacacacacacacacauacaaaugcaaauauauauauauauacauguaguuuuuaaauuugggg

SEQ ID NO: 757105 - RNA, 64 nt, Homo Sapiens
cacacacacacacacacauaggaaugcaaauauauauauauauaauuguaguuuuuaaauuugg

SEQ ID NO: 757106 - RNA, 64 nt, Homo Sapiens
uacacacacacacacacacaggggaaugcaaauauauauauauaaaauuguaguuuuuaaauuu

SEQ ID NO: 757107 - RNA, 64 nt, Homo Sapiens
uauacacacacacacacacauuggggaaugcaaauauauauauaccaaauuguaguuuuuaaau

SEQ ID NO: 757108 - RNA, 64 nt, Homo Sapiens
gugccuuuuugguguugugaccuauuaaacuauauauauauacagucuuuuaaaauaaguauuu

SEQ ID NO: 757109 - RNA, 64 nt, Homo Sapiens
cagugccuuuuugguguuguuuccuauuaaacuauauauauauacagucuuuuaaaauaaguau

SEQ ID NO: 757110 - RNA, 64 nt, Homo Sapiens
uacagugccuuuuugguguuauuuccuauuaaacuauauauauagucagucuuuuaaaauaagu

SEQ ID NO: 757111 - RNA, 64 nt, Homo Sapiens
uagggaauuuuuuuuaauguaaaaaauauauauauauauauaaacaagaguaaaacuccaucuc

SEQ ID NO: 757112 - RNA, 64 nt, Homo Sapiens
aauagggaauuuuuuuuaauucaaaaaauauauauauauauauaaacaagaguaaaacuccauc

SEQ ID NO: 757113 - RNA, 64 nt, Homo Sapiens
uaaauagggaauuuuuuuuaucucaaaaaauauauauauauauagcaacaagaguaaaacucca

SEQ ID NO: 757114 - RNA, 64 nt, Homo Sapiens
uauaaauagggaauuuuuuucaucucaaaaaauauauauauauagggcaacaagaguaaaacuc

SEQ ID NO: 757115 - RNA, 64 nt, Homo Sapiens
uauauaaauagggaauuuuuuccaucucaaaaaauauauauauacugggcaacaagaguaaaac

SEQ ID NO: 757116 - RNA, 64 nt, Homo Sapiens
cacacacauauacaguauaauuaauuuauauauauauauauacaaguguuuauauacgugcaga

SEQ ID NO: 757117 - RNA, 64 nt, Homo Sapiens
cacacacacauauacaguaugauuaauuuauauauauauauauauuaguguuuauauacgugca

SEQ ID NO: 757118 - RNA, 64 nt, Homo Sapiens
uacacacacacauauacagucagauuaauuuauauauauauauauuuuaguguuuauauacgug

SEQ ID NO: 757119 - RNA, 64 nt, Homo Sapiens
uauacacacacacauauacaugcagauuaauuuauauauauauaccuuuuaguguuuauauacg

SEQ ID NO: 757120 - RNA, 64 nt, Homo Sapiens
uauauacacacacacauauacgugcagauuaauuuauauauauacuccuuuuaguguuuauaua

SEQ ID NO: 757121 - RNA, 64 nt, Homo Sapiens
uaucugguagaucacauguauauauauauauauauauauauaucuauauauauauauauauaua

SEQ ID NO: 757122 - RNA, 64 nt, Homo Sapiens
ucuaucugguagaucacauguauauauauauauauauauauauauauauauauauauauauaua

SEQ ID NO: 757123 - RNA, 64 nt, Homo Sapiens
uaucuaucugguagaucacauauauauauauauauauauauauauauauauauauauauauaua

SEQ ID NO: 757124 - RNA, 64 nt, Homo Sapiens
uauaucuaucugguagaucauauauauauauauauauauauauauauauauauauauauauaua

SEQ ID NO: 757125 - RNA, 64 nt, Homo Sapiens
uauauaucuaucugguagauuauauauauauauauauauauauaaauauauauauauauauaua

SEQ ID NO: 757126 - RNA, 64 nt, Homo Sapiens
uauauauaucuaucugguaguauauauauauauauauauauauauuaauauauauauauauaua

SEQ ID NO: 757127 - RNA, 64 nt, Homo Sapiens
uauauauauaucuaucugguuauauauauauauauauauauauauuuuaauauauauauauaua

SEQ ID NO: 757128 - RNA, 64 nt, Homo Sapiens
uauauauauauaucuaucuguauauauauauauauauauauauacuuuuuaauauauauauaua

SEQ ID NO: 757129 - RNA, 64 nt, Homo Sapiens
uauauauauauauaucuaucuauauauauauauauauauauauacucuuuuuaauauauauaua

SEQ ID NO: 757130 - RNA, 64 nt, Homo Sapiens
uauauauauauauauaucuauauauauauauauauauauauauacucucuuuuuaauauauaua

SEQ ID NO: 757131 - RNA, 64 nt, Homo Sapiens
uauauauauauauauauaucuauauauauauauauauauauauaggcucucuuuuuaauauaua

SEQ ID NO: 757132 - RNA, 64 nt, Homo Sapiens
uauauauauauauauauauauauauauauauauauauauauauaauggcucucuuuuuaauaua

SEQ ID NO: 757133 - RNA, 64 nt, Homo Sapiens
uauauauauauauauauauauauauauauauauauauauauauacuauggcucucuuuuuaaua

SEQ ID NO: 757134 - RNA, 64 nt, Homo Sapiens
uauauauauauauauauauauauauauauauauauauauauauauucuauggcucucuuuuuaa

SEQ ID NO: 757135 - RNA, 64 nt, Homo Sapiens
uauauauauauauauauauaaauauauauauauauauauauauaucuucuauggcucucuuuuu

SEQ ID NO: 757136 - RNA, 64 nt, Homo Sapiens
uauauauauauauauauauauuaauauauauauauauauauauaaaucuucuauggcucucuuu

SEQ ID NO: 757137 - RNA, 64 nt, Homo Sapiens
uauauauauauauauauauauuuuaauauauauauauauauauacaaaucuucuauggcucucu

SEQ ID NO: 757138 - RNA, 64 nt, Homo Sapiens
uauauauauauauauauauacuuuuuaauauauauauauauauauccaaaucuucuauggcucu

SEQ ID NO: 757139 - RNA, 64 nt, Homo Sapiens
uauauauauauauauauauacucuuuuuaauauauauauauauauuuccaaaucuucuauggcu

SEQ ID NO: 757140 - RNA, 64 nt, Homo Sapiens
uauauauauauauauauauacucucuuuuuaauauauauauauaguuuuccaaaucuucuaugg

SEQ ID NO: 757141 - RNA, 64 nt, Homo Sapiens
uauauauauauauauauauaggcucucuuuuuaauauauauauaagguuuuccaaaucuucuau

SEQ ID NO: 757142 - RNA, 64 nt, Homo Sapiens
auaagagaaacuguaugugcauuauauauauaaauauauauaaguuuguuuaaagaucugcaau

SEQ ID NO: 757143 - RNA, 64 nt, Homo Sapiens
uauauauaagauaagagaaagaucugcaauauuauauauauaaagcacaaaaccuuuguuuaaa

SEQ ID NO: 757144 - RNA, 64 nt, Homo Sapiens
aauauauauaagauaagagaaagaucugcaauauuauauauauauugcacaaaaccuuuguuua

SEQ ID NO: 757145 - RNA, 64 nt, Homo Sapiens
aauaagggcuauuguaaaauuuaaaagaaauauuuauauauacacauauauacacauacacaca

SEQ ID NO: 757146 - RNA, 64 nt, Homo Sapiens
uuuauauauacacauauauacacauacacacauguauauauauauucuucauaauggaggacaa

SEQ ID NO: 757147 - RNA, 64 nt, Homo Sapiens
uauauauacacauauauacacauacacacauguauauauauauucuucauaauggaggacaaug

SEQ ID NO: 757148 - RNA, 64 nt, Homo Sapiens
uaauuuuauauuaauauauaauacagauuaacauuauauauaauauguaccugugucacuucug

SEQ ID NO: 757149 - RNA, 64 nt, Homo Sapiens
aaccuggguaacauggccagaccccaucucuauuuauauauauauauauaaaacuuagaguuuu

SEQ ID NO: 757150 - RNA, 64 nt, Homo Sapiens
ccuggguaacauggccagaccccaucucuauuuauauauauauauauaaaacuuagaguuuuua

SEQ ID NO: 757151 - RNA, 64 nt, Homo Sapiens
uggguaacauggccagaccccaucucuauuuauauauauauauauaaaacuuagaguuuuuauc

SEQ ID NO: 757152 - RNA, 64 nt, Homo Sapiens
gguaacauggccagaccccaucucuauuuauauauauauauauaaaacuuagaguuuuuaucuu

SEQ ID NO: 757153 - RNA, 64 nt, Homo Sapiens
uaacauggccagaccccaucucuauuuauauauauauauauaaaacuuagaguuuuuaucuucc

SEQ ID NO: 757154 - RNA, 64 nt, Homo Sapiens
uauuuuccuuaauagaggaaauacagauuauauauauauauacauuguauuugaagauauaugg

SEQ ID NO: 757155 - RNA, 64 nt, Homo Sapiens
cauauuuuccuuaauagaggggauacagauuauauauauauauacauuguauuugaagauauau

SEQ ID NO: 757156 - RNA, 64 nt, Homo Sapiens
uacauauuuuccuuaauagaauggauacagauuauauauauauacccauuguauuugaagauau

SEQ ID NO: 757157 - RNA, 64 nt, Homo Sapiens
uauacauauuuuccuuaauaauauggauacagauuauauauauauacccauuguauuugaagau

SEQ ID NO: 757158 - RNA, 64 nt, Homo Sapiens
gacuuguuacaugaagauguauaauauguauauauauauauauuauauauauauauauauauau

SEQ ID NO: 757159 - RNA, 64 nt, Homo Sapiens
uugacuuguuacaugaagauauauaauauguauauauauauauaauauauauauauauauauau

SEQ ID NO: 757160 - RNA, 64 nt, Homo Sapiens
uauugacuuguuacaugaagauauauaauauguauauauauauaauauauauauauauauauau

SEQ ID NO: 757161 - RNA, 64 nt, Homo Sapiens
uauauugacuuguuacaugaauauauauaauauguauauauauauuauauauauauauauauau

SEQ ID NO: 757162 - RNA, 64 nt, Homo Sapiens
auguauauauauauauauuguauauauauauauauauauauaaugagaguauauauuuuauaua

SEQ ID NO: 757163 - RNA, 64 nt, Homo Sapiens
auauguauauauauauauauuauauauauauauauauauauauagugagaguauauauuuuaua

SEQ ID NO: 757164 - RNA, 64 nt, Homo Sapiens
uaauauguauauauauauauuauauauauauauauauauauauauggugagaguauauauuuua

SEQ ID NO: 757165 - RNA, 64 nt, Homo Sapiens
uauaauauguauauauauauuauauauauauauauauauauauaacuggugagaguauauauuu

SEQ ID NO: 757166 - RNA, 64 nt, Homo Sapiens
uauauaauauguauauauauuuuauauauauauauauauauauaaaacuggugagaguauauau

SEQ ID NO: 757167 - RNA, 64 nt, Homo Sapiens
uauauauaauauguauauauauuuuauauauauauauauauauaguaaacuggugagaguauau

SEQ ID NO: 757168 - RNA, 64 nt, Homo Sapiens
uauauauauaauauguauauauauuuuauauauauauauauauagaguaaacuggugagaguau

SEQ ID NO: 757169 - RNA, 64 nt, Homo Sapiens
uauauauauauaauauguauauauauuuuauauauauauauauaaagaguaaacuggugagagu

SEQ ID NO: 757170 - RNA, 64 nt, Homo Sapiens
uauauauauauauaauauguguauauauuuuauauauauauauaagaagaguaaacuggugaga

SEQ ID NO: 757171 - RNA, 64 nt, Homo Sapiens
uauauauauauauauaauaugaguauauauuuuauauauauauaacagaagaguaaacugguga

SEQ ID NO: 757172 - RNA, 64 nt, Homo Sapiens
uauauauauauauauauaaugagaguauauauuuuauauauauauuacagaagaguaaacuggu

SEQ ID NO: 757173 - RNA, 64 nt, Homo Sapiens
gauuauuuguuuuacacacauuugaguuuucuuauauauauauucuuauuuaaaacaacuuguu

SEQ ID NO: 757174 - RNA, 64 nt, Homo Sapiens
uugauuauuuguuuuacacauuuuugaguuuucuuauauauauagacuuauuuaaaacaacuug

SEQ ID NO: 757175 - RNA, 64 nt, Homo Sapiens
uugagcuugcuucuuucuuguacguuuauauaaauauauauaaagggugguuuuuauuuuuaua

SEQ ID NO: 757176 - RNA, 64 nt, Homo Sapiens
cucaguguccccugaacucuuuauuugccuaauuuauauauauauauaugagauauauaaauau

SEQ ID NO: 757177 - RNA, 64 nt, Homo Sapiens
caguguccccugaacucuuuauuugccuaauuuauauauauauauaugagauauauaaauauau

SEQ ID NO: 757178 - RNA, 64 nt, Homo Sapiens
guguccccugaacucuuuauuugccuaauuuauauauauauauaugagauauauaaauauauau

SEQ ID NO: 757179 - RNA, 64 nt, Homo Sapiens
guccccugaacucuuuauuugccuaauuuauauauauauauaugagauauauaaauauauauaa

SEQ ID NO: 757180 - RNA, 64 nt, Homo Sapiens
ccuaauuuauauauauauauaugagauauauaaauauauauaaaauagcuauuuugcuuaaauu

SEQ ID NO: 757181 - RNA, 64 nt, Homo Sapiens
gucuuucuuucuacuccaggacugguuuuguuuuuauauauauaaaaaaaaaaagugaaaacac

SEQ ID NO: 757182 - RNA, 64 nt, Homo Sapiens
cuuucuuucuacuccaggacugguuuuguuuuuauauauauaaaaaaaaaaagugaaaacacca

SEQ ID NO: 757183 - RNA, 64 nt, Homo Sapiens
uuuaaauuuuuauaucuauacauacauauauacauauauauauaauguacaauauauacauaga

SEQ ID NO: 757184 - RNA, 64 nt, Homo Sapiens
uaaauuuuuauaucuauacauacauauauacauauauauauaauguacaauauauacauagacu

SEQ ID NO: 757185 - RNA, 64 nt, Homo Sapiens
ucucuuagauuuuaauuuauccuguaaauuucuguauauauaauuuaauaacagaagccuccac

SEQ ID NO: 757186 - RNA, 64 nt, Homo Sapiens
cucccgcagcguuacugccuguguauaguauaaauauauauauuuucuauauauaagauguaua

SEQ ID NO: 757187 - RNA, 64 nt, Homo Sapiens
acugccuguguauaguauaaauauauauauuuucuauauauaagauguauaauauaaggcucca

SEQ ID NO: 757188 - RNA, 64 nt, Homo Sapiens
gcccaugguggcccuuccagugcauauacauacauauauauauauauaugcauauauauauaua

SEQ ID NO: 757189 - RNA, 64 nt, Homo Sapiens
ccaugguggcccuuccagugcauauacauacauauauauauauauaugcauauauauauauaua

SEQ ID NO: 757190 - RNA, 64 nt, Homo Sapiens
augguggcccuuccagugcauauacauacauauauauauauauaugcauauauauauauauaua

SEQ ID NO: 757191 - RNA, 64 nt, Homo Sapiens
gguggcccuuccagugcauauacauacauauauauauauauaugcauauauauauauauauaua

SEQ ID NO: 757192 - RNA, 64 nt, Homo Sapiens
agugcauauacauacauauauauauauauaugcauauauauauauauauauauauauaugugua

SEQ ID NO: 757193 - RNA, 64 nt, Homo Sapiens
ugcauauacauacauauauauauauauaugcauauauauauauauauauauauauauguguaua

SEQ ID NO: 757194 - RNA, 64 nt, Homo Sapiens
cauauacauacauauauauauauauaugcauauauauauauauauauauauauauguguauaca

SEQ ID NO: 757195 - RNA, 64 nt, Homo Sapiens
uauacauacauauauauauauauaugcauauauauauauauauauauauauauguguauacaca

SEQ ID NO: 757196 - RNA, 64 nt, Homo Sapiens
uacauacauauauauauauauaugcauauauauauauauauauauauauauguguauacacaca

SEQ ID NO: 757197 - RNA, 64 nt, Homo Sapiens
cauacauauauauauauauaugcauauauauauauauauauauauauauguguauacacacaca

SEQ ID NO: 757198 - RNA, 64 nt, Homo Sapiens
uacauauauauauauauaugcauauauauauauauauauauauauauguguauacacacacaca

SEQ ID NO: 757199 - RNA, 64 nt, Homo Sapiens
cauauauauauauauaugcauauauauauauauauauauauauauguguauacacacacacaua

SEQ ID NO: 757200 - RNA, 64 nt, Homo Sapiens
uauauauauauauaugcauauauauauauauauauauauauauguguauacacacacacauaga

SEQ ID NO: 757201 - RNA, 64 nt, Homo Sapiens
uauauauguguauacacacacacauagacagacauauauauauauauuuauuuuuuuuacugag

SEQ ID NO: 757202 - RNA, 64 nt, Homo Sapiens
uauauguguauacacacacacauagacagacauauauauauauauuuauuuuuuuuacugagag

SEQ ID NO: 757203 - RNA, 64 nt, Homo Sapiens
uauguguauacacacacacauagacagacauauauauauauauuuauuuuuuuuacugagagcu

SEQ ID NO: 757204 - RNA, 64 nt, Homo Sapiens
caaaagggguuaauguuacuuuaaaauuacauucuauauauauauaaauauauauaaauauaua

SEQ ID NO: 757205 - RNA, 64 nt, Homo Sapiens
aaagggguuaauguuacuuuaaaauuacauucuauauauauauaaauauauauaaauauauauu

SEQ ID NO: 757206 - RNA, 64 nt, Homo Sapiens
agggguuaauguuacuuuaaaauuacauucuauauauauauaaauauauauaaauauauauuaa

SEQ ID NO: 757207 - RNA, 64 nt, Homo Sapiens
guuacuuuaaaauuacauucuauauauauauaaauauauauaaauauauauuaaaauaccaguu

SEQ ID NO: 757208 - RNA, 64 nt, Homo Sapiens
gagaaaaaggaaagaugaaauaaauaaauaaacauauauauauagauauacacacacacauauc

SEQ ID NO: 757209 - RNA, 64 nt, Homo Sapiens
gaaaaaggaaagaugaaauaaauaaauaaacauauauauauagauauacacacacacauaucug

SEQ ID NO: 757210 - RNA, 64 nt, Homo Sapiens
ugacuggaagagauuaauuuaaaauauauauauauauauauagcaacauuuuguaaaaaaaaaa

SEQ ID NO: 757211 - RNA, 64 nt, Homo Sapiens
gcugacuggaagagauuaauaaaaaauauauauauauauauauaauaacauuuuguaaaaaaaa

SEQ ID NO: 757212 - RNA, 64 nt, Homo Sapiens
uagcugacuggaagagauuaaaaaaaaauauauauauauauauagaauaacauuuuguaaaaaa

SEQ ID NO: 757213 - RNA, 64 nt, Homo Sapiens
uauagcugacuggaagagauaaaaaaaaaauauauauauauauauggaauaacauuuuguaaaa

SEQ ID NO: 757214 - RNA, 64 nt, Homo Sapiens
uauauagcugacuggaagagaaaaaaaaaaaauauauauauauaucuggaauaacauuuuguaa

SEQ ID NO: 757215 - RNA, 64 nt, Homo Sapiens
uauauauagcugacuggaagaaaaaaaaaaaaaauauauauauaagucuggaauaacauuuugu

SEQ ID NO: 757216 - RNA, 64 nt, Homo Sapiens
uauggaaaacuaguuguuggucacucuguguauguauauauaccauauaccuauugaaauucuc

SEQ ID NO: 757217 - RNA, 64 nt, Homo Sapiens
uauugaaauucucucacucuacauauauaguagauauauauaccuguuuguguguguauaccug

SEQ ID NO: 757218 - RNA, 64 nt, Homo Sapiens
ucuauuuuuagucuggaaaggagggauaaauauauauauauaaaggguggggggaauuaaaagg

SEQ ID NO: 757219 - RNA, 64 nt, Homo Sapiens
aaucuauuuuuagucuggaagggagggauaaauauauauauauaaaggguggggggaauuaaaa

SEQ ID NO: 757220 - RNA, 64 nt, Homo Sapiens
uaaaucuauuuuuagucuggaagggagggauaaauauauauauagaaaggguggggggaauuaa

SEQ ID NO: 757221 - RNA, 64 nt, Homo Sapiens
augcccacuuuauuuuauauccaaguuagugcauuauauauauauuuuugcuuuggcuauauuu

SEQ ID NO: 757222 - RNA, 64 nt, Homo Sapiens
gcccacuuuauuuuauauccaaguuagugcauuauauauauauuuuugcuuuggcuauauuuac

SEQ ID NO: 757223 - RNA, 64 nt, Homo Sapiens
uuauuuccguuuuuuaaaugaguugauguacccuuauauauauauacauauauauauaaauaua

SEQ ID NO: 757224 - RNA, 64 nt, Homo Sapiens
auuuccguuuuuuaaaugaguugauguacccuuauauauauauacauauauauauaaauauaaa

SEQ ID NO: 757225 - RNA, 64 nt, Homo Sapiens
uuccguuuuuuaaaugaguugauguacccuuauauauauauacauauauauauaaauauaaaua

SEQ ID NO: 757226 - RNA, 64 nt, Homo Sapiens
uaaaugaguugauguacccuuauauauauauacauauauauauaaauauaaauauauauaaaaa

SEQ ID NO: 757227 - RNA, 64 nt, Homo Sapiens
aaugaguugauguacccuuauauauauauacauauauauauaaauauaaauauauauaaaaaca

SEQ ID NO: 757228 - RNA, 64 nt, Homo Sapiens
cuuauauauauauacauauauauauaaauauaaauauauauaaaaacaacaaaacaaaacaaaa

SEQ ID NO: 757229 - RNA, 64 nt, Homo Sapiens
agugcccaguuuuuguucauuuuugaaaucugauuauauauauuuuauauauacuuauguaugu

SEQ ID NO: 757230 - RNA, 64 nt, Homo Sapiens
uuuguucauuuuugaaaucugauuauauauauuuuauauauacuuauguauguauauauaauau

SEQ ID NO: 757231 - RNA, 64 nt, Homo Sapiens
cugauuauauauauuuuauauauacuuauguauguauauauaauauauauagaaaucuggauau

SEQ ID NO: 757232 - RNA, 64 nt, Homo Sapiens
uauauuuuauauauacuuauguauguauauauaauauauauagaaaucuggauauauauguaua

SEQ ID NO: 757233 - RNA, 64 nt, Homo Sapiens
auuuuauuuguaccuguaaauacuguacagcuaauauauauauauauauauauauaugugugug

SEQ ID NO: 757234 - RNA, 64 nt, Homo Sapiens
uuuauuuguaccuguaaauacuguacagcuaauauauauauauauauauauauaugugugugug

SEQ ID NO: 757235 - RNA, 64 nt, Homo Sapiens
uauuuguaccuguaaauacuguacagcuaauauauauauauauauauauauaugugugugugug

SEQ ID NO: 757236 - RNA, 64 nt, Homo Sapiens
uuuguaccuguaaauacuguacagcuaauauauauauauauauauauauaugugugugugugug

SEQ ID NO: 757237 - RNA, 64 nt, Homo Sapiens
uguaccuguaaauacuguacagcuaauauauauauauauauauauauaugugugugugugugug

SEQ ID NO: 757238 - RNA, 64 nt, Homo Sapiens
uaccuguaaauacuguacagcuaauauauauauauauauauauauaugugugugugugugugug

SEQ ID NO: 757239 - RNA, 64 nt, Homo Sapiens
ccuguaaauacuguacagcuaauauauauauauauauauauauaugugugugugugugugugug

SEQ ID NO: 757240 - RNA, 64 nt, Homo Sapiens
uguaaauacuguacagcuaauauauauauauauauauauauaugugugugugugugugugugua

SEQ ID NO: 757241 - RNA, 64 nt, Homo Sapiens
uguuuauagagauacacacacauauauauguguguauauauauacacauacauauauauacaca

SEQ ID NO: 757242 - RNA, 64 nt, Homo Sapiens
uuuauagagauacacacacauauauauguguguauauauauacacauacauauauauacacaca

SEQ ID NO: 757243 - RNA, 64 nt, Homo Sapiens
cacauauauauguguguauauauauacacauacauauauauacacacacgcauuugcacagaca

SEQ ID NO: 757244 - RNA, 64 nt, Homo Sapiens
guauuuuuugaauugaguauaaucacuuugcuaguauauauaauuuaauagauuuuauuuaucu

SEQ ID NO: 757245 - RNA, 64 nt, Homo Sapiens
uuuauaaauguguauuucuguguauucacauacauauauauauacacacauauauauguacaua

SEQ ID NO: 757246 - RNA, 64 nt, Homo Sapiens
uauaaauguguauuucuguguauucacauacauauauauauacacacauauauauguacauaca

SEQ ID NO: 757247 - RNA, 64 nt, Homo Sapiens
uaaauaagccacccuucugauugucguucuacuguauauauauauauauuugaguguuguuugu

SEQ ID NO: 757248 - RNA, 64 nt, Homo Sapiens
aauaagccacccuucugauugucguucuacuguauauauauauauauuugaguguuguuugugu

SEQ ID NO: 757249 - RNA, 64 nt, Homo Sapiens
uaagccacccuucugauugucguucuacuguauauauauauauauuugaguguuguuuguguuu

SEQ ID NO: 757250 - RNA, 64 nt, Homo Sapiens
agccacccuucugauugucguucuacuguauauauauauauauuugaguguuguuuguguuuca

SEQ ID NO: 757251 - RNA, 64 nt, Homo Sapiens
uuuugaagaauuccuuuuguguuuuaaaaugugauauauauauauauaaaauuccuaggaugca

SEQ ID NO: 757252 - RNA, 64 nt, Homo Sapiens
uugaagaauuccuuuuguguuuuaaaaugugauauauauauauauaaaauuccuaggaugcagu

SEQ ID NO: 757253 - RNA, 64 nt, Homo Sapiens
gaagaauuccuuuuguguuuuaaaaugugauauauauauauauaaaauuccuaggaugcagugu

SEQ ID NO: 757254 - RNA, 64 nt, Homo Sapiens
agaauuccuuuuguguuuuaaaaugugauauauauauauauaaaauuccuaggaugcagugucu

SEQ ID NO: 757255 - RNA, 64 nt, Homo Sapiens
gugugggaauagggaucuaaauuuuaaauaaaauuauauauauauauaaauuggugcugauuuu

SEQ ID NO: 757256 - RNA, 64 nt, Homo Sapiens
gugggaauagggaucuaaauuuuaaauaaaauuauauauauauauaaauuggugcugauuuuau

SEQ ID NO: 757257 - RNA, 64 nt, Homo Sapiens
gggaauagggaucuaaauuuuaaauaaaauuauauauauauauaaauuggugcugauuuuauaa

SEQ ID NO: 757258 - RNA, 64 nt, Homo Sapiens
gaauagggaucuaaauuuuaaauaaaauuauauauauauauaaauuggugcugauuuuauaauu

SEQ ID NO: 757259 - RNA, 64 nt, Homo Sapiens
ggggaaaaguuucuuucagagaguuaaguuauuuuauauauauaauauauauauaaaauauaua

SEQ ID NO: 757260 - RNA, 64 nt, Homo Sapiens
ggaaaaguuucuuucagagaguuaaguuauuuuauauauauaauauauauauaaaauauauaau

SEQ ID NO: 757261 - RNA, 64 nt, Homo Sapiens
ucuuucagagaguuaaguuauuuuauauauauaauauauauauaaaauauauaauauacaauau

SEQ ID NO: 757262 - RNA, 64 nt, Homo Sapiens
uuucagagaguuaaguuauuuuauauauauaauauauauauaaaauauauaauauacaauauaa

SEQ ID NO: 757263 - RNA, 64 nt, Homo Sapiens
uuuuccuuucaaaucagacguauauaauguuuuauauauauauuucuuccuggaacucacuuuu

SEQ ID NO: 757264 - RNA, 64 nt, Homo Sapiens
uuuuuuccuuucaaaucagauuuauauaauguuuuauauauauauuucuuccuggaacucacuu

SEQ ID NO: 757265 - RNA, 64 nt, Homo Sapiens
uuaauucagaguuacauacagagugacugauauauauauauauuccaauaaggauuuagaacca

SEQ ID NO: 757266 - RNA, 64 nt, Homo Sapiens
uuuuaauucagaguuacauacagagugacugauauauauauauagcccaauaaggauuuagaac

SEQ ID NO: 757267 - RNA, 64 nt, Homo Sapiens
uauuuuaauucagaguuacaaccagagugacugauauauauauauugcccaauaaggauuuaga

SEQ ID NO: 757268 - RNA, 64 nt, Homo Sapiens
cacacacacacacauuagucuauauaaauauauauauauauacauuuucauugugcucuguacg

SEQ ID NO: 757269 - RNA, 64 nt, Homo Sapiens
cacacacacacacacauuagcguauauaaauauauauauauauagcuuuucauugugcucugua

SEQ ID NO: 757270 - RNA, 64 nt, Homo Sapiens
uacacacacacacacacauuuacguauauaaauauauauauauagugcuuuucauugugcucug

SEQ ID NO: 757271 - RNA, 64 nt, Homo Sapiens
uauacacacacacacacacauguacguauauaaauauauauauauugugcuuuucauugugcuc

SEQ ID NO: 757272 - RNA, 64 nt, Homo Sapiens
uccuuucauauuauuuuacuugcuaaauuuacaguauauauagaucuguacauaaaaguguuuu

SEQ ID NO: 757273 - RNA, 64 nt, Homo Sapiens
uuuuaauuucauagcaacuuaaacacuuaagauauauauauaaauacaauuuugagugcuuuau

SEQ ID NO: 757274 - RNA, 64 nt, Homo Sapiens
aauuuuaauuucauagcaacauaaacacuuaagauauauauauagcuacaauuuugagugcuuu

SEQ ID NO: 757275 - RNA, 64 nt, Homo Sapiens
uaucuauuuaucugucugagauauauauauauauuauauauaaaagacccugucuuugcuguuu

SEQ ID NO: 757276 - RNA, 64 nt, Homo Sapiens
auauauaaauaucuauuuauuugcuguuuauauauauauauauucaagccaggagacccugucu

SEQ ID NO: 757277 - RNA, 64 nt, Homo Sapiens
uuauauauaaauaucuauuucuuugcuguuuauauauauauauacucaagccaggagacccugu

SEQ ID NO: 757278 - RNA, 64 nt, Homo Sapiens
uauuauauauaaauaucuaugucuuugcuguuuauauauauauacccucaagccaggagacccu

SEQ ID NO: 757279 - RNA, 64 nt, Homo Sapiens
uauauuauauauaaauaucucugucuuugcuguuuauauauauaaccccucaagccaggagacc

SEQ ID NO: 757280 - RNA, 64 nt, Homo Sapiens
uuuuuguucuguuugcauuugaaaaaauuauauauauauauauucuugaaaccuuuggauaggg

SEQ ID NO: 757281 - RNA, 64 nt, Homo Sapiens
uuuuuuuguucuguuugcaugggaaaaaauuauauauauauauagacuugaaaccuuuggauag

SEQ ID NO: 757282 - RNA, 64 nt, Homo Sapiens
uauuuuuuuguucuguuugcaggggaaaaaauuauauauauauagagacuugaaaccuuuggau

SEQ ID NO: 757283 - RNA, 64 nt, Homo Sapiens
uauauuuuuuuguucuguuuauaggggaaaaaauuauauauauauugagacuugaaaccuuugg

SEQ ID NO: 757284 - RNA, 64 nt, Homo Sapiens
caaaacugucauuuaccuguuauauacacaaauauauauauacacguauacauauauacaacua

SEQ ID NO: 757285 - RNA, 64 nt, Homo Sapiens
cacaaaacugucauuuaccuuauauauacacaaauauauauauagccguauacauauauacaac

SEQ ID NO: 757286 - RNA, 64 nt, Homo Sapiens
caaauauauauauacacaaauacauauauacaacuauauauacaccuuugugucuacugccgua

SEQ ID NO: 757287 - RNA, 64 nt, Homo Sapiens
uguguguguguguugcuuauuuuauauauaugcauauauauauggcacuuuuucuuaaucauuu

SEQ ID NO: 757288 - RNA, 64 nt, Homo Sapiens
cauauauauaugugugugugucuuaaucauuuuuuauauauaugcuguuauucuuugcacuuuu

SEQ ID NO: 757289 - RNA, 64 nt, Homo Sapiens
cacacauauauaggcaguugcacacagacauauauauauauaugauugaauggaucaauacaca

SEQ ID NO: 757290 - RNA, 64 nt, Homo Sapiens
ugcacacauauauaggcagucacacacagacauauauauauauaacauugaauggaucaauaca

SEQ ID NO: 757291 - RNA, 64 nt, Homo Sapiens
uaugcacacauauauaggcacacacacacagacauauauauauaugacauugaauggaucaaua

SEQ ID NO: 757292 - RNA, 64 nt, Homo Sapiens
uguauauuuuuuuuaauuucguuucuugcucauauauauauagaugggaccaaaaaaugcacuu

SEQ ID NO: 757293 - RNA, 64 nt, Homo Sapiens
gauguauauuuuuuuuaauuuuguuucuugcucauauauauauaauugggaccaaaaaaugcac

SEQ ID NO: 757294 - RNA, 64 nt, Homo Sapiens
uuacaaaguauuuuguugcacauucagagaauuuuauauauauaugucuuguguggguguccuc

SEQ ID NO: 757295 - RNA, 64 nt, Homo Sapiens
acaaaguauuuuguugcacauucagagaauuuuauauauauaugucuuguguggguguccucga

SEQ ID NO: 757296 - RNA, 64 nt, Homo Sapiens
ccuccucuucuagaauugcuuugcucuauuuuuguauauauaaauauguuaugaugauuauuaa

SEQ ID NO: 757297 - RNA, 64 nt, Homo Sapiens
gugagugagugugcguauguaucccuucugugauuauauauauucacacaucucuauauauuuu

SEQ ID NO: 757298 - RNA, 64 nt, Homo Sapiens; identical to SEQ ID NO: 283920

SEQ ID NO: 757299 - RNA, 64 nt, Homo Sapiens; identical to SEQ ID NO: 283921

SEQ ID NO: 757300 - RNA, 64 nt, Homo Sapiens; identical to SEQ ID NO: 283922

SEQ ID NO: 757301 - RNA, 64 nt, Homo Sapiens; identical to SEQ ID NO: 283923

SEQ ID NO: 757302 - RNA, 64 nt, Homo Sapiens; identical to SEQ ID NO: 283924

SEQ ID NO: 757303 - RNA, 64 nt, Homo Sapiens; identical to SEQ ID NO: 283925

SEQ ID NO: 757304 - RNA, 64 nt, Homo Sapiens; identical to SEQ ID NO: 283926

SEQ ID NO: 757305 - RNA, 64 nt, Homo Sapiens; identical to SEQ ID NO: 283927

SEQ ID NO: 757306 - RNA, 64 nt, Homo Sapiens; identical to SEQ ID NO: 283928

SEQ ID NO: 757307 - RNA, 64 nt, Homo Sapiens; identical to SEQ ID NO: 283929

SEQ ID NO: 757308 - RNA, 64 nt, Homo Sapiens; identical to SEQ ID NO: 283930

SEQ ID NO: 757309 - RNA, 64 nt, Homo Sapiens; identical to SEQ ID NO: 283931

SEQ ID NO: 757310 - RNA, 64 nt, Homo Sapiens; identical to SEQ ID NO: 283932

SEQ ID NO: 757311 - RNA, 64 nt, Homo Sapiens; identical to SEQ ID NO: 283933

SEQ ID NO: 757312 - RNA, 64 nt, Homo Sapiens; identical to SEQ ID NO: 283934

SEQ ID NO: 757313 - RNA, 64 nt, Homo Sapiens; identical to SEQ ID NO: 283935

SEQ ID NO: 757314 - RNA, 64 nt, Homo Sapiens; identical to SEQ ID NO: 283930

SEQ ID NO: 757315 - RNA, 64 nt, Homo Sapiens; identical to SEQ ID NO: 283937

SEQ ID NO: 757316 - RNA, 64 nt, Homo Sapiens; identical to SEQ ID NO: 283938

SEQ ID NO: 757317 - RNA, 64 nt, Homo Sapiens; identical to SEQ ID NO: 283939

SEQ ID NO: 757318 - RNA, 64 nt, Homo Sapiens; identical to SEQ ID NO: 283940

SEQ ID NO: 757319 - RNA, 64 nt, Homo Sapiens; identical to SEQ ID NO: 283941

SEQ ID NO: 757320 - RNA, 64 nt, Homo Sapiens; identical to SEQ ID NO: 283942

SEQ ID NO: 757321 - RNA, 64 nt, Homo Sapiens; identical to SEQ ID NO: 283943

SEQ ID NO: 757322 - RNA, 64 nt, Homo Sapiens; identical to SEQ ID NO: 283944

SEQ ID NO: 757323 - RNA, 60 nt, Homo Sapiens; identical to SEQ ID NO: 283945

SEQ ID NO: 757324 - RNA, 64 nt, Homo Sapiens; identical to SEQ ID NO: 283946

SEQ ID NO: 757325 - RNA, 64 nt, Homo Sapiens; identical to SEQ ID NO: 283947

SEQ ID NO: 757326 - RNA, 64 nt, Homo Sapiens; identical to SEQ ID NO: 283948

SEQ ID NO: 757327 - RNA, 64 nt, Homo Sapiens; identical to SEQ ID NO: 283949

SEQ ID NO: 757328 - RNA, 64 nt, Homo Sapiens; identical to SEQ ID NO: 283950

SEQ ID NO: 757329 - RNA, 64 nt, Homo Sapiens; identical to SEQ ID NO: 283951

SEQ ID NO: 757330 - RNA, 64 nt, Homo Sapiens; identical to SEQ ID NO: 283952

SEQ ID NO: 757331 - RNA, 64 nt, Homo Sapiens; identical to SEQ ID NO: 283953

SEQ ID NO: 757332 - RNA, 64 nt, Homo Sapiens; identical to SEQ ID NO: 283954

SEQ ID NO: 757333 - RNA, 64 nt, Homo Sapiens; identical to SEQ ID NO: 283955

SEQ ID NO: 757334 - RNA, 64 nt, Homo Sapiens; identical to SEQ ID NO: 283956

SEQ ID NO: 757335 - RNA, 64 nt, Homo Sapiens; identical to SEQ ID NO: 283957

SEQ ID NO: 757336 - RNA, 64 nt, Homo Sapiens; identical to SEQ ID NO: 283958

SEQ ID NO: 757337 - RNA, 64 nt, Homo Sapiens; identical to SEQ ID NO: 283959

SEQ ID NO: 757338 - RNA, 64 nt, Homo Sapiens; identical to SEQ ID NO: 283960

SEQ ID NO: 757339 - RNA, 64 nt, Homo Sapiens; identical to SEQ ID NO: 283961

SEQ ID NO: 757340 - RNA, 64 nt, Homo Sapiens; identical to SEQ ID NO: 283962

SEQ ID NO: 757341 - RNA, 64 nt, Homo Sapiens; identical to SEQ ID NO: 283963

SEQ ID NO: 757342 - RNA, 64 nt, Homo Sapiens; identical to SEQ ID NO: 283964

SEQ ID NO: 757343 - RNA, 64 nt, Homo Sapiens; identical to SEQ ID NO: 283965

SEQ ID NO: 757344 - RNA, 64 nt, Homo Sapiens; identical to SEQ ID NO: 283966

SEQ ID NO: 757345 - RNA, 64 nt, Homo Sapiens; identical to SEQ ID NO: 283967

SEQ ID NO: 757346 - RNA, 64 nt, Homo Sapiens; identical to SEQ ID NO: 283968

SEQ ID NO: 757347 - RNA, 64 nt, Homo Sapiens; identical to SEQ ID NO: 283969

SEQ ID NO: 757348 - RNA, 64 nt, Homo Sapiens; identical to SEQ ID NO: 283970

SEQ ID NO: 757349 - RNA, 64 nt, Homo Sapiens; identical to SEQ ID NO: 283971

SEQ ID NO: 757350 - RNA, 64 nt, Homo Sapiens; identical to SEQ ID NO: 283972

SEQ ID NO: 757351 - RNA, 64 nt, Homo Sapiens; identical to SEQ ID NO: 283973

SEQ ID NO: 757352 - RNA, 64 nt, Homo Sapiens; identical to SEQ ID NO: 283974

SEQ ID NO: 757353 - RNA, 64 nt, Homo Sapiens; identical to SEQ ID NO: 283975

SEQ ID NO: 757354 - RNA, 64 nt, Homo Sapiens; identical to SEQ ID NO: 283976

SEQ ID NO: 757355 - RNA, 64 nt, Homo Sapiens; identical to SEQ ID NO: 283977

SEQ ID NO: 757356 - RNA, 64 nt, Homo Sapiens; identical to SEQ ID NO: 283978

SEQ ID NO: 757357 - RNA, 64 nt, Homo Sapiens; identical to SEQ ID NO: 283979

SEQ ID NO: 757358 - RNA, 64 nt, Homo Sapiens; identical to SEQ ID NO: 283980

SEQ ID NO: 757359 - RNA, 64 nt, Homo Sapiens; identical to SEQ ID NO: 283981

SEQ ID NO: 757360 - RNA, 64 nt, Homo Sapiens; identical to SEQ ID NO: 283982

SEQ ID NO: 757361 - RNA, 64 nt, Homo Sapiens; identical to SEQ ID NO: 283983

SEQ ID NO: 757362 - RNA, 64 nt, Homo Sapiens; identical to SEQ ID NO: 283984

SEQ ID NO: 757363 - RNA, 64 nt, Homo Sapiens; identical to SEQ ID NO: 114926

SEQ ID NO: 757364 - RNA, 64 nt, Homo Sapiens; identical to SEQ ID NO: 114927

SEQ ID NO: 757365 - RNA, 64 nt, Homo Sapiens
ucugaaacccccauggaugaagcagagacucccugcccaucaagcaccuccaguuuggcuucug

SEQ ID NO: 757366 - RNA, 64 nt, Homo Sapiens
ccuguccugcagaggauggucugccccaccacucgcccaucagggacuccgacugaggcaugcc

SEQ ID NO: 757367 - RNA, 64 nt, Homo Sapiens
uugcugucuacagccaacuauucuauuaguuacaaaacucaaucauuuuauucagcaacuggau

SEQ ID NO: 757368 - RNA, 64 nt, Homo Sapiens
caucaaaaaaauaaaguaaaauagaaaacugagaaaacucaauccaugaccagggagaacuuac

SEQ ID NO: 757369 - RNA, 64 nt, Homo Sapiens
gaagaauggugccaccacucaagcaacaagccucaaacucaaccaugucaucuuuuucuuggau

SEQ ID NO: 757370 - RNA, 64 nt, Homo Sapiens
cauaaaggacaagaugguuaagucaauucuguuaaaacucaaggcuuauauuaagcaaacacuu

SEQ ID NO: 757371 - RNA, 64 nt, Homo Sapiens
uggcaccuacugaauuaaaaauuaaggauuuuauaaacucaaauuuuucugcacaaagaauaaa

SEQ ID NO: 757372 - RNA, 64 nt, Homo Sapiens
ccucacagauuauaauagaauuuuuaaaacuuaaaaacucaacacuggcuuugauuaaaggcca

SEQ ID NO: 757373 - RNA, 64 nt, Homo Sapiens
aguuucucuguuugcuugucauagcagcauuuggaaacucaaacaugcuuucauuuacauaaau

SEQ ID NO: 757374 - RNA, 64 nt, Homo Sapiens
uaaggguauuaauuauugaaagucccuuuccccaaaacucaacuccuauggcaauuaugaacuc

SEQ ID NO: 757375 - RNA, 64 nt, Homo Sapiens
aagugucuuuucagccuuuccaucuuuacaaauaaaacucaaaaaagccguccagcuuauccca

SEQ ID NO: 757376 - RNA, 64 nt, Homo Sapiens
ccuaaggauugccugugugcuggaaauauauuugaaacucaaccaguaugcccagccuauugca

SEQ ID NO: 757377 - RNA, 64 nt, Homo Sapiens
cuuugucacgucugauauuauuguccaggcaaauaaacucaaauaaaagccagacaaacccaag

SEQ ID NO: 757378 - RNA, 64 nt, Homo Sapiens
ugaguuuuaccaauuaauguuaucacaucuuugaaaacucaauuauauuggugcacuuuaauac

SEQ ID NO: 757379 - RNA, 64 nt, Homo Sapiens
ccaucaucucuuaucucuauaguugguuccuagaaaacucaauacuuuaaaaaucuuucccaga

SEQ ID NO: 757380 - RNA, 64 nt, Homo Sapiens
cagauaaagauaaauaugugaaaauguuuaaaagaaacucaauaaaccaucuguuacuguucua

SEQ ID NO: 757381 - RNA, 64 nt, Homo Sapiens
uuuagaaaaacucauucaugucucgaaaaccaauaaacucaaagagcuuuggcaugacuguuug

SEQ ID NO: 757382 - RNA, 60 nt, Homo Sapiens; identical to SEQ ID NO: 93955

SEQ ID NO: 757383 - RNA, 64 nt, Homo Sapiens
uaguaaaagcaccuagugugcaaaaaaaaaaaaaaaacucaagaaggacuauuucucuaaaacu

SEQ ID NO: 757384 - RNA, 64 nt, Homo Sapiens
aaaaaaaaaaaacucaagauggacuauuucucuaaaacucaaaaguuucuaagucauauuaaaa

SEQ ID NO: 757385 - RNA, 64 nt, Homo Sapiens
uuaagacuagaaccuauaggaaacuacuuggagcaaacucaaaggacagauuagggaucgagau

SEQ ID NO: 757386 - RNA, 64 nt, Homo Sapiens
gcagaaagcgugauagaggagagaauuuuugacaaaacucaaaaguuguuugcacagcuguucu

SEQ ID NO: 757387 - RNA, 64 nt, Homo Sapiens
cauguagauguuuuguguguauuuuuuuaaaugaaaacucaaaauaagacaaguaauuuguuga

SEQ ID NO: 757388 - RNA, 64 nt, Homo Sapiens
acccagcaagcuacaaagagggugugucacacugaaacucaauaguugaguuuggcuguuguug

SEQ ID NO: 757389 - RNA, 64 nt, Homo Sapiens
uugucaguauggcuuuuaguacugaagccaaaugaaacucaaaaccaucucucuuccagcugcu

SEQ ID NO: 757390 - RNA, 64 nt, Homo Sapiens
uugugaaucaccaaaggagcuauggagagaauuaaaacucaacauuacuguuaacugugcguua

SEQ ID NO: 757391 - RNA, 64 nt, Homo Sapiens
acuaugaaauuucaccuaauugccaguguugaguaaacucaacucucaaacucaguccaucuga

SEQ ID NO: 757392 - RNA, 62 nt, Homo Sapiens
ucaguccaucugaugccaguuuggcaccacucaaacucaaaccaccuggagguggccauuaa

SEQ ID NO: 757393 - RNA, 64 nt, Homo Sapiens
uauauguaaucccaacaucuaauuuuagucuuagaaacucaaacuauuaauaaguggaaaaagu

SEQ ID NO: 757394 - RNA, 64 nt, Homo Sapiens
ugcucacuuguugcaguacaaucaucggguuaaaaaacucaaugaaaucagcaaacugggaauu

SEQ ID NO: 757395 - RNA, 64 nt, Homo Sapiens
aagcuucaaugucuuuuuuuuuuuuuucauggaaaaacucaaaccucuguuauuugggagcuca

SEQ ID NO: 757396 - RNA, 64 nt, Homo Sapiens
aguuuugcuugacaguuucuaaacaaacaaaaauaaacucaaugaaaggaaagauguuucuuuu

SEQ ID NO: 757397 - RNA, 64 nt, Homo Sapiens
ggaaaauaucuuggggccccagaaucacuaaggaaaacucaagcuuagggaaacuucuuagggc

SEQ ID NO: 757398 - RNA, 64 nt, Homo Sapiens
auaucugauugccuccuuuggaaaggcuaaucagaaacucaaaagaaugcaacuguuugugucu

SEQ ID NO: 757399 - RNA, 64 nt, Homo Sapiens
aucugaucaauuuggaauauauaaaguguacuaaaaacucaacugaagucaggcaugguagcuc

SEQ ID NO: 757400 - RNA, 64 nt, Homo Sapiens
ugaggccucaucucaaaaaaaaaaaaaggccacaaaacucaacaauaaaaacaaacaguccaau

SEQ ID NO: 757401 - RNA, 64 nt, Homo Sapiens
gcagucaauuauucacgccaugcccuaaaacuccaaacucaaauuauuuugcuuaagucaacag

SEQ ID NO: 757402 - RNA, 64 nt, Homo Sapiens
ugcagcuggacugcaggcuuaggguaaagcaagaaaacucaagccaagacagacaguauuggau

SEQ ID NO: 757403 - RNA, 64 nt, Homo Sapiens; identical to SEQ ID NO: 94908

SEQ ID NO: 757404 - RNA, 64 nt, Homo Sapiens; identical to SEQ ID NO: 94909

SEQ ID NO: 757405 - RNA, 64 nt, Homo Sapiens; identical to SEQ ID NO: 94910

SEQ ID NO: 757406 - RNA, 64 nt, Homo Sapiens; identical to SEQ ID NO: 94911

SEQ ID NO: 757407 - RNA, 64 nt, Homo Sapiens; identical to SEQ ID NO: 94912

SEQ ID NO: 757408 - RNA, 64 nt, Homo Sapiens; identical to SEQ ID NO: 94913

SEQ ID NO: 757409 - RNA, 64 nt, Homo Sapiens; identical to SEQ ID NO: 94914

SEQ ID NO: 757410 - RNA, 64 nt, Homo Sapiens; identical to SEQ ID NO: 94915

SEQ ID NO: 757411 - RNA, 64 nt, Homo Sapiens; identical to SEQ ID NO: 94916

SEQ ID NO: 757412 - RNA, 64 nt, Homo Sapiens; identical to SEQ ID NO: 94917

SEQ ID NO: 757413 - RNA, 64 nt, Homo Sapiens; identical to SEQ ID NO: 94918

SEQ ID NO: 757414 - RNA, 64 nt, Homo Sapiens; identical to SEQ ID NO: 94919

SEQ ID NO: 757415 - RNA, 64 nt, Homo Sapiens; identical to SEQ ID NO: 94920

SEQ ID NO: 757416 - RNA, 64 nt, Homo Sapiens; identical to SEQ ID NO: 94921

SEQ ID NO: 757417 - RNA, 64 nt, Homo Sapiens; identical to SEQ ID NO: 94922

SEQ ID NO: 757418 - RNA, 64 nt, Homo Sapiens; identical to SEQ ID NO: 94923

SEQ ID NO: 757419 - RNA, 64 nt, Homo Sapiens; identical to SEQ ID NO: 94924

SEQ ID NO: 757420 - RNA, 64 nt, Homo Sapiens; identical to SEQ ID NO: 94925

SEQ ID NO: 757421 - RNA, 64 nt, Homo Sapiens; identical to SEQ ID NO: 94926

SEQ ID NO: 757422 - RNA, 64 nt, Homo Sapiens; identical to SEQ ID NO: 94927

SEQ ID NO: 757423 - RNA, 64 nt, Homo Sapiens; identical to SEQ ID NO: 94928

SEQ ID NO: 757424 - RNA, 64 nt, Homo Sapiens; identical to SEQ ID NO: 94929

SEQ ID NO: 757425 - RNA, 64 nt, Homo Sapiens; identical to SEQ ID NO: 94930

SEQ ID NO: 757426 - RNA, 64 nt, Homo Sapiens; identical to SEQ ID NO: 94931

SEQ ID NO: 757427 - RNA, 64 nt, Homo Sapiens; identical to SEQ ID NO: 263107

SEQ ID NO: 757428 - RNA, 64 nt, Homo Sapiens; identical to SEQ ID NO: 263108

SEQ ID NO: 757429 - RNA, 64 nt, Homo Sapiens; identical to SEQ ID NO: 263109

SEQ ID NO: 757430 - RNA, 64 nt, Homo Sapiens; identical to SEQ ID NO: 263110

SEQ ID NO: 757431 - RNA, 64 nt, Homo Sapiens; identical to SEQ ID NO: 263111

SEQ ID NO: 757432 - RNA, 64 nt, Homo Sapiens; identical to SEQ ID NO: 263112

SEQ ID NO: 757433 - RNA, 64 nt, Homo Sapiens; identical to SEQ ID NO: 263113

SEQ ID NO: 757434 - RNA, 64 nt, Homo Sapiens; identical to SEQ ID NO: 263114

SEQ ID NO: 757435 - RNA, 64 nt, Homo Sapiens; identical to SEQ ID NO: 263115

SEQ ID NO: 757436 - RNA, 64 nt, Homo Sapiens; identical to SEQ ID NO: 263116

SEQ ID NO: 757437 - RNA, 64 nt, Homo Sapiens; identical to SEQ ID NO: 263117

SEQ ID NO: 757438 - RNA, 64 nt, Homo Sapiens; identical to SEQ ID NO: 263118

SEQ ID NO: 757439 - RNA, 64 nt, Homo Sapiens; identical to SEQ ID NO: 263119

SEQ ID NO: 757440 - RNA, 64 nt, Homo Sapiens; identical to SEQ ID NO: 263120

SEQ ID NO: 757441 - RNA, 64 nt, Homo Sapiens; identical to SEQ ID NO: 494502

SEQ ID NO: 757442 - RNA, 64 nt, Homo Sapiens; identical to SEQ ID NO: 494503

SEQ ID NO: 757443 - RNA, 64 nt, Homo Sapiens; identical to SEQ ID NO: 494504

SEQ ID NO: 757444 - RNA, 64 nt, Homo Sapiens; identical to SEQ ID NO: 494505

SEQ ID NO: 757445 - RNA, 64 nt, Homo Sapiens; identical to SEQ ID NO: 494506

SEQ ID NO: 757446 - RNA, 64 nt, Homo Sapiens; identical to SEQ ID NO: 494507

SEQ ID NO: 757447 - RNA, 64 nt, Homo Sapiens; identical to SEQ ID NO: 494508

SEQ ID NO: 757448 - RNA, 64 nt, Homo Sapiens; identical to SEQ ID NO: 494509

SEQ ID NO: 757449 - RNA, 64 nt, Homo Sapiens; identical to SEQ ID NO: 494510

SEQ ID NO: 757450 - RNA, 64 nt, Homo Sapiens; identical to SEQ ID NO: 494511

SEQ ID NO: 757451 - RNA, 64 nt, Homo Sapiens; identical to SEQ ID NO: 494512

SEQ ID NO: 757452 - RNA, 64 nt, Homo Sapiens; identical to SEQ ID NO: 494513

SEQ ID NO: 757453 - RNA, 64 nt, Homo Sapiens; identical to SEQ ID NO: 494514

SEQ ID NO: 757454 - RNA, 64 nt, Homo Sapiens; identical to SEQ ID NO: 494515

SEQ ID NO: 757455 - RNA, 62 nt, Homo Sapiens
gaacuuuccagcucccccucaucaugccuccuccuuccuaccugccuccccucugcuggugc

SEQ ID NO: 757456 - RNA, 62 nt, Homo Sapiens
cucucaucuuacuuuuucuucucagauuucucccuuccuagaacauucucucuguuuagcac

SEQ ID NO: 757457 - RNA, 62 nt, Homo Sapiens
uuguugcuguuggucauuuggccugccuuuucccuuccuauuucacuuugccucccaucaca

SEQ ID NO: 757458 - RNA, 62 nt, Homo Sapiens
auaaagucaucuaacuauuaaaaaaaaaacacccuuccuaacccuucuuuucuuaaaauucc

SEQ ID NO: 757459 - RNA, 62 nt, Homo Sapiens
ucucaauagucuuuaaacccaaucucucaauaccuuccuauucugcucugaugaaacccaau

SEQ ID NO: 757460 - RNA, 62 nt, Homo Sapiens
ucucaauagucuuuaagcccagucucucaauaccuuccuauuaguccgcucugaugaaaccc

SEQ ID NO: 757461 - RNA, 62 nt, Homo Sapiens
acuuacgcuucaaguuucauauauugaacauaccuuccuaccucuaaaauucagcuuuaaaa

SEQ ID NO: 757462 - RNA, 62 nt, Homo Sapiens
gucaugguuuguuauagagaaagacaagucauccuuccuacuugugugugcucuauugaugc

SEQ ID NO: 757463 - RNA, 62 nt, Homo Sapiens
acuugaugcaugugguuuggcccuucuugcauccuuccuauacucccuuuccuuccuaauuu

SEQ ID NO: 757464 - RNA, 62 nt, Homo Sapiens; identical to SEQ ID NO: 77867

SEQ ID NO: 757465 - RNA, 62 nt, Homo Sapiens
ucuuugauuuuucuuuagcuucaucaguccuuccuuccuaaucucuaauccccugaagccua

SEQ ID NO: 757466 - RNA, 62 nt, Homo Sapiens
uacuuagucuguguccaugugauccaaaauuaccuuccuauugcauuuccuacuccuuugcu

SEQ ID NO: 757467 - RNA, 62 nt, Homo Sapiens
uuacucgcuuuguuuaauggauuccaccccugccuuccuaggugaccuuggacaaauucucg

SEQ ID NO: 757468 - RNA, 62 nt, Homo Sapiens
auauguccucaaaauccccauaaauauccaucccuuccuagauggcauuaacuuucauuuua

SEQ ID NO: 757469 - RNA, 62 nt, Homo Sapiens
cccucugggcuccuuugguaacagauggagcuccuuccuagcuagggagaccuuaugagaag

SEQ ID NO: 757470 - RNA, 62 nt, Homo Sapiens
ucuuuucuuccuuccucuucucuuccuucccuccuuccuacuuccuacuuuccuucauucuc

SEQ ID NO: 757471 - RNA, 62 nt, Homo Sapiens
uuccuucauucucucuuccuguucccuucuuuccuuccuacuuugucucuucagaguaaaug

SEQ ID NO: 757472 - RNA, 62 nt, Homo Sapiens
ggcauuuucuuuaacuuccagcugccucuuugccuuccuaggguagauugagccauacucug

SEQ ID NO: 757473 - RNA, 62 nt, Homo Sapiens
acuuagcccccucugacaauucaguccauuugccuuccuaguggguaccuuguuccaggcag

SEQ ID NO: 757474 - RNA, 64 nt, Homo Sapiens; identical to SEQ ID NO: 494502

SEQ ID NO: 757475 - RNA, 64 nt, Homo Sapiens; identical to SEQ ID NO: 494503

SEQ ID NO: 757476 - RNA, 64 nt, Homo Sapiens; identical to SEQ ID NO: 494504

SEQ ID NO: 757477 - RNA, 64 nt, Homo Sapiens; identical to SEQ ID NO: 494505

SEQ ID NO: 757478 - RNA, 64 nt, Homo Sapiens; identical to SEQ ID NO: 494506

SEQ ID NO: 757479 - RNA, 64 nt, Homo Sapiens; identical to SEQ ID NO: 494507

SEQ ID NO: 757480 - RNA, 64 nt, Homo Sapiens; identical to SEQ ID NO: 494508

SEQ ID NO: 757481 - RNA, 64 nt, Homo Sapiens; identical to SEQ ID NO: 494509

SEQ ID NO: 757482 - RNA, 64 nt, Homo Sapiens; identical to SEQ ID NO: 494510

SEQ ID NO: 757483 - RNA, 64 nt, Homo Sapiens; identical to SEQ ID NO: 494511

SEQ ID NO: 757484 - RNA, 64 nt, Homo Sapiens; identical to SEQ ID NO: 494512

SEQ ID NO: 757485 - RNA, 64 nt, Homo Sapiens; identical to SEQ ID NO: 494513

SEQ ID NO: 757486 - RNA, 64 nt, Homo Sapiens; identical to SEQ ID NO: 494514

SEQ ID NO: 757487 - RNA, 64 nt, Homo Sapiens; identical to SEQ ID NO: 494515

SEQ ID NO: 757488 - RNA, 62 nt, Homo Sapiens; identical to SEQ ID NO: 757455

SEQ ID NO: 757489 - RNA, 62 nt, Homo Sapiens; identical to SEQ ID NO: 757456

SEQ ID NO: 757490 - RNA, 62 nt, Homo Sapiens; identical to SEQ ID NO: 757457

SEQ ID NO: 757491 - RNA, 62 nt, Homo Sapiens; identical to SEQ ID NO: 757458

SEQ ID NO: 757492 - RNA, 62 nt, Homo Sapiens; identical to SEQ ID NO: 757459

SEQ ID NO: 757493 - RNA, 62 nt, Homo Sapiens; identical to SEQ ID NO: 757460

SEQ ID NO: 757494 - RNA, 62 nt, Homo Sapiens; identical to SEQ ID NO: 757461

SEQ ID NO: 757495 - RNA, 62 nt, Homo Sapiens; identical to SEQ ID NO: 757462

SEQ ID NO: 757496 - RNA, 62 nt, Homo Sapiens; identical to SEQ ID NO: 757463

SEQ ID NO: 757497 - RNA, 62 nt, Homo Sapiens; identical to SEQ ID NO: 77867

SEQ ID NO: 757498 - RNA, 62 nt, Homo Sapiens; identical to SEQ ID NO: 757465

SEQ ID NO: 757499 - RNA, 62 nt, Homo Sapiens; identical to SEQ ID NO: 757466

SEQ ID NO: 757500 - RNA, 62 nt, Homo Sapiens; identical to SEQ ID NO: 757467

SEQ ID NO: 757501 - RNA, 62 nt, Homo Sapiens; identical to SEQ ID NO: 757468

SEQ ID NO: 757502 - RNA, 62 nt, Homo Sapiens; identical to SEQ ID NO: 757469

SEQ ID NO: 757503 - RNA, 62 nt, Homo Sapiens; identical to SEQ ID NO: 757470

SEQ ID NO: 757504 - RNA, 62 nt, Homo Sapiens; identical to SEQ ID NO: 757471

SEQ ID NO: 757505 - RNA, 62 nt, Homo Sapiens; identical to SEQ ID NO: 757472

SEQ ID NO: 757506 - RNA, 62 nt, Homo Sapiens; identical to SEQ ID NO: 757473

SEQ ID NO: 757507 - RNA, 64 nt, Homo Sapiens; identical to SEQ ID NO: 365168

SEQ ID NO: 757508 - RNA, 64 nt, Homo Sapiens; identical to SEQ ID NO: 365169

SEQ ID NO: 757509 - RNA, 64 nt, Homo Sapiens; identical to SEQ ID NO: 365170

SEQ ID NO: 757510 - RNA, 64 nt, Homo Sapiens; identical to SEQ ID NO: 365171

SEQ ID NO: 757511 - RNA, 64 nt, Homo Sapiens; identical to SEQ ID NO: 365172

SEQ ID NO: 757512 - RNA, 64 nt, Homo Sapiens; identical to SEQ ID NO: 365173

SEQ ID NO: 757513 - RNA, 64 nt, Homo Sapiens; identical to SEQ ID NO: 365174

SEQ ID NO: 757514 - RNA, 64 nt, Homo Sapiens; identical to SEQ ID NO: 365175

SEQ ID NO: 757515 - RNA, 64 nt, Homo Sapiens; identical to SEQ ID NO: 365176

SEQ ID NO: 757516 - RNA, 64 nt, Homo Sapiens; identical to SEQ ID NO: 365177

SEQ ID NO: 757517 - RNA, 64 nt, Homo Sapiens; identical to SEQ ID NO: 365178

SEQ ID NO: 757518 - RNA, 64 nt, Homo Sapiens; identical to SEQ ID NO: 365179

SEQ ID NO: 757519 - RNA, 64 nt, Homo Sapiens; identical to SEQ ID NO: 365180

SEQ ID NO: 757520 - RNA, 64 nt, Homo Sapiens; identical to SEQ ID NO: 365181

SEQ ID NO: 757521 - RNA, 64 nt, Homo Sapiens; identical to SEQ ID NO: 365182

SEQ ID NO: 757522 - RNA, 64 nt, Homo Sapiens; identical to SEQ ID NO: 365183

SEQ ID NO: 757523 - RNA, 64 nt, Homo Sapiens; identical to SEQ ID NO: 365184

SEQ ID NO: 757524 - RNA, 64 nt, Homo Sapiens; identical to SEQ ID NO: 365185

SEQ ID NO: 757525 - RNA, 64 nt, Homo Sapiens; identical to SEQ ID NO: 365186

SEQ ID NO: 757526 - RNA, 64 nt, Homo Sapiens; identical to SEQ ID NO: 365187

SEQ ID NO: 757527 - RNA, 64 nt, Homo Sapiens; identical to SEQ ID NO: 365188

SEQ ID NO: 757528 - RNA, 64 nt, Homo Sapiens; identical to SEQ ID NO: 365189

SEQ ID NO: 757529 - RNA, 64 nt, Homo Sapiens; identical to SEQ ID NO: 365190

SEQ ID NO: 757530 - RNA, 64 nt, Homo Sapiens; identical to SEQ ID NO: 365191

SEQ ID NO: 757531 - RNA, 64 nt, Homo Sapiens; identical to SEQ ID NO: 365192

SEQ ID NO: 757532 - RNA, 64 nt, Homo Sapiens; identical to SEQ ID NO: 365193

SEQ ID NO: 757533 - RNA, 51 nt, Homo Sapiens; identical to SEQ ID NO: 365194

SEQ ID NO: 757534 - RNA, 64 nt, Homo Sapiens; identical to SEQ ID NO: 365195

SEQ ID NO: 757535 - RNA, 64 nt, Homo Sapiens; identical to SEQ ID NO: 365196

SEQ ID NO: 757536 - RNA, 64 nt, Homo Sapiens; identical to SEQ ID NO: 365197

SEQ ID NO: 757537 - RNA, 64 nt, Homo Sapiens; identical to SEQ ID NO: 365198

SEQ ID NO: 757538 - RNA, 64 nt, Homo Sapiens; identical to SEQ ID NO: 365199

SEQ ID NO: 757539 - RNA, 64 nt, Homo Sapiens; identical to SEQ ID NO: 365200

SEQ ID NO: 757540 - RNA, 64 nt, Homo Sapiens; identical to SEQ ID NO: 365201

SEQ ID NO: 757541 - RNA, 64 nt, Homo Sapiens; identical to SEQ ID NO: 365202

SEQ ID NO: 757542 - RNA, 64 nt, Homo Sapiens; identical to SEQ ID NO: 365203

SEQ ID NO: 757543 - RNA, 64 nt, Homo Sapiens; identical to SEQ ID NO: 365204

SEQ ID NO: 757544 - RNA, 62 nt, Homo Sapiens
uucuuccacccucucacuuuccugccuguuccccacuccacaggagggagcugacguuggcu

SEQ ID NO: 757545 - RNA, 62 nt, Homo Sapiens
agguuaauuucuaucucugaucccuccccaacccacuccauauuugggucauggacaguaaa

SEQ ID NO: 757546 - RNA, 62 nt, Homo Sapiens
auuccaccucucuaaaagaaucagcaguugggccacuccacuucccuggcugccaaaacugc

SEQ ID NO: 757547 - RNA, 62 nt, Homo Sapiens
gugccgaaggagcucugccacuucaagccuccccacuccaccuuguucuucaucuccugucu

SEQ ID NO: 757548 - RNA, 62 nt, Homo Sapiens
cugggcgacagagcaagacugaucaugccacuccacuccaguuggcgguugcugugagccaa

SEQ ID NO: 757549 - RNA, 62 nt, Homo Sapiens
ccagucugggcgacagagcagccaagaucaugccacuccacuggagguggcgguugcuguga

SEQ ID NO: 757550 - RNA, 62 nt, Homo Sapiens
accugcccaccuggggcuccugugcccccuccccacuccagaggccacccuacaaguugucc

SEQ ID NO: 757551 - RNA, 62 nt, Homo Sapiens
gguagccacucuaggucguuggccuuccuugaccacuccauuuaauucucucugcuguuugg

SEQ ID NO: 757552 - RNA, 62 nt, Homo Sapiens
ugacccuuccaccccgccucacucccuccgucccacuccacuccaggcugccggcaccugcc

SEQ ID NO: 757553 - RNA, 62 nt, Homo Sapiens
cuuccaccccgccucacucccuccgucccacuccacuccaggcugccggcaccugccccauu

SEQ ID NO: 757554 - RNA, 62 nt, Homo Sapiens
cuccagccugucccucuuagcacucuagcugcccacuccagggcagggacucgaaacccccu

SEQ ID NO: 757555 - RNA, 62 nt, Homo Sapiens
ccaccgcccaggucuuaacuuucuggcauccaccacuccaugucucuggaugugucacuugg

SEQ ID NO: 757556 - RNA, 62 nt, Homo Sapiens
aggggcucuccagaccccuuuuccaugaugacccacuccaagauauuauguguaaauugugu

SEQ ID NO: 757557 - RNA, 62 nt, Homo Sapiens
gcccgguggaauggauucugcugguguggaaaccacuccauucgugcccagcacaagugagc

SEQ ID NO: 757558 - RNA, 62 nt, Homo Sapiens
cuacaagcagugggacuccucugauaacuuccccacuccaccgggccugggcagucugaaga

SEQ ID NO: 757559 - RNA, 62 nt, Homo Sapiens
gugcacacuuccaggccucccuggagagguguccacuccauccuucccuccguggcguaggg

SEQ ID NO: 757560 - RNA, 62 nt, Homo Sapiens
aaagacaaggggccaggagccaacaccagaggccacuccacaaccccagcgccagucagcaa

SEQ ID NO: 757561 - RNA, 62 nt, Homo Sapiens
gaggcccuggcugcugccacacuccaggugggccacuccaaggccacccaaacugccacucc

SEQ ID NO: 757562 - RNA, 62 nt, Homo Sapiens
ugggccacuccaaggaggcccaaacugccacuccacuccaggaucuucgccuagaagccacc

SEQ ID NO: 757563 - RNA, 62 nt, Homo Sapiens
ccaggugggccacuccaaggccacccaaacugccacuccacuggggcaucuucgccuagaag

SEQ ID NO: 757564 - RNA, 62 nt, Homo Sapiens
auaguccaucccgcuaguccaucccgcuagccccacuccagggacucagacccaucuccaac

SEQ ID NO: 757565 - RNA, 62 nt, Homo Sapiens
uaugccuuccuguccuuucuacucaaugguccccacuccaagaugaguugacacaaccccuu

SEQ ID NO: 757566 - RNA, 62 nt, Homo Sapiens
cuuucucuacucccugccuccacccccaccuaccacuccaugacccagaggaacccccaccc

SEQ ID NO: 757567 - RNA, 62 nt, Homo Sapiens
gcccaguccuucuccugccccagacccccucgccacuccagcucugcagggagugagcuccc

SEQ ID NO: 757568 - RNA, 62 nt, Homo Sapiens
gcuccaucggcacuaaugcuccacucggcgccccacuccaucggccccgcuccaucggcacu

SEQ ID NO: 757569 - RNA, 62 nt, Homo Sapiens
gcuccaucggcacuaaugccccacucggcgccccacuccaucagcacuaaugcuccacucca

SEQ ID NO: 757570 - RNA, 62 nt, Homo Sapiens
acucggcgccccacuccaucagcacuaaugcuccacuccauuggcacuaacgccccaacucc

SEQ ID NO: 757571 - RNA, 62 nt, Homo Sapiens
cacuaaugacccgcuccuuugacauuggugccccacuccaucagcacuaacgcccugcucca

SEQ ID NO: 757572 - RNA, 62 nt, Homo Sapiens
cacuaacgcccugcuccaucggcacuggugucccacuccauugucacuaacguccggcucca

SEQ ID NO: 757573 - RNA, 62 nt, Homo Sapiens
caggggacgggaugaggagcgggaggguuccgccacuccaguuuucuccucugcuucuuugc

SEQ ID NO: 757574 - RNA, 62 nt, Homo Sapiens
cuucuuugccucccucagauagaaaacagcccccacuccaguccacuccugaccccucuccu

SEQ ID NO: 757575 - RNA, 62 nt, Homo Sapiens
cccuauauuucuguguauguaccccugauuucccacuccacaucagcucugaaggccgugag

SEQ ID NO: 757576 - RNA, 62 nt, Homo Sapiens
cugggugagaaagcaagaccgugauuucaccaccacuccagcgguugaggcugcagugagcc

SEQ ID NO: 757577 - RNA, 62 nt, Homo Sapiens; identical to SEQ ID NO: 355781

SEQ ID NO: 757578 - RNA, 62 nt, Homo Sapiens
gccccccccuugaaucugcagggagcaacucuccacuccauauuuauuuaaacaauuuuuuc

SEQ ID NO: 757579 - RNA, 62 nt, Homo Sapiens
aacccagagccacauuagaagcuucgacccacccacuccaggaaguuucuuccccgagugga

SEQ ID NO: 757580 - RNA, 62 nt, Homo Sapiens
aacuugaacugcaggggcagggccacugacagccacuccagggaacagauuuaaagacaggu

SEQ ID NO: 757581 - RNA, 64 nt, Homo Sapiens
aauguacuugacauuuauguuuacuugauauuucuugcccuaguaaaaauacgacucuguuguc

SEQ ID NO: 757582 - RNA, 64 nt, Homo Sapiens
cuaccugaggguuuaggaggugguuuugaaggccuugcccuaagaccaucacccuuuuccccuu

SEQ ID NO: 757583 - RNA, 64 nt, Homo Sapiens
acgucucccuagcuguucuuauugagacuuauuuuugcccuaaacucagccugguaucagggaa

SEQ ID NO: 757584 - RNA, 64 nt, Homo Sapiens
agacacugccuuuucagcagaguggacauuauucuugcccuaaggugucugguccauugcuggc

SEQ ID NO: 757585 - RNA, 64 nt, Homo Sapiens
caagcugugccccaucccccgucccuguccccccuggguccagcauuuugggucagacaucaau

SEQ ID NO: 757586 - RNA, 64 nt, Homo Sapiens
ccccucugcauuuacacagagccccugcauccccuggguccagcaccccugcaccuucguugga

SEQ ID NO: 757587 - RNA, 64 nt, Homo Sapiens
caccagcaaugaaggagauauugugaugguguucuggguccauauuuuaggccaaggaaauauu

SEQ ID NO: 757588 - RNA, 64 nt, Homo Sapiens
cuaaaaaccaccauuuaacuuacagcuuaaaucauggguccagcuucgguuugagcuggauggg

SEQ ID NO: 757589 - RNA, 64 nt, Homo Sapiens
agguagcugccccuggcucugaccgaaacagcgcuggguccaccccaugucaccggauccuggg

SEQ ID NO: 757590 - RNA, 64 nt, Homo Sapiens
gagauggggugggguggagaacuccuaggguggcuggguccaggggaugggagguugugggcau

SEQ ID NO: 757591 - RNA, 64 nt, Homo Sapiens
cacucagaaguguaggggccggccuuugagcauauggguccagccuugugucuugggaacaaaa

SEQ ID NO: 757592 - RNA, 64 nt, Homo Sapiens
ggaggaagaaggaaggagagaggagggcagggcuuggguccagugagucagauuuuuacagagg

SEQ ID NO: 757593 - RNA, 64 nt, Homo Sapiens
acugcccuacaugugacuaugggaggagggguucuggguccauccccuggagcacaggagagua

SEQ ID NO: 757594 - RNA, 64 nt, Homo Sapiens
cucaagucagauacaacccuugcugaugcugcccuggguccagaaaaaaccugccauuuucacc

SEQ ID NO: 757595 - RNA, 64 nt, Homo Sapiens
ccuggccauguggcccuccaccagggugagagucuggguccaggccuccaaugcugccugggag

SEQ ID NO: 757596 - RNA, 64 nt, Homo Sapiens
uggcugugacaucuacguauugacugugcccaaguggguccaagaauacucugaauuuggaguc

SEQ ID NO: 757597 - RNA, 64 nt, Homo Sapiens
guccucaucccauccucccuucuggagggagacguggguccaagcuuuuagacaugguuguggg

SEQ ID NO: 757598 - RNA, 64 nt, Homo Sapiens
uuaauaugauucugcuccccaaacacucaucccauggguccaaauccuggaaacagcaugaaua

SEQ ID NO: 757599 - RNA, 64 nt, Homo Sapiens
cagaguugaucagucccugccuggcgcugagagguggguccaaguguccagcccuguugcucuc

SEQ ID NO: 757600 - RNA, 64 nt, Homo Sapiens
gugcccugcgaugggucccggcuuaacgugaggguggguccagugaccaaaucgcugguugugc

SEQ ID NO: 757601 - RNA, 64 nt, Homo Sapiens
accguuugcauucgaaacacaacucagguuaacuuggguccaugccgcggaauccugcagagca

SEQ ID NO: 757602 - RNA, 64 nt, Homo Sapiens
ccuggaccaugucacaaaaaaacaaguguuguuuuggguccauguaguuuaccuauucuacacu

SEQ ID NO: 757603 - RNA, 64 nt, Homo Sapiens
ugaaaugcgccaaggguucaggcuggauaugggaaguaggcaaaugcaguggagcccugagcag

SEQ ID NO: 757604 - RNA, 54 nt, Homo Sapiens
gccccagcccggucaggcucguggaguaggcauuucugcucaaagcucaccuga

SEQ ID NO: 757605 - RNA, 64 nt, Homo Sapiens
aaaugcuaugugccugacccaaugguaggcacauaguaggcacucaacucauauguuuaauuga

SEQ ID NO: 757606 - RNA, 64 nt, Homo Sapiens
uuuguaaaaaggaaguauuucucccaaaauugggaguaggcaaacuacuaaucaguuuagcuuu

SEQ ID NO: 757607 - RNA, 64 nt, Homo Sapiens
gcacuuuauaauaaagcauggaagaaauuaucuuaguaggcaauuguaacacuuuuugaaagua

SEQ ID NO: 757608 - RNA, 64 nt, Homo Sapiens
caugaagaaugcagaagucaaacccucaugacaaaguaggcacaagucuacaauaagcuaaauc

SEQ ID NO: 757609 - RNA, 64 nt, Homo Sapiens
agcucuaccucccccggcagccuccucucccugcaguaggcaccgcccaggccagcacugccag

SEQ ID NO: 757610 - RNA, 64 nt, Homo Sapiens
uguuauggcaguggguccagacccagggaccccaaguaggcaaccaccccacccacuccauccu

SEQ ID NO: 757611 - RNA, 61 nt, Homo Sapiens
ccucccaggugggggaacugcuugggccuugcugagccaggguccucagggugaagcagga

SEQ ID NO: 757612 - RNA, 61 nt, Homo Sapiens
ugccccauccccuuugagugucagaagcacucugagccaaggggacagggggcacgugcac

SEQ ID NO: 757613 - RNA, 61 nt, Homo Sapiens
cccugguggucacaggcugugccuugguuuccugagccaccuuuacucugcucuaugccag

SEQ ID NO: 757614 - RNA, 61 nt, Homo Sapiens
gggcgugccugccaagcucacacagcaggaacugagccagaaacgcagauugggcuggcuc

SEQ ID NO: 757615 - RNA, 61 nt, Homo Sapiens
ucagaggauuauguaaccccugcaguggaaacugagccagcuaacuuaaaaagcugccuua

SEQ ID NO: 757616 - RNA, 61 nt, Homo Sapiens
uauuagauucguaggucauauuacuuaucaacugagccaaaugucugugugcaauuguguu

SEQ ID NO: 757617 - RNA, 61 nt, Homo Sapiens
gcggccccucagccugccugguucaccagcccugagccauguggggguuuggggcuaagaa

SEQ ID NO: 757618 - RNA, 61 nt, Homo Sapiens
gggguuuggggcuaagaaguggaagagagggcugagccauggcccugcccagccagccauc

SEQ ID NO: 757619 - RNA, 61 nt, Homo Sapiens
ugaaaugagccaccgugaacggucauaaacccugagccagacuggaacauccugucaguuu

SEQ ID NO: 757620 - RNA, 61 nt, Homo Sapiens
cucuccccuccucugcccuggcuucaggacucugagccauuacugaucugaaggagguggu

SEQ ID NO: 757621 - RNA, 61 nt, Homo Sapiens
ugucuuccacuguaucuacuugggcugccagcugagccaccgaccuccaccaccccugcag

SEQ ID NO: 757622 - RNA, 61 nt, Homo Sapiens
ccccucaggcccggcauggggauacuaaagucugagccaggucaaggcagcaguccccuug

SEQ ID NO: 757623 - RNA, 61 nt, Homo Sapiens
uacaggacacccccagccugaaugcuggaggcugagccaagggccauuaggcagccuaauu

SEQ ID NO: 757624 - RNA, 61 nt, Homo Sapiens
guucccccagggaacucagugccaacugacucugagccaggagcccucugccuccagggag

SEQ ID NO: 757625 - RNA, 61 nt, Homo Sapiens
gaguaugcgacggacagaggaacuaaucuaccugagccagaagauugaguuugagugcaaa

SEQ ID NO: 757626 - RNA, 61 nt, Homo Sapiens
ucaucauuaaaaaaagggggaccauuggggccugagccaaggaacuuuccuucuacugccu

SEQ ID NO: 757627 - RNA, 61 nt, Homo Sapiens
acccuggacuggcccagucugauucucugcccugagccaccagccacgcugucuggugggu

SEQ ID NO: 757628 - RNA, 61 nt, Homo Sapiens
gcugcugacugacuccagccaagccuaugcccugagccauggucacugccucaggaccccc

SEQ ID NO: 757629 - RNA, 61 nt, Homo Sapiens
uauaccuuugaaauauuaaaccuugucaauacugagccauuuaguucagauacagggugcu

SEQ ID NO: 757630 - RNA, 61 nt, Homo Sapiens
auuuccugggagaaagaccacaucgugaucacugagccaucugaaugugaagcaaacacag

SEQ ID NO: 757631 - RNA, 61 nt, Homo Sapiens
aggagacauuagugaauugguuuagccuguucugagccauuagggguuaucugggagaagc

SEQ ID NO: 757632 - RNA, 61 nt, Homo Sapiens
gauucagauggcacaggaagaagaucugauccugagccagacccaccagagauguggucau

SEQ ID NO: 757633 - RNA, 61 nt, Homo Sapiens
cccuuucacccuccucuaccagaagcgggcucugagccacgccaggauacgcccgagcgga

SEQ ID NO: 757634 - RNA, 61 nt, Homo Sapiens
gugaguuggucaaaugcucccguaagggacccugagccacacugguuuccccaacaggcug

SEQ ID NO: 757635 - RNA, 61 nt, Homo Sapiens
acuucugaggagcagaguugagggagccgagcugagccacgcugggaggccagagccuuuc

SEQ ID NO: 757636 - RNA, 61 nt, Homo Sapiens
ggauccucagccauguucaagugaaguaagccugagccagugcguggacuggugccacggg

SEQ ID NO: 757637 - RNA, 61 nt, Homo Sapiens
cucuucugcacagcuccuccccugcuaccugcugagccagauuccccaggaaucuugaaug

SEQ ID NO: 757638 - RNA, 61 nt, Homo Sapiens
accucuucuucuccaaaggaucuuuguuccucugagccaagacugagguaaauaaagccac

SEQ ID NO: 757639 - RNA, 61 nt, Homo Sapiens
ugcaauaagaacauagaucccccuagacgggcugagccaugcaucuggucuugguagaugu

SEQ ID NO: 757640 - RNA, 61 nt, Homo Sapiens
gugauggacuguauauuugaggugacaugcacugagccaaggaaaucccuggagaauuuuu

SEQ ID NO: 757641 - RNA, 61 nt, Homo Sapiens
accacacguccauccugggauggaggcagcacugagccagcauggauggacagacaggcca

SEQ ID NO: 757642 - RNA, 61 nt, Homo Sapiens
ggcagaauggauggacagacuggagccagcccugagccagacacacagggagacgggggcc

SEQ ID NO: 757643 - RNA, 61 nt, Homo Sapiens
ucaccuuguugguaccucccucccuggaucucugagccagcagccaggaggaccugaccca

SEQ ID NO: 757644 - RNA, 61 nt, Homo Sapiens
cggucagcacagugccuuuuccucuccugcucugagccaggguggggcauucccucuagau

SEQ ID NO: 757645 - RNA, 61 nt, Homo Sapiens
agugaauggcccuuccuuagucuagaaacuucugagccagggggcacuuucaccaagaugu

SEQ ID NO: 757646 - RNA, 61 nt, Homo Sapiens
gccuucacggaccucccuagccccugcugcccugagccaaccauucccagggcacuccuua

SEQ ID NO: 757647 - RNA, 61 nt, Homo Sapiens
auugacuuucuguugagguaccuuggagaagcugagccauucugaggacaucuggcugugu

SEQ ID NO: 757648 - RNA, 61 nt, Homo Sapiens
gccuugggucaguccagcccccuccacaucacugagccaucaaugagcugagagaucaaug

SEQ ID NO: 757649 - RNA, 61 nt, Homo Sapiens
aggggcucugagcccgggccacgcaggggcccugagccaaaagagggggagaaugagaagg

SEQ ID NO: 757650 - RNA, 61 nt, Homo Sapiens
ccccuccagucguuauuucuguuuguuuaagcugagccacggauaccgccacggguuuccc

SEQ ID NO: 757651 - RNA, 61 nt, Homo Sapiens
uggaacccaauaccuaggcuuacaggccauccugagccaggggccucuggaaauucucuuc

SEQ ID NO: 757652 - RNA, 61 nt, Homo Sapiens
cuggauguuccccagcuggcaguugagcugccugagccaaugugucugucuuugguaacug

SEQ ID NO: 757653 - RNA, 61 nt, Homo Sapiens
ggauguccagagcuggccaggccacugggcccugagccagagacaaggucaccugggcugu

SEQ ID NO: 757654 - RNA, 61 nt, Homo Sapiens
ucccgacucugauaccuucuggcugugcuaccugagccaagucgccuccccucucugggcu

SEQ ID NO: 757655 - RNA, 61 nt, Homo Sapiens
cucauucacccaaccucaggguucuccccaucugagccagccugcuggugugacuuacuca

SEQ ID NO: 757656 - RNA, 61 nt, Homo Sapiens
cauccuccauuccucugcacuugcagacuuucugagccaggguuuucuuuuaguggaaaca

SEQ ID NO: 757657 - RNA, 61 nt, Homo Sapiens
augugcaccuguagucccagcuacucgggggcugagccaggcggauagcuugagcucaggg

SEQ ID NO: 757658 - RNA, 61 nt, Homo Sapiens
cccguaccacuguugaugugaagcaccucuucugagccaggccgagccccuggccgacuug

SEQ ID NO: 757659 - RNA, 61 nt, Homo Sapiens
cuggcugggacugacuuggccauguucucagcugagccacgcggcugguagugcagccuuc

SEQ ID NO: 757660 - RNA, 61 nt, Homo Sapiens
aagggauuucuggcucaggcuguaaaaguagcugagccauccugcccauuccuggaggucc

SEQ ID NO: 757661 - RNA, 61 nt, Homo Sapiens
ggugauuucaaugauggcauccaggaauuagcugagccaacagaccauguggacagcuuug

SEQ ID NO: 757662 - RNA, 61 nt, Homo Sapiens
gcugaccugccuagcgagcaggacaucccuucugagccaucugcugcucucucauuucauc

SEQ ID NO: 757663 - RNA, 61 nt, Homo Sapiens
agcagggugguccugcguccacuucccaagccugagccaagcucaucuucauugaaugucu

SEQ ID NO: 757664 - RNA, 61 nt, Homo Sapiens
ccuccuguuggagggguggagggauguuccccugagccaggcugagacuagaaccccaucu

SEQ ID NO: 757665 - RNA, 61 nt, Homo Sapiens
gagccaggcugagacuagaaccccaucuucccugagccaggcugagacuagaaccccaucu

SEQ ID NO: 757666 - RNA, 61 nt, Homo Sapiens
ugggcugaggcaggggccgcugucgucaggccugagccagggugagcuggugccugccuug

SEQ ID NO: 757667 - RNA, 61 nt, Homo Sapiens
acacaaucaguggggcagccagagcucagaccugagccauuuugucaguauccaggacccc

SEQ ID NO: 757668 - RNA, 61 nt, Homo Sapiens
ggaaacccguuguuccucccgucuucagaugcugagccaacugcuuggacagcagccagcg

SEQ ID NO: 757669 - RNA, 61 nt, Homo Sapiens
agaugucuuaaaagacuagaauccacacuuccugagccagaggggccguguugacgguaau

SEQ ID NO: 757670 - RNA, 64 nt, Homo Sapiens
caauuucauauaauaaauauggaauuguagucugagggcguagaggucaccaucuaacuauuca

SEQ ID NO: 757671 - RNA, 64 nt, Homo Sapiens
agugccauccugacucuagaaggccccccacagcagggcguagggggcaucacccugcucacuc

SEQ ID NO: 757672 - RNA, 64 nt, Homo Sapiens
ucgaaaaccagaguacagucuguugcaucacagaagggcguauuaguaaguuucgauaaauaau

SEQ ID NO: 757673 - RNA, 64 nt, Homo Sapiens
uuuuguugagcccuuccuccucacugacuuaugcagggcguauauggguugaaaauuuggaccu

SEQ ID NO: 757674 - RNA, 64 nt, Homo Sapiens
aucccuaguuguuugaauuaacugaauaaagugcagggcguaauagugacuggcugggggcacu

SEQ ID NO: 757675 - RNA, 51 nt, Homo Sapiens
agaagauaacuaccguuuagcagggcguacugcgguuggugacgggggucc

SEQ ID NO: 757676 - RNA, 64 nt, Homo Sapiens
uuuuagagggaacggccacucccccagguugugaagggcguaaccuuguccuccccuccuccac

SEQ ID NO: 757677 - RNA, 64 nt, Homo Sapiens
uuccuguuuacaacaugucaaagccauugguucaagggcguaauaaauacuugcguauucaaug

SEQ ID NO: 757678 - RNA, 64 nt, Homo Sapiens
uggaauaagauguauucucacucccuugaucucaagggcguaacucuggaagcacagcuugacu

SEQ ID NO: 757679 - RNA, 64 nt, Homo Sapiens
gaaagcacguccucaagacuuguagaccagacacagggcguauguaucacaagacacgccugca

SEQ ID NO: 757680 - RNA, 64 nt, Homo Sapiens
gagugaaggcuuuuuccccuaauccuggcagagcagggcguagaaaagagaggauguccgugcu

SEQ ID NO: 757681 - RNA, 64 nt, Homo Sapiens
cugagcucucggcuccuccuccgucuucagggccagggcguagcgucugcucucucggccucug

SEQ ID NO: 757682 - RNA, 58 nt, Homo Sapiens
gcccaggcugcacaccgugaagauguggagggcguagggugggggcagugaggaaugg

SEQ ID NO: 757683 - RNA, 64 nt, Homo Sapiens
ucucuggcacaaggggagccccagggcuugggggagggcguaagguggggggaaaugccacugc

SEQ ID NO: 757684 - RNA, 64 nt, Homo Sapiens
ccagguuagcuagguagaguagucccugcuguguagggcguaguaagccugccacucuuuaccu

SEQ ID NO: 757685 - RNA, 64 nt, Homo Sapiens
gcacgcacacggccccgcacacagccccgccccaccccgcaaccagcccugucgacugccuuau

SEQ ID NO: 757686 - RNA, 64 nt, Homo Sapiens
ccccaccccacccacccucggggcgccccccuccccccgcaagccagccugggccagccccgcu

SEQ ID NO: 757687 - RNA, 64 nt, Homo Sapiens; identical to SEQ ID NO: 95465

SEQ ID NO: 757688 - RNA, 64 nt, Homo Sapiens; identical to SEQ ID NO: 95466

SEQ ID NO: 757689 - RNA, 64 nt, Homo Sapiens; identical to SEQ ID NO: 95467

SEQ ID NO: 757690 - RNA, 64 nt, Homo Sapiens; identical to SEQ ID NO: 95468

SEQ ID NO: 757691 - RNA, 64 nt, Homo Sapiens; identical to SEQ ID NO: 95469

SEQ ID NO: 757692 - RNA, 64 nt, Homo Sapiens; identical to SEQ ID NO: 95470

SEQ ID NO: 757693 - RNA, 64 nt, Homo Sapiens; identical to SEQ ID NO: 95471

SEQ ID NO: 757694 - RNA, 64 nt, Homo Sapiens; identical to SEQ ID NO: 95472

SEQ ID NO: 757695 - RNA, 64 nt, Homo Sapiens; identical to SEQ ID NO: 95473

SEQ ID NO: 757696 - RNA, 64 nt, Homo Sapiens; identical to SEQ ID NO: 95474

SEQ ID NO: 757697 - RNA, 64 nt, Homo Sapiens; identical to SEQ ID NO: 95475

SEQ ID NO: 757698 - RNA, 64 nt, Homo Sapiens; identical to SEQ ID NO: 95476

SEQ ID NO: 757699 - RNA, 64 nt, Homo Sapiens; identical to SEQ ID NO: 95477

SEQ ID NO: 757700 - RNA, 64 nt, Homo Sapiens; identical to SEQ ID NO: 141401

SEQ ID NO: 757701 - RNA, 64 nt, Homo Sapiens; identical to SEQ ID NO: 141402

SEQ ID NO: 757702 - RNA, 64 nt, Homo Sapiens; identical to SEQ ID NO: 98595

SEQ ID NO: 757703 - RNA, 64 nt, Homo Sapiens; identical to SEQ ID NO: 98596

SEQ ID NO: 757704 - RNA, 64 nt, Homo Sapiens; identical to SEQ ID NO: 98597

SEQ ID NO: 757705 - RNA, 64 nt, Homo Sapiens; identical to SEQ ID NO: 98598

SEQ ID NO: 757706 - RNA, 64 nt, Homo Sapiens; identical to SEQ ID NO: 98599

SEQ ID NO: 757707 - RNA, 64 nt, Homo Sapiens; identical to SEQ ID NO: 98600

SEQ ID NO: 757708 - RNA, 64 nt, Homo Sapiens; identical to SEQ ID NO: 98601

SEQ ID NO: 757709 - RNA, 64 nt, Homo Sapiens; identical to SEQ ID NO: 98602

SEQ ID NO: 757710 - RNA, 64 nt, Homo Sapiens; identical to SEQ ID NO: 98603

SEQ ID NO: 757711 - RNA, 64 nt, Homo Sapiens; identical to SEQ ID NO: 98604

SEQ ID NO: 757712 - RNA, 64 nt, Homo Sapiens; identical to SEQ ID NO: 98605

SEQ ID NO: 757713 - RNA, 64 nt, Homo Sapiens; identical to SEQ ID NO: 98606

SEQ ID NO: 757714 - RNA, 64 nt, Homo Sapiens; identical to SEQ ID NO: 98607

SEQ ID NO: 757715 - RNA, 64 nt, Homo Sapiens; identical to SEQ ID NO: 98608

SEQ ID NO: 757716 - RNA, 64 nt, Homo Sapiens; identical to SEQ ID NO: 98609

SEQ ID NO: 757717 - RNA, 64 nt, Homo Sapiens; identical to SEQ ID NO: 98610

SEQ ID NO: 757718 - RNA, 64 nt, Homo Sapiens; identical to SEQ ID NO: 98611

SEQ ID NO: 757719 - RNA, 64 nt, Homo Sapiens; identical to SEQ ID NO: 98612

SEQ ID NO: 757720 - RNA, 64 nt, Homo Sapiens; identical to SEQ ID NO: 98613

SEQ ID NO: 757721 - RNA, 64 nt, Homo Sapiens; identical to SEQ ID NO: 98614

SEQ ID NO: 757722 - RNA, 64 nt, Homo Sapiens; identical to SEQ ID NO: 98615

SEQ ID NO: 757723 - RNA, 57 nt, Homo Sapiens; identical to SEQ ID NO: 98616

SEQ ID NO: 757724 - RNA, 64 nt, Homo Sapiens; identical to SEQ ID NO: 98617

SEQ ID NO: 757725 - RNA, 64 nt, Homo Sapiens; identical to SEQ ID NO: 98618

SEQ ID NO: 757726 - RNA, 64 nt, Homo Sapiens; identical to SEQ ID NO: 98619

SEQ ID NO: 757727 - RNA, 64 nt, Homo Sapiens; identical to SEQ ID NO: 98620

SEQ ID NO: 757728 - RNA, 64 nt, Homo Sapiens; identical to SEQ ID NO: 98621

SEQ ID NO: 757729 - RNA, 64 nt, Homo Sapiens; identical to SEQ ID NO: 98622

SEQ ID NO: 757730 - RNA, 64 nt, Homo Sapiens; identical to SEQ ID NO: 98623

SEQ ID NO: 757731 - RNA, 64 nt, Homo Sapiens; identical to SEQ ID NO: 98624

SEQ ID NO: 757732 - RNA, 64 nt, Homo Sapiens; identical to SEQ ID NO: 98625

SEQ ID NO: 757733 - RNA, 64 nt, Homo Sapiens; identical to SEQ ID NO: 98626

SEQ ID NO: 757734 - RNA, 64 nt, Homo Sapiens; identical to SEQ ID NO: 98627

SEQ ID NO: 757735 - RNA, 64 nt, Homo Sapiens; identical to SEQ ID NO: 98628

SEQ ID NO: 757736 - RNA, 64 nt, Homo Sapiens; identical to SEQ ID NO: 98629

SEQ ID NO: 757737 - RNA, 64 nt, Homo Sapiens; identical to SEQ ID NO: 98630

SEQ ID NO: 757738 - RNA, 64 nt, Homo Sapiens; identical to SEQ ID NO: 98631

SEQ ID NO: 757739 - RNA, 64 nt, Homo Sapiens; identical to SEQ ID NO: 98632

SEQ ID NO: 757740 - RNA, 64 nt, Homo Sapiens; identical to SEQ ID NO: 98633

SEQ ID NO: 757741 - RNA, 64 nt, Homo Sapiens; identical to SEQ ID NO: 98634

SEQ ID NO: 757742 - RNA, 64 nt, Homo Sapiens; identical to SEQ ID NO: 98635

SEQ ID NO: 757743 - RNA, 64 nt, Homo Sapiens; identical to SEQ ID NO: 98636

SEQ ID NO: 757744 - RNA, 64 nt, Homo Sapiens; identical to SEQ ID NO: 98637

SEQ ID NO: 757745 - RNA, 64 nt, Homo Sapiens; identical to SEQ ID NO: 98638

SEQ ID NO: 757746 - RNA, 64 nt, Homo Sapiens; identical to SEQ ID NO: 98639

SEQ ID NO: 757747 - RNA, 64 nt, Homo Sapiens; identical to SEQ ID NO: 98640

SEQ ID NO: 757748 - RNA, 64 nt, Homo Sapiens; identical to SEQ ID NO: 98641

SEQ ID NO: 757749 - RNA, 64 nt, Homo Sapiens; identical to SEQ ID NO: 98642

SEQ ID NO: 757750 - RNA, 64 nt, Homo Sapiens; identical to SEQ ID NO: 98643

SEQ ID NO: 757751 - RNA, 64 nt, Homo Sapiens; identical to SEQ ID NO: 98644

SEQ ID NO: 757752 - RNA, 64 nt, Homo Sapiens; identical to SEQ ID NO: 98645

SEQ ID NO: 757753 - RNA, 64 nt, Homo Sapiens; identical to SEQ ID NO: 98646

SEQ ID NO: 757754 - RNA, 64 nt, Homo Sapiens; identical to SEQ ID NO: 98647

SEQ ID NO: 757755 - RNA, 64 nt, Homo Sapiens; identical to SEQ ID NO: 98648

SEQ ID NO: 757756 - RNA, 64 nt, Homo Sapiens; identical to SEQ ID NO: 98649

SEQ ID NO: 757757 - RNA, 64 nt, Homo Sapiens; identical to SEQ ID NO: 98650

SEQ ID NO: 757758 - RNA, 64 nt, Homo Sapiens; identical to SEQ ID NO: 98651

SEQ ID NO: 757759 - RNA, 64 nt, Homo Sapiens; identical to SEQ ID NO: 98652

SEQ ID NO: 757760 - RNA, 64 nt, Homo Sapiens; identical to SEQ ID NO: 98653

SEQ ID NO: 757761 - RNA, 64 nt, Homo Sapiens; identical to SEQ ID NO: 98654

SEQ ID NO: 757762 - RNA, 64 nt, Homo Sapiens; identical to SEQ ID NO: 98655

SEQ ID NO: 757763 - RNA, 64 nt, Homo Sapiens; identical to SEQ ID NO: 98656

SEQ ID NO: 757764 - RNA, 64 nt, Homo Sapiens; identical to SEQ ID NO: 98657

SEQ ID NO: 757765 - RNA, 64 nt, Homo Sapiens; identical to SEQ ID NO: 98658

SEQ ID NO: 757766 - RNA, 64 nt, Homo Sapiens; identical to SEQ ID NO: 98659

SEQ ID NO: 757767 - RNA, 64 nt, Homo Sapiens; identical to SEQ ID NO: 98660

SEQ ID NO: 757768 - RNA, 64 nt, Homo Sapiens; identical to SEQ ID NO: 98661

SEQ ID NO: 757769 - RNA, 64 nt, Homo Sapiens; identical to SEQ ID NO: 98662

SEQ ID NO: 757770 - RNA, 64 nt, Homo Sapiens; identical to SEQ ID NO: 98663

SEQ ID NO: 757771 - RNA, 64 nt, Homo Sapiens; identical to SEQ ID NO: 98664

SEQ ID NO: 757772 - RNA, 64 nt, Homo Sapiens; identical to SEQ ID NO: 98665

SEQ ID NO: 757773 - RNA, 64 nt, Homo Sapiens; identical to SEQ ID NO: 98666

SEQ ID NO: 757774 - RNA, 64 nt, Homo Sapiens; identical to SEQ ID NO: 98667

SEQ ID NO: 757775 - RNA, 64 nt, Homo Sapiens; identical to SEQ ID NO: 98668

SEQ ID NO: 757776 - RNA, 64 nt, Homo Sapiens; identical to SEQ ID NO: 98669

SEQ ID NO: 757777 - RNA, 64 nt, Homo Sapiens; identical to SEQ ID NO: 98670

SEQ ID NO: 757778 - RNA, 64 nt, Homo Sapiens; identical to SEQ ID NO: 98671

SEQ ID NO: 757779 - RNA, 62 nt, Homo Sapiens
ggcccuccaccuguggcucacaucucgccagccccacagagcauccucaggccucuccaagg

SEQ ID NO: 757780 - RNA, 62 nt, Homo Sapiens
cucaaccuccggaguccaggagaacccguacccccacagagccuuaagcaacuacuucugug

SEQ ID NO: 757781 - RNA, 62 nt, Homo Sapiens
cuauuucugaugaauaugaauaaaacaugccucccacagaaucgucagcccgaguucugaau

SEQ ID NO: 757782 - RNA, 62 nt, Homo Sapiens
cgugaguugauuaaaucucuaagcauguaaagcccacagaacugaggccuccccagaagcag

SEQ ID NO: 757783 - RNA, 62 nt, Homo Sapiens
ucucggaccucgcuguguuucacugccuccugcccacagacccaggccugccggcccggacc

SEQ ID NO: 757784 - RNA, 62 nt, Homo Sapiens
caaguggacacauggcugugcaggccaggaggcccacagauggacugagugcugggaagggg

SEQ ID NO: 757785 - RNA, 62 nt, Homo Sapiens
uaauauauguccggacagcuaugccugugugccccacagacccugccacauggagucuugcc

SEQ ID NO: 757786 - RNA, 62 nt, Homo Sapiens
cacagugugucuggacagccagaucugagugccccacagaguacugucaugcaggucauauc

SEQ ID NO: 757787 - RNA, 62 nt, Homo Sapiens
caagaugguguucugcuaauguuaaaugucagcccacagagcuaauaauaccucaguauaau

SEQ ID NO: 757788 - RNA, 62 nt, Homo Sapiens
aacaacaagguuaagcuucaucugcuuggugucccacagaacuugcacaagcaguuguuauu

SEQ ID NO: 757789 - RNA, 62 nt, Homo Sapiens
cugguggggagaccauggcugaggcugcucaccccacagacaugagaccuuggcucuguaug

SEQ ID NO: 757790 - RNA, 62 nt, Homo Sapiens
gguuggcagcuucucuugucaaaagcuggggacccacagagggaggagaggaaacagugacu

SEQ ID NO: 757791 - RNA, 62 nt, Homo Sapiens
augcagcccccagcugcaugggaugaagccaccccacagaggggccccacagaccccacaga

SEQ ID NO: 757792 - RNA, 62 nt, Homo Sapiens
augaagccaccccacagaggggccccacagaccccacagaggaaugcugaugacuuggagca

SEQ ID NO: 757793 - RNA, 62 nt, Homo Sapiens
ccacagaggaugaagccacccuuggagcaggccccacagaccugggcauggaaugcugauga

SEQ ID NO: 757794 - RNA, 62 nt, Homo Sapiens
acacugaaagcugaguccugccgucugucucacccacagaugucuguagucggucgguguga

SEQ ID NO: 757795 - RNA, 62 nt, Homo Sapiens
ccagauucucaagcagaugcccaagggagguccccacagagccagagugccugaggcuuccu

SEQ ID NO: 757796 - RNA, 62 nt, Homo Sapiens
uuuguuuuuaaguaugacaggaguuaccucuucccacagacaaaaugauugauaauaggaau

SEQ ID NO: 757797 - RNA, 62 nt, Homo Sapiens
cacauccaagcucacaaauacucucaucuucccccacagauauauuuuccagagucucuaaa

SEQ ID NO: 757798 - RNA, 62 nt, Homo Sapiens
gacccccagagccaagguggcugggaucuggccccacagauggggaaagauggggaagggug

SEQ ID NO: 757799 - RNA, 62 nt, Homo Sapiens
cuccauaugcaaucaguagcgagcagccgggccccacagacccucaugcacucucuuacgug

SEQ ID NO: 757800 - RNA, 62 nt, Homo Sapiens
cuccagagcuagcugaggccaccugccccucccccacagagcgaauccugacugcaaggccc

SEQ ID NO: 757801 - RNA, 62 nt, Homo Sapiens
ucuuagccaauccuaugcagucccgagccccgcccacagagcgggcaacggcuccccauuuu

SEQ ID NO: 757802 - RNA, 62 nt, Homo Sapiens
caaauuugcugggagagggaaagacauucagacccacagaaaggaggcagcacacagagaaa

SEQ ID NO: 757803 - RNA, 62 nt, Homo Sapiens
ggggagguuggucagggaagagagggguucuacccacagaucaacuguguaaucuuuuacua

SEQ ID NO: 757804 - RNA, 62 nt, Homo Sapiens
gcaggagcauagaauaguuuggguaccaggaacccacagaggcacacaugaaaagccaaauu

SEQ ID NO: 757805 - RNA, 62 nt, Homo Sapiens
uagucuccauuucauagaugaaaauagugaagcccacagaaaauaaguagcuccuccacagg

SEQ ID NO: 757806 - RNA, 62 nt, Homo Sapiens
ccaccagucuuucugggaacuaugcacucagccccacagaacagggaccacccuccccacag

SEQ ID NO: 757807 - RNA, 62 nt, Homo Sapiens
guuugauggcugugcuguauguuacucugcaccccacagauggaguccccagccucccucag

SEQ ID NO: 757808 - RNA, 62 nt, Homo Sapiens
cugcuccccacacggacuccaggcgguccccacccacagaagcagaccuucagcucagguaa

SEQ ID NO: 757809 - RNA, 62 nt, Homo Sapiens
ggguggcccuggaggccccugaccccaccccacccacagagcacgagggccccgucagcuca

SEQ ID NO: 757810 - RNA, 62 nt, Homo Sapiens
acgggaugcuuugaagauaccaugaaauaaaacccacagagguauuugauguauuuaauugu

SEQ ID NO: 757811 - RNA, 62 nt, Homo Sapiens
agggacuugcaguggauucuuggucaggugugcccacagaugcggaggcgaggugagugauu

SEQ ID NO: 757812 - RNA, 62 nt, Homo Sapiens
aagguggugagggcggaggggccgcuccaggccccacagagcaggagacccccagagaaagc

SEQ ID NO: 757813 - RNA, 62 nt, Homo Sapiens
gugaguuuggugcaugcaaaccugugugcucacccacagagcaugggguaaugguguguaga

SEQ ID NO: 757814 - RNA, 62 nt, Homo Sapiens
gcaaagaaacugcccaugguaggauaggggugcccacagaggucagcccaacugcagguggu

SEQ ID NO: 757815 - RNA, 62 nt, Homo Sapiens
gcugcuccuggaugccccugcacgggccccuccccacagaaacugugcuggccugugcucaa

SEQ ID NO: 757816 - RNA, 64 nt, Homo Sapiens; identical to SEQ ID NO: 376674

SEQ ID NO: 757817 - RNA, 64 nt, Homo Sapiens; identical to SEQ ID NO: 376675

SEQ ID NO: 757818 - RNA, 64 nt, Homo Sapiens; identical to SEQ ID NO: 376676

SEQ ID NO: 757819 - RNA, 64 nt, Homo Sapiens; identical to SEQ ID NO: 376677

SEQ ID NO: 757820 - RNA, 64 nt, Homo Sapiens; identical to SEQ ID NO: 376678

SEQ ID NO: 757821 - RNA, 64 nt, Homo Sapiens; identical to SEQ ID NO: 376679

SEQ ID NO: 757822 - RNA, 64 nt, Homo Sapiens; identical to SEQ ID NO: 376680

SEQ ID NO: 757823 - RNA, 64 nt, Homo Sapiens; identical to SEQ ID NO: 376681

SEQ ID NO: 757824 - RNA, 64 nt, Homo Sapiens; identical to SEQ ID NO: 376682

SEQ ID NO: 757825 - RNA, 64 nt, Homo Sapiens; identical to SEQ ID NO: 376683

SEQ ID NO: 757826 - RNA, 64 nt, Homo Sapiens; identical to SEQ ID NO: 376684

SEQ ID NO: 757827 - RNA, 64 nt, Homo Sapiens; identical to SEQ ID NO: 376685

SEQ ID NO: 757828 - RNA, 64 nt, Homo Sapiens; identical to SEQ ID NO: 376686

SEQ ID NO: 757829 - RNA, 64 nt, Homo Sapiens; identical to SEQ ID NO: 376687

SEQ ID NO: 757830 - RNA, 64 nt, Homo Sapiens; identical to SEQ ID NO: 376688

SEQ ID NO: 757831 - RNA, 64 nt, Homo Sapiens; identical to SEQ ID NO: 376689

SEQ ID NO: 757832 - RNA, 64 nt, Homo Sapiens; identical to SEQ ID NO: 376690

SEQ ID NO: 757833 - RNA, 64 nt, Homo Sapiens; identical to SEQ ID NO: 376691

SEQ ID NO: 757834 - RNA, 64 nt, Homo Sapiens; identical to SEQ ID NO: 376692

SEQ ID NO: 757835 - RNA, 64 nt, Homo Sapiens; identical to SEQ ID NO: 376693

SEQ ID NO: 757836 - RNA, 64 nt, Homo Sapiens; identical to SEQ ID NO: 376694

SEQ ID NO: 757837 - RNA, 64 nt, Homo Sapiens; identical to SEQ ID NO: 376695

SEQ ID NO: 757838 - RNA, 64 nt, Homo Sapiens; identical to SEQ ID NO: 376696

SEQ ID NO: 757839 - RNA, 64 nt, Homo Sapiens; identical to SEQ ID NO: 376697

SEQ ID NO: 757840 - RNA, 64 nt, Homo Sapiens; identical to SEQ ID NO: 376698

SEQ ID NO: 757841 - RNA, 64 nt, Homo Sapiens; identical to SEQ ID NO: 376699

SEQ ID NO: 757842 - RNA, 64 nt, Homo Sapiens; identical to SEQ ID NO: 376700

SEQ ID NO: 757843 - RNA, 64 nt, Homo Sapiens; identical to SEQ ID NO: 376701

SEQ ID NO: 757844 - RNA, 64 nt, Homo Sapiens; identical to SEQ ID NO: 376702

SEQ ID NO: 757845 - RNA, 64 nt, Homo Sapiens; identical to SEQ ID NO: 376703

SEQ ID NO: 757846 - RNA, 64 nt, Homo Sapiens; identical to SEQ ID NO: 376704

SEQ ID NO: 757847 - RNA, 64 nt, Homo Sapiens; identical to SEQ ID NO: 376705

SEQ ID NO: 757848 - RNA, 64 nt, Homo Sapiens; identical to SEQ ID NO: 376706

SEQ ID NO: 757849 - RNA, 64 nt, Homo Sapiens; identical to SEQ ID NO: 376707

SEQ ID NO: 757850 - RNA, 64 nt, Homo Sapiens; identical to SEQ ID NO: 376708

SEQ ID NO: 757851 - RNA, 64 nt, Homo Sapiens; identical to SEQ ID NO: 376709

SEQ ID NO: 757852 - RNA, 64 nt, Homo Sapiens; identical to SEQ ID NO: 376710

SEQ ID NO: 757853 - RNA, 64 nt, Homo Sapiens; identical to SEQ ID NO: 376711

SEQ ID NO: 757854 - RNA, 64 nt, Homo Sapiens; identical to SEQ ID NO: 376712

SEQ ID NO: 757855 - RNA, 64 nt, Homo Sapiens; identical to SEQ ID NO: 376713

SEQ ID NO: 757856 - RNA, 64 nt, Homo Sapiens; identical to SEQ ID NO: 376714

SEQ ID NO: 757857 - RNA, 64 nt, Homo Sapiens; identical to SEQ ID NO: 376715

SEQ ID NO: 757858 - RNA, 64 nt, Homo Sapiens; identical to SEQ ID NO: 376716

SEQ ID NO: 757859 - RNA, 64 nt, Homo Sapiens; identical to SEQ ID NO: 376717

SEQ ID NO: 757860 - RNA, 64 nt, Homo Sapiens; identical to SEQ ID NO: 376718

SEQ ID NO: 757861 - RNA, 64 nt, Homo Sapiens; identical to SEQ ID NO: 376719

SEQ ID NO: 757862 - RNA, 64 nt, Homo Sapiens; identical to SEQ ID NO: 376720

SEQ ID NO: 757863 - RNA, 64 nt, Homo Sapiens; identical to SEQ ID NO: 376721

SEQ ID NO: 757864 - RNA, 64 nt, Homo Sapiens; identical to SEQ ID NO: 376722

SEQ ID NO: 757865 - RNA, 64 nt, Homo Sapiens; identical to SEQ ID NO: 376723

SEQ ID NO: 757866 - RNA, 64 nt, Homo Sapiens; identical to SEQ ID NO: 376724

SEQ ID NO: 757867 - RNA, 64 nt, Homo Sapiens; identical to SEQ ID NO: 376725

SEQ ID NO: 757868 - RNA, 64 nt, Homo Sapiens; identical to SEQ ID NO: 376726

SEQ ID NO: 757869 - RNA, 64 nt, Homo Sapiens; identical to SEQ ID NO: 376727

SEQ ID NO: 757870 - RNA, 64 nt, Homo Sapiens; identical to SEQ ID NO: 376728

SEQ ID NO: 757871 - RNA, 64 nt, Homo Sapiens; identical to SEQ ID NO: 376729

SEQ ID NO: 757872 - RNA, 64 nt, Homo Sapiens; identical to SEQ ID NO: 376730

SEQ ID NO: 757873 - RNA, 64 nt, Homo Sapiens; identical to SEQ ID NO: 376731

SEQ ID NO: 757874 - RNA, 62 nt, Homo Sapiens; identical to SEQ ID NO: 376732

SEQ ID NO: 757875 - RNA, 64 nt, Homo Sapiens; identical to SEQ ID NO: 376733

SEQ ID NO: 757876 - RNA, 64 nt, Homo Sapiens; identical to SEQ ID NO: 376734

SEQ ID NO: 757877 - RNA, 55 nt, Homo Sapiens; identical to SEQ ID NO: 376735

SEQ ID NO: 757878 - RNA, 64 nt, Homo Sapiens; identical to SEQ ID NO: 376736

SEQ ID NO: 757879 - RNA, 64 nt, Homo Sapiens; identical to SEQ ID NO: 376737

SEQ ID NO: 757880 - RNA, 64 nt, Homo Sapiens; identical to SEQ ID NO: 376738

SEQ ID NO: 757881 - RNA, 64 nt, Homo Sapiens; identical to SEQ ID NO: 376739

SEQ ID NO: 757882 - RNA, 64 nt, Homo Sapiens; identical to SEQ ID NO: 376740

SEQ ID NO: 757883 - RNA, 64 nt, Homo Sapiens; identical to SEQ ID NO: 376741

SEQ ID NO: 757884 - RNA, 64 nt, Homo Sapiens; identical to SEQ ID NO: 376742

SEQ ID NO: 757885 - RNA, 64 nt, Homo Sapiens; identical to SEQ ID NO: 376743

SEQ ID NO: 757886 - RNA, 64 nt, Homo Sapiens; identical to SEQ ID NO: 376744

SEQ ID NO: 757887 - RNA, 64 nt, Homo Sapiens; identical to SEQ ID NO: 376745

SEQ ID NO: 757888 - RNA, 64 nt, Homo Sapiens; identical to SEQ ID NO: 376746

SEQ ID NO: 757889 - RNA, 64 nt, Homo Sapiens; identical to SEQ ID NO: 376747

SEQ ID NO: 757890 - RNA, 64 nt, Homo Sapiens; identical to SEQ ID NO: 376748

SEQ ID NO: 757891 - RNA, 64 nt, Homo Sapiens; identical to SEQ ID NO: 376749

SEQ ID NO: 757892 - RNA, 64 nt, Homo Sapiens; identical to SEQ ID NO: 376750

SEQ ID NO: 757893 - RNA, 64 nt, Homo Sapiens; identical to SEQ ID NO: 376751

SEQ ID NO: 757894 - RNA, 64 nt, Homo Sapiens; identical to SEQ ID NO: 376752

SEQ ID NO: 757895 - RNA, 64 nt, Homo Sapiens; identical to SEQ ID NO: 376753

SEQ ID NO: 757896 - RNA, 64 nt, Homo Sapiens; identical to SEQ ID NO: 376754

SEQ ID NO: 757897 - RNA, 64 nt, Homo Sapiens; identical to SEQ ID NO: 376755

SEQ ID NO: 757898 - RNA, 64 nt, Homo Sapiens; identical to SEQ ID NO: 376756

SEQ ID NO: 757899 - RNA, 64 nt, Homo Sapiens; identical to SEQ ID NO: 376757

SEQ ID NO: 757900 - RNA, 64 nt, Homo Sapiens; identical to SEQ ID NO: 376758

SEQ ID NO: 757901 - RNA, 64 nt, Homo Sapiens; identical to SEQ ID NO: 376759

SEQ ID NO: 757902 - RNA, 64 nt, Homo Sapiens; identical to SEQ ID NO: 376760

SEQ ID NO: 757903 - RNA, 64 nt, Homo Sapiens; identical to SEQ ID NO: 376761

SEQ ID NO: 757904 - RNA, 64 nt, Homo Sapiens; identical to SEQ ID NO: 376762

SEQ ID NO: 757905 - RNA, 64 nt, Homo Sapiens; identical to SEQ ID NO: 376763

SEQ ID NO: 757906 - RNA, 64 nt, Homo Sapiens; identical to SEQ ID NO: 376764

SEQ ID NO: 757907 - RNA, 64 nt, Homo Sapiens; identical to SEQ ID NO: 376765

SEQ ID NO: 757908 - RNA, 64 nt, Homo Sapiens; identical to SEQ ID NO: 376766

SEQ ID NO: 757909 - RNA, 64 nt, Homo Sapiens; identical to SEQ ID NO: 376767

SEQ ID NO: 757910 - RNA, 64 nt, Homo Sapiens; identical to SEQ ID NO: 376768

SEQ ID NO: 757911 - RNA, 64 nt, Homo Sapiens; identical to SEQ ID NO: 376769

SEQ ID NO: 757912 - RNA, 64 nt, Homo Sapiens; identical to SEQ ID NO: 376770

SEQ ID NO: 757913 - RNA, 64 nt, Homo Sapiens; identical to SEQ ID NO: 376771

SEQ ID NO: 757914 - RNA, 64 nt, Homo Sapiens; identical to SEQ ID NO: 376772

SEQ ID NO: 757915 - RNA, 64 nt, Homo Sapiens; identical to SEQ ID NO: 376773

SEQ ID NO: 757916 - RNA, 64 nt, Homo Sapiens; identical to SEQ ID NO: 376774

SEQ ID NO: 757917 - RNA, 64 nt, Homo Sapiens; identical to SEQ ID NO: 376775

SEQ ID NO: 757918 - RNA, 64 nt, Homo Sapiens; identical to SEQ ID NO: 376776

SEQ ID NO: 757919 - RNA, 64 nt, Homo Sapiens; identical to SEQ ID NO: 376777

SEQ ID NO: 757920 - RNA, 64 nt, Homo Sapiens; identical to SEQ ID NO: 376778

SEQ ID NO: 757921 - RNA, 64 nt, Homo Sapiens; identical to SEQ ID NO: 376779

SEQ ID NO: 757922 - RNA, 64 nt, Homo Sapiens; identical to SEQ ID NO: 376780

SEQ ID NO: 757923 - RNA, 64 nt, Homo Sapiens; identical to SEQ ID NO: 376781

SEQ ID NO: 757924 - RNA, 64 nt, Homo Sapiens; identical to SEQ ID NO: 376782

SEQ ID NO: 757925 - RNA, 64 nt, Homo Sapiens; identical to SEQ ID NO: 376783

SEQ ID NO: 757926 - RNA, 64 nt, Homo Sapiens; identical to SEQ ID NO: 376784

SEQ ID NO: 757927 - RNA, 64 nt, Homo Sapiens; identical to SEQ ID NO: 376785

SEQ ID NO: 757928 - RNA, 64 nt, Homo Sapiens; identical to SEQ ID NO: 83612

SEQ ID NO: 757929 - RNA, 64 nt, Homo Sapiens; identical to SEQ ID NO: 83613

SEQ ID NO: 757930 - RNA, 64 nt, Homo Sapiens; identical to SEQ ID NO: 83614

SEQ ID NO: 757931 - RNA, 64 nt, Homo Sapiens; identical to SEQ ID NO: 83615

SEQ ID NO: 757932 - RNA, 64 nt, Homo Sapiens; identical to SEQ ID NO: 83616

SEQ ID NO: 757933 - RNA, 64 nt, Homo Sapiens; identical to SEQ ID NO: 83617

SEQ ID NO: 757934 - RNA, 64 nt, Homo Sapiens; identical to SEQ ID NO: 83618

SEQ ID NO: 757935 - RNA, 64 nt, Homo Sapiens; identical to SEQ ID NO: 83619

SEQ ID NO: 757936 - RNA, 64 nt, Homo Sapiens; identical to SEQ ID NO: 83620

SEQ ID NO: 757937 - RNA, 64 nt, Homo Sapiens; identical to SEQ ID NO: 83621

SEQ ID NO: 757938 - RNA, 64 nt, Homo Sapiens; identical to SEQ ID NO: 83622

SEQ ID NO: 757939 - RNA, 64 nt, Homo Sapiens; identical to SEQ ID NO: 83623

SEQ ID NO: 757940 - RNA, 64 nt, Homo Sapiens; identical to SEQ ID NO: 83624

SEQ ID NO: 757941 - RNA, 64 nt, Homo Sapiens; identical to SEQ ID NO: 83625

SEQ ID NO: 757942 - RNA, 64 nt, Homo Sapiens; identical to SEQ ID NO: 83626

SEQ ID NO: 757943 - RNA, 64 nt, Homo Sapiens; identical to SEQ ID NO: 83627

SEQ ID NO: 757944 - RNA, 64 nt, Homo Sapiens; identical to SEQ ID NO: 83628

SEQ ID NO: 757945 - RNA, 64 nt, Homo Sapiens; identical to SEQ ID NO: 83629

SEQ ID NO: 757946 - RNA, 64 nt, Homo Sapiens; identical to SEQ ID NO: 83630

SEQ ID NO: 757947 - RNA, 64 nt, Homo Sapiens; identical to SEQ ID NO: 83631

SEQ ID NO: 757948 - RNA, 64 nt, Homo Sapiens; identical to SEQ ID NO: 83632

SEQ ID NO: 757949 - RNA, 60 nt, Homo Sapiens; identical to SEQ ID NO: 83633

SEQ ID NO: 757950 - RNA, 64 nt, Homo Sapiens; identical to SEQ ID NO: 83634

SEQ ID NO: 757951 - RNA, 64 nt, Homo Sapiens; identical to SEQ ID NO: 83635

SEQ ID NO: 757952 - RNA, 64 nt, Homo Sapiens; identical to SEQ ID NO: 83636

SEQ ID NO: 757953 - RNA, 64 nt, Homo Sapiens; identical to SEQ ID NO: 83637

SEQ ID NO: 757954 - RNA, 64 nt, Homo Sapiens; identical to SEQ ID NO: 83638

SEQ ID NO: 757955 - RNA, 64 nt, Homo Sapiens; identical to SEQ ID NO: 83639

SEQ ID NO: 757956 - RNA, 64 nt, Homo Sapiens; identical to SEQ ID NO: 83640

SEQ ID NO: 757957 - RNA, 64 nt, Homo Sapiens; identical to SEQ ID NO: 83641

SEQ ID NO: 757958 - RNA, 64 nt, Homo Sapiens; identical to SEQ ID NO: 83642

SEQ ID NO: 757959 - RNA, 64 nt, Homo Sapiens; identical to SEQ ID NO: 83643

SEQ ID NO: 757960 - RNA, 64 nt, Homo Sapiens; identical to SEQ ID NO: 83644

SEQ ID NO: 757961 - RNA, 64 nt, Homo Sapiens; identical to SEQ ID NO: 83645

SEQ ID NO: 757962 - RNA, 64 nt, Homo Sapiens; identical to SEQ ID NO: 83646

SEQ ID NO: 757963 - RNA, 64 nt, Homo Sapiens; identical to SEQ ID NO: 83647

SEQ ID NO: 757964 - RNA, 64 nt, Homo Sapiens; identical to SEQ ID NO: 83648

SEQ ID NO: 757965 - RNA, 64 nt, Homo Sapiens; identical to SEQ ID NO: 83649

SEQ ID NO: 757966 - RNA, 64 nt, Homo Sapiens; identical to SEQ ID NO: 83650

SEQ ID NO: 757967 - RNA, 54 nt, Homo Sapiens; identical to SEQ ID NO: 83651

SEQ ID NO: 757968 - RNA, 64 nt, Homo Sapiens; identical to SEQ ID NO: 83652

SEQ ID NO: 757969 - RNA, 64 nt, Homo Sapiens; identical to SEQ ID NO: 83653

SEQ ID NO: 757970 - RNA, 64 nt, Homo Sapiens; identical to SEQ ID NO: 83654

SEQ ID NO: 757971 - RNA, 64 nt, Homo Sapiens; identical to SEQ ID NO: 83655

SEQ ID NO: 757972 - RNA, 64 nt, Homo Sapiens; identical to SEQ ID NO: 83656

SEQ ID NO: 757973 - RNA, 64 nt, Homo Sapiens; identical to SEQ ID NO: 83657

SEQ ID NO: 757974 - RNA, 59 nt, Homo Sapiens; identical to SEQ ID NO: 83658

SEQ ID NO: 757975 - RNA, 64 nt, Homo Sapiens; identical to SEQ ID NO: 83659

SEQ ID NO: 757976 - RNA, 64 nt, Homo Sapiens; identical to SEQ ID NO: 83660

SEQ ID NO: 757977 - RNA, 64 nt, Homo Sapiens; identical to SEQ ID NO: 83661

SEQ ID NO: 757978 - RNA, 64 nt, Homo Sapiens; identical to SEQ ID NO: 83662

SEQ ID NO: 757979 - RNA, 64 nt, Homo Sapiens; identical to SEQ ID NO: 83663

SEQ ID NO: 757980 - RNA, 64 nt, Homo Sapiens; identical to SEQ ID NO: 83664

SEQ ID NO: 757981 - RNA, 64 nt, Homo Sapiens; identical to SEQ ID NO: 83665

SEQ ID NO: 757982 - RNA, 64 nt, Homo Sapiens; identical to SEQ ID NO: 83666

SEQ ID NO: 757983 - RNA, 64 nt, Homo Sapiens; identical to SEQ ID NO: 83667

SEQ ID NO: 757984 - RNA, 64 nt, Homo Sapiens; identical to SEQ ID NO: 83668

SEQ ID NO: 757985 - RNA, 64 nt, Homo Sapiens
ggagccuaaaccaggcugcaucggaggccaggacccggaucauucacugugauacccugcccuc

SEQ ID NO: 757986 - RNA, 64 nt, Homo Sapiens
accagaggcagaucuggaacucgucaacaacagcccggaucacaugcuguuacuggacugccca

SEQ ID NO: 757987 - RNA, 64 nt, Homo Sapiens
acuggcauucuuuucuccugugggaguuugccagccggaucacauuacauggcuucaucuaccu

SEQ ID NO: 757988 - RNA, 64 nt, Homo Sapiens
agcacaauugugaaacuuguuguccucgaggaucccggaucauccaagcauugaucuguguacg

SEQ ID NO: 757989 - RNA, 64 nt, Homo Sapiens
cugcugcaucuucuaccucccuccaugacccccaccggaucaguauagcaaugucuggauuggc

SEQ ID NO: 757990 - RNA, 64 nt, Homo Sapiens
cacacacguguucccuucuaacacggagcauuauccggaucagccagucugaaaaccuaagcag

SEQ ID NO: 757991 - RNA, 64 nt, Homo Sapiens
gagaugcagaaugcauaagaugaacauugcaugaccggaucauuuuagugucuuugcguuaaaa

SEQ ID NO: 757992 - RNA, 57 nt, Homo Sapiens
ucagguaggggagaacugacgagagcaccggaucauccuuuuguggacacuuguuga

SEQ ID NO: 757993 - RNA, 51 nt, Homo Sapiens
guucuucccugccugcuuagcccggaucaagucacuuagaucgcuccuugg

SEQ ID NO: 757994 - RNA, 64 nt, Homo Sapiens
ucgagcaaccagucaugaugaaaccaagugguggccggaucaguaugacacccugcugcccccg

SEQ ID NO: 757995 - RNA, 64 nt, Homo Sapiens
uccacuuuucuauguccuccuuccaccccaagucccggaucacucgcuguuuucuggcuagcuc

SEQ ID NO: 757996 - RNA, 64 nt, Homo Sapiens
gcaggaccucccuuccgaccugacgaaacuggccccggaucagaccugagccccgcccucuucc

SEQ ID NO: 757997 - RNA, 64 nt, Homo Sapiens
auucuggaggugcacuuacucuucuacaauguggccggaucauuugucauuccugaauaggucu

SEQ ID NO: 757998 - RNA, 64 nt, Homo Sapiens
gugguuggguggaggucuguagccagcagguccuccggaucacucagcaucacaccagccaugc

SEQ ID NO: 757999 - RNA, 64 nt, Homo Sapiens
ggggagacuuuuaggaggccgcagccuuccaucaccggaucaguuuuuccucuuaggaaagcug

SEQ ID NO: 758000 - RNA, 64 nt, Homo Sapiens
gcagggcguuuacauagaaacagcagugcacuccccggaucacacuccugcugaccccgccacu

SEQ ID NO: 758001 - RNA, 64 nt, Homo Sapiens
ccgucccaccuccagccgaauagaaggucugcucccggaucacccucagccuuggugcucagug

SEQ ID NO: 758002 - RNA, 64 nt, Homo Sapiens
aucugaagagcagacggauguuccauguuguuggccggaucaccccuguaaacauagauucgcu

SEQ ID NO: 758003 - RNA, 64 nt, Homo Sapiens
ugcauucucaacacaggacuucccuuaacaguuuccggaucagugaccaccaccacguucaggu

SEQ ID NO: 758004 - RNA, 64 nt, Homo Sapiens
aguuauaucacaguugagaguuuaaucaaaaugaccggaucagcauauucuuuuuuuagaugag

SEQ ID NO: 758005 - RNA, 64 nt, Homo Sapiens
aucuagaagucuugggucccuguuggggaaaaucccggaucaggccccaucucuagaaugagga

SEQ ID NO: 758006 - RNA, 64 nt, Homo Sapiens
agaucccagcucuauucuugguauaaaggcuucuccggaucaguacaugcaugucacauuaaca

SEQ ID NO: 758007 - RNA, 64 nt, Homo Sapiens
cagcuguggccucucgggcucggcagaagggacgccggaucaggggccuggucuccagcaccug

SEQ ID NO: 758008 - RNA, 64 nt, Homo Sapiens
gugugaggaggccggggcuacaaugugaccaauuccggaucaggcccccucccuuuucaaauuc

SEQ ID NO: 758009 - RNA, 64 nt, Homo Sapiens
accguggucugaugaauggaaaggccaagccaagccggaucagcacccccccagugcaaacccc

SEQ ID NO: 758010 - RNA, 64 nt, Homo Sapiens; identical to SEQ ID NO: 60066

SEQ ID NO: 758011 - RNA, 64 nt, Homo Sapiens; identical to SEQ ID NO: 60067

SEQ ID NO: 758012 - RNA, 64 nt, Homo Sapiens; identical to SEQ ID NO: 60068

SEQ ID NO: 758013 - RNA, 64 nt, Homo Sapiens; identical to SEQ ID NO: 60069

SEQ ID NO: 758014 - RNA, 64 nt, Homo Sapiens; identical to SEQ ID NO: 60070

SEQ ID NO: 758015 - RNA, 64 nt, Homo Sapiens; identical to SEQ ID NO: 60071

SEQ ID NO: 758016 - RNA, 64 nt, Homo Sapiens; identical to SEQ ID NO: 60072

SEQ ID NO: 758017 - RNA, 64 nt, Homo Sapiens; identical to SEQ ID NO: 60073

SEQ ID NO: 758018 - RNA, 64 nt, Homo Sapiens; identical to SEQ ID NO: 60074

SEQ ID NO: 758019 - RNA, 64 nt, Homo Sapiens; identical to SEQ ID NO: 60075

SEQ ID NO: 758020 - RNA, 64 nt, Homo Sapiens; identical to SEQ ID NO: 60076

SEQ ID NO: 758021 - RNA, 64 nt, Homo Sapiens
aucaguuuacuuucaguggauucagaauuguguagcaggauaaccuuguauuuuuccauccgcu

SEQ ID NO: 758022 - RNA, 64 nt, Homo Sapiens
aucaaacagaguucaaauuccacacagauaagaggcaggauauauaagcgccagugguaguugg

SEQ ID NO: 758023 - RNA, 62 nt, Homo Sapiens
uuuuccucacaagucaucaugauuuuuuauuuuaaaauaaucuggaaguaaugggaacuuag

SEQ ID NO: 758024 - RNA, 62 nt, Homo Sapiens
aagaugccucccugauguauagaaucuccuuguaaaauaaauaauugcauuguauaucaguc

SEQ ID NO: 758025 - RNA, 62 nt, Homo Sapiens
auaugaucagagcuugaacacaggcuuauuuuuaaaauaaaaauauuuuuaacauggguuuc

SEQ ID NO: 758026 - RNA, 62 nt, Homo Sapiens
uguuauuucuuaaaauucagugagauauaggauaaaauaaugcuuugagaagaauguuuaau

SEQ ID NO: 758027 - RNA, 62 nt, Homo Sapiens
uaaugcuuugagaagaauguuuaauagaaaauuaaaauaacuuuuucuggccucucuuguuu

SEQ ID NO: 758028 - RNA, 62 nt, Homo Sapiens
uaacaaacuagguguuauuuauuaacguauuauaaaauaauguuugauccaguaugugcuug

SEQ ID NO: 758029 - RNA, 62 nt, Homo Sapiens
guugaauuccaauugcuuuuuggccuuuuggcuaaaauaaauguagcaucuaauuuuaucag

SEQ ID NO: 758030 - RNA, 62 nt, Homo Sapiens
uucagccaucaguucaagagccaaugccuuuuuaaaauaaagcuucuguggucuuguuuuua

SEQ ID NO: 758031 - RNA, 62 nt, Homo Sapiens
auguuaaauuuaugcauaguaauuuugcacuguaaaauaauucccuucucccauuccuuguc

SEQ ID NO: 758032 - RNA, 62 nt, Homo Sapiens
aauuuuaauaaauuauauaauuauacauauuguaaaauaaagaccgguauuuuauuuucugc

SEQ ID NO: 758033 - RNA, 62 nt, Homo Sapiens
ugugucuguuauguucaauaacugagcuaacauaaaauaacucuagguuucuacuugauuuu

SEQ ID NO: 758034 - RNA, 62 nt, Homo Sapiens
cacuuguuuuugccaaugggagguagacacaauaaaauaaugccaugggagucacacugaaa

SEQ ID NO: 758035 - RNA, 62 nt, Homo Sapiens
cucuguagcuaacccuuauaaacuaggcucaguaaaauaaagcacucuuauuuuuugaucug

SEQ ID NO: 758036 - RNA, 62 nt, Homo Sapiens
guguauuuuuucagguuucuggaaauaaauaguaaaauaaauggcacaaauaguuucaauaa

SEQ ID NO: 758037 - RNA, 62 nt, Homo Sapiens
uaaagaaauuauauuuuguucuauugcuaggguaaaauaaauacauuuguguccaacugaaa

SEQ ID NO: 758038 - RNA, 62 nt, Homo Sapiens
acauuuguguccaacugaaauauaauugucauuaaaauaauuuuaaagagugaagaaaauau

SEQ ID NO: 758039 - RNA, 62 nt, Homo Sapiens
gaacaaaaggugccuauucuuuuuuaaaaaaauaaaauaaaacauaaauauuacucuuccau

SEQ ID NO: 758040 - RNA, 62 nt, Homo Sapiens
aauagccuagggcugaauuuuugucagauaaauaaaauaaaucauucauccuuuuuuuugau

SEQ ID NO: 758041 - RNA, 62 nt, Homo Sapiens
uaaauguauuuuagacuuccuguagggggcgauaaaauaaaaugcuaaacaacuggguauac

SEQ ID NO: 758042 - RNA, 62 nt, Homo Sapiens
uauauaauauucaguggcucauuuauaccuaauaaaauaaugguauuuuaaaauaaugcuac

SEQ ID NO: 758043 - RNA, 62 nt, Homo Sapiens
gcucauuuauaccuaauaaaauaaugguauuuuaaaauaaugcuacuuucaaaguagcauuu

SEQ ID NO: 758044 - RNA, 62 nt, Homo Sapiens
cuguauauacaauaacauaauuuguacauauguaaaauaaaauuaugccauagcaagauugc

SEQ ID NO: 758045 - RNA, 62 nt, Homo Sapiens
cuuaaaauagcaacacucuauauuuagauuguuaaaauaacuaguguugcuuggacuauuau

SEQ ID NO: 758046 - RNA, 62 nt, Homo Sapiens
auccugucucaaaaauuaauuaauuaauuaauuaaaauaaacuagguaaacuuggauaggca

SEQ ID NO: 758047 - RNA, 62 nt, Homo Sapiens
gugucuucucuuguaaaaaugaaacucaaaaauaaaauaaaugugucaaauuuugaaaaaaa

SEQ ID NO: 758048 - RNA, 62 nt, Homo Sapiens
gcuucccucaguucaccaaaguuaccaaaauguaaaauaaaauaagacuggcucagguaagu

SEQ ID NO: 758049 - RNA, 62 nt, Homo Sapiens
ccucaguucaccaaaguuaccaaaauguaaaauaaaauaagacuggcucagguaaguagugc

SEQ ID NO: 758050 - RNA, 62 nt, Homo Sapiens
uuuuuucauugcucccauaagcaaauuuguuuuaaaauaauuguaaaugagguauauacuua

SEQ ID NO: 758051 - RNA, 62 nt, Homo Sapiens
uugaaguauauucaaccaaauacuuuaauguauaaaauaaauauuauacaauauacuuguau

SEQ ID NO: 758052 - RNA, 62 nt, Homo Sapiens
cauuuuuuaaaaaauggacucuugaaaucuguuaaaauaaaauuguacauuuggagauguuu

SEQ ID NO: 758053 - RNA, 62 nt, Homo Sapiens
uaaaauaaaauaaaauaaaaaauaaaauaaaauaaaauaaaacaaaaaauaaaauaaaauaa

SEQ ID NO: 758054 - RNA, 62 nt, Homo Sapiens
uaaaauaaaauaaaauaaaaaauaaaauaaaauaaaauaaaaugucucaaaaaauaaaauaa

SEQ ID NO: 758055 - RNA, 62 nt, Homo Sapiens
uaaaauaaaauaaaauaaaaaauaaaauaaaauaaaauaaaacacucugucucaaaaaauaa

SEQ ID NO: 758056 - RNA, 62 nt, Homo Sapiens
uaaaauaaaauaaaauaaaaaauaaaauaaaauaaaauaaaaagugacacucugucucaaaa

SEQ ID NO: 758057 - RNA, 62 nt, Homo Sapiens
uaaaauaaaauaaaauaaaacaaaaaauaaaauaaaauaaaaaacagagugacacucugucu

SEQ ID NO: 758058 - RNA, 62 nt, Homo Sapiens
uaaaauaaaauaaaauaaaaugucucaaaaaauaaaauaaaaugggcaacagagugacacuc

SEQ ID NO: 758059 - RNA, 62 nt, Homo Sapiens
caccauuuuguuucccuuucaaauaaauaaaauaaaauaaaggccacuguagcgccuuuuua

SEQ ID NO: 758060 - RNA, 62 nt, Homo Sapiens
uaaagcaccauuuuguuuccuuuuaaaauaaauaaaauaaaaguccugccacuguagcgccu

SEQ ID NO: 758061 - RNA, 62 nt, Homo Sapiens
aaaauaaaauaaagcaccauguagcgccuuuuuaaaauaaaucccagcagcguccugccacu

SEQ ID NO: 758062 - RNA, 62 nt, Homo Sapiens
aauaacaaagaagaaaaccaagggucuaccuuuaaaauaagcguaaaaucuauaucagcaaa

SEQ ID NO: 758063 - RNA, 62 nt, Homo Sapiens
auauuuuguugagauauuccgcaguguuaucuuaaaauaagaauuaaggugguggagccacu

SEQ ID NO: 758064 - RNA, 62 nt, Homo Sapiens
aauaaaauuauuucuaaugaauugaacugcuuuaaaauaaauaccauuuugcuaccaguuac

SEQ ID NO: 758065 - RNA, 62 nt, Homo Sapiens
auacuugcacaugaaaauaaauguugccuuuuuaaaauaauuuauaaaagacuuuuaaugaa

SEQ ID NO: 758066 - RNA, 62 nt, Homo Sapiens
auuuuugacuaugaacauuauuucauaaauuuuaaaauaauucuauauaacuaaaaauuuug

SEQ ID NO: 758067 - RNA, 62 nt, Homo Sapiens
ugcuaaaucuuaaaagaaacaagauaagagacuaaaauaaaaggguacaagugguccaaacu

SEQ ID NO: 758068 - RNA, 62 nt, Homo Sapiens
aggagaaaggcuuaggaaguacaauacauugcuaaaauaaaggauaaagucgcacauuuucc

SEQ ID NO: 758069 - RNA, 62 nt, Homo Sapiens
aggaaaacagacuuaaauuuaaaauacauuuauaaaauaaaaggauuaaacaaguauaaaau

SEQ ID NO: 758070 - RNA, 62 nt, Homo Sapiens
uacauuuauaaaauaaaaagauuaaacaaguauaaaauaaaaaugugcuaggucuaagaugg

SEQ ID NO: 758071 - RNA, 62 nt, Homo Sapiens
gcgacagagcaagacccccucucaaaaauaaauaaaauaaaguaaaauaaauauaaauaauu

SEQ ID NO: 758072 - RNA, 62 nt, Homo Sapiens
aagacccccucucaaaaauaaauaaaauaaaguaaaauaaauauaaauaauuguggccgggu

SEQ ID NO: 758073 - RNA, 62 nt, Homo Sapiens
ggaaggucugauuugcaggauuuuuagagcauuaaaauaacuaucaggcagaagaaucuuuc

SEQ ID NO: 758074 - RNA, 62 nt, Homo Sapiens
agucguuugagugcaguaaugaaaucugaaucuaaaauaaaaacaagauuauuuuugucaug

SEQ ID NO: 758075 - RNA, 62 nt, Homo Sapiens
uuaucucaaguauauaaaguuuugccccaugauaaaauaaguaacauauaaauuaauacaua

SEQ ID NO: 758076 - RNA, 62 nt, Homo Sapiens
gugaauuuuaaaauguagaagaaagcaaaaaauaaaauaaguccuaaagugaagaagccauc

SEQ ID NO: 758077 - RNA, 62 nt, Homo Sapiens
ccugauuuucaaaaucugcccucagaugaaaauaaaauaaacgaaacauuuagacaauggcu

SEQ ID NO: 758078 - RNA, 62 nt, Homo Sapiens
aauuuuaugugacuaugaaacgaauauaagcuuaaaauaagugaaucuaauaaaauggcuau

SEQ ID NO: 758079 - RNA, 62 nt, Homo Sapiens
gagcgagaccuugucucuaaaaauaauaguaauaaaauaaaaauaacguuuuaugacuauuu

SEQ ID NO: 758080 - RNA, 62 nt, Homo Sapiens
gcuaaguuaaaauacaguuuaguuauuugcuuuaaaauaaacucuucuuuuuuucuuuaaag

SEQ ID NO: 758081 - RNA, 62 nt, Homo Sapiens
ccuuugggccuguacaaagaaauucuggauguuaaaauaauauauacucaucacagaaaaau

SEQ ID NO: 758082 - RNA, 62 nt, Homo Sapiens
ugauaggggaagugggaguugacaggaugguuuaaaauaagacgugaagguuucaguuaccu

SEQ ID NO: 758083 - RNA, 62 nt, Homo Sapiens
uuuggacugcagguaaaaugaguucuaucaucuaaaauaaccuuuggguuugggguucuugc

SEQ ID NO: 758084 - RNA, 62 nt, Homo Sapiens
uucuuacaaaguauuuuuuuuguuggguuuucuaaaauaauagagcuguauuugcaguuuug

SEQ ID NO: 758085 - RNA, 62 nt, Homo Sapiens
ucccaagccuuuccuuuuagugugacugcugguaaaauaauguguugcaucucagauaaacc

SEQ ID NO: 758086 - RNA, 62 nt, Homo Sapiens
uuuuauaaggaauacuguuauuuuuaaaaccauaaaauaaauuuauacaauaauuuaaauau

SEQ ID NO: 758087 - RNA, 62 nt, Homo Sapiens
aggcaacuuuauuaaugccugaacacuguaccuaaaauaaagaaccuaaaugaccuaaauaa

SEQ ID NO: 758088 - RNA, 62 nt, Homo Sapiens
ccagaacaccaaaaauaaaaccuuuugucuuuuaaaauaaucauugcaacccuuuucuuuac

SEQ ID NO: 758089 - RNA, 62 nt, Homo Sapiens
aauaaaaugguguaguauuuaauaaaauaaaauaaaauaauuagacucuaucucaaaaauaa

SEQ ID NO: 758090 - RNA, 62 nt, Homo Sapiens
uaauuaauaaaaugguguagaauaaaauaaaauaaaauaaaagagcaagacucuaucucaaa

SEQ ID NO: 758091 - RNA, 62 nt, Homo Sapiens
uaaaauaauuaauaaaauggucaaaaauaaaauaaaauaaaacaacagagcaagacucuauc

SEQ ID NO: 758092 - RNA, 62 nt, Homo Sapiens
uaaaauaaaauaauuaauaacuaucucaaaaauaaaauaaaacugagcaacagagcaagacu

SEQ ID NO: 758093 - RNA, 62 nt, Homo Sapiens
cacaucugccuucuugauauccuaauguaaaauaaaauaaaaugagauugugguuuuuucuu

SEQ ID NO: 758094 - RNA, 62 nt, Homo Sapiens
uaaaacacaucugccuucuuuucuuccuaauguaaaauaaaaugcuuugagauugugguuuu

SEQ ID NO: 758095 - RNA, 62 nt, Homo Sapiens
uuuucuugcauaaauacugggaaaaaaaugccuaaaauaagguuauuuuaauuguauagaaa

SEQ ID NO: 758096 - RNA, 62 nt, Homo Sapiens
aauauuuguaaaaaucauacuaccagcuucauuaaaauaaacuuuuaaauggacauugucug

SEQ ID NO: 758097 - RNA, 62 nt, Homo Sapiens
uauccuuggggucaagauccucuuucuuggaauaaaauaauaucaucuuuucgccuaccuga

SEQ ID NO: 758098 - RNA, 62 nt, Homo Sapiens
auacacacacacacacacccaauauguguguauaaaauaaacguaauauauuagaauauaca

SEQ ID NO: 758099 - RNA, 62 nt, Homo Sapiens
gggucuaaguauuuuaaaugaaauuguagcuuuaaaauaacagcaacugauuuugcaaaaaa

SEQ ID NO: 758100 - RNA, 62 nt, Homo Sapiens
ugaguuuuuuggaacucuuucuguguuuucucuaaaauaaucgauaagcuaacaauaacagu

SEQ ID NO: 758101 - RNA, 62 nt, Homo Sapiens
cauauauuuuaugaaucagaauaaccuucaaauaaaauaaaucuaagucgguuaaaauggau

SEQ ID NO: 758102 - RNA, 62 nt, Homo Sapiens
uaaauauauuuuuauagaaaaacaaaucuacauaaaauaaaucuacuguuuagugagcagua

SEQ ID NO: 758103 - RNA, 62 nt, Homo Sapiens
uuuaauuuuugggaccucaguuucuuuguaaguaaaauaacaccugcuuguucuucaucccu

SEQ ID NO: 758104 - RNA, 62 nt, Homo Sapiens
aagcacuuggaaaaugcacuuguccuguuuuguaaaauaaaaagguauuaaauguguauuuc

SEQ ID NO: 758105 - RNA, 62 nt, Homo Sapiens
gcauaaucaaggcacuguaaaucuuauaauuuuaaaauaaauuacuuaagaacaguugucau

SEQ ID NO: 758106 - RNA, 62 nt, Homo Sapiens
auaauucuugcauuuuuuccccauaaccugguuaaaauaaauacgccauuggcaauacuuca

SEQ ID NO: 758107 - RNA, 62 nt, Homo Sapiens
uuaacaauauuaaaugugcaauagaacuuuuauaaaauaauuagaacagagauuuuacaguu

SEQ ID NO: 758108 - RNA, 62 nt, Homo Sapiens
gaccaaggaaggauuuaaccuggugccaagguuaaaauaacauuucucuacugccuauuguu

SEQ ID NO: 758109 - RNA, 62 nt, Homo Sapiens
uuuuuaguucuuaaaaauuuauuuuuaaguucuaaaauaaaauaaaaauaaguucuuaaaau

SEQ ID NO: 758110 - RNA, 62 nt, Homo Sapiens
aguucuuaaaaauuuauuuuuaaguucuaaaauaaaauaaaaauaaguucuuaaaauuuauu

SEQ ID NO: 758111 - RNA, 62 nt, Homo Sapiens
gaaugaaaugauacgaugucucagauuugcuuuaaaauaauagggagguuggggaagugggu

SEQ ID NO: 758112 - RNA, 62 nt, Homo Sapiens
uaugaacugugauaaugcagaagguuuccuuuuaaaauaaaguucagucaaaaaagugagau

SEQ ID NO: 758113 - RNA, 62 nt, Homo Sapiens
uugauuaaaaucuggcaaaguuauauuuacuuuaaaauaaaauaauuuuauugcaauguauu

SEQ ID NO: 758114 - RNA, 62 nt, Homo Sapiens
uaaaaucuggcaaaguuauauuuacuuuaaaauaaaauaauuuuauugcaauguauuuaucu

SEQ ID NO: 758115 - RNA, 62 nt, Homo Sapiens
cucugugccucaguuuucccaugcaugaaaaauaaaauaaaauaaaacggggauucuaaugu

SEQ ID NO: 758116 - RNA, 62 nt, Homo Sapiens
ugccucaguuuucccaugcaugaaaaauaaaauaaaauaaaacggggauucuaauguuugua

SEQ ID NO: 758117 - RNA, 62 nt, Homo Sapiens
uaacuauauauauugccaucacacacgaacaauaaaauaaaguguucuauuaaccugaucuc

SEQ ID NO: 758118 - RNA, 62 nt, Homo Sapiens
gcaacauagugagaccuugucucuacaaaaaauaaaauaaaauaaaaaccaaauuagccaga

SEQ ID NO: 758119 - RNA, 62 nt, Homo Sapiens
auagugagaccuugucucuacaaaaaauaaaauaaaauaaaaaccaaauuagccagacaugg

SEQ ID NO: 758120 - RNA, 62 nt, Homo Sapiens
uccauuauucuuaauauggcuccuauuucucuuaaaauaaaacucuuaaaauaaaauccauu

SEQ ID NO: 758121 - RNA, 62 nt, Homo Sapiens
uccauuuccuauuucucuuauccuguuucucuuaaaauaaaagauuaugcuuaacagcuguu

SEQ ID NO: 758122 - RNA, 62 nt, Homo Sapiens
cccucuuuguuuaaaccauuaauucuuguaaauaaaauaaaucagccgccauccuucuccag

SEQ ID NO: 758123 - RNA, 62 nt, Homo Sapiens
aucaccacuuccccaaagaaaugcacaaucccuaaaauaaagaggugaggguuacacugaag

SEQ ID NO: 758124 - RNA, 62 nt, Homo Sapiens
ugcuuuucagguauuaauauuucgggauguauuaaaauaauugacaugguaauggcacucca

SEQ ID NO: 758125 - RNA, 62 nt, Homo Sapiens
cucccuaccuugcuucaguuugcuguuuauaguaaaauaaaaaugaagacauuuaacgguug

SEQ ID NO: 758126 - RNA, 62 nt, Homo Sapiens
uuauccuguaacauaaauuugcccaugcccauuaaaauaaagauaccuuuguguauagacaa

SEQ ID NO: 758127 - RNA, 62 nt, Homo Sapiens
aaaaauuuuaaacugguuuuauuucaaacaauuaaaauaagagcuucuuuggcucuagaaaa

SEQ ID NO: 758128 - RNA, 62 nt, Homo Sapiens
gggcuaucccguaauuggaagaaugucagaauuaaaauaacacauucuguuuaaaucccuaa

SEQ ID NO: 758129 - RNA, 62 nt, Homo Sapiens
augaucuauguuguuugcccuaauuuaguuaauaaaauaauuguuuuuauucaaagcagcug

SEQ ID NO: 758130 - RNA, 62 nt, Homo Sapiens
augaaccagcaaaaggucagaaguaguaugacuaaaauaaaguuuuuuaaauauauauuuuu

SEQ ID NO: 758131 - RNA, 62 nt, Homo Sapiens
uuuuuuaaauauauauuuuugaagaugacuuuuaaaauaauaagaaguuuaugauucaagug

SEQ ID NO: 758132 - RNA, 62 nt, Homo Sapiens
ucacaguaucaguggacuaauaaaccuugcauuaaaauaauaucuguaauaaaaaacuaaau

SEQ ID NO: 758133 - RNA, 62 nt, Homo Sapiens
uguguaaauugaaauuuuuuaauguacuauuuuaaaauaauacuaugucucauaaaaauuag

SEQ ID NO: 758134 - RNA, 62 nt, Homo Sapiens
ugccagaucucuaagauugcaugccuuauauauaaaauaaguauaacgucucuuggucacag

SEQ ID NO: 758135 - RNA, 62 nt, Homo Sapiens
uggcuucuaucccuaacccuacuuuguuggcauaaaauaaccaauaaggcuuuuuagagcag

SEQ ID NO: 758136 - RNA, 62 nt, Homo Sapiens
cacuguuucccuuuggaacugaaaguacuccuuaaaauaaaaagcccucauauaauagguuu

SEQ ID NO: 758137 - RNA, 62 nt, Homo Sapiens
auaaaauauaggcuuuaaaaaaaauuaaaaaauaaaauaaauagugagacccugucacuaac

SEQ ID NO: 758138 - RNA, 62 nt, Homo Sapiens
acagaaaaucauuggucucuaauaugagauauuaaaauaagcuaaaauaagaauugaauguc

SEQ ID NO: 758139 - RNA, 62 nt, Homo Sapiens
auugaaugucaauaugagauauguuuccuaauuaaaauaagaacaccauaguuuacaauauu

SEQ ID NO: 758140 - RNA, 62 nt, Homo Sapiens
gucuagucuucuuauaauagcagaggucuugguaaaauaacuaccauauauaacguguuauu

SEQ ID NO: 758141 - RNA, 62 nt, Homo Sapiens
cauauggaaaucuuuuaauaaauauauguaaauaaaauaaaaaauauuugucuccaccuuuu

SEQ ID NO: 758142 - RNA, 62 nt, Homo Sapiens
uggaagaggcugagguuguggaacacacugaauaaaauaaaggcagugugacuccaaauuca

SEQ ID NO: 758143 - RNA, 62 nt, Homo Sapiens
ugagccuuuaggugaucuuuaaacuaugguaguaaaauaagccucacucaaacauagcugac

SEQ ID NO: 758144 - RNA, 62 nt, Homo Sapiens
cuacaaugaacauguuuuauuuuuacuuuuguuaaaauaaauaacauuuaauuugacggaaa

SEQ ID NO: 758145 - RNA, 62 nt, Homo Sapiens
aaagaaacaagagagaaaaaaaucaaaauaauuaaaauaaauuguuagagaaaaguuacuuu

SEQ ID NO: 758146 - RNA, 62 nt, Homo Sapiens
uuaaauggaugcauacaguccacaucauacaauaaaauaaaagguaauucagggucccaaag

SEQ ID NO: 758147 - RNA, 62 nt, Homo Sapiens
agaauaacuauaaaauaugaaagcucuaaauuuaaaauaaauuuagagauagaaucauggua

SEQ ID NO: 758148 - RNA, 62 nt, Homo Sapiens
aggguuuguuuuguauacaaaugggauuauacuaaaauaaguaaugccuauuuuuaaggaua

SEQ ID NO: 758149 - RNA, 62 nt, Homo Sapiens
aauuugugaaugaucauuucaaauauauugaauaaaauaagcaaaagcuauuguuauuuacu

SEQ ID NO: 758150 - RNA, 62 nt, Homo Sapiens
agauaauuuguugggccauauuuuaggacagguaaaauaacaucagguuccaguugcuugaa

SEQ ID NO: 758151 - RNA, 62 nt, Homo Sapiens
caaggcccugaguuggcaguggcccauaaguguaaaauaaaaguuuacagaaaccuugcaag

SEQ ID NO: 758152 - RNA, 62 nt, Homo Sapiens
uuuagucaaucguucaucugucauugguacuguaaaauaagcuguggucuauuuccacuguu

SEQ ID NO: 758153 - RNA, 62 nt, Homo Sapiens
gaaaaugguuucugguaaacugagaaggauauuaaaauaaguggcuuuuuucugggcuacca

SEQ ID NO: 758154 - RNA, 62 nt, Homo Sapiens
auuuuuuuuguuuucugucuauagcaucauucuaaaauaagaaaauauuuuacaaguuacau

SEQ ID NO: 758155 - RNA, 62 nt, Homo Sapiens
auuaaacuucaaacucuuuaugucaauuuuuguaaaauaaaaaaucauguugguuuuaauag

SEQ ID NO: 758156 - RNA, 62 nt, Homo Sapiens
uauuucauuugcacacaaugaaacauuauuauuaaaauaaauacacauuaaccagaaagcuu

SEQ ID NO: 758157 - RNA, 62 nt, Homo Sapiens
acucuguguaauuuuuccauaauauucuuuacuaaaauaaaaaauguuuuuaaauauaaaca

SEQ ID NO: 758158 - RNA, 62 nt, Homo Sapiens
aaauaaauacacauuuuggccgaaguacaaaguaaaauaaauaauaauaacugacaugccac

SEQ ID NO: 758159 - RNA, 62 nt, Homo Sapiens
acugacaugccaccgaaguagcugagagacaguaaaauaauacaaccaacagugaaugugga

SEQ ID NO: 758160 - RNA, 62 nt, Homo Sapiens
auacccuuacgaauuuuuuguuuugaaaaaaguaaaauaacacuauaguuuauuuggauuau

SEQ ID NO: 758161 - RNA, 62 nt, Homo Sapiens
agacucuuccaaagccuuaaaaaauuauuauguaaaauaauaauuccauaaaaguaguuggg

SEQ ID NO: 758162 - RNA, 62 nt, Homo Sapiens
aagcuuaugucuuaaguugugcccuacaauuuuaaaauaacaagauauguaaguaaagacaa

SEQ ID NO: 758163 - RNA, 62 nt, Homo Sapiens
ugcuguucuuuugucuucuuauugaguuuggguaaaauaaguaaaagauuucaguagccuuc

SEQ ID NO: 758164 - RNA, 62 nt, Homo Sapiens
agauaauuauccaggcuuaagagcugguuuauuaaaauaagcagaaguagauuaaaacuaga

SEQ ID NO: 758165 - RNA, 62 nt, Homo Sapiens
uguuuuugacuaagugacuagguugguccaaauaaaauaaauuagucaaacaaaauuuacuu

SEQ ID NO: 758166 - RNA, 62 nt, Homo Sapiens
cuucacugcuccacuccaggucuugaaagagguaaaauaaacugguggaauauauggagaga

SEQ ID NO: 758167 - RNA, 62 nt, Homo Sapiens
aauauaaccuuuuaagcuauguuuuuauacuuuaaaauaagagguuuagccuuuaaguguau

SEQ ID NO: 758168 - RNA, 62 nt, Homo Sapiens
cauuucuaaugaggauucacauuaauauaauauaaaauaaauaggucaguuacuggucucuu

SEQ ID NO: 758169 - RNA, 62 nt, Homo Sapiens
uccgaauguuauguuuugcuuuuaucucacaguaaaauaaauauaauuaaugguuugcaugu

SEQ ID NO: 758170 - RNA, 62 nt, Homo Sapiens
gagauugcaccacugcacuccagcuugggugauaaaauaaaauaaaauagucgugaaucuug

SEQ ID NO: 758171 - RNA, 62 nt, Homo Sapiens
ugcaccacugcacuccagcuugggugauaaaauaaaauaaaauagucgugaaucuuguucaa

SEQ ID NO: 758172 - RNA, 62 nt, Homo Sapiens
uuguauauuuauuguauuaacacagagugucauaaaauaaaaugcuguuuacuggauguuug

SEQ ID NO: 758173 - RNA, 62 nt, Homo Sapiens
acuugguuagcuaaagaagauguaaaaauaucuaaaauaauguucauggugaaucuuauuuu

SEQ ID NO: 758174 - RNA, 62 nt, Homo Sapiens
uugaugucaauauuaguaguccacuuuaugcuuaaaauaaaaucauaaaaaaucaaguuuua

SEQ ID NO: 758175 - RNA, 62 nt, Homo Sapiens
cauaaaaaaucaaguuuuaagguuauauuuuuuaaaauaaugaauuuucuaucucuaggcaa

SEQ ID NO: 758176 - RNA, 62 nt, Homo Sapiens
guuacuucucaguuuccuagaacuucaaguauuaaaauaaccuguugcauguauuaggcaua

SEQ ID NO: 758177 - RNA, 62 nt, Homo Sapiens
uucuauuuucccuguauugguaucuccuuaaauaaaauaaaauauuccuauuguaagugaua

SEQ ID NO: 758178 - RNA, 62 nt, Homo Sapiens
gccugggcaauaagagcaaaacuccaucaaaauaaaauaaaauaaaauauaaaauaacuuaa

SEQ ID NO: 758179 - RNA, 62 nt, Homo Sapiens
ggcaauaagagcaaaacuccaucaaaauaaaauaaaauaaaauauaaaauaacuuaaaaaga

SEQ ID NO: 758180 - RNA, 62 nt, Homo Sapiens
aaaacuccaucaaaauaaaauaaaauaaaauauaaaauaacuuaaaaagaacuuugaauaaa

SEQ ID NO: 758181 - RNA, 62 nt, Homo Sapiens
gauccugcuaaauuucaauuaagaggggaccuuaaaauaaggaucaaucucuuauuuaaccc

SEQ ID NO: 758182 - RNA, 62 nt, Homo Sapiens
ugucuagauuauauagguuuagguugaaguuauaaaauaaaauaaaauucauuuuccacugg

SEQ ID NO: 758183 - RNA, 62 nt, Homo Sapiens
agauuauauagguuuagguugaaguuauaaaauaaaauaaaauucauuuuccacuggaacuc

SEQ ID NO: 758184 - RNA, 62 nt, Homo Sapiens
guuaauaauauaacauauaagaauacuuuuauuaaaauaaccaugcaacaauaacacuaucg

SEQ ID NO: 758185 - RNA, 62 nt, Homo Sapiens
guacguauguuuaucuuacucuuccuauaaacuaaaauaacauuacaguuuccgaauuuagc

SEQ ID NO: 758186 - RNA, 62 nt, Homo Sapiens
aaaaauuaaaugcauaagcauaagguagaaauuaaaauaacaaaauugucuacagcuucuua

SEQ ID NO: 758187 - RNA, 62 nt, Homo Sapiens
uacagaguaauuacauggugauuuuugcaauguaaaauaaaguguuucugauuauuuucuau

SEQ ID NO: 758188 - RNA, 62 nt, Homo Sapiens
ucacugaaauaaacuccauuucauaucuaauuuaaaauaauugcauaugggagcuuaauaua

SEQ ID NO: 758189 - RNA, 62 nt, Homo Sapiens
gauuucucacugagaggaacaaauuuugccauuaaaauaaaucagauuuuacugauauguaa

SEQ ID NO: 758190 - RNA, 62 nt, Homo Sapiens
ucauuuucaguaugugauauaauguaaauggauaaaauaaaagacaaguuuauaucaaguua

SEQ ID NO: 758191 - RNA, 62 nt, Homo Sapiens
guguaagcaaaauuuucuuuuauaaggaagaauaaaauaaacgacccauuuugauaagucuu

SEQ ID NO: 758192 - RNA, 62 nt, Homo Sapiens
auuuuucacucucuuuaaaauacacaaaagcauaaaauaauguuauuuaauucaucuaaugc

SEQ ID NO: 758193 - RNA, 62 nt, Homo Sapiens
uugagguuaaauaauggguaaugacgauuccauaaaauaaacauguuuguaaaagcucaaac

SEQ ID NO: 758194 - RNA, 62 nt, Homo Sapiens
uuuuaauauugaaccauuuuugggcuuuaaaauaaaauaauauaagaagcuuucugaaagau

SEQ ID NO: 758195 - RNA, 62 nt, Homo Sapiens
uaauauuuuaauauugaaccaagauugggcuuuaaaauaaaauauacuaagaagcuuucuga

SEQ ID NO: 758196 - RNA, 62 nt, Homo Sapiens
cugccucuccccucccccaguuucuccuccccuaaaauaaaaauaguggucaacuuuaguaa

SEQ ID NO: 758197 - RNA, 62 nt, Homo Sapiens
ucauuucacucuacugucucaaaauuuuguuuuaaaauaauagaaauguuuugccauuauua

SEQ ID NO: 758198 - RNA, 62 nt, Homo Sapiens
cuuuugcugucuuucucuaaauaugauuacuuuaaaauaaaaaaguaacaaggugucuuuuc

SEQ ID NO: 758199 - RNA, 62 nt, Homo Sapiens
ugccguauaggaugucagacaauaccacugguuaaaauaaagccuauuuuucaaauuuagug

SEQ ID NO: 758200 - RNA, 62 nt, Homo Sapiens
uuaauaguaugaucuuuaaaguuuugacaauauaaaauaaacuugguaacuguuuuacaaau

SEQ ID NO: 758201 - RNA, 62 nt, Homo Sapiens
uguuggucauaaguuaacuguauuaagaacaguaaaauaaauaaaaaccaauaguacuaauu
